United States Patent 11,332,783 (SAMPLE ANALYSIS, PRESENCE DETERMINATION OF A TARGET SEQUENCE) - sequence listing, part 11

SEQ ID NO: 210398 - DNA, 75 bp, Artificial Sequence
  Synthetic
gatgatcttacagtggaggatgaagaagatggccatcggatcctcaattcactcttcgagcgtcttaatgaagga

SEQ ID NO: 210399 - DNA, 75 bp, Artificial Sequence
  Synthetic
agctctggacctaccagaaatagggccagacgtagcaccagtggagcatgttggaagtgaaagaaggaaatactt

SEQ ID NO: 210400 - DNA, 75 bp, Artificial Sequence
  Synthetic
tgttaatgaaatcaactactgtaaggcctctacagttatgatgaagtatgtgctttttcacacctcattgctgaa

SEQ ID NO: 210401 - DNA, 75 bp, Artificial Sequence
  Synthetic
gtcacggaagaactttatcttttaagtaaaagaattgatgataacatattgttccacaaaacgataatagctaac

SEQ ID NO: 210402 - DNA, 75 bp, Artificial Sequence
  Synthetic
tgaaagcaatgccagcatgggaaaatacaaagtaataccaataaccaatagaatagtaaatgaaaaaggagaaag

SEQ ID NO: 210403 - DNA, 75 bp, Artificial Sequence
  Synthetic
gtatcattatcattattagaaacattgtatgaaatgaaggatgtggttgaagtgtacagcaggcagtgcttgtga

SEQ ID NO: 210404 - DNA, 75 bp, Artificial Sequence
  Synthetic
tttcttgtgaacttcaagtaccagtaaaagaactgaaaatcaaaatgtccaacatggatattgacggtatcaaca

SEQ ID NO: 210405 - DNA, 75 bp, Artificial Sequence
  Synthetic
aaaagaactgaaaatcaaaatgtccaacatggatattgacggtatcaacactgggacaattgacaaaacaccgga

SEQ ID NO: 210406 - DNA, 75 bp, Artificial Sequence
  Synthetic
tttcgacatgctttatggtctagcggttaaaggacaatctcatctgaggggagacactgatgtcgtaacagttgt

SEQ ID NO: 210407 - DNA, 75 bp, Artificial Sequence
  Synthetic
aactttcgaatttagtagtacagaccccagagtggactcaggaaagtggccaaaatatactgtgtttaggattgg

SEQ ID NO: 210408 - DNA, 75 bp, Artificial Sequence
  Synthetic
caaaatatactgtgtttaggattggctccctatttgtgagtggaagggaaaaatctgtgtacctatattgcagag

SEQ ID NO: 210409 - DNA, 75 bp, Artificial Sequence
  Synthetic
tgaatggcacaaataagatccaaatgaaatggggaatggaagctagaagatgtctgcttcaatcaatgcaacaaa

SEQ ID NO: 210410 - DNA, 75 bp, Artificial Sequence
  Synthetic
tgtctgcttcaatcaatgcaacaaatggaagcaattgttgaacaagaatcctcgatacaggggtacgacatgacc

SEQ ID NO: 210411 - DNA, 75 bp, Artificial Sequence
  Synthetic
aaagcttgtttcaagggggacagagtaaatagccccaaaactttcagtattggaactcaagaagggaaactagta

SEQ ID NO: 210412 - DNA, 75 bp, Artificial Sequence
  Synthetic
aaaggatcctttggaaaagcactaagagtaatatttactaaatgtttgatgcactatgtatttggaaatgcccag

SEQ ID NO: 210413 - DNA, 75 bp, Artificial Sequence
  Synthetic
ttggagggattcagtgccgagtctaggagacttctactgttgattcaagcattaaaggacagaaaaggcccttgg

SEQ ID NO: 210414 - DNA, 75 bp, Artificial Sequence
  Synthetic
gtgttcgacttagagggaatgtattctggaatagaagaatgtatcagtaacaacccttgggtaatacagagtgca

SEQ ID NO: 210415 - DNA, 75 bp, Artificial Sequence
  Synthetic
tactggttcaatgaatggttgggttttgaaaaggaggggagtaaagtattagagtcagtagatgaaataatggat

SEQ ID NO: 210416 - DNA, 75 bp, Artificial Sequence
  Synthetic
ggatgcacgactagattatgaatcaggaagaatgtcaaaggatgactttgagaaagcaatggctcaccttggtga

SEQ ID NO: 210417 - DNA, 75 bp, Artificial Sequence
  Synthetic
ttcaatgaatggttgggttttgaaaaggaggggagtaaagtattagagtcagtagatgaaataatggatgaataa

SEQ ID NO: 210418 - DNA, 75 bp, Artificial Sequence
  Synthetic
agctccgaagatgtctatggggttattggtcatcattggatacatgtgacaaacaaatgattaaaatgaaaaaaa

SEQ ID NO: 210419 - DNA, 75 bp, Artificial Sequence
  Synthetic
cttctcaaaaactgaggcaaataggccaaaaatgaacaatgctaccttcaactatacaaacgttaaccctatttc

SEQ ID NO: 210420 - DNA, 75 bp, Artificial Sequence
  Synthetic
ccctggtcaagaccgtctaaacagactaaagaggaaattagagtcaagaataaagactcacaacaaaagtgagcc

SEQ ID NO: 210421 - DNA, 75 bp, Artificial Sequence
  Synthetic
taaagactcacaacaaaagtgagcctgaaagtaaaagaatgtctcttgaagagagaaaagcaattggagtaaaaa

SEQ ID NO: 210422 - DNA, 75 bp, Artificial Sequence
  Synthetic
aaaatgtcgctgtttggagacacaattgcctacttgctttcattgacagaagatggagaaggcaaagcagaacta

SEQ ID NO: 210423 - DNA, 75 bp, Artificial Sequence
  Synthetic
caaagagcaactgtccgaaatacagttggattgattacccttcaaccccagggaggtgccttgatgacatagaag

SEQ ID NO: 210424 - DNA, 75 bp, Artificial Sequence
  Synthetic
cctaattagcccccatagattcggagaaatcaaaggaaactcagctcccttgataataagggaaccttttattgc

SEQ ID NO: 210425 - DNA, 75 bp, Artificial Sequence
  Synthetic
aactgaaatagtattaagggacatgaacaacaaagatgcaaggcaaaagataaaggaggaagtaaacactcagaa

SEQ ID NO: 210426 - DNA, 75 bp, Artificial Sequence
  Synthetic
taaaggaggaagtaaacactcagaaagaagggaagttccgtttgacaataaaaagggatatgcgtaatgtattgt

SEQ ID NO: 210427 - DNA, 75 bp, Artificial Sequence
  Synthetic
tttgctctaacccattatgcagctcaaccagggggatactacaatggaacaagagaagacagaaacaagctgagg

SEQ ID NO: 210428 - DNA, 75 bp, Artificial Sequence
  Synthetic
aaaagggatatgcgtaatgtattgtccctgagagtgttagtaaacggaacattcctcaaacaccccaatggatac

SEQ ID NO: 210429 - DNA, 75 bp, Artificial Sequence
  Synthetic
attcctcaaacaccccaatggatacaagtccttatcaactctgcatagattgaatgcatatgaccagagtggaag

SEQ ID NO: 210430 - DNA, 75 bp, Artificial Sequence
  Synthetic
aagtccttatcaactctgcatagattgaatgcatatgaccagagtggaaggcttgttgctaaacttgttgctact

SEQ ID NO: 210431 - DNA, 75 bp, Artificial Sequence
  Synthetic
cattcaaagccaattcgagcagctgaaactgcggtgggagtcttatcccaatttggtcaagagcaccgattatca

SEQ ID NO: 210432 - DNA, 75 bp, Artificial Sequence
  Synthetic
gtcacggaagaactttatcttttaagtaaaagaattgatgataacatattgttccacaaaacagtaatagctaac

SEQ ID NO: 210433 - DNA, 75 bp, Artificial Sequence
  Synthetic
agctccataatagctgacatggttgtatcattatcattattagaaacattgtatgaaatgaaggatgtggttgaa

SEQ ID NO: 210434 - DNA, 75 bp, Artificial Sequence
  Synthetic
tatcattattagaaacattgtatgaaatgaaggatgtggttgaagtgtacagcaggcagtgcttgtgaatttaaa

SEQ ID NO: 210435 - DNA, 75 bp, Artificial Sequence
  Synthetic
atgtccaacatggatattgacggtataaacactgggacaattgacaaaacaccggaagaaataacttctggaacc

SEQ ID NO: 210436 - DNA, 75 bp, Artificial Sequence
  Synthetic
accggaagaaataacttctggaaccagtgggacaaccagaccaatcattagaccagcaacccttgccccaccaag

SEQ ID NO: 210437 - DNA, 75 bp, Artificial Sequence
  Synthetic
gaccagcaacccttgccccaccaagcaacaaacgaacccgtaacccatccccggaaagagcaaccacaagcagtg

SEQ ID NO: 210438 - DNA, 75 bp, Artificial Sequence
  Synthetic
aagatgatgtcggaaggaaaacccaaaagaaacagaccccgacagagataaagaagagcgtctacaacatggtgg

SEQ ID NO: 210439 - DNA, 75 bp, Artificial Sequence
  Synthetic
aagaagagcgtctacaacatggtggtgaaactgggcgaattctataaccagatgatggtcaaagctggactcaat

SEQ ID NO: 210440 - DNA, 75 bp, Artificial Sequence
  Synthetic
gatgatggtcaaagctggactcaatgatgacatggagagaaacctaatccaaaatgcgtatgccgtggaaagaat

SEQ ID NO: 210441 - DNA, 75 bp, Artificial Sequence
  Synthetic
tctattggctgccactgatgacaagaaaaccgagttccagaagaaaaagaatgccagagatgtcaaagaagggaa

SEQ ID NO: 210442 - DNA, 75 bp, Artificial Sequence
  Synthetic
aaaaccgagttccagaagaaaaagaatgccagagatgtcaaagaagggaaagaagaaatagatcacaacaaaaca

SEQ ID NO: 210443 - DNA, 75 bp, Artificial Sequence
  Synthetic
ttgtttaatgggctcaggacaattgctgtgggacactgtcacaggtgttgatatggctctgtaatggaggaatgg

SEQ ID NO: 210444 - DNA, 75 bp, Artificial Sequence
  Synthetic
ccctataagaattacctttttaaaagaagaggtgaaaacaatgtacaaaaccaccatggggagtgatggcttcag

SEQ ID NO: 210445 - DNA, 75 bp, Artificial Sequence
  Synthetic
aggaacaatgctacgctaaatgttgcaacctatttgaggcctgttttaacagtgcgtcgtacaggaagccagtag

SEQ ID NO: 210446 - DNA, 75 bp, Artificial Sequence
  Synthetic
aacctcaggatcttgccctaacgctaccagtaaaagcggatttttcgcaacaatggcttgggctgtcccaaagga

SEQ ID NO: 210447 - DNA, 75 bp, Artificial Sequence
  Synthetic
gattgcaggttggcacggatacacatctcacggagcacatggagtggcagttgctgcagaccttaagagcacaca

SEQ ID NO: 210448 - DNA, 75 bp, Artificial Sequence
  Synthetic
agcacctttgcgggaagcacagtccccagaagatcaggtgcgactggtgttgcaatcaaaggaggcggaacttta

SEQ ID NO: 210449 - DNA, 75 bp, Artificial Sequence
  Synthetic
gtggctgaagccattcgatttataggaagagcaatggcagacagagggctattgagagacatcaaagccaagact

SEQ ID NO: 210450 - DNA, 75 bp, Artificial Sequence
  Synthetic
gcctatgaaaagattcttctgaatctaaaaaacaaatgctctgcgccccaacaaaaggctctagttgatcaagtg

SEQ ID NO: 210451 - DNA, 75 bp, Artificial Sequence
  Synthetic
acagtgaagatgagcatctattggcacttgagagaaaactaaagaaaatgctgggtccctctgctgtagacatag

SEQ ID NO: 210452 - DNA, 75 bp, Artificial Sequence
  Synthetic
cagacattgaagatctaaccctgcttgctcgtagtatggtcgttgttaggccctctgtggcaagcaaagtggtgc

SEQ ID NO: 210453 - DNA, 75 bp, Artificial Sequence
  Synthetic
ttcccataagcatttacgccaaaatacctcaactagggttcaatgttgaagagtactctatggttgggtacgaag

SEQ ID NO: 210454 - DNA, 75 bp, Artificial Sequence
  Synthetic
acagtagatcaatataacataataagaaaattcaatacatcaagaattgaaaagaacccttcattaaggatgaag

SEQ ID NO: 210455 - DNA, 75 bp, Artificial Sequence
  Synthetic
gatgatgcaaaagataaatcgcaattattcttcatgtcttgcttcggagctgcctatgaagacctgagagttttg

SEQ ID NO: 210456 - DNA, 75 bp, Artificial Sequence
  Synthetic
tattcttcatgtcttgcttcggagctgcctatgaagacctgagagttttgtctgcattaacaggcacagaattca

SEQ ID NO: 210457 - DNA, 75 bp, Artificial Sequence
  Synthetic
tctgcattaacaggcacagaattcaagcctagatcagcattaaaatgcaagggtttccatgttccagcaaaggaa

SEQ ID NO: 210458 - DNA, 75 bp, Artificial Sequence
  Synthetic
caggtagaaggaatgggagcagctctgatgtccatcaagctccagttttgggctccgatgaccagatctgggggg

SEQ ID NO: 210459 - DNA, 75 bp, Artificial Sequence
  Synthetic
gcacagctaatgataacatatgatacaccaaagatgtgggagatggggacaaccaaagaactggtgcagaacacc

SEQ ID NO: 210460 - DNA, 75 bp, Artificial Sequence
  Synthetic
atgtcgctgtttggagacacaattgcctacctgctttcattgacagaagatggagaaggcaaagcagaactagca

SEQ ID NO: 210461 - DNA, 75 bp, Artificial Sequence
  Synthetic
aacgaagcaggtggagacggagggtctggccaaataagctgcagtccagtgtttgcagtggaaagacctattgct

SEQ ID NO: 210462 - DNA, 75 bp, Artificial Sequence
  Synthetic
tgatgcagatgtcaaaggaaatctactcaagatgatgaatgactcaatggctaagaaaaccagtggaaatgcttt

SEQ ID NO: 210463 - DNA, 75 bp, Artificial Sequence
  Synthetic
cattgggaagaaaatgtttcaaatatcagacaaaaacaaaaccaatcccattgaaattccaattaagcagaccat

SEQ ID NO: 210464 - DNA, 75 bp, Artificial Sequence
  Synthetic
cctacctgctttcattgacagaagatggagaaggcaaagcagaactagcggaaaaattacactgttggttcggtg

SEQ ID NO: 210465 - DNA, 75 bp, Artificial Sequence
  Synthetic
acatcagctgagttcatagaaatgctacactgcttacaaggtgaaaattggagacaaatatatcacccgggaggg

SEQ ID NO: 210466 - DNA, 75 bp, Artificial Sequence
  Synthetic
ggaaagaatttgacctagactctgccttggaatggataaaaaacaaaagatgcttaacagatatacagaaagcac

SEQ ID NO: 210467 - DNA, 75 bp, Artificial Sequence
  Synthetic
atggatacttttattacaaagaatttccagactacaataatacaaaaggccaaaaacacaatggcagaatttagt

SEQ ID NO: 210468 - DNA, 75 bp, Artificial Sequence
  Synthetic
gaagatcctgaattacagccagcagtactattcaacatctgcgtccatctggaggtctgctatgtaataagtgat

SEQ ID NO: 210469 - DNA, 75 bp, Artificial Sequence
  Synthetic
atgaactttcttgatgaggaaggaaagacatatacagcattagaaggacaaggaaaagagcaaaatttgagacca

SEQ ID NO: 210470 - DNA, 75 bp, Artificial Sequence
  Synthetic
cagtatgaagtgattgagggaatgccaagaaacatagcatggatggttcaaagatccttagcccaagagcatgga

SEQ ID NO: 210471 - DNA, 75 bp, Artificial Sequence
  Synthetic
tgcgaaaaacaagcatcacattcacacagagctcatagcagagcagcgagatcttcagtgcccggagtgagacgg

SEQ ID NO: 210472 - DNA, 75 bp, Artificial Sequence
  Synthetic
ccaaaaagaaattcaggctaaagaagcaatgaaggaagtactctctgacaacatggaggtattgagtgaccacat

SEQ ID NO: 210473 - DNA, 75 bp, Artificial Sequence
  Synthetic
atagagactccaaggtatctggctgatttatttgattataaaaccaagaggtttatcgaagtcggaataacaaag

SEQ ID NO: 210474 - DNA, 75 bp, Artificial Sequence
  Synthetic
agtaattgaggggctttctgcagaagagataataaaaatgggtgaaacagttttggaggtagaaaaatcgcatta

SEQ ID NO: 210475 - DNA, 75 bp, Artificial Sequence
  Synthetic
ctggcagaagaactgcaaagcaacattggagtattgagatcccttggggcaagtcagaagaatggggaaggaatt

SEQ ID NO: 210476 - DNA, 75 bp, Artificial Sequence
  Synthetic
ggattggctgatgattacttttggaaaaagaaagaaaagttggggaatagcatggaactgatgatattcagctac

SEQ ID NO: 210477 - DNA, 75 bp, Artificial Sequence
  Synthetic
aatcaagactactcgttaagtgatgaatcttcattggatgaggaaggaaaagggagagtgctaagcagactcaca

SEQ ID NO: 210478 - DNA, 75 bp, Artificial Sequence
  Synthetic
gcaaaggatgtaatggaagtgctaaagcagagctctatgggaaattcagctcttgtgaagaaatacctataatgt

SEQ ID NO: 210479 - DNA, 75 bp, Artificial Sequence
  Synthetic
gtaattgaggggctttctgcagaagagataataaaaatgggtgaaacagttttggaggtagaaaaatcgcattaa

SEQ ID NO: 210480 - DNA, 75 bp, Artificial Sequence
  Synthetic
gaacttcaggctgagttaagtttgaaaaacctatggcaagttctaataggggaagaagaaattgaaaaaggaatt

SEQ ID NO: 210481 - DNA, 75 bp, Artificial Sequence
  Synthetic
ttgaaccattccagattctttcaatttgttcttttattttatcagctctccatttcatggcttggacaataggac

SEQ ID NO: 210482 - DNA, 75 bp, Artificial Sequence
  Synthetic
gacttcaaacttggacaaacaatatctaaactgaggaatatatctgttccagctggtttctccaattttgaaggg

SEQ ID NO: 210483 - DNA, 75 bp, Artificial Sequence
  Synthetic
atttaaatcaaataaaaagaggagtaaacatgaaaataagaataaaggggccaaataaagagacaataaacagag

SEQ ID NO: 210484 - DNA, 75 bp, Artificial Sequence
  Synthetic
atgagaagttacatagacaacatagaccctaaaggagcaatagagagaaatctagcaaggatgtctcccttagta

SEQ ID NO: 210485 - DNA, 75 bp, Artificial Sequence
  Synthetic
tcagttacacccaaaaagttgaaatgggaggacctgagacccatagggcctcacatttacaaccatgagctacca

SEQ ID NO: 210486 - DNA, 75 bp, Artificial Sequence
  Synthetic
agtaattgaggggctttctgctgaagagataataaaaatgggtgaaacagttttggaggtagaagaattgcatta

SEQ ID NO: 210487 - DNA, 75 bp, Artificial Sequence
  Synthetic
gaagttccatataatgcctttctcctcatgtctgatgagttggggctggccaatatgactgaaggaaagtccaag

SEQ ID NO: 210488 - DNA, 75 bp, Artificial Sequence
  Synthetic
gaattgcattaaattcaattttactgtacttcttactatgcatttaagcaaattgtaaccaatgtcagcaaataa

SEQ ID NO: 210489 - DNA, 75 bp, Artificial Sequence
  Synthetic
atgaaggcaataattgtactactcatggtagtaacatccaatgcagatcgaatctgcactgggataacatcttca

SEQ ID NO: 210490 - DNA, 75 bp, Artificial Sequence
  Synthetic
aaaccgaagaccttagctaaggaatgtctagaaaggtattcaacactacgtgatcaaactgacccaatattgata

SEQ ID NO: 210491 - DNA, 75 bp, Artificial Sequence
  Synthetic
tggtagtaacatccaatgcagatcgaatctgcactgggataacatcttcaaactcacctcatgtggtcaaaacag

SEQ ID NO: 210492 - DNA, 75 bp, Artificial Sequence
  Synthetic
atgaaaagcgaaaaagctaacgaaaacttcttatggaggttatggagggactgtgtaaatacaataagcaatgag

SEQ ID NO: 210493 - DNA, 75 bp, Artificial Sequence
  Synthetic
ccaacaaaatcttattttgcaaatctcaaaggaacaaggaccagagggaaactatgcccggactgtctcaactgt

SEQ ID NO: 210494 - DNA, 75 bp, Artificial Sequence
  Synthetic
gaaacaggcaacgaattacagaaaaccaattatgccaagtgggccacaggagatggactaacataccaaaaaata

SEQ ID NO: 210495 - DNA, 75 bp, Artificial Sequence
  Synthetic
atcttatgcatggtattttctcaagacactaggatgttccaaggagtgagaggagaaataaattttcttaatcga

SEQ ID NO: 210496 - DNA, 75 bp, Artificial Sequence
  Synthetic
acagatctggatgtggccttgggcaggccaatgtgtgtggggaccacaccttctgctaaagcttcaatactccac

SEQ ID NO: 210497 - DNA, 75 bp, Artificial Sequence
  Synthetic
atgaaagaagtagcaatagatgacgaaacgatgtaccaagaagaacccaaaatacccaataaatgtagagtggct

SEQ ID NO: 210498 - DNA, 75 bp, Artificial Sequence
  Synthetic
gaggtcagacctgttacatccggatgctttcctataatgcacgacagaacaaaaatcaggcaactacccaatctt

SEQ ID NO: 210499 - DNA, 75 bp, Artificial Sequence
  Synthetic
gcttgggttcaggcagagatgaatctactgagtactctgacaagtaaaagggccctggatctgccagaaataggg

SEQ ID NO: 210500 - DNA, 75 bp, Artificial Sequence
  Synthetic
tactgagtactctgacaagtaaaagggccctggatctgccagaaatagggccagatgtagcacccgtggagcatg

SEQ ID NO: 210501 - DNA, 75 bp, Artificial Sequence
  Synthetic
tatcaacccaaaacgttatcgatgcagaaaaagcaccaggaggaccctacagacttggaacctcaggatcttgcc

SEQ ID NO: 210502 - DNA, 75 bp, Artificial Sequence
  Synthetic
tactttttcacacttcattattaaatgaaagcaatgctagtatgggaaaatataaagtaataccaatcaccaaca

SEQ ID NO: 210503 - DNA, 75 bp, Artificial Sequence
  Synthetic
ctaacgctaccagtaaaatcggatttttcgcaacaatggcttgggctgtcccaaaggacaactacaaaaatgcaa

SEQ ID NO: 210504 - DNA, 75 bp, Artificial Sequence
  Synthetic
gagtggtaaatgaaaaaggggaaagctttgacatgctttatggtctggcggttaaggggcaatctcatttgcggg

SEQ ID NO: 210505 - DNA, 75 bp, Artificial Sequence
  Synthetic
cgaacccactaacagtggaagtaccatacatttgtacagaaggggaagaccaaattactgtttgggggttccatt

SEQ ID NO: 210506 - DNA, 75 bp, Artificial Sequence
  Synthetic
atacatttgtacagaaggggaagaccaaattactgtttgggggttccattcagataacaaaacccaaatgaagag

SEQ ID NO: 210507 - DNA, 75 bp, Artificial Sequence
  Synthetic
gggacacggatgttgtaacagttgtgactttcgagtttagtagtacagatcctagagtggactcaggaaagtggc

SEQ ID NO: 210508 - DNA, 75 bp, Artificial Sequence
  Synthetic
cctctatggagactcaaatcctcaaaagttcacctcatctgctaatggagtaaccacacattatgtttctcagat

SEQ ID NO: 210509 - DNA, 75 bp, Artificial Sequence
  Synthetic
caaaatatactgtctttaaaattggctccctatttgtgagtggaagagaaaaacctgtgtacctatattgccgag

SEQ ID NO: 210510 - DNA, 75 bp, Artificial Sequence
  Synthetic
gacggaggactaccacaaagcggcagaattgttgttgattacatgatgcaaaaacctgggaaaacaggaacaatt

SEQ ID NO: 210511 - DNA, 75 bp, Artificial Sequence
  Synthetic
tgaatggtacaaacaaaatccaaatgaaatggggaatggaagctagaagatgtctgcttcaatcaatgcaacaaa

SEQ ID NO: 210512 - DNA, 75 bp, Artificial Sequence
  Synthetic
aaaacctgggaaaacaggaacaattgtctatcaaagaggtgttttgttgcctcaaaaggtgtggtgcgcgagtgg

SEQ ID NO: 210513 - DNA, 75 bp, Artificial Sequence
  Synthetic
tggaggcaattgttgatcaagaatcatcgatacaagggtatgatatgaccaaagcttgtttcaagggagacagag

SEQ ID NO: 210514 - DNA, 75 bp, Artificial Sequence
  Synthetic
gtgtttaggattggctccctatttgtgagtgggagggaaaaatctgtgtacttgtattgccgagtgaatggcaca

SEQ ID NO: 210515 - DNA, 75 bp, Artificial Sequence
  Synthetic
gtctatcaaagaggtgttttgttgcctcaaaaggtgtggtgcgcgagtggcaagagcaaagtaataaaagggtca

SEQ ID NO: 210516 - DNA, 75 bp, Artificial Sequence
  Synthetic
ttgcccttaattggtgaagcagattgccttcatgaagaatacggtggattaaacaaaagcaagccttactacaca

SEQ ID NO: 210517 - DNA, 75 bp, Artificial Sequence
  Synthetic
tgaataatcccaaaactttcagtattgggactcaggaaggcaaactagtaaaagggtcctttgggaaagcactaa

SEQ ID NO: 210518 - DNA, 75 bp, Artificial Sequence
  Synthetic
tgaatggttgggctttgaaagggaggggagtaaagtgttggaatcagtggatgagataatggatgaataaaagga

SEQ ID NO: 210519 - DNA, 75 bp, Artificial Sequence
  Synthetic
gagtaatattcaccaaatgtttgatgcattatgtatttggaaatgctcaattggaggggtttagtgccgaatcta

SEQ ID NO: 210520 - DNA, 75 bp, Artificial Sequence
  Synthetic
gccttcatgaagaatacggtggattaaacaaaagcaagccttactacacaggaaaacatgcaaaagccataggaa

SEQ ID NO: 210521 - DNA, 75 bp, Artificial Sequence
  Synthetic
ggagacttctactgttaattcaggcattaaaagacaggaagggcccttgggtatttgacttggagggaatgtact

SEQ ID NO: 210522 - DNA, 75 bp, Artificial Sequence
  Synthetic
tgctggtttcctagaaggaggatgggaaggaatgattgcaggttggcacggatacacatctcacggagcacatgg

SEQ ID NO: 210523 - DNA, 75 bp, Artificial Sequence
  Synthetic
ttggagtagaggaatgtattagtaacaatccttgggtaatacagagtgcatactggtttaatgaatggttgggca

SEQ ID NO: 210524 - DNA, 75 bp, Artificial Sequence
  Synthetic
gatgaatataaatccttattttctcttcatagatgtgcccgtacaggcagcaatttcaacaacattcccatacac

SEQ ID NO: 210525 - DNA, 75 bp, Artificial Sequence
  Synthetic
agtggcagtggcggcagaccttaagagtacacaggaagccataaataagataacaaaaaatctcaattctttgag

SEQ ID NO: 210526 - DNA, 75 bp, Artificial Sequence
  Synthetic
ttgaaaaagaaggaagtaaagtgttagaatcaatagatgaaataatggatgaatgaacgaagggcatagcgctca

SEQ ID NO: 210527 - DNA, 75 bp, Artificial Sequence
  Synthetic
taacaaaaaatctcaattctttgagtgagctagaagtaaagaaccttcaaagactaagtggtgccatggatgaac

SEQ ID NO: 210528 - DNA, 75 bp, Artificial Sequence
  Synthetic
agcagaagcgttgcattttctaatatccacaaaatgaaggcaataattgtactactcatggtagtaacatccaat

SEQ ID NO: 210529 - DNA, 75 bp, Artificial Sequence
  Synthetic
aaaagaaggaagtaaagtgttagaatcaatagatgaaataatggatgaatgaacgaagggcatagcgctcaattt

SEQ ID NO: 210530 - DNA, 75 bp, Artificial Sequence
  Synthetic
actactcatggtagtaacatccaatgcagatcgaatctgcactgggataacatcgtcaaactcacctcatgtggt

SEQ ID NO: 210531 - DNA, 75 bp, Artificial Sequence
  Synthetic
tgagaaagtggatgatctcagagctgacactataagctcacaaatagaacttgcagtcttgctttccaacgaagg

SEQ ID NO: 210532 - DNA, 75 bp, Artificial Sequence
  Synthetic
taaaactgccactcaaggggaagtcaatgtgactggtgtgataccactaacaacaacacctaccaaatctcattt

SEQ ID NO: 210533 - DNA, 75 bp, Artificial Sequence
  Synthetic
tgcaaatctcaaaggaacacagaccagaggaaaactatgcccaaactgttttaactgcacagatctggacgtggc

SEQ ID NO: 210534 - DNA, 75 bp, Artificial Sequence
  Synthetic
accaaacacaaatgcaaccagacctgcttagacaggatagctgctggcacctttaatgcaggagaattttccctc

SEQ ID NO: 210535 - DNA, 75 bp, Artificial Sequence
  Synthetic
cctaggcagaccaaaatgcatggggaacacaccctccgcaaaagtctcaatactccatgaagtcaaacctgctac

SEQ ID NO: 210536 - DNA, 75 bp, Artificial Sequence
  Synthetic
cccacttttgattcattgaacattactgctgcatctttaaatgatgatggattggataaccatactatactgctc

SEQ ID NO: 210537 - DNA, 75 bp, Artificial Sequence
  Synthetic
atctggatgctttcctataatgcacgacagaacaaaaatcagacaactacctaatcttctcagaggatatgaaaa

SEQ ID NO: 210538 - DNA, 75 bp, Artificial Sequence
  Synthetic
tattactcaactgctgcttctagtttggctgtaacattaatgctagctatttttattgtttatatggtctccaga

SEQ ID NO: 210539 - DNA, 75 bp, Artificial Sequence
  Synthetic
catcaggttatcaaccagtaatgttatcaatacagagacggcaccaggaggaccctacaaggtggggacctcagg

SEQ ID NO: 210540 - DNA, 75 bp, Artificial Sequence
  Synthetic
gtaacattaatgctagctatttttattgtttatatggtctccagagacaacgtttcatgctccatctgtctataa

SEQ ID NO: 210541 - DNA, 75 bp, Artificial Sequence
  Synthetic
atgaacaatgctaccctcaactatacaaacgttaaccctatttctcacatcagggggagtattattatcactata

SEQ ID NO: 210542 - DNA, 75 bp, Artificial Sequence
  Synthetic
atcttgccctaacgttgctaatgggaacggcttcttcaacacaatggcttgggttatcccaaaagacaacaacaa

SEQ ID NO: 210543 - DNA, 75 bp, Artificial Sequence
  Synthetic
caaacgttaaccctatttctcacatcagggggagtattattatcactatatgtgtcagcttcattgtcatactta

SEQ ID NO: 210544 - DNA, 75 bp, Artificial Sequence
  Synthetic
ctatatttggatatattgctaaaattcccatcaacagaaattactgcaccaacaatgccattagattgtgcaaac

SEQ ID NO: 210545 - DNA, 75 bp, Artificial Sequence
  Synthetic
gacagcaataaatccagtaacagtagaagtaccatacatttgttcagaaggggaagaccaaattactgtttgggg

SEQ ID NO: 210546 - DNA, 75 bp, Artificial Sequence
  Synthetic
aacaatgccattagattgtgcaaacgcatcaaatgttcaggctgtgaaccgttctgcaacaaaaggggtgacact

SEQ ID NO: 210547 - DNA, 75 bp, Artificial Sequence
  Synthetic
gttccactctgatgacaaaacccaaatggaaagactctatggagactcaaatcctcaaaagttcacctcatctgc

SEQ ID NO: 210548 - DNA, 75 bp, Artificial Sequence
  Synthetic
caatggagtaaccacacattatgtttctcagattggtggcttcccaaatcaaacagaagacgaagggctaaaaca

SEQ ID NO: 210549 - DNA, 75 bp, Artificial Sequence
  Synthetic
tagccctcatagattcggagaaaccaaaggaaactcagctcccttgataataagggaaccttttattgcttgtgg

SEQ ID NO: 210550 - DNA, 75 bp, Artificial Sequence
  Synthetic
aaaggaaactcagctcccttgataataagggaaccttttattgcttgtggaccaaaggaatgcaaacactttgct

SEQ ID NO: 210551 - DNA, 75 bp, Artificial Sequence
  Synthetic
aagcggcagaattgttgttgattacatggtacaaaaacctggaaaaacaggaacaattgtttatcaaagaggcat

SEQ ID NO: 210552 - DNA, 75 bp, Artificial Sequence
  Synthetic
tttattgcctcaaaaagtgtggtgcgcaagtggcaggagcaaggtaataaaagggtccttgcctttaattggtga

SEQ ID NO: 210553 - DNA, 75 bp, Artificial Sequence
  Synthetic
agacagaaacaagctgaggcatctaatttcagtcaaattgggcaaaatcccaacagtagaaaactccattttcca

SEQ ID NO: 210554 - DNA, 75 bp, Artificial Sequence
  Synthetic
agcagattgcctccacgaaaagtacggtggattaaataaaagcaagccttactacacaggagagcatgcaaaggc

SEQ ID NO: 210555 - DNA, 75 bp, Artificial Sequence
  Synthetic
atttcagtcaaattgggcaaaatcccaacagtagaaaactccattttccacatggcagcatggagcgggtccgca

SEQ ID NO: 210556 - DNA, 75 bp, Artificial Sequence
  Synthetic
tgtcatgatggtaaggaatggacatatatcggagttgatggccctgacaataatgcattgctcaaaataaaatat

SEQ ID NO: 210557 - DNA, 75 bp, Artificial Sequence
  Synthetic
ggggaagcatatactgacacataccattcctatgcaaacaacatcctaagaacacaagaaagtgcctgcaattgc

SEQ ID NO: 210558 - DNA, 75 bp, Artificial Sequence
  Synthetic
attcctatgcaaacaacatcctaagaacacaagaaagtgcctgcaattgcatcggaggaaattgttatcttatga

SEQ ID NO: 210559 - DNA, 75 bp, Artificial Sequence
  Synthetic
actattaaaggaaagaggtttcttcggagctattgctggtttcttggaaggaggatgggaaggaatgattgcagg

SEQ ID NO: 210560 - DNA, 75 bp, Artificial Sequence
  Synthetic
ttggcacggatacacatctcatggagcacatggagtggcagtggcagcagaccttaagagtacacaagaagctat

SEQ ID NO: 210561 - DNA, 75 bp, Artificial Sequence
  Synthetic
aaacaagataacaaaaaatctcaactatttaagtgagctagaagtaaaaaaccttcaaagactaagcggagcaat

SEQ ID NO: 210562 - DNA, 75 bp, Artificial Sequence
  Synthetic
tatttccaacaggaagaacacaacatactgaagaatgcacatgcggatttgctagcaataaaaccatagaatgtg

SEQ ID NO: 210563 - DNA, 75 bp, Artificial Sequence
  Synthetic
gaatgagcttcacgacgaaatactcgagctagacgaaaaagtggatgatctaagagctgatacaataagctcaca

SEQ ID NO: 210564 - DNA, 75 bp, Artificial Sequence
  Synthetic
cctgtagagataacagttacacagcaaaaagaccctttgtcaaattaaacgtggagactgatacagcagaaataa

SEQ ID NO: 210565 - DNA, 75 bp, Artificial Sequence
  Synthetic
aatagagcttgcagtcttgctttccaacgaagggataataaacagtgaagatgagcatctcttggcacttgaaag

SEQ ID NO: 210566 - DNA, 75 bp, Artificial Sequence
  Synthetic
gattgatgtgcacaaagacttatttggacacccccagaccagatgatggaagcataacagggccttgtgaatcta

SEQ ID NO: 210567 - DNA, 75 bp, Artificial Sequence
  Synthetic
aaaactgaagaaaatgcttggcccctctgctgtagaaatagggaatgggtgctttgaaaccaaacacaaatgcaa

SEQ ID NO: 210568 - DNA, 75 bp, Artificial Sequence
  Synthetic
atggaggcaaagggagtggaggcatcaagggaggatttgtccatcaaagaatggcatccaagattgcaaggtggt

SEQ ID NO: 210569 - DNA, 75 bp, Artificial Sequence
  Synthetic
caagggaggatttgtccatcaaagaatggcatccaagattgcaaggtggtactctcgaacgatgtctaaaactga

SEQ ID NO: 210570 - DNA, 75 bp, Artificial Sequence
  Synthetic
ccagacttgcctagacaggatagctgctggcacctttaatgcaggagatttttctcttcccacttttgattcatt

SEQ ID NO: 210571 - DNA, 75 bp, Artificial Sequence
  Synthetic
aaggaaggggatggggctgtatgtcaagtataatggagacccatgggctgacagtgatgcccttgcttttagtgg

SEQ ID NO: 210572 - DNA, 75 bp, Artificial Sequence
  Synthetic
aaacattactgctgcatctttaaatgatgatggcttggataatcatactatactgctctactactcaactgctgc

SEQ ID NO: 210573 - DNA, 75 bp, Artificial Sequence
  Synthetic
agtaatggtttcaatggaagaacctggttggtactcctttggctttgaaataaaagacaagaaatgtgatgtccc

SEQ ID NO: 210574 - DNA, 75 bp, Artificial Sequence
  Synthetic
ttctagcttggctgtaacattaatgatagctatcttcattgtctacatggtctccagagacaatgtttcttgttc

SEQ ID NO: 210575 - DNA, 75 bp, Artificial Sequence
  Synthetic
catctgtctgtgagggagattaagccctgtgttttcctttactgtagtgctcatttgcttgtcaccattacaaag

SEQ ID NO: 210576 - DNA, 75 bp, Artificial Sequence
  Synthetic
acagccatttactgtttaatgggctcaggacagctgctgtgggacactgtcacaggtgttaatatgactctgtaa

SEQ ID NO: 210577 - DNA, 75 bp, Artificial Sequence
  Synthetic
atgaatataaatccttattttctattcatagatgtacccatacaggcagcaatttcaacaacattcccatacacc

SEQ ID NO: 210578 - DNA, 75 bp, Artificial Sequence
  Synthetic
atgacgttggctaaaattgaactactaaagcagctgttaagggacaatgaagccaaaacggtgttgagacagaca

SEQ ID NO: 210579 - DNA, 75 bp, Artificial Sequence
  Synthetic
aatttcaacaacattcccatacaccggtgttcccccttattcccatggaacgggaacaggctacacaatagacac

SEQ ID NO: 210580 - DNA, 75 bp, Artificial Sequence
  Synthetic
acggtagaccaatacaacataataagaaaattcaatacatcaagaattgaaaagaacccttcattaagaatgaag

SEQ ID NO: 210581 - DNA, 75 bp, Artificial Sequence
  Synthetic
cgggaacaggctacacaatagacaccgtgatcagaacacatgagtattcgaacaaaggaaaacagtatgtttctg

SEQ ID NO: 210582 - DNA, 75 bp, Artificial Sequence
  Synthetic
tttcctttactgtagtgctcatttgcttgtcaccattacaaagaaacgttattgaaaaatgctcttgttactact

SEQ ID NO: 210583 - DNA, 75 bp, Artificial Sequence
  Synthetic
aacaaaggaaaacagtatgtttctgacatcacaggatgtacaatgatagatccaacaaatgggccattacctgaa

SEQ ID NO: 210584 - DNA, 75 bp, Artificial Sequence
  Synthetic
tgggccatgtgttccaattttcccttagctctgaccaagggtgatatggcaaatcgaatccccttggaatacaag

SEQ ID NO: 210585 - DNA, 75 bp, Artificial Sequence
  Synthetic
gacaatgagccaagtgcctatgcacaattagattgcgttctggaggctttggatagaatggatgaggaacatcca

SEQ ID NO: 210586 - DNA, 75 bp, Artificial Sequence
  Synthetic
ggaatacaacttaaaacaaatgctgaagacataggaactaaaggacaaatgtgttcaatagcagcagttacctgg

SEQ ID NO: 210587 - DNA, 75 bp, Artificial Sequence
  Synthetic
tggaatacatatgggcccataggggatactgaagggtttgaaaaggtctacgaaagcttttttctcagaaagatg

SEQ ID NO: 210588 - DNA, 75 bp, Artificial Sequence
  Synthetic
catataagcttcgaagatgtttatggggttattggtcatcattgaatacatgcgatacacaaatgattaaaatga

SEQ ID NO: 210589 - DNA, 75 bp, Artificial Sequence
  Synthetic
agacaaactttcgattggacagtatgcagaaaccagcctgctgcaacggcactaaacacaacaataacctccttc

SEQ ID NO: 210590 - DNA, 75 bp, Artificial Sequence
  Synthetic
agacttgacaatgccacttggggccgaataacctttggccctgttgagagagtaagaaaaagagtactactaaac

SEQ ID NO: 210591 - DNA, 75 bp, Artificial Sequence
  Synthetic
actaaacacaacaataacctccttcagattgaatgatttgaatggagctgataagggtggattggtacccttttg

SEQ ID NO: 210592 - DNA, 75 bp, Artificial Sequence
  Synthetic
ccgctcaccaaggaaatgcccccagatgaagcgagcaatgtaataatggaaatattattccctaaagaagcagga

SEQ ID NO: 210593 - DNA, 75 bp, Artificial Sequence
  Synthetic
ataagggtggattggtacccttttgccaagatatcattgattcattagacaagcctgaaatgaccttcttctcag

SEQ ID NO: 210594 - DNA, 75 bp, Artificial Sequence
  Synthetic
taaagaatataaagaaaaaattgcctgcaaaaaacagaaagggtttcctcataaagagaataccaatgaaagtaa

SEQ ID NO: 210595 - DNA, 75 bp, Artificial Sequence
  Synthetic
ctgctgaagagataataaaaatgggtgaaacagttttggagatagaagaattgcattaaattcaattttactgta

SEQ ID NO: 210596 - DNA, 75 bp, Artificial Sequence
  Synthetic
tgcaaaaaacagaaagggtttcctcataaagagaataccaatgaaagtaaaagacaggatatccagagtggaata

SEQ ID NO: 210597 - DNA, 75 bp, Artificial Sequence
  Synthetic
actcccattgtactggcatacatgcttgagagagaactagttgcccgaagaaggttcctgccagtagcaggagca

SEQ ID NO: 210598 - DNA, 75 bp, Artificial Sequence
  Synthetic
aagacaggatatccagagtggaatacatcaaacgagcattgtcattaaacacaatgacaaaagatgctgaaagag

SEQ ID NO: 210599 - DNA, 75 bp, Artificial Sequence
  Synthetic
acatcagcagagttcatagaaatgctacattgcttacaaggtgaaaattggagacaaatatatcatccaggaggg

SEQ ID NO: 210600 - DNA, 75 bp, Artificial Sequence
  Synthetic
aataaactaactgaatctagatctcaatcaatgattgtagcttgcaggaagataatcagaagatcaatagttgca

SEQ ID NO: 210601 - DNA, 75 bp, Artificial Sequence
  Synthetic
tttgtattagtagttgaaaacttggctaaaaacatctgtgaaaatctagaacaaagtggtttgcccgtgggtgga

SEQ ID NO: 210602 - DNA, 75 bp, Artificial Sequence
  Synthetic
tgtttaatgggctcaggacggctgctgtgggacactgccacaggtgttgacatggctctgtgatggaggaatggt

SEQ ID NO: 210603 - DNA, 75 bp, Artificial Sequence
  Synthetic
aatgaaaagaaggccaaactgtcaaatgcagtggccaaaatgctcagtaactgcccaccaggagggatcagcatg

SEQ ID NO: 210604 - DNA, 75 bp, Artificial Sequence
  Synthetic
tcaaacccactagagctagctgtagagattgcaaataagactgtgatagacactgaacctttaaaatcatgtctg

SEQ ID NO: 210605 - DNA, 75 bp, Artificial Sequence
  Synthetic
ctgcccaccaggagggatcagcatgacagtaacaggagacaatactaaatggaatgaatgcttaaatccacgaat

SEQ ID NO: 210606 - DNA, 75 bp, Artificial Sequence
  Synthetic
gcagccctggatggaggtgatgtagcctgtgacataataagagctgcattaggattaaaaattagacaaagacaa

SEQ ID NO: 210607 - DNA, 75 bp, Artificial Sequence
  Synthetic
ggttgagtctgttctaaaccctttgttcctgttttgtttgaacaattgtccttgctaaacttgattgtttctgaa

SEQ ID NO: 210608 - DNA, 75 bp, Artificial Sequence
  Synthetic
ctttttggctatgactgaaagaataaccagagacagcccaatttggttccgggatttttgtagtatagcaccggt

SEQ ID NO: 210609 - DNA, 75 bp, Artificial Sequence
  Synthetic
agatttgggagacttgaactaaagagaatatcaggaagaggattcaaaaatgatgaagagatattaatcggaaac

SEQ ID NO: 210610 - DNA, 75 bp, Artificial Sequence
  Synthetic
cttgttctccaacaaaatagccagattagggaaaggattcatgataacaagtaaaacaaaaagactaaaggctca

SEQ ID NO: 210611 - DNA, 75 bp, Artificial Sequence
  Synthetic
ggaacaatacaaaagattggaatatgggacggagaagaggaattccatgtaagatgtggcgaatgcagggggata

SEQ ID NO: 210612 - DNA, 75 bp, Artificial Sequence
  Synthetic
aataccttgtcctgatctgttcagcataccattagaaagatataatgaagaaacaagggcgaaattaaaaaggct

SEQ ID NO: 210613 - DNA, 75 bp, Artificial Sequence
  Synthetic
ataccattagaaagatataatgaagaaacaagggcgaaattaaaaaggctgaaaccattcttcaatgaagaagga

SEQ ID NO: 210614 - DNA, 75 bp, Artificial Sequence
  Synthetic
ttgaaaaaaagccaaatgagaatggaaaaactactgataaattcagccaaaaaggaggacatgaaagatttaata

SEQ ID NO: 210615 - DNA, 75 bp, Artificial Sequence
  Synthetic
acagcatctttgtcgcctgggatgatgatgggaatgtttaatatgctatctaccgtgttgggagtagcagcacta

SEQ ID NO: 210616 - DNA, 75 bp, Artificial Sequence
  Synthetic
ggcatcaaaaacattggaaacaaggaatacttatgggatggactgcaatcttccgatgattttgctttatttgtt

SEQ ID NO: 210617 - DNA, 75 bp, Artificial Sequence
  Synthetic
gcaggccaacttttatcccccatgtaccaactccaacgatactttctgaataggagcaatgacctttttgatcaa

SEQ ID NO: 210618 - DNA, 75 bp, Artificial Sequence
  Synthetic
aatgcaaaagatgaagaaacatgtatggaagggataaacgatttttaccgaacatgtaaattattgggaataaac

SEQ ID NO: 210619 - DNA, 75 bp, Artificial Sequence
  Synthetic
tggggatatgaggaatcacctaaagcaagtgagctacatgggataaatgaattaatgaatgcatctgactataca

SEQ ID NO: 210620 - DNA, 75 bp, Artificial Sequence
  Synthetic
aagcatgttctatagagatggatttgtatctaactttgcaatggaaattccttcatttggagttgctggagtaaa

SEQ ID NO: 210621 - DNA, 75 bp, Artificial Sequence
  Synthetic
gcacagctaatgataacgtatgatacacccaagatgtgggaaatgggaacaaccaaagaactggtacaaaacact

SEQ ID NO: 210622 - DNA, 75 bp, Artificial Sequence
  Synthetic
tgaatcagcagatatggcaataggaatgacaataataaagaacaatatgattaacaatggaatgggtccggcaac

SEQ ID NO: 210623 - DNA, 75 bp, Artificial Sequence
  Synthetic
taccaatgggtgcttaaaaatttagtaacattgaaggctcagtttcttttgggaaaagaagacatgttccaatgg

SEQ ID NO: 210624 - DNA, 75 bp, Artificial Sequence
  Synthetic
agcacaaacagccatacaattgttcatagctgattataggtacacatacaaatgccacagaggagattccaaagt

SEQ ID NO: 210625 - DNA, 75 bp, Artificial Sequence
  Synthetic
ccaaaattaaggagcaatggggagccttatcaattcttaaaacttgtattgaaaggaggaggggagaatttcatc

SEQ ID NO: 210626 - DNA, 75 bp, Artificial Sequence
  Synthetic
gatgcatttgaagcatttgaaagcataatccctcagaagatggctggtcagtacagtggatttgcaagagcagtg

SEQ ID NO: 210627 - DNA, 75 bp, Artificial Sequence
  Synthetic
ggaaggaaaaagaatgaaaattataaaagagctatgggaaaacactaaaggaagagatggtctgttagtagcaga

SEQ ID NO: 210628 - DNA, 75 bp, Artificial Sequence
  Synthetic
ctcaaacaaatgagagaccaagaggttatgaaaactgaccaattcataaaattgttgcctttctgtttttcgcca

SEQ ID NO: 210629 - DNA, 75 bp, Artificial Sequence
  Synthetic
tggtgggcccaacatttacaatttgagaaacttacatatcccagaaatagtattgaagtacaacctaatggaccc

SEQ ID NO: 210630 - DNA, 75 bp, Artificial Sequence
  Synthetic
agaaacttacatatcccagaaatagtattgaagtacaacctaatggaccctgaatacaaagggcggttacttcac

SEQ ID NO: 210631 - DNA, 75 bp, Artificial Sequence
  Synthetic
ccaaaattaaggagcaatggagagccttatcaatttttgaggcttatgctgaaaggaggaggggaaaatttcatc

SEQ ID NO: 210632 - DNA, 75 bp, Artificial Sequence
  Synthetic
gaagtaaggaaagggtcccccttgttctcctacaatccacaaacggaaatcctaactatatgcggcagaatgatg

SEQ ID NO: 210633 - DNA, 75 bp, Artificial Sequence
  Synthetic
gtgaggaaaatggattacgatgcagtgtctggaactcatagttggagaaccaaaaggaacagatctatactaaat

SEQ ID NO: 210634 - DNA, 75 bp, Artificial Sequence
  Synthetic
tgtctggaactcatagttggagaaccaaaaggaacagatctatactaaatactgatcagaggaacatgattcttg

SEQ ID NO: 210635 - DNA, 75 bp, Artificial Sequence
  Synthetic
tcattaaaaggaaaaattgaggatgaagaaagaaatagatcaatggggaatgcagtactggcaggctttcttgtt

SEQ ID NO: 210636 - DNA, 75 bp, Artificial Sequence
  Synthetic
aagaacaatgctatgctaaatgttgcaatctttttgaggcctgttttaacagtgcatcatacaggaaaccagtag

SEQ ID NO: 210637 - DNA, 75 bp, Artificial Sequence
  Synthetic
agtggcaaatatgaccctgatcttggagatttcaaaaccattgaggaacttgaaagactaaaaccgggagaaaaa

SEQ ID NO: 210638 - DNA, 75 bp, Artificial Sequence
  Synthetic
ggcaacatagcatgcttgaggctatggcccatagattgagaatggatgcacgactggattatgaatcaggaagaa

SEQ ID NO: 210639 - DNA, 75 bp, Artificial Sequence
  Synthetic
gccaacatcttactttaccaaggaaagcccgttaaagtagttaaaaggaaaagatatagtgctttatccaatgat

SEQ ID NO: 210640 - DNA, 75 bp, Artificial Sequence
  Synthetic
taccaataaccaatagggtggtaaatgaaaaaggagaaagtttcgacatgctttatggtctagcggttaaaggac

SEQ ID NO: 210641 - DNA, 75 bp, Artificial Sequence
  Synthetic
tatgaatcaggaagaatgtcaaaggatgattttgaaaaagcaatggctcaccttggtgagattgggtacacatga

SEQ ID NO: 210642 - DNA, 75 bp, Artificial Sequence
  Synthetic
agcagaagcggagctttaagatgaatataaatccatattttcttttcatagatgtacctatacaggcagcaattt

SEQ ID NO: 210643 - DNA, 75 bp, Artificial Sequence
  Synthetic
ttatccaatgatatttcacaagggattaagagacaaagaatgacagttgagtccatggggtgggccttgagctaa

SEQ ID NO: 210644 - DNA, 75 bp, Artificial Sequence
  Synthetic
agccaaaacagtactgaaacaaacaacagtagatcaatataacataataagaaaattcaatacatcaagaattga

SEQ ID NO: 210645 - DNA, 75 bp, Artificial Sequence
  Synthetic
caacaacattcccatacaccggtgttcccccttattctcatggaacgggaacaggctacacaatagacaccgtga

SEQ ID NO: 210646 - DNA, 75 bp, Artificial Sequence
  Synthetic
tgggcgatgtgttctaattttcccttggctttgaccaagggtgacatggcaaacagaatccccttggaatacaag

SEQ ID NO: 210647 - DNA, 75 bp, Artificial Sequence
  Synthetic
ttagaacacacgagtactcaaacaagggaaaacaatacatttctgatgttacaggatgtgtaatggtagatccaa

SEQ ID NO: 210648 - DNA, 75 bp, Artificial Sequence
  Synthetic
caaatgggccattacccgaagacaatgaaccgagtgcctatgcacaattggattgtgttctggaggctttggata

SEQ ID NO: 210649 - DNA, 75 bp, Artificial Sequence
  Synthetic
aagacataggaaccaaaggccaaatgtgctcaatagcagcagttacctggtggaatacatatggaccaataggag

SEQ ID NO: 210650 - DNA, 75 bp, Artificial Sequence
  Synthetic
gaatggatgaagaacatccaggtctgtttcaagcagggtcacagaatgccatggaggcactaatggtcacaacag

SEQ ID NO: 210651 - DNA, 75 bp, Artificial Sequence
  Synthetic
taaacagagaagtatcaattttgagacacaattaccaaaaagaaattcaggctaaagaagcaatgaaggaagtac

SEQ ID NO: 210652 - DNA, 75 bp, Artificial Sequence
  Synthetic
tggacaaattgactcaggggagacagacctttgattggacggtgtgtagaaaccaacctgctgcaacggcactga

SEQ ID NO: 210653 - DNA, 75 bp, Artificial Sequence
  Synthetic
gaataacttttggcccagttgaaagagtaagaaaaagggtactgctaaaccctctcactaaggaaatgcctccag

SEQ ID NO: 210654 - DNA, 75 bp, Artificial Sequence
  Synthetic
agtaagaaaaagggtactgctaaaccctctcactaaggaaatgcctccagatgaagcaagcaatgtgataatgga

SEQ ID NO: 210655 - DNA, 75 bp, Artificial Sequence
  Synthetic
acacaacaataacctcttttaggttgaatgatttaaatggagccgacaagggtggattagtgcccttttgccaag

SEQ ID NO: 210656 - DNA, 75 bp, Artificial Sequence
  Synthetic
aatattgttccctaaagaagcaggaataccaagagaatctacttggatacatagggaactgataaaagaaaaaag

SEQ ID NO: 210657 - DNA, 75 bp, Artificial Sequence
  Synthetic
atatcattgattcattagacaaacctgaaatgattttcttcacagtaaagaatataaagaaaaaattgcctgcta

SEQ ID NO: 210658 - DNA, 75 bp, Artificial Sequence
  Synthetic
aaaacagaaagggtttccttataaaaagaatacctatgaaggtaaaagacagaataacaagagtggaatacatca

SEQ ID NO: 210659 - DNA, 75 bp, Artificial Sequence
  Synthetic
aaggttcctgcccgtggcaggagcaacatcagctgagttcatagaaatgctacactgcttacaaggtgaaaattg

SEQ ID NO: 210660 - DNA, 75 bp, Artificial Sequence
  Synthetic
aaagagcattatcattaaacacaatgactaaagatgctgaaagaggcaaactaaaaagaagagcaattgccaccg

SEQ ID NO: 210661 - DNA, 75 bp, Artificial Sequence
  Synthetic
tacactgcttacaaggtgaaaattggaggcaaatatatcacccgggagggaataaactaaccgaatctaggtccc

SEQ ID NO: 210662 - DNA, 75 bp, Artificial Sequence
  Synthetic
caatggcttgggctgtcccaaaggacaacaacaaaaatgcaacgaacccattaacagtagaggtaccatacattt

SEQ ID NO: 210663 - DNA, 75 bp, Artificial Sequence
  Synthetic
ctgggatacaaatcagaggatttgtattagtagttgaaaacttggctaaaaatatctgtgaaaatctagagcaaa

SEQ ID NO: 210664 - DNA, 75 bp, Artificial Sequence
  Synthetic
aatcgatgattgtggcttgtagaaagataatcagaagatcaatagtcgcatcaaacccattggagctagctgtag

SEQ ID NO: 210665 - DNA, 75 bp, Artificial Sequence
  Synthetic
aaaccagtggaaatgctttcattgggaagaaaatgtttcaaatatcagacaaaaacaaaaccaatcccgttgaaa

SEQ ID NO: 210666 - DNA, 75 bp, Artificial Sequence
  Synthetic
gtggtttacccgtaggtggaaacgaaaagaaggccaaactatcaaatgcagtggctaaaatgctcagtaattgtc

SEQ ID NO: 210667 - DNA, 75 bp, Artificial Sequence
  Synthetic
acagccatagacggaggtgatgtcgcctgtgacataataagagctgcattaggactaaagatcagacaaagacaa

SEQ ID NO: 210668 - DNA, 75 bp, Artificial Sequence
  Synthetic
caccaggagggatcagtatgactgtgacaggagacaatactaaatggaatgaatgcttaaatccaagaatctttt

SEQ ID NO: 210669 - DNA, 75 bp, Artificial Sequence
  Synthetic
gaatatcaggaagaggattcaaaaatgatgaagaaatattaatcgggaacggaacaatacagaagattggaatat

SEQ ID NO: 210670 - DNA, 75 bp, Artificial Sequence
  Synthetic
ggaacaatacagaagattggaatatgggacggagaagaggagttccatgtgagatgtggtgaatgcaggggaata

SEQ ID NO: 210671 - DNA, 75 bp, Artificial Sequence
  Synthetic
tctccaataaaatagctagattgggaaaagggttcatgataacaagtaaaacaaaaagactaaaagctcaaatac

SEQ ID NO: 210672 - DNA, 75 bp, Artificial Sequence
  Synthetic
cttgtcccgatctgtttaatataccattagaaagatataatgaagaaacaagggcaaaactgaaaaagctaaaac

SEQ ID NO: 210673 - DNA, 75 bp, Artificial Sequence
  Synthetic
aaaaactactaataaattcagctaaaaaggaggacatgaaagatttaataattttgtgcatggtattttcccaag

SEQ ID NO: 210674 - DNA, 75 bp, Artificial Sequence
  Synthetic
ctttcttcaatgaagaaggaacggcatctctttcgccaggaatgatgatgggaatgtttaatatgctatctacag

SEQ ID NO: 210675 - DNA, 75 bp, Artificial Sequence
  Synthetic
acactaggatgttccaaggagtgaggggtgaaataaattttcttaatagagcaggccaacttttatctccaatgt

SEQ ID NO: 210676 - DNA, 75 bp, Artificial Sequence
  Synthetic
tattaggagtagccgcactagggataaaaaacattggaaacaaagaatacttatgggatggactgcagtcttcgg

SEQ ID NO: 210677 - DNA, 75 bp, Artificial Sequence
  Synthetic
atcaactccaaagatattttttgagtagaagtaacgatctctttgatcaatgggggtatgaggaatcacccaaag

SEQ ID NO: 210678 - DNA, 75 bp, Artificial Sequence
  Synthetic
atgattttgctctgtttgttaatgcaaaagatgaagagacatgtatggaaggaataaacgatttttaccgaacat

SEQ ID NO: 210679 - DNA, 75 bp, Artificial Sequence
  Synthetic
gtaagctattgggaataaacatgagcaaaaagaaaagttactgtaatgaaactgggatgtttgaatttaccagca

SEQ ID NO: 210680 - DNA, 75 bp, Artificial Sequence
  Synthetic
atgtaattgatgattttagttctactgaaacagaaaaagtatctataacaaaaaatcttagtttaataaaaagga

SEQ ID NO: 210681 - DNA, 75 bp, Artificial Sequence
  Synthetic
tcatagatgtacccatacaggcagcaatttcaacaacattcccatacaccggtgttcccccttactcccatggaa

SEQ ID NO: 210682 - DNA, 75 bp, Artificial Sequence
  Synthetic
tgttttacagagatggatttgtatctaattttgcaatggaactcccttcatttggagtcgctggagtgaatgaat

SEQ ID NO: 210683 - DNA, 75 bp, Artificial Sequence
  Synthetic
cagcagacatggcaataggaatgacaataataaagaacaatatgatcaacaatgggatgggcccagcaacggcac

SEQ ID NO: 210684 - DNA, 75 bp, Artificial Sequence
  Synthetic
tatcaatgggtgctgaaaaatttggtaacactaaaggctcagtttcttctagggaaagaagacatgttccaatgg

SEQ ID NO: 210685 - DNA, 75 bp, Artificial Sequence
  Synthetic
aaacagccatacaattattcatagctgactatagatacacctacaaatgccacaggggagattccaaagtggaag

SEQ ID NO: 210686 - DNA, 75 bp, Artificial Sequence
  Synthetic
agggaaagaagacatgttccaatgggatgcatttgaagcatttgaaagcataattccccagaagatggctggcca

SEQ ID NO: 210687 - DNA, 75 bp, Artificial Sequence
  Synthetic
ggaagagaatgaaaattataaaggagctatgggaaaacactaaaggaagagatggtctattagtagcagatggtg

SEQ ID NO: 210688 - DNA, 75 bp, Artificial Sequence
  Synthetic
atacagtggatttgcaagagcagtgctcaaacaaatgagagaccaagaggtcatgaaaactgaccagttcataaa

SEQ ID NO: 210689 - DNA, 75 bp, Artificial Sequence
  Synthetic
ggcctaatctttacaatttgagaaacctgcatattccagaaataatattaaaatacaacataatggaccctgagt

SEQ ID NO: 210690 - DNA, 75 bp, Artificial Sequence
  Synthetic
gttgttgcccttttgtttctcaccaccaaagttaaggagtaatggggagccctatcagttcttgaggcttgtact

SEQ ID NO: 210691 - DNA, 75 bp, Artificial Sequence
  Synthetic
acaaaggacggttactgcatcctcaaaatccctttgtaggacatttgtctattgagggtatcaaagaagcagata

SEQ ID NO: 210692 - DNA, 75 bp, Artificial Sequence
  Synthetic
taacacctgcacatggcccaataaagaaaatggactacgatgcggtatctggaactcatagttggagaaccaaaa

SEQ ID NO: 210693 - DNA, 75 bp, Artificial Sequence
  Synthetic
ggaacagatctatactaaacactgatcagaggaacatgattcttgaggaacaatgctacgctaagtgttgcaacc

SEQ ID NO: 210694 - DNA, 75 bp, Artificial Sequence
  Synthetic
tgcagtgttggcgggttttcttgttagtggcaagtatgacccagatcttggagatttcaaaaccattgaagaact

SEQ ID NO: 210695 - DNA, 75 bp, Artificial Sequence
  Synthetic
agtggcaagtatgacccagatcttggagatttcaaaaccattgaagaacttgaaaagttgaaaccaggggagaaa

SEQ ID NO: 210696 - DNA, 75 bp, Artificial Sequence
  Synthetic
tttttgaggcttgctttaacagtgcgtcatacaggaaaccagtaggccagcacagcatgcttgaagctatggccc

SEQ ID NO: 210697 - DNA, 75 bp, Artificial Sequence
  Synthetic
gcaaacatcttactttatcaaggaaagcccgttaaagtagttaaaaggaaaagatatagtgctttatccaatgac

SEQ ID NO: 210698 - DNA, 75 bp, Artificial Sequence
  Synthetic
acagattaagaatggatgcacgactggactatgagtcaggaaggatgtcaaaagaggatttcgaaaaagcaatgg

SEQ ID NO: 210699 - DNA, 75 bp, Artificial Sequence
  Synthetic
ctcaccttggtgagattgggtacatgtaagctccggaaatgtctatggggttattggtcatcgttgaatacatgc

SEQ ID NO: 210700 - DNA, 75 bp, Artificial Sequence
  Synthetic
gtttgatttgtcataatggatacctttattacaagaaacttccagactacaataatacaaaaggccaaaaacaca

SEQ ID NO: 210701 - DNA, 75 bp, Artificial Sequence
  Synthetic
tatggggttattggtcatcgttgaatacatgcggtgcacaaatgattaaaatgaaaaaaggctcgtgtttctact

SEQ ID NO: 210702 - DNA, 75 bp, Artificial Sequence
  Synthetic
caaaatttgagaccacaatatgaagtaattgaggggatgccaagaaccatagcatggatggtccaaaggtcctta

SEQ ID NO: 210703 - DNA, 75 bp, Artificial Sequence
  Synthetic
aaagctgggaaatagcatggaactgatgatattcagctacaaccaagactactcgttaagtaatgaatcctcatt

SEQ ID NO: 210704 - DNA, 75 bp, Artificial Sequence
  Synthetic
tttcttatgaacttcaagcaccagtaaaataactgaaaatcaaaatgtccaacatggatattgacggtatcaaca

SEQ ID NO: 210705 - DNA, 75 bp, Artificial Sequence
  Synthetic
atgagcaaaaagaaaagttactgcaacgaaactggaatgtttgaatttacaagcatgttctatagagatggattt

SEQ ID NO: 210706 - DNA, 75 bp, Artificial Sequence
  Synthetic
ttggacaaacaatatctagactaagggatatatctgttccagctggtttctccaatttcgaaggaatgaggagct

SEQ ID NO: 210707 - DNA, 75 bp, Artificial Sequence
  Synthetic
tgaatcagcagacatggcaataggaatgacaataataaagaacaatatgattaacaatgggatgggcccagcaac

SEQ ID NO: 210708 - DNA, 75 bp, Artificial Sequence
  Synthetic
acatagacaatatagacccaaaaggagcaatagaaagaaatctagcaaggatgtctcccttagtatcagtcacac

SEQ ID NO: 210709 - DNA, 75 bp, Artificial Sequence
  Synthetic
ctaagaagttgaaatgggaggacctaaggccaatagggcctcacatttacaatcatgagctaccagaagttccat

SEQ ID NO: 210710 - DNA, 75 bp, Artificial Sequence
  Synthetic
gagggaaagtccaaaaaaccgaagacattagccaaagaatgtctagaaaagtactcaacactacgggatcaaact

SEQ ID NO: 210711 - DNA, 75 bp, Artificial Sequence
  Synthetic
gacccaatattaataatgaaaagcgaaaaagctaacgaaaatttcctatggaagctttggagagactgtgtaaat

SEQ ID NO: 210712 - DNA, 75 bp, Artificial Sequence
  Synthetic
cctcaaaatccctttgtaggacatttgtccattgaaggcatcaaagaagcagatataaccccagcacatggtcct

SEQ ID NO: 210713 - DNA, 75 bp, Artificial Sequence
  Synthetic
gttgattacatgatgcaaaaacctgggaaaacaggaacaattgtctatcaaagaggcattttgttgcctcaaaag

SEQ ID NO: 210714 - DNA, 75 bp, Artificial Sequence
  Synthetic
cacctgtggagcatgtagggagtgaaagaaggaaatactttgttaatgaaatcaactactgtaaagcctctacag

SEQ ID NO: 210715 - DNA, 75 bp, Artificial Sequence
  Synthetic
aagaaggaaatactttgttaatgaaatcaactactgtaaagcctctacagttatgatgaagtatgtgctttttca

SEQ ID NO: 210716 - DNA, 75 bp, Artificial Sequence
  Synthetic
taccaataaccaatagggtggtaaatgaaaagggagaaagtttcgacatgctttatggtctggcggttaaaggac

SEQ ID NO: 210717 - DNA, 75 bp, Artificial Sequence
  Synthetic
gaatggaatgggaaaaggagaagacgtccaaaaactggcagaagaactgcaaagcaacattggagtgctgagatc

SEQ ID NO: 210718 - DNA, 75 bp, Artificial Sequence
  Synthetic
gtgagtgggagggaaaaatctgtgtacctgtattgccgagtgaatggcacaaataagatccaaatgaagtgggga

SEQ ID NO: 210719 - DNA, 75 bp, Artificial Sequence
  Synthetic
atggaagctagaagatgtctgcttcaatcaatgcagcaaatggaagcaattgttgaacaagaatcatcgatacaa

SEQ ID NO: 210720 - DNA, 75 bp, Artificial Sequence
  Synthetic
ggatatgacatgaccaaagcttgtttcaagggagacagagtaaatagccccaaaactttcagtgttggaacccaa

SEQ ID NO: 210721 - DNA, 75 bp, Artificial Sequence
  Synthetic
gaaggaaaactagtaaaaggatcctttggaaaagcactacgagtaatatttactaaatgtttgatgcactatgta

SEQ ID NO: 210722 - DNA, 75 bp, Artificial Sequence
  Synthetic
tttggaaatgcccaattggaggggtttagtgccgagtctaggagacttctactgttgattcaagcattaaaggac

SEQ ID NO: 210723 - DNA, 75 bp, Artificial Sequence
  Synthetic
aaaacctatggcaagttctcataggagaggaagatgttgaaaagggaattgactttaagcttggacaaacaatat

SEQ ID NO: 210724 - DNA, 75 bp, Artificial Sequence
  Synthetic
aatagcagaaggccatgaaagctcagcgctactatactgtctcatggtcatgtacctgaatcctggaaattattc

SEQ ID NO: 210725 - DNA, 75 bp, Artificial Sequence
  Synthetic
agaaagggcccttgggtgtttgacttggagggaatgtattctggaatagaagaatgtattagtaacaacccttgg

SEQ ID NO: 210726 - DNA, 75 bp, Artificial Sequence
  Synthetic
gtgatacagagtgcatactggttcaatgaatggttgggctttgaaaaggaggggagtaaggtattagaatcagta

SEQ ID NO: 210727 - DNA, 75 bp, Artificial Sequence
  Synthetic
atgaatggttgggctttgaaaaggaggggagtaaggtattagaatcagtagatgaaataatggatgaataaaaag

SEQ ID NO: 210728 - DNA, 75 bp, Artificial Sequence
  Synthetic
acatagtactcaatttagtactattttgttcattatgtatctaaacatccaataaaaagaaccaagaatcaaaaa

SEQ ID NO: 210729 - DNA, 75 bp, Artificial Sequence
  Synthetic
gtcactggcaaacaggaaaaatggcggacaacatgaccacaacacaaattgaggtgggtccgggagcaaccaatg

SEQ ID NO: 210730 - DNA, 75 bp, Artificial Sequence
  Synthetic
ccaccataaactttgaagcaggaattctggagtgctatgaaaggctttcatggcaaagggcccttgactatcctg

SEQ ID NO: 210731 - DNA, 75 bp, Artificial Sequence
  Synthetic
gtcaagaccgcctaaacagactaaaaagaaaattagagtcaagaataaagactcacaacaaaagtgagcctgaaa

SEQ ID NO: 210732 - DNA, 75 bp, Artificial Sequence
  Synthetic
aaaagcaattggagtaaaaatgatgaaagtactcctatttatgaatccgtctgctggaattgaagggtttgagcc

SEQ ID NO: 210733 - DNA, 75 bp, Artificial Sequence
  Synthetic
cgcagaagcagaggatttatttagtcactggcaaacggaaagatggcggacaacatgaccacaacacaaattgag

SEQ ID NO: 210734 - DNA, 75 bp, Artificial Sequence
  Synthetic
gcggtgggagtcctatcccaatttggtcaagagcaccgattatcaccagaagagggagacaattagactagtcac

SEQ ID NO: 210735 - DNA, 75 bp, Artificial Sequence
  Synthetic
gtgggtccgggagcaaccaatgccactataaactttgaagcaggaattctggagtgctatgaaaggttttcatgg

SEQ ID NO: 210736 - DNA, 75 bp, Artificial Sequence
  Synthetic
caaagagcccttgactatcctggtcaagaccgcctacacagactaaaacgaaaattagaatcaagaataaagact

SEQ ID NO: 210737 - DNA, 75 bp, Artificial Sequence
  Synthetic
attattagaaacattgtatgaaatgaaggatgtggttgaagtgtacagcaggcagtgcttgtgaatttaaaataa

SEQ ID NO: 210738 - DNA, 75 bp, Artificial Sequence
  Synthetic
cacaacaagagtgagcctgagaataaaaggatgtctcttgaagagagaaaagcaattggggtaaaaatgatgaaa

SEQ ID NO: 210739 - DNA, 75 bp, Artificial Sequence
  Synthetic
gtgcttctgtttatggatccctctgctggaattgaagggtttgagccatactgtgtgaaaaatccctcaactagc

SEQ ID NO: 210740 - DNA, 75 bp, Artificial Sequence
  Synthetic
caacccttgccccaccaagcaacaaacgaacccgtaacccatccccggaaagagcaactacaagcagtgaagatg

SEQ ID NO: 210741 - DNA, 75 bp, Artificial Sequence
  Synthetic
acgaacccgtaacccatccccggaaagagcaactacaagcagtgaagatgatgtcggaaggaaaacccaaaagaa

SEQ ID NO: 210742 - DNA, 75 bp, Artificial Sequence
  Synthetic
aaatgtccaaattacgattggaccgattaccctccaaccccaggaaagtaccttgatgacatagaagaagagccg

SEQ ID NO: 210743 - DNA, 75 bp, Artificial Sequence
  Synthetic
atgtcggaaggaaaacccaaaagaaacagaccccgacagagataaagaagagcgtctacaacatggtagtgaaac

SEQ ID NO: 210744 - DNA, 75 bp, Artificial Sequence
  Synthetic
gaaaatgtcgatcacccaattgaggtagtattaagggacatgaacaataaagatgcacgacaaaagataaaggat

SEQ ID NO: 210745 - DNA, 75 bp, Artificial Sequence
  Synthetic
tgggcgaattctacaaccagatgatggtcaaagctggactcaatgatgacatggagaggaacctaatccaaaatg

SEQ ID NO: 210746 - DNA, 75 bp, Artificial Sequence
  Synthetic
gaagtaaacactcagaaagaggggaaattccgtttgacaataaaaagggatatacgtaatgtgttgtccttgaga

SEQ ID NO: 210747 - DNA, 75 bp, Artificial Sequence
  Synthetic
cgcatgccgtggaaagaattctattggctgccactgatgacaagaaaaccgagttccagaagaaaaagaatgcca

SEQ ID NO: 210748 - DNA, 75 bp, Artificial Sequence
  Synthetic
gtgttggtgaacggaaccttcctcaagcaccctaatggagacaagtccttatcaactcttcatagattgaatgca

SEQ ID NO: 210749 - DNA, 75 bp, Artificial Sequence
  Synthetic
tatgaccagaatggagggcttgttgctaaacttgttgctactgatgatcggacagtggaggatgaaaaagatggc

SEQ ID NO: 210750 - DNA, 75 bp, Artificial Sequence
  Synthetic
gacagtggaggatgaaaaagatggccatcggatcctcaactcactcttcgagcgttttgatgaaggacattcaaa

SEQ ID NO: 210751 - DNA, 75 bp, Artificial Sequence
  Synthetic
caaatagcaactgtcagaaatacaattggaccgattacccttcaacaccagggaggtgccttgatgacatagaag

SEQ ID NO: 210752 - DNA, 75 bp, Artificial Sequence
  Synthetic
gatcaaaagcactaaaaagagtgggacttgatccttcattaatcagtacctttgcaggaagcacaatccccagaa

SEQ ID NO: 210753 - DNA, 75 bp, Artificial Sequence
  Synthetic
gggagacaattagactggccacggaagaactttatctcttgagtaaaagaattgatgatagtatattgttccaca

SEQ ID NO: 210754 - DNA, 75 bp, Artificial Sequence
  Synthetic
tttgcaggaagcacaatccccagaagatcaggtgcgactggtgttgcaattaaaggaggtggaactttagtggct

SEQ ID NO: 210755 - DNA, 75 bp, Artificial Sequence
  Synthetic
aaacagtaatagctaacagctccataatagctgacatgattgtatcattatcattactggaaacattgtatgaaa

SEQ ID NO: 210756 - DNA, 75 bp, Artificial Sequence
  Synthetic
gaagccattcgatttataggaagagcaatggcagacagagggctattgagagacatcaaagccaaaactgcctat

SEQ ID NO: 210757 - DNA, 75 bp, Artificial Sequence
  Synthetic
gaaatgaaggatgtggttgaagtgtacagcaggcagtgcttatgaatgtaaaataaaaatcctcttgttactact

SEQ ID NO: 210758 - DNA, 75 bp, Artificial Sequence
  Synthetic
gagaagattcttctgaatctaaagaacaaatgctctgctccccaacaaaaggctctagttgatcaagtgatcgga

SEQ ID NO: 210759 - DNA, 75 bp, Artificial Sequence
  Synthetic
ggctctagttgatcaagtgatcggaagcagaaatccagggattgcagacattgaagatctaaccctgcttgctcg

SEQ ID NO: 210760 - DNA, 75 bp, Artificial Sequence
  Synthetic
ttgaagatctaaccctgcttgctcgtagtatggtcgttgttaggccctctgtggcgagcaaagtggttcttccca

SEQ ID NO: 210761 - DNA, 75 bp, Artificial Sequence
  Synthetic
ataaaaccatctacttcagccctataagaattacctttttaaaagaagaggtgaaaacaatgtacaagaccacca

SEQ ID NO: 210762 - DNA, 75 bp, Artificial Sequence
  Synthetic
ggttgagtctgttctaaaccctttgttcctattttgtttgaacaattgttcttactgagcttaattgtttctgaa

SEQ ID NO: 210763 - DNA, 75 bp, Artificial Sequence
  Synthetic
ggcagaagcacagcattttcttgtgagcttcgagcactaataaaactgaaaatcaaaatgtccaacatggatatt

SEQ ID NO: 210764 - DNA, 75 bp, Artificial Sequence
  Synthetic
gacagtataaataccggaacaatcgataaaacaccagaagaactgactcccggaaccagtggggcaaccagacca

SEQ ID NO: 210765 - DNA, 75 bp, Artificial Sequence
  Synthetic
ccatcaagctccagttttgggctccaatgaccagatctggggggaacgaagtaggtggagacggaggatctggcc

SEQ ID NO: 210766 - DNA, 75 bp, Artificial Sequence
  Synthetic
atactgagggtttcgaaaaagtctacgaaagcttttttctcagaaagatgaggcttgacaatggcacttggggcc

SEQ ID NO: 210767 - DNA, 75 bp, Artificial Sequence
  Synthetic
aaataagctgcagcccagtgttcgcagtggaaagacctattgctctaagcaagcaagctgtaagaagaatgctgt

SEQ ID NO: 210768 - DNA, 75 bp, Artificial Sequence
  Synthetic
agtggaaagacctattgctctaagcaagcaagctgtaagaagaatgctgtcaatgaatattgagggacgtgatgc

SEQ ID NO: 210769 - DNA, 75 bp, Artificial Sequence
  Synthetic
atcatcaagccagcaacccttgctccgccaagcaacaaacgaacccgaaatccatctccagaaaggacaaccaca

SEQ ID NO: 210770 - DNA, 75 bp, Artificial Sequence
  Synthetic
agcagtgaaaccgatatcggaaggaaaatccaaaagaaacaaaccccaacagagataaagaagagcgtctacaaa

SEQ ID NO: 210771 - DNA, 75 bp, Artificial Sequence
  Synthetic
atggtggtaaaactgggtgaattctacaaccagatgatggtcaaagctggacttaatgatgacatggaaaggaat

SEQ ID NO: 210772 - DNA, 75 bp, Artificial Sequence
  Synthetic
ctaattcaaaatgcacaagctgtggagagaatcctattggctgcaactgatgacaagaaaactgaataccaaaag

SEQ ID NO: 210773 - DNA, 75 bp, Artificial Sequence
  Synthetic
ttccaattaagcagaccatccccaatttcttctttgggagggacacagcagaggattatgatgacctcgattatt

SEQ ID NO: 210774 - DNA, 75 bp, Artificial Sequence
  Synthetic
aaaaggaatgccagagatgtcaaagaagggaaggaagaaatagaccacaacaagacaggaggcaccttttataag

SEQ ID NO: 210775 - DNA, 75 bp, Artificial Sequence
  Synthetic
aagggaaggaagaaatagaccacaacaagacaggaggcaccttttataagatggtaagagatgataaaaccatct

SEQ ID NO: 210776 - DNA, 75 bp, Artificial Sequence
  Synthetic
aatagacactatgactgtgattgtttcaatacgtttggaatgtgggtgtttattcttattaaaataaatataaaa

SEQ ID NO: 210777 - DNA, 75 bp, Artificial Sequence
  Synthetic
tttcttaaaatgtcgctgtttggagacacaattgcctacctgctttcattgacagaagatggagaaggcaaagca

SEQ ID NO: 210778 - DNA, 75 bp, Artificial Sequence
  Synthetic
acacaattgcctacctgctttcattgacagaagatggagaaggcaaagcagaactagcagaaaaattacactgtt

SEQ ID NO: 210779 - DNA, 75 bp, Artificial Sequence
  Synthetic
acttcagccctataaaaattacctttttaaaagaagaggtgaaaacaatgtacaagaccaccatggggagtgatg

SEQ ID NO: 210780 - DNA, 75 bp, Artificial Sequence
  Synthetic
ggttcggtgggaaagaatttgacctagactctgccttggaatggataaaaaacaaaagatgcttaactgatatac

SEQ ID NO: 210781 - DNA, 75 bp, Artificial Sequence
  Synthetic
gtttcagtggactaaatcacattatgattggacattcacagatgaacgatgtctgtttccaaagatcaaagggac

SEQ ID NO: 210782 - DNA, 75 bp, Artificial Sequence
  Synthetic
agaaagcactaattggtgcatctatctgctttttaaaacccaaagaccaggaaagaaaaagaagattcatcacag

SEQ ID NO: 210783 - DNA, 75 bp, Artificial Sequence
  Synthetic
tgaaaagggttggacttgacccttcattaatcagtacttttgccggaagcacactacccagaagatcaggtacaa

SEQ ID NO: 210784 - DNA, 75 bp, Artificial Sequence
  Synthetic
ctggtgttgcaatcaaaggaggtggaactttagtggatgaagccatccgatttataggaagagcaatggcagaca

SEQ ID NO: 210785 - DNA, 75 bp, Artificial Sequence
  Synthetic
gtgtgagcttccatgaagcatttgaaatagcagaaggccatgaaagctcagcgttactgtattgtctcatggtca

SEQ ID NO: 210786 - DNA, 75 bp, Artificial Sequence
  Synthetic
gagggctactgagagacatcaaggccaagacggcctatgaaaagattcttctgaatctgaaaaacaagtgctctg

SEQ ID NO: 210787 - DNA, 75 bp, Artificial Sequence
  Synthetic
tgtacctgaatcctggaaattattcaatgcaagtaaaactaggaacgctctgtgctttgtgcgagaaacaagcat

SEQ ID NO: 210788 - DNA, 75 bp, Artificial Sequence
  Synthetic
cgccgcaacaaaaggctctagttgatcaagtgatcggaagtaggaacccagggattgcagacatagaagacctaa

SEQ ID NO: 210789 - DNA, 75 bp, Artificial Sequence
  Synthetic
tgtgctttgtgcgagaaacaagcatcacattcacacagggctcatagcagagcagcgagatcttcagtgcccgga

SEQ ID NO: 210790 - DNA, 75 bp, Artificial Sequence
  Synthetic
ctctgcttgccagaagcatggtagttgtcagaccctctgtagcgagcaaagtggtgcttcccataagcatttatg

SEQ ID NO: 210791 - DNA, 75 bp, Artificial Sequence
  Synthetic
gtgagacgagaaatgcagatggtctcagctatgaacacagcaaaaacaatgaatggaatgggaaaaggagaagac

SEQ ID NO: 210792 - DNA, 75 bp, Artificial Sequence
  Synthetic
ctaaaatacctcaactaggattcaataccgaagaatactctatggttgggtatgaagccatggctctttataata

SEQ ID NO: 210793 - DNA, 75 bp, Artificial Sequence
  Synthetic
gtccaaaaactggcagaagaactgcaaagcaacattggagtattgagatctctgggggcaagccaaaagaatgga

SEQ ID NO: 210794 - DNA, 75 bp, Artificial Sequence
  Synthetic
ggtctgtttcaagcagcctcacagaatgccatggaggcactaatggtcacaactgtagacaaattaacccagggg

SEQ ID NO: 210795 - DNA, 75 bp, Artificial Sequence
  Synthetic
tctgggggcaagccaaaagaatggagaaggaattgcaaaggatgtaatggaagtgctaaagcagagctctatggg

SEQ ID NO: 210796 - DNA, 75 bp, Artificial Sequence
  Synthetic
tggcaacacctgtttccatattaagaatgggagatgacgcaaaagataaatctcaactattcttcatgtcgtgct

SEQ ID NO: 210797 - DNA, 75 bp, Artificial Sequence
  Synthetic
gcaaactaaaaagaagagcgattgcaaccgctggaatacaaatcagagggtttgtattagtagttgaaaacttgg

SEQ ID NO: 210798 - DNA, 75 bp, Artificial Sequence
  Synthetic
aagtgctaaagcagagctctatgggaaattcagctcttgtgaagaaatacctataatgctcgaaccatttcagat

SEQ ID NO: 210799 - DNA, 75 bp, Artificial Sequence
  Synthetic
tcggagctgcctatgaagatctaagagtgttatctgcactaacgggcaccgaatttaagcctagatcagcactaa

SEQ ID NO: 210800 - DNA, 75 bp, Artificial Sequence
  Synthetic
tctttcaatttgttcttttattttatcagctctccatttcatggcctggacaataggacatttgaatcaaataaa

SEQ ID NO: 210801 - DNA, 75 bp, Artificial Sequence
  Synthetic
cttattctccaataaaatagccagactgggaaaagggtttatgataacaagtaaaacaaaaagactgaaggctca

SEQ ID NO: 210802 - DNA, 75 bp, Artificial Sequence
  Synthetic
aatgcaagggtttccatgtcccggctaaggagcaagtagaaggaatgggggcagctctgatgtccatcaagcttc

SEQ ID NO: 210803 - DNA, 75 bp, Artificial Sequence
  Synthetic
aagaggagtaaacatgaaaatacgaataaaggggccaaataaagagacgataaacagagaggtatcaattttgag

SEQ ID NO: 210804 - DNA, 75 bp, Artificial Sequence
  Synthetic
agttctgggccccaatgaccagatctggagggaatgaagtaagtggagaaggagggtctggtcaaataagttgca

SEQ ID NO: 210805 - DNA, 75 bp, Artificial Sequence
  Synthetic
taaacagagaggtatcaattttgagacacaattaccaaaaagaaattcaggctaaagaagcaatgaaggaagtac

SEQ ID NO: 210806 - DNA, 75 bp, Artificial Sequence
  Synthetic
gccctgtgtttgcagtagaaagacctattgctctaagcaagcaagctgtaagaagaatgctgtcaatgaacgttg

SEQ ID NO: 210807 - DNA, 75 bp, Artificial Sequence
  Synthetic
aaggacgtgatgcagatgtcaaaggaaatctactcaaaatgatgaatgattcaatggcaaagaaaaccagtggaa

SEQ ID NO: 210808 - DNA, 75 bp, Artificial Sequence
  Synthetic
atgctttcattgggaagaaaatgtttcaaatatcagacaaaaacaaagtcaatcccattgagattccaattaagc

SEQ ID NO: 210809 - DNA, 75 bp, Artificial Sequence
  Synthetic
aattcaatttttactgtacttcttactatgcatttaagcaaattgtaatcaatgtcagcaaataaactggaaaaa

SEQ ID NO: 210810 - DNA, 75 bp, Artificial Sequence
  Synthetic
ctttaagatgaatataaatccttattttctcttcatagatgtacccatacaggcagcaatttcaacaacattccc

SEQ ID NO: 210811 - DNA, 75 bp, Artificial Sequence
  Synthetic
agaccatccccaatttcttctttgggagggacacagcagaggattatgatgacctcgattattaaagcaataaaa

SEQ ID NO: 210812 - DNA, 75 bp, Artificial Sequence
  Synthetic
atactgaaggtttcgaaaaagtctacgaaagcttttttctcagaaagatgagacttgacaatgccacttggggcc

SEQ ID NO: 210813 - DNA, 75 bp, Artificial Sequence
  Synthetic
catggaacgggaacaggccacacaatagacaccgtgatcagaacacatgagtactcaaataagggaaaacaatat

SEQ ID NO: 210814 - DNA, 75 bp, Artificial Sequence
  Synthetic
tagacactatggctgtgactgtttcagtacgtttgggatgtgggtgtttactcttattgaaataaatgtaaaaaa

SEQ ID NO: 210815 - DNA, 75 bp, Artificial Sequence
  Synthetic
gtctctgacatcacaggatgtacaatggtagacccaacaaatggaccattacctgaagacaatgagccaagtgcc

SEQ ID NO: 210816 - DNA, 75 bp, Artificial Sequence
  Synthetic
gactgtttcagtacgtttgggatgtgggtgtttactcttattgaaataaatgtaaaaaatgctgttgtttctact

SEQ ID NO: 210817 - DNA, 75 bp, Artificial Sequence
  Synthetic
ccaggggagacagacttttgattggacagtatgtagaaaccagcctgctgcaacggcactaaacacaacaataac

SEQ ID NO: 210818 - DNA, 75 bp, Artificial Sequence
  Synthetic
ctcatttaggttgaatgatttgaatggagctgacaagggtggattggtacccttttgccaagatatcattgattc

SEQ ID NO: 210819 - DNA, 75 bp, Artificial Sequence
  Synthetic
ccttttgccaagatatcattgattcattggacaagcctgagatgaccttcttctcagtaaagaatataaagaaaa

SEQ ID NO: 210820 - DNA, 75 bp, Artificial Sequence
  Synthetic
tggaatacatcaaaagagcattgtcattaaacacaatgacaaaagatgctgaaaggggcaaactaaaaagaagag

SEQ ID NO: 210821 - DNA, 75 bp, Artificial Sequence
  Synthetic
attaaacacaatgacaaaagatgctgaaaggggcaaactaaaaagaagagcgattgcaaccgctggaatacaaat

SEQ ID NO: 210822 - DNA, 75 bp, Artificial Sequence
  Synthetic
cagagggtttgtattagtagttgaaaacttggctaaaaatatctgtgaaaatctagaacaaagtggtttgcccgt

SEQ ID NO: 210823 - DNA, 75 bp, Artificial Sequence
  Synthetic
aggtggaaatgaaaagaaagccaaactgtcaaatgcagtggccaaaatgctcagcaactgcccaccaggagggat

SEQ ID NO: 210824 - DNA, 75 bp, Artificial Sequence
  Synthetic
atcaatacaagggtatgacatgaccaaagcctgtttcaagggagacagaataaatagccccaaaactttcagcat

SEQ ID NO: 210825 - DNA, 75 bp, Artificial Sequence
  Synthetic
cagcatgacagtaacaggagataatactaaatggaatgaatgcttaaatccaagaatctttttggctatgactga

SEQ ID NO: 210826 - DNA, 75 bp, Artificial Sequence
  Synthetic
tggaactcaagaagggaaactagtaaaaggatcctttggaaaagcactaagagtaatatttactaaatgcttgat

SEQ ID NO: 210827 - DNA, 75 bp, Artificial Sequence
  Synthetic
aagaataaccagagacagcccaatttggttccgggatttttgtagtatagcaccggtcttattctccaataaaat

SEQ ID NO: 210828 - DNA, 75 bp, Artificial Sequence
  Synthetic
ccatggctctttacaatatggcaacacctgtttccatactgagaatgggagatgatgcaaaagataaatcgcaat

SEQ ID NO: 210829 - DNA, 75 bp, Artificial Sequence
  Synthetic
caccggtcttattctccaataaaatagccagactgggaaaaggatttatgataacaagtaaaacaaaaagactga

SEQ ID NO: 210830 - DNA, 75 bp, Artificial Sequence
  Synthetic
ataacaagtaaaacaaaaagactgaaggctcaaataccttgccctgatctgtttagcataccattagaaagatat

SEQ ID NO: 210831 - DNA, 75 bp, Artificial Sequence
  Synthetic
aatgaagaaacaagagcaaaattaagaaagctgaaaccattcttcaatgaagaaggaacggcatctttgtcgcct

SEQ ID NO: 210832 - DNA, 75 bp, Artificial Sequence
  Synthetic
ggaatgatgatgggaatgtttaacatgctatctaccgtgttgggagtagccgcactaggtatcaaaaacattgga

SEQ ID NO: 210833 - DNA, 75 bp, Artificial Sequence
  Synthetic
aacaaagaatacttatgggatggactgcaatcttctgatgattttgctctgtttgttaatgcaaaagatgaagag

SEQ ID NO: 210834 - DNA, 75 bp, Artificial Sequence
  Synthetic
gcatgtatggaagggataaacgacttttaccgaacatgcaaattattgggaataaatatgagcaaaaagaaaagt

SEQ ID NO: 210835 - DNA, 75 bp, Artificial Sequence
  Synthetic
ccaattaagcagaccatccccaatttcttctttgggagggacacagcagaggattatgatgacctcgattattaa

SEQ ID NO: 210836 - DNA, 75 bp, Artificial Sequence
  Synthetic
cagcaacagcacaaacagccatacaattgttcatagctgattatagatacacctacaaatgccacaggggagatt

SEQ ID NO: 210837 - DNA, 75 bp, Artificial Sequence
  Synthetic
ccaaagtggaaggaaaaagaatgaaaattataaaggagctatgggaaaacactaaaggaagagatggtctgttag

SEQ ID NO: 210838 - DNA, 75 bp, Artificial Sequence
  Synthetic
tggcagatggtgggcccaacatttacaatttgagaaacttgcatatcccagaaatagtgttgaagtacaatctaa

SEQ ID NO: 210839 - DNA, 75 bp, Artificial Sequence
  Synthetic
gaaatagtgttgaagtacaatctaatggaccctgaatacaaagggcgattgcttcaccctcaaaatccctttgta

SEQ ID NO: 210840 - DNA, 75 bp, Artificial Sequence
  Synthetic
attggatacatataagcttcgaagatgtttatggggttattggtcatcattgaatacatgcgatacataaatgat

SEQ ID NO: 210841 - DNA, 75 bp, Artificial Sequence
  Synthetic
tggtcccgtgaagaaaatggattatgatgcagtatctgggactcatagctggagaactaaaaggaacagatctat

SEQ ID NO: 210842 - DNA, 75 bp, Artificial Sequence
  Synthetic
actaaatactgatcagaggaacatgattcttgaggaacaatgctacgctaagtgttgcaacctttttgaggcctg

SEQ ID NO: 210843 - DNA, 75 bp, Artificial Sequence
  Synthetic
ttttaacagtgcatcatacaggaaaccagtaggtcagcacagcatgcttgaagctatggcccatagattaagaat

SEQ ID NO: 210844 - DNA, 75 bp, Artificial Sequence
  Synthetic
gattggatacacataagctccgaagatgtctatggggttattggtcatcattggatacatgtgacaaacaaatga

SEQ ID NO: 210845 - DNA, 75 bp, Artificial Sequence
  Synthetic
aagctccgaagatgtctatggggttattggtcatcattggatacatgtgacaaacaaatgattaaaatgaaaaaa

SEQ ID NO: 210846 - DNA, 75 bp, Artificial Sequence
  Synthetic
cttctcaaaaaactgaggcaaataggccaaaaatgaacaatgctaccttcaactatacaaacgttaaccctattt

SEQ ID NO: 210847 - DNA, 75 bp, Artificial Sequence
  Synthetic
aactatacaaacgttaaccctatttctcacatcagggggagtgttattatcactatatgtgtcagcttcattgtc

SEQ ID NO: 210848 - DNA, 75 bp, Artificial Sequence
  Synthetic
atacttactatattcggatatattgctaaaattttcacagacagaaataactgcaccaataatgccattggattg

SEQ ID NO: 210849 - DNA, 75 bp, Artificial Sequence
  Synthetic
tacaaacgcatcaaatgttcaggctgtgaatcgttctgcagcaaaaggggtgacacttcttctcccagaaccgga

SEQ ID NO: 210850 - DNA, 75 bp, Artificial Sequence
  Synthetic
ttgataataagggaaccttttattgcttgtggaccaacggaatgcaaacactttgctctaacccattatgcagct

SEQ ID NO: 210851 - DNA, 75 bp, Artificial Sequence
  Synthetic
aaaatcccaacagtagaaaactccattttccacatggcagcttggagcgggtccgcatgccatgatggtaaagaa

SEQ ID NO: 210852 - DNA, 75 bp, Artificial Sequence
  Synthetic
tggacatatatcggagttgatggccccgacagtaatgcattgctcaaaataaaatatggagaagcatatactgac

SEQ ID NO: 210853 - DNA, 75 bp, Artificial Sequence
  Synthetic
ggttaagtctgttttaaaccctttattcctgttttgtttgaacaattgtccttactaaacttaattgtttctgaa

SEQ ID NO: 210854 - DNA, 75 bp, Artificial Sequence
  Synthetic
acgtaccattcctatgcaaaaaacatcctaaggacacaagaaagtgcctgcaattgcatcgggggagattgttat

SEQ ID NO: 210855 - DNA, 75 bp, Artificial Sequence
  Synthetic
cttatgataactgatggcccagcttcaggggttagtgaatgcagattccttaagattcgagaaggcagaataata

SEQ ID NO: 210856 - DNA, 75 bp, Artificial Sequence
  Synthetic
aaagaaatatttccaacaggaagagtaaaacatactgaggaatgcacatgcggatttgccagcaacaaaaccata

SEQ ID NO: 210857 - DNA, 75 bp, Artificial Sequence
  Synthetic
gaatgtgcttgtagagataaccgttacacagcaaaaagaccctttgtcaaattaaatgtggagactgatacagcg

SEQ ID NO: 210858 - DNA, 75 bp, Artificial Sequence
  Synthetic
gacagttgagtctatggggtgggccttgagctaatataaatttatccattaattcaatgaacgcaattgagtgaa

SEQ ID NO: 210859 - DNA, 75 bp, Artificial Sequence
  Synthetic
gaaataagattgatgtgcacagagacttatttggacacccccagaccaaatgatggaagcataacagggccttgc

SEQ ID NO: 210860 - DNA, 75 bp, Artificial Sequence
  Synthetic
cttatttggacacccccagaccaaatgatggaagcataacagggccttgcgaatctgatggggacaaagggagtg

SEQ ID NO: 210861 - DNA, 75 bp, Artificial Sequence
  Synthetic
aaattcaattttactgtatttcttactatgcatttaagcaaattgtaatcaatgtcagcaaataaactggaaaaa

SEQ ID NO: 210862 - DNA, 75 bp, Artificial Sequence
  Synthetic
gaggcatcaagggaggatttgttcatcaaagaatggcatccaagattggaaggtggtactctcgaacgatgtcta

SEQ ID NO: 210863 - DNA, 75 bp, Artificial Sequence
  Synthetic
aaaccaaaagaatggggatgggactgtatgtaaagtatgatggagacccatggactgacagtgaagcccttgctc

SEQ ID NO: 210864 - DNA, 75 bp, Artificial Sequence
  Synthetic
ttagtggagtaatggtttcaatggaagaacctggttggtattcctttggcttcgaaataaaagataagaaatgtg

SEQ ID NO: 210865 - DNA, 75 bp, Artificial Sequence
  Synthetic
atgtcccctgtattgggatagaaatggtacatgatggtgggaaaacgacttggcactcagcagcaacagccattt

SEQ ID NO: 210866 - DNA, 75 bp, Artificial Sequence
  Synthetic
ggtacatgatggtgggaaaacgacttggcactcagcagcaacagccatttattgtttaatgggctcaggacaatt

SEQ ID NO: 210867 - DNA, 75 bp, Artificial Sequence
  Synthetic
tttctaatatccacaaaatgaaggcaataattgtactactcatggtagtaacatccaatgcagatcgaatctgca

SEQ ID NO: 210868 - DNA, 75 bp, Artificial Sequence
  Synthetic
aatggctcaccttggtgagattgggtacatataagcttcgaagatgtttatggggttattggtcatcattgaata

SEQ ID NO: 210869 - DNA, 75 bp, Artificial Sequence
  Synthetic
tcatgtggtcaaaacagctactcaaggggaggtcaatgtgactggtgtgataccactaacaacaacaccaacaaa

SEQ ID NO: 210870 - DNA, 75 bp, Artificial Sequence
  Synthetic
attgggtacatataagcttcgaagatgtttatggggttattggtcatcattgaatacatgcgatacacaaatgat

SEQ ID NO: 210871 - DNA, 75 bp, Artificial Sequence
  Synthetic
cctaactatatgcggcaggatgatgtcattaaaagggaaaattgaagatgaagaaaggaatagatcaatggggaa

SEQ ID NO: 210872 - DNA, 75 bp, Artificial Sequence
  Synthetic
atcttattttgcaaatctcaaaggaacaaagaccagagggaaactatgcccagactgtctcaactgtacagatct

SEQ ID NO: 210873 - DNA, 75 bp, Artificial Sequence
  Synthetic
ggatgtggccttgggcaggccaatgtgtgtgggaactacaccatctgcgaaagcttcaatacttcacgaagtcag

SEQ ID NO: 210874 - DNA, 75 bp, Artificial Sequence
  Synthetic
acctgttacatccgggtgcttccctataatgcacgacagaacaaaaatcaggcaactagccaatcttctcagagg

SEQ ID NO: 210875 - DNA, 75 bp, Artificial Sequence
  Synthetic
accagtaaaagcggatttttcgcaacaatggcttgggctgtcccaaaggacaacaacaaaaatgcaacgaaccca

SEQ ID NO: 210876 - DNA, 75 bp, Artificial Sequence
  Synthetic
agggagagtgctaagcagactcacggaacttcaagctgaattaagtctgaaaaacctatggcaagttctcatagg

SEQ ID NO: 210877 - DNA, 75 bp, Artificial Sequence
  Synthetic
gtgcagaaggagaagaccaaattactgtttgggggttccattcagataacaaaacccaaatgaagaacctctatg

SEQ ID NO: 210878 - DNA, 75 bp, Artificial Sequence
  Synthetic
gtgtggtgcgcgagtggcaggagcaaagtaataaaagggtccttgcctttaattggtgaagcagattgccttcat

SEQ ID NO: 210879 - DNA, 75 bp, Artificial Sequence
  Synthetic
gaaaaatacggtggattaaacaaaagcaagccttactacacaggagaacatgcaaaagccataggaaattgccca

SEQ ID NO: 210880 - DNA, 75 bp, Artificial Sequence
  Synthetic
tgcaaaagccataggaaattgcccaatatgggtgaaaacacctttgaagcttgccaatggaaccaaatatagacc

SEQ ID NO: 210881 - DNA, 75 bp, Artificial Sequence
  Synthetic
tgtctgcttcaatcaatgcaacaaatggaagcaattgttgaacaagaatcctcgatacaaggatacgacatgacc

SEQ ID NO: 210882 - DNA, 75 bp, Artificial Sequence
  Synthetic
ttgccaatggaaccaaatatagacctcctgcaaaactattaaaggaaaggggtttcttcggagctattgctggtt

SEQ ID NO: 210883 - DNA, 75 bp, Artificial Sequence
  Synthetic
agaagctataaacaagataacaaaaaatctcaactctttgagtgagctagaagtaaagaatcttcaaaggctaag

SEQ ID NO: 210884 - DNA, 75 bp, Artificial Sequence
  Synthetic
tggtgccatggatgaactccacaacgaaatactcgagctggatgagaaagtggatgatctcagagctgacactat

SEQ ID NO: 210885 - DNA, 75 bp, Artificial Sequence
  Synthetic
tggatgatctcagagctgacactataagttcacaaatagaacttgcagtcttgctttccaacgaaggaataataa

SEQ ID NO: 210886 - DNA, 75 bp, Artificial Sequence
  Synthetic
acaagggtggattggtacccttttgccaagatataattgattcattagacaagcctgaaatgactttcttctcag

SEQ ID NO: 210887 - DNA, 75 bp, Artificial Sequence
  Synthetic
ctgggtccctctgctgtagacataggaaatggatgcttcgaaaccaaacacaaatgcaaccagacctgcttagac

SEQ ID NO: 210888 - DNA, 75 bp, Artificial Sequence
  Synthetic
aactgctgcttctagtttggctgtaacattgatgctagctatttttattgtttatatggtctccagagacaacgt

SEQ ID NO: 210889 - DNA, 75 bp, Artificial Sequence
  Synthetic
ttcatgctccatctgtctataaggaagattaggccttgtattttcctttgttgtagtgcttgtttgcttgtcatc

SEQ ID NO: 210890 - DNA, 75 bp, Artificial Sequence
  Synthetic
ggaagattaggccttgtattttcctttgttgtagtgcttgtttgcttgtcatcattacaaagaaacgttattgaa

SEQ ID NO: 210891 - DNA, 75 bp, Artificial Sequence
  Synthetic
atgacattggctaaaattgaattgttaaaacaactgttaagggacaatgaagccaaaacagtgctgaaacaaaca

SEQ ID NO: 210892 - DNA, 75 bp, Artificial Sequence
  Synthetic
tggctttgaccaagggtgacatggcaaacagaatccccttggaatacaaggggatacaacttaaaacaaatgctg

SEQ ID NO: 210893 - DNA, 75 bp, Artificial Sequence
  Synthetic
aagacataggaacaaaaggccaaatgtgctcaatagcagcagttacctggtggaatacatatggaccaataggag

SEQ ID NO: 210894 - DNA, 75 bp, Artificial Sequence
  Synthetic
gctcaccttggtgagattgggtacatataagcttcgaagatgtttatggagttattggtcatcattgaatacatg

SEQ ID NO: 210895 - DNA, 75 bp, Artificial Sequence
  Synthetic
aaagaagggcctgattctggctgagagaaaaatgagaaaatgtgtgagcttccatgaagcatttgaaatagcaga

SEQ ID NO: 210896 - DNA, 75 bp, Artificial Sequence
  Synthetic
gaataacttttggcccagttgaaagagtaagaaaaagggtactgctaaaccctctcaccaaggaaatgcctccag

SEQ ID NO: 210897 - DNA, 75 bp, Artificial Sequence
  Synthetic
atgaagcaagtaatgtgataatggaaatattgttccctaaagaagcagggataccaagagaatctacttggatac

SEQ ID NO: 210898 - DNA, 75 bp, Artificial Sequence
  Synthetic
tacactgcttacaaggtgaaaattggaggcaaatatatcacccgggagggaataaactaactgaatctagatctc

SEQ ID NO: 210899 - DNA, 75 bp, Artificial Sequence
  Synthetic
agatttggacgacttgaactaaagagaatatcaggaagaggattcaaaaatgatgaagaaatattaatcgggaac

SEQ ID NO: 210900 - DNA, 75 bp, Artificial Sequence
  Synthetic
ggaacaatacagaagattggaatatgggacggagaagaggagttccatgtgagatgtggagaatgcagaggaata

SEQ ID NO: 210901 - DNA, 75 bp, Artificial Sequence
  Synthetic
ttaaaaaagagcaaaatgagaatggaaaaactactaataaattcagctaagaaggaggacatgaaagatttaata

SEQ ID NO: 210902 - DNA, 75 bp, Artificial Sequence
  Synthetic
aaaaactactaataaattcagctaagaaggaggacatgaaagatttaataatcttgtgcatggtattttctcaag

SEQ ID NO: 210903 - DNA, 75 bp, Artificial Sequence
  Synthetic
caagtgagctacatgggataaatgaactaatgaatgcatctgactacactttgaaaggggttgtagtaacaaaaa

SEQ ID NO: 210904 - DNA, 75 bp, Artificial Sequence
  Synthetic
ttgaaaggggttgtagtaacaaaaaatgtgattgatgattttagttctactgaaacagaaaaagtatctataaca

SEQ ID NO: 210905 - DNA, 75 bp, Artificial Sequence
  Synthetic
tgaaacagaaaaagtatctataacaaaaaatcttagtttaataaaaaggactggggaggtcataatgggagccaa

SEQ ID NO: 210906 - DNA, 75 bp, Artificial Sequence
  Synthetic
ctggggaggtcataatgggagccaatgatgtaagtgaattagaatcacaagcacagctaatgataatatatgata

SEQ ID NO: 210907 - DNA, 75 bp, Artificial Sequence
  Synthetic
aaccaaagaactggtgcagaacacctatcaatgggtgatgaaaaatttggtgacactgaaggctcagtttcttct

SEQ ID NO: 210908 - DNA, 75 bp, Artificial Sequence
  Synthetic
ggattatgatgacctcgattattaaatcaacaaaatagacactatgactgtgattgtttcaatacgtttggaatg

SEQ ID NO: 210909 - DNA, 75 bp, Artificial Sequence
  Synthetic
agggaaagaagacatgttccaatgggatgcatttgaagcatttgaaagcataatcccccagaagatggccggcca

SEQ ID NO: 210910 - DNA, 75 bp, Artificial Sequence
  Synthetic
gttgttgcccttttgtttctcaccaccaaagctaaggagcaatggggagccttatcagttcctgaggcttgtatt

SEQ ID NO: 210911 - DNA, 75 bp, Artificial Sequence
  Synthetic
taactgatggctcagcttcaggtgttagtgaatgcagatttcttaagattcgagagggccgaataatgaaagaaa

SEQ ID NO: 210912 - DNA, 75 bp, Artificial Sequence
  Synthetic
gaagggaggaggagaaaatttcatcgaagtaaggaaagggtcccctctattctcttacaatccacaaacagaagt

SEQ ID NO: 210913 - DNA, 75 bp, Artificial Sequence
  Synthetic
agtggcaagtatgacccagatcttggagatttcaaaaccattgaagaacttgaaaagctaaaaccaggggagaaa

SEQ ID NO: 210914 - DNA, 75 bp, Artificial Sequence
  Synthetic
tgcattaaattcaatttttactgtacttcttactatgcatttaagcaaattgtaaccaatgtcagcaaataaact

SEQ ID NO: 210915 - DNA, 75 bp, Artificial Sequence
  Synthetic
ttatccaatgacatttcacaaggaattaagagacaaagaatgacagttgagtccatggggtgggccttgagctaa

SEQ ID NO: 210916 - DNA, 75 bp, Artificial Sequence
  Synthetic
gaagatcctgaattgcaaccagcaatgctattcaatatctgcgtccatctagaggtttgctatgtaataagtgac

SEQ ID NO: 210917 - DNA, 75 bp, Artificial Sequence
  Synthetic
aactcacctcatgtggtcaaaacagctactcaaggggaggtcaatgtgactggtgtgataccactgacaacaaca

SEQ ID NO: 210918 - DNA, 75 bp, Artificial Sequence
  Synthetic
agaggtttgctatgtaataagtgacatgaattttcttgacgaagaaggaaaagcatatacagcattagaaggaca

SEQ ID NO: 210919 - DNA, 75 bp, Artificial Sequence
  Synthetic
atgaattttcttgacgaagaaggaaaagcatatacagcattagaaggacaagggaaagaacaaaacttgagacca

SEQ ID NO: 210920 - DNA, 75 bp, Artificial Sequence
  Synthetic
gagatccttagctcaagagcatggaatagagactcccaagtatctggctgatttgtttgattataaaaccaaaag

SEQ ID NO: 210921 - DNA, 75 bp, Artificial Sequence
  Synthetic
atttatagaagttggaataacaaagggattggctgatgattacttttggaaaaagaaagaaaaattgggaaatag

SEQ ID NO: 210922 - DNA, 75 bp, Artificial Sequence
  Synthetic
aatcctcattggatgaggaagggaaagggagagtgctaagcagactcacagaacttcaggctgaattaagtctga

SEQ ID NO: 210923 - DNA, 75 bp, Artificial Sequence
  Synthetic
aaaatttatggcaagttctcataggagaagaagatgttgaaaagggaattgattttaaacttggacagacaatat

SEQ ID NO: 210924 - DNA, 75 bp, Artificial Sequence
  Synthetic
tcagtcacacctaaaaagttaacatgggaggacctaagaccaatagggcctcacatttacgaccatgagctacca

SEQ ID NO: 210925 - DNA, 75 bp, Artificial Sequence
  Synthetic
agaaaaattgaaaggaacgatgataactcccattgtactggcatacatgctcgagagggaattagttgccaggag

SEQ ID NO: 210926 - DNA, 75 bp, Artificial Sequence
  Synthetic
gaagttccatataatgcctttcttctaatgtctgatgaactaggattggccaatatgactgagggaaagtccaaa

SEQ ID NO: 210927 - DNA, 75 bp, Artificial Sequence
  Synthetic
tcaaacccattggagctagctgtagaaattgcaaataagaccgtgatagatactgaacctttaaaatcatgtctg

SEQ ID NO: 210928 - DNA, 75 bp, Artificial Sequence
  Synthetic
aaaaatcttagtttaataaaaaggactggggaagtcataatgggagccaatgacgtaagtgaattagaatcacaa

SEQ ID NO: 210929 - DNA, 75 bp, Artificial Sequence
  Synthetic
ggatggattaacataccagaaaataatgaaagaagtagcaatagatgacgaaacaatgtgccaagaagagcctaa

SEQ ID NO: 210930 - DNA, 75 bp, Artificial Sequence
  Synthetic
aatccctaacaaatgtagagtggctgcttgggttcaaacagagatgaatctattgagcactctgacaagtaaaag

SEQ ID NO: 210931 - DNA, 75 bp, Artificial Sequence
  Synthetic
gcttgggttcaaacagagatgaatctattgagcactctgacaagtaaaagagctctggacctaccagaaataggg

SEQ ID NO: 210932 - DNA, 75 bp, Artificial Sequence
  Synthetic
agctctggacctaccagaaatagggccagacatagcacccgtagagcatgtaggaagtgaaagaaggaaatactt

SEQ ID NO: 210933 - DNA, 75 bp, Artificial Sequence
  Synthetic
tacaaagtaataccaataaccaacagagtagtaaatgaaaaaggagaaagtttcgacatgctttacggtctggcg

SEQ ID NO: 210934 - DNA, 75 bp, Artificial Sequence
  Synthetic
aactttcgaatttagtagtacagatccaagagtggactcaggaaagtggccaaaatatactgtgtttaggattgg

SEQ ID NO: 210935 - DNA, 75 bp, Artificial Sequence
  Synthetic
gtgatacagagtgcatactggttcaatgaatggttgggctttgaaaaggaagggagtagggtattggaatcagta

SEQ ID NO: 210936 - DNA, 75 bp, Artificial Sequence
  Synthetic
gaaatggggaatggaagctagaagatgtttgcttcaatcaatgcaacaaatggaggcaattgttgaacaggaatc

SEQ ID NO: 210937 - DNA, 75 bp, Artificial Sequence
  Synthetic
caaataataactgtcagaaacacaattggaccgattacccttcaacaccagggaggtgccttgatgacatagaag

SEQ ID NO: 210938 - DNA, 75 bp, Artificial Sequence
  Synthetic
tgtttgcttcaatcaatgcaacaaatggaggcaattgttgaacaggaatcatcaatacaaggatatgacatgacc

SEQ ID NO: 210939 - DNA, 75 bp, Artificial Sequence
  Synthetic
atcaatacaaggatatgacatgaccaaagcctgtttcaagggagacagagtaaatagccccaaaactttcagtat

SEQ ID NO: 210940 - DNA, 75 bp, Artificial Sequence
  Synthetic
aaagcctgtttcaagggagacagagtaaatagccccaaaactttcagtattggaactcaagaaggaaaactagta

SEQ ID NO: 210941 - DNA, 75 bp, Artificial Sequence
  Synthetic
ttggaggggtttagtgccgagtctaggagacttctactgttgattcaagcattaaaggacagaaagggtccttgg

SEQ ID NO: 210942 - DNA, 75 bp, Artificial Sequence
  Synthetic
gtgttcgacttagagggaatgtattctggaatagaagaatgtattagcaacaacccttgggtgatacagagtgta

SEQ ID NO: 210943 - DNA, 75 bp, Artificial Sequence
  Synthetic
ctggaatagaagaatgtattagcaacaacccttgggtgatacagagtgtatactggttcaatgaatggttgggct

SEQ ID NO: 210944 - DNA, 75 bp, Artificial Sequence
  Synthetic
tactggttcaatgaatggttgggctttgaaaaggaggggagtaaagtgttggaatcagtggatgaaataatggat

SEQ ID NO: 210945 - DNA, 75 bp, Artificial Sequence
  Synthetic
ttcaatgaatggttgggctttgaaaaggaggggagtaaagtgttggaatcagtggatgaaataatggatgaataa

SEQ ID NO: 210946 - DNA, 75 bp, Artificial Sequence
  Synthetic
atggcgaacaacaacatgaccacaacacaaattgaggtgggtccgggagcaaccaatgccaccataaactttgaa

SEQ ID NO: 210947 - DNA, 75 bp, Artificial Sequence
  Synthetic
cacaaattgaggtgggtccgggagcaaccaatgccaccataaactttgaagcaggaattctggagtgctatgaaa

SEQ ID NO: 210948 - DNA, 75 bp, Artificial Sequence
  Synthetic
gcaggaattctggagtgctatgaaaggctttcatggcaaagagcccttgactaccccggtcaagaccgcctaaac

SEQ ID NO: 210949 - DNA, 75 bp, Artificial Sequence
  Synthetic
gaataaagactcacaacaaaagtgagcctgaaagtaaaaggatgtcccttgaagagagaaaagcaattggagtaa

SEQ ID NO: 210950 - DNA, 75 bp, Artificial Sequence
  Synthetic
ataccaagagaatctacttggatacatagagaactgataaaagaaaaaagagaaaaattgaaaggaacgatgata

SEQ ID NO: 210951 - DNA, 75 bp, Artificial Sequence
  Synthetic
aaatgatgaaagtactcctatttatgaatccgtctgctggaattgaagggtttgagccatactgtatgaacagtt

SEQ ID NO: 210952 - DNA, 75 bp, Artificial Sequence
  Synthetic
cctcaaatagcaactgtacgaaatacaattggaccgattacccttcaacaccagagaggtgccttgatgacatag

SEQ ID NO: 210953 - DNA, 75 bp, Artificial Sequence
  Synthetic
agcagaagcacgcactttcttaaaatgtcgctgtttggagacacaattgcctacctgctttcactaatagaagat

SEQ ID NO: 210954 - DNA, 75 bp, Artificial Sequence
  Synthetic
ccagagaggtgccttgatgacatagaggaagaaccagaggatgttgatggcccaactgaaatagtattaagggac

SEQ ID NO: 210955 - DNA, 75 bp, Artificial Sequence
  Synthetic
ggagaaggcaaagcagaactagctgaaaaattacactgttggttcggtgggaaagaatttgacctagattctgct

SEQ ID NO: 210956 - DNA, 75 bp, Artificial Sequence
  Synthetic
ttggaatggataaaaaacaaaaggtgcctaactgatatacaaaaagcactaattggtgcctctatatgcttttta

SEQ ID NO: 210957 - DNA, 75 bp, Artificial Sequence
  Synthetic
ataaaaagggatatgcgtaatgtattgtccttgagagtgttggtaaatggaacattcctcaaacaccccaatgga

SEQ ID NO: 210958 - DNA, 75 bp, Artificial Sequence
  Synthetic
aaacccaaagaccaagaaagaaaaaggagattcatcacagagcccctgtcaggaatgggaacaacagcaacaaag

SEQ ID NO: 210959 - DNA, 75 bp, Artificial Sequence
  Synthetic
aagaaaggcctaattctagctgagagaaaaatgagaagatgtgtaagctttcatgaagcatttgaaatagcagaa

SEQ ID NO: 210960 - DNA, 75 bp, Artificial Sequence
  Synthetic
ggccacgaaagctcagcattactatattgtcttatggtcatgtacctaaaccctgaaaactattcaatgcaagta

SEQ ID NO: 210961 - DNA, 75 bp, Artificial Sequence
  Synthetic
aaactaggaacgctctgtgctttatgcgagaaacaagcatcgcactcgcatagagcccatagcagagcagcaagg

SEQ ID NO: 210962 - DNA, 75 bp, Artificial Sequence
  Synthetic
ctgaaactgcggtgggagtcttatcccaatttggtcaagagcaccgattatcaccagaagagggagacaattaga

SEQ ID NO: 210963 - DNA, 75 bp, Artificial Sequence
  Synthetic
tcaccagaagagggagacaattagactggtcacggaagaactttatcttttaagtaaaagaattgatgataacat

SEQ ID NO: 210964 - DNA, 75 bp, Artificial Sequence
  Synthetic
tcttcggtacctggagtaagacgagaaatgcagatggtttcagctatgaacacagcaaagacaatgaatggaatg

SEQ ID NO: 210965 - DNA, 75 bp, Artificial Sequence
  Synthetic
taagtaaaagaattgatgataacatactattccacaaaacagtgatagctaacagctccataatagctgacatgg

SEQ ID NO: 210966 - DNA, 75 bp, Artificial Sequence
  Synthetic
ggaaagggagaagacgtccaaaaactagcagaagagctgcaaaacaacattggagtgttgagatctctaggagca

SEQ ID NO: 210967 - DNA, 75 bp, Artificial Sequence
  Synthetic
atcattattagaaacattgtatgaaatgaaggatgtggttgaagtgtacagcaggcagtgcttgtgaatttaaaa

SEQ ID NO: 210968 - DNA, 75 bp, Artificial Sequence
  Synthetic
tttcttgtgaacttcaagcaccagtaaaagaactgaaaatcaaaatgtccaacatggatatcgacggtatgaaca

SEQ ID NO: 210969 - DNA, 75 bp, Artificial Sequence
  Synthetic
agtcaaaagaatggagaaggaattgccaaagatgtaatggaagtgctaaaacagagctctatgggaaattcagct

SEQ ID NO: 210970 - DNA, 75 bp, Artificial Sequence
  Synthetic
tgaccacataataattgaggggctttctgccgaagagataataaaaatgggtgaaacagttttggagatagaaga

SEQ ID NO: 210971 - DNA, 75 bp, Artificial Sequence
  Synthetic
ctgggacaattgacaaaacaccggaagaaataacttctggaaccagtgggacaaccagaccaatcattagaccag

SEQ ID NO: 210972 - DNA, 75 bp, Artificial Sequence
  Synthetic
cttgtgaggaaatacttataatgctcgaaccacttcagattctttcaatttgttctttcattttatcagctctcc

SEQ ID NO: 210973 - DNA, 75 bp, Artificial Sequence
  Synthetic
atttcatggcttggacaatagggcatttgaatcaaataaaaagaggggtaaacttgaaaatacaaataaggaatc

SEQ ID NO: 210974 - DNA, 75 bp, Artificial Sequence
  Synthetic
agagcaaccacaagcagtgaagatgatgtcggaaggaaaacccaaaagaagcagaccccgacagagataaagaag

SEQ ID NO: 210975 - DNA, 75 bp, Artificial Sequence
  Synthetic
caaataaggaggcaataaacagagaggtgtcaattctgagacacaattaccaaaaggaaatccaagccaaagaaa

SEQ ID NO: 210976 - DNA, 75 bp, Artificial Sequence
  Synthetic
caatgaagaaaatactctctgacaacatggaagtattgggtgaccacatagtagttgaagggctttcaactgatg

SEQ ID NO: 210977 - DNA, 75 bp, Artificial Sequence
  Synthetic
ggtcaaagctggactcaatgatgacatggagagaaatctaatccaaaatgcgcatgccgtggaaagaattttatt

SEQ ID NO: 210978 - DNA, 75 bp, Artificial Sequence
  Synthetic
agataataaaaatgggtgaaacagttttggaggtggaagaattgcaatgagcccaattttcactgtatttcttac

SEQ ID NO: 210979 - DNA, 75 bp, Artificial Sequence
  Synthetic
gagttccagaagaaaaagaatgccagagatgtcaaagaagggaaggaagaaatagatcacaacaaaacaggaggc

SEQ ID NO: 210980 - DNA, 75 bp, Artificial Sequence
  Synthetic
atttcttactatgcatttaagcaaattgtaatcaatgtcagtgaataaaactggaaaaagtgcgttgtttctact

SEQ ID NO: 210981 - DNA, 75 bp, Artificial Sequence
  Synthetic
aatagatcacaacaaaacaggaggcaccttttacaagatggtaagagatgataaaaccatctatttcagccctat

SEQ ID NO: 210982 - DNA, 75 bp, Artificial Sequence
  Synthetic
aaatagacaatatgactgtgattgtttcaatacgtttggaatgtgggtgtttattcttattaaaataaatataaa

SEQ ID NO: 210983 - DNA, 75 bp, Artificial Sequence
  Synthetic
gatcaaaggcactaaaaagagttggacttgatccttcattaatcagtacctttgcgggaagcacagtccccagaa

SEQ ID NO: 210984 - DNA, 75 bp, Artificial Sequence
  Synthetic
tgaatcagcagatatggcaataggaatgacaataataaagaacaacatgatcaacaatggaatgggtccggcaac

SEQ ID NO: 210985 - DNA, 75 bp, Artificial Sequence
  Synthetic
tttgcgggaagcacagtccccagaagatcaggtgcgactggtgttgcaatcaaaggaggtggaaccttagtggct

SEQ ID NO: 210986 - DNA, 75 bp, Artificial Sequence
  Synthetic
taatggatacttttattacaagaaacttccagactacaataatacaaaaagccaaaaacacaatggcagaattta

SEQ ID NO: 210987 - DNA, 75 bp, Artificial Sequence
  Synthetic
gaaaagattcttctgaatctaaagaacaaatgctctgcgccccaacaaaaggctctagttgatcaagtgatcgga

SEQ ID NO: 210988 - DNA, 75 bp, Artificial Sequence
  Synthetic
agcagaaatccggggattgcagacattgaagatctaaccctgcttgctcgtagtatggtcgttgttaggccctct

SEQ ID NO: 210989 - DNA, 75 bp, Artificial Sequence
  Synthetic
cacaatatgaagtaattgagggaatgccaagaaccatagcatggatggtccagagatccttagctcaagagcatg

SEQ ID NO: 210990 - DNA, 75 bp, Artificial Sequence
  Synthetic
tctatggttgggtacgaagccatggctctttacaatatggcaacacctgtttccatattaagaatgggggatgat

SEQ ID NO: 210991 - DNA, 75 bp, Artificial Sequence
  Synthetic
ccatcaagctccagttttgggctccgatgaccagatctggggggaacgaagtaggtggagacggagggtctggcc

SEQ ID NO: 210992 - DNA, 75 bp, Artificial Sequence
  Synthetic
gaatgaggagctacatagacaatatagacccaaaaggagcaatagagagaaatctagcaaggatgtctcccttag

SEQ ID NO: 210993 - DNA, 75 bp, Artificial Sequence
  Synthetic
aaatagacactatgactgtgattgtttcaatacgtttggaatgtgggtgtttattctcattaaaataaatataaa

SEQ ID NO: 210994 - DNA, 75 bp, Artificial Sequence
  Synthetic
atgtcgctgtttggagacacaattgcctacttgctttcattgacagaagatggagaaggcaaagcagaactagca

SEQ ID NO: 210995 - DNA, 75 bp, Artificial Sequence
  Synthetic
tggagaaggcaaagcagaactagcagaaaagttacactgttggtttggtgggaaagaatttgacctagactctgc

SEQ ID NO: 210996 - DNA, 75 bp, Artificial Sequence
  Synthetic
cttggaatggataaagaacaaaagatgcttaactgatatacaaaaagcactaattggtgcctctatatgcttttt

SEQ ID NO: 210997 - DNA, 75 bp, Artificial Sequence
  Synthetic
aaaacccaaagaccaggaaagaaaaagaagattcatcacagagcccttatcaggaatgggaacaacagcaacaaa

SEQ ID NO: 210998 - DNA, 75 bp, Artificial Sequence
  Synthetic
aaagaaaggcctgattctggctgagagaaaaatgagaagatgtgtgagctttcatgaagcatttgaaatagcaga

SEQ ID NO: 210999 - DNA, 75 bp, Artificial Sequence
  Synthetic
tgcgagaaacaagcatcacattcacacagggctcatagcagagcagcgagatcttcagtgcctggagtgagacga

SEQ ID NO: 211000 - DNA, 75 bp, Artificial Sequence
  Synthetic
gaaatgcagatggtctcagctatgaacacagcaaaaacaatgaatggaatgggaaaaggagaagacgtccaaaag

SEQ ID NO: 211001 - DNA, 75 bp, Artificial Sequence
  Synthetic
ctggcagaagagttgcaaagcaacattggagtgctgagatctcttggggcaagtcaaaagaatggggaagggatt

SEQ ID NO: 211002 - DNA, 75 bp, Artificial Sequence
  Synthetic
tgtgctttttcacacttcattgttgaatgaaagcaatgccagcatgggaaaatacaaagtaataccaataaccaa

SEQ ID NO: 211003 - DNA, 75 bp, Artificial Sequence
  Synthetic
gcaaaggatgtaatggaagtgctaaagcagagctccatgggaaattcagctcttgtgaagaaatatctataatgc

SEQ ID NO: 211004 - DNA, 75 bp, Artificial Sequence
  Synthetic
tcgaaccatttcagattcttacaatttgttcttttatcttatcagctctccatttcatggcttggacaatagggc

SEQ ID NO: 211005 - DNA, 75 bp, Artificial Sequence
  Synthetic
cggttaaaggacaatctcatctgaggggagatactgatgttgtaacagttgtaactttcgaatttagtagtacag

SEQ ID NO: 211006 - DNA, 75 bp, Artificial Sequence
  Synthetic
atttgaatcaaataaaaagaggaataaacatgaaaatacgaataaaaggtccaaacaaagagacaataaacagag

SEQ ID NO: 211007 - DNA, 75 bp, Artificial Sequence
  Synthetic
ccaaacaaagagacaataaacagagaggtatcaattttgagacacagttaccaaaaagaaatccaggccaaagaa

SEQ ID NO: 211008 - DNA, 75 bp, Artificial Sequence
  Synthetic
aggtatcaattttgagacacagttaccaaaaagaaatccaggccaaagaaacaatgaaggaagtgctctctgaca

SEQ ID NO: 211009 - DNA, 75 bp, Artificial Sequence
  Synthetic
acaatgaaggaagtgctctctgacaacatggaggtattgaatgaccacataataattgaggggctttctgccgaa

SEQ ID NO: 211010 - DNA, 75 bp, Artificial Sequence
  Synthetic
gaattgcattaaattcaattttactgtatttcttactatgcatttaagcaaattgtaatcaatgtcagcaaataa

SEQ ID NO: 211011 - DNA, 75 bp, Artificial Sequence
  Synthetic
aataattgtactactcatggtagtaacatccaatgcagatcgaatctgcactgggataacatcgtcaaactcacc

SEQ ID NO: 211012 - DNA, 75 bp, Artificial Sequence
  Synthetic
acatgtcgtcaaaactgctactcaaggggaggtcaatgtgaccggtgtaataccactgacaacaacacccaccaa

SEQ ID NO: 211013 - DNA, 75 bp, Artificial Sequence
  Synthetic
atctcattttgcaaatctcaaaggaacagaaaccagggggaaactatgcccaaaatgcctcaactgcacagatct

SEQ ID NO: 211014 - DNA, 75 bp, Artificial Sequence
  Synthetic
ggacgtagccttgggcagaccaaaatgcacagggaaaataccctcggcaagagtttcaatactccatgaagtcag

SEQ ID NO: 211015 - DNA, 75 bp, Artificial Sequence
  Synthetic
acctgttacatctgggtgctttcctataatgcacgatagaacaaaaattagacagctgcctaaccttctccgagg

SEQ ID NO: 211016 - DNA, 75 bp, Artificial Sequence
  Synthetic
ataatgcacgatagaacaaaaattagacagctgcctaaccttctccgaggatacgaacatatcaggttatcaact

SEQ ID NO: 211017 - DNA, 75 bp, Artificial Sequence
  Synthetic
aatggatgaataaaaggaaatagtactcaatttggtactattttgttcattatgtatctaaacatccaataaaaa

SEQ ID NO: 211018 - DNA, 75 bp, Artificial Sequence
  Synthetic
cacaacgttatcaatgcagaagatgcaccaggaggaccctacaaaattggaacctcagggtcttgccctaacgtt

SEQ ID NO: 211019 - DNA, 75 bp, Artificial Sequence
  Synthetic
accaatggaaacggattcttcgcaacaatggcttgggccgtcccaaaaaacgacaaaaacaaaacagcaacaaat

SEQ ID NO: 211020 - DNA, 75 bp, Artificial Sequence
  Synthetic
ccattaacaatagaagtaccatacatttgtacagaaggagaagaccaaattaccgtttgggggttccactctgac

SEQ ID NO: 211021 - DNA, 75 bp, Artificial Sequence
  Synthetic
aacgagacccaaatggcaaagctctatggggactcaaagccccagaagttcacctcatctgccaacggagtgacc

SEQ ID NO: 211022 - DNA, 75 bp, Artificial Sequence
  Synthetic
atggggactcaaagccccagaagttcacctcatctgccaacggagtgaccacacattacgtttcacagattggtg

SEQ ID NO: 211023 - DNA, 75 bp, Artificial Sequence
  Synthetic
gcttcccaaatcaaacagaagacggaggactaccacaaagtggtagaattgttgttgattacatggtgcaaaaat

SEQ ID NO: 211024 - DNA, 75 bp, Artificial Sequence
  Synthetic
aggactaccacaaagtggtagaattgttgttgattacatggtgcaaaaatctggaaaaacaggaacaattaccta

SEQ ID NO: 211025 - DNA, 75 bp, Artificial Sequence
  Synthetic
tcaaagaggtattttattgcctcaaaaggtgtggtgcgcaagtggcaggagcaaggtaataaaaggatccttgcc

SEQ ID NO: 211026 - DNA, 75 bp, Artificial Sequence
  Synthetic
cttaaaatgtcgctgtttggagacacaattgcctacttgctttcattgacagaagatggagaaggcaaagcagaa

SEQ ID NO: 211027 - DNA, 75 bp, Artificial Sequence
  Synthetic
gaatcagggagaatgtcaaaggatgattttgagaaagcaatggctcaccttggtgagattgggtacatataagct

SEQ ID NO: 211028 - DNA, 75 bp, Artificial Sequence
  Synthetic
tttaattggagaagcagattgcctccacgaaaaatacggtggattaaacaaaagcaagccttactacacagggga

SEQ ID NO: 211029 - DNA, 75 bp, Artificial Sequence
  Synthetic
acatgcaaaggccataggaaattgcccaatatgggtgaaaacacccttgaagctggccaatggaaccaaatatag

SEQ ID NO: 211030 - DNA, 75 bp, Artificial Sequence
  Synthetic
ccaatatgggtgaaaacacccttgaagctggccaatggaaccaaatatagacctcctgcaaaactattaaaggaa

SEQ ID NO: 211031 - DNA, 75 bp, Artificial Sequence
  Synthetic
aggggtttcttcggagctattgctggtttcttagaaggaggatgggaaggaatgattgcaggttggcacggatac

SEQ ID NO: 211032 - DNA, 75 bp, Artificial Sequence
  Synthetic
acatcccatggggcacatggagtagcggtggcagctgaccttaagagcactcaagaggccataaacaagataaca

SEQ ID NO: 211033 - DNA, 75 bp, Artificial Sequence
  Synthetic
aaaaatctcaactctttgagtgagctggaagtaaagaatcttcaaagactaagcggtgccatggatgaactccac

SEQ ID NO: 211034 - DNA, 75 bp, Artificial Sequence
  Synthetic
aacgaaatactagaactagatgagaaagtggatgatctcagagctgatacaataagctcacaaatagaactcgca

SEQ ID NO: 211035 - DNA, 75 bp, Artificial Sequence
  Synthetic
gtcctgctttccaatgaaggaataataaacagtgaagatgaacatctcttggcgcttgaaagaaagctgaagaaa

SEQ ID NO: 211036 - DNA, 75 bp, Artificial Sequence
  Synthetic
atgctgggcccctctgctgtagagatagggaatggatgctttgaaaccaaacacaagtgcaaccagacctgtctc

SEQ ID NO: 211037 - DNA, 75 bp, Artificial Sequence
  Synthetic
gacagaatagctgctggtacctttgatgcaggagaattttctctccccacctttgattcactgaatattactgct

SEQ ID NO: 211038 - DNA, 75 bp, Artificial Sequence
  Synthetic
gcatctttaaatgacgatggattggataatcatactatactgctttactactcaactgctgcctccagtttggct

SEQ ID NO: 211039 - DNA, 75 bp, Artificial Sequence
  Synthetic
gtaacactgatgatagctatctttgttgtttatatggtctccagagacaatgtttcttgctccatctgtctataa

SEQ ID NO: 211040 - DNA, 75 bp, Artificial Sequence
  Synthetic
gggaagttaagccctgtattttcctttattgtagtgcttgtttgcttgttgtcattacaaagaaacgttattgaa

SEQ ID NO: 211041 - DNA, 75 bp, Artificial Sequence
  Synthetic
cttctcaaaactgaagcaaataggccaaaaatgaacaatgctaccttcaactatacaaacgttaaccctatttct

SEQ ID NO: 211042 - DNA, 75 bp, Artificial Sequence
  Synthetic
caaaaatgaacaatgctaccttcaactatacaaacgttaaccctatttctcacatcagggggagtattattatca

SEQ ID NO: 211043 - DNA, 75 bp, Artificial Sequence
  Synthetic
ctatatgtgtcagcttcattatcatacttactatattcggatatattgctaaaattctcaccaacagaaataact

SEQ ID NO: 211044 - DNA, 75 bp, Artificial Sequence
  Synthetic
gcaccaacaatgccattggattgtgcaaacgcatcaaatgttcaggctgtgaaccgttctgcaacaaaaggggtg

SEQ ID NO: 211045 - DNA, 75 bp, Artificial Sequence
  Synthetic
acacttcttctcccagaaccggagtggacatacccgcgtttatcttgcccgggctcaacctttcagaaagcactc

SEQ ID NO: 211046 - DNA, 75 bp, Artificial Sequence
  Synthetic
gggctcaacctttcagaaagcactcctaattagccctcatagattcggagaaaccaaaggaaactcagctccctt

SEQ ID NO: 211047 - DNA, 75 bp, Artificial Sequence
  Synthetic
ttgctctaacccattatgcagcccaaccagggggatactacaatggaacaagaggagacagaaacaagctgaggc

SEQ ID NO: 211048 - DNA, 75 bp, Artificial Sequence
  Synthetic
ccgcgtgccatgatggtaaggaatggacatatatcggagttgatggccctgacaataatgcattgctcaaagtaa

SEQ ID NO: 211049 - DNA, 75 bp, Artificial Sequence
  Synthetic
attgcatcgggggaaattgttatctaatgataactgatggctcagcttcaggtgttagtgaatgcagatttctta

SEQ ID NO: 211050 - DNA, 75 bp, Artificial Sequence
  Synthetic
ggtgttagtgaatgcagatttcttaagattcgagagggccgaataataaaagaaatatttccaacaggaagagta

SEQ ID NO: 211051 - DNA, 75 bp, Artificial Sequence
  Synthetic
aaacacactgaggaatgcacatgcggatttgccagcaataaaaccatagaatgtgcctgtagagacaacaggtac

SEQ ID NO: 211052 - DNA, 75 bp, Artificial Sequence
  Synthetic
acagcaaaaagaccttttgtcaaattaaacgtggagactgatacagcagaaataagattgatgtgcacagatact

SEQ ID NO: 211053 - DNA, 75 bp, Artificial Sequence
  Synthetic
tatttggacacccccagaccaaatgatggaagcataacaggcccttgtgaatctgatggggacaaagggagtgga

SEQ ID NO: 211054 - DNA, 75 bp, Artificial Sequence
  Synthetic
ggcatcaagggaggatttgttcatcaaagaatgaaatccaagattggaaggtggtactctcgaacgatgtctaaa

SEQ ID NO: 211055 - DNA, 75 bp, Artificial Sequence
  Synthetic
actgaaaggatggggatgggactgtatgtcaagtatgatggagacccatgggctgacagtgatgccctagctttt

SEQ ID NO: 211056 - DNA, 75 bp, Artificial Sequence
  Synthetic
agtggagtaatggtttcaatgaaagaacctggttggtattcctttggcttcgaaataaaagataagaaatgcgat

SEQ ID NO: 211057 - DNA, 75 bp, Artificial Sequence
  Synthetic
gtcccctgtattgggatagagatggtacatgatggtggaaaagagacttggcactcagcagcaacagccatttac

SEQ ID NO: 211058 - DNA, 75 bp, Artificial Sequence
  Synthetic
tgtttaatgggctcaggacagctgctgtgggacactgtcacaggtgttgacatggctctgtaatggaggaatggt

SEQ ID NO: 211059 - DNA, 75 bp, Artificial Sequence
  Synthetic
ggttaagtctgttctaaaccctttgttcctgttttgtttgaacaattgtccttactaaacttaattgtttctgaa

SEQ ID NO: 211060 - DNA, 75 bp, Artificial Sequence
  Synthetic
atgaatataaatccttattttctcttcatagatgtgcccgtacaggcagcaatttcaacaacattcccatacact

SEQ ID NO: 211061 - DNA, 75 bp, Artificial Sequence
  Synthetic
tcatagatgtgcccgtacaggcagcaatttcaacaacattcccatacactggtgttcccccttattcccatggaa

SEQ ID NO: 211062 - DNA, 75 bp, Artificial Sequence
  Synthetic
caggaacaggctacacaatagacaccgtgatcagaacgcatgagtactcaaacaaggggaaacagtacatttctg

SEQ ID NO: 211063 - DNA, 75 bp, Artificial Sequence
  Synthetic
gataatgagccgagtgcctatgcgcaattagattgcgttttagaggctttggatagaatggatgaagaacaccca

SEQ ID NO: 211064 - DNA, 75 bp, Artificial Sequence
  Synthetic
ggtctttttcaagcagcctcacagaatgctatggaggccctaatggtcacaactgtagacaaattaacccagggg

SEQ ID NO: 211065 - DNA, 75 bp, Artificial Sequence
  Synthetic
agacagacttttgattggacagtatgcagaaaccaacctgctgcaacggcactgaatacaacaataacctctttt

SEQ ID NO: 211066 - DNA, 75 bp, Artificial Sequence
  Synthetic
tatgaatcaggaagaatgtcaaaggatgactttgagaaagcaatggctcaccttggtgagattggatacacataa

SEQ ID NO: 211067 - DNA, 75 bp, Artificial Sequence
  Synthetic
aggttgaatgatttaaatggagccgacaaaggtggattaatacctttttgccaggatatcattgattcattagac

SEQ ID NO: 211068 - DNA, 75 bp, Artificial Sequence
  Synthetic
cgacctgaaatgactttcttctcagtaaagaatataaagaaaaaattgcctgccaaaaacagaaagggtttcctc

SEQ ID NO: 211069 - DNA, 75 bp, Artificial Sequence
  Synthetic
ataaagaggataccaatgaaggtaaaagacaaaataaccaaagtggaatacatcaaaagagcattatcattaaac

SEQ ID NO: 211070 - DNA, 75 bp, Artificial Sequence
  Synthetic
acaatgacaaaagacgctgaaagaggcaaactgaaaagaagagcgattgccactgctggaatacaaataagaggg

SEQ ID NO: 211071 - DNA, 75 bp, Artificial Sequence
  Synthetic
tttgtattagtagttgaaaacttggctaaaaatatatgtgaaaatctagaacaaagtggtttaccagtaggtgga

SEQ ID NO: 211072 - DNA, 75 bp, Artificial Sequence
  Synthetic
aacgagaagaaagccaaactgtcaaatgcagtggccaaaatgctcagtaactgcccaccaggagggattagcatg

SEQ ID NO: 211073 - DNA, 75 bp, Artificial Sequence
  Synthetic
ctcagaggatatgaaaatatcaggttatcaacccaaaacgttatcgatgcagaaaaagcaccaggaggaccctac

SEQ ID NO: 211074 - DNA, 75 bp, Artificial Sequence
  Synthetic
acagtaacaggagacaatacaaaatggaatgaatgtttaaacccaagaatctttttggccatgactgaaagaata

SEQ ID NO: 211075 - DNA, 75 bp, Artificial Sequence
  Synthetic
ggaatgaatgtttaaacccaagaatctttttggccatgactgaaagaataaccagagacagcccagtttggttca

SEQ ID NO: 211076 - DNA, 75 bp, Artificial Sequence
  Synthetic
gggatttttgtagtatagcaccggtcctgttctccaataagatagcaagattggggaaaggatttatgataacaa

SEQ ID NO: 211077 - DNA, 75 bp, Artificial Sequence
  Synthetic
aaacaagggcaaaattgaaaaagctaaaaccattcttcaatgaagaaggaactgcatctttgtcgcctgggatga

SEQ ID NO: 211078 - DNA, 75 bp, Artificial Sequence
  Synthetic
taaccacacattatgtttctcagattggcggcttcccagatcaaacagaagacggaggactaccacaaagcggca

SEQ ID NO: 211079 - DNA, 75 bp, Artificial Sequence
  Synthetic
actgcatctttgtcgcctgggatgatgatgggaatgtttaatatgctatctaccgtgttgggagtagctgcacta

SEQ ID NO: 211080 - DNA, 75 bp, Artificial Sequence
  Synthetic
gaattgtcgttgattacatgatgcaaaaacctgggaaaacaggaacaattgtctatcaaagaggtgttttgttgc

SEQ ID NO: 211081 - DNA, 75 bp, Artificial Sequence
  Synthetic
ggtatcaagaacattggaaacaaagaatacctatgggatggactgcaatcttctgatgattttgctctatttgtt

SEQ ID NO: 211082 - DNA, 75 bp, Artificial Sequence
  Synthetic
ttctgatgattttgctctatttgttaatgcaaaggatgaagaaacatgtatggaaggaataaacgacttttaccg

SEQ ID NO: 211083 - DNA, 75 bp, Artificial Sequence
  Synthetic
aacatgtaaattattgggaataaacatgagcaaaaagaaaagttactgtaatgagactggaatgtttgaatttac

SEQ ID NO: 211084 - DNA, 75 bp, Artificial Sequence
  Synthetic
aagcatgttctacagagatggatttgtatctaattttgcaatggaactcccttcgtttggggttgctggagtaaa

SEQ ID NO: 211085 - DNA, 75 bp, Artificial Sequence
  Synthetic
tgaatcagcagatatggcaataggaatgacaataataaagaacaacatgatcaacaatggaatgggtccagcaac

SEQ ID NO: 211086 - DNA, 75 bp, Artificial Sequence
  Synthetic
agcacaaacagccatacagctattcatagctgattatagatacacctacaaatgccacaggggagattccaaagt

SEQ ID NO: 211087 - DNA, 75 bp, Artificial Sequence
  Synthetic
agaaggaaagagaatgaaaatcataaaggagttatgggaaaacactaaaggaagagatggtctattagtagcaga

SEQ ID NO: 211088 - DNA, 75 bp, Artificial Sequence
  Synthetic
tggtgggcccaacatttacaatttgagaaacttgcatatcccagaaatagtattaaagtataatctaatggaccc

SEQ ID NO: 211089 - DNA, 75 bp, Artificial Sequence
  Synthetic
tgaatacaaagggcggttacttcatcctcaaaatccctttgtgggacatttgtctattgagggcatcaaagaggc

SEQ ID NO: 211090 - DNA, 75 bp, Artificial Sequence
  Synthetic
agacataactccagcacatggtccagtaaagaaaatggactacgatgcggtgtctggaactcatagttggagaac

SEQ ID NO: 211091 - DNA, 75 bp, Artificial Sequence
  Synthetic
caaaagaaacagatctatactaaacactgatcagaggaacatgattcttgaggaacaatgctacgctaaatgttg

SEQ ID NO: 211092 - DNA, 75 bp, Artificial Sequence
  Synthetic
caacctatttgaggcctgttttaacagtgcatcatacaggaagccagtgggtcaacatagcatgcttgaggctat

SEQ ID NO: 211093 - DNA, 75 bp, Artificial Sequence
  Synthetic
gtcaacatagcatgcttgaggctatggcccacagattaagaatggatgcacgattagattatgaatcagggagaa

SEQ ID NO: 211094 - DNA, 75 bp, Artificial Sequence
  Synthetic
aggaagattaggccttgtattttcctttgttgtagtgcttgtttgcttgtcatcattacaaagaaacgttattga

SEQ ID NO: 211095 - DNA, 75 bp, Artificial Sequence
  Synthetic
tatgaatcagggagaatgtcaaaggatgattttgagaaagcaatggctcaccttggtgagattgggtacatataa

SEQ ID NO: 211096 - DNA, 75 bp, Artificial Sequence
  Synthetic
atgacattagccaaaattgaattgttaaaacaactgctaagggacaatgaggccaaaacagttttgaagcaaaca

SEQ ID NO: 211097 - DNA, 75 bp, Artificial Sequence
  Synthetic
atgtgattgatgattttagttctactgaaacagaaaaagtatctataacaaaaaaccttagtttaataaaaagaa

SEQ ID NO: 211098 - DNA, 75 bp, Artificial Sequence
  Synthetic
ggccaaaacagttttgaagcaaacaacagtagaccaatataacataataagaaaattcaatacatcaaggattga

SEQ ID NO: 211099 - DNA, 75 bp, Artificial Sequence
  Synthetic
aaagaatccttcactaaggatgaagtgggccatgtgttctaactttcccttggctctaaccaagggcgatatggc

SEQ ID NO: 211100 - DNA, 75 bp, Artificial Sequence
  Synthetic
aaacagaatccccttggaatacaaagggatacaacttaaaacaaatgctgaagacataggaaccaaaggccaaat

SEQ ID NO: 211101 - DNA, 75 bp, Artificial Sequence
  Synthetic
aaggtccttagctcaagagcatggaatagagactcctaagtatctggctgatttgtttgattataaaaccaagag

SEQ ID NO: 211102 - DNA, 75 bp, Artificial Sequence
  Synthetic
acactgaaggttttgaaagggtctacgaaagcttttttctcagaaaaatgagacttgacaacgccacttggggcc

SEQ ID NO: 211103 - DNA, 75 bp, Artificial Sequence
  Synthetic
cgaaagcttttttctcagaaaaatgagacttgacaacgccacttggggccggataacttttggcccagttgaaag

SEQ ID NO: 211104 - DNA, 75 bp, Artificial Sequence
  Synthetic
aatattgttccctaaagaagcaggaataccaagagaatccacttggatacatagggaactgataaaagaaaaaag

SEQ ID NO: 211105 - DNA, 75 bp, Artificial Sequence
  Synthetic
ctagactaagggatatatctgttccagctggtttctccaattttgaaggaatgaggagctacatagacaatatag

SEQ ID NO: 211106 - DNA, 75 bp, Artificial Sequence
  Synthetic
agaaaaattgaaaggaacaatgataactccaatcgtactggcatacatgcttgaaagagaactggttgctcgaag

SEQ ID NO: 211107 - DNA, 75 bp, Artificial Sequence
  Synthetic
aagattcttgccagtggcaggagcaacatcagctgagttcatagaaatgctacactgcttacaaggtgaaaattg

SEQ ID NO: 211108 - DNA, 75 bp, Artificial Sequence
  Synthetic
tacactgcttacaaggtgaaaattggagacaaatatatcacccaggagggaataaattaactgagtccaggtctc

SEQ ID NO: 211109 - DNA, 75 bp, Artificial Sequence
  Synthetic
aatcaatgatagtagcttgtaggaaaataatcagaagatcaatagtcgcttcaaacccactggagctagctgtag

SEQ ID NO: 211110 - DNA, 75 bp, Artificial Sequence
  Synthetic
aaattgcaaacaagactgtgatagatactgaacctttaaagtcatgtctggcagccatagacggaggtgatgtag

SEQ ID NO: 211111 - DNA, 75 bp, Artificial Sequence
  Synthetic
gaatatcaggaagaggattcaaaaatgatgaagaaatattaatagggaacggaacaatacagaagattggaatat

SEQ ID NO: 211112 - DNA, 75 bp, Artificial Sequence
  Synthetic
ccggacgtagcacctgtggagcatgtagggagtgaaagaaggaaatactttgttaatgaaatcaactactgtaaa

SEQ ID NO: 211113 - DNA, 75 bp, Artificial Sequence
  Synthetic
gggacggggaagaggagttccatgtaagatgtggtgaatgcaggggaatattaaaaaagagtaaaatgaaactgg

SEQ ID NO: 211114 - DNA, 75 bp, Artificial Sequence
  Synthetic
ttaaaaaagagtaaaatgaaactggaaaaactactgataaattcagccaaaaaggaggatatgagagatttaata

SEQ ID NO: 211115 - DNA, 75 bp, Artificial Sequence
  Synthetic
gcaggccaacttttatctccaatgtaccaactccaacgatattttttgaatagaagcaacgacctttttgatcaa

SEQ ID NO: 211116 - DNA, 75 bp, Artificial Sequence
  Synthetic
tgggggtatgaggaatcacccaaagcaagtgaactacatgggataaatgaatcaatgaatgcatctgactataca

SEQ ID NO: 211117 - DNA, 75 bp, Artificial Sequence
  Synthetic
ttgaaagggattgtagtgacaagaaatgtaattgacgactttagctctactgaaacagaaaaagtatccataaca

SEQ ID NO: 211118 - DNA, 75 bp, Artificial Sequence
  Synthetic
aaaaatcttagcttaataaaaaggactggggaagtcataatgggagctaatgacgtgagtgaattagaatcacaa

SEQ ID NO: 211119 - DNA, 75 bp, Artificial Sequence
  Synthetic
gcacagctgatgataacatatgatacacctaaaatgtgggaaatgggaacaaccaaagaactggtgcaaaacact

SEQ ID NO: 211120 - DNA, 75 bp, Artificial Sequence
  Synthetic
tatcaatgggtgctaaaaaacttggtgacactgaaggctcagtttcttctaggaaaagaggacatgttccaatgg

SEQ ID NO: 211121 - DNA, 75 bp, Artificial Sequence
  Synthetic
gatgcatttgaagcatttgagagcataattcctcagaaaatggctggtcagtacagtggatttgcaagagcagtg

SEQ ID NO: 211122 - DNA, 75 bp, Artificial Sequence
  Synthetic
ctcaaacaaatgagagaccaggaggttatgaaaactgaccagttcataaagttgctgcctttttgtttctcacca

SEQ ID NO: 211123 - DNA, 75 bp, Artificial Sequence
  Synthetic
ttcaatgaatggttgggctttgaaaaggaggggagtaaggtattagaatcagtagatgaaataatggatgaataa

SEQ ID NO: 211124 - DNA, 75 bp, Artificial Sequence
  Synthetic
tgcagtattagcaggctttctcgttagtggcaagtatgacccagatcttggagatttcaaaactattgaagaact

SEQ ID NO: 211125 - DNA, 75 bp, Artificial Sequence
  Synthetic
tgaaaagctgaaaccaggggaaaaggcaaacatcttgctttatcaaggaaaaccagttaaagtagtgaaaaggaa

SEQ ID NO: 211126 - DNA, 75 bp, Artificial Sequence
  Synthetic
aaggtatagtgctttgtccaatgacatttcacaaggaattaagagacaaagaatgacagttgagtctatggggtg

SEQ ID NO: 211127 - DNA, 75 bp, Artificial Sequence
  Synthetic
ttgtccaatgacatttcacaaggaattaagagacaaagaatgacagttgagtctatggggtgggccttgagctaa

SEQ ID NO: 211128 - DNA, 75 bp, Artificial Sequence
  Synthetic
tttgatttatcataatggatacttttattacaagaaacttccagactacaataatacaaaaggccaaaaacacaa

SEQ ID NO: 211129 - DNA, 75 bp, Artificial Sequence
  Synthetic
gcattagaaggacaagggaaagaacaaaacttgagaccacaatatgaagtaattgagggaatgccaagaaccata

SEQ ID NO: 211130 - DNA, 75 bp, Artificial Sequence
  Synthetic
tgatattcagctacaatcaagactactcgttaagtaatgaatcctcattggatgaggaagggaaagggagagtgc

SEQ ID NO: 211131 - DNA, 75 bp, Artificial Sequence
  Synthetic
gatatgacatgaccaaagcctgcttcaagggagacagagtaaataaccccaaaactttcagtattggaactcaag

SEQ ID NO: 211132 - DNA, 75 bp, Artificial Sequence
  Synthetic
atcattattagaaacattgtatgaaatgaaggatgtgattgaagtgtacagcaggcagtgcttgtgaatttaaaa

SEQ ID NO: 211133 - DNA, 75 bp, Artificial Sequence
  Synthetic
aagctttggagagactgtgtaaatacaataagtaatgaggaaacgagtaacgagttacagaaaaccaattatgcc

SEQ ID NO: 211134 - DNA, 75 bp, Artificial Sequence
  Synthetic
aaggaaatagtactcaatttggtactattttgttcattatgtatctaaacatccaataaaaagaaacaagaatca

SEQ ID NO: 211135 - DNA, 75 bp, Artificial Sequence
  Synthetic
tttggaaatgcccaattggaagggtttagtgccgaatctaggagacttctactgttgattcaagcattaaaggac

SEQ ID NO: 211136 - DNA, 75 bp, Artificial Sequence
  Synthetic
gatgaaataatggatgaataaaaggacatagtactcaatttggtactattttgttcattatgtatctaaacatcc

SEQ ID NO: 211137 - DNA, 75 bp, Artificial Sequence
  Synthetic
aacaaggggaaacagtacatttctgatgttacaggatgcacaatggtagatccaacaaatggaccattacccgaa

SEQ ID NO: 211138 - DNA, 75 bp, Artificial Sequence
  Synthetic
gcaaaacaaaaagactgaaggctcaaataccttgtcctgatctgtttagtataccattagaaagatataatgaag

SEQ ID NO: 211139 - DNA, 75 bp, Artificial Sequence
  Synthetic
ctgggacaattgacaaaacaccggaagaaataacttctggaaccagtgggacagcccgaccaatcattagaccgg

SEQ ID NO: 211140 - DNA, 75 bp, Artificial Sequence
  Synthetic
aatatggagaagcatatactgacacataccattcctatgcaaacaaaatcctaagaacacaagaaagtgcctgca

SEQ ID NO: 211141 - DNA, 75 bp, Artificial Sequence
  Synthetic
atgacattagccaaaattgaattgttaaaacaactactaagggacaatgaagccaaaacagttttgaagcaaaca

SEQ ID NO: 211142 - DNA, 75 bp, Artificial Sequence
  Synthetic
cttgtgacataataagagctgcattaggactaaagatcagacaaagacaaagatttggacggcttgagctaaaaa

SEQ ID NO: 211143 - DNA, 75 bp, Artificial Sequence
  Synthetic
ttcttaaaatgtcgctgtttggagacacaattgcctacttgctttcattgacagaagatggagaaggcaaagcag

SEQ ID NO: 211144 - DNA, 75 bp, Artificial Sequence
  Synthetic
agatgaatataaatccttattttctcttcatagatgtgcccgtacaggcagcaatttcaacaacattcccataca

SEQ ID NO: 211145 - DNA, 75 bp, Artificial Sequence
  Synthetic
ttgcattaaattcaattttactgtatttcttactatgcatttaagcaaattgtaatcaatgtcagcaaataaact

SEQ ID NO: 211146 - DNA, 75 bp, Artificial Sequence
  Synthetic
attaaattcaattttactgtatttcttactatgcatttaagcaaattgtaatcaatgtcagcaaataaactggaa

SEQ ID NO: 211147 - DNA, 75 bp, Artificial Sequence
  Synthetic
agcagaagcagagcatattcttagaactgaagtgaacaggccaaaaatgaacaatgctaccttcaactgtacaaa

SEQ ID NO: 211148 - DNA, 75 bp, Artificial Sequence
  Synthetic
cattaaccctattactcacatcagggggagtattattatcactatatgtgtcagcctcattgtcatacttattgt

SEQ ID NO: 211149 - DNA, 75 bp, Artificial Sequence
  Synthetic
attcggatgtattgctaaaattttcatcaacaaaaacaactgcaccaacaatgtcattagagtgcacaaacgcat

SEQ ID NO: 211150 - DNA, 75 bp, Artificial Sequence
  Synthetic
caaatgcccagactgtgaaccattctgcaacaaaagagatgacatttccacccccagagccggagtggacatacc

SEQ ID NO: 211151 - DNA, 75 bp, Artificial Sequence
  Synthetic
ctcgtttatcttgccagggctcaacctttcagaaggcactcctaattagccctcataggttcggagagatcaaag

SEQ ID NO: 211152 - DNA, 75 bp, Artificial Sequence
  Synthetic
gaaactcagctcccttgataataagagaaccttttgttgcttgtggaccaaaagaatgcagacactttgctctga

SEQ ID NO: 211153 - DNA, 75 bp, Artificial Sequence
  Synthetic
cccattatgcagctcagccggggggatactacaatggaacaagaaaggacagaaacaagctgaggcatctagtat

SEQ ID NO: 211154 - DNA, 75 bp, Artificial Sequence
  Synthetic
cagtcaaattgggaaaaatcccaactgtggaaaactccattttccacatggcagcttggagcggatccgcatgcc

SEQ ID NO: 211155 - DNA, 75 bp, Artificial Sequence
  Synthetic
atgatggtagagaatggacatatatcggagttgatggtcctgacaatgatgcattggtcaaaataaaatatggag

SEQ ID NO: 211156 - DNA, 75 bp, Artificial Sequence
  Synthetic
aagcatatactgacacatatcattcctatgcacacaacatcctaagaacacaagaaagtgcctgcaattgcatcg

SEQ ID NO: 211157 - DNA, 75 bp, Artificial Sequence
  Synthetic
ggggagattgttatcttatgataacagacggctcagcttcaggaattagtaaatgcagatttcttaaaattagag

SEQ ID NO: 211158 - DNA, 75 bp, Artificial Sequence
  Synthetic
agggtcgaataataaaagaaatacttccaacaggaagagtggagcacactgaagagtgcacatgcgggttcgcca

SEQ ID NO: 211159 - DNA, 75 bp, Artificial Sequence
  Synthetic
gcaataaaaccatagaatgtgcctgtagagacaacagttacacagcaaaaagaccctttgtcaaattaaatgtgg

SEQ ID NO: 211160 - DNA, 75 bp, Artificial Sequence
  Synthetic
aaactgatacagctgaaataagattgatgtgcacaaagacttatctagacactcccagaccggatgatggaagca

SEQ ID NO: 211161 - DNA, 75 bp, Artificial Sequence
  Synthetic
tagcagggccttgcgaatctaatggagacaagtggcttggaggcatcaaaggaggattcgtccatcaaagaatgg

SEQ ID NO: 211162 - DNA, 75 bp, Artificial Sequence
  Synthetic
catctaagattggaagatggtactcccgaacgatgtctaaaactaacagaatggggatggaactgtatgtaaagt

SEQ ID NO: 211163 - DNA, 75 bp, Artificial Sequence
  Synthetic
atgatggtgacccatggactgacagtgatgctcttactcttagtggagtaatggtttccatagaagaacctggtt

SEQ ID NO: 211164 - DNA, 75 bp, Artificial Sequence
  Synthetic
ggtattcttttggcttcgaaataaaggacaagaaatgtgatgtcccttgtattgggatagagatggtacacgatg

SEQ ID NO: 211165 - DNA, 75 bp, Artificial Sequence
  Synthetic
gtggaaaagatacttggcattcagctgcaacagccatttactgtttgatgggctcaggacaattgctatgggaca

SEQ ID NO: 211166 - DNA, 75 bp, Artificial Sequence
  Synthetic
ctgtcacaggcgttgatatggctttataatagaggaatggttggatctgttctaaaccctttgttcctattttat

SEQ ID NO: 211167 - DNA, 75 bp, Artificial Sequence
  Synthetic
cctttgttcctattttatttgaacagttgttcttactagatttaattgtttctgaaaaatgctcttgttactact

SEQ ID NO: 211168 - DNA, 75 bp, Artificial Sequence
  Synthetic
gattgggtacatataagcttcgaagatgtttatggggttattggtcatcattgaatacatgcgatacacaaatga

SEQ ID NO: 211169 - DNA, 75 bp, Artificial Sequence
  Synthetic
ttaacaggcacagaattcaagcctagatcagcattaaaatgcaagggcttccatgttccagcaaaggaacagata

SEQ ID NO: 211170 - DNA, 75 bp, Artificial Sequence
  Synthetic
aagctttggagagactgtgtaaatacaataagtaatgaggaaatgagtaacgagttacagaaaaccaattatgcc

SEQ ID NO: 211171 - DNA, 75 bp, Artificial Sequence
  Synthetic
agaaggaaatactttgttaatgaaatcaactactgtaaggcctctacagttatgatgaagtatgtgctttttcac

SEQ ID NO: 211172 - DNA, 75 bp, Artificial Sequence
  Synthetic
acaatgacaaaagacgctgaaagaggcaaactaaaaagaagagcgattgccacagctggaatacaaataagagga

SEQ ID NO: 211173 - DNA, 75 bp, Artificial Sequence
  Synthetic
cacagttaccaaaaagaaatccaggccaaagaaacaatgaaggaagtactctctgacaacatggaggtattgaat

SEQ ID NO: 211174 - DNA, 75 bp, Artificial Sequence
  Synthetic
tggggagtgatggcttcagtggactaaatcacataatgattgggcattcacagatgaatgatgtctgtttccaaa

SEQ ID NO: 211175 - DNA, 75 bp, Artificial Sequence
  Synthetic
tctatggttgggtacgaagccatggctctttacaatatggcaacacctgtttccatattaagaatgggagatgat

SEQ ID NO: 211176 - DNA, 75 bp, Artificial Sequence
  Synthetic
ctctttacaatatggcaacacctgtttccatattaagaatgggagatgatgcaaaggataaatcgcaattattct

SEQ ID NO: 211177 - DNA, 75 bp, Artificial Sequence
  Synthetic
gatgatcttacagtggaggatgaagaagatggccatcggatcctcaactcactcttcgagcgtcttaatgaagga

SEQ ID NO: 211178 - DNA, 75 bp, Artificial Sequence
  Synthetic
gataataagggaaccttttattgcttgtggaccaaatgaatgcaaacactttgctctaacccattatgcagccca

SEQ ID NO: 211179 - DNA, 75 bp, Artificial Sequence
  Synthetic
atctaatttcagtcaaattgggcaaaatcccaacagtagaaaactccattttccacatggcagcatggagcgggt

SEQ ID NO: 211180 - DNA, 75 bp, Artificial Sequence
  Synthetic
agtgagaaaaagggtactgctaaaccctctcaccaaggaaatgcctccggatgaggcgagcaatgtgataatgga

SEQ ID NO: 211181 - DNA, 75 bp, Artificial Sequence
  Synthetic
ctcgattattaaatcaacaaaatagacactatgactgtgattgtttcaatacgtttggaatgtgggtgtttattc

SEQ ID NO: 211182 - DNA, 75 bp, Artificial Sequence
  Synthetic
atcataatggatacttttattacaagaaacttccagactacaataatacaaaaggccaaaaacacaatggcagaa

SEQ ID NO: 211183 - DNA, 75 bp, Artificial Sequence
  Synthetic
ccatctagaggtttgctatgtaataagtgacatgaattttcttgacgaagaaggaaaagcatacacagcattaga

SEQ ID NO: 211184 - DNA, 75 bp, Artificial Sequence
  Synthetic
aaatagcatggaactgatgatattcagctacaatcaagactactcgttaagtaatgaatcctcattggatgagga

SEQ ID NO: 211185 - DNA, 75 bp, Artificial Sequence
  Synthetic
gaagtaaggaaagggtcccctctattttcctataatccacaaacagaagtcctaactatatgcggcagaatgatg

SEQ ID NO: 211186 - DNA, 75 bp, Artificial Sequence
  Synthetic
cataggagaagaagatgttgaaaagggaattgattttaaacttggacaaacaatatctagactaagggatatatc

SEQ ID NO: 211187 - DNA, 75 bp, Artificial Sequence
  Synthetic
ttatccaatgacatttcacaaggaattaagagacaaagaatgacagttgagtctatggggtgggccttgagctaa

SEQ ID NO: 211188 - DNA, 75 bp, Artificial Sequence
  Synthetic
agcagaagcaggggtacttttccaaaatgtccgacaaaacagtcaaatcaacaaatttaatggcatttgtagcca

SEQ ID NO: 211189 - DNA, 75 bp, Artificial Sequence
  Synthetic
caaaaatgttagagagacaagaagatttagacacatgcactgaaatgcaagtagaaaaaatgaaaacgtcaacaa

SEQ ID NO: 211190 - DNA, 75 bp, Artificial Sequence
  Synthetic
aagccaggttgaaaacagaatcttcttttgcacctagaacatgggaagatgcaataaaagatggtgagcttctat

SEQ ID NO: 211191 - DNA, 75 bp, Artificial Sequence
  Synthetic
tcaacgggacgattctgcaagcagagtctcctacaatgacgccagcgtccgtagaaatgaaggggaagaaatttc

SEQ ID NO: 211192 - DNA, 75 bp, Artificial Sequence
  Synthetic
ctattgattttgctccaagaaacatagcaccaattgggcaaaatccaatatatttgtcaccatgtattcctaact

SEQ ID NO: 211193 - DNA, 75 bp, Artificial Sequence
  Synthetic
ttgatggaaacgtctgggaagcaacgatgtatcatcatcgtggagcaactttgacaaagacaatgaattgcaact

SEQ ID NO: 211194 - DNA, 75 bp, Artificial Sequence
  Synthetic
gttttcaaagaacaatttggtgccatccaaatccttcacgtatgagattgagctatgcatttgttttgtattgca

SEQ ID NO: 211195 - DNA, 75 bp, Artificial Sequence
  Synthetic
gaaatactaagaagatctgtggatacctcatcgctagacaagtggccggaattgaaacaggaattagaaaatgtt

SEQ ID NO: 211196 - DNA, 75 bp, Artificial Sequence
  Synthetic
tcagatgcattaaaagcggattcgttatggctaccgatgaaatctctctcactatactccaaagtatcaaatcag

SEQ ID NO: 211197 - DNA, 75 bp, Artificial Sequence
  Synthetic
gagcccagctcgatccctattggggaaatgaaacaccagatattgacaagactgaagcttatatgctctcgctta

SEQ ID NO: 211198 - DNA, 75 bp, Artificial Sequence
  Synthetic
gagaagctggaccttaacctgagcaaagcagtcttaggaatccaaaattctgaagatcttattttgatcatatat

SEQ ID NO: 211199 - DNA, 75 bp, Artificial Sequence
  Synthetic
aacagagatgtttgtaaaaacactatattaatgataaaatctttgtgtaattcacttatataattgttttaagtt

SEQ ID NO: 211200 - DNA, 75 bp, Artificial Sequence
  Synthetic
aaaatctttgtgtaattcacttatataattgttttaagttgttattccaaagttaaaaaaccccttgctcctgct

SEQ ID NO: 211201 - DNA, 75 bp, Artificial Sequence
  Synthetic
agcagaagcaggggatttcaaaacaatggcacatgaaatactgattgctgaaacagaggcatttctaaaaaatgt

SEQ ID NO: 211202 - DNA, 75 bp, Artificial Sequence
  Synthetic
tgctcctgagaccaggacagcaataatttcagcaataacaggaggaaaatcagcctgcaaatcagcagctaaact

SEQ ID NO: 211203 - DNA, 75 bp, Artificial Sequence
  Synthetic
gattaagaatgaacatcttcccctaatgtctggagaagccaccacaatgcacatcgttatgaggtgcttatatcc

SEQ ID NO: 211204 - DNA, 75 bp, Artificial Sequence
  Synthetic
tgaaataaaaccatggaaaaaggcaagcgacatgctgaataaagcaacttctagtttgaaaaaatcagaaggaag

SEQ ID NO: 211205 - DNA, 75 bp, Artificial Sequence
  Synthetic
agacataagaaagcaaatgaaagcagctggagacttcttgggagtggagtcaatgatgaaaatgagggccttcag

SEQ ID NO: 211206 - DNA, 75 bp, Artificial Sequence
  Synthetic
agatgaccaaataatggaaatggttgaagaagtatatgatcacccagacgactacacaccagacatccgaatagg

SEQ ID NO: 211207 - DNA, 75 bp, Artificial Sequence
  Synthetic
aacaatcacagcttggttgagatgcaaaaacaagaaaagtgaaagatacaggagtaatgtctcagaaagtggaag

SEQ ID NO: 211208 - DNA, 75 bp, Artificial Sequence
  Synthetic
aacagctttaaaaattcatgaagtaagaaaagccagcacagcaatgaacgagattgctggtattactggccttgg

SEQ ID NO: 211209 - DNA, 75 bp, Artificial Sequence
  Synthetic
agaagaagcactatctctccaaagacaaacagaaagtttggccatattatgtaatcacacttttggaagtaatat

SEQ ID NO: 211210 - DNA, 75 bp, Artificial Sequence
  Synthetic
aatgagaccccacttggaaaaagcaataaaaggagttgaaggcagagttggagagatgggacgaatggcaatgaa

SEQ ID NO: 211211 - DNA, 75 bp, Artificial Sequence
  Synthetic
atggttagttgttataatatgtttctctataacaagtcaacctgcttctgcttgcaatctaaagacctgtctaaa

SEQ ID NO: 211212 - DNA, 75 bp, Artificial Sequence
  Synthetic
actatttaacaatactgatgcggtaactgttcattgttttaatgaaaaccaaggatacatgctaacattagcctc

SEQ ID NO: 211213 - DNA, 75 bp, Artificial Sequence
  Synthetic
tttgggattagggataattactatgttgtatttattagtaaaaatcataattgaacttgtcaatggttttgtgct

SEQ ID NO: 211214 - DNA, 75 bp, Artificial Sequence
  Synthetic
cggcagatgggagagatggtgtggagatataaagaccacaattatgcctgaaattgactcgatggaaaaagatat

SEQ ID NO: 211215 - DNA, 75 bp, Artificial Sequence
  Synthetic
tgccctttctagggagagacttgacctgggagaggatgctcctgacgaaaccgacaactcaccaattcctttttc

SEQ ID NO: 211216 - DNA, 75 bp, Artificial Sequence
  Synthetic
aactcaccaattcctttttccaatgatggtatttttgaaatttaattaccttgaaaaaatccccttgctactgct

SEQ ID NO: 211217 - DNA, 75 bp, Artificial Sequence
  Synthetic
agcagaagcagaggattggaaatgtcttttctattgacaatagcaaaggaatacaaaagactatgccaagatgct

SEQ ID NO: 211218 - DNA, 75 bp, Artificial Sequence
  Synthetic
aaggcagctcaaatgatgacagtaggaactgtatcaaactacactacgttcaagaaatggactacatcaaggaag

SEQ ID NO: 211219 - DNA, 75 bp, Artificial Sequence
  Synthetic
gaaaagaatccttcactaagaatgagatgggcaatgagcagcaaattcccaataatagctaacaagagaatgctg

SEQ ID NO: 211220 - DNA, 75 bp, Artificial Sequence
  Synthetic
gaagaagctcaaattcctaaagaacacaacaatgtagccctttgggaagacacagaagatgtttcaaaaagggat

SEQ ID NO: 211221 - DNA, 75 bp, Artificial Sequence
  Synthetic
catgttcttgcaagcgcctcttgtataaattattggaatttttgtggaccttgtgtcaacaattcagaagtgatc

SEQ ID NO: 211222 - DNA, 75 bp, Artificial Sequence
  Synthetic
aaagaagtttataaatctagatttggaagattagaaagaaggaaagaaataatgtggaaagaacttagatttaca

SEQ ID NO: 211223 - DNA, 75 bp, Artificial Sequence
  Synthetic
ttagttgatagacaacgaagaagagttgacactcagcctgtagaacaaagattgagaactggagaaattaaagac

SEQ ID NO: 211224 - DNA, 75 bp, Artificial Sequence
  Synthetic
ttgcaaatgtggactttgttcgaagatgaagctcctcttgctagcaaatttattttagacaattatggtctagtc

SEQ ID NO: 211225 - DNA, 75 bp, Artificial Sequence
  Synthetic
aaagaaatgagatcaaagtttgcaaacaaacctctgaataaagaagtagttgcacacatgttagaaaaacaattc

SEQ ID NO: 211226 - DNA, 75 bp, Artificial Sequence
  Synthetic
aatccggaaagtagattcttgcctgttttcggagctataaggccagaaagaatggaattgatccatgcattagga

SEQ ID NO: 211227 - DNA, 75 bp, Artificial Sequence
  Synthetic
ggagaaacttggatacaagaagctaacactgcagggatttccaatgttgatcaaaggaaaaatgatatgagagca

SEQ ID NO: 211228 - DNA, 75 bp, Artificial Sequence
  Synthetic
gtatgtaggaaagtttgtcttgcagcaaatgcaagtataatgaacgccaaaagcaaactggttgagtatataaaa

SEQ ID NO: 211229 - DNA, 75 bp, Artificial Sequence
  Synthetic
agtacaagtatgagaattggagaaacagaaagaaagcttgaagaacttatacttgaaaccgatgatgtctcacct

SEQ ID NO: 211230 - DNA, 75 bp, Artificial Sequence
  Synthetic
gaagtaacattatgtaaatctgctttaggaggaccattaggaaaaactctatcttttgggcccatgctactcaag

SEQ ID NO: 211231 - DNA, 75 bp, Artificial Sequence
  Synthetic
aaaatttctggttccggagtaaaagttaaagatacagtatatatccaaggtgtcagagcagtacaatttgaatac

SEQ ID NO: 211232 - DNA, 75 bp, Artificial Sequence
  Synthetic
tggagtgagcaagaagaattctatggagaatataagtcagccaccgctttattcagcagaaaggaaagatcacta

SEQ ID NO: 211233 - DNA, 75 bp, Artificial Sequence
  Synthetic
gaatggattacaataggaggaggaataaatgaagacagaaagagacttctagctatgtgcatgatattttgcaga

SEQ ID NO: 211234 - DNA, 75 bp, Artificial Sequence
  Synthetic
gatggagattattttaaagacgcccctgcaacaataacaatggcagatttaagtacgaagttaggaagagaaatt

SEQ ID NO: 211235 - DNA, 75 bp, Artificial Sequence
  Synthetic
ccatatcaatatgtgatgatgaattggatacaaaaatcagaagataatctcgaagccttattatacagtagggga

SEQ ID NO: 211236 - DNA, 75 bp, Artificial Sequence
  Synthetic
attgtagaaaccaatccaggaaaaatggggagctcaatgggaattgatggttccaaaagagcaattaaatcttta

SEQ ID NO: 211237 - DNA, 75 bp, Artificial Sequence
  Synthetic
agggctgtcacaatacaatcaggaaagattgacatgccagaatcaaaagaaaaaattcaccttgagctctctgat

SEQ ID NO: 211238 - DNA, 75 bp, Artificial Sequence
  Synthetic
aatcttgaagcatttgattcatcaggaagaattgttgcaacaattttagaccttcctagtgacaaaaaggtaaca

SEQ ID NO: 211239 - DNA, 75 bp, Artificial Sequence
  Synthetic
tttcaggatgtaagctttcaacatcctgatctggcagtattgagagatgagaaaacggccataacaaaagggtat

SEQ ID NO: 211240 - DNA, 75 bp, Artificial Sequence
  Synthetic
gaagcgctaatcaaaaggctaggaacaggggacaatgatattccttccttaattgcaaagaaggattatttgtct

SEQ ID NO: 211241 - DNA, 75 bp, Artificial Sequence
  Synthetic
ctttataatttaccagaagtaaaattaatggctcccttaatcagacccaatagaaaaggagtttattccagagtt

SEQ ID NO: 211242 - DNA, 75 bp, Artificial Sequence
  Synthetic
gctagaaaattagtgtctacacaagttactactggacattattcattacatgaattgataaaggtcttacccttt

SEQ ID NO: 211243 - DNA, 75 bp, Artificial Sequence
  Synthetic
acttatttcgccccaaaacagggaatgtttgaaggaaggcttttctttagcaacgatagctttgttgagcctgga

SEQ ID NO: 211244 - DNA, 75 bp, Artificial Sequence
  Synthetic
gtaaataacaatgtattttcttggagtaaggctgacagttctaaaatatattgtcatggaatagcgataagggta

SEQ ID NO: 211245 - DNA, 75 bp, Artificial Sequence
  Synthetic
cctttagttgttggagatgaacacatggacacttcgttagcactattagaagggtttagtgtttgtgaaaacgac

SEQ ID NO: 211246 - DNA, 75 bp, Artificial Sequence
  Synthetic
cccagagcaccaatggtaacaagacaagatttaattgatgtgggatttgggcaaaaagttagactcttcgtaggc

SEQ ID NO: 211247 - DNA, 75 bp, Artificial Sequence
  Synthetic
caagggagcgttagaaccttcaagcgaactgcctcacaaagggctgcatcaagcgatgtaaataagaatgtgaaa

SEQ ID NO: 211248 - DNA, 75 bp, Artificial Sequence
  Synthetic
gggctgcatcaagcgatgtaaataagaatgtgaaaaagataaagatgtctaactaaaaatcctcttgctactgct

SEQ ID NO: 211249 - DNA, 75 bp, Artificial Sequence
  Synthetic
agcagaagcaggggtttaataatgtttttctcattactcttgatgttgggcctcacagaggctgaaaaaataaag

SEQ ID NO: 211250 - DNA, 75 bp, Artificial Sequence
  Synthetic
atatgccttcaaaagcaagtgaacagtagcttcagcctacacaatggcttcggaggaaatttgtatgccacggaa

SEQ ID NO: 211251 - DNA, 75 bp, Artificial Sequence
  Synthetic
gaaaaaagaatgtttgagcttgttaagcccaaagctggagcctctgtcttgaatcaaagtacatggattggcttt

SEQ ID NO: 211252 - DNA, 75 bp, Artificial Sequence
  Synthetic
ggagattcaaggactgacaaaagcaattcagcttttcctaggtctgcggatgtttcagcaaaaactgctgataag

SEQ ID NO: 211253 - DNA, 75 bp, Artificial Sequence
  Synthetic
tttcgttctttgtctggtggatccttgatgttgagtatgtttggaccacctgggaaggtagactacctttaccaa

SEQ ID NO: 211254 - DNA, 75 bp, Artificial Sequence
  Synthetic
ggatgtggaaaacataaggttttttatgaaggagttaactggagtccacatgctgctataaattgttacagaaaa

SEQ ID NO: 211255 - DNA, 75 bp, Artificial Sequence
  Synthetic
aattggactgatatcaaactgaatttccagaaaaacatttatgaactggcttcacaatcacattgcatgagcttg

SEQ ID NO: 211256 - DNA, 75 bp, Artificial Sequence
  Synthetic
gtgaatgccttggacaaaactattcctttacaagcgactgcaggggttgcaaaaaattgcaacaacagcttctta

SEQ ID NO: 211257 - DNA, 75 bp, Artificial Sequence
  Synthetic
aaaaatccagcattgtacacacaagaagtcaatccttcagtagaaaaatgtgggaaagaaaatcttgctttcttc

SEQ ID NO: 211258 - DNA, 75 bp, Artificial Sequence
  Synthetic
acacttccaacccaatttggaacctatgagtgcaaactgcatcttgtggcttcttgctatttcatctatgatagt

SEQ ID NO: 211259 - DNA, 75 bp, Artificial Sequence
  Synthetic
aaagaagtgtacaataaaagaggatgtgacaactactttcaagtgatctatgattcatctggaaaagttgttgga

SEQ ID NO: 211260 - DNA, 75 bp, Artificial Sequence
  Synthetic
ggactagataacagggtatcaccttacacagggaattctggagacaccccaacaatgcaatgtgacatgctccag

SEQ ID NO: 211261 - DNA, 75 bp, Artificial Sequence
  Synthetic
ctgaaacctggaagatattcagtaagaagctctccaagattccttttaatgcccgaaagaagttattgctttgac

SEQ ID NO: 211262 - DNA, 75 bp, Artificial Sequence
  Synthetic
atgaaagaaaaaggaccagtcactgctgtccaatccatttggggaaaaggcagagaatctgaccatgcagtggat

SEQ ID NO: 211263 - DNA, 75 bp, Artificial Sequence
  Synthetic
caagcttgcttgagcactccagggtgcatgttgatccaaaagcaaaagccatacattggagaagctgatgatcac

SEQ ID NO: 211264 - DNA, 75 bp, Artificial Sequence
  Synthetic
catggagatcaagaaatgagggagttgctgtcaggactggactatgaagctagatgcatatcacaatcagggtgg

SEQ ID NO: 211265 - DNA, 75 bp, Artificial Sequence
  Synthetic
gtgaatgaaaccagcccttttacggaagaatacctccttcctcccaaatttggaagatgccccttggctgcaaag

SEQ ID NO: 211266 - DNA, 75 bp, Artificial Sequence
  Synthetic
gaagaatccattccaaaaatcccagatggccttctaattcccaccagtggaactgataccactgtaaccaaacct

SEQ ID NO: 211267 - DNA, 75 bp, Artificial Sequence
  Synthetic
aagagcagaatttttggaatcgatgacctcattattggtttgctctttgttgcaatcgttgaagcaggaattgga

SEQ ID NO: 211268 - DNA, 75 bp, Artificial Sequence
  Synthetic
ggctatctgcttggaagtagaaaagtatcaggaggaggtgtgacaaaagaatcagctgaaaaagggtttgagaaa

SEQ ID NO: 211269 - DNA, 75 bp, Artificial Sequence
  Synthetic
attggaaatgacatacaaatcctaagatcttctacaaatatcgcaatagaaaaactgaatgacagaatttctcat

SEQ ID NO: 211270 - DNA, 75 bp, Artificial Sequence
  Synthetic
gatgagcaagccatcagagatctaactttagaaattgaaaatgcaagatctgaagctttgttaggagaattggga

SEQ ID NO: 211271 - DNA, 75 bp, Artificial Sequence
  Synthetic
ataataagagccttgttggtaggaaatataagcataggattacaagaatctttatgggaactagcttcagaaata

SEQ ID NO: 211272 - DNA, 75 bp, Artificial Sequence
  Synthetic
acaaatagagcaggagatctagcagttgaagtctctccaggttgctgggtaattgacaataacatttgtgatcaa

SEQ ID NO: 211273 - DNA, 75 bp, Artificial Sequence
  Synthetic
agttgtcaaaactttattttcaagttcaacgaaactgcacctgttccaaccattccccctcttgacacaaaaatt

SEQ ID NO: 211274 - DNA, 75 bp, Artificial Sequence
  Synthetic
gatctgcaatcagatcctttttactggggaagcagcttgggcttagcaataactgctgctatttcattggcagct

SEQ ID NO: 211275 - DNA, 75 bp, Artificial Sequence
  Synthetic
ttggtgatctctgggatcgccatctgcagaactaaatgactgggacaattttaaaaaatggataatatattagtc

SEQ ID NO: 211276 - DNA, 75 bp, Artificial Sequence
  Synthetic
ttttaaaaaatggataatatattagtcaatattttgtacagttttataaaaaacaaaaatccccttgctactgct

SEQ ID NO: 211277 - DNA, 75 bp, Artificial Sequence
  Synthetic
agcagaagcaggagatttgattttcaaaaatgtctgacagacgtcaaaacagaaagacgccagatgagcaacgca

SEQ ID NO: 211278 - DNA, 75 bp, Artificial Sequence
  Synthetic
aagccaatgctctcataataaatgagaacattgaagcctacattgccatttgtaaggaagtgggccttaatggcg

SEQ ID NO: 211279 - DNA, 75 bp, Artificial Sequence
  Synthetic
atgaaatgttgatcctggaaaatggcatagcaattgaaaaagctataagaatatgttgtgatggaaagtatcagg

SEQ ID NO: 211280 - DNA, 75 bp, Artificial Sequence
  Synthetic
aaaaaagggaaaagaaagcaagagaagcccaaagagcggacagcaacttcaatgcagattccattgggatcagac

SEQ ID NO: 211281 - DNA, 75 bp, Artificial Sequence
  Synthetic
tagttaaaagagctggttcaggcaccaatataacctaccatgcagttgttgaattgacaagccgctcaagaattg

SEQ ID NO: 211282 - DNA, 75 bp, Artificial Sequence
  Synthetic
ttcaaattctcaaatctcattggggaaatgaactaaacagagcaaaaattgcaggaaaaagactcggcttctctg

SEQ ID NO: 211283 - DNA, 75 bp, Artificial Sequence
  Synthetic
cactctttgcttctaacttagaagcaattatttatcaaagaggaagaaatgcagcaagaagaaacggttctgctg

SEQ ID NO: 211284 - DNA, 75 bp, Artificial Sequence
  Synthetic
aattgttcactctcactcaaggggctggaatcgaaactagatataaatggataatggaaaagcacatcggaattg

SEQ ID NO: 211285 - DNA, 75 bp, Artificial Sequence
  Synthetic
gagttcttatagctgacgcaaaaggtttaataaatggaaagagagaaggcaaaagaggagttgatgccaatgtaa

SEQ ID NO: 211286 - DNA, 75 bp, Artificial Sequence
  Synthetic
aattgagagcaggaacgactggttcccctctggaaagagccatgcaaggaattgagaaaaaagcgtttcctgggc

SEQ ID NO: 211287 - DNA, 75 bp, Artificial Sequence
  Synthetic
ctttaagagcactagcaagaagagttgtaaaagcaaactacaatgatgccagagaagctctaaatgtcatcgcag

SEQ ID NO: 211288 - DNA, 75 bp, Artificial Sequence
  Synthetic
aagcatcactcctgttaaagcctcagataaccaacaagatgacaatgccttggtgtatgtggttggctgccagac

SEQ ID NO: 211289 - DNA, 75 bp, Artificial Sequence
  Synthetic
ttactctgaaagatgagtttgccaatttctgtgcatatgcaggaagaagagcctttgaagtcttcaatattgcaa

SEQ ID NO: 211290 - DNA, 75 bp, Artificial Sequence
  Synthetic
tggagaaaattggaatttgttcctttcaagggacaataatgaacgatgatgaaattgaatcaatagaggacaagg

SEQ ID NO: 211291 - DNA, 75 bp, Artificial Sequence
  Synthetic
ctcaagtattaatgatggcatgctttggacttgcttatgaagacttcagtttggtctctgctatggttagccacc

SEQ ID NO: 211292 - DNA, 75 bp, Artificial Sequence
  Synthetic
ctcttaagttgagaaacagaatgaaaataggaaacttcagagtcggtgaaaaagtttcaacagtgctttctccct

SEQ ID NO: 211293 - DNA, 75 bp, Artificial Sequence
  Synthetic
tattgagattcacaagatgggcagagtttgctcaaagatttgctcttcaggcaaatacttcaagagaaggcgctc

SEQ ID NO: 211294 - DNA, 75 bp, Artificial Sequence
  Synthetic
aaatcagcaattcagcagtttttgcagtggaaaggaagataaccacagatgtccaaagagttgaagagctactaa

SEQ ID NO: 211295 - DNA, 75 bp, Artificial Sequence
  Synthetic
ataaagttcaagctcatgaagatgaaccattacaaacactttacaaaaaagtaagagaacaaatttccataattg

SEQ ID NO: 211296 - DNA, 75 bp, Artificial Sequence
  Synthetic
gaaggaacaagtctgaaataaaggagtttctagggtcttcaatgtatgatttaaatgatcaagaaaaacaaaatc

SEQ ID NO: 211297 - DNA, 75 bp, Artificial Sequence
  Synthetic
caataaatttcaggtctggagcacaccctttctttttcgaattcgacccagactacaaccccataagagtgaaaa

SEQ ID NO: 211298 - DNA, 75 bp, Artificial Sequence
  Synthetic
gacccaaaaaaccaatagcaaagagaaattcaaatatcagcagattggaagaagaaggaatggatgaaaattcag

SEQ ID NO: 211299 - DNA, 75 bp, Artificial Sequence
  Synthetic
agattggacaagccaagaagatgaaacctttggatcaattgaccagcactagtagcaacattcctggaaaaaatt

SEQ ID NO: 211300 - DNA, 75 bp, Artificial Sequence
  Synthetic
aaagtcagattaaattcatcacatattttatgatcaactgttgtattgctatatataattcaaaaatctccttgc

SEQ ID NO: 211301 - DNA, 75 bp, Artificial Sequence
  Synthetic
gattaaattcatcacatattttatgatcaactgttgtattgctatatataattcaaaaatctccttgctactgct

SEQ ID NO: 211302 - DNA, 75 bp, Artificial Sequence
  Synthetic
agcagaagcagaggattatggaaatcaacccatatttgatgtttctaaacaacgacgtcacatcgctgatatcaa

SEQ ID NO: 211303 - DNA, 75 bp, Artificial Sequence
  Synthetic
caacatacccctatacagggccacctccaatgtcacatggatcatcaaccaaatacactttggaaactattaaaa

SEQ ID NO: 211304 - DNA, 75 bp, Artificial Sequence
  Synthetic
gaacatatgactactcaagaacatcagttgaaaaaacatcgaaagttttcaatataccaagaagaaagttttgca

SEQ ID NO: 211305 - DNA, 75 bp, Artificial Sequence
  Synthetic
attgtcttgaagacaaagatgagttggtaaaaccaacaggaaacgttgatatcagttccttgttgggccttgcag

SEQ ID NO: 211306 - DNA, 75 bp, Artificial Sequence
  Synthetic
agatgatggagaaaagaatgggggaaggattttttaagcattgtgtaatggaggcagaaacagaaatacttaaaa

SEQ ID NO: 211307 - DNA, 75 bp, Artificial Sequence
  Synthetic
tgcacttctctagacttacggaaggaagacaaacatatgattggacttctgaaagaaacatgccagcggccactg

SEQ ID NO: 211308 - DNA, 75 bp, Artificial Sequence
  Synthetic
ctttgcaactgacagttgatgccataaaagaaacagaaggaccatttaaagggacaacaatgcttgaatattgca

SEQ ID NO: 211309 - DNA, 75 bp, Artificial Sequence
  Synthetic
ataaaatgatagaaatgcttgattggaaagaagttaaattcagaaaagtcaaaacaatggtgagaagggagaaag

SEQ ID NO: 211310 - DNA, 75 bp, Artificial Sequence
  Synthetic
ataaaagaagtgggaaggagataaaaactaaagtacctgtaatgggaattgactcaattaaacatgatgagtttt

SEQ ID NO: 211311 - DNA, 75 bp, Artificial Sequence
  Synthetic
taattagagcattaactattaataccatggccaaagatggggaaagagggaaattgcaaagaagagcaattgcaa

SEQ ID NO: 211312 - DNA, 75 bp, Artificial Sequence
  Synthetic
cacccggtatgatagtaagaccattttcaaaaattgttgaaactgtagcacagaaaatatgtgagaaattgaaag

SEQ ID NO: 211313 - DNA, 75 bp, Artificial Sequence
  Synthetic
aaagcggtctacctgttggtggtaatgagaagaaagcaaaacttaagactactgttacttctctcaatgccagga

SEQ ID NO: 211314 - DNA, 75 bp, Artificial Sequence
  Synthetic
tgaacagtgatcagtttgcagttaatataactggagacaatagtaaatggaatgaatgccaacaacctgaggctt

SEQ ID NO: 211315 - DNA, 75 bp, Artificial Sequence
  Synthetic
atttagcacttttggcttacatcaccaaagactcctctgatttaatgaaagacttatgcagtgttgctccagtgc

SEQ ID NO: 211316 - DNA, 75 bp, Artificial Sequence
  Synthetic
ttttctgtaataagtttgtgaaacttggacaaggaataagactttcaaataaaagaaaaacaaaggaagtcataa

SEQ ID NO: 211317 - DNA, 75 bp, Artificial Sequence
  Synthetic
taaaagctgagaaaatgggaaaatacaagaatctaatgagagaagaatataaaaacctttttgaacccttagaga

SEQ ID NO: 211318 - DNA, 75 bp, Artificial Sequence
  Synthetic
aatatattcagaaggatgtctgttttttacctggaggaatgcttatgggaatgttcaacatgctgtcaacagttc

SEQ ID NO: 211319 - DNA, 75 bp, Artificial Sequence
  Synthetic
ttggagtaagtacattatgttatatggatgaagaactaaaagccaaaggatgtttttggactggactccaatctt

SEQ ID NO: 211320 - DNA, 75 bp, Artificial Sequence
  Synthetic
ctgatgactttgttctttttgcagttgcttcaaactggtcaaatatacattggacaataagacggtttaatgctg

SEQ ID NO: 211321 - DNA, 75 bp, Artificial Sequence
  Synthetic
tatgcaagttaattggtataaacatgtctcttgaaaaatcgtatggttctctcccagaactctttgaatttacaa

SEQ ID NO: 211322 - DNA, 75 bp, Artificial Sequence
  Synthetic
gtatgttctttgatggagaatttgtgtccaatcttgctatggaattgccagctttcactactgcaggagttaatg

SEQ ID NO: 211323 - DNA, 75 bp, Artificial Sequence
  Synthetic
aaggagttgattttacagctgcaatgtcaattattaagacaaatatgataaataacagcttatcaccttctactg

SEQ ID NO: 211324 - DNA, 75 bp, Artificial Sequence
  Synthetic
ctttaatggccttaaggatatgtctccaagaatttagagcgacttatagagtccatccttgggattcaagagtga

SEQ ID NO: 211325 - DNA, 75 bp, Artificial Sequence
  Synthetic
aaggtgggagaatgaaaataataaatgagttcataaaaaccatagaaaataaagatggattattaattgctgatg

SEQ ID NO: 211326 - DNA, 75 bp, Artificial Sequence
  Synthetic
gtgggaaactgatgaacaacattagcacccttcatattcctgaggaagtactgaagtttgaaaaaatggatgaac

SEQ ID NO: 211327 - DNA, 75 bp, Artificial Sequence
  Synthetic
aatatagaaatagggtattcaaccccaaaaatccctttactaactttgacaaaactattgatatatttagagcac

SEQ ID NO: 211328 - DNA, 75 bp, Artificial Sequence
  Synthetic
atggcccaataagggttgaagaaaatgaagcagtagtttcaactcatagcttcagaactagagcaaacagaaccc

SEQ ID NO: 211329 - DNA, 75 bp, Artificial Sequence
  Synthetic
tattgaatacagatatgagagcaatgatggcagaagagaaaagatatcaaatggtttgcgacatgtttaaaagcg

SEQ ID NO: 211330 - DNA, 75 bp, Artificial Sequence
  Synthetic
tgtttgaatcagcggacataaatcctccaattggggctatgagcattggagaggccatagaagaaaaactattag

SEQ ID NO: 211331 - DNA, 75 bp, Artificial Sequence
  Synthetic
agagagctaaaatgaaaagagacattggggcaatagaagattcagaatatgaagaaataaaagacattataaggg

SEQ ID NO: 211332 - DNA, 75 bp, Artificial Sequence
  Synthetic
atgcaaagaaagctagaattgaaagtagatgaggaggggctgttaaaccctttcctcctacttgcacatattttt

SEQ ID NO: 211333 - DNA, 75 bp, Artificial Sequence
  Synthetic
gctgttaaaccctttcctcctacttgcacatatttttgttattccattaaatgaaaaaatcctcttgctactgct

SEQ ID NO: 211334 - DNA, 75 bp, Artificial Sequence
  Synthetic
agcagaagcaggggatccgaaatgtcaaaaacttttgccgaaatagcagaggcttttctagagccagaagctgta

SEQ ID NO: 211335 - DNA, 75 bp, Artificial Sequence
  Synthetic
agaatagccaaagaagcagtagaagaatatggggatcacgaaagaaaaataatacaaattggaatacactttcaa

SEQ ID NO: 211336 - DNA, 75 bp, Artificial Sequence
  Synthetic
gtttgctgcatgttctgtgatgagtatttgagtacaaatgggagtgatagatttgtgctcattgaaggaagaaaa

SEQ ID NO: 211337 - DNA, 75 bp, Artificial Sequence
  Synthetic
agaggaactgcagtgtctttacaaaatgagctatgtaaaagttatgatcttgaaccactaccttttctttgtgac

SEQ ID NO: 211338 - DNA, 75 bp, Artificial Sequence
  Synthetic
atttttgacagggaggaaaaacaattcgttgaaattggaataacaagaaaagcagatgatagctattttcaatcc

SEQ ID NO: 211339 - DNA, 75 bp, Artificial Sequence
  Synthetic
aagtttggtaaacttggaaatagctgcaagatatttgtattctcctatgatggaagattagacaaaaattgtgaa

SEQ ID NO: 211340 - DNA, 75 bp, Artificial Sequence
  Synthetic
ggccctatggaggaacaaaaattgagaattttcagttttcttgcaactgctgctgattttcttaggaaagaaaac

SEQ ID NO: 211341 - DNA, 75 bp, Artificial Sequence
  Synthetic
atgtttaacgaaatcttcttaccagacaatgaagaaaccatcattgaaatgaagaaaggaaaaacatttctaaaa

SEQ ID NO: 211342 - DNA, 75 bp, Artificial Sequence
  Synthetic
ttgagggatgaaagtgttcctttaccttttcaaacttatgaacagatgaaagattactgcgaaaaatttaaagga

SEQ ID NO: 211343 - DNA, 75 bp, Artificial Sequence
  Synthetic
aatccaagagaattagcttctaaagtaagccaaatgcaaagcaatattaaattaccaataaaacattatgagcag

SEQ ID NO: 211344 - DNA, 75 bp, Artificial Sequence
  Synthetic
aataaatttcgacaaatacgtctaccaaagggaccaatggcaccctatacccacaagttcttaatggaagaagca

SEQ ID NO: 211345 - DNA, 75 bp, Artificial Sequence
  Synthetic
tggatgtttacaaaaattagtgatccagaaagatcaagagctggtgaaattctcattgatttcttcaagaaaggg

SEQ ID NO: 211346 - DNA, 75 bp, Artificial Sequence
  Synthetic
aatctttctgcaatcagacccaaagacaaaccattacaagggaaatatcccatacattacaaaaatctttggaat

SEQ ID NO: 211347 - DNA, 75 bp, Artificial Sequence
  Synthetic
cagattaaagcagcaattgccgatagaaccatggtaataaatgaaaatgatcattcagagtttctaggaggaatt

SEQ ID NO: 211348 - DNA, 75 bp, Artificial Sequence
  Synthetic
ggaagagcctctaaaaagatcccagaggtttctctgacacaagatgtaataacaacagaaggattaaaacaatca

SEQ ID NO: 211349 - DNA, 75 bp, Artificial Sequence
  Synthetic
gaaaataagttaccagaaccaagatctttccctaaatggttcaatgctgagtggatgtgggcaataaaagattct

SEQ ID NO: 211350 - DNA, 75 bp, Artificial Sequence
  Synthetic
gaccttactggatgggtgcccatggcagaataccctcctgctgataatgaattggaagattacgctgaacatcta

SEQ ID NO: 211351 - DNA, 75 bp, Artificial Sequence
  Synthetic
aataaaaccatggaaggggtcttgcaaggaacaaattgcgcaagagaaatggggaaatgcattcttactgttggg

SEQ ID NO: 211352 - DNA, 75 bp, Artificial Sequence
  Synthetic
gcactaatgactgaatgtagactatttcctgggaaaataaaagtggtgcccatatatgctagaagtaaagaaagg

SEQ ID NO: 211353 - DNA, 75 bp, Artificial Sequence
  Synthetic
aaatcaatgcaagaagggcttccggtgccctcagaaatggactgtttatttggtatatgcgtcaagtcaaaatca

SEQ ID NO: 211354 - DNA, 75 bp, Artificial Sequence
  Synthetic
catttaaacaaggatgatggaatgtacacaataataacatttgaattctcaataagagagcctaatttagaaaaa

SEQ ID NO: 211355 - DNA, 75 bp, Artificial Sequence
  Synthetic
catcaaaaatatactgtatttgaagcaggacacacaacagttagaatgaagaaaggagagtcagttattggaaga

SEQ ID NO: 211356 - DNA, 75 bp, Artificial Sequence
  Synthetic
gaagtccctctttatttatactgtaggacaactgccctttccaaaatcaagaatgactggctatcaaaggctaga

SEQ ID NO: 211357 - DNA, 75 bp, Artificial Sequence
  Synthetic
agatgtttcatcacaactatggacacagtggaaaccatatgtctaagagagtcagcaaaggctgaagaaaatcta

SEQ ID NO: 211358 - DNA, 75 bp, Artificial Sequence
  Synthetic
gttgaaaagacattaaacgaaaaacagatgtggattgggaagaaaaatggagagttaattgctcaacctttaaga

SEQ ID NO: 211359 - DNA, 75 bp, Artificial Sequence
  Synthetic
gaagctttaagagtacagctggtacaacaattctatttctgcatctataatgacagtcaattagaaggcttttgt

SEQ ID NO: 211360 - DNA, 75 bp, Artificial Sequence
  Synthetic
aatgagcagaagaaaatcctaatggctcttgaaggtgacaagaaaaataaatcatcttttggatttaatccagaa

SEQ ID NO: 211361 - DNA, 75 bp, Artificial Sequence
  Synthetic
ggattattagaaaagattgaagagtgtcttataaataatccgatgtgcctttttatggctcaaaggttgaatgaa

SEQ ID NO: 211362 - DNA, 75 bp, Artificial Sequence
  Synthetic
cttgtaattgaggcctcaaaaagaggcgctaagtttttcaaaattgattgatcattataagaaaaaatccccttg

SEQ ID NO: 211363 - DNA, 75 bp, Artificial Sequence
  Synthetic
tgaggcctcaaaaagaggcgctaagtttttcaaaattgattgatcattataagaaaaaatccccttgctactgct

SEQ ID NO: 211364 - DNA, 75 bp, Artificial Sequence
  Synthetic
cgcacagtggatcctaggcattttggttgcgcttatttcttgtccaattatgggacagataataaccttctttca

SEQ ID NO: 211365 - DNA, 75 bp, Artificial Sequence
  Synthetic
ggaagtgcctcacattatagaggaagtcatgaacattgttctgatcaccctatccctcttggctatcttgaaggg

SEQ ID NO: 211366 - DNA, 75 bp, Artificial Sequence
  Synthetic
tgtgtacaatgtcatgacttgtggtctgattggattgatttcctttctcttactgtgtgggaagtcctgctctct

SEQ ID NO: 211367 - DNA, 75 bp, Artificial Sequence
  Synthetic
aatctacaaggacacatataacttctcatccattgaacttgacctctcacacctcaacatgacattgcccatgtc

SEQ ID NO: 211368 - DNA, 75 bp, Artificial Sequence
  Synthetic
ctgcagccgaaacaactcacaccactatgtcttcttcaacggatctggcttagagatgacattcactaacgattc

SEQ ID NO: 211369 - DNA, 75 bp, Artificial Sequence
  Synthetic
acttcttaaccacaaattctgcaatctttcagacgcccataaaaagaatctttacgatcatgcgctaatgggcat

SEQ ID NO: 211370 - DNA, 75 bp, Artificial Sequence
  Synthetic
tgtcacaactttccacttgtcaatcccgaacttcaatcaatacgaagcaatggcctgtgacttcaatggagggaa

SEQ ID NO: 211371 - DNA, 75 bp, Artificial Sequence
  Synthetic
tattagcattcaatacaacttgagccacaatgatcgaacagatgcaatgaaccactgtggcactgtagctaatgg

SEQ ID NO: 211372 - DNA, 75 bp, Artificial Sequence
  Synthetic
tgtactggatgctttttataggttccattggggcagaaatataacctacatcgctcagttgccaaatggcgacgg

SEQ ID NO: 211373 - DNA, 75 bp, Artificial Sequence
  Synthetic
cactggcagatggacattctgttatgccacaagttataagtacctggttatccaaaacattagctgggctgatca

SEQ ID NO: 211374 - DNA, 75 bp, Artificial Sequence
  Synthetic
ttgtcaaatgtcaagaccaactcccattggctttgctagcattctgagccaacggattaggagcatttacatttc

SEQ ID NO: 211375 - DNA, 75 bp, Artificial Sequence
  Synthetic
aagacgactgatgagcacattcacttggtctctatccgacagttcaggtactgagaatccaggtggctattgtct

SEQ ID NO: 211376 - DNA, 75 bp, Artificial Sequence
  Synthetic
caccagatggatgctttttgcggctgacttgaaatgctttggaaacacagccattgccaaatgtaacctgaatca

SEQ ID NO: 211377 - DNA, 75 bp, Artificial Sequence
  Synthetic
tgatgaagagttctgcgacatgttgaggcttattgacttcaacaagcaagccttgaaaacattcaaatcggaggt

SEQ ID NO: 211378 - DNA, 75 bp, Artificial Sequence
  Synthetic
taaccatggtctacaactaattacaaaggcgattaatgccttgatcaatgaccaactcattatgaagaatcactt

SEQ ID NO: 211379 - DNA, 75 bp, Artificial Sequence
  Synthetic
aagggacctaatgggtatcccttattgcaattattcaaaattctggtatctaaatgacacaagaacaggtagagt

SEQ ID NO: 211380 - DNA, 75 bp, Artificial Sequence
  Synthetic
ctctctgcctaagtgctggatgatcagcaacgggacctatctaaatgagactcatttttctgatgagattgaaca

SEQ ID NO: 211381 - DNA, 75 bp, Artificial Sequence
  Synthetic
ggaagcagacaatatgatcacagaaatgttgagaaaagagtatcaagaaagacaagggaagaccccattgggtct

SEQ ID NO: 211382 - DNA, 75 bp, Artificial Sequence
  Synthetic
agttgatctttttatttttagcacaagcttttattcaatcacagtgttcctccatctcataaagattccaacgca

SEQ ID NO: 211383 - DNA, 75 bp, Artificial Sequence
  Synthetic
cagacacatcgtgggacaagggtgtcccaagccacacagactaaacagtagagcaatctgctcctgtggtgccta

SEQ ID NO: 211384 - DNA, 75 bp, Artificial Sequence
  Synthetic
taaacagccgggactacccaccaagtggaagcgctgatctccacaggggcccccgtgacccaccgccgaaaggcg

SEQ ID NO: 211385 - DNA, 75 bp, Artificial Sequence
  Synthetic
gtgggtcacgggggtgccacttacagggcaaccttctctgtcactgctctaaagaccatgtctctgggcaacaca

SEQ ID NO: 211386 - DNA, 75 bp, Artificial Sequence
  Synthetic
gccctgatggaacccgggctgaatctgcctgtggatgctgcttcatacatcaggcaatccaacaatgcacaatgg

SEQ ID NO: 211387 - DNA, 75 bp, Artificial Sequence
  Synthetic
ggcgttatctcctccttgttgcctctcttcttcttttcaacaacgtgaccagtatgaattttgcataaaaatccg

SEQ ID NO: 211388 - DNA, 75 bp, Artificial Sequence
  Synthetic
aatttatcccacacttcatcttcaaattttctggcctcagatttggacatcagtacatcaatgagcttgatgtcc

SEQ ID NO: 211389 - DNA, 75 bp, Artificial Sequence
  Synthetic
tttctcccctgagaatccaggagcctccttatgtcttcagacccttggcaggttaagaccatatttggaggtaaa

SEQ ID NO: 211390 - DNA, 75 bp, Artificial Sequence
  Synthetic
agctccaaaaccgctgatgttaacccaggctgcacgttgaagagatctccaatgtcaataccatgggagtatttg

SEQ ID NO: 211391 - DNA, 75 bp, Artificial Sequence
  Synthetic
gagtcctgtttgaactgtttggcgtctgtgggttctctgtagaagtgtatgtaagctcctgtttgtggctggtaa

SEQ ID NO: 211392 - DNA, 75 bp, Artificial Sequence
  Synthetic
aaggctatctccacggggtcctcagctctcccttctatgtcaatccacgtcttggcatttggatccacggcggcc

SEQ ID NO: 211393 - DNA, 75 bp, Artificial Sequence
  Synthetic
atcagatctttaagagctagtatctgagacattgtgagaccagaaggcatcccgtgtccggcccctttgggttta

SEQ ID NO: 211394 - DNA, 75 bp, Artificial Sequence
  Synthetic
gctggactcatctgtttgttttgggacagatcaatgggtggtccgagatcaactacagtattgtcccaagccctt

SEQ ID NO: 211395 - DNA, 75 bp, Artificial Sequence
  Synthetic
cctgtcagacttgttctgcatgctatataaggccaaccgttgccagagagacatactttgtacagcagattttca

SEQ ID NO: 211396 - DNA, 75 bp, Artificial Sequence
  Synthetic
tatgggtttctgtcgcctggtgtatctgacacaaacatactgtgggctctttttactttcaacatagaagctaat

SEQ ID NO: 211397 - DNA, 75 bp, Artificial Sequence
  Synthetic
atgtcctccaagttttggggagtcaccttcaatgtctcaagcatgttaccaccatctagcatacatgcgcctgcc

SEQ ID NO: 211398 - DNA, 75 bp, Artificial Sequence
  Synthetic
ttcactgctgcactcaagctgaagttgtacccagagacattgatagatgatttggaaacatcaataatgcttaag

SEQ ID NO: 211399 - DNA, 75 bp, Artificial Sequence
  Synthetic
actgggtgtgcttgagttagtttctcaagatccatggcattaggatacttggctgcgtaaactagaccaagatca

SEQ ID NO: 211400 - DNA, 75 bp, Artificial Sequence
  Synthetic
gtgagagattgcacaacatcatttaactcatactgtccctgtttactcatacaggctagagtgagactaggcata

SEQ ID NO: 211401 - DNA, 75 bp, Artificial Sequence
  Synthetic
gtcccaaactggttgtttaagagtgaggagtctttcacatcccacacccgcaccactccgtctgcaccaggcctg

SEQ ID NO: 211402 - DNA, 75 bp, Artificial Sequence
  Synthetic
ggtgcattcctcgcattgctaatgcctatcatgtccagaagccgttttctctgatcaagttgttgatttgttaga

SEQ ID NO: 211403 - DNA, 75 bp, Artificial Sequence
  Synthetic
ttgcccatatagacaccaagagtttgtggtctctcagttctcatcactttgttcttcagtctgtccaagtcagct

SEQ ID NO: 211404 - DNA, 75 bp, Artificial Sequence
  Synthetic
gcgagaaccaagaggtcgtcagacgttagcttcccaactctcaaaacattcttctgctgtgtagatttcagttca

SEQ ID NO: 211405 - DNA, 75 bp, Artificial Sequence
  Synthetic
acaaggttgaacactgcttggtttaggtcccttagcctcttgaggtctgagtcattccttttgtctttcctcatg

SEQ ID NO: 211406 - DNA, 75 bp, Artificial Sequence
  Synthetic
agcctttgaatattggagacttctgagaagtccagactgtgcaggagagactgggcatccttgataatggaggat

SEQ ID NO: 211407 - DNA, 75 bp, Artificial Sequence
  Synthetic
tttacagtactacagtactgcccaagttctctcctgagtgcctgggtccaaaggaatgacttcacttctttggaa

SEQ ID NO: 211408 - DNA, 75 bp, Artificial Sequence
  Synthetic
tctttggaattggccattgctggagatttttgacagtgaaaaagcgcaatcaaattgcctaggatccactgtgcg

SEQ ID NO: 211409 - DNA, 75 bp, Artificial Sequence
  Synthetic
cgcaccggggatcctaggcaatttggtgtgtcatttctataccaatcaagcctgatttccaaagcactcacacaa

SEQ ID NO: 211410 - DNA, 75 bp, Artificial Sequence
  Synthetic
gtcccgcaaccaccacacctacaaggacccgccaacagtcccgccaaatcgctaggccatcacccaacccagcat

SEQ ID NO: 211411 - DNA, 75 bp, Artificial Sequence
  Synthetic
gggacagaaccaaagcagagacaaacaaaaggccatccaaaatcagcccaaagacacagggaacagagcagacat

SEQ ID NO: 211412 - DNA, 75 bp, Artificial Sequence
  Synthetic
cattccagatgcaacaggcatggggccagagttttgcaagagctgctggtttgagcgtaggagtcttgttgcttg

SEQ ID NO: 211413 - DNA, 75 bp, Artificial Sequence
  Synthetic
taacaatcactacctttgcatgaactgcctgacattgttactaagtgtctcagaaagatgtccaatttgcaaact

SEQ ID NO: 211414 - DNA, 75 bp, Artificial Sequence
  Synthetic
gcctctgccacaaaaactgaaactaacatctagtccaagtgcccctccatcacccagtccaccaccatactcccc

SEQ ID NO: 211415 - DNA, 75 bp, Artificial Sequence
  Synthetic
ttaagccccaaacaacagcggacccaaacaaaaaacaagaaacaaaaaacaaaccaaaaacaaaggaaaaggcca

SEQ ID NO: 211416 - DNA, 75 bp, Artificial Sequence
  Synthetic
aaaccaaaaaacaaccacaaccaccccctcccccgcaagggggaggggggccccgccgggccccccctccccccc

SEQ ID NO: 211417 - DNA, 75 bp, Artificial Sequence
  Synthetic
cctggggggaggagatgtctagtctatctcttcaacaacttcgacataaaatgccggttggcagagtctaccctt

SEQ ID NO: 211418 - DNA, 75 bp, Artificial Sequence
  Synthetic
gagcctcattgtgcccgttgatgagtgcctcatcacttgtctcctacttttactaaaacacagtgagtagccttt

SEQ ID NO: 211419 - DNA, 75 bp, Artificial Sequence
  Synthetic
aaaatcaaaccattgatcaatctcttgcattgattttgaaatgaactcctctgctttatcattaaggattcttag

SEQ ID NO: 211420 - DNA, 75 bp, Artificial Sequence
  Synthetic
tgcaatggttaagatgtccacattaataaggtacaaattgcaacattgtctatgtttcaatatatctgcaaactt

SEQ ID NO: 211421 - DNA, 75 bp, Artificial Sequence
  Synthetic
gcacaccaacaagtcccaatgatcttccttcagttcattaatgaaaacttcaatatcttgatccagaatgacagg

SEQ ID NO: 211422 - DNA, 75 bp, Artificial Sequence
  Synthetic
gttgatgatggctaccttttctttgagttctaacagatgcccatcttcaacaacaaggggcacaatattgacttc

SEQ ID NO: 211423 - DNA, 75 bp, Artificial Sequence
  Synthetic
tggtccaactttcgagatgtcagatacggagagttcaagcaaatctggttccaaccatacatcaagtggataagc

SEQ ID NO: 211424 - DNA, 75 bp, Artificial Sequence
  Synthetic
ctcagaagatggagaagctgttgaaatgtaagcatctacaacatctgaatgaacgaaccactcagatgctccagc

SEQ ID NO: 211425 - DNA, 75 bp, Artificial Sequence
  Synthetic
tttaaattccctatctgacttcaataatgaccagcagtcaatcacaaagtgctcatccacagggcctgagtacag

SEQ ID NO: 211426 - DNA, 75 bp, Artificial Sequence
  Synthetic
cacttctaattgcttaggtacgaaagtacacgagtttgttataaatccggtaaaattcaaatgaactgagaactt

SEQ ID NO: 211427 - DNA, 75 bp, Artificial Sequence
  Synthetic
ctggccttgtagcttcccttgagtcttctgtgttagtctaacagtttttgacaacttaacagaccctacctttaa

SEQ ID NO: 211428 - DNA, 75 bp, Artificial Sequence
  Synthetic
agtggagagataatgccagaattgatcaacatcttcaaaacagctttcctctgtcagcccagatgcaattagctg

SEQ ID NO: 211429 - DNA, 75 bp, Artificial Sequence
  Synthetic
ggactgattgaggtgtgccaactctatctcgtaatccaaccatgaatagcccatgaataaatcatatctatacat

SEQ ID NO: 211430 - DNA, 75 bp, Artificial Sequence
  Synthetic
aggcctctctatgcctttaaatacaactttctcaatgaatgttgaaaaaggccctagtctttcaatgccctcacc

SEQ ID NO: 211431 - DNA, 75 bp, Artificial Sequence
  Synthetic
ttgaggtagtgatgatctgtgagggaaccaagaaaatgatccaagtgtcctagaggttgcaacaaagggtttgac

SEQ ID NO: 211432 - DNA, 75 bp, Artificial Sequence
  Synthetic
gaaagactcaaaatagatttgtttcaggaagttgtcagcaacatcagaagtactcaccactgtctcatccataag

SEQ ID NO: 211433 - DNA, 75 bp, Artificial Sequence
  Synthetic
tgtagtatgtttacgatcatgagaaactaaaagatcatcagacaaaacaatgtaatgctcttctcttttccattt

SEQ ID NO: 211434 - DNA, 75 bp, Artificial Sequence
  Synthetic
aaccacatgtgaaattaaggacagtgcctcacaattcacatcaagagttacacacaaatccaaaaacttaattct

SEQ ID NO: 211435 - DNA, 75 bp, Artificial Sequence
  Synthetic
tggagaccacttcaacttcatggcagccaaatcgctcatgtaaggcaaaagatgcttctcaaacatctcagggta

SEQ ID NO: 211436 - DNA, 75 bp, Artificial Sequence
  Synthetic
gagccttctaactgcatgaattatgtggttcattccaatcctatcttccaaaattcggttatgagcaggcctcaa

SEQ ID NO: 211437 - DNA, 75 bp, Artificial Sequence
  Synthetic
aggaaaatagtcacagggtcttggtttccaaaagtcagatttcaccttgaacacgggctcacctaggacccaggg

SEQ ID NO: 211438 - DNA, 75 bp, Artificial Sequence
  Synthetic
accaatctctagagaagttgacaatgctatgcagaggtagtcccatagaagaggcctcaagagttcaatttgcca

SEQ ID NO: 211439 - DNA, 75 bp, Artificial Sequence
  Synthetic
gggttttacagaggctgactgtgtatcatcagtctttgattcataaacccataagtttaagtggcccttgttcag

SEQ ID NO: 211440 - DNA, 75 bp, Artificial Sequence
  Synthetic
aggtttaacattgcagtgtgtctgtaagtattgaattattgattttatgtaatggctctccctttcaggatcacg

SEQ ID NO: 211441 - DNA, 75 bp, Artificial Sequence
  Synthetic
aacacacttgcttcccaaggttttgcaaagtccaacaaatcctgaggcaatgctactttgaaatgcacttttatt

SEQ ID NO: 211442 - DNA, 75 bp, Artificial Sequence
  Synthetic
cacagcttccgacagcaacttttgagcacctctagtaaatcctgaagatagcttgttttgtaatgtcctgatcag

SEQ ID NO: 211443 - DNA, 75 bp, Artificial Sequence
  Synthetic
tgttggaactttttcctcttctaaatttaaagcagaaggataaataaccttctgacgcaataccatcctaagtgg

SEQ ID NO: 211444 - DNA, 75 bp, Artificial Sequence
  Synthetic
atggcaggctgtcaaatttaaccaacagatcattagatcttcagtagaagggggttttacacccatcaattcagc

SEQ ID NO: 211445 - DNA, 75 bp, Artificial Sequence
  Synthetic
caaaccaactaatgtttctgacctattttgtgataagtaagccgatgcaaactcctcatgaagctcatttgattt

SEQ ID NO: 211446 - DNA, 75 bp, Artificial Sequence
  Synthetic
caatttgttgtaaagaattcttagtagggacctgacactcgcagtcccctctggtaatgtttgttcaatcaccct

SEQ ID NO: 211447 - DNA, 75 bp, Artificial Sequence
  Synthetic
cattattctgtatcccctattcccatcgacccaatccttgacatctgaatcactgtgaagcaaaaatgggtcaat

SEQ ID NO: 211448 - DNA, 75 bp, Artificial Sequence
  Synthetic
aggatatttactaaactcaagtaatctcaaagttcgtttctgaacttcgttgcaaactgacactggtacaccatt

SEQ ID NO: 211449 - DNA, 75 bp, Artificial Sequence
  Synthetic
ggcaactgcttgatcaataatcgtgtccacagtttcagccaattggtgtggttccttgcatttgatattatgtag

SEQ ID NO: 211450 - DNA, 75 bp, Artificial Sequence
  Synthetic
tgatgctgccacaaatttgctcaacagtggaacttcatcaccccagacataaaatcttgatttgaattcagctac

SEQ ID NO: 211451 - DNA, 75 bp, Artificial Sequence
  Synthetic
aaatctgccaacaacactttttgggcttataaacttgtttaaaagactacttaaatagttgtggaattctagata

SEQ ID NO: 211452 - DNA, 75 bp, Artificial Sequence
  Synthetic
aatgaggaattcttctggatcagtatccatcagttctgtaaatttatgactaaacaaagaaatttggtcatcact

SEQ ID NO: 211453 - DNA, 75 bp, Artificial Sequence
  Synthetic
agatgtataagcttcaatggggttacctgacactaatctcagtgcatagttaatgaacctctcacttatcaaacc

SEQ ID NO: 211454 - DNA, 75 bp, Artificial Sequence
  Synthetic
ataaaaatcagatgtgttgtgcaggattccctgccccatatctagtacagaggaaaagtgagatgggatgacccc

SEQ ID NO: 211455 - DNA, 75 bp, Artificial Sequence
  Synthetic
tctttcaaattcagagaagaacaaactttcagtgatcgtctgagaagtgtctttcatgatccctaattttctctt

SEQ ID NO: 211456 - DNA, 75 bp, Artificial Sequence
  Synthetic
gatataagacctcatcattgctgtgacaacattgaaaggcacctctaccagcttatgaatatgccaagataaaat

SEQ ID NO: 211457 - DNA, 75 bp, Artificial Sequence
  Synthetic
tgttgatatgttgtcacagccttttaattctacttcagttcctttgagtttgggactcaaatttctgtataacat

SEQ ID NO: 211458 - DNA, 75 bp, Artificial Sequence
  Synthetic
caaaaacaagaatgggcacatcatgggtccccatttactatgatccaatgagtaagaggcatgagccaatgaaac

SEQ ID NO: 211459 - DNA, 75 bp, Artificial Sequence
  Synthetic
acccaatttcatgccaagaatagctttttcaaattccttctcattgttaaggcagctaccctctaattgttttgt

SEQ ID NO: 211460 - DNA, 75 bp, Artificial Sequence
  Synthetic
ataagattcaaagtaatcttcaacaaatctagtaaacattttcgttctcaaatcaccaatgtatagctctctatt

SEQ ID NO: 211461 - DNA, 75 bp, Artificial Sequence
  Synthetic
tccaccaacttgctctttatatgatagagagaatttcatcctgccagtgtccggacctgtctctgtatatgaact

SEQ ID NO: 211462 - DNA, 75 bp, Artificial Sequence
  Synthetic
aggagattcttgactataaaaacaaaggtttttaagtgcagatgttaaacagttgactagtgacaatgccttgct

SEQ ID NO: 211463 - DNA, 75 bp, Artificial Sequence
  Synthetic
gagggcttctgagttactttctctttcacttattctcgaatcatccatcaatctgccatgatcaaaccggaaatt

SEQ ID NO: 211464 - DNA, 75 bp, Artificial Sequence
  Synthetic
tagattctgtgatttgtaatgtgaatattttcctgacaatttatttgcatccatctgaagtaataatgacttgaa

SEQ ID NO: 211465 - DNA, 75 bp, Artificial Sequence
  Synthetic
gcagtgaaaatattcccctgacatgtatgtccttgttgctaatgcttgtgtcatcttttctattggacagaggcc

SEQ ID NO: 211466 - DNA, 75 bp, Artificial Sequence
  Synthetic
tgcttcagagtcataaaagtattttgttctaaaatctttattgttaaaagctttctcacacacttccttgtaaaa

SEQ ID NO: 211467 - DNA, 75 bp, Artificial Sequence
  Synthetic
attctcacttagaaggcctttgtcaaagtcctcaaccagatggtatgataattctcctaatattaatcgtctact

SEQ ID NO: 211468 - DNA, 75 bp, Artificial Sequence
  Synthetic
taattcatcttcaacaatgatctttaagtcattgacactcttatcattgttctgggacctcacgcctctgtttgg

SEQ ID NO: 211469 - DNA, 75 bp, Artificial Sequence
  Synthetic
tttgtattgatctaacactctttccacagaggcttttagctgatccatataatcagagtcaacgtctaaaatttc

SEQ ID NO: 211470 - DNA, 75 bp, Artificial Sequence
  Synthetic
ctcaggttgctcagatttagatgagcctataaccaggctggataaaacctcttgaatcttatagtcataatcttc

SEQ ID NO: 211471 - DNA, 75 bp, Artificial Sequence
  Synthetic
tttgttcagcaagtatttaccctttctagaaaagatttctgacaactgacaaacagcaacactaacaagtttatc

SEQ ID NO: 211472 - DNA, 75 bp, Artificial Sequence
  Synthetic
ataattgtaatccaatactctgccatctttagtgtatttattgatcaccacacttttattgctggccaaatccag

SEQ ID NO: 211473 - DNA, 75 bp, Artificial Sequence
  Synthetic
cgcagtggcagatccactgtcttcaagagggtctttcatacccttctttaattctgattctttgaaaagtagccc

SEQ ID NO: 211474 - DNA, 75 bp, Artificial Sequence
  Synthetic
tgaattgaatgcagagagcatcagtgaaaaaacttttttggatacgccaggcttcttggatggtggatcatccac

SEQ ID NO: 211475 - DNA, 75 bp, Artificial Sequence
  Synthetic
ttcatcacaggtttttttactcaagaacatgtttacaccatgcagaatatcatctttttcttcatcagtcggggt

SEQ ID NO: 211476 - DNA, 75 bp, Artificial Sequence
  Synthetic
ttctttgggattgactgttaatgagccaaattgaattttaggttccaaatatttttcaaaacattttatctgatc

SEQ ID NO: 211477 - DNA, 75 bp, Artificial Sequence
  Synthetic
tgttagtctatcaggcgtctcttttgtgataaaatgacagaaataagatatatttaaaataaatttgaacctatt

SEQ ID NO: 211478 - DNA, 75 bp, Artificial Sequence
  Synthetic
gttcaacattgtgcttacttcatcattcagcaaaattgttaagattttccccaaaagcttaaacaagaagaactc

SEQ ID NO: 211479 - DNA, 75 bp, Artificial Sequence
  Synthetic
agcatcagtgatcagttcttccctcaacttgtcaaacaactctacatggtggtaatcagaaacaaatgccatgat

SEQ ID NO: 211480 - DNA, 75 bp, Artificial Sequence
  Synthetic
gaagtatctgagattttgaagtagtttctgggatctcttactgggttgacaaagaatcactagtaaaatcatctt

SEQ ID NO: 211481 - DNA, 75 bp, Artificial Sequence
  Synthetic
tgtcagcttctttatgtcacggagactatcctccaactccacaatacccatcaaccaggtcatcatagtatcaat

SEQ ID NO: 211482 - DNA, 75 bp, Artificial Sequence
  Synthetic
aacctttgtaatcacattttcagaaaatattggacaaaaataccgtttaggatcagcataaaaagagcagatttc

SEQ ID NO: 211483 - DNA, 75 bp, Artificial Sequence
  Synthetic
acccaccctcttactattaacagagtaacattttgacccttcaccagttttttgatagagtaacacaagatctct

SEQ ID NO: 211484 - DNA, 75 bp, Artificial Sequence
  Synthetic
gtactcattccctaactcctgatagtagcactccttacactgcaccactctgtacctttctctccccattgcatt

SEQ ID NO: 211485 - DNA, 75 bp, Artificial Sequence
  Synthetic
ctgtcttgtcttgactgtggaggaggttttcattgagtttacaagggatagtgataaagatgagagcatctttaa

SEQ ID NO: 211486 - DNA, 75 bp, Artificial Sequence
  Synthetic
gtctgagtcatcttcagctgagaattctcttagtggaatgggtggctgttgattggttttaatgtagctgattgt

SEQ ID NO: 211487 - DNA, 75 bp, Artificial Sequence
  Synthetic
cggagtcactcccacaatcttgaatctcatgatttcttctaggccaactttgtttaggaaatcaaatgagacccc

SEQ ID NO: 211488 - DNA, 75 bp, Artificial Sequence
  Synthetic
ataggattcaaagctgagaccaacatcccctaaagctttgcttgacttttgaatcatggtgtttatcatcttatg

SEQ ID NO: 211489 - DNA, 75 bp, Artificial Sequence
  Synthetic
caactctgtcgacttttgtccaacacctccattggccttcaacctacgctttaaccacttagataagtcatgttg

SEQ ID NO: 211490 - DNA, 75 bp, Artificial Sequence
  Synthetic
aatggcaccgacagaaaccagtcggtctcccacactgaaaaatgatgatcctaaccagtccctttcacataaagt

SEQ ID NO: 211491 - DNA, 75 bp, Artificial Sequence
  Synthetic
agggaataattctctaacataacaatggctcataagaatgatggtgtctatcaataacaacagcttccttctagt

SEQ ID NO: 211492 - DNA, 75 bp, Artificial Sequence
  Synthetic
attgagaacttttagtgatttcaccttgttaaaggctgaccttaacccagtgggtagattcgaaatttcattcac

SEQ ID NO: 211493 - DNA, 75 bp, Artificial Sequence
  Synthetic
ttcagcatttgattcactatctatcctcagatgaatataacgcagaatggggctgatgttcggaagctcagcagc

SEQ ID NO: 211494 - DNA, 75 bp, Artificial Sequence
  Synthetic
caatgcatcaactgtggtttcttctaccccacaaattcctatacccttgtacatttcacaatattcttttaacag

SEQ ID NO: 211495 - DNA, 75 bp, Artificial Sequence
  Synthetic
acttttttgatccacttttctaaattggtgcttaatgactcccttttttaatttttgtctaaacacctgataaag

SEQ ID NO: 211496 - DNA, 75 bp, Artificial Sequence
  Synthetic
gttttcaatttgacctttcaattcaaccccaccaatgctcgggtcaatgcctatgtggcatgccttcagtatctc

SEQ ID NO: 211497 - DNA, 75 bp, Artificial Sequence
  Synthetic
attgtagtgttcccccctgcagtctagaagtgaatggagtccttgtgcccctgaggccctacctcccgacacatt

SEQ ID NO: 211498 - DNA, 75 bp, Artificial Sequence
  Synthetic
gagtgattcacaaagtctcagatattctgattcttcaaacaatgcattattctcttgctcaaactcaagaagttt

SEQ ID NO: 211499 - DNA, 75 bp, Artificial Sequence
  Synthetic
aaacaaattgtgtcgaaactgatcgcaaacccattcttccattagtgaattatagtaacttgttctcccatcaat

SEQ ID NO: 211500 - DNA, 75 bp, Artificial Sequence
  Synthetic
gattggtatcagactgatcccagctctctccaagtctccttttaatgaatccaatttcacactgtcttcttgata

SEQ ID NO: 211501 - DNA, 75 bp, Artificial Sequence
  Synthetic
cttctgctggaaatttgtaggatttgacctgacaaaacattcaagtataattagaatgttaccatttagcttcat

SEQ ID NO: 211502 - DNA, 75 bp, Artificial Sequence
  Synthetic
cccatctggaaccacaagagggagagatgggcacagaatgtggttttggaatagaaaattctcaacactttgccc

SEQ ID NO: 211503 - DNA, 75 bp, Artificial Sequence
  Synthetic
ttctgtattgtgtgtgcagcaatttgtatcacatgaatctatttcaatacacagagacaacagttttaacccctc

SEQ ID NO: 211504 - DNA, 75 bp, Artificial Sequence
  Synthetic
aatgagaagggacctaggctcagactggcccaggaacgcaagcttttgtctcgcaattcgttcatcttgtcgaag

SEQ ID NO: 211505 - DNA, 75 bp, Artificial Sequence
  Synthetic
gtatctagaaatgagtagctttgtttctcgaagggattcctccatcagaattcctgctcagatcacaaagcgcat

SEQ ID NO: 211506 - DNA, 75 bp, Artificial Sequence
  Synthetic
ccatcagaattcctgctcagatcacaaagcgcattagacaaatagcttgacacaatgcctaggatcctcggtcgc

SEQ ID NO: 211507 - DNA, 75 bp, Artificial Sequence
  Synthetic
acgcttaacaaccaaatcacaaaaggggtagacatgttcatctgtagaacagaaatgtaacacccctaaaatgga

SEQ ID NO: 211508 - DNA, 75 bp, Artificial Sequence
  Synthetic
agagactgctgtcccccattcatatttcattcattttaggtccttaggtctgagtggcaagtccccttactcgtc

SEQ ID NO: 211509 - DNA, 75 bp, Artificial Sequence
  Synthetic
ttctgaccgaattgtcttcaaagttcataatcagctggtttctctaaggccagaggttatttctgatcagtatga

SEQ ID NO: 211510 - DNA, 75 bp, Artificial Sequence
  Synthetic
taatgcagtgggtcatacatttaatctgatccactttgtcgggtgttatatgggtcaggtcagatcactcaatgc

SEQ ID NO: 211511 - DNA, 75 bp, Artificial Sequence
  Synthetic
atacaaataccctgcaattgtggataaaaagaaacctagtatcaccctgggaaaagcccccgatctgaatacagc

SEQ ID NO: 211512 - DNA, 75 bp, Artificial Sequence
  Synthetic
caccgtcatacaaagctgtgccccacacgagatgtctgtgttaggaggatatctgggagaagagttctttggaag

SEQ ID NO: 211513 - DNA, 75 bp, Artificial Sequence
  Synthetic
atacaagtcaatcctatctgggatgaatgctgccaagcttgatcctgatgatgtgtgttcttatttggctgcggc

SEQ ID NO: 211514 - DNA, 75 bp, Artificial Sequence
  Synthetic
gggaacctttgaaagacgattcttcagggatgagaaagaactgcaggactatgaagccgccgaggcaactaagat

SEQ ID NO: 211515 - DNA, 75 bp, Artificial Sequence
  Synthetic
aatggtatacttcgaaggaatatgtccagaagactggactagctacgggataaacattgccagaaaaggagataa

SEQ ID NO: 211516 - DNA, 75 bp, Artificial Sequence
  Synthetic
agatttggcattggaggacgatggaaccgtgaactcagatgatgaagacttcttctcaggagagaccagaagccc

SEQ ID NO: 211517 - DNA, 75 bp, Artificial Sequence
  Synthetic
gataactcctgcagtcctagttgatatacaaaggacaaacacagaagggaactgggctcaagctggaggacaaga

SEQ ID NO: 211518 - DNA, 75 bp, Artificial Sequence
  Synthetic
tgaggcagtttactcaaggatcatgatgagtggggggaggctcaaaaagtctcacatcaagaggtacatctcagt

SEQ ID NO: 211519 - DNA, 75 bp, Artificial Sequence
  Synthetic
cctcactagagacccaacaacaccagagcatgcgtctttagtcgggctcctcttgtgtctatacagactaagcaa

SEQ ID NO: 211520 - DNA, 75 bp, Artificial Sequence
  Synthetic
cagttcaaaccatcaggccagacctaattcatttgcggaatttctcaataagacttatgccagtgatacaagata

SEQ ID NO: 211521 - DNA, 75 bp, Artificial Sequence
  Synthetic
gatagttggacaaaacaccgggaattacaagaccaatgtggcagagagaatggagcagatctttgagactgcacc

SEQ ID NO: 211522 - DNA, 75 bp, Artificial Sequence
  Synthetic
aacccattcattcgtcaagatttaagaatattcaagctgatctcaaaacatcctgaaaaaaactaacaccactcc

SEQ ID NO: 211523 - DNA, 75 bp, Artificial Sequence
  Synthetic
atttgtcaaaattgtggaacatcacaccttaatgaccacccacaaaatgtgtgcaaattggagcacaataccaaa

SEQ ID NO: 211524 - DNA, 75 bp, Artificial Sequence
  Synthetic
gttggtcctctcatcatcatgagcaagatctttgtcaaccccagtgcaatcagagctggtctggcagatctggag

SEQ ID NO: 211525 - DNA, 75 bp, Artificial Sequence
  Synthetic
cttcagatttctagcaggggtgtatgacatgttcttttcaagaatcgagcacctgtactcagcaattcgtgtggg

SEQ ID NO: 211526 - DNA, 75 bp, Artificial Sequence
  Synthetic
atggcggaggagactattgatttgatcaatagaaccatagaggataatcaggcccatctgcaaggagtccccata

SEQ ID NO: 211527 - DNA, 75 bp, Artificial Sequence
  Synthetic
aacagttgtgactgcgtatgaagactgctctgggctggtgtcatttaccacgtttatcagacaaattaacttaac

SEQ ID NO: 211528 - DNA, 75 bp, Artificial Sequence
  Synthetic
gaggtcgaagcccttccagaggatatgaagaagcttcaaatttccgaccatcaacaaggtcaaccatccggaggg

SEQ ID NO: 211529 - DNA, 75 bp, Artificial Sequence
  Synthetic
tgctagagatgctgttttgtacttctttcacaagaacttcgaagaggagatcaagagaatgttcgagcctggtca

SEQ ID NO: 211530 - DNA, 75 bp, Artificial Sequence
  Synthetic
gcaactgggcaggatgggagtgaggaagaagacttctatatgacagagagtgagaacccatatattccgttccag

SEQ ID NO: 211531 - DNA, 75 bp, Artificial Sequence
  Synthetic
agagactgcagttcctcactcatatttcattcatttcaggtccctagggctgagtggtaagtctccttactcatc

SEQ ID NO: 211532 - DNA, 75 bp, Artificial Sequence
  Synthetic
tcatatcttgatgctgttggaattcagcttgttaggaagatgaagacaggagagggattcctcaagatttggtca

SEQ ID NO: 211533 - DNA, 75 bp, Artificial Sequence
  Synthetic
taatgcagtgggtcatacatttaatctgatccactttgtcgggtgttacatgggtcaggtcagatctctcaatgc

SEQ ID NO: 211534 - DNA, 75 bp, Artificial Sequence
  Synthetic
caggccgccgaggaaatagtctcctatgttgccatcaacttcccccttcctgctgacaaagaatccgctgaaaag

SEQ ID NO: 211535 - DNA, 75 bp, Artificial Sequence
  Synthetic
cactgtcatacaaagttgtgctccacacgagatgtctgtgttaggaggatatctgggagaggagttctttgggag

SEQ ID NO: 211536 - DNA, 75 bp, Artificial Sequence
  Synthetic
tcaactcagactgtgggggagcctctcaagtccaacagtgcatcgaacacccccaataagagatcaaaaccctcg

SEQ ID NO: 211537 - DNA, 75 bp, Artificial Sequence
  Synthetic
aggaacctttgaaagacgattcttcagggatgagaaggagctgcaggactatgaagccgccgaagcgaccaaaat

SEQ ID NO: 211538 - DNA, 75 bp, Artificial Sequence
  Synthetic
acatcgacagatctaaaggctcaagaagcgtctggccctcacggcattgactgggcagcaagcaatgatgaagat

SEQ ID NO: 211539 - DNA, 75 bp, Artificial Sequence
  Synthetic
agatttagcgttggaggatgatggaaccgtgaactcagatgatgaagacttcttctccggagagactagaagccc

SEQ ID NO: 211540 - DNA, 75 bp, Artificial Sequence
  Synthetic
gatgcatctgtagaggcagaaattgcccatcagattgccgaaagtttctcgaagaagtacaaattcccctccaga

SEQ ID NO: 211541 - DNA, 75 bp, Artificial Sequence
  Synthetic
tgaagcagtttactccagaatcatgatgagtgggggaaggctcaaaaagtcccacattaagaggtacatctcagt

SEQ ID NO: 211542 - DNA, 75 bp, Artificial Sequence
  Synthetic
tcatccgggatatttctttggaactttgaacagcttaaaatgaatttggatgatattgtcggcggggcaaaggag

SEQ ID NO: 211543 - DNA, 75 bp, Artificial Sequence
  Synthetic
cagctcaaaccatcaggctagacccaactcctttgcagagtttctcaacaagacctatgccagtgatacaaggta

SEQ ID NO: 211544 - DNA, 75 bp, Artificial Sequence
  Synthetic
attccgggtgtaattaggatggccaaagaaggcaacaaactgccactcaggtgcatcctaggaggtgtggcattg

SEQ ID NO: 211545 - DNA, 75 bp, Artificial Sequence
  Synthetic
aacccatttatctatcaagatttaagaatattcaagttgatctcacaacatcctgaaaaaaactaacaccactcc

SEQ ID NO: 211546 - DNA, 75 bp, Artificial Sequence
  Synthetic
acccattccaagagatttcaagtcctagtcaactccgaaaagctaggcaggatcatgcaggaggacttgaacaaa

SEQ ID NO: 211547 - DNA, 75 bp, Artificial Sequence
  Synthetic
gttggtcctatcatcattatgagcaagatttttgtcaaccccagtgcaatcagagctggtctggcagatctggaa

SEQ ID NO: 211548 - DNA, 75 bp, Artificial Sequence
  Synthetic
taccttgcaaattaactcacaactagtcacctcaactagttgtcattgaagcaggtcaatgaataatcatgaaaa

SEQ ID NO: 211549 - DNA, 75 bp, Artificial Sequence
  Synthetic
atggcggaagagaccattgatttgatcaatagaaccatagaggacaatcaggcccatttgcaaggagtccctata

SEQ ID NO: 211550 - DNA, 75 bp, Artificial Sequence
  Synthetic
aaacgtataacaccactgacaagatgaacattatccgcaagatagtaaagagctgcaaggacgaggaagaacata

SEQ ID NO: 211551 - DNA, 75 bp, Artificial Sequence
  Synthetic
gaggtcgatgcccttccagaggatatgaagaagcttcaaatttcagaccatcaacatggtcaaccatcaggagga

SEQ ID NO: 211552 - DNA, 75 bp, Artificial Sequence
  Synthetic
agcctaatccggtgtcagctcctccagacgatgacgatctgtggctcccccctccggagtatgttcctctggcgg

SEQ ID NO: 211553 - DNA, 75 bp, Artificial Sequence
  Synthetic
gcaaccggacaggatggaagtgaggaagaggacttctacatgacagagagtgagaacccatatattccattccag

SEQ ID NO: 211554 - DNA, 75 bp, Artificial Sequence
  Synthetic
agataaccggcaagaagaacatgagaaacttctgcattaatggggaagtcaaggtctgcagccccaatggatact

SEQ ID NO: 211555 - DNA, 75 bp, Artificial Sequence
  Synthetic
tcataccttgatgctgttgggattcaacttgttaggaagatgaagacaggagagggattcctcaagatctggtca

SEQ ID NO: 211556 - DNA, 75 bp, Artificial Sequence
  Synthetic
cattcaggatcctacgacatatcctgaagtcattcgagggtgtttattcaggaaatagaagaatgataggtcttg

SEQ ID NO: 211557 - DNA, 75 bp, Artificial Sequence
  Synthetic
aaggctgccgaggagatagtctcctatgtcgccatcaactttccccttcctgcagataagaactctgcagagaaa

SEQ ID NO: 211558 - DNA, 75 bp, Artificial Sequence
  Synthetic
tcaaagtggtgatagggttagcacaatctggggcccctgttcctgaggggatgaactgggtctataaaataaggc

SEQ ID NO: 211559 - DNA, 75 bp, Artificial Sequence
  Synthetic
tcaactcagactgtggcggaacctcccaggcccaacactgcatcgaccacccccagcaagaggtctaaacccaca

SEQ ID NO: 211560 - DNA, 75 bp, Artificial Sequence
  Synthetic
gcacccttgtgtttcagtgggctgaatcttctggacctctggatggggaggaactggagtactctcaggagatca

SEQ ID NO: 211561 - DNA, 75 bp, Artificial Sequence
  Synthetic
atatccacagatctgaaggctcaagaatcatctggccctcacggcatcgactgggcggcaagcaatgacgaggat

SEQ ID NO: 211562 - DNA, 75 bp, Artificial Sequence
  Synthetic
cctgggacgatgactcagagtttgtaggactgcagatccgggtaagcgcaaggcagtgtcacatccaagggagac

SEQ ID NO: 211563 - DNA, 75 bp, Artificial Sequence
  Synthetic
gatgcatctgtagaggcagaaattgcccatcagattgcagaaagtttctcgaagaagtacaagttcccctctaga

SEQ ID NO: 211564 - DNA, 75 bp, Artificial Sequence
  Synthetic
tatggtgtattaacatgaactcaagggcgtgtcagctttgggcagacatgtcactgaaaactcaacagtctaatg

SEQ ID NO: 211565 - DNA, 75 bp, Artificial Sequence
  Synthetic
tcatctgggatctttctttggaactttgaacagcttaaaatgaatttggatgacattgttagtggggcgaaggag

SEQ ID NO: 211566 - DNA, 75 bp, Artificial Sequence
  Synthetic
aagacaagaacacctccctgcttcttgaatgaccataactaaacgctctgatcatatggattacctccacaccaa

SEQ ID NO: 211567 - DNA, 75 bp, Artificial Sequence
  Synthetic
attccgggcgtaattaggatggctaaagaaggcaacaagctgccactcaggtgcatcctgggaggtgtggcatta

SEQ ID NO: 211568 - DNA, 75 bp, Artificial Sequence
  Synthetic
tgaatgaccataactaaacgctctgatcatatggattacctccacaccaaaccatgcacacgagcactctcttcc

SEQ ID NO: 211569 - DNA, 75 bp, Artificial Sequence
  Synthetic
acccattccaagagatttcaagtcttggtcaactctgagaagctaggccggatcatgcaggaggatttgaacaaa

SEQ ID NO: 211570 - DNA, 75 bp, Artificial Sequence
  Synthetic
cgctcctcactgccgttattgcctttctcttcattagcaccttctgttcaggaaaatttcccatttacacgatcc

SEQ ID NO: 211571 - DNA, 75 bp, Artificial Sequence
  Synthetic
taccttgcaaattaacctacaattagtcacctcaattagttgtcgttaaaacaggtcaataactaatcatggaaa

SEQ ID NO: 211572 - DNA, 75 bp, Artificial Sequence
  Synthetic
ccgacaagattgggccttggagccccattgatataaatcatctcagctgtccgaacaacttagaggtagaggatg

SEQ ID NO: 211573 - DNA, 75 bp, Artificial Sequence
  Synthetic
aaacatataacaccactgacaagatgaacattatccgcaaaatagtgaagagttgcaaggacgaggaagaacata

SEQ ID NO: 211574 - DNA, 75 bp, Artificial Sequence
  Synthetic
aggggtgtactactctcaccgcattcaactacatggaactcaaggtaggatacataacatctattaaagtcgacg

SEQ ID NO: 211575 - DNA, 75 bp, Artificial Sequence
  Synthetic
agcccaatccagtgtcagctcctcctgatgacgacgatctgtggctcccccctccagagtatgtccccctggcgg

SEQ ID NO: 211576 - DNA, 75 bp, Artificial Sequence
  Synthetic
gattcacttgtacaggggtggttacggaggcagagacttacacgaactttgtggggtatgtgaccacaacattta

SEQ ID NO: 211577 - DNA, 75 bp, Artificial Sequence
  Synthetic
agataacaggcaagaagaacatgaggaacttctgcataaatggggaagtcaaagtgtgcagtcccaacggatact

SEQ ID NO: 211578 - DNA, 75 bp, Artificial Sequence
  Synthetic
aaaggaagcactttcgccctaatgtcagcgcctgcagggcagcctttagttggaagacagcaggcgatccgaggt

SEQ ID NO: 211579 - DNA, 75 bp, Artificial Sequence
  Synthetic
catttaggatcttgcgacacatcctgaagtcattcgagggtgtttactcggggaatcgacgaatgataggccttg

SEQ ID NO: 211580 - DNA, 75 bp, Artificial Sequence
  Synthetic
atgaggagtcattgcacaatccctatcctgattcccattggttgaggacagtaaccaccacaaaagaatctttgt

SEQ ID NO: 211581 - DNA, 75 bp, Artificial Sequence
  Synthetic
tcaaggtggtgataggtttggctctctctggggccccagtccctgaggggatgaactgggtttataagataaggc

SEQ ID NO: 211582 - DNA, 75 bp, Artificial Sequence
  Synthetic
tgattatctctcctagtgttgtcgacatggacgcctatgacaagacactctactccaagatgttccccaacggga

SEQ ID NO: 211583 - DNA, 75 bp, Artificial Sequence
  Synthetic
gcacccttgtgtttcagtgggctgagtctgctggacctctggatggagaggagctggagtactctcaggaaatta

SEQ ID NO: 211584 - DNA, 75 bp, Artificial Sequence
  Synthetic
aatgctttccaccaatatcagattctccattctgctcgaccaatcatgattatacattatggcttcccgaaaaag

SEQ ID NO: 211585 - DNA, 75 bp, Artificial Sequence
  Synthetic
cctgggacgatgactcagagtttgtaggactgcagatccgggtaagcgccagacagtgtcacatccaagggagac

SEQ ID NO: 211586 - DNA, 75 bp, Artificial Sequence
  Synthetic
agaagcttagcatgtcctgcaatatatttgtctccagtaaggggaagaaagcaacaaaggacggtagattgtgcg

SEQ ID NO: 211587 - DNA, 75 bp, Artificial Sequence
  Synthetic
tatggtgtatcaacatgaactcaagggcgtgtcagctttgggcagacatgtcgctgaaaactcaacagtccaatg

SEQ ID NO: 211588 - DNA, 75 bp, Artificial Sequence
  Synthetic
gatttgtcgatgaaagaggactgtacaagtctctcaaaggggcatgtaaattgaagttatgtgggatggcaggca

SEQ ID NO: 211589 - DNA, 75 bp, Artificial Sequence
  Synthetic
aagacaagaacacttccctgcttcttgaatgaccataacagaatgctctgatcatatggattacctccacaccaa

SEQ ID NO: 211590 - DNA, 75 bp, Artificial Sequence
  Synthetic
tgaggctgatggacgggtcttgggtgtccctacaaagggcagatgcccctgagtggtgtccccccggtgctcttg

SEQ ID NO: 211591 - DNA, 75 bp, Artificial Sequence
  Synthetic
tgaatgaccataacagaatgctctgatcatatggattacctccacaccaaaccatgcacacaagcactctcttcc

SEQ ID NO: 211592 - DNA, 75 bp, Artificial Sequence
  Synthetic
gtctttatgcgagcaatagatcaacatatgtaatggtgcctcactatagctgcatactcttaatatatataatca

SEQ ID NO: 211593 - DNA, 75 bp, Artificial Sequence
  Synthetic
ttaatgtgcacgattttcattcagacgagatagcccactttgttgttgaggagctaataaagaaacgagaagaat

SEQ ID NO: 211594 - DNA, 75 bp, Artificial Sequence
  Synthetic
gataccttcacatgtgaatccactgcaatgtgaaaaaaacattcaacatccctcgaaaaagctcaaaagccatgt

SEQ ID NO: 211595 - DNA, 75 bp, Artificial Sequence
  Synthetic
gcttggacaccttagagaccatcctcaccactaagtctataagctttaggcgtctgagccatttcagaaagctgg

SEQ ID NO: 211596 - DNA, 75 bp, Artificial Sequence
  Synthetic
cgctcctcactgccgttattgcctttttcttcattagcaccttctgttcaggaaaattccccatttacacgatcc

SEQ ID NO: 211597 - DNA, 75 bp, Artificial Sequence
  Synthetic
tgcctggtctagggaaggcatatactctaataaacaacaccttgatggaagctgaagctcactataagtctatta

SEQ ID NO: 211598 - DNA, 75 bp, Artificial Sequence
  Synthetic
ccgacaaaatcgggccttggagccctattgatataaatcatcttagctgtccgaacaacttagaggtagaagatg

SEQ ID NO: 211599 - DNA, 75 bp, Artificial Sequence
  Synthetic
gggaatggaaagaaattattccatctaaaggttgtttgaaggcgggggggcgttgtcatcctcactatgatggga

SEQ ID NO: 211600 - DNA, 75 bp, Artificial Sequence
  Synthetic
aggggtgcaccaccctcaccgcgtttgactacatggagctcaaggtgggatacataacctctattaaggtcgacg

SEQ ID NO: 211601 - DNA, 75 bp, Artificial Sequence
  Synthetic
tctttttcaatgggataattctcggtccgaacggagatgtgctcatcccagagatgcaatcgtccctgcttcagc

SEQ ID NO: 211602 - DNA, 75 bp, Artificial Sequence
  Synthetic
ggttcacttgcacaggggtagtcaccgaggcagagacctacacgaattttgtgggatatgtgactacaacgttta

SEQ ID NO: 211603 - DNA, 75 bp, Artificial Sequence
  Synthetic
aacacatagagttgttggagtcatctatgattcctcttagacaccctctggctgattcttctgctatattcagga

SEQ ID NO: 211604 - DNA, 75 bp, Artificial Sequence
  Synthetic
aaagaaagcacttccgtcctaatgtcaatgcatgcagagccgcttttagttggaagatagcaggtgatccaaggt

SEQ ID NO: 211605 - DNA, 75 bp, Artificial Sequence
  Synthetic
gtgataatgaggctgaggactttgtagatgttcatcttcctgatacacaaaaacaagtgtcagatatagatttgg

SEQ ID NO: 211606 - DNA, 75 bp, Artificial Sequence
  Synthetic
acgaggagtcattacacaatccttatcctgattctcattggttgaggacagtaaccaccacaaaagaagctctgt

SEQ ID NO: 211607 - DNA, 75 bp, Artificial Sequence
  Synthetic
gctttccggaatggaagcgctatttcttgataggggtctctgcaattgccttgttctctctagcaataataatag

SEQ ID NO: 211608 - DNA, 75 bp, Artificial Sequence
  Synthetic
tgattatatctcctagtgttgttgacatggatgcctatgataagacactttattccaaactgtttcccaccggaa

SEQ ID NO: 211609 - DNA, 75 bp, Artificial Sequence
  Synthetic
ctgtttgttgtagaaagttcaagagaaggaagaggcccaaaccaggcccaattgagttggtgaggaaagtttccg

SEQ ID NO: 211610 - DNA, 75 bp, Artificial Sequence
  Synthetic
aatgcttcccacctatatcggattctcctttttgctcgaccaatcatgattatactttatggcttccggagaagg

SEQ ID NO: 211611 - DNA, 75 bp, Artificial Sequence
  Synthetic
ttacttcccaaagtggaaaggtggtcccgtcttgggagtcctacaaagagggtgccacaagtcaaccttaacaat

SEQ ID NO: 211612 - DNA, 75 bp, Artificial Sequence
  Synthetic
agaaactcagcatgtcctgcaatatatttgtctccagtaaggggaagaaagcaacaaaagacggcagactgtgtg

SEQ ID NO: 211613 - DNA, 75 bp, Artificial Sequence
  Synthetic
tcactgtgtgtataatcggttgaggtggctggatcctcctcatcatattcatatcagggtcctaaaaccatcatt

SEQ ID NO: 211614 - DNA, 75 bp, Artificial Sequence
  Synthetic
gatttgtcgatgagagagggctgtacaagtctctgaaaggggcatgtaaactaaagttgtgtggaatggcaggca

SEQ ID NO: 211615 - DNA, 75 bp, Artificial Sequence
  Synthetic
tcacttgaccattttgcaggtgatagcctttgtgaaccaaatattgtggtgaatcaacgacctgacaattgcttt

SEQ ID NO: 211616 - DNA, 75 bp, Artificial Sequence
  Synthetic
tgaggctgatggatgggtcctgggtgtctctgcaaaagggagatgcccctgagtggtgtccccccggtgctcttg

SEQ ID NO: 211617 - DNA, 75 bp, Artificial Sequence
  Synthetic
ctgacaggtgtagtgtcattccctacggtgaaagtgaacatgtcagaacactgtgattcgtgctctccggagatt

SEQ ID NO: 211618 - DNA, 75 bp, Artificial Sequence
  Synthetic
ttaatgtgcatgacttccattcagacgagatcgcccacttcgtcgtagaggagctaataaagaaacgagaagagt

SEQ ID NO: 211619 - DNA, 75 bp, Artificial Sequence
  Synthetic
ggcatgggatcacatttgcataagatgccggtgcttccagtgatccaaattgcgcagcttggtggtgttatgctg

SEQ ID NO: 211620 - DNA, 75 bp, Artificial Sequence
  Synthetic
gcttggacaccttagagaccatcctaaccaccaagtctataagtttcaggcgtctgagccattttagaaagctgg

SEQ ID NO: 211621 - DNA, 75 bp, Artificial Sequence
  Synthetic
agataatactagtaggatgattctagtcggcaatccataagaatcatacagatctgcttcgcactaactgtccca

SEQ ID NO: 211622 - DNA, 75 bp, Artificial Sequence
  Synthetic
tgcccggtctggggaaggcatatacgttgataaataataccttgatggaagctgaggctcactataagtctatca

SEQ ID NO: 211623 - DNA, 75 bp, Artificial Sequence
  Synthetic
tctctcaagcttgaataaaacctcaccctagatctcctctgaatggaattgtaagacaggaagaatcatcttcat

SEQ ID NO: 211624 - DNA, 75 bp, Artificial Sequence
  Synthetic
gggaatggaaagagattattccatccaaaggttgtttgaaggcgggggggcgttgtcatcctcattatgatggga

SEQ ID NO: 211625 - DNA, 75 bp, Artificial Sequence
  Synthetic
aaatctgggattataaacatggacaaaaaaggcggtacacaaggttagaatatcatgaaaaaaacatgacatgtg

SEQ ID NO: 211626 - DNA, 75 bp, Artificial Sequence
  Synthetic
tcttttttaatgggataatcctcggcccgaacggagatgtgctcatcccggagatgcaatcatccttgcttcagc

SEQ ID NO: 211627 - DNA, 75 bp, Artificial Sequence
  Synthetic
taaagacctaacacccctccttcataataacctctccaacatgattgagtctactgaggtttatgacgacccggt

SEQ ID NO: 211628 - DNA, 75 bp, Artificial Sequence
  Synthetic
aacacatagagttattggagtcgtctaggattccccttagacaccctctggctgattcctctgctgtattcagga

SEQ ID NO: 211629 - DNA, 75 bp, Artificial Sequence
  Synthetic
agaccctgtagagcccgatgttgacattagaaacaactctgttgtacctaacattctgagaaactctgactacaa

SEQ ID NO: 211630 - DNA, 75 bp, Artificial Sequence
  Synthetic
gtgacaatgaggcagaggactttgtagatgttcatcttcccgatgcacaaaagcaagtgtcagatatcgatttgg

SEQ ID NO: 211631 - DNA, 75 bp, Artificial Sequence
  Synthetic
cttgaactctccactcttagaagacccttcccgactcatgttggactggcttatcaccgggaataaaccttgtcg

SEQ ID NO: 211632 - DNA, 75 bp, Artificial Sequence
  Synthetic
ggttcccggaatggaagcgctatttcttgataggggtgtctgctattgccttgttctcattagcaataataatag

SEQ ID NO: 211633 - DNA, 75 bp, Artificial Sequence
  Synthetic
attgaatctaacagacaacctgttcaggtcctataaagtcttgaggagctatttcaagaaaattgatataggctc

SEQ ID NO: 211634 - DNA, 75 bp, Artificial Sequence
  Synthetic
ctgtttgttgcagaaagttcaagagaaggaagaggcctaaaccaagccctattgagctggtgaggaaagtctcag

SEQ ID NO: 211635 - DNA, 75 bp, Artificial Sequence
  Synthetic
cctaaaagtgggaagtctcggtgcacagtccatgacaactctatggctacatggatcacatgcagagtcgaccag

SEQ ID NO: 211636 - DNA, 75 bp, Artificial Sequence
  Synthetic
tcacttcccaaagtggaaaggtggttccgtcttgggagtcctacaaagagggtgccacaagtcaaccttaacaat

SEQ ID NO: 211637 - DNA, 75 bp, Artificial Sequence
  Synthetic
gagcagaaaatgtctatctgacctttctcagttttacaaaaaatcctccccaatagaaatccttctgaactatac

SEQ ID NO: 211638 - DNA, 75 bp, Artificial Sequence
  Synthetic
tcactgtgtgtttgatcgatcgaggtggctggatcctcctcatcacatccacatcagggtcctgaaaccatcatt

SEQ ID NO: 211639 - DNA, 75 bp, Artificial Sequence
  Synthetic
attggagaatcgagggctccaaaccccggccgagggagtcctatctagcctaaacaaagtccattatgatcaggc

SEQ ID NO: 211640 - DNA, 75 bp, Artificial Sequence
  Synthetic
tcacttgaccattcttcaggtgatcgccttcgcgaaccaaatattgtggtgaatcaatgacttgacaattgttct

SEQ ID NO: 211641 - DNA, 75 bp, Artificial Sequence
  Synthetic
gtttggacgctatctaggaaatacctactctgcttatttgtttttccatgtcatcatattatacatgaatgcact

SEQ ID NO: 211642 - DNA, 75 bp, Artificial Sequence
  Synthetic
ctgacaggggtggtgtcactcttcacagtaagagtgggcatgtcagaacactgtgattagtgcactccggagatt

SEQ ID NO: 211643 - DNA, 75 bp, Artificial Sequence
  Synthetic
ggactgggatgaagagaagactatcctggcgttgtggaaggacattgcatccatagatgtcaagaatgatctagt

SEQ ID NO: 211644 - DNA, 75 bp, Artificial Sequence
  Synthetic
ggcatgggatcacatttgcataagatgccggtgcttccagtgatccgaactgcgcagcttgattgtgtcagttcg

SEQ ID NO: 211645 - DNA, 75 bp, Artificial Sequence
  Synthetic
taaattcagggatcagatctggggatccctagttgtaaccaaagatttcgtgtattcccagagtgccaattgtct

SEQ ID NO: 211646 - DNA, 75 bp, Artificial Sequence
  Synthetic
agataatgctcataggaggattctaatcggcaatctataagaatcatacagatctgcttcgcactaactgtctca

SEQ ID NO: 211647 - DNA, 75 bp, Artificial Sequence
  Synthetic
tttcgacagaaattacaccctaatgctcaaagacctgtttctttcaagatttaactcacttctgatcttgctgtc

SEQ ID NO: 211648 - DNA, 75 bp, Artificial Sequence
  Synthetic
tctctcaagcttgaataaaacctcaccttagacctccaccgaatggaattctgagacagggagattcatcttcac

SEQ ID NO: 211649 - DNA, 75 bp, Artificial Sequence
  Synthetic
ccctccagaatttaggtattccgatgatctggtttctaccttatgtcagctttacatagcaggggataaggtcct

SEQ ID NO: 211650 - DNA, 75 bp, Artificial Sequence
  Synthetic
aaatctaggagcatgattatggacaataaaggcggcacacagagttagaatctcatgaaaaaaacatgacacatg

SEQ ID NO: 211651 - DNA, 75 bp, Artificial Sequence
  Synthetic
agcatcgtgtggcaattccggatatgatgtcatcaagatgttagagccttacattgttaacaagctggtgcaaag

SEQ ID NO: 211652 - DNA, 75 bp, Artificial Sequence
  Synthetic
tgagaaactaacacccctccttcatgataacctctccaacatgatcgagtctactgaggtttatgacgacccggt

SEQ ID NO: 211653 - DNA, 75 bp, Artificial Sequence
  Synthetic
ggcagagagcttcaggcctcttatccactctttaggagacttccctcaatttatccgagacaagacaacccagtt

SEQ ID NO: 211654 - DNA, 75 bp, Artificial Sequence
  Synthetic
agatcctgtagaacctgatgttgacattagaaacaactctgtcgtacctaacattcttagaaactctgactataa

SEQ ID NO: 211655 - DNA, 75 bp, Artificial Sequence
  Synthetic
ggaagggatctttggccccagagcaagggagttctttcagactatggacctgctagacaacatacacgacctcgt

SEQ ID NO: 211656 - DNA, 75 bp, Artificial Sequence
  Synthetic
cttgaactctccactattagaagatccctctaggcttatgttggattggcttgtcaccgggaacaaaccttgtcg

SEQ ID NO: 211657 - DNA, 75 bp, Artificial Sequence
  Synthetic
cttcacctatggttgttatagacattgggggcacccctatattgattacaggaaggggctctccaaactctatga

SEQ ID NO: 211658 - DNA, 75 bp, Artificial Sequence
  Synthetic
attgaatctaacagacaacctgttcagatcttataaagtcttgaggagttattttaaaaagattgatatcggatc

SEQ ID NO: 211659 - DNA, 75 bp, Artificial Sequence
  Synthetic
ccaggttcatgtaaagaaggtgatagatcaacactaccaggagtgtctagcaagtgatttggccaaaaggatcct

SEQ ID NO: 211660 - DNA, 75 bp, Artificial Sequence
  Synthetic
attaaaagtaggaagtctcggtgcacagtctatgacaactctgtggctacatggatcccatgcggagtcgaccag

SEQ ID NO: 211661 - DNA, 75 bp, Artificial Sequence
  Synthetic
ccggtgggggtttgataagtactcacgttggtatttagatcaagaactcttgcccaaagatcaccctttgactcc

SEQ ID NO: 211662 - DNA, 75 bp, Artificial Sequence
  Synthetic
gagcagaaaatgtctatctgacctttcccagttttacaagaaatcctctccgatagaaatccttctgaactatac

SEQ ID NO: 211663 - DNA, 75 bp, Artificial Sequence
  Synthetic
ctatgtgaagacccagacatggcctcccaaacatgtagttgatctaattggtgattcctggcacaatctcccgat

SEQ ID NO: 211664 - DNA, 75 bp, Artificial Sequence
  Synthetic
attggagaataggggtcttcagaccccggctgagggagtcctctctagcctaagcaaagtccattatgaccaagc

SEQ ID NO: 211665 - DNA, 75 bp, Artificial Sequence
  Synthetic
cactcaattgtttgaaatcccagagtctatggatccctctgaaattctagatgataaatcccactcttttaccag

SEQ ID NO: 211666 - DNA, 75 bp, Artificial Sequence
  Synthetic
gtttgggcgctatctaggaaacacttactctgcttatctgttcttccatgtcataatattatacatgaatgcgtt

SEQ ID NO: 211667 - DNA, 75 bp, Artificial Sequence
  Synthetic
gacaaagttggcctcttggctttcagaaaataggggtggtccagttcccagtgagaaagtcatcatcacggcact

SEQ ID NO: 211668 - DNA, 75 bp, Artificial Sequence
  Synthetic
ggactgggatgaagagaagactatattggcgttgtggaaggatattgcgtccatagatgtcaagaatgatctagt

SEQ ID NO: 211669 - DNA, 75 bp, Artificial Sequence
  Synthetic
gtctaggccccccgtcaatcctagagagttcctcaggtctatagatgtgggggggctgcccgacgatgacctaat

SEQ ID NO: 211670 - DNA, 75 bp, Artificial Sequence
  Synthetic
taaattcagagatcagatctggggatctcttgtagtgactaaagactttgtgtattcccaaagtgccaactgcct

SEQ ID NO: 211671 - DNA, 75 bp, Artificial Sequence
  Synthetic
cattggcttaaagcccaaggaaagggagctcaaagtagaggggagattcttcgcactgatgtcttggaaccttcg

SEQ ID NO: 211672 - DNA, 75 bp, Artificial Sequence
  Synthetic
ctttgaccgaaattacacactaatgctcaaagacttattcctttctagatttaattcacttctgatcctgctgtc

SEQ ID NO: 211673 - DNA, 75 bp, Artificial Sequence
  Synthetic
actttactttgtaatcacggaaaagctcctagcaacttacattttgcccctgtttgatgcattgactatgacaga

SEQ ID NO: 211674 - DNA, 75 bp, Artificial Sequence
  Synthetic
tcctccagagtttcgatattctgatgacttagtttctaccctatgtcagctttacatagctggggacaaggtctt

SEQ ID NO: 211675 - DNA, 75 bp, Artificial Sequence
  Synthetic
caacctgaacaaagtttttaagaagctcatagatagggtgacaggccaaggtttattagattactccagagtaac

SEQ ID NO: 211676 - DNA, 75 bp, Artificial Sequence
  Synthetic
ggcatcatgtggcaactctggatatgatgtcatcaagatgttggagccttacattgtcaacaagctggtgcaaag

SEQ ID NO: 211677 - DNA, 75 bp, Artificial Sequence
  Synthetic
ctatgcattccacttagactatgagaagtggaacaatcatcagagattggaatcaacaaaagatgtcttttcagt

SEQ ID NO: 211678 - DNA, 75 bp, Artificial Sequence
  Synthetic
ggcagagagcttcaggcctcttatccactccttaggagatttccctcaattcatccgagacaagacaacccagct

SEQ ID NO: 211679 - DNA, 75 bp, Artificial Sequence
  Synthetic
tcttgataaggcattcggactcaagagggtgttctcaagaacacacgaattcttccaaaaatcctggatttatta

SEQ ID NO: 211680 - DNA, 75 bp, Artificial Sequence
  Synthetic
ggaagggatctttggccccagagcaagagagttctttcagactatggacttgctagacaatatacatgacctcgt

SEQ ID NO: 211681 - DNA, 75 bp, Artificial Sequence
  Synthetic
ttctgatagatcagacttgataggtatgtggaaggaccaaatttattgtctggacatgagcaacggaccgacatg

SEQ ID NO: 211682 - DNA, 75 bp, Artificial Sequence
  Synthetic
cttcacctatggttgttataggcattggggacacccttatattgattacaggaaggggcttactaaactctatga

SEQ ID NO: 211683 - DNA, 75 bp, Artificial Sequence
  Synthetic
ttggaatgggcaggatgggggactagagggcttaaggcaaaagggatggagtctggtcagcctactaatgattga

SEQ ID NO: 211684 - DNA, 75 bp, Artificial Sequence
  Synthetic
tcaggttcatgtaaagaaggtgatagaccaacactaccaagaatgtttggcaagtgatttggcaaaaaggatact

SEQ ID NO: 211685 - DNA, 75 bp, Artificial Sequence
  Synthetic
tagagagtctcaaactaggaacactcggactaagattctcgcacagggggacaatcaggtcttatgcccgacgta

SEQ ID NO: 211686 - DNA, 75 bp, Artificial Sequence
  Synthetic
ccgatgggggtttgacaaatattcacgttggtatctagaccaagaactcttgcccaaagatcatccgttgactcc

SEQ ID NO: 211687 - DNA, 75 bp, Artificial Sequence
  Synthetic
tatgttgtcatcagggttgaccaaagagggtcttctttatgagctagatagtatctcaagaaacgccatctccat

SEQ ID NO: 211688 - DNA, 75 bp, Artificial Sequence
  Synthetic
ctatgtgaaaacacagacatggcctcccaaacacgtagttgacataattggggattcctggcataatctcccaat

SEQ ID NO: 211689 - DNA, 75 bp, Artificial Sequence
  Synthetic
atatagggccatcgaagatggggcctcgaaactgggactcatcatcaaaaaagaggagacaatgtgcagttacga

SEQ ID NO: 211690 - DNA, 75 bp, Artificial Sequence
  Synthetic
tacccagttgtttgaaattccggaatctatggacccttctgaaattctagatgacaaatctcattctttcaccag

SEQ ID NO: 211691 - DNA, 75 bp, Artificial Sequence
  Synthetic
ctttctcatttatgggaaaaccccgttgttcagaggaaacatattggtgccagaatccaaaagatgggctcgagt

SEQ ID NO: 211692 - DNA, 75 bp, Artificial Sequence
  Synthetic
gacaaagctggcctcttggctttcagaaaacaggggtggtccagttcccagtgagaaggtcatcatcacggcgct

SEQ ID NO: 211693 - DNA, 75 bp, Artificial Sequence
  Synthetic
gtcttgcatatctaacgaccagatagtcaacttggcaaacatcatgtctaccgtgtcaacaaatgccctgactgt

SEQ ID NO: 211694 - DNA, 75 bp, Artificial Sequence
  Synthetic
gtccagaccccctgtcaacccaagagaattcctcaggtctatagatgtgggagggctgcctgacgatgatttaat

SEQ ID NO: 211695 - DNA, 75 bp, Artificial Sequence
  Synthetic
ggcccaacactctcagtctttggttaagccaatgagagactttctacttatgtctgttcaggctgtctttcacta

SEQ ID NO: 211696 - DNA, 75 bp, Artificial Sequence
  Synthetic
catcggtttaaagcctaaggagagagagctcaaggtagaagggaggttcttcgcactgatgtcttggaaccttcg

SEQ ID NO: 211697 - DNA, 75 bp, Artificial Sequence
  Synthetic
tctcttgttcagccctatactgaaagacagagtgtataagatcctagtagcggatgggaatgaatttctgctggc

SEQ ID NO: 211698 - DNA, 75 bp, Artificial Sequence
  Synthetic
actttactttgtaatcacagaaaagctactagcaacttacattttgcccctatttgatgcattgaccatgacaga

SEQ ID NO: 211699 - DNA, 75 bp, Artificial Sequence
  Synthetic
tatgtccaggattgtgtacctggatccgtccttaggaggagtctcagggatgtcgctagggcgatttcacattcg

SEQ ID NO: 211700 - DNA, 75 bp, Artificial Sequence
  Synthetic
caacctgaacaaagtttttaagaagctcatagatagagtgacgggacaaggtctgttagattactccagagtaac

SEQ ID NO: 211701 - DNA, 75 bp, Artificial Sequence
  Synthetic
ccaattttctgatccggtgtcagaagggttagcattttggagggagatctggttgagttctaacgaaccttggat

SEQ ID NO: 211702 - DNA, 75 bp, Artificial Sequence
  Synthetic
ctatgcattccacttggactatgagaagtggaacaaccatcagagactggaatcaacaaaagatgtcttctcagt

SEQ ID NO: 211703 - DNA, 75 bp, Artificial Sequence
  Synthetic
ccattctctgtgtcaggaagcaggaaaccctgaccttggtgatagaagtttggagagctttactagactcttaga

SEQ ID NO: 211704 - DNA, 75 bp, Artificial Sequence
  Synthetic
tcttgataaggcattcggacttaagagggtgttctcaagaacgcacgagttcttccaaaaatcctggatttacta

SEQ ID NO: 211705 - DNA, 75 bp, Artificial Sequence
  Synthetic
agacccgacaaccctaaacatcaggggaggtgctagccctaccattctgttaaaagaggcaatcaggaaagctct

SEQ ID NO: 211706 - DNA, 75 bp, Artificial Sequence
  Synthetic
ttctgatagatcggacttaataggtctatggaaggaccaaatttactgtctggacatgagcaacggcccaacatg

SEQ ID NO: 211707 - DNA, 75 bp, Artificial Sequence
  Synthetic
atatgaagaagtcgacaaggtggaaaactcggagtttagagaggcgatcttactgtccaagactcatagggataa

SEQ ID NO: 211708 - DNA, 75 bp, Artificial Sequence
  Synthetic
ttggaacgggcaggatggaggactagagggcttaaggcaaaaaggatggagtttagtcagtcttctaatgattga

SEQ ID NO: 211709 - DNA, 75 bp, Artificial Sequence
  Synthetic
cttcatacttttcttgaagtcagtggagcccctctttccccggttcctcagcgaattgtttagctcctcattctt

SEQ ID NO: 211710 - DNA, 75 bp, Artificial Sequence
  Synthetic
cagagagtctcaaactaggaacactcggaccaagattctcgcacagggggacaaccaggtgttgtgtccaacgta

SEQ ID NO: 211711 - DNA, 75 bp, Artificial Sequence
  Synthetic
gggaataccagaatctataataggcttaatccagaattcccggacaattaggcgacaatttaggagaagtttgtc

SEQ ID NO: 211712 - DNA, 75 bp, Artificial Sequence
  Synthetic
catgttgtcatcagggttgaccaaggagggtcttctttatgaactagatagtatatcaagaaatgccatctctat

SEQ ID NO: 211713 - DNA, 75 bp, Artificial Sequence
  Synthetic
tagggctttagaagaatccttctttaactcagagattcacggagtcaaccgaatgactcaagttccacaaaggat

SEQ ID NO: 211714 - DNA, 75 bp, Artificial Sequence
  Synthetic
atacagggccatagaagagggggcctcgaaactgggactcatcatcaaaaaagaggagactatgtgtagttatga

SEQ ID NO: 211715 - DNA, 75 bp, Artificial Sequence
  Synthetic
agggcgagtatgggcatgctctgcagagcgtgctgatcaactgcgagagatatcttggggaagaaaagtagttgg

SEQ ID NO: 211716 - DNA, 75 bp, Artificial Sequence
  Synthetic
ctttctcatctatggtaagaccccgttgtttagaggaaacatattggtgccagaatctaaaagatgggctcgggt

SEQ ID NO: 211717 - DNA, 75 bp, Artificial Sequence
  Synthetic
gacaacagtgcctcacccctctgagatgattgctctcatccccaaatcatcaatctcatgcacatgcagccagtc

SEQ ID NO: 211718 - DNA, 75 bp, Artificial Sequence
  Synthetic
atcttgtatatctaatgatcagatagtcaacctggcaaacatcatgtctactgtgtcaacaaatgccttgactgt

SEQ ID NO: 211719 - DNA, 75 bp, Artificial Sequence
  Synthetic
aggagaagccaatcctcgaatctctgtatcagtcttgccatcttttgaccagtcatatttttcacgaggacctct

SEQ ID NO: 211720 - DNA, 75 bp, Artificial Sequence
  Synthetic
ggcacaacactctcagtcgttggtcaagccaatgagagactttctactcatgtctgttcaagccgtctttcacta

SEQ ID NO: 211721 - DNA, 75 bp, Artificial Sequence
  Synthetic
gaaggggtatctgggttcctccacctccatgtcgacccaactattccatgcatgggagaaagtgaccaatgtgca

SEQ ID NO: 211722 - DNA, 75 bp, Artificial Sequence
  Synthetic
tctcctattcagccctatactgaaagacagagtatacaagatcctagtggcggaggggaatgaatttctgctagc

SEQ ID NO: 211723 - DNA, 75 bp, Artificial Sequence
  Synthetic
tgtcgtgaaaagggcactatctctcaaggaatcaatcaactggttcattaccagagactcgaaccttgctcagac

SEQ ID NO: 211724 - DNA, 75 bp, Artificial Sequence
  Synthetic
catgtccaggatcgtgtacctggatccgtccctagggggagtctcagggatgtcgttaggacgatttcatatccg

SEQ ID NO: 211725 - DNA, 75 bp, Artificial Sequence
  Synthetic
gttgattaaaaacattgtatccttgactgggcccacatttccccttgaagaggctcctgtatttaagcgaactgg

SEQ ID NO: 211726 - DNA, 75 bp, Artificial Sequence
  Synthetic
ccaattttccgatccggtgtcagaagggttggcattttggcgggagatctggttgagctcaaatgagccttggat

SEQ ID NO: 211727 - DNA, 75 bp, Artificial Sequence
  Synthetic
atctgccctccatcgtttcaaatcagctagatacagtgagggaggttattcctctatatgccccaacttgttgtc

SEQ ID NO: 211728 - DNA, 75 bp, Artificial Sequence
  Synthetic
ccattctctgtgtcaggaggcaggcaatcctgaccttggtgatagaagtttagagagtttcactagacttttgga

SEQ ID NO: 211729 - DNA, 75 bp, Artificial Sequence
  Synthetic
gcatatttcagtcagtacagacaccatgtcagaccttacccaagacggaaccaacttcgactttatgttccagcc

SEQ ID NO: 211730 - DNA, 75 bp, Artificial Sequence
  Synthetic
agaccctacaaccctaaacatcagaggaggtgccagccctactattctattaaaagaggcaattaggaaggccct

SEQ ID NO: 211731 - DNA, 75 bp, Artificial Sequence
  Synthetic
tctcatgctttacgcacagacatggacatccgagctggtacagaaagatctgcgtcttaaagactctacttttca

SEQ ID NO: 211732 - DNA, 75 bp, Artificial Sequence
  Synthetic
atatgaagaggttgacaaggtggaaaactcggagttcagagaggcgatcttactatccaaaacccatagggataa

SEQ ID NO: 211733 - DNA, 75 bp, Artificial Sequence
  Synthetic
ctggcacctcaggtgcttgaaatgtataaggccaatagacgacgtgattttagagactcctcaagtcttcgtctt

SEQ ID NO: 211734 - DNA, 75 bp, Artificial Sequence
  Synthetic
cttcatactcttcctcaagtctgtggagcccctctttccccgattcctcagtgaattgtttagctcctccttctt

SEQ ID NO: 211735 - DNA, 75 bp, Artificial Sequence
  Synthetic
ccctgatgtatcaaaaagaatatctcggatggtgtcgggagcagttccccaatttagaaaactccctgatataac

SEQ ID NO: 211736 - DNA, 75 bp, Artificial Sequence
  Synthetic
ggggatcccagaatcaataataggcctaatccagaactcccggacaattaggagacaatttaggagaagtttatc

SEQ ID NO: 211737 - DNA, 75 bp, Artificial Sequence
  Synthetic
tctaaaacctggaaagtttgatgccctgaaagggaaggagaagtcacagcacataggaacagcacagggtctcct

SEQ ID NO: 211738 - DNA, 75 bp, Artificial Sequence
  Synthetic
tagggctttagaagaatccttctttaactcagagattcatggggtcaaccgaatgactcaggttccgcaaaggat

SEQ ID NO: 211739 - DNA, 75 bp, Artificial Sequence
  Synthetic
ttattccatattggttgccacacatgactcagggtataatgatggaacgatatttcctgttaacatctatggcaa

SEQ ID NO: 211740 - DNA, 75 bp, Artificial Sequence
  Synthetic
agggcgagtctgggcatgctctgcagagcgcgctgatcaactgcgagagatatcctggggaaggaaggtagttgg

SEQ ID NO: 211741 - DNA, 75 bp, Artificial Sequence
  Synthetic
ggtgtctcccagggattacttgagggggttggccaggggtgttttgattggatcttctatatgctttctcacaag

SEQ ID NO: 211742 - DNA, 75 bp, Artificial Sequence
  Synthetic
aacgacagtgcctcacccttctgagatgatagcactcatccccaaatcatcaatttcatgcacatgtagccagtc

SEQ ID NO: 211743 - DNA, 75 bp, Artificial Sequence
  Synthetic
aatgaccaacatcaacataaacagacccctggagctgatttccggggtcatctcatacattcttttaaggttgga

SEQ ID NO: 211744 - DNA, 75 bp, Artificial Sequence
  Synthetic
aggagaagccaatccccgaatctcagtatcagtcttgccatcttttgaccagtcatatttctcacgaggaccttt

SEQ ID NO: 211745 - DNA, 75 bp, Artificial Sequence
  Synthetic
caatcacccttctttatatgtcatgctaaaagagccatccttgagatctgagatcttctctattccccagaaagt

SEQ ID NO: 211746 - DNA, 75 bp, Artificial Sequence
  Synthetic
gaagggatatctgggatcttccacttctatgtctacccagttgttccatgcatgggagaaagtgacaaatgtgca

SEQ ID NO: 211747 - DNA, 75 bp, Artificial Sequence
  Synthetic
gcctgctgcctaccccaccaccatgaaagagggtaaccgatcagttctgtgttatctgcaacatgtcctccgata

SEQ ID NO: 211748 - DNA, 75 bp, Artificial Sequence
  Synthetic
tgttgtgaagagggcactgtccctcaaggaatcaattaactggttcatcaccagagattcaaatctagcccagac

SEQ ID NO: 211749 - DNA, 75 bp, Artificial Sequence
  Synthetic
tgagagggaggcaatcacagcttctccggaaaatgattggctctggatattctcagatttcagaagtataaagat

SEQ ID NO: 211750 - DNA, 75 bp, Artificial Sequence
  Synthetic
attgatcaaaaacattgtttccttgactgggcccacattccctctagaagaggctcctgtattcaagcgaacagg

SEQ ID NO: 211751 - DNA, 75 bp, Artificial Sequence
  Synthetic
gacctatctgacattaatcacctaccaatcccacattttacttcagagggtagagaagaacttgtccaaacagat

SEQ ID NO: 211752 - DNA, 75 bp, Artificial Sequence
  Synthetic
atctgccctccatcgcttcaaatcagctagatacagtgagggaggttactcctctgtatgccccaacctgttgtc

SEQ ID NO: 211753 - DNA, 75 bp, Artificial Sequence
  Synthetic
gagggtcaagcttcgacaactcaactcacttatgagacaggtgcttggaggccatggggaaagtacactagactc

SEQ ID NO: 211754 - DNA, 75 bp, Artificial Sequence
  Synthetic
acatatttctgtcagcaccgacaccatgtcagacctcacacaggatggaaccaactttgattttatgttccagcc

SEQ ID NO: 211755 - DNA, 75 bp, Artificial Sequence
  Synthetic
tgatgaagatatacagagtttattaagagactctctgaggaggacaaaatgggtagatcaagaagttcgacacgc

SEQ ID NO: 211756 - DNA, 75 bp, Artificial Sequence
  Synthetic
cctcatgctttatgcccaaacatggacatcagagttggtgcaaaaagatctgcgtcttaaggactctacgtttca

SEQ ID NO: 211757 - DNA, 75 bp, Artificial Sequence
  Synthetic
agcaaagacgatgacgtgtgagtatagtcccagtaagaaggtgtctaggaaagctgggtgttcagagtggatatg

SEQ ID NO: 211758 - DNA, 75 bp, Artificial Sequence
  Synthetic
ctggcacctcagatgcttgaaatgtataaggccaatagacgatgtgattttagagacccctcaagttttcgcctt

SEQ ID NO: 211759 - DNA, 75 bp, Artificial Sequence
  Synthetic
ctctgcacagcaagtcgcaatctcaacctcatcaaatcctgcaccagtctctgaaatggacgtgagggcactctc

SEQ ID NO: 211760 - DNA, 75 bp, Artificial Sequence
  Synthetic
ccctgatgtatctaagaggatatcccggatggtgtcaggagcagttcctcaattcagaaagctcccagatataat

SEQ ID NO: 211761 - DNA, 75 bp, Artificial Sequence
  Synthetic
caagaagctccaaaaccctcttatctctggcctaagggtagttcagtgggcgacaggtgcacattacaaactcaa

SEQ ID NO: 211762 - DNA, 75 bp, Artificial Sequence
  Synthetic
tctgaaacccgggaagtttgatgctctgagggggaaggagaagtcacagcacataggaacggcacagggtctcct

SEQ ID NO: 211763 - DNA, 75 bp, Artificial Sequence
  Synthetic
gcccattttggatgacctagacttctatcccacactctgcctggttgtgggtgatggctctggggggatatctcg

SEQ ID NO: 211764 - DNA, 75 bp, Artificial Sequence
  Synthetic
ttattccatattggttgccacacatgactcagggtataatgatggaacaatatttcctgttaacatctatggcaa

SEQ ID NO: 211765 - DNA, 75 bp, Artificial Sequence
  Synthetic
ggcagttctgagcatgttccctgacgccaaattggtctttaacagtctattagaggtgaatgatttgatggcctc

SEQ ID NO: 211766 - DNA, 75 bp, Artificial Sequence
  Synthetic
ggtgtctccaagagactacttaaggggattagctaggggtgtcttgattggatcttctatatgcttcctcacaag

SEQ ID NO: 211767 - DNA, 75 bp, Artificial Sequence
  Synthetic
tgggacacaccccttaccaccctctgccttgatgagtggaggggaggacatcatctcaagagtgatagactttga

SEQ ID NO: 211768 - DNA, 75 bp, Artificial Sequence
  Synthetic
aatgaccaacatcaacataaacagacctctagagctgatttccggggtcatctcttacattcttctaaggttgga

SEQ ID NO: 211769 - DNA, 75 bp, Artificial Sequence
  Synthetic
ctccatctgggagaagccctcagatctgcggaacacgtctacatggaggtactttcagtctgtccaacagtctat

SEQ ID NO: 211770 - DNA, 75 bp, Artificial Sequence
  Synthetic
caatcatccttctttatatgtcatgctaaaggaaccatccttgagatctgagatcttctctatcccgcagaagat

SEQ ID NO: 211771 - DNA, 75 bp, Artificial Sequence
  Synthetic
caacatgtcttatgacttgatcatctgcgatgcagaagtgactgatattcattctgtgaataagataaccttgct

SEQ ID NO: 211772 - DNA, 75 bp, Artificial Sequence
  Synthetic
acctgctgcgtaccccacaaccatgaaagagggtaaccgatcagtcctatgttatctgcaacatgttctccgata

SEQ ID NO: 211773 - DNA, 75 bp, Artificial Sequence
  Synthetic
gatgtctgatttctcactttccattaacggtcctcttaacttgattttcaaaacctatggaaccatgctggtcaa

SEQ ID NO: 211774 - DNA, 75 bp, Artificial Sequence
  Synthetic
tgaaagggaagcaatcacagcatctccagaaaatgactggctctggatattctcggatttccgaagtataaagat

SEQ ID NO: 211775 - DNA, 75 bp, Artificial Sequence
  Synthetic
cccggaatacaaggccatccaacacttatcacgggcttttccatctgtgactgggtacatcacccagatgacatc

SEQ ID NO: 211776 - DNA, 75 bp, Artificial Sequence
  Synthetic
gacttatctgacattgatcacctaccaatcccacattttacttcagaaagtcgagaagaacctgtccaaacagat

SEQ ID NO: 211777 - DNA, 75 bp, Artificial Sequence
  Synthetic
gtccttttcatctgagttgtatctgaagttctccaagcgagggaagttttttagagatccggaatatttgacatc

SEQ ID NO: 211778 - DNA, 75 bp, Artificial Sequence
  Synthetic
gagggtcaagcttcgacaactcaactcactcatgagacaggtgcttggaggccatggagagagtacactagactc

SEQ ID NO: 211779 - DNA, 75 bp, Artificial Sequence
  Synthetic
gtccacgttgagggagatgagcctagtccttttcaattgtagcagctcaaagagtgagatgctaagggcccgatc

SEQ ID NO: 211780 - DNA, 75 bp, Artificial Sequence
  Synthetic
tgatgaagatatacagggtttattaagggattctctgaggaggacaaaatgggtagatcaagaagtacgacatgc

SEQ ID NO: 211781 - DNA, 75 bp, Artificial Sequence
  Synthetic
attaaactatcaagatctagtaagaggatttccagaagagataatttcaaatccttacaacgaaatgataataac

SEQ ID NO: 211782 - DNA, 75 bp, Artificial Sequence
  Synthetic
ggcaaagacgatgacgtgcgagtatagtcccagtaagaaagtgtctcggaaggctgggtgttcagagtggatatg

SEQ ID NO: 211783 - DNA, 75 bp, Artificial Sequence
  Synthetic
tctcatagacaatgacgtcgagtcatttctcgttcataagatggttgatgaccttgaactgcaaagagggtcatt

SEQ ID NO: 211784 - DNA, 75 bp, Artificial Sequence
  Synthetic
ttctgcacagcaagtggcaatttctacctcctcgaatcctgccccagtctccgagatggatgtccgagcactctc

SEQ ID NO: 211785 - DNA, 75 bp, Artificial Sequence
  Synthetic
ctccaaaatgtctattatagtcactatcatgttggtgttttccaacagagtcttcaatgtgtccaagccgttgaa

SEQ ID NO: 211786 - DNA, 75 bp, Artificial Sequence
  Synthetic
caagaaactccaaaaccctcttatctcgggtctaagggtagttcagtgggcaacaggtgcacattataaactcaa

SEQ ID NO: 211787 - DNA, 75 bp, Artificial Sequence
  Synthetic
tgaccccaagttttaccctccatcagacccaaaaatattgaggcacttcaatatatgctgtggaactctgatata

SEQ ID NO: 211788 - DNA, 75 bp, Artificial Sequence
  Synthetic
gcccattttagacgacctggacttctatcccacactctgcttggttgttggtgatggatctggggggatatctcg

SEQ ID NO: 211789 - DNA, 75 bp, Artificial Sequence
  Synthetic
cttgtccaccgcattgggggatgttctcaacttcgcacgacttcatgagttatacaataaccctgtgacctatta

SEQ ID NO: 211790 - DNA, 75 bp, Artificial Sequence
  Synthetic
ggcagttctgagtatgtttcctgatgccaagttagtctttaacagtctactagaggtgaatgatctgatggcctc

SEQ ID NO: 211791 - DNA, 75 bp, Artificial Sequence
  Synthetic
cttcaaaaagcagattttaggaggaaggatgtatctttcatggagttgggcagataacactcctattttcaagag

SEQ ID NO: 211792 - DNA, 75 bp, Artificial Sequence
  Synthetic
tggaactcacccattaccaccttccgccttgatgagtggaggggaggacatcatctcaagagtgattgactttaa

SEQ ID NO: 211793 - DNA, 75 bp, Artificial Sequence
  Synthetic
ggttgcatgcaactccagtctgagtctctcgtcccattggataagattgatttataaaattgtgaagactacaag

SEQ ID NO: 211794 - DNA, 75 bp, Artificial Sequence
  Synthetic
ctccatctgggagaagccttcagatctacgaaatacagctacatggaggtattttcagtctatccaacagtctat

SEQ ID NO: 211795 - DNA, 75 bp, Artificial Sequence
  Synthetic
gttaatcgggaatgctcatgatctctccaaggaagttgagagacacttgaggagttacaatagatggatcaattt

SEQ ID NO: 211796 - DNA, 75 bp, Artificial Sequence
  Synthetic
caacatgtcttatgacttaatcatctgtgatgcggaagtgactgacattcattcagtgaacaagataaccttgct

SEQ ID NO: 211797 - DNA, 75 bp, Artificial Sequence
  Synthetic
caatgatctgagatctagatcatctctattagactatagttgtctatgacaaatttaaaatcaatatcttgctat

SEQ ID NO: 211798 - DNA, 75 bp, Artificial Sequence
  Synthetic
gatgtccgatttttcactttctatcaacggtcctcttaacttgatttttaagacctatggaaccatgctggtcag

SEQ ID NO: 211799 - DNA, 75 bp, Artificial Sequence
  Synthetic
gccgattcctgtcattcaatagggcgtgaaaaaaacttatccgacagtcagcatttctacattcttgacttattt

SEQ ID NO: 211800 - DNA, 75 bp, Artificial Sequence
  Synthetic
aaaaacttatccgacagtcagcatttctacattcttgacttattttatgtcttctttgttgtttttgttaagcgt

SEQ ID NO: 211801 - DNA, 75 bp, Artificial Sequence
  Synthetic
cccggagtataaggccatccaacacttatcacgggcttttccatctgtgacaggatacatcacccaaatgacatc

SEQ ID NO: 211802 - DNA, 75 bp, Artificial Sequence
  Synthetic
ttccttctcatctgagttgtatctgaagttctctaagcgagggaagtttttccgagatcctgaatacctgacatc

SEQ ID NO: 211803 - DNA, 75 bp, Artificial Sequence
  Synthetic
gtccactttgagggagatgagcctagttctctttaattgtagcagctcaaagagtgaaatgctgagggcccgatc

SEQ ID NO: 211804 - DNA, 75 bp, Artificial Sequence
  Synthetic
actaaactatcaagacctagtaagagggttccctgacgagataatttcaaatccttacaacgaaatgataataac

SEQ ID NO: 211805 - DNA, 75 bp, Artificial Sequence
  Synthetic
tctcatagacaatgacgtcgagtcatttcttgttcataagatggttgatgaccttgaactgcagagagggtcatt

SEQ ID NO: 211806 - DNA, 75 bp, Artificial Sequence
  Synthetic
ctccaaaatgtctatcatagttactatcatgttggtgttttccaacagagtcttcaatgtgtccaaaccgttaaa

SEQ ID NO: 211807 - DNA, 75 bp, Artificial Sequence
  Synthetic
tgatcctaaattttaccctccatctgatcccaaaatattgaggcactttaacatatgctgtggaactctgatata

SEQ ID NO: 211808 - DNA, 75 bp, Artificial Sequence
  Synthetic
cttgtccaccgcattgggggatgttctcaatttcgcaagacttcatgaattatacaacaatcctgtgacctatta

SEQ ID NO: 211809 - DNA, 75 bp, Artificial Sequence
  Synthetic
cttcaaaaagcaggtcttaggaggaaggatgtatctttcatggagctgggcggacaacactcccattttcaaaag

SEQ ID NO: 211810 - DNA, 75 bp, Artificial Sequence
  Synthetic
agttgcctgcaactccagtctgagtctctcgtctcattggataagattgatatacaaaattgtgaaaaccacaag

SEQ ID NO: 211811 - DNA, 75 bp, Artificial Sequence
  Synthetic
gctaatcggaaatgctcatgatctctcgaaagaagttgagagacatttgaggaattacaatagatggatcaattt

SEQ ID NO: 211812 - DNA, 75 bp, Artificial Sequence
  Synthetic
caatgatctgagatctagatcatctctattggactatagttgtctatgacaaatttagagtcgatatcttgctat

SEQ ID NO: 211813 - DNA, 75 bp, Artificial Sequence
  Synthetic
gccaatctctgtcattcaatagagcgtgaaaaaaacttttccgacagccagcatttctacattcttgatttgctt

SEQ ID NO: 211814 - DNA, 75 bp, Artificial Sequence
  Synthetic
aaaaacttttccgacagccagcatttctacattcttgatttgctttgtgtcttctttgtgttttttgttaagcat

SEQ ID NO: 211815 - DNA, 75 bp, Artificial Sequence
  Synthetic
acgcttaacaacaaaatcacaaaaggggtagacatgttcatctgtagaacagaaatgtaacacccctaaaatgga

SEQ ID NO: 211816 - DNA, 75 bp, Artificial Sequence
  Synthetic
ttctgacagaattgtcttcaaagttcataaccagctggtttctcttaagccagaggttatctctgatcagtatga

SEQ ID NO: 211817 - DNA, 75 bp, Artificial Sequence
  Synthetic
atacaaataccctgcgattgatgataaaaagaaacccagtattacactgggaaaagcccctgatttgaaaacagc

SEQ ID NO: 211818 - DNA, 75 bp, Artificial Sequence
  Synthetic
atataagtcaatcctatcagggatgaatgctgccaagcttgatcctgatgatgtgtgctcttacttggctgcggc

SEQ ID NO: 211819 - DNA, 75 bp, Artificial Sequence
  Synthetic
aatggtattttttgaaggaatatgtcctgaagattggactagctatgggataaacattgccaaaaaaggagacaa

SEQ ID NO: 211820 - DNA, 75 bp, Artificial Sequence
  Synthetic
gataacccctgcagtcctagttgatatacaaaggacaaacacagaaggtaattgggctcaggcaggaggacaaga

SEQ ID NO: 211821 - DNA, 75 bp, Artificial Sequence
  Synthetic
ccttactagagatccaacaacaccggaacatgcgtctttagtcgggctcctcttgtgtctatacaggctgagcaa

SEQ ID NO: 211822 - DNA, 75 bp, Artificial Sequence
  Synthetic
gattgtgggacaaaacaccgggaattacaaaaccaatgtggcggagaggatggagcagatatttgagactgcacc

SEQ ID NO: 211823 - DNA, 75 bp, Artificial Sequence
  Synthetic
gtttgtcaaaattgtggaacatcacaccttgatgaccacccataaaatgtgtgcaaattggagcacaataccaaa

SEQ ID NO: 211824 - DNA, 75 bp, Artificial Sequence
  Synthetic
ctttagatttctggcaggggtttatgacatgttcttttcaagaattgagcacctgtattcagcaattcgtgtggg

SEQ ID NO: 211825 - DNA, 75 bp, Artificial Sequence
  Synthetic
aacagttgtgactgcatatgaggactgctctgggctggtgtcatttaccacatttatcagacagattaacttgac

SEQ ID NO: 211826 - DNA, 75 bp, Artificial Sequence
  Synthetic
tgctagggatgctgttttgtacttctttcacaagaacttcgaggaagagatcaagagaatgttcgagcctggtca

SEQ ID NO: 211827 - DNA, 75 bp, Artificial Sequence
  Synthetic
accaaacaaagaagtgtgggattaatttaacgaacaagatgaataatcaacctttaggagcaaagtagttctcct

SEQ ID NO: 211828 - DNA, 75 bp, Artificial Sequence
  Synthetic
atcatacagaatcagtgtttgacacccagaatcattttgttgcgtgcaataagcatttactcttgattgttcgca

SEQ ID NO: 211829 - DNA, 75 bp, Artificial Sequence
  Synthetic
ttggttggggacttggttgctccacaatgtcgaaacttaataaggtgttggatgagttccgtgacttcaaaaata

SEQ ID NO: 211830 - DNA, 75 bp, Artificial Sequence
  Synthetic
aatcagatctacaaatttattacttcacttttgaaatggtgctaatgttctgtgatgttgtggaagggagattga

SEQ ID NO: 211831 - DNA, 75 bp, Artificial Sequence
  Synthetic
acccgccaaaaaaagtagggccagtgacagcactgcaaggattcaaaaagaatgtggttgttcctgtccctatga

SEQ ID NO: 211832 - DNA, 75 bp, Artificial Sequence
  Synthetic
tgattgaaacagggatgaggtctgactggaggtatagtgaattcttgatcagaggttcaaaattgtgggaattaa

SEQ ID NO: 211833 - DNA, 75 bp, Artificial Sequence
  Synthetic
tgaaggacacggtcaaacgatttcattttataacattttgtttgcaactcgtttggtcagacctttcttcaggag

SEQ ID NO: 211834 - DNA, 75 bp, Artificial Sequence
  Synthetic
tggattgtatgtttgaagatctagggaatgacacgtataacatcgtagccatgatagaaccccttgttcttggtt

SEQ ID NO: 211835 - DNA, 75 bp, Artificial Sequence
  Synthetic
cttttataacaggtgcatttcttgctctgctatctatatttgctgagaaccctgcagctatgctaagatctctcc

SEQ ID NO: 211836 - DNA, 75 bp, Artificial Sequence
  Synthetic
atcttcaattgaaagatgagtccagtcttctaaagggtgcatttttggacttttgctttaatgaggttatcagtg

SEQ ID NO: 211837 - DNA, 75 bp, Artificial Sequence
  Synthetic
taaatgatccagacattgatgttcaattggctgagattgcggacatcgacaatgacaaactaaagttggctacca

SEQ ID NO: 211838 - DNA, 75 bp, Artificial Sequence
  Synthetic
aacttgaaagtcatggctacacagacaagagagacatcaaattcgttctggattacatcagtgatattttccagt

SEQ ID NO: 211839 - DNA, 75 bp, Artificial Sequence
  Synthetic
gaggcaaagaaatgagccgctatgagaatgacatgatgagaatggcttctgcaggtccgtcgaaaggtgcctctc

SEQ ID NO: 211840 - DNA, 75 bp, Artificial Sequence
  Synthetic
gtgatgacattcacatgatttcagaatttttctccttttttagaacatttggccatcccaccctagaagctgaag

SEQ ID NO: 211841 - DNA, 75 bp, Artificial Sequence
  Synthetic
cctacccatatgttcggcaagagtatcaagagctgtgccccaagtcaacagaagaactgcagctttgtgttcaat

SEQ ID NO: 211842 - DNA, 75 bp, Artificial Sequence
  Synthetic
aagcagctaacaaagtccgggctcacatgaataaaccgaaagttattagtttcgaaatcatgatgaagggtcatg

SEQ ID NO: 211843 - DNA, 75 bp, Artificial Sequence
  Synthetic
ccattacaacacagctctggatactgctcacaaaagcagtgacagccattgacacagcccgcgactccgaaaaga

SEQ ID NO: 211844 - DNA, 75 bp, Artificial Sequence
  Synthetic
cattgttctgcggtataatcattaatggtttcagagatagacatggaggagcatggccacctcacacttttcctg

SEQ ID NO: 211845 - DNA, 75 bp, Artificial Sequence
  Synthetic
agaggtgggggaaattcttgcagcagcgtagagctcttgaggaatatcaacttgttgacgcctggttggatcgag

SEQ ID NO: 211846 - DNA, 75 bp, Artificial Sequence
  Synthetic
accatgtagacaagccggttagagaggcatcaatgaactcagaggctctaactcatgaattgtgtatacagaact

SEQ ID NO: 211847 - DNA, 75 bp, Artificial Sequence
  Synthetic
ctcgagttagagttgcctccgaccttgcaattagaagatacatgatcacaatcctgctggagactgggaagatga

SEQ ID NO: 211848 - DNA, 75 bp, Artificial Sequence
  Synthetic
ggaaatcatttgttggattcaaatttaagtgtttcatgcctcttactctagatgaagacctcaccatgtatatga

SEQ ID NO: 211849 - DNA, 75 bp, Artificial Sequence
  Synthetic
ctggaccgaaacccagggtagttgagctcattgccgacattgggaattacatcagtgaaaccggaatggctggat

SEQ ID NO: 211850 - DNA, 75 bp, Artificial Sequence
  Synthetic
aggacaaagcacttgctgcgataaagccagagtgggattctgtttatcctagggaaaatttaccatatcccccac

SEQ ID NO: 211851 - DNA, 75 bp, Artificial Sequence
  Synthetic
tcttcctaaccatcaagtacggaatagaaaccaagtatcctgtacttgccatgagtgagtttgcagcagacttgg

SEQ ID NO: 211852 - DNA, 75 bp, Artificial Sequence
  Synthetic
caaagcagactacttctagaaggttggtggaagtatttctcaaggatacctcattcgaccctgtcaacctgatta

SEQ ID NO: 211853 - DNA, 75 bp, Artificial Sequence
  Synthetic
ctactgtattgagcttaatgaagatgtacacaacactcggggagaaggcaccatacatggtaatactcgaagaat

SEQ ID NO: 211854 - DNA, 75 bp, Artificial Sequence
  Synthetic
actatgtcctgagtggtgattatcttaaagacaatgatttcaacttgtcttatagcttgaaagagaaagagatca

SEQ ID NO: 211855 - DNA, 75 bp, Artificial Sequence
  Synthetic
ccatccagacaaaatttgccccgggaaattatcccatactatggagctatgcaatgggggtcgcatcagtgcttg

SEQ ID NO: 211856 - DNA, 75 bp, Artificial Sequence
  Synthetic
aaaaagtcggtagattgtttgctaaaatgacatataaaatgagagcatgtcaagtgattggggaatcattgattg

SEQ ID NO: 211857 - DNA, 75 bp, Artificial Sequence
  Synthetic
acagatcggtcagcaaccttaactatactcgaccgtacttggaaaatgcatttttcaggcttggtgagtcaatgg

SEQ ID NO: 211858 - DNA, 75 bp, Artificial Sequence
  Synthetic
caacaggtgtgggtaaatactttaaagagaatggaatggtcaaggacgagcatgaacttctcaagaccctccata

SEQ ID NO: 211859 - DNA, 75 bp, Artificial Sequence
  Synthetic
ttcaaaatatgggcttcactgtgaacaaagctgttgctgaagatctgggattctcagaggagcaagttgctgcag

SEQ ID NO: 211860 - DNA, 75 bp, Artificial Sequence
  Synthetic
aattatcagtttcatctgtttccaaaaataacaaagttggcttgaagacagagaggtatgacaacaagagtgaga

SEQ ID NO: 211861 - DNA, 75 bp, Artificial Sequence
  Synthetic
ttagggagattctaaaatccgagaacgccaacatgagcaatggtccacaggggccaaaagcaaatcaatcatcca

SEQ ID NO: 211862 - DNA, 75 bp, Artificial Sequence
  Synthetic
caagaaaaacaagaggaaaaaacaactctagaaacataataaagtgtaaatcctgtaaatcctcagtcaataaat

SEQ ID NO: 211863 - DNA, 75 bp, Artificial Sequence
  Synthetic
caaagtcacttgacatcaaaaatgcagattcaatcatccccgagtctgatgatgagacagacgctccagaggatg

SEQ ID NO: 211864 - DNA, 75 bp, Artificial Sequence
  Synthetic
catattctagaagagaaacatgtgaaaataaagacctaaatgatgtacaatatgagacgatgagcacgttcttaa

SEQ ID NO: 211865 - DNA, 75 bp, Artificial Sequence
  Synthetic
tcaaagccagactggacgcagagaaggaagcatcaaggaagaaaagagaggccagcatgagaaagagacaatcca

SEQ ID NO: 211866 - DNA, 75 bp, Artificial Sequence
  Synthetic
caactgatttacagaaattttgtctgaattggagacaagaaacaacaaacatatttgctcagagactagatgaga

SEQ ID NO: 211867 - DNA, 75 bp, Artificial Sequence
  Synthetic
agcaggacaagtctcgggctgactctaccataagggacatagaggacgaactcaatgacatcatctccaagacaa

SEQ ID NO: 211868 - DNA, 75 bp, Artificial Sequence
  Synthetic
tatatggactgcctgggttcttttcatggctacataaacgtctggaaatctcaacactgtatgtagccgatccac

SEQ ID NO: 211869 - DNA, 75 bp, Artificial Sequence
  Synthetic
agaatctgtcaagcaagccaaaaggcagctcaaacactacagacacacctaaacagtctgacgaaatgtctgacc

SEQ ID NO: 211870 - DNA, 75 bp, Artificial Sequence
  Synthetic
actgtcctccttacaactcgtgtaaaatcaaactagatgacacagagaataaacaaatctttataaagtatccga

SEQ ID NO: 211871 - DNA, 75 bp, Artificial Sequence
  Synthetic
tctcagctatcaatggctaaacctacaatgctcacagcactccaagtatgaaacactacaatatatactatttac

SEQ ID NO: 211872 - DNA, 75 bp, Artificial Sequence
  Synthetic
tgggtggtattgaagggtactgtcagaagatgtggacgattattacaatacctttgttattcctcagtgcctatg

SEQ ID NO: 211873 - DNA, 75 bp, Artificial Sequence
  Synthetic
ctcaccatattatatattaagaaaaacttaggagtaaagtttggttcctttattccaaagacaattcaaactttg

SEQ ID NO: 211874 - DNA, 75 bp, Artificial Sequence
  Synthetic
agtgtggtgccaagatagctgcagtggtacaaggggacaatcaggccattgccattacaaaaagagtgcacccta

SEQ ID NO: 211875 - DNA, 75 bp, Artificial Sequence
  Synthetic
ctccctgttctacaatatctgtcaatcagatgaactcctatagtgttcaggcactagaacaattggtgaacgatg

SEQ ID NO: 211876 - DNA, 75 bp, Artificial Sequence
  Synthetic
atctaccatataaacagaaaaagtatctatgctccaaactagctcaggagtatttcaatcgtttgagaatcaaca

SEQ ID NO: 211877 - DNA, 75 bp, Artificial Sequence
  Synthetic
gaatcaaaactgcccaattttttcagaagaatcaggagaacattcagaagacgtacgggagaagtgcaattggac

SEQ ID NO: 211878 - DNA, 75 bp, Artificial Sequence
  Synthetic
tgggtggaataggtcacaatcttaaggcaaatgagacaatagtcagttcacacttttttatatactccaagagga

SEQ ID NO: 211879 - DNA, 75 bp, Artificial Sequence
  Synthetic
taccaaccaccaaagaaagaatctcagcctgggaagccgttgcagagactccctatggagagcagatccagctgg

SEQ ID NO: 211880 - DNA, 75 bp, Artificial Sequence
  Synthetic
tctattatgatggtcaagtcttgtcccaagcattgaaacctctttcaaggtgtgtgttttggtcagaaacaatcg

SEQ ID NO: 211881 - DNA, 75 bp, Artificial Sequence
  Synthetic
gtggaggaaacggagaagatcagagaggagaacaagctgaaggccaagacaatcctggtggccatggacatggtg

SEQ ID NO: 211882 - DNA, 75 bp, Artificial Sequence
  Synthetic
tggatgagactcgatctgcatgcagcaacatttgtactgctgttgctaaatcaattgaacaagggttcagtagat

SEQ ID NO: 211883 - DNA, 75 bp, Artificial Sequence
  Synthetic
gagaagagatacccaccggcgcaaatccttcagctttacagttgcagggatcttataaccaagtatgggatggtc

SEQ ID NO: 211884 - DNA, 75 bp, Artificial Sequence
  Synthetic
gggttggatactcaattgcagttcttaagactttacaacagctagttatatccttgaaattcactattaatgaat

SEQ ID NO: 211885 - DNA, 75 bp, Artificial Sequence
  Synthetic
cgaatgttgctacttatagtggcggagaagggggagataccgggaatcaacatgggaggactgattcaggctcgg

SEQ ID NO: 211886 - DNA, 75 bp, Artificial Sequence
  Synthetic
caatgacaagagacattgctgagccgattctcaagaatccaaattggatgatagctgcagctctaattccatccc

SEQ ID NO: 211887 - DNA, 75 bp, Artificial Sequence
  Synthetic
ctgctgacacaggaggaagtaaccaatctgatggaagcagtacctatagtacggttgatgctggagaccttaggc

SEQ ID NO: 211888 - DNA, 75 bp, Artificial Sequence
  Synthetic
agcttggaggattcaattacataaatattagcaggctttatattaggaatattggagacccagtgactgcatcaa

SEQ ID NO: 211889 - DNA, 75 bp, Artificial Sequence
  Synthetic
aaatgatgatatttgatcatgagacctccgctattgaagtgggagcatctaagaacaacacaatgaaaataagga

SEQ ID NO: 211890 - DNA, 75 bp, Artificial Sequence
  Synthetic
tagcagatcttaagagaatgatatctgtagggttaatggatgagagagttttacagaaggtcatgcatcaagaac

SEQ ID NO: 211891 - DNA, 75 bp, Artificial Sequence
  Synthetic
atgcaacagaagaggatctcgggaacgtgatgagcgagggcacatccaaaatccacaaacgtctgagaggtgttg

SEQ ID NO: 211892 - DNA, 75 bp, Artificial Sequence
  Synthetic
ctggtgattgtaattttctcgattgggctagtgaaccttactcaataaatattccatcatctcaaagtgttacta

SEQ ID NO: 211893 - DNA, 75 bp, Artificial Sequence
  Synthetic
ctgcaatgacggatcctctccctgttccaagaacgaccggaggaccagttaaaaaaggcatcgaagagagttctg

SEQ ID NO: 211894 - DNA, 75 bp, Artificial Sequence
  Synthetic
taatgcttaaaaacataacggctcgcatgattttaaaagggagtgcaaaccctatgttgaaaggtcttttccatg

SEQ ID NO: 211895 - DNA, 75 bp, Artificial Sequence
  Synthetic
tatcgacaattttggggggaagacctacatccgggagtggtgcaatccccaatgtgcacccatcactgttactcc

SEQ ID NO: 211896 - DNA, 75 bp, Artificial Sequence
  Synthetic
atgattttgatcaagaggatagggatttagcaaaatttctgatggatagagccataattatacctagagctgcac

SEQ ID NO: 211897 - DNA, 75 bp, Artificial Sequence
  Synthetic
tacccagtcaagatgtacatgcggagagtgccccaaagtgtgtgcaagatgtatcaaagaccggatctacgtgcc

SEQ ID NO: 211898 - DNA, 75 bp, Artificial Sequence
  Synthetic
atgaaatcatggacaagtcattgacaggtgcaagacaagaaatagccgggatgttggattcaacaaagggactta

SEQ ID NO: 211899 - DNA, 75 bp, Artificial Sequence
  Synthetic
aaagtagcaaggctgaacaggattgttctggaattgagggcaagattgacttactactagggaatcttgaaaagg

SEQ ID NO: 211900 - DNA, 75 bp, Artificial Sequence
  Synthetic
taaggaatggtcttatagcgggaggtttaaggccaagattggtagaaaggttatcccagtatgactatgaacaat

SEQ ID NO: 211901 - DNA, 75 bp, Artificial Sequence
  Synthetic
ttacccgtgctcttgatgtgttgccggaaataagggaggaaatacgaaacataaacaagaaaattacaaatctca

SEQ ID NO: 211902 - DNA, 75 bp, Artificial Sequence
  Synthetic
ttagggtgtttaatgccctaatgagtatcaaaaccaccagttcgctaatcaattgggacgcttgcgcagttgagc

SEQ ID NO: 211903 - DNA, 75 bp, Artificial Sequence
  Synthetic
gcctaggtctatcaactgttgagggatacatcaaatctatgatgatcatcattcctgggtccgggaaaccaaatc

SEQ ID NO: 211904 - DNA, 75 bp, Artificial Sequence
  Synthetic
tggccaggcgactaagaaatacgatgtgggtgcatctaacacatggaaggcctatatatggtttggaagtacctg

SEQ ID NO: 211905 - DNA, 75 bp, Artificial Sequence
  Synthetic
ctggtgatacacctgaagtcaatcccgatctaaaggctgttatcggcagggacaacaccagaggcctctctgagg

SEQ ID NO: 211906 - DNA, 75 bp, Artificial Sequence
  Synthetic
acactattgaggcgatgaatggatttctgattgagtcatgctctgactgttactactgtcaagcaaataataccg

SEQ ID NO: 211907 - DNA, 75 bp, Artificial Sequence
  Synthetic
tgagatctcaaaagatcaatctagaatctctcactgatgacccgccttcccttggaactattgatgaatcccaca

SEQ ID NO: 211908 - DNA, 75 bp, Artificial Sequence
  Synthetic
agtactgctggttctttgtcccaattaactgcgaactagaccaggtagcccatgagtccaacaatatcagggtgc

SEQ ID NO: 211909 - DNA, 75 bp, Artificial Sequence
  Synthetic
tagttagagacctagacttcacaaagagcaatgctgcaaattttgcgcccaccaatagattcagctcagtaatga

SEQ ID NO: 211910 - DNA, 75 bp, Artificial Sequence
  Synthetic
cttattttggttccaccactgaagaaagaagtgagattaagctatcaagtgttcgatctgcttcaagggctctaa

SEQ ID NO: 211911 - DNA, 75 bp, Artificial Sequence
  Synthetic
ccatgttcaacatgatcaaagaagaagtgaaagattacaacatgagagcaggattaactaggtggttggaggatg

SEQ ID NO: 211912 - DNA, 75 bp, Artificial Sequence
  Synthetic
aagcagcaataaggattgcaacagtgtacacatgggcttacggggattctgatgaaagatgggaagaggcttggt

SEQ ID NO: 211913 - DNA, 75 bp, Artificial Sequence
  Synthetic
caatagaaagactggacgcggacgatgtgtaccgtgcactgagacgcacactggacagacttgcagaggatgatg

SEQ ID NO: 211914 - DNA, 75 bp, Artificial Sequence
  Synthetic
atttggcttcatttcgagccagattaacaatagatgagcttaaggctattacacctatatcaacatccaataata

SEQ ID NO: 211915 - DNA, 75 bp, Artificial Sequence
  Synthetic
aggatgatgaggaagaagacgagaactaacaaatcaatggatcaatccatgcacaactaacacaccgcacacctg

SEQ ID NO: 211916 - DNA, 75 bp, Artificial Sequence
  Synthetic
ttgcccacagattaagagacaaaagcacacaaatgaaatattctggtagctccttaaatagggtgagtagatata

SEQ ID NO: 211917 - DNA, 75 bp, Artificial Sequence
  Synthetic
cttaagcacttgctttgccgtcactactattaagaaaaacttaggagtaaggtacgatggctggtaacgctggtc

SEQ ID NO: 211918 - DNA, 75 bp, Artificial Sequence
  Synthetic
ctatgattagcaatgataatctcaattttgtcaaggaagggaataagattgacaccaatctgatatatcagcaag

SEQ ID NO: 211919 - DNA, 75 bp, Artificial Sequence
  Synthetic
ttgctgagttcatgaggtcatcatgggaggacggaggaactctcgaagcaatagacccagaagcagacgagaagg

SEQ ID NO: 211920 - DNA, 75 bp, Artificial Sequence
  Synthetic
taatgttgctggggcttgcatcgctggaggacctttttagatttagccaaacaacaggttctgagaacaccgtgt

SEQ ID NO: 211921 - DNA, 75 bp, Artificial Sequence
  Synthetic
gcagactcgttccaaagtacagagtcatcaatcctggaagaaacagcagaaaaagtgcaggctatatgtatcttc

SEQ ID NO: 211922 - DNA, 75 bp, Artificial Sequence
  Synthetic
accatctccatgtagaacagaactgttgtgtgattgaaatggaagaccatccttatgttagttctgacgatgtgc

SEQ ID NO: 211923 - DNA, 75 bp, Artificial Sequence
  Synthetic
tcgtccatggaatcatagaagagaagccaaccgctgggccaaaaaacagaggcctgaaaacatttgcagcatttc

SEQ ID NO: 211924 - DNA, 75 bp, Artificial Sequence
  Synthetic
tgccgactctcagaggtgtgtatgacaatagattaatatatgatgagacccctctactagataaggaagttgaga

SEQ ID NO: 211925 - DNA, 75 bp, Artificial Sequence
  Synthetic
cccttggtgttgggaattctagagccatgcctcaaaccctcctcgaggctattgtggacctagaaataacagttc

SEQ ID NO: 211926 - DNA, 75 bp, Artificial Sequence
  Synthetic
ccatacacactcaaatgtaccgatcaaatgtcctagattttcctagatacagtattaaagaactcaatactttgc

SEQ ID NO: 211927 - DNA, 75 bp, Artificial Sequence
  Synthetic
gcaggactgcaggctcgggagagatgctagtgttcggatcaaacaacataaaacctgagcttcaaccctggaaaa

SEQ ID NO: 211928 - DNA, 75 bp, Artificial Sequence
  Synthetic
tgtctcagtctctggcatgcacgataattgatattataacaaaagacaccaaggatcacctgacagaatttaaag

SEQ ID NO: 211929 - DNA, 75 bp, Artificial Sequence
  Synthetic
acatcctgaccactggtgccattttccctgccatcaaggtttgcaacaatgtggatatggtggcagttgacagac

SEQ ID NO: 211930 - DNA, 75 bp, Artificial Sequence
  Synthetic
ttctggcaaatgatgatgatatcaacagtctgataacagagtttctcttagtagatccatcagaattttctgttc

SEQ ID NO: 211931 - DNA, 75 bp, Artificial Sequence
  Synthetic
cacagaagttccgagctgtgtttctcaccataacaatgctgacagatgcggggatttacaaggtaccaaagaata

SEQ ID NO: 211932 - DNA, 75 bp, Artificial Sequence
  Synthetic
atctcggcatggttatagcaatcaattggtcttatgatgtatactatagaaggccccatgggaaatatcagatga

SEQ ID NO: 211933 - DNA, 75 bp, Artificial Sequence
  Synthetic
tacttgatttccgcatgcctcatgctatctccttcaacttgttgatcgaactgtcagtgggagctgacctagatg

SEQ ID NO: 211934 - DNA, 75 bp, Artificial Sequence
  Synthetic
gtgagtatctttcaacatatctgagggtaacatcaagatcttttctgagtgttctgtccaacgctctttcccacc

SEQ ID NO: 211935 - DNA, 75 bp, Artificial Sequence
  Synthetic
gttctggaattagagggatggttaatgatgaaggagagaaagtaacaactttcatgatacacattgggaacttcc

SEQ ID NO: 211936 - DNA, 75 bp, Artificial Sequence
  Synthetic
ctagagtgttcagaaggttctgggatgtagggctcgtagaaccaatctatggctctaatattaatacccagaatt

SEQ ID NO: 211937 - DNA, 75 bp, Artificial Sequence
  Synthetic
atagaaggaaggggaaggaatattctgttgattactgcagacaaaagatcgacaagatggacctgcgctttgctc

SEQ ID NO: 211938 - DNA, 75 bp, Artificial Sequence
  Synthetic
acacaatggttgcaatagatttattgactaggagctatgaaaattatctagatctctggttggatggtgaggaac

SEQ ID NO: 211939 - DNA, 75 bp, Artificial Sequence
  Synthetic
tcggggctgttggtggtttaagccttcatgtcagtatatgcggcaaaatgagtcatgccctaagagctcaaattg

SEQ ID NO: 211940 - DNA, 75 bp, Artificial Sequence
  Synthetic
tagaatatatactgcctgagagcaatgaggagtatgtggatcagagatacgaactagtacaatccaaacatcttt

SEQ ID NO: 211941 - DNA, 75 bp, Artificial Sequence
  Synthetic
ggtacaaaacatcaatttgctactcattaatggacacaaatccgtatctcaacaagctgatgtggaaagcagaat

SEQ ID NO: 211942 - DNA, 75 bp, Artificial Sequence
  Synthetic
gctgtctttgctgcctctatcttgatagagaggaaatgccgagaattctaggtatgacctctattgaaaagtgtt

SEQ ID NO: 211943 - DNA, 75 bp, Artificial Sequence
  Synthetic
gtcacatcaacaaagtgactgctgttcttcaaccctccattcctaaggagttcaaagtttatgaagatgtcttga

SEQ ID NO: 211944 - DNA, 75 bp, Artificial Sequence
  Synthetic
caattttaacagattcactcaaccgtttcaagtacacaaagccagggttttacacctggaatttgtcaccattaa

SEQ ID NO: 211945 - DNA, 75 bp, Artificial Sequence
  Synthetic
ttgatcacactgggaagataatgaaatgaaattacttgcagtcgaacattgaaaccatgttcatctgaattacac

SEQ ID NO: 211946 - DNA, 75 bp, Artificial Sequence
  Synthetic
gtgtctgtgtctatcctgtttccttgacatatatccgaagaggtacaattaaacacatcagattgagatgtgcaa

SEQ ID NO: 211947 - DNA, 75 bp, Artificial Sequence
  Synthetic
tccaactataccacatgaacagataacggtacggatcctcctattacccttataatttagactatccatgaacac

SEQ ID NO: 211948 - DNA, 75 bp, Artificial Sequence
  Synthetic
tacagtttagtgaccccatcacagaaaatgcaaaattcgaccctctgaatcagaaaagttttgtcataactcgaa

SEQ ID NO: 211949 - DNA, 75 bp, Artificial Sequence
  Synthetic
aacccaatgatgctagatggaatcaaccagcttctgcctgatcataataagaaaaacttaggagtcaaggtcgcc

SEQ ID NO: 211950 - DNA, 75 bp, Artificial Sequence
  Synthetic
atattgagaatggcctattaacatcattcaaggcatttgattgtgtcctcctcttaagttctgactttagaaaat

SEQ ID NO: 211951 - DNA, 75 bp, Artificial Sequence
  Synthetic
cttctatcctcaaattaacagcattcacactgctaacattccctacaatcatgaaacctgtagctttaatatatc

SEQ ID NO: 211952 - DNA, 75 bp, Artificial Sequence
  Synthetic
tcaataatttggaaccctcacttcctactcacaacagatgggagtctcatgttactagaagagttggactaaatt

SEQ ID NO: 211953 - DNA, 75 bp, Artificial Sequence
  Synthetic
tgacgatactagcattcactgtgaaagtcagatcacaacttgctctaagcgacctcactaagattggcatcatac

SEQ ID NO: 211954 - DNA, 75 bp, Artificial Sequence
  Synthetic
caacatcatgttataaagccgcagaagtcggcctgtacatcctgaacaaaatcagtttgagtggtgataggctct

SEQ ID NO: 211955 - DNA, 75 bp, Artificial Sequence
  Synthetic
ctgcaaaatcatatgaattgaagatttctactcaggcggctcaacaactgatggttatcaagttgattcccaacg

SEQ ID NO: 211956 - DNA, 75 bp, Artificial Sequence
  Synthetic
ttcttggtgagggatctggtgccatgctgacattttactatatgctctttggagctgctaaatgttattacaaca

SEQ ID NO: 211957 - DNA, 75 bp, Artificial Sequence
  Synthetic
taaatggccttacaaactgtaccattcctgtgatggattcttacaagaagatgttggatagaatcctgaaaccta

SEQ ID NO: 211958 - DNA, 75 bp, Artificial Sequence
  Synthetic
ccggtgttctcaatacaggtttagtggggcaaagagtgttccaagtcttcccatctgaagtcctaattgtgagtc

SEQ ID NO: 211959 - DNA, 75 bp, Artificial Sequence
  Synthetic
ttgatgatgctctgaaccatgtgaaaaatgctatccaggataagcaaggggatggtgtgcctggagttaggtttt

SEQ ID NO: 211960 - DNA, 75 bp, Artificial Sequence
  Synthetic
acaataatccgaatgatctagatctggagaagaatatcaaagtcttgttcaatggaaaaccagaatgctcatgga

SEQ ID NO: 211961 - DNA, 75 bp, Artificial Sequence
  Synthetic
ggggtgctatcataggtggggttgctcttggggtcgcgacatcagcacagatcaccgctggtgttgccctccaca

SEQ ID NO: 211962 - DNA, 75 bp, Artificial Sequence
  Synthetic
ttggggatatggaatgctttgcatatataatgaactcaattccattgaattcactctctcttatccacaacgata

SEQ ID NO: 211963 - DNA, 75 bp, Artificial Sequence
  Synthetic
attcaatacagaatgcaaatgccattttacaactcaaagaatcaatcagaaattccaacaaggcaattgaggagc

SEQ ID NO: 211964 - DNA, 75 bp, Artificial Sequence
  Synthetic
cggaatcatctctggagaaaacacctgaggttatactgaatgagcagatccacagcttatgccttgctttaaacc

SEQ ID NO: 211965 - DNA, 75 bp, Artificial Sequence
  Synthetic
ttcaagcaggcttacagtcaactgtgctagttatcaatgctttacaggatcagataaatagccaattagtccctg

SEQ ID NO: 211966 - DNA, 75 bp, Artificial Sequence
  Synthetic
taggtgacaacaatagtatttatgttgttaaacttgctccaagggataatgattactcatcgacattgatcagct

SEQ ID NO: 211967 - DNA, 75 bp, Artificial Sequence
  Synthetic
cgattaatacactggggtgttcagttattgctaatacactaggccttcgtctgaatcagtatttcagtgaaatct

SEQ ID NO: 211968 - DNA, 75 bp, Artificial Sequence
  Synthetic
tgttctatcagtattattctaatgtgatttgtttactcccttcgtatagtaacccagcttcacctgagtgctata

SEQ ID NO: 211969 - DNA, 75 bp, Artificial Sequence
  Synthetic
cactggtctttgggccaaacttgcgcgacccaacatctcaaacgctttcaattcaggcaattgcaaaagcattca

SEQ ID NO: 211970 - DNA, 75 bp, Artificial Sequence
  Synthetic
ttatttgcactgagaagaaacaccacagtcttatatatccagcattagtggtgaactcccttaatattatctcta

SEQ ID NO: 211971 - DNA, 75 bp, Artificial Sequence
  Synthetic
atggtgactttgattctatgatgaagaaaatgcactacacggacagtgatttcttggatctccttgagagtgaca

SEQ ID NO: 211972 - DNA, 75 bp, Artificial Sequence
  Synthetic
actcaactaatactaccataaatcataatattatggacatgaaatttaacatgaggaaagaaattgtggcaaaca

SEQ ID NO: 211973 - DNA, 75 bp, Artificial Sequence
  Synthetic
gcataagagggaggattatatctgtatcactagaggactatcttataatcatacaaattgactatcctggcctga

SEQ ID NO: 211974 - DNA, 75 bp, Artificial Sequence
  Synthetic
gaaaatggtacggtgattatctagattccgacttgactactttagatgaggtggagaagttgatgttatcctatg

SEQ ID NO: 211975 - DNA, 75 bp, Artificial Sequence
  Synthetic
ccaccataccaaactccgtggttcagacattcaacctcataacatataattacaaaggaacagagtgggaatcaa

SEQ ID NO: 211976 - DNA, 75 bp, Artificial Sequence
  Synthetic
gatttcagattaatggacctaaactcatcaagcaaataattggacatgatgtagcttcaggggagataaatttta

SEQ ID NO: 211977 - DNA, 75 bp, Artificial Sequence
  Synthetic
tattcccaagggaactgctcatacgtggtagttacatatcaaacattgacatttctcagtgtgttgggacatcaa

SEQ ID NO: 211978 - DNA, 75 bp, Artificial Sequence
  Synthetic
agtcttacgttaactcaacattaaataacattgtcaaccactgtgatcctgataggagcacaagtgcttttcttg

SEQ ID NO: 211979 - DNA, 75 bp, Artificial Sequence
  Synthetic
agtcaatgatatgtaaatcagacactagtaccacgatatcccctgctacctgggcctgtgcgacaggtaacctaa

SEQ ID NO: 211980 - DNA, 75 bp, Artificial Sequence
  Synthetic
agccctatccacttcttaaggattccaaattaagagagcttatggatatgctaggtttcaaattgtgtgtgtata

SEQ ID NO: 211981 - DNA, 75 bp, Artificial Sequence
  Synthetic
caagttgtgcaagaacccgtgttgttaattcacactctacaaggtttgcactatcaggaggtgttttatttgcca

SEQ ID NO: 211982 - DNA, 75 bp, Artificial Sequence
  Synthetic
tacttttgtacatgaaagttcataaccaatcttacagacggaatcttattaacgatatacggagaaaatacctta

SEQ ID NO: 211983 - DNA, 75 bp, Artificial Sequence
  Synthetic
actgtgctcctatcgcatgcaggtgtcaggatcctcagtacagtataaatcaggagcccaaaacaacaaatgtta

SEQ ID NO: 211984 - DNA, 75 bp, Artificial Sequence
  Synthetic
gagttgatctcaaaagtgatgagatcaaatgtgttttgcaggagtatctgctaaggaagctaaaaaagtttgggg

SEQ ID NO: 211985 - DNA, 75 bp, Artificial Sequence
  Synthetic
tggtaacatctgaagattgtaaagaactctacattgatggtttttatctcacacttgggaagaaaatgcttgata

SEQ ID NO: 211986 - DNA, 75 bp, Artificial Sequence
  Synthetic
tcaacatgaggtggcattataaccttagtacaccagaggtaaagatatggtggaagattgttggttattctgtgc

SEQ ID NO: 211987 - DNA, 75 bp, Artificial Sequence
  Synthetic
gagcaatgtatgctgaagatgtggctcttggaggatctgtaagtgttgatccgattgacattgggaatgaattaa

SEQ ID NO: 211988 - DNA, 75 bp, Artificial Sequence
  Synthetic
tttattctgaggattgatcagttggtgacaactcgggaccagcgccagacccagcaaggttctataaggtataga

SEQ ID NO: 211989 - DNA, 75 bp, Artificial Sequence
  Synthetic
acagtatcaacgagtcgatcaacaagtctcatgaatacctcgataaggctaatgagcttcttgaacaagtcaacc

SEQ ID NO: 211990 - DNA, 75 bp, Artificial Sequence
  Synthetic
caaggttctataaggtatagataagggcattaagaaaaacttataagttaagaatctatacctactttgttaggt

SEQ ID NO: 211991 - DNA, 75 bp, Artificial Sequence
  Synthetic
ccaacattgtgaatgtatcatcattcagctttatactagtcatcagtatattgttgataatatggtttattgtga

SEQ ID NO: 211992 - DNA, 75 bp, Artificial Sequence
  Synthetic
cacttgtatggctgatttatttgacaaagcacatgaacttcattgtgggcaaggtagcaatgggtagcagatcat

SEQ ID NO: 211993 - DNA, 75 bp, Artificial Sequence
  Synthetic
ctacagttaattcactgtcaggctttgttggctgaaacacaatcctatgtctttgtaaataatgatgtaatttat

SEQ ID NO: 211994 - DNA, 75 bp, Artificial Sequence
  Synthetic
aaataaaaacttaggacaaaagtcctgaggttcacactccaatcagatcatactgtacaagacattcacagctca

SEQ ID NO: 211995 - DNA, 75 bp, Artificial Sequence
  Synthetic
cactgctagcacatcagatcatggatatcgacgcagccatcacagtatctgtaattgcactcattgttttcctgt

SEQ ID NO: 211996 - DNA, 75 bp, Artificial Sequence
  Synthetic
ggattctaactagcaccgcatggttggtgtctattgagatgagaataaagtcaatgttgatgaggtctgccagaa

SEQ ID NO: 211997 - DNA, 75 bp, Artificial Sequence
  Synthetic
atcatagggatgtgtctgttggcttaataccaagacatccgggacctccagattactcatcagtagtaacctgta

SEQ ID NO: 211998 - DNA, 75 bp, Artificial Sequence
  Synthetic
tatagatctttaataatttgtgaattcatgcatctaatctacaaattcgaaatattatatcatataagttagaaa

SEQ ID NO: 211999 - DNA, 75 bp, Artificial Sequence
  Synthetic
aaacttaggaggaatgttcctccttttacccttgcttatttggttaatccatctagcctttgttatatcgcttgg

SEQ ID NO: 212000 - DNA, 75 bp, Artificial Sequence
  Synthetic
attgcaagtggggactgataaagaagacactgataatgacatcaacagtgtatgaggatcctgaatcagcgctat

SEQ ID NO: 212001 - DNA, 75 bp, Artificial Sequence
  Synthetic
cagggtatgagtcaatgaggtctgatggagcacgagggttaccagcattacctagaagatgtaagacggctaata

SEQ ID NO: 212002 - DNA, 75 bp, Artificial Sequence
  Synthetic
cctataggagcgcaagaagagttagagttgttacaagaagaagagttaacaactctgtttattttgttttcatta

SEQ ID NO: 212003 - DNA, 75 bp, Artificial Sequence
  Synthetic
ttgtttgtcttgctatcttggtcgctatggctgcttatgttataattggtatagaagggcttaaatatactcgtt

SEQ ID NO: 212004 - DNA, 75 bp, Artificial Sequence
  Synthetic
acaactccaaggatgtgggccctgatggatcaaagagactggaagatattgatcagaaattaaatcaaatctcat

SEQ ID NO: 212005 - DNA, 75 bp, Artificial Sequence
  Synthetic
cagcagtaaacaccatcatgaatgctctaacctattctgtaccgtcagttttgagtacttatcgtacatcattac

SEQ ID NO: 212006 - DNA, 75 bp, Artificial Sequence
  Synthetic
tgaacaggataaaccaccttgcaacagagcttaaggaagcagcgaggatgaacaatgttgatttggacgttaaat

SEQ ID NO: 212007 - DNA, 75 bp, Artificial Sequence
  Synthetic
ggggatcaaacaggacagtcttactcaagacagggtccaggtttcaccaactgaatactagagagctcaccacca

SEQ ID NO: 212008 - DNA, 75 bp, Artificial Sequence
  Synthetic
aaaacacacttgttacaagttaccccagaatgcccacaattattccgaaagtggataaaaagccgccgagctttt

SEQ ID NO: 212009 - DNA, 75 bp, Artificial Sequence
  Synthetic
atcctctgatgaaggttgatagtgatcaagatctcaatgaaaaggttaaagcagtgacaaagatatttcatgata

SEQ ID NO: 212010 - DNA, 75 bp, Artificial Sequence
  Synthetic
tgagtgtgacaaaggatagtcaagatgaggcaatttggaatctcaatccagcaagcaagtgatagtatcacccta

SEQ ID NO: 212011 - DNA, 75 bp, Artificial Sequence
  Synthetic
gtctaaaatatatagtagatcaattattagcttggcactaccccacatacactcctcaacctactattcactcca

SEQ ID NO: 212012 - DNA, 75 bp, Artificial Sequence
  Synthetic
ctaacagtaggctcacattaagaaaaacttaggagtgaatgagcgtctccttcgcttgatgaactctactccaca

SEQ ID NO: 212013 - DNA, 75 bp, Artificial Sequence
  Synthetic
tagactgaatgaatcccgttgccatgtcgaatttctacgggatcaaccaggccgatcacctccgagagaagggag

SEQ ID NO: 212014 - DNA, 75 bp, Artificial Sequence
  Synthetic
accaaccagagaagggcccatccgtcctgacatacgtctctttgattactggactgttgagcttatttaccatta

SEQ ID NO: 212015 - DNA, 75 bp, Artificial Sequence
  Synthetic
ttgctctgaatgtcacaaatattatttatttgacagggtctggtggtaccatggcaacaatcaaggacaatcaac

SEQ ID NO: 212016 - DNA, 75 bp, Artificial Sequence
  Synthetic
aatcaatgagtggctccatgagagatatatcaggtatgcttgtcgaagacctgaaacccaaaactgacttgatca

SEQ ID NO: 212017 - DNA, 75 bp, Artificial Sequence
  Synthetic
atagcatggtgagctacacaatcccttctcagatctcagccatgtctgctatgattaagaatgaggttttgcggc

SEQ ID NO: 212018 - DNA, 75 bp, Artificial Sequence
  Synthetic
aatgtacaccttcattcatgtttaacaacaccatctgtcctattgcagaacatccagtccatacaagttattttg

SEQ ID NO: 212019 - DNA, 75 bp, Artificial Sequence
  Synthetic
aagaggtcggaattgaagctatttcaatgtgtacaggaacaaatcggaagcttgttgtgaatcaggggataaatt

SEQ ID NO: 212020 - DNA, 75 bp, Artificial Sequence
  Synthetic
ttgttgagtatccatcatttattcctggttcaacaaaacctggtgggtgtgtccgactaccatccttttcacttg

SEQ ID NO: 212021 - DNA, 75 bp, Artificial Sequence
  Synthetic
gtcttgaggtattcgcatatgctcatgctattacccaagatgactgtacatcatctagcactccagattactact

SEQ ID NO: 212022 - DNA, 75 bp, Artificial Sequence
  Synthetic
tctcagtcggaagaattgcggatcatggtacagatgttcctgtatttgaaaccttggctgaatggttcctcgatg

SEQ ID NO: 212023 - DNA, 75 bp, Artificial Sequence
  Synthetic
acaagatgaacaggaggtcttgctcagtaactgctgcagggaaaggaggttggcttggatgttctatacttgtag

SEQ ID NO: 212024 - DNA, 75 bp, Artificial Sequence
  Synthetic
ggagttttactgatgaattaacaagcccagaagtgaaccgtatatccctgtcttacatggatacatttggaaaga

SEQ ID NO: 212025 - DNA, 75 bp, Artificial Sequence
  Synthetic
agaaagactggctctatactgggtcagaagtgagagctgaccagagttggtcagcccttttcttctcggtgggat

SEQ ID NO: 212026 - DNA, 75 bp, Artificial Sequence
  Synthetic
caggtgttgtaattggggatacagtttatttcctggtgtggggaggtttgaaccatccaatcaatgttgatgcga

SEQ ID NO: 212027 - DNA, 75 bp, Artificial Sequence
  Synthetic
tgtgtagagccccgggatgtcaatctccaacacagtctctatgtaactatgccattaagcctcaagagtggggag

SEQ ID NO: 212028 - DNA, 75 bp, Artificial Sequence
  Synthetic
gaaatcagatagtcaatggtattctccattttaaacatgacacaaatgagaagccaaccctccatgtaaggacat

SEQ ID NO: 212029 - DNA, 75 bp, Artificial Sequence
  Synthetic
tatcaccggacaataactggatgggagctgaagggagacttttccactttcacaactcagggaaaacctttatat

SEQ ID NO: 212030 - DNA, 75 bp, Artificial Sequence
  Synthetic
acacaaggtcttcaacatggcatactttaccccaagtgggcatcctgacacttggttggcctttgtctgtacagt

SEQ ID NO: 212031 - DNA, 75 bp, Artificial Sequence
  Synthetic
gggttgatatcacgtcaatatccaggcccggacagtcaccttgtgaatatgataatcgctgtcctcatcaatgtg

SEQ ID NO: 212032 - DNA, 75 bp, Artificial Sequence
  Synthetic
ttactggagtctacactgacttgtttcctctcggtgtctcatacgagtactcagtgactgcctatttggatcaag

SEQ ID NO: 212033 - DNA, 75 bp, Artificial Sequence
  Synthetic
tccagtcacgtatgaaccctaagattgcactagttggtgctcaagaaaagatctatgagaagaccattaccacta

SEQ ID NO: 212034 - DNA, 75 bp, Artificial Sequence
  Synthetic
atacacaacatgcagactacacaacaacctcctgctttgcctataagcttagggtctggtgcgtaagtatagttg

SEQ ID NO: 212035 - DNA, 75 bp, Artificial Sequence
  Synthetic
aaatgtctcctggagttataacaacaagacagcctgtcccatttttatatcatctaaatcttggttgtcaagaca

SEQ ID NO: 212036 - DNA, 75 bp, Artificial Sequence
  Synthetic
cctcaactggatcactgacccctttggatgctcatggtggcacatatctcaacactgacccggtagggaacaagg

SEQ ID NO: 212037 - DNA, 75 bp, Artificial Sequence
  Synthetic
tagattgttattttgtattacatgagggccaaatctactttggaatgagtgtcggaccaatcaactacacttata

SEQ ID NO: 212038 - DNA, 75 bp, Artificial Sequence
  Synthetic
gtatagttggaaggtcgagagagattggggccaatatgaatgtttctctcaatcagctatgtcatagtgtctata

SEQ ID NO: 212039 - DNA, 75 bp, Artificial Sequence
  Synthetic
ctgagtttcttaaggagaaagaacacccaggaacaaggaataacattgatgtagaagggtggctgcttaagagga

SEQ ID NO: 212040 - DNA, 75 bp, Artificial Sequence
  Synthetic
tcgaaactctgaatgggacaaagatatttgggttggatgacttggaaggaagtgggcctggccaccaatctggac

SEQ ID NO: 212041 - DNA, 75 bp, Artificial Sequence
  Synthetic
cagaggatccaagcattgcccccatagggcacaattaatccactcctcccaccaagaaggccaagaccccaccag

SEQ ID NO: 212042 - DNA, 75 bp, Artificial Sequence
  Synthetic
gcccactgaatacagttaaacccccacaagagattccacctacatcaaaaatggcaagcaatcaggagaaggacg

SEQ ID NO: 212043 - DNA, 75 bp, Artificial Sequence
  Synthetic
agagacacctgccagagactcatctcagccctacaacaagtggaaaaaggctatcgaaggcaggggcaaagggtc

SEQ ID NO: 212044 - DNA, 75 bp, Artificial Sequence
  Synthetic
aagaaggagatggccgtacaactctggcagatttggggagaacaaatacatcaaaagatgagatcaggaacaaga

SEQ ID NO: 212045 - DNA, 75 bp, Artificial Sequence
  Synthetic
tggtgtcaaccactccagagagaaatgataagactagtgctaaaagggaaaggaataccaacgcacccagaggtg

SEQ ID NO: 212046 - DNA, 75 bp, Artificial Sequence
  Synthetic
ggaacaccactgcccccatacgtgagggatctgatagagagcataatactagtttatatcctgacaaatccaaga

SEQ ID NO: 212047 - DNA, 75 bp, Artificial Sequence
  Synthetic
tctccattctacatccctcacataatacatctagtgaggaacatccgagtaattctacaaataattacagtagta

SEQ ID NO: 212048 - DNA, 75 bp, Artificial Sequence
  Synthetic
ctgttaatgctgacaaaccatctaatgtaagtcatcataatagaatgagtggatcagtgaatcctaccaatcctt

SEQ ID NO: 212049 - DNA, 75 bp, Artificial Sequence
  Synthetic
ctaattccccacatctaaatcaggatcttgctacaaattcattaccattgagtgaggaagaactgttaacaaata

SEQ ID NO: 212050 - DNA, 75 bp, Artificial Sequence
  Synthetic
tgttatcaacaatacctaaaaaacaagctgatttgattaccagaggcactacccaatcagtaccttctaacccta

SEQ ID NO: 212051 - DNA, 75 bp, Artificial Sequence
  Synthetic
aacattctaacctaaggatggcttacattcaagaggatgattatccccctccttatgatgaccccaaaagtgatc

SEQ ID NO: 212052 - DNA, 75 bp, Artificial Sequence
  Synthetic
aagactacaattacaggttgaatcttgaagggaatgacaacgtcagatcaatcatggaaatggcattgtctagtt

SEQ ID NO: 212053 - DNA, 75 bp, Artificial Sequence
  Synthetic
tcatcgcacattctgacccaggcaacaccgacaacagccgatctcaacctgatgatgccatccaatatcaagata

SEQ ID NO: 212054 - DNA, 75 bp, Artificial Sequence
  Synthetic
gcttggaatatggagctcaggatcccccagacatgggttattcagacagttattatgatctgaatggggattatt

SEQ ID NO: 212055 - DNA, 75 bp, Artificial Sequence
  Synthetic
caggtgatcttcattacaacaccgagccatcaataattagtctccaaacttcaagcaaaacacattcattttctg

SEQ ID NO: 212056 - DNA, 75 bp, Artificial Sequence
  Synthetic
aggtgatcagagatgtggcaaatcatgagaaatactcgtcaatcgggtatcttgcagactgttcaaaaagtcagc

SEQ ID NO: 212057 - DNA, 75 bp, Artificial Sequence
  Synthetic
ctccgtacagcagtatttgtctcaatgatgtaatggtcatctccgttgagtacaattatgacgtcctcagaagca

SEQ ID NO: 212058 - DNA, 75 bp, Artificial Sequence
  Synthetic
gtatggaggaaatggtctataaaccagttgggtctagtagacccacattgccgagagctgtacactacactaatg

SEQ ID NO: 212059 - DNA, 75 bp, Artificial Sequence
  Synthetic
ataagaacacagggataggagctttgtacctggaaggattactatgtgaattttgctcaggagtgttaagagaca

SEQ ID NO: 212060 - DNA, 75 bp, Artificial Sequence
  Synthetic
caaagaatgaagattatatcattcatgagtttatacctatcgtaaaagataggactctttttataggaatgtccc

SEQ ID NO: 212061 - DNA, 75 bp, Artificial Sequence
  Synthetic
ctcatgaaaagatcaaacaggagtatgatgagatggaaaagaagaacaacctgtctagagctgatatgagcatct

SEQ ID NO: 212062 - DNA, 75 bp, Artificial Sequence
  Synthetic
actgggacgagaacggtcttaatcccttttatacactgccctttaggatatcggggagatatccaattactataa

SEQ ID NO: 212063 - DNA, 75 bp, Artificial Sequence
  Synthetic
catcattaatgctatgggttaataatgtccagagaagtgttctaggtgaagtatgtttcggtgtcttgattaagg

SEQ ID NO: 212064 - DNA, 75 bp, Artificial Sequence
  Synthetic
gttatccatttgtatataaaagaggtgatatcaattcctatctgtttgctctttcaagaactcaaggtttttcaa

SEQ ID NO: 212065 - DNA, 75 bp, Artificial Sequence
  Synthetic
cttacgggaagaagtcattggtttctgttgagtgcttgtgtggcattatcaatgatcctgataatttgaataagt

SEQ ID NO: 212066 - DNA, 75 bp, Artificial Sequence
  Synthetic
tgagaaatggaacatcaatagggtgtgggtttatctcattaaatatactgacaacatatatgatcagagatcctg

SEQ ID NO: 212067 - DNA, 75 bp, Artificial Sequence
  Synthetic
agacttctccgaatgaaaatcttgttttcagtcaagatgatataatccttgggtacacctctaacggcataacag

SEQ ID NO: 212068 - DNA, 75 bp, Artificial Sequence
  Synthetic
acttatcagttgtgacacctaaccaggacccacttttccatctgaccacctctaatagtcaatctcaaagtgctg

SEQ ID NO: 212069 - DNA, 75 bp, Artificial Sequence
  Synthetic
caggaggcaaaaacccaaacttcttgagcggttacttgaagggatggtggtaaactcctccttcatgattgagtc

SEQ ID NO: 212070 - DNA, 75 bp, Artificial Sequence
  Synthetic
aaagtgtatgggcggatttgaagttttaccttggactgcatcaatataattatataatcaaggatctataattaa

SEQ ID NO: 212071 - DNA, 75 bp, Artificial Sequence
  Synthetic
gaaaaacttaggagtgaatgcactcaaaagcttctttactcaacttattgcataacaaaaggtaaagaagcctgt

SEQ ID NO: 212072 - DNA, 75 bp, Artificial Sequence
  Synthetic
gcatgtcactccttacaatggatagtaatatatctatcactgatatcctctatcctgagtgccatctggatagtc

SEQ ID NO: 212073 - DNA, 75 bp, Artificial Sequence
  Synthetic
ccatagtcacaggcaagctgtattcacttctctgcagaggtggattcccccatagagaacacttggacgataaaa

SEQ ID NO: 212074 - DNA, 75 bp, Artificial Sequence
  Synthetic
cacttgatataaattatcgtgtcaatcaatcatatattaagagattgcctataacagtggaccaacaaaaactga

SEQ ID NO: 212075 - DNA, 75 bp, Artificial Sequence
  Synthetic
agcaatgcttgaatgagaagtacaagaacatggagaaactcaaccccattccttatccatttgcaaacaaatact

SEQ ID NO: 212076 - DNA, 75 bp, Artificial Sequence
  Synthetic
tgtttagaataaatgacctagaattcatttcagacatagctagtacattctctctagccaatacatgctataaga

SEQ ID NO: 212077 - DNA, 75 bp, Artificial Sequence
  Synthetic
aaatttccaatagacttgtcaaacttaagtcacatacattggcaaagttaggaatgaaaacgactgtggatcaac

SEQ ID NO: 212078 - DNA, 75 bp, Artificial Sequence
  Synthetic
aatctgaaattcatgaagaaaagagtattaaatctctgcctaccattatggagggaacaatatggtatcaacctt

SEQ ID NO: 212079 - DNA, 75 bp, Artificial Sequence
  Synthetic
ttctattttggtttaaatgcaaattcatcatgagatccttgatcaagaggcacacaagattaagacataatgctt

SEQ ID NO: 212080 - DNA, 75 bp, Artificial Sequence
  Synthetic
gcctcggcctcctgtatatataaaaaaaagggaaggtagggaggagctggctaaaactggatggctgccagccaa

SEQ ID NO: 212081 - DNA, 75 bp, Artificial Sequence
  Synthetic
ctaaaactggatggctgccagccaagcatgagctcatacctagggagccaaccagctaacagccagagggagccc

SEQ ID NO: 212082 - DNA, 75 bp, Artificial Sequence
  Synthetic
tggctgcatgccactggcagttatagtgaaacccctcccatagtccttaatcacaagtaaacaaagcacaagggg

SEQ ID NO: 212083 - DNA, 75 bp, Artificial Sequence
  Synthetic
gtgaaacccctcccatagtccttaatcacaagtaaacaaagcacaaggggaagtggaaagcagccaggggaacat

SEQ ID NO: 212084 - DNA, 75 bp, Artificial Sequence
  Synthetic
tcacaagtaaacaaagcacaaggggaagtggaaagcagccaggggaacatgttttgcgagccagagctgttttgg

SEQ ID NO: 212085 - DNA, 75 bp, Artificial Sequence
  Synthetic
gcagacaaagatgctgtaatcaaaagcctttattgtaatatgcagtacattttaataaagtataaccagctttac

SEQ ID NO: 212086 - DNA, 75 bp, Artificial Sequence
  Synthetic
tcgccagctgtcacgtaaggcttctgtaaaagttagtaaaacctggagtggaactaaaaaaagagctcaaaggat

SEQ ID NO: 212087 - DNA, 75 bp, Artificial Sequence
  Synthetic
gaactaaaaaaagagctcaaaggattttaatttttttgttagaatttttgctggacttttgcacaggtgaagaca

SEQ ID NO: 212088 - DNA, 75 bp, Artificial Sequence
  Synthetic
ttgtgttttcaggttcatgggtgccgcacttgcacttttgggggacctagttgctactgtttctgaggctgctgc

SEQ ID NO: 212089 - DNA, 75 bp, Artificial Sequence
  Synthetic
tttgggggaggggtttttggttttttgaaacattgaaagcctttacagatgtgataggtgcagtgttcctgtgtg

SEQ ID NO: 212090 - DNA, 75 bp, Artificial Sequence
  Synthetic
aaaaacaaaatattatgacccccaaaaccatgtctacttataaaagttacagaatatttttccataagtttctta

SEQ ID NO: 212091 - DNA, 75 bp, Artificial Sequence
  Synthetic
attgctgctggagaggctgctgctactatagaagttgaaattgcatcccttgctactgtagaggggattacaagt

SEQ ID NO: 212092 - DNA, 75 bp, Artificial Sequence
  Synthetic
gctgggtttgctgcattggttcaaactgtaactggtggtagtgctattgctcagttgggatatagattttttgct

SEQ ID NO: 212093 - DNA, 75 bp, Artificial Sequence
  Synthetic
aaagcaaaagcaaagtcatgccactttgcaaaatccttttttctagtaaatattcagagcagcttagtgattttc

SEQ ID NO: 212094 - DNA, 75 bp, Artificial Sequence
  Synthetic
tattcagagcagcttagtgattttctcaggtaggccttaggtctaaaatctatttgccttacaaatctggcttgt

SEQ ID NO: 212095 - DNA, 75 bp, Artificial Sequence
  Synthetic
cccaggctttttggaatcttgttagagatgatttgccatctttaacatctcaggaaattcaaagaagaacccaaa

SEQ ID NO: 212096 - DNA, 75 bp, Artificial Sequence
  Synthetic
taattattaattgctgaaactctatgtctatgtggtgttaaaaaaaacaagatattatgactcccaaaaccatgt

SEQ ID NO: 212097 - DNA, 75 bp, Artificial Sequence
  Synthetic
ataattatatttcagactattattctagattgtctccagttaggccctctatggtaaggcaggttgcccaaaggg

SEQ ID NO: 212098 - DNA, 75 bp, Artificial Sequence
  Synthetic
ctcatacacccaaagtatagatgatgcagacagcattcaagaagttacccaaaggctagatttaaaaaccccaaa

SEQ ID NO: 212099 - DNA, 75 bp, Artificial Sequence
  Synthetic
tgtgcaatctggtgaatttatagagaaaagtattgcaccaggaggtgcaaatcaaagatctgctcctcaatggat

SEQ ID NO: 212100 - DNA, 75 bp, Artificial Sequence
  Synthetic
atcaaagatctgctcctcaatggatgttgcctttacttttagggttgtacgggactgtaacacctgctcttgaag

SEQ ID NO: 212101 - DNA, 75 bp, Artificial Sequence
  Synthetic
gttgcctttacttttagggttgtacgggactgtaacacctgctcttgaagcatatgaagatggccccaacaaaaa

SEQ ID NO: 212102 - DNA, 75 bp, Artificial Sequence
  Synthetic
gaaaaggagaaaggaaggaccccgtgcaagttccaaaacttcttataagaggaggagtagaagttctagaagtta

SEQ ID NO: 212103 - DNA, 75 bp, Artificial Sequence
  Synthetic
aaactggggttgactcaattacagaggtagaatgctttttaactccagaaatgggtgacccagatgagcatctta

SEQ ID NO: 212104 - DNA, 75 bp, Artificial Sequence
  Synthetic
atcagatacatttgaaagtgactccccaaataaggacatgcttccttgttacagtgtggccagaattccactacc

SEQ ID NO: 212105 - DNA, 75 bp, Artificial Sequence
  Synthetic
tctaatggtcaagcaacccatgacaatggtgcaggaaagccagtgcagggcaccagctttcattttttttctgtt

SEQ ID NO: 212106 - DNA, 75 bp, Artificial Sequence
  Synthetic
gtacccagatggaacaatttttccaaagaatgcaacagtgcaatctcaagtaatgaacacagagcacaaggcgta

SEQ ID NO: 212107 - DNA, 75 bp, Artificial Sequence
  Synthetic
caaaagcctttattgtaatatgcagtacattttaataaagtataaccagctttacactttgcagttgcagttact

SEQ ID NO: 212108 - DNA, 75 bp, Artificial Sequence
  Synthetic
caactaacatttcttctctggtcatgtggatactgtcaaccctttgtttggctgctacagtatcaacagcctgct

SEQ ID NO: 212109 - DNA, 75 bp, Artificial Sequence
  Synthetic
tctttagggtcttctaccttttttttcttcttaggtggggtagagtgttgggatcctgtgttttcatcatcactg

SEQ ID NO: 212110 - DNA, 75 bp, Artificial Sequence
  Synthetic
gtccttaatcacaagtaaacaaagcacaaggggaagtggaaagcagccaagggaacatgttttgcgagccagagc

SEQ ID NO: 212111 - DNA, 75 bp, Artificial Sequence
  Synthetic
taacagatctggttcccagcagtggagaggactgtccagatattttaaggttcagctcagaaaaagaagggttaa

SEQ ID NO: 212112 - DNA, 75 bp, Artificial Sequence
  Synthetic
gaggttagagtttttgaggggacagaggaacttccaggggacccagacatgatgagatatgttgacagatatgga

SEQ ID NO: 212113 - DNA, 75 bp, Artificial Sequence
  Synthetic
aaaaaactaaaggtacatagtttttgacagtaattattaattgctgaaactctatgtctatgtggtgttaaaaaa

SEQ ID NO: 212114 - DNA, 75 bp, Artificial Sequence
  Synthetic
gatgagatatgttgacagatatggacagttgcagacaaaaatgctgtaatcaaaagcctttattgtaatatgcag

SEQ ID NO: 212115 - DNA, 75 bp, Artificial Sequence
  Synthetic
aggaacttccaggggacccagacatgatgagatatgttgacagatatggacagttgcagacaaaaatgctgtaat

SEQ ID NO: 212116 - DNA, 75 bp, Artificial Sequence
  Synthetic
cagttgcagacaaaaatgctgtaatcaaaagcctttattgtaatatgcagtacattttaataaagtataaccagc

SEQ ID NO: 212117 - DNA, 75 bp, Artificial Sequence
  Synthetic
ataagtgcagtgttcctgtgtgtctgcaccagaggcttctgagacctgggaagagcattgtgattgagattcagt

SEQ ID NO: 212118 - DNA, 75 bp, Artificial Sequence
  Synthetic
gcttgatccatgtccagagtcttctgcttcagaatcttcctctctaggaaagtcaagaatgggtctccccatacc

SEQ ID NO: 212119 - DNA, 75 bp, Artificial Sequence
  Synthetic
aacattagctttcatagtagaaaatgtatacatgcttatttctaaatccagcctttctttccactgcacaatcct

SEQ ID NO: 212120 - DNA, 75 bp, Artificial Sequence
  Synthetic
gtgctttgcctgaaccaaaagctacataggtaagtaatgtttttttttgtgttttcaggttcatgggtgccgcac

SEQ ID NO: 212121 - DNA, 75 bp, Artificial Sequence
  Synthetic
cagctaaagtagttttgccactgtctattggccccttgaatagccagtaccttttttttggaatgtttaatacaa

SEQ ID NO: 212122 - DNA, 75 bp, Artificial Sequence
  Synthetic
cccccacagagatcaagtaaagctgcagctaaagtagttttgccactgtctattggccccttgaatagccagtac

SEQ ID NO: 212123 - DNA, 75 bp, Artificial Sequence
  Synthetic
attacagggggtggtttttaattacagaacaacgtacccagatggaacaatttttccaaagaatgccacagtgca

SEQ ID NO: 212124 - DNA, 75 bp, Artificial Sequence
  Synthetic
attgctctaaaacagcattgccatgtgccccaaaaattaagtccattttatcaagcaaaaaattaaacctttcaa

SEQ ID NO: 212125 - DNA, 75 bp, Artificial Sequence
  Synthetic
ggtaggccttaggtctaaaatctatttgccttacaaatctggcttgtaaagttctaggcactgaatattcattca

SEQ ID NO: 212126 - DNA, 75 bp, Artificial Sequence
  Synthetic
taaccagctttactttacattcgcagttattttgggggaggggtctttggttttttaaagcattgaaagccttta

SEQ ID NO: 212127 - DNA, 75 bp, Artificial Sequence
  Synthetic
cgtacctagataagaacaaagcatatcctgtagaatgttgggttcctgatcccaccagaaaagaaaacacaagat

SEQ ID NO: 212128 - DNA, 75 bp, Artificial Sequence
  Synthetic
cgtacctagataagaacaaagcatatcctgtagaatgttgggttcctgatcccaccagaaatgaaaacacaagat

SEQ ID NO: 212129 - DNA, 75 bp, Artificial Sequence
  Synthetic
cgtacctagataagaacaaagcatatcctgtagaatgttgggttcctgatcccaccagaaacgaaaacacaagat

SEQ ID NO: 212130 - DNA, 75 bp, Artificial Sequence
  Synthetic
cgtacctagataagaacaaagcatatcctgtagaatgttgggttcctgatcccaccagaaaggaaaacacaagat

SEQ ID NO: 212131 - DNA, 75 bp, Artificial Sequence
  Synthetic
cgtacctagataagaacaaagcatatcctgtagaatgttgggttcctgatccctccagaaaagaaaacacaagat

SEQ ID NO: 212132 - DNA, 75 bp, Artificial Sequence
  Synthetic
cgtacctagataagaacaaagcatatcctgtagaatgttgggttcctgatccctccagaaatgaaaacacaagat

SEQ ID NO: 212133 - DNA, 75 bp, Artificial Sequence
  Synthetic
cgtacctagataagaacaaagcatatcctgtagaatgttgggttcctgatccctccagaaacgaaaacacaagat

SEQ ID NO: 212134 - DNA, 75 bp, Artificial Sequence
  Synthetic
cgtacctagataagaacaaagcatatcctgtagaatgttgggttcctgatccctccagaaaggaaaacacaagat

SEQ ID NO: 212135 - DNA, 75 bp, Artificial Sequence
  Synthetic
cgtacctagataagaacaaagcatatcctgtagaatgttgggttcctgatccccccagaaaagaaaacacaagat

SEQ ID NO: 212136 - DNA, 75 bp, Artificial Sequence
  Synthetic
cgtacctagataagaacaaagcatatcctgtagaatgttgggttcctgatccccccagaaatgaaaacacaagat

SEQ ID NO: 212137 - DNA, 75 bp, Artificial Sequence
  Synthetic
cgtacctagataagaacaaagcatatcctgtagaatgttgggttcctgatccccccagaaacgaaaacacaagat

SEQ ID NO: 212138 - DNA, 75 bp, Artificial Sequence
  Synthetic
cgtacctagataagaacaaagcatatcctgtagaatgttgggttcctgatccccccagaaaggaaaacacaagat

SEQ ID NO: 212139 - DNA, 75 bp, Artificial Sequence
  Synthetic
cgtacctagataagaacaaagcatatcctgtagaatgttgggttcctgatcccgccagaaaagaaaacacaagat

SEQ ID NO: 212140 - DNA, 75 bp, Artificial Sequence
  Synthetic
cgtacctagataagaacaaagcatatcctgtagaatgttgggttcctgatcccgccagaaatgaaaacacaagat

SEQ ID NO: 212141 - DNA, 75 bp, Artificial Sequence
  Synthetic
cgtacctagataagaacaaagcatatcctgtagaatgttgggttcctgatcccgccagaaacgaaaacacaagat

SEQ ID NO: 212142 - DNA, 75 bp, Artificial Sequence
  Synthetic
cgtacctagataagaacaaagcatatcctgtagaatgttgggttcctgatcccgccagaaaggaaaacacaagat

SEQ ID NO: 212143 - DNA, 75 bp, Artificial Sequence
  Synthetic
cgtacctagataagaacaaagcatatcctgttgaatgttgggttcctgatcccaccagaaaagaaaacacaagat

SEQ ID NO: 212144 - DNA, 75 bp, Artificial Sequence
  Synthetic
cgtacctagataagaacaaagcatatcctgttgaatgttgggttcctgatcccaccagaaatgaaaacacaagat

SEQ ID NO: 212145 - DNA, 75 bp, Artificial Sequence
  Synthetic
cgtacctagataagaacaaagcatatcctgttgaatgttgggttcctgatcccaccagaaacgaaaacacaagat

SEQ ID NO: 212146 - DNA, 75 bp, Artificial Sequence
  Synthetic
cgtacctagataagaacaaagcatatcctgttgaatgttgggttcctgatcccaccagaaaggaaaacacaagat

SEQ ID NO: 212147 - DNA, 75 bp, Artificial Sequence
  Synthetic
cgtacctagataagaacaaagcatatcctgttgaatgttgggttcctgatccctccagaaaagaaaacacaagat

SEQ ID NO: 212148 - DNA, 75 bp, Artificial Sequence
  Synthetic
cgtacctagataagaacaaagcatatcctgttgaatgttgggttcctgatccctccagaaatgaaaacacaagat

SEQ ID NO: 212149 - DNA, 75 bp, Artificial Sequence
  Synthetic
cgtacctagataagaacaaagcatatcctgttgaatgttgggttcctgatccctccagaaacgaaaacacaagat

SEQ ID NO: 212150 - DNA, 75 bp, Artificial Sequence
  Synthetic
cgtacctagataagaacaaagcatatcctgttgaatgttgggttcctgatccctccagaaaggaaaacacaagat

SEQ ID NO: 212151 - DNA, 75 bp, Artificial Sequence
  Synthetic
cgtacctagataagaacaaagcatatcctgttgaatgttgggttcctgatccccccagaaaagaaaacacaagat

SEQ ID NO: 212152 - DNA, 75 bp, Artificial Sequence
  Synthetic
cgtacctagataagaacaaagcatatcctgttgaatgttgggttcctgatccccccagaaatgaaaacacaagat

SEQ ID NO: 212153 - DNA, 75 bp, Artificial Sequence
  Synthetic
cgtacctagataagaacaaagcatatcctgttgaatgttgggttcctgatccccccagaaacgaaaacacaagat

SEQ ID NO: 212154 - DNA, 75 bp, Artificial Sequence
  Synthetic
cgtacctagataagaacaaagcatatcctgttgaatgttgggttcctgatccccccagaaaggaaaacacaagat

SEQ ID NO: 212155 - DNA, 75 bp, Artificial Sequence
  Synthetic
cgtacctagataagaacaaagcatatcctgttgaatgttgggttcctgatcccgccagaaaagaaaacacaagat

SEQ ID NO: 212156 - DNA, 75 bp, Artificial Sequence
  Synthetic
cgtacctagataagaacaaagcatatcctgttgaatgttgggttcctgatcccgccagaaatgaaaacacaagat

SEQ ID NO: 212157 - DNA, 75 bp, Artificial Sequence
  Synthetic
cgtacctagataagaacaaagcatatcctgttgaatgttgggttcctgatcccgccagaaacgaaaacacaagat

SEQ ID NO: 212158 - DNA, 75 bp, Artificial Sequence
  Synthetic
cgtacctagataagaacaaagcatatcctgttgaatgttgggttcctgatcccgccagaaaggaaaacacaagat

SEQ ID NO: 212159 - DNA, 75 bp, Artificial Sequence
  Synthetic
cgtacctagataagaacaaagcatatcctgtcgaatgttgggttcctgatcccaccagaaaagaaaacacaagat

SEQ ID NO: 212160 - DNA, 75 bp, Artificial Sequence
  Synthetic
cgtacctagataagaacaaagcatatcctgtcgaatgttgggttcctgatcccaccagaaatgaaaacacaagat

SEQ ID NO: 212161 - DNA, 75 bp, Artificial Sequence
  Synthetic
cgtacctagataagaacaaagcatatcctgtcgaatgttgggttcctgatcccaccagaaacgaaaacacaagat

SEQ ID NO: 212162 - DNA, 75 bp, Artificial Sequence
  Synthetic
cgtacctagataagaacaaagcatatcctgtcgaatgttgggttcctgatcccaccagaaaggaaaacacaagat

SEQ ID NO: 212163 - DNA, 75 bp, Artificial Sequence
  Synthetic
cgtacctagataagaacaaagcatatcctgtcgaatgttgggttcctgatccctccagaaaagaaaacacaagat

SEQ ID NO: 212164 - DNA, 75 bp, Artificial Sequence
  Synthetic
cgtacctagataagaacaaagcatatcctgtcgaatgttgggttcctgatccctccagaaatgaaaacacaagat

SEQ ID NO: 212165 - DNA, 75 bp, Artificial Sequence
  Synthetic
cgtacctagataagaacaaagcatatcctgtcgaatgttgggttcctgatccctccagaaacgaaaacacaagat

SEQ ID NO: 212166 - DNA, 75 bp, Artificial Sequence
  Synthetic
cgtacctagataagaacaaagcatatcctgtcgaatgttgggttcctgatccctccagaaaggaaaacacaagat

SEQ ID NO: 212167 - DNA, 75 bp, Artificial Sequence
  Synthetic
cgtacctagataagaacaaagcatatcctgtcgaatgttgggttcctgatccccccagaaaagaaaacacaagat

SEQ ID NO: 212168 - DNA, 75 bp, Artificial Sequence
  Synthetic
cgtacctagataagaacaaagcatatcctgtcgaatgttgggttcctgatccccccagaaatgaaaacacaagat

SEQ ID NO: 212169 - DNA, 75 bp, Artificial Sequence
  Synthetic
cgtacctagataagaacaaagcatatcctgtcgaatgttgggttcctgatccccccagaaacgaaaacacaagat

SEQ ID NO: 212170 - DNA, 75 bp, Artificial Sequence
  Synthetic
cgtacctagataagaacaaagcatatcctgtcgaatgttgggttcctgatccccccagaaaggaaaacacaagat

SEQ ID NO: 212171 - DNA, 75 bp, Artificial Sequence
  Synthetic
cgtacctagataagaacaaagcatatcctgtcgaatgttgggttcctgatcccgccagaaaagaaaacacaagat

SEQ ID NO: 212172 - DNA, 75 bp, Artificial Sequence
  Synthetic
cgtacctagataagaacaaagcatatcctgtcgaatgttgggttcctgatcccgccagaaatgaaaacacaagat

SEQ ID NO: 212173 - DNA, 75 bp, Artificial Sequence
  Synthetic
cgtacctagataagaacaaagcatatcctgtcgaatgttgggttcctgatcccgccagaaacgaaaacacaagat

SEQ ID NO: 212174 - DNA, 75 bp, Artificial Sequence
  Synthetic
cgtacctagataagaacaaagcatatcctgtcgaatgttgggttcctgatcccgccagaaaggaaaacacaagat

SEQ ID NO: 212175 - DNA, 75 bp, Artificial Sequence
  Synthetic
cgtacctagataagaacaaagcatatcctgtggaatgttgggttcctgatcccaccagaaaagaaaacacaagat

SEQ ID NO: 212176 - DNA, 75 bp, Artificial Sequence
  Synthetic
cgtacctagataagaacaaagcatatcctgtggaatgttgggttcctgatcccaccagaaatgaaaacacaagat

SEQ ID NO: 212177 - DNA, 75 bp, Artificial Sequence
  Synthetic
cgtacctagataagaacaaagcatatcctgtggaatgttgggttcctgatcccaccagaaacgaaaacacaagat

SEQ ID NO: 212178 - DNA, 75 bp, Artificial Sequence
  Synthetic
cgtacctagataagaacaaagcatatcctgtggaatgttgggttcctgatcccaccagaaaggaaaacacaagat

SEQ ID NO: 212179 - DNA, 75 bp, Artificial Sequence
  Synthetic
cgtacctagataagaacaaagcatatcctgtggaatgttgggttcctgatccctccagaaaagaaaacacaagat

SEQ ID NO: 212180 - DNA, 75 bp, Artificial Sequence
  Synthetic
cgtacctagataagaacaaagcatatcctgtggaatgttgggttcctgatccctccagaaatgaaaacacaagat

SEQ ID NO: 212181 - DNA, 75 bp, Artificial Sequence
  Synthetic
cgtacctagataagaacaaagcatatcctgtggaatgttgggttcctgatccctccagaaacgaaaacacaagat

SEQ ID NO: 212182 - DNA, 75 bp, Artificial Sequence
  Synthetic
cgtacctagataagaacaaagcatatcctgtggaatgttgggttcctgatccctccagaaaggaaaacacaagat

SEQ ID NO: 212183 - DNA, 75 bp, Artificial Sequence
  Synthetic
cgtacctagataagaacaaagcatatcctgtggaatgttgggttcctgatccccccagaaaagaaaacacaagat

SEQ ID NO: 212184 - DNA, 75 bp, Artificial Sequence
  Synthetic
cgtacctagataagaacaaagcatatcctgtggaatgttgggttcctgatccccccagaaatgaaaacacaagat

SEQ ID NO: 212185 - DNA, 75 bp, Artificial Sequence
  Synthetic
cgtacctagataagaacaaagcatatcctgtggaatgttgggttcctgatccccccagaaacgaaaacacaagat

SEQ ID NO: 212186 - DNA, 75 bp, Artificial Sequence
  Synthetic
cgtacctagataagaacaaagcatatcctgtggaatgttgggttcctgatccccccagaaaggaaaacacaagat

SEQ ID NO: 212187 - DNA, 75 bp, Artificial Sequence
  Synthetic
cgtacctagataagaacaaagcatatcctgtggaatgttgggttcctgatcccgccagaaaagaaaacacaagat

SEQ ID NO: 212188 - DNA, 75 bp, Artificial Sequence
  Synthetic
cgtacctagataagaacaaagcatatcctgtggaatgttgggttcctgatcccgccagaaatgaaaacacaagat

SEQ ID NO: 212189 - DNA, 75 bp, Artificial Sequence
  Synthetic
cgtacctagataagaacaaagcatatcctgtggaatgttgggttcctgatcccgccagaaacgaaaacacaagat

SEQ ID NO: 212190 - DNA, 75 bp, Artificial Sequence
  Synthetic
cgtacctagataagaacaaagcatatcctgtggaatgttgggttcctgatcccgccagaaaggaaaacacaagat

SEQ ID NO: 212191 - DNA, 75 bp, Artificial Sequence
  Synthetic
tgtccatttgaggcagcaaacaatgaatccaggccaccccagccatatattgctctaaaacagcattgccatgtg

SEQ ID NO: 212192 - DNA, 75 bp, Artificial Sequence
  Synthetic
aatccaggccaccccagccatatattgctctaaaacagcattgccatgtgccccaaaaattaagtccattttatc

SEQ ID NO: 212193 - DNA, 75 bp, Artificial Sequence
  Synthetic
tactgtcaaccctttgtttggctgctacagtatcaacagcctgctggcaaatgcttttttgatttttgctatctg

SEQ ID NO: 212194 - DNA, 75 bp, Artificial Sequence
  Synthetic
tcttctgggttaaagtcatgctccttaaggcccccctgaatactttcttccactactgcatatggctgtctacac

SEQ ID NO: 212195 - DNA, 75 bp, Artificial Sequence
  Synthetic
taaggcccccctgaatactttcttccactactgcatatggctgtctacacaaggcactgtaaaacaagtattcct

SEQ ID NO: 212196 - DNA, 75 bp, Artificial Sequence
  Synthetic
cactacccaatctaaatgaggatctaacctgtggaaatatactaatgtgggaggctgtgaccttaaaaactgagg

SEQ ID NO: 212197 - DNA, 75 bp, Artificial Sequence
  Synthetic
acagcaaaagaagcaacagttctattactaaacacagcttgactgaggaatgcatgcagatctacaggaaagtct

SEQ ID NO: 212198 - DNA, 75 bp, Artificial Sequence
  Synthetic
tactaaacacagcttgactgaggaatgcatgcagatctacaggaaagtctttagggtcttctaccttttttttct

SEQ ID NO: 212199 - DNA, 75 bp, Artificial Sequence
  Synthetic
tgcaggaaagccagtgcagggcaccagctttcattttttttctgttgggggggaggctttagaattacagggggt

SEQ ID NO: 212200 - DNA, 75 bp, Artificial Sequence
  Synthetic
tgcatgcagatctacaggaaagtctttagggtcttctaccttttttttcttcttaggtggggtagagtgttggga

SEQ ID NO: 212201 - DNA, 75 bp, Artificial Sequence
  Synthetic
caaaaattgagtttattgtaaaaaacaaaatgccctgcaaaagaaaaattgtggtttaccttaaagctttagatc

SEQ ID NO: 212202 - DNA, 75 bp, Artificial Sequence
  Synthetic
caaaatgccctgcaaaagaaaaattgtggtttaccttaaagctttagatccctgtagggggtgtctccaagaacc

SEQ ID NO: 212203 - DNA, 75 bp, Artificial Sequence
  Synthetic
gtggtttaccttaaagctttagatccctgtagggggtgtctccaagaaccttctcccagcaatgaagagcttctt

SEQ ID NO: 212204 - DNA, 75 bp, Artificial Sequence
  Synthetic
gtagacgggaaaaaaagacagaaacacagtggtttgactgagcagacatacagtgctttgcctgaaccaaaagct

SEQ ID NO: 212205 - DNA, 75 bp, Artificial Sequence
  Synthetic
ttctcccagcaatgaagagcttcttgggttaagtcacacccaaaccattgtctgaagcaatcaaagcaatagcaa

SEQ ID NO: 212206 - DNA, 75 bp, Artificial Sequence
  Synthetic
atgtaccaaaatcaggctgatgagcaacttttacaccttgttccatttttttatataaaaaattcattctcttca

SEQ ID NO: 212207 - DNA, 75 bp, Artificial Sequence
  Synthetic
aaccagctgtacttaacagttgcaattattttgggggaggggtttttggttttttgaagcattgaaagcctttac

SEQ ID NO: 212208 - DNA, 75 bp, Artificial Sequence
  Synthetic
gattcctccctattcagcactttgtccatttttgctttttgtagcaaaaaattagtgcaaaaaagggaaaaacaa

SEQ ID NO: 212209 - DNA, 75 bp, Artificial Sequence
  Synthetic
acaagggaatttccctggcctcctaaaaagcctccacgcccttactacttctgagtaagcttggaggcggaggcg

SEQ ID NO: 212210 - DNA, 75 bp, Artificial Sequence
  Synthetic
aaagtcagcaactggcctaaaccagattaaaagcaaaagcaaagtcatgccactttgcaaaatccttttttctag

SEQ ID NO: 212211 - DNA, 75 bp, Artificial Sequence
  Synthetic
gcatgagctcatacctagggagccaaccagctgacagccagagggagccctggctgcatgccactggcagttata

SEQ ID NO: 212212 - DNA, 75 bp, Artificial Sequence
  Synthetic
gtgaaagttagtaaaacctggagtggaactaaaaaaagagctcaaaggattttaatttttttgttagaatttttg

SEQ ID NO: 212213 - DNA, 75 bp, Artificial Sequence
  Synthetic
gtgttttctctctaaattaactttcacacttccatctaagtaatctcttaggcaatcaaggttgcttatgccatg

SEQ ID NO: 212214 - DNA, 75 bp, Artificial Sequence
  Synthetic
acacttccatctaagtaatctcttaggcaatcaaggttgcttatgccatgccctgaaggtaaatcccttgactct

SEQ ID NO: 212215 - DNA, 75 bp, Artificial Sequence
  Synthetic
acacagtggtttgactgagcagacatacagtgctttgcctgaaccaaaagctacataggtaagtaatgttttttt

SEQ ID NO: 212216 - DNA, 75 bp, Artificial Sequence
  Synthetic
ctatagaagttgaaattgcatcccttgctactgtagaggggattacaagtacctctgaggctatagctgctatag

SEQ ID NO: 212217 - DNA, 75 bp, Artificial Sequence
  Synthetic
ggcccgtccttgttctccacaatctcccaggctttttggaatcttgttagagatgatttgccagccttaacctct

SEQ ID NO: 212218 - DNA, 75 bp, Artificial Sequence
  Synthetic
tagattgtctccagttaggccctctatggtaaggcaagttgcccaaagggagggaacctatatttcttttggcca

SEQ ID NO: 212219 - DNA, 75 bp, Artificial Sequence
  Synthetic
accagaggcttctgagacctgggaagagcattgtgattgagattcagtgcttgatccatgtccagagtcttctgc

SEQ ID NO: 212220 - DNA, 75 bp, Artificial Sequence
  Synthetic
atacccagatggaacaatttttccaaagaatgccacagtgcaatctcaagtcatgaacacagagcacaaggcgta

SEQ ID NO: 212221 - DNA, 75 bp, Artificial Sequence
  Synthetic
ccttttacatcctcaaatacaaccataaactgatctatacccactcctaactcaaagtttaatctttctaatggc

SEQ ID NO: 212222 - DNA, 75 bp, Artificial Sequence
  Synthetic
caaaatccttttttctagcaaatactcagagcagcttagtgattttctcaggtaggcctttggtctaaaatctat

SEQ ID NO: 212223 - DNA, 75 bp, Artificial Sequence
  Synthetic
gcatattaacatttaatgactttcccccacagagatcaagtaaagcagcagctaaagtagtcttgccactgtcta

SEQ ID NO: 212224 - DNA, 75 bp, Artificial Sequence
  Synthetic
gtgatcacaagtaaacaaagcacaaggggaagtggaaagttttgcgaagtaaacaaagcacaaggggaagtggaa

SEQ ID NO: 212225 - DNA, 75 bp, Artificial Sequence
  Synthetic
gtggagaggactctccagatattttaaggttcagctaaggaaaaggagggttaaaaacccctacccaatttcttt

SEQ ID NO: 212226 - DNA, 75 bp, Artificial Sequence
  Synthetic
tttttcatgatggttaaagtgatttggctgatcctttttctcacattttttgcattgctgtgggttttcctgaaa

SEQ ID NO: 212227 - DNA, 75 bp, Artificial Sequence
  Synthetic
tgttgggatcctgtgttttcatcatccctggcaaacattttttcatggcaaaacaggttttcatcccacttttca

SEQ ID NO: 212228 - DNA, 75 bp, Artificial Sequence
  Synthetic
attccaccaggattcccattcatctgttccataggttggcacctaaaaaaaaaacaattaggttgattgtaaaaa

SEQ ID NO: 212229 - DNA, 75 bp, Artificial Sequence
  Synthetic
acaaaatgccctgcaaaagcaaaatagtggtttaccttaaagctttagatccctgtagggggtgtctccaagaac

SEQ ID NO: 212230 - DNA, 75 bp, Artificial Sequence
  Synthetic
cttaaaaattttctgtttctatgccttaattttagcatgcacattaaacaggggcaatgcactgaaggattagtg

SEQ ID NO: 212231 - DNA, 75 bp, Artificial Sequence
  Synthetic
tttatataaaaaattcattctcttcattttgtcttcgtccccacctttatcagggtggagttctttgcatttttt

SEQ ID NO: 212232 - DNA, 75 bp, Artificial Sequence
  Synthetic
cagctggccatggttcttcgccagctgtggatggctgccagccaagcatgagctcatacctagggagccaaccag

SEQ ID NO: 212233 - DNA, 75 bp, Artificial Sequence
  Synthetic
gctgtaatcaaaagcctttattgtaatatgcagtacattttaataaagtttaaccagctttactttacatttgca

SEQ ID NO: 212234 - DNA, 75 bp, Artificial Sequence
  Synthetic
gcccttactacttctgagtaagcttggaggcggaggcggcctcggcctcctgtatatataaaaaaaagggaaggt

SEQ ID NO: 212235 - DNA, 75 bp, Artificial Sequence
  Synthetic
tccagatattttaaggttcagctaagaaaaaggagggttaaaaacccctacccaatttctttccttcttactgat

SEQ ID NO: 212236 - DNA, 75 bp, Artificial Sequence
  Synthetic
gggaggagctggctggctgccagccaagcatgagctcatacctagggagccaaccagctaacagccagagggagc

SEQ ID NO: 212237 - DNA, 75 bp, Artificial Sequence
  Synthetic
gcagttatagtgaaaccactcccatagtccttaatcacaagtaaacaaagcacaaggggaagtggaaagcagcca

SEQ ID NO: 212238 - DNA, 75 bp, Artificial Sequence
  Synthetic
gaatttttgctggatttttgcacaggtgaagacagtgtagacgggaaaaaaagacagaaacacagtggtttgact

SEQ ID NO: 212239 - DNA, 75 bp, Artificial Sequence
  Synthetic
tgcagacagcattcaagaagttacccaaaggctagatttaaaaaccccaaatgtgcaatctggtgaatttataga

SEQ ID NO: 212240 - DNA, 75 bp, Artificial Sequence
  Synthetic
atatggacagttgcagacaaaaatgctgtaatcaaaagcctttattgtaatatgcagtacattttaataaagtat

SEQ ID NO: 212241 - DNA, 75 bp, Artificial Sequence
  Synthetic
ttattttgggggaggggtctttggttttttgaaacattgaaagcctttacagatgtgaaaagtgcagttttcctg

SEQ ID NO: 212242 - DNA, 75 bp, Artificial Sequence
  Synthetic
ctctaatgggcaagcaactcatgacaatggtgcagggaagccagtgcagggcaccagctttcattttttttctgt

SEQ ID NO: 212243 - DNA, 75 bp, Artificial Sequence
  Synthetic
actcatctgttccataggttggcacctacaaaaaaaaaattaagtttattgtaaaaaacaaaatgccctaaaaaa

SEQ ID NO: 212244 - DNA, 75 bp, Artificial Sequence
  Synthetic
ctattattctagattgtctccagttaggccctctatggtaaggcaggttgcccaaagggagggaacctatatttc

SEQ ID NO: 212245 - DNA, 75 bp, Artificial Sequence
  Synthetic
gctcaaatagaggaggttagagtttttgaggggacagagcaacttccaggggacccagatatgatgagatatgtt

SEQ ID NO: 212246 - DNA, 75 bp, Artificial Sequence
  Synthetic
acacttccatctaagtaatctcttaagcaatcaaggttgcttatgccatgccctgaaggtaaatcccttgactct

SEQ ID NO: 212247 - DNA, 75 bp, Artificial Sequence
  Synthetic
atacaaccataaactgatctatacccactcctaactcaaagtttaatctttctaatggcatattaacatttaatg

SEQ ID NO: 212248 - DNA, 75 bp, Artificial Sequence
  Synthetic
gtgattttctcaggtaggccttaggtctaaaatctatttgccttacaaatctggcttgtaatgttctaggcactg

SEQ ID NO: 212249 - DNA, 75 bp, Artificial Sequence
  Synthetic
tataaccagctttactttacagttgcagttattttgggggaggggtttttggttttttgaaacattgaaagcctt

SEQ ID NO: 212250 - DNA, 75 bp, Artificial Sequence
  Synthetic
cagttattttgggggaggggtttttggttttttgaaacattgaaagcctttacagatgtgataagtgcagtgttc

SEQ ID NO: 212251 - DNA, 75 bp, Artificial Sequence
  Synthetic
gccagtaccttttttttggaatgtttaatacaatgcattttaagaactcataaatgacagtgtccatttgaggca

SEQ ID NO: 212252 - DNA, 75 bp, Artificial Sequence
  Synthetic
aaaagggaagggatggctgccagccaagcatgagctcatacctagggagccaaccagctaacagccagtaaacaa

SEQ ID NO: 212253 - DNA, 75 bp, Artificial Sequence
  Synthetic
aagcatgagctcatacctagggagccaaccagctaacagccagtaaacaaagcacaaggctgtatatataaaaaa

SEQ ID NO: 212254 - DNA, 75 bp, Artificial Sequence
  Synthetic
attccaccaggattcccattcatctgttccataggttggcacctaagaaaaaaacaattaagtttattgtaaaaa

SEQ ID NO: 212255 - DNA, 75 bp, Artificial Sequence
  Synthetic
cacaatcctctcatgaatggcagctgcaaagtcagcaactggcctaaaccagattaaaagcaaaagcaaagtcat

SEQ ID NO: 212256 - DNA, 75 bp, Artificial Sequence
  Synthetic
gcaaaaatttgggcattataatagtgtttttcatgatggttaaagtgatttggctgatcctttttttcacatttt

SEQ ID NO: 212257 - DNA, 75 bp, Artificial Sequence
  Synthetic
caggtcttcatcccacttctcattaaatgtattccaccaggattcccactcatctgttccataggttggcaccta

SEQ ID NO: 212258 - DNA, 75 bp, Artificial Sequence
  Synthetic
aaaatctatttgccttacaaatctggcttgtaaagttctaggcactgaatattcattcatggttacaattccagg

SEQ ID NO: 212259 - DNA, 75 bp, Artificial Sequence
  Synthetic
tcaagtgggctgcttcttaaaaattttctgtttctatgccttattttagcatgcacattaaacaggggcaatgca

SEQ ID NO: 212260 - DNA, 75 bp, Artificial Sequence
  Synthetic
ttgtaaaaaacaaaatgccctgcaaaagaaaaattgtggtttaccttaaagctttagatccctgtagggggtgtc

SEQ ID NO: 212261 - DNA, 75 bp, Artificial Sequence
  Synthetic
atgcatgcagatctacaggaaagtctttagggtcttctaccttttttttctttttaggtggggtagagtgttggg

SEQ ID NO: 212262 - DNA, 75 bp, Artificial Sequence
  Synthetic
gagggttaaaaacccctacccaatttctttccttcttactgatttaattaacagaaggactcctagagttgatgg

SEQ ID NO: 212263 - DNA, 75 bp, Artificial Sequence
  Synthetic
gggggaggggtctttggttttttgaaacattgaaagcctttacagatgtgataggtgcagtgttcctgtgtgtct

SEQ ID NO: 212264 - DNA, 75 bp, Artificial Sequence
  Synthetic
gcacaaggggaagtggaaagcagccaggagcatgttttgcgagccagagctgttttggcttgtcaccagctggcc

SEQ ID NO: 212265 - DNA, 75 bp, Artificial Sequence
  Synthetic
aaacccctacccaatttctttccttcttactgatttgattaacagaaggacccctagagttgatgggcagcctat

SEQ ID NO: 212266 - DNA, 75 bp, Artificial Sequence
  Synthetic
gtttgactcagcagacatacagtgctttgcctgaaccaaaagctacataggtaagtaatgtttttttttgtgttt

SEQ ID NO: 212267 - DNA, 75 bp, Artificial Sequence
  Synthetic
ggtaaatcccttgactctgcaccagtgccttttacatcctcaaatacaaccataaactgatctatacccactcct

SEQ ID NO: 212268 - DNA, 75 bp, Artificial Sequence
  Synthetic
tggaaatatactaatgtgggaggctgtgaccttaaaaactgaggttttaggggtgacaactttgatgaatgtgca

SEQ ID NO: 212269 - DNA, 75 bp, Artificial Sequence
  Synthetic
gacagagacacagtggtttgactgagcagacatacagtgctttgcctgaaccaaaagctaaataggtaagtaatg

SEQ ID NO: 212270 - DNA, 75 bp, Artificial Sequence
  Synthetic
accagctgacacaagtaaacaaagcacaaggggaagtggaaagcgccaagcatgagctcatacctagggagccaa

SEQ ID NO: 212271 - DNA, 75 bp, Artificial Sequence
  Synthetic
aaaggattttaatttttttgttagaatttttgctggacttttgcacaggtgaagacagtgtagacgggaaaaaaa

SEQ ID NO: 212272 - DNA, 75 bp, Artificial Sequence
  Synthetic
ttttggaatcttgttagagatgatttgccatctttaacatctcaggaaattcaaagaagaacccaaaaactattt

SEQ ID NO: 212273 - DNA, 75 bp, Artificial Sequence
  Synthetic
gcctcggcctcctgtatatataaaaaaaagggaaggctggatggctgccagccaagcatgagctcatacctaggg

SEQ ID NO: 212274 - DNA, 75 bp, Artificial Sequence
  Synthetic
attccaccaggattcccattcatctgttccataggttggcacctaaaaacaaaaaattaagtttattgtaaaaaa

SEQ ID NO: 212275 - DNA, 75 bp, Artificial Sequence
  Synthetic
cccaggcattttggaatcttgttagagatgatttgccatctttaacatctcaggaaattcaaagaagaacccaaa

SEQ ID NO: 212276 - DNA, 75 bp, Artificial Sequence
  Synthetic
ggaaatatactaatgtgggaggctgtgaccttaaaaactgaggttataggggtgacaactttgatgaatgtgcac

SEQ ID NO: 212277 - DNA, 75 bp, Artificial Sequence
  Synthetic
taacaggaggagaaaatgttcctccagttcttcatataacaaacactgccacaacagtgctgcttgatgaatttg

SEQ ID NO: 212278 - DNA, 75 bp, Artificial Sequence
  Synthetic
gccccaaaaattaagtccattttatcaagcaaaaaattaaacctttcaactaacatttcttctctggtcatatgg

SEQ ID NO: 212279 - DNA, 75 bp, Artificial Sequence
  Synthetic
gtatggcatggatgctcagatagaggaggttagagtttttgaggggacagagcaacttccaggggacccagatat

SEQ ID NO: 212280 - DNA, 75 bp, Artificial Sequence
  Synthetic
gttttcctgaaagtctaagtacatgcccataagcaagaaaacatcctcacacttggtgtccaaagcatactgtgt

SEQ ID NO: 212281 - DNA, 75 bp, Artificial Sequence
  Synthetic
gttctaggcactgaatattcattcatggttacaattccaggtggaaacacctgtgttcttttattttggtgtttt

SEQ ID NO: 212282 - DNA, 75 bp, Artificial Sequence
  Synthetic
tgggcattataatagtgcttttcatgatggttaaagtgatttggctgatcctttttttcacattttttgcattgc

SEQ ID NO: 212283 - DNA, 75 bp, Artificial Sequence
  Synthetic
caaaatgccctgcaaaacaaagattgtggtttaccttaaagctttagatccctgtagggggtatctccaagaacc

SEQ ID NO: 212284 - DNA, 75 bp, Artificial Sequence
  Synthetic
accagctgaaagcagctcatgacaatggtgcaggcaccagctttcacagccaagcatgagctcatacctagtaaa

SEQ ID NO: 212285 - DNA, 75 bp, Artificial Sequence
  Synthetic
atggttcttcgccagctgtcacgtaaggcttctgtgaaagttagtaaaacctggagtggaactaaaaaaagagct

SEQ ID NO: 212286 - DNA, 75 bp, Artificial Sequence
  Synthetic
taatgtttttttttgtgttttcaggttcatgggtgccgcacttgcacttttgggggacctagttgctactgtttc

SEQ ID NO: 212287 - DNA, 75 bp, Artificial Sequence
  Synthetic
cacttctcattaaatgtattccaccaggattcccattcatctgttccataggttggcacctaaaaacaaaaaatt

SEQ ID NO: 212288 - DNA, 75 bp, Artificial Sequence
  Synthetic
aacatatgctgtaattactggagctccgggggctgtagctgggtttgctgcattggttcaaactgtaactggtgg

SEQ ID NO: 212289 - DNA, 75 bp, Artificial Sequence
  Synthetic
gcctcggcctcctgtatatataaaaaaaagggaaggtagggaggagctggctaaaatgagctcatacctagggag

SEQ ID NO: 212290 - DNA, 75 bp, Artificial Sequence
  Synthetic
aaaagggaaggtagggaggagctggctaaaatgagctcatacctagggagccaaccagctgacagccagagggag

SEQ ID NO: 212291 - DNA, 75 bp, Artificial Sequence
  Synthetic
ttttagcatgcacattaaacaggggcaatgcactgaaggattagtggcacaattaggccattccttgcaataaag

SEQ ID NO: 212292 - DNA, 75 bp, Artificial Sequence
  Synthetic
tagtgattttctcaggtaggcctttggtctaaaatctatttgccttacaaatctggcctgtaaagttctaggcac

SEQ ID NO: 212293 - DNA, 75 bp, Artificial Sequence
  Synthetic
ccctggctgcatgccactggcagttatataagggagccctggctgcatgccactggcagttatataatcacaagt

SEQ ID NO: 212294 - DNA, 75 bp, Artificial Sequence
  Synthetic
tccccacctttatcagggtggagttctttgcattttttcagataagcttttctcatgacaggaatgttcccccat

SEQ ID NO: 212295 - DNA, 75 bp, Artificial Sequence
  Synthetic
gaaagtgactccccaaataaggacatgcttccttgttacagtgtggccagaattccactacccaatctaaatgag

SEQ ID NO: 212296 - DNA, 75 bp, Artificial Sequence
  Synthetic
agcaaagtcataccactttgcaaaatccttttttctagtaaatattcagagcagcttagtgattttctcaggtag

SEQ ID NO: 212297 - DNA, 75 bp, Artificial Sequence
  Synthetic
catgcttccttgttacagtgtggccagaattccactacccaatctaaatgaggatctaacctgtggaaatatact

SEQ ID NO: 212298 - DNA, 75 bp, Artificial Sequence
  Synthetic
atgaatgtgcactctaatggtcaagcaactcatgacaatggtgcaggaaagccagtgcagggcaccagctttcat

SEQ ID NO: 212299 - DNA, 75 bp, Artificial Sequence
  Synthetic
accttaaaaactgaggttataggggtgacaactttgatgaatgtgcactctaatggtcaagcaactcatgacaat

SEQ ID NO: 212300 - DNA, 75 bp, Artificial Sequence
  Synthetic
gccagtgcagggcaccagctttcattttttttctgttgggggggaggctttagaattacagggggtggtttttaa

SEQ ID NO: 212301 - DNA, 75 bp, Artificial Sequence
  Synthetic
tgcaatctcaagtaatgaacacagagcacaaggcgtacctagataagaacaaagcatatcctgttgaatgttggg

SEQ ID NO: 212302 - DNA, 75 bp, Artificial Sequence
  Synthetic
cacaagatattttgggacactaacaggaggagaaaatgttcctccagttcttcatataacaaacactgccacaac

SEQ ID NO: 212303 - DNA, 75 bp, Artificial Sequence
  Synthetic
cctagagttgatgggcagcctatgtatggcatggatgctcaggtagaggaggttagagtttttgaggggacagag

SEQ ID NO: 212304 - DNA, 75 bp, Artificial Sequence
  Synthetic
tcccagcagtggagaggactgtccagatattttaaggttcagctaagaaaaaggagggttaaaaacccctaccca

SEQ ID NO: 212305 - DNA, 75 bp, Artificial Sequence
  Synthetic
accagagggagccctggctgcatgccactggcagttatagtgaaaccactcccatagtccttaatcacaagtaaa

SEQ ID NO: 212306 - DNA, 75 bp, Artificial Sequence
  Synthetic
cattgaaagcctttacagatgtgataggtgcagtgttcctgtgtgtctgcaccagaggcttctgagacctgggaa

SEQ ID NO: 212307 - DNA, 75 bp, Artificial Sequence
  Synthetic
agtataaccagctttacttcaaagttgcagttatttagggggaggggtttttggctttttgaaacattgaaagcc

SEQ ID NO: 212308 - DNA, 75 bp, Artificial Sequence
  Synthetic
tgcagttatttagggggaggggtttttggctttttgaaacattgaaagcctttacagatgtgataagtacactgt

SEQ ID NO: 212309 - DNA, 75 bp, Artificial Sequence
  Synthetic
ctttggttttttgaaacattgaaagcctttacagatgtgaaaagtgcagttttcctgtgtgtctgcaccaaaggc

SEQ ID NO: 212310 - DNA, 75 bp, Artificial Sequence
  Synthetic
aggtggaaacacctgtgttcttttgttttggtgttttctctctaaattaacttttacacttccatctaagtaatc

SEQ ID NO: 212311 - DNA, 75 bp, Artificial Sequence
  Synthetic
taatgactttcccccacagagatcaagtaaagctgcagctaaagtagttttgccactgtctattggccccttgaa

SEQ ID NO: 212312 - DNA, 75 bp, Artificial Sequence
  Synthetic
cataaatgacagtgtccatttgaggcagcaaacaatgaatccaggccaccccagccatatattgctctaaaacag

SEQ ID NO: 212313 - DNA, 75 bp, Artificial Sequence
  Synthetic
aatagccagtatcttttttttggaatgtttaatacaatgcattttagaaagtcataaataacagtgtccatttga

SEQ ID NO: 212314 - DNA, 75 bp, Artificial Sequence
  Synthetic
ttgtttggctgctacagtatcaacagcctgctggcaaatgcttttttgatttttgctatctgcaaaaatttgggc

SEQ ID NO: 212315 - DNA, 75 bp, Artificial Sequence
  Synthetic
ccaaaaccatgtctacttataaaggttacagaatatttttccataagtttcttatataaaatttgagctttttct

SEQ ID NO: 212316 - DNA, 75 bp, Artificial Sequence
  Synthetic
accagctgacagccagagggaacaaagcacaagggatgagctcatacctagggagccaaccagctgacagccaga

SEQ ID NO: 212317 - DNA, 75 bp, Artificial Sequence
  Synthetic
tcatcactggcaaacatttcttcatggcaaaacaggtcttcatcccacttctcattaaatgtattccaccaggat

SEQ ID NO: 212318 - DNA, 75 bp, Artificial Sequence
  Synthetic
ggcaaaacaggtcttcatcccacttctcattaaatgtattccaccaggattcccattcatctgttccataggttg

SEQ ID NO: 212319 - DNA, 75 bp, Artificial Sequence
  Synthetic
gtaaagttctaggcactgaatattcattcatggttacaattccaggtggaaacacctgtgttcttttgttttggt

SEQ ID NO: 212320 - DNA, 75 bp, Artificial Sequence
  Synthetic
acgggaaaaaaagacagaaacacagtggtttgactcagcagacatacagtgctttgcctgaaccaaaagctacat

SEQ ID NO: 212321 - DNA, 75 bp, Artificial Sequence
  Synthetic
tcccattcatctgttccataggttggcacctaaaaacaaaaaattaagtttattgtaaaaaacaaaatgccctgc

SEQ ID NO: 212322 - DNA, 75 bp, Artificial Sequence
  Synthetic
tttattgtaaaaaacaaaatgccctgcaaaagaaaaatagtggtttaccttaaagctttagatccctgtaggggg

SEQ ID NO: 212323 - DNA, 75 bp, Artificial Sequence
  Synthetic
tcattctcttcattttgtcttcgtccccacctttatcagggtgaagttctttgcattttttcagataagcttttc

SEQ ID NO: 212324 - DNA, 75 bp, Artificial Sequence
  Synthetic
agatctatcaaggcctaataaatccatgagctccatggattcctccctattcagcactttgtccatttttgcttt

SEQ ID NO: 212325 - DNA, 75 bp, Artificial Sequence
  Synthetic
gggaaaaacaagggaatttccctggcctcctaaaaagcctccacgcccttactacttctgagtaagcttggaggc

SEQ ID NO: 212326 - DNA, 75 bp, Artificial Sequence
  Synthetic
aacattgaaagcctttacagatgtgataagtgcagtgttcctgtgtgtctgcaccagaggcttctgagacctggg

SEQ ID NO: 212327 - DNA, 75 bp, Artificial Sequence
  Synthetic
taaacaaagcacaaaagcatgagctcatacctagggagccaaccagctgacagccttaatcacaagtaaacaaag

SEQ ID NO: 212328 - DNA, 75 bp, Artificial Sequence
  Synthetic
cataagcctttattgtaatatgcagtacattttaataaagtataaccagctttactttacagttgcacttatttt

SEQ ID NO: 212329 - DNA, 75 bp, Artificial Sequence
  Synthetic
gcctcggcctcctgtatatataaaaaaaagggaaggtagggaggagctggctaaaactgcttggctgccagccaa

SEQ ID NO: 212330 - DNA, 75 bp, Artificial Sequence
  Synthetic
gatatagattttttgctgactgggatcataaagtttcaacagttgggctttttcagcagccagctatggctttac

SEQ ID NO: 212331 - DNA, 75 bp, Artificial Sequence
  Synthetic
atgtttgtggcatgtttactaacagatctggttcccagcagtggagaggactgtccagatattttaaggttcagc

SEQ ID NO: 212332 - DNA, 75 bp, Artificial Sequence
  Synthetic
aggaatgttcccccatgcagacctatcaaggcctaataaatccataagctccatggattcctccctattcagcac

SEQ ID NO: 212333 - DNA, 75 bp, Artificial Sequence
  Synthetic
tcatgacaatggtgcaggaaagccagtgcagggcaccagctttcattttttttctgttgggggggaggctttaga

SEQ ID NO: 212334 - DNA, 75 bp, Artificial Sequence
  Synthetic
actcatgtgggaggctgtgaccttaaaaactgaggttataggggtgacaagtttgatgaatgtgcactctaatgg

SEQ ID NO: 212335 - DNA, 75 bp, Artificial Sequence
  Synthetic
agaacaaagcatatcctgttgaatgttgggttcctgatcccaccagaaatgaaaacacaagatattttgggacac

SEQ ID NO: 212336 - DNA, 75 bp, Artificial Sequence
  Synthetic
gtgttgggccactttgcaaaggtgacaacttatacttgtcagctgttgatgtctgtggcatgtttactaacaggt

SEQ ID NO: 212337 - DNA, 75 bp, Artificial Sequence
  Synthetic
ctccagatattttaaggttcagctaaggaaaaggagggttaaaaacccctacccaatttctttccttcttactga

SEQ ID NO: 212338 - DNA, 75 bp, Artificial Sequence
  Synthetic
tttgcaaaggtgacaacttgtatttgtcagctgttgatgtttgtggcatgtttactaacagatctggttcccagc

SEQ ID NO: 212339 - DNA, 75 bp, Artificial Sequence
  Synthetic
tggatgctcaagtagaggaggttagagtttttgagggaacagaggagcttccaggggacccagacatgatgagat

SEQ ID NO: 212340 - DNA, 75 bp, Artificial Sequence
  Synthetic
agaagaacccaaaaactatttgttgaaaatttagcaaggtttttggaagaaactacttgggcaatagttaattca

SEQ ID NO: 212341 - DNA, 75 bp, Artificial Sequence
  Synthetic
caacaggtctggttcccagcagtggagaggactctctagatattttaaggttcagctaaggaaaagaagagttaa

SEQ ID NO: 212342 - DNA, 75 bp, Artificial Sequence
  Synthetic
atctttctaatggcatattaacatttaatgacttccccccacagagatcaagtaaagctgcagctaaagtagttt

SEQ ID NO: 212343 - DNA, 75 bp, Artificial Sequence
  Synthetic
aaagtcataccactttgcaaaatccttttttctagcaaatactcagagcagcttagtgattttctcaggtaggcc

SEQ ID NO: 212344 - DNA, 75 bp, Artificial Sequence
  Synthetic
ccaaccagctgacagccagagggagccctggctgcatgccactggcagttatagtgaaacccctcccatagtcct

SEQ ID NO: 212345 - DNA, 75 bp, Artificial Sequence
  Synthetic
cattgccatgtgccccaaaaatcaagtccattttatcaagcaaaaaattaaacctttcaactaacatttcttctc

SEQ ID NO: 212346 - DNA, 75 bp, Artificial Sequence
  Synthetic
tttagctttttgcagcaaaaaattactgcaaaaaagggaaaaacaagggaatttccctggcctcctaaaaagcct

SEQ ID NO: 212347 - DNA, 75 bp, Artificial Sequence
  Synthetic
aggtagggaggagctggctaaaactggatggctgccagccaagcatgagctcatacctagggagccaaccagctg

SEQ ID NO: 212348 - DNA, 75 bp, Artificial Sequence
  Synthetic
taacctgtggaaatatactgatgtgggaggctgtgaccctaaaaactgaggttataggggtgacaactttgatga

SEQ ID NO: 212349 - DNA, 75 bp, Artificial Sequence
  Synthetic
gcctcggcctcctgtatatataaaaaaaagggaaggtagggaggagctggcaaactggatggctgccagccaagc

SEQ ID NO: 212350 - DNA, 75 bp, Artificial Sequence
  Synthetic
agggagccaaccagcgagctggctaaaactggatggctgccagccaagcatgagctcatacctagggagccaacc

SEQ ID NO: 212351 - DNA, 75 bp, Artificial Sequence
  Synthetic
ccagacatgatgagatatgttgacagatatggacagttgcagacaaagatgctgtaatcaaaagcctttattgta

SEQ ID NO: 212352 - DNA, 75 bp, Artificial Sequence
  Synthetic
gcttagtttcttctggttcttctgggttaaagtcatgctccttaaggcccccctgaatactttcttccactactg

SEQ ID NO: 212353 - DNA, 75 bp, Artificial Sequence
  Synthetic
aaactggatggctgccagccaagcatgagctcatacctagggagccaaccagctgacccttaatcacaagtaaac

SEQ ID NO: 212354 - DNA, 75 bp, Artificial Sequence
  Synthetic
aaagcacaatgttttggcttgtcaccagctggccatggttcttcgccagctgtcacgtaaggcttctgtgaaagt

SEQ ID NO: 212355 - DNA, 75 bp, Artificial Sequence
  Synthetic
ttcctgtgtgtctgcaccagaggcttctgagacctgggaaaagcattgtgattgtgattcagtgcttgatccatg

SEQ ID NO: 212356 - DNA, 75 bp, Artificial Sequence
  Synthetic
taaccagctttactcttacagttgcagttattttgggggaggagtttttggttttttgaaacattgaaagccttt

SEQ ID NO: 212357 - DNA, 75 bp, Artificial Sequence
  Synthetic
ttttctcatgacaggaatgttcccccatgcagacctatcaaggcctaataaatccataagctccatggattcctc

SEQ ID NO: 212358 - DNA, 75 bp, Artificial Sequence
  Synthetic
acaaagcacaaggggaagtggaaagcagccaggggaacatgttttgcgagccagagctgttttggcttgtcacca

SEQ ID NO: 212359 - DNA, 75 bp, Artificial Sequence
  Synthetic
aaaaaagggaaaaacaagggaatttccctggcctcctaaaaagcctccacgcccttactacttctgagtaagctt

SEQ ID NO: 212360 - DNA, 75 bp, Artificial Sequence
  Synthetic
aaaaaacaaaatattatgacccccaaaaccatgtctacttataaaggttacagaatatttttccataagtttctt

SEQ ID NO: 212361 - DNA, 75 bp, Artificial Sequence
  Synthetic
tgtcaccagctggccatggttcttcgccagctgtcacgtaaggcttctgtgaaagttagtaaaacctggagtgga

SEQ ID NO: 212362 - DNA, 75 bp, Artificial Sequence
  Synthetic
ggaaatatactaatgtgggaggctgtaaccttaaaaactgaggtcataggggtgacaactttgatgaatgtgcac

SEQ ID NO: 212363 - DNA, 75 bp, Artificial Sequence
  Synthetic
acttggtgtccaaagcatactgtgtaactaatttccatgaaacctgcttagtttcttctggctcttctgggttaa

SEQ ID NO: 212364 - DNA, 75 bp, Artificial Sequence
  Synthetic
ccccatgcagatctatcaaggcctaataaatccataagctccatggattcctccctattcagcactttgtccatt

SEQ ID NO: 212365 - DNA, 75 bp, Artificial Sequence
  Synthetic
aagtattgcaccaggaggtgcaaatcaaagatctgctcctcaatggatgttgcctttacttttagggttgtacgg

SEQ ID NO: 212366 - DNA, 75 bp, Artificial Sequence
  Synthetic
taacttttacacttccatctaagtaatctcttaagcaatcaaggttgtttatgccatgccctgaaggtaaatccc

SEQ ID NO: 212367 - DNA, 75 bp, Artificial Sequence
  Synthetic
ttaatctttctaatggcatattaacatttaatgactttcccccacagagatcaagtaaagcagcagctaaagtag

SEQ ID NO: 212368 - DNA, 75 bp, Artificial Sequence
  Synthetic
ctctggtcatatggatgctgtcaaccctttgtttggctgctacagtatcaacagcctgctggcaaatgctttttt

SEQ ID NO: 212369 - DNA, 75 bp, Artificial Sequence
  Synthetic
ggttgactcaattacagaggtagaatgctttttaactccagaaatgggtgacccagatgagcatcttaggggttt

SEQ ID NO: 212370 - DNA, 75 bp, Artificial Sequence
  Synthetic
tcttttgtggtatacacagcaaaagaagcaacagttctattactaaacacagcttgactgaggaaggcatgcaga

SEQ ID NO: 212371 - DNA, 75 bp, Artificial Sequence
  Synthetic
tactgtagaggggattacaagtacctctgaggctatagctgcaataggccttactcctgaaacatatgctgtaat

SEQ ID NO: 212372 - DNA, 75 bp, Artificial Sequence
  Synthetic
gcctcggcctcctgtatatataaaaaaaagggaaggtagggaggagctggctaaaacaaagcacaaactggatgg

SEQ ID NO: 212373 - DNA, 75 bp, Artificial Sequence
  Synthetic
agtttattgtaaaaaacaaaataccctgcaaaagaaaaattagtggtttaccttaaagctttagatccctgtagg

SEQ ID NO: 212374 - DNA, 75 bp, Artificial Sequence
  Synthetic
ctagggagccaaccagctgacagcaaacaaagcacaaggggaactagggagccaaccagctgacagcaaacaaag

SEQ ID NO: 212375 - DNA, 75 bp, Artificial Sequence
  Synthetic
aggctttagaattacagggggtggtttttaattacagaacaaagtacccagatggaacaatttttccaaagaatg

SEQ ID NO: 212376 - DNA, 75 bp, Artificial Sequence
  Synthetic
cacaaactggatggctgccagccaagcatgagctcatacctagggagccaaccagctgacagcaaacaaagcaca

SEQ ID NO: 212377 - DNA, 75 bp, Artificial Sequence
  Synthetic
ggctttttcagcagccagctatggctttacagttatttaatccagaagactactatgatattttatttcctggag

SEQ ID NO: 212378 - DNA, 75 bp, Artificial Sequence
  Synthetic
tcaagaatgggtctccccataccaacattagctttcatagtagaaaatgtatacatgcttatttctaaatccagc

SEQ ID NO: 212379 - DNA, 75 bp, Artificial Sequence
  Synthetic
tttggaagaaactacttgggcaatagttaattcaccagttaacttatataattatatttcagactattattctag

SEQ ID NO: 212380 - DNA, 75 bp, Artificial Sequence
  Synthetic
tgtttgtggaatgtttactaacagatctggttcccagcagtggagaggactgtccagatattttaaggttcagct

SEQ ID NO: 212381 - DNA, 75 bp, Artificial Sequence
  Synthetic
agttgatgggcagcctatgtatggtatggatgctcaggtagaggaggttagagtttttgaggggacagaggaact

SEQ ID NO: 212382 - DNA, 75 bp, Artificial Sequence
  Synthetic
aaacccctacccaatttctttccttcttactgacttaattaacagaaggacccctagagttgatgggcagcctat

SEQ ID NO: 212383 - DNA, 75 bp, Artificial Sequence
  Synthetic
ctaaaactggatggctgccagccaagcatgagctcatacctagggagccaaccagctgacagcaatcacaagtaa

SEQ ID NO: 212384 - DNA, 75 bp, Artificial Sequence
  Synthetic
gcctttattgtaatatgcagtacattttaataaagtataaccagctttactttacagttgcagttattttggggg

SEQ ID NO: 212385 - DNA, 75 bp, Artificial Sequence
  Synthetic
ctaagtacatgcccataagcaaaaaaacatcctcacacttggtttccaaggcatactgtgtaactaatttccatg

SEQ ID NO: 212386 - DNA, 75 bp, Artificial Sequence
  Synthetic
acacctttacaaattaaaaaactaaaggtacacagtttttgacagtaattattaattgctgaaactctatgtcta

SEQ ID NO: 212387 - DNA, 75 bp, Artificial Sequence
  Synthetic
ctaaaactggatggctgccagccaagcatgagctcatacctagggagccaaccagctgacagtcacaagtaaaca

SEQ ID NO: 212388 - DNA, 75 bp, Artificial Sequence
  Synthetic
gctgtaatcaaaagcctttattgtaatatgcagtacattttaataaagtataaccagctttactttacagttgca

SEQ ID NO: 212389 - DNA, 75 bp, Artificial Sequence
  Synthetic
atatgcagtacattttaataaagtataaccagctttactttacagttgcagtcattttgggggaggggtttttgg

SEQ ID NO: 212390 - DNA, 75 bp, Artificial Sequence
  Synthetic
atatttcagactattattctagattgtctccagttaggccctctatggtaaggcaagttgcccaaagggagggaa

SEQ ID NO: 212391 - DNA, 75 bp, Artificial Sequence
  Synthetic
atttggtgttgggccactttgcaaaggtgacaacttgtatttgtcagctgttgatgtttgtggcatgtttactaa

SEQ ID NO: 212392 - DNA, 75 bp, Artificial Sequence
  Synthetic
tcatcccacttctcattaaatgtattccaccaggattcccattcatctgttccataggttggcacctaaaaaaaa

SEQ ID NO: 212393 - DNA, 75 bp, Artificial Sequence
  Synthetic
ttgcagacaaagatgctgtaatcaaaggcctttattgtaatatgcagtacattttaataaagtataaccagcttt

SEQ ID NO: 212394 - DNA, 75 bp, Artificial Sequence
  Synthetic
aaacagcattgccatgtgccccaaaaattaagtccattttatcaagcaaaaaattaaacctttcaactaacattt

SEQ ID NO: 212395 - DNA, 75 bp, Artificial Sequence
  Synthetic
ttagtaagtcaatatctatatcagatacatttgaaagtgactccccaaataaggacatgcttccttgttacagtg

SEQ ID NO: 212396 - DNA, 75 bp, Artificial Sequence
  Synthetic
cagggaagccagtgcagggcaccagctttcattttttttctgttgggggggaggctttagaattacagggggtgg

SEQ ID NO: 212397 - DNA, 75 bp, Artificial Sequence
  Synthetic
atgaattgcagctgcaaagtcagcaactggcctaaaccagattaaaagcaaaagcaaagtcatgccactttgcaa

SEQ ID NO: 212398 - DNA, 75 bp, Artificial Sequence
  Synthetic
agagtttttgagggaacagaggagcttccaggggacccagacatgatgagatacgttgacagatatggacagttg

SEQ ID NO: 212399 - DNA, 75 bp, Artificial Sequence
  Synthetic
tgtatatataaaaaaaagggaaggtagggaggagctggctaaaactggatggctgccagccaagcatgagctcat

SEQ ID NO: 212400 - DNA, 75 bp, Artificial Sequence
  Synthetic
tgtcaaccctttgtttggctgctacagtatcaacagcctgctggcaaatgcttttttgatttttgctgtctgcaa

SEQ ID NO: 212401 - DNA, 75 bp, Artificial Sequence
  Synthetic
ttaattgctgaaactctatgtctatgtggtgttaagaaaaacaaaatattatgacccccaaaaccatgtctactt

SEQ ID NO: 212402 - DNA, 75 bp, Artificial Sequence
  Synthetic
ctatgatattttatttcctggagtgaatgcctttgttaacaatattcactatttagatcctagacattggggccc

SEQ ID NO: 212403 - DNA, 75 bp, Artificial Sequence
  Synthetic
cctagagttgatgggcagcctatgtatggcatggatgctcaagtagaggaggttagagtttttgaggggacagag

SEQ ID NO: 212404 - DNA, 75 bp, Artificial Sequence
  Synthetic
gtcttcgtccccacctttatcagggtgaagttctttgcattttttcagataagcttttctcatgacaggaatgtt

SEQ ID NO: 212405 - DNA, 75 bp, Artificial Sequence
  Synthetic
cctacccaatttctttccttcttactgatttaattaacagaaggacccctagagttgatgggcagcctatgtatg

SEQ ID NO: 212406 - DNA, 75 bp, Artificial Sequence
  Synthetic
tgatttaattaacagaaggacccctagagttgatgggcagcctatgtatggcatggatgctcaaatagaggaggt

SEQ ID NO: 212407 - DNA, 75 bp, Artificial Sequence
  Synthetic
gcagacaaagatgctgtaatcaaaagcctttattgtaatatgcagtacatttcaataaagtataaccagctttac

SEQ ID NO: 212408 - DNA, 75 bp, Artificial Sequence
  Synthetic
cattgtgattgagattcagtgcttgatccatgtccagagtcttctgcttcagaatcttcctctctaggaaagtca

SEQ ID NO: 212409 - DNA, 75 bp, Artificial Sequence
  Synthetic
aagtaatctcttaggcaatcaaggttgcttatgccatgtcctgaaggtaaatcccttgactctgcaccagtgcct

SEQ ID NO: 212410 - DNA, 75 bp, Artificial Sequence
  Synthetic
aaagtttaatctttctaatggcatattaacatttaatgactttcccccacagagatcaagtaaagctgcagctaa

SEQ ID NO: 212411 - DNA, 75 bp, Artificial Sequence
  Synthetic
tccaaagcatactgtgtaactaatttccatgaaacctgcttagtttcttctggttcttctgggttaaagtcatgc

SEQ ID NO: 212412 - DNA, 75 bp, Artificial Sequence
  Synthetic
aaagcacaaggggaagtggaaagcagccagcatgttttgcgagccagagctgttttggcttgtcaccagctggcc

SEQ ID NO: 212413 - DNA, 75 bp, Artificial Sequence
  Synthetic
attcccactcatctgttccataggttggcacctacaaaaaaaaaattaagtttattgtaaaaaacaaaatgccct

SEQ ID NO: 212414 - DNA, 75 bp, Artificial Sequence
  Synthetic
atcctttttttcacattttttgcattgcagtgggttttcctgaaagtctaagtacatgcccataagcaagaaaac

SEQ ID NO: 212415 - DNA, 75 bp, Artificial Sequence
  Synthetic
ttgtctgaagcaatcaaagcaatagcaatctatccacacaagtgggctgcttcttaaaaattttctgtttctatg

SEQ ID NO: 212416 - DNA, 75 bp, Artificial Sequence
  Synthetic
gccctggctgcatgccactggcagttatagtgaaacccctcccatagtccttaatcacaagtaaacaaagcacaa

SEQ ID NO: 212417 - DNA, 75 bp, Artificial Sequence
  Synthetic
agtggaaagcagccaagggaacatgttttgcgagccagagctgttttggcttgtcaccagctggccatggttctt

SEQ ID NO: 212418 - DNA, 75 bp, Artificial Sequence
  Synthetic
atgtttactaacagatctggttcccagcagtggagaggcctgtccagatattttaaggttcagctaagaaagagg

SEQ ID NO: 212419 - DNA, 75 bp, Artificial Sequence
  Synthetic
tgccctgcaaaagaaaaattgtggtttaccttaaagctttagatccctgtagggggtgtctccaagaaccttctc

SEQ ID NO: 212420 - DNA, 75 bp, Artificial Sequence
  Synthetic
atgcactgaaggattagtggcacaattaggccattccttgcaataaagagtatcagaattaggaggaaaatcaca

SEQ ID NO: 212421 - DNA, 75 bp, Artificial Sequence
  Synthetic
acattttttgcattgctgtgggttttcctgaaagtctaagtacatgcccataagcaagaaaacatcctcacactt

SEQ ID NO: 212422 - DNA, 75 bp, Artificial Sequence
  Synthetic
tggaaatatactcatgtgggaggctgtgaccttaaaaactgaggttataggggtgacaagtttgatgaatgtgca

SEQ ID NO: 212423 - DNA, 75 bp, Artificial Sequence
  Synthetic
gcctcggcctcctgtatatataaaaaaaagggaaggtagggaggagctggctggctgccagccaagcatgagctc

SEQ ID NO: 212424 - DNA, 75 bp, Artificial Sequence
  Synthetic
ctaaaactggatggctgccagccaagcatgagctcatacctagggagccaaccagctgaccctggctgcatgcca

SEQ ID NO: 212425 - DNA, 75 bp, Artificial Sequence
  Synthetic
accagctgaccctggctgcatgccactggcagttaaacaaagcacaaggggaagtggaaagcagccaagggaccg

SEQ ID NO: 212426 - DNA, 75 bp, Artificial Sequence
  Synthetic
gtaaaacctggagtggaactaaaaaaagagctcaaaggattttaatttttttgttagaatttttgctggattttt

SEQ ID NO: 212427 - DNA, 75 bp, Artificial Sequence
  Synthetic
atgttttgcgagccagagctgttttggcttgtcaccagctggccatggttcttcgccagctgtcacgtaaggctt

SEQ ID NO: 212428 - DNA, 75 bp, Artificial Sequence
  Synthetic
cacaaggggaagggaggagctggctaaaactggatggctgccagccaagcatgagctcatattaatcacaagtaa

SEQ ID NO: 212429 - DNA, 75 bp, Artificial Sequence
  Synthetic
aaaactggatggctgccagccaagcatgagctcatattaatcacaagtaaacaaagcacaaggggaagggaggag

SEQ ID NO: 212430 - DNA, 75 bp, Artificial Sequence
  Synthetic
ctggctaaaactggatggctgccagccaagcatgagctcatacaccactcccatagtccttaatcacaagtaaac

SEQ ID NO: 212431 - DNA, 75 bp, Artificial Sequence
  Synthetic
tagctgggtttgctgcattggttcaaactgtaactggtggtagtgctattgctcagttgggatatagattttttg

SEQ ID NO: 212432 - DNA, 75 bp, Artificial Sequence
  Synthetic
attcactatttagatcctagacattggggcccttctttgttctccacaatctcccaggctttttggaatcttgtt

SEQ ID NO: 212433 - DNA, 75 bp, Artificial Sequence
  Synthetic
cagttgcagacaaagatgctgtaataaaaagcctttattgtaatctgcagtacatttcaataaagtataaccagc

SEQ ID NO: 212434 - DNA, 75 bp, Artificial Sequence
  Synthetic
gttacagggggtggtttttaattacagaactaagtacccagatggaccaatttttccaaagaatgcaacagggca

SEQ ID NO: 212435 - DNA, 75 bp, Artificial Sequence
  Synthetic
ctatggtaaggcaggttgcccaaagggagggaacctatatttcctttggccactcatacacccaaagtatagatg

SEQ ID NO: 212436 - DNA, 75 bp, Artificial Sequence
  Synthetic
agaactaagtacccagatggaccaatttttccaaagaatgcaacagggcaatctcaagtaatgaacccagagccc

SEQ ID NO: 212437 - DNA, 75 bp, Artificial Sequence
  Synthetic
gtttaatacaatgcattttaagaactcataaatgactgtgtccatttgaggcagcaaacagtgaatccaggccac

SEQ ID NO: 212438 - DNA, 75 bp, Artificial Sequence
  Synthetic
ctgaatattcattcatggttacaattccaggtggaaacacctgtgttcttttgttttggtgttttctctctaaat

SEQ ID NO: 212439 - DNA, 75 bp, Artificial Sequence
  Synthetic
ctttacagatgtgataagtgcagtgttcctgtgtgtctgcaccagaggcttctgagacctgggaaaagcattgtg

SEQ ID NO: 212440 - DNA, 75 bp, Artificial Sequence
  Synthetic
aatttttgctggacttttgcacaggtgaagacagtgtagacgggaaaaaaagacagaaacacagtggtttgactg

SEQ ID NO: 212441 - DNA, 75 bp, Artificial Sequence
  Synthetic
cttcatataacaaacactgccacaacagtgctgcttgatgaatttggtgttgggccactttgcaaaggtgacaac

SEQ ID NO: 212442 - DNA, 75 bp, Artificial Sequence
  Synthetic
agaggaacttccaggggacccagacatgatgagatatgttgacagatatggacagttgcagacaaagatgctgta

SEQ ID NO: 212443 - DNA, 75 bp, Artificial Sequence
  Synthetic
atgatgagatatgttgacagatatggacagttgcagacaaagatgctgtaatcaaaagcctttattgtaatatgc

SEQ ID NO: 212444 - DNA, 75 bp, Artificial Sequence
  Synthetic
gacagttgcagacaaagatgctgtaatcaaaagcctttattgtaatatgcagtacattttaataaagtataacca

SEQ ID NO: 212445 - DNA, 75 bp, Artificial Sequence
  Synthetic
cccacagagatcaagtaaagctgcagctaaagtagttttaccactgtctattggccccttgaatagccagtacct

SEQ ID NO: 212446 - DNA, 75 bp, Artificial Sequence
  Synthetic
tgcccaaagggagggaacctatatttcctttggccactcatacacccaaagtatagatgatgcagacagcattca

SEQ ID NO: 212447 - DNA, 75 bp, Artificial Sequence
  Synthetic
ggcacaattaggccattccttgcaataaagggtatcagaattaggaggaaaatcacaaccaacctctgaactatt

SEQ ID NO: 212448 - DNA, 75 bp, Artificial Sequence
  Synthetic
ggggacagagcaacttccaggggacccagatatgatgagatatgttgacagatatggacagttgcagacaaaaat

SEQ ID NO: 212449 - DNA, 75 bp, Artificial Sequence
  Synthetic
ttcacacctttacaaattaaaaaactaaaggtacatagtttttgacagtagttattaattgctgaaactctatgt

SEQ ID NO: 212450 - DNA, 75 bp, Artificial Sequence
  Synthetic
ccatatattgctctaaaacagcattgccatgtgccccaaaaatcaagtccattttatcaagcaaaaaattaaacc

SEQ ID NO: 212451 - DNA, 75 bp, Artificial Sequence
  Synthetic
tttcaactaacatttcttctctggtcatatggatactgtcaaccctttgtttggctgctacagtatcaacagcct

SEQ ID NO: 212452 - DNA, 75 bp, Artificial Sequence
  Synthetic
gcacaaggaagtggaaagcagccaggggaacatgttttgcgagccagagctgttttggcttgtcaccagctggcc

SEQ ID NO: 212453 - DNA, 75 bp, Artificial Sequence
  Synthetic
agtgatttggctgatcctttttttcacattttttgcattgcagtgggttttcctgaaagtctaagtacatgccca

SEQ ID NO: 212454 - DNA, 75 bp, Artificial Sequence
  Synthetic
attcatctgttccataggttggcactaaaaacaaaaaattaagtttattgtaaaaaacaaagtgccctgcaaaaa

SEQ ID NO: 212455 - DNA, 75 bp, Artificial Sequence
  Synthetic
gcatgagctcatacctagggagccaaccagctgacagccagagaatagtccttaatcacaagggagccaaccagc

SEQ ID NO: 212456 - DNA, 75 bp, Artificial Sequence
  Synthetic
gtattccttattcacacctttacaaattaaaaaactaaaggtacatagtttttgacagtaattattaattgctga

SEQ ID NO: 212457 - DNA, 75 bp, Artificial Sequence
  Synthetic
attacagaacaaagtacccagatggaacaatttttccaaagaatgcaacagtgcaatctcaagtcatgaacacag

SEQ ID NO: 212458 - DNA, 75 bp, Artificial Sequence
  Synthetic
tttggttttttgaaacattgaaagcctttacagatgtgataagtgcagtgttcctgtgtgtctgcaccagaggct

SEQ ID NO: 212459 - DNA, 75 bp, Artificial Sequence
  Synthetic
cctaaaaagcctccacgcccttactacttctgagtaagctaggaggcggaggcggcctcggcctcctgtatatat

SEQ ID NO: 212460 - DNA, 75 bp, Artificial Sequence
  Synthetic
tggctgcatgccactggcagttatagtgaaacccctcccatagtccttaatcacaagtaaacacaaggggaagtg

SEQ ID NO: 212461 - DNA, 75 bp, Artificial Sequence
  Synthetic
gtttttaattacagaacaaagtacccagatggaacaatttttccaaagaatgcaacagtgcaatctcaagtaatg

SEQ ID NO: 212462 - DNA, 75 bp, Artificial Sequence
  Synthetic
aggagctggctaaaactggatggctgccagccaagcatgagctcatacctagggagccaaccagctgacagccag

SEQ ID NO: 212463 - DNA, 75 bp, Artificial Sequence
  Synthetic
cacaagtaaacaaagcacagctggctaaaactggatggctgccagccaagcatgagctcataatagtccttaatc

SEQ ID NO: 212464 - DNA, 75 bp, Artificial Sequence
  Synthetic
taaaactggatggctgccagccaagcatgagctcataatagtccttaatcacaagtaaacaaagcacaaggggaa

SEQ ID NO: 212465 - DNA, 75 bp, Artificial Sequence
  Synthetic
gatcctagacattggggcccttccttgttctccacaatctcccaggctttttggaatcttgttagagatgatttg

SEQ ID NO: 212466 - DNA, 75 bp, Artificial Sequence
  Synthetic
tgccgcacttgcacttttgggggacctagttgctactgtttctgaggctgctgctgccacaggattttcagtagc

SEQ ID NO: 212467 - DNA, 75 bp, Artificial Sequence
  Synthetic
cctttctttccactgcacaatcctctcatgaatggcagctgcaaagtcagcaactggcctaaaccagattaaaag

SEQ ID NO: 212468 - DNA, 75 bp, Artificial Sequence
  Synthetic
acagttgggctttttcagcagccagctatggctttacaattatttaatccagaagactactatgatattttattt

SEQ ID NO: 212469 - DNA, 75 bp, Artificial Sequence
  Synthetic
gctgtaatcaaaagcctttattgtaatatgcagtacattttaataaaatataaccagctttactttacagttgca

SEQ ID NO: 212470 - DNA, 75 bp, Artificial Sequence
  Synthetic
atatgcagtacattttaataaaatataaccagctttactttacagttgcagttattttgggggaggggtttttgg

SEQ ID NO: 212471 - DNA, 75 bp, Artificial Sequence
  Synthetic
gcactctaatgggcaagcaactcatgacaatggtgcagggaagccagtgcagggcaccagctttcattttttttc

SEQ ID NO: 212472 - DNA, 75 bp, Artificial Sequence
  Synthetic
tgtttgtggcatgtttactaacagatctggttcccagcagtggagaggactctccagatattttaaggttcagct

SEQ ID NO: 212473 - DNA, 75 bp, Artificial Sequence
  Synthetic
caagtcatgaacacagagcacaaggcgtacctagataagaacaaagcatatcctgttgaatgttgggttcctgat

SEQ ID NO: 212474 - DNA, 75 bp, Artificial Sequence
  Synthetic
agacaaaaatgctgtaatcaaaagcctttattgtaatatgcagtacattttaataaagtataaccagctttactt

SEQ ID NO: 212475 - DNA, 75 bp, Artificial Sequence
  Synthetic
ctttattgtaatatgcagtacattttaataaagtataaccagctttactttacatttgcagttattttgggggag

SEQ ID NO: 212476 - DNA, 75 bp, Artificial Sequence
  Synthetic
aagtatagatgatgcagacagcattcaagaagttacccaaaggctagatttaaaaaccccaaatgtgcaatctgg

SEQ ID NO: 212477 - DNA, 75 bp, Artificial Sequence
  Synthetic
ctatgtatggcatggatgctcaagtagaggaggttagagtttttgagggaacagaggagcttccaggggacccag

SEQ ID NO: 212478 - DNA, 75 bp, Artificial Sequence
  Synthetic
ttttctagtaaatattcagagcagcttagtgattttctcaggtaggccttaggtctaaaatctatttgccttaca

SEQ ID NO: 212479 - DNA, 75 bp, Artificial Sequence
  Synthetic
tagttttgccactgtctattggccccttgaatagccagtaccttttttttggaatgtttaatacaatgcatttta

SEQ ID NO: 212480 - DNA, 75 bp, Artificial Sequence
  Synthetic
aagatgctgtaatgaaaagcctttattgtaatatgcagtacattttaataaagtttaaccagctgtacttaacag

SEQ ID NO: 212481 - DNA, 75 bp, Artificial Sequence
  Synthetic
gcctcggcctcctgtatatataaaaaaaagggaagggatggctgccagccaagcatgagctcatacctagggagc

SEQ ID NO: 212482 - DNA, 75 bp, Artificial Sequence
  Synthetic
aaaagggaagggatggctgccagccaagcatgagctcatacctagggagccaaccagcagaccacaagtaaacaa

SEQ ID NO: 212483 - DNA, 75 bp, Artificial Sequence
  Synthetic
agcacaaggggaccatggttcttcgccagctgcatggctgccagccaagcatgagctcatacctagggagccaac

SEQ ID NO: 212484 - DNA, 75 bp, Artificial Sequence
  Synthetic
acagtgtccatttgaggcagcaagcaatgaatccaggccaccccagccatatattgctctaaaacagcattgcca

SEQ ID NO: 212485 - DNA, 75 bp, Artificial Sequence
  Synthetic
tatggctgtctacacaaggcactgtaaaacaagtattccttattcacacctttacaaattaaaaaactaaaggta

SEQ ID NO: 212486 - DNA, 75 bp, Artificial Sequence
  Synthetic
acccaaaaactatttgttgaaactttagcaaggtttttggaagaaactacttgggcaatagttaattcaccagtt

SEQ ID NO: 212487 - DNA, 75 bp, Artificial Sequence
  Synthetic
ttggccactcatacacccaaagtatagataatgcagacagcattcaagaagttacccaaaggctagatttaaaaa

SEQ ID NO: 212488 - DNA, 75 bp, Artificial Sequence
  Synthetic
gcctcggcctcctgtatatataaaaaaaaggaaggtagggaggagctggctaaaactggatggctgccagccaag

SEQ ID NO: 212489 - DNA, 75 bp, Artificial Sequence
  Synthetic
gggatcctgtgttttcatcatcactggcaaacatttcttcatggcaaaacaggtcttcatcccacttctcattaa

SEQ ID NO: 212490 - DNA, 75 bp, Artificial Sequence
  Synthetic
ctccagaaatgggggacccagatgagcatcttaggggttttagtaagtcaatttctatatcagatacatttgaaa

SEQ ID NO: 212491 - DNA, 75 bp, Artificial Sequence
  Synthetic
tgccagccaagcatgagctcatacctagggagccaaccagctgacagccagagggagccctggctgcctgccact

SEQ ID NO: 212492 - DNA, 75 bp, Artificial Sequence
  Synthetic
agtagaagttctagaagttaaaactggggttgactcaattacagaggtagaatgttttttaactccagaaatggg

SEQ ID NO: 212493 - DNA, 75 bp, Artificial Sequence
  Synthetic
gaagtggaaagcagccaagggaacatgttttgcgagccagagctgttttggcatagtccttaatcacaagtaaac

SEQ ID NO: 212494 - DNA, 75 bp, Artificial Sequence
  Synthetic
agaagtttatctgtgtgaacttcttggcttagtatcgttgagaagaatcgagagattagtgcagtttaaacagtt

SEQ ID NO: 212495 - DNA, 75 bp, Artificial Sequence
  Synthetic
gaccgttggcctcgtcttccttggctgttggggtcaaatcaccctcacaacgtttctgacagccatggttctggc

SEQ ID NO: 212496 - DNA, 75 bp, Artificial Sequence
  Synthetic
tgttggggtcaaatcaccctcacaacgtttctgacagccatggttctggcgacacttcactatgggtacatgctc

SEQ ID NO: 212497 - DNA, 75 bp, Artificial Sequence
  Synthetic
cgtttctgacagccatggttctggcgacacttcactatgggtacatgctccctggatggcaagcagaagcactca

SEQ ID NO: 212498 - DNA, 75 bp, Artificial Sequence
  Synthetic
ctaaaaaaccaggagggcccggaaaaaaccgggccatcaatatgctgaaacgcggattaccccgcgtattcccac

SEQ ID NO: 212499 - DNA, 75 bp, Artificial Sequence
  Synthetic
ggcttagtatcgttgagaagaatcgagagattagtgcagtttaaacagttttttagaacggaagaacaaccatga

SEQ ID NO: 212500 - DNA, 75 bp, Artificial Sequence
  Synthetic
agagattagtgcagtttaaacagttttttagaacggaagaacaaccatgactaaaaaaccaggagggcccggaaa

SEQ ID NO: 212501 - DNA, 75 bp, Artificial Sequence
  Synthetic
gatgcaaaagaaagtcggacaggtgctcctcataggggtaagcgtggcagcgttcctcgtcaaccctaatgtcac

SEQ ID NO: 212502 - DNA, 75 bp, Artificial Sequence
  Synthetic
gggacaatggagccagtgccgtttggaattccaccacagccacgggactctgccatgtcatgcgaggtagctacc

SEQ ID NO: 212503 - DNA, 75 bp, Artificial Sequence
  Synthetic
gaattccaccacagccacgggactctgccatgtcatgcgaggtagctacctggctggaggctccattgcttggac

SEQ ID NO: 212504 - DNA, 75 bp, Artificial Sequence
  Synthetic
ggaaaaactaaatgccatgagcagagaagagttttttaaataccggagagaggccataatcgaggtggaccgcac

SEQ ID NO: 212505 - DNA, 75 bp, Artificial Sequence
  Synthetic
atgttgggtccgagcgatcgacgttggttacatgtgtgaagacaccatcacgtacgaatgtccgaagctagcagt

SEQ ID NO: 212506 - DNA, 75 bp, Artificial Sequence
  Synthetic
tttcgcgaggctcagcaaaactccgttggctcgtggagaaaggatttgtctcgccaataggaaaagtcattgatc

SEQ ID NO: 212507 - DNA, 75 bp, Artificial Sequence
  Synthetic
gaccaggcattccaaacgaagcagaagatccgtttcggtccaaacgcatggggaaagctcactagtgaacaaaaa

SEQ ID NO: 212508 - DNA, 75 bp, Artificial Sequence
  Synthetic
gggaaagctcactagtgaacaaaaaagaggcttggctggattcaacgaaggccacgcgatacctcatgaaaacgg

SEQ ID NO: 212509 - DNA, 75 bp, Artificial Sequence
  Synthetic
gccacgcgatacctcatgaaaacggagaattggatcataaggaaccctggttatgctttcctggcggcggcactt

SEQ ID NO: 212510 - DNA, 75 bp, Artificial Sequence
  Synthetic
ggttggatgcttggcagcaatagtggtcaacgtgtggtgttcaccatcctcctgctgttggtcgctccggcttac

SEQ ID NO: 212511 - DNA, 75 bp, Artificial Sequence
  Synthetic
gcccagtgacaccctgttctgtgacataggggaatcctccccaagtccagaagtagaagaacaacgcacactacg

SEQ ID NO: 212512 - DNA, 75 bp, Artificial Sequence
  Synthetic
ataggggaatcctccccaagtccagaagtagaagaacaacgcacactacgcgtcctagagatgacatctgactgg

SEQ ID NO: 212513 - DNA, 75 bp, Artificial Sequence
  Synthetic
agttttaactgtctgggaatggggaatcgagatttcatagaaggagccagtggagccacttgggtggatctggtg

SEQ ID NO: 212514 - DNA, 75 bp, Artificial Sequence
  Synthetic
tggagccacttgggtggatctggtgttagaaggagacagctgtttgacaatcatggcaaacgacaagccaacact

SEQ ID NO: 212515 - DNA, 75 bp, Artificial Sequence
  Synthetic
ctagccaacttgctgaggtcagaagttactgctatcatgcttcagtcactgacatctcgacggtggctcggtgcc

SEQ ID NO: 212516 - DNA, 75 bp, Artificial Sequence
  Synthetic
ggatggggaaatggatgtggacttttcgggaaaggaagcattgacacttgcgcaaagttttcttgtaccagtaag

SEQ ID NO: 212517 - DNA, 75 bp, Artificial Sequence
  Synthetic
aacaagagccgtgggaaagggagaagtccatagcaatcaggagaaaatcaagaagagaatccagaagcttaaaga

SEQ ID NO: 212518 - DNA, 75 bp, Artificial Sequence
  Synthetic
ggacataccacggaagctatgaagtgaaggctactggctcagccagctctctcgtcaacggagtggtgaagctca

SEQ ID NO: 212519 - DNA, 75 bp, Artificial Sequence
  Synthetic
gtttactgtaactccaaatgctccttcaataaccctcaagcttggtgattatggagaagttacactggattgtga

SEQ ID NO: 212520 - DNA, 75 bp, Artificial Sequence
  Synthetic
cgaagtcattcttagtccatagggaatggttccatgacctttctcttccctggacgtccccctcaagcacggcat

SEQ ID NO: 212521 - DNA, 75 bp, Artificial Sequence
  Synthetic
gaaggctcctgagccaccagctggagccaaggaagtgctcaacgagaccaccaactggctgtgggcccacttgtc

SEQ ID NO: 212522 - DNA, 75 bp, Artificial Sequence
  Synthetic
ccaactggctgtgggcccacttgtcacgggaaaaaagaccccgcttgtgcaccaaggaagaattcataaagaaag

SEQ ID NO: 212523 - DNA, 75 bp, Artificial Sequence
  Synthetic
acatgatgggaaaaagagagaagaagcctggagagtttggaaaagctaaaggaagcagggccatttggttcatgt

SEQ ID NO: 212524 - DNA, 75 bp, Artificial Sequence
  Synthetic
ggaagcagggccatttggttcatgtggcttggagcacggtatctagagtttgaagctttggggttcctgaatgaa

SEQ ID NO: 212525 - DNA, 75 bp, Artificial Sequence
  Synthetic
gaacctcctttcggagactcttatatcgtggttggaagaggggacaagcagattaaccatcactggcacaaagct

SEQ ID NO: 212526 - DNA, 75 bp, Artificial Sequence
  Synthetic
tcgtggttggaagaggggacaagcagattaaccatcactggcacaaagctggaagcacgttgggcaaagccttct

SEQ ID NO: 212527 - DNA, 75 bp, Artificial Sequence
  Synthetic
gacaggtggtcacttatgctcttaacactttcacgaacatcgctgtccagctcgtcaggctgatggaggctgagg

SEQ ID NO: 212528 - DNA, 75 bp, Artificial Sequence
  Synthetic
agaacgctctttggggggatgtcttggatcacgcaagggctaatgggggccctacttctctggatgggtgtcaac

SEQ ID NO: 212529 - DNA, 75 bp, Artificial Sequence
  Synthetic
atggagaggagagagtgaccaggatggcgatcagcggagacgactgtgtcgtcaagccgctggacgacagattcg

SEQ ID NO: 212530 - DNA, 75 bp, Artificial Sequence
  Synthetic
gctgacactggctgtgccattgacatcacgagaaaagaaatgaggtgtggaagtggcattttcgtgcacaacgac

SEQ ID NO: 212531 - DNA, 75 bp, Artificial Sequence
  Synthetic
aatgtcaaaggtcagaaaagacatccaggaatggaagccttcgcatggctggcacgattggcagcaagttccctt

SEQ ID NO: 212532 - DNA, 75 bp, Artificial Sequence
  Synthetic
caggaatggaagccttcgcatggctggcacgattggcagcaagttcccttctgctctaaccattttcaggagatt

SEQ ID NO: 212533 - DNA, 75 bp, Artificial Sequence
  Synthetic
actggaggacaacaccgaggtagagatagtcacccggatgggtgagaggaagatcctcaagccgagatggcttga

SEQ ID NO: 212534 - DNA, 75 bp, Artificial Sequence
  Synthetic
ttccatcgcagggacttgcgtctcatggcaaatgcgatttgctcagcagtgccagtggattgggtgcccacaggc

SEQ ID NO: 212535 - DNA, 75 bp, Artificial Sequence
  Synthetic
agcatggggaaaaagcattctcttcgcccccgaactagccaactccacgttcgtcgtggatggacctgagacaaa

SEQ ID NO: 212536 - DNA, 75 bp, Artificial Sequence
  Synthetic
tggattgaagaaaatgaatggatgatggacaagactccaatcacaagctggacagacgttccgtatgtgggaaag

SEQ ID NO: 212537 - DNA, 75 bp, Artificial Sequence
  Synthetic
cgtgtggctgaaaattagagaggaggacactgatgagtgtgatggagcgatcataggcacagctgtaaaagggca

SEQ ID NO: 212538 - DNA, 75 bp, Artificial Sequence
  Synthetic
acgctgataagccctccttgaaaaggggaaggcctgggggcaggacgctaggggagcaatggaaggaaaaactaa

SEQ ID NO: 212539 - DNA, 75 bp, Artificial Sequence
  Synthetic
gggaaggcctgggggcaggacgctaggggagcaatggaaggaaaaactaaatgccatgagcagagaagagttttt

SEQ ID NO: 212540 - DNA, 75 bp, Artificial Sequence
  Synthetic
cttcggagaggtgaaatcttgcacttggcccgagacacacactctttggggtgacggtgttgaggagagcgagct

SEQ ID NO: 212541 - DNA, 75 bp, Artificial Sequence
  Synthetic
tggcccgagacacacactctttggggtgacggtgttgaggagagcgagctcatcatcccacacaccatagctgga

SEQ ID NO: 212542 - DNA, 75 bp, Artificial Sequence
  Synthetic
catcatcccacacaccatagctggaccgagaagcaagcacaatcggagagaagggtacaagacacaaaaccaggg

SEQ ID NO: 212543 - DNA, 75 bp, Artificial Sequence
  Synthetic
tctagtgtgatttaaggtagaaaagtagactatgtaaataatgtaaatgagaaaatgcatgcatatggagtcagg

SEQ ID NO: 212544 - DNA, 75 bp, Artificial Sequence
  Synthetic
aagggtacaagacacaaaaccagggaccctgggatgagaacggcattgtccttgattttgactattgtccaggaa

SEQ ID NO: 212545 - DNA, 75 bp, Artificial Sequence
  Synthetic
tagactatgtaaataatgtaaatgagaaaatgcatgcatatggagtcaggccagcaaaagctgccaccggatact

SEQ ID NO: 212546 - DNA, 75 bp, Artificial Sequence
  Synthetic
ttctctaccgcccttacggttccggacagaaaatggctgctggtatgggatggaaatcagacctgttaggcatga

SEQ ID NO: 212547 - DNA, 75 bp, Artificial Sequence
  Synthetic
tggaaatcagacctgttaggcatgatgaaacaacactcgttagatcacaggttgacgctttcaacggcgaaatga

SEQ ID NO: 212548 - DNA, 75 bp, Artificial Sequence
  Synthetic
ttgacccttttcagctgggccttctggtgatgtttctggccacccaggaggtccttcgcaagaggtggacggcca

SEQ ID NO: 212549 - DNA, 75 bp, Artificial Sequence
  Synthetic
ggtgatgtttctggccacccaggaggtccttcgcaagaggtggacggccagattgacgattcctgcggttttggg

SEQ ID NO: 212550 - DNA, 75 bp, Artificial Sequence
  Synthetic
tctcggaagtaggtccctgctcactggaagttgaaagaccaacgtcaggccacaaatttgtgccaccccgctggg

SEQ ID NO: 212551 - DNA, 75 bp, Artificial Sequence
  Synthetic
tttcgcggaggccaacagtggaggagatgtcctgcacctcgctctgatagccgtcttcaagatccaaccagcttt

SEQ ID NO: 212552 - DNA, 75 bp, Artificial Sequence
  Synthetic
gatgtcctgcacctcgctctgatagccgtcttcaagatccaaccagcttttctggtcatgaacatgcttagcgcg

SEQ ID NO: 212553 - DNA, 75 bp, Artificial Sequence
  Synthetic
ccgcagccatagcatggatgatcgttcgagcgatcacatttcccacaacttctaccgttaccatgccagtcttgg

SEQ ID NO: 212554 - DNA, 75 bp, Artificial Sequence
  Synthetic
cgctcctaactccgggaatgagagccttgtatctggacacttacagaatcattcttctcgtcataggaatttgtt

SEQ ID NO: 212555 - DNA, 75 bp, Artificial Sequence
  Synthetic
ccctgctacaagagaggagaaagaccatggcgaagaagaaaggggccgtgctcttgggcttagcgctcacatcca

SEQ ID NO: 212556 - DNA, 75 bp, Artificial Sequence
  Synthetic
catggcgaagaagaaaggggccgtgctcttgggcttagcgctcacatccaccggatggttttcgcccaccaccat

SEQ ID NO: 212557 - DNA, 75 bp, Artificial Sequence
  Synthetic
gttgatgtttgccattgtgggaggtctagccgagttggacatcgaatccatgtcaatacccttcatgctggcagg

SEQ ID NO: 212558 - DNA, 75 bp, Artificial Sequence
  Synthetic
tggacgacgacggtgactttcatttgattgatgatcccggtgttccatggaaagtctggctcttgcgtatgtcct

SEQ ID NO: 212559 - DNA, 75 bp, Artificial Sequence
  Synthetic
ctgggccatcgtccccgccgcttttggctattggctcactctgaaaacaacaaaaagagggggcgtgttctggga

SEQ ID NO: 212560 - DNA, 75 bp, Artificial Sequence
  Synthetic
ggctattggctcactctgaaaacaacaaaaagagggggcgtgttctgggacacgccatctccaaagccttgctta

SEQ ID NO: 212561 - DNA, 75 bp, Artificial Sequence
  Synthetic
ggccagagacacacaccctttggggagacggtgttgaggaaagtgaactcatcattccgcataccatagccggac

SEQ ID NO: 212562 - DNA, 75 bp, Artificial Sequence
  Synthetic
ctaacgccatactggggtagtgtgaaggaagaccgcataagctatggaggcccgtggaggttcgaccggaagtgg

SEQ ID NO: 212563 - DNA, 75 bp, Artificial Sequence
  Synthetic
aggaagaccgcataagctatggaggcccgtggaggttcgaccggaagtggaatggaacagatgatgtgcaagtga

SEQ ID NO: 212564 - DNA, 75 bp, Artificial Sequence
  Synthetic
gtgtttcgcaccccttttggggagattggagcagtcagcctggactacccgcgaggaacatccggctcacccatt

SEQ ID NO: 212565 - DNA, 75 bp, Artificial Sequence
  Synthetic
ggatccttttcctgactcaaatgctccaatccatgatttgcaagatgagataccagacagggcatggagcagtgg

SEQ ID NO: 212566 - DNA, 75 bp, Artificial Sequence
  Synthetic
attgtgcagggtgaccgtcaagaggaaccagttccagatgcctacactccaagcatgctaaaaaaaagacaaatg

SEQ ID NO: 212567 - DNA, 75 bp, Artificial Sequence
  Synthetic
actgtgctggacctgcacccaggttcgggaaaaaccaggaagatcctaccccaaataatcaaggacgccatccag

SEQ ID NO: 212568 - DNA, 75 bp, Artificial Sequence
  Synthetic
cgggaaaaaccaggaagatcctaccccaaataatcaaggacgccatccagcagcgcttgagaacagccgtgctgg

SEQ ID NO: 212569 - DNA, 75 bp, Artificial Sequence
  Synthetic
aatggcggaagccttgaggggactcccagtacgataccaaacctcagcagtgcagagggagcatcagggaaatga

SEQ ID NO: 212570 - DNA, 75 bp, Artificial Sequence
  Synthetic
agtgtgaaaatggggaatgagatcgcaatgtgccttcagagagcgggaaaaaaggtcatccagctcaatcgtaaa

SEQ ID NO: 212571 - DNA, 75 bp, Artificial Sequence
  Synthetic
attcataaagaaagtcaacagcaacgcggctcttggagcagtgttcgctgaacagaatcaatggagcacggcgcg

SEQ ID NO: 212572 - DNA, 75 bp, Artificial Sequence
  Synthetic
tgggagatggttgatgaagagagggaaaaccatctgcgaggagagtgtcacacatgcatctacaacatgatggga

SEQ ID NO: 212573 - DNA, 75 bp, Artificial Sequence
  Synthetic
acccaccatcctagaggagggagaaggtagagtcattcttggaaacccatcccccataaccagtgcaagtgcagc

SEQ ID NO: 212574 - DNA, 75 bp, Artificial Sequence
  Synthetic
gagcttgttggacggcagagggccagtgcgatttgtgctggctcttatcacgttcttcaagttcacagcattagc

SEQ ID NO: 212575 - DNA, 75 bp, Artificial Sequence
  Synthetic
gaaaaggctttcacaatggatggagagtaccgtcttagaggtgaggagaagaagaacttcttggagctgcttaga

SEQ ID NO: 212576 - DNA, 75 bp, Artificial Sequence
  Synthetic
aaaacaaaagaggagggaatgagagctcgatcatgtggcttgccagcttggcaatcgtaacagcttgtgccggag

SEQ ID NO: 212577 - DNA, 75 bp, Artificial Sequence
  Synthetic
tactggaagataacactgaggtggagatagttacccgaatgggtgagagaaagatcctcaagcccaggtggctcg

SEQ ID NO: 212578 - DNA, 75 bp, Artificial Sequence
  Synthetic
gcagcgggcaagagatcagccgtcagtttcatagaggtgctcggtcgcatgcctgagcatttcatgggaaagaca

SEQ ID NO: 212579 - DNA, 75 bp, Artificial Sequence
  Synthetic
gcctgagcatttcatgggaaagacacgggaagccttagacacaatgtacctggtggcaacagctgagaaaggagg

SEQ ID NO: 212580 - DNA, 75 bp, Artificial Sequence
  Synthetic
ttagaaggagacagttgtttgacaatcatggcaaacgacaaaccaacactagatgtccgcatgatcaacattgaa

SEQ ID NO: 212581 - DNA, 75 bp, Artificial Sequence
  Synthetic
cacgctggctacctttttcctatgggcggcagaggttcctggaaccaaaatagcgggtaccttattggtcgccct

SEQ ID NO: 212582 - DNA, 75 bp, Artificial Sequence
  Synthetic
gaaccagagaaacagaggtcacagacagacaatcaattggcagtatttcttatctgcgtcctgactgtggtcgga

SEQ ID NO: 212583 - DNA, 75 bp, Artificial Sequence
  Synthetic
cagacaatcaattggcagtatttcttatctgcgtcctgactgtggtcggagtggtggcagcaaatgagtacggaa

SEQ ID NO: 212584 - DNA, 75 bp, Artificial Sequence
  Synthetic
atcagttcacaagcgggctcgctgtttgtcttgccgcgaggcgtgcctttcactgacttggatctaaccgttggc

SEQ ID NO: 212585 - DNA, 75 bp, Artificial Sequence
  Synthetic
ttgtcttgccgcgaggcgtgcctttcactgacttggatctaaccgttggccttgtctttcttggctgttggggcc

SEQ ID NO: 212586 - DNA, 75 bp, Artificial Sequence
  Synthetic
gagaagaacagcggctggcataatgaagaatgccgtcgtggacggaatggtcgccactgatgtgcccgaactgga

SEQ ID NO: 212587 - DNA, 75 bp, Artificial Sequence
  Synthetic
actggcagcgctaggggacacagcctgggactttggttccattgggggggtattcaactccatagggaaagctgt

SEQ ID NO: 212588 - DNA, 75 bp, Artificial Sequence
  Synthetic
gaggcaggggtgttggtgacggcagctacactcaccttgtgggacaatggagccagcgccgtctggaattccacc

SEQ ID NO: 212589 - DNA, 75 bp, Artificial Sequence
  Synthetic
accgccacggggctctgccatgtcatgcgaggcagctacctagctggcggctctattgcctggactctcatcaag

SEQ ID NO: 212590 - DNA, 75 bp, Artificial Sequence
  Synthetic
aggggagcagtggaaggaaaagttgaatgcaatgagcagggatgagttcttcaaatataggagagaagccataat

SEQ ID NO: 212591 - DNA, 75 bp, Artificial Sequence
  Synthetic
cggtggatctcagtgtggtggttaacaagcctgtggggagataccgctcagcccccaaacgcctatccatgactc

SEQ ID NO: 212592 - DNA, 75 bp, Artificial Sequence
  Synthetic
agggctaggcgcgagaacaacatagtgggaggacacccagtttcgcgagggtcagcaaagctccgctggctcgtg

SEQ ID NO: 212593 - DNA, 75 bp, Artificial Sequence
  Synthetic
tgggaggacacccagtttcgcgagggtcagcaaagctccgctggctcgtggaaaaaggatttgtctcgccaatag

SEQ ID NO: 212594 - DNA, 75 bp, Artificial Sequence
  Synthetic
cgctaaagagtggggtggacgtgttctacaaaccctcggagcccagtgacaccctgttctgtgacataggagaat

SEQ ID NO: 212595 - DNA, 75 bp, Artificial Sequence
  Synthetic
atgacatctgactggttacatcggggacctagagagttctgcataaaagtgctttgtccttacatgcccaaagtc

SEQ ID NO: 212596 - DNA, 75 bp, Artificial Sequence
  Synthetic
gtcgcttcgggggagggctggtgcgcctccccttgtcccgaaactccaaccatgagatgtactgggtgagtgggg

SEQ ID NO: 212597 - DNA, 75 bp, Artificial Sequence
  Synthetic
gagggccaaagtatgaagaggatgtcaacctgggcagcgggacaagagctgtggggaagggagaggtccatagca

SEQ ID NO: 212598 - DNA, 75 bp, Artificial Sequence
  Synthetic
acaacctggcacaaagatcccgagcatccataccgaacttggacctatcacggaagctacgaagtgaaggccact

SEQ ID NO: 212599 - DNA, 75 bp, Artificial Sequence
  Synthetic
gggtggtaaagctcatgagcaaaccctgggatgccatcgccaatgtcaccacaatggctatgaccgatactaccc

SEQ ID NO: 212600 - DNA, 75 bp, Artificial Sequence
  Synthetic
gagccaccagcaggagtcaaggaagtgctcaacgagactaccaactggctgtgggcccacttgtcacgggagaaa

SEQ ID NO: 212601 - DNA, 75 bp, Artificial Sequence
  Synthetic
tgctcaacgagactaccaactggctgtgggcccacttgtcacgggagaaacgaccccgcttgtgtaccaaggaag

SEQ ID NO: 212602 - DNA, 75 bp, Artificial Sequence
  Synthetic
cgcagctctcggagcagtgttcgctgaacagaatcaatggagcacagcgcgggaggccgtgggtgaccctctgtt

SEQ ID NO: 212603 - DNA, 75 bp, Artificial Sequence
  Synthetic
ctatctggttcatgtggctcggagcacggtatctagagttcgaagccctaggattcctaaatgaagaccattggc

SEQ ID NO: 212604 - DNA, 75 bp, Artificial Sequence
  Synthetic
tgagccgagagaattcaggaggcggggtagaaggttcaggcgtccaaaagctgggatacatcctccgtgacatag

SEQ ID NO: 212605 - DNA, 75 bp, Artificial Sequence
  Synthetic
accctgacccatagactaatgtcaccaaacagagtgcccaactacaatttatttgtgatggatgaggctcacttc

SEQ ID NO: 212606 - DNA, 75 bp, Artificial Sequence
  Synthetic
ggggctatattgcaaccaaggtggaactaggggaagcagcagccattttcatgacggcgactccgcccgggacta

SEQ ID NO: 212607 - DNA, 75 bp, Artificial Sequence
  Synthetic
aggaaaaacaagatagctgttaggacctggctctttgagaatggagaggagagagtgactaggatggcgatcagt

SEQ ID NO: 212608 - DNA, 75 bp, Artificial Sequence
  Synthetic
ggagacgactgcgtcgtcaagccgctggatgacagattcgccacggctctccatttcctcaacgcaatgtcgaag

SEQ ID NO: 212609 - DNA, 75 bp, Artificial Sequence
  Synthetic
cattttcaggagattgtgatgaaagatggaaggagcatagtcgtcccgtgcagagggcaggatgagctgattggc

SEQ ID NO: 212610 - DNA, 75 bp, Artificial Sequence
  Synthetic
ggtcaatacactcaaaaggagagtggatgaccactgaagacatgctgcaagtctggaacagggtatggattgaag

SEQ ID NO: 212611 - DNA, 75 bp, Artificial Sequence
  Synthetic
tctggtgtggaagcctcatcggaacgcgatccagggcaacttgggctgagaacatctacgcggcaataaaccaag

SEQ ID NO: 212612 - DNA, 75 bp, Artificial Sequence
  Synthetic
ttatgttgattacatgacttccctcagaagatatgaggatgttttgattcaggaggacagggtcatttagacagg

SEQ ID NO: 212613 - DNA, 75 bp, Artificial Sequence
  Synthetic
aggccagcaaaagctgccaccggatactgggtagacggtgctgcctgcgtctcagttccaggaggactgggttaa

SEQ ID NO: 212614 - DNA, 75 bp, Artificial Sequence
  Synthetic
gaccaacgtcaggccacaattttgtgccactccgctggggagtgcggcctgcgcagccccaggaggactgggtta

SEQ ID NO: 212615 - DNA, 75 bp, Artificial Sequence
  Synthetic
gggtcagcgtggcggcgttcctcgtcaaccccaatgtcaccaccgtgagagaggcaggggtgttggtgacggcag

SEQ ID NO: 212616 - DNA, 75 bp, Artificial Sequence
  Synthetic
cgttcttcaagtttacagcattagccccgaccaaggcgcttttgggccgctggagagcagtggaaaaaagtgtgg

SEQ ID NO: 212617 - DNA, 75 bp, Artificial Sequence
  Synthetic
gcaatcgtaacagcctgtgccggagccatgaagctatcaaactttcaaggaaagcttctgatgaccatcaacaac

SEQ ID NO: 212618 - DNA, 75 bp, Artificial Sequence
  Synthetic
ccatgaagctatcaaactttcaaggaaagcttctgatgaccatcaacaacacggacattgcggacgtcatcgtga

SEQ ID NO: 212619 - DNA, 75 bp, Artificial Sequence
  Synthetic
aaagcttctgatgaccatcaacaacacggacattgcggacgtcatcgtgatccccacctcaaaaggtgaaaacag

SEQ ID NO: 212620 - DNA, 75 bp, Artificial Sequence
  Synthetic
cgtatgaatgtccgaagcttgccgtgggcaacgatccggaagacgtggactgctggtgcgacaatcaggaagtct

SEQ ID NO: 212621 - DNA, 75 bp, Artificial Sequence
  Synthetic
gggcaacgatccggaagacgtggactgctggtgcgacaatcaggaagtctacgtgcagtatggtcgctgcacacg

SEQ ID NO: 212622 - DNA, 75 bp, Artificial Sequence
  Synthetic
agatgtccgcatgatcaacattgaagctagccaacttgctgaagtcaggagttactgctatcacgcttcagtcac

SEQ ID NO: 212623 - DNA, 75 bp, Artificial Sequence
  Synthetic
gctagccaacttgctgaagtcaggagttactgctatcacgcttcagtcactgacatttcaacggtggctcgatgc

SEQ ID NO: 212624 - DNA, 75 bp, Artificial Sequence
  Synthetic
gccattggaagaatgatccaaccagagaacatcaagtacgaggttggcatattcgtgcacggaactaccacctcg

SEQ ID NO: 212625 - DNA, 75 bp, Artificial Sequence
  Synthetic
tcgagctcagtgaagttgacatcaggtcacctgaaatgcaggctaaaaatggacaaactggctctgaagggcacg

SEQ ID NO: 212626 - DNA, 75 bp, Artificial Sequence
  Synthetic
gtcacctgaaatgcaggctaaaaatggacaaactggctctgaagggcacgacttatggcatgtgtacagaaaaat

SEQ ID NO: 212627 - DNA, 75 bp, Artificial Sequence
  Synthetic
tctcgttcgcgaaaaatccagcggacacaggccatggaacagttgtcattgagctcacatattctggaagtgatg

SEQ ID NO: 212628 - DNA, 75 bp, Artificial Sequence
  Synthetic
agtcgcgagtttaaacgacatgacccctgtggggaggctggtaacagtaaaccccttcgtcgcgacatctagctc

SEQ ID NO: 212629 - DNA, 75 bp, Artificial Sequence
  Synthetic
caacaactttgaaaggggctcagagactagcagcgctaggtgacacagcctgggacttcggctccattggagggg

SEQ ID NO: 212630 - DNA, 75 bp, Artificial Sequence
  Synthetic
tcaccaagtatttggcggtgcattcagaacgctctttgggggaatgtcttggatcacacaaggactaatgggggc

SEQ ID NO: 212631 - DNA, 75 bp, Artificial Sequence
  Synthetic
agaacgctctttgggggaatgtcttggatcacacaaggactaatgggggccttacttctttggatgggtgtcaac

SEQ ID NO: 212632 - DNA, 75 bp, Artificial Sequence
  Synthetic
cttacttctttggatgggtgtcaacgcacgagaccggtcaatcgccctggcttttctggccacgggaggtgtgct

SEQ ID NO: 212633 - DNA, 75 bp, Artificial Sequence
  Synthetic
gccgacactggctgtgccattgacatcacaagaaaagagatgaggtgtggaagtggcatcttcgtgcacaacgac

SEQ ID NO: 212634 - DNA, 75 bp, Artificial Sequence
  Synthetic
aagtggcatcttcgtgcacaacgacgtagaggcttgggtagataggtacaaatatctgccagagacgcccagatc

SEQ ID NO: 212635 - DNA, 75 bp, Artificial Sequence
  Synthetic
catcaagaaggagtgtgcggggtcagatccgtcactagactggaacaccagatgtgggaatctgtgcgggacgaa

SEQ ID NO: 212636 - DNA, 75 bp, Artificial Sequence
  Synthetic
gatgtgggaatctgtgcgggacgaactgaatgtcttgctcaaagagaacgcggtggatctcagtgtggtggtgaa

SEQ ID NO: 212637 - DNA, 75 bp, Artificial Sequence
  Synthetic
gcccccaaacgcctatccatgactcaagaaaagtttgagatgggctggaaagcatggggaaaaagcattctcttc

SEQ ID NO: 212638 - DNA, 75 bp, Artificial Sequence
  Synthetic
tcggcttcggcatcacatcaacccgagtgtggctgaaaattagagaggagaacactgatgagtgtgatggagcaa

SEQ ID NO: 212639 - DNA, 75 bp, Artificial Sequence
  Synthetic
tgtggcagttcatagtgacttgtcatactggattgagagccgtctcaatgacacctggaaacttgagagggctgt

SEQ ID NO: 212640 - DNA, 75 bp, Artificial Sequence
  Synthetic
tactggattgagagccgtctcaatgacacctggaaacttgagagggctgtcttcggagaggtgaaatcttgcact

SEQ ID NO: 212641 - DNA, 75 bp, Artificial Sequence
  Synthetic
ccgagaagcaagcacaaccggagagaagggtataaaacacaaaaccagggaccctgggatgagaacggcattgtc

SEQ ID NO: 212642 - DNA, 75 bp, Artificial Sequence
  Synthetic
cttgactttgactattgtccaggaacaaaagtcaccatcacagaggactgtggcaagaggggtccctcaatcaga

SEQ ID NO: 212643 - DNA, 75 bp, Artificial Sequence
  Synthetic
tcaccgattggtgctgccgcagctgttctctaccgcctttacggttccggacagaaaatggttgctggtatggga

SEQ ID NO: 212644 - DNA, 75 bp, Artificial Sequence
  Synthetic
gatgttctgcacctcgctctgatagccgtcttcaagatccaaccagcttttctggtcatgaacatgcttagcgcg

SEQ ID NO: 212645 - DNA, 75 bp, Artificial Sequence
  Synthetic
tctggtcatgaacatgcttagcgcgagatggacgaaccaagagaacgtggttctggtcctgggggcggctttttt

SEQ ID NO: 212646 - DNA, 75 bp, Artificial Sequence
  Synthetic
ccaaacaagaagagagggtggccagccaccgagttcctttcagcggttgggttgatgtttgccattgtgggaggt

SEQ ID NO: 212647 - DNA, 75 bp, Artificial Sequence
  Synthetic
gattgatgatcccggtgttccatggaaagtctggctcttgcgcatgtcttgtatcggtttagccgctctgacacc

SEQ ID NO: 212648 - DNA, 75 bp, Artificial Sequence
  Synthetic
aaagtcaccatcacagaggactgtggcaagaggggtccctcaatcagaaccactactgacagtggaaagctgatc

SEQ ID NO: 212649 - DNA, 75 bp, Artificial Sequence
  Synthetic
caaaaagagggggcgtgttctgggacacgccatctccaaagccttgcttaaagggggacaccaccacaggagttt

SEQ ID NO: 212650 - DNA, 75 bp, Artificial Sequence
  Synthetic
agtaaacatccagacaaaaccgggagtgtttcgcacccctttcggggaggttggagcagtcagcttggactaccc

SEQ ID NO: 212651 - DNA, 75 bp, Artificial Sequence
  Synthetic
attgtgcaaggcgaccgtcaagaggaaccagttccagatgcctacactccaagtatgctgaaaaagagacagatg

SEQ ID NO: 212652 - DNA, 75 bp, Artificial Sequence
  Synthetic
ccagttccagatgcctacactccaagcatgctgaaaaagagacagatgactgtgctggacctgcacccaggttcg

SEQ ID NO: 212653 - DNA, 75 bp, Artificial Sequence
  Synthetic
tgcagagggagcatcagggaaatgaaatagtagacgtaatgtgccatgccactctgacccatagactaatgtcac

SEQ ID NO: 212654 - DNA, 75 bp, Artificial Sequence
  Synthetic
actgacccagctagcatcgccgctcggggttatattgcaaccaaggtggaactgggggaggcagcagccattttt

SEQ ID NO: 212655 - DNA, 75 bp, Artificial Sequence
  Synthetic
ctgatccctttcccgactcaaatgccccaattcatgacctgcaggatgagatcccagacagggcatggagcagtg

SEQ ID NO: 212656 - DNA, 75 bp, Artificial Sequence
  Synthetic
cccaattcatgacctgcaggatgagatcccagacagggcatggagcagtggatacgaatggatcacggactatgc

SEQ ID NO: 212657 - DNA, 75 bp, Artificial Sequence
  Synthetic
tcatatgacacagaatacccaaaatgcaaaaatggagattgggactttgttatcaccactgacatctctgagatg

SEQ ID NO: 212658 - DNA, 75 bp, Artificial Sequence
  Synthetic
atgggtctaggggctctagtgctcacgctggccacctttttcctatgggcggcagaggttcctggaaccaaaata

SEQ ID NO: 212659 - DNA, 75 bp, Artificial Sequence
  Synthetic
acatacacatgcctaatggattagtggctcagctgtacgggccagagagggaaaaggctttcacaatggatggag

SEQ ID NO: 212660 - DNA, 75 bp, Artificial Sequence
  Synthetic
ggctcagctgtacgggccagagagggaaaaggctttcacaatggatggagagtaccgtctcagaggtgaggagaa

SEQ ID NO: 212661 - DNA, 75 bp, Artificial Sequence
  Synthetic
aagatcctcaagccgagatggctcgatgcgagggtttatgcagaccaccaggccctcaagtggtttaaggatttt

SEQ ID NO: 212662 - DNA, 75 bp, Artificial Sequence
  Synthetic
aaaggcacaccgcatggctcttgaagaactgcccgacgcattggagaccatcacactcatcgttgccatcactgt

SEQ ID NO: 212663 - DNA, 75 bp, Artificial Sequence
  Synthetic
gaactgcccgacgcattggagaccatcacactcatcgttgccatcactgtgatgacaggaggattcttcctgctc

SEQ ID NO: 212664 - DNA, 75 bp, Artificial Sequence
  Synthetic
gtcgatacactcgaaaggagagtggatgaccacggaagacatgctacaggtctggaacagagtatggattgaaga

SEQ ID NO: 212665 - DNA, 75 bp, Artificial Sequence
  Synthetic
gtcgatacactcgaaaggagagtggatgaccacggaagacatgctacaggtctggaacagagtttggattgaaga

SEQ ID NO: 212666 - DNA, 75 bp, Artificial Sequence
  Synthetic
gtcgatacactcgaaaggagagtggatgaccacggaagacatgctacaggtctggaacagagtctggattgaaga

SEQ ID NO: 212667 - DNA, 75 bp, Artificial Sequence
  Synthetic
gtcgatacactcgaaaggagagtggatgaccacggaagacatgctacaggtctggaacagagtgtggattgaaga

SEQ ID NO: 212668 - DNA, 75 bp, Artificial Sequence
  Synthetic
gtcgatacactcgaaaggagagtggatgaccacggaagacatgcttcaggtctggaacagagtatggattgaaga

SEQ ID NO: 212669 - DNA, 75 bp, Artificial Sequence
  Synthetic
gtcgatacactcgaaaggagagtggatgaccacggaagacatgcttcaggtctggaacagagtttggattgaaga

SEQ ID NO: 212670 - DNA, 75 bp, Artificial Sequence
  Synthetic
gtcgatacactcgaaaggagagtggatgaccacggaagacatgcttcaggtctggaacagagtctggattgaaga

SEQ ID NO: 212671 - DNA, 75 bp, Artificial Sequence
  Synthetic
gtcgatacactcgaaaggagagtggatgaccacggaagacatgcttcaggtctggaacagagtgtggattgaaga

SEQ ID NO: 212672 - DNA, 75 bp, Artificial Sequence
  Synthetic
gtcgatacactcgaaaggagagtggatgaccacggaagacatgctccaggtctggaacagagtatggattgaaga

SEQ ID NO: 212673 - DNA, 75 bp, Artificial Sequence
  Synthetic
gtcgatacactcgaaaggagagtggatgaccacggaagacatgctccaggtctggaacagagtttggattgaaga

SEQ ID NO: 212674 - DNA, 75 bp, Artificial Sequence
  Synthetic
gtcgatacactcgaaaggagagtggatgaccacggaagacatgctccaggtctggaacagagtctggattgaaga

SEQ ID NO: 212675 - DNA, 75 bp, Artificial Sequence
  Synthetic
gtcgatacactcgaaaggagagtggatgaccacggaagacatgctccaggtctggaacagagtgtggattgaaga

SEQ ID NO: 212676 - DNA, 75 bp, Artificial Sequence
  Synthetic
gtcgatacactcgaaaggagagtggatgaccacggaagacatgctgcaggtctggaacagagtatggattgaaga

SEQ ID NO: 212677 - DNA, 75 bp, Artificial Sequence
  Synthetic
gtcgatacactcgaaaggagagtggatgaccacggaagacatgctgcaggtctggaacagagtttggattgaaga

SEQ ID NO: 212678 - DNA, 75 bp, Artificial Sequence
  Synthetic
gtcgatacactcgaaaggagagtggatgaccacggaagacatgctgcaggtctggaacagagtctggattgaaga

SEQ ID NO: 212679 - DNA, 75 bp, Artificial Sequence
  Synthetic
gtcgatacactcgaaaggagagtggatgaccacggaagacatgctgcaggtctggaacagagtgtggattgaaga

SEQ ID NO: 212680 - DNA, 75 bp, Artificial Sequence
  Synthetic
gtcgatacactcgaaaggtgagtggatgaccacggaagacatgctacaggtctggaacagagtatggattgaaga

SEQ ID NO: 212681 - DNA, 75 bp, Artificial Sequence
  Synthetic
gtcgatacactcgaaaggtgagtggatgaccacggaagacatgctacaggtctggaacagagtttggattgaaga

SEQ ID NO: 212682 - DNA, 75 bp, Artificial Sequence
  Synthetic
gtcgatacactcgaaaggtgagtggatgaccacggaagacatgctacaggtctggaacagagtctggattgaaga

SEQ ID NO: 212683 - DNA, 75 bp, Artificial Sequence
  Synthetic
gtcgatacactcgaaaggtgagtggatgaccacggaagacatgctacaggtctggaacagagtgtggattgaaga

SEQ ID NO: 212684 - DNA, 75 bp, Artificial Sequence
  Synthetic
gtcgatacactcgaaaggtgagtggatgaccacggaagacatgcttcaggtctggaacagagtatggattgaaga

SEQ ID NO: 212685 - DNA, 75 bp, Artificial Sequence
  Synthetic
gtcgatacactcgaaaggtgagtggatgaccacggaagacatgcttcaggtctggaacagagtttggattgaaga

SEQ ID NO: 212686 - DNA, 75 bp, Artificial Sequence
  Synthetic
gtcgatacactcgaaaggtgagtggatgaccacggaagacatgcttcaggtctggaacagagtctggattgaaga

SEQ ID NO: 212687 - DNA, 75 bp, Artificial Sequence
  Synthetic
gtcgatacactcgaaaggtgagtggatgaccacggaagacatgcttcaggtctggaacagagtgtggattgaaga

SEQ ID NO: 212688 - DNA, 75 bp, Artificial Sequence
  Synthetic
gtcgatacactcgaaaggtgagtggatgaccacggaagacatgctccaggtctggaacagagtatggattgaaga

SEQ ID NO: 212689 - DNA, 75 bp, Artificial Sequence
  Synthetic
gtcgatacactcgaaaggtgagtggatgaccacggaagacatgctccaggtctggaacagagtttggattgaaga

SEQ ID NO: 212690 - DNA, 75 bp, Artificial Sequence
  Synthetic
gtcgatacactcgaaaggtgagtggatgaccacggaagacatgctccaggtctggaacagagtctggattgaaga

SEQ ID NO: 212691 - DNA, 75 bp, Artificial Sequence
  Synthetic
gtcgatacactcgaaaggtgagtggatgaccacggaagacatgctccaggtctggaacagagtgtggattgaaga

SEQ ID NO: 212692 - DNA, 75 bp, Artificial Sequence
  Synthetic
gtcgatacactcgaaaggtgagtggatgaccacggaagacatgctgcaggtctggaacagagtatggattgaaga

SEQ ID NO: 212693 - DNA, 75 bp, Artificial Sequence
  Synthetic
gtcgatacactcgaaaggtgagtggatgaccacggaagacatgctgcaggtctggaacagagtttggattgaaga

SEQ ID NO: 212694 - DNA, 75 bp, Artificial Sequence
  Synthetic
gtcgatacactcgaaaggtgagtggatgaccacggaagacatgctgcaggtctggaacagagtctggattgaaga

SEQ ID NO: 212695 - DNA, 75 bp, Artificial Sequence
  Synthetic
gtcgatacactcgaaaggtgagtggatgaccacggaagacatgctgcaggtctggaacagagtgtggattgaaga

SEQ ID NO: 212696 - DNA, 75 bp, Artificial Sequence
  Synthetic
gtcgatacactcgaaaggcgagtggatgaccacggaagacatgctacaggtctggaacagagtatggattgaaga

SEQ ID NO: 212697 - DNA, 75 bp, Artificial Sequence
  Synthetic
gtcgatacactcgaaaggcgagtggatgaccacggaagacatgctacaggtctggaacagagtttggattgaaga

SEQ ID NO: 212698 - DNA, 75 bp, Artificial Sequence
  Synthetic
gtcgatacactcgaaaggcgagtggatgaccacggaagacatgctacaggtctggaacagagtctggattgaaga

SEQ ID NO: 212699 - DNA, 75 bp, Artificial Sequence
  Synthetic
gtcgatacactcgaaaggcgagtggatgaccacggaagacatgctacaggtctggaacagagtgtggattgaaga

SEQ ID NO: 212700 - DNA, 75 bp, Artificial Sequence
  Synthetic
gtcgatacactcgaaaggcgagtggatgaccacggaagacatgcttcaggtctggaacagagtatggattgaaga

SEQ ID NO: 212701 - DNA, 75 bp, Artificial Sequence
  Synthetic
gtcgatacactcgaaaggcgagtggatgaccacggaagacatgcttcaggtctggaacagagtttggattgaaga

SEQ ID NO: 212702 - DNA, 75 bp, Artificial Sequence
  Synthetic
gtcgatacactcgaaaggcgagtggatgaccacggaagacatgcttcaggtctggaacagagtctggattgaaga

SEQ ID NO: 212703 - DNA, 75 bp, Artificial Sequence
  Synthetic
gtcgatacactcgaaaggcgagtggatgaccacggaagacatgcttcaggtctggaacagagtgtggattgaaga

SEQ ID NO: 212704 - DNA, 75 bp, Artificial Sequence
  Synthetic
gtcgatacactcgaaaggcgagtggatgaccacggaagacatgctccaggtctggaacagagtatggattgaaga

SEQ ID NO: 212705 - DNA, 75 bp, Artificial Sequence
  Synthetic
gtcgatacactcgaaaggcgagtggatgaccacggaagacatgctccaggtctggaacagagtttggattgaaga

SEQ ID NO: 212706 - DNA, 75 bp, Artificial Sequence
  Synthetic
gtcgatacactcgaaaggcgagtggatgaccacggaagacatgctccaggtctggaacagagtctggattgaaga

SEQ ID NO: 212707 - DNA, 75 bp, Artificial Sequence
  Synthetic
gtcgatacactcgaaaggcgagtggatgaccacggaagacatgctccaggtctggaacagagtgtggattgaaga

SEQ ID NO: 212708 - DNA, 75 bp, Artificial Sequence
  Synthetic
gtcgatacactcgaaaggcgagtggatgaccacggaagacatgctgcaggtctggaacagagtatggattgaaga

SEQ ID NO: 212709 - DNA, 75 bp, Artificial Sequence
  Synthetic
gtcgatacactcgaaaggcgagtggatgaccacggaagacatgctgcaggtctggaacagagtttggattgaaga

SEQ ID NO: 212710 - DNA, 75 bp, Artificial Sequence
  Synthetic
gtcgatacactcgaaaggcgagtggatgaccacggaagacatgctgcaggtctggaacagagtctggattgaaga

SEQ ID NO: 212711 - DNA, 75 bp, Artificial Sequence
  Synthetic
gtcgatacactcgaaaggcgagtggatgaccacggaagacatgctgcaggtctggaacagagtgtggattgaaga

SEQ ID NO: 212712 - DNA, 75 bp, Artificial Sequence
  Synthetic
gtcgatacactcgaaaggggagtggatgaccacggaagacatgctacaggtctggaacagagtatggattgaaga

SEQ ID NO: 212713 - DNA, 75 bp, Artificial Sequence
  Synthetic
gtcgatacactcgaaaggggagtggatgaccacggaagacatgctacaggtctggaacagagtttggattgaaga

SEQ ID NO: 212714 - DNA, 75 bp, Artificial Sequence
  Synthetic
gtcgatacactcgaaaggggagtggatgaccacggaagacatgctacaggtctggaacagagtctggattgaaga

SEQ ID NO: 212715 - DNA, 75 bp, Artificial Sequence
  Synthetic
gtcgatacactcgaaaggggagtggatgaccacggaagacatgctacaggtctggaacagagtgtggattgaaga

SEQ ID NO: 212716 - DNA, 75 bp, Artificial Sequence
  Synthetic
gtcgatacactcgaaaggggagtggatgaccacggaagacatgcttcaggtctggaacagagtatggattgaaga

SEQ ID NO: 212717 - DNA, 75 bp, Artificial Sequence
  Synthetic
gtcgatacactcgaaaggggagtggatgaccacggaagacatgcttcaggtctggaacagagtttggattgaaga

SEQ ID NO: 212718 - DNA, 75 bp, Artificial Sequence
  Synthetic
gtcgatacactcgaaaggggagtggatgaccacggaagacatgcttcaggtctggaacagagtctggattgaaga

SEQ ID NO: 212719 - DNA, 75 bp, Artificial Sequence
  Synthetic
gtcgatacactcgaaaggggagtggatgaccacggaagacatgcttcaggtctggaacagagtgtggattgaaga

SEQ ID NO: 212720 - DNA, 75 bp, Artificial Sequence
  Synthetic
gtcgatacactcgaaaggggagtggatgaccacggaagacatgctccaggtctggaacagagtatggattgaaga

SEQ ID NO: 212721 - DNA, 75 bp, Artificial Sequence
  Synthetic
gtcgatacactcgaaaggggagtggatgaccacggaagacatgctccaggtctggaacagagtttggattgaaga

SEQ ID NO: 212722 - DNA, 75 bp, Artificial Sequence
  Synthetic
gtcgatacactcgaaaggggagtggatgaccacggaagacatgctccaggtctggaacagagtctggattgaaga

SEQ ID NO: 212723 - DNA, 75 bp, Artificial Sequence
  Synthetic
gtcgatacactcgaaaggggagtggatgaccacggaagacatgctccaggtctggaacagagtgtggattgaaga

SEQ ID NO: 212724 - DNA, 75 bp, Artificial Sequence
  Synthetic
gtcgatacactcgaaaggggagtggatgaccacggaagacatgctgcaggtctggaacagagtatggattgaaga

SEQ ID NO: 212725 - DNA, 75 bp, Artificial Sequence
  Synthetic
gtcgatacactcgaaaggggagtggatgaccacggaagacatgctgcaggtctggaacagagtttggattgaaga

SEQ ID NO: 212726 - DNA, 75 bp, Artificial Sequence
  Synthetic
gtcgatacactcgaaaggggagtggatgaccacggaagacatgctgcaggtctggaacagagtctggattgaaga

SEQ ID NO: 212727 - DNA, 75 bp, Artificial Sequence
  Synthetic
gtcgatacactcgaaaggggagtggatgaccacggaagacatgctgcaggtctggaacagagtgtggattgaaga

SEQ ID NO: 212728 - DNA, 75 bp, Artificial Sequence
  Synthetic
tatctgcgtcctgaccgtggtcggagtggtggcagcaaatgagtacggaatgctggaaaaaaccaaagcagacct

SEQ ID NO: 212729 - DNA, 75 bp, Artificial Sequence
  Synthetic
atgaccacggaagacatgctacaggtctggaacagagtatggattgaagaaaatgaatggatgatggacatgact

SEQ ID NO: 212730 - DNA, 75 bp, Artificial Sequence
  Synthetic
atgaccacggaagacatgctacaggtctggaacagagtttggattgaagaaaatgaatggatgatggacatgact

SEQ ID NO: 212731 - DNA, 75 bp, Artificial Sequence
  Synthetic
atgaccacggaagacatgctacaggtctggaacagagtctggattgaagaaaatgaatggatgatggacatgact

SEQ ID NO: 212732 - DNA, 75 bp, Artificial Sequence
  Synthetic
atgaccacggaagacatgctacaggtctggaacagagtgtggattgaagaaaatgaatggatgatggacatgact

SEQ ID NO: 212733 - DNA, 75 bp, Artificial Sequence
  Synthetic
atgaccacggaagacatgcttcaggtctggaacagagtatggattgaagaaaatgaatggatgatggacatgact

SEQ ID NO: 212734 - DNA, 75 bp, Artificial Sequence
  Synthetic
atgaccacggaagacatgcttcaggtctggaacagagtttggattgaagaaaatgaatggatgatggacatgact

SEQ ID NO: 212735 - DNA, 75 bp, Artificial Sequence
  Synthetic
atgaccacggaagacatgcttcaggtctggaacagagtctggattgaagaaaatgaatggatgatggacatgact

SEQ ID NO: 212736 - DNA, 75 bp, Artificial Sequence
  Synthetic
atgaccacggaagacatgcttcaggtctggaacagagtgtggattgaagaaaatgaatggatgatggacatgact

SEQ ID NO: 212737 - DNA, 75 bp, Artificial Sequence
  Synthetic
atgaccacggaagacatgctccaggtctggaacagagtatggattgaagaaaatgaatggatgatggacatgact

SEQ ID NO: 212738 - DNA, 75 bp, Artificial Sequence
  Synthetic
atgaccacggaagacatgctccaggtctggaacagagtttggattgaagaaaatgaatggatgatggacatgact

SEQ ID NO: 212739 - DNA, 75 bp, Artificial Sequence
  Synthetic
atgaccacggaagacatgctccaggtctggaacagagtctggattgaagaaaatgaatggatgatggacatgact

SEQ ID NO: 212740 - DNA, 75 bp, Artificial Sequence
  Synthetic
atgaccacggaagacatgctccaggtctggaacagagtgtggattgaagaaaatgaatggatgatggacatgact

SEQ ID NO: 212741 - DNA, 75 bp, Artificial Sequence
  Synthetic
atgaccacggaagacatgctgcaggtctggaacagagtatggattgaagaaaatgaatggatgatggacatgact

SEQ ID NO: 212742 - DNA, 75 bp, Artificial Sequence
  Synthetic
atgaccacggaagacatgctgcaggtctggaacagagtttggattgaagaaaatgaatggatgatggacatgact

SEQ ID NO: 212743 - DNA, 75 bp, Artificial Sequence
  Synthetic
atgaccacggaagacatgctgcaggtctggaacagagtctggattgaagaaaatgaatggatgatggacatgact

SEQ ID NO: 212744 - DNA, 75 bp, Artificial Sequence
  Synthetic
atgaccacggaagacatgctgcaggtctggaacagagtgtggattgaagaaaatgaatggatgatggacatgact

SEQ ID NO: 212745 - DNA, 75 bp, Artificial Sequence
  Synthetic
agccacagcttgggcgctgtatggggggagcacagttgtgttaacccctctcctgaagcacctaatcacctcaga

SEQ ID NO: 212746 - DNA, 75 bp, Artificial Sequence
  Synthetic
tcctgaagcacctaatcacctcagaatacgtcaccacatcgttagcttcaatcagttcacaagcgggttcgctgt

SEQ ID NO: 212747 - DNA, 75 bp, Artificial Sequence
  Synthetic
agctatggtgctagtgacactccactacggatacatgctccctgggtggcaagcagaggcactcagagctgctca

SEQ ID NO: 212748 - DNA, 75 bp, Artificial Sequence
  Synthetic
aagcagaggcactcagagctgctcagagaagaacagcggctggcataatgaagaatgccgtcgtggacggaatgg

SEQ ID NO: 212749 - DNA, 75 bp, Artificial Sequence
  Synthetic
aagaactactcctttgatgcaaaagaaagtcggccaagtgctcctcataggggtcagcgtggcggcgtttctcgt

SEQ ID NO: 212750 - DNA, 75 bp, Artificial Sequence
  Synthetic
gaggcaggtgtgttggtgacggcagccacactcaccttgtgggacaatggagccagtgccgtctggaattccacc

SEQ ID NO: 212751 - DNA, 75 bp, Artificial Sequence
  Synthetic
aggggagcagtggaaggaaaagttgaatgctatgagcagggatgagttcttcaaatacagaagagaggccataat

SEQ ID NO: 212752 - DNA, 75 bp, Artificial Sequence
  Synthetic
aatgctatgagcagggatgagttcttcaaatacagaagagaggccataattgaggtggaccgcactgaagcacgc

SEQ ID NO: 212753 - DNA, 75 bp, Artificial Sequence
  Synthetic
tgaggtggaccgcactgaagcacgcagggctaggcgcgagaacaacatagtgggaggacatccagtctcgcgagg

SEQ ID NO: 212754 - DNA, 75 bp, Artificial Sequence
  Synthetic
gtcagcaaagctccgctggctcgtggaaaaaggatttgtctcgccaataggaaaagtcatagatctgggatgcgg

SEQ ID NO: 212755 - DNA, 75 bp, Artificial Sequence
  Synthetic
gcgcggaggctggagctactacgcagcaactctgaaaaaagttcaggaagtcaaagggtacacgaaaggtggggc

SEQ ID NO: 212756 - DNA, 75 bp, Artificial Sequence
  Synthetic
tcaaagggtacacgaaaggtggggcgggacacgaagaaccgatgctcatgcagagttacggttggaacctggtct

SEQ ID NO: 212757 - DNA, 75 bp, Artificial Sequence
  Synthetic
tgagccgagagaattcaggaggtggggtggaaggttcaggcgtccaaaagttgggatacatctccggtgacataa

SEQ ID NO: 212758 - DNA, 75 bp, Artificial Sequence
  Synthetic
aacatctacgcggcaataaaccaagtgagggccatccttggaaaagaaaattatgttgattacatggacttccct

SEQ ID NO: 212759 - DNA, 75 bp, Artificial Sequence
  Synthetic
ccttcccctgtctcgaaactccaaccatgagatgtactgggtgagtggagctgctggcaatgtggtgcatgcggt

SEQ ID NO: 212760 - DNA, 75 bp, Artificial Sequence
  Synthetic
caacatgaccagccaagtgctgctagggcgaatggatcgcacagtgtggagagggccaaagtatgaagaggatgt

SEQ ID NO: 212761 - DNA, 75 bp, Artificial Sequence
  Synthetic
accaggaaaaaattaggaagagaatccagaaacttagagaggaattcgccacaacctggcacaaagaccccgagc

SEQ ID NO: 212762 - DNA, 75 bp, Artificial Sequence
  Synthetic
acaacctggcacaaagaccccgagcatccataccgaacttggacctatcatggaagctacgaagtgaaggccact

SEQ ID NO: 212763 - DNA, 75 bp, Artificial Sequence
  Synthetic
gggtggtaaagctcatgagcaaaccctgggacgccatcgccaatgtcaccacaatggccatgaccgacaccaccc

SEQ ID NO: 212764 - DNA, 75 bp, Artificial Sequence
  Synthetic
ctgggacgccatcgccaatgtcaccacaatggccatgaccgacaccaccccctttggccagcagagggtctttaa

SEQ ID NO: 212765 - DNA, 75 bp, Artificial Sequence
  Synthetic
cgaccccgcttgtgcactaaggaagaattcataaagaaagtcaacagcaacgcagctctcggagcagtgttcgct

SEQ ID NO: 212766 - DNA, 75 bp, Artificial Sequence
  Synthetic
aattcataaagaaagtcaacagcaacgcagctctcggagcagtgttcgctgaacagaatcaatggagcacggcgc

SEQ ID NO: 212767 - DNA, 75 bp, Artificial Sequence
  Synthetic
gaaaaccatttgcgaggggagtgccacacgtgcatttacaacatgatgggaaaaagagagaaaaaacccggagag

SEQ ID NO: 212768 - DNA, 75 bp, Artificial Sequence
  Synthetic
ctatttggttcatgtggctcggagctcggtacctagagttcgaagccctaggatttctaaatgaagaccattggc

SEQ ID NO: 212769 - DNA, 75 bp, Artificial Sequence
  Synthetic
ggatttctaaatgaagaccattggctgagccgagagaattcaggaggtggggtggaaggttcaggcgtccaaaag

SEQ ID NO: 212770 - DNA, 75 bp, Artificial Sequence
  Synthetic
gagacctgcagcaggaggaaagacagtgatggacgtgatatcacgagaagaccaaagggggagtgggcaggtggt

SEQ ID NO: 212771 - DNA, 75 bp, Artificial Sequence
  Synthetic
accaaagggggagtgggcaggtggtgacctacgctctcaacacattcacgaacattgccgtccagcttgtccgct

SEQ ID NO: 212772 - DNA, 75 bp, Artificial Sequence
  Synthetic
tggatgacagattcgccacggctctccatttcctcaacgcaatgtcgaaggtcagaaaagatatccaagaatgga

SEQ ID NO: 212773 - DNA, 75 bp, Artificial Sequence
  Synthetic
agccttcgcatggttggcacgactggcagcaggttcccttttgctccaatcattttcaggagattgtgatgaaag

SEQ ID NO: 212774 - DNA, 75 bp, Artificial Sequence
  Synthetic
gatggaatgtgaaggacacagcttgcctggccaaagcgtatgcacagatgtggctgcttctatacttccatcgga

SEQ ID NO: 212775 - DNA, 75 bp, Artificial Sequence
  Synthetic
gtctggaacagggtatggattgaagaaaatgaatggatgatggacaagaccccaatcacaagctggacagacgtt

SEQ ID NO: 212776 - DNA, 75 bp, Artificial Sequence
  Synthetic
aggaggacagggtcatttagacaggattaagtcatgtgtgtaatgtgagataagaaaatgtgcatgtggagtcag

SEQ ID NO: 212777 - DNA, 75 bp, Artificial Sequence
  Synthetic
attaagtcatgtgtgtaatgtgagataagaaaatgtgcatgtggagtcaggccagcaaaagctgccaccggatac

SEQ ID NO: 212778 - DNA, 75 bp, Artificial Sequence
  Synthetic
taagaaaatgtgcatgtggagtcaggccagcaaaagctgccaccggatactgagtagacggtgctgcctgcgtct

SEQ ID NO: 212779 - DNA, 75 bp, Artificial Sequence
  Synthetic
tccctgctcaccggaagttgaaagaccaacgtcaggccacaattttgtgccactccgctggggagtgcggcctgc

SEQ ID NO: 212780 - DNA, 75 bp, Artificial Sequence
  Synthetic
aagcctcgtctaagatgcaatagactaggtgtaaggactagaggttagaggagaccccgtggaaacaacattatg

SEQ ID NO: 212781 - DNA, 75 bp, Artificial Sequence
  Synthetic
cggcccaagccccctcgaagctgtagaggaggtggaaggactagaggttagaggagaccccgcatttgcatcaaa

SEQ ID NO: 212782 - DNA, 75 bp, Artificial Sequence
  Synthetic
gcggcctaccccgcgtattcccactagtgggagtgaagagggtagtaatgagcttgttggacggcagagggccag

SEQ ID NO: 212783 - DNA, 75 bp, Artificial Sequence
  Synthetic
cggacattgcagacgttatcgtgattcccacctcaaaaggagagaacagatgctgggtccgggcaatcgacgtcg

SEQ ID NO: 212784 - DNA, 75 bp, Artificial Sequence
  Synthetic
gctacatgtgtgaggacactatcacgtacgaatgtcctaagcttaccatgggcaatgatccagaggatgtggatt

SEQ ID NO: 212785 - DNA, 75 bp, Artificial Sequence
  Synthetic
gatccgtgtcggtccaaacacatggggagagttcactagtgaataaaaaagaggcttggctggattcaacgaaag

SEQ ID NO: 212786 - DNA, 75 bp, Artificial Sequence
  Synthetic
tcgtgacttcatagaaggagccagtggagccacttgggtggacttggtgctagaaggagatagctgcttgacaat

SEQ ID NO: 212787 - DNA, 75 bp, Artificial Sequence
  Synthetic
tagaaggagatagctgcttgacaattatggcaaacgacaaaccaacattggacgtccgcatgatcaacatcgaag

SEQ ID NO: 212788 - DNA, 75 bp, Artificial Sequence
  Synthetic
gaagcgagctgatagtagctatgtgtgcaaacaaggcttcactgatcgtgggtggggcaacggatgtggactttt

SEQ ID NO: 212789 - DNA, 75 bp, Artificial Sequence
  Synthetic
tttgtgcatggaaccaccacttcggaaaaccatgggaattattcagcgcaagttggggcgtcccaggcggcaaag

SEQ ID NO: 212790 - DNA, 75 bp, Artificial Sequence
  Synthetic
gagaaacagagaactcctcatggagtttgaagaggcgcacgccacaaaacagtccgttgttgctcttgggtcaca

SEQ ID NO: 212791 - DNA, 75 bp, Artificial Sequence
  Synthetic
caaacagagtgcccaactacaatttattcgtgatggatgaggctcacttcactgacccagctagcatcgccgctc

SEQ ID NO: 212792 - DNA, 75 bp, Artificial Sequence
  Synthetic
caagctcagtgaagttaacatcaggccacctgaaatgtaggctgaaaatggacaaactggctctgaaaggcacaa

SEQ ID NO: 212793 - DNA, 75 bp, Artificial Sequence
  Synthetic
aactctcctactctgggagtgatggcccctgcaaaattccgattgtctccgttgcgagcctcaatgacatgaccc

SEQ ID NO: 212794 - DNA, 75 bp, Artificial Sequence
  Synthetic
cccctgcaaaattccgattgtctccgttgcgagcctcaatgacatgacccccgttgggcggctggtgacagtgaa

SEQ ID NO: 212795 - DNA, 75 bp, Artificial Sequence
  Synthetic
atcaaccaccattggcacaaagctggaagcacgctgggcaaagccttttcaacaactttgaagggagctcagaga

SEQ ID NO: 212796 - DNA, 75 bp, Artificial Sequence
  Synthetic
gggactttggctccattggaggggtcttcaactccataggaaaagccgttcaccaagtgtttggtggtgccttca

SEQ ID NO: 212797 - DNA, 75 bp, Artificial Sequence
  Synthetic
caccaagtgtttggtggtgccttcagaacactctttgggggaatgtcttggatcacacaagggctaatgggtgcc

SEQ ID NO: 212798 - DNA, 75 bp, Artificial Sequence
  Synthetic
agaccccgtggaattaacattatgcgtcccaagccccctcgaagctgtataggaggtggaaggactaaaggttag

SEQ ID NO: 212799 - DNA, 75 bp, Artificial Sequence
  Synthetic
ctactactctggatgggcgtcaacgcacgagaccgatcaattgctttggccttcttagccacaggaggtgtgctc

SEQ ID NO: 212800 - DNA, 75 bp, Artificial Sequence
  Synthetic
cacgagaccgatcaattgctttggccttcttagccacaggaggtgtgctcgtgttcttagcgaccaatgtgcatg

SEQ ID NO: 212801 - DNA, 75 bp, Artificial Sequence
  Synthetic
aagcccgtggggagatatcgctcagcccctaaacgcctatccatgacgcaagagaagtttgaaatgggctggaaa

SEQ ID NO: 212802 - DNA, 75 bp, Artificial Sequence
  Synthetic
gaatgccctgatgagcacagagcttggaacagcatgcaaatcgaagacttcggctttggcatcacatcaacccgt

SEQ ID NO: 212803 - DNA, 75 bp, Artificial Sequence
  Synthetic
ggaacagcatgcaaatcgaagacttcggctttggcatcacatcaacccgtgtgtggctgaagattagagaggaga

SEQ ID NO: 212804 - DNA, 75 bp, Artificial Sequence
  Synthetic
cactgactggtgctgtcgcagttgctcccttccgcccctacgattccggacagaaaatggctgctggtacggaat

SEQ ID NO: 212805 - DNA, 75 bp, Artificial Sequence
  Synthetic
gcatcacttacactgatttggcgaggtatgtggtgctagtcgctgctgctttcgcagaggccaacagtggaggag

SEQ ID NO: 212806 - DNA, 75 bp, Artificial Sequence
  Synthetic
ttcgcagaggccaacagtggaggagacgtcctgcaccttgctttgattgccgtttttaagatccaaccagcattt

SEQ ID NO: 212807 - DNA, 75 bp, Artificial Sequence
  Synthetic
cgtttttaagatccaaccagcatttttagtgatgaacatgcttagcacgagatggacgaaccaagaaaacgtggt

SEQ ID NO: 212808 - DNA, 75 bp, Artificial Sequence
  Synthetic
ttagtgatgaacatgcttagcacgagatggacgaaccaagaaaacgtggttctggtcctaggggctgcctttttc

SEQ ID NO: 212809 - DNA, 75 bp, Artificial Sequence
  Synthetic
tcctcctcgtcatagggatttgctctctgctgcaagagaggaaaaagaccatggcaaaaaagaaaggagctgtac

SEQ ID NO: 212810 - DNA, 75 bp, Artificial Sequence
  Synthetic
gcccccacggcccaagcctcgtctaggatgcaatagacgaggtgtaaggactagagttagaggagaccccgtgga

SEQ ID NO: 212811 - DNA, 75 bp, Artificial Sequence
  Synthetic
tcatgtacgagaatgttttccacacactatggcacacaactagaggagcagccattatgagtggagaaggaaaat

SEQ ID NO: 212812 - DNA, 75 bp, Artificial Sequence
  Synthetic
actatggcacacaactagaggagcagccattatgagtggagaaggaaaattgacgccatactggggtagtgtgaa

SEQ ID NO: 212813 - DNA, 75 bp, Artificial Sequence
  Synthetic
gccattatgagtggagaaggaaaattgacgccatactggggtagtgtgaaagaagaccgcatagcttacggaggc

SEQ ID NO: 212814 - DNA, 75 bp, Artificial Sequence
  Synthetic
agaagaccgcatagcttacggaggcccatggaggtttgatcgaaaatggaatggaacagatgacgtgcaagtgat

SEQ ID NO: 212815 - DNA, 75 bp, Artificial Sequence
  Synthetic
ccatggaggtttgatcgaaaatggaatggaacagatgacgtgcaagtgatcgtggtagaaccggggaaggctgca

SEQ ID NO: 212816 - DNA, 75 bp, Artificial Sequence
  Synthetic
accagtcccagaagcttacaccccaaacatgttgagaaagagacagatgactgtactagatttgcaccctggttc

SEQ ID NO: 212817 - DNA, 75 bp, Artificial Sequence
  Synthetic
agcgcctaagaacagctgtgttggcaccgacgcgggtggtagcagcagaaatggcagaagctttgagagggctcc

SEQ ID NO: 212818 - DNA, 75 bp, Artificial Sequence
  Synthetic
gcagagagagcaccaagggaatgaaatagtggatgtgatgtgccacgccactctgacccatagactgatgtcacc

SEQ ID NO: 212819 - DNA, 75 bp, Artificial Sequence
  Synthetic
ctctgacccatagactgatgtcaccgaacagagtgcccaactacaacctatttgtcatggatgaagctcatttca

SEQ ID NO: 212820 - DNA, 75 bp, Artificial Sequence
  Synthetic
cagaggcaaagatcatgttagacaacatacacatgcccaatggactggtggcccagctctatggaccagagaggg

SEQ ID NO: 212821 - DNA, 75 bp, Artificial Sequence
  Synthetic
cggctgacctcccggtgtggctggcctacaaggtggcgtccaatggcattcagtacaccgacagaaagtggtgtt

SEQ ID NO: 212822 - DNA, 75 bp, Artificial Sequence
  Synthetic
cagtacaccgacagaaagtggtgttttgatgggccgcgcacgaatgccatactggaggacaacaccgaggtagag

SEQ ID NO: 212823 - DNA, 75 bp, Artificial Sequence
  Synthetic
cctgagcatttcatgggaaagacgcgggaagctttagacaccatgtacttggttgcaacggctgagaaaggtggg

SEQ ID NO: 212824 - DNA, 75 bp, Artificial Sequence
  Synthetic
attaaccatcactggcacaaagctggaagcacgctgggtaaagccttctcaacaactttgaaaggggctcagaga

SEQ ID NO: 212825 - DNA, 75 bp, Artificial Sequence
  Synthetic
gaagcacgctgggtaaagccttctcaacaactttgaaaggggctcagagactagcagcgctaggtgacacagcct

SEQ ID NO: 212826 - DNA, 75 bp, Artificial Sequence
  Synthetic
acgctagctaccttcttcctgtgggcggcagaggttcctggaaccaaaatagcagggaccctgctgatcgccctg

SEQ ID NO: 212827 - DNA, 75 bp, Artificial Sequence
  Synthetic
cggcagaggttcctggaaccaaaatagcagggaccctgctgatcgccctgctgcttatggtggttctcatcccag

SEQ ID NO: 212828 - DNA, 75 bp, Artificial Sequence
  Synthetic
ccgacactggatgtgccattgacatcacaagaaaagagatgaggtgtggaagtggcatcttcgtgcacaacgacg

SEQ ID NO: 212829 - DNA, 75 bp, Artificial Sequence
  Synthetic
aagagcatgtttggcggaaagacgcaggcatcaggactgactggattgccaagcatggcattggacctgcgtcca

SEQ ID NO: 212830 - DNA, 75 bp, Artificial Sequence
  Synthetic
ggagcacagtcgtgctaacccctcttctgaagcacctgatcacgtcggaatacgtcaccacatcgctagcctcaa

SEQ ID NO: 212831 - DNA, 75 bp, Artificial Sequence
  Synthetic
atgggtacatgctccctggatggcaagcagaagcactcagagctgcccagagaaggacagcggctggaataatga

SEQ ID NO: 212832 - DNA, 75 bp, Artificial Sequence
  Synthetic
agaaggacagcggctggaataatgaagaatgccgttgttgacggaatggtcgccactgatgtgcctgaactggaa

SEQ ID NO: 212833 - DNA, 75 bp, Artificial Sequence
  Synthetic
agaatgccgttgttgacggaatggtcgccactgatgtgcctgaactggaaaggaccactcctctgatgcaaaaga

SEQ ID NO: 212834 - DNA, 75 bp, Artificial Sequence
  Synthetic
aggaccactcctctgatgcaaaagaaagtcggacaggtgctcctcataggggtaagcgtggcagcgttcctcgtc

SEQ ID NO: 212835 - DNA, 75 bp, Artificial Sequence
  Synthetic
cataggcacggctgtcaaagggcatgtgacagttcatagtgacgtgtcgtactggattgagagtcgctacaatga

SEQ ID NO: 212836 - DNA, 75 bp, Artificial Sequence
  Synthetic
aagtcggacaggtgctcctcataggggtaagcgtggcagcgttcctcgtcaaccccaatgtcaccactgtgagag

SEQ ID NO: 212837 - DNA, 75 bp, Artificial Sequence
  Synthetic
aagcaggggtgttggtgacggcggctacgctcactttgtgggacaatggagccagtgccgtttggaattccacca

SEQ ID NO: 212838 - DNA, 75 bp, Artificial Sequence
  Synthetic
gccagtgccgtttggaattccaccactgccacgggactctgccatgtaatgcgaggtagctacctggctggaggc

SEQ ID NO: 212839 - DNA, 75 bp, Artificial Sequence
  Synthetic
ggggcagtcagcttggactacccacggggaacatccggctcacccatcctagattccaatggagacatcataggc

SEQ ID NO: 212840 - DNA, 75 bp, Artificial Sequence
  Synthetic
gcgaggtagctacctggctggaggctccattgcttggactctcatcaagaacgctgacaagccctccttgaaaag

SEQ ID NO: 212841 - DNA, 75 bp, Artificial Sequence
  Synthetic
atgccatgagcagagaagagttttttaaataccggagagaggccataatcgaggtggaccgcactgaagcacgca

SEQ ID NO: 212842 - DNA, 75 bp, Artificial Sequence
  Synthetic
aaaagtcattgatctagggtgtgggcgtggaggatggagctactacgcagcaaccctgaagaaggtccaggaagt

SEQ ID NO: 212843 - DNA, 75 bp, Artificial Sequence
  Synthetic
caaccctgaagaaggtccaggaagtcagaggatacacgaaaggtggggcgggacatgaagaaccgatgctcatgc

SEQ ID NO: 212844 - DNA, 75 bp, Artificial Sequence
  Synthetic
cagaggatacacgaaaggtggggcgggacatgaagaaccgatgctcatgcagagctacggctggaacctggtctc

SEQ ID NO: 212845 - DNA, 75 bp, Artificial Sequence
  Synthetic
gggcaacgatccggaagacgtggactgctggagcgacaatcaggaaatctatgtgcagtatggtcgctgcacacg

SEQ ID NO: 212846 - DNA, 75 bp, Artificial Sequence
  Synthetic
atgttctgcacctcgctctgatagccgtcttcaagatccaaccagcttttctggtcatgaacatgcttagcgcga

SEQ ID NO: 212847 - DNA, 75 bp, Artificial Sequence
  Synthetic
cgctggcaatgtggtgcacgctgtgaacatgaccagccaggtactactggggcgaatggatcgcacagtgtggag

SEQ ID NO: 212848 - DNA, 75 bp, Artificial Sequence
  Synthetic
aacatgaccagccaggtactactggggcgaatggatcgcacagtgtggagagggccaaagtatgaggaagatgtc

SEQ ID NO: 212849 - DNA, 75 bp, Artificial Sequence
  Synthetic
ggcgaatggatcgcacagtgtggagagggccaaagtatgaggaagatgtcaacctagggagcggaacaagagccg

SEQ ID NO: 212850 - DNA, 75 bp, Artificial Sequence
  Synthetic
agtggtgaagctcatgagcaaaccttgggacgccattgccaacgtcaccaccatggccatgactgacaccacccc

SEQ ID NO: 212851 - DNA, 75 bp, Artificial Sequence
  Synthetic
gctcaacgagaccaccaactggctgtgggcctacttgtcacgggaaaaaagaccccgcttgtgcaccaaggaaga

SEQ ID NO: 212852 - DNA, 75 bp, Artificial Sequence
  Synthetic
aagtctggctcttgcgtatgtcttgcatcggtttagccgctctgacaccctgggctatcgttcccgccgcttttg

SEQ ID NO: 212853 - DNA, 75 bp, Artificial Sequence
  Synthetic
gcggctcttggagcagtgttcgctgaacagaatcaatggagcacggcgcgtgaggctgtggatgacccgcggttt

SEQ ID NO: 212854 - DNA, 75 bp, Artificial Sequence
  Synthetic
tgaggctgtggatgacccgcggttttgggagatggttgatgaagagagggaaaaccatctgcgaggagagtgtca

SEQ ID NO: 212855 - DNA, 75 bp, Artificial Sequence
  Synthetic
ggttcctgaatgaagaccattggctgagccgagagaattcaggaggtggagtggaaggctcaggcgtccaaaagc

SEQ ID NO: 212856 - DNA, 75 bp, Artificial Sequence
  Synthetic
gagccgagagaattcaggaggtggagtggaaggctcaggcgtccaaaagctgggatacatcctccgtgacatagc

SEQ ID NO: 212857 - DNA, 75 bp, Artificial Sequence
  Synthetic
aggaaagcaaggagggaaaatgtacgctgatgataccgccgggtgggacactagaattaccagaactgatttaga

SEQ ID NO: 212858 - DNA, 75 bp, Artificial Sequence
  Synthetic
cccgagccataattgaattgacttacaggcacaaagtggtcaaggtcatgagacctgcagcagaaggaaagaccg

SEQ ID NO: 212859 - DNA, 75 bp, Artificial Sequence
  Synthetic
caggcacaaagtggtcaaggtcatgagacctgcagcagaaggaaagaccgtgatggacgtgatatcaagagaaga

SEQ ID NO: 212860 - DNA, 75 bp, Artificial Sequence
  Synthetic
agacctgcagcagaaggaaagaccgtgatggacgtgatatcaagagaagatcaaagggggagtggacaggtggtc

SEQ ID NO: 212861 - DNA, 75 bp, Artificial Sequence
  Synthetic
ggcgatggatcatacgtcagcgccattgtgcagggcgaccgtcaagaggaaccagttccagatgcctacactcca

SEQ ID NO: 212862 - DNA, 75 bp, Artificial Sequence
  Synthetic
acatcgctgtccagctcgtcaggctgatggaggctgagggggtcattggaccacaacacttggaacagctaccta

SEQ ID NO: 212863 - DNA, 75 bp, Artificial Sequence
  Synthetic
atttgctcagcagtgccagtggattgggtgcccacgggcaggacatcctggtcgatacactcgaaaggagagtgg

SEQ ID NO: 212864 - DNA, 75 bp, Artificial Sequence
  Synthetic
atgaccacagaagacatgctgcaggtctggaacagagtctggattgaagaaaatgaatggatgatggacaagact

SEQ ID NO: 212865 - DNA, 75 bp, Artificial Sequence
  Synthetic
caaaaatggagattgggactttgttatcaccactgacatctctgagatgggggccaattttggtgcgagcagggt

SEQ ID NO: 212866 - DNA, 75 bp, Artificial Sequence
  Synthetic
caacggagaggtagagtgggcaggaatcccaaccaagttggagatgaataccattacgggggggccaccagtgaa

SEQ ID NO: 212867 - DNA, 75 bp, Artificial Sequence
  Synthetic
gctgcctgcgtctcagtcccaggaggactgggttaacaaatctgacaatagaaagtgagaaagccctcagaaccg

SEQ ID NO: 212868 - DNA, 75 bp, Artificial Sequence
  Synthetic
gagtgcggcctgcgcagccccaggaggactgggttaccaaagccgttgaggcccccacggcccaagcctcgtcta

SEQ ID NO: 212869 - DNA, 75 bp, Artificial Sequence
  Synthetic
gcccccacggcccaagcctcgtctaggatgcaatagacgaggtgtaaggactagaggttagaggagaccccgtgg

SEQ ID NO: 212870 - DNA, 75 bp, Artificial Sequence
  Synthetic
ggatgcaatagacgaggtgtaaggactagaggttagaggagaccccgtggaaacaacaacatgcggcccaagccc

SEQ ID NO: 212871 - DNA, 75 bp, Artificial Sequence
  Synthetic
cctcgaagctgtagaggaggtggaaggactagaggttagaggagaccccgcatttgcatcaaacagcatattgac

SEQ ID NO: 212872 - DNA, 75 bp, Artificial Sequence
  Synthetic
cgcggattaccccgcgtattcccactagtgggagtgaagagggtagtaatgagcttgttggacggcagagggcca

SEQ ID NO: 212873 - DNA, 75 bp, Artificial Sequence
  Synthetic
tggagagcagtggaaaaaagtgtggcaatgaaacatcttaccagtttcaaacgagaacttggaacactcatcgac

SEQ ID NO: 212874 - DNA, 75 bp, Artificial Sequence
  Synthetic
acgagaacttggaacactcatcgacgccgtgaacaagcggggcaaaaaacaaaacaaaagaggagggaatgaaag

SEQ ID NO: 212875 - DNA, 75 bp, Artificial Sequence
  Synthetic
gccgtgaacaagcggggcaaaaaacaaaacaaaagaggagggaatgaaagctcgattatgtggcttgccagcttg

SEQ ID NO: 212876 - DNA, 75 bp, Artificial Sequence
  Synthetic
aagagcatgtttggcggaaggacgcaagcatcaggactgaccggattgccaagcatggcactggacttgcgccca

SEQ ID NO: 212877 - DNA, 75 bp, Artificial Sequence
  Synthetic
ggttacatgtgtgaagacaccatcacgtacgaatgtccgaagcttgccgtgggcaacgatccggaagacgtggac

SEQ ID NO: 212878 - DNA, 75 bp, Artificial Sequence
  Synthetic
tgctggtgcgacaatcaagaagtctacgtgcagtatggtcgctgcacacggaccaggcattccaaacgaagcaga

SEQ ID NO: 212879 - DNA, 75 bp, Artificial Sequence
  Synthetic
ttatgctttcctggcggcggcacttggatggatgcttggcagcaacagtggccaacgtgtggtgttcactattct

SEQ ID NO: 212880 - DNA, 75 bp, Artificial Sequence
  Synthetic
ggatggatgcttggcagcaacagtggccaacgtgtggtgttcactattctcttgctgttggtcgctccggcttac

SEQ ID NO: 212881 - DNA, 75 bp, Artificial Sequence
  Synthetic
attcgtgcacggaaccaccacctcggaaaaccatgggaattactcagcgcaagtaggagcgtctcaagcagcaaa

SEQ ID NO: 212882 - DNA, 75 bp, Artificial Sequence
  Synthetic
atttgaagaggcacatgccacaaaacaatctgtcgtagctcttgggtcacaggagggaggcctccatcaagcgtt

SEQ ID NO: 212883 - DNA, 75 bp, Artificial Sequence
  Synthetic
caatctgtcgtagctcttgggtcacaggagggaggcctccatcaagcgttggcaggagccatcgtggtggagtac

SEQ ID NO: 212884 - DNA, 75 bp, Artificial Sequence
  Synthetic
gcgaggtagctacctggctggaggctccattgcctggactctcatcaagaacgctgacaagccctccttgaaaag

SEQ ID NO: 212885 - DNA, 75 bp, Artificial Sequence
  Synthetic
cttttttggccacgggaggtgtgctcgtgtttttagcgaccaatgtgcatgccgacactggctgtgccattgaca

SEQ ID NO: 212886 - DNA, 75 bp, Artificial Sequence
  Synthetic
tgggaaagggagaagtccatagcgatcaggagaaaatcaagaagagaatccagaagcttaaagaggaatttgcca

SEQ ID NO: 212887 - DNA, 75 bp, Artificial Sequence
  Synthetic
aagggtataaaacacaaaaccagggaccctgggatgagaacggcatcgtccttgactttgactattgtccaggaa

SEQ ID NO: 212888 - DNA, 75 bp, Artificial Sequence
  Synthetic
ggaagccgtgggtgaccctctgttctgggagatggtcaatgaagaaagggaaaaccatttgcgaggggagtgcca

SEQ ID NO: 212889 - DNA, 75 bp, Artificial Sequence
  Synthetic
ccaactagcttcagtggatttacagatcggagtccacggaatcctgaatgccgcagccatagcatggatgatcgt

SEQ ID NO: 212890 - DNA, 75 bp, Artificial Sequence
  Synthetic
atcggagtccacggaatcctgaatgccgcagccatagcatggatgatcgttcgagcgatcacatttcccacaact

SEQ ID NO: 212891 - DNA, 75 bp, Artificial Sequence
  Synthetic
catggcgaagaagaaaggagccgtgctcttgggcttagcgctcacatccaccggatggttttcgcccaccactat

SEQ ID NO: 212892 - DNA, 75 bp, Artificial Sequence
  Synthetic
gcttatggcagtgtcctacgtggtatcaggaaaggcaaccgacatgtggctggaccgggctgccgatatcagctg

SEQ ID NO: 212893 - DNA, 75 bp, Artificial Sequence
  Synthetic
gtatcggtttagccgctctgacaccctgggctatcgtccccgccgcttttggctattggctcactctgaaaacaa

SEQ ID NO: 212894 - DNA, 75 bp, Artificial Sequence
  Synthetic
agtaaacatccagacaaaaccgggagtgtttcgcacccctttcggggagattggagcagtcagcttggactaccc

SEQ ID NO: 212895 - DNA, 75 bp, Artificial Sequence
  Synthetic
ctagattccaatggagacatcataggcttgtatggcaatggagttgaactcggcgatggatcgtacgtcagcgcc

SEQ ID NO: 212896 - DNA, 75 bp, Artificial Sequence
  Synthetic
tggtttcatgacctcgctctcccttggacgtccccttcgagcacagcgtggagaaacagagaactcctcatggaa

SEQ ID NO: 212897 - DNA, 75 bp, Artificial Sequence
  Synthetic
ccaaataatcaaggacgccatccagcagcgcttgagaacagccgtgctggcacccacacgagtggtagcagcaga

SEQ ID NO: 212898 - DNA, 75 bp, Artificial Sequence
  Synthetic
agtgtgaaaatggggaatgagatcgcaatgtgccttcaaagagcggggaaaaaggtcatccagctcaatcgtaag

SEQ ID NO: 212899 - DNA, 75 bp, Artificial Sequence
  Synthetic
gcaaaaatggagattgggactttgtcatcaccactgacatctctgagatgggggccaattttggtgcgagcaggg

SEQ ID NO: 212900 - DNA, 75 bp, Artificial Sequence
  Synthetic
cagccccaggaggactgggttaacaaagccgttgaggccccacggcccaagcctcgtctaagatgcaatagacta

SEQ ID NO: 212901 - DNA, 75 bp, Artificial Sequence
  Synthetic
gcccaagccccctcgaagctgtagaggaggtggaaggactagaggttagaggagaccccgcaatttgcatcaaac

SEQ ID NO: 212902 - DNA, 75 bp, Artificial Sequence
  Synthetic
acagaggcaaaaattatgctagacaacatacacatgcctaatggattagtggctcagctgtacgggccagagagg

SEQ ID NO: 212903 - DNA, 75 bp, Artificial Sequence
  Synthetic
ggccctcaagtggtttaaggattttgcagcgggcaagagatcagccgtcagtttcatagaggtgctcggtcgcat

SEQ ID NO: 212904 - DNA, 75 bp, Artificial Sequence
  Synthetic
tcacacaagggctaatgggtgccctactactctggatgggcgtcaacgcacgagaccgatcaattgctttggcct

SEQ ID NO: 212905 - DNA, 75 bp, Artificial Sequence
  Synthetic
tagcgggtaccttactggtcgccctgttgctgatggtggtcctcattccggaaccagagaaacagaggtcacaga

SEQ ID NO: 212906 - DNA, 75 bp, Artificial Sequence
  Synthetic
atacgtcaccacatcgttagcttcaatcagttcacaagcgggttcgctgtttgtcttgccgcgaggcgtgccttt

SEQ ID NO: 212907 - DNA, 75 bp, Artificial Sequence
  Synthetic
caaccccaatgtcaccaccgtgagagaggcaggtgtgttggtgacggcagccacactcaccttgtgggacaatgg

SEQ ID NO: 212908 - DNA, 75 bp, Artificial Sequence
  Synthetic
ccacactcaccttgtgggacaatggagccagtgcagtctggaattctaccaccgctacggggctctgccatgtca

SEQ ID NO: 212909 - DNA, 75 bp, Artificial Sequence
  Synthetic
tgcgaggcagctacctagctggcggctccattgcctggactctcatcaagaacgctgacaagccctccttaaaaa

SEQ ID NO: 212910 - DNA, 75 bp, Artificial Sequence
  Synthetic
cgctaaaaagtggggtggacgtattctacaaaccctcggagcctagtgacaccctgttctgtgacataggagaat

SEQ ID NO: 212911 - DNA, 75 bp, Artificial Sequence
  Synthetic
gggcgaatggatcgcacagtgtggagagggccaaagtatgaagaggatgtcaacctgggcagcgggacgagagct

SEQ ID NO: 212912 - DNA, 75 bp, Artificial Sequence
  Synthetic
caacctgggcagcgggacgagagctgtggggaagggagaggtccatagcaaccaggaaaaaattaggaagagaat

SEQ ID NO: 212913 - DNA, 75 bp, Artificial Sequence
  Synthetic
aaaatgaagccaaagtgctggagcttttggatggtgaacaccgcatgctcgcccgagccataattgaactaacgt

SEQ ID NO: 212914 - DNA, 75 bp, Artificial Sequence
  Synthetic
gtgatggacgtgatatcacgagaagaccaaagggggagcgggcaggtggtgacctacgctctcaacacattcacg

SEQ ID NO: 212915 - DNA, 75 bp, Artificial Sequence
  Synthetic
tgatggaggctgagggggtcattggaccacaacacttggaacagctgcccaggaaaaacaagatagctgttagga

SEQ ID NO: 212916 - DNA, 75 bp, Artificial Sequence
  Synthetic
accacaacacttggaacagctgcccaggaaaaacaagatagctgttaggacctggctctttgagaatggagagga

SEQ ID NO: 212917 - DNA, 75 bp, Artificial Sequence
  Synthetic
aatctgctcagcagttccagtggactgggtgcccacaggcagaacatcctggtcaatacactcaaaaggagagtg

SEQ ID NO: 212918 - DNA, 75 bp, Artificial Sequence
  Synthetic
agaagtttatctgtgtgaacttcttggcttagtattgttgagaagaatcgagagattagtgcagtttaaacagtt

SEQ ID NO: 212919 - DNA, 75 bp, Artificial Sequence
  Synthetic
agtgggagtgaagagggtagtgatgagcttgctggacggcagagggccagcacgatttgtgctggctcttattac

SEQ ID NO: 212920 - DNA, 75 bp, Artificial Sequence
  Synthetic
ccgaccaaggcgctcctaggccgatggagagcagtggagaagagtgtggcaatgaaacatctcaccagtttcaaa

SEQ ID NO: 212921 - DNA, 75 bp, Artificial Sequence
  Synthetic
ggagagcagtggagaagagtgtggcaatgaaacatctcaccagtttcaaacgcgaacttgggatactcattgacg

SEQ ID NO: 212922 - DNA, 75 bp, Artificial Sequence
  Synthetic
aaacaaaagaggaggaaacgaaggctcaatcatgtggctcgctagcttggcagtcgtcatggcttgcgctggagc

SEQ ID NO: 212923 - DNA, 75 bp, Artificial Sequence
  Synthetic
cagtcgtcatggcttgcgctggagctatgaagctatcaaacttccagggaaaactcctgatgaccgttaacaata

SEQ ID NO: 212924 - DNA, 75 bp, Artificial Sequence
  Synthetic
tgttgggtccgagcaatcgacgttggttacatgtgtgaagacaccatcacctacgaatgtcccaagctcaccaca

SEQ ID NO: 212925 - DNA, 75 bp, Artificial Sequence
  Synthetic
gctggtgtgataatcaagaggtctacatccaatacggtcgatgcacgcggaccaggcattccaagcgaagcagga

SEQ ID NO: 212926 - DNA, 75 bp, Artificial Sequence
  Synthetic
catccaatacggtcgatgcacgcggaccaggcattccaagcgaagcaggagatccgtatcagtccaaacgcatgg

SEQ ID NO: 212927 - DNA, 75 bp, Artificial Sequence
  Synthetic
gaggcttggctagattcaacaaaagccacgcgataccttatgaaaacagagaattggattatacggaaccctggt

SEQ ID NO: 212928 - DNA, 75 bp, Artificial Sequence
  Synthetic
ccacgcgataccttatgaaaacagagaattggattatacggaaccctggttatgcttttctggcagcggctcttg

SEQ ID NO: 212929 - DNA, 75 bp, Artificial Sequence
  Synthetic
ccaacgtgtggtatttactatccttctgctgttggtcgctccggcttacagcttcaattgcctgggaatgggcaa

SEQ ID NO: 212930 - DNA, 75 bp, Artificial Sequence
  Synthetic
ctgctgttggtcgctccggcttacagcttcaattgcctgggaatgggcaatcgagattttatcgaaggagctagt

SEQ ID NO: 212931 - DNA, 75 bp, Artificial Sequence
  Synthetic
tagaaggagacagctgcttgacaatcatggcaaacgacaaaccaacattagatgtccgtatgataaacattgaag

SEQ ID NO: 212932 - DNA, 75 bp, Artificial Sequence
  Synthetic
catggcaaacgacaaaccaacattagatgtccgtatgataaacattgaagccagtcaacttgctgaagtcagaag

SEQ ID NO: 212933 - DNA, 75 bp, Artificial Sequence
  Synthetic
gacatttcaacggtggctcgatgtcccacgactggagaagctcacaacgagaagcgtgctgacagtagttatgtg

SEQ ID NO: 212934 - DNA, 75 bp, Artificial Sequence
  Synthetic
ccacgactggagaagctcacaacgagaagcgtgctgacagtagttatgtgtgcaaacaaggtttcaccgatcgtg

SEQ ID NO: 212935 - DNA, 75 bp, Artificial Sequence
  Synthetic
cggaaaaggaagcattgacacatgtgcaaaattttcttgtactagcaaggccattggaagaacaatccagccaga

SEQ ID NO: 212936 - DNA, 75 bp, Artificial Sequence
  Synthetic
gcaaaattttcttgtactagcaaggccattggaagaacaatccagccagagaacatcaagtacgaggttggcata

SEQ ID NO: 212937 - DNA, 75 bp, Artificial Sequence
  Synthetic
aaaaccatgggaattattcagcgcaggttggtgcgtcccaggcagcgaaattcactgtcacccccaacgctcctt

SEQ ID NO: 212938 - DNA, 75 bp, Artificial Sequence
  Synthetic
ggttggtgcgtcccaggcagcgaaattcactgtcacccccaacgctccttcaattaccctcaaacttggtgacta

SEQ ID NO: 212939 - DNA, 75 bp, Artificial Sequence
  Synthetic
ccaaggagtgggctgaacactgaagccttttatgtcatgaccgtgggcccgaaatcattcttagtccacagggaa

SEQ ID NO: 212940 - DNA, 75 bp, Artificial Sequence
  Synthetic
ccttttatgtcatgaccgtgggcccgaaatcattcttagtccacagggaatggttccatgacctctccctcccct

SEQ ID NO: 212941 - DNA, 75 bp, Artificial Sequence
  Synthetic
gagaaacagagaacttcttatggagtttgaagaggcacatgccacaaaacaatccgtcgttgctcttgggtcaca

SEQ ID NO: 212942 - DNA, 75 bp, Artificial Sequence
  Synthetic
tttgaagaggcacatgccacaaaacaatccgtcgttgctcttgggtcacaggaaggaggcctccaccaggcgctg

SEQ ID NO: 212943 - DNA, 75 bp, Artificial Sequence
  Synthetic
tgtcttgccacgaggcgtgccttttaccgacctagacttgaccgttggcctagtcttccttggctgttggggtca

SEQ ID NO: 212944 - DNA, 75 bp, Artificial Sequence
  Synthetic
caagctcagtaaagttgacatcaggtcacctgaaatgcaggctaaaaatggacaaactggctctgaaaggcacaa

SEQ ID NO: 212945 - DNA, 75 bp, Artificial Sequence
  Synthetic
tcacctgaaatgcaggctaaaaatggacaaactggctctgaaaggcacaacctatggtatgtgcacagaaaactc

SEQ ID NO: 212946 - DNA, 75 bp, Artificial Sequence
  Synthetic
acaggccatggaacagttgtcattgagctcacatactctgggagtgatggtccctgtaagattccaattgtctcc

SEQ ID NO: 212947 - DNA, 75 bp, Artificial Sequence
  Synthetic
agctcacatactctgggagtgatggtccctgtaagattccaattgtctccgttgcgagcctgaatgacatgaccc

SEQ ID NO: 212948 - DNA, 75 bp, Artificial Sequence
  Synthetic
cccctttgtcgcgacatccagcgccaactcaaaagtgctggttgaaatggaacccccttttggagattcttacat

SEQ ID NO: 212949 - DNA, 75 bp, Artificial Sequence
  Synthetic
aactcaaaagtgctggttgaaatggaacccccttttggagattcttacatcgtggtcggaagaggtgacaagcag

SEQ ID NO: 212950 - DNA, 75 bp, Artificial Sequence
  Synthetic
gaagcacgctgggaaaagctttttcaacgactttgaagggagctcaaaggctagcggcattgggtgacacagcct

SEQ ID NO: 212951 - DNA, 75 bp, Artificial Sequence
  Synthetic
aacgactttgaagggagctcaaaggctagcggcattgggtgacacagcctgggactttggctccattggaggggt

SEQ ID NO: 212952 - DNA, 75 bp, Artificial Sequence
  Synthetic
caccaagtttttggcggtgcattcagaacgctctttgggggaatgtcttggatcacacaaggtctaatgggggca

SEQ ID NO: 212953 - DNA, 75 bp, Artificial Sequence
  Synthetic
gaacgctctttgggggaatgtcttggatcacacaaggtctaatgggggcactgcttctctggatgggcgttaacg

SEQ ID NO: 212954 - DNA, 75 bp, Artificial Sequence
  Synthetic
cttgctgttggtcgctccggcttacagtttcaactgtctgggaatggggaatcgggatttcatagaaggagccag

SEQ ID NO: 212955 - DNA, 75 bp, Artificial Sequence
  Synthetic
ttttttagccacaggaggtgtgctcgtgtttctggcgaccaatgtgcacgctgacacaggatgtgccattgacat

SEQ ID NO: 212956 - DNA, 75 bp, Artificial Sequence
  Synthetic
gtgtttctggcgaccaatgtgcacgctgacacaggatgtgccattgacatcaccagaaaagagatgaggtgtgga

SEQ ID NO: 212957 - DNA, 75 bp, Artificial Sequence
  Synthetic
atcgggatttcatagaaggagccagtggagccacttgggtggatctggtgttagaaggagatagctgtttgacaa

SEQ ID NO: 212958 - DNA, 75 bp, Artificial Sequence
  Synthetic
tggaagcttgggtagacaggtataaatatctgccagaaacgcccaaatccttagcaaagattgtccacaaagcgt

SEQ ID NO: 212959 - DNA, 75 bp, Artificial Sequence
  Synthetic
atatctgccagaaacgcccaaatccttagcaaagattgtccacaaagcgtataaagaaggcgtgtgtggaattag

SEQ ID NO: 212960 - DNA, 75 bp, Artificial Sequence
  Synthetic
atgtgggaatctgtgcgggacgaattaaacgtcctactcaaagagaacgcggtggacctcagtgtggtggtgaac

SEQ ID NO: 212961 - DNA, 75 bp, Artificial Sequence
  Synthetic
ctccgaaacgcctatccatgactcaagagaagtttgaaatgggctggaaagcttgggggaaaagcattcttttcg

SEQ ID NO: 212962 - DNA, 75 bp, Artificial Sequence
  Synthetic
agagaagtttgaaatgggctggaaagcttgggggaaaagcattcttttcgccccggaactggcaaattccacgtt

SEQ ID NO: 212963 - DNA, 75 bp, Artificial Sequence
  Synthetic
tatagggacagctgtcaaagggcacgtggcggtccatagtgacttgtcgtactggattgagagcagattcaacga

SEQ ID NO: 212964 - DNA, 75 bp, Artificial Sequence
  Synthetic
gtggcggtccatagtgacttgtcgtactggattgagagcagattcaacgacacctggaaacttgagagggctgtt

SEQ ID NO: 212965 - DNA, 75 bp, Artificial Sequence
  Synthetic
ggcctgagacacacactctttggggagatggcgttgaggaaagtgatcttgtcatcccacatactatcgccggac

SEQ ID NO: 212966 - DNA, 75 bp, Artificial Sequence
  Synthetic
agatggcgttgaggaaagtgatcttgtcatcccacatactatcgccggaccaagaagcaagcacaaccggagaga

SEQ ID NO: 212967 - DNA, 75 bp, Artificial Sequence
  Synthetic
ccctgggatgagaatggcattgtcttggactttgattactgcccaggaacgacagtcaccattacagaggattgt

SEQ ID NO: 212968 - DNA, 75 bp, Artificial Sequence
  Synthetic
ccaccactgacagtggaaagctgatcactgactggtgctgccgcagctgttccctaccacccttacggttccgga

SEQ ID NO: 212969 - DNA, 75 bp, Artificial Sequence
  Synthetic
gccctacttgtgctgatgcttgggggcatcacttacactgatttggcgagatatgtagtgctagtcgctgcagct

SEQ ID NO: 212970 - DNA, 75 bp, Artificial Sequence
  Synthetic
acgttctgcacctcgccttgattgccgtcttcaagatccaaccagcatttctggtcatgaacatgcttagtgcga

SEQ ID NO: 212971 - DNA, 75 bp, Artificial Sequence
  Synthetic
cgtcttcaagatccaaccagcatttctggtcatgaacatgcttagtgcgaaatggacaaatcaagaaaacatggt

SEQ ID NO: 212972 - DNA, 75 bp, Artificial Sequence
  Synthetic
caactggcctcagtagacttgcagatcggagttcatgggatcttgaacgctgcagccatagcgtggatgatcgtt

SEQ ID NO: 212973 - DNA, 75 bp, Artificial Sequence
  Synthetic
tcggagttcatgggatcttgaacgctgcagccatagcgtggatgatcgttcgagcgatcactttccccacgactt

SEQ ID NO: 212974 - DNA, 75 bp, Artificial Sequence
  Synthetic
gctgctaactccgggaatgagggctttgtacttggacacctacagaatcattcttcttgtcatagggatttgctc

SEQ ID NO: 212975 - DNA, 75 bp, Artificial Sequence
  Synthetic
ttgtacttggacacctacagaatcattcttcttgtcatagggatttgctccctgctgcaagagaggaggaagacc

SEQ ID NO: 212976 - DNA, 75 bp, Artificial Sequence
  Synthetic
tcttgggattagctctcacatccactggatggttctcgcccaccactatcgcggccggactaatggcctgcaacc

SEQ ID NO: 212977 - DNA, 75 bp, Artificial Sequence
  Synthetic
cgaacaaaaagagggggtggccagccactgaattcctttcagcagttggattgatgttcgccattgtgggtggtc

SEQ ID NO: 212978 - DNA, 75 bp, Artificial Sequence
  Synthetic
gtcaatacccttcatgctggcaggtctcatggcagtgtcttacgtggtgtcaggaaaagcaacagacatgtggct

SEQ ID NO: 212979 - DNA, 75 bp, Artificial Sequence
  Synthetic
ctcatggcagtgtcttacgtggtgtcaggaaaagcaacagacatgtggcttgaacgagccgcagatatcagctgg

SEQ ID NO: 212980 - DNA, 75 bp, Artificial Sequence
  Synthetic
gcagccggaggctagatgttaagctggatgatgacggtgatttccacttgattgatgatcccggagttccttgga

SEQ ID NO: 212981 - DNA, 75 bp, Artificial Sequence
  Synthetic
ggatgatgacggtgatttccacttgattgatgatcccggagttccttggaagatctggctcttgcgcatgtcttg

SEQ ID NO: 212982 - DNA, 75 bp, Artificial Sequence
  Synthetic
agatggtgttgaggaaagtgaactcatcattccgcacaccatagccggaccaaaaagcaagcacaatcggaggga

SEQ ID NO: 212983 - DNA, 75 bp, Artificial Sequence
  Synthetic
tgggctattgttcccgctgcctttggttattggctcactttgaaaacaacgaaaagagggggcgtgttctgggac

SEQ ID NO: 212984 - DNA, 75 bp, Artificial Sequence
  Synthetic
gttattggctcactttgaaaacaacgaaaagagggggcgtgttctgggacacgccgtccccgaaaccttgcttga

SEQ ID NO: 212985 - DNA, 75 bp, Artificial Sequence
  Synthetic
tcgaatcatggctaggggaattcttggcacgtatcaggccggcgtcggagtcatgtacgagaatgttttccacac

SEQ ID NO: 212986 - DNA, 75 bp, Artificial Sequence
  Synthetic
ggcacgtatcaggccggcgtcggagtcatgtacgagaatgttttccacacattgtggcacacaaccagaggagca

SEQ ID NO: 212987 - DNA, 75 bp, Artificial Sequence
  Synthetic
tgacgccatactggggaagtgtgaaggaagaccgcataagctatggaggcccgtggaggtttgatcggaaatgga

SEQ ID NO: 212988 - DNA, 75 bp, Artificial Sequence
  Synthetic
tgtggtggaaccagggaaagctgcagtaaacatccagacaaaaccgggagtgtttcgcaccccctttggagaagt

SEQ ID NO: 212989 - DNA, 75 bp, Artificial Sequence
  Synthetic
tggattccaatggagacatcataggcctatacggcaatggagttgaactcggcgatggctcatacgtcagcgcta

SEQ ID NO: 212990 - DNA, 75 bp, Artificial Sequence
  Synthetic
gccagttccagaagcctacactccaagcatgttaaagaagagacaaatgactgtattggacctgcacccaggttc

SEQ ID NO: 212991 - DNA, 75 bp, Artificial Sequence
  Synthetic
agcatgttaaagaagagacaaatgactgtattggacctgcacccaggttcgggaaaaactaggaaaatcctaccc

SEQ ID NO: 212992 - DNA, 75 bp, Artificial Sequence
  Synthetic
agcgcctgagaacagccgtgctggcgcccacgcgagtggtagcagcggaaatggcggaggccttgagaggacttc

SEQ ID NO: 212993 - DNA, 75 bp, Artificial Sequence
  Synthetic
gcccacgcgagtggtagcagcggaaatggcggaggccttgagaggacttccagtgcggtaccaaacttcagcagt

SEQ ID NO: 212994 - DNA, 75 bp, Artificial Sequence
  Synthetic
atagtggatgtgatgtgccatgcaactctgactcacagactgatgtcaccaaacagagtgcccaattacaacttg

SEQ ID NO: 212995 - DNA, 75 bp, Artificial Sequence
  Synthetic
ctctgactcacagactgatgtcaccaaacagagtgcccaattacaacttgtttgtgatggatgaagctcacttta

SEQ ID NO: 212996 - DNA, 75 bp, Artificial Sequence
  Synthetic
cctatggcatgtgcacagaaaaattctcgttcgcgaaaaacccggcggacactggtcacggaacagttgtcatcg

SEQ ID NO: 212997 - DNA, 75 bp, Artificial Sequence
  Synthetic
aggctatatcgccaccaaggtagaattaggggaggcagcggctatttttatgacggcgaccccgcccggaaccac

SEQ ID NO: 212998 - DNA, 75 bp, Artificial Sequence
  Synthetic
ttaggggaggcagcggctatttttatgacggcgaccccgcccggaaccacggatccttttcctgactcaaacgcc

SEQ ID NO: 212999 - DNA, 75 bp, Artificial Sequence
  Synthetic
tcccagacagggcatggagcagtggatatgaatggatcacggaatattcgggcaaaaccgtgtggttcgtggcaa

SEQ ID NO: 213000 - DNA, 75 bp, Artificial Sequence
  Synthetic
atatgaatggatcacggaatattcgggcaaaaccgtgtggttcgtggcaagtgtgaagatgggaaatgagattgc

SEQ ID NO: 213001 - DNA, 75 bp, Artificial Sequence
  Synthetic
aaagtcatccagctcaaccgcaagtcttatgacacagaatacccaaaatgcaagaatggggactgggactttgtc

SEQ ID NO: 213002 - DNA, 75 bp, Artificial Sequence
  Synthetic
cttatgacacagaatacccaaaatgcaagaatggggactgggactttgtcattaccaccgacatctctgagatgg

SEQ ID NO: 213003 - DNA, 75 bp, Artificial Sequence
  Synthetic
cattgactgcagaaaaagtgtcaaacctaccatcctagaggaaggagaaggcagagttattcttggaaatccgtc

SEQ ID NO: 213004 - DNA, 75 bp, Artificial Sequence
  Synthetic
cctaccatcctagaggaaggagaaggcagagttattcttggaaatccgtctcccataaccagtgcaagtgcggcc

SEQ ID NO: 213005 - DNA, 75 bp, Artificial Sequence
  Synthetic
atcccaaccaagttggggatgagtatcattacgggggggccaccagtgaagacgacagtaacctagctcactgga

SEQ ID NO: 213006 - DNA, 75 bp, Artificial Sequence
  Synthetic
tcattacgggggggccaccagtgaagacgacagtaacctagctcactggacagaggcaaagattatgctagacaa

SEQ ID NO: 213007 - DNA, 75 bp, Artificial Sequence
  Synthetic
gcccagctgtatggaccagagagggaaaaggccttcacaatggatggggagtaccgcctcagaggcgaagagaag

SEQ ID NO: 213008 - DNA, 75 bp, Artificial Sequence
  Synthetic
aaaaggccttcacaatggatggggagtaccgcctcagaggcgaagagaagaaaaacttcttggagctgcttagaa

SEQ ID NO: 213009 - DNA, 75 bp, Artificial Sequence
  Synthetic
ctacaaggtggcatccaatggcattcaatacactgacagaaagtggtgttttgatggaccacgcacgaacgccat

SEQ ID NO: 213010 - DNA, 75 bp, Artificial Sequence
  Synthetic
caatacactgacagaaagtggtgttttgatggaccacgcacgaacgccatactagaagacaacactgaggtagaa

SEQ ID NO: 213011 - DNA, 75 bp, Artificial Sequence
  Synthetic
agatcctcaagccaaggtggcttgatgcaagggtttatgcagatcaccaagctctcaagtggttcaaggactttg

SEQ ID NO: 213012 - DNA, 75 bp, Artificial Sequence
  Synthetic
tgcaagggtttatgcagatcaccaagctctcaagtggttcaaggactttgcggcgggcaagagatcagccgtcag

SEQ ID NO: 213013 - DNA, 75 bp, Artificial Sequence
  Synthetic
cctgagcatttcatgggaaagacacgggaagctctagacacaatgtacctggttgcaacagctgagaaaggtgga

SEQ ID NO: 213014 - DNA, 75 bp, Artificial Sequence
  Synthetic
gggaagctctagacacaatgtacctggttgcaacagctgagaaaggtggaaaagcacaccgaatggctcttgaag

SEQ ID NO: 213015 - DNA, 75 bp, Artificial Sequence
  Synthetic
cacactcattatcgccatcaccgtgatgacgggaggattctttctgctcatgatgcagagaaagggcataggaaa

SEQ ID NO: 213016 - DNA, 75 bp, Artificial Sequence
  Synthetic
atgacgggaggattctttctgctcatgatgcagagaaagggcataggaaagatgggtctaggagctttagtgctc

SEQ ID NO: 213017 - DNA, 75 bp, Artificial Sequence
  Synthetic
cggcagaggttcccggaactaaaatagcgggaaccctgctgatcgccctgttgctgatggtggttctcattccgg

SEQ ID NO: 213018 - DNA, 75 bp, Artificial Sequence
  Synthetic
agcgggaaccctgctgatcgccctgttgctgatggtggttctcattccggagccagagaaacagaggtcacagac

SEQ ID NO: 213019 - DNA, 75 bp, Artificial Sequence
  Synthetic
atctgtgttctgacagtggttggagtggtggcagcaaacgagtacggaatgctggaaagaactaaagcagacctc

SEQ ID NO: 213020 - DNA, 75 bp, Artificial Sequence
  Synthetic
tggtggcagcaaacgagtacggaatgctggaaagaactaaagcagacctcaagagcatgtttggtggaaagacgc

SEQ ID NO: 213021 - DNA, 75 bp, Artificial Sequence
  Synthetic
aagcatggcgctggatctgcgcccagccacagcttgggcgttgtatgggggaagcacagttgtgctgacccctct

SEQ ID NO: 213022 - DNA, 75 bp, Artificial Sequence
  Synthetic
gccacagcttgggcgttgtatgggggaagcacagttgtgctgacccctctcctgaagcacttgatcacgtcggaa

SEQ ID NO: 213023 - DNA, 75 bp, Artificial Sequence
  Synthetic
tcagctcacaagctggttctctattcgtgttgccacgaggtgttcccttcactgatctagacttaaccgttggcc

SEQ ID NO: 213024 - DNA, 75 bp, Artificial Sequence
  Synthetic
cgtgttgccacgaggtgttcccttcactgatctagacttaaccgttggccttgtctttcttggctgttggggaca

SEQ ID NO: 213025 - DNA, 75 bp, Artificial Sequence
  Synthetic
gccatggtgctagtgacactccattatggatacatgctccctggatggcaggcagaggcactcagagccgcccag

SEQ ID NO: 213026 - DNA, 75 bp, Artificial Sequence
  Synthetic
atggatacatgctccctggatggcaggcagaggcactcagagccgcccagagaagaacagcagctggcataatga

SEQ ID NO: 213027 - DNA, 75 bp, Artificial Sequence
  Synthetic
cgccactgatgtgccagaactggaaaggactacccctctaatgcaaaagaaagtcggccaggtgctccttatagg

SEQ ID NO: 213028 - DNA, 75 bp, Artificial Sequence
  Synthetic
aggactacccctctaatgcaaaagaaagtcggccaggtgctccttataggagttagcgtggcggcgttcctcgtc

SEQ ID NO: 213029 - DNA, 75 bp, Artificial Sequence
  Synthetic
aagcaggagtgttggtgacggcagccacgctcactctgtgggataatggagccagtgccgtctggaattccacca

SEQ ID NO: 213030 - DNA, 75 bp, Artificial Sequence
  Synthetic
cacgctcactctgtgggataatggagccagtgccgtctggaattccaccactgccacagggctctgccacgtcat

SEQ ID NO: 213031 - DNA, 75 bp, Artificial Sequence
  Synthetic
tccattgcttggactcttattaagaatgctgacaagccctccttgaaaagggggaggcctggtggccggacgctg

SEQ ID NO: 213032 - DNA, 75 bp, Artificial Sequence
  Synthetic
atgctgacaagccctccttgaaaagggggaggcctggtggccggacgctgggagagcagtggaaggaaaagctaa

SEQ ID NO: 213033 - DNA, 75 bp, Artificial Sequence
  Synthetic
taaatacaggagggaggccataattgaggtggaccgcactgaagcgcgcagggctaggcgtgagaacaacatagt

SEQ ID NO: 213034 - DNA, 75 bp, Artificial Sequence
  Synthetic
gaggtggaccgcactgaagcgcgcagggctaggcgtgagaacaacatagtggggggacacccagtctcacgaggc

SEQ ID NO: 213035 - DNA, 75 bp, Artificial Sequence
  Synthetic
aaaaaggatttgtctcaccaatagggaaagtcatagacttgggatgtgggcgtggaggctggagctactacgcag

SEQ ID NO: 213036 - DNA, 75 bp, Artificial Sequence
  Synthetic
gaaagtcatagacttgggatgtgggcgtggaggctggagctactacgcagcaaccctgaaaaaagtccaggaagt

SEQ ID NO: 213037 - DNA, 75 bp, Artificial Sequence
  Synthetic
ggacatgaagaaccgatgctcatgcagagttacggctggaacctggtctcgttaaagagcggagtggacgtgttt

SEQ ID NO: 213038 - DNA, 75 bp, Artificial Sequence
  Synthetic
agagttacggctggaacctggtctcgttaaagagcggagtggacgtgttttacaaaccttcggagcccagtgaca

SEQ ID NO: 213039 - DNA, 75 bp, Artificial Sequence
  Synthetic
ctccccaagtccagatgtggaggaacagcgcacgttacgcgtcctggaaatgacttctgactggctgcaccgggg

SEQ ID NO: 213040 - DNA, 75 bp, Artificial Sequence
  Synthetic
cagcgcacgttacgcgtcctggaaatgacttctgactggctgcaccggggacctagggagttctgcataaaagtg

SEQ ID NO: 213041 - DNA, 75 bp, Artificial Sequence
  Synthetic
tagaaaagatggaagtcctgcagcgccggttcggaggtggcttagtgcgtctccccttgtcccgaaactccaatc

SEQ ID NO: 213042 - DNA, 75 bp, Artificial Sequence
  Synthetic
ccggttcggaggtggcttagtgcgtctccccttgtcccgaaactccaatcatgagatgtactgggtgagtggggc

SEQ ID NO: 213043 - DNA, 75 bp, Artificial Sequence
  Synthetic
aacatgactagccaggtgctgttagggcgaatggaccgcacagtctggaggggtccaaggtatgaagaggatgtt

SEQ ID NO: 213044 - DNA, 75 bp, Artificial Sequence
  Synthetic
ggcgaatggaccgcacagtctggaggggtccaaggtatgaagaggatgttaacttggggagcggaacaagagctg

SEQ ID NO: 213045 - DNA, 75 bp, Artificial Sequence
  Synthetic
ccaggaaaaaattaagaaaagaatccagaagcttaaagaggaattcgccacaacgtggcacaaagaccccgagca

SEQ ID NO: 213046 - DNA, 75 bp, Artificial Sequence
  Synthetic
cagaagcttaaagaggaattcgccacaacgtggcacaaagaccccgagcatccatatcggacttggacctaccat

SEQ ID NO: 213047 - DNA, 75 bp, Artificial Sequence
  Synthetic
gctcagccagctctctcgttaatggggtggtgaaactcatgagcaaaccctgggatgctatcgccaatgtcacca

SEQ ID NO: 213048 - DNA, 75 bp, Artificial Sequence
  Synthetic
caatggccatgaccgacacaaccccttttgggcagcaaagagttttcaaagagaaagtcgacacgaaggctccgg

SEQ ID NO: 213049 - DNA, 75 bp, Artificial Sequence
  Synthetic
cgtacgtgggaaagcgtgaggacatctggtgtggtagcctcatcggaacgcgatccagagcaacctgggccgaga

SEQ ID NO: 213050 - DNA, 75 bp, Artificial Sequence
  Synthetic
gaccccgcttgtgcaccaaggaagaattcataaagaaagtcaacagtaacgcggctctcggagcagtgtttgctg

SEQ ID NO: 213051 - DNA, 75 bp, Artificial Sequence
  Synthetic
agaggctgtggatgacccgcggttttgggagatggtggatgaagagagggaaaaccatttgcgaggagaatgcca

SEQ ID NO: 213052 - DNA, 75 bp, Artificial Sequence
  Synthetic
tgggagatggtggatgaagagagggaaaaccatttgcgaggagaatgccacacatgtgtgtacaacatgatggga

SEQ ID NO: 213053 - DNA, 75 bp, Artificial Sequence
  Synthetic
tcggaaaagctaaaggaagcagggctatctggttcatgtggcttggagcacggtatctagagtttgaagccctgg

SEQ ID NO: 213054 - DNA, 75 bp, Artificial Sequence
  Synthetic
tatctggttcatgtggcttggagcacggtatctagagtttgaagccctggggttcttaaatgaagaccattggct

SEQ ID NO: 213055 - DNA, 75 bp, Artificial Sequence
  Synthetic
gtggaaggttcaggcgtccaaaaactgggatacatcctccgtgacatagctggaaagcaaggaggaaagatgtac

SEQ ID NO: 213056 - DNA, 75 bp, Artificial Sequence
  Synthetic
tggaaagcaaggaggaaagatgtacgccgatgacaccgccggatgggataccagaatcactagaactgacttaga

SEQ ID NO: 213057 - DNA, 75 bp, Artificial Sequence
  Synthetic
cccgagccatcattgaactaacgtacaggcacaaagtggtcaaggtcatgagacccgcatcaggaggaaagacag

SEQ ID NO: 213058 - DNA, 75 bp, Artificial Sequence
  Synthetic
tcaaagggggagtggacaggtggtaacctacgctctcaacacattcacgaacatcgccgtccagctcgtccgctt

SEQ ID NO: 213059 - DNA, 75 bp, Artificial Sequence
  Synthetic
acctacgctctcaacacattcacgaacatcgccgtccagctcgtccgcttgatggaggctgaaggggtcattgga

SEQ ID NO: 213060 - DNA, 75 bp, Artificial Sequence
  Synthetic
gaggcttggctggattcaacgaaagccacacgatacctcatgaaaactgagaactggatcataaggaatcctggc

SEQ ID NO: 213061 - DNA, 75 bp, Artificial Sequence
  Synthetic
gaaaaaccaaaatcgctgttaggacatggctctttgagaatggagaggagcgagtaaccaggatggcgatcagtg

SEQ ID NO: 213062 - DNA, 75 bp, Artificial Sequence
  Synthetic
gcgatgactgtgtcgtcaagccgctggatgacagattcgccacgtccctccatttcctcaacgcaatgtcgaagg

SEQ ID NO: 213063 - DNA, 75 bp, Artificial Sequence
  Synthetic
attttcaggagattgtgatgaaagatggaaggagcatagttgtcccgtgcagaggacaggatgagctgatcggca

SEQ ID NO: 213064 - DNA, 75 bp, Artificial Sequence
  Synthetic
atggaatgtaaaggacaccgcttgcctggccaaagcctacgcacagatgtggctactcctatacttccatcgcag

SEQ ID NO: 213065 - DNA, 75 bp, Artificial Sequence
  Synthetic
atctgctcagcagtcccagtgaactgggtacccacaggtaggacatcttggtcaatacactctaagggagagtgg

SEQ ID NO: 213066 - DNA, 75 bp, Artificial Sequence
  Synthetic
aaatgaatggatgacagacaagaccccaatcacaagctggacagacgttccatacgtgggaaagcgtgaagacat

SEQ ID NO: 213067 - DNA, 75 bp, Artificial Sequence
  Synthetic
cgatccagggcaacctgggctgagaacatctacgcggcaataaaccaggtgagagccatcattgggaaggaaaat

SEQ ID NO: 213068 - DNA, 75 bp, Artificial Sequence
  Synthetic
gaagatatgaagatgtcctaattcaggaagacagggtcatttagatagcaaatcaagttaagtgtataatgtgaa

SEQ ID NO: 213069 - DNA, 75 bp, Artificial Sequence
  Synthetic
gatcacacaagggttaatgggtgccctactactctggatgggcgtcaacgcacgagatcgatcaattgctttggc

SEQ ID NO: 213070 - DNA, 75 bp, Artificial Sequence
  Synthetic
gtacgaatgtcctaagcttaccatgggcaatgatccagaggatgtggactgttggtgtgacaaccaagaagtcta

SEQ ID NO: 213071 - DNA, 75 bp, Artificial Sequence
  Synthetic
tatgctttcctggcggcggcacttggctggatgcttggcagcaacaacggtcaacgcgtggtgttcaccatcctc

SEQ ID NO: 213072 - DNA, 75 bp, Artificial Sequence
  Synthetic
tcaacgcgtggtgttcaccatcctcctgctgttggtcgctccggcttacagttttaactgtctgggaatgggcaa

SEQ ID NO: 213073 - DNA, 75 bp, Artificial Sequence
  Synthetic
ctagccaacttgctgaagtcagaagttactgctatcatgcttcagtcactgacatctcgacggtggctcggtgcc

SEQ ID NO: 213074 - DNA, 75 bp, Artificial Sequence
  Synthetic
ttactgctatcatgcttcagtcactgacatctcgacggtggctcggtgccccacgactggagaagcccacaacga

SEQ ID NO: 213075 - DNA, 75 bp, Artificial Sequence
  Synthetic
gacaaactggctctgaaaggcacaacctatggcatgtgcacagaaaaattctcgttcgcgaaaaatccggcggac

SEQ ID NO: 213076 - DNA, 75 bp, Artificial Sequence
  Synthetic
cccttgcaaaattccgattgtctccgttgcgagtctcaatgacatgacccccgttgggcggctggtgacagtgaa

SEQ ID NO: 213077 - DNA, 75 bp, Artificial Sequence
  Synthetic
aacaactttgaagggagctcaaagactggcagcgttgggcgacacagcctgggactttggctccattggaggggt

SEQ ID NO: 213078 - DNA, 75 bp, Artificial Sequence
  Synthetic
aaatcaccctcaccacgtttctaacagctatggtgctagtgacactccactacggatacatgctccctgggtggc

SEQ ID NO: 213079 - DNA, 75 bp, Artificial Sequence
  Synthetic
gcatggggaaaaagcattctctttgccccggaattggctaactccacatttgtcgtagatggacctgagacaaag

SEQ ID NO: 213080 - DNA, 75 bp, Artificial Sequence
  Synthetic
cggctttggcatcacatcaacccgtgtgtggctgaaaattagagaggagagcactgacgagtgtgatggagcgat

SEQ ID NO: 213081 - DNA, 75 bp, Artificial Sequence
  Synthetic
gcactgacgagtgtgatggagcgatcataggcacggctgtcaaaggacatgtggcagtccatagtgacttgtcgt

SEQ ID NO: 213082 - DNA, 75 bp, Artificial Sequence
  Synthetic
gccctacttgtgctgatgcttgggggcatcacttacactgatttggcgaggtatgtggtgctagtcgctgctgct

SEQ ID NO: 213083 - DNA, 75 bp, Artificial Sequence
  Synthetic
caattggcctcagtagatctgcaaataggagtccacggaatcctgaatgccgccgctatagcatggatgattgtc

SEQ ID NO: 213084 - DNA, 75 bp, Artificial Sequence
  Synthetic
cctccgtcaccatgccagtcttagcgcttctaactccgggaatgagggctctatacctagacacttacagaatca

SEQ ID NO: 213085 - DNA, 75 bp, Artificial Sequence
  Synthetic
gcttctaactccgggaatgagggctctatacctagacacttacagaatcatcctcctcgtcatagggatttgctc

SEQ ID NO: 213086 - DNA, 75 bp, Artificial Sequence
  Synthetic
ccgtacgtgggaaagcgtgaggacatctggtgtggcagcctcatcggaacgcgatccagggcaacatgggctgag

SEQ ID NO: 213087 - DNA, 75 bp, Artificial Sequence
  Synthetic
tggatggttctcgcccaccactatagctgccggactaatggtctgcaacccaaacaagaagagagggtggccagc

SEQ ID NO: 213088 - DNA, 75 bp, Artificial Sequence
  Synthetic
ggatgatgacggagattttcacttgattgatgatcccggtgttccatggaaggtctgggtcctgcgcatgtcttg

SEQ ID NO: 213089 - DNA, 75 bp, Artificial Sequence
  Synthetic
gttattggctcactttaaaaacaacaaaaagagggggcgtgttttgggacacgccatccccaaaaccttgctcaa

SEQ ID NO: 213090 - DNA, 75 bp, Artificial Sequence
  Synthetic
aaaaagagggggcgtgttttgggacacgccatccccaaaaccttgctcaaaaggagacaccactacaggagtcta

SEQ ID NO: 213091 - DNA, 75 bp, Artificial Sequence
  Synthetic
ttttagaacggaagaaaaccatgactaaaaaaccaggagggcccggtaaaaaccgggctatcaatatgctgaaac

SEQ ID NO: 213092 - DNA, 75 bp, Artificial Sequence
  Synthetic
gtttttcaagttcacagcactagccccgaccaaggcactcgttagccgatggaaggcagtagagaagagcatcgc

SEQ ID NO: 213093 - DNA, 75 bp, Artificial Sequence
  Synthetic
agggaaaaccaggaaaattctgccacaaataattaaggacgctatccagcagcgcctgagaacagctgtgctggc

SEQ ID NO: 213094 - DNA, 75 bp, Artificial Sequence
  Synthetic
ctgtaaataagaggggcaaaaaacaaaacaaaagaggaggaagtaatggaacagtcatctggataatgggcttgg

SEQ ID NO: 213095 - DNA, 75 bp, Artificial Sequence
  Synthetic
aatcaagctgtcaaattttcaaggcaaggtgctgatgacaatcaacaacaccgatgtggctgatgtgatcactat

SEQ ID NO: 213096 - DNA, 75 bp, Artificial Sequence
  Synthetic
tgttgggtccgagctatagatgtgggacacatgtgcgaggacacaatcacctatgaatgcccaaagcttgacgct

SEQ ID NO: 213097 - DNA, 75 bp, Artificial Sequence
  Synthetic
agaaagttctctagtgaacaaaaaagaagcttggatggattcgacgaaagccactcggtatctcatgaaaacaga

SEQ ID NO: 213098 - DNA, 75 bp, Artificial Sequence
  Synthetic
catcgactgtagaaagagcgtgaagcccaccatcttagaagagggagaaggcagagtcatcctcggaaacccatc

SEQ ID NO: 213099 - DNA, 75 bp, Artificial Sequence
  Synthetic
tcgtgacttcatcgaaggagttagtggagcgacgtgggtggacctggtgctggaaggagacagttgcctcactat

SEQ ID NO: 213100 - DNA, 75 bp, Artificial Sequence
  Synthetic
ggagcgacgtgggtggacctggtgctggaaggagacagttgcctcactatcatggcgaacgacaaaccaacactg

SEQ ID NO: 213101 - DNA, 75 bp, Artificial Sequence
  Synthetic
ataccgtctcagaggtgaagaaaagaaaaacttcttagagctgcttaggacggctgaccttccggtgtggctggc

SEQ ID NO: 213102 - DNA, 75 bp, Artificial Sequence
  Synthetic
aaaaacttcttagagctgcttaggacggctgaccttccggtgtggctggcctacaaggtggcgtccaatggcatt

SEQ ID NO: 213103 - DNA, 75 bp, Artificial Sequence
  Synthetic
cggctgaccttccggtgtggctggcctacaaggtggcgtccaatggcattcagtacaccgacagaaagtggtgtt

SEQ ID NO: 213104 - DNA, 75 bp, Artificial Sequence
  Synthetic
ccacggaactggctgaggtgcgaacctactgttaccacgccacagtggctgacatttcaacagtggcaagatgcc

SEQ ID NO: 213105 - DNA, 75 bp, Artificial Sequence
  Synthetic
ctactgttaccacgccacagtggctgacatttcaacagtggcaagatgccccactactggagaagcccataacac

SEQ ID NO: 213106 - DNA, 75 bp, Artificial Sequence
  Synthetic
aaatcctcaagccgagatggcttgatgcaagagtttatgcagatcaccaagccctcaagtggttcaaagactttg

SEQ ID NO: 213107 - DNA, 75 bp, Artificial Sequence
  Synthetic
aaacatcaaatatgaagttggagtgtttgttcatggaaccacaacagcagagaaccacggaaactacacagccca

SEQ ID NO: 213108 - DNA, 75 bp, Artificial Sequence
  Synthetic
tttgttcatggaaccacaacagcagagaaccacggaaactacacagcccagattggggcttctcaggctgccaag

SEQ ID NO: 213109 - DNA, 75 bp, Artificial Sequence
  Synthetic
ccatcactctgaagctcggagattacggagagatcacgatggattgcgagccgcgtagtggatttaacactgagg

SEQ ID NO: 213110 - DNA, 75 bp, Artificial Sequence
  Synthetic
atgacaggaggattctttctactaatgatgcagcgaaagggtatagggaagatgggtcttggagctctagtgctc

SEQ ID NO: 213111 - DNA, 75 bp, Artificial Sequence
  Synthetic
cggagagatcacgatggattgcgagccgcgtagtggatttaacactgaggcattttacgtgctgactgtagggtc

SEQ ID NO: 213112 - DNA, 75 bp, Artificial Sequence
  Synthetic
tggttcaatgatcttgcgcttccgtggctatctccatctagcacaaattggagaaatagagagatcctgatggag

SEQ ID NO: 213113 - DNA, 75 bp, Artificial Sequence
  Synthetic
aaccggaaaaacagaggtcacagacagataaccaactggcggtgtttcttatctgtgtcttgaccgtggttggag

SEQ ID NO: 213114 - DNA, 75 bp, Artificial Sequence
  Synthetic
ggctatctccatctagcacaaattggagaaatagagagatcctgatggagttcgaagaggctcacgcgacaaaac

SEQ ID NO: 213115 - DNA, 75 bp, Artificial Sequence
  Synthetic
agagggagccttacatcaggcattggctggcgccatagtggtggagtactctagctcagtgaagttgacttctgg

SEQ ID NO: 213116 - DNA, 75 bp, Artificial Sequence
  Synthetic
gctggcgccatagtggtggagtactctagctcagtgaagttgacttctggtcacctcaaatgcagactaaaaatg

SEQ ID NO: 213117 - DNA, 75 bp, Artificial Sequence
  Synthetic
aagcatggcactggacctgcgtccagccacagcctgggcactgtatggggggagcacagtcgtgctaacccctct

SEQ ID NO: 213118 - DNA, 75 bp, Artificial Sequence
  Synthetic
gccacagcctgggcactgtatggggggagcacagtcgtgctaacccctctcctgaagcacctgatcacgtcggaa

SEQ ID NO: 213119 - DNA, 75 bp, Artificial Sequence
  Synthetic
cctatggcatgtgcacagagaaattctctttttccaagaacccagctgacactggtcatggtacggttgtcatag

SEQ ID NO: 213120 - DNA, 75 bp, Artificial Sequence
  Synthetic
ctctttttccaagaacccagctgacactggtcatggtacggttgtcatagaattgcaatacactggcactgacgg

SEQ ID NO: 213121 - DNA, 75 bp, Artificial Sequence
  Synthetic
cagttggtagattggtgacagtcaatccttttgttgccacatccaccgccaattcgaaggttctggtagaattgg

SEQ ID NO: 213122 - DNA, 75 bp, Artificial Sequence
  Synthetic
tgttgttggaagaggagataagcagatcaatcaccattggcacaaggctggcagttcactgggaaaggctttcac

SEQ ID NO: 213123 - DNA, 75 bp, Artificial Sequence
  Synthetic
atcaatcaccattggcacaaggctggcagttcactgggaaaggctttcacgaccactttgaaaggtgctcagaga

SEQ ID NO: 213124 - DNA, 75 bp, Artificial Sequence
  Synthetic
cgccactgatgtgcctgaactggaaaggactactcctctgatgcaaaagaaagtcggacaggtgctcctcatagg

SEQ ID NO: 213125 - DNA, 75 bp, Artificial Sequence
  Synthetic
gggactttggatccattggaggggttttcaattccattggtaaggccgtgcaccaagtgtttggaggagctttca

SEQ ID NO: 213126 - DNA, 75 bp, Artificial Sequence
  Synthetic
tttcaattccattggtaaggccgtgcaccaagtgtttggaggagctttcagaaccctttttggtggcatgtcctg

SEQ ID NO: 213127 - DNA, 75 bp, Artificial Sequence
  Synthetic
ctgctgctgtggatgggtatcaacgcacgagatcggtcaattgcattagcttttcttgctacaggaggtgtgctc

SEQ ID NO: 213128 - DNA, 75 bp, Artificial Sequence
  Synthetic
cacgagatcggtcaattgcattagcttttcttgctacaggaggtgtgctcttgtttctggctaccaatgtccatg

SEQ ID NO: 213129 - DNA, 75 bp, Artificial Sequence
  Synthetic
aaccagaaaagaaatgaggtgtggtagtggcatatttgtgcacaatgacgtggaggcttgggttgatagatacaa

SEQ ID NO: 213130 - DNA, 75 bp, Artificial Sequence
  Synthetic
agtggcatatttgtgcacaatgacgtggaggcttgggttgatagatacaagtatctacctgagactcccaagtct

SEQ ID NO: 213131 - DNA, 75 bp, Artificial Sequence
  Synthetic
acaaggaaggcatttgtggagtgagatcagtcaccagactggaacatcaaatgtgggaagccgtcagggacgagt

SEQ ID NO: 213132 - DNA, 75 bp, Artificial Sequence
  Synthetic
atcagtcaccagactggaacatcaaatgtgggaagccgtcagggacgagttaaatgtcctgttgaaggagaatgc

SEQ ID NO: 213133 - DNA, 75 bp, Artificial Sequence
  Synthetic
aaaccatcaggaagataccgaccagctccattacggctgaccatgactcaggaaaagtttgagatgggttggaag

SEQ ID NO: 213134 - DNA, 75 bp, Artificial Sequence
  Synthetic
tagaaaaaatggaagtcctgcagcgccgcttcggaggtgggctagtgcgtcttcccctgtcccgcaactccaatc

SEQ ID NO: 213135 - DNA, 75 bp, Artificial Sequence
  Synthetic
ctccattacggctgaccatgactcaggaaaagtttgagatgggttggaaggcatgggggaagagcattctctttg

SEQ ID NO: 213136 - DNA, 75 bp, Artificial Sequence
  Synthetic
tgtgatcgacggacctgaaaccaaagagtgtccagatgagcgtagagcatggaatagcatgcagattgaagattt

SEQ ID NO: 213137 - DNA, 75 bp, Artificial Sequence
  Synthetic
gagtgtccagatgagcgtagagcatggaatagcatgcagattgaagattttgggtttggcattacgtcgactcga

SEQ ID NO: 213138 - DNA, 75 bp, Artificial Sequence
  Synthetic
ccatggccatgactgacaccaccccttttggacagcaaagagttttcaaggagaaagttgacacgaaggctcctg

SEQ ID NO: 213139 - DNA, 75 bp, Artificial Sequence
  Synthetic
gcacaaatgaatgtgatggagccatcatcggcacggctgttaaaggtaacatggcagtgcacagtgacttgtcat

SEQ ID NO: 213140 - DNA, 75 bp, Artificial Sequence
  Synthetic
catcggcacggctgttaaaggtaacatggcagtgcacagtgacttgtcatattggattgaaagccatctcaacga

SEQ ID NO: 213141 - DNA, 75 bp, Artificial Sequence
  Synthetic
cttagtatcgttgagaagaatcgaaagattagtgcagtttaaacagttttttagaacggaagaacaaccatgact

SEQ ID NO: 213142 - DNA, 75 bp, Artificial Sequence
  Synthetic
tttggagagataaagtcttgcacttggccagaaacacacacgctctggggagatggtgttgaggaaagtgagtta

SEQ ID NO: 213143 - DNA, 75 bp, Artificial Sequence
  Synthetic
gcggctcttggagcagtgttcgctgaacagaatcaatggagcacagcgcgtgaggctgtggatgacccgcggttt

SEQ ID NO: 213144 - DNA, 75 bp, Artificial Sequence
  Synthetic
ggccagaaacacacacgctctggggagatggtgttgaggaaagtgagttaataattccacacacactcgcgggac

SEQ ID NO: 213145 - DNA, 75 bp, Artificial Sequence
  Synthetic
tgggagatggtcgatgaagagagggaaaaccatctgcgaggagagtgtcacacatgtatctacaacatgatggga

SEQ ID NO: 213146 - DNA, 75 bp, Artificial Sequence
  Synthetic
aaaaccatctgcgaggagagtgtcacacatgtatctacaacatgatgggaaaaagagagaagaagcctggagagt

SEQ ID NO: 213147 - DNA, 75 bp, Artificial Sequence
  Synthetic
gggttacaaaacacagaatcagggaccatgggacgagaatgagatcactcttgatttcgactactgtccagggac

SEQ ID NO: 213148 - DNA, 75 bp, Artificial Sequence
  Synthetic
ccatgggacgagaatgagatcactcttgatttcgactactgtccagggaccacagtcaccattgccgagggatgt

SEQ ID NO: 213149 - DNA, 75 bp, Artificial Sequence
  Synthetic
ccaccactgatagtggaaaattaatcactgattggtgttgcaggagctgcactttgccgccactgaggttcagga

SEQ ID NO: 213150 - DNA, 75 bp, Artificial Sequence
  Synthetic
gctgatgataccgccgggtgggacactagaattaccagaactgatttagaaaatgaagctaaggtgctggagctc

SEQ ID NO: 213151 - DNA, 75 bp, Artificial Sequence
  Synthetic
ctagaattaccagaactgatttagaaaatgaagctaaggtgctggagctcctagacggtgaacaccgcatgctcg

SEQ ID NO: 213152 - DNA, 75 bp, Artificial Sequence
  Synthetic
cagccagtgggtgctggtatggaatggaaatacggcccatgaagcatgatgaatccacgctcgtaaaatcacaag

SEQ ID NO: 213153 - DNA, 75 bp, Artificial Sequence
  Synthetic
ctagacggtgaacaccgcatgctcgcccgagccataatcgaactgacttacaggcacaaagtggtcaaggtcatg

SEQ ID NO: 213154 - DNA, 75 bp, Artificial Sequence
  Synthetic
gcatcacctacactgatttagtgagatatgtggtgttggtggctgctgcttttgctgaagccaacaatggaggcg

SEQ ID NO: 213155 - DNA, 75 bp, Artificial Sequence
  Synthetic
atatgtggtgttggtggctgctgcttttgctgaagccaacaatggaggcgatgtagttcatttggccttgattgc

SEQ ID NO: 213156 - DNA, 75 bp, Artificial Sequence
  Synthetic
ctagttatgagcatagcaagaacaaattggacaaaccaggaaaacattgccctagtgctaggagctgctttcttt

SEQ ID NO: 213157 - DNA, 75 bp, Artificial Sequence
  Synthetic
attggacaaaccaggaaaacattgccctagtgctaggagctgctttctttcagatggcctcaacagacctggagt

SEQ ID NO: 213158 - DNA, 75 bp, Artificial Sequence
  Synthetic
agcggcgacggcctggatggtagtgcgggcgatcacgtttcccacgacctccaccatcacaatgcccatactagc

SEQ ID NO: 213159 - DNA, 75 bp, Artificial Sequence
  Synthetic
gcaaacaaggctttactgatcgcggatggggaaatggatgtggacttttcgggaaaggaagcattgacacatgcg

SEQ ID NO: 213160 - DNA, 75 bp, Artificial Sequence
  Synthetic
atggaatgtgaaggacacagcttgcctggccaaagcatatgcacagatgtggctactcctatacttccatcgtag

SEQ ID NO: 213161 - DNA, 75 bp, Artificial Sequence
  Synthetic
cgggcgatcacgtttcccacgacctccaccatcacaatgcccatactagctttgctggcgccaggaatgagagct

SEQ ID NO: 213162 - DNA, 75 bp, Artificial Sequence
  Synthetic
ttttgcttatcattggggtttgtgctctgctgcatgaaaggaggaaaaccatggcgaagaagaaaggtgctgtcc

SEQ ID NO: 213163 - DNA, 75 bp, Artificial Sequence
  Synthetic
tctgctgcatgaaaggaggaaaaccatggcgaagaagaaaggtgctgtccttttgggcctagccctcagttccac

SEQ ID NO: 213164 - DNA, 75 bp, Artificial Sequence
  Synthetic
gcagctgggctaatggcgtgcaatccaaacaaaaaaagaggatggccagcgacagaagttttgtctgcgattggg

SEQ ID NO: 213165 - DNA, 75 bp, Artificial Sequence
  Synthetic
caaacaaaaaaagaggatggccagcgacagaagttttgtctgcgattgggttgatgtttgctattgttgggggcc

SEQ ID NO: 213166 - DNA, 75 bp, Artificial Sequence
  Synthetic
ggcgatacctttcatgttagctgggcttatggcagtgtcatatgtggtatcaggaaaagcaacggacatgtggct

SEQ ID NO: 213167 - DNA, 75 bp, Artificial Sequence
  Synthetic
cttatggcagtgtcatatgtggtatcaggaaaagcaacggacatgtggctagaacgtgcggctgacattagttgg

SEQ ID NO: 213168 - DNA, 75 bp, Artificial Sequence
  Synthetic
tagagctgtcattgggaaagaaaattatgttgactacatgacttcactcaggagatacgaagacgtcttgatcca

SEQ ID NO: 213169 - DNA, 75 bp, Artificial Sequence
  Synthetic
gcagccgaaggttggacgtcaaactggatgatgatggagatttccaccttattgatgatccaggtgtcccatgga

SEQ ID NO: 213170 - DNA, 75 bp, Artificial Sequence
  Synthetic
ggatgatgatggagatttccaccttattgatgatccaggtgtcccatggaaaatttgggtactgcgcatgtcttg

SEQ ID NO: 213171 - DNA, 75 bp, Artificial Sequence
  Synthetic
tgggccatcatcccagcagcttttggatattggctgactttgaaaaccacgaagagaggaggcgttttttgggac

SEQ ID NO: 213172 - DNA, 75 bp, Artificial Sequence
  Synthetic
gatattggctgactttgaaaaccacgaagagaggaggcgttttttgggacacaccatcacccaaagtctacgcaa

SEQ ID NO: 213173 - DNA, 75 bp, Artificial Sequence
  Synthetic
caggataatggctcgagggatccttggcgtctaccaggcaggtgttggagtgatgtatgagaacgtgttccacac

SEQ ID NO: 213174 - DNA, 75 bp, Artificial Sequence
  Synthetic
ggcgtctaccaggcaggtgttggagtgatgtatgagaacgtgttccacactctgtggcacacgaccagaggagct

SEQ ID NO: 213175 - DNA, 75 bp, Artificial Sequence
  Synthetic
tgacgccgtactggggaagtgttaaggaggaccgcataacttatgggggcccatggagattcgatcgaaaatgga

SEQ ID NO: 213176 - DNA, 75 bp, Artificial Sequence
  Synthetic
ggaggaccgcataacttatgggggcccatggagattcgatcgaaaatggaatggagtggatgacgtgcaaatgat

SEQ ID NO: 213177 - DNA, 75 bp, Artificial Sequence
  Synthetic
gtgaatgtccaaacaaagccaggagtgtttcggactccacacggagaaattggagctgttagcttggattatcct

SEQ ID NO: 213178 - DNA, 75 bp, Artificial Sequence
  Synthetic
tgtttcggactccacacggagaaattggagctgttagcttggattatcctagtgggacatcgggctcacccatcc

SEQ ID NO: 213179 - DNA, 75 bp, Artificial Sequence
  Synthetic
attgtacgggaatggagttgaacttggagatggctcatatgtgagcgctattgtgcagggtgaacggcaagagga

SEQ ID NO: 213180 - DNA, 75 bp, Artificial Sequence
  Synthetic
ggagatggctcatatgtgagcgctattgtgcagggtgaacggcaagaggagcccatccccgatgcatacaatcca

SEQ ID NO: 213181 - DNA, 75 bp, Artificial Sequence
  Synthetic
ccgtgttggacttgcatccaggatctggaaaaacaaggaaaatcttaccccaaatcatcagggatgccattcaac

SEQ ID NO: 213182 - DNA, 75 bp, Artificial Sequence
  Synthetic
tggaaaaacaaggaaaatcttaccccaaatcatcagggatgccattcaacagcgtctcagaacagctgttctagc

SEQ ID NO: 213183 - DNA, 75 bp, Artificial Sequence
  Synthetic
atggcagaagctcttagaggacttcctgttagataccaaacttcagcggttcagcgagaacatcaggggaatgag

SEQ ID NO: 213184 - DNA, 75 bp, Artificial Sequence
  Synthetic
ctgttagataccaaacttcagcggttcagcgagaacatcaggggaatgagatagttgatgtcatgtgtcacgcca

SEQ ID NO: 213185 - DNA, 75 bp, Artificial Sequence
  Synthetic
aaatcgcgttcccaactacaacttgtttgtcatggatgaggcccatttcactgacccagccagcatcgccgcaag

SEQ ID NO: 213186 - DNA, 75 bp, Artificial Sequence
  Synthetic
tttgtcatggatgaggcccatttcactgacccagccagcatcgccgcaagaggatacatatccaccagagtggaa

SEQ ID NO: 213187 - DNA, 75 bp, Artificial Sequence
  Synthetic
tgactgccactccaccaggaacgactgaccccttccctgactccaacgctcccattcatgatttgcaggacgaga

SEQ ID NO: 213188 - DNA, 75 bp, Artificial Sequence
  Synthetic
tgaccccttccctgactccaacgctcccattcatgatttgcaggacgagatccctgacagagcatggagcagtgg

SEQ ID NO: 213189 - DNA, 75 bp, Artificial Sequence
  Synthetic
ggaaagacagtatggtttgtggcgagtgtgaaaatgggcaacgaaatcgcggtgtgtctacagagagctggaaag

SEQ ID NO: 213190 - DNA, 75 bp, Artificial Sequence
  Synthetic
gtgtgaaaatgggcaacgaaatcgcggtgtgtctacagagagctggaaagagagtcatccagttaaatcggaaat

SEQ ID NO: 213191 - DNA, 75 bp, Artificial Sequence
  Synthetic
taagaatggggattgggactttgtcatcactacggacatttctgaaatgggggccaacttcggagcgagcagagt

SEQ ID NO: 213192 - DNA, 75 bp, Artificial Sequence
  Synthetic
atcactacggacatttctgaaatgggggccaacttcggagcgagcagagtgatcgattgtaggaagagtgtgaaa

SEQ ID NO: 213193 - DNA, 75 bp, Artificial Sequence
  Synthetic
gaagagtcattctcagcaacccatcgcccatcaccagtgcgagtgcagctcaacggagaggcagagtaggcagaa

SEQ ID NO: 213194 - DNA, 75 bp, Artificial Sequence
  Synthetic
gcccatcaccagtgcgagtgcagctcaacggagaggcagagtaggcagaaatccgaaccaggttggagatgagta

SEQ ID NO: 213195 - DNA, 75 bp, Artificial Sequence
  Synthetic
gatgacaccaacctagcacactggacagaagctaagatcatgttggacaacatccacttgccaaatgggttggta

SEQ ID NO: 213196 - DNA, 75 bp, Artificial Sequence
  Synthetic
cagaagctaagatcatgttggacaacatccacttgccaaatgggttggtagctcagctctatggacctgaaaggg

SEQ ID NO: 213197 - DNA, 75 bp, Artificial Sequence
  Synthetic
ctcctaactccgggaatgagggccttgtatctggacacttacagaatcattcttcttgtcataggaatttgttcc

SEQ ID NO: 213198 - DNA, 75 bp, Artificial Sequence
  Synthetic
gtatcgattgaggggtgaggaaaagaagaactttctggagttaatcagaacagccgacctccccgtatggctagc

SEQ ID NO: 213199 - DNA, 75 bp, Artificial Sequence
  Synthetic
aagaactttctggagttaatcagaacagccgacctccccgtatggctagcttacaaagtggcttcaaatggaata

SEQ ID NO: 213200 - DNA, 75 bp, Artificial Sequence
  Synthetic
ttgatggacctcggacgaatgctatcttagaagacagcactgaagtggagataatcaccagaacgggagaaagga

SEQ ID NO: 213201 - DNA, 75 bp, Artificial Sequence
  Synthetic
cttagaagacagcactgaagtggagataatcaccagaacgggagaaaggaagattttaaaaccaagatggttgga

SEQ ID NO: 213202 - DNA, 75 bp, Artificial Sequence
  Synthetic
gctttgaaatggtttaaggactttgcagcaggaaagagatcagctgtcagctttctagaggtgcttgggcgcatg

SEQ ID NO: 213203 - DNA, 75 bp, Artificial Sequence
  Synthetic
cagcaggaaagagatcagctgtcagctttctagaggtgcttgggcgcatgccagaacacttcatggggaaaaccc

SEQ ID NO: 213204 - DNA, 75 bp, Artificial Sequence
  Synthetic
ggttgccacggcagaaaaaggggggaaagctcaccgaatggccttggaggaattgccagatgcactggagacggt

SEQ ID NO: 213205 - DNA, 75 bp, Artificial Sequence
  Synthetic
aaagctcaccgaatggccttggaggaattgccagatgcactggagacggtgacactcatcgcagcgattgtcgta

SEQ ID NO: 213206 - DNA, 75 bp, Artificial Sequence
  Synthetic
tgatgcaacgaaagggcataggaaaaatgggccttggggctctcgtgctcaccctggccacttttttcttgtgga

SEQ ID NO: 213207 - DNA, 75 bp, Artificial Sequence
  Synthetic
aatgggccttggggctctcgtgctcaccctggccacttttttcttgtggatggcagaggtctcagggacgaaaat

SEQ ID NO: 213208 - DNA, 75 bp, Artificial Sequence
  Synthetic
ttgcttatggtggtactcatcccggagccggagaagcaaagatcccaaacggacaaccagttggccgtgtttctg

SEQ ID NO: 213209 - DNA, 75 bp, Artificial Sequence
  Synthetic
agccggagaagcaaagatcccaaacggacaaccagttggccgtgtttctgatctgcgtcctcaccgtagtgggaa

SEQ ID NO: 213210 - DNA, 75 bp, Artificial Sequence
  Synthetic
gctcgaaaagaccaaggaagacataaggaatgtgtttggcaacaaggttcagacatctaatgtacctggaagcct

SEQ ID NO: 213211 - DNA, 75 bp, Artificial Sequence
  Synthetic
aggaatgtgtttggcaacaaggttcagacatctaatgtacctggaagcctatcaagtctggcgctcgatctacga

SEQ ID NO: 213212 - DNA, 75 bp, Artificial Sequence
  Synthetic
gaggcagtacagtgattttaactccactgctgaaacatttgatcacctctgagtatgtgacaacatcactagcct

SEQ ID NO: 213213 - DNA, 75 bp, Artificial Sequence
  Synthetic
actgctgaaacatttgatcacctctgagtatgtgacaacatcactagcctcaatcaactcacaggccggctcact

SEQ ID NO: 213214 - DNA, 75 bp, Artificial Sequence
  Synthetic
tttacggatttggatctgacggttggacttgtctttctgggctgttgggggcaaatcactctcaccacttttctg

SEQ ID NO: 213215 - DNA, 75 bp, Artificial Sequence
  Synthetic
gacttgtctttctgggctgttgggggcaaatcactctcaccacttttctgacagctggagtgttagcagttctgc

SEQ ID NO: 213216 - DNA, 75 bp, Artificial Sequence
  Synthetic
gcaagctgaagccctgagggcagctcagagacggacagctgcgggtatcatgaagaacgccgttgtggatgggat

SEQ ID NO: 213217 - DNA, 75 bp, Artificial Sequence
  Synthetic
cagagacggacagctgcgggtatcatgaagaacgccgttgtggatgggatggttgccactgatgtgcctgaattg

SEQ ID NO: 213218 - DNA, 75 bp, Artificial Sequence
  Synthetic
ggcatcacttacactgacctggcaagatatgtggtgctagttgctgcggctttcgcggaggccaacagtggagga

SEQ ID NO: 213219 - DNA, 75 bp, Artificial Sequence
  Synthetic
gatatgtggtgctagttgctgcggctttcgcggaggccaacagtggaggagatgttctgcacctcgctctgatag

SEQ ID NO: 213220 - DNA, 75 bp, Artificial Sequence
  Synthetic
agaaggtggggcaagtgttgctaataggagtcagtatagcagcttttcttgtcaatcccaatgtcaccaccgtgc

SEQ ID NO: 213221 - DNA, 75 bp, Artificial Sequence
  Synthetic
aggagtcagtatagcagcttttcttgtcaatcccaatgtcaccaccgtgcgagaagccggtgtgctggtgaccgc

SEQ ID NO: 213222 - DNA, 75 bp, Artificial Sequence
  Synthetic
ggagcaagtgccgtctggaattcaactacagctacaggactctgccacgtcatgagaggcagttacttggctggt

SEQ ID NO: 213223 - DNA, 75 bp, Artificial Sequence
  Synthetic
ctacagctacaggactctgccacgtcatgagaggcagttacttggctggtggttcaatagcttggactctcatca

SEQ ID NO: 213224 - DNA, 75 bp, Artificial Sequence
  Synthetic
aagaggaaggcctggaggaagaacgctgggtgagcagtggaaagaaaaattgaacgccatgaacaaagaagagtt

SEQ ID NO: 213225 - DNA, 75 bp, Artificial Sequence
  Synthetic
ctgggtgagcagtggaaagaaaaattgaacgccatgaacaaagaagagtttttcaggtacaggaaagaagccata

SEQ ID NO: 213226 - DNA, 75 bp, Artificial Sequence
  Synthetic
gcagggctagacgagaaaacaacaaagtgggaggtcatcctgtgtcacgaggttcagcaaagcttcgatggatgg

SEQ ID NO: 213227 - DNA, 75 bp, Artificial Sequence
  Synthetic
agtgggaggtcatcctgtgtcacgaggttcagcaaagcttcgatggatggtggagaaagggtttgtctcacctgt

SEQ ID NO: 213228 - DNA, 75 bp, Artificial Sequence
  Synthetic
gggcggggaggatggtgctattatgccgccaccctgaaaaaagtgcaggaagtcaaaggttacacaaaaggaggg

SEQ ID NO: 213229 - DNA, 75 bp, Artificial Sequence
  Synthetic
ccgccaccctgaaaaaagtgcaggaagtcaaaggttacacaaaaggaggggccggacatgaggaaccaatgctga

SEQ ID NO: 213230 - DNA, 75 bp, Artificial Sequence
  Synthetic
cacgatgaagagtggagtggatgtgttctacagaccttcagagcctagtgacaccctgctctgtgacatagggga

SEQ ID NO: 213231 - DNA, 75 bp, Artificial Sequence
  Synthetic
ttctacagaccttcagagcctagtgacaccctgctctgtgacataggggagtcctctccaagtccagacgtcgag

SEQ ID NO: 213232 - DNA, 75 bp, Artificial Sequence
  Synthetic
aaatggcctcagagtggctacaccgaggacccagagaattctgcataaaagttttgtgtccatacatgccaaagg

SEQ ID NO: 213233 - DNA, 75 bp, Artificial Sequence
  Synthetic
aggacccagagaattctgcataaaagttttgtgtccatacatgccaaaggtgatagaaaagatggaaacgctaca

SEQ ID NO: 213234 - DNA, 75 bp, Artificial Sequence
  Synthetic
cgtgttcccctgtcacgcaactcaaatcacgaaatgtactgggttagtggagctgctgggaacgtggtacacgct

SEQ ID NO: 213235 - DNA, 75 bp, Artificial Sequence
  Synthetic
atcacgaaatgtactgggttagtggagctgctgggaacgtggtacacgctgtaaatatgactagtcaagttttgc

SEQ ID NO: 213236 - DNA, 75 bp, Artificial Sequence
  Synthetic
gagaggacccaaatatgaagaagatgtcaacttgggaagcgggaccagagctgtagggaaaggtgaggttcacag

SEQ ID NO: 213237 - DNA, 75 bp, Artificial Sequence
  Synthetic
gtcaacttgggaagcgggaccagagctgtagggaaaggtgaggttcacagtgaccaagggaaaatcaagaagcgg

SEQ ID NO: 213238 - DNA, 75 bp, Artificial Sequence
  Synthetic
cagcaacgtggcacgaggaccctgaacatccataccgcacctggacataccacggaagctatgaagtgaaggcca

SEQ ID NO: 213239 - DNA, 75 bp, Artificial Sequence
  Synthetic
acatccataccgcacctggacataccacggaagctatgaagtgaaggccaccggttcagccagctcccttgttaa

SEQ ID NO: 213240 - DNA, 75 bp, Artificial Sequence
  Synthetic
ccctgggacgctatcactagtgtcaccaccatggccatgactgacactactccctttggtcagcagagagtcttc

SEQ ID NO: 213241 - DNA, 75 bp, Artificial Sequence
  Synthetic
ccaccatggccatgactgacactactccctttggtcagcagagagtcttcaaagaaaaagttgacaccaaggcgc

SEQ ID NO: 213242 - DNA, 75 bp, Artificial Sequence
  Synthetic
agtgctggacgaaaccaccaactggctgtgggcctacttgtcaagagagaaaagaccccgcttgtgtacgagaga

SEQ ID NO: 213243 - DNA, 75 bp, Artificial Sequence
  Synthetic
ctgtgggcctacttgtcaagagagaaaagaccccgcttgtgtacgagagaggagttcatccggaaagtcaacagc

SEQ ID NO: 213244 - DNA, 75 bp, Artificial Sequence
  Synthetic
gccactgatgtgcccgaactggaaagaaccactcctttgatgcaaaagaaagtcggccaagtgctcctcataggg

SEQ ID NO: 213245 - DNA, 75 bp, Artificial Sequence
  Synthetic
ccgagcaaaatcagtggagctcagccagggaggctgttagtgacccggccttctggaacatggtcgacattgaaa

SEQ ID NO: 213246 - DNA, 75 bp, Artificial Sequence
  Synthetic
cagggaggctgttagtgacccggccttctggaacatggtcgacattgaaagagagaatcacctacgaggggagtg

SEQ ID NO: 213247 - DNA, 75 bp, Artificial Sequence
  Synthetic
ggaaagagagagaagaaacctggtgagtttgggaaggctaaaggaagcagagctatctggttcatgtggctcgga

SEQ ID NO: 213248 - DNA, 75 bp, Artificial Sequence
  Synthetic
agtttgggaaggctaaaggaagcagagctatctggttcatgtggctcggagcccgctacctggaattcgaggcac

SEQ ID NO: 213249 - DNA, 75 bp, Artificial Sequence
  Synthetic
gctgagcagggagaactctggaggaggagtggaaggctcaggcatacagaagctagggtacatcttgcgggacat

SEQ ID NO: 213250 - DNA, 75 bp, Artificial Sequence
  Synthetic
ggagtggaaggctcaggcatacagaagctagggtacatcttgcgggacatctcaacgaaatctggagggaaaatg

SEQ ID NO: 213251 - DNA, 75 bp, Artificial Sequence
  Synthetic
aatcccaaccaagttggagatgaatatcattacgggggggccaccagtgaagatgacagcaacttagcccactgg

SEQ ID NO: 213252 - DNA, 75 bp, Artificial Sequence
  Synthetic
acactaggatcacaagggttgatctggacaatgaggcaaaggtgctggaacttctggatggggaacacaggatgt

SEQ ID NO: 213253 - DNA, 75 bp, Artificial Sequence
  Synthetic
ggacaatgaggcaaaggtgctggaacttctggatggggaacacaggatgttggcccgtgccatcatagaattgac

SEQ ID NO: 213254 - DNA, 75 bp, Artificial Sequence
  Synthetic
atgaggccagcagtgggtggaaagaccgtgatggatgtgatctctagagaagaccaaagagggagtgggcaagtg

SEQ ID NO: 213255 - DNA, 75 bp, Artificial Sequence
  Synthetic
ccgtgatggatgtgatctctagagaagaccaaagagggagtgggcaagtggtcacatatgctctcaacaccttca

SEQ ID NO: 213256 - DNA, 75 bp, Artificial Sequence
  Synthetic
gctgatggaggctgaaggagttgtcggtccacaggatgtggagcagctccccaggaaaaccaaattcgcagtcag

SEQ ID NO: 213257 - DNA, 75 bp, Artificial Sequence
  Synthetic
ggtccacaggatgtggagcagctccccaggaaaaccaaattcgcagtcaggacatggctttttgaaaatggagaa

SEQ ID NO: 213258 - DNA, 75 bp, Artificial Sequence
  Synthetic
aacgcacgctgcgcgtcttagaaatgacatctgactggttacatcggggacctagagagttctgcataaaagtgc

SEQ ID NO: 213259 - DNA, 75 bp, Artificial Sequence
  Synthetic
gtggggatgactgcgttgtcaaaccattggatgacagattcgcgcatgctttacatttcttaaatgcgatgtcaa

SEQ ID NO: 213260 - DNA, 75 bp, Artificial Sequence
  Synthetic
attggatgacagattcgcgcatgctttacatttcttaaatgcgatgtcaaaagtgaggaaagacacacaagaatg

SEQ ID NO: 213261 - DNA, 75 bp, Artificial Sequence
  Synthetic
tggcagcaagtccctttctgctcgaaccactttcaggagatcgtgatgaaggatggtagaagccttgttgtgccc

SEQ ID NO: 213262 - DNA, 75 bp, Artificial Sequence
  Synthetic
accactttcaggagatcgtgatgaaggatggtagaagccttgttgtgccctgccggggacaggatgagttaatag

SEQ ID NO: 213263 - DNA, 75 bp, Artificial Sequence
  Synthetic
aggatggaatgtaagagacacagcctgcctagctaaggcctacgcccaaatgtggctcctcctctactttcaccg

SEQ ID NO: 213264 - DNA, 75 bp, Artificial Sequence
  Synthetic
tgcctagctaaggcctacgcccaaatgtggctcctcctctactttcaccggagagacttgcgcctcatggccaac

SEQ ID NO: 213265 - DNA, 75 bp, Artificial Sequence
  Synthetic
actgggtacccacaggtaggacatcatggtcgatacattcaaaaggagaatggatgacaacagaagacatgctgc

SEQ ID NO: 213266 - DNA, 75 bp, Artificial Sequence
  Synthetic
caagcatggcactggacttgcgcccagccacagcttgggcgctgtatggggggagcacagttgtgttaacccctc

SEQ ID NO: 213267 - DNA, 75 bp, Artificial Sequence
  Synthetic
atggtcgatacattcaaaaggagaatggatgacaacagaagacatgctgcaggtgtggaacagggtatggattga

SEQ ID NO: 213268 - DNA, 75 bp, Artificial Sequence
  Synthetic
gggcccacttgtcacgggagaaacgaccccgcttgtgcactaaggaagaattcataaagaaagtcaacagcaacg

SEQ ID NO: 213269 - DNA, 75 bp, Artificial Sequence
  Synthetic
acccccgtcgccagttggaccgacgtcccatacgtcggaaagagggaagacatctggtgcggcagtttgatcgga

SEQ ID NO: 213270 - DNA, 75 bp, Artificial Sequence
  Synthetic
tcccatacgtcggaaagagggaagacatctggtgcggcagtttgatcggaacgcggacaagggccacttgggcag

SEQ ID NO: 213271 - DNA, 75 bp, Artificial Sequence
  Synthetic
agtgagagcaataattggaaatgaaaagtatgtggactacatgacatcacttaggaggtatgaagacactttggt

SEQ ID NO: 213272 - DNA, 75 bp, Artificial Sequence
  Synthetic
aaagagagaaaaaacccggagagttcggaaaggctaaagggagtagggctatctggttcatgtggctcggagctc

SEQ ID NO: 213273 - DNA, 75 bp, Artificial Sequence
  Synthetic
cttttggtaatgattgtaaatagtagcatttattgtaaatagtgtaaataaataaatttaaagagggagtcaggc

SEQ ID NO: 213274 - DNA, 75 bp, Artificial Sequence
  Synthetic
tggaaggttcaggcgtccaaaagctgggatacattctccgtgacatagcagggaagcaaggaggtaaaatgtatg

SEQ ID NO: 213275 - DNA, 75 bp, Artificial Sequence
  Synthetic
gggatacattctccgtgacatagcagggaagcaaggaggtaaaatgtatgccgatgacaccgccgggtgggacac

SEQ ID NO: 213276 - DNA, 75 bp, Artificial Sequence
  Synthetic
cgctaaggagtgcagcctgtacagccccgggaggaccgggtaaacaaagccgatgaggcccccacggcccaaacc

SEQ ID NO: 213277 - DNA, 75 bp, Artificial Sequence
  Synthetic
cagagttacggttggaacctggtctcgctaaagagtggggtggacgtattctacaaaccctcggagcctagtgac

SEQ ID NO: 213278 - DNA, 75 bp, Artificial Sequence
  Synthetic
ctacaaaccctcggagcctagtgacaccctgttctgtgacataggagaatcttccccaagtccagaggtggagga

SEQ ID NO: 213279 - DNA, 75 bp, Artificial Sequence
  Synthetic
gagtgactaggatggcgatcagtggagacgactgcgtcgtcaagccgctggatgacagattcgccacggctctcc

SEQ ID NO: 213280 - DNA, 75 bp, Artificial Sequence
  Synthetic
gtcgtttcggtggcgggctggtgcgccttcccctgtctcgaaactccaaccatgagatgtactgggtgagtggag

SEQ ID NO: 213281 - DNA, 75 bp, Artificial Sequence
  Synthetic
acaacttggcacaaagaccccgagcatccataccgaacttggacctatcacggaagctacgaagtgaaggccact

SEQ ID NO: 213282 - DNA, 75 bp, Artificial Sequence
  Synthetic
cggaagctacgaagtgaaggccactggctcagcaagctctctcgtcaatggggtggtaaagctcatgagcaaacc

SEQ ID NO: 213283 - DNA, 75 bp, Artificial Sequence
  Synthetic
ggagagttcactagtgaataaaaaagaagcttggctggattcaacgaaagccacacgatatctcatgaaaactga

SEQ ID NO: 213284 - DNA, 75 bp, Artificial Sequence
  Synthetic
tggctgctcctatacttccatcggagggacctacgcctcatggcaaatgcaatctgctcagcagttccagtggac

SEQ ID NO: 213285 - DNA, 75 bp, Artificial Sequence
  Synthetic
cttagtatcgttgagaagaatcgagagattagtgcagtttaaacagttttttagaacggaagataaccatgacta

SEQ ID NO: 213286 - DNA, 75 bp, Artificial Sequence
  Synthetic
cttgttggacggcagagggccagtacgtttcgtgctggctcttatcacgttcttcaagtttacagcattagcccc

SEQ ID NO: 213287 - DNA, 75 bp, Artificial Sequence
  Synthetic
tgaagttgtcaaatttccaggggaagcttttgatgaccattaacaacacggacattgcagacgttatcgtgattc

SEQ ID NO: 213288 - DNA, 75 bp, Artificial Sequence
  Synthetic
cggatggttttcgcccaccactatagctgccggactaatggtctgcaacccaaacaagaagagagggtggccagc

SEQ ID NO: 213289 - DNA, 75 bp, Artificial Sequence
  Synthetic
tggtgtgacaaccaagaagtctacgtccaatatggacggtgcacgcggaccaggcattccaagcgaagcaggaga

SEQ ID NO: 213290 - DNA, 75 bp, Artificial Sequence
  Synthetic
gagaagtcacactggactgtgagccaaggagtggactgaacactgaagcgttttacgtcatgaccgtggggtcaa

SEQ ID NO: 213291 - DNA, 75 bp, Artificial Sequence
  Synthetic
tgaagaggcgcacgccacaaaacagtccgttgttgctcttgggtcacaggaaggaggcctccatcaggcgttggc

SEQ ID NO: 213292 - DNA, 75 bp, Artificial Sequence
  Synthetic
aagcaggggtgttggtgacggcggctacgctcactttgtgggacaacggagccagtgccgtttggaattccacca

SEQ ID NO: 213293 - DNA, 75 bp, Artificial Sequence
  Synthetic
tagttggaaggggagacaagcagatcaaccaccattggcacaaagctggaagcacgctgggcaaagccttttcaa

SEQ ID NO: 213294 - DNA, 75 bp, Artificial Sequence
  Synthetic
aacgtcctgctcaaagagaatgcagtggacctcagtgtggttgtgaacaagcccgtggggagatatcgctcagcc

SEQ ID NO: 213295 - DNA, 75 bp, Artificial Sequence
  Synthetic
cattccgcataccatagccggaccaaaaagcaagcacaatcggagggaagggtataagacacaaaaccagggacc

SEQ ID NO: 213296 - DNA, 75 bp, Artificial Sequence
  Synthetic
catgaagttgtcaaatttccaggggaagcttttgatgaccatcaacaacacggacattgcagacgttatcgtgat

SEQ ID NO: 213297 - DNA, 75 bp, Artificial Sequence
  Synthetic
atgtggtgctagtcgctgctgctttcgcagaggccaacagtggaggagacgtcctgcaccttgctttgattgccg

SEQ ID NO: 213298 - DNA, 75 bp, Artificial Sequence
  Synthetic
ggaaaagcaacagatatgtggcttgaacgggccgccgacatcagctgggagatggatgctgcaatcacaggaagc

SEQ ID NO: 213299 - DNA, 75 bp, Artificial Sequence
  Synthetic
tacgtcaccacatcgctagcctcaattaactcacaagctggctcattattcgtcttgccacgaggcgtgcctttt

SEQ ID NO: 213300 - DNA, 75 bp, Artificial Sequence
  Synthetic
gtgcagggtgaccgtcaggaggaaccagtcccagaagcttacaccccaaacatgttgagaaagagacagatgact

SEQ ID NO: 213301 - DNA, 75 bp, Artificial Sequence
  Synthetic
cgacgcgggtggtagcagcagaaatggcagaagctttgagagggctcccagtacgatatcaaacttcagcagtgc

SEQ ID NO: 213302 - DNA, 75 bp, Artificial Sequence
  Synthetic
ggtcatccaactcaaccgcaagtcctatgacacagaatacccaaaatgtaagaatggagactgggattttgtcat

SEQ ID NO: 213303 - DNA, 75 bp, Artificial Sequence
  Synthetic
agaatggagactgggattttgtcatcaccaccgacatctctgaaatgggggccaacttcggtgcgagcagggtca

SEQ ID NO: 213304 - DNA, 75 bp, Artificial Sequence
  Synthetic
tcatagaggtgctcggtcgtatgcctgagcatttcatgggaaagacgcgggaagctttagacaccatgtacttgg

SEQ ID NO: 213305 - DNA, 75 bp, Artificial Sequence
  Synthetic
gaagctttagacaccatgtacttggttgcaacggctgagaaaggtgggaaagcacaccgaatggctctcgaagag

SEQ ID NO: 213306 - DNA, 75 bp, Artificial Sequence
  Synthetic
tccattgcttggactctcatcaagaacgctgataagccctccttgaaaaggggaagcctgggggcaggacgccta

SEQ ID NO: 213307 - DNA, 75 bp, Artificial Sequence
  Synthetic
gccatgagcagagaagagttttttaaataccggagagaggccataatcgaggtggaccgcactgaagcacgcagg

SEQ ID NO: 213308 - DNA, 75 bp, Artificial Sequence
  Synthetic
gagatgtattgggttagtggagccgctggcaatgtggtgcacgctgtgaacatgaccagccaggtactactgggg

SEQ ID NO: 213309 - DNA, 75 bp, Artificial Sequence
  Synthetic
aggagaaaatcaagaagagaatccagaagcttaaagaagaattcgccacaacgtggcacaaagaccctgagcatc

SEQ ID NO: 213310 - DNA, 75 bp, Artificial Sequence
  Synthetic
cacaggccatggaacagttgtcattgagctcacatactctggaagtgatggtccctgcaaaattccgattgtctc

SEQ ID NO: 213311 - DNA, 75 bp, Artificial Sequence
  Synthetic
tcataaagaaagtcaatagcaacgcggctcttggagcagtgttcgctgaacagaatcaatggagcacggcgcgtg

SEQ ID NO: 213312 - DNA, 75 bp, Artificial Sequence
  Synthetic
ggaaggctcaggcgtccaaaagctgggatacatcctccgtgacatagcaggaaagcaaggagggaaaatgtacgc

SEQ ID NO: 213313 - DNA, 75 bp, Artificial Sequence
  Synthetic
aaaaacaagatagctgtcaggacctggctctttgagaatggagaggagagagtgaccaggatggcgatcagcgga

SEQ ID NO: 213314 - DNA, 75 bp, Artificial Sequence
  Synthetic
ccagaagctcaaagaggaattcgccacaacctggcacaaagatcccgagcatccataccgaacttggacctatca

SEQ ID NO: 213315 - DNA, 75 bp, Artificial Sequence
  Synthetic
tgagggccgtcattggaaaagaaaattatgttgattacatgacttccctcagaagatatgaggatgtattgattc

SEQ ID NO: 213316 - DNA, 75 bp, Artificial Sequence
  Synthetic
agatgacagcaacctggcccactggacagaggcaaaaattatgctagacaacatacacatgcccaatggactagt

SEQ ID NO: 213317 - DNA, 75 bp, Artificial Sequence
  Synthetic
agctttaactgtctgggaatggggaatcgggatttcatagaaggagccagtggagccacttgggtggatctggtg

SEQ ID NO: 213318 - DNA, 75 bp, Artificial Sequence
  Synthetic
gttactgctatcacgcttcagtcactgacatttcaacggtggctcgatgccccacgactggagaagcccacaacg

SEQ ID NO: 213319 - DNA, 75 bp, Artificial Sequence
  Synthetic
tcaataaccctcaagcttggtgattatggagaagtcacactggattgtgaaccaaggagtggactgaacactgaa

SEQ ID NO: 213320 - DNA, 75 bp, Artificial Sequence
  Synthetic
gtgcgatttgtgctggctcttatcacgttcttcaagtttacagcattagccccgaccaaggcgcttttgggccgc

SEQ ID NO: 213321 - DNA, 75 bp, Artificial Sequence
  Synthetic
gcacgagaccggtcaatcgccctggcttttctggccacgggaggtgtgctcgtgtttttagcgaccaatgtgcat

SEQ ID NO: 213322 - DNA, 75 bp, Artificial Sequence
  Synthetic
cttttctggccacgggaggtgtgctcgtgtttttagcgaccaatgtgcatgccgacactggctgtgccattgaca

SEQ ID NO: 213323 - DNA, 75 bp, Artificial Sequence
  Synthetic
gatccgtcactagattggaacaccagatgtgggaatctgtgcgggacgaactgaatgtcttgctcaaagagaacg

SEQ ID NO: 213324 - DNA, 75 bp, Artificial Sequence
  Synthetic
tgccgatgacaccgccgggtgggacaccagaattactagaactgacttggaaaatgaagccaaagtgctggagct

SEQ ID NO: 213325 - DNA, 75 bp, Artificial Sequence
  Synthetic
agtagccggaggctagatgttaagttggatgacgacggcgactttcacttgattgatgatcccggtgttccatgg

SEQ ID NO: 213326 - DNA, 75 bp, Artificial Sequence
  Synthetic
aaaggggacaccaccacaggagtttaccgaattatggccagggggattctcggcacttaccaggccggcgttgga

SEQ ID NO: 213327 - DNA, 75 bp, Artificial Sequence
  Synthetic
tccctgctcactggaagttgaaagaccaacgtcaggccacaattttgtgccactccgctggggagtgcggcctgc

SEQ ID NO: 213328 - DNA, 75 bp, Artificial Sequence
  Synthetic
attcgtgatggatgaggctcacttcactgacccagctagcatcgccgctcggggttatattgcgaccaaggtgga

SEQ ID NO: 213329 - DNA, 75 bp, Artificial Sequence
  Synthetic
gttgctgatggtggtcctcatcccggaaccagaaaaacagaggtcacagacagacaaccagttggcagtgtttct

SEQ ID NO: 213330 - DNA, 75 bp, Artificial Sequence
  Synthetic
cgttaaagagtggggtggacgtattctacaaaccctcggagcctagtgacaccctgttctgtgacataggagaat

SEQ ID NO: 213331 - DNA, 75 bp, Artificial Sequence
  Synthetic
gcgatccagggcaacatgggctgagaacatctacgcggcaataaaccaagtgagggccatcattggaaaagaaaa

SEQ ID NO: 213332 - DNA, 75 bp, Artificial Sequence
  Synthetic
gttcttcaagtttacagcattagccccgaccaaggcgcttttaggccgatggaaagcagtggaaaagagtgtggc

SEQ ID NO: 213333 - DNA, 75 bp, Artificial Sequence
  Synthetic
tgctgggttcgggcgatagacgtcggctacatgtgtgaggacaccatcacgtatgaatgtcccaagcttaccatg

SEQ ID NO: 213334 - DNA, 75 bp, Artificial Sequence
  Synthetic
ttactgctatcatgcctcagtcactgacatctcgacggtggctcggtgccctacgactggagaagcccacaacga

SEQ ID NO: 213335 - DNA, 75 bp, Artificial Sequence
  Synthetic
actggtcacggaacagttgtcattgaactttcatactctgggagtgatggcccctgcaagattccgattgtctcc

SEQ ID NO: 213336 - DNA, 75 bp, Artificial Sequence
  Synthetic
ggtggggcaacggatgtggactcttcgggaaggggagcattgacacatgtgcaaaattctcctgtactagcaaag

SEQ ID NO: 213337 - DNA, 75 bp, Artificial Sequence
  Synthetic
aaacatcaaatacgaagttggcatttttgtgcatggaaccaccacttcagaaaaccatgggaattattcagcgca

SEQ ID NO: 213338 - DNA, 75 bp, Artificial Sequence
  Synthetic
agtccgttgttgctcttgggtcacaggaaggaggcctccatcaggcgctggcaggggccattgtggtggagtact

SEQ ID NO: 213339 - DNA, 75 bp, Artificial Sequence
  Synthetic
ccacctgaaatgcaggctaaaaatggacaaactggccctgaaaggcacaacctatggcatgtgcacagaaaaatt

SEQ ID NO: 213340 - DNA, 75 bp, Artificial Sequence
  Synthetic
cccctgcaaaattccgattgtctccgttgcgagccttaatgacatgactcccgttgggcggctggtgacagtgaa

SEQ ID NO: 213341 - DNA, 75 bp, Artificial Sequence
  Synthetic
ccctgggatgagaatggcatagtcttggactttgattactgtccagggacaaaagtcaccattacagaggattgt

SEQ ID NO: 213342 - DNA, 75 bp, Artificial Sequence
  Synthetic
tgtggttgggaggggagacaagcagattaaccaccattggcacaaagctggaagcacgctaggcaaggccttttc

SEQ ID NO: 213343 - DNA, 75 bp, Artificial Sequence
  Synthetic
agtggcatctttgtgcataacgacgtggaagcctgggtggacaggtacaagtacttgccagaaacgcccagatcc

SEQ ID NO: 213344 - DNA, 75 bp, Artificial Sequence
  Synthetic
agtggaccttagtgtggttgtgaacaagcccgtgggaagatatcgctcagcccctaaacgtctttccatgacgca

SEQ ID NO: 213345 - DNA, 75 bp, Artificial Sequence
  Synthetic
gcactgatgagtgtgatggagcgatcataggcacggctgtcaaaggaaatgtggcagtccatagtgacctgtcgt

SEQ ID NO: 213346 - DNA, 75 bp, Artificial Sequence
  Synthetic
cgccgctatagcgtggatgattgttcgagcgatcaccttccccacaacctcctccgtcaccatgccaatcttagc

SEQ ID NO: 213347 - DNA, 75 bp, Artificial Sequence
  Synthetic
cagcagggaagagatcagccattagcttcatagaggtccgtggtcgcatgcccgagcatttcatgggaaagacgc

SEQ ID NO: 213348 - DNA, 75 bp, Artificial Sequence
  Synthetic
ctatacttagacacttatagaatcatccttctcgtcataggggtttgttccctgctgcaagagaggagaaagacc

SEQ ID NO: 213349 - DNA, 75 bp, Artificial Sequence
  Synthetic
cctgctgcaagagaggagaaagaccatggcaaaaaagaaaggagctgtactcatgggcttagcgctcacatccac

SEQ ID NO: 213350 - DNA, 75 bp, Artificial Sequence
  Synthetic
gggccaacttcggtgcgagcagggtcatcgactgtaggaagagcgtgaagcccaccatcttagaagagggagaag

SEQ ID NO: 213351 - DNA, 75 bp, Artificial Sequence
  Synthetic
gcagtcggaggctggatgtgaaactggatgatgacggagattttcacttgattgatgatcccggtgttccatgga

SEQ ID NO: 213352 - DNA, 75 bp, Artificial Sequence
  Synthetic
aggtctgggtcctgcgcatgtcttgcattggcttagccgccctcacgccctgggccatcgttcccgctgctttcg

SEQ ID NO: 213353 - DNA, 75 bp, Artificial Sequence
  Synthetic
tgtttcggactcccttcggggaggttggggctgtcagtctggattacccgcgaggcacgtccggctcacccattc

SEQ ID NO: 213354 - DNA, 75 bp, Artificial Sequence
  Synthetic
tgacagcgaccccgcctggaaccacggatccttttcctgattcaaatgccccaatccatgatttgcaagatgaga

SEQ ID NO: 213355 - DNA, 75 bp, Artificial Sequence
  Synthetic
ccaatccatgatttgcaagatgagataccagacagggcatggagcagtggatacgaatggatcacagaatatgcg

SEQ ID NO: 213356 - DNA, 75 bp, Artificial Sequence
  Synthetic
cctatgacacagaatacccaaaatgtaagaatggagactgggactttgtcatcaccaccgacatctctgaaatgg

SEQ ID NO: 213357 - DNA, 75 bp, Artificial Sequence
  Synthetic
cattgactgtagaaagagtgtgaaacctaccatcttagaagagggagaaggcagagttatcctcggaaacccatc

SEQ ID NO: 213358 - DNA, 75 bp, Artificial Sequence
  Synthetic
catacacatgcccaatggactggtggcccaactctatggaccagaaagggaaaaggctttcacaatggacggcga

SEQ ID NO: 213359 - DNA, 75 bp, Artificial Sequence
  Synthetic
cgagggacatccggctcacccattctggattccaatggagacatcataggcctatacggcaatggagttgagctt

SEQ ID NO: 213360 - DNA, 75 bp, Artificial Sequence
  Synthetic
tgccagagtttatgcagatcaccaagccctcaagtggttcaaagactttgcagctggaaagagatcagccattag

SEQ ID NO: 213361 - DNA, 75 bp, Artificial Sequence
  Synthetic
aaagcacaccgaatggctctcgaagagctgccagatgcattggaaaccatcacacttattgttgccattactgtg

SEQ ID NO: 213362 - DNA, 75 bp, Artificial Sequence
  Synthetic
atgacaggaggattcttcctactaatgatgcagcgaaagggtatagggaagatgggtcttggagctctagtgctc

SEQ ID NO: 213363 - DNA, 75 bp, Artificial Sequence
  Synthetic
tggtggcagcaaatgagtacgggatgctagaaaaaaccaaagcagatctcaagagcatgtttgccggaaagacgc

SEQ ID NO: 213364 - DNA, 75 bp, Artificial Sequence
  Synthetic
tctgaagcacctgatcacgtctgaatacgtcaccacatcgctagcctcaattaactcacaagctggctcattatt

SEQ ID NO: 213365 - DNA, 75 bp, Artificial Sequence
  Synthetic
tgtgggggtgaagagggtaataatgaacttgctggacggcagagggccaatacgattcgttttggctctcttggc

SEQ ID NO: 213366 - DNA, 75 bp, Artificial Sequence
  Synthetic
gtttttcaagttcacagcattggccccaactaaggcacttattagccgatggaaagcagtagagaagagcgtcgc

SEQ ID NO: 213367 - DNA, 75 bp, Artificial Sequence
  Synthetic
aaggaactgggaacgctcatcaacgctgtgaataagaggggcaaaaaacaaaacaaaagaggaggaagtaatgga

SEQ ID NO: 213368 - DNA, 75 bp, Artificial Sequence
  Synthetic
ctgtgaataagaggggcaaaaaacaaaacaaaagaggaggaagtaatggaacaattatttggatgataggtttgg

SEQ ID NO: 213369 - DNA, 75 bp, Artificial Sequence
  Synthetic
aagtcggacaggtgctcctcataggggtgagcgtagcagcgttccttgtcaaccctaatgtcaccactgtgagag

SEQ ID NO: 213370 - DNA, 75 bp, Artificial Sequence
  Synthetic
agtcaagctgtcaaactttcagggcaaggtgctgatgacaatcaataacaccgacgtggctgatgtgatcaccat

SEQ ID NO: 213371 - DNA, 75 bp, Artificial Sequence
  Synthetic
tgttgggttcgggcaatagatgtgggacacatgtgcgaggacacaatcacctacgaatgccctaaacttgatgct

SEQ ID NO: 213372 - DNA, 75 bp, Artificial Sequence
  Synthetic
gcgaggtagctacttggctggaggctccattgcttggactctcatcaagaacgcggataagccctccttgaagag

SEQ ID NO: 213373 - DNA, 75 bp, Artificial Sequence
  Synthetic
gttggtgcgacaaacaagccgtgtatgtccagtatgggcgttgcacgaggaccaggcactccaggagaagtagaa

SEQ ID NO: 213374 - DNA, 75 bp, Artificial Sequence
  Synthetic
gatctgtgtcagtgcaaacccacggagaaagctccctagtgaacaaaaaagaagcttggatggattcgacgaaag

SEQ ID NO: 213375 - DNA, 75 bp, Artificial Sequence
  Synthetic
agaaagctccctagtgaacaaaaaagaagcttggatggattcgacgaaagccacgcggtatctcatgaaaacaga

SEQ ID NO: 213376 - DNA, 75 bp, Artificial Sequence
  Synthetic
tatgctctcgtggcagtggcactcggatggatgcttggcagcaacaacggccagcgtgtggtgttcacaattctc

SEQ ID NO: 213377 - DNA, 75 bp, Artificial Sequence
  Synthetic
gatggatgcttggcagcaacaacggccagcgtgtggtgttcacaattctcttgttgttggtcgcacccgcataca

SEQ ID NO: 213378 - DNA, 75 bp, Artificial Sequence
  Synthetic
ccgcgacttcattgaaggagtcagcggagccacgtgggtagacctggtgctggaaggagacagttgcctcaccat

SEQ ID NO: 213379 - DNA, 75 bp, Artificial Sequence
  Synthetic
ggagccacgtgggtagacctggtgctggaaggagacagttgcctcaccatcatggcgaacgataaaccaacactg

SEQ ID NO: 213380 - DNA, 75 bp, Artificial Sequence
  Synthetic
ccacgcaactggctgaagtacgaacctattgctaccacgctacagtggctgacatttcaacagtagcaagatgcc

SEQ ID NO: 213381 - DNA, 75 bp, Artificial Sequence
  Synthetic
ctattgctaccacgctacagtggctgacatttcaacagtagcaagatgccccacgactggagaagcccacaacac

SEQ ID NO: 213382 - DNA, 75 bp, Artificial Sequence
  Synthetic
tgcaagcaaggctatacagaccgtggatggggaaacggatgcgggttgtttgggaaaggcagcattgacacatgc

SEQ ID NO: 213383 - DNA, 75 bp, Artificial Sequence
  Synthetic
gatggggaaacggatgcgggttgtttgggaaaggcagcattgacacatgcgctaaatttgtctgcagccacaagg

SEQ ID NO: 213384 - DNA, 75 bp, Artificial Sequence
  Synthetic
aaatatcaaatatgaagttggagtatttgtccatggaaccacaacagccgagaaccatggaaactactccgctca

SEQ ID NO: 213385 - DNA, 75 bp, Artificial Sequence
  Synthetic
tttgtccatggaaccacaacagccgagaaccatggaaactactccgctcagattggagcttcccaggctgccaag

SEQ ID NO: 213386 - DNA, 75 bp, Artificial Sequence
  Synthetic
ccatcaccctgaagcttggggactacggagaagtcacaatggattgcgagcctcgtagtggatttaacactgaag

SEQ ID NO: 213387 - DNA, 75 bp, Artificial Sequence
  Synthetic
cggagaagtcacaatggattgcgagcctcgtagtggatttaacactgaagcattttatgtgctgaccgttgggac

SEQ ID NO: 213388 - DNA, 75 bp, Artificial Sequence
  Synthetic
tggtttaatgatttggcgcttccatggctgtctccatctagcacaaactggagaaacagagagatcttgctggaa

SEQ ID NO: 213389 - DNA, 75 bp, Artificial Sequence
  Synthetic
ggctgtctccatctagcacaaactggagaaacagagagatcttgctggaatttgaagaagcccacgcgacgaaac

SEQ ID NO: 213390 - DNA, 75 bp, Artificial Sequence
  Synthetic
agagggagctctacaccaggctctggctggcgccatagtggtggagtattctagctcagtgaagttaacttctgg

SEQ ID NO: 213391 - DNA, 75 bp, Artificial Sequence
  Synthetic
gctggcgccatagtggtggagtattctagctcagtgaagttaacttctggccacctcaaatgtagactaaaaatg

SEQ ID NO: 213392 - DNA, 75 bp, Artificial Sequence
  Synthetic
cctatggcatgtgcacagagaagttctccttttcgaaaaacccagctgacactggtcatggcacggtcgtcatag

SEQ ID NO: 213393 - DNA, 75 bp, Artificial Sequence
  Synthetic
ctccttttcgaaaaacccagctgacactggtcatggcacggtcgtcatagaattgcagtacactggcactgatgg

SEQ ID NO: 213394 - DNA, 75 bp, Artificial Sequence
  Synthetic
gtggccagcctgaatgatttgactccagttggcagattggtgacagtcaatccttttgttgccacatccactgcc

SEQ ID NO: 213395 - DNA, 75 bp, Artificial Sequence
  Synthetic
cagttggcagattggtgacagtcaatccttttgttgccacatccactgccaactcgaaagttttggtggaacttg

SEQ ID NO: 213396 - DNA, 75 bp, Artificial Sequence
  Synthetic
tgttgttgggagaggagacaagcagattaaccaccattggcacaaggcaggcagttcgctgggaaaggcttttac

SEQ ID NO: 213397 - DNA, 75 bp, Artificial Sequence
  Synthetic
attaaccaccattggcacaaggcaggcagttcgctgggaaaggcttttaccactaccctgaaaggtgcccagagg

SEQ ID NO: 213398 - DNA, 75 bp, Artificial Sequence
  Synthetic
gtggaaggctcaggcgtccaaaagctgggatacattctccgtgacatagcaggaaagcaaggagggaaaatgtat

SEQ ID NO: 213399 - DNA, 75 bp, Artificial Sequence
  Synthetic
aaatgaagctaaggtgctggagctcctagacggtgaacaccgcatgctcgcccgagccataattgaactgactta

SEQ ID NO: 213400 - DNA, 75 bp, Artificial Sequence
  Synthetic
gggattttgggtccattggaggagtttttaattccattggcaaggccgtgcaccaggtgtttggaggagctttta

SEQ ID NO: 213401 - DNA, 75 bp, Artificial Sequence
  Synthetic
ttttaattccattggcaaggccgtgcaccaggtgtttggaggagcttttagaacactttttggtggcatgtcttg

SEQ ID NO: 213402 - DNA, 75 bp, Artificial Sequence
  Synthetic
ctgctgctgtggatgggtatcaatgcgcgagaccggtcgatcgcactggcctttcttgctacaggaggcgtgctc

SEQ ID NO: 213403 - DNA, 75 bp, Artificial Sequence
  Synthetic
cgcgagaccggtcgatcgcactggcctttcttgctacaggaggcgtgctcttgtttctggctaccaatgtccacg

SEQ ID NO: 213404 - DNA, 75 bp, Artificial Sequence
  Synthetic
gactaggaaagaaatgaggtgcggcagtggcatatttgtgcacaatgatgtggaggcttgggtggacagatacaa

SEQ ID NO: 213405 - DNA, 75 bp, Artificial Sequence
  Synthetic
agtggcatatttgtgcacaatgatgtggaggcttgggtggacagatacaagtatttgcctgagacccccaagtct

SEQ ID NO: 213406 - DNA, 75 bp, Artificial Sequence
  Synthetic
ataaggaaggcatttgcggagtgagatcagtcaccaggctggaacatcaaatgtgggaagccgtcagagatgagt

SEQ ID NO: 213407 - DNA, 75 bp, Artificial Sequence
  Synthetic
atcagtcaccaggctggaacatcaaatgtgggaagccgtcagagatgagttaaatgtcctactgaaggagaacgc

SEQ ID NO: 213408 - DNA, 75 bp, Artificial Sequence
  Synthetic
tcagaaaagatatccaggaatggaagccctcgcatggctggcacgactggcagcaagttcccttctgctctaacc

SEQ ID NO: 213409 - DNA, 75 bp, Artificial Sequence
  Synthetic
aaaccagtgggaagataccgaccagcgccactgcggctatccatgacccaggaaaagtttgagatgggttggaaa

SEQ ID NO: 213410 - DNA, 75 bp, Artificial Sequence
  Synthetic
cgccactgcggctatccatgacccaggaaaagtttgagatgggttggaaagcatgggggaagagcattctctttg

SEQ ID NO: 213411 - DNA, 75 bp, Artificial Sequence
  Synthetic
tgtgattgacggacccgaaaccaaagagtgtccagacgagcgcagagcatggaacagcatgcagattgaagactt

SEQ ID NO: 213412 - DNA, 75 bp, Artificial Sequence
  Synthetic
ggttactcctatacttccatcgtagggacttgcgtctcatggcaaatgcgatttgctcagcagtgccagtggact

SEQ ID NO: 213413 - DNA, 75 bp, Artificial Sequence
  Synthetic
gagtgtccagacgagcgcagagcatggaacagcatgcagattgaagactttgggtttggcatcacgtcgactcga

SEQ ID NO: 213414 - DNA, 75 bp, Artificial Sequence
  Synthetic
gcacggatgaatgtgatggcgccatcattggcacggccgtcaaaggaaatatggcggtgcacagtgacttgtcat

SEQ ID NO: 213415 - DNA, 75 bp, Artificial Sequence
  Synthetic
cattggcacggccgtcaaaggaaatatggcggtgcacagtgacttgtcatactggattgaaagccatctcaatga

SEQ ID NO: 213416 - DNA, 75 bp, Artificial Sequence
  Synthetic
tttggagagattaaatcgtgcacctggccagaaacacacacgctttggggagatggtgttgaggaaagtgagtta

SEQ ID NO: 213417 - DNA, 75 bp, Artificial Sequence
  Synthetic
ggccagaaacacacacgctttggggagatggtgttgaggaaagtgagttaataataccacacacgctcgcaggac

SEQ ID NO: 213418 - DNA, 75 bp, Artificial Sequence
  Synthetic
ggggtataaaacacagaaccaaggaccatgggatgagagtgaaatcacccttgactttgactactgtccggggac

SEQ ID NO: 213419 - DNA, 75 bp, Artificial Sequence
  Synthetic
ccatgggatgagagtgaaatcacccttgactttgactactgtccggggacaacagttaccattgctgaaggatgt

SEQ ID NO: 213420 - DNA, 75 bp, Artificial Sequence
  Synthetic
ccaccactgacagcgggaaattaatcactgattggtgctgtaggagctgtactttgcccccgctgagatttagaa

SEQ ID NO: 213421 - DNA, 75 bp, Artificial Sequence
  Synthetic
cagccagtggctgctggtatggaatggaaatccggcccatgaagcatgacgaatccacgcttgtgaagtcacaag

SEQ ID NO: 213422 - DNA, 75 bp, Artificial Sequence
  Synthetic
gtgatctttctggccacccaggaggtccttcgcaagaggtggacggccagactaacgatccctgcggttttgggg

SEQ ID NO: 213423 - DNA, 75 bp, Artificial Sequence
  Synthetic
gcatcacctacactgatctggtgagatatgtggtactagtggctgctgccttcgctgaagctaacaatggaggag

SEQ ID NO: 213424 - DNA, 75 bp, Artificial Sequence
  Synthetic
atatgtggtactagtggctgctgccttcgctgaagctaacaatggaggagatgtggtccacttggctctgatcgc

SEQ ID NO: 213425 - DNA, 75 bp, Artificial Sequence
  Synthetic
ctagtcatgagcatagcaagtaccaattggactaaccaggagaacattgctttagtgctaggagctgctttcttt

SEQ ID NO: 213426 - DNA, 75 bp, Artificial Sequence
  Synthetic
attggactaaccaggagaacattgctttagtgctaggagctgctttctttcagatggcttcaacggacttggagt

SEQ ID NO: 213427 - DNA, 75 bp, Artificial Sequence
  Synthetic
agcggcgacggcctggatggtggtgcgggcgattacgttccccacgacctccaccatcacgatgcccattctagc

SEQ ID NO: 213428 - DNA, 75 bp, Artificial Sequence
  Synthetic
cgggcgattacgttccccacgacctccaccatcacgatgcccattctagctttgttggcaccaggaatgagagct

SEQ ID NO: 213429 - DNA, 75 bp, Artificial Sequence
  Synthetic
ttctgctcatcattggagtctgtgctctgctgcatgaaaggaagaaaactatggcaaaaaagaaaggtgctgtcc

SEQ ID NO: 213430 - DNA, 75 bp, Artificial Sequence
  Synthetic
tctgctgcatgaaaggaagaaaactatggcaaaaaagaaaggtgctgtcctcttaggcctggccctcagttctac

SEQ ID NO: 213431 - DNA, 75 bp, Artificial Sequence
  Synthetic
gctgctgggctcatggcttgcaacccaaacaagaaaagaggatggccagcgacagaattcctgtctgcaattggg

SEQ ID NO: 213432 - DNA, 75 bp, Artificial Sequence
  Synthetic
caaacaagaaaagaggatggccagcgacagaattcctgtctgcaattgggctaatgtttgccattgttgggggtc

SEQ ID NO: 213433 - DNA, 75 bp, Artificial Sequence
  Synthetic
ggcaataccttttatgttagctggacttatggcagtgtcgtatgtggtgtcaggaaaagcaacagacatgtggtt

SEQ ID NO: 213434 - DNA, 75 bp, Artificial Sequence
  Synthetic
cttatggcagtgtcgtatgtggtgtcaggaaaagcaacagacatgtggttggaacgcgcagccgacattagttgg

SEQ ID NO: 213435 - DNA, 75 bp, Artificial Sequence
  Synthetic
gcagccagaggttggatgtcaaattggatgacgatggagatttccatcttattgatgacccaggcgtcccatgga

SEQ ID NO: 213436 - DNA, 75 bp, Artificial Sequence
  Synthetic
ggatgacgatggagatttccatcttattgatgacccaggcgtcccatggaaaatttgggtattgcgcatgtcttg

SEQ ID NO: 213437 - DNA, 75 bp, Artificial Sequence
  Synthetic
tgggccattataccagcagcttttggatactggctgaccctgaaaaccacgaagaggggaggcgtcttctgggac

SEQ ID NO: 213438 - DNA, 75 bp, Artificial Sequence
  Synthetic
gatactggctgaccctgaaaaccacgaagaggggaggcgtcttctgggacacaccatctcccaaagtctacgcaa

SEQ ID NO: 213439 - DNA, 75 bp, Artificial Sequence
  Synthetic
ggaagttgaaagaccaacgtcaggccacaaatttgtgccactccgctggggggtgcggcctgcgcagccccagga

SEQ ID NO: 213440 - DNA, 75 bp, Artificial Sequence
  Synthetic
caggataatggcgcgagggatccttggcgtctaccaagcaggcgtcggagtgatgtatgagaacgtgttccacac

SEQ ID NO: 213441 - DNA, 75 bp, Artificial Sequence
  Synthetic
ggcgtctaccaagcaggcgtcggagtgatgtatgagaacgtgttccacactctctggcacacgactagaggagcc

SEQ ID NO: 213442 - DNA, 75 bp, Artificial Sequence
  Synthetic
taacaccgtactggggaagtgtcaaggaagaccgcataacttatgggggtccatggagattcgaccgaaaatgga

SEQ ID NO: 213443 - DNA, 75 bp, Artificial Sequence
  Synthetic
ggaagaccgcataacttatgggggtccatggagattcgaccgaaaatggaatggagtggatgacgtgcagatgat

SEQ ID NO: 213444 - DNA, 75 bp, Artificial Sequence
  Synthetic
gtgaacgtccaaacaaaaccaggagtgttccggaccccgcacggagagatcggagctgtcagcttagattatcct

SEQ ID NO: 213445 - DNA, 75 bp, Artificial Sequence
  Synthetic
tgttccggaccccgcacggagagatcggagctgtcagcttagattatcctagtgggacatcaggctcacccatcc

SEQ ID NO: 213446 - DNA, 75 bp, Artificial Sequence
  Synthetic
attgtatggaaacggagttgaacttggagatggctcatatgtaagcgccattgtgcagggtgaacgtcaagagga

SEQ ID NO: 213447 - DNA, 75 bp, Artificial Sequence
  Synthetic
ggagatggctcatatgtaagcgccattgtgcagggtgaacgtcaagaggaacccgtccctgatgcatacaatcca

SEQ ID NO: 213448 - DNA, 75 bp, Artificial Sequence
  Synthetic
cagtgttggacctgcatccaggatcgggcaaaacaaggaaaattttgccccaaatcatcagggatgctattcaac

SEQ ID NO: 213449 - DNA, 75 bp, Artificial Sequence
  Synthetic
gggcaaaacaaggaaaattttgccccaaatcatcagggatgctattcaacaacgcctcagaacagctgttttggc

SEQ ID NO: 213450 - DNA, 75 bp, Artificial Sequence
  Synthetic
atggcagaagctctgagaggactccccgtcagataccaaacttcagcggtccagcgggaacaccagggaaatgag

SEQ ID NO: 213451 - DNA, 75 bp, Artificial Sequence
  Synthetic
ccgtcagataccaaacttcagcggtccagcgggaacaccagggaaatgagatagttgatgtcatgtgtcatgcca

SEQ ID NO: 213452 - DNA, 75 bp, Artificial Sequence
  Synthetic
aaaccgcgttcccaattacaacttgttcgttatggatgaggctcacttcactgacccagctagcattgctgcaag

SEQ ID NO: 213453 - DNA, 75 bp, Artificial Sequence
  Synthetic
ttcgttatggatgaggctcacttcactgacccagctagcattgctgcaagaggatacatatctaccaaagtggaa

SEQ ID NO: 213454 - DNA, 75 bp, Artificial Sequence
  Synthetic
tgactgccactccacccggaacgactgacccgttcccggactccaatgctcccattcatgatttgcaggacgaaa

SEQ ID NO: 213455 - DNA, 75 bp, Artificial Sequence
  Synthetic
tgacccgttcccggactccaatgctcccattcatgatttgcaggacgaaatccctgacagagcatggagcagtgg

SEQ ID NO: 213456 - DNA, 75 bp, Artificial Sequence
  Synthetic
ggcaagacagtatggtttgtggcgagcgtaaaaatgggcaatgaaatcgcagtgtgcttacagagagctgggaag

SEQ ID NO: 213457 - DNA, 75 bp, Artificial Sequence
  Synthetic
gcgtaaaaatgggcaatgaaatcgcagtgtgcttacagagagctgggaagagggtcatccagttgaatcggaaat

SEQ ID NO: 213458 - DNA, 75 bp, Artificial Sequence
  Synthetic
taagaatggggattgggattttgtcatcaccacggacatttctgagatgggggccaacttcggagcgagcagagt

SEQ ID NO: 213459 - DNA, 75 bp, Artificial Sequence
  Synthetic
atcaccacggacatttctgagatgggggccaacttcggagcgagcagagtgattgattgtaggaaaagtgtgaaa

SEQ ID NO: 213460 - DNA, 75 bp, Artificial Sequence
  Synthetic
gaagagtcattctcagtaatccatcgcccatcaccagtgcgagcgcagctcagcggagaggcagagtgggcagaa

SEQ ID NO: 213461 - DNA, 75 bp, Artificial Sequence
  Synthetic
gcccatcaccagtgcgagcgcagctcagcggagaggcagagtgggcagaaatccaaatcaggttggggatgagta

SEQ ID NO: 213462 - DNA, 75 bp, Artificial Sequence
  Synthetic
gatgacaccaacctagcccactggacagaagccaagatcatgcttgataacatccacttgccaaatggattagta

SEQ ID NO: 213463 - DNA, 75 bp, Artificial Sequence
  Synthetic
cagaagccaagatcatgcttgataacatccacttgccaaatggattagtagctcaactttatggacctgaaaggg

SEQ ID NO: 213464 - DNA, 75 bp, Artificial Sequence
  Synthetic
gtatcgattgaggggtgaggaaaagaaaaattttctggagctgattagaacagccgacctcccagtatggctggc

SEQ ID NO: 213465 - DNA, 75 bp, Artificial Sequence
  Synthetic
aaaaattttctggagctgattagaacagccgacctcccagtatggctggcctacaaagtggcgtcaaatggaata

SEQ ID NO: 213466 - DNA, 75 bp, Artificial Sequence
  Synthetic
ttgatggtccccggacgaatgccatcttagaggacagcactgaagtggagataatcaccagaatgggagagagaa

SEQ ID NO: 213467 - DNA, 75 bp, Artificial Sequence
  Synthetic
cttagaggacagcactgaagtggagataatcaccagaatgggagagagaaaaactctaaaaccaagatggctgga

SEQ ID NO: 213468 - DNA, 75 bp, Artificial Sequence
  Synthetic
gctctgaagtggttcaaggacttcgcggcagggaagagatcagctgtcagctttctagaggtgcttgggcgcatg

SEQ ID NO: 213469 - DNA, 75 bp, Artificial Sequence
  Synthetic
cggcagggaagagatcagctgtcagctttctagaggtgcttgggcgcatgccggaacatttcatggggaaaactc

SEQ ID NO: 213470 - DNA, 75 bp, Artificial Sequence
  Synthetic
gttcttcaagtttacagcattagccccgaccaaggcgcttttaggccgatggaaagcagtggaaaagagtgtagc

SEQ ID NO: 213471 - DNA, 75 bp, Artificial Sequence
  Synthetic
agttgccacagcagagaaaggggggaaagcccatcgaatggctctagaagaattgccagatgcactggaaacggt

SEQ ID NO: 213472 - DNA, 75 bp, Artificial Sequence
  Synthetic
aaagcccatcgaatggctctagaagaattgccagatgcactggaaacggtgacactcattgcagcgatagccgtg

SEQ ID NO: 213473 - DNA, 75 bp, Artificial Sequence
  Synthetic
tgatgcaacgaaaggggatagggaaaatgggcctgggcgcccttgtgctcaccctggccaccttcttcttgtgga

SEQ ID NO: 213474 - DNA, 75 bp, Artificial Sequence
  Synthetic
aatgggcctgggcgcccttgtgctcaccctggccaccttcttcttgtggatggcagaggtatcagggacgaaaat

SEQ ID NO: 213475 - DNA, 75 bp, Artificial Sequence
  Synthetic
ttgctcatggtggtactcattccggagccggagaaacaaagatcccaaacggacaatcagttggccgtgttcctg

SEQ ID NO: 213476 - DNA, 75 bp, Artificial Sequence
  Synthetic
agccggagaaacaaagatcccaaacggacaatcagttggccgtgttcctgatctgcgtcctaactgtggtaggaa

SEQ ID NO: 213477 - DNA, 75 bp, Artificial Sequence
  Synthetic
gcttgagaagacaaaggaagacataaggagcatccttggcaacagggctcagacatccagcgtgcctggaagtct

SEQ ID NO: 213478 - DNA, 75 bp, Artificial Sequence
  Synthetic
aggagcatccttggcaacagggctcagacatccagcgtgcctggaagtctgtcaagcctggcgctcgatttgcga

SEQ ID NO: 213479 - DNA, 75 bp, Artificial Sequence
  Synthetic
gaggcagcacagtggttttaactccactgctgaaacacttgatcacttctgagtatgtgacaacatctctagctt

SEQ ID NO: 213480 - DNA, 75 bp, Artificial Sequence
  Synthetic
actgctgaaacacttgatcacttctgagtatgtgacaacatctctagcttcaatcaactcacaggccggctcact

SEQ ID NO: 213481 - DNA, 75 bp, Artificial Sequence
  Synthetic
ttcacagatttggatctgacggttggactcgtctttctgggctgctgggggcaagtcactcttaccacttttttg

SEQ ID NO: 213482 - DNA, 75 bp, Artificial Sequence
  Synthetic
gactcgtctttctgggctgctgggggcaagtcactcttaccacttttttgacagctggagtgctggcagctttgc

SEQ ID NO: 213483 - DNA, 75 bp, Artificial Sequence
  Synthetic
gcaagccgaagctttgagggcagctcaaagaagaacagccgcgggcatcatgaagaacgccgttgtggatgggat

SEQ ID NO: 213484 - DNA, 75 bp, Artificial Sequence
  Synthetic
caaagaagaacagccgcgggcatcatgaagaacgccgttgtggatgggatggtggccactgacgtgccagaactg

SEQ ID NO: 213485 - DNA, 75 bp, Artificial Sequence
  Synthetic
gacaaactggctctgaaaggcacaacctatggcatgtgcacagaaaaattctccttcgcgaaaaatccggcggac

SEQ ID NO: 213486 - DNA, 75 bp, Artificial Sequence
  Synthetic
aggagtaagcatagctgcttttctcgtcaaccctaatgtcacaacagtacgagaggccggtgtgttggtgaccgc

SEQ ID NO: 213487 - DNA, 75 bp, Artificial Sequence
  Synthetic
aaaaggtggggcaagtgttgctaataggagtaagcatagctgcttttctcgtcaaccctaatgtcacaacagtac

SEQ ID NO: 213488 - DNA, 75 bp, Artificial Sequence
  Synthetic
ggagcaagtgctgtttggaattcaactacagccacaggactctgccacgttatgcgaggcagctacttggctggt

SEQ ID NO: 213489 - DNA, 75 bp, Artificial Sequence
  Synthetic
ctacagccacaggactctgccacgttatgcgaggcagctacttggctggtggttcaatagcctggaccctcatta

SEQ ID NO: 213490 - DNA, 75 bp, Artificial Sequence
  Synthetic
aagaggaagacctggaggaagaacgctgggtgagcaatggaaagaaaggttgaacgccatgaacaaggaagagtt

SEQ ID NO: 213491 - DNA, 75 bp, Artificial Sequence
  Synthetic
ctgggtgagcaatggaaagaaaggttgaacgccatgaacaaggaagagttttttaagtacaggaaagaagccata

SEQ ID NO: 213492 - DNA, 75 bp, Artificial Sequence
  Synthetic
gcagggctagacgagagaacaacaaagtgggaggccatcccgtgtcacgaggatcagcaaagctccgatggatag

SEQ ID NO: 213493 - DNA, 75 bp, Artificial Sequence
  Synthetic
agtgggaggccatcccgtgtcacgaggatcagcaaagctccgatggatagtggagaaagggtttgtctcaccagt

SEQ ID NO: 213494 - DNA, 75 bp, Artificial Sequence
  Synthetic
gggcggggaggttggtgctattatacagccaccctgaaaaaagtccaggaagtcaagggttacacaaaaggaggg

SEQ ID NO: 213495 - DNA, 75 bp, Artificial Sequence
  Synthetic
cagccaccctgaaaaaagtccaggaagtcaagggttacacaaaaggaggggctggacatgaggaacctatgttga

SEQ ID NO: 213496 - DNA, 75 bp, Artificial Sequence
  Synthetic
cacaatgaagagtggagtggacgtgttctacagaccttcagagcccagtgacaccctgctctgtgatatagggga

SEQ ID NO: 213497 - DNA, 75 bp, Artificial Sequence
  Synthetic
ttctacagaccttcagagcccagtgacaccctgctctgtgatataggggagtcttccccaagtcctgacgtcgaa

SEQ ID NO: 213498 - DNA, 75 bp, Artificial Sequence
  Synthetic
aaatggcatcagagtggttgcaccgagggcccagggaattttgcataaaagtcctatgtccatacatgccaaagg

SEQ ID NO: 213499 - DNA, 75 bp, Artificial Sequence
  Synthetic
agggcccagggaattttgcataaaagtcctatgtccatacatgccaaaggtgatagaaaagatggaaacactgca

SEQ ID NO: 213500 - DNA, 75 bp, Artificial Sequence
  Synthetic
gggaaaaactgtgtggttcgtggcaagtgtgaaaatggggaatgagatcgcaatgtgccttcagagagcggggaa

SEQ ID NO: 213501 - DNA, 75 bp, Artificial Sequence
  Synthetic
cgtgttcctctgtcacgcaattcgaaccatgagatgtactgggtcagtggagccgctgggaatgtggtacacgct

SEQ ID NO: 213502 - DNA, 75 bp, Artificial Sequence
  Synthetic
accatgagatgtactgggtcagtggagccgctgggaatgtggtacacgctgtaaacatgaccagtcaagtcttgc

SEQ ID NO: 213503 - DNA, 75 bp, Artificial Sequence
  Synthetic
gagaggacccaaatatgaggaagatgttaacttgggaagcgggactagagctgtaggaaaaggtgaggttcacag

SEQ ID NO: 213504 - DNA, 75 bp, Artificial Sequence
  Synthetic
gttaacttgggaagcgggactagagctgtaggaaaaggtgaggttcacagtgaccaagggaaaataaaaaagcgg

SEQ ID NO: 213505 - DNA, 75 bp, Artificial Sequence
  Synthetic
cagcaacctggcatgaggatccagaacacccataccgcacctggacataccatggaagttacgaagtgaaagcca

SEQ ID NO: 213506 - DNA, 75 bp, Artificial Sequence
  Synthetic
acacccataccgcacctggacataccatggaagttacgaagtgaaagccaccgggtcagccagctcccttgtcaa

SEQ ID NO: 213507 - DNA, 75 bp, Artificial Sequence
  Synthetic
cctccgtcaccatgccagtcttagcgcttctaactccgggaatgagggctctatacctagatacttacagaatca

SEQ ID NO: 213508 - DNA, 75 bp, Artificial Sequence
  Synthetic
ccttgggacgccatcaccagtgtcaccactatggccatgactgatactactccttttggtcagcagagagttttc

SEQ ID NO: 213509 - DNA, 75 bp, Artificial Sequence
  Synthetic
ccactatggccatgactgatactactccttttggtcagcagagagttttcaaagaaaaggttgacactaaagcgc

SEQ ID NO: 213510 - DNA, 75 bp, Artificial Sequence
  Synthetic
agtgctggacgagacgaccaattggctgtgggcctacctatcaagagagaaaaaacctcgcttgtgcacgagaga

SEQ ID NO: 213511 - DNA, 75 bp, Artificial Sequence
  Synthetic
ctgtgggcctacctatcaagagagaaaaaacctcgcttgtgcacgagagaggaatttgttcggaaagtcaacagc

SEQ ID NO: 213512 - DNA, 75 bp, Artificial Sequence
  Synthetic
ccgagcagaaccaatggagctcagccagagaggctgttagcgacccggccttctgggacatggttgacgttgaaa

SEQ ID NO: 213513 - DNA, 75 bp, Artificial Sequence
  Synthetic
aatgaaacatcttaccagtttcaaacgagaacttggaacactcattgacgccgtgaacaagcggggcagaaagca

SEQ ID NO: 213514 - DNA, 75 bp, Artificial Sequence
  Synthetic
cagagaggctgttagcgacccggccttctgggacatggttgacgttgaaagagagaaccacctacgaggggagtg

SEQ ID NO: 213515 - DNA, 75 bp, Artificial Sequence
  Synthetic
gggaaaagagaaaagaaacccggtgagtttgggaaggccaagggaagcagggccatctggttcatgtggcttgga

SEQ ID NO: 213516 - DNA, 75 bp, Artificial Sequence
  Synthetic
agtttgggaaggccaagggaagcagggccatctggttcatgtggcttggagctcgctacctggaatttgaggcac

SEQ ID NO: 213517 - DNA, 75 bp, Artificial Sequence
  Synthetic
gttgagtagggagaattcaggaggaggagtggaaggctcaggcatacagaagctagggtacatcctgcgagacat

SEQ ID NO: 213518 - DNA, 75 bp, Artificial Sequence
  Synthetic
ggagtggaaggctcaggcatacagaagctagggtacatcctgcgagacatctcaatgaaagctggaggaaaaatg

SEQ ID NO: 213519 - DNA, 75 bp, Artificial Sequence
  Synthetic
acactaggatcacaagggttgatctggacaatgaggcgaaggtactagagctcttggatggggaacataggatgt

SEQ ID NO: 213520 - DNA, 75 bp, Artificial Sequence
  Synthetic
ggacaatgaggcgaaggtactagagctcttggatggggaacataggatgttggcccgtgccataatagaattgac

SEQ ID NO: 213521 - DNA, 75 bp, Artificial Sequence
  Synthetic
atgaggccagcagccggtggaaagactgtaatggatgtgatctccagagaagaccaaagagggagtggacaagtg

SEQ ID NO: 213522 - DNA, 75 bp, Artificial Sequence
  Synthetic
gaacagagtgcccaactacaacctatttgtcatggatgaagctcatttcaccgacccagccagtatagccgcacg

SEQ ID NO: 213523 - DNA, 75 bp, Artificial Sequence
  Synthetic
tttgtcatggatgaagctcatttcaccgacccagccagtatagccgcacgaggatacattgctaccaaggtggaa

SEQ ID NO: 213524 - DNA, 75 bp, Artificial Sequence
  Synthetic
ctgtaatggatgtgatctccagagaagaccaaagagggagtggacaagtggttacatatgctcttaacaccttca

SEQ ID NO: 213525 - DNA, 75 bp, Artificial Sequence
  Synthetic
gttaatggaggcagaaggagttgttggcccgcaggacgtagaacagctcccaagaaaaaccaagtttgcagtcag

SEQ ID NO: 213526 - DNA, 75 bp, Artificial Sequence
  Synthetic
ggcccgcaggacgtagaacagctcccaagaaaaaccaagtttgcagtcaggacatggctttttgaaaatggagag

SEQ ID NO: 213527 - DNA, 75 bp, Artificial Sequence
  Synthetic
gtggggatgattgtgttgtcaaaccactcgatgacagattcgcgaatgctctgcatttcttgaatgcgatgtcaa

SEQ ID NO: 213528 - DNA, 75 bp, Artificial Sequence
  Synthetic
actcgatgacagattcgcgaatgctctgcatttcttgaatgcgatgtcaaaggtgaggaaagacatacaggaatg

SEQ ID NO: 213529 - DNA, 75 bp, Artificial Sequence
  Synthetic
tggcagcaagtccctttctgctcaaatcatttccaggagatcgtgatgaaagatggcagaagcctcgtcgtgccc

SEQ ID NO: 213530 - DNA, 75 bp, Artificial Sequence
  Synthetic
atcatttccaggagatcgtgatgaaagatggcagaagcctcgtcgtgccctgccggggacaggatgaattaatag

SEQ ID NO: 213531 - DNA, 75 bp, Artificial Sequence
  Synthetic
aggatggaacgtgagagacacggcctgcttagccaaggcatacgcccaaatgtggctcctcctctatttccaccg

SEQ ID NO: 213532 - DNA, 75 bp, Artificial Sequence
  Synthetic
tgcttagccaaggcatacgcccaaatgtggctcctcctctatttccaccggagagacctgcgcctcatggccaac

SEQ ID NO: 213533 - DNA, 75 bp, Artificial Sequence
  Synthetic
actgggtgcccacaggccggacttcatggtcgatacactcaaaaggagaatggatgacaacagaagacatgttgc

SEQ ID NO: 213534 - DNA, 75 bp, Artificial Sequence
  Synthetic
atggtcgatacactcaaaaggagaatggatgacaacagaagacatgttgcaggtgtggaacagagtatggattga

SEQ ID NO: 213535 - DNA, 75 bp, Artificial Sequence
  Synthetic
actcccgtcgccagttggaccgacgttccttacgtcgggaaaagggaagacatctggtgtggcagcttgatcgga

SEQ ID NO: 213536 - DNA, 75 bp, Artificial Sequence
  Synthetic
ttccttacgtcgggaaaagggaagacatctggtgtggcagcttgatcggaacgcgaacaagagctacctgggcag

SEQ ID NO: 213537 - DNA, 75 bp, Artificial Sequence
  Synthetic
agtgagggcaataattggaaacgaaaagtatgtggactacatgacatcactcaggaggtatgaagacactttggt

SEQ ID NO: 213538 - DNA, 75 bp, Artificial Sequence
  Synthetic
actcttgaaaacaaatgtaaatagtagtaattgtttagtgtaaatagtgtaaataaataaatttagataggaagt

SEQ ID NO: 213539 - DNA, 75 bp, Artificial Sequence
  Synthetic
agctgagtagacggtgctgcctgcgcctcagccccaggaggactgggttaacaaatctgacaaccgaaggtagga

SEQ ID NO: 213540 - DNA, 75 bp, Artificial Sequence
  Synthetic
cctcagccccaggaggactgggttaacaaatctgacaaccgaaggtaggaaagccctcagaaccgtctcggaaga

SEQ ID NO: 213541 - DNA, 75 bp, Artificial Sequence
  Synthetic
agaccgtgtcaggccacgtaagtgccacttcgctgaggagtgcagcctgtacagccccgggaggaccgggtaaac

SEQ ID NO: 213542 - DNA, 75 bp, Artificial Sequence
  Synthetic
cacttcgctgaggagtgcagcctgtacagccccgggaggaccgggtaaacaaagccgaaaaggcccccacggccc

SEQ ID NO: 213543 - DNA, 75 bp, Artificial Sequence
  Synthetic
gaggcgtaaggactagaggttagaggagaccccgtggaaaagaagatgcggcccaaactctttcgaagctgtaga

SEQ ID NO: 213544 - DNA, 75 bp, Artificial Sequence
  Synthetic
gagaccccgtggaaaagaagatgcggcccaaactctttcgaagctgtagaaggagtggaaggactagaggttaga

SEQ ID NO: 213545 - DNA, 75 bp, Artificial Sequence
  Synthetic
agcatattgacacctgggattagactaggagatcttctgatctatctcaacatcagctacaaggcaccgagcgcc

SEQ ID NO: 213546 - DNA, 75 bp, Artificial Sequence
  Synthetic
taggagatcttctgatctatctcaacatcagctacaaggcaccgagcgccgaagtatgtagctggtggtggggaa

SEQ ID NO: 213547 - DNA, 75 bp, Artificial Sequence
  Synthetic
tatgttgactacatgacctcactcaggagatacgaagatgtcttgatccaggaagacagggtcatctagtgtgat

SEQ ID NO: 213548 - DNA, 75 bp, Artificial Sequence
  Synthetic
ggactgggttaccaaagccgttgagcccccacggcccaagcctcgtctaggatgcaatagacgaggtgtaaggac

SEQ ID NO: 213549 - DNA, 75 bp, Artificial Sequence
  Synthetic
aagcttttgatgaccatcaacaacacggacattgcagacgttatcgtgattcccacctcaaaaggagagaacaga

SEQ ID NO: 213550 - DNA, 75 bp, Artificial Sequence
  Synthetic
ctgctgttggtcgctccggcttacagttttaattgtctgggaatgggcaatcgtgacttcatagaaggagccagt

SEQ ID NO: 213551 - DNA, 75 bp, Artificial Sequence
  Synthetic
ccacctgaaatgtaggctaaaaatggacaaactggctctgaaaggcacaacctatggcatgtgtacagaaaaatt

SEQ ID NO: 213552 - DNA, 75 bp, Artificial Sequence
  Synthetic
cctatggcatgtgtacagaaaaattctcgttcgcgaaaaatccggcggacactggccacggaacagttgtcattg

SEQ ID NO: 213553 - DNA, 75 bp, Artificial Sequence
  Synthetic
cacaaggaaagagatgagatgtggaagtggcatctttgtgcacaacgacgtggaagcctgggtggataggtataa

SEQ ID NO: 213554 - DNA, 75 bp, Artificial Sequence
  Synthetic
cacatggaaacttgagagggcagtctttggagaggtcaaatcttgcacttggccagagacacacaccctttgggg

SEQ ID NO: 213555 - DNA, 75 bp, Artificial Sequence
  Synthetic
gaaacaacactcgtcagatcacaggttgatgctttcaatggtgaaatggttgacccttttcagctgggccttctg

SEQ ID NO: 213556 - DNA, 75 bp, Artificial Sequence
  Synthetic
gtaaacatccagacaaaaccaggagtgtttcggactcccttcggggaggttggggctgttagtctggattacccg

SEQ ID NO: 213557 - DNA, 75 bp, Artificial Sequence
  Synthetic
cgccactgatgtgcctgaactggaaaggactacccctctgatgcaaaagaaagtcggacaggtgctcctcatagg

SEQ ID NO: 213558 - DNA, 75 bp, Artificial Sequence
  Synthetic
ggggagcaatggaaggaaaaactaaatgccatgagcagagaagagttttttaaataccgaagagaggccataatc

SEQ ID NO: 213559 - DNA, 75 bp, Artificial Sequence
  Synthetic
cttgaagagtggagtggatgtgttttacaaaccttcagaacccagtgacaccctgttctgtgacataggggaatc

SEQ ID NO: 213560 - DNA, 75 bp, Artificial Sequence
  Synthetic
caacgcacactacgcgtcctagagatgacatctgactggttgcaccgaggacctagagagttctgcataaaagtt

SEQ ID NO: 213561 - DNA, 75 bp, Artificial Sequence
  Synthetic
aacagaatcaatggagcacggctcgtgaggctgtggatgacccgcggttttgggagatggttgatgaagagaggg

SEQ ID NO: 213562 - DNA, 75 bp, Artificial Sequence
  Synthetic
atcgggatttcatagaaggagccagtggagccacttgggtgtacttggtgctagaaggagatagctgtttgacaa

SEQ ID NO: 213563 - DNA, 75 bp, Artificial Sequence
  Synthetic
ggatggggaaatggatgtggacttttcgggaaaggaagcattgacacacgcgcaaaatttctttgtaccagtaag

SEQ ID NO: 213564 - DNA, 75 bp, Artificial Sequence
  Synthetic
tggaaggagtatagttgtcccgtgcagaggacaggatgagctgataggcagggctcgcatctctccaggagctgg

SEQ ID NO: 213565 - DNA, 75 bp, Artificial Sequence
  Synthetic
gtcaatacactcgaaaggagagtggatgaccacggaagacatgctgcaggtctggaacagagtctggattgaaga

SEQ ID NO: 213566 - DNA, 75 bp, Artificial Sequence
  Synthetic
cgtatgtgggaaagcgtgaggacatctggtgtggtagcctcatcggaacgcgatccagagcaacctgggctgaga

SEQ ID NO: 213567 - DNA, 75 bp, Artificial Sequence
  Synthetic
acatctatgcggcgataaaccaggttagagctgtcattgggaaagaaaattatgttgactacatgacctcactca

SEQ ID NO: 213568 - DNA, 75 bp, Artificial Sequence
  Synthetic
ccctgcaaaattccgattgtctcagtcgcgagtttaaacgacatgacccctgtggggaggttggtaacagtaaac

SEQ ID NO: 213569 - DNA, 75 bp, Artificial Sequence
  Synthetic
agagattagtgcagtttaaacagttttttagaacggaagataaccatgactaaaaaaccaggagggcccggtaga

SEQ ID NO: 213570 - DNA, 75 bp, Artificial Sequence
  Synthetic
gtacgaatgtcctaagcttactgcgggcaatgatccagaggatgtggattgctggtgtgacaaccaagaggtcta

SEQ ID NO: 213571 - DNA, 75 bp, Artificial Sequence
  Synthetic
caattggcctcagtggatttgcaaataggagtccacggaatcctgaatgccgccgccatagcatggatgattgtc

SEQ ID NO: 213572 - DNA, 75 bp, Artificial Sequence
  Synthetic
ctcatggcagtgtcttacgtggtatcaggaaaagcaacagacatgtggcttgaacgggccgccgacatcagctgg

SEQ ID NO: 213573 - DNA, 75 bp, Artificial Sequence
  Synthetic
caaataattaaggacgctatccagcagcgcctaagaacagctgtgttggcaccgacgcgggtggtggcagcagag

SEQ ID NO: 213574 - DNA, 75 bp, Artificial Sequence
  Synthetic
atagtggatgtgatgtgccatgccactctgacccatagactgatgtcaccgaacagagtgcccaactacaaccta

SEQ ID NO: 213575 - DNA, 75 bp, Artificial Sequence
  Synthetic
tcccataaccagtgcaagcgcagctcaacggaggggcagggtaggcagaaaccctaaccaagttggagatgaata

SEQ ID NO: 213576 - DNA, 75 bp, Artificial Sequence
  Synthetic
acgctgacaagccctccttgaaaaggggaaggcccgggggcaggacgctaggggagcagtggaaggaaaaactaa

SEQ ID NO: 213577 - DNA, 75 bp, Artificial Sequence
  Synthetic
ggtaagtgtggcagcgttcctcgtcaaccctaatgtcactactgtgagagaggcaggggtgttggtgacggcggc

SEQ ID NO: 213578 - DNA, 75 bp, Artificial Sequence
  Synthetic
cggtatctagagtttgaagctttggggttcctgaatgaagaccactggctgagccgagagaattcaggaggtgga

SEQ ID NO: 213579 - DNA, 75 bp, Artificial Sequence
  Synthetic
ggatggggaaatggatgtggacttttcgggaaaggaagcattgacacttgcgcaaagtttacttgtactaataag

SEQ ID NO: 213580 - DNA, 75 bp, Artificial Sequence
  Synthetic
agaacatcaagtatgaagttggtgtattcgtgcacggaaccaccacctcggaaaaccatgggaattactcagcgc

SEQ ID NO: 213581 - DNA, 75 bp, Artificial Sequence
  Synthetic
gtcacctgaaatgcaggctgaaaatggacaaactggctctgaagggcacgacttatggcatgtgcacagaaaaat

SEQ ID NO: 213582 - DNA, 75 bp, Artificial Sequence
  Synthetic
cgtatgtgggaaagcgtgaggacatctggtgtggcagcctcatcggaacgcgatccagagcaacctgggctgaga

SEQ ID NO: 213583 - DNA, 75 bp, Artificial Sequence
  Synthetic
tatgttgattacatgacctcactcaggagatacgaagacgttttggtccaggaagatagggtcatctagtgtgat

SEQ ID NO: 213584 - DNA, 75 bp, Artificial Sequence
  Synthetic
aagagaagtttgagatgggctggaaagcatggggaaaaagcattctcttcgcccccgaactggccaactccacgt

SEQ ID NO: 213585 - DNA, 75 bp, Artificial Sequence
  Synthetic
agccatcatgagtggagaaggaaaactaacgccatactggggtagtgtgaaggaagaccgcataagctatggagg

SEQ ID NO: 213586 - DNA, 75 bp, Artificial Sequence
  Synthetic
atttgctcagcagtgccagtggattgggtgcccacaggcaggacatcctggtcgatacactcgaaaggagagtgg

SEQ ID NO: 213587 - DNA, 75 bp, Artificial Sequence
  Synthetic
actgctttggatgggcgttaacgcacgagaccgatcaattgctctggctttcttagccacaggaggtgtgctcat

SEQ ID NO: 213588 - DNA, 75 bp, Artificial Sequence
  Synthetic
ggcacttaccaggccggcgtcggagtcatgtacgagaatgttttccacacattatggcacacaactagaggagca

SEQ ID NO: 213589 - DNA, 75 bp, Artificial Sequence
  Synthetic
ctgggatgccatcgccaatgtcaccacaatggctatgaccgatactaccccctttggccagcaaagggtctttaa

SEQ ID NO: 213590 - DNA, 75 bp, Artificial Sequence
  Synthetic
cattccgcataccatagccggaccaaaaagcaagcacaatcggagggaagggtacaagacacaaaaccagggacc

SEQ ID NO: 213591 - DNA, 75 bp, Artificial Sequence
  Synthetic
ggagtccatggaatcctgaatgccgccgctatagcgtggatgattgttcgagcgatcaccttccccacaacctcc

SEQ ID NO: 213592 - DNA, 75 bp, Artificial Sequence
  Synthetic
ggagatggaagctgcaatcacaggaagtagccggaggctagatgttaagttggatgacgacggcgactttcattt

SEQ ID NO: 213593 - DNA, 75 bp, Artificial Sequence
  Synthetic
atgatgacggagattttcacttgattgatgatcccggtgttccatggaaggtttgggtcctgcgcatgtcttgca

SEQ ID NO: 213594 - DNA, 75 bp, Artificial Sequence
  Synthetic
gttattggctcactttaaagacaacaaaaagagggggcgtgttttgggacacgccatccccaaaaccttgctcaa

SEQ ID NO: 213595 - DNA, 75 bp, Artificial Sequence
  Synthetic
ataatcaactggcggtgtttctcatttgtgtcttgtccgtggttggagtggtggcagcaaatgagtatgggatgc

SEQ ID NO: 213596 - DNA, 75 bp, Artificial Sequence
  Synthetic
gtcttccttggctgttggggtcaaatcaccattacaacgtttctgacagccgtggttctggcgacacttcattat

SEQ ID NO: 213597 - DNA, 75 bp, Artificial Sequence
  Synthetic
gctacaggactctgccatgttatgcgaggtagctacttggctggaggctccattgcttggactctcatcaagaac

SEQ ID NO: 213598 - DNA, 75 bp, Artificial Sequence
  Synthetic
gtccctgtaaaattccgattgtctcagtcgcgagtttgaacgacatgacccctgtggggaggctggtaacagtga

SEQ ID NO: 213599 - DNA, 75 bp, Artificial Sequence
  Synthetic
agtccgttgttgctcttgggtcacaggaaggaggcctccatcaggcgctggcaggagccatcgtggtggagtact

SEQ ID NO: 213600 - DNA, 75 bp, Artificial Sequence
  Synthetic
aactcaaaggtgctggtcgagatggaaccccccttcggagactcctacatcgtagttggaaggggagacaagcag

SEQ ID NO: 213601 - DNA, 75 bp, Artificial Sequence
  Synthetic
cccacctcaaaaggtgaaaacagatgttgggtccgagcaatcgacgttggttacatgtgtgaagacaccatcacg

SEQ ID NO: 213602 - DNA, 75 bp, Artificial Sequence
  Synthetic
cacaagaaaagagatgagatgtggaagtggcatcttcgtgcacaacgacgtggaagcctgggtggataggtataa

SEQ ID NO: 213603 - DNA, 75 bp, Artificial Sequence
  Synthetic
cacgcgatacctcatgaaaacggagaactggatcataaggaaccctggttatgctttcctggcggcggcacttgg

SEQ ID NO: 213604 - DNA, 75 bp, Artificial Sequence
  Synthetic
aaacgtgctgacagcagctacgtgtgcaaacaaggctttactgatcgcggatggggaaatggatgtggacttttc

SEQ ID NO: 213605 - DNA, 75 bp, Artificial Sequence
  Synthetic
actcaaaggtgctggttgagatggaacctcccttcggagactcttatatcgtggttggaagaggggacaagcaga

SEQ ID NO: 213606 - DNA, 75 bp, Artificial Sequence
  Synthetic
gatggacgaaccaagaaaacgtggttctggtcctaggggctgccttttttcaactggcctcagtagatctgcaaa

SEQ ID NO: 213607 - DNA, 75 bp, Artificial Sequence
  Synthetic
acgagaccggtcaatcgccctggcttttttggccacgggaggtgtgctcgtgtttttagcgaccaatgtgcatgc

SEQ ID NO: 213608 - DNA, 75 bp, Artificial Sequence
  Synthetic
gtcgtggatggacccgagacaaaggaatgccctgatgagcgcagagcctggaacagcatgcaaatcgaagacttc

SEQ ID NO: 213609 - DNA, 75 bp, Artificial Sequence
  Synthetic
ccgacccagccagtatagccgcacgaggatacattgctaccaaggtggaattaggggaggcagcagccatcttca

SEQ ID NO: 213610 - DNA, 75 bp, Artificial Sequence
  Synthetic
gggccaacttcggtgcgagcagggtcatcgactgcagaaagagcgtgaaacccaccatcttagaagagggagaag

SEQ ID NO: 213611 - DNA, 75 bp, Artificial Sequence
  Synthetic
ggttgcaacggctgagaaaggtgggaaggcacaccgaatggctctcgaagagttgccggatgcactggaaaccat

SEQ ID NO: 213612 - DNA, 75 bp, Artificial Sequence
  Synthetic
tggaacagatgatgtgcaagtgatcgtggtggaaccagggaaacctgcagtaaacatccagacaaaaccgggagt

SEQ ID NO: 213613 - DNA, 75 bp, Artificial Sequence
  Synthetic
tgggggaagcagcagccatttttatgacggcgaccccgcccgggaccactgatccctttcccgactcaaatgccc

SEQ ID NO: 213614 - DNA, 75 bp, Artificial Sequence
  Synthetic
aaccctaatgtcaccactgtgagagaagcaggggtgttggtgacggcggctacgcttactttgtgggacaatgga

SEQ ID NO: 213615 - DNA, 75 bp, Artificial Sequence
  Synthetic
ctccattgcctggactctcatcaagaacgctgacaagccctccttaaaaaaggggaggcctggaggcaggacgct

SEQ ID NO: 213616 - DNA, 75 bp, Artificial Sequence
  Synthetic
gggaggacatccggtttcgcgaggctcagcaaaactccgttggctcgtggagaaaggattcgtctcgccaatagg

SEQ ID NO: 213617 - DNA, 75 bp, Artificial Sequence
  Synthetic
tggatggtgaacaccgcatgctcgcccgagccataattgaactaacgtacaggcacaaagtggtcaaggtcatga

SEQ ID NO: 213618 - DNA, 75 bp, Artificial Sequence
  Synthetic
ctggtgtggcagcctcatcggaacgcgatccagagcaacctgggctgagaacatctatgcggcgataaaccaggt

SEQ ID NO: 213619 - DNA, 75 bp, Artificial Sequence
  Synthetic
tatgctttcctggcggcggcacttggctggatgcttggcagcaacaacggtcaacgtttggtgtttactatcctc

SEQ ID NO: 213620 - DNA, 75 bp, Artificial Sequence
  Synthetic
cagaaaatggctgctggtacggaatggaaatcagacctgttaggcatgatgaaacaacactcgtcagatcgcagg

SEQ ID NO: 213621 - DNA, 75 bp, Artificial Sequence
  Synthetic
ccactatgggggggccaccagtgaagatgacagtaacctagcccattggacagaggcaaagatcatgttagacaa

SEQ ID NO: 213622 - DNA, 75 bp, Artificial Sequence
  Synthetic
ggagaccccgcatttgcatcaaacagcatattgacacctgggaatagactgggagatcttctgctctatctcaac

SEQ ID NO: 213623 - DNA, 75 bp, Artificial Sequence
  Synthetic
tctaccgttgccatgccagtcttagcgctcctaactccgggaatgagggccttgtatctggacacttacagaatc

SEQ ID NO: 213624 - DNA, 75 bp, Artificial Sequence
  Synthetic
accgaatcatggctagggggattctcggcacttaccaggccggcgttggagtcatgtacgagaatgttttccaca

SEQ ID NO: 213625 - DNA, 75 bp, Artificial Sequence
  Synthetic
aatagtagacgtaatgtgccatgccactctgacccatagactaatgtcaccaaacagggtgcccaattacaattt

SEQ ID NO: 213626 - DNA, 75 bp, Artificial Sequence
  Synthetic
caagcaccaggactgaccggattgccaagcatggcactggacttgcgcccagccacagcttgggcgctgtatggg

SEQ ID NO: 213627 - DNA, 75 bp, Artificial Sequence
  Synthetic
aaagtcggccaagtgctcctcataggggtcagcgtggcggcgtttctcgtcaaccccaatgtcaccaccgtgaga

SEQ ID NO: 213628 - DNA, 75 bp, Artificial Sequence
  Synthetic
ggcttagtattgttgaggagaatcgagagattagtgcagtttacacagtttcttaaaacggaagatatccatgac

SEQ ID NO: 213629 - DNA, 75 bp, Artificial Sequence
  Synthetic
aaccgggctatctatatgctgaaacgcggtctaccccgcgtattcccactcgtgggagtgaagagggtagtgatt

SEQ ID NO: 213630 - DNA, 75 bp, Artificial Sequence
  Synthetic
gcggtctaccccgcgtattcccactcgtgggagtgaagagggtagtgattagcttgttggacggtatagggccat

SEQ ID NO: 213631 - DNA, 75 bp, Artificial Sequence
  Synthetic
gttcttcaagtttacagctttatccccgaccaaggcgctcttgggccggtggagagcactggagaagagtgttgc

SEQ ID NO: 213632 - DNA, 75 bp, Artificial Sequence
  Synthetic
ccgaccaaggcgctcttgggccggtggagagcactggagaagagtgttgcaatgaaacacctcactagcttcaaa

SEQ ID NO: 213633 - DNA, 75 bp, Artificial Sequence
  Synthetic
ctgtcaataaacggggcagaaaacaaaataaaagaggaggaaatggaggaacaacattgtggttcatgagcttga

SEQ ID NO: 213634 - DNA, 75 bp, Artificial Sequence
  Synthetic
aaataaaagaggaggaaatggaggaacaacattgtggttcatgagcttgacaattgctgcagtctgtgtaggagc

SEQ ID NO: 213635 - DNA, 75 bp, Artificial Sequence
  Synthetic
aagttactaatggctgtcaacaatacggacatcgcggatgtcatcgtgatcccgacctctaagggagaaaataga

SEQ ID NO: 213636 - DNA, 75 bp, Artificial Sequence
  Synthetic
ctatctggttcatgtggctcggagctcggtacctagagttcgaagccctaggatttctaaatgaagaccattggc

SEQ ID NO: 213637 - DNA, 75 bp, Artificial Sequence
  Synthetic
cggacatcgcggatgtcatcgtgatcccgacctctaagggagaaaatagatgctgggttagggcaatcgacgtag

SEQ ID NO: 213638 - DNA, 75 bp, Artificial Sequence
  Synthetic
gtacgagtgccccaaacttactcctggcaatgacccacaagatgtcgactgctggtgtgaccatcaagaagtgta

SEQ ID NO: 213639 - DNA, 75 bp, Artificial Sequence
  Synthetic
ggcaatgacccacaagatgtcgactgctggtgtgaccatcaagaagtgtacgttcaatatggacggtgcacaaga

SEQ ID NO: 213640 - DNA, 75 bp, Artificial Sequence
  Synthetic
gatccgtgtctgtccacacgcatggggagagttcgctagtgaataaaaaagaagcttggctgaattcaacgaagg

SEQ ID NO: 213641 - DNA, 75 bp, Artificial Sequence
  Synthetic
ggagagttcgctagtgaataaaaaagaagcttggctgaattcaacgaaggccacccggtatcttgtgaaaactga

SEQ ID NO: 213642 - DNA, 75 bp, Artificial Sequence
  Synthetic
tatgcgttcttagcagcggtacttggctggatgcttggcagcaacagtggtccacgcgtggtgttcaccattctg

SEQ ID NO: 213643 - DNA, 75 bp, Artificial Sequence
  Synthetic
gctggatgcttggcagcaacagtggtccacgcgtggtgttcaccattctgttgctactggtcgctccggcataca

SEQ ID NO: 213644 - DNA, 75 bp, Artificial Sequence
  Synthetic
ccgtgatttcatagagggtgttagtggggctacctgggtggacttggtgctagaaggagacagctgcctgacaat

SEQ ID NO: 213645 - DNA, 75 bp, Artificial Sequence
  Synthetic
agaagttttaactgtgtgacttcttggcttagtatcgttgagaagaatcgagagattagtgcagtttaaacagtt

SEQ ID NO: 213646 - DNA, 75 bp, Artificial Sequence
  Synthetic
ggggctacctgggtggacttggtgctagaaggagacagctgcctgacaatcatggcaaatgacagaccaacattg

SEQ ID NO: 213647 - DNA, 75 bp, Artificial Sequence
  Synthetic
ctagtcaacttgctgaagttaggagttattgctatcatgcttcagtcactgatatctcgacggtggctcgctgcc

SEQ ID NO: 213648 - DNA, 75 bp, Artificial Sequence
  Synthetic
ttattgctatcatgcttcagtcactgatatctcgacggtggctcgctgccccacgaccggagaggcccacaacga

SEQ ID NO: 213649 - DNA, 75 bp, Artificial Sequence
  Synthetic
tgcaagcaaggcttcactgatcgcgggtggggcaacggatgtggactttttggaaaaggaagcattgacacatgt

SEQ ID NO: 213650 - DNA, 75 bp, Artificial Sequence
  Synthetic
ggtggggcaacggatgtggactttttggaaaaggaagcattgacacatgtgctaagttctcctgcactagcaagg

SEQ ID NO: 213651 - DNA, 75 bp, Artificial Sequence
  Synthetic
aaacatcaagtacgaagttggtatatttgtgcacggaaccacgacctcagaaaatcatggcaactatacagcaca

SEQ ID NO: 213652 - DNA, 75 bp, Artificial Sequence
  Synthetic
tttgtgcacggaaccacgacctcagaaaatcatggcaactatacagcacaaatcggggcgtctcaggcagcgaag

SEQ ID NO: 213653 - DNA, 75 bp, Artificial Sequence
  Synthetic
caataaccctgaagcttggcgactacggagaagtcacattagattgtgaaccacggagcggacttaacactgagg

SEQ ID NO: 213654 - DNA, 75 bp, Artificial Sequence
  Synthetic
cggagaagtcacattagattgtgaaccacggagcggacttaacactgaggcgttctacgtcatgactgtgggctc

SEQ ID NO: 213655 - DNA, 75 bp, Artificial Sequence
  Synthetic
tggtttcatgatctcgccctcccttggacgtcctcttcaaacacagcatggagaaatagagaacttctcatggaa

SEQ ID NO: 213656 - DNA, 75 bp, Artificial Sequence
  Synthetic
ggacgtcctcttcaaacacagcatggagaaatagagaacttctcatggaatttgaagaggcgcatgccaccaagc

SEQ ID NO: 213657 - DNA, 75 bp, Artificial Sequence
  Synthetic
agaaagagccctccatcaggcattggcaggggccatcgtcgtggaatactcaagctcagtgaagctgacatcagg

SEQ ID NO: 213658 - DNA, 75 bp, Artificial Sequence
  Synthetic
gcaggggccatcgtcgtggaatactcaagctcagtgaagctgacatcaggccacttgaaatgcaggctgaaaatg

SEQ ID NO: 213659 - DNA, 75 bp, Artificial Sequence
  Synthetic
cctatggaatgtgcacagaaaagttttcgtttgcaaagaatccagcagacactggtcatggaacagttgtcattg

SEQ ID NO: 213660 - DNA, 75 bp, Artificial Sequence
  Synthetic
ttcgtttgcaaagaatccagcagacactggtcatggaacagttgtcattgaactcctgtattctggaagtgacgg

SEQ ID NO: 213661 - DNA, 75 bp, Artificial Sequence
  Synthetic
gtggccagtctaaacgacatgactccagttggaaggttggtgacagtgaaccccttcgtggccacatccagttcc

SEQ ID NO: 213662 - DNA, 75 bp, Artificial Sequence
  Synthetic
cagttggaaggttggtgacagtgaaccccttcgtggccacatccagttccaattcacaggtcttagttgagatgg

SEQ ID NO: 213663 - DNA, 75 bp, Artificial Sequence
  Synthetic
tcaccaagtatttggcggtgcattcagaacgctctttgggggaatgtcttggatcacacaaggactaatgggagc

SEQ ID NO: 213664 - DNA, 75 bp, Artificial Sequence
  Synthetic
tgtggtcgggagaggagaaaaacaaatcaaccaccactggcacaaacctggaagcacattgggcaaagccttctc

SEQ ID NO: 213665 - DNA, 75 bp, Artificial Sequence
  Synthetic
atcaaccaccactggcacaaacctggaagcacattgggcaaagccttctcaacaacgttgaaaggtgcccaaaga

SEQ ID NO: 213666 - DNA, 75 bp, Artificial Sequence
  Synthetic
gggattttggctccattggaggggtcttcaattccattgggaaggccgttcaccaggtattcggtggcgcattca

SEQ ID NO: 213667 - DNA, 75 bp, Artificial Sequence
  Synthetic
cttcaattccattgggaaggccgttcaccaggtattcggtggcgcattcagaacgctttttggtggaatgtcctg

SEQ ID NO: 213668 - DNA, 75 bp, Artificial Sequence
  Synthetic
ctgctactctggatgggaataaacgctagagatcgctcaatcgccatggccttcttggtcacaggtggaacactt

SEQ ID NO: 213669 - DNA, 75 bp, Artificial Sequence
  Synthetic
ctagagatcgctcaatcgccatggccttcttggtcacaggtggaacacttttgtttttagcaaccaacgtacacg

SEQ ID NO: 213670 - DNA, 75 bp, Artificial Sequence
  Synthetic
agtggcatctttgtgcacaacgacgtggaagcttgggtggataggtataagtacttacctgaaacacctagggcc

SEQ ID NO: 213671 - DNA, 75 bp, Artificial Sequence
  Synthetic
acatggaaggaatttgtggagtgaggtctgtcaccagactagaacaccaaatgtgggaggctgtgcgcgatgagc

SEQ ID NO: 213672 - DNA, 75 bp, Artificial Sequence
  Synthetic
gtctgtcaccagactagaacaccaaatgtgggaggctgtgcgcgatgagctgaacgttttactcaaagaaaacgc

SEQ ID NO: 213673 - DNA, 75 bp, Artificial Sequence
  Synthetic
aagcctgtgggcaggtatcgctcagccccgaaacgtctgtccatgacacaagagaagtttgaaatgggatggaaa

SEQ ID NO: 213674 - DNA, 75 bp, Artificial Sequence
  Synthetic
ccccgaaacgtctgtccatgacacaagagaagtttgaaatgggatggaaagcatggggaaaaagcatcctttttg

SEQ ID NO: 213675 - DNA, 75 bp, Artificial Sequence
  Synthetic
tgttgttgatggacctgaaacaaaggagtgccccgatgaacacagagcctggaacagtatgcaaattgaggattt

SEQ ID NO: 213676 - DNA, 75 bp, Artificial Sequence
  Synthetic
gagtgccccgatgaacacagagcctggaacagtatgcaaattgaggattttggctttggcattacatcaacccgt

SEQ ID NO: 213677 - DNA, 75 bp, Artificial Sequence
  Synthetic
acactgatgagtgcgatggaacaatcatagggacggccatcaaaggacatgtggcagtccatagtgacctgtcat

SEQ ID NO: 213678 - DNA, 75 bp, Artificial Sequence
  Synthetic
catagggacggccatcaaaggacatgtggcagtccatagtgacctgtcatactggattgagagtcacttgaacga

SEQ ID NO: 213679 - DNA, 75 bp, Artificial Sequence
  Synthetic
tttggagagataaaatcttgcacgtggccagaaacacacactctctggggagatggcgttgaggaaagtgaactc

SEQ ID NO: 213680 - DNA, 75 bp, Artificial Sequence
  Synthetic
ggccagaaacacacactctctggggagatggcgttgaggaaagtgaactcatcatcccacatacgatagcgggac

SEQ ID NO: 213681 - DNA, 75 bp, Artificial Sequence
  Synthetic
gaccccgcttgtgcaccaaggaagaattcataaagaaagtcaatagcaacgcggctcttggagcagtgtttgctg

SEQ ID NO: 213682 - DNA, 75 bp, Artificial Sequence
  Synthetic
agggtacaaaactcagaatcaggggccctgggacgaagatggcatcgtcttagactttgactattgcccaggaac

SEQ ID NO: 213683 - DNA, 75 bp, Artificial Sequence
  Synthetic
ccctgggacgaagatggcatcgtcttagactttgactattgcccaggaacaaaggtcactattacagaagattgt

SEQ ID NO: 213684 - DNA, 75 bp, Artificial Sequence
  Synthetic
ccaccactgacagtggaaaactgatcactgattggtgttgccgcagctgcacgctgccgcccctacggttccgga

SEQ ID NO: 213685 - DNA, 75 bp, Artificial Sequence
  Synthetic
caggaagtggctgctggtatggaatggaagtcaggcctgtcaagcatgacgaggctacacttgtcagatcgcagg

SEQ ID NO: 213686 - DNA, 75 bp, Artificial Sequence
  Synthetic
tgatccttttcagttgggccttctggtgatgtttctggccacccaggaggtccttcgcaagaggtggacggccag

SEQ ID NO: 213687 - DNA, 75 bp, Artificial Sequence
  Synthetic
gcatcacgtacactgatctggcgaggtacgtagtgctagtcgccgccgcttttgcagaagctaataacggagggg

SEQ ID NO: 213688 - DNA, 75 bp, Artificial Sequence
  Synthetic
gtacgtagtgctagtcgccgccgcttttgcagaagctaataacggaggggacgtcttgcatctcgccctgattgc

SEQ ID NO: 213689 - DNA, 75 bp, Artificial Sequence
  Synthetic
ctggttgcgaacatgctcagcacgagatggacgaatcaggaaaatgtagttctggttctcggagcagccttcttt

SEQ ID NO: 213690 - DNA, 75 bp, Artificial Sequence
  Synthetic
gatggacgaatcaggaaaatgtagttctggttctcggagcagccttctttcaactggcatcggcagacctgcaga

SEQ ID NO: 213691 - DNA, 75 bp, Artificial Sequence
  Synthetic
cgcagctatagcttggatgatcattaaagcaatcacttttcccacaacttccaccatcaccatgccattgctggc

SEQ ID NO: 213692 - DNA, 75 bp, Artificial Sequence
  Synthetic
aaagcaatcacttttcccacaacttccaccatcaccatgccattgctggcgttgctggctccgggcatgagggct

SEQ ID NO: 213693 - DNA, 75 bp, Artificial Sequence
  Synthetic
gaactgcccgatgcattggagaccatcacactcatcgttgccatcactgtgatgacaggaggattcttcctgctc

SEQ ID NO: 213694 - DNA, 75 bp, Artificial Sequence
  Synthetic
ttctcctcattattggggtctgctctctgttgcaggagagaaggaggaccatggcgaaaaagaaaggagctgtgc

SEQ ID NO: 213695 - DNA, 75 bp, Artificial Sequence
  Synthetic
tctgttgcaggagagaaggaggaccatggcgaaaaagaaaggagctgtgctcttgggtttggcgctcacatccac

SEQ ID NO: 213696 - DNA, 75 bp, Artificial Sequence
  Synthetic
gccgcgggactcatggtctgcaacccaaacaagaagagaggatggcccgctactgagttcctgtcggcagttggc

SEQ ID NO: 213697 - DNA, 75 bp, Artificial Sequence
  Synthetic
caaacaagaagagaggatggcccgctactgagttcctgtcggcagttggcttaatgttcgccatcgtgggtggct

SEQ ID NO: 213698 - DNA, 75 bp, Artificial Sequence
  Synthetic
gtcgatacctttcatgctagcaggacttatggcagtgtcttacgtggtgtcaggaaaggcgacagatatgtggct

SEQ ID NO: 213699 - DNA, 75 bp, Artificial Sequence
  Synthetic
cttatggcagtgtcttacgtggtgtcaggaaaggcgacagatatgtggctcgagcgtgccgctgatatcagctgg

SEQ ID NO: 213700 - DNA, 75 bp, Artificial Sequence
  Synthetic
gcagccgaaggttagacgtcaagctggacgatgatggagacttccacctgatagatgatccaggtgtcccttgga

SEQ ID NO: 213701 - DNA, 75 bp, Artificial Sequence
  Synthetic
ggacgatgatggagacttccacctgatagatgatccaggtgtcccttggaaggtttgggtcttgcgcatgtcctg

SEQ ID NO: 213702 - DNA, 75 bp, Artificial Sequence
  Synthetic
tgggcgatcgtccctgctgcgtttggctactggctcactctgaaaacaacaaaaagaggaggtgtgttttgggac

SEQ ID NO: 213703 - DNA, 75 bp, Artificial Sequence
  Synthetic
gctactggctcactctgaaaacaacaaaaagaggaggtgtgttttgggacacaccatctccaaagccctgcgcaa

SEQ ID NO: 213704 - DNA, 75 bp, Artificial Sequence
  Synthetic
ccggattatggcaagaggaattcttggcacttaccaagccggtgttggagtcatgtatgagagtgtgttccacac

SEQ ID NO: 213705 - DNA, 75 bp, Artificial Sequence
  Synthetic
ggcacttaccaagccggtgttggagtcatgtatgagagtgtgttccacacgttatggcataccacgcgaggggcc

SEQ ID NO: 213706 - DNA, 75 bp, Artificial Sequence
  Synthetic
tgactccatactggggaagtgtaaaagaagatcgcatagcctatggaggtccatggaggtttgaccggaagtgga

SEQ ID NO: 213707 - DNA, 75 bp, Artificial Sequence
  Synthetic
agaagatcgcatagcctatggaggtccatggaggtttgaccggaagtggaacggaacggatgacgtgcaggtgat

SEQ ID NO: 213708 - DNA, 75 bp, Artificial Sequence
  Synthetic
acaaacatccagacgaagccgggagtgttttgcactccttttggagaagttggagctgtcagcctggattacccg

SEQ ID NO: 213709 - DNA, 75 bp, Artificial Sequence
  Synthetic
tgttttgcactccttttggagaagttggagctgtcagcctggattacccgcgaggaacatctggctcacccatcc

SEQ ID NO: 213710 - DNA, 75 bp, Artificial Sequence
  Synthetic
cttgtatggcaatggagttgagcttggggatggctcatatgtcagcgccatcgtgcagggtgaccgtcaagagga

SEQ ID NO: 213711 - DNA, 75 bp, Artificial Sequence
  Synthetic
ggggatggctcatatgtcagcgccatcgtgcagggtgaccgtcaagaggaaccaatcccagaagcgtacaatcca

SEQ ID NO: 213712 - DNA, 75 bp, Artificial Sequence
  Synthetic
ccgtgctggacttgcatccagggtcgggaaagactaggaagattctgcctcagataatcagagacgcaatacaac

SEQ ID NO: 213713 - DNA, 75 bp, Artificial Sequence
  Synthetic
gggaaagactaggaagattctgcctcagataatcagagacgcaatacaacaacgtctgagaacggctgtgctggc

SEQ ID NO: 213714 - DNA, 75 bp, Artificial Sequence
  Synthetic
atggcagaagccttgagaggacttccagtgcggtaccaaacttcagcagtgcaaagggagcatcaaggaaatgag

SEQ ID NO: 213715 - DNA, 75 bp, Artificial Sequence
  Synthetic
cagtgcggtaccaaacttcagcagtgcaaagggagcatcaaggaaatgagatagtagacgtgatgtgccatgcca

SEQ ID NO: 213716 - DNA, 75 bp, Artificial Sequence
  Synthetic
gaacagggtgcctaattacaacctgtttgtaatggatgaagcccacttcactgacccagctggcatcgctgcgcg

SEQ ID NO: 213717 - DNA, 75 bp, Artificial Sequence
  Synthetic
tttgtaatggatgaagcccacttcactgacccagctggcatcgctgcgcggggttacattgcaacaaaagtggaa

SEQ ID NO: 213718 - DNA, 75 bp, Artificial Sequence
  Synthetic
tgacggcgacacctcctggaaccacggatccctttcctgactcaaacgctccaattcatgatttgcaagacgaag

SEQ ID NO: 213719 - DNA, 75 bp, Artificial Sequence
  Synthetic
ggatccctttcctgactcaaacgctccaattcatgatttgcaagacgaagttccagacagggcgtggagtagtgg

SEQ ID NO: 213720 - DNA, 75 bp, Artificial Sequence
  Synthetic
ggaaaaaccgtctggtttgtagctagtgtgaagatgggaaatgaaattgctgtttgcctccagagagcgggaaaa

SEQ ID NO: 213721 - DNA, 75 bp, Artificial Sequence
  Synthetic
gtgtgaagatgggaaatgaaattgctgtttgcctccagagagcgggaaaaaaggtcatccagctcaatcggaaat

SEQ ID NO: 213722 - DNA, 75 bp, Artificial Sequence
  Synthetic
taaaaatggagattgggactttgtcatcaccactgacatctcagagatgggggccaattttggagcgagcagggt

SEQ ID NO: 213723 - DNA, 75 bp, Artificial Sequence
  Synthetic
atcaccactgacatctcagagatgggggccaattttggagcgagcagggtgattgactgcagaaagagtgtgaag

SEQ ID NO: 213724 - DNA, 75 bp, Artificial Sequence
  Synthetic
gcagagtcattctcggaaacccatctcccataaccagtgcaagcgcagctcaacggagaggcagggtgggcagga

SEQ ID NO: 213725 - DNA, 75 bp, Artificial Sequence
  Synthetic
tcccataaccagtgcaagcgcagctcaacggagaggcagggtgggcaggaatccgaaccaggttggagatgagta

SEQ ID NO: 213726 - DNA, 75 bp, Artificial Sequence
  Synthetic
gatgatagcaacctcgcccactggacggaagcaaaaatcttgctagacaacatacacatgcccaatggacttgtg

SEQ ID NO: 213727 - DNA, 75 bp, Artificial Sequence
  Synthetic
cggaagcaaaaatcttgctagacaacatacacatgcccaatggacttgtggcccaactgtatggacctgagaggg

SEQ ID NO: 213728 - DNA, 75 bp, Artificial Sequence
  Synthetic
gtaccgtctcagaggtgaggagaaaaagaatttcctagagttacttaggactgctgacctcccggtgtggctggc

SEQ ID NO: 213729 - DNA, 75 bp, Artificial Sequence
  Synthetic
aagaatttcctagagttacttaggactgctgacctcccggtgtggctggcctacaaggttgcgtccaatgggatt

SEQ ID NO: 213730 - DNA, 75 bp, Artificial Sequence
  Synthetic
ttgacgggcctcgcacaaatgccatactagaggataacactgaagttgagatagtcactagaacgggtgagagga

SEQ ID NO: 213731 - DNA, 75 bp, Artificial Sequence
  Synthetic
actagaggataacactgaagttgagatagtcactagaacgggtgagaggaaggtcctcaagcccagatggcttga

SEQ ID NO: 213732 - DNA, 75 bp, Artificial Sequence
  Synthetic
gccttaaagtggttcaaagacttcgcagccgggaaaaggtcagccattagcttcatagaagtgcttggacgcatg

SEQ ID NO: 213733 - DNA, 75 bp, Artificial Sequence
  Synthetic
cagccgggaaaaggtcagccattagcttcatagaagtgcttggacgcatgcctgaacacttcgcgggaaaaacac

SEQ ID NO: 213734 - DNA, 75 bp, Artificial Sequence
  Synthetic
ggtcgccacagcagagagaggtgggaaagcacatcgcatggctcttgaagagctaccagacgcattggagaccat

SEQ ID NO: 213735 - DNA, 75 bp, Artificial Sequence
  Synthetic
aaagcacatcgcatggctcttgaagagctaccagacgcattggagaccatcacactcattgtagccatcgctgtg

SEQ ID NO: 213736 - DNA, 75 bp, Artificial Sequence
  Synthetic
tgacatttcaacggtggctcgatgccccacgactggagaagctcacaacgaaaaacgtgctgacagcagctacgt

SEQ ID NO: 213737 - DNA, 75 bp, Artificial Sequence
  Synthetic
tgaagcaacggaaagggataggaaagatgggtttgggggctcttgtgcttgtactggccaccttcttcttgtggg

SEQ ID NO: 213738 - DNA, 75 bp, Artificial Sequence
  Synthetic
gatgggtttgggggctcttgtgcttgtactggccaccttcttcttgtgggcagcagaagtgtcaggaaccaagat

SEQ ID NO: 213739 - DNA, 75 bp, Artificial Sequence
  Synthetic
ttgctgatggtggtcctcatcccggaaccggagaagcagagatcgcagacagataatcaactggcagtgtttctc

SEQ ID NO: 213740 - DNA, 75 bp, Artificial Sequence
  Synthetic
aaccggagaagcagagatcgcagacagataatcaactggcagtgtttctcatctgcgtcctgactgtggtgggag

SEQ ID NO: 213741 - DNA, 75 bp, Artificial Sequence
  Synthetic
gttagaaaaaacaaaagcagacctcaaaagcatgttcggagggaaagcgcctgtgtcaggaatgactggactgcc

SEQ ID NO: 213742 - DNA, 75 bp, Artificial Sequence
  Synthetic
aaaagcatgttcggagggaaagcgcctgtgtcaggaatgactggactgcctggtatggcattggacctacgccca

SEQ ID NO: 213743 - DNA, 75 bp, Artificial Sequence
  Synthetic
gtagtacagttgtgctaacgcctctcttgaaacacataatcacatcagaatacgtgaccacatcactcgcctcaa

SEQ ID NO: 213744 - DNA, 75 bp, Artificial Sequence
  Synthetic
cttgaaacacataatcacatcagaatacgtgaccacatcactcgcctcaatcaattcacaggccggatcactatt

SEQ ID NO: 213745 - DNA, 75 bp, Artificial Sequence
  Synthetic
actgacctggatttgactgttggtctagtcttccttggctgctggggtcagatcactctcacgaccttcctgacg

SEQ ID NO: 213746 - DNA, 75 bp, Artificial Sequence
  Synthetic
tagtcttccttggctgctggggtcagatcactctcacgaccttcctgacggccgtggttttgacaacgctccatt

SEQ ID NO: 213747 - DNA, 75 bp, Artificial Sequence
  Synthetic
agctgaggcactaagagccgcacagaggagaacggcggccggtatcatgaaaaatgccgtcgtggacggcatggt

SEQ ID NO: 213748 - DNA, 75 bp, Artificial Sequence
  Synthetic
aggagaacggcggccggtatcatgaaaaatgccgtcgtggacggcatggttgctactgatgtgcctgaactggaa

SEQ ID NO: 213749 - DNA, 75 bp, Artificial Sequence
  Synthetic
aagttggccaggtgcttctcataggagttagcgtggcagcattccttgtcaaccccaacgtcaccactgtacgag

SEQ ID NO: 213750 - DNA, 75 bp, Artificial Sequence
  Synthetic
agttagcgtggcagcattccttgtcaaccccaacgtcaccactgtacgagaagcaggagtgctggtgacggcagc

SEQ ID NO: 213751 - DNA, 75 bp, Artificial Sequence
  Synthetic
gccagtgccgtatggaactccaccaccgccactgggctctgccatgttatgagaggcagctacttggctgggggt

SEQ ID NO: 213752 - DNA, 75 bp, Artificial Sequence
  Synthetic
ccgccactgggctctgccatgttatgagaggcagctacttggctgggggttccatcgcatggactcttattaaga

SEQ ID NO: 213753 - DNA, 75 bp, Artificial Sequence
  Synthetic
aggaagacctgggggcaggactttgggtgaacaatggaaggagaggctgaacgcgatgagcagagaagaattttt

SEQ ID NO: 213754 - DNA, 75 bp, Artificial Sequence
  Synthetic
ggtgctgcctgcgtctcagttccaggaggactgggttaacaaatctgacaacggaaggtgggaaagccctcagaa

SEQ ID NO: 213755 - DNA, 75 bp, Artificial Sequence
  Synthetic
ggtgaacaatggaaggagaggctgaacgcgatgagcagagaagaattttttaaatacaggagggaagccataatt

SEQ ID NO: 213756 - DNA, 75 bp, Artificial Sequence
  Synthetic
gagccaggcgtgagaacaacaaagtgggggggcatccagtttcgcgaggttcagcaaaacttcgctggctcgtgg

SEQ ID NO: 213757 - DNA, 75 bp, Artificial Sequence
  Synthetic
gggggggcatccagtttcgcgaggttcagcaaaacttcgctggctcgtggagaaaggattcgtttcaccaatagg

SEQ ID NO: 213758 - DNA, 75 bp, Artificial Sequence
  Synthetic
cgtggaggctggagctactacgcggcaactctgaagaaagtccaggaggtgagaggatacacgaaaggcggggca

SEQ ID NO: 213759 - DNA, 75 bp, Artificial Sequence
  Synthetic
caactctgaagaaagtccaggaggtgagaggatacacgaaaggcggggcagggcatgaggaacccatgctcatgc

SEQ ID NO: 213760 - DNA, 75 bp, Artificial Sequence
  Synthetic
attaaagagtggagtagacgtgttctacaggccctcggaacctagtgacaccttgctctgtgacataggggaatc

SEQ ID NO: 213761 - DNA, 75 bp, Artificial Sequence
  Synthetic
tacaggccctcggaacctagtgacaccttgctctgtgacataggggaatcttcccctagtccagaagtggaagaa

SEQ ID NO: 213762 - DNA, 75 bp, Artificial Sequence
  Synthetic
tgacttctgactggttgcacagaggccctagagaattctgcataaaggtgctctgcccttacatgcccaaggtca

SEQ ID NO: 213763 - DNA, 75 bp, Artificial Sequence
  Synthetic
ccctagagaattctgcataaaggtgctctgcccttacatgcccaaggtcatagagaagatggaagtgttgcagcg

SEQ ID NO: 213764 - DNA, 75 bp, Artificial Sequence
  Synthetic
cttcctttatctcggaactcaaatcatgagatgtactgggttagcggagcagctggtaatgtggtgcatgcggtg

SEQ ID NO: 213765 - DNA, 75 bp, Artificial Sequence
  Synthetic
atgagatgtactgggttagcggagcagctggtaatgtggtgcatgcggtgaacatgaccagccaggtgttattag

SEQ ID NO: 213766 - DNA, 75 bp, Artificial Sequence
  Synthetic
aggaccaaagtacgaagaggatgtcaatctggggagtggaaccagagccgtaggaaagggagaagtccacagtga

SEQ ID NO: 213767 - DNA, 75 bp, Artificial Sequence
  Synthetic
aatctggggagtggaaccagagccgtaggaaagggagaagtccacagtgaccaaggaaaaatcaagaaaaggatt

SEQ ID NO: 213768 - DNA, 75 bp, Artificial Sequence
  Synthetic
cgacatggcacagggaccctgagcacccgtatcgcacttggacataccacggtagctatgaagtgaaagccactg

SEQ ID NO: 213769 - DNA, 75 bp, Artificial Sequence
  Synthetic
cccgtatcgcacttggacataccacggtagctatgaagtgaaagccactggctcagccagctctcttgtcaatgg

SEQ ID NO: 213770 - DNA, 75 bp, Artificial Sequence
  Synthetic
tgggatgccatagccaatgtcaccacaatggccatgactgacacaactcccttcggacagcaaagagtcttcaaa

SEQ ID NO: 213771 - DNA, 75 bp, Artificial Sequence
  Synthetic
caatggccatgactgacacaactcccttcggacagcaaagagtcttcaaagaaaaagttgacacaaaagctccgg

SEQ ID NO: 213772 - DNA, 75 bp, Artificial Sequence
  Synthetic
gctcaacgaaaccacaaattggctgtgggcctatttgtcccgtgaaaaaagaccccgcttgtgcacgaaggaaga

SEQ ID NO: 213773 - DNA, 75 bp, Artificial Sequence
  Synthetic
tgggcctatttgtcccgtgaaaaaagaccccgcttgtgcacgaaggaagagtttataaagaaagtcaacagcaac

SEQ ID NO: 213774 - DNA, 75 bp, Artificial Sequence
  Synthetic
aacagaatcaatggagcacagcgcgggaagccgtgggtgacccgcgcttctgggagatggttgacgtggagaggg

SEQ ID NO: 213775 - DNA, 75 bp, Artificial Sequence
  Synthetic
ggaagccgtgggtgacccgcgcttctgggagatggttgacgtggagagggaaaaccacctgcgaggagaatgcca

SEQ ID NO: 213776 - DNA, 75 bp, Artificial Sequence
  Synthetic
aaaagagagaagaaacctggagagttcgggaaagccaagggaagtagggccatttggttcatgtggctaggagcg

SEQ ID NO: 213777 - DNA, 75 bp, Artificial Sequence
  Synthetic
tcgggaaagccaagggaagtagggccatttggttcatgtggctaggagcgcgatacctagaattcgaggctctgg

SEQ ID NO: 213778 - DNA, 75 bp, Artificial Sequence
  Synthetic
aagccggaggaattcaggtggtggagtggaaggttcaggcgtacagaagctaggatacatcctccgtgacatagc

SEQ ID NO: 213779 - DNA, 75 bp, Artificial Sequence
  Synthetic
gtggaaggttcaggcgtacagaagctaggatacatcctccgtgacatagcaaggaaagaaggagggaaaatgtac

SEQ ID NO: 213780 - DNA, 75 bp, Artificial Sequence
  Synthetic
ctagaataaccaaaactgacttggaaaatgaggctaaggttctggagctactggatggagaacatcgcatgcttg

SEQ ID NO: 213781 - DNA, 75 bp, Artificial Sequence
  Synthetic
aaatgaggctaaggttctggagctactggatggagaacatcgcatgcttgctcgcgccataattgaattgacata

SEQ ID NO: 213782 - DNA, 75 bp, Artificial Sequence
  Synthetic
aggccctcgacagacggaaagactgtgatggacgtgatatcaagagaagaccagagaggcagcgggcaagtggtc

SEQ ID NO: 213783 - DNA, 75 bp, Artificial Sequence
  Synthetic
tgatggacgtgatatcaagagaagaccagagaggcagcgggcaagtggtcacctatgctctcaacacctttacaa

SEQ ID NO: 213784 - DNA, 75 bp, Artificial Sequence
  Synthetic
aatggaggctgaaggggttattggaccacaacatgtggaacaattgcctaggaaaaataagatagcagtcaggac

SEQ ID NO: 213785 - DNA, 75 bp, Artificial Sequence
  Synthetic
ccacaacatgtggaacaattgcctaggaaaaataagatagcagtcaggacttggttgtttgaaaatggagaggaa

SEQ ID NO: 213786 - DNA, 75 bp, Artificial Sequence
  Synthetic
gagatgactgtgttgtcaagccgcttgacgacagatttgccacggccctttactttctcaacgcgatgtcgaagg

SEQ ID NO: 213787 - DNA, 75 bp, Artificial Sequence
  Synthetic
tgacgacagatttgccacggccctttactttctcaacgcgatgtcgaaggtcagaaaagacatccaggagtggaa

SEQ ID NO: 213788 - DNA, 75 bp, Artificial Sequence
  Synthetic
cagcaagttcctttctgctctaaccatttccaggagatcgtaatgaaggatgggaggagcatagttgtcccatgt

SEQ ID NO: 213789 - DNA, 75 bp, Artificial Sequence
  Synthetic
atttccaggagatcgtaatgaaggatgggaggagcatagttgtcccatgtaggggccaggatgagctaataggca

SEQ ID NO: 213790 - DNA, 75 bp, Artificial Sequence
  Synthetic
gtggaatgtgagggacacagcctgcttagccaaagcctacgcgcaaatgtggctgctcttgtactttcaccgcag

SEQ ID NO: 213791 - DNA, 75 bp, Artificial Sequence
  Synthetic
ttagccaaagcctacgcgcaaatgtggctgctcttgtactttcaccgcagagacttgcgtctcatggcaaacgcg

SEQ ID NO: 213792 - DNA, 75 bp, Artificial Sequence
  Synthetic
gggtgcccacaggcagaacatcttggtcgatccactcaaagggagaatggatgacgactgaggacatgctgcagg

SEQ ID NO: 213793 - DNA, 75 bp, Artificial Sequence
  Synthetic
gtcgatccactcaaagggagaatggatgacgactgaggacatgctgcaggtttggaacagagtttggatagagga

SEQ ID NO: 213794 - DNA, 75 bp, Artificial Sequence
  Synthetic
ccaattacaagctggacagatgtcccttacgtgggaaaacgggaggacatttggtgcggcagcctcatcggaacg

SEQ ID NO: 213795 - DNA, 75 bp, Artificial Sequence
  Synthetic
cttacgtgggaaaacgggaggacatttggtgcggcagcctcatcggaacgcgcgctagagcaacctgggctgaga

SEQ ID NO: 213796 - DNA, 75 bp, Artificial Sequence
  Synthetic
gagagcaatcatcgggaaagagacttatgtcgactacatgacatcactcaggagatacgaggatgtcttgatcca

SEQ ID NO: 213797 - DNA, 75 bp, Artificial Sequence
  Synthetic
tatgtcgactacatgacatcactcaggagatacgaggatgtcttgatccaggaagacagggtcatctagtgtggt

SEQ ID NO: 213798 - DNA, 75 bp, Artificial Sequence
  Synthetic
aaatgaatgtataatatagggtgtacatatggagtcaggccagcgttagctgccaccggatactgggtagacggt

SEQ ID NO: 213799 - DNA, 75 bp, Artificial Sequence
  Synthetic
catatggagtcaggccagcgttagctgccaccggatactgggtagacggtgctgcctgcaactcagtcccaggag

SEQ ID NO: 213800 - DNA, 75 bp, Artificial Sequence
  Synthetic
gggtaacgatccggaagacgtggactgctggtgcgacaatcaagaagtctacgtgcagtatggtcgctgcacacg

SEQ ID NO: 213801 - DNA, 75 bp, Artificial Sequence
  Synthetic
gagagtgagaaagccctcagaaccgtctcggaagaaggtccctgctcactggatgttggaagaccaacgtcaggc

SEQ ID NO: 213802 - DNA, 75 bp, Artificial Sequence
  Synthetic
tctcggaagaaggtccctgctcactggatgttggaagaccaacgtcaggccacaatcttgtgccactccgctgag

SEQ ID NO: 213803 - DNA, 75 bp, Artificial Sequence
  Synthetic
ggactgggttaacaaagcccatgaggcccccacggcccaagtctcgtccaggatgcaatggacgagatgtaagga

SEQ ID NO: 213804 - DNA, 75 bp, Artificial Sequence
  Synthetic
atgttgattatatgacttccctcagaagatatgaggatgtattgattcaggaggacagggtcatttagataggat

SEQ ID NO: 213805 - DNA, 75 bp, Artificial Sequence
  Synthetic
ctgctctatctcaacatcaagccactaggcacagagcgccgaagtatgtagctggtggtgaggaagaacacagga

SEQ ID NO: 213806 - DNA, 75 bp, Artificial Sequence
  Synthetic
tccataaccctcaagcttggtgattttggagaagtcacactggattgtgaaccaaagagtggactgaacactgaa

SEQ ID NO: 213807 - DNA, 75 bp, Artificial Sequence
  Synthetic
accccttcgtcgcgacatctagctccaactcaaaggtgctgttggagatagaacctcccttcggagactcttata

SEQ ID NO: 213808 - DNA, 75 bp, Artificial Sequence
  Synthetic
caacaactttgaaaggggctcagagattagcagcgctaggtgacacagcctgggacttcggctccattggaaggg

SEQ ID NO: 213809 - DNA, 75 bp, Artificial Sequence
  Synthetic
ccaacgtgtggtgttcactattctcttgctgttggtcgctccggcttacagttttaactgtctgggaatggggaa

SEQ ID NO: 213810 - DNA, 75 bp, Artificial Sequence
  Synthetic
gactgggagatcttctgctctatctcaacatcagctactaggcacagagcgccgaaagtatgtagctggtggtga

SEQ ID NO: 213811 - DNA, 75 bp, Artificial Sequence
  Synthetic
ggaatgccctgatgagcgcagagcctggaacagcatgcaaatcgaagacttcggctttggcatcacatcaacccg

SEQ ID NO: 213812 - DNA, 75 bp, Artificial Sequence
  Synthetic
cgggaaaggaagcattgacacatgcgcaaaattttcttgtaccagtaaggccattggaagaatgatccaaccaga

SEQ ID NO: 213813 - DNA, 75 bp, Artificial Sequence
  Synthetic
aactcaaaggtgctggtcgagatggaaccccctttcggagactcctacatcgtggttgggaggggagacaagcag

SEQ ID NO: 213814 - DNA, 75 bp, Artificial Sequence
  Synthetic
ctccattgcctggactctcatcaagaacgctgacaagccgtcctttaaaaagggaaggcctggaggcaggacgct

SEQ ID NO: 213815 - DNA, 75 bp, Artificial Sequence
  Synthetic
gcaactctgaaaaaagttcaggaagtcaaagggtacacgaaaggtggggcgggacatgaagaaccgatgctcatg

SEQ ID NO: 213816 - DNA, 75 bp, Artificial Sequence
  Synthetic
ggcacttaccaggccggcgttggagtcatgtacgagaatgttttccacacattgtggcacacaactagaggagca

SEQ ID NO: 213817 - DNA, 75 bp, Artificial Sequence
  Synthetic
tggagcagtcagcttggactacccacggggaacatccggctcacccatcctaaattccaatggagacgtcgtggg

SEQ ID NO: 213818 - DNA, 75 bp, Artificial Sequence
  Synthetic
caaataattaaggacgccatccagcagcgcttaagaacagccgtgttggcaccgacgcgggtggtagcagcagaa

SEQ ID NO: 213819 - DNA, 75 bp, Artificial Sequence
  Synthetic
tcatggcaaacgacaagccaacactagatgtccgcatgatcaacattgaagctagccaacttgctgaagtcagga

SEQ ID NO: 213820 - DNA, 75 bp, Artificial Sequence
  Synthetic
agaacatcaagtacgaggttggcatattcgtgcacggaaccaccacctcggaaaaccatggaaattactcagcgc

SEQ ID NO: 213821 - DNA, 75 bp, Artificial Sequence
  Synthetic
aatcccaaccaagttggagatgaataccattacggaggggccaccagtgaagatgacagcaacttagcccactgg

SEQ ID NO: 213822 - DNA, 75 bp, Artificial Sequence
  Synthetic
acctagagagttctgcataaaagttctctgcccctacatgcccaaggtcatagaaaaaatggaagttctgcagcg

SEQ ID NO: 213823 - DNA, 75 bp, Artificial Sequence
  Synthetic
ctctgcccctacatgcccaaggtcatagaaaaaatggaagttctgcagcgccgcttcggaggtgggctagtgcgt

SEQ ID NO: 213824 - DNA, 75 bp, Artificial Sequence
  Synthetic
ccaggataaaattaggaggagaatccagaaacttagagaggaattcggtacaacgtggcacaaagaccccgagca

SEQ ID NO: 213825 - DNA, 75 bp, Artificial Sequence
  Synthetic
ggagatacgaagatgtcctgatccaggaagatagggtcatctagtgtgatttagggtagaaaagtagactatgta

SEQ ID NO: 213826 - DNA, 75 bp, Artificial Sequence
  Synthetic
gctggatgcttggcagtaacaacggtcaacgcgtggtattcaccatcctcctgctgttggtcgctccggcttaca

SEQ ID NO: 213827 - DNA, 75 bp, Artificial Sequence
  Synthetic
gagacgactgcgtcgtcaagccgctggatgatagattcgccacagctctccattttctcaacgcaatgtctaaag

SEQ ID NO: 213828 - DNA, 75 bp, Artificial Sequence
  Synthetic
gccttcgcatggttggcacgactggctgcatgttcccttttgctccaatcattttcatgagattgtgatgaaaga

SEQ ID NO: 213829 - DNA, 75 bp, Artificial Sequence
  Synthetic
cgttttacgtcatgaccgtggggtcaaagtcatttttggtccatagggaatggtttcatgacctcgctctcccct

SEQ ID NO: 213830 - DNA, 75 bp, Artificial Sequence
  Synthetic
ccttgggacgagaatggcatagtcttggactttgactattgcccagggacaaaagtcaccatcacagaggattgt

SEQ ID NO: 213831 - DNA, 75 bp, Artificial Sequence
  Synthetic
ggcaagagaggcccttcggtcagaaccaccactgacagtggaaagttgatcactgactggtgctgtcgcagttgc

SEQ ID NO: 213832 - DNA, 75 bp, Artificial Sequence
  Synthetic
ccaccactgacagtggaaagttgatcactgactggtgctgtcgcagttgctcccttccgcccctaggattccgga

SEQ ID NO: 213833 - DNA, 75 bp, Artificial Sequence
  Synthetic
acgccatccccaaaaccttgctcaaaaggagacaccaccacaggagtttaccgcattatggcttgtgggattctt

SEQ ID NO: 213834 - DNA, 75 bp, Artificial Sequence
  Synthetic
aaaccgggccatcaatatgttgaaacggggattaccccgggtattcccactagtgggagggaagagggtagtgat

SEQ ID NO: 213835 - DNA, 75 bp, Artificial Sequence
  Synthetic
gagcttgtgggacggcagggggccagtaggatttgtgctggctcttataacgtttttcaagtttacaccattagc

SEQ ID NO: 213836 - DNA, 75 bp, Artificial Sequence
  Synthetic
agcagccggaggctagatgttaagttggatgacgacggcgactttcatttgattgatgatcccggagttccatgg

SEQ ID NO: 213837 - DNA, 75 bp, Artificial Sequence
  Synthetic
gcttgtatggcaatggagttgaactcggcgatggatcgtacgtcagcgccattgtgcagggtgaccgtcaagagg

SEQ ID NO: 213838 - DNA, 75 bp, Artificial Sequence
  Synthetic
ttctggtcctgggggcggcttttttccaactagcttcagtggatttacagatcggagtccacggaatcctgaacg

SEQ ID NO: 213839 - DNA, 75 bp, Artificial Sequence
  Synthetic
atacgtcaccacatcgttagcttcaattagttcacaggcgggttcactgttcgtcttgccgcgaggagtgccttt

SEQ ID NO: 213840 - DNA, 75 bp, Artificial Sequence
  Synthetic
agaagttttttttgtgtgacttctgggcttagtatcgttgagaagaatcgagagattagtgcagtttaaacagtt

SEQ ID NO: 213841 - DNA, 75 bp, Artificial Sequence
  Synthetic
aaaaggagagaacagatgctgggtccgggcaatcgacgtcggctacatgtgtgaggacactatcacgtacgaatg

SEQ ID NO: 213842 - DNA, 75 bp, Artificial Sequence
  Synthetic
tccaagcgaagcaggagatccgtgtcggtccaaacacatggggagagttcactagtgaataaaaaagaggcttgg

SEQ ID NO: 213843 - DNA, 75 bp, Artificial Sequence
  Synthetic
cataaggaatcctggctatgctttcctggcggcggtacttggctggatgcttggcagtaacaacggtcaacgcgt

SEQ ID NO: 213844 - DNA, 75 bp, Artificial Sequence
  Synthetic
tgggtggacttggtgctagaaggagatagctgcttgacaattatggcaaacgacaaaccaacattggacgtccgc

SEQ ID NO: 213845 - DNA, 75 bp, Artificial Sequence
  Synthetic
atgatcaacatcgaagctagccaacttgctgaggtcagaagttactgttatcatgcttcagtcactgacatctcg

SEQ ID NO: 213846 - DNA, 75 bp, Artificial Sequence
  Synthetic
ggcttcactgatcgtgggtggggcaacggatgtggacttttcgggaagggaagcattgacacatgtgcaaaattc

SEQ ID NO: 213847 - DNA, 75 bp, Artificial Sequence
  Synthetic
gtcccaggcggcaaagtttacagtaacacccaatgctccttcgataaccctcaaacttggtgactacggagaagt

SEQ ID NO: 213848 - DNA, 75 bp, Artificial Sequence
  Synthetic
tcaaacttggtgactacggagaagtcacactggactgtgagccaaggagtggactgaacactgaagcgttttacg

SEQ ID NO: 213849 - DNA, 75 bp, Artificial Sequence
  Synthetic
cttttttggccacgggaggtgtgctcgtctttttagcgaccaatgtgcatgctgacactggctgtgccattgaca

SEQ ID NO: 213850 - DNA, 75 bp, Artificial Sequence
  Synthetic
cctccatcaggcgttggcaggagccatcgtggtggagtactcaagctcagtgaagttaacatcaggccacctgaa

SEQ ID NO: 213851 - DNA, 75 bp, Artificial Sequence
  Synthetic
agaaacgcccagatccctagcgaagatcgtccacaaagcgcacaaggaaggcgtgtgcggagtcagatctgtcac

SEQ ID NO: 213852 - DNA, 75 bp, Artificial Sequence
  Synthetic
gcctatccatgacgcaagagaagtttgaaatgggctggaaagcatggggaaaaagcattctctttgccccggaat

SEQ ID NO: 213853 - DNA, 75 bp, Artificial Sequence
  Synthetic
tggacctgagacaaaggaatgccctgatgagcacagagcttggaacagcatgcaaatcgaagacttcggctttgg

SEQ ID NO: 213854 - DNA, 75 bp, Artificial Sequence
  Synthetic
catagtgacttgtcgtactggattgagagtcgctacaacgacacatggaaacttgagagggcagtctttggagag

SEQ ID NO: 213855 - DNA, 75 bp, Artificial Sequence
  Synthetic
gacacaaaaccagggaccttgggacgagaatggcatagtcttggactttgactattgcccagggacaaaagtcac

SEQ ID NO: 213856 - DNA, 75 bp, Artificial Sequence
  Synthetic
ctggccacccaggaggtccttcgcaagaggtggacggccagattgaccattcctgcggttttgggggccctactt

SEQ ID NO: 213857 - DNA, 75 bp, Artificial Sequence
  Synthetic
accttgctttgattgccgtttttaagatccaaccagcatttttagtgatgaacatgcttagcacgagatggacga

SEQ ID NO: 213858 - DNA, 75 bp, Artificial Sequence
  Synthetic
agaagtttatctgcgtgaacttcttggcttagtatcgttgagaagaatcgaaagattagtgcagtttaaacagtt

SEQ ID NO: 213859 - DNA, 75 bp, Artificial Sequence
  Synthetic
gttcccgccgcttttggttattggctcactttaaaaacaacaaaaagagggggcgtgttttgggacacgccatcc

SEQ ID NO: 213860 - DNA, 75 bp, Artificial Sequence
  Synthetic
ggctagagggattcttggcacttaccaggccggcgtcggagtcatgtacgagaatgttttccacacactatggca

SEQ ID NO: 213861 - DNA, 75 bp, Artificial Sequence
  Synthetic
caatggagttgagcttggcgatggctcatacgtcagcgccatcgtgcagggtgaccgtcaggaggaaccagtccc

SEQ ID NO: 213862 - DNA, 75 bp, Artificial Sequence
  Synthetic
caggaaaattctgccacaaataattaaggacgctatccagcagcgcctaagaacagctgtgttggcaccgacgcg

SEQ ID NO: 213863 - DNA, 75 bp, Artificial Sequence
  Synthetic
aaggacgctatccagcagcgcctaagaacagctgtgttggcaccgacgcgggtggtagcagcagaaatggcagaa

SEQ ID NO: 213864 - DNA, 75 bp, Artificial Sequence
  Synthetic
atcaaacttcagcagtgcagagagagcaccaagggaatgaaatagtggatgtgatgtgccacgccactctgaccc

SEQ ID NO: 213865 - DNA, 75 bp, Artificial Sequence
  Synthetic
tggggaatgagattgcaatgtgcctccaaagagcggggaaaaaggtcatccaactcaaccgcaagtcctatgaca

SEQ ID NO: 213866 - DNA, 75 bp, Artificial Sequence
  Synthetic
gcaagaggggtccctcaatcagaactaccactgacagtggaaagctgatcaccgattggtgctgccgcagctgtt

SEQ ID NO: 213867 - DNA, 75 bp, Artificial Sequence
  Synthetic
aggaaaggcaaccgacatgtggctggaccgggctgccgacatcagctgggagatggaagctgcaatcacaggaag

SEQ ID NO: 213868 - DNA, 75 bp, Artificial Sequence
  Synthetic
actggcggtgtttctcatctgtgtcttgaccgtggttggagtggtggcagcaaacgagtacgggatgctagaaaa

SEQ ID NO: 213869 - DNA, 75 bp, Artificial Sequence
  Synthetic
cctgatcacgtcggaatacgtcaccacatcgctagcctcaattaactcacaagctggctcattatttgtcttgcc

SEQ ID NO: 213870 - DNA, 75 bp, Artificial Sequence
  Synthetic
acgaggcgtgccttttaccgacctagacttgaccgttggcctcgtcttccttggctgttggggtcaaatcaccct

SEQ ID NO: 213871 - DNA, 75 bp, Artificial Sequence
  Synthetic
tacatgcccaaggttatagaaaaaatggaagttctgcagcgccgcttcggaggtgggctagtgcgtctccccctg

SEQ ID NO: 213872 - DNA, 75 bp, Artificial Sequence
  Synthetic
cacttggacataccacggaagctatgaagtgaaggctactggctcagctagctctctcgtcaacggagtggtgaa

SEQ ID NO: 213873 - DNA, 75 bp, Artificial Sequence
  Synthetic
gacgtccgcatgatcaacatcgaagctagccaacttgctgaggtcagaagttactgctatcatgcttcagtcact

SEQ ID NO: 213874 - DNA, 75 bp, Artificial Sequence
  Synthetic
atgaagaccattggctgagccgagagaattcaggaggtggagtggaaggctcaggcgtccaaaagctgggataca

SEQ ID NO: 213875 - DNA, 75 bp, Artificial Sequence
  Synthetic
gcaggagccatcgtggtggagtactcaagctcagtgaagttaacatcaggtcacctgaaatgcaggctgaaaatg

SEQ ID NO: 213876 - DNA, 75 bp, Artificial Sequence
  Synthetic
gtgtcgtcaagccgctggacgacagattcgccacggccctccacttcctcaacgcaatgtcaaaggtcagaaaag

SEQ ID NO: 213877 - DNA, 75 bp, Artificial Sequence
  Synthetic
gcatatgcacagatgtggctactcctatacttccatcgtagggacttgcgtctcatggcaaatgcgatttgctca

SEQ ID NO: 213878 - DNA, 75 bp, Artificial Sequence
  Synthetic
acaaggaaggcgtgtgcggagtcagatctgtcactagactggagcaccaaatgtgggaagccgtacgggacgaat

SEQ ID NO: 213879 - DNA, 75 bp, Artificial Sequence
  Synthetic
tacatgacctcactcaggagatacgaagacgtcttgatccaggaagacagggtcatctagtgtgatttaaggtag

SEQ ID NO: 213880 - DNA, 75 bp, Artificial Sequence
  Synthetic
cacgtggaaacttgagagggcagtctttggagagatcaaatcttgcacttggccggagacacacaccctttgggg

SEQ ID NO: 213881 - DNA, 75 bp, Artificial Sequence
  Synthetic
ctcggaagcaggtccctgctcactggaagttgaaagaccaacgtcaggccacaaatttgtgccactccgctgggg

SEQ ID NO: 213882 - DNA, 75 bp, Artificial Sequence
  Synthetic
ggaaatcagacctgtcaggcatgatgaaacaacactcgtcagatcacaggttgatgctttcaatggtgaaatggt

SEQ ID NO: 213883 - DNA, 75 bp, Artificial Sequence
  Synthetic
tggcaaacgacaaaccaacattggatgtccgcatgattaacatcgaagctagccaacttgctgaggtcagaagct

SEQ ID NO: 213884 - DNA, 75 bp, Artificial Sequence
  Synthetic
attgatgatcccggtgttccatggaaggtttgggtcctgcgcatgtcttgcattggcttagccgccctcacgccc

SEQ ID NO: 213885 - DNA, 75 bp, Artificial Sequence
  Synthetic
ggacatgaagaaccgatgctcatgcagagctacggctggaacctggtctccttgaagagtggagtggacgtgttt

SEQ ID NO: 213886 - DNA, 75 bp, Artificial Sequence
  Synthetic
ctctgacccacagactgatgtcaccgaacagagtgcccaactacaacttatttgtcatggatgaggcccacttca

SEQ ID NO: 213887 - DNA, 75 bp, Artificial Sequence
  Synthetic
gatactggatgtgccattgacatcacaagaagagagatgagatgtggaagtggcatctttgtgcataacgacgtg

SEQ ID NO: 213888 - DNA, 75 bp, Artificial Sequence
  Synthetic
gctggaaaaaaccaaagcagatctcaagagcatgtttggcggaaagacacaggcatcaggattgactggactgcc

SEQ ID NO: 213889 - DNA, 75 bp, Artificial Sequence
  Synthetic
agccaccagctggagtcagggaagtgctcaatgaggccaccaattggctgtgggcccacttgtcacgggaaaaaa

SEQ ID NO: 213890 - DNA, 75 bp, Artificial Sequence
  Synthetic
attcataaagaaagttaatagcaacgcggctcttggagcagtgtttgctgaacagaatcaatggagcacagcacg

SEQ ID NO: 213891 - DNA, 75 bp, Artificial Sequence
  Synthetic
accgtctcagaggcgaagaaaagaaaaacttcttggagctgcttaggacggctgaccttccggtgtggctggcct

SEQ ID NO: 213892 - DNA, 75 bp, Artificial Sequence
  Synthetic
agacccgcagcagaaggaaagactgtgatggacgtgatatcaagagaagaccaaagggggagtggacaggtggtc

SEQ ID NO: 213893 - DNA, 75 bp, Artificial Sequence
  Synthetic
aaccgggctatcaatatgctgaaacgcggcttaccccgcgtattcccactagtgggagtgaagagggtagtgatg

SEQ ID NO: 213894 - DNA, 75 bp, Artificial Sequence
  Synthetic
aagcttttgatgaccgtcaacaaaacggacattgcagacgttatcgtgattcccacctcaaaaggagagaacaga

SEQ ID NO: 213895 - DNA, 75 bp, Artificial Sequence
  Synthetic
cggagaagtcacactggactgtgagccaaggagtggactaaacactgaagcgttttacgtcatgaccgtggggtc

SEQ ID NO: 213896 - DNA, 75 bp, Artificial Sequence
  Synthetic
tggaacagcatgcaaatcgaagacttcggcttcggtatcacatcaacccgagtgtggctgaaaattagagaggag

SEQ ID NO: 213897 - DNA, 75 bp, Artificial Sequence
  Synthetic
caacggaggggcagagtaggcagaaaccccaaccaagttggagatgaataccactatgggggggctaccagtgaa

SEQ ID NO: 213898 - DNA, 75 bp, Artificial Sequence
  Synthetic
cccacgactggagaagcccacaacgagaagcgagctgatagtagctatgtgtgcaaacaaggcttcactgatcgt

SEQ ID NO: 213899 - DNA, 75 bp, Artificial Sequence
  Synthetic
aaaacatcaaatacgaagttggtatttttgtgcatggaaccaccacttcggaaaaccatgggaattactcagcgc

SEQ ID NO: 213900 - DNA, 75 bp, Artificial Sequence
  Synthetic
tgcaagagtttatgcagatcaccaagccctcaagtggttcaaagactttgcagcagggaagagatcagccgttag

SEQ ID NO: 213901 - DNA, 75 bp, Artificial Sequence
  Synthetic
gaaaaccatgggaattactcagcgcaagttggggcgtcccaggcggcaaagtttacagtaacacccaatgctcct

SEQ ID NO: 213902 - DNA, 75 bp, Artificial Sequence
  Synthetic
gccatggttctggcgacacttcactacgggtacatgctccctggatggcaagcagaagcactcagggctgcccag

SEQ ID NO: 213903 - DNA, 75 bp, Artificial Sequence
  Synthetic
agaggacaggatgagttgataggcagggctcgcatctccccaggagctggatggaatgtgaaggacacagcttgc

SEQ ID NO: 213904 - DNA, 75 bp, Artificial Sequence
  Synthetic
tatgttgactacatgacttcactcaggagatatgaagacgtcttgatccaggaagacagggtcatctagtgtgat

SEQ ID NO: 213905 - DNA, 75 bp, Artificial Sequence
  Synthetic
ccaattggcctcagtggatttgcagataggagtccacggaatcctgaatgccgctgccatagcatggatgattgt

SEQ ID NO: 213906 - DNA, 75 bp, Artificial Sequence
  Synthetic
gtgtttcggactcccttcggggaggttggggctgttagtctggattacccgcgaggaacatccggctcacccatt

SEQ ID NO: 213907 - DNA, 75 bp, Artificial Sequence
  Synthetic
acggctgacctcccagtatggctagcctacaaagtggcgtccaatggcattcagtacactgacagaaaatggtgc

SEQ ID NO: 213908 - DNA, 75 bp, Artificial Sequence
  Synthetic
agatgacagtaatctagctcattggacagaggcaaagattatgttagacaacatacacatgcccaatggactggt

SEQ ID NO: 213909 - DNA, 75 bp, Artificial Sequence
  Synthetic
gaaaaggctttcacaatggatggcgaatatcgtctcagaggtgaagaaaagaaaaacttcttagaactgcttagg

SEQ ID NO: 213910 - DNA, 75 bp, Artificial Sequence
  Synthetic
ggggtctcctctaacctctagtccttacacctcgtctattgcatcctagacgaggcttgggccgtgggggcctca

SEQ ID NO: 213911 - DNA, 75 bp, Artificial Sequence
  Synthetic
tacacctcgtctattgcatcctagacgaggcttgggccgtgggggcctcaacggctttggtaacccagtcctcct

SEQ ID NO: 213912 - DNA, 75 bp, Artificial Sequence
  Synthetic
cgaggcttgggccgtgggggcctcaacggctttggtaacccagtcctcctggggctgcgcaggccgcactcccca

SEQ ID NO: 213913 - DNA, 75 bp, Artificial Sequence
  Synthetic
gacgttggtctttcaacttccagtgagcagggacctgcttccgagacggttctgagggctttctcactttctgtt

SEQ ID NO: 213914 - DNA, 75 bp, Artificial Sequence
  Synthetic
gcctgagcatttcatgggaaagacgcgggaagccttagacaccatgtacttggttgcaacggctgagaaaggtgg

SEQ ID NO: 213915 - DNA, 75 bp, Artificial Sequence
  Synthetic
agcagggacctgcttccgagacggttctgagggctttctcactttctgttgtcagatttgttaacccagtcctcc

SEQ ID NO: 213916 - DNA, 75 bp, Artificial Sequence
  Synthetic
tggttgcaacggctgagaaaggtgggaaagcacatcgaatggctctcgaagagctgccagatgcactggaaacca

SEQ ID NO: 213917 - DNA, 75 bp, Artificial Sequence
  Synthetic
tctacccagtatccggtggcagcttttgctggcctgactccatatgcatgcattttctcatttacattatttaca

SEQ ID NO: 213918 - DNA, 75 bp, Artificial Sequence
  Synthetic
tcacacttattgttgccattactgtgatgacaggaggattcttcctactaatgatgcagcgaaagggtataggga

SEQ ID NO: 213919 - DNA, 75 bp, Artificial Sequence
  Synthetic
ttgctggcctgactccatatgcatgcattttctcatttacattatttacatagtctacttttctaccttaagtca

SEQ ID NO: 213920 - DNA, 75 bp, Artificial Sequence
  Synthetic
tcaaaacatcttcgtatctcctgagtgaggtcatgtagtcaacataattttctttcccaatgacagctctaacct

SEQ ID NO: 213921 - DNA, 75 bp, Artificial Sequence
  Synthetic
tgaggtcatgtagtcaacataattttctttcccaatgacagctctaacctggtttatcgccgcatagatgttctc

SEQ ID NO: 213922 - DNA, 75 bp, Artificial Sequence
  Synthetic
ccgatgaggctgccacaccagatgtcctcacgctttcccacatacggaacgtctgtccagcttgtgattggagtc

SEQ ID NO: 213923 - DNA, 75 bp, Artificial Sequence
  Synthetic
cctcacgctttcccacatacggaacgtctgtccagcttgtgattggagtcttgtccatcatccattcattttctt

SEQ ID NO: 213924 - DNA, 75 bp, Artificial Sequence
  Synthetic
cagcatgtcttccgtggtcatccactctcctttcgagtgtattgaccaggatgtcctgcctgtgggcacccaatc

SEQ ID NO: 213925 - DNA, 75 bp, Artificial Sequence
  Synthetic
tctcctttcgagtgtattgaccaggatgtcctgcctgtgggcacccaatccactggcactgctgagcaaattgca

SEQ ID NO: 213926 - DNA, 75 bp, Artificial Sequence
  Synthetic
acgatttgtgctggctcttatcacgttcttcaagtttacagcattagccccgaccaaggcgcttttgggccgctg

SEQ ID NO: 213927 - DNA, 75 bp, Artificial Sequence
  Synthetic
gatggaagtataggagtagccacatctgtgcatacgctttggccaggcaagctgtgtccttcacattccatccag

SEQ ID NO: 213928 - DNA, 75 bp, Artificial Sequence
  Synthetic
ctgtgcatacgctttggccaggcaagctgtgtccttcacattccatccagctcctggagagatgcgagccctgcc

SEQ ID NO: 213929 - DNA, 75 bp, Artificial Sequence
  Synthetic
gggacgactatactccttccatctttcatcacaatctcctgaaaatggttggagcagaagggaacttgctgccaa

SEQ ID NO: 213930 - DNA, 75 bp, Artificial Sequence
  Synthetic
tcatcacaatctcctgaaaatggttggagcagaagggaacttgctgccaatcgtgccagccatgcgaaggcttcc

SEQ ID NO: 213931 - DNA, 75 bp, Artificial Sequence
  Synthetic
tgacattgcgttgaggaagtggagggctgtggcgaatctgtcgtccagcggcttgacgacgcagtcatctccgct

SEQ ID NO: 213932 - DNA, 75 bp, Artificial Sequence
  Synthetic
gctgtggcgaatctgtcgtccagcggcttgacgacgcagtcatctccgctgatcgccatcctggtcactctctcc

SEQ ID NO: 213933 - DNA, 75 bp, Artificial Sequence
  Synthetic
tgacagctatcttgttttttctaggtagctgttccaagtgttgtggtccaatgaccccctcagcctccatcagcc

SEQ ID NO: 213934 - DNA, 75 bp, Artificial Sequence
  Synthetic
tagctgttccaagtgttgtggtccaatgaccccctcagcctccatcagcctgacgagctggacagcgatgttcgt

SEQ ID NO: 213935 - DNA, 75 bp, Artificial Sequence
  Synthetic
atccgtttcggtccaaacgcatggggaaagctcactagtgaacaaaaaagaggcttggctggattcaacgaaggc

SEQ ID NO: 213936 - DNA, 75 bp, Artificial Sequence
  Synthetic
acttgtccactcccccgttgatcttctcttgatatcacgtccatcacggtctttccttctgctgcaggtctcatg

SEQ ID NO: 213937 - DNA, 75 bp, Artificial Sequence
  Synthetic
ctcttgatatcacgtccatcacggtctttccttctgctgcaggtctcatgaccttgaccactttatgcctgtaag

SEQ ID NO: 213938 - DNA, 75 bp, Artificial Sequence
  Synthetic
catgcggtgttcaccgtctagaagctccagcaccttggcttcattttctaaatcagttctggtaattctagtgtc

SEQ ID NO: 213939 - DNA, 75 bp, Artificial Sequence
  Synthetic
tccagcaccttggcttcattttctaaatcagttctggtaattctagtgtcccacccggcggtatcatcagcgtac

SEQ ID NO: 213940 - DNA, 75 bp, Artificial Sequence
  Synthetic
tgtcacggaggatgtatcccagcttttggacgcctgagccttccactccacctcctgaattctctcggctcagcc

SEQ ID NO: 213941 - DNA, 75 bp, Artificial Sequence
  Synthetic
ttggacgcctgagccttccactccacctcctgaattctctcggctcagccagtggtcttcattcaggaaccccaa

SEQ ID NO: 213942 - DNA, 75 bp, Artificial Sequence
  Synthetic
ccaagccacatgaaccagatggccctgcttcctttggcttttccaaactctccaggcttcttctctctttttccc

SEQ ID NO: 213943 - DNA, 75 bp, Artificial Sequence
  Synthetic
tgcttcctttggcttttccaaactctccaggcttcttctctctttttcccatcatgttgtagatacatgtgtgac

SEQ ID NO: 213944 - DNA, 75 bp, Artificial Sequence
  Synthetic
ctcttcatcaactatctcccaaaaccgcgggtcatccacagcctcacgcgccgtgctccattgattctgttcagc

SEQ ID NO: 213945 - DNA, 75 bp, Artificial Sequence
  Synthetic
cgcgggtcatccacagcctcacgcgccgtgctccattgattctgttcagcgaacactgctccaagagccgcgttg

SEQ ID NO: 213946 - DNA, 75 bp, Artificial Sequence
  Synthetic
ccttagtgcacaagcggggtcttttcttccgtgacaagtgggcccacagccagttggtggtctcgttgagcactt

SEQ ID NO: 213947 - DNA, 75 bp, Artificial Sequence
  Synthetic
tcgtgcacggaaccaccacctcggagaaccatggaaattactcagcgcaagtaggagcgtctcaagcagcaaagt

SEQ ID NO: 213948 - DNA, 75 bp, Artificial Sequence
  Synthetic
cttccgtgacaagtgggcccacagccagttggtggtctcgttgagcacttccttggctccaactggtggctcagg

SEQ ID NO: 213949 - DNA, 75 bp, Artificial Sequence
  Synthetic
aaaactctttgctgtccaaaaggggtggtgtcagtcatggccatggtggtaacgttggcaatggcgtcccagggt

SEQ ID NO: 213950 - DNA, 75 bp, Artificial Sequence
  Synthetic
tggtgtcagtcatggccatggtggtaacgttggcaatggcgtcccagggtttgctcatgagcttcaccactccgt

SEQ ID NO: 213951 - DNA, 75 bp, Artificial Sequence
  Synthetic
agccttcacttcatagcttccgtggtatgtccaagtgcggtatggatgctcagggtctttgtgccacgttgtggc

SEQ ID NO: 213952 - DNA, 75 bp, Artificial Sequence
  Synthetic
tatgtccaagtgcggtatggatgctcagggtctttgtgccacgttgtggcgaattcttctttaagcttctggatt

SEQ ID NO: 213953 - DNA, 75 bp, Artificial Sequence
  Synthetic
tatggatttctccctttcccacagctcttgttccgctccctaggttgacatcttcctcatactttggccctctcc

SEQ ID NO: 213954 - DNA, 75 bp, Artificial Sequence
  Synthetic
tcttgttccgctccctaggttgacatcttcctcatactttggccctctccacactgtgcgatccattcgccccag

SEQ ID NO: 213955 - DNA, 75 bp, Artificial Sequence
  Synthetic
gcgtgcaccacattaccagcagctccactaacccaatacatctcgtgattggagtttcgggacaaggggagacgc

SEQ ID NO: 213956 - DNA, 75 bp, Artificial Sequence
  Synthetic
cactaacccaatacatctcgtgattggagtttcgggacaaggggagacgcactagcccacctccgaagcggcgct

SEQ ID NO: 213957 - DNA, 75 bp, Artificial Sequence
  Synthetic
cttgggcatgtaagggcagagaacttttatgcagaactctctaggtcctcggtgcaaccaatcagatgtcatctc

SEQ ID NO: 213958 - DNA, 75 bp, Artificial Sequence
  Synthetic
tttatgcagaactctctaggtcctcggtgcaaccaatcagatgtcatctctaggacgcgtagtgtgcgttgttcc

SEQ ID NO: 213959 - DNA, 75 bp, Artificial Sequence
  Synthetic
cccctatgtcacagaacagggtgtcactgggctctgaaggtttataaaacacgtccactccactcttcagggaga

SEQ ID NO: 213960 - DNA, 75 bp, Artificial Sequence
  Synthetic
actgggctctgaaggtttataaaacacgtccactccactcttcagggagaccaagttccagccgtagctctgcat

SEQ ID NO: 213961 - DNA, 75 bp, Artificial Sequence
  Synthetic
tagcagcgctaggtgacacagcctgggacttcggctccattggaggggtattcaactccatagggaaagctgttc

SEQ ID NO: 213962 - DNA, 75 bp, Artificial Sequence
  Synthetic
ccacctttcgtgtatcctctgacctcctggaccttcttcagggttgctgcgtagtagctccatcctccacgccca

SEQ ID NO: 213963 - DNA, 75 bp, Artificial Sequence
  Synthetic
cctggaccttcttcagggttgctgcgtagtagctccatcctccacgcccacaccctagatcaatgacttttccta

SEQ ID NO: 213964 - DNA, 75 bp, Artificial Sequence
  Synthetic
atcacacaaggactaatgggggccttacttctttggatgggtgtcaacgcacgagaccggtcaatcgccctggct

SEQ ID NO: 213965 - DNA, 75 bp, Artificial Sequence
  Synthetic
gagccaacggagctttgctgagccccgcgaaaccggatgtcctcctactacgttattttcacgtctagccctgcg

SEQ ID NO: 213966 - DNA, 75 bp, Artificial Sequence
  Synthetic
cgcgaaaccggatgtcctcctactacgttattttcacgtctagccctgcgtgcttcagtgcggtccacctcgatt

SEQ ID NO: 213967 - DNA, 75 bp, Artificial Sequence
  Synthetic
actcttctctgctcatggcatttagtttttccttccactgctcccctagcgtcctgcccccaggccttccccttt

SEQ ID NO: 213968 - DNA, 75 bp, Artificial Sequence
  Synthetic
tttttccttccactgctcccctagcgtcctgcccccaggccttccccttttcaaggaaggcctgtcagcgttctt

SEQ ID NO: 213969 - DNA, 75 bp, Artificial Sequence
  Synthetic
agaggcctgggtagataggtacaaatatctgccagagacgcccagatccttagcgaagatcgtccacaaagcaca

SEQ ID NO: 213970 - DNA, 75 bp, Artificial Sequence
  Synthetic
ccagccaggtagctgccacgcatgacatggcaaagtcccgtggctgtggtggaattccaaacagcactggctcca

SEQ ID NO: 213971 - DNA, 75 bp, Artificial Sequence
  Synthetic
catggcaaagtcccgtggctgtggtggaattccaaacagcactggctccattgtcccacaaagtaagcgtagccg

SEQ ID NO: 213972 - DNA, 75 bp, Artificial Sequence
  Synthetic
cacagtagtgacattagggttgacgaggaacgctgccacacttacccctatgaggagcacctgtccgactttctt

SEQ ID NO: 213973 - DNA, 75 bp, Artificial Sequence
  Synthetic
aggaacgctgccacacttacccctatgaggagcacctgtccgactttcttttgcatcagaggagtagtcctttcc

SEQ ID NO: 213974 - DNA, 75 bp, Artificial Sequence
  Synthetic
ttccgtcaacaacggcattcttcattattccagctgctgtccttctctgggcagccctgagtgcttctgcttgcc

SEQ ID NO: 213975 - DNA, 75 bp, Artificial Sequence
  Synthetic
tattccagctgctgtccttctctgggcagccctgagtgcttctgcttgccatccagggagcatgtacccgtagtg

SEQ ID NO: 213976 - DNA, 75 bp, Artificial Sequence
  Synthetic
cactgatgagtgtgatggagcaatcatagggacagctgttaaagggcatgtggcagttcatagtgacttgtcata

SEQ ID NO: 213977 - DNA, 75 bp, Artificial Sequence
  Synthetic
agaaacgttgtgagggtgatttgaccccaacagccaaggaaaacgaggccaacggtcaagtctaggtcggtaaaa

SEQ ID NO: 213978 - DNA, 75 bp, Artificial Sequence
  Synthetic
cccaacagccaaggaaaacgaggccaacggtcaagtctaggtcggtaaaaggcacgcctcgtggcaggacgaata

SEQ ID NO: 213979 - DNA, 75 bp, Artificial Sequence
  Synthetic
ggccagcgatgtggtgacgtattccgacgtgatcaggtgcttcagaagaggggttagcacgactgtgctcccccc

SEQ ID NO: 213980 - DNA, 75 bp, Artificial Sequence
  Synthetic
gacgtgatcaggtgcttcagaagaggggttagcacgactgtgctccccccatacagtgcccaggctgtggctgga

SEQ ID NO: 213981 - DNA, 75 bp, Artificial Sequence
  Synthetic
atccagtcagtcctgatgcctgcgtctttccgccgaacatgctcttgagatctgctttggttttttctagcatgc

SEQ ID NO: 213982 - DNA, 75 bp, Artificial Sequence
  Synthetic
ctttccgccgaacatgctcttgagatctgctttggttttttctagcatgccgtactcgtttgctgccaccactcc

SEQ ID NO: 213983 - DNA, 75 bp, Artificial Sequence
  Synthetic
aacactgctagttggttatctgtctgtgacctctgtttttccggttctgggatgagaaccaccatcagcagcagg

SEQ ID NO: 213984 - DNA, 75 bp, Artificial Sequence
  Synthetic
gtgacctctgtttttccggttctgggatgagaaccaccatcagcagcagggcgatcagcagggtccctgctattt

SEQ ID NO: 213985 - DNA, 75 bp, Artificial Sequence
  Synthetic
aaacaacactcgttagatcacaggttgacgctttcaacggcgaaatgattgacccttttcagctgggccttctgg

SEQ ID NO: 213986 - DNA, 75 bp, Artificial Sequence
  Synthetic
caggaaaaaggtagctagcgtgagcactagagctccaagacccatcttccctataccctttcgctgcatcattag

SEQ ID NO: 213987 - DNA, 75 bp, Artificial Sequence
  Synthetic
actagagctccaagacccatcttccctataccctttcgctgcatcattagtaggaagaatcctcctgtcatcaca

SEQ ID NO: 213988 - DNA, 75 bp, Artificial Sequence
  Synthetic
aaataatgtaaatgagaaaatgtatgcatatggagtcaggccagcaaaagctgccaccggatactgggtagacgg

SEQ ID NO: 213989 - DNA, 75 bp, Artificial Sequence
  Synthetic
gcatatggagtcaggccagcaaaagctgccaccggatactgggtagacggtgctgcctgcgtctcagtcccagga

SEQ ID NO: 213990 - DNA, 75 bp, Artificial Sequence
  Synthetic
ctgccaccggatactgggtagacggtgctgcctgcgtctcagtcccaggaggactgggttaacaaatctgacaac

SEQ ID NO: 213991 - DNA, 75 bp, Artificial Sequence
  Synthetic
tttccagtgcatctggcagctcttcgagagccattcgatgtgctttcccacctttctcagccgttgcaaccaagt

SEQ ID NO: 213992 - DNA, 75 bp, Artificial Sequence
  Synthetic
gagagccattcgatgtgctttcccacctttctcagccgttgcaaccaagtacatggtgtctaaggcttcccgcgt

SEQ ID NO: 213993 - DNA, 75 bp, Artificial Sequence
  Synthetic
cgaccgagcacctctatgaagctaacggctgatctcttccctgatgcaaagtctttgaaccacttgagggcttgg

SEQ ID NO: 213994 - DNA, 75 bp, Artificial Sequence
  Synthetic
cggctgatctcttccctgatgcaaagtctttgaaccacttgagggcttggtgatctgcgtaaactcttgcgtcaa

SEQ ID NO: 213995 - DNA, 75 bp, Artificial Sequence
  Synthetic
ctcacccatccgggtgactatctctacctcggtgttgtcctccaatatggcattcgtacgcggcccatcaaaaca

SEQ ID NO: 213996 - DNA, 75 bp, Artificial Sequence
  Synthetic
acctcggtgttgtcctccaatatggcattcgtacgcggcccatcaaaacaccactttctgtcggtgtactgaatg

SEQ ID NO: 213997 - DNA, 75 bp, Artificial Sequence
  Synthetic
gccacaccgggaggtcagccgtcctaagcagttctaagaagtttttcttttcttcgcctctgagacgatattcgc

SEQ ID NO: 213998 - DNA, 75 bp, Artificial Sequence
  Synthetic
tgtatctggacacttacagaatcattcttcttgtcataggaatttgttccctgctgcaagagaggagaaagacca

SEQ ID NO: 213999 - DNA, 75 bp, Artificial Sequence
  Synthetic
aagcagttctaagaagtttttcttttcttcgcctctgagacgatattcgccatccattgtgaaggccttttccct

SEQ ID NO: 214000 - DNA, 75 bp, Artificial Sequence
  Synthetic
agtccattgggcatgtgtatgttgtctaacataatctttgcctctgtccaatgagctagattactgtcatcttca

SEQ ID NO: 214001 - DNA, 75 bp, Artificial Sequence
  Synthetic
ctaacataatctttgcctctgtccaatgagctagattactgtcatcttcactggtagcccccccatagtggtatt

SEQ ID NO: 214002 - DNA, 75 bp, Artificial Sequence
  Synthetic
accgagttcctttcagcggttgggttgatgtttgccattgtgggaggtctagccgagttggacatcgaatctatg

SEQ ID NO: 214003 - DNA, 75 bp, Artificial Sequence
  Synthetic
gcctactctgcccctccgttgagctgcgcttgcactggttatgggagatgggtttccgaggatgactctgccttc

SEQ ID NO: 214004 - DNA, 75 bp, Artificial Sequence
  Synthetic
gcgcttgcactggttatgggagatgggtttccgaggatgactctgccttctccctcttctaagatggtgggtttc

SEQ ID NO: 214005 - DNA, 75 bp, Artificial Sequence
  Synthetic
tcaatacccttcatgctggcagggctcatggcagtgtcctacgtggtatcaggaaaggcaaccgacatgtggctg

SEQ ID NO: 214006 - DNA, 75 bp, Artificial Sequence
  Synthetic
tgctcgcaccgaagttggcccccatttcagagatgtcggtggtgatgacaaaatcccagtctccattcttacatt

SEQ ID NO: 214007 - DNA, 75 bp, Artificial Sequence
  Synthetic
ttcagagatgtcggtggtgatgacaaaatcccagtctccattcttacattttgggtattctgtgtcataggactt

SEQ ID NO: 214008 - DNA, 75 bp, Artificial Sequence
  Synthetic
cccgctctttggaggcacattgcaatctcattccccatttttacgctcgccacaaaccacacggttttacccgca

SEQ ID NO: 214009 - DNA, 75 bp, Artificial Sequence
  Synthetic
tctcattccccatttttacgctcgccacaaaccacacggttttacccgcatattctgtgatccattcgtatccac

SEQ ID NO: 214010 - DNA, 75 bp, Artificial Sequence
  Synthetic
atcttgcaaatcatggattggggcattggagtcaggaaagggatccgtggttccaggcggagtcgctgtcatgaa

SEQ ID NO: 214011 - DNA, 75 bp, Artificial Sequence
  Synthetic
ttggagtcaggaaagggatccgtggttccaggcggagtcgctgtcatgaagatggctgctgcctcccctaattcc

SEQ ID NO: 214012 - DNA, 75 bp, Artificial Sequence
  Synthetic
gcacttaccaggccggcgttggagtcatgtacgaaaatgttttccacacattgtggcacacaactagaggagcag

SEQ ID NO: 214013 - DNA, 75 bp, Artificial Sequence
  Synthetic
cggctatactggctgggtcggtgaaatgagcttcatccatgacaaataggttgtagttgggcactctgttcggtg

SEQ ID NO: 214014 - DNA, 75 bp, Artificial Sequence
  Synthetic
atgagcttcatccatgacaaataggttgtagttgggcactctgttcggtgacatcagtctatgggtcagagtggc

SEQ ID NO: 214015 - DNA, 75 bp, Artificial Sequence
  Synthetic
ttcccttggtgctctctctgcactgctgaagtttgatatcgtactgggagccctctcaaagcttctgacatctct

SEQ ID NO: 214016 - DNA, 75 bp, Artificial Sequence
  Synthetic
ctgaagtttgatatcgtactgggagccctctcaaagcttctgacatctctgctgccaccacccgcgtcggtgcca

SEQ ID NO: 214017 - DNA, 75 bp, Artificial Sequence
  Synthetic
gatagcgtccttaattatttgcggcagaattttcctggtttttcctgaaccagggtgcaaatctaagcacagtca

SEQ ID NO: 214018 - DNA, 75 bp, Artificial Sequence
  Synthetic
agaattttcctggtttttcctgaaccagggtgcaaatctaagcacagtcagctgtctcttcctcaacatatttgg

SEQ ID NO: 214019 - DNA, 75 bp, Artificial Sequence
  Synthetic
tcctgacggtcaccctgcacgatggcgctgacgtatgagccatcgccaagctcaactccattgccgtataggcct

SEQ ID NO: 214020 - DNA, 75 bp, Artificial Sequence
  Synthetic
cgctgacgtatgagccatcgccaagctcaactccattgccgtataggcctatgatgtctccattggaatccagaa

SEQ ID NO: 214021 - DNA, 75 bp, Artificial Sequence
  Synthetic
gtaatccagactaacagccccaacctccccgaagggagtccgaaacactcctggctttgtctggatgtttactgc

SEQ ID NO: 214022 - DNA, 75 bp, Artificial Sequence
  Synthetic
tccccgaagggagtccgaaacactcctggctttgtctggatgtttactgcagccttccccggttctaccacgatt

SEQ ID NO: 214023 - DNA, 75 bp, Artificial Sequence
  Synthetic
tggcggaagctttgagaggactcccagtacgatatcaaacctcagcagtgcagagggagcatcagggaaatgaaa

SEQ ID NO: 214024 - DNA, 75 bp, Artificial Sequence
  Synthetic
attttcggtcaaacctccatgggcctccgtaagctatgcggtcttctctcacactaccccagtacggcgtcaatt

SEQ ID NO: 214025 - DNA, 75 bp, Artificial Sequence
  Synthetic
tccgtaagctatgcggtcttctctcacactaccccagtacggcgtcaattttccttctccactcataatggctgc

SEQ ID NO: 214026 - DNA, 75 bp, Artificial Sequence
  Synthetic
tgaaaaacattctcatacatgactccaacaccggcctggtaagtgccaagaatccctctagccataattcggtag

SEQ ID NO: 214027 - DNA, 75 bp, Artificial Sequence
  Synthetic
caacaccggcctggtaagtgccaagaatccctctagccataattcggtagactcctgtagtggtgtctccttttg

SEQ ID NO: 214028 - DNA, 75 bp, Artificial Sequence
  Synthetic
ccaaaacacgccccctctttttgttgtttttaaagtgagccaataaccgaaagcggcgggaacgatggcccaagg

SEQ ID NO: 214029 - DNA, 75 bp, Artificial Sequence
  Synthetic
gtttttaaagtgagccaataaccgaaagcggcgggaacgatggcccaaggcgtgagagcggctaagccaatgcaa

SEQ ID NO: 214030 - DNA, 75 bp, Artificial Sequence
  Synthetic
atggaacaccgggatcatcaatcaagtgaaaatctccgtcatcatccagtttcacatccagcctccgactgcttc

SEQ ID NO: 214031 - DNA, 75 bp, Artificial Sequence
  Synthetic
gtgaaaatctccgtcatcatccagtttcacatccagcctccgactgcttcctgtgattgcagcatccatctccca

SEQ ID NO: 214032 - DNA, 75 bp, Artificial Sequence
  Synthetic
attgactgcagaaagagtgtgaaacccaccatcctagaggagggagaaggtagagtcattcttggaaacccatcc

SEQ ID NO: 214033 - DNA, 75 bp, Artificial Sequence
  Synthetic
cacatatctgttgcttttcctgataccacgtaggacactgccatgagacctgccagcatgaagggtattgacatg

SEQ ID NO: 214034 - DNA, 75 bp, Artificial Sequence
  Synthetic
ccacgtaggacactgccatgagacctgccagcatgaagggtattgacatggattcaatatccaactcggccaaac

SEQ ID NO: 214035 - DNA, 75 bp, Artificial Sequence
  Synthetic
aactgccgacaaaaactcagtagctggccaccctctcttcttgtttgggttgcagaccattagtccggcagcaat

SEQ ID NO: 214036 - DNA, 75 bp, Artificial Sequence
  Synthetic
ggccaccctctcttcttgtttgggttgcagaccattagtccggcagcaatagtggtgggcgagaaccatccagtg

SEQ ID NO: 214037 - DNA, 75 bp, Artificial Sequence
  Synthetic
cagctcctttcttttttgccatggtcttcttcctctcctgcagcagggagcaaatccctatgacgaggaggatga

SEQ ID NO: 214038 - DNA, 75 bp, Artificial Sequence
  Synthetic
cttcttcctctcctgcagcagggagcaaatccctatgacgaggaggatgattctgtaagtgtctaggtatagagc

SEQ ID NO: 214039 - DNA, 75 bp, Artificial Sequence
  Synthetic
aagactggcatggtgacggaggaggttgtggggaaggtgatagcccggacaatcatccatgctatggcggcggca

SEQ ID NO: 214040 - DNA, 75 bp, Artificial Sequence
  Synthetic
ttgtggggaaggtgatagcccggacaatcatccatgctatggcggcggcattcaggattccgtggactcctattt

SEQ ID NO: 214041 - DNA, 75 bp, Artificial Sequence
  Synthetic
ctagaagataacactgaggtggagatagtcacccgaatgggtgagagaaagatcctcaagccgagatggctcgat

SEQ ID NO: 214042 - DNA, 75 bp, Artificial Sequence
  Synthetic
aaaggcagcccctaggaccagaaccatgttttcttggttcgtccatctcgtgctaagcatgttcatcactagaaa

SEQ ID NO: 214043 - DNA, 75 bp, Artificial Sequence
  Synthetic
atgttttcttggttcgtccatctcgtgctaagcatgttcatcactagaaatgctggttggatcttaaaaacggca

SEQ ID NO: 214044 - DNA, 75 bp, Artificial Sequence
  Synthetic
ttcatagaggtgctcggtcgcatgcctgagcatttcatgggaaagacacgggaagccttagacacaatgtatctg

SEQ ID NO: 214045 - DNA, 75 bp, Artificial Sequence
  Synthetic
ctccactgttggcctccgcgaaagcagcagcgactagcaccacatacctcgccaaatcagtgtaagtgatgcccc

SEQ ID NO: 214046 - DNA, 75 bp, Artificial Sequence
  Synthetic
agcagcgactagcaccacatacctcgccaaatcagtgtaagtgatgcccccaagcatcagcacaagtagggcccc

SEQ ID NO: 214047 - DNA, 75 bp, Artificial Sequence
  Synthetic
gccgtccacctcttgcgaaggacctcctgggtggccagaaacatcaccagaaggcccagctgaaaagggtcaacc

SEQ ID NO: 214048 - DNA, 75 bp, Artificial Sequence
  Synthetic
cctgggtggccagaaacatcaccagaaggcccagctgaaaagggtcaaccatttcaccattgaaagcatcaacct

SEQ ID NO: 214049 - DNA, 75 bp, Artificial Sequence
  Synthetic
atgcctgacaggtctgatttccattccgtaccagcagccattttctgtccgaaatcgtaggggcggaagggagca

SEQ ID NO: 214050 - DNA, 75 bp, Artificial Sequence
  Synthetic
ccgtaccagcagccattttctgtccgaaatcgtaggggcggaagggagcaactgcgacagcaccagtcagtgatc

SEQ ID NO: 214051 - DNA, 75 bp, Artificial Sequence
  Synthetic
tgaccgaagggcctctcttgccacaatcctctgtaatggtgacttttgtccctgggcaataatcgaagtccaaga

SEQ ID NO: 214052 - DNA, 75 bp, Artificial Sequence
  Synthetic
atcctctgtaatggtgacttttgtccctgggcaataatcgaagtccaagactatgccattctcatcccaaggtcc

SEQ ID NO: 214053 - DNA, 75 bp, Artificial Sequence
  Synthetic
ctccgattgtgcttgctttttggtccggctatggtatgcggaatgatgagttcgctttcctcaacaccatctccc

SEQ ID NO: 214054 - DNA, 75 bp, Artificial Sequence
  Synthetic
cggctatggtatgcggaatgatgagttcgctttcctcaacaccatctccccaaagggtgtgtgtctctggccaag

SEQ ID NO: 214055 - DNA, 75 bp, Artificial Sequence
  Synthetic
gagcacagttgtgttaacccctctcctgaagcacctaatcacctcagaatacgtcaccacatcgttagcttcaat

SEQ ID NO: 214056 - DNA, 75 bp, Artificial Sequence
  Synthetic
tgccctctcaagtttccatgtgtcgttgtagcgactctcaatccagtacgacaagtcactatgaactgccacatg

SEQ ID NO: 214057 - DNA, 75 bp, Artificial Sequence
  Synthetic
ttgtagcgactctcaatccagtacgacaagtcactatgaactgccacatgtcctttgacagccgtgcctatgatc

SEQ ID NO: 214058 - DNA, 75 bp, Artificial Sequence
  Synthetic
tgtctttcttggctgttggggccaaatcaccctcaccacgttcctaacagctatggtgctagtgacactccacta

SEQ ID NO: 214059 - DNA, 75 bp, Artificial Sequence
  Synthetic
cctctctaattttcagccacacacgggttgatgtgatgccaaagccgaagtcttcgatttgcatgctgttccaag

SEQ ID NO: 214060 - DNA, 75 bp, Artificial Sequence
  Synthetic
ggttgatgtgatgccaaagccgaagtcttcgatttgcatgctgttccaagctctgtgctcatcagggcattcctt

SEQ ID NO: 214061 - DNA, 75 bp, Artificial Sequence
  Synthetic
gtggagttagccaattccggggcaaagagaatgctttttccccatgctttccagcccatttcaaacttctcttgc

SEQ ID NO: 214062 - DNA, 75 bp, Artificial Sequence
  Synthetic
agagaatgctttttccccatgctttccagcccatttcaaacttctcttgcgtcatggacaggcgtttgggggctg

SEQ ID NO: 214063 - DNA, 75 bp, Artificial Sequence
  Synthetic
cacaaccacactgaggtccactgcattctctttgagcaggacgttcaattcgtcccgtacggcttcccacatctg

SEQ ID NO: 214064 - DNA, 75 bp, Artificial Sequence
  Synthetic
ttctctttgagcaggacgttcaattcgtcccgtacggcttcccacatctggtgctccagtctagtgacagatctg

SEQ ID NO: 214065 - DNA, 75 bp, Artificial Sequence
  Synthetic
ctttgtggacgatcttcgctagggatctgggcgtttctggcaaatatttatacctatccacccaggcttctacgt

SEQ ID NO: 214066 - DNA, 75 bp, Artificial Sequence
  Synthetic
tctgggcgtttctggcaaatatttatacctatccacccaggcttctacgtcattgtgcacgaagatgccacttcc

SEQ ID NO: 214067 - DNA, 75 bp, Artificial Sequence
  Synthetic
tcaatagcgcatccggtgtcagcatgcacattggtcgctaagaacacgagcacacctcctgttgctaagaaggcc

SEQ ID NO: 214068 - DNA, 75 bp, Artificial Sequence
  Synthetic
gcacattggtcgctaagaacacgagcacacctcctgttgctaagaaggccaaagcaattgatcggtctcgtgcgt

SEQ ID NO: 214069 - DNA, 75 bp, Artificial Sequence
  Synthetic
gcccattagcccttgtgtgatccaagacattcccccaaagagtgttctgaaggcaccaccaaacacttggtgaac

SEQ ID NO: 214070 - DNA, 75 bp, Artificial Sequence
  Synthetic
gacattcccccaaagagtgttctgaaggcaccaccaaacacttggtgaacggcttttcctatagagttaaagacc

SEQ ID NO: 214071 - DNA, 75 bp, Artificial Sequence
  Synthetic
ctgtgtcgcctaacgctgccagtctctgagctcccttcaaagttgttgaaaaggccttgcccagcgtgcttccag

SEQ ID NO: 214072 - DNA, 75 bp, Artificial Sequence
  Synthetic
ctgagctcccttcaaagttgttgaaaaggccttgcccagcgtgcttccagctttgtgccaatggtggttgatctg

SEQ ID NO: 214073 - DNA, 75 bp, Artificial Sequence
  Synthetic
taggagtctccgaaggggggttccatctcgaccagcacctttgagttggcactggaagtcgcgacgaaggggttc

SEQ ID NO: 214074 - DNA, 75 bp, Artificial Sequence
  Synthetic
tctcgaccagcacctttgagttggcactggaagtcgcgacgaaggggttcactgtcaccagccgcccaacgggag

SEQ ID NO: 214075 - DNA, 75 bp, Artificial Sequence
  Synthetic
cctagagagttctgcataaaagtgctctgcccttacatgcctaaagttatagaaaagatggaagtcctgcaacgt

SEQ ID NO: 214076 - DNA, 75 bp, Artificial Sequence
  Synthetic
gacaatcggaattttgcaggggccatcactcccagagtaggagagttcaatgacaactgttccgtgaccagtgtc

SEQ ID NO: 214077 - DNA, 75 bp, Artificial Sequence
  Synthetic
tcactcccagagtaggagagttcaatgacaactgttccgtgaccagtgtccgccggatttttcgcgaacgagaat

SEQ ID NO: 214078 - DNA, 75 bp, Artificial Sequence
  Synthetic
tgcctttcagggctagtttgtccattttcagcctacatttcaggtggcctgatgttaacttcactgagcttgagt

SEQ ID NO: 214079 - DNA, 75 bp, Artificial Sequence
  Synthetic
tttcagcctacatttcaggtggcctgatgttaacttcactgagcttgagtactccaccacgatggctcctgccaa

SEQ ID NO: 214080 - DNA, 75 bp, Artificial Sequence
  Synthetic
gaaccaagagcaacaacggaccgttttgtggcgtgcgcctcttcaaattccatgaggagttctctgtttctccac

SEQ ID NO: 214081 - DNA, 75 bp, Artificial Sequence
  Synthetic
ttgtggcgtgcgcctcttcaaattccatgaggagttctctgtttctccacgctgtgctcgaaggggacgtccagg

SEQ ID NO: 214082 - DNA, 75 bp, Artificial Sequence
  Synthetic
cctatggaccagaaatgactttgaccccacggtcatgacataaaacgcttcagtgttcagtccactccttggctc

SEQ ID NO: 214083 - DNA, 75 bp, Artificial Sequence
  Synthetic
cccacggtcatgacataaaacgcttcagtgttcagtccactccttggctcacagtccagtgtgacttctccgtag

SEQ ID NO: 214084 - DNA, 75 bp, Artificial Sequence
  Synthetic
tttggccagcagagggtctttaaagagaaggttgacacgaaggctccagagccaccagcaggagtcaaggaagtg

SEQ ID NO: 214085 - DNA, 75 bp, Artificial Sequence
  Synthetic
gagcattgggtgttactgtaaactttgccgcctgggacgccccaacttgcgctgagtaattcccatggttttccg

SEQ ID NO: 214086 - DNA, 75 bp, Artificial Sequence
  Synthetic
tgccgcctgggacgccccaacttgcgctgagtaattcccatggttttccgaagtggtggttccatgcacaaaaat

SEQ ID NO: 214087 - DNA, 75 bp, Artificial Sequence
  Synthetic
ggctggattgttctcccaatcgctttgctggtgcaggagaattttgcacatgtgtcaatgcttcccttcccgaaa

SEQ ID NO: 214088 - DNA, 75 bp, Artificial Sequence
  Synthetic
tgctggtgcaggagaattttgcacatgtgtcaatgcttcccttcccgaaaagtccacatccgttgccccacccac

SEQ ID NO: 214089 - DNA, 75 bp, Artificial Sequence
  Synthetic
atagctactatcagctcgcttcttgttgtgggcttctccagtcgtggggcaccgagccaccgtcgagatgtcagt

SEQ ID NO: 214090 - DNA, 75 bp, Artificial Sequence
  Synthetic
actcattgacgccgtgaacaagcggggcagaaagcaaaacaaaagaggaggaaatgaaggctcaatcatgtggct

SEQ ID NO: 214091 - DNA, 75 bp, Artificial Sequence
  Synthetic
ggcagaaagcaaaacaaaagaggaggaaatgaaggctcaatcatgtggctcgcgagcttggcagttgtcatagct

SEQ ID NO: 214092 - DNA, 75 bp, Artificial Sequence
  Synthetic
ttgtgggcttctccagtcgtggggcaccgagccaccgtcgagatgtcagtgactgaggcatgataacagtaactt

SEQ ID NO: 214093 - DNA, 75 bp, Artificial Sequence
  Synthetic
cgatgttaatcatgcggacgtccaatgttggtttgtcgtttgccatgattgtcaaacagctatctccttctagca

SEQ ID NO: 214094 - DNA, 75 bp, Artificial Sequence
  Synthetic
tgttggtttgtcgtttgccatgattgtcaaacagctatctccttctagcaccaagtccacccaagtggctccact

SEQ ID NO: 214095 - DNA, 75 bp, Artificial Sequence
  Synthetic
cccattcccagacaattaaaactgtaagccggggcgaccaacagcaggaggatggtaaataccacgcgttgaccg

SEQ ID NO: 214096 - DNA, 75 bp, Artificial Sequence
  Synthetic
aagccggggcgaccaacagcaggaggatggtaaataccacgcgttgaccgttgttactgccaagcatccagccaa

SEQ ID NO: 214097 - DNA, 75 bp, Artificial Sequence
  Synthetic
agcttaccatgggcaatgatccagaggatgtggattgctggtgtgacaaccaagaagtctacgtccaatatggac

SEQ ID NO: 214098 - DNA, 75 bp, Artificial Sequence
  Synthetic
aggattccttatgatccagttctcagtttttgtgagatatcgtgtggctttcgttgaatccagccaagcctcttt

SEQ ID NO: 214099 - DNA, 75 bp, Artificial Sequence
  Synthetic
gtttttgtgagatatcgtgtggctttcgttgaatccagccaagcctcttttttattcactagtgaactctcccca

SEQ ID NO: 214100 - DNA, 75 bp, Artificial Sequence
  Synthetic
cctacgctctcaacacattcacgaacattgccgtccagcttgtccgcttgatggaggctgagggggtcattggac

SEQ ID NO: 214101 - DNA, 75 bp, Artificial Sequence
  Synthetic
tgcttcgcttggaatgcctagttcgcgtgcaccgtccatattggacgtagacctcttggttgtcacaccagcaat

SEQ ID NO: 214102 - DNA, 75 bp, Artificial Sequence
  Synthetic
atgaaaactgagaactggatcataaggaatcctggctatgctttcctggcggcggtacttggctggatgcttggc

SEQ ID NO: 214103 - DNA, 75 bp, Artificial Sequence
  Synthetic
cgtgcaccgtccatattggacgtagacctcttggttgtcacaccagcaatccacatcctctggatcattgcccgc

SEQ ID NO: 214104 - DNA, 75 bp, Artificial Sequence
  Synthetic
tggctctttgagaatggagaggagagagtgactaggatggcgatcagtggagacgactgtgtcgtcaagccgctg

SEQ ID NO: 214105 - DNA, 75 bp, Artificial Sequence
  Synthetic
ggaatgggcaatcgtgacttcatagaaggagccagtggagccacttgggtggacttggtgctagaaggagatagc

SEQ ID NO: 214106 - DNA, 75 bp, Artificial Sequence
  Synthetic
atggtgtcctcacacatgtacccgacgtcgattgcccggacccagcatctgttctctccttttgaggtggggatc

SEQ ID NO: 214107 - DNA, 75 bp, Artificial Sequence
  Synthetic
cgtcgattgcccggacccagcatctgttctctccttttgaggtggggatcacgataacgtctgcaatgtccgtgt

SEQ ID NO: 214108 - DNA, 75 bp, Artificial Sequence
  Synthetic
ctggaaattcgacaacttcatggctcctgcacaagctatgacaactgccaagctcgtgagccacatgattgagcc

SEQ ID NO: 214109 - DNA, 75 bp, Artificial Sequence
  Synthetic
cctgcacaagctatgacaactgccaagctcgtgagccacatgattgagccttcatttcctcctcttttattttgc

SEQ ID NO: 214110 - DNA, 75 bp, Artificial Sequence
  Synthetic
gaggtcagaagttactgctatcatgcttcagtcactgacatctcgacggtggctcggtgccccacgactggagaa

SEQ ID NO: 214111 - DNA, 75 bp, Artificial Sequence
  Synthetic
agcaggttcccttttgctccaatcattttcaggagattgtgatgaaagatggaaggagcatagtcgtcccgtgca

SEQ ID NO: 214112 - DNA, 75 bp, Artificial Sequence
  Synthetic
gagggcaggatgagctgattggcagggcgcgcatctccccaggagctggatggaatgtgaaggacacagcttgcc

SEQ ID NO: 214113 - DNA, 75 bp, Artificial Sequence
  Synthetic
caatgagtgttccaagttctcgtttgaaactagtaaggtgtttcattgccacactcttttccactgctttccatc

SEQ ID NO: 214114 - DNA, 75 bp, Artificial Sequence
  Synthetic
gaaactagtaaggtgtttcattgccacactcttttccactgctttccatcggcctaaaagcgccttggtcggggc

SEQ ID NO: 214115 - DNA, 75 bp, Artificial Sequence
  Synthetic
tgtggacttttcgggaagggaagcattgacacatgtgcaaaattctcctgcaccagtaaagcgattgggagaaca

SEQ ID NO: 214116 - DNA, 75 bp, Artificial Sequence
  Synthetic
ataagagccagcacgaaacgtgctggccctctgccgtccaacaagctcattactaccctcttcactcccactagt

SEQ ID NO: 214117 - DNA, 75 bp, Artificial Sequence
  Synthetic
gccctctgccgtccaacaagctcattactaccctcttcactcccactagtgggaatacgcggggtagaccgcgtt

SEQ ID NO: 214118 - DNA, 75 bp, Artificial Sequence
  Synthetic
accgggccctcctggttttttagtcatggttatcttccgttctaaaaaactgtttaaactgcactaatctctcga

SEQ ID NO: 214119 - DNA, 75 bp, Artificial Sequence
  Synthetic
atggttatcttccgttctaaaaaactgtttaaactgcactaatctctcgattcttctcaacgatactaagccaag

SEQ ID NO: 214120 - DNA, 75 bp, Artificial Sequence
  Synthetic
atgttgattacatgacttccctcagaagatatgaggatgtattgattcaggaggacagggtcatttagacaggat

SEQ ID NO: 214121 - DNA, 75 bp, Artificial Sequence
  Synthetic
gtgacagtgaaccccttcgtcgcgacttccagtgccaactcaaaggtgctggtcgagatggaaccccccttcgga

SEQ ID NO: 214122 - DNA, 75 bp, Artificial Sequence
  Synthetic
agcatattgacacctgggaatagactgggagatcttctgctctatctcaacatcagctactaggcacagagcgcc

SEQ ID NO: 214123 - DNA, 75 bp, Artificial Sequence
  Synthetic
aaggccttttcaacaactttgaagggagctcaaagactggcagcgttgggcgacacagcctgggactttggctct

SEQ ID NO: 214124 - DNA, 75 bp, Artificial Sequence
  Synthetic
cgacacagcctgggactttggctctattggaggggtcttcaactccataggaaaagccgttcaccaagtgtttgg

SEQ ID NO: 214125 - DNA, 75 bp, Artificial Sequence
  Synthetic
gctacatgtgtgaggacactatcacgtacgaatgtcctaagcttaccatgggcaatgatccagaggatgtggact

SEQ ID NO: 214126 - DNA, 75 bp, Artificial Sequence
  Synthetic
cgcccagatccctagcgaagatcgtccacaaagcgcacaaggaaggcgtgtgcggagtcagatctgtcactagac

SEQ ID NO: 214127 - DNA, 75 bp, Artificial Sequence
  Synthetic
tgcggagtcagatctgtcactagactggagcaccaaatgtgggaagccgtacgggacgaattgaacgtcctgctc

SEQ ID NO: 214128 - DNA, 75 bp, Artificial Sequence
  Synthetic
tggagcaccaaatgtgggaagccgtacgggacgaattgaacgtcctgctcaaagagaatgcagtggacctcagtg

SEQ ID NO: 214129 - DNA, 75 bp, Artificial Sequence
  Synthetic
tggttgtgaacaagcccgtgggaagatatcgctcagcccctaaacgcctatccatgacgcaagagaagtttgaaa

SEQ ID NO: 214130 - DNA, 75 bp, Artificial Sequence
  Synthetic
tgacttgtcgtactggattgagagtcgctacaacgacacatggaaacttgagagggcagtctttggagaggtcaa

SEQ ID NO: 214131 - DNA, 75 bp, Artificial Sequence
  Synthetic
cgctacaacgacacatggaaacttgagagggcagtctttggagaggtcaaatcttgcacttggccagagacacac

SEQ ID NO: 214132 - DNA, 75 bp, Artificial Sequence
  Synthetic
gaggtggaaggactagaggttagaggagaccccgcatttgcatcaaacagcatattgacacctgggaatagactg

SEQ ID NO: 214133 - DNA, 75 bp, Artificial Sequence
  Synthetic
ggagatcttctgctctatctcaacatcagctactaggcacagagcgccgaagtatgtagctggtggtgaggaaga

SEQ ID NO: 214134 - DNA, 75 bp, Artificial Sequence
  Synthetic
tgcccagggacaaaagtcaccattacagaggattgtggcaagagaggcccttcggtcagaaccactactgacagt

SEQ ID NO: 214135 - DNA, 75 bp, Artificial Sequence
  Synthetic
actggtcacggaacagttgtcattgaactctcctactctgggagtgatggcccttgcaaaattccgattgtctcc

SEQ ID NO: 214136 - DNA, 75 bp, Artificial Sequence
  Synthetic
tggacggccagattgaccattcctgcggttttgggggccctacttgtgctgatgcttgggggcatcacttacact

SEQ ID NO: 214137 - DNA, 75 bp, Artificial Sequence
  Synthetic
aaccagcatttctagtgatgaacatgcttagcacgagatggacgaaccaagaaaacgtggttctggtcctagggg

SEQ ID NO: 214138 - DNA, 75 bp, Artificial Sequence
  Synthetic
atcctgaatgccgccgctatagcatggatgattgtccgagcgatcaccttccccacaacctcctccgtcaccatg

SEQ ID NO: 214139 - DNA, 75 bp, Artificial Sequence
  Synthetic
aggagctgtactcttgggcttagcgctcacatccactggatggttctcgcccaccactatagctgccggactaat

SEQ ID NO: 214140 - DNA, 75 bp, Artificial Sequence
  Synthetic
cgtttttaagatccaaccagcatttctagtgatgaacatgctcagcacgagatggacgaaccaagaaaacgtggt

SEQ ID NO: 214141 - DNA, 75 bp, Artificial Sequence
  Synthetic
ggtctgcaacccaaacaagaagagagggtggccagctactgagtttttgtcggcagttggattgatgtttgccat

SEQ ID NO: 214142 - DNA, 75 bp, Artificial Sequence
  Synthetic
cgtaggtggtttggccgagttggatattgaatccatgtcaatacccttcatgctggcaggtctcatggcagtgtc

SEQ ID NO: 214143 - DNA, 75 bp, Artificial Sequence
  Synthetic
acgccatccccaaaaccttgctcaaaaggagacaccaccacaggagtctaccgaattatggctagagggattctt

SEQ ID NO: 214144 - DNA, 75 bp, Artificial Sequence
  Synthetic
cgcatgtcttgcattggcttagccgccctcacgccttgggccatcgttcccgccgctttcggttattggctcact

SEQ ID NO: 214145 - DNA, 75 bp, Artificial Sequence
  Synthetic
cgtcaggaggaaccagtcccagaagcttacaccccaaacatgttgagaaagagacagatgactgtgctagatttg

SEQ ID NO: 214146 - DNA, 75 bp, Artificial Sequence
  Synthetic
gagacagatgactgtgctagatttgcaccctggttcagggaaaaccaggaaaattctgccacaaataattaagga

SEQ ID NO: 214147 - DNA, 75 bp, Artificial Sequence
  Synthetic
ccaaggtggaattaggggaggcagcagccatctttatgacagcgaccccgcctggaaccacggatccttttcctg

SEQ ID NO: 214148 - DNA, 75 bp, Artificial Sequence
  Synthetic
agccatctttatgacagcgaccccgcctggaaccacggatccttttcctgactcaaatgccccaatccatgattt

SEQ ID NO: 214149 - DNA, 75 bp, Artificial Sequence
  Synthetic
cagaatatgcgggtaaaaccgtgtggtttgtggcgagcgtaaaaatggggaatgagattgcaatgtgcctccaaa

SEQ ID NO: 214150 - DNA, 75 bp, Artificial Sequence
  Synthetic
tggtggcagcaaacgagtacgggatgctagaaaaaaccaaagcagatctcaagagcatgtttggcggaaagacgc

SEQ ID NO: 214151 - DNA, 75 bp, Artificial Sequence
  Synthetic
agagggagaaggcagagtcatcctcggaaacccatctcccataaccagtgcaagcgcagctcaacggaggggcag

SEQ ID NO: 214152 - DNA, 75 bp, Artificial Sequence
  Synthetic
agtaggcagaaaccccaaccaagttggagatgaataccactatgggggggctaccagtgaagatgacagtaacct

SEQ ID NO: 214153 - DNA, 75 bp, Artificial Sequence
  Synthetic
agcccattggacagaggcaaagatcatgttagacaacatacacatgcccaatggactggtggcccagctctatgg

SEQ ID NO: 214154 - DNA, 75 bp, Artificial Sequence
  Synthetic
cagatcaccaagccctcaagtggttcaaagactttgcagcagggaagagatcagccgttagcttcatagaggtgc

SEQ ID NO: 214155 - DNA, 75 bp, Artificial Sequence
  Synthetic
accatgtacttggttgcaacggctgagaaaggtgggaaagcacaccgaatggctctcgaagagctgccagatgca

SEQ ID NO: 214156 - DNA, 75 bp, Artificial Sequence
  Synthetic
acatcgctgtccagctcgtcaggctgatggaggctgagggggtcattggaccacaacacttggaacagctaccca

SEQ ID NO: 214157 - DNA, 75 bp, Artificial Sequence
  Synthetic
gggctcgcatctccccaggagctggatggaatgtgaaggacacagcttgcctggccaaagcatatgcacagatgt

SEQ ID NO: 214158 - DNA, 75 bp, Artificial Sequence
  Synthetic
tctcatcccagaaccggaaaaacagaggtcacagacagataaccaactggcggtgtttctcatctgtgtcttgac

SEQ ID NO: 214159 - DNA, 75 bp, Artificial Sequence
  Synthetic
cgcacagtggatcctaggcgtaacttcatcattaaaatctcagattctgctctgagtgtgacttactgcgaagag

SEQ ID NO: 214160 - DNA, 75 bp, Artificial Sequence
  Synthetic
cactccaaaaggagcccacaataactcaagagactctcgctcatcaacagataggttctttgatttcaacttgga

SEQ ID NO: 214161 - DNA, 75 bp, Artificial Sequence
  Synthetic
tctgagtgtgacttactgcgaagaggcagacaaatgggcaactgcaacggggcatccaagtctaaccagccagac

SEQ ID NO: 214162 - DNA, 75 bp, Artificial Sequence
  Synthetic
gcagacaaatgggcaactgcaacggggcatccaagtctaaccagccagactcctcaagagccacacagccagccg

SEQ ID NO: 214163 - DNA, 75 bp, Artificial Sequence
  Synthetic
ggtctcaacttttgacccctcactattagccatcttagctagtgtcatttgtacatcatttctgataccctcaaa

SEQ ID NO: 214164 - DNA, 75 bp, Artificial Sequence
  Synthetic
cagaatttaggagggtagctcacagcagtctatatggtagatataactgtaagtgctgctggtttgctgatacca

SEQ ID NO: 214165 - DNA, 75 bp, Artificial Sequence
  Synthetic
ggcccttacttgatcctctgttaaactctcatacatcactgacaactcttcttgattggttctagttcttgaacc

SEQ ID NO: 214166 - DNA, 75 bp, Artificial Sequence
  Synthetic
atttgataacctgtaatgatcactacctttgtttaaggtgccatcagggtatgttaaggaattcagatctctgca

SEQ ID NO: 214167 - DNA, 75 bp, Artificial Sequence
  Synthetic
atgttaaggaattcagatctctgcaatatctgctggaagcccctgcccaccacaatcacagtaccggtggagcca

SEQ ID NO: 214168 - DNA, 75 bp, Artificial Sequence
  Synthetic
tccaagttcgtcaagcttagggatcactacacttttgttgcttgacaaatccagagctgtgctagtgatgttagg

SEQ ID NO: 214169 - DNA, 75 bp, Artificial Sequence
  Synthetic
acagcaccaccaccataggcagactgcacagggtcagacccgaccccccggggggcccccatggggaccccccgt

SEQ ID NO: 214170 - DNA, 75 bp, Artificial Sequence
  Synthetic
gggggaaccccgggggtgatgcgccattagtcaatgtctttgatctcgactttgtgcttcagtggcctgcatgtc

SEQ ID NO: 214171 - DNA, 75 bp, Artificial Sequence
  Synthetic
acccctttcaatctgaactgcccttggggatctgatatcagcaggtcatttaaagatctgctgaatgccaccttg

SEQ ID NO: 214172 - DNA, 75 bp, Artificial Sequence
  Synthetic
ggggatctgatatcagcaggtcatttaaagatctgctgaatgccaccttgaaatttgagaattccaaccagtcac

SEQ ID NO: 214173 - DNA, 75 bp, Artificial Sequence
  Synthetic
tcttatcatggtgtcctcttgttctagtgttagactcccatttaaaggggggtttacaacaacacaaccaaactt

SEQ ID NO: 214174 - DNA, 75 bp, Artificial Sequence
  Synthetic
aaatttgagaattccaaccagtcaccaaatttatcaagtgaacggatcaactgctctttgtgtagatcataaacg

SEQ ID NO: 214175 - DNA, 75 bp, Artificial Sequence
  Synthetic
aggacaaagtcctcttgctgaaataatattgtttgtgatgttgtttttagataaggccatagttggcttaataag

SEQ ID NO: 214176 - DNA, 75 bp, Artificial Sequence
  Synthetic
gtgacacaaataactaacattcaatagatatttgaaccttcttgcaaagtaaagatccgcatcttccccttcact

SEQ ID NO: 214177 - DNA, 75 bp, Artificial Sequence
  Synthetic
gtttccacactatcaatgtcctctagtgctccaattgccttgactatgacatccccagacaactcaactctatat

SEQ ID NO: 214178 - DNA, 75 bp, Artificial Sequence
  Synthetic
agatatttgaaccttcttgcaaagtaaagatccgcatcttccccttcactcaaaattatctggaaaagttccaca

SEQ ID NO: 214179 - DNA, 75 bp, Artificial Sequence
  Synthetic
gttgacaacctttcattacctctgtaaaagataccctctttcaagacaagaggttctcctgggttatctggccca

SEQ ID NO: 214180 - DNA, 75 bp, Artificial Sequence
  Synthetic
atttgatttgcatatgccatcaagaaatatcttaaaccttgtaaaaatgtttggttccttttggaaggggaacaa

SEQ ID NO: 214181 - DNA, 75 bp, Artificial Sequence
  Synthetic
atgaggtcatatgcatacttgttacttagttcagaataaaagtcaccaaagttgaacttaacatggctcagaata

SEQ ID NO: 214182 - DNA, 75 bp, Artificial Sequence
  Synthetic
ttgtcatcatttgtcgcagcgtagcctgcatcaataaacaagccagctaggtcaaagctctcatggcctgtgaac

SEQ ID NO: 214183 - DNA, 75 bp, Artificial Sequence
  Synthetic
gaaaaatctctttggatcacagtaaaaagagccttgttcttctagcaccccattggtagacagatagatagaata

SEQ ID NO: 214184 - DNA, 75 bp, Artificial Sequence
  Synthetic
aatggtaggctagcgataaccagtgcaccatccaacaatgagtggcttccctcagacccagaaacacattgactc

SEQ ID NO: 214185 - DNA, 75 bp, Artificial Sequence
  Synthetic
ctcagacccagaaacacattgactcattgcatccacattcagctctaattcaggggtaccgacatcatccactcc

SEQ ID NO: 214186 - DNA, 75 bp, Artificial Sequence
  Synthetic
ataacactctcttagtctaacattcccaaaatatctagaatactctctttcattgatcaacaatcgggaggagaa

SEQ ID NO: 214187 - DNA, 75 bp, Artificial Sequence
  Synthetic
tagtgaactgacaatggtgtaactgtacaccatctttcttctaagtttaaattttgtcgaaactcgtgtgtgttc

SEQ ID NO: 214188 - DNA, 75 bp, Artificial Sequence
  Synthetic
ccaaaatatctagaatactctctttcattgatcaacaatcgggaggagaatgatgtcttcattgagttgaccaat

SEQ ID NO: 214189 - DNA, 75 bp, Artificial Sequence
  Synthetic
attttgtcgaaactcgtgtgtgttctacttgaatgatcaattttagtttcacagcttcttggcaagcaacattgc

SEQ ID NO: 214190 - DNA, 75 bp, Artificial Sequence
  Synthetic
gcaagggaaatggaggacaaaattctaaataatttcttctgctcaccttccaccaaactgctgaatggctgatgt

SEQ ID NO: 214191 - DNA, 75 bp, Artificial Sequence
  Synthetic
acagcttcttggcaagcaacattgcgcaacacagtgtgcaggtccatcatgtcttcctgaggcaacaaggagatg

SEQ ID NO: 214192 - DNA, 75 bp, Artificial Sequence
  Synthetic
ctacagattttctcaaattctctgtcaatagtatatctcatcactggtctgtcagaaacaagcacctgagctaaa

SEQ ID NO: 214193 - DNA, 75 bp, Artificial Sequence
  Synthetic
aaaccttgatattatcaaagctagaaactacataacccattgcaatgtcttcaacaaacattgctcttgatactt

SEQ ID NO: 214194 - DNA, 75 bp, Artificial Sequence
  Synthetic
gtcagaaacaagcacctgagctaaaatcatcaagttatccatatcagggtgttttattagtttttccagctgtaa

SEQ ID NO: 214195 - DNA, 75 bp, Artificial Sequence
  Synthetic
ccttattaatttaatcgcctccagaatatccagtagtctgtcattgactaacattaacatttgtccaacaactat

SEQ ID NO: 214196 - DNA, 75 bp, Artificial Sequence
  Synthetic
gggtttatcatcgaagataagacaacttgcaccatgaagttcctgcaaacttgctgtgggctgatgccaacttcc

SEQ ID NO: 214197 - DNA, 75 bp, Artificial Sequence
  Synthetic
tcccgcatttcttagcctcacaattgcaccatcatacgttttgaaaagatcacaaagtaaattgagtaaaactaa

SEQ ID NO: 214198 - DNA, 75 bp, Artificial Sequence
  Synthetic
caatttgtatactctgactgtctaacatgggctgaagcgcaatcactctgtttcacaatataaacattattatct

SEQ ID NO: 214199 - DNA, 75 bp, Artificial Sequence
  Synthetic
gtccagaaacagtaaagtatttctcctggtgttaaaaacttttagacctttcactttgttacaaacagaaagggc

SEQ ID NO: 214200 - DNA, 75 bp, Artificial Sequence
  Synthetic
cttactttcaataagtgacttataatccctaagttttcattcatcatgtctagagccacacagacatctagaaac

SEQ ID NO: 214201 - DNA, 75 bp, Artificial Sequence
  Synthetic
ttgaagataacacctctctacagcatcaatagatgtagaattctcatctgactgcctttccatgttgacttcatc

SEQ ID NO: 214202 - DNA, 75 bp, Artificial Sequence
  Synthetic
ttgagtcttccactatccaaagatctgttcacttgaagatcattcataaagggtgccaaatgttcttcaaatagt

SEQ ID NO: 214203 - DNA, 75 bp, Artificial Sequence
  Synthetic
tgttcacttgaagatcattcataaagggtgccaaatgttcttcaaatagtttggggtaatttcttcgtatagaat

SEQ ID NO: 214204 - DNA, 75 bp, Artificial Sequence
  Synthetic
aaaaagggcagctgggcacatcactgtctttgtgacttcctaataagatcaagtcatttataaggttagactttt

SEQ ID NO: 214205 - DNA, 75 bp, Artificial Sequence
  Synthetic
ggtttaacagcccagaagaaattcttattacataagaccagaggggcctgtggactcttaatagcaaaaaacacc

SEQ ID NO: 214206 - DNA, 75 bp, Artificial Sequence
  Synthetic
cactcccctaactcacaggcatttgtcagcaccaaagagaagtaatcccacaaaattggtttagaaaattggtta

SEQ ID NO: 214207 - DNA, 75 bp, Artificial Sequence
  Synthetic
tcatttaatctctcatcataacccagagaattctttttcaaacattcaatgttttctaatcccaaactctggttt

SEQ ID NO: 214208 - DNA, 75 bp, Artificial Sequence
  Synthetic
acttctttaagtgatttttgacagtaaataactttaggctttctctcacaaattccacaaagacatggcattatt

SEQ ID NO: 214209 - DNA, 75 bp, Artificial Sequence
  Synthetic
cgagtaaatatgtcctttatatacagaaatccgcctttaccatccctaacacacttactccccatactcttacaa

SEQ ID NO: 214210 - DNA, 75 bp, Artificial Sequence
  Synthetic
acacttactccccatactcttacaaaacccaatgaagcctgaggcaacagaagactgaaatgcagatttgttgat

SEQ ID NO: 214211 - DNA, 75 bp, Artificial Sequence
  Synthetic
ttctttagaatgtcgatcagtaaccaccgaaccctttcaacaacccaatcagcaaggaatctattgctgtagcta

SEQ ID NO: 214212 - DNA, 75 bp, Artificial Sequence
  Synthetic
tgactctgccaagatcttcttcacgccttttgtgaaatttcttgacagcctggactgtattgtccttatcaatgt

SEQ ID NO: 214213 - DNA, 75 bp, Artificial Sequence
  Synthetic
gatctgccgtcaactacaggaaccaatgtaatccctaccctcagtagatcggactttaggtttaagagctttgac

SEQ ID NO: 214214 - DNA, 75 bp, Artificial Sequence
  Synthetic
atgtcactcttccattttctctcaaattcatcaggattgactctgacaaaggtttccaacaggatgagtgttttc

SEQ ID NO: 214215 - DNA, 75 bp, Artificial Sequence
  Synthetic
cttcgacttgtcatgagtttggtcctcaagaccaacctcaagtccccaaagctcgctaaattgacccatctgtag

SEQ ID NO: 214216 - DNA, 75 bp, Artificial Sequence
  Synthetic
tctagagtttgtctgatttcatcttcactacacccggcatattgcaggaatccggataaagcctcatcccctccc

SEQ ID NO: 214217 - DNA, 75 bp, Artificial Sequence
  Synthetic
ctgcttatcaagttgataaggttttcctcaaagattttgcctctcttaatgtcattgaacactttcctcgcgcag

SEQ ID NO: 214218 - DNA, 75 bp, Artificial Sequence
  Synthetic
ttccttataaacattgtctccttatcatcagaaaaaatagcttcaattttcctctgtagacggtaccctctagac

SEQ ID NO: 214219 - DNA, 75 bp, Artificial Sequence
  Synthetic
ccatcaacccagtctttgacatcttgttcttcaatagctccaaacggagtctctctgtatccagagtatctaatc

SEQ ID NO: 214220 - DNA, 75 bp, Artificial Sequence
  Synthetic
aattggttgactctaatggaaatctttgacactatatgagtgctaaccccattagcaatacattgatcacaaatt

SEQ ID NO: 214221 - DNA, 75 bp, Artificial Sequence
  Synthetic
cgcacggaggatcctaggcgattttggtcacgctataattgtgactgttttctgcttggacaacatcaaaatctg

SEQ ID NO: 214222 - DNA, 75 bp, Artificial Sequence
  Synthetic
tagagcagcagacacaaacttggtgagtaaaggagtctcttcacccatgacaaaaaatcttgacttaaactcagc

SEQ ID NO: 214223 - DNA, 75 bp, Artificial Sequence
  Synthetic
ttcatgcaagaaataccaacctttttgcaggaggctctgaacattgctcttgttgcagtcagtcttattgccatc

SEQ ID NO: 214224 - DNA, 75 bp, Artificial Sequence
  Synthetic
caaaaaatcttgacttaaactcagcaacaaaagttcctatcacactctttgggctgataaacttgtttaatttag

SEQ ID NO: 214225 - DNA, 75 bp, Artificial Sequence
  Synthetic
aacaaaagttcctatcacactctttgggctgataaacttgtttaatttagaagataagaattcatggaagcacac

SEQ ID NO: 214226 - DNA, 75 bp, Artificial Sequence
  Synthetic
attaagggtgtggtgaacttgtacaaaagtggtttgttccaattctttgtattcctagcgcttgcaggaaggtcc

SEQ ID NO: 214227 - DNA, 75 bp, Artificial Sequence
  Synthetic
aaagtggtttgttccaattctttgtattcctagcgcttgcaggaaggtcctgtacagaagaagcttttaaaatcg

SEQ ID NO: 214228 - DNA, 75 bp, Artificial Sequence
  Synthetic
catttccagcagttctgtcctgtcttgaaacttttcatcactaaggcaaggaatttttataaggctaacctggtc

SEQ ID NO: 214229 - DNA, 75 bp, Artificial Sequence
  Synthetic
gactgcacactgagttccagactgtgtccttctcaatggtgggtctcttttctaacaatccacatgacctacctt

SEQ ID NO: 214230 - DNA, 75 bp, Artificial Sequence
  Synthetic
atcgctggaggtataagtgacaggtatcacatcatacaataagtcaagtgcataacacagaaattgttcagtaat

SEQ ID NO: 214231 - DNA, 75 bp, Artificial Sequence
  Synthetic
tgttatgtaccttaaacaagagccatctttacattaaggggggcaatgcttcatttatgatcagctttgatgata

SEQ ID NO: 214232 - DNA, 75 bp, Artificial Sequence
  Synthetic
tagcccatataaatctgatgtgttgtgcaagattccctggcccatgtccaagacagacattatatggctggggac

SEQ ID NO: 214233 - DNA, 75 bp, Artificial Sequence
  Synthetic
tctttacattaaggggggcaatgcttcatttatgatcagctttgatgatattgaagtattgttgccacagtatga

SEQ ID NO: 214234 - DNA, 75 bp, Artificial Sequence
  Synthetic
ctggtcccttgactgcagatactggtgaaaaaactcttcaccaacactagtacagtcacaacccattaaacctaa

SEQ ID NO: 214235 - DNA, 75 bp, Artificial Sequence
  Synthetic
agatctcttcaatttccctacacagtaggcttctgcaacattaattggaacttcaacgaccttatgaagatgcca

SEQ ID NO: 214236 - DNA, 75 bp, Artificial Sequence
  Synthetic
ggaaccgtacaaagacagaaggcttcatctttcaagttaacacctccaagactggtgttaatgaaaactatgcta

SEQ ID NO: 214237 - DNA, 75 bp, Artificial Sequence
  Synthetic
tttgagaatgttcattactggttcaagattcacctttgttctatctctgggattcttcaattctaatgtgtacaa

SEQ ID NO: 214238 - DNA, 75 bp, Artificial Sequence
  Synthetic
aaaagaaaggaaaagtgctgggctcatagttggtccccatttggagtggtcatatgaacaggacaagtcaccatt

SEQ ID NO: 214239 - DNA, 75 bp, Artificial Sequence
  Synthetic
atagttggtccccatttggagtggtcatatgaacaggacaagtcaccattgttaacagccattttcatatcacag

SEQ ID NO: 214240 - DNA, 75 bp, Artificial Sequence
  Synthetic
gcaaaaacattcaacttccaaggaggtccttgaaagcattcttctcctggtctttgacagactcatccggcaagg

SEQ ID NO: 214241 - DNA, 75 bp, Artificial Sequence
  Synthetic
gtccttgaaagcattcttctcctggtctttgacagactcatccggcaaggatactcctgggggctactgtctaga

SEQ ID NO: 214242 - DNA, 75 bp, Artificial Sequence
  Synthetic
tcaactaacctggtcatcagcttagtgttgaggtctcccacatacagttctctatttgagccaacctgctcctta

SEQ ID NO: 214243 - DNA, 75 bp, Artificial Sequence
  Synthetic
tctatttgagccaacctgctccttataacttagtccaaatttcaagttccctgtatttgagctgatgcttgtgaa

SEQ ID NO: 214244 - DNA, 75 bp, Artificial Sequence
  Synthetic
taacttagtccaaatttcaagttccctgtatttgagctgatgcttgtgaactctgtaggagagtcgtctgaatag

SEQ ID NO: 214245 - DNA, 75 bp, Artificial Sequence
  Synthetic
tagcaaaatgcaatttgaaccatgactctgaattctgtgacatgttgaggctttttgattacaacaagaatgcca

SEQ ID NO: 214246 - DNA, 75 bp, Artificial Sequence
  Synthetic
taaaaaccctaaatgatgaaactaagaaacaagtaaatctgatggggcagacaatcaatgccttgatatctgaca

SEQ ID NO: 214247 - DNA, 75 bp, Artificial Sequence
  Synthetic
tccctggtactaagccgaacctcatcctttagtctcagaacttcactggaaaagcccaatctagatctacttcta

SEQ ID NO: 214248 - DNA, 75 bp, Artificial Sequence
  Synthetic
atttattgatgaaaaacaaaattagggaactgatgagcgtcccctactgcaattatacaaaattttggtatgtca

SEQ ID NO: 214249 - DNA, 75 bp, Artificial Sequence
  Synthetic
tgctcataactacccaatttctgatcataatgtccttgaattaaaagatacttgaagcattcaaagaattcatct

SEQ ID NO: 214250 - DNA, 75 bp, Artificial Sequence
  Synthetic
cataatgtccttgaattaaaagatacttgaagcattcaaagaattcatcttcttggtaggctattgttgtcaaat

SEQ ID NO: 214251 - DNA, 75 bp, Artificial Sequence
  Synthetic
tcttggtaggctattgttgtcaaattttttaataacaaacccaaagggcagatgtcctgcggtgcttcaagaaaa

SEQ ID NO: 214252 - DNA, 75 bp, Artificial Sequence
  Synthetic
acttccgtaatgactggatattggagagtgacttcttaatttctgaaatgctaagcaaagagtattcggacagac

SEQ ID NO: 214253 - DNA, 75 bp, Artificial Sequence
  Synthetic
taagtcaatttaaatggagatagataaacagcatcacataactctttatacacatcagacctgagcacatctgga

SEQ ID NO: 214254 - DNA, 75 bp, Artificial Sequence
  Synthetic
agggtaaaactcctttgactttagttgacatctgtttttggagcacagtattcttcacagcgtcactcttccttc

SEQ ID NO: 214255 - DNA, 75 bp, Artificial Sequence
  Synthetic
acttagtaggcatacccacccacagacacatcagaggcgaagcatgccctttgccacacaggttgaacagtttgg

SEQ ID NO: 214256 - DNA, 75 bp, Artificial Sequence
  Synthetic
cactccaaaaggggcccacaatgactcaagagactctcgctcatcaacagatggattttttgatttcaacttggt

SEQ ID NO: 214257 - DNA, 75 bp, Artificial Sequence
  Synthetic
gtggttgcagatgtggcaagtaccccaatctaaagaaaccaacagtttggcgcagaggacactaagacctcccga

SEQ ID NO: 214258 - DNA, 75 bp, Artificial Sequence
  Synthetic
gatctcaacttttgtcccctcactattagccatcttggctagtgtcatttgtacgtcatttctaataccctcaaa

SEQ ID NO: 214259 - DNA, 75 bp, Artificial Sequence
  Synthetic
ggcccttacttgatcctctgttaaactctcatacatcactgataattcttcttgattggttctggttcttgaacc

SEQ ID NO: 214260 - DNA, 75 bp, Artificial Sequence
  Synthetic
gcggcctggccgcggactgggaaggcactgcttacagtgcataggctgccttcgggaggaacagcaggctcggtg

SEQ ID NO: 214261 - DNA, 75 bp, Artificial Sequence
  Synthetic
ggtgctcacaagacctgttagattttttaatattaagtagtccatggaatcaggatcaagattatacctgccttt

SEQ ID NO: 214262 - DNA, 75 bp, Artificial Sequence
  Synthetic
gtaatagaggtgtgagttcctcctcatagagcttcccatctaacactgactgaaacattatgcagtctagcaggg

SEQ ID NO: 214263 - DNA, 75 bp, Artificial Sequence
  Synthetic
tgttttaaacctctcagccatagtagaaacgcatgttgaaacaagtttctccttatcataaacagaaagaatatt

SEQ ID NO: 214264 - DNA, 75 bp, Artificial Sequence
  Synthetic
cacagtgtggctcactggaggccaacttgaagggagtgtccttatccctctttttcttgttgacaaccactccat

SEQ ID NO: 214265 - DNA, 75 bp, Artificial Sequence
  Synthetic
tccaagttcgtcgagcttggggattaccacacttttattgcttgacagatccagagctgtgctagtgatgttagg

SEQ ID NO: 214266 - DNA, 75 bp, Artificial Sequence
  Synthetic
tgtgatatttgcatagatgaccatacttctcccagacttgttgatcaaactgcctggcttgttcagatgtaagtc

SEQ ID NO: 214267 - DNA, 75 bp, Artificial Sequence
  Synthetic
cctgtagggattgcttttcagttcacctgtaactttaagtcttcctctattgaagagagaaatgcagaaggacaa

SEQ ID NO: 214268 - DNA, 75 bp, Artificial Sequence
  Synthetic
tgcctggcttgttcagatgtaagtctaacatcaaccagtttgagatctcttcttccatggaggtcaaatagcttc

SEQ ID NO: 214269 - DNA, 75 bp, Artificial Sequence
  Synthetic
cctgtaactttaagtcttcctctattgaagagagaaatgcagaaggacaaaatctctttacacactcctggaatt

SEQ ID NO: 214270 - DNA, 75 bp, Artificial Sequence
  Synthetic
gccgatcacgtaactaagaactcctggcattgcatcttctatgtccttcattaagatgccgtgggagtgtctgct

SEQ ID NO: 214271 - DNA, 75 bp, Artificial Sequence
  Synthetic
tcttatcatggtgtcctcttgttccagtgttagactcccacttagaggggggtttacaacaacacaatcaaactt

SEQ ID NO: 214272 - DNA, 75 bp, Artificial Sequence
  Synthetic
accatttttgaaccctttctcatcatgtggtttcctgaagcagtgaatgtactgtttacttgcaggttggaacaa

SEQ ID NO: 214273 - DNA, 75 bp, Artificial Sequence
  Synthetic
tgccatctcaacaggatcagtggctagtccttcaatgtcgagccaaagggtattggtggggtcgagtttccccac

SEQ ID NO: 214274 - DNA, 75 bp, Artificial Sequence
  Synthetic
gtgacacagataactaacatttaatagatatttaaaccttcttgcaaagtaaagatctgcatcttccccttcacc

SEQ ID NO: 214275 - DNA, 75 bp, Artificial Sequence
  Synthetic
aaagatctgcatcttccccttcacccaaaattgtctggaaaagttccacagccatcctctgaatcagcacctctg

SEQ ID NO: 214276 - DNA, 75 bp, Artificial Sequence
  Synthetic
gccatcctctgaatcagcacctctgatccagacatgcagtcgacccttaactttgacatcaaatccacatgatgg

SEQ ID NO: 214277 - DNA, 75 bp, Artificial Sequence
  Synthetic
atttgatttgcatatgccatcaagaaatatcttagaccttgtaaaaatgtctggttccttttggaaggggaacag

SEQ ID NO: 214278 - DNA, 75 bp, Artificial Sequence
  Synthetic
agtacagctaacactaacaatcttaatattggccttgtcattgtcatgagttcgtggctaaaatccaaccagctg

SEQ ID NO: 214279 - DNA, 75 bp, Artificial Sequence
  Synthetic
gtcatttcctcacacatttcaattaacacatcctccgaaaatataggcaggaaaaatctctttggatcacagtaa

SEQ ID NO: 214280 - DNA, 75 bp, Artificial Sequence
  Synthetic
gaaaaatctctttggatcacagtaaaaagagccttgttcttccaataccccattgatggatagatagatagaata

SEQ ID NO: 214281 - DNA, 75 bp, Artificial Sequence
  Synthetic
ataacactctcttagtctaacattcccaaaatatctagaatactctctttcattgattaacaatcgggaggaaaa

SEQ ID NO: 214282 - DNA, 75 bp, Artificial Sequence
  Synthetic
ccaaaatatctagaatactctctttcattgattaacaatcgggaggaaaatgatgtcttcatcgagttgaccaat

SEQ ID NO: 214283 - DNA, 75 bp, Artificial Sequence
  Synthetic
actgttcattgtctcacctccttgaacagtcatgcatgcaattgtcaatgcagggacagagccaaactgattgtt

SEQ ID NO: 214284 - DNA, 75 bp, Artificial Sequence
  Synthetic
tagctttgaagggtccttaacatcccatatcctcaccacaccatttcctccagtcccttgttgttgaaatcccag

SEQ ID NO: 214285 - DNA, 75 bp, Artificial Sequence
  Synthetic
catatcctcaccacaccatttcctccagtcccttgttgttgaaatcccagtgttcttaatatctctgatcttttg

SEQ ID NO: 214286 - DNA, 75 bp, Artificial Sequence
  Synthetic
ctacagattttctcaaattccttgttaatagtatatctcatcactggtctgtcagaaacaagtgcctgagctaaa

SEQ ID NO: 214287 - DNA, 75 bp, Artificial Sequence
  Synthetic
gcaagttgtgactgggacaaattgcccatgtaaaccccttgagagcctgtctctgctcttcttatcttgtttttt

SEQ ID NO: 214288 - DNA, 75 bp, Artificial Sequence
  Synthetic
atcatcaagctatccatatcagggtgttttattagtttttccagctgtgaccagagatcttgatgagagttcttc

SEQ ID NO: 214289 - DNA, 75 bp, Artificial Sequence
  Synthetic
ctctgctcttcttatcttgttttttaatttctcaaggtcagatgccaactccatcagttcatccctccccagatc

SEQ ID NO: 214290 - DNA, 75 bp, Artificial Sequence
  Synthetic
ccttattagtttaatcgcctccagaatatctagaagtctgtcattgactaacattaacatttgtccaacaactat

SEQ ID NO: 214291 - DNA, 75 bp, Artificial Sequence
  Synthetic
tcccgcatttcttaaccttacaattgcatcatcatgcgttttgaaaagatcacaaagtaaattgagtaaaactaa

SEQ ID NO: 214292 - DNA, 75 bp, Artificial Sequence
  Synthetic
gcatcatcatgcgttttgaaaagatcacaaagtaaattgagtaaaactaagtccagaaacagtaaagtgtttctc

SEQ ID NO: 214293 - DNA, 75 bp, Artificial Sequence
  Synthetic
ctggtgttgaaaacttttagacctttcactttgttacacacggaaagggcttgaagataacacctctctacagca

SEQ ID NO: 214294 - DNA, 75 bp, Artificial Sequence
  Synthetic
cctcaaggactgagtccatctgaagcttggaacctccttggagtgtgccataccagaagttctggtgattttgat

SEQ ID NO: 214295 - DNA, 75 bp, Artificial Sequence
  Synthetic
agttctggtgattttgatctgagatagagttgctcagtagaagtgttagacactatgcctaggatcctccgtgcg

SEQ ID NO: 214296 - DNA, 75 bp, Artificial Sequence
  Synthetic
tattggatgcaatgcgatagagtagactacatccatcaacttgtttgcacaaaaagggcagctgggcacatcact

SEQ ID NO: 214297 - DNA, 75 bp, Artificial Sequence
  Synthetic
cgcacagaggatcctaggcgattttagtcacgctataattgtgactgttttctgtttggacaacatcaaaaatct

SEQ ID NO: 214298 - DNA, 75 bp, Artificial Sequence
  Synthetic
aaaaagggcagctgggcacatcactgtctttgtggcttcctaataagatcaagtcatttataagcttagactttt

SEQ ID NO: 214299 - DNA, 75 bp, Artificial Sequence
  Synthetic
gtgaaaatttgaatttccccaactgcttgtcaaaaatctccttcttaaaccaaaaccttaactttatgagttctt

SEQ ID NO: 214300 - DNA, 75 bp, Artificial Sequence
  Synthetic
ttgcaggaggctctgaacattgctcttgttgcagtcagtcttattgccatcattaagggtgtagtgaatttgtac

SEQ ID NO: 214301 - DNA, 75 bp, Artificial Sequence
  Synthetic
ctcttatgacagattctctaatgtctcctctaaccccaacaaagagggattcatttaacctctcatcataaccca

SEQ ID NO: 214302 - DNA, 75 bp, Artificial Sequence
  Synthetic
tcatttaacctctcatcataacccaaagaattctttttcaagcattcgatgttttctaatcccaagctctggttt

SEQ ID NO: 214303 - DNA, 75 bp, Artificial Sequence
  Synthetic
tgtccttctcaatggtgggtctcttttctaacaatccacatgacctacctttgctgtgtaccttaaacaagagcc

SEQ ID NO: 214304 - DNA, 75 bp, Artificial Sequence
  Synthetic
tttgtgttggacaaactatggatcaatcgctggtattcttgttcttcaatattaatctcttgcataaattttgat

SEQ ID NO: 214305 - DNA, 75 bp, Artificial Sequence
  Synthetic
atcgctggtattcttgttcttcaatattaatctcttgcataaattttgatttctttaggatgtcgatcagcaacc

SEQ ID NO: 214306 - DNA, 75 bp, Artificial Sequence
  Synthetic
accgaactctttcaacaacccaatcagcaaggaatctattgctgtagctagatctgccatcaaccacaggaacca

SEQ ID NO: 214307 - DNA, 75 bp, Artificial Sequence
  Synthetic
acgtaatccctgcccttagtaggtcggactttaggtttaagagctttgacatgtcactcttccattttctctcaa

SEQ ID NO: 214308 - DNA, 75 bp, Artificial Sequence
  Synthetic
actcatcaggattgaccctaacaaaggtttccaataggatgagtgttttccctgtgagtttgaagccatccggaa

SEQ ID NO: 214309 - DNA, 75 bp, Artificial Sequence
  Synthetic
aggaaccgtacaaagacagagggcttcatctttcaagttaacacctccaagactggtgtcaatgaaaactatgca

SEQ ID NO: 214310 - DNA, 75 bp, Artificial Sequence
  Synthetic
tgacttttggaagggtgggacatagtatgccatagtcagacaggatcacatcaacaaacttctgatctgaattga

SEQ ID NO: 214311 - DNA, 75 bp, Artificial Sequence
  Synthetic
aagaagtttaagactggcatgcatcatttgtatagagaatatcctgactcttgcttaaatggcaaactgtgctta

SEQ ID NO: 214312 - DNA, 75 bp, Artificial Sequence
  Synthetic
tcaacaaacttctgatctgaattgatctgacaggcgtgtgcctcacaggactcaagctctactaaacttgacaga

SEQ ID NO: 214313 - DNA, 75 bp, Artificial Sequence
  Synthetic
agctggggtgatgttgagataaaaagatgtccctttggtatgctagctcctgtctttctggaaaatgctttctaa

SEQ ID NO: 214314 - DNA, 75 bp, Artificial Sequence
  Synthetic
atgctttctaataaggctttttatttcatttactgattcctccatgctcaagtgccgcctaggatccactgtgcg

SEQ ID NO: 214315 - DNA, 75 bp, Artificial Sequence
  Synthetic
cgcacagtggatcctaggcgattttggttacgctataattgtaactgttttctgtttggacaacatcaaaaacat

SEQ ID NO: 214316 - DNA, 75 bp, Artificial Sequence
  Synthetic
atcaaaaccctaaatgatgaaactaagaaacaagtaaatctaatggggcagacaatcaatgccttgatatctgac

SEQ ID NO: 214317 - DNA, 75 bp, Artificial Sequence
  Synthetic
atcattaagggtgtagtgaacctgtacaaaagtggtttgttccaattctttgtattcctagcactcgcaggaaga

SEQ ID NO: 214318 - DNA, 75 bp, Artificial Sequence
  Synthetic
acaaaagtggtttgttccaattctttgtattcctagcactcgcaggaagatcctgcacagaagaagcttttaaaa

SEQ ID NO: 214319 - DNA, 75 bp, Artificial Sequence
  Synthetic
ttttccaacaatccacatgacctgcctctgttgtgtaccttaaacaagagccatctttacattaaggggggcaat

SEQ ID NO: 214320 - DNA, 75 bp, Artificial Sequence
  Synthetic
atgatcaaatttggttgtctcagtggttcatgaatgctgtgggacatgattggcatctagacccaccatttctgt

SEQ ID NO: 214321 - DNA, 75 bp, Artificial Sequence
  Synthetic
agggtccccaccagcccgggcactgcccgggctggtgtggccccccagtccgcggcctggccgcggactggggag

SEQ ID NO: 214322 - DNA, 75 bp, Artificial Sequence
  Synthetic
taatgaaggcacaacctaccagttggcctctccaatgtccactcgaccacgttaacacattacacttccttacaa

SEQ ID NO: 214323 - DNA, 75 bp, Artificial Sequence
  Synthetic
gaggtccttgaaagcattcttctcctggtctttgacagactcatccggcaaggatacccctggaggctattgtct

SEQ ID NO: 214324 - DNA, 75 bp, Artificial Sequence
  Synthetic
gcacagtgtggttcactggaggccaacttgaagggagtatccttatccctctttttcttattgacaaccactcca

SEQ ID NO: 214325 - DNA, 75 bp, Artificial Sequence
  Synthetic
aaaatgaagtgttttggcaatactgctgtagcaaaatgcaatctgaatcatgactctgaattctgtgacatgctg

SEQ ID NO: 214326 - DNA, 75 bp, Artificial Sequence
  Synthetic
acaatttattgatgaaaaacaaaattagggaactgatgagtgtcccttactgcaattacacaaaattttggtatg

SEQ ID NO: 214327 - DNA, 75 bp, Artificial Sequence
  Synthetic
ctgacttccgtaatgactggatattagaaagtgacttcttaatttctgaaatgctaagcaaagagtattcggaca

SEQ ID NO: 214328 - DNA, 75 bp, Artificial Sequence
  Synthetic
tatctctgtcaagttagccaatcttaaattctgaccacttttttccggttgtctaggaccagcaactggtttcct

SEQ ID NO: 214329 - DNA, 75 bp, Artificial Sequence
  Synthetic
gtattcttcacagcgtcactcttccttcacttggtgggtataccctcccacagacacatcaggggcgaagcatgc

SEQ ID NO: 214330 - DNA, 75 bp, Artificial Sequence
  Synthetic
gtctaggaccagcaactggtttccttgtcagatcaatgctagtgttgtcccatgacctgcccgtgatttgcgatc

SEQ ID NO: 214331 - DNA, 75 bp, Artificial Sequence
  Synthetic
cagacacatcaggggcgaagcatgccctttgccacacaggttgaacagcttgggtggttgcagatgtggtaagta

SEQ ID NO: 214332 - DNA, 75 bp, Artificial Sequence
  Synthetic
tgggtggttgcagatgtggtaagtaccccaatctaaagaaaccaacagtttggcgtagaggacactaagacctcc

SEQ ID NO: 214333 - DNA, 75 bp, Artificial Sequence
  Synthetic
aggttttcataaggatttctattgcctggtttctcatcaataaacatgccttctcttcgtttaacttgaatggtt

SEQ ID NO: 214334 - DNA, 75 bp, Artificial Sequence
  Synthetic
tggcgtagaggacactaagacctcctgagggtccccaccagcccgggcactgcccgggctggtgtggccccccag

SEQ ID NO: 214335 - DNA, 75 bp, Artificial Sequence
  Synthetic
gattttatgagggaagagaagttttctggggtgactctgattgtttccaacatatttccaccatcaagaatggat

SEQ ID NO: 214336 - DNA, 75 bp, Artificial Sequence
  Synthetic
aactgcctggcttgttcagatgtgagcttaacatcaaccagtttaagatctcttcttccatggaggtcaaacaac

SEQ ID NO: 214337 - DNA, 75 bp, Artificial Sequence
  Synthetic
gcttaacatcaaccagtttaagatctcttcttccatggaggtcaaacaacttcctgatgtcatcggatccttgag

SEQ ID NO: 214338 - DNA, 75 bp, Artificial Sequence
  Synthetic
caagccgatcacgtaactaagaactcctggcattgcatcttctatgtctttcattaagatgccgtgagagtgtct

SEQ ID NO: 214339 - DNA, 75 bp, Artificial Sequence
  Synthetic
cctggcattgcatcttctatgtctttcattaagatgccgtgagagtgtctgctaccatttttaaaccctttctca

SEQ ID NO: 214340 - DNA, 75 bp, Artificial Sequence
  Synthetic
tcattaagatgccgtgagagtgtctgctaccatttttaaaccctttctcatcatgtggttttctgaagcagtgaa

SEQ ID NO: 214341 - DNA, 75 bp, Artificial Sequence
  Synthetic
tcatgtggttttctgaagcagtgaatatactgcttacctgcaggctggaacaacgccatctcaacagggtcagta

SEQ ID NO: 214342 - DNA, 75 bp, Artificial Sequence
  Synthetic
gggtattggtggggtcgagtttccccactgcctctctgatgacagcttcttgtatctctgtcaagttagccaatc

SEQ ID NO: 214343 - DNA, 75 bp, Artificial Sequence
  Synthetic
ttgtctaggtccagcaactggtttccttgtcagatcaatacttgtgttgtcccatgacctgcctatgatttgtga

SEQ ID NO: 214344 - DNA, 75 bp, Artificial Sequence
  Synthetic
tctggaaccaatataaggccaaccatcgccagaaaggcaaagtttgtacagaaggttttcataagggtttctatt

SEQ ID NO: 214345 - DNA, 75 bp, Artificial Sequence
  Synthetic
cgcaccggggatcctaggcggcacttgagcatggaggaatcagtgaatgaaataaaaaaccttattagaaagcat

SEQ ID NO: 214346 - DNA, 75 bp, Artificial Sequence
  Synthetic
gcctggtttctcatcaataaacatgccttctcttcgtttaacctgaatggttgattttatgagggaagaaaagtt

SEQ ID NO: 214347 - DNA, 75 bp, Artificial Sequence
  Synthetic
atctggggtgactctgattgtctccaacatatttccaccatcaagaatggatgcaccagcctttactgcagctga

SEQ ID NO: 214348 - DNA, 75 bp, Artificial Sequence
  Synthetic
tttccagaaagacaggaattagcataccaaagggacatctttttatctcaacatcaccccagctctctgttgttg

SEQ ID NO: 214349 - DNA, 75 bp, Artificial Sequence
  Synthetic
aagactaaagttgtagccagaaatgttgatggagctttcatccttagtcacaatctggaggcagtcatgttcctg

SEQ ID NO: 214350 - DNA, 75 bp, Artificial Sequence
  Synthetic
ttgatggagctttcatccttagtcacaatctggaggcagtcatgttcctgagtcaatctgtcaaggtcactcaag

SEQ ID NO: 214351 - DNA, 75 bp, Artificial Sequence
  Synthetic
gaagggttcaagcttctgtcaagtttagtagagcttgagtcctgtgaggcacatgcctgtcagatcaattcagat

SEQ ID NO: 214352 - DNA, 75 bp, Artificial Sequence
  Synthetic
cagaagtttgttgatgtgattctgtctgaccatggcatactatgtcccaccctcccaaaagtcattccggatggt

SEQ ID NO: 214353 - DNA, 75 bp, Artificial Sequence
  Synthetic
tttaaactcacagggaaaacactcatcctgttggaaacctttgttagagtcaatcctgatgaatttgagaaaaaa

SEQ ID NO: 214354 - DNA, 75 bp, Artificial Sequence
  Synthetic
gttaagttttgaaggatctttaacatcccataccctcaccacaccatttcccccagttccttgctgttgaaatcc

SEQ ID NO: 214355 - DNA, 75 bp, Artificial Sequence
  Synthetic
tggaagagtgacatgtcaaagctcttaaacctaaagtccgatctattgagggcagggattacgttggttcctgta

SEQ ID NO: 214356 - DNA, 75 bp, Artificial Sequence
  Synthetic
cagtgttctcaatatctctgatctcttggccagttgtgattgagacaagttacccatgtaaaccccttgagagcc

SEQ ID NO: 214357 - DNA, 75 bp, Artificial Sequence
  Synthetic
gttgatggcagatctagctacagcaatagattccttgctgattgggttgttgaaagagttcggtggctactgatt

SEQ ID NO: 214358 - DNA, 75 bp, Artificial Sequence
  Synthetic
gacatcctaaagaaatcaaaatttatgcaagagattaatattgaagaacaagaataccagcgattaattcatagt

SEQ ID NO: 214359 - DNA, 75 bp, Artificial Sequence
  Synthetic
ttgtccaatacaaaaaaccagagcttgggattagaaaacattgaatgtttgaaaaagaattctttgggttatgat

SEQ ID NO: 214360 - DNA, 75 bp, Artificial Sequence
  Synthetic
gagagattaaatgaatccctttttgttggggttagaggagacattagagaatctgttataagagaagaactcata

SEQ ID NO: 214361 - DNA, 75 bp, Artificial Sequence
  Synthetic
gtcaatgctgtcagcaattagcttggcatccttcagaacatccgacttgacagtctgagtaaattgactcaaacc

SEQ ID NO: 214362 - DNA, 75 bp, Artificial Sequence
  Synthetic
aagttaaggttttggtttaagaaggagatttttgacaagcagttggggaaattcaaattttcacaaaaatctaac

SEQ ID NO: 214363 - DNA, 75 bp, Artificial Sequence
  Synthetic
gcatccttcagaacatccgacttgacagtctgagtaaattgactcaaacctctccttaaggactgagtccatcta

SEQ ID NO: 214364 - DNA, 75 bp, Artificial Sequence
  Synthetic
cttataaatgacttggtctcattaggaagccacaaagacagtgatgtgcccagctgccctttttgtgcaaacaag

SEQ ID NO: 214365 - DNA, 75 bp, Artificial Sequence
  Synthetic
tctccttaaggactgagtccatctaaagcttggaacctctttggagtgtgccatgccagaagttctggtgatttt

SEQ ID NO: 214366 - DNA, 75 bp, Artificial Sequence
  Synthetic
agttctggtgattttgatctagaatagagttgctcagtgaaagtgttagacactatgcctaggatccactgtgcg

SEQ ID NO: 214367 - DNA, 75 bp, Artificial Sequence
  Synthetic
cgcaccggggatcctaggcgtaacttcatcattaaaatctcagattctgctctgagtgtgacttactgcgaagag

SEQ ID NO: 214368 - DNA, 75 bp, Artificial Sequence
  Synthetic
ttgatggatgtggtctactctatcgcatcgcatccaatagatgaagtcaacatgaaaagccagtcagatgagaat

SEQ ID NO: 214369 - DNA, 75 bp, Artificial Sequence
  Synthetic
tctatatctattgatgctgtagagaggtgttatcttcaagccctttccgtctgtaacaaagtgaaaggtctaaaa

SEQ ID NO: 214370 - DNA, 75 bp, Artificial Sequence
  Synthetic
gttttcaacaccaggagaaatactttactgtttctggatttagttttactcaatttactttgtgatctttttaaa

SEQ ID NO: 214371 - DNA, 75 bp, Artificial Sequence
  Synthetic
tcaacaaacattgctcttgatactttattattcttaattgacaaggtaaaatctgtgagttcagctagatctact

SEQ ID NO: 214372 - DNA, 75 bp, Artificial Sequence
  Synthetic
aagcatgatgatgcaattgtaaggctaagaaatgcaggaatagttgttggacaaatgttaatgttagtcaatgac

SEQ ID NO: 214373 - DNA, 75 bp, Artificial Sequence
  Synthetic
agacttctagatattctggaggcgattaaattaataaggaagaaattgatgaccagccccaagtgggttcaaatg

SEQ ID NO: 214374 - DNA, 75 bp, Artificial Sequence
  Synthetic
ccttttgtgaaatttcttgacagcctggactgtattgtctttatcaatgttggcatctcttctttctctaacact

SEQ ID NO: 214375 - DNA, 75 bp, Artificial Sequence
  Synthetic
tgttccagaacattgaagaactctcatcaagatctctggtcacagctggaaaaactaataaaacaccctgatatg

SEQ ID NO: 214376 - DNA, 75 bp, Artificial Sequence
  Synthetic
gtcattaaacactttcctcgcgcagttccttataaacattgtctccttatcatcagaaaaaatagcttcaatttt

SEQ ID NO: 214377 - DNA, 75 bp, Artificial Sequence
  Synthetic
gatagcatgatgatcttagctcaggcacttgtttctgacagaccagtgatgagatatactattgacagagaatct

SEQ ID NO: 214378 - DNA, 75 bp, Artificial Sequence
  Synthetic
agacagacattatatggctggggacctggtcccttgactgcagatactggtgaaagaactcttcaccaacactag

SEQ ID NO: 214379 - DNA, 75 bp, Artificial Sequence
  Synthetic
gagaaaatctgtagacatcagccattcagcagtttagtggaaggtgagcagaagaaattatttaggattttgtcc

SEQ ID NO: 214380 - DNA, 75 bp, Artificial Sequence
  Synthetic
tccatttcccttgcattggtcaactcaatgaagacatcattttcctcccgattgttgatcaatgaaagagagtat

SEQ ID NO: 214381 - DNA, 75 bp, Artificial Sequence
  Synthetic
attgcacgttcgaattccttttctgaattcaagcatgtgtatctcattgaactacccacagcttctgagaagtct

SEQ ID NO: 214382 - DNA, 75 bp, Artificial Sequence
  Synthetic
tctagatactttggaaatgttagactaagagagtgttatgtacaaagatttcatctgataaagaacacatttggt

SEQ ID NO: 214383 - DNA, 75 bp, Artificial Sequence
  Synthetic
ctcttgttttaccaaaaaacaggtgagaagtcaaggtgctattctatctatctatctatcaatggggtgttggaa

SEQ ID NO: 214384 - DNA, 75 bp, Artificial Sequence
  Synthetic
gaacaaggctctttttactgtgatccaaagagatttttcctgcctatattttcggaggatgtgttaattgaaatg

SEQ ID NO: 214385 - DNA, 75 bp, Artificial Sequence
  Synthetic
gactttgggctcaataaacttctcaaaacactttatttgatctgtcaggcgatcaggtgtctctttggttaccaa

SEQ ID NO: 214386 - DNA, 75 bp, Artificial Sequence
  Synthetic
tgtgaggaaatgaccagctggttggattttagccacgaactcatgacaatgacaaggccaacattaagattgtta

SEQ ID NO: 214387 - DNA, 75 bp, Artificial Sequence
  Synthetic
gcaccttgacttctcacctgttttttggtaaaacaagagaccaaatgtgttctttgtcagatgaaatctttgtac

SEQ ID NO: 214388 - DNA, 75 bp, Artificial Sequence
  Synthetic
gtgttggctgtgctctgttccccttccaaaaggaaccagacatttttacaaggtctaagatatttcttgatggca

SEQ ID NO: 214389 - DNA, 75 bp, Artificial Sequence
  Synthetic
tatgcaaatcaaatccatcatgtggatttgatgtcaaagctaagggtcgactgcatgtctggatcagaggtgctg

SEQ ID NO: 214390 - DNA, 75 bp, Artificial Sequence
  Synthetic
ccagagatcttgatgagagttcttcaatgttctggaacacacttgaacccacttggggctggtcatcaatttctt

SEQ ID NO: 214391 - DNA, 75 bp, Artificial Sequence
  Synthetic
attcagaggatggctgtggaacttttccagacaattttgagtgaaggggaagatgcagatctttactttgcaaga

SEQ ID NO: 214392 - DNA, 75 bp, Artificial Sequence
  Synthetic
atatctagaagtctgtcattgactaacattaacatttgtccaacaactattcccgcatttcttagccttacaatt

SEQ ID NO: 214393 - DNA, 75 bp, Artificial Sequence
  Synthetic
aggttcaaatatctattgaatgttagttatttgtgtcacttggtaaccaaagagacacctgatcggctgacagat

SEQ ID NO: 214394 - DNA, 75 bp, Artificial Sequence
  Synthetic
caaataaagtgttttgagaagtttattgagcccaaagtcaagtttgattgtgttgttgtaaacccccctttaaat

SEQ ID NO: 214395 - DNA, 75 bp, Artificial Sequence
  Synthetic
gggagtctaacactggaacaagaggacatcatgataagaggattggacagattcttttccaaagaggctaagact

SEQ ID NO: 214396 - DNA, 75 bp, Artificial Sequence
  Synthetic
atgctttctaataaggctttttatttcatttactgattcctccatgctcaagtgccgcctaggatcctcggtgcg

SEQ ID NO: 214397 - DNA, 75 bp, Artificial Sequence
  Synthetic
cgcaccggggatcctaggcgattttggttacgctataattgtaactgttttctgtttggacaacatcaaaaacat

SEQ ID NO: 214398 - DNA, 75 bp, Artificial Sequence
  Synthetic
tcctcagatactcaaattccaggagtgagtaaagagatcttgtctttctgcatttctctcttcaatagaggaaga

SEQ ID NO: 214399 - DNA, 75 bp, Artificial Sequence
  Synthetic
cttaaagttacaggtgagctgaaaagcaatccctacagacctaacatcactagcacagctttggatttgtcaagc

SEQ ID NO: 214400 - DNA, 75 bp, Artificial Sequence
  Synthetic
aataaaagtgtggtgatccccaagctcgacgaacttggaaatattctctctgtttatgataaggagaaacttgtt

SEQ ID NO: 214401 - DNA, 75 bp, Artificial Sequence
  Synthetic
tcctgcacagaagaagctttcaaaatcggactgcacactgagttccagactgtgtccttctcaatggtgggtctc

SEQ ID NO: 214402 - DNA, 75 bp, Artificial Sequence
  Synthetic
tcaacatgtgtttctaccatggctgagagattcaaaacaaaaggcaggtataatcttgatcctgattccatggac

SEQ ID NO: 214403 - DNA, 75 bp, Artificial Sequence
  Synthetic
gttcatgaatgctgtgggacatgattggcatctagacccaccatttctgtgtaggaaccgtacaaagacagaagg

SEQ ID NO: 214404 - DNA, 75 bp, Artificial Sequence
  Synthetic
tatttaatattaaaaaatctaacaggtcttgtgagcaccggttctagaactagaaccaatcaagaagaattgtca

SEQ ID NO: 214405 - DNA, 75 bp, Artificial Sequence
  Synthetic
atgatgtatgagagtttaacagaggatcaagtaagggcctttgagggtatcagaaatgacgtgcaaatgacacta

SEQ ID NO: 214406 - DNA, 75 bp, Artificial Sequence
  Synthetic
ctaagaagtttaagactggcatgcatcatttatatagagaatatcctgactcttgcccgaatggcaaactgtgct

SEQ ID NO: 214407 - DNA, 75 bp, Artificial Sequence
  Synthetic
gctaagatggctaatagtgaggggtcaaaagttgagaccaccaagttgaaatcaaagaatctatctgttgatgag

SEQ ID NO: 214408 - DNA, 75 bp, Artificial Sequence
  Synthetic
cgagagtctcttgagtcattgtgggccccttttggagtgttgagagagattaaagcagaggtgtcaatgcatgag

SEQ ID NO: 214409 - DNA, 75 bp, Artificial Sequence
  Synthetic
gtgaaggattttgatccagatgtgttcaggtctgatgtgtataaagagttatgtgatgctgtttatctatctcca

SEQ ID NO: 214410 - DNA, 75 bp, Artificial Sequence
  Synthetic
aggatacccctggaggctattgtctagaagagtggatgctcgtagcagccaaaatgaagtgttttggcaatactg

SEQ ID NO: 214411 - DNA, 75 bp, Artificial Sequence
  Synthetic
tttaaattgacttatttccttgaagcaccgcaggatatctgccctttgggtttgttattaaaaaatttgacaaca

SEQ ID NO: 214412 - DNA, 75 bp, Artificial Sequence
  Synthetic
ctatcaaaaccctaaatgatgaaactaagaaacaagtaaatctgatggggcagacaatcaatgccctgatatctg

SEQ ID NO: 214413 - DNA, 75 bp, Artificial Sequence
  Synthetic
atagcctaccaagaagatgaattctttgaatgcttcaagtatcttttaattcaaggacattatgatcagaaattg

SEQ ID NO: 214414 - DNA, 75 bp, Artificial Sequence
  Synthetic
ggtagttatgagcatagaagtagatctagattgggcttttccagtgaagttctgaaactaaaggatgaggttcgg

SEQ ID NO: 214415 - DNA, 75 bp, Artificial Sequence
  Synthetic
cttagtaccagggaaagcaattctgaggccattgctgataagctagacaaaagttattttacaaacgcagcccta

SEQ ID NO: 214416 - DNA, 75 bp, Artificial Sequence
  Synthetic
cggaatttatgtttctattcagacgactctcctacagaatttacaagcatcagctcaaatacagggaacttgaaa

SEQ ID NO: 214417 - DNA, 75 bp, Artificial Sequence
  Synthetic
tttggactaagttataaagagcaggttggctcaaatagagaactgtatgtgggagacctcaacactaagctgatg

SEQ ID NO: 214418 - DNA, 75 bp, Artificial Sequence
  Synthetic
accaggttagttgaagacttctcagaagctgtgggtagttcaatgagatacacatgcttgaattcagaaaaggaa

SEQ ID NO: 214419 - DNA, 75 bp, Artificial Sequence
  Synthetic
gctggtccttcaatgtcgagccaaagggtgttggtggggtcgagtttccccactgcctctctgatgacagcttct

SEQ ID NO: 214420 - DNA, 75 bp, Artificial Sequence
  Synthetic
tttgaacgtgcaatctgtgatatgaagatggctgttaacaatggtgacttgtcctgttcatatgaccactccaaa

SEQ ID NO: 214421 - DNA, 75 bp, Artificial Sequence
  Synthetic
cactgcctctctgatgacagcttcttgtatctctgtcaagttagccaatctcaaattctgaccgtttttttccgg

SEQ ID NO: 214422 - DNA, 75 bp, Artificial Sequence
  Synthetic
tggggaccaactatgagcccagcacttttcctttcttttttgtacacattagaattgaagaatcccagagataga

SEQ ID NO: 214423 - DNA, 75 bp, Artificial Sequence
  Synthetic
cttgtcagatcaatacttgtgttgtcccatgacctgcctgtgatttgtgatctagaaccaatataaggccaacca

SEQ ID NO: 214424 - DNA, 75 bp, Artificial Sequence
  Synthetic
cccatgacctgcctgtgatttgtgatctagaaccaatataaggccaaccatcgccagaaagacaaagtttgtaca

SEQ ID NO: 214425 - DNA, 75 bp, Artificial Sequence
  Synthetic
tctagaaccaatataaggccaaccatcgccagaaagacaaagtttgtacaaaaggttttcataaggatttctatt

SEQ ID NO: 214426 - DNA, 75 bp, Artificial Sequence
  Synthetic
acaaaggtgaatcttgaaccagtaatgaatattctcaaatggcatcttcataaggtagttgaagttccaattaat

SEQ ID NO: 214427 - DNA, 75 bp, Artificial Sequence
  Synthetic
gttgcagaagcctactgtgtagggaaattgaagagatctttaggtttaatgggttgtgactgtactagtgttggt

SEQ ID NO: 214428 - DNA, 75 bp, Artificial Sequence
  Synthetic
gaagagttctttcaccagtatctgcagtcaagggaccaggtccctagccatataatgtctgtcttggacatgggg

SEQ ID NO: 214429 - DNA, 75 bp, Artificial Sequence
  Synthetic
cagggaatcttgcacaacacatcagatttatatgggctgattactgaacaatttctgtgttatgcacttgactta

SEQ ID NO: 214430 - DNA, 75 bp, Artificial Sequence
  Synthetic
atgctccagcctttactgcagctgaaagactgaagttgtaaccagaaatattgatggagctttcatctttagtca

SEQ ID NO: 214431 - DNA, 75 bp, Artificial Sequence
  Synthetic
ttgtatgatgtgatacctgtcacttatacctccagtgatgaccaggttagccttataaagattccttgccttagt

SEQ ID NO: 214432 - DNA, 75 bp, Artificial Sequence
  Synthetic
caatctgaaggcagtcatgttcctgagtcagtctgtcaaggtcacttaagtttggatacttcacagtgtatagaa

SEQ ID NO: 214433 - DNA, 75 bp, Artificial Sequence
  Synthetic
gatgaaaagtgtcaagacagaacagaactgctggaaatggtgtgcttccatgaattcttatcatctaaattaaac

SEQ ID NO: 214434 - DNA, 75 bp, Artificial Sequence
  Synthetic
gacactgttcattgtctcacctccttgaacagtcatgcatgcaattgtcaatgcaggaacagagccaaactgatt

SEQ ID NO: 214435 - DNA, 75 bp, Artificial Sequence
  Synthetic
aagtttatcagcccaaagagtgtgataggaacctttgttgctgagtttaagtcaagattttttgtcatgggtgaa

SEQ ID NO: 214436 - DNA, 75 bp, Artificial Sequence
  Synthetic
tgaacagtcatgcatgcaattgtcaatgcaggaacagagccaaactgattgtttagctttgaagggtctttaaca

SEQ ID NO: 214437 - DNA, 75 bp, Artificial Sequence
  Synthetic
gaaactcctttactcaccaagtttgtgtctgctgctctacacaatgttaagtgtaaaactccaacacaactgtca

SEQ ID NO: 214438 - DNA, 75 bp, Artificial Sequence
  Synthetic
gagaccatagacacaatttgtgatcaatgtattgctaatggggttagcactcatatagtttcaaagatttccatt

SEQ ID NO: 214439 - DNA, 75 bp, Artificial Sequence
  Synthetic
agagtcaaccaattgatcagatactccggatacagggagactccatttggagctattgaagaacaggatgtcaaa

SEQ ID NO: 214440 - DNA, 75 bp, Artificial Sequence
  Synthetic
cctcaacttattgaggtcttcttccccccttttagtctttctgagtgcccgctgcacctgtgccacttggttgaa

SEQ ID NO: 214441 - DNA, 75 bp, Artificial Sequence
  Synthetic
ccccttttagtctttctgagtgcccgctgcacctgtgccacttggttgaagtcgatgctgtcagcaattagcttg

SEQ ID NO: 214442 - DNA, 75 bp, Artificial Sequence
  Synthetic
gactgggttgacgggtctagagggtaccgtctacagaggaaaattgaagctattttttctgatgataaggagaca

SEQ ID NO: 214443 - DNA, 75 bp, Artificial Sequence
  Synthetic
tctccttaaggactgagtccatctaaagcttggaacctccttggagtgtgccatgccagaagttctggtgatttt

SEQ ID NO: 214444 - DNA, 75 bp, Artificial Sequence
  Synthetic
atgtttataaggaattgcgcgaggaaagtgtttaatgacattaagaaaggcaaaatctttgaggaaaaccttatc

SEQ ID NO: 214445 - DNA, 75 bp, Artificial Sequence
  Synthetic
ggttacgctataattgtgactgttttctgtttggacaacaccaaaatatctattgtacaatggggcagttcatta

SEQ ID NO: 214446 - DNA, 75 bp, Artificial Sequence
  Synthetic
aacttgataagcaggggaggggatgaggccttgtccggattcctgcaatatgccgggtgtagtgaagatgaaatc

SEQ ID NO: 214447 - DNA, 75 bp, Artificial Sequence
  Synthetic
agacgaactctagactacagatgggtcaatttggcaagcttcggggacttgaggttggtcttgaggaccaaactc

SEQ ID NO: 214448 - DNA, 75 bp, Artificial Sequence
  Synthetic
atgacaagtcgaagagtgttagagaaagaagagatgccaacgttgataaagacaatacagtccaggctgtcaaga

SEQ ID NO: 214449 - DNA, 75 bp, Artificial Sequence
  Synthetic
aatttcacaaaaggcgtgaagaagatcttggcagagtctatcaacaaatctgcatttcagtcttctgttgcctca

SEQ ID NO: 214450 - DNA, 75 bp, Artificial Sequence
  Synthetic
gtgtccttctcaatggtgggtctcttttccaacaatccacatgacctacctttgttgtgcaccttaaataagagc

SEQ ID NO: 214451 - DNA, 75 bp, Artificial Sequence
  Synthetic
ggctttattgggttttgtaagagtatggggagtaagtgtgttagggatggtaaaggcggatttttgtatataaag

SEQ ID NO: 214452 - DNA, 75 bp, Artificial Sequence
  Synthetic
cttcatttatgatcagctttgatgatattgcagtgttgttgccacagtatgatgttataatacaacatccggcag

SEQ ID NO: 214453 - DNA, 75 bp, Artificial Sequence
  Synthetic
gacatatttactcgaataatgccatgtctttgtgaaatttgtgagaaaaagcctaaagttatctactgtcaaaaa

SEQ ID NO: 214454 - DNA, 75 bp, Artificial Sequence
  Synthetic
gatgttataatacaacatccggcagatatgagctggtgttctaaaagtgatgatcaaatttggttgtctcaatgg

SEQ ID NO: 214455 - DNA, 75 bp, Artificial Sequence
  Synthetic
tcacttcaagaagttaaccaattttctaaaccaattttgtgggattacttctctttggtgctgacaaatgcctgt

SEQ ID NO: 214456 - DNA, 75 bp, Artificial Sequence
  Synthetic
tgatcaaatttggttgtctcaatggttcatgaatgctgtgggacatgattggcatctagacccaccatttctgtg

SEQ ID NO: 214457 - DNA, 75 bp, Artificial Sequence
  Synthetic
gagctaggggagtgggtgttttctgctgttaagagtccacaagcccctctggtcttatgtaataagaatttcttt

SEQ ID NO: 214458 - DNA, 75 bp, Artificial Sequence
  Synthetic
tgggctgttaaacccaaagcagtacgacaaatagaagaccaattaggcatgaaccatgtattgcattctatacga

SEQ ID NO: 214459 - DNA, 75 bp, Artificial Sequence
  Synthetic
agaaattaccccaaactatttgaagaacatttggcaccctttatgaatgatcttcaagtgaacagatctttagac

SEQ ID NO: 214460 - DNA, 75 bp, Artificial Sequence
  Synthetic
cctctccaatgtccactcgaccatgttaacacattacatttccttacaagaggcaaaaacattcaacttccaagg

SEQ ID NO: 214461 - DNA, 75 bp, Artificial Sequence
  Synthetic
agtggaagactcaagtttttggatgtctgtgtagctctagacatgatgaatgagaacttagggatcataagtcac

SEQ ID NO: 214462 - DNA, 75 bp, Artificial Sequence
  Synthetic
ttattaaaggtgagggataataatgtttatattgtgaaacagagtgactgcgcttcagcccatgtcagacagtca

SEQ ID NO: 214463 - DNA, 75 bp, Artificial Sequence
  Synthetic
gaagagtggatgctcgtagcagccaaaatgaagtgttttggcaacactgctgtagcaaaatgcaatttgaatcat

SEQ ID NO: 214464 - DNA, 75 bp, Artificial Sequence
  Synthetic
gagtatacaaattgggaagttggcattagcccacagcaagtttgcaggaacttcatggtgcaagttgtcttgtct

SEQ ID NO: 214465 - DNA, 75 bp, Artificial Sequence
  Synthetic
tgtagcaaaatgcaatttgaatcatgactctgaattctgtgacatgttgaggctttttgattacaacaaaaatgc

SEQ ID NO: 214466 - DNA, 75 bp, Artificial Sequence
  Synthetic
aaatgaagtgttttggcaacactgctgtagcaaaatgcaatttgaatcatgactctgaattctgtgacatgttga

SEQ ID NO: 214467 - DNA, 75 bp, Artificial Sequence
  Synthetic
tcgatgataaacccactggtcatgtcaacatcgtgtctcaaatccttcttttggttcaatgaagttctggatcta

SEQ ID NO: 214468 - DNA, 75 bp, Artificial Sequence
  Synthetic
gactctgaattctgtgacatgttgaggctttttgattacaacaaaaatgccataaaaaccttaaatgatgaaact

SEQ ID NO: 214469 - DNA, 75 bp, Artificial Sequence
  Synthetic
aagaaacaagtaaatctgatggggcagacaatcaatgccttgatatctgacaatttattgatgaaaaacaaaatt

SEQ ID NO: 214470 - DNA, 75 bp, Artificial Sequence
  Synthetic
gaagatgacagtcaagtagatctagctgaactcacggatttcaccttgtcaattaagaataacaaagtatcaaga

SEQ ID NO: 214471 - DNA, 75 bp, Artificial Sequence
  Synthetic
caatttattgatgaaaaacaaaattagggaactgatgagtgtcccctactgcaattacacaaaattttggtatgt

SEQ ID NO: 214472 - DNA, 75 bp, Artificial Sequence
  Synthetic
agggaactgatgagtgtcccctactgcaattacacaaaattttggtatgttaaccacacactttcaggacaacac

SEQ ID NO: 214473 - DNA, 75 bp, Artificial Sequence
  Synthetic
gcaatgtttgttgaagacattgcaatgggctatgtagtttctagctttgataatatcaaggttttcctagagagt

SEQ ID NO: 214474 - DNA, 75 bp, Artificial Sequence
  Synthetic
gtctctgttgacaacatctccttgttgcctcaggaagacatgatagacctgcacactgtgttgcgcaatgttgct

SEQ ID NO: 214475 - DNA, 75 bp, Artificial Sequence
  Synthetic
tgccaagaagctgtgaaactaaaattgatcattcaagtggaacacacacgagtttcgacaaaatttaaacttaga

SEQ ID NO: 214476 - DNA, 75 bp, Artificial Sequence
  Synthetic
agaaagatggtgtacagctacaccattgtcagttcactaagagtggatgatgtcagtacccctgaattagagttg

SEQ ID NO: 214477 - DNA, 75 bp, Artificial Sequence
  Synthetic
aatgtggatgcaatgagtcaatgtgtttctgggtctgagggaaaccactcattgttagatggtgcactagttatt

SEQ ID NO: 214478 - DNA, 75 bp, Artificial Sequence
  Synthetic
gggtggttgcagatgtggtaagtaccccaatctaaagaaaccaacagtttggcgtagaagacactgagaccccct

SEQ ID NO: 214479 - DNA, 75 bp, Artificial Sequence
  Synthetic
gctagcctaccattgttcacaggccatgagagctttgacctagctggcttgtttattgatgcaggctacgctgtg

SEQ ID NO: 214480 - DNA, 75 bp, Artificial Sequence
  Synthetic
gcccgggctggtgtggccccccagtccgcggcctggccgcggactggggaggcactgcttacagtgcataggctg

SEQ ID NO: 214481 - DNA, 75 bp, Artificial Sequence
  Synthetic
acaaatgatgacaatattctgagccatgttaagttaaactttggtgacttttattctgaactaggtaacaagtat

SEQ ID NO: 214482 - DNA, 75 bp, Artificial Sequence
  Synthetic
gcatatgacctcattgggccaaataacccaggggaacctcttgttttgaaagagggtatcttttacagaggtaat

SEQ ID NO: 214483 - DNA, 75 bp, Artificial Sequence
  Synthetic
tcatagagcttcccatctaacactgactgaaacattatgcagtctagcagagcacagtgtggttcactggaggcc

SEQ ID NO: 214484 - DNA, 75 bp, Artificial Sequence
  Synthetic
gaaaggctgtcaacatataaagttgagttgtctggggatgttatagtcaaggcaattggagcactagaggacatt

SEQ ID NO: 214485 - DNA, 75 bp, Artificial Sequence
  Synthetic
tctttttcttattgacaaccactccattgtgatgtttgcataggtgaccatatttctcccagacctgttgatcga

SEQ ID NO: 214486 - DNA, 75 bp, Artificial Sequence
  Synthetic
gatagtgtggaaaccttattatgccaactatggccttatctaaaaacaacatcccagacaatattgtttcagcaa

SEQ ID NO: 214487 - DNA, 75 bp, Artificial Sequence
  Synthetic
actgcctggcttgttcagatgtaagcctgacatcaaccagtttaagatctcttcttccatggaggtcaaacagct

SEQ ID NO: 214488 - DNA, 75 bp, Artificial Sequence
  Synthetic
gaggactttgtcctcgtttatgatctacacaaagagcagttggtccgttcacttgataaatttggtgactggttg

SEQ ID NO: 214489 - DNA, 75 bp, Artificial Sequence
  Synthetic
cttcttccatggaggtcaaacagcttcctgatgtcatcggatccttgagtagtcacaaccatgtctggaggcagt

SEQ ID NO: 214490 - DNA, 75 bp, Artificial Sequence
  Synthetic
gaattctcaaatttcaaagtagcattcagtagatctttaaatgacctgctggtatcagatccccaagggcaattc

SEQ ID NO: 214491 - DNA, 75 bp, Artificial Sequence
  Synthetic
ctggcattgcatcttctatgtccttcattaagatgccgtgagagtgtctgctaccatttttaaatcctttctcat

SEQ ID NO: 214492 - DNA, 75 bp, Artificial Sequence
  Synthetic
agattaaaaggggtgacgtgcaggccactgaagcacaaagtcgagatcaaagacattgattaatagtacatcacc

SEQ ID NO: 214493 - DNA, 75 bp, Artificial Sequence
  Synthetic
ctaccatttttaaatcctttctcatcatgtggttttctgaagcagtgaatgtactgcttacctgcaggttggaac

SEQ ID NO: 214494 - DNA, 75 bp, Artificial Sequence
  Synthetic
catgtggttttctgaagcagtgaatgtactgcttacctgcaggttggaacaatgccatctcaacagggtcagtgg

SEQ ID NO: 214495 - DNA, 75 bp, Artificial Sequence
  Synthetic
cccgggttcccccacggggggtccccatgggggccccccggggggtcaggtctgaccctgtgcagtctgcctatg

SEQ ID NO: 214496 - DNA, 75 bp, Artificial Sequence
  Synthetic
aatgccatctcaacagggtcagtggctggtccttcaatgtcgagccaaagggtattggtggggtcgagtttcccc

SEQ ID NO: 214497 - DNA, 75 bp, Artificial Sequence
  Synthetic
gtggtggtgctgttggctccaccggcactgtgattgtggtaggtaggggcttccaacagatattgcagaggtccg

SEQ ID NO: 214498 - DNA, 75 bp, Artificial Sequence
  Synthetic
actgcctctctgatgacagcttcttgtatctctgtcaagttagccaatctcaaattctgaccgtttttttccggt

SEQ ID NO: 214499 - DNA, 75 bp, Artificial Sequence
  Synthetic
aattccttaacataacctgatggcaccttaaacaaaggtagtgatcattgcaggttatcagattggtgtcagcaa

SEQ ID NO: 214500 - DNA, 75 bp, Artificial Sequence
  Synthetic
accagcagcacttgcagttgtatctaccatatagactgctgtgagccaccctcctgaattctgcggctggctgtg

SEQ ID NO: 214501 - DNA, 75 bp, Artificial Sequence
  Synthetic
tgacccttgaagagtctggctggtttgacttggatgccccgttgcagttgcccatttgtctgcctcttcacagta

SEQ ID NO: 214502 - DNA, 75 bp, Artificial Sequence
  Synthetic
ctcttcacagtaagtcacactcagaacagaatctgagattttagtgatgaagttacgcctaggatccccggtgcg

SEQ ID NO: 214503 - DNA, 75 bp, Artificial Sequence
  Synthetic
tgcagtaaggggatcctaggcgattttggtaacgctataagttgttactgctttctatttggacaacatcaaacc

SEQ ID NO: 214504 - DNA, 75 bp, Artificial Sequence
  Synthetic
tgctccagcctttactgcagctgagagactgaagttgtagccagaaatgttgatggagctttcatccttagtcac

SEQ ID NO: 214505 - DNA, 75 bp, Artificial Sequence
  Synthetic
ctttctatttggacaacatcaaaccatctattgtacaatggggcaattcatcagcttcatgcaagaaatacctac

SEQ ID NO: 214506 - DNA, 75 bp, Artificial Sequence
  Synthetic
tgatggagctttcatccttagtcacaatctgaaggcagtcatgttcctgagtcaatctgtcaaggtcacttaagt

SEQ ID NO: 214507 - DNA, 75 bp, Artificial Sequence
  Synthetic
tgcaggaacagagccaaactgattgtttagctttgaagggtctttaacatcccatatcctcaccacaccacttcc

SEQ ID NO: 214508 - DNA, 75 bp, Artificial Sequence
  Synthetic
tttagctttgaagggtctttaacatcccatatcctcaccacaccacttcctccagtcccttgctgttgaaatccc

SEQ ID NO: 214509 - DNA, 75 bp, Artificial Sequence
  Synthetic
cccatatcctcaccacaccacttcctccagtcccttgctgttgaaatcccagtgttctcaatatctctgatcttt

SEQ ID NO: 214510 - DNA, 75 bp, Artificial Sequence
  Synthetic
gcctctgttgtgtaccttaaacaagagccatctttacattaaggggggcaatgcttcattcaagatcagctttga

SEQ ID NO: 214511 - DNA, 75 bp, Artificial Sequence
  Synthetic
agtgttctcaatatctctgatcttttagcaagttgtgactgggacaaattacccatgtaaaccccctgagagcct

SEQ ID NO: 214512 - DNA, 75 bp, Artificial Sequence
  Synthetic
tgacatcgcagtgttgttaccagaatatgacgttataattcagcatccggcagatatgagctggtgttctaaaag

SEQ ID NO: 214513 - DNA, 75 bp, Artificial Sequence
  Synthetic
ctccatcagttcatccctccccagatctcccaccttgaaaactgtgtttcgttgaacactcctcatggacataag

SEQ ID NO: 214514 - DNA, 75 bp, Artificial Sequence
  Synthetic
tgatgatcaaatttggctgtctcagtggttcatgaatgctgtggggcatgattggtatctagacccaccatttct

SEQ ID NO: 214515 - DNA, 75 bp, Artificial Sequence
  Synthetic
tctgtcaacctctttattcaagtccctcaacttattgaggtcttcttctccccttttggtctttctgagtgcccg

SEQ ID NO: 214516 - DNA, 75 bp, Artificial Sequence
  Synthetic
ctcaacttattgaggtcttcttctccccttttggtctttctgagtgcccgttgcacctgtgccacttgattgaag

SEQ ID NO: 214517 - DNA, 75 bp, Artificial Sequence
  Synthetic
gtgtaggaaccgtacaaagacagaaggcttcatctttcaagtcaatacctccaagactggtatcaatgaaaacta

SEQ ID NO: 214518 - DNA, 75 bp, Artificial Sequence
  Synthetic
tgccaagaagtttaagactggtatgcaccatttatatagagaataccccgactcttgcttggatggcaaactgtg

SEQ ID NO: 214519 - DNA, 75 bp, Artificial Sequence
  Synthetic
agtctgagtgaattgactcaaacctctccttaaggactgagtccatctaaagcttggaacctccttggagtgtgc

SEQ ID NO: 214520 - DNA, 75 bp, Artificial Sequence
  Synthetic
tttgatgaaggcacaacccaccagttggcctctccaatgtccacttgaccatgtcaacacattacatttcctcac

SEQ ID NO: 214521 - DNA, 75 bp, Artificial Sequence
  Synthetic
catgccagaagttctgctgattttgatctggggtaaagttgctcagtgaaagtgttagacactatgcctaggatc

SEQ ID NO: 214522 - DNA, 75 bp, Artificial Sequence
  Synthetic
aagaggcaagaacattcagcttccaaggaggtctttaaaagcattcttttcctggtctctgacagactcatccgg

SEQ ID NO: 214523 - DNA, 75 bp, Artificial Sequence
  Synthetic
agttctgctgattttgatctggggtaaagttgctcagtgaaagtgttagacactatgcctaggatccactgtgcg

SEQ ID NO: 214524 - DNA, 75 bp, Artificial Sequence
  Synthetic
tcaacaaacattgctcttgatactttattattcctaattgacaaggtaaaatctgtgagttcagctagatctact

SEQ ID NO: 214525 - DNA, 75 bp, Artificial Sequence
  Synthetic
gacagacaatcaatgcgctgatatctgacaatttattgatgaaaaacaaaattagggaattgatgagtgtccctt

SEQ ID NO: 214526 - DNA, 75 bp, Artificial Sequence
  Synthetic
ggttacgctataattgtaactgttttctgtttggacaacatcaaaaacatccattgcacaatggggcaattcatc

SEQ ID NO: 214527 - DNA, 75 bp, Artificial Sequence
  Synthetic
agcttcatgcaagaaatacctacctttttgcaggaagctctgaatattgctcttgttgcagtcagtctcattgcc

SEQ ID NO: 214528 - DNA, 75 bp, Artificial Sequence
  Synthetic
gtaggaaccgtgcaaagacagaaggcttcatctttcaagtcaacacctccaagactggtgtcaatgaaaattatg

SEQ ID NO: 214529 - DNA, 75 bp, Artificial Sequence
  Synthetic
cataggcacatcagaggcgaggcatgccctctgccccacaggctaaatagcttgggtggttgcagatgtggtaag

SEQ ID NO: 214530 - DNA, 75 bp, Artificial Sequence
  Synthetic
ctaagaagtttaagactggcatgcatcatttatatagagaatatcctgactcttgcttgaatggcaaactgtgct

SEQ ID NO: 214531 - DNA, 75 bp, Artificial Sequence
  Synthetic
agtccgcggcctggccgcggactggggaggcactgcttacagtgcataggctgccttcgggaggaacagcaagct

SEQ ID NO: 214532 - DNA, 75 bp, Artificial Sequence
  Synthetic
ctgccttcgggaggaacagcaagctcggtggtaatagaggtgtaagttcttcttcatagagcttcccatccaaca

SEQ ID NO: 214533 - DNA, 75 bp, Artificial Sequence
  Synthetic
cgcacggaggatcctaggcgattttggttacgctataattgtaactgttttctgtttggacaacatcagaatatc

SEQ ID NO: 214534 - DNA, 75 bp, Artificial Sequence
  Synthetic
ctgactgaaacattatgcagtctagcagagcacagtgtggctcactggaggccaacttaaagggagcatccttat

SEQ ID NO: 214535 - DNA, 75 bp, Artificial Sequence
  Synthetic
ctctctttttcttgctgacaaccactccattgtgatgtttgcataggtggccaaatttctcccagacctgttggt

SEQ ID NO: 214536 - DNA, 75 bp, Artificial Sequence
  Synthetic
cgaactgcctggcttgttctgatgtaagcctaacatcaaccagcttaagatctcttcttccatggaggtcaaaca

SEQ ID NO: 214537 - DNA, 75 bp, Artificial Sequence
  Synthetic
caaaagtggtttattccaattctttgtattcctagcgcttgcaggaagatcctgtacagaagaagttttcaaaat

SEQ ID NO: 214538 - DNA, 75 bp, Artificial Sequence
  Synthetic
acttcctgatgtcatcggacccttgagtggtcacaaccatgtccggaggcagcaagccaatcacgtaactaagaa

SEQ ID NO: 214539 - DNA, 75 bp, Artificial Sequence
  Synthetic
tttccaacaatccacatgacctacctttgttgtgtaccttaaacaagagccatctttacattaaggggggcaatg

SEQ ID NO: 214540 - DNA, 75 bp, Artificial Sequence
  Synthetic
tattgcagtgttgctgccacagtatgatgttataattcaacatccggcagatatgagctggtgttctaaaagtga

SEQ ID NO: 214541 - DNA, 75 bp, Artificial Sequence
  Synthetic
aatatacttgctacctgcaggctggaacaacgccatctcaacagggtcagtagctggtccttcaatgtcgagcca

SEQ ID NO: 214542 - DNA, 75 bp, Artificial Sequence
  Synthetic
taggaaccgtacaaagacagaaggcttcatctttcaagtcaacacctccaaggccggtgttaatgaaaactatgc

SEQ ID NO: 214543 - DNA, 75 bp, Artificial Sequence
  Synthetic
gaagaagtttaagactggcatgcatcatttatatagagaataccctgactcttgcttgaatggcagactgtgttt

SEQ ID NO: 214544 - DNA, 75 bp, Artificial Sequence
  Synthetic
aatgaaggcacaacccaccagttggcctctccaatgtccactcgaccatgttaacacattacatttccttacaag

SEQ ID NO: 214545 - DNA, 75 bp, Artificial Sequence
  Synthetic
ggtctttgacagactcatccggcaaggacacccctggaggctattgtctagaagagtggatgcttgtagcagcca

SEQ ID NO: 214546 - DNA, 75 bp, Artificial Sequence
  Synthetic
gactctgaattctgtgacatgttgaggctttttgattacaacaaaaatgccatcaaaaccctaaatgatgaaacc

SEQ ID NO: 214547 - DNA, 75 bp, Artificial Sequence
  Synthetic
aagcccaagagaggttaaagcctgtatgacactgttcattgtctcacctccttgaacagtcatgcatgcaattgt

SEQ ID NO: 214548 - DNA, 75 bp, Artificial Sequence
  Synthetic
agggaactgatgagtgtcccctactgcaattatacaaaattttggtatgtcaaccatacactttcaggacaacac

SEQ ID NO: 214549 - DNA, 75 bp, Artificial Sequence
  Synthetic
gagagtgacttcttaatttctgaaatgctaagcaaagagtattcggacaggcagggtaaaactcctttgacttta

SEQ ID NO: 214550 - DNA, 75 bp, Artificial Sequence
  Synthetic
tgctaagcaaagagtattcggacaggcagggtaaaactcctttgactttagttgacatctgtttttggagcacag

SEQ ID NO: 214551 - DNA, 75 bp, Artificial Sequence
  Synthetic
tcttggccagttgtgactgagacaagttacccatgtaaaccccttgagagcctgtctctgctcttctaaacttgg

SEQ ID NO: 214552 - DNA, 75 bp, Artificial Sequence
  Synthetic
tcatttagtgggcatacctacccatagacacatcaggggcgaagcatgccctttgccacacaggttgaatagctt

SEQ ID NO: 214553 - DNA, 75 bp, Artificial Sequence
  Synthetic
tttttaaattcccaaggccagacgccaactccatccgctcaaccctccccagatctcccgccttgaaaaccgtgt

SEQ ID NO: 214554 - DNA, 75 bp, Artificial Sequence
  Synthetic
ttcgttgaacactcctcatggacatgagtctgtcaacctctttattcaggtccctcaacttattgaggtcttctt

SEQ ID NO: 214555 - DNA, 75 bp, Artificial Sequence
  Synthetic
cccaatctaaagaaaccaacagtttggcgtagaagacactaagacctcctgaaggtccccaccagcccgggcact

SEQ ID NO: 214556 - DNA, 75 bp, Artificial Sequence
  Synthetic
ggcactgcttacagtgcataggctgccttcgggaggaacagcaagctcgatggtaatagaggtgtaagttcctcc

SEQ ID NO: 214557 - DNA, 75 bp, Artificial Sequence
  Synthetic
tcatagagcttcccatccaacactgactgaaacattatgcagtctagcagagcacagtgtggttcactggaggcc

SEQ ID NO: 214558 - DNA, 75 bp, Artificial Sequence
  Synthetic
taaagcttggaacctctttggagtgtgccatgccagaagatctggtggttttgatctgagaaaaaattgctcagt

SEQ ID NO: 214559 - DNA, 75 bp, Artificial Sequence
  Synthetic
agcacagtgtggttcactggaggccaacttgaagggagtgtccttatccctctttttcttattgacaaccactcc

SEQ ID NO: 214560 - DNA, 75 bp, Artificial Sequence
  Synthetic
agatctggtggttttgatctgagaaaaaattgctcagtgaaagtgttagacactatgcctaggatccactgtgcg

SEQ ID NO: 214561 - DNA, 75 bp, Artificial Sequence
  Synthetic
cgcacagtggatcctaggcgattttggtcacgctataattgtgactattttctgtttggacaacctgaaaacatc

SEQ ID NO: 214562 - DNA, 75 bp, Artificial Sequence
  Synthetic
ggtcacgctataattgtgactattttctgtttggacaacctgaaaacatctattgcacaatggggcagttcatta

SEQ ID NO: 214563 - DNA, 75 bp, Artificial Sequence
  Synthetic
tatttctcccagacctgttgatcaaactgcctggcttgttcagatgtaagcctaacatcaaccagtttaagatct

SEQ ID NO: 214564 - DNA, 75 bp, Artificial Sequence
  Synthetic
actgcctggcttgttcagatgtaagcctaacatcaaccagtttaagatctcttcttccatgaaggtcaaacagct

SEQ ID NO: 214565 - DNA, 75 bp, Artificial Sequence
  Synthetic
aacttgaagggagtgtccttatccctctttttcttattgacaaccactccattgtgatgtttgcacaggtgacca

SEQ ID NO: 214566 - DNA, 75 bp, Artificial Sequence
  Synthetic
caaaagtggtttattccagttctttgtattcttagcgcttgcaggaagatcctgcacagaagaagcctttaaaat

SEQ ID NO: 214567 - DNA, 75 bp, Artificial Sequence
  Synthetic
gtattcttagcgcttgcaggaagatcctgcacagaagaagcctttaaaatcggactgcacactgagttccagact

SEQ ID NO: 214568 - DNA, 75 bp, Artificial Sequence
  Synthetic
aagccgatcacgtaactaagaactcctggcattgcatcttctatgtccttcattaagatgccgtgagagtgtctg

SEQ ID NO: 214569 - DNA, 75 bp, Artificial Sequence
  Synthetic
catgtggttttctgaagcaatggatatactgcttacctgcaggctggaacaatgccatctcaacagggtcagtgg

SEQ ID NO: 214570 - DNA, 75 bp, Artificial Sequence
  Synthetic
ctagaaccaatataaggccaaccatcgccagaaagacaaagtttatacaaaaggttttcataaggatttctattg

SEQ ID NO: 214571 - DNA, 75 bp, Artificial Sequence
  Synthetic
tgattttatgagggaagagaagttttctggggtgactctgattgtttccaacatgtttccaccatcaagaatgga

SEQ ID NO: 214572 - DNA, 75 bp, Artificial Sequence
  Synthetic
acatgtttccaccatcaagaatggatgctccagccttcactgcagctgagagactaaagttgtagccagaaatgt

SEQ ID NO: 214573 - DNA, 75 bp, Artificial Sequence
  Synthetic
tgatttccgtaatgactggatattggagagtgacttcttgatttctgaaatgctaagcaaagagtattcggacag

SEQ ID NO: 214574 - DNA, 75 bp, Artificial Sequence
  Synthetic
tagcaagttgtgactgggacaaattacccatgtaaaccccctgagagccagtctctgctcttcttatcttgtttt

SEQ ID NO: 214575 - DNA, 75 bp, Artificial Sequence
  Synthetic
cctaatctaaagaaaccaacagtttggcgtagaagacactaagacctcctgagggtccccgccagcccgggcacc

SEQ ID NO: 214576 - DNA, 75 bp, Artificial Sequence
  Synthetic
gttgaacactcctcatggacataagtctgtcaacctctttatttaagtccctcaacttgttgaggtcttcttccc

SEQ ID NO: 214577 - DNA, 75 bp, Artificial Sequence
  Synthetic
ggcactgcttacagtgcataggctgccttcgggaggaacagcaagctcgatggtaataggggtgtgagttcctcc

SEQ ID NO: 214578 - DNA, 75 bp, Artificial Sequence
  Synthetic
ctcttttggtctttctgagtgcccgctgcacctgtgccacttggttgaagtcaatgctgtcagcaattagcttgg

SEQ ID NO: 214579 - DNA, 75 bp, Artificial Sequence
  Synthetic
agttctggtgattttgatctagggtaaagttgctcagtgaaagtgttagacactatgcctaggatcctccgtgcg

SEQ ID NO: 214580 - DNA, 75 bp, Artificial Sequence
  Synthetic
actgcctggcttgttcagatgtaagcctaacatcaaccagtttaagatctcttcttccatggaggtcaaacagct

SEQ ID NO: 214581 - DNA, 75 bp, Artificial Sequence
  Synthetic
tcctgatgtcatcggatccttgagtagtcacaaccatgtctggaggcagtaagccgatcacgtaactaagaactc

SEQ ID NO: 214582 - DNA, 75 bp, Artificial Sequence
  Synthetic
gtctgtcaacctctttattcaggtccctcaacttattgaggtcttcttccccctttttagtctttctgagtgccc

SEQ ID NO: 214583 - DNA, 75 bp, Artificial Sequence
  Synthetic
gcgcacagtggatcctaggcgatttaagtcacgctgcaaattgtcactgctttctgtttgaacaacatcagaaca

SEQ ID NO: 214584 - DNA, 75 bp, Artificial Sequence
  Synthetic
tccattgtacaatggggcaatttatcagcttcatgcaagaaataccaactttcttgcaagaagctctgaacattg

SEQ ID NO: 214585 - DNA, 75 bp, Artificial Sequence
  Synthetic
tttagctttgaagggtctttaacatcccatatcctcaccacaccatttcctccagtcccttgctgttgaaatccc

SEQ ID NO: 214586 - DNA, 75 bp, Artificial Sequence
  Synthetic
ctcttgttgcagtcagtctcattgccatcattaagggtatagtaaacctgtacaaaagtggtttattccaattct

SEQ ID NO: 214587 - DNA, 75 bp, Artificial Sequence
  Synthetic
ttgtgttcctagcacttgcgggaagatcttgcacagaagaagctttcaaaatcggactgcacactgagtttcaga

SEQ ID NO: 214588 - DNA, 75 bp, Artificial Sequence
  Synthetic
ctgtgtccttctcaatggtgggcctcctttccaacagtccacatgacctgcctttgttgtgcaccttaaacaaga

SEQ ID NO: 214589 - DNA, 75 bp, Artificial Sequence
  Synthetic
gccatctttacatcaagggaggtaatgctacatttatgatcacctttgatgacattgcagtattgttgccacaat

SEQ ID NO: 214590 - DNA, 75 bp, Artificial Sequence
  Synthetic
tctgtcaacctctttattcaggtccctcaacttattgaggtcttcttctccccttttggcctttctgagtgcccg

SEQ ID NO: 214591 - DNA, 75 bp, Artificial Sequence
  Synthetic
tgctacatttatgatcacctttgatgacattgcagtattgttgccacaatatgatgttgtaatccaacacccggc

SEQ ID NO: 214592 - DNA, 75 bp, Artificial Sequence
  Synthetic
agatatgagctggtgttccaaaagtgatgatcaaatttggttgtctcaatggttcatgaatgctgtgggacatga

SEQ ID NO: 214593 - DNA, 75 bp, Artificial Sequence
  Synthetic
ctgcacctgtgccacttggttgaagtcaatgctgtcagcaatcagcttggcgtccttcagaacatctgacttgac

SEQ ID NO: 214594 - DNA, 75 bp, Artificial Sequence
  Synthetic
ggttcatgaatgctgtgggacatgattggtatttagacccaccatttctgtgtagaaaccgtacaaagacagaag

SEQ ID NO: 214595 - DNA, 75 bp, Artificial Sequence
  Synthetic
gcttcatctttcaagtcaacacctccaagactggtgttaatgaaaactatgccaagaagtttaagactggcatgc

SEQ ID NO: 214596 - DNA, 75 bp, Artificial Sequence
  Synthetic
cgcacggaggatcctaggcgattttggttacgctataattgtgactgtttactgtttggacaacatcaaaacatc

SEQ ID NO: 214597 - DNA, 75 bp, Artificial Sequence
  Synthetic
agttctggtgattttgatctggggtagagttgctcagtgaaagtgttagacactatgcctaggatccactgtgcg

SEQ ID NO: 214598 - DNA, 75 bp, Artificial Sequence
  Synthetic
accatttatatagagaataccctgactcctgcttgagtggcaaactgtgtttgatgaaggcacaacccaccagtt

SEQ ID NO: 214599 - DNA, 75 bp, Artificial Sequence
  Synthetic
ggcctctccagtgtccacttgaccacgttaacacattgcatttcctcacaagaggtaagaacattcaacttccaa

SEQ ID NO: 214600 - DNA, 75 bp, Artificial Sequence
  Synthetic
ggaggtctttgaaagcattcttttcctggtcactgaccgactcatccggaaaggacacccctgggggctattgtc

SEQ ID NO: 214601 - DNA, 75 bp, Artificial Sequence
  Synthetic
ctggtcactgaccgactcatccggaaaggacacccctgggggctattgtctggaagagtggatgctcgtagcagc

SEQ ID NO: 214602 - DNA, 75 bp, Artificial Sequence
  Synthetic
ttcatctttcaagtcaacacctccaagactggtgttaatgaaaactatgctaagaagtttaagactggcatgcat

SEQ ID NO: 214603 - DNA, 75 bp, Artificial Sequence
  Synthetic
catttatatagagaatatcctgactcttgcttgaatggcaaactgtgtttaatgaaggcacaacccaccagttgg

SEQ ID NO: 214604 - DNA, 75 bp, Artificial Sequence
  Synthetic
ggtctttgacagactcatccggcaaggatacccctggaggctattgtctggaagaatggatgctcgtagcagcca

SEQ ID NO: 214605 - DNA, 75 bp, Artificial Sequence
  Synthetic
gagactttttgattacaacaaaaatgctataaaaaccttaaatgatgaaactaagaaacaagtaaatctgatggg

SEQ ID NO: 214606 - DNA, 75 bp, Artificial Sequence
  Synthetic
acagacaatcaatgcgctgatctctgataatttattgatgaaaaataaaattagggaattgatgagtgttcctta

SEQ ID NO: 214607 - DNA, 75 bp, Artificial Sequence
  Synthetic
ctgcaattatacaaagttttggtatgtcaaccatacactttcaggacaacactcattaccaaggtgctggttaat

SEQ ID NO: 214608 - DNA, 75 bp, Artificial Sequence
  Synthetic
tcatttggtgggcatacctacccacagacacatcaggggcgaagcatgccctttgccacacaggttgaacagctt

SEQ ID NO: 214609 - DNA, 75 bp, Artificial Sequence
  Synthetic
actcattaccaaggtgctggttaataaagaacaacagttacttgaacatctctgacttccgtaatgactggatac

SEQ ID NO: 214610 - DNA, 75 bp, Artificial Sequence
  Synthetic
gggtggttgcagatgtggtaagtaccccaatctaaagaaaccaacagtttggcgtagaagacactaagacctcct

SEQ ID NO: 214611 - DNA, 75 bp, Artificial Sequence
  Synthetic
cccaatctaaagaaaccaacagtttggcgtagaagacactaagacctcctgagggtccccaccagcccgggcact

SEQ ID NO: 214612 - DNA, 75 bp, Artificial Sequence
  Synthetic
tagttgacatctgtttttggagcacagtattcttcacagcgtctctcttccttcacttggtgggcatacccaccc

SEQ ID NO: 214613 - DNA, 75 bp, Artificial Sequence
  Synthetic
atagacacattaggggcgaggcatgtcccttgccccacaggttaaacagcctgggtggttgcagatgtggcaagt

SEQ ID NO: 214614 - DNA, 75 bp, Artificial Sequence
  Synthetic
accccaatctaaagaaaccaacagtttggtgtagaagacactgagacctcctgaaggtccccaccagcccgggca

SEQ ID NO: 214615 - DNA, 75 bp, Artificial Sequence
  Synthetic
ttggtgtagaagacactgagacctcctgaaggtccccaccagcccgggcactgcccgggttggtgtggcccccca

SEQ ID NO: 214616 - DNA, 75 bp, Artificial Sequence
  Synthetic
gtccgcggcttggccgcggactggggaggcactgcttacagtgcataggctgccttcgggaggaacagcaagctt

SEQ ID NO: 214617 - DNA, 75 bp, Artificial Sequence
  Synthetic
tgtctaggaccagcaactggtttccttgtcagatcaatacttgtgttgtcccatgacctgcctgtgatttgggat

SEQ ID NO: 214618 - DNA, 75 bp, Artificial Sequence
  Synthetic
ggtggtagtagaggtgtaggttcctcctcatagagcttcccatccaacactgactgaaacattatgcagtctaac

SEQ ID NO: 214619 - DNA, 75 bp, Artificial Sequence
  Synthetic
agagcacagtgaggctcactggaggctaacttgaagggagtgtccttatccctctttttcttactgacaaccact

SEQ ID NO: 214620 - DNA, 75 bp, Artificial Sequence
  Synthetic
ccattatgatgtttgcataggtggccaaatttctcccagacctgttgatcaaactgcctggcttgttctgatgta

SEQ ID NO: 214621 - DNA, 75 bp, Artificial Sequence
  Synthetic
agcctaacatcaaccagtttaagatcccttcttccatgaagatcaaacaacttcctgatatcatcagatccttga

SEQ ID NO: 214622 - DNA, 75 bp, Artificial Sequence
  Synthetic
gtggtcacaaccatgtctggaggcagcaaaccaatcacgtaactaagaactcctggcattgcatcttctatgtct

SEQ ID NO: 214623 - DNA, 75 bp, Artificial Sequence
  Synthetic
ttcattaggatgccgtgagaatgcctgctaccattcttaaaccctttctcatcatgtggttttctaaagcagtga

SEQ ID NO: 214624 - DNA, 75 bp, Artificial Sequence
  Synthetic
atatattgcttacctgcaggttggaacaatgccatttcaacaggatcagtggctggtccttcaatgtcgagccaa

SEQ ID NO: 214625 - DNA, 75 bp, Artificial Sequence
  Synthetic
tcaatgctgtcagcaattagcttggcgtccttcaaaacatctgacttgacagtctgagtgaattgactcaaacct

SEQ ID NO: 214626 - DNA, 75 bp, Artificial Sequence
  Synthetic
agggtattagtggggtcaagtttccccactgcttctctgatgacagcttcttgtatctctgtcaagtttgccaat

SEQ ID NO: 214627 - DNA, 75 bp, Artificial Sequence
  Synthetic
agttctggtgattttgatctggggtagagttgctcagtgaaagtgttagacactatgcctaggatcctcagtgcg

SEQ ID NO: 214628 - DNA, 75 bp, Artificial Sequence
  Synthetic
agttctggtgattttgatctggggtagagttgctcagtgaaagtgttagacactatgcctaggatcctctgtgcg

SEQ ID NO: 214629 - DNA, 75 bp, Artificial Sequence
  Synthetic
agttctggtgattttgatctggggtagagttgctcagtgaaagtgttagacactatgcctaggatcctccgtgcg

SEQ ID NO: 214630 - DNA, 75 bp, Artificial Sequence
  Synthetic
agttctggtgattttgatctggggtagagttgctcagtgaaagtgttagacactatgcctaggatcctcggtgcg

SEQ ID NO: 214631 - DNA, 75 bp, Artificial Sequence
  Synthetic
ctcaaattctgaccgttcttttccggttgtctaggaccagcaactggtttccttgtcaggtcaatacttgtgtta

SEQ ID NO: 214632 - DNA, 75 bp, Artificial Sequence
  Synthetic
gcgcacagtggatcctaggcgtaacttcatcattaaatctcagattctgctctgagtgtgacttactgcgaagag

SEQ ID NO: 214633 - DNA, 75 bp, Artificial Sequence
  Synthetic
cgcacagaggatcctaggcgattttggtcacgctataattgtgactgttttccgtttggacgacatcaacacgcc

SEQ ID NO: 214634 - DNA, 75 bp, Artificial Sequence
  Synthetic
gttgtctaggaccagcaactggtttccttgtcaggtcaatacttgtgttatcccatgacctgcctatgatttgtg

SEQ ID NO: 214635 - DNA, 75 bp, Artificial Sequence
  Synthetic
atctagaaccaatataaggccaaccatcgccagaaagacaaagtttgtacagaaggttttcataagggtttctat

SEQ ID NO: 214636 - DNA, 75 bp, Artificial Sequence
  Synthetic
tgcctggtttctcatcaacaaacatgccttctcttcgtttaacctgaatagttgatcttatgagggaagagaagt

SEQ ID NO: 214637 - DNA, 75 bp, Artificial Sequence
  Synthetic
cttgttgcagtcagtctcattgccatcattaagggtgttgtgaacttatacaaaagtggtttattccaattcttt

SEQ ID NO: 214638 - DNA, 75 bp, Artificial Sequence
  Synthetic
tatctggggtgactctgattgtttccaacatgttcccaccatcaagaatggatgcaccagcctttactgcagctg

SEQ ID NO: 214639 - DNA, 75 bp, Artificial Sequence
  Synthetic
aaagactgaagttatagccagagatgttgatagagctttcatccttagtcacgatttgaaggcagtcatgttcct

SEQ ID NO: 214640 - DNA, 75 bp, Artificial Sequence
  Synthetic
acgatttgaaggcagtcatgttcctgggtcaatctgtcaagatcacttaagtttggatattttacagtgtataga

SEQ ID NO: 214641 - DNA, 75 bp, Artificial Sequence
  Synthetic
agcccaagagaggttaaagcctgtatgacattgttcattgtctcacctccttgaacagtcatgcatgcaattgta

SEQ ID NO: 214642 - DNA, 75 bp, Artificial Sequence
  Synthetic
taggaaccgtacaaagacagaaggtttcatcttccaagttaatacctccaagactggtgttaatgagaactatgc

SEQ ID NO: 214643 - DNA, 75 bp, Artificial Sequence
  Synthetic
agtgcaggaacagaaccaaactgattgttaagcttcgaagggtctttaacatcccatatcctcaccacaccattt

SEQ ID NO: 214644 - DNA, 75 bp, Artificial Sequence
  Synthetic
cccccagtcccctgctgttgaaatcctagtgttttcagtatctctgatcttttggccagttgtgactgggacagg

SEQ ID NO: 214645 - DNA, 75 bp, Artificial Sequence
  Synthetic
ggtctttgacagactcatccggcaaggacacccctggaggctattgtctagaagagtggatgctcgttgcagcca

SEQ ID NO: 214646 - DNA, 75 bp, Artificial Sequence
  Synthetic
ttgcccatataaaccccttgagagcctgcctctgctcttcttatcttgttttttaacttctcaaggtcagacgcc

SEQ ID NO: 214647 - DNA, 75 bp, Artificial Sequence
  Synthetic
ttttaacttctcaaggtcagacgccaactccatcaactcatccctccccagatcccccgccttgaaaactgtgtt

SEQ ID NO: 214648 - DNA, 75 bp, Artificial Sequence
  Synthetic
aagaaacaagtaaatctgatggggcagacaatcaatgccctgatatctgacaatttactgatgaaaaacaaaatt

SEQ ID NO: 214649 - DNA, 75 bp, Artificial Sequence
  Synthetic
agtctgtcaacctctttattcaggtccctcaacttattgaggtcttcttccccccttttggtctttctgagtgcc

SEQ ID NO: 214650 - DNA, 75 bp, Artificial Sequence
  Synthetic
cgctgcacctgtgccacttggttgaagtcaatgctatcagcaattagcttagcatccttcaaaacatctgacttg

SEQ ID NO: 214651 - DNA, 75 bp, Artificial Sequence
  Synthetic
acagtctgagtgaattgactcaaacctctccttagggactgagtccatctgaagcttggaacctctttggagtgt

SEQ ID NO: 214652 - DNA, 75 bp, Artificial Sequence
  Synthetic
gggtggttgcagatgtggtaagtaccccaatctaaagaaaccaacagtctggcgcaaaggacactaagacctccc

SEQ ID NO: 214653 - DNA, 75 bp, Artificial Sequence
  Synthetic
gccatgctggaagctccggtgattttgatccgggatagagttgctcagtgaaagtgttagacactatgcctagga

SEQ ID NO: 214654 - DNA, 75 bp, Artificial Sequence
  Synthetic
agctccggtgattttgatccgggatagagttgctcagtgaaagtgttagacactatgcctaggatccactgtgcg

SEQ ID NO: 214655 - DNA, 75 bp, Artificial Sequence
  Synthetic
gagggtccccaccagcccgggcattgcccgggctggtgtggccccccagtccgcggcctggccgcggactgggga

SEQ ID NO: 214656 - DNA, 75 bp, Artificial Sequence
  Synthetic
actgaaacattatgcagtccagcagagcacaatgtggttcgctggaggccaacttgaagggagtatccttatccc

SEQ ID NO: 214657 - DNA, 75 bp, Artificial Sequence
  Synthetic
cgcacagaggattctaggcgattttggttacgcaataattgtgactgttttctgtttggacgacatcaacacatc

SEQ ID NO: 214658 - DNA, 75 bp, Artificial Sequence
  Synthetic
tattgcacaatggggcagttcattagcttcatgcaagaaataccaacctttttgcaggaggctctgaacattgct

SEQ ID NO: 214659 - DNA, 75 bp, Artificial Sequence
  Synthetic
cttcttccatggaggtcaaacagcttcctgatgtcatcggacccttgagttgtcacaaccatatctggaggcagt

SEQ ID NO: 214660 - DNA, 75 bp, Artificial Sequence
  Synthetic
catctttacattaaggggggcaatgcttcatttatgatcagctttgatgatattgcagtattgttgccacagtat

SEQ ID NO: 214661 - DNA, 75 bp, Artificial Sequence
  Synthetic
cttcatttatgatcagctttgatgatattgcagtattgttgccacagtatgatgttataatacaacatccggcag

SEQ ID NO: 214662 - DNA, 75 bp, Artificial Sequence
  Synthetic
gatgttataatacaacatccggcagatatgaactggtgttccaaaagtgatgatcaaatttggttgtctcaatgg

SEQ ID NO: 214663 - DNA, 75 bp, Artificial Sequence
  Synthetic
cctctccaatgtccactcgaccatgttaacacattacatttccttacaagaggcaaaaacattcagcttccaagg

SEQ ID NO: 214664 - DNA, 75 bp, Artificial Sequence
  Synthetic
gactctgaattctgtgacatgttgaggctttttgattacaacaaaaatgccatcaaaaccctaaatgatgaaact

SEQ ID NO: 214665 - DNA, 75 bp, Artificial Sequence
  Synthetic
cgcaccggggatcctaggcgtaacttcatcactaaaatctcagattctgttctgagtgtgacttactgtgaagag

SEQ ID NO: 214666 - DNA, 75 bp, Artificial Sequence
  Synthetic
atgctttctaataaggttttttatttcattcactgattcctccatgctcaagtgccgcctaggatcctcggtgcg

SEQ ID NO: 214667 - DNA, 75 bp, Artificial Sequence
  Synthetic
gttgacatctgtttttggagcacagtattcttcacagcatcactcttccttcacttagtgggcatacccacccac

SEQ ID NO: 214668 - DNA, 75 bp, Artificial Sequence
  Synthetic
gcgcacagtggatcctaggcgattttggttacgctataattgtaactgttttctgtttggacaacatcaaaaaca

SEQ ID NO: 214669 - DNA, 75 bp, Artificial Sequence
  Synthetic
ccttcgggaggaacagtaagctcggtggtaatagaggcgtaagttcctcctcatagagcttcccatctaacactg

SEQ ID NO: 214670 - DNA, 75 bp, Artificial Sequence
  Synthetic
tctttttcttattgacaaccactccattgtgatatttgcataggtgaccatatttctcccagacctgttgatcaa

SEQ ID NO: 214671 - DNA, 75 bp, Artificial Sequence
  Synthetic
tgcttcatttcagatcagctttgatgatattgcagtattgttgccacagtatgatgttataatacaacatccagc

SEQ ID NO: 214672 - DNA, 75 bp, Artificial Sequence
  Synthetic
gtatctctgtcaagttagccaatctcaaattctgaccgtttttttccggttgtctaggaccagcaactggtttcc

SEQ ID NO: 214673 - DNA, 75 bp, Artificial Sequence
  Synthetic
aaggttttcataaggatttctattgcctggtttttcatcaataaacatgccttctcttcgtttaacctgaatggt

SEQ ID NO: 214674 - DNA, 75 bp, Artificial Sequence
  Synthetic
agactgaagttgtagccagaaatgttgatggagctttcatccttggtcacaatctgaaggcagtcatgttcctga

SEQ ID NO: 214675 - DNA, 75 bp, Artificial Sequence
  Synthetic
gaggctttttgattacaacaaaaatgctatcaaaaccctaaatgatgaaactaagaaacaagtaaatctgatggg

SEQ ID NO: 214676 - DNA, 75 bp, Artificial Sequence
  Synthetic
tttagctttgaagggtctttaacatcccatatcctcactacaccatttcctccagtcccttgctgttgaaacccc

SEQ ID NO: 214677 - DNA, 75 bp, Artificial Sequence
  Synthetic
tccagtcccttgctgttgaaaccccagtgttctcaatatctctgatcttttagcaagttgtgactgggacaaatt

SEQ ID NO: 214678 - DNA, 75 bp, Artificial Sequence
  Synthetic
gttgaacactcctcatagacataagtctgtcaacctctttattcaggtctctcaacttattgaggtcttcttccc

SEQ ID NO: 214679 - DNA, 75 bp, Artificial Sequence
  Synthetic
ctgcacctgtgccacttggttgaagtcaatgctgtcagcaattagcttggcgtccttcaagacatctgacttgac

SEQ ID NO: 214680 - DNA, 75 bp, Artificial Sequence
  Synthetic
agtctgagtgaattgactcaaacctctcctcaaggactgagtccatctaaagcttggaacctccttggagtgtgc

SEQ ID NO: 214681 - DNA, 75 bp, Artificial Sequence
  Synthetic
catgccagaagttctggtgattttgatttggggtagagttgctcagtgaaagtgttagacactatgcctaggatc

SEQ ID NO: 214682 - DNA, 75 bp, Artificial Sequence
  Synthetic
agttctggtgattttgatttggggtagagttgctcagtgaaagtgttagacactatgcctaggatcctccgtgcg

SEQ ID NO: 214683 - DNA, 75 bp, Artificial Sequence
  Synthetic
gcttcatgcaagaaataccaacctttttgcaagaggctctgaacattgctcttgttgcagtcagtctcattgcca

SEQ ID NO: 214684 - DNA, 75 bp, Artificial Sequence
  Synthetic
tttgcaagaggctctgaacattgctcttgttgcagtcagtctcattgccataattaagggtctggtgaacttgta

SEQ ID NO: 214685 - DNA, 75 bp, Artificial Sequence
  Synthetic
tattacagtgttgctgccacagtatgatgttataatacaacatccagcagatatgagctggtgttctgaaagtga

SEQ ID NO: 214686 - DNA, 75 bp, Artificial Sequence
  Synthetic
tgatcaaatttggctgtctcaatggttcatgaatgctgtgggacatgattggcatctagacccaccatttctgtg

SEQ ID NO: 214687 - DNA, 75 bp, Artificial Sequence
  Synthetic
ttcatctttcaagtcaacacctccaaggccggtgttaatgaaaactatgctaagaagtttaagactggtatgcat

SEQ ID NO: 214688 - DNA, 75 bp, Artificial Sequence
  Synthetic
aggcaaaaacattcaacttccaaggaggtccttgaaagcatttttctcctggtcattgacagactcatctggcaa

SEQ ID NO: 214689 - DNA, 75 bp, Artificial Sequence
  Synthetic
aagaaacaagtaaatctaatggggcagacaatcaatgccttgatatctgacaacttattgatgaaaaacaaaatc

SEQ ID NO: 214690 - DNA, 75 bp, Artificial Sequence
  Synthetic
tgctaagcaaagagtattcggacaggcagggcaaaactcctttgactttagttgacatctgtttttggagcacag

SEQ ID NO: 214691 - DNA, 75 bp, Artificial Sequence
  Synthetic
gcagggcaaaactcctttgactttagttgacatctgtttttggagcacagcattcttcacagcgtcactttttct

SEQ ID NO: 214692 - DNA, 75 bp, Artificial Sequence
  Synthetic
aacttgaagggagtgtccttatccctctttttcttattgacaaccactccattgtgatgcttgcataggtgacca

SEQ ID NO: 214693 - DNA, 75 bp, Artificial Sequence
  Synthetic
catgtggttttctgaagcagtggatatactgcttacctgcaggttggaacaatgccatctcaacagggtcagtgg

SEQ ID NO: 214694 - DNA, 75 bp, Artificial Sequence
  Synthetic
cgcaccggggatcctaggcgattttggtcacgctataattgtgactattttctgtttggacaacctgaaaacatc

SEQ ID NO: 214695 - DNA, 75 bp, Artificial Sequence
  Synthetic
cgcacggaggatcctaggcgattttggtcacgctacaggtgtgactgttttctgtttggacaacatcaaaacatc

SEQ ID NO: 214696 - DNA, 75 bp, Artificial Sequence
  Synthetic
tttgcaggaggctctgaacattgctcttgttgcagtcagtctcattgccatcattaagggtatagtgaacttgta

SEQ ID NO: 214697 - DNA, 75 bp, Artificial Sequence
  Synthetic
tgctccagccttcactgcagctgagaggctgaagttgtagccagaaatgttgatggagctttcatccttagtcac

SEQ ID NO: 214698 - DNA, 75 bp, Artificial Sequence
  Synthetic
gtgtccttctcaatggtgggtctcttttccaacaatccacatgacctacctttattgtgcaccttaaacaaaagc

SEQ ID NO: 214699 - DNA, 75 bp, Artificial Sequence
  Synthetic
tattgcagtgttgttgccacagtatgatgttgtaatacaacatccggcagatatgagctggtgttccaaaagtga

SEQ ID NO: 214700 - DNA, 75 bp, Artificial Sequence
  Synthetic
acactgttcattgtctcacctccttgaacagtcatgcatgcaattgttaatgcaggaacagagccaaactgattg

SEQ ID NO: 214701 - DNA, 75 bp, Artificial Sequence
  Synthetic
ttcatgaatgctgtggggcatgattggcatctagacccaccatttctgtgcaggaaccgcacaaagacagaaggc

SEQ ID NO: 214702 - DNA, 75 bp, Artificial Sequence
  Synthetic
cctctccaatgcccacttgaccatgttaacacattgcatttccttacaagaggcaaaaacattcaactaccaagg

SEQ ID NO: 214703 - DNA, 75 bp, Artificial Sequence
  Synthetic
tctgtcaacctctttattcaagtccctcaacttgttaaggtcttcttcccctcttttggtctttctgagtgcccg

SEQ ID NO: 214704 - DNA, 75 bp, Artificial Sequence
  Synthetic
agttctggtgattttgatctagggtagagttgctcagtgaaagtgttagacacaatgcctaggatcctccgtgcg

SEQ ID NO: 214705 - DNA, 75 bp, Artificial Sequence
  Synthetic
agacacatcagaggcgaagcatgccctttgccacacaggttgaacagcttaggtggttgcaggtgtggtaagtac

SEQ ID NO: 214706 - DNA, 75 bp, Artificial Sequence
  Synthetic
tggtaatagaggtgtaagttcctcctcatagagtttcccgtccaacacagattgaaacattatgcagtctagcag

SEQ ID NO: 214707 - DNA, 75 bp, Artificial Sequence
  Synthetic
tttggttacgctataattgtaactgttttctgtttggacaacatcaaaaacatccattgcacaatggggcagttc

SEQ ID NO: 214708 - DNA, 75 bp, Artificial Sequence
  Synthetic
gtgcagtaaggggatcctaggcgattttggttacgctataattgtaactgttttctgtttggacaacatcaaaaa

SEQ ID NO: 214709 - DNA, 75 bp, Artificial Sequence
  Synthetic
aacttgaagggagtgtccttatccctctttttcttattgacaaccactccattgtgatacttgcatagatgaccg

SEQ ID NO: 214710 - DNA, 75 bp, Artificial Sequence
  Synthetic
tgtacaaaagtggtttattccaattctttgtattcctagcgcttgcaggaagatcctgcacagaagaagctttca

SEQ ID NO: 214711 - DNA, 75 bp, Artificial Sequence
  Synthetic
aaatcggactgcacactgagttccagactgtgtccttctcaatggtgggtctcttttccaacaatccacatgacc

SEQ ID NO: 214712 - DNA, 75 bp, Artificial Sequence
  Synthetic
gtatgatgttataatacaacatccagcagatatgagctggtgttccaaaagtgatgatcaaatttggttgtctca

SEQ ID NO: 214713 - DNA, 75 bp, Artificial Sequence
  Synthetic
gtctctcctcttcttatcttgttttttaatttctcaaggtcagacgccaactccatcagttcatccctccctaga

SEQ ID NO: 214714 - DNA, 75 bp, Artificial Sequence
  Synthetic
caagaggtaaaaacattcaacttccaaggaggtccttgaaagcattcttctcctggtctttgacagactcatccg

SEQ ID NO: 214715 - DNA, 75 bp, Artificial Sequence
  Synthetic
tcccccaccttgaagactgtgtttcgttgaacactcctcatggacataagtctgtcaacctctttattcaagtcc

SEQ ID NO: 214716 - DNA, 75 bp, Artificial Sequence
  Synthetic
gttgaacactcctcatggacataagtctgtcaacctctttattcaagtccctcaatttattgaggtcttcttccc

SEQ ID NO: 214717 - DNA, 75 bp, Artificial Sequence
  Synthetic
tctagaagagtggatgctcgtagcagccaaaatgaagtgttttggcaatactgctgtagcaaaatgcaatttgaa

SEQ ID NO: 214718 - DNA, 75 bp, Artificial Sequence
  Synthetic
gccaaaatgaagtgttttggcaatactgctgtagcaaaatgcaatttgaatcatgactctgaattctgtgacatg

SEQ ID NO: 214719 - DNA, 75 bp, Artificial Sequence
  Synthetic
catgctgaaagttctggtgattttgatctgggatagagttgctcagtgaaagtgttagacactatgcctaggatc

SEQ ID NO: 214720 - DNA, 75 bp, Artificial Sequence
  Synthetic
agttctggtgattttgatctgggatagagttgctcagtgaaagtgttagacactatgcctaggatcctctgtgcg

SEQ ID NO: 214721 - DNA, 75 bp, Artificial Sequence
  Synthetic
tactgcaattacacaaaattttggtatgtcaaccacacactttcaggacaacactcattaccaaggtgctggtta

SEQ ID NO: 214722 - DNA, 75 bp, Artificial Sequence
  Synthetic
acactcattaccaaggtgctggttaataaaaaacaacagctatttgaacatctctgacttccgtaatgactggat

SEQ ID NO: 214723 - DNA, 75 bp, Artificial Sequence
  Synthetic
attgcctggtttctcatcaataaacatgccttctcttcgtttaacctgaatggttgattttatgagggaagagaa

SEQ ID NO: 214724 - DNA, 75 bp, Artificial Sequence
  Synthetic
gcctgtctctgctcttcttatcttgttttttaatttctcaaggtcagacgccaactccatcagttcatccctccc

SEQ ID NO: 214725 - DNA, 75 bp, Artificial Sequence
  Synthetic
ttttttaatttctcaaggtcagacgccaactccatcagttcatccctccccagatctcccaccttgaaaactgtg

SEQ ID NO: 214726 - DNA, 75 bp, Artificial Sequence
  Synthetic
cagatctcccaccttgaaaactgtgtttcgttgaacactcctcatggacatgagtctgtcaacctctttattcag

SEQ ID NO: 214727 - DNA, 75 bp, Artificial Sequence
  Synthetic
cgcacagtggatcctaggcgtaacttcatcactaaaatctcagattctgttctgagtgtgacttactgtgaagag

SEQ ID NO: 214728 - DNA, 75 bp, Artificial Sequence
  Synthetic
tcatcactaaaatctcagattctgttctgagtgtgacttactgtgaagaggcagacaaatgggcaactgcaacgg

SEQ ID NO: 214729 - DNA, 75 bp, Artificial Sequence
  Synthetic
ggcatccaagtcaaaccagccagactcttcaagggtcacacagccagccgcagaattcaggagggtggctcacag

SEQ ID NO: 214730 - DNA, 75 bp, Artificial Sequence
  Synthetic
cagtctatatggtagatacaactgcaagtgctgctggtttgctgacaccaatctgataacctgcaatgatcacta

SEQ ID NO: 214731 - DNA, 75 bp, Artificial Sequence
  Synthetic
cctttgtttaaggtgccatcaggttatgttaaggaattcggacctctgcaatatctgttggaagcccctacctac

SEQ ID NO: 214732 - DNA, 75 bp, Artificial Sequence
  Synthetic
atgttaaggaattcggacctctgcaatatctgttggaagcccctacctaccacaatcacagtgccggtggagcca

SEQ ID NO: 214733 - DNA, 75 bp, Artificial Sequence
  Synthetic
gcacagggtcagacctgaccccccggggggcccccatggggaccccccgtgggggaacccgggggtgatgtacta

SEQ ID NO: 214734 - DNA, 75 bp, Artificial Sequence
  Synthetic
ttaatcaatgtctttgatctcgactttgtgcttcagtggcctgcacgtcaccccttttaatctgaattgcccttg

SEQ ID NO: 214735 - DNA, 75 bp, Artificial Sequence
  Synthetic
ccccttttaatctgaattgcccttggggatctgataccagcaggtcatttaaagatctactgaatgctactttga

SEQ ID NO: 214736 - DNA, 75 bp, Artificial Sequence
  Synthetic
aatttgagaattccaaccagtcaccaaatttatcaagtgaacggaccaactgctctttgtgtagatcataaacga

SEQ ID NO: 214737 - DNA, 75 bp, Artificial Sequence
  Synthetic
ggacaaagtcctcttgctgaaacaatattgtctgggatgttgtttttagataaggccatagttggcataataagg

SEQ ID NO: 214738 - DNA, 75 bp, Artificial Sequence
  Synthetic
tttccacactatcaatgtcctctagtgctccaattgccttgactataacatccccagacaactcaactttatatg

SEQ ID NO: 214739 - DNA, 75 bp, Artificial Sequence
  Synthetic
ttgacagcctttcattacctctgtaaaagataccctctttcaaaacaagaggttcccctgggttatttggcccaa

SEQ ID NO: 214740 - DNA, 75 bp, Artificial Sequence
  Synthetic
tgaggtcatatgcatacttgttacctagttcagaataaaagtcaccaaagtttaacttaacatggctcagaatat

SEQ ID NO: 214741 - DNA, 75 bp, Artificial Sequence
  Synthetic
tcaaagctctcatggcctgtgaacaatggtaggctagcaataactagtgcaccatctaacaatgagtggtttccc

SEQ ID NO: 214742 - DNA, 75 bp, Artificial Sequence
  Synthetic
tcagacccagaaacacattgactcattgcatccacattcaactctaattcaggggtactgacatcatccactctt

SEQ ID NO: 214743 - DNA, 75 bp, Artificial Sequence
  Synthetic
caacaaacattgctcttgatactttgttattcttaattgacaaggtgaaatccgtgagttcagctagatctactt

SEQ ID NO: 214744 - DNA, 75 bp, Artificial Sequence
  Synthetic
gactgtcatcttctagatccagaacttcattgaaccaaaagaaggatttgagacacgatgttgacatgaccagtg

SEQ ID NO: 214745 - DNA, 75 bp, Artificial Sequence
  Synthetic
ggtttatcatcgaagacaagacaacttgcaccatgaagttcctgcaaacttgctgtgggctaatgccaacttccc

SEQ ID NO: 214746 - DNA, 75 bp, Artificial Sequence
  Synthetic
aatttgtatactctgactgtctgacatgggctgaagcgcagtcactctgtttcacaatataaacattattatccc

SEQ ID NO: 214747 - DNA, 75 bp, Artificial Sequence
  Synthetic
tcacctttaataagtgacttatgatccctaagttctcattcatcatgtctagagctacacagacatccaaaaact

SEQ ID NO: 214748 - DNA, 75 bp, Artificial Sequence
  Synthetic
tgagtcttccactgtctaaagatctgttcacttgaagatcattcataaagggtgccaaatgttcttcaaatagtt

SEQ ID NO: 214749 - DNA, 75 bp, Artificial Sequence
  Synthetic
tggggtaatttcttcgtatagaatgcaatacatggttcatgcctaattggtcttctatttgtcgtactgctttgg

SEQ ID NO: 214750 - DNA, 75 bp, Artificial Sequence
  Synthetic
gtttaacagcccaaaagaaattcttattacataagaccagaggggcttgtggactcttaacagcagaaaacaccc

SEQ ID NO: 214751 - DNA, 75 bp, Artificial Sequence
  Synthetic
aaaattggtttagaaaattggttaacttcttgaagtgatttttgacagtagataactttaggctttttctcacaa

SEQ ID NO: 214752 - DNA, 75 bp, Artificial Sequence
  Synthetic
cttcttgaagtgatttttgacagtagataactttaggctttttctcacaaatttcacaaagacatggcattattc

SEQ ID NO: 214753 - DNA, 75 bp, Artificial Sequence
  Synthetic
agactgaaatgcagatttgttgatagactctgccaagatcttcttcacgccttttgtgaaatttcttgacagcct

SEQ ID NO: 214754 - DNA, 75 bp, Artificial Sequence
  Synthetic
ggcatctcttctttctctaacactcttcgacttgtcatgagtttggtcctcaagaccaacctcaagtccccgaag

SEQ ID NO: 214755 - DNA, 75 bp, Artificial Sequence
  Synthetic
cttgccaaattgacccatctgtagtctagagttcgtctgatttcatcttcactacacccggcatattgcaggaat

SEQ ID NO: 214756 - DNA, 75 bp, Artificial Sequence
  Synthetic
ccggacaaggcctcatcccctcccctgcttatcaagttgataaggttttcctcaaagattttgcctttcttaatg

SEQ ID NO: 214757 - DNA, 75 bp, Artificial Sequence
  Synthetic
tccttataaacattgtctccttatcatcagaaaaaatagcttcaattttcctctgtagacggtaccctctagacc

SEQ ID NO: 214758 - DNA, 75 bp, Artificial Sequence
  Synthetic
cgtcaacccagtctttgacatcctgttcttcaatagctccaaatggagtctccctgtatccggagtatctgatca

SEQ ID NO: 214759 - DNA, 75 bp, Artificial Sequence
  Synthetic
ttagcaatacattgatcacaaattgtgtctatggtctctgacagttgtgttggagttttacacttaacattgtgt

SEQ ID NO: 214760 - DNA, 75 bp, Artificial Sequence
  Synthetic
ggctgataaacttgtttaatttagatgataagaattcatggaagcacaccatttccagcagttctgttctgtctt

SEQ ID NO: 214761 - DNA, 75 bp, Artificial Sequence
  Synthetic
gacacttttcatcactaaggcaaggaatctttataaggctaacctggtcatcactggaggtataagtgacaggta

SEQ ID NO: 214762 - DNA, 75 bp, Artificial Sequence
  Synthetic
ataacacagaaattgttcagtaatcagcccatataaatctgatgtgttgtgcaagattccctgccccatgtccaa

SEQ ID NO: 214763 - DNA, 75 bp, Artificial Sequence
  Synthetic
ctatttgagccaacctgctctttataacttagtccaaatttcaagttccctgtatttgagctgatgcttgtaaat

SEQ ID NO: 214764 - DNA, 75 bp, Artificial Sequence
  Synthetic
tctgtaggagagtcgtctgaatagaaacataaattccgtagggctgcgtttgtaaaataacttttgtctagctta

SEQ ID NO: 214765 - DNA, 75 bp, Artificial Sequence
  Synthetic
cttggtaggctattgttgtcaaattttttaataacaaacccaaagggcagatatcctgcggtgcttcaaggaaat

SEQ ID NO: 214766 - DNA, 75 bp, Artificial Sequence
  Synthetic
aacagcatcacataactctttatacacatcagacctgaacacatctggatcaaaatccttcacctcatgcattga

SEQ ID NO: 214767 - DNA, 75 bp, Artificial Sequence
  Synthetic
acatcagacctgaacacatctggatcaaaatccttcacctcatgcattgacacctctgctttaatctctctcaac

SEQ ID NO: 214768 - DNA, 75 bp, Artificial Sequence
  Synthetic
cacctctgctttaatctctctcaacactccaaaaggggcccacaatgactcaagagactctcgctcatcaacaga

SEQ ID NO: 214769 - DNA, 75 bp, Artificial Sequence
  Synthetic
actccaaaaggggcccacaatgactcaagagactctcgctcatcaacagatagattctttgatttcaacttggtg

SEQ ID NO: 214770 - DNA, 75 bp, Artificial Sequence
  Synthetic
gtctcaacttttgacccctcactattagccatcttagctagtgtcatttgcacgtcatttctgataccctcaaag

SEQ ID NO: 214771 - DNA, 75 bp, Artificial Sequence
  Synthetic
gcccttacttgatcctctgttaaactctcatacatcattgacaattcttcttgattggttctagttctagaaccg

SEQ ID NO: 214772 - DNA, 75 bp, Artificial Sequence
  Synthetic
gtgctcacaagacctgttagattttttaatattaaatagtccatggaatcaggatcaagattatacctgcctttt

SEQ ID NO: 214773 - DNA, 75 bp, Artificial Sequence
  Synthetic
gttttgaatctctcagccatggtagaaacacatgttgaaacaagtttctccttatcataaacagagagaatattt

SEQ ID NO: 214774 - DNA, 75 bp, Artificial Sequence
  Synthetic
cttatcataaacagagagaatatttccaagttcgtcgagcttggggatcaccacacttttattgcttgacaaatc

SEQ ID NO: 214775 - DNA, 75 bp, Artificial Sequence
  Synthetic
caaagctgtgctagtgatgttaggtctgtagggattgcttttcagctcacctgtaactttaagtcttcctctatt

SEQ ID NO: 214776 - DNA, 75 bp, Artificial Sequence
  Synthetic
ctgtagggattgcttttcagctcacctgtaactttaagtcttcctctattgaagagagaaatgcagaaagacaag

SEQ ID NO: 214777 - DNA, 75 bp, Artificial Sequence
  Synthetic
atctctttacacactcctggaatttgagtatctgaggaagtcttagcctctttggaaaagaatctgtccaatcct

SEQ ID NO: 214778 - DNA, 75 bp, Artificial Sequence
  Synthetic
cttatcatgatgtcctcttgttccagtgttagactcccatttaaaggggggtttacaacaacacaatcaaacttg

SEQ ID NO: 214779 - DNA, 75 bp, Artificial Sequence
  Synthetic
tttgatttgcatatgccatcaagaaatatcttagaccttgtaaaaatgtctggttccttttggaaggggaacaga

SEQ ID NO: 214780 - DNA, 75 bp, Artificial Sequence
  Synthetic
gcacagccaacactaacaatcttaatgttggccttgtcattgtcatgagttcgtggctaaaatccaaccagctgg

SEQ ID NO: 214781 - DNA, 75 bp, Artificial Sequence
  Synthetic
aaaaatctctttggatcacagtaaaaagagccttgttcttccaacaccccattgatagatagatagatagaatag

SEQ ID NO: 214782 - DNA, 75 bp, Artificial Sequence
  Synthetic
caccttgacttctcacctgttttttggtaaaacaagagaccaaatgtgttctttatcagatgaaatctttgtaca

SEQ ID NO: 214783 - DNA, 75 bp, Artificial Sequence
  Synthetic
taacactctcttagtctaacatttccaaagtatctagaatactctctttcattgatcaacaatcgggaggaaaat

SEQ ID NO: 214784 - DNA, 75 bp, Artificial Sequence
  Synthetic
gatgtcttcattgagttgaccaatgcaagggaaatggaggacaaaatcctaaataatttcttctgctcaccttcc

SEQ ID NO: 214785 - DNA, 75 bp, Artificial Sequence
  Synthetic
caagggaaatggaggacaaaatcctaaataatttcttctgctcaccttccactaaactgctgaatggctgatgtc

SEQ ID NO: 214786 - DNA, 75 bp, Artificial Sequence
  Synthetic
tacagattttctcagattctctgtcaatagtatatctcatcactggtctgtcagaaacaagtgcctgagctaaga

SEQ ID NO: 214787 - DNA, 75 bp, Artificial Sequence
  Synthetic
cctgcatttcttagccttacaattgcatcatcatgctttttaaaaagatcacaaagtaaattgagtaaaactaaa

SEQ ID NO: 214788 - DNA, 75 bp, Artificial Sequence
  Synthetic
catcatcatgctttttaaaaagatcacaaagtaaattgagtaaaactaaatccagaaacagtaaagtatttctcc

SEQ ID NO: 214789 - DNA, 75 bp, Artificial Sequence
  Synthetic
tgaagataacacctctctacagcatcaatagatatagaattctcatctgactggcttttcatgttgacttcatct

SEQ ID NO: 214790 - DNA, 75 bp, Artificial Sequence
  Synthetic
attggatgcgatgcgatagagtagaccacatccatcaacttgtttgcacaaaaagggcagctgggcacatcactg

SEQ ID NO: 214791 - DNA, 75 bp, Artificial Sequence
  Synthetic
aaaagggcagctgggcacatcactgtctttgtggcttcctaatgagaccaagtcatttataaggttagatttttg

SEQ ID NO: 214792 - DNA, 75 bp, Artificial Sequence
  Synthetic
tgaaaatttgaatttccccaactgcttgtcaaaaatctccttcttaaaccaaaaccttaactttatgagttcttc

SEQ ID NO: 214793 - DNA, 75 bp, Artificial Sequence
  Synthetic
tcttataacagattctctaatgtctcctctaaccccaacaaaaagggattcatttaatctctcatcataacccaa

SEQ ID NO: 214794 - DNA, 75 bp, Artificial Sequence
  Synthetic
agaattctttttcaaacattcaatgttttctaatcccaagctctggttttttgtattggacaaactatgaattaa

SEQ ID NO: 214795 - DNA, 75 bp, Artificial Sequence
  Synthetic
tcgctggtattcttgttcttcaatattaatctcttgcataaattttgatttctttaggatgtcaatcagtagcca

SEQ ID NO: 214796 - DNA, 75 bp, Artificial Sequence
  Synthetic
ccgaactctttcaacaacccaatcagcaaggaatctattgctgtagctagatctgccatcaactacaggaaccaa

SEQ ID NO: 214797 - DNA, 75 bp, Artificial Sequence
  Synthetic
cgtaatccctgccctcaatagatcggactttaggtttaagagctttgacatgtcactcttccattttttctcaaa

SEQ ID NO: 214798 - DNA, 75 bp, Artificial Sequence
  Synthetic
gactttaggtttaagagctttgacatgtcactcttccattttttctcaaattcatcaggattgactctaacaaag

SEQ ID NO: 214799 - DNA, 75 bp, Artificial Sequence
  Synthetic
gtttccaacaggatgagtgttttccctgtgagtttaaaaccatccggaatgacttttgggagggtgggacatagt

SEQ ID NO: 214800 - DNA, 75 bp, Artificial Sequence
  Synthetic
gacttttgggagggtgggacatagtatgccatggtcagacagaatcacatcaacaaacttctgatctgaattgat

SEQ ID NO: 214801 - DNA, 75 bp, Artificial Sequence
  Synthetic
tcaagctctactaaacttgacagaagcttgaacccttccaacaacagagagctggggtgatgttgagataaaaag

SEQ ID NO: 214802 - DNA, 75 bp, Artificial Sequence
  Synthetic
atgtccctttggtatgctaattcctgtctttctggaaaatgctttctaataaggttttttatttcattcactgat

SEQ ID NO: 214803 - DNA, 75 bp, Artificial Sequence
  Synthetic
gtctttctggaaaatgctttctaataaggttttttatttcattcactgattcctccatgctcaagtgccgcctag

SEQ ID NO: 214804 - DNA, 75 bp, Artificial Sequence
  Synthetic
atgctttctaataaggttttttatttcattcactgattcctccatgctcaagtgccgcctaggatccactgtgcg

SEQ ID NO: 214805 - DNA, 75 bp, Artificial Sequence
  Synthetic
cgcacggaggatcctaggcgattttggtcacgctataattgtgactgttttctgtttggacaacatcaaaaaatc

SEQ ID NO: 214806 - DNA, 75 bp, Artificial Sequence
  Synthetic
tgttgcacaatggggcagttcattagtttcatgcaagaaataccaacctttttgcaggaggctctgaacattgct

SEQ ID NO: 214807 - DNA, 75 bp, Artificial Sequence
  Synthetic
tttgcaggaggctctgaacattgctcttgttgcagtcagtcttattgccatcattaagggtgtagtaaacttgta

SEQ ID NO: 214808 - DNA, 75 bp, Artificial Sequence
  Synthetic
taggaaccgtacaaagacagagggcttcatctttcaggttaacacctccaagactggtgtcaatgaaaactatgc

SEQ ID NO: 214809 - DNA, 75 bp, Artificial Sequence
  Synthetic
ttcatctttcaggttaacacctccaagactggtgtcaatgaaaactatgctaagaagtttaagactggcatgcat

SEQ ID NO: 214810 - DNA, 75 bp, Artificial Sequence
  Synthetic
aggtccttaaaagcattcttctcctggtctttgacagactcatccggcaaggatacccctgggggctattgtcta

SEQ ID NO: 214811 - DNA, 75 bp, Artificial Sequence
  Synthetic
agggaactgatgagtgtcccctactgcaattacacaaaattttggtatgtcaaccacacactttcaggacaacac

SEQ ID NO: 214812 - DNA, 75 bp, Artificial Sequence
  Synthetic
agacacatcagaggcgaagcatgccctttgccacacaggttgaacagcttgggtggttgcaggtgtggcaagtac

SEQ ID NO: 214813 - DNA, 75 bp, Artificial Sequence
  Synthetic
cccaatctaaagaaaccaacaatttggcgcagaggacactaagacctcccgagggtccccaccagcccgggcact

SEQ ID NO: 214814 - DNA, 75 bp, Artificial Sequence
  Synthetic
ggcactgcttacagtgcataggctgccttcgggaggaacagcaagctcggtggtaatagaggtgtaagttcctcc

SEQ ID NO: 214815 - DNA, 75 bp, Artificial Sequence
  Synthetic
actgcctggcttgttcagatgtaagcctaacatcaaccagtttgaggtctcttctcccatggaggtcaaatagct

SEQ ID NO: 214816 - DNA, 75 bp, Artificial Sequence
  Synthetic
ctaccatttttaaaccctttctcatcatgtggttttctgaagcagtgaatgtactgtttacccgcaggttggaac

SEQ ID NO: 214817 - DNA, 75 bp, Artificial Sequence
  Synthetic
tgtctaggaccagcaactggtttccttgtcagatcaatgcttgtgttgtcccatgacctgcctgtgatttgcgat

SEQ ID NO: 214818 - DNA, 75 bp, Artificial Sequence
  Synthetic
tgatggagctttcatccttagtcacaatttgaaggcagtcatgttcctgagtcaatctgtcaagatcactcaagt

SEQ ID NO: 214819 - DNA, 75 bp, Artificial Sequence
  Synthetic
gtcaatctgtcaagatcactcaagtttggatacttcacagtgtatagaagcccaagagaggttaaagcttgtatg

SEQ ID NO: 214820 - DNA, 75 bp, Artificial Sequence
  Synthetic
tttagctttgaagggtctttaacatcccatatcctcaccacaccatttcctccagccccttgctgttgaaatccc

SEQ ID NO: 214821 - DNA, 75 bp, Artificial Sequence
  Synthetic
tccagccccttgctgttgaaatcccagtgttctcaatatctctgatcttttagcaagttgtgactgggacaaatt

SEQ ID NO: 214822 - DNA, 75 bp, Artificial Sequence
  Synthetic
ctccatcagttcatccctccccagatctcctactttgaaaactgtgtttcgttgaacactcttcatggacataag

SEQ ID NO: 214823 - DNA, 75 bp, Artificial Sequence
  Synthetic
cccttttggtctttctgagtgcccgctgcacctgtgccacttggttgaagtcaatgctgtcagcaattagcttgg

SEQ ID NO: 214824 - DNA, 75 bp, Artificial Sequence
  Synthetic
ctgcacctgtgccacttggttgaagtcaatgctgtcagcaattagcttggcgtccttcaaaacatctgacttgac

SEQ ID NO: 214825 - DNA, 75 bp, Artificial Sequence
  Synthetic
agttctggtgattttgatctaaggtagagttgctcagtgaaagtgttagacactatgcctaggatcctccgtgcg

SEQ ID NO: 214826 - DNA, 75 bp, Artificial Sequence
  Synthetic
cgcacggtggatcctaggcgattttggttacgctacaattgtgactgttttctgtttggacagcattaaaaacat

SEQ ID NO: 214827 - DNA, 75 bp, Artificial Sequence
  Synthetic
tctgtttggacagcattaaaaacattcattgcacaatggggcagttcattagcttcatgcaagaaataccaacct

SEQ ID NO: 214828 - DNA, 75 bp, Artificial Sequence
  Synthetic
atcattaagggtattgtgaacttgtacaaaagtggtttgttccaattctttgtgttcctagcgcttgcaggaaga

SEQ ID NO: 214829 - DNA, 75 bp, Artificial Sequence
  Synthetic
tgatgttataatacaacatccggcagacatgagctggtgttccaaaagtgatgatcaaatatggctgtctcagtg

SEQ ID NO: 214830 - DNA, 75 bp, Artificial Sequence
  Synthetic
gttcatgaatgctgtgggacatgattggcatctagacccaccattcctgtgtaggaaccgtacaaagacagaagg

SEQ ID NO: 214831 - DNA, 75 bp, Artificial Sequence
  Synthetic
gtaggaaccgtacaaagacagaaggcttcatctttcaagtcaacacctccaagactggtgttaatgaaaactatg

SEQ ID NO: 214832 - DNA, 75 bp, Artificial Sequence
  Synthetic
aagactggtgttaatgaaaactatgctaagaaatttaagactggcatgcatcatttgtatagagaatatcctgac

SEQ ID NO: 214833 - DNA, 75 bp, Artificial Sequence
  Synthetic
tcttgcttgaatggcaaactgtgtttaatgaaggcacagcccgccagttggcctctccaatgtccactcgaccat

SEQ ID NO: 214834 - DNA, 75 bp, Artificial Sequence
  Synthetic
taatgaaggcacagcccgccagttggcctctccaatgtccactcgaccatgtcaacacattacatttcctcacaa

SEQ ID NO: 214835 - DNA, 75 bp, Artificial Sequence
  Synthetic
cagacaatcaatgccttgatatctgacaatttattaatgaaaaacaaaattagggaactgatgagtgtcccctac

SEQ ID NO: 214836 - DNA, 75 bp, Artificial Sequence
  Synthetic
agttgacatctgtttttggagcacagtattcttcacagcatcactcttccttcatttggtgggcatacccaccca

SEQ ID NO: 214837 - DNA, 75 bp, Artificial Sequence
  Synthetic
tccgcggcctagccgcggactggggaggcactacttacagtgcataggctgccttcgggaggaacagcaagctcg

SEQ ID NO: 214838 - DNA, 75 bp, Artificial Sequence
  Synthetic
gtggtaatagaggtgtgagttcctcctcatagagcttcccatccaacactgactgaaacattatgcagtctagca

SEQ ID NO: 214839 - DNA, 75 bp, Artificial Sequence
  Synthetic
caacttgaagggagtatccttgtccctctttttcttactgacaaccactccattgtgatatttgcacaagtgacc

SEQ ID NO: 214840 - DNA, 75 bp, Artificial Sequence
  Synthetic
ctctttttcttactgacaaccactccattgtgatatttgcacaagtgaccatatttctcccagacctgttgatca

SEQ ID NO: 214841 - DNA, 75 bp, Artificial Sequence
  Synthetic
aactgcctggcttgctcagatgtaagcctaacatcaaccagtttaagatctcttctcccatggaggtcaaacaac

SEQ ID NO: 214842 - DNA, 75 bp, Artificial Sequence
  Synthetic
ttcctgatgtcatcggatccctgagtagtcacaaccatgtctggaggcagtaagccgatcacgtaactaagaacc

SEQ ID NO: 214843 - DNA, 75 bp, Artificial Sequence
  Synthetic
ttgtctaggaccagcaactggtttccttgtcagatcaatacttgtgttgtcccatgacctgcctgtgatttgtga

SEQ ID NO: 214844 - DNA, 75 bp, Artificial Sequence
  Synthetic
gcctggcttctcatcaatgaacataccttctcttcgtttaacctgaatggttgattttatgagggaagagaagtt

SEQ ID NO: 214845 - DNA, 75 bp, Artificial Sequence
  Synthetic
ttctggggtaactctgattgtttctaacatgtttccaccatcaagaatagatgctccagccttcactgcagctga

SEQ ID NO: 214846 - DNA, 75 bp, Artificial Sequence
  Synthetic
aacatgtttccaccatcaagaatagatgctccagccttcactgcagctgaaagactgaagttgtaaccagaaatg

SEQ ID NO: 214847 - DNA, 75 bp, Artificial Sequence
  Synthetic
tttggatacttcacagtgtatagaagcccaagagaggttaaagcttgtatgacactgttcattgtctcacctcct

SEQ ID NO: 214848 - DNA, 75 bp, Artificial Sequence
  Synthetic
cagtgttctcaatatctctgatcttttagcaagttgtgattgggacaagttacccatgtagactccctgggagcc

SEQ ID NO: 214849 - DNA, 75 bp, Artificial Sequence
  Synthetic
ccccttttggtctttctgagtgcccgctgcacctgtgccacttggttaaagtcaatgctgtcagcaattagtttg

SEQ ID NO: 214850 - DNA, 75 bp, Artificial Sequence
  Synthetic
ggttctggtgattttgatctgggatagaattgctcagtgaaagtgtaagacactatgcctaggatcctccgtgcg

SEQ ID NO: 214851 - DNA, 75 bp, Artificial Sequence
  Synthetic
cgcacggaggatcctaggcgattttggttacgctataattgtgactgttttctgtttggacaacaccaaaatatc

SEQ ID NO: 214852 - DNA, 75 bp, Artificial Sequence
  Synthetic
agttctgctgattttgatctggggtaaagttgctcagtgaaagtgttagacactatgcctaggatcctccgtgcg

SEQ ID NO: 214853 - DNA, 75 bp, Artificial Sequence
  Synthetic
cgcaccggggatcctaggcgtaacttcatcactaaaatctcagattctgttttgagtgtgacttactgcgaagag

SEQ ID NO: 214854 - DNA, 75 bp, Artificial Sequence
  Synthetic
gcagacaaatgggcaactgcaacggggcatccaagtctaaccagccagactcctcaagagtcacacagccagctg

SEQ ID NO: 214855 - DNA, 75 bp, Artificial Sequence
  Synthetic
atctgataacctgtaatgatcactacctttgtttaaggtgccatcaggtaatgttaaggaattcagatctctgca

SEQ ID NO: 214856 - DNA, 75 bp, Artificial Sequence
  Synthetic
atgttaaggaattcagatctctgcaatatctgttggaagcccctacccaccacaatcacagtgcctgtggagcca

SEQ ID NO: 214857 - DNA, 75 bp, Artificial Sequence
  Synthetic
gggggcccccatggggaccccccgtgggggaaccccgggggtgatacaccattaatcaatgtctttgatctcgac

SEQ ID NO: 214858 - DNA, 75 bp, Artificial Sequence
  Synthetic
taaagatctgctgaatgctaccttgaaatttgagaattccaaccagtcaccaaatttatcaagtgaacggattaa

SEQ ID NO: 214859 - DNA, 75 bp, Artificial Sequence
  Synthetic
ctgctctttgtgtagatcataaatgaggacaaagtcctcttgctgaaacaatattgtttgggatgtcatttttag

SEQ ID NO: 214860 - DNA, 75 bp, Artificial Sequence
  Synthetic
ataaggccatagttggcttaataaggtttccacactatcaatgtcctctagcgctccaattgccttgactataac

SEQ ID NO: 214861 - DNA, 75 bp, Artificial Sequence
  Synthetic
atccccagacaactcaactctatatgttgacagcctttcattacctctgtaaaagacaccctctttcaaaacaag

SEQ ID NO: 214862 - DNA, 75 bp, Artificial Sequence
  Synthetic
aggttcccctaggttatctggcccaatgaggtcgtatgcatacttgttactaatttcagaataaaagtcaccaaa

SEQ ID NO: 214863 - DNA, 75 bp, Artificial Sequence
  Synthetic
gttgaacttgacatgacccagaatattatcatcatttgtcaaagcgtagcctgcatcaataaataagccagctag

SEQ ID NO: 214864 - DNA, 75 bp, Artificial Sequence
  Synthetic
ttatcatcatttgtcaaagcgtagcctgcatcaataaataagccagctaggtcaaagctctcatggcctgtgaac

SEQ ID NO: 214865 - DNA, 75 bp, Artificial Sequence
  Synthetic
ctcagacccagaaacacactgactcattgtatccacattcagctctaattcaggggtactgacatcatccactct

SEQ ID NO: 214866 - DNA, 75 bp, Artificial Sequence
  Synthetic
gtcttcctgaggcaacaaggagatgttgtcaacagagacactctcaaggaaaaccttgatattatcaaagctaga

SEQ ID NO: 214867 - DNA, 75 bp, Artificial Sequence
  Synthetic
tgactgtcatcttctagatctagaacttcattgaaccaaaagaaggatttgagacacgatgttgacatgaccagt

SEQ ID NO: 214868 - DNA, 75 bp, Artificial Sequence
  Synthetic
caatttgtgtactctgactgtctaacatgggctgaagcgcagtcactctgtttcacaatgtaaacattattgtct

SEQ ID NO: 214869 - DNA, 75 bp, Artificial Sequence
  Synthetic
cttaccttcaataagtgacttataatccctaagttctcattcatcatgtctagagccacacagacatccaagaat

SEQ ID NO: 214870 - DNA, 75 bp, Artificial Sequence
  Synthetic
ttgagtcttccactgtccaaagatctgtttacttgaagatcattcataaagggtgccaaatgttcttcaaataat

SEQ ID NO: 214871 - DNA, 75 bp, Artificial Sequence
  Synthetic
tgtttacttgaagatcattcataaagggtgccaaatgttcttcaaataatttggggtaatttcttcgtatggaat

SEQ ID NO: 214872 - DNA, 75 bp, Artificial Sequence
  Synthetic
aattccgcagagacatggtattattctagtaaatatgtcctttatgtacaaaaatccgcctttaccatccctaac

SEQ ID NO: 214873 - DNA, 75 bp, Artificial Sequence
  Synthetic
ccttttgtgaaatttcttgacaacctggactgaattgtctttatcaacgttggcatctcttctttctctaacact

SEQ ID NO: 214874 - DNA, 75 bp, Artificial Sequence
  Synthetic
tctagagtttgtctgatttcatcttcactacacccggcatattgcaggaatccggacaaagcctcatcccctcct

SEQ ID NO: 214875 - DNA, 75 bp, Artificial Sequence
  Synthetic
ctgcttatcaagttgataaggttttcctcaaagattttgcctctcttaatgtcattaaacactttcctcgcacaa

SEQ ID NO: 214876 - DNA, 75 bp, Artificial Sequence
  Synthetic
ccgtcaacccagtctttgacatcttgttcttcaatagctccaaacggagtctccctgtatccagagtatctgatc

SEQ ID NO: 214877 - DNA, 75 bp, Artificial Sequence
  Synthetic
atcactggaggtataagtgacaggtatcacatcatacagtaagtcaagtgcataacacagaaattgttcagtgat

SEQ ID NO: 214878 - DNA, 75 bp, Artificial Sequence
  Synthetic
ctggtcccttgactgcagatattggtgaaagaactcttcaccaacactagtacaatcacaacccattaaacccaa

SEQ ID NO: 214879 - DNA, 75 bp, Artificial Sequence
  Synthetic
tttgagaatgttcattactggttcaagattcaccttcgttctatctctgggattcttcaattctaatgtgtgcaa

SEQ ID NO: 214880 - DNA, 75 bp, Artificial Sequence
  Synthetic
actacccacagcttctgagaagtcttcaactaacctggtcatcagcttagtgttgaggtcccccacatatagttc

SEQ ID NO: 214881 - DNA, 75 bp, Artificial Sequence
  Synthetic
aaacataaattccgtagggctgcgtttgtaaaataacttttgtctagcttatcagcaatggcttcagaattgctt

SEQ ID NO: 214882 - DNA, 75 bp, Artificial Sequence
  Synthetic
tccctggtactaagccgaacttcatccttcagtttcaatacttcactggaaaagcccaatctagatctacttcta

SEQ ID NO: 214883 - DNA, 75 bp, Artificial Sequence
  Synthetic
tccctggtactaagccgaacttcttccttcagtttcaatacttcactggaaaagcccaatctagatctacttcta

SEQ ID NO: 214884 - DNA, 75 bp, Artificial Sequence
  Synthetic
tccctggtactaagccgaacttcctccttcagtttcaatacttcactggaaaagcccaatctagatctacttcta

SEQ ID NO: 214885 - DNA, 75 bp, Artificial Sequence
  Synthetic
tccctggtactaagccgaacttcgtccttcagtttcaatacttcactggaaaagcccaatctagatctacttcta

SEQ ID NO: 214886 - DNA, 75 bp, Artificial Sequence
  Synthetic
tgctcatagctacccaatttctgatcataatgtccttgaattaaaaggtacttgaagcattcaaagaattcttct

SEQ ID NO: 214887 - DNA, 75 bp, Artificial Sequence
  Synthetic
tcttggtaggctattgttgtcagattttttaataacaaacccaaagggcagatgtcctgcggtgcctcaaggaaa

SEQ ID NO: 214888 - DNA, 75 bp, Artificial Sequence
  Synthetic
gatgtcctgcggtgcctcaaggaaataagtcaatttatatggagatagataaacagtatcacataactctttata

SEQ ID NO: 214889 - DNA, 75 bp, Artificial Sequence
  Synthetic
gtagaaaattctgaatattaacgcaacgctttgagattagctcgacaacctttaatagattgaatttaaattttg

SEQ ID NO: 214890 - DNA, 75 bp, Artificial Sequence
  Synthetic
aagatatggtacagtatgacaatgaattgacggctgaactaatcaattcaatgccaatgaatgtaaccatatcag

SEQ ID NO: 214891 - DNA, 75 bp, Artificial Sequence
  Synthetic
taagaaaattagtcgaaaaaacaatcaaaatgtcaaatgcaaggtataatatgatatcagctgtttcagctagtg

SEQ ID NO: 214892 - DNA, 75 bp, Artificial Sequence
  Synthetic
ctaagctcaggccaagttataatactaataacgttatgcccatcttaacaagaaaattcagagttgtacccttac

SEQ ID NO: 214893 - DNA, 75 bp, Artificial Sequence
  Synthetic
gttgcaaaaacgataaaccattttgcgttcataaagtagtagcagtaatagtaattattgtttcatctggaatta

SEQ ID NO: 214894 - DNA, 75 bp, Artificial Sequence
  Synthetic
cttacttgaagaagagtactgctgaatttcacctatttgtgccacgtcatgatctgctaaacggaactgaaatag

SEQ ID NO: 214895 - DNA, 75 bp, Artificial Sequence
  Synthetic
ccgtagttaatcagattggtcaaaagaaattatcaactgacgattattttgtgctatccttggtttgtgatgcta

SEQ ID NO: 214896 - DNA, 75 bp, Artificial Sequence
  Synthetic
atgatgtaagttatgaaaccttaattaatatgtcttatgaagtttgtgcacttaaaactttatttggcaaaccat

SEQ ID NO: 214897 - DNA, 75 bp, Artificial Sequence
  Synthetic
ttagtaatattattgtggtcggtctatctgttgtgggaatgaccgccagttcaaagaccaagcaagtattaactg

SEQ ID NO: 214898 - DNA, 75 bp, Artificial Sequence
  Synthetic
acaatacttatttaatggatatgactttggggttaggtgtgatgaataagtttgttaaaccgatgtctaacagca

SEQ ID NO: 214899 - DNA, 75 bp, Artificial Sequence
  Synthetic
atggtggtgaaaatgcgattgagcttaatcatatgccaaaacgtattgttaagaaattactgaaagatgagaata

SEQ ID NO: 214900 - DNA, 75 bp, Artificial Sequence
  Synthetic
tagcattatatagttattcaaattcaagtaatagtagatataacagtgaggagttcaagtttatacgtgattatc

SEQ ID NO: 214901 - DNA, 75 bp, Artificial Sequence
  Synthetic
gaaatggagctgaatttgtaaaatcaataggcaaagatttgaaaaataatgacagtaagcctgatccttcggcac

SEQ ID NO: 214902 - DNA, 75 bp, Artificial Sequence
  Synthetic
tgtatacttatccttattcgagtttaattgataaaacattcaaccaagtaacacacggtagatcgtattctgata

SEQ ID NO: 214903 - DNA, 75 bp, Artificial Sequence
  Synthetic
caccgaaatacgagaaaatagatgaatcgtttgatttaaagagcgaatttgcaggtaaaagcttgataaccgata

SEQ ID NO: 214904 - DNA, 75 bp, Artificial Sequence
  Synthetic
acacagttaatatatatgatgagtgttcagatgaggcaccactctttatacccatatacagtcttccattaaatg

SEQ ID NO: 214905 - DNA, 75 bp, Artificial Sequence
  Synthetic
accgtactgggcaatcatttattgtgacaactgacttagtaaaaccgcttattctagaaagtcgatctcagagtt

SEQ ID NO: 214906 - DNA, 75 bp, Artificial Sequence
  Synthetic
caaaaatcaattattatgatatgcgtactgtttgtgtgatggataaggatggcttggctaaaattggctttaagt

SEQ ID NO: 214907 - DNA, 75 bp, Artificial Sequence
  Synthetic
aagtgttaataacaggtaagatccatccccttcatttgggttaccactttgggtcttatttggtttggaacgaag

SEQ ID NO: 214908 - DNA, 75 bp, Artificial Sequence
  Synthetic
ttagtcaacctgataaccagatgtcaactcaaattgtaaaattagtttcgtttattcttaaagaaatatgtgaga

SEQ ID NO: 214909 - DNA, 75 bp, Artificial Sequence
  Synthetic
gtagaaaatttgttgagtgtaagattgtgtaaatgtcaaatatacattgttatggatccgacccatccgaaggac

SEQ ID NO: 214910 - DNA, 75 bp, Artificial Sequence
  Synthetic
ataacaggtaagatccatccccttcatttgggttaccactttgggtcttatttggtttggaacgaagaaaacgac

SEQ ID NO: 214911 - DNA, 75 bp, Artificial Sequence
  Synthetic
aacgtaacctatcacataagcacttagatgatgaaataagatcgcaggttctagaaaattacttcaaagacaaaa

SEQ ID NO: 214912 - DNA, 75 bp, Artificial Sequence
  Synthetic
acttttgtatctatagattcgatgaaggacaaccattcactgttaaatttcgtcagaaagggaagattcagcaca

SEQ ID NO: 214913 - DNA, 75 bp, Artificial Sequence
  Synthetic
gtggtatagattataatatagttggtactacagtaatgattaatgacagactagtctcagttagcggacatatgc

SEQ ID NO: 214914 - DNA, 75 bp, Artificial Sequence
  Synthetic
ttgagcttgagaactcgattggccataatggtgctattaactacggtagtatttttgatactattaagtatttca

SEQ ID NO: 214915 - DNA, 75 bp, Artificial Sequence
  Synthetic
agtacatactcattggttcagttctagggttaccttatggaatcaaaagatatattatggagatcgaatcaaaca

SEQ ID NO: 214916 - DNA, 75 bp, Artificial Sequence
  Synthetic
ctagcattgtcggccttaccctaattaataacaatatgactatagatctgaattctgtcgctgtggataataggt

SEQ ID NO: 214917 - DNA, 75 bp, Artificial Sequence
  Synthetic
tactcaatcccaaggctgggtatgagcgaaaatctggtagtcgcgtttggcatggttttcacagccactatttgg

SEQ ID NO: 214918 - DNA, 75 bp, Artificial Sequence
  Synthetic
ttagaggtaacgctaccatggtggcgttgaaatgtaatgttttgggtaacctattccttaagaagatagtctcta

SEQ ID NO: 214919 - DNA, 75 bp, Artificial Sequence
  Synthetic
ctgttgacagtgctttattatacttgactactctgatgaatttcaaagtggaacaattcgatatgatcaaaacta

SEQ ID NO: 214920 - DNA, 75 bp, Artificial Sequence
  Synthetic
gtgatttacagttaacactgaaattttattataataaacagattagatatgatgtatttgctgggatgtatggtt

SEQ ID NO: 214921 - DNA, 75 bp, Artificial Sequence
  Synthetic
gttttaattggattaagatacaactgttggatttggcgagtaagtatagtaattacctacttgtagatgagcgaa

SEQ ID NO: 214922 - DNA, 75 bp, Artificial Sequence
  Synthetic
taattaatttgcgaaattcgaagtttaacgataatgcttataactatggcataattattgaacagtgttatccaa

SEQ ID NO: 214923 - DNA, 75 bp, Artificial Sequence
  Synthetic
gtttaatttcgtagtcattttcgacttaatgatacaaacgttataaatgcaggcaatcgagactaacgcgcgatt

SEQ ID NO: 214924 - DNA, 75 bp, Artificial Sequence
  Synthetic
taaaagatttgcctatgaataagattcttgctggactaaaagcattaatgttgtttcatgagcatacgaactgta

SEQ ID NO: 214925 - DNA, 75 bp, Artificial Sequence
  Synthetic
cactatgactgggttgaataggtgcagggcctggagccccaatcctcggtcagaggtcgcgtgatgcgtttttgg

SEQ ID NO: 214926 - DNA, 75 bp, Artificial Sequence
  Synthetic
ttcacggtgattgtaatccatctaacataatgtgtgacaaaatgggaaatgttaaaattgttgacccggcttctc

SEQ ID NO: 214927 - DNA, 75 bp, Artificial Sequence
  Synthetic
gtagaattttaacgatcgtttaatcatgaatactattgaacgtacaacctcactggtgaacgagacttcagctca

SEQ ID NO: 214928 - DNA, 75 bp, Artificial Sequence
  Synthetic
gaataggtgcagggcctggagccccaatcctcggtcagaggtcgcgtgatgcgtttttggaattttaaaaatgac

SEQ ID NO: 214929 - DNA, 75 bp, Artificial Sequence
  Synthetic
tggtaacaagagtagttacgtatatcaacgagtattataaagatttgactcccaaaagtgaagttggtgcgtatc

SEQ ID NO: 214930 - DNA, 75 bp, Artificial Sequence
  Synthetic
attgaaaactttggtttccaatgctgagaaatctcattttcttaaaccggatgaagtcagagctaaactagcttt

SEQ ID NO: 214931 - DNA, 75 bp, Artificial Sequence
  Synthetic
tattatcttgtttcgagatagttagtgacttaaggaagttgcctcttgaaaagatattcattaagcgtggttatc

SEQ ID NO: 214932 - DNA, 75 bp, Artificial Sequence
  Synthetic
tttgattaatccaaaacaaaacttgtttgctaatttgaactctttctttaataagcagaaatgtttggatgacct

SEQ ID NO: 214933 - DNA, 75 bp, Artificial Sequence
  Synthetic
taggtttgcctgagtatgcagatgatggaggaattaatgcaatcgactttctcactagtttacaggatggcttga

SEQ ID NO: 214934 - DNA, 75 bp, Artificial Sequence
  Synthetic
gactcgcatactcaaagtttgtggtggtactgaaacaagatatcaaattacagctattggtttaagtcatttgat

SEQ ID NO: 214935 - DNA, 75 bp, Artificial Sequence
  Synthetic
ctacccattctgatttaatgtctgctatagctggagttccttttgacggcttgttagctaataatgagtacatcg

SEQ ID NO: 214936 - DNA, 75 bp, Artificial Sequence
  Synthetic
cgagtattgtttaaaatacgaattaccaagtgatgcacgcatgttaaagtcattcatcttcatcatatttagtgt

SEQ ID NO: 214937 - DNA, 75 bp, Artificial Sequence
  Synthetic
acgatgacttatcagataatgaatgtaatgttaatttggatgcaggtattgacaatttagagtttaacaatttag

SEQ ID NO: 214938 - DNA, 75 bp, Artificial Sequence
  Synthetic
atttgacaaggtcgactcacgctctcaaggcaatgtgatgaagtttgacgaagtgtatgattatataaatagtga

SEQ ID NO: 214939 - DNA, 75 bp, Artificial Sequence
  Synthetic
acgttgatgactctgactctgagtgagtgttagtcttatcatcattgttactttccgttggtttatttgggtgac

SEQ ID NO: 214940 - DNA, 75 bp, Artificial Sequence
  Synthetic
gttagccgataatgttgacttaactgctggagaaattgatggttcaaaggttattaagatatcttttctaaccac

SEQ ID NO: 214941 - DNA, 75 bp, Artificial Sequence
  Synthetic
gaattcattatatgtatgttgacgcgggttcatagagaggctgttgtttcaacccagcagtcgatcgacgaacac

SEQ ID NO: 214942 - DNA, 75 bp, Artificial Sequence
  Synthetic
gacttacgtatgtgaacaagttaacactaaagtaatcgctgaccaagttctagccaaactgggtcagtatttgat

SEQ ID NO: 214943 - DNA, 75 bp, Artificial Sequence
  Synthetic
gtcgatcgacgaacacgtactcggtgtggtaaccgaggccaaaagcggttttacctaatgagtttaaagaacgac

SEQ ID NO: 214944 - DNA, 75 bp, Artificial Sequence
  Synthetic
gtagaaaattctgaatcgtaaacatgaatgtaattattccagctcatttgttagaggggggtttagtagacactt

SEQ ID NO: 214945 - DNA, 75 bp, Artificial Sequence
  Synthetic
ttctgaccaattcggttactttaagtcgaagataggtgtcaatggaaatgagaagtctgatgcaattgcaattat

SEQ ID NO: 214946 - DNA, 75 bp, Artificial Sequence
  Synthetic
taggtaacgatagttcgttgcgtaaatttgctcgcacaacgaagtacctagctaatgattggcatgatggagctg

SEQ ID NO: 214947 - DNA, 75 bp, Artificial Sequence
  Synthetic
gaatggtaaacaggatgaatcatgtcacgttgatttatttaggaataagtatagcgtaattcctgcttactacaa

SEQ ID NO: 214948 - DNA, 75 bp, Artificial Sequence
  Synthetic
tctccgttttgagaaatcgtaacaatgaatccaaacttgaaaatagttaccaaagcttcgcaggtgagaggttaa

SEQ ID NO: 214949 - DNA, 75 bp, Artificial Sequence
  Synthetic
acagttggtggcagaggtacgagctctcagaaagataaaatcagctggcaatccaaatggagtcaagtttagagg

SEQ ID NO: 214950 - DNA, 75 bp, Artificial Sequence
  Synthetic
ctcatgcaccaggtggtaacagaggtggtttgagaactgacttactggtgcgttgtattcaatcaacagtaactc

SEQ ID NO: 214951 - DNA, 75 bp, Artificial Sequence
  Synthetic
tattactaagtttggtttcattaaaccgttgacggatatgcaacgttttaagaaaactgccctcaatgtagcttt

SEQ ID NO: 214952 - DNA, 75 bp, Artificial Sequence
  Synthetic
agaatgttggtatcaacgttcctcaagctgagaagatagcactaggtaatagtttagcttcaagtgacacaccag

SEQ ID NO: 214953 - DNA, 75 bp, Artificial Sequence
  Synthetic
gattgactctaactccaagtacttcacaaccaattcaggtaaattgtactacgcttatgatcaatgtgtattaag

SEQ ID NO: 214954 - DNA, 75 bp, Artificial Sequence
  Synthetic
cttcagccgaccacattatgacaactgttcctgtcattttgcaaaaaccaaacaatgtatctcattcagtaacag

SEQ ID NO: 214955 - DNA, 75 bp, Artificial Sequence
  Synthetic
ttacatggatgatattgaaataagcgcgaatcgcgtttgtagggagttaatggatataaatgctttggtagctta

SEQ ID NO: 214956 - DNA, 75 bp, Artificial Sequence
  Synthetic
gtagaaaagagatggtagcaacgttttcaaatgaaaatggcgaagcgatcaacatcaatatgtcatttagatcac

SEQ ID NO: 214957 - DNA, 75 bp, Artificial Sequence
  Synthetic
taaattgttacataattatggtttaggaaataagtgtaagaatgcgaaatgtagtgtcgtaggacatataagccc

SEQ ID NO: 214958 - DNA, 75 bp, Artificial Sequence
  Synthetic
caacttcgattgaaatcatgagcgatacgccttttatttacggtagattgggtgatgcagcacaacaagctgttc

SEQ ID NO: 214959 - DNA, 75 bp, Artificial Sequence
  Synthetic
agctatacaatccgctttggcgaaacgctacactggcgctttgaaagacatcattctagatgagactcttgatga

SEQ ID NO: 214960 - DNA, 75 bp, Artificial Sequence
  Synthetic
aaagattgttcttgcacagctcaaacgctggcacttactatttcaatattcccgcaaatgcaactcgtacttttg

SEQ ID NO: 214961 - DNA, 75 bp, Artificial Sequence
  Synthetic
cgtggacgatggtgttgatactagtgctattgctaatgaagcttctaaagatgtacctttgtcatccgattccag

SEQ ID NO: 214962 - DNA, 75 bp, Artificial Sequence
  Synthetic
taataactgctagcacaccaagatcaatggataaagatacttcactcaattatcacatcgtcgaagcaggattca

SEQ ID NO: 214963 - DNA, 75 bp, Artificial Sequence
  Synthetic
aatggttaagggtgacaacaactatatgtatatgtcagctaaagataagtcgcgcaacgcagcttcatcggatag

SEQ ID NO: 214964 - DNA, 75 bp, Artificial Sequence
  Synthetic
agcgcgctaaagcaactggtttgttagatggtgttgtagctagagatttcgatgaatttgtcaccaatcagtgct

SEQ ID NO: 214965 - DNA, 75 bp, Artificial Sequence
  Synthetic
attagcgaagtacaaaagtgttaggaatacagaggatgatacaccatcgtctactgttgttgcttctaactcagc

SEQ ID NO: 214966 - DNA, 75 bp, Artificial Sequence
  Synthetic
tcaacttaccagcagcagagagtacatgtgccactttggccattttatttgaagcatatgaattggtgaacttag

SEQ ID NO: 214967 - DNA, 75 bp, Artificial Sequence
  Synthetic
tgacgttattcatgttgatgacattgacatcgacaacatcagcattgcttcaagttctaattcagttaatacaca

SEQ ID NO: 214968 - DNA, 75 bp, Artificial Sequence
  Synthetic
cagcggacgttaagattgtgaatatgttatattaaaacgttaccctgggtaattcattcgtgtagttatcgattt

SEQ ID NO: 214969 - DNA, 75 bp, Artificial Sequence
  Synthetic
caagtcgaaaccatttgcagctagaaacggaaagtctttgctctaacagtcgttgtatgttactttcagaggggg

SEQ ID NO: 214970 - DNA, 75 bp, Artificial Sequence
  Synthetic
atcgggatggtgcccaaggttgttcctaccaaccttggtgcccgattaattgatacttactttgcagtttaaaac

SEQ ID NO: 214971 - DNA, 75 bp, Artificial Sequence
  Synthetic
ggcggaccgcacatccaagctcccgatgattgaagcttattcaatggttaaggctgtctgaccaacagctaggtc

SEQ ID NO: 214972 - DNA, 75 bp, Artificial Sequence
  Synthetic
gtagaatttttcaagtttgtaagacatgtcaacaatgaattacagtagaccaaatgcaatttcagcattaagtgc

SEQ ID NO: 214973 - DNA, 75 bp, Artificial Sequence
  Synthetic
gtagaaaatttaagattctgtatgaactagacctgtctcaaggacgtcctcgatatactgaaaacataaatatta

SEQ ID NO: 214974 - DNA, 75 bp, Artificial Sequence
  Synthetic
tcccgatgattgaagcttattcaatggttaaggctgtctgaccaacagctaggtccaaatgaaattaaatccgac

SEQ ID NO: 214975 - DNA, 75 bp, Artificial Sequence
  Synthetic
atcaggattcaggggttatgtgcctgacaactctgtcagttcggcactgatcccacgtcttgttgtcaccaatga

SEQ ID NO: 214976 - DNA, 75 bp, Artificial Sequence
  Synthetic
actacggaaataatcatttcaataagatgaactacacaccagttagttatggtttggtatctcaccaaccagtca

SEQ ID NO: 214977 - DNA, 75 bp, Artificial Sequence
  Synthetic
ggatggtgcccaaggttgttcctaccaaccttggtgcccgattaattgatacttactttgcagtttaaaaccgac

SEQ ID NO: 214978 - DNA, 75 bp, Artificial Sequence
  Synthetic
acgtgagcacgtcttggctggacggctcaaacgtattgaagataatattgctaagaataaattaactgaacatga

SEQ ID NO: 214979 - DNA, 75 bp, Artificial Sequence
  Synthetic
atttgtgttacgtcgtgccagctttggtagtgcaacaggtttcctcacctgttgtacccggtgggcacgatcaat

SEQ ID NO: 214980 - DNA, 75 bp, Artificial Sequence
  Synthetic
tgacattgaagtagttaaaagtgattatgaatcattagctaacaatttcgaagaacagattaagtttgacaacgc

SEQ ID NO: 214981 - DNA, 75 bp, Artificial Sequence
  Synthetic
gtagttttgattctggaaatggatcagttagtggttttgaccattcaagtgtgaatgagcaaccaatattatcat

SEQ ID NO: 214982 - DNA, 75 bp, Artificial Sequence
  Synthetic
tacggaccgagcattacatgacttttcaactcagattaagattgtagatagtgaacgagagaaagagatgactgt

SEQ ID NO: 214983 - DNA, 75 bp, Artificial Sequence
  Synthetic
gggctgatgaagttgaagcagaattcaatgaaaaggagttaaaagttagtggtgccgctaactctacagctgaat

SEQ ID NO: 214984 - DNA, 75 bp, Artificial Sequence
  Synthetic
actcctaggtgcagtaaacgataattctcaagccataaacgatatcataaaagacgtgacggtaattgataacat

SEQ ID NO: 214985 - DNA, 75 bp, Artificial Sequence
  Synthetic
tgaatcaacctgaacctgttggtttaacgcgttttgacgttaacttacaggctgagaattttgatttacgtgatg

SEQ ID NO: 214986 - DNA, 75 bp, Artificial Sequence
  Synthetic
tgaaaaggcaaatttaatactcgaaaaggttatagctgtttcaagagctacagctaaaactgctgagatagctgc

SEQ ID NO: 214987 - DNA, 75 bp, Artificial Sequence
  Synthetic
agaatgatgcattacgtgccgaaaataataaattgaaaatagagttagccgctttgaaagaggagagattgaaga

SEQ ID NO: 214988 - DNA, 75 bp, Artificial Sequence
  Synthetic
tgatggtgttggagttgttcctgtttttggaccatctattgctaacggtgcgaagattgcggcgcatacagctga

SEQ ID NO: 214989 - DNA, 75 bp, Artificial Sequence
  Synthetic
acgtttctcttgacgttgagatcgtcgaagatgctaagattaaagctatcttggaagccattaacgtaactgagc

SEQ ID NO: 214990 - DNA, 75 bp, Artificial Sequence
  Synthetic
aatggttgctaacacatctgaagctgtcaaagcatcaggtatacttaacgatttgaatgaaacttttaaagctat

SEQ ID NO: 214991 - DNA, 75 bp, Artificial Sequence
  Synthetic
gtgttatgaatcgcttacctgctaaggatcctagcattctagctcgagttgaagcattattacggatgaaggatg

SEQ ID NO: 214992 - DNA, 75 bp, Artificial Sequence
  Synthetic
aacttctgtacactctagaccaaatgacttaatcaaatcagcggttaaatcaaccaataacgcagtcgatttagc

SEQ ID NO: 214993 - DNA, 75 bp, Artificial Sequence
  Synthetic
aattagtattcataggccatttcaccaaagaatgtaaacgccttattggtggttacaagaacgttgatgggcatc

SEQ ID NO: 214994 - DNA, 75 bp, Artificial Sequence
  Synthetic
tgcgaaattgaaagttatgatcgattcagcgcgtcgtaagaatgatatcggattgagtaaaatttcaattcctag

SEQ ID NO: 214995 - DNA, 75 bp, Artificial Sequence
  Synthetic
atgatgatacactaatgacttacttgcaaacagctgatcataatcagtttttatctgcattatttgaaatgtatt

SEQ ID NO: 214996 - DNA, 75 bp, Artificial Sequence
  Synthetic
tgtggttgttaagtcaacggtagagtggcctagagttattgatgcctatgatactcattgtatctataaactgca

SEQ ID NO: 214997 - DNA, 75 bp, Artificial Sequence
  Synthetic
atgataatcattcaaaggctgaagttgtaagtttattgtcatatttacataagtttaactttaacgttaatcttg

SEQ ID NO: 214998 - DNA, 75 bp, Artificial Sequence
  Synthetic
tccaactaacggatcagttgggctaatcgttgaagttaaaaatacattaatcagctaccaagtgaagaaacaata

SEQ ID NO: 214999 - DNA, 75 bp, Artificial Sequence
  Synthetic
acaagcaggctgttattgatgtgactcgtgttaagtataataataacattgatgcaaatgacgtttcaattaagg

SEQ ID NO: 215000 - DNA, 75 bp, Artificial Sequence
  Synthetic
tggtaagcttgattctgatggctttggtgatacaatcatatctggaggaagaatagtgggtattgcaggtgctaa

SEQ ID NO: 215001 - DNA, 75 bp, Artificial Sequence
  Synthetic
ttgattttgacgatttggtgtcaggctctgattatgtatatggtacccatggattagaaggattcccattagcta

SEQ ID NO: 215002 - DNA, 75 bp, Artificial Sequence
  Synthetic
acgtgttgttgatttccatctatcagtagatgctgcacatagcttagctatggttatggctttgcaatcgctaag

SEQ ID NO: 215003 - DNA, 75 bp, Artificial Sequence
  Synthetic
tgatgcatgccttatctcacgttgacagtactattaacggtaagggtttagccaaatatcatgttggagcagcgt

SEQ ID NO: 215004 - DNA, 75 bp, Artificial Sequence
  Synthetic
caacaggctcgacagcacatcaatcgtcggttatttcgaagaatattttgaattaggaatgcgggtagagaaacc

SEQ ID NO: 215005 - DNA, 75 bp, Artificial Sequence
  Synthetic
gccgcatgaatgagtgtagtattgttgaagtgtttagtaatggtgtctcaaagagatacaagccgttcaaatgct

SEQ ID NO: 215006 - DNA, 75 bp, Artificial Sequence
  Synthetic
tgaagtggataacgcgtttagtaaccatttgcatgatttgacggttgatacatcatatatagattggcacaagta

SEQ ID NO: 215007 - DNA, 75 bp, Artificial Sequence
  Synthetic
gggattcttacgtcatcttacccactctagaaggtgaagttaatggtagggttgaagctgttttgcatcacgttg

SEQ ID NO: 215008 - DNA, 75 bp, Artificial Sequence
  Synthetic
tgaaacggaaatgttaaatacacacaatgaacgcaaatccgttttaatcaacgaagttaacgagacactgggagc

SEQ ID NO: 215009 - DNA, 75 bp, Artificial Sequence
  Synthetic
gagtaacgtacatcaccttggttcgatgttacgacaagctcgaccggctaagagcgcagcggttgcatcataatg

SEQ ID NO: 215010 - DNA, 75 bp, Artificial Sequence
  Synthetic
tggttcttcagttcatatggtacctgagggttttattactttagaaacgacaccgactataattgaattaacacc

SEQ ID NO: 215011 - DNA, 75 bp, Artificial Sequence
  Synthetic
attatcttataaatggatcaataagcagacggtgtcaacgttggctaataagtataagcttaagacttttgacat

SEQ ID NO: 215012 - DNA, 75 bp, Artificial Sequence
  Synthetic
agtcatgaagataggagcttatagtgtatatgaacatttgtttggcccattcgtaaataccggtacttacaccta

SEQ ID NO: 215013 - DNA, 75 bp, Artificial Sequence
  Synthetic
gttctttactgaagatggtttatgtatacattcagtgggttgtcgtcataatatatctaacagggttaactgttg

SEQ ID NO: 215014 - DNA, 75 bp, Artificial Sequence
  Synthetic
taatctagtagttgatgttataggacaaccaacaaaatggtatactcaattagttgatgtacgtggccaggttgt

SEQ ID NO: 215015 - DNA, 75 bp, Artificial Sequence
  Synthetic
ttataattcatatcaaagaaatggagaacagcaacgtacacataaacaaccaagcgataacattagattcaatcg

SEQ ID NO: 215016 - DNA, 75 bp, Artificial Sequence
  Synthetic
aagttcaagttcattagatgcattaccaacacagccagtcgatttggtggtcggtactaaaggctcgatgagcac

SEQ ID NO: 215017 - DNA, 75 bp, Artificial Sequence
  Synthetic
tgatcatgtgtctgcatcaaaacacgacagcaatactcagaagcagcagcgctatcacgataagcggaacaggcg

SEQ ID NO: 215018 - DNA, 75 bp, Artificial Sequence
  Synthetic
aatacctggttctagcggcttactggtggatagaaggctattacgtatttatgttaagcaacctaagtgtgtacg

SEQ ID NO: 215019 - DNA, 75 bp, Artificial Sequence
  Synthetic
tcagcaatttaataaattcggtgacgctagtcaagtcgaaaggtcaatcgggaatattaattcaattaatagttg

SEQ ID NO: 215020 - DNA, 75 bp, Artificial Sequence
  Synthetic
cgttttctgtggttggaagagtggtgtatcgtcatttagattttctcctaagacgatggaggaacagaaagcatt

SEQ ID NO: 215021 - DNA, 75 bp, Artificial Sequence
  Synthetic
gaggagtaacaattagattctgcaactggtttaaatgtatacttatatgcactgtggcgggtacgtactctcgct

SEQ ID NO: 215022 - DNA, 75 bp, Artificial Sequence
  Synthetic
cagtcatgaatttagcaggctacataggttcttagatcctaatgcagctttagccattactgaagggtcccacgt

SEQ ID NO: 215023 - DNA, 75 bp, Artificial Sequence
  Synthetic
cgtcaccgtgcatgacgtattgaaattgattataagtattttaatctgaattagtaagaccacccctattaaaca

SEQ ID NO: 215024 - DNA, 75 bp, Artificial Sequence
  Synthetic
ttgggaagcatatgcaaagggtaattacaacaatcctatcgattaatcactgattaacgaatattatgcattgtt

SEQ ID NO: 215025 - DNA, 75 bp, Artificial Sequence
  Synthetic
gtagaaaaatcagcaaaatgtcgagtaccacggaggtcttagcgatctcgagcttgggagaattaattgagtata

SEQ ID NO: 215026 - DNA, 75 bp, Artificial Sequence
  Synthetic
acagttggcgaagtacatgacgggatgattgttgagcaaacatagttcttggatgaaggaagaaaagaaaatgac

SEQ ID NO: 215027 - DNA, 75 bp, Artificial Sequence
  Synthetic
cattttaatttattcttaattgttaactatgttcaatcctgatgacttaatgggaaactaataagctagctttga

SEQ ID NO: 215028 - DNA, 75 bp, Artificial Sequence
  Synthetic
tgaaaagaacagaagtagatcgtatcatcactaattcagttggatctagacgtttaatggaattgtcacgaccat

SEQ ID NO: 215029 - DNA, 75 bp, Artificial Sequence
  Synthetic
atgtttggcgtaatacattgtttacagaaatcggggtcacgccggtcaacgtgactctggtgagtcctctgcacg

SEQ ID NO: 215030 - DNA, 75 bp, Artificial Sequence
  Synthetic
acattgaaggaggcaaaatacaatatgtcgatagaaataatgtgattggtgtttgtattgattcgaatccgcgag

SEQ ID NO: 215031 - DNA, 75 bp, Artificial Sequence
  Synthetic
gtagaaaattcatttatgatggtaggatgctagacttagaatttgagaactgtttaatcgatgatttgaagacta

SEQ ID NO: 215032 - DNA, 75 bp, Artificial Sequence
  Synthetic
ttacagaaatcggggtcacgccggtcaacgtgactctggtgagtcctctgcacgaacgtaaaaattaaaactgac

SEQ ID NO: 215033 - DNA, 75 bp, Artificial Sequence
  Synthetic
gtgacgttttgattcaagccgtgattaatcatttaattactggtgttgcaacttttccaggtagagtggacgttt

SEQ ID NO: 215034 - DNA, 75 bp, Artificial Sequence
  Synthetic
ttgataaatgggagaaacaacaattgtccgtttatgatgagttatatggaactgaaactgctgagtttgtacttg

SEQ ID NO: 215035 - DNA, 75 bp, Artificial Sequence
  Synthetic
caacaagaaatttgactttatataatgtgatagctgagaaagggtataacattgaaaccgataatataaattatc

SEQ ID NO: 215036 - DNA, 75 bp, Artificial Sequence
  Synthetic
gagagggtaagttacccaactcttataggacaaacgtctttaagataactgaatctggtgataagatatttcttg

SEQ ID NO: 215037 - DNA, 75 bp, Artificial Sequence
  Synthetic
tattgacattggcttgtatcggtgttgaaaatttgaattcagaacaacgacttaggttagtaatattgttgaaaa

SEQ ID NO: 215038 - DNA, 75 bp, Artificial Sequence
  Synthetic
gtacactaattaacaagttgttcagaccgcaaattgatttaagtaagttaaaagatgaacgactattaagatgtg

SEQ ID NO: 215039 - DNA, 75 bp, Artificial Sequence
  Synthetic
tgatagcaataaaagataataatttattatggtataaaagtatgataagagcaaattcctggatgagaacttttg

SEQ ID NO: 215040 - DNA, 75 bp, Artificial Sequence
  Synthetic
ttgagtatgataatggttggtatcaactatgtgttaagatacaacgcgctatcgataacggattggagatagaga

SEQ ID NO: 215041 - DNA, 75 bp, Artificial Sequence
  Synthetic
atgtagactttgatttaactcaaaacagcatcgaacgagtcaatctcaatatagctataattcagaagggtgtca

SEQ ID NO: 215042 - DNA, 75 bp, Artificial Sequence
  Synthetic
aagctgatttacctaagtatgatccaaaatttgaatataacataaaacatccaacccgtgagaatggtttcctta

SEQ ID NO: 215043 - DNA, 75 bp, Artificial Sequence
  Synthetic
atcatactctatctaagccatatttagatgccagtcttgaacacgcatatcttagttctagatacaatgatctga

SEQ ID NO: 215044 - DNA, 75 bp, Artificial Sequence
  Synthetic
actactatgttcttaaggaatgtagtgttgagatatatatgaaggatgataacggtatacctgatccagcaatat

SEQ ID NO: 215045 - DNA, 75 bp, Artificial Sequence
  Synthetic
tgatgtatgaccatttggataagccaagtttgaacagaataagtgatagacgtagttacacaactaactacatta

SEQ ID NO: 215046 - DNA, 75 bp, Artificial Sequence
  Synthetic
tacgtggttgggacatcagtactatacctgagtcaattcaactgccttctggtgtcgtctttaatgttagaaaag

SEQ ID NO: 215047 - DNA, 75 bp, Artificial Sequence
  Synthetic
atgccttaagactatatggcataaatccaccatttataaatgccgtttaagacagaaaaattgcaaatttaaatc

SEQ ID NO: 215048 - DNA, 75 bp, Artificial Sequence
  Synthetic
cttgcatgcgtaggatcaacgatgaagcacctttctatctctatacaagtatatttcaatatgctgcgactagaa

SEQ ID NO: 215049 - DNA, 75 bp, Artificial Sequence
  Synthetic
ctagctttagattgttaatgccggttgaatccgtgcggcatttgtcagtattcgggcctttcccttcggggatct

SEQ ID NO: 215050 - DNA, 75 bp, Artificial Sequence
  Synthetic
tagatatggacgatccatacacacggatttggttgaagtattttatcggagctgaagacttcttctcatataatg

SEQ ID NO: 215051 - DNA, 75 bp, Artificial Sequence
  Synthetic
agtattcgggcctttcccttcggggatctaccacattggctcggtattggcgcgttggcgactgatataaccgac

SEQ ID NO: 215052 - DNA, 75 bp, Artificial Sequence
  Synthetic
gtagaataaactaggaattgaaatctgaactgtcaaacttaaacggaatttttgcggaaagtcattatttcgtat

SEQ ID NO: 215053 - DNA, 75 bp, Artificial Sequence
  Synthetic
gtagagttatagagtgtgacaaaagtctattagctcataaacgcttcgagatgatgatagctgctcaacgtgcag

SEQ ID NO: 215054 - DNA, 75 bp, Artificial Sequence
  Synthetic
tcaaaatcattatgaataacgttaagggtatgcttcaagagttatgtgttaaacgtggattggaactgcctgttt

SEQ ID NO: 215055 - DNA, 75 bp, Artificial Sequence
  Synthetic
cattgaaatatgacatggttggaaatgatatctttaaggagtgtatgcttgaagcgtttgaaaatataattcgtg

SEQ ID NO: 215056 - DNA, 75 bp, Artificial Sequence
  Synthetic
acgaaaaattgtctaaagttggtcctgaccatgcaccaaccattactgttaaattaacagctaatggtattgaag

SEQ ID NO: 215057 - DNA, 75 bp, Artificial Sequence
  Synthetic
atccaatatataattcatatcggcttagaggtgcatttggcgatctaaatcaacatgtgtttgcgaggacggatt

SEQ ID NO: 215058 - DNA, 75 bp, Artificial Sequence
  Synthetic
tgattgaggccgctagctcacgagctcaagctgaaaagctggcagcagcaacgttgtatgaaaagatgaaacatc

SEQ ID NO: 215059 - DNA, 75 bp, Artificial Sequence
  Synthetic
cacctgcattgaacatctcaatggttggggtcgagtcaactagttttagaatgagagaggggacggggataactg

SEQ ID NO: 215060 - DNA, 75 bp, Artificial Sequence
  Synthetic
ttgaggtgcatgatgaaaggaagagcgtttcaattatgagtattttgatggtatcgtttgctaatgcacttatta

SEQ ID NO: 215061 - DNA, 75 bp, Artificial Sequence
  Synthetic
actctgattcccgtatcaacttgattgacggtgaatcatttgaggcttcactgcagacccttcgtgattacggtc

SEQ ID NO: 215062 - DNA, 75 bp, Artificial Sequence
  Synthetic
ataaggtaatcgacttattctcgacgtgtaaacaagatatcatattttgctctgaagtagatgaagttactgatg

SEQ ID NO: 215063 - DNA, 75 bp, Artificial Sequence
  Synthetic
ttagtaaaaatgcagacttacttcaacgtgcagttagatttcctattaatagggttaattgtaaattaggcttct

SEQ ID NO: 215064 - DNA, 75 bp, Artificial Sequence
  Synthetic
atgttcattttgatccaacattgagtaacctgatgtcaagtggattaacggatcgtagtgcttggaatagattat

SEQ ID NO: 215065 - DNA, 75 bp, Artificial Sequence
  Synthetic
tgaatcgtatggtacttggtttatgtggttatacgggttcgcatggtaattctgctgtggtgaagcagtttactg

SEQ ID NO: 215066 - DNA, 75 bp, Artificial Sequence
  Synthetic
ataaattattatctgatctagctttagagaatggattcaattgcataacgagaaagaatggtaaaggtttgttat

SEQ ID NO: 215067 - DNA, 75 bp, Artificial Sequence
  Synthetic
ggacacgtgacatggggccgaacgtgacgaaagagttttacgatgaggtagtaaatgaggtctttctaacgtata

SEQ ID NO: 215068 - DNA, 75 bp, Artificial Sequence
  Synthetic
ttagaagtttgctaaatgatgatttggtagcaaatgaatctttcaaaaatagctcattaaatgttgcgtttaata

SEQ ID NO: 215069 - DNA, 75 bp, Artificial Sequence
  Synthetic
agtcagctctgcaaatgggtgattttgttgaaccacaatacagacttgatgtgttaatgaaaggtggaacttcat

SEQ ID NO: 215070 - DNA, 75 bp, Artificial Sequence
  Synthetic
caactgaagacaaagaggtcagtatgttatgttacaatcgatgctgtcaaggaagtggttcacccccctccactg

SEQ ID NO: 215071 - DNA, 75 bp, Artificial Sequence
  Synthetic
cagcaagtagcacctttaatcaccataaaataaaagctagaatacgttataattcgccgttcttcactgacgacg

SEQ ID NO: 215072 - DNA, 75 bp, Artificial Sequence
  Synthetic
acttgactttaataggaaagctaactgctgatctagctaacgcttcaggcttaggtaaacacagtgtattcacaa

SEQ ID NO: 215073 - DNA, 75 bp, Artificial Sequence
  Synthetic
atttagattcaaagtccgataaggtggttaaaactgtggacggtaagtaccgtataattaccgaagttgcaacta

SEQ ID NO: 215074 - DNA, 75 bp, Artificial Sequence
  Synthetic
actcattgaagcaggtacttaatgacgaaagcttgaatcataacgataaagtaaccatattattatcacaaagta

SEQ ID NO: 215075 - DNA, 75 bp, Artificial Sequence
  Synthetic
ctttgaaatcgaaaagcgccacgattctgacgcacccagaggacttcatttatgcatctgatgatatgttaaagt

SEQ ID NO: 215076 - DNA, 75 bp, Artificial Sequence
  Synthetic
gccttttgaagaatattcaggttgaagatttgttgactctagtccggtcaacgatatctggtgccgactctcaag

SEQ ID NO: 215077 - DNA, 75 bp, Artificial Sequence
  Synthetic
gccgtgttaaaatgggctctaggttagtgcgtggtacgcgtgataaacgtataataacacctaattacggttcaa

SEQ ID NO: 215078 - DNA, 75 bp, Artificial Sequence
  Synthetic
tacgcatagattacgattaggtcatggtcgttgctgcgattgcaactgccgacaggctcgtcccacagtaaatcc

SEQ ID NO: 215079 - DNA, 75 bp, Artificial Sequence
  Synthetic
cctatttttcaatgctgttatcttcgctttctgctgttcgtttgttatctagtaggataccaaatatgccagctt

SEQ ID NO: 215080 - DNA, 75 bp, Artificial Sequence
  Synthetic
acagtaaatcccacgctgcggcggaggtttgtgaaggcggctgagatcactccattcagtagttaataaaacgac

SEQ ID NO: 215081 - DNA, 75 bp, Artificial Sequence
  Synthetic
tgtccgtttctggtagaataggaacaacttatgaaggtgcattgccgcatgtagttatggctccaatgatggcag

SEQ ID NO: 215082 - DNA, 75 bp, Artificial Sequence
  Synthetic
gtagaaaattctaaatattaacacgacgctttgagattatctcgacaacttttaacagattaaattgaattttgt

SEQ ID NO: 215083 - DNA, 75 bp, Artificial Sequence
  Synthetic
ctttaagtggatcaacaaaatatgccgctgttgctctcgatttctcacaatatgattctagtttacatggcgaca

SEQ ID NO: 215084 - DNA, 75 bp, Artificial Sequence
  Synthetic
aagtaaattcgtcgaaaagtaatcaaaatgtcaaatgcaagatataatatgatatcggctgtttcagctagtggt

SEQ ID NO: 215085 - DNA, 75 bp, Artificial Sequence
  Synthetic
tctcaaaagctcatgctgaaggattacgcaaatatgcaagtttgtatccaaagggctcaaattatgacgatgctg

SEQ ID NO: 215086 - DNA, 75 bp, Artificial Sequence
  Synthetic
tgcaaaaacgataaaccattttgtgttcataaagtagtggcagtaatcgtaatcattgtttcatctggaataact

SEQ ID NO: 215087 - DNA, 75 bp, Artificial Sequence
  Synthetic
agattgttgacttaacgaaagtatcgccaaataaattttgtgacattacagctaagaattacgagacgccattag

SEQ ID NO: 215088 - DNA, 75 bp, Artificial Sequence
  Synthetic
gtagttaatcagattggtcaaaggaagctgtcaactgatgattattttgttctgtccttggtttgtgatgcaatt

SEQ ID NO: 215089 - DNA, 75 bp, Artificial Sequence
  Synthetic
aatatgaaagcgtgggtatagtagctgaggctgcaggtgtaaaatctggtgagttgacaacccaactacgtaata

SEQ ID NO: 215090 - DNA, 75 bp, Artificial Sequence
  Synthetic
agtaatattattgtggtcggtctatctgttgtgggaatgaccgccagttcaaagaccaaacaagtattaactgat

SEQ ID NO: 215091 - DNA, 75 bp, Artificial Sequence
  Synthetic
ctgatccgaataaagctcatacgacgttaactctcaaacggtataactctaagtatgttagaaaaatggatttag

SEQ ID NO: 215092 - DNA, 75 bp, Artificial Sequence
  Synthetic
ggtggtgagaatgcgattgagcttaatcatatgccaaaacgtattgtcaagaaattgctgaaagaagaagctaaa

SEQ ID NO: 215093 - DNA, 75 bp, Artificial Sequence
  Synthetic
ttcacgagaatattgtaggtgacgataaatacgtaatattagtgatgacagatggtaaaccagttacgaagttag

SEQ ID NO: 215094 - DNA, 75 bp, Artificial Sequence
  Synthetic
aatggagtagattttgtcaaatcaataggtaaagatttgaagagtaatgataataagcctgatccttcagcacca

SEQ ID NO: 215095 - DNA, 75 bp, Artificial Sequence
  Synthetic
acttaaagcggttcattgactgtgccgttgatgttgcagctgaaaatcacctcgtcatatcaggtaaacgatctg

SEQ ID NO: 215096 - DNA, 75 bp, Artificial Sequence
  Synthetic
ccaaaatatgagaaaatagatgaatcatttgagttaaagagtgagtttgcaggcaaaagtttgataactgataat

SEQ ID NO: 215097 - DNA, 75 bp, Artificial Sequence
  Synthetic
ttgctggtaatataaagggagaacacattaagatatgggttattaaaggatacattacacaagatgtatttctag

SEQ ID NO: 215098 - DNA, 75 bp, Artificial Sequence
  Synthetic
cgtactgggcaatcatttattgtaacatctgatttagtaaaaccgcttattttagagagtcggtctcagagctaa

SEQ ID NO: 215099 - DNA, 75 bp, Artificial Sequence
  Synthetic
attcgctcgtgtcagaaaagatctcatttagagagatgaagtacgtagacaaactaactactatttatgatatat

SEQ ID NO: 215100 - DNA, 75 bp, Artificial Sequence
  Synthetic
atgttgataacaggtaagattcatccccttcatttgggttaccactttggatcttatttggtttggaatgaagaa

SEQ ID NO: 215101 - DNA, 75 bp, Artificial Sequence
  Synthetic
gtagaaatttgtaaagattaacaatgtcgagtttaaaggaacataggactaataaagcgaattcaagaaacttaa

SEQ ID NO: 215102 - DNA, 75 bp, Artificial Sequence
  Synthetic
tcatgtccatgttaacgaggtttgctacgacaggaccattaatggagttattcatgagagatatcatattaattg

SEQ ID NO: 215103 - DNA, 75 bp, Artificial Sequence
  Synthetic
ataacaggtaagattcatccccttcatttgggttaccactttggatcttatttggtttggaatgaagaaaacgac

SEQ ID NO: 215104 - DNA, 75 bp, Artificial Sequence
  Synthetic
ttcgtagtccagatgaagctccaccaacagataacagtttattgaacaaaggtgaaatattagcacttactttca

SEQ ID NO: 215105 - DNA, 75 bp, Artificial Sequence
  Synthetic
aaggcgttaaaatgggatatcttaactttataccgactgttaagctaattagtgcagttggtggacctgaaatgt

SEQ ID NO: 215106 - DNA, 75 bp, Artificial Sequence
  Synthetic
gtgatgaatacatcaaatcaaaactattacttggtccgaaactgcaaggtttacctcctccatcacttccaccca

SEQ ID NO: 215107 - DNA, 75 bp, Artificial Sequence
  Synthetic
gtccatctgctccagagttacggggtatggctagatacatgcatgattacgataaggataaatttgataccataa

SEQ ID NO: 215108 - DNA, 75 bp, Artificial Sequence
  Synthetic
attcgtacggttatcattgcaatgggtcgttcgccacctatttgctaagagaatcattgattaatgtcagacaca

SEQ ID NO: 215109 - DNA, 75 bp, Artificial Sequence
  Synthetic
atagattatttgccacgttacgcgaacgtaatggtacagaggcctttagacgacaaatcttacgtcaagtgcgtg

SEQ ID NO: 215110 - DNA, 75 bp, Artificial Sequence
  Synthetic
ttttcgctcactgtgcaccaaatttgaataattcagtagctactaatgttgcaaaatcggctgttgcagcaacaa

SEQ ID NO: 215111 - DNA, 75 bp, Artificial Sequence
  Synthetic
aggatgaaatcgttaaaaatgagccactggtatcaccactttggcgtatacatttcagacgcaggaatgggatca

SEQ ID NO: 215112 - DNA, 75 bp, Artificial Sequence
  Synthetic
tcgctagtggtacagttgagcaattaagatactgtcaacttggttcattaggtggtgatctaccagatagatcat

SEQ ID NO: 215113 - DNA, 75 bp, Artificial Sequence
  Synthetic
tcgtagataatgacttggtagctgatacttttaatgatataaagaaattcatgccagaacatgtggatataaagt

SEQ ID NO: 215114 - DNA, 75 bp, Artificial Sequence
  Synthetic
caactttaatggtactatatgagtgtgatgtcgcaggttcaaccacttcagatgattttggtaaaatcaacatta

SEQ ID NO: 215115 - DNA, 75 bp, Artificial Sequence
  Synthetic
tgactgaagatttgatatcaactttgaaagagccagttgctggcagaatggatgataatgttatactgattaatt

SEQ ID NO: 215116 - DNA, 75 bp, Artificial Sequence
  Synthetic
tctatcaaacttgtacttcatcagtttctagcacattatcctggagaatatctaaagtatcaatgccaataacta

SEQ ID NO: 215117 - DNA, 75 bp, Artificial Sequence
  Synthetic
tatttacagtaggtaagttaggtaagtatgatagacccaagtttaagtacaaatttttcttgacagagtataaaa

SEQ ID NO: 215118 - DNA, 75 bp, Artificial Sequence
  Synthetic
gttatatttcaaaatgtttatatgttacaaataccgatttagttccaatgcctggtattaacctaagcattacta

SEQ ID NO: 215119 - DNA, 75 bp, Artificial Sequence
  Synthetic
ctactggcgtagaatcaccatacttaggagcttgtgagggtgttaggatggtgcataagatagttggtttggctg

SEQ ID NO: 215120 - DNA, 75 bp, Artificial Sequence
  Synthetic
cttcagatgtaacctccaagttcataattaaaccaccgttcaataccaaagtattatttttctgttgtgtacgtg

SEQ ID NO: 215121 - DNA, 75 bp, Artificial Sequence
  Synthetic
atgctaatgttaaggtgcttaatccagctgcacggctgagcgctttacttagatctagacccggaacacatccag

SEQ ID NO: 215122 - DNA, 75 bp, Artificial Sequence
  Synthetic
atcgtgagcatacaacattaataaatgatttatttgcgctaactaacattcctaattccggttaaacttagacat

SEQ ID NO: 215123 - DNA, 75 bp, Artificial Sequence
  Synthetic
cttatttaagtggtgaagacatatttggtgtgttaagtagtagagttaatgcccaacaaacttgggtcacagtac

SEQ ID NO: 215124 - DNA, 75 bp, Artificial Sequence
  Synthetic
agacatatcgatcgttttgggaggtctcaccagcctctcaatctttcgagttaatacgagcaagcaaacactgac

SEQ ID NO: 215125 - DNA, 75 bp, Artificial Sequence
  Synthetic
ttgaacttcttgacttttcagcttcagttatacccgacgtaatcgacttttgttcaaagaacatgcaccgttatt

SEQ ID NO: 215126 - DNA, 75 bp, Artificial Sequence
  Synthetic
tgacggataagaatgtcaatctaaccgctatttttgataacacatcgcgtacttatgacgtgtcagccgaaatga

SEQ ID NO: 215127 - DNA, 75 bp, Artificial Sequence
  Synthetic
tcaaacaacgcgttaagatttcaggtagtgagagagctgggatggtgctaacacgtggacttggtctggagggta

SEQ ID NO: 215128 - DNA, 75 bp, Artificial Sequence
  Synthetic
tgaagtacatgctctatatggctagacgcggcagatcagttaaagcaagcacaacaccgacagttgttggtaatt

SEQ ID NO: 215129 - DNA, 75 bp, Artificial Sequence
  Synthetic
tgactataatagatgatgattagttattgttaattgttcatatcgattaaaactaatctctaattcagtttagtt

SEQ ID NO: 215130 - DNA, 75 bp, Artificial Sequence
  Synthetic
tattgttaattgttcatatcgattaaaactaatctctaattcagtttagttcatcattgagttttgaaaactgac

SEQ ID NO: 215131 - DNA, 75 bp, Artificial Sequence
  Synthetic
gtagaaatttcattagaggataacggttgataagtttgtttgtaatgcctaataaaagaagtaataaaggaaaag

SEQ ID NO: 215132 - DNA, 75 bp, Artificial Sequence
  Synthetic
cttcgaaagatgtaaaagttacaagttcagacactaaaacaattaacggtggttcactaaacgatgaaaaagcta

SEQ ID NO: 215133 - DNA, 75 bp, Artificial Sequence
  Synthetic
actcgattttagacgaagcgttcaactcacgtcaagtcaacgattctggcgatcgcttgataacgtcaagctcta

SEQ ID NO: 215134 - DNA, 75 bp, Artificial Sequence
  Synthetic
agatagttaacaatgttctaccaggtcctgaaacattcgcagaaattcgtgatagtaagaaagatggcactgttg

SEQ ID NO: 215135 - DNA, 75 bp, Artificial Sequence
  Synthetic
tgagaggtgagaatcaggctatattgattgatgttaataatgatgtgagtggtgcaacagccgaagcgttttcga

SEQ ID NO: 215136 - DNA, 75 bp, Artificial Sequence
  Synthetic
agagcacaactcaaccgctagctgctgctaatactagggagcttcttgagcaatcgcgattggctgcatctgaag

SEQ ID NO: 215137 - DNA, 75 bp, Artificial Sequence
  Synthetic
gattgagaaaggtgatacctacaaaggagttgctagttgctgcctatcttggtccagatgctgatcgttatgatg

SEQ ID NO: 215138 - DNA, 75 bp, Artificial Sequence
  Synthetic
ctgatcttgacgcgcttagtgctgctctgatagtcggacaagatgaagttagaaagatcagaagcgagaatcttg

SEQ ID NO: 215139 - DNA, 75 bp, Artificial Sequence
  Synthetic
agattaggaagattgggataggtagtccaaatcttgaagtaatcacctctaacaaaggtaggacggctaagtgcg

SEQ ID NO: 215140 - DNA, 75 bp, Artificial Sequence
  Synthetic
ctataatacgtgagaatgttggttttatgaaaatcaaaactggcataaataagaacattcaatgtcgtaaattgg

SEQ ID NO: 215141 - DNA, 75 bp, Artificial Sequence
  Synthetic
caaaagctctgttggatagatatggcttgacttcacccttcgtcattgacatcagcaatatggttgagactgttg

SEQ ID NO: 215142 - DNA, 75 bp, Artificial Sequence
  Synthetic
tttacgataactcaagctactccacagctggttacgattataaacaaatagttgaagcgctcaatgctacgcgta

SEQ ID NO: 215143 - DNA, 75 bp, Artificial Sequence
  Synthetic
ggttcagaggaatgccagaactacaaccacgtgagttaactgaaataagatctgatttgttagtgaccgatggac

SEQ ID NO: 215144 - DNA, 75 bp, Artificial Sequence
  Synthetic
ctgacaggacgtcaataagtacactgtatgatggaacgatcaaggctcaaattattaaagcagctgcttatgagt

SEQ ID NO: 215145 - DNA, 75 bp, Artificial Sequence
  Synthetic
gggagcaggacataatatctttaccagagtacatcagacgcattaagctgagtataccagaaggatacaggatta

SEQ ID NO: 215146 - DNA, 75 bp, Artificial Sequence
  Synthetic
aggaatattcacctaaagagatgaggtatggtaaggtttattatagattcagacaggcatcactgcgtatgctgc

SEQ ID NO: 215147 - DNA, 75 bp, Artificial Sequence
  Synthetic
ttgatatgttaggtgacgaatgctctgatttctttattaaacgtttataccttgatatcaaacataagttaccag

SEQ ID NO: 215148 - DNA, 75 bp, Artificial Sequence
  Synthetic
ctactgcatcttcaactacttcagttgtagccgctatagctcccgatgtcagagtatcatcaacgaccactagtt

SEQ ID NO: 215149 - DNA, 75 bp, Artificial Sequence
  Synthetic
tagctaattcattcctcagtgcacttaagttgactgatatcgagaatgttagagctctctcaattttgtgtgctg

SEQ ID NO: 215150 - DNA, 75 bp, Artificial Sequence
  Synthetic
tgttcaagaatctgcaaatcgaaataaactttacaaagaggtctggaaatgctgggataatggacatgatagccg

SEQ ID NO: 215151 - DNA, 75 bp, Artificial Sequence
  Synthetic
caacgtttgctttgctcttctttcctgatcattcaatctcggatgcgttgtatttatccattcttaaagtgattg

SEQ ID NO: 215152 - DNA, 75 bp, Artificial Sequence
  Synthetic
cctcattcttaggtaaacgcgccatccaagattatcgcgattacaatagtgttcaaatgcgtgatgagttgattg

SEQ ID NO: 215153 - DNA, 75 bp, Artificial Sequence
  Synthetic
gactgaattggcctttcattaatagatgtactcccgaacagttggagttggaggggtcacccttcttctcgaatg

SEQ ID NO: 215154 - DNA, 75 bp, Artificial Sequence
  Synthetic
gtgaaattgggcgatatgacataccattaaatattaactctagaggcaaacacgttctgggtgacatcagtcgtg

SEQ ID NO: 215155 - DNA, 75 bp, Artificial Sequence
  Synthetic
agcttagagctatgtctagagaacgttggagggataataactcttcagttggcctgctagtttcgagtgttttaa

SEQ ID NO: 215156 - DNA, 75 bp, Artificial Sequence
  Synthetic
aattcgcaatttcagcttgctatgacctatttgacacacacatagacgttgtcgcccatattcgtgctatggttc

SEQ ID NO: 215157 - DNA, 75 bp, Artificial Sequence
  Synthetic
cgaatgaagtagccgaaatgttagaccataccagaggcacatatcagattgaaccatcttctcttgtatcatata

SEQ ID NO: 215158 - DNA, 75 bp, Artificial Sequence
  Synthetic
tcatgcatatcggcaaatgggagataactgacacattcgttgatgagatcgatgtgatggctgaaaagaggttga

SEQ ID NO: 215159 - DNA, 75 bp, Artificial Sequence
  Synthetic
gtgaataccatcaactagctcttgatataagtgaagctattaacatcactcgtaccattatttctgagactaaac

SEQ ID NO: 215160 - DNA, 75 bp, Artificial Sequence
  Synthetic
caaccaacgctagacgtttagcttacactaacgctgtcgtgcgttatgtcgatcacatgtggggaaaagagtctg

SEQ ID NO: 215161 - DNA, 75 bp, Artificial Sequence
  Synthetic
ctgatggtaaacaaggtataagtagtacattgggtttattgttaggagctgcagctggagctgatttaaaatctg

SEQ ID NO: 215162 - DNA, 75 bp, Artificial Sequence
  Synthetic
gttataagcgtttcttaaatgatttatgtactcgtaatgacgccactccagccgatgagccattataccgtataa

SEQ ID NO: 215163 - DNA, 75 bp, Artificial Sequence
  Synthetic
tggagtcagttacgaagattgttgagagtaatctctcagcgtttggcataactgaagagatattaatatgtccga

SEQ ID NO: 215164 - DNA, 75 bp, Artificial Sequence
  Synthetic
aaagacatagaattgaaactgatgcaagatttaatggtatattcagacagagtccatttgttgctacaatgccag

SEQ ID NO: 215165 - DNA, 75 bp, Artificial Sequence
  Synthetic
ttgaatatagaagagttcattatactgatttactcaaaatgggtgcgcttgaggcggctaaagttataagcgtcg

SEQ ID NO: 215166 - DNA, 75 bp, Artificial Sequence
  Synthetic
gagttatagtatacggagtgccttttaactacgaataccgtatacattcaggtgacagtagtacggtcagtgaga

SEQ ID NO: 215167 - DNA, 75 bp, Artificial Sequence
  Synthetic
agcagtttgttaatctcgatacgaatggagtgacattaggtgagttggaatgggatatatattttgataatggtc

SEQ ID NO: 215168 - DNA, 75 bp, Artificial Sequence
  Synthetic
ataatgttgttgctgagtgtgatgacatctttggacttggctataagactatgattgtaacaccaccgaatctac

SEQ ID NO: 215169 - DNA, 75 bp, Artificial Sequence
  Synthetic
agccaattgataattacaatgaatataaagttaaatacactagtgcggatgatgaagctatttatattaatgatc

SEQ ID NO: 215170 - DNA, 75 bp, Artificial Sequence
  Synthetic
acatttacatgtacaaacgaacttaataaaggttgttacctcgcaaccgttagtgcaaacctctacgtaagcatg

SEQ ID NO: 215171 - DNA, 75 bp, Artificial Sequence
  Synthetic
ttacctcgcaaccgttagtgcaaacctctacgtaagcatgtggtagtgcttacgctttgttgaagaaaaactgac

SEQ ID NO: 215172 - DNA, 75 bp, Artificial Sequence
  Synthetic
gtagaaaatttcaagattgtttaattttaaagcgtttgttagttatgtcttttgtagaggatgatacgtcttgtg

SEQ ID NO: 215173 - DNA, 75 bp, Artificial Sequence
  Synthetic
ttagagaatttgacagattgttgaaagttttagagtttggttattccgttagtgaagatggaacactacctaaaa

SEQ ID NO: 215174 - DNA, 75 bp, Artificial Sequence
  Synthetic
cttacaataatatgaatgatagaatttattattctttaggtgatatgtttcaatctaattataataacacaagat

SEQ ID NO: 215175 - DNA, 75 bp, Artificial Sequence
  Synthetic
atgtcataccacatggtactaatgccttatttcagaaagtaggttattttaaaattggaaccgaaagagcgaaca

SEQ ID NO: 215176 - DNA, 75 bp, Artificial Sequence
  Synthetic
ggacggctgtgttgaggagcgcagctgcaagtttcgcaaatatcattggagtagaaccgaacggtataaaagcaa

SEQ ID NO: 215177 - DNA, 75 bp, Artificial Sequence
  Synthetic
ttagtttcaaaggaaatggttttagattatatgatggttacatatactcatgttctaattccccgattaatgatt

SEQ ID NO: 215178 - DNA, 75 bp, Artificial Sequence
  Synthetic
ttgttgaccattgctcacgcagatggaagtacgactttgatgatgaacgtaaaattatgctagagcagttggtga

SEQ ID NO: 215179 - DNA, 75 bp, Artificial Sequence
  Synthetic
tgaggtataaacgtaattacatgagaatgtttgataagattaatcatataaattcaactgatggtttattcattg

SEQ ID NO: 215180 - DNA, 75 bp, Artificial Sequence
  Synthetic
ctaaaattgaaaatgaccacttcacttccatgtttacatcgccgaggcacgttaagctagttgataatgacgtta

SEQ ID NO: 215181 - DNA, 75 bp, Artificial Sequence
  Synthetic
tatatagtgggcatttaataagggcgatggctggatctgcttctatcgatgacggtcgtcttaaaaatcagttga

SEQ ID NO: 215182 - DNA, 75 bp, Artificial Sequence
  Synthetic
gcacacagggacttttaatgacgcatgaaaggtactttttaataggtgaagctcctggtaatcattattcattat

SEQ ID NO: 215183 - DNA, 75 bp, Artificial Sequence
  Synthetic
ataaaagatttatgaacaaagaaaattgtttactgatagaccccagggatgtccattcaagtgtagtcgatatcg

SEQ ID NO: 215184 - DNA, 75 bp, Artificial Sequence
  Synthetic
tcagacatgagaagagattcttcacaagggcagacattatgcgtatagctgaaatagcagcctcgaatcaacata

SEQ ID NO: 215185 - DNA, 75 bp, Artificial Sequence
  Synthetic
ttaactttctgctccgtatcgatatacgtaatgacaagcctcataaaggagacggagcttataattctaagtggg

SEQ ID NO: 215186 - DNA, 75 bp, Artificial Sequence
  Synthetic
agtttttgaaaacttctgtgaatgtttatatccttagtcggatcgagctaaattttaaatcaaaggagttgttcg

SEQ ID NO: 215187 - DNA, 75 bp, Artificial Sequence
  Synthetic
gaaaagtgaccttggttcgttatgaatagaggaagcttgaagaaggggcctccgggcccaacatccaaccgtccg

SEQ ID NO: 215188 - DNA, 75 bp, Artificial Sequence
  Synthetic
tcggttggaccgcccgactcggcgggaaaacgagtcaaacaagtggccccaccaccaactaggggtcacatggag

SEQ ID NO: 215189 - DNA, 75 bp, Artificial Sequence
  Synthetic
agaggactctctctcttaaccaagaacgacaatgtgtcgcgacaggcaaaacggcaacgaaaccctcggcaacag

SEQ ID NO: 215190 - DNA, 75 bp, Artificial Sequence
  Synthetic
ctttctggaatctttggcggtggtgttggcgcctggctgcgtgtgctacacatggacatcggaacggcaatctta

SEQ ID NO: 215191 - DNA, 75 bp, Artificial Sequence
  Synthetic
tggcttgccctggcaacggcatctctcggacagcgtatgtttaagcaactgaactctcttcgtaagcgcgtgaag

SEQ ID NO: 215192 - DNA, 75 bp, Artificial Sequence
  Synthetic
cgcctcgaaaaacaacgtagtggaccgaaccttgtcatgatcattgggctcttggctcttggcttatgctatggt

SEQ ID NO: 215193 - DNA, 75 bp, Artificial Sequence
  Synthetic
gagatgcttcgctatctatcggacggaaaaggagctctcaggctggaacgcgaggatggaagcattgtggacgtg

SEQ ID NO: 215194 - DNA, 75 bp, Artificial Sequence
  Synthetic
gctttttataagctaccgagcgatgcctgccctggtggaacggttattgaaaagcattgtccattggtaatcagg

SEQ ID NO: 215195 - DNA, 75 bp, Artificial Sequence
  Synthetic
atgagtgatctggaaaatatcgattgtggatcaagcgttgaagggtttcatctacggtatcaccgttgtgtgccc

SEQ ID NO: 215196 - DNA, 75 bp, Artificial Sequence
  Synthetic
caagtgcgacgtcgacgagctccccaaccacaagtctcaaaccaagttggcttgttggaggaagtggagatgatt

SEQ ID NO: 215197 - DNA, 75 bp, Artificial Sequence
  Synthetic
ggcttcaggttctttcgtgaaaatgttcccgtcatcgtggtgtgcttgctagtcgcagctgttgcaatgcgttgg

SEQ ID NO: 215198 - DNA, 75 bp, Artificial Sequence
  Synthetic
ccgatgtggagcgtagtgttgatcagcgtcctcacatggaacgtggtcaaggcgtcttccattgagccgttgtat

SEQ ID NO: 215199 - DNA, 75 bp, Artificial Sequence
  Synthetic
accatctcggcaactggaacctcgctgactcatgctcgtttgctctcgaatgaaatatactcaatctcaactgag

SEQ ID NO: 215200 - DNA, 75 bp, Artificial Sequence
  Synthetic
cgtgggttgattcacttggacatccacaatgtaacggtgcgtggagaaagaccattcaaaacccttctcacaaag

SEQ ID NO: 215201 - DNA, 75 bp, Artificial Sequence
  Synthetic
tgtgatgttgtggagagtttctcagaggacacttgccctggcggatcacatttggacatggcccggatcaggcga

SEQ ID NO: 215202 - DNA, 75 bp, Artificial Sequence
  Synthetic
cacaatcgtacatgcaaagtcgactcattcaatcgcggttggggaactggctgttttgagtggggacttggacaa

SEQ ID NO: 215203 - DNA, 75 bp, Artificial Sequence
  Synthetic
gtcgctacttgtgttgaagtgagttgtgcaagccacacaaatgtctctgtgctcgttgattccatcatccaagca

SEQ ID NO: 215204 - DNA, 75 bp, Artificial Sequence
  Synthetic
aaggtgagtatggaaattcatggccatcaggacacccagtccatcgtgagggatgtcccgacccaattccaattt

SEQ ID NO: 215205 - DNA, 75 bp, Artificial Sequence
  Synthetic
ggcgacgttggcaccatcacgctcacgtgtggtgtcacaacagaccgcatagctggacactactatcacattcgt

SEQ ID NO: 215206 - DNA, 75 bp, Artificial Sequence
  Synthetic
gagggagtcaaagctggattggtacttcgtgaggccgtggattcttggcctggcatgatcaaaatgggtgggttc

SEQ ID NO: 215207 - DNA, 75 bp, Artificial Sequence
  Synthetic
acttccggcatggacaaaattgtcagatggggaattacaactgctaatgaaataaagatcgatggtctcatcaac

SEQ ID NO: 215208 - DNA, 75 bp, Artificial Sequence
  Synthetic
cctcaaattgattggcaaacttcggtgcttagggacatacgatccatttctttcacgtgcgaaatgatctttgac

SEQ ID NO: 215209 - DNA, 75 bp, Artificial Sequence
  Synthetic
aacatctcgttcagcagtcttcccctgtgtgcggcaaatgccagtggcactttcatccaaaatggatatggccag

SEQ ID NO: 215210 - DNA, 75 bp, Artificial Sequence
  Synthetic
gatggtgttgttgccgtgagtctagaggaagttatggaacaagcgtgtagcttccctctcaagtgcaaagggtgc

SEQ ID NO: 215211 - DNA, 75 bp, Artificial Sequence
  Synthetic
acactgacatgtcctagtcttgtcattgctgaaaagagccaagttggccgggcgcatgttatctgtggaaatgga

SEQ ID NO: 215212 - DNA, 75 bp, Artificial Sequence
  Synthetic
acaagccatgtcgagtttggtacaacagtggtgccagtggagtgtctggttacacccgtaacccaggcgtggcgg

SEQ ID NO: 215213 - DNA, 75 bp, Artificial Sequence
  Synthetic
ctattgtctcacgtgactggtcgctacacaaaaaccggtgtgacaggactgggaagcgtctgggaggatctgctg

SEQ ID NO: 215214 - DNA, 75 bp, Artificial Sequence
  Synthetic
ggaaacttgcggttctcatggtcttggttcccgagtagctggctggtcatggctttcataggtttggcgctattc

SEQ ID NO: 215215 - DNA, 75 bp, Artificial Sequence
  Synthetic
cttgttttcggaagagttggatcttttgttgtttttgtggtgatcatagctgtgtacgtgcggtcggtttctgct

SEQ ID NO: 215216 - DNA, 75 bp, Artificial Sequence
  Synthetic
gacgtcggatgcggagtggacacaacaaggaagacaatctcctgcggaagtggcgctttcgtttggaaacaactt

SEQ ID NO: 215217 - DNA, 75 bp, Artificial Sequence
  Synthetic
ggattgggggccacaaaggatcacgcagtggaactggatgattacgagttcaccgatttgtatatcaaggacatg

SEQ ID NO: 215218 - DNA, 75 bp, Artificial Sequence
  Synthetic
ttcgatggaaccaacaaaccttgtctgatatgcgaggactcattgcaatgtgccgctctccgttcagcagcttac

SEQ ID NO: 215219 - DNA, 75 bp, Artificial Sequence
  Synthetic
tcggctgcattccgtatgagcccggccctagtcagtgtgaacgacaccctatcccgcactcgacagtttattgaa

SEQ ID NO: 215220 - DNA, 75 bp, Artificial Sequence
  Synthetic
accaggaagcgaactatgactgtcacattgaatttggttgaatataaaattggatcgtatgtcactcatggacgg

SEQ ID NO: 215221 - DNA, 75 bp, Artificial Sequence
  Synthetic
cttgagggggatatgggattgttgccaactctctttgggtcatttcctgagaaaccctctgacaaggttatccgg

SEQ ID NO: 215222 - DNA, 75 bp, Artificial Sequence
  Synthetic
attgtggcgtcaagacctgatatccggcgtctctgtggaaaagcggtttctttccagtttcagtacacagggttt

SEQ ID NO: 215223 - DNA, 75 bp, Artificial Sequence
  Synthetic
cgacgggctttgtatggatccaatgtccaggtgaaagtgtcaaagaacataaccaatcattgccccacatatctt

SEQ ID NO: 215224 - DNA, 75 bp, Artificial Sequence
  Synthetic
gctggtgttgtcgtaaaaaatgggcggaccattatcactgatggcatgttttggatggaaagtgaaaacagggat

SEQ ID NO: 215225 - DNA, 75 bp, Artificial Sequence
  Synthetic
ggagtaaagcaaatagtgtctctcgagatgactcagtcacatcgatgtgtgtggccagaggaatacacccctgag

SEQ ID NO: 215226 - DNA, 75 bp, Artificial Sequence
  Synthetic
acacttcaagatccaagagacatgaacatcttcatccccccggcctggggaggaccgatctcgaaagtcaaccac

SEQ ID NO: 215227 - DNA, 75 bp, Artificial Sequence
  Synthetic
attcctgggtataagatgcagacagactttccgtggaatgccagtgacatcaccttggtcgaaggtcctgttcca

SEQ ID NO: 215228 - DNA, 75 bp, Artificial Sequence
  Synthetic
ggaactgaagttaaagtcgatgcaagatgcaatggacgcatgcgagcgaaggtagttgacccgaaaggaaatggg

SEQ ID NO: 215229 - DNA, 75 bp, Artificial Sequence
  Synthetic
tcctggtgttgccagtcatgcaataggatcgtgcatttcaaggttggtgaccagctcgtgtacccaatggagata

SEQ ID NO: 215230 - DNA, 75 bp, Artificial Sequence
  Synthetic
cagcttggaactatgcctgagataccaaaacctaagccaaaaatcgtggaggagccaataggagatgaatatgac

SEQ ID NO: 215231 - DNA, 75 bp, Artificial Sequence
  Synthetic
cctgaagttgatgacatcctacacaactacggaaaagctcatgcctgttcggattttcgctcgtcgaactcacgg

SEQ ID NO: 215232 - DNA, 75 bp, Artificial Sequence
  Synthetic
acaggagttgggttcgacaggtccattctgaatctcctgtgtctcgcggtgtctcttcagttgatcggagcgaaa

SEQ ID NO: 215233 - DNA, 75 bp, Artificial Sequence
  Synthetic
acacgggtttctacactgacgcgcctggttctcaccatcctagccatgctcatatttggaatgcccaacatattt

SEQ ID NO: 215234 - DNA, 75 bp, Artificial Sequence
  Synthetic
tcatctgtggggctttctgcttgggtcttgttggcagcatcatcatctttgcggccgcgcgacgtcctcatgaat

SEQ ID NO: 215235 - DNA, 75 bp, Artificial Sequence
  Synthetic
ctgtggatcattctacaaaccgggagctcagcagtactcctgctggggttcatgatccggaagagaatgtccatc

SEQ ID NO: 215236 - DNA, 75 bp, Artificial Sequence
  Synthetic
gtgctcgggactcaacacatggtagccctagtgtgtgtgcatttcctcttctcagtggtcgatcggcatcagaaa

SEQ ID NO: 215237 - DNA, 75 bp, Artificial Sequence
  Synthetic
acactttatggcttgctagaactgtcagcggcagcgattctaatcggggcctacaacggaatatctcagacactc

SEQ ID NO: 215238 - DNA, 75 bp, Artificial Sequence
  Synthetic
ccaccggaagtcttggtattttgcctcgtgatgggttggaagacgtccctggccattctcaccgttgtgtctctg

SEQ ID NO: 215239 - DNA, 75 bp, Artificial Sequence
  Synthetic
atgttcagtttgcacgcatgctacaggttcgtcgtgaaatttcacagcacgaaaaacgggtacagggactatggg

SEQ ID NO: 215240 - DNA, 75 bp, Artificial Sequence
  Synthetic
gcgagttcgtggttctggattgtctccttcgcgagcgctggggcgatttgggccgcggaaagagcgcagcaacca

SEQ ID NO: 215241 - DNA, 75 bp, Artificial Sequence
  Synthetic
acaatagcagcgactctagcctttaccatgatagttctgtttctgttcatggaccagtccagcgtgagtatgaat

SEQ ID NO: 215242 - DNA, 75 bp, Artificial Sequence
  Synthetic
cttgaatttctgtccaaaggtgaaatccccgaaggtgttcgaattgaagatgatgaaggtagagatctcgccgac

SEQ ID NO: 215243 - DNA, 75 bp, Artificial Sequence
  Synthetic
ctgcgaggacgttacggagatgagggaatcgtggtgggcacacagcagacctccatgcatttgcctgaaatggtg

SEQ ID NO: 215244 - DNA, 75 bp, Artificial Sequence
  Synthetic
attgtcgtcctggtcggatgtgcgttaacctctgtatccttctttcttggagccttgtacgtagttgtagcttcc

SEQ ID NO: 215245 - DNA, 75 bp, Artificial Sequence
  Synthetic
agcacaaatctaccacttcatgtggtgcgctacatccgcataagactttcggagcagaacagatctgacgatctt

SEQ ID NO: 215246 - DNA, 75 bp, Artificial Sequence
  Synthetic
cttggcattggagtgtccggcggtcctgagctcttgaccagcttcggtgagctccccaatggggtctatcgaatc

SEQ ID NO: 215247 - DNA, 75 bp, Artificial Sequence
  Synthetic
acggtgaggagcctttttggaactcgacaaaggggagtgggctttgcaaagaacggagtttttcacacactaatg

SEQ ID NO: 215248 - DNA, 75 bp, Artificial Sequence
  Synthetic
catgtcactagaggtgaaccattgaattggcgtggaaaagctgttatcccccactctgggagtgctttacgggat

SEQ ID NO: 215249 - DNA, 75 bp, Artificial Sequence
  Synthetic
gtagtttcgtatggcggtccatggcaactcgagacccctaccgcaaccgatgacatagtcttgatggcttgtaga

SEQ ID NO: 215250 - DNA, 75 bp, Artificial Sequence
  Synthetic
ccagatggaactgtggagtatcgccgatacagacctggactaatgtccattgatgacgaatccgtgatgtttgtt

SEQ ID NO: 215251 - DNA, 75 bp, Artificial Sequence
  Synthetic
agtgatgactttggaaaaggatcatccggctcaccattcttcattaatggtgaccccgttgggttctatggtttc

SEQ ID NO: 215252 - DNA, 75 bp, Artificial Sequence
  Synthetic
gggttttatgtggatggtatctaccgttcgatcgtggccggtggaaagcccactgatgtcaatgaacctatcggt

SEQ ID NO: 215253 - DNA, 75 bp, Artificial Sequence
  Synthetic
gacgatgccaccaggcgtttcatcacatggcatcccggaaaaggcaagacgcgccgggtcattgtcgaggaaacc

SEQ ID NO: 215254 - DNA, 75 bp, Artificial Sequence
  Synthetic
aaacagaattacgcggccaacctgcgaaccatcatcctgaccccaacccgagtcgtcatggctgaggtgattgaa

SEQ ID NO: 215255 - DNA, 75 bp, Artificial Sequence
  Synthetic
gcattgaaaaactacgacatcaagtgtgacaaaaatttgtcgtactgcacaagaaaccttgtcacagttgcctgc

SEQ ID NO: 215256 - DNA, 75 bp, Artificial Sequence
  Synthetic
cacgcgaccttcaccaaattcgtcttgagccatggagtcaagaaggtgcgggtggctctgataatcatggatgaa

SEQ ID NO: 215257 - DNA, 75 bp, Artificial Sequence
  Synthetic
tgtcacttcatggaccccatgtcaatagccgctcgaggcataatggaacaccttcatggtttgggaacaaagctc

SEQ ID NO: 215258 - DNA, 75 bp, Artificial Sequence
  Synthetic
atgtatctcagcgcgacccctccgggtcacacccctgactctggatcaaattatccgatatgtgaccaagccatc

SEQ ID NO: 215259 - DNA, 75 bp, Artificial Sequence
  Synthetic
aatttcccggcgtggctcagtgctgcgtgggtaaacaatgtgcgcaagaccaccgggtcaaagaaaacaatcatg

SEQ ID NO: 215260 - DNA, 75 bp, Artificial Sequence
  Synthetic
tttgttccctctcacaaccaggccaatgcattggcagctgcgatccccggtgcggtcccactgcatcgtgcaaat

SEQ ID NO: 215261 - DNA, 75 bp, Artificial Sequence
  Synthetic
ttctctgccaactatgcccaggccagtagtgaagagacaaccttggtcgtgtcgacggatatctcggagatggga

SEQ ID NO: 215262 - DNA, 75 bp, Artificial Sequence
  Synthetic
gccaaccttggagtcgacctcgtcattgatactcggaaagcgttacgaccaatggtggactcagcgacgagggtt

SEQ ID NO: 215263 - DNA, 75 bp, Artificial Sequence
  Synthetic
aagctagaggaaacgcccataacaacatcatcgatggtacagcgtagaggcagaaccggcagacgggaacctgga

SEQ ID NO: 215264 - DNA, 75 bp, Artificial Sequence
  Synthetic
atgtacgtgtacccagtggacagtaggacagaggagaatcctgtctcgtgggtgtgttggccagaggcacaaatg

SEQ ID NO: 215265 - DNA, 75 bp, Artificial Sequence
  Synthetic
atattggatcaacttggaatgacctttatgctagaggaggccacttttagccagcccccaggtaggtttacctta

SEQ ID NO: 215266 - DNA, 75 bp, Artificial Sequence
  Synthetic
gttggggaggatcgtctccgtttctctaaattgatggacagagacgacatcccaatatggttggcctggaactgg

SEQ ID NO: 215267 - DNA, 75 bp, Artificial Sequence
  Synthetic
gctgaagctggtgaccgacgccactccgcattattccaaggaaaaagcactggacaaatcctcgagagtcgcttt

SEQ ID NO: 215268 - DNA, 75 bp, Artificial Sequence
  Synthetic
ggaaagcaggagtataagccacagtacgttgatgacaggtttgaaaacctcgaatgggacacaagaaagctgtcc

SEQ ID NO: 215269 - DNA, 75 bp, Artificial Sequence
  Synthetic
attgaattctatctcaactgccgtagctcgcaaactttctatgacctgttcaagagtattgactgggctaacata

SEQ ID NO: 215270 - DNA, 75 bp, Artificial Sequence
  Synthetic
tggaagaaaactctctcagcactctgggacattcgagatacattcagtgggacattgaaggaccaggtcatggcc

SEQ ID NO: 215271 - DNA, 75 bp, Artificial Sequence
  Synthetic
gagcggtccctgaccactgggatggcctttagcctgggaatactccttgtcttggcggttatcgtggtcgtgtgg

SEQ ID NO: 215272 - DNA, 75 bp, Artificial Sequence
  Synthetic
atcctggggtttctggtagcaatgctcaagcccacgaagatgtcttatgagtcgatgccgtctggggaccctttc

SEQ ID NO: 215273 - DNA, 75 bp, Artificial Sequence
  Synthetic
aatggtggcatggtactcacagcccctagcgtcctccactacatgggagttcctctcggattctgtgtcatcatc

SEQ ID NO: 215274 - DNA, 75 bp, Artificial Sequence
  Synthetic
tttcttgctatgttcattgtgtatccggtcctctataaggctataggcaaccgcagttacatggacagtgacctt

SEQ ID NO: 215275 - DNA, 75 bp, Artificial Sequence
  Synthetic
gtcaaatgggtgatcattggatcatgttttgtctgtggggttctcgcatgggaaatgcgcttgtttcctaacata

SEQ ID NO: 215276 - DNA, 75 bp, Artificial Sequence
  Synthetic
cgtggggatatcatggagatggcttctgccatgaaggaaccacaggaaactcaaagtcaagcatctactatctcg

SEQ ID NO: 215277 - DNA, 75 bp, Artificial Sequence
  Synthetic
gggtcattcttcacttctcgcgttaggggggagagggccacgatgttggactcgctgcaggtcttcttcttcgta

SEQ ID NO: 215278 - DNA, 75 bp, Artificial Sequence
  Synthetic
actgtgctaatgaatgaattcatcatctgggtgcaggagaactggatcgcacagatgtacgtgatgaaacacccc

SEQ ID NO: 215279 - DNA, 75 bp, Artificial Sequence
  Synthetic
gaaatggtgagcactgtgggcggattcagacttgacagaattccgttcagagccgtgcttccatctggtttcgcc

SEQ ID NO: 215280 - DNA, 75 bp, Artificial Sequence
  Synthetic
atagtcaccacatccagcttgtccagctcactcgtcggtcttgcagcgtcaagcttgttcctaaccatcgcgtat

SEQ ID NO: 215281 - DNA, 75 bp, Artificial Sequence
  Synthetic
tatcagaacaagtggaacgcaacacccaaaataatctccgctatggacgcccgtgatcaaaaacatgaccgtccc

SEQ ID NO: 215282 - DNA, 75 bp, Artificial Sequence
  Synthetic
acggacattacaaaccgagtcccactggacaacaccagatccgtcatgtatgcttttgggatgttttttagcatg

SEQ ID NO: 215283 - DNA, 75 bp, Artificial Sequence
  Synthetic
gcttgggtgttctgcacccggtctcgatgggatgctggcctttgcaccctggttgtcattgcatgcatgtggcaa

SEQ ID NO: 215284 - DNA, 75 bp, Artificial Sequence
  Synthetic
attctgcacccacgctcacgtgtgcatgatgtgatggactttggatcaatgttgtcggcgattggaatttttgag

SEQ ID NO: 215285 - DNA, 75 bp, Artificial Sequence
  Synthetic
ttggatttcctgttctataagttcatccacatcgctgctcgtgggttgggcgggatgcctccattcaatcagttt

SEQ ID NO: 215286 - DNA, 75 bp, Artificial Sequence
  Synthetic
cgcgctctggagaaatccacagctgtaggccttggtataaaatggaaaactctgcttaactctctggacaaggac

SEQ ID NO: 215287 - DNA, 75 bp, Artificial Sequence
  Synthetic
accttcgacaagtacaaggtccgaggggtcaatgagaccgaacgaggagactatgtgtctagaggtggcttgaaa

SEQ ID NO: 215288 - DNA, 75 bp, Artificial Sequence
  Synthetic
ctggatgaggtcattcggaaatacaattggaaaccaaacggacgggttgttgacctgggttgtggtagaggcgga

SEQ ID NO: 215289 - DNA, 75 bp, Artificial Sequence
  Synthetic
tggagtcagagagttgtcatggaggagtccgtgtcgtctgtgtatggatacacagttggaggacaagaaaaagaa

SEQ ID NO: 215290 - DNA, 75 bp, Artificial Sequence
  Synthetic
gtaccccagaagttcctgactaagggctacaacttgactaacctcaaatctggagtagacgtgtacaggctcccc

SEQ ID NO: 215291 - DNA, 75 bp, Artificial Sequence
  Synthetic
ccaactcgttgtgacacaatcatgtgtgacataggcgaaagtgatccgaatcctgctaaggaaaaaacccgaacc

SEQ ID NO: 215292 - DNA, 75 bp, Artificial Sequence
  Synthetic
ctcaaggttctcgagttgctcgagaactggttgagtgtgaatcccagcgctgaatttgtgtgcaagattctctcc

SEQ ID NO: 215293 - DNA, 75 bp, Artificial Sequence
  Synthetic
ccgtattcgttggaagtgctgcggaagatcgaaactttgcaacagaagcacaagggtcgcctagtacgcttaacg

SEQ ID NO: 215294 - DNA, 75 bp, Artificial Sequence
  Synthetic
tatagccggaacagcactgcagaaatgtactacgtgtctggcagcagatccaacgcagtaagggatgtgtacatg

SEQ ID NO: 215295 - DNA, 75 bp, Artificial Sequence
  Synthetic
actctggctgcccttgttgcacgattttctcggcacttggatagtatcgtcctgccccctcccgatttactcaag

SEQ ID NO: 215296 - DNA, 75 bp, Artificial Sequence
  Synthetic
ggaacccgagccgacccaactgccagcgtagcttctatggatgtgagtgatatggaggatcgtgtcaaacgaata

SEQ ID NO: 215297 - DNA, 75 bp, Artificial Sequence
  Synthetic
aaacatgaaaaccagaccacctggtttgtcgatccagaacatccgtacaaaagcttcaagtactttggatcattt

SEQ ID NO: 215298 - DNA, 75 bp, Artificial Sequence
  Synthetic
gtgactgatgatgttaaggttggtgggcaggcaattaacccgctcgtaagaaaaatcatgtggccttgggaagcg

SEQ ID NO: 215299 - DNA, 75 bp, Artificial Sequence
  Synthetic
ataacttcggttgttggattcctcatgaccgacgtctccacatactcgcaacaaaaagtattgcgggaaaaagtg

SEQ ID NO: 215300 - DNA, 75 bp, Artificial Sequence
  Synthetic
gacacagtgatcccacctcatccaccacaagttcgagaagttaacaaactcatcacccaacatctggtgaaactc

SEQ ID NO: 215301 - DNA, 75 bp, Artificial Sequence
  Synthetic
ttccggtcacgcaatctccaacctcgcatcctgtccaaggaggagttcatcgcgaacgttcggaatgatgcggcc

SEQ ID NO: 215302 - DNA, 75 bp, Artificial Sequence
  Synthetic
ataggatcatggagcaagaatgtaccgtggagagatgtccaggatgccgttcaagatcaagccttctggaacctc

SEQ ID NO: 215303 - DNA, 75 bp, Artificial Sequence
  Synthetic
gtcggacaagagcgacgccttcatctccaagggaaatgcgagatgtgtctttacaacactatgggaaagaaggag

SEQ ID NO: 215304 - DNA, 75 bp, Artificial Sequence
  Synthetic
aagaaaccgagcctggctggtgaggccaagggatctcgaaccatctggtacatgtggctaggaagccgtttcctc

SEQ ID NO: 215305 - DNA, 75 bp, Artificial Sequence
  Synthetic
gaatttgaggctcttggtttccttaacgctgaccactgggtgagccgggaaaacttccccggtggtgttggaggt

SEQ ID NO: 215306 - DNA, 75 bp, Artificial Sequence
  Synthetic
ctaggagtgaactacttcggatattacctaaaagacatcgctggtcgaggtaaatatctctttgctgacgacata

SEQ ID NO: 215307 - DNA, 75 bp, Artificial Sequence
  Synthetic
gctggatgggacacaaaaatcagctctgaggaccttgaagatgaggagaccttgttaaccgagctcacagccaat

SEQ ID NO: 215308 - DNA, 75 bp, Artificial Sequence
  Synthetic
ccataccataaagctctaattagagccaccatgaagctcgcttaccagaacatcgttgccatgttcccacgaacc

SEQ ID NO: 215309 - DNA, 75 bp, Artificial Sequence
  Synthetic
cattcaaagtatggtagtgggacggtcatggatgtggtgggacggcgagatcaacgaggctctgggcaagtagtg

SEQ ID NO: 215310 - DNA, 75 bp, Artificial Sequence
  Synthetic
acatatgccttgaacactgtgaccaatggcaaagtacaagtcgctagggtattggagagcgaaggattgctcaac

SEQ ID NO: 215311 - DNA, 75 bp, Artificial Sequence
  Synthetic
gctgacatcaatgtgattgacaagtggcttaccaagaacatggaaaacgtcctgagtaacatggttatagcaggg

SEQ ID NO: 215312 - DNA, 75 bp, Artificial Sequence
  Synthetic
gatgatgtagtcgtctctactgacaacagagagttctcatcctctctcgagtaccttgagctgacgggaaagacg

SEQ ID NO: 215313 - DNA, 75 bp, Artificial Sequence
  Synthetic
cggaagaacattccccaaggtgcaccctcccgaatggagtgcaattgggaaaaagtcgaattctgctcccatcat

SEQ ID NO: 215314 - DNA, 75 bp, Artificial Sequence
  Synthetic
taccatgaaatgtacctaagagatgggcgtaatctaattgtgccgtgtcgacatgaagatgagatcgttgggcgg

SEQ ID NO: 215315 - DNA, 75 bp, Artificial Sequence
  Synthetic
agcaggctacagaaaggaggggttgtcagcttagccgaaagtgcttgcatggcaaaggcatacgcccaaatgtgg

SEQ ID NO: 215316 - DNA, 75 bp, Artificial Sequence
  Synthetic
gccttgtacttctttcaccgacgtgatcttcgcttaggatttgtagccattacctcttctgtccccacaaactgg

SEQ ID NO: 215317 - DNA, 75 bp, Artificial Sequence
  Synthetic
tttcccattggacgcacctcttggtcaattcaccaacatcatgagtggatgacaacatgcgacatgctacgtgtg

SEQ ID NO: 215318 - DNA, 75 bp, Artificial Sequence
  Synthetic
tggaatgacgtgtggatccacgacaacccatggatgaccatgaaggagcccatcaatgcctgggaagatatcccc

SEQ ID NO: 215319 - DNA, 75 bp, Artificial Sequence
  Synthetic
tatcttcataaaaaacaagacattgaatgtggcagtcttattggttccaaggaaagagccacctgggctcgcgac

SEQ ID NO: 215320 - DNA, 75 bp, Artificial Sequence
  Synthetic
atggagaacagcgttctgagtgtccgcaagatcctggactccgaaacaggaaccaataattcgtacaaggatgag

SEQ ID NO: 215321 - DNA, 75 bp, Artificial Sequence
  Synthetic
ctctcggtgatgagtcgtttccggaaggggaatgacgtcatttgagacaaaggtccttgagtccaagttcctatc

SEQ ID NO: 215322 - DNA, 75 bp, Artificial Sequence
  Synthetic
caagaaggaacaccctccccctaacccccccctccaaaagtccccatcccttccccctctcctttctggagtttg

SEQ ID NO: 215323 - DNA, 75 bp, Artificial Sequence
  Synthetic
catctgtctctatcccaagccctcagtggtttaagacagggggtatttggaactgatttccataacccctcatgc

SEQ ID NO: 215324 - DNA, 75 bp, Artificial Sequence
  Synthetic
gcgacttttagagcagggcacgaaagtgtcgggcatgacgcacccgctcccccgagtcccctgaaaatagggtgg

SEQ ID NO: 215325 - DNA, 75 bp, Artificial Sequence
  Synthetic
gcaatgcactcctgagtaggacgggagcccagaatcctacaaaaccctcgccatgggaactggcatgacacagga

SEQ ID NO: 215326 - DNA, 75 bp, Artificial Sequence
  Synthetic
gtggtgacctgtctcatacatgacaccttgaaaccccacccgtgacagcatgggctggcctctaaccctctgggt

SEQ ID NO: 215327 - DNA, 75 bp, Artificial Sequence
  Synthetic
aatgctcgtacatggcagcaatcctggttctcgcaactccagtcgaatcttcgagtacacgggaacaaggatcag

SEQ ID NO: 215328 - DNA, 75 bp, Artificial Sequence
  Synthetic
caatgtttttacgacatcaccaagacgggtggaatgtccaaccccccggtagcatccgtgccaaaatggtggctc

SEQ ID NO: 215329 - DNA, 75 bp, Artificial Sequence
  Synthetic
tcgcaactccggtggaatcttcgatcccatcggagtgagagtcagtaatttttcgcggtgcctcccggaccgtgg

SEQ ID NO: 215330 - DNA, 75 bp, Artificial Sequence
  Synthetic
aatgccggcccggacgtctaggtaggaacgtaggcgtttcggattgtggttgaccgctgggtggtgctcatattt

SEQ ID NO: 215331 - DNA, 75 bp, Artificial Sequence
  Synthetic
gaagcatctctcagagtctcttaccacaacctgaaatgtctgagatagaagtggcggcctatctcattgaaaacg

SEQ ID NO: 215332 - DNA, 75 bp, Artificial Sequence
  Synthetic
ccatttgagcagggcacgaaagtgtcgggcctgacgcacccgctcccccgagtcccctggaaacagggtgggcct

SEQ ID NO: 215333 - DNA, 75 bp, Artificial Sequence
  Synthetic
cgaaaaatccaccgtaggaaggagcccaatcctacaagaaccctctggtcataggcacctgacctgggataagag

SEQ ID NO: 215334 - DNA, 75 bp, Artificial Sequence
  Synthetic
tggcgccttatctcatatttagctagctggtggactcaagcacccccccccatggaatggggtaagagaggcctg

SEQ ID NO: 215335 - DNA, 75 bp, Artificial Sequence
  Synthetic
taaacatcgctggatggctccagcactcttataaattggccgccaagcgatccggagctttcaaaaccggacgga

SEQ ID NO: 215336 - DNA, 75 bp, Artificial Sequence
  Synthetic
gcaacagggaatttcccggggacgcgtaccccctccgtaatgtgaaaaagtatggggaaaagaacccagctaaat

SEQ ID NO: 215337 - DNA, 75 bp, Artificial Sequence
  Synthetic
tatggggaaaagaacccagctaaatctcccaccgatagggagtttggactatcttttctataccataaatgcgct

SEQ ID NO: 215338 - DNA, 75 bp, Artificial Sequence
  Synthetic
acttttttgatcggtgtgaatcgatacaaacagattttgtagagaagttattctaacactcgtgtcaacagtttt

SEQ ID NO: 215339 - DNA, 75 bp, Artificial Sequence
  Synthetic
cgtgttgagaaagaaaacagattcttcggaaatgaaaacccaaaaaagggccgcatcgcggcctatcaatatgct

SEQ ID NO: 215340 - DNA, 75 bp, Artificial Sequence
  Synthetic
gaagcgctttggatctagcgctggccttttcggcctaaagaagatccttatgaagttgctgggagggtttggacc

SEQ ID NO: 215341 - DNA, 75 bp, Artificial Sequence
  Synthetic
agttaggctggttctagccttccttgccttcttcaaattcacatcgctgcgcccttcccctggactcctcaagag

SEQ ID NO: 215342 - DNA, 75 bp, Artificial Sequence
  Synthetic
atggagctcggtagggaagaaagaggccagcagaaccctcaaagggttcaaaaaggacattggacagatgctgaa

SEQ ID NO: 215343 - DNA, 75 bp, Artificial Sequence
  Synthetic
caccatcaacaagaggaagaggagcccagttaattggttctggaccctcagcatgtttggcgtgctaacggcagt

SEQ ID NO: 215344 - DNA, 75 bp, Artificial Sequence
  Synthetic
taaaataggagactaccagggagcgaaaatcatgatagccgagaagtctgatgtgggagtgccaatagacatacc

SEQ ID NO: 215345 - DNA, 75 bp, Artificial Sequence
  Synthetic
tggcgaggatggcatcaacaggtgcatactgcaggccatggatgttggcgaactctgcgctcataccatgacgta

SEQ ID NO: 215346 - DNA, 75 bp, Artificial Sequence
  Synthetic
tgaatgcccaatccttgataagttggttgaacctgaagacatagactgctggtgcaatgcttcggccacctgggt

SEQ ID NO: 215347 - DNA, 75 bp, Artificial Sequence
  Synthetic
gatgtacgggacgtgtttgcacaagtcacaagaacccagaagatcaaggaggtctgtgtcattgccaccccacac

SEQ ID NO: 215348 - DNA, 75 bp, Artificial Sequence
  Synthetic
agagaaaaaacttgagacaagacacgaatcgtggttggagaccaggtcttacctagcccatctggaaaaaactga

SEQ ID NO: 215349 - DNA, 75 bp, Artificial Sequence
  Synthetic
acgctgggtcctgagaaaccccggattcgccctggttgccggtgctctaggttggatgctgggaacgagcaaaac

SEQ ID NO: 215350 - DNA, 75 bp, Artificial Sequence
  Synthetic
ccagaaagttctcatagccggcttgctgctcttagtggctcctgcttacagcattcgttgcattggtgtgtcaaa

SEQ ID NO: 215351 - DNA, 75 bp, Artificial Sequence
  Synthetic
cagagactttgttgaaggtgtgtctggggcatcgtgggtggaccttgtccttgagcatgggacctgtgtgacagt

SEQ ID NO: 215352 - DNA, 75 bp, Artificial Sequence
  Synthetic
catgggtgaaaacagacccaccatcgacatagagcttctcaagacagctgcctccaacatggctcatgcaagggc

SEQ ID NO: 215353 - DNA, 75 bp, Artificial Sequence
  Synthetic
ctactgctatgaggcgaccataagtgatacagtcatggagacaagatgcccgacacaaggagaagcagtgtctga

SEQ ID NO: 215354 - DNA, 75 bp, Artificial Sequence
  Synthetic
caaaaaaggggatggcaactacctctgtaagaaaggatataatgacagaggatggggaaatggatgcggcttgtt

SEQ ID NO: 215355 - DNA, 75 bp, Artificial Sequence
  Synthetic
cggcaagggcagctacatgtcttgcacaaagtttgagtgcaagaaacacaccaaggcccagatcatcctccccga

SEQ ID NO: 215356 - DNA, 75 bp, Artificial Sequence
  Synthetic
aaacctggcctatgatgttgccattgcagtgcactcctcgcaaggagctgtgcacattgacaacgagatagcgca

SEQ ID NO: 215357 - DNA, 75 bp, Artificial Sequence
  Synthetic
ggccacagaggaacacaaggccaaaatcacgttcactccacaagcaccaacggcagaagtggacttgaagtccta

SEQ ID NO: 215358 - DNA, 75 bp, Artificial Sequence
  Synthetic
tggcactatgaccatgacgtgcgaggctcaatcaggcttggacttcagccaattgtatttgatgactctggacaa

SEQ ID NO: 215359 - DNA, 75 bp, Artificial Sequence
  Synthetic
aaaacattggttggtgaacagggagtggtatcacgacctggacctcccgtggatggccggagaggacgcaagata

SEQ ID NO: 215360 - DNA, 75 bp, Artificial Sequence
  Synthetic
caagtattggaacaacaaggaagccctggtcgagttccgagatgcccatgccaagaaacaagaggtggtcgtctt

SEQ ID NO: 215361 - DNA, 75 bp, Artificial Sequence
  Synthetic
aggctctcaagaaggagctctgcattcagctctggcgggagcgacggtggctgaaatggattcagaaaaggcagc

SEQ ID NO: 215362 - DNA, 75 bp, Artificial Sequence
  Synthetic
catcttttctggacacctgaaatgcagactgaagatggacaagctacggctcagaggtgtctcgtacgccatgtg

SEQ ID NO: 215363 - DNA, 75 bp, Artificial Sequence
  Synthetic
tggaggaaaattctcatttcacagaaatcccgcaccaacacaacatgggactgtcaccgtagacataggatactc

SEQ ID NO: 215364 - DNA, 75 bp, Artificial Sequence
  Synthetic
aggggatgctccgtgtaaggtccctatttcagtctcaagtgaagcgaactcgcacaagaatgtgggccggctggt

SEQ ID NO: 215365 - DNA, 75 bp, Artificial Sequence
  Synthetic
aacagcaaaccccattgtgatgaagaacggagattcagtccttgtggaagtggagccgcctttcggagattcgta

SEQ ID NO: 215366 - DNA, 75 bp, Artificial Sequence
  Synthetic
cattgtggtagggactgggcccacaaagattaattaccattggtataaacccgggagctctatagggagagcctt

SEQ ID NO: 215367 - DNA, 75 bp, Artificial Sequence
  Synthetic
cgagtcgatcatgaaaggagcaagacgcatggccatcttgggggacactgcatgggacttcggttccgttggcgg

SEQ ID NO: 215368 - DNA, 75 bp, Artificial Sequence
  Synthetic
agtgttccagagtatcggaaaggcagtgcaccaggttctgggcggagccttcaggacgctgtttggtggcatgaa

SEQ ID NO: 215369 - DNA, 75 bp, Artificial Sequence
  Synthetic
ttggttcaccaagatcctgatcggtgggctactgtgctggctgggagtgaactcccgtagcacgtcgctggcagc

SEQ ID NO: 215370 - DNA, 75 bp, Artificial Sequence
  Synthetic
agggttcatcacattgggggcaatcctcatctttttggccacttctgtgaacggggaccaagggtgtgcaatgga

SEQ ID NO: 215371 - DNA, 75 bp, Artificial Sequence
  Synthetic
tttaaccaggaaggaaatgaagtgcggaaatggactttttgtttataatgatgtagaatcatggactagcacata

SEQ ID NO: 215372 - DNA, 75 bp, Artificial Sequence
  Synthetic
caggtatcacgtctctgagcccaagaagctcggagcaatcattgtggaagcaatggaaagtggcatctgtggagt

SEQ ID NO: 215373 - DNA, 75 bp, Artificial Sequence
  Synthetic
gctgtcagtgtcaaagacagagcacatcatgtggaagtccatcgagaatgagctcaatgctatcctggaggaaaa

SEQ ID NO: 215374 - DNA, 75 bp, Artificial Sequence
  Synthetic
cgataaggacatcagcgtggttgtcggggaagtaacgtaccctcttcggagggggccaaagaggttgaaacccgc

SEQ ID NO: 215375 - DNA, 75 bp, Artificial Sequence
  Synthetic
ggaaagagaacttccctttggttggaaagcctggggcaagtccaagatcttctcagttgacaggaagaataagac

SEQ ID NO: 215376 - DNA, 75 bp, Artificial Sequence
  Synthetic
attccacgtggatggccaagggtggaaggaatgtccagctgacagcagggcatggaatagcctcttggtcgaaga

SEQ ID NO: 215377 - DNA, 75 bp, Artificial Sequence
  Synthetic
ctatggagtggggatgttccacacaggggtgtggatgaagatcaatgaagagaacactacagactgcgaaaccag

SEQ ID NO: 215378 - DNA, 75 bp, Artificial Sequence
  Synthetic
caccatgggcgcggctgtcaaagacaaaagagcggttcatggagacctatcttactggattgagagtgcaaacaa

SEQ ID NO: 215379 - DNA, 75 bp, Artificial Sequence
  Synthetic
cggaagctggaagcttgagagagcccagctggccggagtgaagagctgctcatggccctctacgcacacaatttg

SEQ ID NO: 215380 - DNA, 75 bp, Artificial Sequence
  Synthetic
gagtgagggagtggaggagagtcatttgatcatcccacacacactagcaggaccacgctcttggcacaacaccag

SEQ ID NO: 215381 - DNA, 75 bp, Artificial Sequence
  Synthetic
gaaaggataccagacccaggtcaaggggccttgggctgaaggtgagcttgaattggtttttgaccactgcccagg

SEQ ID NO: 215382 - DNA, 75 bp, Artificial Sequence
  Synthetic
aaccacagtcacagtcacagaggagtgtggtagacgagggccttcactaagaacaaccacagctagtggaagagt

SEQ ID NO: 215383 - DNA, 75 bp, Artificial Sequence
  Synthetic
ggtaccagactggtgctgtagagattgcacgctgcccccactctccttcaggaaaggaaaggagtgttggtacgc

SEQ ID NO: 215384 - DNA, 75 bp, Artificial Sequence
  Synthetic
catggaaattaggcccaagaatgaaaaggaggactccctggtgaaggctagggtgtcagctggctcaggctctgg

SEQ ID NO: 215385 - DNA, 75 bp, Artificial Sequence
  Synthetic
agttgacagcttgtcgctgggagcagtggtggtcttcctggccctgcaggaaggactaaaaaagcgttacacagc

SEQ ID NO: 215386 - DNA, 75 bp, Artificial Sequence
  Synthetic
ccggggaatcatggtggctggtgtcgcgctgctggctgcttggctggttggtggggtcactctcatggacttggg

SEQ ID NO: 215387 - DNA, 75 bp, Artificial Sequence
  Synthetic
caggtacatgttcctggtggggacagcgttcgctgaagtgaactctggtagagacgtggcccatctggcgttgat

SEQ ID NO: 215388 - DNA, 75 bp, Artificial Sequence
  Synthetic
tgccactttcaaagttaggccggcattgctaacaacatatctatggagattgcactggggcacaagggaagagat

SEQ ID NO: 215389 - DNA, 75 bp, Artificial Sequence
  Synthetic
agggctggcagtggcggcttgcctgatgcacctaagtgtggcggggctcgagtggaacattcccgagctactgga

SEQ ID NO: 215390 - DNA, 75 bp, Artificial Sequence
  Synthetic
tgccatggccatggctgtgctggtgctgagagcgagcgccgactgcagggccaagaattggagcttggttgggct

SEQ ID NO: 215391 - DNA, 75 bp, Artificial Sequence
  Synthetic
ggcattgttgacacaggaagggctgaggaatgtcatgccagcatggaaaggcgcaatgctcggaatagctgcagg

SEQ ID NO: 215392 - DNA, 75 bp, Artificial Sequence
  Synthetic
catcatcctttcaaaaaagagcagcagtctaaagaaatcagcccctctaggattggcttggataatgtggggagc

SEQ ID NO: 215393 - DNA, 75 bp, Artificial Sequence
  Synthetic
tgggaggttatcacccttggctgcagtgcccttgctcctgacaggagagaagagaaggagctggcccccaacaga

SEQ ID NO: 215394 - DNA, 75 bp, Artificial Sequence
  Synthetic
agctctatccgccgtagggatgttgggcctggtgatgggcgcgacgatgaagcccggagctgagctgtcagggcc

SEQ ID NO: 215395 - DNA, 75 bp, Artificial Sequence
  Synthetic
actcgtagcctccggcctcctgctggtttgctacatcatatctggaaaaggcacagatctttttttagagcgcgc

SEQ ID NO: 215396 - DNA, 75 bp, Artificial Sequence
  Synthetic
tgcggaactgtcctggtgtccggacgcagcggtttcaggcaccagcccaaggcttgatgtgaagatcacagaagg

SEQ ID NO: 215397 - DNA, 75 bp, Artificial Sequence
  Synthetic
tggagatatggaactgattgatgataaaggaccatccacagaatctatcgtcctcaaggcaaccctcgtggctgt

SEQ ID NO: 215398 - DNA, 75 bp, Artificial Sequence
  Synthetic
gtgtggaatgtggccgctggcaatccccttcgcaatgggagtctggatgctctatgacaagaaagcgaagcggag

SEQ ID NO: 215399 - DNA, 75 bp, Artificial Sequence
  Synthetic
tggagctctgtgggacatgccagcccctagaccagctcctcctgccgtcctcggcgacggggtgtacaggataat

SEQ ID NO: 215400 - DNA, 75 bp, Artificial Sequence
  Synthetic
gagtaaaaaacttctgggaccatcacaactaggagtgggcgtcatgacacaaggggtgtttcacaccatgtggca

SEQ ID NO: 215401 - DNA, 75 bp, Artificial Sequence
  Synthetic
tgtcactagaggctgcaccattgaatacaatggtggaaggctgaccccttactggggaagcgtaaaggaagatgc

SEQ ID NO: 215402 - DNA, 75 bp, Artificial Sequence
  Synthetic
catctcttatggtggaccatggaagctcactgaaaaatgggacggcacatcagaagtccagctaattgcagtggc

SEQ ID NO: 215403 - DNA, 75 bp, Artificial Sequence
  Synthetic
accaggtaaaggagcagagaatgtgcagaccaaacctgggatattcaacacagccacagggaccataggggcggt

SEQ ID NO: 215404 - DNA, 75 bp, Artificial Sequence
  Synthetic
tgcattggattaccccgctggcacctctggctcacccatcctaaacagtgaagggaaggttgtgggcttgtacgg

SEQ ID NO: 215405 - DNA, 75 bp, Artificial Sequence
  Synthetic
gaacggtgtgctggtgggcggaagctcatatgtgagtgccatatcccaggtcaagcaccctgagacccaaccaca

SEQ ID NO: 215406 - DNA, 75 bp, Artificial Sequence
  Synthetic
ggtggtcagtgacgacatgttcaggaaaaagaacttgaccattcttgacctccatcccggggcgggaaagaccag

SEQ ID NO: 215407 - DNA, 75 bp, Artificial Sequence
  Synthetic
acgcatcctgcctgagatagtgaaacaagctattgacaggaggatgaggacagtcatcttggccccgacgagagt

SEQ ID NO: 215408 - DNA, 75 bp, Artificial Sequence
  Synthetic
tgttgccgcggagatgggtgaggctctgaaggggctgcccgttagatacatgaccacagccgtgcagagagagca

SEQ ID NO: 215409 - DNA, 75 bp, Artificial Sequence
  Synthetic
cacaggaaccgagatcgtggatgtcatgtgccatgcaacattcaccatgcggttgatacagcccatgcgggttcc

SEQ ID NO: 215410 - DNA, 75 bp, Artificial Sequence
  Synthetic
taactacaatttgttcgtcatggatgaggcacatttcacagatcctgcaagcattgcagcgagagggtacatagc

SEQ ID NO: 215411 - DNA, 75 bp, Artificial Sequence
  Synthetic
caccaaagtcaatatgggagaagcggcagccattttcatgactgccacacccccaggccatgctgaccccttccc

SEQ ID NO: 215412 - DNA, 75 bp, Artificial Sequence
  Synthetic
tgattcgaactctccagtagatgacatggaaatcatggttcccgataaaccctggaataaagggtttgaatgggt

SEQ ID NO: 215413 - DNA, 75 bp, Artificial Sequence
  Synthetic
caccgactatcctggcaagactgtgtggtttgttcctagtgtccgcaatgggaatgagatagcatgttgtctgga

SEQ ID NO: 215414 - DNA, 75 bp, Artificial Sequence
  Synthetic
aaaggcaggaaagaaaaccattcagctaaataggaaaagcttcaacacagagtatcagagaacaaagaatgaaca

SEQ ID NO: 215415 - DNA, 75 bp, Artificial Sequence
  Synthetic
atgggactttgtgatcacaacagacatctcggagatgggcgccaactttgacgctgagcgcgtgattgactcacg

SEQ ID NO: 215416 - DNA, 75 bp, Artificial Sequence
  Synthetic
aaaatgcataaaaccagtcattctggaggaaggcagggttaacctggtgggaccaatcccagtgaccgcctcaag

SEQ ID NO: 215417 - DNA, 75 bp, Artificial Sequence
  Synthetic
cgccgctcagagaagagggaggatcggcagaaatccgagtagaacaggtgacgagtaccgatactcgggggggac

SEQ ID NO: 215418 - DNA, 75 bp, Artificial Sequence
  Synthetic
cgttgaggatgatagtgaccacgcccactggacagaagccaaaatcctccttgacaatgtgcagatgccagacag

SEQ ID NO: 215419 - DNA, 75 bp, Artificial Sequence
  Synthetic
gataataccccagctctatggacctgagcaaggaaaagtgaatgacgttgacgggatctacagactgcgggagcc

SEQ ID NO: 215420 - DNA, 75 bp, Artificial Sequence
  Synthetic
agagaaaaaagtgttcattgagcttctcaagagagctgaattgccagtgtggctaacctaccaggtcgcgtcagc

SEQ ID NO: 215421 - DNA, 75 bp, Artificial Sequence
  Synthetic
gggcatacagtacaatgacaaaaaatggtgctttgatggtgagaggaacaacaccatcttagaggacagcgtccc

SEQ ID NO: 215422 - DNA, 75 bp, Artificial Sequence
  Synthetic
tgccgaggtttggaccagggagggggagcggaaggtgctgaagccacggtggatggatgggagagtctgctcaga

SEQ ID NO: 215423 - DNA, 75 bp, Artificial Sequence
  Synthetic
ccatgcggccctaagggcctttaaagagtttgctgctgggagaaggggagcaacagccggagtgatcgatgggct

SEQ ID NO: 215424 - DNA, 75 bp, Artificial Sequence
  Synthetic
tgcccaggttccttcacatctgctggagagattcaaagcagcggttgacactctgacagttttgagtacagctga

SEQ ID NO: 215425 - DNA, 75 bp, Artificial Sequence
  Synthetic
ccctgcagggagagcttaccgacatgcggtcggagagctccctgagacccttgagaccataatgctcttctcgat

SEQ ID NO: 215426 - DNA, 75 bp, Artificial Sequence
  Synthetic
gctgctgctagtaacgggcggtggatgcttgctgatgatgaagagcaaacccatagggaaaatgactgcgggact

SEQ ID NO: 215427 - DNA, 75 bp, Artificial Sequence
  Synthetic
ggtggtgacattggtagcagccggcctgtgttggcaagccaacgtcagtaaggttgtgatcgccagcgggatgac

SEQ ID NO: 215428 - DNA, 75 bp, Artificial Sequence
  Synthetic
cgtgaccttgctcctgctgatagtgctcgtcccagagcctgagaggcagcggtcagtccaggacaactacattgc

SEQ ID NO: 215429 - DNA, 75 bp, Artificial Sequence
  Synthetic
catgttagtcttgggggtcacggtgctcctgggactggtagccgccaacgaagccgggcttttggagaggacaaa

SEQ ID NO: 215430 - DNA, 75 bp, Artificial Sequence
  Synthetic
ggctgacatccgaggcttgttaaagaaagaggaggtgaatgagccaggctggtctttgccacggctcgaacttga

SEQ ID NO: 215431 - DNA, 75 bp, Artificial Sequence
  Synthetic
tttgaaacctgcaaccacctggacactgtacgcagtcattaccattatcttgtcacccttcgtgcagcacagcat

SEQ ID NO: 215432 - DNA, 75 bp, Artificial Sequence
  Synthetic
cattaccacatacaacaacttctcattgacagcaataggcaaccaggccgggattctgttcggaatggggacggg

SEQ ID NO: 215433 - DNA, 75 bp, Artificial Sequence
  Synthetic
agtccccttctacaagtgggattggggagttcccttgctcctgcttgggtgcgccacccaaataaccccaacagt

SEQ ID NO: 215434 - DNA, 75 bp, Artificial Sequence
  Synthetic
catggtcgctagtggagtcttgctggccgctcactatgctttcctgatcccaggattgcaagcacaggcggttag

SEQ ID NO: 215435 - DNA, 75 bp, Artificial Sequence
  Synthetic
agcggcccaaaagcggacggcggcaggaataatgaagaaccctgttgtggacggggtggtggttacagatattca

SEQ ID NO: 215436 - DNA, 75 bp, Artificial Sequence
  Synthetic
ggacttgcatgtggacccacagactgaaaagaccatggggcaggtgttgctgatggcagtggccttggcgagcgc

SEQ ID NO: 215437 - DNA, 75 bp, Artificial Sequence
  Synthetic
atgcttgacgccgagcacgtggacgtgtggagaagcagtggcgttgatgtcagcagcagccgggaccctgtggga

SEQ ID NO: 215438 - DNA, 75 bp, Artificial Sequence
  Synthetic
gggaaacccaggcagaatgtggaactcgagcacggcttgttccctagcaaacgtgtttcgagggagcatgctcgc

SEQ ID NO: 215439 - DNA, 75 bp, Artificial Sequence
  Synthetic
aggcgccggactgatgtatacagtgacccgcaacgtgtcatccacaaagaggagcaacagaggcctaggggaaac

SEQ ID NO: 215440 - DNA, 75 bp, Artificial Sequence
  Synthetic
cctgggggagaagtggaaaagagagctgaaccaactgtcagcggccagcttccatgcatacaaaagagcggggat

SEQ ID NO: 215441 - DNA, 75 bp, Artificial Sequence
  Synthetic
aaccgaagtggacagaaccgctgcccgaaaagcactccaagaaaacgctaccaactctgggcatgccgtctcaag

SEQ ID NO: 215442 - DNA, 75 bp, Artificial Sequence
  Synthetic
agggacggccaagctggcatggatggctgagagagggttcgtggacttgaagggaagagtggtggacctcggatg

SEQ ID NO: 215443 - DNA, 75 bp, Artificial Sequence
  Synthetic
cggacgaggaggctggagctattatgctgcatcccaaaagaaggtccacgaggtggctggattcacaaaaggagg

SEQ ID NO: 215444 - DNA, 75 bp, Artificial Sequence
  Synthetic
gccaggacacgaggagcccatcatggtgcagagttatggctggaatatcgtgagaatgaaaagtggaattgacgt

SEQ ID NO: 215445 - DNA, 75 bp, Artificial Sequence
  Synthetic
tcattacttgccagtgcaaccagcggacactctgctgtgcgacataggcgaaagctcttccaacccaggggttga

SEQ ID NO: 215446 - DNA, 75 bp, Artificial Sequence
  Synthetic
agaggcccgcaccctgaaagtcttggagctggtagagaactggataaaaccggggacttcattttgcgtgaaagt

SEQ ID NO: 215447 - DNA, 75 bp, Artificial Sequence
  Synthetic
gttctgtccatacatgccgaaggtgctggaaaagctggaaagtctgcaaaggaactttggaggagggctggtgcg

SEQ ID NO: 215448 - DNA, 75 bp, Artificial Sequence
  Synthetic
ttgccctctttcacgcaattccacgtatgagatgtattgggtctcaggagggaaaagcaacatggtttcagcagt

SEQ ID NO: 215449 - DNA, 75 bp, Artificial Sequence
  Synthetic
gaacaccacatcacagttgctagtcagcagatttcgtatggcaggaaagaaaccacgcatggaaccagacttgat

SEQ ID NO: 215450 - DNA, 75 bp, Artificial Sequence
  Synthetic
gcttgggactggcacaagagcggtgagcagccaagcagagacacctgatctgagcaagatcaaagagcgtgtgga

SEQ ID NO: 215451 - DNA, 75 bp, Artificial Sequence
  Synthetic
gttaataaagagaacccacagccacacttggaaagaagatccagagcacccctacagaacttgggcttacctagg

SEQ ID NO: 215452 - DNA, 75 bp, Artificial Sequence
  Synthetic
gagttacaccaccgagccaaagggaacatccgcctccatggtgaacggagtcgtgaagcttctcacgaagccctg

SEQ ID NO: 215453 - DNA, 75 bp, Artificial Sequence
  Synthetic
ggatgtggtgagcggagttgtgaacatagccatgaccgacacaaccccttttgggcaacagagagtgttcaagga

SEQ ID NO: 215454 - DNA, 75 bp, Artificial Sequence
  Synthetic
gaaggtggataccagagtccctccagttccagctggagttaaaaggaccatgagactggtggccacgtggctctg

SEQ ID NO: 215455 - DNA, 75 bp, Artificial Sequence
  Synthetic
gaaagaactgtcaaggaacaagaaaccccggatgtgcacaaaggaagagtttattgccaaagtgcgctcccatgc

SEQ ID NO: 215456 - DNA, 75 bp, Artificial Sequence
  Synthetic
agcactgggcgcactattgccggagcaacaaggatggagctctgcggctgaagcagtggaagatccaaagttctg

SEQ ID NO: 215457 - DNA, 75 bp, Artificial Sequence
  Synthetic
gaggctagtggatgaagagagggagctgcacaaacaaggtaggtgcaggacctgtgtgtacaacatgatgggaaa

SEQ ID NO: 215458 - DNA, 75 bp, Artificial Sequence
  Synthetic
aagagagaaaaagacctcagaatttgggaaagcgaaaggcagcagggctatctggtacatgtggctgggagctag

SEQ ID NO: 215459 - DNA, 75 bp, Artificial Sequence
  Synthetic
attcttagagtttgaagccctcggcttcctgaatgaggaccactggttcagcagagaaaacagccacgccggagt

SEQ ID NO: 215460 - DNA, 75 bp, Artificial Sequence
  Synthetic
ggaaggcatgggcctccaaaagctgggctatgttctagaggaaatttccaagaggcacggcggactcatgtacgc

SEQ ID NO: 215461 - DNA, 75 bp, Artificial Sequence
  Synthetic
cgatgacacagcaggatgggacactcgtgttacggaagcagacttggatgacgaagcgctcatcatagagagcat

SEQ ID NO: 215462 - DNA, 75 bp, Artificial Sequence
  Synthetic
ggacagagagcacgcccagctggcttcggtgctcacggaaatggcttacaagaacaaagtggtttgtgtgctgag

SEQ ID NO: 215463 - DNA, 75 bp, Artificial Sequence
  Synthetic
gccgggaaaaggggaaaccctgatggatgtgattagccgcagggaccaaagagggagtgggcaggtggtgacata

SEQ ID NO: 215464 - DNA, 75 bp, Artificial Sequence
  Synthetic
cgcactgaacacctttacaaatgagaaagtccagctcattagatgcatggaggccgagggcgtcctagaagagag

SEQ ID NO: 215465 - DNA, 75 bp, Artificial Sequence
  Synthetic
tgacgcagagcacctgatggatgagagcaaagtcaacaaatggctggagagccacggagtggagaggctgagaag

SEQ ID NO: 215466 - DNA, 75 bp, Artificial Sequence
  Synthetic
catggccatcagtggtgatgactgcgtggttaaacccctagatgaaaggttctcaaattcccttagattcctcaa

SEQ ID NO: 215467 - DNA, 75 bp, Artificial Sequence
  Synthetic
ttcaatgggaaaaataagaaaagacatccaggaatgggaggcctcgaaaggctgggcagattgggaaaaagtgcc

SEQ ID NO: 215468 - DNA, 75 bp, Artificial Sequence
  Synthetic
cttctgttcgcaccacttccataagttgcaactaaaggacgggcgacacattgtcgctccatgccgtcaccagga

SEQ ID NO: 215469 - DNA, 75 bp, Artificial Sequence
  Synthetic
tgagctgataggcagagcacgagttgctcctggaagaggatgggtgctgaaggaagctgcatgtttggcaaagtc

SEQ ID NO: 215470 - DNA, 75 bp, Artificial Sequence
  Synthetic
gtacgcacagatgtggagcctgatgtacttccatagacgagacctcagattggcaggcaatgccatttgctcagc

SEQ ID NO: 215471 - DNA, 75 bp, Artificial Sequence
  Synthetic
agtgccaaaagcctgggtgccaaccgggagaaccacttggtccgtgcacggaaaaggagaatggatgactacaga

SEQ ID NO: 215472 - DNA, 75 bp, Artificial Sequence
  Synthetic
agacatgctacaggtgtggaatagagtttggatagaagacaatgaatggatggaaaacaagacccctgtcactgc

SEQ ID NO: 215473 - DNA, 75 bp, Artificial Sequence
  Synthetic
ctggagggatgtcccttacttgcaaaagcgggacgacctgtggtgcggctccctgataggtcacagctcaagagc

SEQ ID NO: 215474 - DNA, 75 bp, Artificial Sequence
  Synthetic
ctcatgggctgagaacatcagagtggcagtggagcaggtgcggaaggcaatagggagagaagagtatgctgatta

SEQ ID NO: 215475 - DNA, 75 bp, Artificial Sequence
  Synthetic
cctaggagtgcaagacaggtactccacccactcattggaaatgacaggagccttgtaagacatggaatgatcatg

SEQ ID NO: 215476 - DNA, 75 bp, Artificial Sequence
  Synthetic
gaaaaggtacagacaaacaaggaaatgaacaaaggacttgaaggacttgacgtcaggccactcgtgagagtgcca

SEQ ID NO: 215477 - DNA, 75 bp, Artificial Sequence
  Synthetic
cagtacggtaaagactgtgcggcctgcgagccccctgggactatcggtatccaggctaaacaaaaaccgttgcac

SEQ ID NO: 215478 - DNA, 75 bp, Artificial Sequence
  Synthetic
ctcattgggctggtgcgtaaaatgacattgcggggcccaagccggctaagctgtaaccggtggaaggactaggag

SEQ ID NO: 215479 - DNA, 75 bp, Artificial Sequence
  Synthetic
gttagaggagaccccccgcgcccataaccaacataaaacagcatattgacacctgggaaagaccggagactctgt

SEQ ID NO: 215480 - DNA, 75 bp, Artificial Sequence
  Synthetic
gttggctttccccacaccagccccctggcacagagcgccagatcgggggttggtgtggagcaacccaacaggact

SEQ ID NO: 215481 - DNA, 75 bp, Artificial Sequence
  Synthetic
gtttcagacaacgtgagtggcgctttgtttgtatttccttggtgggaaagttttgaagcgttaacgtgttgagga

SEQ ID NO: 215482 - DNA, 75 bp, Artificial Sequence
  Synthetic
taaaggaaaggggggcggtccccctaggcgagtgccgaaagagaccgcaaaaaagacgcgtcaaggaccaggccg

SEQ ID NO: 215483 - DNA, 75 bp, Artificial Sequence
  Synthetic
aggcgagtgccgaaagagaccgcaaaaaagacgcgtcaaggaccaggccgattgccaaatggactggtgttgatg

SEQ ID NO: 215484 - DNA, 75 bp, Artificial Sequence
  Synthetic
cgctccgcaaaattagaaagacagttggactgctattggactctctaaacagaagaagagggaagagaaggtcaa

SEQ ID NO: 215485 - DNA, 75 bp, Artificial Sequence
  Synthetic
tggactgctattggactctctaaacagaagaagagggaagagaaggtcaaccactgggtttctcacatcaatctt

SEQ ID NO: 215486 - DNA, 75 bp, Artificial Sequence
  Synthetic
atctccgcgacaattcgcagagagagaacaggggacatggtgatcagggcagaaggaaaggacgctgccacgcaa

SEQ ID NO: 215487 - DNA, 75 bp, Artificial Sequence
  Synthetic
aagaaccagttgatgtggactgtttctgcaggggcgtcgagcgggtgtccctggaatacgggaggtgtgggaagc

SEQ ID NO: 215488 - DNA, 75 bp, Artificial Sequence
  Synthetic
gacgcatctgacacgtgtggaaggctgggtatggaagaataagctcctgacgatggccttttgtgcagttgtgtg

SEQ ID NO: 215489 - DNA, 75 bp, Artificial Sequence
  Synthetic
tttgtctggctcccacatatgccactcggtgcacacacctgcagaaccgggactttgtttcagggatccaaggga

SEQ ID NO: 215490 - DNA, 75 bp, Artificial Sequence
  Synthetic
caaaggtggtcgcacgttgcccggccatgggtccggcgacattgccagaggagcatcaggcgagcacagtctgca

SEQ ID NO: 215491 - DNA, 75 bp, Artificial Sequence
  Synthetic
gacgagaccagagtgatagaggatggggcaaccactgtggactgtttgggaagggcagcattgtggcttgtgcca

SEQ ID NO: 215492 - DNA, 75 bp, Artificial Sequence
  Synthetic
agtttgcctgtgaggccaagaagaaggcaaccggatatgtgtatgatgtcaataagatcacatatgtggtgaaag

SEQ ID NO: 215493 - DNA, 75 bp, Artificial Sequence
  Synthetic
tggaaccccacacgggtgactatttggcagctaatgagtcccacagcaatcgaaaaacggcatcttttacaacgc

SEQ ID NO: 215494 - DNA, 75 bp, Artificial Sequence
  Synthetic
acgtgccgggtgactagtggagtggatcctgcccaaactgtggtattggaactggacaagacagcggaacacttg

SEQ ID NO: 215495 - DNA, 75 bp, Artificial Sequence
  Synthetic
ctgtgcccattgactgggtcccgcagggacgaaccacatggagcatccacgcgagtggagcgtggatgaccacag

SEQ ID NO: 215496 - DNA, 75 bp, Artificial Sequence
  Synthetic
atggcgacacgagggcgcccatgaatggaaccacgctgaccggctcgtggaatttggtgaaccgcatgctgtgaa

SEQ ID NO: 215497 - DNA, 75 bp, Artificial Sequence
  Synthetic
aatggatatttataaccttggagaccagactggcatcctgttgaagtctctggctggagtgcccgtggccaacat

SEQ ID NO: 215498 - DNA, 75 bp, Artificial Sequence
  Synthetic
cagactggcatcctgttgaagtctctggctggagtgcccgtggccaacatagagggcagtaagtaccatctccag

SEQ ID NO: 215499 - DNA, 75 bp, Artificial Sequence
  Synthetic
agtggtcatgtcacctgtgatgtgggccttgaaaaactcaagatgaaaggaatgacatacacggtctgtgaggga

SEQ ID NO: 215500 - DNA, 75 bp, Artificial Sequence
  Synthetic
tcaaagtttgcttggaagaggccgccaaccgacagtgggcatgacactgtggtcatggaagtgacttacactggg

SEQ ID NO: 215501 - DNA, 75 bp, Artificial Sequence
  Synthetic
agcaagccatgcagaataccagtgagagccgtggcccatggagaacctaatgtcaatgtagctagcctgataact

SEQ ID NO: 215502 - DNA, 75 bp, Artificial Sequence
  Synthetic
ccaaatccatccatggagacaactggaggaggtttcgttgaactgcagctgccaccaggagacaacatcatctat

SEQ ID NO: 215503 - DNA, 75 bp, Artificial Sequence
  Synthetic
gtgggtgagctgagtcaccagtggtttcagaagggtagtacaataggccgtgttctggaaaagaccaggaggggc

SEQ ID NO: 215504 - DNA, 75 bp, Artificial Sequence
  Synthetic
atagagagactcacagtggtgggagagcacgcttgggactttggttcggtgggtggtgtgctgtcatcagtgggg

SEQ ID NO: 215505 - DNA, 75 bp, Artificial Sequence
  Synthetic
aaggctctgcacacagcttttggtgcagcatttaacaccatttttggaggagtgggatttctcccacgtattctg

SEQ ID NO: 215506 - DNA, 75 bp, Artificial Sequence
  Synthetic
cattccctctcaggagatttcctccccctacaactaaatttccccctgccatgcagggggggcggttcttgttct

SEQ ID NO: 215507 - DNA, 75 bp, Artificial Sequence
  Synthetic
tcagacaacgttgagtggcgctttgtttgtatttccttggtgggaaagttttgaagcgttaacgtgttgaggaaa

SEQ ID NO: 215508 - DNA, 75 bp, Artificial Sequence
  Synthetic
ttgggggtggctctggcttggctggggctcaactcacggaaccctaccctctcagtcgggtttttgatcactggt

SEQ ID NO: 215509 - DNA, 75 bp, Artificial Sequence
  Synthetic
ggacttgtgttaacaatgacactgggggttggtgccgacatgggctgtgcaattgatgccaacaggatggagcta

SEQ ID NO: 215510 - DNA, 75 bp, Artificial Sequence
  Synthetic
cgttgtggtgagggccttgttgtgtggagagaggtcactgattggtatgatggctatgcattccacccagaatcg

SEQ ID NO: 215511 - DNA, 75 bp, Artificial Sequence
  Synthetic
ccccctgttcttgcggcatctctaaaggaagcatatgaggagggagtctgtgggattgtgccccagaaccggctt

SEQ ID NO: 215512 - DNA, 75 bp, Artificial Sequence
  Synthetic
gactgctattggactctctaaacagaagaagagggaagagaaggtcaactaccgggcttctcacatcaatcttgc

SEQ ID NO: 215513 - DNA, 75 bp, Artificial Sequence
  Synthetic
gttgtggatagaagggatcctagtgactacaggggaggcaaagtggggatcttaaagcggtcaggcaaggagatg

SEQ ID NO: 215514 - DNA, 75 bp, Artificial Sequence
  Synthetic
ttgataaacgccgaacaggagtcttcacggtggcagagtttgggatgggaatgaggaccaagatcttcttggatc

SEQ ID NO: 215515 - DNA, 75 bp, Artificial Sequence
  Synthetic
tacgggagactagttcttcagactgtgacaccggagtcatgggggctgcagtcaagagcggtcatgccgtccaca

SEQ ID NO: 215516 - DNA, 75 bp, Artificial Sequence
  Synthetic
atatcagaactgatagtgaccgacttacggaactgcacatggccagccagtcacaccctggacaatgccggtgtc

SEQ ID NO: 215517 - DNA, 75 bp, Artificial Sequence
  Synthetic
tcacaccctggacaatgccggtgtcgttgattcaaaactcttccttccagtaagcctggctggaccacggtcgca

SEQ ID NO: 215518 - DNA, 75 bp, Artificial Sequence
  Synthetic
ttacaatcacattcctgggtatgcagaacaggttaggggaccgtggaaccaaacacccctacgggtggttagaga

SEQ ID NO: 215519 - DNA, 75 bp, Artificial Sequence
  Synthetic
accctgccctgggaccacagtcaagattgaccagaattgtgacaaaagggggtcgtcgttgcgtagcacgacaga

SEQ ID NO: 215520 - DNA, 75 bp, Artificial Sequence
  Synthetic
tgggtggctgtgtcactctcacggctgaaggcaaaccatccgtggatgtctggctcgatgacatacaccaggaga

SEQ ID NO: 215521 - DNA, 75 bp, Artificial Sequence
  Synthetic
tgaaggcaaaccatccgtggatgtctggctcgatgacatacaccaggagagccctgctaagacacgagagtattg

SEQ ID NO: 215522 - DNA, 75 bp, Artificial Sequence
  Synthetic
aagcgggaaggtcataccagaatggtgctgccgcacatgtgagctgcctccggtcacattccgtagtgggaccga

SEQ ID NO: 215523 - DNA, 75 bp, Artificial Sequence
  Synthetic
tgctgccgcacatgtgagctgcctccggtcacattccgtagtgggaccgattgctggtacgctatggaaatcaga

SEQ ID NO: 215524 - DNA, 75 bp, Artificial Sequence
  Synthetic
ccagtccaccaacagggtggtctggtgaggtcgatggtgctggctgacaacggagccatgttaagtgaaggtgga

SEQ ID NO: 215525 - DNA, 75 bp, Artificial Sequence
  Synthetic
gtccctggcattgtggccgtattcgtggtcctggagctagtcattaggagacgcccaacaactggcacctcagtg

SEQ ID NO: 215526 - DNA, 75 bp, Artificial Sequence
  Synthetic
tggtcctggagctagtcattaggagacgcccaacaactggcacctcagtggtgtggtgtggagtggtcgttcttg

SEQ ID NO: 215527 - DNA, 75 bp, Artificial Sequence
  Synthetic
gtgtggtgtggagtggtcgttcttggcctagtcgtaactgggctagtcaccattgaaggcctgtgccgttatgtg

SEQ ID NO: 215528 - DNA, 75 bp, Artificial Sequence
  Synthetic
gcctagtcgtaactgggctagtcaccattgaaggcctgtgccgttatgtggtggctgtcggcatcttgatgagca

SEQ ID NO: 215529 - DNA, 75 bp, Artificial Sequence
  Synthetic
gcaatgggaacattgattctacaggcgtgcagtcaagagggcagagcccgagtgggctatctcctggcagctatg

SEQ ID NO: 215530 - DNA, 75 bp, Artificial Sequence
  Synthetic
cgtgcagtcaagagggcagagcccgagtgggctatctcctggcagctatgatgacccaaaaggacatggccataa

SEQ ID NO: 215531 - DNA, 75 bp, Artificial Sequence
  Synthetic
tccacacaggcttgaccatttttctatcagccgccacggcaatggcggtctggagcatgatcaagggtcaacggg

SEQ ID NO: 215532 - DNA, 75 bp, Artificial Sequence
  Synthetic
gactggcatcctgttgaagtctctggctggagtgcccgtggccaacatagagggcagcaagtaccacctccagag

SEQ ID NO: 215533 - DNA, 75 bp, Artificial Sequence
  Synthetic
atcagccgccacggcaatggcggtctggagcatgatcaagggtcaacgggaccagaagggactgtcctgggccac

SEQ ID NO: 215534 - DNA, 75 bp, Artificial Sequence
  Synthetic
accagaagggactgtcctgggccacaccacttgtaggcctcttcggaggcgaaggtgtgggtcttagactgctgg

SEQ ID NO: 215535 - DNA, 75 bp, Artificial Sequence
  Synthetic
accacttgtaggcctcttcggaggcgaaggtgtgggtcttagactgctggcgtttcgaaggcttgcagagcgaag

SEQ ID NO: 215536 - DNA, 75 bp, Artificial Sequence
  Synthetic
ctgtggcaagtgggatggtgagacacacatcccaggaggctctgtgcgctcttgtggctggggcctttctcctcc

SEQ ID NO: 215537 - DNA, 75 bp, Artificial Sequence
  Synthetic
tcatgatggtgctgggaacacggaagatgcagctcatcgcagaatggtgcggtgaagtggaatggaacccagacc

SEQ ID NO: 215538 - DNA, 75 bp, Artificial Sequence
  Synthetic
gatgcagctcatcgcagaatggtgcggtgaagtggaatggaacccagacctagtgaatgaggggggagaggtcaa

SEQ ID NO: 215539 - DNA, 75 bp, Artificial Sequence
  Synthetic
tgatagtattggctatatggacattctttgagatgctgagctcggggcgaaggtctgaacttgtcttctctggac

SEQ ID NO: 215540 - DNA, 75 bp, Artificial Sequence
  Synthetic
aggggacccggaccgaaaggaatcggccttttgagatcaaggatggagcctaccgcatctacagtcctggtttgc

SEQ ID NO: 215541 - DNA, 75 bp, Artificial Sequence
  Synthetic
gccttttgagatcaaggatggagcctaccgcatctacagtcctggtttgctgtggggacatcgccagattggagt

SEQ ID NO: 215542 - DNA, 75 bp, Artificial Sequence
  Synthetic
ggggtatggagccaagggagtcctgcacaccatgtggcacgtcacaaggggagcagccctggttgtggaagaggc

SEQ ID NO: 215543 - DNA, 75 bp, Artificial Sequence
  Synthetic
cacaccatgtggcacgtcacaaggggagcagccctggttgtggaagaggcaatctccggaccctattgggctgac

SEQ ID NO: 215544 - DNA, 75 bp, Artificial Sequence
  Synthetic
gtcagggaagatgttgtatgctatggtggagcatggagccttgagagccggtggaggggtgagaccgtccaggtg

SEQ ID NO: 215545 - DNA, 75 bp, Artificial Sequence
  Synthetic
gtggagcatggagccttgagagccggtggaggggtgagaccgtccaggtgcacgcatttccaccagggagacccc

SEQ ID NO: 215546 - DNA, 75 bp, Artificial Sequence
  Synthetic
tgagcaaaggtacctcgggaagtccgataatcaatgctcagggagaggtggtgggtctttacgggaatggcctga

SEQ ID NO: 215547 - DNA, 75 bp, Artificial Sequence
  Synthetic
agaccaatgaagcttatgttagtagcatagcacaaggagaagccgagaaaagtagaccggaacttccgctgagtg

SEQ ID NO: 215548 - DNA, 75 bp, Artificial Sequence
  Synthetic
gagtcctcccggagctcgtgaggcagtgtgcaaaccgagggatgagaactctagttcttgcccctacccgggtgg

SEQ ID NO: 215549 - DNA, 75 bp, Artificial Sequence
  Synthetic
ctagttcttgcccctacccgggtggttctgaaggagatggagaaggcgcttgctggcaagaaggtccgcttccac

SEQ ID NO: 215550 - DNA, 75 bp, Artificial Sequence
  Synthetic
tcacccgcggtagaagggcagagcacagcgggagccgttgttgacgttatgtgccatgccacgtacgtccacaga

SEQ ID NO: 215551 - DNA, 75 bp, Artificial Sequence
  Synthetic
aggctgctgcctcaggggagacagaattgggaagttgccataatggatgaagcccattggaccgatccacatagc

SEQ ID NO: 215552 - DNA, 75 bp, Artificial Sequence
  Synthetic
atcgcggcgagagggcatctttactcgcttgccaaagaaaacaggtgcgctttggtgctcatgacagcaacccca

SEQ ID NO: 215553 - DNA, 75 bp, Artificial Sequence
  Synthetic
cagagtatgaggggcggacagcatggttcgtcccatccatatcaaaaggtggagccattgcaagaaccctgcgcc

SEQ ID NO: 215554 - DNA, 75 bp, Artificial Sequence
  Synthetic
agagaggcaaaagtgtgatctgtctcaatagcaaaacctttgagaaggattacctgcgggtcagagaagagaagc

SEQ ID NO: 215555 - DNA, 75 bp, Artificial Sequence
  Synthetic
ctctgagatgggtgccaacttggatgtcagccgagttattgatggcagaacaaacataaagccagaggaggtgga

SEQ ID NO: 215556 - DNA, 75 bp, Artificial Sequence
  Synthetic
gtggtgtggagtggtcgttcttggcctagttgtgactgggctagtcaccattgaaggcttgtgccgttatgtggt

SEQ ID NO: 215557 - DNA, 75 bp, Artificial Sequence
  Synthetic
tggaaaggtggagatgactggaaccagaaagatcacgacagcatcggcagctcaacgccggggcagggtgggaag

SEQ ID NO: 215558 - DNA, 75 bp, Artificial Sequence
  Synthetic
ctagttgtgactgggctagtcaccattgaaggcttgtgccgttatgtggtggccgtcggcatcctgatgagcatg

SEQ ID NO: 215559 - DNA, 75 bp, Artificial Sequence
  Synthetic
ctcaacgccggggcagggtgggaaggacatccggacgcactgatgagtacatatactctggacagtgtgacgatg

SEQ ID NO: 215560 - DNA, 75 bp, Artificial Sequence
  Synthetic
ggaggcacagatactcctggacaacattaccacactgagaggtccagttgctactttttatggacctgagcagat

SEQ ID NO: 215561 - DNA, 75 bp, Artificial Sequence
  Synthetic
aacacttccggcacttgatgactcaatgtgactttacgccttggctggcatggcatgttgctaccaacaccagca

SEQ ID NO: 215562 - DNA, 75 bp, Artificial Sequence
  Synthetic
atgtgactttacgccttggctggcatggcatgttgctaccaacaccagcaatgtgctggatcggagctggacctg

SEQ ID NO: 215563 - DNA, 75 bp, Artificial Sequence
  Synthetic
tccccggtctcctgaggcacaggtgtgccagtgcgcttgatgtagtttacaccctcctcaatgagaatccaggta

SEQ ID NO: 215564 - DNA, 75 bp, Artificial Sequence
  Synthetic
cgatagccttttgtgcagttgtgtggatggtcacagatagcttaccgacaaggttcattgtcatgacagtggccc

SEQ ID NO: 215565 - DNA, 75 bp, Artificial Sequence
  Synthetic
attgttgaggtggccgttctaggggtggccactcttggcatactgtggtgctttgtggcaagaacttcggttagc

SEQ ID NO: 215566 - DNA, 75 bp, Artificial Sequence
  Synthetic
ctttgtggcaagaacttcggttagccgaatgtttttgggcacggttgtgctctttgctgccctcttgctgctgtg

SEQ ID NO: 215567 - DNA, 75 bp, Artificial Sequence
  Synthetic
atggcagggatagccctgatattctacatcttcctcactgtgctgcagccagagccggggaaacagcgaagtagc

SEQ ID NO: 215568 - DNA, 75 bp, Artificial Sequence
  Synthetic
acttgtgacggctaacgaaatgggcatgctggataaaacaaaagctgaccttgcagggctaatgtggcgcggaga

SEQ ID NO: 215569 - DNA, 75 bp, Artificial Sequence
  Synthetic
gcaaaggcatccagcctgggaggagtggacaaatgtggacatccagccagcacgatcctggggaacgtatgtgtt

SEQ ID NO: 215570 - DNA, 75 bp, Artificial Sequence
  Synthetic
atgttgcaccagcttcagacaaaaatacaacaactggtgaatagttcggtggctagtggtgctcaggctatgaga

SEQ ID NO: 215571 - DNA, 75 bp, Artificial Sequence
  Synthetic
tacaacaactggtgaatagttcggtggctagtggtgctcaggctatgagagatcttgggggtgggactcccttct

SEQ ID NO: 215572 - DNA, 75 bp, Artificial Sequence
  Synthetic
gcagaactgacgcagagggcgcacagggtgttcttctcggcaatggtcaaaaatccaatggtggatggagacgtc

SEQ ID NO: 215573 - DNA, 75 bp, Artificial Sequence
  Synthetic
atcaatcccttccctgatggagagacaaagccagtgctatacgagagaaggatgagtctaatcctagccattgcc

SEQ ID NO: 215574 - DNA, 75 bp, Artificial Sequence
  Synthetic
ttgtgcatggtttcagtggttctcaaccgaactgcggcctcaatgacagaggctggggctgttggtctagctgcg

SEQ ID NO: 215575 - DNA, 75 bp, Artificial Sequence
  Synthetic
ggcgtgtggtatggcgggactcgtgcgagggagcttctggggcctgttgcccatgggacaccgattatggctcaa

SEQ ID NO: 215576 - DNA, 75 bp, Artificial Sequence
  Synthetic
ccatgggacaccgattatggctcaagacaactggaacacgcagaggaggtgccgatggagaaactcttggggaca

SEQ ID NO: 215577 - DNA, 75 bp, Artificial Sequence
  Synthetic
tctggaagaggcggctgaatggttgctctagggaggagttttttcagtaccgacgaagtggagtcatggagacgg

SEQ ID NO: 215578 - DNA, 75 bp, Artificial Sequence
  Synthetic
ctggctgtctctcgagggacggctaagctagcatggctagaagaacggggctatgcgaccttgaaaggtgaggtt

SEQ ID NO: 215579 - DNA, 75 bp, Artificial Sequence
  Synthetic
gttgatctaggctgtggcagaggcggttggtcatactatgccgcttccaggcccgccgtcatgggagtgaaggcc

SEQ ID NO: 215580 - DNA, 75 bp, Artificial Sequence
  Synthetic
tacacgataggggggaaaggtcatgaggtcccaagactgatcacaagcctcgggtggaacctcatcaagttcaga

SEQ ID NO: 215581 - DNA, 75 bp, Artificial Sequence
  Synthetic
aggtcccaagactgatcacaagcctcgggtggaacctcatcaagttcagaaccgggatggatgtgtattccctag

SEQ ID NO: 215582 - DNA, 75 bp, Artificial Sequence
  Synthetic
aggcacacagggctgacaccattctttgtgatattggtgagagcaacccagatcccttggtggaaggagagagga

SEQ ID NO: 215583 - DNA, 75 bp, Artificial Sequence
  Synthetic
ttgtgatattggtgagagcaacccagatcccttggtggaaggagagaggagtcgccgtgtcatcctcctaatgga

SEQ ID NO: 215584 - DNA, 75 bp, Artificial Sequence
  Synthetic
gtcgccgtgtcatcctcctaatggagaaatggaaactccgcaaccctgacgcgtcctgcgtgttcaaggttttgg

SEQ ID NO: 215585 - DNA, 75 bp, Artificial Sequence
  Synthetic
gcgtcctgcgtgttcaaggttttggccccgtatagaccagaggtacttgaggctcttcacagattccagcttcaa

SEQ ID NO: 215586 - DNA, 75 bp, Artificial Sequence
  Synthetic
gagaacaagagctggggatggccaaaggagccgtccttaaaggaaaggggggcggtccccctaggcgagtgccga

SEQ ID NO: 215587 - DNA, 75 bp, Artificial Sequence
  Synthetic
tggggcggggggctagtccgcgtccccttttcccgcaattccacgcatgagatgtacttctccactgctgttagt

SEQ ID NO: 215588 - DNA, 75 bp, Artificial Sequence
  Synthetic
ggcaacatcgtcaattcagtgaacatccagtccaggaagttgttagccagatttggagaccagcggggacctacc

SEQ ID NO: 215589 - DNA, 75 bp, Artificial Sequence
  Synthetic
ctggcacacgctgtgtggtactggcagaggataaggttagggaagctgatgtggccgaaagaataactgctctca

SEQ ID NO: 215590 - DNA, 75 bp, Artificial Sequence
  Synthetic
gtggccgaaagaataactgctctcaaaacccaatatggtgactcctggcacgtggataaagaacatccatacaga

SEQ ID NO: 215591 - DNA, 75 bp, Artificial Sequence
  Synthetic
cacatcaatcttgctggcctgcctggcgacactggtgatctccgcgacaattcgcagagagagaacaggggacat

SEQ ID NO: 215592 - DNA, 75 bp, Artificial Sequence
  Synthetic
cgtggataaagaacatccatacagaacatggcaatactggggaagttacaagacagaagccacaggatcggctgc

SEQ ID NO: 215593 - DNA, 75 bp, Artificial Sequence
  Synthetic
ctctttgatcaatggagtggtgaagcttctcagttggccttggaatgctagggaggatgtggtgcgcatggcaat

SEQ ID NO: 215594 - DNA, 75 bp, Artificial Sequence
  Synthetic
gacagataccacggcctttggccaacagagggttttcaaggaaaaggtggataccaaagcgcaggagccacaggt

SEQ ID NO: 215595 - DNA, 75 bp, Artificial Sequence
  Synthetic
gggaaccaagatcattatgagggccgtcaatgactggattctcgaaagactcgcgggaaagaaaacaccacgact

SEQ ID NO: 215596 - DNA, 75 bp, Artificial Sequence
  Synthetic
gaagagggcataagtggcttaggggggactcagtcaagcctcatctgacacgtgtggagggctgggtatggaaga

SEQ ID NO: 215597 - DNA, 75 bp, Artificial Sequence
  Synthetic
ttgtggcaagaacttcggttagccgaatgtttttgggcacggttgtgctctttgctgcccttttgttgctatgga

SEQ ID NO: 215598 - DNA, 75 bp, Artificial Sequence
  Synthetic
ttgatgaggaaagagagagacatcttagaggacggtgtgcccagtgcgtgtacaacatgatgggcaagagagaga

SEQ ID NO: 215599 - DNA, 75 bp, Artificial Sequence
  Synthetic
tgcagttgtgtggatggtcacagatagcttaccgacaaggttcattgtcataacagtggccctttgtctggctcc

SEQ ID NO: 215600 - DNA, 75 bp, Artificial Sequence
  Synthetic
agaaacttggtgaattcggtgtcgccaaggggagccgcgccatctggtatatgtggttggggagccggtatctgg

SEQ ID NO: 215601 - DNA, 75 bp, Artificial Sequence
  Synthetic
aatttgaggcactgggtttcctcaatgaggatcactgggcttccagggatctcagtggagcgggggttgagggga

SEQ ID NO: 215602 - DNA, 75 bp, Artificial Sequence
  Synthetic
ttagtctcaactacctgggatggcacttgaaaagactgtccgaacttgaaggagggcttttctatgcagacgaca

SEQ ID NO: 215603 - DNA, 75 bp, Artificial Sequence
  Synthetic
aacaccgaaccctcgcaaagacaattttggaaaaagcctatcatgccaaagtggtcaaagtggctcgcccctcca

SEQ ID NO: 215604 - DNA, 75 bp, Artificial Sequence
  Synthetic
gctcgggaggctgcgtcatggacatcataactagaagagaccaacgtggttcaggtcaggtggtgacttacgctc

SEQ ID NO: 215605 - DNA, 75 bp, Artificial Sequence
  Synthetic
cttttacaacgcagtccgagaagacatcttgacactgggagattatggagacatctcttctcacgtgccgggtga

SEQ ID NO: 215606 - DNA, 75 bp, Artificial Sequence
  Synthetic
cacaggatcctcgacttttacgtgtggaggcctggctgaaagagtacggagaggaacgtctcacccgtatgctgg

SEQ ID NO: 215607 - DNA, 75 bp, Artificial Sequence
  Synthetic
gaggaacgtctcacccgtatgctggtcagcggggatgattgtgttgtgagacctatcgacgaccgcttcgggaag

SEQ ID NO: 215608 - DNA, 75 bp, Artificial Sequence
  Synthetic
acctatcgacgaccgcttcgggaaggccctctacttcttgaatgatatggctaaggtgagaaaggacattggaga

SEQ ID NO: 215609 - DNA, 75 bp, Artificial Sequence
  Synthetic
atgggagccctcggagggttactccagctgggaagaggttcccttctgctctcaccatttccatgagctgacgat

SEQ ID NO: 215610 - DNA, 75 bp, Artificial Sequence
  Synthetic
gaaggacggcagggtcataattgtcccatgcagagatcaagatgagctggtggggcgggcaagagtgtctcctgg

SEQ ID NO: 215611 - DNA, 75 bp, Artificial Sequence
  Synthetic
gtgtggctggagcgtcagggaaacagcatgtctctcaaaggcctacggacagatgtggctgttaagctactttca

SEQ ID NO: 215612 - DNA, 75 bp, Artificial Sequence
  Synthetic
ttgactgggtcccgcagggacgaaccacatggagcatccacgcgagtggagcgtggatgaccacagaggacatgc

SEQ ID NO: 215613 - DNA, 75 bp, Artificial Sequence
  Synthetic
gaataccagtgagagccgtggcccatggagaacctaatgtcaatgtagctagcctgataactcccaaatccatcc

SEQ ID NO: 215614 - DNA, 75 bp, Artificial Sequence
  Synthetic
atggagacaactgggaggaggtttcgttgaactgcagctgccaccaggagacaacatcatctatgttggtgagct

SEQ ID NO: 215615 - DNA, 75 bp, Artificial Sequence
  Synthetic
ggacgccgagaacgggcggaatgggcaaagaacatctggggatcagtggagaaagtgaggaggatgatcgggccc

SEQ ID NO: 215616 - DNA, 75 bp, Artificial Sequence
  Synthetic
tggcagcacaccatttggtgacgggaagctggtcgctcccgacgcaggccgtcgtaagaactttgtgagaccaaa

SEQ ID NO: 215617 - DNA, 75 bp, Artificial Sequence
  Synthetic
ctccccgaaccatcatcaccaagacacagattgtcagacaaggaggtggtgcatgtttcggaaaaaacatccgct

SEQ ID NO: 215618 - DNA, 75 bp, Artificial Sequence
  Synthetic
agatttttttgcacgtgagtgctctcgtttcagacaacgtgagtggcgctttgtttgtacttccttggtgggaaa

SEQ ID NO: 215619 - DNA, 75 bp, Artificial Sequence
  Synthetic
gttttgaagcgttaacgtgttgaggaaaagacagcttaggagaacaagagctggggatggccaaaggagccgtcc

SEQ ID NO: 215620 - DNA, 75 bp, Artificial Sequence
  Synthetic
gcgcatgatgggagtgttgtggcatatgatcgccgggacggccaggagtccgattctcaagcgattctgggcgac

SEQ ID NO: 215621 - DNA, 75 bp, Artificial Sequence
  Synthetic
agttccggtgcggcaggccatcgcagcgctccgcaaaattagaaagacagttggactgctattggactctctaaa

SEQ ID NO: 215622 - DNA, 75 bp, Artificial Sequence
  Synthetic
catcttgatgagcatggaacttggaccagagattgtggcactagtcctgctgcaggcggtgtttgacatgaggac

SEQ ID NO: 215623 - DNA, 75 bp, Artificial Sequence
  Synthetic
ggctgaaggcaaaccatccgtggatgtctggctcgatgacatacaccaggagaacccggctaagacacgagagta

SEQ ID NO: 215624 - DNA, 75 bp, Artificial Sequence
  Synthetic
gggcgtgatcgggccatcagactcacaggatcctcgactcttacgtgtggaggcctggctgaaagagcacggaga

SEQ ID NO: 215625 - DNA, 75 bp, Artificial Sequence
  Synthetic
agaacccggctaagacacgagagtattgtctccatgccaagctggcaagctcaaaggtggtcgcacgctgcccgg

SEQ ID NO: 215626 - DNA, 75 bp, Artificial Sequence
  Synthetic
ttgaccatttttctatcagccgccacggcaatggcggtctggagcatgatcaagggtcaacgggaccagaaggga

SEQ ID NO: 215627 - DNA, 75 bp, Artificial Sequence
  Synthetic
cagtccgagaagaccatcttgacactgggagattatggagacatctctctcacgtgccgggtgactagtggagtg

SEQ ID NO: 215628 - DNA, 75 bp, Artificial Sequence
  Synthetic
gactgggtcccgcagggacgaaccacatggagcatccacgcaagtggagcgtggatgaccacagaagacatgctg

SEQ ID NO: 215629 - DNA, 75 bp, Artificial Sequence
  Synthetic
gcccaaggcttggcaggtgcaccgagactggtttgaagacctctccttgccatggcgacacgagggcgcccatga

SEQ ID NO: 215630 - DNA, 75 bp, Artificial Sequence
  Synthetic
atcccgtacctccctaagtcccaggatgggttgtgctcttccctggtgggacgccgagaacgggcggaatgggca

SEQ ID NO: 215631 - DNA, 75 bp, Artificial Sequence
  Synthetic
aggaggggggagagggaaaattggcattccctctcaggagatttcctccccctacaactaaatttccccctgcca

SEQ ID NO: 215632 - DNA, 75 bp, Artificial Sequence
  Synthetic
gggggagagggaaaattggcattccctctcaggagatttcctccccctacaactaaatttccccctgccatgcac

SEQ ID NO: 215633 - DNA, 75 bp, Artificial Sequence
  Synthetic
tgtcgattccagtgcatgctcatagtgatcttaccggaagagggcataagtggcttaggggggactcagtcaaga

SEQ ID NO: 215634 - DNA, 75 bp, Artificial Sequence
  Synthetic
ggtatggaagaataagctcctgacgatggccttttgtgcagttgtgtggatggtcacagatagcttaccgacaag

SEQ ID NO: 215635 - DNA, 75 bp, Artificial Sequence
  Synthetic
aatcgccacggcgttttatggttgggattgaggggactggggagtgtccacttgataaacgccgaacaggagtct

SEQ ID NO: 215636 - DNA, 75 bp, Artificial Sequence
  Synthetic
ggccgttctaggggtggccactcttggcatactgtggtgctttgtggcaagaacttcggttagccgaatgttttt

SEQ ID NO: 215637 - DNA, 75 bp, Artificial Sequence
  Synthetic
tgggcacggttgtgctctttgctgccctcttgttgctgtggattggtggggtggactacggacacatggcaggga

SEQ ID NO: 215638 - DNA, 75 bp, Artificial Sequence
  Synthetic
tatggcttcttgcagggttggtggcttcagcttttcactgggccggcattctgatagtattggctatatggacat

SEQ ID NO: 215639 - DNA, 75 bp, Artificial Sequence
  Synthetic
caagagacacaccaatgtcagccgggagaactcatcctggagaatggtaggaaacttggagcagttcctattgac

SEQ ID NO: 215640 - DNA, 75 bp, Artificial Sequence
  Synthetic
catcctcctaatggagaaatggaaactccgcaacccctgacgcgtcctgcgtgttcaaggttttggccccgtata

SEQ ID NO: 215641 - DNA, 75 bp, Artificial Sequence
  Synthetic
acccggccggggagatcctttcccggagtccaatggagccatcatgagtgaggaaagggccattccggacggaga

SEQ ID NO: 215642 - DNA, 75 bp, Artificial Sequence
  Synthetic
gtgttcaaggttttggccccgtatagaccagaggtacttgaggctctttcacagattccagcttcaatggggcgg

SEQ ID NO: 215643 - DNA, 75 bp, Artificial Sequence
  Synthetic
gtggagagaaggctttgactggataacagagtatgaggggcggacagcatggttcgtcccatccatatcaaaagg

SEQ ID NO: 215644 - DNA, 75 bp, Artificial Sequence
  Synthetic
caacaactggtgaatagttcggtggctagtggtgctcaggctatgagagatcttgggggtgggaaccccttcttc

SEQ ID NO: 215645 - DNA, 75 bp, Artificial Sequence
  Synthetic
ccagattttgtggtaacaacagacatctctgagatgggtgccaacttggatgtcagccgagttattgatggcaga

SEQ ID NO: 215646 - DNA, 75 bp, Artificial Sequence
  Synthetic
catatactctggacagtgtgacgatgatgacaccagcctcgttcaatggaaggaggcacagatactcttggacaa

SEQ ID NO: 215647 - DNA, 75 bp, Artificial Sequence
  Synthetic
aggaggcacagatactcttggacaacattaccacactgaggggtccagttgctactttttatggacccgagcaga

SEQ ID NO: 215648 - DNA, 75 bp, Artificial Sequence
  Synthetic
tgaagatgccagaagtggctggccactacaggctgaatgaggagaaaaggaaacacttccggcacttgatgaccc

SEQ ID NO: 215649 - DNA, 75 bp, Artificial Sequence
  Synthetic
ggcaagggccggagggaaatgctattgatggggccgatggagatctagtgcggttcaaaacacctggcggctcag

SEQ ID NO: 215650 - DNA, 75 bp, Artificial Sequence
  Synthetic
ttggagaccagcggggacctaccaaggttcccgaagtggatctggggactggcacacgctgtgtggtactggcag

SEQ ID NO: 215651 - DNA, 75 bp, Artificial Sequence
  Synthetic
agcagagcaatgcgcatggctgagagagatgcgccagaggcatttctgactattgttgaggtggccgttctaggg

SEQ ID NO: 215652 - DNA, 75 bp, Artificial Sequence
  Synthetic
gcgggaaagaaaacaccacgactgtgcacgcgagaagaattcatcgcaaaggtgcgctcaaacgctgcgctcgga

SEQ ID NO: 215653 - DNA, 75 bp, Artificial Sequence
  Synthetic
ggattggtggggtggactacggatacatggcagggatagccctgatattctacatcttcctcactgtgctgcagc

SEQ ID NO: 215654 - DNA, 75 bp, Artificial Sequence
  Synthetic
acgaccgcttcgggaaggccctctacttcttgaatgatatgctaaggtgagaaaggacattggagaatgggagcc

SEQ ID NO: 215655 - DNA, 75 bp, Artificial Sequence
  Synthetic
ttcggggtggccggtcatgtaattgccttgggtgtcacgtcacttgtgggtgccactcccttgtctttgggtttg

SEQ ID NO: 215656 - DNA, 75 bp, Artificial Sequence
  Synthetic
ggggtggctctggctgccttccacttggccatcgtcgcttcgggattggaagcagaactgacgcagagggcgcac

SEQ ID NO: 215657 - DNA, 75 bp, Artificial Sequence
  Synthetic
catccacgcgagtggagcgtggatgaccacagaggacatgctggaagtgtggaatcgagtctggattcttgacaa

SEQ ID NO: 215658 - DNA, 75 bp, Artificial Sequence
  Synthetic
ggaatcgagtctggattcttgacaatcaatccttttatgagtgacaaagggaaagtgaaggaatggaggggacat

SEQ ID NO: 215659 - DNA, 75 bp, Artificial Sequence
  Synthetic
gttgggccagttggtccatcccgagactgagacactctggacaatgccaatggcgtgtggtatggcgggactcgt

SEQ ID NO: 215660 - DNA, 75 bp, Artificial Sequence
  Synthetic
gggttgtgctcttccctggtgggacgccgagaacgggcggaatgggcaaagaacatctggggatcagtggagaaa

SEQ ID NO: 215661 - DNA, 75 bp, Artificial Sequence
  Synthetic
gaacgtgacagggctcgagagcttctgaagagaggtgagacaaacatgggactggctgtctctcgagggacggct

SEQ ID NO: 215662 - DNA, 75 bp, Artificial Sequence
  Synthetic
caagagctggggatggccaaaggagccgtccttaaaggaaaggggggcggtccccctaggcgagtgccgaaagag

SEQ ID NO: 215663 - DNA, 75 bp, Artificial Sequence
  Synthetic
aggttatgaaggcccctggctttggccaggaggggggagagggaaaattggcattccctctcaggagatttccaa

SEQ ID NO: 215664 - DNA, 75 bp, Artificial Sequence
  Synthetic
acaggagggatctgagaacgcttggtttggcaatctgctcagctgtgcccattgactgggtcccgcagggacgaa

SEQ ID NO: 215665 - DNA, 75 bp, Artificial Sequence
  Synthetic
ctggaagtgtggaatcgagtctggattcttgacaatccttttatgagtgacaaagggaaagtgaaggaatggagg

SEQ ID NO: 215666 - DNA, 75 bp, Artificial Sequence
  Synthetic
caaagggaaagtgaaggaatggagggacatcccgtacctccctaagtcccaggatgggttgtgctcttccctggt

SEQ ID NO: 215667 - DNA, 75 bp, Artificial Sequence
  Synthetic
agaaagtgaggaggatgatcgggcccgagaggtatgcagattacctgtcttgcatggacaggcatgagcttcact

SEQ ID NO: 215668 - DNA, 75 bp, Artificial Sequence
  Synthetic
agcctcccagagaaggccgaactgggaggccatgaaggcccctggctttagccaggaggggggagagggaaaatt

SEQ ID NO: 215669 - DNA, 75 bp, Artificial Sequence
  Synthetic
agaagaagagggaagagaaggtcaaccactgggcttctcacatcaatcttgctggcctgcctggcgacactggtg

SEQ ID NO: 215670 - DNA, 75 bp, Artificial Sequence
  Synthetic
gtggaagtcgtgaatggaacgtgcatcattctcgccacagacatggggagttggtgtgatgattcaatcatgtac

SEQ ID NO: 215671 - DNA, 75 bp, Artificial Sequence
  Synthetic
cagttggcggcagaagcaggaggtcggtgtcgattccagtgcatgctcatagtgatcttaccggaagagggcata

SEQ ID NO: 215672 - DNA, 75 bp, Artificial Sequence
  Synthetic
ggtgtcgattccagtgcatgctcatagtgatcttaccggaagagggcataagtggcttaaaggggactcagtcaa

SEQ ID NO: 215673 - DNA, 75 bp, Artificial Sequence
  Synthetic
aggtggagtccctggcattgtggctgtgttcgtggtcctggagctggtcatcaggagacgcccaacaactggcac

SEQ ID NO: 215674 - DNA, 75 bp, Artificial Sequence
  Synthetic
ctcagtggtgtggtgtgggatggttgtccttggccttgttgtgactgggctagtcaccattgagggcctatgccg

SEQ ID NO: 215675 - DNA, 75 bp, Artificial Sequence
  Synthetic
ctatgtggtggccgtcggcatcttgatgagcatggagctcggaccagagattgtggcactagttctgctacaggc

SEQ ID NO: 215676 - DNA, 75 bp, Artificial Sequence
  Synthetic
gagatggccatgtggagacgtgtggaggctgtgctcaacttggcccttgcagagaatgatgccaacctcacggtg

SEQ ID NO: 215677 - DNA, 75 bp, Artificial Sequence
  Synthetic
aagacttcatggaagggatggagccaatcctttgtgtggagtgtcccagaatcgccacggcgttttatggttggg

SEQ ID NO: 215678 - DNA, 75 bp, Artificial Sequence
  Synthetic
aatcctttgtgtggagtgtcccagaatcgccacggcgttttatggttgggattgaggggactggggagtgtccgc

SEQ ID NO: 215679 - DNA, 75 bp, Artificial Sequence
  Synthetic
ccgatcagagtctctggatgaagtcgcacaggaacgcaacgggagtgttcatatcagaactgatagtgaccgact

SEQ ID NO: 215680 - DNA, 75 bp, Artificial Sequence
  Synthetic
tctgaaagtgaggcaggacgccatggggaatctccatctcactgaggtggagaaggaagaacgcgcgatggcgtt

SEQ ID NO: 215681 - DNA, 75 bp, Artificial Sequence
  Synthetic
gggaatctccatctcactgaggtggagaaggaagaacgcgcgatggcgttatggcttcttgcagggttggtggct

SEQ ID NO: 215682 - DNA, 75 bp, Artificial Sequence
  Synthetic
agaaggaagaacgcgcgatggcgttatggcttcttgcagggttggtggcttcagcttttcactgggccggcattc

SEQ ID NO: 215683 - DNA, 75 bp, Artificial Sequence
  Synthetic
aagagacacaccaatgtcagccgggagaactcatcctggagaatggtaggaaacttggagcagttcctattgacc

SEQ ID NO: 215684 - DNA, 75 bp, Artificial Sequence
  Synthetic
gggacgttaaagactttatactgtacgcctccgggcgtcgcagcgttggcgatgtcctgggtggtctagcggggg

SEQ ID NO: 215685 - DNA, 75 bp, Artificial Sequence
  Synthetic
tctttgctgccctcttgttgctgtggattggtggggtggactacggacacatggcagggatagccctgatattct

SEQ ID NO: 215686 - DNA, 75 bp, Artificial Sequence
  Synthetic
agagccggggaaacagcgaagtagcgatgacaatagactggcatacttcctcctaggactccttagcttggctgg

SEQ ID NO: 215687 - DNA, 75 bp, Artificial Sequence
  Synthetic
tccagtccaggaagttgttagccagatttggagaccagcggggacccaccaaggttcccgaagtggatctgggga

SEQ ID NO: 215688 - DNA, 75 bp, Artificial Sequence
  Synthetic
cagcgggctgggacacaagaattaccaatgcagaccttgaggatgaggagcaaatcctgcgttatctgaggggcg

SEQ ID NO: 215689 - DNA, 75 bp, Artificial Sequence
  Synthetic
tgaacaccctcacgaacatcaaggtgcagctcatccgcatgatggagggagagggcgtgatcgggccatcagact

SEQ ID NO: 215690 - DNA, 75 bp, Artificial Sequence
  Synthetic
gcatggacaggcatgagcttcactgggacctgaagctggaaagcaacatcatttagatgcactaaccacctggaa

SEQ ID NO: 215691 - DNA, 75 bp, Artificial Sequence
  Synthetic
atggccaaaggagccgtccttaaaggaaaggggggcggtccccctaggcgagtgccgaaagagaccgcaaaaaag

SEQ ID NO: 215692 - DNA, 75 bp, Artificial Sequence
  Synthetic
gaaaggggggcggtccccctaggcgagtgccgaaagagaccgcaaaaaagacgcgtcaaggaccaggccgattgc

SEQ ID NO: 215693 - DNA, 75 bp, Artificial Sequence
  Synthetic
caaacggactggtattgatgcgcatgatgggagtgctgtggcatatggtcgctggaacggccaggaatccgatcc

SEQ ID NO: 215694 - DNA, 75 bp, Artificial Sequence
  Synthetic
tcaagcgattctgggcgactgttccggtacggcaggccattgcagcgctccgtaaaatccgaaagacagttggac

SEQ ID NO: 215695 - DNA, 75 bp, Artificial Sequence
  Synthetic
tgctattggactctttaaataaaagaagagggaagagaaggtcaaccaccggattgctcacgccaatcttgctag

SEQ ID NO: 215696 - DNA, 75 bp, Artificial Sequence
  Synthetic
cttgcctggcgaccctggtgttctctgcgacagttcgcagagagagaacagggaacatggtgatcagggcagaag

SEQ ID NO: 215697 - DNA, 75 bp, Artificial Sequence
  Synthetic
gaaaggacgcagccacgcaagtggaagtcatgaatggaacatgcaccattcttgccacagacatggggagttggt

SEQ ID NO: 215698 - DNA, 75 bp, Artificial Sequence
  Synthetic
gtgatgattcaatcatgtacgagtgtgtcaccattgactcgggagaagaaccagttgatgtggattgcttctgca

SEQ ID NO: 215699 - DNA, 75 bp, Artificial Sequence
  Synthetic
aaggcgttgagcgagtgtcactggaatacggaaggtgtgggaaaccagctggcggtagaaacaggaggtcagtgt

SEQ ID NO: 215700 - DNA, 75 bp, Artificial Sequence
  Synthetic
cgattccggtgcatgctcatagtgatctcaccggaagagggcacaagtggcttaaaggggactcagtcaagacac

SEQ ID NO: 215701 - DNA, 75 bp, Artificial Sequence
  Synthetic
atctgacacgtgtggaaggctgggtttggaaaaacaagttcctgacagcggccttttgtgcagttgtgtggatgg

SEQ ID NO: 215702 - DNA, 75 bp, Artificial Sequence
  Synthetic
taacggacagcctgccgacaaggttcattgtcataacggtggccctttgcctggctcctacatatgccacacgat

SEQ ID NO: 215703 - DNA, 75 bp, Artificial Sequence
  Synthetic
gcacacacctgcagaaccgggactttgtctcagggacccaagggacgactagagtttcattggtgttggaattag

SEQ ID NO: 215704 - DNA, 75 bp, Artificial Sequence
  Synthetic
gcggctgtgtcaccctcacagctgaaggcaagccatcagtggatgtttggctcgacgacatacaccaggagaacc

SEQ ID NO: 215705 - DNA, 75 bp, Artificial Sequence
  Synthetic
cggccaagacacgagagtattgtcttcatgccaagctggcaaactccaaggtggccgcacgttgtccagccatgg

SEQ ID NO: 215706 - DNA, 75 bp, Artificial Sequence
  Synthetic
gtccagcgacactgccagaggagcaccaggcgagcacagtctgtagacgagaccagagtgacagaggctggggta

SEQ ID NO: 215707 - DNA, 75 bp, Artificial Sequence
  Synthetic
accattgtggactgttcgggaagggcagcattgtggcttgtgccaagtttagctgtgaggccaaaaagaaggcaa

SEQ ID NO: 215708 - DNA, 75 bp, Artificial Sequence
  Synthetic
ctggatatgtgtacgatgtcaacaaaatcacatatgtggtgaaggtggaacctcacacgggtgactatctagcgg

SEQ ID NO: 215709 - DNA, 75 bp, Artificial Sequence
  Synthetic
cctcacacgggtgactatctagcggccaacgagtcgcacagcaaccggaagacagcatctttcacaacgcagtcc

SEQ ID NO: 215710 - DNA, 75 bp, Artificial Sequence
  Synthetic
ccgggtgactagtggagtggatcctgcccagactgtggtattggaactggacaagacagcggaacacttgcccaa

SEQ ID NO: 215711 - DNA, 75 bp, Artificial Sequence
  Synthetic
ggcttggcaggtacaccgagactggtttgaggacctctccttgccatggcgacacgggggtgcccaggaatggaa

SEQ ID NO: 215712 - DNA, 75 bp, Artificial Sequence
  Synthetic
ccatgctgaccggctcgtggaatttggtgaaccgcacgctgtgaaaatggacatttttaaccttggggaccagac

SEQ ID NO: 215713 - DNA, 75 bp, Artificial Sequence
  Synthetic
gggtatcctgttgaagtctctggctggagtgcccgtggctaacatagagggcagcaagtaccatctccagagtgg

SEQ ID NO: 215714 - DNA, 75 bp, Artificial Sequence
  Synthetic
tcatgtcacctgcgatgtgggccttgaaaaacttaagatgaaagggatgacatacacggtttgtgagggatcaaa

SEQ ID NO: 215715 - DNA, 75 bp, Artificial Sequence
  Synthetic
atttgcttggaaaaggccgccaaccgacagtggacatgataccgtagtcatggaggtgacttacaccgggagcaa

SEQ ID NO: 215716 - DNA, 75 bp, Artificial Sequence
  Synthetic
gccatgcagaataccagtgagagccgtggcccatggagaacccaatgttaacgtggcaagtctaataaccccaaa

SEQ ID NO: 215717 - DNA, 75 bp, Artificial Sequence
  Synthetic
cccatccatggaaacaactggaggagggttcgttgagctacagctaccaccaggagacaacatcatctatgttgg

SEQ ID NO: 215718 - DNA, 75 bp, Artificial Sequence
  Synthetic
tgagctgagccaccagtggtttcagaagggcagcacaattggccgtgttctggaaaagaccaggaggggcataga

SEQ ID NO: 215719 - DNA, 75 bp, Artificial Sequence
  Synthetic
gacatgctggaagtgtggaaccgggtctggattcttgacaaccccttcatgggggacaaagggaaagtgagagaa

SEQ ID NO: 215720 - DNA, 75 bp, Artificial Sequence
  Synthetic
gagactcacagttgtgggagagcacgcctgggacttcggttcggtaggcggcatgctatcatcagtggggaaggc

SEQ ID NO: 215721 - DNA, 75 bp, Artificial Sequence
  Synthetic
tctacacacggcttttggcgcagcatttaataccatttttggaggggtgggattcctcccacgcattctgctggg

SEQ ID NO: 215722 - DNA, 75 bp, Artificial Sequence
  Synthetic
ggtagctctggcttggctggggctcaactcacggaaccccaccctttcagtcggctttttgattactggtggact

SEQ ID NO: 215723 - DNA, 75 bp, Artificial Sequence
  Synthetic
tgtgttgacaatgacactgggggttggtgctgatatgggctgtgcaattgatgctaacaggatggagctacgatg

SEQ ID NO: 215724 - DNA, 75 bp, Artificial Sequence
  Synthetic
tggtgagggccttgttgtgtggagagaggtcaccgactggtatgatggttacgcattccacccagaatcgccctc

SEQ ID NO: 215725 - DNA, 75 bp, Artificial Sequence
  Synthetic
accgtgtgacaggggcaacgcggtaaggattgaaggagccccaacgacgaactgtggcagcacaccatttggtga

SEQ ID NO: 215726 - DNA, 75 bp, Artificial Sequence
  Synthetic
tgtccttgcggcatctctaaaagaagcatatgaggaaggaatttgtggtattgtgccccagaaccggcttgagat

SEQ ID NO: 215727 - DNA, 75 bp, Artificial Sequence
  Synthetic
ggccatgtggaggcgtgtggaggctgtgctcaacttggccctcgcagagagtgatgctaatctaacggtggttgt

SEQ ID NO: 215728 - DNA, 75 bp, Artificial Sequence
  Synthetic
ggacaaaagagatcccagtgactacaggggaggcaaagtgggaaccctaaggcgttcaggcaaggaaatgaagac

SEQ ID NO: 215729 - DNA, 75 bp, Artificial Sequence
  Synthetic
gtcatggaagggatggagccaatcctttgtgtggagtgtcccagaagcgccacggcgttttatggttggggttga

SEQ ID NO: 215730 - DNA, 75 bp, Artificial Sequence
  Synthetic
gggggctggagagtgtcctcttgacaaacgccgaacaggagtcttcacagtggcagagtttgggatgggaatgag

SEQ ID NO: 215731 - DNA, 75 bp, Artificial Sequence
  Synthetic
gaccaaggtcttcttggacctacgtgagactgcctcctcagactgtgataccggagtcatgggggctgcagtcaa

SEQ ID NO: 215732 - DNA, 75 bp, Artificial Sequence
  Synthetic
aagcggtcatgccgtccacaccgaccaaagtctttggatgaggtcgcacaggaatgcaacgggagtgttcatatc

SEQ ID NO: 215733 - DNA, 75 bp, Artificial Sequence
  Synthetic
tgagttgatagtgaccgacctacggaactgcacatggccagccagccacaccttggacaacgccggtgtcgtgga

SEQ ID NO: 215734 - DNA, 75 bp, Artificial Sequence
  Synthetic
ctcaaaactcttccttccagcaggcctggctggaccacggtcgcactacaatcacattcctgggtacgcagaaca

SEQ ID NO: 215735 - DNA, 75 bp, Artificial Sequence
  Synthetic
ggttaaggggccatggagccaaacgcccctacgggtggtaagggaaccctgccctgggactgcggttaagattga

SEQ ID NO: 215736 - DNA, 75 bp, Artificial Sequence
  Synthetic
tgcaggggacaggctggatgtcaaaaggtcagattacggtgctggacatgcacccggggtcagggaagacacatc

SEQ ID NO: 215737 - DNA, 75 bp, Artificial Sequence
  Synthetic
ccagagttgtgacaaaaggggggcgtcgctgcgtagcacgacggaaagcgggaaggccataccagaatggtgttg

SEQ ID NO: 215738 - DNA, 75 bp, Artificial Sequence
  Synthetic
ccgcacatgtgagctgcccccagtcacattccgtagtgggactgattgctggtatgccatggaaattagaccagt

SEQ ID NO: 215739 - DNA, 75 bp, Artificial Sequence
  Synthetic
cgtcggcatcttgatgagcatggagctcggaccagagattgtggcactagttctgctacaggcagtgtttgacat

SEQ ID NO: 215740 - DNA, 75 bp, Artificial Sequence
  Synthetic
gaggactggcctcctggtggcttttgcagtcaaaagggcctacacaactagagaggctgtggcaacctatttctt

SEQ ID NO: 215741 - DNA, 75 bp, Artificial Sequence
  Synthetic
gctcctcgtgctggaacttgggtttccggaggcctcactgagtaacatctggaagtgggccgactccttggcaat

SEQ ID NO: 215742 - DNA, 75 bp, Artificial Sequence
  Synthetic
gggagcactgattctccaggcgtgtggtcaggagggtagaactcgagtgggctatctcctggcagctatgatgac

SEQ ID NO: 215743 - DNA, 75 bp, Artificial Sequence
  Synthetic
ggtcaggagggtagaactcgagtgggctatctcctggcagctatgatgacccaaaaggacatggtaataatccac

SEQ ID NO: 215744 - DNA, 75 bp, Artificial Sequence
  Synthetic
aagggactttcctgggccacaccacttgcaggcctccttggaggcgagggagtgggtcttagattgctggcgttt

SEQ ID NO: 215745 - DNA, 75 bp, Artificial Sequence
  Synthetic
cgaaagcttgccgagcgaaggaacagacggtctttcagtgaaccactgacggtggtgggagtcatgctcactgtg

SEQ ID NO: 215746 - DNA, 75 bp, Artificial Sequence
  Synthetic
gcaagtgggatggtgagacacacatcccaggaagcactgtgcgctcttgtagctggggcctttctcctcctcatg

SEQ ID NO: 215747 - DNA, 75 bp, Artificial Sequence
  Synthetic
atggtactgggaacacggaagatgcagctcaccgcagagtggtgcggtgaagtggaatggaacccagacctagtg

SEQ ID NO: 215748 - DNA, 75 bp, Artificial Sequence
  Synthetic
agctcaccgcagagtggtgcggtgaagtggaatggaacccagacctagtgaacgagggaggagaggttaatctga

SEQ ID NO: 215749 - DNA, 75 bp, Artificial Sequence
  Synthetic
tcacaccctggacaatgccggtgtcgttgattcaaaactctttcttccagttagcctggctggaccacggtcgca

SEQ ID NO: 215750 - DNA, 75 bp, Artificial Sequence
  Synthetic
ttcttgcagggttggtggcttcagccttccactgggcaggcattctaatagtattggctgtgtggacactttttg

SEQ ID NO: 215751 - DNA, 75 bp, Artificial Sequence
  Synthetic
agatgctgggctcggggcgaaggtctgaacttgtcttctctggacaggagacccggaccgaaaggaatcggccct

SEQ ID NO: 215752 - DNA, 75 bp, Artificial Sequence
  Synthetic
ttgagatcaaggatggagcctatcgcatctacagccctggcttgctttggggacaccgccaaattggagtggggt

SEQ ID NO: 215753 - DNA, 75 bp, Artificial Sequence
  Synthetic
atggagccaagggagttctgcacaccatgtggcacgtcactaggggggcagccctggttgtggatgaggcaatct

SEQ ID NO: 215754 - DNA, 75 bp, Artificial Sequence
  Synthetic
ctggaccctattgggctgacgtcagggaagacgttgtgtgctatggtggagcatggagtcttgagagccggtgga

SEQ ID NO: 215755 - DNA, 75 bp, Artificial Sequence
  Synthetic
ggggtgagaccgttcaggtgcacgcgtttccaccagggagaccccaagagacacaccagtgccagccgggtgaac

SEQ ID NO: 215756 - DNA, 75 bp, Artificial Sequence
  Synthetic
tcatcctggagaatggcaggaaacttggagcagtccctattgacctgagcaaaggcacctcgggaagtcctatca

SEQ ID NO: 215757 - DNA, 75 bp, Artificial Sequence
  Synthetic
ttaacgcccagggagaggtggtgggtctttatgggaacggcctgaagaccaatgaagcctacgtcagcagcatag

SEQ ID NO: 215758 - DNA, 75 bp, Artificial Sequence
  Synthetic
cacaaggagaagccgagaaaagcagaccggaaatcccgttgagtgtgcaaggaacaggctggatgtcaaaaggtc

SEQ ID NO: 215759 - DNA, 75 bp, Artificial Sequence
  Synthetic
aaatcacggtgctggacatgcatccggggtcagggaagacacatcgagtcctcccggagcttgtgaggcagtgtg

SEQ ID NO: 215760 - DNA, 75 bp, Artificial Sequence
  Synthetic
cagaccgagggatgaggactctagttcttgcccccacccgggtggtcctgaaggagatggagagagcgcttgctg

SEQ ID NO: 215761 - DNA, 75 bp, Artificial Sequence
  Synthetic
gcaagaaggtccgattccactcacccgcggtggaagggcagaccacagcgggggccattgttgacgtcatgtgcc

SEQ ID NO: 215762 - DNA, 75 bp, Artificial Sequence
  Synthetic
atgccacgtacgtccacagaaggctgctgccccaagggagacaaaattgggaagtcgccataatggatgaggccc

SEQ ID NO: 215763 - DNA, 75 bp, Artificial Sequence
  Synthetic
attggactgatccgcacagtatcgcggcaagagggcatctttattcgctcgccaaagagaacaggtgcgccttgg

SEQ ID NO: 215764 - DNA, 75 bp, Artificial Sequence
  Synthetic
ggcaagagggcatctttattcgctcgccaaagagaacaggtgcgccttggtgctcatgacagcaactccacccgg

SEQ ID NO: 215765 - DNA, 75 bp, Artificial Sequence
  Synthetic
aatggagccattatgagtgaggaaagggccattccggacggagagtggagagtgggctttgactggataacagag

SEQ ID NO: 215766 - DNA, 75 bp, Artificial Sequence
  Synthetic
tatgagggtcgaacagcatggttcgttccatccatatcaaaaggtggggcggttgcaagaaccctgcgccagaga

SEQ ID NO: 215767 - DNA, 75 bp, Artificial Sequence
  Synthetic
ggcaaaagtgtgatctgtctcaacagtaaaacctttgagaaggattacctgagggtcagggaagagaagccagat

SEQ ID NO: 215768 - DNA, 75 bp, Artificial Sequence
  Synthetic
gtaaaacctttgagaaggattacctgagggtcagggaagagaagccagattttgtggtgacaacagatatctctg

SEQ ID NO: 215769 - DNA, 75 bp, Artificial Sequence
  Synthetic
agatgggtgccaacctggatgtcagccgagttattgatggtagaacaaacataaagccagaggaggtggatggaa

SEQ ID NO: 215770 - DNA, 75 bp, Artificial Sequence
  Synthetic
aggtagagttgactggaaccaggaaggtcacgacagcatcggcggctcagcgccggggcagggtgggaaggacat

SEQ ID NO: 215771 - DNA, 75 bp, Artificial Sequence
  Synthetic
ctggacgcactgatgagtacatatactctggacagtgtgatgatgacgacaccagcctcgttcaatggaaggagg

SEQ ID NO: 215772 - DNA, 75 bp, Artificial Sequence
  Synthetic
cgcagatactcctggacaatatcaccacactgaggggtccggtcgcaactttttatggacccgagcaggtgaaga

SEQ ID NO: 215773 - DNA, 75 bp, Artificial Sequence
  Synthetic
tgccagaagtggctggccactacaggctgaatgaggagaaaaggaaacacttccggcacttgatgactcaatgtg

SEQ ID NO: 215774 - DNA, 75 bp, Artificial Sequence
  Synthetic
acttcactccctggctggcgtggcatgtcgccaccaacaccagcaatgtgttggatcggagctggacctggcagg

SEQ ID NO: 215775 - DNA, 75 bp, Artificial Sequence
  Synthetic
ggccggaggaaaatgccattgacggggccgacggagatctggtgcggtttaaaacgcctggcggctcagaacgtg

SEQ ID NO: 215776 - DNA, 75 bp, Artificial Sequence
  Synthetic
tcttgcagccggtgtggaaggactgcagaatgttccgtgagggacgggacgtcaaagacttcatactgtacgcct

SEQ ID NO: 215777 - DNA, 75 bp, Artificial Sequence
  Synthetic
ccgggcgtcgcagtgttggtgatgttttgggtggtctggcgggggtccccggtctcttgaggcacaggtgcgcca

SEQ ID NO: 215778 - DNA, 75 bp, Artificial Sequence
  Synthetic
gcgcgcttgacgtagtttacacccttctcaatgagaatccgggcagcagggcaatgcgcatggctgagagagatg

SEQ ID NO: 215779 - DNA, 75 bp, Artificial Sequence
  Synthetic
caccagaggcatttctgactattgttgaggttgctgttttaggagtggccactcttggcatactctggtgctttg

SEQ ID NO: 215780 - DNA, 75 bp, Artificial Sequence
  Synthetic
tggcaagaacttcggtcagccgcatgttcctgggcacggttgtgctctttgctgccctctttctgctgtggattg

SEQ ID NO: 215781 - DNA, 75 bp, Artificial Sequence
  Synthetic
gctagcctgcctggcgacactggtgatctccgcgacaattcgcagagagagaacaggggacatggtgatcagggc

SEQ ID NO: 215782 - DNA, 75 bp, Artificial Sequence
  Synthetic
gtggagtggactatggacacatggcagggatagccctgatattttacaccctcctcactgtgctgcagccagagc

SEQ ID NO: 215783 - DNA, 75 bp, Artificial Sequence
  Synthetic
cgggaaaacagcgaagtagcgatgacaacagactggcatacttcctcctggggctttttagtttggctggactcg

SEQ ID NO: 215784 - DNA, 75 bp, Artificial Sequence
  Synthetic
tgacggccaacgaaatgggcatgttggacaagacaaaggctgaccttgcagggctggtgtggcgcggagagcaga

SEQ ID NO: 215785 - DNA, 75 bp, Artificial Sequence
  Synthetic
ggcatccagcctgggaggagtggacaaatgtggacatccaaccagcacgatcttggggggcgtatgtgctgatcg

SEQ ID NO: 215786 - DNA, 75 bp, Artificial Sequence
  Synthetic
tctctctgttcactccctacatgctgcaccagcttcagacaaaaatacaacaactggtgaacagttcagtggcaa

SEQ ID NO: 215787 - DNA, 75 bp, Artificial Sequence
  Synthetic
gtggtgctcaggctatgagagatcttgggggtgggacaccattcttcggggtggccggccatgtgattgccttgg

SEQ ID NO: 215788 - DNA, 75 bp, Artificial Sequence
  Synthetic
gcgtcacgtcactcgtgggtgccactcccatgtccttgggcttgggggtggctttggctgctttccacttggcca

SEQ ID NO: 215789 - DNA, 75 bp, Artificial Sequence
  Synthetic
tcgtcgcctcgggattggaagcagagctgacgcagagggcgcacagggtattcttctcggcaatggttaaaaacc

SEQ ID NO: 215790 - DNA, 75 bp, Artificial Sequence
  Synthetic
caatggtggatggagacgtcatcaatcccttccccgatggagagacaaagccagcgctatacgagagaaggatga

SEQ ID NO: 215791 - DNA, 75 bp, Artificial Sequence
  Synthetic
gtttaatcctggccattgccttgtgcatgggttcagtggtcctcaaccgaaccgcggcctcaatgaccgaggctg

SEQ ID NO: 215792 - DNA, 75 bp, Artificial Sequence
  Synthetic
gggctgttggcctagcagcgctgggtcagctggtccatcccgagactgagacactctggacaatgccaatggcgt

SEQ ID NO: 215793 - DNA, 75 bp, Artificial Sequence
  Synthetic
gtggtatggcggggctcgtgcgggggagcttctggggcctgttgcccatgggacaccgactgtggcttaggacaa

SEQ ID NO: 215794 - DNA, 75 bp, Artificial Sequence
  Synthetic
ggacaccgactgtggcttaggacaactggaacacgcagaggaggtgccgagggagagactcttggggacatctgg

SEQ ID NO: 215795 - DNA, 75 bp, Artificial Sequence
  Synthetic
tgtctctcgagggacggctaagctggcatggctagaagaacggggctatgcgaccttgaaaggtgaggttgttga

SEQ ID NO: 215796 - DNA, 75 bp, Artificial Sequence
  Synthetic
gatgtacttctccactgctgttagtggcaacatcgtcaattcagtgaacatccagtccaggaaattgttagccag

SEQ ID NO: 215797 - DNA, 75 bp, Artificial Sequence
  Synthetic
tctcggctgtggcagaggcgggtggtcatactacgctgcttccaggccagctgtcatgggagtgaaggcctacac

SEQ ID NO: 215798 - DNA, 75 bp, Artificial Sequence
  Synthetic
gataggagggaaaggccatgaggtcccaagactgatcacaagcctcggatggaacctcatcaagtttaggaccgg

SEQ ID NO: 215799 - DNA, 75 bp, Artificial Sequence
  Synthetic
aatggatgtgtactccctagaggcacacagggctgacaccatcctttgtgacattggtgagagtagtccggatcc

SEQ ID NO: 215800 - DNA, 75 bp, Artificial Sequence
  Synthetic
cctggcggaaggagagaggagccgccgtgtcatcctcctcatggagaaatggaaactccgcaaccctgacgcgtc

SEQ ID NO: 215801 - DNA, 75 bp, Artificial Sequence
  Synthetic
ctgcgtgttcaaggttttggctccgtacagaccagaggtgcttgaggctctccacagattccagcttcaatgggg

SEQ ID NO: 215802 - DNA, 75 bp, Artificial Sequence
  Synthetic
cggggggttggtccgcgtccctttctcccgcaattccacgcatgagatgtacttctccactgcgatcagtggtaa

SEQ ID NO: 215803 - DNA, 75 bp, Artificial Sequence
  Synthetic
cattatcaactcagtgaacactcagtccaggaagttgttggccagatttggggatcagcggggacccaccaaggt

SEQ ID NO: 215804 - DNA, 75 bp, Artificial Sequence
  Synthetic
ccccgaggtggatctgggaactggcacacgctgtgtggtactggcagaagacaaggtcagggaagctgatgtggc

SEQ ID NO: 215805 - DNA, 75 bp, Artificial Sequence
  Synthetic
cgaaagaatagctgccctcaagacccaatatggtgattcttggcatgtggacaaagaacatccatacagaacatg

SEQ ID NO: 215806 - DNA, 75 bp, Artificial Sequence
  Synthetic
gcaatattggggaagctacaagacagaggccacaggttcggctgcctctctgatcaacggagtggtgaaactcct

SEQ ID NO: 215807 - DNA, 75 bp, Artificial Sequence
  Synthetic
cagttggccctggaatgctagggaggatgtggtgcgcatggcaatgacggacacaacggcctttggccagcagag

SEQ ID NO: 215808 - DNA, 75 bp, Artificial Sequence
  Synthetic
ggtttttaaggaaaaggtggacaccaaagcgcaggagccgcaggtgggaaccaagatcatcatgagggccgttaa

SEQ ID NO: 215809 - DNA, 75 bp, Artificial Sequence
  Synthetic
aaagcgcaggagccgcaggtgggaaccaagatcatcatgagggccgttaacgactggatctttgaaagacttgcg

SEQ ID NO: 215810 - DNA, 75 bp, Artificial Sequence
  Synthetic
ggaaagaaaacaccacgactgtgcacgcgagaggaattcatcgcaaaggtgcgctcaaacgctgcgctcggagcc

SEQ ID NO: 215811 - DNA, 75 bp, Artificial Sequence
  Synthetic
tggtcagatgaacaaaatcgctggccaaacgcccgagaagcagtggaggaccccgagttttggaggctcgttgat

SEQ ID NO: 215812 - DNA, 75 bp, Artificial Sequence
  Synthetic
gaggaaagagagagacatcttggaggacggtgtgcccagtgtgtgtacaacatgatgggtaagagagagaagaaa

SEQ ID NO: 215813 - DNA, 75 bp, Artificial Sequence
  Synthetic
ctcggtgagttcggtgtcgccaaggggagccgtgccatctggtacatgtggttggggagccggtatctggaattt

SEQ ID NO: 215814 - DNA, 75 bp, Artificial Sequence
  Synthetic
gaggcactgggtttcctcaatgaagaccactgggcttccagggacctcagtggagcgggggttgaggggaccagt

SEQ ID NO: 215815 - DNA, 75 bp, Artificial Sequence
  Synthetic
tctgcgttatctggaaggcgaacaccgaaccctcgcaaagacaatcttggaaaaagcttaccatgccaaagtggt

SEQ ID NO: 215816 - DNA, 75 bp, Artificial Sequence
  Synthetic
caaagtggcgcgcccctccagctcgggaggctgcgtcatggacatcataaccagaagagaccaacgtggttcagg

SEQ ID NO: 215817 - DNA, 75 bp, Artificial Sequence
  Synthetic
ccaggtggtgacctacgctctaaacaccctcacgaacatcaaggtgcagcttatccgcatgatggagggagaggg

SEQ ID NO: 215818 - DNA, 75 bp, Artificial Sequence
  Synthetic
ggagggcttttctatgcagacgacacagcgggctgggacacaagaatcaccaatgcagaccttgaggatgaggag

SEQ ID NO: 215819 - DNA, 75 bp, Artificial Sequence
  Synthetic
cgtgatcgggccatctgactcacaggacccgcgactcctacgtgtggaagcctggctgaaagagcatggagagga

SEQ ID NO: 215820 - DNA, 75 bp, Artificial Sequence
  Synthetic
gcgcctgacccgcatgctggtcagtggggatgattgcgttgtgagaccaattgacgaccgcttcgggaaggccct

SEQ ID NO: 215821 - DNA, 75 bp, Artificial Sequence
  Synthetic
gaagcgttaacgtgttgaggaaaagacagcttaggagaacaagagctggggatggccaaaggagccgtccttaaa

SEQ ID NO: 215822 - DNA, 75 bp, Artificial Sequence
  Synthetic
ctacttcctaaatgacatggccaaggtgagaaaggacattggagagtgggagccctcagaaggttactccagctg

SEQ ID NO: 215823 - DNA, 75 bp, Artificial Sequence
  Synthetic
ggaggaggtccccttttgttcccaccatttccatgagttgacgatgaaggatggcagggtcataatcgtcccatg

SEQ ID NO: 215824 - DNA, 75 bp, Artificial Sequence
  Synthetic
cagagaccaagatgagttggtggggcgggcaagagtgtcacctgggtgtggctggagcgttagggaaacagcatg

SEQ ID NO: 215825 - DNA, 75 bp, Artificial Sequence
  Synthetic
tctctcaaaggcctatggacagatgtggctgctgagctacttccacaggagggacctgaggacgctcggcctggc

SEQ ID NO: 215826 - DNA, 75 bp, Artificial Sequence
  Synthetic
tggctgctgagctacttccacaggagggacctgaggacgctcggcctggcaatctgctcagctgtgcccattgat

SEQ ID NO: 215827 - DNA, 75 bp, Artificial Sequence
  Synthetic
gtgtggaaccgggtctggattcttgacaaccccttcatgggggacaaagggaaagtgagagaatggagggacatc

SEQ ID NO: 215828 - DNA, 75 bp, Artificial Sequence
  Synthetic
ggctgtgctcttccctggtgggacgccgagaacgggcggaatgggcaaagaacatctggggatcagtggagaaag

SEQ ID NO: 215829 - DNA, 75 bp, Artificial Sequence
  Synthetic
tgaggagaatgatcggccccgagaggtatgctgattatctctcctgcatggacaggcatgagctccactgggacc

SEQ ID NO: 215830 - DNA, 75 bp, Artificial Sequence
  Synthetic
tgaagttggaaagcaatatcatctaaatgcaccaaccatctgggaccagacaagacaacaccctcaccgtgtgac

SEQ ID NO: 215831 - DNA, 75 bp, Artificial Sequence
  Synthetic
aggggcaatcgcggtaaggattgaaggagccccaacgacgaactgtggcagcacaccatttggtgacgggaagct

SEQ ID NO: 215832 - DNA, 75 bp, Artificial Sequence
  Synthetic
ggggcaatcgcggtaaggattgaaggagccccaacgacgaactgtggcagcacaccatttggtgacgggaagctg

SEQ ID NO: 215833 - DNA, 75 bp, Artificial Sequence
  Synthetic
gtttcagacaacgtgagtggcgctttgtttgtatttccctggtgggaaagttttgaagcgttaacgtgttgagga

SEQ ID NO: 215834 - DNA, 75 bp, Artificial Sequence
  Synthetic
tgtttgtatttccctggtgggaaagttttgaagcgttaacgtgttgaggaaaagacagcttaggagaacaagagc

SEQ ID NO: 215835 - DNA, 75 bp, Artificial Sequence
  Synthetic
ttggtgtgatgattcaatcatgtacgagtgcgtcactattgactcggaagaagaaccagttgatgtggactgttt

SEQ ID NO: 215836 - DNA, 75 bp, Artificial Sequence
  Synthetic
cgactagagtctcattggtgttggaattgggtggctgtgtcactctcacggctgaaggcaaaccatccgttgatg

SEQ ID NO: 215837 - DNA, 75 bp, Artificial Sequence
  Synthetic
cgaaaaacggcatcttttacaacgcagtctgagaagaccatcttgacactgggagattatggagatatctctctc

SEQ ID NO: 215838 - DNA, 75 bp, Artificial Sequence
  Synthetic
ccaaatccatccatggagacaactggaggagggtttgttgaactgcaactgccaccaggagacaacatcatctat

SEQ ID NO: 215839 - DNA, 75 bp, Artificial Sequence
  Synthetic
gagatggccatgtggagacgtgtggaggctgtactcaacttggccctcgcagagaatgatgccaacctcacggtg

SEQ ID NO: 215840 - DNA, 75 bp, Artificial Sequence
  Synthetic
gacatgaggaccggtctccttgtggctttcgcagttaaaagggcctacacaactagagaagctgtgatgacctat

SEQ ID NO: 215841 - DNA, 75 bp, Artificial Sequence
  Synthetic
tgcaggggacaggctggatgtcaaagggtcagatcacggtgctggatatgcacccggggtcagggaagacacatc

SEQ ID NO: 215842 - DNA, 75 bp, Artificial Sequence
  Synthetic
ctctgagatgggtgccaacctggatgtcagccgagttattgatggcagaacaaacataaagccagaggaggtgga

SEQ ID NO: 215843 - DNA, 75 bp, Artificial Sequence
  Synthetic
gattgtctctctgttcaccccctacatgttgcaccagcttcagacaaaaatacaacaactggtgaatagttcggt

SEQ ID NO: 215844 - DNA, 75 bp, Artificial Sequence
  Synthetic
gagcttggtcagatgaacaaaatcgctggtcaaatgctcgggaagcagtggaggaccctgagttttggaggcttg

SEQ ID NO: 215845 - DNA, 75 bp, Artificial Sequence
  Synthetic
gagggcgtgatcgggccatcagactcacaggatcctcgacttttacgtgtggaagcctggctgaaagagtacgga

SEQ ID NO: 215846 - DNA, 75 bp, Artificial Sequence
  Synthetic
gcctcccagagagggccgaactgggaggttatgaaggcccctggctttggccaggaggggggagagggaaaattg

SEQ ID NO: 215847 - DNA, 75 bp, Artificial Sequence
  Synthetic
ctagacaagacaaacaccctcaccgtgtgataggggcaacacggtaaggattgaaggagccccaacgacgaactg

SEQ ID NO: 215848 - DNA, 75 bp, Artificial Sequence
  Synthetic
agagaggcaaaagtgtgatctgtctcaatagcaaaacctttgagaaggactacctgcgggtcagagaagagaagc

SEQ ID NO: 215849 - DNA, 75 bp, Artificial Sequence
  Synthetic
agtgctctcgtttcagacaacgtgagtggcgctttgtttgtacttccttggtgggaaagttttgaagcgttaacg

SEQ ID NO: 215850 - DNA, 75 bp, Artificial Sequence
  Synthetic
caggagtccgattctcaagcgattctgggcgacagttccggtgcggcaggccatcgcagcgctccgcaaaattag

SEQ ID NO: 215851 - DNA, 75 bp, Artificial Sequence
  Synthetic
ttaccgacaaggttcattgtcataacagtggccctttgtctggctcccacatatgccactcggtgcacacacctg

SEQ ID NO: 215852 - DNA, 75 bp, Artificial Sequence
  Synthetic
cgagagtattgtctccatgccaagctggcaagctcaaaggtggtcgcacgctgcccggccatgggtccggcgaca

SEQ ID NO: 215853 - DNA, 75 bp, Artificial Sequence
  Synthetic
ctgcccggccatgggtccggcgacattgccagaggagcatcaggcgagcacagtctgcagacgagaccagagtga

SEQ ID NO: 215854 - DNA, 75 bp, Artificial Sequence
  Synthetic
tcttaactacctgggatggcatttgaagaagctgtccgaactcgaaggagggcttttctatgccgacgacacagc

SEQ ID NO: 215855 - DNA, 75 bp, Artificial Sequence
  Synthetic
gggctgggacacaagaatcaccaatgcagaccttgaggatgaggagcaaattctgcgttatctggaaggcgaaca

SEQ ID NO: 215856 - DNA, 75 bp, Artificial Sequence
  Synthetic
agatttttttgcacgtgagtgctctcgtttcaggcaacgtgagtggcgctttgttggtatttccttggtgggaaa

SEQ ID NO: 215857 - DNA, 75 bp, Artificial Sequence
  Synthetic
gcggtgtttgacatgaggaccggcctccttgtggctttcgcagttaaaagggcctacacaactagagaggctgtg

SEQ ID NO: 215858 - DNA, 75 bp, Artificial Sequence
  Synthetic
gtgacctatttcttgctcctcgtgctggagcttgggtttccagaggcctcactgagcaacatttggaagtgggct

SEQ ID NO: 215859 - DNA, 75 bp, Artificial Sequence
  Synthetic
actgagcaacatttggaagtgggctgactccttggcaatgggaacattgattctacaggcgtgcagtcaagaggg

SEQ ID NO: 215860 - DNA, 75 bp, Artificial Sequence
  Synthetic
agagcgaaggaacagacggtctttcagtgaaccactaacagtggtgggcgtcatgctcactgtggcaagtgggat

SEQ ID NO: 215861 - DNA, 75 bp, Artificial Sequence
  Synthetic
cggctcagaacgtgtcttgcagccggtgtggaaggactgcagaatgttccgtgagggacgggacgttaaagactt

SEQ ID NO: 215862 - DNA, 75 bp, Artificial Sequence
  Synthetic
actgtggtgctttgtggcaagaacttcggttagccgaatgtttttgggcacggttgtgctctttgctgccctctt

SEQ ID NO: 215863 - DNA, 75 bp, Artificial Sequence
  Synthetic
acgcttaacgacaaaaccagaaaaggaatagacatcatcgcctgtagaataggaatgtaacacccctacaatgga

SEQ ID NO: 215864 - DNA, 75 bp, Artificial Sequence
  Synthetic
tgccgacagaattgtctttaaagttaagaatcagttggtgtctgttaagccggaggtgattgttgatcagtacga

SEQ ID NO: 215865 - DNA, 75 bp, Artificial Sequence
  Synthetic
gtacaaatacccggctattgtggataggcagaagcccagcatcactctggggaaagctccagacctgaacaaggc

SEQ ID NO: 215866 - DNA, 75 bp, Artificial Sequence
  Synthetic
ttacaagtccattctttccggattgactgctgccaaactcgatccggatgatgtctgttcttatttggccgcagc

SEQ ID NO: 215867 - DNA, 75 bp, Artificial Sequence
  Synthetic
aatggagctgtttgatggaacttgccccgatgattggacgagttatgggatccttattgccaagaaaggagataa

SEQ ID NO: 215868 - DNA, 75 bp, Artificial Sequence
  Synthetic
aatcactccagccactttagttaacattcaaagaacagatgtcgagggcaactgggcattgaccggaggtctaga

SEQ ID NO: 215869 - DNA, 75 bp, Artificial Sequence
  Synthetic
cctgacaagagatccgactgtagccgaacatgcatccttagtggggctccttctcagcctttatcgactgagtaa

SEQ ID NO: 215870 - DNA, 75 bp, Artificial Sequence
  Synthetic
agtctctgggcagaacacagggaattacaaaaccaatgttgctgaccgaatggagcaaatcttcgagacagctcc

SEQ ID NO: 215871 - DNA, 75 bp, Artificial Sequence
  Synthetic
atttgccaaaattgtggaacatcacaccttgatgaccactcacaaaatgtgtgctaactggagcacaattcccaa

SEQ ID NO: 215872 - DNA, 75 bp, Artificial Sequence
  Synthetic
ttttaggtttttagcagggacatatgacatgtttttctcgagaattgagcatttgtattcagccataagagtagg

SEQ ID NO: 215873 - DNA, 75 bp, Artificial Sequence
  Synthetic
aactgttgtgaccgcatatgaggattgttctgggttggtttcattcacagggttcatcaaacagataaatttgac

SEQ ID NO: 215874 - DNA, 75 bp, Artificial Sequence
  Synthetic
agcgaaggaagcgatattgtatttcttccacaaaaattttgaagaagagatcaagaggatgtttgagccaggtca

SEQ ID NO: 215875 - DNA, 75 bp, Artificial Sequence
  Synthetic
ggagacggctgtcccgcattcttatttcatccacttcaggtcattgggactaagtggaaaatctccatactcttc

SEQ ID NO: 215876 - DNA, 75 bp, Artificial Sequence
  Synthetic
gaatgcagttggtcatgtgtttaacctcatccactttgtcggctgttacatgggccagattagatctttaaacgc

SEQ ID NO: 215877 - DNA, 75 bp, Artificial Sequence
  Synthetic
aactgtcatctctagttgtgcacctcatgagatgtcggttcttggtggttacttaggggaggagtttttcggtaa

SEQ ID NO: 215878 - DNA, 75 bp, Artificial Sequence
  Synthetic
gggaacattcgaaaggagatttttcagggatgagaaagagctcaaggagtatgaggctgctgagtcagtaaagac

SEQ ID NO: 215879 - DNA, 75 bp, Artificial Sequence
  Synthetic
ggacacagccttggcagatgatggaactgtcaattccgatgacgaagactttttctctggagagacaagaagtcc

SEQ ID NO: 215880 - DNA, 75 bp, Artificial Sequence
  Synthetic
ggaagcagtgtacaccaggattatgatgaacggaggacgattgaaaaagtcccacatcaggagatatgtttccgt

SEQ ID NO: 215881 - DNA, 75 bp, Artificial Sequence
  Synthetic
cagctcaaaccatcaagcaagaccaaactcatttgctgagtttttgaataaaacctactcaagtgatccaagata

SEQ ID NO: 215882 - DNA, 75 bp, Artificial Sequence
  Synthetic
aagagctgggctcccattctgtgatttgcctcattgactatctctaaaattaacagagaaaaaaactaacacccc

SEQ ID NO: 215883 - DNA, 75 bp, Artificial Sequence
  Synthetic
tccctctattccatcccagccatgagcaagatttttgtcaatccgagcgctattcgagcagggctggccgacttg

SEQ ID NO: 215884 - DNA, 75 bp, Artificial Sequence
  Synthetic
gagatggcggaggagacagttgacctgatcaacaggaatgttgaggacaatcaggcgcatcttcaaggagaaccc

SEQ ID NO: 215885 - DNA, 75 bp, Artificial Sequence
  Synthetic
atagaggtggaagccctccctgaggacatgagaagacttcacataagtgagcaaaaacatagccagctgtctgac

SEQ ID NO: 215886 - DNA, 75 bp, Artificial Sequence
  Synthetic
agcgcttgtggaaaagaggagggaagcgatgatgatttttacatggctgacagcgaggacccttatgtcccaatg

SEQ ID NO: 215887 - DNA, 75 bp, Artificial Sequence
  Synthetic
cagtcttacctggataacgtcgggattcaaatcgtcaagaaaatgaagacaggggaaaggttcttcaagatctgg

SEQ ID NO: 215888 - DNA, 75 bp, Artificial Sequence
  Synthetic
tctcaggcggtagaagagatcatctcatatgtgactgtcaacttccctctgccttctgggaagtcaactgatgac

SEQ ID NO: 215889 - DNA, 75 bp, Artificial Sequence
  Synthetic
aagtctactcagactgtgtcagagagatctaggcagaacccacaaccttcctcagtcaaaaaggaggaccaactg

SEQ ID NO: 215890 - DNA, 75 bp, Artificial Sequence
  Synthetic
tcaaagactaaggtcgtctcccaagaagcttccgggcctcctgcgttggaatggtcagccacaaacgatgaagat

SEQ ID NO: 215891 - DNA, 75 bp, Artificial Sequence
  Synthetic
gatgcatccgtggaggcagagatagcacaccagattgctgagagcttctccaaaaaatacaagttcccatctaga

SEQ ID NO: 215892 - DNA, 75 bp, Artificial Sequence
  Synthetic
tcctctggaatattcttgtacaatttcgagcagttgaaaacaaatctcgatgacatcgtgagagaggccaaaagg

SEQ ID NO: 215893 - DNA, 75 bp, Artificial Sequence
  Synthetic
atcccgggcgtgatgcgacttgctcaggatggtctgaggctccccctcaggtgtattttagggtgggttgcttca

SEQ ID NO: 215894 - DNA, 75 bp, Artificial Sequence
  Synthetic
acccactcgaagagattccaaattttggtggactcagacaagttgagtaagattatgcaggatgacatcaatcga

SEQ ID NO: 215895 - DNA, 75 bp, Artificial Sequence
  Synthetic
tatttggcctactgagtgcccctccctctcagggccccaaactgcccagcatgactaatgaaaaaaacatgtaac

SEQ ID NO: 215896 - DNA, 75 bp, Artificial Sequence
  Synthetic
accactgacgagatgaacttcctccgcaagattgtaaagagctgtaaggacgaggaagatcagaagccagctctg

SEQ ID NO: 215897 - DNA, 75 bp, Artificial Sequence
  Synthetic
gtctctgccccaccggatgacgacgatttatggcttcccccacccgagtctgttcctctgacagagatttcaggg

SEQ ID NO: 215898 - DNA, 75 bp, Artificial Sequence
  Synthetic
aagaagaacatgagaaacttctgtattaatggtgaagtcaagatatgcagccctaacggctactcctttaagatc

SEQ ID NO: 215899 - DNA, 75 bp, Artificial Sequence
  Synthetic
ctaagacacatcctaaaatcctttgatggaatctattctggaaaccggagaatgatagggcttgtcaaggtggtt

SEQ ID NO: 215900 - DNA, 75 bp, Artificial Sequence
  Synthetic
attggtcttgctctctcaggggcccctgtcccagaggggatgaattgggtctacaaaatcaggcgcaccttggtg

SEQ ID NO: 215901 - DNA, 75 bp, Artificial Sequence
  Synthetic
tttcagtgggccgaatcccgtggtccgctagacggagaagagttagaatactctcaagagataacatgggatgac

SEQ ID NO: 215902 - DNA, 75 bp, Artificial Sequence
  Synthetic
gactctgagtttattggcttgcagatcagagttagcgcaaggcagtgccacatccaaggaagagtctggtgtatc

SEQ ID NO: 215903 - DNA, 75 bp, Artificial Sequence
  Synthetic
aacatgaactccagagcatgtcaactgtggtctgatatgtctctcaagacccagcagtcggatgaggacaaaaac

SEQ ID NO: 215904 - DNA, 75 bp, Artificial Sequence
  Synthetic
acctccttgctgctggaatgagccgctccctacacaaccaatcactcggttacctctgcacaaaaatatatacaa

SEQ ID NO: 215905 - DNA, 75 bp, Artificial Sequence
  Synthetic
ttttaccttctaccttttgcgagcaatagaacaaatatgttatggtgccacacaaccgctgcattttattgaaac

SEQ ID NO: 215906 - DNA, 75 bp, Artificial Sequence
  Synthetic
atctgattgaacaccttcacatgtgaagcctctgcaatgtgaaaaaaacatttaacatccctcaaggatcttaga

SEQ ID NO: 215907 - DNA, 75 bp, Artificial Sequence
  Synthetic
agccatgccctctcaagcagtctttcttgttcttaccacggttttctctcagtgtgttgggaaattccctattta

SEQ ID NO: 215908 - DNA, 75 bp, Artificial Sequence
  Synthetic
cactattcctgacaaattaggaccttggagccccatagacattcatcatcttagctgtccgaataatttagtggt

SEQ ID NO: 215909 - DNA, 75 bp, Artificial Sequence
  Synthetic
ggaagatgatgggtgcaccaccctatctgggttcacgtatatggagttgaaggtgggatatataacaacgataaa

SEQ ID NO: 215910 - DNA, 75 bp, Artificial Sequence
  Synthetic
agtagatggttttacatgtactggaatagtgacagaggcagaaacctacacaaattttgttggttacgttaccac

SEQ ID NO: 215911 - DNA, 75 bp, Artificial Sequence
  Synthetic
cactttcaaaaggaaacatttcaggccaggcccaagtgcatgcagggatgcatacaactggaaagccgcaggtga

SEQ ID NO: 215912 - DNA, 75 bp, Artificial Sequence
  Synthetic
ccctagatacgaagagtccttgcacaatccatatccagattctcactggttgagaaccgtcacaaccactaaaga

SEQ ID NO: 215913 - DNA, 75 bp, Artificial Sequence
  Synthetic
gtctcttttaatcatttcgcctagcgtggtggacatggatgcatacgacaaatctcttctctctaagatattccc

SEQ ID NO: 215914 - DNA, 75 bp, Artificial Sequence
  Synthetic
taacgggaagtgccccggggtatccattgcctctccattttgctccaccaatcatgattacacaatttggatgcc

SEQ ID NO: 215915 - DNA, 75 bp, Artificial Sequence
  Synthetic
tgaaaacacaaagaccggaatgtcgtgtgatatattcacgaccagtaaagggaagagagctactaaggatggtaa

SEQ ID NO: 215916 - DNA, 75 bp, Artificial Sequence
  Synthetic
gttgtgtgggtttgttgatgagagggggctctataaatcattgaagggatcatgcaaattgaaactgtgcggtgt

SEQ ID NO: 215917 - DNA, 75 bp, Artificial Sequence
  Synthetic
ctctggcttaaggctgatggacgggtcatgggtctccatccaaaatcacgaagaggccaagtggtgccctcccga

SEQ ID NO: 215918 - DNA, 75 bp, Artificial Sequence
  Synthetic
tcaactggtgaacgttcatgatttccactcagatgagatcgagcatctgattgtagaggagcttgttaagaagcg

SEQ ID NO: 215919 - DNA, 75 bp, Artificial Sequence
  Synthetic
ggaggagtgtttggacgccttagaatcgatcatgacaaccaaatcgatcagttttcgtcgcctcagccacctgag

SEQ ID NO: 215920 - DNA, 75 bp, Artificial Sequence
  Synthetic
aaaacttgttcctgggtttggcaaagcttacaccatcataaacaagacactcatggaagctgatgctcattacaa

SEQ ID NO: 215921 - DNA, 75 bp, Artificial Sequence
  Synthetic
gtcgataagggaatggtcagaaattatcccatccaagggatgtttggtagcgggaggcagatgttatcatcatca

SEQ ID NO: 215922 - DNA, 75 bp, Artificial Sequence
  Synthetic
caatggagtattcttcaacgggataatcttgagccctgatggacatgtattaatcccggagatgcagtctgcttt

SEQ ID NO: 215923 - DNA, 75 bp, Artificial Sequence
  Synthetic
gcttcaacaacatatcgagctattggagtcatctgtaataccactcatgcatccactggctgacccttccactgt

SEQ ID NO: 215924 - DNA, 75 bp, Artificial Sequence
  Synthetic
tttcaaaggggatgatggggcggaggattttgtagaggttcatcttccagatgttcaaaaacagatctctggaat

SEQ ID NO: 215925 - DNA, 75 bp, Artificial Sequence
  Synthetic
tgatttaggccttccggagtggaagagatacttcttaataggagtggctgcattgaccctatttgccttgacaat

SEQ ID NO: 215926 - DNA, 75 bp, Artificial Sequence
  Synthetic
atttgttgtggtgtgctgtcgaagagttaggaggagggagagggccaaacccaatccagtggaattgattcgaaa

SEQ ID NO: 215927 - DNA, 75 bp, Artificial Sequence
  Synthetic
ggtgtctgtgacttctcaaagcggcaaagtgatcccttcatgggaatcatacaaggtggaggcagagggtcaatc

SEQ ID NO: 215928 - DNA, 75 bp, Artificial Sequence
  Synthetic
ccaagcctaaattatctgcctgacagactgaatatctgataatccaccccttaaaacacatctgggactgtcaaa

SEQ ID NO: 215929 - DNA, 75 bp, Artificial Sequence
  Synthetic
atcatgagttccttatgggccagggataatttataagagagaggctgcctgatttctacacatgattctcaatca

SEQ ID NO: 215930 - DNA, 75 bp, Artificial Sequence
  Synthetic
atgaattaaactatttcagatctaccggtacacagggttttacaatagctacatcgattattggtgcttcagtca

SEQ ID NO: 215931 - DNA, 75 bp, Artificial Sequence
  Synthetic
atttgggatgcattccatgaatcatttatgttgaacaaaagttatacacttgccaactcatccatgtgacgcaaa

SEQ ID NO: 215932 - DNA, 75 bp, Artificial Sequence
  Synthetic
catatcagtatgtcttaatgtatgacctgtctcagtcaggatcagcatgaatttcccacaatctggaaagagatc

SEQ ID NO: 215933 - DNA, 75 bp, Artificial Sequence
  Synthetic
ctaggttgataatgctctgctatgttactaaccaaaggtatataatgacaatgagctcaatcatctttatcatat

SEQ ID NO: 215934 - DNA, 75 bp, Artificial Sequence
  Synthetic
aatcatgaaaaaaacatcttaccgggagagaaacaacacctctccgggaagagagctctccaaaatgattgattc

SEQ ID NO: 215935 - DNA, 75 bp, Artificial Sequence
  Synthetic
tcttgaggtgtatgatgatcctgtagatccaattgagccggaggtggacctcaaaaacaacgcagtggtgcctaa

SEQ ID NO: 215936 - DNA, 75 bp, Artificial Sequence
  Synthetic
cattctcaggaactcagattataatctcaattcccccctgatagaggatccgtctcagctcatgctggattggct

SEQ ID NO: 215937 - DNA, 75 bp, Artificial Sequence
  Synthetic
aatcacggggaataagcccaatcgactgtccccatctgataatttagtgaggtcatataaagtcctaaagagtta

SEQ ID NO: 215938 - DNA, 75 bp, Artificial Sequence
  Synthetic
ttttaagaaagtggatgtagggtctttacggatcggaggcctcggagcacaggctatgacatcactgtggctaca

SEQ ID NO: 215939 - DNA, 75 bp, Artificial Sequence
  Synthetic
tggggctcactcagagtctaccaggagtcgaaaatgcctctctgatctcgcccaattttaccaaaaatcatcacc

SEQ ID NO: 215940 - DNA, 75 bp, Artificial Sequence
  Synthetic
cattgagaagttgttgaactatacgttagaaaatagaggcctccaagtcccaccggagggggtcctctccagtct

SEQ ID NO: 215941 - DNA, 75 bp, Artificial Sequence
  Synthetic
gaagaaggtgagctatgatcgggcatttggacgataccttgccaacacttactcctcttacttgtttttccatgt

SEQ ID NO: 215942 - DNA, 75 bp, Artificial Sequence
  Synthetic
tataatcttgtatatgaatgcgttggattgggaagaggagaagacaatactggccctttggaaagatctgaactc

SEQ ID NO: 215943 - DNA, 75 bp, Artificial Sequence
  Synthetic
ggtggacataaagaaagaccaggtgaaattccgagatcagatctggggatcccttgtagtgaccaaagattttgt

SEQ ID NO: 215944 - DNA, 75 bp, Artificial Sequence
  Synthetic
ctattctcagagcgccaactgtcttttcgaccgaaattacactcttatgttgaaggacctatttctatcccggtt

SEQ ID NO: 215945 - DNA, 75 bp, Artificial Sequence
  Synthetic
caattctcttctaatcttgctgtcacctccagagccaagatactcagatgatttgatatctcagttgtgtcaact

SEQ ID NO: 215946 - DNA, 75 bp, Artificial Sequence
  Synthetic
atacattgcgggggacaatgtcttgtcaatgtgtggcaactcgggctatgatgtcatcaagatgttagaaccata

SEQ ID NO: 215947 - DNA, 75 bp, Artificial Sequence
  Synthetic
tgttgtgaacagcctggtacaaagagcagaagggtttcgacccttgatacactccttaggagactttcctctctt

SEQ ID NO: 215948 - DNA, 75 bp, Artificial Sequence
  Synthetic
tatcaaggacaaagtaacccaacttgaaggcactttcggacccagtgcaaggaacttcttccggattcttgatca

SEQ ID NO: 215949 - DNA, 75 bp, Artificial Sequence
  Synthetic
attggacaacatacacgacttagtatttgtatatggttgttataggcactgggggcatccttatatcgagtacag

SEQ ID NO: 215950 - DNA, 75 bp, Artificial Sequence
  Synthetic
gaaagggttgtccaagttgtatgatcaagttcatgtgaagaaggtcattgatggagactatcaggagtgtttggc

SEQ ID NO: 215951 - DNA, 75 bp, Artificial Sequence
  Synthetic
cagtgacttagctaagcgaattcttagatggggatttgacaaatattccaagtggtacctggactccaaattgtt

SEQ ID NO: 215952 - DNA, 75 bp, Artificial Sequence
  Synthetic
ggctcccaatcaccctttgaccccctatatcaaaactcaaacctggcctccaaaacatatagtagatatggtggg

SEQ ID NO: 215953 - DNA, 75 bp, Artificial Sequence
  Synthetic
aaatacctggcacaagcttcctatcactcagatattcgagataccagagtctatggatccgtcagagattttgga

SEQ ID NO: 215954 - DNA, 75 bp, Artificial Sequence
  Synthetic
cgataagtcacattccttcaccagaactaaactagcctcttggctttccgacaaccgaggagggcctgttcccag

SEQ ID NO: 215955 - DNA, 75 bp, Artificial Sequence
  Synthetic
tgaaaaggtaataataacagcactgtcaagacctcctgtcaaccctagagagttcctgaaatctatagacattgg

SEQ ID NO: 215956 - DNA, 75 bp, Artificial Sequence
  Synthetic
ggggctgccagatgacgaccttataatcggactgaaacccaaggagagagagctgaagatcgaaggtagattctt

SEQ ID NO: 215957 - DNA, 75 bp, Artificial Sequence
  Synthetic
tgccttgatgtcatggaacctaaggctttactttgtaattacagagaagctcttggctaactacatcttacctct

SEQ ID NO: 215958 - DNA, 75 bp, Artificial Sequence
  Synthetic
ctttgatgccttaaccatgactgataacctgaataaggtgttcaagaaattgatcgatagggtcacagggcaggg

SEQ ID NO: 215959 - DNA, 75 bp, Artificial Sequence
  Synthetic
tctgcaggattactctagggtaacatatgcattccatctagactatgaaaaatggaacaatcaccagagattgga

SEQ ID NO: 215960 - DNA, 75 bp, Artificial Sequence
  Synthetic
atccaccaaggatgtattttctgtactggattatgtatttgggcttaaaaaggtcttttccaggacccatgagtt

SEQ ID NO: 215961 - DNA, 75 bp, Artificial Sequence
  Synthetic
tttccaaaagtcttgggtatattattctgacagatcggacttgatagggttatgggaggaccagatatattgcct

SEQ ID NO: 215962 - DNA, 75 bp, Artificial Sequence
  Synthetic
ggacatgtccaatggaccaacttgctggaatggccaggatgggggtctagagggtttaagacagaaaggttggag

SEQ ID NO: 215963 - DNA, 75 bp, Artificial Sequence
  Synthetic
tctagtgagtttactgatgattgatagagagtcccaaactaggaatacaagaactaagattttagctcagggaga

SEQ ID NO: 215964 - DNA, 75 bp, Artificial Sequence
  Synthetic
caatcaggtcttatgtccgacatatatgctgtcctctgggctgacccaagagggacttctctatgagttagacag

SEQ ID NO: 215965 - DNA, 75 bp, Artificial Sequence
  Synthetic
tatttcacggaatgctctatctatatatcgagcaattgaagacggggcatccaaattaggactcatcattaagaa

SEQ ID NO: 215966 - DNA, 75 bp, Artificial Sequence
  Synthetic
ggaggagacgatgtgtagttacgactttttaatatatgggaagacacctctatttagaggcaacatactagtccc

SEQ ID NO: 215967 - DNA, 75 bp, Artificial Sequence
  Synthetic
tgagtctaaaaggtgggccagagtctcatgcatttccaacgatcaaattgttaatcttgcaaacatcatgtctac

SEQ ID NO: 215968 - DNA, 75 bp, Artificial Sequence
  Synthetic
tgtgtctaccaatgcattgacagttgcacagcactctcaatccttgattaagcctatgagggacttcttactcat

SEQ ID NO: 215969 - DNA, 75 bp, Artificial Sequence
  Synthetic
gtcggtccaagctgtgttccactacttgctgttcagtcctattctgaaagatagagtttacaagattctgagtgc

SEQ ID NO: 215970 - DNA, 75 bp, Artificial Sequence
  Synthetic
tgacggagatgattttctattggcgatgtctaggattgtcttcctggatccatcacttggaggagtgtcagggat

SEQ ID NO: 215971 - DNA, 75 bp, Artificial Sequence
  Synthetic
gtctttaggtcgttttcacatccgccagttttcggatcctgtgtcggaaggattgtcattctggaaagagatctg

SEQ ID NO: 215972 - DNA, 75 bp, Artificial Sequence
  Synthetic
gtcaagctcctcagagtcatggattcactctctgtgtcaggaagcaggtaaccctgacttgggtgacaggagttt

SEQ ID NO: 215973 - DNA, 75 bp, Artificial Sequence
  Synthetic
ggaaagtttcactcgtctcctcgaggatcccaccactctcaacataagaggtggagcgagccctaccattctgtt

SEQ ID NO: 215974 - DNA, 75 bp, Artificial Sequence
  Synthetic
gaaagaagccataaggaaggctctgtatgatgaagtggacaaagttgagaactctgaatttagagaagcaatatt

SEQ ID NO: 215975 - DNA, 75 bp, Artificial Sequence
  Synthetic
gttgtccaagactcacagagataacttcatactgtttttgagatccatcgagcccctatttccaagattcctcag

SEQ ID NO: 215976 - DNA, 75 bp, Artificial Sequence
  Synthetic
cgagttattcagctcatcatttctggggatacctgagtcaattatcgggctaattcaaaactctagaacaatcag

SEQ ID NO: 215977 - DNA, 75 bp, Artificial Sequence
  Synthetic
acggcagtttaggaaaagtctctcaaggaccctagaggagtccttcttcaattcagaagttcatggaatcaaccg

SEQ ID NO: 215978 - DNA, 75 bp, Artificial Sequence
  Synthetic
gatgacccaagtaccccaaagaattggaagagtttggccctgctcagctgagagagctgacctattaagagagat

SEQ ID NO: 215979 - DNA, 75 bp, Artificial Sequence
  Synthetic
ctcttgggggagaaaagtggttggcaccactgttccccacccctctgaaatgttagccttgttgccaaagtcctc

SEQ ID NO: 215980 - DNA, 75 bp, Artificial Sequence
  Synthetic
catctcatgtgtttgcgggcagactggagaagacagtcctagaatttctgtatctgttttaccatcttttgatca

SEQ ID NO: 215981 - DNA, 75 bp, Artificial Sequence
  Synthetic
atccttcttctcaaggggtcctcttaaaggatatttgggctcttcgacatctatgtccacccaactgtttcacgc

SEQ ID NO: 215982 - DNA, 75 bp, Artificial Sequence
  Synthetic
atgggagaaggttaccaatgtccacgttgttaagagggctttgtctcttaaagagtctatcaattggttcatagt

SEQ ID NO: 215983 - DNA, 75 bp, Artificial Sequence
  Synthetic
tagagactctaatctggcacaagtgctgatcaagaatataatttctttgacaggccccctatttcctctcgagga

SEQ ID NO: 215984 - DNA, 75 bp, Artificial Sequence
  Synthetic
gactcccgtgtttaagcggactggatcagcactccatcggttcaaatcagccagatacagtgaaggtggttattc

SEQ ID NO: 215985 - DNA, 75 bp, Artificial Sequence
  Synthetic
ctctatttgtccaaatttactctctcacatttcggtcagcacagacaccatgtcagaattgacacaagatgggaa

SEQ ID NO: 215986 - DNA, 75 bp, Artificial Sequence
  Synthetic
aaactttgattttatgttccaaccccttatgctttatgcacaaacctggacttctgagctggtgcaaaaggatct

SEQ ID NO: 215987 - DNA, 75 bp, Artificial Sequence
  Synthetic
gcgattaaaagattctacattccattggcacctccgatgcccaaaatgtatcagaccaatagatgatataacctt

SEQ ID NO: 215988 - DNA, 75 bp, Artificial Sequence
  Synthetic
agaggccccccaagtattcatgtttccagatgtttctaagagaatatctaggatggtgtcaggtgctgttcccca

SEQ ID NO: 215989 - DNA, 75 bp, Artificial Sequence
  Synthetic
gtttcagaggcttcctgaaatcagcctaaaacctggaaagtttgagtctctgaatggcaaggataagtccaggca

SEQ ID NO: 215990 - DNA, 75 bp, Artificial Sequence
  Synthetic
tatagggactgcccagggactgctgtactctatattggtcgccacccatgattctggatataatgatggcaccat

SEQ ID NO: 215991 - DNA, 75 bp, Artificial Sequence
  Synthetic
attcccggtgaacatatacggcaaagtatctcctaaggattatttgagaggactggcccggggtgtcctgatcgg

SEQ ID NO: 215992 - DNA, 75 bp, Artificial Sequence
  Synthetic
gtcatcgatctgctttttgaccaggatgaccaatatcaatataaacagacccttagagctgatctctggtgttat

SEQ ID NO: 215993 - DNA, 75 bp, Artificial Sequence
  Synthetic
ttcttacatattattgaggcttgataaccacccctcactatatgtcatgcttaaggagccctccctcaggtctga

SEQ ID NO: 215994 - DNA, 75 bp, Artificial Sequence
  Synthetic
aatattttcaatcccccaaaagatccctgcagcttatccaaccaccatgaaagagggcaatagatcagtattgtg

SEQ ID NO: 215995 - DNA, 75 bp, Artificial Sequence
  Synthetic
ctatctgcaacatgtactccgctacgagagggatgtgattactgcctcccctgagaatgattggctctggatctt

SEQ ID NO: 215996 - DNA, 75 bp, Artificial Sequence
  Synthetic
ttccgactttagaagcacaaagatgacttatttgactttggtgacttatcagtcacacatcctgctccaaaaaat

SEQ ID NO: 215997 - DNA, 75 bp, Artificial Sequence
  Synthetic
tgagaagagtttgtcaaaacaaatgagaataagactgagacagttaagctctctaatgagacaagtcctgggggg

SEQ ID NO: 215998 - DNA, 75 bp, Artificial Sequence
  Synthetic
ccatggggaggattctctagactctgatgaagactttcagggactattaagagatgcattacagagaaccaggtg

SEQ ID NO: 215999 - DNA, 75 bp, Artificial Sequence
  Synthetic
ggtggaccaggaggttcgtcacgccgccaaaaccatgactggggatcacagccctaccaagaaggtgtctcgaaa

SEQ ID NO: 216000 - DNA, 75 bp, Artificial Sequence
  Synthetic
agccggaggctcagaatggatatgttctgctcagcaggtagcaatatcaacctcgtcaaacccggccccaacctc

SEQ ID NO: 216001 - DNA, 75 bp, Artificial Sequence
  Synthetic
ggagctcgacgtgagggcgttatcaaggaagtttcagaatcctctgatatctggtctgagggtggttcaatgggc

SEQ ID NO: 216002 - DNA, 75 bp, Artificial Sequence
  Synthetic
cacgggtgcacattacaagctaaagccaatacttgatgatcttgaatcttgtccatccctttgcctggttgtggg

SEQ ID NO: 216003 - DNA, 75 bp, Artificial Sequence
  Synthetic
tgatggctctggaggaatctcacggactgtacttagtatgttccctgatgccaggttggttttcaatagtttatt

SEQ ID NO: 216004 - DNA, 75 bp, Artificial Sequence
  Synthetic
agaggtgagtgatcttatggcctcaggaacacatccattgcctccatcagccatcatgagtgggggagacgacat

SEQ ID NO: 216005 - DNA, 75 bp, Artificial Sequence
  Synthetic
agtatcaagagttatagactttgagtcaatttgggagaagccttcagacttaagaaacctttctacctggaggta

SEQ ID NO: 216006 - DNA, 75 bp, Artificial Sequence
  Synthetic
tttccaatctgttcagaacagcagcaaaatgtcgtatgatctgatcatctgtgatgccgaggtgactgacatatc

SEQ ID NO: 216007 - DNA, 75 bp, Artificial Sequence
  Synthetic
ctctgttaacaaaataactttattaatgtcagacttctccctctcaatcaatggtcccttaaccttgatattcaa

SEQ ID NO: 216008 - DNA, 75 bp, Artificial Sequence
  Synthetic
aacttacgggactatgctggtaaactcggattataaggcaattcagcatctctcaagggcattcccctctgtaac

SEQ ID NO: 216009 - DNA, 75 bp, Artificial Sequence
  Synthetic
tgggtatattacccaaatgacctcttcattctcctctgagttgtatctgaagttctccaaaaggggcaaattctt

SEQ ID NO: 216010 - DNA, 75 bp, Artificial Sequence
  Synthetic
cagagatgccgaatatctgacatcatcgacattgcgagaaatgagccttgtattgtttaactgcagcagtcccaa

SEQ ID NO: 216011 - DNA, 75 bp, Artificial Sequence
  Synthetic
gagtgagatgcaaagagcccgctcgttgaattatcaagaccttgtgcgaggattcccagaggagatcatatcaaa

SEQ ID NO: 216012 - DNA, 75 bp, Artificial Sequence
  Synthetic
tccgtacaatgagatgatcataactctgatagacagtgaggtcgagtcgttcttggttcacaagatggtggatga

SEQ ID NO: 216013 - DNA, 75 bp, Artificial Sequence
  Synthetic
tttagaacttcaaaaaggagccttatccaaaatgtcaatcattattgcgattgtgatggtgttctctaacagagt

SEQ ID NO: 216014 - DNA, 75 bp, Artificial Sequence
  Synthetic
ttttaacgtatccaagcccttaagtgacccgatgttttatccgccttctgaccctaaaattctcagacacttcaa

SEQ ID NO: 216015 - DNA, 75 bp, Artificial Sequence
  Synthetic
tatttgctgcagcaccctaatgtacttgtcaactgctttaggtgacgtcctcaactttgctagactccatgagct

SEQ ID NO: 216016 - DNA, 75 bp, Artificial Sequence
  Synthetic
atataataaccctgtaacgtactacttcaagaagcaggttatcagaggaagcatatatttgtcttggagttggtc

SEQ ID NO: 216017 - DNA, 75 bp, Artificial Sequence
  Synthetic
agacagtacatccgtcttcaagagggttgcctgtaactccaacctgagcttgtcatctcactggattcgcctgat

SEQ ID NO: 216018 - DNA, 75 bp, Artificial Sequence
  Synthetic
ttacaagatagttcgaactacccgatttgtggggagcagcagtgatttatcggaagaagttgagaagcatttgag

SEQ ID NO: 216019 - DNA, 75 bp, Artificial Sequence
  Synthetic
aggatacaatagatggattaaatttcatgatataagatctagatcgtccctgttggattacagctgcttgtgaat

SEQ ID NO: 216020 - DNA, 75 bp, Artificial Sequence
  Synthetic
cctgcagcggaacattcttgacccttcagcattctttagataatagagcttgaaaaaaacatatctcgaagtcag

SEQ ID NO: 216021 - DNA, 75 bp, Artificial Sequence
  Synthetic
aaaaaacatatctcgaagtcagaatatgtccctattcgaggaacttttctctttattgttttttttgttaagcgt

SEQ ID NO: 216022 - DNA, 75 bp, Artificial Sequence
  Synthetic
cctctggcctcctgtaatatagaaaaaaagggcacagtgattgacagttgtgtatacaagcatgtgtggtatgtt

SEQ ID NO: 216023 - DNA, 75 bp, Artificial Sequence
  Synthetic
tggttttgccactgttaattgggcctttgaaaagccaatatctgtgttttggcttgttgtctacaattagcttta

SEQ ID NO: 216024 - DNA, 75 bp, Artificial Sequence
  Synthetic
tgtatacaagcatgtgtggtatgtttagtgtgtaagccaataaagttaaaggtcactactgtgggtggtgacacc

SEQ ID NO: 216025 - DNA, 75 bp, Artificial Sequence
  Synthetic
tgataccggcggaactagttgctacgtgccacacaatagctttcactcttggcgtgaagccaacttcctgggccg

SEQ ID NO: 216026 - DNA, 75 bp, Artificial Sequence
  Synthetic
aaaatctaacaactaattcatctatttttttatttagtccagtataccaggctattgaagccatataaagcagta

SEQ ID NO: 216027 - DNA, 75 bp, Artificial Sequence
  Synthetic
tgagccagcttcctgcggccttgtgttttttaccaacacacctggtgaacttctactgtccttgacacaggtaag

SEQ ID NO: 216028 - DNA, 75 bp, Artificial Sequence
  Synthetic
tttttctttctccaacaacaattttatccatttcattaaaaagctttttaaaccttttagttagtagctttttcc

SEQ ID NO: 216029 - DNA, 75 bp, Artificial Sequence
  Synthetic
actggggaccctttgtaggccaaaggagagtgaagggtaactgaaatgctaagactgtaagttctaatcctagta

SEQ ID NO: 216030 - DNA, 75 bp, Artificial Sequence
  Synthetic
tagttaaggttaaacagttatatcttctttctgctataactctatcaatggcttgtgtgcaagcatttttttggc

SEQ ID NO: 216031 - DNA, 75 bp, Artificial Sequence
  Synthetic
tttcagttcggggatgttggcgccatcgtctcgaacctggcctgcatacctttggatatagagggtcaccaattt

SEQ ID NO: 216032 - DNA, 75 bp, Artificial Sequence
  Synthetic
ttttactttcttgcaaaagcacagcattttcatgattttgcacatgtacccttttatgggtagcatcatcatttt

SEQ ID NO: 216033 - DNA, 75 bp, Artificial Sequence
  Synthetic
ttattttgtttttagatgggaatatttcttgctgtacctgaaattatagcagcatctatagctggaggagcagag

SEQ ID NO: 216034 - DNA, 75 bp, Artificial Sequence
  Synthetic
tactgcatttttcacactcttcaggcttagtagcaaaccttatatatgaccccagtaagtaatacacatcatcta

SEQ ID NO: 216035 - DNA, 75 bp, Artificial Sequence
  Synthetic
gccttgtcaattgctggttctggagctgccatagctactggtgaaggcttagctgcccttggtggtataacagag

SEQ ID NO: 216036 - DNA, 75 bp, Artificial Sequence
  Synthetic
tgtcaaattccagagcaaagttagctatttgattccagcttaatgagggttccttaggttccccaaataaatctt

SEQ ID NO: 216037 - DNA, 75 bp, Artificial Sequence
  Synthetic
ggagctgcacttcttggggaaacaataccaatatctgaagcagctactactgtgttaactaaagttcctgaactt

SEQ ID NO: 216038 - DNA, 75 bp, Artificial Sequence
  Synthetic
ctggattaaattcattttcttttaaccctccaggaatattttcttcacacaaattaaatggttgtctacacatcc

SEQ ID NO: 216039 - DNA, 75 bp, Artificial Sequence
  Synthetic
gttcaagctacccaagctgtaacagcagctgtgcaaggaggtgcaggccttgtaggtggcatttatactgcctta

SEQ ID NO: 216040 - DNA, 75 bp, Artificial Sequence
  Synthetic
tactatacagaccataagggttattaactcctttacagaataaaaagctaacagtacaatgacctttgcagaagt

SEQ ID NO: 216041 - DNA, 75 bp, Artificial Sequence
  Synthetic
gcatcagaccaccctggggacctgcctccgaacaccccaacaggaagtgcaagtggactccatcccacctcagga

SEQ ID NO: 216042 - DNA, 75 bp, Artificial Sequence
  Synthetic
tattaatagcactaactctatgcttgtgaggagttaagaaaaatattaaaacagtattataaaatgcatgcttac

SEQ ID NO: 216043 - DNA, 75 bp, Artificial Sequence
  Synthetic
tacaatccccagggagcaggactcaatctccagtcagtgcacaaaccaattcacgccccctactcaggaatggca

SEQ ID NO: 216044 - DNA, 75 bp, Artificial Sequence
  Synthetic
ttataaagctacattgatacttttgaagtaactttttataaagtacttcccctttttctctagtagtatgtacta

SEQ ID NO: 216045 - DNA, 75 bp, Artificial Sequence
  Synthetic
ttggtacctatccctgaataccagttggaaactggaattccgggcatcccagactggctcttcaaccttgtcgcg

SEQ ID NO: 216046 - DNA, 75 bp, Artificial Sequence
  Synthetic
caaagcacgttatacacttattactaaatacagcatgtgaaacaaactctaacaactctttaggaaattctaaag

SEQ ID NO: 216047 - DNA, 75 bp, Artificial Sequence
  Synthetic
tcatacttgcccgagttgcctagtttgcaggacgtgttcaatagaattgcctttggaatctggtcatcatattac

SEQ ID NO: 216048 - DNA, 75 bp, Artificial Sequence
  Synthetic
aagcatcaaatgcatgttttttcttaggaggggttgcctgagaacagctaggctcctcttctggtgcacttcttt

SEQ ID NO: 216049 - DNA, 75 bp, Artificial Sequence
  Synthetic
aatgcggggtcaacagtagttaacagagttcttagtgatgaaattcaaagacttttaagagaccttgaatatgga

SEQ ID NO: 216050 - DNA, 75 bp, Artificial Sequence
  Synthetic
ttggagaagatggcatggattcattacatcttaactcttcttcccagtaggtgttgaactgtgaccaccactcat

SEQ ID NO: 216051 - DNA, 75 bp, Artificial Sequence
  Synthetic
tttagagcaactttagccagcataggagaatcagatcctgtaaatgctatagctactcaagttagaagcttagct

SEQ ID NO: 216052 - DNA, 75 bp, Artificial Sequence
  Synthetic
cccagtcaggtgtaccgtatgtaggtatctatacaacaaaaatatacatttaatattacacaaacaattatttaa

SEQ ID NO: 216053 - DNA, 75 bp, Artificial Sequence
  Synthetic
accacagcaagggaaagggagctgctacaaattactgcaggtcagccacttgacctttctaggcctaccagcgcc

SEQ ID NO: 216054 - DNA, 75 bp, Artificial Sequence
  Synthetic
aaacattattttatgcttaccgtaataatggttgaactgctcgtatttcagtattaaaaataatcactttccaaa

SEQ ID NO: 216055 - DNA, 75 bp, Artificial Sequence
  Synthetic
ttgtcagcagcagctggagcattaactgaagcagcttataattttatatatgatgcttcaagcctgcccaaagat

SEQ ID NO: 216056 - DNA, 75 bp, Artificial Sequence
  Synthetic
agaaaaatgtttgcattgaaattggaaaaaaaaaccactccctgtagcacttatagcagtagcactctatccaca

SEQ ID NO: 216057 - DNA, 75 bp, Artificial Sequence
  Synthetic
ggctttaatgctttaagtgagggtgtacacagactaggtcagtggatttccttttcagggcctacaggaggtacc

SEQ ID NO: 216058 - DNA, 75 bp, Artificial Sequence
  Synthetic
caggtggttttctataaattttgtacttttctttatgatatttgcttaaaatacagtgaatgcattggcattcgt

SEQ ID NO: 216059 - DNA, 75 bp, Artificial Sequence
  Synthetic
ccacattatgcaactcctgactggattttgtatgtgctagaacaactaaatgctgatacctataaaattcctaca

SEQ ID NO: 216060 - DNA, 75 bp, Artificial Sequence
  Synthetic
gattgtagccatgaatgcatacatcccactgcttcataatatatgcttcatagtaatcaccatatatagcaccaa

SEQ ID NO: 216061 - DNA, 75 bp, Artificial Sequence
  Synthetic
ggggacagccacttgatgtagttggtgtaacacccacagacaagtataggggcccaactacctatacaattaatc

SEQ ID NO: 216062 - DNA, 75 bp, Artificial Sequence
  Synthetic
caggcagtaaaaagaaaacaagatgagctgcaccccgtgtcgcccacaaaaaaggctaacaaggccaagaagtca

SEQ ID NO: 216063 - DNA, 75 bp, Artificial Sequence
  Synthetic
ctaatctaaacttattgcagcacaaatctttgcagtatacctgagaagattgccatatattatcttcttcttcat

SEQ ID NO: 216064 - DNA, 75 bp, Artificial Sequence
  Synthetic
agttccccgggtacaaactctggcaacagaagtaaaaaaaggaggggtagaagtactagccgcagtaccactgtc

SEQ ID NO: 216065 - DNA, 75 bp, Artificial Sequence
  Synthetic
ttaaatcatgtacactgctaactgagtcttgcagttttaaatataaagaattaagaagcttcatgctttcctcat

SEQ ID NO: 216066 - DNA, 75 bp, Artificial Sequence
  Synthetic
agaagaaacagaatttaaagtggaactatttgtaaagccagtaattggaaatacaacagctgctcaggatgggcg

SEQ ID NO: 216067 - DNA, 75 bp, Artificial Sequence
  Synthetic
ttcctcctttatctggatgatattctttgcactttactaagtattgtcttctcattaatggtaaattgccccagc

SEQ ID NO: 216068 - DNA, 75 bp, Artificial Sequence
  Synthetic
tgagcccacccctcattactggtcaattagctctgccattcatgacaaggaaagcggttcaagtatcaaagttga

SEQ ID NO: 216069 - DNA, 75 bp, Artificial Sequence
  Synthetic
aactcatgtccaaacataaaagttgcattagctgctttgcctcttctctagataaagttttatccattttgcctc

SEQ ID NO: 216070 - DNA, 75 bp, Artificial Sequence
  Synthetic
agaaactccagatgctgacacaactgtatgttacagcctggcagaaattgctccccctgatataccaaatcaagt

SEQ ID NO: 216071 - DNA, 75 bp, Artificial Sequence
  Synthetic
attttgcctctctaggcctctcaaatgcctctgcaggccctctccttcttctagaaaaagctggggcttttttgg

SEQ ID NO: 216072 - DNA, 75 bp, Artificial Sequence
  Synthetic
tagtgagtgtgacatgaaagtatgggagctgtacagaatggaaacagagttgcttgttgtacctctagttaatgc

SEQ ID NO: 216073 - DNA, 75 bp, Artificial Sequence
  Synthetic
tctaggaaacaccaatggtgttgtacatggtctggctggaacccagttgtatttttgggctgttgggggacagcc

SEQ ID NO: 216074 - DNA, 75 bp, Artificial Sequence
  Synthetic
atttttgggctgttgggggacagccacttgatgtagttggtgtaacacccacagacaaatataaaggcccaacta

SEQ ID NO: 216075 - DNA, 75 bp, Artificial Sequence
  Synthetic
cctatacaattaatccaccaggagaccctagaacactgcatgtgtacaatagtaatacacccaaagcaaaggtta

SEQ ID NO: 216076 - DNA, 75 bp, Artificial Sequence
  Synthetic
ccagtgagagatattctgttgaatcatgggccccagaccccagtagaaatgacaattgtagatattttggaagag

SEQ ID NO: 216077 - DNA, 75 bp, Artificial Sequence
  Synthetic
tggtaggtggtgctgcaacacctccagttgtatcatatggtaacaactctactattccactattggatgaaaatg

SEQ ID NO: 216078 - DNA, 75 bp, Artificial Sequence
  Synthetic
gcattggtatactttgcttgcagggaagattgtacattacttgtgcagatatgcttggaacagctaatagtagaa

SEQ ID NO: 216079 - DNA, 75 bp, Artificial Sequence
  Synthetic
tccatacccctatggctaggttttttaggctacattttagacaaagaagggttaagaatccttttacaatgaatg

SEQ ID NO: 216080 - DNA, 75 bp, Artificial Sequence
  Synthetic
tgctgtataaacaagtgtttaacagacccacagaaactgttgatgcacaggttggtgtaacagaggtgactatgg

SEQ ID NO: 216081 - DNA, 75 bp, Artificial Sequence
  Synthetic
aaaagggcacagtgattgacagttgtgtatacaagcatgtgtggtatgttcagtgtgtaagccaataaagttaaa

SEQ ID NO: 216082 - DNA, 75 bp, Artificial Sequence
  Synthetic
tagaagaaataggcccactgccccccagtatacaaactaccctccccaccagtgtaaatcttactcagcttccac

SEQ ID NO: 216083 - DNA, 75 bp, Artificial Sequence
  Synthetic
ggtcaccacggtgggtggtgacacctgataccggcggaactagttgctacgtgccacacaatagctttcactctt

SEQ ID NO: 216084 - DNA, 75 bp, Artificial Sequence
  Synthetic
gcactgtaacacttcagtcccaggctcctttgttaaatactcaacaaaattcaaagtgaatgtattataataaag

SEQ ID NO: 216085 - DNA, 75 bp, Artificial Sequence
  Synthetic
ctgtttattcaaaccacttttctagtatgttttttccattggttacattcatttgcatagtggcaaactcagtaa

SEQ ID NO: 216086 - DNA, 75 bp, Artificial Sequence
  Synthetic
cctctggcctcctgtaatatagaaaaaaagggcacagtgattgacagttgtgtatacaaaggcgctgcggcatgt

SEQ ID NO: 216087 - DNA, 75 bp, Artificial Sequence
  Synthetic
tgtatacaaaggcgctgcggcatgtgtggtatgtttagtgtgtaagccaataaagttaaaggtcaccacagtggg

SEQ ID NO: 216088 - DNA, 75 bp, Artificial Sequence
  Synthetic
ggcctatataattatcaagaacttctttccaatacacaacattactttgaatttcttcatcaaagtcacttacag

SEQ ID NO: 216089 - DNA, 75 bp, Artificial Sequence
  Synthetic
gtctataccatattagcaataacaacatagctattccactgtgtaatattctttgtgatagtaactgtggtgttt

SEQ ID NO: 216090 - DNA, 75 bp, Artificial Sequence
  Synthetic
tttctaggctttctcttaaatttcttttaatagtgaacataacagttttttcaaatctcacagcaactgtttctg

SEQ ID NO: 216091 - DNA, 75 bp, Artificial Sequence
  Synthetic
gaatacaatattcattcatggttacaatccctgggggaaatatttgtgacctcttattaacatgttttttttcta

SEQ ID NO: 216092 - DNA, 75 bp, Artificial Sequence
  Synthetic
agttaacctcaacacaaccatcaaggtagtctcttaagttatcaagattatttaccccattaccagaaggtagtt

SEQ ID NO: 216093 - DNA, 75 bp, Artificial Sequence
  Synthetic
gcttttcaatacctatttgacctttgacatcttcaaacacaaccatatattgatcaagagcaactccaagttcaa

SEQ ID NO: 216094 - DNA, 75 bp, Artificial Sequence
  Synthetic
atggtagtttttctgaaggtatgttaatgttcaaggctttgccaccacacaaatttaacaaagcagtggctaatg

SEQ ID NO: 216095 - DNA, 75 bp, Artificial Sequence
  Synthetic
atgcccaaaaaaccaggaaagcccgggaggactcgggctgtcaatatgctaaagcgcggtgcatcccgcgcgctc

SEQ ID NO: 216096 - DNA, 75 bp, Artificial Sequence
  Synthetic
gctgacgacacagctgggtgggacacccgaatcaccgagtgtgacttgaggaatgaagcgcacatcatggaatac

SEQ ID NO: 216097 - DNA, 75 bp, Artificial Sequence
  Synthetic
ggcccactggccaagctgaagaggatgcttgcagacctactggatggcaaggggccgttgagactggtattggct

SEQ ID NO: 216098 - DNA, 75 bp, Artificial Sequence
  Synthetic
atggaaaatgaacatcgaaagctagcgcgtgccatctttgaacttacctacaaacacaaagttgtgaaagtgatg

SEQ ID NO: 216099 - DNA, 75 bp, Artificial Sequence
  Synthetic
ctagtagctttttttagattcacggccttaagaccaacgacaggtttgctcaaaagatggggaatgatggacaag

SEQ ID NO: 216100 - DNA, 75 bp, Artificial Sequence
  Synthetic
agaccaggaaaaggagtaccccttatggacatcatttcacgagaagaccagagaggaagtggccaggttgtgacc

SEQ ID NO: 216101 - DNA, 75 bp, Artificial Sequence
  Synthetic
cttcatgccctatcgctgttgaaaggattcaagaaggatttagcctccatgattgacaccatcaacagaagaaag

SEQ ID NO: 216102 - DNA, 75 bp, Artificial Sequence
  Synthetic
tatgccctgaacactttcacaaacttggtggtgcagcttataagaatggcagaagcagagtgcgtcctcacgccc

SEQ ID NO: 216103 - DNA, 75 bp, Artificial Sequence
  Synthetic
aaaaaacgtggtgcctttaacggtttagttttccttactgtggtggggtgtgttttaggtgctcggataacccag

SEQ ID NO: 216104 - DNA, 75 bp, Artificial Sequence
  Synthetic
gaagacctacatgaaatgtcccaatcggccaagttgagactcttaaaatggctgaaagaagaaggatgggaacga

SEQ ID NO: 216105 - DNA, 75 bp, Artificial Sequence
  Synthetic
caaaatggaatgcctttgatgaaagtccagaaatcggatgtcgggaaagtcatcacaatgaggacagagcaaggg

SEQ ID NO: 216106 - DNA, 75 bp, Artificial Sequence
  Synthetic
ctcacgaggatggctgttagtggagatgactgcgtggtggctgctcctgatgcaaggttcggtgcggccttgacg

SEQ ID NO: 216107 - DNA, 75 bp, Artificial Sequence
  Synthetic
gaaaacagatgcataatccaagccatggatgtgggggaagattgtgaagacaccataacctatctgtgcccagcg

SEQ ID NO: 216108 - DNA, 75 bp, Artificial Sequence
  Synthetic
ttcctgaatgccatgtcaaaaattaggaaggacatcaaagaatggacgccctcgaaaggatggaagaattgggag

SEQ ID NO: 216109 - DNA, 75 bp, Artificial Sequence
  Synthetic
atcgaaaacccgtcagagcctgatgacattgactgctggtgtgatagagccgacacaatggtgagttatggaagg

SEQ ID NO: 216110 - DNA, 75 bp, Artificial Sequence
  Synthetic
gaagttccattctgctcccaccacttccacagacttcaaatgaaagatggtagagagctagtggtaccatgtcgt

SEQ ID NO: 216111 - DNA, 75 bp, Artificial Sequence
  Synthetic
tgctcaaagacaaggcactctagaagatcaagaagatcgactaacatagctggacatgctgattccacactggac

SEQ ID NO: 216112 - DNA, 75 bp, Artificial Sequence
  Synthetic
tctcaagatgagctaattggaagggccagggtgacgcagggtcctggagacctcatgagctcagcatgtctggcc

SEQ ID NO: 216113 - DNA, 75 bp, Artificial Sequence
  Synthetic
agcagaggtgcggtgtggatggacacaaaaaaggcggccagttacctgacgaaagctgaaagctgggctttgagg

SEQ ID NO: 216114 - DNA, 75 bp, Artificial Sequence
  Synthetic
aaggcctatgcccagatgtggcagctgctgtatttccacagaagagacttaaggttgatgggaaatgccatatgc

SEQ ID NO: 216115 - DNA, 75 bp, Artificial Sequence
  Synthetic
aatccgggatatgcgttggtggcagtgatcctagggtggaatttaggtacatcgaaggctcaaaagatcatcttc

SEQ ID NO: 216116 - DNA, 75 bp, Artificial Sequence
  Synthetic
tcggctgttccagttgattgggtcccgacggggcgcacaacgtggtccatccatggtaaaggagaatggatgact

SEQ ID NO: 216117 - DNA, 75 bp, Artificial Sequence
  Synthetic
acaatcatgatcctgctgatagcccccgcttacagcatgcgctgtgtgggggttgagaaccgggatttcattgag

SEQ ID NO: 216118 - DNA, 75 bp, Artificial Sequence
  Synthetic
tctgagaacatgctggaagtgtggaaccgggtgtggattgaggaaaatgagcacatggaagacaaaactccagta

SEQ ID NO: 216119 - DNA, 75 bp, Artificial Sequence
  Synthetic
ggtgtgtcaggagggacctgggttgatgtagtgttggaacatcggggatgtgtcactgtaatggctccggacaag

SEQ ID NO: 216120 - DNA, 75 bp, Artificial Sequence
  Synthetic
cgggagtggactgacattccgtacctagggaaaagagaagatccatggtgtggttcatacataggctaccggcct

SEQ ID NO: 216121 - DNA, 75 bp, Artificial Sequence
  Synthetic
ccaactatagatatagaactcacatccaccgtggctcgatcaatggctgtgactagaacctattgtgtagaggcg

SEQ ID NO: 216122 - DNA, 75 bp, Artificial Sequence
  Synthetic
cgttcaacttgggcagaaaacatcaaggtaccagtgaacgtgatccgggttaagattggagggaacaagtatcaa

SEQ ID NO: 216123 - DNA, 75 bp, Artificial Sequence
  Synthetic
caggtgacagaactctccgtggacgctaggtgtccaacgatgggggaggctcacaatccgaaatctgccgacatt

SEQ ID NO: 216124 - DNA, 75 bp, Artificial Sequence
  Synthetic
gactatctgggaacacagaagaggtatgagagtgagaagagagttgagttccgaggagttctgtagatgaagaga

SEQ ID NO: 216125 - DNA, 75 bp, Artificial Sequence
  Synthetic
acccacgtatgcaagaaaggattcagtgaccgaggctggggaaatggatgtggattgttcggaaaaggcagtata

SEQ ID NO: 216126 - DNA, 75 bp, Artificial Sequence
  Synthetic
atgaagtgagttattttgttgtgatagtcaggcctgaaaagccacctgatccggtgaaggtgctgcctgcatccg

SEQ ID NO: 216127 - DNA, 75 bp, Artificial Sequence
  Synthetic
gaaacgtgtgcaaaattcacgtgtcaatccaaggcagaaggccgcatcatccagaaggagaatttggagtacaca

SEQ ID NO: 216128 - DNA, 75 bp, Artificial Sequence
  Synthetic
gcctggagtgatgctccagtgtcgtggaacaacaaccgatggagccaagcccggaggggatccggcccccgactt

SEQ ID NO: 216129 - DNA, 75 bp, Artificial Sequence
  Synthetic
gtgcatttaaacgtgcacgcctccacagaaacggaccatttcatgaatgacacaattgcgacggaaaacaaacat

SEQ ID NO: 216130 - DNA, 75 bp, Artificial Sequence
  Synthetic
ccggaggttgccacaccttgtaaatatgtacatacagagtcagatccgaaaggccaccagtttggtgcagaactg

SEQ ID NO: 216131 - DNA, 75 bp, Artificial Sequence
  Synthetic
ggtacaaaaatctccataacagccgcggctccttctaggacggcagacttgggagactatggcacaataacgttg

SEQ ID NO: 216132 - DNA, 75 bp, Artificial Sequence
  Synthetic
gtgctatctgtgaacactcccaggaggactgggtaaacaaagccattagggaccatcacggcccgagggggagaa

SEQ ID NO: 216133 - DNA, 75 bp, Artificial Sequence
  Synthetic
gattgtgagcccagagcaggactagactttgaaaacctttatctgctgactcttgagaagaacagctggctagta

SEQ ID NO: 216134 - DNA, 75 bp, Artificial Sequence
  Synthetic
gaacgcgaactcccccaaaggactagaggttagaggagacccgtgattagggagatgagggagcccatctcaggg

SEQ ID NO: 216135 - DNA, 75 bp, Artificial Sequence
  Synthetic
aacagggactggttccatgacgtgaacttgccatggaccggaggctctgagggtacctggaaaaacagagaagct

SEQ ID NO: 216136 - DNA, 75 bp, Artificial Sequence
  Synthetic
aaagctgtaaccctgggggaaggactagaggttagaggagaccctcccacaaagaagcgcaaacacaaaacagca

SEQ ID NO: 216137 - DNA, 75 bp, Artificial Sequence
  Synthetic
ttaattgagtttggcgaagcccatgccactaagcaagaagtactagctctaggatcgcaagaggggagtcttcaa

SEQ ID NO: 216138 - DNA, 75 bp, Artificial Sequence
  Synthetic
tattgacacctgggaaagactaggggatttgctgctctggacttccggctctcggcacagaacgccgttgaggag

SEQ ID NO: 216139 - DNA, 75 bp, Artificial Sequence
  Synthetic
aggatcgcaagaggggagtcttcaaatggccttggctggtgcgatggtggccaactatgacaacagcgtggcgac

SEQ ID NO: 216140 - DNA, 75 bp, Artificial Sequence
  Synthetic
ggatttgctgctctggacttccggctctcggcacagaacgccgttgaggagccggaggcccaaaacaccagatct

SEQ ID NO: 216141 - DNA, 75 bp, Artificial Sequence
  Synthetic
cataagcagtgggcacctaaagtgcagactgaaattggataaattgaaaatcaaaggaacaacatatcatatgtg

SEQ ID NO: 216142 - DNA, 75 bp, Artificial Sequence
  Synthetic
taaaggcgcctttgcattcactaaaactccgtctgacacaggccacgggacagccgtggttgagttgacgtactc

SEQ ID NO: 216143 - DNA, 75 bp, Artificial Sequence
  Synthetic
aggagttgatgggccttgccgaatccccatactgataacaacgagtctcagcaatgtggagcctgtcggaagaat

SEQ ID NO: 216144 - DNA, 75 bp, Artificial Sequence
  Synthetic
ggtaacagtcaatcccatcgtgacaacgtcatcaacccaaaaaaccacaatgattgaagtggagccgccgttcgg

SEQ ID NO: 216145 - DNA, 75 bp, Artificial Sequence
  Synthetic
agattcctacatcatcgtcgggagtggcgaccagagagttcattaccattggaggaaatcgggaagcagcatagg

SEQ ID NO: 216146 - DNA, 75 bp, Artificial Sequence
  Synthetic
agctgcttttgcaaccatgatgaagggagccaggcgcctagcggtcataggagacgacgcttgggacttcggctc

SEQ ID NO: 216147 - DNA, 75 bp, Artificial Sequence
  Synthetic
tgtggggggaattctcaactcagtgggaaaagctttgcatcaggtctttggaagtatgtttaggacgctgtttgg

SEQ ID NO: 216148 - DNA, 75 bp, Artificial Sequence
  Synthetic
tgggatgtcgtggataacccagataatggtgggagctttatgctgctggctaggaatcaatgctagggacaagag

SEQ ID NO: 216149 - DNA, 75 bp, Artificial Sequence
  Synthetic
tatcgcgctcacttttttggcagttggaggggtgttgatatttttggctacctccgtgaacgctgactctggatg

SEQ ID NO: 216150 - DNA, 75 bp, Artificial Sequence
  Synthetic
tgctttggacctgaataggaaagagttcaaatgtggaaatgggatcttcgtctttaatgacgcggaggcctggac

SEQ ID NO: 216151 - DNA, 75 bp, Artificial Sequence
  Synthetic
gcacacgtacaagtatcatcccagcactccgaagcagctcgccggctcaatcgtcaaagctctggaagatgggca

SEQ ID NO: 216152 - DNA, 75 bp, Artificial Sequence
  Synthetic
atgtggagccagatcagtgggacgcctggaacatgagatgtggaaatccaatgcaaaggaaatcaacgccatctt

SEQ ID NO: 216153 - DNA, 75 bp, Artificial Sequence
  Synthetic
agtggaaaatgacaaaaatctcagcgttgtggttctggaaagtgactattacaggaaagcgaagaagctcatgcc

SEQ ID NO: 216154 - DNA, 75 bp, Artificial Sequence
  Synthetic
tataggtgaagagctggcttttggatggaagagctgggggaaaaaattttttgaagaacctccgatgcaaaacga

SEQ ID NO: 216155 - DNA, 75 bp, Artificial Sequence
  Synthetic
aactttcatcgttgatgggaaggttggaaaagaatgtcctgaagagaggagatcctggaacaacttcaagatcga

SEQ ID NO: 216156 - DNA, 75 bp, Artificial Sequence
  Synthetic
ggactttgggtttggggtcttttccacttcagtgtggatggaacagagagccgtttatactgaggattgtgacga

SEQ ID NO: 216157 - DNA, 75 bp, Artificial Sequence
  Synthetic
aaaggtaattggtgctgccgtgaaaggggagagagccgcccacagtgatttgggttattggatggaaagcatttc

SEQ ID NO: 216158 - DNA, 75 bp, Artificial Sequence
  Synthetic
cctgaacgggacgtggagattggaacatgtgtacatgatagaagttaaatcctgcacctggcctgccactcacac

SEQ ID NO: 216159 - DNA, 75 bp, Artificial Sequence
  Synthetic
gttatggaacggaggagtggaagaatccgagttgataatcccgaaaagcagggctgggccagtgtcacatcacaa

SEQ ID NO: 216160 - DNA, 75 bp, Artificial Sequence
  Synthetic
tactagaaaggggtatcaaaaccaaatcaaaggaccctggcatctccatcctctcgaaattaggtttgagagttg

SEQ ID NO: 216161 - DNA, 75 bp, Artificial Sequence
  Synthetic
ccctggcacgacagtcaccataactgaggaatgcggtggaagaggagcgtcgctaagaaccaccaccagcagtgg

SEQ ID NO: 216162 - DNA, 75 bp, Artificial Sequence
  Synthetic
taaagtcattactgaatggtgttgcagaagctgcaccatgcccccactgagtttccgagccccggatggttgctg

SEQ ID NO: 216163 - DNA, 75 bp, Artificial Sequence
  Synthetic
gtacggaatggaaatcagacctatgagagagagggaggagacattagtgaaaagtcatgtgagtgcaggaagagg

SEQ ID NO: 216164 - DNA, 75 bp, Artificial Sequence
  Synthetic
tgacggccttgacaacttctcattgggagttttggttttgaccatcacgctgcaggaagtgctgaggaagcgggt

SEQ ID NO: 216165 - DNA, 75 bp, Artificial Sequence
  Synthetic
gttgggaaaacacgtgctgtggatgatcttagtggtgttcctactgatgatgataggagggataacttacagaga

SEQ ID NO: 216166 - DNA, 75 bp, Artificial Sequence
  Synthetic
cgttgggcgttacctcgttctggctggagcggcgtttgcagaacagaactcaggtggcgacttactgcatctggt

SEQ ID NO: 216167 - DNA, 75 bp, Artificial Sequence
  Synthetic
gctagtggccactttcaaagtgaggccgatggcgttgcttggcttcgtcctgggaggtagatggtgccggcggca

SEQ ID NO: 216168 - DNA, 75 bp, Artificial Sequence
  Synthetic
gtctttgttgttggcaataggagctgtgctcgtgaatttggctctggattccagaggaggctatttcgaaattgt

SEQ ID NO: 216169 - DNA, 75 bp, Artificial Sequence
  Synthetic
ggactcactggccctggcacttctctttgttaaagccatcatccactcagatgcctcttcggtcagcctgccact

SEQ ID NO: 216170 - DNA, 75 bp, Artificial Sequence
  Synthetic
gctagcagctctggcaccaacgggatgctacaccattttgggaacacataggtttgtgatgctcgccctgattct

SEQ ID NO: 216171 - DNA, 75 bp, Artificial Sequence
  Synthetic
tgtgacattcctaggatgtaagagaaccgcttccgtgaaaaaagctggagtagcagccatgagtgtagtcatgac

SEQ ID NO: 216172 - DNA, 75 bp, Artificial Sequence
  Synthetic
cataggaggcttcagcccgctgccaatgttggggatgttgatgttcacgaatgtggggaaaaggagctggcctct

SEQ ID NO: 216173 - DNA, 75 bp, Artificial Sequence
  Synthetic
tcacgaagctatggcggctgtgggcatcctatgcgctctatttggcgcattggctgagactgaagttgaccttgc

SEQ ID NO: 216174 - DNA, 75 bp, Artificial Sequence
  Synthetic
cggaccaatggctgcagcaggtctgatcatcatggcttatgtggtatctggacgaagcaacgatatcagcataaa

SEQ ID NO: 216175 - DNA, 75 bp, Artificial Sequence
  Synthetic
gaaagttgaggaaaccaggtggagcggtgaagcagaagtgactggagagagtgtcagctatcacgtcagcttaga

SEQ ID NO: 216176 - DNA, 75 bp, Artificial Sequence
  Synthetic
tgagcagggtgatttcacgctgacagaagactcaggccctggaatggaaaaagtgctcttgaaagttgggttgat

SEQ ID NO: 216177 - DNA, 75 bp, Artificial Sequence
  Synthetic
ggccgtcagtggactataccctgttgccatcccctttgctttgggagcgtggttctttttggaaaagcgacaaaa

SEQ ID NO: 216178 - DNA, 75 bp, Artificial Sequence
  Synthetic
aagagcaggtgctttgtgggatgtgccatccccaagggagtcaaaaccggctaaatgtgaagatggagtgtaccg

SEQ ID NO: 216179 - DNA, 75 bp, Artificial Sequence
  Synthetic
ggtattctcaaggagacttttcggagagagccaaattggagctggggtgatgtttaaaggcacttttcacacgat

SEQ ID NO: 216180 - DNA, 75 bp, Artificial Sequence
  Synthetic
gtggcatgtaaccagaggggccgtcatcaaatcaggagatggtgtctttgaacccgtttgggcagatgtccggag

SEQ ID NO: 216181 - DNA, 75 bp, Artificial Sequence
  Synthetic
agacttgatagcctacggaggacattggaaactcactgaacgatgggatggggtggaagaagtgcaacttatcgc

SEQ ID NO: 216182 - DNA, 75 bp, Artificial Sequence
  Synthetic
attggagccagggaaaaaagttagacacatccagacaaaacccgggatcttcaaaacggcagagggtgagatcgg

SEQ ID NO: 216183 - DNA, 75 bp, Artificial Sequence
  Synthetic
agcagtggacttggactgtccagccggcacctcaggatctccgatagtcaacaaaaacggggatgttatcggttt

SEQ ID NO: 216184 - DNA, 75 bp, Artificial Sequence
  Synthetic
gtatggaaatggagtcttggtaaaaggtgacaggtatgtaagtgcaatatctcaaaagagcgaagtagtagaagg

SEQ ID NO: 216185 - DNA, 75 bp, Artificial Sequence
  Synthetic
ggaaacagaggaaatggaagacaggtggttcaagaaaagagaactaacagtcctggatctccatccaggagctgg

SEQ ID NO: 216186 - DNA, 75 bp, Artificial Sequence
  Synthetic
aaaaacccgccgcgtcttgccgcagctcgtaagagaagcggtgaaacgtcgtctgaggacggtgattctgtctcc

SEQ ID NO: 216187 - DNA, 75 bp, Artificial Sequence
  Synthetic
gacaagagtggtggcagccgagatgtatgaggctctaaagggggaaccagttaggtacatgacaccagcagtcca

SEQ ID NO: 216188 - DNA, 75 bp, Artificial Sequence
  Synthetic
gagtgagcgcactggcacagagataatagacttgatgtgccattcaacattcaccatgaagttgctgcaaggagt

SEQ ID NO: 216189 - DNA, 75 bp, Artificial Sequence
  Synthetic
gagggtgcccaattacaacctgtacataatggatgaagcgcacttcatggatcccgcgagtgttgctgccagagg

SEQ ID NO: 216190 - DNA, 75 bp, Artificial Sequence
  Synthetic
gtacatagaaactagggtgagcttgggcgacgcgggagccatatttatgacagccaccccccctggaatgagcga

SEQ ID NO: 216191 - DNA, 75 bp, Artificial Sequence
  Synthetic
gccattcccaccttccaatgctcccatcatggatgaagaaatgcgcattccggacaaagcctggaatgctggata

SEQ ID NO: 216192 - DNA, 75 bp, Artificial Sequence
  Synthetic
tgaatggataaccgaatttcagggaaagaccgtgtggttcgtccatagcataaaacaaggggctgaattggggac

SEQ ID NO: 216193 - DNA, 75 bp, Artificial Sequence
  Synthetic
ctgcctgcaaaaggcaggaaagaaggttatatatctcaataggaaaagatttgagagcgaataccctagatgcaa

SEQ ID NO: 216194 - DNA, 75 bp, Artificial Sequence
  Synthetic
accactgatatctccgaaaagggagcaaatttcaaagctgaccgagacattgatcccacagtggtagtgaaacct

SEQ ID NO: 216195 - DNA, 75 bp, Artificial Sequence
  Synthetic
atcttgatggatggacgagttagtatgcaggggcctatagccatctcgccagcatcagcagctcaaagaaggggg

SEQ ID NO: 216196 - DNA, 75 bp, Artificial Sequence
  Synthetic
agaatcggtagaaatcctgaaaagctcggggacgtttacgcgttcagtgggaacgttagctcagacaacgaggaa

SEQ ID NO: 216197 - DNA, 75 bp, Artificial Sequence
  Synthetic
catgtgagttggactgaagctagaatgttgctggacaacatccatgtgcaaggaggagttgttgcgcaactctac

SEQ ID NO: 216198 - DNA, 75 bp, Artificial Sequence
  Synthetic
acaccggaaagagaaaaatgtgagtgttatgaaggtgagttcaaactcaaaaccactcagcgaaagatcttctca

SEQ ID NO: 216199 - DNA, 75 bp, Artificial Sequence
  Synthetic
gagttgatacgcaccggagatcttccagtatggttggcataccaggtggcttcatcaaacatggaatatcatgat

SEQ ID NO: 216200 - DNA, 75 bp, Artificial Sequence
  Synthetic
cgcaagtggtgttttgatgggcctaatgaacatctgcttctggagaacaaccaggaagtggaagtgtggaccaaa

SEQ ID NO: 216201 - DNA, 75 bp, Artificial Sequence
  Synthetic
caaggacaaaggaaagtactgaaaccccgctggcttgatggaagaataacatccgaccacttgaatttgaagagc

SEQ ID NO: 216202 - DNA, 75 bp, Artificial Sequence
  Synthetic
ttcaaggaatttgcagctggcaagagaagcgctgtgggcgtgatggatgtgatctcaaccctacccagtcacctg

SEQ ID NO: 216203 - DNA, 75 bp, Artificial Sequence
  Synthetic
aacatgagacttcaagaggcgttggacacggctgcaatactcactagatcagagcctggaagtaggagttacaaa

SEQ ID NO: 216204 - DNA, 75 bp, Artificial Sequence
  Synthetic
gcagccatggagaatacccctgaaatggttgaaacatttcttttgtttgctctggtgtcattgatcacactagga

SEQ ID NO: 216205 - DNA, 75 bp, Artificial Sequence
  Synthetic
gtgatagccattttagtgaaaggaaagggaccaggaaaacttacatttggaatggtggcaataggagggatggcg

SEQ ID NO: 216206 - DNA, 75 bp, Artificial Sequence
  Synthetic
tggctgctgtggcaggcgaacgtggaccctgggaagatagcagcatcagtgattctggtattcctccttctggtg

SEQ ID NO: 216207 - DNA, 75 bp, Artificial Sequence
  Synthetic
gtgctgataccggaacctgagaagcaaaggtccattcaagacaaccagctggccatgctaatgttactgctggcc

SEQ ID NO: 216208 - DNA, 75 bp, Artificial Sequence
  Synthetic
gctatcatggggggagttgccgctaatgagatgggctggcttgaaaagacgaaagatgatttgagctggatattg

SEQ ID NO: 216209 - DNA, 75 bp, Artificial Sequence
  Synthetic
cagagcagagacgctcaggggaccgtttccacaccggtttttgagctagacatgaaacctgccacggcatggaca

SEQ ID NO: 216210 - DNA, 75 bp, Artificial Sequence
  Synthetic
ttgtatgctcttgcaactacatttttgactcctttgtttcagcatttgattgttacaaaatatgcaagcatctcc

SEQ ID NO: 216211 - DNA, 75 bp, Artificial Sequence
  Synthetic
ctcatggccatagccacacaggctgggacactgttcagcatggatagtggaatacccctttccagcatagagctg

SEQ ID NO: 216212 - DNA, 75 bp, Artificial Sequence
  Synthetic
agtgtgcctcttttggcactggggtgctggactcaaatcacaccttgtagcctgattttggcctgtgctttgttg

SEQ ID NO: 216213 - DNA, 75 bp, Artificial Sequence
  Synthetic
ctcatccactacgccatcctcctcccaggaatgcaggctcaagcagctagggacgcacagcggaggacggcagct

SEQ ID NO: 216214 - DNA, 75 bp, Artificial Sequence
  Synthetic
ggcataatgaaaaacgctgtggtggacggaattgtggccactgacataccacctcttgacggagctggtccgtta

SEQ ID NO: 216215 - DNA, 75 bp, Artificial Sequence
  Synthetic
acagaaaagaagcttggacagctactcctgtttgccgctgctgttgccggggtggttataacgagaagcccacga

SEQ ID NO: 216216 - DNA, 75 bp, Artificial Sequence
  Synthetic
tcatggagtgagttgggagttcttggttcagctgtgggatcaactttgatagaaggaagtgccggaagattctgg

SEQ ID NO: 216217 - DNA, 75 bp, Artificial Sequence
  Synthetic
aatgccacaacggcaacagctatgtgcaacctgtttagagggagttacttggcaggtatacctttaacctacatg

SEQ ID NO: 216218 - DNA, 75 bp, Artificial Sequence
  Synthetic
gtgataaggaacagcgggacaggaaccaagcgaggaggagggattggtgagacactaggagagaagtggaaagcg

SEQ ID NO: 216219 - DNA, 75 bp, Artificial Sequence
  Synthetic
agactcaatcaattgaacactctggaattcaacagatacaggagaagccacattactgaggtggatcgtgagcca

SEQ ID NO: 216220 - DNA, 75 bp, Artificial Sequence
  Synthetic
gctaaggccgctctcaaggcgggagaccccggaagaggagcagctgtttctagaggcagcgccaaactccgatgg

SEQ ID NO: 216221 - DNA, 75 bp, Artificial Sequence
  Synthetic
atgcacgagagagggtatgtgaagttgtatgacaaagtcgtggacttggggtgtggcagaggaggatggagttat

SEQ ID NO: 216222 - DNA, 75 bp, Artificial Sequence
  Synthetic
tacgctgcctcccagaaggaagtgaaagaagttaaaggttacactaaagggggaagaggccatgaagaaccgata

SEQ ID NO: 216223 - DNA, 75 bp, Artificial Sequence
  Synthetic
atgacgcagagttacggttggaatatcgtccagttcaagagtgggattgatgtcttttacaaggaagctgaaagc

SEQ ID NO: 216224 - DNA, 75 bp, Artificial Sequence
  Synthetic
tgtgatgtggtgatgtgtgacattggtgagtgcagcagttcaccgatagttgaagcttcacgcacactcaaggtg

SEQ ID NO: 216225 - DNA, 75 bp, Artificial Sequence
  Synthetic
ttggaattggcagagaggtggttgaccagaaatccaaaggctgactactgcattaaggtgctgtgcccatacatg

SEQ ID NO: 216226 - DNA, 75 bp, Artificial Sequence
  Synthetic
ccagaagtaattgaaaaattgagtaaattgcagcttaagcatggtggttgtgttgtgagaaacccactctcaaga

SEQ ID NO: 216227 - DNA, 75 bp, Artificial Sequence
  Synthetic
aattccactcatgaaatgtactgggtctcaggtttcaaaggaaatttagttggcatcatcaactcaacctccaat

SEQ ID NO: 216228 - DNA, 75 bp, Artificial Sequence
  Synthetic
ttgctcttgaaaaggatggagatcaagttcgcggagccaaggtatgaagaggacgtgaacctgggcagcggaacc

SEQ ID NO: 216229 - DNA, 75 bp, Artificial Sequence
  Synthetic
agggccgtgacaattgctccaccccggtttgactatggaaagatcagatcaaggatagaaaggctgcaggcagag

SEQ ID NO: 216230 - DNA, 75 bp, Artificial Sequence
  Synthetic
cacaaagccacatggcattatgacgtggaacacccttacagaacgtgggcatatcatgggagttatgtggtcaag

SEQ ID NO: 216231 - DNA, 75 bp, Artificial Sequence
  Synthetic
ccttcgggaagcgcttcatcactagtgaatggggtggtcaaaatgttatccaagccatgggacgtgatttctgag

SEQ ID NO: 216232 - DNA, 75 bp, Artificial Sequence
  Synthetic
gtcacaggtatgtctatgacagacaccacaccctttggacagcaaagggtttttaaggagaaggtggacaccaaa

SEQ ID NO: 216233 - DNA, 75 bp, Artificial Sequence
  Synthetic
gcccctgaacccccgcccggagctgaaatggcgaccatcatagtttcagaatggctgtggaggaaactagcagag

SEQ ID NO: 216234 - DNA, 75 bp, Artificial Sequence
  Synthetic
aagaaaagacttcgcatgtgcacgaaggaagagttcatcaagaaagtgaggagcaatgctgctctcgggcctgtc

SEQ ID NO: 216235 - DNA, 75 bp, Artificial Sequence
  Synthetic
ttcgaggatgaaaacaggtggaaagacgctgcagaagctgtgcaggaccctgacttctggaacatggttgatgag

SEQ ID NO: 216236 - DNA, 75 bp, Artificial Sequence
  Synthetic
gaacgcaagaaccatttagaaggtagatgtgaaacatgtgtgtacaacatgatgggaaaaagagagaaaaagcgg

SEQ ID NO: 216237 - DNA, 75 bp, Artificial Sequence
  Synthetic
ggcgaatttgggaaagccaagggaagccgcgcgatctggttcatgtggctcggagcaaggttcctagagtttgaa

SEQ ID NO: 216238 - DNA, 75 bp, Artificial Sequence
  Synthetic
gcattcggattcttgaacgaagaccactggatggggagagaaaactcaggtggaggggtcgaaggcctcggcatc

SEQ ID NO: 216239 - DNA, 75 bp, Artificial Sequence
  Synthetic
caaaagttaggatatgtaatgagagagataggaagtaaaggtggtgtgatctacgctgatgacacagccggttgg

SEQ ID NO: 216240 - DNA, 75 bp, Artificial Sequence
  Synthetic
gacacacgcatcacagagagtgatttgcggaatgagagccacattctggaattcatggaaggagaacacaggaaa

SEQ ID NO: 216241 - DNA, 75 bp, Artificial Sequence
  Synthetic
ttggcaaaagctgtctttgaccttacgtatagacacaaggttgtcaaggtcatgagaccaggaaaaggagtcacc

SEQ ID NO: 216242 - DNA, 75 bp, Artificial Sequence
  Synthetic
ttgatggacattatctctagagaggatcagcgtggtagtggccaagtcgtcacctacgctctaaacaccttcacc

SEQ ID NO: 216243 - DNA, 75 bp, Artificial Sequence
  Synthetic
aacctcgtggtgcagcttgtgagaatggctgaatcagaggagatccttcaagttgatgacctccaggaactatca

SEQ ID NO: 216244 - DNA, 75 bp, Artificial Sequence
  Synthetic
agtgatgtgaggttgaagctgaacagatggctgaaggatcaaggctgggagagactgcagcgcatggccgtgagc

SEQ ID NO: 216245 - DNA, 75 bp, Artificial Sequence
  Synthetic
ggtgacgattgcgctgtggcggcaatagatgaaaggttcgcgaacgctcttcacttcctaaacgcttgctcaaag

SEQ ID NO: 216246 - DNA, 75 bp, Artificial Sequence
  Synthetic
gtaagaaaggatgtgcgtgagtggaccccgtcgaaaggttggaaaaactgggaggaagtgcccttctgttcacat

SEQ ID NO: 216247 - DNA, 75 bp, Artificial Sequence
  Synthetic
cacttccaccgcttgaacatgaaagacgggagggaactgattgtgccatgccgctcgcaggatgaattgattggg

SEQ ID NO: 216248 - DNA, 75 bp, Artificial Sequence
  Synthetic
cgagctagaataacgcagggtgtcggagatttggccagttctgcctgtttggcaaaagcctacgcccaaatgtgg

SEQ ID NO: 216249 - DNA, 75 bp, Artificial Sequence
  Synthetic
cagttgatgtacttccatagaagagacctaagactcatgagcaatgcgatctgctctgccgtgccagtagactgg

SEQ ID NO: 216250 - DNA, 75 bp, Artificial Sequence
  Synthetic
gtaccaactggaagaaccacctggtccattcacggaaaaggagagtggatgacgactgaggacatgcttgaagtg

SEQ ID NO: 216251 - DNA, 75 bp, Artificial Sequence
  Synthetic
tggaacagggtgtggattgaagaaaatgagtacatgaaagataagacccctgtcacagattggactgacgtgccc

SEQ ID NO: 216252 - DNA, 75 bp, Artificial Sequence
  Synthetic
tatttgggaaaacgggaagaccagtggtgtggttccttgataggatatcgaccccgcaccacctgggctgaaaac

SEQ ID NO: 216253 - DNA, 75 bp, Artificial Sequence
  Synthetic
ataagagtgcccatcaatgtgatccgcgtcaagataggaggaaacaagttcaaggattacctgatcagccagagg

SEQ ID NO: 216254 - DNA, 75 bp, Artificial Sequence
  Synthetic
aagttcaaggattacctgatcagccagaggagatatgacgtggcagagaaattgaaatttacaggagtgttgtag

SEQ ID NO: 216255 - DNA, 75 bp, Artificial Sequence
  Synthetic
agcaggactagactttgaaaacctttatctgctgactctaggtggaaacataacacagtgtgagcaagttttttg

SEQ ID NO: 216256 - DNA, 75 bp, Artificial Sequence
  Synthetic
tatctgctgactctaggtggaaacataacacagtgtgagcaagttttttgaacagcaatgcccaaaaaaccagga

SEQ ID NO: 216257 - DNA, 75 bp, Artificial Sequence
  Synthetic
aaaagttttgagagcgaataccctagatgcaagaaagaagattgggactttgttatcaccactgatatctccgaa

SEQ ID NO: 216258 - DNA, 75 bp, Artificial Sequence
  Synthetic
atgggcgcaaatttcaaagctgaccgagtcattgatcccaggaaaaccgtgaaacctatcttgatggatggacga

SEQ ID NO: 216259 - DNA, 75 bp, Artificial Sequence
  Synthetic
ccagaggagatatgacgtggcagagaaattgaaatttacaggagtgttgtagattgattgttaattaaataaggg

SEQ ID NO: 216260 - DNA, 75 bp, Artificial Sequence
  Synthetic
gggtgtaatatttatagtcaggcctgaaaagccatctgatccggtgaagatgctgcctgcttccggctcagggtg

SEQ ID NO: 216261 - DNA, 75 bp, Artificial Sequence
  Synthetic
atgccctgatgttgtggataaacaaccaatggagccaagcccggagggaatccggcccccgaccataagcagtgg

SEQ ID NO: 216262 - DNA, 75 bp, Artificial Sequence
  Synthetic
gaccataagcagtgggcacctaaagtgcagactgaaattggataaattgaaaatcaaaggaacaacatatcatat

SEQ ID NO: 216263 - DNA, 75 bp, Artificial Sequence
  Synthetic
tctatggatgatactgggagtgtttttgctgatgatgataggtggaaacataacacagtgtgagcaagttttttg

SEQ ID NO: 216264 - DNA, 75 bp, Artificial Sequence
  Synthetic
aacagcaatgaccaaaaaaccaggaaagcccgggaaaactcgggctgtcaatatgctgaagcgcggcgcatcccg

SEQ ID NO: 216265 - DNA, 75 bp, Artificial Sequence
  Synthetic
cgcgcttggccccttagccaagcttaagaggatgtttgcgaatctgcttgacggcagaggtccgttgcgcctggt

SEQ ID NO: 216266 - DNA, 75 bp, Artificial Sequence
  Synthetic
gttagctctagtggctttcttcaggttcacggatctaaagccgacggcgggcttgctgaagagatgggggatgat

SEQ ID NO: 216267 - DNA, 75 bp, Artificial Sequence
  Synthetic
ggacaaaattcatgctctgtctctgctgaagggattcaagaaggacctcgcatcaatgactgacatcatcaacag

SEQ ID NO: 216268 - DNA, 75 bp, Artificial Sequence
  Synthetic
aaggaagaagaagagaggagcatccaatgggatagtcttcttggtcttattcggatgcgtcatgggagtgaggat

SEQ ID NO: 216269 - DNA, 75 bp, Artificial Sequence
  Synthetic
tacacaggagaatggcatgcccatgatgaaaatacaaaaaaccgatgtggggaaagtgatcaccatgagaactga

SEQ ID NO: 216270 - DNA, 75 bp, Artificial Sequence
  Synthetic
tcaaggtgagaacagatgcatagtccaagcactagacgtgggggaggaatgtgaggataccatgacttacctctg

SEQ ID NO: 216271 - DNA, 75 bp, Artificial Sequence
  Synthetic
ccctgccattgagaacccatccgatcctgacgacatagactgttggtgtgacagagtggattctatggttagcta

SEQ ID NO: 216272 - DNA, 75 bp, Artificial Sequence
  Synthetic
cggaaggtgctctaaaaccagacatgcaaaaagatcacggagatcgaccaacatagctggacacgccgattcgag

SEQ ID NO: 216273 - DNA, 75 bp, Artificial Sequence
  Synthetic
cctcgatagtcgaggaacagtttggatggacaccaggaaggcagccagctacttgacaaaagcagaaagttgggc

SEQ ID NO: 216274 - DNA, 75 bp, Artificial Sequence
  Synthetic
ccttcggaatccaggttacgctttagttgcaattgttttgggatggaacttgggaacatcaaaagcccaaaaaat

SEQ ID NO: 216275 - DNA, 75 bp, Artificial Sequence
  Synthetic
catattcacggccatgttactactcatagcaccagcttacagcatgcggtgcataggagttgaaaaccgtgactt

SEQ ID NO: 216276 - DNA, 75 bp, Artificial Sequence
  Synthetic
tattgaaggagtttctggagggacctgggttgatgtggtgttagagcacagaggatgtgttaccattatggcccc

SEQ ID NO: 216277 - DNA, 75 bp, Artificial Sequence
  Synthetic
tgacaaacccaccattgacctggagttaacgtcgacacttgccaagtccatggcggtaacaagaacctattgtgt

SEQ ID NO: 216278 - DNA, 75 bp, Artificial Sequence
  Synthetic
ccaagcacaggtcactgaactttcggttgacacccgttgtccaaccatgggtgaggcccacaactcaaagtctac

SEQ ID NO: 216279 - DNA, 75 bp, Artificial Sequence
  Synthetic
tgatgtctcatacgtttgcaagaaaggctttagtgatcgtggatggggaaatggatgtggtctttttgggaaagg

SEQ ID NO: 216280 - DNA, 75 bp, Artificial Sequence
  Synthetic
aagcatggagacttgtgcaaagttcacctgtcaaaccaaagctgagggtagaatcattcaaaaagagaaccttga

SEQ ID NO: 216281 - DNA, 75 bp, Artificial Sequence
  Synthetic
atacacgattcatctaaatgttcatgcctctacagagacagatcacttcatgaacgacactgctgctgcagagaa

SEQ ID NO: 216282 - DNA, 75 bp, Artificial Sequence
  Synthetic
taagcatggatcaaagatttctatcacagcaacagctccgtctagaaccgcagacttgggggattatggcaccat

SEQ ID NO: 216283 - DNA, 75 bp, Artificial Sequence
  Synthetic
aactctagattgtgagccgagagcagggctggacttcgacaacctctacctactcaccttggaaaagaacagctg

SEQ ID NO: 216284 - DNA, 75 bp, Artificial Sequence
  Synthetic
gctcgtcaacagagactggtttcatgatgtgaatcttccttggacgggcggggcagaaggaaattggaaaaacag

SEQ ID NO: 216285 - DNA, 75 bp, Artificial Sequence
  Synthetic
agaagctttggtggaatttggcgaagcccatgccaccaagcaggaagtactggctctgagctcacaagaagggag

SEQ ID NO: 216286 - DNA, 75 bp, Artificial Sequence
  Synthetic
tctgcaaatggcattggctggtgccatggtggccaaatatgacaacgatgcagccactatcagcagtggtcatct

SEQ ID NO: 216287 - DNA, 75 bp, Artificial Sequence
  Synthetic
gaagtgcagactcaagttggacaagttgaagattaaaggaacaacctaccatatgtgcaagggatcattcgcctt

SEQ ID NO: 216288 - DNA, 75 bp, Artificial Sequence
  Synthetic
caccaagactccatcagacacgggacatggaacagttgtgattgaactgacctattcggggaccgatggtccgtg

SEQ ID NO: 216289 - DNA, 75 bp, Artificial Sequence
  Synthetic
cagagtgcccatatccatgacgactagtctgagcaacgttgaaccagttgggaggatggtaactgtgaacccaat

SEQ ID NO: 216290 - DNA, 75 bp, Artificial Sequence
  Synthetic
agtgacttctgcctcaactcagaaaaccataatgattgaagttgaacccccttttggcgactcctacatcattgc

SEQ ID NO: 216291 - DNA, 75 bp, Artificial Sequence
  Synthetic
aggaacaggtgaaccgcgggtgcattaccactggaggaaatcagggagtagtattggggccgcttttgcaacaac

SEQ ID NO: 216292 - DNA, 75 bp, Artificial Sequence
  Synthetic
tatgaaaggagcaaaacgtttggctgtcattggagatgatgcatgggactttggctcagtgggaggcattctcaa

SEQ ID NO: 216293 - DNA, 75 bp, Artificial Sequence
  Synthetic
ctcaataggaaaagccttgcaccaggtgtttggtagcatgttcaggaccttgtttggaggaatgtcttgggtgac

SEQ ID NO: 216294 - DNA, 75 bp, Artificial Sequence
  Synthetic
acaaatcatgattggaggactgtgctgctggctggggattaacgctcgagacaagagcatagctctcacgttcct

SEQ ID NO: 216295 - DNA, 75 bp, Artificial Sequence
  Synthetic
cgccgttggaggggtgctgattttcttggctacatctgtaaacgccgattcaggctgcgctcttgatctgaacag

SEQ ID NO: 216296 - DNA, 75 bp, Artificial Sequence
  Synthetic
gaaagaattcaagtgtggaaatggcattttcgtgttcaatgacgctgaggcttggacccatacatacaaatacca

SEQ ID NO: 216297 - DNA, 75 bp, Artificial Sequence
  Synthetic
ccctagcaccccgaaaaggctggctggatccatcgtcaaagcgatggaagaagggcaatgtggtgtgcgctcagt

SEQ ID NO: 216298 - DNA, 75 bp, Artificial Sequence
  Synthetic
agggaaattagaacacgaaatgtggaagtccaacgccaaagagatcaatgccatcctctctgaaaatgacaagaa

SEQ ID NO: 216299 - DNA, 75 bp, Artificial Sequence
  Synthetic
cttgagtgtggtagtactggaaagtgattactacaggaaagccaagaatctaatgcctgttggagaagagctcac

SEQ ID NO: 216300 - DNA, 75 bp, Artificial Sequence
  Synthetic
cttcggatggaagagttgggggaaaaaattctttgaggatccaccattgcaaaacacaacattcattgtggatgg

SEQ ID NO: 216301 - DNA, 75 bp, Artificial Sequence
  Synthetic
caagaccggaaaagagtgccctgaagagagaagatcctggaacaacttcaaaatagaggattttggatttggcgt

SEQ ID NO: 216302 - DNA, 75 bp, Artificial Sequence
  Synthetic
gttctcgacttctgtttggatggagcaaaggacaacttattctgaggaatgtgacgagaaagtgataggagctgc

SEQ ID NO: 216303 - DNA, 75 bp, Artificial Sequence
  Synthetic
cgtgaaaggggacagggcagcccatagtgaccttggctattggatggagagtgcttctcacaacggcagttggag

SEQ ID NO: 216304 - DNA, 75 bp, Artificial Sequence
  Synthetic
actcgagcatgtgtacatgatagaagtcaagtcatgctcttggcctgcgacgcacacgctttggaatggaggggt

SEQ ID NO: 216305 - DNA, 75 bp, Artificial Sequence
  Synthetic
cgaggagtctgagctgatagtacccaaaacacgggctggaccaatatcgcatcacaacaccagacgtggatacca

SEQ ID NO: 216306 - DNA, 75 bp, Artificial Sequence
  Synthetic
gaatcagattaaaggtccgtggcatcttcatcctttggaaatcagatttgagacatgtccaggaacgacagtgtc

SEQ ID NO: 216307 - DNA, 75 bp, Artificial Sequence
  Synthetic
aatcactgaggaatgtggaaatagagggccatcactgaggacaaccaccgcaagtggcaaggtcatctctgagtg

SEQ ID NO: 216308 - DNA, 75 bp, Artificial Sequence
  Synthetic
gtgctgtagaagctgtactatgcctccactgagtttccggggtcctgatgggtgctggtatgggatggaaatacg

SEQ ID NO: 216309 - DNA, 75 bp, Artificial Sequence
  Synthetic
accattgaaggagagagaagaaactctggtaaaaagctacgtcagcgcaggaagaggggatggtttggataattt

SEQ ID NO: 216310 - DNA, 75 bp, Artificial Sequence
  Synthetic
ctctctcggtgttcttgtgttgaccatattgcttcaagaagtgctgaggaagcgagtgcttggaaagcacgctct

SEQ ID NO: 216311 - DNA, 75 bp, Artificial Sequence
  Synthetic
atggatgatactgggagtgtttttgctgatgatgatgggtggtttgacttacaaggatctaggcaggtacatgat

SEQ ID NO: 216312 - DNA, 75 bp, Artificial Sequence
  Synthetic
attggtgggtgctacctttgcagagcagaacaatggaggggatcttctacaccttgtcctggttgccactttcaa

SEQ ID NO: 216313 - DNA, 75 bp, Artificial Sequence
  Synthetic
agtcagaccaatggccttgctaggatttgtgctaggaggacgatggtgtcgaagacaatccctgttaatggccat

SEQ ID NO: 216314 - DNA, 75 bp, Artificial Sequence
  Synthetic
tggagcagtgctagtgaactttgccctagagttcaaaggtgggtactttgaggtggttgactccttcgccctggc

SEQ ID NO: 216315 - DNA, 75 bp, Artificial Sequence
  Synthetic
cttgttgtttgtcaaagccatcgtccattccgacgcctcaagcgtcagtcttccgctgctggcagcattggctcc

SEQ ID NO: 216316 - DNA, 75 bp, Artificial Sequence
  Synthetic
agcaggatgctacacggtcctgggcacgcaccggtttgtgatgttggccttgatattgaccacctttctgagttg

SEQ ID NO: 216317 - DNA, 75 bp, Artificial Sequence
  Synthetic
caagagaacatcctcagtgaaaaaagctggcacggcagcactcagtgtcttgatgtcagccattggaatgaaacc

SEQ ID NO: 216318 - DNA, 75 bp, Artificial Sequence
  Synthetic
acttccaatgctggggatgctaatgatgaccagcgccgggaagagaagctggccgctgcatgaggccatggcagc

SEQ ID NO: 216319 - DNA, 75 bp, Artificial Sequence
  Synthetic
cgtaggaatactgtgtgcattgtttggggctctagctgaaactgaggtcgatttggctggaccattagctgcagc

SEQ ID NO: 216320 - DNA, 75 bp, Artificial Sequence
  Synthetic
cgggcttgtgatcatggcctacgtgatctcaggcaaaagcaatgacataagcatcaagaaggtggaagagattaa

SEQ ID NO: 216321 - DNA, 75 bp, Artificial Sequence
  Synthetic
atggagtgaagaggcagaggtcacgggtgagagtgtgagctaccatgttagccttgatgaacagggagatttcac

SEQ ID NO: 216322 - DNA, 75 bp, Artificial Sequence
  Synthetic
actgacggaggactcggggccagggatggagaaagtgctcttaaagatcggattgatggcaattagcggtctcta

SEQ ID NO: 216323 - DNA, 75 bp, Artificial Sequence
  Synthetic
tcccgtggccatccctttcgccctaggcgcgtggttttttctagaaaagaaacataagagggccggggcattgtg

SEQ ID NO: 216324 - DNA, 75 bp, Artificial Sequence
  Synthetic
ggatattccatcaccgaaggacaccaaagctgccaaatgtgaggatggagtgtatcgcgttttctcgcggaggct

SEQ ID NO: 216325 - DNA, 75 bp, Artificial Sequence
  Synthetic
attgggtgaaagtcaaataggagctggagtgatgtacaaagggacctttcacaccatgtggcatgtgaccagggg

SEQ ID NO: 216326 - DNA, 75 bp, Artificial Sequence
  Synthetic
agctgtgataagagctggtgacggcattcttgagccaacttgggctgacgtaaggcgagaccttgttgcatatgg

SEQ ID NO: 216327 - DNA, 75 bp, Artificial Sequence
  Synthetic
aggaaattggaagctggtcgagcagtgggacggcattgaggaggttcaacttatagctctagaaccaggcaagaa

SEQ ID NO: 216328 - DNA, 75 bp, Artificial Sequence
  Synthetic
agtcagacacatccaaaccaaaccaggaattttcaaaaccactgaaggtgagattggagccgttgacttggattg

SEQ ID NO: 216329 - DNA, 75 bp, Artificial Sequence
  Synthetic
tcctgcaggcacttcaggatccccaattgtcaacaagaatggggagatcattgggttgtatggaaatggtgttct

SEQ ID NO: 216330 - DNA, 75 bp, Artificial Sequence
  Synthetic
agtgaaaggagagagatatgtgagcgccatatcacaaagaagtgaagctcccgaagatgagaaggatgagattga

SEQ ID NO: 216331 - DNA, 75 bp, Artificial Sequence
  Synthetic
ggatagatggttcaagaagagagagctgactgtcttggatctccaccctggagctgggaaaacacggagagtgct

SEQ ID NO: 216332 - DNA, 75 bp, Artificial Sequence
  Synthetic
gccccaactggtccgtgaggccgtgaaaagacggttaaggactgtcatcctgtctccaacaagagtagtggctgc

SEQ ID NO: 216333 - DNA, 75 bp, Artificial Sequence
  Synthetic
cgaaatgtacgaagccttgaagggtgaaccagtgaggtatatgacccccgcagtgcaaaatgaaagaactggcac

SEQ ID NO: 216334 - DNA, 75 bp, Artificial Sequence
  Synthetic
agagatcgtcgatttaatgtgccactccacgttcaccatgaagctccttcaaggggtaagagtgccaaactacaa

SEQ ID NO: 216335 - DNA, 75 bp, Artificial Sequence
  Synthetic
cctgtacataatggatgaagcacactttatggaccctgctagtgtagccgctaggggctatatagagactcgggt

SEQ ID NO: 216336 - DNA, 75 bp, Artificial Sequence
  Synthetic
caacatgggtgatgctggggctatcttcatgacggccaccccaccaggaacaacagaagcgtttcctccctcaaa

SEQ ID NO: 216337 - DNA, 75 bp, Artificial Sequence
  Synthetic
tgcgccaatagtggatgaagaggtgagaatcccggacaaggcatggaacgctggatatgagtgggttaccgactt

SEQ ID NO: 216338 - DNA, 75 bp, Artificial Sequence
  Synthetic
ccagggaaagaccgtatggtttgtacacagcataaaacaaggagctgagctagggatgtgcctccaaaaagcagg

SEQ ID NO: 216339 - DNA, 75 bp, Artificial Sequence
  Synthetic
gaaaaaagtcatctatctaaatagaaagagctttgaaagcgaatatcccaaatgcaaaaaggaagattgggattt

SEQ ID NO: 216340 - DNA, 75 bp, Artificial Sequence
  Synthetic
tgtgatgacgaccgacatctcagaaatgggagctaactttagagctgacagagtgattgatcccaggaagaccat

SEQ ID NO: 216341 - DNA, 75 bp, Artificial Sequence
  Synthetic
aaagccagtcctaattgatgggcgcgtgtgcatgcaagggccgatagcaatctcccccgcgtcagctgcacaaag

SEQ ID NO: 216342 - DNA, 75 bp, Artificial Sequence
  Synthetic
aagaggtagagttgggagaaatccagaaaagttgggtgacacatatgcttacagtggaaatgtgagcacggacaa

SEQ ID NO: 216343 - DNA, 75 bp, Artificial Sequence
  Synthetic
tgaaggacatgtcagctggacagaggcacggatgctgttggacaacatacatgtccaaggaggggtggtagccca

SEQ ID NO: 216344 - DNA, 75 bp, Artificial Sequence
  Synthetic
attgtacacgcctgaaagggaaaagtgtgactgctatgaaggagagtacaaattgaaaaccacccagcgaaaaat

SEQ ID NO: 216345 - DNA, 75 bp, Artificial Sequence
  Synthetic
tttttccgaactgatacgcacaggagacctgccagtgtggttggcttaccaggtggctgcctcaaatgttgacta

SEQ ID NO: 216346 - DNA, 75 bp, Artificial Sequence
  Synthetic
tcatgatcggaagtggtgctttgacgggccgaatgagaatttgctattagaaaacaatcaggaggtggaaatttg

SEQ ID NO: 216347 - DNA, 75 bp, Artificial Sequence
  Synthetic
gaacaagcaaggccaaagaaagatactcaaaccgaggtggctggatggaaggctaacgtcagaccacctaaacct

SEQ ID NO: 216348 - DNA, 75 bp, Artificial Sequence
  Synthetic
caagagcttcaaagagtttgcagccgggaaaaggagcgcaattggcatgatagacattatatcaacccttccaag

SEQ ID NO: 216349 - DNA, 75 bp, Artificial Sequence
  Synthetic
tcatctcaatatgagactgcaggaggctcttgatacagcagccatgctgagccggtctgaaccaggtagcagaag

SEQ ID NO: 216350 - DNA, 75 bp, Artificial Sequence
  Synthetic
ttacagagccgccctagaaaactcgcctgaaatggttgagaccttcctgctattcactctagtggctttgatgac

SEQ ID NO: 216351 - DNA, 75 bp, Artificial Sequence
  Synthetic
cttgggcctggtagcagttttggtaaggggcaagggacccggaaagttggcctttgggatggtggcaatcggggg

SEQ ID NO: 216352 - DNA, 75 bp, Artificial Sequence
  Synthetic
aatgacgtggttgttgtggcaggcaaaggtagatccagggaagattgctgcagctgtggtcctggtgttcttatt

SEQ ID NO: 216353 - DNA, 75 bp, Artificial Sequence
  Synthetic
gctagttgtgctgatccctgaaccagagaaacaacgttccatccaggacaatcagctggctatgttaatgttgtt

SEQ ID NO: 216354 - DNA, 75 bp, Artificial Sequence
  Synthetic
actagccacaatcatgggcggggtggcagctaatgagatgggctggttggaaaaaacaaaaaaggacctaggatg

SEQ ID NO: 216355 - DNA, 75 bp, Artificial Sequence
  Synthetic
gttttttcaaggtaggactaccaccagcactgccccagcctttgagctggacatgaaaccagcgacagcatggac

SEQ ID NO: 216356 - DNA, 75 bp, Artificial Sequence
  Synthetic
tctttatgctttggcaacaaccctcctaacaccattattccagcatctcatcgtcaccaggtatgccaacatatc

SEQ ID NO: 216357 - DNA, 75 bp, Artificial Sequence
  Synthetic
gctcatggctatagcttctcaagctggaaccttgtttagcatggacagtgggatcccattttcaagtgtggagct

SEQ ID NO: 216358 - DNA, 75 bp, Artificial Sequence
  Synthetic
cagtgtacccctactagctctaggatgttggacacagatcacgccgtgtagtctcattttggcttgtgtgttact

SEQ ID NO: 216359 - DNA, 75 bp, Artificial Sequence
  Synthetic
cttgatccactatgctattctcctcccaggaatgcaagcccaagccgcacgcgacgcccagaggagaactgccgc

SEQ ID NO: 216360 - DNA, 75 bp, Artificial Sequence
  Synthetic
gggcattatgaagaatgcagtggttgatggtatagtggcaacagacataccaccacttgatggcgcaggaccctt

SEQ ID NO: 216361 - DNA, 75 bp, Artificial Sequence
  Synthetic
aacagaaaagaaactgggacaactcctgttgttcgcagcagcggtcacgggagtggtcattacaaggagtccacg

SEQ ID NO: 216362 - DNA, 75 bp, Artificial Sequence
  Synthetic
gtcatggagcgaactgggagtcttgggctcagctgtgggttcaaccttgattgagggaaacgcaggaaaattttg

SEQ ID NO: 216363 - DNA, 75 bp, Artificial Sequence
  Synthetic
gaacgctactaccgctacggccatgtgtaatctcttcagaggaagctatctagccggcattcccttgacatacac

SEQ ID NO: 216364 - DNA, 75 bp, Artificial Sequence
  Synthetic
cataatcaggaacagtgggagtggaacaaaaagaggtggtggtgttggcgaaaccttaggagagaagtggaaagc

SEQ ID NO: 216365 - DNA, 75 bp, Artificial Sequence
  Synthetic
gcgcctaaaccagctgaacacgctggaatttaatcgataccggcgcagtcacatcacagaagtagatagagaacc

SEQ ID NO: 216366 - DNA, 75 bp, Artificial Sequence
  Synthetic
agcaagggctgctctacgcgcaggagatttcaatagaggggcggctgtttcaagaggtagtgccaagctacgttg

SEQ ID NO: 216367 - DNA, 75 bp, Artificial Sequence
  Synthetic
gatgcatgagcggggttatgtgaagctccatgacaaggtggtggatctcgggtgtggcagaggaggctggagtta

SEQ ID NO: 216368 - DNA, 75 bp, Artificial Sequence
  Synthetic
ttacgcggccacccagaaagaagtgaaagaggtcaaaggctacactaaaggtggaagaggccatgaggaaccagt

SEQ ID NO: 216369 - DNA, 75 bp, Artificial Sequence
  Synthetic
gatgacccagagttacggatggaacatcgtgcaactcaaaagcggggtggatgtgttctatagggagactgaaag

SEQ ID NO: 216370 - DNA, 75 bp, Artificial Sequence
  Synthetic
ctgtgacgtggtgatgtgtgacattggggagtgtagtagctctcctgcggtagaggccgcacggaccatcaaagt

SEQ ID NO: 216371 - DNA, 75 bp, Artificial Sequence
  Synthetic
tttggaattggctgaacgctggctggggaggaacccgcaagcggattactgcttcaaggtcctatgcccttacat

SEQ ID NO: 216372 - DNA, 75 bp, Artificial Sequence
  Synthetic
gcctgaggtgattgaggtgctgagcaaactccaactgaaatacgggggctgtgtggtgagaaacccactctcacg

SEQ ID NO: 216373 - DNA, 75 bp, Artificial Sequence
  Synthetic
aaactcgacccacgagatgtattgggtttccggatttaaagggaatttggttgggaccatcaattctacatcaaa

SEQ ID NO: 216374 - DNA, 75 bp, Artificial Sequence
  Synthetic
tctcctcttgaaaaggatggaaatcaagtttgctgaaccaaggtatgaagaagacgtcaacctgggctgcggaac

SEQ ID NO: 216375 - DNA, 75 bp, Artificial Sequence
  Synthetic
tcgagcagtatgcatagcccccccgaaatttgactataagaaaattggagcacgagttgaaaagttgagggcaga

SEQ ID NO: 216376 - DNA, 75 bp, Artificial Sequence
  Synthetic
gcataaagccacctggcattatgacgctgaacacccatacaggacatgggcctaccatgggagctacgttgtgaa

SEQ ID NO: 216377 - DNA, 75 bp, Artificial Sequence
  Synthetic
accatcagggagcgcctcctctcaggtcaacagtgtcgtgaagctgctctcaaaaccctgggatgtcatatcaga

SEQ ID NO: 216378 - DNA, 75 bp, Artificial Sequence
  Synthetic
agtcactggaatgtcaatgacagacaccacaccatttgggcaacagagagtgttcaaagagaaggtggacacgaa

SEQ ID NO: 216379 - DNA, 75 bp, Artificial Sequence
  Synthetic
ggctccggaacctcccccgggcgccgaaatggcaacgaccatagtttcagaatggctgtggaagaaattggcaga

SEQ ID NO: 216380 - DNA, 75 bp, Artificial Sequence
  Synthetic
aaagaagaaacccaggatgtgcacaagagaagaattcatcaagaaagtcaggagtaacgcggctctagggccggt

SEQ ID NO: 216381 - DNA, 75 bp, Artificial Sequence
  Synthetic
gtttgaggaggaaaacaagtggaaggacgccgctgaagctgtccaggaccctgaattttggaatttggttgatga

SEQ ID NO: 216382 - DNA, 75 bp, Artificial Sequence
  Synthetic
tgagagaaagaggcatctagaaggcaagtgtgagacatgtgtgtacaacatgatgggaaaacgcgaaaagaaacg

SEQ ID NO: 216383 - DNA, 75 bp, Artificial Sequence
  Synthetic
tggcgaatttggaaaggcaaaaggtagtagagccatttggtacatgtggcttggggcccgatacttggaatttga

SEQ ID NO: 216384 - DNA, 75 bp, Artificial Sequence
  Synthetic
agccttcggcttcttgaatgaagatcattggatgggcagagagaattctggtggaggggttgaaggcctagggat

SEQ ID NO: 216385 - DNA, 75 bp, Artificial Sequence
  Synthetic
tcaaaaactaggatatgtgatgcaggaaattggcaacaagggaggcattatttatgctgatgacaccgccggctg

SEQ ID NO: 216386 - DNA, 75 bp, Artificial Sequence
  Synthetic
ggacaccagaatcactgagaatgacctgagaaatgaaagccacataatggagtacatggacagtgatcacaaaaa

SEQ ID NO: 216387 - DNA, 75 bp, Artificial Sequence
  Synthetic
attggccaaagcggtctttgaactcacctacaaacacaaggtggtcaaagtaatgagaccaggcaaaggagtcac

SEQ ID NO: 216388 - DNA, 75 bp, Artificial Sequence
  Synthetic
tctgatggacatcatttcaagagaagaccaaagaggcagcggacaggtggtgacatatgctttaaacacgttcac

SEQ ID NO: 216389 - DNA, 75 bp, Artificial Sequence
  Synthetic
caacttggttgtgcagctgattaggatggcagaagctgaaggtatactaacggccgaggacctggatgagctgtc

SEQ ID NO: 216390 - DNA, 75 bp, Artificial Sequence
  Synthetic
aaatgaagtgaaactgcgtctaaacaagtggctgaaagaagtaggctgggaaaggcttcagaggatggccgtcag

SEQ ID NO: 216391 - DNA, 75 bp, Artificial Sequence
  Synthetic
cggggacgactgcgccgtggccgctctggacgaaagattcgctctagccctgcactttttgaatgcactctcaaa

SEQ ID NO: 216392 - DNA, 75 bp, Artificial Sequence
  Synthetic
gattaggaaggacatcagagagtgggcgccttcaagaggatggaagaattgggaggaagtgccgttctgttctca

SEQ ID NO: 216393 - DNA, 75 bp, Artificial Sequence
  Synthetic
ccacttccataaagtgaacatgaaagatgggagagaattggtggtgccatgtaggtctcaagacgaactggtggg

SEQ ID NO: 216394 - DNA, 75 bp, Artificial Sequence
  Synthetic
acgcgctagagtaactcaaggtcctggggaccttgctagttctgcttgtcttgcaaaggcttacgcgcaaatgtg

SEQ ID NO: 216395 - DNA, 75 bp, Artificial Sequence
  Synthetic
gcaactgctgtacttccatagaagagacctcaggctcatgggcaacgctatctgctcagccgttcctgtagattg

SEQ ID NO: 216396 - DNA, 75 bp, Artificial Sequence
  Synthetic
ggtgcccacagggcgcacgacctggtcaattcatggaagaggagagtggatgaccacggaggacatgctagaggt

SEQ ID NO: 216397 - DNA, 75 bp, Artificial Sequence
  Synthetic
ttggaacagagtgtggattgaggagaatgagtatatgacagacaagactcctgtcaccagttggactgacgtgcc

SEQ ID NO: 216398 - DNA, 75 bp, Artificial Sequence
  Synthetic
gtacctcggaaaaagagaggaccagtggtgcggatctctcatcggctatcggccaagatcgacatgggccgagaa

SEQ ID NO: 216399 - DNA, 75 bp, Artificial Sequence
  Synthetic
catcaaagtgcccgtgaatgtcatccgaatgaaggtgggtggcagtaagttccaggactacctgagcagccaaaa

SEQ ID NO: 216400 - DNA, 75 bp, Artificial Sequence
  Synthetic
gaggtacgatgtggaggaaagtgtcaagttcacaggggttctgtaagagggaatgatggtgaacatagatgatat

SEQ ID NO: 216401 - DNA, 75 bp, Artificial Sequence
  Synthetic
agtcaggcctgaataagccatctgatccggtgaagatgctgcctgcttccggctcagggtgacgccctgatgtag

SEQ ID NO: 216402 - DNA, 75 bp, Artificial Sequence
  Synthetic
tggaacaacagtcgatggagccaagcccggagggaatccggcccccgactaccggagactgccacgcctgtaaat

SEQ ID NO: 216403 - DNA, 75 bp, Artificial Sequence
  Synthetic
atgtaaataaagagtcagatccttacggccaccagcaagatgtaaatctggtgctatctgttgacatccccaggc

SEQ ID NO: 216404 - DNA, 75 bp, Artificial Sequence
  Synthetic
ggactgggttaacaaagccattagggaccatcgcggcccgaggggaagctagcgcgaactaccctaaaggactag

SEQ ID NO: 216405 - DNA, 75 bp, Artificial Sequence
  Synthetic
aggttagaggagaccccgcgattaggaaaaagaaatgagagcccaatccaggggaagctgtaaacctggaggaag

SEQ ID NO: 216406 - DNA, 75 bp, Artificial Sequence
  Synthetic
agaccccgcgattaggaaaaagaaatgagagcccaatccaggggaagctgtaaacctggaggaaggactagtggt

SEQ ID NO: 216407 - DNA, 75 bp, Artificial Sequence
  Synthetic
taggtgattacataacacagtgtgaacaagttttttgaacagcaatgaccaaaaaaccaggaaagcccggtagaa

SEQ ID NO: 216408 - DNA, 75 bp, Artificial Sequence
  Synthetic
atcgggctgtcaatatgctaaagcgcggcgcatcccgcgcgcttggtccaatgatcaagcttaagaggatgtttg

SEQ ID NO: 216409 - DNA, 75 bp, Artificial Sequence
  Synthetic
caggcctgctggatggtagaggaccgctcagaatggttttggctattctggcgttcttcagatttacagcattaa

SEQ ID NO: 216410 - DNA, 75 bp, Artificial Sequence
  Synthetic
aaccaacagcaggactgctaaaaagatggggaatgatggacaaagttcatgccctatctctcctaagaggattca

SEQ ID NO: 216411 - DNA, 75 bp, Artificial Sequence
  Synthetic
agaaggacttggcttccatgactgacatagtgcaccgacgcaagaagaggagtggcgtgaccatgatttggctga

SEQ ID NO: 216412 - DNA, 75 bp, Artificial Sequence
  Synthetic
tgcttgttgtttcagttacagcagctgtcagaatcactcaggagaatggcatgcctctaatgaagatacaaaaga

SEQ ID NO: 216413 - DNA, 75 bp, Artificial Sequence
  Synthetic
ctgacgtcggaaaggtcatcacgatgcgcactgagcaaggtgagaacagatgcatagtgcaagcaatggatgtag

SEQ ID NO: 216414 - DNA, 75 bp, Artificial Sequence
  Synthetic
gtgaggattgcgaggacacaatgacatacctttgtccagcgattgaaaacccttcagatccagatgacattgact

SEQ ID NO: 216415 - DNA, 75 bp, Artificial Sequence
  Synthetic
gctggtgtgacagaacagatgccatggtcacctacgggagatgttcaaagacccgacactctaggaggtcgcgcc

SEQ ID NO: 216416 - DNA, 75 bp, Artificial Sequence
  Synthetic
gctcgacaaacatagctggacacgctgactcacgcctggaaagtagaggggcagtatggatggacaccaagaagg

SEQ ID NO: 216417 - DNA, 75 bp, Artificial Sequence
  Synthetic
ctacgacgtatttgaccaaagcagaaagttgggctctccgcaacccagggtatgctctagtggcagccattttag

SEQ ID NO: 216418 - DNA, 75 bp, Artificial Sequence
  Synthetic
gctggagcttgggaacctcgaaagctcaaaaggtgatcttcacaatcatgatcttgctgatcgctccagcttaca

SEQ ID NO: 216419 - DNA, 75 bp, Artificial Sequence
  Synthetic
gcatcagatgtgtgggagttgaaaacagagacttcattgaaggagtgtcaggaggaacgtgggtggatgtagtgt

SEQ ID NO: 216420 - DNA, 75 bp, Artificial Sequence
  Synthetic
tggagcacagaggttgtgtgacaatcatggccccagacaaaccaacaattgatctggaactcacctccaccacgg

SEQ ID NO: 216421 - DNA, 75 bp, Artificial Sequence
  Synthetic
ccaagtcaatggcagtgaccaggacatactgtgtgcaggctcaaatatcagaactgtcagtggaaacgcgatgcc

SEQ ID NO: 216422 - DNA, 75 bp, Artificial Sequence
  Synthetic
caacgatgggcgaagcgcacaaccctaagtcgggagacgctgcctacgtctgcaagaagggaatcagcgacagag

SEQ ID NO: 216423 - DNA, 75 bp, Artificial Sequence
  Synthetic
gctggggcaacggctgtggactttttgggaagggtagcatggaaacatgcgccaagttctcatgccagaccaagg

SEQ ID NO: 216424 - DNA, 75 bp, Artificial Sequence
  Synthetic
cagaaggaaggatcatacaaagggaaaacctagagtataccatccacatgaatgttcatgcttcccaggagactg

SEQ ID NO: 216425 - DNA, 75 bp, Artificial Sequence
  Synthetic
accactttatgaatgacaccatcgccagtgagaacaaacatggagcaaaaatatccattaccaccacaggcccat

SEQ ID NO: 216426 - DNA, 75 bp, Artificial Sequence
  Synthetic
cgagaacagcggacctaggtgattatggaatggtgaccatggattgtgaaccaagagctggacttgactttgaca

SEQ ID NO: 216427 - DNA, 75 bp, Artificial Sequence
  Synthetic
acttgtacttgctcacccttgggaaaaacagctggctagtcaatagagactggtttcacgatgtgaatctcccgt

SEQ ID NO: 216428 - DNA, 75 bp, Artificial Sequence
  Synthetic
ggacaggaggggctgaaggtcattggagaaacagggaagccctggtggagtttggggaagcccatgccacgaagc

SEQ ID NO: 216429 - DNA, 75 bp, Artificial Sequence
  Synthetic
aggaagtgctggctctgggctcgcaggaaggaaccttgcaagttgccttggctggtgccatgatagcaaagtatg

SEQ ID NO: 216430 - DNA, 75 bp, Artificial Sequence
  Synthetic
attctgacacggccaccatgaacagcggtcacctcaagtgccgcttgaagctggacaaattgaagataaaaggga

SEQ ID NO: 216431 - DNA, 75 bp, Artificial Sequence
  Synthetic
ccacgtatcacatgtgtaagggctctttcgccttcacgaaaacaccctctgatacggggcatggcactgtcttgc

SEQ ID NO: 216432 - DNA, 75 bp, Artificial Sequence
  Synthetic
tcgaactgacctactcgggaacagacggaccctgcagagtacccatatcaatgtctttgagcttgagcaacgtcg

SEQ ID NO: 216433 - DNA, 75 bp, Artificial Sequence
  Synthetic
aacctgttggcagaatggtgactgtgaaccccatagtgacctcgtcctctacccagaagacgatcatgattgagg

SEQ ID NO: 216434 - DNA, 75 bp, Artificial Sequence
  Synthetic
tggaaccaccatttggagattctttcatcattgctggcacaggtgagccaagagtgcattaccactggaggaaat

SEQ ID NO: 216435 - DNA, 75 bp, Artificial Sequence
  Synthetic
ctggaagcagcattggggcagcattcgccactacggtgaaaggagcccgtcgtcttgctgtgattggtgatgacg

SEQ ID NO: 216436 - DNA, 75 bp, Artificial Sequence
  Synthetic
catgggactttggttcagtaggaggaatattcaattcagtaggaaaagccctgcaccaaatatttggaggaatgt

SEQ ID NO: 216437 - DNA, 75 bp, Artificial Sequence
  Synthetic
ttaggaccttgtttgggggaatgtcctggttcactcaaatcatgattggagccctgtgttgttggctggggatca

SEQ ID NO: 216438 - DNA, 75 bp, Artificial Sequence
  Synthetic
atgcacgggataagtctatcgccatgacgtttttggcagtggggggtgtactcattttcctagccacttctgtga

SEQ ID NO: 216439 - DNA, 75 bp, Artificial Sequence
  Synthetic
acgcggattcaggttgcgcccttgatctgaagcgaaaggaattcaagtgcgggaatggcatcttcgtgttcaatg

SEQ ID NO: 216440 - DNA, 75 bp, Artificial Sequence
  Synthetic
acgcagaggcatggtcacacacttacaaataccaccctagcacgcctaaaaaactggctggttcggtgatcaaag

SEQ ID NO: 216441 - DNA, 75 bp, Artificial Sequence
  Synthetic
ctttcgaggaaggacaatgtggagtcagatcagtgagcaggctggaacatgagatgtggaaagcaaatgccaaag

SEQ ID NO: 216442 - DNA, 75 bp, Artificial Sequence
  Synthetic
agttgaatgccatccttcttgaaaacgaaaagaacttgagtgtggtagttttggaaagtgactattaccggaagg

SEQ ID NO: 216443 - DNA, 75 bp, Artificial Sequence
  Synthetic
ctaaaaacctaatgcctataggggaagaattggcattcggctggaaaagctggggcaaaaaattttttgaggaac

SEQ ID NO: 216444 - DNA, 75 bp, Artificial Sequence
  Synthetic
caccactacaaaacaaaacattcctcgtagatggcaagacggggaaagaatgtccagaagagaaacgatcttgga

SEQ ID NO: 216445 - DNA, 75 bp, Artificial Sequence
  Synthetic
acaatttccagattgaagactttggcttcggagtgttcaccacttcagtttggatggagcaacgcactgaataca

SEQ ID NO: 216446 - DNA, 75 bp, Artificial Sequence
  Synthetic
cagaggagtgtgaccaaaaagttataggagctgctgttaagggggaggtagctgctcatagtgacctagggtact

SEQ ID NO: 216447 - DNA, 75 bp, Artificial Sequence
  Synthetic
ggattgaaagcaagtcaaaaaatggtagttgggaacttgagcatgcctacttcctggaagtaaagtcctgcagct

SEQ ID NO: 216448 - DNA, 75 bp, Artificial Sequence
  Synthetic
ggcccgcaacgcacacactctggaatggaggggttgaggaatcggagttgatcatacccaagagtagagcagggc

SEQ ID NO: 216449 - DNA, 75 bp, Artificial Sequence
  Synthetic
cagtgtcacatcacaacaccagaaaaggctaccagaaccaaataaaaggaccgtggcatcttactccattggaaa

SEQ ID NO: 216450 - DNA, 75 bp, Artificial Sequence
  Synthetic
tcaagtttgaaaattgcccaggaacaactgtgacagtcaccgaggaatgtgggaacagaggaccgtcgctgagaa

SEQ ID NO: 216451 - DNA, 75 bp, Artificial Sequence
  Synthetic
caaccacctcaagcgggaaaattgtttcagaatggtgttgcagatcatgcacgatgcccccgctgagctttaggg

SEQ ID NO: 216452 - DNA, 75 bp, Artificial Sequence
  Synthetic
ctccagatggatgttggtacggaatggaaataaggcccatgaaagaacgggaagagaccatggtgaagagctatg

SEQ ID NO: 216453 - DNA, 75 bp, Artificial Sequence
  Synthetic
taagcgctggaagaggcgatggtctcgacaacctatctttaggtttgttagtgctgacgatagctcttcaggaag

SEQ ID NO: 216454 - DNA, 75 bp, Artificial Sequence
  Synthetic
tgatgcgcaaaagaatccttgggcgtcacatcatttggatgacaacagtcgtgttccttgcgatgattctgggtg

SEQ ID NO: 216455 - DNA, 75 bp, Artificial Sequence
  Synthetic
gccttagctacagtgatttggggagatatctagtgctggttggagccgcttttgccgaacagaactccggagggg

SEQ ID NO: 216456 - DNA, 75 bp, Artificial Sequence
  Synthetic
atttgttacacctggtgctagtagccacgttcaaggtgagaccaatggcactcttggggttcatgttggggggga

SEQ ID NO: 216457 - DNA, 75 bp, Artificial Sequence
  Synthetic
agtggtgtcggagacaatcacttcttctttccataggtgccgtcctggttaatttcgctcttgaattccaagggg

SEQ ID NO: 216458 - DNA, 75 bp, Artificial Sequence
  Synthetic
ggtactttgaactagtagactccttagccttagccctgttgttcgtcaaggccgtggttcaaactgacacgacat

SEQ ID NO: 216459 - DNA, 75 bp, Artificial Sequence
  Synthetic
cagtgtcgctcccattgttggcagctctggcaccggctggctgttacactgttcttgggacacataggttcatca

SEQ ID NO: 216460 - DNA, 75 bp, Artificial Sequence
  Synthetic
tgctcactctgatcctggtaacatttctagggtgcaaaaagaccgcctctgtgaagaaggctggcacggctgcgg

SEQ ID NO: 216461 - DNA, 75 bp, Artificial Sequence
  Synthetic
taggcgcagttctaggtatggctggaatgaaagccgttcctatgctggggttgctgatgatcacaggaaaggcaa

SEQ ID NO: 216462 - DNA, 75 bp, Artificial Sequence
  Synthetic
agagaagttggcctctacatgaagccatggctgccgtcggcatcctatgtgccttgttcggagctttggcagaga

SEQ ID NO: 216463 - DNA, 75 bp, Artificial Sequence
  Synthetic
ccgaggttgatctagcagggcctctagcagcagcaggactcatcatcatggcttatgtgatctcaggcagaagca

SEQ ID NO: 216464 - DNA, 75 bp, Artificial Sequence
  Synthetic
acgacctgagcataaagaaagttgaggaaataaggtggagtgatgaggctgaggtcacaggggaaagtgtgagtt

SEQ ID NO: 216465 - DNA, 75 bp, Artificial Sequence
  Synthetic
accacgtcagcttggatgaacagggagacttcacattgactgaggacacgggacccgggttggagaaagtgctat

SEQ ID NO: 216466 - DNA, 75 bp, Artificial Sequence
  Synthetic
taaagattggattgatggcagttagtggaatctacccagtagccattccctttgcactgggagcctggttcttcc

SEQ ID NO: 216467 - DNA, 75 bp, Artificial Sequence
  Synthetic
tggaaaagagatgcaagcgtgctggagctctctgggatgttccttctccacgcgaggcaaaacccacaaaggttg

SEQ ID NO: 216468 - DNA, 75 bp, Artificial Sequence
  Synthetic
aagatggtgtataccgcatcttctccaggaaactgtttggtgaaagccagattggagccggggttatggtaaagg

SEQ ID NO: 216469 - DNA, 75 bp, Artificial Sequence
  Synthetic
gcacattccacaccatgtggcacgtcacaagaggggctgttttaaaagctggtgagggattgctggaaccgactt

SEQ ID NO: 216470 - DNA, 75 bp, Artificial Sequence
  Synthetic
gggctgatgttaggaaagaccttatatgctatggaggaagttggaaattggaagaacattgggacgggagtgaag

SEQ ID NO: 216471 - DNA, 75 bp, Artificial Sequence
  Synthetic
atgtccaactcatagctcttgaaccagggaaaaaggtgcgacacatccagacaaaacccggaacatttaagacct

SEQ ID NO: 216472 - DNA, 75 bp, Artificial Sequence
  Synthetic
gtgacggggaaattggagccctagacctcgactgtgcggctggaacttctggctccccgattgtcaacaagaatg

SEQ ID NO: 216473 - DNA, 75 bp, Artificial Sequence
  Synthetic
gggaaattgttggactgtatgggaatggagtgctcatcaagggtgaccggtacgtgagtgccatatcccagaagg

SEQ ID NO: 216474 - DNA, 75 bp, Artificial Sequence
  Synthetic
aaaataccgagcaggaggaaggcacagacatcgaggagacttggttcagaaagagagagttaacagtgcttgatc

SEQ ID NO: 216475 - DNA, 75 bp, Artificial Sequence
  Synthetic
tacacccaggagcggggaaaacgcgaagggtgctccctcaactggtacgagaggcggtgaaaaaacggctccgaa

SEQ ID NO: 216476 - DNA, 75 bp, Artificial Sequence
  Synthetic
cagtcattttagccccgacccgagtagtcgcttcagagatgtatgaagcattgaagggagaaccggtcagataca

SEQ ID NO: 216477 - DNA, 75 bp, Artificial Sequence
  Synthetic
tgacaccagcagtgcagagtgataggacaggcaatgaaataattgacctcatgtgccattcaacctttaccatga

SEQ ID NO: 216478 - DNA, 75 bp, Artificial Sequence
  Synthetic
agttacttcaaggagtcagggtgcccaactacaacttgtacatcatggatgaagcccactttcttgatccagcta

SEQ ID NO: 216479 - DNA, 75 bp, Artificial Sequence
  Synthetic
gcgtagcagctaggggatacatagagacacgggtgaacatgggagacgctggggccatctttatgacggccaccc

SEQ ID NO: 216480 - DNA, 75 bp, Artificial Sequence
  Synthetic
cgcctggaatgactgaggcttttcctccatcaaacgctccaattattgatgaagaaacaagaataccagacaaag

SEQ ID NO: 216481 - DNA, 75 bp, Artificial Sequence
  Synthetic
cttggagctcagggtatgaatggataactgattttgatggaagaacagtgtggttcgtccacagcataaagcaag

SEQ ID NO: 216482 - DNA, 75 bp, Artificial Sequence
  Synthetic
gggctgagattgggacgtgcctccagaaagcaggaaagaaagtgctgtatttgaacagaaagacttttgagagtg

SEQ ID NO: 216483 - DNA, 75 bp, Artificial Sequence
  Synthetic
aataccccaaatgcaaaaatgaaaaatgggattttgttttgacgacagacatctctgaaatgggagccaacttca

SEQ ID NO: 216484 - DNA, 75 bp, Artificial Sequence
  Synthetic
aagcagacagagtcattgaccccaggaagaccatcaaacccgttctgcttgacggaagagtcagcatgcagggac

SEQ ID NO: 216485 - DNA, 75 bp, Artificial Sequence
  Synthetic
caatagccataactcctgcatcggcagcccaaagaaggggaagagttggaaggaatcctgaaaaactaggggaca

SEQ ID NO: 216486 - DNA, 75 bp, Artificial Sequence
  Synthetic
tctacgcctacagtggaaatgtgagctcagacaatgaaggacatgtgagttggacagaagccaggatgctactgg

SEQ ID NO: 216487 - DNA, 75 bp, Artificial Sequence
  Synthetic
acaacgtgcacgtacaaggaggggtggttgcccagctgtactcgcccgaaagggagaagactgaagcatacgagg

SEQ ID NO: 216488 - DNA, 75 bp, Artificial Sequence
  Synthetic
gagagttcaagctgaaaacaaatcagcgcaagatcttttctgagctcatacgaaccggtgacctcccagtctggc

SEQ ID NO: 216489 - DNA, 75 bp, Artificial Sequence
  Synthetic
ttgcataccaagtggcttctgcaaacattgaataccatgacaggaggtggtgcttcgatggtcccaatgagcacc

SEQ ID NO: 216490 - DNA, 75 bp, Artificial Sequence
  Synthetic
tgctgctagaaaacaaccaggagatcgaggtgtggactaggcaggggcaaaggaaggtgctgaaaccacgttggc

SEQ ID NO: 216491 - DNA, 75 bp, Artificial Sequence
  Synthetic
tggatggcagaatcacctctgaccatctgaatctaaagagtttcaaggactttgcatccgggaaaaggtcggccc

SEQ ID NO: 216492 - DNA, 75 bp, Artificial Sequence
  Synthetic
tgagtgttcttgacctggtctcagtcctcccgagccacctcaacatgagactccaagaagccctggacactgctg

SEQ ID NO: 216493 - DNA, 75 bp, Artificial Sequence
  Synthetic
ccattctcagccgctcggagcccggaagcagaagctacaaagctgccttggaaaactcccctgaaatggtagaga

SEQ ID NO: 216494 - DNA, 75 bp, Artificial Sequence
  Synthetic
cctttctgctgtgcgcactggtttgcctgatgaccataggcttggtggtggtcttggtgagaggaaaaggacctg

SEQ ID NO: 216495 - DNA, 75 bp, Artificial Sequence
  Synthetic
ggaaacttgcttttggaatggtgtccattggtgtgatgacttggttgctgtggaccgcgggagtggatcccggga

SEQ ID NO: 216496 - DNA, 75 bp, Artificial Sequence
  Synthetic
agattgcggccgccgtgatcttggtctttctactgctagtggttctgattcctgaacctgaaaagcagaggtctg

SEQ ID NO: 216497 - DNA, 75 bp, Artificial Sequence
  Synthetic
tgcaggacaaccaattggccatgctcatgttgtttatagcaaccattttaggaggagtggcggcaaacgagatgg

SEQ ID NO: 216498 - DNA, 75 bp, Artificial Sequence
  Synthetic
gctggctggagaagaccaaggctgacctatcctgggtaatgaaagggagaactccagcgtctcctgtagcagtgg

SEQ ID NO: 216499 - DNA, 75 bp, Artificial Sequence
  Synthetic
agctggacatgaaacctgctacagcttggacgttgtacgcattagcgacgacgctccttactccactctttcaac

SEQ ID NO: 216500 - DNA, 75 bp, Artificial Sequence
  Synthetic
atctgatagtcaccaagtacgccaacatttccctaatggcaatagcctcgcaggcaggcgccctcttcagcatgg

SEQ ID NO: 216501 - DNA, 75 bp, Artificial Sequence
  Synthetic
acagtggcatccctttttcatccattgaattgagcgtgcctctattagcgcttggatgttggacccaaataacac

SEQ ID NO: 216502 - DNA, 75 bp, Artificial Sequence
  Synthetic
cctgcagcctgattctcgcatgcgtacttttattagtacactatgcagttttgcttccgggaatgcaggcccagg

SEQ ID NO: 216503 - DNA, 75 bp, Artificial Sequence
  Synthetic
ccgctcgggatgcccaaagaaggacagcagctggtataatgaaaaacgcagtggttgatgggattgttgcaacag

SEQ ID NO: 216504 - DNA, 75 bp, Artificial Sequence
  Synthetic
acataccacctcttgatggagccggccctttaactgagaagaaacttggccagctgctcttgttcgctgccgccg

SEQ ID NO: 216505 - DNA, 75 bp, Artificial Sequence
  Synthetic
tgactggggtagtgataaccagatctcctcgctcttggagtgaactaggagtgttgggctctgcggtcggctcta

SEQ ID NO: 216506 - DNA, 75 bp, Artificial Sequence
  Synthetic
ctctcgtcgaggggaatgcaggaaagttttggaatgctaccaccgctacagccatgtgcaacctcttcagaggaa

SEQ ID NO: 216507 - DNA, 75 bp, Artificial Sequence
  Synthetic
gctatcttgctggcatccctctgacttacacgatcattaggaatagcagctccagtaacaaaagaggaggagggg

SEQ ID NO: 216508 - DNA, 75 bp, Artificial Sequence
  Synthetic
ttggggagaccctgggtgagaaatggaaagcgagattgaaccaaatgagcacactggaatttcacagatacagga

SEQ ID NO: 216509 - DNA, 75 bp, Artificial Sequence
  Synthetic
gaagccacatcacggaagttgaccgagaaccagcgaaagcggctctcagggcaggagatttcactagaggggctg

SEQ ID NO: 216510 - DNA, 75 bp, Artificial Sequence
  Synthetic
ctgtctcaagaggaagtgccaagttgagatggatgcatgagcgaggatatgtcaaactgcatgacaaagtggtag

SEQ ID NO: 216511 - DNA, 75 bp, Artificial Sequence
  Synthetic
acctaggttgtggaagaggtggttggtgctactatgcggccacaataaaggaagtgaaagatgtcaaaggataca

SEQ ID NO: 216512 - DNA, 75 bp, Artificial Sequence
  Synthetic
caaaaggaggtagaggacatgaagagccagtaatgactcagagttatgggtggaatattgtgcagatgaagagcg

SEQ ID NO: 216513 - DNA, 75 bp, Artificial Sequence
  Synthetic
ggactgatgtcttttacaaggaagcagaagcttgtgacaccatcctttgtgacataggtgaatgcagtagctccc

SEQ ID NO: 216514 - DNA, 75 bp, Artificial Sequence
  Synthetic
cagctgtcgaggctgctcgtaccctgaaagtactagagcttgctgaaaggtggctggaaaggaatactggagccg

SEQ ID NO: 216515 - DNA, 75 bp, Artificial Sequence
  Synthetic
attactgcataaaggtgctttgcccatacatgcctgaagtggtagagaagctgagcaagttacagctcaaacacg

SEQ ID NO: 216516 - DNA, 75 bp, Artificial Sequence
  Synthetic
gtgggtgtctggtgaggaatccactttcaagaaactccacacatgagatgtactgggtgtctggatacagaggaa

SEQ ID NO: 216517 - DNA, 75 bp, Artificial Sequence
  Synthetic
acttgattggcgtgataaactcaacatcaacactactgttgaaaaggatggaaatcaagtttgctgagcccaggt

SEQ ID NO: 216518 - DNA, 75 bp, Artificial Sequence
  Synthetic
atgaagaagatgtgaacttgggttgtggcactagagctgtgagcatagcggcaccaaagtttgattacaagaaaa

SEQ ID NO: 216519 - DNA, 75 bp, Artificial Sequence
  Synthetic
tagggcagagagtggagaaactaagggctgaacaccaaagcacatggcattatgatcaggaacatccctacagaa

SEQ ID NO: 216520 - DNA, 75 bp, Artificial Sequence
  Synthetic
cttgggcttatcatggaagttacgtggtgaagccatcggggagtgcgtcctctcaagtcaatggccttgtcaagt

SEQ ID NO: 216521 - DNA, 75 bp, Artificial Sequence
  Synthetic
tactgtcgaaaccttgggatgtgatatctgaggtgacaggaatgtccatgactgatacgaccccttttggccagc

SEQ ID NO: 216522 - DNA, 75 bp, Artificial Sequence
  Synthetic
agagagtgttcaaggaaaaagtggacacaaaagcccccgaaccgccgccaggagctgaaatggcatcaatcatcg

SEQ ID NO: 216523 - DNA, 75 bp, Artificial Sequence
  Synthetic
tgtctgaatggttgtggaaacgtctgactagagaaaagaagccacgcttgtgcaccaaggaagaattcatcaaga

SEQ ID NO: 216524 - DNA, 75 bp, Artificial Sequence
  Synthetic
aggtcagaagcaacgctgcattgggccctgtgtttgaggaggaaaaccagtggaaagacgccgctgaggcagttc

SEQ ID NO: 216525 - DNA, 75 bp, Artificial Sequence
  Synthetic
aagacccagagttttggaacctagtggatgcagaacgcaagaaacatctggaagggaagtgtgagacctgcgtct

SEQ ID NO: 216526 - DNA, 75 bp, Artificial Sequence
  Synthetic
acaacatgatgggcaaacgtgagaagaagagaggggaatttgggaaagcaaaaggaagcagagccatttggtaca

SEQ ID NO: 216527 - DNA, 75 bp, Artificial Sequence
  Synthetic
tgtggctaggcgccagattccttgaatttgaagctctcgggttcttgaatgaagaccactggatgagtagagaaa

SEQ ID NO: 216528 - DNA, 75 bp, Artificial Sequence
  Synthetic
attcaggaggtggtgttgaaggcttggggatacagaaacttggctatgtcatgaaggaaattggagagaagggtg

SEQ ID NO: 216529 - DNA, 75 bp, Artificial Sequence
  Synthetic
gaattctttatgcagatgacacagctggatgggacacccgcatcacagaatgcgacctgagaaatgaagcacatg

SEQ ID NO: 216530 - DNA, 75 bp, Artificial Sequence
  Synthetic
ttatggagtacatggaagatgaacatcggaagctggcatacgctatttttgagctcacctacaggcacaaagttg

SEQ ID NO: 216531 - DNA, 75 bp, Artificial Sequence
  Synthetic
tcaaggttatgagaccaggaaagggggtgactctcatggacgtcatctcacgagaggatcagagagggagtggcc

SEQ ID NO: 216532 - DNA, 75 bp, Artificial Sequence
  Synthetic
aggtcgtgacctatgctttgaataccttcacaaatttggtgatgcaactaatcagaatggcggaagcagaaggcg

SEQ ID NO: 216533 - DNA, 75 bp, Artificial Sequence
  Synthetic
tgctcacccccgaagacctacaagaaatgtctcacgcagcaaaactaaggctccagaagtggttgaaggaagaag

SEQ ID NO: 216534 - DNA, 75 bp, Artificial Sequence
  Synthetic
gatgggaaagactcacaaggatggctgtcagcggggatgactgtgttgtatcagcccttgatgagagattcgctg

SEQ ID NO: 216535 - DNA, 75 bp, Artificial Sequence
  Synthetic
cggcattgatattcctaaatgccatgtcaaagatcagaaaggacattaaagaatgggtgccatccaagggctgga

SEQ ID NO: 216536 - DNA, 75 bp, Artificial Sequence
  Synthetic
agaactgggaagaggtccccttctgctcccaccattttcacaaacttcagatgaaagatgggagagaactggtag

SEQ ID NO: 216537 - DNA, 75 bp, Artificial Sequence
  Synthetic
tgccatgccgctcgcaggatgaactgattggaagagccagggtcacacaaggcccaggggacctcatgagttccg

SEQ ID NO: 216538 - DNA, 75 bp, Artificial Sequence
  Synthetic
cctgcctagccaaagcttatgcacaaatgtggcagctgttgtacttccataggagggacctgagactgatgggga

SEQ ID NO: 216539 - DNA, 75 bp, Artificial Sequence
  Synthetic
atgccatatgctcagctgttccagttgactgggttccaaccggaaggacgacgtggtccatccatggaaaaggag

SEQ ID NO: 216540 - DNA, 75 bp, Artificial Sequence
  Synthetic
aatggatgacctctgaggacatgctagacgtgtggaacagagtatggatagaggacaatgagcacatgaaggaca

SEQ ID NO: 216541 - DNA, 75 bp, Artificial Sequence
  Synthetic
aaaccccagtgcgggagtggactgacgttccgtacctagggaaaagagaagatcaatggtgcgggtcgctcattg

SEQ ID NO: 216542 - DNA, 75 bp, Artificial Sequence
  Synthetic
gataccggccccgctcaacctgggctgaaaacatcaaggtgccggtgaatgtgatccgagtgaaaattgggggga

SEQ ID NO: 216543 - DNA, 75 bp, Artificial Sequence
  Synthetic
acaaatatcaagattacctaggtacacaaaagaggtacgatgctgagaagagggtggtgttcagtggtgttttgt

SEQ ID NO: 216544 - DNA, 75 bp, Artificial Sequence
  Synthetic
aaatgagagagtgaagaaggttcttgtggtttattagtcaggcctgaaaagccacctgatccggtgaaggtgctg

SEQ ID NO: 216545 - DNA, 75 bp, Artificial Sequence
  Synthetic
cctgcagccggcctagggtgatgccctagtgtcgtggagcaacaaccgatggagccaagcccggagggaatccgg

SEQ ID NO: 216546 - DNA, 75 bp, Artificial Sequence
  Synthetic
tccccgactaccggaggttgccacaccctgtaaatatgtaaatacaaagtcagatccgaaaggccaccagtttag

SEQ ID NO: 216547 - DNA, 75 bp, Artificial Sequence
  Synthetic
tgcagagctggtgctatctgtaagcactcccaggaggactgggttaacaaagccattagggaccatcacggcccg

SEQ ID NO: 216548 - DNA, 75 bp, Artificial Sequence
  Synthetic
cgagggagagaagagcgcgagctcccccaaaggactagaggttagaggagaccccgtgattaggaacagtgggag

SEQ ID NO: 216549 - DNA, 75 bp, Artificial Sequence
  Synthetic
agatgttcacctgtgtgaactaaccagacagatcgaagttaggtgattacataacacagtgtgaacaagtttttt

SEQ ID NO: 216550 - DNA, 75 bp, Artificial Sequence
  Synthetic
ataacacagtgtgaacaagttttttgaacagcaatgaccaaaaaaccaggaaggcccggtagaaatcgggccgtc

SEQ ID NO: 216551 - DNA, 75 bp, Artificial Sequence
  Synthetic
aatatgctaaagcgcggtgcgtcccgcgcgcttggtccaatgatcaagcttaagaggatgctttttggcctgctg

SEQ ID NO: 216552 - DNA, 75 bp, Artificial Sequence
  Synthetic
gatgggagggggccgctcaggatggtcttggccattctggcgttcttcagatttacagcattgaaaccaacggca

SEQ ID NO: 216553 - DNA, 75 bp, Artificial Sequence
  Synthetic
ggactattgaagaggtggggcatgatggacaaagtacatgccttgtctcttttgaaaggatttaagaaagatttg

SEQ ID NO: 216554 - DNA, 75 bp, Artificial Sequence
  Synthetic
gcttccatgaccgacttcgtgcaccttcccaaaaagaagagtggggtttccataattgggaggatgctggttttt

SEQ ID NO: 216555 - DNA, 75 bp, Artificial Sequence
  Synthetic
tcattcacagcagcggtcagagtcaccctagaaaacggcatgtctttgatgaaaattcaaaaggctgacgttgga

SEQ ID NO: 216556 - DNA, 75 bp, Artificial Sequence
  Synthetic
aaggtcatcaccatacgcactgaccgaggtgaaaacaggtgcatagtgcaagcaatggatgtgggcgaggattgt

SEQ ID NO: 216557 - DNA, 75 bp, Artificial Sequence
  Synthetic
gaggacacgatgaagtatctctgcccagccatcgaaaacccttcagaacctgatgacattgactgttggtgtgac

SEQ ID NO: 216558 - DNA, 75 bp, Artificial Sequence
  Synthetic
aaggcagacgccatggtgacctacgggagatgttcaaaaactcgacattctaggaggtcacggcgttcaacgaat

SEQ ID NO: 216559 - DNA, 75 bp, Artificial Sequence
  Synthetic
atagctggacacgccgattcaagattggacagcagaggttctgtgtggatggacaccaaaaaagccacaagctat

SEQ ID NO: 216560 - DNA, 75 bp, Artificial Sequence
  Synthetic
ctgacgaaagcagagagctgggcccttcgcaaccccggatacgctctggttgctgctgtattgggatggagcctt

SEQ ID NO: 216561 - DNA, 75 bp, Artificial Sequence
  Synthetic
ggaacctcaaacgcccagaaggtgatattcaccgtcatgattttattgattgccccggcctatagcatcagatgt

SEQ ID NO: 216562 - DNA, 75 bp, Artificial Sequence
  Synthetic
gtgggggttgagaatcgggacttcattgaaggggtgtccggaggaacttgggtggacgtggtcctggagcacggg

SEQ ID NO: 216563 - DNA, 75 bp, Artificial Sequence
  Synthetic
ggatgtgtgaccattatggccccagacaagcccacaatagatttggaactaacatcaacgatagccaaatcgatg

SEQ ID NO: 216564 - DNA, 75 bp, Artificial Sequence
  Synthetic
gcagtgactagaacttactgtgtgcaagctcaagtttcggaactgtccgtggaaactagatgtccaaccatgggc

SEQ ID NO: 216565 - DNA, 75 bp, Artificial Sequence
  Synthetic
gaagcgcacaattccaagtcaagcgacgctgcctacgtgtgcaagaaaggattcagtgacagaggctggggaaat

SEQ ID NO: 216566 - DNA, 75 bp, Artificial Sequence
  Synthetic
ggatgtgggctctttgggaaaggtagcatggagacatgtgcaaagttttcatgtcagaccaaagcggaagggagg

SEQ ID NO: 216567 - DNA, 75 bp, Artificial Sequence
  Synthetic
attattcaacgggagaacttggaatataccatccacatgaacgtccacgcctcacaggagaccggccatttcatg

SEQ ID NO: 216568 - DNA, 75 bp, Artificial Sequence
  Synthetic
aatgacactatcgccagtgagaacaagcacggagccaagatatccattacagccacgggcccttcacgaacggct

SEQ ID NO: 216569 - DNA, 75 bp, Artificial Sequence
  Synthetic
gatttaggggactacggcatggtgaccttggattgcgaaccaagagccgggcttgattttgacaatttgtaccta

SEQ ID NO: 216570 - DNA, 75 bp, Artificial Sequence
  Synthetic
cttacacttggaaggaacagctggcttgtcaatagagactggtttcacgatgtaaaccttccatggataggagga

SEQ ID NO: 216571 - DNA, 75 bp, Artificial Sequence
  Synthetic
gcagaaggtcattggaaaaacagagagtccttggtggagttcggaaaaacccatgccaccaagcgagaagtgcta

SEQ ID NO: 216572 - DNA, 75 bp, Artificial Sequence
  Synthetic
gccctaggttcacaagaagggacattgcaagtggctctagcgggcgccatgatagcgaaatttggttcaaatgtg

SEQ ID NO: 216573 - DNA, 75 bp, Artificial Sequence
  Synthetic
gcaactataaatagtggacatctaaagtgcaggctgaaattggacaaactcaaaataaaaggcaccacgtaccac

SEQ ID NO: 216574 - DNA, 75 bp, Artificial Sequence
  Synthetic
atgtgtaagggctcgtttgctttcacaaaaacgccttctgacacaggccacggcacggtgctgctagaattgact

SEQ ID NO: 216575 - DNA, 75 bp, Artificial Sequence
  Synthetic
tattctggatcagatgggccatgcagggtgcccatatcaatgtctgtgagcctgagcaacatagagcccgttggt

SEQ ID NO: 216576 - DNA, 75 bp, Artificial Sequence
  Synthetic
aggatggtaactgtaaaccccatagtgctatcctcttccccccagaaaacaatcatgatcgaagtggaaccacca

SEQ ID NO: 216577 - DNA, 75 bp, Artificial Sequence
  Synthetic
tttggagactccttcatcatcgctggaacaggcgaaccaagggcgcactaccactggaggaaatcaggaagcagc

SEQ ID NO: 216578 - DNA, 75 bp, Artificial Sequence
  Synthetic
attggggcagcgtttgctaccaccatcaagggagccaggcgacttgccgtgatcggtgatgacgcatgggacttc

SEQ ID NO: 216579 - DNA, 75 bp, Artificial Sequence
  Synthetic
ggctctgtgggaggaatattaaactcagttgggaaagctctacaccagatttttggaggaatgttcagaactctc

SEQ ID NO: 216580 - DNA, 75 bp, Artificial Sequence
  Synthetic
tttggaggcatgtcttggtttacccaaattatgattggggccttgtgctgttggctggggatcaacgcccgggac

SEQ ID NO: 216581 - DNA, 75 bp, Artificial Sequence
  Synthetic
agaaccatcgctgtcacattcttggcagtgggaggagtccttgtgtttctcgctacttctgtgaacgcggattcc

SEQ ID NO: 216582 - DNA, 75 bp, Artificial Sequence
  Synthetic
ggttgtgctcttgatctgaagagaaaggaattcaagtgtggaaatggaatatttgtgttcaatgacgcggaagca

SEQ ID NO: 216583 - DNA, 75 bp, Artificial Sequence
  Synthetic
tggtcccactcatatcgatatcatcccagtacacccaagaagttagccggctccatagttagagccattgaggaa

SEQ ID NO: 216584 - DNA, 75 bp, Artificial Sequence
  Synthetic
ggacaatgtggagtcagatcagttggcaggttggaacatgaaatgtggagagccaatgctagggagataaacgcc

SEQ ID NO: 216585 - DNA, 75 bp, Artificial Sequence
  Synthetic
atccttcttgagaatgaaaagaacctgagtgttgtcgtcttggaaagtgaatactacagaaaggccaagaacctg

SEQ ID NO: 216586 - DNA, 75 bp, Artificial Sequence
  Synthetic
atgcccataggcgacgaaatgccatttggatggaagagctggggaaaaaagttttttgaggaaccacaattgcaa

SEQ ID NO: 216587 - DNA, 75 bp, Artificial Sequence
  Synthetic
aaccaaacgtttgtggttgatggcagagtgggaaaggagtgccctgaagagaaaagatcatggaataatttcaga

SEQ ID NO: 216588 - DNA, 75 bp, Artificial Sequence
  Synthetic
atcgaggacttcgggtttggcgttttcactacatcagtgtggatggaacaacgcacagaatacactgaggactgt

SEQ ID NO: 216589 - DNA, 75 bp, Artificial Sequence
  Synthetic
gatcagaaagtgattggagccgcggtcaaaggagaattagccgctcatagtgatctaggctattggattgagagc

SEQ ID NO: 216590 - DNA, 75 bp, Artificial Sequence
  Synthetic
aggtcaaaaaacggtagctgggaacttgaacgtgcttatctactagaatcaaaatcatgcagctggcccgcgacc

SEQ ID NO: 216591 - DNA, 75 bp, Artificial Sequence
  Synthetic
cacacactttggaatggaggagtggaggaatcagagttgataatacccaagagtagagcaggcccagtgtcacac

SEQ ID NO: 216592 - DNA, 75 bp, Artificial Sequence
  Synthetic
cacaacaccagaaaaggctaccataaccaaattaaaggaccatggcaccttaccccattggagatcaggtttgaa

SEQ ID NO: 216593 - DNA, 75 bp, Artificial Sequence
  Synthetic
agttgcccaggaacgaccgttgtgactaccgaggaatgtgggaatagaggaccctctctaaggacaaccactaca

SEQ ID NO: 216594 - DNA, 75 bp, Artificial Sequence
  Synthetic
agcggaaaggtaatttcagagtggtgttgcaggtcatgcacaatgcccccattgagttttagaaccgccgatggt

SEQ ID NO: 216595 - DNA, 75 bp, Artificial Sequence
  Synthetic
tgctggtatgggatggaaattaggccattgaaagaacgagaagagaccatggtaaagagccacgtgagtgccggc

SEQ ID NO: 216596 - DNA, 75 bp, Artificial Sequence
  Synthetic
agaggggacggcgtcgacaacttatccttgggattgttggtgttgacgattgctctccaggaagtgatgcgcaag

SEQ ID NO: 216597 - DNA, 75 bp, Artificial Sequence
  Synthetic
agaatcttaggacgtcacataacctggatggtgatagctgtgttcatggcaatgattctagggggactcagttac

SEQ ID NO: 216598 - DNA, 75 bp, Artificial Sequence
  Synthetic
cgtgatttgggaaggtacttggttttggttggcgccgccttcgctgagcggaactcaggaggggacttgctccac

SEQ ID NO: 216599 - DNA, 75 bp, Artificial Sequence
  Synthetic
ttagtgctggtggctacattcaaagtcaaaccgatggccttactaggcttcgtgcttggggggaggtggtgtcgg

SEQ ID NO: 216600 - DNA, 75 bp, Artificial Sequence
  Synthetic
cgacagtcgctcctactctccattggcgcagtcctagtgaattttgcactggagttccagggaggatactttgag

SEQ ID NO: 216601 - DNA, 75 bp, Artificial Sequence
  Synthetic
ctagttgattcactcgcgctagctctattgtttgttaaggctgtggtccagactgacacgacttcggtatcgctc

SEQ ID NO: 216602 - DNA, 75 bp, Artificial Sequence
  Synthetic
ccgctgctggcagctcttgccccggctggatgctacacggttttggggacacaccggttcattatgctaaccttg

SEQ ID NO: 216603 - DNA, 75 bp, Artificial Sequence
  Synthetic
gttttggtgacattcctggggtgtaaaaagaccgcctctgtgaaaaaagccggaacggctgcggttggggtggtt

SEQ ID NO: 216604 - DNA, 75 bp, Artificial Sequence
  Synthetic
ctgggcatggttggaatgaaaacaattcccatgttgggaatgctgatggttaccagcagggcaagaagaagctgg

SEQ ID NO: 216605 - DNA, 75 bp, Artificial Sequence
  Synthetic
cctctccatgaggccatggctgcagttggcattctatgtgccctctttggagccctggcggaaactgaggttgac

SEQ ID NO: 216606 - DNA, 75 bp, Artificial Sequence
  Synthetic
ttggctggaccgttggccgcggctgggctcatcgtcatggcttatgttatctcaggcagaagcaatgatctgagt

SEQ ID NO: 216607 - DNA, 75 bp, Artificial Sequence
  Synthetic
atcaaaaaagttgaggatgtgaaatggagtgatgaagcagaagtcactggagagagtgtcagctaccacgtgagc

SEQ ID NO: 216608 - DNA, 75 bp, Artificial Sequence
  Synthetic
ctagatgttcgaggagacccaacattaacggaggactcaggacctggactggaaaaggtgctgctgaaggttgga

SEQ ID NO: 216609 - DNA, 75 bp, Artificial Sequence
  Synthetic
ttaatggcaattagcgggatttaccccgtggccattcccttcgccttgggagcttggttctttctagaaaagagg

SEQ ID NO: 216610 - DNA, 75 bp, Artificial Sequence
  Synthetic
tgcaagcgcgcgggagctctttgggacatcccttccccgcgggaagcaaagccagccaaggttgaggacggagtc

SEQ ID NO: 216611 - DNA, 75 bp, Artificial Sequence
  Synthetic
taccgcatcttttctaggaagctgtttggcgaaagccaaattggagcaggcgttatggtaaagggcactttccac

SEQ ID NO: 216612 - DNA, 75 bp, Artificial Sequence
  Synthetic
accatgtggcatgtcacgagaggagcagtattgaaagctggtgaaggccttttggaacctgcctgggctgatgtt

SEQ ID NO: 216613 - DNA, 75 bp, Artificial Sequence
  Synthetic
aggaaagatttaatatgttatggtggaaattggaaattggaggaacattgggatggaaatgaagaagtgcagctc

SEQ ID NO: 216614 - DNA, 75 bp, Artificial Sequence
  Synthetic
atagcccttgaaccggggaagaaagtaaggcacattcaaacgaaacctggaatcttcaaaaccagtgagggagaa

SEQ ID NO: 216615 - DNA, 75 bp, Artificial Sequence
  Synthetic
atcggggctctcgaccttgactgcatggctggaacttctgggtctccaatcgtgaacaagaacggggaagtggtt

SEQ ID NO: 216616 - DNA, 75 bp, Artificial Sequence
  Synthetic
ggactgtatggaaatggtgttctcattaaaggggatcgctacgtgagcgcgatatctcagaaggaaaacgtgggg

SEQ ID NO: 216617 - DNA, 75 bp, Artificial Sequence
  Synthetic
caggaagacggagcagagattgaggacaactggttcagaaaaagagagctgacggtccttgacttgcaccctgga

SEQ ID NO: 216618 - DNA, 75 bp, Artificial Sequence
  Synthetic
gcggggaaaacgcgaagagtgcttccccaactggtgcgggaggccgtgaagaaacggctccgaacagtgatcttg

SEQ ID NO: 216619 - DNA, 75 bp, Artificial Sequence
  Synthetic
gcccctacccgtgtggtggcttcagaaatgtatgaagccttaagaggagagcctattagatacatgactccagcg

SEQ ID NO: 216620 - DNA, 75 bp, Artificial Sequence
  Synthetic
gtgcagagtgagagaactggaaatgaaatagtcgatttcatgtgtcactcgactttcaccatgaaactgttccaa

SEQ ID NO: 216621 - DNA, 75 bp, Artificial Sequence
  Synthetic
ggagtcagagttcccaattacaatttgtacatcatggatgaagcccattttcttgatccggctagcgtggctgct

SEQ ID NO: 216622 - DNA, 75 bp, Artificial Sequence
  Synthetic
aggggatatatagaaacaagagtgagcatgggagatgctggagccattttcatgacagctacaccaccaggaacc

SEQ ID NO: 216623 - DNA, 75 bp, Artificial Sequence
  Synthetic
actgaggcttttcccccctctaattccccaatcatagatgaggaaacaagaataccagacaaagcctggaattca

SEQ ID NO: 216624 - DNA, 75 bp, Artificial Sequence
  Synthetic
gggtatgaatggataattgagtttgatggaagaacagtgtggttcgtgcatagcataaagcagggagctgagatc

SEQ ID NO: 216625 - DNA, 75 bp, Artificial Sequence
  Synthetic
ggaacatgcctccaaaaggcagggaaaaaggtgctctacttgaataggaagacctttgagagtgagtaccccaag

SEQ ID NO: 216626 - DNA, 75 bp, Artificial Sequence
  Synthetic
tgtaaaagtgagaaatgggattttgtaataacaactgacatatctgagatgggggcaaacttcaaagcggacaga

SEQ ID NO: 216627 - DNA, 75 bp, Artificial Sequence
  Synthetic
gtgatcgaccctagaaaaaccattaagcccatactgctggatggaagagtgagcatgcaaggtccaatagccatc

SEQ ID NO: 216628 - DNA, 75 bp, Artificial Sequence
  Synthetic
actcccgcttcagcggcacaaagaagaggaaggattggtagaaaccctgaaaagcttggagacatctatgcttac

SEQ ID NO: 216629 - DNA, 75 bp, Artificial Sequence
  Synthetic
agtggaaatgtgagctcagacaacgaaggacacgtgagctggacagaagctagaatgttgttggacaacgtccat

SEQ ID NO: 216630 - DNA, 75 bp, Artificial Sequence
  Synthetic
gttcaaggaggagtggtggcccaactgtatacgcctgaaagggaaaaaactgaagcgtatgaaggagagtttaaa

SEQ ID NO: 216631 - DNA, 75 bp, Artificial Sequence
  Synthetic
ttgaaaacaaaccaaagaaaagtcttctccgagctcatacggactggggacctcccagtgtggctggcgttccaa

SEQ ID NO: 216632 - DNA, 75 bp, Artificial Sequence
  Synthetic
gtggcctcagcaaatgtcgagtaccatgacagaaagtggtgcttcgacggaccaaacgaacacctgttattggaa

SEQ ID NO: 216633 - DNA, 75 bp, Artificial Sequence
  Synthetic
aacaaccaggaaatagaagtgtggactaggcaaggacaaaggagagtgttgaaaccacggtggttagacggtaga

SEQ ID NO: 216634 - DNA, 75 bp, Artificial Sequence
  Synthetic
attacttctgaccacttgaacttgaaaagctttaaggaatttgcatccgggaaaaggtcagccttgagcatcctt

SEQ ID NO: 216635 - DNA, 75 bp, Artificial Sequence
  Synthetic
gacttgattgcggtcctcccaagccacctcaatctgagacttcaagaggccctagacactgctgccattttgagc

SEQ ID NO: 216636 - DNA, 75 bp, Artificial Sequence
  Synthetic
cgctctgagccagggagtagaagttacaaagcagccttggagaattctcctgagatgatagaaacctttctgctg

SEQ ID NO: 216637 - DNA, 75 bp, Artificial Sequence
  Synthetic
tgtgctttggtatgcctaatgaccataggcctggtggtagttctggttagaggaaaaggaccagggaagttggcg

SEQ ID NO: 216638 - DNA, 75 bp, Artificial Sequence
  Synthetic
tttgggatggtttccatcggcgtgatgacctggctgttgtggtctgcaggagtcgacccagggaagatcgcagct

SEQ ID NO: 216639 - DNA, 75 bp, Artificial Sequence
  Synthetic
gccgttatcctggtctttctgctgctcgtggtgctgattcctgaacctgaaaagcagaggtctgtgcaggacaac

SEQ ID NO: 216640 - DNA, 75 bp, Artificial Sequence
  Synthetic
cagttagctatgctcatgttactcatagcgaccatcctaggaggggtggcagcaaatgaaatgggatggctggaa

SEQ ID NO: 216641 - DNA, 75 bp, Artificial Sequence
  Synthetic
aaaacaaaagcagatctgtcatgggttgtgagagggaggagctcgaccaccaccccggtggttgaattggacatg

SEQ ID NO: 216642 - DNA, 75 bp, Artificial Sequence
  Synthetic
aaacctgccactgcttggacactgtacgcgttggcaacaacgcttctcactcccctttttcagcatttgattgtc

SEQ ID NO: 216643 - DNA, 75 bp, Artificial Sequence
  Synthetic
actaaatatgccaatatttctttgatggctattgcttcacaagctggaaccctctttagcatggacagtggtatc

SEQ ID NO: 216644 - DNA, 75 bp, Artificial Sequence
  Synthetic
cccttctcctccattgagttgagtgtgcctttgctcgcccttgggtgctggacccagataacaccctgtagtctt

SEQ ID NO: 216645 - DNA, 75 bp, Artificial Sequence
  Synthetic
attctcgcatgcgtgctcttgtcaacgcactatgcgattttgctccccggcatgcaggcacaggcagctcgagat

SEQ ID NO: 216646 - DNA, 75 bp, Artificial Sequence
  Synthetic
gcccagagaaggacagcagccggcataatgaagaacgcagtggttgatggcatcgtggctacagacataccgccc

SEQ ID NO: 216647 - DNA, 75 bp, Artificial Sequence
  Synthetic
cttgatggagctggacccctgacagagaagaaactgggccagttactcttgttcgcagcggccgtcaccggggtg

SEQ ID NO: 216648 - DNA, 75 bp, Artificial Sequence
  Synthetic
gtcataacaagatcgccacgttcttggagcgagttgggtgtgttgggatcggcagttggctcgaccctcattgaa

SEQ ID NO: 216649 - DNA, 75 bp, Artificial Sequence
  Synthetic
ggtagtgctgggaagttctggaatgccaccaccgttacggccatgtgcaatctttttagagggagctatttggct

SEQ ID NO: 216650 - DNA, 75 bp, Artificial Sequence
  Synthetic
ggtgtgccactgacgtacacgattatccgaaacagcaatccaagcaacaagagaggtggtggcatcggagaaaca

SEQ ID NO: 216651 - DNA, 75 bp, Artificial Sequence
  Synthetic
ctaggagaaaaatggaaagcacggttaaaccagatgaataccttggaattccaccgatacagacggagccacatc

SEQ ID NO: 216652 - DNA, 75 bp, Artificial Sequence
  Synthetic
atggaagttgaccgagagccagcgagagctgccctcaagtcaggggactttactagaggagctgccgtatcaaga

SEQ ID NO: 216653 - DNA, 75 bp, Artificial Sequence
  Synthetic
gggagtgccaaattaaggtggatgcatgagcgaggatacatccgactgcatgataaagttgtggacctgggctgt

SEQ ID NO: 216654 - DNA, 75 bp, Artificial Sequence
  Synthetic
ggaagaggcggttggtgctactactcagcgacagtaaaagaagtgaaagaggtcaaaggatacacaaagggagga

SEQ ID NO: 216655 - DNA, 75 bp, Artificial Sequence
  Synthetic
agaggacatgaggagccagtgttgacacaaagttatggatggaacattgtgcagatgaaaagtggtgtggatgtc

SEQ ID NO: 216656 - DNA, 75 bp, Artificial Sequence
  Synthetic
ttctataaggaagcggaaccctgtgacgttgttctctgtgacataggtgaatgtagtagttccccggctgtagag

SEQ ID NO: 216657 - DNA, 75 bp, Artificial Sequence
  Synthetic
gctgaccgctccacaaaggtactggaattggcagagaggtggctagaaagaaatgatggggccgacttttgcatc

SEQ ID NO: 216658 - DNA, 75 bp, Artificial Sequence
  Synthetic
aaagtgctttgtccatacatgcctgaagtagtggaaaaattgagtaagttgcagctcaggtatggagggtgcttg

SEQ ID NO: 216659 - DNA, 75 bp, Artificial Sequence
  Synthetic
gtgagaaaccctctttccagaaactcgacacatgagatgtactgggtgtcagggtacaaaggaaacttgattggt

SEQ ID NO: 216660 - DNA, 75 bp, Artificial Sequence
  Synthetic
gtcataaactcgacatcagcactgctgttgaggaggatggagatcaagtttgctgaaccaagatatgaagaagat

SEQ ID NO: 216661 - DNA, 75 bp, Artificial Sequence
  Synthetic
gtcaacctcagctgtggtaccagggctgtcagcatagcgccaccaaagtttgactacaaaaagatagggcagaga

SEQ ID NO: 216662 - DNA, 75 bp, Artificial Sequence
  Synthetic
gtggaaagactaaaagccgagcatatgagtacatggcactatgattgtgaacacccttacaggacgtgggcatac

SEQ ID NO: 216663 - DNA, 75 bp, Artificial Sequence
  Synthetic
catggcagttatgtcgtgaagccttcaggaagcgcctcctcccaggtgaacggcgtggtcaagctgttgtcgaaa

SEQ ID NO: 216664 - DNA, 75 bp, Artificial Sequence
  Synthetic
ccatgggatgtgagctcagaagtcacgggaatgtccatgaccgacacaaccccctttggccaacagagagtgttc

SEQ ID NO: 216665 - DNA, 75 bp, Artificial Sequence
  Synthetic
aaggaaaaagttgacaccaaggcgcctgaacccccagcgggagctgaaatggcctccgttatagtttcagagtgg

SEQ ID NO: 216666 - DNA, 75 bp, Artificial Sequence
  Synthetic
ctatggaaacgcttgaacagagagaaaaaaccacgtctgtgcaccaaggaagagtttgtcaggaaagttaggggc

SEQ ID NO: 216667 - DNA, 75 bp, Artificial Sequence
  Synthetic
aatgcggcgctgggcccggtgtttgaagaagaaaaccagtggaaggacgctgcagaggctgttcaagacccggga

SEQ ID NO: 216668 - DNA, 75 bp, Artificial Sequence
  Synthetic
ttttggaacttggttgacatggagcggaaaaaccatctggaagggaagtgtgaaacatgtgtgtataacatgatg

SEQ ID NO: 216669 - DNA, 75 bp, Artificial Sequence
  Synthetic
ggcaaacgtgaaaagaagaggggagaattcggaaaagcaaaaggaagcagagcaatatggtatatgtggcttggt

SEQ ID NO: 216670 - DNA, 75 bp, Artificial Sequence
  Synthetic
gctaggtttcttgaattcgaagccttagggtttttgaacgaagaccattggatgagcagaggaaactcaggagga

SEQ ID NO: 216671 - DNA, 75 bp, Artificial Sequence
  Synthetic
ggagttgaaggactcggaatccagaaactggggtacgtcatgagagagatcggagaaaaaggggggatcctctat

SEQ ID NO: 216672 - DNA, 75 bp, Artificial Sequence
  Synthetic
acgcttaacagcaaaatcagagaagatatagacatccacaatgggatacgcaaaatgtaacacccctacaatgga

SEQ ID NO: 216673 - DNA, 75 bp, Artificial Sequence
  Synthetic
ttcagacaagattgtgtttaaagtccgcaatcaggtggtgtcagttaaaccagaaatcatttcagatcagtatga

SEQ ID NO: 216674 - DNA, 75 bp, Artificial Sequence
  Synthetic
gtataaataccctgcaatcacagatgggaaaaagcccggcattacactgggaagggctccagacttgaacacagc

SEQ ID NO: 216675 - DNA, 75 bp, Artificial Sequence
  Synthetic
atacaagtcaatattgtctggaatgaaggctgccaagttagaccctgacgatgtgtgttcttatttggctgcagc

SEQ ID NO: 216676 - DNA, 75 bp, Artificial Sequence
  Synthetic
catgcaacttttcgaaggcgtctgtccagaagattgggtgagctatgggatcattatagctaggaaaggagaaac

SEQ ID NO: 216677 - DNA, 75 bp, Artificial Sequence
  Synthetic
tataactccgaatactttgatagacataacaaggacaaatgtagagggtaattgggcccaagcaggtggtactga

SEQ ID NO: 216678 - DNA, 75 bp, Artificial Sequence
  Synthetic
tgtgattagggacccaacagttgcagaacatgcatcccttgtaggacttctgctgtgtctttatagacttagcaa

SEQ ID NO: 216679 - DNA, 75 bp, Artificial Sequence
  Synthetic
gatagtaggccaaaatactgccaattataagaccaatgtggcggacaggatggaacagattttcgagactgcccc

SEQ ID NO: 216680 - DNA, 75 bp, Artificial Sequence
  Synthetic
ttttgtgaagattgtagaacatcacactttgatgaccacacataaaatgtgtgcaaactggtgtacaatcccgaa

SEQ ID NO: 216681 - DNA, 75 bp, Artificial Sequence
  Synthetic
tttcagattcttggttggcacatacgacatgttttttgctcgaattgaacatctttactctgccctcagagtagg

SEQ ID NO: 216682 - DNA, 75 bp, Artificial Sequence
  Synthetic
tacagtggtgacggcttatgaagattgctcaggattggtatctttcacaggcttcatcaaacagattaatttgtc

SEQ ID NO: 216683 - DNA, 75 bp, Artificial Sequence
  Synthetic
cgcaagagatgcacttctttatttctttcacaaaaacttcgaggaggagatcaagaggatgttcgaaccaggtca

SEQ ID NO: 216684 - DNA, 75 bp, Artificial Sequence
  Synthetic
ggagactgcagttcctcactcatacttcatacatttcagagctctaggcctcagtgggaagtctccttactcatc

SEQ ID NO: 216685 - DNA, 75 bp, Artificial Sequence
  Synthetic
ttcatacatttcagagctctaggcctcagtgggaagtctccttactcatctaatgcagtaggtcacactttcaat

SEQ ID NO: 216686 - DNA, 75 bp, Artificial Sequence
  Synthetic
ctcatccattttattggatgttatatgggtcaaattagatctctaaatgccacagttattcagacgtgtgcgcca

SEQ ID NO: 216687 - DNA, 75 bp, Artificial Sequence
  Synthetic
tgggtcaaattagatctctaaatgccacagttattcagacgtgtgcgccacacgagatgtctgtcttaggaggat

SEQ ID NO: 216688 - DNA, 75 bp, Artificial Sequence
  Synthetic
atctaggtgaagagttcttcgggaaaggaactttcgaacgtagattctttagagatgagaaagaaatgcaagatt

SEQ ID NO: 216689 - DNA, 75 bp, Artificial Sequence
  Synthetic
atgcagaattagagggtgcaaaagtcgaggcttctcttgcagatgatgggactgttgattcagatgacgaggact

SEQ ID NO: 216690 - DNA, 75 bp, Artificial Sequence
  Synthetic
tcttttcaggagaaacaagaagtccagaagctgtttacagtcggataatgatgaacaatggtagattgaagaagt

SEQ ID NO: 216691 - DNA, 75 bp, Artificial Sequence
  Synthetic
cacatattagaaggtacgtttctgtgagctctaatcatcaggcgcgaccgaattcctttgctgagtttctcaaca

SEQ ID NO: 216692 - DNA, 75 bp, Artificial Sequence
  Synthetic
aggtgtactctgaaagttcataaccttgctgtttaaactcaaaaaatcactactggacatagatcattgtgattc

SEQ ID NO: 216693 - DNA, 75 bp, Artificial Sequence
  Synthetic
acagagataaagaaaaaaactcaacaccactccttaatcgatcttctcaaaatgagcaaggatcttgtacatccc

SEQ ID NO: 216694 - DNA, 75 bp, Artificial Sequence
  Synthetic
accactccttaatcgatcttctcaaaatgagcaaggatcttgtacatcccagcctgctcagatctggtttagtca

SEQ ID NO: 216695 - DNA, 75 bp, Artificial Sequence
  Synthetic
aaatagagatggctgatgagactgcagacctggtcaaccggaccattgcggacaatcaggctcatttacaaggag

SEQ ID NO: 216696 - DNA, 75 bp, Artificial Sequence
  Synthetic
agacctggtcaaccggaccattgcggacaatcaggctcatttacaaggagagccctttagtgttgactcattgcc

SEQ ID NO: 216697 - DNA, 75 bp, Artificial Sequence
  Synthetic
ggaagacatgagtaggatgaggattattgagacctcgggaagaatggaggtgatcgaggaaggagatgatgaatc

SEQ ID NO: 216698 - DNA, 75 bp, Artificial Sequence
  Synthetic
cagttcagaagaggaatactatatgcctcaaggacaagacctgatggttccttttcagagttttctagaagaggt

SEQ ID NO: 216699 - DNA, 75 bp, Artificial Sequence
  Synthetic
cctcaaggacaagacctgatggttccttttcagagttttctagaagaggtcggagctcaagtggtaaaaagaatg

SEQ ID NO: 216700 - DNA, 75 bp, Artificial Sequence
  Synthetic
aaatcaggggagggctttttcaaaatctggtccacagtgtccgaggatatcaaagggtatgtctcttccaacctc

SEQ ID NO: 216701 - DNA, 75 bp, Artificial Sequence
  Synthetic
caaagggtatgtctcttccaacctcatgagacctcgatccaaatcaacagagagcaagaatactcagactgaccc

SEQ ID NO: 216702 - DNA, 75 bp, Artificial Sequence
  Synthetic
tgtcatctcatccaaaccgacccaggaagtggtcctgaccaaaaaggatgaagcatcaggatctagaggtttagg

SEQ ID NO: 216703 - DNA, 75 bp, Artificial Sequence
  Synthetic
aggaaagggtccatccaaaaacactccaaagccaagctggatcactgacacagaggaagtcaatgacatagaggg

SEQ ID NO: 216704 - DNA, 75 bp, Artificial Sequence
  Synthetic
ggaagttgcccatcaggtggctgagagcttctcaaagaaatacaaattcccgtctcgatcctcaggcatcttcct

SEQ ID NO: 216705 - DNA, 75 bp, Artificial Sequence
  Synthetic
cgtctcgatcctcaggcatcttcctctggaactttgaacaactcaagatgaatttggatgatattgtgaaggcct

SEQ ID NO: 216706 - DNA, 75 bp, Artificial Sequence
  Synthetic
ccatgaatataccaggggtggacaaactagctgaaagaggggggaagctgccactaagatgtatcctggggttcg

SEQ ID NO: 216707 - DNA, 75 bp, Artificial Sequence
  Synthetic
tatctctggattcttcgaaaagattccgacttctagctgatgctgacaaagtggctaaactcatgcaggatgata

SEQ ID NO: 216708 - DNA, 75 bp, Artificial Sequence
  Synthetic
tcaacaactacatgaccagattggaggaaatagacaaaaactgaagaatccccaaaaatcagaacacagatgaca

SEQ ID NO: 216709 - DNA, 75 bp, Artificial Sequence
  Synthetic
ttcgtctagatgataatgaaaaaaacattcaacacccctaacaaaatgaattttctaagaaagatagttaagact

SEQ ID NO: 216710 - DNA, 75 bp, Artificial Sequence
  Synthetic
tgcaaggatgaagaggcccccaagtatgaagcagcctctgctcctccagatgatgatgacctctggatgccaccc

SEQ ID NO: 216711 - DNA, 75 bp, Artificial Sequence
  Synthetic
atgaagcagcctctgctcctccagatgatgatgacctctggatgccaccccctgaatatgtgcccttgactcaag

SEQ ID NO: 216712 - DNA, 75 bp, Artificial Sequence
  Synthetic
tcaaaggcaagggaagtgttaggaatttctgcataaatggagaggtcaaaatctgtagtccaaatggctattctt

SEQ ID NO: 216713 - DNA, 75 bp, Artificial Sequence
  Synthetic
tcaggatcctcagacatattctaaaatcgtttgacaatgtatactctgggaatcgaaggatgatcggactcgtca

SEQ ID NO: 216714 - DNA, 75 bp, Artificial Sequence
  Synthetic
atcgtttgacaatgtatactctgggaatcgaaggatgatcggactcgtcaagataataataggactggttttatc

SEQ ID NO: 216715 - DNA, 75 bp, Artificial Sequence
  Synthetic
tggatctccagtcccagagggtatgaactgggtttacaaactgcgcagaactctgatttttcagtgggccgagtc

SEQ ID NO: 216716 - DNA, 75 bp, Artificial Sequence
  Synthetic
ctctgatttttcagtgggccgagtctcatgggcctcttgaaggagaggaactagagtattctcaggagataacat

SEQ ID NO: 216717 - DNA, 75 bp, Artificial Sequence
  Synthetic
ctagagtattctcaggagataacatgggatgacgagtcagaatttgtaggcctccaaattagagtgagtgccaag

SEQ ID NO: 216718 - DNA, 75 bp, Artificial Sequence
  Synthetic
caatgccacattcagggacgattgtggtgtatcaacatgaactcgagggcttgccaactttggtcggatatggca

SEQ ID NO: 216719 - DNA, 75 bp, Artificial Sequence
  Synthetic
ctgagaactcagcaatcccaagaggatgagaacacttcacttttgctggagtaacttcacacctggtgaatttgt

SEQ ID NO: 216720 - DNA, 75 bp, Artificial Sequence
  Synthetic
atgtgactgttacctccacattgagtagatataatctgtgagcaatagaacaaatactgtaatggtgcctgcttt

SEQ ID NO: 216721 - DNA, 75 bp, Artificial Sequence
  Synthetic
cagcacaatgtctataacttgcacacttgtctatttctagattcaggtttgagcaaaatgtgaaaaaaactccga

SEQ ID NO: 216722 - DNA, 75 bp, Artificial Sequence
  Synthetic
gataagagtcaacagcactccctgtttgtcatcatgagttactcgatttcaacaccttttctgttcgctgtggct

SEQ ID NO: 216723 - DNA, 75 bp, Artificial Sequence
  Synthetic
gcaatttcagttgcagacttccccctttacacaattcccgagaagatcgactcctggacccctatagatatgatc

SEQ ID NO: 216724 - DNA, 75 bp, Artificial Sequence
  Synthetic
tttacacaattcccgagaagatcgactcctggacccctatagatatgatccatctgagttgtccaaacaaccttc

SEQ ID NO: 216725 - DNA, 75 bp, Artificial Sequence
  Synthetic
tgtcaggggatgacgggtgcagcacatccacatctttcagttacgtggagctcaaaacaggttatctgactcatc

SEQ ID NO: 216726 - DNA, 75 bp, Artificial Sequence
  Synthetic
agaaagtgtctgggttcacctgtaccggggtcatcaatgaggctgttacatacacaaactttgtaggttatgtga

SEQ ID NO: 216727 - DNA, 75 bp, Artificial Sequence
  Synthetic
caaccacatttaaaaggaagcatttcaagcccacggtctcagcttgtagagatgcatttcattggaagatctcag

SEQ ID NO: 216728 - DNA, 75 bp, Artificial Sequence
  Synthetic
gatgcatttcattggaagatctcaggggatcctagatatgaagagtctctgcatacaccttaccctgacagtagt

SEQ ID NO: 216729 - DNA, 75 bp, Artificial Sequence
  Synthetic
gggatcctagatatgaagagtctctgcatacaccttaccctgacagtagttggctaaggacggttactacaacaa

SEQ ID NO: 216730 - DNA, 75 bp, Artificial Sequence
  Synthetic
aggagtccttgctgataatctcccccagcattgtagagatggatatatatagtagaactcttcactctcctatgt

SEQ ID NO: 216731 - DNA, 75 bp, Artificial Sequence
  Synthetic
ttcccacaggaacttgttccagattttatccatcagttccatcctgcgctaccaatcacgactacaccttgtggt

SEQ ID NO: 216732 - DNA, 75 bp, Artificial Sequence
  Synthetic
ttatccatcagttccatcctgcgctaccaatcacgactacaccttgtggttgccagaagattctaacttaagtct

SEQ ID NO: 216733 - DNA, 75 bp, Artificial Sequence
  Synthetic
accaatcacgactacaccttgtggttgccagaagattctaacttaagtctcatctgtgacatattcattactagc

SEQ ID NO: 216734 - DNA, 75 bp, Artificial Sequence
  Synthetic
acaggtagaaaagcaatgaacggctccaagatgtgtgggttcacagatgagaggggtttttacaggacactgaga

SEQ ID NO: 216735 - DNA, 75 bp, Artificial Sequence
  Synthetic
ggggcctgtaaattgacgctctgcgggaaaccaggtctaagactatatgatggaacatgggtatcctttacacga

SEQ ID NO: 216736 - DNA, 75 bp, Artificial Sequence
  Synthetic
ccggaagttcatgtatggtgctctccaaatcaactagtcaatgtacataacaaccgtatcgatgagcttgaacat

SEQ ID NO: 216737 - DNA, 75 bp, Artificial Sequence
  Synthetic
ctgattgtggatgaccttatccaaaaaagagaagcatgtttagataccctggaaacaattctgatgtctaagtca

SEQ ID NO: 216738 - DNA, 75 bp, Artificial Sequence
  Synthetic
aaagagaagcatgtttagataccctggaaacaattctgatgtctaagtcaatcagtttcaggagactcagtcatt

SEQ ID NO: 216739 - DNA, 75 bp, Artificial Sequence
  Synthetic
ggaaacaattctgatgtctaagtcaatcagtttcaggagactcagtcatttcagaaagttggtacccggatatgg

SEQ ID NO: 216740 - DNA, 75 bp, Artificial Sequence
  Synthetic
aaaggcttacaccatattaaatgggagcttgatggagacaaatgtccactacagaagggtggacaattggactga

SEQ ID NO: 216741 - DNA, 75 bp, Artificial Sequence
  Synthetic
tatcttgccatcgaaaggatgtctgaaagtggggaacaaatgccttgatccccataaaggagtttatttcaatgg

SEQ ID NO: 216742 - DNA, 75 bp, Artificial Sequence
  Synthetic
tattattaagggtcctgatggtcatattttaatcccagagatgcagtcgggcatgctgaaacagcatatagatct

SEQ ID NO: 216743 - DNA, 75 bp, Artificial Sequence
  Synthetic
tctgaaggcagcggtttttcccctccgtcaccctcttatagatcagagttctgtgttcaaaaaagatggtgatgc

SEQ ID NO: 216744 - DNA, 75 bp, Artificial Sequence
  Synthetic
agatgattttgttgatgttcacatgccggatgtgaacaagttagtatcggacatagatctagggttccatcactg

SEQ ID NO: 216745 - DNA, 75 bp, Artificial Sequence
  Synthetic
gggtctgttcattctgataggagtgacagtattggcgtttctagttctgatatgtcttctttgtatctgttgtaa

SEQ ID NO: 216746 - DNA, 75 bp, Artificial Sequence
  Synthetic
acagtattggcgtttctagttctgatatgtcttctttgtatctgttgtaagagagtgaagagtggaaggtctact

SEQ ID NO: 216747 - DNA, 75 bp, Artificial Sequence
  Synthetic
agggataggacggacccgtcattagcattatcttcaatctctcaatcaaaaccgaaagtggtgtcatcttgggag

SEQ ID NO: 216748 - DNA, 75 bp, Artificial Sequence
  Synthetic
cattatcttcaatctctcaatcaaaaccgaaagtggtgtcatcttgggagtcttacaagggctcttcaaatgcct

SEQ ID NO: 216749 - DNA, 75 bp, Artificial Sequence
  Synthetic
accgaaagtggtgtcatcttgggagtcttacaagggctcttcaaatgcctaagagctcgctcttcggatgggtcg

SEQ ID NO: 216750 - DNA, 75 bp, Artificial Sequence
  Synthetic
gataggaagatgcaaccctatcagctgcctcctcatcttaaaacattccactatacggtttttcatttttttgag

SEQ ID NO: 216751 - DNA, 75 bp, Artificial Sequence
  Synthetic
gtaactgccaatttgactgtttgattgtccaagtgagatgtagattgtttgtcaagtagatttgtgtgtttgatt

SEQ ID NO: 216752 - DNA, 75 bp, Artificial Sequence
  Synthetic
atgtgtctagatttagatttatataaaacctcaatatctgttgtttctgatctgtgcagcgacaatcagaaatta

SEQ ID NO: 216753 - DNA, 75 bp, Artificial Sequence
  Synthetic
gacagagaaaagaatgtatctatgaattcagagactgaatcagctgtccaaaaggactcctactttagcctttaa

SEQ ID NO: 216754 - DNA, 75 bp, Artificial Sequence
  Synthetic
cactcagtggtgcatactttacaaataaagcaatcatgtagttcgtgcactccttttaatgtaatatagtcaaag

SEQ ID NO: 216755 - DNA, 75 bp, Artificial Sequence
  Synthetic
tccttttaatgtaatatagtcaaagggtgcacgtctgttaaagataaggatgatgtagaatataatgttttcttt

SEQ ID NO: 216756 - DNA, 75 bp, Artificial Sequence
  Synthetic
ggtgcacgtctgttaaagataaggatgatgtagaatataatgttttctttcttttgatgtgtcagtcttttattc

SEQ ID NO: 216757 - DNA, 75 bp, Artificial Sequence
  Synthetic
taatgttttgctcaaggtccatgtcaaataagttgtgtgaaaaaaacgtgaatttttctcactgatcacgtaaca

SEQ ID NO: 216758 - DNA, 75 bp, Artificial Sequence
  Synthetic
acagtcctcctaaatctgttaaaaacatgatagattctacagaggtgtatgatgatccaattgatcccgcagagc

SEQ ID NO: 216759 - DNA, 75 bp, Artificial Sequence
  Synthetic
cagaaagtgaatggaatggaaattcagtcatcccaaacattttgcgaaactcggattacaatttaaactctccct

SEQ ID NO: 216760 - DNA, 75 bp, Artificial Sequence
  Synthetic
tattagaggaccctactaatttaatgatacaatggctcttatcaggaaatcgaccacccagggtaacagtcacag

SEQ ID NO: 216761 - DNA, 75 bp, Artificial Sequence
  Synthetic
agaacattctaagatctcataagattctcaaaagtttcttcaaaaagatagacattgcttttgtcaaagtgggaa

SEQ ID NO: 216762 - DNA, 75 bp, Artificial Sequence
  Synthetic
gacattgcttttgtcaaagtgggaagttcaggagctcaagcaatgatggggacctgggtgttggggtctcacgct

SEQ ID NO: 216763 - DNA, 75 bp, Artificial Sequence
  Synthetic
gacctgggtgttggggtctcacgctgaatcttcaagaagtcgaaaatgtttgtctgaattatctgccttttatca

SEQ ID NO: 216764 - DNA, 75 bp, Artificial Sequence
  Synthetic
aaaatcgttacccattgagtccatactaaattataccctaatgaatagaggattgcaaaccccaagagaaggggt

SEQ ID NO: 216765 - DNA, 75 bp, Artificial Sequence
  Synthetic
gattgcaaaccccaagagaaggggttctggcgggcctgagtagagtcagttatgaccattcttttgggaggtact

SEQ ID NO: 216766 - DNA, 75 bp, Artificial Sequence
  Synthetic
tatgaccattcttttgggaggtacttgggaaacttatattcatcctatctactatttcacaccatcatcttatat

SEQ ID NO: 216767 - DNA, 75 bp, Artificial Sequence
  Synthetic
atgaatgctctagattgggaagaagaaaagacgattctggcactgtggaaagacatgacctctgtagacgtaaag

SEQ ID NO: 216768 - DNA, 75 bp, Artificial Sequence
  Synthetic
aatgacaaaatcacttttaaagaccctctatggggaaaatttttggttaccaaagaatttgtttattctcacact

SEQ ID NO: 216769 - DNA, 75 bp, Artificial Sequence
  Synthetic
agcaatactctttttgatcgaaattataccttaatgctaaaagacctgtttctatctcgattcaattctttgatg

SEQ ID NO: 216770 - DNA, 75 bp, Artificial Sequence
  Synthetic
tctatctcgattcaattctttgatgattctaatatccccccccgaacctagatactctgatgatttgattgccaa

SEQ ID NO: 216771 - DNA, 75 bp, Artificial Sequence
  Synthetic
attctaatatccccccccgaacctagatactctgatgatttgattgccaatttgtgtcatctttacatcgctggt

SEQ ID NO: 216772 - DNA, 75 bp, Artificial Sequence
  Synthetic
gacaagattatatccacatgtggaaactctggttatgacataatcaagatgctagaaccttatgttgtaaacctc

SEQ ID NO: 216773 - DNA, 75 bp, Artificial Sequence
  Synthetic
ttagtacaaaaagcagaaacatttcgacccttgatccattctttgggagagtttccagcgtttataaaggataag

SEQ ID NO: 216774 - DNA, 75 bp, Artificial Sequence
  Synthetic
accacccagttaattggaactttcggaccctgtgcatctcaatttttctcccaacttgaccaatttgaaaacatc

SEQ ID NO: 216775 - DNA, 75 bp, Artificial Sequence
  Synthetic
cacgatcttgtattcgtttatgggtgctatcgacactggggacatccttacattgattacagaaaaggtctgacc

SEQ ID NO: 216776 - DNA, 75 bp, Artificial Sequence
  Synthetic
aagttgtttgaccaagttcacatgaagaaaacaatagatatgaaatatcaagagtgcttagctagtgatttggcc

SEQ ID NO: 216777 - DNA, 75 bp, Artificial Sequence
  Synthetic
aaaaagattcttaggtggggatttgataagtattctaagtggtatctagatactagatctttacccagagatcac

SEQ ID NO: 216778 - DNA, 75 bp, Artificial Sequence
  Synthetic
cctttgacaccttatataactacacagacctggcctcctaaacacattgtagatctccttggtgattcttggcat

SEQ ID NO: 216779 - DNA, 75 bp, Artificial Sequence
  Synthetic
ttgttaccaataacccaaatctttgaaattccggaatcaatggatccgtctgaaatattggatgacaaatctcat

SEQ ID NO: 216780 - DNA, 75 bp, Artificial Sequence
  Synthetic
tgaaatattggatgacaaatctcattcccttacaaggacaaagctgacatattggctttccgaaaataggggcgg

SEQ ID NO: 216781 - DNA, 75 bp, Artificial Sequence
  Synthetic
gccagttccaagtgagaaagtcatcattactgccttatctaaacctcctgtcaatccgagagaatttttgaaggc

SEQ ID NO: 216782 - DNA, 75 bp, Artificial Sequence
  Synthetic
tatagatcaggggggcttacctgaggatgacttgatcattgggctcaaaccgaaagaacgagagctaaagataga

SEQ ID NO: 216783 - DNA, 75 bp, Artificial Sequence
  Synthetic
gatgacttgatcattgggctcaaaccgaaagaacgagagctaaagatagaaggacgtttttttgcactgatgtca

SEQ ID NO: 216784 - DNA, 75 bp, Artificial Sequence
  Synthetic
tggaatctcaggttgtatttcgttattactgagaaattgctagcaaatcatattcttcctctttttgatgccctg

SEQ ID NO: 216785 - DNA, 75 bp, Artificial Sequence
  Synthetic
acaatgacagataacctaaacaaggtttttaaaaagctgatagatagagttactggacaagggttgcgggattat

SEQ ID NO: 216786 - DNA, 75 bp, Artificial Sequence
  Synthetic
tcgagagttacttatgccttccatctagactatgaaaagtggaacaaccatcaaagacttgaatctacaaaagat

SEQ ID NO: 216787 - DNA, 75 bp, Artificial Sequence
  Synthetic
gtcttctctgttctggataaggccttcgggatgtctaaggtgttctccaggacacatgaattcttccagaggtca

SEQ ID NO: 216788 - DNA, 75 bp, Artificial Sequence
  Synthetic
tggatctattattcagacagatctgacctcatagggatctggagggaccaaatatattgtcttgacatgacagaa

SEQ ID NO: 216789 - DNA, 75 bp, Artificial Sequence
  Synthetic
aatatattgtcttgacatgacagaaggacctacatgctggaacggacaagatgggggattggaaggccttagaca

SEQ ID NO: 216790 - DNA, 75 bp, Artificial Sequence
  Synthetic
aaagggatggagtctggttagtcttctaatgatagagagagagtctcaaactcgaaatactcgaactaagatttt

SEQ ID NO: 216791 - DNA, 75 bp, Artificial Sequence
  Synthetic
ggcccagggtgataatcaggtattgtgccctacatatatgctctcatctggactcaacaatgagggactgatgta

SEQ ID NO: 216792 - DNA, 75 bp, Artificial Sequence
  Synthetic
cgagttggagagtatatcaaagaatgcaatgtcaatttatagagcaatcgaggaaggtgccttaaaacttggttt

SEQ ID NO: 216793 - DNA, 75 bp, Artificial Sequence
  Synthetic
gataataaagaaagaagagaccatgtgtagttttgacttccttatttatggaaagacccctttatttcgaggtaa

SEQ ID NO: 216794 - DNA, 75 bp, Artificial Sequence
  Synthetic
tgtagttttgacttccttatttatggaaagacccctttatttcgaggtaacattcttgtcccggaatcaaaaagg

SEQ ID NO: 216795 - DNA, 75 bp, Artificial Sequence
  Synthetic
tgggcaagggtctcttgcatatcaaatgatcagattgtaaatttagctaacatcatgtccactgtatctacgaat

SEQ ID NO: 216796 - DNA, 75 bp, Artificial Sequence
  Synthetic
catcatgtccactgtatctacgaatgctttaacagttgcacaacactcacagtctttagtcaaacctatgcgaga

SEQ ID NO: 216797 - DNA, 75 bp, Artificial Sequence
  Synthetic
gctttaacagttgcacaacactcacagtctttagtcaaacctatgcgagacttcctactaatgtcagttcaagca

SEQ ID NO: 216798 - DNA, 75 bp, Artificial Sequence
  Synthetic
atatatcattatctattgtttagccccatcctgaaagacagagtctacaaagttctaaattccaaaggagatgat

SEQ ID NO: 216799 - DNA, 75 bp, Artificial Sequence
  Synthetic
ttcctcttggcaatgtcaaggattatttatttggatccttctttaggaggggtttcaggcatgtcattagggagg

SEQ ID NO: 216800 - DNA, 75 bp, Artificial Sequence
  Synthetic
tttcatatcagacaattttctgatccagtgtctgagggcttagcgttttggaaagaaatatggtccagctcatcc

SEQ ID NO: 216801 - DNA, 75 bp, Artificial Sequence
  Synthetic
cagtgtctgagggcttagcgttttggaaagaaatatggtccagctcatccgagacttggattcatcatctttgtc

SEQ ID NO: 216802 - DNA, 75 bp, Artificial Sequence
  Synthetic
aagaggcagggaatcctgatctaggggatcgaagtttggagagttttaccagacttctggaggatccgactacct

SEQ ID NO: 216803 - DNA, 75 bp, Artificial Sequence
  Synthetic
taaatataagaggaggagcaagtcccaccatactgttgaaagaagctattagaaaggcactgtatgatgaagtag

SEQ ID NO: 216804 - DNA, 75 bp, Artificial Sequence
  Synthetic
acaaggtagaaaattctgaattcagagaggccataattctttctaagactcatagagacaattttattctgttct

SEQ ID NO: 216805 - DNA, 75 bp, Artificial Sequence
  Synthetic
tgagatcaatagaacctttatttccaagattcttaagtgagttgttcagctcttcctttttggggataccggaat

SEQ ID NO: 216806 - DNA, 75 bp, Artificial Sequence
  Synthetic
ctataataggcctaatccaaaactcaaggacagtgaggagacagttcaggaggagcttatcaaggaccctggaag

SEQ ID NO: 216807 - DNA, 75 bp, Artificial Sequence
  Synthetic
aaggacagtgaggagacagttcaggaggagcttatcaaggaccctggaagaatccttttaccattctgaaatcca

SEQ ID NO: 216808 - DNA, 75 bp, Artificial Sequence
  Synthetic
tggaattagtaggatgactcagactcctcaacggttaggaagagtatggtcatgttctgccgagagagcagatca

SEQ ID NO: 216809 - DNA, 75 bp, Artificial Sequence
  Synthetic
actgagagaaatctcttggggaagaaaagtagttggaacaacagtaccccatccatctgagatgttaatgttggt

SEQ ID NO: 216810 - DNA, 75 bp, Artificial Sequence
  Synthetic
aaagtagttggaacaacagtaccccatccatctgagatgttaatgttggtccccaagtcgtcagtatcttgtggt

SEQ ID NO: 216811 - DNA, 75 bp, Artificial Sequence
  Synthetic
atccatctgagatgttaatgttggtccccaagtcgtcagtatcttgtggttgtaacattagagaggcatataatc

SEQ ID NO: 216812 - DNA, 75 bp, Artificial Sequence
  Synthetic
cccggatttcagtatctgtgttgccttcttttgaccactctttcttctctagaggccctctcaaagggtatctgg

SEQ ID NO: 216813 - DNA, 75 bp, Artificial Sequence
  Synthetic
gatcatctacatccgtctccactcaactatttcatgcgtgggagaaagttacaaacgtccatgtggttaagagag

SEQ ID NO: 216814 - DNA, 75 bp, Artificial Sequence
  Synthetic
ccctatctcttaaagagtctatcaactggtttgtatcaagagattccaatttagcaaggacactcatcaaaaata

SEQ ID NO: 216815 - DNA, 75 bp, Artificial Sequence
  Synthetic
ttagcaaggacactcatcaaaaatattttgtccttgacaggtccttcgtttcctatcgaagaggctcctgttttt

SEQ ID NO: 216816 - DNA, 75 bp, Artificial Sequence
  Synthetic
aagagaaccggctccgcattgcacagatttaaatctgctagatatagtgaaggtggttactcttccgtatgtccc

SEQ ID NO: 216817 - DNA, 75 bp, Artificial Sequence
  Synthetic
aatttgttatcccatatttccgtcagcactgacacaatgtctgacttaacccaggatggaaccaattttgacttt

SEQ ID NO: 216818 - DNA, 75 bp, Artificial Sequence
  Synthetic
atgttccagcctctgatgctatatgcccaaacatggacttctgagctagttcagaaagataatcggctgaaagac

SEQ ID NO: 216819 - DNA, 75 bp, Artificial Sequence
  Synthetic
tcgacattccattggcacctaagatgtcccaaatgcattagacctatagaagaagtgtctttggaggccccccag

SEQ ID NO: 216820 - DNA, 75 bp, Artificial Sequence
  Synthetic
agcttcacattccctgatatatcaacaaggatatcaaggatggtttctggagcagtccctcaatttagaaaattg

SEQ ID NO: 216821 - DNA, 75 bp, Artificial Sequence
  Synthetic
ccagacattgagcttagacctggagacttaatgatgttaaccaacagtgaaagatcatatcacataggcacagcc

SEQ ID NO: 216822 - DNA, 75 bp, Artificial Sequence
  Synthetic
aagatcatatcacataggcacagcccaaggcttgttgtattctatattggtggcagttcatgatccgggatacaa

SEQ ID NO: 216823 - DNA, 75 bp, Artificial Sequence
  Synthetic
tgataactccttatttcctgttaatatttacggaaaggtctctccaaggagctacttgagagggttagcacgtgg

SEQ ID NO: 216824 - DNA, 75 bp, Artificial Sequence
  Synthetic
agttctgattgggtcgtctatctgtttcttaacaagaatgaccaacatcaatattaatcgaccacttgaattgat

SEQ ID NO: 216825 - DNA, 75 bp, Artificial Sequence
  Synthetic
atcaggggtaatatcatacatcttgctaaggttagacaatcatccatctctatatgtaatgttgaaagaaccaga

SEQ ID NO: 216826 - DNA, 75 bp, Artificial Sequence
  Synthetic
attaagatcagaaatcttttcaatccctcagaaaatacctgctgcatatcctacgactatggaagagggaaatag

SEQ ID NO: 216827 - DNA, 75 bp, Artificial Sequence
  Synthetic
cctcagaaaatacctgctgcatatcctacgactatggaagagggaaatagatctgtactctgctatcttcaacaa

SEQ ID NO: 216828 - DNA, 75 bp, Artificial Sequence
  Synthetic
gttttgaggtatgaaagagacagtatgtcttcctcaccagaaagtgagctcttatggattttctctgacttccga

SEQ ID NO: 216829 - DNA, 75 bp, Artificial Sequence
  Synthetic
agcacaaagatgacctatcttacattagtaacttaccaggctcatctctggttacaaaaagtggagaagaattta

SEQ ID NO: 216830 - DNA, 75 bp, Artificial Sequence
  Synthetic
tcgaagcagatgagggccaaactccgccagctcaactctttaatgcgtcaagtcttagggggccatggagaagac

SEQ ID NO: 216831 - DNA, 75 bp, Artificial Sequence
  Synthetic
aatgttgaatctgatgatgaaattcactctttgctaaaagaggccctacgaaggactagatgggtagaccaagaa

SEQ ID NO: 216832 - DNA, 75 bp, Artificial Sequence
  Synthetic
gttcgccatgcagctaagactatgaaacctgatgttaatcctgtccctcgtgtgtctagaaaagttgggtcatcc

SEQ ID NO: 216833 - DNA, 75 bp, Artificial Sequence
  Synthetic
gaatggatttgttctgcccaacaaatcgctatctccacctctcttaaccctgcttcggcatcagatatagattta

SEQ ID NO: 216834 - DNA, 75 bp, Artificial Sequence
  Synthetic
agatctctatctcgtcagttccaaaaccctcttatgtccgggctaagggttgttcagtgggcaacaggggcacat

SEQ ID NO: 216835 - DNA, 75 bp, Artificial Sequence
  Synthetic
tataaaatcaagcctatactgaatgacctagatatatgcccatgtttgtctctagtagttggagatggatctgga

SEQ ID NO: 216836 - DNA, 75 bp, Artificial Sequence
  Synthetic
gggatttctagagttgttttgagcatgtttccagactccaagcttgtctttaatagcttgctagaagtcaatgac

SEQ ID NO: 216837 - DNA, 75 bp, Artificial Sequence
  Synthetic
ttgatggcctcaggaactcacccattacctccatctgcacttgttagagggggagatgagatcacatcaagagta

SEQ ID NO: 216838 - DNA, 75 bp, Artificial Sequence
  Synthetic
atagactttgactcaatctgggagaagccctctgacttgagaaacccgctaacgtggaaatatttcagctctgta

SEQ ID NO: 216839 - DNA, 75 bp, Artificial Sequence
  Synthetic
caatccaaaataaagagtcagttcgatctaattgtgtgtgatgctgaagtcactgacatagattcagttaacaag

SEQ ID NO: 216840 - DNA, 75 bp, Artificial Sequence
  Synthetic
ataacactgttgttatcagactttgcaatgtccataagaggacctctgtacttaatatttaaaacgtatgggact

SEQ ID NO: 216841 - DNA, 75 bp, Artificial Sequence
  Synthetic
atgttagtaaaccctgattacaaggccatccatcacttgtcccgtgcattccccaatgtgacagggttcgttact

SEQ ID NO: 216842 - DNA, 75 bp, Artificial Sequence
  Synthetic
ccccaatgtgacagggttcgttactcaaatgacctcttcattctcctcagaaatttatttgagattctcaaagaa

SEQ ID NO: 216843 - DNA, 75 bp, Artificial Sequence
  Synthetic
aaatttatttgagattctcaaagaaaggccatttctttagggatcatgaactgctgacagcatcaacaattaggg

SEQ ID NO: 216844 - DNA, 75 bp, Artificial Sequence
  Synthetic
agatgagtctagtgttatttaattgcagcaatcccaagagtgagatgttaagggctaggtcacttaattatcaag

SEQ ID NO: 216845 - DNA, 75 bp, Artificial Sequence
  Synthetic
accttataagaggattccctgatgagattatttctaacccttataatgaaatgattataactctgattgatagtg

SEQ ID NO: 216846 - DNA, 75 bp, Artificial Sequence
  Synthetic
atgattataactctgattgatagtgaggtggagtctttcctagttcataagatggtggatgacctagaactgaag

SEQ ID NO: 216847 - DNA, 75 bp, Artificial Sequence
  Synthetic
gatggtggatgacctagaactgaagagaggctgttcatcaaagatggcaataatactagcgataactattttgtt

SEQ ID NO: 216848 - DNA, 75 bp, Artificial Sequence
  Synthetic
ctcgaatagggtttttaatgtgtcaaagtctcttaaggacaaaaagttttttcctccgtctgatcctaaattgct

SEQ ID NO: 216849 - DNA, 75 bp, Artificial Sequence
  Synthetic
ttcctccgtctgatcctaaattgctaagacatttcaacatttgctctagtactcttctgttcttgtccacaacaa

SEQ ID NO: 216850 - DNA, 75 bp, Artificial Sequence
  Synthetic
tgggagatctacccaactttactagactacatgagctttataatgccccggtaacatactatttcaagaaacaaa

SEQ ID NO: 216851 - DNA, 75 bp, Artificial Sequence
  Synthetic
caataagaggtaaaaagtatttatcatggagttggtctgacccaagccctatttttaagaaggttgcttgtaact

SEQ ID NO: 216852 - DNA, 75 bp, Artificial Sequence
  Synthetic
atttttaagaaggttgcttgtaactcgtctttgagtctctctgctcattggattagactgatttataagatagtg

SEQ ID NO: 216853 - DNA, 75 bp, Artificial Sequence
  Synthetic
cgtctttgagtctctctgctcattggattagactgatttataagatagtgaagaacacgaggctcaactgtagtc

SEQ ID NO: 216854 - DNA, 75 bp, Artificial Sequence
  Synthetic
ctaaagacttgataagagaagcagaggactgcttgagaaattataacagatggatcaacatgagagacattagat

SEQ ID NO: 216855 - DNA, 75 bp, Artificial Sequence
  Synthetic
ctcgaacctcagtgttagactattgttgtttatgatagttcaaacgacatctcttttaaaatccgccaaataagt

SEQ ID NO: 216856 - DNA, 75 bp, Artificial Sequence
  Synthetic
tgagtccttccaaagaaattatcttgaaaaaaactcttgtcaatttctgaccgtatcacaaagtgattgttttta

SEQ ID NO: 216857 - DNA, 75 bp, Artificial Sequence
  Synthetic
aaaaactcttgtcaatttctgaccgtatcacaaagtgattgtttttaatttttttattgtttttttgttaagcgt

SEQ ID NO: 216858 - DNA, 75 bp, Artificial Sequence
  Synthetic
ttcatacatttcagagctctaggcctaagtgggaagtctccttactcatcgaatgcagtaggtcacactttcaat

SEQ ID NO: 216859 - DNA, 75 bp, Artificial Sequence
  Synthetic
tgggtcaaattagatctctaaatgccacagttattcagacgtgtgcgccacatgagatgtctgttttaggaggat

SEQ ID NO: 216860 - DNA, 75 bp, Artificial Sequence
  Synthetic
aggtatattctgaaagttcataaccttgctgttcaaactcaaaagagcactgctgaacatagatcattgtgattc

SEQ ID NO: 216861 - DNA, 75 bp, Artificial Sequence
  Synthetic
ggacctggtcaaccggaccattgcggacaatcaggctcatttacaaggagagccttttagtgttgactcactgcc

SEQ ID NO: 216862 - DNA, 75 bp, Artificial Sequence
  Synthetic
cctcaaggacaagacctgatggttccttttcagagttttctagaggaggttggagctcaagtggtaaaaagaatg

SEQ ID NO: 216863 - DNA, 75 bp, Artificial Sequence
  Synthetic
tgtcatcccatccaaaccgacccaggaagtggtcttgaccaaaaaggatgaagcatcaggatctagaggtgtggg

SEQ ID NO: 216864 - DNA, 75 bp, Artificial Sequence
  Synthetic
atgaagcggcctctgctcctccagatgatgatgacctctggatgccaccccctgagtatgtgcccttgactcagg

SEQ ID NO: 216865 - DNA, 75 bp, Artificial Sequence
  Synthetic
atcgtttgacaatgtatactctgggaatagaaggatgatcggactcgtcaagataataataggactggtcttatc

SEQ ID NO: 216866 - DNA, 75 bp, Artificial Sequence
  Synthetic
ctagagtattctcaggagataacatgggatgatgagtcggaatttgtaggcctccaaattagagtgagtgccagg

SEQ ID NO: 216867 - DNA, 75 bp, Artificial Sequence
  Synthetic
tttacacaattcccgagaagatcgactcctggacgcctatagatatgatccatctgagttgtccaaataaccttt

SEQ ID NO: 216868 - DNA, 75 bp, Artificial Sequence
  Synthetic
gggatcctagatatgaagagtctctgcatacgccttaccctgacagtagttggttaagaacggtcaccacaacaa

SEQ ID NO: 216869 - DNA, 75 bp, Artificial Sequence
  Synthetic
accaatcacgattacaccttgtggttgccagaagattctaacttaagtctcatttgtgacatattcgttactagc

SEQ ID NO: 216870 - DNA, 75 bp, Artificial Sequence
  Synthetic
ccggaagttcatgtatggtgctccccgaatcaactagtcaatgtgcataataaccgtatcgatgagcttgagcat

SEQ ID NO: 216871 - DNA, 75 bp, Artificial Sequence
  Synthetic
ggaaacaattctgatgtctaagtcaattagtttcaggagactcagtcatttcagaaagttggtacctggatatgg

SEQ ID NO: 216872 - DNA, 75 bp, Artificial Sequence
  Synthetic
gggtctgttcattctgataggggtgacagtattggcgtttcttgttctgatatgtcttctttgtatttgttgtaa

SEQ ID NO: 216873 - DNA, 75 bp, Artificial Sequence
  Synthetic
acagtattggcgtttcttgttctgatatgtcttctttgtatttgttgtaagagagtgaagaggggaaggtctact

SEQ ID NO: 216874 - DNA, 75 bp, Artificial Sequence
  Synthetic
accgaaagtggtgtcatcttgggagtcttacaagggctcctcaaatgcctaagatctcgctcttcggataggtcg

SEQ ID NO: 216875 - DNA, 75 bp, Artificial Sequence
  Synthetic
ggtgcacgtctgttaaagataaggatgatgtagaatataatgttttctttcttttgatgtgttagtcctttattc

SEQ ID NO: 216876 - DNA, 75 bp, Artificial Sequence
  Synthetic
gacctgggtgttggggtctcacgccgagtcttcaagaagtcgaaaatgtttgtctgaattatctgccttctacca

SEQ ID NO: 216877 - DNA, 75 bp, Artificial Sequence
  Synthetic
tacgaccattcttttgggaggtacttggggaacttatattcatcctatctactatttcacaccatcatcttgtat

SEQ ID NO: 216878 - DNA, 75 bp, Artificial Sequence
  Synthetic
attctaatatccccccccgaacctagatactctgatgatttgattgccaatctgtgtcatctttacatcgcaggt

SEQ ID NO: 216879 - DNA, 75 bp, Artificial Sequence
  Synthetic
ttagtacaaaaggcagagacatttcgacccttgatccattctttgggagagtttccagcatttataaaggataaa

SEQ ID NO: 216880 - DNA, 75 bp, Artificial Sequence
  Synthetic
gcctgttccaagtgagaaagtcatcattactgccttatctaaacctcccgtcaatccgagagaatttttgaaggc

SEQ ID NO: 216881 - DNA, 75 bp, Artificial Sequence
  Synthetic
aatagatcagggggggttacctgaggatgacttgatcattgggctcaaaccgaaagaacgagaactaaagataga

SEQ ID NO: 216882 - DNA, 75 bp, Artificial Sequence
  Synthetic
gatgacttgatcattgggctcaaaccgaaagaacgagaactaaagatagaaggacgtttttttgcgctgatgtca

SEQ ID NO: 216883 - DNA, 75 bp, Artificial Sequence
  Synthetic
aaaaggatggagtctggtcagtcttctgatgatagagagagagtctcaaactagaaatactcgaactaagatttt

SEQ ID NO: 216884 - DNA, 75 bp, Artificial Sequence
  Synthetic
tgtagttttgacttccttatttatggaaagacccctttatttcgaggtaatattcttgtcccggagtcaaaaagg

SEQ ID NO: 216885 - DNA, 75 bp, Artificial Sequence
  Synthetic
gctttaacagttgcacaacactcacagtctttagttaaacctatgcgagacttcctgctaatgtcagtccaagca

SEQ ID NO: 216886 - DNA, 75 bp, Artificial Sequence
  Synthetic
tttcatatcagacaattttctgatccggtgtctgagggcttagctttttggaaagaaatatggtccagctcatcc

SEQ ID NO: 216887 - DNA, 75 bp, Artificial Sequence
  Synthetic
cggtgtctgagggcttagctttttggaaagaaatatggtccagctcatccgagacttggatccatcacctttgtc

SEQ ID NO: 216888 - DNA, 75 bp, Artificial Sequence
  Synthetic
aaggacagtgaggagacagttcaggaggagcttatcaaggaccttggaagaatctttttaccattctgaaatcca

SEQ ID NO: 216889 - DNA, 75 bp, Artificial Sequence
  Synthetic
atccatctgagatgttaatgttggtccccaagtcgtcagtatcttgtggttgtaacattagggagacatataatc

SEQ ID NO: 216890 - DNA, 75 bp, Artificial Sequence
  Synthetic
ttagcaaggacactcatcaaaaacattttgtccctgacaggtccttcgtttcctattgaggaggctcctgttttt

SEQ ID NO: 216891 - DNA, 75 bp, Artificial Sequence
  Synthetic
ccagacattgagctcagacctggagacttaatgactttaaccaacagtgaaaggtcatatcacataggcacagcc

SEQ ID NO: 216892 - DNA, 75 bp, Artificial Sequence
  Synthetic
aaggtcatatcacataggcacagcccaaggcttgttgtattctatcttggtggcagttcatgatccggggtacaa

SEQ ID NO: 216893 - DNA, 75 bp, Artificial Sequence
  Synthetic
cctcagaaaatacctgctgcatatcctaccactatggaagagggaaatagatctgtgctttgctatcttcaacag

SEQ ID NO: 216894 - DNA, 75 bp, Artificial Sequence
  Synthetic
agcataaagatgacctatcttacattagtaacttaccaggctcatctttggttacaaaaagtggaaaagaatttg

SEQ ID NO: 216895 - DNA, 75 bp, Artificial Sequence
  Synthetic
agatttatttgagattctcaaagaaaggccatttcttcagggatcatgaactgctgacggcatcaacaattaggg

SEQ ID NO: 216896 - DNA, 75 bp, Artificial Sequence
  Synthetic
gatggtggatgacctagaactgaagagaggcagttcatcaaagatggcaataatactagcaataactgttttgtt

SEQ ID NO: 216897 - DNA, 75 bp, Artificial Sequence
  Synthetic
catctttgagtctctctgctcattggattagactgatttataagatagtgaaaaccacgaggctcaactgtagtc

SEQ ID NO: 216898 - DNA, 75 bp, Artificial Sequence
  Synthetic
ctcgaacttcagtgttagactattgttgtttatgatagttcaaacaacacctcttttaaaatcctccaaataagt

SEQ ID NO: 216899 - DNA, 75 bp, Artificial Sequence
  Synthetic
tgagtccttccaaagaaattatcttgaaaaaaacttttgtcaatttctgaccgtatcacaaagtgattgtcttta

SEQ ID NO: 216900 - DNA, 75 bp, Artificial Sequence
  Synthetic
aaaaacttttgtcaatttctgaccgtatcacaaagtgattgtctttaatttttttattgtttttttgttaagcgt

SEQ ID NO: 216901 - DNA, 75 bp, Artificial Sequence
  Synthetic
acgcttaacaacaaaatcagagaagacatagacacctacaatgaggtaatcaaaatgtaacactactacaatgga

SEQ ID NO: 216902 - DNA, 75 bp, Artificial Sequence
  Synthetic
ttcagaaaggattgttttcagagttcataatcaggtagtgtcactcaaaccagagattatatcagatcaatatga

SEQ ID NO: 216903 - DNA, 75 bp, Artificial Sequence
  Synthetic
atataaatatccagctattacagatgggaaaaaaccaggcatcactttaggaagggctcctgatttgagcacagc

SEQ ID NO: 216904 - DNA, 75 bp, Artificial Sequence
  Synthetic
atacaagtctatattgtctggtatgaatgccgccaagttagattcagatgacgtttgctcctatctggctgcagc

SEQ ID NO: 216905 - DNA, 75 bp, Artificial Sequence
  Synthetic
tatgcaactctttgaaggggtctgtccagaggattggataagttacggaatacatatagcaacaaaaggagaaac

SEQ ID NO: 216906 - DNA, 75 bp, Artificial Sequence
  Synthetic
catcactccggatgttttgatagatgtgaccaggacaaacgtggaggggaattgggctcaagcaggaggaacaga

SEQ ID NO: 216907 - DNA, 75 bp, Artificial Sequence
  Synthetic
catgacaagagatcccacaattgctgaacatgcttctctagtaggacttttgctgtgtctatatcgtctgagcaa

SEQ ID NO: 216908 - DNA, 75 bp, Artificial Sequence
  Synthetic
aatagtgggtcagaacacagcaaattacaaaaccaatgtagcagacagaatggagcagattttcgagacagcccc

SEQ ID NO: 216909 - DNA, 75 bp, Artificial Sequence
  Synthetic
ctttgttaaagttgtagagcatcacactttgatgaccgtccacaaaatgtgtgcaaattggagcacaatccccaa

SEQ ID NO: 216910 - DNA, 75 bp, Artificial Sequence
  Synthetic
cttcagatttttggcagggacttacgacatgttttttgcaagggttgaacatctctactctgctcttagggttgg

SEQ ID NO: 216911 - DNA, 75 bp, Artificial Sequence
  Synthetic
cacagttgtaactgcttacgaggattgctccggactggtgtcttttacagggttcattaaacagatcaacctatc

SEQ ID NO: 216912 - DNA, 75 bp, Artificial Sequence
  Synthetic
tgcacgagacgcgctcttatatttctttcacaagaagtttgaagaagagattaaaagaatgtttgaacctggtca

SEQ ID NO: 216913 - DNA, 75 bp, Artificial Sequence
  Synthetic
agaaacagctgttcctcattcatatttcatacattttagggcattggggttgagtggaaagtctccttattcatc

SEQ ID NO: 216914 - DNA, 75 bp, Artificial Sequence
  Synthetic
caacgcagtgggtcatacattcaacctgattcacttcataggatgttatatgggtcagataagatcacttaatgc

SEQ ID NO: 216915 - DNA, 75 bp, Artificial Sequence
  Synthetic
gaccgtaattcagacttgtgcacctcatgagatgtcagtattgggggggtatcttggtgaagagttctttggaaa

SEQ ID NO: 216916 - DNA, 75 bp, Artificial Sequence
  Synthetic
ggggaccttcgaaagaagattcttccgagatgagaaagaaatgcaagattatgccgacttagaaggagcaagagt

SEQ ID NO: 216917 - DNA, 75 bp, Artificial Sequence
  Synthetic
agaggcatctttggcagatgacgggacggtagactctgatgatgaggacttcttctctggagagacaaggagccc

SEQ ID NO: 216918 - DNA, 75 bp, Artificial Sequence
  Synthetic
tgaagcagtctacagcagaatcatgatgaacaatggcagattgaagaaatctcacatacgcagatatgtttctgt

SEQ ID NO: 216919 - DNA, 75 bp, Artificial Sequence
  Synthetic
cagttcgaaccatcaggcccggccgaattcctttgcagaattcctcaacaaggtgtattcagagagctcataact

SEQ ID NO: 216920 - DNA, 75 bp, Artificial Sequence
  Synthetic
ctactgcttacgctccaagcgcaagcgcatcgaacggtacatattattgaaggaggatagaaaaaaactcaacat

SEQ ID NO: 216921 - DNA, 75 bp, Artificial Sequence
  Synthetic
ctctcctcaagtcatctctccaacatgagcaagggattaatacaccctagtgccatccgctcaggcttggtagat

SEQ ID NO: 216922 - DNA, 75 bp, Artificial Sequence
  Synthetic
ttggagatggctgaggaaactgtggacttggttcataaaaatcttgcagacagtcaagcacatttgcaaggggag

SEQ ID NO: 216923 - DNA, 75 bp, Artificial Sequence
  Synthetic
cccttaaatgtcgactccttgccggaagatatgaggaagatgaggttgacgaatgccccgagtgagagagaaatc

SEQ ID NO: 216924 - DNA, 75 bp, Artificial Sequence
  Synthetic
attgaagaagatgaagaggaatatagctctgaggatgaatactatctgtctcaggggcaagaccctatggttcca

SEQ ID NO: 216925 - DNA, 75 bp, Artificial Sequence
  Synthetic
ttccagaatttcctcgacgaacttgggacacaaatagtcaggaggacgaaatcaggagatggctttttcaaaatc

SEQ ID NO: 216926 - DNA, 75 bp, Artificial Sequence
  Synthetic
tggtccgcagcatcagaggatgtaaaagggtatgttctctccaccttcatgaagccagaaacacaggctacagtg

SEQ ID NO: 216927 - DNA, 75 bp, Artificial Sequence
  Synthetic
agcaaacaaacacagacagactcactatctgttccgagaccttcccaggggtacacttctgtcccgagggataag

SEQ ID NO: 216928 - DNA, 75 bp, Artificial Sequence
  Synthetic
ccatccaactctgagtcacaagggggagggatcaagcctaagaaagttcagaaatcagagtggactagagatact

SEQ ID NO: 216929 - DNA, 75 bp, Artificial Sequence
  Synthetic
gatgaaatcagtgatattgaaggagaagtcgcacatcaagttgctgagagtttttcaaagaaatataaattcccg

SEQ ID NO: 216930 - DNA, 75 bp, Artificial Sequence
  Synthetic
tctagatcatctgggattttcttgtggaacttcgaacaactcaaaatgaatctggatgacatagtcaaaacctca

SEQ ID NO: 216931 - DNA, 75 bp, Artificial Sequence
  Synthetic
atgaatgtccctggagtagacaaaattgcagagaaaggaggaaagctgccgctgaggtgcattttggggttcgtc

SEQ ID NO: 216932 - DNA, 75 bp, Artificial Sequence
  Synthetic
tctctagattcttctaagagatttcgcctccttgcggacactgacaaggtggccagactcatgcaggatgacatc

SEQ ID NO: 216933 - DNA, 75 bp, Artificial Sequence
  Synthetic
cacaactacatgactagaattgaggagatagatcacaattagaaaattctcaaaaatgagctgattccgatcaac

SEQ ID NO: 216934 - DNA, 75 bp, Artificial Sequence
  Synthetic
atgggtaaaatcttggaaaaaacatgcaacacccctagaaccatgaatttcctgaggaagatagtgaagaattgc

SEQ ID NO: 216935 - DNA, 75 bp, Artificial Sequence
  Synthetic
aaagatgaagagatcccaaagcccgggactccatcagctcctcctgatgatgatgacctttggatgcctccccca

SEQ ID NO: 216936 - DNA, 75 bp, Artificial Sequence
  Synthetic
gagtatgtgcctttgactcaaattaagggcaaagagaatgttagaaacttttgtataaatggagagatcaaaata

SEQ ID NO: 216937 - DNA, 75 bp, Artificial Sequence
  Synthetic
tgtagccccaatggttactcttttaggatccttagacatatattgaaatcttttgacaatgtttattctgggaat

SEQ ID NO: 216938 - DNA, 75 bp, Artificial Sequence
  Synthetic
agaagactgatcggggtagtcaaaatggtgatcggcctggttttatctggatctcctgtcccggagggcatgaat

SEQ ID NO: 216939 - DNA, 75 bp, Artificial Sequence
  Synthetic
tgggtttataaactccgtagaactttgatttttcaatgggcagagtcccatggtcctcttgagggagaagaacta

SEQ ID NO: 216940 - DNA, 75 bp, Artificial Sequence
  Synthetic
gaatactcccaagagattacatgggatgacgaggcagagtttgtaagcctacaaattagagtcagtgccaaacaa

SEQ ID NO: 216941 - DNA, 75 bp, Artificial Sequence
  Synthetic
tgccacatccaggggaggctgtggtgtatcaatatgaactctaaggcatgtcaactctgggcagatatgggccta

SEQ ID NO: 216942 - DNA, 75 bp, Artificial Sequence
  Synthetic
aaaacccagcaatctcaagaagatgagaacacttcacttctgttggaataatatagagctcagtgaacatgtctc

SEQ ID NO: 216943 - DNA, 75 bp, Artificial Sequence
  Synthetic
tatctgttacctctgttttgagtagatataatctgtgagcaatagaacaaatacagctatggtgcctgcttcaaa

SEQ ID NO: 216944 - DNA, 75 bp, Artificial Sequence
  Synthetic
tacaaaatctatgaatttcgcactcggtcatctttagaatcaggtctgagcaaaatgtgaaaaaaactttttaat

SEQ ID NO: 216945 - DNA, 75 bp, Artificial Sequence
  Synthetic
aagatttaacagccctccccacttgtcaccatgagtcaactaaatttgataccctttttctgtgtaattatagtc

SEQ ID NO: 216946 - DNA, 75 bp, Artificial Sequence
  Synthetic
ttgtctgtagaggactttcctctatatacaattcctgaaaagataggtccttggactccgatcgacctgatccat

SEQ ID NO: 216947 - DNA, 75 bp, Artificial Sequence
  Synthetic
ctgagctgtcctaataatttgcagtcagaggatgaaggatgtggtacctcatcagtcttcagttatgtagagctc

SEQ ID NO: 216948 - DNA, 75 bp, Artificial Sequence
  Synthetic
aagacaggttatctcactcatcagaaagtgtctgggttcacctgtacaggagtggttaatgaggctgtcacatac

SEQ ID NO: 216949 - DNA, 75 bp, Artificial Sequence
  Synthetic
actaactttgtcggatatgtgacaaccacctttaagcggaaacatttcaagccgacggcattggcttgcagagat

SEQ ID NO: 216950 - DNA, 75 bp, Artificial Sequence
  Synthetic
gcttatcattggaagatttctggggatccaaggtatgaggagtctctccacacaccatatcctgacaacagctgg

SEQ ID NO: 216951 - DNA, 75 bp, Artificial Sequence
  Synthetic
ttgaggacagttaccacaaccaaagaatctcttgtgataatctctccaagcattgtggagatggatgtatatagt

SEQ ID NO: 216952 - DNA, 75 bp, Artificial Sequence
  Synthetic
agaacacttcattctcccatgtttcccaccgggacctgttctaggttctatccgtcatccccttcttgtgccaca

SEQ ID NO: 216953 - DNA, 75 bp, Artificial Sequence
  Synthetic
aatcatgattacactttatggcttccagatgaccctaatctgagtttggcatgtgatatctttgtgaccagcaca

SEQ ID NO: 216954 - DNA, 75 bp, Artificial Sequence
  Synthetic
gggaaaaagtcaatgaatggctctagaatgtgtggatttacagacgagagagggtattaccggacaataaaagga

SEQ ID NO: 216955 - DNA, 75 bp, Artificial Sequence
  Synthetic
gcttgtaaactgacattatgtgggaaaccaggtttgaggttatttgatggcacatggatatccttcacccgcccg

SEQ ID NO: 216956 - DNA, 75 bp, Artificial Sequence
  Synthetic
gaagtcactacccggtgccttcctaatcagttagtcaatattcacaacaataggatagatgaagttgagcatctg

SEQ ID NO: 216957 - DNA, 75 bp, Artificial Sequence
  Synthetic
attgtagaagatctcattcgaaaaagagaagagtgtttggacactttagagacagttttaatgtccaaatcaatc

SEQ ID NO: 216958 - DNA, 75 bp, Artificial Sequence
  Synthetic
agttttagacgactaagtcacttcagaaaattagtgccaggatatgggaaggcttacactattttaaatgggagc

SEQ ID NO: 216959 - DNA, 75 bp, Artificial Sequence
  Synthetic
ttaatggaaactaacgttcattatttaaaggttgacaattggagtgaaatactgccttccaagggatgtttaaaa

SEQ ID NO: 216960 - DNA, 75 bp, Artificial Sequence
  Synthetic
ataaacaatcagtgtgttgctcattataagggggtcttctttaacgggatcatcaagggaccagatggtcatatt

SEQ ID NO: 216961 - DNA, 75 bp, Artificial Sequence
  Synthetic
ttaattccggagatgcagtcaagtttgttgaaacagcacatggacctcttgaaggcagcggtttttcccttgaga

SEQ ID NO: 216962 - DNA, 75 bp, Artificial Sequence
  Synthetic
catcctctgattgaaccgggctctttgttcaataaggatggtgatgccgatgaatttgttgatgtccacatgcct

SEQ ID NO: 216963 - DNA, 75 bp, Artificial Sequence
  Synthetic
gatgtacataagttggtatcagatgtcgacttggggctacccgattggagcctttatgcgttgataggggcaact

SEQ ID NO: 216964 - DNA, 75 bp, Artificial Sequence
  Synthetic
attatagctttctttatactgatatgtcttattcgtatctgctgcaagaagaggggtcggagaaactctcccaca

SEQ ID NO: 216965 - DNA, 75 bp, Artificial Sequence
  Synthetic
aatagacctgatcttcctatagggttgtctactacacctcaacccaagtctaaagtgatatcatcatgggaatct

SEQ ID NO: 216966 - DNA, 75 bp, Artificial Sequence
  Synthetic
tataagggtacctctaatgtctgatgctgccttcttggagggatctccagcagataacttacaacccaactaact

SEQ ID NO: 216967 - DNA, 75 bp, Artificial Sequence
  Synthetic
gcctcttcatttttgaacattccacgatacaatcatctcattgggtgatgggtcatgtcggctctaatcatctga

SEQ ID NO: 216968 - DNA, 75 bp, Artificial Sequence
  Synthetic
aacttatattttatttgaagctatttatcggcttgatgtaaatattaattcagatatctgaatgtcgtgtaatca

SEQ ID NO: 216969 - DNA, 75 bp, Artificial Sequence
  Synthetic
ggggtgtctttatttctcgcttttggacagtgatatgacaatcagcgggtgtgcagggtctaggacacatctaga

SEQ ID NO: 216970 - DNA, 75 bp, Artificial Sequence
  Synthetic
agactttgactagatgtgaccgtctcaaaacatatcttcactttagcctttacaattctgaggtgcaatattcta

SEQ ID NO: 216971 - DNA, 75 bp, Artificial Sequence
  Synthetic
caaatgaagcaattttacagtttttgtattcctcaaagtctaatcatccatggggagataaattattgtctgatc

SEQ ID NO: 216972 - DNA, 75 bp, Artificial Sequence
  Synthetic
taagaatagcacacaatgcgaaatccactctcccctcgttcccatctatcatgtgtttatttcagttgagtctgt

SEQ ID NO: 216973 - DNA, 75 bp, Artificial Sequence
  Synthetic
gtaacataattaacatgaaaaaaacgggttgttttgacaagtcaagtaccaacagccctcatttatatttcacaa

SEQ ID NO: 216974 - DNA, 75 bp, Artificial Sequence
  Synthetic
tcatgattgattcatctgaagtgtacgatgatcctatcgaccctgtagagccagaaaatgaatggaccgggaact

SEQ ID NO: 216975 - DNA, 75 bp, Artificial Sequence
  Synthetic
cgatcatcccaaatatattgagaaattcggattacaacttgaattctcccctgttggaagaccctactgacctaa

SEQ ID NO: 216976 - DNA, 75 bp, Artificial Sequence
  Synthetic
tgatgcaatggttgttgtccggaaatcgaccaaccagaatagctgtcacagaaaatatatcaagatctcataaag

SEQ ID NO: 216977 - DNA, 75 bp, Artificial Sequence
  Synthetic
ttcttaaaagttcctttaagaagattgatatcgccctcatcaaaatagggggggcaagtgctcaggcaatgatag

SEQ ID NO: 216978 - DNA, 75 bp, Artificial Sequence
  Synthetic
gaatttgggtactagggtctcatgcagaatcctctcgtagtcgaaagtgcttgtctgacttgtctgctttctacc

SEQ ID NO: 216979 - DNA, 75 bp, Artificial Sequence
  Synthetic
aaagatctttacccattgagtctattttgaattataccttactcaatagaggattgcaaacccccaaagagggag

SEQ ID NO: 216980 - DNA, 75 bp, Artificial Sequence
  Synthetic
ttttggcaggtttgagtcgaatcaactatgaccagtcttttggaagatatctcgggaatttgtattcttcttatc

SEQ ID NO: 216981 - DNA, 75 bp, Artificial Sequence
  Synthetic
tcttatttcatatcatcatcctttatatgaatgcactagattgggaggaagagaagacaattttggctttatgga

SEQ ID NO: 216982 - DNA, 75 bp, Artificial Sequence
  Synthetic
aggatatagcatctatagatgtgaaaagtgatagagtgtcgttcaaggaccccttatggggcaagctcttggtga

SEQ ID NO: 216983 - DNA, 75 bp, Artificial Sequence
  Synthetic
ccaaagagtttgtttactcttactcaggcaatagtttatttgacagaaattacacattgatgttaaaagatttgt

SEQ ID NO: 216984 - DNA, 75 bp, Artificial Sequence
  Synthetic
tcctctctcgatttaactctcttctaatacttatatctccccctgaatctagatactctgatgacttggttggaa

SEQ ID NO: 216985 - DNA, 75 bp, Artificial Sequence
  Synthetic
acttgtgtcgtttgtatatcacgggtgatcgtatcatatcaacatgtggaaactcagggtatgatataattaaaa

SEQ ID NO: 216986 - DNA, 75 bp, Artificial Sequence
  Synthetic
tgttagaaccttatgtggttgatttgttagtccgaaaagcagaaacctttcgtccactgattcactctttggggg

SEQ ID NO: 216987 - DNA, 75 bp, Artificial Sequence
  Synthetic
aattcccgaccttcatcaaggataaaacaacccaactgatcggaacatttggaccgtgtgctgcacagtttttct

SEQ ID NO: 216988 - DNA, 75 bp, Artificial Sequence
  Synthetic
cagttctgaatcagtttgagaacattcatgacctggtatttgtttatggctgctacaggcattggggacatcctt

SEQ ID NO: 216989 - DNA, 75 bp, Artificial Sequence
  Synthetic
atattgactacagaaaagggttaaccaagttgtttgaccaagttcacatgaagaagactattgacaagaaatatc

SEQ ID NO: 216990 - DNA, 75 bp, Artificial Sequence
  Synthetic
aagaatgtttggcaagtgatttagcaaaaaagattcttcgatggggatttgataaatattccaaatggtatctag

SEQ ID NO: 216991 - DNA, 75 bp, Artificial Sequence
  Synthetic
acacgaattcaatcccaaaagaccaccctttagccccttatatagctactcagacatggcctccaaagcatgtag

SEQ ID NO: 216992 - DNA, 75 bp, Artificial Sequence
  Synthetic
ttgatcttttaggtgattcttggcatatattgcctatgactcaaatatttgaaatacccgaatcaatggatccat

SEQ ID NO: 216993 - DNA, 75 bp, Artificial Sequence
  Synthetic
ctgaaatactagatgacaaatctcactcatttactcggactaaactcatttattggctatctgaaaacaaggggg

SEQ ID NO: 216994 - DNA, 75 bp, Artificial Sequence
  Synthetic
gacctgtgcctagtgagaaagttatcatcacagctctatcaaagcctccggtcaacccaagagagttcttaaaat

SEQ ID NO: 216995 - DNA, 75 bp, Artificial Sequence
  Synthetic
ctatagatctgggaggtctgaaagaggatgatctaattataggactcaaacccaaagagagagagttgaaaattg

SEQ ID NO: 216996 - DNA, 75 bp, Artificial Sequence
  Synthetic
aaggtcggttttttgccttgatgtcttggaatctccggctgtattttgttatcacagaaaagctattggcaaatc

SEQ ID NO: 216997 - DNA, 75 bp, Artificial Sequence
  Synthetic
atattcttcccttattcgatgccctcaccatgacggacaatttgaacaaagtgttcaagaaactgatagacagag

SEQ ID NO: 216998 - DNA, 75 bp, Artificial Sequence
  Synthetic
tgactgggcaagggttgagggattactcgagagtcacttatgctttccatctagattatgaaaaatggaataatc

SEQ ID NO: 216999 - DNA, 75 bp, Artificial Sequence
  Synthetic
atcagagactggaatccacgaaagacgttttctccgttctagacaaggcatttggtttgtctcatgttttttcta

SEQ ID NO: 217000 - DNA, 75 bp, Artificial Sequence
  Synthetic
gaacacatgagttcttccaaaaatcatggatttattactctgatagatcagatcttataggtatatggagagatc

SEQ ID NO: 217001 - DNA, 75 bp, Artificial Sequence
  Synthetic
aaatatattgtttggacatggctgccggtcctacatgttggaatggtcaagatggggggctggaaggtctacgac

SEQ ID NO: 217002 - DNA, 75 bp, Artificial Sequence
  Synthetic
aaaaggggtggagcctggttagtctccttatgatagaaagagaatctcaaacacgaaacactaggacaaagattt

SEQ ID NO: 217003 - DNA, 75 bp, Artificial Sequence
  Synthetic
tagcccagggagacaatcaagtgttatgtcccacttatatgctttcatctggcctcaacagtgaagggcttatgt

SEQ ID NO: 217004 - DNA, 75 bp, Artificial Sequence
  Synthetic
atgaattagagagcatctccaagaatgctatgtctatctacagggccatagaagagggtgcctcaaaactggggc

SEQ ID NO: 217005 - DNA, 75 bp, Artificial Sequence
  Synthetic
tgattataaagaaagaagaaactatgtgcagctttgatttcctaatttatgggaagactccattgtttcggggga

SEQ ID NO: 217006 - DNA, 75 bp, Artificial Sequence
  Synthetic
atatattggtgcctgaatcaaaaaggtgggctagggtttcttgcatatcaaatgaccagatcgtgaacctggcaa

SEQ ID NO: 217007 - DNA, 75 bp, Artificial Sequence
  Synthetic
acatcatgtctactgtgtccaccaatgctctaactgtggcccagcattcgcagtctctgatcaaacccatgaggg

SEQ ID NO: 217008 - DNA, 75 bp, Artificial Sequence
  Synthetic
atttccttctgatgtctgtccaagctatatatcattatttgttgttcagccctattttaaaggatcgagtatata

SEQ ID NO: 217009 - DNA, 75 bp, Artificial Sequence
  Synthetic
aggtgttaaactctaaaggagaggacttcctcttggcaatgtcgagaataatctatctagatccctctttagggg

SEQ ID NO: 217010 - DNA, 75 bp, Artificial Sequence
  Synthetic
gtgtatccggtatgtcattggggaggtttcatatcagacagttctctgatccagtgtctgaaggtttgacctttt

SEQ ID NO: 217011 - DNA, 75 bp, Artificial Sequence
  Synthetic
ggaaagaaatatggctcagttcgtctgaaacttggatccatcacctttgtcaggaagcaggaaacccagatttgg

SEQ ID NO: 217012 - DNA, 75 bp, Artificial Sequence
  Synthetic
gagacagaagcttagagagtttcacccgactgttagaggatcctactacacttaacattagaggaggggctagcc

SEQ ID NO: 217013 - DNA, 75 bp, Artificial Sequence
  Synthetic
ctaccatcctattgaaagaagctattagaaaagctctttatgatgaagtggataaagttgagaattcggagtttc

SEQ ID NO: 217014 - DNA, 75 bp, Artificial Sequence
  Synthetic
gagaagcgataattctatccaagacccatagagacaacttcattctattcttaaaatccatagagcccttatttc

SEQ ID NO: 217015 - DNA, 75 bp, Artificial Sequence
  Synthetic
ctagatttttgagtgaactctttagttcctcttttttgggaatcccagaatctataataggtctaattcaaaact

SEQ ID NO: 217016 - DNA, 75 bp, Artificial Sequence
  Synthetic
caagaactgtcaggaggcagttccgaaaaagtctctcaaggacactagaagagtcatttttttactcagagattc

SEQ ID NO: 217017 - DNA, 75 bp, Artificial Sequence
  Synthetic
acgggataaacaggatgactcaaactcctcaaagactaggtagggtgtggcagtgctctgctgaaagggcagatc

SEQ ID NO: 217018 - DNA, 75 bp, Artificial Sequence
  Synthetic
agctaagggagatttcctgggggaggaaagtggtcgggacaactgttcctcatccttcagagatgttagtactaa

SEQ ID NO: 217019 - DNA, 75 bp, Artificial Sequence
  Synthetic
ttcctaaatcatctgtggcttgtggttgtaatacaagagagacttgcaatcctcgcatatcagtatcaattctac

SEQ ID NO: 217020 - DNA, 75 bp, Artificial Sequence
  Synthetic
cctcatttgatcattctttcttttctagaggtcccctcaaggggtatctagggtcttcaacatcggtctctactc

SEQ ID NO: 217021 - DNA, 75 bp, Artificial Sequence
  Synthetic
aactatttcacgcatgggagaaagtgacaaatgtccatgtggttaagagagctctatctctaaaagagtcaatca

SEQ ID NO: 217022 - DNA, 75 bp, Artificial Sequence
  Synthetic
actggtttgtatccagggactcaaacctggctcaaaccttgataaagaatattctatctctgacaggccctgcct

SEQ ID NO: 217023 - DNA, 75 bp, Artificial Sequence
  Synthetic
tcccaatcgaggaggcccccgttttcaaaaggacaggctctgccttgcatagattcaagtctgccagatatagtg

SEQ ID NO: 217024 - DNA, 75 bp, Artificial Sequence
  Synthetic
agggaggctattcttcagtttgtccaaacttattgtctcacatatctgttagtacagataccatgtcggatttga

SEQ ID NO: 217025 - DNA, 75 bp, Artificial Sequence
  Synthetic
ctcaggatggaaccaattttgatttcatgtttcaacctctcatgttgtatgctcagacgtggacttctgaactag

SEQ ID NO: 217026 - DNA, 75 bp, Artificial Sequence
  Synthetic
ttcagaaagatgggaggctgaaagactcaacttttcattggcatttgagatgcaagaaatgtatcagaccaattg

SEQ ID NO: 217027 - DNA, 75 bp, Artificial Sequence
  Synthetic
aagaggtctctcttgaggctcctcaaagtttcacgtttcctgatatatccacaagaatatcaaggatggtgtctg

SEQ ID NO: 217028 - DNA, 75 bp, Artificial Sequence
  Synthetic
gagcagtcccacaatttagaaagctacctgagattgagctaaagccaggtgacttgatgatcttaagcaataatg

SEQ ID NO: 217029 - DNA, 75 bp, Artificial Sequence
  Synthetic
agagatcataccatataggcacagcacaaggtctgttgtattccatattggttgctattcatgatccggggtata

SEQ ID NO: 217030 - DNA, 75 bp, Artificial Sequence
  Synthetic
atgacaactcgctctttccagtgaatatttatgggaagatatctgcacgtagttatttacgagggttagcacgag

SEQ ID NO: 217031 - DNA, 75 bp, Artificial Sequence
  Synthetic
gtgtactgataggatcatcaatatgttttctgacgagaatgactaatatcaacatcaacagacctttggagttac

SEQ ID NO: 217032 - DNA, 75 bp, Artificial Sequence
  Synthetic
tgtctggggtgatatcatatatcttgttgaggcttgacaatcatccttctctctatgtaatgttaaaagaaccag

SEQ ID NO: 217033 - DNA, 75 bp, Artificial Sequence
  Synthetic
agttaagatcagaaatattctcaatcccccaaaagataccggctgcttaccctaccaccatggaagaagggaatc

SEQ ID NO: 217034 - DNA, 75 bp, Artificial Sequence
  Synthetic
gatctgttctatgctatcttcaacaggtcctgagatacgagagggatagcatctcttcatccccagggagtgagc

SEQ ID NO: 217035 - DNA, 75 bp, Artificial Sequence
  Synthetic
tattgtggatattctcagattttagaagtataaaaatgacttatctcacgttgatcacttatcaagctcatctct

SEQ ID NO: 217036 - DNA, 75 bp, Artificial Sequence
  Synthetic
ggctacaaaagatggagaagaatctctctaagcaaatgagggccaagttgcgccagctgaactccttaatgcgtc

SEQ ID NO: 217037 - DNA, 75 bp, Artificial Sequence
  Synthetic
aagttttaggaggccacggagaagaaaacgtagagtcagatgatgaaatacactccttacttaaagaagctttga

SEQ ID NO: 217038 - DNA, 75 bp, Artificial Sequence
  Synthetic
gaagaactagatgggtagatcaagaagttcgtcatgcagctaaaacaatggagccagactccaacccagtctcta

SEQ ID NO: 217039 - DNA, 75 bp, Artificial Sequence
  Synthetic
gggtgtctagaaaagtagggtcatcggaatggatatgctcagcccaacaaattgccttttcaacatctctcaatc

SEQ ID NO: 217040 - DNA, 75 bp, Artificial Sequence
  Synthetic
cagcatctacatctgatattgatttgaggtccttatcccgtcagtatcaaaatccacttatgtctgggctacgag

SEQ ID NO: 217041 - DNA, 75 bp, Artificial Sequence
  Synthetic
tggttcagtgggctaccggagctcactacaaaatcaaacctatactaaatgatcttgagacatgtccatgtttat

SEQ ID NO: 217042 - DNA, 75 bp, Artificial Sequence
  Synthetic
cattggtaataggagatggatcaggcggtatttctcgagttgtgttaagcatgtttcctgactccaagttggttt

SEQ ID NO: 217043 - DNA, 75 bp, Artificial Sequence
  Synthetic
tcaatagcttattggaagtgaatgatctgatggcctctggcacccatcctttgcctccctctgcattaatgcgag

SEQ ID NO: 217044 - DNA, 75 bp, Artificial Sequence
  Synthetic
gaggcgaagaaataacatctcgggtgattgattttgaatctatctgggagaagccttctgacttgagaaaccctc

SEQ ID NO: 217045 - DNA, 75 bp, Artificial Sequence
  Synthetic
tcacatggaagtatttccattcagtacaaaccagagtgaagactcaatttgatttgatagtgtgtgatgctgaag

SEQ ID NO: 217046 - DNA, 75 bp, Artificial Sequence
  Synthetic
tcactgacattgactcagtcaataaaataacccttttgttatctgatttctctatgtcaatcaaaggacctttgt

SEQ ID NO: 217047 - DNA, 75 bp, Artificial Sequence
  Synthetic
atttgatctttaagacttatggaactatgctgattaatcccaattacaaagctatccatcacttatctagagcat

SEQ ID NO: 217048 - DNA, 75 bp, Artificial Sequence
  Synthetic
tcccatgtgtcactggatttgtcacccaaatgacctcttctttttcttcagaaatatatttgagattttcgaaaa

SEQ ID NO: 217049 - DNA, 75 bp, Artificial Sequence
  Synthetic
caggttatttcttccgagatcacgagctgttaactgcatcaactatcagagaaatgagtcttgtattgtttaatt

SEQ ID NO: 217050 - DNA, 75 bp, Artificial Sequence
  Synthetic
gcagcaatccgaaaagtgagatgttaagagctcggacattaaactatcaggacctggttagaggctttcccgagg

SEQ ID NO: 217051 - DNA, 75 bp, Artificial Sequence
  Synthetic
aaatcatttcaaacccttataacgagatgatcataacattgattgacagtgaggtcgagtcttttctagttcata

SEQ ID NO: 217052 - DNA, 75 bp, Artificial Sequence
  Synthetic
agatggtggatgatcttgagttgaagagaggtcattcttcaaagatggcaataattcttgctataactattttgt

SEQ ID NO: 217053 - DNA, 75 bp, Artificial Sequence
  Synthetic
tttccaacagagtcttcaatgtttccaagtctctcaaagataaaaagttttctcctccctctgatccaaaacttt

SEQ ID NO: 217054 - DNA, 75 bp, Artificial Sequence
  Synthetic
tggggcattttaatatatgctctagcacccttttatttttatctactgctatgggtgatttgactaactttacaa

SEQ ID NO: 217055 - DNA, 75 bp, Artificial Sequence
  Synthetic
aaattcatgaactttacaactctcccataacttattactttaagaagcagaccataaaaagtaaaaggttcttgt

SEQ ID NO: 217056 - DNA, 75 bp, Artificial Sequence
  Synthetic
catggagttgggaagatcctggacctgtttttaaaaaagtgtcatgcaattcatctctaagcttatcagctcatt

SEQ ID NO: 217057 - DNA, 75 bp, Artificial Sequence
  Synthetic
ggatcagattaatctacaagatagtcaagactactcgattgaattgcagtcctagggagctggttagagagatcg

SEQ ID NO: 217058 - DNA, 75 bp, Artificial Sequence
  Synthetic
agatgtatctgcggaattataatcggtggattacaatgaaagatatccgatcaagaacgtcgattttggattatt

SEQ ID NO: 217059 - DNA, 75 bp, Artificial Sequence
  Synthetic
gctgtctataaaaatgttgtcgaattttgacctttttcctctctctaaatgtgatacacagaccaaagagaaaat

SEQ ID NO: 217060 - DNA, 75 bp, Artificial Sequence
  Synthetic
atagaaaaaaacatctgcaagtgtctgaacgtctctccatgtgattgtttttaatttttattcgttttttttgtt

SEQ ID NO: 217061 - DNA, 75 bp, Artificial Sequence
  Synthetic
aaaaacatctgcaagtgtctgaacgtctctccatgtgattgtttttaatttttattcgttttttttgttaagcgt

SEQ ID NO: 217062 - DNA, 75 bp, Artificial Sequence
  Synthetic
acgcttaacagcaaaatcagagaagatatagacagcgacaatgcgctaaacaaaatgtaacacccctacaatgga

SEQ ID NO: 217063 - DNA, 75 bp, Artificial Sequence
  Synthetic
atatagacagcgacaatgcgctaaacaaaatgtaacacccctacaatggattctgacaagattgttttcaaggtt

SEQ ID NO: 217064 - DNA, 75 bp, Artificial Sequence
  Synthetic
cataatcagatcgtatctttaaagcctgagattatatcagaccaatatgaatataagtatccagctatcacagat

SEQ ID NO: 217065 - DNA, 75 bp, Artificial Sequence
  Synthetic
gggaagaagccgggcatcactctcgggaaggccccagacctgagtacagcttacaagtcgatattgtcaggcatg

SEQ ID NO: 217066 - DNA, 75 bp, Artificial Sequence
  Synthetic
aatgctgccaaattagacccagatgatgtgtgttcttatctggccgcagcaatgcagttcttcgaaggagtgtgt

SEQ ID NO: 217067 - DNA, 75 bp, Artificial Sequence
  Synthetic
cctgaggactgggtcagctatgggattatcatagcgaagaaaggggagacaataactcccaatgttttggtagat

SEQ ID NO: 217068 - DNA, 75 bp, Artificial Sequence
  Synthetic
aataactcccaatgttttggtagatataaccaggacaaatgtggaaggaaactgggcgcaagcagggggggcaga

SEQ ID NO: 217069 - DNA, 75 bp, Artificial Sequence
  Synthetic
ataaccaggacaaatgtggaaggaaactgggcgcaagcagggggggcagatatgacaagggatcccacgattgct

SEQ ID NO: 217070 - DNA, 75 bp, Artificial Sequence
  Synthetic
gaacatgcctctttagtgggactcttgctttgtctttatagactgagtaagatagtgggtcaaaacacagctaat

SEQ ID NO: 217071 - DNA, 75 bp, Artificial Sequence
  Synthetic
tacaagaccaatgtggcagataggatggagcagatcttcgaaactgctccctttataaaagtggtggagcatcac

SEQ ID NO: 217072 - DNA, 75 bp, Artificial Sequence
  Synthetic
accctgatgacaactcacaagatgtgtgcaaactggagtactatcccaaacttcaggtttttggcaggtacatat

SEQ ID NO: 217073 - DNA, 75 bp, Artificial Sequence
  Synthetic
gacatgttttttgccagaattgaacatctttattctgctattagggtcggcactgtggtgactgcttatgaggac

SEQ ID NO: 217074 - DNA, 75 bp, Artificial Sequence
  Synthetic
tgttcaggattggtatctttcactggattcattaaacagatcaacttatccgcgagagatgctcttctgtacttt

SEQ ID NO: 217075 - DNA, 75 bp, Artificial Sequence
  Synthetic
ttccataaaaacttcgaagaggaaattaaaagaatgtttgagccaggacaagaaactgctgttcctcattcatat

SEQ ID NO: 217076 - DNA, 75 bp, Artificial Sequence
  Synthetic
ttaaaagaatgtttgagccaggacaagaaactgctgttcctcattcatattttatccacttcagggctttgggac

SEQ ID NO: 217077 - DNA, 75 bp, Artificial Sequence
  Synthetic
agaaactgctgttcctcattcatattttatccacttcagggctttgggactcagcgggaagtccccttactcatc

SEQ ID NO: 217078 - DNA, 75 bp, Artificial Sequence
  Synthetic
aaatgccgtgggtcatacctttaatttgatccatttcataggttgttatatggggcagatacgatctctaaatgc

SEQ ID NO: 217079 - DNA, 75 bp, Artificial Sequence
  Synthetic
aactgtgattcagacatgtgcaccccatgagatgtctgttttggggggatatttaggggaggagttttttgggaa

SEQ ID NO: 217080 - DNA, 75 bp, Artificial Sequence
  Synthetic
gggaacttttgagaggagattctttagagatgagaaggagatgcaagattatgcggagttagagggcgcaaaggt

SEQ ID NO: 217081 - DNA, 75 bp, Artificial Sequence
  Synthetic
atgcggagttagagggcgcaaaggttgaggcatctttggcggatgatggaacagttgattctgacgatgaggagt

SEQ ID NO: 217082 - DNA, 75 bp, Artificial Sequence
  Synthetic
tcttctctggcgaaaccaggagtccagaggccgtatatagcaggattatgatgaataatggtcgactgaggaagt

SEQ ID NO: 217083 - DNA, 75 bp, Artificial Sequence
  Synthetic
ctcatatacagagatatgtatctgtaagctcaaaccaccaggctcgcccaaactcttttgcggaattcctcaaca

SEQ ID NO: 217084 - DNA, 75 bp, Artificial Sequence
  Synthetic
aagtgtactcggagagctcttgagtcttaaattttagtttttgacacaaacaatgaaggtgcatcgctgtgcagg

SEQ ID NO: 217085 - DNA, 75 bp, Artificial Sequence
  Synthetic
aagatttaagaaaaaaactcaacaccactccttgatccatcatctcagcatgagtaaggatctggtgcatcccag

SEQ ID NO: 217086 - DNA, 75 bp, Artificial Sequence
  Synthetic
cttggtgcgtgcagggtatgtggagttggagatggccgatgagactgctgatgtggtcaatttgactatagcgag

SEQ ID NO: 217087 - DNA, 75 bp, Artificial Sequence
  Synthetic
ttggagatggccgatgagactgctgatgtggtcaatttgactatagcgagtaatcaggcacatttgcaaggtgag

SEQ ID NO: 217088 - DNA, 75 bp, Artificial Sequence
  Synthetic
cctttctacgttgactccttgccagaagacatgaatagaatgaggctcgcagaaacatctgggaaaatggaggtt

SEQ ID NO: 217089 - DNA, 75 bp, Artificial Sequence
  Synthetic
gcagaggatgatgaggatgattgcagctcagaagatgagttctatttgcctaaggggcaagatcctctggtcccc

SEQ ID NO: 217090 - DNA, 75 bp, Artificial Sequence
  Synthetic
ttccagggatttcttgaggaagtaggggcaaggattgttaaaaggatgaagtcaggggaagggttttttaagata

SEQ ID NO: 217091 - DNA, 75 bp, Artificial Sequence
  Synthetic
tggtctacaatgacagaggacataaaaggttatgtactcacgaatgtgatgaagaccagttctaaaaccgtggaa

SEQ ID NO: 217092 - DNA, 75 bp, Artificial Sequence
  Synthetic
gaagaccagttctaaaaccgtggaaaataggcaaacgcaaactgacaaacaactctcctctaatctgcctcaaga

SEQ ID NO: 217093 - DNA, 75 bp, Artificial Sequence
  Synthetic
aataggcaaacgcaaactgacaaacaactctcctctaatctgcctcaagaaccgaccccgtccaagagggaagac

SEQ ID NO: 217094 - DNA, 75 bp, Artificial Sequence
  Synthetic
gcactcaatcccaaaaaggcagaggagagacccaagccaagcaaggctccagaggtgagttggactaatgagact

SEQ ID NO: 217095 - DNA, 75 bp, Artificial Sequence
  Synthetic
gaagaagtcaatgacatagagggagaggttgcccatcaagttgctgaaagcttttctaaaaagtataagttccca

SEQ ID NO: 217096 - DNA, 75 bp, Artificial Sequence
  Synthetic
aggttgcccatcaagttgctgaaagcttttctaaaaagtataagttcccatctagatcatcagggatcttcctat

SEQ ID NO: 217097 - DNA, 75 bp, Artificial Sequence
  Synthetic
ggaactttgaacagctcaaaatgaacttggatgatatagtcaaggcatcaatgaacataccgggggtggagaaga

SEQ ID NO: 217098 - DNA, 75 bp, Artificial Sequence
  Synthetic
tcgcagaaaagggagggaagctgcctctcagatgtatcctagggtttgtggccttagactcttctaagaggttca

SEQ ID NO: 217099 - DNA, 75 bp, Artificial Sequence
  Synthetic
gactattggcagatacagacaaggtggccagacttatgcaagatgatatcaacagttatatggcaaggctggaag

SEQ ID NO: 217100 - DNA, 75 bp, Artificial Sequence
  Synthetic
atgtagacaggaattagaatgttgatcaaattgactcatttcaatcaaatttggacaaagccatgaaaaaaacat

SEQ ID NO: 217101 - DNA, 75 bp, Artificial Sequence
  Synthetic
gtaacatccctaaaaagatgaatttcctgaagaaaatagtgaagacttgcaaagatgaggagactcccaagtatg

SEQ ID NO: 217102 - DNA, 75 bp, Artificial Sequence
  Synthetic
gggcagcatcagctccccctgatgatgatgacctttggatgcctccgccggagtatgtccctttgactcaggtta

SEQ ID NO: 217103 - DNA, 75 bp, Artificial Sequence
  Synthetic
aaggcaaagcaagtgttcgaaatttctgtatcaatggagagattaagatatgtagtcctaatggatactccttta

SEQ ID NO: 217104 - DNA, 75 bp, Artificial Sequence
  Synthetic
gaattcttcgacacatcttgaagtcgttcgacaacgtctattcaggaaaccgaagaatgatcgggctggtcaaaa

SEQ ID NO: 217105 - DNA, 75 bp, Artificial Sequence
  Synthetic
tagtaattggcttagtattatctgggtcccccgtccctgaaggtatgaactgggtttacaaacttcgcagaacct

SEQ ID NO: 217106 - DNA, 75 bp, Artificial Sequence
  Synthetic
tgatctttcagtgggctgaatctcatgggcctctagagggagaagagctagagtattctcaagaaataacatggg

SEQ ID NO: 217107 - DNA, 75 bp, Artificial Sequence
  Synthetic
atgacgaggcagagttcgtcggcttgcagattagagtgagtgcaagacaatgccacatccagggaaggttgtggt

SEQ ID NO: 217108 - DNA, 75 bp, Artificial Sequence
  Synthetic
tgccacatccagggaaggttgtggtgcatcaacatgaattctcgagcctgtcagctctgggcagatatggcacta

SEQ ID NO: 217109 - DNA, 75 bp, Artificial Sequence
  Synthetic
aagacacaacaatctcaagaggacgagaacacttccctccttttggagtaattcaaggcccaacaaatatatccg

SEQ ID NO: 217110 - DNA, 75 bp, Artificial Sequence
  Synthetic
tgattgttacctccatcttgagtagatataatctgtgagcaatagaacaaatacagtaatggtgcctgcttccag

SEQ ID NO: 217111 - DNA, 75 bp, Artificial Sequence
  Synthetic
cacaacatctataacctaaacacttgtttatctctagatccagggttgagcataatgtgaaaaaaacttgtgaac

SEQ ID NO: 217112 - DNA, 75 bp, Artificial Sequence
  Synthetic
acggaataacaaccctccctaatcgccaccatgagtcaattgttctcaaccttcatcttttgcttgttcatagga

SEQ ID NO: 217113 - DNA, 75 bp, Artificial Sequence
  Synthetic
agttccataggagacttccctctatatacaattcccgaacggcttaatccctggactccaattgacttaatccac

SEQ ID NO: 217114 - DNA, 75 bp, Artificial Sequence
  Synthetic
ctgagctgtcctaacaacttactgtctgatgctgaggggtgcagtgaaacttcatcctttacctatgtagagctc

SEQ ID NO: 217115 - DNA, 75 bp, Artificial Sequence
  Synthetic
aaaaccggttttctcgcccatcagaaagtgccggggttcacttgcacaggtgtgataaacgaggcagtcacatac

SEQ ID NO: 217116 - DNA, 75 bp, Artificial Sequence
  Synthetic
accaactttgttggatatgttactaccacatttaagagaaaacattttaaaccaactgtttccgcatgtagggat

SEQ ID NO: 217117 - DNA, 75 bp, Artificial Sequence
  Synthetic
gccttcaactggaaagtttctggagatcctagatacgaggagtctttacatacaccctatccggataacagttgg

SEQ ID NO: 217118 - DNA, 75 bp, Artificial Sequence
  Synthetic
ctgcgaactgtcaccacaaccaaagaatccttgttaataatctctccaagcattgtagagatggatgtatacggt

SEQ ID NO: 217119 - DNA, 75 bp, Artificial Sequence
  Synthetic
agaactctccattcccccatgtttcctacaggaatctgctctaagttttatccatcaattccttcatgtgctacc

SEQ ID NO: 217120 - DNA, 75 bp, Artificial Sequence
  Synthetic
aatcatgattacacgttgtggttgcctgaagaccctaacttgagtttgatttgtgacatatttgtgacaagcaca

SEQ ID NO: 217121 - DNA, 75 bp, Artificial Sequence
  Synthetic
ggaagaaaggcaatgaatgggtctcgtatgtgtggattcacagatgaacgagggttttatcgaaccctgaaggga

SEQ ID NO: 217122 - DNA, 75 bp, Artificial Sequence
  Synthetic
gcatgcaagttgaccttgtgtgggaaaccaggcctacggttatatgatgggacatgggtctcgttcactaggcct

SEQ ID NO: 217123 - DNA, 75 bp, Artificial Sequence
  Synthetic
gaaatccatgtatggtgctctcctgatcagctggtgaacgtgcataacaaccgcatagacgaaattgaacatttg

SEQ ID NO: 217124 - DNA, 75 bp, Artificial Sequence
  Synthetic
attgtagatgacctcatcaggaagagagaggagtgtttggatacactagagaccgtcctaatgtctaagtcgtta

SEQ ID NO: 217125 - DNA, 75 bp, Artificial Sequence
  Synthetic
agtttcagaaggctcagtcacttccggaagttagtccccgggtatggaaaggcctatacaatcctcaatgggagt

SEQ ID NO: 217126 - DNA, 75 bp, Artificial Sequence
  Synthetic
ctgatggaaaccaatgttcactataaaagggtggataattgggtcgacattctgccttccaaagggtgccttaag

SEQ ID NO: 217127 - DNA, 75 bp, Artificial Sequence
  Synthetic
gtaaacaataaatgtatggagtcagacacaggggttttcttcaatggaatcattaaagggcccgatggtaggatt

SEQ ID NO: 217128 - DNA, 75 bp, Artificial Sequence
  Synthetic
ctcatccctgaaatgcagtctggactgctaaaacaacatatggacctcttgaaggctgcagtgttccctttaaga

SEQ ID NO: 217129 - DNA, 75 bp, Artificial Sequence
  Synthetic
cacccattaattgacaaagcctcagtgttcaaaaaggatggtgatgcagatgacttcgtcgatgtccacatgcca

SEQ ID NO: 217130 - DNA, 75 bp, Artificial Sequence
  Synthetic
gacatccagaagctagtatctgatgtcgacttgggcttgccaaattggagtttctttgctttgataggtgccagt

SEQ ID NO: 217131 - DNA, 75 bp, Artificial Sequence
  Synthetic
gtaattgcactgctcattctagtatgtcttctgaggatgtgctgcaaacggatgaggagaagaagctctgtcagg

SEQ ID NO: 217132 - DNA, 75 bp, Artificial Sequence
  Synthetic
gatcaagtagccccaccgtttagcttatcttctactccttcttctaagtcaaaggtggtgtcatcatgggagtca

SEQ ID NO: 217133 - DNA, 75 bp, Artificial Sequence
  Synthetic
tataaagggacatcaagtgtctaattgaccaccctttaatgcgttgttggtggatggaatacaacccgattaact

SEQ ID NO: 217134 - DNA, 75 bp, Artificial Sequence
  Synthetic
gcctcttcatctggaaacattccacggtacagtcgtatcatctcagtggaagaattgagctattgctcaaatcct

SEQ ID NO: 217135 - DNA, 75 bp, Artificial Sequence
  Synthetic
ctgacaatcaatgctcgctaggaattatttattagctaggtgcaaatgtttctcaaacattccagtgtggccgaa

SEQ ID NO: 217136 - DNA, 75 bp, Artificial Sequence
  Synthetic
ttcactgttctttatgtctatattttcaggtcgatatgacgacaatcagtttctgaataaatgtgaggtttgata

SEQ ID NO: 217137 - DNA, 75 bp, Artificial Sequence
  Synthetic
tgaaggatcagggtccaaatagatcttattaaataaaattcttcactttggcctttaaaactctgaggtgcgaaa

SEQ ID NO: 217138 - DNA, 75 bp, Artificial Sequence
  Synthetic
atcaatgctttaagcaatcttaaagattctgtgctccctttggtctgatgagctccagggagtttctaattgttc

SEQ ID NO: 217139 - DNA, 75 bp, Artificial Sequence
  Synthetic
tgtataaagacagaacacaacttagtgtcttctctttgtatatgtctttatttgtcatagttgcatctctatatt

SEQ ID NO: 217140 - DNA, 75 bp, Artificial Sequence
  Synthetic
tgtcttctctttgtatatgtctttatttgtcatagttgcatctctatattgttgacgggacgtaaatggtgtgaa

SEQ ID NO: 217141 - DNA, 75 bp, Artificial Sequence
  Synthetic
aaaaacataaatactctaagggcttgtaacgagacaacattcctcatcattacatcttgaacatgattgattcct

SEQ ID NO: 217142 - DNA, 75 bp, Artificial Sequence
  Synthetic
cagaggtgtatgatgaccctattgaccctgccgaaccggagtgtgaatggagcgggaacccagtgatccccaaca

SEQ ID NO: 217143 - DNA, 75 bp, Artificial Sequence
  Synthetic
ttttgaggaactccgattataatctgaattccccattgctggaagatccaacccatctgatgattcaatggcttc

SEQ ID NO: 217144 - DNA, 75 bp, Artificial Sequence
  Synthetic
acccatctgatgattcaatggcttctatctggaaacagacctttgaggatgacagtcacagaaaacatggtgagg

SEQ ID NO: 217145 - DNA, 75 bp, Artificial Sequence
  Synthetic
gacagtcacagaaaacatggtgaggtctcataaggttttgaaggcatcctttaaacgggtggacattgctgtcat

SEQ ID NO: 217146 - DNA, 75 bp, Artificial Sequence
  Synthetic
taaaatcgggggcacaagtgctcaagcaatgatgggaacatgggtacagggatcccacgcagagtcatcccggag

SEQ ID NO: 217147 - DNA, 75 bp, Artificial Sequence
  Synthetic
gcaatgatgggaacatgggtacagggatcccacgcagagtcatcccggagtaggaagtgcctggccgatctgtca

SEQ ID NO: 217148 - DNA, 75 bp, Artificial Sequence
  Synthetic
tctttctatcagaggtcttcacctattgagtcgatcttgaactacactcttatgaatcgaggcttgcagactccg

SEQ ID NO: 217149 - DNA, 75 bp, Artificial Sequence
  Synthetic
agagaaggggttttggccggcttgagcagggtcagttacgatcaatccttcggaagatatttaggaaatctgtac

SEQ ID NO: 217150 - DNA, 75 bp, Artificial Sequence
  Synthetic
tcatcttacttattgtttcataccattgttctttatatgaatgccctggattgggaagaaaagaagaccattctg

SEQ ID NO: 217151 - DNA, 75 bp, Artificial Sequence
  Synthetic
ttgttctttatatgaatgccctggattgggaagaaaagaagaccattctggcactctggaaagacgtaacatcag

SEQ ID NO: 217152 - DNA, 75 bp, Artificial Sequence
  Synthetic
tagacataaagaatgacaaagtcttgtttaaggatcccctgtgggggaagttcctggtcaccaaggactttgttt

SEQ ID NO: 217153 - DNA, 75 bp, Artificial Sequence
  Synthetic
gtttaaggatcccctgtgggggaagttcctggtcaccaaggactttgtttattcttatgactccaacagcctgtt

SEQ ID NO: 217154 - DNA, 75 bp, Artificial Sequence
  Synthetic
tgacaggaactatacattgatgttgaaagatctgtttctttcccgattcaattcattgctgattctaatatcccc

SEQ ID NO: 217155 - DNA, 75 bp, Artificial Sequence
  Synthetic
tccagaaccaaggtattctgatgaacttgtagccaacctatgtcgcctttatattgcgggggataagatcttgtc

SEQ ID NO: 217156 - DNA, 75 bp, Artificial Sequence
  Synthetic
tacgtgcgggaatcctggatatgacataatcaagatgctagagccatatgtcgtgaaccttctggtacagaaagc

SEQ ID NO: 217157 - DNA, 75 bp, Artificial Sequence
  Synthetic
agaaacgttccgacctctgatccatccccttggagagtttccaacctttataaaggacaagacggcccagttgat

SEQ ID NO: 217158 - DNA, 75 bp, Artificial Sequence
  Synthetic
tgggacttttggaccttgcgcctcacagttcttctctatgttgagccaatttgacaacatccatgatcttgtgtt

SEQ ID NO: 217159 - DNA, 75 bp, Artificial Sequence
  Synthetic
cagttcttctctatgttgagccaatttgacaacatccatgatcttgtgtttgtttatggttgctacagacactgg

SEQ ID NO: 217160 - DNA, 75 bp, Artificial Sequence
  Synthetic
ggacacccatacatcgactatagacgaggactcaccaagctatttgatcaggttcatatgagaaagaccatagat

SEQ ID NO: 217161 - DNA, 75 bp, Artificial Sequence
  Synthetic
ggttcatatgagaaagaccatagatcagaaatatcaagaatgcttggctagcgatcttgcgaagaaaattctcag

SEQ ID NO: 217162 - DNA, 75 bp, Artificial Sequence
  Synthetic
gtggggtttcgacaaatattctaaatggtatctagacacaaattccctccctaaaaatcatccgttagctcccta

SEQ ID NO: 217163 - DNA, 75 bp, Artificial Sequence
  Synthetic
cattgcaactcagacctggcctcctaaacatattgtagacctcctaggagactcttggcatttattgcccatgac

SEQ ID NO: 217164 - DNA, 75 bp, Artificial Sequence
  Synthetic
aaacatattgtagacctcctaggagactcttggcatttattgcccatgacacaaatctttgaaattcctgaatcc

SEQ ID NO: 217165 - DNA, 75 bp, Artificial Sequence
  Synthetic
atggacccttcagagattctggatgacaagtcacactcattcactcgatctaagcttgcttattggctatcagaa

SEQ ID NO: 217166 - DNA, 75 bp, Artificial Sequence
  Synthetic
acaagtcacactcattcactcgatctaagcttgcttattggctatcagaaaacagggggggtcctgttcctagcg

SEQ ID NO: 217167 - DNA, 75 bp, Artificial Sequence
  Synthetic
aaaaggtcatcattacagccttgtcacgacccccagtcaatcctagagagtttttaagaacaatcgatcaaggag

SEQ ID NO: 217168 - DNA, 75 bp, Artificial Sequence
  Synthetic
ggctaccggaagatgacctgatcataggactaaaacccaaggagagggagttgaaaatagaggggaggttctttg

SEQ ID NO: 217169 - DNA, 75 bp, Artificial Sequence
  Synthetic
ccttgatgtcatggaatctaaggctatactttgtaatcacagagaagttgttggccaaccatattcttcctctgt

SEQ ID NO: 217170 - DNA, 75 bp, Artificial Sequence
  Synthetic
ttgatgctttgaccatgacggacaatttgaataaggtattcaagaagttgatagacagggttaccggtcaagggc

SEQ ID NO: 217171 - DNA, 75 bp, Artificial Sequence
  Synthetic
tgttggattactcaagagtcacttatgcctttcacctggactatgaaaagtggaataatcaccagcgactagagt

SEQ ID NO: 217172 - DNA, 75 bp, Artificial Sequence
  Synthetic
tgcctttcacctggactatgaaaagtggaataatcaccagcgactagagtctaccaaggatgtattctctgtctt

SEQ ID NO: 217173 - DNA, 75 bp, Artificial Sequence
  Synthetic
agacaaagcttttggtttgtccagagtgttctctaggacacacgagttcttccagaagtcctgggtatattattc

SEQ ID NO: 217174 - DNA, 75 bp, Artificial Sequence
  Synthetic
tccagaagtcctgggtatattattcagacaggtctgacctgatagggatttggaaagaccaaatatactgtctcg

SEQ ID NO: 217175 - DNA, 75 bp, Artificial Sequence
  Synthetic
acatggctgaagggcccacttgctggaatggtcaagacggaggattagaaggcctcagacaaaaggggtggagtc

SEQ ID NO: 217176 - DNA, 75 bp, Artificial Sequence
  Synthetic
tggtcagccttcttatgattgagagagaatcacaaacccgaaatacgaggacaaagattctggcacagggggaca

SEQ ID NO: 217177 - DNA, 75 bp, Artificial Sequence
  Synthetic
accaagtgctctgccccacttacatgctttcatcaggcctcaacaatgaggggcttaggtatgagctggaaagta

SEQ ID NO: 217178 - DNA, 75 bp, Artificial Sequence
  Synthetic
tatcgaagaatgccatgtccatctatagagcgatagaggagggggcctctaaactcggattgataataaagaaag

SEQ ID NO: 217179 - DNA, 75 bp, Artificial Sequence
  Synthetic
aagaaacaatgtgtagctttgacttcctcatttacggaaaaactcccctatttcgtggaaacatcctggtcccag

SEQ ID NO: 217180 - DNA, 75 bp, Artificial Sequence
  Synthetic
aatctaagaggtgggccagagtatcctgcatctcaaatgaccaaattgtgaatctagccaacattatgtctacag

SEQ ID NO: 217181 - DNA, 75 bp, Artificial Sequence
  Synthetic
ctgcatctcaaatgaccaaattgtgaatctagccaacattatgtctacagtctccaccaatgccttgactgttgc

SEQ ID NO: 217182 - DNA, 75 bp, Artificial Sequence
  Synthetic
tcaacactcacaatctctcatcaagcccatgagagacttcctcttgatgtcagttcaagcaatttatcattatct

SEQ ID NO: 217183 - DNA, 75 bp, Artificial Sequence
  Synthetic
cccatgagagacttcctcttgatgtcagttcaagcaatttatcattatcttttattcagccctatcctgaaggac

SEQ ID NO: 217184 - DNA, 75 bp, Artificial Sequence
  Synthetic
cagttcaagcaatttatcattatcttttattcagccctatcctgaaggaccgagttcacaaagttctgaactcta

SEQ ID NO: 217185 - DNA, 75 bp, Artificial Sequence
  Synthetic
aaggagatgatttcctactggcgatgtctaggataatttatctagatccatcgttggggggagtatcaggaatgt

SEQ ID NO: 217186 - DNA, 75 bp, Artificial Sequence
  Synthetic
ccctgggaagattccacatcagacaattttctgatcccgtgtcggagggtctaaccttctggaaagagatatggc

SEQ ID NO: 217187 - DNA, 75 bp, Artificial Sequence
  Synthetic
tgagtgcctccgagacatggatccatcacctgtgtcaggaggcagggaatccagatctaggggacagaactttag

SEQ ID NO: 217188 - DNA, 75 bp, Artificial Sequence
  Synthetic
tcacctgtgtcaggaggcagggaatccagatctaggggacagaactttagaaagtttcacccgtcttttggagga

SEQ ID NO: 217189 - DNA, 75 bp, Artificial Sequence
  Synthetic
ccccactacactcaacataaggggaggagcaagtcctacaattctcctgaaagaagctattaggaaggctctgta

SEQ ID NO: 217190 - DNA, 75 bp, Artificial Sequence
  Synthetic
tgatgaagtggacaaggtagagaattctgagttcagggaggcaataattttgtcgaagacacatcgagacaattt

SEQ ID NO: 217191 - DNA, 75 bp, Artificial Sequence
  Synthetic
tattctttttctcaaatctatagagcctttgtttcctaggttcctgagtgagctttttagctcttctttcttagg

SEQ ID NO: 217192 - DNA, 75 bp, Artificial Sequence
  Synthetic
aataccagagtctattataggtctgattcaaaactccagaacagtgaggagacagtttagaaagagcctttcaag

SEQ ID NO: 217193 - DNA, 75 bp, Artificial Sequence
  Synthetic
attcaaaactccagaacagtgaggagacagtttagaaagagcctttcaagggcactggaggagtctttcttccac

SEQ ID NO: 217194 - DNA, 75 bp, Artificial Sequence
  Synthetic
tccgaaattcacgggataaatcggatgacccaaacccctcaacgattggggagagtctggccctgttctgcagag

SEQ ID NO: 217195 - DNA, 75 bp, Artificial Sequence
  Synthetic
cgggcagatcaactcagagagatctcatggggaaggaaggtggtgggaaccacagttcctcacccagcagagatg

SEQ ID NO: 217196 - DNA, 75 bp, Artificial Sequence
  Synthetic
ctggtccttgttcccaggtcatctgtagcttgtggatgcaatgttagagatgcatacaaccctcgattatcggtg

SEQ ID NO: 217197 - DNA, 75 bp, Artificial Sequence
  Synthetic
tctgtcttaccttcttttgacaattcctttttctcaagaggtcctctcaaagggtacctagggtcttcaacttca

SEQ ID NO: 217198 - DNA, 75 bp, Artificial Sequence
  Synthetic
gtctctactcaactgtttcatgcctgggagaaggtgaccaatgttcatgtcgtgaagagagcattgtctctcaag

SEQ ID NO: 217199 - DNA, 75 bp, Artificial Sequence
  Synthetic
gggagaaggtgaccaatgttcatgtcgtgaagagagcattgtctctcaaggagtcaatcaattggtttgtgtcaa

SEQ ID NO: 217200 - DNA, 75 bp, Artificial Sequence
  Synthetic
cgtgaagagagcattgtctctcaaggagtcaatcaattggtttgtgtcaagagactcaaatctggcccagacgct

SEQ ID NO: 217201 - DNA, 75 bp, Artificial Sequence
  Synthetic
catcagaaatatcctttccttaacaggtccatcttttcctattgaagaggctcccgtttttaaacggacaggatc

SEQ ID NO: 217202 - DNA, 75 bp, Artificial Sequence
  Synthetic
agccctgcataggtttaaatctgccagatatagtgaaggaggttattcatctgtatgtcccaacttgttgtctca

SEQ ID NO: 217203 - DNA, 75 bp, Artificial Sequence
  Synthetic
catatctgtcagtacagatactatgtcagacctgactcaggatgggaccaattttgatttcatgttccaaccttt

SEQ ID NO: 217204 - DNA, 75 bp, Artificial Sequence
  Synthetic
gatgttgtatgctcaaacctggacctctgagttggttcaaaaagatgttagactaaaggactcaacatttcactg

SEQ ID NO: 217205 - DNA, 75 bp, Artificial Sequence
  Synthetic
gcatttgaggtgtcagaaatgtataagaccaatagaagaggtctctttagaagccccccagagctttatattccc

SEQ ID NO: 217206 - DNA, 75 bp, Artificial Sequence
  Synthetic
tgatatatcaacacggatttcaagaatggtgtcgggagccgtcccacaattcaggaaactgcctgatatcggctt

SEQ ID NO: 217207 - DNA, 75 bp, Artificial Sequence
  Synthetic
aaaagcaggtgatttgacagtgttgaacaacaatgagcggtcttatcacatcggaacagctcagggtctcctgta

SEQ ID NO: 217208 - DNA, 75 bp, Artificial Sequence
  Synthetic
ttctatattggttgcagtccatgatccaggatataatgacaactctttgtttccagtaaacatctatggaagggt

SEQ ID NO: 217209 - DNA, 75 bp, Artificial Sequence
  Synthetic
gtcggctagaagttatttaagaggactagcgcgaggagtcttgatagggtcttcgatatgctttctaaccagaat

SEQ ID NO: 217210 - DNA, 75 bp, Artificial Sequence
  Synthetic
gacgaacatcaacataaacaggcctctcgaattaatatcaggagtgatttcatacattttattgaggctcgacaa

SEQ ID NO: 217211 - DNA, 75 bp, Artificial Sequence
  Synthetic
tcatccgtctctatatgtgatgttaaaagagccggatcttagagcagagatcttttcaatacctcaaaagattcc

SEQ ID NO: 217212 - DNA, 75 bp, Artificial Sequence
  Synthetic
agcagcttatcccaccacgatggaggagggaaacaggtctgtgttgtgctatcttcaacaggtcttaaggtatga

SEQ ID NO: 217213 - DNA, 75 bp, Artificial Sequence
  Synthetic
gagagacagcatgtgttcctcgccagaaagtgagctcctctggatattctctgattttagaagtatcaaaatgac

SEQ ID NO: 217214 - DNA, 75 bp, Artificial Sequence
  Synthetic
ctatctgacattgataacttaccaggcccatctatggctacaaaaggtagaaagaaatttgtcaaaacagatgag

SEQ ID NO: 217215 - DNA, 75 bp, Artificial Sequence
  Synthetic
agccaagttacgccaattgaattccctgatgaggcaggtgttggggggccatggtgaggacaacgtagagtcaga

SEQ ID NO: 217216 - DNA, 75 bp, Artificial Sequence
  Synthetic
tgaggagatacactctctgctaaaagaggcgttgagaagaaccagatgggtggatcaggaggttcgtcatgcagc

SEQ ID NO: 217217 - DNA, 75 bp, Artificial Sequence
  Synthetic
caagtcgatgagtccagacttgagtccaattccaagaatatcacgcaaaatcggatcctctgaatggatatgttc

SEQ ID NO: 217218 - DNA, 75 bp, Artificial Sequence
  Synthetic
tcggatcctctgaatggatatgttctgcacagcagatcgcaatatccacctctttgaatccagcattggcatcag

SEQ ID NO: 217219 - DNA, 75 bp, Artificial Sequence
  Synthetic
tgcacagcagatcgcaatatccacctctttgaatccagcattggcatcagacattgatctaagatctctgtcccg

SEQ ID NO: 217220 - DNA, 75 bp, Artificial Sequence
  Synthetic
tcaatttcaaaacccgctcatgtcaggtctaaggatcgttcaatgggcaacaggtgctcactacaaggtaaagcc

SEQ ID NO: 217221 - DNA, 75 bp, Artificial Sequence
  Synthetic
caggtgctcactacaaggtaaagcccatactgaatgaactggatgtgtgcccttgtttgtcccttgttatcggtg

SEQ ID NO: 217222 - DNA, 75 bp, Artificial Sequence
  Synthetic
catactgaatgaactggatgtgtgcccttgtttgtcccttgttatcggtgacgggtccggcggaatatctcgagt

SEQ ID NO: 217223 - DNA, 75 bp, Artificial Sequence
  Synthetic
tgttttgagtatgttcccagattccaaattggtcttcaacagcttgttggaggtgaatgacttaatggcttcagg

SEQ ID NO: 217224 - DNA, 75 bp, Artificial Sequence
  Synthetic
cactcacccattgcctccgtctgcactaatgagaggaggagaggaaataacatcaagagtcatcgatttcgactc

SEQ ID NO: 217225 - DNA, 75 bp, Artificial Sequence
  Synthetic
tatatgggagaagccctctgatctgagaaaccctctcacttggaagtattttcactccgtgcagtctaaactaaa

SEQ ID NO: 217226 - DNA, 75 bp, Artificial Sequence
  Synthetic
aactcagttcgacttaattgtatgcgatgcagaggttacagacattgagtcagtaaataaaataacacttctatt

SEQ ID NO: 217227 - DNA, 75 bp, Artificial Sequence
  Synthetic
gtctgacttctctatgtctattcgagggcccttgtgcttgatttttaaaacctatgggaccatgctggtcaatcc

SEQ ID NO: 217228 - DNA, 75 bp, Artificial Sequence
  Synthetic
agattataaggcaattcaccacttgtccagagcgtttccgaacgtgacagggtttgtcacccagatgacatcttc

SEQ ID NO: 217229 - DNA, 75 bp, Artificial Sequence
  Synthetic
tttctcttcagaggtttatctgaagttttccaaaaagggtcacttctttagagatcatgagttgcttacggcttc

SEQ ID NO: 217230 - DNA, 75 bp, Artificial Sequence
  Synthetic
ttttccaaaaagggtcacttctttagagatcatgagttgcttacggcttctactatccgggagatgagcctggtg

SEQ ID NO: 217231 - DNA, 75 bp, Artificial Sequence
  Synthetic
ttgttcaactgcagcaacaccaaaagcgagatgttaagggctagaactttgaattatcaggacttggtaagaggc

SEQ ID NO: 217232 - DNA, 75 bp, Artificial Sequence
  Synthetic
ttccctgaggagattatatcaaacccttataatgagatgatcataacgttgatagacagtgaagtagaatcgttc

SEQ ID NO: 217233 - DNA, 75 bp, Artificial Sequence
  Synthetic
ttggttcataagatggtggatgagttggagttgaagagaggctacccatctaagatggctataatactcgcaata

SEQ ID NO: 217234 - DNA, 75 bp, Artificial Sequence
  Synthetic
accatagtattctccaacagggttttcaatgtgtctaaatctctcaaggagtctaagttcttccctccctctgac

SEQ ID NO: 217235 - DNA, 75 bp, Artificial Sequence
  Synthetic
ccaaagctattgagacactttaacatctgttctagcacacttctgtttctatcgacaacattgggagatttgcct

SEQ ID NO: 217236 - DNA, 75 bp, Artificial Sequence
  Synthetic
aacttcactagaatccacgaactttacaacctccctgtcacttactacttcaagaagcaaaccatcaggagcaaa

SEQ ID NO: 217237 - DNA, 75 bp, Artificial Sequence
  Synthetic
aagtacctatcatggagctgggcaagtcctagcccgatattcaaaaaggtagcgtgcaattcatctctgagtttg

SEQ ID NO: 217238 - DNA, 75 bp, Artificial Sequence
  Synthetic
tcagctcattggataagaatgatatacaagatagtaaaaactaccagactgagctgtcgtccgaaagacctaatc

SEQ ID NO: 217239 - DNA, 75 bp, Artificial Sequence
  Synthetic
gagctgtcgtccgaaagacctaatcagggagacagaagcttgtctcaagaattataatagatggataaatatgag

SEQ ID NO: 217240 - DNA, 75 bp, Artificial Sequence
  Synthetic
attataatagatggataaatatgagagatattaaatcaagaacatctcttatggattattgttgtctataaaaga

SEQ ID NO: 217241 - DNA, 75 bp, Artificial Sequence
  Synthetic
gcttcgggatgacaaactgtgtactaggtgaaagtgactgacacatgccaaagaatttacagtgaaaaaaacatc

SEQ ID NO: 217242 - DNA, 75 bp, Artificial Sequence
  Synthetic
aagaatttacagtgaaaaaaacatctgcaagtttctgagagcatcttaacttgactgtttttaattcttgtattg

SEQ ID NO: 217243 - DNA, 75 bp, Artificial Sequence
  Synthetic
aaaacatctgcaagtttctgagagcatcttaacttgactgtttttaattcttgtattgttttttttgttaagcgt

SEQ ID NO: 217244 - DNA, 75 bp, Artificial Sequence
  Synthetic
atatagacagcgacaatgcgctgaacaaaatgtaacacccctacaatggattctgacaagattgtttttaaggtt

SEQ ID NO: 217245 - DNA, 75 bp, Artificial Sequence
  Synthetic
ataaccaggacaaatgtggaaggaaactgggcgcaagcagggggggcagatatgactagggaccccacgattgct

SEQ ID NO: 217246 - DNA, 75 bp, Artificial Sequence
  Synthetic
agaaactgctgttccccattcatattttatccacttcagggctttgggactcagcgggaaatctccttactcatc

SEQ ID NO: 217247 - DNA, 75 bp, Artificial Sequence
  Synthetic
ttttctctggtgaaaccaggagtccagaggccgtatatagcaggattatgatgaacaatggtcgactgaggaagt

SEQ ID NO: 217248 - DNA, 75 bp, Artificial Sequence
  Synthetic
aacaggcaaacgcaaactgacaaacaactctcctctaatctgcctcaagaactgaccccgcccaagagggaagaa

SEQ ID NO: 217249 - DNA, 75 bp, Artificial Sequence
  Synthetic
gaattcttcgacacatcttgaagtcgtttgataacgtctattcaggaaaccgaagaatgatcgggctggtcaaaa

SEQ ID NO: 217250 - DNA, 75 bp, Artificial Sequence
  Synthetic
tagtaattggcttagtgttatctgggtcccccatccctgaaggtatgaactgggtttacaaacttcgcagaaccc

SEQ ID NO: 217251 - DNA, 75 bp, Artificial Sequence
  Synthetic
tgccacatccagggaaggttgtggtgcatcaacatgaactctcgagcctgccagctctgggcagatatggcccta

SEQ ID NO: 217252 - DNA, 75 bp, Artificial Sequence
  Synthetic
tgtcttctctttgtatatgtctttatttgtcatagttgcatctctgtattgttgacaggacataaatggtgtgaa

SEQ ID NO: 217253 - DNA, 75 bp, Artificial Sequence
  Synthetic
gacagtcacagaaaacatggtgaggtctcataaggttttgaaggcatcatttaaacgggtggatattgctgtcat

SEQ ID NO: 217254 - DNA, 75 bp, Artificial Sequence
  Synthetic
gcaatgatgggaacatgggtacggggatcccacgcagagtcatcccggagtaggaagtgcctggctgatttgtca

SEQ ID NO: 217255 - DNA, 75 bp, Artificial Sequence
  Synthetic
ttgttctttatatgaatgccctggattgggaagaagagaagaccattctggcactctggaaagacataacatcag

SEQ ID NO: 217256 - DNA, 75 bp, Artificial Sequence
  Synthetic
tggaacttttggaccttgcgcctcacagttcttctctatgttgagccaatttgacaatatccatgatctggtatt

SEQ ID NO: 217257 - DNA, 75 bp, Artificial Sequence
  Synthetic
cagttcttctctatgttgagccaatttgacaatatccatgatctggtattcgtttatggttgctacagacactgg

SEQ ID NO: 217258 - DNA, 75 bp, Artificial Sequence
  Synthetic
acaagtcacactcattcactcgatctaagcttgcttattggctatcagaaaacaggggaggtccggttcctagcg

SEQ ID NO: 217259 - DNA, 75 bp, Artificial Sequence
  Synthetic
ctgcatctcaaatgaccaaattgtaaatctagccaacattatgtctacagtctccaccaacgccttgactgttgc

SEQ ID NO: 217260 - DNA, 75 bp, Artificial Sequence
  Synthetic
cagttcaagcaatttatcattatcttttgttcagccctatcctgaaggaccgagtttacaaggttctgaactcta

SEQ ID NO: 217261 - DNA, 75 bp, Artificial Sequence
  Synthetic
tcacctgtgtcaggaggcagggaatccagatctaggggatagaactttagaaagtttcacccgtcttttagagga

SEQ ID NO: 217262 - DNA, 75 bp, Artificial Sequence
  Synthetic
attcagaactccagaacagtgaggagacagtttagaaagagcctttcaagggcactggaggagtctttcttccat

SEQ ID NO: 217263 - DNA, 75 bp, Artificial Sequence
  Synthetic
cgtgaagagagcattgtctctcaaggagtcaatcaattggtttgtgtcaagagactcaaatctggcccaaactct

SEQ ID NO: 217264 - DNA, 75 bp, Artificial Sequence
  Synthetic
tgcacagcagatcgcaatatccacctctttgaatccagcgttggcatcagacattgacctgagatctctgtcccg

SEQ ID NO: 217265 - DNA, 75 bp, Artificial Sequence
  Synthetic
catactgaatgatctggatgtgtgcccttgtttgtcccttgttatcggtgacgggtccggcggaatttctcgagt

SEQ ID NO: 217266 - DNA, 75 bp, Artificial Sequence
  Synthetic
ttttccaaaaagggtcacttctttagagatcatgagttgcttacggcttctactatccgagagatgagcctggtt

SEQ ID NO: 217267 - DNA, 75 bp, Artificial Sequence
  Synthetic
attataatagatggataaatatgagagatattagatcaaggacatctcttatggattattgttgtctatgaaaga

SEQ ID NO: 217268 - DNA, 75 bp, Artificial Sequence
  Synthetic
aaaaacatctgcaagtttctgagagtatcttaacttgactgtttttaattcttgtattgtttttttgttaagcgt

SEQ ID NO: 217269 - DNA, 75 bp, Artificial Sequence
  Synthetic
agattttcttgcgcgtgcatgcgtgtgcttcagacagcccaggcagcgactgtgattgtggatattctttctgca

SEQ ID NO: 217270 - DNA, 75 bp, Artificial Sequence
  Synthetic
agttttgtcgtgaacgtgttgagaaaaagacagcttaggagaacaagagctgggaatggccgggaaggccgttct

SEQ ID NO: 217271 - DNA, 75 bp, Artificial Sequence
  Synthetic
aaaaggaaagggggggggtccccctcgacgagcgtcgaaagtggccccaaagaagacgcgtcagttgcgggtcca

SEQ ID NO: 217272 - DNA, 75 bp, Artificial Sequence
  Synthetic
aatgccaaatggacttgtactgatgcgcatgctgggagttctgtggcatgccctgactgggactgcacgaagccc

SEQ ID NO: 217273 - DNA, 75 bp, Artificial Sequence
  Synthetic
agtactgaaagcgttttggaaagtcgttcctttgaagcaggctactctggcactgcgtaagatcaagagaacggt

SEQ ID NO: 217274 - DNA, 75 bp, Artificial Sequence
  Synthetic
gagcaccctcatggtaggcctgcaccgccgaggaagtagaaggacgaccattgactggatgactcccttgttgat

SEQ ID NO: 217275 - DNA, 75 bp, Artificial Sequence
  Synthetic
cactgtcatgcttggaatgtgcctcacggcaactgtccgtagagagagagatgggtcaatggtgattcgtgctga

SEQ ID NO: 217276 - DNA, 75 bp, Artificial Sequence
  Synthetic
agggcgagatgctgcaacccaggttagagtggagaatggcacttgtgtcattcttgctacagacatgggatcatg

SEQ ID NO: 217277 - DNA, 75 bp, Artificial Sequence
  Synthetic
gtgtgatgactcgttggcttacgaatgcgtgaccattgaccagggagaggaacccgttgatgtagactgcttttg

SEQ ID NO: 217278 - DNA, 75 bp, Artificial Sequence
  Synthetic
cagaggtgttgagaaggtgacactggagtatggacgttgtggaaggcgtgaaggttcacgttccaggcgctccgt

SEQ ID NO: 217279 - DNA, 75 bp, Artificial Sequence
  Synthetic
gctgattccgtcacacgcacagcgtgacctgaccgggcggggacaccaatggctcgagggagaggctgtgaaggc

SEQ ID NO: 217280 - DNA, 75 bp, Artificial Sequence
  Synthetic
acacctgacccgcgttgagggttgggtgtggaagaacaaattgttcaccctttctcttgtgatggtggcctggtt

SEQ ID NO: 217281 - DNA, 75 bp, Artificial Sequence
  Synthetic
gatggtggatggattgttgcccaggattctcattgtggttgtggctctcgcattggcaccggcctacgcgtcgag

SEQ ID NO: 217282 - DNA, 75 bp, Artificial Sequence
  Synthetic
atgcacccacctggaaaacagagacttcgtcactggggtgcaggggacgacccgcctcacattggttctcgagct

SEQ ID NO: 217283 - DNA, 75 bp, Artificial Sequence
  Synthetic
ggggggctgcgtgacggtcacggcggatgggaagccatccctcgacgtctggctcgactccatctaccaagagag

SEQ ID NO: 217284 - DNA, 75 bp, Artificial Sequence
  Synthetic
ccctgcacagacaagggagtattgcctacatgcaaagttgactgggacaaaggtggctgccagatgcccgacaat

SEQ ID NO: 217285 - DNA, 75 bp, Artificial Sequence
  Synthetic
ggggccagccacgcttccagaggagcaccaaagtggaacagtgtgcaagagagatcagagcgacaggggatgggg

SEQ ID NO: 217286 - DNA, 75 bp, Artificial Sequence
  Synthetic
gagatcagagcgacaggggatggggtaaccattgtggactatttggcaaagggagcatcgtaacctgcgtcaagt

SEQ ID NO: 217287 - DNA, 75 bp, Artificial Sequence
  Synthetic
taaccattgtggactatttggcaaagggagcatcgtaacctgcgtcaagttcacttgtgaggacaagaagaaggc

SEQ ID NO: 217288 - DNA, 75 bp, Artificial Sequence
  Synthetic
cacaggacatgtgtatgatgtgaacaaaatcacctataccataaaggtggagccacacactggagagtttgtggc

SEQ ID NO: 217289 - DNA, 75 bp, Artificial Sequence
  Synthetic
agccaatgagactcactcagggaggaagtcagcctcgttcacagtgtcatcagaaaaaacaatcttgactcttgg

SEQ ID NO: 217290 - DNA, 75 bp, Artificial Sequence
  Synthetic
agactatggtgatgtatcactcttgtgtagagtggccagtggggtggaccttgctcagactgtggttttggcttt

SEQ ID NO: 217291 - DNA, 75 bp, Artificial Sequence
  Synthetic
ggacaagacacatgagcatctgcccacagcatggcaggtgcatcgtgactggtttaatgatctggccctcccttg

SEQ ID NO: 217292 - DNA, 75 bp, Artificial Sequence
  Synthetic
gaagcatgatggagctgaggcttggaacgaagcaggacggctcgtggagtttgggacgcctcatgcagtgaaaat

SEQ ID NO: 217293 - DNA, 75 bp, Artificial Sequence
  Synthetic
ggatgtgttcaatctgggagaccagacgggagtgttgttgaagtcactggctggggtccctgtagctagcataga

SEQ ID NO: 217294 - DNA, 75 bp, Artificial Sequence
  Synthetic
gggaactaagtatcatctaaagagtggacatgttacttgtgaggttggcttggaaaaactgaagatgaaaggatt

SEQ ID NO: 217295 - DNA, 75 bp, Artificial Sequence
  Synthetic
gacatacacagtctgtgacaagacaaagttcacttggaaaagagcacccacagacagcggtcatgacaccgtggt

SEQ ID NO: 217296 - DNA, 75 bp, Artificial Sequence
  Synthetic
catggaggttggcttctcgggaactaggccttgcagaattccagtacgtgcggttgcacacggagttcctgaggt

SEQ ID NO: 217297 - DNA, 75 bp, Artificial Sequence
  Synthetic
taacgtggccatgctcataacacctaacccgacaatggagaacaacggaggtggattcattgagatgcagctccc

SEQ ID NO: 217298 - DNA, 75 bp, Artificial Sequence
  Synthetic
tcctggagataacataatctatgttggtgacctgaaccatcagtggtttcagaaggggagcagcatcggcagggt

SEQ ID NO: 217299 - DNA, 75 bp, Artificial Sequence
  Synthetic
cctccagaagaccaggaaggggattgagagactcaccgtccttggagaacatgcttgggactttggctcagtggg

SEQ ID NO: 217300 - DNA, 75 bp, Artificial Sequence
  Synthetic
aggtgtcatgacgtccattgggagagccatgcacaccgtcctgggaggagcgtttaacaccctcctagggggggt

SEQ ID NO: 217301 - DNA, 75 bp, Artificial Sequence
  Synthetic
gggcttcctacccaagatactactaggcgtagctatggcctggctgggcttgaacatgaggaacccaaccttgtc

SEQ ID NO: 217302 - DNA, 75 bp, Artificial Sequence
  Synthetic
catgggcttcctactctcagggggcttggtgctggccatgactctgggggttggagccgatgtgggctgcgcagt

SEQ ID NO: 217303 - DNA, 75 bp, Artificial Sequence
  Synthetic
ggacacagagcgaatggagctccgatgtggagaaggactggtggtatggagagaggtgtcagaatggtacgacaa

SEQ ID NO: 217304 - DNA, 75 bp, Artificial Sequence
  Synthetic
ctacgtgttccacccagagactccggcggttctggcatcggcagttcagagggcctatgaagaggaaatctgtgg

SEQ ID NO: 217305 - DNA, 75 bp, Artificial Sequence
  Synthetic
cattgtccctcaaaatagactggagatggccatgtggagaagctctctagtggagctcaacctggctctagcgga

SEQ ID NO: 217306 - DNA, 75 bp, Artificial Sequence
  Synthetic
gggtgaggcaaacctgactgttgtggtcgacaaggcagaccccagtgactacagggggggcgttcccgggctcct

SEQ ID NO: 217307 - DNA, 75 bp, Artificial Sequence
  Synthetic
taacaagggaaaagacattaaagtatcttggaggagttgggggcgatccatgctctggagtgttcccgaggcccc

SEQ ID NO: 217308 - DNA, 75 bp, Artificial Sequence
  Synthetic
tcgcaggttcatgattggagtggaaggaggtagagagtgcccctttgccagaaggaagacaggtgtgatgacggt

SEQ ID NO: 217309 - DNA, 75 bp, Artificial Sequence
  Synthetic
ggcagagtttgggattggtcttcgcacgaaagtcttcatggacttgcggcaagaattgacaacagagtgtgacac

SEQ ID NO: 217310 - DNA, 75 bp, Artificial Sequence
  Synthetic
aggggtcatgggggctgcggtcaagaatggaatggccgtccacactgatcaaagtctgtggatgaaatccatcaa

SEQ ID NO: 217311 - DNA, 75 bp, Artificial Sequence
  Synthetic
gaatgatacaactgtaacaatagttgagctgattgtgacagacctgagaaactgcacttggccagctagccacac

SEQ ID NO: 217312 - DNA, 75 bp, Artificial Sequence
  Synthetic
cattgacaatgccggagtagtgaactcaaagctgtttctaccggccagtctggctggacctaggtcaacctacaa

SEQ ID NO: 217313 - DNA, 75 bp, Artificial Sequence
  Synthetic
tgtgatacctggctatgcagagcaagtgaggggaccgtgggcgcacaccccggtcagaataaaaagagaagaatg

SEQ ID NO: 217314 - DNA, 75 bp, Artificial Sequence
  Synthetic
ccctggaacccgagtgaccattgacaaggcatgtgacaagagaggggcgtcggtgagaagcactacagagagtgg

SEQ ID NO: 217315 - DNA, 75 bp, Artificial Sequence
  Synthetic
gaaagtcatacccgaatggtgctgtcgcacctgtgagctgcccccggtcacatatcgcactgggactgattgttg

SEQ ID NO: 217316 - DNA, 75 bp, Artificial Sequence
  Synthetic
gtatgccatggagattaggccggtacacactcagggtggcctggtcagatccatggtagtggctgacaacggggc

SEQ ID NO: 217317 - DNA, 75 bp, Artificial Sequence
  Synthetic
tctactcagtgaaggtggagttccgggggtagtagcgctctttgtggttttggagctggtgattagaaggcgacc

SEQ ID NO: 217318 - DNA, 75 bp, Artificial Sequence
  Synthetic
agccacggggggcacggtgatctggggaggcattgccattctggctcttttggtgacgggactagtctctgtgga

SEQ ID NO: 217319 - DNA, 75 bp, Artificial Sequence
  Synthetic
gagtctgtttcgttaccttgtagcagtcggtctggtgtttcagctggaactgggaccagaggctgtggctatggt

SEQ ID NO: 217320 - DNA, 75 bp, Artificial Sequence
  Synthetic
gcttctacaggcagtttttgagatgagaacgtgtctactgagtgggtttgtgcttcgtagaagcataaccacgag

SEQ ID NO: 217321 - DNA, 75 bp, Artificial Sequence
  Synthetic
agaaattgtgacagtgtacttcctcctcctggtgttggagatgggcattccagtgaagggtctggagcatctctg

SEQ ID NO: 217322 - DNA, 75 bp, Artificial Sequence
  Synthetic
gagatggactgatgcgctggcgatgggggccatcatcttcagggcatgcactgcagaggggaagacaggcattgg

SEQ ID NO: 217323 - DNA, 75 bp, Artificial Sequence
  Synthetic
tttgcttttggctgcattcatgacccagagtgacatgaacatcatccatgatggcttgaccgcttttctttgtgt

SEQ ID NO: 217324 - DNA, 75 bp, Artificial Sequence
  Synthetic
ggccactaccatggccatatggagatacatcaggggccagggagagagaaaaggactgacatggatcgtcccgct

SEQ ID NO: 217325 - DNA, 75 bp, Artificial Sequence
  Synthetic
tgctggcatccttggaggagagggctcaggagtacgactgctggccttctgggagttggcggcctccagggggag

SEQ ID NO: 217326 - DNA, 75 bp, Artificial Sequence
  Synthetic
acgttcctttaatgagcctatgactgtcataggagtgatgctgactttggccagtggaatgatgcgccacacgtc

SEQ ID NO: 217327 - DNA, 75 bp, Artificial Sequence
  Synthetic
tcaggaggcggtgtgtgccatggcgctggcggctttccttctactcatgctcacgcttggaactaggaaaatgca

SEQ ID NO: 217328 - DNA, 75 bp, Artificial Sequence
  Synthetic
gttgttggctgagtggagtgggaacattgagtggaatccagaactgaccagtgagggcggtgaagtgagcctgcg

SEQ ID NO: 217329 - DNA, 75 bp, Artificial Sequence
  Synthetic
cgtcagacaagatgcccttggaaacttgcacctgactgaactggagaaggaggaacgcatgatggctttttggct

SEQ ID NO: 217330 - DNA, 75 bp, Artificial Sequence
  Synthetic
ggtggtaggcttgattgcctcggcctttcactggtcggggatccttatcgtcatgggactgtggaccatttcgga

SEQ ID NO: 217331 - DNA, 75 bp, Artificial Sequence
  Synthetic
gatgcttggctcacccaggagaacggatcttgtgttttcaggatgctccgaagggcgaagtgacagccgtccgct

SEQ ID NO: 217332 - DNA, 75 bp, Artificial Sequence
  Synthetic
cgatgtaaaaaatggagtgtaccgcatatatactccaggcctgctctggggacaaagacagattggagtgggcta

SEQ ID NO: 217333 - DNA, 75 bp, Artificial Sequence
  Synthetic
cggggcaaagggtgtgctacacaccatgtggcatgtcactaggggggctgccctgctggttgatggagttgcagt

SEQ ID NO: 217334 - DNA, 75 bp, Artificial Sequence
  Synthetic
gggcccctactgggctgatgtgcgggaggatgtggtttgttatggaggcgcctggagtctggaaagcaggtggag

SEQ ID NO: 217335 - DNA, 75 bp, Artificial Sequence
  Synthetic
gggtgagactgtgcaggtgcatgccttcccacccggcagggcacatgaaacacaccaatgccaacctggagagtt

SEQ ID NO: 217336 - DNA, 75 bp, Artificial Sequence
  Synthetic
gatattggagaatgggaggaagatgggagccattcccattgatctcgccaaaggaacatcaggcagtccaattat

SEQ ID NO: 217337 - DNA, 75 bp, Artificial Sequence
  Synthetic
gaactcacagggagaggtcgttggcctgtatggaaacggcctcaagactaatgacacgtatgtcagcagcatagc

SEQ ID NO: 217338 - DNA, 75 bp, Artificial Sequence
  Synthetic
acagggtgaagtggaaaaaagtagaccaaatctcccacagtcagtagttggcacgggctggacagccaagggaca

SEQ ID NO: 217339 - DNA, 75 bp, Artificial Sequence
  Synthetic
gatcacggtgttggatatgcaccctggctcggggaagacccatcgggtcctccctgagctcatccgtcaatgtgt

SEQ ID NO: 217340 - DNA, 75 bp, Artificial Sequence
  Synthetic
ggagcggcgattgcgaaccttggtcttggcccccacacgagtggtgctgagggagatggaacgcgcccttagtgg

SEQ ID NO: 217341 - DNA, 75 bp, Artificial Sequence
  Synthetic
ttggcccccacacgagtggtgctgagggagatggaacgcgcccttagtgggaagaacgtgcggttccattcgcct

SEQ ID NO: 217342 - DNA, 75 bp, Artificial Sequence
  Synthetic
gcagtcacagagcagcacgccaacggtgcaatcgttgatgtcatgtgccatgctacatatgtcaacagaagactc

SEQ ID NO: 217343 - DNA, 75 bp, Artificial Sequence
  Synthetic
ctcccacaggggagacaaaactgggaggtggctatcatggatgaggctcattggactgacccccacagtatagcg

SEQ ID NO: 217344 - DNA, 75 bp, Artificial Sequence
  Synthetic
gccagaggacacctctactcccttgccaaggaaaacagatgtgctttcgttctcatgacggcaacaccaccgggg

SEQ ID NO: 217345 - DNA, 75 bp, Artificial Sequence
  Synthetic
aagagtgaaccctttcctgagtccaacggagccatagccagtgaggagagacagatccctgatggggagtggcgg

SEQ ID NO: 217346 - DNA, 75 bp, Artificial Sequence
  Synthetic
gacgggtttgactggatcacagagtatgagggtaggacagcctggttcgttccgtcaattgccagaggaggagcc

SEQ ID NO: 217347 - DNA, 75 bp, Artificial Sequence
  Synthetic
atagcaagggctttgaggcagcgagggaagagtgtcatttgcttaaacagcaagacctttgacaaggagtactca

SEQ ID NO: 217348 - DNA, 75 bp, Artificial Sequence
  Synthetic
agagtgaaggatgaaaaacccgactttgtggtgaccacggacatatcagagatgggggcgaatcttgatgtcacc

SEQ ID NO: 217349 - DNA, 75 bp, Artificial Sequence
  Synthetic
cgcgtcattgatggccggacaaacatcaaaccggaggaggtggacggcaggatcgaactcacagggacgagacgt

SEQ ID NO: 217350 - DNA, 75 bp, Artificial Sequence
  Synthetic
gtgacaaccgcgtctgctgcacagcgcaggggaagagtgggcaggcaggggggtcgcacagatgaatacatatac

SEQ ID NO: 217351 - DNA, 75 bp, Artificial Sequence
  Synthetic
tcaggccagtgtgatgatgatgacagtggtcttgtgcagtggaaagaggcccagatactcttggacaacatcaca

SEQ ID NO: 217352 - DNA, 75 bp, Artificial Sequence
  Synthetic
acagcaagagggccggttgccacattctatggccctgagcaggagaggatgacagagacggcaggccactaccgc

SEQ ID NO: 217353 - DNA, 75 bp, Artificial Sequence
  Synthetic
ctgccagaggagaagagaaaacacttcagacatctgttggctcagtgtgatttcacaccatggctggcctggcat

SEQ ID NO: 217354 - DNA, 75 bp, Artificial Sequence
  Synthetic
gttgcggccaatgttgcttcagtgactgataggagctggacatgggaaggaccagaggaaaatgctgtggatgag

SEQ ID NO: 217355 - DNA, 75 bp, Artificial Sequence
  Synthetic
aacaatggagaactggtgacattcagaagcccaaatggagcagaaagaacactcaggcccgtatggagagacgcc

SEQ ID NO: 217356 - DNA, 75 bp, Artificial Sequence
  Synthetic
cgtatgtttagagagggccgtgacataagggagtttgtgtcctatgcttctggaagacgcagtgtgggagatgtg

SEQ ID NO: 217357 - DNA, 75 bp, Artificial Sequence
  Synthetic
ctcatgggaatgtctggggtgccagcgctcctacggcaaagatgcaccagtgcaatggatgtgttttacacgctc

SEQ ID NO: 217358 - DNA, 75 bp, Artificial Sequence
  Synthetic
atgcatgaagagcctgggagcagagccatgcgaatggctgaacgagatgcccctgaggccttcctgacggcagtg

SEQ ID NO: 217359 - DNA, 75 bp, Artificial Sequence
  Synthetic
gagatgcttgtcctggggcttgcaaccctgggagttgtctggtgttttgttgtgcgcacctcggtcagtaggatg

SEQ ID NO: 217360 - DNA, 75 bp, Artificial Sequence
  Synthetic
gtgttggggaccctagttctcgccacctcactgatcttcctgtgggccggaggtgttggctacgggaacatggct

SEQ ID NO: 217361 - DNA, 75 bp, Artificial Sequence
  Synthetic
ggggtggcactggtgttttacaccctactgacagtcctgcaaccggagaccggaaagcagcggagtagtgatgac

SEQ ID NO: 217362 - DNA, 75 bp, Artificial Sequence
  Synthetic
aacaaactggcatactttctgctaacattgtgcggcctggccgggatggtggctgccaatgaaatgggcctcttg

SEQ ID NO: 217363 - DNA, 75 bp, Artificial Sequence
  Synthetic
gagaaaactaaagcagatctcgcagcactcttcgctagagaccaaggggagactgtgcgatggggggagtggacc

SEQ ID NO: 217364 - DNA, 75 bp, Artificial Sequence
  Synthetic
aatttggacatccagccggcaagatcatggggcacatatgttctggtggtatctttgttcaccccctatatgctg

SEQ ID NO: 217365 - DNA, 75 bp, Artificial Sequence
  Synthetic
caccaattgcagacaagaatccagcagttggtgaacagtgcagtggcttcaggagcccaggcaatgagagatcta

SEQ ID NO: 217366 - DNA, 75 bp, Artificial Sequence
  Synthetic
gggggagggactcctttctttggtgtggcgggacatgtcttggcactcgggatcgcgtctctcgttggagcgacc

SEQ ID NO: 217367 - DNA, 75 bp, Artificial Sequence
  Synthetic
ccgacatctttaatcctgggagtcgggctggcggctttccacctggccatagtggtgtcgggactggaggcagag

SEQ ID NO: 217368 - DNA, 75 bp, Artificial Sequence
  Synthetic
ttaacacaaagggctcacaaagtgttcttctcggccatggtccggaacccaatggtggacggggatgtcatcaac

SEQ ID NO: 217369 - DNA, 75 bp, Artificial Sequence
  Synthetic
ccatttggagatggtgaggcaaagcctgcgctctatgagaggaagctcagccttatcctggctttggtgttgtgc

SEQ ID NO: 217370 - DNA, 75 bp, Artificial Sequence
  Synthetic
ttggcctcggtggtcatgaatcggacatttgtggcagttactgaggcaggagccgtgggagtggctgcagcaatg

SEQ ID NO: 217371 - DNA, 75 bp, Artificial Sequence
  Synthetic
cagttgctgagacctgagatggacgttttgtggactatgcctgtggcctgtggcatgagtggagtggtcagggga

SEQ ID NO: 217372 - DNA, 75 bp, Artificial Sequence
  Synthetic
agcctgtggggccttctgccactcggccacagactgtggctccggaccactgggacacggcgtggtggatccgag

SEQ ID NO: 217373 - DNA, 75 bp, Artificial Sequence
  Synthetic
ggagacaccctgggtgacatgtggaaggcccggttgaacagctgcacaaaagaggagttcttcgcctaccgcaga

SEQ ID NO: 217374 - DNA, 75 bp, Artificial Sequence
  Synthetic
gctggagtgatggagactgaccgtgaaaaggccagagagcttttaaaaagaggggaaactaacatgggcttggcg

SEQ ID NO: 217375 - DNA, 75 bp, Artificial Sequence
  Synthetic
gtttccaggggaacttccaagctggcatggatggaagagaggggctacgtcaccctgaaaggggaagtggtcgac

SEQ ID NO: 217376 - DNA, 75 bp, Artificial Sequence
  Synthetic
ctgggctgcggcagaggcggctggtcatactatgcagcatcacgaccagcggttatgagtgtgagagcatacacc

SEQ ID NO: 217377 - DNA, 75 bp, Artificial Sequence
  Synthetic
atcggtggaaagggacatgaatcaccacgcatggtaaccagcctcgggtggaacctgataaaattcagagcaggc

SEQ ID NO: 217378 - DNA, 75 bp, Artificial Sequence
  Synthetic
atggatgtgttctcaatggagcctcatcgagcagatgcaatcctatgtgacataggggaaagcaatccagacgca

SEQ ID NO: 217379 - DNA, 75 bp, Artificial Sequence
  Synthetic
gtggtggaaggagagagatcacggcgtgtgattcttcttatggagcaatggaaaaatcgcaatccaacagcgaca

SEQ ID NO: 217380 - DNA, 75 bp, Artificial Sequence
  Synthetic
tgtgtgttcaaggtcttggctccttatcgtcccgaggtaatagaggcactgcacaggttccaacttcaatgggga

SEQ ID NO: 217381 - DNA, 75 bp, Artificial Sequence
  Synthetic
gggggtcttgtgaggacacctttttcccgaaattccacccatgaaatgtacttctcaactgccatcacggggaac

SEQ ID NO: 217382 - DNA, 75 bp, Artificial Sequence
  Synthetic
attgtgaattcagtgaacatccagtctcgaaagctgctggctaggtttggagaccaaagagggccaacccgagtg

SEQ ID NO: 217383 - DNA, 75 bp, Artificial Sequence
  Synthetic
cccgagatcgatctgggtgtgggcactaggtgcgtagtgctggcagaggacaaggtcaaagaaaaagatgtgatg

SEQ ID NO: 217384 - DNA, 75 bp, Artificial Sequence
  Synthetic
gaaaggatccaggccttgaaggaccagtactgcgacacctggcacgaggatcatgaacatccatacagaacatgg

SEQ ID NO: 217385 - DNA, 75 bp, Artificial Sequence
  Synthetic
cagtactgggggagctacaagacagcggccacagggtcatcagcttcgctgctgaatggggtcgtgaagcttctc

SEQ ID NO: 217386 - DNA, 75 bp, Artificial Sequence
  Synthetic
agttggccatggaatgctagggaagatgtggtgcggatggcaatgactgacacaactgcattcgggcagcagagg

SEQ ID NO: 217387 - DNA, 75 bp, Artificial Sequence
  Synthetic
gtctttaaggacaaagtcgacaccaaggcacaggagccgcaacccgggaccaaaatcatcatgagagcggtgaat

SEQ ID NO: 217388 - DNA, 75 bp, Artificial Sequence
  Synthetic
gactggctgcttgagcgactggtcaagaagagtcggccacgcatgtgctccagggaggagttcatagcgaaagtc

SEQ ID NO: 217389 - DNA, 75 bp, Artificial Sequence
  Synthetic
cgttcgaatgcggcccttggcgcttggtcagatgagcaaaacaaatggaagagtgcgagagaagcagtggaagat

SEQ ID NO: 217390 - DNA, 75 bp, Artificial Sequence
  Synthetic
cctgagttctggagtcttgttgaggctgagagagagcgccacttgcaggggagatgcgcccattgtgtgtacaac

SEQ ID NO: 217391 - DNA, 75 bp, Artificial Sequence
  Synthetic
atgatggggaaaagagagaaaaagcttggtgaatttggagtagccaagggcagcagggccatctggtacatgtgg

SEQ ID NO: 217392 - DNA, 75 bp, Artificial Sequence
  Synthetic
ctgggcagtcggttcctggagtttgaggccctcggtttcctcaatgaggatcactgggcgtccagggcttctagt

SEQ ID NO: 217393 - DNA, 75 bp, Artificial Sequence
  Synthetic
ggagctggagtggaaggaatcagcctcaactacctggggtggcatttgaaaaaactggcttccttgagtggtggt

SEQ ID NO: 217394 - DNA, 75 bp, Artificial Sequence
  Synthetic
ctgttttatgccgacgacactgctggctgggacacgaggatcaccaatgcagatctggatgatgaggagcagatc

SEQ ID NO: 217395 - DNA, 75 bp, Artificial Sequence
  Synthetic
cttcgttacatggatggagaccacaagaaactggcggccacagtgctaaggaaggcctatcatgccaaggtggtg

SEQ ID NO: 217396 - DNA, 75 bp, Artificial Sequence
  Synthetic
agagtggctaggcccagccgtgaggggggctgtgtcatggacatcataacgcgtagagaccagagaggctcagga

SEQ ID NO: 217397 - DNA, 75 bp, Artificial Sequence
  Synthetic
caggttgtgacttatgctctaaacacaatcacaaacatcaaggtgcagctggtgaggatgatggaaggtgagggt

SEQ ID NO: 217398 - DNA, 75 bp, Artificial Sequence
  Synthetic
gtcattgaggtggcggactcccacaacccaagactgctacgtgtggaaaaatggctcgaagagcatggagaggaa

SEQ ID NO: 217399 - DNA, 75 bp, Artificial Sequence
  Synthetic
aggctgagcagaatgctggtgagcggtgacgactgtgtggtcaggccagtggatgacaggttcagcaaggccctt

SEQ ID NO: 217400 - DNA, 75 bp, Artificial Sequence
  Synthetic
tacttcctcaatgacatggcaaaaacccggaaagacaccggtgagtgggagccctcaaccggattcgctagctgg

SEQ ID NO: 217401 - DNA, 75 bp, Artificial Sequence
  Synthetic
gaagaggtccccttttgctcacaccactttcatgaacttgtgatgaaggacggacgcgctcttgtggtgccgtgc

SEQ ID NO: 217402 - DNA, 75 bp, Artificial Sequence
  Synthetic
cgtgaccaggatgagttggtgggcagggcacgtgtctcacctggctgcggctggagtgtgcgggagacggcctgt

SEQ ID NO: 217403 - DNA, 75 bp, Artificial Sequence
  Synthetic
ctatcgaaggcttacggacaaatgtggctgttgagctacttccacaggagggacttgaggactctggggttcgcc

SEQ ID NO: 217404 - DNA, 75 bp, Artificial Sequence
  Synthetic
atatgttcggcagtgcccgtggactgggtcccaacaggaagaacaacctggagcatacatgcaagtggtgcctgg

SEQ ID NO: 217405 - DNA, 75 bp, Artificial Sequence
  Synthetic
atgacaaccgaagacatgctggaggtgtggaaccgggtgtggatctatgacaacccattcatggaagacaagaca

SEQ ID NO: 217406 - DNA, 75 bp, Artificial Sequence
  Synthetic
agagttgatgagtggagagacactccatacctgccaaaatcacaggacatcctgtgttcatcattggtgggaagg

SEQ ID NO: 217407 - DNA, 75 bp, Artificial Sequence
  Synthetic
ggtgaaagagcagagtgggcaaagaacatctggggagccgtggagaaggtgagaaggatgatcggaccagaacac

SEQ ID NO: 217408 - DNA, 75 bp, Artificial Sequence
  Synthetic
tacagggactacttgtcaagcatggacagacacgacctacactgggagctcaaactggagagctcaatattttaa

SEQ ID NO: 217409 - DNA, 75 bp, Artificial Sequence
  Synthetic
agccagacacaaggagtccaacctggagggctcttgaaaaactcgtccagaaaccaaacaaatgagcaagtcaac

SEQ ID NO: 217410 - DNA, 75 bp, Artificial Sequence
  Synthetic
aggagatgataactcgtacgagctgatctccaacacacaagaaaaatggtgggatgcggcaacgcacgaggctcg

SEQ ID NO: 217411 - DNA, 75 bp, Artificial Sequence
  Synthetic
tgacggggaaatgatcgctcccgacgcacccctccattggagacaacttcgtgagatcccccaggtgtttagggg

SEQ ID NO: 217412 - DNA, 75 bp, Artificial Sequence
  Synthetic
cacacgcctgaggtaagcaagccccagggcgcattccggcagcacaccagtgagagtggtgacgggaaactggtc

SEQ ID NO: 217413 - DNA, 75 bp, Artificial Sequence
  Synthetic
actcccgacggagctgcgccttgtgaaactttgtgagaccccttgcgtccagagaaggccgaactgggcgttata

SEQ ID NO: 217414 - DNA, 75 bp, Artificial Sequence
  Synthetic
aggaggcccccagggggaaacccctgggaggagggaagagagaaattggcaactctcttcaggatatttcctcct

SEQ ID NO: 217415 - DNA, 75 bp, Artificial Sequence
  Synthetic
cctataccaaattccccctcgtcagagggggggcggttcttgttctccctgagccaccatcacctagacacagat

SEQ ID NO: 217416 - DNA, 75 bp, Artificial Sequence
  Synthetic
tctccctgagccaccatcacctagacacagatagtctgaaaaggaggtgatgcgtgtctcggaaaaacacccgct

SEQ ID NO: 217417 - DNA, 75 bp, Artificial Sequence
  Synthetic
taaccattgtggactatttggcaaagggagcatcgtaacctgcgtcaaggtaacttgtgaggacaaaaagaaggc

SEQ ID NO: 217418 - DNA, 75 bp, Artificial Sequence
  Synthetic
cggggatcctaggcatttttggttgcgcaattcaagtgtcctatttaaaatgggacagatagtgacattcttcca

SEQ ID NO: 217419 - DNA, 75 bp, Artificial Sequence
  Synthetic
actttgtattcatagtcctgcttgttgagaaggtactttccttttcttgagaagacttcagtgagctgcgacacg

SEQ ID NO: 217420 - DNA, 75 bp, Artificial Sequence
  Synthetic
ggaagtgcctcatgtaatagaagaggtgatgaacattgtactcattgcactgtctatactagcagtgctgaaggg

SEQ ID NO: 217421 - DNA, 75 bp, Artificial Sequence
  Synthetic
caccaggagggtactgtctgaccaggtggatgctaattgaagctgaactgaaatgctttggcaacacagctgtag

SEQ ID NO: 217422 - DNA, 75 bp, Artificial Sequence
  Synthetic
agaatctcaatattggtgatgctctcttgaactgatgaatcaaatgttcaatattgtcttctgcagccatcctat

SEQ ID NO: 217423 - DNA, 75 bp, Artificial Sequence
  Synthetic
tatcataccctaaactatccaaccggcttgcaaggaggattagaacgtcaaaaacaagaagaagttttcttctag

SEQ ID NO: 217424 - DNA, 75 bp, Artificial Sequence
  Synthetic
cagtctttacaaaggggtttatgagcttcagactctggaactaaacatggagacactcaatatgaccatgcctct

SEQ ID NO: 217425 - DNA, 75 bp, Artificial Sequence
  Synthetic
agtcataatccagaatgcgagacccatctgtatatttattcacaacaacactcttattgctggctaagtccaaag

SEQ ID NO: 217426 - DNA, 75 bp, Artificial Sequence
  Synthetic
tttgacttcaataaacaagctattcagaggttgaaagccgaagcacaaatgagtattcagttgatcaacaaagca

SEQ ID NO: 217427 - DNA, 75 bp, Artificial Sequence
  Synthetic
atacttctttgaaacaccaggccttttatagtctggtccctcgacacttgtgcatccatctttacttaaaaactt

SEQ ID NO: 217428 - DNA, 75 bp, Artificial Sequence
  Synthetic
tccttttctttaaataatgaaccattattaaaactagacacaaggagtgagataaattttttagaaacaccaggc

SEQ ID NO: 217429 - DNA, 75 bp, Artificial Sequence
  Synthetic
ccaccgcctattggcggtgggtcacgggggcgtccatttacaggacgactcttggtgtcgatgttctaaacacca

SEQ ID NO: 217430 - DNA, 75 bp, Artificial Sequence
  Synthetic
catcatggggattccatactgcaattacagcaagtactggtatctcaacaacacagccactgggaaaacatcact

SEQ ID NO: 217431 - DNA, 75 bp, Artificial Sequence
  Synthetic
tgttttaatctatcagacatcattgatttcagtgcaccaactaaaaggtgcggggaactatcaccaatctctctt

SEQ ID NO: 217432 - DNA, 75 bp, Artificial Sequence
  Synthetic
acacagccactgggaaaacatcactgcccaaatgttggcttatatcaaatggctcatatttgaacgaaactcact

SEQ ID NO: 217433 - DNA, 75 bp, Artificial Sequence
  Synthetic
tgcaatctgtctgatgcccacaaaaagaacctttatgaccacgctcttatgagcataatctcaactttccatttg

SEQ ID NO: 217434 - DNA, 75 bp, Artificial Sequence
  Synthetic
ttgtgattcaaggagtttccctatgtcatcagacccctgacaggtaatgaccatattccgggggagtgtgtctat

SEQ ID NO: 217435 - DNA, 75 bp, Artificial Sequence
  Synthetic
aagaccatctcccatcggttatcttgggctcctctcacaaagaaccagagatatttacattagtagaaggttact

SEQ ID NO: 217436 - DNA, 75 bp, Artificial Sequence
  Synthetic
gtcacgggggcgtccatttacaggacgactctgggtgtcgatgttctaaacaccatgtctctaggtagaaccgct

SEQ ID NO: 217437 - DNA, 75 bp, Artificial Sequence
  Synthetic
gattctgaaggcaaggacacaccagggggatattgtttgaccagatggatgctaattgaagctgaactaaaatgc

SEQ ID NO: 217438 - DNA, 75 bp, Artificial Sequence
  Synthetic
gcagtccatcaaagcacagtgaggtgttatctcctccttgccgcctcttttcttcttttcaacaacaacacctgt

SEQ ID NO: 217439 - DNA, 75 bp, Artificial Sequence
  Synthetic
tctgtcttgataatctctcgttatccactaggtactttgatactaagtctttgacataggctatgtcttcctcca

SEQ ID NO: 217440 - DNA, 75 bp, Artificial Sequence
  Synthetic
cttgttccttgtaagacaaagaaaattttagtctaccagtgtcagggccagttgaattataagattgaggtgatt

SEQ ID NO: 217441 - DNA, 75 bp, Artificial Sequence
  Synthetic
cagacttttcctcactggaatttagatccgcatacaagaatttaaggactggagaggctctctgaaactggaatg

SEQ ID NO: 217442 - DNA, 75 bp, Artificial Sequence
  Synthetic
gggacaatagttcactatgggataaggtcctgtaggaggcacaggggacacaagaggtaaataaagacaattaaa

SEQ ID NO: 217443 - DNA, 75 bp, Artificial Sequence
  Synthetic
acactttgagcattcacctgtcttttgatataatagtttgaatcccatcctattgatgaagaactcttggcaata

SEQ ID NO: 217444 - DNA, 75 bp, Artificial Sequence
  Synthetic
ggtcctgtaggaggcacaggggacacaagaggtaaataaagacaattaaaatagatagccttaatgcctaggatc

SEQ ID NO: 217445 - DNA, 75 bp, Artificial Sequence
  Synthetic
ttatgtcatcagatccctgacaggtgatgaccatgttccggggaagtgcctctatgacagcactggtcaagcctg

SEQ ID NO: 217446 - DNA, 75 bp, Artificial Sequence
  Synthetic
ctggaactgatgtcttgtgtgggaaccacgtgaaggaccccaatgtccttgtagtcgcaacaaatggtctcacat

SEQ ID NO: 217447 - DNA, 75 bp, Artificial Sequence
  Synthetic
atgttggcttgtgtcaaatggttcatacttaaacgagacccacttttctgatgatattgagcaacaagctgacaa

SEQ ID NO: 217448 - DNA, 75 bp, Artificial Sequence
  Synthetic
ttgcactgtctatactagcagtgctgaaaggtttgtacaattttgcaacatgtggtatcgttggtttggtcactt

SEQ ID NO: 217449 - DNA, 75 bp, Artificial Sequence
  Synthetic
acccagactaaaattgtaaccagaaatgttcagggagcttttgctggtgtctatcatttttagaatggggtggct

SEQ ID NO: 217450 - DNA, 75 bp, Artificial Sequence
  Synthetic
ttccctcaatgtccatccaggttttagcattgggatcaagctgcagcattgcatctttgagggtcataagctgag

SEQ ID NO: 217451 - DNA, 75 bp, Artificial Sequence
  Synthetic
caatcaagaatcttaaaatcaattccataagagttagtttctatgccaacctccctcaaagcattagtggctcga

SEQ ID NO: 217452 - DNA, 75 bp, Artificial Sequence
  Synthetic
tcagcctgttgcctccgctcaacccatttctcaagatccctttttgttgactctaaagaaactagtctatcattt

SEQ ID NO: 217453 - DNA, 75 bp, Artificial Sequence
  Synthetic
gctcacagccatttgcattgcaagaatcaacctcaatacaaagggacagaagtttcaatccttccattaaaagca

SEQ ID NO: 217454 - DNA, 75 bp, Artificial Sequence
  Synthetic
tccaccgttttaaatctctttttgttgattccaatgaaactaatctatcgttaacactcacaaaacaggagccca

SEQ ID NO: 217455 - DNA, 75 bp, Artificial Sequence
  Synthetic
taggtgttgatgttctaaataccatgtctctaggcagcactgctcttaaaacagatgtgttcagtcctcctgaga

SEQ ID NO: 217456 - DNA, 75 bp, Artificial Sequence
  Synthetic
ttaacactcacaaaacaggagcccagccaaccagcaaggagcccgtcaccatgctttatgcggtccaaccggcta

SEQ ID NO: 217457 - DNA, 75 bp, Artificial Sequence
  Synthetic
aggagagcccgtctctggtcaagttgttgtgaactcaagttgcccatataaactcctgcactcaatggcctttct

SEQ ID NO: 217458 - DNA, 75 bp, Artificial Sequence
  Synthetic
tcttgtcagtctttatgaattgactttctatgcctccctgcctcaacttgtttctgaagatttggtactcttcct

SEQ ID NO: 217459 - DNA, 75 bp, Artificial Sequence
  Synthetic
ccatcagccgccccaacggcgcccccagctggagcaggagacaacaccagacccccaccctacagtccctgaaca

SEQ ID NO: 217460 - DNA, 75 bp, Artificial Sequence
  Synthetic
ggggggaccccccgccgggggccccccgggggagccagccacctccaagattactcaatgtcctcaacaagttcg

SEQ ID NO: 217461 - DNA, 75 bp, Artificial Sequence
  Synthetic
ctccttcttcacttctctttctttaaatagtgagccattgttaaaagaagatgtaagaagggacaagtacttctt

SEQ ID NO: 217462 - DNA, 75 bp, Artificial Sequence
  Synthetic
tcaaagcattttatctggtctgtcagtctatctggtgtttcctttgtgatgaaatggcacatgtaagaaatgttt

SEQ ID NO: 217463 - DNA, 75 bp, Artificial Sequence
  Synthetic
tgtgattcaaggagtttccttatgtcatcagacccctgacaggtaatgaccatattccgggggagtgcatctatg

SEQ ID NO: 217464 - DNA, 75 bp, Artificial Sequence
  Synthetic
ggtatcaatcatgtttaagatggggtgactctgagtcaacctatctaagtctgaggcattagggtactttgctgt

SEQ ID NO: 217465 - DNA, 75 bp, Artificial Sequence
  Synthetic
gccattatgaagtatctaaggttttggaggagtttttgtgaacgtttgctggggtgagccagaatcaaaattaga

SEQ ID NO: 217466 - DNA, 75 bp, Artificial Sequence
  Synthetic
tatctcgggctcctctcacaaagaaccagagatatttacattagcagaagattgctgggcacattcacatggaca

SEQ ID NO: 217467 - DNA, 75 bp, Artificial Sequence
  Synthetic
cctgtccttgttttgttaaacatgccaatgtcagacttggcatagtgccgaactgattgttaagtaggtctgcat

SEQ ID NO: 217468 - DNA, 75 bp, Artificial Sequence
  Synthetic
atggatgctaattgaggctgaactgaaatgctttgggaacacagctgtggcaaaatgcaatgagaagcatgatga

SEQ ID NO: 217469 - DNA, 75 bp, Artificial Sequence
  Synthetic
cacagcaaagagtcaagactatctgctgaatgacaagagcaaagcgcaatccaatagcctaggatccactgtgcg

SEQ ID NO: 217470 - DNA, 75 bp, Artificial Sequence
  Synthetic
ccggggatcctaggcaatttggttgttcttctttttaggtcatttttgccaaactccaccagatgggaaacaagc

SEQ ID NO: 217471 - DNA, 75 bp, Artificial Sequence
  Synthetic
aaactccaccagatgggaaacaagcaagtcaagacctcagaggcaagggacagcccaagggccagtctgattccg

SEQ ID NO: 217472 - DNA, 75 bp, Artificial Sequence
  Synthetic
accaacagatcatctgaggttagagttcctactctcagcacacttttctgttgggtagatttcagctcaacaagg

SEQ ID NO: 217473 - DNA, 75 bp, Artificial Sequence
  Synthetic
ttaaaacaaacttgaatctattggtcatcatactgacaacttcttcagacagaattatctttaataagtgacgaa

SEQ ID NO: 217474 - DNA, 75 bp, Artificial Sequence
  Synthetic
aagtcaagacctcagaggcaagggacagcccaagggccagtctgattccggacgctacagacctaggaccacagt

SEQ ID NO: 217475 - DNA, 75 bp, Artificial Sequence
  Synthetic
cctcaatgtacttctgctcaaagttagcaggagatgacctaacaaaacactccagcagtattagaacattgcccg

SEQ ID NO: 217476 - DNA, 75 bp, Artificial Sequence
  Synthetic
ctgattccaagtcaacgacagtgttttcccaggctcttcctgttattgaggtccttgatgcaatatatggccatc

SEQ ID NO: 217477 - DNA, 75 bp, Artificial Sequence
  Synthetic
tcattctttaattgttctagtttcttgtgatcttctaaatacttctgttcaaaattggcgggggatgatctaaca

SEQ ID NO: 217478 - DNA, 75 bp, Artificial Sequence
  Synthetic
tccagcagtattagaacattgcccgtcagtttgtaaccgtccggcaccacaaaacatagtgaaggtgtcaagatt

SEQ ID NO: 217479 - DNA, 75 bp, Artificial Sequence
  Synthetic
cactacttatgccttaattgcctcactctacttctgagtgttagcaacaggtgtcccatctgcaagatgcccctt

SEQ ID NO: 217480 - DNA, 75 bp, Artificial Sequence
  Synthetic
ccatggtcatggagaattctttccacagatttgtcctcactattatgctcgcaaccatttgcgttgcaagaatca

SEQ ID NO: 217481 - DNA, 75 bp, Artificial Sequence
  Synthetic
gtgtcccatctgcaagatgccccttcccacaagactaaggccatcagccaacccaacagcacccccagccgaaac

SEQ ID NO: 217482 - DNA, 75 bp, Artificial Sequence
  Synthetic
tggctgacacaacattaaaaggtatctcaaccattttgtgcatatgccatgttagcaatgttgaaagataatctc

SEQ ID NO: 217483 - DNA, 75 bp, Artificial Sequence
  Synthetic
ggactttacctcctttgaagcactcattgccaggttgtcgtgttgtatgtagacagcggagagctgaaactgtct

SEQ ID NO: 217484 - DNA, 75 bp, Artificial Sequence
  Synthetic
attgccaggttgtcgtgttgtatgtagacagcggagagctgaaactgtctgctaaaatgacaagagcaaagcgca

SEQ ID NO: 217485 - DNA, 75 bp, Artificial Sequence
  Synthetic
gtctgaggtgacaccttgattgtctccaacatattgccaccatccagcatgcaagctcctgccttcacagctgca

SEQ ID NO: 217486 - DNA, 75 bp, Artificial Sequence
  Synthetic
agtgctttgcacgattatcaattagagcattgatgctttctattccggagagtctaccagaagttaaagctaatg

SEQ ID NO: 217487 - DNA, 75 bp, Artificial Sequence
  Synthetic
cctccgaggaactactcaatgtcctcaacatactcatctttctcagttaactcctcacatgttctgccttttagc

SEQ ID NO: 217488 - DNA, 75 bp, Artificial Sequence
  Synthetic
cctcacaggttgaatcacatgggcatatgttcctgcggactctataaacagcccggtgtgcctgtaaaatggaag

SEQ ID NO: 217489 - DNA, 75 bp, Artificial Sequence
  Synthetic
tccaaccaaaatgggtaacagacaggctaaatcagccaaagttactgagcatcagagagcacatctagtgccgga

SEQ ID NO: 217490 - DNA, 75 bp, Artificial Sequence
  Synthetic
cctggtacccagcagatggggaacaagcaagccaaagcttcagaagcaaaagacagcccgagggctagtctgatt

SEQ ID NO: 217491 - DNA, 75 bp, Artificial Sequence
  Synthetic
tccatgtctggccacgagtatgttggtcagaaccctcaaaacatgtgatctgctagagcaacagttcaccacagg

SEQ ID NO: 217492 - DNA, 75 bp, Artificial Sequence
  Synthetic
ccagggtcccgtggggggcacaagggatacaagaggcaattaaagacaattaaattagatagccttaatgcctag

SEQ ID NO: 217493 - DNA, 75 bp, Artificial Sequence
  Synthetic
gtcacgggggcgtccatttacaggacgactctaggtgtcgatgttctgaacaccatgtctctgggtagcactgct

SEQ ID NO: 217494 - DNA, 75 bp, Artificial Sequence
  Synthetic
ggggatcctaggcatttaggattgcgcttttagagatctttgtgtgagtgggcttcatcaagccatgggacaaat

SEQ ID NO: 217495 - DNA, 75 bp, Artificial Sequence
  Synthetic
ccccccggggggaccccccgccgggggcccccccgggggagccaaccatcaccaaaagactactcaatgtcctcg

SEQ ID NO: 217496 - DNA, 75 bp, Artificial Sequence
  Synthetic
ttatctgtgtctcaattgccttagtttgctccttagcgtcagcagcagatgcccaatctgcaagatgccccttcc

SEQ ID NO: 217497 - DNA, 75 bp, Artificial Sequence
  Synthetic
aatcactatctgtgtctcaactgcctcagtctgcttctgagtgtcagcagcaggtgccccatctgcaaaatgccc

SEQ ID NO: 217498 - DNA, 75 bp, Artificial Sequence
  Synthetic
gaccatatcacttaatgtcctgatcaacaggtcaggtgaagtgtccccaacctctttcacaaacatctcaagatc

SEQ ID NO: 217499 - DNA, 75 bp, Artificial Sequence
  Synthetic
caggtgccccatctgcaaaatgcccctcccgacaagactgaggccatcaacagccccaacagcacccccagccag

SEQ ID NO: 217500 - DNA, 75 bp, Artificial Sequence
  Synthetic
ttgctccttagcgtcagcagcagatgcccaatctgcaagatgccccttcccaccagactaaaggcagcgacacaa

SEQ ID NO: 217501 - DNA, 75 bp, Artificial Sequence
  Synthetic
caccccgtaaactccgaacccacacctccacctccacaacccaccccccacccccggggggaccccccgccgggg

SEQ ID NO: 217502 - DNA, 75 bp, Artificial Sequence
  Synthetic
accccaccactcctcccaccccccgacaccccccggggggaccccccgccgggggcccccccgggggagccgacc

SEQ ID NO: 217503 - DNA, 75 bp, Artificial Sequence
  Synthetic
gtggcctctttgggttggtgtcctttcttctcttatgtggaaggtcatgctcaacaacttacaagggtgtttatg

SEQ ID NO: 217504 - DNA, 75 bp, Artificial Sequence
  Synthetic
ttggtcctgtataacaggtgtgaaagatgccaacttcttcccacattcccatagacctcctctatgtacaaccag

SEQ ID NO: 217505 - DNA, 75 bp, Artificial Sequence
  Synthetic
agctagacatggcaagccttaatatgacaatgcccttgtcttgcacgaagaacaactcccaccattacatcatgg

SEQ ID NO: 217506 - DNA, 75 bp, Artificial Sequence
  Synthetic
tgattttaactcaacaaggttgttgaccgcttgatttaggtccctcaatcgtttcaaatcattgtcatcccttct

SEQ ID NO: 217507 - DNA, 75 bp, Artificial Sequence
  Synthetic
atgttcttccctttaatctgaggctacccctgcttgactggatcataaccttttgctttgatttgctataacaaa

SEQ ID NO: 217508 - DNA, 75 bp, Artificial Sequence
  Synthetic
tctcaatttgccactgcttgactgcaccatcactctcctccttgacttactgtagcaaagggcataacccttgaa

SEQ ID NO: 217509 - DNA, 75 bp, Artificial Sequence
  Synthetic
ctccacctccacaacccaccccccacccccggggggaccccccgccgggggcccccccggggggtggacagcctg

SEQ ID NO: 217510 - DNA, 75 bp, Artificial Sequence
  Synthetic
agccacaagttctgtaacctttctgatgcacataaaaagaatctttatgaccatgctttaatgagtattatctca

SEQ ID NO: 217511 - DNA, 75 bp, Artificial Sequence
  Synthetic
acccctgcttgactggatcataaccttttgctttgatttgctataacaaagggcataacctttgaaatcaatcca

SEQ ID NO: 217512 - DNA, 75 bp, Artificial Sequence
  Synthetic
agtctgacaagacacatgggcttactgcaccagaatacataacagttacatcgtgtaccaaatacttggcctgtt

SEQ ID NO: 217513 - DNA, 75 bp, Artificial Sequence
  Synthetic
gtctttgttttgctagaactgagacaatgtccacacctgtccactgagctctttgtttcaatctatcagacatca

SEQ ID NO: 217514 - DNA, 75 bp, Artificial Sequence
  Synthetic
ggaaacaatgtccacccctgaccactgcattctcaacccaagcctatccaacatcatgttactcaatgcctcgat

SEQ ID NO: 217515 - DNA, 75 bp, Artificial Sequence
  Synthetic
aatgtccacacctgtccactgagctctttgtttcaatctatcagacatcattgaacctagtgcgtcgaccagaag

SEQ ID NO: 217516 - DNA, 75 bp, Artificial Sequence
  Synthetic
acatcataggaccccatttactatgatccatgctgtaggagacgtgtgccaaagagacattgagtttcatagaca

SEQ ID NO: 217517 - DNA, 75 bp, Artificial Sequence
  Synthetic
ttttcttttttgggttttttaggtttttggttttttggttttttggtttttggttttttggttttgtacgcagaa

SEQ ID NO: 217518 - DNA, 75 bp, Artificial Sequence
  Synthetic
acctcactgtctgacttagctttgcagaccctgaaggtaatgatgcaacagcatcaaaaaaatcctctaatgagt

SEQ ID NO: 217519 - DNA, 75 bp, Artificial Sequence
  Synthetic
cctgaataattggcgtaaatgtagcaattcttctatcagattcccatagcgctcctctacagacaactaacggca

SEQ ID NO: 217520 - DNA, 75 bp, Artificial Sequence
  Synthetic
ggatgccaatttcttttcacattcccataaactccctctatgcacaaccaatgggactggttcagtacaggggcc

SEQ ID NO: 217521 - DNA, 75 bp, Artificial Sequence
  Synthetic
aattcttctatcagattcccatagcgctcctctacagacaactaacggcacaggttcgttatcaggaccgatctt

SEQ ID NO: 217522 - DNA, 75 bp, Artificial Sequence
  Synthetic
tgcaccagaatacataacagttacatcgtgtaccaaatacttggcctgttgattcatagtgccagtgtaatcaag

SEQ ID NO: 217523 - DNA, 75 bp, Artificial Sequence
  Synthetic
gccacacacctagggccacagttctgcaagagctgctggttcgaaaacaagggcctggttgagtgcaacaaccac

SEQ ID NO: 217524 - DNA, 75 bp, Artificial Sequence
  Synthetic
tgcattctcaacccaagcctatccaacatcatgttactcaatgcctcgatcaacaaatcagatgaggtgtcccca

SEQ ID NO: 217525 - DNA, 75 bp, Artificial Sequence
  Synthetic
tcataggtacaacatttcccaattgctgtgtgtcctttaaaaactcatttactacatctgactcaacataccaaa

SEQ ID NO: 217526 - DNA, 75 bp, Artificial Sequence
  Synthetic
tagctggtttgtgtcaaccaaaaactcattaatgatctcagtatcaacataccacgctgacttgcccttgaaagt

SEQ ID NO: 217527 - DNA, 75 bp, Artificial Sequence
  Synthetic
atgaggaaaatggacccagtctatgcagtccttcaccctctggaatcgatgtcttatgtggaaaccaggtaaagg

SEQ ID NO: 217528 - DNA, 75 bp, Artificial Sequence
  Synthetic
ctgtgtgtcctttaaaaactcatttactacatctgactcaacataccaaactgatctacctttgaaggttgggcc

SEQ ID NO: 217529 - DNA, 75 bp, Artificial Sequence
  Synthetic
aggtcccgacaaaactaacctccaacagtctgacaagacacatggactaactgcaccagaatacatggcagtcac

SEQ ID NO: 217530 - DNA, 75 bp, Artificial Sequence
  Synthetic
tccattgtctgaggtgacaccttgattgtctctaacatgttgccaccatctagcatgcaagctcctgctttcaca

SEQ ID NO: 217531 - DNA, 75 bp, Artificial Sequence
  Synthetic
cagaatatagtgcttgcacatcactcactacgaactcaccacattgattgacaagtcctctcatgttgaggtgga

SEQ ID NO: 217532 - DNA, 75 bp, Artificial Sequence
  Synthetic
ttgtctctaacatgttgccaccatctagcatgcaagctcctgctttcacagctgcacccaaactgaaattataac

SEQ ID NO: 217533 - DNA, 75 bp, Artificial Sequence
  Synthetic
ggacagcatcggaccaccaccctacagtccctgaatccctcaccgactcccaccactctcaccctccccccgaca

SEQ ID NO: 217534 - DNA, 75 bp, Artificial Sequence
  Synthetic
ctagtatgagacaacctcaattcagaagatagcacaatataatgttcctctcttttccatttcactatgtgtgaa

SEQ ID NO: 217535 - DNA, 75 bp, Artificial Sequence
  Synthetic
actgtctggtggaattgaacagagcctattggcattgtgctcaacaaatcaaggaaatcttcaaaggactccaac

SEQ ID NO: 217536 - DNA, 75 bp, Artificial Sequence
  Synthetic
actagcatcttggctcttaatgcggaacctcactgtctgactcaattttgcagaccctgaaggcaataatgctac

SEQ ID NO: 217537 - DNA, 75 bp, Artificial Sequence
  Synthetic
aaattttatcctgggtgaccacttcattttggttgacgccaaatcgctcataaatggtaatatgtgtttctcaaa

SEQ ID NO: 217538 - DNA, 75 bp, Artificial Sequence
  Synthetic
atgcaatcagttgattctgattgaacttggcaggctcaatgtcaaagtctatccaagcataacccatcattaaat

SEQ ID NO: 217539 - DNA, 75 bp, Artificial Sequence
  Synthetic
cagtgttagacttggcatggtcccaaactgattattaagcaactcagcattttttacatcccaaactctcaccac

SEQ ID NO: 217540 - DNA, 75 bp, Artificial Sequence
  Synthetic
cttcaatcaatcttgtgaacatcttggtcctcagatcaccaatgtacaactccctgttaccaccaacctgttcct

SEQ ID NO: 217541 - DNA, 75 bp, Artificial Sequence
  Synthetic
gctcgaagttggcaggggatgatctaacaaaacattcaagcagaatcaaaacattgccagtgaatttatagccat

SEQ ID NO: 217542 - DNA, 75 bp, Artificial Sequence
  Synthetic
cttggcaggctcaatgtcaaagtctatccaagcataacccatcattaaatcatgtttgaacattggtctttcaac

SEQ ID NO: 217543 - DNA, 75 bp, Artificial Sequence
  Synthetic
gcaatccttcaccttctgggaccgacgtcttatgtgggaaccaagtgaaagaccccaatgttcttgttgtggcaa

SEQ ID NO: 217544 - DNA, 75 bp, Artificial Sequence
  Synthetic
cgtcttatgtgggaaccaagtgaaagaccccaatgttcttgttgtggcaacaaatggtctcacataagactcaaa

SEQ ID NO: 217545 - DNA, 75 bp, Artificial Sequence
  Synthetic
caagacccatgcacctagttctattgcagtcgataaggaaatgcacatgtagtcccataacagaggtctaaaata

SEQ ID NO: 217546 - DNA, 75 bp, Artificial Sequence
  Synthetic
gcagtcgataaggaaatgcacatgtagtcccataacagaggtctaaaataactaaccacagcttcacctctgttt

SEQ ID NO: 217547 - DNA, 75 bp, Artificial Sequence
  Synthetic
cctccaccataggctcatgtgtgcgagaatgcgaatttctcaattcagaagccaacacaacatagtgttcctccc

SEQ ID NO: 217548 - DNA, 75 bp, Artificial Sequence
  Synthetic
tttcttctaccataggttcatgtgttctagtatgagataatcttaattcagatgacaatacaatataatgctctt

SEQ ID NO: 217549 - DNA, 75 bp, Artificial Sequence
  Synthetic
gtaatgaaatgacacatataagaaatatttaaaacgaacttgaatctattagtcatcatactgacaacttcttca

SEQ ID NO: 217550 - DNA, 75 bp, Artificial Sequence
  Synthetic
caattcgatcccctgagtaccagaaattgaagactgtatggatttaatatatagattctctttatttggcccccg

SEQ ID NO: 217551 - DNA, 75 bp, Artificial Sequence
  Synthetic
attgaagactgtatggatttaatatatagattctctttatttggcccccgaacacatttgctacccagtgttcta

SEQ ID NO: 217552 - DNA, 75 bp, Artificial Sequence
  Synthetic
tctagtatgagataatcttaattcagatgacaatacaatataatgctcttctctcttccacttaactatgtgtga

SEQ ID NO: 217553 - DNA, 75 bp, Artificial Sequence
  Synthetic
gaaattttattctaggtgaccacttcattttggtggatgccaaatcactcatgaatggtaatatgtgtttctcaa

SEQ ID NO: 217554 - DNA, 75 bp, Artificial Sequence
  Synthetic
tgtacctgtatggcgtgtgggtcagctggtagtgccccacaaaagctcttacagaaatgagagacaatatgccaa

SEQ ID NO: 217555 - DNA, 75 bp, Artificial Sequence
  Synthetic
actttattctgggtgaccatttcatctttgtggaagctagatcactcataaatggtaatatgtgcttttcaaaca

SEQ ID NO: 217556 - DNA, 75 bp, Artificial Sequence
  Synthetic
gatagcttcagataataatttttgtgcacctcgagtgaaggtagaagatagcttattctgaatagtcttaacaat

SEQ ID NO: 217557 - DNA, 75 bp, Artificial Sequence
  Synthetic
atccccagattgttgtgttggatgcacgtagcagaaagctgaaactttctactgaagtgacaaaagcaaagcgca

SEQ ID NO: 217558 - DNA, 75 bp, Artificial Sequence
  Synthetic
tcctgacacagctgcatcatacattatgcaatccattagagcacagtgtggggtaatttcttctttacctcctct

SEQ ID NO: 217559 - DNA, 75 bp, Artificial Sequence
  Synthetic
ttcattgagccaatatactcaaggtggatggcaaagctttccttaaaactagcatcttgacttttaatacggaac

SEQ ID NO: 217560 - DNA, 75 bp, Artificial Sequence
  Synthetic
ctgtcttccagtaattttgaaacagtgggtctcaaggggaaatagtcacaaggattgtgtttaaaaaagtccaaa

SEQ ID NO: 217561 - DNA, 75 bp, Artificial Sequence
  Synthetic
cagttggtttcaaggggaaataatcacatgggttgtgcttgaagaactccaatgccttaaccgttttaggttctc

SEQ ID NO: 217562 - DNA, 75 bp, Artificial Sequence
  Synthetic
gtggtgtgcagctaaatttagccaagaatactcaaggtcagactcagatgggggttcaacatctaagagttcaca

SEQ ID NO: 217563 - DNA, 75 bp, Artificial Sequence
  Synthetic
agtccgagagccagcctgatcccagatgccacacatctagggccacaattctgcaagagctgctggttcgaaaac

SEQ ID NO: 217564 - DNA, 75 bp, Artificial Sequence
  Synthetic
tcccataaaagaggccttaaataagtgacagctggatcatctctgcccttggcctctgatgaaaccctccatatt

SEQ ID NO: 217565 - DNA, 75 bp, Artificial Sequence
  Synthetic
aactgatcacaccttcatttttactcctaaggtccaatggaactcgccaatattgaacaccattagaatttgtta

SEQ ID NO: 217566 - DNA, 75 bp, Artificial Sequence
  Synthetic
gccggggatcctaggcaatttggttgttcttttcggagaccttgtgttaaactcccccaaaatggggaacaagca

SEQ ID NO: 217567 - DNA, 75 bp, Artificial Sequence
  Synthetic
tctcctgcacaaagaacaacagtcatcattacataatggtgggtaatgagacaggactggaactgaccttgacca

SEQ ID NO: 217568 - DNA, 75 bp, Artificial Sequence
  Synthetic
taacctgttgtacagctttcttagcatagacctaatcttactgcaagcgtcaggaatcaacccctctatttgcct

SEQ ID NO: 217569 - DNA, 75 bp, Artificial Sequence
  Synthetic
gatactttggggtttaccggttgagatttttactcagtaagttaatgaaaagcgcaatccaatagcctaggatcc

SEQ ID NO: 217570 - DNA, 75 bp, Artificial Sequence
  Synthetic
aggttctccttattgggacccctgacgcacttactacccagtgttctacacaatcctacaaatccggatgctata

SEQ ID NO: 217571 - DNA, 75 bp, Artificial Sequence
  Synthetic
gaacacatttgctacctaatgttctgcacaatccaacaaagccagatgcaatagaactttgaaatgcagatttgt

SEQ ID NO: 217572 - DNA, 75 bp, Artificial Sequence
  Synthetic
ccacaaaactgagaccatcaaccgcaccaacggcacccccagctggagcagcagacagcaccaggcccccaccct

SEQ ID NO: 217573 - DNA, 75 bp, Artificial Sequence
  Synthetic
cttgtgtggaaaccacgtgaaggaccccaatgtccttgtggtcgcaacaaatggtctcacataagactcaaaata

SEQ ID NO: 217574 - DNA, 75 bp, Artificial Sequence
  Synthetic
agggtatctggcatattgtaaaagactcaaggtcctcatctgtattaagttgcataaatgaacagggacaccatt

SEQ ID NO: 217575 - DNA, 75 bp, Artificial Sequence
  Synthetic
cgcacttactacccagtgttctacacaatcctacaaatccggatgctatagagctttggaaagctgacttattta

SEQ ID NO: 217576 - DNA, 75 bp, Artificial Sequence
  Synthetic
ctattttgcaaggtttttactatcgtagggatcttctcatcttccaggttaacagcgccagaataaattatcttc

SEQ ID NO: 217577 - DNA, 75 bp, Artificial Sequence
  Synthetic
tagtgggaatcttttcatcatccaggttaacagcacctgagtatatcaccttttgcctcagcaccatccttaggg

SEQ ID NO: 217578 - DNA, 75 bp, Artificial Sequence
  Synthetic
cttccaccatgggttcatgtgtcctgctgtgagacaacctcaattcagacgacaatacaatgtaatgttcctctc

SEQ ID NO: 217579 - DNA, 75 bp, Artificial Sequence
  Synthetic
tgcataaatgaacagggacaccattcgcaactgattggtcaatgattgtgtcaattgtttctgccagctgatgtg

SEQ ID NO: 217580 - DNA, 75 bp, Artificial Sequence
  Synthetic
tagggatcttctcatcttccaggttaacagcgccagaataaattatcttctgccgcaataccatcctaagaggat

SEQ ID NO: 217581 - DNA, 75 bp, Artificial Sequence
  Synthetic
gcacaatccaacaaagccagatgcaatagaactttgaaatgcagatttgttgatggcttcagataataatttctg

SEQ ID NO: 217582 - DNA, 75 bp, Artificial Sequence
  Synthetic
ggttcaatgcctagaagcttgaataaattctgtagtgatgttgtgtgttcacctgataagtagttggtggtgaac

SEQ ID NO: 217583 - DNA, 75 bp, Artificial Sequence
  Synthetic
ataagtttctcaatgacgagatgtgctcactagacaagtagtttgttgtgaattcctcatgaagttgtccagtct

SEQ ID NO: 217584 - DNA, 75 bp, Artificial Sequence
  Synthetic
acacagcacctccaccgtatgccccatgatcccaagaccaacactcccatctccaccacccaccccccgcccccg

SEQ ID NO: 217585 - DNA, 75 bp, Artificial Sequence
  Synthetic
aattctgtagtgatgttgtgtgttcacctgataagtagttggtggtgaactcttcgtgaagatcaccagttttta

SEQ ID NO: 217586 - DNA, 75 bp, Artificial Sequence
  Synthetic
gttaacagcacctgagtatatcaccttttgcctcagcaccatccttaggggatgatgtgcagccaagttcaacca

SEQ ID NO: 217587 - DNA, 75 bp, Artificial Sequence
  Synthetic
ctcactagacaagtagtttgttgtgaattcctcatgaagttgtccagtcttcaatctattgtagagtcttcttaa

SEQ ID NO: 217588 - DNA, 75 bp, Artificial Sequence
  Synthetic
ggaatcagcctctcaatctgcctcattattctataactacggtttccatctacccaatctctcacatcagtttcg

SEQ ID NO: 217589 - DNA, 75 bp, Artificial Sequence
  Synthetic
caaagagggagatttgatcatcactagaagtgtaagcatctattgtgccaccacatatgcaactaatagcatagt

SEQ ID NO: 217590 - DNA, 75 bp, Artificial Sequence
  Synthetic
tcatgattctgtaactgcggttgccatccacccagtccctaacatctgtctcgcaatttaacaagaatgggtcaa

SEQ ID NO: 217591 - DNA, 75 bp, Artificial Sequence
  Synthetic
ttattctataactacggtttccatctacccaatctctcacatcagtttcgcagtttaaaaggaatggatcaatgg

SEQ ID NO: 217592 - DNA, 75 bp, Artificial Sequence
  Synthetic
agaagtgtaagcatctattgtgccaccacatatgcaactaatagcatagttaataaacctttctgaaatgagagc

SEQ ID NO: 217593 - DNA, 75 bp, Artificial Sequence
  Synthetic
aagccccccctatgcacaaccagagggactggctcagtacaaggacccaccaatacaaagtcatactctgtaaac

SEQ ID NO: 217594 - DNA, 75 bp, Artificial Sequence
  Synthetic
agctaatatgagaaggcaccacaccgatttgaaaattagagtgaaagaaatcttctgttattgactgtgtagttt

SEQ ID NO: 217595 - DNA, 75 bp, Artificial Sequence
  Synthetic
ttgcgactgattgatcaataatagtgtcaattgtttctgccagttggtgcggctctttgcactttatattgtgga

SEQ ID NO: 217596 - DNA, 75 bp, Artificial Sequence
  Synthetic
tgggaattccatactgtaattacagcaagtattggtacctcaaccacacaactactgggaaaacatcactgccca

SEQ ID NO: 217597 - DNA, 75 bp, Artificial Sequence
  Synthetic
gttcctaagttctagtggaacttgccaatattgaatgccattagagtttgtcaataacttgattcccctaacatt

SEQ ID NO: 217598 - DNA, 75 bp, Artificial Sequence
  Synthetic
atccacccagtccctaacatctgtctcgcaatttaacaagaatgggtcaatgggatatctagcgtattgcaagag

SEQ ID NO: 217599 - DNA, 75 bp, Artificial Sequence
  Synthetic
actacattgaaaggtatctccaccattttgtgcatatgccacataagcaaggttgagaggtagtctcttcctttt

SEQ ID NO: 217600 - DNA, 75 bp, Artificial Sequence
  Synthetic
aaccttgatttgaattctgcaacaaatctgccaattgcgctcttcggactcacaaacttattcaattgatcactc

SEQ ID NO: 217601 - DNA, 75 bp, Artificial Sequence
  Synthetic
cgaacctaccaatgacactcttgggacttacaaatttattaagttggtcactcatgtagtagtgaaactccatca

SEQ ID NO: 217602 - DNA, 75 bp, Artificial Sequence
  Synthetic
ttaatgatttcggtgtcaacataccatgctgatttgcccttaaaagtaggccctgacatgaccagtctccagcag

SEQ ID NO: 217603 - DNA, 75 bp, Artificial Sequence
  Synthetic
gtcaattgtttctgccagttggtgcggctctttgcactttatattgtggagggctgcagcaacaaacttcgttaa

SEQ ID NO: 217604 - DNA, 75 bp, Artificial Sequence
  Synthetic
gtgtcctaaattcttctgggtctctttctaaaagctctgtgagagtttgatcaaagagggagatttgatcatcac

SEQ ID NO: 217605 - DNA, 75 bp, Artificial Sequence
  Synthetic
aagcaattctgttaagctctgatcaaataatgatatttgatcatcactagatgtgtaagcatcaacttgtccccc

SEQ ID NO: 217606 - DNA, 75 bp, Artificial Sequence
  Synthetic
ccatgcctatcatgttcagcaatgctcttctttgctcaagctgctgtgtactcaaattccccatgtaaacacctg

SEQ ID NO: 217607 - DNA, 75 bp, Artificial Sequence
  Synthetic
ctgcgcacctcgagtgaaagtggaagacaatttgttttggattgttttgacaatggtggggatcttttcatcatc

SEQ ID NO: 217608 - DNA, 75 bp, Artificial Sequence
  Synthetic
accctggaggtagtgaagccacagcgtcaaagaagtcctccaatgagtcaaacctagaatcaaccaagcctgatg

SEQ ID NO: 217609 - DNA, 75 bp, Artificial Sequence
  Synthetic
aataatgatatttgatcatcactagatgtgtaagcatcaacttgtcccccagacacgcactttatcgcaaagttt

SEQ ID NO: 217610 - DNA, 75 bp, Artificial Sequence
  Synthetic
gccctgtcccatgtcgaggattgaactaatgtgtgaaggaactgtaccgacctgaaagttagaattaaaaaagtc

SEQ ID NO: 217611 - DNA, 75 bp, Artificial Sequence
  Synthetic
ctaatgtgtgaaggaactgtaccgacctgaaagttagaattaaaaaagtcctctgtcattgactgtgtagttttc

SEQ ID NO: 217612 - DNA, 75 bp, Artificial Sequence
  Synthetic
gccgccaacttgttccttatacgataaagagaatttgagcctccctgtatcaggccccactgaattataagactg

SEQ ID NO: 217613 - DNA, 75 bp, Artificial Sequence
  Synthetic
ttcttcctcaatcccagttgagccttaataaatgacttcatcatggctgacactacattgaaaggtatttccacc

SEQ ID NO: 217614 - DNA, 75 bp, Artificial Sequence
  Synthetic
gtgaactcctcatggagctgcccagtcttcaacctattgtatagttttcttagcatagacctaatcttgctgcaa

SEQ ID NO: 217615 - DNA, 75 bp, Artificial Sequence
  Synthetic
aacattgaacgggatttccaccatcttgtgcatgtgccatgttaataatgttgacaggtaatctttgccctttaa

SEQ ID NO: 217616 - DNA, 75 bp, Artificial Sequence
  Synthetic
ttgtgcatgtgccatgttaataatgttgacaggtaatctttgccctttaaatcagcttgtagatcatcagaaagc

SEQ ID NO: 217617 - DNA, 75 bp, Artificial Sequence
  Synthetic
taataaatgacttcatcatggctgacactacattgaaaggtatttccaccatcttgtgcatgtgccacataagca

SEQ ID NO: 217618 - DNA, 75 bp, Artificial Sequence
  Synthetic
tgtccagagaaatgacttcacttccttagaagcactcatcttggtctggacacttagggatttactggttgaaag

SEQ ID NO: 217619 - DNA, 75 bp, Artificial Sequence
  Synthetic
agaaagattaaattttgtagaacagttaagaatagaaatggacacatcattgggccccacttactgtgatccatg

SEQ ID NO: 217620 - DNA, 75 bp, Artificial Sequence
  Synthetic
ggacacttagggatttactggttgaaagttttactcagtaagtcaatgaaaagcgcaatccaatagcctaggatc

SEQ ID NO: 217621 - DNA, 75 bp, Artificial Sequence
  Synthetic
ttaagaatagaaatggacacatcattgggccccacttactgtgatccatgctgtaggaaacatgtgccagggaga

SEQ ID NO: 217622 - DNA, 75 bp, Artificial Sequence
  Synthetic
atcctaggcaattcagctggacttcagtggtaaggcttattttagtgaatccttgaaccaaagtgcctagtcaaa

SEQ ID NO: 217623 - DNA, 75 bp, Artificial Sequence
  Synthetic
gtctcgcaattcaataagaatgggtcaatggggtatcttgcatattgcaaaagacttaaggttcttttctgtatc

SEQ ID NO: 217624 - DNA, 75 bp, Artificial Sequence
  Synthetic
cttgaactgctttaaatcagtaggttcacggaagaagtgaatgtagcagcctgaacttggttgatagagggcaat

SEQ ID NO: 217625 - DNA, 75 bp, Artificial Sequence
  Synthetic
aaacaactccctgataactgtagacttaatgcttcaaagtaatcctccacaagcctagtaaacatctttgtccta

SEQ ID NO: 217626 - DNA, 75 bp, Artificial Sequence
  Synthetic
tccaacgctacacaaaggtccagaaattttattctgggtgaccacttcattttagtcgatgctagatcactcatg

SEQ ID NO: 217627 - DNA, 75 bp, Artificial Sequence
  Synthetic
ccttgtgaacatttttgttctcagatctccaatgtacaactctctattgcctcccacctgctccttgtaagacag

SEQ ID NO: 217628 - DNA, 75 bp, Artificial Sequence
  Synthetic
tcaactctccaataggacattgtgacatatgcccacagtaaaaatacttgccccttaacttactattctcataga

SEQ ID NO: 217629 - DNA, 75 bp, Artificial Sequence
  Synthetic
ttaatgcttcaaagtaatcctccacaagcctagtaaacatctttgtcctaagatctccaatgtataactctctgt

SEQ ID NO: 217630 - DNA, 75 bp, Artificial Sequence
  Synthetic
aagtcttcaaccatgtgattagacaattcacctttaatcagcctaatgtaaaacttgtttgggacaatttcatcc

SEQ ID NO: 217631 - DNA, 75 bp, Artificial Sequence
  Synthetic
tcaggccctactgaatcataagactgtggtgactcttgactataaaaacataagttcttcagcattgctgtagtg

SEQ ID NO: 217632 - DNA, 75 bp, Artificial Sequence
  Synthetic
gtgattcttgactataaaaacataggttcttcaacattgctgttgtgcagttagttagagacaaagccttactga

SEQ ID NO: 217633 - DNA, 75 bp, Artificial Sequence
  Synthetic
cacctgtattgggtttgggtttgtgccagaatggcttgtgggtcagctgctggcaccctacaaaagctcctacaa

SEQ ID NO: 217634 - DNA, 75 bp, Artificial Sequence
  Synthetic
gttcttcaacattgctgttgtgcagttagttagagacaaagccttactgagtgcctcagagttactctcacgttc

SEQ ID NO: 217635 - DNA, 75 bp, Artificial Sequence
  Synthetic
attcacctttaatcagcctaatgtaaaacttgtttgggacaatttcatccaagtcatttactgatggttggccat

SEQ ID NO: 217636 - DNA, 75 bp, Artificial Sequence
  Synthetic
atcttctcaacggtctcctttagctgactgaaataaacacttgcacctccatcgagcagaatttcatctagatcg

SEQ ID NO: 217637 - DNA, 75 bp, Artificial Sequence
  Synthetic
agcttacccatatcgaatttgaaattgaggtttcttgatttataatgggtgtaccttcccatgagtgtatttgca

SEQ ID NO: 217638 - DNA, 75 bp, Artificial Sequence
  Synthetic
gacacttgctcttataatgagagtacctacccatcaacttattcccattcatcaccaacaaaattgacttaaaac

SEQ ID NO: 217639 - DNA, 75 bp, Artificial Sequence
  Synthetic
gggcataaaaatctgatgtgttgtgtaatattccttgacccatgtcaagtattgaactgatatgagaaggcacta

SEQ ID NO: 217640 - DNA, 75 bp, Artificial Sequence
  Synthetic
cttcagtcttaggttgcccccacttgactgaatcataactctttgccttgatttactatagcaaagagcatagcc

SEQ ID NO: 217641 - DNA, 75 bp, Artificial Sequence
  Synthetic
gactgaaataaacacttgcacctccatcgagcagaatttcatctagatcggcttcatcggcatcacttttgcgct

SEQ ID NO: 217642 - DNA, 75 bp, Artificial Sequence
  Synthetic
taatcctgcttattaagtaggtgttttcccttccttgagaagacttcagtgagctgtgagacagccaatgctgta

SEQ ID NO: 217643 - DNA, 75 bp, Artificial Sequence
  Synthetic
aattctcctatagggcatgagttcattggtcctgtgtaaaaatatttgtctttcagaaccgtatcattatatata

SEQ ID NO: 217644 - DNA, 75 bp, Artificial Sequence
  Synthetic
gtcaactctccaatggggcattgtgacatatgtccacaataaaagtacttcctcttcagcttgtcactctcatag

SEQ ID NO: 217645 - DNA, 75 bp, Artificial Sequence
  Synthetic
ctttaatgaaagacttcatcatagctgttactacattaaaaggtatttctaccattttgtgcatatgccacataa

SEQ ID NO: 217646 - DNA, 75 bp, Artificial Sequence
  Synthetic
caatcatgtttaggatggggtgactttgagtcagcctatctaagtctgaagtattgggatactttgctgtgtaga

SEQ ID NO: 217647 - DNA, 75 bp, Artificial Sequence
  Synthetic
ttgagtcagcctatctaagtctgaagtattgggatactttgctgtgtagatcagacccaaatctgtcaatgcttg

SEQ ID NO: 217648 - DNA, 75 bp, Artificial Sequence
  Synthetic
aaatctaaggctgtagcacagccactggtgatgagggggtctctgatctccttctttacttccctttctttaaat

SEQ ID NO: 217649 - DNA, 75 bp, Artificial Sequence
  Synthetic
agttcactcttaatcaacctaatataaaatttgtttgagacaatctcatctaagtcattcactgatggctggcta

SEQ ID NO: 217650 - DNA, 75 bp, Artificial Sequence
  Synthetic
tcactctttatcaaccttataaagagtttttcttccaccactttatcaagatcagatattgaaggcacattgcag

SEQ ID NO: 217651 - DNA, 75 bp, Artificial Sequence
  Synthetic
cagccaagaataaaaatggacacatcattgggccccacttactatgatccatgctataggagacatgtgccaatg

SEQ ID NO: 217652 - DNA, 75 bp, Artificial Sequence
  Synthetic
cattgggccccacttactatgatccatgctataggagacatgtgccaatgaaacattcaatttcatggaaaggat

SEQ ID NO: 217653 - DNA, 75 bp, Artificial Sequence
  Synthetic
aatgagccattgttgaaggaggatgtaagaagagataagaacttctttgagacaccaggctttttgtagttgggc

SEQ ID NO: 217654 - DNA, 75 bp, Artificial Sequence
  Synthetic
atcaacagtgcacctcagttggtcaaaatattcagatgctcctccatccaacaatatttcatccaaatcagcatt

SEQ ID NO: 217655 - DNA, 75 bp, Artificial Sequence
  Synthetic
tgattaaaataatcacttgcacctccgtcgagcaggatttcgtccagatcagcctcatcagtatcagttttatgc

SEQ ID NO: 217656 - DNA, 75 bp, Artificial Sequence
  Synthetic
aaatattcagatgctcctccatccaacaatatttcatccaaatcagcattgtcgatgtcaccactccctcccttg

SEQ ID NO: 217657 - DNA, 75 bp, Artificial Sequence
  Synthetic
gttcatccaaatcattgattgatggttcactattccctcccttcattgagcctaaaccagcaggttctctatatt

SEQ ID NO: 217658 - DNA, 75 bp, Artificial Sequence
  Synthetic
aaaatttgtttgagacaatctcatctaagtcattcactgatggctggctatcatcattggggctcaagcctggtt

SEQ ID NO: 217659 - DNA, 75 bp, Artificial Sequence
  Synthetic
cgtcgagcaggatttcgtccagatcagcctcatcagtatcagttttatgctgtcgagatcctagaactaagttgc

SEQ ID NO: 217660 - DNA, 75 bp, Artificial Sequence
  Synthetic
ctgtttgttgagcaagaacttacctttacgtgcaaacacttcagttaattgtgtgacagctaaagctgtaagttt

SEQ ID NO: 217661 - DNA, 75 bp, Artificial Sequence
  Synthetic
tttcccttccttgagaaaacctcggtgagttgtgatacggccaatgctgtgagtttgttaaaatcataatttaat

SEQ ID NO: 217662 - DNA, 75 bp, Artificial Sequence
  Synthetic
gtaagagatgttcaaaatgaatttgaatctattagtcatcatactcaccacatcctcagacaaaatcaagtttat

SEQ ID NO: 217663 - DNA, 75 bp, Artificial Sequence
  Synthetic
agtctccaacagtcaggcagaacacatgggctcacagacccagaatatagtgcctgtacatcattcactacaaac

SEQ ID NO: 217664 - DNA, 75 bp, Artificial Sequence
  Synthetic
ttacgtgcaaacacttcagttaattgtgtgacagctaaagctgtaagtttattgaaatcataatctaaaatgcga

SEQ ID NO: 217665 - DNA, 75 bp, Artificial Sequence
  Synthetic
gtgcagtttgtcagtgacagagccttactaagtgcctctgagttgctctccctttcactaattctcacatcatca

SEQ ID NO: 217666 - DNA, 75 bp, Artificial Sequence
  Synthetic
taaagctgttgcacagccacttgtgatgagaggatctcgcagcgtcttttttacttccttttctttaaatagcga

SEQ ID NO: 217667 - DNA, 75 bp, Artificial Sequence
  Synthetic
ctagtgataagaggatctttgatttccttcttcacttccctttctttaaacaatgatccattattaaaagaagat

SEQ ID NO: 217668 - DNA, 75 bp, Artificial Sequence
  Synthetic
cttgtggtgataatctgacacataggccattatgaagtacctaaggttttggagaagtttttgagaacgtttact

SEQ ID NO: 217669 - DNA, 75 bp, Artificial Sequence
  Synthetic
atgagaggatctcgcagcgtcttttttacttccttttctttaaatagcgaaccattattaaaactagacacaaga

SEQ ID NO: 217670 - DNA, 75 bp, Artificial Sequence
  Synthetic
aatctattagtcatcatactcaccacatcctcagacaaaatcaagtttattaatgctcttattaacttatagagc

SEQ ID NO: 217671 - DNA, 75 bp, Artificial Sequence
  Synthetic
gcattcatgatcaagagtatggacttaaaacattgaaagtattcatgactaaagtatgtccttgttgacactgcc

SEQ ID NO: 217672 - DNA, 75 bp, Artificial Sequence
  Synthetic
cgcatctacacaacattctttactcagaaattttcttgcattatagaccatttcagtgagctcctcctctgatgc

SEQ ID NO: 217673 - DNA, 75 bp, Artificial Sequence
  Synthetic
tcctctaacacttgtgcatccatccttactcaagaacttttttgcattatagaccatgtcatccagttcctcttc

SEQ ID NO: 217674 - DNA, 75 bp, Artificial Sequence
  Synthetic
gcaatcttctatccaagagatcatagtgttcactgttgtctgtagaacttcagatgagaatactgctggaaaata

SEQ ID NO: 217675 - DNA, 75 bp, Artificial Sequence
  Synthetic
agaaattttcttgcattatagaccatttcagtgagctcctcctctgatgcatcgtcttttgggttcacactcaca

SEQ ID NO: 217676 - DNA, 75 bp, Artificial Sequence
  Synthetic
gccattatgaagtacctaaggttttggagaagtttttgagaacgtttactagggtgaactagaatcaaaactaaa

SEQ ID NO: 217677 - DNA, 75 bp, Artificial Sequence
  Synthetic
gtgttcactgttgtctgtagaacttcagatgagaatactgctggaaaatatcttttaggatcagcataaaatgag

SEQ ID NO: 217678 - DNA, 75 bp, Artificial Sequence
  Synthetic
atcagtcagtctatcaggtgtctcttttgtaataaaatgacacatgtaagagatgtttaaaacaaatttaaacct

SEQ ID NO: 217679 - DNA, 75 bp, Artificial Sequence
  Synthetic
cctcatcaccccaaacatagaaccttgatttgaactctgcaacaaacctgccaattgcgctctttggactcacaa

SEQ ID NO: 217680 - DNA, 75 bp, Artificial Sequence
  Synthetic
ccctgtcttttgataaatcaattgaaattcagtgtcacccagtgagaactcttggcaatatgcttctttgcatct

SEQ ID NO: 217681 - DNA, 75 bp, Artificial Sequence
  Synthetic
tttgtaataaaatgacacatgtaagagatgtttaaaacaaatttaaacctattggtcatcatactaacaacttca

SEQ ID NO: 217682 - DNA, 75 bp, Artificial Sequence
  Synthetic
gccaccacatatgcagctaatagcataattgatgaacctctctgaaatgagggcataaaaatctgatgtgttatg

SEQ ID NO: 217683 - DNA, 75 bp, Artificial Sequence
  Synthetic
gggatcctaggcaatttggttgttctttctgaggtattatgcgttgtactcctccaaatgggaaacaagcaagcc

SEQ ID NO: 217684 - DNA, 75 bp, Artificial Sequence
  Synthetic
ttcaacttctgtgatcagatcctctctaattttttcaattaaatccttatgataaaaatcagacacaaaggccat

SEQ ID NO: 217685 - DNA, 75 bp, Artificial Sequence
  Synthetic
taagaactcaacatcagtaatcaattcttctctcactttatcaatgaggtccttgtgataataatctgatacata

SEQ ID NO: 217686 - DNA, 75 bp, Artificial Sequence
  Synthetic
cagggcaaggctcactgaagagagtctctctaaatcagtagttcccagtaggtctacatcccccatggtataggg

SEQ ID NO: 217687 - DNA, 75 bp, Artificial Sequence
  Synthetic
aacaatgtgtgaaacaagtgaaagtgcctcgcaattcacatctaaggcaacacaaagatcaaggaactttattct

SEQ ID NO: 217688 - DNA, 75 bp, Artificial Sequence
  Synthetic
ctaattttttcaattaaatccttatgataaaaatcagacacaaaggccatcatgaaatatctaatattctgtaga

SEQ ID NO: 217689 - DNA, 75 bp, Artificial Sequence
  Synthetic
ccaggtcagaccggtcaacattgacaccttgctgctgagaccctaagaccaagttgctcattgcttgttgaacct

SEQ ID NO: 217690 - DNA, 75 bp, Artificial Sequence
  Synthetic
tttggtcagtaacttaatatttgtcagctgttcggataactctgtgcactcctcaatccagctgaccattacatt

SEQ ID NO: 217691 - DNA, 75 bp, Artificial Sequence
  Synthetic
gatcatctttgtcagagatttaatgttgttcagctgctctcccaactcattgcaatcctctatccaggaaatcat

SEQ ID NO: 217692 - DNA, 75 bp, Artificial Sequence
  Synthetic
ataaccattaggatgaaccacctccatatcaatcccataatggtccacactaatcccaagatcctttaaagtggt

SEQ ID NO: 217693 - DNA, 75 bp, Artificial Sequence
  Synthetic
agctgttcggataactctgtgcactcctcaatccagctgaccattacattgaccatcttctgcagcacactactg

SEQ ID NO: 217694 - DNA, 75 bp, Artificial Sequence
  Synthetic
agttgatcaaaataatcgcttgcaccaccatcgagcaggatttcatctaggtcagccctattagcatcactttta

SEQ ID NO: 217695 - DNA, 75 bp, Artificial Sequence
  Synthetic
ctctctaaatcagtagttcccagtaggtctacatcccccatggtatagggaaatgttccctcctctgatctctgg

SEQ ID NO: 217696 - DNA, 75 bp, Artificial Sequence
  Synthetic
ctctccaactgtgttgttgttaatagcatagcactttgagcactcacctgtcttctggtataataatttaaaacc

SEQ ID NO: 217697 - DNA, 75 bp, Artificial Sequence
  Synthetic
gcaaatctcaccaaccctgttgttgttaatagcatagcacttcgagcactcccctgtcttttgataaatcaattg

SEQ ID NO: 217698 - DNA, 75 bp, Artificial Sequence
  Synthetic
ggttctagacctttcagcctgctgcctccgctcaacccatttctttaaatccctctttgttgactctaaggagac

SEQ ID NO: 217699 - DNA, 75 bp, Artificial Sequence
  Synthetic
gcatagcactttgagcactcacctgtcttctggtataataatttaaaacccatcttattgatgaagaactcttga

SEQ ID NO: 217700 - DNA, 75 bp, Artificial Sequence
  Synthetic
atatcaatcccataatggtccacactaatcccaagatcctttaaagtggtagtagccttcaagatggttttctga

SEQ ID NO: 217701 - DNA, 75 bp, Artificial Sequence
  Synthetic
ctccgctcaacccatttctttaaatccctctttgttgactctaaggagactagtctgtcattaacacttataaag

SEQ ID NO: 217702 - DNA, 75 bp, Artificial Sequence
  Synthetic
attttgccttaactttaccgtagaagatgttttcattgagttgatcagagctagactcagtgttgacaatctatc

SEQ ID NO: 217703 - DNA, 75 bp, Artificial Sequence
  Synthetic
aaattcattttgtctcaacttcacagtggaagaagtcttcatcgaattcactaatgcaagactcaatgaagaaag

SEQ ID NO: 217704 - DNA, 75 bp, Artificial Sequence
  Synthetic
actcgcaaggaggattaaagcatcaaaaatcaacagaagctttctccttgtgttcagtatcctcatagactttac

SEQ ID NO: 217705 - DNA, 75 bp, Artificial Sequence
  Synthetic
gatgttttcattgagttgatcagagctagactcagtgttgacaatctatctagatcgattgcatctaaaatatca

SEQ ID NO: 217706 - DNA, 75 bp, Artificial Sequence
  Synthetic
tcttcggaactgaaatgttaactgttcaatgttgtcatcacaggtgtctattttatcacaatatagctttctgaa

SEQ ID NO: 217707 - DNA, 75 bp, Artificial Sequence
  Synthetic
aaaatcaacagaagctttctccttgtgttcagtatcctcatagactttactttgtttaggaatgatctccagcac

SEQ ID NO: 217708 - DNA, 75 bp, Artificial Sequence
  Synthetic
aatagtgggtgtgaccccagagatttcaacatccattattacatcataaacatcgcaatcaaggatcttgagatc

SEQ ID NO: 217709 - DNA, 75 bp, Artificial Sequence
  Synthetic
ataagtgattgtagggataactccagaaacatcgaagctcatgatcaagtcataactgttagaacaaatcactcc

SEQ ID NO: 217710 - DNA, 75 bp, Artificial Sequence
  Synthetic
accaatatctgcatacaaaaatctcaacattggtgatgctctcttgaactcataaatcaaatgttcaacattgtc

SEQ ID NO: 217711 - DNA, 75 bp, Artificial Sequence
  Synthetic
tcaacatccattattacatcataaacatcgcaatcaaggatcttgagatcaattccatatgagttggtctctata

SEQ ID NO: 217712 - DNA, 75 bp, Artificial Sequence
  Synthetic
gtggaagaagtcttcatcgaattcactaatgcaagactcaatgaagaaagtctctctaagtcagtggttcttagc

SEQ ID NO: 217713 - DNA, 75 bp, Artificial Sequence
  Synthetic
ttttacagctactttgtcgacgtataaatcgttgaactccttaagcagctgacctctctcaacctttaagaattg

SEQ ID NO: 217714 - DNA, 75 bp, Artificial Sequence
  Synthetic
ggcgagaagttcatggttcctttctcccttgggtggtagagtttctaggcctttgcctttagtcctctttctact

SEQ ID NO: 217715 - DNA, 75 bp, Artificial Sequence
  Synthetic
aagtattcttggtccaaaaaagtcctagtcaccactgcttttgtcagttcactaataggacatgagttcattggc

SEQ ID NO: 217716 - DNA, 75 bp, Artificial Sequence
  Synthetic
tcaacaggggtcacatgccctagttgatttgtgtcaattaaaaactcattaataatctcggtgtcaacataccat

SEQ ID NO: 217717 - DNA, 75 bp, Artificial Sequence
  Synthetic
ggtccttatgatgataatctgacacataagccattacaaagtacctaagattttggaggagcttttgagaacgtt

SEQ ID NO: 217718 - DNA, 75 bp, Artificial Sequence
  Synthetic
aaagtatgtccttgttgacactgcctttgtcaactctccaataggacactgtgacatatgtccacagtaaaaata

SEQ ID NO: 217719 - DNA, 75 bp, Artificial Sequence
  Synthetic
aattcttcccttattttgtcaatgaggtccttatgatgataatctgacacataagccattacaaagtacctaaga

SEQ ID NO: 217720 - DNA, 75 bp, Artificial Sequence
  Synthetic
ctgacaaaaccagtctccagcagtctgacaaaacacacggactcactgcacctgagtacataacggatacatcat

SEQ ID NO: 217721 - DNA, 75 bp, Artificial Sequence
  Synthetic
gcctagccacccagtaaggcatttatcaccatgtcttatgcgatccagccggtcagcaagtagaattagaacgtc

SEQ ID NO: 217722 - DNA, 75 bp, Artificial Sequence
  Synthetic
gaatattgagttaaggatttggtttctgcttgagcactgagaaggctgcatgaccccagacttttcggcctgttg

SEQ ID NO: 217723 - DNA, 75 bp, Artificial Sequence
  Synthetic
acaagatcccagccaccctcttaggcacttttgcttcatttggtcatgtttacttgcaaggagaatcagtgcgtc

SEQ ID NO: 217724 - DNA, 75 bp, Artificial Sequence
  Synthetic
aaaatttatctggtaagatatcataatcaaagtcttcaaccatgtgattggataactcacctttaatcagcctaa

SEQ ID NO: 217725 - DNA, 75 bp, Artificial Sequence
  Synthetic
tcaccatgtcttatgcgatccagccggtcagcaagtagaattagaacgtcaaaaataaggaggagtttcctcctg

SEQ ID NO: 217726 - DNA, 75 bp, Artificial Sequence
  Synthetic
ttgcatttgtccacttggggtatcagcagtcttttcatcactggaacctaaatctgcatataggaacttaagaac

SEQ ID NO: 217727 - DNA, 75 bp, Artificial Sequence
  Synthetic
ttgcacctggcattccccggtggtttgattcccctttttactaccctcctcatcaattttagcatacaggaatct

SEQ ID NO: 217728 - DNA, 75 bp, Artificial Sequence
  Synthetic
ctgtaaagacttattggacccagcagttcccactttttgtggttttccatctgactcgagatccacagtagtatt

SEQ ID NO: 217729 - DNA, 75 bp, Artificial Sequence
  Synthetic
gtttgataggttccctatactgatcaacaatcttttcaacagtctcctttagctgatcaaaataatcgcttgcac

SEQ ID NO: 217730 - DNA, 75 bp, Artificial Sequence
  Synthetic
gacccaatcaggtatttgctcattgtaaaatgatgttctcccatctataagtggtatcagattgatgtcgatact

SEQ ID NO: 217731 - DNA, 75 bp, Artificial Sequence
  Synthetic
gcagtcttttcatcactggaacctaaatctgcatataggaacttaagaactggggaggctctccggaactgaaat

SEQ ID NO: 217732 - DNA, 75 bp, Artificial Sequence
  Synthetic
atttctgaaatcctctaacaacttcagcttatcagtcttaacgaattgaccctctatatccccttgtcttaattt

SEQ ID NO: 217733 - DNA, 75 bp, Artificial Sequence
  Synthetic
tttgttcaaagttggcaggagatgacctaacaaaacactccaataatattaggacattacctgttagtttataac

SEQ ID NO: 217734 - DNA, 75 bp, Artificial Sequence
  Synthetic
cagattattaaactcactgagtaattgactcttctctacccttaagaactgactttctatctctccttttcttaa

SEQ ID NO: 217735 - DNA, 75 bp, Artificial Sequence
  Synthetic
tgattcccctttttactaccctcctcatcaattttagcatacaggaatctcagtattggtgatgccctcttgaac

SEQ ID NO: 217736 - DNA, 75 bp, Artificial Sequence
  Synthetic
catctggtaccacaaagcacagtgagggagtcaaaaccccatggtcatgaagaattctttctacagatttgtcct

SEQ ID NO: 217737 - DNA, 75 bp, Artificial Sequence
  Synthetic
aggagagcttgttgttgatgccctgatgacaactagagattatatcctcaaagtgtcttgcacgtttatcaatca

SEQ ID NO: 217738 - DNA, 75 bp, Artificial Sequence
  Synthetic
ttggtggcatgaggctatcacttcttcataatggttggaacggttgtccaacaaaacatttaaactctccactcc

SEQ ID NO: 217739 - DNA, 75 bp, Artificial Sequence
  Synthetic
ctcatagtcctgcttgttgagaaggtactttccttttcttgagaagacctcagtaagctgcgacacggctagtgc

SEQ ID NO: 217740 - DNA, 75 bp, Artificial Sequence
  Synthetic
tgactcttctctacccttaagaactgactttctatctctccttttcttaatctatttctaaacacttgatactct

SEQ ID NO: 217741 - DNA, 75 bp, Artificial Sequence
  Synthetic
tgttgacaacaacactcttgttactagctagatccaaggctgtagcacagccactggtgatgagggggtctttga

SEQ ID NO: 217742 - DNA, 75 bp, Artificial Sequence
  Synthetic
agctagatccaaggctgtagcacagccactggtgatgagggggtctttgatttcccttttaacttctctttcttt

SEQ ID NO: 217743 - DNA, 75 bp, Artificial Sequence
  Synthetic
ttaatagcatcctgggctctgtttgcacaagaaatgccaacttttgtcttgacaacctctcattatctgccaaat

SEQ ID NO: 217744 - DNA, 75 bp, Artificial Sequence
  Synthetic
ttcttgagcatatcttaacaatgagaaaagtgtgtctcttagcttatcattaacccaatcaggtatttgttcatt

SEQ ID NO: 217745 - DNA, 75 bp, Artificial Sequence
  Synthetic
ctttgaataaagaaccattgttgaaagaagacgtgagaagggagaggaacttcttcgaaactccaggctttttgt

SEQ ID NO: 217746 - DNA, 75 bp, Artificial Sequence
  Synthetic
tcataatggttggaacggttgtccaacaaaacatttaaactctccactcctgacaatctccctgaggtcatggac

SEQ ID NO: 217747 - DNA, 75 bp, Artificial Sequence
  Synthetic
gaatgttgttctgccgtctatgagagggatgaggttgatgccaacagtctccagatcacatttcaattgttctaa

SEQ ID NO: 217748 - DNA, 75 bp, Artificial Sequence
  Synthetic
ttgaaacaccaggctttttatagtctggtcccttgacacttgtacatccatccttacttaaaaacctttttgcat

SEQ ID NO: 217749 - DNA, 75 bp, Artificial Sequence
  Synthetic
tgtgggtgtggtggtcagggttcttgaagtgtgtgatcaactggagcaacagttcactataagacagggttccat

SEQ ID NO: 217750 - DNA, 75 bp, Artificial Sequence
  Synthetic
tagtttcttgaagtcttcaatgtacttctgttcaaagttggcaggggatgatctaacaaaacactctaacaatat

SEQ ID NO: 217751 - DNA, 75 bp, Artificial Sequence
  Synthetic
agttcactataagacagggttccataagagaaacaaaggacacaaccaattaattaaagacaattagaatagata

SEQ ID NO: 217752 - DNA, 75 bp, Artificial Sequence
  Synthetic
tccttacttaaaaacctttttgcattgtagaccatgtcgaccaattcttcctccgtggctgtgtctgcaggatta

SEQ ID NO: 217753 - DNA, 75 bp, Artificial Sequence
  Synthetic
aacattgccagtgagtttgtaaccatcaggaaccacaaagcacaaagctggagtaagaatcccatgatcattaag

SEQ ID NO: 217754 - DNA, 75 bp, Artificial Sequence
  Synthetic
gggatgaggttgatgccaacagtctccagatcacatttcaattgttctaatttcttatgatcttccagatacttt

SEQ ID NO: 217755 - DNA, 75 bp, Artificial Sequence
  Synthetic
tcaggaaccacaaagcacaaagctggagtaagaatcccatgatcattaaggatggactcaactgatttgtcctcc

SEQ ID NO: 217756 - DNA, 75 bp, Artificial Sequence
  Synthetic
gaggatcctttctacagacttatcttcactgttgtgttcacatccatttgcattgcaggagtcaacctcaatgca

SEQ ID NO: 217757 - DNA, 75 bp, Artificial Sequence
  Synthetic
ttctgttcaaagttggcaggggatgatctaacaaaacactctaacaatatcagaacattgcctgttaatttgtaa

SEQ ID NO: 217758 - DNA, 75 bp, Artificial Sequence
  Synthetic
tcactgttgtgttcacatccatttgcattgcaggagtcaacctcaatgcaaagggacaggagcttcaacccctcc

SEQ ID NO: 217759 - DNA, 75 bp, Artificial Sequence
  Synthetic
agacagcagctttaatccttccatgagcaacattctgggttcagtttggactagaaaagccaatttctgtcttga

SEQ ID NO: 217760 - DNA, 75 bp, Artificial Sequence
  Synthetic
cctcaccaagattagcatacaggaatctcaatattggtgatgctctcttgaactgataaattaggtgttcgacat

SEQ ID NO: 217761 - DNA, 75 bp, Artificial Sequence
  Synthetic
tctcaatattggtgatgctctcttgaactgataaattaggtgttcgacattgtcttcagcagctaccttatcagt

SEQ ID NO: 217762 - DNA, 75 bp, Artificial Sequence
  Synthetic
tgacaatctctcgttgtctgctaaatattttgatactagatctttgacacaggctatgtcttcctccatgtctga

SEQ ID NO: 217763 - DNA, 75 bp, Artificial Sequence
  Synthetic
ctgtcttgacagcttctcgttgtctgcaaggtactttgagatgaggtctttggcgttggcaatgtcttcctccat

SEQ ID NO: 217764 - DNA, 75 bp, Artificial Sequence
  Synthetic
ataggccattataaagtacctaagattttggaggagcttttgagaacgtttactaggatgagctaagattaaaat

SEQ ID NO: 217765 - DNA, 75 bp, Artificial Sequence
  Synthetic
caacccactgtgggatgcggtcttataaaacaagtataaatgatgaatgacaaataacgatcaacaattaaagac

SEQ ID NO: 217766 - DNA, 75 bp, Artificial Sequence
  Synthetic
taaaacaagtataaatgatgaatgacaaataacgatcaacaattaaagacaattaaagtagatagcctaaatgcc

SEQ ID NO: 217767 - DNA, 75 bp, Artificial Sequence
  Synthetic
cctcctctgtggctatgtctgcagggttcacactcacatgaccaaactctattttaggctcaagaaacttctcaa

SEQ ID NO: 217768 - DNA, 75 bp, Artificial Sequence
  Synthetic
catcaaagagctcatctagtgccagatgcatcccatctaggcccccagttttgcaaaagttgctggtttgagaac

SEQ ID NO: 217769 - DNA, 75 bp, Artificial Sequence
  Synthetic
ccaccaagctaaaggcaacagtacagccaagtgcaccctcgactgaggcggcccagagcacagcacctccaccgt

SEQ ID NO: 217770 - DNA, 75 bp, Artificial Sequence
  Synthetic
tgcaaatggtgtcttacagactttcatgaggatggcttggggtgggagttacattgctcttgactcaggccgtgg

SEQ ID NO: 217771 - DNA, 75 bp, Artificial Sequence
  Synthetic
gtgtgattctagatctttcggcctgttgccttcgctcaacccatttcccgagatccctttttgttgactctaaag

SEQ ID NO: 217772 - DNA, 75 bp, Artificial Sequence
  Synthetic
tgcccccacttgactggatcataactttttgctttgatttgctgtagcaaagggcatagcctttaaaatcaatcc

SEQ ID NO: 217773 - DNA, 75 bp, Artificial Sequence
  Synthetic
tttttgctttgatttgctgtagcaaagggcatagcctttaaaatcaatccattctccaagagattcaagaagttc

SEQ ID NO: 217774 - DNA, 75 bp, Artificial Sequence
  Synthetic
tgaaatcctctaataacttcatcttatcagttttaacaaattgactttctatgtccccctgcctcagtttgttcc

SEQ ID NO: 217775 - DNA, 75 bp, Artificial Sequence
  Synthetic
taatagttcactttaagacaagatcccgtaggaggctcagaagacacaagaggtaattaaagacaattatataag

SEQ ID NO: 217776 - DNA, 75 bp, Artificial Sequence
  Synthetic
gcgcttttagagatctttgtgtgagtgggcttcatcaagccatgggacaaatcataacatttttccaggaagtac

SEQ ID NO: 217777 - DNA, 75 bp, Artificial Sequence
  Synthetic
cattgtcctgattgctctcagccttctggcaatactgaaagggatctacaatgttgctacctgtggcctctttgg

SEQ ID NO: 217778 - DNA, 75 bp, Artificial Sequence
  Synthetic
tgaatttaaacctatttgtcatcatacttttcacttcattgcataaaatcaagcttatcaaagcccttattagtt

SEQ ID NO: 217779 - DNA, 75 bp, Artificial Sequence
  Synthetic
tctcaatatcggtgatgccctcttgaactgataaattaaatgttcgatattatcttctgcagctaccttatcaga

SEQ ID NO: 217780 - DNA, 75 bp, Artificial Sequence
  Synthetic
gcagtccattagtgcacaggaggggttatttcctctttaccgcctcttttcttcttttcaacaacgacacctgtg

SEQ ID NO: 217781 - DNA, 75 bp, Artificial Sequence
  Synthetic
cctctcatcctctaagaggtacctgctcacaagatctttgctctcggacagcaactcctccatcaaacacacttg

SEQ ID NO: 217782 - DNA, 75 bp, Artificial Sequence
  Synthetic
tcctgataatcttcctgaagtcatggataaggattcgcagagtctgctatattctgactcttcaaaaagtgcgtt

SEQ ID NO: 217783 - DNA, 75 bp, Artificial Sequence
  Synthetic
ctcacaagatctttgctctcggacagcaactcctccatcaaacacacttgttcctcagaagagagagtcacaatg

SEQ ID NO: 217784 - DNA, 75 bp, Artificial Sequence
  Synthetic
cagccgacagcaccaccagaaatcccaccatcccaaaatccccaccctacagcccctgaggcagaactccgcccc

SEQ ID NO: 217785 - DNA, 75 bp, Artificial Sequence
  Synthetic
ggattttatttcctttgaggcactcattgccagattatagtgttgaatgcacacaacaaagaactgagactatct

SEQ ID NO: 217786 - DNA, 75 bp, Artificial Sequence
  Synthetic
cctgtgttggacttgggcttgtacctgtatagcgtgtgggtcagctagtagtgccccacaaaagctcttacagaa

SEQ ID NO: 217787 - DNA, 75 bp, Artificial Sequence
  Synthetic
attcatgatcaagagtatggacttaaaacactgaaagtattcatggttaaagtatgtccttgttgacactgcctt

SEQ ID NO: 217788 - DNA, 75 bp, Artificial Sequence
  Synthetic
tgtacaatgttgcaacatgtggtcttattggtttggttacctttcttttactgtgtggtagatcttgtacaacca

SEQ ID NO: 217789 - DNA, 75 bp, Artificial Sequence
  Synthetic
ccttgataatctctcattgtccattaggtactttgacactaaatctttgacacaagctatgtcttcctccatatt

SEQ ID NO: 217790 - DNA, 75 bp, Artificial Sequence
  Synthetic
cggctgcaggtgtgaatgtcagaacccttgggacatgtggtccgctagagtagcagtttattataagataaggtt

SEQ ID NO: 217791 - DNA, 75 bp, Artificial Sequence
  Synthetic
cctgtatggcttgcaggtcagctggtggtgccccacaaaaactcccacagaaatgagagacaatatgcctaggat

SEQ ID NO: 217792 - DNA, 75 bp, Artificial Sequence
  Synthetic
acggtttcacgccctcttgaactctctcttcaaagttcttttcaacttttcccttacggtacttgttgactatcg

SEQ ID NO: 217793 - DNA, 75 bp, Artificial Sequence
  Synthetic
cccttacggtacttgttgactatcggtctcgtgccggtatttagccttagatggagtttaccacccgcttttggg

SEQ ID NO: 217794 - DNA, 75 bp, Artificial Sequence
  Synthetic
gtctcgtgccggtatttagccttagatggagtttaccacccgcttttgggctgcattcccaagcaacccgactcc

SEQ ID NO: 217795 - DNA, 75 bp, Artificial Sequence
  Synthetic
gtataatctcaactttccacttgtccattcccaactttaatcagtatgaagcaatgagttgtgactttaatggag

SEQ ID NO: 217796 - DNA, 75 bp, Artificial Sequence
  Synthetic
gacacatttttctgatgacattgaacaacaagcagacaacatgataacagaactgttgcaaaaggagtacatgga

SEQ ID NO: 217797 - DNA, 75 bp, Artificial Sequence
  Synthetic
gtagagtatgttttcataaggattcctttcaccaggggtgtctgagatgaacatcccaagagccttcttgacctt

SEQ ID NO: 217798 - DNA, 75 bp, Artificial Sequence
  Synthetic
caattcagatttctttctttttgacatggggcagattgtgacattctttcaagaagtgcctcatgtaatagaaga

SEQ ID NO: 217799 - DNA, 75 bp, Artificial Sequence
  Synthetic
atggggcagattgtgacattctttcaagaagtgcctcatgtaatagaagaagtgatgaacatcgtccttatagca

SEQ ID NO: 217800 - DNA, 75 bp, Artificial Sequence
  Synthetic
ccagtttttatctcattagcatcttcctccacctggttaaaatcccaacccatagacatgtcatagggaaaccct

SEQ ID NO: 217801 - DNA, 75 bp, Artificial Sequence
  Synthetic
atggcgttttgcagaccttcatgagaatggcctggggtgggagttacattgctcttgactcaggtcgcaatggat

SEQ ID NO: 217802 - DNA, 75 bp, Artificial Sequence
  Synthetic
tctcattggcttggtcaccttcttcctactgtgtggtagatcctgctcctccaacctctataagggggtctatga

SEQ ID NO: 217803 - DNA, 75 bp, Artificial Sequence
  Synthetic
ttatgcagtccagccggctagcaagaagaatcagaacgtcaaaaacaaggagaagtttcctcctggtgttgagga

SEQ ID NO: 217804 - DNA, 75 bp, Artificial Sequence
  Synthetic
ctactgtgtggtagatcctgctcctccaacctctataagggggtctatgaactccaatctctagatctgaacatg

SEQ ID NO: 217805 - DNA, 75 bp, Artificial Sequence
  Synthetic
agtggaaaagataggaggcagacccacccatgggcccccgtgacccaccgccgaaaggcggtgggtcacgggggc

SEQ ID NO: 217806 - DNA, 75 bp, Artificial Sequence
  Synthetic
gctcctctcacaaaggaccagagacatttacattagtagaagactgctgggcacattcacatggacactgtcaga

SEQ ID NO: 217807 - DNA, 75 bp, Artificial Sequence
  Synthetic
tcattacataagagttggcaatgagacagggctggaactgaccttaaccaacacaagtttgcttgatcataagtt

SEQ ID NO: 217808 - DNA, 75 bp, Artificial Sequence
  Synthetic
tgagtataatctcaactttccacctatctatacccaacttcaaccaatatgaagcaatgagctgtgactttaatg

SEQ ID NO: 217809 - DNA, 75 bp, Artificial Sequence
  Synthetic
atctatacccaacttcaaccaatatgaagcaatgagctgtgactttaatgggggcaaaatcactgtccagtacaa

SEQ ID NO: 217810 - DNA, 75 bp, Artificial Sequence
  Synthetic
taatctgatctgttaatctatctggtgtttcttttgtaataaaatgacacatgtaggaaacattcaaaatgaatt

SEQ ID NO: 217811 - DNA, 75 bp, Artificial Sequence
  Synthetic
gaggatggcatggggtggaagctacattgctcttgactcaggccatgggaactgggactgcatcatgaccagtta

SEQ ID NO: 217812 - DNA, 75 bp, Artificial Sequence
  Synthetic
attgctcttgactcaggccatgggaactgggactgcatcatgaccagttatcaatacctgataatccaaaacaca

SEQ ID NO: 217813 - DNA, 75 bp, Artificial Sequence
  Synthetic
aaaagatctgctacatcaatcccatgagaatatttggcatcttgcttgaactgttttaagtctgttggttctctg

SEQ ID NO: 217814 - DNA, 75 bp, Artificial Sequence
  Synthetic
tagtctcctctcacagagaaccagagatatctacattagcagaaggttgttaggcacattcacatggacactgtc

SEQ ID NO: 217815 - DNA, 75 bp, Artificial Sequence
  Synthetic
gatatctacattagcagaaggttgttaggcacattcacatggacactgtcagactccgaggggaatgctacacca

SEQ ID NO: 217816 - DNA, 75 bp, Artificial Sequence
  Synthetic
ccattgggtctggttgacctctttgtgttcagcacaagtttttatctcattagtatcttccttcacctagtcaaa

SEQ ID NO: 217817 - DNA, 75 bp, Artificial Sequence
  Synthetic
ctttggcaacacagcagtggcaaagtgcaatgaaaagcatgatgaggaattctgtgacatgctcagactgtttga

SEQ ID NO: 217818 - DNA, 75 bp, Artificial Sequence
  Synthetic
tgcaatgaaaagcatgatgaggaattctgtgacatgctcagactgtttgatttcaacaagcaggccataagcaga

SEQ ID NO: 217819 - DNA, 75 bp, Artificial Sequence
  Synthetic
tgccttaattaatgatcagttgattatgaaaaaccatttgcgagacattatggggatcccatattgcaattacag

SEQ ID NO: 217820 - DNA, 75 bp, Artificial Sequence
  Synthetic
atgaaaaaccatttgcgagacattatggggatcccatattgcaattacagcaaatactggtatcttaaccacaca

SEQ ID NO: 217821 - DNA, 75 bp, Artificial Sequence
  Synthetic
acttcaagatgccatccattgtctgaggtgtaaccttgatggtctccaacatgttccccccatcaagcatacaag

SEQ ID NO: 217822 - DNA, 75 bp, Artificial Sequence
  Synthetic
caccttacttctaagtgtcagcaacaggtgccccatttgcaagatgcctcttcccacaaaactgagaccatcagc

SEQ ID NO: 217823 - DNA, 75 bp, Artificial Sequence
  Synthetic
atacttgaatgagacccatttttctgatgacatcgaacagcaagccgacaacatgatcacagagatgctacaaaa

SEQ ID NO: 217824 - DNA, 75 bp, Artificial Sequence
  Synthetic
gatgacatcgaacagcaagccgacaacatgatcacagagatgctacaaaaggaatacatggacaggcaaggaaaa

SEQ ID NO: 217825 - DNA, 75 bp, Artificial Sequence
  Synthetic
gttgggtttggatttgtgtcaatatagtttgtaggtcagctggtgatgtctcaaaaaagctcctacagaaatgag

SEQ ID NO: 217826 - DNA, 75 bp, Artificial Sequence
  Synthetic
ttgttgctgccagctttttgtggcttcccatctgattccagatcaacgacagtgttttcccaggcccttcctgtt

SEQ ID NO: 217827 - DNA, 75 bp, Artificial Sequence
  Synthetic
acccacccatgggcccccgtgacccaccgccgaaaggcggtgggtcacgggggcgtccatttacaggacgacctt

SEQ ID NO: 217828 - DNA, 75 bp, Artificial Sequence
  Synthetic
gggaatgtttcttcctctgttctctgataactgattgtagggacaactccagagacatcaaagtccataatcaaa

SEQ ID NO: 217829 - DNA, 75 bp, Artificial Sequence
  Synthetic
gattagcattttccttcatttagtcaaaataccgacccatagacacattgtgggtaaaccgtgtcccaagcctca

SEQ ID NO: 217830 - DNA, 75 bp, Artificial Sequence
  Synthetic
cccccggggggaccccccgccgggggcccccccggggggcaggcaacttagctctactcaatgtcctcaacacac

SEQ ID NO: 217831 - DNA, 75 bp, Artificial Sequence
  Synthetic
ctttaagatggacttgaggatgccatccattgtctgaggtgacaccttgattgtctccaacatgttgccaccatc

SEQ ID NO: 217832 - DNA, 75 bp, Artificial Sequence
  Synthetic
tggttaatccaggttgagcagggaaaagatctgttacatcaatcccatgagaatatttggcatcttgcttgaact

SEQ ID NO: 217833 - DNA, 75 bp, Artificial Sequence
  Synthetic
cgcacagtggatcctaggctattggattgcgctttgtaccaattactttagcagataatttcgacactctgctaa

SEQ ID NO: 217834 - DNA, 75 bp, Artificial Sequence
  Synthetic
tgggtaaaccgtgtcccaagcctcacaggctgaaccgcatgggcatttgctcttgtggtttgtacaagcaacctg

SEQ ID NO: 217835 - DNA, 75 bp, Artificial Sequence
  Synthetic
gtggtggccttcaaaatggttttctggaatattgaattaagaatttgattcttactcaagcactgggaggactgt

SEQ ID NO: 217836 - DNA, 75 bp, Artificial Sequence
  Synthetic
taggcatggtgccgaactggttgttcaaaagatctggattcttaacatcccacaccctaacaactccgtctcttc

SEQ ID NO: 217837 - DNA, 75 bp, Artificial Sequence
  Synthetic
acagcagcatcaaacatgatgcagtccattagtgcacaatgaggggtaatttcttccttgccacctctcttcttc

SEQ ID NO: 217838 - DNA, 75 bp, Artificial Sequence
  Synthetic
ccattagtgcacaatgaggggtaatttcttccttgccacctctcttcttcttctcaacgacaacacctgtgtgca

SEQ ID NO: 217839 - DNA, 75 bp, Artificial Sequence
  Synthetic
gattccaaatcaacgacagtgttttcccaggcccttcctgttattgaagttcttgatgcaatgtacggccaccca

SEQ ID NO: 217840 - DNA, 75 bp, Artificial Sequence
  Synthetic
tagtgtcagacttggcatggttccgaactgattattaagcaactctgcattttttacatcccaaactctcaccac

SEQ ID NO: 217841 - DNA, 75 bp, Artificial Sequence
  Synthetic
atcttgatcttgtatcacaggtgtgaaggatgccaatttcttcccacattcccacagacctcctctatgcacaac

SEQ ID NO: 217842 - DNA, 75 bp, Artificial Sequence
  Synthetic
aaggatgccaatttcttcccacattcccacagacctcctctatgcacaaccagaggggctggttcagtgcaggga

SEQ ID NO: 217843 - DNA, 75 bp, Artificial Sequence
  Synthetic
gagtcagtcttactaagggcaatgtcaatcagttttatgtcttttctcccttgtgattcaagaagcttccttatg

SEQ ID NO: 217844 - DNA, 75 bp, Artificial Sequence
  Synthetic
caatcagttttatgtcttttctcccttgtgattcaagaagcttccttatgtcttcagacccctggcaagtgataa

SEQ ID NO: 217845 - DNA, 75 bp, Artificial Sequence
  Synthetic
cttgaagctttatgctggagcaataacctgaaagctccctccttaatgactgtgtccagagaaatgacttcactt

SEQ ID NO: 217846 - DNA, 75 bp, Artificial Sequence
  Synthetic
gcagcaaacaaatctgtgacatcaattccatgagaatactttgcatcttgtttaaactgcttaagatcagtgggc

SEQ ID NO: 217847 - DNA, 75 bp, Artificial Sequence
  Synthetic
ttccatgagaatactttgcatcttgtttaaactgcttaagatcagtgggctcccgaaagaagtgtatatagcacc

SEQ ID NO: 217848 - DNA, 75 bp, Artificial Sequence
  Synthetic
ccatatttagaatggggtggctctgagtcagcctgtctaagtctgaagtgttagggtattttgctgtgtaaatca

SEQ ID NO: 217849 - DNA, 75 bp, Artificial Sequence
  Synthetic
gggatcctaggcaatttggttattctttctgtaaccttgtgcactgcacttctcctctaaatgggaaacaagcag

SEQ ID NO: 217850 - DNA, 75 bp, Artificial Sequence
  Synthetic
ggcaattcagctggacttcagtggaaagactcttttagtgaatccctaaatcaaggtgcctaatcaaaatgggca

SEQ ID NO: 217851 - DNA, 75 bp, Artificial Sequence
  Synthetic
tctatgtccatccatgtcttggcatttgggtcaagctgcagcattgcatctttaagagtcataagttgagagtag

SEQ ID NO: 217852 - DNA, 75 bp, Artificial Sequence
  Synthetic
tcaaggtgcctaatcaaaatgggcaacagacaggccaaatcgacaaaagtcgatgaacatcaaagagctcatcta

SEQ ID NO: 217853 - DNA, 75 bp, Artificial Sequence
  Synthetic
cgatgaacatcaaagagctcatctagtgccagatgcatcccatctaggccctcagttctgcaagagttgctggtt

SEQ ID NO: 217854 - DNA, 75 bp, Artificial Sequence
  Synthetic
agtcagcctgtctaagtctgaagtgttagggtattttgctgtgtaaatcagacccaaatctgttagcgcctgcac

SEQ ID NO: 217855 - DNA, 75 bp, Artificial Sequence
  Synthetic
ttgggtcaagctgcagcattgcatctttaagagtcataagttgagagtaggtcagcccagctgggaagcctgcag

SEQ ID NO: 217856 - DNA, 75 bp, Artificial Sequence
  Synthetic
tctgcctcgaggtctaccacagtgttttcccaggccctccctactattgatgttctagatgcaatgtatggccac

SEQ ID NO: 217857 - DNA, 75 bp, Artificial Sequence
  Synthetic
tttcccaggccctccctactattgatgttctagatgcaatgtatggccacccatcacctgataagcaaattttat

SEQ ID NO: 217858 - DNA, 75 bp, Artificial Sequence
  Synthetic
tcctcacatgttctgcccttcagtctcaatttaccactacttgactgtaccatcaccttcccctttgacttacta

SEQ ID NO: 217859 - DNA, 75 bp, Artificial Sequence
  Synthetic
atcccaagagctctcttgaccttcaagatggactttaaaatgccatccattgattgaggtgaaactttgattgtt

SEQ ID NO: 217860 - DNA, 75 bp, Artificial Sequence
  Synthetic
agatggactttaaaatgccatccattgattgaggtgaaactttgattgtttccaacatgttcccaccatccaaca

SEQ ID NO: 217861 - DNA, 75 bp, Artificial Sequence
  Synthetic
gaagagctcgtctttggtcaagttgctgtgagctcaagttgcccatatagacacctgcactcaatggcctttctg

SEQ ID NO: 217862 - DNA, 75 bp, Artificial Sequence
  Synthetic
atgttcagggagctcttcttggtatcaatcatgtttaaaatggggtgactttgagtcaacctgtccagatcagag

SEQ ID NO: 217863 - DNA, 75 bp, Artificial Sequence
  Synthetic
caatcatgtttaaaatggggtgactttgagtcaacctgtccagatcagaggcattaggatatttagctgtgtaaa

SEQ ID NO: 217864 - DNA, 75 bp, Artificial Sequence
  Synthetic
agacccatctgtatacttgttcacaacaacactcttattactggccaagtccaaagctgttgcacaaccacttgt

SEQ ID NO: 217865 - DNA, 75 bp, Artificial Sequence
  Synthetic
tgcacaagaaatgccaacttctgtcttgataatctctcgttgtccactaggtactttgatactaagtctttgaca

SEQ ID NO: 217866 - DNA, 75 bp, Artificial Sequence
  Synthetic
ccttgttttgttagacatgctaatgtcaagcttggcattgtaccaaattgattattcaataattctgcatttttt

SEQ ID NO: 217867 - DNA, 75 bp, Artificial Sequence
  Synthetic
tctcctttgaggcactcattgtcaggttgttatgttggatacacgcagcaaagagtcgagactttccgctgaatg

SEQ ID NO: 217868 - DNA, 75 bp, Artificial Sequence
  Synthetic
tcaagcttggcattgtaccaaattgattattcaataattctgcattttttacatcccagactctcaccaccccat

SEQ ID NO: 217869 - DNA, 75 bp, Artificial Sequence
  Synthetic
agctggacttcagtggtaaagctcattttggtgaatccctgaatcaagtgcccagttaaaatgggtaacagacag

SEQ ID NO: 217870 - DNA, 75 bp, Artificial Sequence
  Synthetic
atgattcactataggacaaggtcctgtaggaggcacaggagacacaagaggtaataaaagacaataaaattagat

SEQ ID NO: 217871 - DNA, 75 bp, Artificial Sequence
  Synthetic
aggagtgccctcctctgatcaagctgctgtgaactcaggtttcccatgtagacacctgagctcaggggcctctct

SEQ ID NO: 217872 - DNA, 75 bp, Artificial Sequence
  Synthetic
gctgtgaactcaggtttcccatgtagacacctgagctcaggggcctctctgttcttgtgactttagacttcagct

SEQ ID NO: 217873 - DNA, 75 bp, Artificial Sequence
  Synthetic
cccatagtgctcccctacatacaaccaatggtactggttcgttgtcaggtccgaccttggaaaagtcaaactcac

SEQ ID NO: 217874 - DNA, 75 bp, Artificial Sequence
  Synthetic
ctgtctatactagcagtgttgaaaggtctgtacaattttgcaacatgtggcctcgttggcttggtcactttcctc

SEQ ID NO: 217875 - DNA, 75 bp, Artificial Sequence
  Synthetic
gtctgtacaattttgcaacatgtggcctcgttggcttggtcactttcctcctgttgtgtggcaggtcttgcacaa

SEQ ID NO: 217876 - DNA, 75 bp, Artificial Sequence
  Synthetic
actctcagtacatttttctgttgtgttgatttcaactcaacaaggttgttgactgcctggtttaggtccctgagt

SEQ ID NO: 217877 - DNA, 75 bp, Artificial Sequence
  Synthetic
ttgatttcaactcaacaaggttgttgactgcctggtttaggtccctgagtcgttttagatcaccatcatccctcc

SEQ ID NO: 217878 - DNA, 75 bp, Artificial Sequence
  Synthetic
attcaacttctgtgatcaaatcctctttaattttctcaatcaaatccttgtgataaaaatcggacacaaaggcca

SEQ ID NO: 217879 - DNA, 75 bp, Artificial Sequence
  Synthetic
ccatgtagaagagcttgggcatccttcaccacctgcagcttgatgttggaacagtagcccgataattctctcctc

SEQ ID NO: 217880 - DNA, 75 bp, Artificial Sequence
  Synthetic
cccccggggggaccccccgccgggggcccccccggggggcaggcaacccagctctattcaatgtcctcaacgcac

SEQ ID NO: 217881 - DNA, 75 bp, Artificial Sequence
  Synthetic
taagtcagtaagtgctgatcaaagctgttggaaatcactgatgtgattaatgcaaagcgcaatccaatagcctag

SEQ ID NO: 217882 - DNA, 75 bp, Artificial Sequence
  Synthetic
cacgcaccgaggatcctaggcattttgactgtcttgtaagattgtcttatctaaggtcaagttctgtcatcttat

SEQ ID NO: 217883 - DNA, 75 bp, Artificial Sequence
  Synthetic
ctcgcaccgaggatcctaggcattttgactgtcttgtaagattgtcttatctaaggtcaagttctgtcatcttat

SEQ ID NO: 217884 - DNA, 75 bp, Artificial Sequence
  Synthetic
cccgcaccgaggatcctaggcattttgactgtcttgtaagattgtcttatctaaggtcaagttctgtcatcttat

SEQ ID NO: 217885 - DNA, 75 bp, Artificial Sequence
  Synthetic
cgcgcaccgaggatcctaggcattttgactgtcttgtaagattgtcttatctaaggtcaagttctgtcatcttat

SEQ ID NO: 217886 - DNA, 75 bp, Artificial Sequence
  Synthetic
ctaaggtcaagttctgtcatcttatagttgcagacttggtaagctttcccagacagtgatcctaacaactaagta

SEQ ID NO: 217887 - DNA, 75 bp, Artificial Sequence
  Synthetic
agttgcagacttggtaagctttcccagacagtgatcctaacaactaagtatggaagaggacatagcttatgtaaa

SEQ ID NO: 217888 - DNA, 75 bp, Artificial Sequence
  Synthetic
ccgagcgcaccctcaaccgaggcgacccagaacacaacacctccaccatacaccccgtgatcccaggaacagcac

SEQ ID NO: 217889 - DNA, 75 bp, Artificial Sequence
  Synthetic
agttagcatttcttgtccagactgaacccagaatgctcttgatggagggattgaaacttctgtctctttgcattg

SEQ ID NO: 217890 - DNA, 75 bp, Artificial Sequence
  Synthetic
acccagaatgctcttgatggagggattgaaacttctgtctctttgcattgaagttgattcatgcaatgcaaacgg

SEQ ID NO: 217891 - DNA, 75 bp, Artificial Sequence
  Synthetic
tcgttgcagaccttcaccctctggtattgaggttttatgaggaaaccaagtgaatgacccaagtgtccttgttgt

SEQ ID NO: 217892 - DNA, 75 bp, Artificial Sequence
  Synthetic
tgtccactgcatcagcggtactaaccaccctttcttccatcatgggctcatgtgtgcgagagtgtgaatttctca

SEQ ID NO: 217893 - DNA, 75 bp, Artificial Sequence
  Synthetic
atggcattttgaccccatctctttgttttgtagtgccagatgggtataaattgactggcaatgttttgatcctgc

SEQ ID NO: 217894 - DNA, 75 bp, Artificial Sequence
  Synthetic
ttttgtagtgccagatgggtataaattgactggcaatgttttgatcctgctagaatgttttgtgagatcatcccc

SEQ ID NO: 217895 - DNA, 75 bp, Artificial Sequence
  Synthetic
taaaagaagacttaaaaagtgttgatattagccttattccactgatagacggcagaacatccttctacaacgagc

SEQ ID NO: 217896 - DNA, 75 bp, Artificial Sequence
  Synthetic
ctttgtttcaatctatcagacatcattgatttcaatgcaccaaccaaaagatgtggggaactatcaccaatctcc

SEQ ID NO: 217897 - DNA, 75 bp, Artificial Sequence
  Synthetic
tattagccttattccactgatagacggcagaacatccttctacaacgagcaactacctgattgggtcaatgataa

SEQ ID NO: 217898 - DNA, 75 bp, Artificial Sequence
  Synthetic
actgctgcatcaaacatgatgcagtccattagtgcacagtgaggggttatttcctctttgccgcctcttttcttc

SEQ ID NO: 217899 - DNA, 75 bp, Artificial Sequence
  Synthetic
aatgtccacacctgtccattgaattctttgtttcaatctatcagacatcattgatttcaatgcaccaaccaaaag

SEQ ID NO: 217900 - DNA, 75 bp, Artificial Sequence
  Synthetic
cttgaatagatggtgaaaatgtggctaccctcctatcagattcccacagtgctcccctacatacaaccaatggca

SEQ ID NO: 217901 - DNA, 75 bp, Artificial Sequence
  Synthetic
cactttttgaggaatcagaatacagtaggctctgtgaatctttgtcgatgacctcagggagactttcaggaatcg

SEQ ID NO: 217902 - DNA, 75 bp, Artificial Sequence
  Synthetic
taggctctgtgaatctttgtcgatgacctcagggagactttcaggaatcgagagtttaaacaccttgttagataa

SEQ ID NO: 217903 - DNA, 75 bp, Artificial Sequence
  Synthetic
ttccccgagcacccatgctccaagttctatagctgtagatagtgttatacacatataatcccatagaagaggtct

SEQ ID NO: 217904 - DNA, 75 bp, Artificial Sequence
  Synthetic
ataataaactaacagctcatgaagtaaagttacaaattgaggaagagtatcaagtttttagaaacagactgagag

SEQ ID NO: 217905 - DNA, 75 bp, Artificial Sequence
  Synthetic
aaagttacaaattgaggaagagtatcaagtttttagaaacagactgagaggaggggaaataaagtgtcagtttat

SEQ ID NO: 217906 - DNA, 75 bp, Artificial Sequence
  Synthetic
tccacatctggattccattgtcccccatcactacttcaacaccttgagtccctagtagctgagtctgtatggatt

SEQ ID NO: 217907 - DNA, 75 bp, Artificial Sequence
  Synthetic
agtatcaaaactaaaatcattttggttaacaatttgatagtgatcaattgttcagataactctgtgcactcttct

SEQ ID NO: 217908 - DNA, 75 bp, Artificial Sequence
  Synthetic
atgatgcagtggttgttgaagatgacattgagcagctgatttatcaatttaaaagatcatcacccatactaaggt

SEQ ID NO: 217909 - DNA, 75 bp, Artificial Sequence
  Synthetic
cattgagcagctgatttatcaatttaaaagatcatcacccatactaaggtttttgtattcagacatcgagagaga

SEQ ID NO: 217910 - DNA, 75 bp, Artificial Sequence
  Synthetic
aaaggatgatgtgcagccaagtttaaccaagaatactcaaggtcagactcagatgggggctcaacatccaacagc

SEQ ID NO: 217911 - DNA, 75 bp, Artificial Sequence
  Synthetic
aggtgtccctaagtttgtcattcacccagtcaggtatctgctcgttataaaaagttgttctaccgtctataagag

SEQ ID NO: 217912 - DNA, 75 bp, Artificial Sequence
  Synthetic
ggaggtcattcttgaacaaagttaagtctctaaggattctaaatacgagaaggaaactcttgttaatttttgaca

SEQ ID NO: 217913 - DNA, 75 bp, Artificial Sequence
  Synthetic
gtctctaaggattctaaatacgagaaggaaactcttgttaatttttgacacactaattcttcttgcgagtagata

SEQ ID NO: 217914 - DNA, 75 bp, Artificial Sequence
  Synthetic
aagcggatgatgggtggctaagttcaaccaatgatactccaagtcagaatcagacaaaggttcaacgtctagaag

SEQ ID NO: 217915 - DNA, 75 bp, Artificial Sequence
  Synthetic
tcagtgtcaatgatagactagtttctttggagtcaaccaaaaaagaccttaagagatggatagaacggagacaac

SEQ ID NO: 217916 - DNA, 75 bp, Artificial Sequence
  Synthetic
tttggagtcaaccaaaaaagaccttaagagatggatagaacggagacaacagattgaggcatcaaaatccgtaac

SEQ ID NO: 217917 - DNA, 75 bp, Artificial Sequence
  Synthetic
tagtgaattcctcatgaagctcaccagttttcaatttattgaacagtatcctaagcattgacctcatctttttgc

SEQ ID NO: 217918 - DNA, 75 bp, Artificial Sequence
  Synthetic
agaccatcacaagggctttggctgcactagaaagtgttgggataagtatggaccaatttggcgtagacatgaacg

SEQ ID NO: 217919 - DNA, 75 bp, Artificial Sequence
  Synthetic
actagaaagtgttgggataagtatggaccaatttggcgtagacatgaacgtagtcagtcttgattgttatgattc

SEQ ID NO: 217920 - DNA, 75 bp, Artificial Sequence
  Synthetic
agtcacaagaggagattttcccatatgccatgggggtagttgaactgctgcagattactgatttggagagattgt

SEQ ID NO: 217921 - DNA, 75 bp, Artificial Sequence
  Synthetic
cttcaacaccttgagtccccagtagctgagtctgtatggatctaatgtaaagattctccttgttagggcctctga

SEQ ID NO: 217922 - DNA, 75 bp, Artificial Sequence
  Synthetic
tgccatgggggtagttgaactgctgcagattactgatttggagagattgtcttcgttaagccttgctttgatcaa

SEQ ID NO: 217923 - DNA, 75 bp, Artificial Sequence
  Synthetic
aaacatagaaccttgatttgaactctgcaacaaacctgccaattgcactctttggactcacaaatttatttagct

SEQ ID NO: 217924 - DNA, 75 bp, Artificial Sequence
  Synthetic
cagcaagatatcaagtggttagatgcaaggaggcttactgtcaggaatttatgctgaataacactaagtttcaac

SEQ ID NO: 217925 - DNA, 75 bp, Artificial Sequence
  Synthetic
caaggaggcttactgtcaggaatttatgctgaataacactaagtttcaactaatttatcaaaaaacaggagaatg

SEQ ID NO: 217926 - DNA, 75 bp, Artificial Sequence
  Synthetic
tttatgctgaccctaagaggtactttcctgcaattttctcagctgaggttttgcaaacaacagtagatactatga

SEQ ID NO: 217927 - DNA, 75 bp, Artificial Sequence
  Synthetic
tcctgcaattttctcagctgaggttttgcaaacaacagtagatactatgatcacttggattgaagattgtagtga

SEQ ID NO: 217928 - DNA, 75 bp, Artificial Sequence
  Synthetic
caacgcataaaagtctgaggtgttgtgcaggataccctgtcccatatcaaggattgaactaatgtgtgaggggac

SEQ ID NO: 217929 - DNA, 75 bp, Artificial Sequence
  Synthetic
aagagcccttctttggtcaagttgctgtgagcttaggttgcccatatagacacctgcactcaatggcctttctgt

SEQ ID NO: 217930 - DNA, 75 bp, Artificial Sequence
  Synthetic
tattaatcttagcccacccaagcaaacgcagtcaaaaacttcttcagaaccttagatactttatcatggcttatg

SEQ ID NO: 217931 - DNA, 75 bp, Artificial Sequence
  Synthetic
acgcagtcaaaaacttcttcagaaccttagatactttatcatggcttatgtatcagactaccaccatatagatct

SEQ ID NO: 217932 - DNA, 75 bp, Artificial Sequence
  Synthetic
agtcatctgaggttagagtcccaactctcagtacactcttttgttgagttgattttaattcaacaagattgttga

SEQ ID NO: 217933 - DNA, 75 bp, Artificial Sequence
  Synthetic
atagattaataagggctctaataaacctgattttacatgatgaggtgaaaagcatgatgactaatagatttaaat

SEQ ID NO: 217934 - DNA, 75 bp, Artificial Sequence
  Synthetic
cctgattttacatgatgaggtgaaaagcatgatgactaatagatttaaattcattctgaacgtgtcatacatgtg

SEQ ID NO: 217935 - DNA, 75 bp, Artificial Sequence
  Synthetic
gttttgagaagtttcttgagcctaaaatagaatttggccatgtgagtgtgaaccctgcagatacagctacagagg

SEQ ID NO: 217936 - DNA, 75 bp, Artificial Sequence
  Synthetic
atgacctacaaagggagttatcaacttgaaacccttgagctgaacatggagacgcttaacatgactatgcctctg

SEQ ID NO: 217937 - DNA, 75 bp, Artificial Sequence
  Synthetic
aattctgtaatgatgttgtgtgttcacctgataggtagttggtggtgaattcctcatgaagctcaccagttttta

SEQ ID NO: 217938 - DNA, 75 bp, Artificial Sequence
  Synthetic
aatagaatttggccatgtgagtgtgaaccctgcagatacagctacagaggaggagttgatagacatggttcacca

SEQ ID NO: 217939 - DNA, 75 bp, Artificial Sequence
  Synthetic
tccaagagccagcctgatcccagatgccacacacctagggccacagttctgcaagagctgctggttcgaaaacaa

SEQ ID NO: 217940 - DNA, 75 bp, Artificial Sequence
  Synthetic
aatataaaaagcctggagtctcgaggagattcctttcccttctcacatcttctttcaacaatggttctttgttta

SEQ ID NO: 217941 - DNA, 75 bp, Artificial Sequence
  Synthetic
ccctttcactaattctcacatcatcagagagcttacccatatcaaacttgaaattaaggtttcttgacttataat

SEQ ID NO: 217942 - DNA, 75 bp, Artificial Sequence
  Synthetic
gagattcctttcccttctcacatcttctttcaacaatggttctttgtttaaagaaaaggaagtaaaaaaggagtt

SEQ ID NO: 217943 - DNA, 75 bp, Artificial Sequence
  Synthetic
gcaataaaagcgtggttgtgaataagtacactgatggctctagagtactaaattatgacttcaacaaacttactg

SEQ ID NO: 217944 - DNA, 75 bp, Artificial Sequence
  Synthetic
gtacactgatggctctagagtactaaattatgacttcaacaaacttactgcattagctgtgacacagctgactga

SEQ ID NO: 217945 - DNA, 75 bp, Artificial Sequence
  Synthetic
ctatccaggcataacccatcatcagatcatgtttaaacattggcctttcaacacccttgtgaataactttctcta

SEQ ID NO: 217946 - DNA, 75 bp, Artificial Sequence
  Synthetic
atagacagcattacagaattcttcataaaacttacctggtaagatatcatgatcaaagtcctcaaccatgtgatt

SEQ ID NO: 217947 - DNA, 75 bp, Artificial Sequence
  Synthetic
acaaggtacagcaggcaatgagcaacttagtgttgggatctcagcaacaaactgctgatgttgacaggtctgatc

SEQ ID NO: 217948 - DNA, 75 bp, Artificial Sequence
  Synthetic
tgagagtatttccccattagcttattcccattcattaataataaaattgacttaaagcactggaaatattcttgg

SEQ ID NO: 217949 - DNA, 75 bp, Artificial Sequence
  Synthetic
cttagtgttgggatctcagcaacaaactgctgatgttgacaggtctgatctggatgaaatcttgcttgaaggggg

SEQ ID NO: 217950 - DNA, 75 bp, Artificial Sequence
  Synthetic
atcaatatagagaacctattagtctgagttcggtaaaaagaagtgatggtcaaccatcaattaatgatctggatg

SEQ ID NO: 217951 - DNA, 75 bp, Artificial Sequence
  Synthetic
gagttcggtaaaaagaagtgatggtcaaccatcaattaatgatctggatgaattgatttccaataaattctacat

SEQ ID NO: 217952 - DNA, 75 bp, Artificial Sequence
  Synthetic
gtattgatcctcagacaggatttctcgatcaaaatcttctatcatatggtttgaaagttcactttttattaacct

SEQ ID NO: 217953 - DNA, 75 bp, Artificial Sequence
  Synthetic
ggtcagccccatcagcatcacttttgtgctgtccagaccccaggaccagattgctcattgcctgttgtactttgt

SEQ ID NO: 217954 - DNA, 75 bp, Artificial Sequence
  Synthetic
tctcaattcctgaaagtctccctgaagtcattgacaaagactcacacagcctactgtattctgattcctcaaaaa

SEQ ID NO: 217955 - DNA, 75 bp, Artificial Sequence
  Synthetic
atgaaattctgcctgatgatttttataaagaattctgtgacaatgtctacaatagtcacaagatgagagaaaaat

SEQ ID NO: 217956 - DNA, 75 bp, Artificial Sequence
  Synthetic
taaagaattctgtgacaatgtctacaatagtcacaagatgagagaaaaatatttttacagcggtcatatgtccca

SEQ ID NO: 217957 - DNA, 75 bp, Artificial Sequence
  Synthetic
agcaagagtatttccagtgttttaaatctgtgcttttgatcatgaatgcaaataagctcatgggaagatatactc

SEQ ID NO: 217958 - DNA, 75 bp, Artificial Sequence
  Synthetic
atctgtgcttttgatcatgaatgcaaataagctcatgggaagatatactcattataagtcaaggaatctaaactt

SEQ ID NO: 217959 - DNA, 75 bp, Artificial Sequence
  Synthetic
gccactggtgatgagagggtctttgatttccctttttacttccttctccttaaatagtgagccattgttaaaaga

SEQ ID NO: 217960 - DNA, 75 bp, Artificial Sequence
  Synthetic
tcccaagacccatgcacccagttctattgcagttgataaagaaatgcacatgtagtcccataacagaggtctaaa

SEQ ID NO: 217961 - DNA, 75 bp, Artificial Sequence
  Synthetic
aaagcaattctgaagcattaagcaaggccctgtcactaacaagttgcaccactgctatgttaaagaatctttgtt

SEQ ID NO: 217962 - DNA, 75 bp, Artificial Sequence
  Synthetic
ggccctgtcactaacaagttgcaccactgctatgttaaagaatctttgtttttacagtcaagagtcaccacaatc

SEQ ID NO: 217963 - DNA, 75 bp, Artificial Sequence
  Synthetic
ataaagagcaggtaggtggtaacagggaattgtacattggtgatttaagaaccaagatgttcacaagattaattg

SEQ ID NO: 217964 - DNA, 75 bp, Artificial Sequence
  Synthetic
ggaattgtacattggtgatttaagaaccaagatgttcacaagattaattgaggattattttgaagcactgagttt

SEQ ID NO: 217965 - DNA, 75 bp, Artificial Sequence
  Synthetic
ttttgtctatgaaactcaatgtctctttagcacacgtctcctacagtatggatcacagtaagtggggtccaatga

SEQ ID NO: 217966 - DNA, 75 bp, Artificial Sequence
  Synthetic
tttagcacacgtctcctacagtatggatcacagtaagtggggtccaatgatgtgtccatttttgtttttagctgt

SEQ ID NO: 217967 - DNA, 75 bp, Artificial Sequence
  Synthetic
ttgttcttttttgagaccttgtgcgctgaactcctccaaatgggaaacaaacaagccaaggtcccagaatcaaaa

SEQ ID NO: 217968 - DNA, 75 bp, Artificial Sequence
  Synthetic
gaagagattacctctcaacactactaacatggcatatgcataaaatggttgaaatacccttcaatgttgtatcag

SEQ ID NO: 217969 - DNA, 75 bp, Artificial Sequence
  Synthetic
aacatggatctaatcttgctacaggcatcaggaattaatccctctatctgcctcataatcctgtaactgcggtta

SEQ ID NO: 217970 - DNA, 75 bp, Artificial Sequence
  Synthetic
aacatggcatatgcataaaatggttgaaatacccttcaatgttgtatcagctatgatgaagtcatttataaaagc

SEQ ID NO: 217971 - DNA, 75 bp, Artificial Sequence
  Synthetic
ttggccctacataaaaatatttacttctcaaagcagcatcattgtagatattctcacaaattttgatgtattgat

SEQ ID NO: 217972 - DNA, 75 bp, Artificial Sequence
  Synthetic
tttactccaactttcagataggcgtggtaccctcccatatcagctctatacttgacatgggtcagggtatattac

SEQ ID NO: 217973 - DNA, 75 bp, Artificial Sequence
  Synthetic
ggtaccctcccatatcagctctatacttgacatgggtcagggtatattacataacacatcggatttctatgctct

SEQ ID NO: 217974 - DNA, 75 bp, Artificial Sequence
  Synthetic
tgtgcactcttctatccagctgaccataacatcaaccactttctgcaacacatcactggagaaaactgaaggaaa

SEQ ID NO: 217975 - DNA, 75 bp, Artificial Sequence
  Synthetic
caatagatgcctacacttcgagtgatgaccaaatttccttatttgatcaggctttaactgaactcatgcaaagag

SEQ ID NO: 217976 - DNA, 75 bp, Artificial Sequence
  Synthetic
acacatcattgggccccacttgctatgatccatgctataggacacatgtgccaatgagacattcaatttcatgga

SEQ ID NO: 217977 - DNA, 75 bp, Artificial Sequence
  Synthetic
gaacaaacctctccaactacattgttattaatagcataacactttgagcattcacctgtcttttgatacaatagt

SEQ ID NO: 217978 - DNA, 75 bp, Artificial Sequence
  Synthetic
tgaccaaatttccttatttgatcaggctttaactgaactcatgcaaagagacccggaagaattcaagacattgtt

SEQ ID NO: 217979 - DNA, 75 bp, Artificial Sequence
  Synthetic
aaagtgttgttggtaggtttgttgcagaatttaaatccagattttatgtgtggggggatgaggtccctttactaa

SEQ ID NO: 217980 - DNA, 75 bp, Artificial Sequence
  Synthetic
agaatttaaatccagattttatgtgtggggggatgaggtccctttactaacaaaattcgttgctgcagccttaca

SEQ ID NO: 217981 - DNA, 75 bp, Artificial Sequence
  Synthetic
tcattgatcaatcagttgcaaatggagtccctgttcacttgtgcaatttgattcagctaaggactttgagtctcc

SEQ ID NO: 217982 - DNA, 75 bp, Artificial Sequence
  Synthetic
agtccctgttcacttgtgcaatttgattcagctaaggactttgagtctcctgcaatatgctaggtaccctatcga

SEQ ID NO: 217983 - DNA, 75 bp, Artificial Sequence
  Synthetic
gttgcctccgctcaacccatttcttgagatccctttttgttgactccaaagaaactagtctatcattgacactta

SEQ ID NO: 217984 - DNA, 75 bp, Artificial Sequence
  Synthetic
accgcagctacagaatcatgagacagatagagagcttaatccctgaagcatgtagtaaggttagatctatgctaa

SEQ ID NO: 217985 - DNA, 75 bp, Artificial Sequence
  Synthetic
gatagagagcttaatccctgaagcatgtagtaaggttagatctatgctaaggaaactgtttaacaggctgaagac

SEQ ID NO: 217986 - DNA, 75 bp, Artificial Sequence
  Synthetic
cgtcctcacttaggaatttatgtaatatgttaggtgttgatcctccatcagaatctgatttagagttttcgtggt

SEQ ID NO: 217987 - DNA, 75 bp, Artificial Sequence
  Synthetic
tgtccaaattctaatttgggttcaaggaatttttcaaagcatttgatctgatcagtcagtctgtcaggtgtttct

SEQ ID NO: 217988 - DNA, 75 bp, Artificial Sequence
  Synthetic
tatgttaggtgttgatcctccatcagaatctgatttagagttttcgtggttgaatctggctgcttaccacccttt

SEQ ID NO: 217989 - DNA, 75 bp, Artificial Sequence
  Synthetic
cattctattgataaagaactcttggcaataggcctctttgcacctcacaacctggtatctagagggtccaaattc

SEQ ID NO: 217990 - DNA, 75 bp, Artificial Sequence
  Synthetic
aaggtggatggcaaagctttccttaaaactagcatcttgactcttaatacggaacctcactgtctgactcagttt

SEQ ID NO: 217991 - DNA, 75 bp, Artificial Sequence
  Synthetic
atgatgaaaaaatccccacaattattaagacgatccagaacaagttgtcgtcaactttcactcgaggggcacaga

SEQ ID NO: 217992 - DNA, 75 bp, Artificial Sequence
  Synthetic
taagacgatccagaacaagttgtcgtcaactttcactcgaggggcacagaaactgttatcagaagctataaataa

SEQ ID NO: 217993 - DNA, 75 bp, Artificial Sequence
  Synthetic
cattgggtagcaaatgtgttcgggggccaaataaggaaaatctgtacatcaagtccattcaatcattgatttcta

SEQ ID NO: 217994 - DNA, 75 bp, Artificial Sequence
  Synthetic
gccaaataaggaaaatctgtacatcaagtccattcaatcattgatttctagcactcagggtattgagctcttaac

SEQ ID NO: 217995 - DNA, 75 bp, Artificial Sequence
  Synthetic
aaattgactttctatgtccccctgcctcagtttgttcctgaagatttgatactcctcctcaattaaactcttgac

SEQ ID NO: 217996 - DNA, 75 bp, Artificial Sequence
  Synthetic
tccatcagaacatttaaactctccacccctgataatctacctgaagtcatagataaagattcacagagtctgcta

SEQ ID NO: 217997 - DNA, 75 bp, Artificial Sequence
  Synthetic
aaaagaatagtgtggttggttattttagaccactgctatgggactatatgtgcatttctctatcaactgcaatag

SEQ ID NO: 217998 - DNA, 75 bp, Artificial Sequence
  Synthetic
tttttcaagcacaatccttgtgattatttccctttgaagccgactgcatcaaaactacttgaagacagggtgggt

SEQ ID NO: 217999 - DNA, 75 bp, Artificial Sequence
  Synthetic
aagcactcatctcagtctggacacttagggatttgctgattgaaagctttaatcagtaaatcaatgaaaagcgca

SEQ ID NO: 218000 - DNA, 75 bp, Artificial Sequence
  Synthetic
atcctaggcaatttagctggacttcagtggtaaggctcaacctagtggatccctgaatcaaagtgcctaataaaa

SEQ ID NO: 218001 - DNA, 75 bp, Artificial Sequence
  Synthetic
gatttggcttccacaaagatgaagtggtcacccaggataaagtttctggatctttgtgtagcactagatgtgaac

SEQ ID NO: 218002 - DNA, 75 bp, Artificial Sequence
  Synthetic
tggagaggctcttcggaattgaaatgttaactgttcaatgttgtcatcacaggtgtctatcttatcattatacaa

SEQ ID NO: 218003 - DNA, 75 bp, Artificial Sequence
  Synthetic
acattacatagtgttatcgtctgagttgaggttatctcatagcaggatccatgagcccatggtggaggagagagt

SEQ ID NO: 218004 - DNA, 75 bp, Artificial Sequence
  Synthetic
ttgaggttatctcatagcaggatccatgagcccatggtggaggagagagttgtgagtaccagtgatgcagttgat

SEQ ID NO: 218005 - DNA, 75 bp, Artificial Sequence
  Synthetic
taggtactttgacactaagtctttgacataggctacatcttcctccatgtctagccacaggtgtgatgatcagaa

SEQ ID NO: 218006 - DNA, 75 bp, Artificial Sequence
  Synthetic
tacaactagaactctaggatcctttacatggtttccacataagacaagcatcccagagggtgaggggctacaaag

SEQ ID NO: 218007 - DNA, 75 bp, Artificial Sequence
  Synthetic
acatggtttccacataagacaagcatcccagagggtgaggggctacaaagactaggcccattttcttcatttgtg

SEQ ID NO: 218008 - DNA, 75 bp, Artificial Sequence
  Synthetic
gcaacagttaactataggacagggtctcgcgggaggcacaaaaggaacaagaggcaattaaagacaattaaaata

SEQ ID NO: 218009 - DNA, 75 bp, Artificial Sequence
  Synthetic
gctccaacagcacctcaaaccggagcagcggacagcatcagacccccaccctatagtccctgaacatcccaccaa

SEQ ID NO: 218010 - DNA, 75 bp, Artificial Sequence
  Synthetic
agcattggcaatgtcttcctccatcgccaattgtggcacctgtgttgggtttgggtttgtgccagtatggcttgt

SEQ ID NO: 218011 - DNA, 75 bp, Artificial Sequence
  Synthetic
aatgatgggctacgcttggatagatttcgatgttgaaccagctaagttcaatcaaaaccaattgattgcatcagg

SEQ ID NO: 218012 - DNA, 75 bp, Artificial Sequence
  Synthetic
acaactccagagacatcaaagtccataatcatatcataactgttaaggcaaatcacctccatatcaattttatag

SEQ ID NO: 218013 - DNA, 75 bp, Artificial Sequence
  Synthetic
ttcgatgttgaaccagctaagttcaatcaaaaccaattgattgcatcaggattggtcaattctaaatttgagtca

SEQ ID NO: 218014 - DNA, 75 bp, Artificial Sequence
  Synthetic
atttaggattgcgctttttggagacctttgtgtgagtgggcttcatcaagccatgggacaaatcataacattttt

SEQ ID NO: 218015 - DNA, 75 bp, Artificial Sequence
  Synthetic
attaagtcaaacaataaggtttcaaattaaaagtcaagatgctagctttaaagagaattttgccattcacctcaa

SEQ ID NO: 218016 - DNA, 75 bp, Artificial Sequence
  Synthetic
attaaaagtcaagatgctagctttaaagagaattttgccattcacctcaactttgttggctcaataaatgaacaa

SEQ ID NO: 218017 - DNA, 75 bp, Artificial Sequence
  Synthetic
ctcctgtgttttatcagattgttggagattggtgctgtctggtccaaccttcaaggggaaatcagcatggtatgt

SEQ ID NO: 218018 - DNA, 75 bp, Artificial Sequence
  Synthetic
agattggtgctgtctggtccaaccttcaaggggaaatcagcatggtatgtagatactgaagaaatcaatgagttc

SEQ ID NO: 218019 - DNA, 75 bp, Artificial Sequence
  Synthetic
accagattgctcattgcttgctgcactttgtattcatagtcctgtttgttgagaagatactttccctttcttgag

SEQ ID NO: 218020 - DNA, 75 bp, Artificial Sequence
  Synthetic
tcaattaaactcttgacttcatgagaggtgagcttgttattaatgccctgatgacaactagaaattatttcctca

SEQ ID NO: 218021 - DNA, 75 bp, Artificial Sequence
  Synthetic
cattcccctcatcaatatttgcatacaaaaatctcaatattggtgatgctctcttgaactgataaattaagtgtt

SEQ ID NO: 218022 - DNA, 75 bp, Artificial Sequence
  Synthetic
tgatgccgatagattacaatttatggaacatgattttgttttggtgggcccttgttctgaatcagttcctttggt

SEQ ID NO: 218023 - DNA, 75 bp, Artificial Sequence
  Synthetic
caatgtcttcctccatcgtcaattgtggcacctatattgggcttgggcttgtacctatgtggtgtgtgggtcagc

SEQ ID NO: 218024 - DNA, 75 bp, Artificial Sequence
  Synthetic
ctggcttggagctgactttaacaaatacaagtattatcaaccacaagttttgtaacctttctgatgcacataaaa

SEQ ID NO: 218025 - DNA, 75 bp, Artificial Sequence
  Synthetic
gaacatgattttgttttggtgggcccttgttctgaatcagttcctttggttgtacatagaggtgggttgtgggag

SEQ ID NO: 218026 - DNA, 75 bp, Artificial Sequence
  Synthetic
tccattcctaactttaatcagtatgaagcaatgagttgtgacttcaatggagggaagataagtgttcagtacaac

SEQ ID NO: 218027 - DNA, 75 bp, Artificial Sequence
  Synthetic
tgtgggtcagctggtagtaccccacaaaagctcttacagaaatgagagtcaatatgcctaggatcctcggtgcgc

SEQ ID NO: 218028 - DNA, 75 bp, Artificial Sequence
  Synthetic
tgagttatttgtaaaagaagttggtgatacatctcctagcctgctgagtggggcattgagtgccatgatatcaga

SEQ ID NO: 218029 - DNA, 75 bp, Artificial Sequence
  Synthetic
caatatggggcagatagtcacgtttttccaagaagtgcctcatgttatagaggaagtgatgaacattgtgctcat

SEQ ID NO: 218030 - DNA, 75 bp, Artificial Sequence
  Synthetic
cgcaccggggatcctaggcatttttggttgcgcaattcaggtgtccatttcaatatggggcagatagtcacgttt

SEQ ID NO: 218031 - DNA, 75 bp, Artificial Sequence
  Synthetic
ttccaagaagtgcctcatgttatagaggaagtgatgaacattgtgctcattgcactgtctttgctagcagtgctg

SEQ ID NO: 218032 - DNA, 75 bp, Artificial Sequence
  Synthetic
gatacatctcctagcctgctgagtggggcattgagtgccatgatatcagatagattgaggttaagaatgcagtgg

SEQ ID NO: 218033 - DNA, 75 bp, Artificial Sequence
  Synthetic
agaatctttatgaccatgctttaatgagcatcatctcaaccttccacttatccattcctaactttaatcagtatg

SEQ ID NO: 218034 - DNA, 75 bp, Artificial Sequence
  Synthetic
cttggaggtcctgaacactgtttttgaggtagtggacgattgggttgaatttaagggctatgcactatgcttcag

SEQ ID NO: 218035 - DNA, 75 bp, Artificial Sequence
  Synthetic
ccttttgttgtgtggtaggtcttgtacaaccaatctttacaagggagtctatgagcttcaagccctggaattaaa

SEQ ID NO: 218036 - DNA, 75 bp, Artificial Sequence
  Synthetic
gaggtagtggacgattgggttgaatttaagggctatgcactatgcttcagtaagtcaaggagaagaattatgata

SEQ ID NO: 218037 - DNA, 75 bp, Artificial Sequence
  Synthetic
atgagcttcaagccctggaattaaacatggagacgctcaacatgaccatgcctctctcctgcacaaagaacaata

SEQ ID NO: 218038 - DNA, 75 bp, Artificial Sequence
  Synthetic
tctcagggaagaagaacaggtcgaagacatagaataactgcccgagcgtggccgcctcccccgggggggcccccg

SEQ ID NO: 218039 - DNA, 75 bp, Artificial Sequence
  Synthetic
gacatagaataactgcccgagcgtggccgcctcccccgggggggcccccggcggggggtccccccggggggtgtc

SEQ ID NO: 218040 - DNA, 75 bp, Artificial Sequence
  Synthetic
accaacacaagcattatcaatcacaagttttgcaacctgtctgatgcccacaaaaagaacctctatgatcacgcc

SEQ ID NO: 218041 - DNA, 75 bp, Artificial Sequence
  Synthetic
agttttgcaacctgtctgatgcccacaaaaagaacctctatgatcacgccttaatgagcataatctcaactttcc

SEQ ID NO: 218042 - DNA, 75 bp, Artificial Sequence
  Synthetic
gtgggggattggtgatgctctccctggtgatttgtggtgctgttggcgtggttatcggcttgagcttcgtgggaa

SEQ ID NO: 218043 - DNA, 75 bp, Artificial Sequence
  Synthetic
ggtgatttgtggtgctgttggcgtggttatcggcttgagcttcgtgggaagaggcatcttacagatagggcacct

SEQ ID NO: 218044 - DNA, 75 bp, Artificial Sequence
  Synthetic
aatgggggaaggatcagtgtgcagtataacctaagtcacagctatgctggggatgcagccagccattgtggtaca

SEQ ID NO: 218045 - DNA, 75 bp, Artificial Sequence
  Synthetic
gtgcctatatggcttgcaggtcagctagtggtgcccaaaaaactcccacagaaatgagagacaatatgcctagga

SEQ ID NO: 218046 - DNA, 75 bp, Artificial Sequence
  Synthetic
gcactgatcaatgaccagctgattatgaagaatcatttgagagatatcatgggaattccttactgcaattacagc

SEQ ID NO: 218047 - DNA, 75 bp, Artificial Sequence
  Synthetic
gaggtcctgtagggggcacaagggacacaagagtcaattaaaagcaattaaattagatggccttaatgcctagga

SEQ ID NO: 218048 - DNA, 75 bp, Artificial Sequence
  Synthetic
tgttacactcaactaaacctttgttttcaaaccaacaactcttgcaaaattgtggtccaaggtgcgtggcatccg

SEQ ID NO: 218049 - DNA, 75 bp, Artificial Sequence
  Synthetic
ttatattgctcttgattcaggccatggtggatgggactgcatcatgactagttaccaatatctgataattcagaa

SEQ ID NO: 218050 - DNA, 75 bp, Artificial Sequence
  Synthetic
ggtggatgggactgcatcatgactagttaccaatatctgataattcagaacacaacctgggaagatcactgccag

SEQ ID NO: 218051 - DNA, 75 bp, Artificial Sequence
  Synthetic
tttaacaagcaagctataaggaggctgaagacagaagcacagatgagtatccaactgataaacaaagcagtgaac

SEQ ID NO: 218052 - DNA, 75 bp, Artificial Sequence
  Synthetic
ctctgtctttggatctttggcttgcttattccccatttgctgagcctaagttgtgaagctctgtagaggaacgat

SEQ ID NO: 218053 - DNA, 75 bp, Artificial Sequence
  Synthetic
atgacattgaacaacaagcagacaacatgataacagaactgttgcaaaaggagtacatagacaggcaagggaaaa

SEQ ID NO: 218054 - DNA, 75 bp, Artificial Sequence
  Synthetic
ctgtttcaagtctgttggttctctgaagaagtgtatgtaacagcccgacataggttggtaaagagctatttccac

SEQ ID NO: 218055 - DNA, 75 bp, Artificial Sequence
  Synthetic
taggtgaccatttcatctttgtggaagctaaatcactcataaatggcaatatgtgcttctcaaacagagacggat

SEQ ID NO: 218056 - DNA, 75 bp, Artificial Sequence
  Synthetic
ctactgggcacattcacatggacattgtcagattctgaaggcaaggatacaccaggggggtactgtctaactagg

SEQ ID NO: 218057 - DNA, 75 bp, Artificial Sequence
  Synthetic
agacatggcaagccttaatatgacaatgcccttatcttgcacgaagaacaacagccaccattacatcatggtcgg

SEQ ID NO: 218058 - DNA, 75 bp, Artificial Sequence
  Synthetic
accatgcctctctcttgcacaaagaacaacagtcatcattacataagggtgggcaatgagacaggactagaactg

SEQ ID NO: 218059 - DNA, 75 bp, Artificial Sequence
  Synthetic
gaattttgtgatatgttgagactgtttgacttcaacaaacaagccattcaaaggctgaaagcagaagcacagatg

SEQ ID NO: 218060 - DNA, 75 bp, Artificial Sequence
  Synthetic
tcagtatgaagcaatgagttgtgacttcaatggggggaagataagtgttcagtacaaccttagccacacttatgc

SEQ ID NO: 218061 - DNA, 75 bp, Artificial Sequence
  Synthetic
aataatgaaaaaccatctgcgagacattatggggattccatactgtaactacagcaagtattggtatctcaacca

SEQ ID NO: 218062 - DNA, 75 bp, Artificial Sequence
  Synthetic
ctgcccctgttttgtcagacatgccagtgtcagacttggcatggtcccgaactgattattgagcaactctgcatt

SEQ ID NO: 218063 - DNA, 75 bp, Artificial Sequence
  Synthetic
agtgtcagacttggcatggtcccgaactgattattgagcaactctgcatttttcacatcccaaactctcaccact

SEQ ID NO: 218064 - DNA, 75 bp, Artificial Sequence
  Synthetic
cctaagtgctggcttgtgtcaaatggctcatatctgaacgaaacccacttctctgatgatattgagcaacaggcc

SEQ ID NO: 218065 - DNA, 75 bp, Artificial Sequence
  Synthetic
ctgacacagctgcatcatacattatgcagtccattaaagcacagtgcggggtgatctcctctttgccccctcttt

SEQ ID NO: 218066 - DNA, 75 bp, Artificial Sequence
  Synthetic
tgatcccaaacagcattttcaaatctcctagagtcagccttgctcagtgcaatgtcaataagctttatatccctt

SEQ ID NO: 218067 - DNA, 75 bp, Artificial Sequence
  Synthetic
agtcaaaataccgactcataggcatgttgtaggaaaaccgtgtcctaaacctcacagactgaatcacatgggcat

SEQ ID NO: 218068 - DNA, 75 bp, Artificial Sequence
  Synthetic
agaagactactaggcacatttacatggacactgtcagactctgaaggcaaggacacaccagggggatattgtctg

SEQ ID NO: 218069 - DNA, 75 bp, Artificial Sequence
  Synthetic
agcatcttgacttttaatacggaacctcactgtctgactcagtttcgcagaccctggaggtagtaaagccacagc

SEQ ID NO: 218070 - DNA, 75 bp, Artificial Sequence
  Synthetic
ggtggcggttcactgtgggatagggccctacaagatgcaactagaccggataaaatgaaatgaatgaatgaaaag

SEQ ID NO: 218071 - DNA, 75 bp, Artificial Sequence
  Synthetic
aagtccatgtaaaagagcctgggcatctttcaccacctgtagtttgatgttggagcagtaaccagataattccct

SEQ ID NO: 218072 - DNA, 75 bp, Artificial Sequence
  Synthetic
accatatctctgggcagcactgcccttaaaaccagtgtgttcagtcctcctgacactgctgcatcaaacatgatg

SEQ ID NO: 218073 - DNA, 75 bp, Artificial Sequence
  Synthetic
tgcatgtggcataagtctttgtactggtcccagactgcgttctcatacttcctagaatcagttttgctgagagca

SEQ ID NO: 218074 - DNA, 75 bp, Artificial Sequence
  Synthetic
caagctgacaacatgatcactgagatgttacagaaagagtacatggaaaggcaggggaagacaccattgggtcta

SEQ ID NO: 218075 - DNA, 75 bp, Artificial Sequence
  Synthetic
ccttggaagcactcatcctgatctagacactcagggactcactggttgaaagtatcactcagtaagtcagtgaaa

SEQ ID NO: 218076 - DNA, 75 bp, Artificial Sequence
  Synthetic
gcaggggaagacaccattgggtctagttgacctctttgtgttcagcacaagtttctatctcattagcatcttcct

SEQ ID NO: 218077 - DNA, 75 bp, Artificial Sequence
  Synthetic
tatgtcatcagaaccctgacaggtgatgaccatgttccgggggagtgcttctattacagcactagttagtcctgg

SEQ ID NO: 218078 - DNA, 75 bp, Artificial Sequence
  Synthetic
ctgtgcagcaaaaaggtctgtgacatcaattccatgtgaatacttagcatcttgtttaaactgttttaggtcagt

SEQ ID NO: 218079 - DNA, 75 bp, Artificial Sequence
  Synthetic
ggaagaggtgagactcccatcagggcccccgtgacccaccgcctattggcggtgggtcacgggggcgtccattta

SEQ ID NO: 218080 - DNA, 75 bp, Artificial Sequence
  Synthetic
gcatttggatcaagctgcagcattgcatccttaagggtcatgagctgagaataagtgagcccagcagcaaaccct

SEQ ID NO: 218081 - DNA, 75 bp, Artificial Sequence
  Synthetic
caggacgactctaggtgtcgatgttctgaacaccatgtctctgggtagcactgctctcaggaccaatgttttcag

SEQ ID NO: 218082 - DNA, 75 bp, Artificial Sequence
  Synthetic
atcacctccatatcaattttatagtggtccacactgatcccaacatcctttaaaacagtggtggccttcagaatg

SEQ ID NO: 218083 - DNA, 75 bp, Artificial Sequence
  Synthetic
tattgtgttcgcagccattggccttgcaggagtcaatctcaatacagagagatagcagtttcaacccctccatga

SEQ ID NO: 218084 - DNA, 75 bp, Artificial Sequence
  Synthetic
cccatctgattccaaatcaacaacagtgttttcccaggcccttcctattattgaagtccttgatgcaatatatgg

SEQ ID NO: 218085 - DNA, 75 bp, Artificial Sequence
  Synthetic
aaaagcaaaggttttttaacatagcagtagtacaatttgttaatgatagggccttgctcaatgcctcagaattgc

SEQ ID NO: 218086 - DNA, 75 bp, Artificial Sequence
  Synthetic
gtgttttcccaggcccttcctattattgaagtccttgatgcaatatatggccatccatcccctgacagacagatt

SEQ ID NO: 218087 - DNA, 75 bp, Artificial Sequence
  Synthetic
gaacatcccaaggctctttttgacctttagaatggacttgagaatgccgtccattgtttggggtgacactttgat

SEQ ID NO: 218088 - DNA, 75 bp, Artificial Sequence
  Synthetic
gctaattgtgatgtgagtgcttcaaagtaatcctcaatgagccttgtgaacatctttgtccttaaatctccgatg

SEQ ID NO: 218089 - DNA, 75 bp, Artificial Sequence
  Synthetic
atataaacacctgagcttagtggcctttctgttctaatgaccttcgactttagtttctctaagtcagctgccaat

SEQ ID NO: 218090 - DNA, 75 bp, Artificial Sequence
  Synthetic
tttagaatggacttgagaatgccgtccattgtttggggtgacactttgattgtctctaacatgttcccaccgtcc

SEQ ID NO: 218091 - DNA, 75 bp, Artificial Sequence
  Synthetic
gtcagcaggtcatctgaggtcaaggtcccaactctcaagatactcttttgttgtgtcgatttgagttctacaaga

SEQ ID NO: 218092 - DNA, 75 bp, Artificial Sequence
  Synthetic
tgagatgtttagagagctcttattagcgtcaatcatctttaggatggggtggctttgagtcagcctgtccaggtc

SEQ ID NO: 218093 - DNA, 75 bp, Artificial Sequence
  Synthetic
gcgtcaatcatctttaggatggggtggctttgagtcagcctgtccaggtccgaagtattgggatactttgctgtg

SEQ ID NO: 218094 - DNA, 75 bp, Artificial Sequence
  Synthetic
aagtcaaactcactgaactgcagtttatctggattgataatcagcttcatgggtataacatcccctaactgctgt

SEQ ID NO: 218095 - DNA, 75 bp, Artificial Sequence
  Synthetic
gcgtccatttacaggacgactctgggtgttgaagttctaaagaccatgtctctgggcaacacagccctcaagact

SEQ ID NO: 218096 - DNA, 75 bp, Artificial Sequence
  Synthetic
gccgagttgaagtgctttgggaacacagcagttgcgaaatgcaatgagaaacatgatgaagagttttgtgacatg

SEQ ID NO: 218097 - DNA, 75 bp, Artificial Sequence
  Synthetic
ctgcccttgttttgtcagacacgccaatgtcaggcttggcatggtcccaaactgattattaagtagatctgcatt

SEQ ID NO: 218098 - DNA, 75 bp, Artificial Sequence
  Synthetic
aatgtcaggcttggcatggtcccaaactgattattaagtagatctgcattcttcacatcccaaaccctcaccact

SEQ ID NO: 218099 - DNA, 75 bp, Artificial Sequence
  Synthetic
gacttcagtggtaaggctctttttagtaaatccctgaattaaagtgcccagttaaaatgggtaacagacaggcca

SEQ ID NO: 218100 - DNA, 75 bp, Artificial Sequence
  Synthetic
gtttaggagagctcgtctttggtcaagttgctgtgagctcaagttgcccatataaatgcctgcgctcaatggtct

SEQ ID NO: 218101 - DNA, 75 bp, Artificial Sequence
  Synthetic
tctggtaaaactgaacagagtccactggcattgtacttaacaaatcaaagaaatcttcaagggagtctaacctca

SEQ ID NO: 218102 - DNA, 75 bp, Artificial Sequence
  Synthetic
tcccatctaggcccccagttctgcaagagttgctggtttgagaacagagggttggtagagtgcaacaatcactac

SEQ ID NO: 218103 - DNA, 75 bp, Artificial Sequence
  Synthetic
tggggagaactgctcttaaaactggtatattgagtcctcctgacacagctgcatcatacattatgcagtccatta

SEQ ID NO: 218104 - DNA, 75 bp, Artificial Sequence
  Synthetic
tcctcagtgtcagcagcaggtgcccgatctgcaagatgcccctccccaccaagctaaaggcaacagcacagccaa

SEQ ID NO: 218105 - DNA, 75 bp, Artificial Sequence
  Synthetic
cttctttgtttgcgcatcaaccgttggacattgctgacctcagagaagtcaagtccatgcagaagggcttgggca

SEQ ID NO: 218106 - DNA, 75 bp, Artificial Sequence
  Synthetic
gcgcaccatcagccgaggcaatccagaacacaacacctccaccgtacaccccataatcccagaaccaacactcct

SEQ ID NO: 218107 - DNA, 75 bp, Artificial Sequence
  Synthetic
ggacattgctgacctcagagaagtcaagtccatgcagaagggcttgggcatctttcacaacctgtaatttgatgt

SEQ ID NO: 218108 - DNA, 75 bp, Artificial Sequence
  Synthetic
gatgccatccattgtctgaggtgtaaccttgatggtctccaacatgttccccccatcaagcatacaggctccagc

SEQ ID NO: 218109 - DNA, 75 bp, Artificial Sequence
  Synthetic
gactttatctcttttgaggcactcattgccaagttgttgtattgtatactcacagcagagagttgagacaatctg

SEQ ID NO: 218110 - DNA, 75 bp, Artificial Sequence
  Synthetic
ttgccaagttgttgtattgtatactcacagcagagagttgagacaatctgctgaaatgattaatgcaaagcgcaa

SEQ ID NO: 218111 - DNA, 75 bp, Artificial Sequence
  Synthetic
cggggatcctaggcaatttggttgttcttctttttggcctttacaccttgtagtccaacaaatggggaacaagca

SEQ ID NO: 218112 - DNA, 75 bp, Artificial Sequence
  Synthetic
tccttgccacctttcttcttcttctcaactacgatgcctgtgtgcatgtgacataggtctttgtactgatcccag

SEQ ID NO: 218113 - DNA, 75 bp, Artificial Sequence
  Synthetic
acaaacatttccaaatcttgatcttgaatggatggtgtaaatgtagctacccttctatcagattcccacagtgct

SEQ ID NO: 218114 - DNA, 75 bp, Artificial Sequence
  Synthetic
caacaaaactaagaccatcagccgtcccaacagcgcccccaaccaaagcagaagacaacaccagacccccaccct

SEQ ID NO: 218115 - DNA, 75 bp, Artificial Sequence
  Synthetic
cccaacagcgcccccaaccaaagcagaagacaacaccagacccccaccctatagtccctgagccccccgcaagcc

SEQ ID NO: 218116 - DNA, 75 bp, Artificial Sequence
  Synthetic
ggcccccccgggggagccagctctctccagagatctactcgatctcctcaatgtgctcttccttttcagccaact

SEQ ID NO: 218117 - DNA, 75 bp, Artificial Sequence
  Synthetic
gtcgatgaacatcaaagagctcatctggtgccagatgcatcccatctaggcccccagttctgcaagagttgctgg

SEQ ID NO: 218118 - DNA, 75 bp, Artificial Sequence
  Synthetic
tccagagatctactcgatctcctcaatgtgctcttccttttcagccaactcctcacatgttctaccctttagcct

SEQ ID NO: 218119 - DNA, 75 bp, Artificial Sequence
  Synthetic
cactcatcgccagattgttgtgttgaatacacgcagcagggagctgaggctatctgccaaaaatgacaaaagcaa

SEQ ID NO: 218120 - DNA, 75 bp, Artificial Sequence
  Synthetic
aatttggttgttctttccttttggagccttttgcactgaactccctaaaatgggaaacaagcaaaccaaagcccc

SEQ ID NO: 218121 - DNA, 75 bp, Artificial Sequence
  Synthetic
ctgtctcagcctgctcctcagtgtcagcagcagatgcccgatctgcaagatgccccttcccaccaagctaaaggc

SEQ ID NO: 218122 - DNA, 75 bp, Artificial Sequence
  Synthetic
aacagagggcataacctttgaattccacccaattatctactgcctcaagaaccgcactcaagactcctgtgctgc

SEQ ID NO: 218123 - DNA, 75 bp, Artificial Sequence
  Synthetic
tcagtggtaaggctcattttagtgaatccctgaatcaaagtgcccagttaaaatgggcaacagacatgccaaatc

SEQ ID NO: 218124 - DNA, 75 bp, Artificial Sequence
  Synthetic
cacccaattatctactgcctcaagaaccgcactcaagactcctgtgctgcttggtgctgcagcccttaatatgga

SEQ ID NO: 218125 - DNA, 75 bp, Artificial Sequence
  Synthetic
tggttctatgtcaaagtctatccatgcatagcccatcattagatcaaacttaaacataggtctctctatcccttt

SEQ ID NO: 218126 - DNA, 75 bp, Artificial Sequence
  Synthetic
tcatgttgcttaatgcctcgatcagtaggtcagatgaggtgtccccaacttctctcacaaatatctcaagatcct

SEQ ID NO: 218127 - DNA, 75 bp, Artificial Sequence
  Synthetic
taggtcagatgaggtgtccccaacttctctcacaaatatctcaagatcctgatcttgtataacaggtgtgaagga

SEQ ID NO: 218128 - DNA, 75 bp, Artificial Sequence
  Synthetic
gactctaggagtttcttgatatcctccgacccctggcatgtgataaccatatttcgtggaagtgcttctatcact

SEQ ID NO: 218129 - DNA, 75 bp, Artificial Sequence
  Synthetic
aagatgcctctccccacaaaactgagaccatcagctgccccaacagcacccccagccggagcagcgcacagcgcc

SEQ ID NO: 218130 - DNA, 75 bp, Artificial Sequence
  Synthetic
aggcaacccagccctactcaatgtcctcaatgcacttctccggcccaaacaactctgaacatgtccttcccttca

SEQ ID NO: 218131 - DNA, 75 bp, Artificial Sequence
  Synthetic
ggactggctcagcacaagggcccaccaacacaaagtcatactctgtaaactgcagtttttctatgtcaacaacaa

SEQ ID NO: 218132 - DNA, 75 bp, Artificial Sequence
  Synthetic
caacacaaagtcatactctgtaaactgcagtttttctatgtcaacaacaatctcaacaggagtcacacaccctag

SEQ ID NO: 218133 - DNA, 75 bp, Artificial Sequence
  Synthetic
ccatccccccgacaccccccggggggaccccccgccgggggcccccccgggggagccagctatttccgaggaact

SEQ ID NO: 218134 - DNA, 75 bp, Artificial Sequence
  Synthetic
gaccccccgccgggggcccccccgggggagccagctatttccgaggaactactcaatatcctcgatgtgttcatc

SEQ ID NO: 218135 - DNA, 75 bp, Artificial Sequence
  Synthetic
taatccacaggtctctgttttgtgaggattgagacaatgtccacacctgtccattgaattctttgttttaatcta

SEQ ID NO: 218136 - DNA, 75 bp, Artificial Sequence
  Synthetic
atggtgatttgcccttaaaagtgggccctgacaaaaccaacctccaacagtctgacaagacgcaaggactcactg

SEQ ID NO: 218137 - DNA, 75 bp, Artificial Sequence
  Synthetic
ccctgacaaaaccaacctccaacagtctgacaagacgcaaggactcactgcaccagaatacatagcggtcacatc

SEQ ID NO: 218138 - DNA, 75 bp, Artificial Sequence
  Synthetic
cacttgactgtatcatcacctttccccttgacttactataacagagagcataacccttaaactccacccagttgt

SEQ ID NO: 218139 - DNA, 75 bp, Artificial Sequence
  Synthetic
accaatctcccttacaaacatatctaaatcttgatcttggatagatggtgtgaatgtagctacctttctatcaga

SEQ ID NO: 218140 - DNA, 75 bp, Artificial Sequence
  Synthetic
ccggggatcctaggcaattcagttggactttagttgtagggctccttttagtgaatccctgaatcaaagcaccca

SEQ ID NO: 218141 - DNA, 75 bp, Artificial Sequence
  Synthetic
catcattcaaatcaacttgaccttgtttggtgagacatgctaatgtcagactaggcatggtgccgaactggttgt

SEQ ID NO: 218142 - DNA, 75 bp, Artificial Sequence
  Synthetic
gaatagcaaagttttctttaaaactagcatcttgactcttaatacgaaacctcactgtctgactcaattttgcag

SEQ ID NO: 218143 - DNA, 75 bp, Artificial Sequence
  Synthetic
accaatggcactggttcgttgtcaggtccaaccttggagaagtcaaactcactgaactgcagtttatctggatta

SEQ ID NO: 218144 - DNA, 75 bp, Artificial Sequence
  Synthetic
gccctcaacgtggagacaatatccacccctgaccactgcatctttaaccctagcctgtctatcatcatatcactc

SEQ ID NO: 218145 - DNA, 75 bp, Artificial Sequence
  Synthetic
cacttgttctttgtaagacaaagaaaattttagtctgccagtgtcagggccagttgaattataagattgaggtga

SEQ ID NO: 218146 - DNA, 75 bp, Artificial Sequence
  Synthetic
tttagtagctttctgggttaaagtatccaaccaaaatgggtaacagacaggctaaatcagccaaagttactgagc

SEQ ID NO: 218147 - DNA, 75 bp, Artificial Sequence
  Synthetic
cccctgaccactgcatctttaaccctagcctgtctatcatcatatcactcaatgcctcaatgagcagatcagatg

SEQ ID NO: 218148 - DNA, 75 bp, Artificial Sequence
  Synthetic
caaccagttgattctgattgaactttgctggttcaatatcaaagtctatccaggcataacccatcatcaaatcat

SEQ ID NO: 218149 - DNA, 75 bp, Artificial Sequence
  Synthetic
acaggtgtaaaggatgccaatttctttccacactcccataagccccccttatgcacaactagagggactggttca

SEQ ID NO: 218150 - DNA, 75 bp, Artificial Sequence
  Synthetic
gaagaattagaacgtcaaaaataaggagaagttttctcctggtgttgaggatcctcagagattttatcttattta

SEQ ID NO: 218151 - DNA, 75 bp, Artificial Sequence
  Synthetic
cgcaccatcaaccgaggcgacccagaacacaacacctccaccatacaccccgtaaccccaggaccaacactccca

SEQ ID NO: 218152 - DNA, 75 bp, Artificial Sequence
  Synthetic
gctaaatcagccaaagttactgagcatcagagagcacatctagtgccggatgcatcccatttgggtcctcaattc

SEQ ID NO: 218153 - DNA, 75 bp, Artificial Sequence
  Synthetic
tgctggttcaatatcaaagtctatccaggcataacccatcatcaaatcatgtttaaacattggcctctcaatgcc

SEQ ID NO: 218154 - DNA, 75 bp, Artificial Sequence
  Synthetic
aaccttcaccctctgggactgatgatttatgtggaaaccatgtgaaagatcccagtgttcttgttgtagcaacaa

SEQ ID NO: 218155 - DNA, 75 bp, Artificial Sequence
  Synthetic
tttatgtggaaaccatgtgaaagatcccagtgttcttgttgtagcaacaaatggtctcacataggactcgaaata

SEQ ID NO: 218156 - DNA, 75 bp, Artificial Sequence
  Synthetic
cccgggggggcaggcagcccagctctactcaatgtcctcaacacacttctccggcccaaacaactctgaacatgt

SEQ ID NO: 218157 - DNA, 75 bp, Artificial Sequence
  Synthetic
aactgctttagatcagtcggttctctgaagaagtggatgtaacaacctgagtttggctggtatagggctatctcg

SEQ ID NO: 218158 - DNA, 75 bp, Artificial Sequence
  Synthetic
cccctaaaagtaggccctgacaagaccaacctccaacagtctgacaaaacgcacggactcaccgcacctgagtac

SEQ ID NO: 218159 - DNA, 75 bp, Artificial Sequence
  Synthetic
tctgcaagatgccccttcccaccaagctaaaggcagcagcacagccgagcgcaccatcaaccgaggcgatccaga

SEQ ID NO: 218160 - DNA, 75 bp, Artificial Sequence
  Synthetic
agtgtgagacaatcttaattcagatgacagcacaatgtaatgttcttccctcttccatttaactatatgtgaaac

SEQ ID NO: 218161 - DNA, 75 bp, Artificial Sequence
  Synthetic
ctttccttaaaactagcatcttggcttttaatacggaacctcactgtctgactcagttttgcagaccctggaggc

SEQ ID NO: 218162 - DNA, 75 bp, Artificial Sequence
  Synthetic
ggaccttttcatcctccagattcacagcaccagaatagattatcttttgccgcaacaccattctaagcgggtgat

SEQ ID NO: 218163 - DNA, 75 bp, Artificial Sequence
  Synthetic
attttatcctgggtgaccacttcattttggttgatgctaaatcgctcataaatggcaatatgtgtttctcaaata

SEQ ID NO: 218164 - DNA, 75 bp, Artificial Sequence
  Synthetic
gcaccggggatcctaggcaattcagctggacttcagtggtgaagcttttcttagtgaatccctaaatcaaagtac

SEQ ID NO: 218165 - DNA, 75 bp, Artificial Sequence
  Synthetic
ttagtgaatccctaaatcaaagtacccagtgaaatgggcaacagacaggctaaatcgacaaaagtcgatgaacat

SEQ ID NO: 218166 - DNA, 75 bp, Artificial Sequence
  Synthetic
atgaatgatgtgatttaaaccgaccctgtcctctagtagttttgatgcagtcggtttcaaaggaaagtaatcaca

SEQ ID NO: 218167 - DNA, 75 bp, Artificial Sequence
  Synthetic
tgttttgtgaggattgagacaatgtccacacctgtccattgaattctttgtttcaatctatcagacatcattgat

SEQ ID NO: 218168 - DNA, 75 bp, Artificial Sequence
  Synthetic
acctcaactgtcttaggttcccctaagacccatgcacccagttctattgcagttgataaggagatgcacatataa

SEQ ID NO: 218169 - DNA, 75 bp, Artificial Sequence
  Synthetic
tattgaacaatatcctaagcattgacctcatctttttgcatgcatcaggaatcagcctctcaatttgcctcatta

SEQ ID NO: 218170 - DNA, 75 bp, Artificial Sequence
  Synthetic
agttgataaagaaatacacatatagtcccataacaaaggtctaaaatagctggtcacaccttcacttccacttcc

SEQ ID NO: 218171 - DNA, 75 bp, Artificial Sequence
  Synthetic
tcagtaactcaaccccttgggtgctagagattagagactggatggacttaatgtacaaattctctttatttggcc

SEQ ID NO: 218172 - DNA, 75 bp, Artificial Sequence
  Synthetic
agagattagagactggatggacttaatgtacaaattctctttatttggccctcgaacacatttgctacctaatgt

SEQ ID NO: 218173 - DNA, 75 bp, Artificial Sequence
  Synthetic
tgtttctgccaattgatggggttctttgcactttatgttgtgtaaagctgcagcaacaaactttgttagcagggg

SEQ ID NO: 218174 - DNA, 75 bp, Artificial Sequence
  Synthetic
tgttaatggcttcagacagcaacttttgtgcacctcgagtgaaggtggaagacagcttgttttgaattgtcttga

SEQ ID NO: 218175 - DNA, 75 bp, Artificial Sequence
  Synthetic
ttgtgcacctcgagtgaaggtggaagacagcttgttttgaattgtcttgacaatagttggaatcttctcatcatc

SEQ ID NO: 218176 - DNA, 75 bp, Artificial Sequence
  Synthetic
agagtcatgagctgggagtaggtcagtcctgctgggaagccagctgactgtagagatctgttggattcattgctc

SEQ ID NO: 218177 - DNA, 75 bp, Artificial Sequence
  Synthetic
cctccattgccaactgtggcacttgtgttgagtttaggcttgtgccagtatgacttgtgggtcaactggtggtgc

SEQ ID NO: 218178 - DNA, 75 bp, Artificial Sequence
  Synthetic
tgttgagtttaggcttgtgccagtatgacttgtgggtcaactggtggtgccccacagaagctcctatagaaatga

SEQ ID NO: 218179 - DNA, 75 bp, Artificial Sequence
  Synthetic
aagggtggtgcgcagccagatttaaccaagagtactcaaggtcagattcagatgggggctcaacatccaatagct

SEQ ID NO: 218180 - DNA, 75 bp, Artificial Sequence
  Synthetic
cccccggggggaccccccgccgggggcccccccggggggcgagcggctcagctctactcaatgtcctcaatgcac

SEQ ID NO: 218181 - DNA, 75 bp, Artificial Sequence
  Synthetic
ccaagagtactcaaggtcagattcagatgggggctcaacatccaatagctcacataaatttcttaatgaagagag

SEQ ID NO: 218182 - DNA, 75 bp, Artificial Sequence
  Synthetic
taactctgttaaattctgatcaaataaagatatctgatcgtcactggaagtgtaagcatcgatttgtcccccaga

SEQ ID NO: 218183 - DNA, 75 bp, Artificial Sequence
  Synthetic
agatgcacatgtaatcccataacaagggtctgaagtaactgaccacactctcactcccactttcatttctaagtt

SEQ ID NO: 218184 - DNA, 75 bp, Artificial Sequence
  Synthetic
tctttaatctattatagagtcttcttaacatagatctaattttgctacaagcactaggaatcaatccttctatct

SEQ ID NO: 218185 - DNA, 75 bp, Artificial Sequence
  Synthetic
agcaagaagaatgagaacatcaaaaacaaggagaagtttcctcctggtgttaaggatccttagagactttatctt

SEQ ID NO: 218186 - DNA, 75 bp, Artificial Sequence
  Synthetic
cgcaaaatttataaatctttcagaaatcaacgcataaaagtctgaggtgttgtgcaggataccctgtcccatatc

SEQ ID NO: 218187 - DNA, 75 bp, Artificial Sequence
  Synthetic
taacatagatctaattttgctacaagcactaggaatcaatccttctatctgcctcatgatcctataactacggtt

SEQ ID NO: 218188 - DNA, 75 bp, Artificial Sequence
  Synthetic
attcccttgacatcagaaatcaaagactgaatagacttaatatacagattctctttatttggtccccgaacacat

SEQ ID NO: 218189 - DNA, 75 bp, Artificial Sequence
  Synthetic
atgatttcatcattgctgatacaacattaaatgggatctcaaccattttgtgcatatgccatgttaataatgttg

SEQ ID NO: 218190 - DNA, 75 bp, Artificial Sequence
  Synthetic
caatggggtatctagcatattgcaaaaggttcaaggtccttatctgtatcaagttgcatagatggacaggaacac

SEQ ID NO: 218191 - DNA, 75 bp, Artificial Sequence
  Synthetic
attaaatgggatctcaaccattttgtgcatatgccatgttaataatgttgataggtaatctttaccttttaaatc

SEQ ID NO: 218192 - DNA, 75 bp, Artificial Sequence
  Synthetic
tgtatcaattgtctctgctagttgatgtggctccttacactttatattatgaagggctgcagcgacaaattttgt

SEQ ID NO: 218193 - DNA, 75 bp, Artificial Sequence
  Synthetic
tctctgcaggagttccgttaaagtctgatcaaaaagggaaatctgatcatcactggaggtataagcatctattgt

SEQ ID NO: 218194 - DNA, 75 bp, Artificial Sequence
  Synthetic
cttgacgcaatgtaaggccacccatctcctgataggcagattttgtatagtatattctcataagggtttctctca

SEQ ID NO: 218195 - DNA, 75 bp, Artificial Sequence
  Synthetic
tcaattcctctgtcaggcctgaagcaataagctggttcaagtttatctgagctggttctatgtcaaagtctatcc

SEQ ID NO: 218196 - DNA, 75 bp, Artificial Sequence
  Synthetic
gccttgctaagtgcttcagaattactctcacgttcacttatcctgacatcatcagccaatcttcctgtatcaaat

SEQ ID NO: 218197 - DNA, 75 bp, Artificial Sequence
  Synthetic
ctcttctgaatttgattacacagatcaactgggacaccattagccacagattgatcaattatggtatcaattgtt

SEQ ID NO: 218198 - DNA, 75 bp, Artificial Sequence
  Synthetic
taatattccctgacccatgtcaagtattgaacttatatgagaaggcaccacaccgatttgaaagttagaataaaa

SEQ ID NO: 218199 - DNA, 75 bp, Artificial Sequence
  Synthetic
tcatcaccccaaacatagaaccttgatttgaactctgcaacaaacctaccaattgcactctttggactcacaaat

SEQ ID NO: 218200 - DNA, 75 bp, Artificial Sequence
  Synthetic
ggtccaaaaaagtcctagtcaccactgcttttgtcagctcactaataggacatgaattcattggccctacataaa

SEQ ID NO: 218201 - DNA, 75 bp, Artificial Sequence
  Synthetic
cttttataaatgacttcatcattgctgatactacattgaagggtatttctaccatcttgtgcatgtgccacataa

SEQ ID NO: 218202 - DNA, 75 bp, Artificial Sequence
  Synthetic
tgatactacattgaagggtatttctaccatcttgtgcatgtgccacataagcaaagttgagaggtagtctcttcc

SEQ ID NO: 218203 - DNA, 75 bp, Artificial Sequence
  Synthetic
aaaagctaacttctgtcttgatagcttctcattatctgcaaggtattttgagataagatctttagcattggcaat

SEQ ID NO: 218204 - DNA, 75 bp, Artificial Sequence
  Synthetic
tagttaagaataaaaatgggcacatcattgggccccacttactgtgatccatgctataagagacttgtgccaagg

SEQ ID NO: 218205 - DNA, 75 bp, Artificial Sequence
  Synthetic
cattgggccccacttactgtgatccatgctataagagacttgtgccaaggagacattcaatttcatggagaggat

SEQ ID NO: 218206 - DNA, 75 bp, Artificial Sequence
  Synthetic
ctttttatcaaccttattaagagtttttcttccaccaccttgtcaagatcagatattgagggtgcattgcaatct

SEQ ID NO: 218207 - DNA, 75 bp, Artificial Sequence
  Synthetic
gtctgctgctgtctttctggttgctccctatactgactgacaatattgtcaacagtacacctcagttggtcgaag

SEQ ID NO: 218208 - DNA, 75 bp, Artificial Sequence
  Synthetic
tataagcctagtgaacatctttgtcctaagatcaccaatgtacaactctctgttgccaccaacttgttctttata

SEQ ID NO: 218209 - DNA, 75 bp, Artificial Sequence
  Synthetic
attgtggtgactcttggctatagaaacacaagttcttcagcattgctgtggtgcaatttgtcaatgatagagctt

SEQ ID NO: 218210 - DNA, 75 bp, Artificial Sequence
  Synthetic
tggggtgaaaccttgattgtctccagcatgttgccaccatctagcatacaggcccctgcttttactgcagcaccc

SEQ ID NO: 218211 - DNA, 75 bp, Artificial Sequence
  Synthetic
catgtgccgatgagacattcagcttcattgacaaaatggcattgtcaaactccttctcattgtttagacagctgc

SEQ ID NO: 218212 - DNA, 75 bp, Artificial Sequence
  Synthetic
gaaagcttacccatgtcaaacttaaaattaaggttccttgatctataatgggtgtacctacccataagtgtgttt

SEQ ID NO: 218213 - DNA, 75 bp, Artificial Sequence
  Synthetic
aaccctacaaacccagatgctatagaactttggaaagctgatttatttattgcttcagacagtagcttctgagct

SEQ ID NO: 218214 - DNA, 75 bp, Artificial Sequence
  Synthetic
tttgtcaactctccaatgggacattgtgacatatttccacagtaaaagtacttctccttcaacctaccattctca

SEQ ID NO: 218215 - DNA, 75 bp, Artificial Sequence
  Synthetic
aactctgtcaagttctgatcaaataaagatatctgatcgtcactggacgtgtaagcatcgatttgtcccccagac

SEQ ID NO: 218216 - DNA, 75 bp, Artificial Sequence
  Synthetic
atcaaagtcttcaaccatgtgattggatagttcacttttaattaatctaatataaaatttgtttggaacaacttc

SEQ ID NO: 218217 - DNA, 75 bp, Artificial Sequence
  Synthetic
tcaaaataatcttctatgagccttgtaaacatctttgttctaagatcaccaatatatagttccctgttaccgcct

SEQ ID NO: 218218 - DNA, 75 bp, Artificial Sequence
  Synthetic
gatagttcacttttaattaatctaatataaaatttgtttggaacaacttcgtccagatcattcactgatggctgg

SEQ ID NO: 218219 - DNA, 75 bp, Artificial Sequence
  Synthetic
atttttcaaagcatttgatctggtcagtcagtctgtcaggtgtttcttttgtaatgaaatgacacatataagaga

SEQ ID NO: 218220 - DNA, 75 bp, Artificial Sequence
  Synthetic
aacaattttctcaacagtttctttcagctgattgaaataaacacttgcacctccatcgagcaaaatctcatctag

SEQ ID NO: 218221 - DNA, 75 bp, Artificial Sequence
  Synthetic
gtaatgaaatgacacatataagagatgtttaaaataaacttgaatctgttggtcatcatactgacaacttcttca

SEQ ID NO: 218222 - DNA, 75 bp, Artificial Sequence
  Synthetic
ggtcatcatactgacaacttcttcagacagaattatctttaataagtgacgaacaagtctgtagagcagatattc

SEQ ID NO: 218223 - DNA, 75 bp, Artificial Sequence
  Synthetic
agctgattgaaataaacacttgcacctccatcgagcaaaatctcatctagatcagcttcatcggcatcagtattg

SEQ ID NO: 218224 - DNA, 75 bp, Artificial Sequence
  Synthetic
ctcatagtcctgtttgttgagaaggtgcttcccttttcttgagaagacctcagtaagctgtgatacagccaatgc

SEQ ID NO: 218225 - DNA, 75 bp, Artificial Sequence
  Synthetic
ttaggttttgaattattgttaaaaacaagaaaggacacatcatagggccccacttgctgtgatccatactatatg

SEQ ID NO: 218226 - DNA, 75 bp, Artificial Sequence
  Synthetic
tgcttcccttttcttgagaagacctcagtaagctgtgatacagccaatgctgtgagcttattaaagtcatagttt

SEQ ID NO: 218227 - DNA, 75 bp, Artificial Sequence
  Synthetic
gaaagtctatctaagtcagatgaatttgggtacttcgcggtgtaaatcagtcccaaatctgtcagggcctgaaca

SEQ ID NO: 218228 - DNA, 75 bp, Artificial Sequence
  Synthetic
agccaaatccaaggctgtggcacagccactagtgataagagggtctttgatttccctctttacttctctttcctt

SEQ ID NO: 218229 - DNA, 75 bp, Artificial Sequence
  Synthetic
gcagaattcctcataaaatttacttggtaggatatcataatcaaaatcctcaaccatatgattggataattcacc

SEQ ID NO: 218230 - DNA, 75 bp, Artificial Sequence
  Synthetic
caaccatatgattggataattcacccttaatcagcctaatgtaaaacttatttgggacaatctcatcaagatcat

SEQ ID NO: 218231 - DNA, 75 bp, Artificial Sequence
  Synthetic
ttgaaacaccaggcctcttataacttggcccttttgcacttgtgcatccatccttactcaaaaacttttttgcat

SEQ ID NO: 218232 - DNA, 75 bp, Artificial Sequence
  Synthetic
tggcccttttgcacttgtgcatccatccttactcaaaaacttttttgcattatagatcatgtcatccagctcttc

SEQ ID NO: 218233 - DNA, 75 bp, Artificial Sequence
  Synthetic
ggtatctagagggtccaaattcattttgccttagtttcactgtggaagacgttttcattgagttgatcaaagcca

SEQ ID NO: 218234 - DNA, 75 bp, Artificial Sequence
  Synthetic
ttggttcaaggaatttttcaaaacattttatttgatctgtcaatctatctggtgtttcctttgtaataaagtgac

SEQ ID NO: 218235 - DNA, 75 bp, Artificial Sequence
  Synthetic
aaaatttcgtctaggtcagcctcattagcatcacttttatgctgtccggatcctagaaccaggttgctcattgcc

SEQ ID NO: 218236 - DNA, 75 bp, Artificial Sequence
  Synthetic
ttttatttgatctgtcaatctatctggtgtttcctttgtaataaagtgacacatgtaagaaatattcagaataaa

SEQ ID NO: 218237 - DNA, 75 bp, Artificial Sequence
  Synthetic
acgccaagagtataagggaacatgtcttcctgagttttctggtaacttatagtgggtgtgataccggagacctca

SEQ ID NO: 218238 - DNA, 75 bp, Artificial Sequence
  Synthetic
tcattagtgcccttattaatctatagagtaagaactcaacatcagtaattagttcttctctaactttgtcaatga

SEQ ID NO: 218239 - DNA, 75 bp, Artificial Sequence
  Synthetic
gagtaagaactcaacatcagtaattagttcttctctaactttgtcaatgaggtccttgtgataataatctgacac

SEQ ID NO: 218240 - DNA, 75 bp, Artificial Sequence
  Synthetic
tactagggtgagctaaaaccaagacaaggatcatctttgtcaaagatctaatgtcgtctaattgctctaccagtt

SEQ ID NO: 218241 - DNA, 75 bp, Artificial Sequence
  Synthetic
aaggatcatctttgtcaaagatctaatgtcgtctaattgctctaccagttcagtgcaatcttctatccaagaaat

SEQ ID NO: 218242 - DNA, 75 bp, Artificial Sequence
  Synthetic
tttaatagttctggatttctcacgtcccagacccttacgataccatcccttccggcacttgttccttgactgcta

SEQ ID NO: 218243 - DNA, 75 bp, Artificial Sequence
  Synthetic
agtatcttttaggatcagcataaaatgagcagacttcaccaactctgttgtcattaatagcataacactttgaac

SEQ ID NO: 218244 - DNA, 75 bp, Artificial Sequence
  Synthetic
tgagcagacttcaccaactctgttgtcattaatagcataacactttgaacactctcctgtcttttgataaattaa

SEQ ID NO: 218245 - DNA, 75 bp, Artificial Sequence
  Synthetic
tagcaagaagaatcagaatgtcaaagataaggagaagtttcctcctggtgttgaggatcctcagagactttatct

SEQ ID NO: 218246 - DNA, 75 bp, Artificial Sequence
  Synthetic
caatgcaaagggatagtagtttcaatccttccatgagcaacattctaggttcggtttggaccaaaaaggctaact

SEQ ID NO: 218247 - DNA, 75 bp, Artificial Sequence
  Synthetic
atctgaccacctgataccttgcaggcccaaattcattttgtctcaactttacagtggaagaagttttcatcgagt

SEQ ID NO: 218248 - DNA, 75 bp, Artificial Sequence
  Synthetic
tagtcatcatgctctttacatcctcagacaaaaccagattcattagtgtccttattaatctatagagcaggaatt

SEQ ID NO: 218249 - DNA, 75 bp, Artificial Sequence
  Synthetic
cccaaattcattttgtctcaactttacagtggaagaagttttcatcgagttcaccaaagcaagactcaatgagga

SEQ ID NO: 218250 - DNA, 75 bp, Artificial Sequence
  Synthetic
tgtctattttatcactatatagctttctgaaatcctctaataacttcattttatcggtcttaacaaattgacttt

SEQ ID NO: 218251 - DNA, 75 bp, Artificial Sequence
  Synthetic
aaggaaacgtctcctcttctgatctttggtagctaattgtagggacaaccccagaaacaatgaagtccatgatta

SEQ ID NO: 218252 - DNA, 75 bp, Artificial Sequence
  Synthetic
gtttgagtttgtaccagaatggcttgtgggtcaactggtgatgccccacaaaagctcctacagaaatgagagaca

SEQ ID NO: 218253 - DNA, 75 bp, Artificial Sequence
  Synthetic
ttggtagctaattgtagggacaaccccagaaacaatgaagtccatgattaagtcataactattaggacgaatcac

SEQ ID NO: 218254 - DNA, 75 bp, Artificial Sequence
  Synthetic
actttcttgcattataaaccatttcagcaagctcttcctccaatgcatcatccttcgggttcacacttacatgtc

SEQ ID NO: 218255 - DNA, 75 bp, Artificial Sequence
  Synthetic
cagtagtggcctttaagatggttttgtggaatattgagttgaggatttgattcttgttcgagcactgagagggtt

SEQ ID NO: 218256 - DNA, 75 bp, Artificial Sequence
  Synthetic
gtggaatattgagttgaggatttgattcttgttcgagcactgagagggttgcatgactctagacttttcagcttg

SEQ ID NO: 218257 - DNA, 75 bp, Artificial Sequence
  Synthetic
tcacaaagtcttgaatactcagactcttcgaacaatgcattactttcttgtgaatattttaacaaggtgaataag

SEQ ID NO: 218258 - DNA, 75 bp, Artificial Sequence
  Synthetic
aaaccagcctatcattaacacttataaaacaagatcccagccatcctctcaaacattcttgtttcatttggtcat

SEQ ID NO: 218259 - DNA, 75 bp, Artificial Sequence
  Synthetic
aaaacaagatcccagccatcctctcaaacattcttgtttcatttggtcatgtttgcttgcaaggagaaccagtgc

SEQ ID NO: 218260 - DNA, 75 bp, Artificial Sequence
  Synthetic
aatcaggtatctgttcattgtaaaatgttgtcctaccgtctatgaggggaatgagattgatgccaacagattcca

SEQ ID NO: 218261 - DNA, 75 bp, Artificial Sequence
  Synthetic
cctgaactcaacggcctttcagtgcgaattacctttgattttaacttctctaagtcagcagccaaggtcagcaga

SEQ ID NO: 218262 - DNA, 75 bp, Artificial Sequence
  Synthetic
tgactttgttcagaaatgatctccagcactgcatctggcactcaccggtagtttgacttcctctttcccagttcc

SEQ ID NO: 218263 - DNA, 75 bp, Artificial Sequence
  Synthetic
gcactgcatctggcactcaccggtagtttgacttcctctttcccagttccccttagctacatttgcatacagaaa

SEQ ID NO: 218264 - DNA, 75 bp, Artificial Sequence
  Synthetic
agcattattaatcataaattttgcaatctgtctgatgcccacaaaaagaacctctatgaccacgctcttatgagc

SEQ ID NO: 218265 - DNA, 75 bp, Artificial Sequence
  Synthetic
tcctgagttttctggtaacttatagtgggtgtgataccggagatctcaatgtccatgatggcatcataaacatca

SEQ ID NO: 218266 - DNA, 75 bp, Artificial Sequence
  Synthetic
tgtcttttgtggtcactttatcagcatacaaatcattgaactcattgagtaattgactcttctcgacctttagga

SEQ ID NO: 218267 - DNA, 75 bp, Artificial Sequence
  Synthetic
atacaaatcattgaactcattgagtaattgactcttctcgacctttaggaactgactctctatctccccttttct

SEQ ID NO: 218268 - DNA, 75 bp, Artificial Sequence
  Synthetic
tcttgtagtggtccacactgatcccaacatcctttaaagcagtggtggccttcaagatggttttctgaaacattg

SEQ ID NO: 218269 - DNA, 75 bp, Artificial Sequence
  Synthetic
ttatgttcacatccattggccttgcaagagtcaatctcaatgcaaagagatagtagtttcaatccttccatgagc

SEQ ID NO: 218270 - DNA, 75 bp, Artificial Sequence
  Synthetic
catgagctgttagtttgttgttaatgccttggtggcatgaggttatcacttcctcataatggttggaacgattgt

SEQ ID NO: 218271 - DNA, 75 bp, Artificial Sequence
  Synthetic
gccttggtggcatgaggttatcacttcctcataatggttggaacgattgtctaataaaacattcaagctctccac

SEQ ID NO: 218272 - DNA, 75 bp, Artificial Sequence
  Synthetic
cacctgtgttagatttgggtttgtgctagaatgacttgtgggttaactagtggtgtcccacaaaagttcctacag

SEQ ID NO: 218273 - DNA, 75 bp, Artificial Sequence
  Synthetic
attctgactcttcaaaaagtgaattgctttcttgagcatatttcaacagtgagaaaagtgtgtcccttagtttat

SEQ ID NO: 218274 - DNA, 75 bp, Artificial Sequence
  Synthetic
gctttcttgagcatatttcaacagtgagaaaagtgtgtcccttagtttatcattaacccagtcaggtatttgttc

SEQ ID NO: 218275 - DNA, 75 bp, Artificial Sequence
  Synthetic
aggagaattagtgcatcaaagattaaaagaagtttcctccttgtgttcaatatccttagggattttactttattt

SEQ ID NO: 218276 - DNA, 75 bp, Artificial Sequence
  Synthetic
ccctttttcatttccctcaccaacatttgcatacaagaatctcagtattggtgatgctcttttgaactgataaat

SEQ ID NO: 218277 - DNA, 75 bp, Artificial Sequence
  Synthetic
cactcctcagatcttccttcaactgctctaactttttgaagtcctcaatgtacttctgttcaaagttggcagggg

SEQ ID NO: 218278 - DNA, 75 bp, Artificial Sequence
  Synthetic
tgagaaacatgatgaggaattttgtgacatgctgaggctgtttgacttcaacaaacaagccattcaaagattgaa

SEQ ID NO: 218279 - DNA, 75 bp, Artificial Sequence
  Synthetic
tttgcatacaagaatctcagtattggtgatgctcttttgaactgataaattaagtgttcaatattatcttttgca

SEQ ID NO: 218280 - DNA, 75 bp, Artificial Sequence
  Synthetic
ctctaactttttgaagtcctcaatgtacttctgttcaaagttggcaggggatgacctaacaaaacactccaataa

SEQ ID NO: 218281 - DNA, 75 bp, Artificial Sequence
  Synthetic
gcctgatttaagtctctgaggcgtttcaggtcactatcatccctattctgcttgcgcatcaatcgttgcacattg

SEQ ID NO: 218282 - DNA, 75 bp, Artificial Sequence
  Synthetic
gcctgatttaagtctctgaggcgtttcaggtcactatcatcccttttctgcttgcgcatcaatcgttgcacattg

SEQ ID NO: 218283 - DNA, 75 bp, Artificial Sequence
  Synthetic
gcctgatttaagtctctgaggcgtttcaggtcactatcatccctcttctgcttgcgcatcaatcgttgcacattg

SEQ ID NO: 218284 - DNA, 75 bp, Artificial Sequence
  Synthetic
gcctgatttaagtctctgaggcgtttcaggtcactatcatccctgttctgcttgcgcatcaatcgttgcacattg

SEQ ID NO: 218285 - DNA, 75 bp, Artificial Sequence
  Synthetic
gtgaaggggtcaagatcccatggtcatgaaggattctttctacagatttgtcctcgttgttgtgttcacacccat

SEQ ID NO: 218286 - DNA, 75 bp, Artificial Sequence
  Synthetic
atcagtcttgacaaattgactttctatgttcccttgccttagtttgttcctgaagatttgatactcctcttcaat

SEQ ID NO: 218287 - DNA, 75 bp, Artificial Sequence
  Synthetic
atgaaggattctttctacagatttgtcctcgttgttgtgttcacacccatttgcattgcaagaatcaacctcaat

SEQ ID NO: 218288 - DNA, 75 bp, Artificial Sequence
  Synthetic
atttaggattgcgcttttagagatctttgtgtgattgggcctcactgggtcatggggcaaatcataacattcttc

SEQ ID NO: 218289 - DNA, 75 bp, Artificial Sequence
  Synthetic
ataaaaatcggacacaaaggccatcacaaagtacctaatgttttgtaaaaatttttgacaccttttactaggatg

SEQ ID NO: 218290 - DNA, 75 bp, Artificial Sequence
  Synthetic
tttgcacaagaaatgctaacttctgccttgacagtttctcgttgtcagctaagtactttgatactaaatctttga

SEQ ID NO: 218291 - DNA, 75 bp, Artificial Sequence
  Synthetic
attgttcagataactctgtgcactcttctatccagctgaccataacatcgactactttctgcaacacatcactgg

SEQ ID NO: 218292 - DNA, 75 bp, Artificial Sequence
  Synthetic
cataggccatgtcttcctccatgcttgactgcagatgaggtgatcacagctctcaaataagtggttaactgaggt

SEQ ID NO: 218293 - DNA, 75 bp, Artificial Sequence
  Synthetic
tacaaactctagaactgaacatggcaaaccttaatatgacgatgcccttgtcttgtacgaagaacaacagccatc

SEQ ID NO: 218294 - DNA, 75 bp, Artificial Sequence
  Synthetic
gatccagaacacaacacctccaccatacaccccataatcccaggaccaacactcccacctccatcacccaccccc

SEQ ID NO: 218295 - DNA, 75 bp, Artificial Sequence
  Synthetic
tgaagtcctcaatgtacttctgctcaaagttggcaggagatgatctaacgaaacactccagcagtattagaacat

SEQ ID NO: 218296 - DNA, 75 bp, Artificial Sequence
  Synthetic
ggagtttcagcccttccattaatagcatcctgggctctgtctgcacaagaaatgccaacttttgccttgataatc

SEQ ID NO: 218297 - DNA, 75 bp, Artificial Sequence
  Synthetic
tctttgtaaaagctctgtgagagattgatcaaagagagaaatttgatcatcactagaggtataagcatctatcgt

SEQ ID NO: 218298 - DNA, 75 bp, Artificial Sequence
  Synthetic
aatgccaacttttgccttgataatctctcattgtccaccaggtactttgatactaaatctttgacgcaggctatg

SEQ ID NO: 218299 - DNA, 75 bp, Artificial Sequence
  Synthetic
tcttcctccatcgccaattggggcacctgtatagggtttgggtttgtgctggaatggcctgtggttcaactgatg

SEQ ID NO: 218300 - DNA, 75 bp, Artificial Sequence
  Synthetic
gcacagatgagtatccaactaataaacaaagcagtgaacgcactgatcaatgaccagctcattatgaagaatcat

SEQ ID NO: 218301 - DNA, 75 bp, Artificial Sequence
  Synthetic
tcgagttaaaactctgttgatgatagcaaggagctcacaatttcgttcctctccaagtgataggacacctgcatt

SEQ ID NO: 218302 - DNA, 75 bp, Artificial Sequence
  Synthetic
cgcccatctcctattggttacttaggactattgtcacagagaactagagatatctatatcagtcgaagacttctc

SEQ ID NO: 218303 - DNA, 75 bp, Artificial Sequence
  Synthetic
cccccggggggaccccccgccgggggcccccccgggggggcaggcagcccagctctactcaatgtcctcaacgca

SEQ ID NO: 218304 - DNA, 75 bp, Artificial Sequence
  Synthetic
gtagtctgctggagcgacagttcactgtaggacgggatctagtagggggcacagaagacacaagaggtaattaaa

SEQ ID NO: 218305 - DNA, 75 bp, Artificial Sequence
  Synthetic
aatgggacaaatagtgacattcttccaggaagtgcctcatgtaatagaagaggtgatgaacattgttctcattgc

SEQ ID NO: 218306 - DNA, 75 bp, Artificial Sequence
  Synthetic
cctgtatagggtttgggtttgtgctggaatggcctgtggttcaactgatggtgccccacagaagctcctacagaa

SEQ ID NO: 218307 - DNA, 75 bp, Artificial Sequence
  Synthetic
gatgcgcgagctgttctcgagcacctactcaatgtcgaggggaggccccacctcttcaaagaggggcctgcacag

SEQ ID NO: 218308 - DNA, 75 bp, Artificial Sequence
  Synthetic
tgttgaggatcctcagagactttatcttatttagaaaagatctccaacactgcatctgttcactttgagagtcag

SEQ ID NO: 218309 - DNA, 75 bp, Artificial Sequence
  Synthetic
gctttaatgaaagacttcatcatagctgtcaccacattaaaaggtatttccaccattttgtgcatatgccacata

SEQ ID NO: 218310 - DNA, 75 bp, Artificial Sequence
  Synthetic
cattaatcaatgaccaactgattatgaagaaccatctaagggacatcatgggaattccttattgcaactacagta

SEQ ID NO: 218311 - DNA, 75 bp, Artificial Sequence
  Synthetic
atctgcatacaagaacttaaggactggagaggctctttggaactggaatgttaactgttcaatgttgtcatcaca

SEQ ID NO: 218312 - DNA, 75 bp, Artificial Sequence
  Synthetic
cagaatggcttgtaggtcaactagtagtaccccacaaaagctcctacaaaaatgagagacaatatgcctaggatc

SEQ ID NO: 218313 - DNA, 75 bp, Artificial Sequence
  Synthetic
cctgtgttggatttggatttgtgccaatatggcctgtgggtcagctggtgatgcccaaaaaagctcctacagaaa

SEQ ID NO: 218314 - DNA, 75 bp, Artificial Sequence
  Synthetic
atttgaggctttcatccttaggttgtcatttagattctcactgaactcctaggaagccatggaagatgaggttgc

SEQ ID NO: 218315 - DNA, 75 bp, Artificial Sequence
  Synthetic
tccacccaattgtccactgcctcaagaactgcactcaggacctctgcattacttggtgctgcagccctcagcgtg

SEQ ID NO: 218316 - DNA, 75 bp, Artificial Sequence
  Synthetic
acctaaacgaaacacatttttctgatgacattgaacaacaagcagacaacatgataacagaaatgttgcagaaag

SEQ ID NO: 218317 - DNA, 75 bp, Artificial Sequence
  Synthetic
ggtgtctattttatcactatatagctttctgaaatcttccaataacttcatcttatcagtcttgacaaattgact

SEQ ID NO: 218318 - DNA, 75 bp, Artificial Sequence
  Synthetic
gcaaatggtgtcctgcagactttcatgaggatggcctggggtggaagctacattgctcttgactcaggccatggc

SEQ ID NO: 218319 - DNA, 75 bp, Artificial Sequence
  Synthetic
taagcatctttctccatctggtcaagatcccaactcacaggcacatcgtggggaaaccttgccctaagccacaca

SEQ ID NO: 218320 - DNA, 75 bp, Artificial Sequence
  Synthetic
gacactcagagatttaccggttgaaagttctgctcagtgagtcaatgaaaagcgcaatccaatagcctaggatcc

SEQ ID NO: 218321 - DNA, 75 bp, Artificial Sequence
  Synthetic
ccggggatcctaggcaattaagctggatttcagtggtgaaactcattttggtgaatccttgaaccaaagtgtgta

SEQ ID NO: 218322 - DNA, 75 bp, Artificial Sequence
  Synthetic
gatcccaactcacaggcacatcgtggggaaaccttgccctaagccacacagactcaaccacatgggcatctgctc

SEQ ID NO: 218323 - DNA, 75 bp, Artificial Sequence
  Synthetic
gtgaatccttgaaccaaagtgtgtagtcaaaatgggcaacagacaggccaaatcgacagaagtcaatgaacatca

SEQ ID NO: 218324 - DNA, 75 bp, Artificial Sequence
  Synthetic
tcgagaccatctcccatcggttatctcggtctcctttcgcaaaggaccagagacatttatattagtagaagacta

SEQ ID NO: 218325 - DNA, 75 bp, Artificial Sequence
  Synthetic
catcattcaagtcaacctgcccctgttttgtcagacatgccagtgtcagacttggcatggtcccgaactgattat

SEQ ID NO: 218326 - DNA, 75 bp, Artificial Sequence
  Synthetic
tgcgaggaagggcttcaatgactgcactggtcaagccaggttgagcagggaaaagatctgccacatcaatcccat

SEQ ID NO: 218327 - DNA, 75 bp, Artificial Sequence
  Synthetic
cactgtcaaagacttagtggcaaaatacttggctgacaatgagaagttatcaaggcaaaaattagcattcttggt

SEQ ID NO: 218328 - DNA, 75 bp, Artificial Sequence
  Synthetic
cccaaacagcattttcaaacttcctagagtcaaccttgcttaatgaaatatcaataagctttatgtccctccttc

SEQ ID NO: 218329 - DNA, 75 bp, Artificial Sequence
  Synthetic
ctatcaatacctgataatccaaaatacaacctgggacaatcattgccagttctcaagaccatctcccatcggtta

SEQ ID NO: 218330 - DNA, 75 bp, Artificial Sequence
  Synthetic
cggggggaccccccgccgggggcccccccgggggggcaggcggcccagctctactcaatgtcctcaacacacctc

SEQ ID NO: 218331 - DNA, 75 bp, Artificial Sequence
  Synthetic
aatgtcttcctccatcgccaattgtggcacctgtattgggtttgggtttatgccagaatagcttgtgggtcagct

SEQ ID NO: 218332 - DNA, 75 bp, Artificial Sequence
  Synthetic
ggtgatgaacattgttctcattgcactgtctatactagcagtgctgaaaggtctgtacaattttgcaacatgtgg

SEQ ID NO: 218333 - DNA, 75 bp, Artificial Sequence
  Synthetic
gcgcaatttgaatgtccttgttgacatgggacaaatagtgactttcttccaggaggtgcctcatgtgatagagga

SEQ ID NO: 218334 - DNA, 75 bp, Artificial Sequence
  Synthetic
tttttgacaccttttactaggatgtgtcagtatcaaaactaaaatcattttggttaacaattttatagtgatcaa

SEQ ID NO: 218335 - DNA, 75 bp, Artificial Sequence
  Synthetic
tcaaatggttcctacctgaatgagacacatttttctgatgacattgaacaacaagcagacaacatgataacagaa

SEQ ID NO: 218336 - DNA, 75 bp, Artificial Sequence
  Synthetic
cgcaaatgggtgtgaacacaacacagaggacaaatccgtagaaaatatcctccacgactttggaattccgacccc

SEQ ID NO: 218337 - DNA, 75 bp, Artificial Sequence
  Synthetic
aagtctgtccaggtcggagctgtttgggtacttagctgtgtatattagacccaggtctgttagtgccaagacggc

SEQ ID NO: 218338 - DNA, 75 bp, Artificial Sequence
  Synthetic
ggcaagggaaaacacccttagggttggtggatctctttgttttcagcaccagcttttatctcattagcatcttcc

SEQ ID NO: 218339 - DNA, 75 bp, Artificial Sequence
  Synthetic
ttgtaatctgtctgatgctcacaaaaagaatctctatgatcacacccttatgagcataatttcgacttttcattt

SEQ ID NO: 218340 - DNA, 75 bp, Artificial Sequence
  Synthetic
tccattagtgcacagtggggagttatttcctctttaccgcccttctttttcttttcaacaacgacacctgtgtgc

SEQ ID NO: 218341 - DNA, 75 bp, Artificial Sequence
  Synthetic
gctcttctttgctcaagttgctgtgtactcagatttcccatgtaaacacctgagcttagtggcctttctgttctg

SEQ ID NO: 218342 - DNA, 75 bp, Artificial Sequence
  Synthetic
gtccattcccaacttcaatcagtatgaagcaatgagctgtgacttcaatggagggaaaattagtgtgcaatacaa

SEQ ID NO: 218343 - DNA, 75 bp, Artificial Sequence
  Synthetic
atacaggccccagcctttactgcagctcccaagctaaaattgtaaccagaaatgttcaaggagctcttcttagtg

SEQ ID NO: 218344 - DNA, 75 bp, Artificial Sequence
  Synthetic
gatacttttggggtttgctgattgaaagttttactcagcaagtcaatgaaaagcgcaatccaatagcctaggatc

SEQ ID NO: 218345 - DNA, 75 bp, Artificial Sequence
  Synthetic
atcagtcccaagtccgtcagtgctaggacagcatcatttaggtcaacttgaccctgtttagtaagacatgctaat

SEQ ID NO: 218346 - DNA, 75 bp, Artificial Sequence
  Synthetic
ccaatatctaataattcaaaatacaacctgggaagatcactgccagttctcaagaccatctcccatcggctatct

SEQ ID NO: 218347 - DNA, 75 bp, Artificial Sequence
  Synthetic
acctgggaagatcactgccagttctcaagaccatctcccatcggctatcttgggctcctctcacaaaggaccaga

SEQ ID NO: 218348 - DNA, 75 bp, Artificial Sequence
  Synthetic
ttactggggtgagctaaaattaaaaccaggatcatctttgtcaaagatctgatattgttcaactgcccttccagc

SEQ ID NO: 218349 - DNA, 75 bp, Artificial Sequence
  Synthetic
aggagggcctgagcatccttgacaacttgaagctttatgctggagcagtaacctgagagctccctcctcaatgac

SEQ ID NO: 218350 - DNA, 75 bp, Artificial Sequence
  Synthetic
gacatttacattagtagaagactactgggcacattcacatggacactatcggattctgaaggcaatgacacacca

SEQ ID NO: 218351 - DNA, 75 bp, Artificial Sequence
  Synthetic
cccgggggggcaggcagcccaactctactcaatgtcctcaacacacctctccggcccaaacaactctgaacatgt

SEQ ID NO: 218352 - DNA, 75 bp, Artificial Sequence
  Synthetic
ccttgagggtcataagctgagaatatgttagcccagcggcaaaccctgccgactgcagggatttgttggaattgg

SEQ ID NO: 218353 - DNA, 75 bp, Artificial Sequence
  Synthetic
cttcggtaacacagctgtagccaaatgcaatgaaaaacatgatgaagaattctgtgacatgctgagactgtttga

SEQ ID NO: 218354 - DNA, 75 bp, Artificial Sequence
  Synthetic
acttcagtggtaaagtccattctagtgaatcccttaatcaaagtgcccagccaaaatgggcaacaagcaggccaa

SEQ ID NO: 218355 - DNA, 75 bp, Artificial Sequence
  Synthetic
tgcaatgaaaaacatgatgaagaattctgtgacatgctgagactgtttgactttaacaaacaagccattcaaaga

SEQ ID NO: 218356 - DNA, 75 bp, Artificial Sequence
  Synthetic
tacactcagggactcactggttgaaagtatcactcagtaagtcagtgaaatgcgcaatccaatagcctaggatcc

SEQ ID NO: 218357 - DNA, 75 bp, Artificial Sequence
  Synthetic
acgttttaaatcaccatcatctcttttctgtttgcgcattagacgttgcacattgttgacctcagagaagtcaag

SEQ ID NO: 218358 - DNA, 75 bp, Artificial Sequence
  Synthetic
ttctgtttgcgcattagacgttgcacattgttgacctcagagaagtcaaggccgtgaaggagggcctgggcatcc

SEQ ID NO: 218359 - DNA, 75 bp, Artificial Sequence
  Synthetic
tgctctgattaatgaccaattgataatgaaaaaccatctacgggacatcatggggattccatactgtaactatag

SEQ ID NO: 218360 - DNA, 75 bp, Artificial Sequence
  Synthetic
gagttgctggtttgagaacagagggctggtggagtgcaacaaccactatctgtgtctcaactgtctcagcctgct

SEQ ID NO: 218361 - DNA, 75 bp, Artificial Sequence
  Synthetic
atcctcaccagctaactttgaacaaaagtatactgaagatctcacaaaactagagcagctgaaagacgatcttaa

SEQ ID NO: 218362 - DNA, 75 bp, Artificial Sequence
  Synthetic
caatgactgtgtccaaaggaatgatttcacctccttggaagcactcatcctgatctgagtaccctgaaacttact

SEQ ID NO: 218363 - DNA, 75 bp, Artificial Sequence
  Synthetic
gacctgctggacccagcagtacccactttttgtggcttcccgtctgtctcaaggtccacaatagtattctcccaa

SEQ ID NO: 218364 - DNA, 75 bp, Artificial Sequence
  Synthetic
ttcacctccttggaagcactcatcctgatctgagtaccctgaaacttactagttgaaatatatcacccagtaaat

SEQ ID NO: 218365 - DNA, 75 bp, Artificial Sequence
  Synthetic
atcctaggcatttaggattgcgcttttagagatctttgtgtgaataggcttcattaagccatgggacaaatcata

SEQ ID NO: 218366 - DNA, 75 bp, Artificial Sequence
  Synthetic
tctccatcacccaccccccacccccggggggaccccccgccgggggcccccccgggggggcaggcagcccaactc

SEQ ID NO: 218367 - DNA, 75 bp, Artificial Sequence
  Synthetic
ttggcaaaccgtgtccgaaacctcacaggctgaatcacatgggcatatgttcctgtggactctacaaacaacctg

SEQ ID NO: 218368 - DNA, 75 bp, Artificial Sequence
  Synthetic
ccaccgcctgttggcggtgggtcacgggggcgtccatttacaggacgactttgggtgtcgatgttctaaacacca

SEQ ID NO: 218369 - DNA, 75 bp, Artificial Sequence
  Synthetic
aacagcactggtcaagcccggttgtgcagcgaagaggtctgtgacatcaatcccatgtgagtacttagcatcctg

SEQ ID NO: 218370 - DNA, 75 bp, Artificial Sequence
  Synthetic
tgggtctcaaggggaaatagtcacaaggattgtgtttaaaaaagtccaaaatctgggcttgttttggttccccaa

SEQ ID NO: 218371 - DNA, 75 bp, Artificial Sequence
  Synthetic
gagatattcaaagagcttttcttggtgtcaatcatatttaggatggggtgactttgagtcagcctgtccaagtct

SEQ ID NO: 218372 - DNA, 75 bp, Artificial Sequence
  Synthetic
taatgataaattaagagagacactattctcattattgcgatttgctcaagaaaacaatgctctttttgaggaatc

SEQ ID NO: 218373 - DNA, 75 bp, Artificial Sequence
  Synthetic
caattagtttgatatccttcctcccttgtgattcaaggagctttcgaatgtcatcagatccctgacaggtgatga

SEQ ID NO: 218374 - DNA, 75 bp, Artificial Sequence
  Synthetic
caaagattgtgtccacaaaaaggactttatttcttttgaggcactcatcgccaaattgttgtgctggatacacgc

SEQ ID NO: 218375 - DNA, 75 bp, Artificial Sequence
  Synthetic
tcaatgtccatccaggtcttagcatttggatcaagctgcagcattgaatctttgagggtcatgagctgagaatag

SEQ ID NO: 218376 - DNA, 75 bp, Artificial Sequence
  Synthetic
tcctcttgttgtgtggcaggtcttgcacaaccagtctttacaaaggggtttatgagcttcagactctggagctaa

SEQ ID NO: 218377 - DNA, 75 bp, Artificial Sequence
  Synthetic
gtgagcccggcggtgaatcctgccgattgcagggacttattggaattgttgctcccagctttctgtggcttccca

SEQ ID NO: 218378 - DNA, 75 bp, Artificial Sequence
  Synthetic
ttctcagggattttctggttgagagtttcactcagtaagtcaatgagaagcgcaatccaatagcctaggatccac

SEQ ID NO: 218379 - DNA, 75 bp, Artificial Sequence
  Synthetic
attcctctgtcaggcctgaggcaataagctggttcaaatttatctgggctggttctatgtcaaagtctatccatg

SEQ ID NO: 218380 - DNA, 75 bp, Artificial Sequence
  Synthetic
cggggatcctaggcaatttagctggactttagtggtaaagctcatttcagtgagtctctgaatcaaagtgcctag

SEQ ID NO: 218381 - DNA, 75 bp, Artificial Sequence
  Synthetic
tgacagctggatcatctctgcccttggcctctgatgaaaccctccatatttggatcccactgtccttcaccactg

SEQ ID NO: 218382 - DNA, 75 bp, Artificial Sequence
  Synthetic
agaccctgaaggtaatgatgcaacagcatcaaaaaaatcctctaatgagtcaaatctagaatcaaccaaacctga

SEQ ID NO: 218383 - DNA, 75 bp, Artificial Sequence
  Synthetic
ttcgccaggggtttcagatatgaacatcccaagagcctttttcactttcaagatggacttcaggatgccatccat

SEQ ID NO: 218384 - DNA, 75 bp, Artificial Sequence
  Synthetic
ttttggaggagcttttgagaacgtttactagggtgagctaaaattaaaaccaagatcatctttgtcaaagacctg

SEQ ID NO: 218385 - DNA, 75 bp, Artificial Sequence
  Synthetic
gacagacaaccgcactgaccattatgaagatataattgctctttgccatcagggcattaacaacaagttgtcggc

SEQ ID NO: 218386 - DNA, 75 bp, Artificial Sequence
  Synthetic
gcccaagctaaaattgtaacctgagatgttcagggagcttttcttggtgtctatcatgttcagaatagggtggct

SEQ ID NO: 218387 - DNA, 75 bp, Artificial Sequence
  Synthetic
cctcagcgtcagcagcagatgcccgatctgtaagatgcctcttcccaccaaactaaaggcagcagcacaaccgag

SEQ ID NO: 218388 - DNA, 75 bp, Artificial Sequence
  Synthetic
ccttgctttgttaaacatgccagtgtcagacttggcatggtgccaaactgattgttgagcaaatctgcattcttt

SEQ ID NO: 218389 - DNA, 75 bp, Artificial Sequence
  Synthetic
ctctcccaacttgagccccctgattgccaccactcattcctatcatattcaggagagctcgtctttggtcgagtt

SEQ ID NO: 218390 - DNA, 75 bp, Artificial Sequence
  Synthetic
gagtcctcctgacacagctgcatcatacattatgcagtccattaaagcacagtgcggggtaatttcttctttgcc

SEQ ID NO: 218391 - DNA, 75 bp, Artificial Sequence
  Synthetic
tggaggccaaatcactcatgaatggtagtatatgtttctcaaatagagacggatacaaacgtctcaaagagtgga

SEQ ID NO: 218392 - DNA, 75 bp, Artificial Sequence
  Synthetic
cagattgttgtgctgtatgcacgcagcagaaatctgaagctgtctgccaaaatgataaaagcaaagcgcaatcct

SEQ ID NO: 218393 - DNA, 75 bp, Artificial Sequence
  Synthetic
gatagtgttatgcacatataatcccatagaagaggtcttaaataagtgacaacagtatcacctccatctttgact

SEQ ID NO: 218394 - DNA, 75 bp, Artificial Sequence
  Synthetic
caagtcatctgaggttagagtcccaactctcaatacactcttctgttgagttgatttcagctcgacaagattatt

SEQ ID NO: 218395 - DNA, 75 bp, Artificial Sequence
  Synthetic
gggatcctaggcaatttggttgttctttctgaggttttgtgcgctgaacttctctaaatgggaaacaagcaagcc

SEQ ID NO: 218396 - DNA, 75 bp, Artificial Sequence
  Synthetic
gacacttaagggttttttggttgaaagtattgctcagtgagtcactgaaaggcgcaatccaatagcctaggatcc

SEQ ID NO: 218397 - DNA, 75 bp, Artificial Sequence
  Synthetic
ccaatcagcaggtcagatgaagtgtccccaacctccttcacaaacatttcaagatcttggtcttgtatgacaggt

SEQ ID NO: 218398 - DNA, 75 bp, Artificial Sequence
  Synthetic
tcagtttgtcaaggtggaaaaaggggaactgatgtgcaaattcaacaatctatatgttgatgaggggattgtggg

SEQ ID NO: 218399 - DNA, 75 bp, Artificial Sequence
  Synthetic
cttctaagtgtcagcaataggtgccccatttgcaagatgccccttcccacaaaactgagaccgtcagccactcca

SEQ ID NO: 218400 - DNA, 75 bp, Artificial Sequence
  Synthetic
ctagtgaatgtcgatgacaacctattttgcaaggtctttactattgtagggaccttttcatcttccagattcaca

SEQ ID NO: 218401 - DNA, 75 bp, Artificial Sequence
  Synthetic
aaaactgagaccgtcagccactccaacggcacccccaaccgaagctgcggacagcatcggacccccaccctacag

SEQ ID NO: 218402 - DNA, 75 bp, Artificial Sequence
  Synthetic
caagttgttgtgttgaatacacacagcagagagctaagactatctgctgaattgataaaagcaaagcgcaatcca

SEQ ID NO: 218403 - DNA, 75 bp, Artificial Sequence
  Synthetic
ttaaaggcagcagcacaaccgagcgcaccctcaactgaggcgggccagaacacagcacctccaccgtacgcccca

SEQ ID NO: 218404 - DNA, 75 bp, Artificial Sequence
  Synthetic
ccggggatcctaggcaatttggttgttcatttcttttgaggcctcatttaggtctttcttagaccctctgtgctg

SEQ ID NO: 218405 - DNA, 75 bp, Artificial Sequence
  Synthetic
agtcaaagctccagaagcaaggaacagtccgagggccagtctgatcccagacgccacacacctagggccacagtt

SEQ ID NO: 218406 - DNA, 75 bp, Artificial Sequence
  Synthetic
agtccgagggccagtctgatcccagacgccacacacctagggccacagttctgcaagagctgctggttcgagaac

SEQ ID NO: 218407 - DNA, 75 bp, Artificial Sequence
  Synthetic
aaatcctcaagggagtccaacctcaactcctctgttaggcctgaagcaatgagctggttcaaatttatttgggct

SEQ ID NO: 218408 - DNA, 75 bp, Artificial Sequence
  Synthetic
aagggcctggtcgagtgcaacaatcactacctgtgcctcaactgtctaaccctactcctaggtgtcagcagcagg

SEQ ID NO: 218409 - DNA, 75 bp, Artificial Sequence
  Synthetic
tcttcttttcaacaacgacacctgtgtgcatgtggcataagtctttatactgatcccagactgcattctcatact

SEQ ID NO: 218410 - DNA, 75 bp, Artificial Sequence
  Synthetic
cccaacggcgcccccagccggagcaggagacaacaccagacccccaccctacagtccctgaacagcccaccaacc

SEQ ID NO: 218411 - DNA, 75 bp, Artificial Sequence
  Synthetic
ctacaaatgaagaaaatggacccattctatgcaacccttcaccctctggaactgatgtcttgtgtggaaaccacg

SEQ ID NO: 218412 - DNA, 75 bp, Artificial Sequence
  Synthetic
cgcaacaaatggtctcacataagactcaaaataaatttgcctcatgaaattgtcaatagcatcactagtgctcac

SEQ ID NO: 218413 - DNA, 75 bp, Artificial Sequence
  Synthetic
atcaccttccctcttgatttactgtagcagagagcatagcccttgaattccacccaattgtctaccacctcaaga

SEQ ID NO: 218414 - DNA, 75 bp, Artificial Sequence
  Synthetic
agcagagagcatagcccttgaattccacccaattgtctaccacctcaagaaccgcactcaggacctccgcattac

SEQ ID NO: 218415 - DNA, 75 bp, Artificial Sequence
  Synthetic
ggatactgaagaatccaaaggtccaactgtagactggtgtcaaatgcaatgctggagatcgttcttgaacaaggt

SEQ ID NO: 218416 - DNA, 75 bp, Artificial Sequence
  Synthetic
accgcactcaggacctccgcattacctggtgctgcagccctcagcgtggagacaatgtccacccctgaccattgc

SEQ ID NO: 218417 - DNA, 75 bp, Artificial Sequence
  Synthetic
attttattctgggtgaccacttcattttagtcgatgctagatcactcatgaatggcaatatgtgtttctcaaaca

SEQ ID NO: 218418 - DNA, 75 bp, Artificial Sequence
  Synthetic
cagatcagatgaagtgtctccaacttctctcacaaacatctcaagatcctgatcctgtataacaggtgtgaaaga

SEQ ID NO: 218419 - DNA, 75 bp, Artificial Sequence
  Synthetic
tgcagcttatccatatcaacaacaacctcaacaggagtcacatgccctagttgatttgtgtcaaccaaaaactcg

SEQ ID NO: 218420 - DNA, 75 bp, Artificial Sequence
  Synthetic
cctcaacaggagtcacatgccctagttgatttgtgtcaaccaaaaactcgttaatgacctcagtatcaacatacc

SEQ ID NO: 218421 - DNA, 75 bp, Artificial Sequence
  Synthetic
aagctccctcctcaatgactgtgtccagagaaatgacttcacttccttagaagcactcatcttggtctggacact

SEQ ID NO: 218422 - DNA, 75 bp, Artificial Sequence
  Synthetic
ttccattatcccttaccactgcttcaactccttgggtccccagtagctgagtctgtatggatttaatatagagat

SEQ ID NO: 218423 - DNA, 75 bp, Artificial Sequence
  Synthetic
tggacacttggggatttactggttgaaagtatcactcagtaagtcaatgaaaagcgcaatccaatagcctaggat

SEQ ID NO: 218424 - DNA, 75 bp, Artificial Sequence
  Synthetic
ctggttcaaatttatctgggctggttctatgtcaaagtctatccatgcatagcccatcataagatcaaacttaaa

SEQ ID NO: 218425 - DNA, 75 bp, Artificial Sequence
  Synthetic
ttcaccctctggaactgatgtcttgtgtggaaaccacgtgaaggaccccaatgttcttgtagtcgcaacaaatgg

SEQ ID NO: 218426 - DNA, 75 bp, Artificial Sequence
  Synthetic
agcatcctgactcttgatgcggaatctcactgtctgacttagttttgcagaccctgtaggtaatgacgcaacagc

SEQ ID NO: 218427 - DNA, 75 bp, Artificial Sequence
  Synthetic
cacttgttccttgtaggacaaagaaaattttagtctgccagtgtcagggccagttgaattataggattgaggtga

SEQ ID NO: 218428 - DNA, 75 bp, Artificial Sequence
  Synthetic
caatcaattgattctgattaaatctagctggttcaatgtcaaagtctatccaggcataacccatcatcagatcat

SEQ ID NO: 218429 - DNA, 75 bp, Artificial Sequence
  Synthetic
aaatgatcaggtgaaatgcagaggcaggagctcaaaagggtggcttggttcttgtttcatcagtgtaaatgatcg

SEQ ID NO: 218430 - DNA, 75 bp, Artificial Sequence
  Synthetic
gtttgaacattggtctctcaacacctttgtgaatgactttctctacgaatgaagaaaatggacccaatctatgca

SEQ ID NO: 218431 - DNA, 75 bp, Artificial Sequence
  Synthetic
cacctccatcacccaccccccacccccggggggaccccccgccgggggcccccccgggggggcaggcagcccagc

SEQ ID NO: 218432 - DNA, 75 bp, Artificial Sequence
  Synthetic
ctccaagagattcaagaagttcactcagtatattagcataatccacaggtctctgttttgtgaggattgagacaa

SEQ ID NO: 218433 - DNA, 75 bp, Artificial Sequence
  Synthetic
cacaaattttgatgtattgatcctcagacaggatctctcgatcaaaatcttctatcatatggtttgaaagttcac

SEQ ID NO: 218434 - DNA, 75 bp, Artificial Sequence
  Synthetic
aacacatttgctaccaagtgttctgcataaccccacaaagccagatgcaatggaactttggaatgcagatttgtt

SEQ ID NO: 218435 - DNA, 75 bp, Artificial Sequence
  Synthetic
cagatgggtacagccttctcaaagaatgaataatatgattcaacccaaccctgtcttctaacaactttgatgcag

SEQ ID NO: 218436 - DNA, 75 bp, Artificial Sequence
  Synthetic
cgcaccggggatcctaggcaatttggttgtttcttttttgtggccttgtgtgctgaactcctccaaatgggaaac

SEQ ID NO: 218437 - DNA, 75 bp, Artificial Sequence
  Synthetic
gccttagttgtcttcggctcacccagaacccatgcacccagttctattgcagtcgatagagagatgcacatatag

SEQ ID NO: 218438 - DNA, 75 bp, Artificial Sequence
  Synthetic
agtcgatagagagatgcacatatagtcccataataagggtctaaagtaactaactatactttcactcttatttct

SEQ ID NO: 218439 - DNA, 75 bp, Artificial Sequence
  Synthetic
gtcgtccacactggtgtgtagaaatgagattctgaggtcagtgattcaaaagactgtgactaaagccactgctgc

SEQ ID NO: 218440 - DNA, 75 bp, Artificial Sequence
  Synthetic
gctcaatgatgatagtctttctaagtctgttgcatctagaatgtcaatgacgccaagagtataagggaacatgtc

SEQ ID NO: 218441 - DNA, 75 bp, Artificial Sequence
  Synthetic
attcgatcccttgggtgccagtgatcagagactgtatagacttgatatacagattctctttatttggcccccgaa

SEQ ID NO: 218442 - DNA, 75 bp, Artificial Sequence
  Synthetic
tctacccagtctctgacatctgtctcgcaattcaataagaatgggtcaatggggtatcttgcatattgcaaaaga

SEQ ID NO: 218443 - DNA, 75 bp, Artificial Sequence
  Synthetic
gagctttgaaatgcagatttattgatggcttcagataacaatttctgtgcacctcgagtgaaggtggaagatagt

SEQ ID NO: 218444 - DNA, 75 bp, Artificial Sequence
  Synthetic
tgggaattttctcatcatctaggttcacagcacctgaatatatgatcttttgccttaataccatccttagaggat

SEQ ID NO: 218445 - DNA, 75 bp, Artificial Sequence
  Synthetic
cacagcacctgaatatatgatcttttgccttaataccatccttagaggatgatgtgcagccaaattcaaccaaga

SEQ ID NO: 218446 - DNA, 75 bp, Artificial Sequence
  Synthetic
gattttttagtgaagagaggtgttcactagacaggtagtttgttgtaaactcctcatggagctgcccagtcttca

SEQ ID NO: 218447 - DNA, 75 bp, Artificial Sequence
  Synthetic
ttcccacaagcctcccctatgcacaaccagagggactggttcaatacagggacccaccaacacaaagtcatactc

SEQ ID NO: 218448 - DNA, 75 bp, Artificial Sequence
  Synthetic
cacaaatcgactgggacaccatttgcaacagattgatcaattattgtgtcgattgtttctgccaattggtgaggt

SEQ ID NO: 218449 - DNA, 75 bp, Artificial Sequence
  Synthetic
tcttccttaaccctagttgggctttaatgaaagacttcatcatagctgtcaccacattaaaaggtatttctacca

SEQ ID NO: 218450 - DNA, 75 bp, Artificial Sequence
  Synthetic
cttgctcttgtaatgggagtactttcccatcagcttattcccattcatcaccaataaaatcgacttaaagcattg

SEQ ID NO: 218451 - DNA, 75 bp, Artificial Sequence
  Synthetic
cacaggtgaacagggacaccattcgcaactgactgatcaataattgtgtcgattgtctctgccagttggtgtggc

SEQ ID NO: 218452 - DNA, 75 bp, Artificial Sequence
  Synthetic
gattgtctctgccagttggtgtggctccttacattttatgttgtgaagagctgctgcaacaaactttgttagcaa

SEQ ID NO: 218453 - DNA, 75 bp, Artificial Sequence
  Synthetic
gatattaaaacttgatgtttcaggggtgaccccaacaattagttaccaaaaatcacaagaggagaaatttccata

SEQ ID NO: 218454 - DNA, 75 bp, Artificial Sequence
  Synthetic
ctgttgattcattgagccaatgtattcaaggtgaatggcaaagctctccttaaaactagcatcttgacttttaat

SEQ ID NO: 218455 - DNA, 75 bp, Artificial Sequence
  Synthetic
tcgatgtagcttgtgggtcagctggtgatgccccacagaagctcccacagaaatgagaatcaatatgcctaggat

SEQ ID NO: 218456 - DNA, 75 bp, Artificial Sequence
  Synthetic
gcgcttttagagatccttttgtgagtgggtttcattaagccatggggcaaatcataacatttttccaggaagtgc

SEQ ID NO: 218457 - DNA, 75 bp, Artificial Sequence
  Synthetic
ctacagcatcaaagaaatcctccaatgagtcaaacttgggatcaaccaaacctgatgcgatcaattgattttgat

SEQ ID NO: 218458 - DNA, 75 bp, Artificial Sequence
  Synthetic
caacaattctgtcagagtttgatcaaaaagggagatttgatcatcactagaggtgtaagcatctattgtgccacc

SEQ ID NO: 218459 - DNA, 75 bp, Artificial Sequence
  Synthetic
aaaagggagatttgatcatcactagaggtgtaagcatctattgtgccaccacatatgcaactaatggcataatta

SEQ ID NO: 218460 - DNA, 75 bp, Artificial Sequence
  Synthetic
tctgttgcatctagaatgtcaataacgccaagagtgtaagggaacatgtcttcctgagttttctggtaacttata

SEQ ID NO: 218461 - DNA, 75 bp, Artificial Sequence
  Synthetic
tccttggcccatgtcaagtattgaactaatatgagagggcactacaccgatttggaaattggagtaaaagaaatc

SEQ ID NO: 218462 - DNA, 75 bp, Artificial Sequence
  Synthetic
actttgtattcataatcctgcttgttgagaaggtactttccctttcttgagaagacttcagtgagctgcgacacg

SEQ ID NO: 218463 - DNA, 75 bp, Artificial Sequence
  Synthetic
taagagacatgtgccatggagacatttaatttcatggaaagaatagcattttcaaactctttttcgttgttcaaa

SEQ ID NO: 218464 - DNA, 75 bp, Artificial Sequence
  Synthetic
attcagctttaatcaacctaatgtaaaacttatttgatacaatctcatctagatcatttattgatggctgaccat

SEQ ID NO: 218465 - DNA, 75 bp, Artificial Sequence
  Synthetic
ttctatgaagacctcttcgactgtgaagataaggcagaatgaacatggagcagctaggtaccaagtggtaaggtg

SEQ ID NO: 218466 - DNA, 75 bp, Artificial Sequence
  Synthetic
attcagaaaagatctccaacattgcatctgttcactttgagagtcagcagccctctcttcaccagaatctaagtc

SEQ ID NO: 218467 - DNA, 75 bp, Artificial Sequence
  Synthetic
gtgactcttgactataaaaacacaagttcttcaacattgctgtggtgcagttagtcagtgatagagctttactaa

SEQ ID NO: 218468 - DNA, 75 bp, Artificial Sequence
  Synthetic
gtccagatcccagaaccagattgctcattgcctgctgtactttgtattcatagtcctgcttgttgagaaggtact

SEQ ID NO: 218469 - DNA, 75 bp, Artificial Sequence
  Synthetic
ttagtcagtgatagagctttactaagtgcctctgagttactctctctctcactaatcctcgcatcatcagaaagt

SEQ ID NO: 218470 - DNA, 75 bp, Artificial Sequence
  Synthetic
gactttttgacttataatgagtgtacttgcccatgagtgcatttgcattcataatcaaaagtatagacttaaaac

SEQ ID NO: 218471 - DNA, 75 bp, Artificial Sequence
  Synthetic
aaggcagcaacacagccgagcgcaccctcaaccgaggcgacccagaacacaacaccaccaccatacaccccgtga

SEQ ID NO: 218472 - DNA, 75 bp, Artificial Sequence
  Synthetic
tgttcgtgttgacactgcctttgttaattccccaataggacattgtgacatatgtccacagtagaaatacttctc

SEQ ID NO: 218473 - DNA, 75 bp, Artificial Sequence
  Synthetic
cacaaagtcttgaatactcagactcttcaaacaatgcattactttcttgtgaatattttaacagggtgaataagg

SEQ ID NO: 218474 - DNA, 75 bp, Artificial Sequence
  Synthetic
tcacatgaccaaatctcacttttggttccagaaacttttcaaaacattttatctgatctgtcagtctatctggtg

SEQ ID NO: 218475 - DNA, 75 bp, Artificial Sequence
  Synthetic
tcattagagcctgagcccattttaacaggttccctatattgatcaacaatcttttcaacagtctccttcagttga

SEQ ID NO: 218476 - DNA, 75 bp, Artificial Sequence
  Synthetic
caggttccctatattgatcaacaatcttttcaacagtctccttcagttgattgaaataggtgctagcacctccat

SEQ ID NO: 218477 - DNA, 75 bp, Artificial Sequence
  Synthetic
gcacctcgagtgaaggtagaagatagcttattctgaatagtcttaacaatagtgggtatcttctcatcatctagg

SEQ ID NO: 218478 - DNA, 75 bp, Artificial Sequence
  Synthetic
ctcaaagtgttatgcagttaacaatgatgcggttggtgaggtctgctcattttatgctgacccaaaaagatactt

SEQ ID NO: 218479 - DNA, 75 bp, Artificial Sequence
  Synthetic
tctgttgcatctagaatgtcaacaacgccaagagtataagggaacatgtcttcttgagctctttgataacttata

SEQ ID NO: 218480 - DNA, 75 bp, Artificial Sequence
  Synthetic
ttagatcctagaactaagttgctcatcgcctgttgcaccttatactcataatcctgtttgttgagaaggtgcttc

SEQ ID NO: 218481 - DNA, 75 bp, Artificial Sequence
  Synthetic
tcgcctgttgcaccttatactcataatcctgtttgttgagaaggtgcttccccttccttgagaaaacttcagtga

SEQ ID NO: 218482 - DNA, 75 bp, Artificial Sequence
  Synthetic
cccttccttgagaaaacttcagtgagctgtgatacagccaatgctgtgagcttgttgaagtcatagttcaatact

SEQ ID NO: 218483 - DNA, 75 bp, Artificial Sequence
  Synthetic
acaatcaaggatctttaaatcaattccataagagttgatttctatgccaacctcccttagagcattagtagctcg

SEQ ID NO: 218484 - DNA, 75 bp, Artificial Sequence
  Synthetic
cagctgaaaatattgctggaaaatatcttttaggatcagcataaaatgagcacacctcaccaactttgttatcat

SEQ ID NO: 218485 - DNA, 75 bp, Artificial Sequence
  Synthetic
cctcccttagagcattagtagctcgggttaaaactctgttgatgatggcaaggagctcacaattccgatcttctt

SEQ ID NO: 218486 - DNA, 75 bp, Artificial Sequence
  Synthetic
cgacaacactcttattgctagctaaatctaaagcagtagcacagccactagtgataagggggtctttgatctcct

SEQ ID NO: 218487 - DNA, 75 bp, Artificial Sequence
  Synthetic
ttttcattatctgcaaggtattttgagataagatctttagcattggcaatgtcttcctccatcgccgattatggc

SEQ ID NO: 218488 - DNA, 75 bp, Artificial Sequence
  Synthetic
tgacacggctagtgctgtgagcttattgaaatcatagtttaatattctagaaccatctgtgtatttgttgacgac

SEQ ID NO: 218489 - DNA, 75 bp, Artificial Sequence
  Synthetic
cgagccattgttgaaagaagatgtaagaagggacaagtatttctttgagacaccaggctttttgtagcttggccc

SEQ ID NO: 218490 - DNA, 75 bp, Artificial Sequence
  Synthetic
tttggcgctcgtgcacccgtctttactcaaaaacttttttgcattgtagaccatgtcatccagttcttcctccgt

SEQ ID NO: 218491 - DNA, 75 bp, Artificial Sequence
  Synthetic
tcatagaagaagtgatgaacattgtcctgattgccctcagccttctggcaattttgaaagggatctacaatgttg

SEQ ID NO: 218492 - DNA, 75 bp, Artificial Sequence
  Synthetic
ggctgtatctgcaggattgatgcttacgtggccaaatttcacttttggctcaagaaacttctcaaagcattttat

SEQ ID NO: 218493 - DNA, 75 bp, Artificial Sequence
  Synthetic
ccccttcctcaccatgacccaaatctgcatacaagaacctaaggaccggagaggctcttcggaactggaatgcta

SEQ ID NO: 218494 - DNA, 75 bp, Artificial Sequence
  Synthetic
agttgagctttgatgaaagacttcatcatagctgtcaccacattaaaaggtatttccaccattttatgcatgtgc

SEQ ID NO: 218495 - DNA, 75 bp, Artificial Sequence
  Synthetic
gaatactcaaggtcagactcagatgggggttcaacatctaagagttcacagagattttttagtgaggtgaggtgc

SEQ ID NO: 218496 - DNA, 75 bp, Artificial Sequence
  Synthetic
actaaaagatcaattagttaatgtgaagtcattaacaaaaatgatacttattgtggtcttagctcaccctagcaa

SEQ ID NO: 218497 - DNA, 75 bp, Artificial Sequence
  Synthetic
cattatgaagtatctaaggttttggaggagtttttgtgaacgtttgctggggtgagctagaatcaaaattagaat

SEQ ID NO: 218498 - DNA, 75 bp, Artificial Sequence
  Synthetic
aggagtttttgtgaacgtttgctggggtgagctagaatcaaaattagaatcatctttgttaaagacctaattttg

SEQ ID NO: 218499 - DNA, 75 bp, Artificial Sequence
  Synthetic
gctttaatgagtatcatctcaaccttccacttatccattcctaactttaatcagtatgaagcaatgagttgtgac

SEQ ID NO: 218500 - DNA, 75 bp, Artificial Sequence
  Synthetic
atgctgtgagtttgttgaagtcatagttgagtactctagagccatcagtatacttgttcacaaccacacttttat

SEQ ID NO: 218501 - DNA, 75 bp, Artificial Sequence
  Synthetic
tgtccctgagtttgtcattcacccaatcaggtatctgttcattgtaaaatgttgtcctgccgtctatgagaggga

SEQ ID NO: 218502 - DNA, 75 bp, Artificial Sequence
  Synthetic
cagttacatagcacttgattccggaaaagggagctgggattgcataatgacttcctaccaatatttgataatcca

SEQ ID NO: 218503 - DNA, 75 bp, Artificial Sequence
  Synthetic
cctttaaagcattagtggctcgagttaaaactctgttgatgatggtaaggagctcacaattccgttcttctttag

SEQ ID NO: 218504 - DNA, 75 bp, Artificial Sequence
  Synthetic
tgacaatatgcttctttacatctcaccacttggtatcttgctggtccaaactcattctgtctcagcttcacagta

SEQ ID NO: 218505 - DNA, 75 bp, Artificial Sequence
  Synthetic
cagttttctcgcccatcccccatcggttatctggggctgctgtcacaaaggaccagggacatttacatcagtcga

SEQ ID NO: 218506 - DNA, 75 bp, Artificial Sequence
  Synthetic
ctctaagtcagtagtctccaacagatccacatcccccatgatataaggaaacgcttcttcctctgatctctgata

SEQ ID NO: 218507 - DNA, 75 bp, Artificial Sequence
  Synthetic
agatggatgctgattgaagccgaattgaagtgctttgggaacacagcagttgcgaaatgcaatgagaaacatgat

SEQ ID NO: 218508 - DNA, 75 bp, Artificial Sequence
  Synthetic
tgaagtgctttgggaacacagcagttgcgaaatgcaatgagaaacatgatgaggagttttgtgacatgttaagat

SEQ ID NO: 218509 - DNA, 75 bp, Artificial Sequence
  Synthetic
acatcgaagtccataatcaagtcataaccgtcggggcaaatcacttccatatcaatcttatagtggtccacacta

SEQ ID NO: 218510 - DNA, 75 bp, Artificial Sequence
  Synthetic
tgtttgactttaacaaacaagctataaggaggctgaagacagaagcacagatgagtatccaactgataaacaaag

SEQ ID NO: 218511 - DNA, 75 bp, Artificial Sequence
  Synthetic
aaggaggctgaagacagaagcacagatgagtatccaactgataaacaaagcagtgaacgcactgatcaatgacca

SEQ ID NO: 218512 - DNA, 75 bp, Artificial Sequence
  Synthetic
aattgataaattaaaggaaaaattaatcacagagactgaatttttgctatttaggctcctaaggtctttgttgaa

SEQ ID NO: 218513 - DNA, 75 bp, Artificial Sequence
  Synthetic
acctgtattgggtttaggcctgtgcctgtatggcttgcaagccagtcagtgatgccccacaaaagctcctataga

SEQ ID NO: 218514 - DNA, 75 bp, Artificial Sequence
  Synthetic
gtggtattaaattgatatcgacactcttcaagtcttctttcagctgctccaattttttgaagtcctcaatgtatt

SEQ ID NO: 218515 - DNA, 75 bp, Artificial Sequence
  Synthetic
ccgctcaacccatttctttagatccctttttgttgactccaaagaaactaacctgtcattaacactcacaaaaca

SEQ ID NO: 218516 - DNA, 75 bp, Artificial Sequence
  Synthetic
ctttttgttgactccaaagaaactaacctgtcattaacactcacaaaacaggttcctagccaacctcttaaaggc

SEQ ID NO: 218517 - DNA, 75 bp, Artificial Sequence
  Synthetic
attacagcaagtattggtatttaaatcacactgtaacagggaagacatcgttgccaagatgctggcttgtgtcaa

SEQ ID NO: 218518 - DNA, 75 bp, Artificial Sequence
  Synthetic
tttttctgatgacattgaacaacaagcagacaacatgataacagaactgttgcagaaggagtacatggacaggca

SEQ ID NO: 218519 - DNA, 75 bp, Artificial Sequence
  Synthetic
tccatgttttgctgcaggtatgatggtcagggccctcaaaacatgtggtctgctagagcaacgattgactataga

SEQ ID NO: 218520 - DNA, 75 bp, Artificial Sequence
  Synthetic
aattaataaaagtttcctccttgtgttcagtatcctcatagacttcaccttgtttaggaatgacctccagcattg

SEQ ID NO: 218521 - DNA, 75 bp, Artificial Sequence
  Synthetic
aggagtcaaaattccatggtcatggagaattctttccacagatttgtcctcactgttatgttcacaaccatttgc

SEQ ID NO: 218522 - DNA, 75 bp, Artificial Sequence
  Synthetic
atagacctaatcttactgcaagcgtcaggaatcaacccctctatttgcctcataattctataactacggttgcca

SEQ ID NO: 218523 - DNA, 75 bp, Artificial Sequence
  Synthetic
cttgcacctccatcaagcaaaatttcgtctaggtcagcttcatcagcatcacttttgtgctgtccagatcctagt

SEQ ID NO: 218524 - DNA, 75 bp, Artificial Sequence
  Synthetic
agggacaggagtttcaacccttccattaatagcatcctgggctctgtctgcacaagaaatgccaacttctgtctt

SEQ ID NO: 218525 - DNA, 75 bp, Artificial Sequence
  Synthetic
taatatttgcatacaaaaatctcagtattggtgatgctctcttaaattgatgaatcaagtgttcaacactgtctt

SEQ ID NO: 218526 - DNA, 75 bp, Artificial Sequence
  Synthetic
atcctctaacaacttcatcttatcagtcttaacaaattgactttctatgttcccttgccttagtttgttcctgaa

SEQ ID NO: 218527 - DNA, 75 bp, Artificial Sequence
  Synthetic
atgggacaaatagtgactttcttccaggaagtgcctcatgtgatagaggaggtgatgaacattgtgctcatcgca

SEQ ID NO: 218528 - DNA, 75 bp, Artificial Sequence
  Synthetic
tgaatcaagtgttcaacactgtctttctcagccaccttatcagcgtacaaattgttgaactcattaagtaactga

SEQ ID NO: 218529 - DNA, 75 bp, Artificial Sequence
  Synthetic
gtctgtacaatgttgcaacatgtggcctcattggtctggtcaccttccttttactgtgtggtagatcctgcacaa

SEQ ID NO: 218530 - DNA, 75 bp, Artificial Sequence
  Synthetic
ctttgtattcatagtcctgtttgttgagaagatactttccctttcttgagaagacttcagtgagctgcgacacgg

SEQ ID NO: 218531 - DNA, 75 bp, Artificial Sequence
  Synthetic
tctcagccaccttatcagcgtacaaattgttgaactcattaagtaactgattcttttcaacctttaaaaactgac

SEQ ID NO: 218532 - DNA, 75 bp, Artificial Sequence
  Synthetic
ggatcagcataaaaggaacaaacctctccaactacattgttgttaatagcataacactttgagcattcacctgtc

SEQ ID NO: 218533 - DNA, 75 bp, Artificial Sequence
  Synthetic
tcaatttgtaacttcacttcatgagctgtcagcttgttgttgatgccttggtggcatgaagcaatcacttcctca

SEQ ID NO: 218534 - DNA, 75 bp, Artificial Sequence
  Synthetic
agctcactttaagacaaggtcccgtaggaggcacagaagtaacaagaggtaattaaagacaattaaattagatag

SEQ ID NO: 218535 - DNA, 75 bp, Artificial Sequence
  Synthetic
gtgatgaaatggcacatgtaagaaatattcaaaataaacttaaatctattagtcatcatgctcttcacatcctca

SEQ ID NO: 218536 - DNA, 75 bp, Artificial Sequence
  Synthetic
tctttgatttccctttttacttccctttccttaaatagtgaaccattattgaaagaggacgtaagaagggataaa

SEQ ID NO: 218537 - DNA, 75 bp, Artificial Sequence
  Synthetic
tgggcttcatcaagccatgggacaaattataacattcttccaggaagtacctcatgtcatagaggaagtgatgaa

SEQ ID NO: 218538 - DNA, 75 bp, Artificial Sequence
  Synthetic
tggtatctagagggtccaaattcattttgccttagtttcactgtggaagacgttttcattgagttgatcaaagcc

SEQ ID NO: 218539 - DNA, 75 bp, Artificial Sequence
  Synthetic
tttgcattgtagaccatgtcgtcaagttcttcctctgtggcagtatctgcaggattagtgctcacatgaccaaat

SEQ ID NO: 218540 - DNA, 75 bp, Artificial Sequence
  Synthetic
agtgtatccctcagcttatcattaacccaatcaggtatttgctcattataaaatgatgtcctcccatctataagt

SEQ ID NO: 218541 - DNA, 75 bp, Artificial Sequence
  Synthetic
tcatttcataactaaagaaactccagacagattaacagcccaaattaagtgcttcgaaaagtttcttgagccaaa

SEQ ID NO: 218542 - DNA, 75 bp, Artificial Sequence
  Synthetic
aatatcttttaggatcagcataaaatgagcacacctcaccaactttgttatcattaatagcatagcacttcgagc

SEQ ID NO: 218543 - DNA, 75 bp, Artificial Sequence
  Synthetic
tgtgttggaattgggcctgtgcctgtatggcttgtgagtcagctgaaggtgccccacagaagctcctacagaaat

SEQ ID NO: 218544 - DNA, 75 bp, Artificial Sequence
  Synthetic
aattctttcaacagacttgtcttcactattgtgctcacagccatttgcattacaagaatcaacctcaatgcaaag

SEQ ID NO: 218545 - DNA, 75 bp, Artificial Sequence
  Synthetic
ctatccaccgtttcagatctctttttgttgattccaatgaaactaatctatcgttaacactcacaaaacaggagc

SEQ ID NO: 218546 - DNA, 75 bp, Artificial Sequence
  Synthetic
ggacagaagtttcaatccttccattaaaagcatcctgggttccgtttgcacaagaaatgccaatttctgccttga

SEQ ID NO: 218547 - DNA, 75 bp, Artificial Sequence
  Synthetic
acaatgttgctacctgtggcctctttgggctggtgtcctttctcctcttatgtgggagatcatgttcaacaattt

SEQ ID NO: 218548 - DNA, 75 bp, Artificial Sequence
  Synthetic
ttgtaaaacctcagctgaaaatattgctggaaaatatcttttaggatcagcataaaatgagcacacctcaccaac

SEQ ID NO: 218549 - DNA, 75 bp, Artificial Sequence
  Synthetic
agacagatcttgtaaagtatgttctcataagggttcctctcaccaggtgtatctgaaacaaacattcccaaggat

SEQ ID NO: 218550 - DNA, 75 bp, Artificial Sequence
  Synthetic
ttcactatgggacagggtcccataggagatgcaagagacacagctggttaattaaagacaattaaattggatatc

SEQ ID NO: 218551 - DNA, 75 bp, Artificial Sequence
  Synthetic
ttttttacctttaaaatagacttcaagatgccatccattgtctgaggtgtaaccttgatggtctccaacatgttc

SEQ ID NO: 218552 - DNA, 75 bp, Artificial Sequence
  Synthetic
aatgctggcttgtatctaatggttcatatctaaacgagacccacttttctgatgacattgaacagcaagccgaca

SEQ ID NO: 218553 - DNA, 75 bp, Artificial Sequence
  Synthetic
tgcaaaaaagtttttaagtaaagagggatgcactagtgccaataagctaaattataagagacccggtgtgtcgaa

SEQ ID NO: 218554 - DNA, 75 bp, Artificial Sequence
  Synthetic
tcctgtggactctacaaacaacctggtgtacctgtgagatggaagagataagacccccgtcggggcccccgtgac

SEQ ID NO: 218555 - DNA, 75 bp, Artificial Sequence
  Synthetic
tccaaattcattctgtctcaactttacggtcgatgaggttttcatggagtttaccaaagcaaggctcaatgaaga

SEQ ID NO: 218556 - DNA, 75 bp, Artificial Sequence
  Synthetic
aaacctgccaataacacttttaggactcacaaatttattgagttgatcactcatataataatgaaactctattaa

SEQ ID NO: 218557 - DNA, 75 bp, Artificial Sequence
  Synthetic
tgattcttactcaaacactgggaggactgtgtgattctagatcttagcctgttgcctcgctctccccatttctcg

SEQ ID NO: 218558 - DNA, 75 bp, Artificial Sequence
  Synthetic
tagtggcctttctgttctgatgaccttcgactttagtttctctaagtcagctgccaatgtcagcaggtcatctga

SEQ ID NO: 218559 - DNA, 75 bp, Artificial Sequence
  Synthetic
ctgccaatgtcagcaggtcatctgaggtcaaggtcccaactctcaagatactcttttgttgtgttgatttgagtt

SEQ ID NO: 218560 - DNA, 75 bp, Artificial Sequence
  Synthetic
aggtcatgcttacttgcaaggagaattagtgcatcaaaaattaatagaagtttcctccttgtgttcaatatcctc

SEQ ID NO: 218561 - DNA, 75 bp, Artificial Sequence
  Synthetic
ctcttttgttgtgttgatttgagttctacaagattgttgacagcctgattcagatctctgagacgtttcagatca

SEQ ID NO: 218562 - DNA, 75 bp, Artificial Sequence
  Synthetic
tgcgaggaagggcttcaatgactgcactggtcaaaccaggttgagcagggaaaagatctgccacatcaatcccat

SEQ ID NO: 218563 - DNA, 75 bp, Artificial Sequence
  Synthetic
aacagcactggtcaaacctggctgtgcagcgaagaggtctgtgacatcaattccatgtgaatacttagcatcttg

SEQ ID NO: 218564 - DNA, 75 bp, Artificial Sequence
  Synthetic
ataaaaatcttaatattggtgatgctctcttgaactgatagattaaatgttcaatgtcatcctctgcagctactt

SEQ ID NO: 218565 - DNA, 75 bp, Artificial Sequence
  Synthetic
gtaagcccggcggtgaatcctgccgactgcagggacttattggaattattgctcccagttttctgtggcttccca

SEQ ID NO: 218566 - DNA, 75 bp, Artificial Sequence
  Synthetic
aagcactcatcttgatctggatacttttgaggtttactgattgaaagtattactcagtaagtcagtgaaaagcgc

SEQ ID NO: 218567 - DNA, 75 bp, Artificial Sequence
  Synthetic
gcacctgtatagggtttgggtttatgctggaatggcctgtggttcaattgatggtgccccacagaagatcctata

SEQ ID NO: 218568 - DNA, 75 bp, Artificial Sequence
  Synthetic
gatcctaggcaatttagctagacttcagtggtaaggctcatttttagtgaatccctgaatcaagtgcccagccga

SEQ ID NO: 218569 - DNA, 75 bp, Artificial Sequence
  Synthetic
actgaccttctatctctcctttcctcaatctgttcctaaacacttgatactcctcttcgatctgcagctttacct

SEQ ID NO: 218570 - DNA, 75 bp, Artificial Sequence
  Synthetic
aaaggatcccattgttacaagtggttgtgcaacagctctggatttggccagtaacaagagtgtggtcatcaataa

SEQ ID NO: 218571 - DNA, 75 bp, Artificial Sequence
  Synthetic
tgcaggctcctgccttcacagctgcgcccaagctaaaattgtaacctgagatgttcagggagctttttttggtgt

SEQ ID NO: 218572 - DNA, 75 bp, Artificial Sequence
  Synthetic
tcctcataatgattagagcgattgtccatcagaacatttaaactctccacccctgataatctacccgaagtcatg

SEQ ID NO: 218573 - DNA, 75 bp, Artificial Sequence
  Synthetic
ctgctatactctgattcttcaaaaagtgaattactctcctgagcatattttagaagtgagaagagcgtatccctc

SEQ ID NO: 218574 - DNA, 75 bp, Artificial Sequence
  Synthetic
tttgttcattgtagaacgatgttctcccgtctataagtggtattaaattgatatcgacactccttaaatcttctt

SEQ ID NO: 218575 - DNA, 75 bp, Artificial Sequence
  Synthetic
ggagctgactttaacaaatacaagcatcatcaaccacaagttttgtaacctttctgatgcacataaaaagaatct

SEQ ID NO: 218576 - DNA, 75 bp, Artificial Sequence
  Synthetic
gcaggagatgatctgacaaagcactccagtaatattaggacattgcccgtcagtttgtaaccgtccggtaccaca

SEQ ID NO: 218577 - DNA, 75 bp, Artificial Sequence
  Synthetic
gaagcactcatcctggtctgaagactcagggacttgctggttgaaagtgtcactcagtaagtcaatgaaaagcgc

SEQ ID NO: 218578 - DNA, 75 bp, Artificial Sequence
  Synthetic
tggcactcactggttgaaagtatcactcagtaagtcaatgaaaagcgcaatccaatagcctaggatccactgtgc

SEQ ID NO: 218579 - DNA, 75 bp, Artificial Sequence
  Synthetic
cattggctgtcacacagttaactgaggttttctctcgaaaggggaagtttttgctcaacaaacaagactatgagt

SEQ ID NO: 218580 - DNA, 75 bp, Artificial Sequence
  Synthetic
ccggggatcctaggcaatttaactgtacttcagtggtaaagcttttctagtgaatccctgaatcaaagtgtgcag

SEQ ID NO: 218581 - DNA, 75 bp, Artificial Sequence
  Synthetic
ccggggatcctaggcaattcagttggacttcagtggtgaggctcttcttagtgaatccctgaattaaaggaccca

SEQ ID NO: 218582 - DNA, 75 bp, Artificial Sequence
  Synthetic
acaaccactccagtatgcatatggcatagatctttgcactgatcccaaacagcattttcaaatctcctagagtca

SEQ ID NO: 218583 - DNA, 75 bp, Artificial Sequence
  Synthetic
ccatgtttgactgcaggtatgatgatcgaaaccctcagggcatatggtctgccagaacaacagttcactatagga

SEQ ID NO: 218584 - DNA, 75 bp, Artificial Sequence
  Synthetic
gccagaacaacagttcactataggacaaaatcctgtaaaaggcacagaagaaacaaaaggcaattaaagacaatt

SEQ ID NO: 218585 - DNA, 75 bp, Artificial Sequence
  Synthetic
ggttttctctcgaaaggggaagtttttgctcaacaaacaagactatgagtacaaaattcagcaggcaatgagtag

SEQ ID NO: 218586 - DNA, 75 bp, Artificial Sequence
  Synthetic
agccggagcagcagacatcaccagacccccaccctacagtccctgaacctgccatcgacccccaccacctccacc

SEQ ID NO: 218587 - DNA, 75 bp, Artificial Sequence
  Synthetic
gagccaaccacctccaagaaactattcaatgtcctcgatgcattcatccttcgcagttaactcctcacatgttct

SEQ ID NO: 218588 - DNA, 75 bp, Artificial Sequence
  Synthetic
gtgccaaccacctccaagaaactattcaatgtcctcgatgcattcatccttcgcagttaactcctcacatgttct

SEQ ID NO: 218589 - DNA, 75 bp, Artificial Sequence
  Synthetic
gcgccaaccacctccaagaaactattcaatgtcctcgatgcattcatccttcgcagttaactcctcacatgttct

SEQ ID NO: 218590 - DNA, 75 bp, Artificial Sequence
  Synthetic
gggccaaccacctccaagaaactattcaatgtcctcgatgcattcatccttcgcagttaactcctcacatgttct

SEQ ID NO: 218591 - DNA, 75 bp, Artificial Sequence
  Synthetic
tgtgtctcaactgtctcagtctgctcctcagcgttagcagtagatgcccgatttgcaagatgcccctccccacca

SEQ ID NO: 218592 - DNA, 75 bp, Artificial Sequence
  Synthetic
atgtctatccaggttttggcacttgggtcaagttgcatcattgagtctttaagtgtcatcaactgagaataggtc

SEQ ID NO: 218593 - DNA, 75 bp, Artificial Sequence
  Synthetic
gcagatagtctcagttctttgttgcgtgcatacaacacaacaatctggcgatgagtgcctcaaaggaaataaaat

SEQ ID NO: 218594 - DNA, 75 bp, Artificial Sequence
  Synthetic
cgcacagtggatcctaggctattggattgcgctttgcttttgtcattttggcagatagtctcagttctttgttgc

SEQ ID NO: 218595 - DNA, 75 bp, Artificial Sequence
  Synthetic
accggggatcctaggcaatttggttgttcttctcttttgaggcctcttttaggcctttcttaaactctttgtgct

SEQ ID NO: 218596 - DNA, 75 bp, Artificial Sequence
  Synthetic
gtgcatacaacacaacaatctggcgatgagtgcctcaaaggaaataaaatcctttttgtggacacaatctttgag

SEQ ID NO: 218597 - DNA, 75 bp, Artificial Sequence
  Synthetic
catacaaccaatggcactggttcattgtcaggtccgaccttggagaaatcaaactcactgaactgcagtttatct

SEQ ID NO: 218598 - DNA, 75 bp, Artificial Sequence
  Synthetic
atgcccaggctcttttacatggacttgacttctccgaagtcagtaatgttcaacggttgatgcgcaaggagagaa

SEQ ID NO: 218599 - DNA, 75 bp, Artificial Sequence
  Synthetic
tgacttctccgaagtcagtaatgttcaacggttgatgcgcaaggagagaagggatgacaatgatttgaaacggtt

SEQ ID NO: 218600 - DNA, 75 bp, Artificial Sequence
  Synthetic
tcaatgaccagctgatcatgaagaatcatttgagagatatcatgggaattccttactgcaattacagcaagtatt

SEQ ID NO: 218601 - DNA, 75 bp, Artificial Sequence
  Synthetic
aacaaaagagtatactgagagttgggactctaacctcagatgacttattaatcttagccgctgatctagagaagt

SEQ ID NO: 218602 - DNA, 75 bp, Artificial Sequence
  Synthetic
gactctaacctcagatgacttattaatcttagccgctgatctagagaagttaaagtcaaaggtgatcagaacaga

SEQ ID NO: 218603 - DNA, 75 bp, Artificial Sequence
  Synthetic
ggggcccccccgggggagccaaccacctccaaaaactactcaatgtcctcaacatgttcgtccccctcagtcaac

SEQ ID NO: 218604 - DNA, 75 bp, Artificial Sequence
  Synthetic
ttgaccaaagaagagctctcctgaatatgataggaatgagtggtggtaatcaaggggctcgggctgggagagatg

SEQ ID NO: 218605 - DNA, 75 bp, Artificial Sequence
  Synthetic
tatgataggaatgagtggtggtaatcaaggggctcgggctgggagagatggagtggtgagagtttgggatgtgaa

SEQ ID NO: 218606 - DNA, 75 bp, Artificial Sequence
  Synthetic
aacccacagacatgtcatagggaaaccctgccctaaaccacacagactcaaccacatgggcatatgctcatgtgg

SEQ ID NO: 218607 - DNA, 75 bp, Artificial Sequence
  Synthetic
agcatcaatatattttgatcagttaagagagacagttgagaaaattgtggaacagtacaaggaaccggcaaaaca

SEQ ID NO: 218608 - DNA, 75 bp, Artificial Sequence
  Synthetic
tggcatgtctgacaaaacaggggcaggttgacttgaatgatgcagtacaagcattgacagatttgggtttgatct

SEQ ID NO: 218609 - DNA, 75 bp, Artificial Sequence
  Synthetic
ggttgacttgaatgatgcagtacaagcattgacagatttgggtttgatctacacagcaaagtatcccaacacttc

SEQ ID NO: 218610 - DNA, 75 bp, Artificial Sequence
  Synthetic
aggtacaacatcccctaactgctgtgtatcctttaggaactcatttaccacatctgaatcaacaaaccaggctga

SEQ ID NO: 218611 - DNA, 75 bp, Artificial Sequence
  Synthetic
gggggcgtccatttacaggacgactctaggtgttgatgttctgaacaccatatctctgggcagcactgctctcaa

SEQ ID NO: 218612 - DNA, 75 bp, Artificial Sequence
  Synthetic
ccaagaaaagctctttgaatatctcaggttataattttagcttgggtgcagctgtgaaggcaggagcttgcatgc

SEQ ID NO: 218613 - DNA, 75 bp, Artificial Sequence
  Synthetic
aggttataattttagcttgggtgcagctgtgaaggcaggagcttgcatgctggatggtggcaatatgttggagac

SEQ ID NO: 218614 - DNA, 75 bp, Artificial Sequence
  Synthetic
tgatcctgtataacaggtgtgaaagatgccaatttcttttcacattcccacaggcctcccctacgcacaactaga

SEQ ID NO: 218615 - DNA, 75 bp, Artificial Sequence
  Synthetic
aggtcaagaaggctcttggaatgttcatttcagacacccctggtgaaaggaatccttatgaaaacatactctaca

SEQ ID NO: 218616 - DNA, 75 bp, Artificial Sequence
  Synthetic
ataaacgtctcaaagaatgaatgatgtggctcatgccaaccctgtcctctagcagtttcgaaacagtgggtctca

SEQ ID NO: 218617 - DNA, 75 bp, Artificial Sequence
  Synthetic
catttcagacacccctggtgaaaggaatccttatgaaaacatactctacaagatttgtttgtcaggagatggatg

SEQ ID NO: 218618 - DNA, 75 bp, Artificial Sequence
  Synthetic
ctgtcgttgatctggaatcagatgggaagccacagaaagctgacagcaacaattccagtaaatccctgcagtcgg

SEQ ID NO: 218619 - DNA, 75 bp, Artificial Sequence
  Synthetic
gtccgacaagacacatgggctcactgcaccagagtacatggcagtcacatcatgcactaaatatttggcctgttg

SEQ ID NO: 218620 - DNA, 75 bp, Artificial Sequence
  Synthetic
gaagccacagaaagctgacagcaacaattccagtaaatccctgcagtcggcagggtttaccgctgggcttaccta

SEQ ID NO: 218621 - DNA, 75 bp, Artificial Sequence
  Synthetic
gcgcaccggggatcctaggcaatttggttggactttagtggtaagacttattttagtgaattcctaatttaaagt

SEQ ID NO: 218622 - DNA, 75 bp, Artificial Sequence
  Synthetic
ctaagacctggatggacattgaaggaagacctgaagatccagtggaaattgccctctatcaaccaagttcaggct

SEQ ID NO: 218623 - DNA, 75 bp, Artificial Sequence
  Synthetic
aagacctgaagatccagtggaaattgccctctatcaaccaagttcaggctgctacatacacttcttccgtgaacc

SEQ ID NO: 218624 - DNA, 75 bp, Artificial Sequence
  Synthetic
cggggatcctaggcaattcagttggacttcagtggcaaggctcattttagtgaattcctgaatcaaagtactaag

SEQ ID NO: 218625 - DNA, 75 bp, Artificial Sequence
  Synthetic
atgtcacagacctcttcgctacacaaccgggcttgaccagtgctgtcattgatgcactcccccggaatatggtca

SEQ ID NO: 218626 - DNA, 75 bp, Artificial Sequence
  Synthetic
accgggcttgaccagtgctgtcattgatgcactcccccggaatatggtcattacctgtcaggggtccgatgacat

SEQ ID NO: 218627 - DNA, 75 bp, Artificial Sequence
  Synthetic
aagactaattaaaggagaactctcacaccacatgattgaagactttgatcatgagatcttaccagagggtttcta

SEQ ID NO: 218628 - DNA, 75 bp, Artificial Sequence
  Synthetic
ttgccctcagcaaaactgattccaggaagtatgaaaatgcagtctgggaccagtataaagacttatgccacatgc

SEQ ID NO: 218629 - DNA, 75 bp, Artificial Sequence
  Synthetic
gaagtatgaaaatgcagtctgggaccagtataaagacttatgccacatgcacacaggtgtcgttgttgaaaagaa

SEQ ID NO: 218630 - DNA, 75 bp, Artificial Sequence
  Synthetic
agctaaaggcagcagcacagccgagtgcaccttcagccgaggcgatccagaacacaacgcctccaccatacaccc

SEQ ID NO: 218631 - DNA, 75 bp, Artificial Sequence
  Synthetic
tagtgtgagaaaaccttaattcagatgataacacaatgtaatgctcctctcttttccattttactatgtgtgaaa

SEQ ID NO: 218632 - DNA, 75 bp, Artificial Sequence
  Synthetic
gcatcatgtttgatgcagcagtgtcaggaggactgaacacatcggttttgagagcagtgctgcccagagatatgg

SEQ ID NO: 218633 - DNA, 75 bp, Artificial Sequence
  Synthetic
aggaggactgaacacatcggttttgagagcagtgctgcccagagatatggtgttcagaacatcgacacctagagt

SEQ ID NO: 218634 - DNA, 75 bp, Artificial Sequence
  Synthetic
aattttatcctgggtgaccacttcattttggttgatgctaaatcgctcatgaatggtaatatgtgtttctcaaac

SEQ ID NO: 218635 - DNA, 75 bp, Artificial Sequence
  Synthetic
acgggggccctgacaagggtctcatctcttccatttcacaggcacaccaggctgtttgtagagtccacaggaaca

SEQ ID NO: 218636 - DNA, 75 bp, Artificial Sequence
  Synthetic
ctcttccatttcacaggcacaccaggctgtttgtagagtccacaggaacaaatgcccatatgattcaatctgtga

SEQ ID NO: 218637 - DNA, 75 bp, Artificial Sequence
  Synthetic
gggatcctaggcaatttggttgttctttctttttaagctttgtgcgctgaactcctccaaatgggaaacaagcaa

SEQ ID NO: 218638 - DNA, 75 bp, Artificial Sequence
  Synthetic
taggtgaaggaagatgctaataagatagaaacttgtactgaacacaaagaggtcaactagacccaatggtgtctt

SEQ ID NO: 218639 - DNA, 75 bp, Artificial Sequence
  Synthetic
tagaaacttgtactgaacacaaagaggtcaactagacccaatggtgtcttcccctgcctctccatatactccttc

SEQ ID NO: 218640 - DNA, 75 bp, Artificial Sequence
  Synthetic
gataggtagttggtagtgaactcttcatgaagctcaccagtttttaatttattgaacaatatcctaagcattgac

SEQ ID NO: 218641 - DNA, 75 bp, Artificial Sequence
  Synthetic
tctaagtcagctgccaatgtcagcaggtcatctgaggttaaggtcccaactctcaagacactcttttgttgtgtt

SEQ ID NO: 218642 - DNA, 75 bp, Artificial Sequence
  Synthetic
atttagctgatcactcatgtagtaatggaattctaacaatgttttgaattcctctgtatctcttgagagtaactc

SEQ ID NO: 218643 - DNA, 75 bp, Artificial Sequence
  Synthetic
aaagtgggtctcgttcaagtatgaaccatttgatacaagccaacatttgggcagtgatgttctcccagtagttgt

SEQ ID NO: 218644 - DNA, 75 bp, Artificial Sequence
  Synthetic
ccatttgatacaagccaacatttgggcagtgatgttctcccagtagttgtgtggttgaggtaccaatacttgctg

SEQ ID NO: 218645 - DNA, 75 bp, Artificial Sequence
  Synthetic
caatctcttacatcagtctcgcagtttaaaaggaatggatcaatgggatacttggcataacataacaaactcaaa

SEQ ID NO: 218646 - DNA, 75 bp, Artificial Sequence
  Synthetic
ttgtcctattggtgaactcacaaaagctgtagcaacaagaacatatcttgactgtgaatttttccagtgtttcaa

SEQ ID NO: 218647 - DNA, 75 bp, Artificial Sequence
  Synthetic
cttggcataacataacaaactcaaagtcctcttctgaatttgattacacagatcaactgggacaccattagccac

SEQ ID NO: 218648 - DNA, 75 bp, Artificial Sequence
  Synthetic
accccccggggggaccccccgccgggggcccccccgggggagccaaccatcaccaggagactactcaatgtcctc

SEQ ID NO: 218649 - DNA, 75 bp, Artificial Sequence
  Synthetic
aagttggtcatttatcaaagcatttactgctttgttgatcaactgaatgctcatttgtgcttcagctttcaacct

SEQ ID NO: 218650 - DNA, 75 bp, Artificial Sequence
  Synthetic
actgctttgttgatcaactgaatgctcatttgtgcttcagctttcaacctttgaatggcttgtttgttgaagtca

SEQ ID NO: 218651 - DNA, 75 bp, Artificial Sequence
  Synthetic
tgccacagctgtgttcccgaagcattttagttcagcctcaattagcatccacctggtcagacaatatccccctgg

SEQ ID NO: 218652 - DNA, 75 bp, Artificial Sequence
  Synthetic
tttagttcagcctcaattagcatccacctggtcagacaatatccccctggtgtgtctttaccttcagaatctgac

SEQ ID NO: 218653 - DNA, 75 bp, Artificial Sequence
  Synthetic
agtcctttgtgagaggagcccgagataaccgatgggagatggtctcgagaattggcagtgatcttcccaggttgt

SEQ ID NO: 218654 - DNA, 75 bp, Artificial Sequence
  Synthetic
taaccgatgggagatggtctcgagaattggcagtgatcttcccaggttgtattttggattatcagatattgataa

SEQ ID NO: 218655 - DNA, 75 bp, Artificial Sequence
  Synthetic
gctcccaccccaagccatcctcataaaagtctgtaacacaccatttgcaacagtaccacaatggttggctgcatc

SEQ ID NO: 218656 - DNA, 75 bp, Artificial Sequence
  Synthetic
aaagtctgtaacacaccatttgcaacagtaccacaatggttggctgcatccccagcatagctgtgactcaggttg

SEQ ID NO: 218657 - DNA, 75 bp, Artificial Sequence
  Synthetic
agcgcaccctcaaccgaggcgacccagaacacaacacctccaccgtacaccccatgatcccaggaccaacactct

SEQ ID NO: 218658 - DNA, 75 bp, Artificial Sequence
  Synthetic
catctttgtccttaaatctccgatgtacagttctctattgcctcccacttgttccttgtaagacaaagagaattt

SEQ ID NO: 218659 - DNA, 75 bp, Artificial Sequence
  Synthetic
ctgattgaagttggggatggacaagtggaaagttgagattatgctcataagagcgtggtcatagaggttcttttt

SEQ ID NO: 218660 - DNA, 75 bp, Artificial Sequence
  Synthetic
tggaaagttgagattatgctcataagagcgtggtcatagaggttctttttgtgggcatcagacagattgcaaaat

SEQ ID NO: 218661 - DNA, 75 bp, Artificial Sequence
  Synthetic
gtctgacaagacacacggactcactgcacctgagtacataacggttacatcatgtactaaatacttggcctgttg

SEQ ID NO: 218662 - DNA, 75 bp, Artificial Sequence
  Synthetic
gaactttattctaggtgaccatttcatctttgtggaagctaaatcactcataaatggcaatatgtgcttctcaaa

SEQ ID NO: 218663 - DNA, 75 bp, Artificial Sequence
  Synthetic
caaatttgacactaacaagctctctgatgatgtgagaattagtgaaagggagagcaattcggaagctcttagtaa

SEQ ID NO: 218664 - DNA, 75 bp, Artificial Sequence
  Synthetic
attgcccaccattatataatgatgactgttgttctttgtgcaggagagaggcatggtcatattgagtgtctccat

SEQ ID NO: 218665 - DNA, 75 bp, Artificial Sequence
  Synthetic
ctgttgttctttgtgcaggagagaggcatggtcatattgagtgtctccatgtttagttccagagtctgaagctca

SEQ ID NO: 218666 - DNA, 75 bp, Artificial Sequence
  Synthetic
gaaagtgaccaaaccaacaaggccacacgttgcaaaattgtacagacctttcagcactgctagtacagacagtgc

SEQ ID NO: 218667 - DNA, 75 bp, Artificial Sequence
  Synthetic
tctattacatgaggcacttcctggaagaatgtcactatttgtcccattttaaataggacacttgaattgcgcaac

SEQ ID NO: 218668 - DNA, 75 bp, Artificial Sequence
  Synthetic
ccttctatcagattcccacaatgctcccctacatacaaccaatggcactggttcgttgtcaggtccgaccttgga

SEQ ID NO: 218669 - DNA, 75 bp, Artificial Sequence
  Synthetic
agctgagtctgtatggatctaatgtaaagattctccttgttagggcctctgacgcacttgctacctagtgttctg

SEQ ID NO: 218670 - DNA, 75 bp, Artificial Sequence
  Synthetic
gacgcacttgctacctagtgttctgcacaaccccacaaacccagatgctatagaactttggaaagctgatttatt

SEQ ID NO: 218671 - DNA, 75 bp, Artificial Sequence
  Synthetic
tactgtgagacaacctcaattcagatgataacacaatgtaatgttcctctcttttccatttcactatatgtgaga

SEQ ID NO: 218672 - DNA, 75 bp, Artificial Sequence
  Synthetic
agaaatagaaatggacacatcattgggccccacttactatgatccatgctgtaagagacatgtgccatggaaaca

SEQ ID NO: 218673 - DNA, 75 bp, Artificial Sequence
  Synthetic
aggacacatgggctcacagacccagaatacaatgcctgtacatcattcactacaaactcaccacattgattaaca

SEQ ID NO: 218674 - DNA, 75 bp, Artificial Sequence
  Synthetic
ttacaactccactgggcctgatacaggaagactaaagttctctttatcttataaggagcaggttgggggcaacag

SEQ ID NO: 218675 - DNA, 75 bp, Artificial Sequence
  Synthetic
gtctagtgaacatctttgtcctaagatcaccaatgtataactctctgttgccgccaacttgttctttgtatgata

SEQ ID NO: 218676 - DNA, 75 bp, Artificial Sequence
  Synthetic
atcaaagtcttcaaccatgtgattggataactcacctttaatcagcctaatgtaaaacttatttgaaacaatttc

SEQ ID NO: 218677 - DNA, 75 bp, Artificial Sequence
  Synthetic
ccaatattgaatgccattagaatttgtcaacaatttgattcccttgacatcagaaatcagagactgaatggactt

SEQ ID NO: 218678 - DNA, 75 bp, Artificial Sequence
  Synthetic
tatacctaactttttccgcatctgcacaacattctttacttagaaactttcttgcattataaaccatttcagcaa

SEQ ID NO: 218679 - DNA, 75 bp, Artificial Sequence
  Synthetic
tggacattgctgacctcagagaaatcaagtccatgcaaaagggcttgggcatctttcactacctgtagtttgata

SEQ ID NO: 218680 - DNA, 75 bp, Artificial Sequence
  Synthetic
tcaatcaaatccttgtgataaaagtcagacacaaaggccatcacaaaatacctaatgttttgtaaaaatttttga

SEQ ID NO: 218681 - DNA, 75 bp, Artificial Sequence
  Synthetic
gcagctgtctggaagctgtctcaacaatgagaaagaatttgaaaacgctattctctcaatgaagctgaatgtgtc

SEQ ID NO: 218682 - DNA, 75 bp, Artificial Sequence
  Synthetic
tagtttcactgtggaagacgttttcattgagttgatcaaagccaagctcaatgatgatagtctttctaagtctgt

SEQ ID NO: 218683 - DNA, 75 bp, Artificial Sequence
  Synthetic
tcacaggttgaatcatatgggcatttgttcctgtggactctataaacagcctggtgtgcctgtgaaatggaagag

SEQ ID NO: 218684 - DNA, 75 bp, Artificial Sequence
  Synthetic
tgttcctgtggactctataaacagcctggtgtgcctgtgaaatggaagagatgagacccttgtcagggcccccgt

SEQ ID NO: 218685 - DNA, 75 bp, Artificial Sequence
  Synthetic
accatatcatccagttcttcctccgtggctgtatctgcaggattgatgctcacgtggccaaatttcacttttggc

SEQ ID NO: 218686 - DNA, 75 bp, Artificial Sequence
  Synthetic
cctcatctttttgcatgcatcaggaattagcctctcaatttgcctcattatcctataactacgattcccgtccac

SEQ ID NO: 218687 - DNA, 75 bp, Artificial Sequence
  Synthetic
gcaccggggatcctaggcaatttagttgttcttcttttggaaccttgcaccctggtacccagcagatggggaaca

SEQ ID NO: 218688 - DNA, 75 bp, Artificial Sequence
  Synthetic
gctgcagaatttggttgtcttgtcaaaagacttgcaggcagatatcaaaggacgtgattatctttcgactcttct

SEQ ID NO: 218689 - DNA, 75 bp, Artificial Sequence
  Synthetic
atcccagactgcattttcatacttcctggaatcagtcttgctgagggcaatgtcaattagtttaatgtcttttct

SEQ ID NO: 218690 - DNA, 75 bp, Artificial Sequence
  Synthetic
gagaagtttcctcctggtgttgaggatcctcagagactttatcttattcagaaaagacctccaacattgcatctg

SEQ ID NO: 218691 - DNA, 75 bp, Artificial Sequence
  Synthetic
actgttcaatattgtcatcacaggtgtctattttgtcattatacagctttctgaaatcctctaataacttcatct

SEQ ID NO: 218692 - DNA, 75 bp, Artificial Sequence
  Synthetic
cctccctcaaggcattagtggctcgagttaaaactctgttgatgatagcaaggagctcacaattccgttcttctt

SEQ ID NO: 218693 - DNA, 75 bp, Artificial Sequence
  Synthetic
agctgaaaatattgctgggaaatatcttttcggatcagcataaaatgagcatacctcgccaaccctgttgtcatt

SEQ ID NO: 218694 - DNA, 75 bp, Artificial Sequence
  Synthetic
cttttcggatcagcataaaatgagcatacctcgccaaccctgttgtcattaatggcataacactttgaacactcc

SEQ ID NO: 218695 - DNA, 75 bp, Artificial Sequence
  Synthetic
agcaagccaaagcttcagaagcaaaagacagcccgagggctagtctgattccagatgccacacacctaggaccac

SEQ ID NO: 218696 - DNA, 75 bp, Artificial Sequence
  Synthetic
tgttattaataccctgatgacaactagaaattatttcctcaaaatgttttgcacgcttgtcagttagaacattga

SEQ ID NO: 218697 - DNA, 75 bp, Artificial Sequence
  Synthetic
caacaattttttcaacagtctcctttagctgatcaaaataatcgcttgcacctccatcgagcaaaatttcgtcta

SEQ ID NO: 218698 - DNA, 75 bp, Artificial Sequence
  Synthetic
acaactaggtctaagaacaagcacatcacagaccacaactgaagactttttttactccaactttcaaattggttt

SEQ ID NO: 218699 - DNA, 75 bp, Artificial Sequence
  Synthetic
caatctcaatgcagagagacagtagtttcaatccctccatgagcaacattctaggttcagtttggacaagaaaag

SEQ ID NO: 218700 - DNA, 75 bp, Artificial Sequence
  Synthetic
cagaaaggcttgtaggacaactggcggtgccccacaaaagctcttacagaaatgagagacaatatgcctaggatc

SEQ ID NO: 218701 - DNA, 75 bp, Artificial Sequence
  Synthetic
ttcccttccttgagaagacttcagtgagctgtgagacagccaatgctgtaagtttgttaaagtcatagttcaaaa

SEQ ID NO: 218702 - DNA, 75 bp, Artificial Sequence
  Synthetic
cttctgtgatcaaatcctccctgattttctcaatcaaatccttgtgataaaaatcggacacaaaggccatcacaa

SEQ ID NO: 218703 - DNA, 75 bp, Artificial Sequence
  Synthetic
gaaaggtctgtacaattttgcaacatgtggcctcattggtttggtcactttcctcctgttgtgtggcaggtcttg

SEQ ID NO: 218704 - DNA, 75 bp, Artificial Sequence
  Synthetic
acctgtgttgggtttgggcttatgcctgtatggcttgtgagtcagctagtggtgcttcacaaaaattcctacaga

SEQ ID NO: 218705 - DNA, 75 bp, Artificial Sequence
  Synthetic
acaatcttcctgaagtcatggacaaggattcacaaagtctactatattctgactcttcaaagagtgaattacttt

SEQ ID NO: 218706 - DNA, 75 bp, Artificial Sequence
  Synthetic
tttcttccaccaccttgtcaagatcagatattgagggtgcattgcagtctgcctgctgctgtctttccggttgct

SEQ ID NO: 218707 - DNA, 75 bp, Artificial Sequence
  Synthetic
catttcagaaagatttattaactatgctatcggatgtgtttgtggaggggtgatcgacgcttacacatccagtga

SEQ ID NO: 218708 - DNA, 75 bp, Artificial Sequence
  Synthetic
acccaatcaggtatttgctcattataaaatgatgtcctcccatctataagtggtattaaattgatgtcaacactc

SEQ ID NO: 218709 - DNA, 75 bp, Artificial Sequence
  Synthetic
acaaaaagaacctctatgaccatgcccttatgagcataatttcaactttccacttgtccatccccaacttcaatc

SEQ ID NO: 218710 - DNA, 75 bp, Artificial Sequence
  Synthetic
aacaagccaaggtcccagaatcaaaagacagcccgagagccagcctaatcccagatgccacacatctagggccgc

SEQ ID NO: 218711 - DNA, 75 bp, Artificial Sequence
  Synthetic
ttgttcaaaattagcaggagaagacctaacaaaacactccaataatattaggacgttgcctgtcagtttgtaacc

SEQ ID NO: 218712 - DNA, 75 bp, Artificial Sequence
  Synthetic
agctgttgcacagccacttgtaataagagggtctcgcagtgtcttctttacttccttttctttgaacaatgaacc

SEQ ID NO: 218713 - DNA, 75 bp, Artificial Sequence
  Synthetic
acaccccccggggggaccccccgccgggggcccccccgggggagccgaccatctccaaggatctactcaatgtct

SEQ ID NO: 218714 - DNA, 75 bp, Artificial Sequence
  Synthetic
ttcctccatgtttggctgcaagtatggtaatcgaaactcttggaatatgtggtcagctagagtaacggttcacta

SEQ ID NO: 218715 - DNA, 75 bp, Artificial Sequence
  Synthetic
agaatttcatttttacatgagtgatcagttgaataaatttgtgagtcccaaaagtgttattgggagatttgttgc

SEQ ID NO: 218716 - DNA, 75 bp, Artificial Sequence
  Synthetic
ccaactctcagtatactcttttgttgagttgattttaactcaacaaggttgttgaccgcttgatttaggtccctc

SEQ ID NO: 218717 - DNA, 75 bp, Artificial Sequence
  Synthetic
aaaaatcagatacaaaagccatcataaaatacctaatgttttgtaaaaatttttgacaccttttactgggatgtg

SEQ ID NO: 218718 - DNA, 75 bp, Artificial Sequence
  Synthetic
tactttctgcaacacatcactggagaaaactgaaggaaaaaaccgtttaggatcagcataaaaggaacaaacctc

SEQ ID NO: 218719 - DNA, 75 bp, Artificial Sequence
  Synthetic
tatgttcttgtggactctataaacaacccggtgtgcctgtgaaatggaagagatgagacccctgtcagggccccc

SEQ ID NO: 218720 - DNA, 75 bp, Artificial Sequence
  Synthetic
accatcactctcctccttgacttactgtagcaaagggcataacccttgaattccacccaattatccactgcctca

SEQ ID NO: 218721 - DNA, 75 bp, Artificial Sequence
  Synthetic
gtcacgggggcgtccatttacagaacgactctaggtgtcgatgtcctgaacaccatatctctaggcagcactgct

SEQ ID NO: 218722 - DNA, 75 bp, Artificial Sequence
  Synthetic
gcaatgagttgtgacttcaatgggggaaagataagtgttcagtacaaccttagccacacttatgctgtagatgca

SEQ ID NO: 218723 - DNA, 75 bp, Artificial Sequence
  Synthetic
tctatccaagcataacccatcatcagatcatgtttaaacattggcctttcaacacctttgtgaataactttctct

SEQ ID NO: 218724 - DNA, 75 bp, Artificial Sequence
  Synthetic
gatggcttggggtggcagttacatagcacttgattccggaaaggggagttgggattgtataatgacttcctacca

SEQ ID NO: 218725 - DNA, 75 bp, Artificial Sequence
  Synthetic
tgagcaacattctgggttcggtttggaccaaaaaggctaacttttgtcttgatagcttctcattgtctgcaagat

SEQ ID NO: 218726 - DNA, 75 bp, Artificial Sequence
  Synthetic
tgtagcacctgtgttggatttgggtttgtgccagtatggcttgtagatcaaccggtggtgccccacaaaagctcc

SEQ ID NO: 218727 - DNA, 75 bp, Artificial Sequence
  Synthetic
ttgtgccagtatggcttgtagatcaaccggtggtgccccacaaaagctcccacagaaatgagagacaatatgcct

SEQ ID NO: 218728 - DNA, 75 bp, Artificial Sequence
  Synthetic
gtcctttccttactagaatccaaatctgcatacaagaacttaaggactggagaggctcttcgaaactggaatgtc

SEQ ID NO: 218729 - DNA, 75 bp, Artificial Sequence
  Synthetic
agaatggcttgtgggtcagctggtggtgtcccacaaaaaactcctacagaaatgagagacaatatgcctaggatc

SEQ ID NO: 218730 - DNA, 75 bp, Artificial Sequence
  Synthetic
actcctatttctaagttctagtggaacctgccaatattggatgccattagaatttgttaacaatttgattccctt

SEQ ID NO: 218731 - DNA, 75 bp, Artificial Sequence
  Synthetic
tccatcgtctgaggtgacaccttaattgtctctagcatgttgccgccatctagcatgcaagctcctgccttcaca

SEQ ID NO: 218732 - DNA, 75 bp, Artificial Sequence
  Synthetic
tggatggcaaagctttctttaaaactagcatcttgacttttaatacggaacctcactgtctgactcagttttgca

SEQ ID NO: 218733 - DNA, 75 bp, Artificial Sequence
  Synthetic
aatttgttaacaatttgattcccttgacatcagaaatcagagactgaatggacttaatatacaggttctctttat

SEQ ID NO: 218734 - DNA, 75 bp, Artificial Sequence
  Synthetic
tccatccctaacttcaatcagtatgaggcaatgagctgcgatttcaatgggggaaagattagtgtgcagtacaac

SEQ ID NO: 218735 - DNA, 75 bp, Artificial Sequence
  Synthetic
cccttgggtggtagagtttctaggcctttgcctttagtcctctttctactgtccatccaccgtttgagatccttc

SEQ ID NO: 218736 - DNA, 75 bp, Artificial Sequence
  Synthetic
ttttcacatcccaaactctcaccactccatctctcccagcccgagccccttgattaccaccactcattcctatca

SEQ ID NO: 218737 - DNA, 75 bp, Artificial Sequence
  Synthetic
atatagacacctgcactcaatggcctttctgtcctggtcacctttgatttcaacttctctagatcagcggctaag

SEQ ID NO: 218738 - DNA, 75 bp, Artificial Sequence
  Synthetic
tttctgtcctggtcacctttgatttcaacttctctagatcagcggctaagattaataagtcatctgatgttagag

SEQ ID NO: 218739 - DNA, 75 bp, Artificial Sequence
  Synthetic
atcccaaacagcattttcaaatctcctagagtcagccttgctcagtgcaatgtcaataagctttatgtcccttct

SEQ ID NO: 218740 - DNA, 75 bp, Artificial Sequence
  Synthetic
cctgtgtggcttgtaaatcagctagtggtgctccacaaaaaactcctacagaaatgagagacaatacgcctagga

SEQ ID NO: 218741 - DNA, 75 bp, Artificial Sequence
  Synthetic
cataaactccctctatgcacaaccaatgggactggttcagtacaggggcccaccaacacaaagtcatactctcca

SEQ ID NO: 218742 - DNA, 75 bp, Artificial Sequence
  Synthetic
ctaactagatggatgttaattgaagcagaactgaagtgctttgggaacacagcagtcgcaaagtgcaacgagaaa

SEQ ID NO: 218743 - DNA, 75 bp, Artificial Sequence
  Synthetic
ggggattccatactgtaattacagcaagtattggtacctcaaccacacaactactggaaaaacatcactgcccaa

SEQ ID NO: 218744 - DNA, 75 bp, Artificial Sequence
  Synthetic
tgttctttctgaggcattgtgcactgtactcctccaaatgggaaacaagcaagccaaagccccagaagcaaaaga

SEQ ID NO: 218745 - DNA, 75 bp, Artificial Sequence
  Synthetic
tggggatctccatgaagaattcacaaccaactacctttcaaatgaacattcatcctcacttaaaaatctctgtga

SEQ ID NO: 218746 - DNA, 75 bp, Artificial Sequence
  Synthetic
ccactatctgtgtctcaactgcctcaccttacttctaagtgtcagcaataggtgccccatttgcaagatgcctct

SEQ ID NO: 218747 - DNA, 75 bp, Artificial Sequence
  Synthetic
acaatggtgggaatcttctcatcatctaggttcacagcacctgaatatattatcttttgtctcaacaccattctt

SEQ ID NO: 218748 - DNA, 75 bp, Artificial Sequence
  Synthetic
tatcttttgtctcaacaccattcttaaaggatgatgcgcagccaagtttaaccaagaatactcaaggtcagactc

SEQ ID NO: 218749 - DNA, 75 bp, Artificial Sequence
  Synthetic
gaggggctggttcagtgcagggacctactagtacaaagtcatactctgtaaactgtaacctttccatatcaacaa

SEQ ID NO: 218750 - DNA, 75 bp, Artificial Sequence
  Synthetic
aagaatggtactgagacagaaaatcatttactcaggtgcagtcaacttagatgaagaaaaggtcccaacaatagt

SEQ ID NO: 218751 - DNA, 75 bp, Artificial Sequence
  Synthetic
tcatcagagagcttacccatatcaaacttaaaattaaggttccttgacttgtaatgagtgtacctccccataagt

SEQ ID NO: 218752 - DNA, 75 bp, Artificial Sequence
  Synthetic
actcattaatgatctcggtgtcaacataccatgctgatttgcccttaaaagtaggtcctgacaaaaccagtctcc

SEQ ID NO: 218753 - DNA, 75 bp, Artificial Sequence
  Synthetic
aatttcatctaaatcatttattgatggttggccatcaccattgaggcctgagcctagcttgactggttccctata

SEQ ID NO: 218754 - DNA, 75 bp, Artificial Sequence
  Synthetic
cccgggggggcaggcagcccagctctactcaatgtcctcgacacacctctctggcccaaacaactccgaacatgt

SEQ ID NO: 218755 - DNA, 75 bp, Artificial Sequence
  Synthetic
tttcttccaccatgggttcatgtgtcctactgtgagacaacctcagctcagatgatagcacaatgtaatgttcct

SEQ ID NO: 218756 - DNA, 75 bp, Artificial Sequence
  Synthetic
aattcagtgtcacccagtgagaactcttggcaatatgcttctttgcatctcaccacttggtatcttgctggccca

SEQ ID NO: 218757 - DNA, 75 bp, Artificial Sequence
  Synthetic
gatgatagcacaatgtaatgttcctcccttttccattttactatgtgtgagacaagagacaaggcttcacagtta

SEQ ID NO: 218758 - DNA, 75 bp, Artificial Sequence
  Synthetic
gtctgcatttcaaagttcaattgcatctggcttcgttggtttgtgtaggacactgggcagtaaatgtgtaagagg

SEQ ID NO: 218759 - DNA, 75 bp, Artificial Sequence
  Synthetic
tacttagctgtgtatatcagtcccaaatccgtcagtgctaggacagcatcatttaggtcaacttgaccttgttta

SEQ ID NO: 218760 - DNA, 75 bp, Artificial Sequence
  Synthetic
ctctcttttccattttactatatgtgagacaagagacaaggcttcacagttaacatccaacgctacacagagatc

SEQ ID NO: 218761 - DNA, 75 bp, Artificial Sequence
  Synthetic
caaacatctccaaatcttgatcttggatagatggtgtaaatgtagctactcttctatcagattcccacagtgctc

SEQ ID NO: 218762 - DNA, 75 bp, Artificial Sequence
  Synthetic
aatcagttgtaattcagtgttgctcaatgaaaactcttgacagtatacttctttgcatctaaccacttgatacct

SEQ ID NO: 218763 - DNA, 75 bp, Artificial Sequence
  Synthetic
tgaagaaagtctctctaagtcagtggttcccagtagttccacatcccccatcacataagggaatgtttcttcctc

SEQ ID NO: 218764 - DNA, 75 bp, Artificial Sequence
  Synthetic
gaggtgctcactagataaatagtttgttgtgaattcttcgtggagttgcccagtcttcaacctattgtacagttt

SEQ ID NO: 218765 - DNA, 75 bp, Artificial Sequence
  Synthetic
ttaaaacagtggtggccttcagaatggttttctggaaaattgaattgaggatttgattcttactcaaacactggg

SEQ ID NO: 218766 - DNA, 75 bp, Artificial Sequence
  Synthetic
gacaccattcgcaaccgactgatcaatgattgtgtcaattgtttctgccagttgatgtggctctttacactttat

SEQ ID NO: 218767 - DNA, 75 bp, Artificial Sequence
  Synthetic
gattcacagagtcttgaatactcagactcctcgaacaatgcattactttcttgtgaatattttaatagagtaaat

SEQ ID NO: 218768 - DNA, 75 bp, Artificial Sequence
  Synthetic
ctcttgaactgataaattaagtgttcgatattgtcttctgcagctaccttatcagcgtacagattattaagttca

SEQ ID NO: 218769 - DNA, 75 bp, Artificial Sequence
  Synthetic
ttcctccttgtgttcaatatcctcaaagattttactttatttaggaatgatctccagcattggacctgacattct

SEQ ID NO: 218770 - DNA, 75 bp, Artificial Sequence
  Synthetic
cctcatgtgatagaggaggtgatgaacattgtactcattgcactatccatactagcagtgctgaagggtttgtac

SEQ ID NO: 218771 - DNA, 75 bp, Artificial Sequence
  Synthetic
acattgtactcattgcactatccatactagcagtgctgaagggtttgtacaatgttgcaacatgtggcctcattg

SEQ ID NO: 218772 - DNA, 75 bp, Artificial Sequence
  Synthetic
cagctgctccaattttttaaagtcttcaatgtatttttgctcaaagttagcaggagatgatctaacaaaacactc

SEQ ID NO: 218773 - DNA, 75 bp, Artificial Sequence
  Synthetic
tacaaaggggcttatgaacttcagactctagaactcaacatggaaacactcaacatgaccatgcccctctcctgc

SEQ ID NO: 218774 - DNA, 75 bp, Artificial Sequence
  Synthetic
ctctagaactcaacatggaaacactcaacatgaccatgcccctctcctgcacaaagaacaacagccatcactaca

SEQ ID NO: 218775 - DNA, 75 bp, Artificial Sequence
  Synthetic
cctccatatcaatcttatagtgatccacactgatcccaacatcccttaaagcagtggtggccttcaagatggttt

SEQ ID NO: 218776 - DNA, 75 bp, Artificial Sequence
  Synthetic
atcattgatcacaagttctgcaacttgtctgatgctcataaaaagaacctttatgaccacacccttatgagcatt

SEQ ID NO: 218777 - DNA, 75 bp, Artificial Sequence
  Synthetic
tgtctgatgctcataaaaagaacctttatgaccacacccttatgagcattatctcaaccttccacttgtccatcc

SEQ ID NO: 218778 - DNA, 75 bp, Artificial Sequence
  Synthetic
aaaacacaagttcttcaacattgctgtggtacagtttgtcagtgacagggccttactgagtgcctctgaattgct

SEQ ID NO: 218779 - DNA, 75 bp, Artificial Sequence
  Synthetic
attagtgtgcagtacaatctaagtcatgcatatgctatagatgcggccaaccattgtggcacagttgcaaatggt

SEQ ID NO: 218780 - DNA, 75 bp, Artificial Sequence
  Synthetic
ttcaaagtaatcttcaatgagccttgtgaacatctttgttctcagatctccgatgtacaactctctattgcctcc

SEQ ID NO: 218781 - DNA, 75 bp, Artificial Sequence
  Synthetic
agggtagggacacaccagggggatactgtctgaccagatggatgttaattgaagctgagctgaagtgctttggca

SEQ ID NO: 218782 - DNA, 75 bp, Artificial Sequence
  Synthetic
ctgtctgaccagatggatgttaattgaagctgagctgaagtgctttggcaacacagctgtagctaagtgtaatga

SEQ ID NO: 218783 - DNA, 75 bp, Artificial Sequence
  Synthetic
cctttagctgatcaaaataatcgcttgcacctccatcgagcaaaatttcgtctaggtcagccccatcagcatcac

SEQ ID NO: 218784 - DNA, 75 bp, Artificial Sequence
  Synthetic
tcatgagctgttaacttattgttgatgccttggtggcatgaggcgatcacttcctcataatgattagagcgattg

SEQ ID NO: 218785 - DNA, 75 bp, Artificial Sequence
  Synthetic
ccatcttcgggatatcatgggaataccatactgcaactacagcaagtactggtatctcaaccatacgactactgg

SEQ ID NO: 218786 - DNA, 75 bp, Artificial Sequence
  Synthetic
cattttggtggatgccaaatcactcatgaatggtaatatgtgtttctcaaacacagatgggtataatctcctcag

SEQ ID NO: 218787 - DNA, 75 bp, Artificial Sequence
  Synthetic
agtacaagtttctatctcattagcatcttccttcatctggtcaaaataccaactcatagacatattataggcaaa

SEQ ID NO: 218788 - DNA, 75 bp, Artificial Sequence
  Synthetic
aactcatagacatattataggcaaaccatgtcctaagccacatagactaaatcacatgggcatatgctcctgtgg

SEQ ID NO: 218789 - DNA, 75 bp, Artificial Sequence
  Synthetic
gacacatgtaggaaatgttcaaaatgaacttgaacctattagtcatcatgctctttacatcctcggataaaacca

SEQ ID NO: 218790 - DNA, 75 bp, Artificial Sequence
  Synthetic
atcaaacataatgcaatccattagagcacagtgtggggttatttcctctttgccacctcttttcttcttttcaac

SEQ ID NO: 218791 - DNA, 75 bp, Artificial Sequence
  Synthetic
tgattgcacaaatcgactgggacaccatttgcaacagattgatcaattattgtgtcgattgtttctgccaattgg

SEQ ID NO: 218792 - DNA, 75 bp, Artificial Sequence
  Synthetic
attaattcttcccttattttttcaataaggtccttatgatgataatctgacacataagccattacaaagtaccta

SEQ ID NO: 218793 - DNA, 75 bp, Artificial Sequence
  Synthetic
aaatctttatattggtcccaaactgcattttcatactttctagagtcaactttgctgagggcaatgtcaattagt

SEQ ID NO: 218794 - DNA, 75 bp, Artificial Sequence
  Synthetic
gaatacttagcatcttgtttgaattgttttaaatcagtaggttcacggaagaagtgaatgtaacaacctgaactt

SEQ ID NO: 218795 - DNA, 75 bp, Artificial Sequence
  Synthetic
acatgggttgtgcttgaagaactccaatgccttaaccgttttaggttctcccaaaacccatgcacctaattctat

SEQ ID NO: 218796 - DNA, 75 bp, Artificial Sequence
  Synthetic
ttatcattaatagcatagcactttgagcactcccctgtcttttgataaattagttgaaatacagtgttacccaat

SEQ ID NO: 218797 - DNA, 75 bp, Artificial Sequence
  Synthetic
gttttaaatcagtaggttcacggaagaagtgaatgtaacaacctgaacttggctgatagagagcgacctccaccg

SEQ ID NO: 218798 - DNA, 75 bp, Artificial Sequence
  Synthetic
agctgcagcattgtatccttgagagtcatgagttgagaataagtgagcccagcagtgaaccctgctgactggagg

SEQ ID NO: 218799 - DNA, 75 bp, Artificial Sequence
  Synthetic
acatctttgtccttaaatctccgatgtacaactctctattgcctcccacttgttccttgtaggacaaagaaaatt

SEQ ID NO: 218800 - DNA, 75 bp, Artificial Sequence
  Synthetic
tatgttcctgcggattctataaacagcccggtgtgcctgtaaaatggaagagatgagaccctcatcagggccccc

SEQ ID NO: 218801 - DNA, 75 bp, Artificial Sequence
  Synthetic
actctttttgaccttcagtatagacttgaggatgccatccattgtctgaggtgataccttgattgtctccagcat

SEQ ID NO: 218802 - DNA, 75 bp, Artificial Sequence
  Synthetic
cataggtccccatttactgtgatccatgctatatgaaacatgtgcggatgagacatttagcttcattgataagat

SEQ ID NO: 218803 - DNA, 75 bp, Artificial Sequence
  Synthetic
taaaattgtagcctgagatgttcagggaacttttcttggtgtctatcatgtttaggatggggtggctctgagtca

SEQ ID NO: 218804 - DNA, 75 bp, Artificial Sequence
  Synthetic
tcctggaatcagttttgctgagggcaatatcaattagtttgatgtcttttcttccttgtgattcaaggagtttcc

SEQ ID NO: 218805 - DNA, 75 bp, Artificial Sequence
  Synthetic
ggaacttttcttggtgtctatcatgtttaggatggggtggctctgagtcagcctgtctaagtctgaggtgttggg

SEQ ID NO: 218806 - DNA, 75 bp, Artificial Sequence
  Synthetic
cttaagaagcaagaccccaaccacccttttaaacatttttgtttcattaggtcatgtttacttgcaaggagaatt

SEQ ID NO: 218807 - DNA, 75 bp, Artificial Sequence
  Synthetic
tgcatcaaaaattaatagaagtttcctccttgtgttcaatatcctcaaagattttactttatttaggaatgatct

SEQ ID NO: 218808 - DNA, 75 bp, Artificial Sequence
  Synthetic
cattcaagtcaacttgtccttgttttgttaaacatgccaatgtcagacttggcatggtgccgaactgattgttaa

SEQ ID NO: 218809 - DNA, 75 bp, Artificial Sequence
  Synthetic
cctaaggtccaatggaactcgccaatattgaacaccattagaatttgttagtaattcaatcccctgagtaccaga

SEQ ID NO: 218810 - DNA, 75 bp, Artificial Sequence
  Synthetic
tgttaaacatgccaatgtcagacttggcatggtgccgaactgattgttaagcaggtctgcgttcttcacatccca

SEQ ID NO: 218811 - DNA, 75 bp, Artificial Sequence
  Synthetic
tcattcctatcatatttagaagagctcgtctttggtcaagttgctgtgagctcaggttgcccatgtaaacacctg

SEQ ID NO: 218812 - DNA, 75 bp, Artificial Sequence
  Synthetic
gctgtttgacttcaacaaacaagccattcaaaggctgaaagctgaagcacaaatgagcattcagttgatcaacaa

SEQ ID NO: 218813 - DNA, 75 bp, Artificial Sequence
  Synthetic
tcagcagctagaactagcaagtcatctgaggtcagagtcccaaccctcagtacactcttttgctgagtagatttc

SEQ ID NO: 218814 - DNA, 75 bp, Artificial Sequence
  Synthetic
ctgaggtcagagtcccaaccctcagtacactcttttgctgagtagatttcagctcaacaaggttgttcactgctt

SEQ ID NO: 218815 - DNA, 75 bp, Artificial Sequence
  Synthetic
tcttgcattataaaccatttcagcaagctcttcctccgatgcatcatccttcgggttcacacttacatgtccaaa

SEQ ID NO: 218816 - DNA, 75 bp, Artificial Sequence
  Synthetic
tgtccataggaaggactttatctcctttgaggcactcattgtcaagttgttgtgtactgttcaaatagcagaaaa

SEQ ID NO: 218817 - DNA, 75 bp, Artificial Sequence
  Synthetic
cttgtcattgacccagtcaggtatttgttcattgtagaatgatgttctcccgtctataagtggtattaaattgat

SEQ ID NO: 218818 - DNA, 75 bp, Artificial Sequence
  Synthetic
aggggttatttcctctttaccgcctcttttcttcttctcaacaacaacacctgtgtgcatgtggcataggtcttt

SEQ ID NO: 218819 - DNA, 75 bp, Artificial Sequence
  Synthetic
gacaatcttcctgaagtcatggatagagactcacaaagtctactatactctgactcctcaaaaagtgaattactt

SEQ ID NO: 218820 - DNA, 75 bp, Artificial Sequence
  Synthetic
cagtgactataagatgacaaaattgatattgattttaattgattttaatttagatattctcataagaaagtcaaa

SEQ ID NO: 218821 - DNA, 75 bp, Artificial Sequence
  Synthetic
actaggtactttgatactaagtctttaacataggctatgtcttcctccatgtttggttgcagatatgatgatcag

SEQ ID NO: 218822 - DNA, 75 bp, Artificial Sequence
  Synthetic
aaggcagcagcacagccgagcgcaccatcaaccgagacgatccagaacacaacacctccaccgtacaccccataa

SEQ ID NO: 218823 - DNA, 75 bp, Artificial Sequence
  Synthetic
tgacatcaatcccatgtgagtacttagcatcctgcttgaactgctttaaatcagtaggttcacggaagaagtgta

SEQ ID NO: 218824 - DNA, 75 bp, Artificial Sequence
  Synthetic
gagcaatagttcactaaagggcaaggtcccgtaggaggcaaaggagacacaagaggcaattgaagacaataaaag

SEQ ID NO: 218825 - DNA, 75 bp, Artificial Sequence
  Synthetic
gtcccgtaggaggcaaaggagacacaagaggcaattgaagacaataaaagacaataaaattagatagccttaatg

SEQ ID NO: 218826 - DNA, 75 bp, Artificial Sequence
  Synthetic
tgttgctacctgtggcctctttggattggtgtcctttctcctcttatgtggaagatcatgctcaacaacttacaa

SEQ ID NO: 218827 - DNA, 75 bp, Artificial Sequence
  Synthetic
ggatcctaggcatttttggttgcgcaattcaagtgtcctatttcaaaatgggacagatagtgacattcttccagg

SEQ ID NO: 218828 - DNA, 75 bp, Artificial Sequence
  Synthetic
ttgcaaatggtgtcttacagactttcatgaggatggcttggggtgggagctacattgctcttgactcaggccgtg

SEQ ID NO: 218829 - DNA, 75 bp, Artificial Sequence
  Synthetic
ccccccggggggaccccccgccgggggcccccccgggggagccaaccctctccaagagactactcaatgtcctcg

SEQ ID NO: 218830 - DNA, 75 bp, Artificial Sequence
  Synthetic
ttatcaatatctgataatccaaaatacaacctgggaagatcactgccaattctcaagaccatctcctatcggtta

SEQ ID NO: 218831 - DNA, 75 bp, Artificial Sequence
  Synthetic
gtcggaaatgagactggcttggagctgactttaacaaatacaagtattatcaaccacaagttttgcaacctttct

SEQ ID NO: 218832 - DNA, 75 bp, Artificial Sequence
  Synthetic
gcataatttcaactttccacttgtccatccccaacttcaatcagtatgaggcaatgagctgcgattttaatgggg

SEQ ID NO: 218833 - DNA, 75 bp, Artificial Sequence
  Synthetic
aatgacttcctaccaatatttgataatccaaaacaccacttgggaagatcactgccagttttctcgcccatcccc

SEQ ID NO: 218834 - DNA, 75 bp, Artificial Sequence
  Synthetic
aaaactgagaccatcagccgctccaacagcacccccagccagagcagcggacgacaccaggcccccgccctacag

SEQ ID NO: 218835 - DNA, 75 bp, Artificial Sequence
  Synthetic
ccccggggggaccccccgccgggggcccccccgggggagccaaccatccctgaaagactactcaatgtcttcgat

SEQ ID NO: 218836 - DNA, 75 bp, Artificial Sequence
  Synthetic
caatgtccactcctgaccactgcatcttcaaccctagcctgtctatcatcatgtcactcaatgccccaatcagca

SEQ ID NO: 218837 - DNA, 75 bp, Artificial Sequence
  Synthetic
gtcaaaataccaactcataggcatattgtaggcaagtcgtgtcctaaacctcacagattgaatcacatgggcata

SEQ ID NO: 218838 - DNA, 75 bp, Artificial Sequence
  Synthetic
actggctcaatgcaaggacccaccaacacaaagtcatattctgtaaactgcaacctttccatatcaacaacaact

SEQ ID NO: 218839 - DNA, 75 bp, Artificial Sequence
  Synthetic
actcattgccagattgttgtattgagtgcacgtgataaaagctgaaactatttgccaaaatgacaaaagcaaagc

SEQ ID NO: 218840 - DNA, 75 bp, Artificial Sequence
  Synthetic
ttcttctcaacaacgacacctgtgtgcatgtggcataagtctttatactgatcccagactgcattctcatacttc

SEQ ID NO: 218841 - DNA, 75 bp, Artificial Sequence
  Synthetic
atgggcatatgctcatgtggtctttacaaacatcctggtgttccagtcaagtggaaaagataggagataaacccg

SEQ ID NO: 218842 - DNA, 75 bp, Artificial Sequence
  Synthetic
attgaatcacatgggcatatgttcctgtggactctacaaacagcccggtgtacctgtgaaatggaagagatgaga

SEQ ID NO: 218843 - DNA, 75 bp, Artificial Sequence
  Synthetic
agaaaatggacccaatctatgcaacccttcaccctctggaactgatgtcttgtgtggaaaccacgtgaaggaccc

SEQ ID NO: 218844 - DNA, 75 bp, Artificial Sequence
  Synthetic
gttgctgccagctttctgtggcttcccatctgattccagatcaacgacagtgttttcccaggcccttcctgttat

SEQ ID NO: 218845 - DNA, 75 bp, Artificial Sequence
  Synthetic
ctggtcaaaccaggttgagcagggaaaagatctgccacatcaatcccatgagaatatttggcatcttgcttgaac

SEQ ID NO: 218846 - DNA, 75 bp, Artificial Sequence
  Synthetic
gctttgatttactatagcaaagagcatagcctttgaaatcaatccattctccaagagattcaagaagttcactca

SEQ ID NO: 218847 - DNA, 75 bp, Artificial Sequence
  Synthetic
gaatgatgtgattcaaaccaaccttgtcttccaatagttttgatgcagttggcttcaagggaaagtagtcacaag

SEQ ID NO: 218848 - DNA, 75 bp, Artificial Sequence
  Synthetic
cgttggcaatgtcttcctccattattgaatgtagcacttaagttgagttgaggtttgtgtttgtgtgatctgcag

SEQ ID NO: 218849 - DNA, 75 bp, Artificial Sequence
  Synthetic
gagggtcatcagctgagaataggtaagcccagcggtaaaccctgccgactgcagggatttattggaattgttgct

SEQ ID NO: 218850 - DNA, 75 bp, Artificial Sequence
  Synthetic
ctgattattgagcaactctgcatttttcacatcccaaactctcaccactccatctctcccagcccgagccccttg

SEQ ID NO: 218851 - DNA, 75 bp, Artificial Sequence
  Synthetic
ttcacatcccaaactctcaccactccatctctcccagcccgagccccttgattaccaccactcatccctatcatg

SEQ ID NO: 218852 - DNA, 75 bp, Artificial Sequence
  Synthetic
atatagattctctttgtttggtccccgaacacatttgctgcccaatgttctacacaaccccacaaagccagatgc

SEQ ID NO: 218853 - DNA, 75 bp, Artificial Sequence
  Synthetic
cttttgtctcaacaccatccttaaaggatgatgcgcagctaagtttaaccaagaatactcaaggtcagactcaga

SEQ ID NO: 218854 - DNA, 75 bp, Artificial Sequence
  Synthetic
actcaaattccccatataaacacctgagcttagtggcctctctgttctaatgaccttcgactttagtttctctaa

SEQ ID NO: 218855 - DNA, 75 bp, Artificial Sequence
  Synthetic
aggtgtaaccttgatggtctccaacatgttccccccatcaagcatacaagctccagctttcactgcagctcccaa

SEQ ID NO: 218856 - DNA, 75 bp, Artificial Sequence
  Synthetic
ccggggatcctaggcaatttggacgttcttctttctgaagccttgtgtgctgaactcctccaaatgggaaacaag

SEQ ID NO: 218857 - DNA, 75 bp, Artificial Sequence
  Synthetic
tgagtcagcctatctaagtctgaagtgttgggatactttgctgtgtagattagacccaaatctgtcagtgcttgc

SEQ ID NO: 218858 - DNA, 75 bp, Artificial Sequence
  Synthetic
accactcattcctatcatactcagaagagcccgtctttggtcaagttgctgtgagctcaagttgcccatatagac

SEQ ID NO: 218859 - DNA, 75 bp, Artificial Sequence
  Synthetic
agatgccacacacctagggccacaattctgcaagagctgctggttcgaaaacaagggcctggttgagtgcaacaa

SEQ ID NO: 218860 - DNA, 75 bp, Artificial Sequence
  Synthetic
cctgaaagctccctcctcaatgactgtgtccagagaaatgacttcacttccttagaagcactcatcttggtctgg

SEQ ID NO: 218861 - DNA, 75 bp, Artificial Sequence
  Synthetic
gtcatctgaggttagagtcccaactctcagtatactcttttgttgagttgattttaactcaacaaggttgttgac

SEQ ID NO: 218862 - DNA, 75 bp, Artificial Sequence
  Synthetic
ggggatcctaggcaattcagctggacttcagtggtaaggctcaattcagcaaatccctgaatcaaagcacctagt

SEQ ID NO: 218863 - DNA, 75 bp, Artificial Sequence
  Synthetic
gcttcatcaagccatgggacaaatcataacatttttccaggaagtacctcatgtcatagaggaagtgatgaacat

SEQ ID NO: 218864 - DNA, 75 bp, Artificial Sequence
  Synthetic
caaaatgggcaacagacaggccaaatcgacaaaagtcgatgaacatcaaagagctcatctagtgccagatgcatc

SEQ ID NO: 218865 - DNA, 75 bp, Artificial Sequence
  Synthetic
aaggagctcttcttagtgtccaccatattcagtataggatggctttgagaaagtctgtctaggtcagaactattt

SEQ ID NO: 218866 - DNA, 75 bp, Artificial Sequence
  Synthetic
attgttgtgctggatgcacgcagcagaaagcaaaaactatctgccaaaatgataaaagcaaagcgcaatccaata

SEQ ID NO: 218867 - DNA, 75 bp, Artificial Sequence
  Synthetic
ggatcctaggcaatttggttgttctcttttgggttttgtgtgctgaactcctccagatgggaaacaagcaagtca

SEQ ID NO: 218868 - DNA, 75 bp, Artificial Sequence
  Synthetic
cacttgactgaatcataactctttgctttgatttactatagcaaagagcatagcctttgaaatcaatccattctc

SEQ ID NO: 218869 - DNA, 75 bp, Artificial Sequence
  Synthetic
catttgcaagatgccccttcccacaaaactgagaccatcagtcactccaacagcacccccaaccagagcagcgga

SEQ ID NO: 218870 - DNA, 75 bp, Artificial Sequence
  Synthetic
cattttcaaattccttctcgttgttcaggcaactccctgataactgtaggcttagagcttcaaagtaatcttcta

SEQ ID NO: 218871 - DNA, 75 bp, Artificial Sequence
  Synthetic
ttcaatgcaccaactaaaaggtgcggggaactatcaccaatctcccttacaaacatttccaaatcttgatcttgg

SEQ ID NO: 218872 - DNA, 75 bp, Artificial Sequence
  Synthetic
atgtccacccctgaccactgcatccttaatcccagtctgtctatcatcatatcactcaatgccccaatcagcagg

SEQ ID NO: 218873 - DNA, 75 bp, Artificial Sequence
  Synthetic
gacatatgtccacagtaaaaatacttctcctttaacttattgttctcatagacagcgttacagaattcttcataa

SEQ ID NO: 218874 - DNA, 75 bp, Artificial Sequence
  Synthetic
taattcacccttgatcagcctaatgtaaaacttatttgggacaatctcatctaaatcatttattgatggctggct

SEQ ID NO: 218875 - DNA, 75 bp, Artificial Sequence
  Synthetic
ctgaccaaaatattcgcttgcacctccatcaagcaaaatttcgtctaggtcagccccatcagcatcacttttgtg

SEQ ID NO: 218876 - DNA, 75 bp, Artificial Sequence
  Synthetic
atagtgaaccattgttaaaagaggacgtaaggagggataaatacttctttgaaacaccaggccttttatagtctg

SEQ ID NO: 218877 - DNA, 75 bp, Artificial Sequence
  Synthetic
ttatgtcccttcttccttgggaatccaagagtctcttaatgtcatctgaaccttgacaggtcagtaccatattgc

SEQ ID NO: 218878 - DNA, 75 bp, Artificial Sequence
  Synthetic
tagaccatgtcatctaattcttcctccgtggctgtatctgcaggattggtgctcacatgaccaaatctcactttt

SEQ ID NO: 218879 - DNA, 75 bp, Artificial Sequence
  Synthetic
ctggtgaaattttccatatctggattccattgtcccctatcactgcttcaataccttgagtccctagtagctggg

SEQ ID NO: 218880 - DNA, 75 bp, Artificial Sequence
  Synthetic
attgtgacatatgtccacagtaaaaatacttctccttcaatctactattctcatagacagcattacagaattctt

SEQ ID NO: 218881 - DNA, 75 bp, Artificial Sequence
  Synthetic
tctgcgcacctcgagtgaaagtagaagacaatttgttttgaattgttttgacaatggtagggattttctcatcat

SEQ ID NO: 218882 - DNA, 75 bp, Artificial Sequence
  Synthetic
tgtttctttcgtgataaagtggcacatgtaagagatgttcaagacaaacttgaacctattagtcatcatgctttt

SEQ ID NO: 218883 - DNA, 75 bp, Artificial Sequence
  Synthetic
gcaggaattcaacgtcggtgattaattcttcccttatcttgtcaatgaggtctttatgatgataatctgacgtgt

SEQ ID NO: 218884 - DNA, 75 bp, Artificial Sequence
  Synthetic
tatcttttagggtcagcataaaatgagcacacctcgccaactttgttatcattaatggcatagcactttgaacat

SEQ ID NO: 218885 - DNA, 75 bp, Artificial Sequence
  Synthetic
tgctgtgagcttattgaagtcatagtttaatattctagaaccatctgtgtatttattgacaacaacacttttgtt

SEQ ID NO: 218886 - DNA, 75 bp, Artificial Sequence
  Synthetic
attgatcccaacatccttcaaggcagtagtggcttttaaaatggttttctgaaatattgaattaaggatttgatt

SEQ ID NO: 218887 - DNA, 75 bp, Artificial Sequence
  Synthetic
acttgactgaatcataactctttgctttgatttactgtagcaaagagcatagcctttgaaatcaatccattctcc

SEQ ID NO: 218888 - DNA, 75 bp, Artificial Sequence
  Synthetic
tttgatttactgtagcaaagagcatagcctttgaaatcaatccattctccaagagattcaagaagttcactcagt

SEQ ID NO: 218889 - DNA, 75 bp, Artificial Sequence
  Synthetic
tgagagatatcatgggaattccttactgcaattacagcaagtactggtatctaaatcacactgtaacagggaaga

SEQ ID NO: 218890 - DNA, 75 bp, Artificial Sequence
  Synthetic
ttacttgcaaggagaattagtgcatcgaaaattaacagaagttttcttcttgtgttcaatatcctcagagatttt

SEQ ID NO: 218891 - DNA, 75 bp, Artificial Sequence
  Synthetic
cgaaaattaacagaagttttcttcttgtgttcaatatcctcagagattttaccttattcaggaatgatctccagc

SEQ ID NO: 218892 - DNA, 75 bp, Artificial Sequence
  Synthetic
cagattgttgtgctggatgcacgcagcaggaagctgagactacctgtcaaaaatgacaaatgcaaagcgcaatcc

SEQ ID NO: 218893 - DNA, 75 bp, Artificial Sequence
  Synthetic
tcaccaatatttgcatacaaaaatcttaatattggtgatgcccttttgaactgataaattaattgttcaatattg

SEQ ID NO: 218894 - DNA, 75 bp, Artificial Sequence
  Synthetic
tagaagcactcatcttgatctagacactaggggacttgctggttgaaagtatcactcagtaagtcaatgaaaagc

SEQ ID NO: 218895 - DNA, 75 bp, Artificial Sequence
  Synthetic
tcttttgcatctactttgtcagcgtacaaattattaaattcactaagtaaccggcccttatcgacctttaaaaac

SEQ ID NO: 218896 - DNA, 75 bp, Artificial Sequence
  Synthetic
aaaacatagtgaaggtgtcaagattccatggtcatggagaattctttccacagatttgtcctcactattatgctc

SEQ ID NO: 218897 - DNA, 75 bp, Artificial Sequence
  Synthetic
taatgaacctctctgaaatgagggcataaaaatctgatgtgttgtgtaatattccttgacccatgtcaagtattg

SEQ ID NO: 218898 - DNA, 75 bp, Artificial Sequence
  Synthetic
cttggtggcatgaggcaatcacttcctcataatgattagagcgattgtccgtcaggacatttaaactctccacac

SEQ ID NO: 218899 - DNA, 75 bp, Artificial Sequence
  Synthetic
ggaaaattaaattctgtaagacagtcaagaataaaaatggacacatcattgggccccacttactatgatccatgc

SEQ ID NO: 218900 - DNA, 75 bp, Artificial Sequence
  Synthetic
aaagaaaacttaagccttcctgtatcaggtcccactgagtcataagattgtggcgactcttggctataaaaacac

SEQ ID NO: 218901 - DNA, 75 bp, Artificial Sequence
  Synthetic
caccgggtgggtattgtctaacaagatggatgctgattgaggccgagttgaagtgctttgggaacacagcagttg

SEQ ID NO: 218902 - DNA, 75 bp, Artificial Sequence
  Synthetic
acgattgactatagagcagggtcctgtaagaggcacagaagacacaagaggcaattaaagacaattaaaatagat

SEQ ID NO: 218903 - DNA, 75 bp, Artificial Sequence
  Synthetic
ccggggatcctaggcatttaggattgcgctttaaagagatctttgtgtgactgagcttcatcaagccatgggaca

SEQ ID NO: 218904 - DNA, 75 bp, Artificial Sequence
  Synthetic
gtggtgactcttgactataaaaacataagttcttcagcattgctgtagtgcagtttgtcaatgacagggctttac

SEQ ID NO: 218905 - DNA, 75 bp, Artificial Sequence
  Synthetic
ctgagcttcatcaagccatgggacaaataataacattctttcaggaggttcctcatgttatagaagaggtgatga

SEQ ID NO: 218906 - DNA, 75 bp, Artificial Sequence
  Synthetic
atttcccttttcacttccttctccttaaatagtgaaccattgttaaaggaggacgtaaggagggataaatacttc

SEQ ID NO: 218907 - DNA, 75 bp, Artificial Sequence
  Synthetic
aataataacattctttcaggaggttcctcatgttatagaagaggtgatgaatattgtcctgattgctctcagcct

SEQ ID NO: 218908 - DNA, 75 bp, Artificial Sequence
  Synthetic
gccaagatgctggcttgtgtcaaatggttcctacctgaatgaaacacatttttctgatgacattgaacaacaagc

SEQ ID NO: 218909 - DNA, 75 bp, Artificial Sequence
  Synthetic
ggctgatctcctttcttcttctgtgtggaagatcatgctcaacaacctacaaaggtgtctatgagctacaaaccc

SEQ ID NO: 218910 - DNA, 75 bp, Artificial Sequence
  Synthetic
tggaagatcatgctcaacaacctacaaaggtgtctatgagctacaaaccctggagctggatatggcaaacctcaa

SEQ ID NO: 218911 - DNA, 75 bp, Artificial Sequence
  Synthetic
gacaggttccctatactgatcaacaattttttcaacagtttcctttagctgatcaaaataatcgcttgcacctcc

SEQ ID NO: 218912 - DNA, 75 bp, Artificial Sequence
  Synthetic
tggttgggaatgagacaggcctagaactgaccttaacaaacacaagtataatcaatcataagttctgcaaccttt

SEQ ID NO: 218913 - DNA, 75 bp, Artificial Sequence
  Synthetic
gattcaactgttttgtcttcagtgttatgttcacatccattggccttgcaagagtcaatctcaatgcaaagagat

SEQ ID NO: 218914 - DNA, 75 bp, Artificial Sequence
  Synthetic
actgaccttaacaaacacaagtataatcaatcataagttctgcaacctttctgatgcacacaaaaagaatcttta

SEQ ID NO: 218915 - DNA, 75 bp, Artificial Sequence
  Synthetic
acttcaatcagtatgaagcaatgagttgtgactttaatgaagggaaaataagtgtgcaatacaatctcagtcata

SEQ ID NO: 218916 - DNA, 75 bp, Artificial Sequence
  Synthetic
ttgtgactttaatgaagggaaaataagtgtgcaatacaatctcagtcatagttatgctatagatgcagccggcca

SEQ ID NO: 218917 - DNA, 75 bp, Artificial Sequence
  Synthetic
ggggcggcagttacatagcacttgattctggaaaagggaactgggattgcataatgacttcctatcagtacttga

SEQ ID NO: 218918 - DNA, 75 bp, Artificial Sequence
  Synthetic
actactcaatgtcctcaatgcattcatccttcctagttaactcctcacatgttctgcccttcagtctcaatctgc

SEQ ID NO: 218919 - DNA, 75 bp, Artificial Sequence
  Synthetic
ttctggaaaagggaactgggattgcataatgacttcctatcagtacttgattatccagaacaccacctgggaaga

SEQ ID NO: 218920 - DNA, 75 bp, Artificial Sequence
  Synthetic
aacagcacccccaaccggagcagcggacagcaccaaacccccaccctacagcccctgatcgacccaccgaccctc

SEQ ID NO: 218921 - DNA, 75 bp, Artificial Sequence
  Synthetic
tgaggtttcttgatttataatgggtgtaccttcccatgagtgtatttgcattcataatcaaaagtatggacttaa

SEQ ID NO: 218922 - DNA, 75 bp, Artificial Sequence
  Synthetic
atcctaggcaattcagctggacttcagtggtgaggtttttttctcttagtgaatccccaaatcaaagtacccagt

SEQ ID NO: 218923 - DNA, 75 bp, Artificial Sequence
  Synthetic
cacagagaactagagatatttatattagtcggagacttcttggaactttcacctggactctctctgactctgagg

SEQ ID NO: 218924 - DNA, 75 bp, Artificial Sequence
  Synthetic
tcaactgggacaccattagccacagattgatcaattatggtatcaattgtttctgccaattgatggggttctttg

SEQ ID NO: 218925 - DNA, 75 bp, Artificial Sequence
  Synthetic
ctggcaatactgaaagggatctacaatgttgctacctgtggcctttttggactggtatcctttctcctcttgtgt

SEQ ID NO: 218926 - DNA, 75 bp, Artificial Sequence
  Synthetic
gaactcttgacaatatgcttctttgcatctgaccacttgataccttgcgggtccaaattcattctgtcttaactt

SEQ ID NO: 218927 - DNA, 75 bp, Artificial Sequence
  Synthetic
tagtcggagacttcttggaactttcacctggactctctctgactctgagggcaatgaagcacccggtggatactg

SEQ ID NO: 218928 - DNA, 75 bp, Artificial Sequence
  Synthetic
tcaggagggataaatatttctttgaaacaccaggccttttatagtctggtcccttaacactagtgcatccatctt

SEQ ID NO: 218929 - DNA, 75 bp, Artificial Sequence
  Synthetic
cagccattgcaaagtgtaatgagaagcacgatgaggaattctgtgatatgttgagactttttgacttcaacaaac

SEQ ID NO: 218930 - DNA, 75 bp, Artificial Sequence
  Synthetic
gcacgatgaggaattctgtgatatgttgagactttttgacttcaacaaacaagccataaaaaggctaaaagcaga

SEQ ID NO: 218931 - DNA, 75 bp, Artificial Sequence
  Synthetic
atgaccagttgatcatgaagaaccacttgagggatatcatgggaattccttattgcaattacagcaagtactggt

SEQ ID NO: 218932 - DNA, 75 bp, Artificial Sequence
  Synthetic
tattgcaattacagcaagtactggtatctaaaccacactgtgacagggaagacatcattgccgaagtgttggctt

SEQ ID NO: 218933 - DNA, 75 bp, Artificial Sequence
  Synthetic
atcatctttgtcaaagatctgatgttgttcaactgcccttccagctcactgcaatcttctatccaagaaatcata

SEQ ID NO: 218934 - DNA, 75 bp, Artificial Sequence
  Synthetic
tccaccgttttagatctctttttgttgattccaatgaaactaatctatcattaacactcacaaaacaggagccca

SEQ ID NO: 218935 - DNA, 75 bp, Artificial Sequence
  Synthetic
acaggcaggggaaaacaccattagggttagtggatctttttgtcttcagcaccagcttttatctcataagtattt

SEQ ID NO: 218936 - DNA, 75 bp, Artificial Sequence
  Synthetic
tcttttaggatcagcataaaatgagcacacttcaccaactttgttatcattgatggcataacacttcgagcactc

SEQ ID NO: 218937 - DNA, 75 bp, Artificial Sequence
  Synthetic
gaccacttgataccttgcaggtccaaattcattctgtctcaactttacggtcgatgaggttttcatggagttcac

SEQ ID NO: 218938 - DNA, 75 bp, Artificial Sequence
  Synthetic
acatatgtccacaataaaagtacttcctcttcagcttgtcactctcatagacggcattacagaactctttgtaga

SEQ ID NO: 218939 - DNA, 75 bp, Artificial Sequence
  Synthetic
ccttgtgttcaatatcctcaaagatttcactttatttaggaatgatctccagcattgcacctgacattctccagt

SEQ ID NO: 218940 - DNA, 75 bp, Artificial Sequence
  Synthetic
gtccatttacaggacgactttgggacttgaagttctgaacaccatgtctcttgggagaacagccctcaagattgg

SEQ ID NO: 218941 - DNA, 75 bp, Artificial Sequence
  Synthetic
aagcacagtgtggagtgatctcctctttgcctcctctcttctttttctcaacgaccactccggtgtgcatgtgac

SEQ ID NO: 218942 - DNA, 75 bp, Artificial Sequence
  Synthetic
tgagattatttgacttcaacaaacaagccataaggagactgaaaacagaggcacaaatgaatatccaactgataa

SEQ ID NO: 218943 - DNA, 75 bp, Artificial Sequence
  Synthetic
tttgcctcctctcttctttttctcaacgaccactccggtgtgcatgtgacacaaatctttgcactggtcccagac

SEQ ID NO: 218944 - DNA, 75 bp, Artificial Sequence
  Synthetic
tgatcccaacatcctttaaagcagtggtggccttcaaaatggttttctggaatattgaattgagaatttggttct

SEQ ID NO: 218945 - DNA, 75 bp, Artificial Sequence
  Synthetic
aacaactccgtctcttccaggttgggtgccctgagccccaccaaccatgcctatcatgttcagcaatgctcttct

SEQ ID NO: 218946 - DNA, 75 bp, Artificial Sequence
  Synthetic
gcttgatgtcccttctcccctgagaatctaagagttttttaatgtcgtctgaaccttgacacgttaacaccatgt

SEQ ID NO: 218947 - DNA, 75 bp, Artificial Sequence
  Synthetic
ttccccatataaacacctgagcttagtggcctttctgttctaatgaccttcgactttagtttctctaagtcagct

SEQ ID NO: 218948 - DNA, 75 bp, Artificial Sequence
  Synthetic
aagagatctgtcacatcaatcccatgagaatatttggcatcttgtttgaactgttttaaatctgttggttctctg

SEQ ID NO: 218949 - DNA, 75 bp, Artificial Sequence
  Synthetic
agggtcttctggacgaccctcgatgtctatccaggttttggcgcttgggtcaagttgcatcattgaatctttgag

SEQ ID NO: 218950 - DNA, 75 bp, Artificial Sequence
  Synthetic
tctatccaggttttggcgcttgggtcaagttgcatcattgaatctttgagtgtcatcagttgagaataagttagc

SEQ ID NO: 218951 - DNA, 75 bp, Artificial Sequence
  Synthetic
cactttctgtggtttcccatctgactcaaggtccacagtggtattctcccaagctctacccacaatggaggttct

SEQ ID NO: 218952 - DNA, 75 bp, Artificial Sequence
  Synthetic
ggttcttgttaacctttaaaaactgaccttctatctcaccttttctcagtctgttcctaaacacttgatactcct

SEQ ID NO: 218953 - DNA, 75 bp, Artificial Sequence
  Synthetic
cctagggattgactggtcaaaagtttcactcagtaagtcaatgaaaggcgcaatccagtagcctaggatccactg

SEQ ID NO: 218954 - DNA, 75 bp, Artificial Sequence
  Synthetic
atcctaggcaattcagctggacttcagtggtgaggctcactttggtgaattcctgaattaaagtacctagtcaaa

SEQ ID NO: 218955 - DNA, 75 bp, Artificial Sequence
  Synthetic
tcaaggtccacagtggtattctcccaagctctacccacaatggaggttcttgaagctatgtagggccagccgtcc

SEQ ID NO: 218956 - DNA, 75 bp, Artificial Sequence
  Synthetic
aggtgtgtctgaaacaaacattcccagggaccttttcacctttagaatggacttcagaatgccatccattgtctg

SEQ ID NO: 218957 - DNA, 75 bp, Artificial Sequence
  Synthetic
atgggcaacagacaggccaaatcgacaaaagtcgatgaacatcaaagagctcatctagtgccagatgcatcccat

SEQ ID NO: 218958 - DNA, 75 bp, Artificial Sequence
  Synthetic
agggaccttttcacctttagaatggacttcagaatgccatccattgtctgaggcgtcaccttaatagtttccaac

SEQ ID NO: 218959 - DNA, 75 bp, Artificial Sequence
  Synthetic
acacaaaaggcaatcaaaaacaataaaattagacaattaaattagatagccttaatgcctaggatcctcggcgcg

SEQ ID NO: 218960 - DNA, 75 bp, Artificial Sequence
  Synthetic
cggggatcctaggcatttttggttgcgcaatccaagcatcccattcaaaatgggacaaatagtgacatttttcca

SEQ ID NO: 218961 - DNA, 75 bp, Artificial Sequence
  Synthetic
gtcataatccagaacacgggacccatctgtatacttattcacaacaacactcttattactggccaagtccaaagc

SEQ ID NO: 218962 - DNA, 75 bp, Artificial Sequence
  Synthetic
actaaaattatagccagaaatatttagggagctcttcttggtgtctaccatgtttaatatgggatggctctggga

SEQ ID NO: 218963 - DNA, 75 bp, Artificial Sequence
  Synthetic
gacccagtcaggtatttgttcattgtagaatgatgttctcccgtctataagtggtattaaattgatatcgacact

SEQ ID NO: 218964 - DNA, 75 bp, Artificial Sequence
  Synthetic
gtgatgaacattgttctcattgcactgtccatactagcagtgctgaagggtctgtacaactttgcaacatgtggc

SEQ ID NO: 218965 - DNA, 75 bp, Artificial Sequence
  Synthetic
cctgttggaaaccccgctgactgtaaagacttgttggacccagcagtgcccactttttgtggtttcccatctgac

SEQ ID NO: 218966 - DNA, 75 bp, Artificial Sequence
  Synthetic
gtcatttaagtcaacctgaccctgtttagtgagacatgctagtgttaaactaggcatggtgccaaattggttgtt

SEQ ID NO: 218967 - DNA, 75 bp, Artificial Sequence
  Synthetic
agggagctcttcttggtgtctaccatgtttaatatgggatggctctgggaaagtctatctaggtcagaactattg

SEQ ID NO: 218968 - DNA, 75 bp, Artificial Sequence
  Synthetic
ttagtgagacatgctagtgttaaactaggcatggtgccaaattggttgttgaggaggtccgggttttttacatcc

SEQ ID NO: 218969 - DNA, 75 bp, Artificial Sequence
  Synthetic
gatttactatagcaaagagcatagcctttgaaatcaatccattctccaagagattcaagaagttcactcagtata

SEQ ID NO: 218970 - DNA, 75 bp, Artificial Sequence
  Synthetic
gaccatgcctatcatactcaataacgccttcctctgctcaagttgttgtgtgctcaagtttcccatatacacacc

SEQ ID NO: 218971 - DNA, 75 bp, Artificial Sequence
  Synthetic
gccttcctctgctcaagttgttgtgtgctcaagtttcccatatacacaccagaactcaatggcctctctgtccta

SEQ ID NO: 218972 - DNA, 75 bp, Artificial Sequence
  Synthetic
gttacaagaatcaacctcaatgcagagggacaggagtttcaacccttctattaatagcatcctgggctctgtctg

SEQ ID NO: 218973 - DNA, 75 bp, Artificial Sequence
  Synthetic
gtctgaggtcagtgttccaactcttagaacactcttttgttgtgttgacttgagctcaacaagattgttaactgc

SEQ ID NO: 218974 - DNA, 75 bp, Artificial Sequence
  Synthetic
agaacactcttttgttgtgttgacttgagctcaacaagattgttaactgcctgatttaggtctctaagacgtttt

SEQ ID NO: 218975 - DNA, 75 bp, Artificial Sequence
  Synthetic
agttcactttgagacaggttctcgtaggaggcacataaaaacaagaggtaagaggtaattaaagacaatttaata

SEQ ID NO: 218976 - DNA, 75 bp, Artificial Sequence
  Synthetic
gacctcagagaaatcgaggccatgcagaagggcctgtgcatccttaaccacctggagttttatattagagcaata

SEQ ID NO: 218977 - DNA, 75 bp, Artificial Sequence
  Synthetic
ccttggaagcactcatcctggtcgatgttaattggaactcactggttgaaaatgttatccagtaaatcaacagta

SEQ ID NO: 218978 - DNA, 75 bp, Artificial Sequence
  Synthetic
tgttaattggaactcactggttgaaaatgttatccagtaaatcaacagtagtaagcgcaatctaaaagcctagga

SEQ ID NO: 218979 - DNA, 75 bp, Artificial Sequence
  Synthetic
ggatacttagctgtgtatattagacccaggtctgttagtgctaagacagcatcattcaaatcaacttgaccttgt

SEQ ID NO: 218980 - DNA, 75 bp, Artificial Sequence
  Synthetic
tgtggccttgttggtttggtcactttcctcctgttgtgtggtaggtcttgcacaaccagtctttataaaggggtt

SEQ ID NO: 218981 - DNA, 75 bp, Artificial Sequence
  Synthetic
ggggatcctaggcaatttagttggacttcactaagaagacttgtcttgtgagtttctggattgtgccacatagtc

SEQ ID NO: 218982 - DNA, 75 bp, Artificial Sequence
  Synthetic
ctcaccacattgattaacaagtcctgtcatgttgagatggatagaaaaagtctctttaaaactagcatcctgact

SEQ ID NO: 218983 - DNA, 75 bp, Artificial Sequence
  Synthetic
tatgagcttcagactctggaactaaacatggagacactcaatatgaccatgcctctctcctgcacaaagaacaac

SEQ ID NO: 218984 - DNA, 75 bp, Artificial Sequence
  Synthetic
agtttctggattgtgccacatagtcaagatgggcaacaggcaaaccaggccaactgaagccactgagcagagcag

SEQ ID NO: 218985 - DNA, 75 bp, Artificial Sequence
  Synthetic
aagatgggcaacaggcaaaccaggccaactgaagccactgagcagagcagggcccacttggtaccagatgcatcc

SEQ ID NO: 218986 - DNA, 75 bp, Artificial Sequence
  Synthetic
agtggagtgcaacaaccactacctgtgtctcaactgtctcagcttgctcctcagtgtcagcagcagatgtccaat

SEQ ID NO: 218987 - DNA, 75 bp, Artificial Sequence
  Synthetic
tgtctcaactgtctcagcttgctcctcagtgtcagcagcagatgtccaatctgcaagatgccccttcccaccagg

SEQ ID NO: 218988 - DNA, 75 bp, Artificial Sequence
  Synthetic
tattgggtttgggtttatgccagaatagcttgtgggtcagctagtggtgccccacaaagctcctacagaaatgag

SEQ ID NO: 218989 - DNA, 75 bp, Artificial Sequence
  Synthetic
caaagcacctccaccatacaccccataagcccaaggcccagctcccaatctccaccacccaccccccacccccgg

SEQ ID NO: 218990 - DNA, 75 bp, Artificial Sequence
  Synthetic
attttggattgcgcatttctagagccaacgaaaagagcacttcacccaagtatgggtcagatagtgacattcttt

SEQ ID NO: 218991 - DNA, 75 bp, Artificial Sequence
  Synthetic
tatgggtcagatagtgacattctttcaggaagttcctcatgtcattgaggaaattatgaacattgtcctcatcac

SEQ ID NO: 218992 - DNA, 75 bp, Artificial Sequence
  Synthetic
cggggatcctaggcaatttagctggacttcagtggtaaggctcattttagtgaatccctgagtcaagcacccagc

SEQ ID NO: 218993 - DNA, 75 bp, Artificial Sequence
  Synthetic
taagcccaaggcccagctcccaatctccaccacccaccccccacccccggggggaccccccgccgggggcccccc

SEQ ID NO: 218994 - DNA, 75 bp, Artificial Sequence
  Synthetic
tctctggttcgaacaattctgaacacgttctccccttgagtctaagactgcccccacttgattgaatcatcaccc

SEQ ID NO: 218995 - DNA, 75 bp, Artificial Sequence
  Synthetic
cgttctccccttgagtctaagactgcccccacttgattgaatcatcaccctctgtcttgacttactataacagag

SEQ ID NO: 218996 - DNA, 75 bp, Artificial Sequence
  Synthetic
tgagttgtgatacggccaatgctgtgagtttgttaaaatcataatttaatatcctagatccatctgtatatttat

SEQ ID NO: 218997 - DNA, 75 bp, Artificial Sequence
  Synthetic
tttcctctgtggaaggtcatgttcgatgacctacaaagggagttatcaacttgaaacccttgagctgaacatgga

SEQ ID NO: 218998 - DNA, 75 bp, Artificial Sequence
  Synthetic
cggggatcctaggcaattcagctggacttcagtggtgaggcttatcctagtgaatccctgaatcaaagcacctag

SEQ ID NO: 218999 - DNA, 75 bp, Artificial Sequence
  Synthetic
caggaagttcctcatgtcattgaggaaattatgaacattgtcctcatcaccttatctctgcttgcaatcttgaag

SEQ ID NO: 219000 - DNA, 75 bp, Artificial Sequence
  Synthetic
tcagtatatcaacataatccacaggcctctgttttgttaagatcgaaacaatgtcaacatttgtccactgaactc

SEQ ID NO: 219001 - DNA, 75 bp, Artificial Sequence
  Synthetic
caacctttccatatcaacaacaatttcaacaggggtcacatgccctagttgatttgtgtcaattaaaaactcatt

SEQ ID NO: 219002 - DNA, 75 bp, Artificial Sequence
  Synthetic
ctcagtgttagcagcagatgcccgatctgtaagatgccccttcctaccaagctgaagacagcagcacagccgagt

SEQ ID NO: 219003 - DNA, 75 bp, Artificial Sequence
  Synthetic
agggcttgagctgaccttaaccaatacaagcatcataaaccacaagttctgcaatctctctgatgcacacaaaaa

SEQ ID NO: 219004 - DNA, 75 bp, Artificial Sequence
  Synthetic
aaatgcttcgggaacacagctgtggcaaaatgtaatgagaagcatgatgaggaattttgtgacatgctgaggctg

SEQ ID NO: 219005 - DNA, 75 bp, Artificial Sequence
  Synthetic
cctctgttttgttaagatcgaaacaatgtcaacatttgtccactgaactctttgttttaatctatcagacatcat

SEQ ID NO: 219006 - DNA, 75 bp, Artificial Sequence
  Synthetic
tcacaaacacttccaaatcctgatcttgaatggatggcgtaaatgcagcaatcctcctgtcagactcccacagtg

SEQ ID NO: 219007 - DNA, 75 bp, Artificial Sequence
  Synthetic
ttgaatggatggcgtaaatgcagcaatcctcctgtcagactcccacagtgctcccctgcacacaaccaacggcac

SEQ ID NO: 219008 - DNA, 75 bp, Artificial Sequence
  Synthetic
aaaggttgaaagctgaagcacaaatgagcattcagttgatcaacaaagcagtaaatgctttgataaatgaccaac

SEQ ID NO: 219009 - DNA, 75 bp, Artificial Sequence
  Synthetic
agccatgagttgtgacttcaatggaggtaagattagcatccaatacaatttgagccacacctatgcaggagatgc

SEQ ID NO: 219010 - DNA, 75 bp, Artificial Sequence
  Synthetic
acaagcatcataaaccacaagttctgcaatctctctgatgcacacaaaaagaatctctacgaccactctctcatg

SEQ ID NO: 219011 - DNA, 75 bp, Artificial Sequence
  Synthetic
ggtaagattagcatccaatacaatttgagccacacctatgcaggagatgcagccaaacattgtggcactttggca

SEQ ID NO: 219012 - DNA, 75 bp, Artificial Sequence
  Synthetic
gcttgtctggatcaacaaccagcttcaggggtgtgacatctcccagttgttgtgtatcccttaagaactcattta

SEQ ID NO: 219013 - DNA, 75 bp, Artificial Sequence
  Synthetic
caggggtgtgacatctcccagttgttgtgtatcccttaagaactcatttattacatctgattcaacaaaccaagc

SEQ ID NO: 219014 - DNA, 75 bp, Artificial Sequence
  Synthetic
tgcacttgactcaggtcgaggaaactgggattgtataatgactagctaccaatacttaatcattcagaatacaac

SEQ ID NO: 219015 - DNA, 75 bp, Artificial Sequence
  Synthetic
tgggattgtataatgactagctaccaatacttaatcattcagaatacaacctgggaggaccattgtcaattttca

SEQ ID NO: 219016 - DNA, 75 bp, Artificial Sequence
  Synthetic
actagaaattatttcctcaaagtgttttgcacgcttgtcagttagaacattgatgctttcaattcctgagagcct

SEQ ID NO: 219017 - DNA, 75 bp, Artificial Sequence
  Synthetic
gcaggacacatggactcacagacccagagtacagtgcttgtacatcatttatcacaaattcaccatgttgattaa

SEQ ID NO: 219018 - DNA, 75 bp, Artificial Sequence
  Synthetic
cagcaaagaggtctgtgacatcaatcccatgtgagtatttagcatcttgcttgaactgctttaaatcagtaggct

SEQ ID NO: 219019 - DNA, 75 bp, Artificial Sequence
  Synthetic
aatttacatcagtagaagactgctaggaacatttacatggacattgtcagattctgaaggcaatgaaaatccagg

SEQ ID NO: 219020 - DNA, 75 bp, Artificial Sequence
  Synthetic
ggaacatttacatggacattgtcagattctgaaggcaatgaaaatccagggggttactgcttaaccagatggatg

SEQ ID NO: 219021 - DNA, 75 bp, Artificial Sequence
  Synthetic
cagaaggagtatatggagaggcaggggaagacaccattgggtctagttgacctctttgtgttcagcacaagtttc

SEQ ID NO: 219022 - DNA, 75 bp, Artificial Sequence
  Synthetic
ctgtctgataaaactgcacagaatcttttggcattgtactcaataagtcaagaaaatcctcaagggactcaagct

SEQ ID NO: 219023 - DNA, 75 bp, Artificial Sequence
  Synthetic
agagtacagtgcttgtacatcatttatcacaaattcaccatgttgattaatgaatcccttcatattgaggtggat

SEQ ID NO: 219024 - DNA, 75 bp, Artificial Sequence
  Synthetic
ttttggcattgtactcaataagtcaagaaaatcctcaagggactcaagcttcagctcctctgtcaagcctgaggc

SEQ ID NO: 219025 - DNA, 75 bp, Artificial Sequence
  Synthetic
tgtgacatgctgaggctttttgatttcaacaaacaagccattcagagattgaaggctgaggctcaaatgagtatt

SEQ ID NO: 219026 - DNA, 75 bp, Artificial Sequence
  Synthetic
ctaagttcaaccaatgaaaccccaagtcagaatcagacaaaggttcaatgcctagaagtttaaacaaattctgta

SEQ ID NO: 219027 - DNA, 75 bp, Artificial Sequence
  Synthetic
atgcatagcccatcatcaaatcaaatttaaacatgggtctttctatccccttgtaaatagctttctcaacaaatg

SEQ ID NO: 219028 - DNA, 75 bp, Artificial Sequence
  Synthetic
caccatatctctgggcagcactgctctcaaaaccgatgtgttcagtcctcctgacactgctgcatcaaacatgat

SEQ ID NO: 219029 - DNA, 75 bp, Artificial Sequence
  Synthetic
ctgcagggatttgttggaattgttgctgccagctttctgtggcttcccatctgattctagatcaacgacagtgtt

SEQ ID NO: 219030 - DNA, 75 bp, Artificial Sequence
  Synthetic
gaaaaatcatctcagagacattatgggcataccatattgcaactatagcaaatattggtatcttaatcatacgac

SEQ ID NO: 219031 - DNA, 75 bp, Artificial Sequence
  Synthetic
cgactctaggtgtcgatgttctgaacaccatatctctgggcagcactgctctcaaaaccgatgtgttcagtcctc

SEQ ID NO: 219032 - DNA, 75 bp, Artificial Sequence
  Synthetic
tttaaacatgggtctttctatccccttgtaaatagctttctcaacaaatgaggaaaagggacccagtcgctgcag

SEQ ID NO: 219033 - DNA, 75 bp, Artificial Sequence
  Synthetic
ccagagtccttgttgttgccacaaacgatcgaacatatgattcaaagtaaatttgtctcatgaagttgtctactg

SEQ ID NO: 219034 - DNA, 75 bp, Artificial Sequence
  Synthetic
cgatcgaacatatgattcaaagtaaatttgtctcatgaagttgtctactgcatcagcagtgctaaccactctttc

SEQ ID NO: 219035 - DNA, 75 bp, Artificial Sequence
  Synthetic
ggcataccatattgcaactatagcaaatattggtatcttaatcatacgaccacgggtagaacttcactaccaaga

SEQ ID NO: 219036 - DNA, 75 bp, Artificial Sequence
  Synthetic
cgacatagaacaacaagctgacaacatgataacagaaatgttgcagaaagagtacatcgatagacaaggaaagac

SEQ ID NO: 219037 - DNA, 75 bp, Artificial Sequence
  Synthetic
atgataacagaaatgttgcagaaagagtacatcgatagacaaggaaagaccccactaggcttggttgacttgttt

SEQ ID NO: 219038 - DNA, 75 bp, Artificial Sequence
  Synthetic
ccaacacaacataatgttcttctcttttccacttgacaatatgtgaaacaagtgagagtgcctcacagttcacat

SEQ ID NO: 219039 - DNA, 75 bp, Artificial Sequence
  Synthetic
tttccacttgacaatatgtgaaacaagtgagagtgcctcacagttcacatccagagcaacacagaggtcaagaaa

SEQ ID NO: 219040 - DNA, 75 bp, Artificial Sequence
  Synthetic
gataccaactcatagacacattgtaggtgggccatgccccaaacctcacaggctaaaccacaagggcatttgctc

SEQ ID NO: 219041 - DNA, 75 bp, Artificial Sequence
  Synthetic
ggtgggccatgccccaaacctcacaggctaaaccacaagggcatttgctcttgtgggctatataaacggccagga

SEQ ID NO: 219042 - DNA, 75 bp, Artificial Sequence
  Synthetic
tgacttgtgggtcaactggtggtgccccacaaaagctcctacagaaatgagagacaatatgcctaggatcctcgg

SEQ ID NO: 219043 - DNA, 75 bp, Artificial Sequence
  Synthetic
atggtaatatgtgtttctcaaatagagatggatataagcgtctcaaagagtgaataatgtggctcatgccaaccc

SEQ ID NO: 219044 - DNA, 75 bp, Artificial Sequence
  Synthetic
gcgcaccggggatcctaggcaatttgattgtgttttctgtggaactttacaacctgggcccatcaacatggggaa

SEQ ID NO: 219045 - DNA, 75 bp, Artificial Sequence
  Synthetic
aacctgggcccatcaacatggggaacagacaagccaaaaatccagaggtggagaacagcccaagggctagtctaa

SEQ ID NO: 219046 - DNA, 75 bp, Artificial Sequence
  Synthetic
cgccaaatggcggtgggtcacgggggcgtccatttacaggacgactctgggtgttgaagttctaaagaccatgtc

SEQ ID NO: 219047 - DNA, 75 bp, Artificial Sequence
  Synthetic
catcaccttcccctttgacttactataacagagagcataacccttgaactccacccagttgtccactgcctcaag

SEQ ID NO: 219048 - DNA, 75 bp, Artificial Sequence
  Synthetic
gagggaaccaagtgaatgacccaagtgttcttgttgttgctacaaaagagcggacatatgattcaaagtagattt

SEQ ID NO: 219049 - DNA, 75 bp, Artificial Sequence
  Synthetic
cctgagcttgtttaggttctccgagtacccatgctccaagctctatagctgtagacagtgttatgcacatataat

SEQ ID NO: 219050 - DNA, 75 bp, Artificial Sequence
  Synthetic
agcatttgggtcaagttgcagcattgcatccttgagggtcatcagctgagaataggtaagcccagcggtaaaccc

SEQ ID NO: 219051 - DNA, 75 bp, Artificial Sequence
  Synthetic
ataaccactatctttgcctcaactgcctctccttgcttttaagcgtcagcaacaggtgccctatctgcaagatgc

SEQ ID NO: 219052 - DNA, 75 bp, Artificial Sequence
  Synthetic
tagtgcacaatgtggtgttatctcctccttgccacctttcttcttcttctcaactacgatgcctgtgtgcatgtg

SEQ ID NO: 219053 - DNA, 75 bp, Artificial Sequence
  Synthetic
cagacaagccaaaaatccagaggtggagaacagcccaagggctagtctaattccggatgccacgcaccttgggcc

SEQ ID NO: 219054 - DNA, 75 bp, Artificial Sequence
  Synthetic
cctctccttgcttttaagcgtcagcaacaggtgccctatctgcaagatgccccttcccacgaggctgagaccgac

SEQ ID NO: 219055 - DNA, 75 bp, Artificial Sequence
  Synthetic
ggattccattatcccccatcactgcctcaacaccttgagtttctaacaactgagactgtatggatctaatgtaga

SEQ ID NO: 219056 - DNA, 75 bp, Artificial Sequence
  Synthetic
tacccatgctccaagctctatagctgtagacagtgttatgcacatataatcccataggaggggtctcagataagt

SEQ ID NO: 219057 - DNA, 75 bp, Artificial Sequence
  Synthetic
cgccatacacaccctaacccacccaacacacaccacaaccaacacctccccccgacaccccccggggggaccccc

SEQ ID NO: 219058 - DNA, 75 bp, Artificial Sequence
  Synthetic
caaccttatatcctttctcccttgcgactctaggagtttcttgatatcctccgacccctggcatgtgataaccat

SEQ ID NO: 219059 - DNA, 75 bp, Artificial Sequence
  Synthetic
acacacaccacaaccaacacctccccccgacaccccccggggggaccccccgccgggggcccccccgggggaggc

SEQ ID NO: 219060 - DNA, 75 bp, Artificial Sequence
  Synthetic
ctcaacaccttgagtttctaacaactgagactgtatggatctaatgtagagattctccctgttaggacctctaac

SEQ ID NO: 219061 - DNA, 75 bp, Artificial Sequence
  Synthetic
agctttggaaggcagacttatttattgcttcagacaacaatttctgagcccctctggtgaatgttgatgacaatc

SEQ ID NO: 219062 - DNA, 75 bp, Artificial Sequence
  Synthetic
tgcttcagacaacaatttctgagcccctctggtgaatgttgatgacaatctattctgcagagtcttcactattgt

SEQ ID NO: 219063 - DNA, 75 bp, Artificial Sequence
  Synthetic
agcaactcttcgcatgttctgcctttcaatcttaatttcccaccactagattgtatcatgaccctcctctttgac

SEQ ID NO: 219064 - DNA, 75 bp, Artificial Sequence
  Synthetic
atgtgagtatttagcatcttgtttgaactgctttagatcagtcggttctctgaagaagtggatgtaacaacctga

SEQ ID NO: 219065 - DNA, 75 bp, Artificial Sequence
  Synthetic
tgactttgagtcagcctgtctaagtctgaagtgttgggatactttgctgtgtagatcaaacccaaatctgtcaat

SEQ ID NO: 219066 - DNA, 75 bp, Artificial Sequence
  Synthetic
tcaatcttaatttcccaccactagattgtatcatgaccctcctctttgacttactgaaacacaatgcatagcctt

SEQ ID NO: 219067 - DNA, 75 bp, Artificial Sequence
  Synthetic
gtcgcaacaccatcctaagtggataatgggttgccaggttcagccaatgaaactctagatcagaattggacaggg

SEQ ID NO: 219068 - DNA, 75 bp, Artificial Sequence
  Synthetic
acagtatcacctccatctttgacttctggtgaaactttccatatctggattccattgtcccccatcactgcttca

SEQ ID NO: 219069 - DNA, 75 bp, Artificial Sequence
  Synthetic
aggccgtccttaggcatgaccttcttcaacacagacacgatgtccactcctgaccattgcattctcaattttaat

SEQ ID NO: 219070 - DNA, 75 bp, Artificial Sequence
  Synthetic
gtccagttgcaacatagaatctttgagagtcatgagctgggagtaggtcagtcctgctgggaagccagctgactg

SEQ ID NO: 219071 - DNA, 75 bp, Artificial Sequence
  Synthetic
ctggtgaaactttccatatctggattccattgtcccccatcactgcttcaacaccttgagtccctagtagctgag

SEQ ID NO: 219072 - DNA, 75 bp, Artificial Sequence
  Synthetic
tcaacacagacacgatgtccactcctgaccattgcattctcaattttaatctgtcaagcatcatagcactcaatg

SEQ ID NO: 219073 - DNA, 75 bp, Artificial Sequence
  Synthetic
cttcatgaagctcaccggtttttaatttattaaacaatatccgaagcattgacctcattcttttacatgcatcag

SEQ ID NO: 219074 - DNA, 75 bp, Artificial Sequence
  Synthetic
gtttcctttgtaataaagtggcacatgtaagaaatgttcaaaatgaatttaaacctattggtcatcatgctcttt

SEQ ID NO: 219075 - DNA, 75 bp, Artificial Sequence
  Synthetic
tcaagatcctggtcctgcaaaacagggctaaaagaagctagtcttttgttacactcccacaacccacctctatgt

SEQ ID NO: 219076 - DNA, 75 bp, Artificial Sequence
  Synthetic
ccaggctctaccagtgattgaggtccttgacgcaatgtaaggccacccatctcctgataggcagattttgtatag

SEQ ID NO: 219077 - DNA, 75 bp, Artificial Sequence
  Synthetic
ggctaaaagaagctagtcttttgttacactcccacaacccacctctatgtacaaccagaggaatcgcctcagagc

SEQ ID NO: 219078 - DNA, 75 bp, Artificial Sequence
  Synthetic
tttattaaacaatatccgaagcattgacctcattcttttacatgcatcaggaaccaatctttcaatttgcctcat

SEQ ID NO: 219079 - DNA, 75 bp, Artificial Sequence
  Synthetic
aatttaagaggaatggatctatagggtacttagcataacacaacaagctcaatgttctcttttgaatctgattgc

SEQ ID NO: 219080 - DNA, 75 bp, Artificial Sequence
  Synthetic
ttgctacctagtgttctgcacaaccccacaaacccagatgctatagaactttggaaagctgatttatttattgct

SEQ ID NO: 219081 - DNA, 75 bp, Artificial Sequence
  Synthetic
ttgttgaccgcttgatttaggtccctcaaccgtttcaaatcattgtcatcccttctctccttgcgcatcaaccgt

SEQ ID NO: 219082 - DNA, 75 bp, Artificial Sequence
  Synthetic
tcaataacaatttcaacaggtgtgacctctcccaattggtttgtatcactcatgaactcattgattgcttcagtg

SEQ ID NO: 219083 - DNA, 75 bp, Artificial Sequence
  Synthetic
cgatttcaagatcccatctatagattggggtgaaaccttgattgtctccagcatgttgccaccatctagcataca

SEQ ID NO: 219084 - DNA, 75 bp, Artificial Sequence
  Synthetic
ttgagttgattttaattcaacaagattgttgaccgcttgatttaggtccctcaaccgtttcaaatcattgtcatc

SEQ ID NO: 219085 - DNA, 75 bp, Artificial Sequence
  Synthetic
ccttacactttatattgtgcaaagccgcagcaacaaattttgttagtaaaggcacctcatcaccccagacataaa

SEQ ID NO: 219086 - DNA, 75 bp, Artificial Sequence
  Synthetic
atctttcaccacctgtagtttgatgttggagcagtaaccagataattccctcctcaaagattgtgtccacaaaaa

SEQ ID NO: 219087 - DNA, 75 bp, Artificial Sequence
  Synthetic
ttggagcagtaaccagataattccctcctcaaagattgtgtccacaaaaaggattttatttcctttgaggcactc

SEQ ID NO: 219088 - DNA, 75 bp, Artificial Sequence
  Synthetic
ataggacatgaattcattggccctacataaaaatatttacttctcaaagtagcatcattgtagatattctcacaa

SEQ ID NO: 219089 - DNA, 75 bp, Artificial Sequence
  Synthetic
gagtttactgcaccagagtacatgaccgctacatcttgaaccaaatatttgccttgctcattcattgaaccgaca

SEQ ID NO: 219090 - DNA, 75 bp, Artificial Sequence
  Synthetic
atcgccagattgttgtgttgtatgcacacaacaaagaactgagactatctgccaaaatgacaaaagcaaagcgca

SEQ ID NO: 219091 - DNA, 75 bp, Artificial Sequence
  Synthetic
tgtaatagtgaaactctaacagtgttttgaactcctcttcatctcttgagagtaattgtgtcaagttctgatcaa

SEQ ID NO: 219092 - DNA, 75 bp, Artificial Sequence
  Synthetic
catgtttagtataggatgactctgggaaagtctatctaagtcagatgaatttgggtacttcgcggtgtaaatcag

SEQ ID NO: 219093 - DNA, 75 bp, Artificial Sequence
  Synthetic
gtggatctttgctgatacttcattctgcactcaaagccgcatccggcaagagtcatggggaaaacgcagtccaag

SEQ ID NO: 219094 - DNA, 75 bp, Artificial Sequence
  Synthetic
tgcactcaaagccgcatccggcaagagtcatggggaaaacgcagtccaagggacagcccagcacaaatctcctca

SEQ ID NO: 219095 - DNA, 75 bp, Artificial Sequence
  Synthetic
agtcatggggaaaacgcagtccaagggacagcccagcacaaatctcctcaaggagacagaaccaaggcatccagt

SEQ ID NO: 219096 - DNA, 75 bp, Artificial Sequence
  Synthetic
aactttacggatcctgggggtagtgactcaatggcatcaaagaagtcttcaagcgaatcaaatttagaactaacc

SEQ ID NO: 219097 - DNA, 75 bp, Artificial Sequence
  Synthetic
acttggcattgtcccaaactgattatttaatagttctggatttctcacgtcccagacccttacgataccatccct

SEQ ID NO: 219098 - DNA, 75 bp, Artificial Sequence
  Synthetic
gcacctcagttggtcgaagtattctgatgctcctccatccaatagtatctcatctagatcagcattgttggtgtc

SEQ ID NO: 219099 - DNA, 75 bp, Artificial Sequence
  Synthetic
atcaaatcatacttgaacattggcctttcaattcctttatagataaccttctccacaaatgaagagaatgggccc

SEQ ID NO: 219100 - DNA, 75 bp, Artificial Sequence
  Synthetic
tcgaaaggagggggttagtcaggtgcaacgatcactacctatgtttgaactgtcttacacttttacacacagtgt

SEQ ID NO: 219101 - DNA, 75 bp, Artificial Sequence
  Synthetic
ggtgctcaggttccccatgtaaactcctgaactcaacggcctttcagtgcgaattacctttgattttaacttctc

SEQ ID NO: 219102 - DNA, 75 bp, Artificial Sequence
  Synthetic
taaatctttcagagatcaatgcatagaaatctgaggtgttatgcagtatgccttggcccatatcaagaattgaac

SEQ ID NO: 219103 - DNA, 75 bp, Artificial Sequence
  Synthetic
actcaatggcatcaaagaagtcttcaagcgaatcaaatttagaactaaccaatcctgatgcaatcagttggttat

SEQ ID NO: 219104 - DNA, 75 bp, Artificial Sequence
  Synthetic
tttcaattcctttatagataaccttctccacaaatgaagagaatgggcccaatctttgtaatccctcaccctctg

SEQ ID NO: 219105 - DNA, 75 bp, Artificial Sequence
  Synthetic
gtagccacaaatgatctcacgtaagattcaaagtagatttgcctcatgaagttgtcaactgcatcactagtactc

SEQ ID NO: 219106 - DNA, 75 bp, Artificial Sequence
  Synthetic
tttcagctcgacaaggttattgactgcctgatttaagtctctgaggcgtttcaggtcactatcatccctattctg

SEQ ID NO: 219107 - DNA, 75 bp, Artificial Sequence
  Synthetic
tttcagctcgacaaggttattgactgcctgatttaagtctctgaggcgtttcaggtcactatcatcccttttctg

SEQ ID NO: 219108 - DNA, 75 bp, Artificial Sequence
  Synthetic
tttcagctcgacaaggttattgactgcctgatttaagtctctgaggcgtttcaggtcactatcatccctcttctg

SEQ ID NO: 219109 - DNA, 75 bp, Artificial Sequence
  Synthetic
tttcagctcgacaaggttattgactgcctgatttaagtctctgaggcgtttcaggtcactatcatccctgttctg

SEQ ID NO: 219110 - DNA, 75 bp, Artificial Sequence
  Synthetic
attcaaagtagatttgcctcatgaagttgtcaactgcatcactagtactcacaactctttcttcaaccatgggtt

SEQ ID NO: 219111 - DNA, 75 bp, Artificial Sequence
  Synthetic
tcagcctgcaggtcatcagaaagtaaaatcagattttgaataattgttaggaatagaaagggacacatcattgga

SEQ ID NO: 219112 - DNA, 75 bp, Artificial Sequence
  Synthetic
aaatcagattttgaataattgttaggaatagaaagggacacatcattggaccccacttactgtgatccatgctat

SEQ ID NO: 219113 - DNA, 75 bp, Artificial Sequence
  Synthetic
gcctccctcttaatctaaacttcccctctgaagactggatcatcagtgaagcctgcgatctactgtagcagagac

SEQ ID NO: 219114 - DNA, 75 bp, Artificial Sequence
  Synthetic
tgttcttcccttttccatttgactatgtgtgacacaagagacaaagcctcacaattcacatccagtgccacacag

SEQ ID NO: 219115 - DNA, 75 bp, Artificial Sequence
  Synthetic
cacttgtaattttatgttggagcagtagccggatagctctcttctcagagactgagtccataggaatgacttcac

SEQ ID NO: 219116 - DNA, 75 bp, Artificial Sequence
  Synthetic
tgtgtgacacaagagacaaagcctcacaattcacatccagtgccacacagagatctaggaattttatcctgggtg

SEQ ID NO: 219117 - DNA, 75 bp, Artificial Sequence
  Synthetic
tcgaattctttctcattgtttaggcagctgcctgtcaattgtgatgtaagtgcctcaaagtaatcctcgatgagc

SEQ ID NO: 219118 - DNA, 75 bp, Artificial Sequence
  Synthetic
ttctttcgaagcgctcattgttgtcaccaaactgtgggtcttagtgcacttgggctcacaaggatgaatagcact

SEQ ID NO: 219119 - DNA, 75 bp, Artificial Sequence
  Synthetic
tgcatcgtcccacaacccctataatatcaagttgtagccagtgtagtccttggtccattctggatctcagcatct

SEQ ID NO: 219120 - DNA, 75 bp, Artificial Sequence
  Synthetic
atcaagttgtagccagtgtagtccttggtccattctggatctcagcatcttgctcaaagatctctccaagatttc

SEQ ID NO: 219121 - DNA, 75 bp, Artificial Sequence
  Synthetic
ttttcaaacattgaagggtatagccttcttaaagaatgaatgatgtgattgacacccactctatcttcaagtaat

SEQ ID NO: 219122 - DNA, 75 bp, Artificial Sequence
  Synthetic
aggaagccatggaagatgaggttgccactgtcaaagacttagtggcaaaatacttggctgacaatgagaagttat

SEQ ID NO: 219123 - DNA, 75 bp, Artificial Sequence
  Synthetic
gagaattttagtctaccggtgtcaggaccagttgaattgtaagactgaggtgactcttgactataaaaacataga

SEQ ID NO: 219124 - DNA, 75 bp, Artificial Sequence
  Synthetic
ttcttaaagaatgaatgatgtgattgacacccactctatcttcaagtaattttgatgcggtcggcttcaaaggga

SEQ ID NO: 219125 - DNA, 75 bp, Artificial Sequence
  Synthetic
ggatgttggggttgaagggcaggagtttcctggtcccttcaataaggtatcctgagtcaacaactaaggggattt

SEQ ID NO: 219126 - DNA, 75 bp, Artificial Sequence
  Synthetic
tttcctggtcccttcaataaggtatcctgagtcaacaactaaggggatttcaacatgctcaggccctatatgcgt

SEQ ID NO: 219127 - DNA, 75 bp, Artificial Sequence
  Synthetic
ggttcccccaagacccatgcacccaattctattgcggttgataaagatatgcacatataatcccacagcagtggt

SEQ ID NO: 219128 - DNA, 75 bp, Artificial Sequence
  Synthetic
tctgtattgaactcgactcatgtaacgcaaatgggtgtgaacacaacacagaggacaaatccgtagaaaatatcc

SEQ ID NO: 219129 - DNA, 75 bp, Artificial Sequence
  Synthetic
cttattctgacatcgtcagccaatttccctgtgtcaaacttaaaatttagacatttgcttttataatgggaatat

SEQ ID NO: 219130 - DNA, 75 bp, Artificial Sequence
  Synthetic
attctattgcggttgataaagatatgcacatataatcccacagcagtggtctaaaataaccagctacactaatct

SEQ ID NO: 219131 - DNA, 75 bp, Artificial Sequence
  Synthetic
agggtatcacatcaggaatgggggaactatccctcaagtagtcacaaatattttcagtggacagcaaccaaattg

SEQ ID NO: 219132 - DNA, 75 bp, Artificial Sequence
  Synthetic
actatccctcaagtagtcacaaatattttcagtggacagcaaccaaattgatgtggtttcccttttaaaccatgt

SEQ ID NO: 219133 - DNA, 75 bp, Artificial Sequence
  Synthetic
tttgttaagagctcaataccctgagtattagagattaatgactgaatagacttgatgtaaagattttctttattt

SEQ ID NO: 219134 - DNA, 75 bp, Artificial Sequence
  Synthetic
tcattttactggagtgctttgtaagatcctcaccagctaactttgaacaaaagtatactgaagatctcacaaaac

SEQ ID NO: 219135 - DNA, 75 bp, Artificial Sequence
  Synthetic
gtccttgttaccactgcctttgtcaactctcctataggacaagaattcattgatcctgtgtaaaagtatttgtct

SEQ ID NO: 219136 - DNA, 75 bp, Artificial Sequence
  Synthetic
tattagagattaatgactgaatagacttgatgtaaagattttctttatttggcccccggacacatttactaccca

SEQ ID NO: 219137 - DNA, 75 bp, Artificial Sequence
  Synthetic
taccactgtaagttacatcaagggaatgaggcttgaataatccaccttccaacaccacccctttgaaaaggaggt

SEQ ID NO: 219138 - DNA, 75 bp, Artificial Sequence
  Synthetic
atgaggcttgaataatccaccttccaacaccacccctttgaaaaggaggtggagactaaatttctctttcaatga

SEQ ID NO: 219139 - DNA, 75 bp, Artificial Sequence
  Synthetic
gatttgtttatggcttctgatagcagtttctgtgccccccgagtgaaggtagatgacaacttgttctgaattgtt

SEQ ID NO: 219140 - DNA, 75 bp, Artificial Sequence
  Synthetic
acaatgagcaaatccctgattgggttaatgataaattaagagagacactattctcattattgcgatttgctcaag

SEQ ID NO: 219141 - DNA, 75 bp, Artificial Sequence
  Synthetic
tcttctatcatgtggttggagagttcactcttgatcaatcttatgaagagcttttcctccaccaccttgtcaagg

SEQ ID NO: 219142 - DNA, 75 bp, Artificial Sequence
  Synthetic
gtttctgtgccccccgagtgaaggtagatgacaacttgttctgaattgttttgacaattgtggggattttttcat

SEQ ID NO: 219143 - DNA, 75 bp, Artificial Sequence
  Synthetic
tcccaacactgaggtcggcaaaagcttcaagcagctcacttaccgactcaaagacgtgctgctcggttaatcctg

SEQ ID NO: 219144 - DNA, 75 bp, Artificial Sequence
  Synthetic
ttcaagcagctcacttaccgactcaaagacgtgctgctcggttaatcctgatgctatgagctgtcctaagtttag

SEQ ID NO: 219145 - DNA, 75 bp, Artificial Sequence
  Synthetic
cttagagggtggtaagcagccaggttcagccatgagaactctaagtcagattctgatggggggtcaacatctaaa

SEQ ID NO: 219146 - DNA, 75 bp, Artificial Sequence
  Synthetic
ctggtgtggagagcctaaatgtcttgacagacaaccgcactgaccattatgaagatataattgctctttgccatc

SEQ ID NO: 219147 - DNA, 75 bp, Artificial Sequence
  Synthetic
tcaacagtgcatcttaggtggtcaaagtattctgatgctcctccatctagtagtatctcatcaagatcagtgtta

SEQ ID NO: 219148 - DNA, 75 bp, Artificial Sequence
  Synthetic
tcagccatgagaactctaagtcagattctgatggggggtcaacatctaaaatgatacacaaattcttgagtgatg

SEQ ID NO: 219149 - DNA, 75 bp, Artificial Sequence
  Synthetic
catgcctgtacatgggtctttcaacacccttataaataaccttttctataaaagaagaaaaggggccgaggttgt

SEQ ID NO: 219150 - DNA, 75 bp, Artificial Sequence
  Synthetic
acaaaaaatctagatttaaactctgcaacaaatctgccaatgacacttttagggctcacaaacttattgagttga

SEQ ID NO: 219151 - DNA, 75 bp, Artificial Sequence
  Synthetic
acccttataaataaccttttctataaaagaagaaaaggggccgaggttgtcaagcccttccgactcaggaattga

SEQ ID NO: 219152 - DNA, 75 bp, Artificial Sequence
  Synthetic
ccagtcttcagcttgttgaacaatttcctcagcatagatctaatcttaccacatgcctcaggtattaagctttct

SEQ ID NO: 219153 - DNA, 75 bp, Artificial Sequence
  Synthetic
tgtttgtttagcagatatttgcctttgcgtgcgaacacctctgttaattgtgtgacagccaatgctgtcaacttg

SEQ ID NO: 219154 - DNA, 75 bp, Artificial Sequence
  Synthetic
gaattagacaaggggaggtggagtgtcagtttgtcaaggtggaaaaaggggaactgatgtgcaaattcaacaatc

SEQ ID NO: 219155 - DNA, 75 bp, Artificial Sequence
  Synthetic
cgaatggtctgatgaaggactcaaagtagatttgtctcaggaaattttgtaccacatcataagtggtcaccaccc

SEQ ID NO: 219156 - DNA, 75 bp, Artificial Sequence
  Synthetic
gtagatttgtctcaggaaattttgtaccacatcataagtggtcaccaccctttcatccgtgattgggagatgaga

SEQ ID NO: 219157 - DNA, 75 bp, Artificial Sequence
  Synthetic
gggtcaataggatatctagcatactgcaagagactcaaagttctcagctgaatcagattgcataggtgaacaggg

SEQ ID NO: 219158 - DNA, 75 bp, Artificial Sequence
  Synthetic
ttttgaggtttctgtatgcggacttggatactgaagaatccaaaggtccaactgtagactggtgtcaaatgcaat

SEQ ID NO: 219159 - DNA, 75 bp, Artificial Sequence
  Synthetic
aaagctgtagcacaaccacttgtaataagggggtctagcagtgccttttttacttcttttcccttgaatagagag

SEQ ID NO: 219160 - DNA, 75 bp, Artificial Sequence
  Synthetic
tcctcagcatagatctaatcttaccacatgcctcaggtattaagctttctatttgtctcataattctgtaactac

SEQ ID NO: 219161 - DNA, 75 bp, Artificial Sequence
  Synthetic
ctctcttccacttgacaacatgagaaattaatgacattgcctcacaattcacatctagaaccacacaaagatcaa

SEQ ID NO: 219162 - DNA, 75 bp, Artificial Sequence
  Synthetic
aattaatgacattgcctcacaattcacatctagaaccacacaaagatcaagaaacttaatccttggtgtccacct

SEQ ID NO: 219163 - DNA, 75 bp, Artificial Sequence
  Synthetic
ttgtgtagggccgcagcaacaaattttgtcaataaaggaacttcatccccccatacatagaatctagatttaaac

SEQ ID NO: 219164 - DNA, 75 bp, Artificial Sequence
  Synthetic
acacaatgatactccttgcaagcataaatgatcaggtgaaatgcagaggcaggagctcaaaagggtggcttggtt

SEQ ID NO: 219165 - DNA, 75 bp, Artificial Sequence
  Synthetic
gcatctgtacaagattctttacttaggaactttctcgcattgtagatcatttcatgaagctcttcttctgacgca

SEQ ID NO: 219166 - DNA, 75 bp, Artificial Sequence
  Synthetic
ctgctgctgtctttctggttgctccctatactgactgataatattatcaacagtgcacctcagttggtcaaagta

SEQ ID NO: 219167 - DNA, 75 bp, Artificial Sequence
  Synthetic
atagagatgggtaaagtcttctgaatgagtgaataatatggttaaaccccaccttgtcttccaagagttttgtgg

SEQ ID NO: 219168 - DNA, 75 bp, Artificial Sequence
  Synthetic
tgagtgaataatatggttaaaccccaccttgtcttccaagagttttgtggtagtgggcttcattgggaaatagtc

SEQ ID NO: 219169 - DNA, 75 bp, Artificial Sequence
  Synthetic
tccaataatgtcttgaattcctctggatctctttgcataaggtctgttaagtcctggttaaaaagagatatttga

SEQ ID NO: 219170 - DNA, 75 bp, Artificial Sequence
  Synthetic
ggaggcagcaacttgaggtttccaagtcgtccacactggtgtgtagaaatgagattctgaggtcagtgattcaaa

SEQ ID NO: 219171 - DNA, 75 bp, Artificial Sequence
  Synthetic
tcagtcaatctgtcaggtgtttctttagtaatgaaatgacacatgtatgagatgttcaagacaaacttgaaccta

SEQ ID NO: 219172 - DNA, 75 bp, Artificial Sequence
  Synthetic
ttgtcaataaaggaacttcatccccccatacatagaatctagatttaaactctgcgacaaatctaccaacaacac

SEQ ID NO: 219173 - DNA, 75 bp, Artificial Sequence
  Synthetic
ccaacacccaggaacccagctcaagtgatgtagataaggctatgcagaagtaatcccaaaggacaggtctcaaga

SEQ ID NO: 219174 - DNA, 75 bp, Artificial Sequence
  Synthetic
tgatgtagataaggctatgcagaagtaatcccaaaggacaggtctcaagaaacctaacgcttcctcagctgcctt

SEQ ID NO: 219175 - DNA, 75 bp, Artificial Sequence
  Synthetic
ataagagcatagaagtctgatgtgttgtgcagtataccctgacccatgtcaagtatggagctaacatgagagggt

SEQ ID NO: 219176 - DNA, 75 bp, Artificial Sequence
  Synthetic
tgtttgactgcaatgtttatgattcgatattaaaacttgatgtttcaggggtgaccccaacaattagttaccaaa

SEQ ID NO: 219177 - DNA, 75 bp, Artificial Sequence
  Synthetic
tcaacctctgtaattaaatcctctctaattttgtcaattaggtccttgtggtgaaaatcagacacaaatgccatc

SEQ ID NO: 219178 - DNA, 75 bp, Artificial Sequence
  Synthetic
gatctctttgcataaggtctgttaagtcctggttaaaaagagatatttgatcatcacttgaagtgtaagcatcta

SEQ ID NO: 219179 - DNA, 75 bp, Artificial Sequence
  Synthetic
tggaaacagaatccaatgctgacagtcttgaaactaatgattttatataggcggtggacctatctgagaatcgaa

SEQ ID NO: 219180 - DNA, 75 bp, Artificial Sequence
  Synthetic
tcttgaaactaatgattttatataggcggtggacctatctgagaatcgaacacatttgctacctagtgtcttgca

SEQ ID NO: 219181 - DNA, 75 bp, Artificial Sequence
  Synthetic
tgggcttttatgaatgatttcatcatggctgacacaacattaaaaggtatctcaaccattttgtgcatatgccat

SEQ ID NO: 219182 - DNA, 75 bp, Artificial Sequence
  Synthetic
cctctttgagtttagctttagtaaattctatgaagacctcttcgactgtgaagataaggcagaatgaacatggag

SEQ ID NO: 219183 - DNA, 75 bp, Artificial Sequence
  Synthetic
ttggtcaacagtttgatggtgaccagctgttcagataattctgagcactcttctatccagctgaccataacattg

SEQ ID NO: 219184 - DNA, 75 bp, Artificial Sequence
  Synthetic
tgtgcagtataccctgacccatgtcaagtatggagctaacatgagagggtaccacaccaacctgaaagttagagt

SEQ ID NO: 219185 - DNA, 75 bp, Artificial Sequence
  Synthetic
cggcttcacagagcaacttttgtgcccctcttgtgaaattagaggataacttgctttgcaatgttttcaccaagg

SEQ ID NO: 219186 - DNA, 75 bp, Artificial Sequence
  Synthetic
ccctcttgtgaaattagaggataacttgctttgcaatgttttcaccaaggtaggcagtttttcttccccgagttc

SEQ ID NO: 219187 - DNA, 75 bp, Artificial Sequence
  Synthetic
aaaacagctaaaaacaagaatggacacatcataggaccccatttactatgatccatgctgtaggagacgtgtgcc

SEQ ID NO: 219188 - DNA, 75 bp, Artificial Sequence
  Synthetic
tactctatcagaaaacaggtgagtgctcaaagtgttatgcagttaacaatgatgcggttggtgaggtctgctcat

SEQ ID NO: 219189 - DNA, 75 bp, Artificial Sequence
  Synthetic
tcaccaactacattgttgttgatagcataacactttgaacattcacctgtcttctgatatagcaatttaaatcct

SEQ ID NO: 219190 - DNA, 75 bp, Artificial Sequence
  Synthetic
ctccgtggctgtatctgcagggttagtgctcacatgaccaaatctcacctttggttccagaaacttttcaaaaca

SEQ ID NO: 219191 - DNA, 75 bp, Artificial Sequence
  Synthetic
gatgagttgtcaaattaagccaacacaccgataaatcctcttctgagagggtgtcatcaccaacaaggctggtaa

SEQ ID NO: 219192 - DNA, 75 bp, Artificial Sequence
  Synthetic
caccgataaatcctcttctgagagggtgtcatcaccaacaaggctggtaagtttcttgaaggaatctgcggggtc

SEQ ID NO: 219193 - DNA, 75 bp, Artificial Sequence
  Synthetic
tgcaaactcaatgcctcaaaataatcttcaatcaatcttgtgaacatcttggtcctcagatcaccaatgtacaac

SEQ ID NO: 219194 - DNA, 75 bp, Artificial Sequence
  Synthetic
tgagttggatagaagactgtaatgaactaaaagatcaattagttaatgtgaagtcattaacaaaaatgatactta

SEQ ID NO: 219195 - DNA, 75 bp, Artificial Sequence
  Synthetic
ggataattcacccttgatcaacctaatgtaaaacttatttgagacaatctcatctaaatcatttattgatggctg

SEQ ID NO: 219196 - DNA, 75 bp, Artificial Sequence
  Synthetic
ttctgcctcagcttcacggttgaagatgtcttcattgaattaatgagagccaaactaagtgttgacagtctttcc

SEQ ID NO: 219197 - DNA, 75 bp, Artificial Sequence
  Synthetic
gcttattaaaaactgtccttaggaccttcctaactttctgagtgctttctggtaggattgcctcaatgttcctca

SEQ ID NO: 219198 - DNA, 75 bp, Artificial Sequence
  Synthetic
ataagccattacaaagtacctaagattttggaggagcttttgagaacgtttactagggtgagctaaaattaaaac

SEQ ID NO: 219199 - DNA, 75 bp, Artificial Sequence
  Synthetic
cttcctaactttctgagtgctttctggtaggattgcctcaatgttcctcataatcctatagcccctattgccatc

SEQ ID NO: 219200 - DNA, 75 bp, Artificial Sequence
  Synthetic
taggattgtggtgactcttggctataaaagcaaaggttttttaacatagcagtagtacaatttgttaatgatagg

SEQ ID NO: 219201 - DNA, 75 bp, Artificial Sequence
  Synthetic
atagtaggtgtgaccccagaaacctcaatactcatgattgtgtcatagacatcacaatcaagaatttcaagatca

SEQ ID NO: 219202 - DNA, 75 bp, Artificial Sequence
  Synthetic
tttctgacttttaccacaaggaactaattgataaattaaaggaaaaattaatcacagagactgaatttttgctat

SEQ ID NO: 219203 - DNA, 75 bp, Artificial Sequence
  Synthetic
gatattgtgcatatctaagtagattcagtgttctctcctgaatagcgttacatagtgtgacaggcacaccattgg

SEQ ID NO: 219204 - DNA, 75 bp, Artificial Sequence
  Synthetic
cagtgttctctcctgaatagcgttacatagtgtgacaggcacaccattggccactgactgatcaatgatagtgtc

SEQ ID NO: 219205 - DNA, 75 bp, Artificial Sequence
  Synthetic
ttaaagttcaaatttcttgacctatagtgagaatattttcccatgagtttatttgcattcataatcaaaagtaca

SEQ ID NO: 219206 - DNA, 75 bp, Artificial Sequence
  Synthetic
tggtactgaacatttcttatatgtgtcatttcataactaaagaaactccagacagattaacagcccaaattaagt

SEQ ID NO: 219207 - DNA, 75 bp, Artificial Sequence
  Synthetic
gctaaaagctcgtggtttcgtccccctatggatgatggaagatttgcacttttgtccctggctctccttctacta

SEQ ID NO: 219208 - DNA, 75 bp, Artificial Sequence
  Synthetic
ctccatatcaatcttataatggtccacactgatcccaacatcctttaacgcggtggtggccttcaaaatggtttt

SEQ ID NO: 219209 - DNA, 75 bp, Artificial Sequence
  Synthetic
cggcagccacgaatttcgttaacaatggaacttcatcaccccagacataaaaccttgatttgaactcagcaacaa

SEQ ID NO: 219210 - DNA, 75 bp, Artificial Sequence
  Synthetic
tggaacttcatcaccccagacataaaaccttgatttgaactcagcaacaaatgaaccaataacactctttggact

SEQ ID NO: 219211 - DNA, 75 bp, Artificial Sequence
  Synthetic
cactgggacatatgaccacaataaaagtacttttctttcattttgtgattgctgtaaacattgtcacagaattct

SEQ ID NO: 219212 - DNA, 75 bp, Artificial Sequence
  Synthetic
aagaattagatgaaatgattcataatgcaaaaaagtttttaagtaaagagggatgcactagtgccaataagctaa

SEQ ID NO: 219213 - DNA, 75 bp, Artificial Sequence
  Synthetic
cctagccaaccaacgagatacttgttatcataccctaaactatccaaccggcttgcaaggaggattagaacgtca

SEQ ID NO: 219214 - DNA, 75 bp, Artificial Sequence
  Synthetic
agtgagaatattttcccatgagtttatttgcattcataatcaaaagtacagatttaaaacactggaaatattctt

SEQ ID NO: 219215 - DNA, 75 bp, Artificial Sequence
  Synthetic
cttggaattcctcaggctcatttgagagtaaatctgaaagatccttgccaaatagtgatatttgatcatcactag

SEQ ID NO: 219216 - DNA, 75 bp, Artificial Sequence
  Synthetic
gagtaaatctgaaagatccttgccaaatagtgatatttgatcatcactagaggtatatgaatcaacttcatcttc

SEQ ID NO: 219217 - DNA, 75 bp, Artificial Sequence
  Synthetic
ctaatgtggaatttattgggaatcagttcatccaaatcattgattgatggttcactattccctcccttcattgag

SEQ ID NO: 219218 - DNA, 75 bp, Artificial Sequence
  Synthetic
aagaaaaggagataaagaaggaaataaaggatcccattgttacaagtggttgtgcaacagctctggatttggcca

SEQ ID NO: 219219 - DNA, 75 bp, Artificial Sequence
  Synthetic
tgcatctgtccattctgagggtcagcagacttttcctcactggaatttagatccgcatacaagaatttaaggact

SEQ ID NO: 219220 - DNA, 75 bp, Artificial Sequence
  Synthetic
agtacttttctttcattttgtgattgctgtaaacattgtcacagaattctttgtaaaagctatcaggcagaattt

SEQ ID NO: 219221 - DNA, 75 bp, Artificial Sequence
  Synthetic
ggaagatcatgctcaacaacttacaagggtgtttatgagctacaaactctagagctagacatggcaagccttaat

SEQ ID NO: 219222 - DNA, 75 bp, Artificial Sequence
  Synthetic
agggtgtttatgagctacaaactctagagctagacatggcaagccttaatatgacaatgcccttatcttgcacga

SEQ ID NO: 219223 - DNA, 75 bp, Artificial Sequence
  Synthetic
agaagtcagaagcattgtgcaagatcccttgccccatgtcaattattgagctgagatgtgatggtatcctgtttt

SEQ ID NO: 219224 - DNA, 75 bp, Artificial Sequence
  Synthetic
tctctagttctcttcctgctgtctatccaccgttttagatctctttttgttgattccaatgaaactaatctatcg

SEQ ID NO: 219225 - DNA, 75 bp, Artificial Sequence
  Synthetic
cccttgccccatgtcaattattgagctgagatgtgatggtatcctgttttgtttaaagtattcaaagaagaaagc

SEQ ID NO: 219226 - DNA, 75 bp, Artificial Sequence
  Synthetic
gcactcccttcaagcagaatctcatccaggtcagaccggtcaacattgacaccttgctgctgagaccctaagacc

SEQ ID NO: 219227 - DNA, 75 bp, Artificial Sequence
  Synthetic
gataagatctcatcattgcattcacaacattgaaaggtacctcaattaacttgtgaatgtgccacgacagcaaag

SEQ ID NO: 219228 - DNA, 75 bp, Artificial Sequence
  Synthetic
aacattgaaaggtacctcaattaacttgtgaatgtgccacgacagcaaagtggacacgtaatccttactttttat

SEQ ID NO: 219229 - DNA, 75 bp, Artificial Sequence
  Synthetic
acttcagttaactgtgtaacagctaatgctgtgagtttgttgaagtcatagttgagtactctagagccatcagta

SEQ ID NO: 219230 - DNA, 75 bp, Artificial Sequence
  Synthetic
cacatgtaggaaacattcagaataaacttaaacctattagtcatcatgctcttcacatcctcagataaaaccaga

SEQ ID NO: 219231 - DNA, 75 bp, Artificial Sequence
  Synthetic
ttcctgaaatcttccaataactttatcttgtcagtctttatgaattgactttctatgcctccctgcctcaacttg

SEQ ID NO: 219232 - DNA, 75 bp, Artificial Sequence
  Synthetic
tggcagctagaaattaattcctcaaagtgctttgcacgattatcaattagagcattgatgctttctattccggag

SEQ ID NO: 219233 - DNA, 75 bp, Artificial Sequence
  Synthetic
ggaaaagaaaaggggacatcataggcccccacttgctgtgatcgaggctataagagacctgacctagtgaaacat

SEQ ID NO: 219234 - DNA, 75 bp, Artificial Sequence
  Synthetic
cccccacttgctgtgatcgaggctataagagacctgacctagtgaaacattcaatttcatggctagaatggcatt

SEQ ID NO: 219235 - DNA, 75 bp, Artificial Sequence
  Synthetic
ctcaactccttttttacctccttttctttgaataaagaaccattgttgaaagaagacgtgagaagggagaggaac

SEQ ID NO: 219236 - DNA, 75 bp, Artificial Sequence
  Synthetic
tagacgaagtgcttctagatggtggagcatcaatatattttgatcagttaagagagacagttgagaaaattgtgg

SEQ ID NO: 219237 - DNA, 75 bp, Artificial Sequence
  Synthetic
tgtgaatatttcaataaggcaaacaaggtgtccctaagtttgtcattcacccagtcaggtatctgctcgttataa

SEQ ID NO: 219238 - DNA, 75 bp, Artificial Sequence
  Synthetic
aggtcgtcacaaacaagtttcatgtaagactaattaaaggagaactctcacaccacatgattgaagactttgatc

SEQ ID NO: 219239 - DNA, 75 bp, Artificial Sequence
  Synthetic
gtgcctcaaaataatcctcaattaggcgtgtgaacatttttgtcctcaggtcacctatataaagttccctgttcc

SEQ ID NO: 219240 - DNA, 75 bp, Artificial Sequence
  Synthetic
gcgtgtgaacatttttgtcctcaggtcacctatataaagttccctgttccctccaacttgttctttgtaagataa

SEQ ID NO: 219241 - DNA, 75 bp, Artificial Sequence
  Synthetic
gcatggtaagccatgtccatcaattcctcctctgtggctatgtctgcagggttcacactcacatgaccaaactct

SEQ ID NO: 219242 - DNA, 75 bp, Artificial Sequence
  Synthetic
acttctactgtggtcctatgacgggttgtcctattggtgaactcacaaaagctgtagcaacaagaacatatcttg

SEQ ID NO: 219243 - DNA, 75 bp, Artificial Sequence
  Synthetic
ttcttgtagtcttccagatacttttgctcgaagttggcaggggatgatctaacaaaacattcaagcagaatcaaa

SEQ ID NO: 219244 - DNA, 75 bp, Artificial Sequence
  Synthetic
ttctcgtgttcaatatccttagagattttactttatttaggaatgatctccagcattgcacctgacactctccag

SEQ ID NO: 219245 - DNA, 75 bp, Artificial Sequence
  Synthetic
gggattcttgactgtaaaaacataggttctttagaactgcagttgtacaatttgtcaatgacagtgctttaccta

SEQ ID NO: 219246 - DNA, 75 bp, Artificial Sequence
  Synthetic
gttctttagaactgcagttgtacaatttgtcaatgacagtgctttacctaatgcctcagaattgctctctctttc

SEQ ID NO: 219247 - DNA, 75 bp, Artificial Sequence
  Synthetic
tggcacatgtatgacacatttagaatgaatttaaacctatttgtcatcatacttttcacttcattgcataaaatc

SEQ ID NO: 219248 - DNA, 75 bp, Artificial Sequence
  Synthetic
actataagtccaggtgcctaaacttcaaatttgacactaacaagctctctgatgatgtgagaattagtgaaaggg

SEQ ID NO: 219249 - DNA, 75 bp, Artificial Sequence
  Synthetic
atggtttcaactgttttatcctctgtattgtgttcgcagccattggccttgcaggagtcaatctcaatacagaga

SEQ ID NO: 219250 - DNA, 75 bp, Artificial Sequence
  Synthetic
tctcttgaactgataaattaaatgctcaatattatcttctgcagctaccttatcagtgtacaaattattaagttc

SEQ ID NO: 219251 - DNA, 75 bp, Artificial Sequence
  Synthetic
agcatttgtttttgtaatggctgtattttccagccaatttccctgcattcatctgaagaagtagtgacttgaagc

SEQ ID NO: 219252 - DNA, 75 bp, Artificial Sequence
  Synthetic
ttttccagccaatttccctgcattcatctgaagaagtagtgacttgaagcactgaaaaaactgctggtcattgaa

SEQ ID NO: 219253 - DNA, 75 bp, Artificial Sequence
  Synthetic
ataagatctacatggtggtaatctgacacataagccatgataaagtaccttaagttctgaagaagtttttgacta

SEQ ID NO: 219254 - DNA, 75 bp, Artificial Sequence
  Synthetic
tttacagtcaagaatcaccacagtcttacaactccactgggcctgatacaggaagactaaagttctctttatctt

SEQ ID NO: 219255 - DNA, 75 bp, Artificial Sequence
  Synthetic
tgaccagctgatcatgaagaatcatttgagagatatcatgggaattccttactgcaattacagcaagtattggta

SEQ ID NO: 219256 - DNA, 75 bp, Artificial Sequence
  Synthetic
agcttttcgttgtctacaaggtattttgagatgagatctttggcattggcaatgccttcctccattgttaattgc

SEQ ID NO: 219257 - DNA, 75 bp, Artificial Sequence
  Synthetic
aggaatccaaatagaaatactttgaccttaactccaaatccttaaaaaagcctttgcagatcatctcataagcat

SEQ ID NO: 219258 - DNA, 75 bp, Artificial Sequence
  Synthetic
ccttaactccaaatccttaaaaaagcctttgcagatcatctcataagcatctccaggtagtagtgactcatcaaa

SEQ ID NO: 219259 - DNA, 75 bp, Artificial Sequence
  Synthetic
aattcattacaatctttaatccaagtgatcatggtatctactgtggcttgcaaaacttcagctgaaaagattgca

SEQ ID NO: 219260 - DNA, 75 bp, Artificial Sequence
  Synthetic
aggattactttgaggcattaagccggcagctgtctggaagctgtctcaacaatgagaaagaatttgaaaacgcta

SEQ ID NO: 219261 - DNA, 75 bp, Artificial Sequence
  Synthetic
tgcttatttgatgtgcacgtcagttagtgacactccaagtaaaattctacagagatgagagtcaatatgcctagg

SEQ ID NO: 219262 - DNA, 75 bp, Artificial Sequence
  Synthetic
acacataagccatgataaagtaccttaagttctgaagaagtttttgactacgtttgcttgggtgggccaagatca

SEQ ID NO: 219263 - DNA, 75 bp, Artificial Sequence
  Synthetic
cacagcccacatcttcagtacctaaaaccttcctcaagtctgtcaaggacttctcctctgacccatttcccacag

SEQ ID NO: 219264 - DNA, 75 bp, Artificial Sequence
  Synthetic
aaccttcctcaagtctgtcaaggacttctcctctgacccatttcccacagggaacttcctgtcatatctatactt

SEQ ID NO: 219265 - DNA, 75 bp, Artificial Sequence
  Synthetic
gaacattctcctgttttctgatagactagctgaaattttacaccatccaatagaaattcttgacagtatgcctcc

SEQ ID NO: 219266 - DNA, 75 bp, Artificial Sequence
  Synthetic
attcaaccgttttgtcttcagtgttatgttcacatccattggccttgcaagagtcaatctcaatgcagagagata

SEQ ID NO: 219267 - DNA, 75 bp, Artificial Sequence
  Synthetic
tgtgtcctttcctgtttctcatagtgctgcagaatttggttgtcttgtcaaaagacttgcaggcagatatcaaag

SEQ ID NO: 219268 - DNA, 75 bp, Artificial Sequence
  Synthetic
tgatcatggtatctactgtggcttgcaaaacttcagctgaaaagattgcagggaagtaccttttaggatcagcat

SEQ ID NO: 219269 - DNA, 75 bp, Artificial Sequence
  Synthetic
cacaactatccaagaataactcatctaattcgtcaggagccccttgtgaattgggatttgaggaacctgacttct

SEQ ID NO: 219270 - DNA, 75 bp, Artificial Sequence
  Synthetic
taattcgtcaggagccccttgtgaattgggatttgaggaacctgacttcttccccacaacaaggtcactaatggc

SEQ ID NO: 219271 - DNA, 75 bp, Artificial Sequence
  Synthetic
gaattgattaaagcgagactcaatgaagacagtctccccaagtcagtggtttccgacagctcaaccacccccatg

SEQ ID NO: 219272 - DNA, 75 bp, Artificial Sequence
  Synthetic
caatgatgaagtcttttatcaaagcacaactaggtctaagaacaagcacatcacagaccacaactgaagactttt

SEQ ID NO: 219273 - DNA, 75 bp, Artificial Sequence
  Synthetic
tcttcctccatcgccaattgtagcacctgtgttggatttggatttgtgccaatatggcctgtgggtcagctggtg

SEQ ID NO: 219274 - DNA, 75 bp, Artificial Sequence
  Synthetic
ctagctgaaattttacaccatccaatagaaattcttgacagtatgcctccttgcacctcaccacctgatatctag

SEQ ID NO: 219275 - DNA, 75 bp, Artificial Sequence
  Synthetic
tcctctggaatacctctgatagctggcaaacagaagcagccactagtttatcatgatcgtaattaagtatcctct

SEQ ID NO: 219276 - DNA, 75 bp, Artificial Sequence
  Synthetic
atctcaatattggtgatgctctcttgaattgataaattaagtgttcgatattgtcttctgcagctaccttatcag

SEQ ID NO: 219277 - DNA, 75 bp, Artificial Sequence
  Synthetic
gcaaacagaagcagccactagtttatcatgatcgtaattaagtatcctctctccgtcagtatacttattcacaac

SEQ ID NO: 219278 - DNA, 75 bp, Artificial Sequence
  Synthetic
attgaatcataacagtcaagaccaattacactcatgtcaacaccaaagtgattcatgtttatcccaacatcttcc

SEQ ID NO: 219279 - DNA, 75 bp, Artificial Sequence
  Synthetic
ataatacttcagatttctatgcactcatttcagaaagatttattaactatgctatcggatgtgtttgtggagggg

SEQ ID NO: 219280 - DNA, 75 bp, Artificial Sequence
  Synthetic
aagacagtctccccaagtcagtggtttccgacagctcaaccacccccatggcatatgggaaagtctcctcttgtg

SEQ ID NO: 219281 - DNA, 75 bp, Artificial Sequence
  Synthetic
ctaatggatctttaaacccacttaggtcatctcctttcttgaaaagagagccattgttaaaagaagacgtcatca

SEQ ID NO: 219282 - DNA, 75 bp, Artificial Sequence
  Synthetic
gtcatctcctttcttgaaaagagagccattgttaaaagaagacgtcatcattgagaagaattttcttgacacacc

SEQ ID NO: 219283 - DNA, 75 bp, Artificial Sequence
  Synthetic
ggtgctgtagacttagaactctcaacttgctgtctccgttctatccacttctttaaatccctttttgttgagtct

SEQ ID NO: 219284 - DNA, 75 bp, Artificial Sequence
  Synthetic
acccagatgagttcaagacattattagaatttcatttttacatgagtgatcagttgaataaatttgtgagtccca

SEQ ID NO: 219285 - DNA, 75 bp, Artificial Sequence
  Synthetic
ttacactcatgtcaacaccaaagtgattcatgtttatcccaacatcttccatcgcagctgttgctcttttgatgg

SEQ ID NO: 219286 - DNA, 75 bp, Artificial Sequence
  Synthetic
cttgctgtctccgttctatccacttctttaaatccctttttgttgagtctagggagaccaatctatcattgacac

SEQ ID NO: 219287 - DNA, 75 bp, Artificial Sequence
  Synthetic
aaaatttgtttgctgattcaagcagcagcatcctttcatcttcatccccctcttcagatgggttgatgttaatac

SEQ ID NO: 219288 - DNA, 75 bp, Artificial Sequence
  Synthetic
cagcatcctttcatcttcatccccctcttcagatgggttgatgttaatactgtcaaactccaacttgggctccaa

SEQ ID NO: 219289 - DNA, 75 bp, Artificial Sequence
  Synthetic
tcatacttacttgcaagaagaatcagtgtgtcaaaaattaataaaagtttcctccttgtattcagaatcctcaac

SEQ ID NO: 219290 - DNA, 75 bp, Artificial Sequence
  Synthetic
caaaatttgttgctgctgctctccacaacataaagtgtaaagagccacatcagttggcagaaacaattgacacaa

SEQ ID NO: 219291 - DNA, 75 bp, Artificial Sequence
  Synthetic
gtgtgtcaaaaattaataaaagtttcctccttgtattcagaatcctcaacgacttaactttatttaaaaatgatc

SEQ ID NO: 219292 - DNA, 75 bp, Artificial Sequence
  Synthetic
cacttttgcttcatttggtcatgtttacttgcaaggagaatcagtgcgtcaaagatcaataagagttttctcctt

SEQ ID NO: 219293 - DNA, 75 bp, Artificial Sequence
  Synthetic
tagttataaaatgacacatgtatgataggtttaacacaaacttaaatctattagtcaacatagtgctcacccctt

SEQ ID NO: 219294 - DNA, 75 bp, Artificial Sequence
  Synthetic
taggtttaacacaaacttaaatctattagtcaacatagtgctcaccccttcacccaggatgatgttgagaatgct

SEQ ID NO: 219295 - DNA, 75 bp, Artificial Sequence
  Synthetic
tcttctccctcaatatctgaatataagaaccttagtataggcgatgctctcttaaactggtgagtcagctgctca

SEQ ID NO: 219296 - DNA, 75 bp, Artificial Sequence
  Synthetic
tgcagtatgccagatacccgattgacccatttcttctaaactgtggaactgatgtgagggattgggttgatggca

SEQ ID NO: 219297 - DNA, 75 bp, Artificial Sequence
  Synthetic
agaaccttagtataggcgatgctctcttaaactggtgagtcagctgctcaaggttttcttcaacaactactccat

SEQ ID NO: 219298 - DNA, 75 bp, Artificial Sequence
  Synthetic
caacataaagtgtaaagagccacatcagttggcagaaacaattgacacaattattgatcaatcagtcgcaaatgg

SEQ ID NO: 219299 - DNA, 75 bp, Artificial Sequence
  Synthetic
tcaacttttccattaactgcttatggtggaagtctgaaacaaaggccattatgaagtatcgcagaccttgcaaga

SEQ ID NO: 219300 - DNA, 75 bp, Artificial Sequence
  Synthetic
gtggaagtctgaaacaaaggccattatgaagtatcgcagaccttgcaagaacttctgtgctcttttgctagggtt

SEQ ID NO: 219301 - DNA, 75 bp, Artificial Sequence
  Synthetic
ctcatgaactggcactttatctcccctcctcttagcctgtttctaaaaacttgatactcttcctcaatctgtaac

SEQ ID NO: 219302 - DNA, 75 bp, Artificial Sequence
  Synthetic
gaaagctgttcaacaaattgaaagttggggatctccatgaagaattcacaaccaactacctttcaaatgaacatt

SEQ ID NO: 219303 - DNA, 75 bp, Artificial Sequence
  Synthetic
ctcctcttagcctgtttctaaaaacttgatactcttcctcaatctgtaacttcacctcatgagccgttaatttat

SEQ ID NO: 219304 - DNA, 75 bp, Artificial Sequence
  Synthetic
cccatttcttctaaactgtggaactgatgtgagggattgggttgatggcaatcgctcctataggatcatgaggca

SEQ ID NO: 219305 - DNA, 75 bp, Artificial Sequence
  Synthetic
gttgatctctgagttctatacattcagacaaccaactcatcatggtgttgatagtctcatagataacacagtgtg

SEQ ID NO: 219306 - DNA, 75 bp, Artificial Sequence
  Synthetic
agacaaccaactcatcatggtgttgatagtctcatagataacacagtgtgagaaaattgcaggaaaaaacctttt

SEQ ID NO: 219307 - DNA, 75 bp, Artificial Sequence
  Synthetic
taatgaagaaccatctacgggacatcatgggaattccatactgtaattacagcaaatattggtacctcaaccaca

SEQ ID NO: 219308 - DNA, 75 bp, Artificial Sequence
  Synthetic
gtcttgacaatctctcgttgtccgctaggtactttgatactaagtctttgacacaggctatgtcttcctccatgt

SEQ ID NO: 219309 - DNA, 75 bp, Artificial Sequence
  Synthetic
cgattgtccaatagggtattcaaactctcaattcctgaaagtctccctgaagtcattgacaaagactcacacagc

SEQ ID NO: 219310 - DNA, 75 bp, Artificial Sequence
  Synthetic
taaatctaacagctcatcacccattaagaatggtactgagacagaaaatcatttactcaggtgcagtcaacttag

SEQ ID NO: 219311 - DNA, 75 bp, Artificial Sequence
  Synthetic
cataacattttgagcactctcctgttttctgataaattaagttgaaattcccgcttcccatgataaagctttgat

SEQ ID NO: 219312 - DNA, 75 bp, Artificial Sequence
  Synthetic
tcatacttgaacgagacccacttttctgatgatattgaacaacaagctgacaacatgatcactgagatgttacag

SEQ ID NO: 219313 - DNA, 75 bp, Artificial Sequence
  Synthetic
tttctgataaattaagttgaaattcccgcttcccatgataaagctttgattaaaagcttccttacaacgtacacg

SEQ ID NO: 219314 - DNA, 75 bp, Artificial Sequence
  Synthetic
aacttgtcattgacccaatcaggcagttgttcattataaaaagatgttctgccgtctatcaatggtataagattg

SEQ ID NO: 219315 - DNA, 75 bp, Artificial Sequence
  Synthetic
agctcttatccgaagctatcaacaagtctgcatttcaaagttcaattgcatctggcttcgttggtttgtgtagga

SEQ ID NO: 219316 - DNA, 75 bp, Artificial Sequence
  Synthetic
gcaacagtttactgtagaatgaggtcctgtggggggcacaaaggacacaggagtcaattgaaatcaattaaaggc

SEQ ID NO: 219317 - DNA, 75 bp, Artificial Sequence
  Synthetic
atgtcttcattgaattcaccaatgccaaagagatgctagatagtcttctcaggtcttctatggaatcagcttcca

SEQ ID NO: 219318 - DNA, 75 bp, Artificial Sequence
  Synthetic
caaagagatgctagatagtcttctcaggtcttctatggaatcagcttccaactcaataagagggtaggggaattg

SEQ ID NO: 219319 - DNA, 75 bp, Artificial Sequence
  Synthetic
gctggggatgacctcacaaaacattccaacaagattaaaacattgccagtcaacttgtacccatctggcaccaca

SEQ ID NO: 219320 - DNA, 75 bp, Artificial Sequence
  Synthetic
acattcaagaaattgaagcactggtagatgattccggaattcaattttggagggtccctctgaaagtaaggcagg

SEQ ID NO: 219321 - DNA, 75 bp, Artificial Sequence
  Synthetic
gttgttcattataaaaagatgttctgccgtctatcaatggtataagattgatgtcaacgcttttcaagtcttctc

SEQ ID NO: 219322 - DNA, 75 bp, Artificial Sequence
  Synthetic
ccaacaagattaaaacattgccagtcaacttgtacccatctggcaccacaaaacacagagatggggttaagatac

SEQ ID NO: 219323 - DNA, 75 bp, Artificial Sequence
  Synthetic
ccattaacataagcctctcgtaactgtcctcctccagtatatcttcctctttaacataatctctaaagcacaaac

SEQ ID NO: 219324 - DNA, 75 bp, Artificial Sequence
  Synthetic
gtcctcctccagtatatcttcctctttaacataatctctaaagcacaaactggcagaggataatgcctctttggc

SEQ ID NO: 219325 - DNA, 75 bp, Artificial Sequence
  Synthetic
catccatttgcattgcatgagtcaacttctatacaaagagacaaaagcttcaacccttccatcaagagcattcta

SEQ ID NO: 219326 - DNA, 75 bp, Artificial Sequence
  Synthetic
aattaggagcatgggtcctgggggagccgaaggagtcaaccccaatggagttctttaagcataacccatgtgatt

SEQ ID NO: 219327 - DNA, 75 bp, Artificial Sequence
  Synthetic
cttctatacaaagagacaaaagcttcaacccttccatcaagagcattctaggctctgtctgaacgagaaatgcta

SEQ ID NO: 219328 - DNA, 75 bp, Artificial Sequence
  Synthetic
agatgattccggaattcaattttggagggtccctctgaaagtaaggcaggagtttgaggacgtggctggttactt

SEQ ID NO: 219329 - DNA, 75 bp, Artificial Sequence
  Synthetic
gacacagagttcctacacctcccttcttcttcattgcactcaccattctcctttcaatccactttttaaggtcct

SEQ ID NO: 219330 - DNA, 75 bp, Artificial Sequence
  Synthetic
cttcttcattgcactcaccattctcctttcaatccactttttaaggtccttttgtgtttcttgtagtgacaccaa

SEQ ID NO: 219331 - DNA, 75 bp, Artificial Sequence
  Synthetic
tctttaacataggctatgtcctcctccatgctcggttgtgggggtcgctgtttgaggagtgctactgagtcagtg

SEQ ID NO: 219332 - DNA, 75 bp, Artificial Sequence
  Synthetic
ggaggttgtatcctgccacatttgaaaaacatatactgccctttatgagtgatttggcttccactaaaatgaagt

SEQ ID NO: 219333 - DNA, 75 bp, Artificial Sequence
  Synthetic
gccgaaggagtcaaccccaatggagttctttaagcataacccatgtgattatttcccattaaagcccacagcatc

SEQ ID NO: 219334 - DNA, 75 bp, Artificial Sequence
  Synthetic
aaaacatatactgccctttatgagtgatttggcttccactaaaatgaagtggtcgcctagaataaagttcctaga

SEQ ID NO: 219335 - DNA, 75 bp, Artificial Sequence
  Synthetic
gctcgccgtgacatttaagatcctttaagtgggccaaaaggatgattgcgtcaaaagtcagcattagttttcttc

SEQ ID NO: 219336 - DNA, 75 bp, Artificial Sequence
  Synthetic
taagtgggccaaaaggatgattgcgtcaaaagtcagcattagttttcttctggtgttcaataactttagtgattt

SEQ ID NO: 219337 - DNA, 75 bp, Artificial Sequence
  Synthetic
atgggttcatgtgtcctactgtgagacaacctcaattcagatgataacacaatgtaatgttcctctcttttccat

SEQ ID NO: 219338 - DNA, 75 bp, Artificial Sequence
  Synthetic
acatagttaagtggaagcgggaggaacattacatcgtcttgtcatctgaactgcgagtatctcacagtagaacac

SEQ ID NO: 219339 - DNA, 75 bp, Artificial Sequence
  Synthetic
acattacatcgtcttgtcatctgaactgcgagtatctcacagtagaacacatgaaccaatgatagaagaaagagt

SEQ ID NO: 219340 - DNA, 75 bp, Artificial Sequence
  Synthetic
tctgcaagcagctgtctcgatcaactccctcttgcctataacggtcgtagtcaccatagagcgctgttaccatag

SEQ ID NO: 219341 - DNA, 75 bp, Artificial Sequence
  Synthetic
tccctcttgcctataacggtcgtagtcaccatagagcgctgttaccataggcgaggattttacaaacctctcttt

SEQ ID NO: 219342 - DNA, 75 bp, Artificial Sequence
  Synthetic
cggggatcctaggcaattcagctggacttcagtggtgaaactcattttagtgaatccctgaatcaaagtatccaa

SEQ ID NO: 219343 - DNA, 75 bp, Artificial Sequence
  Synthetic
aatcgtatgtgaggtcatttgtagcaacaacgaggaccctgggttcttttacatggttcccacatagaacatcta

SEQ ID NO: 219344 - DNA, 75 bp, Artificial Sequence
  Synthetic
aacaacgaggaccctgggttcttttacatggttcccacatagaacatctattccagagggtgagggtctgcaaag

SEQ ID NO: 219345 - DNA, 75 bp, Artificial Sequence
  Synthetic
tgttgaaatctctcaagagctgtcgcctatctgtcctgacaaattgtctttctatctcaccctctttaagcttat

SEQ ID NO: 219346 - DNA, 75 bp, Artificial Sequence
  Synthetic
cctatctgtcctgacaaattgtctttctatctcaccctctttaagcttattcctaaaagcatggaattctgatac

SEQ ID NO: 219347 - DNA, 75 bp, Artificial Sequence
  Synthetic
tgtgtctcaactgtctcagcctgctcctcagcgtcagcagcagatgcccgatctgcaagatgccccttcccacca

SEQ ID NO: 219348 - DNA, 75 bp, Artificial Sequence
  Synthetic
aaaggccaatgttcaagtatgacttgatgatggggtatgcatggatcgattatgacattgaaccagcaagattta

SEQ ID NO: 219349 - DNA, 75 bp, Artificial Sequence
  Synthetic
gatgatggggtatgcatggatcgattatgacattgaaccagcaagatttaaccaaaatcagttgattgcatcggg

SEQ ID NO: 219350 - DNA, 75 bp, Artificial Sequence
  Synthetic
ggcagagctccaacaccctctcataatgatcagatcgagaatctgtcaaaacattgaggctctcaatgcccgatg

SEQ ID NO: 219351 - DNA, 75 bp, Artificial Sequence
  Synthetic
atgatcagatcgagaatctgtcaaaacattgaggctctcaatgcccgatgttctcactcctgcttttgttaaaga

SEQ ID NO: 219352 - DNA, 75 bp, Artificial Sequence
  Synthetic
cccaagctctacccacaatagaagtccttgaagctatgtagggccagccgtcaccggaaagacagatcttgtaaa

SEQ ID NO: 219353 - DNA, 75 bp, Artificial Sequence
  Synthetic
ctgaattaccacctggatctgtaaagttgggacagactattagatttcagattagaagtcaagaggctagcttta

SEQ ID NO: 219354 - DNA, 75 bp, Artificial Sequence
  Synthetic
gttgggacagactattagatttcagattagaagtcaagaggctagctttaaggaaaacttttctattcacctaaa

SEQ ID NO: 219355 - DNA, 75 bp, Artificial Sequence
  Synthetic
gcgagaattcaagtaagctaaataggatatgcctaaacctctcattggcccattctggaaacaaatcagtgtaga

SEQ ID NO: 219356 - DNA, 75 bp, Artificial Sequence
  Synthetic
gatatgcctaaacctctcattggcccattctggaaacaaatcagtgtagaaattggttctgccgtctatcaaggg

SEQ ID NO: 219357 - DNA, 75 bp, Artificial Sequence
  Synthetic
cccgggggggcaggcagcccagctctactcaatgtcctcaatacacctctccggcccaaacaactctgaacatgt

SEQ ID NO: 219358 - DNA, 75 bp, Artificial Sequence
  Synthetic
atgtcatgtactccggtgcagtgaattcatgtgttctgccagattgttggaggctggtgctatctggtcccacct

SEQ ID NO: 219359 - DNA, 75 bp, Artificial Sequence
  Synthetic
ttcatgtgttctgccagattgttggaggctggtgctatctggtcccacctacaagggaaggtcccctctgtatgt

SEQ ID NO: 219360 - DNA, 75 bp, Artificial Sequence
  Synthetic
taatggtatcttctttatacttttgctcaaagtttattggtgaagtcctgacaaagcattccagtaatattaatg

SEQ ID NO: 219361 - DNA, 75 bp, Artificial Sequence
  Synthetic
ctcaaagtttattggtgaagtcctgacaaagcattccagtaatattaatgtgttcccactgaatttgaatccatc

SEQ ID NO: 219362 - DNA, 75 bp, Artificial Sequence
  Synthetic
ctgttactcctcttgagattgacgttgatgcacacaagctccagttttcagagtatgattttgtcatggtgggtc

SEQ ID NO: 219363 - DNA, 75 bp, Artificial Sequence
  Synthetic
ctccacctggttaaaatcccaacccacagacatgtcatagggaaaccctgccccaagccacacagactcaaccac

SEQ ID NO: 219364 - DNA, 75 bp, Artificial Sequence
  Synthetic
tgatgcacacaagctccagttttcagagtatgattttgtcatggtgggtcctcacacagaaccagtcccacttgt

SEQ ID NO: 219365 - DNA, 75 bp, Artificial Sequence
  Synthetic
ggatttcaacagaaaggtcttctgagttgtgctcacaaccattggctttgcaactgtctatctcaatacagagtg

SEQ ID NO: 219366 - DNA, 75 bp, Artificial Sequence
  Synthetic
atgggcatatgctcatgtggtctatacaaacatcctggtgtaccagtcaagtggaaaagataggagacagaccca

SEQ ID NO: 219367 - DNA, 75 bp, Artificial Sequence
  Synthetic
gatagatggtgtaaatgtagctacccttctatcagattcccacagtgctcccctacatacaaccaatggcactgg

SEQ ID NO: 219368 - DNA, 75 bp, Artificial Sequence
  Synthetic
tgcccgtcattcaagatcaagatcttgagatattcattagagaagtcaatgatacttctcacaacatgttggttg

SEQ ID NO: 219369 - DNA, 75 bp, Artificial Sequence
  Synthetic
ccctacatacaaccaatggcactggttcgttgtcaggtccgaccttggagaagtcaaactcactgaactgcagtt

SEQ ID NO: 219370 - DNA, 75 bp, Artificial Sequence
  Synthetic
gcctctcatcctctaagaggtacctgctcacaagatctttgctctcggacagcaactcctccatcaccacacact

SEQ ID NO: 219371 - DNA, 75 bp, Artificial Sequence
  Synthetic
tgagatattcattagagaagtcaatgatacttctcacaacatgttggttggggcattagccgccatgatggcaga

SEQ ID NO: 219372 - DNA, 75 bp, Artificial Sequence
  Synthetic
ctaatgaccttcgactttagtttctctaagtcagctgccaatgtcagcaggtcatctgaggtcaaggtcccaact

SEQ ID NO: 219373 - DNA, 75 bp, Artificial Sequence
  Synthetic
tcatgaagatcatgcctgattgtggtatgagtgtccttgccgagctattgaagacaatggatgactggattgagt

SEQ ID NO: 219374 - DNA, 75 bp, Artificial Sequence
  Synthetic
ccggggatcctaggcaattcagctggacttcagtagtaaggctcttttcagtgaatccccgagtcaaagcaccca

SEQ ID NO: 219375 - DNA, 75 bp, Artificial Sequence
  Synthetic
atcctaggcatttaagattgcgcttttaggaatctttgtgtgggtgggcctcatcaagccatgggacaaatcata

SEQ ID NO: 219376 - DNA, 75 bp, Artificial Sequence
  Synthetic
cagtcaagtagtggagggatgagactcaagggcagaacatgtgaagagttgatctggggaacaagactagtggag

SEQ ID NO: 219377 - DNA, 75 bp, Artificial Sequence
  Synthetic
tcaagggcagaacatgtgaagagttgatctggggaacaagactagtggaggatatcgattgattgctttgttgtg

SEQ ID NO: 219378 - DNA, 75 bp, Artificial Sequence
  Synthetic
gtcctgtcatgttgagatggatagaaaaagtctctttaaaactggcatcctgactcttgattttatacctaattg

SEQ ID NO: 219379 - DNA, 75 bp, Artificial Sequence
  Synthetic
cgcacagtggatcctaggctattggattgcgctttgcacagctcacacttgtggaacaattgtgctgagagcctg

SEQ ID NO: 219380 - DNA, 75 bp, Artificial Sequence
  Synthetic
gtggaacaattgtgctgagagcctgtcatatccaacaaccagacagctttcataacaatgagtgcttccaaggaa

SEQ ID NO: 219381 - DNA, 75 bp, Artificial Sequence
  Synthetic
tcatatccaacaaccagacagctttcataacaatgagtgcttccaaggaagtgaaatcattcctgtggactcagt

SEQ ID NO: 219382 - DNA, 75 bp, Artificial Sequence
  Synthetic
ctggatgctttagggttcactggttcactggttgaaagtgttactcagtgagtcaatgaaaagcgcaatccaata

SEQ ID NO: 219383 - DNA, 75 bp, Artificial Sequence
  Synthetic
gtgaaagatgctcaggctcttcttcatggcctggacttctctgaagtcagcaatgttcaacgcttgatgcgtaaa

SEQ ID NO: 219384 - DNA, 75 bp, Artificial Sequence
  Synthetic
gctggacttcagtggtaaggctcattttagtgaatccctgaatcaagtgcctagctgaaatgggcaacagacagg

SEQ ID NO: 219385 - DNA, 75 bp, Artificial Sequence
  Synthetic
atggcctggacttctctgaagtcagcaatgttcaacgcttgatgcgtaaacagaggagagatgatggtgatctaa

SEQ ID NO: 219386 - DNA, 75 bp, Artificial Sequence
  Synthetic
tcaactcagcaaaaaagtgtgttgagagttgggaccctgaactcagatgatctgctggtcctagctgctgaccta

SEQ ID NO: 219387 - DNA, 75 bp, Artificial Sequence
  Synthetic
gagttgggaccctgaactcagatgatctgctggtcctagctgctgacctagaaaagctaaagtcaaaggtcatta

SEQ ID NO: 219388 - DNA, 75 bp, Artificial Sequence
  Synthetic
aaaagtgtgtctcttagcttatcattaacccaatcaggtatttgttcattataaaatgatgttctaccgtcaatg

SEQ ID NO: 219389 - DNA, 75 bp, Artificial Sequence
  Synthetic
cccgatctgcaagatgccccttcccaccaaactgaaggcagcagcacagccgagcgcaccctcaactgaggcggc

SEQ ID NO: 219390 - DNA, 75 bp, Artificial Sequence
  Synthetic
cgagcgcaccctcaactgaggcggcccagaacacagcacctccaccgtatgccccatgatcccaagatcaacacc

SEQ ID NO: 219391 - DNA, 75 bp, Artificial Sequence
  Synthetic
cagcaacttgatcaaagaagggctcttctaaacatgattggcatgactggtggaaacagaggggggggtacctcc

SEQ ID NO: 219392 - DNA, 75 bp, Artificial Sequence
  Synthetic
ttctaaacatgattggcatgactggtggaaacagaggggggggtacctccagtgatggcattgtgagagtctggg

SEQ ID NO: 219393 - DNA, 75 bp, Artificial Sequence
  Synthetic
cccccccgggggggcaggcagcccaactctactcaatgtcctcgatacacttctccggcccaaacaactctgaac

SEQ ID NO: 219394 - DNA, 75 bp, Artificial Sequence
  Synthetic
ctgaccctggcatgcctgaccaaacaaggacaagtagatctgaatgatgctgttcaagccttaacggacttagga

SEQ ID NO: 219395 - DNA, 75 bp, Artificial Sequence
  Synthetic
aaggacaagtagatctgaatgatgctgttcaagccttaacggacttaggactaatctacacagcaaagtacccca

SEQ ID NO: 219396 - DNA, 75 bp, Artificial Sequence
  Synthetic
attgatactaagaaaagctcactcaacatctctggttacaactttagcttgggagctgctgtcaaggcaggggcc

SEQ ID NO: 219397 - DNA, 75 bp, Artificial Sequence
  Synthetic
acatctctggttacaactttagcttgggagctgctgtcaaggcaggggcctgcatgcttgatggtggcaatatgt

SEQ ID NO: 219398 - DNA, 75 bp, Artificial Sequence
  Synthetic
gggcatggtgccaaattggttgttcaaaagatccggattcttgacatcccacaccctaacaactccgtcccttcc

SEQ ID NO: 219399 - DNA, 75 bp, Artificial Sequence
  Synthetic
atcttgaaagtcaagaagagtctgggaatgttcatctcagatgtaccaggtgagaggaacccttatgagaatata

SEQ ID NO: 219400 - DNA, 75 bp, Artificial Sequence
  Synthetic
gaatgttcatctcagatgtaccaggtgagaggaacccttatgagaatatactgtacaaaatttgtctctcagggg

SEQ ID NO: 219401 - DNA, 75 bp, Artificial Sequence
  Synthetic
gatatcatgggaattccttactgcaattacagcaaatattggtatctaaatcacactgtaacagggaagacatcg

SEQ ID NO: 219402 - DNA, 75 bp, Artificial Sequence
  Synthetic
gctcccctacacacaaccaatggcactggttcactgtcaggcccgaccttggagaaatcaaattcactgaactgc

SEQ ID NO: 219403 - DNA, 75 bp, Artificial Sequence
  Synthetic
gaaaatactgtggttgatctggaatcagacaacaaaccacaaaaaaccggaaatggaggttcaaacaagtcattg

SEQ ID NO: 219404 - DNA, 75 bp, Artificial Sequence
  Synthetic
cagacaacaaaccacaaaaaaccggaaatggaggttcaaacaagtcattgcagtctgcaggttttgctgcagggt

SEQ ID NO: 219405 - DNA, 75 bp, Artificial Sequence
  Synthetic
cccaattcaaaaacctggatggatattgaggggagaccagaggatccagtcgagatagctctgtatcaaccaaac

SEQ ID NO: 219406 - DNA, 75 bp, Artificial Sequence
  Synthetic
ttgaggggagaccagaggatccagtcgagatagctctgtatcaaccaaactcaggctgttacatacactttttta

SEQ ID NO: 219407 - DNA, 75 bp, Artificial Sequence
  Synthetic
ggtattgatgtgacagatttgtttgctgcacagccagggttgacaagtgcagtgatagaggctctccccagaaac

SEQ ID NO: 219408 - DNA, 75 bp, Artificial Sequence
  Synthetic
ggttccctatactgatccacaattttttcaacagtctcctttagctgaccaaaatattcgcttgcacctccatca

SEQ ID NO: 219409 - DNA, 75 bp, Artificial Sequence
  Synthetic
ctgcacagccagggttgacaagtgcagtgatagaggctctccccagaaacatggtcatcacctgtcaggggtcag

SEQ ID NO: 219410 - DNA, 75 bp, Artificial Sequence
  Synthetic
gaactgctcttaaaactggtatgttgagtcctcctgacacagctgcatcatacattatgcagtccattaaagcac

SEQ ID NO: 219411 - DNA, 75 bp, Artificial Sequence
  Synthetic
atcgacatttccctcaataaagcggactcaaggaaatttgaaaatgctgtgtgggatcagttcaaggacttatgc

SEQ ID NO: 219412 - DNA, 75 bp, Artificial Sequence
  Synthetic
actcaaggaaatttgaaaatgctgtgtgggatcagttcaaggacttatgccacatgcatactggggttgttgtgg

SEQ ID NO: 219413 - DNA, 75 bp, Artificial Sequence
  Synthetic
gaccttcaccctctggtattgaggttttatgagggaaccaagtgaatgacccaagtgtccttgttgttgctacaa

SEQ ID NO: 219414 - DNA, 75 bp, Artificial Sequence
  Synthetic
atggactgcattatgtttgatgcagcagtctcgggagggctcgatgcaaaggtcctaagagctgtgctccccagg

SEQ ID NO: 219415 - DNA, 75 bp, Artificial Sequence
  Synthetic
cagtctcgggagggctcgatgcaaaggtcctaagagctgtgctccccagggacatggtattcagaacctcaacac

SEQ ID NO: 219416 - DNA, 75 bp, Artificial Sequence
  Synthetic
gtgggtcacgggggcccctgtgggatttttatctcttccatctgacgggcacccctggctgtttgtataaaccac

SEQ ID NO: 219417 - DNA, 75 bp, Artificial Sequence
  Synthetic
tttttatctcttccatctgacgggcacccctggctgtttgtataaaccacaagagcagatgcccatgtgattcag

SEQ ID NO: 219418 - DNA, 75 bp, Artificial Sequence
  Synthetic
tgtatgtaacagcccgacataggttggtaaagagctatttccacagggtcttctggacgaccttcaatgtctatc

SEQ ID NO: 219419 - DNA, 75 bp, Artificial Sequence
  Synthetic
attgttgtattgaatgcacgtgataaaaagctgagactatttgccaaaatgacaaaagcaaagcgcaatccaata

SEQ ID NO: 219420 - DNA, 75 bp, Artificial Sequence
  Synthetic
ctgtatctgcaggattggtgctcacatgaccaaatctcacttttggttccagaaacttttcaaaacactttatct

SEQ ID NO: 219421 - DNA, 75 bp, Artificial Sequence
  Synthetic
ttttgatcagatggaggaagatactgatcaaataaaaacttgtgctaaagacaaaaagatcaactaaccctaaag

SEQ ID NO: 219422 - DNA, 75 bp, Artificial Sequence
  Synthetic
gatcaaataaaaacttgtgctaaagacaaaaagatcaactaaccctaaaggggtcttcccttgtctatctaggta

SEQ ID NO: 219423 - DNA, 75 bp, Artificial Sequence
  Synthetic
catcagagaagtgagtttcattaaggtatgacccgtttgaaacaagccaacatctaggcaatgaagtcttccctg

SEQ ID NO: 219424 - DNA, 75 bp, Artificial Sequence
  Synthetic
gtatgacccgtttgaaacaagccaacatctaggcaatgaagtcttccctgttgatgtgtgattgaggtaccaata

SEQ ID NO: 219425 - DNA, 75 bp, Artificial Sequence
  Synthetic
tcataatcaactgatcatttattaaggcattgactgctttgttgatcaattgtatactcatttgggcttctgtct

SEQ ID NO: 219426 - DNA, 75 bp, Artificial Sequence
  Synthetic
ggcattgactgctttgttgatcaattgtatactcatttgggcttctgtctttaacctcctaatggcttgtttgtt

SEQ ID NO: 219427 - DNA, 75 bp, Artificial Sequence
  Synthetic
acaccaagagactactcaatgtcctcaatgcattcatccttcctagtcaactcctcacatgttctgcccttcagt

SEQ ID NO: 219428 - DNA, 75 bp, Artificial Sequence
  Synthetic
tcaccaagagactactcaatgtcctcaatgcattcatccttcctagtcaactcctcacatgttctgcccttcagt

SEQ ID NO: 219429 - DNA, 75 bp, Artificial Sequence
  Synthetic
ccaccaagagactactcaatgtcctcaatgcattcatccttcctagtcaactcctcacatgttctgcccttcagt

SEQ ID NO: 219430 - DNA, 75 bp, Artificial Sequence
  Synthetic
gcaccaagagactactcaatgtcctcaatgcattcatccttcctagtcaactcctcacatgttctgcccttcagt

SEQ ID NO: 219431 - DNA, 75 bp, Artificial Sequence
  Synthetic
accaggctgacctacctttgaaagttggacccgacaaagcaagtctccaacagtcagacagaacacatgggctca

SEQ ID NO: 219432 - DNA, 75 bp, Artificial Sequence
  Synthetic
ctcttcttggtgtccaccatattcagtatgggatggctttgagaaagtctgtccaggtcggagctatttgggtac

SEQ ID NO: 219433 - DNA, 75 bp, Artificial Sequence
  Synthetic
tgcacttggcaactgctgtgtttccaaaacacttcagctcagcctcaattaacatccacctggtgagacagtatc

SEQ ID NO: 219434 - DNA, 75 bp, Artificial Sequence
  Synthetic
aaaacacttcagctcagcctcaattaacatccacctggtgagacagtatcctcctggcgtctcatttccttcaga

SEQ ID NO: 219435 - DNA, 75 bp, Artificial Sequence
  Synthetic
tgtccctggttctttgtgagaggagcccgagataaccaataggagatggtctggagaactggcagtggtcttccc

SEQ ID NO: 219436 - DNA, 75 bp, Artificial Sequence
  Synthetic
cccgagataaccaataggagatggtctggagaactggcagtggtcttcccaagttgtattctggataattaagta

SEQ ID NO: 219437 - DNA, 75 bp, Artificial Sequence
  Synthetic
caatatagctgcctccccaagccattctcataaatgtctgcaacacaccatttgctactgtgccgcagtgttttg

SEQ ID NO: 219438 - DNA, 75 bp, Artificial Sequence
  Synthetic
tctcataaatgtctgcaacacaccatttgctactgtgccgcagtgttttgctgcatcaactgcataactgtgact

SEQ ID NO: 219439 - DNA, 75 bp, Artificial Sequence
  Synthetic
gaaatattcttggtccaaaaaagtcctagttaccactgcttttgtcagctcactaataggacatgaattcattgg

SEQ ID NO: 219440 - DNA, 75 bp, Artificial Sequence
  Synthetic
cttcatattggttaaagttggggatggatagatggaaagtagaaatgatgctcatgagggcatgatcataaagat

SEQ ID NO: 219441 - DNA, 75 bp, Artificial Sequence
  Synthetic
ggatagatggaaagtagaaatgatgctcatgagggcatgatcataaagatttctcttatgagcatctgagaggtt

SEQ ID NO: 219442 - DNA, 75 bp, Artificial Sequence
  Synthetic
cacaaattttgatgtattgatcctcagataggatttctcgatcaaaatcttctatcatatggtttgaaagttcac

SEQ ID NO: 219443 - DNA, 75 bp, Artificial Sequence
  Synthetic
agataggatttctcgatcaaaatcttctatcatatggtttgaaagttcactttttatcaaccttattaagagttt

SEQ ID NO: 219444 - DNA, 75 bp, Artificial Sequence
  Synthetic
ctgtatcatttcccacacggatgtaatgatgactggtgttctttgtgcaggacaatggcatagtcatgttcaatg

SEQ ID NO: 219445 - DNA, 75 bp, Artificial Sequence
  Synthetic
atgatgactggtgttctttgtgcaggacaatggcatagtcatgttcaatgtctccatgttcaattcaagggtctg

SEQ ID NO: 219446 - DNA, 75 bp, Artificial Sequence
  Synthetic
aagcactcatcttgatctggacacttagagatttactgattgaaattttctattcagtaagtcaataaaaggcgc

SEQ ID NO: 219447 - DNA, 75 bp, Artificial Sequence
  Synthetic
ggaggaatgttacaaggcctatcaagccgcatgtggcaaagttgtagagcccctttaaaattgccaaaacggaca

SEQ ID NO: 219448 - DNA, 75 bp, Artificial Sequence
  Synthetic
gtcttgtgtggaaaccacgtgaaggaccccaatgttcttgtggtcgcaacaaatggtctcacataagactcaaaa

SEQ ID NO: 219449 - DNA, 75 bp, Artificial Sequence
  Synthetic
gggatcctaggcaatttagctggacttcagtggtaaagttcattctagtgaatccctaaatcaaagtgtgtagcc

SEQ ID NO: 219450 - DNA, 75 bp, Artificial Sequence
  Synthetic
tggaagaatgtcacaatctgtcccatcctgattgtctgatctccaaacaaggcttctaaaatgcgcaatcctaaa

SEQ ID NO: 219451 - DNA, 75 bp, Artificial Sequence
  Synthetic
ctgtatcttgtaatcataatcctgtttgttaagcaagaatttgcctttacgtgcaaacacttcagttaactgtgt

SEQ ID NO: 219452 - DNA, 75 bp, Artificial Sequence
  Synthetic
gctgtcgcacagccgcttgtgataagagggtctcgcagtgtcttctttacctccttttctttgaacaatgaacca

SEQ ID NO: 219453 - DNA, 75 bp, Artificial Sequence
  Synthetic
ttgccatctacccagtctctgacatctgtctcgcaattcaataagaatgggtcaatagggtatcttgcatattgc

SEQ ID NO: 219454 - DNA, 75 bp, Artificial Sequence
  Synthetic
gctccctatactgactgacaatattgtcaacagtgcacctcagttggtcgaagtattctgatgctcctccatcca

SEQ ID NO: 219455 - DNA, 75 bp, Artificial Sequence
  Synthetic
gtcaacagtgcacctcagttggtcgaagtattctgatgctcctccatccaatagtatctcatctagatcagcatt

SEQ ID NO: 219456 - DNA, 75 bp, Artificial Sequence
  Synthetic
tacctgctcacaagatctttgctctcggacagcaactcctccatcaccacacacttgttcctcagaagagagagt

SEQ ID NO: 219457 - DNA, 75 bp, Artificial Sequence
  Synthetic
atccaccgttttagatctctttttgttgattccaatgaaactaatctatcgttaacactcacaaaacaggagccc

SEQ ID NO: 219458 - DNA, 75 bp, Artificial Sequence
  Synthetic
agcaagaagaatcagaacatcaaaaataaggagaagtttcctcctagtgttgaggatcctcagggattttatttt

SEQ ID NO: 219459 - DNA, 75 bp, Artificial Sequence
  Synthetic
atcatcctttgggttcacactcacatgtccaaattccaatttgggctcaaggaatttttcaaagcatttgatctg

SEQ ID NO: 219460 - DNA, 75 bp, Artificial Sequence
  Synthetic
tatcagtcttaacaaattgactttctatattcccttgccttagtttgttcctgaagatttgatactcctcctcaa

SEQ ID NO: 219461 - DNA, 75 bp, Artificial Sequence
  Synthetic
tttgtcagctcactaataggacatgaattcattggccctacataaaaatatttacttctcaaagcagcatcattg

SEQ ID NO: 219462 - DNA, 75 bp, Artificial Sequence
  Synthetic
tcgaagacttcttgggacttttacctggactctctctgactccgagggtaatgaaacaccaggtggttattgtct

SEQ ID NO: 219463 - DNA, 75 bp, Artificial Sequence
  Synthetic
tacaggacgaccttggggcttgaggttctaaacaccatgtccctggggagaactgctcttaaaactggtatattg

SEQ ID NO: 219464 - DNA, 75 bp, Artificial Sequence
  Synthetic
acctgtgtttagtttgggtttgtgccgatgtgacttatgggtcagctggtgatgccccacagaagctcctacaga

SEQ ID NO: 219465 - DNA, 75 bp, Artificial Sequence
  Synthetic
cagaatggcttgtgggtcagctggtggtgccccacaaaagctcctacagaaatgagagacaatatgcctaggatc

SEQ ID NO: 219466 - DNA, 75 bp, Artificial Sequence
  Synthetic
acctgtattgggtttgggtttatgccagaatggcttgtgggtcagctggtggtgccccacaaaagctcctacaga

SEQ ID NO: 219467 - DNA, 75 bp, Artificial Sequence
  Synthetic
ggattgcgcttttagagatctttgtgtgagtgggcttcattaagccatgggacaaatcataacatttttccagga

SEQ ID NO: 219468 - DNA, 75 bp, Artificial Sequence
  Synthetic
cacgaagaacaacagccaccattacatcatggtcggaaatgagactggcttggagctgactttaacaaatacaag

SEQ ID NO: 219469 - DNA, 75 bp, Artificial Sequence
  Synthetic
ctttctgaaatcctctaataatttcatcttatcagttttaacaaattgaccttctatgtccccctgccttagttt

SEQ ID NO: 219470 - DNA, 75 bp, Artificial Sequence
  Synthetic
accttgacaggtcagtaccatattgcgagggagggcctcaatgactgcactggtcaagccaggttgagcagggaa

SEQ ID NO: 219471 - DNA, 75 bp, Artificial Sequence
  Synthetic
accactgtgggactatcgccaatggcgttcttcagacttttatgaggatggcttggggtggcagttatatagcac

SEQ ID NO: 219472 - DNA, 75 bp, Artificial Sequence
  Synthetic
gacttgttggacccagcagtgcccactttttgtggttttccatctgactcaagatccacagtagtattctcccaa

SEQ ID NO: 219473 - DNA, 75 bp, Artificial Sequence
  Synthetic
ttgtaaccagaaatgttcaaggagctcttcttagtgtccaccatattcagtataggatggctttgggaaagtctg

SEQ ID NO: 219474 - DNA, 75 bp, Artificial Sequence
  Synthetic
ttttacttggactctctctgattctgaaggtaatgaaacaccgggtgggtattgtctaacaagatggatgctgat

SEQ ID NO: 219475 - DNA, 75 bp, Artificial Sequence
  Synthetic
tataggatggctttgggaaagtctgtccaggtcggagctatttgggtacttagctgtgtatattagacccaggtc

SEQ ID NO: 219476 - DNA, 75 bp, Artificial Sequence
  Synthetic
gacatgctaatgtcagactaggcatggtgccgaactggttgttcaaaagatccggattcttaacatcccacaccc

SEQ ID NO: 219477 - DNA, 75 bp, Artificial Sequence
  Synthetic
gtgcctgtgtggcgtgtgggccagctggcagtgcttcacaaaagctcccacagaaatgagagacaatatgcctag

SEQ ID NO: 219478 - DNA, 75 bp, Artificial Sequence
  Synthetic
tgctgcctccgttcaacccatttctcgagatccctttttgttgactccagagaaactagtctatcattaacactt

SEQ ID NO: 219479 - DNA, 75 bp, Artificial Sequence
  Synthetic
caatttagttggacttcagtggtgaggcttattttagtgaattcctgaatcaaagtgcccagttaaaatgggcaa

SEQ ID NO: 219480 - DNA, 75 bp, Artificial Sequence
  Synthetic
ggaaatgagactggcttggagctgactttaacaaatacaagtattatcaaccacaagttttgtaacctttctgat

SEQ ID NO: 219481 - DNA, 75 bp, Artificial Sequence
  Synthetic
atcctaggcaatttaactggacttcagtggtaaaactcattctggtgaatctcagaatcaaagtacctagtcaaa

SEQ ID NO: 219482 - DNA, 75 bp, Artificial Sequence
  Synthetic
aatctcaatattggtgatgctctcttaaactgatgaattaagtgctcgatgttgtcttctgcagctaccttatca

SEQ ID NO: 219483 - DNA, 75 bp, Artificial Sequence
  Synthetic
ttttatacctaactttttccgcatctgcacaacattctttacttagaaactttcttgcgttgtaaaccatttcag

SEQ ID NO: 219484 - DNA, 75 bp, Artificial Sequence
  Synthetic
attgaattctttgttttaatctatcagacatcattgatttcaatgcaccaactaaaaggtgtggggaactatcac

SEQ ID NO: 219485 - DNA, 75 bp, Artificial Sequence
  Synthetic
atcattgacccagtcaggtatttgttcattgtagaatgatgtcctcccgtctataagtggtatcaaattgatatc

SEQ ID NO: 219486 - DNA, 75 bp, Artificial Sequence
  Synthetic
aagcagacaacatgataacagaactgttgcaaaaggagtatatggacaggcaagggaaaacacccttagggttag

SEQ ID NO: 219487 - DNA, 75 bp, Artificial Sequence
  Synthetic
ctaggtactttgatactaagtctttgacacaggctatgtcttcctccatgtttggctgcaggtatgatggtcaga

SEQ ID NO: 219488 - DNA, 75 bp, Artificial Sequence
  Synthetic
agcaacaattcactataggatgaagcctcgtagaatgcacagaagacacaagacgaaattaaagacaatttaatt

SEQ ID NO: 219489 - DNA, 75 bp, Artificial Sequence
  Synthetic
ctgtgtactcaaattccccatataaacacctgagcttagtggcctttctgttctaatgaccttcgactttagttt

SEQ ID NO: 219490 - DNA, 75 bp, Artificial Sequence
  Synthetic
atcatcagccgctccaacagcacccccaaccggagcagcggacggcaccaaacccccaccctacagcccctgaac

SEQ ID NO: 219491 - DNA, 75 bp, Artificial Sequence
  Synthetic
ctcaccacattggttaacaagccctgtcatgttgagatggatagaaaaggtttccttaaaactagcatcctggct

SEQ ID NO: 219492 - DNA, 75 bp, Artificial Sequence
  Synthetic
aacaaagagcataacccctgaactccacccagctgtccgctgcctcaagaaccgcacttaagatcccctcacaac

SEQ ID NO: 219493 - DNA, 75 bp, Artificial Sequence
  Synthetic
ataagagttggcttctatgccaacctccctcaaagcatttgtagctcgggttaaaactctgttaatgacagcaag

SEQ ID NO: 219494 - DNA, 75 bp, Artificial Sequence
  Synthetic
ttgtttgcgcattaagcgctgcacattgctgacttcagaaaagtcaagaccatgaaggagagcctgagcatcctt

SEQ ID NO: 219495 - DNA, 75 bp, Artificial Sequence
  Synthetic
ttagaaaagatctccaacattgcatctgttcactttgagattcagcagtcctttccttaccagaatccaaatctg

SEQ ID NO: 219496 - DNA, 75 bp, Artificial Sequence
  Synthetic
gcaccggggatcctaggcaattctgttggtcttcagtggtaaggcttattttagtgaatccttgagtcaaagtgc

SEQ ID NO: 219497 - DNA, 75 bp, Artificial Sequence
  Synthetic
ctttccttaccagaatccaaatctgcatacaagaacttaaggactggagaggctcttcgaaactggaatgttaac

SEQ ID NO: 219498 - DNA, 75 bp, Artificial Sequence
  Synthetic
ccaaatcgacaaaagtcgatgaacatcaaagagctcatctagtgccagatgcatcccatctaggcccccagttct

SEQ ID NO: 219499 - DNA, 75 bp, Artificial Sequence
  Synthetic
tcagtcttaacaaattgactttctatgtccccttgccttagtttgttcctgaagatttgatactcttcctcaatt

SEQ ID NO: 219500 - DNA, 75 bp, Artificial Sequence
  Synthetic
ctccaagttctatagctgtagataatgttatgcacatataatcccacagaagaggccttaagtaagtgagaacag

SEQ ID NO: 219501 - DNA, 75 bp, Artificial Sequence
  Synthetic
tctccggcccaaacaactctgaacatgtccttcccttcagtcttaggctgcccccacttgactgaatcataactc

SEQ ID NO: 219502 - DNA, 75 bp, Artificial Sequence
  Synthetic
tgtccacacccgtccattgaattctttgtttcaatctatcagacatcattgatttcaatgcaccaactaaaagat

SEQ ID NO: 219503 - DNA, 75 bp, Artificial Sequence
  Synthetic
cctctttgtgttcagcacaagtttctatctcattagcatcttccttcacctagtcaaaataccaactcataggca

SEQ ID NO: 219504 - DNA, 75 bp, Artificial Sequence
  Synthetic
accattctaagcgggtgatgggtggctaagttcaaccaatgaaaccccaagtcagaatcagacaaaggttcaatg

SEQ ID NO: 219505 - DNA, 75 bp, Artificial Sequence
  Synthetic
attctaggttcagtttggaccaaaaaagctaacttctgtcttgatagcttctcattatctgcaaggtacttggag

SEQ ID NO: 219506 - DNA, 75 bp, Artificial Sequence
  Synthetic
tatctcattagcatcttccttcacctagtcaaaataccaactcataggcatattgtaggcaagtcatgtcctaaa

SEQ ID NO: 219507 - DNA, 75 bp, Artificial Sequence
  Synthetic
tgcgagggagggcttcaatgactgcactggtcaaaccaggttgagcagggaaaagatctgctacatcaatcccat

SEQ ID NO: 219508 - DNA, 75 bp, Artificial Sequence
  Synthetic
ctgtgtagggtttagacttatgcctgtgtggcctgtaggtcagctggtggtgccccacaaaaacacctacagaaa

SEQ ID NO: 219509 - DNA, 75 bp, Artificial Sequence
  Synthetic
atgggtataacatcccctaactgctgtgtatcctttaagaactcatttactacatctgattcaacaaaccaggct

SEQ ID NO: 219510 - DNA, 75 bp, Artificial Sequence
  Synthetic
atcctaggcatttaggattgcgcttttagagatctttgtgtgagtgggcttcattaagccatggggcaaatcata

SEQ ID NO: 219511 - DNA, 75 bp, Artificial Sequence
  Synthetic
ttagagatctttgtgtgagtgggcttcattaagccatggggcaaatcataacatttttccaggaagtgcctcatg

SEQ ID NO: 219512 - DNA, 75 bp, Artificial Sequence
  Synthetic
ccggggatcctaggcaatttagttggacttcagtggtaaggctcatttcagtgaatccccgaaccaaagtgccca

SEQ ID NO: 219513 - DNA, 75 bp, Artificial Sequence
  Synthetic
gcgcaccggggatcctaggcatttttggtagcgcttcctaagtgtcttttgtgacatggggcaaatagtaacatt

SEQ ID NO: 219514 - DNA, 75 bp, Artificial Sequence
  Synthetic
gtgacatggggcaaatagtaacattcttccaagaagtgcctcatgtgatagaggaggtaatgaatattgtactca

SEQ ID NO: 219515 - DNA, 75 bp, Artificial Sequence
  Synthetic
aatcgacaaaagtcgatgaacatcaaagagctcatctagtgccagatgcatcccatttaggcccccagttctgca

SEQ ID NO: 219516 - DNA, 75 bp, Artificial Sequence
  Synthetic
cttccaagaagtgcctcatgtgatagaggaggtaatgaatattgtactcatcgcactgtcgataatggcagtact

SEQ ID NO: 219517 - DNA, 75 bp, Artificial Sequence
  Synthetic
aagagctcatctagtgccagatgcatcccatttaggcccccagttctgcaagagttgctggtttgagaacagagg

SEQ ID NO: 219518 - DNA, 75 bp, Artificial Sequence
  Synthetic
aaaaagtcttcagtcattgattgagttgtcttcttcttcaatccaagttgggatttaatgtatgatttcatcatt

SEQ ID NO: 219519 - DNA, 75 bp, Artificial Sequence
  Synthetic
agtacaaccttagccacacttatgctgtagatgcagctaaccactgtgggactattgccaatggcgttcttcaga

SEQ ID NO: 219520 - DNA, 75 bp, Artificial Sequence
  Synthetic
ttctcttgctgtgtggtaggtcctgcacaaccaccctctacaagggggtctatgagctgcagaccctggaactga

SEQ ID NO: 219521 - DNA, 75 bp, Artificial Sequence
  Synthetic
cacaaccaccctctacaagggggtctatgagctgcagaccctggaactgaacatggaaacactcaacatgaccat

SEQ ID NO: 219522 - DNA, 75 bp, Artificial Sequence
  Synthetic
caggttgggtgccctgagccccaccaaccatgcctatcatgctcagcaatgctcttctttgctcaagctgctgtg

SEQ ID NO: 219523 - DNA, 75 bp, Artificial Sequence
  Synthetic
atgagacaggactagaactgaccttaaccaatacaagcattatcaaccacaaattttgcaatctgtctgatgctc

SEQ ID NO: 219524 - DNA, 75 bp, Artificial Sequence
  Synthetic
cttctcattgtttagacagctgcccgctaattgtgatgtaagcgcttcaaagtaatcctcaatgagccttgtgaa

SEQ ID NO: 219525 - DNA, 75 bp, Artificial Sequence
  Synthetic
agttgcaaatggtgtccttcagactttcatgaggatggcttggggtggaagttatattgctcttgattcaggcca

SEQ ID NO: 219526 - DNA, 75 bp, Artificial Sequence
  Synthetic
gaagagttttgtgacatgctaagattgtttgactttaacaaacaagctataaggaggctgaaagcagaagcacag

SEQ ID NO: 219527 - DNA, 75 bp, Artificial Sequence
  Synthetic
gacactcagggatttgctggttgaaagtatcactcagtgaatcaatggaaaggcgcaatccaatagcctaggatc

SEQ ID NO: 219528 - DNA, 75 bp, Artificial Sequence
  Synthetic
ccggggatcctaggcatttcagctggacttcagtggtgagactcatcttagtgaatccttgaatcaaagtaccta

SEQ ID NO: 219529 - DNA, 75 bp, Artificial Sequence
  Synthetic
caccaggggggtattgtttgactagatggatgctaattgaagctgagttgaagtgctttggcaatacagctgttg

SEQ ID NO: 219530 - DNA, 75 bp, Artificial Sequence
  Synthetic
atggatgctaattgaagctgagttgaagtgctttggcaatacagctgttgcaaaatgtaatgaaaagcatgatga

SEQ ID NO: 219531 - DNA, 75 bp, Artificial Sequence
  Synthetic
aatcgacaagagtcgatgaacatcaaagagcccatctagtgccagatgcatcccatctaggtcctcagttctgca

SEQ ID NO: 219532 - DNA, 75 bp, Artificial Sequence
  Synthetic
aaagactgagagctgaagcacaaatgagtattcaattaatcaacaaagcagtgaatgccctgataaatgatcaac

SEQ ID NO: 219533 - DNA, 75 bp, Artificial Sequence
  Synthetic
gagtattcaattaatcaacaaagcagtgaatgccctgataaatgatcaactaataatgaaaaaccatttacggga

SEQ ID NO: 219534 - DNA, 75 bp, Artificial Sequence
  Synthetic
tccttagcgtcagcagcagatgcccgatctgcaagatgccccttcctaccaggctaagggcagcagtacagccga

SEQ ID NO: 219535 - DNA, 75 bp, Artificial Sequence
  Synthetic
acacaaccaccggaagaacatcattgcctagatgctggcttgtatctaatggttcatacctcaatgaaactcact

SEQ ID NO: 219536 - DNA, 75 bp, Artificial Sequence
  Synthetic
gcctagatgctggcttgtatctaatggttcatacctcaatgaaactcacttctcagatgacattgaacagcaggc

SEQ ID NO: 219537 - DNA, 75 bp, Artificial Sequence
  Synthetic
atcgccagattgttgtgctggatgcacgtggcaggaagctgagattacctgccaaaaagacaaaagcaaagcgca

SEQ ID NO: 219538 - DNA, 75 bp, Artificial Sequence
  Synthetic
ggaaaacaccattgggtttggttgatctttttgttttcagcacaagtttctatctcattagcatctttcttcacc

SEQ ID NO: 219539 - DNA, 75 bp, Artificial Sequence
  Synthetic
ttctaagacattgtgcgctgtactcctccaaatgggaaacaagcaaaccaaagctccagaagcaaaaggcagccc

SEQ ID NO: 219540 - DNA, 75 bp, Artificial Sequence
  Synthetic
tgatcaaaataccaactcacaggcatattgtgggcaaaccatgtcccaaacctcacaggttaaaccacatgggtg

SEQ ID NO: 219541 - DNA, 75 bp, Artificial Sequence
  Synthetic
tgacaggtcagtaccatattgcgagggagggcttcaatgactgcactggttaatccaggttgagcagggaaaaga

SEQ ID NO: 219542 - DNA, 75 bp, Artificial Sequence
  Synthetic
agatgagacccccactggggcccccgtgacccaccgcctgttggcggtgggtcacgggggcgtccatttacagga

SEQ ID NO: 219543 - DNA, 75 bp, Artificial Sequence
  Synthetic
aaactgagaccatcagccactccaacagcacctccaaccgaagcagcggacagcatcagacccccaccctaccgt

SEQ ID NO: 219544 - DNA, 75 bp, Artificial Sequence
  Synthetic
tgtagtaatggaattctaacaatgttttgaattcctctgtatctcttgagagtaactctgttaagttctgatcaa

SEQ ID NO: 219545 - DNA, 75 bp, Artificial Sequence
  Synthetic
acaacattctttactcagaaactttctagcattataaaccatttcagcaagctcttcttccgatgcatcatcttt

SEQ ID NO: 219546 - DNA, 75 bp, Artificial Sequence
  Synthetic
ttcgttgtcaggtccgaccttggagaagtcaaactcattgaactgcagtttatctggattaataatcagcttcat

SEQ ID NO: 219547 - DNA, 75 bp, Artificial Sequence
  Synthetic
aatgatgtggctcataccaaccctgtcctctagcagtttcgaaacagtgggtctcaaggggaagtaatcacaagg

SEQ ID NO: 219548 - DNA, 75 bp, Artificial Sequence
  Synthetic
aatgtccacccctgaccactgcatccttaaccccagcctgtctatcatcatatcactcaatgctccaatcagcag

SEQ ID NO: 219549 - DNA, 75 bp, Artificial Sequence
  Synthetic
ggccagttgaattataagattgaggtgattcttgactgtaaaaacacaggttttttaacattgctgtagtgcagt

SEQ ID NO: 219550 - DNA, 75 bp, Artificial Sequence
  Synthetic
ctgagtacataacggatacatcatgtactaaatacttggcctgttgattgatcgagccaacatattcaagatgaa

SEQ ID NO: 219551 - DNA, 75 bp, Artificial Sequence
  Synthetic
tgataggtagttggtagtgaattcctcatgaagctcaccagtttttaatttattgaacaatatcctaagcattga

SEQ ID NO: 219552 - DNA, 75 bp, Artificial Sequence
  Synthetic
gatgaagaactcttggcaataggcttctttgcacctcacaacctgatatctagagggtccaaattcattttgcct

SEQ ID NO: 219553 - DNA, 75 bp, Artificial Sequence
  Synthetic
ctttagaatggacttgaggatgccatccattgtctgaggtgacaccttgattgtctccagcatgttaccaccatc

SEQ ID NO: 219554 - DNA, 75 bp, Artificial Sequence
  Synthetic
tccattgtctgaggtgacaccttgattgtctccagcatgttaccaccatccaacatgcaagctcctgccttcaca

SEQ ID NO: 219555 - DNA, 75 bp, Artificial Sequence
  Synthetic
tttctatgccaacctccctcaaagcattagtggctcgagttaaaactctgttgatgatggcaaggagctcacaat

SEQ ID NO: 219556 - DNA, 75 bp, Artificial Sequence
  Synthetic
ggtgtcaatcatgttcaggatggggtggctctgagttagcctgtctaagtcggaggtgttagggtactttgctgt

SEQ ID NO: 219557 - DNA, 75 bp, Artificial Sequence
  Synthetic
gcttgcaccacatcattcaagtcaacctgcccctgcttcgttaaacatgccagtgtcagacttggcatggtgcca

SEQ ID NO: 219558 - DNA, 75 bp, Artificial Sequence
  Synthetic
ctcctgctgtccatccaccgtttcagatctctttttgttgattctaatgagactaatctatcgttgacactcaca

SEQ ID NO: 219559 - DNA, 75 bp, Artificial Sequence
  Synthetic
tccatctctaccagcccgggccccttgattaccaccactcatccctatcatgttcagaagagctcgcctctgatc

SEQ ID NO: 219560 - DNA, 75 bp, Artificial Sequence
  Synthetic
tctctgttctggtaacttttgacttcaatttctctaggtcagcagccagaactaataagtcatctgaagtcagag

SEQ ID NO: 219561 - DNA, 75 bp, Artificial Sequence
  Synthetic
gagaagtttcctcctggtgttgaggatcctcagagactttatcttattcagaaaagatctccaacattgcatctg

SEQ ID NO: 219562 - DNA, 75 bp, Artificial Sequence
  Synthetic
caatttctctaggtcagcagccagaactaataagtcatctgaagtcagagtcccaactctcagcacactcttctg

SEQ ID NO: 219563 - DNA, 75 bp, Artificial Sequence
  Synthetic
ttaatcgtttcagatcattgtcatctcttctctgtttgcgcatcagccgttgaacattactgacctcagagaagt

SEQ ID NO: 219564 - DNA, 75 bp, Artificial Sequence
  Synthetic
acttccttttctttaaacaatgaaccattattgaaactagacacaaggagtgagataaattttttggaaacacca

SEQ ID NO: 219565 - DNA, 75 bp, Artificial Sequence
  Synthetic
attgccaagttgttgtgttgtctatacacagcagggagctgatgctacctactagaatgaacaaagcaaagcgca

SEQ ID NO: 219566 - DNA, 75 bp, Artificial Sequence
  Synthetic
cgcaccggggatcctaggcaatttagttgttcttcttttgaggccttgtgtgctgaattccaccaaatggggaac

SEQ ID NO: 219567 - DNA, 75 bp, Artificial Sequence
  Synthetic
gaacacatttgctacccaatgttctgcataatcccacaaagccagatgcaatggaactttggaatgcagatttgt

SEQ ID NO: 219568 - DNA, 75 bp, Artificial Sequence
  Synthetic
tgctgaattccaccaaatggggaacaagcaagccagggctccagaagcgaaggacagcccgagggccagtctgat

SEQ ID NO: 219569 - DNA, 75 bp, Artificial Sequence
  Synthetic
aagcaagccagggctccagaagcgaaggacagcccgagggccagtctgatcccagatgctacacacctagggcca

SEQ ID NO: 219570 - DNA, 75 bp, Artificial Sequence
  Synthetic
caatcactatttgtgcctcaactgcctcaccctgcttctaagcgtcagcagcaggtgccccatctgcaagatgcc

SEQ ID NO: 219571 - DNA, 75 bp, Artificial Sequence
  Synthetic
ctcaccctgcttctaagcgtcagcagcaggtgccccatctgcaagatgcccctccccacaagactgagaccatca

SEQ ID NO: 219572 - DNA, 75 bp, Artificial Sequence
  Synthetic
accctacagcccctgagccgcccaccgacccccaccatccctccgtccccccgacaccccccggggggacccccc

SEQ ID NO: 219573 - DNA, 75 bp, Artificial Sequence
  Synthetic
cgacccccaccatccctccgtccccccgacaccccccggggggaccccccgccgggggcccccccgggggccagc

SEQ ID NO: 219574 - DNA, 75 bp, Artificial Sequence
  Synthetic
agctcctcacatgttctgccttttagtctcagcctgccactacttgattgcaccatcaccctcctccttgactta

SEQ ID NO: 219575 - DNA, 75 bp, Artificial Sequence
  Synthetic
ttgggcttgtgccagaatggcttgtgggtcagttagtggtgcctcacaaaagatccaacagaaatgagagacaat

SEQ ID NO: 219576 - DNA, 75 bp, Artificial Sequence
  Synthetic
gtctcagcctgccactacttgattgcaccatcaccctcctccttgacttactgtagcagagggcataacctttga

SEQ ID NO: 219577 - DNA, 75 bp, Artificial Sequence
  Synthetic
tgttggattcggactaatgcctgtgtggcttgtgggtcagctaatggtgccccacaaaagctcctacagaaatga

SEQ ID NO: 219578 - DNA, 75 bp, Artificial Sequence
  Synthetic
ctattcggtgctgcaaccctcaacgtggagacaatgtccactcctgaccactgcattcttaaacccagcctgtct

SEQ ID NO: 219579 - DNA, 75 bp, Artificial Sequence
  Synthetic
ctgcattcttaaacccagcctgtctgtcatcatgtcactcagtgccccaatcagcaagtcagatgaagtgtcccc

SEQ ID NO: 219580 - DNA, 75 bp, Artificial Sequence
  Synthetic
cgtgcaaacacttcagttaactgtgtgacagccaaagctgtaagcttgttgaagtcataatccagaacacgagac

SEQ ID NO: 219581 - DNA, 75 bp, Artificial Sequence
  Synthetic
ccataagcctcccctatgcacaaccagagggactggttcagtgcaagggcctaccagtacaaagtcatactccgt

SEQ ID NO: 219582 - DNA, 75 bp, Artificial Sequence
  Synthetic
ctagttgatttgtgtcaaccagaaattcgttaatgacctcagtgtcaatataccatgctgatttgcctttgaagg

SEQ ID NO: 219583 - DNA, 75 bp, Artificial Sequence
  Synthetic
ttcgttaatgacctcagtgtcaatataccatgctgatttgcctttgaaggtaggtcctgatagaaccaacctcca

SEQ ID NO: 219584 - DNA, 75 bp, Artificial Sequence
  Synthetic
gtgtccttgttgttgccacaaaagagcggacatatgattcaaagtagatttgtctcataaagttatccactgcat

SEQ ID NO: 219585 - DNA, 75 bp, Artificial Sequence
  Synthetic
catcatacaccaaatacttgccctgttggtttattgagccactgtaatcaagatggatggcaaagttttccttaa

SEQ ID NO: 219586 - DNA, 75 bp, Artificial Sequence
  Synthetic
acaaaaagaacctttatgatcatgcacttatgagcataatctcaactttccacttgtccattcctaactttaatc

SEQ ID NO: 219587 - DNA, 75 bp, Artificial Sequence
  Synthetic
aactagcatcttgacttttaatgcggaacctcactgtctgacttagttttgcagaccctgaaggtagtaatgcaa

SEQ ID NO: 219588 - DNA, 75 bp, Artificial Sequence
  Synthetic
tacaacctaagtcacagctatgctggagatgcagccaaccattgtggcacagttgcaaatggcgttttgcagacc

SEQ ID NO: 219589 - DNA, 75 bp, Artificial Sequence
  Synthetic
tctgcatacaagaacttaagaactggagaggctcttcggaactggaatgttaactgttcaatgttgtcatcacag

SEQ ID NO: 219590 - DNA, 75 bp, Artificial Sequence
  Synthetic
agttatcaatatctgataattcagaatacaacctgggacgatcactgccaattctcaagaccatctcccattggt

SEQ ID NO: 219591 - DNA, 75 bp, Artificial Sequence
  Synthetic
taactgttcaatgttgtcatcacaggtgtctattttatcactatatagctttttgaaatcctctaataacttcac

SEQ ID NO: 219592 - DNA, 75 bp, Artificial Sequence
  Synthetic
agtgttttgcacgcttgtcagttagaacattgatgctttcaattcctgagagcctcccagacgttaaggctaaag

SEQ ID NO: 219593 - DNA, 75 bp, Artificial Sequence
  Synthetic
acaaatggtctcacatatgattcaaagtagatctgtctcatgaaattgtcaacagcatcactagtactcaccact

SEQ ID NO: 219594 - DNA, 75 bp, Artificial Sequence
  Synthetic
ctcttcgaataatgcattactttcttgtgaatactttaacagggtaaataaggtgtccctgagtttgtcattcac

SEQ ID NO: 219595 - DNA, 75 bp, Artificial Sequence
  Synthetic
aaatgtttcggcaacacagctgtggccaaatgtaatgagaagcatgatgaagaattctgtgacatgctgaggcta

SEQ ID NO: 219596 - DNA, 75 bp, Artificial Sequence
  Synthetic
ttccattgtcccccatcactgcttcaacaccttgagtccccagtagctgagtctgtatggatctaatgtaaagat

SEQ ID NO: 219597 - DNA, 75 bp, Artificial Sequence
  Synthetic
taggcctctttacacctcacaacctggtatctagaaggtccaaattcattttgccttagtttcactgtggaagat

SEQ ID NO: 219598 - DNA, 75 bp, Artificial Sequence
  Synthetic
aacacagatgggtacaaccttctcaaggaatgaatgatatggttcaaaccaaccctatcttccaacagctttgaa

SEQ ID NO: 219599 - DNA, 75 bp, Artificial Sequence
  Synthetic
aggaatgaatgatatggttcaaaccaaccctatcttccaacagctttgaagcagtaggcttcaaaggaaagtaat

SEQ ID NO: 219600 - DNA, 75 bp, Artificial Sequence
  Synthetic
gagggtctcgcagtgtcttcttcacttccttttctttaaacaatgaaccattattaaaactagacacaaggagtg

SEQ ID NO: 219601 - DNA, 75 bp, Artificial Sequence
  Synthetic
ataccaactcataggcatattgtaggcaagtcgtgtcccaaacctcacagattgaatcatatgggcatttgttcc

SEQ ID NO: 219602 - DNA, 75 bp, Artificial Sequence
  Synthetic
ttcaaaattggcgggggatgatctaacaaagcactcaagtaagattagaacattaccagtgagtttgtagccgtc

SEQ ID NO: 219603 - DNA, 75 bp, Artificial Sequence
  Synthetic
cctaaaacccatgcgcccaattctattgcagttgacaaagaaatacacatataatcccacaatagaggcctgaag

SEQ ID NO: 219604 - DNA, 75 bp, Artificial Sequence
  Synthetic
tctgcacaacattctttgcttagaaactttcttgcattgtaaaccatttcagcaagctcttcctccgatgcatca

SEQ ID NO: 219605 - DNA, 75 bp, Artificial Sequence
  Synthetic
ttgcagttgacaaagaaatacacatataatcccacaatagaggcctgaagtaactgatcacaccttcacctccac

SEQ ID NO: 219606 - DNA, 75 bp, Artificial Sequence
  Synthetic
tagtcaaaataccaactcatagacacattgtgggcaaaccgtgtcccaaacctcacaggttgaatcatatgggca

SEQ ID NO: 219607 - DNA, 75 bp, Artificial Sequence
  Synthetic
aacaattcgatcccctgaacaccagaaaccaaagattgtatagatttaatatacaggttctccttattgggcccc

SEQ ID NO: 219608 - DNA, 75 bp, Artificial Sequence
  Synthetic
aaaccaaagattgtatagatttaatatacaggttctccttattgggcccccgaacacacttgctacccaatgtcc

SEQ ID NO: 219609 - DNA, 75 bp, Artificial Sequence
  Synthetic
atgtcttcctccatcgccgattatggcacctgtgttgggtttgggcttgtgcctgtatggcttgcaggtcagctg

SEQ ID NO: 219610 - DNA, 75 bp, Artificial Sequence
  Synthetic
ttgatggcttcagataacaatttttgtgcacctcgagtgaaggtggaagacaatttattctggattgtcttgaca

SEQ ID NO: 219611 - DNA, 75 bp, Artificial Sequence
  Synthetic
gcctgtatggcttgcaggtcagctggtggtgccctacaaagaaactcccacagaaatgagagacaatatgcctag

SEQ ID NO: 219612 - DNA, 75 bp, Artificial Sequence
  Synthetic
gtgcacctcgagtgaaggtggaagacaatttattctggattgtcttgacaatagtggggatcttttcatcatcta

SEQ ID NO: 219613 - DNA, 75 bp, Artificial Sequence
  Synthetic
ggatgatgtgcagccaagttcaaccaagaatattcaaggtcagactcagatgggggctcaacatccagtagttcg

SEQ ID NO: 219614 - DNA, 75 bp, Artificial Sequence
  Synthetic
aagaatattcaaggtcagactcagatgggggctcaacatccagtagttcgcagagatttctcaatgaagaaaggt

SEQ ID NO: 219615 - DNA, 75 bp, Artificial Sequence
  Synthetic
actttctgcaacacatcactggagaaaattgaaggaaaaaaccgtttgggatcagcataaaaggaacaaacctct

SEQ ID NO: 219616 - DNA, 75 bp, Artificial Sequence
  Synthetic
ttcaatctgttgtacaactttctcaacatagatctgatcttgccacaagcatcaggaatcagtccttctatttgc

SEQ ID NO: 219617 - DNA, 75 bp, Artificial Sequence
  Synthetic
cttccctgtgattcaaggagtttccttatgtcatcagacccctggcaggtaatgaccatgttccgagggagtgtg

SEQ ID NO: 219618 - DNA, 75 bp, Artificial Sequence
  Synthetic
atcaggaatcagtccttctatttgcctcataatcctgtaactgcggttgccatccacccagtctctgacatctgt

SEQ ID NO: 219619 - DNA, 75 bp, Artificial Sequence
  Synthetic
acatggaaacactcaatatgaccatgcctctctcctgcacaaaaaacagcagtcatcattacataagggtgggca

SEQ ID NO: 219620 - DNA, 75 bp, Artificial Sequence
  Synthetic
tggatgcagccaaccattgtggcacagttgcaaatggtgtcctacagactttcatgaggatggcctggggtggga

SEQ ID NO: 219621 - DNA, 75 bp, Artificial Sequence
  Synthetic
attgcacagatgaacagggacaccatttgcaactgattgatcaatgattgtgtcaattgtctctgccagttggtg

SEQ ID NO: 219622 - DNA, 75 bp, Artificial Sequence
  Synthetic
ataatggcacttcatctccccaaacaaagaatctggatttgaattctgcaacaaacctgccaataacacttttgg

SEQ ID NO: 219623 - DNA, 75 bp, Artificial Sequence
  Synthetic
aaagaatctggatttgaattctgcaacaaacctgccaataacacttttggggctaacaaatttgttgagctgatc

SEQ ID NO: 219624 - DNA, 75 bp, Artificial Sequence
  Synthetic
tttgcaacaattctgtcagagtctgatcaaagagagagatctgatcatcactagaggtataagcgtctattgtac

SEQ ID NO: 219625 - DNA, 75 bp, Artificial Sequence
  Synthetic
gtctctggttctcttccggctgtctatccatcgttttaaatctctttttgttgattccagtgaaaccagtctatc

SEQ ID NO: 219626 - DNA, 75 bp, Artificial Sequence
  Synthetic
tatcttgggctcctctcacaaaggaccagagatatttacattagtagaaggctactaggcacattcacatggaca

SEQ ID NO: 219627 - DNA, 75 bp, Artificial Sequence
  Synthetic
atcaaagagagagatctgatcatcactagaggtataagcgtctattgtaccaccacaaatacaaccaatagcata

SEQ ID NO: 219628 - DNA, 75 bp, Artificial Sequence
  Synthetic
tcagctgaaaatattgctggaaaatatcttttagggtcagcataaaatgagcacacctcaccaactttgttgtca

SEQ ID NO: 219629 - DNA, 75 bp, Artificial Sequence
  Synthetic
gtattccctgacccatgtcaagtatcgaactgatatgagagggcaccactccgatttggaaattagagtaaaaga

SEQ ID NO: 219630 - DNA, 75 bp, Artificial Sequence
  Synthetic
agcaagaagaatcagaacgtcaaaaataaggagaagtttccttctggtgttgaggatccttagagactttatctt

SEQ ID NO: 219631 - DNA, 75 bp, Artificial Sequence
  Synthetic
cgaactgatatgagagggcaccactccgatttggaaattagagtaaaagaaatcttctgttatggactgagtggt

SEQ ID NO: 219632 - DNA, 75 bp, Artificial Sequence
  Synthetic
aatgcaaagcgcaatcctaggcatttttggttgcgcaattcaggtttctttctcaaaatggggcagatagtgaca

SEQ ID NO: 219633 - DNA, 75 bp, Artificial Sequence
  Synthetic
tctcaaaatggggcagatagtgacattctttcaagaagtgccccatgttatagaggaagtgatgaacattgttct

SEQ ID NO: 219634 - DNA, 75 bp, Artificial Sequence
  Synthetic
tgcatacaagaacttaaggactggagaggctcttcggaactggaatgttaactgttcaatgttgtcatcacaggt

SEQ ID NO: 219635 - DNA, 75 bp, Artificial Sequence
  Synthetic
ctgtatcaaatttaaagttcagacacttactcttataatgagagtatcttcccatcagcttattcccattcatca

SEQ ID NO: 219636 - DNA, 75 bp, Artificial Sequence
  Synthetic
gtagatcaaacccaaatctgttagcgcttgcacaacatcattcaggtcaacctgcccttgttttgttagacatgc

SEQ ID NO: 219637 - DNA, 75 bp, Artificial Sequence
  Synthetic
atactacattaaaaggtatctccaccatcttatgcatatgccacataagtaaggttgagaggtagtctctcccct

SEQ ID NO: 219638 - DNA, 75 bp, Artificial Sequence
  Synthetic
ttctttcaagaagtgccccatgttatagaggaagtgatgaacattgttctcatagcactgtctatattggcagtg

SEQ ID NO: 219639 - DNA, 75 bp, Artificial Sequence
  Synthetic
tttcctcctgctgtgtggaagatcctgttcctccaatttatacaagggagtttatgagctccaatctctggacct

SEQ ID NO: 219640 - DNA, 75 bp, Artificial Sequence
  Synthetic
tcaaatcattgtcatcccttctctccttgcgcatcaaccgttgaacattactgacttcggagaagtcaagtccat

SEQ ID NO: 219641 - DNA, 75 bp, Artificial Sequence
  Synthetic
caaaaggagtacatggagagacaggggaagacaccattaggtctggttgacctctttgtgttcagcacaagtttc

SEQ ID NO: 219642 - DNA, 75 bp, Artificial Sequence
  Synthetic
gctataagagacatgtgccaaagaaacatttagtttcatggaaagaatggcattttcaaactccttctcgttatt

SEQ ID NO: 219643 - DNA, 75 bp, Artificial Sequence
  Synthetic
tgttcctccaatttatacaagggagtttatgagctccaatctctggacctgaacatggaaacactcaacatgact

SEQ ID NO: 219644 - DNA, 75 bp, Artificial Sequence
  Synthetic
taatgagacagggctggagctgaccttgaccaacactagcttgattaatcacaaattctgcaacctttcagatgc

SEQ ID NO: 219645 - DNA, 75 bp, Artificial Sequence
  Synthetic
ttgaccaacactagcttgattaatcacaaattctgcaacctttcagatgcccacaaaaagaacctgtatgaccac

SEQ ID NO: 219646 - DNA, 75 bp, Artificial Sequence
  Synthetic
ataaggagaatttaagcctccctgtatcaggtcccactgaattataagactgtggtgactcttggctatagaagc

SEQ ID NO: 219647 - DNA, 75 bp, Artificial Sequence
  Synthetic
tcagtatgaagcaatgagttgtgattttaatgggggcaagattagtgtgcaatacaatctaagccatgcttatgc

SEQ ID NO: 219648 - DNA, 75 bp, Artificial Sequence
  Synthetic
caccatgtctctgggtagcactgctctcagagccagtgttttcaatccacctgacactgctgcgtcaaacatgat

SEQ ID NO: 219649 - DNA, 75 bp, Artificial Sequence
  Synthetic
aagctacattgctcttgactcaggccgtgggaactgggactgtatcatgaccagttatcagtatctgataattca

SEQ ID NO: 219650 - DNA, 75 bp, Artificial Sequence
  Synthetic
tcctcaaagattgtgtccacaagaaggactttatctcctttgaggcactcattgtcgggttgttgtgttggatac

SEQ ID NO: 219651 - DNA, 75 bp, Artificial Sequence
  Synthetic
gttatctcggactcctctcacagagaaccagagacatttacataagcaggaggttgttgggtacattcacatgga

SEQ ID NO: 219652 - DNA, 75 bp, Artificial Sequence
  Synthetic
caggggatcctaggcaatttggttgttctttttgagggcttttgtgtcaaactccaccagatggggaacaagcaa

SEQ ID NO: 219653 - DNA, 75 bp, Artificial Sequence
  Synthetic
cgttaactccccaataggacattgtgacatatgtccacagtaaaaatacttatctttcaacttagtattctcata

SEQ ID NO: 219654 - DNA, 75 bp, Artificial Sequence
  Synthetic
aaccagagacatttacataagcaggaggttgttgggtacattcacatggacactgtcagactccgagggtaacgc

SEQ ID NO: 219655 - DNA, 75 bp, Artificial Sequence
  Synthetic
caaaatcctcaaccatgtgattagataactcacctttaattaatctaatataaaatttgtttgagacaatctcat

SEQ ID NO: 219656 - DNA, 75 bp, Artificial Sequence
  Synthetic
tgaaatgctttggaaatacagcggtagcaaagtgcaatgagaagcatgatgaagaattctgtgacatgctcagac

SEQ ID NO: 219657 - DNA, 75 bp, Artificial Sequence
  Synthetic
agcaaagtgcaatgagaagcatgatgaagaattctgtgacatgctcagactatttgatttcaataagcaggccat

SEQ ID NO: 219658 - DNA, 75 bp, Artificial Sequence
  Synthetic
tctgcacaacattctttacttagaaactttcttgcattataaaccatttcagcaagctcttcctctgatgcatca

SEQ ID NO: 219659 - DNA, 75 bp, Artificial Sequence
  Synthetic
cagtatggtttgtaaatcagctggtggtgccccacgaaagctttcacagaaatgagagacaataagcctaggatc

SEQ ID NO: 219660 - DNA, 75 bp, Artificial Sequence
  Synthetic
cgcaccgaggatcctaggcattaaggctatcttatttaattgtctttaattgcctcttgtgtcttctgtgcccct

SEQ ID NO: 219661 - DNA, 75 bp, Artificial Sequence
  Synthetic
caattttttcaacggtctctctcagttggtcaaaataaatgcttgcacccccatcaagcaaaatttcgtctaggt

SEQ ID NO: 219662 - DNA, 75 bp, Artificial Sequence
  Synthetic
cagtaaatgctttgatcaatgatcaattgattatgaaaaaccatttacgggacataatggggattccatattgta

SEQ ID NO: 219663 - DNA, 75 bp, Artificial Sequence
  Synthetic
tgcctcttgtgtcttctgtgcccctacgggaccctatcccatagcgaactgttgctctagcagaccacatgttct

SEQ ID NO: 219664 - DNA, 75 bp, Artificial Sequence
  Synthetic
attgattatgaaaaaccatttacgggacataatggggattccatattgtaattacagcaaatattggtacctcaa

SEQ ID NO: 219665 - DNA, 75 bp, Artificial Sequence
  Synthetic
taactcacctttaattaatctaatataaaatttgtttgagacaatctcatccagatcatttactgatggctggtc

SEQ ID NO: 219666 - DNA, 75 bp, Artificial Sequence
  Synthetic
ttggtcaaaataaatgcttgcacccccatcaagcaaaatttcgtctaggtcagccttgtctacaccatctttgtg

SEQ ID NO: 219667 - DNA, 75 bp, Artificial Sequence
  Synthetic
catagtcttgcttgttgagaaggtattttccttttcttgagaaaacttcagtgagttgtgaaacagccagtgctg

SEQ ID NO: 219668 - DNA, 75 bp, Artificial Sequence
  Synthetic
atggctcatacctgaatgagacccacttctctgatgatatagagcaacaagctgacaacatgatcacagagatgc

SEQ ID NO: 219669 - DNA, 75 bp, Artificial Sequence
  Synthetic
tagcagagagcataacctttgaattccacccaattgtccactgcctcaagaactgcactcaggaccttcgcatta

SEQ ID NO: 219670 - DNA, 75 bp, Artificial Sequence
  Synthetic
acctagtggacaacgagagattgtcaagacagaagttagcatttcttgtgcagacagagcctaggatgctattaa

SEQ ID NO: 219671 - DNA, 75 bp, Artificial Sequence
  Synthetic
cttctctgatgatatagagcaacaagctgacaacatgatcacagagatgctacaaaaggaatatatggaaaggca

SEQ ID NO: 219672 - DNA, 75 bp, Artificial Sequence
  Synthetic
ttttccttttcttgagaaaacttcagtgagttgtgaaacagccagtgctgtaagcttattgaagtcataatttaa

SEQ ID NO: 219673 - DNA, 75 bp, Artificial Sequence
  Synthetic
ccaaatccaaagctgtggcacagccgctagtgatgagggggtctctaatttccttctttacttccctttccttaa

SEQ ID NO: 219674 - DNA, 75 bp, Artificial Sequence
  Synthetic
tttatctgatcagtatcttcctccatctagtcaagattccgacccatagacacattgtaggtaagccatgtccta

SEQ ID NO: 219675 - DNA, 75 bp, Artificial Sequence
  Synthetic
aggacaaatctgtggaaagaattctccatgaccatggaatcttgacaccttcactatgtttgtggtacccggacg

SEQ ID NO: 219676 - DNA, 75 bp, Artificial Sequence
  Synthetic
cacattgtaggtaagccatgtcctaagccccacaggctgaaccacatgggtatctgttcctgtggtttatacaag

SEQ ID NO: 219677 - DNA, 75 bp, Artificial Sequence
  Synthetic
ttctctcacaaacatctcaagatcctggtcctgtataacaggtgtgaaagatgccaatttcctctcacattccca

SEQ ID NO: 219678 - DNA, 75 bp, Artificial Sequence
  Synthetic
gctagtgatgagggggtctctaatttccttctttacttccctttccttaaatagtgaaccattattgaaggaaga

SEQ ID NO: 219679 - DNA, 75 bp, Artificial Sequence
  Synthetic
gaccctcggcgcttgtacacccatttttgctcagaaacctttttgcattgtggatcatatcatccagttcttctt

SEQ ID NO: 219680 - DNA, 75 bp, Artificial Sequence
  Synthetic
agtacattgaggacttcaaaaaattagagcagctgaaagaagacctgaagagtgtcgacatcaatttaataccac

SEQ ID NO: 219681 - DNA, 75 bp, Artificial Sequence
  Synthetic
tttgctcagaaacctttttgcattgtggatcatatcatccagttcttcttccgttgctgtgtctgcaggattaat

SEQ ID NO: 219682 - DNA, 75 bp, Artificial Sequence
  Synthetic
aagttgctgtgagcttaggttgcccatatagacacctgcactcaatggcctttctgttctggtcacctttgactt

SEQ ID NO: 219683 - DNA, 75 bp, Artificial Sequence
  Synthetic
ccatgaccatggaatcttgacaccttcactatgtttgtggtacccggacggttacaaactgacgggcaatgttct

SEQ ID NO: 219684 - DNA, 75 bp, Artificial Sequence
  Synthetic
agagcagctgaaagaagacctgaagagtgtcgacatcaatttaataccacttatagacgggagaacatcattcta

SEQ ID NO: 219685 - DNA, 75 bp, Artificial Sequence
  Synthetic
ttatctgatctgttaacctatctggtgtttcttttgtaataaaatgacacatataagaaatgttcaagatgaact

SEQ ID NO: 219686 - DNA, 75 bp, Artificial Sequence
  Synthetic
tctcacttttaaagtatgcacaggagagtaattcactttttgaagagtcagagtatagcagactctgtgaatctt

SEQ ID NO: 219687 - DNA, 75 bp, Artificial Sequence
  Synthetic
tgtttcttttgtaataaaatgacacatataagaaatgttcaagatgaacttgaatctattggtcatcatactctt

SEQ ID NO: 219688 - DNA, 75 bp, Artificial Sequence
  Synthetic
aaggtcccgttggaggcacaagagacacaagaggcaattaaagacaataaaattagatagccttaatgcctagga

SEQ ID NO: 219689 - DNA, 75 bp, Artificial Sequence
  Synthetic
cttcttcttttcaacaacaacacctgtgtgcatgtgacacaaatctttgtattgatcccatacagcattttcaaa

SEQ ID NO: 219690 - DNA, 75 bp, Artificial Sequence
  Synthetic
gtgtgcatgtgacacaaatctttgtattgatcccatacagcattttcaaatttcctagagtcaattttgctaagg

SEQ ID NO: 219691 - DNA, 75 bp, Artificial Sequence
  Synthetic
tgttcaggagagctcgtctttggtcaagttgttgcgaactcaggttgcccatataaacacctgagcttagtggtc

SEQ ID NO: 219692 - DNA, 75 bp, Artificial Sequence
  Synthetic
gcaagaactcaacatcagtaattaaatcttctctaactttgtcaatgagatccttatgatgaaaatccgaaacat

SEQ ID NO: 219693 - DNA, 75 bp, Artificial Sequence
  Synthetic
caatatggggcaaatagtgacattctttcaagaggtgcctcatgtgatagaagaggtgatgaacattgttcttat

SEQ ID NO: 219694 - DNA, 75 bp, Artificial Sequence
  Synthetic
aggaagtgattgcctcatgccaccagggcatcaataataaattaacagctcatgaggtaaagctgcagatcgaag

SEQ ID NO: 219695 - DNA, 75 bp, Artificial Sequence
  Synthetic
ctttatgtcttcagacccttggcaggtgataaccatatttcgggggagtgcctcaataacagcactggtcaaacc

SEQ ID NO: 219696 - DNA, 75 bp, Artificial Sequence
  Synthetic
ctgggatgggctaggattaagatcaagatcatctttgttaaaaacttaatgttgtttagttgttctttcagctcg

SEQ ID NO: 219697 - DNA, 75 bp, Artificial Sequence
  Synthetic
tgaacattactgacttcagagaagtcaagtccatgtaaaagagcctgggcatctttcaccacctgtagtttgatg

SEQ ID NO: 219698 - DNA, 75 bp, Artificial Sequence
  Synthetic
agttacttaatgagcttaacaatttgtacgctgataaggtagttgcagaagacaatatcgaacacttaatttacc

SEQ ID NO: 219699 - DNA, 75 bp, Artificial Sequence
  Synthetic
cctcttattatgtggaaggtcttgctcatccaacctctacaagggggtctatgaacttcaatctctggacctgaa

SEQ ID NO: 219700 - DNA, 75 bp, Artificial Sequence
  Synthetic
attgccagattatagtgctgaatgcacacaacaaaaaccgagattatctgccaaagagataaaagcaaagcgcaa

SEQ ID NO: 219701 - DNA, 75 bp, Artificial Sequence
  Synthetic
taggtgataggacacctgcatctctgtctctagttttcttcctgctgtctatccaccgttttaaatccctttttg

SEQ ID NO: 219702 - DNA, 75 bp, Artificial Sequence
  Synthetic
agtgggctctcggaagaagtgtatgtaacacccagagctaggctgatatagggcaacttccaccgggtcttccgg

SEQ ID NO: 219703 - DNA, 75 bp, Artificial Sequence
  Synthetic
tttcaagaggtgcctcatgtgatagaagaggtgatgaacattgttcttatagcattgtctatattggcagtgttg

SEQ ID NO: 219704 - DNA, 75 bp, Artificial Sequence
  Synthetic
aaactattggagaatgtcaggttcaatgctggagatcattcctaaataaagtaaaatctttgaggatattgaaca

SEQ ID NO: 219705 - DNA, 75 bp, Artificial Sequence
  Synthetic
tgacacagggctggaactgaccttgaccaacacgagcatactcaatcacaaattctgcaacctatcagatgctca

SEQ ID NO: 219706 - DNA, 75 bp, Artificial Sequence
  Synthetic
tcatccaacctctacaagggggtctatgaacttcaatctctggacctgaacatggagacactcaacatgaccatg

SEQ ID NO: 219707 - DNA, 75 bp, Artificial Sequence
  Synthetic
agagtaggtcaacccagctggaaagcctgcagattggagggatttatttgagctaccactgtttggtttttgtgg

SEQ ID NO: 219708 - DNA, 75 bp, Artificial Sequence
  Synthetic
ctcttgacaatatgcctctttgcacctgaccacttgataccttgctggtccgaactcattctgtctcagctttac

SEQ ID NO: 219709 - DNA, 75 bp, Artificial Sequence
  Synthetic
accaacacgagcatactcaatcacaaattctgcaacctatcagatgctcacaagaaagacctatatgatcacgca

SEQ ID NO: 219710 - DNA, 75 bp, Artificial Sequence
  Synthetic
tgaggatcctcagagactttatcttattcagaaaagatctccaacattgcatctgttcactttgagagtcagcag

SEQ ID NO: 219711 - DNA, 75 bp, Artificial Sequence
  Synthetic
atacgaagcaatgagttgtgacttcaatgggggcaaaatcagtgtgcagtacaatctaagccattcttatgctat

SEQ ID NO: 219712 - DNA, 75 bp, Artificial Sequence
  Synthetic
ttaggcctttcttagaccctttgtgctgaactccaccagatggggaacaagcaagtcaaagctcctgaagcaagg

SEQ ID NO: 219713 - DNA, 75 bp, Artificial Sequence
  Synthetic
tggccacccatcacctgacaggcagattttatagagtatgttttcataggggtttctttcacccggggtgtctga

SEQ ID NO: 219714 - DNA, 75 bp, Artificial Sequence
  Synthetic
tagatctacaacccccatgacataaggaaacatttcttcctccgatctctggtaactaattgtagggacaactcc

SEQ ID NO: 219715 - DNA, 75 bp, Artificial Sequence
  Synthetic
gtttaaaagggtggttggggtcttgcttcttaagagttaaagatagactagtttctttggaggcaacaaagaggg

SEQ ID NO: 219716 - DNA, 75 bp, Artificial Sequence
  Synthetic
atcaaatcctcaattcaatattccagaaaaccattttgaaggccaccactgctttaaaggatgttgggatcagtg

SEQ ID NO: 219717 - DNA, 75 bp, Artificial Sequence
  Synthetic
ctatattgctcttgactcaggccgtggaaactgggactgtattatgactagctatcaatatctgattattcagaa

SEQ ID NO: 219718 - DNA, 75 bp, Artificial Sequence
  Synthetic
aacggacagcaccagacctccaccctacagtccctgaacactccaccgacccctaccactcccatcctccccccg

SEQ ID NO: 219719 - DNA, 75 bp, Artificial Sequence
  Synthetic
gattgtttctagcatgttgccaccatccaacatacaggcacctgctttcactgcagcacccagactgaaattgta

SEQ ID NO: 219720 - DNA, 75 bp, Artificial Sequence
  Synthetic
actaattccaacatcttttaaagcagtggttgcctttaaaacggttttctggaatattgagttaagaatctgatt

SEQ ID NO: 219721 - DNA, 75 bp, Artificial Sequence
  Synthetic
aatgggggcaaaatcagtgtgcagtacaatctaagccattcttatgctatagatgcagctaatcattgcggcaca

SEQ ID NO: 219722 - DNA, 75 bp, Artificial Sequence
  Synthetic
gagttgtcccaacaatcagttatcagagaacagaggaagaaacattcccttatgtgatgggggatgtggaactac

SEQ ID NO: 219723 - DNA, 75 bp, Artificial Sequence
  Synthetic
tagagacatttacattagcaggaggttgctgggcacattcacgtggacactgtcagactctgagggtaatgctac

SEQ ID NO: 219724 - DNA, 75 bp, Artificial Sequence
  Synthetic
ggaaactgggactgtattatgactagctatcaatatctgattattcagaacacaacctgggaaaatcactgtcag

SEQ ID NO: 219725 - DNA, 75 bp, Artificial Sequence
  Synthetic
gtctgaagtattggggtatttggcagtataaatcaaacccagatctgtgagtgcttgaaccacatcattcaggtc

SEQ ID NO: 219726 - DNA, 75 bp, Artificial Sequence
  Synthetic
aagacccatgcacccagttctattgcagttgataaggaaatgcacatataatcccataataagggtctgaaataa

SEQ ID NO: 219727 - DNA, 75 bp, Artificial Sequence
  Synthetic
atctctttttgttgactctaaggagaccagtctatcattaacacttatgaaacaggatcccaaccacccttttaa

SEQ ID NO: 219728 - DNA, 75 bp, Artificial Sequence
  Synthetic
taaagctgagacagaatgaatttggacccgcaaggtatcaagtggtcagatgcaaagaagcatattgtcaagagt

SEQ ID NO: 219729 - DNA, 75 bp, Artificial Sequence
  Synthetic
aaagtgtaatgaaaagcatgatgaagaattttgcgacatgctcagactttttgattttaataagcaggctataag

SEQ ID NO: 219730 - DNA, 75 bp, Artificial Sequence
  Synthetic
ttgctgggcacattcacgtggacactgtcagactctgagggtaatgctacaccaggaggttattgtctgaccagg

SEQ ID NO: 219731 - DNA, 75 bp, Artificial Sequence
  Synthetic
atttttcacatcccaaactctcaccactccatccctcccagcctgggccccttgattgccacctgtcattcctat

SEQ ID NO: 219732 - DNA, 75 bp, Artificial Sequence
  Synthetic
tgtgttcaatatcctcaaagatttcactttgtttagaaatgacctccaacattgcacttgacattctccagctgc

SEQ ID NO: 219733 - DNA, 75 bp, Artificial Sequence
  Synthetic
gaattttgcgacatgctcagactttttgattttaataagcaggctataagtagattgaaatctgaagcacaaatg

SEQ ID NO: 219734 - DNA, 75 bp, Artificial Sequence
  Synthetic
ataacaaagttggtgaggtgtgctcattttatgctgatcctaaaagatattttccagcaatattttcagctgagg

SEQ ID NO: 219735 - DNA, 75 bp, Artificial Sequence
  Synthetic
aattatgaagaaccacttgcgagacatcatggggattccatattgtaattacagcaagtattggtacctcaatca

SEQ ID NO: 219736 - DNA, 75 bp, Artificial Sequence
  Synthetic
atcatggggattccatattgtaattacagcaagtattggtacctcaatcatacaataactggcaaaacctcatta

SEQ ID NO: 219737 - DNA, 75 bp, Artificial Sequence
  Synthetic
tctctctgttcttgtgacctttgatttcagtttctcaagatcagccgccaaagtcaacagatcatccgagttcaa

SEQ ID NO: 219738 - DNA, 75 bp, Artificial Sequence
  Synthetic
ctggtgaatcaaatgctcgacattgtcttctgcagaaaccttgtcagcgtacaaattgttgaactcattgagcaa

SEQ ID NO: 219739 - DNA, 75 bp, Artificial Sequence
  Synthetic
actccatccctcccagcctgggccccttgattgccacctgtcattcctatcatgtttaggagtgccctcctctga

SEQ ID NO: 219740 - DNA, 75 bp, Artificial Sequence
  Synthetic
tcaggtctctgacaaagatgatcctggttttaattttagctcaccccagtaaacgttctcaaaagctcctccaaa

SEQ ID NO: 219741 - DNA, 75 bp, Artificial Sequence
  Synthetic
ttctgacgacatcgagcaacaagctgacaatatgatcacagagatgctacaaaaggaatacatggagaggcaagg

SEQ ID NO: 219742 - DNA, 75 bp, Artificial Sequence
  Synthetic
gacaatatgatcacagagatgctacaaaaggaatacatggagaggcaagggaaaacgcctttgggtttagttgat

SEQ ID NO: 219743 - DNA, 75 bp, Artificial Sequence
  Synthetic
tctaagtcgcttcagatcaccatcatctcttctttgtttgcgcatcagtcgctgaacattgctgacctcggagaa

SEQ ID NO: 219744 - DNA, 75 bp, Artificial Sequence
  Synthetic
ttcagtttctcaagatcagccgccaaagtcaacagatcatccgagttcaaggtgccaacccttagcacacttttc

SEQ ID NO: 219745 - DNA, 75 bp, Artificial Sequence
  Synthetic
tctcttctttgtttgcgcatcagtcgctgaacattgctgacctcggagaaatcaagcccatgtagaagggcttga

SEQ ID NO: 219746 - DNA, 75 bp, Artificial Sequence
  Synthetic
taatcactgatgttgagttcctgctctataggttaataaggacattaatgaatctggttttatctgaggatgtga

SEQ ID NO: 219747 - DNA, 75 bp, Artificial Sequence
  Synthetic
agtcaagattccaacccatagacacattgtgggcaaaccatgtcctaagccccacaggttgaaccacatgggcat

SEQ ID NO: 219748 - DNA, 75 bp, Artificial Sequence
  Synthetic
attgtgggcaaaccatgtcctaagccccacaggttgaaccacatgggcatttgttcttgcggcttatacaagcag

SEQ ID NO: 219749 - DNA, 75 bp, Artificial Sequence
  Synthetic
tctccttaaagactgtgtccataagaaggacctcacttccttagaggcactcattattgagctgatagatgttgt

SEQ ID NO: 219750 - DNA, 75 bp, Artificial Sequence
  Synthetic
taaagattcacagagtctactgtactctgactcttcaaaaagtgagttactttcctgagcatatctcaataatga

SEQ ID NO: 219751 - DNA, 75 bp, Artificial Sequence
  Synthetic
aaggacctcacttccttagaggcactcattattgagctgatagatgttgttcaaagctgtgagaaaccactaagg

SEQ ID NO: 219752 - DNA, 75 bp, Artificial Sequence
  Synthetic
cagatagattgacagatcagataaaatgttttgagaagtttctggaaccaaaggtgagatttggtcatgtgagca

SEQ ID NO: 219753 - DNA, 75 bp, Artificial Sequence
  Synthetic
cgcacagtggatcctaggctattggattgcgctttgtaccaattactacagcagataatttcgacactctgctgt

SEQ ID NO: 219754 - DNA, 75 bp, Artificial Sequence
  Synthetic
tctgactcttcaaaaagtgagttactttcctgagcatatctcaataatgagaaaagtgtgtctctcaacttgtca

SEQ ID NO: 219755 - DNA, 75 bp, Artificial Sequence
  Synthetic
ggattgcatcatgttcgatgctgctgtgtcaggaggactaaatgcatcggttctcagggctgtattgcccaggga

SEQ ID NO: 219756 - DNA, 75 bp, Artificial Sequence
  Synthetic
tacatacaacacaccaattcagcgatgagtgtctcaaaggagataaaatcctttctgtggacacagtctctgagg

SEQ ID NO: 219757 - DNA, 75 bp, Artificial Sequence
  Synthetic
aagtggtattaagttgatgtcgacactcttcaggtcttcttttagttgctctaatttcttgaaatcctcaatgta

SEQ ID NO: 219758 - DNA, 75 bp, Artificial Sequence
  Synthetic
atggatgcacaactatcgagggaccagattataaaaggcctggtgtttcaaagaagtatttatctcttcttacat

SEQ ID NO: 219759 - DNA, 75 bp, Artificial Sequence
  Synthetic
accatgtctctgggtagcacagctctgagcaccagtgtgttcaaccctcctgagacagcagcatcaaacatgatg

SEQ ID NO: 219760 - DNA, 75 bp, Artificial Sequence
  Synthetic
catggtgtttagaacatcaacaccaaaagtcgtcctgtaaatggacgcccccgtgacccaccgccaaaaggcggt

SEQ ID NO: 219761 - DNA, 75 bp, Artificial Sequence
  Synthetic
accatccggcaccacaaagcataaggagggggtcaagactccattgtcatggagaattctctctacagatttatc

SEQ ID NO: 219762 - DNA, 75 bp, Artificial Sequence
  Synthetic
gacttctctgaggtcagcaatgtccagcggttgatgcgcaagcaaagaagggacgacaacgacctgaaacgactg

SEQ ID NO: 219763 - DNA, 75 bp, Artificial Sequence
  Synthetic
attatcttatttaagatctagctgcttttcctatggtcaccaatctggcaggccttcccagacggtaaccctcac

SEQ ID NO: 219764 - DNA, 75 bp, Artificial Sequence
  Synthetic
gcagtgcagccttggatttagccagcaagaaaagtgttgttgttaataaatacacagatggttctagaatattaa

SEQ ID NO: 219765 - DNA, 75 bp, Artificial Sequence
  Synthetic
tgcatgtgacacaaatctttatattgatcccaaacagcattttcaaactttcttgaatcaatcttactaagagca

SEQ ID NO: 219766 - DNA, 75 bp, Artificial Sequence
  Synthetic
tgagtgtctcaaaggagataaaatcctttctgtggacacagtctctgaggagggagttgtcgggttactgctcta

SEQ ID NO: 219767 - DNA, 75 bp, Artificial Sequence
  Synthetic
tatgtcttcggacccttggcaagtgataaccatattccgggggagcgcctcaataacagcactggtcagacctgg

SEQ ID NO: 219768 - DNA, 75 bp, Artificial Sequence
  Synthetic
acattaacttcagatgacttgttaattttagctgctgacctggagaagctgaagtcaaaggtgaccaggacagaa

SEQ ID NO: 219769 - DNA, 75 bp, Artificial Sequence
  Synthetic
caagacaaaagttagcgtttcttgttcagacagagcctagaatgctcttgatggaggggctaaagcttctgtccc

SEQ ID NO: 219770 - DNA, 75 bp, Artificial Sequence
  Synthetic
cattaaaagcatcctgggctctgtttgtacaagaaatgccaacttctgccttgatagtctctcgttgtctgccaa

SEQ ID NO: 219771 - DNA, 75 bp, Artificial Sequence
  Synthetic
ttctcaacaagcaggactatgagtacaaagttcagcaggcaatgagcaatttggttctaggatctgggcagctca

SEQ ID NO: 219772 - DNA, 75 bp, Artificial Sequence
  Synthetic
agcggttgatgcgcaagcaaagaagggacgacaacgacctgaaacgactgagagacctaaaccaggcagttaaca

SEQ ID NO: 219773 - DNA, 75 bp, Artificial Sequence
  Synthetic
aataaacctttctgaaatgagggcataaaaatctgatgtgttatgtaatattccctgacccatgtcaagtattga

SEQ ID NO: 219774 - DNA, 75 bp, Artificial Sequence
  Synthetic
atgatagggatgagtggtgggaatcaaggggctcagactgggagagacggagtggtgaggatttgggatgtgaaa

SEQ ID NO: 219775 - DNA, 75 bp, Artificial Sequence
  Synthetic
gggctctctgaaaaagtgtatataacacccagagataggctgatagagagcaacttccaccgggtcctctggcct

SEQ ID NO: 219776 - DNA, 75 bp, Artificial Sequence
  Synthetic
ttcatgaatatggtatcttgaccccatctctatgttttgtggtgccggacggatacaagttgactggcaatgttt

SEQ ID NO: 219777 - DNA, 75 bp, Artificial Sequence
  Synthetic
aggagactgttgaaaaaattgttgatcagtatagggaacctgtcaagctaggctcaggccctaatggtgatggcc

SEQ ID NO: 219778 - DNA, 75 bp, Artificial Sequence
  Synthetic
tcagagcatgtggtcaactagaacaacagttcaatacacaagagatacttaaagacaattaattagatagcctta

SEQ ID NO: 219779 - DNA, 75 bp, Artificial Sequence
  Synthetic
gtaagttagtccagccgagaagcctgcagattggagagatttgttggagttaccactgccaattttctgtggttt

SEQ ID NO: 219780 - DNA, 75 bp, Artificial Sequence
  Synthetic
gttgatctgaacgatgttgttcaggcattgacagacctgggcttgatctacacagcaaagtatcccaacacctca

SEQ ID NO: 219781 - DNA, 75 bp, Artificial Sequence
  Synthetic
tggaacagttaaaggaagacttaaagagtgttgacattaatctaataccacttatagacggcaggacatcttttt

SEQ ID NO: 219782 - DNA, 75 bp, Artificial Sequence
  Synthetic
tttatgcatgtgccacataagcaaggttgagaggtagtccctcccctttatgtcagcttgcaagtcctttgagag

SEQ ID NO: 219783 - DNA, 75 bp, Artificial Sequence
  Synthetic
atcacatggttgaggagtttgatcatgatatcttaccaggtaaattttatgaagaattctgtaatgctgtctatg

SEQ ID NO: 219784 - DNA, 75 bp, Artificial Sequence
  Synthetic
cacagcaaagtatcccaacacctcagacctggatagactaacccagagccaccctattctaaacatgattgacac

SEQ ID NO: 219785 - DNA, 75 bp, Artificial Sequence
  Synthetic
ccacccgtcacctgataagcagattttgtagagtatgttttcataggggtttctctcacccggagtatctgagac

SEQ ID NO: 219786 - DNA, 75 bp, Artificial Sequence
  Synthetic
aaagcaattcactctttgaggaatcagaatatagtaggctttgcgagtctttgtcgatgagttcagggagacttt

SEQ ID NO: 219787 - DNA, 75 bp, Artificial Sequence
  Synthetic
ctgtgaaagcaggagcttgtatgttggatggtggcaacatgttagagacaatcaaagtgtcaccccaaacaatgg

SEQ ID NO: 219788 - DNA, 75 bp, Artificial Sequence
  Synthetic
cagtgtcaacaaggacatactttaaccatgaatactttcagtgttttaagtccatactcttgatcatgaatgcga

SEQ ID NO: 219789 - DNA, 75 bp, Artificial Sequence
  Synthetic
ggatggtggcaacatgttagagacaatcaaagtgtcaccccaaacaatggatggtattctcaagtccatcttaaa

SEQ ID NO: 219790 - DNA, 75 bp, Artificial Sequence
  Synthetic
ttgtagagtatgttttcataggggtttctctcacccggagtatctgagacgaacatcccaagagccctcttgacc

SEQ ID NO: 219791 - DNA, 75 bp, Artificial Sequence
  Synthetic
tgtttctaacatgttgccaccatccagcatgcaggcacctgctttcactgcggcacccagactaaaattgtagcc

SEQ ID NO: 219792 - DNA, 75 bp, Artificial Sequence
  Synthetic
agggtattaacaataaactgacagctcatgaagtgaagctacagattgaagaagaatatcaggttttcaggaaca

SEQ ID NO: 219793 - DNA, 75 bp, Artificial Sequence
  Synthetic
acccttatgagaacatactttacaagatctgtttgtcaggggatgggtggccatacattgcatctaggacttcaa

SEQ ID NO: 219794 - DNA, 75 bp, Artificial Sequence
  Synthetic
atgatgtaagaattagtgaaagggagagcaattcagaggcacttagtaaggctctgtcactgacaaactgtacca

SEQ ID NO: 219795 - DNA, 75 bp, Artificial Sequence
  Synthetic
agcatgcaggcacctgctttcactgcggcacccagactaaaattgtagcctgagatgttcagggagctcttcttg

SEQ ID NO: 219796 - DNA, 75 bp, Artificial Sequence
  Synthetic
taacaggaagggcatgggaaaacactgttgttgatttggaatcaggcgagaagccacaaaaaattgggagcaaca

SEQ ID NO: 219797 - DNA, 75 bp, Artificial Sequence
  Synthetic
tgatgtgttaggatatttagctgtataaatcaagcccagatctgtgagtgcttgtaccacatcatttaagtcaac

SEQ ID NO: 219798 - DNA, 75 bp, Artificial Sequence
  Synthetic
tatacactgatgatgcagtggttgctgaagatgacattgagcaattgatttatcaatttaaaagagcgtcgccta

SEQ ID NO: 219799 - DNA, 75 bp, Artificial Sequence
  Synthetic
taaatcaagcccagatctgtgagtgcttgtaccacatcatttaagtcaacttgtccctgctttgtcagacatgct

SEQ ID NO: 219800 - DNA, 75 bp, Artificial Sequence
  Synthetic
gaaggcttaagttttctttgtcatataaagaacaagtgggtggtaacagagaattatatattggtgatcttagaa

SEQ ID NO: 219801 - DNA, 75 bp, Artificial Sequence
  Synthetic
tctcagctcatgactctcaaagatgcaatgctacagcttgacccaaatgctaagacctggatggacattgagggg

SEQ ID NO: 219802 - DNA, 75 bp, Artificial Sequence
  Synthetic
caatgctacagcttgacccaaatgctaagacctggatggacattgaggggagacctgaagatccagtagaaattg

SEQ ID NO: 219803 - DNA, 75 bp, Artificial Sequence
  Synthetic
cttcacatcccagactcttaccactccatctctcccagcctgtgacccctgactgccgtttgtcatcccaatcaa

SEQ ID NO: 219804 - DNA, 75 bp, Artificial Sequence
  Synthetic
tgcagtgttggaggtcatttctaaacaaagtcaaatctttaagaattctaaacacaaggagaaaacttctactaa

SEQ ID NO: 219805 - DNA, 75 bp, Artificial Sequence
  Synthetic
ccatctctcccagcctgtgacccctgactgccgtttgtcatcccaatcaaatttagaagtgccctcctctgatcg

SEQ ID NO: 219806 - DNA, 75 bp, Artificial Sequence
  Synthetic
acgagaaggaatttgaaaatgctatcctttccatgaaattgaatgtttcattggcacatgtgtcttatagcatgg

SEQ ID NO: 219807 - DNA, 75 bp, Artificial Sequence
  Synthetic
actgacctaaaacagttcaagcaagatgctaagtattcacacggaattgatgttacagacctttttgctgcacag

SEQ ID NO: 219808 - DNA, 75 bp, Artificial Sequence
  Synthetic
acccctctatctgcctcataatcctgtaactgcggttaccatccacccaatctctgacatctgtctcgcaattca

SEQ ID NO: 219809 - DNA, 75 bp, Artificial Sequence
  Synthetic
ttctgttcttgtaacttttgatttcagcttttctaaatcagccgccagagtcagtaaatcgtccgaacttagggt

SEQ ID NO: 219810 - DNA, 75 bp, Artificial Sequence
  Synthetic
cctgttttgttagtgttaatgatagattagtttccttggagtcaaccaaaagagatctcaagaaatggattgagc

SEQ ID NO: 219811 - DNA, 75 bp, Artificial Sequence
  Synthetic
gtaactgcggttaccatccacccaatctctgacatctgtctcgcaattcaataagaatggatcaatggggtatct

SEQ ID NO: 219812 - DNA, 75 bp, Artificial Sequence
  Synthetic
aggacttgcaagctgacataaaagggagggactatctctcaaccctacttatgtggcatatgcacaaaatggtgg

SEQ ID NO: 219813 - DNA, 75 bp, Artificial Sequence
  Synthetic
agaaagctccttgagtcacaaggaaggaaggatatcaagttgattgatattgctctcagcaagacagattctaga

SEQ ID NO: 219814 - DNA, 75 bp, Artificial Sequence
  Synthetic
atgctaagtattcacacggaattgatgttacagacctttttgctgcacagccaggtttgaccagtgctgttatag

SEQ ID NO: 219815 - DNA, 75 bp, Artificial Sequence
  Synthetic
aagacgctttaggtcactatcatctctcctttgtttgcgcatcagccgctggacattgctgacctcagagaagtc

SEQ ID NO: 219816 - DNA, 75 bp, Artificial Sequence
  Synthetic
tcattcagaagaccatcacaagggctacaactgcattagaagatgttgggataaacattaatcagtttggtatag

SEQ ID NO: 219817 - DNA, 75 bp, Artificial Sequence
  Synthetic
ggaaggatatcaagttgattgatattgctctcagcaagacagattctagaaaatatgagaatgcagtctgggatc

SEQ ID NO: 219818 - DNA, 75 bp, Artificial Sequence
  Synthetic
aacagtcaataacagaagatttcttttactctaatttccaagctggtgtagtgccttctcacatcagttcaatac

SEQ ID NO: 219819 - DNA, 75 bp, Artificial Sequence
  Synthetic
aagaagggtggcaaagaggaaataacccctcactgtgccctaatggactgtatcatgtttgatgcagcagtgtca

SEQ ID NO: 219820 - DNA, 75 bp, Artificial Sequence
  Synthetic
ctcctttgtttgcgcatcagccgctggacattgctgacctcagagaagtcaagcccatgcaagagagcttgagcg

SEQ ID NO: 219821 - DNA, 75 bp, Artificial Sequence
  Synthetic
cctcagagattgtgtccataagaaagatttcacttctttggaggcactcattgttgagttactgaattgtgatga

SEQ ID NO: 219822 - DNA, 75 bp, Artificial Sequence
  Synthetic
gttatcaaaaatcacaagaagagactttcccatataccatgggggtaattgatctgttgaaaaccactgacttgg

SEQ ID NO: 219823 - DNA, 75 bp, Artificial Sequence
  Synthetic
ttgttgagttactgaattgtgatgaaggctgtgagtggtcactaaagtgatcaatgcaaagcgcaatccaatagc

SEQ ID NO: 219824 - DNA, 75 bp, Artificial Sequence
  Synthetic
ctatcagttgtatatgcggtggtacgatagatgcttatacctctagtgatgatcagatttctctctttgatcaat

SEQ ID NO: 219825 - DNA, 75 bp, Artificial Sequence
  Synthetic
gtcctgtaaacggacgcccccgtgacccaccgccaacaggcggtgggtcacgggggccctggtagggtcttacct

SEQ ID NO: 219826 - DNA, 75 bp, Artificial Sequence
  Synthetic
attgcctgttgtaccttatattcatagtcctgcttgttgagaaggtgttttcctttccttgagaagacctcagtg

SEQ ID NO: 219827 - DNA, 75 bp, Artificial Sequence
  Synthetic
gagcagtgctacccagagacatggtgtttagaacatcaacgcccaaagtcgtcctgtaaacggacgcccccgtga

SEQ ID NO: 219828 - DNA, 75 bp, Artificial Sequence
  Synthetic
aatttggggcagctagatatcaggtggttaggtgcaaagaagcatactgtcaggaattctcactcagtggcatca

SEQ ID NO: 219829 - DNA, 75 bp, Artificial Sequence
  Synthetic
cccaccgccaacaggcggtgggtcacgggggccctggtagggtcttaccttttccatctcacaggtacaccaggt

SEQ ID NO: 219830 - DNA, 75 bp, Artificial Sequence
  Synthetic
aactcaataagtttgtgagccctaaaagtgtcattggcaggtttgttgcagagtttaaatctagattttttgttt

SEQ ID NO: 219831 - DNA, 75 bp, Artificial Sequence
  Synthetic
tttaggacatggtttgcctacaatgtgtctatgtgttggtattttgactaggtggaggaagatgcttataaggta

SEQ ID NO: 219832 - DNA, 75 bp, Artificial Sequence
  Synthetic
tgtctatgtgttggtattttgactaggtggaggaagatgcttataaggtaaaagcttgtactgaacacaaagagg

SEQ ID NO: 219833 - DNA, 75 bp, Artificial Sequence
  Synthetic
ggttaggtgcaaagaagcatactgtcaggaattctcactcagtggcatcaggtttcaattgatctatcaaaaaac

SEQ ID NO: 219834 - DNA, 75 bp, Artificial Sequence
  Synthetic
tctgttcttttaatgctgaccccaagaggtacttccctgcagtcttttcagcagaggttttacaagccacagtag

SEQ ID NO: 219835 - DNA, 75 bp, Artificial Sequence
  Synthetic
gaggtacttccctgcagtcttttcagcagaggttttacaagccacagtagacacaatgatcacctggattgaaga

SEQ ID NO: 219836 - DNA, 75 bp, Artificial Sequence
  Synthetic
aactggcagaaacaattgacacaatcattgatcagtcggttgcgaatggtgtccctgttcacttatgtaatctaa

SEQ ID NO: 219837 - DNA, 75 bp, Artificial Sequence
  Synthetic
taacatctcagtgattaaattgtcagcttgctgttcgatatcatcagagaagtgggtctcatttaggtatgatcc

SEQ ID NO: 219838 - DNA, 75 bp, Artificial Sequence
  Synthetic
gcttgctgttcgatatcatcagagaagtgggtctcatttaggtatgatccatttgatacaagccaacatttgggc

SEQ ID NO: 219839 - DNA, 75 bp, Artificial Sequence
  Synthetic
aagtgtcattggcaggtttgttgcagagtttaaatctagattttttgtttggggagatgaagtgccattattgac

SEQ ID NO: 219840 - DNA, 75 bp, Artificial Sequence
  Synthetic
tgattctggtgttgattctggcccacccgagcaaacgcagtcaaaagtttctccagaacctcagatacttcatta

SEQ ID NO: 219841 - DNA, 75 bp, Artificial Sequence
  Synthetic
cccgagcaaacgcagtcaaaagtttctccagaacctcagatacttcattatggcttatgtgtcagattaccacca

SEQ ID NO: 219842 - DNA, 75 bp, Artificial Sequence
  Synthetic
atgttagagactgggtagatggcaaccgtagttataggattatgaggcaaatagagggattgattcctaatgctt

SEQ ID NO: 219843 - DNA, 75 bp, Artificial Sequence
  Synthetic
attgcagtatgggatccccataatgtctcgcaaatggttcttcattattagctgatcatttatcagagcatttac

SEQ ID NO: 219844 - DNA, 75 bp, Artificial Sequence
  Synthetic
atgagcataatttcaactttccacttgtccatccccaacttcaatcagtatgaggcaatgagctgcgacttcaat

SEQ ID NO: 219845 - DNA, 75 bp, Artificial Sequence
  Synthetic
tctcgcaaatggttcttcattattagctgatcatttatcagagcatttactgctttgttgatcagctgtatactc

SEQ ID NO: 219846 - DNA, 75 bp, Artificial Sequence
  Synthetic
ttcttctttataaactagtgaagactctggtaaatctgattttatgtgatgaggtgaaaagcatgatgacaaata

SEQ ID NO: 219847 - DNA, 75 bp, Artificial Sequence
  Synthetic
tctggtaaatctgattttatgtgatgaggtgaaaagcatgatgacaaatagatttaagtttattctaaatgtgtc

SEQ ID NO: 219848 - DNA, 75 bp, Artificial Sequence
  Synthetic
caaactatttgtctagtgagcacctctcatcactaagaaatctttgtgagctgttggatgttgagcccccatctg

SEQ ID NO: 219849 - DNA, 75 bp, Artificial Sequence
  Synthetic
tagcctcagcatgtcacaaaactcttcatcatgtttctcattacactttgccacggctgtgttgccaaagcactt

SEQ ID NO: 219850 - DNA, 75 bp, Artificial Sequence
  Synthetic
tcatcatgtttctcattacactttgccacggctgtgttgccaaagcactttaactcagcttcaatcagcatccac

SEQ ID NO: 219851 - DNA, 75 bp, Artificial Sequence
  Synthetic
ccgtagttataggattatgaggcaaatagagggattgattcctaatgcttgcagcaagattagatctatgttaag

SEQ ID NO: 219852 - DNA, 75 bp, Artificial Sequence
  Synthetic
agataaagtgttttgagaagtttctcgaacctaaattagagtttggccatgtgagtgtaaaccctgtagacatag

SEQ ID NO: 219853 - DNA, 75 bp, Artificial Sequence
  Synthetic
cgaacctaaattagagtttggccatgtgagtgtaaaccctgtagacatagccacagaagaagagttgatggatat

SEQ ID NO: 219854 - DNA, 75 bp, Artificial Sequence
  Synthetic
tatattcaggtgctgtgaacctagatgatgagaagattcctaccattgtcaaaacaatccaaaataagttgtctt

SEQ ID NO: 219855 - DNA, 75 bp, Artificial Sequence
  Synthetic
tgtccatgtgaatgttcccagcaatctcctgctgatgtaaatatctctggttctctgtgaaaggagcccaagata

SEQ ID NO: 219856 - DNA, 75 bp, Artificial Sequence
  Synthetic
ctcctgctgatgtaaatatctctggttctctgtgaaaggagcccaagatagccgatgggagatggtcttgagaac

SEQ ID NO: 219857 - DNA, 75 bp, Artificial Sequence
  Synthetic
ctcatcactaagaaatctttgtgagctgttggatgttgagcccccatctgagtctgaccttgagtattcttggct

SEQ ID NO: 219858 - DNA, 75 bp, Artificial Sequence
  Synthetic
ggggaccagaatacaaaaaacctggagtttcgaggaaatacctttctctcctcacatcctcctttaacaatggtt

SEQ ID NO: 219859 - DNA, 75 bp, Artificial Sequence
  Synthetic
tgctcactgttgtttgcaaaacttcagctgaaaatattgctggaaaatatcttttagggtcagcataaaatgagc

SEQ ID NO: 219860 - DNA, 75 bp, Artificial Sequence
  Synthetic
ctggctttgtaggattgtgcagaacattgggtagcaaatgtgttcggggaccaaataaagagaatctgtatatta

SEQ ID NO: 219861 - DNA, 75 bp, Artificial Sequence
  Synthetic
agtcatgatgcagtcccagttgccacgacctgaatcaagggcaatgtaacttccgccccaagccatcctcatgaa

SEQ ID NO: 219862 - DNA, 75 bp, Artificial Sequence
  Synthetic
cgacctgaatcaagggcaatgtaacttccgccccaagccatcctcatgaaggtctgcaaaacaccatttgccact

SEQ ID NO: 219863 - DNA, 75 bp, Artificial Sequence
  Synthetic
agtttcgaggaaatacctttctctcctcacatcctcctttaacaatggttctttattcaaggaaagagaggtaaa

SEQ ID NO: 219864 - DNA, 75 bp, Artificial Sequence
  Synthetic
atttagcaagcaataaaagtgtagttgtgaataaatacactgacggctctagagtgcttaattatgattttaata

SEQ ID NO: 219865 - DNA, 75 bp, Artificial Sequence
  Synthetic
tgtgaataaatacactgacggctctagagtgcttaattatgattttaataaactcacagcactagctgttgcaca

SEQ ID NO: 219866 - DNA, 75 bp, Artificial Sequence
  Synthetic
aagttccgctagaacttagaaatggaagtggaggtgaaagtgtggtcagttatttcagacccttgttatgggatt

SEQ ID NO: 219867 - DNA, 75 bp, Artificial Sequence
  Synthetic
ttgcacactgatcttacccccattaaagtcacaactcattgcttcatactgattgaaattgggtatagacagatg

SEQ ID NO: 219868 - DNA, 75 bp, Artificial Sequence
  Synthetic
aagtcacaactcattgcttcatactgattgaaattgggtatagacagatggaaagttgagattatgctcataaga

SEQ ID NO: 219869 - DNA, 75 bp, Artificial Sequence
  Synthetic
attgggtagcaaatgtgttcggggaccaaataaagagaatctgtatattaagtccattcagtctctgatttctga

SEQ ID NO: 219870 - DNA, 75 bp, Artificial Sequence
  Synthetic
attatgaatacaagatccagcaggcaatgagcaacttagttttaggatctcagcaacaggttactgatgttgatg

SEQ ID NO: 219871 - DNA, 75 bp, Artificial Sequence
  Synthetic
aatgagcaacttagttttaggatctcagcaacaggttactgatgttgatgggtctgatctggatgagattttgtt

SEQ ID NO: 219872 - DNA, 75 bp, Artificial Sequence
  Synthetic
ttgattttttcaaacataacccttgtgactattttcccttaaagccaactgcatcaaaactattggaggataggg

SEQ ID NO: 219873 - DNA, 75 bp, Artificial Sequence
  Synthetic
gtgatttataatacttgtgttggtcaaagtcagttctagtcctgtctcattacccaccattatgtaatggtgact

SEQ ID NO: 219874 - DNA, 75 bp, Artificial Sequence
  Synthetic
aaagtcagttctagtcctgtctcattacccaccattatgtaatggtgactgttgttctttgtgcaagagaggggc

SEQ ID NO: 219875 - DNA, 75 bp, Artificial Sequence
  Synthetic
aagtggaggtgaaagtgtggtcagttatttcagacccttgttatgggattatatgtgcatctccttatcaactgc

SEQ ID NO: 219876 - DNA, 75 bp, Artificial Sequence
  Synthetic
agattgtggatcaatatagggaacctactagtttgggttcaatgagaggaggggatggccaaccatcagttggtg

SEQ ID NO: 219877 - DNA, 75 bp, Artificial Sequence
  Synthetic
tactagtttgggttcaatgagaggaggggatggccaaccatcagttggtgatttagatgaattaatctctaataa

SEQ ID NO: 219878 - DNA, 75 bp, Artificial Sequence
  Synthetic
acttcagtgagctgcgacacggccagtgctgtgagcttattgaagtcatagtttaatattctagaaccatctgtg

SEQ ID NO: 219879 - DNA, 75 bp, Artificial Sequence
  Synthetic
aactcccttgtaaagagaggttgaacaagacctaccacataggaagagaaaggtgaccaagccaataaggccaca

SEQ ID NO: 219880 - DNA, 75 bp, Artificial Sequence
  Synthetic
tgagcgatctagcgtcaaccaaaatgaagtggtcacccagaataaaatttctagatctctgtgtagcgttggatg

SEQ ID NO: 219881 - DNA, 75 bp, Artificial Sequence
  Synthetic
caagacctaccacataggaagagaaaggtgaccaagccaataaggccacatgttgcaacattgtacaaacctttc

SEQ ID NO: 219882 - DNA, 75 bp, Artificial Sequence
  Synthetic
attttgattatgaaattctacctgaaggtttttataaagaattctgcgacaatgtctacaatagtcacaagatga

SEQ ID NO: 219883 - DNA, 75 bp, Artificial Sequence
  Synthetic
aggtttttataaagaattctgcgacaatgtctacaatagtcacaagatgagagataaatacttttattgtggcca

SEQ ID NO: 219884 - DNA, 75 bp, Artificial Sequence
  Synthetic
ctgaattgaggttgtctcacagtaggacacatgaacccatggtggaagaaagagtagtgagcactagtgatgctg

SEQ ID NO: 219885 - DNA, 75 bp, Artificial Sequence
  Synthetic
tattacatgagggacttcctggaaaaatgtgactatttgccccattttaagggaaatacttgaattgcgcaacca

SEQ ID NO: 219886 - DNA, 75 bp, Artificial Sequence
  Synthetic
gaagtggtcacccagaataaaatttctagatctctgtgtagcgttggatgttaactgtgaagccttgtctcttgt

SEQ ID NO: 219887 - DNA, 75 bp, Artificial Sequence
  Synthetic
cgcacagtggatcctaggcaatttggttgttcttctcttgaagctctgtagtttgaaccttaccagatggggaac

SEQ ID NO: 219888 - DNA, 75 bp, Artificial Sequence
  Synthetic
cgtactttgaacaggagtatttccaatgcttcaaatctgtgcttctaattatgaatgccaataaacttatgggga

SEQ ID NO: 219889 - DNA, 75 bp, Artificial Sequence
  Synthetic
atgcttcaaatctgtgcttctaattatgaatgccaataaacttatggggaaatactctcactacaaatcaagaaa

SEQ ID NO: 219890 - DNA, 75 bp, Artificial Sequence
  Synthetic
ccttcacgtggtttccacacaagacatcagttccagagggtgaagggttgcatagaatgggtccattttcttcat

SEQ ID NO: 219891 - DNA, 75 bp, Artificial Sequence
  Synthetic
acatcagtgatcagttcttctctcactttgtcaatgaggtccttgtgataataatctgacacatacgccattatg

SEQ ID NO: 219892 - DNA, 75 bp, Artificial Sequence
  Synthetic
ccctgatgccacacacctaggaccacagttttgcaagagctgctggtttgaaaacaagggtctggttgagtgcaa

SEQ ID NO: 219893 - DNA, 75 bp, Artificial Sequence
  Synthetic
gatcctaggcaatttagctggacttcagtggtaaagttcattctagtgaatccctgaatcaaagtgcccagtcaa

SEQ ID NO: 219894 - DNA, 75 bp, Artificial Sequence
  Synthetic
gtgagagagaaagtaattctgaagcactaagcaaggctttgtcgctaacaaattgtaccactgctatgttaaaga

SEQ ID NO: 219895 - DNA, 75 bp, Artificial Sequence
  Synthetic
actaagcaaggctttgtcgctaacaaattgtaccactgctatgttaaagaatctttgcttttatagtcaagagtc

SEQ ID NO: 219896 - DNA, 75 bp, Artificial Sequence
  Synthetic
tagactttgatattgagccagctagattcaatcaaaatcaattgatcgcatcaggtttagttgatcctaagtttg

SEQ ID NO: 219897 - DNA, 75 bp, Artificial Sequence
  Synthetic
acaggtgccccatctgcaaaatgccactccccacaaaactgagaccgtcggccgtcccaacagcgcccccagccc

SEQ ID NO: 219898 - DNA, 75 bp, Artificial Sequence
  Synthetic
atcagttccagagggtgaagggttgcatagaatgggtccattttcttcatttgtagagaaagttattcacaaagg

SEQ ID NO: 219899 - DNA, 75 bp, Artificial Sequence
  Synthetic
attcaatcaaaatcaattgatcgcatcaggtttagttgatcctaagtttgactcattggaggatttctttgatgc

SEQ ID NO: 219900 - DNA, 75 bp, Artificial Sequence
  Synthetic
ctttgtcatataaggaacaagttggtgggaatagggaattgtatattggtgacctaaggaccaagatgttcacaa

SEQ ID NO: 219901 - DNA, 75 bp, Artificial Sequence
  Synthetic
tgggaatagggaattgtatattggtgacctaaggaccaagatgttcacaagattaattgaagattattttgaggc

SEQ ID NO: 219902 - DNA, 75 bp, Artificial Sequence
  Synthetic
tccgtgttaaaagtcaagatgctagttttaaggaaagctttgccatccaccttgagtatactggctcaatgaatc

SEQ ID NO: 219903 - DNA, 75 bp, Artificial Sequence
  Synthetic
ggctagcttctgttttgaaagcctctcatcctctaagaggtacctgctcacaagatctttgctctcggacagcaa

SEQ ID NO: 219904 - DNA, 75 bp, Artificial Sequence
  Synthetic
aagattttggaggagcttttgagaacgtttactggggtgagctaaaattaaaaccaggatcatctttgtcaaata

SEQ ID NO: 219905 - DNA, 75 bp, Artificial Sequence
  Synthetic
cgacaccccccggggggaccccccgccgggggcccccccgggggagccgaccatcccaggagcatcactcgatgt

SEQ ID NO: 219906 - DNA, 75 bp, Artificial Sequence
  Synthetic
aaaacattcaaactctccactcctgataatcttcctgaagtcatggatagagactcacaaagcctgctatactct

SEQ ID NO: 219907 - DNA, 75 bp, Artificial Sequence
  Synthetic
agaatgccatcttatctatgaaacttaatgtctctttagcacacgtctcctatagtatggatcacagcaaatggg

SEQ ID NO: 219908 - DNA, 75 bp, Artificial Sequence
  Synthetic
aatctcagcttgccaccacttgactgtaccattatccttctccttgatttactgtaacagagagcataaccttta

SEQ ID NO: 219909 - DNA, 75 bp, Artificial Sequence
  Synthetic
gttggagactggttttgtcaggacctactttcaagggcaaatcagcatggtatgttgacaccgagatcattaatg

SEQ ID NO: 219910 - DNA, 75 bp, Artificial Sequence
  Synthetic
tctcggagcacctactcaatgtcgaggggagccccacccttcaagaggggcctgcacagcctccctcttaatcta

SEQ ID NO: 219911 - DNA, 75 bp, Artificial Sequence
  Synthetic
gtaccattatccttctccttgatttactgtaacagagagcataacctttaaattccacccaattgtcaactgcct

SEQ ID NO: 219912 - DNA, 75 bp, Artificial Sequence
  Synthetic
acataaaaggaagagattatctctcaacgctgctaacatggcatatgcacaaaatggttgagattccctttaatg

SEQ ID NO: 219913 - DNA, 75 bp, Artificial Sequence
  Synthetic
taatgtctctttagcacacgtctcctatagtatggatcacagcaaatggggtccaatgatgtgtccattcttgtt

SEQ ID NO: 219914 - DNA, 75 bp, Artificial Sequence
  Synthetic
gtggagacaatgtccacccccgaccactgcatcttcaaccccagtctatccaacatcatggcactcagtgcctca

SEQ ID NO: 219915 - DNA, 75 bp, Artificial Sequence
  Synthetic
ttacggagtatgactttgtattggtgggtccttgcactgaaccaacccccctggttgtgcataggggaggcttgt

SEQ ID NO: 219916 - DNA, 75 bp, Artificial Sequence
  Synthetic
catccctcaaagcagtggtggcttttgaaatggttttctggaaaattgaattgaggatttgattcttgcttggac

SEQ ID NO: 219917 - DNA, 75 bp, Artificial Sequence
  Synthetic
actgcatcttcaaccccagtctatccaacatcatggcactcagtgcctcagtcaacaggtcagatgaagtgtccc

SEQ ID NO: 219918 - DNA, 75 bp, Artificial Sequence
  Synthetic
aggatttcttttactctaactaccagaatggtgtagtaccctctcacatcagttccgtacttgatatgggccagg

SEQ ID NO: 219919 - DNA, 75 bp, Artificial Sequence
  Synthetic
aatctatcagacatcattgatttcaatgcaccaactaaaagatgtggggaactatcaccaatctcccttacaaac

SEQ ID NO: 219920 - DNA, 75 bp, Artificial Sequence
  Synthetic
aaagacgccaacttttttccacattcccacagccctcctttatgcacaactaatggagctggttcagtgcaaggg

SEQ ID NO: 219921 - DNA, 75 bp, Artificial Sequence
  Synthetic
ttggggacacttcgtctgacctgctgattggggcattgagtgatatgatgatagacaggctggggttaaggatgc

SEQ ID NO: 219922 - DNA, 75 bp, Artificial Sequence
  Synthetic
cccacagccctcctttatgcacaactaatggagctggttcagtgcaagggcccactaatacaaagtcatattctg

SEQ ID NO: 219923 - DNA, 75 bp, Artificial Sequence
  Synthetic
gaatggtgtagtaccctctcacatcagttccgtacttgatatgggccagggtatactacacaatacatcagattt

SEQ ID NO: 219924 - DNA, 75 bp, Artificial Sequence
  Synthetic
gtgggggtacaatagatgcttatacttcaagtgatgatcaaatttcccttttcgatcaggccttaacagatctca

SEQ ID NO: 219925 - DNA, 75 bp, Artificial Sequence
  Synthetic
ttcaagtgatgatcaaatttcccttttcgatcaggccttaacagatctcatgcaaagagacccggaagagttcaa

SEQ ID NO: 219926 - DNA, 75 bp, Artificial Sequence
  Synthetic
cctagttgatttgtgtcaattaaaaactcattgataacctcagtgtcaacataccatgctgacttgcctttaaag

SEQ ID NO: 219927 - DNA, 75 bp, Artificial Sequence
  Synthetic
ttgaggcagtggacaactgggtggagttcaagggttatgctctctgttatagtaagtcaaggggaaaggtgatgg

SEQ ID NO: 219928 - DNA, 75 bp, Artificial Sequence
  Synthetic
actcattgataacctcagtgtcaacataccatgctgacttgcctttaaaggtagatcctgacataaccagcctcc

SEQ ID NO: 219929 - DNA, 75 bp, Artificial Sequence
  Synthetic
ctttgacaccaaatctttaacgcaagctatgtcttcctccatgtttaactacaagtgcagtgatcgaaactcttg

SEQ ID NO: 219930 - DNA, 75 bp, Artificial Sequence
  Synthetic
ttgattcttactcaaacactgggaggactgtgtgattctagacctctcagcctgttgcctccgctcaacccattt

SEQ ID NO: 219931 - DNA, 75 bp, Artificial Sequence
  Synthetic
gattcaacaaaccaggctgacctacctttgaaagttggacccgacaaagcaagtctccaacagtcaggcagaaca

SEQ ID NO: 219932 - DNA, 75 bp, Artificial Sequence
  Synthetic
acatcatgcactaagtacttagtttgctggttcattgagccagtgtaatcaagatggatagcgaaggtttccttg

SEQ ID NO: 219933 - DNA, 75 bp, Artificial Sequence
  Synthetic
tcagccctaaaagtgttattggcagatttgttgcagagtttaaatccagattttatgtatggggagatgaggttc

SEQ ID NO: 219934 - DNA, 75 bp, Artificial Sequence
  Synthetic
gttcgctatgggataaagtcccataagaggcacaagaagcacagtcagtcaaataaagacaattgaattggatat

SEQ ID NO: 219935 - DNA, 75 bp, Artificial Sequence
  Synthetic
attgaagggcagaacatgtgaggagctgactaggaaggatgaatgcatcgaagacattgagtagttttttggtga

SEQ ID NO: 219936 - DNA, 75 bp, Artificial Sequence
  Synthetic
ttgacacaatcattgatcaatcagttgcaaatggagttcctgtccacctatgtaacctggttcagctgagaacct

SEQ ID NO: 219937 - DNA, 75 bp, Artificial Sequence
  Synthetic
cgtggaccctgagggtaatgacgcaacggcgtcaaaaaagtcctccaatgagtcaaacttggtactaaccagacc

SEQ ID NO: 219938 - DNA, 75 bp, Artificial Sequence
  Synthetic
ccggggggaccccccgccgggggcccccccgggggagccgaccacttctgaaaaactactcaatgtcctcaacgt

SEQ ID NO: 219939 - DNA, 75 bp, Artificial Sequence
  Synthetic
atttgttgcagagtttaaatccagattttatgtatggggagatgaggttcctctattgacaaagttcgttgccgc

SEQ ID NO: 219940 - DNA, 75 bp, Artificial Sequence
  Synthetic
gattttactttatttaagaatgatctccagcattggacctgacattctccagtggtttggttttcccctttttca

SEQ ID NO: 219941 - DNA, 75 bp, Artificial Sequence
  Synthetic
tgcaaatggagttcctgtccacctatgtaacctggttcagctgagaaccttaagtctcttgcagtatgccagata

SEQ ID NO: 219942 - DNA, 75 bp, Artificial Sequence
  Synthetic
tggatggtaaccgtagttacagaatcatgagacagatagagggcttgattcctgaggcatgtggtaagattagat

SEQ ID NO: 219943 - DNA, 75 bp, Artificial Sequence
  Synthetic
catgagacagatagagggcttgattcctgaggcatgtggtaagattagatccatgctaagaaagctgttcaacag

SEQ ID NO: 219944 - DNA, 75 bp, Artificial Sequence
  Synthetic
ttgtaatccttcaccctctgggattgatgtcttgtgtgggaaccatgtgaaagatcctaatgtccttgttgttgc

SEQ ID NO: 219945 - DNA, 75 bp, Artificial Sequence
  Synthetic
aagatcctaatgtccttgttgttgcaacaaatggtctcacataagattcaaagtaaatttgccgcatgaaattgt

SEQ ID NO: 219946 - DNA, 75 bp, Artificial Sequence
  Synthetic
gtgaacatgtttcatcacttaaaaatttatgcagtatgttgggtgttgatcctccatcagaatctgacttagagt

SEQ ID NO: 219947 - DNA, 75 bp, Artificial Sequence
  Synthetic
aatatgaccatgcctctctcttgcacaaagaacaatagtcaccactatataatggtgggtaatgagacgggactg

SEQ ID NO: 219948 - DNA, 75 bp, Artificial Sequence
  Synthetic
tttatgcagtatgttgggtgttgatcctccatcagaatctgacttagagttttcatggttgaatctgtctgctta

SEQ ID NO: 219949 - DNA, 75 bp, Artificial Sequence
  Synthetic
caatgattgtgtccacagaaaggactttatttcctttgaggcactcatcgccagattgttgtgctggatgcacgc

SEQ ID NO: 219950 - DNA, 75 bp, Artificial Sequence
  Synthetic
gttctagtatgagataatctcagctcagatgacaacacaatgtagtgctcttctctcttccatttcactatgtgt

SEQ ID NO: 219951 - DNA, 75 bp, Artificial Sequence
  Synthetic
taaatcttgatgatgataagatccctacaattgttaagacaattcaaaataagctatcatcaacttttactcggg

SEQ ID NO: 219952 - DNA, 75 bp, Artificial Sequence
  Synthetic
tttatttcctttgaggcactcatcgccagattgttgtgctggatgcacgcagcagaaagctgagactacctgcca

SEQ ID NO: 219953 - DNA, 75 bp, Artificial Sequence
  Synthetic
tacaattgttaagacaattcaaaataagctatcatcaacttttactcggggggcacagaagttgttatcagaagc

SEQ ID NO: 219954 - DNA, 75 bp, Artificial Sequence
  Synthetic
ctcctccaaatgggaaacaagcaagccaaagccccagaagcaaaagacagcccgagagccagcctgatcccagat

SEQ ID NO: 219955 - DNA, 75 bp, Artificial Sequence
  Synthetic
ccaaagccccagaagcaaaagacagcccgagagccagcctgatcccagatgccacacatctagggccacagttct

SEQ ID NO: 219956 - DNA, 75 bp, Artificial Sequence
  Synthetic
tatgcaggacattgggtagcaaatgcgttcgggggccaaataaagaaaatctatatattaagtccattcaatcac

SEQ ID NO: 219957 - DNA, 75 bp, Artificial Sequence
  Synthetic
aaatacagatggatacaatcttctcagggaatgaataatatgatttaaaccaatcctgtcctccagcaatttaga

SEQ ID NO: 219958 - DNA, 75 bp, Artificial Sequence
  Synthetic
cgttcgggggccaaataaagaaaatctatatattaagtccattcaatcactgatttctagcactcagggcattga

SEQ ID NO: 219959 - DNA, 75 bp, Artificial Sequence
  Synthetic
tgggataaggtcccataggagatgcaaagacacagctggttaattaaagacaattaaattggatatccttaatgc

SEQ ID NO: 219960 - DNA, 75 bp, Artificial Sequence
  Synthetic
ccaatgctttggtcatcttgggttctcctaagacccatgcacccagttctattgcagttgataaagagatgcaca

SEQ ID NO: 219961 - DNA, 75 bp, Artificial Sequence
  Synthetic
ttagaggggaaaagaatgacgtggttggttatttcagaccactactatgggactatatgtgcatttctttatcaa

SEQ ID NO: 219962 - DNA, 75 bp, Artificial Sequence
  Synthetic
tcctaagacccatgcacccagttctattgcagttgataaagagatgcacatgtagtcccacaacagaggcctaaa

SEQ ID NO: 219963 - DNA, 75 bp, Artificial Sequence
  Synthetic
acaaaactgagaccatcagccactccaacagcacccccaaccgaagcagcagacagcatcagacccccaccctac

SEQ ID NO: 219964 - DNA, 75 bp, Artificial Sequence
  Synthetic
atcataacatttttccaggaagtgcctcatgtcatagaagaagtgatgaacattgtcctgattgccctcagcctt

SEQ ID NO: 219965 - DNA, 75 bp, Artificial Sequence
  Synthetic
ccactggagtttttcagacataacccttgtgattattttcctctaaagccaactgcatcaaaattacttgaagat

SEQ ID NO: 219966 - DNA, 75 bp, Artificial Sequence
  Synthetic
aatattgaacaccataagaattagtcaacaattcaatcccttgagtgcctgaaatcagagattgaatggacttga

SEQ ID NO: 219967 - DNA, 75 bp, Artificial Sequence
  Synthetic
atcaccttctcctttgacttactataacagagagcataacccttgaattccacccagttgtccactgcctcaaga

SEQ ID NO: 219968 - DNA, 75 bp, Artificial Sequence
  Synthetic
aatgtttgagaagcacatattgccatttatgagcgatttagcttcaacaaagatgaaatggtcacccaggataaa

SEQ ID NO: 219969 - DNA, 75 bp, Artificial Sequence
  Synthetic
tcggacacatttactacccaatgttctacacaaccctacaaaaccggaggcaatggagctctggaatgcagattt

SEQ ID NO: 219970 - DNA, 75 bp, Artificial Sequence
  Synthetic
tttatgagcgatttagcttcaacaaagatgaaatggtcacccaggataaagttcttagatctctgtgtagcacta

SEQ ID NO: 219971 - DNA, 75 bp, Artificial Sequence
  Synthetic
acaacttgttctggatcgtcttaacaatggtgggcactttctcgtcatctaggttcacagcacctgaatatatta

SEQ ID NO: 219972 - DNA, 75 bp, Artificial Sequence
  Synthetic
aagggaagaacattacatagtgttgtcatctgagctaaggttgtctcatagcagaacacatgagcccatggtaga

SEQ ID NO: 219973 - DNA, 75 bp, Artificial Sequence
  Synthetic
ggagcaacagttcactatagaataaggtcctgtagggggcacagaagacacaagagtcaaataaaggcaatttaa

SEQ ID NO: 219974 - DNA, 75 bp, Artificial Sequence
  Synthetic
tcatctgagctaaggttgtctcatagcagaacacatgagcccatggtagaggaaagagttgtgagcactagtgat

SEQ ID NO: 219975 - DNA, 75 bp, Artificial Sequence
  Synthetic
caagaaaactcgaggtcagattcagacggaggctcaacgcccaacagttcacagagattcctcagtgaggagaga

SEQ ID NO: 219976 - DNA, 75 bp, Artificial Sequence
  Synthetic
acggaggctcaacgcccaacagttcacagagattcctcagtgaggagagatgttcactagataggtaatttgttg

SEQ ID NO: 219977 - DNA, 75 bp, Artificial Sequence
  Synthetic
atttgtggctacaactagaactttggggtctttcacatggttcccacataagacaagtatcccagagggtgaggg

SEQ ID NO: 219978 - DNA, 75 bp, Artificial Sequence
  Synthetic
gggtctttcacatggttcccacataagacaagtatcccagagggtgaggggctacaaagactgggtccgttttcc

SEQ ID NO: 219979 - DNA, 75 bp, Artificial Sequence
  Synthetic
catcaggaattaatccctctatctgcctcataatcctgtaactgcggttgccatctacccagtctctaacatctg

SEQ ID NO: 219980 - DNA, 75 bp, Artificial Sequence
  Synthetic
gtatgacttgatgatgggttatgcttggatagattttgatgttgagccagccaagtttgaccagaacaaattgat

SEQ ID NO: 219981 - DNA, 75 bp, Artificial Sequence
  Synthetic
tggatagattttgatgttgagccagccaagtttgaccagaacaaattgatcgcatcaggattagtcaattctaaa

SEQ ID NO: 219982 - DNA, 75 bp, Artificial Sequence
  Synthetic
agactcaaggtcctcatctggatcaaattacacagatgaacagggacaccattcgccactgactgatcaatgatt

SEQ ID NO: 219983 - DNA, 75 bp, Artificial Sequence
  Synthetic
aattacacagatgaacagggacaccattcgccactgactgatcaatgattgtatcaattgtttctgccagttgat

SEQ ID NO: 219984 - DNA, 75 bp, Artificial Sequence
  Synthetic
atctacaaagctgaaccagacaataaggtttcagataaaaagtcaggatgctagcttcaaggagaagttcgctat

SEQ ID NO: 219985 - DNA, 75 bp, Artificial Sequence
  Synthetic
aggtttcagataaaaagtcaggatgctagcttcaaggagaagttcgctatccaccttgactttgtcggttcgatg

SEQ ID NO: 219986 - DNA, 75 bp, Artificial Sequence
  Synthetic
gatcaattatggtatcaattgtttctgccaattgatggggttctttgcactttatgttgtgtaaagccgcagcaa

SEQ ID NO: 219987 - DNA, 75 bp, Artificial Sequence
  Synthetic
agcaatggcacctcatctccccaaacaaaaaatctggatttaaattctgcaacaaatctgccaataacgctctta

SEQ ID NO: 219988 - DNA, 75 bp, Artificial Sequence
  Synthetic
tttaaatcacactgtaacagggaagacatcgctgccaagatgctggcttgtgtcaaatggttcctacctgaatga

SEQ ID NO: 219989 - DNA, 75 bp, Artificial Sequence
  Synthetic
tgcagtgagcccctgtgtattgtcagattgttggagattggtgttgtctggtccgacctttaaaggaaaatcagc

SEQ ID NO: 219990 - DNA, 75 bp, Artificial Sequence
  Synthetic
gattgttggagattggtgttgtctggtccgacctttaaaggaaaatcagcatggtacgtggacactgaagaaatc

SEQ ID NO: 219991 - DNA, 75 bp, Artificial Sequence
  Synthetic
cgctcatataatagtggaagtccattagggtcttgaattcatccgggtctctttgtaagagttctgtaagagttt

SEQ ID NO: 219992 - DNA, 75 bp, Artificial Sequence
  Synthetic
gattgtcatcgatgctgatagattacagtttgtagaacatgattttgtcctagtgggcccttgctctgaagcagt

SEQ ID NO: 219993 - DNA, 75 bp, Artificial Sequence
  Synthetic
ccaccacatatgcaactaatggcataattaatgaacctctctgaaatgagggcataaaaatctgacgtgttatgt

SEQ ID NO: 219994 - DNA, 75 bp, Artificial Sequence
  Synthetic
aattaatgaacctctctgaaatgagggcataaaaatctgacgtgttatgtagtatcccttgacccatatcaagta

SEQ ID NO: 219995 - DNA, 75 bp, Artificial Sequence
  Synthetic
cagtttgtagaacatgattttgtcctagtgggcccttgctctgaagcagtccctctggttgtacataggggtgga

SEQ ID NO: 219996 - DNA, 75 bp, Artificial Sequence
  Synthetic
tcagaaatcaacgcataaaagtctgaagtgttgtgcagaataccctgtcccatatcaaggattgaactaatgtgt

SEQ ID NO: 219997 - DNA, 75 bp, Artificial Sequence
  Synthetic
ccaagaccttgaattgtttgtgagagaagttggtgagacatctcctgatttgctgagcggagcgttgagtgccat

SEQ ID NO: 219998 - DNA, 75 bp, Artificial Sequence
  Synthetic
aagtcctctgttattgattgtgtggttttctttctcagccccaattgggctttaatgaatgatttcatcatagct

SEQ ID NO: 219999 - DNA, 75 bp, Artificial Sequence
  Synthetic
gttgataaagggcaacttccaccggatcctcaggtcttccctcaatgtccatccaggtcttagcatttggatcaa

SEQ ID NO: 220000 - DNA, 75 bp, Artificial Sequence
  Synthetic
ttttctttctcagccccaattgggctttaatgaatgatttcatcatagctgataccacattaaaaggtatttcca

SEQ ID NO: 220001 - DNA, 75 bp, Artificial Sequence
  Synthetic
gaagttggtgagacatctcctgatttgctgagcggagcgttgagtgccatgatgcttgataggttgaagttgagg

SEQ ID NO: 220002 - DNA, 75 bp, Artificial Sequence
  Synthetic
tgatagtggtttgaaggttctgaacgctgcctttgaggcggtggatgactgggttgaatttaaaggctatgcatt

SEQ ID NO: 220003 - DNA, 75 bp, Artificial Sequence
  Synthetic
tttatatcagcctgcaagtcctttgaaaggaaaattaagttttgcaaaacagccaagaacagaaatgggcacatc

SEQ ID NO: 220004 - DNA, 75 bp, Artificial Sequence
  Synthetic
aaaggaaaattaagttttgcaaaacagccaagaacagaaatgggcacatcattgggccccatttactgtgatcca

SEQ ID NO: 220005 - DNA, 75 bp, Artificial Sequence
  Synthetic
cagattgtagtgtcgaatgcacgttacaaaaactgtgactatctgccaaagtgataaaagcaaagcgcaatccaa

SEQ ID NO: 220006 - DNA, 75 bp, Artificial Sequence
  Synthetic
gctgcctttgaggcggtggatgactgggttgaatttaaaggctatgcattgtgcttcagcaggtcaaagaggaga

SEQ ID NO: 220007 - DNA, 75 bp, Artificial Sequence
  Synthetic
ggggatcctaggcaatttggttgttcttttctgaggccttgtgcgctgaactcctccaaatgggaaacaagcaag

SEQ ID NO: 220008 - DNA, 75 bp, Artificial Sequence
  Synthetic
tgaagaactacctgaagaagaagaacaggttgaggatattgagtagttgcttcagtgtggctgcctcccccgggg

SEQ ID NO: 220009 - DNA, 75 bp, Artificial Sequence
  Synthetic
gcattctcaaattccttctcgttgttcaaacaactccctgacaattgcaaactcagtgcctcaaagtagtcctct

SEQ ID NO: 220010 - DNA, 75 bp, Artificial Sequence
  Synthetic
tcaaacaactccctgacaattgcaaactcagtgcctcaaagtagtcctctatcagtctagtgaacatctttgtcc

SEQ ID NO: 220011 - DNA, 75 bp, Artificial Sequence
  Synthetic
caggttgaggatattgagtagttgcttcagtgtggctgcctcccccggggggcccccggcggggggtccccccgg

SEQ ID NO: 220012 - DNA, 75 bp, Artificial Sequence
  Synthetic
gtgtgtatggtggaggattggtggtgccttctttgatgatttgtggtgctgtcggcatggttgttggtcttagcc

SEQ ID NO: 220013 - DNA, 75 bp, Artificial Sequence
  Synthetic
gacaaggagaactttagcctccctgtgtcaggtcctactgaattataagactgtggtgactcttggctgtaaaaa

SEQ ID NO: 220014 - DNA, 75 bp, Artificial Sequence
  Synthetic
tgtcaggtcctactgaattataagactgtggtgactcttggctgtaaaaacagagattcttcaacattgctgtgg

SEQ ID NO: 220015 - DNA, 75 bp, Artificial Sequence
  Synthetic
gccttctttgatgatttgtggtgctgtcggcatggttgttggtcttagcctcgtgggcaggggcatcttacagat

SEQ ID NO: 220016 - DNA, 75 bp, Artificial Sequence
  Synthetic
ggtagtggttgttacactcaactaggcccttattttcaaaccaacagctcttgcagaattgcggtccaaggtgcg

SEQ ID NO: 220017 - DNA, 75 bp, Artificial Sequence
  Synthetic
ctctcactaattctgacatcatcagaaagcttgcccatatcaaatttaaaattaagatttcttgatttgtaatga

SEQ ID NO: 220018 - DNA, 75 bp, Artificial Sequence
  Synthetic
caccactcccatcctccccccgacaccccccggggggaccccccgccgggggcccccccgggggagccaaccatc

SEQ ID NO: 220019 - DNA, 75 bp, Artificial Sequence
  Synthetic
aatctgttagtgcttgcactacatcattcaagtcaacctgcccttgttttgttaaacatgccagtgtcagacttg

SEQ ID NO: 220020 - DNA, 75 bp, Artificial Sequence
  Synthetic
aaagcttgcccatatcaaatttaaaattaagatttcttgatttgtaatgagtgtaccttcccattagtgtgtttg

SEQ ID NO: 220021 - DNA, 75 bp, Artificial Sequence
  Synthetic
ttggcttgtctgttccccattgcactgagcttaagttgtgaagctctacagtagaataaccaaattgcctaggat

SEQ ID NO: 220022 - DNA, 75 bp, Artificial Sequence
  Synthetic
tgagcttaagttgtgaagctctacagtagaataaccaaattgcctaggatccccggtgcgcgagacctactggga

SEQ ID NO: 220023 - DNA, 75 bp, Artificial Sequence
  Synthetic
aaatatgtccttgttgtcactgcctttgttagttctccaatgggacactgagacatatgtccgcagtaaaaatat

SEQ ID NO: 220024 - DNA, 75 bp, Artificial Sequence
  Synthetic
agcatcattgtagatattctcacaaattttgatgtattgatcctcagacaggatttctcgatcaaaatcttctat

SEQ ID NO: 220025 - DNA, 75 bp, Artificial Sequence
  Synthetic
ttgttagttctccaatgggacactgagacatatgtccgcagtaaaaatatctctccttcaacttatcattctcat

SEQ ID NO: 220026 - DNA, 75 bp, Artificial Sequence
  Synthetic
tcaaaatcttcaaccatgtggttggataactcacctttaatcaacctgatgtggaacttgttcgaaataacttca

SEQ ID NO: 220027 - DNA, 75 bp, Artificial Sequence
  Synthetic
aggtctgtataattttgctacatgtggcctcgttggtttggttactttcctcttactgtgtggcaggtcttgcac

SEQ ID NO: 220028 - DNA, 75 bp, Artificial Sequence
  Synthetic
ccagatctgttagtgctaagacggcatcattcaaatcaacctgaccttgtttagtgagacatgctaatgtcagac

SEQ ID NO: 220029 - DNA, 75 bp, Artificial Sequence
  Synthetic
acacttggaatttactgattgattgaaagtatcactcagtaagtcaatgaaaggcgcaatccaatagcctaggat

SEQ ID NO: 220030 - DNA, 75 bp, Artificial Sequence
  Synthetic
ataactcacctttaatcaacctgatgtggaacttgttcgaaataacttcatctaaatcattcacagacggctgac

SEQ ID NO: 220031 - DNA, 75 bp, Artificial Sequence
  Synthetic
acgatcttttcaacagtctcccttagctgatcaaaataaacacttgcacccccgtcaagcaggatttcgtccaaa

SEQ ID NO: 220032 - DNA, 75 bp, Artificial Sequence
  Synthetic
gctgatcaaaataaacacttgcacccccgtcaagcaggatttcgtccaaatcagcctcatcagcatcagtcttat

SEQ ID NO: 220033 - DNA, 75 bp, Artificial Sequence
  Synthetic
gcatcaaccgctgaacattgctgacctcagagaagtcaagtccatgtaaaagagcctgggcatctttcaccacct

SEQ ID NO: 220034 - DNA, 75 bp, Artificial Sequence
  Synthetic
gggctggttcagtgcaaggacccaccaatacaaagtcatactccgtaaactgcagcttttccatatcaacaacaa

SEQ ID NO: 220035 - DNA, 75 bp, Artificial Sequence
  Synthetic
agacaattccctcctcaaagattgtgtccacaggaaggactttatctcctttgaggcactcattgccaagttgtt

SEQ ID NO: 220036 - DNA, 75 bp, Artificial Sequence
  Synthetic
tcatagtcctgcttgtttaggaggtgtttccccttccttgagaaaacctcagtaagctgtgacacggctaatgct

SEQ ID NO: 220037 - DNA, 75 bp, Artificial Sequence
  Synthetic
ttgaggcactcattgccaagttgttgtgttgaacacacacagcagagaactaagactatctgctgaattgataaa

SEQ ID NO: 220038 - DNA, 75 bp, Artificial Sequence
  Synthetic
gtttccccttccttgagaaaacctcagtaagctgtgacacggctaatgctgtgagcttattaaaatcgtagttta

SEQ ID NO: 220039 - DNA, 75 bp, Artificial Sequence
  Synthetic
gctaaatccaaggctgtagcacagccactagtgatgaggggatctttgatgtccttcttaacttctttttccttg

SEQ ID NO: 220040 - DNA, 75 bp, Artificial Sequence
  Synthetic
tttctttaaataatgaaccattattgaaactagacacaaggagtgagataaattttttggaaacaccaggctttt

SEQ ID NO: 220041 - DNA, 75 bp, Artificial Sequence
  Synthetic
cactagtgatgaggggatctttgatgtccttcttaacttctttttccttgaacagcgaaccattattaaaagagg

SEQ ID NO: 220042 - DNA, 75 bp, Artificial Sequence
  Synthetic
gacactttagggttcactggttgaaagtattactcagtgagtcaatgaaaagcgcaatccaatagcctaggatcc

SEQ ID NO: 220043 - DNA, 75 bp, Artificial Sequence
  Synthetic
ggtcccttggcacttgtacatccatctttgttcaaaaacttctttgcgttgtagatcatgtcatccaactcttct

SEQ ID NO: 220044 - DNA, 75 bp, Artificial Sequence
  Synthetic
ctttgttcaaaaacttctttgcgttgtagatcatgtcatccaactcttcttccgtagctatgtctgcaggattga

SEQ ID NO: 220045 - DNA, 75 bp, Artificial Sequence
  Synthetic
aatttaggatcaactaagcctgatgcgatcaattgattttgattgaatctagctggctcaatatcaaagtctatc

SEQ ID NO: 220046 - DNA, 75 bp, Artificial Sequence
  Synthetic
cagccacctccaaaaactactcaatgtcctcaacatgttcgtccccctcagtcaactcctcgcatgttctgcctt

SEQ ID NO: 220047 - DNA, 75 bp, Artificial Sequence
  Synthetic
tttatctggtctgttaacctgtctggtgtctcttttgtaatgaaatggcacatgtaggaaatgttcaagatgaat

SEQ ID NO: 220048 - DNA, 75 bp, Artificial Sequence
  Synthetic
gtgtctcttttgtaatgaaatggcacatgtaggaaatgttcaagatgaatttgaatctgttggtcatcatactct

SEQ ID NO: 220049 - DNA, 75 bp, Artificial Sequence
  Synthetic
ttggtagagtgcaacaaccactacctgtgtctcaactgtctcagcctgctcctcagcgttagcagcagatgcccg

SEQ ID NO: 220050 - DNA, 75 bp, Artificial Sequence
  Synthetic
gtctgtagagcagatattcaacttctgtgatcaaatcctccctaattttctcaatcaaatccttgtgataaaaat

SEQ ID NO: 220051 - DNA, 75 bp, Artificial Sequence
  Synthetic
attctgtgatatgctgaggctgtttgacttcaacaaacaggccattcaaaggttaaaagccgaagcacaaatgag

SEQ ID NO: 220052 - DNA, 75 bp, Artificial Sequence
  Synthetic
agtaagaattcagtatctgtgatcagttcttcccttattttatcaattaggtccttgtgataaaaatctgacacg

SEQ ID NO: 220053 - DNA, 75 bp, Artificial Sequence
  Synthetic
ggaattttgtgacatgctgaggctgtttgactttaacaaacaagccattcaaaggttgaaagctgaagcacaaat

SEQ ID NO: 220054 - DNA, 75 bp, Artificial Sequence
  Synthetic
gttcttcccttattttatcaattaggtccttgtgataaaaatctgacacgtaggccattataaagtacctgaggt

SEQ ID NO: 220055 - DNA, 75 bp, Artificial Sequence
  Synthetic
agtatcatcttagtcaatgacctgatattatgcagttgcccttccaactcactacaatcttctatccaagaaatc

SEQ ID NO: 220056 - DNA, 75 bp, Artificial Sequence
  Synthetic
tattatgcagttgcccttccaactcactacaatcttctatccaagaaatcatagtacctactgtagcctgtagaa

SEQ ID NO: 220057 - DNA, 75 bp, Artificial Sequence
  Synthetic
tcatatttgaacgagacccacttttccgatgacattgagcaacaagctgacaatatgatcactgagatgttgcag

SEQ ID NO: 220058 - DNA, 75 bp, Artificial Sequence
  Synthetic
ggggggaccccccgccgggggcccccccggggggcaggcaacccagctctactcaatgtcctcaatgcacttctc

SEQ ID NO: 220059 - DNA, 75 bp, Artificial Sequence
  Synthetic
gagcaaatctcaccaactctgttgtcattgatagcataacactttgaacattcccctgtcttctggtaaaccaac

SEQ ID NO: 220060 - DNA, 75 bp, Artificial Sequence
  Synthetic
cattgatagcataacactttgaacattcccctgtcttctggtaaaccaactgaaattcagtgtcacccaatgaga

SEQ ID NO: 220061 - DNA, 75 bp, Artificial Sequence
  Synthetic
gttaacactcacaaaacaggagcccagccaaccagcaaggagcctatcaccatgccttatgcagtccagtcggct

SEQ ID NO: 220062 - DNA, 75 bp, Artificial Sequence
  Synthetic
ccaaactcattctgcctcaatttcacagtggatgaagttttcatagagttcaccaaagcaaggctcagtgaagaa

SEQ ID NO: 220063 - DNA, 75 bp, Artificial Sequence
  Synthetic
cagtggatgaagttttcatagagttcaccaaagcaaggctcagtgaagaaagtctctccaggtcaacagtttcca

SEQ ID NO: 220064 - DNA, 75 bp, Artificial Sequence
  Synthetic
aaagtatgtccttgttgacactgcctttgtcaactctccaataggacattgtgacatatgtccacagtaaaaata

SEQ ID NO: 220065 - DNA, 75 bp, Artificial Sequence
  Synthetic
tggtagctgattgtaggagtaattccagaaacatcaaaatccatgactgaatcataacaatttggacacattatc

SEQ ID NO: 220066 - DNA, 75 bp, Artificial Sequence
  Synthetic
gtctatccaggcataacccatcattagatcatgtttgaacattggtctctcaacacctttgtgaatgactttctc

SEQ ID NO: 220067 - DNA, 75 bp, Artificial Sequence
  Synthetic
ctcacaattccgttcttctttaggtgataggacacctgcatttctgtccctagttctcttcctgctgtctatcca

SEQ ID NO: 220068 - DNA, 75 bp, Artificial Sequence
  Synthetic
tgcaacattgaattgagaatttgattcttgtttgaacattgggaagactgcatggtcttggacatctcagcctgt

SEQ ID NO: 220069 - DNA, 75 bp, Artificial Sequence
  Synthetic
cactgatccccacatccttcagggcagtggtggccttcaagatggtcttctgcaacattgaattgagaatttgat

SEQ ID NO: 220070 - DNA, 75 bp, Artificial Sequence
  Synthetic
catggtcttggacatctcagcctgttgcctccgttcaacccacttctttagatccctttttgttgactctaaaga

SEQ ID NO: 220071 - DNA, 75 bp, Artificial Sequence
  Synthetic
aagcaggacccaagccaccctctcagactcttatatttcatttgatcatatttacttgcaaggagaatcaataca

SEQ ID NO: 220072 - DNA, 75 bp, Artificial Sequence
  Synthetic
gactcttatatttcatttgatcatatttacttgcaaggagaatcaatacatcaaaaatcagtagaagttttctcc

SEQ ID NO: 220073 - DNA, 75 bp, Artificial Sequence
  Synthetic
gtcagccccatcagcatcacttttatgctgtccagatcccaggaccagattactcattgcctgctgcaccttgta

SEQ ID NO: 220074 - DNA, 75 bp, Artificial Sequence
  Synthetic
tattgcatttgacactctttaatggtttgatcactcttctcattggcttccttcccgacattcgcatacagaaat

SEQ ID NO: 220075 - DNA, 75 bp, Artificial Sequence
  Synthetic
gccatctacccagtctctaacatctgtctcgcaattcaataaaaatgggtcagtagggtatcttgcatattgcaa

SEQ ID NO: 220076 - DNA, 75 bp, Artificial Sequence
  Synthetic
actggtgaatcaaatattcaacatcgtcttctgtggttgacaccttatccatgtacagatcattaaactcattga

SEQ ID NO: 220077 - DNA, 75 bp, Artificial Sequence
  Synthetic
atgtacagatcattaaactcattgagtaatctgctcttctcaacttttaggaactggctctcgatctcccccttc

SEQ ID NO: 220078 - DNA, 75 bp, Artificial Sequence
  Synthetic
gatttgatactcctcctcaattaaactcttgacttcatgagaggtgagcttgttattaatgccctgatgacaact

SEQ ID NO: 220079 - DNA, 75 bp, Artificial Sequence
  Synthetic
gtaatctgctcttctcaacttttaggaactggctctcgatctcccccttcctcagtctgtttctgaacacctggt

SEQ ID NO: 220080 - DNA, 75 bp, Artificial Sequence
  Synthetic
tgtggctctttacactttatattgtgaagagctgctgcaacgaactttgtcaataatggcacttcatctccccaa

SEQ ID NO: 220081 - DNA, 75 bp, Artificial Sequence
  Synthetic
ataccctggtggcacgaagcaattacttcctcataatggtttgagcgattgtccaatagtacatttaaactctcc

SEQ ID NO: 220082 - DNA, 75 bp, Artificial Sequence
  Synthetic
cttcctcataatggtttgagcgattgtccaatagtacatttaaactctccacccctgacaacctccctgaagtca

SEQ ID NO: 220083 - DNA, 75 bp, Artificial Sequence
  Synthetic
ttttatctgatctgtcaatctatctggtgtttcttttgtaataaagtgacacatgtaggaaatgttcaaaatgaa

SEQ ID NO: 220084 - DNA, 75 bp, Artificial Sequence
  Synthetic
ttactttcctgagcatatctcagtaatgagaagagtgtgtccctcaacttgtcatttacccagtcaggtatctgt

SEQ ID NO: 220085 - DNA, 75 bp, Artificial Sequence
  Synthetic
atgagaagagtgtgtccctcaacttgtcatttacccagtcaggtatctgttcattataaaatgatgttctcccgt

SEQ ID NO: 220086 - DNA, 75 bp, Artificial Sequence
  Synthetic
ttgatgccaacagactccaaatcattctttaattgttctagtttcttgtgatcttctaaatacttctgttcaaaa

SEQ ID NO: 220087 - DNA, 75 bp, Artificial Sequence
  Synthetic
tgctccaactttttgaagtcttcaatatacttttgctcaaagttagcaggagacgacctaacaaaacactctaat

SEQ ID NO: 220088 - DNA, 75 bp, Artificial Sequence
  Synthetic
agacgacctaacaaaacactctaataatatcaaaacattgcctgtcaatttgtaaccatccggcaccacaaagca

SEQ ID NO: 220089 - DNA, 75 bp, Artificial Sequence
  Synthetic
gttttcttccttaaccctagttgagctttaatgaaggacttcatcatagctgtcaccacattaaaaggtatttcc

SEQ ID NO: 220090 - DNA, 75 bp, Artificial Sequence
  Synthetic
tttcaatccctccatgagcaacattctaggttcagtttggaccagaaaagctaacttctgtcttgatagcttctc

SEQ ID NO: 220091 - DNA, 75 bp, Artificial Sequence
  Synthetic
tcacagagattttttagtgaagagaggtgttcactagacaggtagtttgttgtaaactcctcatggagctgccca

SEQ ID NO: 220092 - DNA, 75 bp, Artificial Sequence
  Synthetic
tgtcctcactattatgctcgcaaccatttgcgttacaggaatcaatttcaatacagagggacagaagttttaacc

SEQ ID NO: 220093 - DNA, 75 bp, Artificial Sequence
  Synthetic
tgccttgatagtctctcgttatctgctaagtatttggacactaagtctttaacacaagctatgtcctcctccatg

SEQ ID NO: 220094 - DNA, 75 bp, Artificial Sequence
  Synthetic
ggtggcggttcactgtaggatagggctctacaagatgcaactagaccggttagaataaaatgaattaatgaaaag

SEQ ID NO: 220095 - DNA, 75 bp, Artificial Sequence
  Synthetic
aagtgtcagcaacaggtgccccatttgcaagatgcctctccccacaaaactgagaccatcagccgctccaacagc

SEQ ID NO: 220096 - DNA, 75 bp, Artificial Sequence
  Synthetic
tgagaccatcagccgctccaacagcacccccagccggggcagcagacagcatccgacccccaccctacagtccct

SEQ ID NO: 220097 - DNA, 75 bp, Artificial Sequence
  Synthetic
tcggaaatgagactggcttggagctgaccttgacaaatacaagcattatcaaccacaagttttgtaacctttctg

SEQ ID NO: 220098 - DNA, 75 bp, Artificial Sequence
  Synthetic
gtgtcagcaacaggtgccccatctgtaagatgcctcttcccacaaaactgagaccatcagccgctccaacagcac

SEQ ID NO: 220099 - DNA, 75 bp, Artificial Sequence
  Synthetic
tccacccctgaccattgcacccttaaccccagcctatctatcatcatgtcactcaatgccccaatcagcaggtca

SEQ ID NO: 220100 - DNA, 75 bp, Artificial Sequence
  Synthetic
caaccttccacttatccattcctaactttaatcagtatgaagcaatgagctgtgacttcaatggggggaagataa

SEQ ID NO: 220101 - DNA, 75 bp, Artificial Sequence
  Synthetic
ctgacaccacattgaaaggtatttccaccattttgtgcatgtgccacataagcagggttgagagatagtccctcc

SEQ ID NO: 220102 - DNA, 75 bp, Artificial Sequence
  Synthetic
ccactggtgatgagaggatctttgatttccctttttacttccctctccttaaatagtgaaccattgttaaaagag

SEQ ID NO: 220103 - DNA, 75 bp, Artificial Sequence
  Synthetic
tccatatcaacaacaacttcaacgggggtcacatgccctagttgatttgtgtcaattagaaactcattgataacc

SEQ ID NO: 220104 - DNA, 75 bp, Artificial Sequence
  Synthetic
ttttatctgatctgtcaatctatctggtgtttctttcgtaatgaagtggcacatgtaggaaatattcaaaatgaa

SEQ ID NO: 220105 - DNA, 75 bp, Artificial Sequence
  Synthetic
taaaatttgtctggtaagacatcatgatcaaaatcctcaaccatgtggttagacaactcacccttaatcaaccta

SEQ ID NO: 220106 - DNA, 75 bp, Artificial Sequence
  Synthetic
tcttgataatctctcgttgtccactaggtactttgatactaagtctttaacataggctatgtcttcctccatgtt

SEQ ID NO: 220107 - DNA, 75 bp, Artificial Sequence
  Synthetic
cccatcatcagatcatgtttaaacattggcctttcaacacctttgtgaataactttctctacaaatgaagaaaat

SEQ ID NO: 220108 - DNA, 75 bp, Artificial Sequence
  Synthetic
agaccatcagccactccaacagcacccccaaccgaagcagcagacagcatcagacccccaccctaccgcccctaa

SEQ ID NO: 220109 - DNA, 75 bp, Artificial Sequence
  Synthetic
ctccgggggagccaaccctctccaagagactactcaatgtcctcgatgcattcatccctcctggtcaactcctca

SEQ ID NO: 220110 - DNA, 75 bp, Artificial Sequence
  Synthetic
cttgctcagtgcaatgtcaataagctttatgtcccttcttccttgggagtccaagagtctcttaatatcatctga

SEQ ID NO: 220111 - DNA, 75 bp, Artificial Sequence
  Synthetic
gtgcatgtggcataagtctttatattgatcccagactgcattttcatacttcctggaatcagttttactgagggc

SEQ ID NO: 220112 - DNA, 75 bp, Artificial Sequence
  Synthetic
cagtggtggctttcaaaatggttttctggaatattgaattgaggatttgattcttactcaaacactgggaggact

SEQ ID NO: 220113 - DNA, 75 bp, Artificial Sequence
  Synthetic
cacatgtaagagatgtttaagatgaacttgaacctgttggtcatcatgctcttcacatcctcagataaaactaaa

SEQ ID NO: 220114 - DNA, 75 bp, Artificial Sequence
  Synthetic
atgccattggaatttgtcagcaatttgattcccttgatatcagaaatcagagactgaatggattttatatataga

SEQ ID NO: 220115 - DNA, 75 bp, Artificial Sequence
  Synthetic
ctgttgcacagccgcttgtaataagagggtctcgcagtgtcttctttacttccttttctttaaacaatgaaccat

SEQ ID NO: 220116 - DNA, 75 bp, Artificial Sequence
  Synthetic
tgtcttctgcagctaccttatcagcgtacagattattaagttcattaagcaactggctcttatcaacctttaaaa

SEQ ID NO: 220117 - DNA, 75 bp, Artificial Sequence
  Synthetic
aaagattgaaagctgaagcacaaatgagcattcagctgatcaacaaagcagtgaatgctttgataaatgaccaac

SEQ ID NO: 220118 - DNA, 75 bp, Artificial Sequence
  Synthetic
tattgatgaagaactcttggcaataggcctctttacacctcacaacctgatatctagagggtccaaattcatttt

SEQ ID NO: 220119 - DNA, 75 bp, Artificial Sequence
  Synthetic
atttccagattgttgtgttggatgcacgcagcggaaaactgagactatctgccaaaatgacaaaagcaaagcgca

SEQ ID NO: 220120 - DNA, 75 bp, Artificial Sequence
  Synthetic
tcttgataatctctcgttgtccgctaggtactttgatactaagtctttgacacaggctatgtcttcctccatgtt

SEQ ID NO: 220121 - DNA, 75 bp, Artificial Sequence
  Synthetic
gcgcaccggggatcctaggcaatttggttattctttctgtggccttgtgcactgtactcctcctctaaatgggaa

SEQ ID NO: 220122 - DNA, 75 bp, Artificial Sequence
  Synthetic
aaaagacagtccgagagccagcctgatcccagatgccacacatctagggccacagttctgtaagagctgctggtt

SEQ ID NO: 220123 - DNA, 75 bp, Artificial Sequence
  Synthetic
cagcagttcactatagaataaggttccgtaggggcacaaaagacacaagagtcaactgaaggcaatttaattaga

SEQ ID NO: 220124 - DNA, 75 bp, Artificial Sequence
  Synthetic
tgaaaacaagggtctggttgagtgcaataaccactatctgtgtctcaactgccttaccctacttctaagtgtcag

SEQ ID NO: 220125 - DNA, 75 bp, Artificial Sequence
  Synthetic
gtgataaccatatttcgggggagtgcctcaataacagcactggtcaaacctggttgtgcagcaaacagatctgtg

SEQ ID NO: 220126 - DNA, 75 bp, Artificial Sequence
  Synthetic
gccaaccagcaaggagcttatcaccatgccttatgcagtccagccggctagcaagaagaatcagaacgtcaaaaa

SEQ ID NO: 220127 - DNA, 75 bp, Artificial Sequence
  Synthetic
accgacccccaccactcccatcctccccccgacaccccccggggggaccccccgccgggggcccccccgggggag

SEQ ID NO: 220128 - DNA, 75 bp, Artificial Sequence
  Synthetic
cccgccgggggcccccccgggggagccaaccatctccaggggactactcaatgtcctcgatacattcatccttcc

SEQ ID NO: 220129 - DNA, 75 bp, Artificial Sequence
  Synthetic
atttactatagcagagggcataacccttaaattccacccagttgtccactgcctcaagaaccgcacccaggatcc

SEQ ID NO: 220130 - DNA, 75 bp, Artificial Sequence
  Synthetic
gcctcaagaaccgcacccaggatcccttcacaacttggtgttgcagccctcagcgtggacacaatgtccacccct

SEQ ID NO: 220131 - DNA, 75 bp, Artificial Sequence
  Synthetic
cttcctccatcgtcagttgtggcacctgtgttgggcttgggcttgtacctgtattgcgtgtgggccagctggcag

SEQ ID NO: 220132 - DNA, 75 bp, Artificial Sequence
  Synthetic
cccaatcaacaggtcagacgaagtgtccccaacctctctcacaaatacctcaagatcctggtcttgtataacagg

SEQ ID NO: 220133 - DNA, 75 bp, Artificial Sequence
  Synthetic
ctgtgttgggcttgggcttgtacctgtattgcgtgtgggccagctggcagcgcctcacaaaagctcttacagaaa

SEQ ID NO: 220134 - DNA, 75 bp, Artificial Sequence
  Synthetic
taacacccagagctaggctgatatagggcaacttccaccgggtcttccggcctcccctctatatccatccatgtc

SEQ ID NO: 220135 - DNA, 75 bp, Artificial Sequence
  Synthetic
cggtgtgcctgtgaaatggaagagatgagaccctcatcagggcccccgtgacccaccgcctgttggcggtgggtc

SEQ ID NO: 220136 - DNA, 75 bp, Artificial Sequence
  Synthetic
tgattactaccactcattcctatcatgttcagaagagctcttctttggtcaagttgctgtgagcttaggttgccc

SEQ ID NO: 220137 - DNA, 75 bp, Artificial Sequence
  Synthetic
accatcagccgccccgacggcgcccctggctgaagcaggagacaacaccagacccccaccctacagtccctgaac

SEQ ID NO: 220138 - DNA, 75 bp, Artificial Sequence
  Synthetic
aacctgatgcaatcaattgattttgattgaatctagctggctcaatatcaaagtctatccaagcataacccatca

SEQ ID NO: 220139 - DNA, 75 bp, Artificial Sequence
  Synthetic
cctgtattgggtttgggtttgtgccagaatggcttgtgggtcagctgatgatgccccacaaaagctcctacagaa

SEQ ID NO: 220140 - DNA, 75 bp, Artificial Sequence
  Synthetic
agaatggcttgtgggtcagctgatgatgccccacaaaagctcctacagaaatgagagacaatatgcctaggatcc

SEQ ID NO: 220141 - DNA, 75 bp, Artificial Sequence
  Synthetic
atcgccaagttattgtgttgaatgcacgcaacaaaaactgagactatctgccaaagtgatatgagcaaagcgcaa

SEQ ID NO: 220142 - DNA, 75 bp, Artificial Sequence
  Synthetic
cgcaccggggatcctaggcaatttggttgttcttggttgttcttctcttttttgaggccttgtgcgctgaactcc

SEQ ID NO: 220143 - DNA, 75 bp, Artificial Sequence
  Synthetic
cagttaacatccaatgctacacagagatctagaaattttattctgggtgaccacttcattttggttgacgctaga

SEQ ID NO: 220144 - DNA, 75 bp, Artificial Sequence
  Synthetic
cctgcagattggagggatttatttgagctaccactgtttggtttttgtggtttcccatctgcttctaagtccacc

SEQ ID NO: 220145 - DNA, 75 bp, Artificial Sequence
  Synthetic
ggagactactcaatgtcttcgatgcattcatccttcctagtcaactcctcacatgttctgcccttcagtctcaat

SEQ ID NO: 220146 - DNA, 75 bp, Artificial Sequence
  Synthetic
tctctctttgcgcatcaaccgttgaacattgctgacttcggagaagtcaagtccatgcaaaagagcctgagcatc

SEQ ID NO: 220147 - DNA, 75 bp, Artificial Sequence
  Synthetic
acttgactgaatcatgactctttgctttgatttgctataacaaagagcatagcctttaaaatcaatccattctcc

SEQ ID NO: 220148 - DNA, 75 bp, Artificial Sequence
  Synthetic
gcccaatgttctgcacaatcccacaaagcctgatgcaatggaactttgaaatgcagatttattgatagcctcaga

SEQ ID NO: 220149 - DNA, 75 bp, Artificial Sequence
  Synthetic
ttcttctcaacaacaatacctgtgtgcatgtggcataagtctttatactggtcccagactgcattttcatacttc

SEQ ID NO: 220150 - DNA, 75 bp, Artificial Sequence
  Synthetic
tgtaatgagaagcatgatgaggaattttgtgacatgctgaggctgtttgacttcaacaaacaagccattcaaagg

SEQ ID NO: 220151 - DNA, 75 bp, Artificial Sequence
  Synthetic
tgctttgataaatgaccaacttataatgaagaaccatctacgggacatcatgggaattccatactgtaattacag

SEQ ID NO: 220152 - DNA, 75 bp, Artificial Sequence
  Synthetic
ctcccctatgcacaaccagaggggctggttcagtgcaaggacccaccaatacaaagtcatactccgtaaactgca

SEQ ID NO: 220153 - DNA, 75 bp, Artificial Sequence
  Synthetic
tctatcagattcccacagtgctcccctacatacaaccaatggcactggttcgttgtcaggtccgaccttggagaa

SEQ ID NO: 220154 - DNA, 75 bp, Artificial Sequence
  Synthetic
tttgtttcattaggtcatgcttacttgcaaggagaattagtgcatcaaaaatcaatagaagtttcctccttgtgt

SEQ ID NO: 220155 - DNA, 75 bp, Artificial Sequence
  Synthetic
gaatatattatcttttgtctcaacaccattcttaaaggatgatgtgcagccaagtttaaccaagaatactcaagg

SEQ ID NO: 220156 - DNA, 75 bp, Artificial Sequence
  Synthetic
attttatagagtatgttttcataggggtttctttcacccggggtgtctgaaacgaacattccaagagacctctta

SEQ ID NO: 220157 - DNA, 75 bp, Artificial Sequence
  Synthetic
tagatctttcagcctgttgcctccgttcaacccatttcttaagatcccttttagttgactccaaagaaactagtc

SEQ ID NO: 220158 - DNA, 75 bp, Artificial Sequence
  Synthetic
gggtggcagttacatagcacttgattctggaaaggggagttgggattgtataatgacttcctaccaatatttgat

SEQ ID NO: 220159 - DNA, 75 bp, Artificial Sequence
  Synthetic
gtgtgcctgtgaaatggaagagatgagacccttgtcagggcccccgtgacccaccgcctattggcggtgggtcac

SEQ ID NO: 220160 - DNA, 75 bp, Artificial Sequence
  Synthetic
gagtctcttaatatcatctgaaccttgacaggtcagcaccatattgcgagggagggcttcaatgactgcactggt

SEQ ID NO: 220161 - DNA, 75 bp, Artificial Sequence
  Synthetic
ggtaaagagctatttccacagggtcttctggacgaccttcaatgtctatccaggttttggcacttgggtcaagct

SEQ ID NO: 220162 - DNA, 75 bp, Artificial Sequence
  Synthetic
ttgagttgatcactcatatagtagtggaactctaatagagtcctaaattcttctgggtctctttccaagagctct

SEQ ID NO: 220163 - DNA, 75 bp, Artificial Sequence
  Synthetic
ttttagctgctgacctggagaagctgaagtcaaaggtgaccaggacagaaaggccattgagcgctggtgtttaca

SEQ ID NO: 220164 - DNA, 75 bp, Artificial Sequence
  Synthetic
tccaacatacaggcacctgctttcactgcagcacccagactgaaattgtaacctgagatgttcagggagctcttc

SEQ ID NO: 220165 - DNA, 75 bp, Artificial Sequence
  Synthetic
gctgtcagctttctgtggcttcccatctgattccagatcaacaacagtgttttcccaggcccttcctgttattga

SEQ ID NO: 220166 - DNA, 75 bp, Artificial Sequence
  Synthetic
tctgattccagatcaacaacagtgttttcccaggcccttcctgttattgaggttcttgatgcaatatatggccat

SEQ ID NO: 220167 - DNA, 75 bp, Artificial Sequence
  Synthetic
ctatgatccatgctataagagacatttgccaatgaaacattcagtttcatggaaaggatggcattttcaaattcc

SEQ ID NO: 220168 - DNA, 75 bp, Artificial Sequence
  Synthetic
cccccggggggaccccccgccgggggcccccccgggggagccaaccatcaccagaagactactcaatgtcttcga

SEQ ID NO: 220169 - DNA, 75 bp, Artificial Sequence
  Synthetic
gccggggatcctaggcatttaggattgcgcttttagagatctttgtgtgagtgagcttatcaagccatgggacaa

SEQ ID NO: 220170 - DNA, 75 bp, Artificial Sequence
  Synthetic
ataattctctgttaccacccacttgttctttatatgacaaagaaaacttaagccttcctgtatcaggtcccactg

SEQ ID NO: 220171 - DNA, 75 bp, Artificial Sequence
  Synthetic
aaggggctcagactgggagagacggagtggtgaggatttgggatgtgaaaaatgcagagctgcttaacaaccagt

SEQ ID NO: 220172 - DNA, 75 bp, Artificial Sequence
  Synthetic
tccaacatattgccaccatccagcatgcaagctcctgccttcacagctgcacccaagctaaaattataacctgag

SEQ ID NO: 220173 - DNA, 75 bp, Artificial Sequence
  Synthetic
gcacctcgagtgaaagtggaagacaacttattttggattgttttgacaatggtaggaatcttctcatcatctagg

SEQ ID NO: 220174 - DNA, 75 bp, Artificial Sequence
  Synthetic
gtataaatcaaacccagatctgtgagtgcttgaaccacatcattcaggtcgacttgcccctgttttgttagacat

SEQ ID NO: 220175 - DNA, 75 bp, Artificial Sequence
  Synthetic
caggtgccccatttgcaagatgcccctccccacaaaactgagaccatcagctgctccaacagcacccccagccgg

SEQ ID NO: 220176 - DNA, 75 bp, Artificial Sequence
  Synthetic
aggcaattcagctgaacttcagtagtggggctcatcttagtgaatccctgaatcaaagtgcctagtcaaaatggg

SEQ ID NO: 220177 - DNA, 75 bp, Artificial Sequence
  Synthetic
attcttcataaaacttacctggtaagatatcatgatcaaagtcctcaatcatgtgattggacaattcacctttaa

SEQ ID NO: 220178 - DNA, 75 bp, Artificial Sequence
  Synthetic
taggaatcaatccctctatttgcctcataattctataactacggttgccatctacccagtctctgacatctgtct

SEQ ID NO: 220179 - DNA, 75 bp, Artificial Sequence
  Synthetic
tcatgctcaacaacttacaagggtgtttatgagctacaaactctagagctagacatggcaagccttaacatgaca

SEQ ID NO: 220180 - DNA, 75 bp, Artificial Sequence
  Synthetic
gatggctggccatcaccattagggcctgggcctagcttgacaggttccctatactgatcaacaattttctcaaca

SEQ ID NO: 220181 - DNA, 75 bp, Artificial Sequence
  Synthetic
ttcgtctaggtcagccccatcagcatcacttttgtgctgtccagatcccaggaccagattgctcattgcctgttg

SEQ ID NO: 220182 - DNA, 75 bp, Artificial Sequence
  Synthetic
acataaaaagaatctctatgaccatgccttgatgagtatcatctcaaccttccacttatccattcctaactttaa

SEQ ID NO: 220183 - DNA, 75 bp, Artificial Sequence
  Synthetic
attactgacttcggagaagtcaagtccatgtaaaagagcctgggcatctttcaccacctgtagtttgatgttgga

SEQ ID NO: 220184 - DNA, 75 bp, Artificial Sequence
  Synthetic
tgcctcttcccaccaagctagaggcaacgacacagccgagcgcaccatcaaccgaggagacccagagcacaacac

SEQ ID NO: 220185 - DNA, 75 bp, Artificial Sequence
  Synthetic
tcatagtttaatattctagaaccatctgtgtatttattgacaacaacactcttgttgctggctagatccaaggct

SEQ ID NO: 220186 - DNA, 75 bp, Artificial Sequence
  Synthetic
aatcataactctttgccttgatttactataacaaagagcgtaacctttgaaatcaacccattctccaagagattc

SEQ ID NO: 220187 - DNA, 75 bp, Artificial Sequence
  Synthetic
ggagcacctactcaatgtcgaggggaggccccaccctcttcaaagaaggggcctgcacagcctccctcttaatct

SEQ ID NO: 220188 - DNA, 75 bp, Artificial Sequence
  Synthetic
tacatcatgtactaaatacttggcctgttgattcattgagccaacatactcaaggtggatggcaaagctttcctt

SEQ ID NO: 220189 - DNA, 75 bp, Artificial Sequence
  Synthetic
ggttgagagatagtccctccctttaatgtcagcttgcaggtcctttgaaaggaaaattaaattctgcaagacagt

SEQ ID NO: 220190 - DNA, 75 bp, Artificial Sequence
  Synthetic
caaaatgaacttgaacctgttagtcatcatgctcttcacatcctcagataaaatcaaattcattaatgcccttat

SEQ ID NO: 220191 - DNA, 75 bp, Artificial Sequence
  Synthetic
ttaacatccaacgctacacagagatctagaaattttattctaggtgaccacttcattttggttgacgctagatca

SEQ ID NO: 220192 - DNA, 75 bp, Artificial Sequence
  Synthetic
ttatccattcctaactttaatcagtatgaagcaatgagttgtgacttcaatggggggaagataagtgttcagtac

SEQ ID NO: 220193 - DNA, 75 bp, Artificial Sequence
  Synthetic
gacttcagtggtgagactcattttagtgaatccctgaattaaagtgcctagtcaaaatgggcaacaagcagacca

SEQ ID NO: 220194 - DNA, 75 bp, Artificial Sequence
  Synthetic
gatctgcaagatgccccttcccaccaggctaaaggcagcagcacagccgagcgcaccctcaaccgaggcgaccca

SEQ ID NO: 220195 - DNA, 75 bp, Artificial Sequence
  Synthetic
cttttaaagcagtggtggccttcaaaatagttttctggaatattgaattgagaatttgattcttactcaaacact

SEQ ID NO: 220196 - DNA, 75 bp, Artificial Sequence
  Synthetic
ttcagcctgttgcctccgctcaacccacttcttgagatctctttttgttgactccaaagaaaccaatctatcatt

SEQ ID NO: 220197 - DNA, 75 bp, Artificial Sequence
  Synthetic
cattgcctgctgaactttgtattcatagtcttgcttgttgagaaggtactttccttttcttgagaagacttcagt

SEQ ID NO: 220198 - DNA, 75 bp, Artificial Sequence
  Synthetic
ttccttttcttgagaagacttcagtgagctgcgatacggccagtgctgtgagcttgttgaagtcatagtttaata

SEQ ID NO: 220199 - DNA, 75 bp, Artificial Sequence
  Synthetic
aattagtgcatcaaaaattaatagaagtttcctccttgtgttcaatatcctcaaagattttactttatttaggaa

SEQ ID NO: 220200 - DNA, 75 bp, Artificial Sequence
  Synthetic
ggttgcgcaattcaggcttctttcacaatatggggcaaatagtgacattctttcaagaggtgcctcatgtgatag

SEQ ID NO: 220201 - DNA, 75 bp, Artificial Sequence
  Synthetic
agtttcctccttgtgttcaatatcctcaaagattttactttatttaggaatgacttccagcattgcacctgacat

SEQ ID NO: 220202 - DNA, 75 bp, Artificial Sequence
  Synthetic
ttgtggttttccatctgactcgagatccacagtagtattctcccaagctctacccacaatagaagttcttgaagc

SEQ ID NO: 220203 - DNA, 75 bp, Artificial Sequence
  Synthetic
ctttcactgcagctcctaagctgaagttgaaaccagaaatattcaaggagctcttcttagtgtccaccatattca

SEQ ID NO: 220204 - DNA, 75 bp, Artificial Sequence
  Synthetic
gcaatcacctcttcataatgattggagcgattgtccatcagaacatttaaactctccacccctgataatctacct

SEQ ID NO: 220205 - DNA, 75 bp, Artificial Sequence
  Synthetic
gacacttagggatttactggctggaagtatcacttagtaagtcaatggaaagcgcaatccaaaagcctaggatcc

SEQ ID NO: 220206 - DNA, 75 bp, Artificial Sequence
  Synthetic
ccggggatcctaggcaattcagctgaacttcagtggtaagactcattttagtgaatctctggatcaaggtgccta

SEQ ID NO: 220207 - DNA, 75 bp, Artificial Sequence
  Synthetic
tcctcaatgtacttctgctcaaagttagcaggagatgacctaacaaaacactccaacagtattagaacattgccc

SEQ ID NO: 220208 - DNA, 75 bp, Artificial Sequence
  Synthetic
gacaaggtctcgtgggagacacaaaaggaacaagagtcaattaaagacaattaaaatagatagccttaatgccta

SEQ ID NO: 220209 - DNA, 75 bp, Artificial Sequence
  Synthetic
atcctaggcaattcagctggacttcagtggtagggcttatcttagtgaatccctgaatcaaagtgcctagccaaa

SEQ ID NO: 220210 - DNA, 75 bp, Artificial Sequence
  Synthetic
tgtgtatattagacccaggtctgttagtgctaagacggcatcattcaaatcaacttgaccttgtttggtgagaca

SEQ ID NO: 220211 - DNA, 75 bp, Artificial Sequence
  Synthetic
gcgtcagcagcagatgcccgatctgcaagatgccccttcccaccaagctaaaggcagcaacacagccgagcgcac

SEQ ID NO: 220212 - DNA, 75 bp, Artificial Sequence
  Synthetic
gcatatgttcctgtggactctacaaacagcccggtgtgcctgtgagatggaaaagatgagacccttgtcagggcc

SEQ ID NO: 220213 - DNA, 75 bp, Artificial Sequence
  Synthetic
tggacctgacattctccagtagtttggttttcccctttttcattcctcttttcaatatttgcatacaaaaatctt

SEQ ID NO: 220214 - DNA, 75 bp, Artificial Sequence
  Synthetic
aaatgacttcacttccttagaagcactcatcttggtctggacacttagggactcactggttgaaagtttcactca

SEQ ID NO: 220215 - DNA, 75 bp, Artificial Sequence
  Synthetic
gctgtacttctgtggcaaggctcatcttagtgaatccctgaatcaaagtgcctggtcaaaatgggcaacagacag

SEQ ID NO: 220216 - DNA, 75 bp, Artificial Sequence
  Synthetic
cctggtcaaaatgggcaacagacaggccaaatcagcaacagtcgatgaatgtcaaagagctcatctagtaccaga

SEQ ID NO: 220217 - DNA, 75 bp, Artificial Sequence
  Synthetic
cagtaggtctctggcaccgaggatcctaggcattttgactgtcttataggattatcttatttaagatctagctgc

SEQ ID NO: 220218 - DNA, 75 bp, Artificial Sequence
  Synthetic
aatcataatcctgtttgttaagcaagaatttgcctttacgtgcaaacacttcagttaactgtgtgacagccaaag

SEQ ID NO: 220219 - DNA, 75 bp, Artificial Sequence
  Synthetic
gaatttgcctttacgtgcaaacacttcagttaactgtgtgacagccaaagctgtaagcttgttgaagtcataatc

SEQ ID NO: 220220 - DNA, 75 bp, Artificial Sequence
  Synthetic
ttcaagggagtctaacctcaattcctctgttaggcctgaagcaataagctggttcaagtttatctgagctggttc

SEQ ID NO: 220221 - DNA, 75 bp, Artificial Sequence
  Synthetic
tatgtcaaagtctatccatgcatagcccatcattagatcaaacttgaacataggtctctctatccctttgtaaat

SEQ ID NO: 220222 - DNA, 75 bp, Artificial Sequence
  Synthetic
taactttttccgcatctgcacaacattctttacttagaaactttcttgcattataaaccatttcagcaagctctt

SEQ ID NO: 220223 - DNA, 75 bp, Artificial Sequence
  Synthetic
ctgtgttaggtttgggtttgtgccagtatggcttgtaggtcagctggtggtgcctcacggaaattctcacagaaa

SEQ ID NO: 220224 - DNA, 75 bp, Artificial Sequence
  Synthetic
ttttcctatggtcaccaatctggcaggccttcccagacggtaaccctcacaactgaccatggaagaggacatagc

SEQ ID NO: 220225 - DNA, 75 bp, Artificial Sequence
  Synthetic
agttcactatagaatgaggtcccgtagagggcacagaagacacaagagtcaattaaaggcaattaaattagatag

SEQ ID NO: 220226 - DNA, 75 bp, Artificial Sequence
  Synthetic
agagggcacagaagacacaagagtcaattaaaggcaattaaattagatagccttaatgcctaggatcctcggtgc

SEQ ID NO: 220227 - DNA, 75 bp, Artificial Sequence
  Synthetic
aggtgccccatttgcaagatgcctctccccacaaaactgagaccatcagctgctccaacagcacccccagtcgga

SEQ ID NO: 220228 - DNA, 75 bp, Artificial Sequence
  Synthetic
cactggttcgttgtcaggtccgaccttggaaaagtcaaactcactaaactgcagcttgtctggattaataatcag

SEQ ID NO: 220229 - DNA, 75 bp, Artificial Sequence
  Synthetic
taggtgaccatttcatctttgtggaggctagatcactcatgaatggcagtatgtgcttctcaaataaagatggat

SEQ ID NO: 220230 - DNA, 75 bp, Artificial Sequence
  Synthetic
gtggagacaatgtccacccctgaccactgcacccttaaccccagcctgtctatcatcatatcactcaatgcccca

SEQ ID NO: 220231 - DNA, 75 bp, Artificial Sequence
  Synthetic
gaggtcccgtagggggcacagaagacacaagactcaattaaagacaattaaattagatagccttaatgcctagga

SEQ ID NO: 220232 - DNA, 75 bp, Artificial Sequence
  Synthetic
tcagacagagcctagaatgctcttgatggaggggctaaagcttctgtccctttgtatagaagttgactcatgcaa

SEQ ID NO: 220233 - DNA, 75 bp, Artificial Sequence
  Synthetic
ccacaagattgttgacagcctgattcagatctctgagacgtttcagatcactatcatctcttttttgtttgcgca

SEQ ID NO: 220234 - DNA, 75 bp, Artificial Sequence
  Synthetic
agaaaagtcaagaccatgaaggagagcctgagcatccttgacaacttgaagctttatgctggagcaataacctga

SEQ ID NO: 220235 - DNA, 75 bp, Artificial Sequence
  Synthetic
cgagagtgtgagtttctcagttcagaagccaatacaacataatgttcctccctcttccacttaacaatgtgtgaa

SEQ ID NO: 220236 - DNA, 75 bp, Artificial Sequence
  Synthetic
ctttggggtttactggttgaaagtatcactcagtaagtcaatgaaaagcgcaatccaatagcctaggatccactg

SEQ ID NO: 220237 - DNA, 75 bp, Artificial Sequence
  Synthetic
aggcatcagcacagccaagtgcaccctcaactgaggcggcccagaacacagcacctccaccgtatgccccatgat

SEQ ID NO: 220238 - DNA, 75 bp, Artificial Sequence
  Synthetic
atctctatgttttgtggtgccggacggatacaagttgactggcaatgttttgatcttgttggaatgttttgtaag

SEQ ID NO: 220239 - DNA, 75 bp, Artificial Sequence
  Synthetic
tctttcttccaccatgggttcatgtgtcctactgtgagacaacctcaattcagatgataacacaatgtaatgttc

SEQ ID NO: 220240 - DNA, 75 bp, Artificial Sequence
  Synthetic
cagattcccacagtgctcccctacatacaaccaatggcactggctcgttgtcaggtccgaccttggagaagtcaa

SEQ ID NO: 220241 - DNA, 75 bp, Artificial Sequence
  Synthetic
attcctcatgaagctcaccagtttttaatttattgaacaatatcctaagcattgacctcatctttttgcatgcat

SEQ ID NO: 220242 - DNA, 75 bp, Artificial Sequence
  Synthetic
tcaggtccgaccttggagaagtcaaactcactgaactgcagtttatctggattgataattagtttcatgggtata

SEQ ID NO: 220243 - DNA, 75 bp, Artificial Sequence
  Synthetic
aatgtcaattagtttgatgtcttttcttccttgtgattcaaggagtttccttatgtcatcagacccctggcaggt

SEQ ID NO: 220244 - DNA, 75 bp, Artificial Sequence
  Synthetic
cttccttgtgattcaaggagtttccttatgtcatcagacccctggcaggtgatgaccatattccgggggagtgca

SEQ ID NO: 220245 - DNA, 75 bp, Artificial Sequence
  Synthetic
tctgtcttgacagcttctcattgtctgcaaggtactttgagatgagatctttagcattggcaatgtcttcctcca

SEQ ID NO: 220246 - DNA, 75 bp, Artificial Sequence
  Synthetic
tgcaaggtactttgagatgagatctttagcattggcaatgtcttcctccatcgccaattgtggcacctgtgttgg

SEQ ID NO: 220247 - DNA, 75 bp, Artificial Sequence
  Synthetic
gctgtatcttgtaatcataatcctgtttattaagcaagaatttgcctttacgtgcaaacacttcagttaactgtg

SEQ ID NO: 220248 - DNA, 75 bp, Artificial Sequence
  Synthetic
cctcccttaaggcattagtagctcgagttaaaactttgttgatgatggtaaggagctcacaatttcgttcctttt

SEQ ID NO: 220249 - DNA, 75 bp, Artificial Sequence
  Synthetic
atttggatttgtgccaatatggcttgcgggtcagctggtgatgctccacaaaagctcccacagaaatgagagaca

SEQ ID NO: 220250 - DNA, 75 bp, Artificial Sequence
  Synthetic
gagtgttgacattaatctaataccacttatagacggcaggacatctttttataatgaacagctgccagattgggt

SEQ ID NO: 220251 - DNA, 75 bp, Artificial Sequence
  Synthetic
attgacactcacaaaacaggaacccagccaacccgcaaggagcctgtcaccatgtctcttgtagtccagccggct

SEQ ID NO: 220252 - DNA, 75 bp, Artificial Sequence
  Synthetic
catcattagatcaaacttaaacataggtctctctattcctttgtaaatggctttctcaatgaatgaagagaaggg

SEQ ID NO: 220253 - DNA, 75 bp, Artificial Sequence
  Synthetic
tgttgataggtaatctttaccttttaaatcagcttgtaaatcatcagaaagtaagattaggttttgaattattgt

SEQ ID NO: 220254 - DNA, 75 bp, Artificial Sequence
  Synthetic
ggttaacaatttaatagtgatcaattgttcagataactctgtgcactcttctatccagctgaccataacatcgac

SEQ ID NO: 220255 - DNA, 75 bp, Artificial Sequence
  Synthetic
agaatatagtaggctttgcgagtctttgtcgatgagttcagggagactttcaggaatagaaagtttgaacacctt

SEQ ID NO: 220256 - DNA, 75 bp, Artificial Sequence
  Synthetic
aacacttcagttaactgtgtgacagccaaagctgtgagcttgttgaaatcataatccaaaatacgggacccatct

SEQ ID NO: 220257 - DNA, 75 bp, Artificial Sequence
  Synthetic
ccaaagctgtgagcttgttgaaatcataatccaaaatacgggacccatctgtatacttattcacaacaacactct

SEQ ID NO: 220258 - DNA, 75 bp, Artificial Sequence
  Synthetic
cagggccagttgaattataagattgaggtgactcttgactgtaaaaacacaggttttttaacattgctgtagtac

SEQ ID NO: 220259 - DNA, 75 bp, Artificial Sequence
  Synthetic
agcacccccagccggagcagtggacagcatcagacctccaccctacagtccctgaacatcccaccgaccctcacc

SEQ ID NO: 220260 - DNA, 75 bp, Artificial Sequence
  Synthetic
atgcacgcaacaaaaagctgagactatcttccaaagtgataaaagcaaagcgcaatccaatagcctaggatccac

SEQ ID NO: 220261 - DNA, 75 bp, Artificial Sequence
  Synthetic
attgccagattattgtgttgaatgcacgcaacaaaaagctgagactatcttccaaagtgataaaagcaaagcgca

SEQ ID NO: 220262 - DNA, 75 bp, Artificial Sequence
  Synthetic
cgggggagccaaccatcaccaggagactactcaatgtcttcgatgcattcatccttcctagtcaactcctcacat

SEQ ID NO: 220263 - DNA, 75 bp, Artificial Sequence
  Synthetic
cagtatggcctgcaggtcagctggtggtgccccacagaaattctcacagaaatgagagacaatatgcctaggatc

SEQ ID NO: 220264 - DNA, 75 bp, Artificial Sequence
  Synthetic
ctccccacaaaactgagaccatcagctgctccaacagcacccccagtcggagcagcagacagcaccagaccccca

SEQ ID NO: 220265 - DNA, 75 bp, Artificial Sequence
  Synthetic
tcatgaagtgaagctacagattgaagaagaatatcaggttttcaggaacagattgaggggaggggagataaagtg

SEQ ID NO: 220266 - DNA, 75 bp, Artificial Sequence
  Synthetic
tctgaatttgattacacaggtcaactgggacaccgttagccacagattggtcaattatggtatcaattgtttctg

SEQ ID NO: 220267 - DNA, 75 bp, Artificial Sequence
  Synthetic
tcatgatcaaagtcctcaaccatgtgattggataattcacccttaatcaacctaatgtaaaacttatttgagaca

SEQ ID NO: 220268 - DNA, 75 bp, Artificial Sequence
  Synthetic
agagctggtttctatgccaacctccctcaaagcattagtagctcgagttaaaactctgttgatgatggcaaggag

SEQ ID NO: 220269 - DNA, 75 bp, Artificial Sequence
  Synthetic
tgaagatgacattgagcaattgatttatcaatttaaaagagcgtcgcctatactgaggtttttatattcagacat

SEQ ID NO: 220270 - DNA, 75 bp, Artificial Sequence
  Synthetic
tcttcggaactggaatgttaactgttcaatgttgtcatcacaggtgtctattttatcgcaatataactttctgaa

SEQ ID NO: 220271 - DNA, 75 bp, Artificial Sequence
  Synthetic
cggggatcctaggcaatttggttgttcttctttctgaagccttttgcgctgaactcctccaaatgggaaacaagc

SEQ ID NO: 220272 - DNA, 75 bp, Artificial Sequence
  Synthetic
ggagacaatgtccacccccgaccactgcatcctcaaccccagcctgtctatcatcatatcactcaatgccccaat

SEQ ID NO: 220273 - DNA, 75 bp, Artificial Sequence
  Synthetic
tgcatcctcaaccccagcctgtctatcatcatatcactcaatgccccaatcagcaggtcagatgaagtgtcccca

SEQ ID NO: 220274 - DNA, 75 bp, Artificial Sequence
  Synthetic
ccagtatggcttgtaggtcggttgttgatgccccacagaagctcctgcagaaatgagagacaatatgcctaggat

SEQ ID NO: 220275 - DNA, 75 bp, Artificial Sequence
  Synthetic
aaggaccccaatgttcttgtagttgcaacaaatggtctcacataagactcaaaataaatttgcctcatgaaattg

SEQ ID NO: 220276 - DNA, 75 bp, Artificial Sequence
  Synthetic
ttactctcacgttcacttatcctgacatcatcagccaatcttcctgtatcaaatttgaagttcagacacttactc

SEQ ID NO: 220277 - DNA, 75 bp, Artificial Sequence
  Synthetic
caatttcaacaggggtcacatgccccagttgatttgtgtcaattaaaaactcattaataatctcagtatcaacat

SEQ ID NO: 220278 - DNA, 75 bp, Artificial Sequence
  Synthetic
aatatcaattagtttgatgtcttttcttccttgtgattcaaggagtttccttatgtcatcggacccctgacaggt

SEQ ID NO: 220279 - DNA, 75 bp, Artificial Sequence
  Synthetic
ttttaacaaggtgaataaggtgtccctgagtttgtcattcacccaatcaggtatctgttcattgtaaaatgttgt

SEQ ID NO: 220280 - DNA, 75 bp, Artificial Sequence
  Synthetic
catgtcttcctgagttttctggtaacttatagtgggtgtgatgccggagatctcaatgtccatgatggcatcata

SEQ ID NO: 220281 - DNA, 75 bp, Artificial Sequence
  Synthetic
tcttggtccaaaaaggtcctagtcaccactgcctttgtcagttcactaataggacatgagtttaatggtcctaca

SEQ ID NO: 220282 - DNA, 75 bp, Artificial Sequence
  Synthetic
ggctcgagttaaaactctgttgatgatggcaaggagctcacaatttcgttcttctttaagtgataggacacctac

SEQ ID NO: 220283 - DNA, 75 bp, Artificial Sequence
  Synthetic
caaagtcaaatctttaagaattctaaacacaaggagaaaacttctactaatttttgacacactgatcctccttgc

SEQ ID NO: 220284 - DNA, 75 bp, Artificial Sequence
  Synthetic
acaaagcataaagctggggtgagaatcccatgatcactcagaatggattcaaccgttttgtcttcagtgttatgt

SEQ ID NO: 220285 - DNA, 75 bp, Artificial Sequence
  Synthetic
atccaagcataacccatcattagatcatgcttaaacattggcctttcaacacctttgtaaataactttctctaca

SEQ ID NO: 220286 - DNA, 75 bp, Artificial Sequence
  Synthetic
acctcagttggtcgaagtattctgatgctcctccatccaatagtatctcatccagatcagcattgttggcatcac

SEQ ID NO: 220287 - DNA, 75 bp, Artificial Sequence
  Synthetic
tccagatcagcattgttggcatcaccattccttcctttggtccccagaacaagattactcattgcttgttgtatc

SEQ ID NO: 220288 - DNA, 75 bp, Artificial Sequence
  Synthetic
tccattgtctgaggtgacaccttgattgtctccaacatgttgccaccatccagcatgcaggctcctgccttcaca

SEQ ID NO: 220289 - DNA, 75 bp, Artificial Sequence
  Synthetic
ttgtaatcataatcctgtttattaagcaaaaatttgcctttacgtgcaaacacttcagtcaactgtgtgacagcc

SEQ ID NO: 220290 - DNA, 75 bp, Artificial Sequence
  Synthetic
tcattaagccatggggcaaatcataacatttttccaggaagtgcctcatgtcattgaggaggtgatgaacattgt

SEQ ID NO: 220291 - DNA, 75 bp, Artificial Sequence
  Synthetic
acagctcacaaagatttcttagtgaagaaaggtgctcactagacaaatagtttgttgtgaactcttcatggagtt

SEQ ID NO: 220292 - DNA, 75 bp, Artificial Sequence
  Synthetic
tctagatttaaactctgcaacaaacctaccaatgacactcttagggctcacaaacttattgagttgatcactcat

SEQ ID NO: 220293 - DNA, 75 bp, Artificial Sequence
  Synthetic
attagtttccttggagtcaaccaaaagagatctcaagaaatggattgagcggaggcaacagattgagaattctaa

SEQ ID NO: 220294 - DNA, 75 bp, Artificial Sequence
  Synthetic
ttaacaaacacaagtatcatcaaccacaagttctgcaacctttctgatgcacataaaaagaatctctatgaccat

SEQ ID NO: 220295 - DNA, 75 bp, Artificial Sequence
  Synthetic
aaagttctgtgagagattgatcaaagagagaaatttgatcatcactagaggtataagcatctatcgtaccaccac

SEQ ID NO: 220296 - DNA, 75 bp, Artificial Sequence
  Synthetic
ttcaatgggggaaagataagtgttcagtacaacctcagccatgcttatgctgtggatgcagctaaccattgtggg

SEQ ID NO: 220297 - DNA, 75 bp, Artificial Sequence
  Synthetic
atcaccagattgttgtgttgagtgcacgtaacaaaaaactgagactgtttgccaaaatgacaagagcaaagcgca

SEQ ID NO: 220298 - DNA, 75 bp, Artificial Sequence
  Synthetic
cgcaccggggatcctaggcaatttggttgttcttctcttttgaggccttgtgcgctgaactcctccaaatgggaa

SEQ ID NO: 220299 - DNA, 75 bp, Artificial Sequence
  Synthetic
tagctctgtgcactcttctatccagctgaccataacatcgaccactttctgcaacacatcactggagaaaactga

SEQ ID NO: 220300 - DNA, 75 bp, Artificial Sequence
  Synthetic
gttatctggggctactgtcacaaagaaccagggacatttacatcagccgaagactccttggaacttttacctgga

SEQ ID NO: 220301 - DNA, 75 bp, Artificial Sequence
  Synthetic
agcaatgtcttcctccatcgccaactgtggcacctgtgttggttttgggtttgtgtcaatatgacttgtaggtca

SEQ ID NO: 220302 - DNA, 75 bp, Artificial Sequence
  Synthetic
cgaaaacaagggcctggttgagtgtaacaaccactatctgtgtctcaactgcctcaccttacttctaagtgtcag

SEQ ID NO: 220303 - DNA, 75 bp, Artificial Sequence
  Synthetic
atcctaggcatttttggttgcgcaattcaagtgtcctatttaaaatgggacaaatagtgacattcttccaggaag

SEQ ID NO: 220304 - DNA, 75 bp, Artificial Sequence
  Synthetic
cggtcgctccaacagcacctccaaccagagcagcagacagcaccagacccccaccctacagtccctgaacgaccc

SEQ ID NO: 220305 - DNA, 75 bp, Artificial Sequence
  Synthetic
cccgccgggggcccccccggggggggttgaccatcacaaagagactactcaatgtcttcaatgcactcatccttc

SEQ ID NO: 220306 - DNA, 75 bp, Artificial Sequence
  Synthetic
gttgaccatcacaaagagactactcaatgtcttcaatgcactcatccttcctggttagctcctcacatgttctgc

SEQ ID NO: 220307 - DNA, 75 bp, Artificial Sequence
  Synthetic
gatgatagtctttctaagtctgttgcatctagaatatcaataacgccaagagtataagggaacatgtcttcctga

SEQ ID NO: 220308 - DNA, 75 bp, Artificial Sequence
  Synthetic
tacaactgcattagaagatgttgggataaacattaatcagtttggtatagatatgagtgttgttggccttgattg

SEQ ID NO: 220309 - DNA, 75 bp, Artificial Sequence
  Synthetic
gcagacaacatgataacagaattgttacagaaagagtacattgacaggcaagggaaaacacccttagggttggtg

SEQ ID NO: 220310 - DNA, 75 bp, Artificial Sequence
  Synthetic
ataaccatattccgggggagcgcctcaataacagcactggtcagacctggttgtgcagcaaacagatctgcgatg

SEQ ID NO: 220311 - DNA, 75 bp, Artificial Sequence
  Synthetic
tctcttgcacaaagaacaacagtcatcattacataatggtgggcaatgagacaggactggaactgaccttgacca

SEQ ID NO: 220312 - DNA, 75 bp, Artificial Sequence
  Synthetic
acccttgatcaacctaatgtaaaacttatttgagacaatctcatctaaatcatttattgatggttggccatcacc

SEQ ID NO: 220313 - DNA, 75 bp, Artificial Sequence
  Synthetic
gaagcaatgagctgtgattttaatgggggaaagattagtgtacagtacaacctgagtcacagctatgctgtggat

SEQ ID NO: 220314 - DNA, 75 bp, Artificial Sequence
  Synthetic
gcagccaaccattgtggcacagttgcaaatggtgtcttacagactttcatgaggatggcctggggtgggagctac

SEQ ID NO: 220315 - DNA, 75 bp, Artificial Sequence
  Synthetic
tttcccatataccatgggggtaattgatctgttgaaaaccactgacttggagaggttgtcttcattaagcctcgc

SEQ ID NO: 220316 - DNA, 75 bp, Artificial Sequence
  Synthetic
aaacctgatgcgatcaattgattttgattgaatctagctggctcaatatcaaagtctatccaagcataacccatc

SEQ ID NO: 220317 - DNA, 75 bp, Artificial Sequence
  Synthetic
atttttccaggaagtacctcatgtcatagaggaagtgatgaacattgtcctgattgctctcagccttctggcaat

SEQ ID NO: 220318 - DNA, 75 bp, Artificial Sequence
  Synthetic
acaacacttttgttgctggctaaatccaaggctgtagcacagccactggtgatgagaggatccttgatttccctt

SEQ ID NO: 220319 - DNA, 75 bp, Artificial Sequence
  Synthetic
agattctgaaggcaaggacacaccaggggggtattgtctgacaaggtggatgctaattgaagctgaactgaaatg

SEQ ID NO: 220320 - DNA, 75 bp, Artificial Sequence
  Synthetic
cctttctcctcttatgtggaagatcatgctcaacaacttataagggtgtttatgagctacaaactctagagctgg

SEQ ID NO: 220321 - DNA, 75 bp, Artificial Sequence
  Synthetic
cacccagagataggctgatagagagcaacttccaccgggtcctctggcctcccttctatgtccatccacgtcttg

SEQ ID NO: 220322 - DNA, 75 bp, Artificial Sequence
  Synthetic
attgaacaacaagctgacaatatgatcactgagatgttacagaaggagtatatggagaggcaggggaagacacca

SEQ ID NO: 220323 - DNA, 75 bp, Artificial Sequence
  Synthetic
cttctaaatacttctgttcaaaattggcgggggatgatctgacaaagcactcaagtaagattagaacattaccag

SEQ ID NO: 220324 - DNA, 75 bp, Artificial Sequence
  Synthetic
tcaagtaagattagaacattaccagtgagtttgtagccgtcaggtaccacaaagcataaagctggagtgagaatc

SEQ ID NO: 220325 - DNA, 75 bp, Artificial Sequence
  Synthetic
tgttggacccagcagtgcccaccttttgtggttttccatctgactcgagatccacagtggtgttctcccaagctc

SEQ ID NO: 220326 - DNA, 75 bp, Artificial Sequence
  Synthetic
atgaccaaatctcacctttggttccagaaacttctcaaaacattttatctgatctgtcaatctatctggtgtttc

SEQ ID NO: 220327 - DNA, 75 bp, Artificial Sequence
  Synthetic
aatgttggcttgtatcgaatggttcatacttaaacgagacccacttttctgatgatattgaacaacaagctgaca

SEQ ID NO: 220328 - DNA, 75 bp, Artificial Sequence
  Synthetic
ttcttaaagaatgaatgatgtgattcaaaccaaccctatcctccaatagttttgatgcagttggcttcaagggaa

SEQ ID NO: 220329 - DNA, 75 bp, Artificial Sequence
  Synthetic
caaaccaaccctatcctccaatagttttgatgcagttggcttcaagggaaaatagtcacaagggttgtgcttgaa

SEQ ID NO: 220330 - DNA, 75 bp, Artificial Sequence
  Synthetic
ttgggcttgggcttgtacctgtatggtgtgtgggtcagctggcagtgccccacaaaagctcttacagaaatgaga

SEQ ID NO: 220331 - DNA, 75 bp, Artificial Sequence
  Synthetic
ggttcccctaagacccatgcacccagttctattgcagttgataaggagatgcacatataatcccataacaagggt

SEQ ID NO: 220332 - DNA, 75 bp, Artificial Sequence
  Synthetic
ctttgcatctgaccacttgataccttgcgggtccaaactcattctgtctcaactttacagtagaagaagttttca

SEQ ID NO: 220333 - DNA, 75 bp, Artificial Sequence
  Synthetic
gattgctcattgcctgctgcactttgtattcatagtcctgcttgttgagaaggtactttccttttcttgagaaga

SEQ ID NO: 220334 - DNA, 75 bp, Artificial Sequence
  Synthetic
gcagattggagagatttgttggagttaccactgccaattttctgtggtttcccatctgtttcaaggtccactaca

SEQ ID NO: 220335 - DNA, 75 bp, Artificial Sequence
  Synthetic
acactgtaacagggaagacatcgttgccaaggtgctggcttgtgtcaaatggttcctacctgaatgagacacatt

SEQ ID NO: 220336 - DNA, 75 bp, Artificial Sequence
  Synthetic
tgtgggaccattgccaatggcgttcttcagacttttatgaggatggcttggggtggcagttacatagcacttgat

SEQ ID NO: 220337 - DNA, 75 bp, Artificial Sequence
  Synthetic
atactttgctgtgtagatcaaacccaaatctgtcaatgcttgtactgcatcattcaagtcaacctgcccctgttt

SEQ ID NO: 220338 - DNA, 75 bp, Artificial Sequence
  Synthetic
catctatcgtaccaccacatatacaactgatagcataattaatgaacctctctgaaataagggcataaaaatctg

SEQ ID NO: 220339 - DNA, 75 bp, Artificial Sequence
  Synthetic
tctatctctcctttcctcaatctgttcctaaacacttgatactcctcttcgatctgcagctttacttcatgagct

SEQ ID NO: 220340 - DNA, 75 bp, Artificial Sequence
  Synthetic
tgctatactctgactcttcaaaaagtgaattgctctcctgtgcatactttaaaagtgagaagagcgtatccctca

SEQ ID NO: 220341 - DNA, 75 bp, Artificial Sequence
  Synthetic
cttcggagaagtcaagtccatgtaaaagagcctgggcatctttcaccacctgtagtttgatgttggagcagtaac

SEQ ID NO: 220342 - DNA, 75 bp, Artificial Sequence
  Synthetic
aagagcctgggcatctttcaccacctgtagtttgatgttggagcagtaaccagataattccctcctcaaagattg

SEQ ID NO: 220343 - DNA, 75 bp, Artificial Sequence
  Synthetic
ctggacgaccttcaatgtctatccaggttttggcacttgggtcaagctgcatcattgagtctttaagtgtcatca

SEQ ID NO: 220344 - DNA, 75 bp, Artificial Sequence
  Synthetic
caagtttctatcttattagcatcttccttcacctagtcaaataccaactcataggcatattgtaggcaagccgtg

SEQ ID NO: 220345 - DNA, 75 bp, Artificial Sequence
  Synthetic
gctgtgagctcaagttgcccatatagacacctgcactcaatggcctttctgtcctggtcacttttgatttcaact

SEQ ID NO: 220346 - DNA, 75 bp, Artificial Sequence
  Synthetic
cacctccatatcaatcttatagtggtccacactgatcccaacatcctttaaagcagtggtggctttcaaaatggt

SEQ ID NO: 220347 - DNA, 75 bp, Artificial Sequence
  Synthetic
cattgcccgtcagtttgtaaccatccggtaccacaaagcatagtgaaggtgtcaagattccatgatcatggagaa

SEQ ID NO: 220348 - DNA, 75 bp, Artificial Sequence
  Synthetic
cttctcattgttcaggcaactccctgacaactgtagacttatagcttcaaagtaatcttctatgagtctagtaaa

SEQ ID NO: 220349 - DNA, 75 bp, Artificial Sequence
  Synthetic
gccgacagcaccaccagaaatcccaccatcccaaaatcccccaccctacagcccctgaggcagaactccgccccg

SEQ ID NO: 220350 - DNA, 75 bp, Artificial Sequence
  Synthetic
gcatgcatcgtcccacaacccctataatatcaagttgtagccagtgtagtccttggtccattctggatctcagca

SEQ ID NO: 220351 - DNA, 75 bp, Artificial Sequence
  Synthetic
gcagtaaccagatagttccctcctcaaggattgtgtccacagaaaggactttatttcctttgaggcactcattgc

SEQ ID NO: 220352 - DNA, 75 bp, Artificial Sequence
  Synthetic
caaattgctgtgttggatacaagcagcaaaaagctgagactatctcccaaaatgacaaaagcaaagcgcaatcca

SEQ ID NO: 220353 - DNA, 75 bp, Artificial Sequence
  Synthetic
tcttttttgaggccttgtgtgctgaactcctccaaatgggaaataagcaagccaaaaccccagaaacaaaagaca

SEQ ID NO: 220354 - DNA, 75 bp, Artificial Sequence
  Synthetic
ctgttgtgtggcaggtcttgcacaaccagtgtttataaaggggtctatgagcttcagactctggagttaaacatg

SEQ ID NO: 220355 - DNA, 75 bp, Artificial Sequence
  Synthetic
tgacactgcctttgtcaactctccaataggacactgtgacatatgtccacagtaaaaatacttttccttcaatct

SEQ ID NO: 220356 - DNA, 75 bp, Artificial Sequence
  Synthetic
gagtaattcactttttgaagagtcagagtatagcagactctgtgaatctttattcatgacttcgggtagattatc

SEQ ID NO: 220357 - DNA, 75 bp, Artificial Sequence
  Synthetic
tcaaggtcccaactctcaagatactcttttgttgtgtcgatttgagttctacaagattgttgacagcctgattca

SEQ ID NO: 220358 - DNA, 75 bp, Artificial Sequence
  Synthetic
cctccacctccaccctccccccgacaccccccggggggaccccccgccgggggcccccccgggggagccaaccat

SEQ ID NO: 220359 - DNA, 75 bp, Artificial Sequence
  Synthetic
ctccgaaaactattcaatgtcctcgatgtattcatccttcccagtcaactcctcacatgttctgcccttcagtct

SEQ ID NO: 220360 - DNA, 75 bp, Artificial Sequence
  Synthetic
taggcacattcacatggacactgtcagattctgaaggcaaggacacaccagggggatattgtctgaccagatgga

SEQ ID NO: 220361 - DNA, 75 bp, Artificial Sequence
  Synthetic
cgaaacagtgggtctcaaggggaagtaatcacaaggattatgtttaaaaaagtccaagatctgagcttgttttgg

SEQ ID NO: 220362 - DNA, 75 bp, Artificial Sequence
  Synthetic
tgtagcacaaccactggtgatgagaggatctttaatttccctttttacctccctctccttaaatagtgaaccatt

SEQ ID NO: 220363 - DNA, 75 bp, Artificial Sequence
  Synthetic
tgtaatgagaagcatgatgaggaattttgtgacatgttgaggctgtttgacttcaacaaacaagccattcaaagg

SEQ ID NO: 220364 - DNA, 75 bp, Artificial Sequence
  Synthetic
atgctgatgtgcccttaaaagtgggtcctgacaagaccaacctccagcagtctgacaaaacacacggactcactg

SEQ ID NO: 220365 - DNA, 75 bp, Artificial Sequence
  Synthetic
cagacaaaggttcaatgcctagaagtttaaacaaattctgtaatgatgttgtgtgttcacctgataggtagttgg

SEQ ID NO: 220366 - DNA, 75 bp, Artificial Sequence
  Synthetic
gacacttagggattgactggtcgaaagtttcactcagtaagtcaataaaaggcgcaatccagtagcctaggatcc

SEQ ID NO: 220367 - DNA, 75 bp, Artificial Sequence
  Synthetic
ccggggatcctaggcaattcagctggacttcagtggtgaggcttattttagtgaactcctgaaccaaagcgccca

SEQ ID NO: 220368 - DNA, 75 bp, Artificial Sequence
  Synthetic
ggcggtgggtcacgggggcgtccatttacaggacgaccttggggcttgaagttctgaacaccatgtctctgggga

SEQ ID NO: 220369 - DNA, 75 bp, Artificial Sequence
  Synthetic
ggcaacccagctctactcaatgtcctcgacgcacctctctggcccaaacaactccgaacatgtccttcccttcag

SEQ ID NO: 220370 - DNA, 75 bp, Artificial Sequence
  Synthetic
ggcaaccctgctctactcaatgtcctcgacgcacctctctggcccaaacaactccgaacatgtccttcccttcag

SEQ ID NO: 220371 - DNA, 75 bp, Artificial Sequence
  Synthetic
ggcaaccccgctctactcaatgtcctcgacgcacctctctggcccaaacaactccgaacatgtccttcccttcag

SEQ ID NO: 220372 - DNA, 75 bp, Artificial Sequence
  Synthetic
ggcaacccggctctactcaatgtcctcgacgcacctctctggcccaaacaactccgaacatgtccttcccttcag

SEQ ID NO: 220373 - DNA, 75 bp, Artificial Sequence
  Synthetic
aggctaaaggcagcgacacagccgagcgcaccatcaactgaggcgacccagaccacaacacctccaccatacacc

SEQ ID NO: 220374 - DNA, 75 bp, Artificial Sequence
  Synthetic
cccatcacataagggaatgtttcttcctctgttctctgataactaattgtagggacaactccagagacatcaaaa

SEQ ID NO: 220375 - DNA, 75 bp, Artificial Sequence
  Synthetic
aagctctacccacaatagaagtccttgaagctatgtagggccagccgtcaccggaaagacagatcttgtaaagta

SEQ ID NO: 220376 - DNA, 75 bp, Artificial Sequence
  Synthetic
taacacttaagaagcaagatcctaaccacccttttagacacttttgtttcattaggtcatacttacttgcaagga

SEQ ID NO: 220377 - DNA, 75 bp, Artificial Sequence
  Synthetic
agcttttctaaatcagccgccagagtcagtaaatcgtccgaacttagggtcccaactctcagcacacttttctgt

SEQ ID NO: 220378 - DNA, 75 bp, Artificial Sequence
  Synthetic
caatattgaatgccattagaatttgtcaacaatttgattcccttgacatcagaaattagggattgaatggattta

SEQ ID NO: 220379 - DNA, 75 bp, Artificial Sequence
  Synthetic
ctgaccacttgataccttgctggtccgaactcattctgtctcagctttacagtggaagaggttttcatagagttt

SEQ ID NO: 220380 - DNA, 75 bp, Artificial Sequence
  Synthetic
tgggtataacatcccccaactgctgtgtatcctttaagaattcatttaccacatctgattcaacaaaccaggctg

SEQ ID NO: 220381 - DNA, 75 bp, Artificial Sequence
  Synthetic
acatctgattcaacaaaccaggctgacctacctttgaaagttggacccgacaaagcaagtctccaacagtcagac

SEQ ID NO: 220382 - DNA, 75 bp, Artificial Sequence
  Synthetic
agtcctgtcatgttgagatggatagaaaaagtctctttaaaactagcatcctgactcttgattttatacctaatt

SEQ ID NO: 220383 - DNA, 75 bp, Artificial Sequence
  Synthetic
acatgggcatatgctcatgtggtctgtacaaacatcctggtgtgccagtcaagtggaaaagatagaagacagacc

SEQ ID NO: 220384 - DNA, 75 bp, Artificial Sequence
  Synthetic
ctggcattgtgcttaacaaatcaaagaaatcttcaagggagtctaacctcaattcctctgtcaggcctgaagcaa

SEQ ID NO: 220385 - DNA, 75 bp, Artificial Sequence
  Synthetic
gcactaggaatcaacccctctatttgcctcataatcctgtaactacggttgccatccacccagtctctgacatct

SEQ ID NO: 220386 - DNA, 75 bp, Artificial Sequence
  Synthetic
actaccactcatccctatcatgctcagaagagctcgtctctggtcaagttgctgtgagctcaggttacccatgta

SEQ ID NO: 220387 - DNA, 75 bp, Artificial Sequence
  Synthetic
tgagagtatcttcccattagcttattcccattcatcactaataagattgacttaaagcactggaaatattcctgg

SEQ ID NO: 220388 - DNA, 75 bp, Artificial Sequence
  Synthetic
ggaaacatttcttcctccgatctctggtaactaattgtagggacaactccagaaacatcaaaatccataatcaag

SEQ ID NO: 220389 - DNA, 75 bp, Artificial Sequence
  Synthetic
cggggatcctaggcaattcagctggacttcagtggtaaagctcatttcagtgaattcctgaatcaaagtgcctag

SEQ ID NO: 220390 - DNA, 75 bp, Artificial Sequence
  Synthetic
aagcactcatcttggtctggacactcagggattcactggttgaaagtatcactcagtgagtcaatgaaaagcgca

SEQ ID NO: 220391 - DNA, 75 bp, Artificial Sequence
  Synthetic
tttcaacccttccattaatagcatcctaggctctgtctgtacaagaaatgctaacttctgtcttgataatctctc

SEQ ID NO: 220392 - DNA, 75 bp, Artificial Sequence
  Synthetic
ttgtcaagatcagatattgagggtgcattgcagtctgcctgctgctgtctttctggttgctccctatactgactg

SEQ ID NO: 220393 - DNA, 75 bp, Artificial Sequence
  Synthetic
cgcaccatcaaccgaggcaacccaaaacacaacacccccaccgtacaccccataatcccggggtcaacactccca

SEQ ID NO: 220394 - DNA, 75 bp, Artificial Sequence
  Synthetic
cagattgttgtgctggatgcgcgcaacaaaaagctgaggctatctgctaaaatgataaaagcaaagcgcaatcca

SEQ ID NO: 220395 - DNA, 75 bp, Artificial Sequence
  Synthetic
atgggaaacaagcaagccaaagcctcagaagaaaaaaacagtccgagagccagcctgattccagatgccacacac

SEQ ID NO: 220396 - DNA, 75 bp, Artificial Sequence
  Synthetic
ggataggatctcgtaggaggcacagaagacacaagaggaaattaaagacaatttaattagatagccttaatgcct

SEQ ID NO: 220397 - DNA, 75 bp, Artificial Sequence
  Synthetic
tgtagagtatgttttcataaggattcctttcaccaggggtgtctgaaatgaacatcccaagagccttcttgacct

SEQ ID NO: 220398 - DNA, 75 bp, Artificial Sequence
  Synthetic
gtggttgcctttaaaacggttttctggaatattgagttaagaatctgatttttactcaaacattggggagactgt

SEQ ID NO: 220399 - DNA, 75 bp, Artificial Sequence
  Synthetic
aacatcccaagagccttcttgacctttaaaatggatttgaggataccatccattgtctgaggtgacaccttgatt

SEQ ID NO: 220400 - DNA, 75 bp, Artificial Sequence
  Synthetic
ggcttagggcttcaaagtaatcttctataagtctagtaaacatctttgtcctaagatcaccgatatataactctc

SEQ ID NO: 220401 - DNA, 75 bp, Artificial Sequence
  Synthetic
agacactcaatatgaccatgcctctctcttgcacaaagaacaatagtcatcattacataatggtgggcaatgaga

SEQ ID NO: 220402 - DNA, 75 bp, Artificial Sequence
  Synthetic
atgaaccatttcagcaagctcttcctccgatgcatcatcctttgggttcacactcacatgtccaaattctaattt

SEQ ID NO: 220403 - DNA, 75 bp, Artificial Sequence
  Synthetic
gtgtcaggtcccacagagtcataagattgtggcgactcttggctgtaaaagcataagttctttaacattgcagtg

SEQ ID NO: 220404 - DNA, 75 bp, Artificial Sequence
  Synthetic
aagcactcattctgatctagacactcagggacttgctggttgaaggtatcactcagtaagtcagtgaaatgcgca

SEQ ID NO: 220405 - DNA, 75 bp, Artificial Sequence
  Synthetic
tgaatccctgaatcaaagtgcctagtcaaaatgggcaacaaacaggccaaatcgacaaaagtcgatgaacatcaa

SEQ ID NO: 220406 - DNA, 75 bp, Artificial Sequence
  Synthetic
cctgggaggaccactgccaattctcaagaccctctcccatcggttatctcggtctcctttcacaaaggaccagag

SEQ ID NO: 220407 - DNA, 75 bp, Artificial Sequence
  Synthetic
ctcacaagatctttgctctcggacagcaactcctccatcaccaacacacttgttcctcagaagagagagtcaaat

SEQ ID NO: 220408 - DNA, 75 bp, Artificial Sequence
  Synthetic
gggcatcaataataaattaacagctcatgaggtaaagctgcagatcgaagaggagtatcaagtgtttaggaacag

SEQ ID NO: 220409 - DNA, 75 bp, Artificial Sequence
  Synthetic
tgtgtctcaactgtctcagcctgcttctcagcgtcagcagcaggtgtccgatctgcaaaatgccccttcccacca

SEQ ID NO: 220410 - DNA, 75 bp, Artificial Sequence
  Synthetic
tataaaacttatttgagacaatctcatctagatcatttattgatggctggccatcaccattagggcctgagccta

SEQ ID NO: 220411 - DNA, 75 bp, Artificial Sequence
  Synthetic
gcaatgagaaacatgatgaggaattttgtgatatgctgaggctgtttgacttcaacaaacaagccattcaaaggt

SEQ ID NO: 220412 - DNA, 75 bp, Artificial Sequence
  Synthetic
tccttagaagcactcatttcggtctggacacctgggggcttactggttgaaagttttactcagtaagtcaatgaa

SEQ ID NO: 220413 - DNA, 75 bp, Artificial Sequence
  Synthetic
accagtctatcattaacacttatgaaacaggatcccaaccacccttttaagctcctttgtttcatttggtcatgc

SEQ ID NO: 220414 - DNA, 75 bp, Artificial Sequence
  Synthetic
cggcccaaacaactctgaacatgttcttcccttcagtctcaggctgcccccacttgactgaatcataactctttg

SEQ ID NO: 220415 - DNA, 75 bp, Artificial Sequence
  Synthetic
atttagttggactttagtggtgaggcttatcctagtgaatccctgaatcaaagtgcccagtcaaaatgggcaaca

SEQ ID NO: 220416 - DNA, 75 bp, Artificial Sequence
  Synthetic
taactctgttaagttctgatcaaataatgatatctgatcgtcactggacgtgtaagcatcgatttgtcctccaga

SEQ ID NO: 220417 - DNA, 75 bp, Artificial Sequence
  Synthetic
cagtgagctgtgacacggctagtgctgtgagcttattgaaatcatagtttaatattctagaaccatctgtgtatt

SEQ ID NO: 220418 - DNA, 75 bp, Artificial Sequence
  Synthetic
tgggtgaccacttcattttggttgacgctagatcgctcatgaatggtaatatgtgtttctcaaacactgatgggt

SEQ ID NO: 220419 - DNA, 75 bp, Artificial Sequence
  Synthetic
ttcctgctgtctatccaccgttttaaatccctttttgttgattccaatgaaactaatctatcgttaacactcaca

SEQ ID NO: 220420 - DNA, 75 bp, Artificial Sequence
  Synthetic
aatccctttttgttgattccaatgaaactaatctatcgttaacactcacaaaacaggagcccagccaaccagcaa

SEQ ID NO: 220421 - DNA, 75 bp, Artificial Sequence
  Synthetic
cttggactctctctgattctgaaggcaatgaaacaccgggtgggtattgtttaacaagatggatgctgattgagg

SEQ ID NO: 220422 - DNA, 75 bp, Artificial Sequence
  Synthetic
ctttatctgatctgtcaacctatctggtgtttcttttgtaatgaagtggcacatgtaggagatgttcaagatgaa

SEQ ID NO: 220423 - DNA, 75 bp, Artificial Sequence
  Synthetic
actttgtttagaaatgacctccaacattgcacttgacattctccagctgcttgatcaccccctctgccatttcct

SEQ ID NO: 220424 - DNA, 75 bp, Artificial Sequence
  Synthetic
ttcctctgtcaggcctgaagcaataagctggttcaaatttatctgggctggttctatgtcaaagtctatccatgc

SEQ ID NO: 220425 - DNA, 75 bp, Artificial Sequence
  Synthetic
cctgtatcaaatttaaagttcagacacttgctcttataatgagagtatcttcccatcagcttattcccattcatc

SEQ ID NO: 220426 - DNA, 75 bp, Artificial Sequence
  Synthetic
catagtactcactgttgtttgtaaaacctcagctgaaaatattgctgggaaatatcttttaggatcagcataaaa

SEQ ID NO: 220427 - DNA, 75 bp, Artificial Sequence
  Synthetic
tcatttaccacatctgattcaataaaccaggctgacctacctttgaaagttggacctgacaaagcaagtctccaa

SEQ ID NO: 220428 - DNA, 75 bp, Artificial Sequence
  Synthetic
gatggatggaaaaagtctctttaaaactagcatcctgactcttgattttatacctaattgtctggtaaaactgaa

SEQ ID NO: 220429 - DNA, 75 bp, Artificial Sequence
  Synthetic
tacctaattgtctggtaaaactgaacagagtccactggcattgtacttaacaaatcaaagaaatcttcaagggag

SEQ ID NO: 220430 - DNA, 75 bp, Artificial Sequence
  Synthetic
ttgatttgaactctgcaacaaacctgccaattgcactctttggactcacaaacttatttagctgatcactcatgt

SEQ ID NO: 220431 - DNA, 75 bp, Artificial Sequence
  Synthetic
ggtgtcaccactccctcctttggaccccagaacaagattactcattgcttgctgtatcttgtaatcataatcctg

SEQ ID NO: 220432 - DNA, 75 bp, Artificial Sequence
  Synthetic
cccagaacaagattactcattgcttgctgtatcttgtaatcataatcctgtttattaagcaagaatttgccttta

SEQ ID NO: 220433 - DNA, 75 bp, Artificial Sequence
  Synthetic
gtgtgtttctagatctttcagcctgttgcctccgctcaacccatttctcaagatccctttttgttgactccaaag

SEQ ID NO: 220434 - DNA, 75 bp, Artificial Sequence
  Synthetic
agatccctttttgttgactccaaagaaactaatctatcattgacacttatgaagcaggaccctaaccaccctctt

SEQ ID NO: 220435 - DNA, 75 bp, Artificial Sequence
  Synthetic
gccgattatggcacctgtgttgggtttgggcttgtgcctgtatggcttgcaggtcagctgctggtgcccgaaaaa

SEQ ID NO: 220436 - DNA, 75 bp, Artificial Sequence
  Synthetic
aaactaatctatcattgacacttatgaagcaggaccctaaccaccctcttaaacatttttgtctcatcaggtcat

SEQ ID NO: 220437 - DNA, 75 bp, Artificial Sequence
  Synthetic
ccggggatcctaggcatttaggattgcgcttttagagatctttgtgtgagtgggcttcattaagccatgggacaa

SEQ ID NO: 220438 - DNA, 75 bp, Artificial Sequence
  Synthetic
cttgtgttcaatatccttagagatttcactttatttaggaatgatctccagcattgcacctgacactctccagta

SEQ ID NO: 220439 - DNA, 75 bp, Artificial Sequence
  Synthetic
cctcaccaacatttgcatacaaaaatctcaatattggtgatgctctcttgaactgataaattaaatgttcaatat

SEQ ID NO: 220440 - DNA, 75 bp, Artificial Sequence
  Synthetic
caaggaactttattctaggtgaccatttcatctttgtggaggctaaatcactcatgaatggcagtatatgcttct

SEQ ID NO: 220441 - DNA, 75 bp, Artificial Sequence
  Synthetic
aaacagtgggtctcaaggggaagtaatcacaaggattgtgtttaaaaaagtccaagatctgagcttgttttggtt

SEQ ID NO: 220442 - DNA, 75 bp, Artificial Sequence
  Synthetic
tcttcttcgatctgcagctttacttcatgagctgttaacttattattgatgccttggtggcatgaggcaatcact

SEQ ID NO: 220443 - DNA, 75 bp, Artificial Sequence
  Synthetic
aggacttcatcatagctgtaactacattaaaaggtatttctaccatcttgtgcatgtgccacataagtagggttg

SEQ ID NO: 220444 - DNA, 75 bp, Artificial Sequence
  Synthetic
attttctcaatcaaatccttgtgataaaaatcggacacaaaggccatcacaaagtacctgatgttttgtaaaaat

SEQ ID NO: 220445 - DNA, 75 bp, Artificial Sequence
  Synthetic
atcaaattctgtaagacagtcaagaataaaaatggacacatcattgggccccacttactatgatccatgctataa

SEQ ID NO: 220446 - DNA, 75 bp, Artificial Sequence
  Synthetic
ttatgctgtagatgcagccaaccactgtgggaccatcgccaatggcgttcttcagacttttatgaggatggcttg

SEQ ID NO: 220447 - DNA, 75 bp, Artificial Sequence
  Synthetic
tgagctgtcagcttgttgttgataccttggtgacatgaagcaatcacttcctcataatgattagagcgattatcc

SEQ ID NO: 220448 - DNA, 75 bp, Artificial Sequence
  Synthetic
agactgttgtcttagatgcacgcagcagaaagctgagactatctgctgaagtgacaaaagcaaagcgcaatccaa

SEQ ID NO: 220449 - DNA, 75 bp, Artificial Sequence
  Synthetic
aatctcatctagatcatttattgatggttggccatcaccattagggcctgagcctagcttgacaggttccctata

SEQ ID NO: 220450 - DNA, 75 bp, Artificial Sequence
  Synthetic
ctttaaggcattgtgtgctgaattctcccagatggggaacaagcaaaccaaagccccagaggtaaaggacagtcc

SEQ ID NO: 220451 - DNA, 75 bp, Artificial Sequence
  Synthetic
tacttctgttcaaagttggcaggagatgacctgacaaagcactccaacagtattaaaacattgcccgtcagtttg

SEQ ID NO: 220452 - DNA, 75 bp, Artificial Sequence
  Synthetic
gcaattcagctggacttcagtggtaagacttattttggtgaacccctgaatcaaagtgctcagctaaaatgggca

SEQ ID NO: 220453 - DNA, 75 bp, Artificial Sequence
  Synthetic
ttctaagtgtcagcaacaggtgccccatctgcaagatgccccttcccacaaaactgagaccatcaaccgctccaa

SEQ ID NO: 220454 - DNA, 75 bp, Artificial Sequence
  Synthetic
acagagggacaagagtttcaacccttccattaatagcatcctaggctctgtctgcacaagaaatgccaacttctg

SEQ ID NO: 220455 - DNA, 75 bp, Artificial Sequence
  Synthetic
aagcattgacctcatctttttgcatgcatcaggaattagcctctcaatctgcctcattatcctataactacgatt

SEQ ID NO: 220456 - DNA, 75 bp, Artificial Sequence
  Synthetic
caacagtccactatgagacaaaatcttgtaaaaggcacagaagaaacaaaaggcaattaaagacaattaaaatag

SEQ ID NO: 220457 - DNA, 75 bp, Artificial Sequence
  Synthetic
gtaaagctgcagcaacaaattttgttagcaggggcacctcgtcaccccaaacatagaaccttgatttgaactctg

SEQ ID NO: 220458 - DNA, 75 bp, Artificial Sequence
  Synthetic
caggtcagatgaagtgtccccaacttcttttacaaagatctcaagatcttggtcttgtatgacaggtgtaaagga

SEQ ID NO: 220459 - DNA, 75 bp, Artificial Sequence
  Synthetic
tccttcgggttcacacttacatgtccaaattccaatttgggctcaaggaatttctcaaagcatttgatctggtca

SEQ ID NO: 220460 - DNA, 75 bp, Artificial Sequence
  Synthetic
tcctccagacacacacctcaccgcaaaatttataaatctttcagaaatcaacgcataaaagtctgaggtgttgtg

SEQ ID NO: 220461 - DNA, 75 bp, Artificial Sequence
  Synthetic
agttggacccgacaaagcaagtctccaacagtcagacagaacacatgggctcacagacccagaatatagtgcctg

SEQ ID NO: 220462 - DNA, 75 bp, Artificial Sequence
  Synthetic
tttgtaataaagtggcacatgtaggaaatgttcaaaatgaacttgaacctattggtcatcatgctcttcacatcc

SEQ ID NO: 220463 - DNA, 75 bp, Artificial Sequence
  Synthetic
tttagacagctgcctgctaattgtgatgtgagcgcttcaaagtaatcctcaatgagccttgtgaacatctttgtc

SEQ ID NO: 220464 - DNA, 75 bp, Artificial Sequence
  Synthetic
ctattgatgaagaactcttggcaataggcctctttgcacctcacaacctggtatctagagggtccaaattcattt

SEQ ID NO: 220465 - DNA, 75 bp, Artificial Sequence
  Synthetic
ctcttcaggtcttcttttagttgctctaatttcttgaaatcctcaatgtacttctgttcaaaattggcaggagat

SEQ ID NO: 220466 - DNA, 75 bp, Artificial Sequence
  Synthetic
ttagatcaaacttaaacataggtctctctatccctttgtaaatagctttctcaatgaatgaagagaagggaccca

SEQ ID NO: 220467 - DNA, 75 bp, Artificial Sequence
  Synthetic
cttctatccaagaaatcatagtgctcactgttgtttgtaaaacctcagctgaaaatattgctggaaaatatcttt

SEQ ID NO: 220468 - DNA, 75 bp, Artificial Sequence
  Synthetic
cactgttgtttgtaaaacctcagctgaaaatattgctggaaaatatcttttaggatcagcataaaatgagcacac

SEQ ID NO: 220469 - DNA, 75 bp, Artificial Sequence
  Synthetic
taaagcactggaaatattcttggtccaaaaaagtcctagtcaccactgcttttgtcagctcactaataggacatg

SEQ ID NO: 220470 - DNA, 75 bp, Artificial Sequence
  Synthetic
atgtgtgcgagagtgtgagtttctcagttcagaagccaatacaacataatgttcctccctcttccacttaacaat

SEQ ID NO: 220471 - DNA, 75 bp, Artificial Sequence
  Synthetic
ccaatatggcttgtgggtcggctggtgatgtcctagagaaactactacagaaatgagagacaatatgcctaggat

SEQ ID NO: 220472 - DNA, 75 bp, Artificial Sequence
  Synthetic
gttgttcttttttgaggccttgtgcgctgtacttctccaaatgggaaacaagcaagccaaagccccagaatcaaa

SEQ ID NO: 220473 - DNA, 75 bp, Artificial Sequence
  Synthetic
gaagttttcatggagttcaccaaagcgaggctcaatgaagaaagtctctctaagtcaatggttcccagtagttcc

SEQ ID NO: 220474 - DNA, 75 bp, Artificial Sequence
  Synthetic
tctcaaatagagacggatataaacgtctcaaagaatgaatgatgtggctcataccaaccctgtcctctagcagtt

SEQ ID NO: 220475 - DNA, 75 bp, Artificial Sequence
  Synthetic
atttctaagctctgacggaacttgccaatattgaacaccattgggatttgtcaacaatttgattcccttgatatc

SEQ ID NO: 220476 - DNA, 75 bp, Artificial Sequence
  Synthetic
acatcccccatcacataagggaatgattcttcctctgttctctgataactgattgtaggaacaactccagagaca

SEQ ID NO: 220477 - DNA, 75 bp, Artificial Sequence
  Synthetic
agttctgtaagagctgctggttcgaaaacaagggcctggttgagtgcaacaaccactatctgtgtctcaactgcc

SEQ ID NO: 220478 - DNA, 75 bp, Artificial Sequence
  Synthetic
aacgctgctaacatggcatatgcacaaaatggttgagattccctttaatgttgtatcagctatgatgaaatcatt

SEQ ID NO: 220479 - DNA, 75 bp, Artificial Sequence
  Synthetic
gttcctgtggactctacaaacagcctggtgtgcctgtgaaatggaagagatgagacccttgtcagggcccccgtg

SEQ ID NO: 220480 - DNA, 75 bp, Artificial Sequence
  Synthetic
tcaccttacttctaagtgtcagcaacaggtgtcccatttgcaagatgcctctccccacaaaactgagaccatcag

SEQ ID NO: 220481 - DNA, 75 bp, Artificial Sequence
  Synthetic
gaggctcttcggaactgaaatgttaactgttcaatgttgtcatcataggtgtctattttatcacaatatagcttt

SEQ ID NO: 220482 - DNA, 75 bp, Artificial Sequence
  Synthetic
ctgtgcacctcgagtgaaagtggaagacaacttattttggactgttttgacaatggtaggaatcttttcatcatc

SEQ ID NO: 220483 - DNA, 75 bp, Artificial Sequence
  Synthetic
gagggggtcaagactccattgtcatggagaattctctctacagatttatcctcactgttatgctcacaaccattt

SEQ ID NO: 220484 - DNA, 75 bp, Artificial Sequence
  Synthetic
tcagagacatcatgggtataccatattgtaattacagtaaatactggtatcttaatcatacatccacaggcagga

SEQ ID NO: 220485 - DNA, 75 bp, Artificial Sequence
  Synthetic
gccgggggcccccccgggggagccaaccatcaccaaaaaactactcaatgtcttcgatgcattcatccttcctag

SEQ ID NO: 220486 - DNA, 75 bp, Artificial Sequence
  Synthetic
ggttgcgcgagctgttctcggagcacctactcaatgtcgaggggaggccccacctcttcaaagaggggcctgcac

SEQ ID NO: 220487 - DNA, 75 bp, Artificial Sequence
  Synthetic
tactataacagagagcataacccttgaactccacccagttgtccactgcctcaagaaccgcactcaagatcccct

SEQ ID NO: 220488 - DNA, 75 bp, Artificial Sequence
  Synthetic
ttccagattcacagcaccagaatagattatcttttgccgcaacaccattctaagcgggtgatgggtggctaagtt

SEQ ID NO: 220489 - DNA, 75 bp, Artificial Sequence
  Synthetic
ccttagaagcactcatcttggtctggacacttggggatttactggttgaaagtatcactcagtaagtcaatgaaa

SEQ ID NO: 220490 - DNA, 75 bp, Artificial Sequence
  Synthetic
acgggaccctatcccatagcgaactgttgctctagcagaccacatgttctgagggttctgaacatcatacctgca

SEQ ID NO: 220491 - DNA, 75 bp, Artificial Sequence
  Synthetic
gatcctggtcttgtataacaggtgtaaaggatgccaatttctttccacattcccacaagcctcccctatgcacaa

SEQ ID NO: 220492 - DNA, 75 bp, Artificial Sequence
  Synthetic
ccctagttgatttgtgtcaattaaaaactcattaatgatctcggtgtcaacataccatgctgatttgcccttgaa

SEQ ID NO: 220493 - DNA, 75 bp, Artificial Sequence
  Synthetic
tgcactcttctatccagctgaccataacatcgactactttctgcagcacatcactggagaaaactgaaggaaaaa

SEQ ID NO: 220494 - DNA, 75 bp, Artificial Sequence
  Synthetic
tgtacaagaaatgccaacttctgccttgatagtctctcgttgtctgccaagtactttgataccaaatccttagca

SEQ ID NO: 220495 - DNA, 75 bp, Artificial Sequence
  Synthetic
aacaagccgacaatatgataacggagatgttacagaaggagtacatagataggcaagggaagaccccacttggat

SEQ ID NO: 220496 - DNA, 75 bp, Artificial Sequence
  Synthetic
tctttgtgtgagtgggcttcatcaagccatgggacaaatcataacatttttccaggaagtacctcatgtcataga

SEQ ID NO: 220497 - DNA, 75 bp, Artificial Sequence
  Synthetic
cggaacctcactgtctgactcagttttgcagaccctggaggtagtgaagctacggcatcaaagaaatcctccaat

SEQ ID NO: 220498 - DNA, 75 bp, Artificial Sequence
  Synthetic
caccgacttggaaattagagtaaaagaaatcttctgttattgactgtttagttttcttccttaaccctagttgag

SEQ ID NO: 220499 - DNA, 75 bp, Artificial Sequence
  Synthetic
atttcaatgcaccaagtaaaaggtgcgggggactatcactaatctcccttataaacatatctaaatcttgatctt

SEQ ID NO: 220500 - DNA, 75 bp, Artificial Sequence
  Synthetic
aagacagaagttagcatttcttgtgcagacagagcctaggatgctattaatggaagggttgaaactcttgtccct

SEQ ID NO: 220501 - DNA, 75 bp, Artificial Sequence
  Synthetic
gatactaagtctttgacataggctatgtcttcctccatgtttggctgtgagtatgatgatcagaaccctcagaac

SEQ ID NO: 220502 - DNA, 75 bp, Artificial Sequence
  Synthetic
gctgtgggacgggatcccgtggggggcacagaaaacacaaaaggcaatcgaagacaattaaattagacaatcaaa

SEQ ID NO: 220503 - DNA, 75 bp, Artificial Sequence
  Synthetic
tcagatgataacacaatgtaatgttcctctcttttccattttactatgtgtgagacaagagacaaggcttcacag

SEQ ID NO: 220504 - DNA, 75 bp, Artificial Sequence
  Synthetic
cggagcagcagacagcatcagacccccaccttacagtccctgaaactcccaccaaccttcaccactcctatcccc

SEQ ID NO: 220505 - DNA, 75 bp, Artificial Sequence
  Synthetic
tgataaagaaaatttaagcctccctgtgtcaggccccactgagtcataggattgtggcgactcttggctatagaa

SEQ ID NO: 220506 - DNA, 75 bp, Artificial Sequence
  Synthetic
taaatatcatcaccttcccttttgacttactataacagagagcataacccttgaattccacccagctgtccactg

SEQ ID NO: 220507 - DNA, 75 bp, Artificial Sequence
  Synthetic
ctcatgaatggtaatatgtgtttctcaaacactgatgggtacagccttcttaaagaatgaatgatgtgattcaaa

SEQ ID NO: 220508 - DNA, 75 bp, Artificial Sequence
  Synthetic
caaacactgatgggtacagccttcttaaagaatgaatgatgtgattcaaaccaaccctatcctccaatagttttg

SEQ ID NO: 220509 - DNA, 75 bp, Artificial Sequence
  Synthetic
accgaggtgacccagaacacaacacctccaccgtacaccccgtgatcccaggaacaacactcccatctccatcac

SEQ ID NO: 220510 - DNA, 75 bp, Artificial Sequence
  Synthetic
gattgcgcttttagagattcactactagttaggaattcctaaatcatggggcagattattacattctttcaagaa

SEQ ID NO: 220511 - DNA, 75 bp, Artificial Sequence
  Synthetic
tagttaggaattcctaaatcatggggcagattattacattctttcaagaagtgccacatgtaatagaggaagtca

SEQ ID NO: 220512 - DNA, 75 bp, Artificial Sequence
  Synthetic
gcagattattacattctttcaagaagtgccacatgtaatagaggaagtcatgaacattgtgctaattgcgctttc

SEQ ID NO: 220513 - DNA, 75 bp, Artificial Sequence
  Synthetic
tggttctatgtcaaagtctatccatgcatagcccatcattaaatcgaatttaaacataggtctctctatcccttt

SEQ ID NO: 220514 - DNA, 75 bp, Artificial Sequence
  Synthetic
tgaaacattgaaagtattcgtggttaaagtatgtccttgttgatactgcttttgtcaactccccaataggacact

SEQ ID NO: 220515 - DNA, 75 bp, Artificial Sequence
  Synthetic
aataactgaccacactttcacttccacttccatttctaagttctagcggaacttgccaatattgaatgccattag

SEQ ID NO: 220516 - DNA, 75 bp, Artificial Sequence
  Synthetic
ttggattggttgcctttttattcttgtgtggcaagtcttgttccctaacccttaaagggggatatgagctgcaaa

SEQ ID NO: 220517 - DNA, 75 bp, Artificial Sequence
  Synthetic
tgcaatgagaaacatgatgaagagttttgtgacatgttaagattgtttgactttaacaaacaagctataaggagg

SEQ ID NO: 220518 - DNA, 75 bp, Artificial Sequence
  Synthetic
gtgtggcaagtcttgttccctaacccttaaagggggatatgagctgcaaaccttagaattaaatatggagaccct

SEQ ID NO: 220519 - DNA, 75 bp, Artificial Sequence
  Synthetic
gacatcagaaatcagagactgaatggacttaatatacagattctctttatttggtccccgaacacatttgctacc

SEQ ID NO: 220520 - DNA, 75 bp, Artificial Sequence
  Synthetic
gacttaatatacagattctctttatttggtccccgaacacatttgctacccaatgttctgcacaatcctacaaag

SEQ ID NO: 220521 - DNA, 75 bp, Artificial Sequence
  Synthetic
taagagtgggcaatgagactggattagaattgactttaactaacaccagcattataaatcacaaattttgcaact

SEQ ID NO: 220522 - DNA, 75 bp, Artificial Sequence
  Synthetic
agaattgactttaactaacaccagcattataaatcacaaattttgcaacttatccgatgctcacaaaaagaatct

SEQ ID NO: 220523 - DNA, 75 bp, Artificial Sequence
  Synthetic
acaactaccccagtatgcatgtggcatagatctttgcattgatcccaaacagcattttcaaatctcctggagtca

SEQ ID NO: 220524 - DNA, 75 bp, Artificial Sequence
  Synthetic
tccacttaacaatgtgtgaaacaagtgaaagtgcctcgcaattcacatctagggcaacacaaagatcaaggaact

SEQ ID NO: 220525 - DNA, 75 bp, Artificial Sequence
  Synthetic
caaacttcaatcagtatgaagccatgagttgtgatttcaatggagggaaaatcagtgtgcaatacaacctctctc

SEQ ID NO: 220526 - DNA, 75 bp, Artificial Sequence
  Synthetic
ccatccctaacttcaatcagtatgaggcaatgagctgcgatttcaatgggggaaagatcagtgtgcagtacaacc

SEQ ID NO: 220527 - DNA, 75 bp, Artificial Sequence
  Synthetic
gagttgtgatttcaatggagggaaaatcagtgtgcaatacaacctctctcattcctatgctggggatgcggccga

SEQ ID NO: 220528 - DNA, 75 bp, Artificial Sequence
  Synthetic
ttcataatcctgcttgttgagtagatacttcccctttcttgagaagacctcggtaagctgcgacacagccagcgc

SEQ ID NO: 220529 - DNA, 75 bp, Artificial Sequence
  Synthetic
cctggggtggaagatacattgcattagactcaggaaagggaaactgggactgtataatgaccagctaccagtacc

SEQ ID NO: 220530 - DNA, 75 bp, Artificial Sequence
  Synthetic
tgagaggtgctcactagacaaatagtttgttgtgaactcttcatggagttgcccagtcttcaacctattgtacag

SEQ ID NO: 220531 - DNA, 75 bp, Artificial Sequence
  Synthetic
agactcaggaaagggaaactgggactgtataatgaccagctaccagtacctgataattcaaaatacaacatggga

SEQ ID NO: 220532 - DNA, 75 bp, Artificial Sequence
  Synthetic
tgttgacaacaacactcttattgctggctagatccaaagctgtagcacagccactggtgataagggggtctttga

SEQ ID NO: 220533 - DNA, 75 bp, Artificial Sequence
  Synthetic
tgctcttgactcaggccgtgacaggtgggattgtatcatgactagttatcaatatctaataatccagaatacaac

SEQ ID NO: 220534 - DNA, 75 bp, Artificial Sequence
  Synthetic
tgtcacaaaggacaagagatatatatataagtaggaggctcttggggaccttcacctggacattgtcagattctg

SEQ ID NO: 220535 - DNA, 75 bp, Artificial Sequence
  Synthetic
tataagtaggaggctcttggggaccttcacctggacattgtcagattctgagggcaatgaaacaccaggtggtta

SEQ ID NO: 220536 - DNA, 75 bp, Artificial Sequence
  Synthetic
agtctgtatggatctaatgtaaagattctccttgttggggcctctgacacacttgctacctagtgttctacacaa

SEQ ID NO: 220537 - DNA, 75 bp, Artificial Sequence
  Synthetic
tttggaccaaaaaggctaacttctgtcttgacagcttctcattatctgcaaggtactttgagatgagatctttag

SEQ ID NO: 220538 - DNA, 75 bp, Artificial Sequence
  Synthetic
atacagctgtggcaaaatgcaatgagaagcatgatgaggagttttgtgacatgctgagattgtttgatttcaaca

SEQ ID NO: 220539 - DNA, 75 bp, Artificial Sequence
  Synthetic
gaagcatgatgaggagttttgtgacatgctgagattgtttgatttcaacaagcaagcaatccgtaggttgaaggc

SEQ ID NO: 220540 - DNA, 75 bp, Artificial Sequence
  Synthetic
ccagaaagacagatcttgtaaagtatgttctcataagggttcctctcaccaggtgtatctgaaacaaacattccc

SEQ ID NO: 220541 - DNA, 75 bp, Artificial Sequence
  Synthetic
aaacaatgaaccattattaaaactagacacaaggagtgaaataaatttcttggaaacaccaggctttttatacct

SEQ ID NO: 220542 - DNA, 75 bp, Artificial Sequence
  Synthetic
gccaatatggcttgtaggtcagctggtgatgccccacaaaagttcctacagaaatgagagacaatatgcctagga

SEQ ID NO: 220543 - DNA, 75 bp, Artificial Sequence
  Synthetic
tcaatgatcaattaatcatgaagaaccatttaagagacatcatgggcattccctactgcaattacagcaagtatt

SEQ ID NO: 220544 - DNA, 75 bp, Artificial Sequence
  Synthetic
ccatttaagagacatcatgggcattccctactgcaattacagcaagtattggtaccttaatcatactagtagcgg

SEQ ID NO: 220545 - DNA, 75 bp, Artificial Sequence
  Synthetic
ttcacatcctcagataaaaccagattcatcagtgtccttattaatttatagagcagaaactcaacatcggtgatt

SEQ ID NO: 220546 - DNA, 75 bp, Artificial Sequence
  Synthetic
atgaaacccagttctctgatgacatagaacagcaagccgacaatatgatcacagagatgcttcagaaagaataca

SEQ ID NO: 220547 - DNA, 75 bp, Artificial Sequence
  Synthetic
agaacagcaagccgacaatatgatcacagagatgcttcagaaagaatacattgaaagacaagggaaaacgccctt

SEQ ID NO: 220548 - DNA, 75 bp, Artificial Sequence
  Synthetic
aaatgagggcataaaaatctgatgtgttgtgtaatattccttgacccatgtcaagtattgaactgatgtgagaag

SEQ ID NO: 220549 - DNA, 75 bp, Artificial Sequence
  Synthetic
tactagggtgagctaaaattaaaatcaatatcatctttgtcaaagacctgatattatttaattgcccttctagct

SEQ ID NO: 220550 - DNA, 75 bp, Artificial Sequence
  Synthetic
tcaagtattgaactgatgtgagaaggcactacaccgacttggaaattagagtaaaagaaatcttctgttattgac

SEQ ID NO: 220551 - DNA, 75 bp, Artificial Sequence
  Synthetic
ttttcttgcatttaattaaaatccctacacatcgacacatcgttgggaaaccctgtcccaaaccccatagactaa

SEQ ID NO: 220552 - DNA, 75 bp, Artificial Sequence
  Synthetic
tacacatcgacacatcgttgggaaaccctgtcccaaaccccatagactaaatcacatgggagtatgttcctgtgg

SEQ ID NO: 220553 - DNA, 75 bp, Artificial Sequence
  Synthetic
gtaaaagaaatcttctgttattgactgtttagttttcttccttaaccctagttgggctttaatgaaagacttcat

SEQ ID NO: 220554 - DNA, 75 bp, Artificial Sequence
  Synthetic
atttccaccattttgtgcatatgccacataagtagggttgagagatagtccctcccttttatgtcagcttgcaag

SEQ ID NO: 220555 - DNA, 75 bp, Artificial Sequence
  Synthetic
acagggagcccccgtgacccaccgccaatggcggtgggtcacgggggcgttcatttacagaacgactttaggggt

SEQ ID NO: 220556 - DNA, 75 bp, Artificial Sequence
  Synthetic
caatggcggtgggtcacgggggcgttcatttacagaacgactttaggggtgctggtcctgaagaccatgtctctg

SEQ ID NO: 220557 - DNA, 75 bp, Artificial Sequence
  Synthetic
tcctttgagaggaaaattaaattctgtaagacagtcaagaacaaaaatggacacatcattgggccccacttacta

SEQ ID NO: 220558 - DNA, 75 bp, Artificial Sequence
  Synthetic
atcaaacatgatgcagtccagtaaagcgcaatgtggggtgatttcctcttttccacccctctttttcttctcaac

SEQ ID NO: 220559 - DNA, 75 bp, Artificial Sequence
  Synthetic
tcgttgttcaggcaactccctgataactgtaggcttatagcttcaaagtaatcttctataagtctagtaaacatc

SEQ ID NO: 220560 - DNA, 75 bp, Artificial Sequence
  Synthetic
agtagttccacatcccccatcacataaggaaatgttccttcttctgccctctgataactgattgtgggaacaacc

SEQ ID NO: 220561 - DNA, 75 bp, Artificial Sequence
  Synthetic
gcgcaatgtggggtgatttcctcttttccacccctctttttcttctcaacgactactcccgtgtgcatgtgacac

SEQ ID NO: 220562 - DNA, 75 bp, Artificial Sequence
  Synthetic
ctgataactgattgtgggaacaaccccagagatatcgaagtccataatcaagtcataactgtcaaggcaaattac

SEQ ID NO: 220563 - DNA, 75 bp, Artificial Sequence
  Synthetic
tggcataagtctttatactgatcccagactgcattttcatacttcctggaatcagttttgctgagggcaatgtca

SEQ ID NO: 220564 - DNA, 75 bp, Artificial Sequence
  Synthetic
tttgctcaaagaaatatcaatcaatttgatgtctcttctcccttgagactccaacagctttttgatgtcatctga

SEQ ID NO: 220565 - DNA, 75 bp, Artificial Sequence
  Synthetic
ttgatgtctcttctcccttgagactccaacagctttttgatgtcatctgacccctggcaggtcaacaccatattg

SEQ ID NO: 220566 - DNA, 75 bp, Artificial Sequence
  Synthetic
cataagattgtggcgactcttggctataaaaacacaaattctttaacattgctgtggtacagtttgtcagtgaca

SEQ ID NO: 220567 - DNA, 75 bp, Artificial Sequence
  Synthetic
ataaaaacacaaattctttaacattgctgtggtacagtttgtcagtgacagagccttactaagtgcctctgaatt

SEQ ID NO: 220568 - DNA, 75 bp, Artificial Sequence
  Synthetic
gctgtggtacagtttgtcagtgacagagccttactaagtgcctctgaattgctctccctttcactaattcttaca

SEQ ID NO: 220569 - DNA, 75 bp, Artificial Sequence
  Synthetic
gagccttactaagtgcctctgaattgctctccctttcactaattcttacatcatcagagagtttacccatatcaa

SEQ ID NO: 220570 - DNA, 75 bp, Artificial Sequence
  Synthetic
gctctccctttcactaattcttacatcatcagagagtttacccatatcaaacttgaaattaaggttccttgactt

SEQ ID NO: 220571 - DNA, 75 bp, Artificial Sequence
  Synthetic
aagatctgtaacatctatcccatgtgagtacttagcatcctgtttgaattgcttaaggtcagtaggttctctaaa

SEQ ID NO: 220572 - DNA, 75 bp, Artificial Sequence
  Synthetic
acttgaaattaaggttccttgacttataatgagtgtacctccccataagtgtattcgcattcatgatcaagagta

SEQ ID NO: 220573 - DNA, 75 bp, Artificial Sequence
  Synthetic
ccggggatcctaggcaatttagctggacttcagtgataaggcttattttagtgaatccctgaatcaaagtgccta

SEQ ID NO: 220574 - DNA, 75 bp, Artificial Sequence
  Synthetic
gagtacttagcatcctgtttgaattgcttaaggtcagtaggttctctaaaaaagtgtatgtaacaaccagagctt

SEQ ID NO: 220575 - DNA, 75 bp, Artificial Sequence
  Synthetic
agagttgctggtttgagaacagagggttggtggagtgcaacaaccactacttatgtctcaactgtctcagcttac

SEQ ID NO: 220576 - DNA, 75 bp, Artificial Sequence
  Synthetic
tatccatgttttgctacttgggtccaactgtaacatacaatcttttagtgtcatcagttgagaataggtcaaccc

SEQ ID NO: 220577 - DNA, 75 bp, Artificial Sequence
  Synthetic
aactgtaacatacaatcttttagtgtcatcagttgagaataggtcaacccagcatttagacctgcagcctgcaag

SEQ ID NO: 220578 - DNA, 75 bp, Artificial Sequence
  Synthetic
gggaattccttactgcaattacagcaagtattggtatctaaatcacactgtaacagggaagacatcgttgccaag

SEQ ID NO: 220579 - DNA, 75 bp, Artificial Sequence
  Synthetic
gttggtggagtgcaacaaccactacttatgtctcaactgtctcagcttactcctcagcgtcagtagcaggtgccc

SEQ ID NO: 220580 - DNA, 75 bp, Artificial Sequence
  Synthetic
ttctcatagacagcattacagaattcttcataaaatttacctggtaagatatcatgatcaaagtcctcaaccatg

SEQ ID NO: 220581 - DNA, 75 bp, Artificial Sequence
  Synthetic
cttcccgcgtcggtgtctcccccgctggatcctgctgtccatccaccgttttagatccttttttgttgattccaa

SEQ ID NO: 220582 - DNA, 75 bp, Artificial Sequence
  Synthetic
atcatgatcaaagtcctcaaccatgtgattggataattcacccttgatcaacctaatgtaaaacttatttgagac

SEQ ID NO: 220583 - DNA, 75 bp, Artificial Sequence
  Synthetic
caaatcaacaagagtgttttcccaagctctcccagtaattgatgttcttgatgcaatatacggccaaccttcacc

SEQ ID NO: 220584 - DNA, 75 bp, Artificial Sequence
  Synthetic
cttcaccaatatttgcatataaaaattttaatattggtgatgctcttttgaactgataaattaaatgttcaatat

SEQ ID NO: 220585 - DNA, 75 bp, Artificial Sequence
  Synthetic
atcctcacctcccaccccccacccccggggggaccccccgccgggggcccccccggggggcgggcagctcggctc

SEQ ID NO: 220586 - DNA, 75 bp, Artificial Sequence
  Synthetic
atctcctgacaaacaaatcttgtagagtatgttctcataaggattcctttcaccaggggtatctgaaatgaacat

SEQ ID NO: 220587 - DNA, 75 bp, Artificial Sequence
  Synthetic
gcgcaccctcaactgagataacccagaacacaacacctccaccatacaccccatgatcccaagaccaacactccc

SEQ ID NO: 220588 - DNA, 75 bp, Artificial Sequence
  Synthetic
tgatcttttgaccttcagaatagatttcaaaataccgtccattgtttgtggtgacacttttattgtttccaacat

SEQ ID NO: 220589 - DNA, 75 bp, Artificial Sequence
  Synthetic
actgaccttctatttctcctttccttagtctgttcctaaaaacctgatattcttcctcaatctgcagctttactt

SEQ ID NO: 220590 - DNA, 75 bp, Artificial Sequence
  Synthetic
ccccggggggcgggcagctcggctctactcgatatcctcaatacacctctccggcccaaacaattccgaacatgt

SEQ ID NO: 220591 - DNA, 75 bp, Artificial Sequence
  Synthetic
gctctcccagtaattgatgttcttgatgcaatatacggccaaccttcacctgaaaggcagatcttatagaggatg

SEQ ID NO: 220592 - DNA, 75 bp, Artificial Sequence
  Synthetic
accagaatccaaatctgcatacaagaacttaaggactggagaggctcttcggaactggaatgttaactgttcaat

SEQ ID NO: 220593 - DNA, 75 bp, Artificial Sequence
  Synthetic
ttcaaaataccgtccattgtttgtggtgacacttttattgtttccaacatgttgcccccatcaagcatgcaagca

SEQ ID NO: 220594 - DNA, 75 bp, Artificial Sequence
  Synthetic
ggaactcttttttgtgtcaaccattcctagtatagggtgactctgagtgagcatgtctagatctgaagagttcgg

SEQ ID NO: 220595 - DNA, 75 bp, Artificial Sequence
  Synthetic
ccgtcagaacatttaaactctctacacctgacaatcttcctgaggtcatggataaagattcacagagcctgctat

SEQ ID NO: 220596 - DNA, 75 bp, Artificial Sequence
  Synthetic
gttgtcatcacaggtgtctattttatcactatatagctttctgaaatcctctaataacttcatcttatcagtctt

SEQ ID NO: 220597 - DNA, 75 bp, Artificial Sequence
  Synthetic
actctgattcttcaaaaagtgagttactctcctgagcatactttagaagtgagaagagcgtgtccctcagcttgt

SEQ ID NO: 220598 - DNA, 75 bp, Artificial Sequence
  Synthetic
cctagtatagggtgactctgagtgagcatgtctagatctgaagagttcgggtactttgctgtgtaaatcaaacct

SEQ ID NO: 220599 - DNA, 75 bp, Artificial Sequence
  Synthetic
ttgcacctccatcgagcaaaatttcgtctaggtcagccccatcagcatcacttttgagctgcccagatcctagaa

SEQ ID NO: 220600 - DNA, 75 bp, Artificial Sequence
  Synthetic
ggtgaggcacgccaaggtgaggcttggcatggttccaaattggttattgagtaattctgcattttttacgtccca

SEQ ID NO: 220601 - DNA, 75 bp, Artificial Sequence
  Synthetic
ggcatggttccaaattggttattgagtaattctgcattttttacgtcccaaaccctgacgacaccatccccacct

SEQ ID NO: 220602 - DNA, 75 bp, Artificial Sequence
  Synthetic
gccccttcccaccaagctaaaggcagcagcacagccaagcgcaccatcaaccgaggcgatccagaacacaacacc

SEQ ID NO: 220603 - DNA, 75 bp, Artificial Sequence
  Synthetic
ttaaggctaaagattcacaaagtcttgaatactcagactcttcgaacaatgcattactttcttgtgaatatttta

SEQ ID NO: 220604 - DNA, 75 bp, Artificial Sequence
  Synthetic
catccatctttacttaaaaacttttttgcattgtagaccatgtcatccaattcttcctcagtggctgtgtctgca

SEQ ID NO: 220605 - DNA, 75 bp, Artificial Sequence
  Synthetic
cctcctttgatcaagctgttgtgagcttaaattccccatgtaaacacctgagctcaaaggcctttctgtccttat

SEQ ID NO: 220606 - DNA, 75 bp, Artificial Sequence
  Synthetic
cttaaattccccatgtaaacacctgagctcaaaggcctttctgtccttatgactttggacttgagtttttccagg

SEQ ID NO: 220607 - DNA, 75 bp, Artificial Sequence
  Synthetic
gacattcttctgttgagttgacttcagttcaacaagattgttgacagcttgattcagatccctcagtcgctttag

SEQ ID NO: 220608 - DNA, 75 bp, Artificial Sequence
  Synthetic
agttcaacaagattgttgacagcttgattcagatccctcagtcgctttaggtctgcatcatctctcttctgcttg

SEQ ID NO: 220609 - DNA, 75 bp, Artificial Sequence
  Synthetic
aatgaacttgaacctattagtcatcatgctcttcacatcctcagataaaaccagattcattaatgtccttattaa

SEQ ID NO: 220610 - DNA, 75 bp, Artificial Sequence
  Synthetic
atgctcttcacatcctcagataaaaccagattcattaatgtccttattaacctatagagcaggaactcaacatca

SEQ ID NO: 220611 - DNA, 75 bp, Artificial Sequence
  Synthetic
gagagcctgagcatctttgacaacttgcaactttatgttagaacagtaaccagatagttcccttcgtaaggactg

SEQ ID NO: 220612 - DNA, 75 bp, Artificial Sequence
  Synthetic
cgcaggccatgtcttcttccatgtctgactgtaggtatggtggtcaaaaccttcagaacatgtgatctgctagaa

SEQ ID NO: 220613 - DNA, 75 bp, Artificial Sequence
  Synthetic
gagtctttaagtgtcatcaactgagaataggtcagccctgttggaaaccccgctgactgtaaagacttgttggac

SEQ ID NO: 220614 - DNA, 75 bp, Artificial Sequence
  Synthetic
ggcggggggtccccccccggggggagccaaccatctccgaaagactactcaatgtcctcgatgtgttcatccctc

SEQ ID NO: 220615 - DNA, 75 bp, Artificial Sequence
  Synthetic
ctccaacagcacccccagccggaacaatggacagcaccaggcccccgccctacagtccctgaatcccccaccgac

SEQ ID NO: 220616 - DNA, 75 bp, Artificial Sequence
  Synthetic
ttggagcaacctaaaggtggagtgacaagtggttctgtaagagtcactttactctgcacaattatcacaaagcgc

SEQ ID NO: 220617 - DNA, 75 bp, Artificial Sequence
  Synthetic
atttcctttgaggcactcatcgccagattgttgtgttgaatgcacgcaacaaaagctgagactatctgccaaagt

SEQ ID NO: 220618 - DNA, 75 bp, Artificial Sequence
  Synthetic
atgcacgcaacaaaagctgagactatctgccaaagtgataaaagcaaagcgcaatccaatagcctaggatccact

SEQ ID NO: 220619 - DNA, 75 bp, Artificial Sequence
  Synthetic
caccaaccccagcagagagcccccacaacacagccaagcccacccagcccccagaaccgcccacatcagcaggca

SEQ ID NO: 220620 - DNA, 75 bp, Artificial Sequence
  Synthetic
gtacgctgataaggtagttgcagaagacaatatcgaacacttaatttaccagttcaagagagcatcaccaatatt

SEQ ID NO: 220621 - DNA, 75 bp, Artificial Sequence
  Synthetic
ccagaaccgcccacatcagcaggcatgggcaacaagcagaccaggtccccacccaaaccagagcaccccagacca

SEQ ID NO: 220622 - DNA, 75 bp, Artificial Sequence
  Synthetic
tgggcaacaagcagaccaggtccccacccaaaccagagcaccccagaccaaccctgctacccgacgcatcccacc

SEQ ID NO: 220623 - DNA, 75 bp, Artificial Sequence
  Synthetic
ataaaatgagcacacctcaccaactttgttatcattaatagcatagcacttcgagcactcccctgtcttttgata

SEQ ID NO: 220624 - DNA, 75 bp, Artificial Sequence
  Synthetic
atctgcacaacattctttacctagaaactttcttgcattataaaccatttcagtaagctcttcctccaatgcatc

SEQ ID NO: 220625 - DNA, 75 bp, Artificial Sequence
  Synthetic
aatgaaaactcttgacaatatgcttctttgcatctgaccacttgataccttgcgggtccaaattcattctgtctc

SEQ ID NO: 220626 - DNA, 75 bp, Artificial Sequence
  Synthetic
gagtgtaataaccattacctctgtctaaactgtctcacactgcttctcagcgtgagcgacagatgtcctatttgt

SEQ ID NO: 220627 - DNA, 75 bp, Artificial Sequence
  Synthetic
taaaactagcatcctgactcttgattttatatcttattgtctggtaaaactgaacagagtccactggcattgtac

SEQ ID NO: 220628 - DNA, 75 bp, Artificial Sequence
  Synthetic
ctttgcatctgaccacttgataccttgcgggtccaaattcattctgtctcagctttacggtagaagaagttttca

SEQ ID NO: 220629 - DNA, 75 bp, Artificial Sequence
  Synthetic
taaactgtctcacactgcttctcagcgtgagcgacagatgtcctatttgtaagatgcccctccccaccaagctgg

SEQ ID NO: 220630 - DNA, 75 bp, Artificial Sequence
  Synthetic
tcctccccgcccccctacagcccctaactctcccaagacgggcccgcaccccacacccaggaacccaaccaaaca

SEQ ID NO: 220631 - DNA, 75 bp, Artificial Sequence
  Synthetic
aactctcccaagacgggcccgcaccccacacccaggaacccaaccaaacacacacacacagacaaacacatagaa

SEQ ID NO: 220632 - DNA, 75 bp, Artificial Sequence
  Synthetic
tggtccacactgatcccaacatcctttaaagcagtggtggccttcaaaatggttttctggaatattgaattgagg

SEQ ID NO: 220633 - DNA, 75 bp, Artificial Sequence
  Synthetic
gggaccccccgccgggggcccccccggggggctcagaggctggcatcactcaatgtcctctacctgcaccagtgt

SEQ ID NO: 220634 - DNA, 75 bp, Artificial Sequence
  Synthetic
ggggggctcagaggctggcatcactcaatgtcctctacctgcaccagtgtgtcgaacaatttaatgcacgtcctt

SEQ ID NO: 220635 - DNA, 75 bp, Artificial Sequence
  Synthetic
agtgaatgacccaagtgtccttgttgttgctacaaaagagcggacatatgattcaaagtagatttgtctcataaa

SEQ ID NO: 220636 - DNA, 75 bp, Artificial Sequence
  Synthetic
gacagtgttatgcacatataatcccacaggagaggtcttaaataagaaacaacagtatcaccaccatctttggct

SEQ ID NO: 220637 - DNA, 75 bp, Artificial Sequence
  Synthetic
acaggagaggtcttaaataagaaacaacagtatcaccaccatctttggctttcgatgaaactttccatatctgga

SEQ ID NO: 220638 - DNA, 75 bp, Artificial Sequence
  Synthetic
tgacttactataacacagtgagtagcccttgaaatccacccagtcaccaactgcttcaagaagccgaacaagaat

SEQ ID NO: 220639 - DNA, 75 bp, Artificial Sequence
  Synthetic
atgctggagatcattcctaaataaagtaaaatctttgaggatattgaacacaaggaggaaacttctattaatttt

SEQ ID NO: 220640 - DNA, 75 bp, Artificial Sequence
  Synthetic
taatgacttcctaccaatatttaataatccaaaacaccacttgggaagatcactgccagttttctcgcccatccc

SEQ ID NO: 220641 - DNA, 75 bp, Artificial Sequence
  Synthetic
cccttgaaatccacccagtcaccaactgcttcaagaagccgaacaagaattggtctttgcaattctaacacagtc

SEQ ID NO: 220642 - DNA, 75 bp, Artificial Sequence
  Synthetic
caatctgtcagaaaacattgagatcagtgcctctatcaaaagatcttgggaaccatccctaacctcccttatgaa

SEQ ID NO: 220643 - DNA, 75 bp, Artificial Sequence
  Synthetic
agtgcctctatcaaaagatcttgggaaccatccctaacctcccttatgaacaactccaagtcttgatcgtgaatt

SEQ ID NO: 220644 - DNA, 75 bp, Artificial Sequence
  Synthetic
aaggagctcacaatttcgttcttctttaagtgataggacacctgcattcctgtctttagttctcttcctgctgtc

SEQ ID NO: 220645 - DNA, 75 bp, Artificial Sequence
  Synthetic
actgatcactaatggtacaggttcaatttcaggccccaccagtgtgaaatcatactgtgaaaactgcagcttcct

SEQ ID NO: 220646 - DNA, 75 bp, Artificial Sequence
  Synthetic
attttggtctagacactcagggatttactggttgaaagttttttactcagtgagtcaatgaaaagcgcaatccaa

SEQ ID NO: 220647 - DNA, 75 bp, Artificial Sequence
  Synthetic
ttaagtaactggctcttatcaacctttaaaaactgaccttctatctctcctttcctcaatctgttcctaaacact

SEQ ID NO: 220648 - DNA, 75 bp, Artificial Sequence
  Synthetic
ttaaaaactgaccttctatctctcctttcctcaatctgttcctaaacacttgatactcctcttcgatctgcagct

SEQ ID NO: 220649 - DNA, 75 bp, Artificial Sequence
  Synthetic
atttcaggccccaccagtgtgaaatcatactgtgaaaactgcagcttcctcagatcaacaactatctcaatgggg

SEQ ID NO: 220650 - DNA, 75 bp, Artificial Sequence
  Synthetic
agtatcgacaaaccatgcagatttccccttgaaaacagatccagacagcacaagcctccagcagtcaggcagcac

SEQ ID NO: 220651 - DNA, 75 bp, Artificial Sequence
  Synthetic
cccttgaaaacagatccagacagcacaagcctccagcagtcaggcagcacacattggttgactgatccggaaaac

SEQ ID NO: 220652 - DNA, 75 bp, Artificial Sequence
  Synthetic
ctccatctttgacttctggtgaaactttccatatctggattccattgtcccccatcactgcttcaacaccttgaa

SEQ ID NO: 220653 - DNA, 75 bp, Artificial Sequence
  Synthetic
ctcagcctgctcctcagcgtcagcagcagatgcccgatctgcaagatgccccttcccaccaagctaaaggcagca

SEQ ID NO: 220654 - DNA, 75 bp, Artificial Sequence
  Synthetic
ctccacccctgataatctacccgaagtcatggataaagattcacagagtctgctatactctgactcttcaaaaag

SEQ ID NO: 220655 - DNA, 75 bp, Artificial Sequence
  Synthetic
aatgaaattaagatgaatagaaaaattttctttaaaacttgcgtcttggcttctgatttggaatcttattgtctg

SEQ ID NO: 220656 - DNA, 75 bp, Artificial Sequence
  Synthetic
acactgccgagcgcaccatcaaccgaagtgacccagaacacaacacctccaccacactccccatgattccaggac

SEQ ID NO: 220657 - DNA, 75 bp, Artificial Sequence
  Synthetic
ttttctttaaaacttgcgtcttggcttctgatttggaatcttattgtctggctgaatctcactgaaccaactggt

SEQ ID NO: 220658 - DNA, 75 bp, Artificial Sequence
  Synthetic
aactgttcaatgttgtcatcacaggtgtctattttatcactatatagctttctgaaatcctctaataacttcatc

SEQ ID NO: 220659 - DNA, 75 bp, Artificial Sequence
  Synthetic
agttaacccacacatgatcaactgactgtaattgagttttgctggttctaaatcataatcaatccatgcataacc

SEQ ID NO: 220660 - DNA, 75 bp, Artificial Sequence
  Synthetic
cttcttaagagttaaagatagactagtttctttggaggcaacaaagagggatctcgagaaatggggagagcgagg

SEQ ID NO: 220661 - DNA, 75 bp, Artificial Sequence
  Synthetic
ctgtaattgagttttgctggttctaaatcataatcaatccatgcataacccatcatcaaatcatatttgaacata

SEQ ID NO: 220662 - DNA, 75 bp, Artificial Sequence
  Synthetic
tcaatgtacttctgctcaaagttagcaggagatgatctaacaaaacactccagcagtattagaacattgcccgtc

SEQ ID NO: 220663 - DNA, 75 bp, Artificial Sequence
  Synthetic
caggagatgatctaacaaaacactccagcagtattagaacattgcccgtcagtttgtaaccgtccggtaccacaa

SEQ ID NO: 220664 - DNA, 75 bp, Artificial Sequence
  Synthetic
ttgatttgaactctgcaacaaatctgccaattgcactctttgggctcacaaacttatttagttgatcactcatgt

SEQ ID NO: 220665 - DNA, 75 bp, Artificial Sequence
  Synthetic
accctgccctaaaccacacagactcaaccacatgggcatatgctcatgtggtctgtacaaacatcctggtgtacc

SEQ ID NO: 220666 - DNA, 75 bp, Artificial Sequence
  Synthetic
aacatagtgaaggtgtcaagattccatggtcatggagaattctttccacagatttgtcctcactgttatgctcgc

SEQ ID NO: 220667 - DNA, 75 bp, Artificial Sequence
  Synthetic
gccaagtctctgcaaaccttcaccctctgggatagaggttttatgagggaaccatgtaaatgatccaagcgttct

SEQ ID NO: 220668 - DNA, 75 bp, Artificial Sequence
  Synthetic
tctgggatagaggttttatgagggaaccatgtaaatgatccaagcgttctagttgttgcaacaaacgatctgatg

SEQ ID NO: 220669 - DNA, 75 bp, Artificial Sequence
  Synthetic
aaccatttgcgttgcaagaatcaacctcaatacagagggacaagagtttcaacccttccattaatagcatcctag

SEQ ID NO: 220670 - DNA, 75 bp, Artificial Sequence
  Synthetic
gctgacaaccctttcttctatcatgggttcatgtgtcctggtgtgtgacaatctcagctcagatgaaagcactat

SEQ ID NO: 220671 - DNA, 75 bp, Artificial Sequence
  Synthetic
ggttcatgtgtcctggtgtgtgacaatctcagctcagatgaaagcactatgtagtgttcctctctcttccacttc

SEQ ID NO: 220672 - DNA, 75 bp, Artificial Sequence
  Synthetic
acaaagatctagaaatttaattctaggtgaccacttcattttagtcgaggccaaatcactcatgaagggcaacaa

SEQ ID NO: 220673 - DNA, 75 bp, Artificial Sequence
  Synthetic
ggtgaccacttcattttagtcgaggccaaatcactcatgaagggcaacaaatgtttctcaaacagactggggtac

SEQ ID NO: 220674 - DNA, 75 bp, Artificial Sequence
  Synthetic
agggtcccgtaggggcacagaagacacaagaggcaattaaagacaattaaattagatagccttaatgcctaggat

SEQ ID NO: 220675 - DNA, 75 bp, Artificial Sequence
  Synthetic
caaacagcattttcaaatctcctagagtcagccttgctcagtgcaatgtcaataagctttatgtcccttcttcct

SEQ ID NO: 220676 - DNA, 75 bp, Artificial Sequence
  Synthetic
caatttagaagcagtaggttttaagggaaagtagtcacatgggttatgtttgaaaaactccagctgtcctgctgg

SEQ ID NO: 220677 - DNA, 75 bp, Artificial Sequence
  Synthetic
ggaaagtagtcacatgggttatgtttgaaaaactccagctgtcctgctggcttagggttccctagaacccatgcc

SEQ ID NO: 220678 - DNA, 75 bp, Artificial Sequence
  Synthetic
tgtcttcctccatcaccaattgtggtgcctgtattgggtttgggtttgtgccagaatggcttgtgggtcagctgg

SEQ ID NO: 220679 - DNA, 75 bp, Artificial Sequence
  Synthetic
agatctgaaataagataggacactcttcccttcagactcttctcttaccctcattgggaccctccaaatctggac

SEQ ID NO: 220680 - DNA, 75 bp, Artificial Sequence
  Synthetic
gaaaaccattttgaaggccaccactgctttaaaggatgttgggatcagtgtggaccactataaaattgatatgga

SEQ ID NO: 220681 - DNA, 75 bp, Artificial Sequence
  Synthetic
attgcgctttgtgataattgtgcagagtaaagtgactcttacagaaccacttgtcactccacctttaggttgctc

SEQ ID NO: 220682 - DNA, 75 bp, Artificial Sequence
  Synthetic
agtaaagtgactcttacagaaccacttgtcactccacctttaggttgctccaagcacatcagcaatgagcaactc

SEQ ID NO: 220683 - DNA, 75 bp, Artificial Sequence
  Synthetic
ttgtcactccacctttaggttgctccaagcacatcagcaatgagcaactccaaggaaatcaaatcattcctttgg

SEQ ID NO: 220684 - DNA, 75 bp, Artificial Sequence
  Synthetic
ttcccttcagactcttctcttaccctcattgggaccctccaaatctggactccaaggtcgttagttaaacactca

SEQ ID NO: 220685 - DNA, 75 bp, Artificial Sequence
  Synthetic
ttccttgttagaccccctcacacacttgctgccaagtgttctgcataatcctacaaagcctgaagcgattgaact

SEQ ID NO: 220686 - DNA, 75 bp, Artificial Sequence
  Synthetic
ttgctgccaagtgttctgcataatcctacaaagcctgaagcgattgaactttggaaagcagatttatttatggcc

SEQ ID NO: 220687 - DNA, 75 bp, Artificial Sequence
  Synthetic
gcaagttgtcaaagatgctcaggctctcctgcatggccttgacttttctgaggtcagcaatgtgcagaggctgat

SEQ ID NO: 220688 - DNA, 75 bp, Artificial Sequence
  Synthetic
ctcctgcatggccttgacttttctgaggtcagcaatgtgcagaggctgatgcgcaagcagaagagagatgatgca

SEQ ID NO: 220689 - DNA, 75 bp, Artificial Sequence
  Synthetic
ctgaatggttttcactattgttggtattctctcatcatctaaactcactgccccagcataaatcaccttctgtct

SEQ ID NO: 220690 - DNA, 75 bp, Artificial Sequence
  Synthetic
attctctcatcatctaaactcactgccccagcataaatcaccttctgtctcagcaccattcttaatgggtgatgt

SEQ ID NO: 220691 - DNA, 75 bp, Artificial Sequence
  Synthetic
actgaagtcaactcaacagaagaatgtcttaagggtcggcaccttgagttcagatgatctaataactttggcagc

SEQ ID NO: 220692 - DNA, 75 bp, Artificial Sequence
  Synthetic
gtcttaagggtcggcaccttgagttcagatgatctaataactttggcagcggacctggaaaaactcaagtccaaa

SEQ ID NO: 220693 - DNA, 75 bp, Artificial Sequence
  Synthetic
agtacccattaactcgcataaattccttaatgaagaaacatgttcacctgacagataattggtggtaaattcctc

SEQ ID NO: 220694 - DNA, 75 bp, Artificial Sequence
  Synthetic
cttaatgaagaaacatgttcacctgacagataattggtggtaaattcctcatgcaactcacctgtctttaatttg

SEQ ID NO: 220695 - DNA, 75 bp, Artificial Sequence
  Synthetic
aagctcacaacagcttgatcaaaggagggctctcttgagcatgattgggatgtcaggtggacctcaaggaaatag

SEQ ID NO: 220696 - DNA, 75 bp, Artificial Sequence
  Synthetic
agggctctcttgagcatgattgggatgtcaggtggacctcaaggaaataggacaggtggggatggtgtcgtcagg

SEQ ID NO: 220697 - DNA, 75 bp, Artificial Sequence
  Synthetic
caactcttcaatcagtctcatgatcctgtaactacggttgccgtcaacccaatccctaacatctgtgttgcaatt

SEQ ID NO: 220698 - DNA, 75 bp, Artificial Sequence
  Synthetic
ctgtaactacggttgccgtcaacccaatccctaacatctgtgttgcaattgagtaagaatgggtcaatggggtac

SEQ ID NO: 220699 - DNA, 75 bp, Artificial Sequence
  Synthetic
gccaagcctcaccttggcgtgcctcaccaaacaagggcaagtggacctcaatgatgctgtgcaagctttaacaga

SEQ ID NO: 220700 - DNA, 75 bp, Artificial Sequence
  Synthetic
accaaacaagggcaagtggacctcaatgatgctgtgcaagctttaacagatttaggtttgatttacacagcaaag

SEQ ID NO: 220701 - DNA, 75 bp, Artificial Sequence
  Synthetic
gctaactggaacaccgttagcaatggactgatcaattatggtgtcaattgtctctgctaactggtgtggttcttt

SEQ ID NO: 220702 - DNA, 75 bp, Artificial Sequence
  Synthetic
gagaacagaggaagaaacattcccttatgtgatgggggatgtggaactactgggaaccactgacttagagagact

SEQ ID NO: 220703 - DNA, 75 bp, Artificial Sequence
  Synthetic
gactgatcaattatggtgtcaattgtctctgctaactggtgtggttctttacacttaacattatgtagcgcagca

SEQ ID NO: 220704 - DNA, 75 bp, Artificial Sequence
  Synthetic
aggaatggttgacacaaaaaagagttccctgaacatctcaggttacaacttcagtctgggggctgcagttaaagc

SEQ ID NO: 220705 - DNA, 75 bp, Artificial Sequence
  Synthetic
tccctgaacatctcaggttacaacttcagtctgggggctgcagttaaagctggtgcttgcatgcttgatgggggc

SEQ ID NO: 220706 - DNA, 75 bp, Artificial Sequence
  Synthetic
attcccattcatcactaataaaattgacttaaagcactggaaatattcttggtccaaaaaagtcctagtcaccac

SEQ ID NO: 220707 - DNA, 75 bp, Artificial Sequence
  Synthetic
tgatttaaattctgctacaaatcttccaatcacacttttcgggctgacaaacttatttaactgatcactcatata

SEQ ID NO: 220708 - DNA, 75 bp, Artificial Sequence
  Synthetic
ccaatcacacttttcgggctgacaaacttatttaactgatcactcatatagtaatgaaattctaacagggtttta

SEQ ID NO: 220709 - DNA, 75 bp, Artificial Sequence
  Synthetic
gaaatctattctgaaggtcaaaagatcactgggaatgttcatttctgacactcctggtgaaagaaacccatatga

SEQ ID NO: 220710 - DNA, 75 bp, Artificial Sequence
  Synthetic
tcactgggaatgttcatttctgacactcctggtgaaagaaacccatatgagaacatcctctataagatctgcctt

SEQ ID NO: 220711 - DNA, 75 bp, Artificial Sequence
  Synthetic
agaaatttggtcatcactagaagtgtaagcatcaacttgccctccacaaacacaactcacagcatagtttataaa

SEQ ID NO: 220712 - DNA, 75 bp, Artificial Sequence
  Synthetic
attgtagatattctcacaaattttgatgtattgatcttcagacaggatttctcgatcaaaatcttctatcatatg

SEQ ID NO: 220713 - DNA, 75 bp, Artificial Sequence
  Synthetic
ctcgatcaaaatcttctatcatatggtttgaaagttcactttttatcaaccttattaagagtttttcttccacca

SEQ ID NO: 220714 - DNA, 75 bp, Artificial Sequence
  Synthetic
agcttgggaaaacactcttgttgatttggaatctgacaacaaaccaccgaaactaaatagcgctggttccaataa

SEQ ID NO: 220715 - DNA, 75 bp, Artificial Sequence
  Synthetic
ccggggatcctaggcaatttagctggactttagtggtaaagcttatttttagtgaattcctgaatcaaagtgcct

SEQ ID NO: 220716 - DNA, 75 bp, Artificial Sequence
  Synthetic
ttggaatctgacaacaaaccaccgaaactaaatagcgctggttccaataaaagcttgcaggctgcaggtctaaat

SEQ ID NO: 220717 - DNA, 75 bp, Artificial Sequence
  Synthetic
atgagatggcacaacacccaaatgaaagtttgagtaaaagaaatcttctgttagtgtctgagatgtactctttct

SEQ ID NO: 220718 - DNA, 75 bp, Artificial Sequence
  Synthetic
taagcatcaacttgccctccacaaacacaactcacagcatagtttataaatctctccgaaatgagtccataaaag

SEQ ID NO: 220719 - DNA, 75 bp, Artificial Sequence
  Synthetic
acttttttgcattgtaaaccatttcagcaagctcttcttccgatgcatcatcctttgggttcacactcacatgtc

SEQ ID NO: 220720 - DNA, 75 bp, Artificial Sequence
  Synthetic
gttggacccaagtagcaaaacatggatagatattgagggcaggcctgaagacccagtggagattgctttgtttca

SEQ ID NO: 220721 - DNA, 75 bp, Artificial Sequence
  Synthetic
atagatattgagggcaggcctgaagacccagtggagattgctttgtttcaaccaagctctggttgttacatacac

SEQ ID NO: 220722 - DNA, 75 bp, Artificial Sequence
  Synthetic
aagtttgagtaaaagaaatcttctgttagtgtctgagatgtactctttctcaacccaagttgtgcctttatataa

SEQ ID NO: 220723 - DNA, 75 bp, Artificial Sequence
  Synthetic
catgtgccatgccaatagtgttgagagataatcctttcctttggcatcagcctgagtgtccccagtgagtagaat

SEQ ID NO: 220724 - DNA, 75 bp, Artificial Sequence
  Synthetic
agataatcctttcctttggcatcagcctgagtgtccccagtgagtagaattaagttctgtagggttgcaaggaat

SEQ ID NO: 220725 - DNA, 75 bp, Artificial Sequence
  Synthetic
ctcacatgggatagatgttacagatcttttttccacacaacccgggctgacaagtgctgtcatagaggcacttcc

SEQ ID NO: 220726 - DNA, 75 bp, Artificial Sequence
  Synthetic
cttttttccacacaacccgggctgacaagtgctgtcatagaggcacttccccgcaatatggtgttgacctgccag

SEQ ID NO: 220727 - DNA, 75 bp, Artificial Sequence
  Synthetic
tacatgtgcttgtgagacatttaatttcattgacaaaattgcattctcaaactctctttcatcatttaaacaact

SEQ ID NO: 220728 - DNA, 75 bp, Artificial Sequence
  Synthetic
aacaagtctatagagcaaatactcaacttctgtaattaaatcctctttaattttctcaatcaaatccttgtgata

SEQ ID NO: 220729 - DNA, 75 bp, Artificial Sequence
  Synthetic
acccgcaaggtatcaagtggtcagatgcaaagaagcatattgtcaagagttttcattgggtaacactgaattaca

SEQ ID NO: 220730 - DNA, 75 bp, Artificial Sequence
  Synthetic
caaattgattgatatttctttgagcaaagcagattcaaggaagtttgaaaatgctgtgtgggaccaatacaaaga

SEQ ID NO: 220731 - DNA, 75 bp, Artificial Sequence
  Synthetic
aaagcagattcaaggaagtttgaaaatgctgtgtgggaccaatacaaagacttgtgtcacatgcacacgggagta

SEQ ID NO: 220732 - DNA, 75 bp, Artificial Sequence
  Synthetic
ttcattgacaaaattgcattctcaaactctctttcatcatttaaacaacttcccgagaattgcgtcgtcaatgct

SEQ ID NO: 220733 - DNA, 75 bp, Artificial Sequence
  Synthetic
aatataaagttctctattacctccaacctgctctttgtatgacagcgagaattttagtctccctgtatcaggacc

SEQ ID NO: 220734 - DNA, 75 bp, Artificial Sequence
  Synthetic
acctgctctttgtatgacagcgagaattttagtctccctgtatcaggaccaactgagttgaatgattgtggagat

SEQ ID NO: 220735 - DNA, 75 bp, Artificial Sequence
  Synthetic
ctccaagagattcaagaagttcactcagtatatcagcataatccacaggtctctgttttgtgaggattgagacaa

SEQ ID NO: 220736 - DNA, 75 bp, Artificial Sequence
  Synthetic
cgctttactggactgcatcatgtttgatgcagctactactggtagtttgaacatcacaacactgagggcagtact

SEQ ID NO: 220737 - DNA, 75 bp, Artificial Sequence
  Synthetic
gatgcagctactactggtagtttgaacatcacaacactgagggcagtacttcccagagacatggtcttcaggacc

SEQ ID NO: 220738 - DNA, 75 bp, Artificial Sequence
  Synthetic
tagtgagagtgctttactaagtgcttcggagttgctctctctttcacttattctagtgtcggttgacagtttgtc

SEQ ID NO: 220739 - DNA, 75 bp, Artificial Sequence
  Synthetic
gtgcagcgaagaggtctgtgacatcaatcccatgtgagtacttggcatcctgcttgaactgctttaaatcagtag

SEQ ID NO: 220740 - DNA, 75 bp, Artificial Sequence
  Synthetic
tcggagttgctctctctttcacttattctagtgtcggttgacagtttgtctgtgtcaaatttgaaattgagacac

SEQ ID NO: 220741 - DNA, 75 bp, Artificial Sequence
  Synthetic
ttggcggtgggtcacgggggctccctgtttggagtctatctcttccactttgttggaacaccagggtgtttgtac

SEQ ID NO: 220742 - DNA, 75 bp, Artificial Sequence
  Synthetic
tgtttggagtctatctcttccactttgttggaacaccagggtgtttgtacagtccacaggaacatactcccatgt

SEQ ID NO: 220743 - DNA, 75 bp, Artificial Sequence
  Synthetic
tcaatgattgagttgtcttcttcttcaatccaagttgggatttgatatatgatttcatcattgctgacacaacat

SEQ ID NO: 220744 - DNA, 75 bp, Artificial Sequence
  Synthetic
caagagaattgatttgaaacacaggaaatattcctgatctgaataagtcctggttacaactgcttttgttagttc

SEQ ID NO: 220745 - DNA, 75 bp, Artificial Sequence
  Synthetic
cccttctatcagattcccacagtgctcctctacatacaaccaatggcactggttcgttgtcaggtccaaccttgg

SEQ ID NO: 220746 - DNA, 75 bp, Artificial Sequence
  Synthetic
gtagggattttaattaaatgcaagaaaatgctgatcagataaaagcttgtgctaaagatgaaaatgtccactagt

SEQ ID NO: 220747 - DNA, 75 bp, Artificial Sequence
  Synthetic
atttggatcaagttgtagcattgcatccttgagggtcatcagttgagaataggtgagcccagcggtaaaccctgc

SEQ ID NO: 220748 - DNA, 75 bp, Artificial Sequence
  Synthetic
aaatgctgatcagataaaagcttgtgctaaagatgaaaatgtccactagtcccaagggcgttttcccttgtcttt

SEQ ID NO: 220749 - DNA, 75 bp, Artificial Sequence
  Synthetic
acagaactctttataaaaagtgtcagggagtgtgttataatcaaagtcctccaccatgtggtttgagagttcccc

SEQ ID NO: 220750 - DNA, 75 bp, Artificial Sequence
  Synthetic
aaatattcctgatctgaataagtcctggttacaactgcttttgttagttcaccaatagggcaagacaccatgggt

SEQ ID NO: 220751 - DNA, 75 bp, Artificial Sequence
  Synthetic
gggagtgtgttataatcaaagtcctccaccatgtggtttgagagttcccctttaatcaatctgatgtacagtttt

SEQ ID NO: 220752 - DNA, 75 bp, Artificial Sequence
  Synthetic
tctatgtcatcagagaactgggtttcatttagatatgacccattggatataagccaacactttggtagtgatgtt

SEQ ID NO: 220753 - DNA, 75 bp, Artificial Sequence
  Synthetic
tctgtgcactcttctatccagctgaccataacatcgactactttctgcaacacatcactggagaaaactgaagga

SEQ ID NO: 220754 - DNA, 75 bp, Artificial Sequence
  Synthetic
ccataagagttagtttctataccaacctcccttagagcattggtggctcgagtcaaaactctgttaataattgca

SEQ ID NO: 220755 - DNA, 75 bp, Artificial Sequence
  Synthetic
cacatcactggagaaaactgaaggaaaaaaccgtttgggatcagcataaaaggaacaaacctctccaaccacatt

SEQ ID NO: 220756 - DNA, 75 bp, Artificial Sequence
  Synthetic
tgagcgctggtccggtcctttcagatctctatactgatccacaattttttctatagtttcttttaactcatcaaa

SEQ ID NO: 220757 - DNA, 75 bp, Artificial Sequence
  Synthetic
catttagatatgacccattggatataagccaacactttggtagtgatgttctcccgctactagtatgattaaggt

SEQ ID NO: 220758 - DNA, 75 bp, Artificial Sequence
  Synthetic
tggttcttcatgattaattgatcattgattaaggcattcacggctttatttattaattgaatactcatctgggcc

SEQ ID NO: 220759 - DNA, 75 bp, Artificial Sequence
  Synthetic
tgattaaggcattcacggctttatttattaattgaatactcatctgggcctcagccttcaacctacggattgctt

SEQ ID NO: 220760 - DNA, 75 bp, Artificial Sequence
  Synthetic
attttatgctgatcctaaaagatattttccagcaatattttcagctgaggttttacaaacaacaataagcactat

SEQ ID NO: 220761 - DNA, 75 bp, Artificial Sequence
  Synthetic
ccccaaaaccaaattgctcatagcctgctggactttgtactcatagtcttgcttatctaataaatacttaccttt

SEQ ID NO: 220762 - DNA, 75 bp, Artificial Sequence
  Synthetic
tctctatactgatccacaattttttctatagtttcttttaactcatcaaaatatgacatcgcattcccttcaagc

SEQ ID NO: 220763 - DNA, 75 bp, Artificial Sequence
  Synthetic
tgctggactttgtactcatagtcttgcttatctaataaatacttacctttccttgaaaaaacctcggtcaattgt

SEQ ID NO: 220764 - DNA, 75 bp, Artificial Sequence
  Synthetic
ttctcattgcattttgccacagctgtattcccaaaacacttgagttctgcttcaattagcatccacctggttaaa

SEQ ID NO: 220765 - DNA, 75 bp, Artificial Sequence
  Synthetic
tattcccaaaacacttgagttctgcttcaattagcatccacctggttaaacaataaccacctggtgtttcattgc

SEQ ID NO: 220766 - DNA, 75 bp, Artificial Sequence
  Synthetic
tccatctgtgtacttattaatcacaacactcttattgcttgccagatctaaagcagtcgcacagccactggttga

SEQ ID NO: 220767 - DNA, 75 bp, Artificial Sequence
  Synthetic
acactcttattgcttgccagatctaaagcagtcgcacagccactggttgacagagggtcttttaattctttcctc

SEQ ID NO: 220768 - DNA, 75 bp, Artificial Sequence
  Synthetic
atatatatatctcttgtcctttgtgacaaaaggccaaggtacccgataggagacggtcttgagaattggcagtgg

SEQ ID NO: 220769 - DNA, 75 bp, Artificial Sequence
  Synthetic
acaaaaggccaaggtacccgataggagacggtcttgagaattggcagtggtcctcccatgttgtattttgaatta

SEQ ID NO: 220770 - DNA, 75 bp, Artificial Sequence
  Synthetic
ggacaagtacttcttggagacaccaggtttcttgtaccttatttcagctgattccacacagcattccttacctaa

SEQ ID NO: 220771 - DNA, 75 bp, Artificial Sequence
  Synthetic
ggtttcttgtaccttatttcagctgattccacacagcattccttacctaagaactttttagcgttgtacaccatt

SEQ ID NO: 220772 - DNA, 75 bp, Artificial Sequence
  Synthetic
tctaatgcaatgtatcttccaccccaggccattctcataaatgtttgcaacactccgttggcaactgtcccacag

SEQ ID NO: 220773 - DNA, 75 bp, Artificial Sequence
  Synthetic
aggccattctcataaatgtttgcaacactccgttggcaactgtcccacagtgttcggccgcatccccagcatagg

SEQ ID NO: 220774 - DNA, 75 bp, Artificial Sequence
  Synthetic
cccaaactctagttttggttctaagaatttctcaaagcacttgatctgatctgttagtctatcaggggtttcctt

SEQ ID NO: 220775 - DNA, 75 bp, Artificial Sequence
  Synthetic
gaaactaatctatcgttaacactcacaaaacaggagcccagccaaccagcaaggagcttgtcaccatgccttatg

SEQ ID NO: 220776 - DNA, 75 bp, Artificial Sequence
  Synthetic
aatttctcaaagcacttgatctgatctgttagtctatcaggggtttccttagtgataaaatgacacatgtaagaa

SEQ ID NO: 220777 - DNA, 75 bp, Artificial Sequence
  Synthetic
ctcatggcttcatactgattgaagtttggaatggatagatggaatgttgagatgatgctcatgagagcatgatca

SEQ ID NO: 220778 - DNA, 75 bp, Artificial Sequence
  Synthetic
ttggaatggatagatggaatgttgagatgatgctcatgagagcatgatcataaagattctttttgtgagcatcgg

SEQ ID NO: 220779 - DNA, 75 bp, Artificial Sequence
  Synthetic
agataaaacagtgcttaacagggctcttaccactctgaaaagcaagtactcaacatctgtaatcagcttctcttt

SEQ ID NO: 220780 - DNA, 75 bp, Artificial Sequence
  Synthetic
cttaccactctgaaaagcaagtactcaacatctgtaatcagcttctctttgatcttgttgattaagtctttgtga

SEQ ID NO: 220781 - DNA, 75 bp, Artificial Sequence
  Synthetic
ggttttaattttagctcaccccagtaaacgttctcaaaagctcctccaaaatcttaggtactttgtaatggctta

SEQ ID NO: 220782 - DNA, 75 bp, Artificial Sequence
  Synthetic
tctaatccagtctcattgcccactcttatgtaatgatgactgctgttcttggtgcatgataagggcatggtcatg

SEQ ID NO: 220783 - DNA, 75 bp, Artificial Sequence
  Synthetic
gccagattgttgcgctaaatgcacgcaacaaacactgagactatctgctaaaatgacaaaagcaaagcgcaatcc

SEQ ID NO: 220784 - DNA, 75 bp, Artificial Sequence
  Synthetic
ttatgtaatgatgactgctgttcttggtgcatgataagggcatggtcatgtttagggtctccatatttaattcta

SEQ ID NO: 220785 - DNA, 75 bp, Artificial Sequence
  Synthetic
caccggggatcctaggcaatttggttgttcttccttttgaggctttgtacgctgaactcctccaaatgggaaaca

SEQ ID NO: 220786 - DNA, 75 bp, Artificial Sequence
  Synthetic
cttctgacatcgcttactagggtgggtcaagattaaaaccaaaatcattttggttagcactttaattgaggatat

SEQ ID NO: 220787 - DNA, 75 bp, Artificial Sequence
  Synthetic
gaactggaatgttaactgttcaatgttgtcatcacaggtgtctattttatcactatacagctttctgaaatcctc

SEQ ID NO: 220788 - DNA, 75 bp, Artificial Sequence
  Synthetic
cacaagaataaaaaggcaaccaatccaataatcccacatgtagcgatgttatacaagcccttcaagattgccaat

SEQ ID NO: 220789 - DNA, 75 bp, Artificial Sequence
  Synthetic
gtcaagattaaaaccaaaatcattttggttagcactttaattgaggatatatcatccttaagctcagaacaatct

SEQ ID NO: 220790 - DNA, 75 bp, Artificial Sequence
  Synthetic
gagaatcccatggtcactcagaatagattcaaccgttttatcttcagtgttatgttcacaaccattagctttaca

SEQ ID NO: 220791 - DNA, 75 bp, Artificial Sequence
  Synthetic
aaagattgcggggaaaaacctcttgggatccgcataaaaggaacagacttcaccaactaagttgttgtttaccgc

SEQ ID NO: 220792 - DNA, 75 bp, Artificial Sequence
  Synthetic
cacttcttgaaagaatgtaataatctgccccatgatttaggaattcctaactagtagtgaatctctaaaagcgca

SEQ ID NO: 220793 - DNA, 75 bp, Artificial Sequence
  Synthetic
ggatccgcataaaaggaacagacttcaccaactaagttgttgtttaccgcataacattttgaacactcgcccgtt

SEQ ID NO: 220794 - DNA, 75 bp, Artificial Sequence
  Synthetic
caggtgccccatctgcaagatgcctctccccacgaagctgagaccgtcggtcaccccaacagcgcccccaaccag

SEQ ID NO: 220795 - DNA, 75 bp, Artificial Sequence
  Synthetic
aacagtttcaacccctccatgagcaacattctaggttcagtttggaccagaaaagccaacttctgtcttgatagc

SEQ ID NO: 220796 - DNA, 75 bp, Artificial Sequence
  Synthetic
gtatgcttctttgcatcttaccttctggtatcttgctgctccaagctcattttgcctcaacttaacagtggagga

SEQ ID NO: 220797 - DNA, 75 bp, Artificial Sequence
  Synthetic
cacttgctacccagtgttctgcacaaccctacaaacccagatgctatagaactttggaaagctgatttatttatt

SEQ ID NO: 220798 - DNA, 75 bp, Artificial Sequence
  Synthetic
tggtatcttgctgctccaagctcattttgcctcaacttaacagtggaggaagtcttcattgaattcaccaatgca

SEQ ID NO: 220799 - DNA, 75 bp, Artificial Sequence
  Synthetic
atcttcctccatcaccagttacagtatctgaactaggttcaaacttgtgtttgtatggcttgtagatcagccaat

SEQ ID NO: 220800 - DNA, 75 bp, Artificial Sequence
  Synthetic
tgtgcccattgagtagggaaacagtccttcgtcagacttttgataagacattgttggcacaacacctgatgcctc

SEQ ID NO: 220801 - DNA, 75 bp, Artificial Sequence
  Synthetic
ccttcgtcagacttttgataagacattgttggcacaacacctgatgcctcacagttcataactttactaaataca

SEQ ID NO: 220802 - DNA, 75 bp, Artificial Sequence
  Synthetic
taggtctttgagggcacttattgctttggtaacagttttctgcaacatgcaactcaagatttgatttctatctaa

SEQ ID NO: 220803 - DNA, 75 bp, Artificial Sequence
  Synthetic
ttggtaacagttttctgcaacatgcaactcaagatttgatttctatctaatctaacggagtgagtgcttgatgct

SEQ ID NO: 220804 - DNA, 75 bp, Artificial Sequence
  Synthetic
ctataggttaataaggacattaatgaatctggttttatctgaggatgtgaagagcatgatgactaataggttcaa

SEQ ID NO: 220805 - DNA, 75 bp, Artificial Sequence
  Synthetic
tgtggagacaatgtccacccctgaccactgcatccttaaccccagcctgtctatcatcatatcactcagtgcccc

SEQ ID NO: 220806 - DNA, 75 bp, Artificial Sequence
  Synthetic
aattagcctctcaatttgcctcattattctataactacgattcccgtccacccaatctcttacatcagtctcgca

SEQ ID NO: 220807 - DNA, 75 bp, Artificial Sequence
  Synthetic
cctcttagtgtattctaaagacaccaagcggtcattcacactgataaaactggatcctaaccagccttcctgagc

SEQ ID NO: 220808 - DNA, 75 bp, Artificial Sequence
  Synthetic
tctgtcttgatagcttctcattatctgcaaggtactttgagataagatctttagcattagcaatgtcttcctcca

SEQ ID NO: 220809 - DNA, 75 bp, Artificial Sequence
  Synthetic
aagcggtcattcacactgataaaactggatcctaaccagccttcctgagcttgatcttcacatttaatcttgtcc

SEQ ID NO: 220810 - DNA, 75 bp, Artificial Sequence
  Synthetic
ccagaggggctggttcagtgcaaggacccactaatacaaagtcatactccgtaaactgcaacttttccatgtcaa

SEQ ID NO: 220811 - DNA, 75 bp, Artificial Sequence
  Synthetic
tcttgtgttcaaaattctcaaagatttgactttgttgaggaatgacctccaacaatgcatctgactgctgtttgt

SEQ ID NO: 220812 - DNA, 75 bp, Artificial Sequence
  Synthetic
ttgactttgttgaggaatgacctccaacaatgcatctgactgctgtttgtgggtgatgatctatcaaccccattg

SEQ ID NO: 220813 - DNA, 75 bp, Artificial Sequence
  Synthetic
aactcattaataatctcggtatcaacataccatgctgatttgcctctgaaagtgggacctgacaaaaccagtctc

SEQ ID NO: 220814 - DNA, 75 bp, Artificial Sequence
  Synthetic
atacatcaattcttccactccatcttcattagaaaccatttcagaatcatacaagcagtgaaattcttttaacag

SEQ ID NO: 220815 - DNA, 75 bp, Artificial Sequence
  Synthetic
tcattagaaaccatttcagaatcatacaagcagtgaaattcttttaacagtctttctttgtcaactttaacaaat

SEQ ID NO: 220816 - DNA, 75 bp, Artificial Sequence
  Synthetic
tcactgcacctgagtacataacagtcacatcatgcactaaatacttggattgttgattcattgagccagtatatt

SEQ ID NO: 220817 - DNA, 75 bp, Artificial Sequence
  Synthetic
ctcctcaatctgattcttaacctcatgggcagtcattttgttgttgatgccttgatggcagctggcaattatatc

SEQ ID NO: 220818 - DNA, 75 bp, Artificial Sequence
  Synthetic
cggaacctcactgtctgactcagttttgcagaacctgaaggtagtgaagcaacggcatcaaagaaatcctctaat

SEQ ID NO: 220819 - DNA, 75 bp, Artificial Sequence
  Synthetic
ttgcagaacctgaaggtagtgaagcaacggcatcaaagaaatcctctaatgagtcaaacttaggttcaactaaac

SEQ ID NO: 220820 - DNA, 75 bp, Artificial Sequence
  Synthetic
tgggcagtcattttgttgttgatgccttgatggcagctggcaattatatcatcaaaatggttggttcgtttatct

SEQ ID NO: 220821 - DNA, 75 bp, Artificial Sequence
  Synthetic
aagagattcgcataatctagagtactcagactcttcaaagagtgaattgctctcctgagcatatttcatcaagga

SEQ ID NO: 220822 - DNA, 75 bp, Artificial Sequence
  Synthetic
tgtttgagcacctactcaatgtcgaggggaggccccacctcttcaaagaggggcctgcacagcctccctcttaat

SEQ ID NO: 220823 - DNA, 75 bp, Artificial Sequence
  Synthetic
tctatccatgcataacccatcatcaaatcatgtttaaacattggtctttcaacacctttgtgaataactttttct

SEQ ID NO: 220824 - DNA, 75 bp, Artificial Sequence
  Synthetic
atgttttgagaagtttctggaaccaaaggtgagatttggtcatgtgagcactaatcctgcagacacagccactga

SEQ ID NO: 220825 - DNA, 75 bp, Artificial Sequence
  Synthetic
tcagactcttcaaagagtgaattgctctcctgagcatatttcatcaaggagaatagtgtatctctgagtttgtca

SEQ ID NO: 220826 - DNA, 75 bp, Artificial Sequence
  Synthetic
caccatcccaaaatcccccaccctacagcccctgaggcagaactccgccccgaagcccctcaaacacccctcccc

SEQ ID NO: 220827 - DNA, 75 bp, Artificial Sequence
  Synthetic
aagtggtattaggtttatatcaattgacttcaagtcattctttagttgctctaacttctttaagtcctctaggta

SEQ ID NO: 220828 - DNA, 75 bp, Artificial Sequence
  Synthetic
gacttcaagtcattctttagttgctctaacttctttaagtcctctaggtacttctgctcaaagttcactggggat

SEQ ID NO: 220829 - DNA, 75 bp, Artificial Sequence
  Synthetic
gcttcaaagtaatcctcaatgagccttgtgaacatctttgtccttaaatctccgatgtacaactctctattgcct

SEQ ID NO: 220830 - DNA, 75 bp, Artificial Sequence
  Synthetic
gccatcaggcacaacaaagcataatgatggtgttaaaatccctaattcatggagaattacctcaacagagcgtgc

SEQ ID NO: 220831 - DNA, 75 bp, Artificial Sequence
  Synthetic
gatggtgttaaaatccctaattcatggagaattacctcaacagagcgtgcattgctgttgtgctcacaaccattg

SEQ ID NO: 220832 - DNA, 75 bp, Artificial Sequence
  Synthetic
catcaacaacatcctcggctcagtctgcaccaagaatgccaatttttgtctagataatctctcatcatcagaaag

SEQ ID NO: 220833 - DNA, 75 bp, Artificial Sequence
  Synthetic
atattttgaaacaagatcttttacataagctatctcctcctccattaaagaagttgtcaacaatagagcgtctaa

SEQ ID NO: 220834 - DNA, 75 bp, Artificial Sequence
  Synthetic
acttgccaatattgaatgccatcagaatttgtcaacaatttgattcctttgacatcagaaatcagagactgaatg

SEQ ID NO: 220835 - DNA, 75 bp, Artificial Sequence
  Synthetic
agattataaaaggcctggtgtttcaaagaagtatttatctcttcttacatcctcttttaacaatggttcactatt

SEQ ID NO: 220836 - DNA, 75 bp, Artificial Sequence
  Synthetic
cattctgggttcagtttggaccaaaaaagccaacttctgccttgacagcctctcattatctgcaaggtactttga

SEQ ID NO: 220837 - DNA, 75 bp, Artificial Sequence
  Synthetic
atcatccaggttcacagcacctgagtatattatcttttgtctcagcaccattcttaaaggatgatgcgcagccaa

SEQ ID NO: 220838 - DNA, 75 bp, Artificial Sequence
  Synthetic
caagaaaagtgttgttgttaataaatacacagatggttctagaatattaaactatgacttcaataagctcacagc

SEQ ID NO: 220839 - DNA, 75 bp, Artificial Sequence
  Synthetic
gtaagacagtcaagaataagaatggacacatcatagggccccacttgctatgatccatgctataagacacatgtg

SEQ ID NO: 220840 - DNA, 75 bp, Artificial Sequence
  Synthetic
atggtctccaacatgttccccccatcaagcatacaagctccagctttcactgcagctcctaagctgaagttgtaa

SEQ ID NO: 220841 - DNA, 75 bp, Artificial Sequence
  Synthetic
caaagttcagcaggcaatgagcaatttggttctaggatctgggcagctcaaaagtgatgctgatggggctgacct

SEQ ID NO: 220842 - DNA, 75 bp, Artificial Sequence
  Synthetic
ttccataagagttggtttctatgccaacctccctcaaagcattagtggctcgagttaaaactctgttgatgatgg

SEQ ID NO: 220843 - DNA, 75 bp, Artificial Sequence
  Synthetic
aacctccctcaaagcattagtggctcgagttaaaactctgttgatgatggcaaggagctcacaatttcgttcttc

SEQ ID NO: 220844 - DNA, 75 bp, Artificial Sequence
  Synthetic
ataatgagtgtacctccccataagtgtgttcgcattcatgatcaagagtatggacttaaaacactgaaagtattc

SEQ ID NO: 220845 - DNA, 75 bp, Artificial Sequence
  Synthetic
taatgtcagactgggcatggtgccgaactggttgttcaaaagatctggattcttaacatcccacaccctaacaac

SEQ ID NO: 220846 - DNA, 75 bp, Artificial Sequence
  Synthetic
aggcaattcagctggactttagtggtaaggctcattttggtgaatctctgaatcaaagtgtctagtcaaaatggg

SEQ ID NO: 220847 - DNA, 75 bp, Artificial Sequence
  Synthetic
gtgagcttgttattaatgccctgatgacaactagaaattatttcctcaaagtgttttgcacgcttgtcagttaga

SEQ ID NO: 220848 - DNA, 75 bp, Artificial Sequence
  Synthetic
tcagtatagggaacctgtcaagctaggctcaggccctaatggtgatggccaaccatcaataaatgatctagatga

SEQ ID NO: 220849 - DNA, 75 bp, Artificial Sequence
  Synthetic
agacttcagtgagctgcgatacggccagtgctgtgagcttgttgaagtcatagtttaatactctagaaccatctg

SEQ ID NO: 220850 - DNA, 75 bp, Artificial Sequence
  Synthetic
tgacttcacttccttagaagcactcatcttgatctggatactttgggatttactggttgaaagtattactcagta

SEQ ID NO: 220851 - DNA, 75 bp, Artificial Sequence
  Synthetic
atcttgatctggatactttgggatttactggttgaaagtattactcagtaaatcaatgaaaagcgcaatccaata

SEQ ID NO: 220852 - DNA, 75 bp, Artificial Sequence
  Synthetic
atttagctggactctagtggtaaggctcattttagtgaatccctgaatcaagtgcccagccgtaatgggcaacaa

SEQ ID NO: 220853 - DNA, 75 bp, Artificial Sequence
  Synthetic
gggatcctaggcaattcagctggacttcagtggtgaggctatttcagcaaatccctgaatcaaagtacccagtcg

SEQ ID NO: 220854 - DNA, 75 bp, Artificial Sequence
  Synthetic
taaaggcagcaacacagccgagcgcaccatcaaccgaggcgacccagaacacaacacctccaccgtacaccccat

SEQ ID NO: 220855 - DNA, 75 bp, Artificial Sequence
  Synthetic
gatcccaggaccaacactcccatctccaccacccaccccccacccccggggggaccccccgccgggggccccccc

SEQ ID NO: 220856 - DNA, 75 bp, Artificial Sequence
  Synthetic
gccagtatggcttgtgagtcagttagtagtgcccctcagaagctcccacagaaatgagagacaatatgcctagga

SEQ ID NO: 220857 - DNA, 75 bp, Artificial Sequence
  Synthetic
tgatatcttaccaggtaaattttatgaagaattctgtaatgctgtctatgagaatagtagattgaagcagaagta

SEQ ID NO: 220858 - DNA, 75 bp, Artificial Sequence
  Synthetic
ctggaaaatatcttttaggatcagcataaaatgagcatatctcaccaactttattatcattgatagcatagcact

SEQ ID NO: 220859 - DNA, 75 bp, Artificial Sequence
  Synthetic
gttcccagtagtcctacacctcccatcacataagggaatgtttcttcctcggttctctgataactgattgtaggg

SEQ ID NO: 220860 - DNA, 75 bp, Artificial Sequence
  Synthetic
attcaagtgtcctatttaaaatgggacagatagtgacattcttccaggaagtgcctcatgtaatagaagaggtga

SEQ ID NO: 220861 - DNA, 75 bp, Artificial Sequence
  Synthetic
acatcccctaactgctgtgtatcctttaagaactcattcaccacatctgattcaacaaaccaggctgacctacct

SEQ ID NO: 220862 - DNA, 75 bp, Artificial Sequence
  Synthetic
cacatgggctcacagacccagaatatagtgcctgtacatcattcactacaaactcaccacattgattaacaagtc

SEQ ID NO: 220863 - DNA, 75 bp, Artificial Sequence
  Synthetic
gtctccaacagtcagacagaacacatgggctcacagacccagaatacagtgcttgtacatgattcaccacaaact

SEQ ID NO: 220864 - DNA, 75 bp, Artificial Sequence
  Synthetic
ccatgaatactttcagtgttttaagtccatactcttgatcatgaatgcgaatacacttatggggaggtacactca

SEQ ID NO: 220865 - DNA, 75 bp, Artificial Sequence
  Synthetic
tctggtattgaggttttatgagggaaccaagtgaatgacccaagtgtccttgttgttgctacaaaagaacggaca

SEQ ID NO: 220866 - DNA, 75 bp, Artificial Sequence
  Synthetic
tttccatatctggattccattgtcccccatcactgcttcaacaccttgagtccctagtagctgagtctgtatgga

SEQ ID NO: 220867 - DNA, 75 bp, Artificial Sequence
  Synthetic
gggcctctgacgcacttgctgcctagtgttctgcacaaccctacaaacccagatgctatagaactttggaaagct

SEQ ID NO: 220868 - DNA, 75 bp, Artificial Sequence
  Synthetic
ggctcatgccaaccctgtcctctagcagtttcgaaacagtgggtctcaaggggaagtaatcacaaggattatgtt

SEQ ID NO: 220869 - DNA, 75 bp, Artificial Sequence
  Synthetic
gagcaattcagaggcacttagtaaggctctgtcactgacaaactgtaccacagcaatgttaaagaatttgtgttt

SEQ ID NO: 220870 - DNA, 75 bp, Artificial Sequence
  Synthetic
ctcaatacagagggacaagagtttcaacccttctattaatagcatcctgggctctgtttgcacaagaaatgctaa

SEQ ID NO: 220871 - DNA, 75 bp, Artificial Sequence
  Synthetic
gattcccgtccacccaatctcttacatcagtctcgcagttcaaaaggaatggatcaataggatacttggcataac

SEQ ID NO: 220872 - DNA, 75 bp, Artificial Sequence
  Synthetic
aaggtcccgtaggaggcacaaaggcacaagaggcaattaaaaacaattaaattagatagccttaatgcctaggat

SEQ ID NO: 220873 - DNA, 75 bp, Artificial Sequence
  Synthetic
aagtcagaatcagacaaaggttcaatgcctagaagtttaaacaaattctgtaatgatgttgtgtgttcacctgat

SEQ ID NO: 220874 - DNA, 75 bp, Artificial Sequence
  Synthetic
aagacttgttggacccagcagtgcccactttttgcggttttccatctgactcgagatccacagtagtattctccc

SEQ ID NO: 220875 - DNA, 75 bp, Artificial Sequence
  Synthetic
atcatatggtttgaaagttcactctttatcaaccttattaagagtttttcttccaccaccttgtcaagatcagat

SEQ ID NO: 220876 - DNA, 75 bp, Artificial Sequence
  Synthetic
taaagaacaagtgggtggtaacagagaattatatattggtgatcttagaacaaagatgtttactagacttataga

SEQ ID NO: 220877 - DNA, 75 bp, Artificial Sequence
  Synthetic
gggatcctaggcatttaggattgcgcatttagagatctttgtgtgattgggcttcaccaaatcatggggcaaatc

SEQ ID NO: 220878 - DNA, 75 bp, Artificial Sequence
  Synthetic
ttgctgatacaacattaaatgggatctcaaccattttgtgcatatgccatgttaataatgttgataggtaatctt

SEQ ID NO: 220879 - DNA, 75 bp, Artificial Sequence
  Synthetic
ataacattcttccaagaggtgcctcatgtcatagaggaggtcatgaacatcgtcctaatcgccctcagtctcctg

SEQ ID NO: 220880 - DNA, 75 bp, Artificial Sequence
  Synthetic
atatctgatcgtcactagacgtgtaagcatctatttgtcctccagacacacacttcaccgcaaaatttataaatc

SEQ ID NO: 220881 - DNA, 75 bp, Artificial Sequence
  Synthetic
ttgctacctgtggtctctttgggttgatctcctttcttctcttatgtggcagatcatgttcaacaacctataaag

SEQ ID NO: 220882 - DNA, 75 bp, Artificial Sequence
  Synthetic
ggggctactgtcacaaaggaccagggacatttacatcagtcgaagacttcttgggacttttacttggactctctc

SEQ ID NO: 220883 - DNA, 75 bp, Artificial Sequence
  Synthetic
agatcatgttcaacaacctataaaggtgtctatgagttacaagctctagagctggacatggcaaacctcaacatg

SEQ ID NO: 220884 - DNA, 75 bp, Artificial Sequence
  Synthetic
tccaccatattcagtataggatggctttgggaaagtctatctaggtcggagctatttgggtacttagctgtgtat

SEQ ID NO: 220885 - DNA, 75 bp, Artificial Sequence
  Synthetic
acaatgcccttgtcctgcacgaagaacaatagccaccattatatcatggttggaaatgaaacaggcttggagctg

SEQ ID NO: 220886 - DNA, 75 bp, Artificial Sequence
  Synthetic
ccttccacttatccattccaaacttcaatcagtatgaagcaatgagctgtgactttaatggagggaaaataagtg

SEQ ID NO: 220887 - DNA, 75 bp, Artificial Sequence
  Synthetic
ccttttagtggatccttgaatcaaagtgcccagtgatgggcaacagacaggctaaatcgacaaaagttgatgaac

SEQ ID NO: 220888 - DNA, 75 bp, Artificial Sequence
  Synthetic
tggcagttacatagcacttgattccggaaagggaaactgggattgtataatgacttcctatcaatacttgataat

SEQ ID NO: 220889 - DNA, 75 bp, Artificial Sequence
  Synthetic
cctttccatgaaattgaatgtttcattggcacatgtgtcttatagcatggatcatagtaagtggggcccaatgat

SEQ ID NO: 220890 - DNA, 75 bp, Artificial Sequence
  Synthetic
tgccagttttcccgcccatctccaattggttacctgggactattgtcacagagaactagagatatctacattagt

SEQ ID NO: 220891 - DNA, 75 bp, Artificial Sequence
  Synthetic
attcccattcatcactagcaaaattgacttaaagcactggaaatattcttggtccaaaaaagtcctagtcaccac

SEQ ID NO: 220892 - DNA, 75 bp, Artificial Sequence
  Synthetic
ttggttacctgggactattgtcacagagaactagagatatctacattagtcgaagacttctcggaaccttcacct

SEQ ID NO: 220893 - DNA, 75 bp, Artificial Sequence
  Synthetic
actagatggatgttaattgaagcagaactgaagtgctttgggaacacagcagtcgcaaagtgcaacgagaaacat

SEQ ID NO: 220894 - DNA, 75 bp, Artificial Sequence
  Synthetic
agctcgtctctggtcaagttgctgtgagctcaggttgcccatatagacacctgcactcaatggcctttctgtcct

SEQ ID NO: 220895 - DNA, 75 bp, Artificial Sequence
  Synthetic
tataaggaggctaaaaacagaggcacagatgagtattcagctgataaacaaggcagtgaatgcattaatcaatga

SEQ ID NO: 220896 - DNA, 75 bp, Artificial Sequence
  Synthetic
cttcagtggtgaggcttttcttagtgaatccccaaatcaaagtacccagtaagatgggcaacagacaggctaaat

SEQ ID NO: 220897 - DNA, 75 bp, Artificial Sequence
  Synthetic
taaggccttgctaagtgcttcagaattactctcacgttcacttatcctgacatcatcagctaatcttcctgtatc

SEQ ID NO: 220898 - DNA, 75 bp, Artificial Sequence
  Synthetic
agggacatcatgggaattccttattgcaattacagtaaatattggtatctaaatcactctgtgacagggagaaca

SEQ ID NO: 220899 - DNA, 75 bp, Artificial Sequence
  Synthetic
acaattttctgatgacattgaacaacaggcagacaacatgataacagaaatgttgcagaaagagtatatagacag

SEQ ID NO: 220900 - DNA, 75 bp, Artificial Sequence
  Synthetic
cagaatacgggacccatctgtatacttattcacaacaacactcttattactggccaagtccaaagctgttgcaca

SEQ ID NO: 220901 - DNA, 75 bp, Artificial Sequence
  Synthetic
caccatcaaccgagacgatccagaacacaacacctccaccgtacaccccataaccccaggatcaacactcccctc

SEQ ID NO: 220902 - DNA, 75 bp, Artificial Sequence
  Synthetic
gcttttatctcataagcatctttctccacctgatcaagatcccaactcacagacacatcgtagggaaaccctgtc

SEQ ID NO: 220903 - DNA, 75 bp, Artificial Sequence
  Synthetic
catggtcccgaactgattgttaagcaactctgcatttttcacatcccaaactctcaccactccatctctcccagc

SEQ ID NO: 220904 - DNA, 75 bp, Artificial Sequence
  Synthetic
ctaagccgcacaggcttaaccatatgggcatttgctcatgtggtctatacaaacatcctggtatcccagtcaaat

SEQ ID NO: 220905 - DNA, 75 bp, Artificial Sequence
  Synthetic
gagggactatctctcaaccctacttatgtggcatatgcacaaaatggtggaaataccttttaatgtggtgacagc

SEQ ID NO: 220906 - DNA, 75 bp, Artificial Sequence
  Synthetic
aacattatgcaatccatcaaagcacaatgtggggtgatttcttctttgcctcctcttttcttcttctcaacaact

SEQ ID NO: 220907 - DNA, 75 bp, Artificial Sequence
  Synthetic
aagaagaatcagaacgtcaaaaataaggagaagtttcctcctggtgttgaggatcctcagagactttatcttatt

SEQ ID NO: 220908 - DNA, 75 bp, Artificial Sequence
  Synthetic
ttcaaactttctagagtcaatcttacttaatgaaatatcaatgagttttatgtcccttcttccttgagagtccag

SEQ ID NO: 220909 - DNA, 75 bp, Artificial Sequence
  Synthetic
agatttgtctcataaagttatccactgcatcagcagtactaaccaccctttcttccatcatgggctcatgtgtgc

SEQ ID NO: 220910 - DNA, 75 bp, Artificial Sequence
  Synthetic
tgcagctcctaagctgaagttgtaaccagaaatgttcaaggagctcttcttaatgtccaccatattcagtatagg

SEQ ID NO: 220911 - DNA, 75 bp, Artificial Sequence
  Synthetic
aatcaaatccttgtgataaaagtcggacacaaaggccatcacaaaatacctaatgttttgtaaaaatttttgaca

SEQ ID NO: 220912 - DNA, 75 bp, Artificial Sequence
  Synthetic
taatgttttgtaaaaatttttgacaccttttactgggatgtgttagtatcaaaactaaaatcattttggttaaca

SEQ ID NO: 220913 - DNA, 75 bp, Artificial Sequence
  Synthetic
ttactctaatttccaagctggtgtagtgccttctcacatcagttcaatacttgacatgggtcaaggaatattaca

SEQ ID NO: 220914 - DNA, 75 bp, Artificial Sequence
  Synthetic
cccccatcaagcatacaggccccagcttttactgcagcccccaagctaaaattgtaaccagaaatattcagggag

SEQ ID NO: 220915 - DNA, 75 bp, Artificial Sequence
  Synthetic
cttttactgcagcccccaagctaaaattgtaaccagaaatattcagggagctcttcttagtgtccaccatgttta

SEQ ID NO: 220916 - DNA, 75 bp, Artificial Sequence
  Synthetic
agcacccatgctccaagttctatggctgtggatagtgttatgcacatataatcccatagaagaggtcttaaataa

SEQ ID NO: 220917 - DNA, 75 bp, Artificial Sequence
  Synthetic
aatcccatgatcactcagaatggattcaaccgttttgtcttcagtgttatgttcacatccattggccttgcaaga

SEQ ID NO: 220918 - DNA, 75 bp, Artificial Sequence
  Synthetic
ttctgcaacacatcactggagaaaactgaaggaaaaaaccgtttgggatcagcataaaaggaacaaacctctcca

SEQ ID NO: 220919 - DNA, 75 bp, Artificial Sequence
  Synthetic
ttagctgtgtatatcagtcccaaatccgtcagtgctaggacagcatcatttaggtcaacttgaccttgtttagtg

SEQ ID NO: 220920 - DNA, 75 bp, Artificial Sequence
  Synthetic
ccgtcagtgctaggacagcatcatttaggtcaacttgaccttgtttagtgagacatgccaatgtcagactgggca

SEQ ID NO: 220921 - DNA, 75 bp, Artificial Sequence
  Synthetic
ctaacaaccccatctctcccaggttgggtgccctgagttccaccagccatgccaatcatgttaagcaatgccctt

SEQ ID NO: 220922 - DNA, 75 bp, Artificial Sequence
  Synthetic
tctagcagtttcgaaacagtgggtctcaaggggaagtaatcacaaggattatgtttaaaaaagtccaagatctga

SEQ ID NO: 220923 - DNA, 75 bp, Artificial Sequence
  Synthetic
cctattttgcaaggtttttactattgtagggaccttttcatcttccagattcacagcaccagaatagattatctt

SEQ ID NO: 220924 - DNA, 75 bp, Artificial Sequence
  Synthetic
cagtggtctctctgttctgatgacttttgacttcagtttttctaagtcagctgccaatgtcagcaagtcatctga

SEQ ID NO: 220925 - DNA, 75 bp, Artificial Sequence
  Synthetic
tttgacttcagtttttctaagtcagctgccaatgtcagcaagtcatctgaggtcagtgttccaactctcaggatg

SEQ ID NO: 220926 - DNA, 75 bp, Artificial Sequence
  Synthetic
ctgccaatgtcagcaagtcatctgaggtcagtgttccaactctcaggatgctcttttgttgtgttgatttgagtt

SEQ ID NO: 220927 - DNA, 75 bp, Artificial Sequence
  Synthetic
aatcccaccatcccaaaatcccccaccctacagcccctgaggcagaactccgccccgaagcccctcaaactaccc

SEQ ID NO: 220928 - DNA, 75 bp, Artificial Sequence
  Synthetic
gatagatgcttatacctctagtgatgatcagatttctctctttgatcaatctctcacagagcttttgcaaagaga

SEQ ID NO: 220929 - DNA, 75 bp, Artificial Sequence
  Synthetic
tatgcagtccagccggctagcaagaagaatcagaacgtcaaaaataaggagaagtttcctcctggtgttgaggat

SEQ ID NO: 220930 - DNA, 75 bp, Artificial Sequence
  Synthetic
ctgtcatctctcttttgtttgcgcattaggcgttggacattgttgacttcagagaagtcaaggccgtgaaggagg

SEQ ID NO: 220931 - DNA, 75 bp, Artificial Sequence
  Synthetic
ttaggcgttggacattgttgacttcagagaagtcaaggccgtgaaggagggcttgggcatccttgacaacttgaa

SEQ ID NO: 220932 - DNA, 75 bp, Artificial Sequence
  Synthetic
tacaaacccagatgctatagaactttggaaagctgatttatttattgcttcagacagtagcttctgagctcctct

SEQ ID NO: 220933 - DNA, 75 bp, Artificial Sequence
  Synthetic
caaaggaatgatttcacttctttggaagcactcatcctgatctaagtatcctgaaatttactagttgaagtgttt

SEQ ID NO: 220934 - DNA, 75 bp, Artificial Sequence
  Synthetic
aagaacttaaggactggagaggctcttcggaattggaatgttaactgttcaatgttgtcatcacaggtgtctatt

SEQ ID NO: 220935 - DNA, 75 bp, Artificial Sequence
  Synthetic
aagcactcatcctgatctaagtatcctgaaatttactagttgaagtgtttcacccagtaaatcaataataggcgc

SEQ ID NO: 220936 - DNA, 75 bp, Artificial Sequence
  Synthetic
cattactttcttgtgaatattttaacaaggtaaataaggtgtctctgagtttatcgttcacccagtcaggtatct

SEQ ID NO: 220937 - DNA, 75 bp, Artificial Sequence
  Synthetic
taatgggggaaagattagtgtgcagtacaacctgagtcacagctatgccgtggatgcagccagccattgtggcac

SEQ ID NO: 220938 - DNA, 75 bp, Artificial Sequence
  Synthetic
ggtgggtcacgggggcgtccgtttacaggacgaccttggggcttgaggttctaaaaaccatgtctctgggaagga

SEQ ID NO: 220939 - DNA, 75 bp, Artificial Sequence
  Synthetic
ccagagatatttatatcagtagaagactactaggcacattcacatggacattgtcagattctgaaggcaaggaca

SEQ ID NO: 220940 - DNA, 75 bp, Artificial Sequence
  Synthetic
tgagtttgtagccgtcaggtaccacaaagcataaagctggagtgagaatcccatgatcactcagaatggattcaa

SEQ ID NO: 220941 - DNA, 75 bp, Artificial Sequence
  Synthetic
aaagcataaagctggagtgagaatcccatgatcactcagaatggattcaaccgttttgtcctcagtgttgtgttc

SEQ ID NO: 220942 - DNA, 75 bp, Artificial Sequence
  Synthetic
gtttgggtttgtgccagtatggcttgtgggtcaactgatggtgctccacaaaggctcctacagaaatgagagaca

SEQ ID NO: 220943 - DNA, 75 bp, Artificial Sequence
  Synthetic
acaccagggggatattgtctgactagatggatgctaattgaggctgaactaaaatgcttcgggaacacagctgtg

SEQ ID NO: 220944 - DNA, 75 bp, Artificial Sequence
  Synthetic
tccattgtcagttgtggcacctgtgttggacttgggcttgtacctgtatggcgtgtgggtcagctggcagtgccc

SEQ ID NO: 220945 - DNA, 75 bp, Artificial Sequence
  Synthetic
ttggacttgggcttgtacctgtatggcgtgtgggtcagctggcagtgccccacaaaagctcccacagagatgaga

SEQ ID NO: 220946 - DNA, 75 bp, Artificial Sequence
  Synthetic
cctcacagactgaatcacatgggcatttgttcctgtgggctttataaacagcctggtgtgcctgtaaaatggaag

SEQ ID NO: 220947 - DNA, 75 bp, Artificial Sequence
  Synthetic
tgtgtcggatttgggtttatgccaatatggcctgtagatcagctggtgatgccccacaaaagctcttacagaaat

SEQ ID NO: 220948 - DNA, 75 bp, Artificial Sequence
  Synthetic
actctggaactggacatggcaagcctcaatatgacaatgcccttatcctgcacgaagaataacagccaccactac

SEQ ID NO: 220949 - DNA, 75 bp, Artificial Sequence
  Synthetic
ccggggatcctaggcatttttggttgcgcaatttaagtgttttgtttaaaatgggacagatagtgacattcttcc

SEQ ID NO: 220950 - DNA, 75 bp, Artificial Sequence
  Synthetic
cattgatcagtcggttgcgaatggtgtccctgttcacttatgtaatctaatacagaaaagaaccttaaatccttt

SEQ ID NO: 220951 - DNA, 75 bp, Artificial Sequence
  Synthetic
taacattgctgtagtacagttagttagggacaaggccttgctaagtgcttcagaattactctcacgttcacttat

SEQ ID NO: 220952 - DNA, 75 bp, Artificial Sequence
  Synthetic
cttgtagagtatgttttcataaggattcctttcaccaggggtgtctgaaatgaacatccctagagcctttttgac

SEQ ID NO: 220953 - DNA, 75 bp, Artificial Sequence
  Synthetic
cagaagcacagatgagcatccaactgataaacaaagcagtgaacgcattaattaatgaccagttgatcatgaaga

SEQ ID NO: 220954 - DNA, 75 bp, Artificial Sequence
  Synthetic
gcaaacacttcagttaactgtgtgacagccagagctgtaagtttgttgaagtcataatccagaatacgggaccca

SEQ ID NO: 220955 - DNA, 75 bp, Artificial Sequence
  Synthetic
ttttaatattggtgatgctcttttgaactgataaattaaatgttcaatattgtcttttgtatcaactttgtcagt

SEQ ID NO: 220956 - DNA, 75 bp, Artificial Sequence
  Synthetic
ttgttcaccgcttgattcaggtctctcaaccgtttcaaatcattgtcatccctcctctccttgcgcatcaaccgt

SEQ ID NO: 220957 - DNA, 75 bp, Artificial Sequence
  Synthetic
gataagctttatgtctcttctcccttgagaatccaagagtttcttaatgtcatctgacccttgacaggtcagcac

SEQ ID NO: 220958 - DNA, 75 bp, Artificial Sequence
  Synthetic
attgccagattgttgtattgagtgcacgtgataaaactgaaactatttgccaaaatgacaaaagcaaagcgcaat

SEQ ID NO: 220959 - DNA, 75 bp, Artificial Sequence
  Synthetic
gtacctaatgttttgtaaaaatttttgacaccttttactaggatgtgtcagtatcaaaactaaaatcattttggt

SEQ ID NO: 220960 - DNA, 75 bp, Artificial Sequence
  Synthetic
agcatcttgactcttaatacgaaacctcactgtctgactcaattttgcagaccctgagggtagtaaagcaacagc

SEQ ID NO: 220961 - DNA, 75 bp, Artificial Sequence
  Synthetic
gttgttcttcttttgaggccttgtgcgctaaacttctccaaatgggaaacaagcaaaccaaagccccagaatcaa

SEQ ID NO: 220962 - DNA, 75 bp, Artificial Sequence
  Synthetic
caatgtctatccaggttttagcgcttgggtcaagctgcatcattgagtccttaagtgtcatcaactgagaatagg

SEQ ID NO: 220963 - DNA, 75 bp, Artificial Sequence
  Synthetic
cagttctgcaagagctgctggttcgaaaacaagggcctggttgagtgcaacaaccactatctgtgtctcaactgc

SEQ ID NO: 220964 - DNA, 75 bp, Artificial Sequence
  Synthetic
tagtctgttcctaaaaacctgatattcttcctcaatctgcagctttacttcatgagctgtcaacttattattgat

SEQ ID NO: 220965 - DNA, 75 bp, Artificial Sequence
  Synthetic
caaccactatctgtgtctcaactgcctcaccttacttctaagtgtcagcaacaggtgccccatttgcaagatgcc

SEQ ID NO: 220966 - DNA, 75 bp, Artificial Sequence
  Synthetic
gtacccattttttgtggtttgccatctgactcgagatccacagtagtattttcccaagctctacctacaatagag

SEQ ID NO: 220967 - DNA, 75 bp, Artificial Sequence
  Synthetic
atacaacctgggaagatcactgccaattctcgagaccatctcccatcggttatctcgggctcctctcacaaagga

SEQ ID NO: 220968 - DNA, 75 bp, Artificial Sequence
  Synthetic
catcgccaaattgttgtgctggatacacgcagcagaaagctgagactatctgctaaaatgacaaaagcaaagcgc

SEQ ID NO: 220969 - DNA, 75 bp, Artificial Sequence
  Synthetic
cacgcagcagaaagctgagactatctgctaaaatgacaaaagcaaagcgcaatccaatagcctaggatccactgt

SEQ ID NO: 220970 - DNA, 75 bp, Artificial Sequence
  Synthetic
aagtatgttctcataagggttcctctcaccaggtgtatctgaaacaaacattcccaaagatcttttcacctttaa

SEQ ID NO: 220971 - DNA, 75 bp, Artificial Sequence
  Synthetic
gttctattctttgagacattgtgcgctgaactcctccaaatggggaacaagcaaaccaaaacctcagaagtaaaa

SEQ ID NO: 220972 - DNA, 75 bp, Artificial Sequence
  Synthetic
ggttcttgatgcaatatatggccatccatctcctgacaaacaaatcttgtagagtatgttctcataaggattcct

SEQ ID NO: 220973 - DNA, 75 bp, Artificial Sequence
  Synthetic
tcaccaggtgtatctgaaacaaacattcccaaagatcttttcacctttaaaatagacttcaagatgccatccatt

SEQ ID NO: 220974 - DNA, 75 bp, Artificial Sequence
  Synthetic
caccatgttcagtataggatgactttgggagagtctgtccaggtcagagctgtttggatacttggctgtgtatat

SEQ ID NO: 220975 - DNA, 75 bp, Artificial Sequence
  Synthetic
tgggagagtctgtccaggtcagagctgtttggatacttggctgtgtatattagacctaagtctgttagtgccaag

SEQ ID NO: 220976 - DNA, 75 bp, Artificial Sequence
  Synthetic
agcacggagacaatgtccacccctgaccactgcacccttaatcccagcctgtctatcatcatgtcactcaatgcc

SEQ ID NO: 220977 - DNA, 75 bp, Artificial Sequence
  Synthetic
cggggatcctaggcaatttaactgcacttcagtggtaaagctcattctagtgaatccctgagttaaagtgtgtag

SEQ ID NO: 220978 - DNA, 75 bp, Artificial Sequence
  Synthetic
gttcccagtagttccacatcccccatcacataagggaatgtttcttcctctgttctctgataactgattgtgggg

SEQ ID NO: 220979 - DNA, 75 bp, Artificial Sequence
  Synthetic
gtaaaagatgccaatttctttccacattcccacaagcctcccctatgcacaaccagaggggctggttcagtgcaa

SEQ ID NO: 220980 - DNA, 75 bp, Artificial Sequence
  Synthetic
tgatgagaagattcctaccattgtcaaaacaatccaaaataagttgtcttccactttcactcgaggtgcgcaaaa

SEQ ID NO: 220981 - DNA, 75 bp, Artificial Sequence
  Synthetic
aaggagaagtttcctcctggtgttgaggatcctcagagactttatcttatttagaaaagatctccaacactgcat

SEQ ID NO: 220982 - DNA, 75 bp, Artificial Sequence
  Synthetic
tgtgtctcaactgtctcagtctgctcctcagcgtcagcagcagatgcccgatctgcaagatgccccttcccacca

SEQ ID NO: 220983 - DNA, 75 bp, Artificial Sequence
  Synthetic
aagttgctgtgagctcaggttacccatgtagacacctgcactcaatggcctttctgtcctgatcacctttgattt

SEQ ID NO: 220984 - DNA, 75 bp, Artificial Sequence
  Synthetic
cgcaccctcaaccgaggcgacccagaacacaacacctccaccgtacaccccatgatcccaggaccaacaccctca

SEQ ID NO: 220985 - DNA, 75 bp, Artificial Sequence
  Synthetic
aacacaacacctccaccgtacaccccatgatcccaggaccaacaccctcacctccaccacccaccccccaccccc

SEQ ID NO: 220986 - DNA, 75 bp, Artificial Sequence
  Synthetic
caccagggggatattgtctgaccaggtggatgctaattgaggctgaactaaaatgcttcgggaacacagctgtgg

SEQ ID NO: 220987 - DNA, 75 bp, Artificial Sequence
  Synthetic
atcttgacactctgggatttactggttgaaggtatcacccaatgagtcaatgaaaagcgcaatccaatagcctag

SEQ ID NO: 220988 - DNA, 75 bp, Artificial Sequence
  Synthetic
ataccatgcggatgtgcccttaaaagtgggccccgacaagaccaacctccagcagtctgacaaaacacacggact

SEQ ID NO: 220989 - DNA, 75 bp, Artificial Sequence
  Synthetic
cagattgttgtattgaatgcacgcagcagaaagctgaaactgtctgccaaagtgacaagagcaaagcgcaatcca

SEQ ID NO: 220990 - DNA, 75 bp, Artificial Sequence
  Synthetic
tttagtgaattcctgaatcaaagtgcctagccagaatgggcaacaggcaggccaaacagaccaaagtcgacgaac

SEQ ID NO: 220991 - DNA, 75 bp, Artificial Sequence
  Synthetic
gccggggatcctaggcaatttagacgttcttctttttgaagccttgtgtgctaagctcctccaaatgggaaacaa

SEQ ID NO: 220992 - DNA, 75 bp, Artificial Sequence
  Synthetic
ggggatcctaggcaatttggttattctttttgaggttttgtgtgctatactcttccaaatgggaaacaagcaagc

SEQ ID NO: 220993 - DNA, 75 bp, Artificial Sequence
  Synthetic
gagggttggtagagtgcaacaaccattacctatgtctcaactgtctcagcttacttctcagcatcagcagcaggt

SEQ ID NO: 220994 - DNA, 75 bp, Artificial Sequence
  Synthetic
acagcatcaaagaaatcctccaatgagtcaaacttgggatcaactaaacctgatgcaatcaattgattttgatta

SEQ ID NO: 220995 - DNA, 75 bp, Artificial Sequence
  Synthetic
ctccacccctgacaatctacctgaagtcatagataaagattcacagagtctgctatactctgactcttcaaaaag

SEQ ID NO: 220996 - DNA, 75 bp, Artificial Sequence
  Synthetic
cccaggacacaacacctccaccatacaccccatgatcccaagaccaacactcccatcctcacctcccacccccca

SEQ ID NO: 220997 - DNA, 75 bp, Artificial Sequence
  Synthetic
tgttcacatccattggccttgcaagagtcaatctcaatgcaaagagatagtagtttcaatccctccatgagcaac

SEQ ID NO: 220998 - DNA, 75 bp, Artificial Sequence
  Synthetic
cctcgatgcattcatccctcctagttaactcttcacatgttctgcccttcagtctcaacttgccactacttgatt

SEQ ID NO: 220999 - DNA, 75 bp, Artificial Sequence
  Synthetic
cccccggggggaccccccgccgggggcccccccggggggcgggcggctcggctctactcgatgtcctcaacatgc

SEQ ID NO: 221000 - DNA, 75 bp, Artificial Sequence
  Synthetic
gtatcatcaccttcccttttgacttactataacagagagcataacccttgaattccacccagctgtccactgctt

SEQ ID NO: 221001 - DNA, 75 bp, Artificial Sequence
  Synthetic
gaggtcccgtagggggcacagaggacacaagagtcaattgaagtcaattaaaggcaattaaattagatagcctta

SEQ ID NO: 221002 - DNA, 75 bp, Artificial Sequence
  Synthetic
ccacttccatttctgagttctagcgggacttgccaatattgaatgccattagaatttgtcaacaatttgattcct

SEQ ID NO: 221003 - DNA, 75 bp, Artificial Sequence
  Synthetic
cacccttctatcagattcccacagtgctcccctgcatacaaccaatggcactggttcatcatcaggtccaacctt

SEQ ID NO: 221004 - DNA, 75 bp, Artificial Sequence
  Synthetic
cccaatgttctgcataatcccacaaagccagatgcaatggagctttggaatgcagatttgttgatggcttcagac

SEQ ID NO: 221005 - DNA, 75 bp, Artificial Sequence
  Synthetic
tcatcatctaggttcacagcacctgaatatattatcttttgtctcaacaccattcttaagggatgatgcgcagcc

SEQ ID NO: 221006 - DNA, 75 bp, Artificial Sequence
  Synthetic
cattcttaagggatgatgcgcagccaggtttaaccaagaatactcaaggtcagactcagatgggggctcaacatc

SEQ ID NO: 221007 - DNA, 75 bp, Artificial Sequence
  Synthetic
tggtccccgaacacatttgctgcccagtgttctacacaatcccacaaagccagatgctatggaactttggaatgc

SEQ ID NO: 221008 - DNA, 75 bp, Artificial Sequence
  Synthetic
tggaaaaagtctctttaaaactagcatcctgacttttgattttatacctaattgtctggtggaactgaacagagt

SEQ ID NO: 221009 - DNA, 75 bp, Artificial Sequence
  Synthetic
agtttgttgtgaactcttcatggagttgcccagtcttcaacctattgtacagtttccttaacatagatctaatct

SEQ ID NO: 221010 - DNA, 75 bp, Artificial Sequence
  Synthetic
gaacctctatgaccacgctcttatgagcataatctcaactttccacttgtccatccccaacttcaatcagtatga

SEQ ID NO: 221011 - DNA, 75 bp, Artificial Sequence
  Synthetic
gatggcaaagctttctttaaagctagcatcttggcttttaatacggaacctcactgtttgactcagtttcgcaga

SEQ ID NO: 221012 - DNA, 75 bp, Artificial Sequence
  Synthetic
acagcatcaaagaaatcctccaatgagttaaacttagcatcaactaaacctgatgcaatcaattgattttgattg

SEQ ID NO: 221013 - DNA, 75 bp, Artificial Sequence
  Synthetic
ttgcccagtcttcaacctattgtacagtttccttaacatagatctaatcttgctgcaagcattaggaatcaatcc

SEQ ID NO: 221014 - DNA, 75 bp, Artificial Sequence
  Synthetic
cctccatcataggctcatgtgtgcgagagtgtgagttcctcagctcagaagccaacacaacatagtgctcctccc

SEQ ID NO: 221015 - DNA, 75 bp, Artificial Sequence
  Synthetic
tgactattttcccttaaagccaactgcatcaaaactattggaggatagggttggtttgaatcacatcattcattc

SEQ ID NO: 221016 - DNA, 75 bp, Artificial Sequence
  Synthetic
tgatggcataattaatgaacctctctgaaatgagagcataaaaatctgatgtattgtgtaatatcccttgaccca

SEQ ID NO: 221017 - DNA, 75 bp, Artificial Sequence
  Synthetic
aatggtaatatatgcttctcaaataaagatggatataaacgtctcaaagaatgaataatgtggctcatgcctacc

SEQ ID NO: 221018 - DNA, 75 bp, Artificial Sequence
  Synthetic
tgaatgatgtgattcaaaccaaccctatcctccaatagttttgatgcagttggcttcaagggaaaatagtcacaa

SEQ ID NO: 221019 - DNA, 75 bp, Artificial Sequence
  Synthetic
gggattatgcttaaaaaagtccaaggtctgagcttgttttggttccccaagcacccatgctccaagttctatagc

SEQ ID NO: 221020 - DNA, 75 bp, Artificial Sequence
  Synthetic
tagcctctcaatttgcctcattatcctataactacgatttccgtccacccaatctctcacatcagtctcgcagtt

SEQ ID NO: 221021 - DNA, 75 bp, Artificial Sequence
  Synthetic
tcccacaggagaggtcttaaataagaaacaacagcatcaccaccatctttggcttccggtgaaaccttccatatc

SEQ ID NO: 221022 - DNA, 75 bp, Artificial Sequence
  Synthetic
acttaatatacagattctccttgtttggtccccgaacacatttgctgcctaatgttctacacaatcccacaaagc

SEQ ID NO: 221023 - DNA, 75 bp, Artificial Sequence
  Synthetic
tgccaatgaaacattcaatttcatggaaaggatagcattctcaaattccttctcgttgttcaggcaactccctga

SEQ ID NO: 221024 - DNA, 75 bp, Artificial Sequence
  Synthetic
gcaacaaattttgttagcaggggtacctcatcaccccaaacatagaaccttgatttgaactctgcaacaaacctg

SEQ ID NO: 221025 - DNA, 75 bp, Artificial Sequence
  Synthetic
ttgcttcagacagtagcttctgagctcctctagtgaatgttgatgacaacctattttgcaaggtttttactattg

SEQ ID NO: 221026 - DNA, 75 bp, Artificial Sequence
  Synthetic
ccaattgcactctttgggctcacaaatttatttagctgatcactcatgtagtaatggaattctaacaatgttttg

SEQ ID NO: 221027 - DNA, 75 bp, Artificial Sequence
  Synthetic
tacagcaccagaatagattatcttctgtcgcaacaccattctgagcggatgatgggtagctaaattcaaccaatg

SEQ ID NO: 221028 - DNA, 75 bp, Artificial Sequence
  Synthetic
atttgaaaattggagtaaaagaaatcttctgttattgactgtttagtcttcttccttaaccctagttgagcttta

SEQ ID NO: 221029 - DNA, 75 bp, Artificial Sequence
  Synthetic
acaaagatttcttagtgaagagaggtgctcactagacaaatagtttgttgtgaactcttcatggagttgcccagt

SEQ ID NO: 221030 - DNA, 75 bp, Artificial Sequence
  Synthetic
gggtcaagttgcagcattgcatccttgagggtcatcagctgagaataggtaagcccagcggtaaaccctgccgac

SEQ ID NO: 221031 - DNA, 75 bp, Artificial Sequence
  Synthetic
ggcaaagctttccttaaaactagcatcttgactcttaatacggaacctcactgtctgactcagttttgcagatcc

SEQ ID NO: 221032 - DNA, 75 bp, Artificial Sequence
  Synthetic
cataacccatcatcagatcatgtttaaacattggcctttcaacacctttgtgaataactttctctacaaatgaag

SEQ ID NO: 221033 - DNA, 75 bp, Artificial Sequence
  Synthetic
tcgtctaggtcagccccgtcagcatcacctttgggctgcctagatcctaaaaccaaattactcattgcctgttga

SEQ ID NO: 221034 - DNA, 75 bp, Artificial Sequence
  Synthetic
caagctcctgccttcacagctgcacccaagctaaaattataacctgagatattcaaagagcttttcttggtgtca

SEQ ID NO: 221035 - DNA, 75 bp, Artificial Sequence
  Synthetic
gacacatgaacccatggtggaagaaagagtagtgagcactagtgatgctgttgacaatttcatgaggcaaattta

SEQ ID NO: 221036 - DNA, 75 bp, Artificial Sequence
  Synthetic
ctaatgtgtgaagggactgtgccaatctgaaaattggagttaaaaaagtcttcagtcattgattgagttgtcttt

SEQ ID NO: 221037 - DNA, 75 bp, Artificial Sequence
  Synthetic
accccacttactgtgatccatactatatgatacatgtgctgacgagacattcaacttcattgacaagatggcatt

SEQ ID NO: 221038 - DNA, 75 bp, Artificial Sequence
  Synthetic
ttttatcaaccttatcaagagtttttcttccaccaccttgtcaagatcagatattgagggtgcattgcagtctgc

SEQ ID NO: 221039 - DNA, 75 bp, Artificial Sequence
  Synthetic
gaaatggcacatgtaggaaacattcaaaatgaacttaaacctattagtcatcatgctcttcacatcctcagataa

SEQ ID NO: 221040 - DNA, 75 bp, Artificial Sequence
  Synthetic
aagaggacgtaaggagggataaatacttctttgaaacaccaggccttttatagtctggtccctcaacacttgtac

SEQ ID NO: 221041 - DNA, 75 bp, Artificial Sequence
  Synthetic
gtgcttcagaattgctctcacgttcacttattctaacatcatcagccaaccttcctgtatcaaatttaaagttca

SEQ ID NO: 221042 - DNA, 75 bp, Artificial Sequence
  Synthetic
actgaaaatattcttggtccaaaaaagtccttgttaccactgcttttgtcagctcacttatgggacatgagttca

SEQ ID NO: 221043 - DNA, 75 bp, Artificial Sequence
  Synthetic
gagctgttctcggagcacccactcaatgtcgaggggaggccccacctcttcaaagaggggcctgcacagcctccc

SEQ ID NO: 221044 - DNA, 75 bp, Artificial Sequence
  Synthetic
taagattttggaggaacttttgagagcgtttactagggtgagctaaaattaaaattaagatcatctttgtcaaag

SEQ ID NO: 221045 - DNA, 75 bp, Artificial Sequence
  Synthetic
aagtatgtccttgttgacactgcctttgtcaactctccaatggggcattgtgacatatgtccacagtaaaaatac

SEQ ID NO: 221046 - DNA, 75 bp, Artificial Sequence
  Synthetic
gtgatgaacattgtcctcattgcgctgtctatattagcagtgctgaaaggtctgtacaactttgcaacatgtggc

SEQ ID NO: 221047 - DNA, 75 bp, Artificial Sequence
  Synthetic
taacaggtgtaaaggatgccaatttcctcccacattcccacaagcctcccctatgcacaactagaggggctggtt

SEQ ID NO: 221048 - DNA, 75 bp, Artificial Sequence
  Synthetic
acacacggactcactgcacctgagtacataacggttacatcatgtactaaatacttggcttgttgattcattgag

SEQ ID NO: 221049 - DNA, 75 bp, Artificial Sequence
  Synthetic
ggtccctcaacacttgtgcatccatctttacttaaaaacttttttgcattgtagaccatgtcatccaattcttcc

SEQ ID NO: 221050 - DNA, 75 bp, Artificial Sequence
  Synthetic
gtccttatgatgataatctgacacataagccattataaagtacctaagattttggaggagcttttgagaacgttt

SEQ ID NO: 221051 - DNA, 75 bp, Artificial Sequence
  Synthetic
taggatcagcataaaaggaacaaacttctccaactgtattgttgttgatagcataacactttgagcattcacctg

SEQ ID NO: 221052 - DNA, 75 bp, Artificial Sequence
  Synthetic
tatcctattgatagagaactcttggcagtaagcctctttgcacctcacaacctggtatctagaggctccaaattc

SEQ ID NO: 221053 - DNA, 75 bp, Artificial Sequence
  Synthetic
tgtgttcagcacaagtttctatctcatcagcatcttccttcacctagtcaaaataccaactcataggcatattgt

SEQ ID NO: 221054 - DNA, 75 bp, Artificial Sequence
  Synthetic
ttttaaggaaagctttgccatccaccttgagtatactggctcaatgaatcaacaggccaagtatctagtacatga

SEQ ID NO: 221055 - DNA, 75 bp, Artificial Sequence
  Synthetic
gacgttttcattgagttgatcagagccaagcttaatgttgatagtctttctaagtccgttgtatctagaatatca

SEQ ID NO: 221056 - DNA, 75 bp, Artificial Sequence
  Synthetic
cacccagttctattgcagttgataaggagatacacatataatcccataacaagggtctgaaataactgaccacac

SEQ ID NO: 221057 - DNA, 75 bp, Artificial Sequence
  Synthetic
ataacaccaagagtataagggaacatgtcttcctgagttctctggtaactcatagtgggtgtaacaccggaaacc

SEQ ID NO: 221058 - DNA, 75 bp, Artificial Sequence
  Synthetic
tgtccactaggtactttgatactaagtctttgacacaggctatgtcttcctccatgtttcgctgcaggtatgatg

SEQ ID NO: 221059 - DNA, 75 bp, Artificial Sequence
  Synthetic
tccatgtttcgctgcaggtatgatggtcagagccctcagaacatgtggtctgctagagcaacaattcactatagg

SEQ ID NO: 221060 - DNA, 75 bp, Artificial Sequence
  Synthetic
ccaacctcccttagagcattggtggctcgagtcaaaactctgtcaatgattgcaaggagctcactattccgttct

SEQ ID NO: 221061 - DNA, 75 bp, Artificial Sequence
  Synthetic
atcataactgttaaggcaaatcacctccatatcaatcttatagtggtcgacactgatcccaacatcctttaaagc

SEQ ID NO: 221062 - DNA, 75 bp, Artificial Sequence
  Synthetic
ttctctttatttggtccccgaacacatttgctacccaatgttctgcataatcccacaaagccagatgcaatggaa

SEQ ID NO: 221063 - DNA, 75 bp, Artificial Sequence
  Synthetic
atgaggcctcgtaagaagcacagaagacacaagatgaaattaaagacaatttaattagatagccttaatgcctag

SEQ ID NO: 221064 - DNA, 75 bp, Artificial Sequence
  Synthetic
ttgcgcttttagagatctttgtgtgagtaggcttcatcaagccatgggacaaatcataacatttttccaggaagt

SEQ ID NO: 221065 - DNA, 75 bp, Artificial Sequence
  Synthetic
ggctagcaagaagaattagaacgtcaaaaacaaggaggagtttcctcctggtgttaaggatcctcagagacttta

SEQ ID NO: 221066 - DNA, 75 bp, Artificial Sequence
  Synthetic
ttgtcctgccgtctatgagagggatgagattgatgccaacagactccaaatcattctttaattgttctagtttct

SEQ ID NO: 221067 - DNA, 75 bp, Artificial Sequence
  Synthetic
aaaaacaaggaggagtttcctcctggtgttaaggatcctcagagactttaccttattcagaaaggatctccagca

SEQ ID NO: 221068 - DNA, 75 bp, Artificial Sequence
  Synthetic
aatctgcatacaagaacttaaggacaggagaagctcttcgaaattggtatgtcaactgttcaatgttgtcattac

SEQ ID NO: 221069 - DNA, 75 bp, Artificial Sequence
  Synthetic
gcgcttttagagatctttgtgtgagtgagcttcatcaagccatgggacaaatcataacatttttccaggaagtac

SEQ ID NO: 221070 - DNA, 75 bp, Artificial Sequence
  Synthetic
tactttcaagggcaaatcagcatggtatgttgacaccgagatcattaatgagtttttaattgacacaaatcaact

SEQ ID NO: 221071 - DNA, 75 bp, Artificial Sequence
  Synthetic
ctcaatattggcgatgctctcttgaactgataaattaagtgttcgatattgtcttctgcagctaccttatcagcg

SEQ ID NO: 221072 - DNA, 75 bp, Artificial Sequence
  Synthetic
atcaatccctctatttgcctcataattctataactacggttgccatctacccagtctctgacatctgtctcgcaa

SEQ ID NO: 221073 - DNA, 75 bp, Artificial Sequence
  Synthetic
accttatcagtcttaacaaactggctttctatgtccccttgccttagtttgttcctgaagatttgatattcctcc

SEQ ID NO: 221074 - DNA, 75 bp, Artificial Sequence
  Synthetic
tcttcctccatcgccaattgtggcacctgtgttggctttaggcttatgcctgtgtggcttgtaaatcagctagtg

SEQ ID NO: 221075 - DNA, 75 bp, Artificial Sequence
  Synthetic
cctgtgttggctttaggcttatgcctgtgtggcttgtaaatcagctagtggtgctccaaaaaactactacagaaa

SEQ ID NO: 221076 - DNA, 75 bp, Artificial Sequence
  Synthetic
ataatccaaaacaccacttgggaagatcactgccagttttctcgcccatcccccatcggttatctggggctactg

SEQ ID NO: 221077 - DNA, 75 bp, Artificial Sequence
  Synthetic
tcacaaaggaccagggacatttacatcagtcgaagacttcttgggacttttacttggactctctctgattctgaa

SEQ ID NO: 221078 - DNA, 75 bp, Artificial Sequence
  Synthetic
tttcttgtgatcttctaaatacttttgttcaaaattagcaggggatgatctaacaaagcactcaagtaaaattag

SEQ ID NO: 221079 - DNA, 75 bp, Artificial Sequence
  Synthetic
ttatgagcataatctcaactttccacttgtccatccccaacttcaatcagtatgaggcaatgagctgcgatttta

SEQ ID NO: 221080 - DNA, 75 bp, Artificial Sequence
  Synthetic
gggtccttgcactgaaccaacccccctggttgtgcataggggaggcttgtgggaatgtggaaagaaattggcatc

SEQ ID NO: 221081 - DNA, 75 bp, Artificial Sequence
  Synthetic
agaaccctcagaacatgtggtctgctggaacagcaattggctgtgggacaaggtcccgtggggggcgcagagtac

SEQ ID NO: 221082 - DNA, 75 bp, Artificial Sequence
  Synthetic
cagtacctgtgctgggcttaaacttgtgtttgtgtggctcgtagatcagtcaatggtgccccaaaaaaagcctcc

SEQ ID NO: 221083 - DNA, 75 bp, Artificial Sequence
  Synthetic
ccgccgggggcccccccgggggagccaaccatcttcaaaagactactcaatgtcctcgatgcattcatccctcct

SEQ ID NO: 221084 - DNA, 75 bp, Artificial Sequence
  Synthetic
tcttcccacaaaactgagaccatcaaccactccaacagcaccttcaactggagcagcggacagcatcagaccccc

SEQ ID NO: 221085 - DNA, 75 bp, Artificial Sequence
  Synthetic
ccggggatcctaggcatttttggttgcgcaattgaagcgtctttcccaaaatggggcaaatagtaacatttttcc

SEQ ID NO: 221086 - DNA, 75 bp, Artificial Sequence
  Synthetic
atggggcaaatagtaacatttttccaggaagttcctcatgtgatagaggaagtgatgaacattgtactcatcgca

SEQ ID NO: 221087 - DNA, 75 bp, Artificial Sequence
  Synthetic
ggttagtagatctttttgtcttcagcaccagcttttatctcattagcatcttcctccacctggttaaaatcccaa

SEQ ID NO: 221088 - DNA, 75 bp, Artificial Sequence
  Synthetic
cactcatcgccagattgttgtgctggatgcgcgcaacaaaaagctgaggctatctgctaaaatgataaaagcaaa

SEQ ID NO: 221089 - DNA, 75 bp, Artificial Sequence
  Synthetic
cttcaaagtaatcctctataagtctagtgaacatctttgtcctaagatcaccaatgtataattctctgttgccac

SEQ ID NO: 221090 - DNA, 75 bp, Artificial Sequence
  Synthetic
aacagttcactttaagacaaggtcccgtaggaggcacagaagacacaagaggtaattaaagacaattaattagat

SEQ ID NO: 221091 - DNA, 75 bp, Artificial Sequence
  Synthetic
gacaggcaagggaaaacacccttagggttagtagatctttttgtcttcagcaccagcttttatctcattagcatc

SEQ ID NO: 221092 - DNA, 75 bp, Artificial Sequence
  Synthetic
ttgtctatactagcagtgctaaaaggactgtacaatgttgcaacatgtggccttattggcttggtcaccttcctc

SEQ ID NO: 221093 - DNA, 75 bp, Artificial Sequence
  Synthetic
ccattatataagggtaggcaatgacacaggacttgaactgaccctaaccaacacaagcattatccaacacaaatt

SEQ ID NO: 221094 - DNA, 75 bp, Artificial Sequence
  Synthetic
ccaccagaaatcccaccatcccaaaatcccccaccctacagcccctgaggcagaactccgccccgaagcccctcc

SEQ ID NO: 221095 - DNA, 75 bp, Artificial Sequence
  Synthetic
atcaaccacaagttttgtaacctttctgatgcacataaaaagaatctttatgaccatgctttaatgagtatcatc

SEQ ID NO: 221096 - DNA, 75 bp, Artificial Sequence
  Synthetic
gcagccagccattgtgggacagttgcaaatggtgttctgcaaactttcatgagaatggcttggggtgggagctat

SEQ ID NO: 221097 - DNA, 75 bp, Artificial Sequence
  Synthetic
tatgacaatgcccttatcctgcacgaagaacaacagccaccactacatcatggttggaaatgagactggcttgga

SEQ ID NO: 221098 - DNA, 75 bp, Artificial Sequence
  Synthetic
gattggggcattgagtgatatgatgatagacaggctggggttaaggatgcagtggtcaggggtggacattgtctc

SEQ ID NO: 221099 - DNA, 75 bp, Artificial Sequence
  Synthetic
caaatggtgttctgcaaactttcatgagaatggcttggggtgggagctatattgctcttgactctggtcgtggca

SEQ ID NO: 221100 - DNA, 75 bp, Artificial Sequence
  Synthetic
ggagggtactgtctgaccagatggatgttaattgaggctgaactaaaatgctttggtaacacagctgtagcaaaa

SEQ ID NO: 221101 - DNA, 75 bp, Artificial Sequence
  Synthetic
tgttaattgaggctgaactaaaatgctttggtaacacagctgtagcaaaatgcaatgaaaagcatgatgaggaat

SEQ ID NO: 221102 - DNA, 75 bp, Artificial Sequence
  Synthetic
tccagttgatcaacaaagcagtgaatgctttgataaatgaccaactaatcatgaagaaccatttgcgggacatca

SEQ ID NO: 221103 - DNA, 75 bp, Artificial Sequence
  Synthetic
tgtcatcggacccctgacaggtaatgaccatattccgggggagtgcatcaatgacagcactggtcaagcccggtt

SEQ ID NO: 221104 - DNA, 75 bp, Artificial Sequence
  Synthetic
atcactgggaagtcatcattgcctaaatgctggcttgtgtccaacggttcatatctaaatgagacccatttctct

SEQ ID NO: 221105 - DNA, 75 bp, Artificial Sequence
  Synthetic
aatgctggcttgtgtccaacggttcatatctaaatgagacccatttctctgatgacattgagcaagaagccgaca

SEQ ID NO: 221106 - DNA, 75 bp, Artificial Sequence
  Synthetic
gtagatcaaacccaaatctgtcaatgcttgtactgcatcattcaagtcaacctgcccctgttttgtcagacatgc

SEQ ID NO: 221107 - DNA, 75 bp, Artificial Sequence
  Synthetic
acaccactgggcttggttgacctctttgtttttagtacaagtttctatcttattagcatcttcctccacctagtc

SEQ ID NO: 221108 - DNA, 75 bp, Artificial Sequence
  Synthetic
taggtaaaccgtgtcccaaacctcacaggctaaaccacatgggagtatgctcttgtggactctacaaacaacccg

SEQ ID NO: 221109 - DNA, 75 bp, Artificial Sequence
  Synthetic
ttcaaaagatccggattcttaacatcccacaccctaacaactccgtctcttccaggttgggtgccctgagcccca

SEQ ID NO: 221110 - DNA, 75 bp, Artificial Sequence
  Synthetic
cccacaccctaacaactccgtctcttccaggttgggtgccctgagccccaccaaccatgcctatcatgttcagca

SEQ ID NO: 221111 - DNA, 75 bp, Artificial Sequence
  Synthetic
cggggatcctaggcattttggaacgcgcattcctagagtcattgaagagtgcctcacactcagacatgggacaaa

SEQ ID NO: 221112 - DNA, 75 bp, Artificial Sequence
  Synthetic
gcctcacactcagacatgggacaaatagtgacattctttcaagaagttcctcatgtcattgaggaaattatgaac

SEQ ID NO: 221113 - DNA, 75 bp, Artificial Sequence
  Synthetic
tagtgacattctttcaagaagttcctcatgtcattgaggaaattatgaacattgtcctcatcactttgtctctac

SEQ ID NO: 221114 - DNA, 75 bp, Artificial Sequence
  Synthetic
agcttttgagaacgtttactggggtgagctaaaattaaaaccaggatcatctttgtcaaagatctgatgttgttc

SEQ ID NO: 221115 - DNA, 75 bp, Artificial Sequence
  Synthetic
ctgatcacattcctctttctttgtggaaggtcatgttcaacaatctacaaaggaagctatcaactccagacactt

SEQ ID NO: 221116 - DNA, 75 bp, Artificial Sequence
  Synthetic
ccggggatcctaggcaatttagttggacttcagtggtgaggctcatttcagtgaatccctgaatcagagcgccca

SEQ ID NO: 221117 - DNA, 75 bp, Artificial Sequence
  Synthetic
gaatcaatcttgctgagggcaatgtcaattagtttaatgtcttttctcccctgtgattcaaggagtttccttata

SEQ ID NO: 221118 - DNA, 75 bp, Artificial Sequence
  Synthetic
gaaggtcatgttcaacaatctacaaaggaagctatcaactccagacacttgagctaaacatggaaacactcaata

SEQ ID NO: 221119 - DNA, 75 bp, Artificial Sequence
  Synthetic
gtgggcaatgagacaggactggaattaaccttaactaacacaagcatcataaaccataagttctgcaatctttct

SEQ ID NO: 221120 - DNA, 75 bp, Artificial Sequence
  Synthetic
gacagcactggtcaagcctggctgtgcagcaaagaggtctgtgacatcaattccatgtgagtacttggcatcctg

SEQ ID NO: 221121 - DNA, 75 bp, Artificial Sequence
  Synthetic
taaccttaactaacacaagcatcataaaccataagttctgcaatctttctgaagcacacaaaaagaatctctatg

SEQ ID NO: 221122 - DNA, 75 bp, Artificial Sequence
  Synthetic
ctccttagaagcgctcatcttcgtctgggcactcagagattcactagttgaaagcttcactcagttagtcaataa

SEQ ID NO: 221123 - DNA, 75 bp, Artificial Sequence
  Synthetic
ttcaatcagtatgaagcaatgagttgtgacttcaatggaggcaagatcagcgttcagtacaatctaagtcatagt

SEQ ID NO: 221124 - DNA, 75 bp, Artificial Sequence
  Synthetic
ttccaccggatcttcaggtctcccttcaatgtccatccaggtcttagcatttggatcaagttgcagcattgcatc

SEQ ID NO: 221125 - DNA, 75 bp, Artificial Sequence
  Synthetic
tcaatgtccatccaggtcttagcatttggatcaagttgcagcattgcatctttgagggtcataagctgagaatag

SEQ ID NO: 221126 - DNA, 75 bp, Artificial Sequence
  Synthetic
ttggatcaagttgcagcattgcatctttgagggtcataagctgagaataggtgagtccagcagtgaaccctgccg

SEQ ID NO: 221127 - DNA, 75 bp, Artificial Sequence
  Synthetic
gtgacttcaatggaggcaagatcagcgttcagtacaatctaagtcatagttatgcagtggatgcagccaatcatt

SEQ ID NO: 221128 - DNA, 75 bp, Artificial Sequence
  Synthetic
accagaaagacagatcttgtaaagtatattctcataagggttcctttcaccaggtgtatctgaaacaaacattcc

SEQ ID NO: 221129 - DNA, 75 bp, Artificial Sequence
  Synthetic
ggtggaagctacatcgcacttgattcaggccgaggaaattgggactgcataatgacaagctaccaatacttaatc

SEQ ID NO: 221130 - DNA, 75 bp, Artificial Sequence
  Synthetic
actgtagggatttattggaactgttgttcccagttttctgtggcttcccatctgattctaaatcaacgacggtgt

SEQ ID NO: 221131 - DNA, 75 bp, Artificial Sequence
  Synthetic
caggccgaggaaattgggactgcataatgacaagctaccaatacttaatcattcagaatacgacatgggaagacc

SEQ ID NO: 221132 - DNA, 75 bp, Artificial Sequence
  Synthetic
caaagaaccagagatatttacatcagcagaagactgttgggaacgtttacatggacactatcagattctgaaggt

SEQ ID NO: 221133 - DNA, 75 bp, Artificial Sequence
  Synthetic
ctcaacccatttcttgagatctctttttgttgactccaaagaaactagcctatcattaacacttaagaagcaaga

SEQ ID NO: 221134 - DNA, 75 bp, Artificial Sequence
  Synthetic
atggacactatcagattctgaaggtaaagaaaccccaggaggctactgcttaactagatggatgttaattgaagc

SEQ ID NO: 221135 - DNA, 75 bp, Artificial Sequence
  Synthetic
tctaacatgttaccaccatctagcatacaggctcctgctttcacagcggcacccaagctaaaattgtaacctgag

SEQ ID NO: 221136 - DNA, 75 bp, Artificial Sequence
  Synthetic
tacaggctcctgctttcacagcggcacccaagctaaaattgtaacctgagatgttcaaggagctcttcttggtgt

SEQ ID NO: 221137 - DNA, 75 bp, Artificial Sequence
  Synthetic
atgatgaggaattttgtgatatgctgaggctttttgacttcaacaagcaagccattcagaggttgaagactgagg

SEQ ID NO: 221138 - DNA, 75 bp, Artificial Sequence
  Synthetic
gtgttggggtactttgctgtgtagatcagacccagatctgttaatgcctgcactacatcatttaggtcaacctgc

SEQ ID NO: 221139 - DNA, 75 bp, Artificial Sequence
  Synthetic
tatttgcatacaaaaatctcaatattggtgatgctctcttgaactgataaattaagtgttcgatattgtcttctg

SEQ ID NO: 221140 - DNA, 75 bp, Artificial Sequence
  Synthetic
gaccagcttataatgaaaaaccacctcagagacatcatgggtataccatattgtaattacagtaaatactggtat

SEQ ID NO: 221141 - DNA, 75 bp, Artificial Sequence
  Synthetic
atgcagccaaccattgtggcacaattgcaaatggtgtcttacagactttcatgaggatggcctggggtgggagct

SEQ ID NO: 221142 - DNA, 75 bp, Artificial Sequence
  Synthetic
caaccatgcctatcatgcttagtaatgctcttctttgctcaagctgttgtgtactcaagttccccatataaacac

SEQ ID NO: 221143 - DNA, 75 bp, Artificial Sequence
  Synthetic
tcagacccagatctgttaatgcctgcactacatcatttaggtcaacctgcccttgctttgtcaaacatgccagtg

SEQ ID NO: 221144 - DNA, 75 bp, Artificial Sequence
  Synthetic
acatcccaaactctcacaactccgtcattcccggcccgggccccctgattaccaccactcattcctatcatattc

SEQ ID NO: 221145 - DNA, 75 bp, Artificial Sequence
  Synthetic
caacctgggaagatcactgccaattctcaagaccatctcccatcggttatcttgggctcctctcacaaaggacca

SEQ ID NO: 221146 - DNA, 75 bp, Artificial Sequence
  Synthetic
actcatttttcagatgatatagaacaacaagccgacaatatgataacggagatgttacagaaggagtacatagat

SEQ ID NO: 221147 - DNA, 75 bp, Artificial Sequence
  Synthetic
cttgggctcctctcacaaaggaccagagatatatatattagtaggagactactgggcacatttacatggacattg

SEQ ID NO: 221148 - DNA, 75 bp, Artificial Sequence
  Synthetic
aacctgagagctccctcctcaatgactgtgtccaaaggaatgactttacttccttggaagcactcatcctgatct

SEQ ID NO: 221149 - DNA, 75 bp, Artificial Sequence
  Synthetic
aatatagtgcctgtacatcattcactacaaactcaccacattgattaacaagtcctttcatgttgagatggatag

SEQ ID NO: 221150 - DNA, 75 bp, Artificial Sequence
  Synthetic
gttctagttacttttgattttagcttctctaagtctgcagctagaaccaataggtcatctgaagtcagagtccca

SEQ ID NO: 221151 - DNA, 75 bp, Artificial Sequence
  Synthetic
cttcatttggttaagatcccaactcataggcacattgtgggcaaatcatgtcccaaacctcacaggctaaaccat

SEQ ID NO: 221152 - DNA, 75 bp, Artificial Sequence
  Synthetic
tatcaatatctgataatccaaaacacaacctgggaagatcactgccaattctcaagaccatctcccatcggttat

SEQ ID NO: 221153 - DNA, 75 bp, Artificial Sequence
  Synthetic
cattcccggcccgggccccctgattaccaccactcattcctatcatattcaggagagctcgtctctggtcaagtt

SEQ ID NO: 221154 - DNA, 75 bp, Artificial Sequence
  Synthetic
atgggcatctgttcctgtggactgtacaaacagccaggggtacctgtgaagtggaagagataatccctccacagg

SEQ ID NO: 221155 - DNA, 75 bp, Artificial Sequence
  Synthetic
caggacgaccttaggtgttgaggtcctgaagaccatgtccctgggtaacacagctcttaagatcctggcatcaag

SEQ ID NO: 221156 - DNA, 75 bp, Artificial Sequence
  Synthetic
cgcttcaaatcattatcgtctcttctctgtttgcgcattagccgctggacattgctgacctcagagaagtcaagc

SEQ ID NO: 221157 - DNA, 75 bp, Artificial Sequence
  Synthetic
tctctaagtctgcagctagaaccaataggtcatctgaagtcagagtcccaactctcagcacactcttttgttgag

SEQ ID NO: 221158 - DNA, 75 bp, Artificial Sequence
  Synthetic
ggacactcagggattcactggttgaaagtatcactcagtgagtcaatgaaaagcgcaatccaatagcctaggatc

SEQ ID NO: 221159 - DNA, 75 bp, Artificial Sequence
  Synthetic
ctgaagaccatgtccctgggtaacacagctcttaagatcctggcatcaagcccacccactacagctgcgtcaaac

SEQ ID NO: 221160 - DNA, 75 bp, Artificial Sequence
  Synthetic
cgggggatcctaggcaattcagctggacttcagtggtgagactcattttagtgaatccttgaatcagaataccca

SEQ ID NO: 221161 - DNA, 75 bp, Artificial Sequence
  Synthetic
ccttttctttttctcaaccacaatgcccgtatgcatgtggcacaagtctttgtactgatcccaaacagcgttctc

SEQ ID NO: 221162 - DNA, 75 bp, Artificial Sequence
  Synthetic
taatgaagaaccatctacgggacatcatgggaattccatactgtaattacagcaagtactggtacctcaaccaca

SEQ ID NO: 221163 - DNA, 75 bp, Artificial Sequence
  Synthetic
cccgtatgcatgtggcacaagtctttgtactgatcccaaacagcgttctcaaactttctggagtccggtttgctc

SEQ ID NO: 221164 - DNA, 75 bp, Artificial Sequence
  Synthetic
caagttgttgtactatatgcacacaacagagagttgaaactatctgctgaagtgaataaagcaaagcgcaatcca

SEQ ID NO: 221165 - DNA, 75 bp, Artificial Sequence
  Synthetic
tcaccacttgcagtttgatgttggagcaataaccagacaattctctcctcaaagattgtgtccacaggaaggact

SEQ ID NO: 221166 - DNA, 75 bp, Artificial Sequence
  Synthetic
tcaagattccatgatcatggagaattctttccacagatttgtcctcgctgttgtgctcgcatccatttgcgttgc

SEQ ID NO: 221167 - DNA, 75 bp, Artificial Sequence
  Synthetic
tttcttaatgtcttccgacccttgacaggtgatgaccatgtttcgtgggagtgcctctataactgcacttgtcag

SEQ ID NO: 221168 - DNA, 75 bp, Artificial Sequence
  Synthetic
tcctaggcaatttggttgttctttttgggagcttttgctataaagaccactaaatggggaacaagcaagccaaaa

SEQ ID NO: 221169 - DNA, 75 bp, Artificial Sequence
  Synthetic
caggtgatgaccatgtttcgtgggagtgcctctataactgcacttgtcaggccgggctgcgcagcaaacaagtca

SEQ ID NO: 221170 - DNA, 75 bp, Artificial Sequence
  Synthetic
ctttgtgttcagcacaagtttctatctcattagcatcttccttcatttggtcaaaataccaactcataggcatgt

SEQ ID NO: 221171 - DNA, 75 bp, Artificial Sequence
  Synthetic
atcagttggctccctaaagaaatgaatgtaacagcctgagcttggttgatataaagctatctcaactggatcatc

SEQ ID NO: 221172 - DNA, 75 bp, Artificial Sequence
  Synthetic
tgtaggcaagtcgtgtcccaagcctcacagattgaatcacatgggcatatgctcctgcggactctatggacagcc

SEQ ID NO: 221173 - DNA, 75 bp, Artificial Sequence
  Synthetic
atgtaacagcctgagcttggttgatataaagctatctcaactggatcatctggcctaccttcaatgtccatccaa

SEQ ID NO: 221174 - DNA, 75 bp, Artificial Sequence
  Synthetic
ctgcaagatgcccctccccacaaggctgaggccatcaaccgctccaacagcacctccagccggagtgggggacag

SEQ ID NO: 221175 - DNA, 75 bp, Artificial Sequence
  Synthetic
ctgaggccatcaaccgctccaacagcacctccagccggagtgggggacagcaccagccccccaccctacagcccc

SEQ ID NO: 221176 - DNA, 75 bp, Artificial Sequence
  Synthetic
actatggaatgaggtcccgtagggggcacagaagacacaagagtcaattaaaagcaattaaattagatggcctta

SEQ ID NO: 221177 - DNA, 75 bp, Artificial Sequence
  Synthetic
ctgagaataggtcagtcccgcagggaagcctgcagattgcagggatctgttggacccactatttccgggcttctg

SEQ ID NO: 221178 - DNA, 75 bp, Artificial Sequence
  Synthetic
aagcctgcagattgcagggatctgttggacccactatttccgggcttctgaggtttgctgtctgactccaaatct

SEQ ID NO: 221179 - DNA, 75 bp, Artificial Sequence
  Synthetic
gtctcaactgcctcaccttacttttaagtgtcagcaacaggtgccccatttgcaagatgcctctccccacaaaac

SEQ ID NO: 221180 - DNA, 75 bp, Artificial Sequence
  Synthetic
gctcccccggggggaccccccgccaggggcccccccgggggagccaaccatcaccaggagactactcaatgtctt

SEQ ID NO: 221181 - DNA, 75 bp, Artificial Sequence
  Synthetic
ccgggggagccgaccaccaccaagagactactcaatgtcctcaatgcgctcttccccttcaatcaactcctcaca

SEQ ID NO: 221182 - DNA, 75 bp, Artificial Sequence
  Synthetic
ccggggatcctaggcatttaagattgcgcatttagagatctttgtgtgagtgggcctcatcaagccatggggcag

SEQ ID NO: 221183 - DNA, 75 bp, Artificial Sequence
  Synthetic
gtaaggccatccgtctcctgaaaggcagattttgtataatatgttctcatatggattcctctcacctggaatgtc

SEQ ID NO: 221184 - DNA, 75 bp, Artificial Sequence
  Synthetic
cagattttgtataatatgttctcatatggattcctctcacctggaatgtctgatacaaacatccccaagctcctc

SEQ ID NO: 221185 - DNA, 75 bp, Artificial Sequence
  Synthetic
ttcctcttgacttactgtagcagagagcataacccttgaactccacccagctgtccactgccccaagaaccgcgc

SEQ ID NO: 221186 - DNA, 75 bp, Artificial Sequence
  Synthetic
gtcaattaatttgatgtcctttcttccttgtgattcaaggagtttccttatatcatcggacccctgacaggtgat

SEQ ID NO: 221187 - DNA, 75 bp, Artificial Sequence
  Synthetic
tttgattgtctctaacatattgccgccatcaagcatgcaggctcctgccttcactgcagcacccagactgaagtt

SEQ ID NO: 221188 - DNA, 75 bp, Artificial Sequence
  Synthetic
tcaagacctcagaactgtttggtgctgcaaccctcagcgtggagacaatgtccactcctgaccactgcattctca

SEQ ID NO: 221189 - DNA, 75 bp, Artificial Sequence
  Synthetic
tttcaatgcaccaactaaaaggtgtggggaactatcaccaatctccctcacaaacatttctaaatcttgatcttg

SEQ ID NO: 221190 - DNA, 75 bp, Artificial Sequence
  Synthetic
ccatcaagcatgcaggctcctgccttcactgcagcacccagactgaagttgtagccagagatgttgagggaactc

SEQ ID NO: 221191 - DNA, 75 bp, Artificial Sequence
  Synthetic
gatgaggtatccccaacttctctcacaaacatctcaaggtcttggtcttgtataacaggtgtgaaggatgccaac

SEQ ID NO: 221192 - DNA, 75 bp, Artificial Sequence
  Synthetic
taaatcagatgaattgggatacttagcggtataaatcagacccaaatctgtcagagcttggacagcatcattcag

SEQ ID NO: 221193 - DNA, 75 bp, Artificial Sequence
  Synthetic
ccctctgaagactggatcatcagtgaagcctgcgatctactgtagcagagactatagcctttaaaatctgcccag

SEQ ID NO: 221194 - DNA, 75 bp, Artificial Sequence
  Synthetic
ccacctcttcaaagaggggcctgcacagcctccctcttaatctaaacttcccctctgaagactggatcatcagtg

SEQ ID NO: 221195 - DNA, 75 bp, Artificial Sequence
  Synthetic
ggattttatttcctttgaggcactcatcgccagattgttgtgttgtatgcacacaacaaagaactgagactatct

SEQ ID NO: 221196 - DNA, 75 bp, Artificial Sequence
  Synthetic
caaacatctcaaggtcttggtcttgtataacaggtgtgaaggatgccaacctctttccacattcccacaagccac

SEQ ID NO: 221197 - DNA, 75 bp, Artificial Sequence
  Synthetic
aagtcatactcagtaaactgcaatttttctatgtcaacgacaatctcaacaggagtcacatgccctagttgattc

SEQ ID NO: 221198 - DNA, 75 bp, Artificial Sequence
  Synthetic
tgcattcttgacatcccaaactctcactatgccatctctcccggtgcttgccccttgtctatcactagtcatacc

SEQ ID NO: 221199 - DNA, 75 bp, Artificial Sequence
  Synthetic
tttctatgtcaacgacaatctcaacaggagtcacatgccctagttgattcgtatcaaccaaaaattcattaataa

SEQ ID NO: 221200 - DNA, 75 bp, Artificial Sequence
  Synthetic
tcttctctcactttatcaatgaggtccttgtgataataatctgatacataagccattaagaagtatctaaggttt

SEQ ID NO: 221201 - DNA, 75 bp, Artificial Sequence
  Synthetic
gcggtataaatcagacccaaatctgtcagagcttggacagcatcattcagatccacttgcccctgtttggtcaag

SEQ ID NO: 221202 - DNA, 75 bp, Artificial Sequence
  Synthetic
gttttcccaggcccttcctgttattgaggttcttgatgcaatatatggccatccatcccctgacaaacaaatctt

SEQ ID NO: 221203 - DNA, 75 bp, Artificial Sequence
  Synthetic
aaaaccaacctccagcagtctgacagaacacatggactcactgcaccagaatacatagcggttacatcatgcacc

SEQ ID NO: 221204 - DNA, 75 bp, Artificial Sequence
  Synthetic
tggtctctcagtacggatgactttagacttcaacttctctaaatcagcagccaaagtcagtaagtcatcagagct

SEQ ID NO: 221205 - DNA, 75 bp, Artificial Sequence
  Synthetic
actatgccatctctcccggtgcttgccccttgtctatcactagtcataccaatcatgttcaacagagcccttctc

SEQ ID NO: 221206 - DNA, 75 bp, Artificial Sequence
  Synthetic
gacttcaacttctctaaatcagcagccaaagtcagtaagtcatcagagctgagagtcccaactctgagaacactt

SEQ ID NO: 221207 - DNA, 75 bp, Artificial Sequence
  Synthetic
aaaactttccttgaagctagcatcttgacttttgatacggaacctcactgtctgacttagttttgcagaccctga

SEQ ID NO: 221208 - DNA, 75 bp, Artificial Sequence
  Synthetic
tgacttttgatacggaacctcactgtctgacttagttttgcagaccctgaaggtagtaacgcaacagcatcgagg

SEQ ID NO: 221209 - DNA, 75 bp, Artificial Sequence
  Synthetic
atctctaaggcgttttagatcaccgtcatctctcttctgcttgcgcattaatcgctgaacattgctaacttcaga

SEQ ID NO: 221210 - DNA, 75 bp, Artificial Sequence
  Synthetic
tcatctctcttctgcttgcgcattaatcgctgaacattgctaacttcagagaagtcaagaccgtgtaagagagct

SEQ ID NO: 221211 - DNA, 75 bp, Artificial Sequence
  Synthetic
tgaattcttctgtatctctcaagagtaactctgttaagttctgatcaaataatgatatctgatcgtcactggatg

SEQ ID NO: 221212 - DNA, 75 bp, Artificial Sequence
  Synthetic
ctctctcctcagggactgagtccacaggaatgacttcacttctttcgaagcactcattgttgttgttggattgtg

SEQ ID NO: 221213 - DNA, 75 bp, Artificial Sequence
  Synthetic
cactcattgttgttgttggattgtgggccttttgcacacttgatcttacaaggatgattagcacttgaagcgcaa

SEQ ID NO: 221214 - DNA, 75 bp, Artificial Sequence
  Synthetic
gggaaccatgtaaaggaccccagcgttcttgttgttgcaacgaatggtctcacataagactcgaaatagatttgc

SEQ ID NO: 221215 - DNA, 75 bp, Artificial Sequence
  Synthetic
agatggatataagcgtctcaaagagtgaataatgtggctcatgccaaccctgtcctccagtaactttgaattggt

SEQ ID NO: 221216 - DNA, 75 bp, Artificial Sequence
  Synthetic
catgggttcatgtgttctagtgtgagacaaccttaattcagacgacagcacaatgtaatgttcttccctcttcca

SEQ ID NO: 221217 - DNA, 75 bp, Artificial Sequence
  Synthetic
gacaaccttaattcagacgacagcacaatgtaatgttcttccctcttccatttaactatgtgtgagacaagggac

SEQ ID NO: 221218 - DNA, 75 bp, Artificial Sequence
  Synthetic
tgtcccatatcaaggattgaactaatgtgtgaggggactgtgccaatttgaaagttggaattaaaaaagtcttca

SEQ ID NO: 221219 - DNA, 75 bp, Artificial Sequence
  Synthetic
tctaggtgaccacttcattttggttgacgccaaatcactcataaatggtagtatgtgtttttcaaatacagatgg

SEQ ID NO: 221220 - DNA, 75 bp, Artificial Sequence
  Synthetic
atgtgattcaaacctaccctatcctccaataatttagatgcagttggcttcaaagggaaatagtcgcaaggattg

SEQ ID NO: 221221 - DNA, 75 bp, Artificial Sequence
  Synthetic
gtccgtgcaaaagagcttgggcatcttttaccacctgaagtttgatgttggagcagtaaccagacagttccctcc

SEQ ID NO: 221222 - DNA, 75 bp, Artificial Sequence
  Synthetic
ttttaccacctgaagtttgatgttggagcagtaaccagacagttccctcctcagggattgtgtccacagaaaaga

SEQ ID NO: 221223 - DNA, 75 bp, Artificial Sequence
  Synthetic
tatcctgacatcatcagccagtcttcctgtgtcaaatttaaagttcagacacttactcttataatgagagtatct

SEQ ID NO: 221224 - DNA, 75 bp, Artificial Sequence
  Synthetic
aaggaaatgcacatataatcccataataggggtctgaagtaactaattacaccttcatttccattcctaaggcct

SEQ ID NO: 221225 - DNA, 75 bp, Artificial Sequence
  Synthetic
ccggggatcctaggcaatttggttgttcttttttgggggccttgtgcgctgagcttctccaaatgggaaacaagc

SEQ ID NO: 221226 - DNA, 75 bp, Artificial Sequence
  Synthetic
cccttggataccagaaatcagagactgtatagacttgatatacaaattctctttatttggtccccgaacacactt

SEQ ID NO: 221227 - DNA, 75 bp, Artificial Sequence
  Synthetic
acaaagccagatgcaatagaactttgaaatgcggacttgttgatagcttcagacaataacttttgcgcacctcgg

SEQ ID NO: 221228 - DNA, 75 bp, Artificial Sequence
  Synthetic
gtgtcccatttgcaagatgcctctccccacaaaactgagaccatcaaccgccccaacagcacccccagccggagc

SEQ ID NO: 221229 - DNA, 75 bp, Artificial Sequence
  Synthetic
agcggacaacaccagacccccaccctatagcccctgaacctcccatcgaccccaaccacctccaccttccccccg

SEQ ID NO: 221230 - DNA, 75 bp, Artificial Sequence
  Synthetic
gtcctcttctgaattcgattacacagatcaactgggacaccattagccacagactgatcaattatggtatcaatt

SEQ ID NO: 221231 - DNA, 75 bp, Artificial Sequence
  Synthetic
catccaacagatcacaaaggtttttcagtgaagagatgtgttcactagatagatagtttgttgtgaactcctcgt

SEQ ID NO: 221232 - DNA, 75 bp, Artificial Sequence
  Synthetic
tgtatcatcaccttcccctttgacttactataacagagagcataacccttgaattccacccagttgtccactgct

SEQ ID NO: 221233 - DNA, 75 bp, Artificial Sequence
  Synthetic
accttgctgcaagcatcaggaattaacccctctatttgcctcataattctgtaactacggttgccatcaacccag

SEQ ID NO: 221234 - DNA, 75 bp, Artificial Sequence
  Synthetic
agcatactgcaaaaggctcaaggtccttttttgtattaaattgcacagatgaacagggacaccattggcaactga

SEQ ID NO: 221235 - DNA, 75 bp, Artificial Sequence
  Synthetic
tgtggagacaatgtccacccccgaccactgcatccttaaccccagcctgtccaccatcatatcactcagtgcccc

SEQ ID NO: 221236 - DNA, 75 bp, Artificial Sequence
  Synthetic
ttgatcgatgattgtgtcaattgtctccgccagttgatgtggttccttacactttatattatgaagggctgcagc

SEQ ID NO: 221237 - DNA, 75 bp, Artificial Sequence
  Synthetic
aaatcccaccatcccaaaatcccccaccctacagcccctgaggcagaactccgccccgaagcccctctcaagcac

SEQ ID NO: 221238 - DNA, 75 bp, Artificial Sequence
  Synthetic
atttgaattctgcaacaaacctgccaataacactcttagggctcacaaacttattgagttgatcactcatgtaat

SEQ ID NO: 221239 - DNA, 75 bp, Artificial Sequence
  Synthetic
tttgacaccttttactaggatgtgtcagtatcaaaactaaaatcattttggttaacaatttaatagtgatcaatt

SEQ ID NO: 221240 - DNA, 75 bp, Artificial Sequence
  Synthetic
tctgtgagagtttgatcaaagagagaaatttgatcatcactagaagtataagcatcaattgtaccaccacatata

SEQ ID NO: 221241 - DNA, 75 bp, Artificial Sequence
  Synthetic
agtaggtcctgacaagaccaacctccagcagtctgacaaaacacatggactcactgcacctgagtacatagcggt

SEQ ID NO: 221242 - DNA, 75 bp, Artificial Sequence
  Synthetic
caaggtggatggcaaaactttctttaaaactagcatcttgacttttgatgcggaaccttactgtctgactcattt

SEQ ID NO: 221243 - DNA, 75 bp, Artificial Sequence
  Synthetic
gagaaggcacaataccaatttggaaattggaataaaagaaatcttctgttattgactgtgtagttttcttcctca

SEQ ID NO: 221244 - DNA, 75 bp, Artificial Sequence
  Synthetic
aaaactagcatcttgacttttgatgcggaaccttactgtctgactcatttttgcagaccctgaaggtaatgaagc

SEQ ID NO: 221245 - DNA, 75 bp, Artificial Sequence
  Synthetic
ctgattcagatctctgagacgtttcagatcactatcatcccttttttgtttgcgcattaagcgctgcacattgct

SEQ ID NO: 221246 - DNA, 75 bp, Artificial Sequence
  Synthetic
aaaggtatttccaccatcttatgcatgtgccacataagcagggttgagagatagtccctcccctttatatctgct

SEQ ID NO: 221247 - DNA, 75 bp, Artificial Sequence
  Synthetic
aaatggacacatcatcggaccccatttactgtgatccatgctataagagacatgtgccagggaaacatttaattt

SEQ ID NO: 221248 - DNA, 75 bp, Artificial Sequence
  Synthetic
cttactcttataatgagagtatcttcccatcagcttattcccattcatcactaataaaattgacttaaagcactg

SEQ ID NO: 221249 - DNA, 75 bp, Artificial Sequence
  Synthetic
ccttggaagcactcatcctggtctggacactttggggtttactagttggaaatgtttctcagtaagtcaatgaaa

SEQ ID NO: 221250 - DNA, 75 bp, Artificial Sequence
  Synthetic
catgtgccagggaaacatttaatttcatggaaagaatagcgttctcaaattctttctcgttgtttaaacaactcc

SEQ ID NO: 221251 - DNA, 75 bp, Artificial Sequence
  Synthetic
cggggatcctaggcaatttagctggacttcagtggcaaggtttaccttagtgaatccttgaatcaagtgcctggt

SEQ ID NO: 221252 - DNA, 75 bp, Artificial Sequence
  Synthetic
aacatctttgtcctaagatcaccaatgtataactctctgttaccaccaacttgttccttatatgataaagagaat

SEQ ID NO: 221253 - DNA, 75 bp, Artificial Sequence
  Synthetic
ctgaatcataggactgtggtgactcttggctataaaaacacaagttctttaacattgctgtggtacaatttgtta

SEQ ID NO: 221254 - DNA, 75 bp, Artificial Sequence
  Synthetic
tgagacaagagacaaggcttcacagttaacatccagcgccacacagagatccagaaattttatcctaggtgacca

SEQ ID NO: 221255 - DNA, 75 bp, Artificial Sequence
  Synthetic
tatcaaacttgaaattgaggtttcttgacttataatgagtgtaccttcccataagtgtgtttgcgttcataatca

SEQ ID NO: 221256 - DNA, 75 bp, Artificial Sequence
  Synthetic
tatgtccccttgccttagtttgttcctgaaaatttgatactcctcctcaattaaactcttgacttcatgagaggt

SEQ ID NO: 221257 - DNA, 75 bp, Artificial Sequence
  Synthetic
gtcacaagggttgtgcttaaaaaaatccaacaccttaactatcttaggttcccctaagacccatgcacccagttc

SEQ ID NO: 221258 - DNA, 75 bp, Artificial Sequence
  Synthetic
gttgacactgcctttgttaactccccaataggacattgtgacatatgtccacagtaaaaatatttctcctttaac

SEQ ID NO: 221259 - DNA, 75 bp, Artificial Sequence
  Synthetic
taggacatcatgatcaaaatcctcaaccatgtgattggataactcacccttaatcaacctaatataaaacttatt

SEQ ID NO: 221260 - DNA, 75 bp, Artificial Sequence
  Synthetic
accatgtgattggataactcacccttaatcaacctaatataaaacttatttgagacaatttcatcaagatcgttt

SEQ ID NO: 221261 - DNA, 75 bp, Artificial Sequence
  Synthetic
ttggtccccggatacatttgctacccaatgttctgcacaatcccacgaagccagatgcaatagaactttggaatg

SEQ ID NO: 221262 - DNA, 75 bp, Artificial Sequence
  Synthetic
tctatactggtcaacaattttctcaacagtctcttttagctgattaaagtagacgcttgcaccgccatcgagcag

SEQ ID NO: 221263 - DNA, 75 bp, Artificial Sequence
  Synthetic
ccagatgcaatagaactttggaatgcagatttgttgatagcttcagacaacaatttctgtgcaccacgagtgaaa

SEQ ID NO: 221264 - DNA, 75 bp, Artificial Sequence
  Synthetic
ctaaaaccaaattgctcattgcctgttgcactttatattcatagtcttgcttgttgagaaggtgttttcctttcc

SEQ ID NO: 221265 - DNA, 75 bp, Artificial Sequence
  Synthetic
atgggttgccaggttcagccaatgaaactctagatcagaattggacaggggttcaatgttcaaaagtttaaagag

SEQ ID NO: 221266 - DNA, 75 bp, Artificial Sequence
  Synthetic
catctgtgtatttattgacaacaacacttttattgctagctagatccaaggctgtggcacaaccactagtgatga

SEQ ID NO: 221267 - DNA, 75 bp, Artificial Sequence
  Synthetic
ttgttcagctgctctcccaactcattgcaatcctctatccaggaaatcattgtgttcactgttgtttccaaaact

SEQ ID NO: 221268 - DNA, 75 bp, Artificial Sequence
  Synthetic
ttgttgaaagaagatgtgagaagagacaagaacctctttgagacaccaggccttttgtagtttggcccttcgacg

SEQ ID NO: 221269 - DNA, 75 bp, Artificial Sequence
  Synthetic
atccaattcttcttccgtggctgtgtctgctggattgacactcacatgaccgaatttcacctttggctcaagaaa

SEQ ID NO: 221270 - DNA, 75 bp, Artificial Sequence
  Synthetic
ttagagatctttgtgtgagtgggcctcatcaagccatgggacaaatcataacatttttccaggaagtacctcatg

SEQ ID NO: 221271 - DNA, 75 bp, Artificial Sequence
  Synthetic
cttctcattatctgcaaggtactttgagatgagatctttagcattagcaatgtcttcctccatcgccaattgtgg

SEQ ID NO: 221272 - DNA, 75 bp, Artificial Sequence
  Synthetic
gttcagaatgaacttgaacctattggtcatcatgctcttcacatcttcggacaagaccaagttcattaatgtcct

SEQ ID NO: 221273 - DNA, 75 bp, Artificial Sequence
  Synthetic
actctgcaacaaacctgccaatgacacttttagggctcacaaacttattgagttgatcactcatataataatgga

SEQ ID NO: 221274 - DNA, 75 bp, Artificial Sequence
  Synthetic
ttttgtcaatgagatctttgtgataaaaatctgacacataagccattatgaaatacctaaggttttggaggagtt

SEQ ID NO: 221275 - DNA, 75 bp, Artificial Sequence
  Synthetic
tctgagaacgcttgctagggtgagctagaatcaaaattaagatcatctttgtcagagacttgatattgttcaatt

SEQ ID NO: 221276 - DNA, 75 bp, Artificial Sequence
  Synthetic
ggcaacacaaagatcaaggaactttattctaggtgaccatttcatctttgtggaagctaaatcactcataaatgg

SEQ ID NO: 221277 - DNA, 75 bp, Artificial Sequence
  Synthetic
gctttaatgagtatcatctcaaccttccacttatccattcctaactttaatcagtatgaagcaatgagctgtgac

SEQ ID NO: 221278 - DNA, 75 bp, Artificial Sequence
  Synthetic
aggagctcacaattccgttcttctttaagtgatggggtacctgcatttctgtctctagttctcttccggctgtct

SEQ ID NO: 221279 - DNA, 75 bp, Artificial Sequence
  Synthetic
atattgctgggaaatatcttttaggatcagcataaaatgagcacacttcaccaacgttgttgtgattaatagcat

SEQ ID NO: 221280 - DNA, 75 bp, Artificial Sequence
  Synthetic
agcttgttttggttccccgagcacccatgctccaagttctatagctgtagatagtgttatgcacatataatccca

SEQ ID NO: 221281 - DNA, 75 bp, Artificial Sequence
  Synthetic
tcacctgatgagaactcttgacaatatgcctctttgcatctgaccacttgatatcttgctggaccaaattcattc

SEQ ID NO: 221282 - DNA, 75 bp, Artificial Sequence
  Synthetic
atgcctctttgcatctgaccacttgatatcttgctggaccaaattcattctgtctcagttttacggtggaagaag

SEQ ID NO: 221283 - DNA, 75 bp, Artificial Sequence
  Synthetic
tcaatagtccccaacagttccacactccccatggtgtaagggaacatttcctcctctgatctctggtaactgatt

SEQ ID NO: 221284 - DNA, 75 bp, Artificial Sequence
  Synthetic
tcattgttcaggcaactccctgataactgtaggcttagggcttcaaagtaatcttctataagtctagtaaacatc

SEQ ID NO: 221285 - DNA, 75 bp, Artificial Sequence
  Synthetic
cctttcaacctgctgccttcgctcaacccatttctttagatccctttttgttgattctagcgaaaccagtctgtc

SEQ ID NO: 221286 - DNA, 75 bp, Artificial Sequence
  Synthetic
acccatttctttagatccctttttgttgattctagcgaaaccagtctgtcattaacactcatgaagcaggatccc

SEQ ID NO: 221287 - DNA, 75 bp, Artificial Sequence
  Synthetic
gaaatcccaccatcccaaaatcccccaccctacagcccctgaggcagaactccgccccgaagccctctcaaacac

SEQ ID NO: 221288 - DNA, 75 bp, Artificial Sequence
  Synthetic
gtacttagcataacacaacaagctcaatgttctcttttgaatctgattgcacaaatcaactggaacaccgtttgc

SEQ ID NO: 221289 - DNA, 75 bp, Artificial Sequence
  Synthetic
aagaatcagtgcatcaaaaatcaacataagtttcctccttgtgttcaatatcctcaaagacttcactttgtttag

SEQ ID NO: 221290 - DNA, 75 bp, Artificial Sequence
  Synthetic
ataagtttcctccttgtgttcaatatcctcaaagacttcactttgtttaggaatgatctccagcattgcatctga

SEQ ID NO: 221291 - DNA, 75 bp, Artificial Sequence
  Synthetic
cttcataaaattcacctggtaagacatcatgatcaaagtcctcaaccatgtgattggacaattcacccttaatca

SEQ ID NO: 221292 - DNA, 75 bp, Artificial Sequence
  Synthetic
tgcatacaggaatctcaatattggtgatgccctcttgaactgatggatcaggtgttccatgctgtctttcgcagc

SEQ ID NO: 221293 - DNA, 75 bp, Artificial Sequence
  Synthetic
gatgccctcttgaactgatggatcaggtgttccatgctgtctttcgcagccatcttgtcagcgtacaggttgtta

SEQ ID NO: 221294 - DNA, 75 bp, Artificial Sequence
  Synthetic
ttctcctttccttagtctattcctaaacacttgatactcttcttcaatctgcaacttcacttcatgagccgtcaa

SEQ ID NO: 221295 - DNA, 75 bp, Artificial Sequence
  Synthetic
aacacttgatactcttcttcaatctgcaacttcacttcatgagccgtcaacttgttgttgatgccctggtggcat

SEQ ID NO: 221296 - DNA, 75 bp, Artificial Sequence
  Synthetic
agcctagtttaacaggttctctatactgatcaacaatcttttcaacagtctcctttagctgatcaaaataatcgc

SEQ ID NO: 221297 - DNA, 75 bp, Artificial Sequence
  Synthetic
gtctaggtcagcttcatcagcatcacttttatgctgcccagatcctagtaccagattgctcattgcctgctgcac

SEQ ID NO: 221298 - DNA, 75 bp, Artificial Sequence
  Synthetic
tgtggcactgttgcaaatggtgtattacagactttcatgaggatggcttggggtgggagctacattgctcttgac

SEQ ID NO: 221299 - DNA, 75 bp, Artificial Sequence
  Synthetic
cagactctccactcctgacagtcttcctaaggtcatggataaagattcacaaagcctactatactctgactcctc

SEQ ID NO: 221300 - DNA, 75 bp, Artificial Sequence
  Synthetic
gggtgggagctacattgctcttgactcaggccgtgacaggtgggactgtattatgactagttatcaatatctgat

SEQ ID NO: 221301 - DNA, 75 bp, Artificial Sequence
  Synthetic
cagtatggcttgtgaatcggctggtggtgcctcacaggagatcctaaagaaatgagagacaatatgcctaggatc

SEQ ID NO: 221302 - DNA, 75 bp, Artificial Sequence
  Synthetic
cactgtcaattctcgagaccatctcccatcggttatctcgggctcctctcacaaaggaccagagatatttatatt

SEQ ID NO: 221303 - DNA, 75 bp, Artificial Sequence
  Synthetic
ccctcaacttgtcattgacccaatcaggtatttgctcattataaaatgatgttctcccgtctatgagtggtatta

SEQ ID NO: 221304 - DNA, 75 bp, Artificial Sequence
  Synthetic
tctgaggtgttgtgcagaataccctgtcccatatcaaggattgaactaatgtgtgaggggactatgccaatttga

SEQ ID NO: 221305 - DNA, 75 bp, Artificial Sequence
  Synthetic
gcacagccactggtgataagggggtctttgatttccctttttacttctctttccttaaatagtgaaccattatta

SEQ ID NO: 221306 - DNA, 75 bp, Artificial Sequence
  Synthetic
aggtatttgctcattataaaatgatgttctcccgtctatgagtggtattaaattgatgtcgacactcttcaaatc

SEQ ID NO: 221307 - DNA, 75 bp, Artificial Sequence
  Synthetic
ttccttaaatagtgaaccattattaaaagaggacgtaagaagggataaatatttctttgaaacaccaggcttctt

SEQ ID NO: 221308 - DNA, 75 bp, Artificial Sequence
  Synthetic
cgcagcaacaaattttgttagtaaaggcacctcatcaccccagacataaaatcgtgatttaaactctgcaacaaa

SEQ ID NO: 221309 - DNA, 75 bp, Artificial Sequence
  Synthetic
acactccaataatattaggacattacctgtcagtttgtaaccgtccggtaccacgaaacatagtgaaggggtcaa

SEQ ID NO: 221310 - DNA, 75 bp, Artificial Sequence
  Synthetic
gctcacaaccatttgcattgcaggaatcaatttcaatacagagggacaggagtttcagcccttctaccaagagca

SEQ ID NO: 221311 - DNA, 75 bp, Artificial Sequence
  Synthetic
atcaatttcaatacagagggacaggagtttcagcccttctaccaagagcatcctgggctctgtttgcacaagaaa

SEQ ID NO: 221312 - DNA, 75 bp, Artificial Sequence
  Synthetic
gatgaacttgaacctattagtcatcatgctcttcacatcctcagataaaactaaattcatcaatgtccttatcaa

SEQ ID NO: 221313 - DNA, 75 bp, Artificial Sequence
  Synthetic
ccaagtctttgacacaggctatgtcttcctccatgtttggctgtgggtgcagtaaccgagactctcggagtatgt

SEQ ID NO: 221314 - DNA, 75 bp, Artificial Sequence
  Synthetic
caacaagctgacaacatgatcactgagatgttacagaaggagtatatggagaggcaggggaagacaccattgggt

SEQ ID NO: 221315 - DNA, 75 bp, Artificial Sequence
  Synthetic
accattgccaatggtgttcttcagacttttatgaggatggcttggggtggcagttacatagcacttgattccgga

SEQ ID NO: 221316 - DNA, 75 bp, Artificial Sequence
  Synthetic
taggatggagtcttatagggggcacaagaggcacgaaagacaacaaagacaatcaaaatagatagccttaatgcc

SEQ ID NO: 221317 - DNA, 75 bp, Artificial Sequence
  Synthetic
gaggcaggggaagacaccattgggtctggttgacctctttgtgttcagcacaagcttctatctcattagcatctt

SEQ ID NO: 221318 - DNA, 75 bp, Artificial Sequence
  Synthetic
gggcccccgtgacccaccgcctgttggcggtgggtcacgggggcgtccatttacaggacgaccctaggtgtcgat

SEQ ID NO: 221319 - DNA, 75 bp, Artificial Sequence
  Synthetic
accatcccaaaatcccccaccctacagcccctgaggcagaactccgccccgaagcccctctcccaaacacccctc

SEQ ID NO: 221320 - DNA, 75 bp, Artificial Sequence
  Synthetic
tttgaactcctcttcatctcttgagagtaattgtgtcaagttctgatcaaataaagatatctggtcatcactaga

SEQ ID NO: 221321 - DNA, 75 bp, Artificial Sequence
  Synthetic
aagcactcatcttggtctggacacttaggggtttgctggttgaaagttctactcagcaagtcaatgaaaagcgca

SEQ ID NO: 221322 - DNA, 75 bp, Artificial Sequence
  Synthetic
tcctaggcaatttagctggacttcagtagtgaggcttatttcagtgaatccctgaatcagagtacctagtaaaat

SEQ ID NO: 221323 - DNA, 75 bp, Artificial Sequence
  Synthetic
tcagaagagctcgtctttggtcaagttgctgtgagctcaggttgcccatatagacacctgcactcaatggccttt

SEQ ID NO: 221324 - DNA, 75 bp, Artificial Sequence
  Synthetic
ttcaggtcttccttcaatgtccatccaggtcttagcatttgggtcaagttgcagcattgcatccttgagggtcat

SEQ ID NO: 221325 - DNA, 75 bp, Artificial Sequence
  Synthetic
agatgccccttcccaccaagctaaaggcagcaacacagccgagtgcaccatcaaccgaggcgacccagaacacaa

SEQ ID NO: 221326 - DNA, 75 bp, Artificial Sequence
  Synthetic
ctttatttcctttgaggcactcattgccagattgttgtgctggatgcacgcagcggaaaactgagactatctgcc

SEQ ID NO: 221327 - DNA, 75 bp, Artificial Sequence
  Synthetic
ttaaaaactgaccttctatctctccttttctcaatctgttcctaaacacttggtattcttcttcgatctgcagct

SEQ ID NO: 221328 - DNA, 75 bp, Artificial Sequence
  Synthetic
ttaatagcatagcacttcgagcactcccctgtcttttgataaatcaattggtattcagcaccattcaatgagaac

SEQ ID NO: 221329 - DNA, 75 bp, Artificial Sequence
  Synthetic
ctctttgtgtttagcacaagtttctatctcatcagcatcttccttcacctagtcaaaataccaactcataggcat

SEQ ID NO: 221330 - DNA, 75 bp, Artificial Sequence
  Synthetic
tatgtaaggccagccgtcaccggaaagacagatcttgtaaagtatgttctcataagggttcctctcaccaggtgt

SEQ ID NO: 221331 - DNA, 75 bp, Artificial Sequence
  Synthetic
gcttatcattgacccagtcaggtatttgttcattgtagaatgatgttctcccgtctataagtggtattaaattga

SEQ ID NO: 221332 - DNA, 75 bp, Artificial Sequence
  Synthetic
caggagatgacctgacaaagcactccagcagtattaagacattgcccgtcagtttgtaaccgtccggtaccacaa

SEQ ID NO: 221333 - DNA, 75 bp, Artificial Sequence
  Synthetic
tcttcaatccaagttgagatttgatatatgatttcatcattgctgacacaacattaaaaggaatctccaccatct

SEQ ID NO: 221334 - DNA, 75 bp, Artificial Sequence
  Synthetic
ctcttttgttgagttgattttaattcaacaagattgttgactgcttgatttaggtccctcaaccgcttcaaatca

SEQ ID NO: 221335 - DNA, 75 bp, Artificial Sequence
  Synthetic
tgcatgtggcataagtctttatactgatcccagactgcattttcatacttcctggaatcagttttgctgagggca

SEQ ID NO: 221336 - DNA, 75 bp, Artificial Sequence
  Synthetic
gacttatcctcactgttgtgctcgcaaccatttgcgttgcaagaatcaacctcaatacagagggacaggagtttc

SEQ ID NO: 221337 - DNA, 75 bp, Artificial Sequence
  Synthetic
tccactaggtactttgatactagatccttgacgcaggctatgtcttcctccatgttcggctgcaggtatgatgat

SEQ ID NO: 221338 - DNA, 75 bp, Artificial Sequence
  Synthetic
tattctaggtgaccatttcatctttgtggaagctaagtcactcataaatggcagtatgtgcttctcaaatagaga

SEQ ID NO: 221339 - DNA, 75 bp, Artificial Sequence
  Synthetic
gtccatgatggcatcataaacatcacaatcaaggatcttgaaatcaattccataagagttggtttctatgccaac

SEQ ID NO: 221340 - DNA, 75 bp, Artificial Sequence
  Synthetic
cttcaacaaacaggccattcaaaggttgaaagctgaagcacaaatgagcattcagttgatcaacaaggcagtgaa

SEQ ID NO: 221341 - DNA, 75 bp, Artificial Sequence
  Synthetic
aaattcttgtaaaggcatagaagaaacaaaaggcaatcaaagacaatcaaattggatagccttaatgcctaggat

SEQ ID NO: 221342 - DNA, 75 bp, Artificial Sequence
  Synthetic
ctgtgtggtagatcttgcacaaccactctgtacaaaggagtctatgaacttcaggccctggaattaaacatggag

SEQ ID NO: 221343 - DNA, 75 bp, Artificial Sequence
  Synthetic
acactcaatatgaccatgcctctctcttgcacaaagaacaatagtcaccactatataagggtgggtaatgagaca

SEQ ID NO: 221344 - DNA, 75 bp, Artificial Sequence
  Synthetic
cttgcacaaagaacaatagtcaccactatataagggtgggtaatgagacaggactagaactaaccttgaccaaca

SEQ ID NO: 221345 - DNA, 75 bp, Artificial Sequence
  Synthetic
acacaacaaagaactgagactatctgccaaaatgacaaaagcaaagcgcaatccaatagcctaggatccactgtg

SEQ ID NO: 221346 - DNA, 75 bp, Artificial Sequence
  Synthetic
cggggatcctaggcaattcagctggacttcagtggaaagactctttttagtgaatccctaaatcaaagtgcctaa

SEQ ID NO: 221347 - DNA, 75 bp, Artificial Sequence
  Synthetic
gccaaccattgtggcacagttgcaaatggcgttttgcagaccttcatgaggatggcctggggtgggagctacatt

SEQ ID NO: 221348 - DNA, 75 bp, Artificial Sequence
  Synthetic
ctgaacttggttgatagagggcaacttccactggatcttcaggtcttccttcaatatccatccaagtcttagcat

SEQ ID NO: 221349 - DNA, 75 bp, Artificial Sequence
  Synthetic
gcacattcacatggacactgtcagattctgaaggtaaggatacaccaggggggtactgtctgaccagatggatgc

SEQ ID NO: 221350 - DNA, 75 bp, Artificial Sequence
  Synthetic
actcaatgtcctcaatacacttctccggcccaaacaactctgaacatgtccttcccttcagtcttaggctgcccc

SEQ ID NO: 221351 - DNA, 75 bp, Artificial Sequence
  Synthetic
agttgatcaacaaggctgtgaacgctttaataaatgatcaattgataatgaaaaaccatctgcgggatatcatgg

SEQ ID NO: 221352 - DNA, 75 bp, Artificial Sequence
  Synthetic
actgggaaaacatcactgcctagatgctggcttgtgtcaaatggctcatatctaaacgagacccacttctctgat

SEQ ID NO: 221353 - DNA, 75 bp, Artificial Sequence
  Synthetic
ttcaatgcaccaattaaaaggtgcggcgaactatcaccaatctcctttacaaacatttccaaatcttgatcttgg

SEQ ID NO: 221354 - DNA, 75 bp, Artificial Sequence
  Synthetic
gctggcttgtgtcaaatggctcatatctaaacgagacccacttctctgatgacattgaacaacaagctgacaaca

SEQ ID NO: 221355 - DNA, 75 bp, Artificial Sequence
  Synthetic
cctcaaggattgtgtccacaaaaaggattttatttcctttgaggcactcatcgccagattgttgtgttgaatgca

SEQ ID NO: 221356 - DNA, 75 bp, Artificial Sequence
  Synthetic
agctgcctgtcaattgtgatgtaagtgcctcaaagtaatcctcgatgagccttgtgaacatctttgttctgaggt

SEQ ID NO: 221357 - DNA, 75 bp, Artificial Sequence
  Synthetic
cgcacagtggatcctaggcaattttgttgttcttttttgaggccctgtgcgctgaactccttcaaatgggaaaca

SEQ ID NO: 221358 - DNA, 75 bp, Artificial Sequence
  Synthetic
tgggaagatcactgccaattctcgagaccatctcccatcggttatctcgggctcctctcacaaaggaccagagat

SEQ ID NO: 221359 - DNA, 75 bp, Artificial Sequence
  Synthetic
tgtgtggcgtgtgggccagctggcagtaccccacaaaagctcttacagaaatgagagacaatatgcctaggatcc

SEQ ID NO: 221360 - DNA, 75 bp, Artificial Sequence
  Synthetic
tgtggactctataaacaacctggtgtacctgtaaaatggaagagataagactcccatcagggcccccgtgaccca

SEQ ID NO: 221361 - DNA, 75 bp, Artificial Sequence
  Synthetic
attgaggttttatgagggaaccaagtaaatgatccaagtgtccttgttgttgcaacaaaagaacggacatatgat

SEQ ID NO: 221362 - DNA, 75 bp, Artificial Sequence
  Synthetic
gttctgtaagagctgctggttcgaaaacaagggcctagttgagtgcaacaaccactatctgtgtctcaactgcct

SEQ ID NO: 221363 - DNA, 75 bp, Artificial Sequence
  Synthetic
gctgcatcaaacatgatgcagtccattagagcacagtgaggggttatttcctctttaccacctcttttcttcttc

SEQ ID NO: 221364 - DNA, 75 bp, Artificial Sequence
  Synthetic
ctctttaccacctcttttcttcttctcaacgacaacacctgtgtgcatatggcataaatctttatactgatccca

SEQ ID NO: 221365 - DNA, 75 bp, Artificial Sequence
  Synthetic
atgcacgcaataaaaagctgagactatctgccaaaatgacaaaagcaaagcgcaatccaatagcctaggatccac

SEQ ID NO: 221366 - DNA, 75 bp, Artificial Sequence
  Synthetic
agttgggatttgatgtatgatttcatcattgctgatacaacattaaatgggatctcaaccattttgtgcatatgc

SEQ ID NO: 221367 - DNA, 75 bp, Artificial Sequence
  Synthetic
catgtgagtacttagcatcttgcttgaactgctttaaatcagtgggctcacggaagaagtgaatgtagcagcctg

SEQ ID NO: 221368 - DNA, 75 bp, Artificial Sequence
  Synthetic
gaccagttgaattgtaagactgaggtgactcttgactataaaaacatagattctttaacattgctgtggtacaat

SEQ ID NO: 221369 - DNA, 75 bp, Artificial Sequence
  Synthetic
agaccatcaaccactccaacagcacctccaactggagcagcggacagcatcagacccccaccctacagtccctga

SEQ ID NO: 221370 - DNA, 75 bp, Artificial Sequence
  Synthetic
gatcaagttgcaacattgcatctttgagagtcataagctgagaataggtaagcccggcagtgaaccctgttgact

SEQ ID NO: 221371 - DNA, 75 bp, Artificial Sequence
  Synthetic
tctcctgacagacaaattttatagagtatattttcataaggattcctttcgccaggggtgtctgatatgaacatc

SEQ ID NO: 221372 - DNA, 75 bp, Artificial Sequence
  Synthetic
tcagtcttgctgagggcaatgtcaattagtttaatgtcttttcttccttgtgattcaaagagtttccttatgtca

SEQ ID NO: 221373 - DNA, 75 bp, Artificial Sequence
  Synthetic
cagactaaaattgtaaccagagatgttcagggagctcttgctggtgtctatcatatttagaatagggtggctctg

SEQ ID NO: 221374 - DNA, 75 bp, Artificial Sequence
  Synthetic
aacttggcatggtaccgaactgattgttaagcaagtccgcatttttcacatcccaaattctcaccactccatctt

SEQ ID NO: 221375 - DNA, 75 bp, Artificial Sequence
  Synthetic
tccctgtgtcaaacttaaaatttagacatttgcttttataatgggaatatttccccattaacctgttcccgttca

SEQ ID NO: 221376 - DNA, 75 bp, Artificial Sequence
  Synthetic
agagcccgtctctggtcaagttgttgtgaactcaggttacccatataaacacctgcgctcaacggcctttctgtt

SEQ ID NO: 221377 - DNA, 75 bp, Artificial Sequence
  Synthetic
gggtgtattgcagtctgcctgctgctgtctttctggttgctccctatactgactgataatattgtcaacagtgca

SEQ ID NO: 221378 - DNA, 75 bp, Artificial Sequence
  Synthetic
gtcatctgaggtcaaagtcccaactctcaacacactcttttgttgagttgatttcaactcaacaaggttgttgac

SEQ ID NO: 221379 - DNA, 75 bp, Artificial Sequence
  Synthetic
tgcttgattaagatccctcaaccgttttagatcaccatcatcccttctctgtttacgcatcaatcgttgaacatt

SEQ ID NO: 221380 - DNA, 75 bp, Artificial Sequence
  Synthetic
tcacaagggttatgcttgaaaaaatccaacaccttaactgtcttaggttcccctaagacccatgcacccagttct

SEQ ID NO: 221381 - DNA, 75 bp, Artificial Sequence
  Synthetic
ccacctgtaatttaatattggaacaataaccagacagttccctcctcaaagattgtgtccacaagaaggacttta

SEQ ID NO: 221382 - DNA, 75 bp, Artificial Sequence
  Synthetic
tctcctttgaggcactcattgtcgggttgttgtgttggacacacacagcaaagagtcaagactatctgctgaatg

SEQ ID NO: 221383 - DNA, 75 bp, Artificial Sequence
  Synthetic
tccaccagatggggaacaagcaagccaaaaccccagaagcaagggacagcccgagagccagtctgatcccagatg

SEQ ID NO: 221384 - DNA, 75 bp, Artificial Sequence
  Synthetic
ccgagagccagtctgatcccagatgctacacacctagggccacagttctgtaagagctgttggttcgaaaacaaa

SEQ ID NO: 221385 - DNA, 75 bp, Artificial Sequence
  Synthetic
ctacacacctagggccacagttctgtaagagctgttggttcgaaaacaaaggcctggtcgagtgcaacaatcact

SEQ ID NO: 221386 - DNA, 75 bp, Artificial Sequence
  Synthetic
cccatctgcaagatgcccctccccacaaaactgagaccatcagccaccccaactgcacccccagccggagcagga

SEQ ID NO: 221387 - DNA, 75 bp, Artificial Sequence
  Synthetic
cctctcccaattggtttgtatcactcatgaactcattgattgcttcagtgtccacataccatgctgatttcccct

SEQ ID NO: 221388 - DNA, 75 bp, Artificial Sequence
  Synthetic
actctcctataggacaagaattcattgatcctgtgtaaaagtatttgtctcttaaaatctcatcactatatatgc

SEQ ID NO: 221389 - DNA, 75 bp, Artificial Sequence
  Synthetic
gtcaggtgtttcttttgtaatgaaatgacacatataagagatatttaaaacaaacttgaatctattggtcatcat

SEQ ID NO: 221390 - DNA, 75 bp, Artificial Sequence
  Synthetic
cctccctcaaagcgttagtggctcgagttaaaactctgttaataatggcaaggagctcataatttcgttcttctt

SEQ ID NO: 221391 - DNA, 75 bp, Artificial Sequence
  Synthetic
tggtgccgcagccttcaacgtggagacaatgtccacccctgaccactgcactctcaaccccagcctatccatgat

SEQ ID NO: 221392 - DNA, 75 bp, Artificial Sequence
  Synthetic
atacaaaggccatcacaaagtacctgatgttttgtaaaaatttttgacaccttttactaggatgtgtcagtatca

SEQ ID NO: 221393 - DNA, 75 bp, Artificial Sequence
  Synthetic
attgttgcgttgaatgcacgcaatagaaagctgagactatctgccaaagtgttaaaagcaaagcgcaatccaata

SEQ ID NO: 221394 - DNA, 75 bp, Artificial Sequence
  Synthetic
aatacaaagtcgtactctgtaaactgtaacttttccatatcaacaacaacctcaacaggagttacatgccctagt

SEQ ID NO: 221395 - DNA, 75 bp, Artificial Sequence
  Synthetic
gtctattttatcattatatagctttctgaaatcctctaataacttcatcttatcagtcttaacaaattgactttc

SEQ ID NO: 221396 - DNA, 75 bp, Artificial Sequence
  Synthetic
tgctgatttacccttaaaggtaggtcctgacaaaaccagcctccagcagtctgacaagacacatgggttcactgc

SEQ ID NO: 221397 - DNA, 75 bp, Artificial Sequence
  Synthetic
ccgctacatcttgaaccaaatatttgccttgctcattcattgaaccgacaaaattcaggtgaatagcaaaacttt

SEQ ID NO: 221398 - DNA, 75 bp, Artificial Sequence
  Synthetic
ttactgtctggcttagttttgcagaccccgaaggtagtaatgcaacagcatcgaagaaatcctccaatgaatcaa

SEQ ID NO: 221399 - DNA, 75 bp, Artificial Sequence
  Synthetic
cactcttgatcaatcttatgaagagcttttcctccaccaccttgtcaaggtcagatattgagggcgaattgcaat

SEQ ID NO: 221400 - DNA, 75 bp, Artificial Sequence
  Synthetic
cattatataatggtgggtaatgagacaggactagaactgaccttgaccaacactagcatcatcaatcataaattt

SEQ ID NO: 221401 - DNA, 75 bp, Artificial Sequence
  Synthetic
aatcagttgattttggttgaacctggctggctcaatgtcgaagtctatccaggcataacccatcattagatcatg

SEQ ID NO: 221402 - DNA, 75 bp, Artificial Sequence
  Synthetic
aagaaaatggacccatcctatgcagtccttcaccctctgggaccgacgttttgtgtgggaaccacgtgaaggacc

SEQ ID NO: 221403 - DNA, 75 bp, Artificial Sequence
  Synthetic
gttcttttctgtattagattgcacaggtgaacagggacaccattcgcaaccgactgatcaatgattgtgtcaatt

SEQ ID NO: 221404 - DNA, 75 bp, Artificial Sequence
  Synthetic
cgactgatcaatgattgtgtcaattgtttctgccagctggtgtggctctttacactttatattgtgaagagctgc

SEQ ID NO: 221405 - DNA, 75 bp, Artificial Sequence
  Synthetic
atttgcctcatgaagttgtcaacagcatcactagtgcttaccactctttcttccaccatgggctcgtgtgttcta

SEQ ID NO: 221406 - DNA, 75 bp, Artificial Sequence
  Synthetic
gcacttagggacttactggttgaaagtttcactcagtgagtcagtggaaagcgcaatccaatagcctaggatcca

SEQ ID NO: 221407 - DNA, 75 bp, Artificial Sequence
  Synthetic
ttatatgacaaagaaaacttaagccttcccgtgtcaggtcccactgagtcataagattgtggcgactcctggcta

SEQ ID NO: 221408 - DNA, 75 bp, Artificial Sequence
  Synthetic
ctggacttcagtggtaagactcatcttagtgaatccccgaatcaaagtgctagtcaaaatgggcaacagacaggc

SEQ ID NO: 221409 - DNA, 75 bp, Artificial Sequence
  Synthetic
cttccattttactatgtgtgagacaagagataaggcttcacagttgacatccaatgccacacagagatccaaaaa

SEQ ID NO: 221410 - DNA, 75 bp, Artificial Sequence
  Synthetic
agataagatctttagcattagcaatgtcttcctccatcaccaattgtggtacctgtattgggtttgggtttgtgc

SEQ ID NO: 221411 - DNA, 75 bp, Artificial Sequence
  Synthetic
agctctgtgagagattgatcaaagagggaaatttgatcatcactagaggtataagcatctatcgtgccaccacat

SEQ ID NO: 221412 - DNA, 75 bp, Artificial Sequence
  Synthetic
tgaataatatgatttaacccaactctgtcctctaacaattttgatgcagttggcttcaaaggaaaatagtcacaa

SEQ ID NO: 221413 - DNA, 75 bp, Artificial Sequence
  Synthetic
agtattctgatgctcctccatctagtagtatctcatcaagatcagtgttatcaacattactacttccctcttttg

SEQ ID NO: 221414 - DNA, 75 bp, Artificial Sequence
  Synthetic
ccccatgatcccaggaccaacactcccacctccatcacccaccccccacccccggggggaccccccgccgggggc

SEQ ID NO: 221415 - DNA, 75 bp, Artificial Sequence
  Synthetic
ccacctccatcacccaccccccacccccggggggaccccccgccgggggccccccggggggcaggcagctcagct

SEQ ID NO: 221416 - DNA, 75 bp, Artificial Sequence
  Synthetic
cccataataagggtctgaaataaccaaccacaccttcacatccacttctaaggtctaacggaacccgccagtatt

SEQ ID NO: 221417 - DNA, 75 bp, Artificial Sequence
  Synthetic
agagactgtatggacttaatatacagattctccttatttggccctcgaacacacttgctacccaatgttctgcat

SEQ ID NO: 221418 - DNA, 75 bp, Artificial Sequence
  Synthetic
agcttcagataacaacttctgtgcacctcgagtaaaggtggaagatagcttattctggatcgttttgacaatagt

SEQ ID NO: 221419 - DNA, 75 bp, Artificial Sequence
  Synthetic
caccgcctattggcggtgggtcacgggggcgtccatttacaggacgactctaggtgttgatgttctgaacaccat

SEQ ID NO: 221420 - DNA, 75 bp, Artificial Sequence
  Synthetic
ttcaaagtaatcttctataagtctagtaaacatctttgttctaagatcaccaatatataattctctgttgccacc

SEQ ID NO: 221421 - DNA, 75 bp, Artificial Sequence
  Synthetic
cctcgagtaaaggtggaagatagcttattctggatcgttttgacaatagtgggaatcttctcatcatccaggttt

SEQ ID NO: 221422 - DNA, 75 bp, Artificial Sequence
  Synthetic
cattagtgcgcagtggggagttatttcctctttaccacctcgcttcttcttttcaacaacaacacctgtgtgcat

SEQ ID NO: 221423 - DNA, 75 bp, Artificial Sequence
  Synthetic
gttttttagtgaagagaggtgctcactagacaagtagtttgttgtaaactcttcatgaagctgtccagtcttcaa

SEQ ID NO: 221424 - DNA, 75 bp, Artificial Sequence
  Synthetic
ccatcaccaattgtggtacctgtgttgggtttgggtttgtgccaatgtggcttgtgggtcagctggtgatgcccc

SEQ ID NO: 221425 - DNA, 75 bp, Artificial Sequence
  Synthetic
tgcgtgcgaacacctctgttaattgtgtgacagccaatgctgtcaacttgttgaaatcataatccaagacacgtg

SEQ ID NO: 221426 - DNA, 75 bp, Artificial Sequence
  Synthetic
acagatgaacagggacaccatttgcaactgactgatcaataattgtgtcaattgtttccgccaattggtgtggtt

SEQ ID NO: 221427 - DNA, 75 bp, Artificial Sequence
  Synthetic
aactgactgatcaataattgtgtcaattgtttccgccaattggtgtggttccttacattttatattgtgaagggc

SEQ ID NO: 221428 - DNA, 75 bp, Artificial Sequence
  Synthetic
tggcaagatgtcatgatcaaagtcctcaaccatgtgattggatagttcagcttttatcagtctaatgtaaaactt

SEQ ID NO: 221429 - DNA, 75 bp, Artificial Sequence
  Synthetic
tagggcctgagcccagcttgacaggttccctatactgatcaacaatcttttcaacagtttcctttagctgatcaa

SEQ ID NO: 221430 - DNA, 75 bp, Artificial Sequence
  Synthetic
cttgaattcttctggatctctttgcaacaattctgtcagagtttgatcaaagagggagatttgatcatcactgga

SEQ ID NO: 221431 - DNA, 75 bp, Artificial Sequence
  Synthetic
ccatcatgggctcatgtgtgcgagagtgtgagttcctcagctcagaagccaatacaacataatgctcctccctct

SEQ ID NO: 221432 - DNA, 75 bp, Artificial Sequence
  Synthetic
aaaatctgatgtgttatgtaatattccctgacccatgtcaagtattgaactgacatgagaaggcaccacaccgat

SEQ ID NO: 221433 - DNA, 75 bp, Artificial Sequence
  Synthetic
cacataagggaatgtttcttcctctgttctctgataactgattgtggggacaactccggagacatcaaagtccat

SEQ ID NO: 221434 - DNA, 75 bp, Artificial Sequence
  Synthetic
taagggggtctagcagtgccttttttacttcttttcccttgaatagagagccattgttaaaactagacacgagaa

SEQ ID NO: 221435 - DNA, 75 bp, Artificial Sequence
  Synthetic
aaacaaaaatgggcacatcatcgggccccacttactatgatccatgctataagagacatgtgccaaggagacatt

SEQ ID NO: 221436 - DNA, 75 bp, Artificial Sequence
  Synthetic
ccccacttactatgatccatgctataagagacatgtgccaaggagacattcaatttcatagaaaggatggcattc

SEQ ID NO: 221437 - DNA, 75 bp, Artificial Sequence
  Synthetic
atcagtcttaacaaattgactttctatgtccccttgccttagtttgttcctgaagatttgatactcctcctcaat

SEQ ID NO: 221438 - DNA, 75 bp, Artificial Sequence
  Synthetic
tcaaattctttttcattgttcagacagctccctgacaactgtgaacttagagcctcaaaataatcctctataagc

SEQ ID NO: 221439 - DNA, 75 bp, Artificial Sequence
  Synthetic
gccaacttgttccttgtaagataaagagaatttgagcctccctgtatcaggtcctactgaatcataggactgtgg

SEQ ID NO: 221440 - DNA, 75 bp, Artificial Sequence
  Synthetic
tagtgcatcaaaaattaatagaagttttctccttgtgttcaatatcctcagagattttactttatttaggaatga

SEQ ID NO: 221441 - DNA, 75 bp, Artificial Sequence
  Synthetic
ccttattaatctatagagcaggaactcaacatcagtgattaattcttcccttattttgtcaataaggtccttatg

SEQ ID NO: 221442 - DNA, 75 bp, Artificial Sequence
  Synthetic
gagaatttgagcctccctgtatcaggtcctactgaatcataggactgtggtgattcttggctataaaaacataag

SEQ ID NO: 221443 - DNA, 75 bp, Artificial Sequence
  Synthetic
gaaacatcgaagctcatgatcaagtcataactgttagaacaaatcactcccatgtcaactttatagtgatccaca

SEQ ID NO: 221444 - DNA, 75 bp, Artificial Sequence
  Synthetic
tgcttccgagttactctccctctcactaattctcacatcatcagaaagcttacccatgtcaaacttaaaattaag

SEQ ID NO: 221445 - DNA, 75 bp, Artificial Sequence
  Synthetic
tacccatgtcaaacttaaaattaaggtttcttgacttataatgagtgtactttcccataagtgtatttgcattca

SEQ ID NO: 221446 - DNA, 75 bp, Artificial Sequence
  Synthetic
ctggaagtactcatgatcaaagtatgttcttgttgatactgcctttgtcaactccccaataggacattgtgacat

SEQ ID NO: 221447 - DNA, 75 bp, Artificial Sequence
  Synthetic
tggtcaaaataccaactcataggcatgttgtaggcaagtcgtgtcccaaacctcacagactgaatcacatgggca

SEQ ID NO: 221448 - DNA, 75 bp, Artificial Sequence
  Synthetic
agattgttgtgctggatgtgcacagcagaaagctaagattatctgccaaaatgacaaaagcaaagcgcaatccaa

SEQ ID NO: 221449 - DNA, 75 bp, Artificial Sequence
  Synthetic
ttgatgccttggtggcatgaggcaatcacttcctcataatgattagagcgattgtccatcagaacatttaaactc

SEQ ID NO: 221450 - DNA, 75 bp, Artificial Sequence
  Synthetic
cggggatcctaggcaatttgattgttcttccttcttgaagctttttgcgctgaactcctccaaatgggaaacaag

SEQ ID NO: 221451 - DNA, 75 bp, Artificial Sequence
  Synthetic
ttcaacctactattctcatagacagcattacaaaattcctcataaaatttgtctggtaagacatcatgatcaaag

SEQ ID NO: 221452 - DNA, 75 bp, Artificial Sequence
  Synthetic
tgaactcctccaaatgggaaacaagcaaaccaaagccccagaagtgaaaggcagtccgagagccagcctgattcc

SEQ ID NO: 221453 - DNA, 75 bp, Artificial Sequence
  Synthetic
tcttcaaccatgtggttagacaattcacccttaatcaacctaatatagaacttatttgagacaatttcatctaga

SEQ ID NO: 221454 - DNA, 75 bp, Artificial Sequence
  Synthetic
ggaactttctcgcattgtagatcatttcatgaagctcttcttctgacgcatcatcctttgggttcacactgacat

SEQ ID NO: 221455 - DNA, 75 bp, Artificial Sequence
  Synthetic
aggttccctatactgatcaacaatcctttcaacagtctccctcagctgattgaaataaatgcttgcacccccatc

SEQ ID NO: 221456 - DNA, 75 bp, Artificial Sequence
  Synthetic
agtatggcttgtaggtcagatggtggtgccccacaaaggcttcaacaaaaatgagagacaatatgcctaggatcc

SEQ ID NO: 221457 - DNA, 75 bp, Artificial Sequence
  Synthetic
cagctgctctaattttttgaagtcctcaatgtacttttgctcaaagttagcaggagatgacctaacaaaacactc

SEQ ID NO: 221458 - DNA, 75 bp, Artificial Sequence
  Synthetic
ctttcaacagtctccctcagctgattgaaataaatgcttgcacccccatcgagtaaaatttcgtctaagtcagct

SEQ ID NO: 221459 - DNA, 75 bp, Artificial Sequence
  Synthetic
ggtgccccatttgcaagatgccccttcccacaaaactgaaaccatcaaccacaccaacagcacccccaaccggag

SEQ ID NO: 221460 - DNA, 75 bp, Artificial Sequence
  Synthetic
caacatcctttaaagcagtggtggccttcaaaatggttttctggaatatcgaattgagaatttgattcttactca

SEQ ID NO: 221461 - DNA, 75 bp, Artificial Sequence
  Synthetic
ttattaaaatcatagttcaatattctagagccatctgtgtatttattgacgacaacacttttattgctagctaga

SEQ ID NO: 221462 - DNA, 75 bp, Artificial Sequence
  Synthetic
tagagccatctgtgtatttattgacgacaacacttttattgctagctagatctaaggctgttgcacaaccactag

SEQ ID NO: 221463 - DNA, 75 bp, Artificial Sequence
  Synthetic
tcaacccattttttaagatccctttttgttgactccaaagaaactagtctatcattgacacttatgaagcaagac

SEQ ID NO: 221464 - DNA, 75 bp, Artificial Sequence
  Synthetic
caccatcaccttcccctttgacttactataacagagagcatagcctttgaattccacccagttgtccactgtctc

SEQ ID NO: 221465 - DNA, 75 bp, Artificial Sequence
  Synthetic
tccgctaggtactttgatactaaatctttgacataggctatgtcttcctccatgtttggctgtaggtgtgatggt

SEQ ID NO: 221466 - DNA, 75 bp, Artificial Sequence
  Synthetic
gaaccattgttaaaagaagatgtgaggagggacaagaatttctttgagacaccaggccttttgtagtttggcccc

SEQ ID NO: 221467 - DNA, 75 bp, Artificial Sequence
  Synthetic
accaggccttttgtagtttggccccgcaatacttgtgcacccctccttattcaagaacctttttgcattgtggac

SEQ ID NO: 221468 - DNA, 75 bp, Artificial Sequence
  Synthetic
ctagagcaacagctcactatagaatagggtcccgtagggggcacagaaggcacaagagtcaattaaaggcaacaa

SEQ ID NO: 221469 - DNA, 75 bp, Artificial Sequence
  Synthetic
agggtcccgtagggggcacagaaggcacaagagtcaattaaaggcaacaaaattagatagccttaatgcctagga

SEQ ID NO: 221470 - DNA, 75 bp, Artificial Sequence
  Synthetic
catgaccaaattttacctttggttcaagaaacttttcaaaacactttatctggtctgtcagcctatctggtgttt

SEQ ID NO: 221471 - DNA, 75 bp, Artificial Sequence
  Synthetic
acaagaaaggacacatcatagggccccacttactgtgatccatactatatgatacatgtgccgatgagacattca

SEQ ID NO: 221472 - DNA, 75 bp, Artificial Sequence
  Synthetic
gccatccatcccctgacaaacaaatcttgtagagtatgttttcataaggattcctctcgccaggggtgtctgaaa

SEQ ID NO: 221473 - DNA, 75 bp, Artificial Sequence
  Synthetic
cctctgtttgcgcatcaaccgctgaacattgctgacttcagagaagtcaagtccatgtaaaagagcctgggcatc

SEQ ID NO: 221474 - DNA, 75 bp, Artificial Sequence
  Synthetic
tagtaatgaaatgacacatgtatgagatgttcaagacaaacttgaacctattggtcatcatactgacaacctcct

SEQ ID NO: 221475 - DNA, 75 bp, Artificial Sequence
  Synthetic
tagagggcaatttccactggatcttcaggtcttccttcaatgtccatccaggtcttagcatttgggtcaagttgc

SEQ ID NO: 221476 - DNA, 75 bp, Artificial Sequence
  Synthetic
ctgttggtcatcatactcttcacatcctcagataaaaccaagctcattaatgtccttattaatctgtaaagcaag

SEQ ID NO: 221477 - DNA, 75 bp, Artificial Sequence
  Synthetic
cctcagataaaaccaagctcattaatgtccttattaatctgtaaagcaagaattcaacatcagtgatcagttctt

SEQ ID NO: 221478 - DNA, 75 bp, Artificial Sequence
  Synthetic
attatgaagtacctaaggttttggaggagcttttgagagcgtttactaggatgggctagaatcaaaaccaagatc

SEQ ID NO: 221479 - DNA, 75 bp, Artificial Sequence
  Synthetic
gtggcttcccatctgattccagatcaacgacagtgttttcccaggcccttcctgttattgaggttcttgatgcaa

SEQ ID NO: 221480 - DNA, 75 bp, Artificial Sequence
  Synthetic
ggagcttttgagagcgtttactaggatgggctagaatcaaaaccaagatcatctttgtcaaagacctaatattgt

SEQ ID NO: 221481 - DNA, 75 bp, Artificial Sequence
  Synthetic
aggtggatggcaaagctttccttgaaactagcatcctgacttttaatacgaaacctcactgtctgactcagtttt

SEQ ID NO: 221482 - DNA, 75 bp, Artificial Sequence
  Synthetic
ccccgggggagccagccacctccaagattactcaatgtcctcaacaagttcgtccccctcagtcaactcttcgca

SEQ ID NO: 221483 - DNA, 75 bp, Artificial Sequence
  Synthetic
tgtcttttgataaatcaactgaaactcaatgtcacctaaggagaactcttgacaatatgcttctttgcacctcac

SEQ ID NO: 221484 - DNA, 75 bp, Artificial Sequence
  Synthetic
tcaatgtcacctaaggagaactcttgacaatatgcttctttgcacctcaccacttggtatcttgctgacccaaat

SEQ ID NO: 221485 - DNA, 75 bp, Artificial Sequence
  Synthetic
ggcaagactcagtgaagaaagtctttctaagtcaatggttcccagtagatccacatcccccataatataaggaaa

SEQ ID NO: 221486 - DNA, 75 bp, Artificial Sequence
  Synthetic
tctaagtcaatggttcccagtagatccacatcccccataatataaggaaatgtttcttcctctgatctctggtaa

SEQ ID NO: 221487 - DNA, 75 bp, Artificial Sequence
  Synthetic
actattagggcaaatcacctccatatttatcttatagtggtccacactgattccaacatcttttaaagcagtagt

SEQ ID NO: 221488 - DNA, 75 bp, Artificial Sequence
  Synthetic
tttatcttatagtggtccacactgattccaacatcttttaaagcagtagtggcttttgaaatagtcttttggaat

SEQ ID NO: 221489 - DNA, 75 bp, Artificial Sequence
  Synthetic
taattttgtcaattaggtccttgtggtgaaaatcagacacaaatgccatcacaaaatacctaatgttctgtaaaa

SEQ ID NO: 221490 - DNA, 75 bp, Artificial Sequence
  Synthetic
tgtgatggtcagaaccctcagaacatatggtctgctggagcagcaattcgctgtgggacaaggtcccgtgggggg

SEQ ID NO: 221491 - DNA, 75 bp, Artificial Sequence
  Synthetic
atcgccagattgttgtgttaaatgcacgcaacaagaggctgagaatgtctgctgaaatgacaaaagcaaagcgca

SEQ ID NO: 221492 - DNA, 75 bp, Artificial Sequence
  Synthetic
ctgtgggacaaggtcccgtggggggcacagaaaacacaaaaggcaatcaaagacaatcaaattagacaattaaat

SEQ ID NO: 221493 - DNA, 75 bp, Artificial Sequence
  Synthetic
tctagttctttcagcctgctgcctccgctcaacccatttttttagatccctcttcgttgactccaaggaaactag

SEQ ID NO: 221494 - DNA, 75 bp, Artificial Sequence
  Synthetic
agggggtctctcagtgtcttcttcacttctttttctttgaacaatgaaccattattgaaactagacacaaggagt

SEQ ID NO: 221495 - DNA, 75 bp, Artificial Sequence
  Synthetic
tctgtcattgacactcatgaaacaggatcccagccaccctcttaagtgtttttgtctcacttggtcatacttgct

SEQ ID NO: 221496 - DNA, 75 bp, Artificial Sequence
  Synthetic
tggaaagtgtcgcaatcaggatgggacagattgtgacattcttccaagaagttcctcatgttattgaggaagtga

SEQ ID NO: 221497 - DNA, 75 bp, Artificial Sequence
  Synthetic
gcaccggggatcctaggcatttaggattgcgcattttaaaacctcctttttggaaagtgtcgcaatcaggatggg

SEQ ID NO: 221498 - DNA, 75 bp, Artificial Sequence
  Synthetic
acagattgtgacattcttccaagaagttcctcatgttattgaggaagtgatgaatattgtccttattgcactatc

SEQ ID NO: 221499 - DNA, 75 bp, Artificial Sequence
  Synthetic
atcagcaaaagttttctccttgtgttcaatatcctcatagatttaactttgtttaggaatgatctccagcattgc

SEQ ID NO: 221500 - DNA, 75 bp, Artificial Sequence
  Synthetic
tagggcttgtcacattccttctactttcaggaaggtcatgctcactgatctacaaagggacttacgagctgcaaa

SEQ ID NO: 221501 - DNA, 75 bp, Artificial Sequence
  Synthetic
attccctcctcaaagattgtgtccacaaaaaggattttatttcctttgaggcactcatcgccagattgttgtgtt

SEQ ID NO: 221502 - DNA, 75 bp, Artificial Sequence
  Synthetic
ttcctttaccaccatttccttcgccaacattcgcatatagaaacctcaatattggtgatgctctcttgaattgat

SEQ ID NO: 221503 - DNA, 75 bp, Artificial Sequence
  Synthetic
ttcaggaaggtcatgctcactgatctacaaagggacttacgagctgcaaacccttgagttgaatatggagactct

SEQ ID NO: 221504 - DNA, 75 bp, Artificial Sequence
  Synthetic
agatgcaatggagctttggaatgcagatttgttgatagcctcagatagcaatttctgcgcacctcgagtgaaagt

SEQ ID NO: 221505 - DNA, 75 bp, Artificial Sequence
  Synthetic
gatttgttgatagcctcagatagcaatttctgcgcacctcgagtgaaagttgaagacaatttattttggactgtt

SEQ ID NO: 221506 - DNA, 75 bp, Artificial Sequence
  Synthetic
ttgttgaactcattcagtaactgattcttatcaactcttagaaactgaccttctatctctcctttcctcaatcta

SEQ ID NO: 221507 - DNA, 75 bp, Artificial Sequence
  Synthetic
taagggtggggaatgagacaggacttgagctcaccttgaccaacaccagcattcttaatcacaaattctgtaacc

SEQ ID NO: 221508 - DNA, 75 bp, Artificial Sequence
  Synthetic
tgagctcaccttgaccaacaccagcattcttaatcacaaattctgtaacctctctgatgcccacaaaaggaatct

SEQ ID NO: 221509 - DNA, 75 bp, Artificial Sequence
  Synthetic
tttctaaacacttgatactcttcttcaatttgcaatttcacttcatgagctgtcatcttgttgttgatgccttgg

SEQ ID NO: 221510 - DNA, 75 bp, Artificial Sequence
  Synthetic
ccaacttcaatcaatatgaggcaatgagctgcgatttcaatggggggaaaatcactgtgcaatacaacctgagtc

SEQ ID NO: 221511 - DNA, 75 bp, Artificial Sequence
  Synthetic
gagctgcgatttcaatggggggaaaatcactgtgcaatacaacctgagtcatagcttcgcagtggatgcagcagg

SEQ ID NO: 221512 - DNA, 75 bp, Artificial Sequence
  Synthetic
gctgttcagataattctgagcactcttctatccagctgaccataacattgaccactctctgtaggacatcactag

SEQ ID NO: 221513 - DNA, 75 bp, Artificial Sequence
  Synthetic
ttcttgtagttgcaacaaatggtctcacataggactcaaaatagatttgcctcatgaaattgtcaacagcatcac

SEQ ID NO: 221514 - DNA, 75 bp, Artificial Sequence
  Synthetic
cttggggagggagttatattgctcttgattctggacgcggtaactgggactgtataatgaccagttaccaatatc

SEQ ID NO: 221515 - DNA, 75 bp, Artificial Sequence
  Synthetic
tgattctggacgcggtaactgggactgtataatgaccagttaccaatatctaatcattcagaatacaacctggga

SEQ ID NO: 221516 - DNA, 75 bp, Artificial Sequence
  Synthetic
ccaatcaggtatttgttcattataaaatgatgttctcccatctataagtggtattaaattgatatctacactctt

SEQ ID NO: 221517 - DNA, 75 bp, Artificial Sequence
  Synthetic
tctcacaaagaactagagacatatacattagcagaaggttgttggggacattcacctggacactatcagactcag

SEQ ID NO: 221518 - DNA, 75 bp, Artificial Sequence
  Synthetic
gttcaaagttggcaggagatgacctaacaaaacactccagcagtattaggacattgcctgttaatttgtaaccgt

SEQ ID NO: 221519 - DNA, 75 bp, Artificial Sequence
  Synthetic
cattagcagaaggttgttggggacattcacctggacactatcagactcagagggaaatgaaacaccagggggata

SEQ ID NO: 221520 - DNA, 75 bp, Artificial Sequence
  Synthetic
ctggcaccacaaagcatagtgaaggagttaagatcccatgatcgtggagaattctttctacagatttatcctcac

SEQ ID NO: 221521 - DNA, 75 bp, Artificial Sequence
  Synthetic
acactgcagtagccaagtgcaatgagaaacatgatgaagaattttgtgacatgctaaggttgttcgatttcaaca

SEQ ID NO: 221522 - DNA, 75 bp, Artificial Sequence
  Synthetic
ccaaacaaaaaatctagatttaaactctgcaacaaacctaccaatgacactcttagggctcacaaacttattgag

SEQ ID NO: 221523 - DNA, 75 bp, Artificial Sequence
  Synthetic
gaaacatgatgaagaattttgtgacatgctaaggttgttcgatttcaacaaacaggccataaggaggctcaaaac

SEQ ID NO: 221524 - DNA, 75 bp, Artificial Sequence
  Synthetic
gcaagaatcaacctcaatacagagggacaaaagtttcaacccttccattaaaagcatcctgggttctgtttgcac

SEQ ID NO: 221525 - DNA, 75 bp, Artificial Sequence
  Synthetic
taaatgatcagctcatcatgaagaaccacttgagagacatcatgggcataccatattgtaactacagcagatatt

SEQ ID NO: 221526 - DNA, 75 bp, Artificial Sequence
  Synthetic
aacctctcattgtctgctaggtactttgacactaaatctttgacacaagctatgtcttcctccatgcttgactac

SEQ ID NO: 221527 - DNA, 75 bp, Artificial Sequence
  Synthetic
ccacttgagagacatcatgggcataccatattgtaactacagcagatattggtaccttaaccacacatcaacagg

SEQ ID NO: 221528 - DNA, 75 bp, Artificial Sequence
  Synthetic
aaggagttcacaatttcgttcttctttaagtgatgtgacacctacattcctgtctctagttcttttcctgctgtc

SEQ ID NO: 221529 - DNA, 75 bp, Artificial Sequence
  Synthetic
ctactcaatgtcctcaacgtgcctgtcctcctcagtcaactcctcacatgtcctgcctttcagccttaatctacc

SEQ ID NO: 221530 - DNA, 75 bp, Artificial Sequence
  Synthetic
agaccatcagccaccccaactgcacccccagccggagcaggagacggcaccagacccccaccctacagtccctga

SEQ ID NO: 221531 - DNA, 75 bp, Artificial Sequence
  Synthetic
atgagaccaagttttcagatgacatcgaacaacaagctgacaacatgataacagagatgctacaaaaggaataca

SEQ ID NO: 221532 - DNA, 75 bp, Artificial Sequence
  Synthetic
cgaacaacaagctgacaacatgataacagagatgctacaaaaggaatacatagatagacagggcaaaactccact

SEQ ID NO: 221533 - DNA, 75 bp, Artificial Sequence
  Synthetic
acaaagccagacgcaatagagctttgaaacgcagatttgttgatggcttcagatagtaacttctgtgcacctcga

SEQ ID NO: 221534 - DNA, 75 bp, Artificial Sequence
  Synthetic
cataacactttgaacattcacctgtcttctgatatagcaatttaaatcctatcttgttgacaaagaactcttgac

SEQ ID NO: 221535 - DNA, 75 bp, Artificial Sequence
  Synthetic
tctttctccacctggtcaaaataccaacccatagacacattgtaggtaaaccttgcccaaaaccccacaggctga

SEQ ID NO: 221536 - DNA, 75 bp, Artificial Sequence
  Synthetic
aacccatagacacattgtaggtaaaccttgcccaaaaccccacaggctgaaccacatgggcatctgctcctgtgg

SEQ ID NO: 221537 - DNA, 75 bp, Artificial Sequence
  Synthetic
ccttagaagcactcatcttgatctggatactttggggtttactggctgaaagtatcactcagtaagtcaaagaaa

SEQ ID NO: 221538 - DNA, 75 bp, Artificial Sequence
  Synthetic
ggggatcctaggcaatttagctggacttcagtggtaaggctcattttagtgaatccctgaatcaagtgcccagcc

SEQ ID NO: 221539 - DNA, 75 bp, Artificial Sequence
  Synthetic
cagggcccccgtgacccaccgccaattggcggtgggtcacgggggcgtccatctacaggacgactttaggtgttg

SEQ ID NO: 221540 - DNA, 75 bp, Artificial Sequence
  Synthetic
ttggcggtgggtcacgggggcgtccatctacaggacgactttaggtgttgaagttctgaacaccatgtctctagg

SEQ ID NO: 221541 - DNA, 75 bp, Artificial Sequence
  Synthetic
ctgcttgagcactgagaaggctgcatgaccccagacttttcggcctgttgcctccgctcaacccacttctctaag

SEQ ID NO: 221542 - DNA, 75 bp, Artificial Sequence
  Synthetic
caaacataatgcaatccatcagtgcacaatgaggagttatttcctctttaccacctctcttctttttctccacaa

SEQ ID NO: 221543 - DNA, 75 bp, Artificial Sequence
  Synthetic
acaatgaggagttatttcctctttaccacctctcttctttttctccacaactaccccagtgtgcatgtgacatag

SEQ ID NO: 221544 - DNA, 75 bp, Artificial Sequence
  Synthetic
tcctgtatcaggtcccactgagtcataagattgtggcgattcttggctataaaaacacaagttcttcaacattgc

SEQ ID NO: 221545 - DNA, 75 bp, Artificial Sequence
  Synthetic
tactaagagtgatgtcaatcagttttatgtctctcctcccttgtgactcaaggagttttctgatatcctctgatc

SEQ ID NO: 221546 - DNA, 75 bp, Artificial Sequence
  Synthetic
tatgtctctcctcccttgtgactcaaggagttttctgatatcctctgatccttggcaagtgatgaccatgttccg

SEQ ID NO: 221547 - DNA, 75 bp, Artificial Sequence
  Synthetic
atttgaattctgcaacaaatctgccaatgacacttttaggactcacaaatttattgagttgatcactcatataat

SEQ ID NO: 221548 - DNA, 75 bp, Artificial Sequence
  Synthetic
aatcagtcacatcaataccatgtgaatactttgcatcttgtttgaattgcttcaaatctgttggctccctaaaga

SEQ ID NO: 221549 - DNA, 75 bp, Artificial Sequence
  Synthetic
atgtcttcattgaattaatgagagccaaactaagtgttgacagtctttccaaatctgttgcgtttaggatatcaa

SEQ ID NO: 221550 - DNA, 75 bp, Artificial Sequence
  Synthetic
atactttgcatcttgtttgaattgcttcaaatctgttggctccctaaagaaatgtacatagcaacccgagctcgg

SEQ ID NO: 221551 - DNA, 75 bp, Artificial Sequence
  Synthetic
tccaggtttttgcgttgggaatcaagttgaagcacttgaaatctttgagagtcatcaactgagagtaagttaatc

SEQ ID NO: 221552 - DNA, 75 bp, Artificial Sequence
  Synthetic
gttgaagcacttgaaatctttgagagtcatcaactgagagtaagttaatcctgcagcaaagcctgcagactgtaa

SEQ ID NO: 221553 - DNA, 75 bp, Artificial Sequence
  Synthetic
caaggtccaccacagtattttcccatgctcttcccacaatcgaggtccttgatgcaatatagggccatccgtctc

SEQ ID NO: 221554 - DNA, 75 bp, Artificial Sequence
  Synthetic
tgctcttcccacaatcgaggtccttgatgcaatatagggccatccgtctcctgagagacagatcttgtataggat

SEQ ID NO: 221555 - DNA, 75 bp, Artificial Sequence
  Synthetic
cttcatcatagctgacaccacattgaaaggtatttccaccattttgtgcatgtgccacataagcagggttgagag

SEQ ID NO: 221556 - DNA, 75 bp, Artificial Sequence
  Synthetic
gactcttcttaactttcaagattgacttcaagataccatccatggtctgaggtgaaaccttaatagtctctaaca

SEQ ID NO: 221557 - DNA, 75 bp, Artificial Sequence
  Synthetic
cttcaagataccatccatggtctgaggtgaaaccttaatagtctctaacatgttaccaccatcaagcatgcaggc

SEQ ID NO: 221558 - DNA, 75 bp, Artificial Sequence
  Synthetic
tggcctgtaggtcagctggtggtgccccacaaaagctcccacagaaatgagagacaatatgcctaggatcctcgg

SEQ ID NO: 221559 - DNA, 75 bp, Artificial Sequence
  Synthetic
gtgaacttttcttagtgtcaatcatattcagaattggatgactctgagacaatctgtcgagatcagatgagttgg

SEQ ID NO: 221560 - DNA, 75 bp, Artificial Sequence
  Synthetic
attcagaattggatgactctgagacaatctgtcgagatcagatgagttggggtatttggctgtgtaaatcagccc

SEQ ID NO: 221561 - DNA, 75 bp, Artificial Sequence
  Synthetic
aaagtaatcctctatgagtctagtgaacatctttgtcctaagatcaccaatgtataactctctgttgccgccaac

SEQ ID NO: 221562 - DNA, 75 bp, Artificial Sequence
  Synthetic
tggtcaggcatgctaaagttaggcttggcattgttccgaactgattgttgagtaactctgcatttttgacatccc

SEQ ID NO: 221563 - DNA, 75 bp, Artificial Sequence
  Synthetic
tggcattgttccgaactgattgttgagtaactctgcatttttgacatcccaaactctcacaatgccatcactggc

SEQ ID NO: 221564 - DNA, 75 bp, Artificial Sequence
  Synthetic
caatactcatgattgtgtcatagacatcacaatcaagaatttcaagatcaattccatatgaatcgatcttaatac

SEQ ID NO: 221565 - DNA, 75 bp, Artificial Sequence
  Synthetic
gagacagatcttgtaaagtatgttctcataagggttcctctcaccaggtgtatctgaaacaaacattcccaaaga

SEQ ID NO: 221566 - DNA, 75 bp, Artificial Sequence
  Synthetic
ctctcctttgatcaagctgttgtgaactcaaattccccatataaactcctgaactcaaaggcctttctgttctgg

SEQ ID NO: 221567 - DNA, 75 bp, Artificial Sequence
  Synthetic
actcaaattccccatataaactcctgaactcaaaggcctttctgttctggtgacttttgatttcagtttttctaa

SEQ ID NO: 221568 - DNA, 75 bp, Artificial Sequence
  Synthetic
gctttcactgcagctcctaagctgaagttgtaaccagaaatgttcaaggagcttttcttagtgtccaccatattc

SEQ ID NO: 221569 - DNA, 75 bp, Artificial Sequence
  Synthetic
ccggggatcctaggcatttttggttgcgcaattcaagtgtccttcctaacatgggacaaatagtgacatttttcc

SEQ ID NO: 221570 - DNA, 75 bp, Artificial Sequence
  Synthetic
atgggacaaatagtgacatttttccaggaagtgcctcatgtgatagaggaggtgatgaacattgtactcatcgca

SEQ ID NO: 221571 - DNA, 75 bp, Artificial Sequence
  Synthetic
agacacttttctgctgtgtggatttgagctcaacaagattgttgactgcttgattgagatctctcagtcgtttta

SEQ ID NO: 221572 - DNA, 75 bp, Artificial Sequence
  Synthetic
gagctcaacaagattgttgactgcttgattgagatctctcagtcgttttaggtcgccatcatctcttttctgctt

SEQ ID NO: 221573 - DNA, 75 bp, Artificial Sequence
  Synthetic
ggagagcttgagcgtctttaactacctgcaactttatgttggaacagtagccagatagttcccttcttagggatt

SEQ ID NO: 221574 - DNA, 75 bp, Artificial Sequence
  Synthetic
tctcctgcacaaagaacaatagtcaccactacataagggtaggcaatgagacaggactagaactaaccttgacca

SEQ ID NO: 221575 - DNA, 75 bp, Artificial Sequence
  Synthetic
gttgtctgacccttgagtgggtcttgaatgtggtcactccaaaggtttgattagtgcaaagcgcaatccaatagc

SEQ ID NO: 221576 - DNA, 75 bp, Artificial Sequence
  Synthetic
ttgtaacttatctgatgcccacaaaaagaacctctatgatcatgctcttatgagtataatctcaactttccactt

SEQ ID NO: 221577 - DNA, 75 bp, Artificial Sequence
  Synthetic
gcgcaccggggatcctaggcatttttggttgcgcaattcaagtatccttcttaacatgggacaaatagtgacatt

SEQ ID NO: 221578 - DNA, 75 bp, Artificial Sequence
  Synthetic
ttaacatgggacaaatagtgacattctttcaggaagtgcctcatgtgatagaggaggtaatgaacattgtgctca

SEQ ID NO: 221579 - DNA, 75 bp, Artificial Sequence
  Synthetic
gaagcaatgagttgtgactttaatggggggaaaattagtgtgcaatacaacctaagtcacagctatgctgtagat

SEQ ID NO: 221580 - DNA, 75 bp, Artificial Sequence
  Synthetic
gaagggtctatacaatgttgcaacatgcggcctgattggtttagtcaccttcctattgttatgtggtaggtcttg

SEQ ID NO: 221581 - DNA, 75 bp, Artificial Sequence
  Synthetic
gcaagagactcaaagttctcagctgaatcagattgcataggtgaacagggactccatttgcaactgactgatcaa

SEQ ID NO: 221582 - DNA, 75 bp, Artificial Sequence
  Synthetic
gaggatggcctggggtgggagttacattgctcttgattcaggccgcaatgggtgggattgtatcatgaccagtta

SEQ ID NO: 221583 - DNA, 75 bp, Artificial Sequence
  Synthetic
ctatggatgatggaagatttgcacttttgtccctggctctccttctactatctatccaccgttttagatcccttt

SEQ ID NO: 221584 - DNA, 75 bp, Artificial Sequence
  Synthetic
tcaatacctaattattcagaacacaacttgggaagatcactgccaattctcaagaccatctcccattggttacct

SEQ ID NO: 221585 - DNA, 75 bp, Artificial Sequence
  Synthetic
gcctctctcttgtacaaagaacaacagtcaccactatataagggtgggtaatgagacaggactagagttgaccct

SEQ ID NO: 221586 - DNA, 75 bp, Artificial Sequence
  Synthetic
acataagggaatgtttcttcctctgttctttgataactgattgtagggacgaccccagaaacatcaaaattcata

SEQ ID NO: 221587 - DNA, 75 bp, Artificial Sequence
  Synthetic
gaagcactcatcttggtctggacacttggggatttactgattgaaagtatcacacagtaagtcaatgaatggcgc

SEQ ID NO: 221588 - DNA, 75 bp, Artificial Sequence
  Synthetic
ccggggatcctaggcaattcagctggacttcagtggtaaggctcattttagtaaatccctgaatcaaagtactca

SEQ ID NO: 221589 - DNA, 75 bp, Artificial Sequence
  Synthetic
acaaaaagaacctctatgatcatgctttgatgagcataatctcgacttttcacttgtccattcccaacttcaacc

SEQ ID NO: 221590 - DNA, 75 bp, Artificial Sequence
  Synthetic
ctctacactgattccaacatcctttaaagcagcggtggccttcaaaatggttttttggaatatcgagttgagaat

SEQ ID NO: 221591 - DNA, 75 bp, Artificial Sequence
  Synthetic
tttgatgagcataatctcgacttttcacttgtccattcccaacttcaaccaatatgaggcaatgagctgtgactt

SEQ ID NO: 221592 - DNA, 75 bp, Artificial Sequence
  Synthetic
gagatgcagccaaccattgtggtacagttgcaaatggtgttttacaaaccttcatgaggatggcttggggtggga

SEQ ID NO: 221593 - DNA, 75 bp, Artificial Sequence
  Synthetic
agttgcaaatggtgttttacaaaccttcatgaggatggcttggggtgggagttacatcgcccttgactcaggtcg

SEQ ID NO: 221594 - DNA, 75 bp, Artificial Sequence
  Synthetic
atacgacctgggatgatcattgccaattctcaagaccatcccccatcggttatcttgggctcctctcacaaagga

SEQ ID NO: 221595 - DNA, 75 bp, Artificial Sequence
  Synthetic
cgcacagtggatcctaggcttaaaggatacgcttacagaaggtagtctcttctttgtgaaggagagaatccttta

SEQ ID NO: 221596 - DNA, 75 bp, Artificial Sequence
  Synthetic
tgagtgtctgaaagtggactcagcctcatgtttccaccattcttgacaggtgcagttggcccatacactgtctct

SEQ ID NO: 221597 - DNA, 75 bp, Artificial Sequence
  Synthetic
ctaactccagaacaatgggtcaagtgattggattcttccaatcattgcccgagattattaatgaagcgttgaaca

SEQ ID NO: 221598 - DNA, 75 bp, Artificial Sequence
  Synthetic
cttgttaggtcaatctgtgtattctcccatgcacggcctacaatttgagatctagatcctatatagggccatcct

SEQ ID NO: 221599 - DNA, 75 bp, Artificial Sequence
  Synthetic
ttgctctgatctgtgtggctctgcttgccacaatcaagggaatggtcaacatctggaaatctggtttgatacagc

SEQ ID NO: 221600 - DNA, 75 bp, Artificial Sequence
  Synthetic
tcaccagacaggcataatttataaagaatgttttcataaggattcctcaaacctggtttttcattcacaaacatt

SEQ ID NO: 221601 - DNA, 75 bp, Artificial Sequence
  Synthetic
tcctcttcttcctcacattggcaggaagaagttgttctcattcttttacaattggaagatttcatgaatttcaga

SEQ ID NO: 221602 - DNA, 75 bp, Artificial Sequence
  Synthetic
ttttcttggcgtttcacagccaatagactcttaatgatgtcttgaaaattgtcaggtttcaccatgatagtttct

SEQ ID NO: 221603 - DNA, 75 bp, Artificial Sequence
  Synthetic
gtgtgacagttaactttacacagttcatgtcctatgctccaagctcttgctcagtaaacaacacccaccattatt

SEQ ID NO: 221604 - DNA, 75 bp, Artificial Sequence
  Synthetic
aacatattgccaccatccaccaggcatgccccggccttcacagctgctgatagactcaaattgtaacctgaaatg

SEQ ID NO: 221605 - DNA, 75 bp, Artificial Sequence
  Synthetic
tcaaaggtccccaaaacaccacctggggtcttgagttgactttgactaatgaatcaatgataaacatcaccaatt

SEQ ID NO: 221606 - DNA, 75 bp, Artificial Sequence
  Synthetic
ttgttcgcactctcctcctttgttataaactcaagacagggatgatctttagtcaatttgtctagatcatccaga

SEQ ID NO: 221607 - DNA, 75 bp, Artificial Sequence
  Synthetic
ccatgagggtcttcactaacattcatcacaatgtaaccaattgcgtgcagaacatttccgaacatgagggtgtgc

SEQ ID NO: 221608 - DNA, 75 bp, Artificial Sequence
  Synthetic
ttgggatacttcactgtatatagaagaccaagggacgttaagccttggacaacatcattcatttgctcagccccc

SEQ ID NO: 221609 - DNA, 75 bp, Artificial Sequence
  Synthetic
tcaaatggctgcttgagacaatgcacctaagcatcagcaagccaggaaaacacatcgcacctgtcatgtgtgaga

SEQ ID NO: 221610 - DNA, 75 bp, Artificial Sequence
  Synthetic
tggactgtcatgcatgcaatggtcaaagctggcattgagccaaattggtttaccaaaagtttgggatttttgatg

SEQ ID NO: 221611 - DNA, 75 bp, Artificial Sequence
  Synthetic
gacaaaaggggttgctcatcgagtacaatctcactatgaccaaagaccaccacccaaattattggaatcaagtct

SEQ ID NO: 221612 - DNA, 75 bp, Artificial Sequence
  Synthetic
tcccaaatcttgacaacaccattctgattgttccttggttgaaaacctagtgatcttaaaatttccgagcgcttg

SEQ ID NO: 221613 - DNA, 75 bp, Artificial Sequence
  Synthetic
tgtatggactggctaaattattgggctcaagtaagcgtttgtggtttggcgcatgtaacaaggctgactgtcaga

SEQ ID NO: 221614 - DNA, 75 bp, Artificial Sequence
  Synthetic
tccaattgtgctgttgttaagttcccttgatagatacctggtccttgtctgtcactcgaattgattttcctttta

SEQ ID NO: 221615 - DNA, 75 bp, Artificial Sequence
  Synthetic
tgcaatcagaccaccagcacataaaatgcaattactcgaattgcaaaggttacaccagctttaaatacttaatta

SEQ ID NO: 221616 - DNA, 75 bp, Artificial Sequence
  Synthetic
agtttctccagatctgttgcaagatccatgagctcatccttgctgaggctcccaaccctcaaactcacattgttt

SEQ ID NO: 221617 - DNA, 75 bp, Artificial Sequence
  Synthetic
ttcaaaataccacttgggaaaaccattgtgagtataaccatctgaacaccatccaccttctcatgagctctattg

SEQ ID NO: 221618 - DNA, 75 bp, Artificial Sequence
  Synthetic
tgtttgttcttcatcgtcatcaggccgtcaacagacttgttgagatctcttagtttggaaagatcatcatccgtc

SEQ ID NO: 221619 - DNA, 75 bp, Artificial Sequence
  Synthetic
gccaatcctttatcacaagaaggcttcaagcctttttaacctggacactttctgatgcactagggaatgaccttc

SEQ ID NO: 221620 - DNA, 75 bp, Artificial Sequence
  Synthetic
ctcttatcttttctcatcaccctctgaacctgtgagacttggttgaagtccagcccatccatcagagatttagca

SEQ ID NO: 221621 - DNA, 75 bp, Artificial Sequence
  Synthetic
ctgggggatactgtcttgaacagtgggctgtggtgtggtttggcataaagtgttttgataacacagcaatggcca

SEQ ID NO: 221622 - DNA, 75 bp, Artificial Sequence
  Synthetic
tcccttaagacatctcctttagttgctgttgtgaaatgactcaatccccgtcttagagattgagtccatctaaag

SEQ ID NO: 221623 - DNA, 75 bp, Artificial Sequence
  Synthetic
agtgcaatcagaatcatgattcagagttttgtgatatgctaaggctttttgattacaatagaaatgctattcaga

SEQ ID NO: 221624 - DNA, 75 bp, Artificial Sequence
  Synthetic
cttggaacgtcagcaacaccagacatgatcaaatacgtggtataaacacttgatcaagttgcaaagcgttaccct

SEQ ID NO: 221625 - DNA, 75 bp, Artificial Sequence
  Synthetic
acatgatcaaatacgtggtataaacacttgatcaagttgcaaagcgttaccctaatgcctaggatccactgtgcg

SEQ ID NO: 221626 - DNA, 75 bp, Artificial Sequence
  Synthetic
gcttaaatgatcaatctcaagccagattaaaccttttaactaacaccattaattcacttgtctctgacaatttac

SEQ ID NO: 221627 - DNA, 75 bp, Artificial Sequence
  Synthetic
taatgaaaaataagctaagagaactaatgaacgtgccatactgtaattacactagattctggtttattaatgata

SEQ ID NO: 221628 - DNA, 75 bp, Artificial Sequence
  Synthetic
caaagaatggtagacacactcttccacaatgttggttggtatcagatggttcgtacttgaatgaaaccagattca

SEQ ID NO: 221629 - DNA, 75 bp, Artificial Sequence
  Synthetic
gaactcaatggctaagtgaaagtaactctttatacacagaaatgctgactgaagaatatgaaaaaagacagggta

SEQ ID NO: 221630 - DNA, 75 bp, Artificial Sequence
  Synthetic
gaacacctctttctttagtggacctatgcttttggtcaactctcttttacatatcaacattatttgcgcatttag

SEQ ID NO: 221631 - DNA, 75 bp, Artificial Sequence
  Synthetic
tgggtttcccaactcacagacaccttataggtgagggctgcccaaaaccacacagattaacagggtcagggatct

SEQ ID NO: 221632 - DNA, 75 bp, Artificial Sequence
  Synthetic
tgatggaaaagtctgtgtataagaagtaagtcaaagtgcaaagcgttatcctaaatgcctaggatccactgtgcg

SEQ ID NO: 221633 - DNA, 75 bp, Artificial Sequence
  Synthetic
gctcatgtggacattatggtattccaggtaaaccagtcagatggacaaagatgtcaaggtgagcctcgacaccct

SEQ ID NO: 221634 - DNA, 75 bp, Artificial Sequence
  Synthetic
ctcgtctcgggcttggcccgagacgagggggccgccccctcgacccacggcaaagccgtgggtcgagggggttgc

SEQ ID NO: 221635 - DNA, 75 bp, Artificial Sequence
  Synthetic
atttacatggcaactctcggttcatccttaaagatcaagctgttcggtaagagtggttttggaatttgacctgtc

SEQ ID NO: 221636 - DNA, 75 bp, Artificial Sequence
  Synthetic
acctgcccctcgaaagcggcttggaagatgatgcagtccaaaagtgcacagtgtggttcaccactgttgccaccc

SEQ ID NO: 221637 - DNA, 75 bp, Artificial Sequence
  Synthetic
ttcttctttctactcagcacaactccattgtgtcttgtacacaagtgcccaaacttttcccacacaacaccttcg

SEQ ID NO: 221638 - DNA, 75 bp, Artificial Sequence
  Synthetic
aaaaatctggcctgttccgatgaaaaactcatatcaatggtggcaatgtctggtctcccattcatttgcagcagt

SEQ ID NO: 221639 - DNA, 75 bp, Artificial Sequence
  Synthetic
ttttggatatcatcagacccttgacaagtgaaaaccactttctgaggaagtctcattaagatcctactcagaaga

SEQ ID NO: 221640 - DNA, 75 bp, Artificial Sequence
  Synthetic
ccagatctagcattctcaatatcacggagcaagattccatgtgaatatttgctcccattcttgaagcccttttca

SEQ ID NO: 221641 - DNA, 75 bp, Artificial Sequence
  Synthetic
tcatgagggactctaaagcagtgtatgtagttccctgtggaaggctgataaattgccagttccactgggtcattg

SEQ ID NO: 221642 - DNA, 75 bp, Artificial Sequence
  Synthetic
ggtgggccttctatgtcaatccagatggtttcatccatgtccagtttcccaatggcttccttgatcacagcttcc

SEQ ID NO: 221643 - DNA, 75 bp, Artificial Sequence
  Synthetic
tgagtgtcagacaatggactcagtctcatattacctccattttttactggtgcagatggcccatacaccacctcc

SEQ ID NO: 221644 - DNA, 75 bp, Artificial Sequence
  Synthetic
tttgacaaatcaactgtggtgttttcccacgcacgacccacaatctgagatcttgatccaatatagggccagccc

SEQ ID NO: 221645 - DNA, 75 bp, Artificial Sequence
  Synthetic
tctcctgagagacacaacttgtagagaatgttttcatatggattccttagtccaggtttctcattcacgaacatc

SEQ ID NO: 221646 - DNA, 75 bp, Artificial Sequence
  Synthetic
ttttcctgacgcttgataacaagtaaacttttcacaatatcttggaagttgtcaggtttgaccaagattgtttcc

SEQ ID NO: 221647 - DNA, 75 bp, Artificial Sequence
  Synthetic
aacatgttaccaccatccaccaagcaagcaccagcttttacagctgctgatagactgaggttgtaaccagatatg

SEQ ID NO: 221648 - DNA, 75 bp, Artificial Sequence
  Synthetic
ttattagcgctttcctctttggtgatgaactcaagacagggatgatctttgctcaacttgtttaaatcatctaga

SEQ ID NO: 221649 - DNA, 75 bp, Artificial Sequence
  Synthetic
ttggggtacttaactgtgtataggagacccaaagatgtcagcccttgaacgacatcattcatctgctctgcacct

SEQ ID NO: 221650 - DNA, 75 bp, Artificial Sequence
  Synthetic
tgcactgacatgcatgctatcgtcaaagctggaattgagccaaactggttgattaacagctttgggttcttgatg

SEQ ID NO: 221651 - DNA, 75 bp, Artificial Sequence
  Synthetic
tcccaaactttgacaacaccgttttgattggctcttggttgaaagcccagagacttaagaatctctgaacgtttt

SEQ ID NO: 221652 - DNA, 75 bp, Artificial Sequence
  Synthetic
tctagttgtgctgatgttaagttcccttgatagacaccaggtccttgcctatctcctaggttaatcttccttttc

SEQ ID NO: 221653 - DNA, 75 bp, Artificial Sequence
  Synthetic
aacttctccaggtctgttgcaagatccatgagttcatccttggacaggcttccgatcttgaggctgacattattc

SEQ ID NO: 221654 - DNA, 75 bp, Artificial Sequence
  Synthetic
tgcttattcttcatcaccattaaactgtcaacagatctattgaggtctctcaacttagaaagatcatcatctgat

SEQ ID NO: 221655 - DNA, 75 bp, Artificial Sequence
  Synthetic
ctcttgtcctttctcatgaccctctgaacctgagaaacttggttgaaatccaaaccatccaccagtgatttggca

SEQ ID NO: 221656 - DNA, 75 bp, Artificial Sequence
  Synthetic
tccctcaagacatctccctttgctgatgtggtgaagtgactcagtccccttctgagagactgagtccatctgaag

SEQ ID NO: 221657 - DNA, 75 bp, Artificial Sequence
  Synthetic
tctgagagactgagtccatctgaagctgggaacctcactggcaccagacatgatggaaaagtctgtgtataagaa

SEQ ID NO: 221658 - DNA, 75 bp, Artificial Sequence
  Synthetic
atgatggaaaagtctgtgtataagaagtagtcaaagtgcaaagcgttatcctaaatgcctaggatccactgtgcg

SEQ ID NO: 221659 - DNA, 75 bp, Artificial Sequence
  Synthetic
cgcaccgaggatcctaggcacaaacagctcacgcctcctgtgatcctcttgcagagcaccatcaatcatgggctc

SEQ ID NO: 221660 - DNA, 75 bp, Artificial Sequence
  Synthetic
caagcaaagtgctccccccaaaccgctccagctcccacaaccaagagtgtccctgctcagggaggcgaagccctc

SEQ ID NO: 221661 - DNA, 75 bp, Artificial Sequence
  Synthetic
actgtacggaagatacaattgcaaatgttgttggtttcaggacaagaatcttgttgaatgtagcgatcactacct

SEQ ID NO: 221662 - DNA, 75 bp, Artificial Sequence
  Synthetic
ctgcctgaagtgcatcagttcaatgctaaaaagaggcaagaactgtgaaatctgtggcaaagcaattccaaccta

SEQ ID NO: 221663 - DNA, 75 bp, Artificial Sequence
  Synthetic
cattgaagtcggcataactccaacagcaccgcaactcaactgagccaaaggctcccccggcgagggcccccagtg

SEQ ID NO: 221664 - DNA, 75 bp, Artificial Sequence
  Synthetic
ggggccctcgccccgggggggccccccccgggatcgggggagtggtcctgcattactcaatgtcctgcacctcct

SEQ ID NO: 221665 - DNA, 75 bp, Artificial Sequence
  Synthetic
cttcaatcaacctcctacacagaatacctttgagcctattcctaccattggtgtcagagatcattaaacacttga

SEQ ID NO: 221666 - DNA, 75 bp, Artificial Sequence
  Synthetic
aagatttactatagcatatcatataatttcctagattaagccagctatcatatcttgctaatgatgaattgagtt

SEQ ID NO: 221667 - DNA, 75 bp, Artificial Sequence
  Synthetic
cagacaaatagctttccactagtagcaaaagcttgtcttgatgtatgtataacttgctcttggtttgatctgaat

SEQ ID NO: 221668 - DNA, 75 bp, Artificial Sequence
  Synthetic
aaacccacaaattaaaaagaaacaaatctctggatgaaagagattctaattcagataatgcttgcattattctat

SEQ ID NO: 221669 - DNA, 75 bp, Artificial Sequence
  Synthetic
ctgccgaaaaatcgaattgaagggttgttaacttcctaccgccatgtagaatcactcctctatcaagaaccaaag

SEQ ID NO: 221670 - DNA, 75 bp, Artificial Sequence
  Synthetic
gctcatcaacaattactggtccactcaagtgataagaaaacttattacaaagttcatgtttatatttttcaaaat

SEQ ID NO: 221671 - DNA, 75 bp, Artificial Sequence
  Synthetic
tgaaatgaaaggatggcaaggactctgagtaagaaaaagtcaaatcttcttcctcaagtcttgacactaagtcaa

SEQ ID NO: 221672 - DNA, 75 bp, Artificial Sequence
  Synthetic
attttaggtttccatttatcaagggctcttggacaattaaaggtgcagcatcaagggtaaagtggtttccatcat

SEQ ID NO: 221673 - DNA, 75 bp, Artificial Sequence
  Synthetic
gcccactacaaaaaagttctaaatcatcaacaaccaattcaacactttgatcttcttgccccagggaattgagga

SEQ ID NO: 221674 - DNA, 75 bp, Artificial Sequence
  Synthetic
taacctctttcaaaatggatgttctcactatcagagtgtatacagttgttctcttgaggttgaatctcaatgctc

SEQ ID NO: 221675 - DNA, 75 bp, Artificial Sequence
  Synthetic
tcttgacatgtgagatttgtattacaaactgtaagtcaatactattttttgtaaattccgatttaatcatctgta

SEQ ID NO: 221676 - DNA, 75 bp, Artificial Sequence
  Synthetic
tgaaatctttacggtcctcagtcccaccaatgaaatctgaatcaatctgttgcaaaaatatgggttttgataatg

SEQ ID NO: 221677 - DNA, 75 bp, Artificial Sequence
  Synthetic
aaaatgttgtcacactaactgtggaactaatataacctgcactaaggtcctcagaatgcattgctctatcaacat

SEQ ID NO: 221678 - DNA, 75 bp, Artificial Sequence
  Synthetic
taaacttttttacctgtagggcaaagtcagtgagcaaccctaagtcaacatcctcatcagtctctaaggttaaga

SEQ ID NO: 221679 - DNA, 75 bp, Artificial Sequence
  Synthetic
cttgttgaaaccaattgaatttcttcaactctgaactggtcaagactagaggttggaccaaagaactcattatta

SEQ ID NO: 221680 - DNA, 75 bp, Artificial Sequence
  Synthetic
attgtgtcataaagttttgacaaacttgggtggatgtcaattcaacatccacacaaatgctcttctgacacctta

SEQ ID NO: 221681 - DNA, 75 bp, Artificial Sequence
  Synthetic
tgtgtgattgtgagctctcatcctgctttacaatgtagatatcatgcctcctattctttaagaagtgtttcacaa

SEQ ID NO: 221682 - DNA, 75 bp, Artificial Sequence
  Synthetic
tacctaagttctcattggccaagtccaaagctacacaaacatcaaggaatttgactgtcatggtgccaagggttc

SEQ ID NO: 221683 - DNA, 75 bp, Artificial Sequence
  Synthetic
taccagcttgaaaatcactcataaagggtgataggtgagtctcaaagagttgtgggtaatttcttctgattgatt

SEQ ID NO: 221684 - DNA, 75 bp, Artificial Sequence
  Synthetic
gaagaatatgagttagaccaagcttttcctcaatctgacatgagacccttggtttaacaagccaaaaaagattag

SEQ ID NO: 221685 - DNA, 75 bp, Artificial Sequence
  Synthetic
gatttcttaggaaattaatatcttttgggtactcaacatcttcaaaaacccattcaccaagttcacaagcattgg

SEQ ID NO: 221686 - DNA, 75 bp, Artificial Sequence
  Synthetic
acaataccaaagagaagtagtcccacattaatggccttgtgaaactctctatcttaaggcacgaactggagcagt

SEQ ID NO: 221687 - DNA, 75 bp, Artificial Sequence
  Synthetic
atgtgacccctttccaccttgcgcacacttcacagggacagtacaagtcaacttttgacttcagttcttttatat

SEQ ID NO: 221688 - DNA, 75 bp, Artificial Sequence
  Synthetic
aataaaatcccccttctcctgttctcacacacttactcccaacactttggcagaagcctatgaagcctgaggcta

SEQ ID NO: 221689 - DNA, 75 bp, Artificial Sequence
  Synthetic
tggaagactgaaaggctgacttgtttattgactctgcgagaatcttttttgcaccttttacaaagttcttagata

SEQ ID NO: 221690 - DNA, 75 bp, Artificial Sequence
  Synthetic
atttagattgtatagacttgatcaaactaggaatttcttctgtttcaattatcctccttgaactcattaactttg

SEQ ID NO: 221691 - DNA, 75 bp, Artificial Sequence
  Synthetic
ttctaaggactaacctcaaatcaccatgagcacacaggttgatccatcttattctacagagtagggcaatatcct

SEQ ID NO: 221692 - DNA, 75 bp, Artificial Sequence
  Synthetic
cttctgaaacaccaacacttcttaaaaatccagtaattgccttatcaccatcctcttgcacaagatcaaccagag

SEQ ID NO: 221693 - DNA, 75 bp, Artificial Sequence
  Synthetic
cttgctcaactatttttcctgattttatgttggagaagactttcctagctgcttgtctaataaagctagtgcatc

SEQ ID NO: 221694 - DNA, 75 bp, Artificial Sequence
  Synthetic
catcactctcaagatgtaattcaatattcctttgaagtctataacctctgctaccatccacccaatctttaacat

SEQ ID NO: 221695 - DNA, 75 bp, Artificial Sequence
  Synthetic
caaggttttctacattgaggaatgggtgttctccaaacccactatacctaatcagtctgttagtcctgttacata

SEQ ID NO: 221696 - DNA, 75 bp, Artificial Sequence
  Synthetic
tgtatgacacaatctcaacagagacaccattcgctacacattgatcacaaatcgtatccactgtttcagataact

SEQ ID NO: 221697 - DNA, 75 bp, Artificial Sequence
  Synthetic
gaacgggagttttgcacttgacattgtgcaacgcagcagaaacaaactttgtaagtaagggaacttcttcacccc

SEQ ID NO: 221698 - DNA, 75 bp, Artificial Sequence
  Synthetic
aaacaaaaaatcttgatttgaattctgctgcaaatgtcccagcaactgtttttggactgacaaatttgttaaatt

SEQ ID NO: 221699 - DNA, 75 bp, Artificial Sequence
  Synthetic
tagtagagatgaatgcatgaaaatttaaaatagtttcccattcttcaattactttcaatgattcaaagttgcaca

SEQ ID NO: 221700 - DNA, 75 bp, Artificial Sequence
  Synthetic
ttccgctacctatttttatcatggagatttgatcatcactagaggtatatgatgttgtgttcatgtcaaagagga

SEQ ID NO: 221701 - DNA, 75 bp, Artificial Sequence
  Synthetic
aatgaattgcataattaataaactgttcagtaaccaacccatacaagtcagacatattatgaagaatcccctggc

SEQ ID NO: 221702 - DNA, 75 bp, Artificial Sequence
  Synthetic
ccatgtcaatcactgacatcacgtgactcagaggttctctcttctccttaagaagtctatgtacaaatgattcag

SEQ ID NO: 221703 - DNA, 75 bp, Artificial Sequence
  Synthetic
taatagttgatccactcatgttcatcagccccagttgtctcttgatcattcccgtaacatatgcatgaatcacat

SEQ ID NO: 221704 - DNA, 75 bp, Artificial Sequence
  Synthetic
tatatggcacctccacaactttgtggatgtgccaagagagtagtgttataattggatcggtgttcaatttacata

SEQ ID NO: 221705 - DNA, 75 bp, Artificial Sequence
  Synthetic
aggatggaccatacttaagatccaatccctgcagaaatgctgcaaatataacaggagacatatgaggtccccact

SEQ ID NO: 221706 - DNA, 75 bp, Artificial Sequence
  Synthetic
ttgagtgatccagtgacaaactcatatcccctaaattcacacacatcttcatgtcagttatagccttttcaaatt

SEQ ID NO: 221707 - DNA, 75 bp, Artificial Sequence
  Synthetic
cagcttcattatttaagcaagaataactcatgttggaaaccacggattctgaaaaatcctcaattaaccgagtca

SEQ ID NO: 221708 - DNA, 75 bp, Artificial Sequence
  Synthetic
tcagttttgtattcaaatcacccacataaagttctctatttgatccaacctgctctttgtagctcaaaccaaatt

SEQ ID NO: 221709 - DNA, 75 bp, Artificial Sequence
  Synthetic
taagtttccccacatcaggtgaaacatgactataagaaatcggtgattcatcagaataaaaacaaagatttctta

SEQ ID NO: 221710 - DNA, 75 bp, Artificial Sequence
  Synthetic
aggctgagtttgtaaacactgacttgtccaaccttcttgcaatagcttctgagttactttctctagaactcatcc

SEQ ID NO: 221711 - DNA, 75 bp, Artificial Sequence
  Synthetic
taccttcctcccgaactttaagtgcctcaaacttgaagccaaatcttgatctatttttatgttcatacgtaccca

SEQ ID NO: 221712 - DNA, 75 bp, Artificial Sequence
  Synthetic
atttttggtcaaatccagctgttatgagtaaatatttgaaacattcaaacaactcaccatcatcaaaagtggctg

SEQ ID NO: 221713 - DNA, 75 bp, Artificial Sequence
  Synthetic
ttgtcatgtttttgattagtagctctagaggacatgggtttataacactatccaaaaagaacaaagatttgtaat

SEQ ID NO: 221714 - DNA, 75 bp, Artificial Sequence
  Synthetic
tagaattattcactttgaaaaccaatttctgaatcatctggggtggtattatgtctggatcaaaatcctttattt

SEQ ID NO: 221715 - DNA, 75 bp, Artificial Sequence
  Synthetic
catgcaaagagacttctaccaaaatctgcttcataacaccaaattcactccataagttcactaaaacctgttgtg

SEQ ID NO: 221716 - DNA, 75 bp, Artificial Sequence
  Synthetic
gatctgcacatcctgctagagtatttccactatctaacctcttcactccctcttttaaagtactatttgatttag

SEQ ID NO: 221717 - DNA, 75 bp, Artificial Sequence
  Synthetic
atctccccttttccttcagctttcctaatgctatgttaacatctcctttaagtttctccaaaacctcaagttgct

SEQ ID NO: 221718 - DNA, 75 bp, Artificial Sequence
  Synthetic
cttctgacaaggtctccatccactgtgatagttcaaaactgcaaggcttttctcccttgatttttgcatcacttt

SEQ ID NO: 221719 - DNA, 75 bp, Artificial Sequence
  Synthetic
tatcttcatttttcaagaccagattggtcaaatttctcattatggtgtattcttggcaattgatgtccagcttga

SEQ ID NO: 221720 - DNA, 75 bp, Artificial Sequence
  Synthetic
acttgccttttgttttgaatccttcagcaaggtttgtaacacaagaggaaacaagtaactcatagtcgtatctgg

SEQ ID NO: 221721 - DNA, 75 bp, Artificial Sequence
  Synthetic
aaataggattcccaagttcatcaagcttcggcacaacaacacttttattgcttgacaagtctagagcagtactgg

SEQ ID NO: 221722 - DNA, 75 bp, Artificial Sequence
  Synthetic
tgaagttgggtctataagggtcttgtctcaggtgaccattcacatttaacagccctctattaaagctggacacac

SEQ ID NO: 221723 - DNA, 75 bp, Artificial Sequence
  Synthetic
acatgcttaacagagtcttcgacacaccaggacttgttaaatctgtggaacaactcaaactcttacccaaaagtt

SEQ ID NO: 221724 - DNA, 75 bp, Artificial Sequence
  Synthetic
tgtctactccttttagcacttgggcctcctcatcctccgtcatgttctcagtcaaacttggattgacaatgactg

SEQ ID NO: 221725 - DNA, 75 bp, Artificial Sequence
  Synthetic
attcaaattttaacttaggttccatgaatttctcaaaacatttaatctgatctgtaagtctgtctggtgtttctt

SEQ ID NO: 221726 - DNA, 75 bp, Artificial Sequence
  Synthetic
ttgttattagatgacatagataactaacattgagtaaaaacttaaattttctagtcatgtgctcgttatcataat

SEQ ID NO: 221727 - DNA, 75 bp, Artificial Sequence
  Synthetic
ccccttctaaaatcaacctaaagatgtcaaaagaaatacgttgcagacaactttcacaatagcttttcactggta

SEQ ID NO: 221728 - DNA, 75 bp, Artificial Sequence
  Synthetic
ctattaatctatccatcaattctacatggtgaaactgattcacataagccattatgaaatacctaagaccttgca

SEQ ID NO: 221729 - DNA, 75 bp, Artificial Sequence
  Synthetic
ggaaggtctgatttctcttactgggatttgttacgatgagcaatatcaactttcttagtttatcccctaccaaac

SEQ ID NO: 221730 - DNA, 75 bp, Artificial Sequence
  Synthetic
tgtcattgaggttcaggtcagctaaccagagcatcatctctcttgacatgtttaacaaaacaatctgagaaaaaa

SEQ ID NO: 221731 - DNA, 75 bp, Artificial Sequence
  Synthetic
taggcaagaaaaaccttttaggatcacaataaaaggaccctatatactctaattctccattggaaattaaactaa

SEQ ID NO: 221732 - DNA, 75 bp, Artificial Sequence
  Synthetic
tgctataacatcttgacttctccccagttttttggtaagaaagaatcccaactaagtctttagatagaaaaaatc

SEQ ID NO: 221733 - DNA, 75 bp, Artificial Sequence
  Synthetic
tttggcaataacattctatgagatcaacttctccaaagtgattagaagctctcctttcatttatcacagtctttg

SEQ ID NO: 221734 - DNA, 75 bp, Artificial Sequence
  Synthetic
aggtaaatgaggttttcattgaattcaccaaggctaagcacacagaagataagacattaagattcctaaaaaatg

SEQ ID NO: 221735 - DNA, 75 bp, Artificial Sequence
  Synthetic
tctcttcagaaagaggaccaatgggatgctcattatgatccaccttgtcctttccatattgtaatttgaatcttt

SEQ ID NO: 221736 - DNA, 75 bp, Artificial Sequence
  Synthetic
tcaactctagtgaggttgtgattaattctaagctctcgaaatctggaactgttgcccagactaaaacatcatcta

SEQ ID NO: 221737 - DNA, 75 bp, Artificial Sequence
  Synthetic
aggcaacaaattcctgttttttcaactgatgaacacactttgcaatccaattctcacagttctttagtttgttga

SEQ ID NO: 221738 - DNA, 75 bp, Artificial Sequence
  Synthetic
taagtttattcctcaattcattgaggtcaaaatatctgtcattggaaaacaatgccaactgacctgccataagtc

SEQ ID NO: 221739 - DNA, 75 bp, Artificial Sequence
  Synthetic
cacacctcctgtattctgtcaacacttcagggttctgtttccatgagtgaacaatgaagttcaccataattaagt

SEQ ID NO: 221740 - DNA, 75 bp, Artificial Sequence
  Synthetic
caaggaacaacaaagtgtttcttcttgtgttcagcagtttagctgactttattttattgcactgactcaatagtt

SEQ ID NO: 221741 - DNA, 75 bp, Artificial Sequence
  Synthetic
ttaaatagatttgttcagcttgagaaagtgaatcactatgccacattttcgcatagatgggatgataatcgctat

SEQ ID NO: 221742 - DNA, 75 bp, Artificial Sequence
  Synthetic
gaagtggctgccgctttaatgtacctaacttgtctattattgaatacaattttgatgaacatgacatgcaatcaa

SEQ ID NO: 221743 - DNA, 75 bp, Artificial Sequence
  Synthetic
ctggatgttcactatgatgtgttatttgatccaacttggctagaaggccatcacgatttgtaaagacaaacttat

SEQ ID NO: 221744 - DNA, 75 bp, Artificial Sequence
  Synthetic
gaagacttttgttgtttttatactctttaatgaagaattccttcaagacgtttattagattctcttggatttcac

SEQ ID NO: 221745 - DNA, 75 bp, Artificial Sequence
  Synthetic
tttccttcattttactggaaaggttcccaaacatatgtttctttaactcatcgcgatatttaagcccagtttgag

SEQ ID NO: 221746 - DNA, 75 bp, Artificial Sequence
  Synthetic
gaagcttttctatattctcaaaacccagactctgattttctagcttggacagactagtaattaatctctgatact

SEQ ID NO: 221747 - DNA, 75 bp, Artificial Sequence
  Synthetic
caagctcctcaatctcttcaccagattccctcacaaattttattaactgcaataacagccacctgaatctttcta

SEQ ID NO: 221748 - DNA, 75 bp, Artificial Sequence
  Synthetic
tcacccaatcgtctacaaatctattgtaatagttggttctcccatcaacaaggggaactaaggtgatcccacata

SEQ ID NO: 221749 - DNA, 75 bp, Artificial Sequence
  Synthetic
aactaaggtcatcttttaatgacaacaacttgctcatgtcctgattgtatttctgttcaaaagacactggattca

SEQ ID NO: 221750 - DNA, 75 bp, Artificial Sequence
  Synthetic
ccctcacgaaggtttccaaaagaatcaaaacattaccatatagtgaaaaaccatctggtacgattctcggtaatg

SEQ ID NO: 221751 - DNA, 75 bp, Artificial Sequence
  Synthetic
caatggacattatgccctctttcctcagaatcccctcaattgttagcgagtctgagttgtgagtgcagttgttag

SEQ ID NO: 221752 - DNA, 75 bp, Artificial Sequence
  Synthetic
cttccgcagagtctagttccactagtaatgacaacaatttgaatccttctgtaaggatcattttagcatcattct

SEQ ID NO: 221753 - DNA, 75 bp, Artificial Sequence
  Synthetic
ggcaggtaactaaggttatctgttctgttacttttggcctagctgggaaatgcttcctaagtagatcaaataact

SEQ ID NO: 221754 - DNA, 75 bp, Artificial Sequence
  Synthetic
atgcttcctaagtagatcaaataactgattaacaatatcatccatgatcaaggaatgcctaggatcctcggtgcg

SEQ ID NO: 221755 - DNA, 75 bp, Artificial Sequence
  Synthetic
cgcacagtggatcctaggcatattgctgacgcttcaagaagataatctattagtaatcagctcccgtttggaggt

SEQ ID NO: 221756 - DNA, 75 bp, Artificial Sequence
  Synthetic
ttgatcagtcacttagccttcacaatggggcaagtgattggctttttccaatcgctaccagaaatcatcaatgag

SEQ ID NO: 221757 - DNA, 75 bp, Artificial Sequence
  Synthetic
gcactgaatattgccttgatttgtgttgcattgttagccaccatcaaaggagcaatcaatgtttggaaatctgga

SEQ ID NO: 221758 - DNA, 75 bp, Artificial Sequence
  Synthetic
ctaatccaactactcatttttctgactctcgcaggtagaagttgctctcatactttctcaattggtagatatcat

SEQ ID NO: 221759 - DNA, 75 bp, Artificial Sequence
  Synthetic
gagtttcagagtgtgactgtcaacttcactcagtttatgtcatatgctccgagctcctgctcagtcaacaacaca

SEQ ID NO: 221760 - DNA, 75 bp, Artificial Sequence
  Synthetic
catcattatttcaagggccctcaaaacaccagttggggccttgagctcaccttaactaatgaatcgattataaat

SEQ ID NO: 221761 - DNA, 75 bp, Artificial Sequence
  Synthetic
gcaacaaattccatgagggtctttacaaacatccatcacaatgtcacaaactgtgtgcaaaatataaccgagcaa

SEQ ID NO: 221762 - DNA, 75 bp, Artificial Sequence
  Synthetic
gaggatgtgctcaaatggctgcttgagaccatgcatctaagcataaataaaccaggcaagcatattgcacctgtg

SEQ ID NO: 221763 - DNA, 75 bp, Artificial Sequence
  Synthetic
ctttgtgaaagacaaagaggactactcatagaatacaatttaacaaggactcaagatcatcatccaaactattgg

SEQ ID NO: 221764 - DNA, 75 bp, Artificial Sequence
  Synthetic
aaccaaattctgtatggattagccaaaatgttgggttcaacaaaacggctgtggtttggtgcatgcaacaaagct

SEQ ID NO: 221765 - DNA, 75 bp, Artificial Sequence
  Synthetic
gactgtcaaatgcaacctgacaatcaacacataaaatgtaattactcaaattgcaagggtttcactacttttaaa

SEQ ID NO: 221766 - DNA, 75 bp, Artificial Sequence
  Synthetic
tacctcatcatccagaatacaacctgggaaaaccattgtgaatacaaccatctgaacaccattcatctcctcatg

SEQ ID NO: 221767 - DNA, 75 bp, Artificial Sequence
  Synthetic
agttcctctggtcaatcatttatcacaagaagacttcaagcattccttacttggacattatctgatgccaccggc

SEQ ID NO: 221768 - DNA, 75 bp, Artificial Sequence
  Synthetic
aaagatcttcctggtggatactgtcttgaacaatgggctgtagtctggttggggataaagtgttttgataacact

SEQ ID NO: 221769 - DNA, 75 bp, Artificial Sequence
  Synthetic
gccatggctaagtgcaatcaaaaccatgactcagaattttgtgatatgttgagactttttgattacaataggaat

SEQ ID NO: 221770 - DNA, 75 bp, Artificial Sequence
  Synthetic
gcaatccagagtttaaatgatcaatctcaagcaagactgaacctattgaccaacaccattaactcactgatttct

SEQ ID NO: 221771 - DNA, 75 bp, Artificial Sequence
  Synthetic
gacaacttattgatgaaaaataaattgagagagttaatgaatgtaccttattgcaattacacaaggttttggttc

SEQ ID NO: 221772 - DNA, 75 bp, Artificial Sequence
  Synthetic
atcaatgacactaggagcggtagacacactttaccacaatgctggttggtttcagatggttcatatttaaatgag

SEQ ID NO: 221773 - DNA, 75 bp, Artificial Sequence
  Synthetic
acaagatttagaacacaatggttaagtgaaagcaactctctgtacactgagatgttaacagaagattatgaaaga

SEQ ID NO: 221774 - DNA, 75 bp, Artificial Sequence
  Synthetic
agacaaggtcgaacacctctgtcattggttgacctatgcttctggtcaacactcttttacgtcacaaccctattt

SEQ ID NO: 221775 - DNA, 75 bp, Artificial Sequence
  Synthetic
gcacaccttgttggttttccgacccacagacatattgtcaacggtgagtgtccaaagccacacagactaacagga

SEQ ID NO: 221776 - DNA, 75 bp, Artificial Sequence
  Synthetic
tctgggagtgtgttcatgtggtcattatgggattccaggtaaaccagttaaatgggtaaagatgaggggggttgc

SEQ ID NO: 221777 - DNA, 75 bp, Artificial Sequence
  Synthetic
gcttacattgcaaccttgggttcatccttgaagactaagctgtttggcagaagagattttggatgttgacttgtg

SEQ ID NO: 221778 - DNA, 75 bp, Artificial Sequence
  Synthetic
acttgtccttcaaatgcagcctgaaacatgatgcaatccaaaagagcacaatgtggctcaccactgtttcctccc

SEQ ID NO: 221779 - DNA, 75 bp, Artificial Sequence
  Synthetic
ttcttctttctgctcaacacaacaccattatgtcttgtgcaaagatgtccatacttttcccaaacaatcccttca

SEQ ID NO: 221780 - DNA, 75 bp, Artificial Sequence
  Synthetic
aaaaatctagcctgctcagacgaaaaacttagatcaattgtctcaatatcaggtctgccattcaattggaatagc

SEQ ID NO: 221781 - DNA, 75 bp, Artificial Sequence
  Synthetic
ttcttaatgtcttcagagccctgacaagtgaagaccagtttctgaggaagtctcattataattctactcaggaga

SEQ ID NO: 221782 - DNA, 75 bp, Artificial Sequence
  Synthetic
cctggccttgcattctcaatgtcacgaagcagaattccatgtgaatatttacttccatttttgaagcctttctca

SEQ ID NO: 221783 - DNA, 75 bp, Artificial Sequence
  Synthetic
tcatgaggcactctaaaacagtgtatgtaattcccagtggtgggctgatagatggcaagttcgacagggtcattg

SEQ ID NO: 221784 - DNA, 75 bp, Artificial Sequence
  Synthetic
ggaggtccctctatatcaatccagatggtttcatccatgtccaatttaccaatggcctctttgatgattgcttct

SEQ ID NO: 221785 - DNA, 75 bp, Artificial Sequence
  Synthetic
cgcaccggggatcctaggcttgtggattgcgctttcctttagatcaactgagtgcgagatctcacccagtagaag

SEQ ID NO: 221786 - DNA, 75 bp, Artificial Sequence
  Synthetic
agccgttctccattcagatgcttattgaccaccacactcttattactagcaagatctagtgctgtcgcacatcca

SEQ ID NO: 221787 - DNA, 75 bp, Artificial Sequence
  Synthetic
gatgggtcaaattgtgacaatgtttgaggccttgcctcacatcatcgatgaggttatcaacattgttattattgt

SEQ ID NO: 221788 - DNA, 75 bp, Artificial Sequence
  Synthetic
gagttggtcatagggtctagtttgttaagccttttttccccttttaaaatcaaagtgccattgttgaatgaagaa

SEQ ID NO: 221789 - DNA, 75 bp, Artificial Sequence
  Synthetic
gctcattataatcacgagcatcaaggctgtgtacaactttgccacttgcggggtatttgcactggccagcttcct

SEQ ID NO: 221790 - DNA, 75 bp, Artificial Sequence
  Synthetic
accatcatgctgaaagcttctaaattaacacctggaactgtgctctgacaatcaacctccttgccagtaaacttt

SEQ ID NO: 221791 - DNA, 75 bp, Artificial Sequence
  Synthetic
tctcctggctggcagatcttgtgctttgtatggcctaagtggacctgatatttataaaggggtttatcagttcaa

SEQ ID NO: 221792 - DNA, 75 bp, Artificial Sequence
  Synthetic
ttcatttgctcataaaaaacacactcttcttcaggagtcattgcttcttttgggttgacaaaaaagccaaactcg

SEQ ID NO: 221793 - DNA, 75 bp, Artificial Sequence
  Synthetic
gtcagtggaatttgacatgtctcacttgaacctgacaatgcccaatgcatgttcagtcaataactcccaccatta

SEQ ID NO: 221794 - DNA, 75 bp, Artificial Sequence
  Synthetic
cttttaggctcaaggaacttttcaaagcatttggtctgatctgttaacctatcaggggtctcttttgtgattaaa

SEQ ID NO: 221795 - DNA, 75 bp, Artificial Sequence
  Synthetic
catcagtatggggaattctggattggaactgaccttcaccaatgactccatcatctctcatggtttttgtaattt

SEQ ID NO: 221796 - DNA, 75 bp, Artificial Sequence
  Synthetic
tgacagaagtatgaaacattcaacatgaacttaaactttgcactcaacaacaccttctcaccagcaccaaaaatg

SEQ ID NO: 221797 - DNA, 75 bp, Artificial Sequence
  Synthetic
gacctctgccttcaacaagaaaacttttgatcacacgctcatgagcatagtctcaagtctacacctcagtatcag

SEQ ID NO: 221798 - DNA, 75 bp, Artificial Sequence
  Synthetic
gtttttatcaaaaatctgagtaacctataaaccaccttttcagcagctgtaattaggtcctccctcagtttatcc

SEQ ID NO: 221799 - DNA, 75 bp, Artificial Sequence
  Synthetic
aggtcactccaattataaggcggtgtcctgtgatttcaacaatggcattactattcagtataatttgacgttctc

SEQ ID NO: 221800 - DNA, 75 bp, Artificial Sequence
  Synthetic
atcaaagatgtcgaagaaaagtctgagacaatagccattacaaggtatctgatattctgaacctgcttttgattc

SEQ ID NO: 221801 - DNA, 75 bp, Artificial Sequence
  Synthetic
aaatgcacaagatgctctaaatcagtgcaggacttttagaggcagagttctggatatgttcagaactgcctttgg

SEQ ID NO: 221802 - DNA, 75 bp, Artificial Sequence
  Synthetic
ctctttgttggattggtgagcataagcaacaaaagggttctcagtgcagtctcaatatcaacaagacaatctttt

SEQ ID NO: 221803 - DNA, 75 bp, Artificial Sequence
  Synthetic
agggaaatacatgagaagtggctggggctggactggtgcagatggcaaaactacttggtgcagccagacaagtta

SEQ ID NO: 221804 - DNA, 75 bp, Artificial Sequence
  Synthetic
aagtcaggacatgatctgatccatgaaatcatagtgtcaaccatactgtataacacttcatctgaaaagaatggt

SEQ ID NO: 221805 - DNA, 75 bp, Artificial Sequence
  Synthetic
ccaatacttaatcatacaaaatagaacctgggaaaaccactgtagatatgcaggccctttcggaatatctagggt

SEQ ID NO: 221806 - DNA, 75 bp, Artificial Sequence
  Synthetic
aaaaagaatctctttggatctgcataaaaagaaacaagatgaccgttcgggccttgtatagagtagcatcttgaa

SEQ ID NO: 221807 - DNA, 75 bp, Artificial Sequence
  Synthetic
cctttttgctcaagagaagactaagtttctcaccagaagactcgcaggtacattcacttggacactgtcggattc

SEQ ID NO: 221808 - DNA, 75 bp, Artificial Sequence
  Synthetic
gattctccagttttttggtatagtagatggtactcttcagaatctaattttatcacttgacaaaacacttctttg

SEQ ID NO: 221809 - DNA, 75 bp, Artificial Sequence
  Synthetic
ttcaggagtagagaacccgggtggttactgtttgaccagatggatgattctcgctgcagaactcaagtgttttgg

SEQ ID NO: 221810 - DNA, 75 bp, Artificial Sequence
  Synthetic
cattccacaacttgatacctcacagaccccaactggttttgtcttagtctagcaattgagcttgttttcatacta

SEQ ID NO: 221811 - DNA, 75 bp, Artificial Sequence
  Synthetic
gaacacagctgttgcaaagtgcaatgtcaaccatgatgaggaattctgcgacatgctgcgattaattgactacaa

SEQ ID NO: 221812 - DNA, 75 bp, Artificial Sequence
  Synthetic
tttgttaatgctaaacaaacagatgacaatctttttaaactctgtgcagcccttaattgctctgcattaggctga

SEQ ID NO: 221813 - DNA, 75 bp, Artificial Sequence
  Synthetic
caaagctgccttaagcaagttcaaggaggatgtagagtctgctttacacctatttaaaacaacagtgaattcttt

SEQ ID NO: 221814 - DNA, 75 bp, Artificial Sequence
  Synthetic
aagttataatcctcaaattttgtataatacattaaaggatgagtcccagctctcatgaaactctcaaactcagtg

SEQ ID NO: 221815 - DNA, 75 bp, Artificial Sequence
  Synthetic
gatttcagatcaactactgatgaggaaccacctaagagacttgatgggggtaccatactgtaactattcaaaatt

SEQ ID NO: 221816 - DNA, 75 bp, Artificial Sequence
  Synthetic
aatggcacatggcactcatgctcaaggtgttcagacaatccgtagtgcccgaagcttagtcccaccactgacaaa

SEQ ID NO: 221817 - DNA, 75 bp, Artificial Sequence
  Synthetic
ctggtatctggaacacgccaaaactggtgagactagtgtccccaagtgttggcttgtcactaatggctcttactt

SEQ ID NO: 221818 - DNA, 75 bp, Artificial Sequence
  Synthetic
catttctgaacttttatgataaactcatttatggacactgtaaacaactcttcaagagatactcttctgaaggtt

SEQ ID NO: 221819 - DNA, 75 bp, Artificial Sequence
  Synthetic
aaatgagacccattttagtgatcaaattgaacaagaagcagacaatatgatcacagaaatgttgaggaaggatta

SEQ ID NO: 221820 - DNA, 75 bp, Artificial Sequence
  Synthetic
ttggaccttcttctgttcctcaaaagcttgatgaattcttctttggtactatggaaactcaccaacctgtcattc

SEQ ID NO: 221821 - DNA, 75 bp, Artificial Sequence
  Synthetic
cataaaaaggcagggcagcacccccttagctttaatggacttgttaatgttttctacatcagcatatctaatcag

SEQ ID NO: 221822 - DNA, 75 bp, Artificial Sequence
  Synthetic
acactactgtagcaacaaccaacccaatgcttgtcatcttttttaaactgtgactttgagtgttttatcaatgaa

SEQ ID NO: 221823 - DNA, 75 bp, Artificial Sequence
  Synthetic
catcttcctacaccttatgaaaatcccaacacacagacatattaagggtggctcatgtccaaagccacaccgctt

SEQ ID NO: 221824 - DNA, 75 bp, Artificial Sequence
  Synthetic
gagagacataagacatccaggttcagcaattgcctcctcctggtattcagtaactttaagcttttgactttgttc

SEQ ID NO: 221825 - DNA, 75 bp, Artificial Sequence
  Synthetic
gctcatgtccaaagccacaccgcttaaccagcaaaggaatctgtggttgtggtgcatttaaggtgcccggcgtaa

SEQ ID NO: 221826 - DNA, 75 bp, Artificial Sequence
  Synthetic
agcatggagagaagcctttcatattcagtactagcctcaccccctctcttgtacccataagtctccgctgtaaca

SEQ ID NO: 221827 - DNA, 75 bp, Artificial Sequence
  Synthetic
aaactgtctggaaaagacgctgaacaacagcgcctccctgactctccacctcgaaagaggtggagagtcagggag

SEQ ID NO: 221828 - DNA, 75 bp, Artificial Sequence
  Synthetic
aacctcatcaaaggacaagactctactgcctccttacttaatattgaaatgttatcattatcaggaagggtatcg

SEQ ID NO: 221829 - DNA, 75 bp, Artificial Sequence
  Synthetic
gcccaaagggtcttagagcgtcacaacattgggtcctctgaaaatcaggtcatgtggcaggatgttgtggacagt

SEQ ID NO: 221830 - DNA, 75 bp, Artificial Sequence
  Synthetic
taaagttccgaaaattctttgattaagccttcagggctgattttcttaaagtttcttttgagtttcccactctct

SEQ ID NO: 221831 - DNA, 75 bp, Artificial Sequence
  Synthetic
tttcaaatcagggagtcttgccttagaggcactttcaaaaatgatgcaatccataagtgcacaatgtggagtgat

SEQ ID NO: 221832 - DNA, 75 bp, Artificial Sequence
  Synthetic
aagtctcttctaaacctactaaatagagaatttatgccaaagaccacatcatcacagctcatgctgggatttaca

SEQ ID NO: 221833 - DNA, 75 bp, Artificial Sequence
  Synthetic
ctctttcttcttcttgtccctaactatcccagtgtgcattttgcacagccagccgtatttgtcccacactttgtc

SEQ ID NO: 221834 - DNA, 75 bp, Artificial Sequence
  Synthetic
ccatcatgacacatcctcataatctcatcattgtgatgtgatcttgcatcctttaaaattttcatagagtccata

SEQ ID NO: 221835 - DNA, 75 bp, Artificial Sequence
  Synthetic
ttcatattcccttgaagcctccttggtcatttcaacatcaattaactttatgtccctcctattctgtgagtccaa

SEQ ID NO: 221836 - DNA, 75 bp, Artificial Sequence
  Synthetic
ccagagcgcttatcaacagtggtcttaagagattcacagagtctgaagtactcagactcctcaaagattttctca

SEQ ID NO: 221837 - DNA, 75 bp, Artificial Sequence
  Synthetic
aagttttctgatgtcatcagaaccttgacagctcaggaccatcccttgtggaagagcacctataactgatgaagt

SEQ ID NO: 221838 - DNA, 75 bp, Artificial Sequence
  Synthetic
tcctggctagaaaactccagaagtttgaataggaggtctctaaacttaaagttcacccattctggcatgaagctg

SEQ ID NO: 221839 - DNA, 75 bp, Artificial Sequence
  Synthetic
caacccaggttgcgcattaaagaggtcagcgagatccatgccatgtgaatacttagaatcttgcttaaattgctt

SEQ ID NO: 221840 - DNA, 75 bp, Artificial Sequence
  Synthetic
ttgtcatagtcgcagcgaccatccactattggaaccaatgttatgcctgcgacagcaaggtcttctttaatgcat

SEQ ID NO: 221841 - DNA, 75 bp, Artificial Sequence
  Synthetic
ttgatcagtgggttctctataaaagtgtatgaactgcccattctgtggttgaaatattgcaatttccactgggtc

SEQ ID NO: 221842 - DNA, 75 bp, Artificial Sequence
  Synthetic
gccaatttgttggtatcttctatgaatttcttttcaaagctggccggtgtgctcctaacaaagcattcaagaaga

SEQ ID NO: 221843 - DNA, 75 bp, Artificial Sequence
  Synthetic
attaaacctgccttcgatgtcaatccaggtgggagcattagggtcaatccctcccattaggtctttcaacaacat

SEQ ID NO: 221844 - DNA, 75 bp, Artificial Sequence
  Synthetic
ataagagaactgtcaatcagcttataaccatcaggaatgatgagtggcaaccctgggcatataacccctgattca

SEQ ID NO: 221845 - DNA, 75 bp, Artificial Sequence
  Synthetic
tgtctgactatagctcagacccacttgaggtgggcctgatgcaccaggcactggcttgggcgagtttgccgcaga

SEQ ID NO: 221846 - DNA, 75 bp, Artificial Sequence
  Synthetic
attaggattgcttcaacagacttgtcatcatggttatgtatacagccgctcttgtctgcactgtctatctctatg

SEQ ID NO: 221847 - DNA, 75 bp, Artificial Sequence
  Synthetic
tctttcatttgtgagatcaattgttgtattctcccatgctctcccaacaactgatgttctgcaggctatgtaagg

SEQ ID NO: 221848 - DNA, 75 bp, Artificial Sequence
  Synthetic
caacgtgacagcaacttgagcccctcaatcaacaccattctgggttccctctgccccaaaaagttgagtttttgt

SEQ ID NO: 221849 - DNA, 75 bp, Artificial Sequence
  Synthetic
ccatccttcacctgaaagacagactttgtagagtatgttttcgtagggattcctgtccccaacctgatctgagac

SEQ ID NO: 221850 - DNA, 75 bp, Artificial Sequence
  Synthetic
cttgacaatctctcatcctgttctatgtagtttagacacaactccctcaactctgaaataatctcatccattgcg

SEQ ID NO: 221851 - DNA, 75 bp, Artificial Sequence
  Synthetic
aaacatattgagcttcttcttggccccaaggactgcctttaggaggtcctcactgttgcttggcttgatcaagat

SEQ ID NO: 221852 - DNA, 75 bp, Artificial Sequence
  Synthetic
agtttagacacaactccctcaactctgaaataatctcatccattgcgcatcaaaaagcctaggatcctcggtgcg

SEQ ID NO: 221853 - DNA, 75 bp, Artificial Sequence
  Synthetic
ggatcctaggctttttggattgcgctattcaagaaaccattaaaaggtcgcatgggtcaaatcgtgacactcttt

SEQ ID NO: 221854 - DNA, 75 bp, Artificial Sequence
  Synthetic
ggattccagcatatttccaccgtctagcaatgctgcccctgctttcacagcagcaccgagactgaaattgaagcc

SEQ ID NO: 221855 - DNA, 75 bp, Artificial Sequence
  Synthetic
gaggctttgcctcatgtgattgacgaggccatcaatattgcaattatggtcttgataatcatcacaagtgtcaaa

SEQ ID NO: 221856 - DNA, 75 bp, Artificial Sequence
  Synthetic
agaaatattaatgctggactgttgttctgtgataacacccaaaactgggtgtttgtctttcagtctctcaagatc

SEQ ID NO: 221857 - DNA, 75 bp, Artificial Sequence
  Synthetic
gctgtgtacaattttgccacctgtggcatcattgcgttgattggcttcctcctcttagctggtaggtcttgtggc

SEQ ID NO: 221858 - DNA, 75 bp, Artificial Sequence
  Synthetic
agttagatttgggtatttgaccgtataaagcaggccaaggtctgtgagtgcttgcacaacatcattaagtggggt

SEQ ID NO: 221859 - DNA, 75 bp, Artificial Sequence
  Synthetic
tcgaccaccaatgtcaacacccacctctacaaagggctttatgagttcaaatccttggaattcaatttatctcac

SEQ ID NO: 221860 - DNA, 75 bp, Artificial Sequence
  Synthetic
ctgtgactgttttgccatgcaggccattgtcagacttggcattgtgccaaattgattgttcaggagtgatgagtc

SEQ ID NO: 221861 - DNA, 75 bp, Artificial Sequence
  Synthetic
ttgaatttgacaatgcccaatgcgtgttctttgaacaattctcaccattacattaatatgggcaaatccggtctg

SEQ ID NO: 221862 - DNA, 75 bp, Artificial Sequence
  Synthetic
cttcacatcccaaaccctcaccacaccatttgtaccctgttggggtcttctcattccaaccatttgcaggatctg

SEQ ID NO: 221863 - DNA, 75 bp, Artificial Sequence
  Synthetic
gaacttacattcacaaatgattcgattctctctcataaacattgtaacctcaccgatgccttcaaaaaggacact

SEQ ID NO: 221864 - DNA, 75 bp, Artificial Sequence
  Synthetic
agatctttgatcaagttgctgtgctgttaagttccccatgtaaaccccagaagcttgaggtctttcagatctcat

SEQ ID NO: 221865 - DNA, 75 bp, Artificial Sequence
  Synthetic
tttgaccacaccattatgagcataataagcagtttacatcttagtgttaggggccatactgagtacaaagctgtg

SEQ ID NO: 221866 - DNA, 75 bp, Artificial Sequence
  Synthetic
aattttggcctttagcttctcaagatcagctgcaagagacatcagttcttctgcactgagccttcccaccttcaa

SEQ ID NO: 221867 - DNA, 75 bp, Artificial Sequence
  Synthetic
tcatgcgacttcaacaacgggatcaccatccaatataacttgacattgcgtagttcaggtgaggctgtcaatgag

SEQ ID NO: 221868 - DNA, 75 bp, Artificial Sequence
  Synthetic
aacatttttctttgatgtcgaccgtaattctacaagggagtacacagtttggttaaggctcctgagtctttgtag

SEQ ID NO: 221869 - DNA, 75 bp, Artificial Sequence
  Synthetic
tgtaggaccttcaggggaagagttctagacatgttcagaacagcttttggcgggaagtatatgaggagtcatata

SEQ ID NO: 221870 - DNA, 75 bp, Artificial Sequence
  Synthetic
atctttgtcatccctcctttctttcctcatgatcctctggacattgctgacttcggagaagtccagcccatttaa

SEQ ID NO: 221871 - DNA, 75 bp, Artificial Sequence
  Synthetic
gggtggacagatggccagggaaaaacaacttggtgtagtcaaacggattacaattatctaatcatacagaatcgc

SEQ ID NO: 221872 - DNA, 75 bp, Artificial Sequence
  Synthetic
aaggctagttgcgtccttaatgacagcagctttcacatctgatgtgaagccttgcagctctctcctcaatgcctg

SEQ ID NO: 221873 - DNA, 75 bp, Artificial Sequence
  Synthetic
acatgggaaaatcattgtgaatatgcaagtccatttgggtttaccagagtccttcttgctcaagaaaaaacaaaa

SEQ ID NO: 221874 - DNA, 75 bp, Artificial Sequence
  Synthetic
tgtccactgaaagcttttgacttccttagacaaagacattttgccgctcaatgaatcttcaagacaaatgcgcaa

SEQ ID NO: 221875 - DNA, 75 bp, Artificial Sequence
  Synthetic
ttagacaaagacattttgccgctcaatgaatcttcaagacaaatgcgcaatcaaatgcctaggatccactgtgcg

SEQ ID NO: 221876 - DNA, 75 bp, Artificial Sequence
  Synthetic
gcaccggggatcctaggctttttggattgcgctttccgacagatcaacttggtgttggactctgtcctgttttag

SEQ ID NO: 221877 - DNA, 75 bp, Artificial Sequence
  Synthetic
ttcattacaaggagacttgcagggacattcacctggaccttatcagattcttctggaaatgagaaccctggtggt

SEQ ID NO: 221878 - DNA, 75 bp, Artificial Sequence
  Synthetic
gatgggtcagattgtgacgatgtttgaggctttgcctcacatcattgatgaggttatcaacattgtcatcatagt

SEQ ID NO: 221879 - DNA, 75 bp, Artificial Sequence
  Synthetic
tattgcctcacaagatggatgctgattgctgcagatctcaagtgctttgacaatacagcaattgctaaatgcaac

SEQ ID NO: 221880 - DNA, 75 bp, Artificial Sequence
  Synthetic
gctcatcataatcacgagcatcaaggctgtgtacaactttgccacctgcgggatattagcattgatcagttttct

SEQ ID NO: 221881 - DNA, 75 bp, Artificial Sequence
  Synthetic
cttaaccacaatgaggaattctgtgacatgcttagactaatagactataataaagcagctctgcataaattcaaa

SEQ ID NO: 221882 - DNA, 75 bp, Artificial Sequence
  Synthetic
tcttttggctggtaggtcctgcggcctgtatggtcttgatgggcctgatatttacaaagggatttatcaattcaa

SEQ ID NO: 221883 - DNA, 75 bp, Artificial Sequence
  Synthetic
gaagatgttgagtctgctttgcatctttttaagatgacaatcaattcattgatttcagatcagctgttaatgagg

SEQ ID NO: 221884 - DNA, 75 bp, Artificial Sequence
  Synthetic
gtcggtggaatttgacatgtctcacctaaacttgacgatgcctaatgcgtgctcagccaacaactcccatcatta

SEQ ID NO: 221885 - DNA, 75 bp, Artificial Sequence
  Synthetic
aaccatctgagggacttgatgggagtgccttattgcaattactcaaagttttggtacctccagcatagtaaatca

SEQ ID NO: 221886 - DNA, 75 bp, Artificial Sequence
  Synthetic
cattagcatgggaaattctgggttggaattaaccttcacaaatgactccatcattagccacaacttctgcaattt

SEQ ID NO: 221887 - DNA, 75 bp, Artificial Sequence
  Synthetic
aatgagacaagcacgcctaagtgctggcttgtaagtaatggaacttatctgaatgagactcatttcagtgatcaa

SEQ ID NO: 221888 - DNA, 75 bp, Artificial Sequence
  Synthetic
gacctccgctttcaacaagaaaacatttgaccacacactcatgagcatagtctcaagtttgcatcttagtattag

SEQ ID NO: 221889 - DNA, 75 bp, Artificial Sequence
  Synthetic
attgagcaagaagcagacaacatgatcacagagatgctcagaaaggactacttcagaagacaaggggctactcct

SEQ ID NO: 221890 - DNA, 75 bp, Artificial Sequence
  Synthetic
aggaaactctaactacaaggcagtgtcctgtgactttaactctggcatcacaatccagtacaatttgtcattctc

SEQ ID NO: 221891 - DNA, 75 bp, Artificial Sequence
  Synthetic
ttagcattagtggacattttgatgttcacaacatcagcctacctaatgactgtttttttgcatctaatgaggata

SEQ ID NO: 221892 - DNA, 75 bp, Artificial Sequence
  Synthetic
agatgcacaaagtgctctaagccaatgcaaaaccttcagaggcagagtcttggatatgttcagaactgcttttgg

SEQ ID NO: 221893 - DNA, 75 bp, Artificial Sequence
  Synthetic
ccaacacacagacatataaaagggggctcttgcccaaaaccacatcgattaactagtatgggcatttgctcctgt

SEQ ID NO: 221894 - DNA, 75 bp, Artificial Sequence
  Synthetic
agggaagtacatgagaagtggttggggttggacaggctcagatggcaaaaccacttggtgcagccaaacaagcta

SEQ ID NO: 221895 - DNA, 75 bp, Artificial Sequence
  Synthetic
ggtgcattcaagacaccaggagtgaaaacagtatggaagagacggtgagctgcaccgcctccctgactctccacc

SEQ ID NO: 221896 - DNA, 75 bp, Artificial Sequence
  Synthetic
tcaatacctaatcatacaaaacagaacctgggaaaaccactgcagatatgcagggccctttgggatggccagaat

SEQ ID NO: 221897 - DNA, 75 bp, Artificial Sequence
  Synthetic
tcaaagaggtggagagtcagggaggctccctggggagacttagagcaccactgtgttcgggcctctaaagatcag

SEQ ID NO: 221898 - DNA, 75 bp, Artificial Sequence
  Synthetic
cctctttgctcaggaaaagacaaagtttctcactagaagacttgcaggcacattcacttggactctgtcagactc

SEQ ID NO: 221899 - DNA, 75 bp, Artificial Sequence
  Synthetic
gtcatgtggcaggatgttatgaattgacttcaaatctggcagcctagcctttgaggcactctcaaagatgatgca

SEQ ID NO: 221900 - DNA, 75 bp, Artificial Sequence
  Synthetic
ttcaggggtagataatccaggcggttactgcttaaccagatggatgattcttgctgcagatcttaagtgttttgg

SEQ ID NO: 221901 - DNA, 75 bp, Artificial Sequence
  Synthetic
gtccataagagcacagtggagggtgatttctttcttctttttgtccctcactatccctgtgtgcattttacacaa

SEQ ID NO: 221902 - DNA, 75 bp, Artificial Sequence
  Synthetic
gaacacagctgttgcaaaatgcaatatgaatcatgatgaagagttctgtgatatgctgcgactaattgactacaa

SEQ ID NO: 221903 - DNA, 75 bp, Artificial Sequence
  Synthetic
ccagccatatttgtcccatactttgtcttcatattcccttgatgcctctttgctcatctctatatcaatcaactt

SEQ ID NO: 221904 - DNA, 75 bp, Artificial Sequence
  Synthetic
caaggctgccttgagtaagttcaaggaagatgtggaatctgccctacacctatttaaggtgacagtgaattcttt

SEQ ID NO: 221905 - DNA, 75 bp, Artificial Sequence
  Synthetic
aatgtcccttctattttgagactcaagaagcatttttatgtcttctgagccttggcagctgaggaccattccttg

SEQ ID NO: 221906 - DNA, 75 bp, Artificial Sequence
  Synthetic
ggtatccgatcagctcctaatgaggaaccacttgagggatttgatgggggtgccatattgcaactattcaaggtt

SEQ ID NO: 221907 - DNA, 75 bp, Artificial Sequence
  Synthetic
tggaagagcaccaattactgacgatgtcaggcctggctgaacgttgaaaaggtctgcaaggtccatgccatgtga

SEQ ID NO: 221908 - DNA, 75 bp, Artificial Sequence
  Synthetic
ttggtacctggagcatacaaagactggtgaaaccagtgtacctaaatgctggcttgttaccaatggctcctatct

SEQ ID NO: 221909 - DNA, 75 bp, Artificial Sequence
  Synthetic
gaattttgagtcctgtttaaattgtttttgatcaactggttctcgataaaagtggatatattgcccagtctctgg

SEQ ID NO: 221910 - DNA, 75 bp, Artificial Sequence
  Synthetic
aaatgaaacccacttcagtgatcaaattgagcaagaggcagacaatatgatcacagacatgttgaggaaggatta

SEQ ID NO: 221911 - DNA, 75 bp, Artificial Sequence
  Synthetic
ttgaaatatagcaatttctacagggtcattgaacctaccttcaatgtcaatccaagtgggtgcattgggatcaat

SEQ ID NO: 221912 - DNA, 75 bp, Artificial Sequence
  Synthetic
cataaaaagacaaggaagcacccctctggccctgatggatctcttaatgttttccacatcagcatatttagttag

SEQ ID NO: 221913 - DNA, 75 bp, Artificial Sequence
  Synthetic
accattcatcaagtccttcagcagcattgtttgactgtaactcaatcctacctgaggtggccctgctgcccctgg

SEQ ID NO: 221914 - DNA, 75 bp, Artificial Sequence
  Synthetic
tgtttttctacatcttgtgaagataccaacacatagacacataaagggtggttcatgcccaaagccacaccgatt

SEQ ID NO: 221915 - DNA, 75 bp, Artificial Sequence
  Synthetic
cactggtctagatgaatgaattaccggtttgttgtcagacaggtcaatgatggtgttctcccatgctctccccac

SEQ ID NO: 221916 - DNA, 75 bp, Artificial Sequence
  Synthetic
gaccaacaaaggaatctgtagttgtggtgcattcaaagtgccgggtgttaaaactgtgtggaaaagacgctgaac

SEQ ID NO: 221917 - DNA, 75 bp, Artificial Sequence
  Synthetic
tatagatgatgtgcaggctatgtatggccatccttcacctgataaacagactttgtacaggatattttcataagg

SEQ ID NO: 221918 - DNA, 75 bp, Artificial Sequence
  Synthetic
agcagcgcctccctgactctccacctcgaaagaggtggagagtcagggaggcccagagggtcttagagtgtcaca

SEQ ID NO: 221919 - DNA, 75 bp, Artificial Sequence
  Synthetic
gttcctgtcccccacttgatcagacacaaacatgttcaacttcttttttgcaccaagaacagctttcaaaagatc

SEQ ID NO: 221920 - DNA, 75 bp, Artificial Sequence
  Synthetic
acatttggacctctgaaaatcaaatcatgtggcaggatgttgtgaatggttttcaaatcaggaagtcttgccttg

SEQ ID NO: 221921 - DNA, 75 bp, Artificial Sequence
  Synthetic
ctcagtgttgctgggtttgatgtaaattgactccaacatgttgcctccgtccagcagcgcagcacctgccttcac

SEQ ID NO: 221922 - DNA, 75 bp, Artificial Sequence
  Synthetic
gaggcactctcaaagatgatgcagtccatgagtgcacaatgtggagtaacctccttctttttcttgtccctcact

SEQ ID NO: 221923 - DNA, 75 bp, Artificial Sequence
  Synthetic
cgcagcacttaaactgagattgtaaccagaaatattgatgctggactgctgttctgttataacacccaacactgg

SEQ ID NO: 221924 - DNA, 75 bp, Artificial Sequence
  Synthetic
ataccagtgtgcattttgcacagccacccatacttgtcccacactttgtcttcatattctcttgaagcttctttg

SEQ ID NO: 221925 - DNA, 75 bp, Artificial Sequence
  Synthetic
atgcttgtctttaaggttctcaagatcagatagatttgggtattttactgtgtagagtaagcctaaatctgtgag

SEQ ID NO: 221926 - DNA, 75 bp, Artificial Sequence
  Synthetic
gtcatctcaacatcaataagcttaatgtccctcctattctgtgagtctagaagttttctgatgtcatcggaacct

SEQ ID NO: 221927 - DNA, 75 bp, Artificial Sequence
  Synthetic
cgcttgcacaacatcattgagtggtgtttgtgactgcttagtcatgcaggccatggtaaggctgggcattgttcc

SEQ ID NO: 221928 - DNA, 75 bp, Artificial Sequence
  Synthetic
tgacagctcaagaccattccttgtggaagagctcctatgactgacgacgtcagcccaggttgtgcattgaagagg

SEQ ID NO: 221929 - DNA, 75 bp, Artificial Sequence
  Synthetic
aaagtgattgttaaggagtgatgagtctttcacatcccacaccctcacaacaccgttattgccttgttgagggcg

SEQ ID NO: 221930 - DNA, 75 bp, Artificial Sequence
  Synthetic
tcggcaaggtccatgccatgtgagtatttagagtcctgtttgaattgtttttgatctgtaggttctctgtagaag

SEQ ID NO: 221931 - DNA, 75 bp, Artificial Sequence
  Synthetic
tctcatccctaccatctgcagaatctgggatctttgatcaagttgctgagctgttaggttgcccatgtagacacc

SEQ ID NO: 221932 - DNA, 75 bp, Artificial Sequence
  Synthetic
tgtatccaatgtccattttgtggttggaacattgcgatttccaccgggtcattgaatctaccctcaatgtcaatc

SEQ ID NO: 221933 - DNA, 75 bp, Artificial Sequence
  Synthetic
agatgctcggggcccttcagacctcattatcttggcttttagtttttctaaatcagccgcaagagacatcagctc

SEQ ID NO: 221934 - DNA, 75 bp, Artificial Sequence
  Synthetic
catgtaggggcattggggtcaatccctcccatcaagtctttcagcagcattgtttgactgtaacttagacccacc

SEQ ID NO: 221935 - DNA, 75 bp, Artificial Sequence
  Synthetic
gtcagcactcaacctacccacctttagaacattcttctttggagttgatttcagttccacaagggagtgaacggt

SEQ ID NO: 221936 - DNA, 75 bp, Artificial Sequence
  Synthetic
tgaggtgggcctgctgccccaggaactggcttgggtgaattgatcagaggcttatcgcttgtaagatcaattgtg

SEQ ID NO: 221937 - DNA, 75 bp, Artificial Sequence
  Synthetic
ttggttgaggcttcgaagcctttgcaagtctttatcatccctcttatctttcctcataattctctgaacattgct

SEQ ID NO: 221938 - DNA, 75 bp, Artificial Sequence
  Synthetic
gtgttctcccatgctctcccaacaactgaagttctacaagctatgtatggccacccttcacctgaaagacagact

SEQ ID NO: 221939 - DNA, 75 bp, Artificial Sequence
  Synthetic
aacttcagagaagtctaatccatttaaaaggctcgttgcgtctttaatgacagcagcctttgtgttggaggtgaa

SEQ ID NO: 221940 - DNA, 75 bp, Artificial Sequence
  Synthetic
ttgtaaaggatgttttcataaggattcctatcaccaacttggtctgatacaaacatattaagtttcctttttgcc

SEQ ID NO: 221941 - DNA, 75 bp, Artificial Sequence
  Synthetic
gctttgcagctctcttcttagtgcctgcgtccattggaagcttttgacctccttggaaagagacatcttgttgta

SEQ ID NO: 221942 - DNA, 75 bp, Artificial Sequence
  Synthetic
ccaagaactgctttcaggaggtcctcactgttgctaggttttatcaagatggattcaagcatgttgcccccgtct

SEQ ID NO: 221943 - DNA, 75 bp, Artificial Sequence
  Synthetic
cttgttgtagagcactgagacctaaaacaaattgacacacaaaagcgcaatcaaatgcctaggatccactgtgcg

SEQ ID NO: 221944 - DNA, 75 bp, Artificial Sequence
  Synthetic
agcagagctgcccctgctttcacagcagcaccaagactaaagttatagccagaaatgttgatactggactgctgt

SEQ ID NO: 221945 - DNA, 75 bp, Artificial Sequence
  Synthetic
tctgtgatgactcccaagactgggtgtttgtctttcagcctctcaagatcattgagatttgggtacttgactgtg

SEQ ID NO: 221946 - DNA, 75 bp, Artificial Sequence
  Synthetic
actgccaaccaaactgaaagtgtcaacagtcccaagctccccacctccctatgaggagtgacgccccagacctcg

SEQ ID NO: 221947 - DNA, 75 bp, Artificial Sequence
  Synthetic
taaagcaggccaaggtctgtgagtgcctgcacaacatcgttgagtggggtttgtgactgcttagccatacaagcc

SEQ ID NO: 221948 - DNA, 75 bp, Artificial Sequence
  Synthetic
acacaacaggccacccaacgcagaaaaaccacacacaagccggcacacacagacacagcaaccagcacaaagcgc

SEQ ID NO: 221949 - DNA, 75 bp, Artificial Sequence
  Synthetic
attgtcagacttggcatcgtgccaaactgattattgagaagtgatgaatccttcacatcccaaaccctcactacg

SEQ ID NO: 221950 - DNA, 75 bp, Artificial Sequence
  Synthetic
acgaacacacacacacacacacacacaccctcacccacgcgcccccccgcaccgccgggggggcgcccccccggg

SEQ ID NO: 221951 - DNA, 75 bp, Artificial Sequence
  Synthetic
ccatttgcaccttgttgaggtcttctcatcccaaccatctgcaaaatttgagacctctgatcaagttgttgtgtt

SEQ ID NO: 221952 - DNA, 75 bp, Artificial Sequence
  Synthetic
gggcggccccccgggagcccgggcagggccccgcggagatgccggctagtcgatctcctcgaccacctgctccgc

SEQ ID NO: 221953 - DNA, 75 bp, Artificial Sequence
  Synthetic
gttagatttcccatatagactccagaagcctgaggtctttcagatctcataattttggccttcaacttctcaagg

SEQ ID NO: 221954 - DNA, 75 bp, Artificial Sequence
  Synthetic
cgatctcctcgaccacctgctccgccagccaatcgtcacaggatttccccttgagtctgaacctgcccccagttg

SEQ ID NO: 221955 - DNA, 75 bp, Artificial Sequence
  Synthetic
tcagctgcgagagacatcagttcctctgcactgagtctgcccacttttaagacattcttctttgatgctgacctc

SEQ ID NO: 221956 - DNA, 75 bp, Artificial Sequence
  Synthetic
agatccacaagggaatacacagtttgattgagactcctgagcctttgcaagtctttgtcatctcttttctctttc

SEQ ID NO: 221957 - DNA, 75 bp, Artificial Sequence
  Synthetic
ctgaaggtgaaccaatctggcacaaaagataatggtgtcagcatgacggatctgtccatgcagagctcctgaaga

SEQ ID NO: 221958 - DNA, 75 bp, Artificial Sequence
  Synthetic
ctcatgatcctctgaacattgctgacttcagagaagtctagcccattcagaaggctggttgcatccttgatcaca

SEQ ID NO: 221959 - DNA, 75 bp, Artificial Sequence
  Synthetic
actgtacttatttctgactccatcaagtgctcaccagttctgaatcggtgcaggaggaggctgccgaggacatca

SEQ ID NO: 221960 - DNA, 75 bp, Artificial Sequence
  Synthetic
gcagccttcacatctgatgtgaaattctgcaactctcttcttaaagcctgtgtccattgaaagctcttgacttct

SEQ ID NO: 221961 - DNA, 75 bp, Artificial Sequence
  Synthetic
ccaatttttccatagccctcgagctctgccagaaagaccctcatgtcctttgtctccaatttcacagagatattc

SEQ ID NO: 221962 - DNA, 75 bp, Artificial Sequence
  Synthetic
tttggacatagacattttgtcgctcaatgatattccaagacaaatgcgcaatcaaatgcctaggatccactgtgc

SEQ ID NO: 221963 - DNA, 75 bp, Artificial Sequence
  Synthetic
cgcaccggggatcctaggctttttggattgcgctttcctctagatcaactgggtgtcaggccctatcctacagaa

SEQ ID NO: 221964 - DNA, 75 bp, Artificial Sequence
  Synthetic
tgaacaaagttcctcccctcaaagagggcacccttccttatggtcagaggcacaggttcccattcaggccctatc

SEQ ID NO: 221965 - DNA, 75 bp, Artificial Sequence
  Synthetic
ggatgggtcagattgtgacaatgtttgaggctctgcctcacatcatcgatgaggtgatcaacattgtcattattg

SEQ ID NO: 221966 - DNA, 75 bp, Artificial Sequence
  Synthetic
tgcttatcgtgatcacgggtatcaaggctgtctacaattttgccacctgtgggatattcgcattgatcagtttcc

SEQ ID NO: 221967 - DNA, 75 bp, Artificial Sequence
  Synthetic
tacttctggctggcaggtcctgtggcatgtacggtcttaagggacccgacatttacaaaggagtttaccaattta

SEQ ID NO: 221968 - DNA, 75 bp, Artificial Sequence
  Synthetic
agtcagtggagtttgatatgtcacatctgaacctgaccatgcccaacgcatgttcagccaacaactcccaccatt

SEQ ID NO: 221969 - DNA, 75 bp, Artificial Sequence
  Synthetic
aaagatcaatgaaaatttcttcaagcagtcagtgttgttctggttgtgtgtgaaatccactgtgattgagaactc

SEQ ID NO: 221970 - DNA, 75 bp, Artificial Sequence
  Synthetic
cagtcagtgttgttctggttgtgtgtgaaatccactgtgattgagaactccaatatcccctctgtgctgctgagc

SEQ ID NO: 221971 - DNA, 75 bp, Artificial Sequence
  Synthetic
acatcagtatggggacttctggactagaattgaccttcaccaatgattccatcatcagtcacaacttttgcaatc

SEQ ID NO: 221972 - DNA, 75 bp, Artificial Sequence
  Synthetic
tgacctctgccttcaacaaaaagacctttgaccacacactcatgagtatagtttcgagcctacacctcagtatca

SEQ ID NO: 221973 - DNA, 75 bp, Artificial Sequence
  Synthetic
gagggaactccaactataaggcagtatcctgcgacttcaacaatggcataaccatccaatacaacttgacattct

SEQ ID NO: 221974 - DNA, 75 bp, Artificial Sequence
  Synthetic
caagtcattcctaaacatgggcctctctatatttttgttcaccactttcaaaatgaatgattggaagggtcccag

SEQ ID NO: 221975 - DNA, 75 bp, Artificial Sequence
  Synthetic
atcctgcgacttcaacaatggcataaccatccaatacaacttgacattctcagatgcacaaagtgctcagagcca

SEQ ID NO: 221976 - DNA, 75 bp, Artificial Sequence
  Synthetic
tctatatttttgttcaccactttcaaaatgaatgattggaagggtcccagtgcttcagcgccatcttcagatggc

SEQ ID NO: 221977 - DNA, 75 bp, Artificial Sequence
  Synthetic
gtgtagaaccttcagaggtagagtcctagatatgtttagaactgccttcggggggaaatacatgaggagtggctg

SEQ ID NO: 221978 - DNA, 75 bp, Artificial Sequence
  Synthetic
gggctggacaggctcagatggcaagaccacctggtgtagccagacgagttaccaatacctgattatacaaaatag

SEQ ID NO: 221979 - DNA, 75 bp, Artificial Sequence
  Synthetic
aacctgggaaaaccactgcacatatgcaggtccttttgggatgtccaggattctcctttcccaagagaagactaa

SEQ ID NO: 221980 - DNA, 75 bp, Artificial Sequence
  Synthetic
aacaaattcatcaactaaacttgagtctgaccgttggtgagagttgacgagatcagaaaacagcacagtgtaatg

SEQ ID NO: 221981 - DNA, 75 bp, Artificial Sequence
  Synthetic
gatcagaaaacagcacagtgtaatgttcgtccctcttccatttgacaacatgagaaatgagtgacaaagactctg

SEQ ID NO: 221982 - DNA, 75 bp, Artificial Sequence
  Synthetic
gttcttcactaggagactagcgggcacattcacctggactttgtcagactcttcaggggtggagaatccaggtgg

SEQ ID NO: 221983 - DNA, 75 bp, Artificial Sequence
  Synthetic
agttgatgtcaatcagcacacagaggtcaaggaatttaatcctgggactccatctcatattttttgagctcacat

SEQ ID NO: 221984 - DNA, 75 bp, Artificial Sequence
  Synthetic
ttattgcctgaccaaatggatgattcttgctgcagagcttaagtgtttcgggaacacagcagttgcgaaatgcaa

SEQ ID NO: 221985 - DNA, 75 bp, Artificial Sequence
  Synthetic
cttgctgcagagcttaagtgtttcgggaacacagcagttgcgaaatgcaatgtaaatcatgatgaagaattctgt

SEQ ID NO: 221986 - DNA, 75 bp, Artificial Sequence
  Synthetic
gtcaaggaatttaatcctgggactccatctcatattttttgagctcacatcagacataaatgggagcaactgatc

SEQ ID NO: 221987 - DNA, 75 bp, Artificial Sequence
  Synthetic
ctcaaagattttggggtacagtcgcctcacagattgaattacatgattcaaacttactttatcctctagtagtct

SEQ ID NO: 221988 - DNA, 75 bp, Artificial Sequence
  Synthetic
gacatgctgcgactaattgactacaacaaggctgctttgagtaagttcaaagaggacgtagaatctgccttgcac

SEQ ID NO: 221989 - DNA, 75 bp, Artificial Sequence
  Synthetic
ctcacagattgaattacatgattcaaacttactttatcctctagtagtctcgaactctcaggttttcttgctaca

SEQ ID NO: 221990 - DNA, 75 bp, Artificial Sequence
  Synthetic
ttattcaaaacaacagtgaattctttgatttcagatcaactactgatgaggaaccacttgagagatctgatgggg

SEQ ID NO: 221991 - DNA, 75 bp, Artificial Sequence
  Synthetic
gtgccatattgcaattactcaaagttttggtacctagaacatgcaaagaccggcgaaactagtgtccccaagtgc

SEQ ID NO: 221992 - DNA, 75 bp, Artificial Sequence
  Synthetic
tggcttgtcaccaatggttcttacttaaatgagacccacttcagtgatcaaatcgaacaggaagccgataacatg

SEQ ID NO: 221993 - DNA, 75 bp, Artificial Sequence
  Synthetic
attacagagatgttgaggaaggattacataaagaggcaggggagtacccccctagcattgatggaccttctgatg

SEQ ID NO: 221994 - DNA, 75 bp, Artificial Sequence
  Synthetic
ttttccacatctgcatatctagtcagcatcttcctgcaccttgtcaaaataccaacacacaggcacataaaaggt

SEQ ID NO: 221995 - DNA, 75 bp, Artificial Sequence
  Synthetic
ggctcatgtccaaagccacaccgattaaccaacaaaggaatttgtagttgtggtgcatttaaggtgcctggtgta

SEQ ID NO: 221996 - DNA, 75 bp, Artificial Sequence
  Synthetic
tggtgcatttaaggtgcctggtgtaaaaaccgtctggaaaagacgctgaagaacagcgcctccctgactctccac

SEQ ID NO: 221997 - DNA, 75 bp, Artificial Sequence
  Synthetic
ctcgaaagaggtggagagtcagggaggcccagagggtcttagagtgtcacaacatttgggcctctaaaaattagg

SEQ ID NO: 221998 - DNA, 75 bp, Artificial Sequence
  Synthetic
tcatgtggcagaatgttgtgaacagttttcagatctgggagccttgctttggaggcgctttcaaaaatgatgcag

SEQ ID NO: 221999 - DNA, 75 bp, Artificial Sequence
  Synthetic
aagaccaagaatctctcccaattgaaggatggcctctttcttttccctgttgaaaaggtctagaaaaaattcctc

SEQ ID NO: 222000 - DNA, 75 bp, Artificial Sequence
  Synthetic
aggatggcctctttcttttccctgttgaaaaggtctagaaaaaattcctcgttacattcaccgttcttgagtttg

SEQ ID NO: 222001 - DNA, 75 bp, Artificial Sequence
  Synthetic
tccatgagtgcacagtgcggggtgatctctttcttctttttgtcccttactattccagtatgcatcttacacaac

SEQ ID NO: 222002 - DNA, 75 bp, Artificial Sequence
  Synthetic
cagccatatttgtcccacactttgtcttcatactccctcgaagcttccctggtcatttcaacatcgataagctta

SEQ ID NO: 222003 - DNA, 75 bp, Artificial Sequence
  Synthetic
atgtccttcctattctgtgagtccagaagctttctgatgtcatcggagccttgacagcttagaaccatcccctgc

SEQ ID NO: 222004 - DNA, 75 bp, Artificial Sequence
  Synthetic
taacaagaatggatctaaagggaaattagcatatttcaagagatccagtgtcctcctctggatacagtttactaa

SEQ ID NO: 222005 - DNA, 75 bp, Artificial Sequence
  Synthetic
ggaagagcacctataactgacgaggtcaacccgggttgcgcattgaagaggtcggcaagatccatgccgtgtgag

SEQ ID NO: 222006 - DNA, 75 bp, Artificial Sequence
  Synthetic
aaaaactgggactccatttgctatagcttgatcagcaatcgtatctattgtctcacaaagttgatgcggttcttt

SEQ ID NO: 222007 - DNA, 75 bp, Artificial Sequence
  Synthetic
gcttgatcagcaatcgtatctattgtctcacaaagttgatgcggttctttacatttaacattgtgtagtgccgca

SEQ ID NO: 222008 - DNA, 75 bp, Artificial Sequence
  Synthetic
tacttggaatcttgcttgaattgtttttgatcaacgggttccctgtaaaagtgtatgaactgcccgttctgtggt

SEQ ID NO: 222009 - DNA, 75 bp, Artificial Sequence
  Synthetic
tggaaaattgctatttccactggatcattaaatctaccctcaatgtcaatccatgtaggagcgttggggtcaatt

SEQ ID NO: 222010 - DNA, 75 bp, Artificial Sequence
  Synthetic
cctcccatgaggtcttttaaaagcattgtctggctgtagcttaagcccacctgaggtggacctgctgctccaggc

SEQ ID NO: 222011 - DNA, 75 bp, Artificial Sequence
  Synthetic
agtcactcaatctcttgtcaaataaggtgatctgatcatcacttgatgtataggcttctggcctctctccaaaaa

SEQ ID NO: 222012 - DNA, 75 bp, Artificial Sequence
  Synthetic
gctggcctgggtgagttgactgcaggtttctcgcttgtgagatcaattgttgtgttttcccatgctctccccaca

SEQ ID NO: 222013 - DNA, 75 bp, Artificial Sequence
  Synthetic
atcgatgttctacaagctatgtatggccatccttcacctgaaaggcaaactttatagaggatgttttcataaggg

SEQ ID NO: 222014 - DNA, 75 bp, Artificial Sequence
  Synthetic
ttcctgtccccaacttggtctgaaacaaacatgttgagttttctcttggccccgagaactgccttcaagaggtcc

SEQ ID NO: 222015 - DNA, 75 bp, Artificial Sequence
  Synthetic
tcgctgttgcttggcttgatcaaaattgactctaacatgttacccccatccaacagggctgcccctgccttcacg

SEQ ID NO: 222016 - DNA, 75 bp, Artificial Sequence
  Synthetic
gcagcaccaagactaaagttatagccagaaatgttgatgctggactgctgttcagtgatgacccccagaactggg

SEQ ID NO: 222017 - DNA, 75 bp, Artificial Sequence
  Synthetic
tgcttgtctttcagcctttcaagatcattaagatttggatacttgactgtgtaaagcaagccaaggtctgtgagc

SEQ ID NO: 222018 - DNA, 75 bp, Artificial Sequence
  Synthetic
gcttgtacaacgtcattgagcggagtctgtgactgtttggccatacaagccatagttagacttggcattgtgcca

SEQ ID NO: 222019 - DNA, 75 bp, Artificial Sequence
  Synthetic
aattgattgttcaaaagtgatgagtctttcacatcccaaactcttaccacaccacttgcaccctgctgaggcttt

SEQ ID NO: 222020 - DNA, 75 bp, Artificial Sequence
  Synthetic
ctcatcccaactatctgtaggatctgagatctttggtctagttgctgtgttgttaagttccccatatatacccct

SEQ ID NO: 222021 - DNA, 75 bp, Artificial Sequence
  Synthetic
gaagcctggggcctttcagacctcatgatcttggccttcagcttctcaaggtcagccgcaagagacatcagttct

SEQ ID NO: 222022 - DNA, 75 bp, Artificial Sequence
  Synthetic
tctgcactgagcctccccactttcaaaacattcttctttgatgttgactttaaatccacaagagaatgtacagtc

SEQ ID NO: 222023 - DNA, 75 bp, Artificial Sequence
  Synthetic
tggttgagacttctgagtctctgtaggtctttgtcatctctcttttccttcctcatgatcctctgaacattgctg

SEQ ID NO: 222024 - DNA, 75 bp, Artificial Sequence
  Synthetic
acctcagagaagtccaacccattcagaaggttggttgcatccttaatgacagcagccttcacatctgatgtgaag

SEQ ID NO: 222025 - DNA, 75 bp, Artificial Sequence
  Synthetic
ctctgcaattctcttctcaatgcttgcgtccattggaagctcttaacttccttagacaaggacatcttgttgctc

SEQ ID NO: 222026 - DNA, 75 bp, Artificial Sequence
  Synthetic
ccttagacaaggacatcttgttgctcaatggtttctcaagacaaatgcgcaatcaaatgcctaggatccactgtg

SEQ ID NO: 222027 - DNA, 75 bp, Artificial Sequence
  Synthetic
accgtggatcctaggctttttgatgcgcaatggatgaaatcatctcagaattgagagagttatgtttaaactata

SEQ ID NO: 222028 - DNA, 75 bp, Artificial Sequence
  Synthetic
caggatggatcaaagtcctctactagatgaaatgaaatttctgataaaatgaccttcctcagataagctctttta

SEQ ID NO: 222029 - DNA, 75 bp, Artificial Sequence
  Synthetic
tagaacaggatgagaggttgtcaaggcagaaactcaactttctgggacaaagggaacccagaatggttctgattg

SEQ ID NO: 222030 - DNA, 75 bp, Artificial Sequence
  Synthetic
cctgataaaataatctgaaggtggtgtagtccttttgtgttcttgaattctccctccccttgcccttcattaagc

SEQ ID NO: 222031 - DNA, 75 bp, Artificial Sequence
  Synthetic
agggactcaagttgctgtcacgctgcattgaaatagacagtgcagacaagagtggctgcacacacaaccacgacg

SEQ ID NO: 222032 - DNA, 75 bp, Artificial Sequence
  Synthetic
ctagtgcctctattataccgtgttattgtggagttgaccttatcttctaaactcctaaaaaaacttgtctcctcc

SEQ ID NO: 222033 - DNA, 75 bp, Artificial Sequence
  Synthetic
ataagtctgtggaaacaattttggtggagtctggaattgtatgcccaggactaccacttatcattcctgatggtt

SEQ ID NO: 222034 - DNA, 75 bp, Artificial Sequence
  Synthetic
tccccctcgaaacacacatccaccggatcatcttccaatttgtctacttctgttttcctggaaccgatgactaat

SEQ ID NO: 222035 - DNA, 75 bp, Artificial Sequence
  Synthetic
ctaccacttatcattcctgatggttacaagctgatagacaattctctcattcttcttgagtgttttgttaggagc

SEQ ID NO: 222036 - DNA, 75 bp, Artificial Sequence
  Synthetic
acaagctgatagacaattctctcattcttcttgagtgttttgttaggagcactccagccagttttgagaagaaat

SEQ ID NO: 222037 - DNA, 75 bp, Artificial Sequence
  Synthetic
ttatagaggacactaacaaattggcatgcatcagggaagaccttgctgttgcgggtgtcacattagttccaatag

SEQ ID NO: 222038 - DNA, 75 bp, Artificial Sequence
  Synthetic
tagatggtcgttgtgattatgataatagttttatgccagagtgggcaaacttcaaatttagagaccttttattca

SEQ ID NO: 222039 - DNA, 75 bp, Artificial Sequence
  Synthetic
aacttttggagtattctaaccaaaatgagaaagtctttgaagagtctgaatattttagactctgtgagtccctga

SEQ ID NO: 222040 - DNA, 75 bp, Artificial Sequence
  Synthetic
agactactatcgacaagcgctccggtatggactctatgaaaattctgaaagatgcgaggtcaactcacaatgatg

SEQ ID NO: 222041 - DNA, 75 bp, Artificial Sequence
  Synthetic
aaattatgaggatgtgccacgaaggcatcaaccccaacatgagctgtgatgatgtggtttttggaataaactctc

SEQ ID NO: 222042 - DNA, 75 bp, Artificial Sequence
  Synthetic
cattcctcttcgggtgtgattgtttccttagggttgacaaagaaaccaaactcacttttgggctcaaagaacttt

SEQ ID NO: 222043 - DNA, 75 bp, Artificial Sequence
  Synthetic
ttttcagcaggtttagaagagatttagaaagtgggaaattaaagagaaactttcagaaagtaaaccctgaaggct

SEQ ID NO: 222044 - DNA, 75 bp, Artificial Sequence
  Synthetic
tgatcaaggaattctctgagctctatgaaaaccttgctgatagtgatgatatcttaacattaagcagggaggcag

SEQ ID NO: 222045 - DNA, 75 bp, Artificial Sequence
  Synthetic
tcgaatcctgtcctttgatgagattcataactgcagagacccatgggcacgaaaggggaagtgagactagcactg

SEQ ID NO: 222046 - DNA, 75 bp, Artificial Sequence
  Synthetic
aatatgagaggctcctctctatgttaaacaaagtcaagagtttgaaactgttgaatactagaaggagacagttgt

SEQ ID NO: 222047 - DNA, 75 bp, Artificial Sequence
  Synthetic
taaatctggatgttttgtgtctttcctcattgataaaacagtcgaaattcaaagggttaaaaaatgataaacact

SEQ ID NO: 222048 - DNA, 75 bp, Artificial Sequence
  Synthetic
cagtctcaatgtcaataagagaatctttcaagtcagggcatgacctaatccatgaaatcattgtgtctatcatgt

SEQ ID NO: 222049 - DNA, 75 bp, Artificial Sequence
  Synthetic
gggtgggttgttgctatagtagtgtgaatgataggctggtaagctttcacagcactaaagaggagttcattagac

SEQ ID NO: 222050 - DNA, 75 bp, Artificial Sequence
  Synthetic
tttcaagtcagggcatgacctaatccatgaaatcattgtgtctatcatgttgtgcaacacctcatctgaaaaaat

SEQ ID NO: 222051 - DNA, 75 bp, Artificial Sequence
  Synthetic
ttttgaggaatagaaaaaagtcaaaggtgtttagaaaggtgtcttttgaggaattgtttagggcgtctattagtg

SEQ ID NO: 222052 - DNA, 75 bp, Artificial Sequence
  Synthetic
agttcattgcaaaaattcaaaaatgcctgttagtggtgggactgagtttcgagcattacggactgtctgaacacc

SEQ ID NO: 222053 - DNA, 75 bp, Artificial Sequence
  Synthetic
ttgagcaagaatgccacataccattcactgaatttgagaactttatgaaaattggagctcacccgataatgtatt

SEQ ID NO: 222054 - DNA, 75 bp, Artificial Sequence
  Synthetic
atacgaagtttgaagattacaatttccaacccagcacagagcagctgaagaacatacagagcctgagaagattat

SEQ ID NO: 222055 - DNA, 75 bp, Artificial Sequence
  Synthetic
catctgtttgtctggccttaacaaacagtatgaaaactagctcagttgctagactaaggcaaaatcaaatagggt

SEQ ID NO: 222056 - DNA, 75 bp, Artificial Sequence
  Synthetic
gtgtaatgcattacaggatgagtcccggctctcacaaagttctcaaattcagcaaatggtatatggcattcttgc

SEQ ID NO: 222057 - DNA, 75 bp, Artificial Sequence
  Synthetic
cggctctcacaaagttctcaaattcagcaaatggtatatggcattcttgcacgaggcattctgatagtccgtaat

SEQ ID NO: 222058 - DNA, 75 bp, Artificial Sequence
  Synthetic
ctgtgagatatcaagtggtagaatgcaaagaagtgttttgccaagtaataaaactggactctgaagaataccacc

SEQ ID NO: 222059 - DNA, 75 bp, Artificial Sequence
  Synthetic
tattataccagaagactggagaatcttcaaggtgctactccatacaaggcccggatggtcatttaatttccttct

SEQ ID NO: 222060 - DNA, 75 bp, Artificial Sequence
  Synthetic
atgcagatcctaaaaggttctttttaccaattttttcagatgaggtcttatacaatatgatagacatcatgattt

SEQ ID NO: 222061 - DNA, 75 bp, Artificial Sequence
  Synthetic
catggattagatcatgtcctgatttgaaagactgtctcaccgacattgaggttgcactgaggaccctattgttgc

SEQ ID NO: 222062 - DNA, 75 bp, Artificial Sequence
  Synthetic
taatgctcaccaacccaacaaagagaaatcaaaagcaggtacagagtgtcagatatttggtgatggcaatagtgt

SEQ ID NO: 222063 - DNA, 75 bp, Artificial Sequence
  Synthetic
cagatttttcatctacatcattaatggataagttgagggaggatctgatcacacctgctgagaaggtggtgtata

SEQ ID NO: 222064 - DNA, 75 bp, Artificial Sequence
  Synthetic
tactcagtgttagcatcgcttcctctctcatgcccatgggtctctgctgtaatgaacctcattaaggggcaggat

SEQ ID NO: 222065 - DNA, 75 bp, Artificial Sequence
  Synthetic
agctgcttagattcctaataaaaactatttttggtactggtgagaaggtgttgttgagtgcaaaatttaaattta

SEQ ID NO: 222066 - DNA, 75 bp, Artificial Sequence
  Synthetic
tcaactgcctctttgctcaacattaatatgtcatcattatcagtaagggtttcataaagttcagagaattccttg

SEQ ID NO: 222067 - DNA, 75 bp, Artificial Sequence
  Synthetic
tgttgaatgtgtcatacctgtgtcatttgatcacaaaggagacccctgacaggctaacagatcagataaaatgtt

SEQ ID NO: 222068 - DNA, 75 bp, Artificial Sequence
  Synthetic
ttcataaagttcagagaattccttgattaagcccccagggctgaccttttggaaattccttttgagtttcccatt

SEQ ID NO: 222069 - DNA, 75 bp, Artificial Sequence
  Synthetic
ttgaaaagttctttgagcccaaaagtcaatttggtttttttgtcaaccccaaggaagcaatcactcctgaggaag

SEQ ID NO: 222070 - DNA, 75 bp, Artificial Sequence
  Synthetic
aatgtgtgttctatgagcaaatgaagagattcactagtaaagaaattgactgtcagcatacaactccaggtgtta

SEQ ID NO: 222071 - DNA, 75 bp, Artificial Sequence
  Synthetic
atctggaagcctttagcctaatggtgtcttcatttaacaacggcactttaattttcaaaggagagaagaagctaa

SEQ ID NO: 222072 - DNA, 75 bp, Artificial Sequence
  Synthetic
agtactcagactcctcaaaaactttctcatcttgactagaatactccaaaagtttaaataggaggtctctgaact

SEQ ID NO: 222073 - DNA, 75 bp, Artificial Sequence
  Synthetic
acagcctagatcccatgactaactctggatgtgcgacagcattagatcttgctagtaacaaaagtgtggtggtta

SEQ ID NO: 222074 - DNA, 75 bp, Artificial Sequence
  Synthetic
taaaattcacccattctggcatgaaactgttatcataatcacaacgaccatccactattggaaccagtgtgatgc

SEQ ID NO: 222075 - DNA, 75 bp, Artificial Sequence
  Synthetic
ataagcatctaaatggagaacgacttctggaatatgactttaacaaattgcttgttagtgctgtgagtcaaatta

SEQ ID NO: 222076 - DNA, 75 bp, Artificial Sequence
  Synthetic
cggagagtttcgtaagaaaacaaaagtataagttgagccactcagactatgaatataaagtttccaagttagtct

SEQ ID NO: 222077 - DNA, 75 bp, Artificial Sequence
  Synthetic
ctagattggtcatcggttccaagggagaagagacagggagatcggaagacaacctggcagaaatatgttttgatg

SEQ ID NO: 222078 - DNA, 75 bp, Artificial Sequence
  Synthetic
gagaagaagagacaagcttcttcaaaagtctcgaagaaaaggtcaacaccacaatagcacggtacagaagaggta

SEQ ID NO: 222079 - DNA, 75 bp, Artificial Sequence
  Synthetic
ggagggccaatgacaaaggagatggagaaaaacttacaaatacaaaaggactacatcatttacagcttattctaa

SEQ ID NO: 222080 - DNA, 75 bp, Artificial Sequence
  Synthetic
ctctttgtcccaggaagttgagtttttgccttgacagcctctcgtcctgttctatgtaatttagacacaactctc

SEQ ID NO: 222081 - DNA, 75 bp, Artificial Sequence
  Synthetic
cagggaagatggctcacttaagaaaagttatcttgtcagaaatatctttccatttagtagaagactttgacccat

SEQ ID NO: 222082 - DNA, 75 bp, Artificial Sequence
  Synthetic
aatttagacacaactctctcaaatctgcaatagtctcatccattgcgcatcaaaaagcctaggatcctcggtgcg

SEQ ID NO: 222083 - DNA, 75 bp, Artificial Sequence
  Synthetic
catgtctaaccaatgatgacatgaaatttatctgtgaggctgttgagggttccacagagctgtcacctttgtatt

SEQ ID NO: 222084 - DNA, 75 bp, Artificial Sequence
  Synthetic
gcgcaccggggatcctaggctttttggattgcgctttcctctagatcaactgggtgtcaggccctatcctacaga

SEQ ID NO: 222085 - DNA, 75 bp, Artificial Sequence
  Synthetic
tcacctcagtcattaaagatcagtgtggcctcgatgagatggcaaaaaacctttgtagaaagttcttttctgaga

SEQ ID NO: 222086 - DNA, 75 bp, Artificial Sequence
  Synthetic
atgattggttttcttgcatgaagatgattctgttgcaaatgaatgcaaatgcgtactcagggaaatacaggcata

SEQ ID NO: 222087 - DNA, 75 bp, Artificial Sequence
  Synthetic
tgcaaaggcaaggcttgaatttcaaatttgactgggacaaactggaagaagacgtgagaatcagtgagagggaaa

SEQ ID NO: 222088 - DNA, 75 bp, Artificial Sequence
  Synthetic
gtaattctgagtcccttagtaaagctctgtcgttgacaaaatgtatgagtgctgctttgaaaaatctgtgcttct

SEQ ID NO: 222089 - DNA, 75 bp, Artificial Sequence
  Synthetic
actcagaagaatcaccaacatcatacacctcagtaggtcctgactctggaaggctgaaatttgcactatcttata

SEQ ID NO: 222090 - DNA, 75 bp, Artificial Sequence
  Synthetic
aagagcaggttgggggaaatagagaactctatattggagatttgaggacaaaaatgttcacaaggttaatagaag

SEQ ID NO: 222091 - DNA, 75 bp, Artificial Sequence
  Synthetic
attattttgagtctttttcaagtttcttttcaggctcctgtttaaacaatgataaggaatttgaaaatgcaatct

SEQ ID NO: 222092 - DNA, 75 bp, Artificial Sequence
  Synthetic
tgtcaatgactatcaatgtgcgggaagggttcttaaactatagtatggatcacagcaaatggggaccaatgatgt

SEQ ID NO: 222093 - DNA, 75 bp, Artificial Sequence
  Synthetic
gcccatttttgttcttaatgtttctacaaaatctcaaactaggtgatgaccagtatgtgcgttccgggaaagatc

SEQ ID NO: 222094 - DNA, 75 bp, Artificial Sequence
  Synthetic
atgttagcactttgttaacttggcacatgcataagcttgtcgaggtcccctttcctgttgtgaatgcaatgatga

SEQ ID NO: 222095 - DNA, 75 bp, Artificial Sequence
  Synthetic
aatcatatgtcaagtcgaagctaaaacttctcaggggttcagaaacaactgttactgagagaattttcagacaat

SEQ ID NO: 222096 - DNA, 75 bp, Artificial Sequence
  Synthetic
attttgaaatggggatagtgccatcccatatatccagccttattgatatggggcagggaatcttgcataatgctt

SEQ ID NO: 222097 - DNA, 75 bp, Artificial Sequence
  Synthetic
ctgacttctatggtttgcttagcgagaggttcatcaactactgcattggtgttatctttggcgaaagaccagagg

SEQ ID NO: 222098 - DNA, 75 bp, Artificial Sequence
  Synthetic
cttacacatcaagtgatgatcagatcactttatttgataggaggctgagtgacctggttgtaagtgatccggagg

SEQ ID NO: 222099 - DNA, 75 bp, Artificial Sequence
  Synthetic
aagtccttgtcctgttggaattccaatctcatctgagcggcttgttaaacaaatttatcagcccaaaaagtgtgg

SEQ ID NO: 222100 - DNA, 75 bp, Artificial Sequence
  Synthetic
ctgggaggttcgctgcagaatttaaatctagattctatgtatggggggaggaagtccctcttctcacaaagtttg

SEQ ID NO: 222101 - DNA, 75 bp, Artificial Sequence
  Synthetic
tatctgcagcgctacacaatgtcaagtgtaaagagccacatcaactttgtgaaacaatagatacaattgcagatc

SEQ ID NO: 222102 - DNA, 75 bp, Artificial Sequence
  Synthetic
aagccatcgcaaatggcgtcccagtctccctagttaatagtatccaaaggagaacactggacctcctaaagtatg

SEQ ID NO: 222103 - DNA, 75 bp, Artificial Sequence
  Synthetic
ccaatttccctttggatccatttctactgaataccaacactgatgtgaaagattggctggatggttctagaggtt

SEQ ID NO: 222104 - DNA, 75 bp, Artificial Sequence
  Synthetic
acagaatacaaagactcattgaggaactgtgtcctaatgaaacaaaggttgtaagaaagcttgtaaggaaactgc

SEQ ID NO: 222105 - DNA, 75 bp, Artificial Sequence
  Synthetic
atcataagctcaaaaatggtgaatttaatgaagaatttttcttagacctatttaacagagataaaaaggaggcca

SEQ ID NO: 222106 - DNA, 75 bp, Artificial Sequence
  Synthetic
ttcttcaattgggagacctcctcggtcttgaagaagatctgaatcagttagcagatgttaactggttgaatttga

SEQ ID NO: 222107 - DNA, 75 bp, Artificial Sequence
  Synthetic
atgaaatgttcccattaaggatggttttaagacaaaaggtggtttatccatcagtgatgactttccaagaggaaa

SEQ ID NO: 222108 - DNA, 75 bp, Artificial Sequence
  Synthetic
gaatcccatcattgatcaagacactccagaacaaactttgtagtaaattcacaaggggtgcacagaagctgctgt

SEQ ID NO: 222109 - DNA, 75 bp, Artificial Sequence
  Synthetic
cagaagcaatcaacaagtcagctttccagagttgtatctcatctggctttataggcctttgcaaaactctaggaa

SEQ ID NO: 222110 - DNA, 75 bp, Artificial Sequence
  Synthetic
gcaggtgtgtgagaaacaaaaatagggaaaatctgtatatcaaaaagctgcttgaggatctaaccacagatgatc

SEQ ID NO: 222111 - DNA, 75 bp, Artificial Sequence
  Synthetic
atgtgacaagagtttgcaatcgggatggtataacgctgtacatttgtgacaaacagtctcatccagaagcccacc

SEQ ID NO: 222112 - DNA, 75 bp, Artificial Sequence
  Synthetic
gtgatcatatatgccttttaaggcctcttctttgggactacatttgtatttcattgagcaactcttttgagttgg

SEQ ID NO: 222113 - DNA, 75 bp, Artificial Sequence
  Synthetic
gtgtttgggtcctagcagaaccgaccaaagggaagaataacagtgagaacctaactcttaagcacttaaacccat

SEQ ID NO: 222114 - DNA, 75 bp, Artificial Sequence
  Synthetic
gtgattatgtagcaagaaagcctgagagctcaaggctactggaggacaaagtgaatttgaaccaagtgattcaat

SEQ ID NO: 222115 - DNA, 75 bp, Artificial Sequence
  Synthetic
ctgtgaggcggctatatcccaagatctttgaggatcagcttcttccatttatgtctgacatgagctcaaaaaaca

SEQ ID NO: 222116 - DNA, 75 bp, Artificial Sequence
  Synthetic
tgaggtggagtcccagaattaaattccttgacctctgtgttttaattgatattaactcagaatccttgtcactca

SEQ ID NO: 222117 - DNA, 75 bp, Artificial Sequence
  Synthetic
tttctcatgttgttaagtggaaaagggatgaacattacactgttctgttttctgaccttgccaattctcatcagc

SEQ ID NO: 222118 - DNA, 75 bp, Artificial Sequence
  Synthetic
gatctgactccagtctggttgatgaatttgttgttagcacgagggatgtctgcaagaacttcttaaaacaggtgt

SEQ ID NO: 222119 - DNA, 75 bp, Artificial Sequence
  Synthetic
attttgaatcatttgttcgagaatttgttgcaacaaccaggacattaggcaatttttcatggttccctcataaag

SEQ ID NO: 222120 - DNA, 75 bp, Artificial Sequence
  Synthetic
aaatgatgccatctgaagatggtgctgaggcactgggcccctttcaatcatttgtctcaaaggtggtgaacaaaa

SEQ ID NO: 222121 - DNA, 75 bp, Artificial Sequence
  Synthetic
atgtggagaggcctatgtttaggaatgatttgcagtttggttttgggtggttctcttaccgaatgggagatgttg

SEQ ID NO: 222122 - DNA, 75 bp, Artificial Sequence
  Synthetic
tgtgtaatgctgccatgttgattaggcagggcctgacaaacccaaaggcatttaaatccttaaaggatctgtggg

SEQ ID NO: 222123 - DNA, 75 bp, Artificial Sequence
  Synthetic
actacatgctcaactacacaaaaggggtattggagttttcaatttcagtggactttacgcacaatcagaataata

SEQ ID NO: 222124 - DNA, 75 bp, Artificial Sequence
  Synthetic
ctgactgtttaaggaaattttcattgatattcttggttaggtgccaattacagaatccaggtgtggctgaacttt

SEQ ID NO: 222125 - DNA, 75 bp, Artificial Sequence
  Synthetic
tatcatgctctcacctctttaagggtgagatagatagaagaatgttggatgaatgcctccacttactgaggacag

SEQ ID NO: 222126 - DNA, 75 bp, Artificial Sequence
  Synthetic
actctgtcttcaaggtgaacgatggtgtctttgatatcagatctgaagagtttgaggattacatggaagatccct

SEQ ID NO: 222127 - DNA, 75 bp, Artificial Sequence
  Synthetic
tgatacttggtgattctcttgagcttgagttgttgggctccaaaagaatactggatgggattagatctattgact

SEQ ID NO: 222128 - DNA, 75 bp, Artificial Sequence
  Synthetic
ttgagagagttggacctgagtgggagcctgtgccactgactgtaaagatgggtgccctttttgaaggaagaaacc

SEQ ID NO: 222129 - DNA, 75 bp, Artificial Sequence
  Synthetic
ctcttaacttccttagacaaggacatcttgttgctcaatggtttctcaagacaaatgcgcaatcaaatgcctagg

SEQ ID NO: 222130 - DNA, 75 bp, Artificial Sequence
  Synthetic
gcgcaccggggatcctaggcgtttagttgcgctgtttggttgcacaactttcttcgtgaggctgtcagaagtgga

SEQ ID NO: 222131 - DNA, 75 bp, Artificial Sequence
  Synthetic
ttgtccaaaatatcattgtgaagctggagaccaaggacatgaaagtctttctagcaggacttgagggctatgaaa

SEQ ID NO: 222132 - DNA, 75 bp, Artificial Sequence
  Synthetic
agattagtgatgtccttgggaacctcttcctgcatcgattcagaactggtgaacatttgttgggttcagagataa

SEQ ID NO: 222133 - DNA, 75 bp, Artificial Sequence
  Synthetic
gtgtaatcctccaggaactatgtatagacagatctattctgctgattccactgtcgcttttgccagactggttcg

SEQ ID NO: 222134 - DNA, 75 bp, Artificial Sequence
  Synthetic
cctttaaggattgcagactttgttttagcaaatctaggagcactttgatgtatgaaacagtggggggcaggttta

SEQ ID NO: 222135 - DNA, 75 bp, Artificial Sequence
  Synthetic
tcaaggggaggtcctgcgacgattggctgggcgggtcggtggccgaggacatcgactgatgggcatctccgtggg

SEQ ID NO: 222136 - DNA, 75 bp, Artificial Sequence
  Synthetic
cgcaccggggatcctaggcgtttagttgcgctgctttattgcacagcttcactctgctaaactatcaggaactga

SEQ ID NO: 222137 - DNA, 75 bp, Artificial Sequence
  Synthetic
ccacggagatgcccatcagtcgatgtcctcggccaccgacccgcccagccaatcgtcgcaggacctccccttgag

SEQ ID NO: 222138 - DNA, 75 bp, Artificial Sequence
  Synthetic
ccgatcatcagccatgggccaaggcaagtccaaagaagaaagggacaccagcaatacaggcagagcagagctttt

SEQ ID NO: 222139 - DNA, 75 bp, Artificial Sequence
  Synthetic
gccagacaccacctatcttggtcctctaaattgtaaatcatgttggcagaaatttgacagcttggttagatgcca

SEQ ID NO: 222140 - DNA, 75 bp, Artificial Sequence
  Synthetic
tgaccactatctttgcagacactgtctgaatctcctgctgtcagtttccgacagatgtcctctctgtaagtatcc

SEQ ID NO: 222141 - DNA, 75 bp, Artificial Sequence
  Synthetic
actgccaaccaaactgaaggtgtcaacagtcccaagctccctacctccctatgaggagtaacacgccccagacct

SEQ ID NO: 222142 - DNA, 75 bp, Artificial Sequence
  Synthetic
cgacacagcaggccacccaacgcagaaaaaccacacacaagccggcacacacagacacagcaaccagcacaaagc

SEQ ID NO: 222143 - DNA, 75 bp, Artificial Sequence
  Synthetic
gcagaacacgcacacacacacacacatactcttaccgcccccaccacgattcccccccccggggagcgacccccc

SEQ ID NO: 222144 - DNA, 75 bp, Artificial Sequence
  Synthetic
gggagcccgggagggccccgcggagatgccggctagtcgatctccttggccaccgacccgcctagccaatcgtca

SEQ ID NO: 222145 - DNA, 75 bp, Artificial Sequence
  Synthetic
atgccggctagtcgatctccttggccaccgacccgcctagccaatcgtcacaggatttccccttgagtctaaact

SEQ ID NO: 222146 - DNA, 75 bp, Artificial Sequence
  Synthetic
tgcccccagttgtctcatacattacagtgttctttgacctgctgaagcagagcctacaatctctgaaggtgaacc

SEQ ID NO: 222147 - DNA, 75 bp, Artificial Sequence
  Synthetic
agcctacaatctctgaaggtgaaccaatctggcacaaaagacaatggtgtcagcatgacggatctgtccatgcag

SEQ ID NO: 222148 - DNA, 75 bp, Artificial Sequence
  Synthetic
agctcctggaggattacacttatctctgagcccagcaagtgttcgccgattctgaatcgatgcaggaagagtctt

SEQ ID NO: 222149 - DNA, 75 bp, Artificial Sequence
  Synthetic
ctgaggacatcactaatttttccatagccctcgagccctgccagaaagaccctcatgtcctttgtctctaatttc

SEQ ID NO: 222150 - DNA, 75 bp, Artificial Sequence
  Synthetic
acagagatattctgaacaaagtttctcccttcaaagagggcacccatccttatggtcagaggcacaggctcccac

SEQ ID NO: 222151 - DNA, 75 bp, Artificial Sequence
  Synthetic
tcaggcccaatcctctcaaagtcagtagatttgatctcattcagaatccttctagaacctatcagttcaagttct

SEQ ID NO: 222152 - DNA, 75 bp, Artificial Sequence
  Synthetic
agtgaatcaccaagtgtcaaagggtcttccatgtaatcttcaaactcttcagacctaatgtcaaagactccatca

SEQ ID NO: 222153 - DNA, 75 bp, Artificial Sequence
  Synthetic
ttcgctttaaagatagagtctgtcctcaacagattgagacactcatctaataatctcctgtcaacctcacctttg

SEQ ID NO: 222154 - DNA, 75 bp, Artificial Sequence
  Synthetic
aagaaatgagagcatgataagtaatcagctacacctggactctgtaattggcatttaaccacaaagatcaatgaa

SEQ ID NO: 222155 - DNA, 75 bp, Artificial Sequence
  Synthetic
aatttcttcaagcagtcagtgttgttctggttgtgtgtgaaatccactgtgattgagaactccaatatcccgcct

SEQ ID NO: 222156 - DNA, 75 bp, Artificial Sequence
  Synthetic
gtgctgctgagcatgtaatcccacagatctcttaaagatttaaatgcttttggatctgtcaaaccctgcttaatt

SEQ ID NO: 222157 - DNA, 75 bp, Artificial Sequence
  Synthetic
aacatagcggcattacacacaacatcccccacacggtaagagaaccatccaaaaccaaactgcaagtcattccta

SEQ ID NO: 222158 - DNA, 75 bp, Artificial Sequence
  Synthetic
aacatgggcctctctatatttttgttcaccactttcaaaatgaatgattggaaggggcccaggtcttcagcacca

SEQ ID NO: 222159 - DNA, 75 bp, Artificial Sequence
  Synthetic
tcttcagatggcatcatgtccttatgggggaaccatgaaaagttacctaaggtcctagctgttgcaacaaactct

SEQ ID NO: 222160 - DNA, 75 bp, Artificial Sequence
  Synthetic
cgtacaaatgattcgaaatacacttgcttcaaaaagttcttgcagacatcccttgtgctaacaacaaattcatca

SEQ ID NO: 222161 - DNA, 75 bp, Artificial Sequence
  Synthetic
cacagtgtaatgttcgtcccttttccacttgacaacatgagaaatgagtgacaaagactctgagttgatgtcaat

SEQ ID NO: 222162 - DNA, 75 bp, Artificial Sequence
  Synthetic
atcctgggactccatctcatattttttgagctcacatcagacatgaatgggagaaactgatcctcaaagattttg

SEQ ID NO: 222163 - DNA, 75 bp, Artificial Sequence
  Synthetic
gggtacagtcgcctcacagattgaattacatgattcaaactcactttatcctctagtagtctcgaactctcaggc

SEQ ID NO: 222164 - DNA, 75 bp, Artificial Sequence
  Synthetic
tttcttgctacataatcacatggatttaagtgcctaacagccaaatttctctcgttctttcctttcacaggttct

SEQ ID NO: 222165 - DNA, 75 bp, Artificial Sequence
  Synthetic
gctaaaacccaaactcccagctcaaaagagttgctcaatgagatgcaaatgtagtcccagagaaggggcctcaaa

SEQ ID NO: 222166 - DNA, 75 bp, Artificial Sequence
  Synthetic
aggttgatgtggtcacggtgagcctctgggtgtctctgcttgtcgcaaatgtacaacatcacaccatcttgtttg

SEQ ID NO: 222167 - DNA, 75 bp, Artificial Sequence
  Synthetic
gtacaacatcacaccatcttgtttgtgaacccttgtgacatgctcatccatggttagatcttcaagcacctttct

SEQ ID NO: 222168 - DNA, 75 bp, Artificial Sequence
  Synthetic
gatatacatattttccctgtttttatttctcacacacctacttcctaaagtcttacagagacctataaagccgga

SEQ ID NO: 222169 - DNA, 75 bp, Artificial Sequence
  Synthetic
tgagacacaactctgaaaagctgatttgttgattgcctctgacagcagcttctgtgcacctcttgtgaacttact

SEQ ID NO: 222170 - DNA, 75 bp, Artificial Sequence
  Synthetic
acaaagcttattttggagtgttttaatcaatgaggggatcttttcctcttgaaaggtcattactgatgggtaaac

SEQ ID NO: 222171 - DNA, 75 bp, Artificial Sequence
  Synthetic
cactttttgtctcagaaccatcctcaatgggaacatttcattcagattcaaccaattgatgcttgccaactcatt

SEQ ID NO: 222172 - DNA, 75 bp, Artificial Sequence
  Synthetic
aatgggaacatttcattcagattcaaccaattgatgcttgccaactcattaagatcatcctcaagaccaagaatc

SEQ ID NO: 222173 - DNA, 75 bp, Artificial Sequence
  Synthetic
aagatcatcctcaagaccaagaatctctccaaattgaaggatggcctcattcttttccctgttgaagaggtctag

SEQ ID NO: 222174 - DNA, 75 bp, Artificial Sequence
  Synthetic
tctccaaattgaaggatggcctcattcttttccctgttgaagaggtctagaaaaaattcctcgttacattcacag

SEQ ID NO: 222175 - DNA, 75 bp, Artificial Sequence
  Synthetic
ttcttgagtttgtgatgtagtcttcttacaagttttctcatgatctttgtttcactgggacacaattcttcaatg

SEQ ID NO: 222176 - DNA, 75 bp, Artificial Sequence
  Synthetic
agtctttggattctataacctctagaaccatctaaccaatcctttacatcagtgtgagtgtttaacaagaatgga

SEQ ID NO: 222177 - DNA, 75 bp, Artificial Sequence
  Synthetic
agtgtgagtgtttaacaagaatggatctaaagggaaattagcatatttcaagagatccagtgtcctccgctggat

SEQ ID NO: 222178 - DNA, 75 bp, Artificial Sequence
  Synthetic
acagtttacgaaaaaaactgggacgccatttgctatagcttgatcagccatcgtatctattgtctcacaaagttg

SEQ ID NO: 222179 - DNA, 75 bp, Artificial Sequence
  Synthetic
ccatttgctatagcttgatcagccatcgtatctattgtctcacaaagttgatgcggctctttacacttaacattg

SEQ ID NO: 222180 - DNA, 75 bp, Artificial Sequence
  Synthetic
tgtagtgccgcagacacaaatttcgtgaggagagggacctcctccccccactcataaaatctggatttgaattcc

SEQ ID NO: 222181 - DNA, 75 bp, Artificial Sequence
  Synthetic
gctgcaaaccgcccaaccacactttttggactgatgaacttgttcaacaaaccactcaagtgagagtggaattcc

SEQ ID NO: 222182 - DNA, 75 bp, Artificial Sequence
  Synthetic
agcaagacaaggacttcttctgggtcactatcaactaagtcactcaatctcttgtcaaataaagtgatctgatca

SEQ ID NO: 222183 - DNA, 75 bp, Artificial Sequence
  Synthetic
cactatcaactaagtcactcaatctcttgtcaaataaagtgatctgatcatcacttgatgtataggcttctggtc

SEQ ID NO: 222184 - DNA, 75 bp, Artificial Sequence
  Synthetic
tttctccaaaaatgacaccaatacaataattgataaacctttcactaattaaaccgtaaaaatcagaagcattgt

SEQ ID NO: 222185 - DNA, 75 bp, Artificial Sequence
  Synthetic
gtaggatcccctgtcccatgtcaatgagactagatatgtgggatggcactacccccatttcaaaatactctctaa

SEQ ID NO: 222186 - DNA, 75 bp, Artificial Sequence
  Synthetic
agattctctctgtaacagtcgttcctgaccctttgagaagcttgagttttgatttaacatatgatttcatcattg

SEQ ID NO: 222187 - DNA, 75 bp, Artificial Sequence
  Synthetic
cattcacaacagggaaggggacttcaacaagtttatgcatatgccaagtcaacaaggtgctaacatgatcttttc

SEQ ID NO: 222188 - DNA, 75 bp, Artificial Sequence
  Synthetic
cagaacgcacgtactgatcatcacccagtttgagattttggagaagcattaagaataggaatgggcacatcatcg

SEQ ID NO: 222189 - DNA, 75 bp, Artificial Sequence
  Synthetic
gcccccatttgctgtgatccatgctgtagtttaacaacccttctctcacattgatagtcattgacaagattgcat

SEQ ID NO: 222190 - DNA, 75 bp, Artificial Sequence
  Synthetic
tttcaaactctttgtcattgtttaaacaagatcctgaaaagaaactagaaaaggattcaaaataatcttctacca

SEQ ID NO: 222191 - DNA, 75 bp, Artificial Sequence
  Synthetic
atcttgtgaacatttttgtcctcaaatccccaatgtaaagctctctatttcccccaacctgctctttgtatgaca

SEQ ID NO: 222192 - DNA, 75 bp, Artificial Sequence
  Synthetic
atgcaaactttagtctcccagagtcagggccaactgaagtgtatgatgttggtgattcttctgagtaaaaacaca

SEQ ID NO: 222193 - DNA, 75 bp, Artificial Sequence
  Synthetic
gattctttagagcagcactcatgcattttgtcaatgaaagggccttacttagagattcagaattgctttcccttt

SEQ ID NO: 222194 - DNA, 75 bp, Artificial Sequence
  Synthetic
cactgattctcacatcttcttccaatttgtcccagtcaaatttaaaatttaagctctgcctctgcatgtgtctgt

SEQ ID NO: 222195 - DNA, 75 bp, Artificial Sequence
  Synthetic
tcttccctgaatacgcatttgcattcatctgtaacaagatcatcttcatacatgagaaccaatcaccctctgaga

SEQ ID NO: 222196 - DNA, 75 bp, Artificial Sequence
  Synthetic
agaactttctacagaggtttcttgccatctcgtccagaccacattgttctttgacagctgatgtaaaatacaatg

SEQ ID NO: 222197 - DNA, 75 bp, Artificial Sequence
  Synthetic
ttgacagctgatgtaaaatacaatggtgacagttctgttgaaccttcaacagcctcacaaataaatctcatgtcg

SEQ ID NO: 222198 - DNA, 75 bp, Artificial Sequence
  Synthetic
tcattggtgagagaggatggatcaaagtcctctactagatgaaatgaaatttctgataaaatgaccttcctcaga

SEQ ID NO: 222199 - DNA, 75 bp, Artificial Sequence
  Synthetic
taagctctttgacctgacaaaacaatctgaaggtggtgtagtccttttgtgttcttgaattctccccccccttgc

SEQ ID NO: 222200 - DNA, 75 bp, Artificial Sequence
  Synthetic
tctgaaggtggtgtagtccttttgtgttcttgaattctccccccccttgcctgtcattaagcctagtgcctctat

SEQ ID NO: 222201 - DNA, 75 bp, Artificial Sequence
  Synthetic
tataccgtgttattgtggagttgaccttatcttctaaactcctaaaaaaacttgtctcctcctccccatcgaaac

SEQ ID NO: 222202 - DNA, 75 bp, Artificial Sequence
  Synthetic
cttgtctcctcctccccatcgaaacacacatctaccggatcatcttccaatttgtctgcctctgttttcctggaa

SEQ ID NO: 222203 - DNA, 75 bp, Artificial Sequence
  Synthetic
ccgatgactaatctagagacaagctttgagaccttatattcgtaatctgagtgtctcagcttatacttttgtttc

SEQ ID NO: 222204 - DNA, 75 bp, Artificial Sequence
  Synthetic
ctcatgaagccctctgtaatttggctcacagcactaacaagcaatttgttaaaatcatactccaaaagccgttct

SEQ ID NO: 222205 - DNA, 75 bp, Artificial Sequence
  Synthetic
ccattcagatgtttattgacaaccacacttttgttgcttgcgagatctaatgctgtcgcacatccagagttggtc

SEQ ID NO: 222206 - DNA, 75 bp, Artificial Sequence
  Synthetic
atggggtccagattgttgagccttttctctccttttaggattaaggtgccattgttgaatgaagataccatcatg

SEQ ID NO: 222207 - DNA, 75 bp, Artificial Sequence
  Synthetic
ctaaagatctctaaattaacaccaggggttgaatgctgacaatcaatatctttaccggtgaacttcctcatttgt

SEQ ID NO: 222208 - DNA, 75 bp, Artificial Sequence
  Synthetic
gggttgaatgctgacaatcaatatctttaccggtgaacttcctcatttgttcataaaaaacacattcctcttcgg

SEQ ID NO: 222209 - DNA, 75 bp, Artificial Sequence
  Synthetic
tcataaaaaacacattcctcttcgggtgtgattgttctcttagggttgacaaagaaacctaactcactcttgggc

SEQ ID NO: 222210 - DNA, 75 bp, Artificial Sequence
  Synthetic
tcaaagaacttttcaaaacattttatctgatctgtcaatctatcaggggtctcctttgtgatcaaatgacacagg

SEQ ID NO: 222211 - DNA, 75 bp, Artificial Sequence
  Synthetic
tatgacacattcaacataaacttaaattttgcacttaataacaccttttcaccagtaccaaaaattgtcctaatc

SEQ ID NO: 222212 - DNA, 75 bp, Artificial Sequence
  Synthetic
aaaaaccgaagcagcctgtacaccaccttctcggcaggtgtgattagatcctccttcaacttatccattaatgag

SEQ ID NO: 222213 - DNA, 75 bp, Artificial Sequence
  Synthetic
gtcgatgaaaagtctgagacgatggccatcactaaatacctaatattttgaacctgcttttgatttctctttgtt

SEQ ID NO: 222214 - DNA, 75 bp, Artificial Sequence
  Synthetic
gggttggtgagcatcagtaggattaatgtccttagtgcagtctcaatgtcaataagagaatctttcaagtcaggg

SEQ ID NO: 222215 - DNA, 75 bp, Artificial Sequence
  Synthetic
aataagagaatctttcaagtcagggcatgaccgaatccatgaaatcattgtgtctatcatgttgtgcaacgccgc

SEQ ID NO: 222216 - DNA, 75 bp, Artificial Sequence
  Synthetic
atctgaaaaaattggtaaaaagaaccgttttggatctgcgtaaaaggaaatcaagtgaccatccggaccttgtat

SEQ ID NO: 222217 - DNA, 75 bp, Artificial Sequence
  Synthetic
ggaataacacctcgaggattctccagttttctgatatagtagatgatactcttcggaatccagttttattgtctg

SEQ ID NO: 222218 - DNA, 75 bp, Artificial Sequence
  Synthetic
gcaaaacacctctttgcactccaccacttgatatctcacagaccccagttggttctgtctcaacctggcaactga

SEQ ID NO: 222219 - DNA, 75 bp, Artificial Sequence
  Synthetic
acttgatatctcacagaccccagttggttctgtctcaacctggcaactgagcttgttttcatgctgtttgttaga

SEQ ID NO: 222220 - DNA, 75 bp, Artificial Sequence
  Synthetic
gccaaacaaacagatgacagttttctcaaactctgtaaacccctcaattgctctatgttaggctggaaagtgtaa

SEQ ID NO: 222221 - DNA, 75 bp, Artificial Sequence
  Synthetic
tcaaactctgtaaacccctcaattgctctatgttaggctggaaagtgtaatcttcaaattttgtgtaatgcatta

SEQ ID NO: 222222 - DNA, 75 bp, Artificial Sequence
  Synthetic
tcttcaaattttgtgtaatgcattacaggatgagctccggctctcacaaagttctcaaattcagcaaatggtata

SEQ ID NO: 222223 - DNA, 75 bp, Artificial Sequence
  Synthetic
caggatgagctccggctctcacaaagttctcaaattcagcaaatggtatatggcattcttgcacgaggctttctg

SEQ ID NO: 222224 - DNA, 75 bp, Artificial Sequence
  Synthetic
atagtccataatgctcaaaactaagtcccactgctgataggcatttctggatttttgctatgaactcatttatgg

SEQ ID NO: 222225 - DNA, 75 bp, Artificial Sequence
  Synthetic
ataccctaaaaagctcatcaagagatgcttttttgtgcactcttgactttcttctgttcttcaaaagtctgatga

SEQ ID NO: 222226 - DNA, 75 bp, Artificial Sequence
  Synthetic
attcttctttggtactttgaaggctcacaagcctatcattcacactactgtagcaacaaccaacccaatgtttat

SEQ ID NO: 222227 - DNA, 75 bp, Artificial Sequence
  Synthetic
cattttccaaccctttggaaattgactgcttaataagtgaagaaagacataagacatctaagttcagcagctgtc

SEQ ID NO: 222228 - DNA, 75 bp, Artificial Sequence
  Synthetic
tccttctagtgtttaataattttaagcttttcaccttgttcaacatagagagtagcctttcatactcagtgttag

SEQ ID NO: 222229 - DNA, 75 bp, Artificial Sequence
  Synthetic
catcgcttcccctctcatgcccatgggtctctgctgtaatgaacctcattaaggggcaggattcaactgcctccc

SEQ ID NO: 222230 - DNA, 75 bp, Artificial Sequence
  Synthetic
tgctcaacattaatatgtcatcattatcagtaagggtttcataaagttcagagaattccttgatcaagccttcag

SEQ ID NO: 222231 - DNA, 75 bp, Artificial Sequence
  Synthetic
atcagtaagggtttcataaagttcagagaattccttgatcaagccttcagggcttaccttttggaaattccttgt

SEQ ID NO: 222232 - DNA, 75 bp, Artificial Sequence
  Synthetic
gagtttcccatttagcaggtccctcctaaacctgccaaaaaaggaatttatgccaaagaccacatcatcgcaact

SEQ ID NO: 222233 - DNA, 75 bp, Artificial Sequence
  Synthetic
catgttggggttgacaccatcgtggcacattttcataatctcatcgttatgaaatgatcttgcgtctttcagaat

SEQ ID NO: 222234 - DNA, 75 bp, Artificial Sequence
  Synthetic
tttcattgagtccatgccggaacgtttgtcaacagtggtcttcagagactcacagagcctgaagtactcagactc

SEQ ID NO: 222235 - DNA, 75 bp, Artificial Sequence
  Synthetic
cacagagcctgaagtactcagactcctcaaaaactttctcatcttgactagaatactccaaaagtttaaatagga

SEQ ID NO: 222236 - DNA, 75 bp, Artificial Sequence
  Synthetic
ctcaaaaactttctcatcttgactagaatactccaaaagtttaaataggaggtctctaaatttaaaattcaccca

SEQ ID NO: 222237 - DNA, 75 bp, Artificial Sequence
  Synthetic
tagtttaaacataactctctcaattctgagatgatttcatccattgcgcatcaaacaagcctaggatccccggtg

SEQ ID NO: 222238 - DNA, 75 bp, Artificial Sequence
  Synthetic
gacacagcacccaacacagaacacgcacacacacacacacacacacacacacacacgcgcccacacacacacacg

SEQ ID NO: 222239 - DNA, 75 bp, Artificial Sequence
  Synthetic
ttctggcatgaaactgttatcataatcacaacgaccatccactattggaaccagtgtgatgcctgcaacagcaag

SEQ ID NO: 222240 - DNA, 75 bp, Artificial Sequence
  Synthetic
atgggccaaattgtgacgatgtttgaggctctgcctcacatcattgatgaggtcattaacatagtcattatcgtg

SEQ ID NO: 222241 - DNA, 75 bp, Artificial Sequence
  Synthetic
atcttctttgatgcatgctagtttgttggtgtcctcaatgaacttcttttcaaaactagctggtgtgcttctaac

SEQ ID NO: 222242 - DNA, 75 bp, Artificial Sequence
  Synthetic
ctcattatcatcacgagcatcaaagctgtgtacaatttcgccacttgcgggatatttgcattaatcagctttctt

SEQ ID NO: 222243 - DNA, 75 bp, Artificial Sequence
  Synthetic
aaaacattcaagaagaataagggaattgtcaatcaacttataaccatcagggatgatgagtggcagtcctggaca

SEQ ID NO: 222244 - DNA, 75 bp, Artificial Sequence
  Synthetic
ctcctggctggcaggtcctgtggaatgtatggtcttgatgggcccaacatttacaaaggggtttatcaattcaag

SEQ ID NO: 222245 - DNA, 75 bp, Artificial Sequence
  Synthetic
cacaatcccagagtctattaggattgtttcaacagatttgtcgtcgtggttgtgtatgcaaccacttttgtctgc

SEQ ID NO: 222246 - DNA, 75 bp, Artificial Sequence
  Synthetic
tcagtagagtttgacatgtctcaccttaatctgacgatgcccaatgcatgttcggcaaacaactcccatcattat

SEQ ID NO: 222247 - DNA, 75 bp, Artificial Sequence
  Synthetic
actgtctatctctatacagcgtgataacaatttgagtccctcaattaggaccattctgggttctctttgtcccag

SEQ ID NO: 222248 - DNA, 75 bp, Artificial Sequence
  Synthetic
ataagtatggggacttctggattggagttaaccttcacaaatgactccatcatcagtaacaaaccttgtaatctg

SEQ ID NO: 222249 - DNA, 75 bp, Artificial Sequence
  Synthetic
tcttcctccttccagaaggaaacttttgaccacacacttatgagcatagtcacaagtctgcacctcagcatcaga

SEQ ID NO: 222250 - DNA, 75 bp, Artificial Sequence
  Synthetic
agtttagacacaactctctcagatctgcaatagtttcatccattgcgcatcaaaaagcctaggatcctcggtgcg

SEQ ID NO: 222251 - DNA, 75 bp, Artificial Sequence
  Synthetic
cgcacagtggatcctaggctttttggattgcgctttcctcttggtgaactgagtgttagactctgtcttgtctaa

SEQ ID NO: 222252 - DNA, 75 bp, Artificial Sequence
  Synthetic
ggaagcaccaaccgcaaagcagtgtcctgtgattttaacaatggcatcactattcaatacaatctgtcattttct

SEQ ID NO: 222253 - DNA, 75 bp, Artificial Sequence
  Synthetic
aaatgggccaaataatcacaatgtttgaggccctgcctcacatcatcgatgaagtcatcaacattgtcatcattg

SEQ ID NO: 222254 - DNA, 75 bp, Artificial Sequence
  Synthetic
gatgcacagagcgctctgagtcaatgcaggactttcagagggagagtcctggatatgttcagaactgcttttggg

SEQ ID NO: 222255 - DNA, 75 bp, Artificial Sequence
  Synthetic
tgcttattataatcacaagcatcaaagctgtgtacaactttgctacttgtggaatattagcactgaccagctttc

SEQ ID NO: 222256 - DNA, 75 bp, Artificial Sequence
  Synthetic
ggaaagtacatgaggagtggctggggctggacaggttcagatggcaagaccacttggtgcagccagacaaactat

SEQ ID NO: 222257 - DNA, 75 bp, Artificial Sequence
  Synthetic
ttctcttagctggtaggtcatgcggtatgtacggtctcagtgggcctgacatatacaaaggagtttatcaattca

SEQ ID NO: 222258 - DNA, 75 bp, Artificial Sequence
  Synthetic
caatatctgatcatacaaaacagaacttgggaaaaccactgcagatacgcaggccctttcggaatgtccagaatc

SEQ ID NO: 222259 - DNA, 75 bp, Artificial Sequence
  Synthetic
aatcagtggaatttgacatgtcccacttgaatctgacaatgcccaatgcatgttcagtaaacaattctcaccact

SEQ ID NO: 222260 - DNA, 75 bp, Artificial Sequence
  Synthetic
ctcttcgctcaagaaaagacaaggtttctaactaggaggcttgcaggcacattcacttggactttatcagactca

SEQ ID NO: 222261 - DNA, 75 bp, Artificial Sequence
  Synthetic
acatcagcatggggacttctggattagagctaactttcacaaatgactctatcatccaacacaaccattgcaact

SEQ ID NO: 222262 - DNA, 75 bp, Artificial Sequence
  Synthetic
tcaggagtggagaatccaggtggttactgcttgaccaagtggatgatcattgctgcagagctcaaatgttttggg

SEQ ID NO: 222263 - DNA, 75 bp, Artificial Sequence
  Synthetic
tcaggagtggagaatccaggtggttactgcttgaccaagtggatgatctttgctgcagagctcaaatgttttggg

SEQ ID NO: 222264 - DNA, 75 bp, Artificial Sequence
  Synthetic
tcaggagtggagaatccaggtggttactgcttgaccaagtggatgatccttgctgcagagctcaaatgttttggg

SEQ ID NO: 222265 - DNA, 75 bp, Artificial Sequence
  Synthetic
tcaggagtggagaatccaggtggttactgcttgaccaagtggatgatcgttgctgcagagctcaaatgttttggg

SEQ ID NO: 222266 - DNA, 75 bp, Artificial Sequence
  Synthetic
tgacctctgccttcaataagaaaaccttcgatcacacacttatgagcattgtctctagcctacacctcagtataa

SEQ ID NO: 222267 - DNA, 75 bp, Artificial Sequence
  Synthetic
aacacagctgtagcaaagtgcaatgtgaatcatgatgaagagttctgtgatatgctacggctgattgattacaac

SEQ ID NO: 222268 - DNA, 75 bp, Artificial Sequence
  Synthetic
gaggaaactccaactataaggcagtgtcctgtgacttcaacaatggtattaccattcaatacaatctaacactct

SEQ ID NO: 222269 - DNA, 75 bp, Artificial Sequence
  Synthetic
aaggctgctttgagtaaattcaaagaggatgtggaatctgctctgcatctgtttaagacaacagtgaattctctg

SEQ ID NO: 222270 - DNA, 75 bp, Artificial Sequence
  Synthetic
cagactcacaaagtgctctaagtcagtgtaggacttttagagggagggtcctggatatgttcaggactgcctttg

SEQ ID NO: 222271 - DNA, 75 bp, Artificial Sequence
  Synthetic
atttctgatcagcttttgatgagaaatcatttaagagacttgatgggagtgccatactgcaattactcgaaattc

SEQ ID NO: 222272 - DNA, 75 bp, Artificial Sequence
  Synthetic
gggggaagtatatgagaagtggttggggctggacaggttcagatggcaaaaccacctggtgtagccaaacaagct

SEQ ID NO: 222273 - DNA, 75 bp, Artificial Sequence
  Synthetic
tggtatctagagcatgcaaggactggtgagactagtgtccccaagtgctggcttgtcagcaatggttcttatttg

SEQ ID NO: 222274 - DNA, 75 bp, Artificial Sequence
  Synthetic
accagtacttaatcatacaaaacagaacctgggaaaaccactgcaggtatgcaggcccttttggaatgtccagaa

SEQ ID NO: 222275 - DNA, 75 bp, Artificial Sequence
  Synthetic
aatgaaacccatttcagtgaccaaattgagcaggaagcagacaatatgatcacagaaatgctgagaaaggactac

SEQ ID NO: 222276 - DNA, 75 bp, Artificial Sequence
  Synthetic
ttctctttgctcaagaaaagacaaaattccttaccagaaggcttgcaggcacgttcacttggactttgtcagact

SEQ ID NO: 222277 - DNA, 75 bp, Artificial Sequence
  Synthetic
ataaaaaggcaaggaagcacccctctagccttgatggacctgttgatgttttccacatcggcatacttgatcagc

SEQ ID NO: 222278 - DNA, 75 bp, Artificial Sequence
  Synthetic
catcaggagtggagaatccaggtggttattgcttgaccaaatggatgattctcgccgcagaacttaagtgtttcg

SEQ ID NO: 222279 - DNA, 75 bp, Artificial Sequence
  Synthetic
atctttctgcatcttgtgaagataccaacacacagacacataaagggcggctcatgcccaaaaccacatcggtta

SEQ ID NO: 222280 - DNA, 75 bp, Artificial Sequence
  Synthetic
ggaacacagctgttgcaaaatgcaatgtcaatcacgatgaagagttctgtgatatgctgcggttgattgactaca

SEQ ID NO: 222281 - DNA, 75 bp, Artificial Sequence
  Synthetic
accagcatgggaatctgtagttgtggcacattcaaagtgccaggtgtggaaaccacctggaagagacgctgaaca

SEQ ID NO: 222282 - DNA, 75 bp, Artificial Sequence
  Synthetic
acaaggctgctctgagtaagtttaaagaagatgtggagtctgctctgcacctatttaaaacgacagtgaactctc

SEQ ID NO: 222283 - DNA, 75 bp, Artificial Sequence
  Synthetic
gtagcgcctccctgactcaccacctcgaaagaggtggtgagtcagggaggcccagagggtcttagagtgttacta

SEQ ID NO: 222284 - DNA, 75 bp, Artificial Sequence
  Synthetic
tgatttctgaccagttactgatgaggaatcatctgagagatctgatgggggtgccatactgcaattactcaaaat

SEQ ID NO: 222285 - DNA, 75 bp, Artificial Sequence
  Synthetic
catttggacctctgaagatcaggtcatgtggtaggatgttgtggacagttttcaagtcggggagccctgccctgg

SEQ ID NO: 222286 - DNA, 75 bp, Artificial Sequence
  Synthetic
atgtggtaggatgttgtggacagttttcaagtcggggagccctgccctggaggcactctcaaagatgatacaatc

SEQ ID NO: 222287 - DNA, 75 bp, Artificial Sequence
  Synthetic
tctggtacttagaacatgcaaagactggtgagacaagtgtacctaagtgctggctcgttactaatggttcttact

SEQ ID NO: 222288 - DNA, 75 bp, Artificial Sequence
  Synthetic
catgagtgcacagtgtggggtgatctctttctttttcttgtccttcactattccagtgtgcatcttgcatagcca

SEQ ID NO: 222289 - DNA, 75 bp, Artificial Sequence
  Synthetic
taaacgaaacccacttcagtgatcaaatcgagcaggaagcagacaatatgatcacagagatgttgaggaaagatt

SEQ ID NO: 222290 - DNA, 75 bp, Artificial Sequence
  Synthetic
gccatatctgtcccaaactttgtcctcatattctctcgaagcttctttagtcatctcaacatcgataagcttgat

SEQ ID NO: 222291 - DNA, 75 bp, Artificial Sequence
  Synthetic
acataaaaaggcaagggagcacccccttggccttaatggatctcttgatgttttctacatcagcatatttgatca

SEQ ID NO: 222292 - DNA, 75 bp, Artificial Sequence
  Synthetic
gtctcttctgttttgtgaatctaggagtttcctgatgtcatctgaaccttgacagcttaagaccatcccttgtgg

SEQ ID NO: 222293 - DNA, 75 bp, Artificial Sequence
  Synthetic
gtatcttcctacatcttataaaaataccaacacatagacatataaagggcggctcatgccccaagccacaccgtt

SEQ ID NO: 222294 - DNA, 75 bp, Artificial Sequence
  Synthetic
aagagcacctattacagaagatgtcagcccaggttgtgcattgaagaggtcagcaaggtccattccatgtgagta

SEQ ID NO: 222295 - DNA, 75 bp, Artificial Sequence
  Synthetic
taaccaaaaaaggaatttgtagttgtggtgcttttaaagtccctggtgtggaaactgtttggaaaagacgctgaa

SEQ ID NO: 222296 - DNA, 75 bp, Artificial Sequence
  Synthetic
tttggagtcctgcttgaattgtttttgatcagtgggttctctgtagaaatgtatgtactggccattctgtggctg

SEQ ID NO: 222297 - DNA, 75 bp, Artificial Sequence
  Synthetic
ctcgaaagaggtggagagtcagggaggcccagagggtcttagagtgtcacaacattcgggcctctgaagatcagg

SEQ ID NO: 222298 - DNA, 75 bp, Artificial Sequence
  Synthetic
aaatattgctatttctactgggtcattgaatctgccctcaatgtcaatccatgtaggagcgttagggtcaatacc

SEQ ID NO: 222299 - DNA, 75 bp, Artificial Sequence
  Synthetic
tcatgtggtaagatgttgtgaacggtttttaagtcaggcagtcttgccttagaagcactctcaaagattatacag

SEQ ID NO: 222300 - DNA, 75 bp, Artificial Sequence
  Synthetic
tcccatgaggtccttcaacaacattgtttggctgaagcttaagcccacctgaggtgggcccgctgctccaggcac

SEQ ID NO: 222301 - DNA, 75 bp, Artificial Sequence
  Synthetic
tccataagtgcacagtgtggggtaatctctttcttcttcttatccttcactatcccggtgtgcattttgcataac

SEQ ID NO: 222302 - DNA, 75 bp, Artificial Sequence
  Synthetic
tggtttgggtgagttggccataggcctctcgtttgtcagatcaattgttgtgttctcccatgctctccctacaac

SEQ ID NO: 222303 - DNA, 75 bp, Artificial Sequence
  Synthetic
caaccatacttatcccacactttgtcttcatattcccttgaggcttctttggtcatctcaacatcaataagtttg

SEQ ID NO: 222304 - DNA, 75 bp, Artificial Sequence
  Synthetic
tgatgttctgcaggctatgtatggccacccttcccctgaaagacagactttgtagaggatgttctcgtagggatt

SEQ ID NO: 222305 - DNA, 75 bp, Artificial Sequence
  Synthetic
atgtctcttctgttctgtgagtctaggagctttctgatatcctcagaaccctgacagcttaaaaccatcccctgt

SEQ ID NO: 222306 - DNA, 75 bp, Artificial Sequence
  Synthetic
cctgtctccaacctgatcggaaacaaacatgttgagtttcttcttggccccaagaactgctttcaagagatcctc

SEQ ID NO: 222307 - DNA, 75 bp, Artificial Sequence
  Synthetic
ggaagagcacctataactgaagatgtcaacccaggttgcgcattgaaaagatcagcaaggtccataccatgtgaa

SEQ ID NO: 222308 - DNA, 75 bp, Artificial Sequence
  Synthetic
gctgttgcttggcttaattaaaatggattccagcatgttgcccccatctaacaaggcagcccctgctttcacagc

SEQ ID NO: 222309 - DNA, 75 bp, Artificial Sequence
  Synthetic
gctgttgcttggcttaattaaaatggattccagcatgttgcccccatctaacaaggctgcccctgctttcacagc

SEQ ID NO: 222310 - DNA, 75 bp, Artificial Sequence
  Synthetic
gctgttgcttggcttaattaaaatggattccagcatgttgcccccatctaacaaggccgcccctgctttcacagc

SEQ ID NO: 222311 - DNA, 75 bp, Artificial Sequence
  Synthetic
gctgttgcttggcttaattaaaatggattccagcatgttgcccccatctaacaaggcggcccctgctttcacagc

SEQ ID NO: 222312 - DNA, 75 bp, Artificial Sequence
  Synthetic
tacttagaatcttgtttgaattgcttttggtcagtaggttctctataaaagtgaatgaactgcccattctgtggt

SEQ ID NO: 222313 - DNA, 75 bp, Artificial Sequence
  Synthetic
agcaccgagactgaaattgtagccagatatgttgatgctggactgctgctcagtgataactcccaagactgggtg

SEQ ID NO: 222314 - DNA, 75 bp, Artificial Sequence
  Synthetic
tggaatattgctatttccactgggtcattaaatctaccctcaatgtcaatccatgtgggggcattgggatcaatc

SEQ ID NO: 222315 - DNA, 75 bp, Artificial Sequence
  Synthetic
cttgtctttcagcctttcaagatcactcaggttcgggtatttgactgtgtaaagcagcccaaggtctgtgagtgc

SEQ ID NO: 222316 - DNA, 75 bp, Artificial Sequence
  Synthetic
ccccccataaggtctttcagcagcattgtctgactatagctcaagcccacttgaggtgggcctgccgctccgggt

SEQ ID NO: 222317 - DNA, 75 bp, Artificial Sequence
  Synthetic
ttgtacaacgtcattgagtgaggtctgtgattgtttagccatgcaagccatggttaagcttggcattgtgccaaa

SEQ ID NO: 222318 - DNA, 75 bp, Artificial Sequence
  Synthetic
gttggtctgggtgagttaaccatggacctttcatttgtgaggtcaattgttgtgttctcccatgctcttcctaca

SEQ ID NO: 222319 - DNA, 75 bp, Artificial Sequence
  Synthetic
ttgattgttcagaagtgatgaatccttcacatcccagaccctcaccacaccatttgcaccctgctgaggtctcct

SEQ ID NO: 222320 - DNA, 75 bp, Artificial Sequence
  Synthetic
actgatgttctgcaagctatgtacggccacccttcacctgaaagacagactttgtaaaggatgttttcataggga

SEQ ID NO: 222321 - DNA, 75 bp, Artificial Sequence
  Synthetic
cattccaaccatttgcagaatctgagatctttgaacaagctgttgtgctgttaagttccccatgtagactccaga

SEQ ID NO: 222322 - DNA, 75 bp, Artificial Sequence
  Synthetic
cattccaaccatttgcagaatctgagatctttgatcaagctgttgtgctgttaagttccccatgtagactccaga

SEQ ID NO: 222323 - DNA, 75 bp, Artificial Sequence
  Synthetic
cattccaaccatttgcagaatctgagatctttgaccaagctgttgtgctgttaagttccccatgtagactccaga

SEQ ID NO: 222324 - DNA, 75 bp, Artificial Sequence
  Synthetic
cattccaaccatttgcagaatctgagatctttgagcaagctgttgtgctgttaagttccccatgtagactccaga

SEQ ID NO: 222325 - DNA, 75 bp, Artificial Sequence
  Synthetic
cattccaaccatttgcagattctgagatctttgaacaagctgttgtgctgttaagttccccatgtagactccaga

SEQ ID NO: 222326 - DNA, 75 bp, Artificial Sequence
  Synthetic
cattccaaccatttgcagattctgagatctttgatcaagctgttgtgctgttaagttccccatgtagactccaga

SEQ ID NO: 222327 - DNA, 75 bp, Artificial Sequence
  Synthetic
cattccaaccatttgcagattctgagatctttgaccaagctgttgtgctgttaagttccccatgtagactccaga

SEQ ID NO: 222328 - DNA, 75 bp, Artificial Sequence
  Synthetic
cattccaaccatttgcagattctgagatctttgagcaagctgttgtgctgttaagttccccatgtagactccaga

SEQ ID NO: 222329 - DNA, 75 bp, Artificial Sequence
  Synthetic
cattccaaccatttgcagactctgagatctttgaacaagctgttgtgctgttaagttccccatgtagactccaga

SEQ ID NO: 222330 - DNA, 75 bp, Artificial Sequence
  Synthetic
cattccaaccatttgcagactctgagatctttgatcaagctgttgtgctgttaagttccccatgtagactccaga

SEQ ID NO: 222331 - DNA, 75 bp, Artificial Sequence
  Synthetic
cattccaaccatttgcagactctgagatctttgaccaagctgttgtgctgttaagttccccatgtagactccaga

SEQ ID NO: 222332 - DNA, 75 bp, Artificial Sequence
  Synthetic
cattccaaccatttgcagactctgagatctttgagcaagctgttgtgctgttaagttccccatgtagactccaga

SEQ ID NO: 222333 - DNA, 75 bp, Artificial Sequence
  Synthetic
cattccaaccatttgcagagtctgagatctttgaacaagctgttgtgctgttaagttccccatgtagactccaga

SEQ ID NO: 222334 - DNA, 75 bp, Artificial Sequence
  Synthetic
cattccaaccatttgcagagtctgagatctttgatcaagctgttgtgctgttaagttccccatgtagactccaga

SEQ ID NO: 222335 - DNA, 75 bp, Artificial Sequence
  Synthetic
cattccaaccatttgcagagtctgagatctttgaccaagctgttgtgctgttaagttccccatgtagactccaga

SEQ ID NO: 222336 - DNA, 75 bp, Artificial Sequence
  Synthetic
cattccaaccatttgcagagtctgagatctttgagcaagctgttgtgctgttaagttccccatgtagactccaga

SEQ ID NO: 222337 - DNA, 75 bp, Artificial Sequence
  Synthetic
tttctatccccaacttggtccgaaacaaacatgttgagctttctcttggccccaaggactgctttcaagaggtcc

SEQ ID NO: 222338 - DNA, 75 bp, Artificial Sequence
  Synthetic
agttagaggcctttcagacctcatgattttggccttcagtttttcaaggtcagctgcaagggacatcagttcttc

SEQ ID NO: 222339 - DNA, 75 bp, Artificial Sequence
  Synthetic
tcactgttgcttggcttgattaagatagactccaacatgttgcccccatctaacaaagctgctcctgcttttaca

SEQ ID NO: 222340 - DNA, 75 bp, Artificial Sequence
  Synthetic
tgcactaagcctccctacttttagaacattcttttttgatgttgactttaagtccacaagagaatacacagtttg

SEQ ID NO: 222341 - DNA, 75 bp, Artificial Sequence
  Synthetic
cgcaccggggatcctaggctttttggattgcgctttcctttggctccgtcttataggagaatgggccaactagtg

SEQ ID NO: 222342 - DNA, 75 bp, Artificial Sequence
  Synthetic
gcagcaccaagactgaaattgtagccagaaatgttgatgctagactgttgctcagttataactcccaagactggg

SEQ ID NO: 222343 - DNA, 75 bp, Artificial Sequence
  Synthetic
gaacattcttttttgatgttgactttaagtccacaagagaatacacagtttggttgaggcttctgagtctctgca

SEQ ID NO: 222344 - DNA, 75 bp, Artificial Sequence
  Synthetic
acaatgttcgaggctctgcctcacattattgatgaggtcatcaacattgtcattattgtgctcatcatcatcacg

SEQ ID NO: 222345 - DNA, 75 bp, Artificial Sequence
  Synthetic
tgcttatccttcaacctttcaaggtcacttaggtttggatatttgactgtatagagcaggccaaggtctgtaagt

SEQ ID NO: 222346 - DNA, 75 bp, Artificial Sequence
  Synthetic
agcatcaaagctgtgtacaacttcgccacctgcgggatacttgcattgatcagctttcttttcctggctggcagg

SEQ ID NO: 222347 - DNA, 75 bp, Artificial Sequence
  Synthetic
gcctgcacaacatcattgagcggagtctgtgactgtttggccatacaggccattgtcaggcttggcattgtacca

SEQ ID NO: 222348 - DNA, 75 bp, Artificial Sequence
  Synthetic
tcctgtggcatgtatggtctaagtgggcctgacatttacaagggggtttaccaattcaagtcagtggagttcgac

SEQ ID NO: 222349 - DNA, 75 bp, Artificial Sequence
  Synthetic
aattgattattcaagagtgatgagtcctttacatcccagactctcacaacaccatttgcaccctgctgaggcctt

SEQ ID NO: 222350 - DNA, 75 bp, Artificial Sequence
  Synthetic
atgtctcaccttaacctgacaatgcccaatgcatgttcggtaaacaattcccatcactacataagcatgggaact

SEQ ID NO: 222351 - DNA, 75 bp, Artificial Sequence
  Synthetic
ctcattccgaccatttgcaggatttgagacctttgatcaagttgctgtgctgtcaagttccccatgtagactcca

SEQ ID NO: 222352 - DNA, 75 bp, Artificial Sequence
  Synthetic
tctgggttggagttaacttttacaaatgactccattataacacacaatttttgcaatctgacttctgctttcaac

SEQ ID NO: 222353 - DNA, 75 bp, Artificial Sequence
  Synthetic
gaggcctgaggtctctcagatctcatgattttggcctttagtttctcaaggtcagctgcaagagacattagttcc

SEQ ID NO: 222354 - DNA, 75 bp, Artificial Sequence
  Synthetic
aagaaaacctttgaccacacacttatgagtatagtctcaagcctgcacctcagtattagaggaaacaccaactac

SEQ ID NO: 222355 - DNA, 75 bp, Artificial Sequence
  Synthetic
tctgcactgagtctccctacccttaaaacattcttctttgatgtcgatttcaaatctacaagagaatacacagtt

SEQ ID NO: 222356 - DNA, 75 bp, Artificial Sequence
  Synthetic
aaagcagtgtcctgtgattttgacaacggcattactattcaatacaatctgacactttctaatgcacaggaggct

SEQ ID NO: 222357 - DNA, 75 bp, Artificial Sequence
  Synthetic
tgattgagacttctgagtctctgtaggtctttgtcatccctcttttccttcctcatgatcctctgaacattactg

SEQ ID NO: 222358 - DNA, 75 bp, Artificial Sequence
  Synthetic
atgagccaatgtaagaccttcaggggaagagtcttggatatgttcagaactgcttttggaggaaagtacatgagg

SEQ ID NO: 222359 - DNA, 75 bp, Artificial Sequence
  Synthetic
acctcagaaaagtctaatccattaaggaggctggtcgcgtccttaatcacggcagctttcacatctgatgtgaag

SEQ ID NO: 222360 - DNA, 75 bp, Artificial Sequence
  Synthetic
agtggctggggttggacaggttcagatggcaagactacttggtgcagccagacaagctaccaatatttgatcata

SEQ ID NO: 222361 - DNA, 75 bp, Artificial Sequence
  Synthetic
ctttgcaactccctcctcaatgcctgagtccactggaaactcttgatttccttggacagagacattttgtcactc

SEQ ID NO: 222362 - DNA, 75 bp, Artificial Sequence
  Synthetic
caaaacaggacttgggaaaaccattgcagatacgcaggtcccttcggaatgtccagaatcctcttcgctcaagaa

SEQ ID NO: 222363 - DNA, 75 bp, Artificial Sequence
  Synthetic
ttggacagagacattttgtcactcaatgaatctctcagacaaatgcgcaatcaaatgcctaggatccactgtgcg

SEQ ID NO: 222364 - DNA, 75 bp, Artificial Sequence
  Synthetic
aaaacaaaatttcttactaggaggcttgcaggcacattcacttggactctgtcagactcatcgggggtggagaat

SEQ ID NO: 222365 - DNA, 75 bp, Artificial Sequence
  Synthetic
ccgggtggctattgcttgaccaactggatgattcttgctgcagagcttaagtgttttgggaacacagctgtggca

SEQ ID NO: 222366 - DNA, 75 bp, Artificial Sequence
  Synthetic
aaatgcaatgtaaatcatgatgaggagttttgtgatatgcttcgattgattgactacaacaaggctgctctgagt

SEQ ID NO: 222367 - DNA, 75 bp, Artificial Sequence
  Synthetic
cgcaccggggatcctaggctttttggattgcgctttcctttaggacaactgggtgctggattctatccagtaaaa

SEQ ID NO: 222368 - DNA, 75 bp, Artificial Sequence
  Synthetic
gattgcgctttcctttaggacaactgggtgctggattctatccagtaaaaggatgggtcagattgtgacaatgtt

SEQ ID NO: 222369 - DNA, 75 bp, Artificial Sequence
  Synthetic
aaattcaaagaagatgtggaatctgctttacacctgttcaaaacaacagtgaattctttgatttctgatcagctt

SEQ ID NO: 222370 - DNA, 75 bp, Artificial Sequence
  Synthetic
ttagacaaggacatcttgttgctcaatggtttctcaagacaaatgcgcaatcaaatgcctaggatccactgtgcg

SEQ ID NO: 222371 - DNA, 75 bp, Artificial Sequence
  Synthetic
tgaggctttgcctcacatcattgatgaggtcatcaacattgtcattattgtgctcattataatcacgagcatcaa

SEQ ID NO: 222372 - DNA, 75 bp, Artificial Sequence
  Synthetic
ctgatgaggaatcacctgagagatttgatgggggtgccatactgcaattactcaaaattttggtatctgaagcac

SEQ ID NO: 222373 - DNA, 75 bp, Artificial Sequence
  Synthetic
agctgtgtacaatttcgccacctgtgggatattagcactggtcagcttcctttttctggctggtaggtcctgtgg

SEQ ID NO: 222374 - DNA, 75 bp, Artificial Sequence
  Synthetic
gtaaagactggtgaaaccagtgttcccaagtgttggcttatcagtaatggttcttacttaaatgaaactcatttc

SEQ ID NO: 222375 - DNA, 75 bp, Artificial Sequence
  Synthetic
gggatattagcactggtcagcttcctttttctggctggtaggtcctgtggcatgtacggccttaatggtcccgat

SEQ ID NO: 222376 - DNA, 75 bp, Artificial Sequence
  Synthetic
atctataaaggggtttaccagttcaaatcagtggagtttgatatgtctcacttaaatctgacgatgcccaatgcg

SEQ ID NO: 222377 - DNA, 75 bp, Artificial Sequence
  Synthetic
agtgaccaaattgagcaggaggcagacaacatgatcacggagatgttgagaaaggactacataaaaaggcaaggg

SEQ ID NO: 222378 - DNA, 75 bp, Artificial Sequence
  Synthetic
cttaaatctgacgatgcccaatgcgtgctcagtcaacaactctcatcactacatcagtatgggaagctctggact

SEQ ID NO: 222379 - DNA, 75 bp, Artificial Sequence
  Synthetic
agtacccccttagccttgatggatctactgatgttttccacatcagcatatttggtaagcatctttctgcatctt

SEQ ID NO: 222380 - DNA, 75 bp, Artificial Sequence
  Synthetic
tgctcagtcaacaactctcatcactacatcagtatgggaagctctggactggagccaactttcaccaacgactcc

SEQ ID NO: 222381 - DNA, 75 bp, Artificial Sequence
  Synthetic
atccttaatcacaacttctgcaacttaacctccgctctcaacaaaaagtcttttgaccatacactcatgagtata

SEQ ID NO: 222382 - DNA, 75 bp, Artificial Sequence
  Synthetic
gtgaaaataccaacacacagacacataaagggcggctcatgtccaaagccacatcggttgactagtaaaggtatc

SEQ ID NO: 222383 - DNA, 75 bp, Artificial Sequence
  Synthetic
acatcggttgactagtaaaggtatctgtagttgtggtgtgtttaaggtacctggtgtgaaaaccatctggaaaag

SEQ ID NO: 222384 - DNA, 75 bp, Artificial Sequence
  Synthetic
gtctcgagtctacacctcagtatcagagggaattccaactacaaagcagtgtcttgtgattttaacaatggcatc

SEQ ID NO: 222385 - DNA, 75 bp, Artificial Sequence
  Synthetic
gagggaattccaactacaaagcagtgtcttgtgattttaacaatggcatcaccattcaatacaacttgtcatctt

SEQ ID NO: 222386 - DNA, 75 bp, Artificial Sequence
  Synthetic
gtcttgtgattttaacaatggcatcaccattcaatacaacttgtcatcttcggacccacagagcgccatgagcca

SEQ ID NO: 222387 - DNA, 75 bp, Artificial Sequence
  Synthetic
acgctgaacaacagcgcctccctgactctccacctcgaaagaggtggagagtcagggaggcccacagggtctcag

SEQ ID NO: 222388 - DNA, 75 bp, Artificial Sequence
  Synthetic
gtgtaggactttcagaggtagagtcttggacatgtttagaactgcctttggaggaaagtacatgagaagtggctg

SEQ ID NO: 222389 - DNA, 75 bp, Artificial Sequence
  Synthetic
agtgtcacaacgtttggacctctaaagattaggtcatgtggcaggatgttgtggacggttttcaggtcagggagc

SEQ ID NO: 222390 - DNA, 75 bp, Artificial Sequence
  Synthetic
ttggacatgtttagaactgcctttggaggaaagtacatgagaagtggctggggctggacaggttcagatggcaag

SEQ ID NO: 222391 - DNA, 75 bp, Artificial Sequence
  Synthetic
cttgccttagaggcgctctcaaaaatgatgcagtccatgagtgcacagtgtggggtaatctccttcttctttttg

SEQ ID NO: 222392 - DNA, 75 bp, Artificial Sequence
  Synthetic
gaggaaagtacatgagaagtggctggggctggacaggttcagatggcaagaccacttggtgcagccaaacaagct

SEQ ID NO: 222393 - DNA, 75 bp, Artificial Sequence
  Synthetic
atcagtacctaatcatacaaaacaggacttgggaaaaccactgtagatatgcaggcccttttgggatgtctagaa

SEQ ID NO: 222394 - DNA, 75 bp, Artificial Sequence
  Synthetic
tctcttactattccagtgtgcatcttgcacaaccaaccatatttgtcccaaactttgtcctcatattctcttgag

SEQ ID NO: 222395 - DNA, 75 bp, Artificial Sequence
  Synthetic
tcctctttgctcaggaaaagacaaagtttctcactaggagactttcaggcacattcacctggaccctgtcagact

SEQ ID NO: 222396 - DNA, 75 bp, Artificial Sequence
  Synthetic
gcttctttagtcatctcaacatcaataagtttaatgtctcttctattctgtgaatctagaagtttcctgatgtca

SEQ ID NO: 222397 - DNA, 75 bp, Artificial Sequence
  Synthetic
cctcaggagtagaaaatccaggtggttattgcctgaccaaatggatgatccttgctgcagagctcaaatgttttg

SEQ ID NO: 222398 - DNA, 75 bp, Artificial Sequence
  Synthetic
tcagaaccttgacagcttaaaaccattccttgtggaagagcacctatcaccgaagatgtcagcccaggttgtgca

SEQ ID NO: 222399 - DNA, 75 bp, Artificial Sequence
  Synthetic
ggaatacagctgttgcaaaatgtaatgtcaatcatgatgaagagttctgtgacatgctacgactaattgattaca

SEQ ID NO: 222400 - DNA, 75 bp, Artificial Sequence
  Synthetic
ttaaaaagatcagcaaggtccatgccatgtgagtatttggaatcctgtttgaattgcttttggtcagtgggttcc

SEQ ID NO: 222401 - DNA, 75 bp, Artificial Sequence
  Synthetic
gacatgctacgactaattgattacaacaaggctgccctgagtaagttcaagcaagatgtagagtctgccttgcat

SEQ ID NO: 222402 - DNA, 75 bp, Artificial Sequence
  Synthetic
acaaggctgccctgagtaagttcaagcaagatgtagagtctgccttgcatgtattcaaaacaacattaaattctc

SEQ ID NO: 222403 - DNA, 75 bp, Artificial Sequence
  Synthetic
ctataaaaatgtatgtactgcccattctgtggttgaaatattgctatttccactggatcattgaatctgccctca

SEQ ID NO: 222404 - DNA, 75 bp, Artificial Sequence
  Synthetic
tgatttccgatcagctgttgatgaggaatcatctaagagatctaatgggggtaccatactgtaattactcaaagt

SEQ ID NO: 222405 - DNA, 75 bp, Artificial Sequence
  Synthetic
atatcaatccatgtgggagtgttagggtcaatgcctcccatgaggtctttcagcaacattgtctgactgtagctt

SEQ ID NO: 222406 - DNA, 75 bp, Artificial Sequence
  Synthetic
gtaccatactgtaattactcaaagttctggtatctggaacatgctaagactggtgagactagtgtacccaagtgt

SEQ ID NO: 222407 - DNA, 75 bp, Artificial Sequence
  Synthetic
aagcccacttgaggtgggcctgctgctccaggcaccggtctgggtgagttggccatgggcttctcatttgtcaga

SEQ ID NO: 222408 - DNA, 75 bp, Artificial Sequence
  Synthetic
tggcttgtcactaatggctcctacttgaatgagacccattttagtgatcaaatcgaacaagaagcagataacatg

SEQ ID NO: 222409 - DNA, 75 bp, Artificial Sequence
  Synthetic
tcaattgttgtgttttcccatgctctcccaacaactgatgttctacaagctatgtatggccacccttcacctgag

SEQ ID NO: 222410 - DNA, 75 bp, Artificial Sequence
  Synthetic
atcacagagatgttgaggaaggactacataaaaagacaagggagtactcctttagccttaatggatcttttgatg

SEQ ID NO: 222411 - DNA, 75 bp, Artificial Sequence
  Synthetic
aggcagactttataaaggatgttctcgtaaggattcctgtctccaacttggtcagagacaaacatattgagcttt

SEQ ID NO: 222412 - DNA, 75 bp, Artificial Sequence
  Synthetic
tttagccttaatggatcttttgatgttttcaacatcagcatacttgatcagcatctttctgcattttgtgaggat

SEQ ID NO: 222413 - DNA, 75 bp, Artificial Sequence
  Synthetic
accaacacatagacacataaagggcggttcatgtccaaagccacatcgcttgaccaacaaggggatctgtagttg

SEQ ID NO: 222414 - DNA, 75 bp, Artificial Sequence
  Synthetic
ctcttggccccaagaactgctttcaggaggtcctcactgttgcttggcttaattaaaatggattccagcatgttg

SEQ ID NO: 222415 - DNA, 75 bp, Artificial Sequence
  Synthetic
tggtgcattcaaggtgcctggtgtaaaaactatctggaaaagacgctgatcagcagcgcctccctgactctccac

SEQ ID NO: 222416 - DNA, 75 bp, Artificial Sequence
  Synthetic
cccccatccaacagagctgcccctgcttttacagcagcaccaagactgaaattatagccagatatgttgatacta

SEQ ID NO: 222417 - DNA, 75 bp, Artificial Sequence
  Synthetic
gactgctgctcagtgatgacccctaagactggatgcttgtcttttagcctttcaaggtcactcaggttcggatat

SEQ ID NO: 222418 - DNA, 75 bp, Artificial Sequence
  Synthetic
aacattgggtcctctgaagatcaaatcatgtggcaggatgttgtgaacggtctttagatcagggagtcttgcctt

SEQ ID NO: 222419 - DNA, 75 bp, Artificial Sequence
  Synthetic
ttgactgtgtaaagcaacccaaggtctgtgagtgcttgcacaacgtcattaagtgaggtttgtgattgtttggcc

SEQ ID NO: 222420 - DNA, 75 bp, Artificial Sequence
  Synthetic
ggaagcactctcaaagatgatgcagtccatgagtgcacagtgtggggtgatttctttcttctttttgtctctcac

SEQ ID NO: 222421 - DNA, 75 bp, Artificial Sequence
  Synthetic
atacaagccattgttaggcttggcattgtgccaaactgattgttcaaaagtgatgagtccctcacatcccagact

SEQ ID NO: 222422 - DNA, 75 bp, Artificial Sequence
  Synthetic
taccccagtgtgcattttgcatagccagccatatttgtcccacactttatcttcatattctcttgaggcctcctt

SEQ ID NO: 222423 - DNA, 75 bp, Artificial Sequence
  Synthetic
ctcaccacaccacttgcaccctgctgaggtctcctcattccaaccatctgtagaatctgagatctttgatcaagc

SEQ ID NO: 222424 - DNA, 75 bp, Artificial Sequence
  Synthetic
agtcatctcaacatcaatgagttttatgtcccttctattctgtgagtccagaagctttctgatgtcatcagaacc

SEQ ID NO: 222425 - DNA, 75 bp, Artificial Sequence
  Synthetic
tgttgtgctgttaagttccccatgtaaattccagaagcttgaggcctttcagatctcatgattttagccttcagc

SEQ ID NO: 222426 - DNA, 75 bp, Artificial Sequence
  Synthetic
ttgacagctcaagaccatcccttgtgggagagcacctataactgatgaggtcagcccagcctgtgcattgaagag

SEQ ID NO: 222427 - DNA, 75 bp, Artificial Sequence
  Synthetic
agatctcatgattttagccttcagcttctcaaggtcagttgcaagggacatcagttcctctgcactaagtctccc

SEQ ID NO: 222428 - DNA, 75 bp, Artificial Sequence
  Synthetic
gtcagcaagatccatgccgtgtgaatacttggagtcctgcttgaattgcttctggtccgtaggttctctgtaaaa

SEQ ID NO: 222429 - DNA, 75 bp, Artificial Sequence
  Synthetic
cacttttaggacattcttttttgatgttgactttaggtccacaagggaatacacagtttggttgaggcttctaag

SEQ ID NO: 222430 - DNA, 75 bp, Artificial Sequence
  Synthetic
atgtatgaattgcccattttgtggttgaaatattgctatctccactggatcattgaacctgccttcaatgtcaat

SEQ ID NO: 222431 - DNA, 75 bp, Artificial Sequence
  Synthetic
cctctgcaagtctttatcatccctcctttcttttctcatgattctctgaacattactcacctcagagaaatccaa

SEQ ID NO: 222432 - DNA, 75 bp, Artificial Sequence
  Synthetic
ccatgtgggagcattgggatcaatccctcccatcaagtctttcaacagcattgtttgactgtaactcaagcccac

SEQ ID NO: 222433 - DNA, 75 bp, Artificial Sequence
  Synthetic
tccattcagcaggctggtggcatccttgatcacggcagccttcacatctgatgtgaagctctgaagttccctcct

SEQ ID NO: 222434 - DNA, 75 bp, Artificial Sequence
  Synthetic
ctgaggtgggcctgctgctccaggcactggcctagatgagttggccacaagtttttcatttgtgagatcaattgt

SEQ ID NO: 222435 - DNA, 75 bp, Artificial Sequence
  Synthetic
caatgcctgggtccactggaagcttttaacttctttggacagagacatcttgtcgcccaatggatttccaaaaca

SEQ ID NO: 222436 - DNA, 75 bp, Artificial Sequence
  Synthetic
ttggacagagacatcttgtcgcccaatggatttccaaaacaaatgcgcaatcaaatgcctaggatccactgtgcg

SEQ ID NO: 222437 - DNA, 75 bp, Artificial Sequence
  Synthetic
cgtgttctcccatgctctccccacaactgacgttctacaggctatgtatggccatccttcacctgaaagacagac

SEQ ID NO: 222438 - DNA, 75 bp, Artificial Sequence
  Synthetic
cgcaccggggatcctaggcgtttagttgcgcaggttgggcatacacccttcaaagaaacccagagtcgagaaagc

SEQ ID NO: 222439 - DNA, 75 bp, Artificial Sequence
  Synthetic
tttataaaggatgttttcataaggatttctatccccaacttgatctgagacaaacatgttgagtttcttcttggc

SEQ ID NO: 222440 - DNA, 75 bp, Artificial Sequence
  Synthetic
caacagcaagccgaactttcaaccatgggccagggcaagtcaaaggaggagacagctaacagcagtgtcggaaga

SEQ ID NO: 222441 - DNA, 75 bp, Artificial Sequence
  Synthetic
caaacatgttgagtttcttcttggccccaaggactgcttttaggagatcctcactattgcttggtttgatcaaaa

SEQ ID NO: 222442 - DNA, 75 bp, Artificial Sequence
  Synthetic
gcagaacttctaccggatgctacatatcttggacctctgaattgcaagtcatgttggcagaaggttgatagcctg

SEQ ID NO: 222443 - DNA, 75 bp, Artificial Sequence
  Synthetic
cccaaggactgcttttaggagatcctcactattgcttggtttgatcaaaatagattccagcatgttccctccatg

SEQ ID NO: 222444 - DNA, 75 bp, Artificial Sequence
  Synthetic
tagcagagctgcccccgctttcacagccgcaccaagactgaaattataaccagagatattgatactagattgctg

SEQ ID NO: 222445 - DNA, 75 bp, Artificial Sequence
  Synthetic
gttagatgccatgatcactacttatgtagacattgtctgaacctcctgctgactgtctcggacagatgcccccta

SEQ ID NO: 222446 - DNA, 75 bp, Artificial Sequence
  Synthetic
gccgcaccaagactgaaattataaccagagatattgatactagattgctgttcagtaatgacccccagaactggg

SEQ ID NO: 222447 - DNA, 75 bp, Artificial Sequence
  Synthetic
tgcaagcatgtgctacccaccaagttgaaggtctcaactgtccccagctcacctcccccctatgaagaataacaa

SEQ ID NO: 222448 - DNA, 75 bp, Artificial Sequence
  Synthetic
cagagatattgatactagattgctgttcagtaatgacccccagaactgggtgtttatcttttagcctttctaggt

SEQ ID NO: 222449 - DNA, 75 bp, Artificial Sequence
  Synthetic
cactgagattcgggtatttgactgtgtaaagtaagccaaggtctgtgagtgcctgcacaacatcattgagtgggg

SEQ ID NO: 222450 - DNA, 75 bp, Artificial Sequence
  Synthetic
cccaagacaggaacaggacagccgaaccaccgcgaagcacaccacacacaagcggaaggcaaggagacaaccccc

SEQ ID NO: 222451 - DNA, 75 bp, Artificial Sequence
  Synthetic
tctgtgactgttttgccatgcaagccattgtcaggcttggcattgtgccgaactgattgttcagaagtgatgagt

SEQ ID NO: 222452 - DNA, 75 bp, Artificial Sequence
  Synthetic
aggcacacaccaacacaggacccacacacagacaaacacacacaaacacaacaccgagcacacaacaaacaacca

SEQ ID NO: 222453 - DNA, 75 bp, Artificial Sequence
  Synthetic
ccttcacatcccaaacccttactacaccacttgcaccctgctgaggtcttctcatcccaaccatttgcagtattt

SEQ ID NO: 222454 - DNA, 75 bp, Artificial Sequence
  Synthetic
cacccacacccaacacgcgccccccgcggggcgcgcgcccccccccatgcggggggagggggaggagggagagcg

SEQ ID NO: 222455 - DNA, 75 bp, Artificial Sequence
  Synthetic
gggatctctgatcaagttgttgtgctgtcaaatttcccatgtagactccagaagcttgaggcctctcagttctca

SEQ ID NO: 222456 - DNA, 75 bp, Artificial Sequence
  Synthetic
ggggagcccccgcagcggcgccgatcagtcgatctccacaatcgttgccccggcaagccagtcttcacaggactt

SEQ ID NO: 222457 - DNA, 75 bp, Artificial Sequence
  Synthetic
taattttggccttcagcttctcaagatcagctgcaagggtcatcaattcctctgcactaagtcttcccactttca

SEQ ID NO: 222458 - DNA, 75 bp, Artificial Sequence
  Synthetic
ccccttgagcctaaacctccctccaacagtttcaaacatcactgtgttcttagtcttactataacagagttcaca

SEQ ID NO: 222459 - DNA, 75 bp, Artificial Sequence
  Synthetic
gaacatttttctttgatgtagacttcggatcaacaagagaatgcacagtctggttaagactcctgagtctctgca

SEQ ID NO: 222460 - DNA, 75 bp, Artificial Sequence
  Synthetic
gtccttaaaagagaaccagtcgggcacatgcatcatgggcaacagcaagacagaccttgacatacacaattctcg

SEQ ID NO: 222461 - DNA, 75 bp, Artificial Sequence
  Synthetic
agtctttatcgtccctcctttcctttctcatgatcctctgaacgttgctgacttcagaaaagtccaacccattta

SEQ ID NO: 222462 - DNA, 75 bp, Artificial Sequence
  Synthetic
gaggacccagtcaacctctgagctcattaaatgttcacctgttctaaacctatggagaagcaaattgctaagaac

SEQ ID NO: 222463 - DNA, 75 bp, Artificial Sequence
  Synthetic
gaagactggttgcgtccttgatgacggcagcctttacatctgatgtaaaaccctgcaactccctcctcaacgcct

SEQ ID NO: 222464 - DNA, 75 bp, Artificial Sequence
  Synthetic
atcctcaaatttctcatagccttcaagctctgccaaaaaaactcttaaatcttttgtctctaatttgacaagaat

SEQ ID NO: 222465 - DNA, 75 bp, Artificial Sequence
  Synthetic
gtgtccactgaaagcttttgacttctttggacaaagacattttgtcacacaatgaatttccaaataaaagcgcaa

SEQ ID NO: 222466 - DNA, 75 bp, Artificial Sequence
  Synthetic
gttttgaacaaacttcctcccttcataaagagcacccattttaaaggttaatggcacagggtcccactcaggccc

SEQ ID NO: 222467 - DNA, 75 bp, Artificial Sequence
  Synthetic
tttggacaaagacattttgtcacacaatgaatttccaaataaaagcgcaatcaaatgcctaggatccactgtgcg

SEQ ID NO: 222468 - DNA, 75 bp, Artificial Sequence
  Synthetic
gattgcgctttcctttaggtcaactgaggatcgagtttaccttgtggaaggatgggtcaaattgtgacgatgttt

SEQ ID NO: 222469 - DNA, 75 bp, Artificial Sequence
  Synthetic
aactctctcaaaatcaatggattttatatcatccaagatttttctagaacctactagctcaagttcaatagagtc

SEQ ID NO: 222470 - DNA, 75 bp, Artificial Sequence
  Synthetic
cgcaccggggatcctaggctttttggattgcgctttcctttaggtcaactgaggatcgagtttaccttgtggaag

SEQ ID NO: 222471 - DNA, 75 bp, Artificial Sequence
  Synthetic
gaggctttgcctcacatcatcgatgaagtgatgaatattgtcatcattgtgctcattataatcacaagcatcaaa

SEQ ID NO: 222472 - DNA, 75 bp, Artificial Sequence
  Synthetic
accaagtatcagagggtccaccatgtagtcctcgagctcatcagacctaatatcaaaaacgttattgttcacctt

SEQ ID NO: 222473 - DNA, 75 bp, Artificial Sequence
  Synthetic
gctgtgtataactttgccacttgtgggatattcacactggttagctttctccttctagctggcaggtcctgtggt

SEQ ID NO: 222474 - DNA, 75 bp, Artificial Sequence
  Synthetic
gaaagttgagtctgtccttaacaaattgagacattcatctagtaaccttctgtccacctcacccttaaaaaagtg

SEQ ID NO: 222475 - DNA, 75 bp, Artificial Sequence
  Synthetic
atgtacggccttaagggacctgacatttacaagggagtctaccaactcaagtcagtggaatttgacatgtcacat

SEQ ID NO: 222476 - DNA, 75 bp, Artificial Sequence
  Synthetic
agaacatgacaaaaatctggccacaccagggctttggagctcactcttcaccacaaggattaaagaaaacttcct

SEQ ID NO: 222477 - DNA, 75 bp, Artificial Sequence
  Synthetic
ctgaacttgacaatgcccaacgcatgctcagctaataattctcaccactacattagcatggggaaatctgggcta

SEQ ID NO: 222478 - DNA, 75 bp, Artificial Sequence
  Synthetic
cagacagtctgtgttattttggttgtgtgtaaagtccactgtaactgtgaactctaacacaccactcgtatagtt

SEQ ID NO: 222479 - DNA, 75 bp, Artificial Sequence
  Synthetic
cattagcatggggaaatctgggctagaactaaccttcaccaatgactccatcatcagtcacaaccactgtaattt

SEQ ID NO: 222480 - DNA, 75 bp, Artificial Sequence
  Synthetic
gaggagatagtcccataactctcttaatgatttaaatgcctttgaactaattagaccctgtttgaccagcaaagc

SEQ ID NO: 222481 - DNA, 75 bp, Artificial Sequence
  Synthetic
gacttctgcctttaacaagaaaacctttgatcacacacttatgagcataatttctagcctacatcttagtattag

SEQ ID NO: 222482 - DNA, 75 bp, Artificial Sequence
  Synthetic
agcattgcacatagcctcacccactcgataagaaaaccatccaaatccaaactgcaagtcatctctaaacatggg

SEQ ID NO: 222483 - DNA, 75 bp, Artificial Sequence
  Synthetic
gggaaactctaattacaaggcagtttcctgtgatttcaacaatggcatcaccatccaatacaacctgacattctc

SEQ ID NO: 222484 - DNA, 75 bp, Artificial Sequence
  Synthetic
cctctctacatttttgttcaccacttttaacacaaaggattgaaagggacctaaagcctcagcaccgtcctcaga

SEQ ID NO: 222485 - DNA, 75 bp, Artificial Sequence
  Synthetic
tgatgcacagagtgctctgagccaatgcaggaccttcaggggcagagtgctagacatgtttagaactgccttcgg

SEQ ID NO: 222486 - DNA, 75 bp, Artificial Sequence
  Synthetic
aggcatcatacctctgtgtgggaaccatgaaaaattacctagtgtcctagatgttatgacaaactctctaacaaa

SEQ ID NO: 222487 - DNA, 75 bp, Artificial Sequence
  Synthetic
gggaaagtacatgaggagtggttggggctggacaggttcagatggcaaaaccacatggtgtagtcagacaaacta

SEQ ID NO: 222488 - DNA, 75 bp, Artificial Sequence
  Synthetic
cgattcaaaatacacctgttttaagaaatttttgcaaatatcccttgtgctcacaacaaactcatctgtcaggct

SEQ ID NO: 222489 - DNA, 75 bp, Artificial Sequence
  Synthetic
tcaatacttgatcatacaaaatagaacctgggataaccactgcacgtatgcaggcccttttggaatgtctagaat

SEQ ID NO: 222490 - DNA, 75 bp, Artificial Sequence
  Synthetic
cgaatcagtccgctgatgtgacttgacaagatcagagaagaggactgtgtagtgttcatccctcttccacttcac

SEQ ID NO: 222491 - DNA, 75 bp, Artificial Sequence
  Synthetic
cctctttgcccaagagaaaacaaagtttatcactagaagacttgcaggcacattcacttggaccttgtctgattc

SEQ ID NO: 222492 - DNA, 75 bp, Artificial Sequence
  Synthetic
aacgtgtgatataagtgatagagactctgaatttatgtcaatcaacacacaaaggtcaaggaattttatccgggg

SEQ ID NO: 222493 - DNA, 75 bp, Artificial Sequence
  Synthetic
ctcaggagtagaaaatccaggtggctactgcttgacaaggtggatgattattgctgcagatctcaaatgctttgg

SEQ ID NO: 222494 - DNA, 75 bp, Artificial Sequence
  Synthetic
actccatctcatactttttgagctcaagtcagacatgaatggaagtaattgatcttcaaacaccttgggatataa

SEQ ID NO: 222495 - DNA, 75 bp, Artificial Sequence
  Synthetic
gaacacagctgttgcaaagtgcaatgtaaatcatgatgaagagttctgtgacatgttacgattaattgattacaa

SEQ ID NO: 222496 - DNA, 75 bp, Artificial Sequence
  Synthetic
ccttctcacagattggatcacatgattcaaacttaccttgtcttctaataaccttgaactttcaggctttctagc

SEQ ID NO: 222497 - DNA, 75 bp, Artificial Sequence
  Synthetic
caaagctgccttgacaaagttcaaagaagatgtggaatccgccctacacctattcaagacaacagtaaactctct

SEQ ID NO: 222498 - DNA, 75 bp, Artificial Sequence
  Synthetic
gacataatcacatgggttcaaatgttttaaaccggtgtccttgagacatttccctttcacaggttcagccaaaac

SEQ ID NO: 222499 - DNA, 75 bp, Artificial Sequence
  Synthetic
gatttccgatcagctactaatgagaaaccacctgagggatttaatgggagtgccatattgtaactactcaaagtt

SEQ ID NO: 222500 - DNA, 75 bp, Artificial Sequence
  Synthetic
ccaaacacccaactcaaatgaattactcagtgaaatacaaatgtagtcccagagaagaggtcttaaaaggcctac

SEQ ID NO: 222501 - DNA, 75 bp, Artificial Sequence
  Synthetic
ctggtatttggaacatgcgaagactggtgaaactagtgttccgaaatgttggcttgtcaccaacggctcctactt

SEQ ID NO: 222502 - DNA, 75 bp, Artificial Sequence
  Synthetic
atggtctaggtcaggctcagggtgactcagcttatcacaaatatagagtggtatttcatcctgagtttgaattct

SEQ ID NO: 222503 - DNA, 75 bp, Artificial Sequence
  Synthetic
aaatgagacccattttagcgatcagattgagcaggaagcagacaacatgattacggagatgctgagaaaagatta

SEQ ID NO: 222504 - DNA, 75 bp, Artificial Sequence
  Synthetic
tgatatgtttccatcagcagcaacatcctcaagaactctttttatatacaaattttctctattcttgtttctcac

SEQ ID NO: 222505 - DNA, 75 bp, Artificial Sequence
  Synthetic
tataaagaggcaaggaagcacccctttggctttaatggatcttttaatgttttccacatctgcatatttaatcag

SEQ ID NO: 222506 - DNA, 75 bp, Artificial Sequence
  Synthetic
acatctgcttcccaatgtcttacacaaacctatgaaaccagatgatatacaactctgaaaagctgatttatttat

SEQ ID NO: 222507 - DNA, 75 bp, Artificial Sequence
  Synthetic
catttttatgcatctcatgaagatacctacacacagacatataaaaggtggatcatgtccaaaaccgcaccgttt

SEQ ID NO: 222508 - DNA, 75 bp, Artificial Sequence
  Synthetic
agcttctgataacagcttctgtgctcctcttgtaaatttactgcagagcttgctctgaagcgtctttatcagtgt

SEQ ID NO: 222509 - DNA, 75 bp, Artificial Sequence
  Synthetic
aaccagcaaagggatttgtagttgtggtgcatttaaagttcctggtgtaaggaccgtttggaagagacgctgagc

SEQ ID NO: 222510 - DNA, 75 bp, Artificial Sequence
  Synthetic
tgggattctttcctcttggaaagtcattgtcgatgggtagatgactttctgccttaacaccattctcagcgggaa

SEQ ID NO: 222511 - DNA, 75 bp, Artificial Sequence
  Synthetic
aacagcgcctccctgactctccacctcagaagaggtggagagtcagggaggcccagcgggtctcaaagtgtcaca

SEQ ID NO: 222512 - DNA, 75 bp, Artificial Sequence
  Synthetic
catttcatttaaattcaaccagtttatatctgctatacggtttaaatcttcctcaaatttcaagacctcacctag

SEQ ID NO: 222513 - DNA, 75 bp, Artificial Sequence
  Synthetic
acatttggtcctctaaagattagatcatgtggcaagatgttgtgaatggtctttagatcagggagtcttgctttg

SEQ ID NO: 222514 - DNA, 75 bp, Artificial Sequence
  Synthetic
ctgaaggatagcttctttcttctccttattgaacaactctaaaagaaattcttcgttaaattctccattcttgag

SEQ ID NO: 222515 - DNA, 75 bp, Artificial Sequence
  Synthetic
gaggcactctcaaaaatgatgcagtccataagtgcacagtgcggggtgatctcctttttctttttgtcctttact

SEQ ID NO: 222516 - DNA, 75 bp, Artificial Sequence
  Synthetic
cttgtggtgtagtctcctgattagtttcctaaccgtttttgtctcatttgggcatagcctctcgatgagcctttg

SEQ ID NO: 222517 - DNA, 75 bp, Artificial Sequence
  Synthetic
attccagtgtgcatcttacacaaccaaccatacttgtcccatactttgtcttcatattctcttgaggcttcctta

SEQ ID NO: 222518 - DNA, 75 bp, Artificial Sequence
  Synthetic
aattcgataacctctagatccatccaaccagtccttcacatcggcatcagcatttaacaagaaggggtctaaagg

SEQ ID NO: 222519 - DNA, 75 bp, Artificial Sequence
  Synthetic
gtcatttcaacatcaatgagttttatatctctcctattctgtgaatctaggagctttctgatgtcatcggagcct

SEQ ID NO: 222520 - DNA, 75 bp, Artificial Sequence
  Synthetic
aaagtttgcgtacttcaaaagatctaatgtccttttctgtatggtgttaactagggaaaccggcacaccattagc

SEQ ID NO: 222521 - DNA, 75 bp, Artificial Sequence
  Synthetic
tgacaactcaaaaccatcccctgtgggagagcacctataactgaagaggtcagtccaggttgtgcgttgaaaagg

SEQ ID NO: 222522 - DNA, 75 bp, Artificial Sequence
  Synthetic
gacagcctgatctgcaattgtgtctattgtttcacagagttgatgtggctctttgcactttacattatgtagagc

SEQ ID NO: 222523 - DNA, 75 bp, Artificial Sequence
  Synthetic
tcagtaaggtccattccatgtgagtatttagagtcctgcttaaactgcttttgatcagtgggctctctgtaaaaa

SEQ ID NO: 222524 - DNA, 75 bp, Artificial Sequence
  Synthetic
ggcagagacaaatttagtcaacaagggaacctcctcaccccaaacataaaaccttgacttgaactctgctgcaaa

SEQ ID NO: 222525 - DNA, 75 bp, Artificial Sequence
  Synthetic
tgtatgaactgcccattttgtggttggaaaattgctatttccaccggatcattgaatctgccctctatatcaatc

SEQ ID NO: 222526 - DNA, 75 bp, Artificial Sequence
  Synthetic
tctcccaaccacacttttgggactgacgaatttgttcaacaaaccactcagatgagagtgaaactctaataagag

SEQ ID NO: 222527 - DNA, 75 bp, Artificial Sequence
  Synthetic
catgtgggggcgttagggtcgatccctcccataaggtctttcaggagcattgtctggctgtagctcagacccact

SEQ ID NO: 222528 - DNA, 75 bp, Artificial Sequence
  Synthetic
caagatttcgtctggatcagtgtcgaccatttcacttgatcttctatgaaaaagggtgatttgatcatcgctaga

SEQ ID NO: 222529 - DNA, 75 bp, Artificial Sequence
  Synthetic
tgaggtggacctgctgacccaggcactggcctgggtgagctggttgcgagcctctcattcgaaaggtcaattgtt

SEQ ID NO: 222530 - DNA, 75 bp, Artificial Sequence
  Synthetic
tgtgtacgcttccggtctttcaccaaatattacaccaatgcagtaattaataaatctttcactgattaagccata

SEQ ID NO: 222531 - DNA, 75 bp, Artificial Sequence
  Synthetic
gtattttcccatgctctccctacaattgatgttctacatgctatgtatggccatccttcacctgaaagacagact

SEQ ID NO: 222532 - DNA, 75 bp, Artificial Sequence
  Synthetic
gaaatcagatgcgttatgcaagattccctgacccatgtcaataaggctggagatgtgagatgggacaatccctgc

SEQ ID NO: 222533 - DNA, 75 bp, Artificial Sequence
  Synthetic
ttgtagaggatgttttcatatgggtttctatccccaacctgatcagagacaaacatgttgagtttctttttgacc

SEQ ID NO: 222534 - DNA, 75 bp, Artificial Sequence
  Synthetic
ttcaaaataatctctgaatatcctttctgtttcagttgtctgtgtgccgctcaaaagttttagctttgacttgac

SEQ ID NO: 222535 - DNA, 75 bp, Artificial Sequence
  Synthetic
ccaaggactgctttcaataggtcttcactgttgcttggcttgattaggatagactctagcatgtttcccccgtct

SEQ ID NO: 222536 - DNA, 75 bp, Artificial Sequence
  Synthetic
atatgacttcatcatcgcacttacaacaggaaagggaacctcaaccagcttgtgcatgtgccaggttaacagggt

SEQ ID NO: 222537 - DNA, 75 bp, Artificial Sequence
  Synthetic
agcaaagctgctcctgctttcacagcagcaccaagactgaaattgtaaccagaaatgtttatgctagactgctgc

SEQ ID NO: 222538 - DNA, 75 bp, Artificial Sequence
  Synthetic
gctgacatgatctttgccagaccgaacatattgatcatcacccaacttgagattttgcagaagcatgaggaacaa

SEQ ID NO: 222539 - DNA, 75 bp, Artificial Sequence
  Synthetic
tcagtgatgacccctaaaactgggtgcttgtcttttagcttttcaaggtcactgagatttgggtactttactgtg

SEQ ID NO: 222540 - DNA, 75 bp, Artificial Sequence
  Synthetic
aaatggacacatcatgggtccccacttactgtgatccatactataattcaggaacccttctcgcacattgatggt

SEQ ID NO: 222541 - DNA, 75 bp, Artificial Sequence
  Synthetic
taaagtaagccaagatctgtgagtgcttgcacaacgtcattgagtggggtctgtgactgtttggccatgcaagcc

SEQ ID NO: 222542 - DNA, 75 bp, Artificial Sequence
  Synthetic
cattaacagaattgcgttctcaaactccttctcgttattcaagcatgagcccgaaaagaaactggtgaatgattc

SEQ ID NO: 222543 - DNA, 75 bp, Artificial Sequence
  Synthetic
attgtcaggcttggcatggtgccaaattgattgtttaaaagtgatgaatctttcacatcccacactctcaccaca

SEQ ID NO: 222544 - DNA, 75 bp, Artificial Sequence
  Synthetic
aaaatagtcttccactaatcttgtaaacatctttgttcttaaatcaccaatatagagttctctatttcccccaac

SEQ ID NO: 222545 - DNA, 75 bp, Artificial Sequence
  Synthetic
ccagtagcaccttgttgaggcctcctcatcccaaccatgtgcaggatctgtgatctttggtcaagctgctgtgca

SEQ ID NO: 222546 - DNA, 75 bp, Artificial Sequence
  Synthetic
ttgttctttgtaggacagcgcgaatttcagccttccagaatcaggacccactgaagtgtaagaggttggagactc

SEQ ID NO: 222547 - DNA, 75 bp, Artificial Sequence
  Synthetic
gtcaagtttcccatatagactccagaagcttgaggcctttcagaccttataattttagcctttaatttttcaagg

SEQ ID NO: 222548 - DNA, 75 bp, Artificial Sequence
  Synthetic
ttctgaataaaaacataagttttttaaagctgcactcatacattttgtcaatgataaagccttgctcaaagattc

SEQ ID NO: 222549 - DNA, 75 bp, Artificial Sequence
  Synthetic
tcggctgcaagagacattagttcttctgcactgagccttcccactttgagaacattcttcttcgatgttgacttt

SEQ ID NO: 222550 - DNA, 75 bp, Artificial Sequence
  Synthetic
agaattactttccctctcgctaatcctcacctcctcctccaacctatcccagtcaaacttaaaattcaaaccttg

SEQ ID NO: 222551 - DNA, 75 bp, Artificial Sequence
  Synthetic
agatccacaagagaatacacagtttgattaagacttctgagtctctgcaggtctttgtcatccctcttctctttc

SEQ ID NO: 222552 - DNA, 75 bp, Artificial Sequence
  Synthetic
tctttgtacatgcctatactttcctgagtaggcgttcgcattcatctgtagtagaatcattttcatacatgagaa

SEQ ID NO: 222553 - DNA, 75 bp, Artificial Sequence
  Synthetic
ctcataatcctctgaacattactaacttcagagaagtccagcccattcaacagactagttgcatctttgatgaca

SEQ ID NO: 222554 - DNA, 75 bp, Artificial Sequence
  Synthetic
ccaatcgctgtcagaaaaaaactttctacataaattccttgccatttcgtctaaagcacattgatctttaactgt

SEQ ID NO: 222555 - DNA, 75 bp, Artificial Sequence
  Synthetic
gctgccttcacgtctgatgtgaagctctgcagctccctcctcagggcttgtgtccactggaagctcttaacctcc

SEQ ID NO: 222556 - DNA, 75 bp, Artificial Sequence
  Synthetic
tggtgtgaaatacaatgatgacagctctgtggaactttcaatagcttcacacaaaaatctcatgtcatcttgact

SEQ ID NO: 222557 - DNA, 75 bp, Artificial Sequence
  Synthetic
ttggacagagacatcctgttgctcaatgaatttccaagacaaatgcgcaatcaaatgcctaggatccccggtgcg

SEQ ID NO: 222558 - DNA, 75 bp, Artificial Sequence
  Synthetic
cgcaccggggatcctaggctttttggattgcgctttcctctagatcaactagctgttggactctatcctatgaga

SEQ ID NO: 222559 - DNA, 75 bp, Artificial Sequence
  Synthetic
gatgcaagatggatcgaagtcttcaacttgatggaatgatatttcagaaaggataatcttccttaagtgactcat

SEQ ID NO: 222560 - DNA, 75 bp, Artificial Sequence
  Synthetic
ggatgggtcaaattatgacaatgtttgaggccctgcctcatatcatcgatgaagtcatcaacattgtcatcattg

SEQ ID NO: 222561 - DNA, 75 bp, Artificial Sequence
  Synthetic
gctaccagacagaacagtttggagatgatgcaatcccctcaattctttaaccccttctacattccgccctccttc

SEQ ID NO: 222562 - DNA, 75 bp, Artificial Sequence
  Synthetic
tgctcatcataatcacaagcatcaaggctgtctacaatttcgccacctgtgggataatttcactgatcagtttcc

SEQ ID NO: 222563 - DNA, 75 bp, Artificial Sequence
  Synthetic
acctgccttatccttgctaaaatgtgttattgtagaatttaccctgccctccaattccttaaaaaaactggtttc

SEQ ID NO: 222564 - DNA, 75 bp, Artificial Sequence
  Synthetic
ttcttctggctggcaggtcctgtggtatgtatggtcttagtgggcctgacatctacaagggggtctatcagttca

SEQ ID NO: 222565 - DNA, 75 bp, Artificial Sequence
  Synthetic
ctcttctccctcaaagcatgtactcacagaatcacttccgttcctcattgactctgactctctggacccgacgac

SEQ ID NO: 222566 - DNA, 75 bp, Artificial Sequence
  Synthetic
agtcagtggagtttgacatgtctcacttaaacttgacaatgcccaatgcatgttcagtcaacaattcccaccatt

SEQ ID NO: 222567 - DNA, 75 bp, Artificial Sequence
  Synthetic
cagcttagaaaccagttttgacaccttgtactcataatctgagtgacttaatttaaacctctgtttccttatgaa

SEQ ID NO: 222568 - DNA, 75 bp, Artificial Sequence
  Synthetic
acatcagtatggggagctctggactggaactgaccttcacaaatgattccatcatcacacacaatttctgtaatt

SEQ ID NO: 222569 - DNA, 75 bp, Artificial Sequence
  Synthetic
cgattctgtgatctggctcacagcacttacaagtagtttgttaaagttgtactccaataatcgttctccattcaa

SEQ ID NO: 222570 - DNA, 75 bp, Artificial Sequence
  Synthetic
tgactcctgctttcaacaagaggacctttgaccacacacttatgagtatagtctcaagtttgcacctcagtataa

SEQ ID NO: 222571 - DNA, 75 bp, Artificial Sequence
  Synthetic
atgcttattcacaaccacacttttgttgcttgcaaggtccagtgctgttgcgcagccagagttggtcatgggatc

SEQ ID NO: 222572 - DNA, 75 bp, Artificial Sequence
  Synthetic
ggggaaactccaactacaaagcagtgtcttgtgattttaacaatggcatcaccattcaatacaacttgacattct

SEQ ID NO: 222573 - DNA, 75 bp, Artificial Sequence
  Synthetic
cagattactaagctttttttcccctttgaatatcaaagtcccgttattgaatgaagaaaccattaaactaaagac

SEQ ID NO: 222574 - DNA, 75 bp, Artificial Sequence
  Synthetic
cagaagcacaaagtgctctgagtcagtgtaggacctttagagggagagtcctagatatgttcagaactgcttttg

SEQ ID NO: 222575 - DNA, 75 bp, Artificial Sequence
  Synthetic
ctccaggttgacacctggggttgtctgttgacagtccacctccttgctgacgaatttcttcatctgctcataaaa

SEQ ID NO: 222576 - DNA, 75 bp, Artificial Sequence
  Synthetic
gaggaaaatacatgagaagtggctggggttggacaaactcagatggcaagactacttggtgcagccagacaagct

SEQ ID NO: 222577 - DNA, 75 bp, Artificial Sequence
  Synthetic
aacacactcttcttcaggtgtcattgcttccttggggttaacaaaaaatccaaattgtgtctttggttcaaagaa

SEQ ID NO: 222578 - DNA, 75 bp, Artificial Sequence
  Synthetic
accaatacttaatcatacaaaataggacctgggagaaccactgtagatacgcaggtccttttggaatgtctagaa

SEQ ID NO: 222579 - DNA, 75 bp, Artificial Sequence
  Synthetic
tttctcaaaacattttatttggtccgttagtctgtcgggggtctcctttgttatgagatggcacaaatatgagac

SEQ ID NO: 222580 - DNA, 75 bp, Artificial Sequence
  Synthetic
tcctctttgctcaagaaaagacaaagttcctcactagaagacttgcaggtacattcacttggactctgtcagact

SEQ ID NO: 222581 - DNA, 75 bp, Artificial Sequence
  Synthetic
atttagcataaacttaaattttgcacttaacaaaaccttctcatcaactccaaagatagtcctcatcaagtacct

SEQ ID NO: 222582 - DNA, 75 bp, Artificial Sequence
  Synthetic
cttcaggggcggagaatccaggtggctactgtttgaccaaatggatgattctcgctgctgagcttaaatgttttg

SEQ ID NO: 222583 - DNA, 75 bp, Artificial Sequence
  Synthetic
aagcaacctatataccactttctctgcaggagtgattagatcctctctcaatttatccattagtcctatacatga

SEQ ID NO: 222584 - DNA, 75 bp, Artificial Sequence
  Synthetic
gaaacacagcggttgcaaagtgcaatgtcaatcatgatgaagaattctgtgacatgttacgattgattgattata

SEQ ID NO: 222585 - DNA, 75 bp, Artificial Sequence
  Synthetic
aaaatccgacactacagccattaccaaatacctgatattttgaacctgtttttgattccttttggttgggttggt

SEQ ID NO: 222586 - DNA, 75 bp, Artificial Sequence
  Synthetic
acaaggctgccttgagtaagttcaaagaagatgttgagtctgctttgcacctattcaaaacaacagtaaactctt

SEQ ID NO: 222587 - DNA, 75 bp, Artificial Sequence
  Synthetic
gagtaggagcaacaacaaagctttcaaagcgacctcaatgtctagcaatctctctgaaagatcagggcatgacct

SEQ ID NO: 222588 - DNA, 75 bp, Artificial Sequence
  Synthetic
tgatttctgaccagttgttgatgaggaatcatttaagagatctaatgggagtaccatactgtaactactctaaat

SEQ ID NO: 222589 - DNA, 75 bp, Artificial Sequence
  Synthetic
tatccacgaaatcatagtatcagtcatgttgtgcagcacttcatccgaaaatattggcagaaaaaaccttttagg

SEQ ID NO: 222590 - DNA, 75 bp, Artificial Sequence
  Synthetic
tctggtatctggaacatgcaaagactggtgagaccagtgttcccaagtgttggcttgtcactaatggttcttatt

SEQ ID NO: 222591 - DNA, 75 bp, Artificial Sequence
  Synthetic
atctgcatagaaggagaccagatggccctccaacccttgaattgaataacatctagaggactcccctgtcttctg

SEQ ID NO: 222592 - DNA, 75 bp, Artificial Sequence
  Synthetic
tgaatgagacccactttagtgatcaaatcgagcaggaagcagacaatatgatcacagaaatgctgagaaaggact

SEQ ID NO: 222593 - DNA, 75 bp, Artificial Sequence
  Synthetic
atacaatagatgatactcttctgtgtctaatttaatcacttgacagaaaacctctttacattccaccacttggta

SEQ ID NO: 222594 - DNA, 75 bp, Artificial Sequence
  Synthetic
acataaagagacaagggagcacccccttagcattaatggacctcttactgttttctacatcggcatatctgatca

SEQ ID NO: 222595 - DNA, 75 bp, Artificial Sequence
  Synthetic
tctaacagatcctatctgattctgtctcaatctagcaactgagctggtcttcatactatttgttagagccaagca

SEQ ID NO: 222596 - DNA, 75 bp, Artificial Sequence
  Synthetic
gtatctttctacatcttgtgaagataccgacacacaggcacatcaagggcggctcatgcccaaagccacaccgtt

SEQ ID NO: 222597 - DNA, 75 bp, Artificial Sequence
  Synthetic
aacagaagacaacctttttaagctttgaatatccctcaaagcttttggattagggcgaaaggtgtagtcctcaaa

SEQ ID NO: 222598 - DNA, 75 bp, Artificial Sequence
  Synthetic
taaacaacaagggtatctgtagttgtggtgcattcaaggtgcctggtgtgaaaactgtttggaagagacgctgag

SEQ ID NO: 222599 - DNA, 75 bp, Artificial Sequence
  Synthetic
ttttgtgtagtacatgagagggtggtgcccagttttcacaaactcttcaaattctgtcaatgtaacaaaacattc

SEQ ID NO: 222600 - DNA, 75 bp, Artificial Sequence
  Synthetic
ctgcagcgcctccctgactctccacctcgacagaggtggagagtcagggaggcccagagggtcttagagtgtcac

SEQ ID NO: 222601 - DNA, 75 bp, Artificial Sequence
  Synthetic
actcttaagatcctcagataacccgtaacaaccaaaattgaggccaactactgatagacactttctaattttggt

SEQ ID NO: 222602 - DNA, 75 bp, Artificial Sequence
  Synthetic
aacatttgggcctctgaagatcaggtcatgtggtaggatgttgtgaatggttttcaggtcagggagccttgcttt

SEQ ID NO: 222603 - DNA, 75 bp, Artificial Sequence
  Synthetic
gacaaactcctttatggacaattcaaacaacccacttaaagacaatttcttaagggccttagatttcttcctatt

SEQ ID NO: 222604 - DNA, 75 bp, Artificial Sequence
  Synthetic
ggaagcactctcaaaaatgatgcaatccataagtgcacaatgcggggtgatctctttcttctttttgtcctttac

SEQ ID NO: 222605 - DNA, 75 bp, Artificial Sequence
  Synthetic
tttcagaagcctgatgaattcttccttagtgctgtgaaagctcactaatctgtcattcacactgctgtagcagca

SEQ ID NO: 222606 - DNA, 75 bp, Artificial Sequence
  Synthetic
tattccagtgtgcattttgcacagccagccatatttatcccacactttgtcctcatattctcttgaagcttcctt

SEQ ID NO: 222607 - DNA, 75 bp, Artificial Sequence
  Synthetic
gccaacccagtgcttatcattatgtgaccctttaaggttcaattgcttaattaaagcagagaggcataagacatc

SEQ ID NO: 222608 - DNA, 75 bp, Artificial Sequence
  Synthetic
agtcatttcaacatcgatgagcttaatgtctcttctattctgtgaatctaaaagctttctgatgtcatcagaacc

SEQ ID NO: 222609 - DNA, 75 bp, Artificial Sequence
  Synthetic
cagattcaacagctgtcttctccttgtgttcaacaatttcaaactcttgaccttgttcaacattgagagaagtct

SEQ ID NO: 222610 - DNA, 75 bp, Artificial Sequence
  Synthetic
ttggcagctcaagaccattccttgtgggagggcacctatgactgatgatgtcagcccaggctgcgcattgaagag

SEQ ID NO: 222611 - DNA, 75 bp, Artificial Sequence
  Synthetic
ttcatattcagtactagcctcaattttccgtttgtgacctttagtgtctgctgtgatgaacttcatcaaagggca

SEQ ID NO: 222612 - DNA, 75 bp, Artificial Sequence
  Synthetic
gtcagcaaggtccatgccatgtgagtacttggaatcctgtttgaactgcttctggtcagtgggttctctataaaa

SEQ ID NO: 222613 - DNA, 75 bp, Artificial Sequence
  Synthetic
ggactcaactgcatccttggccagtgttgatatatcgtcatcatcatcagtagcaccgtagagctgggaaaattc

SEQ ID NO: 222614 - DNA, 75 bp, Artificial Sequence
  Synthetic
atgtatgaactgcccattctgtggctgaaatattgctatctccactggatcattgaacctgccctcaatgtcaat

SEQ ID NO: 222615 - DNA, 75 bp, Artificial Sequence
  Synthetic
ttttatcaggtctttagaatcaatcttccgaagagtccttttcaacttccttgattccaagtccctcctgaacct

SEQ ID NO: 222616 - DNA, 75 bp, Artificial Sequence
  Synthetic
ccatgtgggggcattggggtcaatccctcccatgagatccttcagtaacattgtctgactgtagctcaggcccac

SEQ ID NO: 222617 - DNA, 75 bp, Artificial Sequence
  Synthetic
gctgtaaagagaatttatgccaagcaccacatcatcgcaactcatatcgggctttactccatcatggcacatttt

SEQ ID NO: 222618 - DNA, 75 bp, Artificial Sequence
  Synthetic
ttgaggtgggcccgctgctcctggcactggtctgggtgaattagcaacaggcttttcatttgtaagatcaattgt

SEQ ID NO: 222619 - DNA, 75 bp, Artificial Sequence
  Synthetic
catgatttcatcattatgacgtgaccttgcatccttcagaatcttcatggaatccatcccggaacgcttatccac

SEQ ID NO: 222620 - DNA, 75 bp, Artificial Sequence
  Synthetic
tgtattttcccatgctctccccacaattgatgttctacaagctatgtatggccacccttcacctgacaggcaaac

SEQ ID NO: 222621 - DNA, 75 bp, Artificial Sequence
  Synthetic
tgtggttttgagtgattcacagagtctgaaatactcggactcttcgaagaccttttcatcttggctggcatactc

SEQ ID NO: 222622 - DNA, 75 bp, Artificial Sequence
  Synthetic
tttgtagagaatgttttcataagggtttctgtccccaacctggtccgagacaaacatattgagcttccttttggc

SEQ ID NO: 222623 - DNA, 75 bp, Artificial Sequence
  Synthetic
tagcagcttgaacaacaagtccctgaacttgaagttcacccattctggcatgaaactattatcataatcacagcg

SEQ ID NO: 222624 - DNA, 75 bp, Artificial Sequence
  Synthetic
cccaaggactgctttcagaagatcctcgctgttacttggcttaatcaagatagactccaacatattacccccatc

SEQ ID NO: 222625 - DNA, 75 bp, Artificial Sequence
  Synthetic
gccatctacaatggggactagtgtgatgccagccacagcaaggtcctctttgatgcttgacaatttgttggtgtc

SEQ ID NO: 222626 - DNA, 75 bp, Artificial Sequence
  Synthetic
caacaaggctgctcctgctttcacagcagcaccaagactaaagttatagccggagatgttgatgttggactgttg

SEQ ID NO: 222627 - DNA, 75 bp, Artificial Sequence
  Synthetic
ttctataaacttcttttcaaaactagctggagtgcttctaacaaaacactcaagaagaatgagggagttgtcaat

SEQ ID NO: 222628 - DNA, 75 bp, Artificial Sequence
  Synthetic
ttctgtaatgactcccaaaactgggtgcttatcttttaacttttcaagatcattcagatttggatacttgactgt

SEQ ID NO: 222629 - DNA, 75 bp, Artificial Sequence
  Synthetic
gagtttgtatccatcagggatgattaggggcaacccaggacacacaatgcctgactctatcaggatggcctcgac

SEQ ID NO: 222630 - DNA, 75 bp, Artificial Sequence
  Synthetic
gtaaagcaggccaaggtctgtgagtgcctgtacaacatcattgagtggagtctgtgactgtttggccatacaagc

SEQ ID NO: 222631 - DNA, 75 bp, Artificial Sequence
  Synthetic
agatttgtcatcgtagttgtgtgtgcagccactcttgtcagcactgtctatctcgatacaacgtgatagtagttt

SEQ ID NO: 222632 - DNA, 75 bp, Artificial Sequence
  Synthetic
cattgtcagacttggcattgtgccaaactggttattcagaagtgatgagtccttcacatcccaaaccctcactac

SEQ ID NO: 222633 - DNA, 75 bp, Artificial Sequence
  Synthetic
cagtccttcaattagcaccatcctcggctctctctgccccaaaaaatttaatttttgccttgacagcctctcatc

SEQ ID NO: 222634 - DNA, 75 bp, Artificial Sequence
  Synthetic
accatttgcgccctgctggggtctcctcatcccaaccatctgtaagatttgagatctttgatcaagctgttgtgc

SEQ ID NO: 222635 - DNA, 75 bp, Artificial Sequence
  Synthetic
ctgatctatgtagtttagacaaagctccctcaattctgagattaactcatccattgcgcatcaaaaagcctagga

SEQ ID NO: 222636 - DNA, 75 bp, Artificial Sequence
  Synthetic
agtttagacaaagctccctcaattctgagattaactcatccattgcgcatcaaaaagcctaggatcctcggtgcg

SEQ ID NO: 222637 - DNA, 75 bp, Artificial Sequence
  Synthetic
tgtcaaatttcccatgtagactccagaggcctgaggcctctcagatctcatgattttagctttcaacttctcaag

SEQ ID NO: 222638 - DNA, 75 bp, Artificial Sequence
  Synthetic
ggatcctaggctttttggattgcgctttcctctgattggagagtgtggtgcatccatgggccagcttgtgacaat

SEQ ID NO: 222639 - DNA, 75 bp, Artificial Sequence
  Synthetic
gtcggctgcaagagacataagttcttctgcactaagtctccccactttaagaacattctttttcgatgtcgactt

SEQ ID NO: 222640 - DNA, 75 bp, Artificial Sequence
  Synthetic
gtttgaggctttgcctcatgtgatcgacgaagccatcaatattgtgatggttgcgctcatcattgtcactagtat

SEQ ID NO: 222641 - DNA, 75 bp, Artificial Sequence
  Synthetic
catatccacaagagaatacacagtttggttgagacttctaagcctctgcaagtctttgtcatccctcctttcctt

SEQ ID NO: 222642 - DNA, 75 bp, Artificial Sequence
  Synthetic
aaaggctgtttacaactttgccacttgtggcattattgcactagtgggcttccttttcttggctggcagatcctg

SEQ ID NO: 222643 - DNA, 75 bp, Artificial Sequence
  Synthetic
cctcataatcctctgaacattgctgacctcagagaagtctaacccattaagaaggctagttgcatccttgatcac

SEQ ID NO: 222644 - DNA, 75 bp, Artificial Sequence
  Synthetic
tggatcaagcgttcattcaaatccccacttgtacaaagggatttaccaattcaagtccttggaattcaatttatc

SEQ ID NO: 222645 - DNA, 75 bp, Artificial Sequence
  Synthetic
agcagccttcacatctgatgtgaagctctgcaactctctcctcaacgcctgtgtccattgaaagcttttgacttc

SEQ ID NO: 222646 - DNA, 75 bp, Artificial Sequence
  Synthetic
acatctaaatctgacaatgcccaacgcatgctcccttaacaactcccatcattacatcagtatgggcagaactgg

SEQ ID NO: 222647 - DNA, 75 bp, Artificial Sequence
  Synthetic
tttggacagagacatcttgtcactcaatgatacccaagacaaatacgcaatcaaatgcctaggatccactgtgcg

SEQ ID NO: 222648 - DNA, 75 bp, Artificial Sequence
  Synthetic
cgcaccggggatcctaggcgtttagttgcgctatttagttgcacaacctttctttgtgaggctattagagacaga

SEQ ID NO: 222649 - DNA, 75 bp, Artificial Sequence
  Synthetic
cttggaactaactttcacaaatgactcaatactcaaccacaatttctgtaacctgactgatgccttcaagaagag

SEQ ID NO: 222650 - DNA, 75 bp, Artificial Sequence
  Synthetic
caccttcgaccacacactcatgagtataataggaagtttacatctcagtgtcaggggtcacactgactacagggc

SEQ ID NO: 222651 - DNA, 75 bp, Artificial Sequence
  Synthetic
cagcactatcaattatgggccagggcaaatccaaggagaagagagacaccagtgatgccaatagagctgagattc

SEQ ID NO: 222652 - DNA, 75 bp, Artificial Sequence
  Synthetic
tgtgtcatgtgatttcaacagtggcattactatacagtacaatttgagtctccacacaatggaggatgccatcaa

SEQ ID NO: 222653 - DNA, 75 bp, Artificial Sequence
  Synthetic
taccagacaccacctatcttggaccgctaaactgcaagtcatgctggcaaaagtttgacagcttggtcagatgcc

SEQ ID NO: 222654 - DNA, 75 bp, Artificial Sequence
  Synthetic
tcagtgtagaacttttaagggtagagtccttgatatgttcagaacagcctttggagggaagtacatgaggagcgg

SEQ ID NO: 222655 - DNA, 75 bp, Artificial Sequence
  Synthetic
atgaccactacctgtgcagaaattgtctgaatctcctgctatcggtctctgatagatgtcccctctgcaaacatc

SEQ ID NO: 222656 - DNA, 75 bp, Artificial Sequence
  Synthetic
cgtgggttggacagatgcacagggtaagacaacatggtgcagccagacagactataattatcttatcatacagaa

SEQ ID NO: 222657 - DNA, 75 bp, Artificial Sequence
  Synthetic
cactgccaactaaattaagggtatcaacagtcccaagttcgccacctccctacgaggagtgacgcccccacaccc

SEQ ID NO: 222658 - DNA, 75 bp, Artificial Sequence
  Synthetic
caggacgtgggagaatcactgtgagtatgcaggcccttttggaatctccagaatccttctctcccaagaaaaaac

SEQ ID NO: 222659 - DNA, 75 bp, Artificial Sequence
  Synthetic
acatcggcagtccaacaaaggaaggacacacacaagccagcacacacagacacagcatccaacacaaaacacaca

SEQ ID NO: 222660 - DNA, 75 bp, Artificial Sequence
  Synthetic
aaaatttctgacaaggagacttgcggggacatttacttggactctgacagactcttcaggggaagacactccagg

SEQ ID NO: 222661 - DNA, 75 bp, Artificial Sequence
  Synthetic
cacacacgcacacacacacactcccacacccacgcgccccccacccctcggggggcgcgccccccgggggggggc

SEQ ID NO: 222662 - DNA, 75 bp, Artificial Sequence
  Synthetic
aggctattgcctcaccaagtggatgctggttgctgcagatatgaaatgctttggcaacacagcagttgcaaaatg

SEQ ID NO: 222663 - DNA, 75 bp, Artificial Sequence
  Synthetic
ggccccccggaggcccgggcagagccgcacggagacgtcgatcagtcgatctcctcagccatcaacccagtcagc

SEQ ID NO: 222664 - DNA, 75 bp, Artificial Sequence
  Synthetic
caatctcaaccatgatgaagaattttgtgacatgctaaggctgatagattataataaagctgcattacataaatt

SEQ ID NO: 222665 - DNA, 75 bp, Artificial Sequence
  Synthetic
cagtcgtcgcaggacttacccttgagtctgaacctgcccccaactgtttcatacatcactgtgttctttgactta

SEQ ID NO: 222666 - DNA, 75 bp, Artificial Sequence
  Synthetic
taaggaagatgtcgagtctgccttgcatcttttcaagatcacagtgaattcattgatctctgatcagcttttaat

SEQ ID NO: 222667 - DNA, 75 bp, Artificial Sequence
  Synthetic
ctgtaacagagtctacaatctttaaaggtgaaccaatctggcacaaatgacaatggcatcaataagacggatcta

SEQ ID NO: 222668 - DNA, 75 bp, Artificial Sequence
  Synthetic
gaggaatcatttaagagatttgatgggagtaccttactgtaactattcaaaattttggtacctagaacatagcag

SEQ ID NO: 222669 - DNA, 75 bp, Artificial Sequence
  Synthetic
tccatgcgcaactcctgaaggatcgtacttatctctgatcccatcaaatgctcaccagtcctgaatcgatgcaaa

SEQ ID NO: 222670 - DNA, 75 bp, Artificial Sequence
  Synthetic
gacaggtgagtctagcacccctaaatgttggcttgtttcaaccgggtcctatctgaatgagactcattttagtga

SEQ ID NO: 222671 - DNA, 75 bp, Artificial Sequence
  Synthetic
agaaggctgccgaggatgtcactaatcctatcataaccttcaagttccgccaaaaagaccctcatatctttagtt

SEQ ID NO: 222672 - DNA, 75 bp, Artificial Sequence
  Synthetic
tcaaatcgagcaagaagcagataatatgattacagaaatgcttaggaaagattatctcaaaaggcagggaagcac

SEQ ID NO: 222673 - DNA, 75 bp, Artificial Sequence
  Synthetic
tccaacttcacaagaatgttttgaacaaagtttctcccttcaaagagagcacccattctcacagtcagaggcaca

SEQ ID NO: 222674 - DNA, 75 bp, Artificial Sequence
  Synthetic
ccccttagcactagtggacatcttgatgttcaccacgtcagcctatctggtcagcattttcttgcatttgatcag

SEQ ID NO: 222675 - DNA, 75 bp, Artificial Sequence
  Synthetic
ggttcccattcaggtccgactctttcaaaatcaagggatttgattccatcgagtatcttcctagagcctatcagc

SEQ ID NO: 222676 - DNA, 75 bp, Artificial Sequence
  Synthetic
aatccccacacacagacatataaaggggggttcatgcccaaaaccacacaggctgaccggcatgggtgtctgtag

SEQ ID NO: 222677 - DNA, 75 bp, Artificial Sequence
  Synthetic
tcaagctcaagggagtcaccgagtattaaggggtcttccatataatcttcaaactcctgagatctgatgtcaaaa

SEQ ID NO: 222678 - DNA, 75 bp, Artificial Sequence
  Synthetic
ctgtggtgcatttaatgtaccaggtgtaaagacggtgtggaagagacgctgagtggcagcgcctccctgactccc

SEQ ID NO: 222679 - DNA, 75 bp, Artificial Sequence
  Synthetic
acaccattattagttctgaaaatagggtctgttcttaataagttgagacactcatccaacaatctcctgtctact

SEQ ID NO: 222680 - DNA, 75 bp, Artificial Sequence
  Synthetic
catctcaagagagatggggagtcagggaggccctgtgagggtcttagagtgtcacagtgtttgggcctctaaaga

SEQ ID NO: 222681 - DNA, 75 bp, Artificial Sequence
  Synthetic
tcacctttgaagaggtgagagcatgacaaaaactcagctacacctaaactctgtaattggcattttattaaaagg

SEQ ID NO: 222682 - DNA, 75 bp, Artificial Sequence
  Synthetic
tgaggtcgtgtggcaggatgttgtggatggcctttagctctggtagccttgcctttgaggcactctcaaaaatga

SEQ ID NO: 222683 - DNA, 75 bp, Artificial Sequence
  Synthetic
atcaatgaaaatttccttaggcagtcagtgttattttggttgtgtgtgaagtccactgtgattgaaaactccaac

SEQ ID NO: 222684 - DNA, 75 bp, Artificial Sequence
  Synthetic
tgcagtccataagagcacagtgtggggtgatttccttcttttttttgtccctcactattcctgtgtgcatcttac

SEQ ID NO: 222685 - DNA, 75 bp, Artificial Sequence
  Synthetic
actccttttgtgtaattgagcatatagtcccacaggtctctcacagatttaaataatcttggatttgtcagacct

SEQ ID NO: 222686 - DNA, 75 bp, Artificial Sequence
  Synthetic
acagccaaccatacttgtcccaaaccttgtcttcgtattccctggaggcctccttgctcatctcaatgtctatta

SEQ ID NO: 222687 - DNA, 75 bp, Artificial Sequence
  Synthetic
tgcttaactaacatggcagcgttacacactatatctcccattcggtaagagaaccacccaaaaccgaactgcaaa

SEQ ID NO: 222688 - DNA, 75 bp, Artificial Sequence
  Synthetic
atttaatatctctcctgttttgagactcaaggagctttttgatgtcatctgacccctgacagctgaggaccatac

SEQ ID NO: 222689 - DNA, 75 bp, Artificial Sequence
  Synthetic
tcattcctaaacataggcctctctatatttttattcaccacttttaaaacaaatgattggaaaggccccaatgct

SEQ ID NO: 222690 - DNA, 75 bp, Artificial Sequence
  Synthetic
cttgagggagagcgccgattacagaagaggttagtcccggctgaacgttaaaaaggtcagtaaggtccatcccat

SEQ ID NO: 222691 - DNA, 75 bp, Artificial Sequence
  Synthetic
tcagcgccatcttcagatggcatcatgtctttatgagggaaccacgagaaacttcctaaagttctagtcgttgca

SEQ ID NO: 222692 - DNA, 75 bp, Artificial Sequence
  Synthetic
gtgaatgttttgcgtcctgtttgaactgcttctggtccgttggttctctgtaaaaatgaatgtattgcccagtct

SEQ ID NO: 222693 - DNA, 75 bp, Artificial Sequence
  Synthetic
acaaattctcgcacaaatgattcaaaatacacctgtttcaaaaagtttttacaaacatcccttgtgctaacaaca

SEQ ID NO: 222694 - DNA, 75 bp, Artificial Sequence
  Synthetic
ctggttggaatatggcaacctccacaggatcattatacctgccttcaatgtcaatccatgtgggagcattaggat

SEQ ID NO: 222695 - DNA, 75 bp, Artificial Sequence
  Synthetic
aattcatcaaccagacttgaatcagaccgttgatgggaattggtgagttcagaaaataggacagtataatgctca

SEQ ID NO: 222696 - DNA, 75 bp, Artificial Sequence
  Synthetic
aggatcattatacctgccttcaatgtcaatccatgtgggagcattaggatcaatcccgttcatcaaatccttcag

SEQ ID NO: 222697 - DNA, 75 bp, Artificial Sequence
  Synthetic
tccctcttccacttaacaacatgagaaatgagcgataaggactctgagttaatgtcaatcaatacacaaaggtca

SEQ ID NO: 222698 - DNA, 75 bp, Artificial Sequence
  Synthetic
aggaatttgatcctgggactccacctcatattttttgagctcatatcagacatgaatggaagtagctggtcctcg

SEQ ID NO: 222699 - DNA, 75 bp, Artificial Sequence
  Synthetic
tgccggcctgttgtcagataagtcaatgatggtgttttcccatgctctccccactatggatgtcctacatgcgat

SEQ ID NO: 222700 - DNA, 75 bp, Artificial Sequence
  Synthetic
aagattttggggtacaatctcctcacagattgaatcacatggttcaaacttattttgtcctccagcagtctggag

SEQ ID NO: 222701 - DNA, 75 bp, Artificial Sequence
  Synthetic
gtagggccacccttcacctgaaagacacaccttgtataaaatattttcatatgggtttctatccccaacttggtc

SEQ ID NO: 222702 - DNA, 75 bp, Artificial Sequence
  Synthetic
ctttcaggtttccttgctacataatcacatgggttaagatgcctaagacttgaagttttatcactcttccctttc

SEQ ID NO: 222703 - DNA, 75 bp, Artificial Sequence
  Synthetic
agatacaaacatattcatttttctccttgcattaagaacggctttcaaaaggtcctcagaattgctaggcttgat

SEQ ID NO: 222704 - DNA, 75 bp, Artificial Sequence
  Synthetic
acaggttctgccaagacccaaacacccaattcaaaagaattgctcagtgagatgcaaatatagtcccagagaagg

SEQ ID NO: 222705 - DNA, 75 bp, Artificial Sequence
  Synthetic
aaaaattgactccagcatattgcctccgtccaacagtgatgctccagctttcacagcagcactcagactaaagtt

SEQ ID NO: 222706 - DNA, 75 bp, Artificial Sequence
  Synthetic
ggccttaggaaattgacatgatcacggtgagcttctgggtgagtctgtttatcacacatatataacattatgcca

SEQ ID NO: 222707 - DNA, 75 bp, Artificial Sequence
  Synthetic
gtacccagagatgttgatactggattgctgttctgttattgtgttgagaactgggtgtttgtctttcaggctctc

SEQ ID NO: 222708 - DNA, 75 bp, Artificial Sequence
  Synthetic
ccatttttatgaagttttgtcacatgctcatccacagctaggtcctcaagcactttcctgatatacaggttttcc

SEQ ID NO: 222709 - DNA, 75 bp, Artificial Sequence
  Synthetic
aagatcatttaaatttggatacttaactgtgtaaagcaaccccaagtctgttaatgcttgaactacatcattaag

SEQ ID NO: 222710 - DNA, 75 bp, Artificial Sequence
  Synthetic
ctgtttttgtttctcacacatctacttcccagagtcttgcaaagacctataaagccagatgagacacaactctga

SEQ ID NO: 222711 - DNA, 75 bp, Artificial Sequence
  Synthetic
gggagtttgcgactgtttagccatgcatgccatagttaagctgggcattgtgccaaattggttgttcaaaagaga

SEQ ID NO: 222712 - DNA, 75 bp, Artificial Sequence
  Synthetic
aaggctgacttattgattgcctctgatagtaacttctgtgcaccccttgtgaacttgctacaaagcttattttgg

SEQ ID NO: 222713 - DNA, 75 bp, Artificial Sequence
  Synthetic
tgagtctttcacatcccagactctcacgacaccattgttcccctgttggggtctcctcatcccaaccatttgtag

SEQ ID NO: 222714 - DNA, 75 bp, Artificial Sequence
  Synthetic
agcgttttaatcaatgaagggatcctttcttcttgaaaagtcatcactgatggataaaccactttttgcctcaaa

SEQ ID NO: 222715 - DNA, 75 bp, Artificial Sequence
  Synthetic
aatctgggatctctgatcaagttgttgtgcagttaggttgcccatatagattccggaagcctgtggcctctcaga

SEQ ID NO: 222716 - DNA, 75 bp, Artificial Sequence
  Synthetic
accattcttaatgggaacatctcatttaagttcaaccagttgatgtttgctaattgatttagatcttctcccaga

SEQ ID NO: 222717 - DNA, 75 bp, Artificial Sequence
  Synthetic
cctcattattttagcctttaatttttccagatcagctgcaagaatcatcaattcgtctgcactgagtcttcctac

SEQ ID NO: 222718 - DNA, 75 bp, Artificial Sequence
  Synthetic
ccaaggatatctcctagttgaaggattgcctctttcttatctctattgaaaaggtctaggaaaaattcttcgttg

SEQ ID NO: 222719 - DNA, 75 bp, Artificial Sequence
  Synthetic
ctttaatacattcttctttgatgttgattttaactccacaagagaatgtacagtttggttgaggctccttagtct

SEQ ID NO: 222720 - DNA, 75 bp, Artificial Sequence
  Synthetic
aattcaccattcttgagtttatgatgaagcttcctcacaagctttcttatgacctttgtttcactaggacacaat

SEQ ID NO: 222721 - DNA, 75 bp, Artificial Sequence
  Synthetic
ctgtaagtctttgtcatcccttttgtccttcctcatgattctctggacattactcacctcagaaaaatcaagtcc

SEQ ID NO: 222722 - DNA, 75 bp, Artificial Sequence
  Synthetic
tcttcaataattctctggatcctatatcctctggagccatctagccaatccttcacatcactattgatgttcaat

SEQ ID NO: 222723 - DNA, 75 bp, Artificial Sequence
  Synthetic
attcaaaaggctggttgcatccttgatgacagcagcctttgtgttcaaggtaaagctctgcagttcccttctcaa

SEQ ID NO: 222724 - DNA, 75 bp, Artificial Sequence
  Synthetic
agaaatgggtttaaagggaagttggcatattttaaaagatctagtgtcctcttctggatacagtttactaaagaa

SEQ ID NO: 222725 - DNA, 75 bp, Artificial Sequence
  Synthetic
tgtctgcgtccactgaaagctcttgacttccttggacagggacatcctgtggggaagcactggcacccagacaaa

SEQ ID NO: 222726 - DNA, 75 bp, Artificial Sequence
  Synthetic
cagggacatcctgtggggaagcactggcacccagacaaaagcgcaatcaaatgcctaggatccactgtgcgggat

SEQ ID NO: 222727 - DNA, 75 bp, Artificial Sequence
  Synthetic
actgggacaccattcgcaacagcttgatcggcgattgtgtctattgtctcgcaaagctgatgcggttccttgcac

SEQ ID NO: 222728 - DNA, 75 bp, Artificial Sequence
  Synthetic
cgcaccggggatcctaggcttattggattgcgctttcctttagatcaactgagtgtcatcctccattcagtagag

SEQ ID NO: 222729 - DNA, 75 bp, Artificial Sequence
  Synthetic
ttaacgttatgtagcgctgcagaaacaaactttgtgaggagaggaacttcctccccccacacataaaatctagat

SEQ ID NO: 222730 - DNA, 75 bp, Artificial Sequence
  Synthetic
aaatgggtcaaattgtgacaatgtttgaggctttacctcatataatcgatgaggtgatcaacattgtcatcattg

SEQ ID NO: 222731 - DNA, 75 bp, Artificial Sequence
  Synthetic
ttgaactctgcggcaaaccgtccaaccacacttttaggactgatgaacttgtttaataacccactcaagtgagaa

SEQ ID NO: 222732 - DNA, 75 bp, Artificial Sequence
  Synthetic
tgctcattataataacgagcatcaaggcagtgtacaattttgccacttgcggggtactttcactgctcagcttcc

SEQ ID NO: 222733 - DNA, 75 bp, Artificial Sequence
  Synthetic
tgaaattctagtaagacaagaacttcttcagggtcactatcaaccaattcgcttaatctcctatcaaataaggtg

SEQ ID NO: 222734 - DNA, 75 bp, Artificial Sequence
  Synthetic
tcattctggctggtaggtcctgtgccttgtatggtctcagtgggcctgacatttacaaaggggtttatcaattca

SEQ ID NO: 222735 - DNA, 75 bp, Artificial Sequence
  Synthetic
atttgatcatcacttgatgtgtaagcttctggcctctcaccaaagatgacaccaatacaatagttgatgaacctt

SEQ ID NO: 222736 - DNA, 75 bp, Artificial Sequence
  Synthetic
aatcagtggaatttgacatgtctcacttgaacctaacaatgcccaatgcatgttcagttaacaactcccaccatt

SEQ ID NO: 222737 - DNA, 75 bp, Artificial Sequence
  Synthetic
tcactaattaagccataaaaatctgaagcattgtgcaatattccttgtcccatgtcaatgagactagatatgtgg

SEQ ID NO: 222738 - DNA, 75 bp, Artificial Sequence
  Synthetic
acatcagtatggggaattctggattggaactaaccttcaccaatgactccattattactcacaatcattgtaact

SEQ ID NO: 222739 - DNA, 75 bp, Artificial Sequence
  Synthetic
gatggtactattcccatttgaaagtattctctaaagatcctttcagtaacagttgtttctgagcccttgagaagc

SEQ ID NO: 222740 - DNA, 75 bp, Artificial Sequence
  Synthetic
tgacctctgccttcaacaagaaaacctttgatcacacactcatgagcatagtttcgagcttgcacctcagcatca

SEQ ID NO: 222741 - DNA, 75 bp, Artificial Sequence
  Synthetic
ttcagctttgacttgacatatgatttcatcattgcactcacaacagggaaggggacctcaacaagtttatgcatg

SEQ ID NO: 222742 - DNA, 75 bp, Artificial Sequence
  Synthetic
gaggaaactccaactataaggcagtgtcctgtgacttcaataatggcatcaccattcaatataatctcacattct

SEQ ID NO: 222743 - DNA, 75 bp, Artificial Sequence
  Synthetic
tgccaagttaataaagtgctgacatgatccttcccagaacgcacatattggtcatcaccaagtttgaggttttga

SEQ ID NO: 222744 - DNA, 75 bp, Artificial Sequence
  Synthetic
cggatgcacaagacgctctgaggcagtgtaaaacctttaggggtagggttctggacatgttcagaactgcttttg

SEQ ID NO: 222745 - DNA, 75 bp, Artificial Sequence
  Synthetic
agtagcattagaaataaaaatgggcacatcatcggtccccatttactgtgatccatgctgtagtttaaaaagcct

SEQ ID NO: 222746 - DNA, 75 bp, Artificial Sequence
  Synthetic
gaggacagcatatgaggagtggctggggctggactggctcagatggcaaaaccacctggtgcagccaaacaagct

SEQ ID NO: 222747 - DNA, 75 bp, Artificial Sequence
  Synthetic
tctcgcacattgatagtcattgataggattgcattttcaaattctttgtcattgtttaaacatgagcctgaaaag

SEQ ID NO: 222748 - DNA, 75 bp, Artificial Sequence
  Synthetic
accaatacctaatcatacaaaatagaacttgggagaaccattgcaggtatgcaggtcctttcggaatgtctagaa

SEQ ID NO: 222749 - DNA, 75 bp, Artificial Sequence
  Synthetic
aaactagaaaaggactcaaaatagtcctctattaatcttgtgaacatttttgtccttaagtctccaatatagagt

SEQ ID NO: 222750 - DNA, 75 bp, Artificial Sequence
  Synthetic
ttctatttgctcaagaaaaaaccaagtttctcactagaaggcttgcaggcacatttacttggactttgtcagact

SEQ ID NO: 222751 - DNA, 75 bp, Artificial Sequence
  Synthetic
tctctatttcctccaacctgctccttgtaagacaatgcaaacttcagccttccggaatcaggaccaactgaagtg

SEQ ID NO: 222752 - DNA, 75 bp, Artificial Sequence
  Synthetic
cttcaggggtggagggaccaggtggttattgcttaaccaaatggatgatccttgctgcggaactcaaatgtttcg

SEQ ID NO: 222753 - DNA, 75 bp, Artificial Sequence
  Synthetic
tatgatgttggtgactcctctgaataaaagcataggttctttaaggcagcactcatacactttgttaatgttaga

SEQ ID NO: 222754 - DNA, 75 bp, Artificial Sequence
  Synthetic
ggaacacagctgttgcaaagtgcaacatcaatcacgacgaggaattctgtgacatgttgcgattgattgattata

SEQ ID NO: 222755 - DNA, 75 bp, Artificial Sequence
  Synthetic
gccttgcttaaagactcagaattgctctccctctcactaattctcacgtcttcttccaatttatcccagtcaaat

SEQ ID NO: 222756 - DNA, 75 bp, Artificial Sequence
  Synthetic
acaaggctgccttaagcaagtttaaagaagatgttgagtctgccctacatctatttaaaacaacagtaaattctt

SEQ ID NO: 222757 - DNA, 75 bp, Artificial Sequence
  Synthetic
ttgaaattcaacccctgcctttgcatatgcctgtacttcccagaatatgcatttgcattcatctgtaacagaatc

SEQ ID NO: 222758 - DNA, 75 bp, Artificial Sequence
  Synthetic
tgatttctgaccagttgctgatgagaaatcacctaagagacctgatgggggtaccatactgcaattactcaaaat

SEQ ID NO: 222759 - DNA, 75 bp, Artificial Sequence
  Synthetic
atcttcatacatgaaaaccaatcaccctctgaaaagaactttctacaaaggttttttgccatttcatctagacca

SEQ ID NO: 222760 - DNA, 75 bp, Artificial Sequence
  Synthetic
tctggtacctggaacacgcaaagactggcgaaactagtgtgcctaaatgttggcttgtcaccaatggctcttatt

SEQ ID NO: 222761 - DNA, 75 bp, Artificial Sequence
  Synthetic
cattgttccttgacagctgaagtgaaatatagtggtgatagttctatagagccctcaacagcctcacatatgaac

SEQ ID NO: 222762 - DNA, 75 bp, Artificial Sequence
  Synthetic
tgaatgagactcattttagtgatcaaatagagcaggaagcagacaacatgattacagagatgttgaggaaagact

SEQ ID NO: 222763 - DNA, 75 bp, Artificial Sequence
  Synthetic
ctcatgtcatcattggtgagacaggttggatcaaagtcttccactaagtgaaaagatatttctgacaaaatgacc

SEQ ID NO: 222764 - DNA, 75 bp, Artificial Sequence
  Synthetic
acataaagaggcaaggaagcacccctttggctttgatggaccttttgatgttctccacatcagcatacttgatta

SEQ ID NO: 222765 - DNA, 75 bp, Artificial Sequence
  Synthetic
ttcctcaaataagccattttgcctgacaaaacaatttgaaggtgatgtagtcctttcgtgttttttaattcctct

SEQ ID NO: 222766 - DNA, 75 bp, Artificial Sequence
  Synthetic
gcatcttcttgcatcttatgaaaataccaacacacagacacataaaaggcggcacgtgtccaaagccacaccgtt

SEQ ID NO: 222767 - DNA, 75 bp, Artificial Sequence
  Synthetic
ccatcttccccctcatcaaccttcttacctcttctgtactgtgttattgtggagttaaccttggtttccagattc

SEQ ID NO: 222768 - DNA, 75 bp, Artificial Sequence
  Synthetic
taaccaacaaaggaatttgtagttgtggtgcatttaaggtgccgggtgtaaaaactgtttggaaaagacgctgaa

SEQ ID NO: 222769 - DNA, 75 bp, Artificial Sequence
  Synthetic
ttgaaaaaatctgtctcttcttctccctcaaagcacacatctactggatcacattccagtttccctgcctccact

SEQ ID NO: 222770 - DNA, 75 bp, Artificial Sequence
  Synthetic
tagcagcgcctccctgactctccacctcacaagaggtggagagtcagggaggcccagtgggtcttagagcgtcac

SEQ ID NO: 222771 - DNA, 75 bp, Artificial Sequence
  Synthetic
cccttggaactgatgaccaatcttgacaccagctttgagactttgtactcataatcagagtgattcaatttatac

SEQ ID NO: 222772 - DNA, 75 bp, Artificial Sequence
  Synthetic
gacgttgggtcctctgaagatcagatcgtgtggcagaatattgtgaacagtttttagatcaggaagccttgcctt

SEQ ID NO: 222773 - DNA, 75 bp, Artificial Sequence
  Synthetic
ttctgcttcctcatgaaaccctctgtaatttgactcacagcactaacaagtaatttgttgaaatcatattccagg

SEQ ID NO: 222774 - DNA, 75 bp, Artificial Sequence
  Synthetic
ggatgcactctcgaagatgatgcagtccataagtgcacagtgtggggtgatctctttcttcttcttgtccctcac

SEQ ID NO: 222775 - DNA, 75 bp, Artificial Sequence
  Synthetic
agccgttctccatttagatgtttattgacaaccacacttttgttgctggcaagatctaatgctgttgcacatcca

SEQ ID NO: 222776 - DNA, 75 bp, Artificial Sequence
  Synthetic
tattccagtgtgcattttacacagccatccatatttgtcccagaccttgtcctcatattcccttgaagcctccct

SEQ ID NO: 222777 - DNA, 75 bp, Artificial Sequence
  Synthetic
gagttggtcatagggtccaggctattgagcttcttttcccctttaaagatcaaagtaccattattaaatgaggac

SEQ ID NO: 222778 - DNA, 75 bp, Artificial Sequence
  Synthetic
gctcatctcaacatctatcagctttatgtcccttctattttgtgagtccaggagcttcctgatgtcatctgagcc

SEQ ID NO: 222779 - DNA, 75 bp, Artificial Sequence
  Synthetic
accatcatgctaaaggcctctaagttaacacctggggttgtgtgctgacaatcaatctccttactggtgaatttt

SEQ ID NO: 222780 - DNA, 75 bp, Artificial Sequence
  Synthetic
ttgacagctcaggaccattccttgtggaagagcacctatgactgatgaagtcaatccgggttgtgcgttgaagag

SEQ ID NO: 222781 - DNA, 75 bp, Artificial Sequence
  Synthetic
ctcatttgttcataaaagacactttcttcttcaggggtgattgcttccttagggttaacaaagaaaccaaattca

SEQ ID NO: 222782 - DNA, 75 bp, Artificial Sequence
  Synthetic
atcagcaagatccataccgtgtgagtatttggagtcttgtttgaattgcttttggtcattaggttctctgtagaa

SEQ ID NO: 222783 - DNA, 75 bp, Artificial Sequence
  Synthetic
ctttttggttcaaagaacttttcaaaacactttatctggtctgtcaacctatcaggggtctcctttgtaatcaaa

SEQ ID NO: 222784 - DNA, 75 bp, Artificial Sequence
  Synthetic
gtgaatgaactgcccattttgtggctgaaatattgctatttctactgggtcattgaatctgccctctatgtcaat

SEQ ID NO: 222785 - DNA, 75 bp, Artificial Sequence
  Synthetic
tgacataggtatgacacattcagcatgaacttaaactttgcactcaatagcactttctctccagtaccgaaaata

SEQ ID NO: 222786 - DNA, 75 bp, Artificial Sequence
  Synthetic
ccatgtgggggcattggggtcaattcctcccatgaggtctttcaacaacattgtctgactatagcttaagcccac

SEQ ID NO: 222787 - DNA, 75 bp, Artificial Sequence
  Synthetic
attttgactagaaacctaagcaatctgtacaccactctctcagcaggcgtaatcaaatcctcctttagtttgtcc

SEQ ID NO: 222788 - DNA, 75 bp, Artificial Sequence
  Synthetic
ttgaggtggacctgctgctccgagtgctggtctgggtgtgttggctgcagatctctcacttgtaaggtcaattgt

SEQ ID NO: 222789 - DNA, 75 bp, Artificial Sequence
  Synthetic
atcaatgatgtggatgaaaagtctgagacaatagccataactagatacctaatgttttgaacctgcttttgattt

SEQ ID NO: 222790 - DNA, 75 bp, Artificial Sequence
  Synthetic
tgtgttttcccatgccctccccacaactgatgttctacaggctatgtatggccacccttcacctgagaggcaaac

SEQ ID NO: 222791 - DNA, 75 bp, Artificial Sequence
  Synthetic
ctctttgttgggttggtgagcatcagtagtagcaaggtcctcaatgcggtctcaatatcatttaaacagtccttc

SEQ ID NO: 222792 - DNA, 75 bp, Artificial Sequence
  Synthetic
tttgtagagaatgttctcatagggattcctgtccccaacctggtctgagacaaacatattgagtttctttttggc

SEQ ID NO: 222793 - DNA, 75 bp, Artificial Sequence
  Synthetic
aaatcaggacatgatctaatccatgaaatcatagtgtcaatcatgttgtgcaacacctcatctgaaaaaattggt

SEQ ID NO: 222794 - DNA, 75 bp, Artificial Sequence
  Synthetic
cccaaggactgcttttagaaggtcctcactgttgcttggcttgattagaatggactccaacatgttccctccatc

SEQ ID NO: 222795 - DNA, 75 bp, Artificial Sequence
  Synthetic
aaaaagaacctttttgggtctgcataaaaggaaattaagtgaccatctgggccttgtatggagtaacaccttgag

SEQ ID NO: 222796 - DNA, 75 bp, Artificial Sequence
  Synthetic
tagcagtgctgctcctgctttcacagcagcaccaagactgaaattgtagccagagatgttaatgctggactgttg

SEQ ID NO: 222797 - DNA, 75 bp, Artificial Sequence
  Synthetic
gattctccagtcttttgatacagcaaatgatactcttcagaatctagcttcattacttggcaaaaaacctcttta

SEQ ID NO: 222798 - DNA, 75 bp, Artificial Sequence
  Synthetic
ttcagtaatgacacctaacactggatgcttgtcttttaacctttcaaggtcgctgagatttggatatttcactgt

SEQ ID NO: 222799 - DNA, 75 bp, Artificial Sequence
  Synthetic
cattccaccacttgataccttatagaccctaattgattttgtctcaacctagcaactgagcttgtcttcatgctg

SEQ ID NO: 222800 - DNA, 75 bp, Artificial Sequence
  Synthetic
gtaaagcaagccaaggtctgtgagtgcctgtacaacatcattaagtggggtttgtgactgtttcgccatgcaagc

SEQ ID NO: 222801 - DNA, 75 bp, Artificial Sequence
  Synthetic
tttgttaaagccaaacaaatagatgacaatttcctcaaactctgcacatccctcaattgctttatattgggctga

SEQ ID NO: 222802 - DNA, 75 bp, Artificial Sequence
  Synthetic
cattgtcagacttggcattgtgccaaattgattgttcaagagtgatgaatctttcacatcccaaaccctcactat

SEQ ID NO: 222803 - DNA, 75 bp, Artificial Sequence
  Synthetic
aagctgtaatcctcaaactttgtataatacatcatggggtgagttccgactctcatgaaattctcaaactcagca

SEQ ID NO: 222804 - DNA, 75 bp, Artificial Sequence
  Synthetic
accgtttgcaccttgttggggtctcctcattccaaccatctgcaggagctgagatctttgatcaagctgttgtgc

SEQ ID NO: 222805 - DNA, 75 bp, Artificial Sequence
  Synthetic
tatgacacacggcattcatgcatgaggtgttcagacaatccgtaatgctcaaagctgagtcctactactgataga

SEQ ID NO: 222806 - DNA, 75 bp, Artificial Sequence
  Synthetic
tgttaggtttcccatgtagactccggaggattgaggtctttcagatctcatgattttagccttcagcttctcaag

SEQ ID NO: 222807 - DNA, 75 bp, Artificial Sequence
  Synthetic
catttctgaatctttgtaataaactcatttatggaggttctgaacaattcctcaagaggcaccttcctgtatgcc

SEQ ID NO: 222808 - DNA, 75 bp, Artificial Sequence
  Synthetic
gtcagctgcgagagacatcaattcttctgcactaagtctcccaacttttagcacgttctttttggatgtcgacct

SEQ ID NO: 222809 - DNA, 75 bp, Artificial Sequence
  Synthetic
ttagacttttttctgttccttaaaagccgaatgaattcttccttggtgctatgaaagctcactagcctatcattc

SEQ ID NO: 222810 - DNA, 75 bp, Artificial Sequence
  Synthetic
caattccactagggaatgtacagtttggttgagacttctgagcctttgtaaatctttgtcatcccttttttcctt

SEQ ID NO: 222811 - DNA, 75 bp, Artificial Sequence
  Synthetic
acactgctatagcagcacccaacccaatgtttgtcattttttaaatctttggactttgactgtctgattagtgaa

SEQ ID NO: 222812 - DNA, 75 bp, Artificial Sequence
  Synthetic
cctcatgattctctgaacattgctgacctcagaaaagtccagaccattaagaaggctggttgcatccttgatgac

SEQ ID NO: 222813 - DNA, 75 bp, Artificial Sequence
  Synthetic
gaaagacacaggacatctagattcaatagctgccttcttctagtgttcagcaactttaaacttttgactttattt

SEQ ID NO: 222814 - DNA, 75 bp, Artificial Sequence
  Synthetic
agcagccttcacatctgatgtgaagttctgcagctctctcctcagtgcctgtgtccactgaaagctctttacttc

SEQ ID NO: 222815 - DNA, 75 bp, Artificial Sequence
  Synthetic
aacatggataggagcctctcatactcagtgctggtttcacttcctcttttatgcccatgggtctctgctgtgata

SEQ ID NO: 222816 - DNA, 75 bp, Artificial Sequence
  Synthetic
cttggacagagacattttgtcgcccaatgatttcccaaaacaaatgcgcaatcaattgcctaggatccactgtgc

SEQ ID NO: 222817 - DNA, 75 bp, Artificial Sequence
  Synthetic
cgcaccggggatcctaggcgtttagttgcgctgtttgatcgcacggttgtactcgtgagacctccaaaccaggac

SEQ ID NO: 222818 - DNA, 75 bp, Artificial Sequence
  Synthetic
aacctcattaagggacaagattcaactgcttccttgctcagtgtcagaatgtcatcattgtcatcaagggtttca

SEQ ID NO: 222819 - DNA, 75 bp, Artificial Sequence
  Synthetic
ttggacagagacattttgtcgcccaatgatttcccaaaacaaatgcgcaatcaattgcctaggatccactgtgcg

SEQ ID NO: 222820 - DNA, 75 bp, Artificial Sequence
  Synthetic
agactaccagtcatgggtcaaggtaggtccaaagagaagggagaaatcagcaacacagacagggccgagattctg

SEQ ID NO: 222821 - DNA, 75 bp, Artificial Sequence
  Synthetic
tagagctctgaaaactctttgatcaggccctcaggattgaccttttgaaagttccttttgagtttcccgctcacc

SEQ ID NO: 222822 - DNA, 75 bp, Artificial Sequence
  Synthetic
ccagacaccacctatcttggtcctctgaactgcaaatcatgctggcagaggtttgacagcttagttaggtgccat

SEQ ID NO: 222823 - DNA, 75 bp, Artificial Sequence
  Synthetic
aaatccctcctaaacctgctaaagagagagtttatgctaaagaccacatcatcacaagtcatgttagggttgata

SEQ ID NO: 222824 - DNA, 75 bp, Artificial Sequence
  Synthetic
gaccactacctttgcagacactgcttaaatctcctgctgtcggtctccaacagatgccctctttgtaagcatcca

SEQ ID NO: 222825 - DNA, 75 bp, Artificial Sequence
  Synthetic
ccatcatggcacattctcattatttcatcattatgaagtgatcttgcgtcttttaagattttcatggaatccatg

SEQ ID NO: 222826 - DNA, 75 bp, Artificial Sequence
  Synthetic
ttaccaaccaaactaaaaatatcaacagccccgagctcaccacctccctatgaagagtgacacccccagagccca

SEQ ID NO: 222827 - DNA, 75 bp, Artificial Sequence
  Synthetic
ccagaacgcttgtcaacagtggtctttagagactcacaaagtctgaagtactcggactcctcaaagactttctca

SEQ ID NO: 222828 - DNA, 75 bp, Artificial Sequence
  Synthetic
acaccaacaggcagcccaccacaagacccagcacaagacacacccacacacaaacacgcacacacacacgcacac

SEQ ID NO: 222829 - DNA, 75 bp, Artificial Sequence
  Synthetic
tcctgactagaatattccagtagtttaaatagaaggtctctaaacttaaaattcacccattctggcatgaagctg

SEQ ID NO: 222830 - DNA, 75 bp, Artificial Sequence
  Synthetic
cccccaccggggggcgcccccccggggggcggcccccccgggggcccaggccgagccccacggagatgccaatca

SEQ ID NO: 222831 - DNA, 75 bp, Artificial Sequence
  Synthetic
ttatcataatcacaacgaccatctactattggaactagtgtgatgcccgcaacagcaaggtcttccttaatgcat

SEQ ID NO: 222832 - DNA, 75 bp, Artificial Sequence
  Synthetic
gtcgatctcctccgccaccaacccagccagccaatcatcacaagacttccccttgagtctgtacctgcccccaac

SEQ ID NO: 222833 - DNA, 75 bp, Artificial Sequence
  Synthetic
gccaatttgttggtatcctctatgaatttcttttcaaaactagccggtgtgcttctgacaaaacattctagaaga

SEQ ID NO: 222834 - DNA, 75 bp, Artificial Sequence
  Synthetic
tgtctcatacatcactgtgttctttgacctgctgaaacagagcctacagtccttaaaggtgaaccagtcgggtac

SEQ ID NO: 222835 - DNA, 75 bp, Artificial Sequence
  Synthetic
atgagagaattgtcaatcaatttataaccatcaggaatgatgagtggcaatcctgggcatacaattccagactca

SEQ ID NO: 222836 - DNA, 75 bp, Artificial Sequence
  Synthetic
aaacgacaatggtgtcagtaggacagatctattcatacatagctcctgaaggattacgtttatttctgatcctgg

SEQ ID NO: 222837 - DNA, 75 bp, Artificial Sequence
  Synthetic
atcaaaattgcttcaacagatttgtcatcatggttgtgcgtgcaaccactcttgtctgcgctgtctatctctata

SEQ ID NO: 222838 - DNA, 75 bp, Artificial Sequence
  Synthetic
caagtgctcaccagttctaaaccgatgaagaagaaggccgccgagaacatcaccaatcttttcatacccctcaag

SEQ ID NO: 222839 - DNA, 75 bp, Artificial Sequence
  Synthetic
caacgtgacagcagtttgagtccctcgatcagcaccattctgggttctctttgccccagaaagttgagtttttgc

SEQ ID NO: 222840 - DNA, 75 bp, Artificial Sequence
  Synthetic
ttctgccaaaaagaccctcatatccttggtctccagctttacaaggatattttgaacgaggtttcttccctcaaa

SEQ ID NO: 222841 - DNA, 75 bp, Artificial Sequence
  Synthetic
cttgacaatctctcatcctgttccacataatttagacacaattctctcaattctgaaataatctcatccattgcg

SEQ ID NO: 222842 - DNA, 75 bp, Artificial Sequence
  Synthetic
aagggcgcccatcctgacagtcaaagggacgggttcccactcaggcccgaccctctcaaaatcaagggacctaat

SEQ ID NO: 222843 - DNA, 75 bp, Artificial Sequence
  Synthetic
cgcaccggggatcctaggctttttggattgcgctttcctctagatcaactgtgtgttggactctatcctgtcgaa

SEQ ID NO: 222844 - DNA, 75 bp, Artificial Sequence
  Synthetic
aatttagacacaattctctcaattctgaaataatctcatccattgcgcatcaaaaagcctaggatccactgtgcg

SEQ ID NO: 222845 - DNA, 75 bp, Artificial Sequence
  Synthetic
tccgtccagcatctttttggaacctatcagttcaagctcaagagtgtcgccgagtatcaagggatcctccatata

SEQ ID NO: 222846 - DNA, 75 bp, Artificial Sequence
  Synthetic
ggatgggtcaaattgtgacaatgtttgaggccttgcctcacattattgatgaagtcatcaatattgtcatcattg

SEQ ID NO: 222847 - DNA, 75 bp, Artificial Sequence
  Synthetic
atcctcaaattcctcagatctaacgtcaaaaatgctgtcgttcatcttgaagacagagtccgtccttaacaaatg

SEQ ID NO: 222848 - DNA, 75 bp, Artificial Sequence
  Synthetic
tgctcataataatcaccagcataaaggctgtgtacaaccttgccacctgtgggatatttgcattggtcagcttcc

SEQ ID NO: 222849 - DNA, 75 bp, Artificial Sequence
  Synthetic
aaggcattcatctaacaacctcctgtccacctcacccttaaagaggtaggaacatgacaagaactcagctacact

SEQ ID NO: 222850 - DNA, 75 bp, Artificial Sequence
  Synthetic
tcctcttggctgggagatcatgtggcatgtatggtctcagtgggcctgacatctacaaaggtgtttaccagttca

SEQ ID NO: 222851 - DNA, 75 bp, Artificial Sequence
  Synthetic
tgggccctttagctggcaccttactaggaagatcaatgaaaacttcctcaaacaatcagtgttgttctgattgtg

SEQ ID NO: 222852 - DNA, 75 bp, Artificial Sequence
  Synthetic
aatcagtagaatttgacatgtcacacctgaacttaacaatgcccaatgcatgctcagccaacaattcccaccatt

SEQ ID NO: 222853 - DNA, 75 bp, Artificial Sequence
  Synthetic
tgtgaaatccactgcaagtgaaagctccaacactccttttgtgttgctgagcatatagtcccacaaatcccccaa

SEQ ID NO: 222854 - DNA, 75 bp, Artificial Sequence
  Synthetic
acatcagcatggggacttcagggctggaattgactttcaccaatgactccatcattgaccacaagctctgtaact

SEQ ID NO: 222855 - DNA, 75 bp, Artificial Sequence
  Synthetic
agacttgaatgctcctgaatttgtcagaccctgcttgatcatcattgcagcattacatacagcatctcccacccg

SEQ ID NO: 222856 - DNA, 75 bp, Artificial Sequence
  Synthetic
tgacttctgctttcaataagaagacctttgaccacaccctcatgagcatagtgtccagcctacaccttagtatca

SEQ ID NO: 222857 - DNA, 75 bp, Artificial Sequence
  Synthetic
gtaagagaaccatccgaaaccaaactgtaaatcatccctgtacatgggcctttccacatttctattcactacctt

SEQ ID NO: 222858 - DNA, 75 bp, Artificial Sequence
  Synthetic
gagggaattcgaattacaaagcagtatcttgtgatttcaacaatggcatcaccattcaatacaacttgacatttt

SEQ ID NO: 222859 - DNA, 75 bp, Artificial Sequence
  Synthetic
caaaacaaatgattggaaagggcctagtgcctcagctccatcctcagacggcatcatgtccttatgagggaacca

SEQ ID NO: 222860 - DNA, 75 bp, Artificial Sequence
  Synthetic
cagacgcacagagtgctttgagccagtgcaggactttcagaggtagagtcttggacatgttcagaactgcttttg

SEQ ID NO: 222861 - DNA, 75 bp, Artificial Sequence
  Synthetic
tgaaaaactgcccaaagttctagctgttgtaacaaattctcgaacaaatgattcaaagtacacctgttttagaaa

SEQ ID NO: 222862 - DNA, 75 bp, Artificial Sequence
  Synthetic
gtggaaagtacatgaggagtggttggggctggactggctcggatggtaggaccacctggtgtagccagacgagtt

SEQ ID NO: 222863 - DNA, 75 bp, Artificial Sequence
  Synthetic
atttttgcaaacatcccttgtactaacgacaaactcatcaaccagacttgaatcagaccgctgatgtgaactagc

SEQ ID NO: 222864 - DNA, 75 bp, Artificial Sequence
  Synthetic
atcaatacctaatcatacaaaatcggacctgggagaaccactgtagatatgcagggccctttggaatgtccagaa

SEQ ID NO: 222865 - DNA, 75 bp, Artificial Sequence
  Synthetic
aagttcagagaatagcacagtgtaatgctcatctctcttccacctgacaacatgagagatgagtgacaaagactc

SEQ ID NO: 222866 - DNA, 75 bp, Artificial Sequence
  Synthetic
tcctctttgctcaggaaaagacaaagttcctcactagaaggcttgccggtacattcacctggactctgtcagact

SEQ ID NO: 222867 - DNA, 75 bp, Artificial Sequence
  Synthetic
tgagttaatgtcaatcaaaacacaaaggtcaagaaatttaatcctgggattccatctcatgttttttgagctcat

SEQ ID NO: 222868 - DNA, 75 bp, Artificial Sequence
  Synthetic
cttcaggagtagaaaacccaggcggttactgcctgaccaagtggatgattcttgctgcagaactcaagtgttttg

SEQ ID NO: 222869 - DNA, 75 bp, Artificial Sequence
  Synthetic
atctgacatgaatggaagcagttgatcctcaaagatttttgggtacaatcgccttacagattgtattacatggtt

SEQ ID NO: 222870 - DNA, 75 bp, Artificial Sequence
  Synthetic
ggaacacagctgttgcaaaatgcaatgtcaatcatgacgaagagttctgtgacatgctacgattaattgattaca

SEQ ID NO: 222871 - DNA, 75 bp, Artificial Sequence
  Synthetic
caagctcaccttgtcttccagcagtcttgagctctcaggttttcttgctacataatcgcatggattcaaatgttt

SEQ ID NO: 222872 - DNA, 75 bp, Artificial Sequence
  Synthetic
ataaggctgcattgagtaagtttaaggaagatgtagaatctgctttgcacttgtttaaaacaacagtaaattctt

SEQ ID NO: 222873 - DNA, 75 bp, Artificial Sequence
  Synthetic
aagacccgaattctgatcacttttccctttcagaggttctgctaagacccacacacctagttcgaaggagttgct

SEQ ID NO: 222874 - DNA, 75 bp, Artificial Sequence
  Synthetic
tgatttccgaccaagtgctcatgaggaatcacttaagagacttgatgggagtgccatactgcaactattcaaaat

SEQ ID NO: 222875 - DNA, 75 bp, Artificial Sequence
  Synthetic
caatgaaatacaaatgtagtcccagaggagaggtcttaagagactgatatgatcacggtgaacttccggatgtcc

SEQ ID NO: 222876 - DNA, 75 bp, Artificial Sequence
  Synthetic
tctggtatctggagcacgcaaagactggtgaaaccagtgttcctaagtgttggcttgtcactaacggctcttatt

SEQ ID NO: 222877 - DNA, 75 bp, Artificial Sequence
  Synthetic
tcgtttatcacaaatgaataacattatgccatcgtgcttatggattcttgttacatgctcatccatggccaagtc

SEQ ID NO: 222878 - DNA, 75 bp, Artificial Sequence
  Synthetic
taaatgagacccattttagtgatcaaatagagcaagaggcggacaacatgatcacagagatgctgaggaaggact

SEQ ID NO: 222879 - DNA, 75 bp, Artificial Sequence
  Synthetic
ctcaagcactttcttaatgtataagttttccctattcttatttctaacacatctgcttcccagagtcttacagag

SEQ ID NO: 222880 - DNA, 75 bp, Artificial Sequence
  Synthetic
atatcaagaggcagggaagcacccccttagccttaatggatcttttgatgttttccacgtcagcctatctaatta

SEQ ID NO: 222881 - DNA, 75 bp, Artificial Sequence
  Synthetic
gcctatgaacccagatgaaatgcaactttgaaaagctgatttgttgattgcttctgatagtaacttctgtgcccc

SEQ ID NO: 222882 - DNA, 75 bp, Artificial Sequence
  Synthetic
gtgtcttcctgcatcttatgaaaataccaacgcacagacacataaagggcggttcatgcccaaagccacatcgtt

SEQ ID NO: 222883 - DNA, 75 bp, Artificial Sequence
  Synthetic
ccttgtaaacttgctgcaaagtttgttttggagtgttttgattagtgaggggattcgctcctcctggaaagtcat

SEQ ID NO: 222884 - DNA, 75 bp, Artificial Sequence
  Synthetic
tgaccaacaaggggatctgtggctgtggtgcattcagggtacccggtgtaaaaactgtttggaagagacgctgag

SEQ ID NO: 222885 - DNA, 75 bp, Artificial Sequence
  Synthetic
cactgatggataaataactttctgtctcaaaaccattctcaacggaaacatctcatttaagttcagccaattgat

SEQ ID NO: 222886 - DNA, 75 bp, Artificial Sequence
  Synthetic
caacagcgcctccctgactctccacctcgaaagaggtggagagtcagggaggcccagagggtcttagagtgtcac

SEQ ID NO: 222887 - DNA, 75 bp, Artificial Sequence
  Synthetic
ctcgaaagaggtggagagtcagggaggcccagagggtcttagagtgtcacaacatttggacctctgaagatcagg

SEQ ID NO: 222888 - DNA, 75 bp, Artificial Sequence
  Synthetic
gtctgccaattgatttaggtcttcttcatggccaaggatatctcccaatagaaggatagcctccttcttttctct

SEQ ID NO: 222889 - DNA, 75 bp, Artificial Sequence
  Synthetic
tcatgtggcagtatgttgtggatggacttcaggtcgggaagccttgccttggaggcactctcaaaaatgatgcaa

SEQ ID NO: 222890 - DNA, 75 bp, Artificial Sequence
  Synthetic
attgaagagatctaaaaagaattcctcattgaattcaccattcttaagcttatgatgtagctttctcacaagttt

SEQ ID NO: 222891 - DNA, 75 bp, Artificial Sequence
  Synthetic
tccataagtgcgcagtgtggggtgatctctttcttctttttgtctctcactatcccggtgtgcatcttgcacagc

SEQ ID NO: 222892 - DNA, 75 bp, Artificial Sequence
  Synthetic
tcttatggtctttgtctcattaggacacagttcttcaataagcctttgaattctataaccccttgagccatctag

SEQ ID NO: 222893 - DNA, 75 bp, Artificial Sequence
  Synthetic
cagccatacttgtcccacaccttgtcctcgtactcccttgaggcttccttggtcatttccacatctataagcttt

SEQ ID NO: 222894 - DNA, 75 bp, Artificial Sequence
  Synthetic
ccaatcctttacatcagtattagtgttcagcaagaatggatccaaggggaagttagcatattttaaaaggtccaa

SEQ ID NO: 222895 - DNA, 75 bp, Artificial Sequence
  Synthetic
atatcccttctattctgtgagtctagtagctttctgatgtcatcagaaccctgacagctcaaaaccatcccctgt

SEQ ID NO: 222896 - DNA, 75 bp, Artificial Sequence
  Synthetic
tgttctcttttgaatgcagtttaccaaagaaactgggacaccattggcaatagcctgatcagcaattgtgtctat

SEQ ID NO: 222897 - DNA, 75 bp, Artificial Sequence
  Synthetic
ggaagggcaccaaggacagatgaggtcaacccaggttgtgcattaaagagatcagcaagatccataccatgtgag

SEQ ID NO: 222898 - DNA, 75 bp, Artificial Sequence
  Synthetic
tgtctcacagagttggtgcggttccttgcacttaacgttgtgtaatgctgcagacacaaactttgtgagaagagg

SEQ ID NO: 222899 - DNA, 75 bp, Artificial Sequence
  Synthetic
tacttagaatcttgcttgaactgtttctgatcagtaggttccctataaaaatgtatgaattgcccagtctgtggt

SEQ ID NO: 222900 - DNA, 75 bp, Artificial Sequence
  Synthetic
gacctcctccccccacacatagaatctagatttgaattccgcagcaaaccgcccaaccacactttttggactgat

SEQ ID NO: 222901 - DNA, 75 bp, Artificial Sequence
  Synthetic
tggaacagtgctatttccactgggtcattggatctgccttcaatgtcaatccatgtaggggcattagggtcgatc

SEQ ID NO: 222902 - DNA, 75 bp, Artificial Sequence
  Synthetic
gaacttgtttaacaaaccacttaagtgagaatgaaattctaacaaaacaagaacttcttctgggtcactatcaac

SEQ ID NO: 222903 - DNA, 75 bp, Artificial Sequence
  Synthetic
cctcccatgaggtctttcaacagcattgtctgactgtagctcaagcctacttgaggtggtcctgctgctccaggt

SEQ ID NO: 222904 - DNA, 75 bp, Artificial Sequence
  Synthetic
catctcgcttattttcttatcaaacagtgtaatttgatcatcacttgatgtataagcttctggcctctcaccaaa

SEQ ID NO: 222905 - DNA, 75 bp, Artificial Sequence
  Synthetic
gatggtctgggtaagttagccacaggtctctcatttgtgaggtcaattgttgtgttctcccatgctctccccaca

SEQ ID NO: 222906 - DNA, 75 bp, Artificial Sequence
  Synthetic
aataacaccaacacagtagttaatgaacctttcactgattaacccataaaaatcagaagcattgtgtaagattcc

SEQ ID NO: 222907 - DNA, 75 bp, Artificial Sequence
  Synthetic
attgatgttctacatgctatgtacggccatccttcacctgataagcaaaccttatagagaatgttttcataagga

SEQ ID NO: 222908 - DNA, 75 bp, Artificial Sequence
  Synthetic
ctgccccatatcaataagactagatatgtgggacggcactatccctaattcaaagtattctctgaagattctttc

SEQ ID NO: 222909 - DNA, 75 bp, Artificial Sequence
  Synthetic
ttccgatctccaacttggtctgaaacaaacatattgagctttctttttgccccgagaactgctttcaagaggtcc

SEQ ID NO: 222910 - DNA, 75 bp, Artificial Sequence
  Synthetic
cgtaattgttgtctctgaacctctaagaagcttcaattttgacttaacatatgatctcatcattgcattcacaac

SEQ ID NO: 222911 - DNA, 75 bp, Artificial Sequence
  Synthetic
tcactgttgcctggtttgatcagaatggactccagcatattgcccccgtccaagagagctgcccctgctttcaca

SEQ ID NO: 222912 - DNA, 75 bp, Artificial Sequence
  Synthetic
aggaaaagggacttcaacaagtttatgcatgtgccaagttaataaggtgctgacatgatcctttccagtgcggac

SEQ ID NO: 222913 - DNA, 75 bp, Artificial Sequence
  Synthetic
gcagcaccgagactgaagttgtagccagaaatgttgattcctgattgctgttcagtgataacccctaagactggg

SEQ ID NO: 222914 - DNA, 75 bp, Artificial Sequence
  Synthetic
atactggtcatcacccagcttgagattctggaggagcattaaaaacaaaaatggacacatcattggcccccattt

SEQ ID NO: 222915 - DNA, 75 bp, Artificial Sequence
  Synthetic
tgtttgtctttcagtctctccagatcaccaaggtttgggtacttaactgtgtaaagtaggccaaggtctgtgagt

SEQ ID NO: 222916 - DNA, 75 bp, Artificial Sequence
  Synthetic
actgtggtccatactgtaatttagcaatccttctctcacgttaatggtcattgatagtattgcattttcaaattc

SEQ ID NO: 222917 - DNA, 75 bp, Artificial Sequence
  Synthetic
gcttgcacgacatcattgagtggggtctgtgactgtttagccatgcaagccattgtcaggcttggcattgtgcca

SEQ ID NO: 222918 - DNA, 75 bp, Artificial Sequence
  Synthetic
tttgtcattgtttaaacaagaacctgagaagaaactggaaaaagattcaaaataatcctctattaatcgtgtaaa

SEQ ID NO: 222919 - DNA, 75 bp, Artificial Sequence
  Synthetic
aattgattgttcagaagtgatgagtctctcacatcccagaccctcaccacgccattcgtgccttgctgaggtctc

SEQ ID NO: 222920 - DNA, 75 bp, Artificial Sequence
  Synthetic
catttttgttctcagatccccaatatagagttctctattccccccaacctgttccttataagacaatgcaaattt

SEQ ID NO: 222921 - DNA, 75 bp, Artificial Sequence
  Synthetic
ctcatcccaaccatctgcaagatctgggatctttgatcaagttgttgcaccgtcaagttccccatgtagacccca

SEQ ID NO: 222922 - DNA, 75 bp, Artificial Sequence
  Synthetic
cagccttccggaatcaggaccaaccgaggtgtatgatgttggtgattcctctgaatagaagcacaggttcttcaa

SEQ ID NO: 222923 - DNA, 75 bp, Artificial Sequence
  Synthetic
gaagcctgaggtctctcagttctcatgattttggccttcagtttctcgagatcagctgcaagagacatcagttcc

SEQ ID NO: 222924 - DNA, 75 bp, Artificial Sequence
  Synthetic
ggcagcactcatgcactttgttaatgacagagccttacttagagattcagagttgctttctctttcactgattct

SEQ ID NO: 222925 - DNA, 75 bp, Artificial Sequence
  Synthetic
tccgcactgagccttcccaccttcaggacatttttcttcgaggttgacttcaagtccacaagagaatacacagtt

SEQ ID NO: 222926 - DNA, 75 bp, Artificial Sequence
  Synthetic
tacgtcctcttctaacttatcccaatcaaatctgaagttcaggccttgtctctgcatgtgtctgtacttccctga

SEQ ID NO: 222927 - DNA, 75 bp, Artificial Sequence
  Synthetic
tgattgaggcttctgagcctctgtaagtctttatcatctcttttttccttcctcatgattctctggacattgctg

SEQ ID NO: 222928 - DNA, 75 bp, Artificial Sequence
  Synthetic
gtatgcatttgcattcatttgtaataaaatcattttcatacatgaaaaccaatcaccctctgaaaaaaacttcct

SEQ ID NO: 222929 - DNA, 75 bp, Artificial Sequence
  Synthetic
acttcagagaagtccaatccgttcaggaggctagttgcatccttgatgacagcagcctttacatctgatgtaaag

SEQ ID NO: 222930 - DNA, 75 bp, Artificial Sequence
  Synthetic
agagaggttctttgccatctcatccaggccacattggtccttaacagttgaagtgaaatacaatgatgacaactc

SEQ ID NO: 222931 - DNA, 75 bp, Artificial Sequence
  Synthetic
ttctgcaactcccttcttaacgcctgtgtccattgaaaactcttgatttctttggacaaggacatcttgtcgctc

SEQ ID NO: 222932 - DNA, 75 bp, Artificial Sequence
  Synthetic
ttcagaaccttcaacagcttcacagaaaaacttcatatcatcattagtgagacaagacgggtcaaagtcctcaac

SEQ ID NO: 222933 - DNA, 75 bp, Artificial Sequence
  Synthetic
ttggacaaggacatcttgtcgctcaatgattcaccaagacaaatgcgcaatcaaatgcctaggatccccggtgcg

SEQ ID NO: 222934 - DNA, 75 bp, Artificial Sequence
  Synthetic
cgcaccggggatcctaggcatttccttgcgctattttattgcatcgccttttcctgcaagaccacctggggcgaa

SEQ ID NO: 222935 - DNA, 75 bp, Artificial Sequence
  Synthetic
caagtgaaaagatatctccgataaaatgaccttccttaaataagccattttacctgacagaacagtctgaaggtg

SEQ ID NO: 222936 - DNA, 75 bp, Artificial Sequence
  Synthetic
gtgggccatcagccatgggtcaagccaagtctagaggtagagagaatgctggcaagatggacagagctgagattc

SEQ ID NO: 222937 - DNA, 75 bp, Artificial Sequence
  Synthetic
atgtaacccttttgcatctctaagtccctctccatccccttccctgtcaaccttcttaccttttttataactagt

SEQ ID NO: 222938 - DNA, 75 bp, Artificial Sequence
  Synthetic
tgccagataccacctaccttggacccttgaactgcaagtcatgctggcagaaactcgacagtctagtcaggtgtc

SEQ ID NO: 222939 - DNA, 75 bp, Artificial Sequence
  Synthetic
tatcgtggaattaaccttgtcttctagaatcttgaaaaattgagtttcttcttctccctcaaaaaacacatcttc

SEQ ID NO: 222940 - DNA, 75 bp, Artificial Sequence
  Synthetic
atgatcactacctttgcagaaattgcctgaaccttctcttaacagtgtctgacaggtgccctctctgcaaacatc

SEQ ID NO: 222941 - DNA, 75 bp, Artificial Sequence
  Synthetic
aggttcaccctccagttgttctgcttctgttttcttggaaccaagaaccaatctagagactaattttgagacttt

SEQ ID NO: 222942 - DNA, 75 bp, Artificial Sequence
  Synthetic
cattgccaaccaggctcacgatctcaacagccccgagctcaccgcctccctacgaggagtgacgccccccaaagg

SEQ ID NO: 222943 - DNA, 75 bp, Artificial Sequence
  Synthetic
gtactcataatctgagtggttcaacttgtacttctgttttctcatgaagccttctgtaatctggctcacagcact

SEQ ID NO: 222944 - DNA, 75 bp, Artificial Sequence
  Synthetic
gcccgcaccaacaaaccatcccacacaagagcacaacacacaagccaacacacacaagcacaacacaaaacacag

SEQ ID NO: 222945 - DNA, 75 bp, Artificial Sequence
  Synthetic
aacaagcaatttgttgaaatcatactccaaaagacgttccccattcaagtgcttgttgacaactacactcttgtt

SEQ ID NO: 222946 - DNA, 75 bp, Artificial Sequence
  Synthetic
acacagccacacccacacccaacaaaaacacaaacacacacacaccacacacacccacgcgcccccacagggggg

SEQ ID NO: 222947 - DNA, 75 bp, Artificial Sequence
  Synthetic
gctggcaagatctaatgctgttgcgcacccagagttagtcattgggtccacactattaagcctcttttccccttt

SEQ ID NO: 222948 - DNA, 75 bp, Artificial Sequence
  Synthetic
cgcccccccgggggcgacccccgggggccaggcgcgaccccgcggagacgccaatcagtcgatctcctcgacgtc

SEQ ID NO: 222949 - DNA, 75 bp, Artificial Sequence
  Synthetic
gaaaattaatgtaccattgttaaatgatgacaccatcatgctgaaagcctctaaattgacacctggggttgtact

SEQ ID NO: 222950 - DNA, 75 bp, Artificial Sequence
  Synthetic
cgaccccgccaaccaatcatcacaggacctccccttgagcctgaacctgcccccaactgtctcatacatcaccgt

SEQ ID NO: 222951 - DNA, 75 bp, Artificial Sequence
  Synthetic
ctgacaatcaacttctttactggtgaatttcttcatttgctcataaaagacacactcttcttcaggtgtgattgc

SEQ ID NO: 222952 - DNA, 75 bp, Artificial Sequence
  Synthetic
attctttgacttgctgaagcagagtctatagtccttaaaagtgaaccagtctggcacaaatgacaatggcaccaa

SEQ ID NO: 222953 - DNA, 75 bp, Artificial Sequence
  Synthetic
ttccttagggttaacaaagaaaccaaactcacttttgggttcaaagaatttctcaaaacattttatctggtctgt

SEQ ID NO: 222954 - DNA, 75 bp, Artificial Sequence
  Synthetic
cagaatagatctgtctatgcccaattcctgaagaactgcacttatttctgaacccatcaagtgctcaccagttct

SEQ ID NO: 222955 - DNA, 75 bp, Artificial Sequence
  Synthetic
tagtctgtcaggggtctcttttgtaattaagtgacacaagtatgatacattgagcatgaacttgaattttgcact

SEQ ID NO: 222956 - DNA, 75 bp, Artificial Sequence
  Synthetic
gaatcggtgtaggaaaagagtgccaagaacatcaccaaccttttcataaccctcaagctccgccagaaagactct

SEQ ID NO: 222957 - DNA, 75 bp, Artificial Sequence
  Synthetic
caacaacaccttttctcctgtgccaaaaatagttctgattaaaaacctaagcaacttatacactatcttctcggc

SEQ ID NO: 222958 - DNA, 75 bp, Artificial Sequence
  Synthetic
catatccttagtttctaacttcacaaggatattctgcacaaagttcctcccctcaaagagagcacccactctcac

SEQ ID NO: 222959 - DNA, 75 bp, Artificial Sequence
  Synthetic
aggtgtgatcaagtcttccttcaacttgctcatcaatgaagtggatgagaaatccgagacaatggccataaccaa

SEQ ID NO: 222960 - DNA, 75 bp, Artificial Sequence
  Synthetic
agtcaagggcacaggctcccattcagggcctattctctcgaaatcaagagatccaacttcatctagtattctctt

SEQ ID NO: 222961 - DNA, 75 bp, Artificial Sequence
  Synthetic
gtatctaatgttctgaacctgcttctgatttctttttgttgggttggtgagtatgagtaacagcaaagttctcag

SEQ ID NO: 222962 - DNA, 75 bp, Artificial Sequence
  Synthetic
ggagcccatcaactcaagctcaagtgaatcaccaagtatcagagggtcttccatataatcttcaaactcctcagt

SEQ ID NO: 222963 - DNA, 75 bp, Artificial Sequence
  Synthetic
tgcagtctcaatatccaaaagacagtcctttaagtctgggcatgatctaatccatgagatcatagtgttaaccat

SEQ ID NO: 222964 - DNA, 75 bp, Artificial Sequence
  Synthetic
cctaatatcaaagatgttatcatttaccctgaaaatggggtccgtcctcagtaagcatagacattcatccagcaa

SEQ ID NO: 222965 - DNA, 75 bp, Artificial Sequence
  Synthetic
actatgcaacacttcatctgagaatatcggcagaaagaatctctttggatccgcataaaaggagatcaaatgacc

SEQ ID NO: 222966 - DNA, 75 bp, Artificial Sequence
  Synthetic
tcttctgtccacttcacctttgaagaggtgagagcatgatacaaattcagctgtgcctgcactctgcaagtgaca

SEQ ID NO: 222967 - DNA, 75 bp, Artificial Sequence
  Synthetic
atctgggccttgtatagagtaacaccttgaggattcccctgtcttttgatacaacaaatggtactcctcagagtc

SEQ ID NO: 222968 - DNA, 75 bp, Artificial Sequence
  Synthetic
ctttaccaaaaagatcaacgagaacttctttaaacaatcagtgttgttttggttgtgtgtgaaatccaccgtgat

SEQ ID NO: 222969 - DNA, 75 bp, Artificial Sequence
  Synthetic
aagtttaacaacctgacagaacacctctttacactctactatttgatatctaatagaacctaattgattttgtct

SEQ ID NO: 222970 - DNA, 75 bp, Artificial Sequence
  Synthetic
tgaaaactccaacatcccctttgtgttagtaagcatgtagtcccacaaatttcccaaggacttaaatgctctggg

SEQ ID NO: 222971 - DNA, 75 bp, Artificial Sequence
  Synthetic
caatctagcaactgaacttgttttcatactgtttgttaaagctaagcaaacagatgacagtcgtcttaaactctg

SEQ ID NO: 222972 - DNA, 75 bp, Artificial Sequence
  Synthetic
atttaccaaaccttgtttgactaacatagcagcattacacacaatatcctctattttataagagaaccatccaaa

SEQ ID NO: 222973 - DNA, 75 bp, Artificial Sequence
  Synthetic
tgcatccctcaactgttctatactgggctgaaaattgtaatcttcaaattttgtgtagtacattataggatgagt

SEQ ID NO: 222974 - DNA, 75 bp, Artificial Sequence
  Synthetic
cccaaactgtaaatcgtttctaaacataggcctttctatatttttgttcaccacttttaaaacaaatgattggaa

SEQ ID NO: 222975 - DNA, 75 bp, Artificial Sequence
  Synthetic
tccggctcttgtaaagttttcaaactcagtgaatggcacatgacattcatacacgagatgttcagacaacccata

SEQ ID NO: 222976 - DNA, 75 bp, Artificial Sequence
  Synthetic
aggccctaatgcatcagcaccatcctcagatggcatcatatctttatgagggaaccatgaaaaattgcccagggt

SEQ ID NO: 222977 - DNA, 75 bp, Artificial Sequence
  Synthetic
gtgctcaaaactcagtcccacaactgtcaagcacctctggattttaaggatgaactcatccacagatgttctgaa

SEQ ID NO: 222978 - DNA, 75 bp, Artificial Sequence
  Synthetic
ccttgtcgttgcgacaaattcccgtacaaatgattcaaagtacacctgctttaaaaagttcttacaaacatctct

SEQ ID NO: 222979 - DNA, 75 bp, Artificial Sequence
  Synthetic
taactcctcaagagacattttcctacatgtttttgatctttttctgttcctcaaaagtttaatgaattcttcctt

SEQ ID NO: 222980 - DNA, 75 bp, Artificial Sequence
  Synthetic
tgtactgacaacaaactcatcaactagacttgagtctgaccgctgatgagagttagaaagttcagaaaatagcac

SEQ ID NO: 222981 - DNA, 75 bp, Artificial Sequence
  Synthetic
tgtgctatgaaaactcactaatctgtcattcacactactatagcagcagccaacccaatgcttgtcattttccaa

SEQ ID NO: 222982 - DNA, 75 bp, Artificial Sequence
  Synthetic
agtgtagtgttcatctcttttccacttaactacgtgagaaatgagtgatagagactctgagttaatgtcaatcaa

SEQ ID NO: 222983 - DNA, 75 bp, Artificial Sequence
  Synthetic
tcttttggatcccgattgtttgatcaatgaggagagacacagaacatccaaattcaacaactgtttccttctagt

SEQ ID NO: 222984 - DNA, 75 bp, Artificial Sequence
  Synthetic
tacacaaagatcaaggaatttgatcctggggctccatctcatattttttgaactcatatcagacataaatggaag

SEQ ID NO: 222985 - DNA, 75 bp, Artificial Sequence
  Synthetic
gttcaacagctttaagcttttaactttattcaacatagagagaagtctctcatattcagtgctagcttcatcacc

SEQ ID NO: 222986 - DNA, 75 bp, Artificial Sequence
  Synthetic
caactgatcctcaaaaattttggggtacagccgcctcacagattgaattacatggttcaaactcaccttatcctc

SEQ ID NO: 222987 - DNA, 75 bp, Artificial Sequence
  Synthetic
tcttttatgtccatgggtctctgctgtgatgaatctcatcaggggacaggattccaccgcctctttactcaatgt

SEQ ID NO: 222988 - DNA, 75 bp, Artificial Sequence
  Synthetic
cagcaatcttgaactttcaggcttccttgccacataatcacatggattcaagtgtttaaggcctgaattcccagt

SEQ ID NO: 222989 - DNA, 75 bp, Artificial Sequence
  Synthetic
gagaatgtcatcatcgtcatcaagggtttcataaagttcagagaattctttgattaagtctctggggttgatcct

SEQ ID NO: 222990 - DNA, 75 bp, Artificial Sequence
  Synthetic
gttttttcctttcacaggttctgctaagacccaaacacccaactcaaaagaattgctcagtgagatgcaaatgta

SEQ ID NO: 222991 - DNA, 75 bp, Artificial Sequence
  Synthetic
ctgaaagtttcttttgagtttcccatttgtcaagtctcttctgaacctgctgaagagagagtttatgccaaagac

SEQ ID NO: 222992 - DNA, 75 bp, Artificial Sequence
  Synthetic
atcccagagaaggggtcttagaaggctaatgtggtcacgatgagcttctgggtgattttgtctgtcacagatgta

SEQ ID NO: 222993 - DNA, 75 bp, Artificial Sequence
  Synthetic
cacatcatcacaactcatgctgggattgatgccatcatggcacatcctcataatttcatcattgtgatatgacct

SEQ ID NO: 222994 - DNA, 75 bp, Artificial Sequence
  Synthetic
cagtgttatgccattgcatttctgaacccttgtcacatgctcatccataatcaagtcctcgagtattttctttat

SEQ ID NO: 222995 - DNA, 75 bp, Artificial Sequence
  Synthetic
tgcatcttttaagactttcatggagtccataccagaacgcttatcaatggtggtcttaagagactcacagagcct

SEQ ID NO: 222996 - DNA, 75 bp, Artificial Sequence
  Synthetic
gaacaaattctttctatttttattcctcacacatctacttcccagagttttacagagacctataaaaccagatga

SEQ ID NO: 222997 - DNA, 75 bp, Artificial Sequence
  Synthetic
gaagtactcagactcttcaaacactttctcatcctggctggaatattccaaaagtttaaatagaaggtctctaaa

SEQ ID NO: 222998 - DNA, 75 bp, Artificial Sequence
  Synthetic
aatgcagctttgaaaggctgacttgttaattgcctctgatagtaacttctgtgcacctcttgtgaatttgctgca

SEQ ID NO: 222999 - DNA, 75 bp, Artificial Sequence
  Synthetic
cttaaaatttacccactccggcatgaaagtattgtcataatcacaacggccatctactattggaactagtgtgat

SEQ ID NO: 223000 - DNA, 75 bp, Artificial Sequence
  Synthetic
aagcttgttctgaagtgtcttaatcagtgaggggattctttcctcctgaaaagtcattactgatgggtacaccac

SEQ ID NO: 223001 - DNA, 75 bp, Artificial Sequence
  Synthetic
gcctgcaacagcaaggtcttccttgatgcttgctaacttgttggtgtcttctatgaattttctttcaaaactcgc

SEQ ID NO: 223002 - DNA, 75 bp, Artificial Sequence
  Synthetic
tttctgcctcaagaccatcctcaatgggaacatctcattcaggtttaaccaattgatgtttgttaactcatctaa

SEQ ID NO: 223003 - DNA, 75 bp, Artificial Sequence
  Synthetic
cggtgtgcttctaacaaaacactcaagaaggatgagggaattatcaatcagcttgtaaccatcagggatgatgag

SEQ ID NO: 223004 - DNA, 75 bp, Artificial Sequence
  Synthetic
atctttttcaagatcaagaatgttccctaactgaaggatggccgctctcttatctctattgaataagtctaagaa

SEQ ID NO: 223005 - DNA, 75 bp, Artificial Sequence
  Synthetic
cggcaatcctgggcagacaattccagaatctatcagaattgtttcaacagacttgtcgtcatgattgtgtatgca

SEQ ID NO: 223006 - DNA, 75 bp, Artificial Sequence
  Synthetic
aaattcctcattgaactcaccatttttgagcttgtggtgcaacttcctcacaagctttctcatgatctttgtttc

SEQ ID NO: 223007 - DNA, 75 bp, Artificial Sequence
  Synthetic
accacttttgtctgcgctgtctatttctatacaacgtgacagcaatttgagcccttcaaccaacaccatcctggg

SEQ ID NO: 223008 - DNA, 75 bp, Artificial Sequence
  Synthetic
actaggacataattcttcaatgagcctttgaattcgataacctctggaaccatcaagccaatccttcacgtcagt

SEQ ID NO: 223009 - DNA, 75 bp, Artificial Sequence
  Synthetic
ctctctttgtcctagaaaattgagtttctgtcttgatagcctttcatcctgttctatgtagttcaggcataattc

SEQ ID NO: 223010 - DNA, 75 bp, Artificial Sequence
  Synthetic
gttggtattcagtaaaaatggatccaaagggaagttagcatatcttaaaaggactaatgtcctcctttgaatgca

SEQ ID NO: 223011 - DNA, 75 bp, Artificial Sequence
  Synthetic
cgcacagtggatcctaggctttttggattgcgctttcctccaggtcaactgagtgtggggctccgtctcgtcaga

SEQ ID NO: 223012 - DNA, 75 bp, Artificial Sequence
  Synthetic
agttcaggcataattctctcaattctgaaatggtctcatccattgcgcatcaaaaagcctaggatccactgtgcg

SEQ ID NO: 223013 - DNA, 75 bp, Artificial Sequence
  Synthetic
atttactaaagaaactgggacaccatttgcaacagcttgatcagcgattgtgtctattgtttcacaaagttgatg

SEQ ID NO: 223014 - DNA, 75 bp, Artificial Sequence
  Synthetic
ggatgggtcagatagtcacaatgtttgaggctttgcctcacatcattgatgaagtgatcaacattgtcatcattg

SEQ ID NO: 223015 - DNA, 75 bp, Artificial Sequence
  Synthetic
cggctctttacacttcacattgtgtagcgctgcagacacaaactttgtgagaagagggacctcttctccccacac

SEQ ID NO: 223016 - DNA, 75 bp, Artificial Sequence
  Synthetic
tgctcattataattaccagtattaaagcggtgtataactttgccacctgcggagtactggcactgatcagctttc

SEQ ID NO: 223017 - DNA, 75 bp, Artificial Sequence
  Synthetic
ataaaatctagatttgaattctgcagcgaacctcccaaccacacttttgggactgatgaatttgttcaataaacc

SEQ ID NO: 223018 - DNA, 75 bp, Artificial Sequence
  Synthetic
tccttttggctggaagatcttgtggaatgtatggcgtcagtgggcccgacatttacaaggggatttatcagttca

SEQ ID NO: 223019 - DNA, 75 bp, Artificial Sequence
  Synthetic
actcaagtgggaatgaaactccaacaacacaagaacttcctccgggtcactgtcaaccaactcacttattctttt

SEQ ID NO: 223020 - DNA, 75 bp, Artificial Sequence
  Synthetic
agtcagtggagtttgacatgtctcatttaaacctgacgatgcccaatgcatgttcggctaacaactctcaccact

SEQ ID NO: 223021 - DNA, 75 bp, Artificial Sequence
  Synthetic
atcgaacaaggtgatttgatcatcacttgatgtgtaggtgtctggtctttctccgaagataacaccaatacaata

SEQ ID NO: 223022 - DNA, 75 bp, Artificial Sequence
  Synthetic
acatcagcatgggaacttctgggctggaattgaccttcacgaacgactccatcattgctcacaaccactgcaatc

SEQ ID NO: 223023 - DNA, 75 bp, Artificial Sequence
  Synthetic
gttaatgaacctctcactaatcaaaccataaaaatcagaagcattgtgcaagattccctgtcccatgtcaatgag

SEQ ID NO: 223024 - DNA, 75 bp, Artificial Sequence
  Synthetic
tgacttctgctttcaataagaaaacctttgatcacacacttatgagcattgtctccagcctgcacctcagtatac

SEQ ID NO: 223025 - DNA, 75 bp, Artificial Sequence
  Synthetic
actagatatgtgggatggtactattcccatttcaaaatattctctaaagattctttccgtaatggttgtctgcga

SEQ ID NO: 223026 - DNA, 75 bp, Artificial Sequence
  Synthetic
gaggaaactccaactacaaggcagtgtcttgtgattttaacaatggcattactattcagtacaatctgacatttt

SEQ ID NO: 223027 - DNA, 75 bp, Artificial Sequence
  Synthetic
acctctaagaagcttcagttttgtttttacatatgacttcatcattgcatttacaacagggaaagggacttcaac

SEQ ID NO: 223028 - DNA, 75 bp, Artificial Sequence
  Synthetic
cagacgcacaaagtgctcttagtcagtgcagaacctttagaggaagagtcttggacatgttcagaactgcctttg

SEQ ID NO: 223029 - DNA, 75 bp, Artificial Sequence
  Synthetic
aagtttgtgcatatgccaagttaacagggtgctaacatggtcctttccagaacgtacgtattgatcatcacccaa

SEQ ID NO: 223030 - DNA, 75 bp, Artificial Sequence
  Synthetic
gtggaaagtttatgaggagtggctggggttggacaggctcagatggcaaaacaacctggtgcagccaaacaagct

SEQ ID NO: 223031 - DNA, 75 bp, Artificial Sequence
  Synthetic
tttgagattttgaaggagcattaagaacaaaaatgggcacatcattggcccccacttactatgatccatactgta

SEQ ID NO: 223032 - DNA, 75 bp, Artificial Sequence
  Synthetic
atcaatacttgatcatacaaaacagaacttgggaaaaccattgcaagtacgcaggtccttttgggatatctagaa

SEQ ID NO: 223033 - DNA, 75 bp, Artificial Sequence
  Synthetic
gttcaagaacccctctcgcacattgatggtcattgataagatcgcattttcaaattctttgtcattgttcaaaca

SEQ ID NO: 223034 - DNA, 75 bp, Artificial Sequence
  Synthetic
ttctctttgctcaggaaaagacaaaatttcttaccagaaggcttcaaggcaccttcacctggacattgtcggact

SEQ ID NO: 223035 - DNA, 75 bp, Artificial Sequence
  Synthetic
ggaacctgagaagaaactagaaaaagactcaaaataatcttctattagtcttgtaaacatctttgtcctcaaatc

SEQ ID NO: 223036 - DNA, 75 bp, Artificial Sequence
  Synthetic
cttcagggacagagaatccaggtggttattgcttgacaaaatggatgatccttgctgcagaactcaaatgttttg

SEQ ID NO: 223037 - DNA, 75 bp, Artificial Sequence
  Synthetic
tccaatataaagctctctatttcccccaacctgctccttataagatagtgcaaattttaatcttccagagtcagg

SEQ ID NO: 223038 - DNA, 75 bp, Artificial Sequence
  Synthetic
ggaacacagcagttgcaaaatgcaacatcaatcatgatgaagagttctgtgacatgctacgactgattgattata

SEQ ID NO: 223039 - DNA, 75 bp, Artificial Sequence
  Synthetic
acccactgaagtgtaagatgttggtgactcttctgagtaaaaacacaaattcttcaaagcagcactcatacactt

SEQ ID NO: 223040 - DNA, 75 bp, Artificial Sequence
  Synthetic
acaaggctgctctgagcaaattcaaggaggatgtggaatctgctttacacctgtttaagacaacagtgaactctc

SEQ ID NO: 223041 - DNA, 75 bp, Artificial Sequence
  Synthetic
tgtcaatgacaaagccttgctcaatgactcagaattgctttccctttcactaattcttacatcttcttctaattt

SEQ ID NO: 223042 - DNA, 75 bp, Artificial Sequence
  Synthetic
taatttctgaccaactactaatgaggaatcacttaagagatttgatgggagtgccatactgcaattactcaaaat

SEQ ID NO: 223043 - DNA, 75 bp, Artificial Sequence
  Synthetic
gtcccagtcaaacttaaaattcaagctctgcctttgcatatgtctgtactttcctgagtacgcatttgcattcat

SEQ ID NO: 223044 - DNA, 75 bp, Artificial Sequence
  Synthetic
tctggtacttggaacatgcaaagactggcgagactagtgtccccaagtgctggcttgtcaccaatggttcttact

SEQ ID NO: 223045 - DNA, 75 bp, Artificial Sequence
  Synthetic
ctgcaatagaatcatcttcatgcatgagaaccaatcactttctgaaaagaatttcctacagaggttctttgccat

SEQ ID NO: 223046 - DNA, 75 bp, Artificial Sequence
  Synthetic
taaatgaaacccattttagtgaccaaatcgagcaggaagcagataacatgatcacagatatgttgagaaaggatt

SEQ ID NO: 223047 - DNA, 75 bp, Artificial Sequence
  Synthetic
ttcatccaggccacattgttctttaagtgatgaggtgaaatacaatggtgacaactctgtggagctctcaatagc

SEQ ID NO: 223048 - DNA, 75 bp, Artificial Sequence
  Synthetic
atataaaaaggcaaggaagcacccccttggccttgatggacctcttgatgttttctacatcagcatatctggtca

SEQ ID NO: 223049 - DNA, 75 bp, Artificial Sequence
  Synthetic
ttcacacacaaacttcatatcatcattagtgagacaggatggatcaaaatcttccactaaatgaaacgatagctc

SEQ ID NO: 223050 - DNA, 75 bp, Artificial Sequence
  Synthetic
gcatttttctgcatcttgtgaaaataccaacacacagacacattaagggtggctcatgcccaaaaccacatcgtt

SEQ ID NO: 223051 - DNA, 75 bp, Artificial Sequence
  Synthetic
tgataaaatgaccttcctcaagtgagccatttttccctttaaaacagtctgaagatgatgtagtcctttagcatt

SEQ ID NO: 223052 - DNA, 75 bp, Artificial Sequence
  Synthetic
tgacgaacaaggggatttgtagttgtggtgcttttaaggtacctggtgtaaaaactgtttggaagagacgctaaa

SEQ ID NO: 223053 - DNA, 75 bp, Artificial Sequence
  Synthetic
tttgagtccttcctcacttccccattcattggccttcttgcctcttctatactgtattattgtggagttgacctt

SEQ ID NO: 223054 - DNA, 75 bp, Artificial Sequence
  Synthetic
ctcgaaagaggtggagagtcagggaggcccagagggtcttagagtgtcacaacatttgggcctctgaagatcaga

SEQ ID NO: 223055 - DNA, 75 bp, Artificial Sequence
  Synthetic
gtcctctagatttctaaaaaaacttgtttcttcttccccttcaaaacacatgctaactggttcttcctctggtct

SEQ ID NO: 223056 - DNA, 75 bp, Artificial Sequence
  Synthetic
tcatgtggtaggatgttatgaacagtcttcaaatcagggagttttgctttggaagcactctcaaagatgatacag

SEQ ID NO: 223057 - DNA, 75 bp, Artificial Sequence
  Synthetic
ctctgctcttgcctccttagaaccaatgaccaatttagagaccagctttgaaaccttgtactcatagtctgaatg

SEQ ID NO: 223058 - DNA, 75 bp, Artificial Sequence
  Synthetic
tccataagtgcgcagtgcggggtgatctctttcttcttcttatcctttactattccagtgtgcattttgcacagc

SEQ ID NO: 223059 - DNA, 75 bp, Artificial Sequence
  Synthetic
tttcagcttaaatttttgttttctcataaagccctcgctaatctggcttacagcactgacaagcagcttgttgaa

SEQ ID NO: 223060 - DNA, 75 bp, Artificial Sequence
  Synthetic
caaccatacctgtcccacactttgtcctcatattcccttgaagcttccttggacatctcaacatcaatgagttta

SEQ ID NO: 223061 - DNA, 75 bp, Artificial Sequence
  Synthetic
atcatattctagaagccgctccccattcaaatgtttattcacaaccacacttttattgctggcaagatccagtgc

SEQ ID NO: 223062 - DNA, 75 bp, Artificial Sequence
  Synthetic
atgtcccttctattctgtgagtccaagagctttctgatatcgtcagaaccctggcaactcagaaccattccttgt

SEQ ID NO: 223063 - DNA, 75 bp, Artificial Sequence
  Synthetic
cgttgcacagccagagttggtcatggggtccaggctattaagctttttctctcctttgaagatcagggtgccatt

SEQ ID NO: 223064 - DNA, 75 bp, Artificial Sequence
  Synthetic
ggaagagcaccaatgactgatgatgtcaacccaggttgtgcgttgaagagatcagtgaggtccatgccatgtgaa

SEQ ID NO: 223065 - DNA, 75 bp, Artificial Sequence
  Synthetic
attgaatgaggaaaccatcaggctaaaaacttccaaattgacacctggggttgtttcctgacaattagtttcttt

SEQ ID NO: 223066 - DNA, 75 bp, Artificial Sequence
  Synthetic
tacttggaatcttgtttaaattgcttttgatcagtcggttctctataaaagtgtataaattgcccattttgtggt

SEQ ID NO: 223067 - DNA, 75 bp, Artificial Sequence
  Synthetic
actggtgaacctcttcatttgttcatagaaaacacactcttcttcaggagtaattgcttccttaggattgatgaa

SEQ ID NO: 223068 - DNA, 75 bp, Artificial Sequence
  Synthetic
tggaatattgcgatctccactggatcattaaatctgccttcaatgtcaatccatgtgggggcattggggtcaatt

SEQ ID NO: 223069 - DNA, 75 bp, Artificial Sequence
  Synthetic
gaaaccgaactgacttttaggttcaaagaacttttcaaaacactttatctgatctgtcagcctatcaggagtctc

SEQ ID NO: 223070 - DNA, 75 bp, Artificial Sequence
  Synthetic
cctcccatgaggtctttcaacaacattgtttgactgtagctcaagcccacttgtggtgggcctgccgccccgggt

SEQ ID NO: 223071 - DNA, 75 bp, Artificial Sequence
  Synthetic
ttttgtgatcaaatgacaaaggtaagatacattcagcatgaacttaaactttgcactcaacagcactttttcacc

SEQ ID NO: 223072 - DNA, 75 bp, Artificial Sequence
  Synthetic
accggcctgggtgagttagtcgtgggtctctcatttgtgaggtcaattgttgtgttctcccatgctctccccaca

SEQ ID NO: 223073 - DNA, 75 bp, Artificial Sequence
  Synthetic
tgtaccaaaaattgttctgatcagaaacctaagtaacctatacactattttttcagcaggtgtgatcagatcttc

SEQ ID NO: 223074 - DNA, 75 bp, Artificial Sequence
  Synthetic
actgatgttctgcaagctatgtatggccacccttcacctgagagacaaaccttatagaggatgttctcataagga

SEQ ID NO: 223075 - DNA, 75 bp, Artificial Sequence
  Synthetic
tcttaatttgtccatcaatgatgtagatgagaaatctgacactatggccatcaccaaatatctaatattttggac

SEQ ID NO: 223076 - DNA, 75 bp, Artificial Sequence
  Synthetic
tttctatctccaacttgatctgacacaaacatgttgagtttctttttaactccaaggactgctttcagaaggtct

SEQ ID NO: 223077 - DNA, 75 bp, Artificial Sequence
  Synthetic
ttgtttttgatttctctttgtcgggttggtgagcataagtaagagcagagtccttgaagcagtttcaatgtcaag

SEQ ID NO: 223078 - DNA, 75 bp, Artificial Sequence
  Synthetic
tcactattgcttggtttaatcaggatagactctaacatattgcccccgtctagcaaagccgctcctgctttcaca

SEQ ID NO: 223079 - DNA, 75 bp, Artificial Sequence
  Synthetic
gagatgatctctcaaatcaggacatgatctgatccaagaaatcatcgtatcaatcatactgtgcagcacttcatc

SEQ ID NO: 223080 - DNA, 75 bp, Artificial Sequence
  Synthetic
gcagcaccaagactgaagttgtagccagaaatgttgatgctagattgttgctcagtgatgacccccaaaactggg

SEQ ID NO: 223081 - DNA, 75 bp, Artificial Sequence
  Synthetic
cgagaaaattggtagaaagaaccttttcgggtctgcgtaaaaggaaatcaagtgaccacctgggccctgtatgga

SEQ ID NO: 223082 - DNA, 75 bp, Artificial Sequence
  Synthetic
tgcttgtccttcaacctctcaagatcattgaggtttgggtacttgaccgtgtagagcaggccaagatctgtgagt

SEQ ID NO: 223083 - DNA, 75 bp, Artificial Sequence
  Synthetic
gtagcaccttgaacattctccagttttttgatacagtaggtgatattcttcagaatccatttttatcacttgaca

SEQ ID NO: 223084 - DNA, 75 bp, Artificial Sequence
  Synthetic
gcctgtacaacatcattgagtggggtctgtgactgtttggccatacaggccattgttaggctgggcattgtgcca

SEQ ID NO: 223085 - DNA, 75 bp, Artificial Sequence
  Synthetic
aaacacttctttgcactccaccacttgataccttccagaccctaattgattttgtctcagcctggcaactgaact

SEQ ID NO: 223086 - DNA, 75 bp, Artificial Sequence
  Synthetic
aattggttattcaaaagtgatgagtccttcacatcccagaccctcaccacaccatttgcaccttgctggggtctt

SEQ ID NO: 223087 - DNA, 75 bp, Artificial Sequence
  Synthetic
tgttttcatgctgtttgtcaaagctaaacaaacagacgacaatcttcttaaactctgcacatcccttagctgctc

SEQ ID NO: 223088 - DNA, 75 bp, Artificial Sequence
  Synthetic
ctcatcccaaccatttgtaggatctgggatctttggtcaagctgctgtgctgttaagttccccatatagactcca

SEQ ID NO: 223089 - DNA, 75 bp, Artificial Sequence
  Synthetic
tatttcagattggaaattgtaatcctcaaactttgtgtaatacattatggggtgagttccagttttcgtgaaatt

SEQ ID NO: 223090 - DNA, 75 bp, Artificial Sequence
  Synthetic
gaagcttgaggtctctcagacctcatgattttggccttcagcttctcgaggtcagccgcaagagacatcagctcc

SEQ ID NO: 223091 - DNA, 75 bp, Artificial Sequence
  Synthetic
cttaaactcagtgaatgatacacggcactcatgttcaagggaatcagacaacccgtagtgttcaaaactaagtcc

SEQ ID NO: 223092 - DNA, 75 bp, Artificial Sequence
  Synthetic
tctgcactgagtctccctacctttaaaacattcttttttgatgttgatctcaattctacaagagaatagacagtt

SEQ ID NO: 223093 - DNA, 75 bp, Artificial Sequence
  Synthetic
caccagtgacagacaatttttgattttcttaataaagccattcaaagatgtgctgaacaattcctcaaggggcac

SEQ ID NO: 223094 - DNA, 75 bp, Artificial Sequence
  Synthetic
tggttgagacttctcagtctctgtaaatccttgtcatctctcttttctttcctcatgattctctgaacattacta

SEQ ID NO: 223095 - DNA, 75 bp, Artificial Sequence
  Synthetic
tcctttgcaaacccttgatcttcttctgttcctcagaagcctaataaattcttccttggtgctctgaaagcttac

SEQ ID NO: 223096 - DNA, 75 bp, Artificial Sequence
  Synthetic
acctcagagaagtccaatccattcagaaggctggttgcatctttgatcacagcagctttcacatcggatgtgaag

SEQ ID NO: 223097 - DNA, 75 bp, Artificial Sequence
  Synthetic
taatctatcattcacgctactgtaacaacaacctacccagtgtttctcactttctgagcctttagatctagattg

SEQ ID NO: 223098 - DNA, 75 bp, Artificial Sequence
  Synthetic
ctctgtagctccctcctcagtgcctgagtccactgaaagcttttgatctctttggacaaagacattttgtcactc

SEQ ID NO: 223099 - DNA, 75 bp, Artificial Sequence
  Synthetic
cttgatcagtgaagaaaggcacaaaacatccagattcaacaattgcctccttctggtgttcagcaatttcaagct

SEQ ID NO: 223100 - DNA, 75 bp, Artificial Sequence
  Synthetic
ttggacaaagacattttgtcactcaatgaattcctaagacaaatgcgcaatcaaatgcctaggatccactgtgcg

SEQ ID NO: 223101 - DNA, 75 bp, Artificial Sequence
  Synthetic
cgcacagtggatcctaggcattttgttgcgctattttatagtgcagatttctcttgtaggaccatcataaacaag

SEQ ID NO: 223102 - DNA, 75 bp, Artificial Sequence
  Synthetic
tttgactttgttcaacatcgaaaggagcctttcatactcagcactggtctcattccttctttgatgcccatgagt

SEQ ID NO: 223103 - DNA, 75 bp, Artificial Sequence
  Synthetic
ccaagccatcacccatgggccaaggcaagtccaagatggagagggacagcagcaacatgaacagggctgagattc

SEQ ID NO: 223104 - DNA, 75 bp, Artificial Sequence
  Synthetic
ctttgctgtgatgaacttcattaaggggcaggattcaactgcctctttgcttaatttcagaatgtcatcatcatc

SEQ ID NO: 223105 - DNA, 75 bp, Artificial Sequence
  Synthetic
tgccggacaccacctaccttggccctctgaactgcaagtcatgctggcaaagatttgatagtttggttagatgcc

SEQ ID NO: 223106 - DNA, 75 bp, Artificial Sequence
  Synthetic
ggtgagggtcccataaagctcagagaattctctgatcaagtcttcagggttgatcttctgaaagtttcttctaag

SEQ ID NO: 223107 - DNA, 75 bp, Artificial Sequence
  Synthetic
atgaccactatctctgcagacactgtctaaatctcctgctgtcagtctctgacagatgccctctctgcaaacatc

SEQ ID NO: 223108 - DNA, 75 bp, Artificial Sequence
  Synthetic
gctcccactttccagatccctcctaaatctgctaaaaagtgaattgatgccaaaaactacatcatcagagctcat

SEQ ID NO: 223109 - DNA, 75 bp, Artificial Sequence
  Synthetic
cactgccgaccaaactgcgggtgtcaacagctccgagctcacctcccccctacgaggagtgacacaagagaccca

SEQ ID NO: 223110 - DNA, 75 bp, Artificial Sequence
  Synthetic
gttggggctgacaccatcatgacacatcttcatgatttcatcgttatgagttgatcttgcgtctttcagaatcct

SEQ ID NO: 223111 - DNA, 75 bp, Artificial Sequence
  Synthetic
cacgcagaccaacacacacacacccagcacccctcacagaacacgaacacaaacacccaaacacacacccacacc

SEQ ID NO: 223112 - DNA, 75 bp, Artificial Sequence
  Synthetic
catggaatccatgccagagcgtttatcgacagtggttttgagagactcacaaagtctgaagtattcacattcctc

SEQ ID NO: 223113 - DNA, 75 bp, Artificial Sequence
  Synthetic
cacacgcccccaaccaggggggcgccccccccggggggcggcccccccgggggcccgggcggagccccacgggga

SEQ ID NO: 223114 - DNA, 75 bp, Artificial Sequence
  Synthetic
aaaaaccctctcatcctggctagaatactccaagagcttaaataagagatccctgaatttaaagttcacccactc

SEQ ID NO: 223115 - DNA, 75 bp, Artificial Sequence
  Synthetic
gacccatcactcgatctcctccaccatcatcccagccagccaatcctcacaagacttccccttgagtctgaacct

SEQ ID NO: 223116 - DNA, 75 bp, Artificial Sequence
  Synthetic
tggcataaagctgttgtcataatcacaacgaccatcgactattggaactagtgtgatgcctgcaatggcgaggtc

SEQ ID NO: 223117 - DNA, 75 bp, Artificial Sequence
  Synthetic
acctccaactgtctcatacattattgtgttttttgatttgctaaagcagagtctacagtccttgaaggtgaacca

SEQ ID NO: 223118 - DNA, 75 bp, Artificial Sequence
  Synthetic
ctccttgatgcatgccaacttgttggtgtcctctataaatttcttctcaaaactagccggtgtgcttctaacaaa

SEQ ID NO: 223119 - DNA, 75 bp, Artificial Sequence
  Synthetic
gtctggcacagacgacaatggtactaacagaacagatctgtctatgcacaactcttgcaaaattgtgcttatttc

SEQ ID NO: 223120 - DNA, 75 bp, Artificial Sequence
  Synthetic
acattccagaagaattagggaattatcaatcagcttataaccatcaggaatgatgagaggcagccctgggcacac

SEQ ID NO: 223121 - DNA, 75 bp, Artificial Sequence
  Synthetic
cgacccctgtagatgctcaccagttctaaatcgatgtagtagaagacttccgaggacgtcaccgattttctcata

SEQ ID NO: 223122 - DNA, 75 bp, Artificial Sequence
  Synthetic
aattccggactcgactaagatcgtttcaacagacttatcatcgtggttgtgtgtgcaaccactcttgtctgcact

SEQ ID NO: 223123 - DNA, 75 bp, Artificial Sequence
  Synthetic
gccttcaagctctgccaaaaaaactctcatatccttagtctccaatttcacaacgatgttttggacaaggttcct

SEQ ID NO: 223124 - DNA, 75 bp, Artificial Sequence
  Synthetic
atctatttctatacagcgtgataacagtttcagcccctcaatcaacaccatcctgggctccctttgccccaggaa

SEQ ID NO: 223125 - DNA, 75 bp, Artificial Sequence
  Synthetic
tccctcaaagagagcacccgtcttcacagtcagaggcacaggctcccattcaggcccaattctctcaaaatcaag

SEQ ID NO: 223126 - DNA, 75 bp, Artificial Sequence
  Synthetic
gttgagtttctgtcttgataacctctcatcctgctctatatagttcaggcacagctctctcaattctgaaattgt

SEQ ID NO: 223127 - DNA, 75 bp, Artificial Sequence
  Synthetic
ggacttgatcccgtccagtatttttctggagcctgttaactcaagctcaagagagtctccgagtatcaaggggtc

SEQ ID NO: 223128 - DNA, 75 bp, Artificial Sequence
  Synthetic
cgcaccggggatcctaggctttttggattgcgctttcctctagatcaactgagtgctgaactctgccaagcagag

SEQ ID NO: 223129 - DNA, 75 bp, Artificial Sequence
  Synthetic
agttcaggcacagctctctcaattctgaaattgtctcatccattgcgcatcaaaaagcctaggatccacggtgcg

SEQ ID NO: 223130 - DNA, 75 bp, Artificial Sequence
  Synthetic
agttcaggcacagctctctcaattctgaaattgtctcatccattgcgcatcaaaaagcctaggatcctcggtgcg

SEQ ID NO: 223131 - DNA, 75 bp, Artificial Sequence
  Synthetic
agttcaggcacagctctctcaattctgaaattgtctcatccattgcgcatcaaaaagcctaggatccccggtgcg

SEQ ID NO: 223132 - DNA, 75 bp, Artificial Sequence
  Synthetic
agttcaggcacagctctctcaattctgaaattgtctcatccattgcgcatcaaaaagcctaggatccgcggtgcg

SEQ ID NO: 223133 - DNA, 75 bp, Artificial Sequence
  Synthetic
ctccatgtagtcctcaaattcttcagacctaatgtcgaaaacaccatcatttaccttgaagatagggtctgttct

SEQ ID NO: 223134 - DNA, 75 bp, Artificial Sequence
  Synthetic
agatgggccaaattgtgacaatgttcgaggctttgcctcacataattgacgaagtcatcaatattgtcattattg

SEQ ID NO: 223135 - DNA, 75 bp, Artificial Sequence
  Synthetic
caataagtggaggcactcatctaacaatctcctgtccacttcgcctttaaaaaggtgagaacaagataagaactt

SEQ ID NO: 223136 - DNA, 75 bp, Artificial Sequence
  Synthetic
tactcatcataatcacgagcatcaaagctgtgtacaattttgccacttgtgggatactcgcactggtcagcttcc

SEQ ID NO: 223137 - DNA, 75 bp, Artificial Sequence
  Synthetic
agccacacctgggctttgcaattgacatcttaccaaaaaaatcaatgaaaactttctcaagcaatcagtattgtt

SEQ ID NO: 223138 - DNA, 75 bp, Artificial Sequence
  Synthetic
tctttctggctggcaagtcttgtgggatgtatggtcttgatggacctgacatttacaaaggggtttatcaattca

SEQ ID NO: 223139 - DNA, 75 bp, Artificial Sequence
  Synthetic
ctgattgtgtgtgaagtccactgtgactgaaaactccaacactccctttgtgttgtttatcatgtagtcccacaa

SEQ ID NO: 223140 - DNA, 75 bp, Artificial Sequence
  Synthetic
agtcagtagagtttgacatgtcccacttgaacctgactatgcccaatgcatgctcagccaacaactctcaccact

SEQ ID NO: 223141 - DNA, 75 bp, Artificial Sequence
  Synthetic
atctcttaaagatttgaatgctttcggattcaccaaaccctgtttgattagcatagctgcattgcacacaatgtc

SEQ ID NO: 223142 - DNA, 75 bp, Artificial Sequence
  Synthetic
acatcagtatggggaaatctggactggagctgacctttaccaatgactccatcctcaatcacaaccactgcaatt

SEQ ID NO: 223143 - DNA, 75 bp, Artificial Sequence
  Synthetic
ccctaagcgataagagaaccatccgaagccaaactgcaaatcgttcctaaacataggcctttccacatttttgtt

SEQ ID NO: 223144 - DNA, 75 bp, Artificial Sequence
  Synthetic
tgacttctgcctttaacaagaagacctttgaccacacactcatgagcatagtctcaagtctacacctcagcatca

SEQ ID NO: 223145 - DNA, 75 bp, Artificial Sequence
  Synthetic
caccactttcaagatgaatgactgaaagggccccaatgcttcagcaccatcttcagatggcatcatgtctttgtg

SEQ ID NO: 223146 - DNA, 75 bp, Artificial Sequence
  Synthetic
gagggaactcaaactacaaggcagtatcctgtgatttcaacaatggcatcaccattcagtacaatttaacatttt

SEQ ID NO: 223147 - DNA, 75 bp, Artificial Sequence
  Synthetic
agggaaccatgagaaacttcctagagtcctggctgttgcaacaaattctcgtacaaaggactcgaaatagacctg

SEQ ID NO: 223148 - DNA, 75 bp, Artificial Sequence
  Synthetic
cagatgcacagagtgctctgagtcaatgtaggacttttagaggcagggtcttagacatgttcagaactgcttttg

SEQ ID NO: 223149 - DNA, 75 bp, Artificial Sequence
  Synthetic
ttttaaaaagttcttgcagacatcccttgtgctaacaacaaattcatcaaccaagcttgaatcggaacgttgatg

SEQ ID NO: 223150 - DNA, 75 bp, Artificial Sequence
  Synthetic
gcgggaagtacatgagaagtggatggggctgggcaggttcagatggcaaaaccacttggtgcagtcagacaagct

SEQ ID NO: 223151 - DNA, 75 bp, Artificial Sequence
  Synthetic
agaacttacaaggtcagaaaataaaacagtgtagtgttcatccctcttccacttaacaacatgagatatgagtga

SEQ ID NO: 223152 - DNA, 75 bp, Artificial Sequence
  Synthetic
accagtacctgatcatacaaaatagaacctgggaaaaccactgcacgtatgcaggtcctttcgggatatccagag

SEQ ID NO: 223153 - DNA, 75 bp, Artificial Sequence
  Synthetic
tagggattctgagttgatatcaattagtacacagagatcaaggaacttgatcctggggctccacctcatattttt

SEQ ID NO: 223154 - DNA, 75 bp, Artificial Sequence
  Synthetic
tcctttttgctcaggagaagacaaagtttctcaccagaagactagcaggtacattcacttggaccttgtcagact

SEQ ID NO: 223155 - DNA, 75 bp, Artificial Sequence
  Synthetic
gtttctcaccagaagactagcaggtacattcacttggaccttgtcagactcttcaggagtggaaaaccctggtgg

SEQ ID NO: 223156 - DNA, 75 bp, Artificial Sequence
  Synthetic
tgaactcatatcagacataaaaggaagtagctggtcctcatagattctgggatacaaacgccttacagattgaat

SEQ ID NO: 223157 - DNA, 75 bp, Artificial Sequence
  Synthetic
ttattgcctaaccaaatggatgatccttgccgcagaactcaaatgttttgggaacacagctgttgcaaagtgcaa

SEQ ID NO: 223158 - DNA, 75 bp, Artificial Sequence
  Synthetic
tacatggtttaaacttattttatcctccagtagccttgaactctcaggtttccttgctacataatcacatggatt

SEQ ID NO: 223159 - DNA, 75 bp, Artificial Sequence
  Synthetic
tgtcaatcatgatgaagagttttgtgacatgctgcgtctaattgattacaacaaggctgctttaagtaagttcaa

SEQ ID NO: 223160 - DNA, 75 bp, Artificial Sequence
  Synthetic
taagtgcttaaggcttaaacttacttcattctttccctttataggttctgctaagacccaaacacccaactcaaa

SEQ ID NO: 223161 - DNA, 75 bp, Artificial Sequence
  Synthetic
ggaagatgtagaatctgctttacacgtgttcaaaacaacagtgaactctctaatttctgaccagctactgatgag

SEQ ID NO: 223162 - DNA, 75 bp, Artificial Sequence
  Synthetic
tgaattactaagtgaagtgcaaatataatcccaaagaaggggcctcaaaagactaacatgatcacggtgagcttc

SEQ ID NO: 223163 - DNA, 75 bp, Artificial Sequence
  Synthetic
aaatcatttgagagacttgatgggagtgccgtactgtaattactcaaaattctggtatctggaacatgcgaagac

SEQ ID NO: 223164 - DNA, 75 bp, Artificial Sequence
  Synthetic
tgggtggctctgcttgtcacaaatatacaacattatgccatcacgcttgtagattcttgtcacatgctcatccat

SEQ ID NO: 223165 - DNA, 75 bp, Artificial Sequence
  Synthetic
tggtgaaactagtgtacccaagtgttggcttgtcaccaatggttcttacttaaatgagacccattttagtgatca

SEQ ID NO: 223166 - DNA, 75 bp, Artificial Sequence
  Synthetic
agctagatcttcaagcacctttctgatgtacagattctctctgcttttatttctcacacatctactccccaaagt

SEQ ID NO: 223167 - DNA, 75 bp, Artificial Sequence
  Synthetic
aattgagcaggaagcagataacatgatcacggagatgttgagaaaggattacataaagaggcaggggagtacccc

SEQ ID NO: 223168 - DNA, 75 bp, Artificial Sequence
  Synthetic
cttacaaaggcctataaagcctgatgaaatacagctctgaaaagctgatttgttgattgcttctgataacaactt

SEQ ID NO: 223169 - DNA, 75 bp, Artificial Sequence
  Synthetic
cttagctttaatggatcttctaatgttctctacatcggcatacctgatcagtgtttttttacaccttttgaaaat

SEQ ID NO: 223170 - DNA, 75 bp, Artificial Sequence
  Synthetic
ttgtgcacctcttgtgaacttactgcagagcttattttgtaatgtcttgatcaacgaagggattttctcttcttg

SEQ ID NO: 223171 - DNA, 75 bp, Artificial Sequence
  Synthetic
accaacacacaggcacataaaaggcggcttatgcccaaggccgcaccgtctaaccagcaaaggtatctgtagttg

SEQ ID NO: 223172 - DNA, 75 bp, Artificial Sequence
  Synthetic
gaaagtcatcactgacgggtataccactttctgcctcaaaaccattctcaatgggaacatctcatttaaatttaa

SEQ ID NO: 223173 - DNA, 75 bp, Artificial Sequence
  Synthetic
taaccagcaaaggtatctgtagttgtggtttgttcaaggtccccggtgtaaaaactgtctggaaaagacgctgaa

SEQ ID NO: 223174 - DNA, 75 bp, Artificial Sequence
  Synthetic
ccaattgatgtttgccaactggtccatatcctcctcaaaaccaaggatgtctcccaactgaaggatggcttcttt

SEQ ID NO: 223175 - DNA, 75 bp, Artificial Sequence
  Synthetic
cagcagcgcctccctgactctccacctcgaaagaggtggagagtcagggaggcccagaggcccttagagtgtcac

SEQ ID NO: 223176 - DNA, 75 bp, Artificial Sequence
  Synthetic
cttgtctctattgaaaaggtctaagaagaattcctcgttaaactcaccattcttgagtttatgatgtaatcttct

SEQ ID NO: 223177 - DNA, 75 bp, Artificial Sequence
  Synthetic
aacattgggccctctgaagatcaagtcatgtggcagaatgttgtggatggttttcaggtcagggagccttgcctt

SEQ ID NO: 223178 - DNA, 75 bp, Artificial Sequence
  Synthetic
tcatgtggcagaatgttgtggatggttttcaggtcagggagccttgccttggaagcactttcaaaaatgatgcag

SEQ ID NO: 223179 - DNA, 75 bp, Artificial Sequence
  Synthetic
cacaagttttctcaccacctttgtctcattaggacataactcttcaatgagcctttgaattctataacctctgga

SEQ ID NO: 223180 - DNA, 75 bp, Artificial Sequence
  Synthetic
tccatgagtgcacagtgtggggtgatctctttcttcttcttgtcctttactattccagtgtgcatcttacacagc

SEQ ID NO: 223181 - DNA, 75 bp, Artificial Sequence
  Synthetic
gccatctagccagtccttaacatcagtattggtgtttagtaaaaatggatccaaaggaaagttagcgtatctcaa

SEQ ID NO: 223182 - DNA, 75 bp, Artificial Sequence
  Synthetic
caaccgtatttgtcccacaccttatcttcgtactctcttgaggcctctctggtcatctcaacatcaatgagtttt

SEQ ID NO: 223183 - DNA, 75 bp, Artificial Sequence
  Synthetic
gaggtccaatgtcctcctctggatgcagtttactaacgaaaccggaacaccattcgcaatggcttgatcagcaat

SEQ ID NO: 223184 - DNA, 75 bp, Artificial Sequence
  Synthetic
atatcccttctattctgtgaatctaggagttttctgatgtcatcagaaccttgacaacttaggaccatcccttgt

SEQ ID NO: 223185 - DNA, 75 bp, Artificial Sequence
  Synthetic
cgtgtctattgtctcacagagttggtgtggctccttgcacttaacattatgcaatgctgctgacacaaactttgt

SEQ ID NO: 223186 - DNA, 75 bp, Artificial Sequence
  Synthetic
ggaagtgcacctataactgatgaagtcagcccaggttgcgcattgaaaagatcagcaagatccataccgtgtgag

SEQ ID NO: 223187 - DNA, 75 bp, Artificial Sequence
  Synthetic
gaggagcgggacctcttccccccacacataaaatctagatttaaattctgcagcaaaccgccccaccacactctt

SEQ ID NO: 223188 - DNA, 75 bp, Artificial Sequence
  Synthetic
tacttagagtcttgtttgaattgtttttggtcaacaggttctctataaaagtgtatgaattgcccattttgtggt

SEQ ID NO: 223189 - DNA, 75 bp, Artificial Sequence
  Synthetic
tggactgatgaacttattcagcaaaccactcaaatgagaatgaaactctagcaggacaagaacttcttctgggtc

SEQ ID NO: 223190 - DNA, 75 bp, Artificial Sequence
  Synthetic
tggaatattgctatttccactggatcattaaatctgccttcgatgtcaatccatgtaggggcattggggtcaatc

SEQ ID NO: 223191 - DNA, 75 bp, Artificial Sequence
  Synthetic
actgtcaactaattcactaattctcttgtcaaacaaggtgatctgatcgtcacttgatgtgtaagactctggcct

SEQ ID NO: 223192 - DNA, 75 bp, Artificial Sequence
  Synthetic
cctcccataagatctttcagcagcattgtctgactgtagctcaagcccacttgaggtgggcccgccgctccaggc

SEQ ID NO: 223193 - DNA, 75 bp, Artificial Sequence
  Synthetic
ttcaccaaaaataacaccaatacaataattaatgaacctctcactgattaagccgtaaaaatcagaagcattgtg

SEQ ID NO: 223194 - DNA, 75 bp, Artificial Sequence
  Synthetic
actggtctgggtgagttagctacaggtttctcggttgtgagatcaattgttgtgttctcccatgcccttcccaca

SEQ ID NO: 223195 - DNA, 75 bp, Artificial Sequence
  Synthetic
caagattccctgtcccatgtcaatgaggctacttatgtgagaaggcactatccctaattcaaaatattctcgaaa

SEQ ID NO: 223196 - DNA, 75 bp, Artificial Sequence
  Synthetic
attgacgtcctacaagctatgtaaggccatccctcacctgaaagacaaactttgtagaggatgttttcataggga

SEQ ID NO: 223197 - DNA, 75 bp, Artificial Sequence
  Synthetic
gattctttcagtgatggttgtttctgaccccctgagaagtttcagttttgatttaacatatgacttcatcattgc

SEQ ID NO: 223198 - DNA, 75 bp, Artificial Sequence
  Synthetic
ttcctatccccaacttggtctgagacaaacatattgagttttcttttagccccaaggactgctttcagaaggtcc

SEQ ID NO: 223199 - DNA, 75 bp, Artificial Sequence
  Synthetic
attcacaacagggaaaggaacctcaacaagtttatgcatgtgccaggttagcaaggtactaacatgatccttccc

SEQ ID NO: 223200 - DNA, 75 bp, Artificial Sequence
  Synthetic
tcactgttgctcggcttaatcaggatggattccaacatattgcccccgtctagcaaagctgcccctgctttcaca

SEQ ID NO: 223201 - DNA, 75 bp, Artificial Sequence
  Synthetic
agaacgcacatactgatcatcacccagcttaagattctgaaggagcatcagaaataaaaatgggcacatcatcgg

SEQ ID NO: 223202 - DNA, 75 bp, Artificial Sequence
  Synthetic
gcagcaccaagactaaagttgtaaccagagatgttgatgctggactgctgttcagtgatgactcctaaaactggg

SEQ ID NO: 223203 - DNA, 75 bp, Artificial Sequence
  Synthetic
cccccacttgctatgatccatactgtagttcaataacccttctcgtacattgatagtcatagataggatcgcatt

SEQ ID NO: 223204 - DNA, 75 bp, Artificial Sequence
  Synthetic
tgtttgtctctcagtctttcaaggtcattgaggtttgggtatttaactgtgtagagcaggccaaggtctgtgagt

SEQ ID NO: 223205 - DNA, 75 bp, Artificial Sequence
  Synthetic
ttcaaactctttgtcattgttcaaacatgaacccgagaaaaagctggaaaaggattcaaaataatcctctattag

SEQ ID NO: 223206 - DNA, 75 bp, Artificial Sequence
  Synthetic
gcctgcacaacatcattgagtggagtctgtgattgtttagccatgcaggccattgttaggcttggcatcgtgccg

SEQ ID NO: 223207 - DNA, 75 bp, Artificial Sequence
  Synthetic
ccttgtaaacatttttgttcttaagtccccaatatagagttccctatttcctcccacttgctccttgtatgacaa

SEQ ID NO: 223208 - DNA, 75 bp, Artificial Sequence
  Synthetic
aattgattgttcagaagtgaagagtccttcacatcccagaccctcaccactccgtttgcactctgctgaggtctc

SEQ ID NO: 223209 - DNA, 75 bp, Artificial Sequence
  Synthetic
tgcaaacttcagccttccagaatcaggaccgactgaagtgtaggacgttggtgattcctctgaataaaagcacag

SEQ ID NO: 223210 - DNA, 75 bp, Artificial Sequence
  Synthetic
ctcatcccaaccatttgcaagatttgagacctttgatcaagttgttgtgctgttaaatttcccatgtaaactccc

SEQ ID NO: 223211 - DNA, 75 bp, Artificial Sequence
  Synthetic
attttttaaagcagcactcatacattttgtcattgataaagctttacttagagactcagaattgctttccctttc

SEQ ID NO: 223212 - DNA, 75 bp, Artificial Sequence
  Synthetic
gaagtctgaggcctctcagatctcataatctttgcttttaacttctcaaggtcagctgcaagagacatcaattcc

SEQ ID NO: 223213 - DNA, 75 bp, Artificial Sequence
  Synthetic
actaattctcacgtcttcttctaatttatcccagtcaaatttgaaattaaggccctgcctctgcatgtgtctata

SEQ ID NO: 223214 - DNA, 75 bp, Artificial Sequence
  Synthetic
tctgcactgagtcttcccaccttcagaacattcttctttgatgtagacttcaattctacaagagaatgtacagtc

SEQ ID NO: 223215 - DNA, 75 bp, Artificial Sequence
  Synthetic
cttccctgagtatgcatttgcattcatttgtaacagaatcatcttcatgcacgaaaaccaatcactttctgaaaa

SEQ ID NO: 223216 - DNA, 75 bp, Artificial Sequence
  Synthetic
tggttgagactcctaagtctctgtaggtccttgtcatccctcttctccttcctcataatcctctgaacattgctg

SEQ ID NO: 223217 - DNA, 75 bp, Artificial Sequence
  Synthetic
gaatttcctacaaagattttgtgccatctcatcaagaccacattgccccttgactgtagaagtgaagtacaatgg

SEQ ID NO: 223218 - DNA, 75 bp, Artificial Sequence
  Synthetic
acttcagagaagtctagcccattcagaaggctggttgcgtctttgatgactgcggctttcacatctgatgtgaaa

SEQ ID NO: 223219 - DNA, 75 bp, Artificial Sequence
  Synthetic
tgacagttctgcagaagattcaacagcctcacagataaacctcatatcatcattggtgagacaggatgggtcaaa

SEQ ID NO: 223220 - DNA, 75 bp, Artificial Sequence
  Synthetic
ctctgtagttctctcctcaatgcctgtgtccattggaagctcttcacttctttggacaaagacatcttgtcgctc

SEQ ID NO: 223221 - DNA, 75 bp, Artificial Sequence
  Synthetic
atcttctactaggtgaaaagaaatttctgataaaatgacctttctcaaataagccattttgcctgataatatagt

SEQ ID NO: 223222 - DNA, 75 bp, Artificial Sequence
  Synthetic
ttggacaaagacatcttgtcgctcaatgagtttccaagacaaatgcgcaatcaaatgcctaggatccactgtgcg

SEQ ID NO: 223223 - DNA, 75 bp, Artificial Sequence
  Synthetic
ctgaaggtgatgtaatccccttgcatttttaagccccacctcatcctccccttcacagacctttttagtcctttc

SEQ ID NO: 223224 - DNA, 75 bp, Artificial Sequence
  Synthetic
atattgcgctttgtattgaagtctgttctgtgtggactgacctcagcacaagtgttatggggcagatcataacaa

SEQ ID NO: 223225 - DNA, 75 bp, Artificial Sequence
  Synthetic
tcgcaccggggatcctaggcttattatattgcgctttgtattgaagtctgttctgtgtggactgacctcagcaca

SEQ ID NO: 223226 - DNA, 75 bp, Artificial Sequence
  Synthetic
atactgctttattgtagagttaaccttatcttccaggttcctaaagaaacttgtctcttcttccccttcaaaaca

SEQ ID NO: 223227 - DNA, 75 bp, Artificial Sequence
  Synthetic
tgtttgaggccctgcctcacattatcgatgaggtcatcaacattgttataatagtgcttataataataacaagca

SEQ ID NO: 223228 - DNA, 75 bp, Artificial Sequence
  Synthetic
tatgtccaccgaaccaccatccaatttccctgcttctgtctctttggaacccatgaccaatctagatactaactt

SEQ ID NO: 223229 - DNA, 75 bp, Artificial Sequence
  Synthetic
taaaggctgtgtacaactttgctacctgtggcatcattgcattgatcagcttctgcttcttggctggaaggtctt

SEQ ID NO: 223230 - DNA, 75 bp, Artificial Sequence
  Synthetic
tgaaactttgtactcataatctaaatggttcaacttgtacttctgctttctcatgaagccttctgtaatctgact

SEQ ID NO: 223231 - DNA, 75 bp, Artificial Sequence
  Synthetic
gtggcttgtatggtgtctctggctctgacatttacaagggactctaccagttccagtccgtagagttcaacatgt

SEQ ID NO: 223232 - DNA, 75 bp, Artificial Sequence
  Synthetic
tacagcactaacgagtaacttattgaaatcatattctagaagccgttctccatttagatgcttatttacaaccac

SEQ ID NO: 223233 - DNA, 75 bp, Artificial Sequence
  Synthetic
cacaattgaatttaacaatgcccaatgcgtgctcagccaacaattcccaccattacatcagcatgggaaaatctg

SEQ ID NO: 223234 - DNA, 75 bp, Artificial Sequence
  Synthetic
tgcgtgctcagccaacaattcccaccattacatcagcatgggaaaatctggcctggaactaacctttacaaatga

SEQ ID NO: 223235 - DNA, 75 bp, Artificial Sequence
  Synthetic
acttttgttgctggcaaggtctaatgctgtcgcacacccagagttagtcatggggtccaggctattgagcctctt

SEQ ID NO: 223236 - DNA, 75 bp, Artificial Sequence
  Synthetic
gcctggaactaacctttacaaatgactccatcattcaacacaacttctgcaacctaactgatgggttcaagaaaa

SEQ ID NO: 223237 - DNA, 75 bp, Artificial Sequence
  Synthetic
ctccatcattcaacacaacttctgcaacctaactgatgggttcaagaaaaaaacctttgatcatacacttatgag

SEQ ID NO: 223238 - DNA, 75 bp, Artificial Sequence
  Synthetic
ctccccttttaaaattaaagtgccattgttgaacgaggacaccatcatgctaaaggcctctaagttaacacctgg

SEQ ID NO: 223239 - DNA, 75 bp, Artificial Sequence
  Synthetic
catagtgtcaagcctgcacctgagcattagaggaaataccatctacaaagctgtgtcctgtgacttcaacaatgg

SEQ ID NO: 223240 - DNA, 75 bp, Artificial Sequence
  Synthetic
ggttgcacgctgacagtttatttctttcccagtgaatttcttcatttgttcataaaaaatgcactcttcctcggg

SEQ ID NO: 223241 - DNA, 75 bp, Artificial Sequence
  Synthetic
gattacaatccagtacaacctaaccttctctgatgcacaaggtgccatcaatcaatgtggaaccttcagaggtag

SEQ ID NO: 223242 - DNA, 75 bp, Artificial Sequence
  Synthetic
ggtaattgattctttagggtttacaaagaaaccaaactcacctttaggttcaaagaatttttcaaaacattttat

SEQ ID NO: 223243 - DNA, 75 bp, Artificial Sequence
  Synthetic
agttttagatatgtttagaacagcttttggggggaaatacatgaggtctggctatggttggaaagactccaatgg

SEQ ID NO: 223244 - DNA, 75 bp, Artificial Sequence
  Synthetic
ttgatctgtcaacctatcaggggtttcctttgtgattaaatgacaaaaatatgacacatttaacataaacttaaa

SEQ ID NO: 223245 - DNA, 75 bp, Artificial Sequence
  Synthetic
gaagacaacctggtgcagtcaaaccaactatcaatacctaatcatacagaacaggacatgggaaaatcactgtga

SEQ ID NO: 223246 - DNA, 75 bp, Artificial Sequence
  Synthetic
cctcgcacttaatagcactctttcacttgtcttaaaaatggttttaaccaaaaaccttaacaatttatacaccac

SEQ ID NO: 223247 - DNA, 75 bp, Artificial Sequence
  Synthetic
gtatgccggtccttttggtctctcaagaattctttttgctcaggagaaaacaaagtttctcactagaagattggc

SEQ ID NO: 223248 - DNA, 75 bp, Artificial Sequence
  Synthetic
tttctcagcaggtgtaattaaattctccttcaacttgtccatcaatgatgtggacgaaaaatctgagacaatagc

SEQ ID NO: 223249 - DNA, 75 bp, Artificial Sequence
  Synthetic
agggacttttacctggacattgtcggattcttcgggaactgaaaccccaggtgggtattgtctgacaaggtggat

SEQ ID NO: 223250 - DNA, 75 bp, Artificial Sequence
  Synthetic
catcaccaaatacctaatgttttgaacctgtttttgatttctttttgttgggttggtgagcatgagcaacagtag

SEQ ID NO: 223251 - DNA, 75 bp, Artificial Sequence
  Synthetic
gctcatagctgctgatctcaagtgtttcgggaacacagcagttgccaaatgcaacatcaaccatgatgaagaatt

SEQ ID NO: 223252 - DNA, 75 bp, Artificial Sequence
  Synthetic
agttcttaatgcagtttcaatatcagcgatataatccttcaagtcaggacatgatctgatccatgaaatcatagt

SEQ ID NO: 223253 - DNA, 75 bp, Artificial Sequence
  Synthetic
ttgtgacatgttgaggttaattgactataacaaagccgctctaaagaaattcaaagaagacgtagagtctgccct

SEQ ID NO: 223254 - DNA, 75 bp, Artificial Sequence
  Synthetic
gttaatcatgctatgcaacacttcatctgaaaaaattggtaaaaagaacctctttggatctgcataaaaggaaat

SEQ ID NO: 223255 - DNA, 75 bp, Artificial Sequence
  Synthetic
tcacttgttcaaaacaactgtgaattccttaatatctgaccagttgttgatgaggaatcatctaagggatctgat

SEQ ID NO: 223256 - DNA, 75 bp, Artificial Sequence
  Synthetic
caagtgaccactagggccttgtatggaataacaccttgaagattctccagtcttttggtatagcaagtgatactc

SEQ ID NO: 223257 - DNA, 75 bp, Artificial Sequence
  Synthetic
gggcgtaccctattgcaactactcaaaattttggtacttacagcatgtaaaaacaggtgagatgagtgctcctaa

SEQ ID NO: 223258 - DNA, 75 bp, Artificial Sequence
  Synthetic
ctcaaagtccaatttcatcacttgacaaaaaacctccttgcattccaccacttgatatcttacagagcccaattg

SEQ ID NO: 223259 - DNA, 75 bp, Artificial Sequence
  Synthetic
gtgctggttggtcaccaatggctcatacctgaatgagacccattttagtgaccaaatagagcaggaggcagacaa

SEQ ID NO: 223260 - DNA, 75 bp, Artificial Sequence
  Synthetic
gttttgtctcaatctggcaactgagcttgtcttcatgctgtttgtcaaagccagacaaacagatgacagtttcct

SEQ ID NO: 223261 - DNA, 75 bp, Artificial Sequence
  Synthetic
tatgattactgaaatgcttagaaaagactacattaagaggcaaggaagcactcctttggcattaatggatctttt

SEQ ID NO: 223262 - DNA, 75 bp, Artificial Sequence
  Synthetic
caaactttgtacactttttaattgctctgtgttgggctgaaaattgtaatcttcaaactttgtgtaatacattat

SEQ ID NO: 223263 - DNA, 75 bp, Artificial Sequence
  Synthetic
gatgttttccacatcagcatatttgatcagcattttccttcatctgatgaaaatcccaacccacagacacattaa

SEQ ID NO: 223264 - DNA, 75 bp, Artificial Sequence
  Synthetic
aggatgagttcctggcctcataaagccctcgaactcaatgaatggtatatgacattcatgcttgaggagctcgga

SEQ ID NO: 223265 - DNA, 75 bp, Artificial Sequence
  Synthetic
aggcggcacatgccctaaaccacacagactaactagcaaaggcatttgtagttgtggtgcattcagagtgccagg

SEQ ID NO: 223266 - DNA, 75 bp, Artificial Sequence
  Synthetic
cagtccatagtgctcaaagctaagccccaccattgataggcatctccggatttttatgatgaattcattaataga

SEQ ID NO: 223267 - DNA, 75 bp, Artificial Sequence
  Synthetic
agtgaagacagtttggaagagacgctagacaacagcgcctccctgactctccacctctgagaggtggagagtcag

SEQ ID NO: 223268 - DNA, 75 bp, Artificial Sequence
  Synthetic
tgtttcaaacaaatcctcaagcgacactcttctacatgcccttgactttcttctgttccttaggagcctgacgaa

SEQ ID NO: 223269 - DNA, 75 bp, Artificial Sequence
  Synthetic
tagacaacagcgcctccctgactctccacctctgagaggtggagagtcagggaggccctttgagggttcagaggg

SEQ ID NO: 223270 - DNA, 75 bp, Artificial Sequence
  Synthetic
tcacaacatttggacctctgaagaccaggtcatggggcagtatattgtgtacagtcttcaggtctggcagcctag

SEQ ID NO: 223271 - DNA, 75 bp, Artificial Sequence
  Synthetic
ctcctccttagtgctgtgaaagctcactagcctatcattcacactgctgtaacaacaaccaacccagtgcttatc

SEQ ID NO: 223272 - DNA, 75 bp, Artificial Sequence
  Synthetic
cctttgaagcactctcaaaaatgatgcagtccatgagagcacagtgtggggtgatttctttcttctttttgtcct

SEQ ID NO: 223273 - DNA, 75 bp, Artificial Sequence
  Synthetic
gttttctgacctcttggatttggactgtttaatcaatgaagaaaggcacaaaacatctaaattcagtaattgtct

SEQ ID NO: 223274 - DNA, 75 bp, Artificial Sequence
  Synthetic
taacaatcccagtgtgcattttgcatagccagccgtacttgtcccaaactttatcctcatattctcgtgaagctt

SEQ ID NO: 223275 - DNA, 75 bp, Artificial Sequence
  Synthetic
ccttctggtgtttaacagttttaaacttttgactttatttaacatagagaggagcctctcgtactcagtgctaac

SEQ ID NO: 223276 - DNA, 75 bp, Artificial Sequence
  Synthetic
ccttgttcatctcgacatcaatgagcttgatatcccttctattctgtgagtctaagagtttcctgatatcatcag

SEQ ID NO: 223277 - DNA, 75 bp, Artificial Sequence
  Synthetic
gtcgttccctctctcataaccatgagtttctgctgttataaacctcatcaagggacaggattcaactgcttctct

SEQ ID NO: 223278 - DNA, 75 bp, Artificial Sequence
  Synthetic
acccttgacagctgagcaccattccctggggaagggcgccaattactgaggaagttaatcccggttgtgcattga

SEQ ID NO: 223279 - DNA, 75 bp, Artificial Sequence
  Synthetic
actcaatgttgaaatgtcatcattgtcatcgagggtctcataaagttcagagtattccttaatcagaccctctgg

SEQ ID NO: 223280 - DNA, 75 bp, Artificial Sequence
  Synthetic
agagatcggccagatccatcccatgtgagtactttgaatcttgtttaaattgtttttgatcagtaggttccctgt

SEQ ID NO: 223281 - DNA, 75 bp, Artificial Sequence
  Synthetic
gttgaccttctgaaagtttctctcaagtttcccattctctaaatctcttctaaatctactaaaaagagagttgat

SEQ ID NO: 223282 - DNA, 75 bp, Artificial Sequence
  Synthetic
aaaaatgtatgaactgcccattctgtggctgaaagatagcaacttccaccggatcattgtatctaccctcaatgt

SEQ ID NO: 223283 - DNA, 75 bp, Artificial Sequence
  Synthetic
gccaaagaccacatcatcacaactcatatttgggttaacaccatcatggcacatcctcataatctcatcgttgtg

SEQ ID NO: 223284 - DNA, 75 bp, Artificial Sequence
  Synthetic
ctatccatgtgggtgcatttggatcaatcccgctcattagatcttttaacagcatggtttgactgtagcttaatc

SEQ ID NO: 223285 - DNA, 75 bp, Artificial Sequence
  Synthetic
agatgacctagcatccttcaaaatcttcatagagtccatgccagagcgtttatcaatagtggttttgagagactc

SEQ ID NO: 223286 - DNA, 75 bp, Artificial Sequence
  Synthetic
acaaagtctaaaatattcagattcctcaaagactttctcatcctgactagagtactctaaaagtttaaacagaag

SEQ ID NO: 223287 - DNA, 75 bp, Artificial Sequence
  Synthetic
ttgttgtgttttcccatgcccttcccacaacagatgtcctacaggcaatgtagggccaaccttcccctgacaggc

SEQ ID NO: 223288 - DNA, 75 bp, Artificial Sequence
  Synthetic
cacaacagatgtcctacaggcaatgtagggccaaccttcccctgacaggcagatcttgtacaagatgttctcata

SEQ ID NO: 223289 - DNA, 75 bp, Artificial Sequence
  Synthetic
gtccctaaacttaaagtttacccactctggcatgaaactgttgtcatagtcacatcgaccatccactatgggaac

SEQ ID NO: 223290 - DNA, 75 bp, Artificial Sequence
  Synthetic
tagtgtaatgcctgcaatggcaagatcttctttgatgcacgccagcttgttagtgtcctctataaatttcttttc

SEQ ID NO: 223291 - DNA, 75 bp, Artificial Sequence
  Synthetic
agggtttctgtctcccacttggtctgagacaaacatattaaacttgcgttttgccccgagaactgcttttaggag

SEQ ID NO: 223292 - DNA, 75 bp, Artificial Sequence
  Synthetic
aaaactagctggtgtgcttctaacgaagcattcaaggaggatgagagaattgtcaattagcttgtagccatctgg

SEQ ID NO: 223293 - DNA, 75 bp, Artificial Sequence
  Synthetic
ttcctcagaattgctgggcttaattaggattgattccaacatattgcccccatccagcaatgcggctcctgcttt

SEQ ID NO: 223294 - DNA, 75 bp, Artificial Sequence
  Synthetic
aatgatcaatggcagtcccgggcatacgattccagactctactaatattgcctcaacagatttgtcatcatgatt

SEQ ID NO: 223295 - DNA, 75 bp, Artificial Sequence
  Synthetic
gacagctgcacccaaactgaagttgtacccagatatattgatgctggattgctgctcggttatcacacccagaac

SEQ ID NO: 223296 - DNA, 75 bp, Artificial Sequence
  Synthetic
gtgtgtgcaaccacacttgtcagcgctgtctatttctatgcaacgtgacagaagttttagtccttcaattaacac

SEQ ID NO: 223297 - DNA, 75 bp, Artificial Sequence
  Synthetic
tgggtgtttgtctttcagcctgtcaagatccgacaaattggggtatttgactgtgtagagcaggcccaggtctgt

SEQ ID NO: 223298 - DNA, 75 bp, Artificial Sequence
  Synthetic
catcctgggttctcgttgccctagaaagttgagtttctgcctcgataatctttcgtcctgttctatgtagtttaa

SEQ ID NO: 223299 - DNA, 75 bp, Artificial Sequence
  Synthetic
gagtgcttgcacaacatcgtttaaaggggtctgtgcctgtttggcaatacaagccattgtcaagctgggcattgt

SEQ ID NO: 223300 - DNA, 75 bp, Artificial Sequence
  Synthetic
gtttaagcacaactctctcagctctgaaatagtttcttccattgcgcattaaaaagcctaggaatccactgtgcg

SEQ ID NO: 223301 - DNA, 75 bp, Artificial Sequence
  Synthetic
gccaaattgattgttcaaaagtgatgagtccttcacatcccaaactctgacaaccccattgtttccctgctgggg

SEQ ID NO: 223302 - DNA, 75 bp, Artificial Sequence
  Synthetic
cgcaccggggatcctaggcgtttagttgcgctttttggctgcacagcccctccttgcaagaccatcagaaacggg

SEQ ID NO: 223303 - DNA, 75 bp, Artificial Sequence
  Synthetic
cctcctcatcccaaccatttgtagaatttgagatctttggtcgagctgctgtgttgtcagattgcccatatagac

SEQ ID NO: 223304 - DNA, 75 bp, Artificial Sequence
  Synthetic
ccctgatgcttgtggtctctctgatctcattatcttggctttcagcttttctagatcagctgctaaagacattaa

SEQ ID NO: 223305 - DNA, 75 bp, Artificial Sequence
  Synthetic
ctcctctgcattgagtctgcccacttttagaatgttcttcttagacgtggattttaactccacaagggagtgtac

SEQ ID NO: 223306 - DNA, 75 bp, Artificial Sequence
  Synthetic
tgtctggttcaggctcctcagtctctgcagatctttgtcatctctcctatcctttctcataattctctgaacgtt

SEQ ID NO: 223307 - DNA, 75 bp, Artificial Sequence
  Synthetic
ctctgccaactaaactgaagatatcgacagccccgagttcaccacctccctacgaggagtgacaccaccaaaccc

SEQ ID NO: 223308 - DNA, 75 bp, Artificial Sequence
  Synthetic
gctaacttcagagaagtcaagtccattgagaagactagtggcatccttgatgacagcagccttaacatttgaggt

SEQ ID NO: 223309 - DNA, 75 bp, Artificial Sequence
  Synthetic
gacaagcacaacacccaacacaaaccacacccacacacacacgaacacacacccacacacacgcgccccccacac

SEQ ID NO: 223310 - DNA, 75 bp, Artificial Sequence
  Synthetic
gaaaccctgtagctctctcctcagtgcctgtgtccactggaaactcttgatctccttggacagagacattgtggt

SEQ ID NO: 223311 - DNA, 75 bp, Artificial Sequence
  Synthetic
cggggggcgcccccccggggggcggtccccccgggggcccggccgggctccgcggagacaccgatcagtcgatct

SEQ ID NO: 223312 - DNA, 75 bp, Artificial Sequence
  Synthetic
tggacagagacattgtggtgatgctcactgtgtctccaacaaaagcgcaatcaaatgcctaggatccactgtgcg

SEQ ID NO: 223313 - DNA, 75 bp, Artificial Sequence
  Synthetic
aatttgcgcttcattgtgagcagtgttgctaccccagaggtcactcttccgagcaggtgccaccatgggtcaagc

SEQ ID NO: 223314 - DNA, 75 bp, Artificial Sequence
  Synthetic
gagcaggtgccaccatgggtcaagcaaaatccagagagacaaggctctccaagagggaagacagggcagaggtac

SEQ ID NO: 223315 - DNA, 75 bp, Artificial Sequence
  Synthetic
acattactgtgttctttgatttactaaagcagagtctacagtctttaaaggtgaaccagtctggcacaagcgaca

SEQ ID NO: 223316 - DNA, 75 bp, Artificial Sequence
  Synthetic
tgcccgatgctacctatcttggtcctctgaactgcaaatcatgctggcagaggtttgacagcctagtcagatgtc

SEQ ID NO: 223317 - DNA, 75 bp, Artificial Sequence
  Synthetic
atggcaccaataatacggatctatctatgcacaactcttgaagaattgtacttatttctgaacctgggaggtgct

SEQ ID NO: 223318 - DNA, 75 bp, Artificial Sequence
  Synthetic
atgaccactatttatgcagacagtgtctaaacctcctactgacagtttcagacaggtgccccctctgcaaacacc

SEQ ID NO: 223319 - DNA, 75 bp, Artificial Sequence
  Synthetic
caccagttctgaatcgatgcaggagaagattgccaagaacatcaccaattttttcatagccttcaagctccgcta

SEQ ID NO: 223320 - DNA, 75 bp, Artificial Sequence
  Synthetic
ccctacccaccaaactgagagtgacacccgctcccagctcaccacccccctatgaggagtagttgaccgaagcac

SEQ ID NO: 223321 - DNA, 75 bp, Artificial Sequence
  Synthetic
acccgctcccagctcaccacccccctatgaggagtagttgaccgaagcacccagcaatccccaccagccccagaa

SEQ ID NO: 223322 - DNA, 75 bp, Artificial Sequence
  Synthetic
ccagcaatccccaccagccccagaaacccaacccccgaacgcaaaagcatgcaaacacacaggcagcgaagcacc

SEQ ID NO: 223323 - DNA, 75 bp, Artificial Sequence
  Synthetic
cacacacccaaacaccacaagacccgacaggagccacccaaacacaacaaccatccacagcccaacaccccccac

SEQ ID NO: 223324 - DNA, 75 bp, Artificial Sequence
  Synthetic
gggggggggcccccccgggggggccccccctcccctcgggggaggcccgcaggcagcactcagtccacatcctcc

SEQ ID NO: 223325 - DNA, 75 bp, Artificial Sequence
  Synthetic
acggactgctctctcagccaatcatcgcaggttctccccttaagcctgtacctcccacccgctgtctcaaacatg

SEQ ID NO: 223326 - DNA, 75 bp, Artificial Sequence
  Synthetic
atggtgttctttgacttacagtagcagagcctacagtccctaaaagtaaaccaatctggtacacttctcaatggt

SEQ ID NO: 223327 - DNA, 75 bp, Artificial Sequence
  Synthetic
gtgagtaagataaatcttgtaatatgcagctcttggatgatagcatttatctccgaattcatcagatgctcacct

SEQ ID NO: 223328 - DNA, 75 bp, Artificial Sequence
  Synthetic
gttctaaacctgtgcaagaggaggctgccaagcacctcatcaatcttggtgtaaccttccagctcagcaatcatg

SEQ ID NO: 223329 - DNA, 75 bp, Artificial Sequence
  Synthetic
attctgaggtccttagtttctaggttaaccataatattttgcacaaaattccttccttcaaaaagggcaccacat

SEQ ID NO: 223330 - DNA, 75 bp, Artificial Sequence
  Synthetic
acaacatctcctattcggtaagagaaccacccaaaaccaaactgtaggtcactcctaaacatgggcctttctaca

SEQ ID NO: 223331 - DNA, 75 bp, Artificial Sequence
  Synthetic
ttgacagtcaggggtacaggctcccattcaggcccgaccctattgaaatcagaggatttaacgtcactcaggatg

SEQ ID NO: 223332 - DNA, 75 bp, Artificial Sequence
  Synthetic
ttattggaccccatcagctctaattccacaaaatcacctagcacgagtgggtcaaccatataatcctcaaattcg

SEQ ID NO: 223333 - DNA, 75 bp, Artificial Sequence
  Synthetic
tcagacctaatgtcaaaagtgttatccttgactttaaagacagggtctgttctcaacaagccaagacattcatcc

SEQ ID NO: 223334 - DNA, 75 bp, Artificial Sequence
  Synthetic
aacagtcttcgatctacctcacctttgaacatataagtgcatgacagaaactcagcaatcccgaggtgaagtaat

SEQ ID NO: 223335 - DNA, 75 bp, Artificial Sequence
  Synthetic
ttacatttcactgtgaacatcaatgaaaacctttttaagtgctctgtgttgttctggttatgtgtgaagtcaatg

SEQ ID NO: 223336 - DNA, 75 bp, Artificial Sequence
  Synthetic
gtcagtgtgaactccaacagaccccccgtgtttttcaagatgtattcccacatgtcctttaatgtcacaaatgtt

SEQ ID NO: 223337 - DNA, 75 bp, Artificial Sequence
  Synthetic
aaacttgatcctggggctccatctcatgttttttgagctcatatcagacataaacggaagtagctggtcctcaaa

SEQ ID NO: 223338 - DNA, 75 bp, Artificial Sequence
  Synthetic
cttgagcttgtcatgccttgctttattaacatggctgcattgcaaactgtatcccccaagcgataagagaaccat

SEQ ID NO: 223339 - DNA, 75 bp, Artificial Sequence
  Synthetic
ccatacccgaactgtaaatcagtcttatacataggcctctcgacatctttgttcacagctttcagtacaaatgat

SEQ ID NO: 223340 - DNA, 75 bp, Artificial Sequence
  Synthetic
tgaaagggtcccatgacttctgctccatcttcagagggcatcatgctccggtggggaaaccatgaaaagttccct

SEQ ID NO: 223341 - DNA, 75 bp, Artificial Sequence
  Synthetic
agtgttctggatgttaccacaaactctcgaacgaacgattcaaaatatacttgtttcaagaagtttttacacaca

SEQ ID NO: 223342 - DNA, 75 bp, Artificial Sequence
  Synthetic
tcccttgtactgaccacaaattcatcagtcagacttgagtctgcacgttggtgtgagttaataaggtctgaggat

SEQ ID NO: 223343 - DNA, 75 bp, Artificial Sequence
  Synthetic
agaactgtgtaatgttcatctctcttccatttcactatgtgtgagatgagtgacaatgattcagagtttatatcg

SEQ ID NO: 223344 - DNA, 75 bp, Artificial Sequence
  Synthetic
atcaacacgcataaatcaagaaactttattcgaggactccatctcatattctttgagctttgatctgacataaaa

SEQ ID NO: 223345 - DNA, 75 bp, Artificial Sequence
  Synthetic
ggcaaaagttgttcttcaaaaatctgaggatacaaccttctaacagactgcaatacgtgacttaggttgattctg

SEQ ID NO: 223346 - DNA, 75 bp, Artificial Sequence
  Synthetic
tcttctaagagtctcgaactttcaggcttccttgcaacataatcacaagcgttgatgtgtcttggcactgattca

SEQ ID NO: 223347 - DNA, 75 bp, Artificial Sequence
  Synthetic
gcttccttgcaacataatcacaagcgttgatgtgtcttggcactgattcaacgactctttttgccttgatgggtt

SEQ ID NO: 223348 - DNA, 75 bp, Artificial Sequence
  Synthetic
ctgccaacacccacacacctaattcaaatgaattgcttaaggaaacacatatgtaatcccagagaaggggcctca

SEQ ID NO: 223349 - DNA, 75 bp, Artificial Sequence
  Synthetic
ggaggcttatgtgacagagatcaggcttcgggtgtgtgtgtttgtcgcagatgtacagaactataccattgcccc

SEQ ID NO: 223350 - DNA, 75 bp, Artificial Sequence
  Synthetic
tttgaacccttgagacatagttatcctggagcaggtcctctaagactctttttatgtacaggttttctttatttt

SEQ ID NO: 223351 - DNA, 75 bp, Artificial Sequence
  Synthetic
tattcctaacacatctactccctaatgttttacagagacctatgaaccctgaagaaatgcagctttgaaaggctg

SEQ ID NO: 223352 - DNA, 75 bp, Artificial Sequence
  Synthetic
atttgtttatagcttctgaaagtagtttttgagcgcctctagtgaacttggaacacaatttattctggagagttt

SEQ ID NO: 223353 - DNA, 75 bp, Artificial Sequence
  Synthetic
taattaatgagggaactttctcttcttgaaagctcatcactgatgggtaaactactttctgtctcaacaccatcc

SEQ ID NO: 223354 - DNA, 75 bp, Artificial Sequence
  Synthetic
tcatagggaacatctcattcagattcaaccagttaatgttagcggtgtcacctagatcatcttcaacaccaagta

SEQ ID NO: 223355 - DNA, 75 bp, Artificial Sequence
  Synthetic
tttcttgtctctattaaagagatccaaaaagaattcttcgttgaactccccattttttagtttatgatgcagtct

SEQ ID NO: 223356 - DNA, 75 bp, Artificial Sequence
  Synthetic
tcttattaacttcctcatgatttttgtttcttgtgggcacaagtcttcaattaacctttgaattctataacctct

SEQ ID NO: 223357 - DNA, 75 bp, Artificial Sequence
  Synthetic
agaaccgtccagccagtcttttgcatctgtgttctcattcaataagaagggatccattggaaaatttgcatactt

SEQ ID NO: 223358 - DNA, 75 bp, Artificial Sequence
  Synthetic
caagagatctagtgttcttttctgaatgcagttgactaacgcaatgggcactccatttgcgacagcctgatctgc

SEQ ID NO: 223359 - DNA, 75 bp, Artificial Sequence
  Synthetic
aatcgtatcaatagtctcacacagctgatgaggttctttacatttcacattatgtagagctgctgacacaaactt

SEQ ID NO: 223360 - DNA, 75 bp, Artificial Sequence
  Synthetic
tgttagaaggggcacttcttctccccagacatagaaccttgacttgaattcagctgcgaacctgcctatgacact

SEQ ID NO: 223361 - DNA, 75 bp, Artificial Sequence
  Synthetic
ttttggactaatgaacttatttagaagcccgcttaagtgggagtgaaattctagtaaaatgaggacattttctgg

SEQ ID NO: 223362 - DNA, 75 bp, Artificial Sequence
  Synthetic
gtcactatcaactaaatcactcaaccttttgtcgaacaaggtgatttggtcatcgcttgatgtgtaagcgtctgg

SEQ ID NO: 223363 - DNA, 75 bp, Artificial Sequence
  Synthetic
cctttcaccaaagatgataccaatacaataattaataaatctttcactgactagaccataaaaatcagaggcatt

SEQ ID NO: 223364 - DNA, 75 bp, Artificial Sequence
  Synthetic
atgcaagatcccttgtcccatgtcaataaggctggagatatgggagggaacaattcccagatcaaagtaactcct

SEQ ID NO: 223365 - DNA, 75 bp, Artificial Sequence
  Synthetic
aaagatttcctctgttactgttgtctgtgttcctcttagaagtttcaatttagccttgatataagacttcatcag

SEQ ID NO: 223366 - DNA, 75 bp, Artificial Sequence
  Synthetic
tgtgttcctcttagaagtttcaatttagccttgatataagacttcatcagtgcattgacgacaggaaatgggacc

SEQ ID NO: 223367 - DNA, 75 bp, Artificial Sequence
  Synthetic
tccacaagcttgtgcatatgccaggtcaataaggtgcttacatggtctttaccagatttaacatattgatcatca

SEQ ID NO: 223368 - DNA, 75 bp, Artificial Sequence
  Synthetic
cctaagcgaaggttttgtaaaagcattaaaaatagaaaaggacacatcattgggccccatttgctatgatccata

SEQ ID NO: 223369 - DNA, 75 bp, Artificial Sequence
  Synthetic
ctatagtttaagaacccttccctgacgtttatggtcattgataagattgcattttcaaattccttctcattattg

SEQ ID NO: 223370 - DNA, 75 bp, Artificial Sequence
  Synthetic
agacatgaacctgagaagaagcttgcaaaagactcaaaatagtcctccacaagcctagtgaacatttttgtcctt

SEQ ID NO: 223371 - DNA, 75 bp, Artificial Sequence
  Synthetic
aagtcaccaatatagagctctctattcccccctacttgttccttgtaagataatgcaaacttcagcctcccagaa

SEQ ID NO: 223372 - DNA, 75 bp, Artificial Sequence
  Synthetic
cctttgtatttctgagttcttccccaccttctctctcattaattttcttgctcctcctataatgtgttattgtag

SEQ ID NO: 223373 - DNA, 75 bp, Artificial Sequence
  Synthetic
tcagggcccacagaagtgtatgaagttggcgactcttctgagtagaaacacaaattcttcaaagcagcactcata

SEQ ID NO: 223374 - DNA, 75 bp, Artificial Sequence
  Synthetic
agctgaccttatcttccagatttttgaaaaaacttgtttcttcttccccctcaaagtatacatctgctgggtcat

SEQ ID NO: 223375 - DNA, 75 bp, Artificial Sequence
  Synthetic
cattttgtcaatgacagagccttacttagggattcagagttgctctccctctcactgatccttacatcctcctcc

SEQ ID NO: 223376 - DNA, 75 bp, Artificial Sequence
  Synthetic
agtctgtcccaatcaaatttgaagttcaagccctgtctttgaacatgcctatatttgcctgagtatgcgttagcg

SEQ ID NO: 223377 - DNA, 75 bp, Artificial Sequence
  Synthetic
ttcatttgtaacaatagcatttttaagcatgaaaaccagtccccttctgaaaaaaactttctacaaaggttcatt

SEQ ID NO: 223378 - DNA, 75 bp, Artificial Sequence
  Synthetic
gccatttcatccagactgcactgttccttaacagtgtgagtgaaatacagtgaagagatatctgcattcttctca

SEQ ID NO: 223379 - DNA, 75 bp, Artificial Sequence
  Synthetic
atagcctcacagataagcttcatatcatcaagtgaaaggcaggctgggtcaaagtcctctactaagtggtatgaa

SEQ ID NO: 223380 - DNA, 75 bp, Artificial Sequence
  Synthetic
atttctgataagatgatcttcctcaaatgagatgactcccctgtcaacaccatctgtagatgatgcagacccttg

SEQ ID NO: 223381 - DNA, 75 bp, Artificial Sequence
  Synthetic
gagcctctgttcttttccagctcccccctttgattaacagtggtccttttcccatactgagatattgtcaacctt

SEQ ID NO: 223382 - DNA, 75 bp, Artificial Sequence
  Synthetic
atcttgttttctatctctttaaaaaagattgtctcctcttccccttcaaaataagtaccatccatcccattctcc

SEQ ID NO: 223383 - DNA, 75 bp, Artificial Sequence
  Synthetic
ttattctcattgtgtttcttttctgtgccaagaaccagcctagacaccaacttagacactttatattcataatca

SEQ ID NO: 223384 - DNA, 75 bp, Artificial Sequence
  Synthetic
ctgtgactcagtttgtacttagttttcctcatgaacccctcagtgatttggctaacagcactaacaagcagttta

SEQ ID NO: 223385 - DNA, 75 bp, Artificial Sequence
  Synthetic
ttgaagtcatactcaagaaggcgctccccattcaagtgtttgttgacaacaacactcttgttgcttgctaaatcc

SEQ ID NO: 223386 - DNA, 75 bp, Artificial Sequence
  Synthetic
agtgctgtcgcacaaccagaatttgtcatggggtccaaattgttaagtttcttctctcctctgcgaatcaatgtg

SEQ ID NO: 223387 - DNA, 75 bp, Artificial Sequence
  Synthetic
ctttgttgggttggtgagcatcagtaaaatcagcgttcttagtgcagtctcaatatcaaaaagacagtctttcag

SEQ ID NO: 223388 - DNA, 75 bp, Artificial Sequence
  Synthetic
ccattgttaaaagatgagaccatgagactaaaaatctctagatttacaccagggaccacatcctggcagtccaca

SEQ ID NO: 223389 - DNA, 75 bp, Artificial Sequence
  Synthetic
tccttactaacaaattttttcatttgtacaagaaaggcttcttcctcctgcggtgagattgcctctttgggattc

SEQ ID NO: 223390 - DNA, 75 bp, Artificial Sequence
  Synthetic
acaaagaacccaaactgagtttttggctcaaaaaacttctcaaagcattttatttggtcagtcagcctatcaggt

SEQ ID NO: 223391 - DNA, 75 bp, Artificial Sequence
  Synthetic
gtttcctttgttattaaatggcataagtatgagacattcaacatgaacttgaattttgcgctgagcatcactttc

SEQ ID NO: 223392 - DNA, 75 bp, Artificial Sequence
  Synthetic
cctcctgtgagaaaaaccttcctcaataaaaatctcagcaacttgtagactactctttcagcattggttatgagg

SEQ ID NO: 223393 - DNA, 75 bp, Artificial Sequence
  Synthetic
tcctcttttagtttatccatcagtgccacggaggaaaagtctgagaccagagccataaccaagtacctcacattc

SEQ ID NO: 223394 - DNA, 75 bp, Artificial Sequence
  Synthetic
tgagtttgtttttgattcctttttgttggatttgttaacaacaacaaaagcagtgttcttaaagcaacttcgata

SEQ ID NO: 223395 - DNA, 75 bp, Artificial Sequence
  Synthetic
tcattgatttgttcaataaggtcagggcatgatttaatccaggagatcatcacactcaccataccatgcaaaact

SEQ ID NO: 223396 - DNA, 75 bp, Artificial Sequence
  Synthetic
tcatcagaaaatattggtagaaaaaatctttttggatctgcataaaaggaaattaagtggcctgacggtccctgt

SEQ ID NO: 223397 - DNA, 75 bp, Artificial Sequence
  Synthetic
agagaataacaccttgaacattctccagttttttgatacaatagatggtattcttcatcatcaattttagccact

SEQ ID NO: 223398 - DNA, 75 bp, Artificial Sequence
  Synthetic
tgaaaaaagacctctttgcactccacaacctgatatctgacagagcccagctgattctgtctcaacctagccact

SEQ ID NO: 223399 - DNA, 75 bp, Artificial Sequence
  Synthetic
gaactagtcttcatgctgttggttaaagctaaacaaatggaagaaagtttccttagacttctcacacttgtcagg

SEQ ID NO: 223400 - DNA, 75 bp, Artificial Sequence
  Synthetic
ttcctttcatctgtttgaaaggtgtaatcgtcaaactttgtgtagtacatcactgggtgattcccctgctttttg

SEQ ID NO: 223401 - DNA, 75 bp, Artificial Sequence
  Synthetic
agacaacccatagtgtgtgagactgaggcccactgcagagagacacctttttaccttcagaatgaagtcttgtat

SEQ ID NO: 223402 - DNA, 75 bp, Artificial Sequence
  Synthetic
agaacttttgaatagttcttctaaggatacactcttatttgatttggacctctttctatttcttaacacccttaa

SEQ ID NO: 223403 - DNA, 75 bp, Artificial Sequence
  Synthetic
aaactcttcttttgtactacaatagctcactaatctatcattcacgctactatagcagacccctacccagtactt

SEQ ID NO: 223404 - DNA, 75 bp, Artificial Sequence
  Synthetic
ctcatttgaagatgcttcagggctgctttgtttgattagggaagagagacaaaggacatctaaattaagtagttg

SEQ ID NO: 223405 - DNA, 75 bp, Artificial Sequence
  Synthetic
tttccttctggtgttcaagagtttcaaactctttaccttattcaacattgaaagcagcctttcgtaggtgctgtt

SEQ ID NO: 223406 - DNA, 75 bp, Artificial Sequence
  Synthetic
ggttgctggacacctcacatgccccttggggtctcctgtgatgaacctcatcagtgggcaggactcaattgattc

SEQ ID NO: 223407 - DNA, 75 bp, Artificial Sequence
  Synthetic
tttacaaagatcatggatgccatccatttctgtcatgtcttcataaagttgggagaactcttcaatcagtgtatt

SEQ ID NO: 223408 - DNA, 75 bp, Artificial Sequence
  Synthetic
ggagtctatcattctgaaatttctagtcagctttcctctctctaaatctctcttaaatctgctaaagaaggaatt

SEQ ID NO: 223409 - DNA, 75 bp, Artificial Sequence
  Synthetic
gatgccaacagcaacctcatcacagctcatgttgggatttatgccgtcatggcacatcttcatgatatcctcatt

SEQ ID NO: 223410 - DNA, 75 bp, Artificial Sequence
  Synthetic
gtgggttgatcttgcatctcttaataccttcattgaatccatgccagatcgcttatccacagtggtctttagaga

SEQ ID NO: 223411 - DNA, 75 bp, Artificial Sequence
  Synthetic
ctcacagagcctgaagtattctgactcttcaaagatcttctcatcctgattagaatattcaagcaatctaaacaa

SEQ ID NO: 223412 - DNA, 75 bp, Artificial Sequence
  Synthetic
cgcaccggggatcctaggctttttggattgcgctttcctccaggtcagctaagagctgaataccgacccacaaag

SEQ ID NO: 223413 - DNA, 75 bp, Artificial Sequence
  Synthetic
agtttaaacataactctctcaattctgagatagtctcatccattgcgcatcaaaaagcctaggatccactgtgcg

SEQ ID NO: 223414 - DNA, 75 bp, Artificial Sequence
  Synthetic
gaggtctctaaacttgaaattgacccagtctggcatgaagctattgtcataggaacaacgaccatccactatggg

SEQ ID NO: 223415 - DNA, 75 bp, Artificial Sequence
  Synthetic
gaatgggtcaaattgtgacaatgtttgaggctttgcctcatatcattgatgaagtcatcaatattgtcatcattg

SEQ ID NO: 223416 - DNA, 75 bp, Artificial Sequence
  Synthetic
gactagggtgatacctgcgagtgcaagatcctcttttatgcttgccagcttattggtatcctcaatgaattttct

SEQ ID NO: 223417 - DNA, 75 bp, Artificial Sequence
  Synthetic
tgctcattataatcacgagcatcaaagctgtgtataactttgccacctgtggagtacttgcattagtcagctttc

SEQ ID NO: 223418 - DNA, 75 bp, Artificial Sequence
  Synthetic
ctcaaaactggctggtgtgcttctaacgaaacattcaagaagaatgagagaattgtcaatcaacttgtacccatc

SEQ ID NO: 223419 - DNA, 75 bp, Artificial Sequence
  Synthetic
tcctcctggctggcaggtcttgcgccatgtatggccttagtggacctgacatttataagggggtctaccagttca

SEQ ID NO: 223420 - DNA, 75 bp, Artificial Sequence
  Synthetic
aatcagtcgagtttgacatgtcccatttgaatctaacaatgcctaacgcatgttcacttaacaactcccaccact

SEQ ID NO: 223421 - DNA, 75 bp, Artificial Sequence
  Synthetic
tggtttctacagacttatcttcaaagttgtgtgtacagccgctcttatctgcgctgtccatctctatacaccttg

SEQ ID NO: 223422 - DNA, 75 bp, Artificial Sequence
  Synthetic
acatcagtatgggaacatctgggctagagctgacgttcacgaatgattccattgtcagccataatttctgcaacc

SEQ ID NO: 223423 - DNA, 75 bp, Artificial Sequence
  Synthetic
agagcagcttgagaccttcaatcaacacgagtctgggttctctctgccctaggaagttcaacttttgtttggaca

SEQ ID NO: 223424 - DNA, 75 bp, Artificial Sequence
  Synthetic
taacttccgccttcaacaagaagacctttgaccacacactcatgagcatagtctcaagcctacatcttagtatca

SEQ ID NO: 223425 - DNA, 75 bp, Artificial Sequence
  Synthetic
gccgttcatcctgctcaatgtagtttaagcagagacttcttaactctgagatgatttcttccattgcgcatcaaa

SEQ ID NO: 223426 - DNA, 75 bp, Artificial Sequence
  Synthetic
gttcatcctgctcaatgtagtttaagcagagacttcttaactctgagatgatttcttccattgcgcatcaaaaaa

SEQ ID NO: 223427 - DNA, 75 bp, Artificial Sequence
  Synthetic
gaggaaactcaaattacaaggcagtgtcttgtgatttcaataacggcatcaccattcaatacaacttaacattct

SEQ ID NO: 223428 - DNA, 75 bp, Artificial Sequence
  Synthetic
gttgcgctttttggctgcacagcccctccttgcaagaccatcagaaacgggttgagcctccagccatgggccaag

SEQ ID NO: 223429 - DNA, 75 bp, Artificial Sequence
  Synthetic
gcgcaccggggatcctaggcattttgttgcgctttttggctgcacagcccctccttgcaagaccatcagaaacgg

SEQ ID NO: 223430 - DNA, 75 bp, Artificial Sequence
  Synthetic
cagatgcacagagtgctttgagtcagtgtaggacttttagaggcagagtgttagacatgtttagaactgcctttg

SEQ ID NO: 223431 - DNA, 75 bp, Artificial Sequence
  Synthetic
gcaaatccaaggagaaaggaagcatcaatgaagcaaacagagctgaaattctaccagacaccacctatcttggcc

SEQ ID NO: 223432 - DNA, 75 bp, Artificial Sequence
  Synthetic
ggggtaagtacatgaggagtggctggggctggacaggctcagacggcaaaaccacttggtgcagccagacaagct

SEQ ID NO: 223433 - DNA, 75 bp, Artificial Sequence
  Synthetic
ccctaaactgcaaatcatgttggcaaagattcgacagtttagtcaggtgccatgatcactatctctgcaggcact

SEQ ID NO: 223434 - DNA, 75 bp, Artificial Sequence
  Synthetic
accaatacttaatcatacagaatagaacttggcaaaaccactgcacgtacgcaggccctttcgggatttccagaa

SEQ ID NO: 223435 - DNA, 75 bp, Artificial Sequence
  Synthetic
gcctgaatcttctgctgtcagtctctgacagatgcccactttgcaagtatcctctgccaactaaactgaagatat

SEQ ID NO: 223436 - DNA, 75 bp, Artificial Sequence
  Synthetic
tcctttttgcccaggagaagacaaaatttctcactagaagacttgcaggcacatttacctggactctgtcagact

SEQ ID NO: 223437 - DNA, 75 bp, Artificial Sequence
  Synthetic
ccgatctccacaaacaacccagcacaagaagagcacagacacatcagcacagacaagcacaacacccaacacaaa

SEQ ID NO: 223438 - DNA, 75 bp, Artificial Sequence
  Synthetic
cttcaggggtggagagtccaggtggttactgcttgaccaaatggatgatccttgccgcagaactcaaatgttttg

SEQ ID NO: 223439 - DNA, 75 bp, Artificial Sequence
  Synthetic
ggaatacagctgttgcaaaatgcaacatcaatcatgatgaggaattctgtgacatgctgcgattaattgattata

SEQ ID NO: 223440 - DNA, 75 bp, Artificial Sequence
  Synthetic
ggaatacagctgttgcataatgcaacatcaatcatgatgaggaattctgtgacatgctgcgattaattgattata

SEQ ID NO: 223441 - DNA, 75 bp, Artificial Sequence
  Synthetic
ggaatacagctgttgcacaatgcaacatcaatcatgatgaggaattctgtgacatgctgcgattaattgattata

SEQ ID NO: 223442 - DNA, 75 bp, Artificial Sequence
  Synthetic
ggaatacagctgttgcagaatgcaacatcaatcatgatgaggaattctgtgacatgctgcgattaattgattata

SEQ ID NO: 223443 - DNA, 75 bp, Artificial Sequence
  Synthetic
cacccacacacacgcgccccccacaccggggggcaccccccgggggggcggtccccccgggggcccggctgggct

SEQ ID NO: 223444 - DNA, 75 bp, Artificial Sequence
  Synthetic
ataaggcagctttgactaaattcaaggaggatgtagaatctgctttacatctgttcaaaacaacagtaaattctt

SEQ ID NO: 223445 - DNA, 75 bp, Artificial Sequence
  Synthetic
agtcttcgcaggacttccccttgagtctgaaccttcccccaactgtctcatacattactgtgttctttgatttac

SEQ ID NO: 223446 - DNA, 75 bp, Artificial Sequence
  Synthetic
tgatctccgatcagctgttgatgaggaatcacctgagggacttgatgggggtgccatactgcaattattcaaaat

SEQ ID NO: 223447 - DNA, 75 bp, Artificial Sequence
  Synthetic
tctggtatctagaacatgcgaagactggtgagactagcgttcccaaatgttggcttgtcagcaatggctcttact

SEQ ID NO: 223448 - DNA, 75 bp, Artificial Sequence
  Synthetic
taaagcagagtctacagtctttaaaggtgaaccagtctggcacaagcgacagtggcaccaataatacggatttat

SEQ ID NO: 223449 - DNA, 75 bp, Artificial Sequence
  Synthetic
ccatgcacaactcttgaagaattgtacttatttctgaacctgggaggtgctcaccagttctgaatcgatgcagaa

SEQ ID NO: 223450 - DNA, 75 bp, Artificial Sequence
  Synthetic
taaatgagacccattttagtgatcaaatagagcaggaggcggacaacatgataacagagatgttgagaaaggatt

SEQ ID NO: 223451 - DNA, 75 bp, Artificial Sequence
  Synthetic
tcaccagttctgaatcgatgcagaagaagattgctaagaacatcaccaattttttcatagccttcaagctccgtt

SEQ ID NO: 223452 - DNA, 75 bp, Artificial Sequence
  Synthetic
acataaagagacaagggagcacccctctagccttgatggatcttctaatgttttccacatcagcatatttggtca

SEQ ID NO: 223453 - DNA, 75 bp, Artificial Sequence
  Synthetic
aagaagaccctcatgtctttagtctccaacttcacaagaatatttcgaacaaggtttctcccttcaaaaagagca

SEQ ID NO: 223454 - DNA, 75 bp, Artificial Sequence
  Synthetic
gcatttttctacatctcttgaagataccaactcacagacacatcaaaggcggctcatgcccaaaaccacatcgcc

SEQ ID NO: 223455 - DNA, 75 bp, Artificial Sequence
  Synthetic
cccagtcttatagtcagaggcacaggctcccattcaggcccgatcctctcaaaatcaagggacttaattccatcc

SEQ ID NO: 223456 - DNA, 75 bp, Artificial Sequence
  Synthetic
gctcccattcaggcccgatcctctcaaaatcaagggacttaattccatccagtattcttttggagcctatcaatt

SEQ ID NO: 223457 - DNA, 75 bp, Artificial Sequence
  Synthetic
tgaccaacaaaggaatctgtagttgtggtgcattcaaagtgcctggtgttaagactgtttggaagagacgctaag

SEQ ID NO: 223458 - DNA, 75 bp, Artificial Sequence
  Synthetic
ccaattcaagagaatcgccgagaatcaaggggtcttccatataatcttcaaactcctcggacctgatatcaaaaa

SEQ ID NO: 223459 - DNA, 75 bp, Artificial Sequence
  Synthetic
caccatcattcgtgctgaaggtggagtctgtctttaacaaacagaggcactcatctaacaaccttctatccactt

SEQ ID NO: 223460 - DNA, 75 bp, Artificial Sequence
  Synthetic
tcatgaggcaggatgttgtgaacagttttcagttctgggagccttgccttggaagcactttcaaaaataatgcag

SEQ ID NO: 223461 - DNA, 75 bp, Artificial Sequence
  Synthetic
cacctttgaagaaataagagcatgataagaattcagctataccggagctctgcaactgacatttcactagaaaga

SEQ ID NO: 223462 - DNA, 75 bp, Artificial Sequence
  Synthetic
tccatgagcgcacagtgtggggtgatctctttcttcttcttatctctcactattccagtatgcatcttgcacagc

SEQ ID NO: 223463 - DNA, 75 bp, Artificial Sequence
  Synthetic
tcaatgaaaacctcctcaagcactcagtgttgttctggttgtgtgtgaagtccactgtaattgaaaactccaaaa

SEQ ID NO: 223464 - DNA, 75 bp, Artificial Sequence
  Synthetic
caaccatatttatcccacactttgtcctcatattctctcgaagcttctttagtcatttctacatcaatgagtttt

SEQ ID NO: 223465 - DNA, 75 bp, Artificial Sequence
  Synthetic
ttctctttgtgttaaagagcatatagtcccataagtccttcaaagatttgaacaccttctgatttgtcaagcctt

SEQ ID NO: 223466 - DNA, 75 bp, Artificial Sequence
  Synthetic
atgtctctcctattttgcgagtctaacagcttcctgatgtcatcagatccctgacaactcagaaccattccttgt

SEQ ID NO: 223467 - DNA, 75 bp, Artificial Sequence
  Synthetic
gtttaattagcaaagcggcattgcacacaacatctcctattcggtaagagaaccacccaaaaccaaactgtaggt

SEQ ID NO: 223468 - DNA, 75 bp, Artificial Sequence
  Synthetic
gggagagcaccgataactgaggaagtcaacccaggttgtgcattgaagagatcagcaagatccatgccatgtgag

SEQ ID NO: 223469 - DNA, 75 bp, Artificial Sequence
  Synthetic
cacaacatctcctattcggtaagagaaccacccaaaaccaaactgtaggtcacttctaaacatgggcctttccac

SEQ ID NO: 223470 - DNA, 75 bp, Artificial Sequence
  Synthetic
atttttgttaaccactttcaagataaacgactgaaagggccccaatgcttctgcaccatcttcagatggcatcat

SEQ ID NO: 223471 - DNA, 75 bp, Artificial Sequence
  Synthetic
tacttagagtcttgcttgaattgtttttgatcagtgggttctctgtaaaaatgtatgaactgcccattttgtggt

SEQ ID NO: 223472 - DNA, 75 bp, Artificial Sequence
  Synthetic
gtccttgtgagggaaccaggaaaagctgcctagagttctagttgttgccacaaattccctcacaaacgattcaaa

SEQ ID NO: 223473 - DNA, 75 bp, Artificial Sequence
  Synthetic
tggaatattgctatctccactggatcattgaacctgccttcaatgtcaatccatgtaggggcgttgggatctatt

SEQ ID NO: 223474 - DNA, 75 bp, Artificial Sequence
  Synthetic
gtacacttgttttaggaagtttttacaaacatcccttgtgctaacaacaaactcatcaactaagcttgaatcaga

SEQ ID NO: 223475 - DNA, 75 bp, Artificial Sequence
  Synthetic
ccccccataaggtccttcaataacattgtctgactgtaactcaagccaacttgaggtgggcctgctgccccaggt

SEQ ID NO: 223476 - DNA, 75 bp, Artificial Sequence
  Synthetic
ccgatggtgagaattagcaaggtcagaaaataagacagtgtaatgttcgtccctcttccacttaataacatgaga

SEQ ID NO: 223477 - DNA, 75 bp, Artificial Sequence
  Synthetic
actggtttgggtgaattggccacgaatttctcgtttgaaaggtcaattgttgtgttctcccatgcccttcctaca

SEQ ID NO: 223478 - DNA, 75 bp, Artificial Sequence
  Synthetic
gataagtgatagagactctgagttgatatcgatcaacacacaaagatcaagaaacttgatcctggggctccatct

SEQ ID NO: 223479 - DNA, 75 bp, Artificial Sequence
  Synthetic
actgatgtcctgcaggctatgtatggccatccttcacctgaaagacagactttatagagaatgttttcgtatgga

SEQ ID NO: 223480 - DNA, 75 bp, Artificial Sequence
  Synthetic
tttctgtctccaacttggtctgagacgaacatattgagtttcctcttggccccaagaactgctttcaagaggtcc

SEQ ID NO: 223481 - DNA, 75 bp, Artificial Sequence
  Synthetic
ataaacggaagtagctggtcctcaaagattttagggtacaatcgccttacagattgaatcacatggtttaaattt

SEQ ID NO: 223482 - DNA, 75 bp, Artificial Sequence
  Synthetic
tcactgttgcttggcttgattaaaatggactccagcatgttgcctccatccagcagagctgcccctgcttttaca

SEQ ID NO: 223483 - DNA, 75 bp, Artificial Sequence
  Synthetic
atcttatcttccaacagtcttgaactctcaggctttcttgcaacataatcacacggattcaggtgtttaaagtct

SEQ ID NO: 223484 - DNA, 75 bp, Artificial Sequence
  Synthetic
gcagcaccaagactgaaattatagccagaaatgttaatgctggactgctgctcagtgatgactcccaagactggg

SEQ ID NO: 223485 - DNA, 75 bp, Artificial Sequence
  Synthetic
gaattcttgtcacctctcccctctataggctccgctagaacccaaacacccaattcaaaggaattgctcagtgag

SEQ ID NO: 223486 - DNA, 75 bp, Artificial Sequence
  Synthetic
tgtttgtcttttagtctttcaaggtcactgaggtttggatatttgactgtataaagcaggccaaggtctgtgagt

SEQ ID NO: 223487 - DNA, 75 bp, Artificial Sequence
  Synthetic
acgcaaatatagtcccagagaagaggccttaaaagactaacatgatcacggtgagcttctggatgggtctgtctg

SEQ ID NO: 223488 - DNA, 75 bp, Artificial Sequence
  Synthetic
gcctgcacaacatcattgagcggggtctgtgattgcttggccatgcaagccattgtcaagctcggcatcgtgcca

SEQ ID NO: 223489 - DNA, 75 bp, Artificial Sequence
  Synthetic
tcacaaatgtataacattataccatcatgtttttcaactcttgttacatattcatccttgactaaatcttcaagc

SEQ ID NO: 223490 - DNA, 75 bp, Artificial Sequence
  Synthetic
catgtttttcaactcttgttacatattcatccttgactaaatcttcaagcactttcttaatgtataagttttccc

SEQ ID NO: 223491 - DNA, 75 bp, Artificial Sequence
  Synthetic
aattgattatttaatagtgatgagtccttgacgtcccaaactctaaccacaccacttatgccttgctgaggtctt

SEQ ID NO: 223492 - DNA, 75 bp, Artificial Sequence
  Synthetic
tgtttttatttcttacgcatctgcttcccaatgtcttacaaagacctataaagccagatgagatgcaactttgaa

SEQ ID NO: 223493 - DNA, 75 bp, Artificial Sequence
  Synthetic
ctcatcccaaccatctgcagaatttgagatctttgatcaagttgttgcattgtcaggttccccatgtagactccg

SEQ ID NO: 223494 - DNA, 75 bp, Artificial Sequence
  Synthetic
aagctgatttgttaattgcttctgacagtagcttctgtgcacccctagtaaacttgctacaaagtttgttttgaa

SEQ ID NO: 223495 - DNA, 75 bp, Artificial Sequence
  Synthetic
gaggcttgaggtctctcagacctcatgatcttggccttcagcttctcaaggtcagctgcgagagacatgagttcc

SEQ ID NO: 223496 - DNA, 75 bp, Artificial Sequence
  Synthetic
gtgttttaatcaacgaagggattctttcctcttgaaaagtcatcactgatggataaaccaccttctgtctcaaaa

SEQ ID NO: 223497 - DNA, 75 bp, Artificial Sequence
  Synthetic
tctgcactgagtcttcccacttttaaaacatttttctttgatgttgacttcaagtccacaagggagtacacagtt

SEQ ID NO: 223498 - DNA, 75 bp, Artificial Sequence
  Synthetic
ccattctcaatgggaacatctcatttaagttcaaccaattgatgtttgctaactgattcaaatcctcttcaaggc

SEQ ID NO: 223499 - DNA, 75 bp, Artificial Sequence
  Synthetic
tgattgagactcctgagcctctgtaaatctttgtcatccctcctttccttcctcatgatcctttgcacattgctg

SEQ ID NO: 223500 - DNA, 75 bp, Artificial Sequence
  Synthetic
caaggatgtctcccagctggaggatggcctctttcttttctctattaaaaagatcaaggaagaattcttcattaa

SEQ ID NO: 223501 - DNA, 75 bp, Artificial Sequence
  Synthetic
acttcagagaagtccagaccatttagaagactagttgcatctttgatgacagcagccttcacatcagatgtaaag

SEQ ID NO: 223502 - DNA, 75 bp, Artificial Sequence
  Synthetic
actcaccatttttgagcttgtgatgtaattttctcacaagctttctgataacctttgtttcactgggacacagtc

SEQ ID NO: 223503 - DNA, 75 bp, Artificial Sequence
  Synthetic
ctttgcagctcccttcttaatgcttgtgtccactgaaagctcttaacttctttggacaaggacattttgtcgctc

SEQ ID NO: 223504 - DNA, 75 bp, Artificial Sequence
  Synthetic
cctcaatgagtctttggattcggtaacctctagagccatccaaccagtccttcacgtcagagttggtgtttaaca

SEQ ID NO: 223505 - DNA, 75 bp, Artificial Sequence
  Synthetic
acctctagagccatccaaccagtccttcacgtcagagttggtgtttaacaagaatgggtcttgagggtagttggc

SEQ ID NO: 223506 - DNA, 75 bp, Artificial Sequence
  Synthetic
cgcaccggggatcctaggcgtttagttgcgctttttgctgcacatttcttgtttgtgagattattgggcacaaat

SEQ ID NO: 223507 - DNA, 75 bp, Artificial Sequence
  Synthetic
ttggacaaggacattttgtcgctctatgaatctccaagacaaatgcgcaatcaaatgcctaggatccactgtgcg

SEQ ID NO: 223508 - DNA, 75 bp, Artificial Sequence
  Synthetic
atactttaagaggtctaatgttctcttctgaatgtggttcaccaaagagactgggacaccattcgcaatagcttg

SEQ ID NO: 223509 - DNA, 75 bp, Artificial Sequence
  Synthetic
caagccatcagtcatgggccagagcaaatccagaggggaaaggggcagcagcagcatgaacagagccgaaattct

SEQ ID NO: 223510 - DNA, 75 bp, Artificial Sequence
  Synthetic
atcggcaattgtatctattgtctcacaaagttgatgtggttctttgcacttaacgttgtgtagtgctgcggacac

SEQ ID NO: 223511 - DNA, 75 bp, Artificial Sequence
  Synthetic
gccagacaccacctatcttggtcctctgaattgtaaatcatgctggcagaagttcgacagcctggtcaggtgtca

SEQ ID NO: 223512 - DNA, 75 bp, Artificial Sequence
  Synthetic
gaattttgtgaggagaggaacctcttctccccacacatagaatctggacttaaactctgcagcaaacctcccaac

SEQ ID NO: 223513 - DNA, 75 bp, Artificial Sequence
  Synthetic
tgaccactatctttgcagacactgcctgaatcttctgctgtcagtatccgacagatgccctctctgcaagcaccc

SEQ ID NO: 223514 - DNA, 75 bp, Artificial Sequence
  Synthetic
cacactttttggactgatgaatttgtttaataaaccacttagatgagaatggaattctagcaggacaaggatttc

SEQ ID NO: 223515 - DNA, 75 bp, Artificial Sequence
  Synthetic
tttaataaaccacttagatgagaatggaattctagcaggacaaggatttcttctgggtcactatcaaccaaatcg

SEQ ID NO: 223516 - DNA, 75 bp, Artificial Sequence
  Synthetic
actaccaaccaaactgagaatctcaacagccccgagctctccgcctccctacgaggagtgaacccagcgttcacc

SEQ ID NO: 223517 - DNA, 75 bp, Artificial Sequence
  Synthetic
ctcaatctcttgtcaaataaagtgatctggtcatcacttgatgtgtaggactctggcctctcaccaaaaataaca

SEQ ID NO: 223518 - DNA, 75 bp, Artificial Sequence
  Synthetic
ggaggcaagcgaccccacgaaggaagaccaaacccagaccagcacaaacaaacacagcacacagcacagagcaca

SEQ ID NO: 223519 - DNA, 75 bp, Artificial Sequence
  Synthetic
ccaatgcaatagttgataaatctttcgctaatcaacccataaaaatcagaagcattgtgcaagattccctgtccc

SEQ ID NO: 223520 - DNA, 75 bp, Artificial Sequence
  Synthetic
cacacacagacacacacgcacacccacacccacacacccccagcgccgggggcgccccccccggggggcggcccc

SEQ ID NO: 223521 - DNA, 75 bp, Artificial Sequence
  Synthetic
atatcaatgaggctggatatgtgggatggtaccactcctttttcaaaatactccctaaatatcctctcagtaaca

SEQ ID NO: 223522 - DNA, 75 bp, Artificial Sequence
  Synthetic
ccgggagcccagcggggccccacggagacgccgatcagtcgatctcctcggccgccgggccagccagccagtcat

SEQ ID NO: 223523 - DNA, 75 bp, Artificial Sequence
  Synthetic
gttgtctctgaacctctaagaagcttcagttttgatttaacatatgacctcatcattgcattcacaacagggaag

SEQ ID NO: 223524 - DNA, 75 bp, Artificial Sequence
  Synthetic
cacaggacttccccttgagtctgaatctaccccccaccgtttcatacatgatggagttccttgacctactgaaac

SEQ ID NO: 223525 - DNA, 75 bp, Artificial Sequence
  Synthetic
ggaacttcaacaagtttatgcatatgccaagtcaacagggtgctaacatgatcctttccagaacgaacatattga

SEQ ID NO: 223526 - DNA, 75 bp, Artificial Sequence
  Synthetic
agagtcgacaatctttaaaggtgaaccaatctggcactgatgacagtggcaccaaaaggatggacttgtctatac

SEQ ID NO: 223527 - DNA, 75 bp, Artificial Sequence
  Synthetic
tcgtcacccaatttaagattttggaggagcattaaaaacaaaaatgggcacatcattggtccccacttactgtgg

SEQ ID NO: 223528 - DNA, 75 bp, Artificial Sequence
  Synthetic
acagttcctgaagaattgcacctatgtctgatcctggcagatgttcaccagttctgaatctatgcaggagaagac

SEQ ID NO: 223529 - DNA, 75 bp, Artificial Sequence
  Synthetic
tccatgctgtagttcagtaacccttctcgcacattgatggtcattgacaggatcgcgttctcaaattctttatca

SEQ ID NO: 223530 - DNA, 75 bp, Artificial Sequence
  Synthetic
taccaaggacttcaccaatcttctcataaccttcaagttccgctagaaacactctcatatccttggtttccagtc

SEQ ID NO: 223531 - DNA, 75 bp, Artificial Sequence
  Synthetic
ttatttaaacacgaacctgagaagaaactggaaaaggactcaaagtaatcctctattagtcttgtaaacattttt

SEQ ID NO: 223532 - DNA, 75 bp, Artificial Sequence
  Synthetic
tcacaaagatattctgaacaaggttcttcccctcaaaaagagcaccgaccctcacagtcagaggcactggctccc

SEQ ID NO: 223533 - DNA, 75 bp, Artificial Sequence
  Synthetic
gtccttaaatctccaatgtagagttctctgtttcctccaacctgttctttataagataatgcaaacttcagtctc

SEQ ID NO: 223534 - DNA, 75 bp, Artificial Sequence
  Synthetic
attcaggccctactctctcaaaatcaagagatttaaccccgtccaacactcctctagaacctattaattcaagct

SEQ ID NO: 223535 - DNA, 75 bp, Artificial Sequence
  Synthetic
ccggagtcagggccaaccgaggtgtatgacgtaggtgattcttctgagtagaaacataggttttttaaagcggca

SEQ ID NO: 223536 - DNA, 75 bp, Artificial Sequence
  Synthetic
caagggagtctcctagtatcagaggatcttccatatagtcctcaaactcttcagacctaatatcgaaaacaccat

SEQ ID NO: 223537 - DNA, 75 bp, Artificial Sequence
  Synthetic
ctcatacattttgtcagtgatagagccttgctcaaagactcagaattgctttctctttcgctaattctcacatct

SEQ ID NO: 223538 - DNA, 75 bp, Artificial Sequence
  Synthetic
cattcaccttgaagattgagtctgtcctcaataggtggaggcactcatccaacaatctcctgtctacctcacctt

SEQ ID NO: 223539 - DNA, 75 bp, Artificial Sequence
  Synthetic
tcttccagcttatcccagtcaaatttgaagttcaagccttgcctctgcacatgtctgtatttccctgaatatgca

SEQ ID NO: 223540 - DNA, 75 bp, Artificial Sequence
  Synthetic
tgaagaggcgggagcatgacaggaatttggcaacacctgcactttgtaactgacatttgactacaaagatcaatg

SEQ ID NO: 223541 - DNA, 75 bp, Artificial Sequence
  Synthetic
tttgcattcatctgtaacaaaatcattttcatacatgagaaccaatcattttctgaaaagaactttctacaaagg

SEQ ID NO: 223542 - DNA, 75 bp, Artificial Sequence
  Synthetic
agaatttctttaagcaatcagtgttgttttgattgtgtgtgaaatccactgtaattgagaactccagtactcctc

SEQ ID NO: 223543 - DNA, 75 bp, Artificial Sequence
  Synthetic
ttctttgccatttcatccaaaccacattgttctttgacagctggagtgaagtataatggtgacaattctgtagaa

SEQ ID NO: 223544 - DNA, 75 bp, Artificial Sequence
  Synthetic
attgttctttgacagctggagtgaagtataatggtgacaattctgtagaactttcaacagcttcacatatgaatt

SEQ ID NO: 223545 - DNA, 75 bp, Artificial Sequence
  Synthetic
ttgtattgctgagcatataatcccataaatctttcaaggacttaaacgctttagggtttgtcaaaccctgcttga

SEQ ID NO: 223546 - DNA, 75 bp, Artificial Sequence
  Synthetic
ccaacatagcagcattacacacaatgtctcccacccgataagagaaccaaccaaaaccaaattgcaaatcatttc

SEQ ID NO: 223547 - DNA, 75 bp, Artificial Sequence
  Synthetic
tcatgtcatcattggtgagacaagaaggatcgaagtcctctactagatggaaagatatctctgacaaaatgacct

SEQ ID NO: 223548 - DNA, 75 bp, Artificial Sequence
  Synthetic
tgaacatgggcctctctatgtttttgttcaccacttttagaacaaatgattggaagggtcctaaagcttcagcac

SEQ ID NO: 223549 - DNA, 75 bp, Artificial Sequence
  Synthetic
tcctcaagtaagccattttgcctgacaagacatcctgaagatgatgtagcccctttgtatttctgagttcttccc

SEQ ID NO: 223550 - DNA, 75 bp, Artificial Sequence
  Synthetic
cgtcttcagatggcatcatacccttgtgagggaaccatgaaaagttacctaaagtccttgttgttgcaacaaatt

SEQ ID NO: 223551 - DNA, 75 bp, Artificial Sequence
  Synthetic
actcctcctataatgtgttattgtagagatgaccttatcttccagatttttgaaaaaacttgtttcttcttcccc

SEQ ID NO: 223552 - DNA, 75 bp, Artificial Sequence
  Synthetic
ctcggacaaatgactcaaaatacacctgcttcaaaaaattcttgcaaacgtctcttgtgctaacaacaaattcat

SEQ ID NO: 223553 - DNA, 75 bp, Artificial Sequence
  Synthetic
gagatgaccttatcttccagatttttgaaaaaacttgtttcttcttccccttcaaagcatacatctgctgggtca

SEQ ID NO: 223554 - DNA, 75 bp, Artificial Sequence
  Synthetic
tcattcacttccccttcttctgcctttttggagccgatgaccaatctagagactaactttgagaccttatactca

SEQ ID NO: 223555 - DNA, 75 bp, Artificial Sequence
  Synthetic
cagtcagacttgaatcagatcgttggtgagagttagcaagatcagaaaagaggacagtgtagtgctcatccctct

SEQ ID NO: 223556 - DNA, 75 bp, Artificial Sequence
  Synthetic
taatctgagtgacttaacttatacttatgctttctcatgaaactctctgttaattggctaacagcactaacaagc

SEQ ID NO: 223557 - DNA, 75 bp, Artificial Sequence
  Synthetic
tccattttacgacatgtgaaatgagtgatagagactctgagttgatatcaattaacacacaaaggtcaaggaact

SEQ ID NO: 223558 - DNA, 75 bp, Artificial Sequence
  Synthetic
aatttgttgaagtcatactccaagagccgttctccatttaggtgcttgttgacaaccacactcctgttactagca

SEQ ID NO: 223559 - DNA, 75 bp, Artificial Sequence
  Synthetic
taatcctgggactccatctcatgttttttgaacttatatcagacataaatggaagcaattgatcctcaaagattt

SEQ ID NO: 223560 - DNA, 75 bp, Artificial Sequence
  Synthetic
agatccaatgctgttgcacaccctgagttggtcatggggtctaggttattgagcttcttttcccctttgaaaatt

SEQ ID NO: 223561 - DNA, 75 bp, Artificial Sequence
  Synthetic
tagggtacaaccgcctcacagactgaatcacatgatttaaactcaccttatcttctagtaatctagaactctcag

SEQ ID NO: 223562 - DNA, 75 bp, Artificial Sequence
  Synthetic
agggtgccgttgttgaacgaggacaccatcatgctaaaaacttccaaattaacacctgggcttgtgtgctgacag

SEQ ID NO: 223563 - DNA, 75 bp, Artificial Sequence
  Synthetic
gctttcttgctacataatcacatggattcaggtgattaagagtaaagtttctgtcattcttccctgtcacaggtt

SEQ ID NO: 223564 - DNA, 75 bp, Artificial Sequence
  Synthetic
ttaatctctttaccagtgaacttcctcatttgctcataaaagacacactcttcttcaggagtgattgcttcttta

SEQ ID NO: 223565 - DNA, 75 bp, Artificial Sequence
  Synthetic
ctgctaagacccagacacctagctcaaaagaattgctcaatgaaatgcagatgtaatcccagagaaggggcctca

SEQ ID NO: 223566 - DNA, 75 bp, Artificial Sequence
  Synthetic
gggttgacaaagaaaccaaactcacttttaggctcaaaaaacttctcaaaacattttatttgatctgtcaaccta

SEQ ID NO: 223567 - DNA, 75 bp, Artificial Sequence
  Synthetic
gaagactgatgtgatcagagtgggcatctggatgacttcgcctatcacagatgtacagcgccacaccatcgtgtt

SEQ ID NO: 223568 - DNA, 75 bp, Artificial Sequence
  Synthetic
tcaggagtctcctttgtgatcaaatgacatagatatgagacattcagcatgaatttaaactttgcactcaacaac

SEQ ID NO: 223569 - DNA, 75 bp, Artificial Sequence
  Synthetic
tttgaattcttgtaacatgctcatccgttgccaaatcttcaagtaccttttttatgtacaaattttctctgttct

SEQ ID NO: 223570 - DNA, 75 bp, Artificial Sequence
  Synthetic
accttctcaccagtgccaaaaatagttctaattaaaaacctaagcaacctatacactaatttttcagcaggtgta

SEQ ID NO: 223571 - DNA, 75 bp, Artificial Sequence
  Synthetic
tatttcttacacacctactccctaaagtcttacaaagacctataaacccagatgaaatgcagctttgaaaagctg

SEQ ID NO: 223572 - DNA, 75 bp, Artificial Sequence
  Synthetic
atgagatcttccttcaatttgtccatcaatgatgtagatgagaaatctgagacaatagccatcaccaaataccta

SEQ ID NO: 223573 - DNA, 75 bp, Artificial Sequence
  Synthetic
atttgttgattgcctctgataatagcttctgtgcacctcttgtgaacttactgcaaagcttgttttggagtgtct

SEQ ID NO: 223574 - DNA, 75 bp, Artificial Sequence
  Synthetic
atattttgaacctgtttctgatttctctttgttgggttggtgagcatcagtaaaatcagggttcttagtgcagtc

SEQ ID NO: 223575 - DNA, 75 bp, Artificial Sequence
  Synthetic
tgattagtgaagggattctttcttcttggaaagtcatcactgaaggataaaccaccttttgccttaaaaccatcc

SEQ ID NO: 223576 - DNA, 75 bp, Artificial Sequence
  Synthetic
tctttgttgggttggtgagcatcagtaaaatcagggttcttagtgcagtctcaatatcaaaaagacagtccttca

SEQ ID NO: 223577 - DNA, 75 bp, Artificial Sequence
  Synthetic
tcaatggaaacatctcatttaaatttaaccagttgatatttgccagttggtccaggtcttcatcaagaccaagga

SEQ ID NO: 223578 - DNA, 75 bp, Artificial Sequence
  Synthetic
ggtcaggacatgatctgatccatgaaatcatggtgttaatcatattgtgtaacacctcatctgaaaagattggta

SEQ ID NO: 223579 - DNA, 75 bp, Artificial Sequence
  Synthetic
tgtctcctaattgaagcatagcttcctttttttctctattgaaaaggtccaagaaaaattcctcgttgaactctc

SEQ ID NO: 223580 - DNA, 75 bp, Artificial Sequence
  Synthetic
agaaaaacctttttggatcagcataaaaggagaccaagtggccatttgggccttgtatagagtaacacctggagg

SEQ ID NO: 223581 - DNA, 75 bp, Artificial Sequence
  Synthetic
catttttgagtttatgatgtagttttcttacaagttttcttatgacccttgtctcactaggacacaattcttcaa

SEQ ID NO: 223582 - DNA, 75 bp, Artificial Sequence
  Synthetic
attctccagtcttttgatatagcaaatgaaactcttcagagtctagtttcatcacctggcaaaatacttccttgc

SEQ ID NO: 223583 - DNA, 75 bp, Artificial Sequence
  Synthetic
taagtctttggattctataacctctagaaccatctaaccagtccttcacatcagtattagtgtttaacagaaatg

SEQ ID NO: 223584 - DNA, 75 bp, Artificial Sequence
  Synthetic
attctaccacttgataccttgctgaacccaactgattttgtcttaatctagcaactgaacttgttttcatactgt

SEQ ID NO: 223585 - DNA, 75 bp, Artificial Sequence
  Synthetic
gatctaaagggaagttagcatatcttaataggtccaaagtcctcctttgaatggagtttaccagaaaaactggaa

SEQ ID NO: 223586 - DNA, 75 bp, Artificial Sequence
  Synthetic
ttgttaaagccaagcaaacagatgacaatcttttcaaactctgtatatccctcagttgctctatgcttggctgga

SEQ ID NO: 223587 - DNA, 75 bp, Artificial Sequence
  Synthetic
cgccatttgcaatagcttgatcagcgattgtatctatcgtctcacagagttgatgcggttctttgcatttgacat

SEQ ID NO: 223588 - DNA, 75 bp, Artificial Sequence
  Synthetic
aattgtaatcttcgaactttgtataatacataacagggtgagttccagccctcataaagctctcaaattcagcga

SEQ ID NO: 223589 - DNA, 75 bp, Artificial Sequence
  Synthetic
tatgcagtgctgcagacacaaacttagtgagaagagggacctcttccccccacacataaaatctagatttgaact

SEQ ID NO: 223590 - DNA, 75 bp, Artificial Sequence
  Synthetic
actgaatatcgcattcacactctaggtgtttggagagtccatagtgctcaaaactgagccctactactgataagc

SEQ ID NO: 223591 - DNA, 75 bp, Artificial Sequence
  Synthetic
ctgcagcaaatcgcccaacaacactctttgggctgataaacttatttaatagaccactcaaatgagaatggaact

SEQ ID NO: 223592 - DNA, 75 bp, Artificial Sequence
  Synthetic
atcttcggatttttgtgataaattcatgtatagatgttttgaacaattcctcaagaggtacctttctgtgcacct

SEQ ID NO: 223593 - DNA, 75 bp, Artificial Sequence
  Synthetic
ccaataagacgaggacttcttctggatcactatccaccagctcacttaatcttctatcaaataaggtgatctgat

SEQ ID NO: 223594 - DNA, 75 bp, Artificial Sequence
  Synthetic
ttgatttttttctgttcctcaaaagtctaatgaattcttcctttgtactgtgaaagctcactagtctatcattta

SEQ ID NO: 223595 - DNA, 75 bp, Artificial Sequence
  Synthetic
catcacttgacgtataagcttctggtctttctccaaaaataacaccaatacaatagttgatgaatctctcactaa

SEQ ID NO: 223596 - DNA, 75 bp, Artificial Sequence
  Synthetic
cactactatagcaacagccaacccaatgcttatcgtttcccaaccctttgagctttgattgtttgattagtgaag

SEQ ID NO: 223597 - DNA, 75 bp, Artificial Sequence
  Synthetic
tcaagccataaaaatcagaagcattgtgcagaattccctgccccatgtcaataagactagatatatgggatggca

SEQ ID NO: 223598 - DNA, 75 bp, Artificial Sequence
  Synthetic
aaagacacaagacatctaagttcaacaactgtcttcttctagtattgagcaattttaagctcttaactttattta

SEQ ID NO: 223599 - DNA, 75 bp, Artificial Sequence
  Synthetic
ctatccccatttcaaagtattctctgaagattctttcagtgactgttgtttctgaacccctaagaagctttaatt

SEQ ID NO: 223600 - DNA, 75 bp, Artificial Sequence
  Synthetic
acatagagaggagcctctcgtactccgtgctaatttcgcttccctttttttgcccatgagcctctgctgttataa

SEQ ID NO: 223601 - DNA, 75 bp, Artificial Sequence
  Synthetic
ttgatttaacatatgacttcatcatggcactcacaacagggaagggtacttcaacaagcttatgcatgtgccaag

SEQ ID NO: 223602 - DNA, 75 bp, Artificial Sequence
  Synthetic
atctcattaaaggacaagactcaactgcctctttgctcaatgtcaagatgtcatcattatcaccaagagtttcat

SEQ ID NO: 223603 - DNA, 75 bp, Artificial Sequence
  Synthetic
ttagcagagtgctgacatgatctttcccagtacgcacatattgatcatcacccagtttgagattttgaagaagca

SEQ ID NO: 223604 - DNA, 75 bp, Artificial Sequence
  Synthetic
aaagcttggaaaattccccaatcaaaccctcagggttgattctctggaagtttcttttaagtttcccactcatca

SEQ ID NO: 223605 - DNA, 75 bp, Artificial Sequence
  Synthetic
tcagaaacaagaatggacacatcattggtccccatttactgtgatccatactgtagttcagaaacccctctcgca

SEQ ID NO: 223606 - DNA, 75 bp, Artificial Sequence
  Synthetic
agtctcttctgaacctgctaaaaagcgagtttatgccaaagaccacatcatcacaagtcatgtttgggttgacac

SEQ ID NO: 223607 - DNA, 75 bp, Artificial Sequence
  Synthetic
cattaatggtcattgacaacactgcgttttcaaattctttgtcgttgttcaaacatgaacctgagaagaaactag

SEQ ID NO: 223608 - DNA, 75 bp, Artificial Sequence
  Synthetic
catcatgacacattctcataatttcatcattgtgaagtgatcttgcatctttcagaattttcatggagtccatac

SEQ ID NO: 223609 - DNA, 75 bp, Artificial Sequence
  Synthetic
aaaaggattcaaaataatcctctatcaaccttgtgaacatttttgtcctcaagtctccaatataaagctctctat

SEQ ID NO: 223610 - DNA, 75 bp, Artificial Sequence
  Synthetic
cagaacgcttgtcaacagtggttttgagagactcacaaagtctgaagtattcagactcttcaaaaactctctcgt

SEQ ID NO: 223611 - DNA, 75 bp, Artificial Sequence
  Synthetic
ttcccccgacctgctctttgtaagaaagtgcgaacttcagtcttccagagtcaggaccaactgaggtgtatgatg

SEQ ID NO: 223612 - DNA, 75 bp, Artificial Sequence
  Synthetic
cctggctagagtattccaagagtctgaatagaaggtctctaaatttgaagtttacccattctggcatgaaactgt

SEQ ID NO: 223613 - DNA, 75 bp, Artificial Sequence
  Synthetic
ttggtgattcttctgaataaaagcacaagttctttaaagcagcactcatacactttgtcagagacaaagccttgc

SEQ ID NO: 223614 - DNA, 75 bp, Artificial Sequence
  Synthetic
tgtcatagtcacagcgaccatctactattgggactagtgtgatgcctgcgacagtaaggtcttctttgatgcttg

SEQ ID NO: 223615 - DNA, 75 bp, Artificial Sequence
  Synthetic
ttagagattcggagttgctctctctctcactaattcttgcgtcctcttctaacttgtcccagtcaaatttgaagt

SEQ ID NO: 223616 - DNA, 75 bp, Artificial Sequence
  Synthetic
tcaatttgttagtgtcctctatgaatttcctttcaaaactggctggagtacttctaacaaagcactcaagaagga

SEQ ID NO: 223617 - DNA, 75 bp, Artificial Sequence
  Synthetic
ttaaaccctgcctttgcatgtgtctgtatttacctgagtatgcatttgcattcatttgcaacaaaatcatcttca

SEQ ID NO: 223618 - DNA, 75 bp, Artificial Sequence
  Synthetic
tgagggaattgtcaatcaacttataaccatcaggaatgataagtggcagccctgggcacacaattccagaatcaa

SEQ ID NO: 223619 - DNA, 75 bp, Artificial Sequence
  Synthetic
tgcatgaaaaccaatcacactctgaaaaaaactttctacaaagattcattgccatctcatccagaccacattgtt

SEQ ID NO: 223620 - DNA, 75 bp, Artificial Sequence
  Synthetic
ctagaattgtctcgacagatttgtcatcatgattgtgtatacaaccactcttgtctgcactgtctatctcgatgc

SEQ ID NO: 223621 - DNA, 75 bp, Artificial Sequence
  Synthetic
ccttaacagctgaagtgaaatacaacgatgacagttctgtggatccttcaacagcctcacatatgaacttcatgt

SEQ ID NO: 223622 - DNA, 75 bp, Artificial Sequence
  Synthetic
agcgtgacagaagtttgagcccctcaatcaataccattctgggttctctttgtcccaggaaattgagtttctgcc

SEQ ID NO: 223623 - DNA, 75 bp, Artificial Sequence
  Synthetic
cttcattagttaggcaagatggatcaaagtcttccactaagtgaaaagaaatttctgacagaatgacctttctta

SEQ ID NO: 223624 - DNA, 75 bp, Artificial Sequence
  Synthetic
ttgacaatctttcatcctgttctacatagtttaaacataactctctcaattctgagatagtctcatccattgcgc

SEQ ID NO: 223625 - DNA, 75 bp, Artificial Sequence
  Synthetic
aataagccattttgcctgacaaaacagtctgaagatgatgcaatccctttgtgtttttaagatcaaccccatctt

SEQ ID NO: 223626 - DNA, 75 bp, Artificial Sequence
  Synthetic
cgcaccggggatcctaggcggtttgttgcgctgtttagtggcctacatctccttcacaagaccaccagagcacag

SEQ ID NO: 223627 - DNA, 75 bp, Artificial Sequence
  Synthetic
agtttaaacataactctctcaattctgagatagtctcatccattgcgcatcaaaaagcctaggatcctcggtgcg

SEQ ID NO: 223628 - DNA, 75 bp, Artificial Sequence
  Synthetic
ctccttcatttgccttcctgcttctcttatatcgcgttattgtgacatcaaccctgtcttttaaacccttaaaga

SEQ ID NO: 223629 - DNA, 75 bp, Artificial Sequence
  Synthetic
caagtcactagccatgggtcaaggtaaatccaagggggaaagagaaatcagcagtgcgcaaagggctgagattct

SEQ ID NO: 223630 - DNA, 75 bp, Artificial Sequence
  Synthetic
aacttgtctcttcttctccttcaaaacacacatctgctgggtcatcccccggtttctctactcctcctccattag

SEQ ID NO: 223631 - DNA, 75 bp, Artificial Sequence
  Synthetic
gccagacaccacatatcttggtcctctaaactgcaagtcatgctggcagaggtttgacagcttagtgaggtgcca

SEQ ID NO: 223632 - DNA, 75 bp, Artificial Sequence
  Synthetic
agccaataaccaatctggaaaccaactttgataccttatactcataatctgagtgattcaacttgtacttctgtt

SEQ ID NO: 223633 - DNA, 75 bp, Artificial Sequence
  Synthetic
tgatcactacctctgcagacattgtctgaatctgctgctgtcagtctccgacagatgtcccctctgcaaacacca

SEQ ID NO: 223634 - DNA, 75 bp, Artificial Sequence
  Synthetic
ttcttataaaaccctctgtgatctggctcacagcactaacaagtagcttattgaaatcatattctaaaagccgtt

SEQ ID NO: 223635 - DNA, 75 bp, Artificial Sequence
  Synthetic
gttgccgaccaaactgaagatatcgacagccccaagctcaccacctccctacgaggcgtgaagccccctgagcaa

SEQ ID NO: 223636 - DNA, 75 bp, Artificial Sequence
  Synthetic
ctccattcaggtgcttattgacaaccacactcttgttgcttgcaagatctagtgctgtcgcacaaccggagttgg

SEQ ID NO: 223637 - DNA, 75 bp, Artificial Sequence
  Synthetic
cagcaagcggcccagcaaaagggacccacacacagaccaacacgcacagacggggagccccccagaacacacaca

SEQ ID NO: 223638 - DNA, 75 bp, Artificial Sequence
  Synthetic
tcatggggtccagactattaagctttttctctcctttgaaaatcaatgtaccgttattgaacgatgataccatca

SEQ ID NO: 223639 - DNA, 75 bp, Artificial Sequence
  Synthetic
cacacatagaagcacacccacacccacacaccccccacacccggggggcgcccccccgggggggacgcccccggg

SEQ ID NO: 223640 - DNA, 75 bp, Artificial Sequence
  Synthetic
gactgaaggcctctaagttaacacctggagttgtgttctgacaatcaatctctttactagtgaacttcttcatct

SEQ ID NO: 223641 - DNA, 75 bp, Artificial Sequence
  Synthetic
ggcccggccggggcccggcggagacgcccattactcgatctcctcgacctccgtcccggctagccagtcgtcgca

SEQ ID NO: 223642 - DNA, 75 bp, Artificial Sequence
  Synthetic
gttcataaaaaacacattcctcctcaggggtgattgcttctttagggttaacaaaaaatccaaactcacttttgg

SEQ ID NO: 223643 - DNA, 75 bp, Artificial Sequence
  Synthetic
ggacttccccttgagtctgaatctgcccccaactgtctcatacatcactgtgttctttgacttactaaaacagag

SEQ ID NO: 223644 - DNA, 75 bp, Artificial Sequence
  Synthetic
gttcaaagaatttttcaaagcattttatctggtctgtcagtctatcaggggtctcctttgttattaaatgacata

SEQ ID NO: 223645 - DNA, 75 bp, Artificial Sequence
  Synthetic
tctgcagtctttgaatgtgaaccagtccggtacaaatgacagcggcaacaacataacagatctgtccatgtgcaa

SEQ ID NO: 223646 - DNA, 75 bp, Artificial Sequence
  Synthetic
agtatgagacattcaacatgaacttgaattttgcacttaacaacaccttttcaccagttccaaatatggtcctta

SEQ ID NO: 223647 - DNA, 75 bp, Artificial Sequence
  Synthetic
ttcccgaagggtcacacctatttctgaacccgacagatgctcaccggttctgaatcgatgcagaagaagattgcc

SEQ ID NO: 223648 - DNA, 75 bp, Artificial Sequence
  Synthetic
ttaaaaatcttagcaatctatacactactctttcagcaggtgtgatcaagtcctccttcaatttatccattaaag

SEQ ID NO: 223649 - DNA, 75 bp, Artificial Sequence
  Synthetic
aagaacatcagtggtcctctcatacccatcaagttctgccagaaaaaccctcatgtccttagtctccagcttcac

SEQ ID NO: 223650 - DNA, 75 bp, Artificial Sequence
  Synthetic
atgttgatgagaagtctgagacaatggccatcactaaatacctgacattttgaacctgcttttgatttcttttcg

SEQ ID NO: 223651 - DNA, 75 bp, Artificial Sequence
  Synthetic
atgaatgttttgaacaaggtttctcccctcaaaaagagcacccatcttcacagtcagtggaacaggctcccattc

SEQ ID NO: 223652 - DNA, 75 bp, Artificial Sequence
  Synthetic
ttgggttagtgagcatcagcagcaacaaggtccttaatgcaatctcaatgtcactgaggctatcttttaaatcag

SEQ ID NO: 223653 - DNA, 75 bp, Artificial Sequence
  Synthetic
agggccaactctttcgaaatcaagggatttgatcccatctaacatctttttagagcctattaattcaacctcgag

SEQ ID NO: 223654 - DNA, 75 bp, Artificial Sequence
  Synthetic
ggcatgatctaatccatgaaatcatagtgttaatcatattgtgcaacacctcatctgagaaaattggtaaaaaga

SEQ ID NO: 223655 - DNA, 75 bp, Artificial Sequence
  Synthetic
acaatcaccaagtatcaaagggtcttccatatagtcctcaaattcttctgatctaacatcaagaacagcattatt

SEQ ID NO: 223656 - DNA, 75 bp, Artificial Sequence
  Synthetic
acctttttgggtctgcataaaaggaaatcaaatgaccatttggaccttgtattgaatagcaccttgaagattcac

SEQ ID NO: 223657 - DNA, 75 bp, Artificial Sequence
  Synthetic
caccttaaagatggggtctgttctaagcaagtgaaggcactcatccagtaatcttctgtccacctcacccttgaa

SEQ ID NO: 223658 - DNA, 75 bp, Artificial Sequence
  Synthetic
cggtcttttgatataacaaatggtattcttcagaatttaattttatcacttggcaaaatacttctttacattcca

SEQ ID NO: 223659 - DNA, 75 bp, Artificial Sequence
  Synthetic
gaggtgagaacatgacaagagctcggctacacctggacctaataattgacacttcactaataaaatcaatgaaaa

SEQ ID NO: 223660 - DNA, 75 bp, Artificial Sequence
  Synthetic
ccacttggtaccttacagaccctaattgattctgtcttaatctagcaaccgaacttgtcttcatgctgttagtca

SEQ ID NO: 223661 - DNA, 75 bp, Artificial Sequence
  Synthetic
cctccgtaaacaatctgtattgttttggttgtgtgagaaatccactgtgattgagagctctagcactccctctgt

SEQ ID NO: 223662 - DNA, 75 bp, Artificial Sequence
  Synthetic
aagccagacaaacagatgacaacctcctaagactctgtacatctttcaattgctctatattgggctgaaaactgt

SEQ ID NO: 223663 - DNA, 75 bp, Artificial Sequence
  Synthetic
gtaagtgagcatatagtcccacagatcctttaaagatttaaatgcccttgagtctgttagcccttgcttaatcaa

SEQ ID NO: 223664 - DNA, 75 bp, Artificial Sequence
  Synthetic
aatcctcaaactttgtgtaatacattagagggtgagtcccgaccctcaagaagctctcaaactcagtgaatgata

SEQ ID NO: 223665 - DNA, 75 bp, Artificial Sequence
  Synthetic
catggcagcattgcacacaatatcccccattcggtaagagaaccacccaaacccaaactgcaaatcacttctaaa

SEQ ID NO: 223666 - DNA, 75 bp, Artificial Sequence
  Synthetic
tatggcactcatgctcgaggtccttagacagcctgtagtgctcaaaactgagccccactactgacagacactttt

SEQ ID NO: 223667 - DNA, 75 bp, Artificial Sequence
  Synthetic
cataggtctctctacacttctgttcaccacttttaaaacaaaagattgaaaagggcccagcgcttcagcaccatc

SEQ ID NO: 223668 - DNA, 75 bp, Artificial Sequence
  Synthetic
gaatcttcgtaataaattcactcatggacaatttgaataactcttctaaagatgtcctcctgtgcactttagatt

SEQ ID NO: 223669 - DNA, 75 bp, Artificial Sequence
  Synthetic
ttcagatggcatcatgtctttatgaggaaaccatgaaaaattacccaacgtcctggttgttgcaacaaactctcg

SEQ ID NO: 223670 - DNA, 75 bp, Artificial Sequence
  Synthetic
ggaaaccatgaaaaattacccaacgtcctggttgttgcaacaaactctcgcacaaatgactcaaaatacacttgt

SEQ ID NO: 223671 - DNA, 75 bp, Artificial Sequence
  Synthetic
tccttctgttcatcaaaagcctaatgaattcctccttggtgctgtgaaagcttaccaacctgtcattaacactac

SEQ ID NO: 223672 - DNA, 75 bp, Artificial Sequence
  Synthetic
tttaaaaagtttttacaaacatcccttgtgctaacaacaaattcatcaaccagacttgaatcagaccgttgatga

SEQ ID NO: 223673 - DNA, 75 bp, Artificial Sequence
  Synthetic
tataacaacagcctacccaatgtttgtcatttcccagtcctttggattttaattgtttaattagtgaagaaagac

SEQ ID NO: 223674 - DNA, 75 bp, Artificial Sequence
  Synthetic
gaattagtgagatcagaaaataaaacagtgtaatgttcatctcttttccacttaacaacatgagaaatgagtgat

SEQ ID NO: 223675 - DNA, 75 bp, Artificial Sequence
  Synthetic
acaaaacatccaaattcagcaactgtctccttctggtgtttaacaatttcaaacttttgactttgtttaacatgg

SEQ ID NO: 223676 - DNA, 75 bp, Artificial Sequence
  Synthetic
aaggactctgagttgatgtcaatcagcacacagagatcaaggaatttgattctgggactccatctcatgtttttt

SEQ ID NO: 223677 - DNA, 75 bp, Artificial Sequence
  Synthetic
agaggagcctctcatactcactgctgacttcattccccctctcatatccatgggtctctgctgtgatgaacctca

SEQ ID NO: 223678 - DNA, 75 bp, Artificial Sequence
  Synthetic
gagctcatatcagacataaacggaagaagctgatcctcaaaaactttagggtataagcgcctcacagattgaatc

SEQ ID NO: 223679 - DNA, 75 bp, Artificial Sequence
  Synthetic
tcaagggacaggactcaactgcctctctgctcaatgtcaggatgtcatcattatcatttagggtctcataaagct

SEQ ID NO: 223680 - DNA, 75 bp, Artificial Sequence
  Synthetic
acatggttcaaactcaccttgtcctccagcaatcttgagctctcaggtttccttgccacataatcacaagggttt

SEQ ID NO: 223681 - DNA, 75 bp, Artificial Sequence
  Synthetic
cagagaactccttgatcaacttctcagggctaactctttgaaaatttcttttgagcttcccattttctaaatccc

SEQ ID NO: 223682 - DNA, 75 bp, Artificial Sequence
  Synthetic
aagtgtttgacgcttgaattctcactgttcttccccatcacaggttccgccaggacccagacacccagctcgaaa

SEQ ID NO: 223683 - DNA, 75 bp, Artificial Sequence
  Synthetic
tcctaaacctgctgaaaagagagtttataccaaagaccacatcatcacaactcatgctagggttgacgccatcat

SEQ ID NO: 223684 - DNA, 75 bp, Artificial Sequence
  Synthetic
gagttgcttagtgaaatgcagatgtagtcccaaagaagaggtcttaggaaactggtgtgatcacgatgattctct

SEQ ID NO: 223685 - DNA, 75 bp, Artificial Sequence
  Synthetic
ggcacatcctcatgatctcatcattatgaagtgatcttgcgtctctcaaaactttcatagagtccataccggaac

SEQ ID NO: 223686 - DNA, 75 bp, Artificial Sequence
  Synthetic
aaatcactttgtttatcataaatatacagcattatgccatcatgtttttgaattcttgtcacatgttcatctgtt

SEQ ID NO: 223687 - DNA, 75 bp, Artificial Sequence
  Synthetic
gcttatcaacagtggtcttaagagactcacagagtctgaagtattcagactcctcaaagactttctcatcctggc

SEQ ID NO: 223688 - DNA, 75 bp, Artificial Sequence
  Synthetic
gacagatcttcaagaaccttcttaatatacaagttctccctattcccatttctcacacacctgctccccaaagtc

SEQ ID NO: 223689 - DNA, 75 bp, Artificial Sequence
  Synthetic
tggaatattccagaagtttaaataaaaggtctctgaacttaaaatttacccactctggcataaaactgttgtcat

SEQ ID NO: 223690 - DNA, 75 bp, Artificial Sequence
  Synthetic
ttacaaagacctatgaagcctgaagaaatgcaactttgaaaagctgatttgttaatcgcctctgacaaaagcttc

SEQ ID NO: 223691 - DNA, 75 bp, Artificial Sequence
  Synthetic
aatcacaacgaccgtccactattggaactagtgtgatgcctgcaacagcaagatcttccttgatgcatgctaatt

SEQ ID NO: 223692 - DNA, 75 bp, Artificial Sequence
  Synthetic
tgtgcacctcttgtgaatttgctgcaaagtttgttttggagtgtcttaatcaatgaaggaattctctcttcttgg

SEQ ID NO: 223693 - DNA, 75 bp, Artificial Sequence
  Synthetic
tgttggtatcttctatgaacttcttttcaaaactggccggtgtgcttctaacaaaacactcaagaagaataagag

SEQ ID NO: 223694 - DNA, 75 bp, Artificial Sequence
  Synthetic
aaagtcatcactgatgggtagaccactttctgcctcaaaaccattcttaacgggaacatttcattcagatttaac

SEQ ID NO: 223695 - DNA, 75 bp, Artificial Sequence
  Synthetic
agttatcaattagtttgtaaccatcagggatgatgagcggtagtcctgggcatacaattccggattctatcagga

SEQ ID NO: 223696 - DNA, 75 bp, Artificial Sequence
  Synthetic
caattgatgtttgccaactgacttaagtcttctccaaaatcaaggatttcccccagttgaagaatagcctctttt

SEQ ID NO: 223697 - DNA, 75 bp, Artificial Sequence
  Synthetic
ttgtttcgacagatttgtcatcatgattgtgtgtgcagccactcttgtctgcactgtcaatttctatacaacgtg

SEQ ID NO: 223698 - DNA, 75 bp, Artificial Sequence
  Synthetic
ttatttctattgaagaggtccataaaaaactcttcattaaattcaccatttttgagcttatgatgcaacttcctt

SEQ ID NO: 223699 - DNA, 75 bp, Artificial Sequence
  Synthetic
acaacagttttagtccctcgattaacaccattctgggttccctttgtcccagaaagttaagcttctgcctggaca

SEQ ID NO: 223700 - DNA, 75 bp, Artificial Sequence
  Synthetic
acaagctttcttatgattttagtttcaccagggcacagttcttcaatgagcctctgaatcctataacctctagaa

SEQ ID NO: 223701 - DNA, 75 bp, Artificial Sequence
  Synthetic
gcctctcatcttgttctatgtaattcagacacaactctcttaattctaaaatggtttcatccattgcgcatcaaa

SEQ ID NO: 223702 - DNA, 75 bp, Artificial Sequence
  Synthetic
aattcagacacaactctcttaattctaaaatggtttcatccattgcgcatcaaaaagcctaggatcctcggtgcg

SEQ ID NO: 223703 - DNA, 75 bp, Artificial Sequence
  Synthetic
ccatccagccaatcttttacatcagtagtggtgtttagcaaaaatggatccaatgggaagttggcatattttaag

SEQ ID NO: 223704 - DNA, 75 bp, Artificial Sequence
  Synthetic
agagccagtgtcctcttctgaatgcagttcactaaagagaccggaacaccattcgcaacggcttgatcagcaatt

SEQ ID NO: 223705 - DNA, 75 bp, Artificial Sequence
  Synthetic
gtgtctattgtttcacaaagttgatgcggctctttacactttacattatgtagtgctgcggacacaaattttgtt

SEQ ID NO: 223706 - DNA, 75 bp, Artificial Sequence
  Synthetic
ctttgaccatacactcatgagtatagtttcaagtttacacctcagcatcagagggcacaccagctacaaggcagt

SEQ ID NO: 223707 - DNA, 75 bp, Artificial Sequence
  Synthetic
aagaggggaacctcttctccccacacataaaatctagatttaaattccgccgcaaaccgtccaaccacacttttt

SEQ ID NO: 223708 - DNA, 75 bp, Artificial Sequence
  Synthetic
ggactgacaaatttgtttagcaatccgctcaaatgagagtgaaattccaacaagacaagaacttcttctggatca

SEQ ID NO: 223709 - DNA, 75 bp, Artificial Sequence
  Synthetic
gtttcaaccaattcacttagtcttctatcaaataaagtgacctgatcatcacttgatgtgtaagcttctggtctc

SEQ ID NO: 223710 - DNA, 75 bp, Artificial Sequence
  Synthetic
tcaccaaagataacacctatacaataattgatgaacctctcactaatcataccataaaaatcagaagcattatgc

SEQ ID NO: 223711 - DNA, 75 bp, Artificial Sequence
  Synthetic
aaaattccctgtcccatgtcaataaggctagatatgtgggatggcaccacccccatttcaaaatattctctgaaa

SEQ ID NO: 223712 - DNA, 75 bp, Artificial Sequence
  Synthetic
ggcacatgtccaaagccacaccgcctaaccaataaaggtatctgcagctgtggtgcatttaaggtgcctggcgta

SEQ ID NO: 223713 - DNA, 75 bp, Artificial Sequence
  Synthetic
attctctctgtgacggttgtctctgaacctctgaggagtttcaactttgatttaacatatgacttcatcattgca

SEQ ID NO: 223714 - DNA, 75 bp, Artificial Sequence
  Synthetic
ctcacaacaggaaaaggaacctcaacaagtttgtgcatgtgccaagttaatagggtgctaacgtgatcctttccg

SEQ ID NO: 223715 - DNA, 75 bp, Artificial Sequence
  Synthetic
gagcgcacatactggtcatcacccagtttaaggttttgaaggagcatcaggaacaaaaatgggcacatcattggt

SEQ ID NO: 223716 - DNA, 75 bp, Artificial Sequence
  Synthetic
ccccatttactgtgatccatactgtagtttaggaacccttctcgcacattgatggtcattgacaggattgcattt

SEQ ID NO: 223717 - DNA, 75 bp, Artificial Sequence
  Synthetic
tcaaattctttgtcattgttcagacatgaacctgaaaaaaagctagaaaaggattcaaaatagtcctctatcagt

SEQ ID NO: 223718 - DNA, 75 bp, Artificial Sequence
  Synthetic
ctagtgaacatttttgtcctcaggtctccaatgtatagctccctgtttcccccaacctgttccttataagataat

SEQ ID NO: 223719 - DNA, 75 bp, Artificial Sequence
  Synthetic
gcaaattttagcctcccagaatcagggccgacagaagtgtatgatgttggtgattcttctgagtagaaacacaaa

SEQ ID NO: 223720 - DNA, 75 bp, Artificial Sequence
  Synthetic
ttcttcaaagcggcactcatgcattttgtcagtgatagggccctactcagagactcagaattgctttccctctcg

SEQ ID NO: 223721 - DNA, 75 bp, Artificial Sequence
  Synthetic
ctgattctcacgtcctcttctaacttaccccaatcaaatctaaaattcaagccttgtcgttgtagatgtctatat

SEQ ID NO: 223722 - DNA, 75 bp, Artificial Sequence
  Synthetic
ttccccttgagtctaaatctgcccccaactgtctcatacattaccgtgttctttgatttgctgtagcagagtcta

SEQ ID NO: 223723 - DNA, 75 bp, Artificial Sequence
  Synthetic
ttccctgaatacgcgttagcattcatctgtagtaaaatcatcttcatacatgagaaccaatcaccttctgaaaaa

SEQ ID NO: 223724 - DNA, 75 bp, Artificial Sequence
  Synthetic
aactttctacaaaggttttgtgccatttcatccaggccacattgttccctgacagctgaagtgaaatatagtggt

SEQ ID NO: 223725 - DNA, 75 bp, Artificial Sequence
  Synthetic
tcggtgcaagaaaagattgcccagaacgtcaccaatcttttcatagccttcaagttctgccaagaaaaccctcat

SEQ ID NO: 223726 - DNA, 75 bp, Artificial Sequence
  Synthetic
gacaactcttcagaaccttcaacagcctcacacacaaacttcatatcatcatttgtaagacaagatgggtcaaaa

SEQ ID NO: 223727 - DNA, 75 bp, Artificial Sequence
  Synthetic
tcttccactaaatggtaagatatttcagacaaaatgaccttcctcaagtgagccattttacctgacagagcaacc

SEQ ID NO: 223728 - DNA, 75 bp, Artificial Sequence
  Synthetic
tgaagatgatgcagtccttttacattttgaagcgttccccctccctctcctttgtttcccttccagcctttctta

SEQ ID NO: 223729 - DNA, 75 bp, Artificial Sequence
  Synthetic
tactgcattattgtggagctcaccttgtcttctagagccttaaaaaattttgtttcctctaccccttcaaaaaaa

SEQ ID NO: 223730 - DNA, 75 bp, Artificial Sequence
  Synthetic
catgcacctgttggttcatcctctggtttctctacctctgccctactggtacctatcaccaacttagagaccagc

SEQ ID NO: 223731 - DNA, 75 bp, Artificial Sequence
  Synthetic
tttgaaaccttatactcatagtctgagtggttcaatttgtacctctgcttcctcataaaaccctctgtaatctga

SEQ ID NO: 223732 - DNA, 75 bp, Artificial Sequence
  Synthetic
ctcacagcactgacgagcagtttattgaaatcatattctagaagccgttccccatttaggtgtttgttgacaact

SEQ ID NO: 223733 - DNA, 75 bp, Artificial Sequence
  Synthetic
acacttttgttgctagcaaggtccaatgctgttgcacacccagagttggtcatggggtccaggctactgagtttc

SEQ ID NO: 223734 - DNA, 75 bp, Artificial Sequence
  Synthetic
ttctcccccttaaatattaaggtgccattgttgaatgaagacaccatcatactaaaagcctctaaattaacacct

SEQ ID NO: 223735 - DNA, 75 bp, Artificial Sequence
  Synthetic
ggggttgttctctgacagtcggcctctttgcttgtgaacttcttcatctgttcgtaaaaaacacactcctcttcg

SEQ ID NO: 223736 - DNA, 75 bp, Artificial Sequence
  Synthetic
ggagtgatcgcttctttagggttgacaaaaaaaccaaactgacttttgggttcgaagaatttctcaaaacatttt

SEQ ID NO: 223737 - DNA, 75 bp, Artificial Sequence
  Synthetic
atctgatctgtcaacctatccggagtctcctttgtgattagatgacagaggtatgagacatttaacatgaacttg

SEQ ID NO: 223738 - DNA, 75 bp, Artificial Sequence
  Synthetic
ttctacaaagattttttgccatctcatccagaccacattgttctttgacagctgaagtgaagtacaatggtgata

SEQ ID NO: 223739 - DNA, 75 bp, Artificial Sequence
  Synthetic
aattttgcgcttaacaataccttctcaccagtgccaaaaatagttttgactagaaatctaagcagtctatacacc

SEQ ID NO: 223740 - DNA, 75 bp, Artificial Sequence
  Synthetic
atcttttcagcatgcgtgattaaatcctccctcagcttgtccattaatgatgttgttgcaaagtctgaaactatg

SEQ ID NO: 223741 - DNA, 75 bp, Artificial Sequence
  Synthetic
ggtggtgcagtcctttagtatctttaagttctctctcaccctgtccctcattgggttttctgccaccatcatatc

SEQ ID NO: 223742 - DNA, 75 bp, Artificial Sequence
  Synthetic
gccatcactaggtacctgatgttttgaacttgcttctggtttctctttgttgggttagttaacattagtaaaagt

SEQ ID NO: 223743 - DNA, 75 bp, Artificial Sequence
  Synthetic
agggtcctcaacgcagtctcaatgtcagtgaggcagtctttcagatcaggacatgatctgatccatgaaatcata

SEQ ID NO: 223744 - DNA, 75 bp, Artificial Sequence
  Synthetic
gtgtcaatcatattgtgcaatacctcatctgaaaaaattggtagaaagtacctttttgggtctgcataaaaggaa

SEQ ID NO: 223745 - DNA, 75 bp, Artificial Sequence
  Synthetic
atcaagtgaccatttggaccttgtatagagtaacaccttgaggactctccagtcttctggtatagtaaatgatac

SEQ ID NO: 223746 - DNA, 75 bp, Artificial Sequence
  Synthetic
tcctcagaatctagttttatcacctggcagaatacttctttacactccaccacttgataccttacagaccctaat

SEQ ID NO: 223747 - DNA, 75 bp, Artificial Sequence
  Synthetic
ggtaaacttcttcatttgctcataaaagacacattcttcctcaggagtgattgcttctttggggttaacaaagaa

SEQ ID NO: 223748 - DNA, 75 bp, Artificial Sequence
  Synthetic
tgattttgccttaacctggcaactgagctagtcttcatgctatttgtcaaagccaagcagacagatgatagcttt

SEQ ID NO: 223749 - DNA, 75 bp, Artificial Sequence
  Synthetic
ctcaggctctgcacactccttaattgctctgtgttgggctcaaagttgtaatcctcaaactttgtgtaatgcatt

SEQ ID NO: 223750 - DNA, 75 bp, Artificial Sequence
  Synthetic
agtgatcaaatgacataagtatgacacattcaacatgaacttgaactttgcactcaataacaccttctcaccagt

SEQ ID NO: 223751 - DNA, 75 bp, Artificial Sequence
  Synthetic
atcgggtggttaccgactttaatgaaactctcaaattcagtgaatgaaatattgcattcatgcacaaggtgctta

SEQ ID NO: 223752 - DNA, 75 bp, Artificial Sequence
  Synthetic
gataatccatagtgttcaaaactgagtcccaccacagacaggcatttttgaatcttcacaataaattcattcatt

SEQ ID NO: 223753 - DNA, 75 bp, Artificial Sequence
  Synthetic
gatattctaaataattcttccagaggtaccctcctaaacaaatttgatttttttctgttcctcaaaagcctaatg

SEQ ID NO: 223754 - DNA, 75 bp, Artificial Sequence
  Synthetic
tactcttccttggtgctgtagaagctcaccagtctatcatttacgctattgtagcaacaacccacccagtgcttt

SEQ ID NO: 223755 - DNA, 75 bp, Artificial Sequence
  Synthetic
tcattttttaaaccttttgacttcaattgtttaataagtgatgaaagacacaagacatccaagttcaacaactgt

SEQ ID NO: 223756 - DNA, 75 bp, Artificial Sequence
  Synthetic
ctgctaaaaagagaatttatgccaaagaccacatcatcacaagtcatgttggggtcaacaccatcatgacacatt

SEQ ID NO: 223757 - DNA, 75 bp, Artificial Sequence
  Synthetic
ttccttctagtgtttagcagtttcaagctttttactttgttcaacatggaaaggagcctttcatactcagtacca

SEQ ID NO: 223758 - DNA, 75 bp, Artificial Sequence
  Synthetic
gtctcgccctctctcttgtgcccactgatctctgctgtgatgaacctcattaaagggcaagattcaactgcttct

SEQ ID NO: 223759 - DNA, 75 bp, Artificial Sequence
  Synthetic
ttcaagaagaacaagggaattgtcaatcaacttataaccgtcaggaataataagtggcagtcccgggcagacaat

SEQ ID NO: 223760 - DNA, 75 bp, Artificial Sequence
  Synthetic
ttgcttagagttgagatgtcatcgctataagccaaggtctcatatagttcagagtattccttgatcagaccctca

SEQ ID NO: 223761 - DNA, 75 bp, Artificial Sequence
  Synthetic
ggtttgactttttggaagttccttgtcaactttccgatttctaggtctctcctgaacctactgaaaagagagttt

SEQ ID NO: 223762 - DNA, 75 bp, Artificial Sequence
  Synthetic
attccaaaaactacttcatcacaactcatgttaggattaatgccctcatgacacattctcataatttcatcgttg

SEQ ID NO: 223763 - DNA, 75 bp, Artificial Sequence
  Synthetic
gcgcaccggggatcctaggctttttggattgcgctttcctctagatcaactgagtgctgaactctgccaagcaga

SEQ ID NO: 223764 - DNA, 75 bp, Artificial Sequence
  Synthetic
tgcaatgatcttgcatctcttaggattttcatggaatccataccagagcgtttgtcaacagtggtcttaagagat

SEQ ID NO: 223765 - DNA, 75 bp, Artificial Sequence
  Synthetic
tcacaaagtctgaagtactcagactcctcaaagaccttctcatcctgactggaatattccaagagtttaaataaa

SEQ ID NO: 223766 - DNA, 75 bp, Artificial Sequence
  Synthetic
agatctctaaacttgaaattcacccactctggcatgaaggagttatcataatcacagcgaccatccactattggt

SEQ ID NO: 223767 - DNA, 75 bp, Artificial Sequence
  Synthetic
accagtgtcacacctgcaagagctagatcctctcttatgcttgccagtttatttgtatcctctatgaatttcttc

SEQ ID NO: 223768 - DNA, 75 bp, Artificial Sequence
  Synthetic
tcaaagctagctggagtgctcctaacaaagcattcaagaagaatgagtgaattgtcaatcagcttgtaaccatca

SEQ ID NO: 223769 - DNA, 75 bp, Artificial Sequence
  Synthetic
gggatgataagtggtagtcctggacacacaattccagattctatcagaattgtctcaactgacttgtcgtcgtga

SEQ ID NO: 223770 - DNA, 75 bp, Artificial Sequence
  Synthetic
ttgtgtatacaaccacttttgtctgcgccgtccatttctatgcagcgtgacaacaatttgagcccctcaattaat

SEQ ID NO: 223771 - DNA, 75 bp, Artificial Sequence
  Synthetic
agcattctaggttctctttgtcctagaagattgagtttttgtcttgacagcctctcatcctgccctatgtagttc

SEQ ID NO: 223772 - DNA, 75 bp, Artificial Sequence
  Synthetic
tagttcagacataactccctcaactcagaaatagtctcatccattgcgcatcaaaagcctaggatccccggtgcg

SEQ ID NO: 223773 - DNA, 75 bp, Artificial Sequence
  Synthetic
cgcaccggggatcctaggcttattatattgcgctttgtattgaagtctgttctgtgtggactgacctcagcacaa

SEQ ID NO: 223774 - DNA, 75 bp, Artificial Sequence
  Synthetic
cctggaactaacctttacaaatgactctatcattgaccacaacttctgcaacctaactgatgggttcaagaaaaa

SEQ ID NO: 223775 - DNA, 75 bp, Artificial Sequence
  Synthetic
tctatcattgaccacaacttctgcaacctaactgatgggttcaagaaaaaaacctttgatcatacactcatgagc

SEQ ID NO: 223776 - DNA, 75 bp, Artificial Sequence
  Synthetic
gaggaatcatctaagggatctgatgggcgtaccctattgcaactactcaaaattttggtacttacagcatgtaaa

SEQ ID NO: 223777 - DNA, 75 bp, Artificial Sequence
  Synthetic
ggcgtaccctattgcaactactcaaaattttggtacttacagcatgtaaagacaggtgagacgagtgtccctaag

SEQ ID NO: 223778 - DNA, 75 bp, Artificial Sequence
  Synthetic
agacaacagcgcctccctgactctccacctctgagaggtggagagtcagggaggccctttggggttcagagggtc

SEQ ID NO: 223779 - DNA, 75 bp, Artificial Sequence
  Synthetic
catggtttgactgtagcttaatcccacttggggtggccctgctgctcctggtgaaggtcttggtaagtcggtcac

SEQ ID NO: 223780 - DNA, 75 bp, Artificial Sequence
  Synthetic
aggcttgtcaccagttagatcaattgttgtgttttcccatgcccttcccacaacagatgtcctacaggcaatgta

SEQ ID NO: 223781 - DNA, 75 bp, Artificial Sequence
  Synthetic
ggacagggacattgtggtgatgctcactgtgtctccaacaaaagcgcaatcaaatcgcctaggatccacggtgcg

SEQ ID NO: 223782 - DNA, 75 bp, Artificial Sequence
  Synthetic
cgcaccggggatcctaggcattaatttgcgcttcatcgtgggcagtgttgctaccccagaggtcactcttttgag

SEQ ID NO: 223783 - DNA, 75 bp, Artificial Sequence
  Synthetic
gcaatccccaccagccccagaaacccaaccctcgaacgcaaaagcacgcaaacacacagacagagaagcacccac

SEQ ID NO: 223784 - DNA, 75 bp, Artificial Sequence
  Synthetic
acacccaaacaccacgggacccgacaggagccacccaaacacaacaaccatccacagcccaacaccccccacggg

SEQ ID NO: 223785 - DNA, 75 bp, Artificial Sequence
  Synthetic
ggggcccccccggggggccccccctcccctcgggggaagcccgcgggcagcactcagtccacgtcctccacggac

SEQ ID NO: 223786 - DNA, 75 bp, Artificial Sequence
  Synthetic
ttgcaacataatcacaagcgttgatgtgtcttggcactgattcaacgactccttttgccttgatgggctctgcca

SEQ ID NO: 223787 - DNA, 75 bp, Artificial Sequence
  Synthetic
tcatcttcaacaccaagtatttccgcaagttgaaggatcgcatttttcttgtctctattaaagagatccaaaaag

SEQ ID NO: 223788 - DNA, 75 bp, Artificial Sequence
  Synthetic
gtctctattaaagagatccaaaaagaattcttcattgaactccccattttttagtttgtgatgcagtcttcttat

SEQ ID NO: 223789 - DNA, 75 bp, Artificial Sequence
  Synthetic
gatccttacatcctcctccagtctgtcccaatcaaatttgaagttcaagccctgtctttgaacatgcctatattt

SEQ ID NO: 223790 - DNA, 75 bp, Artificial Sequence
  Synthetic
tcccaatcaaatttgaagttcaagccctgtctttgaacatgcctatatttgcctgagtatgcattggcgttcatt

SEQ ID NO: 223791 - DNA, 75 bp, Artificial Sequence
  Synthetic
gtgattcccctgctttttgaacccttcaaattcactgagtgtgatctgacattcaaatgccagatcctcagataa

SEQ ID NO: 223792 - DNA, 75 bp, Artificial Sequence
  Synthetic
cccatagtgtatgagactgaggcccactgcagagagacacctttttaccttcagaatgaagtcttgtacagaatt

SEQ ID NO: 223793 - DNA, 75 bp, Artificial Sequence
  Synthetic
ctttgggaacacagctgttgcaaaatgcaatgtaaatcatgatgaagagttctgtgacatgttgcgattaattga

SEQ ID NO: 223794 - DNA, 75 bp, Artificial Sequence
  Synthetic
caatcaacttgtacccatcagggatgattaagggtaaaccaggacacaccacccctgattcaataaggatggttt

SEQ ID NO: 223795 - DNA, 75 bp, Artificial Sequence
  Synthetic
ccacagacttatcttcaaagttgtgtgtacagccgctcttgtctgcactatccatctctatacaccttgagagca

SEQ ID NO: 223796 - DNA, 75 bp, Artificial Sequence
  Synthetic
gtttaagcagagacttcttaactctgaaatgatttcttccattgcgcatcaaaaaagcctaggatcctcggtgcg

SEQ ID NO: 223797 - DNA, 75 bp, Artificial Sequence
  Synthetic
agtgaggatcctaggctttttgatgcgcaatggatgagactatatcagaattaagggaattatgcctgaactaca

SEQ ID NO: 223798 - DNA, 75 bp, Artificial Sequence
  Synthetic
tagagcaggatgagaggttgtcaaaacaaaagcttaacttcctgggacagagagagcctagaatgatgttaattg

SEQ ID NO: 223799 - DNA, 75 bp, Artificial Sequence
  Synthetic
aagggcttaagctgctgtctcgttgtatagaaatagacagtgcagacaaaagtggctgtatacacaactatgacg

SEQ ID NO: 223800 - DNA, 75 bp, Artificial Sequence
  Synthetic
ccacacccacacacacatgaacacacacccacacacacacgccccccacaccggggggcacccccccggggggcg

SEQ ID NO: 223801 - DNA, 75 bp, Artificial Sequence
  Synthetic
acagatctgttgaaacaatattaatagagtccggagttgtgtgtccaggactaccacttatcatacctgatggct

SEQ ID NO: 223802 - DNA, 75 bp, Artificial Sequence
  Synthetic
ccgcggagacaccgatcagtcgatctcctcggacaccgatccagccagccagtcttcgcaggacttccccttgag

SEQ ID NO: 223803 - DNA, 75 bp, Artificial Sequence
  Synthetic
acaagctaattgacaattccctcattttattagagtgttttgttagaagcacaccatgccaacttgaaaagaaat

SEQ ID NO: 223804 - DNA, 75 bp, Artificial Sequence
  Synthetic
ttatagaggacactaacaagttggcatgtatcaaagaagatcttgctgttgcgggaatcacactagttccaatag

SEQ ID NO: 223805 - DNA, 75 bp, Artificial Sequence
  Synthetic
ttgatggtcgttgtaattatgataacagcttcatgccagagtgggtgaacttcaaattcagagatcttctattca

SEQ ID NO: 223806 - DNA, 75 bp, Artificial Sequence
  Synthetic
aacttttggagtatgctagccaggacgagaaggtttttgaggaatctgagtacttcagactctgtgagtctctta

SEQ ID NO: 223807 - DNA, 75 bp, Artificial Sequence
  Synthetic
aaaccactgttgataagcgttctggtatggattccatgaaagttctaaaagatgcaaggtcacttcataatgatg

SEQ ID NO: 223808 - DNA, 75 bp, Artificial Sequence
  Synthetic
aaattatgaagatgtgccatgatggtgtcaaccctaatatgacatgtgatgatgtggtctttggtataaactctc

SEQ ID NO: 223809 - DNA, 75 bp, Artificial Sequence
  Synthetic
cacaacatctcctattcggtaagagaaccacccaaaaccaaactgtaggtcactcctaaacataggcctttccac

SEQ ID NO: 223810 - DNA, 75 bp, Artificial Sequence
  Synthetic
tttttagtagattcagaagagacctgaaaagtgggaagcttgagagaaagtttcagaagaccaaccctgagggcc

SEQ ID NO: 223811 - DNA, 75 bp, Artificial Sequence
  Synthetic
tggtcaaggagttctctgagctctatgaggtccttactgacaatgatgatgtcttaacactatgtaaagaggcag

SEQ ID NO: 223812 - DNA, 75 bp, Artificial Sequence
  Synthetic
ttgaatcctgtcctttgatgaggttcatcacagcagagacccatgggcatgagaggggaaatgagactagtactg

SEQ ID NO: 223813 - DNA, 75 bp, Artificial Sequence
  Synthetic
agtatgagaggctcctctccatgttgaacaaggtcaaaagcttaaagttgttgaatactagaaggaaacaattac

SEQ ID NO: 223814 - DNA, 75 bp, Artificial Sequence
  Synthetic
catgtttttcaactcttgttacatattcatccttgactaaatcttcaagcactttcttgatgtataggttttccc

SEQ ID NO: 223815 - DNA, 75 bp, Artificial Sequence
  Synthetic
tgaatctagatgtcctgtgcctttcttcactgatcaagcagttaaaatttaaaggattaaaaaatgacaaacact

SEQ ID NO: 223816 - DNA, 75 bp, Artificial Sequence
  Synthetic
gggtgggatgctgttatagtagcgtgaatgataggttggtgagctttcacagcacaaaggaggaatttatcaaac

SEQ ID NO: 223817 - DNA, 75 bp, Artificial Sequence
  Synthetic
ttttaaagaacagaagaaggtcaaaggcacacaggaaagtgacccttgaagaattgtttagaatgtccgtgagtg

SEQ ID NO: 223818 - DNA, 75 bp, Artificial Sequence
  Synthetic
agttcatcacaaagattcaagagtgtctgtcagtagtgggacttagtttcgaacattatggactgtctaaatccc

SEQ ID NO: 223819 - DNA, 75 bp, Artificial Sequence
  Synthetic
tcgtgcatgaatgccacataccatttactgagttcgagaacttcatgaaggccggaacccaccctataatgcact

SEQ ID NO: 223820 - DNA, 75 bp, Artificial Sequence
  Synthetic
atacaaagtttgaggattataattttcaacccaacatagagcaattaagggatgtgcagagcttgaagagattgt

SEQ ID NO: 223821 - DNA, 75 bp, Artificial Sequence
  Synthetic
catctgtttgtttagctctaacaaacagtatgaaaacaagctcagttgctagattaagacaaaatcagttagggt

SEQ ID NO: 223822 - DNA, 75 bp, Artificial Sequence
  Synthetic
ctagaaggtatcagacagttgagtgcaaagaagtgttctgccaggtaataaaactagattctgaggaatatcatc

SEQ ID NO: 223823 - DNA, 75 bp, Artificial Sequence
  Synthetic
tactatatcagaagactggagagtcttcgaggtgctattccatacagggcttggatggtcacttaatttcctttt

SEQ ID NO: 223824 - DNA, 75 bp, Artificial Sequence
  Synthetic
acgcagatccaaagaggttttttctaccaattttttcagatgaggtgttgcataatatgattgacaccatgatct

SEQ ID NO: 223825 - DNA, 75 bp, Artificial Sequence
  Synthetic
ccctttgtatttctgagttcttccccaccttctctctcattaattttcttactcctcctataatgtgttattgta

SEQ ID NO: 223826 - DNA, 75 bp, Artificial Sequence
  Synthetic
catggatcaggtcatgccctgatttgaaggacagtatcattgatattgagactgcattgaggaccctactgttac

SEQ ID NO: 223827 - DNA, 75 bp, Artificial Sequence
  Synthetic
taatgctcaccaaccctacaaaaaggaatcaaaagcaagtgcaaaatattagatacttagtcatggccattgtct

SEQ ID NO: 223828 - DNA, 75 bp, Artificial Sequence
  Synthetic
ccgacttttcatccacatcattgatggacaagttgagggagaatctaatcactcctgctgaaaaattggtgtata

SEQ ID NO: 223829 - DNA, 75 bp, Artificial Sequence
  Synthetic
ggctgcttaggtttttgatcaaaaccatttttggtgctggtgagaaagtgctattgagtgcaaagtttaagttca

SEQ ID NO: 223830 - DNA, 75 bp, Artificial Sequence
  Synthetic
tgttaaatgtgtcatacctatgtcatttaattacaaaagagacccctgacagattaacagaccaaataaaatgtt

SEQ ID NO: 223831 - DNA, 75 bp, Artificial Sequence
  Synthetic
ttgaaaagttctttgaacccaagagtcagtttggctttttcctcaaccctaagagaacaatcactcccgaagaaa

SEQ ID NO: 223832 - DNA, 75 bp, Artificial Sequence
  Synthetic
agtgtgttttttatgagcaaatgaagaagttcaccagcaaagaaactgactgtcagcgcacagtcccaggtgtta

SEQ ID NO: 223833 - DNA, 75 bp, Artificial Sequence
  Synthetic
atttggaggttttcagtctaatggtgtcttcatttaacaatggtaccttgattttcaaaggggagaaaaagctca

SEQ ID NO: 223834 - DNA, 75 bp, Artificial Sequence
  Synthetic
acaacttagaccctatggctaattctggatgtgctacggcattggatcttgccagcaataagagtgtagttgtta

SEQ ID NO: 223835 - DNA, 75 bp, Artificial Sequence
  Synthetic
ataagcatctgaatggagagcgactcctggagtatgacttcaacaaattacttgtaaatgctgtaagtcaaatca

SEQ ID NO: 223836 - DNA, 75 bp, Artificial Sequence
  Synthetic
cagagggctttgagaggaagcagaagtataagctgagccactcagattatgaatataaggtctcaaaattggttt

SEQ ID NO: 223837 - DNA, 75 bp, Artificial Sequence
  Synthetic
ctaagttggtcattggctccaagggggcagagccagggaacccagaaagtgacacagcagaagtttgttttgaag

SEQ ID NO: 223838 - DNA, 75 bp, Artificial Sequence
  Synthetic
gagaagaagaaacaagtttcttcaagaaactagaaaacaaggttaactctacaataacacattataagcaaggta

SEQ ID NO: 223839 - DNA, 75 bp, Artificial Sequence
  Synthetic
agaaggttaatggagagaagggtggggaagaactcaaaaacacaaaagggttacatcatcttcagactgtcttgt

SEQ ID NO: 223840 - DNA, 75 bp, Artificial Sequence
  Synthetic
caggtaagatggctcatttgaggaaggtaatcttatcagagatatctttccatctagtagaggactttgatccat

SEQ ID NO: 223841 - DNA, 75 bp, Artificial Sequence
  Synthetic
cctgtctcactaatgatgatatgcaatttgtttgtgaagctgttgagggctctacagaattatcaccattgtatt

SEQ ID NO: 223842 - DNA, 75 bp, Artificial Sequence
  Synthetic
tcacttcagttgttaaagaacaatgtggtctagatgagctggcaaaaaacctttgcaggaaattcttttcagagg

SEQ ID NO: 223843 - DNA, 75 bp, Artificial Sequence
  Synthetic
gcgattggttttcatgtatgaagatgatcctattgcaaatgaatgcgaatgcatactcaggaaagtataggcata

SEQ ID NO: 223844 - DNA, 75 bp, Artificial Sequence
  Synthetic
tacaaagacagggcttgaatttcaaatttgactgggataagctggaagaggacgtaagaatcagcgaaagagaaa

SEQ ID NO: 223845 - DNA, 75 bp, Artificial Sequence
  Synthetic
gcaattctgaatctttaagtaaagccttatcattgacgaagtgcatgagtgctgctttaaaaaatttgtgtttct

SEQ ID NO: 223846 - DNA, 75 bp, Artificial Sequence
  Synthetic
attcagaagagtcaccaacatcatacacttcagttggtcctgattctggaagactgaaatttgcattatcttaca

SEQ ID NO: 223847 - DNA, 75 bp, Artificial Sequence
  Synthetic
aagagcaggttggggggaatagagaactttatattggagatctgaggacaaaaatgttcacaagactaatagagg

SEQ ID NO: 223848 - DNA, 75 bp, Artificial Sequence
  Synthetic
attattttgagtccttttctagtttcttttcaggctcatgcttaaacaatgacaaagaatttgaaaatgctgttc

SEQ ID NO: 223849 - DNA, 75 bp, Artificial Sequence
  Synthetic
tgtcaatgactatcaatgtgcgagaagggtttttaaactacagtatggatcacagcaaatgggggccaatgatgt

SEQ ID NO: 223850 - DNA, 75 bp, Artificial Sequence
  Synthetic
gtccttttctgtttctaatgcttctacaaaatctaaaactggatgatgatcagcatgtgcgctctggaaaggatc

SEQ ID NO: 223851 - DNA, 75 bp, Artificial Sequence
  Synthetic
atgtcagcaccttactgacttggcatatgcacaaacttgttgaagttcctttccctgttgtgaacgcaatgatga

SEQ ID NO: 223852 - DNA, 75 bp, Artificial Sequence
  Synthetic
agtcatatgttaagtcaaaattgaagcttcttagaggttcagaaactactgttacagagagactttttagagaat

SEQ ID NO: 223853 - DNA, 75 bp, Artificial Sequence
  Synthetic
gttttgaattaggaattgtgccatctcatatatctagtcttattgatatgggacaaggaatactgcataacgctt

SEQ ID NO: 223854 - DNA, 75 bp, Artificial Sequence
  Synthetic
cggatttttatggcttaattagtgagaggttcattaattactgcattggtgtcatttttggtgagagacctgaag

SEQ ID NO: 223855 - DNA, 75 bp, Artificial Sequence
  Synthetic
cttacacatcaagtgatgatcagatcactttatttgacagaagattaagtgaactggttaagagtgatccggatg

SEQ ID NO: 223856 - DNA, 75 bp, Artificial Sequence
  Synthetic
aagttcttgtcttgctagagtttcattctcatttaagtggtttgttgaacaaattcatcagtcctaaaagtgtgg

SEQ ID NO: 223857 - DNA, 75 bp, Artificial Sequence
  Synthetic
tcgggcgatttgctgcagaatttaaatctaggttctatgtgtggggagaggaagttcctcttcttacaaagtttg

SEQ ID NO: 223858 - DNA, 75 bp, Artificial Sequence
  Synthetic
tctctgcagcactacacaacgtcaaatgcaaagagccacatcaactttgtgaaaccatagatacaattgctgatc

SEQ ID NO: 223859 - DNA, 75 bp, Artificial Sequence
  Synthetic
aagctattgcaaatggtgttcctgtttctttggtgaactgcatccaaagaaggacactggttctcttaaaatatt

SEQ ID NO: 223860 - DNA, 75 bp, Artificial Sequence
  Synthetic
ccaacttccctttggacccatttttattaaacacaaacactgatgtgaaggattggctagatggttctagaggtt

SEQ ID NO: 223861 - DNA, 75 bp, Artificial Sequence
  Synthetic
atagaatccaaagactcatagaagaactatgtcccaatgaaacaaaggtcataaggaaactcgttaggaaactac

SEQ ID NO: 223862 - DNA, 75 bp, Artificial Sequence
  Synthetic
atcataagctcaaaaatggtgattttaacgaagagtttttattggaccttttcaatagagagaagaaggaggcca

SEQ ID NO: 223863 - DNA, 75 bp, Artificial Sequence
  Synthetic
tccttcagttaggggatatccttaatcttaaagaagatctaagtcagttggcagacatcaattggttgaatttga

SEQ ID NO: 223864 - DNA, 75 bp, Artificial Sequence
  Synthetic
atgaaatgttcccattaaggatggttttgagacaaaaggtgatatacccatcagtgatgactttccaagaagaga

SEQ ID NO: 223865 - DNA, 75 bp, Artificial Sequence
  Synthetic
ggatcccatcattgattaagacactccaaaacaaactctgtagcaagttcacaagaggtgcacagaagctattgt

SEQ ID NO: 223866 - DNA, 75 bp, Artificial Sequence
  Synthetic
cagaggcaatcaataagtcagcctttcaaagctgcatctcatctggtttcataggtctttgcaaaactctgggaa

SEQ ID NO: 223867 - DNA, 75 bp, Artificial Sequence
  Synthetic
gtagatgtgtgagaaataaaaacagagagaacttatatatcaagaaagtgcttgaggacctggccatggatgaat

SEQ ID NO: 223868 - DNA, 75 bp, Artificial Sequence
  Synthetic
atgtgacaagggttcaaaaacacgatggcatcatgctgtacgtctgtgacagacaaagtcacccagatagtcacc

SEQ ID NO: 223869 - DNA, 75 bp, Artificial Sequence
  Synthetic
gtgatcacatcagcctcctaaggcctcttctctgggactacatttgtgtctcgttgagcaactcctttgagttgg

SEQ ID NO: 223870 - DNA, 75 bp, Artificial Sequence
  Synthetic
gtgtctgggtcctagcagagcctgtaaaagcgagggatgttgggatctcaaatattaaacacttaaatccatgtg

SEQ ID NO: 223871 - DNA, 75 bp, Artificial Sequence
  Synthetic
attatgtagcaaggaagcctgaaagttcaagactactagaagacaaagtgagtctaaatcatgtaattcaatctg

SEQ ID NO: 223872 - DNA, 75 bp, Artificial Sequence
  Synthetic
tgaggagattgtaccctaagatttatgaggatcagttgcttccgttcatgtctgatatgagctcaaaaaatatga

SEQ ID NO: 223873 - DNA, 75 bp, Artificial Sequence
  Synthetic
ggtggagtcccaggatcaaattccttgacctctgtgtactaattgacattaacttagagtctttgtcactgattt

SEQ ID NO: 223874 - DNA, 75 bp, Artificial Sequence
  Synthetic
ctcatgttgttaaatggaagagggatgaacattacactgttttattttctgaccttgccaattctcatcaacggt

SEQ ID NO: 223875 - DNA, 75 bp, Artificial Sequence
  Synthetic
ctgattcaagtctggttgatgagtttgttattagcacaagggatgtttgtaaaaactttttaaaacaagtgtatt

SEQ ID NO: 223876 - DNA, 75 bp, Artificial Sequence
  Synthetic
ttgagtcgttcgtgcgagagtttgccgtaacagccaggactttgggcagtttttcatggtttcctcataaagaca

SEQ ID NO: 223877 - DNA, 75 bp, Artificial Sequence
  Synthetic
tgatgccttcagaagatggtgctgaggcactgggaccttttcaatcattcgttttaaaagtagtgaataaaagca

SEQ ID NO: 223878 - DNA, 75 bp, Artificial Sequence
  Synthetic
tagagaggcccatgttcaggaatgatctgcaatttggctttggatggttttcttatcagatgggagacgcagtgt

SEQ ID NO: 223879 - DNA, 75 bp, Artificial Sequence
  Synthetic
gtaatgctgcaatgctgattaagcagggtctaacaaatccaaaggcatttaaatctttgaaggatctgtgggact

SEQ ID NO: 223880 - DNA, 75 bp, Artificial Sequence
  Synthetic
acatgcttgacagcacaaagagagtattagagttctcagttacaatagatttcacgcacaatcaaaataacactg

SEQ ID NO: 223881 - DNA, 75 bp, Artificial Sequence
  Synthetic
actgcttaaggaaattttctttagttctcttaataaagtgtcaactgcagggtccaggtgtggctaagttccttt

SEQ ID NO: 223882 - DNA, 75 bp, Artificial Sequence
  Synthetic
cgtgcaatcacttttttaaaggtgaggtggacaggagactgttagatgaatgtctttgcctgttgagggcagacc

SEQ ID NO: 223883 - DNA, 75 bp, Artificial Sequence
  Synthetic
ctatctttaagaagaacaatagtgtctttgacatcaggtctgaggaatttggggactacattaaagatcctttga

SEQ ID NO: 223884 - DNA, 75 bp, Artificial Sequence
  Synthetic
cacttggtgattctattgaactcaagctggtaggttctaaaaaaatactggatgaggttaggtctctagacttta

SEQ ID NO: 223885 - DNA, 75 bp, Artificial Sequence
  Synthetic
agagaatagggcctgaatgggagcctgtgcctctgactgtgagtgcgggtgcactttttgaagggagaaactttg

SEQ ID NO: 223886 - DNA, 75 bp, Artificial Sequence
  Synthetic
ttcaaaacatccttgtgaaattggagaccaaagatatgagagtctttttggcagaacttgagggctatgagagga

SEQ ID NO: 223887 - DNA, 75 bp, Artificial Sequence
  Synthetic
ttgatggcgttctcggcaacctcctcttgcatcgatttaaaactggtgaacatttatcaggctcagaaataggtg

SEQ ID NO: 223888 - DNA, 75 bp, Artificial Sequence
  Synthetic
tggttcttcaagaattatgcatggacagatctattttattgaaaccattgtcacttgtaccagactggtttgctt

SEQ ID NO: 223889 - DNA, 75 bp, Artificial Sequence
  Synthetic
ttaaagactgtagactctgttacagtaggtctaaaaacacagtgatgtatgaaacagttgggggtagattcagac

SEQ ID NO: 223890 - DNA, 75 bp, Artificial Sequence
  Synthetic
ttcagactcaaagggaggtcttgtgatgactggctctccgcgctggtgacggaggacatcgactgatgggcatct

SEQ ID NO: 223891 - DNA, 75 bp, Artificial Sequence
  Synthetic
cgcaccggggatcctaggctttttggattgcgctttcctcagctccgtcttgtgggagaatgggccaaatagtga

SEQ ID NO: 223892 - DNA, 75 bp, Artificial Sequence
  Synthetic
cgatgtttgaggctctgcctcacatcatcgatgaagtcatcaacatcgtcattatcgtactcattatcatcacaa

SEQ ID NO: 223893 - DNA, 75 bp, Artificial Sequence
  Synthetic
gcatcaaagctgtatacaatttcgccacctgcgggattcttgcattgatcagctttctcttcctggctggcaggt

SEQ ID NO: 223894 - DNA, 75 bp, Artificial Sequence
  Synthetic
cctgtggtatgtatggcctcagtgggcctgacatttacaaaggagtttaccaattcaagtcagtggagtttgaca

SEQ ID NO: 223895 - DNA, 75 bp, Artificial Sequence
  Synthetic
tgtctcaccttaacctgacgatgcccaatgcatgttcggtgaacaattctcatcattacataagtatggggactt

SEQ ID NO: 223896 - DNA, 75 bp, Artificial Sequence
  Synthetic
ctggattagaattgaccttcacaaatgattctatcatcacacacaatttctgtaatctgacttccgcttttaaca

SEQ ID NO: 223897 - DNA, 75 bp, Artificial Sequence
  Synthetic
agaaaacctttgaccacacactcatgagcatagtctcaagcctgcacctcagcattaggggaaactccaattaca

SEQ ID NO: 223898 - DNA, 75 bp, Artificial Sequence
  Synthetic
aagcggtgtcctgtgattttaacagtggcataactattcaatataacctaacattctctgatgcacagagtgctc

SEQ ID NO: 223899 - DNA, 75 bp, Artificial Sequence
  Synthetic
taagccaatgtaagacctttagaggaagagtcctggacatgttcagaactgcctttggagggaagtatatgagga

SEQ ID NO: 223900 - DNA, 75 bp, Artificial Sequence
  Synthetic
gtggctggggctggacaggtgcagacggcaagaccacttggtgcagccagacaagctatcaatatctgatcatac

SEQ ID NO: 223901 - DNA, 75 bp, Artificial Sequence
  Synthetic
aaaacagaacttgggaaaaccactgcacttacgcaggtcccttcggaatgtccagaatcctctctgctcaagaaa

SEQ ID NO: 223902 - DNA, 75 bp, Artificial Sequence
  Synthetic
agacaaaatttcttaccaggaggcttgcaggcacattcacttggactctgtcagactcatcaggggtggaaaatc

SEQ ID NO: 223903 - DNA, 75 bp, Artificial Sequence
  Synthetic
caggtggttattgtttgactaagtggatgattcttgctgcagagctcaagtgttttgggaacacagctgttgcaa

SEQ ID NO: 223904 - DNA, 75 bp, Artificial Sequence
  Synthetic
aatgcaatgtaaatcatgatgaagagttttgtgacatgctgcgattgattgattacaacaaagctgctctgagaa

SEQ ID NO: 223905 - DNA, 75 bp, Artificial Sequence
  Synthetic
aattcaaagaagatatggagtctgctttacacctgtttaaaacaacagtgaactctttgatttctgatcagctac

SEQ ID NO: 223906 - DNA, 75 bp, Artificial Sequence
  Synthetic
taatgaggaatcacctgagagatttaatgggggtaccatactgtaattactcgaaattttggtatctggagcatg

SEQ ID NO: 223907 - DNA, 75 bp, Artificial Sequence
  Synthetic
caaagactggcgaaactagtgtgcccaagtgttggcttgttagcaatggttcttacttaaatgaaacccatttca

SEQ ID NO: 223908 - DNA, 75 bp, Artificial Sequence
  Synthetic
gtgaccaaattgagcaggaagcagataacatgatcacagaaatgctgaggaaagactacctaaaaaggcaaggga

SEQ ID NO: 223909 - DNA, 75 bp, Artificial Sequence
  Synthetic
gcactcccttagctttaatggatctactgatgttctctacatcagcatatttaataagcatctttctgcatctta

SEQ ID NO: 223910 - DNA, 75 bp, Artificial Sequence
  Synthetic
taaaaataccaacacacagacacataaagggtggctcatgcccaaaaccgcaccggttaaccaataaggggatct

SEQ ID NO: 223911 - DNA, 75 bp, Artificial Sequence
  Synthetic
aaagggtggctcatgcccaaaaccgcaccggttaaccaataaggggatctgcagttgtggtgcgttcaaagtgcc

SEQ ID NO: 223912 - DNA, 75 bp, Artificial Sequence
  Synthetic
tggtgtgaaaaccatctggaaaagacgctgaacaacagcgcctccctgactctccacctcgaaagaggtggagag

SEQ ID NO: 223913 - DNA, 75 bp, Artificial Sequence
  Synthetic
tcagggaggcccaaggggtcttagagtgtcacaacgtttggacctctaaagatcaaatcatgtggcaagatgttg

SEQ ID NO: 223914 - DNA, 75 bp, Artificial Sequence
  Synthetic
tgtacagtttttaggtcagggagccttgccttggaggcgctctcaaagatgatacaatccatgagtgcgcagtgt

SEQ ID NO: 223915 - DNA, 75 bp, Artificial Sequence
  Synthetic
ggggtgatctctttcttcttcttgtccctcactattccagtgtgcatcttgcacagccagccatatctgtcccag

SEQ ID NO: 223916 - DNA, 75 bp, Artificial Sequence
  Synthetic
accttgtcctcatattctcttgaagcttctttggtcatttccacatcaataagcttgatgtctcttctattctga

SEQ ID NO: 223917 - DNA, 75 bp, Artificial Sequence
  Synthetic
gaatctaggagctttctgatgtcatcagaaccttgacaacttaagaccattccttgtggaagagcacctatcacc

SEQ ID NO: 223918 - DNA, 75 bp, Artificial Sequence
  Synthetic
gaagatgtcagcccaggttgtgcattaaaaaggtcagcaaggtccataccatgtgaatatttagagtcctgcttg

SEQ ID NO: 223919 - DNA, 75 bp, Artificial Sequence
  Synthetic
aattgtttttggtcagtgggttccctataaaaatgtatgtactgcccattttgtggttgaaatattgctatctcc

SEQ ID NO: 223920 - DNA, 75 bp, Artificial Sequence
  Synthetic
actgggtcattgaatctaccttcaatgtcgatccaggtgggagcattagggtcaatgccccccataaggtccttc

SEQ ID NO: 223921 - DNA, 75 bp, Artificial Sequence
  Synthetic
agcagcattgtctgactatagcttaggcctacttgaggtgggcctgctgccccaggtgctggtctgggtgaattg

SEQ ID NO: 223922 - DNA, 75 bp, Artificial Sequence
  Synthetic
gtcatggccctctcatttgtcagatctattgttgtgttctcccatgctctccccacaactgatgttctacaagct

SEQ ID NO: 223923 - DNA, 75 bp, Artificial Sequence
  Synthetic
atatatggccacccctcacctgagagacagactttatagaggatgttctcataaggattcctgtctccaacctga

SEQ ID NO: 223924 - DNA, 75 bp, Artificial Sequence
  Synthetic
tcagagacaaacatgtttagtttcctcttggccccaagaactgctttcaggaggtcctcattgttgcttggctta

SEQ ID NO: 223925 - DNA, 75 bp, Artificial Sequence
  Synthetic
attaaaatggattctagcatgttgcccccatccaacaaagctgcccctgccttcacagcagcaccaaggctgaaa

SEQ ID NO: 223926 - DNA, 75 bp, Artificial Sequence
  Synthetic
ttgtagccagatatgttaatgctagactgctgctcagtgatgacccccaagactgggtgcttgtctttcaacctt

SEQ ID NO: 223927 - DNA, 75 bp, Artificial Sequence
  Synthetic
tcaaggtcactcagattcgggtatttaactgtgtagagcaacccaaggtctgtgagtgcttgcacgacatcattg

SEQ ID NO: 223928 - DNA, 75 bp, Artificial Sequence
  Synthetic
agtgaggtctgtgactgcttggccatacaggccattgttaggcttggcattgtgccaaactgattgttcaaaagt

SEQ ID NO: 223929 - DNA, 75 bp, Artificial Sequence
  Synthetic
gatgagtctttcacatcccagactctcaccacaccacttgcaccctgctggggtctcctcattccaaccatttgc

SEQ ID NO: 223930 - DNA, 75 bp, Artificial Sequence
  Synthetic
agaatctgggatctttggtcaagctgttgtgcagtcaagttccccatgtagactccagaagcttgaggcctttca

SEQ ID NO: 223931 - DNA, 75 bp, Artificial Sequence
  Synthetic
gatctcataatcttagccttcagcttttcaagatcagctgcaagggacatcaattcttctgcactaagtcttccc

SEQ ID NO: 223932 - DNA, 75 bp, Artificial Sequence
  Synthetic
acttttaggacattcttttttgatgttgactttaggtccacaagggaatacacagtttggttgaggcttctgagt

SEQ ID NO: 223933 - DNA, 75 bp, Artificial Sequence
  Synthetic
ctctgtaagtccttgtcatccctcttttctttcctcatgattctctgaacattacttacctcagagaaatccaat

SEQ ID NO: 223934 - DNA, 75 bp, Artificial Sequence
  Synthetic
ccattcagaaggctggtagcatctttgatcacagcagctttcacgtctgacgtgaagccctgaagttccctcctc

SEQ ID NO: 223935 - DNA, 75 bp, Artificial Sequence
  Synthetic
cgtgaagccctgaagttccctcctcaatgcctgggtccactggaagctttttacttctttggacagagacatttt

SEQ ID NO: 223936 - DNA, 75 bp, Artificial Sequence
  Synthetic
cgcaccggggatcctaggcatttttgttgcgcattttgttgtgctgtttgttgcacagccctctcacgtgggacc

SEQ ID NO: 223937 - DNA, 75 bp, Artificial Sequence
  Synthetic
atcactaacaaaccaaaccattagccatgggccaaggcaggtccaaagaggagaagaacgccagcagtacgaaca

SEQ ID NO: 223938 - DNA, 75 bp, Artificial Sequence
  Synthetic
gagccgagattctgccagacaccacctatcttggacccctgaattgcaagtcatgctggcagagatttgacagtt

SEQ ID NO: 223939 - DNA, 75 bp, Artificial Sequence
  Synthetic
tagtcaaatgccatgaccactatctctgcagacactgtctgaatctcctgctgtcagtctctgacagatgccccc

SEQ ID NO: 223940 - DNA, 75 bp, Artificial Sequence
  Synthetic
tctgtaaatatccactgccaaccaaactaaaaatatcaacggccccaagctcaccacctccctacgaggagtgac

SEQ ID NO: 223941 - DNA, 75 bp, Artificial Sequence
  Synthetic
accccgagtcccaacaccgacacacagcccaacgcaggaaagagacaaaagggcacacacccatcaacacacacg

SEQ ID NO: 223942 - DNA, 75 bp, Artificial Sequence
  Synthetic
gacacagcacccaacgcaagacacgcacacacacgcccacacacacacccacacccacacgccccccacaccagg

SEQ ID NO: 223943 - DNA, 75 bp, Artificial Sequence
  Synthetic
gggcgcccccccgggggggaggccccccgggggcccgggtggagccccgcagggagaccgatcagtcgatttcct

SEQ ID NO: 223944 - DNA, 75 bp, Artificial Sequence
  Synthetic
caaccatcgacccagccagccaatcgtcacaggatttccccttgagtctgaacctgcccacaactgtttcataca

SEQ ID NO: 223945 - DNA, 75 bp, Artificial Sequence
  Synthetic
tcactgtgttctttgacttactaaagcagagtcggcagtctttgaaagtgaaccagtctggtacagacgacagtg

SEQ ID NO: 223946 - DNA, 75 bp, Artificial Sequence
  Synthetic
gtaccagtagaacagatctgtccatgcacagctcctggaggactatgccaatttcagacccctgtagatgctcac

SEQ ID NO: 223947 - DNA, 75 bp, Artificial Sequence
  Synthetic
cagttctaaatcgatgtagtagaaggtttccgaggatgtcatcaaatttttcatagccttcgagttctgccagga

SEQ ID NO: 223948 - DNA, 75 bp, Artificial Sequence
  Synthetic
aaaccctcatatccttggtctccaatttcacagagatgttctgaacaaggcttctcccctcgaaaagagcaccta

SEQ ID NO: 223949 - DNA, 75 bp, Artificial Sequence
  Synthetic
atctcacagttagaggcacaggttcccattcaggcccgatcctctcaaaatcaggggatctaaccccgtccagta

SEQ ID NO: 223950 - DNA, 75 bp, Artificial Sequence
  Synthetic
ttttccttgagcctatcagctcgagctcgagggagtcaccgagtatcaaggggtcctccatataatcctcaaact

SEQ ID NO: 223951 - DNA, 75 bp, Artificial Sequence
  Synthetic
cttcagatctaatgtcaaagacaccatcatttgctctgaagatagagtctgttctcaataaatggaggcattcat

SEQ ID NO: 223952 - DNA, 75 bp, Artificial Sequence
  Synthetic
ccaacaatcttctgtccacctcacctttaaaaaggtgagagcatgacaggaactcagctacacctggactttgca

SEQ ID NO: 223953 - DNA, 75 bp, Artificial Sequence
  Synthetic
attggcactttactaagaaaatcaatgaaaacttcttcaaacaatcagtgttattctggttgtgtgtaaagtcca

SEQ ID NO: 223954 - DNA, 75 bp, Artificial Sequence
  Synthetic
ctgtgattgagaactccagtactccctttgtattattcatcatgtaatcccacaaatttctcaaagatttgaatg

SEQ ID NO: 223955 - DNA, 75 bp, Artificial Sequence
  Synthetic
cttttggattaaccaaaccttgcctgatcagcatggcaacattgcacacaatatctcccaatcggtatgagaacc

SEQ ID NO: 223956 - DNA, 75 bp, Artificial Sequence
  Synthetic
atccaaatccaaattgcaagtcattcctgaacatgggcctttccacatttttgttcacaaccttcaaaatgaatg

SEQ ID NO: 223957 - DNA, 75 bp, Artificial Sequence
  Synthetic
attggaaaggccccagtgcctcggcgccatcttctgatggcatcatgtctttatggggaaaccatgagaaacttc

SEQ ID NO: 223958 - DNA, 75 bp, Artificial Sequence
  Synthetic
ctagagttctagttgttgcgacaaattctcgcacaaatgactcaaaatacacctgtttcaggaagtttttacaga

SEQ ID NO: 223959 - DNA, 75 bp, Artificial Sequence
  Synthetic
catctcttgtgctaacaacaaattcatcaacaaggcttgaatcggagcgttggtgagaacttgcgagatcagaaa

SEQ ID NO: 223960 - DNA, 75 bp, Artificial Sequence
  Synthetic
atagaacagtgtagtgttcgtccctcttccacttgactacatgagaaatgagtgatagagactctgagttgatat

SEQ ID NO: 223961 - DNA, 75 bp, Artificial Sequence
  Synthetic
caatcaatacacaaaggtcaaggaatttgattctaggactccatctcatgttttttgagctcatatcagacataa

SEQ ID NO: 223962 - DNA, 75 bp, Artificial Sequence
  Synthetic
agggaagcagctgatcctcgtaaattttggggtacaatcgtctcacagattggatcacatggtttagacttactt

SEQ ID NO: 223963 - DNA, 75 bp, Artificial Sequence
  Synthetic
tgtcctccaacagtcttgagctctcaggcttccttgctacataatcacatgggtttaaatgttcaaggcctgagt

SEQ ID NO: 223964 - DNA, 75 bp, Artificial Sequence
  Synthetic
ttccctcactctttcctttcacaggctctgctaagacccaaacgcccaactcaaaggagttactcagtgagatgc

SEQ ID NO: 223965 - DNA, 75 bp, Artificial Sequence
  Synthetic
aaatgtaatcccagagaagaggccttaggagactgatgtgatcgcggtgagcttctggatgactttgtctgtcac

SEQ ID NO: 223966 - DNA, 75 bp, Artificial Sequence
  Synthetic
aaatgtacaacattataccatcatgcctgtgggctgctgtcacatgttcatccatagctaaatcctcaagcactt

SEQ ID NO: 223967 - DNA, 75 bp, Artificial Sequence
  Synthetic
tttttatatacaggttatccctattcttatttctcacacacctacttcccaaagtcttacaaagacctataaaac

SEQ ID NO: 223968 - DNA, 75 bp, Artificial Sequence
  Synthetic
ctgatgaaatacaactttggaaagctgacttattgattgcttctgataacaacttttgtgctcctcttgtgaact

SEQ ID NO: 223969 - DNA, 75 bp, Artificial Sequence
  Synthetic
tgctgcagagcttattctggagtgtcttaatcaatgaagggattctttcctcttggaaagtcattgctgaagggt

SEQ ID NO: 223970 - DNA, 75 bp, Artificial Sequence
  Synthetic
agaccactttctgcctcaaaaccattcttaatgggaacatctcgtttagattcagccaatttatgtttgataatt

SEQ ID NO: 223971 - DNA, 75 bp, Artificial Sequence
  Synthetic
gatccagatcctcctcaaggccaaggatgtctcccaactgaagaatagcttccttcttgtccctgttgaaaaggt

SEQ ID NO: 223972 - DNA, 75 bp, Artificial Sequence
  Synthetic
ctaagaagaactcttcattgaactcaccattcttgagcttatgatgtagtctccttacgagtttcctcatgacct

SEQ ID NO: 223973 - DNA, 75 bp, Artificial Sequence
  Synthetic
ttgattcactaggacacaattcttcaatgagcctttggactctgtaacctctagagccatccaaccagtctttga

SEQ ID NO: 223974 - DNA, 75 bp, Artificial Sequence
  Synthetic
catcagtattagtgtttagcaagaatggatctaagggaaagttagcatactttaagagatctagtgtcctttttt

SEQ ID NO: 223975 - DNA, 75 bp, Artificial Sequence
  Synthetic
ggatgcagtttaccaatgaaactggaacaccatttgcaacagcttgatcggcaattgtgtctattgtttcacaga

SEQ ID NO: 223976 - DNA, 75 bp, Artificial Sequence
  Synthetic
gttgatgtggctctttacacttaacgttatgtaatgctgcagacacaaactttgtaagaagtgggacctcttctc

SEQ ID NO: 223977 - DNA, 75 bp, Artificial Sequence
  Synthetic
cccacacataaaatctggacttaaattctgcagcaaatcgccctaccacactcttcggactgatgaacttgttca

SEQ ID NO: 223978 - DNA, 75 bp, Artificial Sequence
  Synthetic
acaaaccactcaaatgggaatgaaattccaacaagacaaggacttcttctggatcactatctactagttcactta

SEQ ID NO: 223979 - DNA, 75 bp, Artificial Sequence
  Synthetic
acctcctatcaaataaggtgatctgatcatcacttgatgtgtaagattctggcctctcaccgaagataacaccga

SEQ ID NO: 223980 - DNA, 75 bp, Artificial Sequence
  Synthetic
tgcaataattgatgaatctttcactaatcaagccgtaaaaatcagaggcattatgtaaaattccttgtcccatgt

SEQ ID NO: 223981 - DNA, 75 bp, Artificial Sequence
  Synthetic
caataagactgcttatgtgagaaggtactatccctaattcaaaatattctcggaagattctttcagtcacagttg

SEQ ID NO: 223982 - DNA, 75 bp, Artificial Sequence
  Synthetic
tctctgaccccctgagaagtttgagctttgatttgatatatgacttcatcattgcattcactacaggaaaaggga

SEQ ID NO: 223983 - DNA, 75 bp, Artificial Sequence
  Synthetic
cctcaacaagtttgtgcatgtgccaagtcaacaaggtgctaacatgatccttcccagaacgcacatactgatcat

SEQ ID NO: 223984 - DNA, 75 bp, Artificial Sequence
  Synthetic
cacccagcttgagattctgaaggagcattagaaacaagaatgggcacatcattggtccccatttactatgatcca

SEQ ID NO: 223985 - DNA, 75 bp, Artificial Sequence
  Synthetic
tgctgtaattcaacaacccttctcgaacattgatggtcattgatagaattgcattttcaaattctttatcattgt

SEQ ID NO: 223986 - DNA, 75 bp, Artificial Sequence
  Synthetic
ttaaacatgaacctgaaaagaaactggaaaaggactcaaaatagtcctctatcagtcttgtgaacatttttgttc

SEQ ID NO: 223987 - DNA, 75 bp, Artificial Sequence
  Synthetic
tcaaatccccgatataaagttctctatttcccccaacctgctctttgtatgataatgcaaacttcagtcttcctg

SEQ ID NO: 223988 - DNA, 75 bp, Artificial Sequence
  Synthetic
aatcaggaccgactgaagtgtatgatgttggtgactcctctgagtaaaaacataaattctttaaagcagcactca

SEQ ID NO: 223989 - DNA, 75 bp, Artificial Sequence
  Synthetic
tacattttgtcaatgacagagccttacttagagactcagaattactttctctttcactaatcctaacatcctcct

SEQ ID NO: 223990 - DNA, 75 bp, Artificial Sequence
  Synthetic
ctagtctgtcccagtcaaacttgaaattcagaccttgtctttgcatgtgtctatacttccctgagtaagcgtttg

SEQ ID NO: 223991 - DNA, 75 bp, Artificial Sequence
  Synthetic
cattcatttgcaatagaatcattttcatacacgaaaaccaatcaccttctgagaagaactttctgcaaaggtttt

SEQ ID NO: 223992 - DNA, 75 bp, Artificial Sequence
  Synthetic
ttgccatttcatccagaccacattgttctttgacagctgaggtgaaatataatggtgacagttctgtggaagttt

SEQ ID NO: 223993 - DNA, 75 bp, Artificial Sequence
  Synthetic
caacagcctcacagataaatttcatgtcatcattagtgagacaagacgggtcaaaatcttccactaaatggaagg

SEQ ID NO: 223994 - DNA, 75 bp, Artificial Sequence
  Synthetic
aaatttctgacaaaatgatcttccttaagtgaaccattttacctgacaatatggtctggaggtggtgtagtcctt

SEQ ID NO: 223995 - DNA, 75 bp, Artificial Sequence
  Synthetic
ttacatttttaagccccacctcgttttctccttcactagccttcttgcttctttcataccgctttattgtggagt

SEQ ID NO: 223996 - DNA, 75 bp, Artificial Sequence
  Synthetic
tgaccttatcttccaggtttttaaagaaacttgtctcttcttccccttcaaaacatatgtctgctgagccaccct

SEQ ID NO: 223997 - DNA, 75 bp, Artificial Sequence
  Synthetic
ctggcttcccagtctctgtttccttggaaccgatgaccagtctggagaccaactttgaaactttgtactcgtaat

SEQ ID NO: 223998 - DNA, 75 bp, Artificial Sequence
  Synthetic
ctgaatgatttaatttgtacttctgcttcctcatgaagccttctgtgatctggctcacggcactaacaagcaatt

SEQ ID NO: 223999 - DNA, 75 bp, Artificial Sequence
  Synthetic
tattaaaatcatactctaggagtcgttctccatttagatgtttgttaacaaccacgcttttgttactagcaagat

SEQ ID NO: 224000 - DNA, 75 bp, Artificial Sequence
  Synthetic
ccaatgctgttgcacacccagagttagtcatgggatccaggctattgagcctcttttctcctttgaaaatcaaag

SEQ ID NO: 224001 - DNA, 75 bp, Artificial Sequence
  Synthetic
tgccattgttgaacgaggataccatcatactaaaggcctccaagttgacacctggggttgtgcgctgacagtcaa

SEQ ID NO: 224002 - DNA, 75 bp, Artificial Sequence
  Synthetic
tttcctttccggtgaacttcttcatttggtcataaaaaatactttcttcctcaggagtaattgactccttagggt

SEQ ID NO: 224003 - DNA, 75 bp, Artificial Sequence
  Synthetic
taacaaaaaagccaaactcacttttaggctcaaagaatttttcaaagcattttatttgatctgttagcctatcag

SEQ ID NO: 224004 - DNA, 75 bp, Artificial Sequence
  Synthetic
gggtctcttttgtgattaaatggcataggtatgacacattcaacatgaacttgaactttgcgctcaacaacacct

SEQ ID NO: 224005 - DNA, 75 bp, Artificial Sequence
  Synthetic
tttcaccagtcccaaaaacggttttgatcagaaatctaagcaatcgatacactaatttctcagcaggtgtgatca

SEQ ID NO: 224006 - DNA, 75 bp, Artificial Sequence
  Synthetic
aatcctctttcagcttgtccatcaatgatgcggatgaaaagtctgaaacaatggccatcaccagatacctaatgt

SEQ ID NO: 224007 - DNA, 75 bp, Artificial Sequence
  Synthetic
tttgaacctgtttttgattcctcttcgttgggttggtgagcataagtaataatagggttctcaatgccgtctcaa

SEQ ID NO: 224008 - DNA, 75 bp, Artificial Sequence
  Synthetic
tgtcattaatacagttcttcaaatcagggcatgatctgatccatgagatcatggtgtcaatcatactgtagagca

SEQ ID NO: 224009 - DNA, 75 bp, Artificial Sequence
  Synthetic
cttcatctgagaaaattggtaaaaagaaccttttcgggtctgcataaaaggaaaccaaatgaccattaggacctt

SEQ ID NO: 224010 - DNA, 75 bp, Artificial Sequence
  Synthetic
gtatagaataacaccttgaagactccccagtcttctgatatagcaggtgataatcctcagaatccaattttatta

SEQ ID NO: 224011 - DNA, 75 bp, Artificial Sequence
  Synthetic
cttgacagaatacttctttgcactccaccacttgataccttacagagcccaactgattctgtcttaatctggcaa

SEQ ID NO: 224012 - DNA, 75 bp, Artificial Sequence
  Synthetic
ctgaacttgttttcatactgtttgtcaaggctagacaaacagacgacaatctttttagactctgcacattcctta

SEQ ID NO: 224013 - DNA, 75 bp, Artificial Sequence
  Synthetic
actgctccgtattggactggaaattataatcttcaaactttgtgtaatacattacaggatgagtccctgacttca

SEQ ID NO: 224014 - DNA, 75 bp, Artificial Sequence
  Synthetic
tgaaattctcaaactcaacaaatggtatttggcactcatgctcaagatgttcagatagaccataatgcccaaaac

SEQ ID NO: 224015 - DNA, 75 bp, Artificial Sequence
  Synthetic
taagtcccaccactgataaacacctctgaatttttaaaatgaactcacttatggatgttttgaacaaatcctcaa

SEQ ID NO: 224016 - DNA, 75 bp, Artificial Sequence
  Synthetic
gagaaaccttcctatatgcctttgactttcttctgttccttaggagtctgatgaactcttcctttgtgctgtgaa

SEQ ID NO: 224017 - DNA, 75 bp, Artificial Sequence
  Synthetic
agctcaccagcctatcattcacactatcatagcaacagccaacccaatgcttatcattttttaaccctttggatt

SEQ ID NO: 224018 - DNA, 75 bp, Artificial Sequence
  Synthetic
tagtctgcttaatcaacgaggaaagacacaggacatctaagtttagtaactgtcttctcctggtgtttaacaatt

SEQ ID NO: 224019 - DNA, 75 bp, Artificial Sequence
  Synthetic
ttaaacttttgactttattcagcatagagagaagcctctcatattcagtgccgatctcgcttcctctctcatacc

SEQ ID NO: 224020 - DNA, 75 bp, Artificial Sequence
  Synthetic
cattggtctctgctgttataaacctcatcaaggggcaggattcgactgcctctttgctcaatgttgagatatcat

SEQ ID NO: 224021 - DNA, 75 bp, Artificial Sequence
  Synthetic
cattgtcatcaagagtctcataaagtccagaaaattctttaattaaatcctcggggttgactttctgaaagttcc

SEQ ID NO: 224022 - DNA, 75 bp, Artificial Sequence
  Synthetic
ttttgagcttcccgatttccaggtcccttctaaatctgctataaagggagtttatgccaaggaccacatcatcgc

SEQ ID NO: 224023 - DNA, 75 bp, Artificial Sequence
  Synthetic
agttcatgtttggattgacaccatcatggcacattttcatgatttcatcattatgaaatgatcttgcatccctca

SEQ ID NO: 224024 - DNA, 75 bp, Artificial Sequence
  Synthetic
agattttcatagaatccataccggaacgcttatcaacagtagttttgagagattcacaaagtctgaagtactcag

SEQ ID NO: 224025 - DNA, 75 bp, Artificial Sequence
  Synthetic
attcctcaaagaccttctcatcctggctggaatactctaaaagtttgaacagaaggtccctgaacttgaagttca

SEQ ID NO: 224026 - DNA, 75 bp, Artificial Sequence
  Synthetic
cccactctggcataaagctattatcataatcacaccgaccatctactatcgggaccaatgtaatacccgcgatgg

SEQ ID NO: 224027 - DNA, 75 bp, Artificial Sequence
  Synthetic
caaggtcttctttaatacacgctagtttattagtgtcctctatgaatttcttctcaaaactagctggtgtgcttc

SEQ ID NO: 224028 - DNA, 75 bp, Artificial Sequence
  Synthetic
taacgaaacattcaagaaggataagggagttgtcaatcagtttataaccatcagggatgatcaaaggcagtcccg

SEQ ID NO: 224029 - DNA, 75 bp, Artificial Sequence
  Synthetic
ggcatacaattccagactctatcaaaattgcctcaacagatttatcatcatggttgtgtatgcagccactcttgt

SEQ ID NO: 224030 - DNA, 75 bp, Artificial Sequence
  Synthetic
cagcgctatctatttctatacaacgtgataagagtttgagtccctctatcaataccattctgggttctctttgtc

SEQ ID NO: 224031 - DNA, 75 bp, Artificial Sequence
  Synthetic
ctaaaaagttaagtttctgccttgacaatctctcatcttgttctatgtagtttaaacacaactccctcaattctg

SEQ ID NO: 224032 - DNA, 75 bp, Artificial Sequence
  Synthetic
agtttaaacacaactccctcaattctgaaatagtctcatccattgcgcatcaaaaagcctaggatcctcggtgcg

SEQ ID NO: 224033 - DNA, 75 bp, Artificial Sequence
  Synthetic
cgcaccgaggatcctaggctttttgatgcgcaatggatgaaatcatctcagaattgagagagttatgtttaaact

SEQ ID NO: 224034 - DNA, 75 bp, Artificial Sequence
  Synthetic
cattcttcttgagtgttttgttaggagctcaccagccagttttgagaagaaatttatagaggacactaacaaatt

SEQ ID NO: 224035 - DNA, 75 bp, Artificial Sequence
  Synthetic
ttagactcaaggggaggtcctgcgacgattggctaggcgggtcggtggccgaggacatcgactgatgggcatctc

SEQ ID NO: 224036 - DNA, 75 bp, Artificial Sequence
  Synthetic
ctcaaggggaggtcctgcgacgattggctaggcgggtcggtggccgaggacatcgactgatgggcatctcctggg

SEQ ID NO: 224037 - DNA, 75 bp, Artificial Sequence
  Synthetic
tttttggattgcgctttcctttaggtcaactgaggatcgagtttaccttgtggaaggatgggtcaaattgtgacg

SEQ ID NO: 224038 - DNA, 75 bp, Artificial Sequence
  Synthetic
ttacaacaaagctgccttgacaaagttcaaagaagatgtggaatccgccctacacctattcaagacaacagtaaa

SEQ ID NO: 224039 - DNA, 75 bp, Artificial Sequence
  Synthetic
ctggaagctcttaacctccttggacagagacatcctgttgctcaatgaatttccaagacaaatgcgcaatcaaat

SEQ ID NO: 224040 - DNA, 75 bp, Artificial Sequence
  Synthetic
tcgcaccgggggatcctaggcttttgggattgcgctttgcgttggtgacagctaaaagagagaacaggaaagttg

SEQ ID NO: 224041 - DNA, 75 bp, Artificial Sequence
  Synthetic
ctctcatccacagtatgggccaaatcatcacaatgtttgaggctttgcctcacatcattgatgaggcaatcaaca

SEQ ID NO: 224042 - DNA, 75 bp, Artificial Sequence
  Synthetic
ttgtcatgattgtgctcataataataacaagtctgaaagctgtgtacaactttgcaacttgtggcatcatagcac

SEQ ID NO: 224043 - DNA, 75 bp, Artificial Sequence
  Synthetic
tgatcagcttttgcctgctagctggtagatcatgcgggatgtatggtttgtctggccctgacatttacaagggag

SEQ ID NO: 224044 - DNA, 75 bp, Artificial Sequence
  Synthetic
tataccagttcaaatccgttgagtttgacatgtcacatttgaacctgacaatgccaaatgcatgctctgtcaaca

SEQ ID NO: 224045 - DNA, 75 bp, Artificial Sequence
  Synthetic
actctcatcattacatcagcatgggaaagtctggcctggagctaactttcacaaatgacagcatccttagccaca

SEQ ID NO: 224046 - DNA, 75 bp, Artificial Sequence
  Synthetic
atttttgtaatttgactgatggctttaagaagagaacctttgactacacactcatgagtattgtggcaagtctgc

SEQ ID NO: 224047 - DNA, 75 bp, Artificial Sequence
  Synthetic
acctcagcatcagaggaaacacccagtacagagctgtctcctgtgacttcaacaatgggattaccatccaataca

SEQ ID NO: 224048 - DNA, 75 bp, Artificial Sequence
  Synthetic
acttgagcttcagcaccacacaaagtgctgcgaatcagtgcaacactttcagaggtagggtcttggacatgttta

SEQ ID NO: 224049 - DNA, 75 bp, Artificial Sequence
  Synthetic
gaacggcatttgggggcaagcacatgaggtcaggttatggctggacggacgcctctgggaagacaacctggtgca

SEQ ID NO: 224050 - DNA, 75 bp, Artificial Sequence
  Synthetic
gccagactgactatatgttcttaataatccagaacaggacgtgggacaatcactgtcagtatgcaggtcccttcg

SEQ ID NO: 224051 - DNA, 75 bp, Artificial Sequence
  Synthetic
ggctctcaagaatcctctttgcacaagagaaaacaaaattcctgaccagaagactcgcagggactttcacctgga

SEQ ID NO: 224052 - DNA, 75 bp, Artificial Sequence
  Synthetic
ctttatctgattcatcgggaactgagaatccaggtggttactgtttgacaaggtggatgataatcgctgcagacc

SEQ ID NO: 224053 - DNA, 75 bp, Artificial Sequence
  Synthetic
ttaagtgctttgggaatactgcagttgcaaaatgcaacataaaccatgatgaggaattttgtgatatgctaagat

SEQ ID NO: 224054 - DNA, 75 bp, Artificial Sequence
  Synthetic
tgattgactacaacaaggctgctttgtccaagttcaaggaagatgttgagtcagctttgcacctgttcaagacaa

SEQ ID NO: 224055 - DNA, 75 bp, Artificial Sequence
  Synthetic
cagtgaattctttgatctcagatcagttgttaatgaggaatcatctaagagacctaatgggggtaccctactgca

SEQ ID NO: 224056 - DNA, 75 bp, Artificial Sequence
  Synthetic
attattcaaaattctggtacctggaacatgcaaaaacaggtgagaccagtgtgcccaagtgctggttggtgtcca

SEQ ID NO: 224057 - DNA, 75 bp, Artificial Sequence
  Synthetic
atggctcatatctgaatgagacacacttcagtgatcagattgaacaggaggctgacaacatgatcactgagatgc

SEQ ID NO: 224058 - DNA, 75 bp, Artificial Sequence
  Synthetic
tcagaaaggattacatcaaaaggcagggaagcacccccctagcattgatggatcttctaatgttttctacatcgg

SEQ ID NO: 224059 - DNA, 75 bp, Artificial Sequence
  Synthetic
cctacttaattagcatcttcctccatctgctgaagatccctacacatagacacatcaaaggaggctcatgtccca

SEQ ID NO: 224060 - DNA, 75 bp, Artificial Sequence
  Synthetic
aaccacaccggctcaccagtaagggtatttgtagctgcggggcattcaaagtgccaggcgtaaaaacagtctgga

SEQ ID NO: 224061 - DNA, 75 bp, Artificial Sequence
  Synthetic
aaagacgctaaatgatggcgcctccctgactctccacctcgaaagaggtggagagtcagggaggccccgtgggga

SEQ ID NO: 224062 - DNA, 75 bp, Artificial Sequence
  Synthetic
ccttagagtgtcacaacatttggacccctgaagattaggtcatgtggcaaaatgttatggatgttcttcagttcg

SEQ ID NO: 224063 - DNA, 75 bp, Artificial Sequence
  Synthetic
ggcagcctggcctttgaagcagcttcaaaaatgatgcagtccataagagcacaatgaggtgtgatctccttcttt

SEQ ID NO: 224064 - DNA, 75 bp, Artificial Sequence
  Synthetic
ttcttgtccttcactaccccagtgtgcatcttgcacagccatccataattgtcccagactttgtcctcatactct

SEQ ID NO: 224065 - DNA, 75 bp, Artificial Sequence
  Synthetic
ctggatgcctcccttgacatctctacatcaatcaatttgatgtccctcctgttttgggaatcaagaagctttctg

SEQ ID NO: 224066 - DNA, 75 bp, Artificial Sequence
  Synthetic
atgtcatctgagccctgacagctaaggaccatcccttgtggtaaagcaccgatgactgatgatgtcagccctggt

SEQ ID NO: 224067 - DNA, 75 bp, Artificial Sequence
  Synthetic
tgtgcattgaaaaggtcagcaaggtccataccatgtgagtactttgagtcttgtttgaattgtttctggtcagct

SEQ ID NO: 224068 - DNA, 75 bp, Artificial Sequence
  Synthetic
ggttctctgtaaaaatgaatgaactgaccattttgaggttgaaatagagcaacctcaacaggatcattgaatctt

SEQ ID NO: 224069 - DNA, 75 bp, Artificial Sequence
  Synthetic
ccctcaatgtcaatccatgtgggtgcattaggatcaatgccactcattaggtcctttaacagcatggtttggctg

SEQ ID NO: 224070 - DNA, 75 bp, Artificial Sequence
  Synthetic
taacttagaccaacctggggtggtcctgcagcacctggggttggtcttggggtattagtgatcagtttgtcacct

SEQ ID NO: 224071 - DNA, 75 bp, Artificial Sequence
  Synthetic
gacaggtcaatggttgtgttctcccaagctcttccaacaacagatgttctacaagcaatataaggccacccctca

SEQ ID NO: 224072 - DNA, 75 bp, Artificial Sequence
  Synthetic
ccggacaagcagaccttgtacaagatgttttcataagggtttctgtccccaacctggtctgacacaaacatattc

SEQ ID NO: 224073 - DNA, 75 bp, Artificial Sequence
  Synthetic
agctttcgctttgcaccaagaactgctttcaggagatcctcagagttgcttggctttattaagatagactctagc

SEQ ID NO: 224074 - DNA, 75 bp, Artificial Sequence
  Synthetic
atgttacccccatctaacagtgcggctccagcttttacagccgcacctaagctgaagttgtatccagatatgttt

SEQ ID NO: 224075 - DNA, 75 bp, Artificial Sequence
  Synthetic
atgcttgattgttgctctgtgatgacacccagaaccggatgtttgtctttcaacctctcaaggtcagaaaggttg

SEQ ID NO: 224076 - DNA, 75 bp, Artificial Sequence
  Synthetic
gggtactttactgtatagagtaaccccaggtctgtgagcgcctgaacaacatcatttaatggagtctgtgattgt

SEQ ID NO: 224077 - DNA, 75 bp, Artificial Sequence
  Synthetic
ttggccatgcaagccattgtcaggctgggcatcgttccaaattggttgttcaagagagaggaatccttgacatcc

SEQ ID NO: 224078 - DNA, 75 bp, Artificial Sequence
  Synthetic
cagactctaacaacaccattgttcccttgctggggtctcctcatcccgaccatttgtaggatttgagatctttgg

SEQ ID NO: 224079 - DNA, 75 bp, Artificial Sequence
  Synthetic
tctagttgctgggttgtcaggttccccatgtacacacctgaggcctgcggcctctcggttctgattattttggct

SEQ ID NO: 224080 - DNA, 75 bp, Artificial Sequence
  Synthetic
tttagcttttcaaggtcagctgcaagggacattagttcctctgcactgagtctcccaacttttaggatattcttt

SEQ ID NO: 224081 - DNA, 75 bp, Artificial Sequence
  Synthetic
tttgaggttgatttcagctccaccaaggaatggacagtctggttgaggctcctaagtctctgcagatctttatcg

SEQ ID NO: 224082 - DNA, 75 bp, Artificial Sequence
  Synthetic
tccctcttgtccttcctcatgatcctctgaacattgctgacttcagagaagtcaagcccattcaaaaggctggta

SEQ ID NO: 224083 - DNA, 75 bp, Artificial Sequence
  Synthetic
gcatctttaatcacggcagctttaacattcgaggtgaacccctgcaattccctcctcaatgcctgagtccattga

SEQ ID NO: 224084 - DNA, 75 bp, Artificial Sequence
  Synthetic
aagctcttgacatccttggacagggacattctgatgggcaccactgtgtcactggcaattgcgcaatcaatttgc

SEQ ID NO: 224085 - DNA, 75 bp, Artificial Sequence
  Synthetic
aagctcttgacttccttggacagggacattctgatgggcaccactgtgtcactggcaattgcgcaatcaatttgc

SEQ ID NO: 224086 - DNA, 75 bp, Artificial Sequence
  Synthetic
aagctcttgacctccttggacagggacattctgatgggcaccactgtgtcactggcaattgcgcaatcaatttgc

SEQ ID NO: 224087 - DNA, 75 bp, Artificial Sequence
  Synthetic
aagctcttgacgtccttggacagggacattctgatgggcaccactgtgtcactggcaattgcgcaatcaatttgc

SEQ ID NO: 224088 - DNA, 75 bp, Artificial Sequence
  Synthetic
acagggacattctgatgggcaccactgtgtcactggcaattgcgcaatcaatttgcctaggatccacggtgcgaa

SEQ ID NO: 224089 - DNA, 75 bp, Artificial Sequence
  Synthetic
gcggttttgacccctccaattgacaaagagtcaagcacatccatcatgggcaggtcaaaatccaaacaaaaagaa

SEQ ID NO: 224090 - DNA, 75 bp, Artificial Sequence
  Synthetic
accactgggcagtggagggtagatcagagattctccccgacgcaacataccttggcccgctcaactgcaaaatcc

SEQ ID NO: 224091 - DNA, 75 bp, Artificial Sequence
  Synthetic
tgctggcaaagacatgacagcctggtcaagtgtcatgaccactacctgtgtagaaactgtctaaatcttttgttg

SEQ ID NO: 224092 - DNA, 75 bp, Artificial Sequence
  Synthetic
acagtttcagacaggtgccccctctgcaagcacccactgcccacaagactgagaatttcaccagcacccagctcg

SEQ ID NO: 224093 - DNA, 75 bp, Artificial Sequence
  Synthetic
cctcccccctacgaagagtagggaccgagaggagagcgggcccccagtggccacacggacacagtcccagacagc

SEQ ID NO: 224094 - DNA, 75 bp, Artificial Sequence
  Synthetic
cagcccagacccacacgacaacacacacacacacacaacgacaccacacacacacacaccccccgggggaccaga

SEQ ID NO: 224095 - DNA, 75 bp, Artificial Sequence
  Synthetic
ccgcttcggtctactctatgtcctggaccggaggctctcccaaccagtcctcacaggacctccccttcagcctaa

SEQ ID NO: 224096 - DNA, 75 bp, Artificial Sequence
  Synthetic
atcttccaactgaggtctcatacattattgtgtcttttgatttgctataacaaagcctacagtctttaaaagaga

SEQ ID NO: 224097 - DNA, 75 bp, Artificial Sequence
  Synthetic
accagtctggcacgcccttcagagatggcaacagggcaggcttttcaacatacagctcttgtagcacaactccta

SEQ ID NO: 224098 - DNA, 75 bp, Artificial Sequence
  Synthetic
tttcagaactcatgagatgttcacctgttctgaatcgatgcaagaaaaggttgcctaacacttcatcaaacttcg

SEQ ID NO: 224099 - DNA, 75 bp, Artificial Sequence
  Synthetic
aataaccttcaagttcagcgaacaaaactctaaggtcttttgtctctatattaaccataatgttctgaacgaggt

SEQ ID NO: 224100 - DNA, 75 bp, Artificial Sequence
  Synthetic
ttctaccttcatacagtgcaccatgtttgacagttagaggcacaggctcccagtctgggccaaccctttcaaaat

SEQ ID NO: 224101 - DNA, 75 bp, Artificial Sequence
  Synthetic
ctacagacctaaccccatccaatattttatatgagctcaagacctccaactctaaggaatcacccagcaccattg

SEQ ID NO: 224102 - DNA, 75 bp, Artificial Sequence
  Synthetic
ggtccaccatgtagtcccaaaactcatcagatcttagatcaaaggtaccgtccctggttttgaaaatgggatctg

SEQ ID NO: 224103 - DNA, 75 bp, Artificial Sequence
  Synthetic
ttctcagtaaattaagacactcatccaggagcctcacatccacttcacctttgaacatatatgtgcatgatagga

SEQ ID NO: 224104 - DNA, 75 bp, Artificial Sequence
  Synthetic
actcagcaacaccaggactctgcagtctacattttattacaaatatcactgaaaaccgtctaagacaatctgtgt

SEQ ID NO: 224105 - DNA, 75 bp, Artificial Sequence
  Synthetic
tgttttgattgtgtgaaaagtcaacagacaccgaaaactctaaaaatccttttgtgtagtcgagaatgtaatccc

SEQ ID NO: 224106 - DNA, 75 bp, Artificial Sequence
  Synthetic
acagatctctcagggttctgaaggacttaggctcagtcagtccctgccttatcaacaaagctgcattgcagatga

SEQ ID NO: 224107 - DNA, 75 bp, Artificial Sequence
  Synthetic
tatctcctagacgatatgaaaaccaaccgaaaccaaactgcaaatcacttttatacataggtctttcaatgcccc

SEQ ID NO: 224108 - DNA, 75 bp, Artificial Sequence
  Synthetic
tgttcactacctttaacacaaaagactggaaaggccccaaagcctctgccccatcttcagagggcatcatctctt

SEQ ID NO: 224109 - DNA, 75 bp, Artificial Sequence
  Synthetic
tatgagggaaccatgagaaattgcccaatgttcttgatgtcaacacaaattctcggatgaacgactcgaagtaaa

SEQ ID NO: 224110 - DNA, 75 bp, Artificial Sequence
  Synthetic
tctgttttaagaagtttttacaaacatctcttgtgctaacaacgaactcgtctgtcaagcttgagtctgaacgtt

SEQ ID NO: 224111 - DNA, 75 bp, Artificial Sequence
  Synthetic
gatgtgactcaacaaggtctgagaataaaactgtgtaatgctcatctcttttccatttcacaacatgggatatca

SEQ ID NO: 224112 - DNA, 75 bp, Artificial Sequence
  Synthetic
atgacaaagactcagaatttatatcaattaatacacacaaatctaaaaatttaatacgagggctccacctcatgt

SEQ ID NO: 224113 - DNA, 75 bp, Artificial Sequence
  Synthetic
tcttggagctttgatcagacataaaaggtaggagctgatcttcgaagatctttgggtacaaccttctgactgatt

SEQ ID NO: 224114 - DNA, 75 bp, Artificial Sequence
  Synthetic
gtaacacatgattcaagctgattttgtcctctagcaatcttgagctttcaggttttcttgcaacataatcgcagg

SEQ ID NO: 224115 - DNA, 75 bp, Artificial Sequence
  Synthetic
gattcaactgctttagtactggcttgcttgttcctcttgccatcgaaggttctgctaaaacccaaacacccaatt

SEQ ID NO: 224116 - DNA, 75 bp, Artificial Sequence
  Synthetic
caaaggaattactcaaggatatacagatgtaatcccagagaagaggcctcagaagactgacatgatcaagaagtg

SEQ ID NO: 224117 - DNA, 75 bp, Artificial Sequence
  Synthetic
gttccgggtgagcatgtttatcacagatatacaacattatgtcacactctttttgaatgccaagaatattgtcat

SEQ ID NO: 224118 - DNA, 75 bp, Artificial Sequence
  Synthetic
ctttggtcaggtcttccagaatttttcttatgtagagattttctctgttctggttcctcacacatctacttccca

SEQ ID NO: 224119 - DNA, 75 bp, Artificial Sequence
  Synthetic
gagtcttacaaagacctataaatcctgatgagatacaactctgaaaagctgatttattgatagcttctgacaaaa

SEQ ID NO: 224120 - DNA, 75 bp, Artificial Sequence
  Synthetic
gtttctgtgctccccttgtgaatctgctgcacaatttgttttgaagtgttttaatcaatgatggcaccctttctt

SEQ ID NO: 224121 - DNA, 75 bp, Artificial Sequence
  Synthetic
cttgaaaattcatagttgaaggataaatcaccttctgcctcagcaccatcctcataggatgtaattcattaagat

SEQ ID NO: 224122 - DNA, 75 bp, Artificial Sequence
  Synthetic
tcaaccagttaatgtcagcaagagtgcccaaatcatcctcaatacctagcacatcagcaagctgaaggatagcct

SEQ ID NO: 224123 - DNA, 75 bp, Artificial Sequence
  Synthetic
ctttcttgtctctattgaaaaggtccaggaagaattcctcattgaattctccattctttagtttgtgatgaagtc

SEQ ID NO: 224124 - DNA, 75 bp, Artificial Sequence
  Synthetic
ttcttatgagcttcctcatagtctttgtttcctgagggcacaatgcctcaatcaacctctgaattctgtaacctc

SEQ ID NO: 224125 - DNA, 75 bp, Artificial Sequence
  Synthetic
tggatccatccagccagtccttcacatctgtgtttgtgttaagaagaaagggatctagagggaaatttgcatatt

SEQ ID NO: 224126 - DNA, 75 bp, Artificial Sequence
  Synthetic
ttaggaggtctaatgttctcctttgaatacagttcactagcgagataggaacaccattggcgacagcttgatctg

SEQ ID NO: 224127 - DNA, 75 bp, Artificial Sequence
  Synthetic
caattgtgtcaattgtctcacagagctgatgtggctccttgcacttaacattatgtaaagctgctgacacgaact

SEQ ID NO: 224128 - DNA, 75 bp, Artificial Sequence
  Synthetic
tcgtaaggagagggacctcctcgccccacacataaaatcttgacttaaactctgcagcaaatctccctactacac

SEQ ID NO: 224129 - DNA, 75 bp, Artificial Sequence
  Synthetic
tttttggactaataaatttgtttagaaggccacttaaatgagagtgaaattccaacagcactaggatttcctctg

SEQ ID NO: 224130 - DNA, 75 bp, Artificial Sequence
  Synthetic
gatcgctatcaaccaggctgctcagtctcttgtcaaacagtgtgatctggtcatcactagatgtgtatgcatctg

SEQ ID NO: 224131 - DNA, 75 bp, Artificial Sequence
  Synthetic
gtctttctccaaagataagaccaatgcagtagtttataaatctttcactaactaagccataaaagtcagaagcat

SEQ ID NO: 224132 - DNA, 75 bp, Artificial Sequence
  Synthetic
tgtgcagaattccttgccccatatcaattagactagagatgtgtgaaggcacaatcccaagatcaaagtaacttc

SEQ ID NO: 224133 - DNA, 75 bp, Artificial Sequence
  Synthetic
tgaagatttcttctgttactgtcgtctgtgaccctctaaggagtttcaatttggctttgacataagatttcatca

SEQ ID NO: 224134 - DNA, 75 bp, Artificial Sequence
  Synthetic
gtgcattaacaactgggtagggaacttcaacaagtttgtgcatgtgccaagtcaagagggtgctaacatggtcct

SEQ ID NO: 224135 - DNA, 75 bp, Artificial Sequence
  Synthetic
tcccagatctaacatactgatcatcacctaaacggaggttctgtaacaacatcaagaaaaggaatgggcacatca

SEQ ID NO: 224136 - DNA, 75 bp, Artificial Sequence
  Synthetic
tggggccccatttactgtgatccatactgtagttgagaaaaccttctctaacattaatggtcatggacaagattg

SEQ ID NO: 224137 - DNA, 75 bp, Artificial Sequence
  Synthetic
cgttttcgaattccttatcattgttgagacatgaacctgagaagaagctagaaaatgactcaaaatagtcctcca

SEQ ID NO: 224138 - DNA, 75 bp, Artificial Sequence
  Synthetic
caagccttgtgaacatctttgtcctcaaatcaccaatatacagttctctattgcccccaacttgttccttgtaag

SEQ ID NO: 224139 - DNA, 75 bp, Artificial Sequence
  Synthetic
acaatgcaaactttaacctaccagaatcagggcctacagaagtgtaagatgtgggagattcttcagagtagaaac

SEQ ID NO: 224140 - DNA, 75 bp, Artificial Sequence
  Synthetic
ataagttcttcagtgctgcactcatgcactttgtcaatgacagagccttactcagagattcagagttactttccc

SEQ ID NO: 224141 - DNA, 75 bp, Artificial Sequence
  Synthetic
tctcgcttattctcacttcttcctccagcctatcccaatcaaatttgaaattcagtccctgtctctgtgcatgtc

SEQ ID NO: 224142 - DNA, 75 bp, Artificial Sequence
  Synthetic
tatacttaccagaatatgcatttgcattcatttgtaacaggatcattttcatacaagaaaaccagtcatgatcac

SEQ ID NO: 224143 - DNA, 75 bp, Artificial Sequence
  Synthetic
aaaagaacttcctacaaagattttttgccatttcatccaggccacattgctctttgacatcactagtaaaatata

SEQ ID NO: 224144 - DNA, 75 bp, Artificial Sequence
  Synthetic
atgatgacagtttttcatgttcctcaacagcttcacacacagacctcatgtcatcgattgaaagacaggctgggt

SEQ ID NO: 224145 - DNA, 75 bp, Artificial Sequence
  Synthetic
caaaatcttccactaaatgaaatgagatctctgataatatgattttccttaggtaagccagcttccctgttaaca

SEQ ID NO: 224146 - DNA, 75 bp, Artificial Sequence
  Synthetic
ccacctgcagatgatgcaggcctttggaaacctcacctttccccacctcttctaattgatcagcaacagtcctct

SEQ ID NO: 224147 - DNA, 75 bp, Artificial Sequence
  Synthetic
tcttatagtttgatattgttgatttgaccttattctccatctgcctaaaaaatgcggtctcctcttcaccatcaa

SEQ ID NO: 224148 - DNA, 75 bp, Artificial Sequence
  Synthetic
aatgggtgtgttcaccattgttcccttctgtattaatgtctggctcctttgaaccaaggaccagtctagaaacaa

SEQ ID NO: 224149 - DNA, 75 bp, Artificial Sequence
  Synthetic
gcttagacaccttatactcgtaatccgagtggcaaagtttgtatttctgttttcttaagaacccttcggttatct

SEQ ID NO: 224150 - DNA, 75 bp, Artificial Sequence
  Synthetic
gactcactgcactaacgagcaatttattgaaattatattctagcaaacgctcaccattcaaatgcttattgacaa

SEQ ID NO: 224151 - DNA, 75 bp, Artificial Sequence
  Synthetic
caacactcttgttacttgcaagatctaaagctgttgcacatcctgagttggtcattggatccaagttgttgagtc

SEQ ID NO: 224152 - DNA, 75 bp, Artificial Sequence
  Synthetic
ttttttctcccttataaatgagtgtgccattgttaaaagatgacaccataaaactgaaaacttctaaatttacac

SEQ ID NO: 224153 - DNA, 75 bp, Artificial Sequence
  Synthetic
caggaactactgcctgacagtcaacttctttactaacaaactttctcatctgttccaaaaagatgtcttcttcct

SEQ ID NO: 224154 - DNA, 75 bp, Artificial Sequence
  Synthetic
gaggtgaaatctcctctttaggattgatgaaaaatccgaatttgcttttaggctcaaaaaacttctcaaaacatt

SEQ ID NO: 224155 - DNA, 75 bp, Artificial Sequence
  Synthetic
ttatttgatcagtcagcctgtcaggagtttccttcgttattaagtggcataaatatgatacattcaacatgaact

SEQ ID NO: 224156 - DNA, 75 bp, Artificial Sequence
  Synthetic
taaacttagctgttaacatgactctctctcctgtaccaaacagtgttactaacaagtatctaagcagcttgtaga

SEQ ID NO: 224157 - DNA, 75 bp, Artificial Sequence
  Synthetic
ccaccctctccgcatgtgtaatcagatcttccttcaacttgtccatcaaagttgtggatgagaaatcagaaacaa

SEQ ID NO: 224158 - DNA, 75 bp, Artificial Sequence
  Synthetic
tggccatcaccatgtacctcatgttctgaacctgtttttgatttctttttgttggattagttagcaacagaagaa

SEQ ID NO: 224159 - DNA, 75 bp, Artificial Sequence
  Synthetic
ttaaagttctcaaggaaagctctatttcatcaatatgtccagcaagatcaggacatgatcttatccaggagatca

SEQ ID NO: 224160 - DNA, 75 bp, Artificial Sequence
  Synthetic
tcacatcaaccatctcatgcaatacctcatcggagaatattggcaggaaaaacctttttggatctgcataaaatg

SEQ ID NO: 224161 - DNA, 75 bp, Artificial Sequence
  Synthetic
agatgacatgacctgctggaccttgtatagaatagcatcttgaggactcccctgtcttttggtacaacagatgat

SEQ ID NO: 224162 - DNA, 75 bp, Artificial Sequence
  Synthetic
attcttccttttctatcttcatgacctggctaaagacctccttacattccacgacctgatatctaacagagccaa

SEQ ID NO: 224163 - DNA, 75 bp, Artificial Sequence
  Synthetic
gttgattctgcctaagcctggccactgagcttgttttcatactgtttgttagtgccaggcagacagatgagagct

SEQ ID NO: 224164 - DNA, 75 bp, Artificial Sequence
  Synthetic
tcctcaagcaccctttgtctctcagattctccacatctgtttgaaagttatattcatcaaattttgtgtagtgca

SEQ ID NO: 224165 - DNA, 75 bp, Artificial Sequence
  Synthetic
ttatgggatggctcccctttctcacatacccctcaaaggcatcaagtgtgatttgacattcagctactaaacctt

SEQ ID NO: 224166 - DNA, 75 bp, Artificial Sequence
  Synthetic
tggagagcccatagtgttcaaaggttaagccgactgctgagaggcacttgtcgattttgactataaactcttgca

SEQ ID NO: 224167 - DNA, 75 bp, Artificial Sequence
  Synthetic
tggattttttaaataattcccttaaatgcacacctttgttcactcttgaccgttttctattcctcaagagcctca

SEQ ID NO: 224168 - DNA, 75 bp, Artificial Sequence
  Synthetic
taaactcttcctttgtgctactgaagctcaccaacctgtcattgacactactgtaacaacagcctacccagtgct

SEQ ID NO: 224169 - DNA, 75 bp, Artificial Sequence
  Synthetic
tctcatttgccaaaccttcggaatggttcaactttattaaagcagaaagacaaagtgcatccaagttcaaaagtt

SEQ ID NO: 224170 - DNA, 75 bp, Artificial Sequence
  Synthetic
gctttctcctggtgttcagaagtttaaggctttttactttgttgagcatggaaagaagcctctcataaatagtgc

SEQ ID NO: 224171 - DNA, 75 bp, Artificial Sequence
  Synthetic
taatggtagggcatcttctgaacccctctgtatttccagtaatgaatctcattagaggacaggattcaattgcct

SEQ ID NO: 224172 - DNA, 75 bp, Artificial Sequence
  Synthetic
cagaacaaagggattgtacggtgtccgaaagtgacacattctcatagagctcagagaactcctcaatcagcatca

SEQ ID NO: 224173 - DNA, 75 bp, Artificial Sequence
  Synthetic
tcgggctagcctttctaaagtttctctttaatctccccccttctaagtctcttctaaatttactgaataatgagt

SEQ ID NO: 224174 - DNA, 75 bp, Artificial Sequence
  Synthetic
tgacacctatggccacctcatcacaggtcaaattggggttcacgccaccatgacacatcttcataatggtttcat

SEQ ID NO: 224175 - DNA, 75 bp, Artificial Sequence
  Synthetic
tgtgagtcgatcttgcatccctcagaaccttcattgagtctattcctgaacgcttgtctaccatagtctttagag

SEQ ID NO: 224176 - DNA, 75 bp, Artificial Sequence
  Synthetic
attcacagagtctgaaatactctgattcttcaaaaactttctcatcctgactagaatattctaacaatttgaata

SEQ ID NO: 224177 - DNA, 75 bp, Artificial Sequence
  Synthetic
gaagatctctgaatttgaagttgacccactctggcatgaagctgttatcataagaacagcgaccgtccactatgg

SEQ ID NO: 224178 - DNA, 75 bp, Artificial Sequence
  Synthetic
gcacgagtgttattccggcaactgcaagatcctccttgatgcttgacagtttgttggtgtcttcaatgaactttc

SEQ ID NO: 224179 - DNA, 75 bp, Artificial Sequence
  Synthetic
tctcaaagctggctggggtggtcctcacaaaacactcaagcaaaatgagtgagttgtcaattaacttgtaaccat

SEQ ID NO: 224180 - DNA, 75 bp, Artificial Sequence
  Synthetic
ccggtatgatcaagggtagaccaggacaaaccactccggagtctataagaatagtttccacggacttgtcatcat

SEQ ID NO: 224181 - DNA, 75 bp, Artificial Sequence
  Synthetic
agttgtgtgtgcagccactcttgtcagcactgtccatctcaatacatctcgacaacagcttgagcccttccatca

SEQ ID NO: 224182 - DNA, 75 bp, Artificial Sequence
  Synthetic
agaccaattttggttctctttgacttaagaaattcagcttctgtcttgacaggcgctcatcctgttctatgtagt

SEQ ID NO: 224183 - DNA, 75 bp, Artificial Sequence
  Synthetic
tttagacataggctccttaactctgaaatgatatcttccattgcgcaaccaaaaaagcctaggatccacggtgcg

SEQ ID NO: 224184 - DNA, 75 bp, Artificial Sequence
  Synthetic
tttagacataggctccttaactctgaaatgatatcttccattgcgcaaccaaaaaagcctaggatcctcggtgcg

SEQ ID NO: 224185 - DNA, 75 bp, Artificial Sequence
  Synthetic
tttagacataggctccttaactctgaaatgatatcttccattgcgcaaccaaaaaagcctaggatccccggtgcg

SEQ ID NO: 224186 - DNA, 75 bp, Artificial Sequence
  Synthetic
tttagacataggctccttaactctgaaatgatatcttccattgcgcaaccaaaaaagcctaggatccgcggtgcg

SEQ ID NO: 224187 - DNA, 75 bp, Artificial Sequence
  Synthetic
cgcaccggggatcctaggctttttggattgcgctttcctcaggtccatcttgtagaagaatgggccaaatagtga

SEQ ID NO: 224188 - DNA, 75 bp, Artificial Sequence
  Synthetic
cgatgttcgaggctctgcctcacatcatcgatgaagtcatcaacattgtcatcatcgtgctcatcattatcacga

SEQ ID NO: 224189 - DNA, 75 bp, Artificial Sequence
  Synthetic
gcatcaaagctgtgtacaatttcgccacctgcgggatacttgcactgatcagctttcttttcctggctggcaggt

SEQ ID NO: 224190 - DNA, 75 bp, Artificial Sequence
  Synthetic
cctgtggtatgtatggtcttagtgggcctgacatctacaagggagtttaccaatttaagtcagtggagtttgata

SEQ ID NO: 224191 - DNA, 75 bp, Artificial Sequence
  Synthetic
tgtcccacctcaacctgacgatgcccaatgcatgttcggtgaacaactcccatcattacataagcatggggactt

SEQ ID NO: 224192 - DNA, 75 bp, Artificial Sequence
  Synthetic
ctgggttggagttgacctttacaaatgactccattatcaaccacaacttttgtaatctgacttctgctttcaaca

SEQ ID NO: 224193 - DNA, 75 bp, Artificial Sequence
  Synthetic
agaaaacctttgaccacacactcatgagtatagtttcgagcctgcacctcagcattagaggaaactccaactaca

SEQ ID NO: 224194 - DNA, 75 bp, Artificial Sequence
  Synthetic
aggcggtgtcctgtgatttcaacaacggcatcactattcaatacaacttgacattctctgatgcaaagagcgctc

SEQ ID NO: 224195 - DNA, 75 bp, Artificial Sequence
  Synthetic
tgagccagtgcaggactttcaggggaagagttttggacatgttcagaactgcttttggaggaaaatacatgagga

SEQ ID NO: 224196 - DNA, 75 bp, Artificial Sequence
  Synthetic
gtggctggggttggacaggttcagatggcaaaactacttggtgcagccagacaagctatcaatatctaatcatac

SEQ ID NO: 224197 - DNA, 75 bp, Artificial Sequence
  Synthetic
aaaatagaacttgggaaaaccactgcagatacgcaggccctttcgggatatctagaatcctctttgctcaagaaa

SEQ ID NO: 224198 - DNA, 75 bp, Artificial Sequence
  Synthetic
agacaaagtttcttactaggaggcttgcaggcacattcacctggactttatcagactcatcaggagtagagaatc

SEQ ID NO: 224199 - DNA, 75 bp, Artificial Sequence
  Synthetic
caggtggttattgcttgaccaggtggatgatccttgctgcagagctcaagtgttttggaaacacagctgttgcaa

SEQ ID NO: 224200 - DNA, 75 bp, Artificial Sequence
  Synthetic
aatgcaatgtaaatcatgatgaggaattctgtgacatgctacgattgattgattacaacaaggctgctctaagca

SEQ ID NO: 224201 - DNA, 75 bp, Artificial Sequence
  Synthetic
agttcaaagaagatgtagaatctgcattacacttgtttaaaacaacagtgaattctctgatttctgatcagcttc

SEQ ID NO: 224202 - DNA, 75 bp, Artificial Sequence
  Synthetic
tgatgaggaatcacctgagagacttaatgggggtgccatactgcaactactcaaaattttggtatctggagcatg

SEQ ID NO: 224203 - DNA, 75 bp, Artificial Sequence
  Synthetic
caaagaccggtgagactagtgtccccaaatgctggcttgttagcaatggttcttacttgaatgaaacccatttca

SEQ ID NO: 224204 - DNA, 75 bp, Artificial Sequence
  Synthetic
gtgaccaaattgaacaggaagcagacaacatgatcacagaaatgctgagaaaggattacataaaaaggcaaggga

SEQ ID NO: 224205 - DNA, 75 bp, Artificial Sequence
  Synthetic
gcacccccttagctttgatggatctgctaatgttttctacatcagcatatttgatcagcatcttcttacatctta

SEQ ID NO: 224206 - DNA, 75 bp, Artificial Sequence
  Synthetic
taaagataccaacacacagacacgtaaagggcggctcatgcccaaagccacaccggttaaccagcaaaggaatct

SEQ ID NO: 224207 - DNA, 75 bp, Artificial Sequence
  Synthetic
aaagggcggctcatgcccaaagccacaccggttaaccagcaaaggaatctgtagctgtggtgcgttcaaggtgcc

SEQ ID NO: 224208 - DNA, 75 bp, Artificial Sequence
  Synthetic
tcagggaggcccagagggtctcagagtgtcacgacatttggacctctgaagatcaggtcatgtggcaagatgttg

SEQ ID NO: 224209 - DNA, 75 bp, Artificial Sequence
  Synthetic
gatcaggtcatgtggcaagatgttgtggacagttttcaagtcagggagccttgccttggtggcgctctcaaagat

SEQ ID NO: 224210 - DNA, 75 bp, Artificial Sequence
  Synthetic
gatgcagtccatgagtgcacagtgtggggtgatctctttcttcttcttgtccttcactattccagtgtgcatctt

SEQ ID NO: 224211 - DNA, 75 bp, Artificial Sequence
  Synthetic
ggggtgatctctttcttcttcttgtccttcactattccagtgtgcatcttgcatagccagccatatttgtcccag

SEQ ID NO: 224212 - DNA, 75 bp, Artificial Sequence
  Synthetic
actttgtcctcatattctcttgaagcttctttggtcatctcgacatcaatgagtttgatgtctcttctgttctgt

SEQ ID NO: 224213 - DNA, 75 bp, Artificial Sequence
  Synthetic
gaatctaggagtttcctgatgtcatcagaaccctgacaacttaagaccattccctgtggaagagcacctaccacc

SEQ ID NO: 224214 - DNA, 75 bp, Artificial Sequence
  Synthetic
gaggatgtcagcccaggttgtgcattgaaaagatcaacaaggtccataccatgtgagtatttggaatcctgcttg

SEQ ID NO: 224215 - DNA, 75 bp, Artificial Sequence
  Synthetic
aactgtttttggtcagtgggttctctataaaaatgtatgtactgcccattttgtggttgaaatattgctatttct

SEQ ID NO: 224216 - DNA, 75 bp, Artificial Sequence
  Synthetic
actgggtcattgaacctgccctcaatgtcaatccatgtgggagcgttggggtcaatgcctcccataaggtctttc

SEQ ID NO: 224217 - DNA, 75 bp, Artificial Sequence
  Synthetic
agcaacattgtttggctgtagcttaaacccacttgaggtgggcctgctgctccaggcgctggtctgggtgagtta

SEQ ID NO: 224218 - DNA, 75 bp, Artificial Sequence
  Synthetic
gccataggcctctcatttgtcagatcaattgttgtgttctcccacgctctccctacaactgatgttctacaagct

SEQ ID NO: 224219 - DNA, 75 bp, Artificial Sequence
  Synthetic
atgtatggccacccctcacctgaaagacagactttatagaggatgttctcgtaaggattcctgtccccaacttga

SEQ ID NO: 224220 - DNA, 75 bp, Artificial Sequence
  Synthetic
tcagaaacaaacatgttgagtttccttttggccccaagaactgctttcaggaggtcctcactattgcttggctta

SEQ ID NO: 224221 - DNA, 75 bp, Artificial Sequence
  Synthetic
attaagatggattccaacatgttgcccccatccaacaaagctgcccctgcttttacagcagcaccgagactgaaa

SEQ ID NO: 224222 - DNA, 75 bp, Artificial Sequence
  Synthetic
ttatagccagatatgttgatgctagactgttgctcagtgatgactcccaagactgggtgcttgtcttttagcctc

SEQ ID NO: 224223 - DNA, 75 bp, Artificial Sequence
  Synthetic
tcaaggtcactcaggttcgggtatttgactgtgtaaagcaacccaaggtctgtgagtgcctgcacaacgtcatta

SEQ ID NO: 224224 - DNA, 75 bp, Artificial Sequence
  Synthetic
agtgaggtctgtgactgtttggccatacaggccattgttaggcttggcattgtgccaaattgattattcagaagt

SEQ ID NO: 224225 - DNA, 75 bp, Artificial Sequence
  Synthetic
gatgagtccttcacatcccagaccctcaccacaccatttgcaccctgctgaggtctcctcatcccaaccatctgc

SEQ ID NO: 224226 - DNA, 75 bp, Artificial Sequence
  Synthetic
agaatttgagatctttgatcaagctgttgtgctgttaaattccccatgtagactccagaagcttgaggcctttca

SEQ ID NO: 224227 - DNA, 75 bp, Artificial Sequence
  Synthetic
gacctcatgattttagccttcagtttttcaagatcagctgcaagagacatcagttcttctgcactgagtctcccc

SEQ ID NO: 224228 - DNA, 75 bp, Artificial Sequence
  Synthetic
acttttagaacattcttttttgatgctgactttaggtccacaagggaatacacagtttggttgaggcttctgagc

SEQ ID NO: 224229 - DNA, 75 bp, Artificial Sequence
  Synthetic
ctctgtaagtctttatcatccctcttttccttcctcatgattctctgaacgttgctcacttcagagaaatccaat

SEQ ID NO: 224230 - DNA, 75 bp, Artificial Sequence
  Synthetic
ccattcagaaggctggtggcatccttgatcacagcagccttcacatctgatgtgaagctctgaagctctcttctc

SEQ ID NO: 224231 - DNA, 75 bp, Artificial Sequence
  Synthetic
tgatcacagcagccttcacatctgatgtgaagctctgaagctctcttctcaatgcttgggtccactgaaaacttt

SEQ ID NO: 224232 - DNA, 75 bp, Artificial Sequence
  Synthetic
tgacttctttggacagagacattttgtcactcaatgaatctccaagacaaatgcgcaatcaaatgcctaggatcc

SEQ ID NO: 224233 - DNA, 75 bp, Artificial Sequence
  Synthetic
ttggacagagacattttgtcactcaatgaatctccaagacaaatgcgcaatcaaatgcctaggatccccggtgcg

SEQ ID NO: 224234 - DNA, 75 bp, Artificial Sequence
  Synthetic
cgcaccggggatcctaggcattttgttgcgctatttggatgcacagtcttcctctgtgaacccattgcaagtgaa

SEQ ID NO: 224235 - DNA, 75 bp, Artificial Sequence
  Synthetic
ctagaccatcagctatgggtcaaagtaaatctaaggaagagaaaggcattagcggcacgagcagagctgagattt

SEQ ID NO: 224236 - DNA, 75 bp, Artificial Sequence
  Synthetic
tgccagataccacttatcttggtcctctgaattgcaaatcatgctggcaaaaattcgacagtttagttaaatgcc

SEQ ID NO: 224237 - DNA, 75 bp, Artificial Sequence
  Synthetic
atgaccactatctctgcagacactgtctgaatctcttgttgacagtctccgacagatgccctctttgcaaatatc

SEQ ID NO: 224238 - DNA, 75 bp, Artificial Sequence
  Synthetic
cactgccaaccaagttgaagatatcaacagccccaagctcaccgcctccctacgaagagtgacgccccaaggctc

SEQ ID NO: 224239 - DNA, 75 bp, Artificial Sequence
  Synthetic
caacaccaacaaacaacccaacacaagagggacacaaacaaaccaacacacacgcacacaacacccaacgcagaa

SEQ ID NO: 224240 - DNA, 75 bp, Artificial Sequence
  Synthetic
cacacgcacacacatccacacacacacccacacccaggcgcccccaccagggggcgccccccgggggggcggccc

SEQ ID NO: 224241 - DNA, 75 bp, Artificial Sequence
  Synthetic
cccgggagcccaggcggagccccacggagaagccgatcagtcgatctcctcgaccaccgacccaaccagccaatc

SEQ ID NO: 224242 - DNA, 75 bp, Artificial Sequence
  Synthetic
gtcgcaggacctccccttgagtctgaacctgcccccaactgtctcatacattactgtgttctttgacttactaaa

SEQ ID NO: 224243 - DNA, 75 bp, Artificial Sequence
  Synthetic
acagagcctacagtctttaaaagtgaaccaatccggcacaaatgatagtggtatcaacagagtggatctatccat

SEQ ID NO: 224244 - DNA, 75 bp, Artificial Sequence
  Synthetic
gcacaactcttgaagaattgtacctatttctgacccttgcagatgctcaccagttctaaatcgatgcagtagaag

SEQ ID NO: 224245 - DNA, 75 bp, Artificial Sequence
  Synthetic
actcccgagaacatcaccgatcttttcatagccctcaagctctgctaagaaaactttcatgtccttggtttctag

SEQ ID NO: 224246 - DNA, 75 bp, Artificial Sequence
  Synthetic
ttttacaacaatgttttggacaaagtttcttccctcaaaaagagcacccatcctgacagtcagaggcacaggctc

SEQ ID NO: 224247 - DNA, 75 bp, Artificial Sequence
  Synthetic
ccattcaggtccgaccctctcaaaatcaggggatctaacttcatccagtattttcctggagcctatcaactcaag

SEQ ID NO: 224248 - DNA, 75 bp, Artificial Sequence
  Synthetic
ctcaagagagtcgccgagtatcaaggggtcctccatatagtcctcaaactcttcagacctaatgtcaaatatgcc

SEQ ID NO: 224249 - DNA, 75 bp, Artificial Sequence
  Synthetic
atcgctcaccctgaagatagaatctgttcttagcaaatggaggcattcatccagcaatctcctgtccacctcgcc

SEQ ID NO: 224250 - DNA, 75 bp, Artificial Sequence
  Synthetic
tttaaagagatgagagcatgacagaaactcggccacacctggactttgtaattgacacctcactaagaaaatcag

SEQ ID NO: 224251 - DNA, 75 bp, Artificial Sequence
  Synthetic
tgaaaacctcctcaaacaatcagtgttgttctgattgtgcgtgaaatccactgtgattgaaaactccaatactcc

SEQ ID NO: 224252 - DNA, 75 bp, Artificial Sequence
  Synthetic
ctttgtgttgttcaacatgtggtcccacagatccctcagagacctgaatgcttttggattcatcaaaccttgctt

SEQ ID NO: 224253 - DNA, 75 bp, Artificial Sequence
  Synthetic
gatcagcatagcagcattgcacacgacatcccccaatcgataggagaaccatccaaaaccaaattgtagatcatt

SEQ ID NO: 224254 - DNA, 75 bp, Artificial Sequence
  Synthetic
cctaaacatgggcctctcaacatttttgttcaccacttttaagataaatgactgaaaaggtcccagtgcttcagc

SEQ ID NO: 224255 - DNA, 75 bp, Artificial Sequence
  Synthetic
gccatcttcagatggcatcatatctttatgagggaaccatgaaaagcttcctagagtcctgcttgttgcaacaaa

SEQ ID NO: 224256 - DNA, 75 bp, Artificial Sequence
  Synthetic
ttctctcacaaatgattcaaaatacacttgtttcagaaaatttttacagacatcccttgtgctaacaacaaattc

SEQ ID NO: 224257 - DNA, 75 bp, Artificial Sequence
  Synthetic
atcaaccagacttgagtcagtacgttgatgagaatttgcaagatcagaaaatagaacagtatagtgttcatccct

SEQ ID NO: 224258 - DNA, 75 bp, Artificial Sequence
  Synthetic
cttccacttaacgacatgggaaatgagagatagagactctgagttgatgtcaatcaatacacagagatcaagaaa

SEQ ID NO: 224259 - DNA, 75 bp, Artificial Sequence
  Synthetic
tttgatcctggggttccatctcatattctttgagctcaaatcagacataaaagggagtaactgatcctcaaagat

SEQ ID NO: 224260 - DNA, 75 bp, Artificial Sequence
  Synthetic
tttagggtacagtcgtctcacagattgaatcacatggtttaaatttattttgtcctccagtagtcttgaactttc

SEQ ID NO: 224261 - DNA, 75 bp, Artificial Sequence
  Synthetic
aggctttcttgctacataatcacacggatttaagtgcctaaaacttgagttcccattgtccttcccttccacagg

SEQ ID NO: 224262 - DNA, 75 bp, Artificial Sequence
  Synthetic
ttctgctaagacccaaacacccaattcaaaagaattactcagtgagatgcaagtatagtcccaaagaaggggcct

SEQ ID NO: 224263 - DNA, 75 bp, Artificial Sequence
  Synthetic
caaaagactgatatgatcacgataagcttctggatgacttagcctgtcacaaaaatacaacattatgccatcatg

SEQ ID NO: 224264 - DNA, 75 bp, Artificial Sequence
  Synthetic
cttgttgatttttgtaacatgctcatctatagccaaatcttcaagcacttttttgatatacagattttctctgtt

SEQ ID NO: 224265 - DNA, 75 bp, Artificial Sequence
  Synthetic
tttgttcctcacacatctgcttcccaaagtcttgcaaagacctataaaacctgatgaaatgcaactttgaaaggc

SEQ ID NO: 224266 - DNA, 75 bp, Artificial Sequence
  Synthetic
tgacttattaattgcttctgataacaacttctgtgcacctcttgtaaatttactgcaaagcttattctggagtgt

SEQ ID NO: 224267 - DNA, 75 bp, Artificial Sequence
  Synthetic
cttgattaatgaagggattttttcttcttggaaagtcatcacggatgggtagaccactttctgtcttaaaaccat

SEQ ID NO: 224268 - DNA, 75 bp, Artificial Sequence
  Synthetic
tctcaatggaaacatctcatttaaattcaaccagctgatgtttgccaactgactcagatcttcttcaaaaccaag

SEQ ID NO: 224269 - DNA, 75 bp, Artificial Sequence
  Synthetic
gatatctcccagctgaaggatagcttcttttttatctctattgaaaaggtctaggaagaattcttcgttaaactc

SEQ ID NO: 224270 - DNA, 75 bp, Artificial Sequence
  Synthetic
accattcttgagcttgtgatgtaatttcctcacaagttttctcatgacctttgtttcattggggcacagtttctc

SEQ ID NO: 224271 - DNA, 75 bp, Artificial Sequence
  Synthetic
aatgagcctttgaatcctataacctctagagccatccaaccaatccttaacatcagtatcggtgttcagtaaaaa

SEQ ID NO: 224272 - DNA, 75 bp, Artificial Sequence
  Synthetic
tgggtccagaggaaagttggcgtattttaagaggtccagtgttctcttctggatgcagtttactaacgaaaccgg

SEQ ID NO: 224273 - DNA, 75 bp, Artificial Sequence
  Synthetic
aacaccgtttgcaatggcttgatcagcaattgtgtctattgtctcgcagagttggtgtggctctttacacttgac

SEQ ID NO: 224274 - DNA, 75 bp, Artificial Sequence
  Synthetic
gttgtgtaaagctgcagacacaaactttgtgaggagtgggacctcttctccccacacatagaatctagatttaaa

SEQ ID NO: 224275 - DNA, 75 bp, Artificial Sequence
  Synthetic
ttctgcagcaaaccgtcccaccacacttttcggactgatgaatttgtttagcaagccactcaaatgagaatgaaa

SEQ ID NO: 224276 - DNA, 75 bp, Artificial Sequence
  Synthetic
ttctaacaagacgagaacttcttctgggtcactgtcaaccagttcacttaacctcttgtcaaataaagtaatctg

SEQ ID NO: 224277 - DNA, 75 bp, Artificial Sequence
  Synthetic
gtcatcacttgatgtataagactctggcctttcaccaaaaatgatgccgatacaatagttaataaacctctcact

SEQ ID NO: 224278 - DNA, 75 bp, Artificial Sequence
  Synthetic
gattaaaccgtaaaaatcagaggcattgtgtaagattccctgtcccatgtcaatgagactacttatgtgggaagg

SEQ ID NO: 224279 - DNA, 75 bp, Artificial Sequence
  Synthetic
cactacccctaattcaaaatattctcgaaagactctttcagtgacagtcgtttctgaccccctgagaagcttcag

SEQ ID NO: 224280 - DNA, 75 bp, Artificial Sequence
  Synthetic
ttttgatttgatatatgacttcatcattgcattcacaacaggaaaaggaacttcaacaagcttatgcatgtgcca

SEQ ID NO: 224281 - DNA, 75 bp, Artificial Sequence
  Synthetic
agttaacaaggtgctgacatgatcctttccagagcgcacatattgatcatctcccagcttaaggttttggaggag

SEQ ID NO: 224282 - DNA, 75 bp, Artificial Sequence
  Synthetic
cattagaaataaaaatgggcacatcattggtccccatttactatgatccatgctgtagttcagtaacccttctcg

SEQ ID NO: 224283 - DNA, 75 bp, Artificial Sequence
  Synthetic
tacattaatggtcattgataggattgcattttcaaattctttatcattgttcaaacatgatcctgaaaaaaagct

SEQ ID NO: 224284 - DNA, 75 bp, Artificial Sequence
  Synthetic
agaaaaggactcaaaataatcctctatcagtcttgtaaacatttttgttctcaagtccccaatatagagttctct

SEQ ID NO: 224285 - DNA, 75 bp, Artificial Sequence
  Synthetic
atttcccccaacctgttctttatatgataatgcaaacttcagccttccggaatcaggaccgactgaagtgtatga

SEQ ID NO: 224286 - DNA, 75 bp, Artificial Sequence
  Synthetic
tgttggtgattcctctgagtagaaacacaaattttttaaggctgcactcatgcattttgtcaatgacagggcttt

SEQ ID NO: 224287 - DNA, 75 bp, Artificial Sequence
  Synthetic
gcttaaagattcagaattactttccctttcactgattctcacgtcctcttccaatttgtcccagtcaaacttgaa

SEQ ID NO: 224288 - DNA, 75 bp, Artificial Sequence
  Synthetic
atttaggccctgtctctgcatgtgtctgtatttccctgagtatgcatttgcgttcatctgcaacaaaatcatttt

SEQ ID NO: 224289 - DNA, 75 bp, Artificial Sequence
  Synthetic
catacacgaaaaccaatcaccctctgaaaagaacttcctacagagattttttgccatctcatccagaccacactg

SEQ ID NO: 224290 - DNA, 75 bp, Artificial Sequence
  Synthetic
ttctttgacaactgaggtgaaatataatgacgacagttctgtagaggcctcaacagcctcacagataaatttcat

SEQ ID NO: 224291 - DNA, 75 bp, Artificial Sequence
  Synthetic
atcatcattggaaatacaggatgggtcaaaatcttccaccaggtgaaaagaaatttctgataaaataaccttcct

SEQ ID NO: 224292 - DNA, 75 bp, Artificial Sequence
  Synthetic
taagtaagccattctgcctgacagtatggtctgaaggtgatgtaatccctttgtacttttaaaccccacctcatc

SEQ ID NO: 224293 - DNA, 75 bp, Artificial Sequence
  Synthetic
ttcaccttcatgggctttcctgcctttctcataccactttattgtagaattgaccttgtcttccagatttttgaa

SEQ ID NO: 224294 - DNA, 75 bp, Artificial Sequence
  Synthetic
aaaacttgtctcttcttctccttcaaaacagatatctgtagagttgccttctagttttcctgtttctactccctt

SEQ ID NO: 224295 - DNA, 75 bp, Artificial Sequence
  Synthetic
ggaaccgatgaccaatctagagatcaacttcgaaaccttgtactcgtaatctgaatggttcaatttgtacttctg

SEQ ID NO: 224296 - DNA, 75 bp, Artificial Sequence
  Synthetic
ttttctcacgaagctttctgtaatctggctcacagcactaacaagcaacttgttgaaatcatactctaaaagccg

SEQ ID NO: 224297 - DNA, 75 bp, Artificial Sequence
  Synthetic
ttccccattcaaatgcttgtttacaaccacacttttgttactagcaaggtctaatgctgttgcacacccagagtt

SEQ ID NO: 224298 - DNA, 75 bp, Artificial Sequence
  Synthetic
agtcatggggtccaggctgttaagccttttctctcctttgaagattaaggtaccattgttaaatgatgacaccat

SEQ ID NO: 224299 - DNA, 75 bp, Artificial Sequence
  Synthetic
catgctgaaggcttctaagttaacacctggagtagtgagttgacagttaatttctttcccagtgaatttcttcat

SEQ ID NO: 224300 - DNA, 75 bp, Artificial Sequence
  Synthetic
ttgctcgtaaaaaacacactcttcttcaggagtgattgactctttagggttaacaaagaacccaaactcactttt

SEQ ID NO: 224301 - DNA, 75 bp, Artificial Sequence
  Synthetic
gggctcaaagaatttttcaaaacactttatttgatctgtcagtctatcaggggtttcctttgtgattaaatggca

SEQ ID NO: 224302 - DNA, 75 bp, Artificial Sequence
  Synthetic
taagtatgacacattcaacatgaacttaaattttgcactcaataacaccttttcaccagtgccaaaaatggtttt

SEQ ID NO: 224303 - DNA, 75 bp, Artificial Sequence
  Synthetic
gatcaaaaacctaagcagtctatacaccactttctcagcaggtgtaatcagatcctccttcaacttactcatcag

SEQ ID NO: 224304 - DNA, 75 bp, Artificial Sequence
  Synthetic
tgatgcggatgaaaagtctgagacaatggccattactaaatacctaatgttttgaacctgcttctgatttctctt

SEQ ID NO: 224305 - DNA, 75 bp, Artificial Sequence
  Synthetic
tgtcggattggtgagcatgagtaacagtagggttctcaatgcagtctcaatgtcaataatgcagtccttcaagtc

SEQ ID NO: 224306 - DNA, 75 bp, Artificial Sequence
  Synthetic
aggacatgacctgatccaagaaatcatagtgtcaatcatactatgtaacacctcacctgagaaaattggtaagaa

SEQ ID NO: 224307 - DNA, 75 bp, Artificial Sequence
  Synthetic
gaatctttttgggtctgcatagaaagaaaccaagtgaccattagggccttgtatagaataacaccttggggattc

SEQ ID NO: 224308 - DNA, 75 bp, Artificial Sequence
  Synthetic
cccagttttttgatatagtagatgatactcctcagagtctaatttcatcacttggcaaaacacctccttgcattc

SEQ ID NO: 224309 - DNA, 75 bp, Artificial Sequence
  Synthetic
caccacttgataccttacagagcccaattgattttgcctcaatctagcaactgaacttgtcttcatgctgtttgt

SEQ ID NO: 224310 - DNA, 75 bp, Artificial Sequence
  Synthetic
caaagctaaacaaacggatgataatcttcttaaactctgcacactcttcaattgctcggtattgggctggaaatt

SEQ ID NO: 224311 - DNA, 75 bp, Artificial Sequence
  Synthetic
ataatcttcaaactttgtataatacattttaggatgggttccagacctcatgaaattttcaaaatcagcgaatga

SEQ ID NO: 224312 - DNA, 75 bp, Artificial Sequence
  Synthetic
tatatagcattcatgctcgagatgttcagataacccatagtgctcaaagctaagccctactattgataggcacct

SEQ ID NO: 224313 - DNA, 75 bp, Artificial Sequence
  Synthetic
ttgaatctttgtaatgaactcttttatagatgttttgaacaaatcctcaagggatgcctttctgtatgcctttga

SEQ ID NO: 224314 - DNA, 75 bp, Artificial Sequence
  Synthetic
ctttctcctgttccttagaagcttggtgaattcttccttggtactatgaaagctcactagcctatcattcacact

SEQ ID NO: 224315 - DNA, 75 bp, Artificial Sequence
  Synthetic
actgtagcagcaaccaacccaatgtctatcatcttccgactttttgagtttagactgcttaatcagtgatgaaag

SEQ ID NO: 224316 - DNA, 75 bp, Artificial Sequence
  Synthetic
acacagaacatctaaattcagtaattgtcttcttctggtgttcaacaattttaagcttttaactttgtttaacat

SEQ ID NO: 224317 - DNA, 75 bp, Artificial Sequence
  Synthetic
agaaagtagcctctcatactcaatgctagcctcactcctcctttcacatccatgagtctctgctgttataaacct

SEQ ID NO: 224318 - DNA, 75 bp, Artificial Sequence
  Synthetic
cattaaagggcaggattcaactgcctccttgctcaacactaggatgtcatcactgtcagtgagagtctcataaag

SEQ ID NO: 224319 - DNA, 75 bp, Artificial Sequence
  Synthetic
ctcagagaattccttgatcaagccttttgggttgaccttctgaaagtttcttttgagtttcccactttccaagtc

SEQ ID NO: 224320 - DNA, 75 bp, Artificial Sequence
  Synthetic
tcttctaaatctgctgaaaagagagtttataccaaagaccacatcatcacaactcatgtttgggttaacaccgtc

SEQ ID NO: 224321 - DNA, 75 bp, Artificial Sequence
  Synthetic
atggcacatcttcataatctcatcattgtgaaatgatctcgcgtcttttaagactttcatagagtccatgccaga

SEQ ID NO: 224322 - DNA, 75 bp, Artificial Sequence
  Synthetic
acgcttgtcaacagtggttttgagagactcacagagtctaaaatattcagattcttcaaagaccttctcattctg

SEQ ID NO: 224323 - DNA, 75 bp, Artificial Sequence
  Synthetic
actagagtactctaaaagtttaaacagaagatctctgaatttaaagtttacccactctggcatgaagctattatc

SEQ ID NO: 224324 - DNA, 75 bp, Artificial Sequence
  Synthetic
ataatcacaccgaccatccactattggaaccaatgtgatgcctgcaatggcaagatcttctttgatacacgctaa

SEQ ID NO: 224325 - DNA, 75 bp, Artificial Sequence
  Synthetic
cttgttggtgtcctctataaatttcttctcaaaactagccggtgtgcttctaacgaagcattcaagaagaatgag

SEQ ID NO: 224326 - DNA, 75 bp, Artificial Sequence
  Synthetic
agaattgtcaatcaacttgtaaccatcaggaatgatgagtggtaatcccgggcagacgattccagactctattag

SEQ ID NO: 224327 - DNA, 75 bp, Artificial Sequence
  Synthetic
aattgtctcaacagatttatcgtcatggttgtgtgtacagccactcttgtcagcgctgtctatctctatgcaacg

SEQ ID NO: 224328 - DNA, 75 bp, Artificial Sequence
  Synthetic
tgacaggagtttgagtccctcaatcaaaaccatcctgggttctctttgtcccagaaaattgagtttttgctttga

SEQ ID NO: 224329 - DNA, 75 bp, Artificial Sequence
  Synthetic
taacctctcgtcctgttctatgtagttcaaacacaattctctcaactctgaaatggcttcatccattgcgcatca

SEQ ID NO: 224330 - DNA, 75 bp, Artificial Sequence
  Synthetic
agttcaaacacaattctctcaactctgaaatggcttcatccattgcgcatcaaaaagcctaggatccccggtgcg

SEQ ID NO: 224331 - DNA, 75 bp, Artificial Sequence
  Synthetic
cgcaccggggatcctaggcgtttagttgcgctgtttggttgcacaactttcttcgtgaggctgtcagaagtggac

SEQ ID NO: 224332 - DNA, 75 bp, Artificial Sequence
  Synthetic
ctggctgatagcgatgggtcaaggcaagtccagagaggagaaaggcaccaatagtacaaacagggccgaaatcct

SEQ ID NO: 224333 - DNA, 75 bp, Artificial Sequence
  Synthetic
accagataccacctatcttggccctttaagctgcaaatcttgctggcagaaatttgacagcttggtaagatgcca

SEQ ID NO: 224334 - DNA, 75 bp, Artificial Sequence
  Synthetic
tgaccactacctttgcaggcactgtttaaaccttctgctgtcagtatccgacaggtgtcctctttgtaaatatcc

SEQ ID NO: 224335 - DNA, 75 bp, Artificial Sequence
  Synthetic
attaccaaccagattgaagatatcaacagccccaagctctccacctccctacgaagagtaacaccgtccggcccc

SEQ ID NO: 224336 - DNA, 75 bp, Artificial Sequence
  Synthetic
ggccccgacaaacagcccagcacaagggaaccgcacgtcgcccaacgcacacagacacagcacccaacacagaac

SEQ ID NO: 224337 - DNA, 75 bp, Artificial Sequence
  Synthetic
acgcacacacacacacacacacacccacacgcacgcgcccccaccaccggggggcgcccccccccggggggcggc

SEQ ID NO: 224338 - DNA, 75 bp, Artificial Sequence
  Synthetic
cacacgcacgcgcccccaccaccggggggcgcccccccccggggggcggccccccgggagcccgggcggagcccc

SEQ ID NO: 224339 - DNA, 75 bp, Artificial Sequence
  Synthetic
acggagatgcccatcagtcgatgtcctcggccaccgacccgcccagccaatcgtcgcaggacctccccttgagtc

SEQ ID NO: 224340 - DNA, 75 bp, Artificial Sequence
  Synthetic
taaacctgccccccactgtttcatacatcaaagtgctcctagatttgctaaaacaaagtctgcaatccttaaagg

SEQ ID NO: 224341 - DNA, 75 bp, Artificial Sequence
  Synthetic
cgaaccagtctggcaaaagcgacagtggaatcagcagaatagatctgtctatacatagttcctggaggattacac

SEQ ID NO: 224342 - DNA, 75 bp, Artificial Sequence
  Synthetic
ttatctctgaacccaacaaatgttcaccagttctgaatcgatgcaggaagaggttcccaaggacatcactaatct

SEQ ID NO: 224343 - DNA, 75 bp, Artificial Sequence
  Synthetic
tttcatagccctcaagtcctgctagaaagactttcatgtccttggtctccagcttcacaatgatattttggacaa

SEQ ID NO: 224344 - DNA, 75 bp, Artificial Sequence
  Synthetic
ggtttcttccttcaaaaagggcacccatctttacagtcagtggcacaggctcccactcaggtccaactctctcaa

SEQ ID NO: 224345 - DNA, 75 bp, Artificial Sequence
  Synthetic
agtcaatagatctaatcccatccagtattcttttggagcccaacaactcaagctcaagagaatcaccaagtatca

SEQ ID NO: 224346 - DNA, 75 bp, Artificial Sequence
  Synthetic
agggatcttccatgtaatcctcaaactcttcagatctgatatcaaagacaccatcgttcaccttgaagacagagt

SEQ ID NO: 224347 - DNA, 75 bp, Artificial Sequence
  Synthetic
ctgtcctcagtaagtggaggcattcatccaacattcttctatctatctcacccttaaagaggtgagagcatgata

SEQ ID NO: 224348 - DNA, 75 bp, Artificial Sequence
  Synthetic
aaagttcagccacacctggattctgtaattggcacctaaccaagaatatcaatgaaaatttccttaaacagtcag

SEQ ID NO: 224349 - DNA, 75 bp, Artificial Sequence
  Synthetic
tattattctgattgtgcgtaaagtccactgaaattgaaaactccaataccccttttgtgtagttgagcatgtagt

SEQ ID NO: 224350 - DNA, 75 bp, Artificial Sequence
  Synthetic
cccacagatcctttaaggatttaaatgcctttgggtttgtcaggccctgcctaatcaacatggcagcattacaca

SEQ ID NO: 224351 - DNA, 75 bp, Artificial Sequence
  Synthetic
caacatctcccattcggtaagagaaccacccaaaaccaaactgcaaatcattcctaaacataggcctctccacat

SEQ ID NO: 224352 - DNA, 75 bp, Artificial Sequence
  Synthetic
ttttgttcaccacctttgagacaaatgattgaaaggggcccagtgcctcagcaccatcttcagatggcatcattt

SEQ ID NO: 224353 - DNA, 75 bp, Artificial Sequence
  Synthetic
ctttatgagggaaccatgaaaaattgcctaatgtcctggttgttgcaacaaattctcgaacaaatgattcaaaat

SEQ ID NO: 224354 - DNA, 75 bp, Artificial Sequence
  Synthetic
acacctgttttaagaagttcttgcagacatccctcgtgctaacaacaaattcatcaaccagactggagtcagatc

SEQ ID NO: 224355 - DNA, 75 bp, Artificial Sequence
  Synthetic
gctgatgagaattggcaaggtcagaaaacagaacagtgtaatgttcatcccttttccacttaacaacatgagaaa

SEQ ID NO: 224356 - DNA, 75 bp, Artificial Sequence
  Synthetic
tgagtgacaaggattctgagttaatatcaattaaaacacagaggtcaaggaatttaattctgggactccacctca

SEQ ID NO: 224357 - DNA, 75 bp, Artificial Sequence
  Synthetic
tgttttttgagctcatgtcagacataaatggaagaagctgatcctcaaagatcttgggatataaccgcctcacag

SEQ ID NO: 224358 - DNA, 75 bp, Artificial Sequence
  Synthetic
attgaatcacttggttcaaattcactttgtcctccagtagccttgagctctcaggctttcttgctacataatcac

SEQ ID NO: 224359 - DNA, 75 bp, Artificial Sequence
  Synthetic
atgggtttaagtgcttaagagttaggttctcactgttattcttccctttggtcggttctgctaggacccaaacac

SEQ ID NO: 224360 - DNA, 75 bp, Artificial Sequence
  Synthetic
ccaactcaaaagagttgctcaatgaaatacaaatgtagtcccaaagaagaggccttaaaaggcatatatgatcac

SEQ ID NO: 224361 - DNA, 75 bp, Artificial Sequence
  Synthetic
ggtgggcttctggatgagactgtttgtcacaaatgtacagcgttataccatcccgattgcaaactcttgtcacat

SEQ ID NO: 224362 - DNA, 75 bp, Artificial Sequence
  Synthetic
gatcatctgtggttagatcctcaagcagctttttgatatacagattttccctatttttgtttctcacacacctgc

SEQ ID NO: 224363 - DNA, 75 bp, Artificial Sequence
  Synthetic
ttcctagagttttgcaaaggcctataaagccagatgagatacaactctggaaagctgacttgttgattgcttctg

SEQ ID NO: 224364 - DNA, 75 bp, Artificial Sequence
  Synthetic
acagcagcttctgtgcaccccttgtgaatttactacaaagtttgttctggagtgtcttgatcaatgatgggattc

SEQ ID NO: 224365 - DNA, 75 bp, Artificial Sequence
  Synthetic
tttcctcttggaaagtcatcactgatggataaaccaccttttgtcttaaaaccatccttaatgggaacatttcat

SEQ ID NO: 224366 - DNA, 75 bp, Artificial Sequence
  Synthetic
tcaaattcaaccagttaacatctgctaactgattcagatcttcttcaagaccgaggaggtctcccaattgaagaa

SEQ ID NO: 224367 - DNA, 75 bp, Artificial Sequence
  Synthetic
tggcctcctttttatctctgttaaataggtctaagaaaaattcttcattaaattcaccatttttgagcttatgat

SEQ ID NO: 224368 - DNA, 75 bp, Artificial Sequence
  Synthetic
gcagtttccttacaagctttcttacaacctttgtttcattaggacacagttcctcaatgagtctttgtattctgt

SEQ ID NO: 224369 - DNA, 75 bp, Artificial Sequence
  Synthetic
aacctctagaaccatccagccaatctttcacatcagtgttggtattcagtagaaatggatccaaagggaaattgg

SEQ ID NO: 224370 - DNA, 75 bp, Artificial Sequence
  Synthetic
catactttaggaggtccagtgttctcctttggatactattaactagggagactgggacgccatttgcgatggctt

SEQ ID NO: 224371 - DNA, 75 bp, Artificial Sequence
  Synthetic
gatctgcaattgtatctattgtttcacaaagttgatgtggctctttacacttgacattgtgtagcgctgcagata

SEQ ID NO: 224372 - DNA, 75 bp, Artificial Sequence
  Synthetic
caaactttgtgagaagagggacttcctccccccatacatagaatctagatttaaattctgcagcgaacctcccag

SEQ ID NO: 224373 - DNA, 75 bp, Artificial Sequence
  Synthetic
ccacactttttgggctgataaatttgtttaacaagccgctcagatgagattggaattccaacaggacaaggactt

SEQ ID NO: 224374 - DNA, 75 bp, Artificial Sequence
  Synthetic
cctccggatcacttacaaccaggtcactcagcctcctatcaaataaagtgatctgatcatcacttgatgtgtaag

SEQ ID NO: 224375 - DNA, 75 bp, Artificial Sequence
  Synthetic
cctctggtctttcgccaaagataacaccaatgcagtagttgatgaacctctcgctaagcaaaccatagaagtcag

SEQ ID NO: 224376 - DNA, 75 bp, Artificial Sequence
  Synthetic
aagcattatgcaagattccctgccccatatcaataaggctggatatatgggatggcactatccccatttcaaaat

SEQ ID NO: 224377 - DNA, 75 bp, Artificial Sequence
  Synthetic
attgtctgaaaattctctcagtaacagttgtttctgaacccctgagaagttttagcttcgacttgacatatgatt

SEQ ID NO: 224378 - DNA, 75 bp, Artificial Sequence
  Synthetic
tcatcattgcattcacaacaggaaaggggacctcgacaagcttatgcatgtgccaagttaacaaagtgctaacat

SEQ ID NO: 224379 - DNA, 75 bp, Artificial Sequence
  Synthetic
gatctttcccggaacgcacatactggtcatcacctagtttgagattttgtagaaacattaagaacaaaaatgggc

SEQ ID NO: 224380 - DNA, 75 bp, Artificial Sequence
  Synthetic
acatcattggtccccatttgctgtgatccatactatagtttaagaacccttcccgcacattgatagtcattgaca

SEQ ID NO: 224381 - DNA, 75 bp, Artificial Sequence
  Synthetic
agattgcattttcaaattccttatcattgtttaaacaggagcctgaaaagaaacttgaaaaagactcaaaataat

SEQ ID NO: 224382 - DNA, 75 bp, Artificial Sequence
  Synthetic
cttctattaaccttgtgaacatttttgtcctcaaatctccaatatagagttctctatttcccccaacctgctctt

SEQ ID NO: 224383 - DNA, 75 bp, Artificial Sequence
  Synthetic
tataagatagtgcaaatttcagccttccagagtcaggacctactgaggtgtatgatgttggtgattcttctgagt

SEQ ID NO: 224384 - DNA, 75 bp, Artificial Sequence
  Synthetic
agaagcacagatttttcaaagcagcactcatacattttgtcaacgacagagctttactaagggactcagaattac

SEQ ID NO: 224385 - DNA, 75 bp, Artificial Sequence
  Synthetic
tttccctctcactgattctcacgtcttcttccagtttgtcccagtcaaatttgaaattcaagccttgcctttgca

SEQ ID NO: 224386 - DNA, 75 bp, Artificial Sequence
  Synthetic
tatgcctgtatttccctgagtacgcatttgcattcatttgcaacagaatcatcttcatgcaagaaaaccaatcat

SEQ ID NO: 224387 - DNA, 75 bp, Artificial Sequence
  Synthetic
tctcagaaaagaactttctacaaaggttttttgccatctcatcgaggccacactgatctttaatgactgaggtga

SEQ ID NO: 224388 - DNA, 75 bp, Artificial Sequence
  Synthetic
aatacaaaggtgacagctctgtggaaccctcaacagcctcacagataaatttcatgtcatcattggttagacatg

SEQ ID NO: 224389 - DNA, 75 bp, Artificial Sequence
  Synthetic
atgggtcaaagtcttctactaaatggaaagatatttctgacaagataacttttcttaagtgagccatcttccctg

SEQ ID NO: 224390 - DNA, 75 bp, Artificial Sequence
  Synthetic
ttagaataagctgtaaatgatgtagtccttttgtatttgtaagtttttctccatctcctttgtcattggccctcc

SEQ ID NO: 224391 - DNA, 75 bp, Artificial Sequence
  Synthetic
tacctcttctgtaccgtgctattgtggtgttgaccttttcttcgagacttttgaagaagcttgtctcttcttctc

SEQ ID NO: 224392 - DNA, 75 bp, Artificial Sequence
  Synthetic
catcaaaacatatttctgccaggttgtcttccgatctccctgtctcttctcccttggaaccgatgaccaatctag

SEQ ID NO: 224393 - DNA, 75 bp, Artificial Sequence
  Synthetic
agactaacttggaaactttatattcatagtctgagtggctcaacttatacttttgttttcttacgaaactctccg

SEQ ID NO: 224394 - DNA, 75 bp, Artificial Sequence
  Synthetic
taatttgactcacagcactaacaagcaatttgttaaagtcatattccagaagtcgttctccatttagatgcttat

SEQ ID NO: 224395 - DNA, 75 bp, Artificial Sequence
  Synthetic
taaccaccacacttttgttactagcaagatctaatgctgtcgcacatccagagttagtcatgggatctaggctgt

SEQ ID NO: 224396 - DNA, 75 bp, Artificial Sequence
  Synthetic
ttagcttcttctctcctttgaaaattaaagtgccgttgttaaatgaagacaccattaggctaaaggcttccagat

SEQ ID NO: 224397 - DNA, 75 bp, Artificial Sequence
  Synthetic
taacacctggagttgtatgctgacagtcaatttctttactagtgaatctcttcatttgctcatagaacacacatt

SEQ ID NO: 224398 - DNA, 75 bp, Artificial Sequence
  Synthetic
cttcctcaggagtgattgcttccttggggttgacaaaaaaaccaaattgacttttgggctcaaagaacttttcaa

SEQ ID NO: 224399 - DNA, 75 bp, Artificial Sequence
  Synthetic
aacattttatctgatctgttagcctgtcaggggtctcctttgtgatcaaatgacacaggtatgacacattcaaca

SEQ ID NO: 224400 - DNA, 75 bp, Artificial Sequence
  Synthetic
taaatttaaattttgcactcaacaacaccttctcaccagtaccaaaaatagtttttattaggaatctaagcagct

SEQ ID NO: 224401 - DNA, 75 bp, Artificial Sequence
  Synthetic
tatacaccaccttctcagcaggtgtgatcagatcctccctcaacttatccattaatgatgtagatgagaaatctg

SEQ ID NO: 224402 - DNA, 75 bp, Artificial Sequence
  Synthetic
acactattgccatcaccaaatatctgacactctgtacctgcttttgatttctctttgttgggttggtgagcatta

SEQ ID NO: 224403 - DNA, 75 bp, Artificial Sequence
  Synthetic
gcaacaatagggtcctcagtgcaacctcaatgtcggtgagacagtctttcaaatcaggacatgatctaatccatg

SEQ ID NO: 224404 - DNA, 75 bp, Artificial Sequence
  Synthetic
aaatcatgatgtctatcatattgtataagacctcatctgaaaaaattggtaaaaagaaccttttaggatctgcat

SEQ ID NO: 224405 - DNA, 75 bp, Artificial Sequence
  Synthetic
agaaggaaattaaatgaccatccgggccttgtatggagtagcaccttgaagattctccagtcttctggtataata

SEQ ID NO: 224406 - DNA, 75 bp, Artificial Sequence
  Synthetic
ggtggtattcttcagagtccagttttattacttggcaaaacacttctttgcattctaccacttgatatctcacag

SEQ ID NO: 224407 - DNA, 75 bp, Artificial Sequence
  Synthetic
accctatttgattttgccttagtctagcaactgagctagttttcatactgtttgttaaggccagacaaacagatg

SEQ ID NO: 224408 - DNA, 75 bp, Artificial Sequence
  Synthetic
ataatcttctcaggctctgtatgttcttcagctgctctgtgctgggttggaaattgtaatcttcaaacttcgtat

SEQ ID NO: 224409 - DNA, 75 bp, Artificial Sequence
  Synthetic
aatacattatcgggtgagctccaattttcataaagttctcaaattcagtgaatggtatgtggcattcttgctcaa

SEQ ID NO: 224410 - DNA, 75 bp, Artificial Sequence
  Synthetic
ggtgttcagacagtccgtaatgctcgaaactcagtcccaccactaacaggcatttttgaatttttgcaatgaact

SEQ ID NO: 224411 - DNA, 75 bp, Artificial Sequence
  Synthetic
cactaatagacgccctaaacaattcctcaaaagacacctttctaaacacctttgacttttttctattcctcaaaa

SEQ ID NO: 224412 - DNA, 75 bp, Artificial Sequence
  Synthetic
gtctaatgaactcctctttagtgctgtgaaagcttaccagcctatcattcacactactatagcaacaacccaccc

SEQ ID NO: 224413 - DNA, 75 bp, Artificial Sequence
  Synthetic
agtgtttatcattttttaaccctttgaatttcgactgttttatcaatgaggaaagacacaaaacatccagattta

SEQ ID NO: 224414 - DNA, 75 bp, Artificial Sequence
  Synthetic
acaactgtctccttctagtattcaacagtttcaaactcttgactttgtttaacatagagaggagcctctcatatt

SEQ ID NO: 224415 - DNA, 75 bp, Artificial Sequence
  Synthetic
cagtgctagtctcacttcccctttcgtgcccatgggtctctgcagttatgaatctcatcaaaggacaggattcca

SEQ ID NO: 224416 - DNA, 75 bp, Artificial Sequence
  Synthetic
ctgcctccctgcttaatgttaagatatcatcactatcagcaaggttttcatagagctcagagaattccttgatca

SEQ ID NO: 224417 - DNA, 75 bp, Artificial Sequence
  Synthetic
agccttcagggtttactttctgaaagtttctctttaatttcccactttctaaatctcttctaaacctgctgaaaa

SEQ ID NO: 224418 - DNA, 75 bp, Artificial Sequence
  Synthetic
gagagtttattccaaaaaccacatcatcacagctcatgttggggttgatgccttcgtggcacatcctcataattt

SEQ ID NO: 224419 - DNA, 75 bp, Artificial Sequence
  Synthetic
catcattatgagttgacctcgcatctttcagaattttcatagagtccataccggagcgcttgtcgatagtagtct

SEQ ID NO: 224420 - DNA, 75 bp, Artificial Sequence
  Synthetic
tcagggactcacagagtctaaaatattcagactcttcaaagactttctcattttggttagaatactccaaaagtt

SEQ ID NO: 224421 - DNA, 75 bp, Artificial Sequence
  Synthetic
tgaataaaaggtctctaaatttgaagtttgcccactctggcataaaactattatcataatcacaacgaccatcta

SEQ ID NO: 224422 - DNA, 75 bp, Artificial Sequence
  Synthetic
ctattggaactaatgtgacacccgcaacagcaaggtcttccctgatgcatgccaatttgttagtgtcctctataa

SEQ ID NO: 224423 - DNA, 75 bp, Artificial Sequence
  Synthetic
atttcttctcaaaactggctggagtgctcctaacaaaacactcaagaagaatgagagaattgtctatcagcttgt

SEQ ID NO: 224424 - DNA, 75 bp, Artificial Sequence
  Synthetic
aaccatcaggaatgataagtggtagtcctgggcatacaattccagactccaccaaaattgtttccacagacttat

SEQ ID NO: 224425 - DNA, 75 bp, Artificial Sequence
  Synthetic
cgtcgtggttgtgtgtgcagccactcttgtctgcactgtctatttcaatgcagcgtgacagcaacttgagtccct

SEQ ID NO: 224426 - DNA, 75 bp, Artificial Sequence
  Synthetic
caatcagaaccattctgggttccctttgtcccagaaagttgagtttctgccttgacaacctctcatcctgttcta

SEQ ID NO: 224427 - DNA, 75 bp, Artificial Sequence
  Synthetic
cttgacaacctctcatcctgttctatatagtttaaacataactctctcaattctgagatgatttcatccattgcg

SEQ ID NO: 224428 - DNA, 75 bp, Artificial Sequence
  Synthetic
agtttaaacataactctctcaattctgagatgatttcatccattgcgcatcaaaaagcctaggatcctcggtgcg

SEQ ID NO: 224429 - DNA, 75 bp, Artificial Sequence
  Synthetic
tgctcagtcaacaactctcatcactacatcagtatgggaagctctggactggagctaactttcactaacgactcc

SEQ ID NO: 224430 - DNA, 75 bp, Artificial Sequence
  Synthetic
gtcttgtgattttaacaatggcatcaccattcaatacaacttgtcattttcggacccacagagcgctataagcca

SEQ ID NO: 224431 - DNA, 75 bp, Artificial Sequence
  Synthetic
gaggaaagtacatgagaagtggctggggctgggcaggttcagatggcaagattacttggtgcagccaaacaagct

SEQ ID NO: 224432 - DNA, 75 bp, Artificial Sequence
  Synthetic
acaaggctgccctgagtaagttcaagcaagatgtagagtctgccttgcatgtattcaagacaacagtaaattctc

SEQ ID NO: 224433 - DNA, 75 bp, Artificial Sequence
  Synthetic
tttagccctaatggatcttttgatgttttcaacatcagcatatctgatcagcatctttctgcatcttgtgaagat

SEQ ID NO: 224434 - DNA, 75 bp, Artificial Sequence
  Synthetic
cccaaggactgcttttaggagatcctcactattgcttggtttgatcagaatagattccagcatgttccctccatc

SEQ ID NO: 224435 - DNA, 75 bp, Artificial Sequence
  Synthetic
cagagatattgatactagattgctgttcagtaatgacccccagaactgggtgtttatcctttaacctttcaaggt

SEQ ID NO: 224436 - DNA, 75 bp, Artificial Sequence
  Synthetic
cgcaccggggatcctaggctttttggattgcgcttttctttaggtcaactaagtgtcaaactctgtcccacacaa

SEQ ID NO: 224437 - DNA, 75 bp, Artificial Sequence
  Synthetic
ggatgggtcagattgtgacaatgtttgaggcgttgcctcatatcattgatgaagtcatcaacattgttattattg

SEQ ID NO: 224438 - DNA, 75 bp, Artificial Sequence
  Synthetic
tactcatcataatcaccagtattaaagctgtgtacaattttgccacctgcgggatattcgcattagtcagcttcc

SEQ ID NO: 224439 - DNA, 75 bp, Artificial Sequence
  Synthetic
ttctcctagccggtaggtcctgcggtatgtacggtctcaatggacccgacatttacaaagggatttaccagttca

SEQ ID NO: 224440 - DNA, 75 bp, Artificial Sequence
  Synthetic
aatcagtggagtttgatatgtcacatttgaacctgacaatgcccaatgcatgttcagccaataattcccaccact

SEQ ID NO: 224441 - DNA, 75 bp, Artificial Sequence
  Synthetic
acatcagcatggggagttctggactggaactgaccttcaccaatgattctattctcagccacaatttttgcaacc

SEQ ID NO: 224442 - DNA, 75 bp, Artificial Sequence
  Synthetic
taacccctgctttcaacaagaagaccttcgaccacacactcatgagcatagtctcaagtctacaccttagcatca

SEQ ID NO: 224443 - DNA, 75 bp, Artificial Sequence
  Synthetic
ggggaaactccaactacaaagcagtgtcttgtgatttcaacaatggcatcacaatccaatacaacctgacgtttt

SEQ ID NO: 224444 - DNA, 75 bp, Artificial Sequence
  Synthetic
cagatgcgcagagtgccatcaaccagtgcagaacttttagaggtagagttctagacatgtttagaactgcttttg

SEQ ID NO: 224445 - DNA, 75 bp, Artificial Sequence
  Synthetic
gtgggaagtatatgcgaagtgggtggggctggacaggttcagatggcaaaaccacttggtgcagccagacaagct

SEQ ID NO: 224446 - DNA, 75 bp, Artificial Sequence
  Synthetic
atcaatatctaatcatacaaaacagaacttgggaaaatcactgcacctacgcaggtccttttggaatgtctagaa

SEQ ID NO: 224447 - DNA, 75 bp, Artificial Sequence
  Synthetic
tcctttttgctcaggaaaagacaaagttcctcactagaagacttgcaggtacattcacttggactctgtcagact

SEQ ID NO: 224448 - DNA, 75 bp, Artificial Sequence
  Synthetic
cttcgggaacagaaaatccaggtggatattgtttgactaaatggatgattttggctgcagaactcaaatgctttg

SEQ ID NO: 224449 - DNA, 75 bp, Artificial Sequence
  Synthetic
ggaacacggctgttgcaaagtgcaacgtcaatcatgatgaggagttctgtgacatgctgcgactaattgattaca

SEQ ID NO: 224450 - DNA, 75 bp, Artificial Sequence
  Synthetic
acaaggctgcactaacaaaattcaagcaagatgttgagtctgctttacacctattcaagacaactgtcaattctc

SEQ ID NO: 224451 - DNA, 75 bp, Artificial Sequence
  Synthetic
tgatttccgatcagctattgatgaggaaccatttaagagatttgatgggggtaccatactgcaattactcaagat

SEQ ID NO: 224452 - DNA, 75 bp, Artificial Sequence
  Synthetic
tctggtacttagaacatgcaaaaactggtgagaccagtgtcccaaagtgctggcttgtcactaacggttcttact

SEQ ID NO: 224453 - DNA, 75 bp, Artificial Sequence
  Synthetic
taaatgagacccactttagtgaccaaatagaacaagaagcagataacatgattacagaaatgctgaggaaagatt

SEQ ID NO: 224454 - DNA, 75 bp, Artificial Sequence
  Synthetic
acataaaaagacaggggagtacccctctagccctgatggacatcttgatgttttctacatcagcataccttgtaa

SEQ ID NO: 224455 - DNA, 75 bp, Artificial Sequence
  Synthetic
gcatttttttgcatcttgtgaagataccaacacacagacatataaaaggtggctcatgtccaaaaccacaccgtt

SEQ ID NO: 224456 - DNA, 75 bp, Artificial Sequence
  Synthetic
tgaccagcaagggaatttgtagttgtggtgcttttaaggtgccaggagtgaaaactgtctggaagagacgctgaa

SEQ ID NO: 224457 - DNA, 75 bp, Artificial Sequence
  Synthetic
caacggcgcctccctgactctccacctcagaagaggtggagagtcagggaggcccagagggtcttagagtttcac

SEQ ID NO: 224458 - DNA, 75 bp, Artificial Sequence
  Synthetic
aacatttgggcctctgaagatcaagtcatgtggcaggatgttgtggacagtctttaagtcagggagcctcgcctt

SEQ ID NO: 224459 - DNA, 75 bp, Artificial Sequence
  Synthetic
ggaagcactctcaaatatgatgcagtccatgagtgcacaatgtggggtgatttctttcttcttcctatccctcac

SEQ ID NO: 224460 - DNA, 75 bp, Artificial Sequence
  Synthetic
tatcccagtgtgcatcttgcataaccagccatatttgtcccacactttgtcttcatactctcttgaagcctcttt

SEQ ID NO: 224461 - DNA, 75 bp, Artificial Sequence
  Synthetic
ggtcatttcaacatcaataagctttatgtcccttctattctgtgaatctaggagctttctgatgtcatcagagcc

SEQ ID NO: 224462 - DNA, 75 bp, Artificial Sequence
  Synthetic
ttgacagcttaagaccattccttgtggaagagcacctatgaccgatgaggtcagtccaggttgtgcattgaagag

SEQ ID NO: 224463 - DNA, 75 bp, Artificial Sequence
  Synthetic
atcagtaaggtccatgccgtgtgagtacttggagtcctgtttgaactgtttctgatcggtaggttctctgtaaaa

SEQ ID NO: 224464 - DNA, 75 bp, Artificial Sequence
  Synthetic
atgtataaattgcccattttgtggttggaatattgctatctccactggatcattgaacctgccctcaatgtcaat

SEQ ID NO: 224465 - DNA, 75 bp, Artificial Sequence
  Synthetic
ccatgtgggagcattaggatcgatccctcccatgaggtccttcagcaacattgtttggctatagctcaggcctac

SEQ ID NO: 224466 - DNA, 75 bp, Artificial Sequence
  Synthetic
ctgaggcggacctgctgctccaggcactggcctgggtgagttggttacagatttctcacttgtgagatcgattgt

SEQ ID NO: 224467 - DNA, 75 bp, Artificial Sequence
  Synthetic
tgtgttttcccatgctctccccacaatcgatgtcctacaagctatatatggccacccttcacctgagagacagac

SEQ ID NO: 224468 - DNA, 75 bp, Artificial Sequence
  Synthetic
tttgtagaggatgttttcgtaagggtttctatctccaacttgatccgagacaaacatgttaagtttcctttttgc

SEQ ID NO: 224469 - DNA, 75 bp, Artificial Sequence
  Synthetic
cccaagaaccgctttcaggaggtcttcactattgctcggcttaatcaagatggattccagcatgttgcccccatc

SEQ ID NO: 224470 - DNA, 75 bp, Artificial Sequence
  Synthetic
cagcaaggctgctcctgctttcacagctgctccaagactgaaattatagccagagatgtttatactggattgctg

SEQ ID NO: 224471 - DNA, 75 bp, Artificial Sequence
  Synthetic
ttcggtgatgactcccaaaactgggtgcttgtctttcagcttttcaaggtcattgagatttgggtatttgactgt

SEQ ID NO: 224472 - DNA, 75 bp, Artificial Sequence
  Synthetic
gtaaagcagaccaaggtctgtgagtgcttgcacaacatcatttagtggagtctgtgattgtttggccatgcaagc

SEQ ID NO: 224473 - DNA, 75 bp, Artificial Sequence
  Synthetic
cattgtcagacttggcattgtgccaaattgattgttcagtagtgatgagtccttcacatcccagactctcaccac

SEQ ID NO: 224474 - DNA, 75 bp, Artificial Sequence
  Synthetic
accatttgcaccttgctgaggcctcctcatcccaaccatttgcaaaatttgagatctttgatcaagctgttgtgt

SEQ ID NO: 224475 - DNA, 75 bp, Artificial Sequence
  Synthetic
tgtcaagttccccatatagactccagaagtttgaggtctttcagacctcataattttggccttcaacttctcaag

SEQ ID NO: 224476 - DNA, 75 bp, Artificial Sequence
  Synthetic
gtcagcagcgagagacatcagctcttccgcactgagtcttcccacttttagaacattcttctttgatgccgactt

SEQ ID NO: 224477 - DNA, 75 bp, Artificial Sequence
  Synthetic
caggtctacaagggaatacacagtctggttaagacttctgagcctttgtaggtctttgtcatccctcttttcctt

SEQ ID NO: 224478 - DNA, 75 bp, Artificial Sequence
  Synthetic
cctcatgattctctgaacattgctgacttcagagaagtctaaaccatttagaaggctagttgcgtccttgatgac

SEQ ID NO: 224479 - DNA, 75 bp, Artificial Sequence
  Synthetic
agcagccttcacatctgttgtgaagttctgcagttccctcctcagtgcctgtgtccactgaaagctcttgacttc

SEQ ID NO: 224480 - DNA, 75 bp, Artificial Sequence
  Synthetic
ttctgcagttccctcctcagtgcctgtgtccactgaaagctcttgacttccttggacagagacatcttgttgctc

SEQ ID NO: 224481 - DNA, 75 bp, Artificial Sequence
  Synthetic
cgcaccggggatcctaggcgtttagttgcgctactcagttgcacagcctttccctgtgagagtacagaaacaaac

SEQ ID NO: 224482 - DNA, 75 bp, Artificial Sequence
  Synthetic
ctagtcattggccatgggtcagggcaagtccaaggagaaaaaagacaccaacatcggagacagagccgagattct

SEQ ID NO: 224483 - DNA, 75 bp, Artificial Sequence
  Synthetic
gccagacaccacctatctcggtccactgaactgcaaatcatgctggcagaagttcgacagtttggtcaggtgcca

SEQ ID NO: 224484 - DNA, 75 bp, Artificial Sequence
  Synthetic
tgaccactacctctgtagacactgtctgaaccttctgttgtcagtctccgacaggtgccctctttgcaagtatcc

SEQ ID NO: 224485 - DNA, 75 bp, Artificial Sequence
  Synthetic
attaccaaccaagctgaagatatcaacagccccaagctcaccacctccctacgaggagtgacgccccaaacctcg

SEQ ID NO: 224486 - DNA, 75 bp, Artificial Sequence
  Synthetic
gcgccaacaagcaacccaacacaaagaggccacacaccgcccaacacacacagacacagcacccaacacaaacca

SEQ ID NO: 224487 - DNA, 75 bp, Artificial Sequence
  Synthetic
caaacacacacacaaccacccacacccacgcgcccccacaccggggggcgcccccccctccccccgccgggggga

SEQ ID NO: 224488 - DNA, 75 bp, Artificial Sequence
  Synthetic
ggcccccggggatccgggggggagccccgcgagggcactgattagtcgatctcctccgtcaccaacgtggagagc

SEQ ID NO: 224489 - DNA, 75 bp, Artificial Sequence
  Synthetic
cagtcatcacaagacttccctttgagtctgaatctacccccaactgtttcatacatcactgtgtttttagacttg

SEQ ID NO: 224490 - DNA, 75 bp, Artificial Sequence
  Synthetic
ctgtaacagagtctacagtctttaaaagcgaaccagtctggtacaagtgacaatggtttcaataaaatagatctg

SEQ ID NO: 224491 - DNA, 75 bp, Artificial Sequence
  Synthetic
tccatgcataactcttgaagaaccacacctatttctgagctcggtaaatgttcaccagttttaaatcgatgcaag

SEQ ID NO: 224492 - DNA, 75 bp, Artificial Sequence
  Synthetic
aggaggttgccgagaacgccatcaatcctctcatagccctcaagttctgccaaaaagactctcatatctttggtc

SEQ ID NO: 224493 - DNA, 75 bp, Artificial Sequence
  Synthetic
tccaatttcacaaggatgttttgaacaaagtttctcccttcaaaaagtgcacccgcgctcacagtcagaggcaca

SEQ ID NO: 224494 - DNA, 75 bp, Artificial Sequence
  Synthetic
ggctcccattcaggccctattctctcaaaatctagagacctaacctcatccagtattttcctagaacctaccagc

SEQ ID NO: 224495 - DNA, 75 bp, Artificial Sequence
  Synthetic
tcgagttcaatagaatcaccgagtgtcaaaggctcttcaatgtaatccccaaattcctcagacctgatgtcaaag

SEQ ID NO: 224496 - DNA, 75 bp, Artificial Sequence
  Synthetic
acactatcgttcttcttaaagatagggtctgtccttaacaggcaaagacattcatctaacagtctcctgtccacc

SEQ ID NO: 224497 - DNA, 75 bp, Artificial Sequence
  Synthetic
tcacctttaaaaaagtgattgcacgaaaggaactcagccacacctggaccctgcagttgacactttattaagaga

SEQ ID NO: 224498 - DNA, 75 bp, Artificial Sequence
  Synthetic
actaaagaaaatttccttaagcaatcagtgttattttggttgtgcgtgaaatctattgtaactgagaactccaat

SEQ ID NO: 224499 - DNA, 75 bp, Artificial Sequence
  Synthetic
actctctttgtgttgtcaagcatgtagtcccacagatccttcaaagatttaaatgcctttgggtttgttagaccc

SEQ ID NO: 224500 - DNA, 75 bp, Artificial Sequence
  Synthetic
tgcttaattagcattgcagcattgcacactacgtctcctatctgataagaaaaccatccaaagccaaattgcaga

SEQ ID NO: 224501 - DNA, 75 bp, Artificial Sequence
  Synthetic
tcattcctgaacataggcctctctatgcttttgttcactacttttaaaacgaatgattgaaaaggtcccagtgcc

SEQ ID NO: 224502 - DNA, 75 bp, Artificial Sequence
  Synthetic
tcagcaccatcttctgaaggcatcatgtctttatgaggaaaccatgaaaaactgcccaaagtcctggctgttgcg

SEQ ID NO: 224503 - DNA, 75 bp, Artificial Sequence
  Synthetic
actgcccaaagtcctggctgttgcgacaaactctcgcacgaacgactcaaaatacacttgttttaaaaagttttt

SEQ ID NO: 224504 - DNA, 75 bp, Artificial Sequence
  Synthetic
acaaacatcccttgtgctaacaacaaactcatcaaccagacttgaatcagaccgttgatgagaattgacaaggtc

SEQ ID NO: 224505 - DNA, 75 bp, Artificial Sequence
  Synthetic
agaaaataaaacagtgtaatgttcatccctcttccatttaacaacatgagaaatcagtgacaaagactctgagtt

SEQ ID NO: 224506 - DNA, 75 bp, Artificial Sequence
  Synthetic
aatgtcaattagtacacagaggtcaagaaatttgatcctgggactccacctcatgttttttgagctcatatcaga

SEQ ID NO: 224507 - DNA, 75 bp, Artificial Sequence
  Synthetic
catgaacggaagcaactgatcctcataaattttagggtacaatcgcctcacagattgaattacatgattcagact

SEQ ID NO: 224508 - DNA, 75 bp, Artificial Sequence
  Synthetic
cactttgtcttccagtagtcttgaactttcaggcttccttgctacataatcacatggatttaagtgtttaacact

SEQ ID NO: 224509 - DNA, 75 bp, Artificial Sequence
  Synthetic
tgagctcccaacatccctcccttttacaggctctgctaggacccaaacacccaactcaaaggagttgttcagcga

SEQ ID NO: 224510 - DNA, 75 bp, Artificial Sequence
  Synthetic
gatacaaatgtagtcccagagaagaggccttaaaaggctgatgtgatcacggtgattgtctgggtgactttgtct

SEQ ID NO: 224511 - DNA, 75 bp, Artificial Sequence
  Synthetic
gtcacagacgtacagcataatgccatcgtgtttttgaacccttgtcacatattcatccatggccaggtcctcaag

SEQ ID NO: 224512 - DNA, 75 bp, Artificial Sequence
  Synthetic
cactttcttgatatataagttctctctgtttttatttctcacacatctacttcccagagtcttgcaaagacctat

SEQ ID NO: 224513 - DNA, 75 bp, Artificial Sequence
  Synthetic
gaaaccagatgagatgcaactttgaaaggctgacttattgattgcctctgacaatagcttctgtgcacctcttgt

SEQ ID NO: 224514 - DNA, 75 bp, Artificial Sequence
  Synthetic
aaacttgctacagagtttgttttggagtgtcttaattaatgatgggattctctcttcttgaaaagtcatcactga

SEQ ID NO: 224515 - DNA, 75 bp, Artificial Sequence
  Synthetic
tgggtatatcactttttgtctcaaaaccatccttaatgggaacatttcattcaaattcaaccaattgatgtttgc

SEQ ID NO: 224516 - DNA, 75 bp, Artificial Sequence
  Synthetic
caactgacttagatcatcttcaagattaaggatatcccctaactgaaggatggcctccttcttctctctattgaa

SEQ ID NO: 224517 - DNA, 75 bp, Artificial Sequence
  Synthetic
aaggtccaagaaaaactcttcgttaaaatcaccatttttgagcttatgatgtaatttcctcacgagttttcttat

SEQ ID NO: 224518 - DNA, 75 bp, Artificial Sequence
  Synthetic
gacctttgtttcattgggacatagttcttctatgagtctctggattctataacctctagaaccatctagccaatc

SEQ ID NO: 224519 - DNA, 75 bp, Artificial Sequence
  Synthetic
cttcacatcagtgtttgtgtttaataaaaatgggtccaaagggaagttggaatattttaagagaaccaatgtcct

SEQ ID NO: 224520 - DNA, 75 bp, Artificial Sequence
  Synthetic
tttttggatgcagttcactaaaaaaacaggaacaccatttgcaatagcttgatcagcaattgtatctatggtttc

SEQ ID NO: 224521 - DNA, 75 bp, Artificial Sequence
  Synthetic
acaaagttgatgtggctctttgcatttgacgttgtgtagtgctgcagagacaaactttgtaagaagaggaacttc

SEQ ID NO: 224522 - DNA, 75 bp, Artificial Sequence
  Synthetic
ctctccccacacatagaacctagatttgaattctgcagcgaatcgcccgaccacacttttgggactgatgaattt

SEQ ID NO: 224523 - DNA, 75 bp, Artificial Sequence
  Synthetic
gtttaacaaaccactcaaatgagaatgaaactctagcaggacaagaacttcatccggatcactctcaaccagttc

SEQ ID NO: 224524 - DNA, 75 bp, Artificial Sequence
  Synthetic
acttaatcttctgtcaaataaagtgatctgatcatcacttgatgtgtaagcttcaggtctctcaccaaaaatgac

SEQ ID NO: 224525 - DNA, 75 bp, Artificial Sequence
  Synthetic
accaatgcagtaattaatgaacctctcactaattaagccataaaaatccgaagcgttatgcagtatcccttgtcc

SEQ ID NO: 224526 - DNA, 75 bp, Artificial Sequence
  Synthetic
catatcaataagactagatatgtgggatggcacaattcctaattcaaaatattctctaaaaattctctctgtaac

SEQ ID NO: 224527 - DNA, 75 bp, Artificial Sequence
  Synthetic
agtagtttctgaacctctaagaagcttcaattttgacttaacatatgacttcatcattgcgttcacaacagggaa

SEQ ID NO: 224528 - DNA, 75 bp, Artificial Sequence
  Synthetic
aggaacttcaacaagtttgtgcatatgccaggtcagcaaggtgctgacatgatccttcccagagcgcacatactg

SEQ ID NO: 224529 - DNA, 75 bp, Artificial Sequence
  Synthetic
atcatcacccagtttcagattttgtagaagcattagaaacagaaaaggacacatcattggcccccatttgctgtg

SEQ ID NO: 224530 - DNA, 75 bp, Artificial Sequence
  Synthetic
atccatactgtagtttaaaagcccttctcgcacattgatagtcattgacaaaacagcattttcaaattctttgtc

SEQ ID NO: 224531 - DNA, 75 bp, Artificial Sequence
  Synthetic
attgtttaaacatgagcctgaaaagaaactagaaaaggactcaaaataatcctctattagtcttgtgaacatttt

SEQ ID NO: 224532 - DNA, 75 bp, Artificial Sequence
  Synthetic
tgtcctcagatctccaatataaagttctctattccccccaacctgctccttgtaagataatgcaaatttcagtct

SEQ ID NO: 224533 - DNA, 75 bp, Artificial Sequence
  Synthetic
cccagaatcaggaccaactgaagtgtatgatgttggtgactcttctgaatagaaacacaaattttttaaggcagc

SEQ ID NO: 224534 - DNA, 75 bp, Artificial Sequence
  Synthetic
actcatgcacttcgtcaatgataaggccttacttaaagattcagaattgctttctctttcgctgattcttacgtc

SEQ ID NO: 224535 - DNA, 75 bp, Artificial Sequence
  Synthetic
ttcttccagcttatcccagtcaaatttgaaattcaagccctgtctttgtatatgcctatactttcctgagtatgc

SEQ ID NO: 224536 - DNA, 75 bp, Artificial Sequence
  Synthetic
attcgcattcatttgcaataggatcatcttcatacatgaaaaccaatcgccctctgaaaagaatttcctgcaaag

SEQ ID NO: 224537 - DNA, 75 bp, Artificial Sequence
  Synthetic
gttttttgccatctcatctagaccacattgttctttaacaactgaagtgaaatacaatggtgataattctgtaga

SEQ ID NO: 224538 - DNA, 75 bp, Artificial Sequence
  Synthetic
gccctcaacagcttcacaaacaaattgcatatcatcattagtgagacaggatggatcaaagtcctctactagatg

SEQ ID NO: 224539 - DNA, 75 bp, Artificial Sequence
  Synthetic
gaaagatatctctgataagattaccttcctcaaatgagccatcttacctgacaagacagtctgaagatgatgtaa

SEQ ID NO: 224540 - DNA, 75 bp, Artificial Sequence
  Synthetic
tccttttgtgtttttgagttcttccccaccctcctctccattaactttcttaccttgcttataatgtgttattgt

SEQ ID NO: 224541 - DNA, 75 bp, Artificial Sequence
  Synthetic
agagttaaccttgttttctagtttcttgaagaaacttgtttcttcttctccttcaaaacaaacttctgctgtgtc

SEQ ID NO: 224542 - DNA, 75 bp, Artificial Sequence
  Synthetic
actttctggattccctggctctgcccccttggagccaatgaccaacttagaaaccaattttgagaccttatactc

SEQ ID NO: 224543 - DNA, 75 bp, Artificial Sequence
  Synthetic
ataatctgagtggctcagcttatacttctgcttcctcacaaagccctctgtgatttgacttacagcacttacaag

SEQ ID NO: 224544 - DNA, 75 bp, Artificial Sequence
  Synthetic
taatttattgaaatcatattccaggagtcgctctccattcagatgcttattaacaactacactcttattgctggc

SEQ ID NO: 224545 - DNA, 75 bp, Artificial Sequence
  Synthetic
aagatctaatgccgtagcacatccagaattagtcatagggtctaagttgttgagctttttctcccctttgaaaat

SEQ ID NO: 224546 - DNA, 75 bp, Artificial Sequence
  Synthetic
caaggtaccattgttgaatgaagacaccattagactgaaaacctccaaattaacacctgggactgtgcgctgaca

SEQ ID NO: 224547 - DNA, 75 bp, Artificial Sequence
  Synthetic
gtcagtttctttactggtgaacttcttcatttgctcataaaaaacacactcttcttcgggagtgattgcttcctt

SEQ ID NO: 224548 - DNA, 75 bp, Artificial Sequence
  Synthetic
agggttgacgaaaaagccaaactgactcttgggttcaaagaacttttcaaaacattttatttggtctgttagtct

SEQ ID NO: 224549 - DNA, 75 bp, Artificial Sequence
  Synthetic
gtcaggggtctcttttgtaattaaatgacataggtatgacacatttaacatgaacttaaactttgcactcaatag

SEQ ID NO: 224550 - DNA, 75 bp, Artificial Sequence
  Synthetic
cactttctcaccagcaccaaaaatggttttgattaaaaatctaagcagcctatacaccaatttttcagcaggagt

SEQ ID NO: 224551 - DNA, 75 bp, Artificial Sequence
  Synthetic
gattagatcctcccttaacttgtccatcaatgatgtggatgaaaagtcggagacaatggccatcactaagtacct

SEQ ID NO: 224552 - DNA, 75 bp, Artificial Sequence
  Synthetic
aatattttgcacctgcttttgattcctttttgtagggttggtgagcattagcaacagtagggtcctcaatgcagt

SEQ ID NO: 224553 - DNA, 75 bp, Artificial Sequence
  Synthetic
ctcaatatcaataatacagtcctttaaatcagggcatgacctgatccatgagatcatggtgtcaatcatattatg

SEQ ID NO: 224554 - DNA, 75 bp, Artificial Sequence
  Synthetic
taacacctcatctgaaaaaattggtagaaaaaacctctttggatctgcgtaaaaggaaatcaagtgaccatccaa

SEQ ID NO: 224555 - DNA, 75 bp, Artificial Sequence
  Synthetic
gccctgtatggaatagcacctcgaagactctccagtcttctgatatagtagatgatattcctcagaatctagttt

SEQ ID NO: 224556 - DNA, 75 bp, Artificial Sequence
  Synthetic
tattacctggcagaacacttctttgcactcaactgtctgataccttccagaccccaactgattttgtctcaatct

SEQ ID NO: 224557 - DNA, 75 bp, Artificial Sequence
  Synthetic
agcaactgagcttgttttcatactgtttgtcagagctaaacaaacagatgacaatctcttcaagctctgcacatc

SEQ ID NO: 224558 - DNA, 75 bp, Artificial Sequence
  Synthetic
ccttaattgctctatgttgggttgaaaattataatcctcaaactttgtatagtgcattatagggtgggttccggc

SEQ ID NO: 224559 - DNA, 75 bp, Artificial Sequence
  Synthetic
cttcatgaagttctcgaactcagtaaatggtatgtggcattcatgcacgagggatttagacagtccataatgctc

SEQ ID NO: 224560 - DNA, 75 bp, Artificial Sequence
  Synthetic
gaaactaagtcccactactgacagacacttttgaatttttgtgatgaactcactcatggacgttctgaataattc

SEQ ID NO: 224561 - DNA, 75 bp, Artificial Sequence
  Synthetic
ttcaagggacaccttcctgtgtgcctttgatcttcttctgttcttcaaaagtttgataaattcctcctttgtgct

SEQ ID NO: 224562 - DNA, 75 bp, Artificial Sequence
  Synthetic
gtgaaagctcaccaacctatcattcacgctgctataacagcatcccacccagtgtttgtcattgtttaatccttt

SEQ ID NO: 224563 - DNA, 75 bp, Artificial Sequence
  Synthetic
aaattttaactgcttgatcagtgaagaaaggcacaggacatctaaattcaataattgtttccttctagtgttcaa

SEQ ID NO: 224564 - DNA, 75 bp, Artificial Sequence
  Synthetic
caactttaagcttttgaccttgttcaacatggagaggagcctctcatactcagtactagtctcatttcctctctc

SEQ ID NO: 224565 - DNA, 75 bp, Artificial Sequence
  Synthetic
atgcccatgggtctctgctgtgatgaacctcatcaaaggacaggattcaactgcctctctacacagtgttaagac

SEQ ID NO: 224566 - DNA, 75 bp, Artificial Sequence
  Synthetic
atcatcattgtcagtaaggacctcatagagcccagagaactccttgaccaagccctcagggttgatcttctgaaa

SEQ ID NO: 224567 - DNA, 75 bp, Artificial Sequence
  Synthetic
ctttctctcaagcttcccacttttcaagtctcttctgaatctactaaaaagagagtttataccaaagaccacatc

SEQ ID NO: 224568 - DNA, 75 bp, Artificial Sequence
  Synthetic
atcacaagtcatattagggttgacaccatcatggcacatcttcataatttcatcattgtgaagtgaccttgcgtc

SEQ ID NO: 224569 - DNA, 75 bp, Artificial Sequence
  Synthetic
ttttagaactttcatggaatccataccagaacgcttatcaacagtggttttaagagactcacagagtctgaagta

SEQ ID NO: 224570 - DNA, 75 bp, Artificial Sequence
  Synthetic
ctcagattcctcaaaaaccttctcatcctggctagcatactccaaaagtttgaatagaaggtctctgaatttgaa

SEQ ID NO: 224571 - DNA, 75 bp, Artificial Sequence
  Synthetic
gttcacccactctggcatgaagctgttatcataatcacaacgaccatcaactattggaactagtgtgattcccgc

SEQ ID NO: 224572 - DNA, 75 bp, Artificial Sequence
  Synthetic
aacagcaagatcttctttgatacatgccaacttgttagtgtcctctataaatttcttttcgaagctggcgggtgt

SEQ ID NO: 224573 - DNA, 75 bp, Artificial Sequence
  Synthetic
gctcctaacaaaacactctaataaaatgagggaattgtcaattagcttgtagccatcaggtatgataagtggtag

SEQ ID NO: 224574 - DNA, 75 bp, Artificial Sequence
  Synthetic
tcctggacacacaactccggactctattaatattgtttcaacagatctgtcgtcatagttgtgtgtacagccact

SEQ ID NO: 224575 - DNA, 75 bp, Artificial Sequence
  Synthetic
tttgtctgcactgtctatttctatacaacgagacagcagcttaagcccttcaatcaacaccattctgggctctct

SEQ ID NO: 224576 - DNA, 75 bp, Artificial Sequence
  Synthetic
ttgtcccaggaagttaagcttttgttttgataacctctcatcctgctctatgtagttcaggcataattctcttaa

SEQ ID NO: 224577 - DNA, 75 bp, Artificial Sequence
  Synthetic
gttcaggcataattctcttaattctgaaatagtctcatccattgcgcatcaaaaaagcctaggatccccggtgcg

SEQ ID NO: 224578 - DNA, 75 bp, Artificial Sequence
  Synthetic
cactgcttgctaactttgacccacagaatgggtcagattgtgacaatgtttgaggccttgcctcacattattgac

SEQ ID NO: 224579 - DNA, 75 bp, Artificial Sequence
  Synthetic
gaggtgatcaacatcgtcatcattgtgctcattataatcacgagcatcaaagctgtctacaactttgctacctgc

SEQ ID NO: 224580 - DNA, 75 bp, Artificial Sequence
  Synthetic
ggggtatttgcattgatcagtttcctcctattagctggcagatcttgtggcatgtacggtctcgaagggcccgac

SEQ ID NO: 224581 - DNA, 75 bp, Artificial Sequence
  Synthetic
atttacaaaggagtttatcaattcaagtcagtggaatttgacatgtcacacttgaacctgacgatgcccaacgca

SEQ ID NO: 224582 - DNA, 75 bp, Artificial Sequence
  Synthetic
tgttcagccaacaactctcaccattacattagtatgggaagttcaggattggagttgaccttcactaatgaatcc

SEQ ID NO: 224583 - DNA, 75 bp, Artificial Sequence
  Synthetic
atcatcagccacaatcattgcaacctgacatctgccttcaataagaagacctttgaccacacgctcatgagcata

SEQ ID NO: 224584 - DNA, 75 bp, Artificial Sequence
  Synthetic
gtctcaagtctgcacctcagtatcagaggaaacaccaattataaagcagtgtcttgtgatttcaacaatggcatc

SEQ ID NO: 224585 - DNA, 75 bp, Artificial Sequence
  Synthetic
accattcaatacaatctaacattctcagatgcgcagagtgctctaagccagtgtagaactttcagaggcagagtc

SEQ ID NO: 224586 - DNA, 75 bp, Artificial Sequence
  Synthetic
ctggacatgtttaggactgctttcggcggaaagtacatgagaagtggctggggctggacaggttctgatggcaaa

SEQ ID NO: 224587 - DNA, 75 bp, Artificial Sequence
  Synthetic
accacctggtgcagtcaaacaaattaccaatacttaatcatacaaaacagaacttgggaaaaccattgtgaatat

SEQ ID NO: 224588 - DNA, 75 bp, Artificial Sequence
  Synthetic
gcaggcccttttggtatgtccagaatcctttttgctcaagagaagacaaagtttctcactaggaggcttgcaggc

SEQ ID NO: 224589 - DNA, 75 bp, Artificial Sequence
  Synthetic
acattcacttggactttgtcggactcctcaggaacagagaacccaggtggttactgcctgaccaagtggatgatc

SEQ ID NO: 224590 - DNA, 75 bp, Artificial Sequence
  Synthetic
cttgctgcagaactcaagtgttttggaaatacagctgttgcaaaatgcaatgtgaatcatgatgaagagttctgt

SEQ ID NO: 224591 - DNA, 75 bp, Artificial Sequence
  Synthetic
gacatgctgcgattgattgactacaacaaggctgctctgagtaagttcaaggaagatgtggagtctgccttgcac

SEQ ID NO: 224592 - DNA, 75 bp, Artificial Sequence
  Synthetic
ctgttcaaaacaactgtcaattctctgatctctgaccaactgttgatgagaaatcacctcagggacttaatgggg

SEQ ID NO: 224593 - DNA, 75 bp, Artificial Sequence
  Synthetic
gtgccatactgcaactattcaaaattctggtatttggagcatgcaaagactggtgagactagtgtccctaagtgc

SEQ ID NO: 224594 - DNA, 75 bp, Artificial Sequence
  Synthetic
tggcttgttactaatggttcttatttaaatgagactcattttagtgatcaaattgagcaggaagcagacaacatg

SEQ ID NO: 224595 - DNA, 75 bp, Artificial Sequence
  Synthetic
ataacagagatgctgaggaaggattacataaagaggcagggaagcacccccctagcattgatggatcttttgatg

SEQ ID NO: 224596 - DNA, 75 bp, Artificial Sequence
  Synthetic
ttctccacatcagcatatttggttagcattttcctgcaccttgttaagatcccaacacatagacacataaaaggt

SEQ ID NO: 224597 - DNA, 75 bp, Artificial Sequence
  Synthetic
ggcacatgtccaaagccacaccgtctaactagcaaagggatttgtagttgcggtgcattcaaggtgcctggtgta

SEQ ID NO: 224598 - DNA, 75 bp, Artificial Sequence
  Synthetic
aagactgtttggaagagacgctgaacaacagcgcctccctgactctccacctcgaaggaggtggagagtcaggga

SEQ ID NO: 224599 - DNA, 75 bp, Artificial Sequence
  Synthetic
ggcccagagggtcttatagggtcaccacatttggacctctaaaaatcagatcatgcggcaggatgttgtgaacag

SEQ ID NO: 224600 - DNA, 75 bp, Artificial Sequence
  Synthetic
tttttaagtcagggagccttgctttggaagcactctcaaagattatgcagtccataagtgcgcagtgtggggtga

SEQ ID NO: 224601 - DNA, 75 bp, Artificial Sequence
  Synthetic
cttctttcttctttttgtcccttactatcccagtatgcattttacatagccatccatatttgtcccacaccttgt

SEQ ID NO: 224602 - DNA, 75 bp, Artificial Sequence
  Synthetic
cctcatactcccgtgaagcttctttggtcatttcaacatcaataagctttatgtcccttctattctgtgaatcca

SEQ ID NO: 224603 - DNA, 75 bp, Artificial Sequence
  Synthetic
atagctttcttatgtcatcagagccttgacaacttaggaccattccctgtggaagagcacctataactgatgaag

SEQ ID NO: 224604 - DNA, 75 bp, Artificial Sequence
  Synthetic
tcagcccaggttgcgcattaaagagatcagcaaggtccataccgtgcgaatacttagaatcttgcttgaattgct

SEQ ID NO: 224605 - DNA, 75 bp, Artificial Sequence
  Synthetic
tttgatcagtaggctctctgtaaaagtgtatgaactgtccattctgtggctgaaatattgctatctccactggat

SEQ ID NO: 224606 - DNA, 75 bp, Artificial Sequence
  Synthetic
cattgaatctgccttctatgtcaatccatgtaggggtgttaggatcaattcctcccatgaggtccttcagcaaca

SEQ ID NO: 224607 - DNA, 75 bp, Artificial Sequence
  Synthetic
ttgtctgactgtaactcaagcccacttgaggtgggcctgctgctccgggcactggtctaggtgagttggccatag

SEQ ID NO: 224608 - DNA, 75 bp, Artificial Sequence
  Synthetic
gcttctcacttgttagatcaattgttgtgttctcccatgctctccccacaactgatgttctacaggctatgtatg

SEQ ID NO: 224609 - DNA, 75 bp, Artificial Sequence
  Synthetic
gccaaccctcacccgagagacaaactttgtagaggatattttcataaggatttctatctccgacttggtctgaga

SEQ ID NO: 224610 - DNA, 75 bp, Artificial Sequence
  Synthetic
caaacatattaagttttttctttgccccaaggactgcctttaaaagatcttcactgttgcttggtttaattaaga

SEQ ID NO: 224611 - DNA, 75 bp, Artificial Sequence
  Synthetic
tggactccagcatgttgcccccatctagcagagctgcccctgcttttacagcagcaccaaggctaaaattgtagc

SEQ ID NO: 224612 - DNA, 75 bp, Artificial Sequence
  Synthetic
cagaaatgttgatgctagactgttgttcagtgatgattcccaaaactgggtgcttgtctttcagcctttcaaggt

SEQ ID NO: 224613 - DNA, 75 bp, Artificial Sequence
  Synthetic
cgttgagattaggatatttgactgtgtaaagcaaaccaagatctgtaagagcttgcacaacgtcattgagtggag

SEQ ID NO: 224614 - DNA, 75 bp, Artificial Sequence
  Synthetic
tttgtgactgtttagccatacaggccattgttaggctcggcattgtgccgaactggttgttcaaaagagatgagt

SEQ ID NO: 224615 - DNA, 75 bp, Artificial Sequence
  Synthetic
ccttcacatcccacactctcactacaccacttgcaccctgctggggttttctcatcccaaccatctgcagaatct

SEQ ID NO: 224616 - DNA, 75 bp, Artificial Sequence
  Synthetic
gagacctttggtcaagttgttgtgcagttaggtttcccatgtagacaccagaagcctgaggcctttcagatctca

SEQ ID NO: 224617 - DNA, 75 bp, Artificial Sequence
  Synthetic
tgattttggccttcagtttctcaagatcagctgcgagagacatcaactcctctgcactgagcctccctactttca

SEQ ID NO: 224618 - DNA, 75 bp, Artificial Sequence
  Synthetic
aaacattcttttttgatgttgatttcaagtccacaagagaatacacagtctggttgagacttctgagtctctgca

SEQ ID NO: 224619 - DNA, 75 bp, Artificial Sequence
  Synthetic
ggtctttgtcatccctcttttccttcctcattatcctttgaacattgctaacttcagaaaagtctagtccattta

SEQ ID NO: 224620 - DNA, 75 bp, Artificial Sequence
  Synthetic
aaagactagttgcatccttgatgacagcagctttcacgtctgatgtgaagctctgtaactccctccttaacgcct

SEQ ID NO: 224621 - DNA, 75 bp, Artificial Sequence
  Synthetic
gtgtccattgaaagctcttgacttccttggacagagacatgttgttgctcaatgatatcccaaaacaaatgcgca

SEQ ID NO: 224622 - DNA, 75 bp, Artificial Sequence
  Synthetic
tggacagagacatgttgttgctcaatgatatcccaaaacaaatgcgcaatcaaatgcctaggatcctcggtgcga

SEQ ID NO: 224623 - DNA, 75 bp, Artificial Sequence
  Synthetic
ggatcctaggcgtttagttgcgctatttagttgcacaactgttctctgtgaaaccatcgagcacagctcaagcta

SEQ ID NO: 224624 - DNA, 75 bp, Artificial Sequence
  Synthetic
acaaccatgggtcagggcaagtccaaagagaaaagggaacctagcagtgtgggcagagctgagattctaccagac

SEQ ID NO: 224625 - DNA, 75 bp, Artificial Sequence
  Synthetic
gccacctatcttggcccactaaactgtaagtcatgttggcaaaggttcgacagcttggttaaatgttatgatcac

SEQ ID NO: 224626 - DNA, 75 bp, Artificial Sequence
  Synthetic
tacctttgcagacattgtttgaatctcctactgtcagtttcagacaggtgccctctttgcaagcacccactacca

SEQ ID NO: 224627 - DNA, 75 bp, Artificial Sequence
  Synthetic
accaaattgaaaatatcaactgccccaagctcaccacctccctacgaggagtgacaccccaggctccagcatcaa

SEQ ID NO: 224628 - DNA, 75 bp, Artificial Sequence
  Synthetic
caggcagcccaacacaaagaaccacacacaggccaccacacacaaacacagcatccacgacaaaacacacacccg

SEQ ID NO: 224629 - DNA, 75 bp, Artificial Sequence
  Synthetic
cacacacacgcacacacacccacacccacgcgcccccacgctggggggcgccccccggggggctgccccccggga

SEQ ID NO: 224630 - DNA, 75 bp, Artificial Sequence
  Synthetic
cccgacggggcccacagagacagccatcagtcaatctcctcggtctcctgcccagtcaaccagtcatcacaagac

SEQ ID NO: 224631 - DNA, 75 bp, Artificial Sequence
  Synthetic
tttcccttgagcctgaacctgccccctgctgtttcgtacattaccgtgttctttgatttactaaaacagagcctg

SEQ ID NO: 224632 - DNA, 75 bp, Artificial Sequence
  Synthetic
cagtccttaaaagtgaaccagtctggcacgagcgacaatggtaccagtaaaacagatctttccatacccagctcc

SEQ ID NO: 224633 - DNA, 75 bp, Artificial Sequence
  Synthetic
tgaagagtaacgcctatctccgatcccggcaggtgttcaccagttcggaatctgtgtagaaagaagctgccgaga

SEQ ID NO: 224634 - DNA, 75 bp, Artificial Sequence
  Synthetic
acatcaccagccctcccatagccttcgagctccgccaaaaaaatcctcatgtccttagtttctaatcttacaagg

SEQ ID NO: 224635 - DNA, 75 bp, Artificial Sequence
  Synthetic
atattctgaacaaagtttctcccttcaaaaagagcacccatcctcacagttagaggtacaggctcccactcaggt

SEQ ID NO: 224636 - DNA, 75 bp, Artificial Sequence
  Synthetic
ccgactctctcaaaacaaagggatgtaattccatccaatatctttctagagcccatcaattcaagatcaaggtgg

SEQ ID NO: 224637 - DNA, 75 bp, Artificial Sequence
  Synthetic
tcaccaagtatcagggggtcctccatataatcctcaaattcttcagacctaatgtcaaaggtgccatcatttgtt

SEQ ID NO: 224638 - DNA, 75 bp, Artificial Sequence
  Synthetic
ttgaagataggatctgttcttaataaatggagacactcatctaatagccttctatccactccacccttaaaaaag

SEQ ID NO: 224639 - DNA, 75 bp, Artificial Sequence
  Synthetic
taggaacacgacaaaaactctgccacaccaggactctgcagttggcacttcaccaagaggatcaatgaaaatctc

SEQ ID NO: 224640 - DNA, 75 bp, Artificial Sequence
  Synthetic
ctcaaacaatcagtgttgttctgattgtgcgtgaaatccactgttattgaaaattctagcactcctttcgtgttg

SEQ ID NO: 224641 - DNA, 75 bp, Artificial Sequence
  Synthetic
ttgagcatgtagtcccataaatcactcaaggatccaaatgcactcgggtttgttagaccctgcttgatcagcaaa

SEQ ID NO: 224642 - DNA, 75 bp, Artificial Sequence
  Synthetic
gcagcattgcacacaatatcccctattcgataagaaaaccatccaaaaccaaattgtaaatcattcctgaacata

SEQ ID NO: 224643 - DNA, 75 bp, Artificial Sequence
  Synthetic
ggtctctctatgtttttgttcaccacttttaagacgaatgactgaaaaggcccaagtgcttcagcaccatcctct

SEQ ID NO: 224644 - DNA, 75 bp, Artificial Sequence
  Synthetic
gatggcatcatgtctttatgaggaaaccatgaaaaattacccaaggtcctggttgttgccacaaactctcgaaca

SEQ ID NO: 224645 - DNA, 75 bp, Artificial Sequence
  Synthetic
aatgattcaaaatacacctgttttaaaaagtttttacaaacatcccttgtgctaacaacaaattcgtcaactaga

SEQ ID NO: 224646 - DNA, 75 bp, Artificial Sequence
  Synthetic
cttgagtcagatcgttgatgagaactggcgagatcagaaaataagacagtgtaatgttcatctctcttccacttg

SEQ ID NO: 224647 - DNA, 75 bp, Artificial Sequence
  Synthetic
acaacgtgagaaatgagtgacaaggattctgaattgatgtcaatcaacacacaaagatcaagaaatttaattcta

SEQ ID NO: 224648 - DNA, 75 bp, Artificial Sequence
  Synthetic
gggctccatctcatattttttgagctcaaatcagacatgaatggaagtagctgatcttcaaaaattttaggatac

SEQ ID NO: 224649 - DNA, 75 bp, Artificial Sequence
  Synthetic
aaccttctcacagattgaatcacatggtttaaactcactttgtcctccagtaaccttgagctctcaggctttctt

SEQ ID NO: 224650 - DNA, 75 bp, Artificial Sequence
  Synthetic
gctatataatcacatgggttgaggtgcttaaggcccgtgttcacatgcttctttccttccaaaggttctgccagg

SEQ ID NO: 224651 - DNA, 75 bp, Artificial Sequence
  Synthetic
acccaaacacccaactcaaaggaattgctcaatgaaatgcaaatgtagtcccatagaagaggccttaaaagagtg

SEQ ID NO: 224652 - DNA, 75 bp, Artificial Sequence
  Synthetic
acatgatcagattgagccttaggatgattcaacctatcacaaatgtataacattatgccatcttgtttttgtact

SEQ ID NO: 224653 - DNA, 75 bp, Artificial Sequence
  Synthetic
cttgtcacataatcatccatagccagatcctcaagcaacttttttatgtataagttttctttatttttattcctc

SEQ ID NO: 224654 - DNA, 75 bp, Artificial Sequence
  Synthetic
acacacctgcttcccagagtcttacagaggcctatgaagccagatgaaatgcagctttgaaaagctgatttattg

SEQ ID NO: 224655 - DNA, 75 bp, Artificial Sequence
  Synthetic
attgcctctgataataacttctgtgctccccttgtgaacttactgcaaagcttattctgaagtgtcttaattaat

SEQ ID NO: 224656 - DNA, 75 bp, Artificial Sequence
  Synthetic
gaagggattctttcttcctgaaaagttatcgccgatggataaaccactttctgcctcaaaaccatccttaatggg

SEQ ID NO: 224657 - DNA, 75 bp, Artificial Sequence
  Synthetic
aacatctcatttaagttcaaccaattgatatctgccaactgacccaaatcttcttcaagtccaaggatatctccc

SEQ ID NO: 224658 - DNA, 75 bp, Artificial Sequence
  Synthetic
agttgtaaaatagcatctttcttttctctgttaaagaggtctaaaaagaattcctcattaaattcaccattctta

SEQ ID NO: 224659 - DNA, 75 bp, Artificial Sequence
  Synthetic
agtttatgatgcaatttcctcacaagcttcctcatgacctttgtttcatcaggacatagtccttcaataagtctt

SEQ ID NO: 224660 - DNA, 75 bp, Artificial Sequence
  Synthetic
tggattctataacccctggaaccatctaaccaatcctttacatcagtggtggtgttcagtaaaaatgggtccaga

SEQ ID NO: 224661 - DNA, 75 bp, Artificial Sequence
  Synthetic
gggaagttggcatacttcaagagatctagtgtcctcctttgaatacagtttaccaaagatatcgggacaccattt

SEQ ID NO: 224662 - DNA, 75 bp, Artificial Sequence
  Synthetic
gcaacagcttgatcagcaattgtgtctattgtctcacaaagttgatgtggttctttacacttaacattatgtaac

SEQ ID NO: 224663 - DNA, 75 bp, Artificial Sequence
  Synthetic
gctgcagatacaaactttgtgagcagaggaacctcctccccccacacataaaatctagatttaaattctgcagca

SEQ ID NO: 224664 - DNA, 75 bp, Artificial Sequence
  Synthetic
aaccgccccaccacactttttgggctaataaatttattcaataagctacttaagtgagaatgaaattccaacaaa

SEQ ID NO: 224665 - DNA, 75 bp, Artificial Sequence
  Synthetic
acaagaacctcttctgggtcactatcaaccagctcactcaaccttctatcaaacaaagtgatttgatcatcactt

SEQ ID NO: 224666 - DNA, 75 bp, Artificial Sequence
  Synthetic
gatgtgtaagcttctggtctctcaccaaaaataacaccaatgcagtagttaatgaatctttcactaattaagcca

SEQ ID NO: 224667 - DNA, 75 bp, Artificial Sequence
  Synthetic
tagaaatcagaggcattgtgaaggattccctgtcccatgtcaataagactggatatgtgggatggcactatcccc

SEQ ID NO: 224668 - DNA, 75 bp, Artificial Sequence
  Synthetic
agctcaaagtattctctaaaaattctttccgtgacagttgtctctgaacccctgagaagctttaattttgattta

SEQ ID NO: 224669 - DNA, 75 bp, Artificial Sequence
  Synthetic
acatatgacttcatcattgcattcacaacaggaaaaggaacttcaacaagcttgtgcatatgccaggttaataag

SEQ ID NO: 224670 - DNA, 75 bp, Artificial Sequence
  Synthetic
gtgctgacatgatctttcccagaacgtatatattggtcatcacccagcttgaggttctggaggagcatcaaaaac

SEQ ID NO: 224671 - DNA, 75 bp, Artificial Sequence
  Synthetic
aagaatgggcacatcattggtccccatttactatgatccatactatagtttaaaaacccttctcgcacattaata

SEQ ID NO: 224672 - DNA, 75 bp, Artificial Sequence
  Synthetic
gtcattgacaaaattgcattttcaaattctttatcattgtttaagcaagaacctgaaaagaaactagaaaaggat

SEQ ID NO: 224673 - DNA, 75 bp, Artificial Sequence
  Synthetic
tcaaagtaatcctctatcagtcttgtgaacatttttgttcttaaatctccaatataaagttccctatttcctcca

SEQ ID NO: 224674 - DNA, 75 bp, Artificial Sequence
  Synthetic
acctgttctttgtacgacagtgcaaatttcaatctaccagaatctggacccaccgaagtgtatgatgttggtgac

SEQ ID NO: 224675 - DNA, 75 bp, Artificial Sequence
  Synthetic
tcctctgagtaaaagcacagattttttaaagcagcactcatacactttgtcaacgacaaggctttgctcagggac

SEQ ID NO: 224676 - DNA, 75 bp, Artificial Sequence
  Synthetic
tcagagttactttccctctcactaattctcacatcttcttctaacttaccccagtcaaacttgaagtttaaacct

SEQ ID NO: 224677 - DNA, 75 bp, Artificial Sequence
  Synthetic
tgcctttgcatgtgcctgtacttccctgaatatgcattcgcattcatttgtaggagaatcattttcatgcatgaa

SEQ ID NO: 224678 - DNA, 75 bp, Artificial Sequence
  Synthetic
aaccaatcaccctctgaaaaaaacttcctgcaaaggttcatcgccatctcgtctagaccacattgttctttaacg

SEQ ID NO: 224679 - DNA, 75 bp, Artificial Sequence
  Synthetic
gctgacgtgaagtacaatggggacaattctgcagagctctcaacagcctcacacacaaacttcatgtcatcattg

SEQ ID NO: 224680 - DNA, 75 bp, Artificial Sequence
  Synthetic
gtaagacaagatggatcaaagtcttccactaaatggaaggatatttctgataaaataaccttccttaaatgagcc

SEQ ID NO: 224681 - DNA, 75 bp, Artificial Sequence
  Synthetic
attctccctgataaaacagtctgaaggtgatgtaatcctttcacatttttgaggtctttctcatcatctccctca

SEQ ID NO: 224682 - DNA, 75 bp, Artificial Sequence
  Synthetic
ttaactttcctatttctcttataatttgttattgtggagttaaccttgtcctccaaatttttgaagaaacttgtt

SEQ ID NO: 224683 - DNA, 75 bp, Artificial Sequence
  Synthetic
tcctcctctccttcaaaacatatatttgctgggtcatctcccaacttcccagtttccattcccttggagtctata

SEQ ID NO: 224684 - DNA, 75 bp, Artificial Sequence
  Synthetic
accaatctagaaattagctttgagaccttatattcataatctgagtggcttagcttgtatttttgttttctcaca

SEQ ID NO: 224685 - DNA, 75 bp, Artificial Sequence
  Synthetic
aaaccttccgtgatctggctcacagcactaacaagcaatttgttgaagtcatattctaaaagtcgttctccattt

SEQ ID NO: 224686 - DNA, 75 bp, Artificial Sequence
  Synthetic
aaatgcttattaacaaccacacttttgttgctagcaagatccaatgccgttgcacatccagagttggtcatagga

SEQ ID NO: 224687 - DNA, 75 bp, Artificial Sequence
  Synthetic
tctagactgctcaacctcttctcccctttaaaaatcagagtgccattgttgaatgaagataccatcaaactaaaa

SEQ ID NO: 224688 - DNA, 75 bp, Artificial Sequence
  Synthetic
acttccaaattgacacctggagttgtgagctgacaatccagctctttgctggtgaacttcctcatttgttcatga

SEQ ID NO: 224689 - DNA, 75 bp, Artificial Sequence
  Synthetic
aagacactttcttcttcaggtgtgattgcttccttagggttgacaaaaaaaccgaactgacttttaggctcaaag

SEQ ID NO: 224690 - DNA, 75 bp, Artificial Sequence
  Synthetic
aatttttcaaaacattttatctgatctgtcagcctatcaggagtctcctttgtgattaagtggcacatgtacgac

SEQ ID NO: 224691 - DNA, 75 bp, Artificial Sequence
  Synthetic
acattcagcatgaacttgaattttgcactcaacaacaccttctcaccagtgccgaaagttgttttaattaggaat

SEQ ID NO: 224692 - DNA, 75 bp, Artificial Sequence
  Synthetic
ctaagcaacttgtacactattttctcagcaggtgtgatcaagtcttccttcaatttgtccatcagtgatgtagat

SEQ ID NO: 224693 - DNA, 75 bp, Artificial Sequence
  Synthetic
gaaaagtctgagacaatagccattactagatacctgatgttctgaacctgcttctgatttctctttgttgggttg

SEQ ID NO: 224694 - DNA, 75 bp, Artificial Sequence
  Synthetic
gtgagtattaataacaacagagtccttaatgcagtttcaatgtcaacaagactatctttcaaatcgggacacgat

SEQ ID NO: 224695 - DNA, 75 bp, Artificial Sequence
  Synthetic
ctaatccacgacatcatggtatcaatcatattatgcagcacttcatctgaaaaaattggtagaaagaacctcttt

SEQ ID NO: 224696 - DNA, 75 bp, Artificial Sequence
  Synthetic
ggatctgcgtaaaaggaaatcaggtgaccatctggaccctgtatagaatagcacctagaagattctccagtcttc

SEQ ID NO: 224697 - DNA, 75 bp, Artificial Sequence
  Synthetic
tgatatagtaaatgatactcctcagaatctagtttcatcacttggcaaaacacctctttgcactccaccacttga

SEQ ID NO: 224698 - DNA, 75 bp, Artificial Sequence
  Synthetic
tacctcacagaacctagctgattttgcctcagtcttgccactgagcttgttttcatactgtttgttaaagctaga

SEQ ID NO: 224699 - DNA, 75 bp, Artificial Sequence
  Synthetic
caaacagatgacaaccttttcagactctgtacacccctcaattgttctgtgtcaggttgaaagttgtaatcttca

SEQ ID NO: 224700 - DNA, 75 bp, Artificial Sequence
  Synthetic
aattttgtatagtgcatcactgggtgagttccaatttttgtaaaactctcaaactcattgtatgttatgtagcac

SEQ ID NO: 224701 - DNA, 75 bp, Artificial Sequence
  Synthetic
tcatgagcaaggtgtttggataatccatagtgctcaaaagtaagccccaccattgacaaacatttctgaattttc

SEQ ID NO: 224702 - DNA, 75 bp, Artificial Sequence
  Synthetic
acaatgaattcatctatagacagcctaaacaactcatctagagaaagcttcttgtacatttttgaccttcttctg

SEQ ID NO: 224703 - DNA, 75 bp, Artificial Sequence
  Synthetic
tttctcaaaagcttaataaattcctccttagtactgtgaaagctcactaacctatcatttacactgctataacaa

SEQ ID NO: 224704 - DNA, 75 bp, Artificial Sequence
  Synthetic
caacctaaccagtgtttgtcattcttcaacttttttgcttttgactgtttgattagtgaagaaagacacaagaca

SEQ ID NO: 224705 - DNA, 75 bp, Artificial Sequence
  Synthetic
tctaagttcaatagttgtcttcttctagtgtttaacaactttaagctcttaaccttgtttaacatggagaggagt

SEQ ID NO: 224706 - DNA, 75 bp, Artificial Sequence
  Synthetic
ctttcataatcagtgctagctccattttctctcttgaatccatgggtttctgctgtaatgaatctcattaaggga

SEQ ID NO: 224707 - DNA, 75 bp, Artificial Sequence
  Synthetic
caggactcaactgcctctctacttaatgttgagacatcgtcattgtcagcaagggtctcataaagctcagagaat

SEQ ID NO: 224708 - DNA, 75 bp, Artificial Sequence
  Synthetic
tctctgatcagaacttcaggttttatcctctgaaattttctttctaatttcccacattctagatctcttctgaat

SEQ ID NO: 224709 - DNA, 75 bp, Artificial Sequence
  Synthetic
ctaccaaaaagagaatttatgccaaagaccacgtcatcacaactcatattggggttaacaccatcgtgacacatt

SEQ ID NO: 224710 - DNA, 75 bp, Artificial Sequence
  Synthetic
ttcatgatttcatcattatgagctgatctcatgtctttcaaaattctcatagagtccattccagaacgtttatca

SEQ ID NO: 224711 - DNA, 75 bp, Artificial Sequence
  Synthetic
acagtggtctttaaagactcacaaagtctaaaatactcagactcttcaaaaactttttcatcctgactggaatat

SEQ ID NO: 224712 - DNA, 75 bp, Artificial Sequence
  Synthetic
tccaaaagcttaaacaaaaggtctctaaacttgaaattcacccactctggcataaaactattttcatagtcacaa

SEQ ID NO: 224713 - DNA, 75 bp, Artificial Sequence
  Synthetic
cggccatcaactattggaaccagtgtgatgcctgcaacagcaagatcctctttaatacaggctagtttgttggtg

SEQ ID NO: 224714 - DNA, 75 bp, Artificial Sequence
  Synthetic
tcttctatgaacttcctttcaaagctagctggtgtgctcctaacaaaacattcaagtagaatgagggtattgtca

SEQ ID NO: 224715 - DNA, 75 bp, Artificial Sequence
  Synthetic
atcagcttgtacccatcaggaatgatgagcggcaaccctggacacacgattccagactctatcagaatcgcttca

SEQ ID NO: 224716 - DNA, 75 bp, Artificial Sequence
  Synthetic
acagatttatcgtcatgattgtgtgtgcagccactcttgtctgcactgtccatttctatacagcgtgataacagt

SEQ ID NO: 224717 - DNA, 75 bp, Artificial Sequence
  Synthetic
ttaagcccctcaatcaacaccattctgggctctctctgccctaggaaattgagtttttgccttgacagtctctca

SEQ ID NO: 224718 - DNA, 75 bp, Artificial Sequence
  Synthetic
tcctgttctatatagttcagacacagttttctcaactcagaaatagtttcatccattgcgcattaaaaaagccta

SEQ ID NO: 224719 - DNA, 75 bp, Artificial Sequence
  Synthetic
gttctatatagttcagacacagttttctcaactcagaaatagtttcatccattgcgcattaaaaaagcctaggac

SEQ ID NO: 224720 - DNA, 75 bp, Artificial Sequence
  Synthetic
ggatcctaggctttttggattgcgccatttaagagaccattaaagggtcgtatgggtcaaattgtgacacttgtt

SEQ ID NO: 224721 - DNA, 75 bp, Artificial Sequence
  Synthetic
gaggctctgcctcatgtgatagacgaagccattaacattgcaatcatagctttaataatcatcacaggtgtcaaa

SEQ ID NO: 224722 - DNA, 75 bp, Artificial Sequence
  Synthetic
gctgtgtacaactttgccacctgtggtatcattgcactagttggcttcctcctcttggctggcagatcttgtggc

SEQ ID NO: 224723 - DNA, 75 bp, Artificial Sequence
  Synthetic
ttggccaccattgtcaacaccaacctctacaaagggctttacgagttcaaaagcctggaattcaacttgtctcac

SEQ ID NO: 224724 - DNA, 75 bp, Artificial Sequence
  Synthetic
ttaaatttgacaatgcctaatgcatgttctttaaataattctcaccattatatcaacatgggcaagtccggtctg

SEQ ID NO: 224725 - DNA, 75 bp, Artificial Sequence
  Synthetic
gaactcacattcacaaataactcaattctcacacaccaacaatgtaacctcactgatgccttcaaaagaaacacc

SEQ ID NO: 224726 - DNA, 75 bp, Artificial Sequence
  Synthetic
tttgatcacaccattatgagcataataagtagtctacatctcagtgttagaggccatactgagtatagagctgtg

SEQ ID NO: 224727 - DNA, 75 bp, Artificial Sequence
  Synthetic
tcatgcgattttaataatgggatcaccattcagtacaatttgacatttcacagttcaaatgaggtcatcaatgag

SEQ ID NO: 224728 - DNA, 75 bp, Artificial Sequence
  Synthetic
tgcaggacttttagaggaagagttttggatatgttcaggacagcctttggcggaaagtatatgagaagtcacgtg

SEQ ID NO: 224729 - DNA, 75 bp, Artificial Sequence
  Synthetic
gggtggacagacggccagggtaaaacaacttggtgtagtcaaacggattacaattatctaatcatacaaaatcgg

SEQ ID NO: 224730 - DNA, 75 bp, Artificial Sequence
  Synthetic
acatgggagaatcattgtgaatatgcaagtccatttgggttttcgagaatccttcttgctcaggaaaaaacaaaa

SEQ ID NO: 224731 - DNA, 75 bp, Artificial Sequence
  Synthetic
ttcataacaagaagacttgcagggacattcacctggaccttgtcagattcttctggaaccgaaaaccctggtggt

SEQ ID NO: 224732 - DNA, 75 bp, Artificial Sequence
  Synthetic
tattgtctcacaaggtggatgctaatcgctgcagatctcaagtgcttcggtaacacagcaattgcaaaatgcaac

SEQ ID NO: 224733 - DNA, 75 bp, Artificial Sequence
  Synthetic
cttaaccatgaggaggaattttgtgacatgctcagattaatagactataataaggcagccttgcacaaattcaaa

SEQ ID NO: 224734 - DNA, 75 bp, Artificial Sequence
  Synthetic
gaggatgttgagtctgctctgcatctgtttaagatgacaattaactcattgatttcagatcaactgcttatgaga

SEQ ID NO: 224735 - DNA, 75 bp, Artificial Sequence
  Synthetic
aatcacttgagagacttgatgggggtgccttattgtaattactcaagattctggtatttacagcatagtaagaca

SEQ ID NO: 224736 - DNA, 75 bp, Artificial Sequence
  Synthetic
aatgagacaagcacacctaaatgctggctcgtgaccaatggaacttatttgaatgagactcacttcagtgatcaa

SEQ ID NO: 224737 - DNA, 75 bp, Artificial Sequence
  Synthetic
attgaacaagaagcagacaacatgatcacagagatgctcaggaaggactattttaaaaggcaaggagccactccc

SEQ ID NO: 224738 - DNA, 75 bp, Artificial Sequence
  Synthetic
ttagcattggtagacatattaatgtttacaacatcagcctatttgatcactgtcttcttgcatctaatgagaata

SEQ ID NO: 224739 - DNA, 75 bp, Artificial Sequence
  Synthetic
ccaacacacagacatgtgaagggaggctcttgcccaaaaccacatcgattgactagtatgggaatctgtgcctgt

SEQ ID NO: 224740 - DNA, 75 bp, Artificial Sequence
  Synthetic
ggtgcatttaagacaccaggagtgaaaacggtatggaagagacggtgagctgcaccgcctccctgactctccacc

SEQ ID NO: 224741 - DNA, 75 bp, Artificial Sequence
  Synthetic
tcaatgaggtggagagtcagggaggctccctggggagactcagagtaccactgtgttcggacctctaaagatcag

SEQ ID NO: 224742 - DNA, 75 bp, Artificial Sequence
  Synthetic
atcatgtggcaggatgttgtggattgatttcaagtccggcaacctagcttttgaggcactctcaaagatgatgca

SEQ ID NO: 224743 - DNA, 75 bp, Artificial Sequence
  Synthetic
atccatgagagcacaatgaggggtgatttccttctttttcttgtcccttactattccggtgtgcatcttgcacaa

SEQ ID NO: 224744 - DNA, 75 bp, Artificial Sequence
  Synthetic
ccagccatatttgtcccacactctatcttcatattctcttgatgtttctttgctcatttctatgtctattaactt

SEQ ID NO: 224745 - DNA, 75 bp, Artificial Sequence
  Synthetic
aatatctttcctattttgagactcaagaagccttcttatgtcatccgagccttggcaactaaggaccatcccctg

SEQ ID NO: 224746 - DNA, 75 bp, Artificial Sequence
  Synthetic
tgggagggcaccaattactgacgatgtcaggcctggctgaacattgaagaggtcggcaagatccatgccatgtga

SEQ ID NO: 224747 - DNA, 75 bp, Artificial Sequence
  Synthetic
gaactttgagtcttgtttgaattgtttttgatcaactggttctcgataaaagtggatgtattgtccagtctctgg

SEQ ID NO: 224748 - DNA, 75 bp, Artificial Sequence
  Synthetic
ttgaaatatggcaatttccacagggtcattgaacctgccttcaatgtcaatccaagtgggtgcattgggatcaat

SEQ ID NO: 224749 - DNA, 75 bp, Artificial Sequence
  Synthetic
tccgttcatcaaatccttcagcaacattgtttgactgtaacttagtcccacctgaggtggtcctgctgctcctgg

SEQ ID NO: 224750 - DNA, 75 bp, Artificial Sequence
  Synthetic
cactggtctggataaatgagctgccggcctgttgtcagataagtcaatgatggtgttttcccatgctctccccac

SEQ ID NO: 224751 - DNA, 75 bp, Artificial Sequence
  Synthetic
tatggatgacctgcaagctatgtatggccatccttcacctgataggcatactttgtataagatattctcataggg

SEQ ID NO: 224752 - DNA, 75 bp, Artificial Sequence
  Synthetic
attcctatcccccacttgatcggacacaaacatgttcaacttcttctttgcactaagaacagcttttaagagatc

SEQ ID NO: 224753 - DNA, 75 bp, Artificial Sequence
  Synthetic
ttcagtattgctgggtttgatgtaaattgactctagcatgttgcctccatccaacagtgcagcacctgccttcac

SEQ ID NO: 224754 - DNA, 75 bp, Artificial Sequence
  Synthetic
tgcagcactcaagctgagattgtagcctgaaatgttgatactggattgctgttctgttataacgcccagcacagg

SEQ ID NO: 224755 - DNA, 75 bp, Artificial Sequence
  Synthetic
gtgcttgtctttaagattctcaagatcagttaggtttgggtacttcactgtgtagagtaagcccaggtctgtgag

SEQ ID NO: 224756 - DNA, 75 bp, Artificial Sequence
  Synthetic
tgcttgcacaacatcattgagtggtgtttgtgactgtttagtcatgcaggccatagtgagacttggcatagtgcc

SEQ ID NO: 224757 - DNA, 75 bp, Artificial Sequence
  Synthetic
aaattgattgtttaaaagtgatgagtctttcacatcccaaactctcacgacaccattgttgccctgttgagggcg

SEQ ID NO: 224758 - DNA, 75 bp, Artificial Sequence
  Synthetic
tctcattccaaccatctgcagaatttgagatctttgatcaagctgctgagctgttaggttgcccatgtagacacc

SEQ ID NO: 224759 - DNA, 75 bp, Artificial Sequence
  Synthetic
agatgcccgtggcccctcagacctcattatcttggcctttaacttttctagatcagctgcaagagacattaactc

SEQ ID NO: 224760 - DNA, 75 bp, Artificial Sequence
  Synthetic
atcagtactcaacctccccaccttcagaacattcttctttggagttgattttagttctacaagagagtgaacagt

SEQ ID NO: 224761 - DNA, 75 bp, Artificial Sequence
  Synthetic
ttgattgaggcttcgaagtctttgcaagtccttgtcatcccttttatcttttctcatgattctttgaacgttgct

SEQ ID NO: 224762 - DNA, 75 bp, Artificial Sequence
  Synthetic
gacctcagagaagtctagtccattcaaaaggctcgttgcgtctttaatgacagcagcctttgtattggaggtgaa

SEQ ID NO: 224763 - DNA, 75 bp, Artificial Sequence
  Synthetic
gctctgcagctccctccttagcgcttgtgtccattgaaagcttttgacctccttggacaaagacatcttgttgta

SEQ ID NO: 224764 - DNA, 75 bp, Artificial Sequence
  Synthetic
atcttgttgtagagcactgtatcctaagacagactaacacaaaagcgcaatcaaatgcctaggatccactgtgcg

SEQ ID NO: 224765 - DNA, 75 bp, Artificial Sequence
  Synthetic
atcctgcgacttcaacaatggcataaccatccaatacaacttgacattctcagatcgacaaagtgctcagagcca

SEQ ID NO: 224766 - DNA, 75 bp, Artificial Sequence
  Synthetic
cttgctgcagagcttaagtgtttcgggaacacagcagttgcgaaatgcaatgtaaatcatgatgccgaattctgt

SEQ ID NO: 224767 - DNA, 75 bp, Artificial Sequence
  Synthetic
cgcaccggggatcctaggctttagattgcgccttccattgaggacttgtgggagtgagagccattcgccacactg

SEQ ID NO: 224768 - DNA, 75 bp, Artificial Sequence
  Synthetic
accatgggtcagatagtgacaatgttcgaggctctgcctcacatcattgatgaagtcatcaacattgtcatcatt

SEQ ID NO: 224769 - DNA, 75 bp, Artificial Sequence
  Synthetic
gtgcttgtcatcatcacaagcataaaggctgtctacaactttgccacgtgtggtctcatcacactgatcggcttt

SEQ ID NO: 224770 - DNA, 75 bp, Artificial Sequence
  Synthetic
ctcttccttgccggtagatcttgtggcatgtatggactctctggtccagacatttacaagggtgtttaccagttc

SEQ ID NO: 224771 - DNA, 75 bp, Artificial Sequence
  Synthetic
aagtctgtggaattcaacatgtcagtgctcaacttgacaatgcccaatgcttgctcagtcaacaactcccaccat

SEQ ID NO: 224772 - DNA, 75 bp, Artificial Sequence
  Synthetic
tatataagtatggggagttccgggctggagctcacatttaccaatgactcgatactctctcacaatttttgcaat

SEQ ID NO: 224773 - DNA, 75 bp, Artificial Sequence
  Synthetic
ctgactgacagtttcaaaaaaagttcgtttgaccacacattgatgagcatagtcacaagcctgcacctcagtatc

SEQ ID NO: 224774 - DNA, 75 bp, Artificial Sequence
  Synthetic
cgaggttttaacaattacaaggctgtgtcctgcgacttcaacaatggcatcaccatacagtacaatctctccttc

SEQ ID NO: 224775 - DNA, 75 bp, Artificial Sequence
  Synthetic
tctagagcagaggatgctatcagacagtgcagaactttcagaggtagagttctggatatgttcagaactgccttt

SEQ ID NO: 224776 - DNA, 75 bp, Artificial Sequence
  Synthetic
ggtggaaagcacatgaggagtggctatggttggaaagattctcaagggagaaccacttggtgcagtcaaactgat

SEQ ID NO: 224777 - DNA, 75 bp, Artificial Sequence
  Synthetic
taccaatatttgattattcaaaacaggacttgggagaaccattgtacgtatgcaggcccttttggtcttgccagg

SEQ ID NO: 224778 - DNA, 75 bp, Artificial Sequence
  Synthetic
gttctctttgctcaagagaaaacaaaatacctgacaagaagacttgcagggacatttacttggacactgtctgat

SEQ ID NO: 224779 - DNA, 75 bp, Artificial Sequence
  Synthetic
tcatcaggtacagagactcctggtggttactgtctaacacggtggatgatacttgctgcagatttgaaatgcttt

SEQ ID NO: 224780 - DNA, 75 bp, Artificial Sequence
  Synthetic
ggaaacactgctgttgccaaatgcaacatgaatcatgatgaggaattctgtgatgtgctcaggctgatagactac

SEQ ID NO: 224781 - DNA, 75 bp, Artificial Sequence
  Synthetic
aacaaggctgcactcaccaagttcaaagaggatgttgagtccgctcttcacctatttaaaactacggtaaactca

SEQ ID NO: 224782 - DNA, 75 bp, Artificial Sequence
  Synthetic
ctgatatctgaccagctgttgatgaggaaccatttgagggacttaatgggggtgccttactgcaactactctagg

SEQ ID NO: 224783 - DNA, 75 bp, Artificial Sequence
  Synthetic
ttttggtatttggagcatgcgaaaacaggtgagactagtgtcccgaagtgctggcttataactaacggctcatat

SEQ ID NO: 224784 - DNA, 75 bp, Artificial Sequence
  Synthetic
ctgaacgaaacacactttagtgatcagattgaacaagaagcagacaacatgatcacagacatgttaagaaaggac

SEQ ID NO: 224785 - DNA, 75 bp, Artificial Sequence
  Synthetic
tacataaaaaggcaagggagcacccctttagcactaatggatttgctaatgttcagcacatcagcttacttgatt

SEQ ID NO: 224786 - DNA, 75 bp, Artificial Sequence
  Synthetic
agcatcttcttacacctgctgaaaatccccacacacagacatataaaaggtggcacgtgccccaagccgcaccgc

SEQ ID NO: 224787 - DNA, 75 bp, Artificial Sequence
  Synthetic
ctgaccagcaaaggaatctgcagctgtggcgcatacaaagtaccaggagtgaagacggtttggaaaagacgctag

SEQ ID NO: 224788 - DNA, 75 bp, Artificial Sequence
  Synthetic
gctctggcgcctccctggctccccacctcgaaggaggtggggagccagggaggccctgagggtctttagagtgtc

SEQ ID NO: 224789 - DNA, 75 bp, Artificial Sequence
  Synthetic
actacattgggtcccctgaagactaagtcatgtggtaggatgttgtgaacggtcttcagttctggtagtctagct

SEQ ID NO: 224790 - DNA, 75 bp, Artificial Sequence
  Synthetic
tttgaagcactctcaaagataatgcagtccatgagagcacaatgtggggtgatctccttcttctttttgtctttg

SEQ ID NO: 224791 - DNA, 75 bp, Artificial Sequence
  Synthetic
actatcccagtgtgcatcttacaaagccaaccatacttgtcccagaccttgtcctcatactctcgagcagcttct

SEQ ID NO: 224792 - DNA, 75 bp, Artificial Sequence
  Synthetic
ttgctcatctccacatcaatcaacttaatatccctccgattctgagaatcaaggagttttctgatgtcatctgag

SEQ ID NO: 224793 - DNA, 75 bp, Artificial Sequence
  Synthetic
ccttgacagctcaagaccattccctgtggaagcgctccgatcaccgaagaagtcaaccctggttgcgcattaaaa

SEQ ID NO: 224794 - DNA, 75 bp, Artificial Sequence
  Synthetic
agatcagcaaggtccatgccatgagaatactttgagtcctgtttgaattgtttttggtcagttggctctctgtaa

SEQ ID NO: 224795 - DNA, 75 bp, Artificial Sequence
  Synthetic
aaatgcacaaactgcccatttcccggttgaaaaatagcaacttctacagggtcgttgaacctcccttcgatgtca

SEQ ID NO: 224796 - DNA, 75 bp, Artificial Sequence
  Synthetic
atccatgttggtgcatttgggtcaatcccactcattaggtccttcaaaagcatggtctgactgtaacttaggcca

SEQ ID NO: 224797 - DNA, 75 bp, Artificial Sequence
  Synthetic
acttggggtggtccagcagacccaggcactggccttggtgggttgacacttggtctgtcaccagacaagtcaatg

SEQ ID NO: 224798 - DNA, 75 bp, Artificial Sequence
  Synthetic
gtggtgttttcccacgcccttcccataactgaagtcctacaagcaatgtatggccaaccctctccagatagacaa

SEQ ID NO: 224799 - DNA, 75 bp, Artificial Sequence
  Synthetic
accttgtacaggatgttctcatatgggtttctatccccaacctggtcagagacaaacatgttcatctttcttttt

SEQ ID NO: 224800 - DNA, 75 bp, Artificial Sequence
  Synthetic
gcgccaagaattgcctttagcaactcttcggagttgctaggtttgatcaatatggactccaacatgttgccacca

SEQ ID NO: 224801 - DNA, 75 bp, Artificial Sequence
  Synthetic
tctagtaaggcagcaccggctttaacagcagcactaaggctgaaattgtatccagatatgttgataccagattgc

SEQ ID NO: 224802 - DNA, 75 bp, Artificial Sequence
  Synthetic
tgttctgtaattacactcaaaactggatgtttgtctttcaatctctcaagatcactcaggttagggtacttcact

SEQ ID NO: 224803 - DNA, 75 bp, Artificial Sequence
  Synthetic
gtgtagagcaggcctaagtctgttagggcctgcacaacatcattgagtggggtctgtgattgcttggccatgcat

SEQ ID NO: 224804 - DNA, 75 bp, Artificial Sequence
  Synthetic
gccattgtcagactgggcatcgtgccaaattggttgttcaagagtgatgagtctttcacatcccacaccctaaca

SEQ ID NO: 224805 - DNA, 75 bp, Artificial Sequence
  Synthetic
ataccattggttccttgctgtggtcttctcattcccaccatttgcaagatttcagacctctggtcgagttgttgt

SEQ ID NO: 224806 - DNA, 75 bp, Artificial Sequence
  Synthetic
gtggtaaggttccccaaatacaccccagaggtctgtggtcgctctgacctcattatcttggccttcagcttctcc

SEQ ID NO: 224807 - DNA, 75 bp, Artificial Sequence
  Synthetic
agatcggctgccagggacataagttcatcagaactgagtctccccacttttaggatgtttttcttggaggtggac

SEQ ID NO: 224808 - DNA, 75 bp, Artificial Sequence
  Synthetic
ttgagttccacaagagagtgaactgtctggtttagacttctgagtctctgtaggtccttgtcatctctcttgtcc

SEQ ID NO: 224809 - DNA, 75 bp, Artificial Sequence
  Synthetic
ttccgcataattctctgtacattgctgacttcggagaagtcaagcccgttgagaaggctggttgcatctttgata

SEQ ID NO: 224810 - DNA, 75 bp, Artificial Sequence
  Synthetic
acagcagctttcacattggatgtgaagccctgtagctccctccttagggcctgcgtccactggaaactcttgatt

SEQ ID NO: 224811 - DNA, 75 bp, Artificial Sequence
  Synthetic
tccttggacagagacatgctgcagcggtgaaatttggctcagtagaaatgcgcaatcaattgcctaggatccact

SEQ ID NO: 224812 - DNA, 75 bp, Artificial Sequence
  Synthetic
ggacagagacatgctgcagcggtgaaatttggctcagtagaaatgcgcaatcaattgcctaggatccactgtgcg

SEQ ID NO: 224813 - DNA, 75 bp, Artificial Sequence
  Synthetic
cgcacagtggatcctaggctttattgtttgcgccaccaaagtgcctgatcttggtgtgttttcacaacctgaacc

SEQ ID NO: 224814 - DNA, 75 bp, Artificial Sequence
  Synthetic
tgaccaattaacgacccagggctgagagaaccatggggcaagcaagatcaaagagttcgaaggaggtccctgaca

SEQ ID NO: 224815 - DNA, 75 bp, Artificial Sequence
  Synthetic
acatggacagggcagaaatgctgccagacgctacatatttggggcctctcaactgcaagtcatgttggcaaaagt

SEQ ID NO: 224816 - DNA, 75 bp, Artificial Sequence
  Synthetic
tcgacagcctagtgaggtgccatgatcattacctgtgcagacactgtctgaacctgctgctcacggtgtcagaca

SEQ ID NO: 224817 - DNA, 75 bp, Artificial Sequence
  Synthetic
ggtgccctctctgcaagtatccactgccaacaagactcaaagtgtcaaccgctccaagctctcctcctccctacc

SEQ ID NO: 224818 - DNA, 75 bp, Artificial Sequence
  Synthetic
aagagtaaagggcagcccacaggaggagaggagaagacccaccacacacaaacacacacagacacccaaacccac

SEQ ID NO: 224819 - DNA, 75 bp, Artificial Sequence
  Synthetic
acacagggccacagccccagccagcccagcggcccacaggggcgcaggcccaaacagacccacacacacagggcc

SEQ ID NO: 224820 - DNA, 75 bp, Artificial Sequence
  Synthetic
cccctcggggggccccccccccgggggggcgcccccccggggggcgcgtggcgtccccgggaccgctcactcgat

SEQ ID NO: 224821 - DNA, 75 bp, Artificial Sequence
  Synthetic
gtcctggatctgtgggacagccagccagtcctcgcaggatctccccttgagcctgaaccttccccctgttgtctc

SEQ ID NO: 224822 - DNA, 75 bp, Artificial Sequence
  Synthetic
atacataattgtttgctttgacttactataacaaagtctgcaatctttgaatgaaaaccaatcaggaacactcat

SEQ ID NO: 224823 - DNA, 75 bp, Artificial Sequence
  Synthetic
caatggctgcaggagcactgatttgggaatatgtaattcctggagaataacgtccaactgtgaattcatgaggtg

SEQ ID NO: 224824 - DNA, 75 bp, Artificial Sequence
  Synthetic
ttcacctgttctatacctgtgcaaaaacaagtgggataggacctcatcaaatcttaaatatccctcaagctcagc

SEQ ID NO: 224825 - DNA, 75 bp, Artificial Sequence
  Synthetic
aatgaagacctttaaatctttggtctctaagttcaccataatgttttgaacacagttccttccttcataaagaac

SEQ ID NO: 224826 - DNA, 75 bp, Artificial Sequence
  Synthetic
gccagatctcacagtgagcggcacaggctcccattcaggacccactctgttaaaatcatgggatcttgcatcact

SEQ ID NO: 224827 - DNA, 75 bp, Artificial Sequence
  Synthetic
cagtattttgtcagacccaatcagctccaactctactgactcgcccagcaccatagggtccaccatgtagtcctc

SEQ ID NO: 224828 - DNA, 75 bp, Artificial Sequence
  Synthetic
aaactcatcggatctgataaggaaaacataatccttagacttgaacactgagtctgttcttaagaggcacaagca

SEQ ID NO: 224829 - DNA, 75 bp, Artificial Sequence
  Synthetic
ttcatccaaaagccttctatccacttcacccttgaagaggtaggtgcacgacaggaactctgccaaagcttggcc

SEQ ID NO: 224830 - DNA, 75 bp, Artificial Sequence
  Synthetic
aagtaacttgcacttaactataaataacaatgaaaatttccttaaacaatcagtgttgttctggttatgtgtgaa

SEQ ID NO: 224831 - DNA, 75 bp, Artificial Sequence
  Synthetic
atccacagagattgtgaattccataataccatcagtgtagttgagagtgtagtcccacaaatcctttaatgcgcg

SEQ ID NO: 224832 - DNA, 75 bp, Artificial Sequence
  Synthetic
aaaagaccctgggtttaccaacccctgcctgatcaacatagcagcagtgcagacaacctctcccaatcgataaga

SEQ ID NO: 224833 - DNA, 75 bp, Artificial Sequence
  Synthetic
gaaccaaccgaacccgaattgaaggtcagtcttaaacataggtctctcaatgtttttattaaccaccttcagcac

SEQ ID NO: 224834 - DNA, 75 bp, Artificial Sequence
  Synthetic
aaaggactgaaaaggtcccatagcctctgcaccatcttcagagggcatcatatctctgtgaggaaaccatgaaaa

SEQ ID NO: 224835 - DNA, 75 bp, Artificial Sequence
  Synthetic
attaccaagtgtcctcgatgttatgacaaattctctaacaaatgattcaaagtacacctgcttcaaaaagttctt

SEQ ID NO: 224836 - DNA, 75 bp, Artificial Sequence
  Synthetic
gcacacatctcttgtgctcacaaccaattcatcggtaaggcttgaatcagaacgttgatgtgagtttacaaggtc

SEQ ID NO: 224837 - DNA, 75 bp, Artificial Sequence
  Synthetic
tgagaaaaggactgtgtagtgctcatctcttttccacttcacaatatgtgatattagtgataatgattcagaatt

SEQ ID NO: 224838 - DNA, 75 bp, Artificial Sequence
  Synthetic
tatgtcaataagcacacaaaggtcaaggaactttattctagggctccatctcatgttcttagagctttggtcaga

SEQ ID NO: 224839 - DNA, 75 bp, Artificial Sequence
  Synthetic
catgaatggcaaaagctgatcttcaaaaactttaggatacaatcttctgactgattgtattacatgattcaagtt

SEQ ID NO: 224840 - DNA, 75 bp, Artificial Sequence
  Synthetic
aatcttatcttcaagcagcctagaactttcaggctttcttgcaacataatcacagggatttagatgtttaagcac

SEQ ID NO: 224841 - DNA, 75 bp, Artificial Sequence
  Synthetic
tgtaccacttgtctttctcgcctcttgtggttcagccaagacccagacacccaattcaaaggaattactcagaga

SEQ ID NO: 224842 - DNA, 75 bp, Artificial Sequence
  Synthetic
aacacatgtataatcccaaaggagcggtctcaacaggcttatgtgatcaggttgcgggtcggagtattttgatct

SEQ ID NO: 224843 - DNA, 75 bp, Artificial Sequence
  Synthetic
gtcacacacataaagtgttacatcatgacttgtgtgaactctcaccaccttatcatcttttgctaaatcctccaa

SEQ ID NO: 224844 - DNA, 75 bp, Artificial Sequence
  Synthetic
cactttcttgatgtacaagttttccctgttcctatttcttacacatctactccctagagttttgcagaggcctat

SEQ ID NO: 224845 - DNA, 75 bp, Artificial Sequence
  Synthetic
gaaacctgaagatatgcaactctgaaaggctgacttgtttatagcttctgacaagagcttctgcgcccctctggt

SEQ ID NO: 224846 - DNA, 75 bp, Artificial Sequence
  Synthetic
gaacttgctacaaagcttgttttgcaaagtcttgatcaaggaaggcaccctctcctcctgaaagttcattgttga

SEQ ID NO: 224847 - DNA, 75 bp, Artificial Sequence
  Synthetic
tgggtacaccactttttgtcttaaaaccatcctaatggggtacagctcattcaggtttagccagttaagattgac

SEQ ID NO: 224848 - DNA, 75 bp, Artificial Sequence
  Synthetic
caattcactcatatcatcttctaagcccaacatttctgcaagctgcaagacggcttcccttttgtctctgttaaa

SEQ ID NO: 224849 - DNA, 75 bp, Artificial Sequence
  Synthetic
caggtctaaaaagaactcttcattaaactccccgtttttaagtttatgatgtaacagcctcaccaacttcctgat

SEQ ID NO: 224850 - DNA, 75 bp, Artificial Sequence
  Synthetic
agtctttgtctcattggggcataggtcctcaattaacctttggaccctataccccctggagccatccaaccagtc

SEQ ID NO: 224851 - DNA, 75 bp, Artificial Sequence
  Synthetic
ttttacgtcagtgttggtattgaggaggaaggggtccataggaaaatttgcatattttaggagattcaatgtcct

SEQ ID NO: 224852 - DNA, 75 bp, Artificial Sequence
  Synthetic
catctgtatggtgttaactaaatggataggaacaccattggcaacagcttggtctgcaattgtatctattgtttc

SEQ ID NO: 224853 - DNA, 75 bp, Artificial Sequence
  Synthetic
acagagttggtgaggttctttacacttcacattatgcaatgcagctgatacaaacttagtaagcagtggaacctc

SEQ ID NO: 224854 - DNA, 75 bp, Artificial Sequence
  Synthetic
ttctccccacacataaaaccttgacttaaactctgctgcgaaccgacccactacacttttggggcttataaattt

SEQ ID NO: 224855 - DNA, 75 bp, Artificial Sequence
  Synthetic
attcagaaggccgctcaagtgagagtggaattctagtaagataagaatttcttctggatgactgtccaccatttc

SEQ ID NO: 224856 - DNA, 75 bp, Artificial Sequence
  Synthetic
acttagcttcttatcgaacagtgtgatttgatcatcacttgaagtgtatgcttctggtctttcaccaaaaattac

SEQ ID NO: 224857 - DNA, 75 bp, Artificial Sequence
  Synthetic
accaatacaataattaataaatctttcagtaaccagcccataaaaatcggaagcattatggaggatcccttgtcc

SEQ ID NO: 224858 - DNA, 75 bp, Artificial Sequence
  Synthetic
catatcaataagactagatatgtgagatggcacaatgcctcgttcaaaatagtttctgaagatctcctctgtcac

SEQ ID NO: 224859 - DNA, 75 bp, Artificial Sequence
  Synthetic
ggttgtttgtgaacccctcaagagcttcaacttagccttcacataagacttcatcaacgcgctgacaacaggaaa

SEQ ID NO: 224860 - DNA, 75 bp, Artificial Sequence
  Synthetic
gggaacttcaacgagcttatgcatgtgccacgtcagtaaagtgctaacatgatctttcccagacctcacgtattg

SEQ ID NO: 224861 - DNA, 75 bp, Artificial Sequence
  Synthetic
atcatcacctaatcgaagattctgcagcaacattaaaaacaggaaagggcacatcattgggccccacttgctgtg

SEQ ID NO: 224862 - DNA, 75 bp, Artificial Sequence
  Synthetic
atccaagctataattgaggagtccctctcttacatttatagtcattgatagtattgcattctcgaattctttttc

SEQ ID NO: 224863 - DNA, 75 bp, Artificial Sequence
  Synthetic
attatttaaacatgaacctgagaaaaaacttgtgaaagactcaaaataatcttctacaagtcttgtaaacatctt

SEQ ID NO: 224864 - DNA, 75 bp, Artificial Sequence
  Synthetic
agttctcagatcaccaatataaagctccctgtttccaccaacctgctctttgtaagaaagcgcaaatttcaatct

SEQ ID NO: 224865 - DNA, 75 bp, Artificial Sequence
  Synthetic
tccagaatccgggcccactgaagtgtaagacgtcggagactcctctgaatagaaacataagttttttagggctgc

SEQ ID NO: 224866 - DNA, 75 bp, Artificial Sequence
  Synthetic
actcatacattttgtcaacgataaggccttactaagtgattctgaattgctttctctctcactaatcctgacttc

SEQ ID NO: 224867 - DNA, 75 bp, Artificial Sequence
  Synthetic
atcttctaacttgtcccagtcaaacttaaagttcagaccctgtctttgaacatgcctgtatttgcctgagtatga

SEQ ID NO: 224868 - DNA, 75 bp, Artificial Sequence
  Synthetic
gttggcattcatttgtaagagtaccattttcatacaagaaaaccaatcttcttctgaaaagaactttctactgag

SEQ ID NO: 224869 - DNA, 75 bp, Artificial Sequence
  Synthetic
gtttttggccatttcatcaaggccacactgttccttaacatgctgagtgaagtaaatcgcagacaaatttgagtt

SEQ ID NO: 224870 - DNA, 75 bp, Artificial Sequence
  Synthetic
tccttcaaccgcctcacacacatgtctcatctcttcaagtgtcaaacatgaagggtcaaaatcttcaaccaagtg

SEQ ID NO: 224871 - DNA, 75 bp, Artificial Sequence
  Synthetic
gaatgatatttctgacaaaatcaatttcctcaaatgagcaaggttcccagtgagggctatctgcaagtggtgcaa

SEQ ID NO: 224872 - DNA, 75 bp, Artificial Sequence
  Synthetic
tccttttgcatcctcaactcctttagaaccttgatgttgtgctatagctgaactactcttgtaagacgcaatcgt

SEQ ID NO: 224873 - DNA, 75 bp, Artificial Sequence
  Synthetic
agcattcactctgctttctaactctttaaaaaagttggactcttctacaccctcaaagtgggcttgttcaaggct

SEQ ID NO: 224874 - DNA, 75 bp, Artificial Sequence
  Synthetic
ggcattttctttctttgagtgtgcctcagaacccaagaccaacttagagactaacttagaaactttgtattcata

SEQ ID NO: 224875 - DNA, 75 bp, Artificial Sequence
  Synthetic
atcagagtggctcagtttgtacttttgttttctaacaaacccttctgttatttgactaactgcactaacaagcaa

SEQ ID NO: 224876 - DNA, 75 bp, Artificial Sequence
  Synthetic
cttgttgaaatcatattctaacagacgttctccgttgaggtgcttgtttacaacaacactcttattactcgcaag

SEQ ID NO: 224877 - DNA, 75 bp, Artificial Sequence
  Synthetic
gtctagtgcagtagcacagcctgaatttgtcatagggtctaagctgttgagccttttctctcccttataaataag

SEQ ID NO: 224878 - DNA, 75 bp, Artificial Sequence
  Synthetic
tgtcccgttgttgaatgatgataccatgaggctaaaagcttctaaattcacacctggaaccactgcttgacaatc

SEQ ID NO: 224879 - DNA, 75 bp, Artificial Sequence
  Synthetic
tatctctttgctaacaaattttctcatctgctcgttgaaaacgtcttcttcctcaggtgtgattgtctcttttgg

SEQ ID NO: 224880 - DNA, 75 bp, Artificial Sequence
  Synthetic
attaacaaagaacccaaactgacttttgggttcaaagaacttttcaaaacactttatctgatcggtaagcctgtc

SEQ ID NO: 224881 - DNA, 75 bp, Artificial Sequence
  Synthetic
tggtgtctctttggttatcaagtgacataagtatgatatgttcaacatgaatttgaacttcgcactcaaaagaat

SEQ ID NO: 224882 - DNA, 75 bp, Artificial Sequence
  Synthetic
tttactaccagagttaaagagtgtttttaacaagtatcttagcagcttgtagacaatcttttcagcgctagtgat

SEQ ID NO: 224883 - DNA, 75 bp, Artificial Sequence
  Synthetic
gagatcctcctttatcttgtccatcaaagttgttgaggaaaagtcagatacaatagccatcaccaaataccttat

SEQ ID NO: 224884 - DNA, 75 bp, Artificial Sequence
  Synthetic
gttttgaacctgcttctggttcctctttgttggattggtaagcagtaatagtattaatgttcttagtgtaagctc

SEQ ID NO: 224885 - DNA, 75 bp, Artificial Sequence
  Synthetic
aatgtccgtaatgtgatcaacaaggtctggacacgatcgaatccaagaaatcatgacatcaaccatattgaacag

SEQ ID NO: 224886 - DNA, 75 bp, Artificial Sequence
  Synthetic
cacttcatgagaaaatatgggcagaaagaatctctttgggtctgcataaaacgatattaggtgaccttcagagcc

SEQ ID NO: 224887 - DNA, 75 bp, Artificial Sequence
  Synthetic
ttgaatagaatagcatctcgatgactcacctgtcttctgatacaacaaatggtactcctcatcatcaaactttat

SEQ ID NO: 224888 - DNA, 75 bp, Artificial Sequence
  Synthetic
gacctgagaaaagacctctttgcattccaccacttggtatctaatggaccccatttgattctgtctcaacctggc

SEQ ID NO: 224889 - DNA, 75 bp, Artificial Sequence
  Synthetic
tactgagcttgttttcatactatttgtcaaggctaaacaaacagatgataacttcttcaggctcccaatgctcct

SEQ ID NO: 224890 - DNA, 75 bp, Artificial Sequence
  Synthetic
caaacactccacatctgcttcaaaactgtagtcctcaaattttgtgtaatacatgagcgggtggttcccagcctt

SEQ ID NO: 224891 - DNA, 75 bp, Artificial Sequence
  Synthetic
tctgaatctctcaaattcgtccaatgaaatctgacattcagttgtcagatctttagaaaggccgtagtgttcaaa

SEQ ID NO: 224892 - DNA, 75 bp, Artificial Sequence
  Synthetic
gtttaggcccacagctgatagacacttactgatcttagtgacaaattcgaagaaaaactttttaaataaatcatc

SEQ ID NO: 224893 - DNA, 75 bp, Artificial Sequence
  Synthetic
taaagtggtacctttatttgtttttgatctcttcctgttccttaaaagcttcacaaactcgtcctttgtactgca

SEQ ID NO: 224894 - DNA, 75 bp, Artificial Sequence
  Synthetic
gtaactcaccaatctgtcattcacactgttgtaacagcaccccacccagtgattgtcatttgtgactcctcccga

SEQ ID NO: 224895 - DNA, 75 bp, Artificial Sequence
  Synthetic
gctttctagcttgatgagagcagaaaggcataagacatccagattcaacagctgccttctcctggtgtttaaaag

SEQ ID NO: 224896 - DNA, 75 bp, Artificial Sequence
  Synthetic
tttcagacttttaactttgttcaatactgataggagtctctcatacaccgtgtttttgtttatgagtcttctatg

SEQ ID NO: 224897 - DNA, 75 bp, Artificial Sequence
  Synthetic
ccctattgtggttgaggcaataaacctcattaaagggcaagatttagtagcttccttacataatgtcctgatgtc

SEQ ID NO: 224898 - DNA, 75 bp, Artificial Sequence
  Synthetic
cacctctgttggcatagtttcataaagattcgagaactctccaattaactcattaggacccaccttcctaaaatt

SEQ ID NO: 224899 - DNA, 75 bp, Artificial Sequence
  Synthetic
cttcttcagctttccagcttcaaagtctctcctaaacctgctaaacaaggaattgatccccaagacaacctcatc

SEQ ID NO: 224900 - DNA, 75 bp, Artificial Sequence
  Synthetic
actactcatgccagggttgacgccatcatgacacattctcatgatctcctcattgtgagttgaccttgcatcctt

SEQ ID NO: 224901 - DNA, 75 bp, Artificial Sequence
  Synthetic
taggatcttcattgagtccatacctgatcttttgtccacagtagtcttgagtgactcacaaagtcggaaatactc

SEQ ID NO: 224902 - DNA, 75 bp, Artificial Sequence
  Synthetic
tgattcctcaaatactttttcatcctgacttgaaaactcaagtaatttgaacaagagatctctgaacttgaagtt

SEQ ID NO: 224903 - DNA, 75 bp, Artificial Sequence
  Synthetic
cacccagtccggcataaaactattgtcataagtgcagcgaccatccactatgggcacaagtgttatacctgaaac

SEQ ID NO: 224904 - DNA, 75 bp, Artificial Sequence
  Synthetic
tgcaaggtcttcctttatacttgacagcttgttggtatcctcaataaactttttttcaaagtttgcaggactgct

SEQ ID NO: 224905 - DNA, 75 bp, Artificial Sequence
  Synthetic
tctaacaaaacactcaagaagtattaacgtgttatcaatcaacttgtatccgtctggaacaatgagaggtagacc

SEQ ID NO: 224906 - DNA, 75 bp, Artificial Sequence
  Synthetic
tgggcagacgacccctgattctatcaagatggtttcaacagatttgtcttcatagttgtgaaggcagccactctt

SEQ ID NO: 224907 - DNA, 75 bp, Artificial Sequence
  Synthetic
gtctgcgctgtccacttctatgcatcgagacagaagctttagaccttcaatcagaactaatctgggctctctttg

SEQ ID NO: 224908 - DNA, 75 bp, Artificial Sequence
  Synthetic
accaaggaagttgagtttctgtctcgacaaacgttcatcttgctcgatgtagtttaaacacaggcttctgagctc

SEQ ID NO: 224909 - DNA, 75 bp, Artificial Sequence
  Synthetic
gtttaaacacaggcttctgagctctgttatgatttcttccattgcgcatcaaaatagcctaggatccactgtgcg

SEQ ID NO: 224910 - DNA, 75 bp, Artificial Sequence
  Synthetic
cgcaccggggatcctaggctttttggattgcgctttcctctggatcaactgagtgttgagctctgtttgatagag

SEQ ID NO: 224911 - DNA, 75 bp, Artificial Sequence
  Synthetic
gaatgggtcagattgtgacaatgtttgaggccttgcctcacatcatcgatgaggttatcaacattgtcatcattg

SEQ ID NO: 224912 - DNA, 75 bp, Artificial Sequence
  Synthetic
tcctcatcataataacgagcattaaagctgtgtataactttgccacatgcgggctatttggcttgctcagcttcc

SEQ ID NO: 224913 - DNA, 75 bp, Artificial Sequence
  Synthetic
ttctcttggcaggcagatcttgtggtatgtacggtcttagtggtcctgatgtttacaaaggggtttatcagttca

SEQ ID NO: 224914 - DNA, 75 bp, Artificial Sequence
  Synthetic
aatcgctagaattcgatatgtcccacttaaacctgacaatgcccaatgcatgttcagttaataactctcaccact

SEQ ID NO: 224915 - DNA, 75 bp, Artificial Sequence
  Synthetic
acattagcatggggacatctggactggagctaacttttactaatgattccatcttgcgccataatttctgcaatt

SEQ ID NO: 224916 - DNA, 75 bp, Artificial Sequence
  Synthetic
tgacttctgccttcaataagaggacctttgaccatacactcatgagtatagtttcaagtttacacctcagcatca

SEQ ID NO: 224917 - DNA, 75 bp, Artificial Sequence
  Synthetic
ctttgaccatacactcatgagtatagtttcaagtttacacctcagcatcagagggcacaccgactacaaggcagt

SEQ ID NO: 224918 - DNA, 75 bp, Artificial Sequence
  Synthetic
gtcctgtgatttcaatgacggtattacaattcagtacaatctgacattttcagatgcacagagtgctataaacca

SEQ ID NO: 224919 - DNA, 75 bp, Artificial Sequence
  Synthetic
atgtaggacttttagaggtagggttctggacatgtttaggactgcctttggaggacagcacatgagaagtggctg

SEQ ID NO: 224920 - DNA, 75 bp, Artificial Sequence
  Synthetic
gggctggacaggctcagatggtaagactacctggtgcagccagacaagttatcaatacttgatcatacagaatag

SEQ ID NO: 224921 - DNA, 75 bp, Artificial Sequence
  Synthetic
aacttgggaaaaccattgcagatatgcaggcccctttgggatatccagaattctccttgctcaggaaaagacaaa

SEQ ID NO: 224922 - DNA, 75 bp, Artificial Sequence
  Synthetic
atttctcaccaggagacttgcaggcacattcacttggactttgtcagactcctcaggggtggaaaatccgggtgg

SEQ ID NO: 224923 - DNA, 75 bp, Artificial Sequence
  Synthetic
ttattgcctaaccaaatggatgattcttgctgcagaacttaaatgttttggaaacacagctgtcgcaaaatgcaa

SEQ ID NO: 224924 - DNA, 75 bp, Artificial Sequence
  Synthetic
tgtcaatcatgacgaagagttctgtgatatgctccgactgattgattacaataaggctgccttgagtaaatttaa

SEQ ID NO: 224925 - DNA, 75 bp, Artificial Sequence
  Synthetic
ggaagatgtggagtctgctttacatgtattcaaaacaacagtcaactctctgatctctgatcagctattgatgag

SEQ ID NO: 224926 - DNA, 75 bp, Artificial Sequence
  Synthetic
aaatcacctaagagatttgatgggggtaccatactgtaattactcaaaattttggtatttagagcacgccaaaac

SEQ ID NO: 224927 - DNA, 75 bp, Artificial Sequence
  Synthetic
tggtgagactagtgtacctaaatgttggcttgtcaccaatggttcctatttgaatgagacccactttagtgatca

SEQ ID NO: 224928 - DNA, 75 bp, Artificial Sequence
  Synthetic
gatcgagcaagaggcagacaacatgatcacagagatgttaaggaaagattacataaagaggcaagggagcacccc

SEQ ID NO: 224929 - DNA, 75 bp, Artificial Sequence
  Synthetic
tctggccttgatggactttctaatgttttctacatcagcatatttgatcagcgtttttctgcaccttgtgaagat

SEQ ID NO: 224930 - DNA, 75 bp, Artificial Sequence
  Synthetic
accaacacacagacatgtaaagggtggcacatgtccaaagccacaccgcctaaccaataaaggtatctgcagctg

SEQ ID NO: 224931 - DNA, 75 bp, Artificial Sequence
  Synthetic
ggcacatgtccaaagccacaccgcctaaccaataaaggtatctgcagctgtggtgcattcaaggtgcccggcgta

SEQ ID NO: 224932 - DNA, 75 bp, Artificial Sequence
  Synthetic
aaaaccgtctggaagagacgctgaacaacagcgcctccctgactctccacctcgaaagaggtggagagtcaggga

SEQ ID NO: 224933 - DNA, 75 bp, Artificial Sequence
  Synthetic
ggcccctagggggtcttagagtgttacaacattaggccctctgaagatcaggtcatgtggtaggatgttgtgaac

SEQ ID NO: 224934 - DNA, 75 bp, Artificial Sequence
  Synthetic
ggcttttaggtcaggaagtcttgccttagaagcactctcaaagatgatgcagtccatgagtgcacaatgtggggt

SEQ ID NO: 224935 - DNA, 75 bp, Artificial Sequence
  Synthetic
gatctcctttttcttcttgtccctcactattccagtgtgcatcttgcatagccagccatacttgtcccacacttt

SEQ ID NO: 224936 - DNA, 75 bp, Artificial Sequence
  Synthetic
gtcttcatattctcttgaagcttcctttgtcatttcgacatcaataagctttatgtcccttctattttgtgagtc

SEQ ID NO: 224937 - DNA, 75 bp, Artificial Sequence
  Synthetic
cagaagctttctgatatcatcagaaccttgacaacttaaaaccatcccttgtgggagagcacctataactgatga

SEQ ID NO: 224938 - DNA, 75 bp, Artificial Sequence
  Synthetic
agtcagcccaggttgcgcattgaaaagatcagcaagatccatgccgtgtgagtacttagagtcttgcttaaattg

SEQ ID NO: 224939 - DNA, 75 bp, Artificial Sequence
  Synthetic
cttttgatcagtaggttctctatagaaatgtataaactgtccattttgtggttggaatactgctatctccactgg

SEQ ID NO: 224940 - DNA, 75 bp, Artificial Sequence
  Synthetic
gtcgttaaatctaccttcaatgtcaatccacgtgggggcattaggatcaattccccccatgaggtcttttagtag

SEQ ID NO: 224941 - DNA, 75 bp, Artificial Sequence
  Synthetic
cattgtctgactatagcttaagcctacctgtggcgggcctgctgccccaggcactggtcttggtgagttggctgc

SEQ ID NO: 224942 - DNA, 75 bp, Artificial Sequence
  Synthetic
aagtctttcatttgtgaggtcaattgttgtgttctcccatgctctccccacaattgatgttctacaagctatgta

SEQ ID NO: 224943 - DNA, 75 bp, Artificial Sequence
  Synthetic
tggccacccttcacctgagagacaaaccttgtagaggatgttttcataagggttcctatccccaacttgatccga

SEQ ID NO: 224944 - DNA, 75 bp, Artificial Sequence
  Synthetic
gacaaacatattgagctttttcttggccccaaggactgcctttaggaggtcttcactattgcttggctttatgag

SEQ ID NO: 224945 - DNA, 75 bp, Artificial Sequence
  Synthetic
gatggattccagcatgttccctccatctagcagagctgcccctgctttcacagcggcaccaagactgaaattgta

SEQ ID NO: 224946 - DNA, 75 bp, Artificial Sequence
  Synthetic
gccagaaatgttgatgctggactgttgttcagttatgattcccaaaactgggtgtttgtctttcagcctctcaag

SEQ ID NO: 224947 - DNA, 75 bp, Artificial Sequence
  Synthetic
atcactgagatttgggtatttgactgtgtagagcagcccaaggtctgtgagtgcctgcacaacatcattgagtgg

SEQ ID NO: 224948 - DNA, 75 bp, Artificial Sequence
  Synthetic
agtctgtgactgttttgccatgcaagccattgttagactcggcattgtgccaaactgattgttcaggagtgatga

SEQ ID NO: 224949 - DNA, 75 bp, Artificial Sequence
  Synthetic
gtctttcacatcccaaaccctcaccacaccgtttgcaccctgttgaggctttctcattccaaccatttgaaggat

SEQ ID NO: 224950 - DNA, 75 bp, Artificial Sequence
  Synthetic
ttgggatctctgatcaagctgttgtgctgttagatttcccatgtaaactccggaagcttggggcctctcagatct

SEQ ID NO: 224951 - DNA, 75 bp, Artificial Sequence
  Synthetic
catgatcttcgccttcaacttctcaaggtcagctgcaagagacatcagttcctctgcactgagtcttcccacttt

SEQ ID NO: 224952 - DNA, 75 bp, Artificial Sequence
  Synthetic
cagaacattcttttttgatgtcgacctcaagtccacaagagaatacacagtctgattgaggctcctgagtctctg

SEQ ID NO: 224953 - DNA, 75 bp, Artificial Sequence
  Synthetic
tagatctttatcatccctcttctcctttctcatgattctctgaacattactgacctcagagaagtccaacccatt

SEQ ID NO: 224954 - DNA, 75 bp, Artificial Sequence
  Synthetic
cagaagacttgttgcatccttgatgacagcagctttcacatctgatgtgaaactctgcagctctctcctcaacgc

SEQ ID NO: 224955 - DNA, 75 bp, Artificial Sequence
  Synthetic
ctgtgtccactggaagcttttaacttctttggacaaagacattctgttgctcaatgatttcccaagacaaatgcg

SEQ ID NO: 224956 - DNA, 75 bp, Artificial Sequence
  Synthetic
ttggacaaagacattctgttgctcaatgatttcccaagacaaatgcgcaatcaaatgcctaggatccactgtgcg

SEQ ID NO: 224957 - DNA, 75 bp, Artificial Sequence
  Synthetic
cgcaccggggatcctaggcgtttagttgcgctattttgttgtgctaatttgttacacaaccccactctgtgaggc

SEQ ID NO: 224958 - DNA, 75 bp, Artificial Sequence
  Synthetic
tgtcagagatagaccaaaccatcaaccatgggccagggcaagtccaagggagagaaggacaccaacaacgcaaac

SEQ ID NO: 224959 - DNA, 75 bp, Artificial Sequence
  Synthetic
cgagcagagctcttgccagatgccacctatcttggccctctaaattgcaaatcatgttggcagaaatttgatagc

SEQ ID NO: 224960 - DNA, 75 bp, Artificial Sequence
  Synthetic
ctagttagatgccatgatcattatctctgcagacactgcctcaacctcctattgtcagtatctgacagatgccct

SEQ ID NO: 224961 - DNA, 75 bp, Artificial Sequence
  Synthetic
ctctgtaaacacccactgccaaccaaactaagagtgtcagcagctccgagctcaccacctccctacgaggagtga

SEQ ID NO: 224962 - DNA, 75 bp, Artificial Sequence
  Synthetic
cgccccgagtcccagcaccagcaggcgacccgagacgggagaaccacacacaggccagcacacacaaacacacca

SEQ ID NO: 224963 - DNA, 75 bp, Artificial Sequence
  Synthetic
cccaccacaggacacacacgcacacacactcacacacacccacacccaagcgcccccggcaccgccgggggcgcc

SEQ ID NO: 224964 - DNA, 75 bp, Artificial Sequence
  Synthetic
ccccgggggggcccccccgggggcccgggcggagcccggcaggagcaccaactagtctatctcctcgaccactgg

SEQ ID NO: 224965 - DNA, 75 bp, Artificial Sequence
  Synthetic
ccccgccagccaatcatcacaggacttccccttgagtctaaatctgcccccaactgtctcatacattaccgtgtt

SEQ ID NO: 224966 - DNA, 75 bp, Artificial Sequence
  Synthetic
ttccccttgagtctaaatctgcccccaactgtctcatacattaccgtgttctttgatttgctgtaacagagtctg

SEQ ID NO: 224967 - DNA, 75 bp, Artificial Sequence
  Synthetic
caatctttgaaggtgaaccaatctggaacaaaagacaatggcctcaacatgatggatttgtccacatgcagctcc

SEQ ID NO: 224968 - DNA, 75 bp, Artificial Sequence
  Synthetic
tgaagaactgcacttatttctgaccccaacaagtgctcaccagttctgaatcggtgcaagaaaagattgcccaga

SEQ ID NO: 224969 - DNA, 75 bp, Artificial Sequence
  Synthetic
ccaacaagtgctcaccagttctgaatcggtgcaagaaaagattgcccagaacgtcaccaatcttttcatagcctt

SEQ ID NO: 224970 - DNA, 75 bp, Artificial Sequence
  Synthetic
tcggtgcaagaaaagattgcccagaacgtcaccaatcttttcatagccttcaagttctgccaagaaaacctttat

SEQ ID NO: 224971 - DNA, 75 bp, Artificial Sequence
  Synthetic
gtccttggtctccaacttcacaaggacattctgaacaaagtttctcccctcaaaaagagcgcccatcctcacagt

SEQ ID NO: 224972 - DNA, 75 bp, Artificial Sequence
  Synthetic
acattctgaacaaagtttctcccctcaaaaagagcgcccatcctcacagtcaaaggcacaggctcccagtcaggt

SEQ ID NO: 224973 - DNA, 75 bp, Artificial Sequence
  Synthetic
ccaattctctcaaagtcaatagatctaatctcgttcaatattcccctagaacccaccagttcaagttcaagagaa

SEQ ID NO: 224974 - DNA, 75 bp, Artificial Sequence
  Synthetic
tcaccaagtgtcaaagagtcctccatataatcctcaaattcatcggatctgatatcaaaaactccatcattcatc

SEQ ID NO: 224975 - DNA, 75 bp, Artificial Sequence
  Synthetic
ctaaacacagagtctgtcttcaacagatggagacactcatccaacaacctcctgtccacctcacctttgaagaaa

SEQ ID NO: 224976 - DNA, 75 bp, Artificial Sequence
  Synthetic
tgggagcaagacaggaactctgctacacctgggctttgtaactggcacttcactacaaaaatcaatgaaaacttc

SEQ ID NO: 224977 - DNA, 75 bp, Artificial Sequence
  Synthetic
ctcaagcagtcagtattgttctgattgtgtgtaaaatctactgtaattgagaactccaacaccccccttgtgttg

SEQ ID NO: 224978 - DNA, 75 bp, Artificial Sequence
  Synthetic
ttgagcatataatcccatagatctcttaaagatttaaatgcttttggttctgtcaagccctgcttaattagcata

SEQ ID NO: 224979 - DNA, 75 bp, Artificial Sequence
  Synthetic
gcagcattacacacaatatctcctacacgataagaaaaccaaccaaaaccaaactgcaagtcattcctaaacata

SEQ ID NO: 224980 - DNA, 75 bp, Artificial Sequence
  Synthetic
ggcctctctatatttttgttaaccacctttaaaataaatgattggaaaggtcccaatgcttcagcgccgtcctca

SEQ ID NO: 224981 - DNA, 75 bp, Artificial Sequence
  Synthetic
gatggcatcatgtctctatgaggaaaccatgagaaactgcctaaggttctacttgttgcaacaaattctcgtatg

SEQ ID NO: 224982 - DNA, 75 bp, Artificial Sequence
  Synthetic
aatgattcaaaatatatttgctttagaaagttcttacaaacatcccttgtgctaacaacaaactcatctactaaa

SEQ ID NO: 224983 - DNA, 75 bp, Artificial Sequence
  Synthetic
gctaacaacaaactcatctactaaacttgagtcagaccgttgatgagagttaacgagatcagaaaacagcacagt

SEQ ID NO: 224984 - DNA, 75 bp, Artificial Sequence
  Synthetic
gtaatgctcgtccctcttccatttgacaacatgagaaatgagtgacaaagactctgaattgatatcaatcaacac

SEQ ID NO: 224985 - DNA, 75 bp, Artificial Sequence
  Synthetic
gcaaaggtctaagaatttaatcctgggactccatctcatgttttttgagctcacatcagacatgaatgggagcag

SEQ ID NO: 224986 - DNA, 75 bp, Artificial Sequence
  Synthetic
ctggtcctcaaagattttgggatacaatcgcctcacagattggattacatgattcaaacttactttatcctccaa

SEQ ID NO: 224987 - DNA, 75 bp, Artificial Sequence
  Synthetic
caatcttgagctttcaggctttcttgccacataatcacatgggtttaagtgtttaacacttaaactcttctcatt

SEQ ID NO: 224988 - DNA, 75 bp, Artificial Sequence
  Synthetic
cttccccttcacaggctctgctagaacccagacacccaattcaaaggaattgctcaatgagatgcagatatagtc

SEQ ID NO: 224989 - DNA, 75 bp, Artificial Sequence
  Synthetic
ccaaagaagaggcctcaaaaggctgatgtgatcatggtgagcctctgggtgactctgtctgtccaagatgtataa

SEQ ID NO: 224990 - DNA, 75 bp, Artificial Sequence
  Synthetic
cattataccatcattattctgaacccctacaatatgatcatccatggctaagtcttcaagcactttcctaatata

SEQ ID NO: 224991 - DNA, 75 bp, Artificial Sequence
  Synthetic
gaggttttccctgtttctgtttctcacacacctgcttcccagagtcttacagaggccaatgaaaccggatgagac

SEQ ID NO: 224992 - DNA, 75 bp, Artificial Sequence
  Synthetic
acaactctggaaagcagacttgttgattgcttcagacaataatttctgtgcaccccttgtgaatttactgcagag

SEQ ID NO: 224993 - DNA, 75 bp, Artificial Sequence
  Synthetic
cttattctggagtgttttaatcagtgagggtaccttttcttcttgaaaggtcatcactgatggataaaccacttt

SEQ ID NO: 224994 - DNA, 75 bp, Artificial Sequence
  Synthetic
ttgccttaaaaccatcctcatcgggaacatttcatttaagtttaaccaattgatgtttgccaattgactgaggtc

SEQ ID NO: 224995 - DNA, 75 bp, Artificial Sequence
  Synthetic
ctcttcaagaccaagaacatctcctaattgaaggatagcttctctcttgtccctattgaaaaggtctagaaaaaa

SEQ ID NO: 224996 - DNA, 75 bp, Artificial Sequence
  Synthetic
ttcttcgttgaattcaccattcttgagtttatggtgtagtcttcttacaagctttcttatgatctttgtttcact

SEQ ID NO: 224997 - DNA, 75 bp, Artificial Sequence
  Synthetic
agggcacaattgttcaatgagtctttgaatcctataccccctggagccatctaaccagtctttcacatcagtgtg

SEQ ID NO: 224998 - DNA, 75 bp, Artificial Sequence
  Synthetic
aatgtttaacaaaaatggatctaaagggaaattggcatatttcaagagatccaatgtcctcttctgaatacaatt

SEQ ID NO: 224999 - DNA, 75 bp, Artificial Sequence
  Synthetic
cactaaagaaactgggactccattcgctatggcttggtcagcaatcgtgtctattgtttcacaaagttgatgtgg

SEQ ID NO: 225000 - DNA, 75 bp, Artificial Sequence
  Synthetic
ttccttgcacttaacattgtgcaatgctgcagacacaaatttggtgagaagagggacttcttccccccatacata

SEQ ID NO: 225001 - DNA, 75 bp, Artificial Sequence
  Synthetic
aaatctggatttaaattccgcagcaaaccgcccaactacactttttggactgatgaatttgttcagtaaaccact

SEQ ID NO: 225002 - DNA, 75 bp, Artificial Sequence
  Synthetic
caaatgagaatggaattctagcaagacaagaacttcttctgggtcactatcaactaattcactcaattttctgtc

SEQ ID NO: 225003 - DNA, 75 bp, Artificial Sequence
  Synthetic
aaataaagtgatctgatcatcacttgatgtgtaggcttctggcctctctccgaagatgacaccaatacaatagtt

SEQ ID NO: 225004 - DNA, 75 bp, Artificial Sequence
  Synthetic
gatgaacctctcactgatcaaaccataaaagtcagaggcattgtgtaggattccctgtcccatgtcaataagact

SEQ ID NO: 225005 - DNA, 75 bp, Artificial Sequence
  Synthetic
ggatatatgagatggcaccacccccatttcaaaatattctctaaagatcctctcagtaacagttgtttctgaacc

SEQ ID NO: 225006 - DNA, 75 bp, Artificial Sequence
  Synthetic
cttgagaagcttgagttttgatttaacatatgacttcatcattgcatttacaacaggaaaaggaacctcaacgag

SEQ ID NO: 225007 - DNA, 75 bp, Artificial Sequence
  Synthetic
tttgtgcatgtgccaagttagcagagtgctaacatgatcctttccagaacgcacatattgatcatcaccaagttt

SEQ ID NO: 225008 - DNA, 75 bp, Artificial Sequence
  Synthetic
gagattctggaggagcattagaaatagaaatggacacatcatcggaccccatttactgtggtccatgctgtaatt

SEQ ID NO: 225009 - DNA, 75 bp, Artificial Sequence
  Synthetic
taacaatccttctcgtacgttgatggtcattgacaatattgcattttcaaattctttgtcgttgttcaaacagga

SEQ ID NO: 225010 - DNA, 75 bp, Artificial Sequence
  Synthetic
acctgagaagaagctggaaaaagactcaaaataatcctccaccaatcttgtaaacatttttgttctcaagtcacc

SEQ ID NO: 225011 - DNA, 75 bp, Artificial Sequence
  Synthetic
gatgtaaagctctctatttcccccaacttgctctttgtaagatagtgcgaactttagtcttccagaatcaggacc

SEQ ID NO: 225012 - DNA, 75 bp, Artificial Sequence
  Synthetic
aacagaagtgtatgatgtcggtgactcttctgagtaaaagcacaggttctttaaggcagcactcatgcattttgt

SEQ ID NO: 225013 - DNA, 75 bp, Artificial Sequence
  Synthetic
caatgacagagccttgcttagagactcagaattactctctctttcactaattcttacatcttcttctaatttgtc

SEQ ID NO: 225014 - DNA, 75 bp, Artificial Sequence
  Synthetic
ccaatcgaatttaaagttcaagccctgcctttgcatgtgtctgtatttccctgaatatgcatttgcattcatttg

SEQ ID NO: 225015 - DNA, 75 bp, Artificial Sequence
  Synthetic
taataaaatcattttcatgcatgaaaaccaatcaccctctgaaaaaaactttctacaaagattttttgccatctc

SEQ ID NO: 225016 - DNA, 75 bp, Artificial Sequence
  Synthetic
aaccaatcaccctctgaaaaaaactttctacaaagattttttgccatctcatccagaccacattgttctttgaca

SEQ ID NO: 225017 - DNA, 75 bp, Artificial Sequence
  Synthetic
ttctacaaagattttttgccatctcatccagaccacattgttctttgacagttgaagtgaagtacaatggtgaca

SEQ ID NO: 225018 - DNA, 75 bp, Artificial Sequence
  Synthetic
gttccgtagaactctcaacagcctcacaaatgtacctcatatcatcactagtaagacaagatgggtcaaaatcct

SEQ ID NO: 225019 - DNA, 75 bp, Artificial Sequence
  Synthetic
ctactaggtgaaatgatatctctgacaaaattatcttccttaaatgagccattttacctgataggatgacctgaa

SEQ ID NO: 225020 - DNA, 75 bp, Artificial Sequence
  Synthetic
attttacctgataggatgacctgaaggtggtgcagtcctttagtatctttaagttctctctcaccctgtccctca

SEQ ID NO: 225021 - DNA, 75 bp, Artificial Sequence
  Synthetic
ggtggtgcagtcctttagtatctttaagttctctctcaccctgtccctcattgggttttttgccaccattatatc

SEQ ID NO: 225022 - DNA, 75 bp, Artificial Sequence
  Synthetic
gtattattgtagaattaactttattttctaaatccctaaagaaacttgtctcttcttctccttcaaaacatacat

SEQ ID NO: 225023 - DNA, 75 bp, Artificial Sequence
  Synthetic
ctattaagtcaccctctgttttttctgtttctgttcctttagaaccaatgactaacctggaaacaagctttgaga

SEQ ID NO: 225024 - DNA, 75 bp, Artificial Sequence
  Synthetic
ccttatactcgtaatctgagtgtttcaatttatacttctgttttctcataaaaccttctgtgatttggctcacag

SEQ ID NO: 225025 - DNA, 75 bp, Artificial Sequence
  Synthetic
cactaacaagtagtttattaaaatcatattctaaaagccgttctccatttagatgcttgttgacaaccacacttt

SEQ ID NO: 225026 - DNA, 75 bp, Artificial Sequence
  Synthetic
tattactcgcaagatctaatgctgttgcacatccagagttggtcatggggtccaggctattgagctttttctctc

SEQ ID NO: 225027 - DNA, 75 bp, Artificial Sequence
  Synthetic
ctttaaatattagggtgccattgttaaatgaagacaccatcatactgaaggcctgtaagttgacacccggggttg

SEQ ID NO: 225028 - DNA, 75 bp, Artificial Sequence
  Synthetic
aatgctgacagtcaatatccttgccggtgaacttcttcatttgctcataaaagacacattcttcctcaggagtga

SEQ ID NO: 225029 - DNA, 75 bp, Artificial Sequence
  Synthetic
ggtgaacttcttcatttgctcataaaagacacattcttcctcaggagtgattgcttccttggggttaacaaagaa

SEQ ID NO: 225030 - DNA, 75 bp, Artificial Sequence
  Synthetic
accgaactcactttttggctcaaagaatttctcaaaacattttatctgatctgtcaatctatcaggagtctcctt

SEQ ID NO: 225031 - DNA, 75 bp, Artificial Sequence
  Synthetic
ctgtcaatctatcaggagtctccttagtgatcaaatgacataagtatgacacattcaacatgaacttgaactttg

SEQ ID NO: 225032 - DNA, 75 bp, Artificial Sequence
  Synthetic
agtgatcaaatgacataagtatgacacattcaacatgaacttgaactttgcactcaataacactttctctccagt

SEQ ID NO: 225033 - DNA, 75 bp, Artificial Sequence
  Synthetic
gtcaaaaattaatttaatcaaaaaccgaagcaacctgtacaccactttttcagcaggtgtgatcaagtcctcctt

SEQ ID NO: 225034 - DNA, 75 bp, Artificial Sequence
  Synthetic
taacttattcattaatgatgttgatgagaagtctgacacaatggccattactaaatacctaatattttgaacctg

SEQ ID NO: 225035 - DNA, 75 bp, Artificial Sequence
  Synthetic
tttttgatttctctttgttggattggtgagcaataacaagagtagggttcttagtgcggtttcaatgtcagtaag

SEQ ID NO: 225036 - DNA, 75 bp, Artificial Sequence
  Synthetic
ttagtgcggtttcaatgtcagtaaggtggtcctttaagtcagggcacgacctaatccatgacatcatagtgtcaa

SEQ ID NO: 225037 - DNA, 75 bp, Artificial Sequence
  Synthetic
tcatgttgtgcagcacctcatctgaaaagattggcaaaaagaaccttttggggtctgcataaaaggaaatcaagt

SEQ ID NO: 225038 - DNA, 75 bp, Artificial Sequence
  Synthetic
gaccattcgaaccctgtatagagtaacaccttgaagactctccagtcttctgatatagtagatagtactcctcag

SEQ ID NO: 225039 - DNA, 75 bp, Artificial Sequence
  Synthetic
aatctagtttcatgacctgacaaaacacctccttacattccaccacttggtacctcacagaccctaattgattct

SEQ ID NO: 225040 - DNA, 75 bp, Artificial Sequence
  Synthetic
gccttaacctagcaactgaacttgttttcatgctatttgttagagccaaacaaacagatgacaatttcctcaaac

SEQ ID NO: 225041 - DNA, 75 bp, Artificial Sequence
  Synthetic
tctgagggctctttaattgctctatatcggattgaaaagtgtagtcttcaaattttgtataatacattacagggt

SEQ ID NO: 225042 - DNA, 75 bp, Artificial Sequence
  Synthetic
gagtcccgattttaacgaagttctcaaactcagcaaatggtatgtggcactcatgctcgaggcactctgacagtc

SEQ ID NO: 225043 - DNA, 75 bp, Artificial Sequence
  Synthetic
cgtaatgaccaaaactaagtcccaccattgataagcaccttttgactttcattatgaactcacttacagacactt

SEQ ID NO: 225044 - DNA, 75 bp, Artificial Sequence
  Synthetic
taaacagctcctcaagggacactctcttatatacccttgattttcttctgttcctcaaaagcctgatgaattctt

SEQ ID NO: 225045 - DNA, 75 bp, Artificial Sequence
  Synthetic
ctttagtactttgagagctcaccaacctatcattcacactactgtaacaacaaccaacccagtacttatcattct

SEQ ID NO: 225046 - DNA, 75 bp, Artificial Sequence
  Synthetic
cctatcattcacactactgtaacaacaaccaacccagtacttatcattcttcaagcctttgagtctcgactgctt

SEQ ID NO: 225047 - DNA, 75 bp, Artificial Sequence
  Synthetic
aatgagtgaagaaaggcacaagacgtcgagattcaacagctgtcttcttctagtgtttaataattttaaactttt

SEQ ID NO: 225048 - DNA, 75 bp, Artificial Sequence
  Synthetic
cactttgttcaacatagagagcagtctttcatactcagtgttgacaccactttctttttcatgcccgtgagtctc

SEQ ID NO: 225049 - DNA, 75 bp, Artificial Sequence
  Synthetic
tgctgtgatgaatctcattaaggggcaggattcaattgcctctctgcttaatgtcgatatgtcatcatcatcaac

SEQ ID NO: 225050 - DNA, 75 bp, Artificial Sequence
  Synthetic
aaggggctcataaagctcagaaaattccttgattaaacccttagggttgatcttctgaaagtttcttttgagctt

SEQ ID NO: 225051 - DNA, 75 bp, Artificial Sequence
  Synthetic
cccattcaccaggtctctcctaaacctgctaaaaagagaatttatgccaaagaccacatcatcacaagtcatgtt

SEQ ID NO: 225052 - DNA, 75 bp, Artificial Sequence
  Synthetic
ctgctaaaaagagaatttatgccaaagaccacatcatcacaagtcatgttggggtcaacaccatcatggcacact

SEQ ID NO: 225053 - DNA, 75 bp, Artificial Sequence
  Synthetic
ctcataatttcttcattatggaatgatcttgcatctttcagaatcttcatagagtccataccagaacgcttatca

SEQ ID NO: 225054 - DNA, 75 bp, Artificial Sequence
  Synthetic
atggtggttttgagagattcacagagtctaaagtactcagactcttcaaagactttttcatcctgactggaatac

SEQ ID NO: 225055 - DNA, 75 bp, Artificial Sequence
  Synthetic
tccaaaagtttaaataggagatctctgaacttgaagtttacccactccggcataaaactgttttcatagtcacaa

SEQ ID NO: 225056 - DNA, 75 bp, Artificial Sequence
  Synthetic
cgaccatccactattggaactagtgtgatgcccgcaacagcaaggtcttctttaatgcttgccaatttgttagtg

SEQ ID NO: 225057 - DNA, 75 bp, Artificial Sequence
  Synthetic
tcttctatgaacttcctctcaaaactagctggtgtgcttctaacgaagcattcaagaagaacaagggaattgtca

SEQ ID NO: 225058 - DNA, 75 bp, Artificial Sequence
  Synthetic
tagctggtgtgcttctaacgaagcattcaagaagaacaagggaattgtcaatcaacttataaccgtcaggaataa

SEQ ID NO: 225059 - DNA, 75 bp, Artificial Sequence
  Synthetic
ttcaagaagaacaagggaattgtcaatcaacttataaccgtcaggaataataagtggcagtcccgggcaaacaac

SEQ ID NO: 225060 - DNA, 75 bp, Artificial Sequence
  Synthetic
cccagagtctattaggattgtttcaacagatttgtcctcatggttgtgtatgcagccacttttgtctgcactgtc

SEQ ID NO: 225061 - DNA, 75 bp, Artificial Sequence
  Synthetic
tatctctatacaacgagacaataatttgagtccttcgattagaaccattctgggttccctttgtcccaagaagtt

SEQ ID NO: 225062 - DNA, 75 bp, Artificial Sequence
  Synthetic
tagtttttgccttgacagcctctcatcctggtctatgtagtttagacacaactctctcaattctaaaatggtttc

SEQ ID NO: 225063 - DNA, 75 bp, Artificial Sequence
  Synthetic
agtttagacacaactctctcaattctaaaatggtttcatccattgcgcatcaaaaagcctaggatccactgtgcg

SEQ ID NO: 225064 - DNA, 75 bp, Artificial Sequence
  Synthetic
gcgccggggatcctaggctttttgcgctattggctgtacaacttttctctgtagagttgctataagatgggccag

SEQ ID NO: 225065 - DNA, 75 bp, Artificial Sequence
  Synthetic
attgtgacaatgttggaggctttgcctcacatcattgatgaggtcatcaacattgtcattattgtgctcattata

SEQ ID NO: 225066 - DNA, 75 bp, Artificial Sequence
  Synthetic
atcacaagtatcaaagctgtgtacaactttgctacctgtgggatatttgcactgatcagcttccttttattagct

SEQ ID NO: 225067 - DNA, 75 bp, Artificial Sequence
  Synthetic
ggcaggtcttgtggcttgtatggccttgaaggtcctgacatttataagagagtttaccaattcaaatcagtggag

SEQ ID NO: 225068 - DNA, 75 bp, Artificial Sequence
  Synthetic
tttgatatgtctcacttaaacttgacgatgcccaagcagtgctcagccaataactcccaccacaatattagcatg

SEQ ID NO: 225069 - DNA, 75 bp, Artificial Sequence
  Synthetic
gggaaatcaggattggagttgaccttcactaatgattccatcattaaccacaatcactgcaacttaacctctgcc

SEQ ID NO: 225070 - DNA, 75 bp, Artificial Sequence
  Synthetic
ttcaacaagaaaacctttgaccacacactcatgagcatagtctcgagtctacaccttagcatcagaggaaacacc

SEQ ID NO: 225071 - DNA, 75 bp, Artificial Sequence
  Synthetic
gtctacaaggcggtgtcctgtgacttcaacaacggcattactattaattacaacttaacattttcagatgcacaa

SEQ ID NO: 225072 - DNA, 75 bp, Artificial Sequence
  Synthetic
agtgctataaatcagtgcagtacctttagggtacgagtcctgagcatgtttagaactgcctttgggggtaaacac

SEQ ID NO: 225073 - DNA, 75 bp, Artificial Sequence
  Synthetic
atgagaagtggctggggttggaaaagttcagatggcaaaaccacttggtgcagccagacagactatcaatatcta

SEQ ID NO: 225074 - DNA, 75 bp, Artificial Sequence
  Synthetic
atcatacaaaataggacctgggaaaaccattgtagatatgcgggcccttttgggatgtctagaatcctcttttct

SEQ ID NO: 225075 - DNA, 75 bp, Artificial Sequence
  Synthetic
caagaaaagacaaagtttcttactagaaggcttgcaggcacattcacttggactttgtcagactcttcaggagta

SEQ ID NO: 225076 - DNA, 75 bp, Artificial Sequence
  Synthetic
gagaacccaggtggttattgtctaacaagatggatgatccttgctgcggatctcaagtgttttggaaacactgct

SEQ ID NO: 225077 - DNA, 75 bp, Artificial Sequence
  Synthetic
gttgcaaagtgcaatgtcaaccatgatgaagagttctgtgacatgatgagactcatcgatttcaacaagactgct

SEQ ID NO: 225078 - DNA, 75 bp, Artificial Sequence
  Synthetic
ctaagcaaattcaaggaggatgtggagtctgctctctccctgttcaaaacaacagtaactcctctgatctctgac

SEQ ID NO: 225079 - DNA, 75 bp, Artificial Sequence
  Synthetic
cagctgttgatgaggaatcacttaagggatttgatgggggtgccatactgcaattcttcaaagttctggtatctg

SEQ ID NO: 225080 - DNA, 75 bp, Artificial Sequence
  Synthetic
gaacatgcaaaaactggtgagactagtgtccccaaatgttggcttgtcactaatggttcctatttaaatgagact

SEQ ID NO: 225081 - DNA, 75 bp, Artificial Sequence
  Synthetic
cactttagtgatcaaatcgaacaggaagcagacaacatgatcacagaaatgctgaggaaagactacataaaaagg

SEQ ID NO: 225082 - DNA, 75 bp, Artificial Sequence
  Synthetic
caagggagcacccctctggccttaatggatcttttgatgttttctacatcagcttatttgattagcgtctttctg

SEQ ID NO: 225083 - DNA, 75 bp, Artificial Sequence
  Synthetic
catcttgtgaagataccaactcacaggcatataaagggtgggtcttgtccaaagccacaccgtctaactgctaaa

SEQ ID NO: 225084 - DNA, 75 bp, Artificial Sequence
  Synthetic
ggaatttgtagctgtggtgcatttaaagtgcccggtgtaaagacaacttggaagagacgctaaacagcagcgcct

SEQ ID NO: 225085 - DNA, 75 bp, Artificial Sequence
  Synthetic
ccctgactctccacctccagtgaggtggagagtcagggaggcccagggggtcttagagtgttacaacattcgggc

SEQ ID NO: 225086 - DNA, 75 bp, Artificial Sequence
  Synthetic
ctctgaagatcaaatcatgtggcaggatattgtgaacagttttcaggtcggggagccttgccttggtggcgctct

SEQ ID NO: 225087 - DNA, 75 bp, Artificial Sequence
  Synthetic
caaagatgatgcagtccaaaagtgcacagtgtggggttatcggtttctttatcttgtccctcactattccagtgt

SEQ ID NO: 225088 - DNA, 75 bp, Artificial Sequence
  Synthetic
atcttgtccctcactattccagtgtgcatcttgcatagccaaccatatttgtcccacactttgtcctcatattct

SEQ ID NO: 225089 - DNA, 75 bp, Artificial Sequence
  Synthetic
ggttctctataaaaatgtatgtactgcccattttgtggttgaaatattgctatttctactgggtcattgaacatg

SEQ ID NO: 225090 - DNA, 75 bp, Artificial Sequence
  Synthetic
ccttcgatgtcaatccatgtgggagtgttgggatcaatccctcccataaggtccttcaacaacattgtctggctg

SEQ ID NO: 225091 - DNA, 75 bp, Artificial Sequence
  Synthetic
taactcaagcccacctgaggtgggcctgctgctccaggtacctttctgggtgaattatttatgcccctgtcgcgt

SEQ ID NO: 225092 - DNA, 75 bp, Artificial Sequence
  Synthetic
gtaagaataattgtattcgtctcccacgctgtccctacaactgatgttctgcaggctatgtttggccaaccttca

SEQ ID NO: 225093 - DNA, 75 bp, Artificial Sequence
  Synthetic
cctgagagacaaactttgtagaggatgttttcataaggatttctatccccaacctggtctgagacgaacatgttg

SEQ ID NO: 225094 - DNA, 75 bp, Artificial Sequence
  Synthetic
agtttccttttggcccccagaaccgcttttagaagatcttcactattgcttggtttaaccaagatgtactccagc

SEQ ID NO: 225095 - DNA, 75 bp, Artificial Sequence
  Synthetic
atattgcccccatccaacaaggctgcccctgcctttacagcagcacccaagctgaaagtatagccagaaatgttt

SEQ ID NO: 225096 - DNA, 75 bp, Artificial Sequence
  Synthetic
atgctggattgctgttcagtgattactcccaaaactgcgtgtttgtccctcagtctttcggggtcattaagattt

SEQ ID NO: 225097 - DNA, 75 bp, Artificial Sequence
  Synthetic
gggaacttaactgtgccaagcagcccaaggtctgtgagcgcatgcacaacatcattaagtggggtctgtgactgt

SEQ ID NO: 225098 - DNA, 75 bp, Artificial Sequence
  Synthetic
ttggccatgcaagccatagttagactcggcattgtgccaaattgattgttcagaagtgatgagtccatcacatcc

SEQ ID NO: 225099 - DNA, 75 bp, Artificial Sequence
  Synthetic
cagaccctcaccacaccatttgcaccctgctggggcttcttcatccctaccatttgtaaaatttgagatctttgg

SEQ ID NO: 225100 - DNA, 75 bp, Artificial Sequence
  Synthetic
tcaagctgttgtgctgtcaagttccccatgtacactccagaagcttgaggcctttcggatctcataatcttggcc

SEQ ID NO: 225101 - DNA, 75 bp, Artificial Sequence
  Synthetic
ttcagcttttcaaggtcagctgcaagggacattaattcctctgcactaagccttcctaccttcagaacatttttc

SEQ ID NO: 225102 - DNA, 75 bp, Artificial Sequence
  Synthetic
tttgatgttgatcttaagtctacaagagaatgcacagtttggttgaggcttctgagcctctgcaggtctttgtcg

SEQ ID NO: 225103 - DNA, 75 bp, Artificial Sequence
  Synthetic
tccctcttctctttcctcatgattctctggacattgctgacctcagaaaagtccaacccattcagaagactggtt

SEQ ID NO: 225104 - DNA, 75 bp, Artificial Sequence
  Synthetic
gcgcccttgatgacagcagccttcacatctgatgtgaagccttgcagctctctcctgagtgcctgcgtccactgg

SEQ ID NO: 225105 - DNA, 75 bp, Artificial Sequence
  Synthetic
catctgatgtgaagccttgcagctctctcctgagtgcctgcgtccactggaaaactttgacttctttggacagag

SEQ ID NO: 225106 - DNA, 75 bp, Artificial Sequence
  Synthetic
cgcaccggggatcctaggcgttttgttgcgctattgagctgtacaacttttctctgtagagtggctataagcagt

SEQ ID NO: 225107 - DNA, 75 bp, Artificial Sequence
  Synthetic
ccagaccaccagccatgggccaaggcaagtccaaagaaaagagagacaccggcaacacaggcagagccgagattc

SEQ ID NO: 225108 - DNA, 75 bp, Artificial Sequence
  Synthetic
tgccggacaccacctacttgggccccctaaactgtaagtcatgttggcagagatttgacagtttgatcaggtgcc

SEQ ID NO: 225109 - DNA, 75 bp, Artificial Sequence
  Synthetic
atgaccactatctttgtagacactgcttaaatcttctactgtcagtctccgacagatgccccctctgcaaatacc

SEQ ID NO: 225110 - DNA, 75 bp, Artificial Sequence
  Synthetic
cattgcccaccaagctgatgatatcaacagccccaagctcaccacccccctacgaggagtgacgtcgccagatca

SEQ ID NO: 225111 - DNA, 75 bp, Artificial Sequence
  Synthetic
acgctggcagcccgccgcaggaagaaaacacacagaccgacacacacaaacacagcatcccacacaggacacacg

SEQ ID NO: 225112 - DNA, 75 bp, Artificial Sequence
  Synthetic
cacacacgcaggcagacacactcccacgcccaacccccccacacacaccggggggggcgccccccgggggggcga

SEQ ID NO: 225113 - DNA, 75 bp, Artificial Sequence
  Synthetic
cgccccccgggggtcggggtggatcccgcgggagacaccgctcagtcgatctcctcaaccaccgatccacccaac

SEQ ID NO: 225114 - DNA, 75 bp, Artificial Sequence
  Synthetic
caataataacaggacttccccttgagtctaaacctgcccccaactgtctcatacataattgtggcttttgactta

SEQ ID NO: 225115 - DNA, 75 bp, Artificial Sequence
  Synthetic
ctgaaacagagcctacaatctttaaaggtgagccaatccggcaccaatgacaatggcaccaagaggacagatctg

SEQ ID NO: 225116 - DNA, 75 bp, Artificial Sequence
  Synthetic
tccatatgcaactcttgaagaatcacacttatctccgaactcggaagatgctcaccagtcctaaatctatgtagg

SEQ ID NO: 225117 - DNA, 75 bp, Artificial Sequence
  Synthetic
agaaggtttccgagaacatcactgatcctctcatagccctcaagttctgccaaaaagaccttcatatccttggtc

SEQ ID NO: 225118 - DNA, 75 bp, Artificial Sequence
  Synthetic
tccaacctcacaagtatattctgaacaaagctcctcccttcaaaaagagcacccatcctcacagtcagaggcaca

SEQ ID NO: 225119 - DNA, 75 bp, Artificial Sequence
  Synthetic
ggttcccagtcaggcccaatcctctcaaaatcagaggatctaatcccttccaacatccttctagaacccaccaac

SEQ ID NO: 225120 - DNA, 75 bp, Artificial Sequence
  Synthetic
tcaagctcaaaggaatcgccaagtatcaaagggtcttccatgtaatcctcaaactcttcagacctgatgtcaaaa

SEQ ID NO: 225121 - DNA, 75 bp, Artificial Sequence
  Synthetic
acactgtcattcattttgaagattgagtctgtccttagtaaatgaagacactcatctagcaatctgctatccact

SEQ ID NO: 225122 - DNA, 75 bp, Artificial Sequence
  Synthetic
tcacctttatagaggtgagaacacgacaagagctctgctacacttggagcctgtaactgacacttcactaagaag

SEQ ID NO: 225123 - DNA, 75 bp, Artificial Sequence
  Synthetic
atcaatgagaatttccttaaacaatcggcattgttttgattgtgtgtgaagtccaccgtaactgaaaactccata

SEQ ID NO: 225124 - DNA, 75 bp, Artificial Sequence
  Synthetic
attccctctgtatttgtaagcatgtagtcccacagatcccttaaagacccaaatgcctttgagtttgtcagaccc

SEQ ID NO: 225125 - DNA, 75 bp, Artificial Sequence
  Synthetic
tgcttgatcaacattgcagcattgcacacaatctctcccatccgataagagaaccacccgaaaccaaactgtaaa

SEQ ID NO: 225126 - DNA, 75 bp, Artificial Sequence
  Synthetic
tcactcctgaacatgggcctctctacatctctgttcactactttcaacacaaatgactgaaagggtcctagtgct

SEQ ID NO: 225127 - DNA, 75 bp, Artificial Sequence
  Synthetic
tcagcaccatcctcagacggcatcatgtctttatgaggaaaccatgaaaaattccctaaagttctggttgttgcc

SEQ ID NO: 225128 - DNA, 75 bp, Artificial Sequence
  Synthetic
acaaactctcgcacaaatgattcgaagtacacctgttttaaaaagtttttgcagacatcccttgtactaataaca

SEQ ID NO: 225129 - DNA, 75 bp, Artificial Sequence
  Synthetic
aattcatcaaccagacttgaatctgaccgctgatgagagctggtgagatctgagaacaaaactgtgtaatgttcg

SEQ ID NO: 225130 - DNA, 75 bp, Artificial Sequence
  Synthetic
tctcttttccacttaacaacgtgagagataagtgacaaagactctgagttaatatcaatcagcacacagagatca

SEQ ID NO: 225131 - DNA, 75 bp, Artificial Sequence
  Synthetic
aggaatttgatcctagggctccatctcatgtttttcgagctcatgtctgacatgaacggcaacaactgatcttca

SEQ ID NO: 225132 - DNA, 75 bp, Artificial Sequence
  Synthetic
aagatctttgggtacagtcgtcttacagactgtattacatggtttagactcactttatcctccaacagccttgag

SEQ ID NO: 225133 - DNA, 75 bp, Artificial Sequence
  Synthetic
ctctcaggcttactcgcaacataatcacatcggtacaagtggttaagagttgatgttttcttattctctcctttt

SEQ ID NO: 225134 - DNA, 75 bp, Artificial Sequence
  Synthetic
ataggttctgcaagcacccagacacccaactcaaaggaattgcttagtgaaatgcaaatgtagtcccaaagaaga

SEQ ID NO: 225135 - DNA, 75 bp, Artificial Sequence
  Synthetic
ggcctcaaaagactgacatgatcacgatgagcttctggatgggtttgtctatcacatatgtacagtgttacacca

SEQ ID NO: 225136 - DNA, 75 bp, Artificial Sequence
  Synthetic
tcctgttttatgaccctcactatatgttcatctgtggccaagtcttcaagtacctttttgatatacagattttcc

SEQ ID NO: 225137 - DNA, 75 bp, Artificial Sequence
  Synthetic
ttattcttgttcctcacacatctactccctagtgtcttgcaaagacctatgaaaccagatgaaatacaactctgg

SEQ ID NO: 225138 - DNA, 75 bp, Artificial Sequence
  Synthetic
aaagctgacttattgatcgcttctgataacaatttttgtgcaccccttgtaaacttactacaaagcttgttctgg

SEQ ID NO: 225139 - DNA, 75 bp, Artificial Sequence
  Synthetic
agtgtcttaatcaatgtaggcttcctttcctcttggaaagtcatctttggtggattaaccactttatgcatcaaa

SEQ ID NO: 225140 - DNA, 75 bp, Artificial Sequence
  Synthetic
accattctcaatgggaacatttcgctcaggttcaaccaattgatgattgctaagagcgttagatcctcctcaaga

SEQ ID NO: 225141 - DNA, 75 bp, Artificial Sequence
  Synthetic
ccaaggatttctgtcagttgaagaatagcttcgtaaaattctctgttaaaaatttctagaaaaaattcttcaata

SEQ ID NO: 225142 - DNA, 75 bp, Artificial Sequence
  Synthetic
gattcacaatttttaagcttatggagtatcctcctcacaagtttcctcacaaccttcgtttcatcgggacacaat

SEQ ID NO: 225143 - DNA, 75 bp, Artificial Sequence
  Synthetic
tctacaataagtctttgaattctataacccctagaaccatctaaccaatccttcacatcagtgttgacattcaat

SEQ ID NO: 225144 - DNA, 75 bp, Artificial Sequence
  Synthetic
aagaaagggtccagagggaagttagcatatttcaggaggtttagtgttctcctctgaatgtgatttaccaaagaa

SEQ ID NO: 225145 - DNA, 75 bp, Artificial Sequence
  Synthetic
actggaacaccatttgcaatagcctgatcagcaattgtgtctattgtctcacaaagttgatgcggttctttgcac

SEQ ID NO: 225146 - DNA, 75 bp, Artificial Sequence
  Synthetic
tttacattgtgcaatgctgcagacacaaacttcgtgagaagaggaacctcttccccccatacataaaatctagac

SEQ ID NO: 225147 - DNA, 75 bp, Artificial Sequence
  Synthetic
ttaaactctgcagcaaaccgccctactacgctttttggactgataaacttatttaacaagccactcaaatgagaa

SEQ ID NO: 225148 - DNA, 75 bp, Artificial Sequence
  Synthetic
tgaaactctaacaagacaagaacttcctctgggtcattatcgactaactcacttaattttctatcaaataatgta

SEQ ID NO: 225149 - DNA, 75 bp, Artificial Sequence
  Synthetic
atctgatcatcacttgatgtataggcctctggcctctcaccaaagatgactccaatacaatagttaataaacctc

SEQ ID NO: 225150 - DNA, 75 bp, Artificial Sequence
  Synthetic
tcactaattaagccataaaaatcagaggcattgtgcaagattccttgtcccatgtcaatgaggctagatatgtga

SEQ ID NO: 225151 - DNA, 75 bp, Artificial Sequence
  Synthetic
gatggcactattcccagttcaaaatattctctaaagatcctttcagtaatagtcgtctctgtccccctgagaagc

SEQ ID NO: 225152 - DNA, 75 bp, Artificial Sequence
  Synthetic
ttcagttttgacttgacatatgatttcatcatcgcactcacaacagggaaagggacctcaacaagtttgtgcata

SEQ ID NO: 225153 - DNA, 75 bp, Artificial Sequence
  Synthetic
tgccaagtaagcaaggtgctaacatgatccttcccagaacgaatgtactggtcatcaccaagtttgaggttttga

SEQ ID NO: 225154 - DNA, 75 bp, Artificial Sequence
  Synthetic
agaagcattaaaaacaagaatgggcacatcattggtccccacttgctgtgatccatactgtagtttaggaaccct

SEQ ID NO: 225155 - DNA, 75 bp, Artificial Sequence
  Synthetic
tctcgcacattaaaagtcatcgacaagattgcgttttcaaattctttatcattgtttaaacaggaacctgagaaa

SEQ ID NO: 225156 - DNA, 75 bp, Artificial Sequence
  Synthetic
aagctggaaaatgactcaaaataatcttccaccagtcttgtgaacatttttgttcttaagtccccaatataaagt

SEQ ID NO: 225157 - DNA, 75 bp, Artificial Sequence
  Synthetic
tctctatttcctccaacctgctctttgtaagatagtgcaaacttcagtcttccagaatcagggccaactgaggta

SEQ ID NO: 225158 - DNA, 75 bp, Artificial Sequence
  Synthetic
tacgatgtgggtgattcttctgagtaaaaacacaggttcttcaaagcagcactcatacacttcgttagagataaa

SEQ ID NO: 225159 - DNA, 75 bp, Artificial Sequence
  Synthetic
gctttacttaaagactcagaattgctttccctttcactaatcctcacgtcttcttctagtttatccctgtcaaat

SEQ ID NO: 225160 - DNA, 75 bp, Artificial Sequence
  Synthetic
ttgaaattcagaccctgcctttgcatgtgtctgtatttccctgagtatgcatttgcattcatttgcaacaagatc

SEQ ID NO: 225161 - DNA, 75 bp, Artificial Sequence
  Synthetic
atcttcatacatgaaaaccaatcaccctctgaaaaaaacttcctacaaaggttctttgccatttcatctagacca

SEQ ID NO: 225162 - DNA, 75 bp, Artificial Sequence
  Synthetic
cactgttctttaactactgaagtgaaatacagtgatgacagctctgaagaaccctcaactgcctcacatataaac

SEQ ID NO: 225163 - DNA, 75 bp, Artificial Sequence
  Synthetic
ctcatgtcatcattagtaaggcaggttgggtcaaagtcctctacaagatgaaaggatatttctgataggatgact

SEQ ID NO: 225164 - DNA, 75 bp, Artificial Sequence
  Synthetic
ttcctcaagtaagccaatttgcctgacaaaacaatctgaaggtgatgcagcccttttgtgtctttgaccttctcc

SEQ ID NO: 225165 - DNA, 75 bp, Artificial Sequence
  Synthetic
ccaatttcccccccatcaactttttcaagcctcctataccgtgttattgtggaatcaaccttgtgtttcagattc

SEQ ID NO: 225166 - DNA, 75 bp, Artificial Sequence
  Synthetic
ttaaaaaaactagtttcttcctctccttcaaagagcacatttgacggatcgccttctaatttcccttcctccgtt

SEQ ID NO: 225167 - DNA, 75 bp, Artificial Sequence
  Synthetic
accttagaacctatgaccagtctggaaactaactttgagaccttatactcgtaatctgagtggcttaacttgtac

SEQ ID NO: 225168 - DNA, 75 bp, Artificial Sequence
  Synthetic
ttctgttttctcataaagccttctgaaatctggctcacagcactaacaagtagtttgttaaaatcatattccagg

SEQ ID NO: 225169 - DNA, 75 bp, Artificial Sequence
  Synthetic
tagatcagctcactgaaactgaactcagggatgagatggcaaacagattgcagacgtggaaaggtaacgacatta

SEQ ID NO: 225170 - DNA, 75 bp, Artificial Sequence
  Synthetic
cccaaatcatcaacaggccatggaagcactaggtgacttggtgtgggaggaactttatgaagggtcttattcaaa

SEQ ID NO: 225171 - DNA, 75 bp, Artificial Sequence
  Synthetic
gacatcgaaactcagtgcaaaggattaacagagcatgtttctattgacaggataactaattatgacaatatcaaa

SEQ ID NO: 225172 - DNA, 75 bp, Artificial Sequence
  Synthetic
tctcaaagaaagtaatcccccatatcccaaatcatcaacaggccatggaagcactaggtgacttggtgtgggagg

SEQ ID NO: 225173 - DNA, 75 bp, Artificial Sequence
  Synthetic
tgtcaacaagttccagttcaacaacttctttgacgttgacgaaatgcctggagatggtacatgtttctttagttc

SEQ ID NO: 225174 - DNA, 75 bp, Artificial Sequence
  Synthetic
ataatcaatataatggagctccctgttatcataattgcatacttcactagacactttggtttcacttacaagaac

SEQ ID NO: 225175 - DNA, 75 bp, Artificial Sequence
  Synthetic
tgtttctaagtatatattcaacacaacagagctgtggcaaacagtcaaaagcacctgtgccaactatgctagagc

SEQ ID NO: 225176 - DNA, 75 bp, Artificial Sequence
  Synthetic
cttgtcatccacgagcaaatagagaactgcctctttttttaccctcaaaatccagttgcttgcatggagaacaac

SEQ ID NO: 225177 - DNA, 75 bp, Artificial Sequence
  Synthetic
acactggaaagaagtgatggagatggatagacagtatgctgaagcagatgcatacatatctgaccttatgagaga

SEQ ID NO: 225178 - DNA, 75 bp, Artificial Sequence
  Synthetic
tgggggggtaggtctcatcctgttgtgcaccttgtcattgaaaggaaatatctaaaggcagatagctccataaca

SEQ ID NO: 225179 - DNA, 75 bp, Artificial Sequence
  Synthetic
ccagtactggggtggctctattgaagctgaaatcttgagcaaagcactcaatatgacaatctatatatgggtgtc

SEQ ID NO: 225180 - DNA, 75 bp, Artificial Sequence
  Synthetic
ctatgtggattgaagaaaggaaaccccacatcgctcaaagggacatggtttgctgagaagactaaggtcacaatt

SEQ ID NO: 225181 - DNA, 75 bp, Artificial Sequence
  Synthetic
aggagacggtgtgtgggtgagtaatgcaagaaggtggggtggtgaacccattcagacatcacttaacctaataca

SEQ ID NO: 225182 - DNA, 75 bp, Artificial Sequence
  Synthetic
gatcttggtgaacctcagactgcaggcaggagaaagttactggctatagagagaaggagaagactgcctgggagg

SEQ ID NO: 225183 - DNA, 75 bp, Artificial Sequence
  Synthetic
cttcacaatcttcagacaacagatgttcttcaaccacactgaatacttcactagagtctatggaccaataacctt

SEQ ID NO: 225184 - DNA, 75 bp, Artificial Sequence
  Synthetic
tgttcatggcggacacttcaatctgctgttaccaaaatatctacaacccgttcaagtgagagaacagatgtcata

SEQ ID NO: 225185 - DNA, 75 bp, Artificial Sequence
  Synthetic
gaagacattcggtgccattcaggtagccacttagtgaaaattgacaagtatgctccaacaaatgagttccagtct

SEQ ID NO: 225186 - DNA, 75 bp, Artificial Sequence
  Synthetic
tgaagagaaggtgaatgtaacagtgtctgccatactagataatgagggcagtgctgagacattggcacaggaatt

SEQ ID NO: 225187 - DNA, 75 bp, Artificial Sequence
  Synthetic
ttcccaaatgctaagataggattctgcaatgatagcatcataacacacttgccgcttggtcaagagtttggttgc

SEQ ID NO: 225188 - DNA, 75 bp, Artificial Sequence
  Synthetic
gactgaaaataagagttcattccaggatgaactgaatgaagagctaaaagcaatggcagagctaaagttctcact

SEQ ID NO: 225189 - DNA, 75 bp, Artificial Sequence
  Synthetic
tacagggtgggatcagtaaagacgcacgtccaatgtaagccgtaccatcatgcctttgacggtgaaaaaacctgt

SEQ ID NO: 225190 - DNA, 75 bp, Artificial Sequence
  Synthetic
gtttgaaaaaaaacatgacattcagctggagaaggagagagcaaaaccagaaaagaccactaaatcagaactaga

SEQ ID NO: 225191 - DNA, 75 bp, Artificial Sequence
  Synthetic
aatgtaagctcggatggtgactgtcgtgaaggggagctttgtgcagcggttaaactgaatggtcaagggattata

SEQ ID NO: 225192 - DNA, 75 bp, Artificial Sequence
  Synthetic
actgaactgtttaatagcaggccattacaggacattcacaagtgaaggtacagagaaatctgtcaaagcaaacct

SEQ ID NO: 225193 - DNA, 75 bp, Artificial Sequence
  Synthetic
aagaacatacctgtcagagtgggcaaggtgctcaacaaccttttcaatgcacctatagaagcagtctttgatgat

SEQ ID NO: 225194 - DNA, 75 bp, Artificial Sequence
  Synthetic
actgcacgtacccatctgggagaagttcaagttaaacattgcctagaggagtgtcagttcagtttcacaagggtg

SEQ ID NO: 225195 - DNA, 75 bp, Artificial Sequence
  Synthetic
ggaaacctactgctctatcctagaatacaagggaaactgcggccaaaggcattcagtattagtgcattagggcat

SEQ ID NO: 225196 - DNA, 75 bp, Artificial Sequence
  Synthetic
aatgatctggaagtatcgttcacatgcccagacggacaacagagaagactacactcaaatgcagttgacaccaac

SEQ ID NO: 225197 - DNA, 75 bp, Artificial Sequence
  Synthetic
attcagtattagtgcattagggcatagaatactggatggagacaaatcctttctaaatgcctgcacccggcttct

SEQ ID NO: 225198 - DNA, 75 bp, Artificial Sequence
  Synthetic
tgtcccttccaaaataaactaggggtttatgccctttatgtctgtagggcaacacaccgtccgctagtgttatac

SEQ ID NO: 225199 - DNA, 75 bp, Artificial Sequence
  Synthetic
ttctaaatgcctgcacccggcttctggtggtcgtaaccagtgaactaatgtccttcttagatgcgagttatcttt

SEQ ID NO: 225200 - DNA, 75 bp, Artificial Sequence
  Synthetic
acatcaaagacacactgagtaacttaatagccaataagctaatcacaatgaactgtgcaacagaagattacaagt

SEQ ID NO: 225201 - DNA, 75 bp, Artificial Sequence
  Synthetic
accactttcatctggttcgtggtaggtacaatagtgctggcgacctctctacaaatgatttcagttactgtaaaa

SEQ ID NO: 225202 - DNA, 75 bp, Artificial Sequence
  Synthetic
tacgacttgtggcgcctggtagtggtttgagtcaaattcctggagttgtgcacccaggcataaaggttgacatgt

SEQ ID NO: 225203 - DNA, 75 bp, Artificial Sequence
  Synthetic
ctctattgttatcttgtggtcctagcaaagaggaagctggacactggcaaaggggtctgtacagactgtggggaa

SEQ ID NO: 225204 - DNA, 75 bp, Artificial Sequence
  Synthetic
gcttgtgcgtgataagcattcttatatcctcatttctctataaggctaagcctaaactgaagagaaactttataa

SEQ ID NO: 225205 - DNA, 75 bp, Artificial Sequence
  Synthetic
agcgtgctttcaacagaagagtggcagcgtcatcaagcatgcaagaaaggcaagtgcccgtattgtggtgtcaag

SEQ ID NO: 225206 - DNA, 75 bp, Artificial Sequence
  Synthetic
actctgccaacaccggaagtagcgtggacaagcagctactgttgaaaggcttgttgaaactgaacaaccgcactc

SEQ ID NO: 225207 - DNA, 75 bp, Artificial Sequence
  Synthetic
ttggatggcaaggtggtcgttaaatacactacttggctagactgtttcttaagctctgaattaagcctaaataga

SEQ ID NO: 225208 - DNA, 75 bp, Artificial Sequence
  Synthetic
ggaagtggtaatgatgttcagaaacatgtcatcaattgcctccagagagaaacagtgctagagcatgacttgaat

SEQ ID NO: 225209 - DNA, 75 bp, Artificial Sequence
  Synthetic
ttgttgaaactgaacaaccgcactctgtacaataccccttacaagctggtccaagaagtttcagttcctttattt

SEQ ID NO: 225210 - DNA, 75 bp, Artificial Sequence
  Synthetic
aaagagagcatggacacaatagccgaggcacttaggttgatgaatgcacagagcaaagttgctttcttctgtcta

SEQ ID NO: 225211 - DNA, 75 bp, Artificial Sequence
  Synthetic
gttcttaccattagaagaacacctaggtatgcactcaggcttggttgcttcttaaatgcccttcaagggaggccc

SEQ ID NO: 225212 - DNA, 75 bp, Artificial Sequence
  Synthetic
gacctaaatggcatgcgcagagaaacctattttaatctactggaagaacttaagactcaagaccttgaagacaaa

SEQ ID NO: 225213 - DNA, 75 bp, Artificial Sequence
  Synthetic
atcaggctgatctggttggttgttctgctactgctgtttgttttcttaataaaacctgtcagaagtctagaaact

SEQ ID NO: 225214 - DNA, 75 bp, Artificial Sequence
  Synthetic
taagactcaagaccttgaagacaaagggtttgtgtctgaagagctaaaagaactacacagctgtgtgcttcttgt

SEQ ID NO: 225215 - DNA, 75 bp, Artificial Sequence
  Synthetic
aatgaccaaactgagggtttatgggaagaagggattgaagaagtcgagaagtgcggtaagggatgctggtacaat

SEQ ID NO: 225216 - DNA, 75 bp, Artificial Sequence
  Synthetic
tgttaagctaagtaagattgctgacaaaaggaatgttccagatgatgttctagaagatgtgaggcagtatttagg

SEQ ID NO: 225217 - DNA, 75 bp, Artificial Sequence
  Synthetic
caagacgtgtgcacctgtgacaaggaagaacctttgcacacctccaggcacatcttatcagttccagcaaaagat

SEQ ID NO: 225218 - DNA, 75 bp, Artificial Sequence
  Synthetic
aaaaggaatgttccagatgatgttctagaagatgtgaggcagtatttaggttctgatgggaaaatattcaggaaa

SEQ ID NO: 225219 - DNA, 75 bp, Artificial Sequence
  Synthetic
aacactacaaagaaaagaaacagcagtgaattggcacaggaatgcataacagtctttttcagaagaagaatgatt

SEQ ID NO: 225220 - DNA, 75 bp, Artificial Sequence
  Synthetic
gacactgagaaagccacatcaaaagataggcaaggtaagaaagtgatgcggtccttagatgttgaagccccatgg

SEQ ID NO: 225221 - DNA, 75 bp, Artificial Sequence
  Synthetic
ttcaaatttgtctctttaaggggaaaagcctattccggtgcctcagtagggaacttgatagcatactgtcacaac

SEQ ID NO: 225222 - DNA, 75 bp, Artificial Sequence
  Synthetic
gggactctgcatataccagaaacgtttagtccagctgggagtgtgaagcacatatcactttcttgggagagcagc

SEQ ID NO: 225223 - DNA, 75 bp, Artificial Sequence
  Synthetic
ttgtacttgtcaagagagagtctaaacttcactgaagaggacactgaacagctttccatcgagataaggaaactc

SEQ ID NO: 225224 - DNA, 75 bp, Artificial Sequence
  Synthetic
agggtggtagggaagcgagtaattctaagcgggaagtcaacagcaatccttaagctgaatccaaaaacaagtaca

SEQ ID NO: 225225 - DNA, 75 bp, Artificial Sequence
  Synthetic
aatgagctcctatctaccgagcctaaaaagcctattgctctcatatgtgctgagctgtacaaaccatttcaagaa

SEQ ID NO: 225226 - DNA, 75 bp, Artificial Sequence
  Synthetic
agttgggagatgaccagccctgatgccaatgagaagaagattttaaccctgtcaatattggactacacacaaata

SEQ ID NO: 225227 - DNA, 75 bp, Artificial Sequence
  Synthetic
ccaaccttctaaagttcatagagtcttctgctgtcagcaattgccaaataggatctttagggaaaaagatccaga

SEQ ID NO: 225228 - DNA, 75 bp, Artificial Sequence
  Synthetic
ttgtttgcagcattgcccaaagactgctcagaagagtgccagactctgtttgaagacgtcagaaattctgaaagc

SEQ ID NO: 225229 - DNA, 75 bp, Artificial Sequence
  Synthetic
tactccagcagatttgagtacttgactggtgacaggaaagtcacaacatggtcagaggggagttgcactggtcct

SEQ ID NO: 225230 - DNA, 75 bp, Artificial Sequence
  Synthetic
catgcgtctgcatggagctcagcactgaggattaaaggagttgcctatgaaggattcttctctatgtcaaatggt

SEQ ID NO: 225231 - DNA, 75 bp, Artificial Sequence
  Synthetic
tgtccaaaggactgtggttgcaatgatcccagttgccacacaaagcaatggctaaatacaaggaattggcgttgt

SEQ ID NO: 225232 - DNA, 75 bp, Artificial Sequence
  Synthetic
tggaggtatatccctgaagacctgaaaccaactctcggtatggctattcaaactgtcttcccagaaaagtttgag

SEQ ID NO: 225233 - DNA, 75 bp, Artificial Sequence
  Synthetic
aaccctacatggtgttgggggatagggacaggttgctcgtgctgctctgccaaggttgttgatctctataagaat

SEQ ID NO: 225234 - DNA, 75 bp, Artificial Sequence
  Synthetic
gattggaagtttaaggtcattcaggaagtgtcactctcacaaaggagtcaaggagtccgtggcataattagcagt

SEQ ID NO: 225235 - DNA, 75 bp, Artificial Sequence
  Synthetic
aaattcctggaaagaactcacttgcatcctgaatacagagacttcacaccggactatttgatgtgcaggtcgaag

SEQ ID NO: 225236 - DNA, 75 bp, Artificial Sequence
  Synthetic
tggcttgtttccatctggcagattgaacatctaagaacacctgtcgtagcctgtctagaattcgaccacgaaaac

SEQ ID NO: 225237 - DNA, 75 bp, Artificial Sequence
  Synthetic
gtgtttaagtctgataaagtgacaaaaaaggtggacagccaaggtgaccctttagtgaaaaagccaaaccatgct

SEQ ID NO: 225238 - DNA, 75 bp, Artificial Sequence
  Synthetic
agagtctgtgatgtggtggaagcaggcatagaaatacagctaggccccgtcacagttgctttctctgaccctttt

SEQ ID NO: 225239 - DNA, 75 bp, Artificial Sequence
  Synthetic
gaggctgatgatgatatacaatacgctaagctttcatcccatcgcaagaggttccctatgccagaaattgctgtc

SEQ ID NO: 225240 - DNA, 75 bp, Artificial Sequence
  Synthetic
ggggaacaaaaaatcttgccacaaaggatcgcagtttaccacaaaagagatgttgaccatgaacatgttgacttg

SEQ ID NO: 225241 - DNA, 75 bp, Artificial Sequence
  Synthetic
ctggctgttaaagtgagaactgtcaaacctgatgagttgacagagagcaagaaaaggaggattgagttaaccaag

SEQ ID NO: 225242 - DNA, 75 bp, Artificial Sequence
  Synthetic
caagaagtaagttcagtatcagcaataatggataggttcaaacttaagtcttcagagaaaggtaggccaataagg

SEQ ID NO: 225243 - DNA, 75 bp, Artificial Sequence
  Synthetic
ctacataaccatggcattggaggggctgagcagtactgcaagctgcagagttgcacacatggtacagctggtgat

SEQ ID NO: 225244 - DNA, 75 bp, Artificial Sequence
  Synthetic
tgtagggccagagacctgtgggagttgatctgtccaggaactagctggaggaaaaatgattttgaatcattgatg

SEQ ID NO: 225245 - DNA, 75 bp, Artificial Sequence
  Synthetic
caggaggagagcaaaccatcagcatcaacagaaaagggagacattgagatcgatgagctacttatcgtggaagta

SEQ ID NO: 225246 - DNA, 75 bp, Artificial Sequence
  Synthetic
tatcagattataaatccagacgcactggtcttcgatgacatcaccagcatgaactactttaaaaaactggatgtg

SEQ ID NO: 225247 - DNA, 75 bp, Artificial Sequence
  Synthetic
ggctaccagactgacatagaaggcaaggtggtgtcagatatggaaaagtggagaggagtcattaatttgatgaca

SEQ ID NO: 225248 - DNA, 75 bp, Artificial Sequence
  Synthetic
tacaataagttgtggatgagttgggaaggagttaatctgggttattattgcaacccaggagactggacaacctgc

SEQ ID NO: 225249 - DNA, 75 bp, Artificial Sequence
  Synthetic
cacctcggcatcaaagtgaatattatcacctgtgcagacaacagtcaaactccaagatcagattggtggatagaa

SEQ ID NO: 225250 - DNA, 75 bp, Artificial Sequence
  Synthetic
acagccgaaaacattgttgtcagaaattcagaagcttttagcaacaggaacaacttggagagaaattattctgtc

SEQ ID NO: 225251 - DNA, 75 bp, Artificial Sequence
  Synthetic
gagaagtatgtcaaactacttttaaactctataagctatctatttaaggaactcctaagcaactcaccatctgaa

SEQ ID NO: 225252 - DNA, 75 bp, Artificial Sequence
  Synthetic
tcgcacttcttccactcatcaagagtttacggatctggcaagtccctcgttatggacctaaaggggaggccaatt

SEQ ID NO: 225253 - DNA, 75 bp, Artificial Sequence
  Synthetic
atcacagatattgctgtaggaaacatcagcactcaaaaattcaggagtgtgctgaaatctggttccattgtgaaa

SEQ ID NO: 225254 - DNA, 75 bp, Artificial Sequence
  Synthetic
cagagtggaggaaacatcaatgtctatgtgactgtgaataatttagagctgaattcaaaaaaggttgttatcact

SEQ ID NO: 225255 - DNA, 75 bp, Artificial Sequence
  Synthetic
acaccagtaactctgaaagaagtttatgatgcttggaaggtggcaaagccacatattatgtgtagacctactgga

SEQ ID NO: 225256 - DNA, 75 bp, Artificial Sequence
  Synthetic
ggtctcaaagtcaaccttagggcctgtacgggatgtttcggatgtaacctaggtgcagagtgtcagatatcactg

SEQ ID NO: 225257 - DNA, 75 bp, Artificial Sequence
  Synthetic
acaaacttgcctgagcacattgctgaggcaattgaggtgtcacttgtagaaggtgctatcatgaacagacagtca

SEQ ID NO: 225258 - DNA, 75 bp, Artificial Sequence
  Synthetic
tctttaactgagcctgacgagtttcatttacaccttaaatctgtgaccccaggggtgacagttcctgataccagc

SEQ ID NO: 225259 - DNA, 75 bp, Artificial Sequence
  Synthetic
gcagaggatgttctctcaaggatagagaaagaaagcgggaatataataaaagagtttgagaggactaaaaatagg

SEQ ID NO: 225260 - DNA, 75 bp, Artificial Sequence
  Synthetic
tttctggtgacctcttctgaagagaagatgtttaatattagggtattttccattcttaaagacgtgaacttttgc

SEQ ID NO: 225261 - DNA, 75 bp, Artificial Sequence
  Synthetic
acagctttcctgcactctcccagtggctcttcgaactggggcagagaccaattggcgctgccaaaatcaacacaa

SEQ ID NO: 225262 - DNA, 75 bp, Artificial Sequence
  Synthetic
cacgaattgaacaaaaacgaagtaacagctcagaaaatattgtttggctggttgatgtctgacctaaataatgcc

SEQ ID NO: 225263 - DNA, 75 bp, Artificial Sequence
  Synthetic
attgaggttctggaatcaaagcactgtcctgagtgcgataaaaaagacttacagtcatgtctgcagctaactttt

SEQ ID NO: 225264 - DNA, 75 bp, Artificial Sequence
  Synthetic
tgctgtcacgaatgtatggttgacatcaaggacaacttaaataaaattgagagtcatgcagaaaagctgagttac

SEQ ID NO: 225265 - DNA, 75 bp, Artificial Sequence
  Synthetic
gaggacccgaaaccagtactattagaacatagaagtgttttgttctctaaaagcaatcaaacctgcggcgacagt

SEQ ID NO: 225266 - DNA, 75 bp, Artificial Sequence
  Synthetic
atgtgcctgatgctaaaacccaatgagaaaggatgctgtagaccatccaagaaatctctttatgaagttagctcc

SEQ ID NO: 225267 - DNA, 75 bp, Artificial Sequence
  Synthetic
actatctcatgctggtctagcagcgcaggcattttgtttaaaggaataggtaactttctatccacccacttcggc

SEQ ID NO: 225268 - DNA, 75 bp, Artificial Sequence
  Synthetic
tttgaaagaaggatgccacctctagaccacatcaaccacaaggaactcaatataggtgtggaagaacagaaggga

SEQ ID NO: 225269 - DNA, 75 bp, Artificial Sequence
  Synthetic
tccattttcagagggattctcctgtcagttttgcctatacttttgatagttggcctgatcttcttttcaccacag

SEQ ID NO: 225270 - DNA, 75 bp, Artificial Sequence
  Synthetic
agaaaatcaaggaaaagaaggctagaaagtaaagcttaaagcccttctgtttgaggttctttatccacagtagtt

SEQ ID NO: 225271 - DNA, 75 bp, Artificial Sequence
  Synthetic
acaatgctagatgccattgttaaactaactcttcctggaaagactgaaaaggaaaggaagctcaagagatctgtt

SEQ ID NO: 225272 - DNA, 75 bp, Artificial Sequence
  Synthetic
atcatatctctgatgagactctgtaaaagaggaagatctgttgtgggatttagaaagaggttttacaaaccgctg

SEQ ID NO: 225273 - DNA, 75 bp, Artificial Sequence
  Synthetic
aaagtaaagcttaaagcccttctgtttgaggttctttatccacagtagttcttggtggagggtttttactaactg

SEQ ID NO: 225274 - DNA, 75 bp, Artificial Sequence
  Synthetic
gaacagctaatcaggtctatgatgagacactctaaggtccaggccataaaactcccttcaggacagatgttggtc

SEQ ID NO: 225275 - DNA, 75 bp, Artificial Sequence
  Synthetic
actgatggtgcagacatgggactttctgcagaggagaaagccttcttgactggtatatttgggaaaaagaaggaa

SEQ ID NO: 225276 - DNA, 75 bp, Artificial Sequence
  Synthetic
gatagttcttttactacacaggccacgctagacaaggaagaaggtaagagttttaagaaaggcggaactaagacc

SEQ ID NO: 225277 - DNA, 75 bp, Artificial Sequence
  Synthetic
tgacttgcttttaatatcttcattgcttgacatcatttagttgcattagtgttctgcttcaaatatttatgcact

SEQ ID NO: 225278 - DNA, 75 bp, Artificial Sequence
  Synthetic
ttattagaggacaaagaacactttgataaggtccttgccccaagtaagttgatgcagtactctgaacatgtcaaa

SEQ ID NO: 225279 - DNA, 75 bp, Artificial Sequence
  Synthetic
gagttaatctgtgctaaactgacagatgcactaagaaagaaaaacttcagcctggaagcatggccagaggtacag

SEQ ID NO: 225280 - DNA, 75 bp, Artificial Sequence
  Synthetic
gtagccttgctttagcagtatgcactttaattaagctcaaactcagcccgactagataatttgaagacgcaagac

SEQ ID NO: 225281 - DNA, 75 bp, Artificial Sequence
  Synthetic
tctgtcatcaaacactctatacagaggatggactgctgcaagggctcactctgtgagattaatccacagtgggtt

SEQ ID NO: 225282 - DNA, 75 bp, Artificial Sequence
  Synthetic
atccagaccagtttctgatattgaccctttaacaactcagtgctgacgaggaagagcagtagggaaacgcaccac

SEQ ID NO: 225283 - DNA, 75 bp, Artificial Sequence
  Synthetic
ctgtgagattaatccacagtgggttaagaatgttcattatgacttagggtcagatgtgtcggatgacaatatctt

SEQ ID NO: 225284 - DNA, 75 bp, Artificial Sequence
  Synthetic
tctcaaagaaagacgtgccgcttacccgtaagcaaacatgtctgagctgaactttaaggatttgaacggcctcaa

SEQ ID NO: 225285 - DNA, 75 bp, Artificial Sequence
  Synthetic
cctggaagcatggccagaggtacagtcttacttagacgagactggattcagcaatatacagcttgagttcctaca

SEQ ID NO: 225286 - DNA, 75 bp, Artificial Sequence
  Synthetic
agccaagatacaagaatcatatgagaagaaagcaaatttcgaagtgaaaaatgataagtaccgatgcatagaatg

SEQ ID NO: 225287 - DNA, 75 bp, Artificial Sequence
  Synthetic
caactggtttgaggagttcaaaaaagatgtacccatttacacatcaggtgcaaattcagcctgtctgagttccgg

SEQ ID NO: 225288 - DNA, 75 bp, Artificial Sequence
  Synthetic
cctttaacaactcagtgctgacgaggaagagcagtagggaaacgcaccaccaaaagaacatcacatacagggtat

SEQ ID NO: 225289 - DNA, 75 bp, Artificial Sequence
  Synthetic
gcctgccattgaggagtacttacacaacaaacttaatagtcataggttgtcagacaacaaagtttttaagctgga

SEQ ID NO: 225290 - DNA, 75 bp, Artificial Sequence
  Synthetic
tttagttgacttaagtcaattcaaactggagattgatgctcaatcatcagagagtgccaagaatgctgtttatgg

SEQ ID NO: 225291 - DNA, 75 bp, Artificial Sequence
  Synthetic
cgaggaagagcagtagggaaacgcaccaccaaaagaacatcacatacagggtatgccgccactatatctttgaga

SEQ ID NO: 225292 - DNA, 75 bp, Artificial Sequence
  Synthetic
ctgtattctattcaaagaagtgtacacagagctgtctgtcagattaagagaaacaccttataattcttgtcctag

SEQ ID NO: 225293 - DNA, 75 bp, Artificial Sequence
  Synthetic
cagagcagtaattgctgcaactaggaatttggcaccaatttatgagtgtgcttggacatcatgtgagggcatctt

SEQ ID NO: 225294 - DNA, 75 bp, Artificial Sequence
  Synthetic
tttaattgcatccctactgaagcttctcctagaatttcagtggtaccagcatcatgtactctactcaaaaatctg

SEQ ID NO: 225295 - DNA, 75 bp, Artificial Sequence
  Synthetic
tgaaagatcaatgtcctggttcaatgacaatgctgacaagccagaatttaaagtctggcatgataaatacaatga

SEQ ID NO: 225296 - DNA, 75 bp, Artificial Sequence
  Synthetic
tgaatcattcctacaaagttgtagtgaattccatagagcaggaataaaggtgcttagggttaggcacaccgatgt

SEQ ID NO: 225297 - DNA, 75 bp, Artificial Sequence
  Synthetic
gaataatggagacgaagtccagctggctgttaaagtgagaactgtcaaacctgatgagttgacagagagcaagaa

SEQ ID NO: 225298 - DNA, 75 bp, Artificial Sequence
  Synthetic
aagtctggcatgataaatacaatgacctgaagtccaacttgcctgaagtggagcagattcttgcttatcagaact

SEQ ID NO: 225299 - DNA, 75 bp, Artificial Sequence
  Synthetic
gaatctagtggtggctttaccttccaataaaaaacaaaacatgaggtgtgttgtttacagtaaggactttcagtt

SEQ ID NO: 225300 - DNA, 75 bp, Artificial Sequence
  Synthetic
gctcaagcctttggcgcaaggacataggttatgagatcaaccagaacaccagtactctgaaaggagacatagttg

SEQ ID NO: 225301 - DNA, 75 bp, Artificial Sequence
  Synthetic
gttgcaaggtccttttatgctgaacaggaggcaagctgtgctcggtgctgcctatccctacttgataactatctg

SEQ ID NO: 225302 - DNA, 75 bp, Artificial Sequence
  Synthetic
aagaatatggtgtcaaccgaaacatagtcggcactgttaaaaatatgcttgtggatatggtcaacaagagaaaga

SEQ ID NO: 225303 - DNA, 75 bp, Artificial Sequence
  Synthetic
ttttctccaatgcttacagcattatagatgcctggatcaggtccaaagtagtagcgaagaagtgcgagctaaaat

SEQ ID NO: 225304 - DNA, 75 bp, Artificial Sequence
  Synthetic
aaagactggggggagttgtgatcacaggtgcagggacgtcagaagaccacatcacctggatggagaactggttag

SEQ ID NO: 225305 - DNA, 75 bp, Artificial Sequence
  Synthetic
gtagcgaagaagtgcgagctaaaattgtgagaaaggttgaaatgttgggggaggtttccttaggattgttgaagg

SEQ ID NO: 225306 - DNA, 75 bp, Artificial Sequence
  Synthetic
atggagaaatagaatcttttagtatcccaggctggggcagctgggcaaagcagaattcaaagggaactagacttg

SEQ ID NO: 225307 - DNA, 75 bp, Artificial Sequence
  Synthetic
aaatgattttgaatcattgatgcagataatatctctgctatctgctacaaagaaagctgaagtttgtgaagaagt

SEQ ID NO: 225308 - DNA, 75 bp, Artificial Sequence
  Synthetic
atgtctatcatggtgctttcatgagcgctagttcaaatcttttaagactatgtaaagaatctggcaattttctga

SEQ ID NO: 225309 - DNA, 75 bp, Artificial Sequence
  Synthetic
caggaacagcaattgccaacattatgcagaagaaggactcagatgcacttgaaaaggccaaagaaaaattggaaa

SEQ ID NO: 225310 - DNA, 75 bp, Artificial Sequence
  Synthetic
gtcagttgaggatcctaggatgttttcagcagaacaagttacctatctagatctcttcgaggattcaccgtcagc

SEQ ID NO: 225311 - DNA, 75 bp, Artificial Sequence
  Synthetic
atagaagcagtcctgatcattttataagcgtcttctcaggcttgaccttagtttttgacgttctacttggtgaca

SEQ ID NO: 225312 - DNA, 75 bp, Artificial Sequence
  Synthetic
agatgaagaagactgctgatgatccagcatcgctggagtctgaaggcatgagtgaggatgcagccaaaaaaatgt

SEQ ID NO: 225313 - DNA, 75 bp, Artificial Sequence
  Synthetic
agagcagggcgactccaaagttatggaggagcctgtaggtgctagtttcacttttaactgggatgattagtcaga

SEQ ID NO: 225314 - DNA, 75 bp, Artificial Sequence
  Synthetic
gtattttgaacaactctcagccattcaataaacagattcagatgatgagatttggaatgctatcaggtcttagca

SEQ ID NO: 225315 - DNA, 75 bp, Artificial Sequence
  Synthetic
gccaggaggttgaagcctcaattgaagaagcagaggtactcctaggcacaaatgttgcacaaggggagtctaaat

SEQ ID NO: 225316 - DNA, 75 bp, Artificial Sequence
  Synthetic
atgattagtcagacagtaactgaagggggtgatggcaatgcagcacaatgaatagcagcagtagatcggaagagc

SEQ ID NO: 225317 - DNA, 75 bp, Artificial Sequence
  Synthetic
ggatgtcgtgtccaaccgaacttggaaagaaattctcatccagttgcaggaaagtagaatttcacgtctccagac

SEQ ID NO: 225318 - DNA, 75 bp, Artificial Sequence
  Synthetic
atcaacagcaggctgctgcaatggatgttcctttctcggcacactactgggcatggagatgcaaggtgaatgaga

SEQ ID NO: 225319 - DNA, 75 bp, Artificial Sequence
  Synthetic
aaagtagaatttcacgtctccagactatatatgcagctagttgtgtttgcttgcaatcacaaggtgaagtcaaat

SEQ ID NO: 225320 - DNA, 75 bp, Artificial Sequence
  Synthetic
gcatggagatgcaaggtgaatgagaacagctttcctgcactctcccagtggctcttcgaactggggcagagacca

SEQ ID NO: 225321 - DNA, 75 bp, Artificial Sequence
  Synthetic
acagctttcctgcactctcccagtggctcttcgaactggggcagagaccaattggtgctgctaaaatcaacacaa

SEQ ID NO: 225322 - DNA, 75 bp, Artificial Sequence
  Synthetic
ttagagaactgggtgaaaggggatttatgccctgaaattaacatgccatgcttctctgtttttgggaccatgata

SEQ ID NO: 225323 - DNA, 75 bp, Artificial Sequence
  Synthetic
ctcttccgatctacccgtaattcttgagagatggaaacttatcatggaagtagatacactgctacttcttgtctg

SEQ ID NO: 225324 - DNA, 75 bp, Artificial Sequence
  Synthetic
tgcttggagaactgcctttcatctgggccaggaatataagaggctcctttgccagttccaacttcaacggcaata

SEQ ID NO: 225325 - DNA, 75 bp, Artificial Sequence
  Synthetic
aatagtgacagacaactcatatttgacatctatcttgttcacatttacaataaagaacttgatgactttgatgag

SEQ ID NO: 225326 - DNA, 75 bp, Artificial Sequence
  Synthetic
aaatctatatgcatcctgctgtcttgacagctggaagattgtcagatatggccgcctgttttggggcttttcccg

SEQ ID NO: 225327 - DNA, 75 bp, Artificial Sequence
  Synthetic
gggtgcatcaaggtacttgaagaaactgcagaacgtcatatgagttgggaaacagaagttaaagaagcatctaag

SEQ ID NO: 225328 - DNA, 75 bp, Artificial Sequence
  Synthetic
ttgcaaacccacagagggctgctgaaggcaccggtaacactagatacttgctgaatctgaaaagagagggtgata

SEQ ID NO: 225329 - DNA, 75 bp, Artificial Sequence
  Synthetic
aagattgaggcaggtcaagaagcaagatactataaacggatgctgcggttattattgggggttcccaacctaaaa

SEQ ID NO: 225330 - DNA, 75 bp, Artificial Sequence
  Synthetic
atccctgtgcttcaatggtaacatctctttttgatgttttttcagcaggctttaaataccaggacatggacattg

SEQ ID NO: 225331 - DNA, 75 bp, Artificial Sequence
  Synthetic
aggatggacatcacttcaagtgaaggcacagaaagcctctctgtctcagaaagaggtagtaccgactcaagacta

SEQ ID NO: 225332 - DNA, 75 bp, Artificial Sequence
  Synthetic
tgcctccagaacacatgcttcaccagtcttttttagggaagacaagcccatttcagacagctaacaagatcaaag

SEQ ID NO: 225333 - DNA, 75 bp, Artificial Sequence
  Synthetic
tctaatgtcagttcaaaatcagctcgatctttccgaagtttaaggtacagacctacatcaatatacgggattagg

SEQ ID NO: 225334 - DNA, 75 bp, Artificial Sequence
  Synthetic
ggagcttcacgaaaatcaatgtggttgctgctcccaataagccgactccttatgtattcacccctgcctctgcca

SEQ ID NO: 225335 - DNA, 75 bp, Artificial Sequence
  Synthetic
tcttcacaagataagccttttagtttgaatgaggttttagaggtctcaagggacgaccagcgagactatcagcaa

SEQ ID NO: 225336 - DNA, 75 bp, Artificial Sequence
  Synthetic
agaaaatcaaggaaaagaaggctagaaagtaaggcttagcccttctgtttgaggttccttatccacagtagttct

SEQ ID NO: 225337 - DNA, 75 bp, Artificial Sequence
  Synthetic
gctgtgacagacaggggtatgtaccacacctaccaagctaaccctgaatctgtttacaaggatgtcgtaacgtgc

SEQ ID NO: 225338 - DNA, 75 bp, Artificial Sequence
  Synthetic
tggtggagggtttttactaactgctttaattaactgcactaacatttatatagtttaagtttagataatagagca

SEQ ID NO: 225339 - DNA, 75 bp, Artificial Sequence
  Synthetic
atcaggcacaatcctaatcacacctttgcctcttatgaattagttcaggcatgcactgaaattgctagagtgaga

SEQ ID NO: 225340 - DNA, 75 bp, Artificial Sequence
  Synthetic
ttagataatagagcaagaagggaagaaagaaagagagtggaatagttcgggtatgcggcaacattatctttgaga

SEQ ID NO: 225341 - DNA, 75 bp, Artificial Sequence
  Synthetic
ttcccccctgagtctatagagagagcaaggaaggataggaaaaattggattagtatatctgaagtgactgagaca

SEQ ID NO: 225342 - DNA, 75 bp, Artificial Sequence
  Synthetic
caaggaaggataggaaaaattggattagtatatctgaagtgactgagacaaccagtatagttgcagagccgagat

SEQ ID NO: 225343 - DNA, 75 bp, Artificial Sequence
  Synthetic
caaagaaagtaatcccccatatcccaaatcatcaacaggccatggaagcactaggtgacttggtgtgggaggaac

SEQ ID NO: 225344 - DNA, 75 bp, Artificial Sequence
  Synthetic
cagtcatcatgatcaaggatgcttaccaaataattttaggtgctgagaacaaaaaaattgttaagctcctaagag

SEQ ID NO: 225345 - DNA, 75 bp, Artificial Sequence
  Synthetic
ggaaattccagaggctaggcatggaatgcaaggcagaaatgaaaggcaaaacaaggtgtcaggagcttctaacta

SEQ ID NO: 225346 - DNA, 75 bp, Artificial Sequence
  Synthetic
caattgaaattttaacagacaaccaactggacagcatagtgaaagggataaccgacccctctaagttaaccttct

SEQ ID NO: 225347 - DNA, 75 bp, Artificial Sequence
  Synthetic
ataactggagggacttggtgaagatgaagatcaaggatgtactcctaactgatgatggaaactacatttactgct

SEQ ID NO: 225348 - DNA, 75 bp, Artificial Sequence
  Synthetic
ggctaaaatctctggctcaagctgtcaagggtagccttagaactgagataaaaggcctcaaatacaacacaatgg

SEQ ID NO: 225349 - DNA, 75 bp, Artificial Sequence
  Synthetic
aaaggcctcaaatacaacacaatgggtacaaagtccaacatcaataagacaaaaacgttggaagatgcagagttc

SEQ ID NO: 225350 - DNA, 75 bp, Artificial Sequence
  Synthetic
actgcagtatctagctttatcaacttcctaaaagcttgtgctgctggagagatcaacagtgacttagacaataaa

SEQ ID NO: 225351 - DNA, 75 bp, Artificial Sequence
  Synthetic
gagatcagtttagacagtttgctatcgtcatggcttaagttctttcggaaagttagaaattcaaaggaagttgaa

SEQ ID NO: 225352 - DNA, 75 bp, Artificial Sequence
  Synthetic
ggggaaggtctatcctctcttgctaaaatggctcaggatattaagaaaatggacctgtcttatagaactctctgc

SEQ ID NO: 225353 - DNA, 75 bp, Artificial Sequence
  Synthetic
gagaaggagagagcaaaaccagaaaagaccactaaatcagaactagattggagaaggaaggttcaagataagaag

SEQ ID NO: 225354 - DNA, 75 bp, Artificial Sequence
  Synthetic
caattaaagaaggaacttcctgacttaagcttttccagggaagagataatcctgagacaactagaaaaggacttt

SEQ ID NO: 225355 - DNA, 75 bp, Artificial Sequence
  Synthetic
cctgagacaactagaaaaggactttataaaacaacatggtgacaacattttgagactatcaaatctgatctttct

SEQ ID NO: 225356 - DNA, 75 bp, Artificial Sequence
  Synthetic
aatctgcctttcctgcccatggtgtgtgcagtacaaaacttttgaatccataatgatgcgaaatgttgctgaagc

SEQ ID NO: 225357 - DNA, 75 bp, Artificial Sequence
  Synthetic
tccaggattcaatctaccaaagagctcaacttcacttagagagcttcatcccgacagtataatattgatgatgat

SEQ ID NO: 225358 - DNA, 75 bp, Artificial Sequence
  Synthetic
aagagaagcttgtttagacacaagtgacgaggaggcaatactgtgcacaaagtactgtatgtgtctgtttactgt

SEQ ID NO: 225359 - DNA, 75 bp, Artificial Sequence
  Synthetic
taatgaaatgccttatacaagtgcaatgaatagccatggtgatttcgtgtataagagccctaatgaacagctcat

SEQ ID NO: 225360 - DNA, 75 bp, Artificial Sequence
  Synthetic
tggcagagtgaaaggaataatggcagcaactggactagacgattccaggtcggacttcaagtggacggtgtgctt

SEQ ID NO: 225361 - DNA, 75 bp, Artificial Sequence
  Synthetic
aattgccaacagcaactttgaggttgccagaaagatcactggtaggagcaatggggaaaggctaccgagaagtgt

SEQ ID NO: 225362 - DNA, 75 bp, Artificial Sequence
  Synthetic
tagaagcaaggtcatctatgaaattgtaaagctagtggatagcacggaaatggcaatactacagcaattggcatt

SEQ ID NO: 225363 - DNA, 75 bp, Artificial Sequence
  Synthetic
ttcgtacatcctggatccaaatcatagattctttgctgtccttgctcctaaagcacaactcggtggtcacagaga

SEQ ID NO: 225364 - DNA, 75 bp, Artificial Sequence
  Synthetic
cctcttagtgcaggagacaggtactaaagtgatacatgcagcaactgaaatgtttagtcgcacattgctttcaac

SEQ ID NO: 225365 - DNA, 75 bp, Artificial Sequence
  Synthetic
tacaaaagatgatggcctcaccaacaaccatcttaaggaaactatactaaattgcggtcttgaggcgataaacca

SEQ ID NO: 225366 - DNA, 75 bp, Artificial Sequence
  Synthetic
gttcaaaattatacatggaaaagagctctccaagggctcaggccagtactatttctacagggtctgctgtatatc

SEQ ID NO: 225367 - DNA, 75 bp, Artificial Sequence
  Synthetic
aggagataatacaaagtggggtcccattcattgctgctccatatttagtggaatgatgcagcaactactgagaga

SEQ ID NO: 225368 - DNA, 75 bp, Artificial Sequence
  Synthetic
ttatgatgactggacatcattctataaactaactttcctaaaaaacttgttcaggcaaattgagatacctgctgc

SEQ ID NO: 225369 - DNA, 75 bp, Artificial Sequence
  Synthetic
actcagggatgagatggcaaacagattgcagacgtggaaaggtaacgacattatgaccttcttggttgaaaacta

SEQ ID NO: 225370 - DNA, 75 bp, Artificial Sequence
  Synthetic
tgtttcaaagggtaagatggctttaaattcttacaaccatatgggacagggcatacaccatgcaacttcctcagt

SEQ ID NO: 225371 - DNA, 75 bp, Artificial Sequence
  Synthetic
gctcacttctataatggcagaaataaatgaaagattaataataaacttttgtggccaaaggctacctgatctcca

SEQ ID NO: 225372 - DNA, 75 bp, Artificial Sequence
  Synthetic
ggttacagtggcacatgcaggaagctctgatgactatgccaaatgcatagttctcagtggtgtattgacagaaac

SEQ ID NO: 225373 - DNA, 75 bp, Artificial Sequence
  Synthetic
actaatggagaactatgaagaagccttctggcctacaatgtgtaacctcaagaactacctagctggttttaatag

SEQ ID NO: 225374 - DNA, 75 bp, Artificial Sequence
  Synthetic
ggcgtgccagatgaaagactctgccaaaacacttgtatctgactgtttctttgaattctacagtgagtttatgat

SEQ ID NO: 225375 - DNA, 75 bp, Artificial Sequence
  Synthetic
gtcacaaaggataaccccagctgttatcaaattcattttgaccggactcatcaatagttcagtcacctcccctct

SEQ ID NO: 225376 - DNA, 75 bp, Artificial Sequence
  Synthetic
cagtttagtgcaggcctgtcaggtatctagccagcaggcactgttcaatagtgtgccgcttataacaaatatagc

SEQ ID NO: 225377 - DNA, 75 bp, Artificial Sequence
  Synthetic
gtgtgccgcttataacaaatatagccttcacaatcttcagacaacagatgttcttcaatcacactgaatacttca

SEQ ID NO: 225378 - DNA, 75 bp, Artificial Sequence
  Synthetic
cttcacaatcttcagacaacagatgttcttcaatcacactgaatacttcagtagagtctatggacccataacctt

SEQ ID NO: 225379 - DNA, 75 bp, Artificial Sequence
  Synthetic
aggaactctatctccctttggaagactctatgttccaaagttcagtggtttgatcagctcatctcttgcaattga

SEQ ID NO: 225380 - DNA, 75 bp, Artificial Sequence
  Synthetic
ggatgcagaagaggtagtgaaaagctgtctagaaatgaaacgactcctattacatcttccagatggcacacgtgc

SEQ ID NO: 225381 - DNA, 75 bp, Artificial Sequence
  Synthetic
tgagttggatagtgcttctgatgacagcactgacaaggttatagaagccgatgtgtctgttgagtctgagagtgt

SEQ ID NO: 225382 - DNA, 75 bp, Artificial Sequence
  Synthetic
tgacacttcatccctaagcagtgcacccacagacagttccggggcaagcttccattttggtataatgaggtcact

SEQ ID NO: 225383 - DNA, 75 bp, Artificial Sequence
  Synthetic
aaccagtgctgaagaagagtactcaaaagtgattagtcagcagtttactggaggtgtgttagataaggttgagga

SEQ ID NO: 225384 - DNA, 75 bp, Artificial Sequence
  Synthetic
ggagatgatgctgacctatcaagataaccaagattatcctattgcaccatgcataagtaaactgctaaagtctgg

SEQ ID NO: 225385 - DNA, 75 bp, Artificial Sequence
  Synthetic
catggtaatctcaaatgtgcacttgaaagacctttgcgacaagccgctaaggttgattaagatagtcaccgcagt

SEQ ID NO: 225386 - DNA, 75 bp, Artificial Sequence
  Synthetic
ggttgattaagatagtcaccgcagtactgaactgtttgatagcaggccattacaggacattcacaagtgaaggta

SEQ ID NO: 225387 - DNA, 75 bp, Artificial Sequence
  Synthetic
actgaactgtttgatagcaggccattacaggacattcacaagtgaaggtacggagaaatctgtcaaagcacacct

SEQ ID NO: 225388 - DNA, 75 bp, Artificial Sequence
  Synthetic
gaatagagatgaaaacagaatgattgaggatcctatgatacaacttctacctgagaagctcagaagagagctcaa

SEQ ID NO: 225389 - DNA, 75 bp, Artificial Sequence
  Synthetic
caggttaggcctggccaggatggaggcagatgaacttatagctaaaccagacatcaaggacacactgagtaactt

SEQ ID NO: 225390 - DNA, 75 bp, Artificial Sequence
  Synthetic
acatcaaggacacactgagtaacttaatagccaacaagctaatcacaatgaactgtgcaacagaagactacaagt

SEQ ID NO: 225391 - DNA, 75 bp, Artificial Sequence
  Synthetic
cagaggtgctcagattaaaacagactctcacttcaagaaatgtgctgcatggactggctggtggtataaaagaac

SEQ ID NO: 225392 - DNA, 75 bp, Artificial Sequence
  Synthetic
tctcacttcaagaaatgtgctgcatggactggctggtggtataaaagaactgtcccttcccttgtacaccatctt

SEQ ID NO: 225393 - DNA, 75 bp, Artificial Sequence
  Synthetic
tatgaagtcttactttttcaaggatttggtgttccttgagcataaagatagatggaattccaagcacagtaccaa

SEQ ID NO: 225394 - DNA, 75 bp, Artificial Sequence
  Synthetic
ttaccgagatagtacagggaaggtgttggatggcaaggtggtcgttaaatacactacttggctagactgtttctt

SEQ ID NO: 225395 - DNA, 75 bp, Artificial Sequence
  Synthetic
ttggatggcaaggtggtcgttaaatacactacttggctagactgtttcttaagctctgaattaagtctaaatagg

SEQ ID NO: 225396 - DNA, 75 bp, Artificial Sequence
  Synthetic
tctactcctattgttagtgatagtttatttgatcctggactgaaaggcatcgaagtcattcacaaaagcaatgga

SEQ ID NO: 225397 - DNA, 75 bp, Artificial Sequence
  Synthetic
tcagtgctgacgaggaagagcagtagggaaacgcaccaccaaaagaacatcacatacagggtagatcggaagagc

SEQ ID NO: 225398 - DNA, 75 bp, Artificial Sequence
  Synthetic
ttagataatagagcaagaagggaagaaagaaagagagtggaatagatcggatatgcggcaacattatctttgaga

SEQ ID NO: 225399 - DNA, 75 bp, Artificial Sequence
  Synthetic
actttcgaattgcaggtgctccctgaagagattgaagttatagaatctgaaactagaagccttgcaattcaattc

SEQ ID NO: 225400 - DNA, 75 bp, Artificial Sequence
  Synthetic
tctcaaagatattgttcccccatatcccaaatcatcaacaggccatggaagcactaggtgacttggtgtgggagg

SEQ ID NO: 225401 - DNA, 75 bp, Artificial Sequence
  Synthetic
actgatgtcaatagacaaaagataaaggttgcagaaagccgtccggctaaacatgagctggatgcgcataaagct

SEQ ID NO: 225402 - DNA, 75 bp, Artificial Sequence
  Synthetic
gttatagtgaagtcaaagcttttttcggcgatagatcaagtaaaactagtgaataatccagcgatagttgttgga

SEQ ID NO: 225403 - DNA, 75 bp, Artificial Sequence
  Synthetic
aacttgcttgatgagacttcactcttccaaacgaagcctagaattgacatgggtaaccttggcagagatagcttc

SEQ ID NO: 225404 - DNA, 75 bp, Artificial Sequence
  Synthetic
aagcttactcaattttacagctctcttgtaaacttaatcagagaaataaataatgagtcggaaaccttaaggaaa

SEQ ID NO: 225405 - DNA, 75 bp, Artificial Sequence
  Synthetic
gagaaaatagtgccgtctgctgaactagtcaacagatatgctaacaacctaactgtactctgcaggatggtacaa

SEQ ID NO: 225406 - DNA, 75 bp, Artificial Sequence
  Synthetic
caggctagaagtaagcttaccagcttctacatgatgaaaggttcccatgtcaacaatgaacccacagttgtagag

SEQ ID NO: 225407 - DNA, 75 bp, Artificial Sequence
  Synthetic
ctgctcaactatggaatagtggagggaaagttttatgaagttcaggacgagattgctgacatgtcttcatatagt

SEQ ID NO: 225408 - DNA, 75 bp, Artificial Sequence
  Synthetic
gtcaagtactggaagatattgcagtgtgtttctgctatatcagtaatgcctctgaaagacaatgataaaactgct

SEQ ID NO: 225409 - DNA, 75 bp, Artificial Sequence
  Synthetic
ttctaaatgcctgcacccggcttctagtggttgtaaccagtgaactaatgtccttcttagatgcaagttatcttt

SEQ ID NO: 225410 - DNA, 75 bp, Artificial Sequence
  Synthetic
ctgctaactagcttccttaattggaagccttccgtcaatgagtgtgacagtgactgtcccttgagtagaagggaa

SEQ ID NO: 225411 - DNA, 75 bp, Artificial Sequence
  Synthetic
aaaagcgttctacaagaattcaatggcagagtgcttgtagatatactatcatctgagctgccatcaataaaaaat

SEQ ID NO: 225412 - DNA, 75 bp, Artificial Sequence
  Synthetic
gaggtccaaaggaagtctatagaagaccttgtggattttgtaaattcacctatggaattgcttcgtaagaaaccc

SEQ ID NO: 225413 - DNA, 75 bp, Artificial Sequence
  Synthetic
ttgttgaaactgaacaatcgcactctgtacaataccccttacaaactggtccaagaagtttcagttcctttgttt

SEQ ID NO: 225414 - DNA, 75 bp, Artificial Sequence
  Synthetic
tgtttgggaaccactgcaagtttcaattgttgggacaacggaggaaagagaggaaggttcacctactccagtagt

SEQ ID NO: 225415 - DNA, 75 bp, Artificial Sequence
  Synthetic
taagactcaagaccttgaagacaaagggtttgtatctgaagagctaaaagaactacatggctgtgtgcttcttgt

SEQ ID NO: 225416 - DNA, 75 bp, Artificial Sequence
  Synthetic
acaggagattcctcaggtgtatttatcggaccttatctttacatcgtcttatctaacaattctcctgctctctta

SEQ ID NO: 225417 - DNA, 75 bp, Artificial Sequence
  Synthetic
ctgcaggtcgagaagaaggtgctagagtggctaaacaaacgccgcactgatgtcatgaccagagagcagcatgag

SEQ ID NO: 225418 - DNA, 75 bp, Artificial Sequence
  Synthetic
tactttttagagttgctccctgactatagaatatttccgaagaaggtgggtgatgggaaaatattctccttgaag

SEQ ID NO: 225419 - DNA, 75 bp, Artificial Sequence
  Synthetic
cctagcagggaagatccgaaactaatgtgtttcctttccccaaaaaatggagataaggttgtcaaagtcaagaaa

SEQ ID NO: 225420 - DNA, 75 bp, Artificial Sequence
  Synthetic
aacatcttatcagttaaaaggaaagctgccgatgaaccattaggagagcctagggcagtctggtcaaacaacaac

SEQ ID NO: 225421 - DNA, 75 bp, Artificial Sequence
  Synthetic
atcacaattctctatgatgagcaggttgaaaaaacagattatcatcaggacttggtagctataaagaacctgcta

SEQ ID NO: 225422 - DNA, 75 bp, Artificial Sequence
  Synthetic
gatgatgtcctagggtctgatagatctaaggtcccttcatctgtttatgaagatacaaggattatcttatcaaga

SEQ ID NO: 225423 - DNA, 75 bp, Artificial Sequence
  Synthetic
gtgtttaagtctgataaagtgacaaaaaaggtggacagccaaagtgaccctttagtgaaaaagccagaccatgct

SEQ ID NO: 225424 - DNA, 75 bp, Artificial Sequence
  Synthetic
ataaggttcagcgcagacctcttcttaaagagccttctcttgcttcatcacttcttagcacacactccatctgct

SEQ ID NO: 225425 - DNA, 75 bp, Artificial Sequence
  Synthetic
gctgtactacaggcacagagtaagaccaaccttctaaagttcatagagtcttctgctgtcagcaattgccaaata

SEQ ID NO: 225426 - DNA, 75 bp, Artificial Sequence
  Synthetic
ccaaccttctaaagttcatagagtcttctgctgtcagcaattgccaaataggatctttggggaagaagatccaga

SEQ ID NO: 225427 - DNA, 75 bp, Artificial Sequence
  Synthetic
aaagtgtgttgagcatgattgcagaggaagtcacaggcatttcctccaaagaagagttaatctgtgctaaactga

SEQ ID NO: 225428 - DNA, 75 bp, Artificial Sequence
  Synthetic
tcagcaatatacagcttgagttcctacaaaggggcacaacggatacatatgattggaagtttaaggtcattcagg

SEQ ID NO: 225429 - DNA, 75 bp, Artificial Sequence
  Synthetic
gattggaagtttaaggtcattcaggaagtatcactctcacaaaggagtcaaggagttcgtggcataattagtagt

SEQ ID NO: 225430 - DNA, 75 bp, Artificial Sequence
  Synthetic
ataagctcagaagcaataccaaggtttctagcacctgtgatcatcgacggtattcttacacacaacattgtccag

SEQ ID NO: 225431 - DNA, 75 bp, Artificial Sequence
  Synthetic
atgtttataaattgcagaaatgtaatcagccgtacaggcatctctgacacagaattggatggtctggtatgctct

SEQ ID NO: 225432 - DNA, 75 bp, Artificial Sequence
  Synthetic
ctgtgagattaatccacagtgggttaagaatgttcattatgacttagggtcagatgtgtcggatgataacatctt

SEQ ID NO: 225433 - DNA, 75 bp, Artificial Sequence
  Synthetic
atagtattttgttcacagtctcttcctattgtaagagaaggacatagattcagcttcaataatttgctgcatctc

SEQ ID NO: 225434 - DNA, 75 bp, Artificial Sequence
  Synthetic
gcaaccaaaaagacatttgctacggctgatggttcgatatcctgcacatttcagaataatggagacgaagtccag

SEQ ID NO: 225435 - DNA, 75 bp, Artificial Sequence
  Synthetic
ctggctgttaaagtgagaactgtcaaacctgatgagttgacagagagcaagaaaaggaggattgaattaactaag

SEQ ID NO: 225436 - DNA, 75 bp, Artificial Sequence
  Synthetic
atgcgtatcttgacagcttacaacagctttctgccaccggtcacatcggtcagtgaaatattgagccacgtggaa

SEQ ID NO: 225437 - DNA, 75 bp, Artificial Sequence
  Synthetic
ggtgcatacgaagatccagtcaagaatactggcgaatattttaatcttgacttagggagaaaaacttctgaaggc

SEQ ID NO: 225438 - DNA, 75 bp, Artificial Sequence
  Synthetic
ggagcgaagaagtgcgagctaaaattgtgagaaaggttgaaatgttgggagaggtttccttgggattgttgaagg

SEQ ID NO: 225439 - DNA, 75 bp, Artificial Sequence
  Synthetic
cttagggagaaaaacttctgaaggctgtaggaccagagacctgtgggagttgatctgtccaggaactagctggag

SEQ ID NO: 225440 - DNA, 75 bp, Artificial Sequence
  Synthetic
tgtaggaccagagacctgtgggagttgatctgtccaggaactagctggaggagaaatgattttgaatcattgatg

SEQ ID NO: 225441 - DNA, 75 bp, Artificial Sequence
  Synthetic
cagataatatctctgctatctgctacaaagaaagctgaagtttgtgaagaagtgtcagttgaggatcctaggatg

SEQ ID NO: 225442 - DNA, 75 bp, Artificial Sequence
  Synthetic
aaagtagaatttcacgtctccagactatatatgcagctagttgtgtttgcctgcaatcacaaggtgaagtctaat

SEQ ID NO: 225443 - DNA, 75 bp, Artificial Sequence
  Synthetic
atggaggagcctgtaggtgctagtttcacttttaactgggatgattagtcagacagtaactgaagggggtgatgg

SEQ ID NO: 225444 - DNA, 75 bp, Artificial Sequence
  Synthetic
aagggggtgatggcaatgcagcacaatgaatagcagcagtaatgattcgggtatgggggaacaatatctttgaga

SEQ ID NO: 225445 - DNA, 75 bp, Artificial Sequence
  Synthetic
tctcaaagaaagacttgcggctacccgtaattcttgagagatggaaacttatcatggaagtagatacactgctac

SEQ ID NO: 225446 - DNA, 75 bp, Artificial Sequence
  Synthetic
cgtaattcttgagagatggaaacttatcatggaagtagatacactgctacttcttgtctgttctttgttatcatg

SEQ ID NO: 225447 - DNA, 75 bp, Artificial Sequence
  Synthetic
cttgttgttgctatcactgctgacaataatgtcacagaaactacaactgcagaggttgtcagtaatacaactgga

SEQ ID NO: 225448 - DNA, 75 bp, Artificial Sequence
  Synthetic
tctacagagggagatacaacttctaagggcatggacacaactcaaataccccaaatcaaccagacctcagcaact

SEQ ID NO: 225449 - DNA, 75 bp, Artificial Sequence
  Synthetic
accagatcaaataatattaccaccaagacatctagaagtgaaagtggagtagatccctccgccacccaaccgctt

SEQ ID NO: 225450 - DNA, 75 bp, Artificial Sequence
  Synthetic
ctagttagctcacaggcctccggcaccattggacaacaacgaggtctgtcgccaacaccagaccccggggccagg

SEQ ID NO: 225451 - DNA, 75 bp, Artificial Sequence
  Synthetic
aaaggcctcaagtacaacacaatgggtacaaagtccaacatcaataaaaccaaaacgttagaagatgcagagttc

SEQ ID NO: 225452 - DNA, 75 bp, Artificial Sequence
  Synthetic
attcgtgtaaagggaggaaagcggagggccgagaggttgactgcacgtctcgatgtcaacggcaacagagttgtt

SEQ ID NO: 225453 - DNA, 75 bp, Artificial Sequence
  Synthetic
ctgaaaagagagatttcaggtaatttgcaactagcaaaagagcaacttgaagaggcagtgctcaacatggaaatt

SEQ ID NO: 225454 - DNA, 75 bp, Artificial Sequence
  Synthetic
gacagcttggacttggaacagttagaggaagaatcgccttacagaagtatgcagagaactagactcatgttgccc

SEQ ID NO: 225455 - DNA, 75 bp, Artificial Sequence
  Synthetic
aagctagaaagctttgcttataatgaagagcaagaggaggacgttatggtaacagggaaattaagccgattcaca

SEQ ID NO: 225456 - DNA, 75 bp, Artificial Sequence
  Synthetic
cgctttgaaagaatcaacatagataagctggaatcaattacagtgtttcaaaatttaaccaacagatctgtactg

SEQ ID NO: 225457 - DNA, 75 bp, Artificial Sequence
  Synthetic
ggcaaattgagatacctgctgcatccatcaagaaaattctgaactcttttagatataagaacaaggacattaaag

SEQ ID NO: 225458 - DNA, 75 bp, Artificial Sequence
  Synthetic
accctatgcacctacttcggacattattacaacaagactcttaagggaacaactgtttctattcaccacaagtgc

SEQ ID NO: 225459 - DNA, 75 bp, Artificial Sequence
  Synthetic
gttattttttgcttatggacacaatggattacgatggcaagttcgcagaatatatggaaactgaatttctaaatt

SEQ ID NO: 225460 - DNA, 75 bp, Artificial Sequence
  Synthetic
taaattgctatgctacaagattgataggccggaaaacttcagcatcgtttgtaacacatatccgacacttaagct

SEQ ID NO: 225461 - DNA, 75 bp, Artificial Sequence
  Synthetic
acaaagctgttgttgaattacagaaatccaaactaaataaattatttccaggaaaacgacaaatcttgattgtaa

SEQ ID NO: 225462 - DNA, 75 bp, Artificial Sequence
  Synthetic
aactgatgatacctggaatccatacgacgtaaattcgtacgttagcaaccgagatgacttatcacttattgcaac

SEQ ID NO: 225463 - DNA, 75 bp, Artificial Sequence
  Synthetic
acgatccaacacatgagttcgacatccacgaaacaggctggttaactgacatctatcacagaacaccaacgcaga

SEQ ID NO: 225464 - DNA, 75 bp, Artificial Sequence
  Synthetic
taacggtataaaaggtaatccttctgaagccatccacctgaatactatttggcttgaagcttgtcagaccgagtt

SEQ ID NO: 225465 - DNA, 75 bp, Artificial Sequence
  Synthetic
ggttaatatggcttggtctgctcatcaatcgaaaactacgtcctgaggacaatctatcactgttgacagatccag

SEQ ID NO: 225466 - DNA, 75 bp, Artificial Sequence
  Synthetic
tgggatgacggagcccattgattataatgcgattaaacttgcaaacagttattcactcaagaatcaacgtaatag

SEQ ID NO: 225467 - DNA, 75 bp, Artificial Sequence
  Synthetic
atcttaaagctttggtcgagtactcaccagcatggtatccgtttgccttgcgaataaatcaagctttgaatgatg

SEQ ID NO: 225468 - DNA, 75 bp, Artificial Sequence
  Synthetic
tacatataatcacatcgttcaattcaatggactacatcctccgaacatcacttaatttcgtcatgacataagatg

SEQ ID NO: 225469 - DNA, 75 bp, Artificial Sequence
  Synthetic
gtctaaatctgaacggtaatgttgaggagtgttcttttgacagtaggttcatcaataacatcaagtttcccagac

SEQ ID NO: 225470 - DNA, 75 bp, Artificial Sequence
  Synthetic
cttgattcgttgtttagaactcttacttagttggtgcaggcgctacggcatgactgcttgtgatggtgactagcc

SEQ ID NO: 225471 - DNA, 75 bp, Artificial Sequence
  Synthetic
ctgagaatgactttctaggtttcaagtttataattgaagccgacacctttgtattattgaaagacgatcttggga

SEQ ID NO: 225472 - DNA, 75 bp, Artificial Sequence
  Synthetic
gttataaataacacgcacttcaggatggctaactattcactaccatggcttaccaatcccgtcgcattaaacggc

SEQ ID NO: 225473 - DNA, 75 bp, Artificial Sequence
  Synthetic
tacggcatgactgcttgtgatggtgactagccacgccagatcaagtagggatggcaccgttgaaataggaccgac

SEQ ID NO: 225474 - DNA, 75 bp, Artificial Sequence
  Synthetic
ttgagaaacctgacgttataagatgttggctgattgatactataccagaagaggttgagattagtggtgagacat

SEQ ID NO: 225475 - DNA, 75 bp, Artificial Sequence
  Synthetic
ggcatggacacgagcgcagctcgtcgattcgctcgcactactcggactgcagcccaaggactgaggcgtggggta

SEQ ID NO: 225476 - DNA, 75 bp, Artificial Sequence
  Synthetic
tcaagttaagggaagagatggtgaggcgggtcgcagacgaggctcccttgtatgcgttttgtgatatagtaaagt

SEQ ID NO: 225477 - DNA, 75 bp, Artificial Sequence
  Synthetic
gaggaggcacttcgatccggcaatgagtcggaattcaacaacgcttacctgatatactcaggtcagctgtcttct

SEQ ID NO: 225478 - DNA, 75 bp, Artificial Sequence
  Synthetic
actgtcttactgaggttgatttcacaaacattgcaatcaagcagtggttgaattacttcgtacgaaagcgtgatt

SEQ ID NO: 225479 - DNA, 75 bp, Artificial Sequence
  Synthetic
aacgttaacccgaatgatggaggtgagcgctcggatgtacttcgccggttgataaccgcaaccagcgcagtagtt

SEQ ID NO: 225480 - DNA, 75 bp, Artificial Sequence
  Synthetic
tcttccggttcaatggtaaagatatggtctgttccagttcgctcatagctcataaacggttcgaggtggccctta

SEQ ID NO: 225481 - DNA, 75 bp, Artificial Sequence
  Synthetic
aatccggccactgtagcacagaatgagctgatccgattgggtcagagactaaattcaagtgattcagcggctcgg

SEQ ID NO: 225482 - DNA, 75 bp, Artificial Sequence
  Synthetic
gtcatcaacgatgtagctcgaagttctcaaggttagatgaagagggatttgaatgtctcactgaaggtgctctct

SEQ ID NO: 225483 - DNA, 75 bp, Artificial Sequence
  Synthetic
tcagattacgtcgtttacactccaatcatgcgggttgatgctccagctggactgactgtctttctttcgggacac

SEQ ID NO: 225484 - DNA, 75 bp, Artificial Sequence
  Synthetic
atatcatgccggatccaatatttcggtcacacatgttgaggtcaccatttggtgatcttaatcagcacgtatttg

SEQ ID NO: 225485 - DNA, 75 bp, Artificial Sequence
  Synthetic
aagactgtttgcgtcgatgtcaataatgccggaccagccaatcttaatctaaccatttcgtattggcgtggaagc

SEQ ID NO: 225486 - DNA, 75 bp, Artificial Sequence
  Synthetic
ctagaactgtgggtcctagtatagtatggagccgttctgacattgaatcaactaacttcagtctgagtatagaac

SEQ ID NO: 225487 - DNA, 75 bp, Artificial Sequence
  Synthetic
agtctgtttatcagctgtcagaccccgtttgttcatagtcgtgcaggtggagcaaatcaaaacgcggttaatgca

SEQ ID NO: 225488 - DNA, 75 bp, Artificial Sequence
  Synthetic
ctgttccagtcgactattcccaaaataggtttaattatgttgataacgaaaacacgaaagaagtcgttgagagct

SEQ ID NO: 225489 - DNA, 75 bp, Artificial Sequence
  Synthetic
gttatgttgacttccgagaatgccggtgcttacaacttcaacatcccagcaggcacacgtctggttttcgaggtt

SEQ ID NO: 225490 - DNA, 75 bp, Artificial Sequence
  Synthetic
tacgcacaatgggaatgcccaagaacgctcgtttattgtacaatctacagaccgccgtcatcaacccaactaata

SEQ ID NO: 225491 - DNA, 75 bp, Artificial Sequence
  Synthetic
tcaggaacatcgtccgtcagtatcgattcgggctctgacttcacgaaggcggaacgtggatatcagagagcgaag

SEQ ID NO: 225492 - DNA, 75 bp, Artificial Sequence
  Synthetic
tgttgaagggtaaggtcaaccgtatgatattagctatgtgtggatacacaggtactcatgctgctactgctttag

SEQ ID NO: 225493 - DNA, 75 bp, Artificial Sequence
  Synthetic
gctgacggattgattgctaacaccatcttgtatccaagtctggatatgtggatggcgactatgcgatatgttttc

SEQ ID NO: 225494 - DNA, 75 bp, Artificial Sequence
  Synthetic
tcaaccagtttaaaggtacttcggacatgggtgaagctgttactgacagttttgccgttagagtggctgataata

SEQ ID NO: 225495 - DNA, 75 bp, Artificial Sequence
  Synthetic
ccgaacactgactcaaccattgccttgatgattatgttgttggagtcgtacgaggacgctaatgttgccctcagc

SEQ ID NO: 225496 - DNA, 75 bp, Artificial Sequence
  Synthetic
tgttcgattacataaacataggatttgcaaaggatggtatcaaggacatatcagctactccggacatactgttca

SEQ ID NO: 225497 - DNA, 75 bp, Artificial Sequence
  Synthetic
ctgcgtatgaatagataagctgcttcaatcccctcgtcgctagtccatagttacattcccgctttattagttatt

SEQ ID NO: 225498 - DNA, 75 bp, Artificial Sequence
  Synthetic
aaggaggaacttcttcagctagtagtactaacacgtttaagagtatatctggcccggtaaagtattactcaccct

SEQ ID NO: 225499 - DNA, 75 bp, Artificial Sequence
  Synthetic
attatctagtcttacgccgtcacgttaatagtaatattaatgatgatttaatcgtaaaattaccgtgaagaagtt

SEQ ID NO: 225500 - DNA, 75 bp, Artificial Sequence
  Synthetic
tcttgacggatgaagacgttgatgataagacagtttttggtacgagtggttctaagaagttggttctgacgagga

SEQ ID NO: 225501 - DNA, 75 bp, Artificial Sequence
  Synthetic
agtcatctaagcgttgccggagttgtgagtgggggcgggccttcgatccattgggcccgtttcacttccgaggct

SEQ ID NO: 225502 - DNA, 75 bp, Artificial Sequence
  Synthetic
ttgtgagtgggggcgggccttcgatccattgggcccgtttcacttccgaggcttccgatgtcatgttgaaccgac

SEQ ID NO: 225503 - DNA, 75 bp, Artificial Sequence
  Synthetic
tatcacacaagttacggagtaagaacgccaatataataactaaccctgagaattttctaaacttcagtgctgacg

SEQ ID NO: 225504 - DNA, 75 bp, Artificial Sequence
  Synthetic
gttattttaaccttacatcatgtcgaagcctcaaactattccgagaacgcgatcgcaggtcgttggattgacctc

SEQ ID NO: 225505 - DNA, 75 bp, Artificial Sequence
  Synthetic
cattggatgaggttgtgaatgcaggctctcgattagttagaggaactagggctaaacgtataatcactcctaatt

SEQ ID NO: 225506 - DNA, 75 bp, Artificial Sequence
  Synthetic
caagatcaaggatttcaccaagagtgtagagaagacaaccctcctgactcaagctgagttgaagaaacaacatcg

SEQ ID NO: 225507 - DNA, 75 bp, Artificial Sequence
  Synthetic
atggttcgatatatgctaattctctgtgcaccgttctacccgctgttcgactcttaagtaatagaccgaagaacg

SEQ ID NO: 225508 - DNA, 75 bp, Artificial Sequence
  Synthetic
tcatctgctttctcaacaacccgaactgtttagtggattggtcaaattgtatgttgataatgtagctaagtttga

SEQ ID NO: 225509 - DNA, 75 bp, Artificial Sequence
  Synthetic
ttctagctaatactctcgaaggtatagttggtactacttatactggtgccctaccacatgacgtcatggccccat

SEQ ID NO: 225510 - DNA, 75 bp, Artificial Sequence
  Synthetic
aaggatcgtccgtttgtatggtggtcaaggtagcagacattcgatttcaagtgttggtttcagtcatctgattga

SEQ ID NO: 225511 - DNA, 75 bp, Artificial Sequence
  Synthetic
tcatgtgcgctactactaatgacccgagttacttcgctgcggcttttgattttgcccaattcgattctagtcagt

SEQ ID NO: 225512 - DNA, 75 bp, Artificial Sequence
  Synthetic
atactgtaataactatgaattaccagatgatgactcaacgcttaaatcgatttgtttcgctatcttccagattca

SEQ ID NO: 225513 - DNA, 75 bp, Artificial Sequence
  Synthetic
atggtcgtatttcagacgcccacgctgatggagtacgacgtttcgccgataaattcacaggtgacgaggtaaatg

SEQ ID NO: 225514 - DNA, 75 bp, Artificial Sequence
  Synthetic
ctcgaatgatcttagaaatggtggagcgaatgctttgttcacaattgcagctgagtattttaataagccagaagt

SEQ ID NO: 225515 - DNA, 75 bp, Artificial Sequence
  Synthetic
atgttaaagggcggttagaccttatgtcgttaaagagcaagttcataattcagtccgagtcgtaccgtagaccac

SEQ ID NO: 225516 - DNA, 75 bp, Artificial Sequence
  Synthetic
caagactatcgttggcgagcacatcaaaattaaatcatgtaataaggtacccgttgcaattgttaacttaaaggc

SEQ ID NO: 225517 - DNA, 75 bp, Artificial Sequence
  Synthetic
tgaagtataagtctaaagggatcgtggctgaagcttcaggggtcaaatcgggtgagttaactacccaattacgta

SEQ ID NO: 225518 - DNA, 75 bp, Artificial Sequence
  Synthetic
attgactcaggttattccgtatcgtggagtgaaagcattaaggactaagctgcttgaaacacaagatgatgtagc

SEQ ID NO: 225519 - DNA, 75 bp, Artificial Sequence
  Synthetic
acacagctacgaataaaggtcatacagacgaagtattgaatagatttaatcaattaagtagacgtaagataagaa

SEQ ID NO: 225520 - DNA, 75 bp, Artificial Sequence
  Synthetic
actggaacacatcggctctttctataatacatgcaaaattaacggtgagttcgacgccgttagtttctgtggact

SEQ ID NO: 225521 - DNA, 75 bp, Artificial Sequence
  Synthetic
tcaaatctgagaatataatcggtgacgataagaatattgtattctcactcgaggatggtcgacctttagattcaa

SEQ ID NO: 225522 - DNA, 75 bp, Artificial Sequence
  Synthetic
gaagttgagacagagctgtgttataacagtagctggacacgccatcgacgttggcccggactattaccgccaaat

SEQ ID NO: 225523 - DNA, 75 bp, Artificial Sequence
  Synthetic
gtactgctaaattattaattgaagtagctcgtgatgtagctcaagagaaccacatggaattgtcagctaaaagga

SEQ ID NO: 225524 - DNA, 75 bp, Artificial Sequence
  Synthetic
gttagctgaagtcacagcattgcttaaactcaagaggaaggtagggtcagtcgttatgcatggaaataatcaatt

SEQ ID NO: 225525 - DNA, 75 bp, Artificial Sequence
  Synthetic
ctgtagttggaaactgtgtcactgaacacattaagatatttgttgctcgagggttcattatgcaagacgtcttcc

SEQ ID NO: 225526 - DNA, 75 bp, Artificial Sequence
  Synthetic
tggattcgtcaagccattggatgcttcacagacacaaagcgttacccaaatccgtaaaatactgaatgatgctag

SEQ ID NO: 225527 - DNA, 75 bp, Artificial Sequence
  Synthetic
tagatagtttcgcttcggaaaagaatagcttcaggtcaatgtcttacgctgatcgtctcaatacgatttatgaca

SEQ ID NO: 225528 - DNA, 75 bp, Artificial Sequence
  Synthetic
tagggctagttttatcaatatcaagaatgccgcaaacagagatgagatggtatacgcttatgagaactgtttact

SEQ ID NO: 225529 - DNA, 75 bp, Artificial Sequence
  Synthetic
tattcatgacgatgttaatccgcttcgcacaggccaaaccgttaatggacttgatgattaatgacatgtgtttga

SEQ ID NO: 225530 - DNA, 75 bp, Artificial Sequence
  Synthetic
ctactacatcaccatacctaatactggtaacaaatcacactgtatacaggcactaaatctgtctggacttcttga

SEQ ID NO: 225531 - DNA, 75 bp, Artificial Sequence
  Synthetic
tggatggacttaagtcaggtagggttacattcattccaactctgggaaatctgtttgctataggtgggcctgaga

SEQ ID NO: 225532 - DNA, 75 bp, Artificial Sequence
  Synthetic
acacagacttttacactacggatctttaggtacaaagtgtagagatccgagttgtggagtcatcggtatagatag

SEQ ID NO: 225533 - DNA, 75 bp, Artificial Sequence
  Synthetic
tgttggttggagctccagaaataagaggcatggccaggtttatgcatagatttgatagtgagtattttagcgtaa

SEQ ID NO: 225534 - DNA, 75 bp, Artificial Sequence
  Synthetic
acctgaactgtactctgagctgaaccgtatcgttgagaacaccacaattaaagatagagctgacgctatgcttga

SEQ ID NO: 225535 - DNA, 75 bp, Artificial Sequence
  Synthetic
tgaatgatctatatgctacacttcgagataattctggtggtaagaagttcattgatgatttgaccaattcagcca

SEQ ID NO: 225536 - DNA, 75 bp, Artificial Sequence
  Synthetic
gatcaatgctgacgaagtttcgtcagttaaatcatccaactcgaataaatcatcgaataagagtaaatacgtcag

SEQ ID NO: 225537 - DNA, 75 bp, Artificial Sequence
  Synthetic
ctgatgatctggtcaaccagttctggataaaccactttaagaggaagaacaactatgatgttagtcttgatactc

SEQ ID NO: 225538 - DNA, 75 bp, Artificial Sequence
  Synthetic
gaactctattgataagggtcacaaccttactgatttgagtgatgccaatggtgatcgatactctcactattcaca

SEQ ID NO: 225539 - DNA, 75 bp, Artificial Sequence
  Synthetic
gtatagctaataaacgtcaactgcagaatctaatccccgagaattgtaaggtacgactgcttaaaatggttctgg

SEQ ID NO: 225540 - DNA, 75 bp, Artificial Sequence
  Synthetic
aatgggaaaaccaagtggtagtgaaatcggcaagttcatcacagctgaagcggttaagggtatatctgattcaac

SEQ ID NO: 225541 - DNA, 75 bp, Artificial Sequence
  Synthetic
atacggttaaagaacctgtaatacaaataatgaacgatactatgtctctggttaacataatacaaagaggtaagt

SEQ ID NO: 225542 - DNA, 75 bp, Artificial Sequence
  Synthetic
tttaaacacaactgaactgaatcttaaattggcgatgctccaagcgtctcctgccacatctagcagatctaaagt

SEQ ID NO: 225543 - DNA, 75 bp, Artificial Sequence
  Synthetic
tgactaagtattccaagccaaagtatcattatgtaagttggttcatacggtcgtacaatggtgttaaatatatat

SEQ ID NO: 225544 - DNA, 75 bp, Artificial Sequence
  Synthetic
tgaaacggataatcagcctaatcccattcagcccaaggacattaagccggttcagaagtcatctgatgaattaga

SEQ ID NO: 225545 - DNA, 75 bp, Artificial Sequence
  Synthetic
caccttatttagccgctgacgatggagttaagaacgtacataccatcgtgggtttagctgaaaggaatacatcaa

SEQ ID NO: 225546 - DNA, 75 bp, Artificial Sequence
  Synthetic
agagatatagtgatacttgtgtgttatccaataaaactatgataacagacgatgccgcgatacttcctcgggttc

SEQ ID NO: 225547 - DNA, 75 bp, Artificial Sequence
  Synthetic
taccggaatctgtagaaccgattaataggttgttacgtaagtatcctcatatgcatccgagctatattggtggca

SEQ ID NO: 225548 - DNA, 75 bp, Artificial Sequence
  Synthetic
gtgtcataagcgccttcaacatgggcgtcttgtgcctcgtccgtttgtttggttagacaagtacggcctggtcga

SEQ ID NO: 225549 - DNA, 75 bp, Artificial Sequence
  Synthetic
gttattttttatcaacttgaacttactggtgtgtttgtttttgaagagcttcgaagtttaaacccgaaaatgaag

SEQ ID NO: 225550 - DNA, 75 bp, Artificial Sequence
  Synthetic
tggacattcttagtgttttgagtgaagtggattcaggtatgtggagggattgtctcttggctcttgactttagag

SEQ ID NO: 225551 - DNA, 75 bp, Artificial Sequence
  Synthetic
cgtcttgtgcctcgtccgtttgtttggttagacaagtacggcctggtcgaccgtacgatgctgaagttactcgac

SEQ ID NO: 225552 - DNA, 75 bp, Artificial Sequence
  Synthetic
ggaggaagaatcaatgccgtagccactttcactggctccggctgtagtaacagacatcctttttgtttgcatagg

SEQ ID NO: 225553 - DNA, 75 bp, Artificial Sequence
  Synthetic
aagatatcattcaaccgttattggtactggttgacaacgtgatgttcaggtatctgcatgaacgtaatgtcacat

SEQ ID NO: 225554 - DNA, 75 bp, Artificial Sequence
  Synthetic
attgtagcgataacagtagtaatcataaccgtatcgattggtttagtcgaccagttgtcagaaaagttagcatca

SEQ ID NO: 225555 - DNA, 75 bp, Artificial Sequence
  Synthetic
caacctctctgtatgataatacctcaaggacttatgacgtatctgactctaacttaaataagttggttcacgtag

SEQ ID NO: 225556 - DNA, 75 bp, Artificial Sequence
  Synthetic
caccgagtaatagtaataaacagtctcttggatggagatttgaaggaatgaaagtcgttttatacatggcaagat

SEQ ID NO: 225557 - DNA, 75 bp, Artificial Sequence
  Synthetic
ggtatgactagtccaggaaagaagacgtacgcgcatgaacatcatgaagctacagctccgatgctcggagacaca

SEQ ID NO: 225558 - DNA, 75 bp, Artificial Sequence
  Synthetic
atggacatatggttagtgtgtctcacgagccactcgtggttgacggagatactgtaaactcgtcttatataacag

SEQ ID NO: 225559 - DNA, 75 bp, Artificial Sequence
  Synthetic
gagtatgtatacgttaagaacaacaattccgacctaccaaatacaggtgacatcgttaagcctaatcaacttaac

SEQ ID NO: 225560 - DNA, 75 bp, Artificial Sequence
  Synthetic
tatataacagctctataaaattgcaattttatcattcgacaatgctgtcgtgtgtcgtcgcaagaaagctctgac

SEQ ID NO: 225561 - DNA, 75 bp, Artificial Sequence
  Synthetic
gttatttttgttaggatgagctcgcgtaaccgtagatctaacatgaagaagaacaagcaaaacgcagcaaagaaa

SEQ ID NO: 225562 - DNA, 75 bp, Artificial Sequence
  Synthetic
gatgatccgaacagaattaagattataaacataaacactggttcagagaagatcgtcactaaggattgagtcgct

SEQ ID NO: 225563 - DNA, 75 bp, Artificial Sequence
  Synthetic
gaagagaatgtcgttgaagattcaggctctgtcagccattcccgactcatgtcggttatggggaaagaggctttt

SEQ ID NO: 225564 - DNA, 75 bp, Artificial Sequence
  Synthetic
cgaagccgacgacactatcacccatgcatttacaattaaactaagcatatttaaccaagcaacactcacaacttt

SEQ ID NO: 225565 - DNA, 75 bp, Artificial Sequence
  Synthetic
gattcattgatggcagcgctagctatcagagaagttccacgtaatacagatccaattctgggaagcatcgcaacg

SEQ ID NO: 225566 - DNA, 75 bp, Artificial Sequence
  Synthetic
gttatttttattcaaagactgtttgagctacaacctgaacctgcttgactagattgcgcgacgatttattcaaca

SEQ ID NO: 225567 - DNA, 75 bp, Artificial Sequence
  Synthetic
tcgagtatacagtataaagatgtagctggtccacagcccgcagatagagataacgccgttaaggagggtaatctt

SEQ ID NO: 225568 - DNA, 75 bp, Artificial Sequence
  Synthetic
caagcatttatcagtacttagtttctttcaaccgcaattcaaaatagtaaaataagtattttgatttattccatt

SEQ ID NO: 225569 - DNA, 75 bp, Artificial Sequence
  Synthetic
ccaccagccgaacttaaaattcctgctgacactactgttgtagcggggcgtttggctacgatggttactgatcca

SEQ ID NO: 225570 - DNA, 75 bp, Artificial Sequence
  Synthetic
ataccatttagttataataccgtgactttgggacaattattagttattaagcgtaaacatagtatttgaggatca

SEQ ID NO: 225571 - DNA, 75 bp, Artificial Sequence
  Synthetic
atgacgactaagaatcaaactgaagtagttgacaagctcagagccgcaatgtctgatggcatggctaaagacatg

SEQ ID NO: 225572 - DNA, 75 bp, Artificial Sequence
  Synthetic
ttcaacttaatatatacattacttaaaacattctacttaatctacatatttactgttctcgaaatgtatcaacag

SEQ ID NO: 225573 - DNA, 75 bp, Artificial Sequence
  Synthetic
ccgacgcgtgaggttcaagttgatatttctcgaggtgttgatcaggctagtattgatgcgcaacatcaggttctg

SEQ ID NO: 225574 - DNA, 75 bp, Artificial Sequence
  Synthetic
attgacttcaacgcagttgactacagcgtactctacaatccgggtggccagctggtccaaccaaccgccatcgtt

SEQ ID NO: 225575 - DNA, 75 bp, Artificial Sequence
  Synthetic
atggctatgacaaggcagactccaaatgtaatcaaagagcttaagaaggatactcgtaaaatcagaaagcttgaa

SEQ ID NO: 225576 - DNA, 75 bp, Artificial Sequence
  Synthetic
ggatcacctgtccactatgaagctgtttatcccacaccaatgttgccttacactgccgtaccgaccgtcacttca

SEQ ID NO: 225577 - DNA, 75 bp, Artificial Sequence
  Synthetic
ataggtcctaccaacctggagatcatcacatctagtctgggtcgtgaatcaattattctagaaagattcccattc

SEQ ID NO: 225578 - DNA, 75 bp, Artificial Sequence
  Synthetic
atgatggaccatctggctgtcgaagtggccggttcttcttccggtttctcatccgatggctgtttgaacgtagat

SEQ ID NO: 225579 - DNA, 75 bp, Artificial Sequence
  Synthetic
atagagatacttaattcagtagaactcactgttcagttagctatgttggcctccagattgataagaacttatcag

SEQ ID NO: 225580 - DNA, 75 bp, Artificial Sequence
  Synthetic
ctcggacttcagcaagagaatcactctttaaagaaggagatctccgatctaaggtctgaagttgagagattgact

SEQ ID NO: 225581 - DNA, 75 bp, Artificial Sequence
  Synthetic
ctagacgatcctgtcgttcttgactcacagggaaactatgtcactcagccttttgaaccgggaaccaagttcacg

SEQ ID NO: 225582 - DNA, 75 bp, Artificial Sequence
  Synthetic
gctgagaacaacatgttacgttctcatgtttgtgaacgtatgaatactaatgaagtcgttggaatagcagacaag

SEQ ID NO: 225583 - DNA, 75 bp, Artificial Sequence
  Synthetic
aaggacggtcttagctactctcagatagtcgacgctctaaatgccaagcgtaattacagtaatgaagcgcgtctt

SEQ ID NO: 225584 - DNA, 75 bp, Artificial Sequence
  Synthetic
gcaacaaagtgtgtagataagtttcaagctcattgggacatgatgttaagatctggtaatactgtacagcataaa

SEQ ID NO: 225585 - DNA, 75 bp, Artificial Sequence
  Synthetic
atgccggctgaagttatggctataatgagatcagctcttatcgttgataatcgtgatggacgtagtgtcacttct

SEQ ID NO: 225586 - DNA, 75 bp, Artificial Sequence
  Synthetic
ggattaaaactagatagtgtattactagcacggattgatactctctatcgtttaaagatcaaacaacccagctct

SEQ ID NO: 225587 - DNA, 75 bp, Artificial Sequence
  Synthetic
tgctttgatggacgtatcaagaatagtattatacaattgggagctagagtgtggggccgaaacatcattaagttg

SEQ ID NO: 225588 - DNA, 75 bp, Artificial Sequence
  Synthetic
catcctttaataaggtcttactttccagacgctgttgataatgaggttctttacgactatgttcgtatcaacaat

SEQ ID NO: 225589 - DNA, 75 bp, Artificial Sequence
  Synthetic
actgattacatggaattgcttagagctgagattccagccaactaccgattgaaagaatattccggactagaattg

SEQ ID NO: 225590 - DNA, 75 bp, Artificial Sequence
  Synthetic
cacttcacttttcttaaggactgttataacagggtattaaatgatattaatccaaatgatctcctcaatcgtgcc

SEQ ID NO: 225591 - DNA, 75 bp, Artificial Sequence
  Synthetic
catcgtggatatgtttattatcaacctaggcatggatcactccgtgtactgatcgaactacttaagcgtgaatgt

SEQ ID NO: 225592 - DNA, 75 bp, Artificial Sequence
  Synthetic
atagaactttgtgccttattacatttttcagggtttaacgctgagaatgtgacagctaacaatttacgtcacttg

SEQ ID NO: 225593 - DNA, 75 bp, Artificial Sequence
  Synthetic
tcggaatattttcttcctctgataactcgggaacttgctatcgttaagtctgaaatcgtaacaactggtagtatt

SEQ ID NO: 225594 - DNA, 75 bp, Artificial Sequence
  Synthetic
gccggcagaaaatatgaacatgacattatttctaactcttatccatataaagtagacatgctcgaaaatgacacc

SEQ ID NO: 225595 - DNA, 75 bp, Artificial Sequence
  Synthetic
caacaacttataagttctgacaacaacgtatcaatcagccgttcctcttatgccaatcaacttctagcttcactt

SEQ ID NO: 225596 - DNA, 75 bp, Artificial Sequence
  Synthetic
aaagttaaggatcatatatacggtaaacatgacattgatattaatgatctgaccatcttacaccttatgagtcat

SEQ ID NO: 225597 - DNA, 75 bp, Artificial Sequence
  Synthetic
gatctgagtagcaatgagaaggtacgtacgtacatcatcatggctagtatgttcaagaattttaagcttgatgtt

SEQ ID NO: 225598 - DNA, 75 bp, Artificial Sequence
  Synthetic
ctctcggttaacgttactggaactaaccttgctaggtatcacgttggtaattcatgtcgtattactgaaagttca

SEQ ID NO: 225599 - DNA, 75 bp, Artificial Sequence
  Synthetic
gaatatggtcaaattccgaacattattgattgtatggcggcaacattttacctgctatttataggtgaggacaat

SEQ ID NO: 225600 - DNA, 75 bp, Artificial Sequence
  Synthetic
gtgcttgagttacctgtaggtgacgagactcgttacttcaaaccactcaagtgttctggaccatatgccatattc

SEQ ID NO: 225601 - DNA, 75 bp, Artificial Sequence
  Synthetic
attaccgactccagctacacatcctctctgctgacgatagccagtttcattaagaacagaccgattgacgcatta

SEQ ID NO: 225602 - DNA, 75 bp, Artificial Sequence
  Synthetic
gaacgattaccatgtgagaaggattatcgtgttaacggcctactccatcattttggagttgttcctataacatta

SEQ ID NO: 225603 - DNA, 75 bp, Artificial Sequence
  Synthetic
ccatggactgatcccgctcaactgagaaatgaactacgtatggcttcttggcccttcgtcgaacgtaacacacct

SEQ ID NO: 225604 - DNA, 75 bp, Artificial Sequence
  Synthetic
gttcgtgacatagtcgagattgaacccataatggaggattattttatcagtggcccagtcggaccgtccattacg

SEQ ID NO: 225605 - DNA, 75 bp, Artificial Sequence
  Synthetic
gttcaatttcgagttaggtattcaccgatcatgtctgatggagaacctggtctttacaacggagctttcaattgt

SEQ ID NO: 225606 - DNA, 75 bp, Artificial Sequence
  Synthetic
tgccttatgaaaacatacgctttaaatcatgtggaaatagtatttggagagaagggactatatgttagaccgacc

SEQ ID NO: 225607 - DNA, 75 bp, Artificial Sequence
  Synthetic
aattccgatcgtcaacacaccatgagggatttgtcaaacatcatcagtaatatgtccaataatagatggcgtgtc

SEQ ID NO: 225608 - DNA, 75 bp, Artificial Sequence
  Synthetic
ggatctaaagatctgtctaaaaccgatgactgttgtcgtcaagcctttgctctaaacaatgaacgaaccagatgt

SEQ ID NO: 225609 - DNA, 75 bp, Artificial Sequence
  Synthetic
ggcaacagtaatcaacttggtactttgatgtcaaccacaatcagttcggcttatactctaatcatgaaatcagta

SEQ ID NO: 225610 - DNA, 75 bp, Artificial Sequence
  Synthetic
cacaaacaacttaaaccaggcaaacgtaacaagaagtctacctcacggaataccaataaaacgaagtaaattaat

SEQ ID NO: 225611 - DNA, 75 bp, Artificial Sequence
  Synthetic
agttcatacaatgatgtcatcagtcgtgtccgtggtggactgcctaatgctttggctaccggacttgactattca

SEQ ID NO: 225612 - DNA, 75 bp, Artificial Sequence
  Synthetic
aacccagggtgtcgaaccacggttaataaaacattcggaataaacaaaattgggagttacacaataccaccaaaa

SEQ ID NO: 225613 - DNA, 75 bp, Artificial Sequence
  Synthetic
agaggtggttataaagtatcatcgattcaagttgtttcctatttcttgtctctgagtcccttgagtatgacacct

SEQ ID NO: 225614 - DNA, 75 bp, Artificial Sequence
  Synthetic
caaaaccaaagcttctgcaatcaagtcaagatgtgagtctcagaccgcaggctttaagtccacgagtaacccgac

SEQ ID NO: 225615 - DNA, 75 bp, Artificial Sequence
  Synthetic
agtctgtacgatagcattgataccatggcttgggaaaacctcaaacagtatgaagacttggctaatgatatagac

SEQ ID NO: 225616 - DNA, 75 bp, Artificial Sequence
  Synthetic
gttatttttgtaagattatccttttcagccatgttgcgatttcaagatgataattctattccttcgaaattcatt

SEQ ID NO: 225617 - DNA, 75 bp, Artificial Sequence
  Synthetic
cgtactctgatcatggcccgttccataatgagggttgaaaggccagaagaagcaccgatcatgtcatatgtcaat

SEQ ID NO: 225618 - DNA, 75 bp, Artificial Sequence
  Synthetic
tctgaggtgaatggaacggtcttgagatatgtcaccatcgatcatgacggcactggttttcggaaatcataccca

SEQ ID NO: 225619 - DNA, 75 bp, Artificial Sequence
  Synthetic
gggatgtcccgagttatcgatgagtgttggaatgactcaagcaagtacaattacatcagtcgtactatggaatca

SEQ ID NO: 225620 - DNA, 75 bp, Artificial Sequence
  Synthetic
aacattaacgaacgtttgtactatgcacttggcgatgcttatgaagctggagttgaacagagaccacttttgatt

SEQ ID NO: 225621 - DNA, 75 bp, Artificial Sequence
  Synthetic
ttacttgcagctgctcaactcagtggtaaagaaggctataaacacctcttgtacgagatgatacgtaaacaacag

SEQ ID NO: 225622 - DNA, 75 bp, Artificial Sequence
  Synthetic
acgaatgaagagactaagtattttaggaacatcggatttcttgaagtaggtgaagagtctactgacagtaagacg

SEQ ID NO: 225623 - DNA, 75 bp, Artificial Sequence
  Synthetic
catgacgtaattaatgaacccctggctgagatcactgatggtgtcattaacatattgaggaataacttgggtgct

SEQ ID NO: 225624 - DNA, 75 bp, Artificial Sequence
  Synthetic
gcgtacctgagacgtgcttttgtacgtgattataatgatataattggagtagaaccaaacggtttaaaagcattg

SEQ ID NO: 225625 - DNA, 75 bp, Artificial Sequence
  Synthetic
tttggaattacttacagtattctgatttatccaagtaatgctggtattgttcgtgatgctagattcgataacgtg

SEQ ID NO: 225626 - DNA, 75 bp, Artificial Sequence
  Synthetic
agtaaatctagaaatgggttgaatatctacgatatgtatgattatatcacgacttttgatccaataagtgatttc

SEQ ID NO: 225627 - DNA, 75 bp, Artificial Sequence
  Synthetic
ttcagacggtctccattcgtagccactatgcccgtcgaaacttacccaagtatcacctaccacgagttgatgttg

SEQ ID NO: 225628 - DNA, 75 bp, Artificial Sequence
  Synthetic
aagcggcactgtgttcaacgctggaaactaagttatccgccggatctggaatctattcaatataagctggccaca

SEQ ID NO: 225629 - DNA, 75 bp, Artificial Sequence
  Synthetic
tcaagagatttcgctcggcaaataagcaggggagtgattgttaccggagttccttttcagtatacacttgaattt

SEQ ID NO: 225630 - DNA, 75 bp, Artificial Sequence
  Synthetic
agctatgatctaaattacaaacgcatgttcaatgaaaacatcacgttagaagaaactaagatagaatctcaatta

SEQ ID NO: 225631 - DNA, 75 bp, Artificial Sequence
  Synthetic
aagaacggtaacttcaattcttatttgaagaatgaagtcatatcagtcactaagtcaggaccagtcatcaataag

SEQ ID NO: 225632 - DNA, 75 bp, Artificial Sequence
  Synthetic
gataagttcacacaatgcacctatgaaaagacatcatatcatatgaatggaaataacattaagactgaaggctta

SEQ ID NO: 225633 - DNA, 75 bp, Artificial Sequence
  Synthetic
atcgaatttgtcatcggatttaatgatgaaccacagattgaggctgaatatgctgatatacttgatcgtaattac

SEQ ID NO: 225634 - DNA, 75 bp, Artificial Sequence
  Synthetic
tttggttttagccctaaattatcatttgctcaacagaacggtagacttaagaacgaatatgttactaaagggtta

SEQ ID NO: 225635 - DNA, 75 bp, Artificial Sequence
  Synthetic
gggattgctattccgactccaccaaatatagatttaatcgtggattataaccgtagtcttgttagatacgataat

SEQ ID NO: 225636 - DNA, 75 bp, Artificial Sequence
  Synthetic
ataatgactcatcataagtacatatttattggtgattcacccgggccacattataatgaatatagcaaaatattg

SEQ ID NO: 225637 - DNA, 75 bp, Artificial Sequence
  Synthetic
gctgatagaaacgctttgtacattgaggatcacaccttggtttatactagaccataaggtgtctgagtcttcaac

SEQ ID NO: 225638 - DNA, 75 bp, Artificial Sequence
  Synthetic
aatccgaataattgtattagttatgatcctagagacctaagttacagtagtttaacaacacattataagcagatg

SEQ ID NO: 225639 - DNA, 75 bp, Artificial Sequence
  Synthetic
cataacaattaattatgaataatgttaagattacagtttcttcgccatgtgcagagatctacataccggcttatg

SEQ ID NO: 225640 - DNA, 75 bp, Artificial Sequence
  Synthetic
tttacgtatgctgacatacctagagtagttggcttttgtaattcggctcacgctcagggtttgaacgtcttagtt

SEQ ID NO: 225641 - DNA, 75 bp, Artificial Sequence
  Synthetic
agaatagacatcaggtctgataaaccgaagatgtcgaagggcgagttgaactctgagtgggagtcgggtgtacaa

SEQ ID NO: 225642 - DNA, 75 bp, Artificial Sequence
  Synthetic
gttattttctatcaacttgaacttatcggtgtgtttgtttttgaagagcttcgacttttaaactttaaaatgaag

SEQ ID NO: 225643 - DNA, 75 bp, Artificial Sequence
  Synthetic
gatctacataccggcttatgttgcatcctacccttgagcttggctaggctcttgggctcgtcaaagtgtaccgac

SEQ ID NO: 225644 - DNA, 75 bp, Artificial Sequence
  Synthetic
gctgataacgaactgaccgcaagcctaatcaatgcactacccattaatgttactattgtagcaaaacttaggcct

SEQ ID NO: 225645 - DNA, 75 bp, Artificial Sequence
  Synthetic
ggaggaagaatcaatgccgtcgccagtttcactggttccggctgcagtaacagacatcctttttgtttgcatagg

SEQ ID NO: 225646 - DNA, 75 bp, Artificial Sequence
  Synthetic
agttacatcgtagggaatgaagcaccatatctcaataaacgctttcgtataccaccgcttcctttcttaacgcat

SEQ ID NO: 225647 - DNA, 75 bp, Artificial Sequence
  Synthetic
attgtagcaataacagtagtgatcataaccgtatcgattggtttagtcgaccagttgtcagaaaagttagtatca

SEQ ID NO: 225648 - DNA, 75 bp, Artificial Sequence
  Synthetic
accaccgctgagttcagcatttttgtacctagaggttcattaaccaagatgagcttgactaattcatataagtac

SEQ ID NO: 225649 - DNA, 75 bp, Artificial Sequence
  Synthetic
acggaccaaaagcatagcatttcattgatatgtgacggactaaatagtatgataataatgattatggccataatt

SEQ ID NO: 225650 - DNA, 75 bp, Artificial Sequence
  Synthetic
gatgacctaaagtcaatgaccagtaaggtgtgtgctttgaaaagaacgtgtggatctttgtacaatatgttcctg

SEQ ID NO: 225651 - DNA, 75 bp, Artificial Sequence
  Synthetic
ggtatgactaatccaggaaagaaagcgtatacgcatgaacatcatgaagctacagctccgatgctcggagacact

SEQ ID NO: 225652 - DNA, 75 bp, Artificial Sequence
  Synthetic
tgtgatttgtacctgaacttaggagttaccattaagcaagctactgtttcgaataattcacttgctttgtttagt

SEQ ID NO: 225653 - DNA, 75 bp, Artificial Sequence
  Synthetic
gagtatgtatatgttaagaacaacaattccgacccatcaaataacggtgacaccgttaagactaatcaacttaac

SEQ ID NO: 225654 - DNA, 75 bp, Artificial Sequence
  Synthetic
ctgtctaatgtaaacaatccaatgcccgagttgacttctgttaagaactatttattaaccttcccttacacatcg

SEQ ID NO: 225655 - DNA, 75 bp, Artificial Sequence
  Synthetic
ggtgaagccaaattcggagtaaatcaaacgtacccacaagtagttagcggagagtacataattactcaaattcca

SEQ ID NO: 225656 - DNA, 75 bp, Artificial Sequence
  Synthetic
atagtgaacacacaatccacccgaataacacacgggcgaacgtacgtagataatgcttttaatatgtttcatgaa

SEQ ID NO: 225657 - DNA, 75 bp, Artificial Sequence
  Synthetic
gatgatccgaatcgaattaagattataaacataaacactggttcagagaagatcgtctctaaagagtgagtcgct

SEQ ID NO: 225658 - DNA, 75 bp, Artificial Sequence
  Synthetic
taccattgtcgtgacagtttagtgatacctttggcagctcttcctgtttcgagtcataatattagtagtgatttc

SEQ ID NO: 225659 - DNA, 75 bp, Artificial Sequence
  Synthetic
cgaagccgacgacactatcacccatgcatttacacctaaaataagcacatttaaccaatcaacaaatacaacttt

SEQ ID NO: 225660 - DNA, 75 bp, Artificial Sequence
  Synthetic
actaacgtcgtagttactgacaattttgacgtcataagaatgactcaacctatagaacaggtttcaacccatatg

SEQ ID NO: 225661 - DNA, 75 bp, Artificial Sequence
  Synthetic
aagttctaaggcgatactgggagggtggacggatagtacccgtcgtaaccaccgccggcccaatcgtcagatgaa

SEQ ID NO: 225662 - DNA, 75 bp, Artificial Sequence
  Synthetic
gcgatactgggagggtggacggatagtacccgtcgtaaccaccgccggcccaatcgtcagatgaaatatctcgac

SEQ ID NO: 225663 - DNA, 75 bp, Artificial Sequence
  Synthetic
gttataaatttcttgcatattcacgatgtcagtattcgattattcacttcagaccaaagttctagattttggatt

SEQ ID NO: 225664 - DNA, 75 bp, Artificial Sequence
  Synthetic
gtaaagttggtcaactttgctctaaaacgtgtatgtcgttcagttggaattaatttcactgaattaaataaaaga

SEQ ID NO: 225665 - DNA, 75 bp, Artificial Sequence
  Synthetic
gactgggatggacaattacgccccagatagttcactagcttcagctttgaaaccaagaccgttgatcagcaacga

SEQ ID NO: 225666 - DNA, 75 bp, Artificial Sequence
  Synthetic
ctcagacgtgaagcgttagaagagtttgtaacacgtaatcccagctatgtcatgttcgacaatgaaacagcctat

SEQ ID NO: 225667 - DNA, 75 bp, Artificial Sequence
  Synthetic
acgtgaacacgcgaatgtagttcgtattgaccgtattgaacatgaactcgtaaaagataggatgcaggaagaagc

SEQ ID NO: 225668 - DNA, 75 bp, Artificial Sequence
  Synthetic
tcgagtaccggacggatgacagttagtgggcacatgatgtacatactgcttggatctatgttaggagtaccctat

SEQ ID NO: 225669 - DNA, 75 bp, Artificial Sequence
  Synthetic
ggatcgtaatgttttgaaagatgatatcaccatgtttgctacttcacttaagactattgttgacttcgacaatca

SEQ ID NO: 225670 - DNA, 75 bp, Artificial Sequence
  Synthetic
ggattggtgagatacctacgagaaatagaaatcaatataatgaaaccgtccgtatcgtatgaacgtggatttggc

SEQ ID NO: 225671 - DNA, 75 bp, Artificial Sequence
  Synthetic
cactgaattcgtacttaataatctaaattcaagcatatccaaggcagaacaaagtcgtgttaaagatgagaactt

SEQ ID NO: 225672 - DNA, 75 bp, Artificial Sequence
  Synthetic
agtcgtgtttggcatggataccacagtcataggatggccgttgatgtagcagttaaagtgatgacgtcattagcc

SEQ ID NO: 225673 - DNA, 75 bp, Artificial Sequence
  Synthetic
cctgctcgctgcaatcaatgagaacgttgatgccgttaacgacatcatcactaatcaacaggctcttaccgcagc

SEQ ID NO: 225674 - DNA, 75 bp, Artificial Sequence
  Synthetic
atagttgaccgtgttcacatagctcagttgctcgagttcgctaattggtataagtcgagattggatgggctagct

SEQ ID NO: 225675 - DNA, 75 bp, Artificial Sequence
  Synthetic
cgagaaagccgatttgatcatggaacaagtaatcaattcagccagagctgtcgcccatactagtgctgcagttgc

SEQ ID NO: 225676 - DNA, 75 bp, Artificial Sequence
  Synthetic
gtgaaatacggccgacggtatactgacgttgacgagaccgatcacattctgactctgaattgaatcatcgacagt

SEQ ID NO: 225677 - DNA, 75 bp, Artificial Sequence
  Synthetic
agatggagtgggagtcattcccatcttcggtccaaatgtagcaagtggggctaaagttctatctgatacagccga

SEQ ID NO: 225678 - DNA, 75 bp, Artificial Sequence
  Synthetic
gaaagtgaatctggaatgtaatccgcaacgggatttaagaggataatagcctgcgcgaggttcttgaaagaccat

SEQ ID NO: 225679 - DNA, 75 bp, Artificial Sequence
  Synthetic
agcaattgctgatactactgctgcaatcaaagcgtctcaaatatctcaacagcttagtactgcatttagcgctct

SEQ ID NO: 225680 - DNA, 75 bp, Artificial Sequence
  Synthetic
ttggtagctagagggaccccttggtagtaaccttggacacctgttaagcgccattttcaggacttgcattattac

SEQ ID NO: 225681 - DNA, 75 bp, Artificial Sequence
  Synthetic
tagctagagggaccccttggtagtaaccttggacacctgttaagcgccattttcaggacttgcattattaccgac

SEQ ID NO: 225682 - DNA, 75 bp, Artificial Sequence
  Synthetic
tagaaccgtacacgaacaccccaacaaattcattgaagcagccgttactaccatcaaaactggtgaagaccttgt

SEQ ID NO: 225683 - DNA, 75 bp, Artificial Sequence
  Synthetic
ccctaaattgaaacaaatcgttgatcgttctcgtagagctaatgagttgacgttctcaagagtaactgtacctgg

SEQ ID NO: 225684 - DNA, 75 bp, Artificial Sequence
  Synthetic
atcaattgcacatagttacgcttacgtttcggttctcgatgattacgacgtactaatggtctatcacattaaacc

SEQ ID NO: 225685 - DNA, 75 bp, Artificial Sequence
  Synthetic
atcaactggtgcttacggacttaaggcttcaattggatcacgtcgggttagttattcgttgcatggattgtttgg

SEQ ID NO: 225686 - DNA, 75 bp, Artificial Sequence
  Synthetic
agaactggattctttcggatttggacctgaaatcatgtcgtctggtgttgtatctcttccgcccattggatcacg

SEQ ID NO: 225687 - DNA, 75 bp, Artificial Sequence
  Synthetic
tcaagttgaatttaacacagttgtaaacgctgaccgttgccgggccatgttgatggcacttcaaagtccgggatt

SEQ ID NO: 225688 - DNA, 75 bp, Artificial Sequence
  Synthetic
gagtctgtcagacgaggagtacgttggttatttcgaacaatatctttgccgtgccattgaaccaactaataaaac

SEQ ID NO: 225689 - DNA, 75 bp, Artificial Sequence
  Synthetic
tgttctgtcggctttgcactccgcttttgacagcattcattccgattcaatgtctaacgatatgcactctgatca

SEQ ID NO: 225690 - DNA, 75 bp, Artificial Sequence
  Synthetic
tatagccatgcttggtcatttggacacacatcgacaaaagcataaggactcactggaagctgagttgcccgggtc

SEQ ID NO: 225691 - DNA, 75 bp, Artificial Sequence
  Synthetic
ttcgaatattcttgttccaattggacatgtcagccgagctaacagtacccacacccttgctttgaagtcaacctt

SEQ ID NO: 225692 - DNA, 75 bp, Artificial Sequence
  Synthetic
caggattggtgagtttagagtttacgattatttcattggtccgtttacacattccggaaagtttgtgattggtgt

SEQ ID NO: 225693 - DNA, 75 bp, Artificial Sequence
  Synthetic
agttatcgacagtatgtatgtcaatagcaataccgacaaccgtcgtttcgtctattcacaatattccggacatga

SEQ ID NO: 225694 - DNA, 75 bp, Artificial Sequence
  Synthetic
gggacaacggatcaattcggtagttaattcatctgagtcaccgatcagactggagttgaccttggacgtcagatc

SEQ ID NO: 225695 - DNA, 75 bp, Artificial Sequence
  Synthetic
tgatctgacgattgagggagttgagggtgatagagctgtactcaggatatatggtgttgatctacatagtgttcg

SEQ ID NO: 225696 - DNA, 75 bp, Artificial Sequence
  Synthetic
tatcatcacgggaccttctgagggcagtgaggctatgattcaaccaccgatgacaaccagtgaccacaaagagtt

SEQ ID NO: 225697 - DNA, 75 bp, Artificial Sequence
  Synthetic
gggcttcgactacggattcatgcgtcgacacattgatcctaaaatcattaacaattcgattgatttgggatatca

SEQ ID NO: 225698 - DNA, 75 bp, Artificial Sequence
  Synthetic
tgattgggagcagtatcacggtaatggtaattggactaacattaaaccgagtgaaaattagaacatccgtcaata

SEQ ID NO: 225699 - DNA, 75 bp, Artificial Sequence
  Synthetic
ctattggttattattgtatattctggtctagacagttgatataatcgcgttctgatagttacaggaccctgacca

SEQ ID NO: 225700 - DNA, 75 bp, Artificial Sequence
  Synthetic
gatataatcgcgttctgatagttacaggaccctgaccaaagttctgtaaagttgattattctctgaaatctcgac

SEQ ID NO: 225701 - DNA, 75 bp, Artificial Sequence
  Synthetic
gttataaagaatctttggactgaaacactaacagtaagtgacgagttagacgcatctcgttttcgaacacaactt

SEQ ID NO: 225702 - DNA, 75 bp, Artificial Sequence
  Synthetic
taaccaaccgcaaaacaaaacatcaactatggctgaaaagaaaagaataaacaacgcagtcggattaatgcagga

SEQ ID NO: 225703 - DNA, 75 bp, Artificial Sequence
  Synthetic
atacgcaattaaactcagtgaatcggcaccttcatatgaagacgtcggctttgagggcccgcctcacaaccgaag

SEQ ID NO: 225704 - DNA, 75 bp, Artificial Sequence
  Synthetic
cttcacgatctcagctacatttagggacaagaagtatgaaggtatcggcccgtcgaagaaagtagcccgtagcgt

SEQ ID NO: 225705 - DNA, 75 bp, Artificial Sequence
  Synthetic
tgccgccaataagatacttgacgatgtggctgaggaaattgcgaatattgatctggacgatccgtctacgcgtaa

SEQ ID NO: 225706 - DNA, 75 bp, Artificial Sequence
  Synthetic
aagtgttttcgcgcttgcgtgcgaattagcatcgcataaaatagccagaggtctgctgtctggagtgatttccca

SEQ ID NO: 225707 - DNA, 75 bp, Artificial Sequence
  Synthetic
ggtcggtggatcggttgatctgattagactttgtcgcaacacaacgtatgatgatagcgctgacttattactgga

SEQ ID NO: 225708 - DNA, 75 bp, Artificial Sequence
  Synthetic
actgtgggatatgagaaaatttgacaagaatggagttgatacgatggttaaacacatggaaagatggtttaccgc

SEQ ID NO: 225709 - DNA, 75 bp, Artificial Sequence
  Synthetic
tgctggactttatctcatcgttgaaaacgataccctaattgttgaagaaatggattatgatgataaagatcatcc

SEQ ID NO: 225710 - DNA, 75 bp, Artificial Sequence
  Synthetic
ccgtcgcgatttgggagacatttagtctcacaatggacgagggataagcatacagtatcaccacatacgcttata

SEQ ID NO: 225711 - DNA, 75 bp, Artificial Sequence
  Synthetic
ttcgagtatgccctaatgacgtcatcatgatagggtgaagcgaggcttcactcgacccatggctgggtgaaccca

SEQ ID NO: 225712 - DNA, 75 bp, Artificial Sequence
  Synthetic
ccaccaggcagtgtcgcctcggcattgacctgttgttagtagctggtgtcaattagtcctcgggatggaatcgac

SEQ ID NO: 225713 - DNA, 75 bp, Artificial Sequence
  Synthetic
gttataaaattcttaactgactaactaatgcaaatggatatcctgtcacccaattgtggttcggttcagaaaaat

SEQ ID NO: 225714 - DNA, 75 bp, Artificial Sequence
  Synthetic
tgttttcaagtctacaaatctcaagatgtgtacagagtgcgattctgtgtggaaggaaaggttcacgacataccc

SEQ ID NO: 225715 - DNA, 75 bp, Artificial Sequence
  Synthetic
ttgcctggtgttagtacccgtcgggatattattggcactgtcaagtatttttgtgagcttatgggccttaacatc

SEQ ID NO: 225716 - DNA, 75 bp, Artificial Sequence
  Synthetic
gtagataattcattgagattgaactggcttaacttgtcggaaatggaaaaccatggcaacaacgtaactttagcg

SEQ ID NO: 225717 - DNA, 75 bp, Artificial Sequence
  Synthetic
aaagtcaaaagtgagtatggtgatctattcgtcaagaaattgcctgctctaccaatcaatgtccattctaccaat

SEQ ID NO: 225718 - DNA, 75 bp, Artificial Sequence
  Synthetic
tacgtatttggaaagtattcagtcttcgctcgtgttttcggtgttgtaaagttgctcaatgatgataactatgaa

SEQ ID NO: 225719 - DNA, 75 bp, Artificial Sequence
  Synthetic
gtcggaattatacttgagaagtgtaatgaaatcagagttatgacggttaacatcatagtcatgggacttaaatca

SEQ ID NO: 225720 - DNA, 75 bp, Artificial Sequence
  Synthetic
ttgatggactcacatcgtgaaagcggaggtacattacatggtgactgtacagtgcaaaatcttatgtgtgataaa

SEQ ID NO: 225721 - DNA, 75 bp, Artificial Sequence
  Synthetic
tatggtatgttaaaactcgttgatccgggtaatcttatgtctcagacggtcgtatggaaaaacgatacacaatat

SEQ ID NO: 225722 - DNA, 75 bp, Artificial Sequence
  Synthetic
tttggcaatacggttgatgatgaagtgtgttctttcgtcatggcctgtcttcagacaacagctaacctacgtaat

SEQ ID NO: 225723 - DNA, 75 bp, Artificial Sequence
  Synthetic
atagaaaagagtaaattgacaataccattcattactgatctatacctacttgacaccgttctttcggatcctaat

SEQ ID NO: 225724 - DNA, 75 bp, Artificial Sequence
  Synthetic
gtgatacatggaactagagaaagcggatggctcgaggtaggaagtgattttgttagtatagtacagatgttcgtg

SEQ ID NO: 225725 - DNA, 75 bp, Artificial Sequence
  Synthetic
gctcttgctaacatggttcgtccttacaacataaacgacattttagcgactttgaaaaccgaggtcactggagag

SEQ ID NO: 225726 - DNA, 75 bp, Artificial Sequence
  Synthetic
aatgaaactttcagtaacgtcataaacaagtacgaagacgaagagcatcctgactctgactttgactaacttgta

SEQ ID NO: 225727 - DNA, 75 bp, Artificial Sequence
  Synthetic
gacagaaagcccaaatcgtaagttacacacttataattggatgatgggtaccaacttgtcaagtttcgggggttg

SEQ ID NO: 225728 - DNA, 75 bp, Artificial Sequence
  Synthetic
tgcacccgacccctaattcttgaggagtctcgcggagtggttctgcggtataaagcttagtctgttatttcggaa

SEQ ID NO: 225729 - DNA, 75 bp, Artificial Sequence
  Synthetic
acccctaattcttgaggagtctcgcggagtggttctgcggtataaagcttagtctgttatttcggaattcctgac

SEQ ID NO: 225730 - DNA, 75 bp, Artificial Sequence
  Synthetic
gttattttttctaagtgacaatgagtaacgtgacagagattcgtgctttgaagagattcgctagacagataaacc

SEQ ID NO: 225731 - DNA, 75 bp, Artificial Sequence
  Synthetic
gtccggcagataaacagacagtaaatgacctacctggtaattcgacagtaagtaaagatgaggtactcacgctcg

SEQ ID NO: 225732 - DNA, 75 bp, Artificial Sequence
  Synthetic
cctattctgacggtagtgttaaacggctactcggtcgtggcgcagacggttcaattcttggcaatgttaatgttt

SEQ ID NO: 225733 - DNA, 75 bp, Artificial Sequence
  Synthetic
ttcatatgaacggagatttctttagatccatgtatctagcagcattcatatctcatcctggactacataaccgcc

SEQ ID NO: 225734 - DNA, 75 bp, Artificial Sequence
  Synthetic
cattcatgtgtcgtgctaacttgggatacgttgttaaccatctgaactcagccgtaatagccagcggagcaccac

SEQ ID NO: 225735 - DNA, 75 bp, Artificial Sequence
  Synthetic
gttcagctacagtaaatcttggagccatacctaattctggagcatcattcgtagttctggtcgaccaactattga

SEQ ID NO: 225736 - DNA, 75 bp, Artificial Sequence
  Synthetic
atggagtagctgacgttggattcgttaatatgtatttccatagtaataatcgtccgcttggtgacacaactgcat

SEQ ID NO: 225737 - DNA, 75 bp, Artificial Sequence
  Synthetic
cttattctgttcaacatattcgagctcaaacgacgctgtttaacccggttaatgttatgttcgattctttgagct

SEQ ID NO: 225738 - DNA, 75 bp, Artificial Sequence
  Synthetic
tggctgttacccccgaatctggatacactattgaagtcgaccctgttcatactggacccttcacctataatgata

SEQ ID NO: 225739 - DNA, 75 bp, Artificial Sequence
  Synthetic
accttaaagtgcattgttatgtagccgttaaagaccgatacgatgttggagttctgagtactgtttggtcagcta

SEQ ID NO: 225740 - DNA, 75 bp, Artificial Sequence
  Synthetic
tgtcgtcaaattacttaacgtaattccatttaattggatagtctatacaaaaccgtgtttacaatcttagcacgt

SEQ ID NO: 225741 - DNA, 75 bp, Artificial Sequence
  Synthetic
ctaaccatcatgcgaaagtagctgtgaaagtccgggaacccaccccggatggaagcggtgtcatctggattagcc

SEQ ID NO: 225742 - DNA, 75 bp, Artificial Sequence
  Synthetic
accatcatgcgaaagtagctgtgaaagtccgggaacccaccccggatggaagcggtgtcatctggattagccgac

SEQ ID NO: 225743 - DNA, 75 bp, Artificial Sequence
  Synthetic
gttattttttcacatcatgtcgacaattggcgttctactaagattgagttctctaaacgaattcatcacattttg

SEQ ID NO: 225744 - DNA, 75 bp, Artificial Sequence
  Synthetic
caaagagacggaattagatggtatgcttcaagatgctcttactcatcgggtgaatggtggacggatgcttatctc

SEQ ID NO: 225745 - DNA, 75 bp, Artificial Sequence
  Synthetic
acgaccagctctgggttcagggctgttcaaagtacaagatgtatttactcaaggcacacctcgtgttgttagaaa

SEQ ID NO: 225746 - DNA, 75 bp, Artificial Sequence
  Synthetic
ggatctgatcggattgattcactcaatagccacttatctcatgtccggagttggtagttattgtggatcagtcga

SEQ ID NO: 225747 - DNA, 75 bp, Artificial Sequence
  Synthetic
tgcttggacacgttcgttaactatctgggatctaattgctagtaaggatatgcgtttcaacctaagtggtatgaa

SEQ ID NO: 225748 - DNA, 75 bp, Artificial Sequence
  Synthetic
catgatcaaacttgttgagtcattccaaattggatatctaacactagagcaagtacgacgacttggaattatcat

SEQ ID NO: 225749 - DNA, 75 bp, Artificial Sequence
  Synthetic
cacacaaaaagaaaaaaagtttttttaacctttttgtgtccttaataccttgaagaatattaatctcttcccgga

SEQ ID NO: 225750 - DNA, 75 bp, Artificial Sequence
  Synthetic
taagagaggtgttccccatgcgtcagcaccgtggtatgaccctacaacttttaagtcatgttcagaaggatcaac

SEQ ID NO: 225751 - DNA, 75 bp, Artificial Sequence
  Synthetic
aatcgagatcgagatctggcttcaagtaacactaattttcgcagtgtccttgactaaggttgagaatatctgtgt

SEQ ID NO: 225752 - DNA, 75 bp, Artificial Sequence
  Synthetic
tgtggttgtctcaatatctacagtagaagtcttacttatgatcaaggatgtagctttctcacgaatgaacacatt

SEQ ID NO: 225753 - DNA, 75 bp, Artificial Sequence
  Synthetic
tcttttgggtgatctccatacgataatcactcatattgtgtcgccactcaagatcaagatctggcaaacccagct

SEQ ID NO: 225754 - DNA, 75 bp, Artificial Sequence
  Synthetic
acttatatgtaagttggctgaattagaggacaccttgacggactaccctactgtggaatccttgcatgatctgta

SEQ ID NO: 225755 - DNA, 75 bp, Artificial Sequence
  Synthetic
ggttgaccaaggtacttgggagacctcttggcccaagctggagtgtcctctggtattcacctgacagtaatagtc

SEQ ID NO: 225756 - DNA, 75 bp, Artificial Sequence
  Synthetic
ccgcagtggagactacttaatttcattactgggatcgacagggtatgatatcattaaatatttggaaccactgtg

SEQ ID NO: 225757 - DNA, 75 bp, Artificial Sequence
  Synthetic
ctaaaacagtgtgcaatcggttcaccgtaaattatcattgatatctgttatatcctaataagcattcaaaatcca

SEQ ID NO: 225758 - DNA, 75 bp, Artificial Sequence
  Synthetic
tctgggccggatacaattgttatccaactttactccacggaaaacctggtattactcccaaatgcaagttgcatt

SEQ ID NO: 225759 - DNA, 75 bp, Artificial Sequence
  Synthetic
atcctcccctgaataacagcccaatccgcaaagtactttgggtataggtataatccaagttgaattctcaagtag

SEQ ID NO: 225760 - DNA, 75 bp, Artificial Sequence
  Synthetic
gctcaaggacttggcagaaagaacaaagggcagggaacttactttataccaacaaacaaagattcggtctttcca

SEQ ID NO: 225761 - DNA, 75 bp, Artificial Sequence
  Synthetic
acaactaggcctttgagtatcctgtgatcatgaatcgttatcttggtcatggtactagaacatctagggaaaata

SEQ ID NO: 225762 - DNA, 75 bp, Artificial Sequence
  Synthetic
tcaaatattatttagacttaaactccgagctcaacaatggtgtgagttattttctatccagaagcactgggggca

SEQ ID NO: 225763 - DNA, 75 bp, Artificial Sequence
  Synthetic
ccaacctgagtgaattacatggtattctaagcctcgggttaaatgtagatcataccattgtaaggaagaagagca

SEQ ID NO: 225764 - DNA, 75 bp, Artificial Sequence
  Synthetic
tcctgtcttgcacagtgagttagcgattgcgaaagttaaaaaacatgggacatgtctgaaagtgctaaggcctag

SEQ ID NO: 225765 - DNA, 75 bp, Artificial Sequence
  Synthetic
tcccgttgtttgagatcggtaactctgatcaagtatgtaattggataattcaaataattgaggctggggtggacc

SEQ ID NO: 225766 - DNA, 75 bp, Artificial Sequence
  Synthetic
tatcatgtttgatactttctgcgttttcaaatacatggtagggaaacatcattttgacaatacaggacattggta

SEQ ID NO: 225767 - DNA, 75 bp, Artificial Sequence
  Synthetic
tgcaggatgttgctgatagctttttaacaatgctctgcgtaaatcatgcttatcaaggagatcctaatttgttcc

SEQ ID NO: 225768 - DNA, 75 bp, Artificial Sequence
  Synthetic
ccgtgtgacacatgacaagaatcttactccaactttaaagacttacattcagaagaaccactttccgacatttcg

SEQ ID NO: 225769 - DNA, 75 bp, Artificial Sequence
  Synthetic
ttgagagtcctgcagctcattatttaaaaggacatggtatccacttcgaaatccagcatcgtgataatgttgatc

SEQ ID NO: 225770 - DNA, 75 bp, Artificial Sequence
  Synthetic
tgatgttaggaagtttctttgggagttttacttggtgcaacatgaggatcttttctcaactaaagtaatcagtga

SEQ ID NO: 225771 - DNA, 75 bp, Artificial Sequence
  Synthetic
acatcacagatctccttggagtagggagtcgagacaaatcactcagaaaaactctttctgcacttgaattcgagc

SEQ ID NO: 225772 - DNA, 75 bp, Artificial Sequence
  Synthetic
tctcagtattttcatcaaagatcgggccactgctgttgagagcatctgctgggatgccgttttcgaaccaaatgt

SEQ ID NO: 225773 - DNA, 75 bp, Artificial Sequence
  Synthetic
ctgatggctcaactacggctgggatgtttttgtctttcgcaagtttatttctcccgaagttagttgtcggtgaac

SEQ ID NO: 225774 - DNA, 75 bp, Artificial Sequence
  Synthetic
actaggttatgcccctcccatgcgattcattacaaaacgggtgcctgaacagttcttagcccaagaggatttctc

SEQ ID NO: 225775 - DNA, 75 bp, Artificial Sequence
  Synthetic
gtgcctgcttggaaaaagtgcagcggcaaattcaaattcatgcagaacaaggcttaatccaatatcccacccaat

SEQ ID NO: 225776 - DNA, 75 bp, Artificial Sequence
  Synthetic
attagaagcagtaatctcttatgcagagaaattacagtacttggaaccagtaaatagaaacttctccttctcttt

SEQ ID NO: 225777 - DNA, 75 bp, Artificial Sequence
  Synthetic
ggcagtccgtaggacatatgatggttgtattcaggctgattcgtgtcaactttgtcctcaaattcctcctagttc

SEQ ID NO: 225778 - DNA, 75 bp, Artificial Sequence
  Synthetic
gaaagagaaagaattaaatataggacgcacctttggaaaattaccttatttaacccgaaatttacaaactctttg

SEQ ID NO: 225779 - DNA, 75 bp, Artificial Sequence
  Synthetic
accagggcatgcacatgatggctgggcatgatgctaatgatgcaatcattgccaattcaatatcccaaacacgat

SEQ ID NO: 225780 - DNA, 75 bp, Artificial Sequence
  Synthetic
tgaggcactattggctgacgggttagctaaagcatttccgagtaatatgatggttgttaccgagagggagcagaa

SEQ ID NO: 225781 - DNA, 75 bp, Artificial Sequence
  Synthetic
tttcaggattgttaatcgtgaagactgtcctagagcatattctccaaaaaactgaggcaggggtccaacttcatc

SEQ ID NO: 225782 - DNA, 75 bp, Artificial Sequence
  Synthetic
agaaactctccttcatcaggcctcatggcatcatgaacagggcaatctaggagaccatgtacaagttcgtggagc

SEQ ID NO: 225783 - DNA, 75 bp, Artificial Sequence
  Synthetic
cattagctcgaacctcgaaagtcaaaggagaactccttgcattcaaatcagcactggaagcgttggcctcacaca

SEQ ID NO: 225784 - DNA, 75 bp, Artificial Sequence
  Synthetic
gagttttgttacagatctggaaaaatacaatctagcctttaggtttgaattcactcgaccattcattgagtactg

SEQ ID NO: 225785 - DNA, 75 bp, Artificial Sequence
  Synthetic
gagagtatgcaccatttgcacggctcttgaacctctctggtgttaataatctagaacatggcctgtatcctcagc

SEQ ID NO: 225786 - DNA, 75 bp, Artificial Sequence
  Synthetic
caaccattgttataacattaagaatgcattcaattggatgcattacttaattcctagctgctatatgcatgtaag

SEQ ID NO: 225787 - DNA, 75 bp, Artificial Sequence
  Synthetic
tctctgccatcgcgcttggagttgctacagctcatggtagcacactagcaggagttaatgtgagtgaacaatacc

SEQ ID NO: 225788 - DNA, 75 bp, Artificial Sequence
  Synthetic
tgactattacaatccacctcatggactaacattggaaaaccgaggatacccgcccgagggtccaagttcatacag

SEQ ID NO: 225789 - DNA, 75 bp, Artificial Sequence
  Synthetic
agcaactccgagaggctgcaacagaggctgagaaacaattacaacagcactcagagatgcgggaattggagaccc

SEQ ID NO: 225790 - DNA, 75 bp, Artificial Sequence
  Synthetic
aggacatcttggagggattgagggcttacagcaaaaattatggacaagtatttcttgtgctcagatcagtcttgc

SEQ ID NO: 225791 - DNA, 75 bp, Artificial Sequence
  Synthetic
ttggactggatgaacaagaaaggaagatccttgcaacattccactcccggaaaaatgagatcaacattcaacaga

SEQ ID NO: 225792 - DNA, 75 bp, Artificial Sequence
  Synthetic
tgaacttcgctctggcttcaagacaagatcagccgtcatgggtgacaaccaatgtattactgtcctctcggtttt

SEQ ID NO: 225793 - DNA, 75 bp, Artificial Sequence
  Synthetic
ccagctcgatattagcaattcgtaaggaacgactccgcaagctgacagaggccctcaatgaagaaaagaataaga

SEQ ID NO: 225794 - DNA, 75 bp, Artificial Sequence
  Synthetic
cccggatcactatcaggaagatttacaggagttggaggcggaagacaatgcagcaagagtagcagctatattggc

SEQ ID NO: 225795 - DNA, 75 bp, Artificial Sequence
  Synthetic
atgcacttgatgatgaggacgaaagtgaagaagacgactggtcaccagaaaatagggggatacggagcaacaagg

SEQ ID NO: 225796 - DNA, 75 bp, Artificial Sequence
  Synthetic
tcgaataactgcttcgtgcggtatatttctaaagcctgaggagactttcgtccactctggattcatttacttcgg

SEQ ID NO: 225797 - DNA, 75 bp, Artificial Sequence
  Synthetic
gatcaaccaaagagtcatcctcctacactgctagcagaaccgaagaagacagaaacaattataatagtaaggatg

SEQ ID NO: 225798 - DNA, 75 bp, Artificial Sequence
  Synthetic
taagaaacaatacctaaatggtgtccagttaccacaatctcttaagactgctgcaagaatggccccattatcaga

SEQ ID NO: 225799 - DNA, 75 bp, Artificial Sequence
  Synthetic
accatctctcaggaaaggaacaaatgtccactcaacaggagtcaggtgctgacgatcttgatcttttcgatctgg

SEQ ID NO: 225800 - DNA, 75 bp, Artificial Sequence
  Synthetic
tgcaatttttgatgatctccaaggtacacttgctagcattggcactgcatttgaaagggctattgctgaatcccg

SEQ ID NO: 225801 - DNA, 75 bp, Artificial Sequence
  Synthetic
acgacgacggtgatacaaacagccaggatccaaacaacagacaaaaacaatccgatactcaacaaacacaagaat

SEQ ID NO: 225802 - DNA, 75 bp, Artificial Sequence
  Synthetic
acatattttcccaattaggattatggctgccatccaatcttacttggcagttaaggttttacaagagaaccattt

SEQ ID NO: 225803 - DNA, 75 bp, Artificial Sequence
  Synthetic
ccagtgaccgttccgactattcaaggcgaccagcctacgactggcccccaggcgacaggccccacacaacacagg

SEQ ID NO: 225804 - DNA, 75 bp, Artificial Sequence
  Synthetic
gggttttccaaaaaacacagatttaggtgtattggcactcgggaaaccaattagtgccaaaatgatcagactctg

SEQ ID NO: 225805 - DNA, 75 bp, Artificial Sequence
  Synthetic
ctacagatgagcacactgacctcttgaacaaggaccatcgacgcaaccaggtgaagcccggaagaaggggaaatg

SEQ ID NO: 225806 - DNA, 75 bp, Artificial Sequence
  Synthetic
cttatccattcctcaagtcctgggtgggctctcattcttgaacccggagaaatgcttttatcgcaatttaagtga

SEQ ID NO: 225807 - DNA, 75 bp, Artificial Sequence
  Synthetic
atccaaggaccctcccattaatcagctttgatgacaatgagggagagatcttagacgacaagtcagacctccctg

SEQ ID NO: 225808 - DNA, 75 bp, Artificial Sequence
  Synthetic
cccagtcacttctggtctctatcaagttaaaaagtacttagcctacatcggccaaggagacctgtttcctctctt

SEQ ID NO: 225809 - DNA, 75 bp, Artificial Sequence
  Synthetic
ctccagacacccactcagaccccgacactgaggagtcagaggaagaacatccagatgaagaactactaccacctg

SEQ ID NO: 225810 - DNA, 75 bp, Artificial Sequence
  Synthetic
tgtggctaagcgaccaggtgatgcaagtgcgattgacctggttcttaaccctctaggactcaattatccaggagc

SEQ ID NO: 225811 - DNA, 75 bp, Artificial Sequence
  Synthetic
ctcctaagtacaacactaaaacttcagagcaagaacccggggattggaagcagcccactagccccctaagtacaa

SEQ ID NO: 225812 - DNA, 75 bp, Artificial Sequence
  Synthetic
ccaggatttaacctccttcttgaggcgcatagttcgtcagagtattacctttcattcaaagaataaattaataaa

SEQ ID NO: 225813 - DNA, 75 bp, Artificial Sequence
  Synthetic
taccggaagaagagggaggtcatgaggcaaacaacgataattccgagtctgatctgatcgatcaaatgtaccagc

SEQ ID NO: 225814 - DNA, 75 bp, Artificial Sequence
  Synthetic
ctcattgtttcatgctaatgcagacttagaggatgagtatttatgtgagtggttactctcatctgagcctgtcat

SEQ ID NO: 225815 - DNA, 75 bp, Artificial Sequence
  Synthetic
atatatttgagacagaaggcgcttatgcagctatcaactattattacaaaaccacaggtcgaccagtgaccttca

SEQ ID NO: 225816 - DNA, 75 bp, Artificial Sequence
  Synthetic
gtcaagatttgctgctgacatcttctctcgaacacccagtggtaagaggctccaaatccttgggtacttggaagg

SEQ ID NO: 225817 - DNA, 75 bp, Artificial Sequence
  Synthetic
cctcaaacaacaaccatgactacacatttcctcaagacattgaaggtctgttcccaccgtgggaaggcaaagaaa

SEQ ID NO: 225818 - DNA, 75 bp, Artificial Sequence
  Synthetic
aactagaactctcttggcatcacggaatctccacacaaattccgaatcatcactcctatctcgactcagagcatt

SEQ ID NO: 225819 - DNA, 75 bp, Artificial Sequence
  Synthetic
atcaaaaggtggcagagatcctcaccaactctctacatgagacagggcaagaatgggctgatatgagtgcaaagg

SEQ ID NO: 225820 - DNA, 75 bp, Artificial Sequence
  Synthetic
aacaacgaagcggtggcaattgtggttcagttatatggaccagtacgatgaagatcttggggacgtgattggaca

SEQ ID NO: 225821 - DNA, 75 bp, Artificial Sequence
  Synthetic
aacggtaccttttcttgataaataactaatcaccccattaaaattgctcatggggcctggagagaaacctgcgct

SEQ ID NO: 225822 - DNA, 75 bp, Artificial Sequence
  Synthetic
gttgacatgtacattggacatcgcgaatgtcttacgtgaatattcctggagtcatgtcctacaaggtcgccgatt

SEQ ID NO: 225823 - DNA, 75 bp, Artificial Sequence
  Synthetic
gcatgtaattaaccatcaagcagtaatctctacactaagatcaattcatcaatgcatgtgagcaaagagaccgcg

SEQ ID NO: 225824 - DNA, 75 bp, Artificial Sequence
  Synthetic
gattggagcaacattgccatgtgtgccagaacagtttgaactcacctggttgactggtgataaggcttgtaagca

SEQ ID NO: 225825 - DNA, 75 bp, Artificial Sequence
  Synthetic
ggctgaacataatggaacaaaagtcgaagaatattaagaaaaacccggcaacgtgttgtagaggtggcaacagag

SEQ ID NO: 225826 - DNA, 75 bp, Artificial Sequence
  Synthetic
ctgtcagtctaaactgagggacaagaagaagccttatgtgtcagcggcattagttgacaaaattattagtcaaag

SEQ ID NO: 225827 - DNA, 75 bp, Artificial Sequence
  Synthetic
aaacctccacggcatatcagccaatcaacacagcccaacacaaaggagacacccgacgggacacaaatccaaggg

SEQ ID NO: 225828 - DNA, 75 bp, Artificial Sequence
  Synthetic
gccgagttatcatcggttaagttggacaatagggactctgacaccttacattgggtcaaggacagaggacaaaat

SEQ ID NO: 225829 - DNA, 75 bp, Artificial Sequence
  Synthetic
tcaggtgatcccgccccaaacacaggactcaaagcccaccagaagggcacaccccagagactccacaggccatcc

SEQ ID NO: 225830 - DNA, 75 bp, Artificial Sequence
  Synthetic
cgggcaatcagcttttaaacccagatgtccctcagctgcactccgggaaacgattgagttagcttcccgaattct

SEQ ID NO: 225831 - DNA, 75 bp, Artificial Sequence
  Synthetic
ctctccaaaagacccgagacgaactacacggcatggacaaagtgacggatgccatcatgactgggcgattatcac

SEQ ID NO: 225832 - DNA, 75 bp, Artificial Sequence
  Synthetic
ctgggtaacacaaggttcgagccaagcggaagatattattcgtccattttgcgaggccaggataaacctgccagt

SEQ ID NO: 225833 - DNA, 75 bp, Artificial Sequence
  Synthetic
tcgacacaatccctggctttcaatgctctgcgccgacctccaggagcaggcccaccgggcgaaagtgtccaccgt

SEQ ID NO: 225834 - DNA, 75 bp, Artificial Sequence
  Synthetic
ccaggaactattcaaattgcttccatcgcactactctggcaatattgttcatcgttacaatgaccagtatggtcc

SEQ ID NO: 225835 - DNA, 75 bp, Artificial Sequence
  Synthetic
gggaaggaccactcattgagcccaagacttccgccaacaaatcaacacaaactgagaacatctaccaaagcgacc

SEQ ID NO: 225836 - DNA, 75 bp, Artificial Sequence
  Synthetic
gcgctcctttatggccaatagaatgagtaacactgccacaaggattatcgtttcaacaaacaccctcgggccata

SEQ ID NO: 225837 - DNA, 75 bp, Artificial Sequence
  Synthetic
aggtcctacgcgaaatcaaacaactgagctcaattctagcccaccaaatcacaaccatggagaggctagagggtt

SEQ ID NO: 225838 - DNA, 75 bp, Artificial Sequence
  Synthetic
ttcgggagggggccaagcggcccgtgacagcaacattatatttcaaaatgtaataaatttcgctgttgctgtact

SEQ ID NO: 225839 - DNA, 75 bp, Artificial Sequence
  Synthetic
cacttcaaagcatacaccaacagcttcaggtggtcgggggcatggcacataacctaacatccttgacaaccctgt

SEQ ID NO: 225840 - DNA, 75 bp, Artificial Sequence
  Synthetic
tgacatccagaatagtttcttagatcagccaatgagtgaatttaagcacatccatctacatattaaagattgctg

SEQ ID NO: 225841 - DNA, 75 bp, Artificial Sequence
  Synthetic
gcacagaaatggttgccaaatatgacttccttgtcatgaccaccggacgagcaactgcaacagcggcggcaacag

SEQ ID NO: 225842 - DNA, 75 bp, Artificial Sequence
  Synthetic
cactcgtgaagtccctagtcagtatttaacctataaggctaattttgggatgaatctccaaaagtatcaatcaaa

SEQ ID NO: 225843 - DNA, 75 bp, Artificial Sequence
  Synthetic
aggcttactggaaagaacatgggaaagccccacctggcccagccttgttcgaagcagatgcacttaaggcacgaa

SEQ ID NO: 225844 - DNA, 75 bp, Artificial Sequence
  Synthetic
tgagttaatttatgacaaagatcctctacgctgtgggctcacctgtagagtcagtgttgagaatttcttcttaaa

SEQ ID NO: 225845 - DNA, 75 bp, Artificial Sequence
  Synthetic
tccaagaaaatcccaaaagtgtcccgactgatgttagagaggcctttgaccgtctagagaagactgaggaggtaa

SEQ ID NO: 225846 - DNA, 75 bp, Artificial Sequence
  Synthetic
acaccattttaaaaactcagttgaaggtgaactattgagatatccgcacctgtcggcttgggggttagccaacac

SEQ ID NO: 225847 - DNA, 75 bp, Artificial Sequence
  Synthetic
cagagaggacgttcggaaagccaaccatctcagctaagctcctcaaggaacttctctatgatcatcttcctggat

SEQ ID NO: 225848 - DNA, 75 bp, Artificial Sequence
  Synthetic
tgtaatgacttctctactagcagatatgaataatgcatctacggacttaataagcgggaatgaagtcaagtcctt

SEQ ID NO: 225849 - DNA, 75 bp, Artificial Sequence
  Synthetic
atgggactgccttccatcagcttgcccaagtcgtatgcaaggtcgggaaagacaatgatctcctggatatcatac

SEQ ID NO: 225850 - DNA, 75 bp, Artificial Sequence
  Synthetic
tacttctcaatttcttgcttacccattgattggaattttttattcattcggggcaataaccacgttcaaacttgg

SEQ ID NO: 225851 - DNA, 75 bp, Artificial Sequence
  Synthetic
atgctgagttccaggccagcctagcagagggtgactctccgcaatgtgccctgattcagatcacgaagcgaatcc

SEQ ID NO: 225852 - DNA, 75 bp, Artificial Sequence
  Synthetic
tcgcaatttgagccttcaaaaaataacaaaatcccagattatctattacttagacagtcagctgtacaatctgcc

SEQ ID NO: 225853 - DNA, 75 bp, Artificial Sequence
  Synthetic
ccatcttcggggagacaccacctcccgtcatctacataaaaacaaaacaagaaatacccaaagcatgccaaaaaa

SEQ ID NO: 225854 - DNA, 75 bp, Artificial Sequence
  Synthetic
tcatcgggcacttcgtgtatttaaaaccactttccaacatccagccgtccttgaatctcttttaaccatcgatcc

SEQ ID NO: 225855 - DNA, 75 bp, Artificial Sequence
  Synthetic
gcctccgccctcttccccccaatcctaaaattgaacggggctgggtatgccattatgtaacagcagatggaaagg

SEQ ID NO: 225856 - DNA, 75 bp, Artificial Sequence
  Synthetic
aagtttttcgttctttcttggaggagcctctggagggaaatcagtggctgatgcgacccgattgtttttaaggtt

SEQ ID NO: 225857 - DNA, 75 bp, Artificial Sequence
  Synthetic
aaatgggcctcaagatataaaactgaacaagcactccaaaggcctacatccaacatcattatggtggacaacctg

SEQ ID NO: 225858 - DNA, 75 bp, Artificial Sequence
  Synthetic
agctatccaagtcttcctgaatttcattagcttatacagccaacaaaagatagggaagactcttcccttatgggt

SEQ ID NO: 225859 - DNA, 75 bp, Artificial Sequence
  Synthetic
tcccaatccagtacacaggcaaaaaacctgcaacaacaggaggtgcccaataacccgagttcccctacaatctcg

SEQ ID NO: 225860 - DNA, 75 bp, Artificial Sequence
  Synthetic
ggtgttcccactagagggagaacctgacgaacctatccttgagtttctatctgaactactaagagctttatccca

SEQ ID NO: 225861 - DNA, 75 bp, Artificial Sequence
  Synthetic
agcggaaaaagctgactacgaggctgtcagaagggggccacaggaaatatggcttaccacctcccgaccagggca

SEQ ID NO: 225862 - DNA, 75 bp, Artificial Sequence
  Synthetic
tccactaccagaccaagaggcatccactgatacccgaattcaaccatcttgtgtatttcgatcagaacagatcta

SEQ ID NO: 225863 - DNA, 75 bp, Artificial Sequence
  Synthetic
caatctgcacaaaacacaccatctccatctccaccccaaaaccaggaccagaggcaggaacaagcacaaagggcc

SEQ ID NO: 225864 - DNA, 75 bp, Artificial Sequence
  Synthetic
caggagcatgtcaacaatgagtaacttcttccatgcgtcactagcctgctggagggaccgacgacagggacgggc

SEQ ID NO: 225865 - DNA, 75 bp, Artificial Sequence
  Synthetic
tacatcgggctcaagcatgagcagccagacacatatccaagacccttcaccccatcaaccccaagaccaacaaca

SEQ ID NO: 225866 - DNA, 75 bp, Artificial Sequence
  Synthetic
aagaggaagttccaatgtaaaagggaccatcttgctatatgacattaaaggtctactatccttaggatggaaaga

SEQ ID NO: 225867 - DNA, 75 bp, Artificial Sequence
  Synthetic
aggctgcagcgctgcaacaccaaaataagattgactaccctgcaaagatccctccacatacaacacgacaatcca

SEQ ID NO: 225868 - DNA, 75 bp, Artificial Sequence
  Synthetic
ctgttctctttcaaatgcaccccttaagaactccctctcctcttcacactgttcaagggatatcctcgaacatcg

SEQ ID NO: 225869 - DNA, 75 bp, Artificial Sequence
  Synthetic
taaatccctagagcctaacggccaaccacaccaaacactcacgaggaagacgccacccgcaaagcaacccaaatg

SEQ ID NO: 225870 - DNA, 75 bp, Artificial Sequence
  Synthetic
tagcaggaatataacagagtgtccacccttgctctccagacgaaccagaatctcccaagaatcaaaacatgcccg

SEQ ID NO: 225871 - DNA, 75 bp, Artificial Sequence
  Synthetic
aacaacaccagcagctccccgaccacccggacgggcaaccgagagcacaacacctcaaacccgtcaacagaccgc

SEQ ID NO: 225872 - DNA, 75 bp, Artificial Sequence
  Synthetic
aaatattgtgcagaatactcaacacgtacggtctgcaactctaccaggcgatgcccccccagaccccacccatag

SEQ ID NO: 225873 - DNA, 75 bp, Artificial Sequence
  Synthetic
cacagaggacccggctaaaacccctcctgagacaagaccagacaccatatcccatctacattgatcccaaaacaa

SEQ ID NO: 225874 - DNA, 75 bp, Artificial Sequence
  Synthetic
accaggatgcttgcgcttgaatgtctttaagactgaacaggacgagactggcctcagcacagaagaaacaattga

SEQ ID NO: 225875 - DNA, 75 bp, Artificial Sequence
  Synthetic
aatactgaagaatattaagaaaaaacaccttggcttgacagttcataagcgaccttataagaggatactctatac

SEQ ID NO: 225876 - DNA, 75 bp, Artificial Sequence
  Synthetic
gcaattactggccaggcttaagatgatgccagacactacatcttattgtcgattcactggggtcattgcatcaat

SEQ ID NO: 225877 - DNA, 75 bp, Artificial Sequence
  Synthetic
gtggatagagaatgttctccaaacatgtaacacttccaccacctccatacaatccaagctcaccggaaggactct

SEQ ID NO: 225878 - DNA, 75 bp, Artificial Sequence
  Synthetic
gcattacaagctagatgaggtcctgtacccaacaaatgagaccccaactgttgctctattagctgaaggtgaggg

SEQ ID NO: 225879 - DNA, 75 bp, Artificial Sequence
  Synthetic
attacaacccagatgcagggaagaaacatgggaacccacactcccatcccgtcccgcacacggagcactcccgag

SEQ ID NO: 225880 - DNA, 75 bp, Artificial Sequence
  Synthetic
ctctggggcattattactgataaggaaataccgggcacgacaaatattcttcaataccttggcaaccggcaatat

SEQ ID NO: 225881 - DNA, 75 bp, Artificial Sequence
  Synthetic
cctccaacaccattcgtccaactgccgatttcagccttgactatgacagtagttctgcttcaggggccatttcag

SEQ ID NO: 225882 - DNA, 75 bp, Artificial Sequence
  Synthetic
ggttgaggctgaggttttgatgggtgagtcagtaccccgcatgttacttcctctgctcccttctatcaataataa

SEQ ID NO: 225883 - DNA, 75 bp, Artificial Sequence
  Synthetic
cctttatgttagaagcctatgtcaatgttatctccaacaacaaggtgctgctgaaacttgttccgttgtggttgc

SEQ ID NO: 225884 - DNA, 75 bp, Artificial Sequence
  Synthetic
ggagattaagatcttcttcaacacgtcagtaacaatgaagacagacataactgatccaaaatggtttgatagtat

SEQ ID NO: 225885 - DNA, 75 bp, Artificial Sequence
  Synthetic
cacttggggtcgcaggacaagacttgtacagctttgactcaacggcctctgccctactgattgcttcatacacca

SEQ ID NO: 225886 - DNA, 75 bp, Artificial Sequence
  Synthetic
agaggatcggcttccaagatcacttgatttactagttatggatgctgagactattggaaatagtatcaggattcc

SEQ ID NO: 225887 - DNA, 75 bp, Artificial Sequence
  Synthetic
ttactcacttcggaatgaccacccgacctcttgtccgtgtcaacagactgggtccaggaatacctgaccatcccc

SEQ ID NO: 225888 - DNA, 75 bp, Artificial Sequence
  Synthetic
gctctacaatgctgttatcaagtgcatagatcgggacaagatgcaagataaaccaaaatgtgttattgtcaaatt

SEQ ID NO: 225889 - DNA, 75 bp, Artificial Sequence
  Synthetic
ttcacttgctccgactcggcaaccaggcattcctgcaagaactagtgctaccgcctcttcagctgccccaatttt

SEQ ID NO: 225890 - DNA, 75 bp, Artificial Sequence
  Synthetic
atttcttaatgattacctagggacctgttggatcttaaaccatatcacccttcgctacaataaagtagagattat

SEQ ID NO: 225891 - DNA, 75 bp, Artificial Sequence
  Synthetic
ttacttttgaactcactgaattgaggctctacacacatctgatgcctcaaaccatctggatagactcagcgcatg

SEQ ID NO: 225892 - DNA, 75 bp, Artificial Sequence
  Synthetic
taaaccattaagttcaaatgctcgatcatcagaatggtacttgaaagcagagcaaccggtcctatcatctgaact

SEQ ID NO: 225893 - DNA, 75 bp, Artificial Sequence
  Synthetic
gagacagacatgaacttcttcgacctgggctctctgtcaacccccgtctgcgccctatattgctcccgtgtaaga

SEQ ID NO: 225894 - DNA, 75 bp, Artificial Sequence
  Synthetic
aaattacataaatgttaattgggagggtcataccaccaaactgatcaaaaaggccttgcattgccaactctctcg

SEQ ID NO: 225895 - DNA, 75 bp, Artificial Sequence
  Synthetic
ctgggaaaaaggtatctcaacacgagattgcctcacctgacaaaataaagtctgttgccaactacataaaagagc

SEQ ID NO: 225896 - DNA, 75 bp, Artificial Sequence
  Synthetic
ccaatcctattgggttacccacctaatgtcctatgcaaatttggatttacaccgggagtatatcagaatgggctt

SEQ ID NO: 225897 - DNA, 75 bp, Artificial Sequence
  Synthetic
tcaagttggtgaccttggatgccacaaagggcgtatatgctctggagatccccgagccattgtttgagaaactaa

SEQ ID NO: 225898 - DNA, 75 bp, Artificial Sequence
  Synthetic
ccctccccttacatctgtactccattaccggtaccatatggtcgcaacagagtcgtcaccattacttactatacg

SEQ ID NO: 225899 - DNA, 75 bp, Artificial Sequence
  Synthetic
cagggaagaagtctccgcagaaaggaagcagcacactgatccccatcctggttccaagactcatgtcgaaggatg

SEQ ID NO: 225900 - DNA, 75 bp, Artificial Sequence
  Synthetic
taggcatacaaatcttttgctccaggaaataagagaattagtgagggactacttcttaagtcgatgtacaagaac

SEQ ID NO: 225901 - DNA, 75 bp, Artificial Sequence
  Synthetic
atctaggagggagggatctggtcatgtcaaccaaaggttcttgcgagaattgttattaccctggagccagtccaa

SEQ ID NO: 225902 - DNA, 75 bp, Artificial Sequence
  Synthetic
tcaagcatttcactttatcaaaacacagaaagggcggataactaaacttgctaatgattatcttaaatggagact

SEQ ID NO: 225903 - DNA, 75 bp, Artificial Sequence
  Synthetic
ctcaacctggaggagaacagtcgtagcctggagttaattacaacctagctatgattgagtgtccctgaattaaac

SEQ ID NO: 225904 - DNA, 75 bp, Artificial Sequence
  Synthetic
cgtattatcagcattagagcgatatactttatttgaacaagcactgaacaatattgagccctacattcaggtatg

SEQ ID NO: 225905 - DNA, 75 bp, Artificial Sequence
  Synthetic
tgagaatttttcttattgatcctctttgaccatacccagacacgcagagcttccaagtcctattgaggacgcact

SEQ ID NO: 225906 - DNA, 75 bp, Artificial Sequence
  Synthetic
tattttaggtccctgcaacaaagctttgtgcagcaacgatcatttgcccattccgctgctctatctcacacgaac

SEQ ID NO: 225907 - DNA, 75 bp, Artificial Sequence
  Synthetic
ggagggtaggaggaacgcgctggtcgactccgtcgctccgaccaatagctaacgcacaatgctatatctcttaac

SEQ ID NO: 225908 - DNA, 75 bp, Artificial Sequence
  Synthetic
tgatcaagccgagaggaagctactgaaccgactagtaggtctagtccagttcttcccagatgggctataataata

SEQ ID NO: 225909 - DNA, 75 bp, Artificial Sequence
  Synthetic
aagctaaccaactcaacccaaagcaatatgcaactaccatcgacatccccccgccactgagacaacccggcaccc

SEQ ID NO: 225910 - DNA, 75 bp, Artificial Sequence
  Synthetic
atatctgggaaatgagtcaaaatccccctgtagtataatcaccttaaccagatgaatcaacttatctcaatacag

SEQ ID NO: 225911 - DNA, 75 bp, Artificial Sequence
  Synthetic
ccccagttccccatgctggctcaatctaacagtcaaacatcacttagactatagtgaaagaaaacatatattgaa

SEQ ID NO: 225912 - DNA, 75 bp, Artificial Sequence
  Synthetic
ctgtagtataatcaccttaaccagatgaatcaacttatctcaatacaggtttagaattaagaaaaaactagttgt

SEQ ID NO: 225913 - DNA, 75 bp, Artificial Sequence
  Synthetic
gaacattaagaaaaagctgttcggagacagggatttcccatccactatattgctttaccaataacatcgagctta

SEQ ID NO: 225914 - DNA, 75 bp, Artificial Sequence
  Synthetic
catactcctcttgaaaatcaagagaggctgagttttgccacgggtgcagaaccgggacaagatggtgcccaccta

SEQ ID NO: 225915 - DNA, 75 bp, Artificial Sequence
  Synthetic
cccgtacagcagcctattagattggagaccaccaccaaacaccctaccatggatcctcaaccttgtggtctttta

SEQ ID NO: 225916 - DNA, 75 bp, Artificial Sequence
  Synthetic
taccatagcctggctgcccgggggagtctcaggaattccactcggtttgttgggaaacaacagcatcacccaaac

SEQ ID NO: 225917 - DNA, 75 bp, Artificial Sequence
  Synthetic
tgtcgtggacaatgtagtgtgcaaggaacaccttgccacaacagatcagctacaggctattggattgggactaga

SEQ ID NO: 225918 - DNA, 75 bp, Artificial Sequence
  Synthetic
ggggcttggtgaacatgctgacctcccgactgccaccaagcgatggggttttcgatctgatgtcatcccaaaaat

SEQ ID NO: 225919 - DNA, 75 bp, Artificial Sequence
  Synthetic
cgtgggatacaccgctggggaatgggtggaaaactgctacaatcttgaaatcaccaagaaagatggtcatccttg

SEQ ID NO: 225920 - DNA, 75 bp, Artificial Sequence
  Synthetic
cctccccagcccgccaactggcttacttggctatccccgatgccgctatgtccacagagccaaaggagcaggccc

SEQ ID NO: 225921 - DNA, 75 bp, Artificial Sequence
  Synthetic
ttgcccaggtgggaatgctttccacaaacatggttctttctttctgtaccacggtatggcttctacagtaattta

SEQ ID NO: 225922 - DNA, 75 bp, Artificial Sequence
  Synthetic
tcatggtgtaacctttacggaaggcacaattgctttcctaattgtcccgaaggatgcaccccgtctcaaggcagg

SEQ ID NO: 225923 - DNA, 75 bp, Artificial Sequence
  Synthetic
gcttggaacaggattcagtcatcaagcagagaaccaaaacccaaacaaccaatttcgaacaacaactttagatta

SEQ ID NO: 225924 - DNA, 75 bp, Artificial Sequence
  Synthetic
tgatgtaatgagtccttggatggacaatgctaccttcttctttcgagcgagggaagacacatcaatgctaatcca

SEQ ID NO: 225925 - DNA, 75 bp, Artificial Sequence
  Synthetic
aacaaggtaccctccagcaaatctagagcttgttcaagaaagattggctaatcttaccggagatcaagctgatcc

SEQ ID NO: 225926 - DNA, 75 bp, Artificial Sequence
  Synthetic
atcaaagatggaagagattgtcgctgaggttttgacattggagctcggtgattggtccggttggacaactaaaaa

SEQ ID NO: 225927 - DNA, 75 bp, Artificial Sequence
  Synthetic
aaccgcagtacaaaccatacggctaagaaacccttcaccagcatctggttcaaccaaggacaagactggccagaa

SEQ ID NO: 225928 - DNA, 75 bp, Artificial Sequence
  Synthetic
gcccatgacggatcatcaggagttcatcctccaacctcattctgctgttggacaaccctgcctctggaacattct

SEQ ID NO: 225929 - DNA, 75 bp, Artificial Sequence
  Synthetic
tcgaactccggggcggaaccctgcacgaaggcaccggcgggaaacaccaccaacaatgtccatcactgctgctcc

SEQ ID NO: 225930 - DNA, 75 bp, Artificial Sequence
  Synthetic
tgggtcaggatacaagccgtacatccaggcaatacctctggtgaaatttcgatgccattgggagggtcttcggca

SEQ ID NO: 225931 - DNA, 75 bp, Artificial Sequence
  Synthetic
tgtgtgtcgtcgatacccctcctgggttcagtgagcaacaatagttcaatacaggagcttgagacttcatctaaa

SEQ ID NO: 225932 - DNA, 75 bp, Artificial Sequence
  Synthetic
agtgcaacagaattgacaactcccatcaatcactcccaatcactacagctcgcatccgtcacaaacacccccaca

SEQ ID NO: 225933 - DNA, 75 bp, Artificial Sequence
  Synthetic
ccgacaacacagtccaagtcctggacagttgactacaacaacacaacgccaaccatggatcccacaacaatactg

SEQ ID NO: 225934 - DNA, 75 bp, Artificial Sequence
  Synthetic
acgacacccgacaccgcaaccattccccctaacaactcatctgatcacaacgccacaacaacaagcaaaacaaga

SEQ ID NO: 225935 - DNA, 75 bp, Artificial Sequence
  Synthetic
cgaaggagacaggtcaacccagtgcccccaacgatcacccaacaaacctctacaagcatcaatacctcccaccac

SEQ ID NO: 225936 - DNA, 75 bp, Artificial Sequence
  Synthetic
cccaatatgacaacacagttagcaagacatccgagtgtgcaaacaaggatgcaaaaccccagctgtaatcccaac

SEQ ID NO: 225937 - DNA, 75 bp, Artificial Sequence
  Synthetic
cttagatactggacaagccgggagatgagtaatgctggggggcttgcatggattccatggattggaccagggatt

SEQ ID NO: 225938 - DNA, 75 bp, Artificial Sequence
  Synthetic
gagggagggatcacagacgggataatggagcatcagaacacaattgtctgtcagttacgggagctcgcgaacacc

SEQ ID NO: 225939 - DNA, 75 bp, Artificial Sequence
  Synthetic
actactaaagccctacagcttttcctccgggctaccactgagctccgaacctactctatcctcaaccgccatgcg

SEQ ID NO: 225940 - DNA, 75 bp, Artificial Sequence
  Synthetic
attgactttctactacagcgttggggtggtacctgcagaatccttggcccaaactgctgtatcgaacctcatgat

SEQ ID NO: 225941 - DNA, 75 bp, Artificial Sequence
  Synthetic
tggtctgccaacattacggctgagataaatcatattagagaagatatcctgaaccatcatgagatccaaccttct

SEQ ID NO: 225942 - DNA, 75 bp, Artificial Sequence
  Synthetic
caagacccctccttttggactggatggcaacagtggatcccaacaggagccagtgctctcggaatcatcctggca

SEQ ID NO: 225943 - DNA, 75 bp, Artificial Sequence
  Synthetic
atattagccttgatttgtctgtgcagaataacacgatgagtagaccgaaagggaaaggcaaaacaaaaaacaatc

SEQ ID NO: 225944 - DNA, 75 bp, Artificial Sequence
  Synthetic
accgccgtgttgccacagccgaaagtcagtccaagccccaatacacagacacccgacaacctcctacgaggcctc

SEQ ID NO: 225945 - DNA, 75 bp, Artificial Sequence
  Synthetic
aaagggccaaaacacaccctcgaaccaggagattaacaggtttaactgagggccgagagaccaaccgctagacaa

SEQ ID NO: 225946 - DNA, 75 bp, Artificial Sequence
  Synthetic
ctacaaatgatggggacctctcctgcaacttcgacccgacgcaacatcaaccctacaatccagcataaggtcaga

SEQ ID NO: 225947 - DNA, 75 bp, Artificial Sequence
  Synthetic
cggtgagcccctgattggctccaccgaacactttaaaacataagcatcaatataacttatctgcatctaatccaa

SEQ ID NO: 225948 - DNA, 75 bp, Artificial Sequence
  Synthetic
tctgcttcccagtacttcttatatacttgaaataaagcaatgatgaatattaagaaaaaactaggctagtattgt

SEQ ID NO: 225949 - DNA, 75 bp, Artificial Sequence
  Synthetic
atagtcttgaccttcttgaaacaaggtagcctagcttgcttaaccggctcttaaagggatcgagatggctgctgg

SEQ ID NO: 225950 - DNA, 75 bp, Artificial Sequence
  Synthetic
tccactaagagccaaagaatgggcaaggagacaattggacaatacaatcagtcatccagttggtccacggccttc

SEQ ID NO: 225951 - DNA, 75 bp, Artificial Sequence
  Synthetic
gaactaccacatcggatctaacctggcccctcagcactatccgagtggaaggggttttaatgaaagagggagaag

SEQ ID NO: 225952 - DNA, 75 bp, Artificial Sequence
  Synthetic
cgtcagtcgacagtgtccaggacaaggcacacaagtcaggccacgttcgcagtcaatgtcgaggttgactaactc

SEQ ID NO: 225953 - DNA, 75 bp, Artificial Sequence
  Synthetic
aagaataacccctggagattggcaatgtcaaccgtgtgattatcccaaggcaaggttcaaacgtgttgaacagtc

SEQ ID NO: 225954 - DNA, 75 bp, Artificial Sequence
  Synthetic
cctggtgccacctgcacccaaagacatctgtccaactctgaaaaaggggtatctttgtgacagccaattctgtaa

SEQ ID NO: 225955 - DNA, 75 bp, Artificial Sequence
  Synthetic
aaaagaccataatctagagcaactaacggatcatgagttgttgttacttgtggcacgacagagctgcatatcatc

SEQ ID NO: 225956 - DNA, 75 bp, Artificial Sequence
  Synthetic
tccggcagcacgagaaatcccgcgggccaaagactgtaggcttgcgacaccatcattgtgtgactaccagcagca

SEQ ID NO: 225957 - DNA, 75 bp, Artificial Sequence
  Synthetic
taaccaagagagtctgaccctaaacaggctttgtgagatcgctcaagcctgggcatctatgacttgggaggatat

SEQ ID NO: 225958 - DNA, 75 bp, Artificial Sequence
  Synthetic
agacgacaaacaattacgagccttattaacattaagtgcagttcttgtcagaaagcactccaaatcgcagttatc

SEQ ID NO: 225959 - DNA, 75 bp, Artificial Sequence
  Synthetic
agctctttgtgagaatcatgtccgcagggaggccctcgctcaagaccaagctagcattgttctcgaagtatatca

SEQ ID NO: 225960 - DNA, 75 bp, Artificial Sequence
  Synthetic
gaaactacatagcgacaagggtggaaagtttgaagctgcgttatggcaacattgggatcggggatctttgactct

SEQ ID NO: 225961 - DNA, 75 bp, Artificial Sequence
  Synthetic
tttcatccatgctgctctgcgggcagggaccactatcccatgtgaaagctcggcaattgtagtcgccagtattat

SEQ ID NO: 225962 - DNA, 75 bp, Artificial Sequence
  Synthetic
gtcattgttgtccaattcccaaaatgattcttctgaaccagtagctgaagggccacctggccaagatcagcaata

SEQ ID NO: 225963 - DNA, 75 bp, Artificial Sequence
  Synthetic
gggctcagcactgcatccaccagtccaccaacagaactaacctttccgaccctgaccctacccacacactacata

SEQ ID NO: 225964 - DNA, 75 bp, Artificial Sequence
  Synthetic
cccatgcaagcagagatcccactaccagcaaacacccctctcgaaaacccaccaaggtagaaggccagccgacct

SEQ ID NO: 225965 - DNA, 75 bp, Artificial Sequence
  Synthetic
gtcagccaacaacaacaaagtaggcaacctaccccaactcctaccaccgatccgaacaacgaacaaccaacacag

SEQ ID NO: 225966 - DNA, 75 bp, Artificial Sequence
  Synthetic
tcctccgaggaggcaacacaacacagaacagtccacccgactccagagcaacaaaacaaacgggccttcaaaagc

SEQ ID NO: 225967 - DNA, 75 bp, Artificial Sequence
  Synthetic
tgcacagtcagccaccacacaaaccatccaccccagactccgacacacccagaccccatgccagtggagggcacg

SEQ ID NO: 225968 - DNA, 75 bp, Artificial Sequence
  Synthetic
acaccaacacagcccacagaggctcccccagccaacaccacccacacaaaaggggtttcgtccaaacacccaagc

SEQ ID NO: 225969 - DNA, 75 bp, Artificial Sequence
  Synthetic
acgatcacctgcaccaaccggccctcttgtccaccaaagatagcaccactccaggggaggcgaaacaatttatta

SEQ ID NO: 225970 - DNA, 75 bp, Artificial Sequence
  Synthetic
agaaaaaagagacgaagaacattaagtgagcttagattgacacattgagctttaacatagtcaattccaacgctc

SEQ ID NO: 225971 - DNA, 75 bp, Artificial Sequence
  Synthetic
caaagcaatagtttaaaagtaatttatcaaagaaatttccaagaaaaaagaggcaggagtggagcataaccttac

SEQ ID NO: 225972 - DNA, 75 bp, Artificial Sequence
  Synthetic
cagacaagactgcaaaaaagaagacccccttttgggggggtgtagatacccagggcaatcaaccaaccatcaagc

SEQ ID NO: 225973 - DNA, 75 bp, Artificial Sequence
  Synthetic
aacaaccaacaaacaggaaaggacctccccctgccataggggacaagccagacagtttccaccactccctccagg

SEQ ID NO: 225974 - DNA, 75 bp, Artificial Sequence
  Synthetic
actaacaaaccgcggaaccattcaagagccccaccgctgcagacaaacgaacaagaacacaaaccaggcacaccc

SEQ ID NO: 225975 - DNA, 75 bp, Artificial Sequence
  Synthetic
agcatccagccctccgatccagtccacacaccacaagaggatccaggctgggcagaagtcccaaccagctgccga

SEQ ID NO: 225976 - DNA, 75 bp, Artificial Sequence
  Synthetic
cagacgaaagacaaaggttcctcccacgatccaaggccgcccacgccaccaaacccgagacaaaacatcgatccg

SEQ ID NO: 225977 - DNA, 75 bp, Artificial Sequence
  Synthetic
ctcagatcggcacaaccgaacacggcccccgaagtcgggcatcccaaaaccagacaccaccgcaaagaggaccta

SEQ ID NO: 225978 - DNA, 75 bp, Artificial Sequence
  Synthetic
gacaaagggccaccacagttcaaggcctgcatcaggagacccacgggacaaacccagacaaaatcccacacaaaa

SEQ ID NO: 225979 - DNA, 75 bp, Artificial Sequence
  Synthetic
ggctgacccaccatggcccgaccgtcaggaaggtacaacatcctccagaccgacacattccatgagaatactgtt

SEQ ID NO: 225980 - DNA, 75 bp, Artificial Sequence
  Synthetic
gtaaaacatgatctatgtaattttcttgtcacaacaacaatcactgggtgggatgtctactgggctggtcatctt

SEQ ID NO: 225981 - DNA, 75 bp, Artificial Sequence
  Synthetic
ttccatgtccccaacaaaggaattgcgcttctcacccgtctaaagacatctgattttgcacctgcatggaccctg

SEQ ID NO: 225982 - DNA, 75 bp, Artificial Sequence
  Synthetic
accaagaatctatttccacatctatttcataacccgaccagtaccctcaaagaccctgtttggggccttagagtg

SEQ ID NO: 225983 - DNA, 75 bp, Artificial Sequence
  Synthetic
atcctggcagcagccctgtatgatcaagtaatggaacaatccctcatcaaacccctaagcgagaccttaactctg

SEQ ID NO: 225984 - DNA, 75 bp, Artificial Sequence
  Synthetic
ctaggagattggcttttgaccacagaaacgcaaaaattcaatctgagaacccctcgggcccaggaacaaataagc

SEQ ID NO: 225985 - DNA, 75 bp, Artificial Sequence
  Synthetic
ttgaggatgttatccttggtaaagaagcatgtggacaactttatcctaaaacttcttgaacttcatgtcataaac

SEQ ID NO: 225986 - DNA, 75 bp, Artificial Sequence
  Synthetic
aatcgagggtttacaagcagcattgaaatcggaaacaagtgtaatactataatcatttcccgaacaaacatggga

SEQ ID NO: 225987 - DNA, 75 bp, Artificial Sequence
  Synthetic
taccttgttgaacagcaggaaccggacaagtctgcacttcgaaaaacaaaacctggtccagtcaaatttacttta

SEQ ID NO: 225988 - DNA, 75 bp, Artificial Sequence
  Synthetic
gtgcacgaggatgcattcagggactttaaaccagaaagatcgagcataaatttattaatcatggagtttaatagt

SEQ ID NO: 225989 - DNA, 75 bp, Artificial Sequence
  Synthetic
tcactcgccatatgagtcccacaggaaacctctgggagtctggccgcaacccactggagtgtcaccaaggcatct

SEQ ID NO: 225990 - DNA, 75 bp, Artificial Sequence
  Synthetic
cccagagaaacacccgaaccgaaaccgctcataactcaacatgccgatcactctcaccctcactagcaaaagaga

SEQ ID NO: 225991 - DNA, 75 bp, Artificial Sequence
  Synthetic
acaggaggcctcccacaagtacattcgttctcttgaatcaatcctaatcttcccttcaactctcaagatccttcc

SEQ ID NO: 225992 - DNA, 75 bp, Artificial Sequence
  Synthetic
tcttcttactttgttccgctcctcgcctagtcccaacacagcaatcaccaaccagatcgaagaaaccgcggcagg

SEQ ID NO: 225993 - DNA, 75 bp, Artificial Sequence
  Synthetic
tcgacccaactgagcaacatcgactgcaacttcacacaagcctccaactggcctccaacagataccgcaaagaac

SEQ ID NO: 225994 - DNA, 75 bp, Artificial Sequence
  Synthetic
ccaaatgcaggaagcacagtacccagatgctagattatcatcaccaatagtgctcgatcaatgtgatctagtagc

SEQ ID NO: 225995 - DNA, 75 bp, Artificial Sequence
  Synthetic
aagagcatgtaatttatattcaaattactcatataacccaacactcaagaagtgtcgattacccaagcacattta

SEQ ID NO: 225996 - DNA, 75 bp, Artificial Sequence
  Synthetic
tagactacagtatgatatagcagtaaatgagtttcttgccggggtccctctttctactttacccattgactatct

SEQ ID NO: 225997 - DNA, 75 bp, Artificial Sequence
  Synthetic
ggttccacttatcattaatgccaacacagattcaatcaaaattcaagatcaaccctcgattaaaaatcatatcaa

SEQ ID NO: 225998 - DNA, 75 bp, Artificial Sequence
  Synthetic
ggacggaatttcctttgctctacatgattctggatttctcaactattatctcaaaacaattggtattaatactat

SEQ ID NO: 225999 - DNA, 75 bp, Artificial Sequence
  Synthetic
gatagatttggggacgttccataactcagccaaaaagatcctactaaatgagcgaataattgatgaagcggttac

SEQ ID NO: 226000 - DNA, 75 bp, Artificial Sequence
  Synthetic
atggctagatcttgttgtggctgcaagacgtgcacgtatgaaccgtggaaatacacgatccacatggtacgcatc

SEQ ID NO: 226001 - DNA, 75 bp, Artificial Sequence
  Synthetic
aggagaattaatagatatattgggttatggggattacattttctggaaaatccccttaaagttattaccattaaa

SEQ ID NO: 226002 - DNA, 75 bp, Artificial Sequence
  Synthetic
agattttcttgcacgtgcgtgctatagcttcggacagctttggcagcggcaggtttgaaagagacactttttcac

SEQ ID NO: 226003 - DNA, 75 bp, Artificial Sequence
  Synthetic
tttcatcagtcgtgaacgtgttgagaaaaagacagcttaggagaacaagagctggggatgggcaggaagaccatc

SEQ ID NO: 226004 - DNA, 75 bp, Artificial Sequence
  Synthetic
aaaaagacagcttaggagaacaagagctggggatgggcaggaagaccatcctgaaaggcaaggggggcggtcccc

SEQ ID NO: 226005 - DNA, 75 bp, Artificial Sequence
  Synthetic
ctgaaaggcaaggggggcggtccccctcgacgagtgtcgaaagagaccgcgacgaagacgcgtcaatctagagtc

SEQ ID NO: 226006 - DNA, 75 bp, Artificial Sequence
  Synthetic
caaatgccaaatggactggtgttgatgcgcatgatggggatattgtggcatgctgtggctggcactgcgagaaac

SEQ ID NO: 226007 - DNA, 75 bp, Artificial Sequence
  Synthetic
ccgttccgttgaggcaggccactgcagcactccggaagatcaagaggacagtgagtgctttgatggttggcttgc

SEQ ID NO: 226008 - DNA, 75 bp, Artificial Sequence
  Synthetic
gtgagtgctttgatggttggcttgcaaaggcgcggaaaaagaaggtcagtgacgaactggatgaactggttgctg

SEQ ID NO: 226009 - DNA, 75 bp, Artificial Sequence
  Synthetic
gtcattgctctgttggggatgacacttgcagcaacagtaaggaaagaaagggacggcaccactgtgatcagggct

SEQ ID NO: 226010 - DNA, 75 bp, Artificial Sequence
  Synthetic
gatcctggccacagacatggggtcatggtgtgatgactcgctgtcatacgagtgtgtgaccatagagcaagggga

SEQ ID NO: 226011 - DNA, 75 bp, Artificial Sequence
  Synthetic
agtgtgtgaccatagagcaaggggaagagcctgttgacgtggattgtttttgccggaatgttgacggagtctatt

SEQ ID NO: 226012 - DNA, 75 bp, Artificial Sequence
  Synthetic
tggagtatggccgttgcgggaaacaggagggctcacggacaagacgctcggtgctgatcccaacccatgcccagg

SEQ ID NO: 226013 - DNA, 75 bp, Artificial Sequence
  Synthetic
ggagggctcacggacaagacgctcggtgctgatcccaacccatgcccagggagagttgacggggaggggacgcaa

SEQ ID NO: 226014 - DNA, 75 bp, Artificial Sequence
  Synthetic
acacacctcacgagagtggaaggatgggtttggaaaaacaaactgcttgctctggcgatggttgccgttgtgtgg

SEQ ID NO: 226015 - DNA, 75 bp, Artificial Sequence
  Synthetic
ctagcactggagagtgtggtgaccagggttgccgtgctggttgtgctcctgtgtttggccccggtctacgcctcg

SEQ ID NO: 226016 - DNA, 75 bp, Artificial Sequence
  Synthetic
cgctgcacacatttggaaaacagggactttgtcactggcacccaggggactacaagagtcaccttggtgctggag

SEQ ID NO: 226017 - DNA, 75 bp, Artificial Sequence
  Synthetic
ctgaggggaagccctcaatggatgtgtggcttgacgccatctaccaggagagccctgccaagacacgcgagtact

SEQ ID NO: 226018 - DNA, 75 bp, Artificial Sequence
  Synthetic
agccctgccaagacacgcgagtactgtttgcacgccaagttgtcagagactaaggttgccgctagatgtccaacg

SEQ ID NO: 226019 - DNA, 75 bp, Artificial Sequence
  Synthetic
ggcaatcactgtgggttgtttggaaagggcagcattgtggcctgcgtcaaggcggcttgtgaagcaaagaagaaa

SEQ ID NO: 226020 - DNA, 75 bp, Artificial Sequence
  Synthetic
agggcagcattgtggcctgcgtcaaggcggcttgtgaagcaaagaagaaagccacgggatacgtgtacgatgcca

SEQ ID NO: 226021 - DNA, 75 bp, Artificial Sequence
  Synthetic
tgaaccacacacgggagactatgttgccgccaacgagacgcacaaggggaggaaaacggcgactttcacggtttc

SEQ ID NO: 226022 - DNA, 75 bp, Artificial Sequence
  Synthetic
ttcagagaagaccatcttgaccttaggggaatatggagacgtctcactgctatgtagggtagccagtggcgtcga

SEQ ID NO: 226023 - DNA, 75 bp, Artificial Sequence
  Synthetic
tatgtagggtagccagtggcgtcgacttggctcagaccatcatcctggaactcgacaagacagcggagcaccttc

SEQ ID NO: 226024 - DNA, 75 bp, Artificial Sequence
  Synthetic
tggaagcatgatggaaacccacactggaacaatgcagagagattggttgagtttggtgcccctcatgctgtcaag

SEQ ID NO: 226025 - DNA, 75 bp, Artificial Sequence
  Synthetic
atggatgtgtacaaccttggagatcagactggagtgctgctgaaggcgctagcaggggttcctgtggcacacatt

SEQ ID NO: 226026 - DNA, 75 bp, Artificial Sequence
  Synthetic
gagggaaacaagtatcacctgaagagtggtcatgtgacctgcgaagtgggactggaaaaactaaagatgaaaggt

SEQ ID NO: 226027 - DNA, 75 bp, Artificial Sequence
  Synthetic
actggaaaaactaaagatgaaaggtctcacgtacaccatgtgtgataaatcaaagtttgcatggaagagaactcc

SEQ ID NO: 226028 - DNA, 75 bp, Artificial Sequence
  Synthetic
caaagtttgcatggaagagaactccaacagacagtgggcatgacacagtggttatggaagtcacattctccgggt

SEQ ID NO: 226029 - DNA, 75 bp, Artificial Sequence
  Synthetic
gttatggaagtcacattctccgggtcaaagccatgcaggatcccggtgagagcagtggcacatggatctcctgat

SEQ ID NO: 226030 - DNA, 75 bp, Artificial Sequence
  Synthetic
agcagtggcacatggatctcctgatgtcaatgtagccatgctgataacgccaaaccccacaattgaaaatgatgg

SEQ ID NO: 226031 - DNA, 75 bp, Artificial Sequence
  Synthetic
caaaccccacaattgaaaatgatggaggaggtttcatagagatgcagcttcccccaggggacaacatcatctatg

SEQ ID NO: 226032 - DNA, 75 bp, Artificial Sequence
  Synthetic
ttggggaactgagtcatcaatggttccagacagggagcagcattggaagggtgttccaaacaaccaggaaaggta

SEQ ID NO: 226033 - DNA, 75 bp, Artificial Sequence
  Synthetic
tagaaagactgacagtaataggagagcacgcttgggactttgggtccgctgggggcttctttagctcaattggaa

SEQ ID NO: 226034 - DNA, 75 bp, Artificial Sequence
  Synthetic
tgggagtggcactggcctggttgggactgaacacaaggaaccccacaatgtccatgagctttctcctggctggag

SEQ ID NO: 226035 - DNA, 75 bp, Artificial Sequence
  Synthetic
gtctggtcttggccatgactctcggggtgggagcggatgtcggctgtgcagtggacacagagcgaatggagctcc

SEQ ID NO: 226036 - DNA, 75 bp, Artificial Sequence
  Synthetic
ggtgggagcggatgtcggctgtgcagtggacacagagcgaatggagctccgctgtggtgagggtttggttgtgtg

SEQ ID NO: 226037 - DNA, 75 bp, Artificial Sequence
  Synthetic
aactatgcatactacccggaaacaccaggggctcttgcatcggcaataaaagaggcatttgaggagggaagctgt

SEQ ID NO: 226038 - DNA, 75 bp, Artificial Sequence
  Synthetic
agaggcatttgaggagggaagctgtggcgtagtcccccagaacagacttgagatggccatgtggagaagctcggt

SEQ ID NO: 226039 - DNA, 75 bp, Artificial Sequence
  Synthetic
gaaggggatgcaaatctcacagtggtggtagacaaaaacgaccccactgactaccgaggcggagttcctggcatg

SEQ ID NO: 226040 - DNA, 75 bp, Artificial Sequence
  Synthetic
ctgaaaaaagggaaggacatgaaggtctcttggaggagctggggccactcaatgatctggagcatccctgaggct

SEQ ID NO: 226041 - DNA, 75 bp, Artificial Sequence
  Synthetic
aatgatctggagcatccctgaggctcctcggcgtttcatggtgggtacagagggacaaagtgagtgcccactaga

SEQ ID NO: 226042 - DNA, 75 bp, Artificial Sequence
  Synthetic
gagacgaaaaacaggtgtgttcacggttgcagagtttggggtcggtctgagaacaaaagtctttctggattttag

SEQ ID NO: 226043 - DNA, 75 bp, Artificial Sequence
  Synthetic
acaggagtgatgggggccgccgttaaaaacggcatggcggtccacacagatcaaagcctctggatgaaatcgatg

SEQ ID NO: 226044 - DNA, 75 bp, Artificial Sequence
  Synthetic
actcggagctttttcttccggcgagtctcgcaggacccaggtcctggtacaacaggatccctggctactcggaac

SEQ ID NO: 226045 - DNA, 75 bp, Artificial Sequence
  Synthetic
gcccctccgagtcatcagagaggagtgtccaggaacgaccgtcacaataaacgccaagtgtgaaaagaggggggc

SEQ ID NO: 226046 - DNA, 75 bp, Artificial Sequence
  Synthetic
ttccgtgaggagcaccacagagagtggcaaggtgattccggaatggtgctgccgagcatgcacaatgcctccagt

SEQ ID NO: 226047 - DNA, 75 bp, Artificial Sequence
  Synthetic
tggtatgccatggaaataaggccagtacacgctcagggggggcttgtccgctcaatggtggttgcggacaatggt

SEQ ID NO: 226048 - DNA, 75 bp, Artificial Sequence
  Synthetic
ctcaatggtggttgcggacaatggtgagctgctcagtgagggaggagtccccgggatagtggcattgtttgtggt

SEQ ID NO: 226049 - DNA, 75 bp, Artificial Sequence
  Synthetic
gagctgctcagtgagggaggagtccccgggatagtggcattgtttgtggtcctggaatgtatcattcggaggaga

SEQ ID NO: 226050 - DNA, 75 bp, Artificial Sequence
  Synthetic
cctggaatgtatcattcggaggagaccttctacaggagtgacggtcgtatggggaggtgttgtcgtcctcgctct

SEQ ID NO: 226051 - DNA, 75 bp, Artificial Sequence
  Synthetic
ccttctacaggagtgacggtcgtatggggaggtgttgtcgtcctcgctctgctcgtcactggaatggtcaggatt

SEQ ID NO: 226052 - DNA, 75 bp, Artificial Sequence
  Synthetic
ggggaggtgttgtcgtcctcgctctgctcgtcactggaatggtcaggattgagagcctcgtgcgttatgtggtgg

SEQ ID NO: 226053 - DNA, 75 bp, Artificial Sequence
  Synthetic
cggtggggattgcgttccaccttgagctgggaccagagactgtggccttgatgctacttcaggccgtgtttgagc

SEQ ID NO: 226054 - DNA, 75 bp, Artificial Sequence
  Synthetic
atgctacttcaggccgtgtttgagctaagagttggacttctcagcgcctttgcgctgcgcagaggcctcaccgtc

SEQ ID NO: 226055 - DNA, 75 bp, Artificial Sequence
  Synthetic
cgagagatggttactacctacttccttctgttggtcctggagatgggactgccgagtgcgagcctcggggatctc

SEQ ID NO: 226056 - DNA, 75 bp, Artificial Sequence
  Synthetic
tggaaatggagtgatgcgctggccatgggggcactgatattcagagcttgcaccgcggagggaaagactggaacg

SEQ ID NO: 226057 - DNA, 75 bp, Artificial Sequence
  Synthetic
caccgcggagggaaagactggaacggggctcttgctcatagccctcatgacacagagggatgttgtgactgtaca

SEQ ID NO: 226058 - DNA, 75 bp, Artificial Sequence
  Synthetic
cacagagggatgttgtgactgtacaccacggacttgtgtgcttcctggccgcggctgcggcctgctcggtctgga

SEQ ID NO: 226059 - DNA, 75 bp, Artificial Sequence
  Synthetic
gactgcttaggggacacagggagcagaagggactgacctggataattcccttggctagattgcttggaggagagg

SEQ ID NO: 226060 - DNA, 75 bp, Artificial Sequence
  Synthetic
gctccgggataagattgctggctttctgggaactggcagcccacagaggaagacggtctttcagtgagccactga

SEQ ID NO: 226061 - DNA, 75 bp, Artificial Sequence
  Synthetic
ctgggaactggcagcccacagaggaagacggtctttcagtgagccactgaccgtggtaggggttatgctgacact

SEQ ID NO: 226062 - DNA, 75 bp, Artificial Sequence
  Synthetic
ggctagcggcatgatgcgtcacacctcccaagaggctctttgtgcgctcgcggtggcctcgtttttcttgctgat

SEQ ID NO: 226063 - DNA, 75 bp, Artificial Sequence
  Synthetic
gcttgtgctcgggacgaggaagatgcagctggttgctgaatggagcggctgtgttgaatggcatccggaactggt

SEQ ID NO: 226064 - DNA, 75 bp, Artificial Sequence
  Synthetic
cagctggttgctgaatggagcggctgtgttgaatggcatccggaactggtgaatgagggtggagagatcagcctg

SEQ ID NO: 226065 - DNA, 75 bp, Artificial Sequence
  Synthetic
cgggtccgccaggactcgatgggaaactttcatttgactgagcttgagaaagaggaaaggatgatggctttttgg

SEQ ID NO: 226066 - DNA, 75 bp, Artificial Sequence
  Synthetic
cactccattggtcaggtatccttggtgtgatgggactgtggacactcacagaaataatgaggtcatccagacggt

SEQ ID NO: 226067 - DNA, 75 bp, Artificial Sequence
  Synthetic
ccgacctggtctactcaggacagggaggccaagaacgtggcgacaggccttttgaggtcaaggatggagtttaca

SEQ ID NO: 226068 - DNA, 75 bp, Artificial Sequence
  Synthetic
aggccaagaacgtggcgacaggccttttgaggtcaaggatggagtttacagaatcttcagtcccggtttgttctg

SEQ ID NO: 226069 - DNA, 75 bp, Artificial Sequence
  Synthetic
gggtcagaggcaggtgggagttggttacggccacaagggtgtcttgcacacgatgtggcacgtgactagaggagc

SEQ ID NO: 226070 - DNA, 75 bp, Artificial Sequence
  Synthetic
aggaggacgtcgtgtgctacgggggagcctggagcctggaggaaaagtggaaaggtgaagtagtacaggtccatg

SEQ ID NO: 226071 - DNA, 75 bp, Artificial Sequence
  Synthetic
ccttcccaccggggaaggcccacgaggtgcaccagtgccagcccggagaattgatccttgacacaggaaagaggc

SEQ ID NO: 226072 - DNA, 75 bp, Artificial Sequence
  Synthetic
ttgatccttgacacaggaaagaggcttggggcaataccaattgacttggcaaagggaacatctggtagccctatt

SEQ ID NO: 226073 - DNA, 75 bp, Artificial Sequence
  Synthetic
aaagggaacatctggtagccctattctcaacgctcagggagcggttgttgggctatacggaaatggtctaaaaac

SEQ ID NO: 226074 - DNA, 75 bp, Artificial Sequence
  Synthetic
ggctatacggaaatggtctaaaaaccaatgagagctacgtcagcagcatcgctcagggagaggcggagaagagtc

SEQ ID NO: 226075 - DNA, 75 bp, Artificial Sequence
  Synthetic
caatgagagctacgtcagcagcatcgctcagggagaggcggagaagagtcgacccaaccttccacaggcagttgt

SEQ ID NO: 226076 - DNA, 75 bp, Artificial Sequence
  Synthetic
cagatcacagtgttggatatgcatccaggctctggaaagacccacagagtcctcccggagctcatccgccaatgc

SEQ ID NO: 226077 - DNA, 75 bp, Artificial Sequence
  Synthetic
attgacaggcgcctgaggacgttagtgctggctccaactcgcgtggtattgaaggagatggagcgtgctctcaat

SEQ ID NO: 226078 - DNA, 75 bp, Artificial Sequence
  Synthetic
catgcaacttatgtcaacagacgcttactcccacaggggaggcagaactgggaggtggcaataatggatgaggcc

SEQ ID NO: 226079 - DNA, 75 bp, Artificial Sequence
  Synthetic
cattggactgatccccatagtatagcagctagaggccacttgtacaccctggcaaaggaaaacaaatgcgccctt

SEQ ID NO: 226080 - DNA, 75 bp, Artificial Sequence
  Synthetic
gtcttgatgacagcaactccccccggcaaaagtgaacctttcccagagtccaacggagccatcaccagtgaggaa

SEQ ID NO: 226081 - DNA, 75 bp, Artificial Sequence
  Synthetic
caacggagccatcaccagtgaggaaagacagattcctgatggggagtggcgtgatggttttgactggatcactga

SEQ ID NO: 226082 - DNA, 75 bp, Artificial Sequence
  Synthetic
gtgatggttttgactggatcactgagtacgaaggacgcaccgcctggtttgttccttcaattgcaaagggtggtg

SEQ ID NO: 226083 - DNA, 75 bp, Artificial Sequence
  Synthetic
agtaaaacttttgaaaaagattattccagagtgagggaagagaagcctgatttcgtggtgacgactgatatctcg

SEQ ID NO: 226084 - DNA, 75 bp, Artificial Sequence
  Synthetic
gaaatgggagccaaccttgacgtgagtcgcgtcatagatggaaggacaaacatcaagcctgaggaggttgatggg

SEQ ID NO: 226085 - DNA, 75 bp, Artificial Sequence
  Synthetic
aaggttgagttcactggcaccagacgagtgaccacggcctccgctgcccagcgacgagggcgggtcggtaggcag

SEQ ID NO: 226086 - DNA, 75 bp, Artificial Sequence
  Synthetic
ggcggtcgaacagatgaatacatatactctggacagtgtgatgatgatgacagtggacttgtgcagtggaaagag

SEQ ID NO: 226087 - DNA, 75 bp, Artificial Sequence
  Synthetic
gcgcaaatacttcttgacaacataacaaccttgcggggtcctgtagccaccttctatggccctgagcaggacaag

SEQ ID NO: 226088 - DNA, 75 bp, Artificial Sequence
  Synthetic
atgccggaggtggccggccactttcgactcactgaggagaagaggaagcacttccgccaccttctcacccattgt

SEQ ID NO: 226089 - DNA, 75 bp, Artificial Sequence
  Synthetic
acgttgcagcgaacgtgtctagcgtgacggaccggagctggacatgggagggaccggaggccaacgccgtggacg

SEQ ID NO: 226090 - DNA, 75 bp, Artificial Sequence
  Synthetic
aggcaagcggggatctggtcaccttcaggagcccgaatggagcggagagaaccctcaggccggtgtggagagacg

SEQ ID NO: 226091 - DNA, 75 bp, Artificial Sequence
  Synthetic
caggagcccgaatggagcggagagaaccctcaggccggtgtggagagacgcacgcatgttcagagaaggacgtga

SEQ ID NO: 226092 - DNA, 75 bp, Artificial Sequence
  Synthetic
accctcaggccggtgtggagagacgcacgcatgttcagagaaggacgtgacatcaaggaatttgtggcgtacgcg

SEQ ID NO: 226093 - DNA, 75 bp, Artificial Sequence
  Synthetic
catcaaggaatttgtggcgtacgcgtccgggcggcggagctttggggatgtcttgacagggatgtcgggagttcc

SEQ ID NO: 226094 - DNA, 75 bp, Artificial Sequence
  Synthetic
tccgggcggcggagctttggggatgtcttgacagggatgtcgggagttccggagcttctgcggcacagatgcgtc

SEQ ID NO: 226095 - DNA, 75 bp, Artificial Sequence
  Synthetic
ggcaatgaagatggcagagagagatgcccccgaggctttcctgacggtggttgagatgatggttctgggtttggc

SEQ ID NO: 226096 - DNA, 75 bp, Artificial Sequence
  Synthetic
gaccctgggtgtcgtctggtgtttcgtcgtccgaacatcaatcagtcgcatgatgctcggcacgctggtcttgct

SEQ ID NO: 226097 - DNA, 75 bp, Artificial Sequence
  Synthetic
ggcctccctgttgcttctgtgggctggtggagtcagctacgggaatatggctggggtggcacttattttttacac

SEQ ID NO: 226098 - DNA, 75 bp, Artificial Sequence
  Synthetic
actgctgacagttctgcagcccgagactgggaaacagagaagcagtgacgacaacaaactggcatacttcctgtt

SEQ ID NO: 226099 - DNA, 75 bp, Artificial Sequence
  Synthetic
gaccctttgcagccttgctggactggttgccgcaaatgagatggggtttttggaaaaaaccaaggcggatctgtc

SEQ ID NO: 226100 - DNA, 75 bp, Artificial Sequence
  Synthetic
tggaaaaaaccaaggcggatctgtctgcggtgctgtggagtgagcacgagggacaccggcaatggagtgagtgga

SEQ ID NO: 226101 - DNA, 75 bp, Artificial Sequence
  Synthetic
acaacttgtcaatagtgccgtggcgtctggagcgcaggccatgagagacttgggggggggagcccccttctttgg

SEQ ID NO: 226102 - DNA, 75 bp, Artificial Sequence
  Synthetic
cccccacctcactgatagtgggcattggcttagcagctttccatttggccatcgtggtgtctggactggaggctg

SEQ ID NO: 226103 - DNA, 75 bp, Artificial Sequence
  Synthetic
agctgacacaaagagcccacaaggtctttttctctgcaatggtacgcaaccctatggtggatggggacgtcatca

SEQ ID NO: 226104 - DNA, 75 bp, Artificial Sequence
  Synthetic
acccgttcagagagggagaggcaaagccagccctatacgaaaggaaaatgagtctggctttggccatagtgctgt

SEQ ID NO: 226105 - DNA, 75 bp, Artificial Sequence
  Synthetic
gtctcgtgtctgtggtcatgaaccgcacagtggcttccatgacagaggctgcggctgtggggctggcagccaccg

SEQ ID NO: 226106 - DNA, 75 bp, Artificial Sequence
  Synthetic
cacagtggcttccatgacagaggctgcggctgtggggctggcagccaccggacagcttctcagaccggaggcgga

SEQ ID NO: 226107 - DNA, 75 bp, Artificial Sequence
  Synthetic
gacagcttctcagaccggaggcggacacactgtggacgatgccggtggcatgcggtatgagtggcgtggtcaggg

SEQ ID NO: 226108 - DNA, 75 bp, Artificial Sequence
  Synthetic
gcagcctctgggggtttctgccccttgggcacagactctggctccgggcttctgggggcaggcgtggtggctctg

SEQ ID NO: 226109 - DNA, 75 bp, Artificial Sequence
  Synthetic
acggagacacgcttggtgacctgtggaaacgcaggctgaacaactgcactagggaggaattcttcgtttacaggc

SEQ ID NO: 226110 - DNA, 75 bp, Artificial Sequence
  Synthetic
tgacaaagccagagagctgctcaggagaggagagacaaacatgggactggcggtctcgcgtggcacggcaaagct

SEQ ID NO: 226111 - DNA, 75 bp, Artificial Sequence
  Synthetic
cgcctggcttgaagaacgcggatacgccaccctcaagggggaagtggtagatctcgggtgtggaaggggtggctg

SEQ ID NO: 226112 - DNA, 75 bp, Artificial Sequence
  Synthetic
gtcctactatgcggcttctcggccggcagtcatgagtgtcagggcgtataccattggcggaagagggcatgaggt

SEQ ID NO: 226113 - DNA, 75 bp, Artificial Sequence
  Synthetic
cccaaagatggtgacaagcctgggttggaacttgattaaattcagagcaggaatggacgtgttcagcatgcaacc

SEQ ID NO: 226114 - DNA, 75 bp, Artificial Sequence
  Synthetic
ccgctgtggagggtgaaaggaccaggaaagtgatattactcatggagcaatggaaaatccgaaacccagcggcgg

SEQ ID NO: 226115 - DNA, 75 bp, Artificial Sequence
  Synthetic
tggaaaatccgaaacccagcggcggcctgtgtgttcaaggtgctggctccataccgcccagaggtaatagaagca

SEQ ID NO: 226116 - DNA, 75 bp, Artificial Sequence
  Synthetic
cctgtgtgttcaaggtgctggctccataccgcccagaggtaatagaagcattgcacagattccagctgcagtggg

SEQ ID NO: 226117 - DNA, 75 bp, Artificial Sequence
  Synthetic
ctcaaggaactcaactcacgagatgtactactcgacagctgtcacaggcaatatagtgaactctgtcaacataca

SEQ ID NO: 226118 - DNA, 75 bp, Artificial Sequence
  Synthetic
tactactcgacagctgtcacaggcaatatagtgaactctgtcaacatacaatcgaggaagctcctggcccggttt

SEQ ID NO: 226119 - DNA, 75 bp, Artificial Sequence
  Synthetic
atcgaggaagctcctggcccggtttggagaccagagagggccaaccaaagtccctgagcttgacctgggagtggg

SEQ ID NO: 226120 - DNA, 75 bp, Artificial Sequence
  Synthetic
aactcggtgtgtggtcctggctgaggataaggtaaaagaacaagatgtgcaagagaggatcagagctttgcggga

SEQ ID NO: 226121 - DNA, 75 bp, Artificial Sequence
  Synthetic
acagtacaatgagacttggcacaaggacgaggaacacccgtacagaacatggcagtactggggtagctaccgcac

SEQ ID NO: 226122 - DNA, 75 bp, Artificial Sequence
  Synthetic
agcaccaactgggtcggcggcatcactgatcaatggggtcgtgaagcttctcagctggccatggaacgcgcggga

SEQ ID NO: 226123 - DNA, 75 bp, Artificial Sequence
  Synthetic
gacacgacagcctttggacagcagagagtgtttaaagagaaagttgacacaaaagcacaggagccccaaccgggg

SEQ ID NO: 226124 - DNA, 75 bp, Artificial Sequence
  Synthetic
gagtgtttaaagagaaagttgacacaaaagcacaggagccccaaccggggacaagagtgatcatgagagcagtga

SEQ ID NO: 226125 - DNA, 75 bp, Artificial Sequence
  Synthetic
aaaagcacaggagccccaaccggggacaagagtgatcatgagagcagtgaacgattggattctagagcggctggc

SEQ ID NO: 226126 - DNA, 75 bp, Artificial Sequence
  Synthetic
ccagaaaagcaaaccacgcatgtgcagcagagaggaattcatagcaaaagtaagatcaaatgcagccctgggagc

SEQ ID NO: 226127 - DNA, 75 bp, Artificial Sequence
  Synthetic
taagatcaaatgcagccctgggagcttggtcagatgaacagaacagatgggcaagtgcgagagaggctgtggagg

SEQ ID NO: 226128 - DNA, 75 bp, Artificial Sequence
  Synthetic
accctgcattctgggccctcgtggatgaggagagagagaggcatctcgtggggaggtgcgcacactgcgtgtaca

SEQ ID NO: 226129 - DNA, 75 bp, Artificial Sequence
  Synthetic
gggaggtgcgcacactgcgtgtacaacatgatgggcaagagagaaaagaaactgggagagttcggagtggcgaag

SEQ ID NO: 226130 - DNA, 75 bp, Artificial Sequence
  Synthetic
gatcactgggcttccagagagtccagtggaggaggagttgagggaataagcttaaactacctgggttggcacctc

SEQ ID NO: 226131 - DNA, 75 bp, Artificial Sequence
  Synthetic
aagaagttatcaaccttgaatggaggcctcttctacgcagatgacactgctggctgggacacaaaggtcaccaat

SEQ ID NO: 226132 - DNA, 75 bp, Artificial Sequence
  Synthetic
gcagacctagaggatgaggaacagatcttgagatacatggaaggagaacacaaacaattggcggccacaataatg

SEQ ID NO: 226133 - DNA, 75 bp, Artificial Sequence
  Synthetic
tcttgagatacatggaaggagaacacaaacaattggcggccacaataatgcaaaaagcataccatgctaaggtag

SEQ ID NO: 226134 - DNA, 75 bp, Artificial Sequence
  Synthetic
caaaaagcataccatgctaaggtagtgaaggtcgcaagaccctctcgcgatggaggctgcatcatggatgtcatt

SEQ ID NO: 226135 - DNA, 75 bp, Artificial Sequence
  Synthetic
gtcaggtcgtgacctatgctctgaataccctcaccaacataaaggtccaattgatccggatgatggagggggaag

SEQ ID NO: 226136 - DNA, 75 bp, Artificial Sequence
  Synthetic
gagtcatagaggcagaagacgcacacaacccaagactacttcgagtggaacgctggctgaaagagcatggagaag

SEQ ID NO: 226137 - DNA, 75 bp, Artificial Sequence
  Synthetic
cgctggctgaaagagcatggagaagaacgccttggaagaatgcttgtcagtggtgatgactgtgtggtgagaccc

SEQ ID NO: 226138 - DNA, 75 bp, Artificial Sequence
  Synthetic
tggtgatgactgtgtggtgagacccatggatgacagatttggcaaagctctctactttctgaatgacatggctaa

SEQ ID NO: 226139 - DNA, 75 bp, Artificial Sequence
  Synthetic
gactaggaaggacattggggagtgggagccctcagctggcttctcgagctgggaagaggtccccttttgttcaca

SEQ ID NO: 226140 - DNA, 75 bp, Artificial Sequence
  Synthetic
gagccctcagctggcttctcgagctgggaagaggtccccttttgttcacaccatttccatgagttggtgatgaag

SEQ ID NO: 226141 - DNA, 75 bp, Artificial Sequence
  Synthetic
gggaagaggtccccttttgttcacaccatttccatgagttggtgatgaaggacggacgcaccttagtggtaccat

SEQ ID NO: 226142 - DNA, 75 bp, Artificial Sequence
  Synthetic
gccgtgaccaggatgagctcgttgggagggctcgcgtctcaccggggtgcggatggagtgtccgcgagacggctt

SEQ ID NO: 226143 - DNA, 75 bp, Artificial Sequence
  Synthetic
gagggctcgcgtctcaccggggtgcggatggagtgtccgcgagacggcttgtctctcaaaagcctacgggcagat

SEQ ID NO: 226144 - DNA, 75 bp, Artificial Sequence
  Synthetic
ggatggagtgtccgcgagacggcttgtctctcaaaagcctacgggcagatgtggctgctgagttattttcaccgg

SEQ ID NO: 226145 - DNA, 75 bp, Artificial Sequence
  Synthetic
gtggctgctgagttattttcaccggcgtgacctgaggacacttgggttcgccatcagctcagcagtgcctgtcga

SEQ ID NO: 226146 - DNA, 75 bp, Artificial Sequence
  Synthetic
ctgggtgcccaccggccgcacgacatggagcatccatgccagcggggcctggatgaccacagaagacatgctgga

SEQ ID NO: 226147 - DNA, 75 bp, Artificial Sequence
  Synthetic
ggatgaccacagaagacatgctggacgtctggaaccgagtgtggatcctggacaaccctttcatgcagaacaaag

SEQ ID NO: 226148 - DNA, 75 bp, Artificial Sequence
  Synthetic
cgtctggaaccgagtgtggatcctggacaaccctttcatgcagaacaaagagaggattatggagtggagggacgt

SEQ ID NO: 226149 - DNA, 75 bp, Artificial Sequence
  Synthetic
accatatctccccaaaacccaggacatgatatgctcctcccttgttggaaggaaagaaagagcagaatgggcaaa

SEQ ID NO: 226150 - DNA, 75 bp, Artificial Sequence
  Synthetic
ggaaagaaagagcagaatgggcaaagaacatctggggagcggtggaaaaggtgaggaagatgataggtcctgaga

SEQ ID NO: 226151 - DNA, 75 bp, Artificial Sequence
  Synthetic
ggttcaaagactatctctcttgcatggaccgccatgacctacattgggagctcaagctagagagctcaataatct

SEQ ID NO: 226152 - DNA, 75 bp, Artificial Sequence
  Synthetic
ctcaagctagagagctcaataatctaaatctagcttgtgacagagcaaaacttgaagagctcgcaaggagaccat

SEQ ID NO: 226153 - DNA, 75 bp, Artificial Sequence
  Synthetic
ggaatgatgcggcagcgcgcagcagcgacggggaaatggtcgcacccgacgcaccatccatgaggcagcaattcg

SEQ ID NO: 226154 - DNA, 75 bp, Artificial Sequence
  Synthetic
cgacggggaaatggtcgcacccgacgcaccatccatgaggcagcaattcgtgagaccccccctggccaggaaaag

SEQ ID NO: 226155 - DNA, 75 bp, Artificial Sequence
  Synthetic
tgagaccccccctggccaggaaaagggggggcaaacaggccaggggtgaagaacgcctccagagtgcaccacggc

SEQ ID NO: 226156 - DNA, 75 bp, Artificial Sequence
  Synthetic
agcacgccagtgagagtggcgacgggagaatggtcgatcccgacgtagggcactctgcaaaattttgcgagaccc

SEQ ID NO: 226157 - DNA, 75 bp, Artificial Sequence
  Synthetic
cccgccccatgacaaggccgaacatggggcattaaagggaggcccccggaagcatgcttccgggaggagggaaga

SEQ ID NO: 226158 - DNA, 75 bp, Artificial Sequence
  Synthetic
ggggcattaaagggaggcccccggaagcatgcttccgggaggagggaagagagaaattggcagctctcttcaggg

SEQ ID NO: 226159 - DNA, 75 bp, Artificial Sequence
  Synthetic
agcatgcttccgggaggagggaagagagaaattggcagctctcttcagggttttttcctcctcctataccaaatt

SEQ ID NO: 226160 - DNA, 75 bp, Artificial Sequence
  Synthetic
ccccctcgacagagggggggcggttcttgttctccctgagccaccatcacccagacacagatagtctgacaagga

SEQ ID NO: 226161 - DNA, 75 bp, Artificial Sequence
  Synthetic
tctccctgagccaccatcacccagacacagatagtctgacaaggaggtgatgtgtgactcggaaaaacacccgct

SEQ ID NO: 226162 - DNA, 75 bp, Artificial Sequence
  Synthetic
agattttcttgcacgtgcgatagcttcggacagctttggcagcggcaggtttgaaagagacatttttttttcttt

SEQ ID NO: 226163 - DNA, 75 bp, Artificial Sequence
  Synthetic
acttcggaagataaagaggacagtgagtgctttgatggttggcttgcaaaggcgcggaaaaaggaggtcagtgac

SEQ ID NO: 226164 - DNA, 75 bp, Artificial Sequence
  Synthetic
gaactggatgaactggttgctggtcattgctctgctggggatgacacttgcagcgacagtaaggaaagaagggga

SEQ ID NO: 226165 - DNA, 75 bp, Artificial Sequence
  Synthetic
cggcaccactgtgatcagggctgaaggaagggacgcggcaacgcaggtgcgtgtggagaacggcacctgtgtgat

SEQ ID NO: 226166 - DNA, 75 bp, Artificial Sequence
  Synthetic
agttgacggggaggggacgcaaatggttggaaggagactcactgcggacacacctcacgagagtggaaggatggg

SEQ ID NO: 226167 - DNA, 75 bp, Artificial Sequence
  Synthetic
aagagtcaccttggtgctggagctgggtggatgcgtaaccataaccgctgaggggaagccctcaatggatgtgtg

SEQ ID NO: 226168 - DNA, 75 bp, Artificial Sequence
  Synthetic
cctgccaagacacgcgagtactgtttgcacgccaagttgtcagagaccaaggttgctgctagatgtccaacgatg

SEQ ID NO: 226169 - DNA, 75 bp, Artificial Sequence
  Synthetic
ggttgctgctagatgtccaacgatgggaccagctgtcctgactgaagaacgccagattggcacagtgtgcaagag

SEQ ID NO: 226170 - DNA, 75 bp, Artificial Sequence
  Synthetic
ggaccagagtgatcgaggctggggaaatcactgtggtttgtttggaaagggcagcattgtggcctgcgtcaaggc

SEQ ID NO: 226171 - DNA, 75 bp, Artificial Sequence
  Synthetic
accacacacgggagactatgttgccgccaatgagacgcacaaggggaggaagacggcgactttcacggtttcttc

SEQ ID NO: 226172 - DNA, 75 bp, Artificial Sequence
  Synthetic
gacaagacagcggagcaccttccaacagcttggcaggtccaccgagactggtttaatgacctggctctcccgtgg

SEQ ID NO: 226173 - DNA, 75 bp, Artificial Sequence
  Synthetic
aagcatgatggaaacccacattggaacaatgcagagagactggttgagtttggcgctcctcatgctgtcaagatg

SEQ ID NO: 226174 - DNA, 75 bp, Artificial Sequence
  Synthetic
gatgtgtacaaccttggagatcagactggagtgctgctgagggcactagcaggggttcctgtggcacacattgag

SEQ ID NO: 226175 - DNA, 75 bp, Artificial Sequence
  Synthetic
accccacaattgaaaatgatggagggggcttcatagagatgcagcttcccccaggggacaatatcatctatgttg

SEQ ID NO: 226176 - DNA, 75 bp, Artificial Sequence
  Synthetic
ttccaaacaaccaggaaaggtatagaaagactgacagtaataggagagcacgcctgggactttggatccgctggt

SEQ ID NO: 226177 - DNA, 75 bp, Artificial Sequence
  Synthetic
aaagactgacagtaataggagagcacgcctgggactttggatccgctggtggcttctttggctcaattggaaagg

SEQ ID NO: 226178 - DNA, 75 bp, Artificial Sequence
  Synthetic
agaggtttcagagtggtatgacaactatgcatactacccggagacaccaggggctcttgcatcggcagtaaaaga

SEQ ID NO: 226179 - DNA, 75 bp, Artificial Sequence
  Synthetic
ggcatttgaggagggaagctgtggcgtggtcccccagaacagacttgagatggccatgtggagaagctcggtcac

SEQ ID NO: 226180 - DNA, 75 bp, Artificial Sequence
  Synthetic
ggaactgaatctggctttagtggaaggggatgcaaatctcacagtggtggtagacaaaaacgaccctactgacta

SEQ ID NO: 226181 - DNA, 75 bp, Artificial Sequence
  Synthetic
ggggatgcaaatctcacagtggtggtagacaaaaacgaccctactgactaccgaggtggagttcctggcacgctg

SEQ ID NO: 226182 - DNA, 75 bp, Artificial Sequence
  Synthetic
ggaaccaacacacgagtgtgacacaggagtgatgggggccgccgtcaaaaacgacatggcggtccacacagatca

SEQ ID NO: 226183 - DNA, 75 bp, Artificial Sequence
  Synthetic
aagcctctggatgaaatcgatgagaaatgacacaggtacctacatagttgaactcctggtcactgacctgaggaa

SEQ ID NO: 226184 - DNA, 75 bp, Artificial Sequence
  Synthetic
ctgctcttggcccgctagtcacaccatcgacaacgcagacgtggtgaactcggagctttttcttccggcgagtct

SEQ ID NO: 226185 - DNA, 75 bp, Artificial Sequence
  Synthetic
atcgacaacgcagacgtggtgaactcggagctttttcttccggcgagtctccgaggacccaggtcctggtacaat

SEQ ID NO: 226186 - DNA, 75 bp, Artificial Sequence
  Synthetic
aggatccctggctactcggaacaagtgaagggaccatggaaacacacgcccctccgagtcatcagagaggagtgt

SEQ ID NO: 226187 - DNA, 75 bp, Artificial Sequence
  Synthetic
gttccgaactggaaccgactgttggtatgccatggaaataaggccagtacacgcccagggagggcttgtccgctc

SEQ ID NO: 226188 - DNA, 75 bp, Artificial Sequence
  Synthetic
tctacaggagtgacggtcgtatggggaggtgttgtcgtccttgctctgctcgtcactggaatggtcaggattgag

SEQ ID NO: 226189 - DNA, 75 bp, Artificial Sequence
  Synthetic
agcctcgtgcgctacgtggtggcggtggggattgcgttccaccttgagctgggaccagagactgtggccttgatg

SEQ ID NO: 226190 - DNA, 75 bp, Artificial Sequence
  Synthetic
ctgctccaggccgtgtttgagctaagagttgggcttctcagcgcctttgcattgcgcagaggcctcaccgtccga

SEQ ID NO: 226191 - DNA, 75 bp, Artificial Sequence
  Synthetic
gagatggttaccacctactttcttttgctggtcctggaattgggactgtcgagtgcgggcctcggggatctctgg

SEQ ID NO: 226192 - DNA, 75 bp, Artificial Sequence
  Synthetic
ctcttgctcatagccctcatgacacagagggatgttgtgactgtacaccacggacttgtgtgcttcctggctgcg

SEQ ID NO: 226193 - DNA, 75 bp, Artificial Sequence
  Synthetic
agagggatgttgtgactgtacaccacggacttgtgtgcttcctggctgcggctgcagcctgctcggtctggagac

SEQ ID NO: 226194 - DNA, 75 bp, Artificial Sequence
  Synthetic
tgcttaggggacacagggagcagaagggactgacctggattattcccttggctagattgcttggaggagagggct

SEQ ID NO: 226195 - DNA, 75 bp, Artificial Sequence
  Synthetic
ccgtgatcagattgctggctttctgggaactggcagcccacagaggaagacggtctttcagtgagccactgaccg

SEQ ID NO: 226196 - DNA, 75 bp, Artificial Sequence
  Synthetic
tggtagtggtcatgctgacactggcaagcggtatgatgcgtcacacctcccaagaggctctttgtgcgctcgcgg

SEQ ID NO: 226197 - DNA, 75 bp, Artificial Sequence
  Synthetic
tggcctcgtttttcttgctgatgcttgtgtccgggacgaggaaaatgcagctggttgctgaatggagcggctgtg

SEQ ID NO: 226198 - DNA, 75 bp, Artificial Sequence
  Synthetic
ttgaatggcatccggaaacggtgaatgagggtggagagatcagcctgcgggtccgtcaagactcgatgggaaact

SEQ ID NO: 226199 - DNA, 75 bp, Artificial Sequence
  Synthetic
ttcatttgactgagcttgagaaagaggaaaggatgatggctttttggctgcttgccggcctggtggcttcagcac

SEQ ID NO: 226200 - DNA, 75 bp, Artificial Sequence
  Synthetic
acctggtctactcaggacagggaggccaagaacgtggcgacaggccttttgaggtcaaggatggagtttacagaa

SEQ ID NO: 226201 - DNA, 75 bp, Artificial Sequence
  Synthetic
ccaagaacgtggcgacaggccttttgaggtcaaggatggagtttacagaattttcagtcccggcttgttctgggg

SEQ ID NO: 226202 - DNA, 75 bp, Artificial Sequence
  Synthetic
ggtgaaacagtacaggtccatgccttcccaccggggagggcgcacgaggtgcaccagtgccagcccggagaattg

SEQ ID NO: 226203 - DNA, 75 bp, Artificial Sequence
  Synthetic
gggcaataccaattgacttggcaaagggaacatctggtagccctattcttaacgctcagggagtggttgttgggc

SEQ ID NO: 226204 - DNA, 75 bp, Artificial Sequence
  Synthetic
gctctggaaagacccacagagtcctcccggagctcatccgccaatgcattgacaggcgcctgagtacgttggtgc

SEQ ID NO: 226205 - DNA, 75 bp, Artificial Sequence
  Synthetic
tggctccaactcgcgtggtactgaaggagatggagcgcgctctcagtgggaagcgggtccggttccattcgccag

SEQ ID NO: 226206 - DNA, 75 bp, Artificial Sequence
  Synthetic
aagcgggtccggttccattcgccagcagtcagtgaccaacaggctggaggggcaattgtcgatgtgatgtgtcat

SEQ ID NO: 226207 - DNA, 75 bp, Artificial Sequence
  Synthetic
gcaacttatgtcaacagacgcttactcccacaggggaggcagaactgggaggtggcaatcatggatgaggcccat

SEQ ID NO: 226208 - DNA, 75 bp, Artificial Sequence
  Synthetic
tggactgatccccacagcatagcagctagaggccacttgtacaccctggcaaaagaaaacaaatgcgcccttgtc

SEQ ID NO: 226209 - DNA, 75 bp, Artificial Sequence
  Synthetic
aaaagaaaacaaatgcgcccttgtcttgatgacagcaactccccctggtaaaagtgaaccttttccagagtccaa

SEQ ID NO: 226210 - DNA, 75 bp, Artificial Sequence
  Synthetic
atggttttgactggattactgagtacgaggggcgcaccgcttggtttgtcccttcaattgcaaagggtggtgtga

SEQ ID NO: 226211 - DNA, 75 bp, Artificial Sequence
  Synthetic
ccttcaattgcaaagggtggtgtgatagctcgcaccttgagacagaagggaaaaagcgtgatctgtctgaacagt

SEQ ID NO: 226212 - DNA, 75 bp, Artificial Sequence
  Synthetic
aagacttttgaaaaagattattccagagtgagggaagagaagcctgacttcgtggtgacgactgacatctcggaa

SEQ ID NO: 226213 - DNA, 75 bp, Artificial Sequence
  Synthetic
atgggagccaaccttgacgtgagccgcgtcatagatggaaggacaaacatcaagcctgaggaggttgatgggaaa

SEQ ID NO: 226214 - DNA, 75 bp, Artificial Sequence
  Synthetic
gtcgagctcaccgggaccaggcgagtgaccacggcttccgctgcccaacggcgcggaagagttggtcggcaagac

SEQ ID NO: 226215 - DNA, 75 bp, Artificial Sequence
  Synthetic
ggacgaacagatgaatacatatactctggacagtgtgatgatgatgacagtggattagtgcaatggaaagaggcg

SEQ ID NO: 226216 - DNA, 75 bp, Artificial Sequence
  Synthetic
caaatacttcttgacaacataacaaccttgcgggggcccgtggccaccttttatggccctgagcaggacaagatg

SEQ ID NO: 226217 - DNA, 75 bp, Artificial Sequence
  Synthetic
tcactgaggagaagaggaagcacttccgccaccttctcacccattgtgatttcacgccctggctggcatggcacg

SEQ ID NO: 226218 - DNA, 75 bp, Artificial Sequence
  Synthetic
ttcacgccctggctggcatggcacgttgcagcgaacgtgtctagcgtgacggaccgaagctggacatgggaggga

SEQ ID NO: 226219 - DNA, 75 bp, Artificial Sequence
  Synthetic
ggaccgaagctggacatgggagggaccagaggccaatgccgtggacgaggcaagcggggatctggtcactttcag

SEQ ID NO: 226220 - DNA, 75 bp, Artificial Sequence
  Synthetic
caaggaatttgtggcgtacgcgtctgggcgtcgcagcttcggagatgttctgacaggaatgtcgggagtgccgga

SEQ ID NO: 226221 - DNA, 75 bp, Artificial Sequence
  Synthetic
gcttctgcggcacagatgcgtcaacgctttggacgttttctacacgctcatgcatgaggaacctggcagcagggc

SEQ ID NO: 226222 - DNA, 75 bp, Artificial Sequence
  Synthetic
cctgggtgtcgtctggtgtttcgtcgtccgaacatcaatcagtcgcatgatgctcggcacgctggtcttgctggc

SEQ ID NO: 226223 - DNA, 75 bp, Artificial Sequence
  Synthetic
ctccctgctactcttgtgggcaggtggcgtcggctatgggaacatggctggagtggctctcatcttttacacact

SEQ ID NO: 226224 - DNA, 75 bp, Artificial Sequence
  Synthetic
ggcgtcggctatgggaacatggctggagtggctctcatcttttacacactgctgacagttctgcaacccgagact

SEQ ID NO: 226225 - DNA, 75 bp, Artificial Sequence
  Synthetic
ggaaaacagagaagcagtgatgacaacaaactggcatacttcctgttgaccctttgcagtcttgctggactggtt

SEQ ID NO: 226226 - DNA, 75 bp, Artificial Sequence
  Synthetic
gccgcaaatgagatgggctttctggagaagaccaaggcagatctgtctgcgatgctgtggagtgggcatgaggaa

SEQ ID NO: 226227 - DNA, 75 bp, Artificial Sequence
  Synthetic
agaagaccaaggcagatctgtctgcgatgctgtggagtgggcatgaggaacaccggcaatggagtgagtggacca

SEQ ID NO: 226228 - DNA, 75 bp, Artificial Sequence
  Synthetic
ggtgcgcaggccatgagagacttgggggggggagctcccttctttggtgtggcaggacatgttatgactctcggg

SEQ ID NO: 226229 - DNA, 75 bp, Artificial Sequence
  Synthetic
gtggtgtccctggttggggccacccccacctcactgatagtgggcattggcttagcagctttccatttggccatc

SEQ ID NO: 226230 - DNA, 75 bp, Artificial Sequence
  Synthetic
ccacctcactgatagtgggcattggcttagcagctttccatttggccatcgtggtatctggactggaggctgagc

SEQ ID NO: 226231 - DNA, 75 bp, Artificial Sequence
  Synthetic
tgacacagcgagcccataaggtctttttctctgcaatggtacgcaaccctatggtggatggggatgtcatcaacc

SEQ ID NO: 226232 - DNA, 75 bp, Artificial Sequence
  Synthetic
cattcggggagggggaggcaaaacctgctctatatgaaaggaaaatgagtctggtgttggccatagtgctgtgtc

SEQ ID NO: 226233 - DNA, 75 bp, Artificial Sequence
  Synthetic
agcttctcagaccggaggcggacacactatggacgatgccggttgcgtgcggcatgagtggtgtggtcaggggca

SEQ ID NO: 226234 - DNA, 75 bp, Artificial Sequence
  Synthetic
gggggcaggcgtggtggctctgatggagacacgcttggtgacctctggaagcgcaggctgaacaactgcaccaag

SEQ ID NO: 226235 - DNA, 75 bp, Artificial Sequence
  Synthetic
gaggaattcttcgtttacaggcgcactggcattctggaaaccgaacgtgacaaggccagagagctgctcaggaga

SEQ ID NO: 226236 - DNA, 75 bp, Artificial Sequence
  Synthetic
caaggccagagagctgctcaggagaggagagacaaacatgggactggcggtctcgcgtggcacggcaaagctcgc

SEQ ID NO: 226237 - DNA, 75 bp, Artificial Sequence
  Synthetic
ttggcttgaagaacgcggatatcgcaccctcaagggagaggtggtagatctcgggtgtggaaggggcggctggtc

SEQ ID NO: 226238 - DNA, 75 bp, Artificial Sequence
  Synthetic
ctactatgcggcttctcgaccggcagtcatgagtgttagggcatataccattggtggaagagggcatgaggttcc

SEQ ID NO: 226239 - DNA, 75 bp, Artificial Sequence
  Synthetic
aaagatggtgacaagcctgggttggaacttgattaggttcagatcaggaatggacgtgttcagcatgcaaccaca

SEQ ID NO: 226240 - DNA, 75 bp, Artificial Sequence
  Synthetic
tcgagctgacaccatcatgtgtgacattggagagagcaacccagatgccgctgtggagggtgaaaggaccaggaa

SEQ ID NO: 226241 - DNA, 75 bp, Artificial Sequence
  Synthetic
agtgatatcgctcatggagcaatggaaaatccgaaacccagcggcggcctgcgtgttcaaggtgctggctccata

SEQ ID NO: 226242 - DNA, 75 bp, Artificial Sequence
  Synthetic
ccgcccagaggtaatagaggcattgcacagattccagctgcagtggggtgggggtctagtgaggactcccttctc

SEQ ID NO: 226243 - DNA, 75 bp, Artificial Sequence
  Synthetic
cacagattccagctgcagtggggtgggggtctagtgaggactcccttctcaaggaactcaactcacgagatgtac

SEQ ID NO: 226244 - DNA, 75 bp, Artificial Sequence
  Synthetic
gaggaagctcctggctcggtttggagaccagagagggccaaccaaggtccctgaagccgacttgggagtgggaac

SEQ ID NO: 226245 - DNA, 75 bp, Artificial Sequence
  Synthetic
tcggtgtgtggtcttggctgaggataaggtaaaagaacaagatgtgcaagagaggatcagagctttgcggaagca

SEQ ID NO: 226246 - DNA, 75 bp, Artificial Sequence
  Synthetic
atacagcgaaacctggcatatggacgaggaacacccgtacagaacatggcagtactggggcacgtcccgcacagc

SEQ ID NO: 226247 - DNA, 75 bp, Artificial Sequence
  Synthetic
agcacaggagccccaaccggggacaagagtgatcacgagagcagtgaatgattggattctagagcgtctggccca

SEQ ID NO: 226248 - DNA, 75 bp, Artificial Sequence
  Synthetic
gaaaagcaaaccacgcatgtgcagcagagaggaattcatagcaaaagtgagatcaaatgcagccctgggagcttg

SEQ ID NO: 226249 - DNA, 75 bp, Artificial Sequence
  Synthetic
gtcggatgagcagaacagatgggcaagtgcgagagaggctgtggtggtccctgcattctgggccctcgtggatga

SEQ ID NO: 226250 - DNA, 75 bp, Artificial Sequence
  Synthetic
ggtgagagagaggcatctcgtggggtggtgcgcacactgcgtgtacatcatgatgggcatgagagaaaagaaact

SEQ ID NO: 226251 - DNA, 75 bp, Artificial Sequence
  Synthetic
gggagagttcggagtggcgaagggcagcagggccatctggtacatgtggctggggagccgcttcctggagtttga

SEQ ID NO: 226252 - DNA, 75 bp, Artificial Sequence
  Synthetic
tggggagccgcttcctggagtttgaggccctcggattcctaaataaggatcactgggcttccagagagtccagtg

SEQ ID NO: 226253 - DNA, 75 bp, Artificial Sequence
  Synthetic
gtggaggagttgagggtataagcttaaactacctgggttggcacctcaagaagttaacaaccttaaatggaggcc

SEQ ID NO: 226254 - DNA, 75 bp, Artificial Sequence
  Synthetic
tcttctacgcagatgacactgctggctgggacacaaaaggcaccaattcagacccagaggatgaagaacagatcc

SEQ ID NO: 226255 - DNA, 75 bp, Artificial Sequence
  Synthetic
gacccagaggatgaagaacagatcctacggtacatggagggtgagcacaaacaattggcaaccacaataatgcaa

SEQ ID NO: 226256 - DNA, 75 bp, Artificial Sequence
  Synthetic
aggttgtgacctatgctcttaacactctcaccaacataaaggtgcaatcaacccggatgatggagggggaaggag

SEQ ID NO: 226257 - DNA, 75 bp, Artificial Sequence
  Synthetic
tggctgaaagagcatggagaggaacgccttggaagaatgcttgtcagtggtgatgactgtgtggtgagacccata

SEQ ID NO: 226258 - DNA, 75 bp, Artificial Sequence
  Synthetic
gatgacagatttggtaaagctctctacttcctgaatgacatggccaagactaggaaggacatgggggagtgggag

SEQ ID NO: 226259 - DNA, 75 bp, Artificial Sequence
  Synthetic
ccctcagctggcttctcgagctgggaagaggtacccttttgctcacaccatttccatgagctggtgatgaaggac

SEQ ID NO: 226260 - DNA, 75 bp, Artificial Sequence
  Synthetic
tttccatgagctggtgatgaaggacggacgcaccttagtggtgccatgccgcgatcaggatgagctcgttgggag

SEQ ID NO: 226261 - DNA, 75 bp, Artificial Sequence
  Synthetic
gctgctgagttactttcaccggcgtgacctgaggacacttgggttcgccatcagcccagcagtgcccgtcgactg

SEQ ID NO: 226262 - DNA, 75 bp, Artificial Sequence
  Synthetic
tgaccacagaagacatgctggacgtctggaaccgggtgtggatcctagacaaccctttcatgcagaacaaagaga

SEQ ID NO: 226263 - DNA, 75 bp, Artificial Sequence
  Synthetic
aagaaagagcagaatgggcaaagaacatctggggagcggtggaaaaggtgaggaagatgataggtcctgagaggt

SEQ ID NO: 226264 - DNA, 75 bp, Artificial Sequence
  Synthetic
tcaaagactatctctcctgcatggaccgccatgacctacactgggagctcaagctagagagctcaataatctaag

SEQ ID NO: 226265 - DNA, 75 bp, Artificial Sequence
  Synthetic
cctagcttgtgacagagcaaaacttgaagagctcgcaaggaaaccatggaatgatgcggcacggcgcgacagcga

SEQ ID NO: 226266 - DNA, 75 bp, Artificial Sequence
  Synthetic
cggggaaatggtcgcacccgacgcaccatccatgaggcagcaattcgtgagacccccctggccaggaaaggggaa

SEQ ID NO: 226267 - DNA, 75 bp, Artificial Sequence
  Synthetic
aacaggccaggggtgaaaacacccccagagtgcaccacggcaacacgccagtgagagtggcgacggggagatggt

SEQ ID NO: 226268 - DNA, 75 bp, Artificial Sequence
  Synthetic
gtgagagtggcgacggggagatggtcgatcccgacgtagggcactctgcaagattttgcgagaccccccgcccca

SEQ ID NO: 226269 - DNA, 75 bp, Artificial Sequence
  Synthetic
agattttcttgcacgtgcgatagcttcggacagctttggcagcggcagatttgaaagagatattttttcactttc

SEQ ID NO: 226270 - DNA, 75 bp, Artificial Sequence
  Synthetic
gtggctggcactgcgagaaaccctgttttgaaagcattctggaattccgttccgttgaggcaggccactgcagca

SEQ ID NO: 226271 - DNA, 75 bp, Artificial Sequence
  Synthetic
tgtgaccatagagcaaggggaagagcccgttgatgtggattgtttttgccggaatgttgacggagtctatttgga

SEQ ID NO: 226272 - DNA, 75 bp, Artificial Sequence
  Synthetic
gtggatgcgtaaccataaccgctgaggggaagccctcagtggatgtgtggcttgacgccatttaccaggagagcc

SEQ ID NO: 226273 - DNA, 75 bp, Artificial Sequence
  Synthetic
ccagattggcacagtgtgcaagagggaccagagtgatcgaggttggggcaatcactgtgggttgtttggaaaggg

SEQ ID NO: 226274 - DNA, 75 bp, Artificial Sequence
  Synthetic
gcttgtgaagcaaagaagaaagccacgggatacgtgtacgatgccaacaaaatagtgtacacagtgaaggttgaa

SEQ ID NO: 226275 - DNA, 75 bp, Artificial Sequence
  Synthetic
aatagtgtacacagtgaaggttgaaccacacacgggagactatgttgccgccaacgagacgcacaaggggaggaa

SEQ ID NO: 226276 - DNA, 75 bp, Artificial Sequence
  Synthetic
aatatggagacgtctcactgctatgtagggtagccagtggcgtcgacttggctcagaccatcatcctggagttag

SEQ ID NO: 226277 - DNA, 75 bp, Artificial Sequence
  Synthetic
tttaatgacctggctctcccgtggaagcatgatggaaacccacactggaacaatgcagagagattggttgagttt

SEQ ID NO: 226278 - DNA, 75 bp, Artificial Sequence
  Synthetic
agcatgatggaaacccacactggaacaatgcagagagattggttgagtttggtgttcctcatgctgtcaagatgg

SEQ ID NO: 226279 - DNA, 75 bp, Artificial Sequence
  Synthetic
atgtgtacaaccttggagatcagactggagtgctgctgaaggcgctagcaggggttcctgtggcacacattgagg

SEQ ID NO: 226280 - DNA, 75 bp, Artificial Sequence
  Synthetic
atgtagccatgctgataacgccaaaccccacaattgaaaatgatggaggaggcttcatagagatgcagcttcccc

SEQ ID NO: 226281 - DNA, 75 bp, Artificial Sequence
  Synthetic
gcttctttagctcaattggaaaggcggtgcacacggttcttggtggtgccttcaacagcatctttggaggagtgg

SEQ ID NO: 226282 - DNA, 75 bp, Artificial Sequence
  Synthetic
ggtgcacacggttcttggtggtgccttcaacagcatctttggaggagtggggtttctgccaaagctcctaatggg

SEQ ID NO: 226283 - DNA, 75 bp, Artificial Sequence
  Synthetic
tagtcccccagaacagacttgagatggccatgtggagaagctcggtcacggaactgaatctggctctagcggaag

SEQ ID NO: 226284 - DNA, 75 bp, Artificial Sequence
  Synthetic
gaactgaatctggctctagcggaaggggatgcaaatctcacagtggtggtagacaaaaacgaccccactgactac

SEQ ID NO: 226285 - DNA, 75 bp, Artificial Sequence
  Synthetic
atctggagcatccctgaggctcctcggcgtttcatggtgggtacagagggacaaagtgaatgcccattagagaga

SEQ ID NO: 226286 - DNA, 75 bp, Artificial Sequence
  Synthetic
actcctggtcactgacctgaggaactgctcctggcctgctagtcacaccatcgacaacgcagacgttgtgaactc

SEQ ID NO: 226287 - DNA, 75 bp, Artificial Sequence
  Synthetic
tcgacaacgcagacgttgtgaactcggagctctttcttccggcgagtctcgcaggacccaggtcctggtacaata

SEQ ID NO: 226288 - DNA, 75 bp, Artificial Sequence
  Synthetic
agcatgcacaatgcctccagtaacgttccgaactggaaccgactgctggtatgccatggaaataaggccagtaca

SEQ ID NO: 226289 - DNA, 75 bp, Artificial Sequence
  Synthetic
aggtgttgtcgtcctcgctctgctcgtcactggaatggtcaggattgagagcctcgtgcgctatgtggtagcggt

SEQ ID NO: 226290 - DNA, 75 bp, Artificial Sequence
  Synthetic
ggggattgcgttccaccttgagctgggaccagagactgtggccttgatgctacttcaggccgtgtttgagctaag

SEQ ID NO: 226291 - DNA, 75 bp, Artificial Sequence
  Synthetic
ggaccagagactgtggccttgatgctacttcaggccgtgtttgagctaagagttggacttcttagcgcctttgcg

SEQ ID NO: 226292 - DNA, 75 bp, Artificial Sequence
  Synthetic
tacttcaggccgtgtttgagctaagagttggacttcttagcgcctttgcgctgcgcagaggcttcaccgtccgag

SEQ ID NO: 226293 - DNA, 75 bp, Artificial Sequence
  Synthetic
ggacttgtgtgcttcctggctgcggctgcagcctgctcggtctggagactgcttaggggacacagggagcagaag

SEQ ID NO: 226294 - DNA, 75 bp, Artificial Sequence
  Synthetic
gaactggcagcccacaaaggaagacggtctttcagtgagccactgaccgtggtaggggtcatgctgacactggct

SEQ ID NO: 226295 - DNA, 75 bp, Artificial Sequence
  Synthetic
gaaaggatgatggctttttggctgcttgccggcctagtggcctcagcactccattggtcaggcatccttggtgtg

SEQ ID NO: 226296 - DNA, 75 bp, Artificial Sequence
  Synthetic
gtggcacgtgactagaggagcggcgttgtccattgatgatgcattggccggcccctactgggctgatgtgaagga

SEQ ID NO: 226297 - DNA, 75 bp, Artificial Sequence
  Synthetic
gcccctactgggctgatgtgaaggaagacgtcgtgtgctacggaggagcttggagcctggaggaaaagtggaaag

SEQ ID NO: 226298 - DNA, 75 bp, Artificial Sequence
  Synthetic
agacgtcgtgtgctacggaggagcttggagcctggaggaaaagtggaaaggtgaaatggtacaggtccatgcctt

SEQ ID NO: 226299 - DNA, 75 bp, Artificial Sequence
  Synthetic
agggagaggcggagaagagtcgacccaaccttccacaggcagttgtgggcacgggctggacgtcaaagggccaga

SEQ ID NO: 226300 - DNA, 75 bp, Artificial Sequence
  Synthetic
ccggagctcatccgtcaatgcattgacaggcgcctgaggacgttggtgctggctccaactcgtgtggtactgaag

SEQ ID NO: 226301 - DNA, 75 bp, Artificial Sequence
  Synthetic
gagatggagcgtgctctcagtgggaagcgggtccggttccattcaccagcggtcagcgatcagcaggttggaggg

SEQ ID NO: 226302 - DNA, 75 bp, Artificial Sequence
  Synthetic
agcgggtccggttccattcaccagcggtcagcgatcagcaggttggaggggcgatagttgatgtgatgtgtcatg

SEQ ID NO: 226303 - DNA, 75 bp, Artificial Sequence
  Synthetic
agattcctgatggggagtggcgtgatggttttgactggattactgagtacgagggacgcaccgcctggtttgttc

SEQ ID NO: 226304 - DNA, 75 bp, Artificial Sequence
  Synthetic
aagcctgaggaggttgatgggaaggttgagttcactggcaccagacgagtgaccacggcctccgctgcccagcga

SEQ ID NO: 226305 - DNA, 75 bp, Artificial Sequence
  Synthetic
ttgagttcactggcaccagacgagtgaccacggcctccgctgcccagcgacgcgggcgggtcggtaggcaaggcg

SEQ ID NO: 226306 - DNA, 75 bp, Artificial Sequence
  Synthetic
agcccgaatggagcggagagaaccctcaggccggtgtggagagacgcacgcatgttcagagagggacatgacatc

SEQ ID NO: 226307 - DNA, 75 bp, Artificial Sequence
  Synthetic
cttctgcggcacagatgcgtcagcgctttggacgttttctacacgctcatgcatgaggaacctggcagtagggca

SEQ ID NO: 226308 - DNA, 75 bp, Artificial Sequence
  Synthetic
ccgcaaatgagatggggtttttggaaaaaaccaaggcggatctgtctgcggtgctgtggagcgagcatgaggaac

SEQ ID NO: 226309 - DNA, 75 bp, Artificial Sequence
  Synthetic
accggcaatggagtgagtggaccaatgtggacatccagccggcacggtcctgggggacctatgtgctagtggtct

SEQ ID NO: 226310 - DNA, 75 bp, Artificial Sequence
  Synthetic
ctctgtttacaccttacatcatccaccaattgcaaaccaaaatccaacaacttgtcaatagtgccgtggcgtctg

SEQ ID NO: 226311 - DNA, 75 bp, Artificial Sequence
  Synthetic
gagcgcaggccatgagagacttgggggggggagcccccttctttggtgtggcaggacatgtcattactctcgggg

SEQ ID NO: 226312 - DNA, 75 bp, Artificial Sequence
  Synthetic
tggtggatggggacgtcatcaacccgttcagagagggagaggcaaagccagccctatatgaaaggaaaatgagtc

SEQ ID NO: 226313 - DNA, 75 bp, Artificial Sequence
  Synthetic
cgtgtctgtggtcatgaaccgcacagtggcttccatgacagaggctgcggctgtggggctggcagccatcggaca

SEQ ID NO: 226314 - DNA, 75 bp, Artificial Sequence
  Synthetic
gtttctcagaccggaggcggacacactgtggacgatgccggtggcatgcggcatgagcagcgtggtcaggggcag

SEQ ID NO: 226315 - DNA, 75 bp, Artificial Sequence
  Synthetic
cctctgggggttcctgccccttgggcatagactctggctccgggcttctgggggcaggcgtggtggctctgatgg

SEQ ID NO: 226316 - DNA, 75 bp, Artificial Sequence
  Synthetic
ggggcaggcgtggtggctctgatggagacacgcttggtgacctttggaagcgcaggctgaacaactgcactaagg

SEQ ID NO: 226317 - DNA, 75 bp, Artificial Sequence
  Synthetic
ctcgcgtggcacggcaaagctcgcttggcttgaagaacgcggatacgccaccctcaagggagaggtggtagatct

SEQ ID NO: 226318 - DNA, 75 bp, Artificial Sequence
  Synthetic
cggatgtggaaggggtggctggtcctactatgcggcttctcggccggcagtcatgggtgtcagggcgtataccat

SEQ ID NO: 226319 - DNA, 75 bp, Artificial Sequence
  Synthetic
tactatgcggcttctcggccggcagtcatgggtgtcagggcgtataccattggtggaagagggcatgaggtccca

SEQ ID NO: 226320 - DNA, 75 bp, Artificial Sequence
  Synthetic
ggacgtgttcagcatgcaaccacaccgagctgacaccatcatgtgtgacattggagagagcaacccagatgccgc

SEQ ID NO: 226321 - DNA, 75 bp, Artificial Sequence
  Synthetic
cgcccagaggtaatagaagcattgcacagattccagcttcagtggggtgggggtttagtgaggactcccttctca

SEQ ID NO: 226322 - DNA, 75 bp, Artificial Sequence
  Synthetic
agtgaactctgtcaacatacaatcgaggaagctcctggcccggtttggagaccagagagggccaaccaaagtccc

SEQ ID NO: 226323 - DNA, 75 bp, Artificial Sequence
  Synthetic
tcaatggggtcgtgaagcttctcagctggccatggaacgcgcgggaagatgtggtgcgcatggccatgactgaca

SEQ ID NO: 226324 - DNA, 75 bp, Artificial Sequence
  Synthetic
cgacagcctttgggcagcagagagtgtttaaagagaaagttgacacaaaggcacaggagccccaaccagggacaa

SEQ ID NO: 226325 - DNA, 75 bp, Artificial Sequence
  Synthetic
gagtgatcatgagagcagtgaatgattggattctagagcggctggcccaaaaaagcaaaccacgcatgtgtagca

SEQ ID NO: 226326 - DNA, 75 bp, Artificial Sequence
  Synthetic
atcaaatgcagccctgggagcttggtcggatgaacagaatagatgggcaagtgcgagagaggctgtggaagaccc

SEQ ID NO: 226327 - DNA, 75 bp, Artificial Sequence
  Synthetic
gcagggccatctggtacatgtggctggggagccgcttcctggagtttgaggccctcgggttcctaaacgaggatc

SEQ ID NO: 226328 - DNA, 75 bp, Artificial Sequence
  Synthetic
ggtcgcaagaccttctcgcgatggaggctgcatcatggatgtcattacgagaagagaccagagaggctccggtca

SEQ ID NO: 226329 - DNA, 75 bp, Artificial Sequence
  Synthetic
agaggtccccttttgttcacaccatttccatgagttggtgatgaaggacggacgcaccctagtggtgccatgccg

SEQ ID NO: 226330 - DNA, 75 bp, Artificial Sequence
  Synthetic
acctgaggacacttgggttcgccatcagctcagcagtgcctgtcgactgggtgcccaccggccgcacgacatgga

SEQ ID NO: 226331 - DNA, 75 bp, Artificial Sequence
  Synthetic
gcatccacgccagcggggcttggatgaccacagaagacatgctggacgtctggaaccgagtgtggatcctggaca

SEQ ID NO: 226332 - DNA, 75 bp, Artificial Sequence
  Synthetic
accctttcatgcagaacaaagagaggatcatggagtggagggacgtaccatatctccccaagacccaggacatga

SEQ ID NO: 226333 - DNA, 75 bp, Artificial Sequence
  Synthetic
agctagagagctcaataatctaagtctagtttgtgacagagcaaaacttgaagagctcgcaaggagaccatggaa

SEQ ID NO: 226334 - DNA, 75 bp, Artificial Sequence
  Synthetic
catccatgaggcagcaattcgtgagacccccctggccaggaaaaggggggcaaacaggccaggggtgaaaacgcc

SEQ ID NO: 226335 - DNA, 75 bp, Artificial Sequence
  Synthetic
cccagagtgcaccacggcagcacgccagtgagagtggcgacgggagaatggtcgatcccgacgtagggcactctg

SEQ ID NO: 226336 - DNA, 75 bp, Artificial Sequence
  Synthetic
cagtgagagtggcgacgggagaatggtcgatcccgacgtagggcactctgcaaaatttgcgagaccccccgcccc

SEQ ID NO: 226337 - DNA, 75 bp, Artificial Sequence
  Synthetic
agattttcttgcacgtgcgtgccacagcttcggacagctttggcagcggcaggtttgaaagagagatttttcact

SEQ ID NO: 226338 - DNA, 75 bp, Artificial Sequence
  Synthetic
tgaaaggcaaggggggcggtccccctcgacgagtgtcgaaagagaccgcgacaaagacgcgtcaatccagagtcc

SEQ ID NO: 226339 - DNA, 75 bp, Artificial Sequence
  Synthetic
aaatgccaaatggactggtattgatgcgcatgatggggatcctgtggcatgctgtggctggcactgcgagaaacc

SEQ ID NO: 226340 - DNA, 75 bp, Artificial Sequence
  Synthetic
acaaattggatgaactggttgctggtcattgctctgctgggaatgacacttgcagcgacagtaaggaaagaaagg

SEQ ID NO: 226341 - DNA, 75 bp, Artificial Sequence
  Synthetic
tcattgctctgctgggaatgacacttgcagcgacagtaaggaaagaaagggatggcaccactgtgatcagggctg

SEQ ID NO: 226342 - DNA, 75 bp, Artificial Sequence
  Synthetic
tgctgatcccaacccatgcccagggagagctgacggggaggggacgcaaatggttggaaggggactcactgcgga

SEQ ID NO: 226343 - DNA, 75 bp, Artificial Sequence
  Synthetic
agggaccagagtgatcgaggctggggcaatcactgtggattgtttggaaagggcagcattgtggcctgtgtcaag

SEQ ID NO: 226344 - DNA, 75 bp, Artificial Sequence
  Synthetic
gcaatcactgtggattgtttggaaagggcagcattgtggcctgtgtcaaggcggcgtgtgaagcaaagaagaaag

SEQ ID NO: 226345 - DNA, 75 bp, Artificial Sequence
  Synthetic
gaaccacatacgggagactatgtcgccgccaacgagacgcacaaggggaggaagactgcgactttcacggtttct

SEQ ID NO: 226346 - DNA, 75 bp, Artificial Sequence
  Synthetic
ggaagcatgatggaaacccatactggaacaatgcagagagattggttgagttcgggggccctcatgctgtcaaga

SEQ ID NO: 226347 - DNA, 75 bp, Artificial Sequence
  Synthetic
agggaaacaagtaccacctgaagagtggtcatgtgacctgtgaggtgggactggaaaaattaaagatgaaaggtc

SEQ ID NO: 226348 - DNA, 75 bp, Artificial Sequence
  Synthetic
tcacgtacacaatgtgtgataaagcagggtttgcatggaagagaactccaacagacagcgggcatgacacagtgg

SEQ ID NO: 226349 - DNA, 75 bp, Artificial Sequence
  Synthetic
ccccaggggacaacatcatctatgttggggaactgagtcatcaatggttccagacagggagcagtatcggaaggg

SEQ ID NO: 226350 - DNA, 75 bp, Artificial Sequence
  Synthetic
tggggaactgagtcatcaatggttccagacagggagcagtatcggaagggtgttccaaacaaccaggaaaggtat

SEQ ID NO: 226351 - DNA, 75 bp, Artificial Sequence
  Synthetic
ggaaagactgacagtaataggagagcacgcctgggactttggatccgctggtggcttctttagatcaattggaaa

SEQ ID NO: 226352 - DNA, 75 bp, Artificial Sequence
  Synthetic
gggggtggcactggcctggttgggactgaacacaaggaaccccacaatgtccatgagctttctcttggttggagg

SEQ ID NO: 226353 - DNA, 75 bp, Artificial Sequence
  Synthetic
ctgtggtgagggtttggttgtgtggagagaggtttcagagtggtatgacaactatgcatactacccggagacacc

SEQ ID NO: 226354 - DNA, 75 bp, Artificial Sequence
  Synthetic
agagaggtttcagagtggtatgacaactatgcatactacccggagacaccaggggctctcgcatcggcaataaaa

SEQ ID NO: 226355 - DNA, 75 bp, Artificial Sequence
  Synthetic
aaggggatgccaatctcacagtggtggtagacaaaaacgaccccactgactaccgaggcggaattcctggcctgc

SEQ ID NO: 226356 - DNA, 75 bp, Artificial Sequence
  Synthetic
tgagaaaagggaaggatatgaaggtttcctggaagagctggggccactcaatgatctggagtatccccgaggctc

SEQ ID NO: 226357 - DNA, 75 bp, Artificial Sequence
  Synthetic
atgatctggagtatccccgaggctcctcggcgtttcatggtgggcacagagggaacaagtgaatgcccgctagag

SEQ ID NO: 226358 - DNA, 75 bp, Artificial Sequence
  Synthetic
aacaaaagtctttctggactttagacaggaaccaacacacgagtgtgacacaggagtgatgggggccgccgttaa

SEQ ID NO: 226359 - DNA, 75 bp, Artificial Sequence
  Synthetic
caggaaccaacacacgagtgtgacacaggagtgatgggggccgccgttaaaaactgcatggcagtccacacggat

SEQ ID NO: 226360 - DNA, 75 bp, Artificial Sequence
  Synthetic
caaagcctctggatgaaatcgatgagaaacgacacaggtacctacatagttgaactcctggtcactgacctgagg

SEQ ID NO: 226361 - DNA, 75 bp, Artificial Sequence
  Synthetic
ctcggaactttttctcccggcgagtctcgcaggacccaggtcctggtataataggatccctggctactcggaaca

SEQ ID NO: 226362 - DNA, 75 bp, Artificial Sequence
  Synthetic
cccctccgagtcatcagagaggagtgtccaggaacgaccgtcacaataaatgccaagtgtgaaaaaaggggggct

SEQ ID NO: 226363 - DNA, 75 bp, Artificial Sequence
  Synthetic
ctggaatgtatcatccggaggagaccttctacaggaatgacggtcgtatggggaggcgttgtcgtcctcgctctg

SEQ ID NO: 226364 - DNA, 75 bp, Artificial Sequence
  Synthetic
gggaggcgttgtcgtcctcgctctgctcgtcactggaatggtcaggattgagagccttgtgcgctatgtggtggc

SEQ ID NO: 226365 - DNA, 75 bp, Artificial Sequence
  Synthetic
gagagttgggcttcttagcgcctttgcgctgcgcagaggcctcaccgtccgagagatggttaccacctacttcct

SEQ ID NO: 226366 - DNA, 75 bp, Artificial Sequence
  Synthetic
gagagatggttaccacctacttcctcctgttggtcctggagatgggactgccgagtgcgagcctcgaggatctct

SEQ ID NO: 226367 - DNA, 75 bp, Artificial Sequence
  Synthetic
aagggactgacctggataattcccttggctagattgcttggaggggagggctctgggatcagattgctggctttc

SEQ ID NO: 226368 - DNA, 75 bp, Artificial Sequence
  Synthetic
tgggaactggcagcccacagaggaagacggtctttcagtgagccactgactgtggtaggggtcatgttgacactg

SEQ ID NO: 226369 - DNA, 75 bp, Artificial Sequence
  Synthetic
cttgtgctcgggacgaggaagatgcagctggttgctgaatggagcggctgtgttgaatggcatccggaactgata

SEQ ID NO: 226370 - DNA, 75 bp, Artificial Sequence
  Synthetic
aatgagggtggagagatcagtctgcgggtccgccaggactcgatgggaaactttcatttgactgagcttgagaaa

SEQ ID NO: 226371 - DNA, 75 bp, Artificial Sequence
  Synthetic
actccattggtcgggcatccttggtgtgatgggactgtggacactcacggaagtaatgaggtcatctagacggtc

SEQ ID NO: 226372 - DNA, 75 bp, Artificial Sequence
  Synthetic
aatcctcagtcctggcttgttctggggtcagaggcaagtgggagttggttacggtcacaagggtgttctgcacac

SEQ ID NO: 226373 - DNA, 75 bp, Artificial Sequence
  Synthetic
ggtcagaggcaagtgggagttggttacggtcacaagggtgttctgcacacgatgtggcacgtgactagaggagcg

SEQ ID NO: 226374 - DNA, 75 bp, Artificial Sequence
  Synthetic
aaggtgaaacagtacaggtccatgccttcccaccggggaaagcccacgaggtgcaccagtgccaacccggagaat

SEQ ID NO: 226375 - DNA, 75 bp, Artificial Sequence
  Synthetic
tggggcaataccaattgacttggcaaagggaacatctggtagccctattcttaacgctcagggagcagttgttgg

SEQ ID NO: 226376 - DNA, 75 bp, Artificial Sequence
  Synthetic
acccaaccttccacaggcagttgtgggcacgggctggacgtcaaagggccagatcacagtgctggacatgcaccc

SEQ ID NO: 226377 - DNA, 75 bp, Artificial Sequence
  Synthetic
aggctctggaaagacccacagagtcctcccggagctcatccgccaatgcattgacaggcgcctgaggacgttggt

SEQ ID NO: 226378 - DNA, 75 bp, Artificial Sequence
  Synthetic
atgcgacttatgtcaacagacgcttgctcccacaagggaggcagagctgggaggtggcaatcatggatgaggccc

SEQ ID NO: 226379 - DNA, 75 bp, Artificial Sequence
  Synthetic
actggactgacccccacagtatagcagccagaggccacttgtacaccctggcaaaagaaaacaaatgcgccttgg

SEQ ID NO: 226380 - DNA, 75 bp, Artificial Sequence
  Synthetic
gatagctcgcgccttgagacagaaagggaaaagtgtgatttgtctaaatagtaagacttttgaaaaagattattc

SEQ ID NO: 226381 - DNA, 75 bp, Artificial Sequence
  Synthetic
aaatgggagctaaccttgacgtgagtcgcgttatagatggaaggacaaacatcaagcctgaggaggttgatggga

SEQ ID NO: 226382 - DNA, 75 bp, Artificial Sequence
  Synthetic
atttcacgccctggctggcatggcacgttgcagctaacgtgtctagcgtgacggaccgaagctggacatgggagg

SEQ ID NO: 226383 - DNA, 75 bp, Artificial Sequence
  Synthetic
gcccagaggccaacgccgtggacgaggcaagcggggatctggtcacctttaggagcccgaatggagcggagagaa

SEQ ID NO: 226384 - DNA, 75 bp, Artificial Sequence
  Synthetic
aggagcccgaatggagcggagagaaccctcaggccggtatggagagacgcacgcatgtttagagaaggacgtgac

SEQ ID NO: 226385 - DNA, 75 bp, Artificial Sequence
  Synthetic
gcgctttggatgttttctacacgctcatgcatgaggaacctggcagtagggcaatgaggatggcagagagagatg

SEQ ID NO: 226386 - DNA, 75 bp, Artificial Sequence
  Synthetic
cccccgaggctttcctgacggtggttgagatgatggttctgggtttagcgaccctgggtgtcgtctggtgttttg

SEQ ID NO: 226387 - DNA, 75 bp, Artificial Sequence
  Synthetic
tcgtccgaacatcaatcagtcgcatgatgctcggcactctggtcttactggcctctctgttgctactgtgggctg

SEQ ID NO: 226388 - DNA, 75 bp, Artificial Sequence
  Synthetic
gtggagtcagctacgggaatatggctggggtggcactcattttttacacactgctgacagttctgcagcccgaat

SEQ ID NO: 226389 - DNA, 75 bp, Artificial Sequence
  Synthetic
ctggaaaacagagaagcagtgatgataacaaactggcatacttcctgttgaccctttgcagtcttgctggactgg

SEQ ID NO: 226390 - DNA, 75 bp, Artificial Sequence
  Synthetic
ggaaaaaaccaaggcggatctgtctgcggtgctgtggagtgagcatggggaacaccggcaatggagtgagtggac

SEQ ID NO: 226391 - DNA, 75 bp, Artificial Sequence
  Synthetic
tcctgggggacctatgtgctagtggtctctctgtttacaccttatatcatccaccaattgcagactaaaatccaa

SEQ ID NO: 226392 - DNA, 75 bp, Artificial Sequence
  Synthetic
gggggggggagcccccttctttggtgtggcaggacatgtcatgaccctcggggtggtgtccctggttggggccac

SEQ ID NO: 226393 - DNA, 75 bp, Artificial Sequence
  Synthetic
cccgttcagagagggagaggcaaagccagctctatatgaaaggaaaatgagtctggctttggccataatcctgtg

SEQ ID NO: 226394 - DNA, 75 bp, Artificial Sequence
  Synthetic
tctcgtgtctgtggtcatgaaccgcacagcggcctccatgacggaggctgcggctgtggggttggcggccaccgg

SEQ ID NO: 226395 - DNA, 75 bp, Artificial Sequence
  Synthetic
acagcttctcagaccggaggcagacacactgtggacgatgccggtggcctgcggcatgagtggcgtggtcagggg

SEQ ID NO: 226396 - DNA, 75 bp, Artificial Sequence
  Synthetic
cagcctctgggggtttttgcccctcgggcacagactctggctccgggcttccgggggcaggcgtggtggctctga

SEQ ID NO: 226397 - DNA, 75 bp, Artificial Sequence
  Synthetic
gggagacacgcttggtgacctctggaagcgcaggctgaacaactgcactagggaggaattcttcgtttacaggcg

SEQ ID NO: 226398 - DNA, 75 bp, Artificial Sequence
  Synthetic
aagcgcaggctgaacaactgcactagggaggaattcttcgtttacaggcgcactggtattctggagactgaacgt

SEQ ID NO: 226399 - DNA, 75 bp, Artificial Sequence
  Synthetic
gcttggcttgaagaacgcggatacgctaccctcaagggagaggtggtagatctcgggtgtggaaggggtggctgg

SEQ ID NO: 226400 - DNA, 75 bp, Artificial Sequence
  Synthetic
tcctactatgcagcttctcggccggcagtcatgagtgtcagggcatacaccattggcggaagagggcatgaggtc

SEQ ID NO: 226401 - DNA, 75 bp, Artificial Sequence
  Synthetic
aatggacgtgttcagcatgcaaccacaccgagctgacaccatcatgtgtgacattggagaaagcaacccggatgc

SEQ ID NO: 226402 - DNA, 75 bp, Artificial Sequence
  Synthetic
tcgaggaagctcctggcccggtttggagaccagagagggccaaccaaagtccctgagcttgacttaggagtggga

SEQ ID NO: 226403 - DNA, 75 bp, Artificial Sequence
  Synthetic
cagctggccatggaacgcgcgggaagatgtggtgcgcatggccatgactgacacgacagcctttggacaacagag

SEQ ID NO: 226404 - DNA, 75 bp, Artificial Sequence
  Synthetic
agtgtttaaagagaaagttgacacaaaagcacaggagcctcaaccggggacgagagtgatcatgagagcagtgaa

SEQ ID NO: 226405 - DNA, 75 bp, Artificial Sequence
  Synthetic
aaagcacaggagcctcaaccggggacgagagtgatcatgagagcagtgaatgattggattttggagcggctggcc

SEQ ID NO: 226406 - DNA, 75 bp, Artificial Sequence
  Synthetic
gcagagaggaattcatagcaaaagtaagatcaaatgcagccctgggagcttggtcggatgaacagaacagatggg

SEQ ID NO: 226407 - DNA, 75 bp, Artificial Sequence
  Synthetic
aaaaagcataccatgccaaggtagtgaaggtcgcaagaccttctcgcgatggaggctgcatcatggatgtcatca

SEQ ID NO: 226408 - DNA, 75 bp, Artificial Sequence
  Synthetic
gaaggtcgcaagaccttctcgcgatggaggctgcatcatggatgtcatcacgagaagagatcagagaggctcagg

SEQ ID NO: 226409 - DNA, 75 bp, Artificial Sequence
  Synthetic
ggtgatgactgtgtggtgagacccatggatgacagatttggtaaagctctctacttcctgaatgacatggcaaag

SEQ ID NO: 226410 - DNA, 75 bp, Artificial Sequence
  Synthetic
ggaagaggtccccttttgttcacaccatttccatgagctggtgatgaaggacggacgcaccttagtggtgccatg

SEQ ID NO: 226411 - DNA, 75 bp, Artificial Sequence
  Synthetic
gaggatcatggagtggagggacgtaccatatctccccaagacccaggacatgatatgttcctcccttgttgggag

SEQ ID NO: 226412 - DNA, 75 bp, Artificial Sequence
  Synthetic
tcaagctagagagctcaataatctaagtctagcctgcgactgagcaaaacttgaagagcccgcaaggaaaccatg

SEQ ID NO: 226413 - DNA, 75 bp, Artificial Sequence
  Synthetic
gagaccccccctggccaggaaaagggggaaaaacaggccaggggtgaagaacgcccccagagtgcaccacggcag

SEQ ID NO: 226414 - DNA, 75 bp, Artificial Sequence
  Synthetic
cacgccagtgagagtggcgacgggagatggtcgatcccgacgtagggcactcggcaaaatttgcgagacccccag

SEQ ID NO: 226415 - DNA, 75 bp, Artificial Sequence
  Synthetic
gatggtcgatcccgacgtagggcactcggcaaaatttgcgagacccccagccccatgacaaggccgaacatgggg

SEQ ID NO: 226416 - DNA, 75 bp, Artificial Sequence
  Synthetic
tgcttccgggaggagggaagagagaaattggcagctctcttcagggtttttcctcctcctataccaaattccccc

SEQ ID NO: 226417 - DNA, 75 bp, Artificial Sequence
  Synthetic
gcgcaccggggatcctaggcttttaattggttgcgcaaagctttggaatggggcagattgttgccgttttccaag

SEQ ID NO: 226418 - DNA, 75 bp, Artificial Sequence
  Synthetic
gggcagattgttgccgttttccaagctatccctgagattctaaacgaggcaattaacattgtgataattgtgatc

SEQ ID NO: 226419 - DNA, 75 bp, Artificial Sequence
  Synthetic
ataatgttcaccctcatcaagggcgttttcaatctatacaaatccggtcttttccagctggtcatctttctccta

SEQ ID NO: 226420 - DNA, 75 bp, Artificial Sequence
  Synthetic
ctctgtggcaagcgttgtgactcatcattgctatcaggattcaatctggagacagttcatttcaacatgtcactg

SEQ ID NO: 226421 - DNA, 75 bp, Artificial Sequence
  Synthetic
ttgagctccatccctatggtctctgaacagcagcactgcatccagcacaatcacagctccataaccttcagtttg

SEQ ID NO: 226422 - DNA, 75 bp, Artificial Sequence
  Synthetic
ctgaccaacaagtccgacttggaaaagtgcaatttcacccgcctgcaagctgttgacagggtgatctttgatctg

SEQ ID NO: 226423 - DNA, 75 bp, Artificial Sequence
  Synthetic
ttcagagagtttcatcaccgtgttggggattttcctgttacttctgatctgaaatgctctcacaacaccagctac

SEQ ID NO: 226424 - DNA, 75 bp, Artificial Sequence
  Synthetic
agagtgatagaatatgaagtcaccaaagagagtctccctcgattgcaggaagctgtgagcaccttgttcccagac

SEQ ID NO: 226425 - DNA, 75 bp, Artificial Sequence
  Synthetic
ctccatctctccgaagataggtttctgcaaattcaggcccatgatgacaagaactgcactggtctacacccattg

SEQ ID NO: 226426 - DNA, 75 bp, Artificial Sequence
  Synthetic
tgcaaattcaggcccatgatgacaagaactgcactggtctacacccattgaactacctgaggctcctgaaagaga

SEQ ID NO: 226427 - DNA, 75 bp, Artificial Sequence
  Synthetic
gaactgcactggtctacacccattgaactacctgaggctcctgaaagagaattcagaaactcactacaaagtgag

SEQ ID NO: 226428 - DNA, 75 bp, Artificial Sequence
  Synthetic
gaaattaatgaaattgtttcagtggtctttgagtgatgagacaggtagccctctgccaggtggacactgtctaga

SEQ ID NO: 226429 - DNA, 75 bp, Artificial Sequence
  Synthetic
ggacatattgtgagacaagatgtcgacaagcgcagaagagaaagctcactggaggaagtaagtgtcctataaacg

SEQ ID NO: 226430 - DNA, 75 bp, Artificial Sequence
  Synthetic
gttaattggactacttttctagtacctcacttcagtgagagtgacatgggtcagagacattcctctggctccggc

SEQ ID NO: 226431 - DNA, 75 bp, Artificial Sequence
  Synthetic
aagatggctcatctttgcgtctgatataaagtgctttgataatgcagcgattgccaaatgcaataaagagcatga

SEQ ID NO: 226432 - DNA, 75 bp, Artificial Sequence
  Synthetic
tgaggagttctgtgacatgttgaggctatttgactacaacaaagcaagtattgccaagcttaggggcgaagcctc

SEQ ID NO: 226433 - DNA, 75 bp, Artificial Sequence
  Synthetic
aagctcgatcaacttgttgtcggggagaatcaatgccatcatttcagacacacttttgatgagatcatccctcaa

SEQ ID NO: 226434 - DNA, 75 bp, Artificial Sequence
  Synthetic
gaggctgatgggcataccatactgcaattatacaaagttctggtatttaaaccatacaaaactggggatacattc

SEQ ID NO: 226435 - DNA, 75 bp, Artificial Sequence
  Synthetic
tttaccccgatgttggctggttagtaatgggagttacctcaacgaaacaaaatttactcatgatatggaagatga

SEQ ID NO: 226436 - DNA, 75 bp, Artificial Sequence
  Synthetic
ccctctgaagacccgcagcgaaacccaaccaaggggcgcccccctctcgcggggggggcgcagctccgccgtcgc

SEQ ID NO: 226437 - DNA, 75 bp, Artificial Sequence
  Synthetic
ggcagataaactgctgaccgagatgctaaagaaagagtatgttaggagacaagagaaaacacccattactctgat

SEQ ID NO: 226438 - DNA, 75 bp, Artificial Sequence
  Synthetic
ggacatactgatgtttagtgtctctttctatatgttttctgtaacactatgcatatgcaacatacccacccatcg

SEQ ID NO: 226439 - DNA, 75 bp, Artificial Sequence
  Synthetic
gcacatcacaggtttgccgtgtcccaaaccacacagactcagaaagaatggcacctgtgcctgtggcttctttaa

SEQ ID NO: 226440 - DNA, 75 bp, Artificial Sequence
  Synthetic
gtcaataaacaggtccactggttgggccaaacactgagagtcccaacacagggaccccatgaccgtcactccgct

SEQ ID NO: 226441 - DNA, 75 bp, Artificial Sequence
  Synthetic
ttgcggagtgacggtcatggggtccgtggagactcacagactcagcttggctgctgttctgaagatcatgtctgc

SEQ ID NO: 226442 - DNA, 75 bp, Artificial Sequence
  Synthetic
aggcagcaagttccttatgggctcttggtaaagttgcccattcactgctgattcatacatgatacagtccatcag

SEQ ID NO: 226443 - DNA, 75 bp, Artificial Sequence
  Synthetic
tgcacaatgtggtgtaatctctttcttccctttcttggacttggtcacaacaattccagtatgctggttgcaaaa

SEQ ID NO: 226444 - DNA, 75 bp, Artificial Sequence
  Synthetic
ggtcttgtatgagtcccaaacctggtcctcgaactttctagaggcctcttttgacatttgaatatcaatgaattt

SEQ ID NO: 226445 - DNA, 75 bp, Artificial Sequence
  Synthetic
cacgtcccttctaccttgactgtgaaggagtttttcaatgtcatccttcccctgacaggttatcaccatgccaag

SEQ ID NO: 226446 - DNA, 75 bp, Artificial Sequence
  Synthetic
ggggagtctttccaacactgctgtggttagtccaggttgggtggagcaaagctgagtgaaatccatgccatgaca

SEQ ID NO: 226447 - DNA, 75 bp, Artificial Sequence
  Synthetic
gtacttgctgtcatttttgaattgtttttgatccgtgggctctctgtagaagtggaggcaaagtctttcttctgg

SEQ ID NO: 226448 - DNA, 75 bp, Artificial Sequence
  Synthetic
ctggaatattgctatctccaccggatcatcaggtctaccttcaatgtccatccatgttctccccttggggttcag

SEQ ID NO: 226449 - DNA, 75 bp, Artificial Sequence
  Synthetic
gtttttcataatgtcatctaagagttgagattggctgaagctcacacccacaggaaattggtggggggcttttgc

SEQ ID NO: 226450 - DNA, 75 bp, Artificial Sequence
  Synthetic
tctttcgttctgtggaggtgtagggtcctttggagtcatatcaatgactgtgttgtcccaggatctgccttttat

SEQ ID NO: 226451 - DNA, 75 bp, Artificial Sequence
  Synthetic
gctggttctggaagagatgtatggccaaccctcacctgataagcagatcttgtatagtagattctcatacgggtt

SEQ ID NO: 226452 - DNA, 75 bp, Artificial Sequence
  Synthetic
tctttctcctggaacctcagacacaaacatctgtactttgttccttgcagttagagttgccttgatcacgtcatc

SEQ ID NO: 226453 - DNA, 75 bp, Artificial Sequence
  Synthetic
aatatttctgctgttcaattcaatggtctccaacatgtctcctcccttcatgagagacgcaccagctttgaccaa

SEQ ID NO: 226454 - DNA, 75 bp, Artificial Sequence
  Synthetic
tgaagcaagactcaagttgtaacctgaaatgttgatcgcagaatcacaattgcttacatagtctaaaactggatg

SEQ ID NO: 226455 - DNA, 75 bp, Artificial Sequence
  Synthetic
cttgttctttagcttgtccagatcatccatgttgggaaactttgcggtgtaaatgaggcccagatctacacaggc

SEQ ID NO: 226456 - DNA, 75 bp, Artificial Sequence
  Synthetic
ttggacactatcattcagatctacccttgtctgtctggttaaacaggccagtgtcagacttggcatagtgccaaa

SEQ ID NO: 226457 - DNA, 75 bp, Artificial Sequence
  Synthetic
ctgattgttcaggagagaagagtctttgacgtcccagaccctcacaactgtgttccttgttggcctcggggtgcc

SEQ ID NO: 226458 - DNA, 75 bp, Artificial Sequence
  Synthetic
cataccaatcatgttgaggagctctgacctcctgcccaattgatcctgactcagattccccctatagactccagg

SEQ ID NO: 226459 - DNA, 75 bp, Artificial Sequence
  Synthetic
gcctctggcttcggtcctggtcaccttctttttgagtttctccagatctgttgccagaatcatcaactcatcaga

SEQ ID NO: 226460 - DNA, 75 bp, Artificial Sequence
  Synthetic
ggttagtttcccaacaccaaccctgttcttcttattgctcgatttaaggtccaccaagccatccactgtctggtt

SEQ ID NO: 226461 - DNA, 75 bp, Artificial Sequence
  Synthetic
caattctctcaatttcattaggtcctcgtcattccttttatcctttctcatgagtctctggacatcggacaccat

SEQ ID NO: 226462 - DNA, 75 bp, Artificial Sequence
  Synthetic
agagaaatcaaggccgttgatcagactcacggcatccttgacaactttggctctcacgtccgtgcaaaacgggga

SEQ ID NO: 226463 - DNA, 75 bp, Artificial Sequence
  Synthetic
gagctctcttctcagagtctgtaaccaaaggaaggatttcacttcttttgattgggacatattgtgagacaagat

SEQ ID NO: 226464 - DNA, 75 bp, Artificial Sequence
  Synthetic
atgtcgacaagcgcagaagagaaagctcactggaggaagtaagtgtcctataaacgcctaggatccactgtgcgc

SEQ ID NO: 226465 - DNA, 75 bp, Artificial Sequence
  Synthetic
gcgcaccggggatcctaggcgttaattggactacttttctagtacctcacttcagtgagagtgacatgggtcaga

SEQ ID NO: 226466 - DNA, 75 bp, Artificial Sequence
  Synthetic
ttggactacttttctagtacctcacttcagtgagagtgacatgggtcagagacattcctctggctccggccaacc

SEQ ID NO: 226467 - DNA, 75 bp, Artificial Sequence
  Synthetic
caaccccaagccgagtgacagcgatcatgaagcgagaaggtcagagcttcactcggacgcctcccatctcggacc

SEQ ID NO: 226468 - DNA, 75 bp, Artificial Sequence
  Synthetic
tctgaactgcaaatcttgctggaagtcaaagaaggcactggtgaagtgctatgatcactacctctgtctaaactg

SEQ ID NO: 226469 - DNA, 75 bp, Artificial Sequence
  Synthetic
cttaagccttctaatgggcatcaccccaagatgtcccttctgttacagagagctacccaaaaatctggaccttgc

SEQ ID NO: 226470 - DNA, 75 bp, Artificial Sequence
  Synthetic
agctacccaaaaatctggaccttgcagaggcaccaagcgcaccacccctctgaagacccgcagcgaaacccaacc

SEQ ID NO: 226471 - DNA, 75 bp, Artificial Sequence
  Synthetic
aaggggcgcccccctctcggggggggcgccccgccccgccgggcgggggcccccccagggggggcgcagctccgc

SEQ ID NO: 226472 - DNA, 75 bp, Artificial Sequence
  Synthetic
cgtcgcgcgctccacagaccacaccaatcatcgatgcagaagatcattcaatctcaatagtggatgtcccctctc

SEQ ID NO: 226473 - DNA, 75 bp, Artificial Sequence
  Synthetic
tcaatagtctacagcatactccaccaagtctcattccaccaccaggatgagcaatcaccagatccttgagatgct

SEQ ID NO: 226474 - DNA, 75 bp, Artificial Sequence
  Synthetic
tgctgtacgctaatgtgtaggaactgagcttgacccatccgattacccctgagaaacagtccaccaaatcatgct

SEQ ID NO: 226475 - DNA, 75 bp, Artificial Sequence
  Synthetic
ccgttaggcccacatctttgaaacacttgattaggtccaccctagacaaatcaacctcatgtttttgagactttt

SEQ ID NO: 226476 - DNA, 75 bp, Artificial Sequence
  Synthetic
tcagcattgtctctatccctttctttattaaagccatgtgctctgggtatagctcagccaagaatatcataacat

SEQ ID NO: 226477 - DNA, 75 bp, Artificial Sequence
  Synthetic
ctttagtatcaagactgacttttagctgtgcaactgtctctttcagctctttcacatcaccatcaattaagacaa

SEQ ID NO: 226478 - DNA, 75 bp, Artificial Sequence
  Synthetic
ggcctaccggaacccagtctggcccaaggcgtgtataagcaagtgggtcatcaacagagaaggactccccaggaa

SEQ ID NO: 226479 - DNA, 75 bp, Artificial Sequence
  Synthetic
tcagttcaaccatgatggtatcctggtttgatggctcttcatgctgatcaatcatctgtctctggacaaacactg

SEQ ID NO: 226480 - DNA, 75 bp, Artificial Sequence
  Synthetic
tcatgtcttctttgctaaatgagaggctcctagcaatggccaagatattggtcctcacaaactcgtccctcacag

SEQ ID NO: 226481 - DNA, 75 bp, Artificial Sequence
  Synthetic
ctccagaaaatccacactcaacacccaggacctccaccatcaggaagccctcagacgcatcgctgacactgccgt

SEQ ID NO: 226482 - DNA, 75 bp, Artificial Sequence
  Synthetic
gaattctgtgaatgatactaaatttgctgtcacaggctccgtttctatttcttttaataaaattgtgagtgattg

SEQ ID NO: 226483 - DNA, 75 bp, Artificial Sequence
  Synthetic
ttatgacgactctctcatcaagattaaaacagtctctccctgcatcagcagaagacactctagatattctttgat

SEQ ID NO: 226484 - DNA, 75 bp, Artificial Sequence
  Synthetic
gagccgaagagatgtacgccttaaaatccttaaggtcaatccagctaaatccactacttagatcatccctgtaca

SEQ ID NO: 226485 - DNA, 75 bp, Artificial Sequence
  Synthetic
ttggcctctcctggcctttgtggattgttttcagaacaaaattctcgaatgggcccaaagaaggtgcaccctcac

SEQ ID NO: 226486 - DNA, 75 bp, Artificial Sequence
  Synthetic
cctttggcatcatggaggcatgtgggaaccatgtgaatgaacctaatgttctgctggacagcaacactggcctaa

SEQ ID NO: 226487 - DNA, 75 bp, Artificial Sequence
  Synthetic
tcagagactcgaagaacaattgctttaagaaattgatacatgtatcagatgtactgatcacttttgaatcaatca

SEQ ID NO: 226488 - DNA, 75 bp, Artificial Sequence
  Synthetic
tagtcgtgaattttctattatgactattcgagaggtctaaagtgagaactgtgtactgctcagacctcttccatt

SEQ ID NO: 226489 - DNA, 75 bp, Artificial Sequence
  Synthetic
taacgacatgactgataagactgatagcttcacaagtgatgtcaagtgagacacatagatctagaaatctgatct

SEQ ID NO: 226490 - DNA, 75 bp, Artificial Sequence
  Synthetic
taggagcccaagaagactttctcaatgagttgtcgtccagaaacggaaggaggtgagtttcaaaaagcgatggat

SEQ ID NO: 226491 - DNA, 75 bp, Artificial Sequence
  Synthetic
ataatcgtcttacactctgtaaaatatgattgtaacccactttgtcttccaagacagcacttttgacagggaaca

SEQ ID NO: 226492 - DNA, 75 bp, Artificial Sequence
  Synthetic
cagcaacatagtcatggctagatctgcctaaaaatgggcccctttgtggaggttcagggtcccctagtacccatg

SEQ ID NO: 226493 - DNA, 75 bp, Artificial Sequence
  Synthetic
tccccaactctagacaattggacaatacaatgcatagataatctatcaaaattggtcttatcattggtcttaacc

SEQ ID NO: 226494 - DNA, 75 bp, Artificial Sequence
  Synthetic
attcgcactctggaggccagtcagactgaattgagccgtcctctgactccaattccactatgagaatgtcatcct

SEQ ID NO: 226495 - DNA, 75 bp, Artificial Sequence
  Synthetic
tcatgatgacttttaaaccaggcagtgattccagttttgataagatctctactatgtaatgacagttcctgtcag

SEQ ID NO: 226496 - DNA, 75 bp, Artificial Sequence
  Synthetic
catctctcacacacttacttcctatcgtctttgctagcccaataaaccctgaagcaacactgctttggaatgcac

SEQ ID NO: 226497 - DNA, 75 bp, Artificial Sequence
  Synthetic
ttttgttcactgaatctgataacagcttttgggtgctttttgtgaagctatggcttaatttgttttgcagcaccc

SEQ ID NO: 226498 - DNA, 75 bp, Artificial Sequence
  Synthetic
tgatcacagttggtaggttgactgattctatctgaagtgcagaaggaaagagaactttctgacgaagaaccattc

SEQ ID NO: 226499 - DNA, 75 bp, Artificial Sequence
  Synthetic
tgatggggtgatgtgcttcaaggttcaaccagcagtctctcaattggggctcatcaaggtcataatgtttgaata

SEQ ID NO: 226500 - DNA, 75 bp, Artificial Sequence
  Synthetic
gggactttaggacagtgaatgggtctcttgagaacaactcagccaaaaagtcttccctcacctcatcatttttta

SEQ ID NO: 226501 - DNA, 75 bp, Artificial Sequence
  Synthetic
aggagttatacaatctccttactaactttcgaacagtcccagtgctatctggaaataagttttctaactgtcttt

SEQ ID NO: 226502 - DNA, 75 bp, Artificial Sequence
  Synthetic
gaatcctgtaacctctggttccatcaatccaatctttgatgtctgtattcacattgagcaagaatggattaatag

SEQ ID NO: 226503 - DNA, 75 bp, Artificial Sequence
  Synthetic
ggaatctacaatacctcaataagttaatacatctcttttgcagaaggttgcatatgttaattggcaccccatttg

SEQ ID NO: 226504 - DNA, 75 bp, Artificial Sequence
  Synthetic
cagcgcattgatccacaatggtgtccacagtttctgacagttgatgcggtgttttgcattttacattgtgtaatg

SEQ ID NO: 226505 - DNA, 75 bp, Artificial Sequence
  Synthetic
aagctgctacgaactttgttaacaaagggacctcttcaccccaaacaaagaatcttgacttaaattctgcaacga

SEQ ID NO: 226506 - DNA, 75 bp, Artificial Sequence
  Synthetic
actcacagagcgagcttttgggactgacaaacttattaagctgactagataaataatagtggtagttcaaaaagc

SEQ ID NO: 226507 - DNA, 75 bp, Artificial Sequence
  Synthetic
ataggagctcttcagtgtcatcccttagtgtggctgataattctttgtcaaacaatgatatttgatcatcgctag

SEQ ID NO: 226508 - DNA, 75 bp, Artificial Sequence
  Synthetic
aagtgaaactcttcagctcacctctgaacaaaagcttcagtgtgtagtttatgaacttctcagttattaaaccat

SEQ ID NO: 226509 - DNA, 75 bp, Artificial Sequence
  Synthetic
aataatcagatgcgttatgcaatataccctgacccatgtctaagatgctgctaatgtgagacggaacaataccat

SEQ ID NO: 226510 - DNA, 75 bp, Artificial Sequence
  Synthetic
gatctaaatgagaaaagatgaactcttctgtttttgtgttaatgacaccctgttgtatacctaactgacgtttta

SEQ ID NO: 226511 - DNA, 75 bp, Artificial Sequence
  Synthetic
caaaggatttggtaatggcattgatgacgttgaagggaacctcaacatatttatgaacatgccaggacagtaatg

SEQ ID NO: 226512 - DNA, 75 bp, Artificial Sequence
  Synthetic
ttgagatatgctcaattggcttatcaaaatctttaatgtacttgatattttttaaaactgtcaagaagagaagcg

SEQ ID NO: 226513 - DNA, 75 bp, Artificial Sequence
  Synthetic
gacacatagttgggccccacttgctgtgatccatgttgtagctaagattcccttctctaatgcactgcttcatct

SEQ ID NO: 226514 - DNA, 75 bp, Artificial Sequence
  Synthetic
ctgagattgcctcctcaaactgtgcttcatcgtttaagcagctcccatttagctgaccagtgagagactcaaaaa

SEQ ID NO: 226515 - DNA, 75 bp, Artificial Sequence
  Synthetic
agtcttccacaaaccttgtgtacatcttagtcttcatgtcaccgatgtacaattctctattcccaccaacctgtt

SEQ ID NO: 226516 - DNA, 75 bp, Artificial Sequence
  Synthetic
ccttgtatgataaagagaactggagcctacccgtgtctggaccagcaccattgtaggaggtgggtgactcatctg

SEQ ID NO: 226517 - DNA, 75 bp, Artificial Sequence
  Synthetic
aatagaaacacaagtttttcagagtggacgtaatgcatttagtgaaagacagcagtttacacatagcctcagaat

SEQ ID NO: 226518 - DNA, 75 bp, Artificial Sequence
  Synthetic
tactctctctttcacttatcctggcatcttcgtagagttttttgtaatcaaacttataattaagtcttagtctgg

SEQ ID NO: 226519 - DNA, 75 bp, Artificial Sequence
  Synthetic
aattgtgcttgaatctaccagagtagtgattcacatttagttgcaataagatggtcttaaagcatttgaaccaat

SEQ ID NO: 226520 - DNA, 75 bp, Artificial Sequence
  Synthetic
ctccctcttcataaaactttcttgtgatgttttttgtgaacatctctatgggacaggattctaacactgtctctg

SEQ ID NO: 226521 - DNA, 75 bp, Artificial Sequence
  Synthetic
tcatgactaattttgagtattttggtgagtttccaactcgctcacagaaatcttcatagaatgaatccggaaaga

SEQ ID NO: 226522 - DNA, 75 bp, Artificial Sequence
  Synthetic
gtgactcttcaaaatcttcaactaaatgataagaaacctctgagagtatgagatttctatctctgtgattggcca

SEQ ID NO: 226523 - DNA, 75 bp, Artificial Sequence
  Synthetic
ctaaatctctcaaagcttcagaaacacttataccctcagtgtcttgaaccttttttgggttttgtttgtgttgat

SEQ ID NO: 226524 - DNA, 75 bp, Artificial Sequence
  Synthetic
actttgagaaaatcttgtctatagaacatctgatcttactcagagattcagatggcaagagttcttcaagtggta

SEQ ID NO: 226525 - DNA, 75 bp, Artificial Sequence
  Synthetic
ctgaatcttcgctctcctcgagatctattgattctgacacactagtctgactatcccttgttgttgtttttttct

SEQ ID NO: 226526 - DNA, 75 bp, Artificial Sequence
  Synthetic
tcttttcttttctattttcttcagccattgtgtgtgaaattgatttcaggattttgtattccagttgttcaggac

SEQ ID NO: 226527 - DNA, 75 bp, Artificial Sequence
  Synthetic
ttaagcaaaacttagttttattgtggaacttctcaacaatatcacacagggaaactccgaccaacttatcataat

SEQ ID NO: 226528 - DNA, 75 bp, Artificial Sequence
  Synthetic
catagtccacagaattccccttatcatcagtctttgggattacaacactcttattgctagacagatcaagtgcag

SEQ ID NO: 226529 - DNA, 75 bp, Artificial Sequence
  Synthetic
attaggaaagtttcttgagataagctgcaggagttcattctttaatgagtccattgtgaattttgtcccataaaa

SEQ ID NO: 226530 - DNA, 75 bp, Artificial Sequence
  Synthetic
tcgaacaacgtgcatctttcaatgggtttgttttaatcttagcaagctcatcaggggtgaagccactggttgaat

SEQ ID NO: 226531 - DNA, 75 bp, Artificial Sequence
  Synthetic
taacgaaagataacatcagcgatagcatctgttttgaaacaccaggtgccttgacatcaaattcatctttgttca

SEQ ID NO: 226532 - DNA, 75 bp, Artificial Sequence
  Synthetic
gaaaccttgagccactctctagtaacagtgacgactcttctttcgtaacgtcgttcttggggttgacaaaaacgc

SEQ ID NO: 226533 - DNA, 75 bp, Artificial Sequence
  Synthetic
ttttaaatttcaactttggttccaagaatttttcaaagcattttatctgatctgttaccctgtccggcgtctctt

SEQ ID NO: 226534 - DNA, 75 bp, Artificial Sequence
  Synthetic
tagttatgaaatggcaaatgtaggacaggttgagaagaaatttgaaccgactagtgagcatagtttcaacactgt

SEQ ID NO: 226535 - DNA, 75 bp, Artificial Sequence
  Synthetic
cacccaatacaagaatcatcacttttcttacacatctatagattagatactcactctttgtgattaaatcttcct

SEQ ID NO: 226536 - DNA, 75 bp, Artificial Sequence
  Synthetic
tcaccttttccatcaaatcaacatgatgtgcaaggccaaagaaagccatgatgaagtatctaaggttttgtaaga

SEQ ID NO: 226537 - DNA, 75 bp, Artificial Sequence
  Synthetic
acttttggctccttttgctaggattcaaaagtactgacatgaaaattatcttcaatagaattttaatttcatcaa

SEQ ID NO: 226538 - DNA, 75 bp, Artificial Sequence
  Synthetic
tgcagccttccagctcctttacatcagaaagccactgcaccattgtatcgatgacacccttgatcacctccgagg

SEQ ID NO: 226539 - DNA, 75 bp, Artificial Sequence
  Synthetic
acattattggcaaaaagtatctcttggggtcagcataaaaagaacagatgtgctcaccatccctatttatagaat

SEQ ID NO: 226540 - DNA, 75 bp, Artificial Sequence
  Synthetic
agcattttgaagactcaccagttttctggtaaatgagagtaaatgtacctttgggagactttatttcttggaaaa

SEQ ID NO: 226541 - DNA, 75 bp, Artificial Sequence
  Synthetic
aacactcttcacaactcactcttccatatctgttctttccactagcattttgtcttatcttagatactgatgatg

SEQ ID NO: 226542 - DNA, 75 bp, Artificial Sequence
  Synthetic
tcttcattgagtttaccaaactcaaagataacgaagaaatcatgcggaggtcagttatgtcctcactaaaactgg

SEQ ID NO: 226543 - DNA, 75 bp, Artificial Sequence
  Synthetic
tttcatccaagtgcatttggggtctgaagttatctctctcataattcataactgggatgcttcctgactttttaa

SEQ ID NO: 226544 - DNA, 75 bp, Artificial Sequence
  Synthetic
aagacataaaatcttcaagagacggccaattctcgaaatcagaggcctcaagtccataactgtgagcggtaagcc

SEQ ID NO: 226545 - DNA, 75 bp, Artificial Sequence
  Synthetic
catgagcatttagactattgaagactttgttaagaatcaaccttctatagtctagaaagatttcattaagcgctt

SEQ ID NO: 226546 - DNA, 75 bp, Artificial Sequence
  Synthetic
tggtcttacccttacttttgttttttggcattctactaagtctgaataaatgctttttaagatctctctgagttg

SEQ ID NO: 226547 - DNA, 75 bp, Artificial Sequence
  Synthetic
acatcactgacacaagtctatctgagactgtggtgaatgactgcccgcaccagacagactcatcatcatcccctc

SEQ ID NO: 226548 - DNA, 75 bp, Artificial Sequence
  Synthetic
taggaaactcattctttaatgaaattagatgacttaacctaacaacatcaagacctaggagcagtttccttcttg

SEQ ID NO: 226549 - DNA, 75 bp, Artificial Sequence
  Synthetic
tgttcattagtttgatactctttgatttattcaacatgctaatcattccacatgattttctatgataatgacggt

SEQ ID NO: 226550 - DNA, 75 bp, Artificial Sequence
  Synthetic
cgttcccaaccttttcggccttatcctgttcggggtgtccttcatcattcttagagtcaaaataaatgaaattgg

SEQ ID NO: 226551 - DNA, 75 bp, Artificial Sequence
  Synthetic
tgaatgatgttgcttctttgaaatctcgcagcaactcccacttggattctggtgctgatgaaactccctgatcta

SEQ ID NO: 226552 - DNA, 75 bp, Artificial Sequence
  Synthetic
agtacaagtcacagaattctttcagcaacctttctttgtctgtcatcatgaataagggtgggatgactcccttct

SEQ ID NO: 226553 - DNA, 75 bp, Artificial Sequence
  Synthetic
tcaacttcgctttgaattctaagaagttctccactatcttggaattaacctctgacaagggaatgtctgggcgca

SEQ ID NO: 226554 - DNA, 75 bp, Artificial Sequence
  Synthetic
caccttcaacacacagcctcattatattctcgaaatgctcacctgaattattcttaagcagattgaatgcgtcta

SEQ ID NO: 226555 - DNA, 75 bp, Artificial Sequence
  Synthetic
aatcaaagagcttgctaccattgcctttgagtgattctgacagcctaatatactctgactcttccaacatcgcct

SEQ ID NO: 226556 - DNA, 75 bp, Artificial Sequence
  Synthetic
cattctcttgcacatactctaatagtctgaagattaaattcttaaatttgaacaccacccaatcaggaatggagt

SEQ ID NO: 226557 - DNA, 75 bp, Artificial Sequence
  Synthetic
tgttttcatacccactcctgcccaccaccagtggcacaagagtgatccctgagtgttcaagatcacccctcagtg

SEQ ID NO: 226558 - DNA, 75 bp, Artificial Sequence
  Synthetic
atgatagcttcttcatgtcattgttgtatttctgctcatactctaggggattcagtctcacaaaacattctagta

SEQ ID NO: 226559 - DNA, 75 bp, Artificial Sequence
  Synthetic
gaatcaacatgtttcctgacaccttgaatccgtctggagtgacacatggaagagaagggacaacaaatccatttt

SEQ ID NO: 226560 - DNA, 75 bp, Artificial Sequence
  Synthetic
ctcttaagataagttccactgacttctcttcagtgttgtggatgcaaccattctcatcgcagatgtcaatctcaa

SEQ ID NO: 226561 - DNA, 75 bp, Artificial Sequence
  Synthetic
tacacgtggataatagcttgagaccctcaatcataatgaacttgggctctgtttggcaaaggacttttagctttt

SEQ ID NO: 226562 - DNA, 75 bp, Artificial Sequence
  Synthetic
ggggagctagtctctcatcattaggaaagtttcttgagataagctgcaggagttcattctttaatgagtccattg

SEQ ID NO: 226563 - DNA, 75 bp, Artificial Sequence
  Synthetic
taagctgcaggagttcattctttaatgagtccattgtgaattttgtcccataaaagcctaggatcctcggtgcgc

SEQ ID NO: 226564 - DNA, 75 bp, Artificial Sequence
  Synthetic
agcttggatggggcagattgttgccgttttccaagctatccctgagattctaaacgaggcaattaacattgtgat

SEQ ID NO: 226565 - DNA, 75 bp, Artificial Sequence
  Synthetic
acacccattgaactacctgaggctcctgaaagagaattcagaaacccactacaaagtgaggaaattaatgaaatt

SEQ ID NO: 226566 - DNA, 75 bp, Artificial Sequence
  Synthetic
cgcaccggggatcctaggcattttgggagcgctatacaaaccactcattgggttggtggagcctcaaccaacatg

SEQ ID NO: 226567 - DNA, 75 bp, Artificial Sequence
  Synthetic
gttttagatcatcttcagtctccagtgctgggctcagcttatacggaaagtcactaaggtcattcttttcataat

SEQ ID NO: 226568 - DNA, 75 bp, Artificial Sequence
  Synthetic
ggtcaaatgatcaccttctttcaggaggtgccccatataatagaggaagtgatgaacatagtcctcatcactctg

SEQ ID NO: 226569 - DNA, 75 bp, Artificial Sequence
  Synthetic
tgatggacggcatgacacctctcacttcaacccccattatcttttcaaaacttgagattgaaattatgttttcta

SEQ ID NO: 226570 - DNA, 75 bp, Artificial Sequence
  Synthetic
tccctccttgcaatactcaagggaatttataacctggcaacttgtggtcttctaggtttaatctcgtttctgttc

SEQ ID NO: 226571 - DNA, 75 bp, Artificial Sequence
  Synthetic
aaacgccaaaatcagaaaattttaagttaacaagtgccaatgcctgttcagccttccttagggtggagctaacaa

SEQ ID NO: 226572 - DNA, 75 bp, Artificial Sequence
  Synthetic
ctgtgcgggaggtcctgcacaatagtgtacaaagacaattatgagctaaacagtgttgagcttgatatgtccact

SEQ ID NO: 226573 - DNA, 75 bp, Artificial Sequence
  Synthetic
ggttataatacaccagtccttgatgctcatggcctgagcctagattcctcacttgatttgtccttcgtctttcca

SEQ ID NO: 226574 - DNA, 75 bp, Artificial Sequence
  Synthetic
ctaaacttcacaatgcccttgtcctgctcaaagaacaatacccaccactacattcaaacctacaatgactctggt

SEQ ID NO: 226575 - DNA, 75 bp, Artificial Sequence
  Synthetic
tccattgatacaattccttctttgtggcagtcaatgagacaagcctatcattaacacttaaaaatgatgtgccaa

SEQ ID NO: 226576 - DNA, 75 bp, Artificial Sequence
  Synthetic
ttggagctcacactaacaaatgattccatcttacaacacaagttttgcaacctctctgatgcacacaagaaaaac

SEQ ID NO: 226577 - DNA, 75 bp, Artificial Sequence
  Synthetic
gccactctgaatcttcaaagtggccaaccacctctttgtcaacagcatgacacagcaaaattattgaatcaaaca

SEQ ID NO: 226578 - DNA, 75 bp, Artificial Sequence
  Synthetic
ttgtatgatcacactcttatgtcagtggtgacaacttttcacttgagcatccccaacttcaaccagtatgaagcc

SEQ ID NO: 226579 - DNA, 75 bp, Artificial Sequence
  Synthetic
acaacaaagtctttctcctagtgttgagtatgtgaagactcttgattttgttcagcaatgatctccaggctggga

SEQ ID NO: 226580 - DNA, 75 bp, Artificial Sequence
  Synthetic
atggcctgcgacttcgatagtgggaagataactgttcaatacaacctgagtcattcaaccccagttgatgttgca

SEQ ID NO: 226581 - DNA, 75 bp, Artificial Sequence
  Synthetic
cacaactgtgcttgggtcttaactcttcagtatcatcaatgtcagcatagagtaatgttattgtgggagacagag

SEQ ID NO: 226582 - DNA, 75 bp, Artificial Sequence
  Synthetic
aatcattgtggaacacttgcaaatggcattctggacacatttagaaggatgcactgggggccagcacattttccc

SEQ ID NO: 226583 - DNA, 75 bp, Artificial Sequence
  Synthetic
tgaggaactcccctctcaatttctccatactctccgcctctgctccaaaatctgaggggtacatcttacaaaagg

SEQ ID NO: 226584 - DNA, 75 bp, Artificial Sequence
  Synthetic
aatcctccatttgtgataggaggcacttcatgcattcagacaagctacaagtacctcatcattcaaaatacaact

SEQ ID NO: 226585 - DNA, 75 bp, Artificial Sequence
  Synthetic
actttagcagctcagatttgtcgaccctcctaaattgtctgggaattgccccggagctcacaccattcctgaagg

SEQ ID NO: 226586 - DNA, 75 bp, Artificial Sequence
  Synthetic
tgggaggatcactgtcagatgtcaagacctacaccgatgggatacttgtctttgatagcacagagaacaaggcag

SEQ ID NO: 226587 - DNA, 75 bp, Artificial Sequence
  Synthetic
cttggaattcattgattatttctcgtttgacatctatagagctcatagagttgtcaatccccatgtgacacaatt

SEQ ID NO: 226588 - DNA, 75 bp, Artificial Sequence
  Synthetic
ctatacatctctagaaggcttatgggcaccttcacttggactttatccgactcagccgggaatgacttgcctgga

SEQ ID NO: 226589 - DNA, 75 bp, Artificial Sequence
  Synthetic
taagaatttcttcatggtgtgttgtcctgcagtcttgtaggatgttgatactctccaacccagaccttttacctt

SEQ ID NO: 226590 - DNA, 75 bp, Artificial Sequence
  Synthetic
ggctactgcctgcaaagatggatgctgattgaagctgagatgaaatgctttggcaacactgctgtggccaagtgt

SEQ ID NO: 226591 - DNA, 75 bp, Artificial Sequence
  Synthetic
ctacattccttaacgattcacagagtctactatattctgattcttccaacatccttgatgattcttgagcaaatt

SEQ ID NO: 226592 - DNA, 75 bp, Artificial Sequence
  Synthetic
aaccagcaacatgatgaggaattttgtgacatgttaaggctgttcgattttaataaggaagcaatcagtagactg

SEQ ID NO: 226593 - DNA, 75 bp, Artificial Sequence
  Synthetic
gaagtagtgagaataagatggatctgaacttttcgtttgcccactctggcataaaagtgtgatcaaaaactgttc

SEQ ID NO: 226594 - DNA, 75 bp, Artificial Sequence
  Synthetic
agggttgaggttgagagaagcgttaatctcatcaacaaggcggtcaattccctcatcaatgatcaactgataata

SEQ ID NO: 226595 - DNA, 75 bp, Artificial Sequence
  Synthetic
tcccatcaattatggggagcaaagtgacccccacactctgtaaatcctgttttaaagaatttaacttcacagagt

SEQ ID NO: 226596 - DNA, 75 bp, Artificial Sequence
  Synthetic
agaaaccatttgagagatctgatgggtataccatattgcaactattcaaagttctggtacctgaatgataccagg

SEQ ID NO: 226597 - DNA, 75 bp, Artificial Sequence
  Synthetic
cctcattatacttttgctcaaaatttgaaggtgaactcctaacaaagcattctagtaaaaccaatacattcccag

SEQ ID NO: 226598 - DNA, 75 bp, Artificial Sequence
  Synthetic
aatgggaagacatccttgccaaagtgctggaaggtgtcgaacaactcttaccttaatgagacccacttttcgaat

SEQ ID NO: 226599 - DNA, 75 bp, Artificial Sequence
  Synthetic
ttagtttaaaaccgtctggaacaacaaagggcagaccaggacacaatatgcctctattgagtaagatcacctcaa

SEQ ID NO: 226600 - DNA, 75 bp, Artificial Sequence
  Synthetic
gagattgaggaagaagctaacaacatgatcacagagatgcttaggaaggaatatgagaagaggcaaagtacaact

SEQ ID NO: 226601 - DNA, 75 bp, Artificial Sequence
  Synthetic
cactcaattcctctgtgttatgttcacaaccattggcctcacagctgtctaattctatgcatagagaaagcagct

SEQ ID NO: 226602 - DNA, 75 bp, Artificial Sequence
  Synthetic
cctcttggtttggtggacctctttgtgttctcaacttctttctatctaatcagtgtgtttcttcatttgataaaa

SEQ ID NO: 226603 - DNA, 75 bp, Artificial Sequence
  Synthetic
tgaggccctcaatcaataagttttgaggctcagattggatcagaaagttcaacttctgtctggacagcctctgat

SEQ ID NO: 226604 - DNA, 75 bp, Artificial Sequence
  Synthetic
atccccacacatagacacattgttggtaaaggctgccccaaacctcacaggttgaaccacatggcagtttgtagt

SEQ ID NO: 226605 - DNA, 75 bp, Artificial Sequence
  Synthetic
cattggctaagtatttggaaatgaggtcctttgcctcacacacacttgtctccataataaggctcccacaaaaga

SEQ ID NO: 226606 - DNA, 75 bp, Artificial Sequence
  Synthetic
tgtggtgcctatggccagcctggactacccgtgagatggaaaagatgatgacccagagggcccccgtgacccacc

SEQ ID NO: 226607 - DNA, 75 bp, Artificial Sequence
  Synthetic
ttgcctcacacacacttgtctccataataaggctcccacaaaagacaacgtcaaatgcctaggatcctcggggcg

SEQ ID NO: 226608 - DNA, 75 bp, Artificial Sequence
  Synthetic
gccttttggcggtgggtcacgggggcgttctcttacagaacgactttgggtgatgttgttctgaacactaggtcc

SEQ ID NO: 226609 - DNA, 75 bp, Artificial Sequence
  Synthetic
ctggatagtactgctctcaattgtggaagcttcacacctccaactgttgcagcctcatacatcaagcaatccatt

SEQ ID NO: 226610 - DNA, 75 bp, Artificial Sequence
  Synthetic
agggcacagtgtggtgtgatctcctcttttccacccctcttcttcttttcaaccacaataccagtgtgcatctta

SEQ ID NO: 226611 - DNA, 75 bp, Artificial Sequence
  Synthetic
cacaaaggtttgtagtggtcccacacatcgtcctcgaatttcctggcctcagattttgccatcccaacatcaatc

SEQ ID NO: 226612 - DNA, 75 bp, Artificial Sequence
  Synthetic
aactttatgtctctccttccctgagactccaaaagcctttttatgtcgtctgccccttggcaagtaaggaccata

SEQ ID NO: 226613 - DNA, 75 bp, Artificial Sequence
  Synthetic
ttcttaggaaggctttccaacactgcactagtgagtccaggttgaacattgaataggtcctgaatgtctagtcca

SEQ ID NO: 226614 - DNA, 75 bp, Artificial Sequence
  Synthetic
tgagagtgtttagaatcctgcttgaactgcttcaagtctgttggttcacgataaaaatggatgtagtgtccattt

SEQ ID NO: 226615 - DNA, 75 bp, Artificial Sequence
  Synthetic
gcaggttgaacaatagcgatttcaacagggtcctctgcccttccctcgatgtcgatccaggtcttggcatttggg

SEQ ID NO: 226616 - DNA, 75 bp, Artificial Sequence
  Synthetic
tctagttgtaacatggaatccttcaactccatgacttgggaatatgttaatgcagtaggaaagccttgtgcttgt

SEQ ID NO: 226617 - DNA, 75 bp, Artificial Sequence
  Synthetic
gcgagtctggtgccaccaggtgcagtgggtctgctttctggtggactgcccccgtccaaatcaacagtggtgttg

SEQ ID NO: 226618 - DNA, 75 bp, Artificial Sequence
  Synthetic
tcccaagctctccccaaaattgaagttctcgaagcgatgtaaggccaaccatctcctgagaggcatagcttgtat

SEQ ID NO: 226619 - DNA, 75 bp, Artificial Sequence
  Synthetic
aagaggttctcataagggttcctgtcccctggtgcttcagatataaacatgcccagtgacctcttgacctttagc

SEQ ID NO: 226620 - DNA, 75 bp, Artificial Sequence
  Synthetic
acagctttcaaaatgtcttgaatgtttttgggactgactctaatagtttcgagcatatttcccccatccaagaga

SEQ ID NO: 226621 - DNA, 75 bp, Artificial Sequence
  Synthetic
cttgcacctgctttgacagccgcactcagactaaaattgtacccagagatgttaatggcactcttattcacatct

SEQ ID NO: 226622 - DNA, 75 bp, Artificial Sequence
  Synthetic
attaaattaaggacaggatgagtctgagccagcttgtcaagatctgaggtgtttggatattttgctgtgtacacc

SEQ ID NO: 226623 - DNA, 75 bp, Artificial Sequence
  Synthetic
agtcccaaatcagtgagggattggatgacatcgtttaggtcaacctggccctgtttgcacatgcatgcaacagtc

SEQ ID NO: 226624 - DNA, 75 bp, Artificial Sequence
  Synthetic
aagctcggcatggtgccaaactggttgttcagtaattctgaattcctaacatcccatacccttattataccatca

SEQ ID NO: 226625 - DNA, 75 bp, Artificial Sequence
  Synthetic
cctctcaccatcggacctgggttcctctgccccattccaatcatctgaaggagagccttcctctgatctagctgt

SEQ ID NO: 226626 - DNA, 75 bp, Artificial Sequence
  Synthetic
tgagctgttaaattccccatatagataccagctgttagaggtctttctgatctggtgatctttgacttgagcttc

SEQ ID NO: 226627 - DNA, 75 bp, Artificial Sequence
  Synthetic
tcaaggtctgcagctagtgtgaggaggtcatcagatgataatgtcccaacacgcaggacattcttttgttgtgct

SEQ ID NO: 226628 - DNA, 75 bp, Artificial Sequence
  Synthetic
gacttgagctcgacaagattgttgactgcctggttcagatctctgagcctcttgagatctgagtcatccctcttc

SEQ ID NO: 226629 - DNA, 75 bp, Artificial Sequence
  Synthetic
tccttcctcattaacctttgtacattgctgacctctgagaagtccaaaccgtgtaaaagtgcttgtgcatcttta

SEQ ID NO: 226630 - DNA, 75 bp, Artificial Sequence
  Synthetic
atgacttgcacttttacatttgaacaaaatcctgataattcccttctcagggattgggtccacagaaaggacttg

SEQ ID NO: 226631 - DNA, 75 bp, Artificial Sequence
  Synthetic
acttctttagaattgctcatgattttggaaacaccttccaatatgcgcagtctattagcctaggatccactgtgc

SEQ ID NO: 226632 - DNA, 75 bp, Artificial Sequence
  Synthetic
cttctttagaattgctcatgattttggaaacaccttccaatatgcgcagtctattagcctaggatccactgtgcg

SEQ ID NO: 226633 - DNA, 75 bp, Artificial Sequence
  Synthetic
cgcaccggggatcctaggcaattttgatgctcatttgagtgaaatccattaaagtgagtgcccacttcactaccc

SEQ ID NO: 226634 - DNA, 75 bp, Artificial Sequence
  Synthetic
acacccgagggagcctcaagcagaacccatctgcaaaacttcccccactattcacaatggggaaagcccagtcca

SEQ ID NO: 226635 - DNA, 75 bp, Artificial Sequence
  Synthetic
aacaaaaccacacatcccaagtccccgagcccaggacggcgttgatacctgacgcctcaggctgtgggcccgagt

SEQ ID NO: 226636 - DNA, 75 bp, Artificial Sequence
  Synthetic
tctgcaaaagttgttggtttgagagaaggggccttgtcaagtgttatgaccattatttgtgcatgaattgtctga

SEQ ID NO: 226637 - DNA, 75 bp, Artificial Sequence
  Synthetic
cactgcttcttacaatctccgatagatgccccatctgcaagtatcccttgccaacaaaactgcagatcaacaaaa

SEQ ID NO: 226638 - DNA, 75 bp, Artificial Sequence
  Synthetic
caccaaccgctcccaaagagtcggccagagatcccccgccgtacagtccctgaacccacccagccacaaaccctc

SEQ ID NO: 226639 - DNA, 75 bp, Artificial Sequence
  Synthetic
acccaccccaagctcccccccgggggggccccccgccggggtccccccccgggggagaacagccgatcccactga

SEQ ID NO: 226640 - DNA, 75 bp, Artificial Sequence
  Synthetic
ctagggctagtcaatatcctgcacctccttgaccacctcgaacagtttgtcacactgtctccccttcaatctgta

SEQ ID NO: 226641 - DNA, 75 bp, Artificial Sequence
  Synthetic
ctttccttgcgaactgtgcaccattatgtcatccaaagttttactaaaacacaaattgtaaccattaaaacccaa

SEQ ID NO: 226642 - DNA, 75 bp, Artificial Sequence
  Synthetic
ccattcacacagatcccgtagagcttctttaagatacaccttataatcattgggcttgcacttcttgacaacccc

SEQ ID NO: 226643 - DNA, 75 bp, Artificial Sequence
  Synthetic
aaccaggtccagttctaaccagtgcagaccctgatcaagcctctgtctcaaaatattcccaattactgtgggggg

SEQ ID NO: 226644 - DNA, 75 bp, Artificial Sequence
  Synthetic
tgactcaacacaactttcatccatttctgaaatcaacacctccatgtcttgatcgagaatactcgggtttattgg

SEQ ID NO: 226645 - DNA, 75 bp, Artificial Sequence
  Synthetic
caaaaccttcctcttgccttcaaccaagtagccgtcctccacaaccagaggcacaggctcaggatctggtcctat

SEQ ID NO: 226646 - DNA, 75 bp, Artificial Sequence
  Synthetic
atgcacaaaatcatactcggtgagatttgttacattctcacttaattcaacattgagcctaacaacttgcccaat

SEQ ID NO: 226647 - DNA, 75 bp, Artificial Sequence
  Synthetic
tgatttgggatcttcaagaaattctgacaggttgtccgcatctactatccacacaggctttagcttgcaaaattg

SEQ ID NO: 226648 - DNA, 75 bp, Artificial Sequence
  Synthetic
atcactgtttaataccaacctccaacaatccaataacagagacctatgcacttgaccactgtagagtacttccaa

SEQ ID NO: 226649 - DNA, 75 bp, Artificial Sequence
  Synthetic
tctatttaacacaaaggaacctgtgtggtttatcatgccccaggtttcgacatgaaacgcaaattcctcacttaa

SEQ ID NO: 226650 - DNA, 75 bp, Artificial Sequence
  Synthetic
agtctcccctttactcttaatcgtaaagacaactgaaaatgtgagctgtatggatcctctcggcaatggttggag

SEQ ID NO: 226651 - DNA, 75 bp, Artificial Sequence
  Synthetic
agcctcccagaattcatcgaaggaagcaaactgctgattatgaatgaagccagaagctataagctggtttaggtt

SEQ ID NO: 226652 - DNA, 75 bp, Artificial Sequence
  Synthetic
tagataagctggtttaaccaccatgtccatccatgaaaaccccatgtataggtctgatttaaacattggcctttc

SEQ ID NO: 226653 - DNA, 75 bp, Artificial Sequence
  Synthetic
aacacctttataaatcaccttttccacaaaagatgcaaatggaccaagaaggctcagtccctcagaagcagggag

SEQ ID NO: 226654 - DNA, 75 bp, Artificial Sequence
  Synthetic
cgatgtcttatgagggaaccaggtgaatgatcctaatgttctactagttgcaacaaagggcctgatgaaggactc

SEQ ID NO: 226655 - DNA, 75 bp, Artificial Sequence
  Synthetic
gaaaaagatttgtcttaagaagttctttgcaacatcttcagtgctaaccaccctctcttccgtcaaagacatatg

SEQ ID NO: 226656 - DNA, 75 bp, Artificial Sequence
  Synthetic
agatcgatcgtgagcttctgacaactctgatgacagaacaacgtagtgctcctctcttttccacttgacaacatg

SEQ ID NO: 226657 - DNA, 75 bp, Artificial Sequence
  Synthetic
gctaatgagagacattgcttcacaattgacatctagaacaacacataagtcaaggaatttcactctgggagacca

SEQ ID NO: 226658 - DNA, 75 bp, Artificial Sequence
  Synthetic
tttcatttttgttgaggctaaatcactcatgaaaggtaacaaatgcttttcaaatagtgacgggtagagtcttct

SEQ ID NO: 226659 - DNA, 75 bp, Artificial Sequence
  Synthetic
aaatgaatgtatgatgtggttaaacccaactttatcctctagtaactttgtgattgtgggcttcaaggggaagta

SEQ ID NO: 226660 - DNA, 75 bp, Artificial Sequence
  Synthetic
atcacaaggtttgaagcttattgcagggacttttgcctttagctttggctcacccagaacccaaggcccaatctc

SEQ ID NO: 226661 - DNA, 75 bp, Artificial Sequence
  Synthetic
caatgcacaagagagagcaatgcacatgtaatcccacaacactggtctgagaaattttataagccagtcatttga

SEQ ID NO: 226662 - DNA, 75 bp, Artificial Sequence
  Synthetic
acatctttgatggatagggacagaccacagattcataccctttaaaataaatcccttcacatcaactcgcccttc

SEQ ID NO: 226663 - DNA, 75 bp, Artificial Sequence
  Synthetic
taattggctcacaattgatttaatgtagtagttgaacttatcaggacctctcacacatttgctccctaatgtcct

SEQ ID NO: 226664 - DNA, 75 bp, Artificial Sequence
  Synthetic
gcataacccaacaaaccctgaagcaatgctactctgaaatgcactcttgtttattgcctcagataggagcttttg

SEQ ID NO: 226665 - DNA, 75 bp, Artificial Sequence
  Synthetic
tgcccccctagtaaaattagaagagagcttattttgaagggttttgactaaggttggtaatttttcttcctcaag

SEQ ID NO: 226666 - DNA, 75 bp, Artificial Sequence
  Synthetic
attcaaggcacctgtgtaaacaactttctgccttagtaccattctcaaagggaagtgggcagaaaggttcagcca

SEQ ID NO: 226667 - DNA, 75 bp, Artificial Sequence
  Synthetic
acatagacttaactctgactcttctaaggggtctacatccagcaatgaacaaatcctctgcaacgactcactagg

SEQ ID NO: 226668 - DNA, 75 bp, Artificial Sequence
  Synthetic
gtctccagacaaataagcagctgtgaattcttcatgtaactcaccggtcttaagtttattataaagtcttctaag

SEQ ID NO: 226669 - DNA, 75 bp, Artificial Sequence
  Synthetic
aaagtatctaattttctttgtcccatctgggcaaatctgctctatgttcctcatgattctataacccctattacc

SEQ ID NO: 226670 - DNA, 75 bp, Artificial Sequence
  Synthetic
atcaacccaatcctttacatcggagtcacaatgcatcaagaatgggtcaatcgggtattgtgcatacctaagaag

SEQ ID NO: 226671 - DNA, 75 bp, Artificial Sequence
  Synthetic
atctaaagtcctttcctggattagattgcagagcttcacaggtaccccatttgcaacagactgatcaatgattgt

SEQ ID NO: 226672 - DNA, 75 bp, Artificial Sequence
  Synthetic
gtcaatagtctctgccaactggtgcggttccttacacttaacattgtgtaaagctgctgcaacaaactttgtcaa

SEQ ID NO: 226673 - DNA, 75 bp, Artificial Sequence
  Synthetic
tagtgggacttcatcaccccatacataaaaccttgacttgaattcagcaacaaaccgccctattacactttttgg

SEQ ID NO: 226674 - DNA, 75 bp, Artificial Sequence
  Synthetic
actaataaatttgttcaacctgtcactcaggtaattatgaaattccaaaatgtattcaaactcatcaggatctct

SEQ ID NO: 226675 - DNA, 75 bp, Artificial Sequence
  Synthetic
gtctaacagattagttaacttatgatcaaataaagagatctggtcatcactggaagtatatgaattaagagtccc

SEQ ID NO: 226676 - DNA, 75 bp, Artificial Sequence
  Synthetic
ttcgtagagtaaaccaatagagtagttaatgaatttttcagtgatcagtccatagaagtcggaggcattatgaag

SEQ ID NO: 226677 - DNA, 75 bp, Artificial Sequence
  Synthetic
gatcccttgccccatatctaagattgagctgatatgagagggcactaccccaagcttgaagtgtctaaaaaagaa

SEQ ID NO: 226678 - DNA, 75 bp, Artificial Sequence
  Synthetic
ggcttcagttagtgtttcatgtaatgatttcttcagccctaagtttgtcttcagataagatctcatcatggcgtt

SEQ ID NO: 226679 - DNA, 75 bp, Artificial Sequence
  Synthetic
gacaactggatgagggacttctatcaatttgtgtatgtgccaggaaagcagtgtgctcacataatctctactctt

SEQ ID NO: 226680 - DNA, 75 bp, Artificial Sequence
  Synthetic
cacgtcctctaatatatctgaagaattccagtgaatattttgtaagaccacaaggaacaataaggggttcatcat

SEQ ID NO: 226681 - DNA, 75 bp, Artificial Sequence
  Synthetic
aggtccccatttgctatgatctagactgtagcaaacttgagccaatgatacattaagcttcattgataatacagc

SEQ ID NO: 226682 - DNA, 75 bp, Artificial Sequence
  Synthetic
attctcaaactctgactcattattcaggcagctgcctctaaattgacctgttaaagactcaaaataatcttcaat

SEQ ID NO: 226683 - DNA, 75 bp, Artificial Sequence
  Synthetic
caaccttgtgaacattttggttcttaaatcaccaatgtatagttctctatttccaccaacttgttccttataaga

SEQ ID NO: 226684 - DNA, 75 bp, Artificial Sequence
  Synthetic
taaagaaaatttcagtcttcctgtgtctggaccaatggatgtgtatgattgtggggattcttggctataaaaaca

SEQ ID NO: 226685 - DNA, 75 bp, Artificial Sequence
  Synthetic
tagattctttaaaactgcagttgtacaattggtaagagaaagtgccttgcttaaagcttcagaattactctctct

SEQ ID NO: 226686 - DNA, 75 bp, Artificial Sequence
  Synthetic
atcactcaatctgcaatcttctattagtctctctctatttaacttgaagtttatacattttgatttataatgact

SEQ ID NO: 226687 - DNA, 75 bp, Artificial Sequence
  Synthetic
gtatttccccacaagtctattggcattcatctgcagcaagatggacttgaaacacaggaaatattctgcattttc

SEQ ID NO: 226688 - DNA, 75 bp, Artificial Sequence
  Synthetic
ataggttctggttgtcactgccctggtgatctctgagatagcacatgagtccattggtcccgagtaaaaatactt

SEQ ID NO: 226689 - DNA, 75 bp, Artificial Sequence
  Synthetic
acttttcaactcatcatttaaatggaccttctcacaaattgctctgtaatcatcgtcagacatcaatgattggtc

SEQ ID NO: 226690 - DNA, 75 bp, Artificial Sequence
  Synthetic
aaagtcttctatcaaatggttggacaattctgataaaatcaactttaagtgcattgggttatcaacaaccttgtg

SEQ ID NO: 226691 - DNA, 75 bp, Artificial Sequence
  Synthetic
taggtcatttatgtcaccagcgtttaccctatcaagtttctcatcacttgggtttttataaccctccatcacagt

SEQ ID NO: 226692 - DNA, 75 bp, Artificial Sequence
  Synthetic
cctaactgattctttaatgtcctcaaggtgggaagaagcagcaccactaaccaacacctcatccaattcctcagt

SEQ ID NO: 226693 - DNA, 75 bp, Artificial Sequence
  Synthetic
aagcgtctctccaccagaagtcttcacattgccaattactagacttgcaatcactttcataattttgtagtcata

SEQ ID NO: 226694 - DNA, 75 bp, Artificial Sequence
  Synthetic
ctcttctttacttaaaaagtatttacttttcctctcaaatgtctccgataattgacacactgcggcagcaacaag

SEQ ID NO: 226695 - DNA, 75 bp, Artificial Sequence
  Synthetic
tttatcataatcataatttagcaccctctcaccatcaacatacttatttataactacacttttattgctagctag

SEQ ID NO: 226696 - DNA, 75 bp, Artificial Sequence
  Synthetic
gtccattgcagttgcacaaccactaaggactaaaggatctttaatttcacctttgaattcttgtttattaaaaag

SEQ ID NO: 226697 - DNA, 75 bp, Artificial Sequence
  Synthetic
agtgccattgttgaatgatgatgtgactaaggatagtatttttctggaaacacccggcctcttaaattggacgac

SEQ ID NO: 226698 - DNA, 75 bp, Artificial Sequence
  Synthetic
acccatgtcagcacatgatgttttgcccaaaaaggtggcaccactcatcaataagctggataactcagtggactc

SEQ ID NO: 226699 - DNA, 75 bp, Artificial Sequence
  Synthetic
tgcaggctcaagggggtttacattgacggaatcaaattctaattttggctctaagtatttttcaaagcacttaat

SEQ ID NO: 226700 - DNA, 75 bp, Artificial Sequence
  Synthetic
ttgatctgtgagtctgtccggtgtctcttttgtaatgaagtgacaaatgtaggagacattgaggataaatttaaa

SEQ ID NO: 226701 - DNA, 75 bp, Artificial Sequence
  Synthetic
cctattcgtcaacattgtattaattgtagggtcgagaaccttgcaaattagtgctctcagaactctaaaaaggaa

SEQ ID NO: 226702 - DNA, 75 bp, Artificial Sequence
  Synthetic
aaactcaacttttgttattaatttttcctccagcttacttaagagatccttgtggtaatattcagaaacgtatgc

SEQ ID NO: 226703 - DNA, 75 bp, Artificial Sequence
  Synthetic
cataacaaagtacctcaggttttggagaaacttttgagatcttttgcttggatgggttaaaatcagtataaagat

SEQ ID NO: 226704 - DNA, 75 bp, Artificial Sequence
  Synthetic
catttttagcagtgcctcaatgtccctcaggtcctgccttaattctaaacaatccctcaaccagctcaccatcac

SEQ ID NO: 226705 - DNA, 75 bp, Artificial Sequence
  Synthetic
tttgatggtctcagatatgactgattgcgagaagatagctggaaagaacctcttaggatcagcataaaaggaaca

SEQ ID NO: 226706 - DNA, 75 bp, Artificial Sequence
  Synthetic
gatctcacctttccgagaattattgattgcataacactttgagcattcccctgttttctggtacaacagtctaaa

SEQ ID NO: 226707 - DNA, 75 bp, Artificial Sequence
  Synthetic
tctggacccagccatatagaactcttgacagtaagcttccttacagtacaccttcttaaaccttccggtgccttt

SEQ ID NO: 226708 - DNA, 75 bp, Artificial Sequence
  Synthetic
ctcattttgtcttaattttacaacagaggatgtcttcattgagtttacaattgccaatgaaatacttgagagccg

SEQ ID NO: 226709 - DNA, 75 bp, Artificial Sequence
  Synthetic
tttcagatcatcctcactctccaatgctgggctcaacttatacggaaaatcactaaggtcattcttttcgtagtt

SEQ ID NO: 226710 - DNA, 75 bp, Artificial Sequence
  Synthetic
gatggatggcatgacacctttcacttcaacccccattatctttttaaaacttgaagttgaaagtatgttttctaa

SEQ ID NO: 226711 - DNA, 75 bp, Artificial Sequence
  Synthetic
cacgccaaaatcagaaaatttcaagttaacaactgctaatgcctgttctgctttccttagagtggaactaacaag

SEQ ID NO: 226712 - DNA, 75 bp, Artificial Sequence
  Synthetic
gttatagtacaccagttcctgatgctcatagcttgaacctagcttccttgcttgatttgtccttcttctttccat

SEQ ID NO: 226713 - DNA, 75 bp, Artificial Sequence
  Synthetic
ccattgatataactccttctttgtggcagttagtgagacaagcctgtcatttacactcagaaatgaggaaccaag

SEQ ID NO: 226714 - DNA, 75 bp, Artificial Sequence
  Synthetic
ccactctgagtcttcaaagtggccaatcacctcctcatcgatagcatgacacagcaaaattattgagtcaaacaa

SEQ ID NO: 226715 - DNA, 75 bp, Artificial Sequence
  Synthetic
caagagagtctttctcctagtattgagtatgtgaagacttttgatcttgttcagcaatgacctccaggctgggac

SEQ ID NO: 226716 - DNA, 75 bp, Artificial Sequence
  Synthetic
acaactatgcttgggtctcaactcttcagtatcatcaatgtcagcatagagcaatgttattgtgggagataaagt

SEQ ID NO: 226717 - DNA, 75 bp, Artificial Sequence
  Synthetic
gagaaactctcctctcaatctctccacagtctccacctccactccaaaatctgaagggtacatcttacaaaagga

SEQ ID NO: 226718 - DNA, 75 bp, Artificial Sequence
  Synthetic
ctctaatagctcagacttctcaaccctcctaaactgtctggggattgccccagagctcacaccattcctgaaggc

SEQ ID NO: 226719 - DNA, 75 bp, Artificial Sequence
  Synthetic
ttggaactcattgataatttctcgtttgacatctatggagctcatggagttgtcaatccccatgtggcataactt

SEQ ID NO: 226720 - DNA, 75 bp, Artificial Sequence
  Synthetic
gagaatttcttcatggtgtgttgccctacaatcttgtaggatgttgatactctccaacccagaccttttaccttc

SEQ ID NO: 226721 - DNA, 75 bp, Artificial Sequence
  Synthetic
tacatttctcaatgattcacagagtctactatactctgattcttccaacatccttgatgattcttgagcaaattg

SEQ ID NO: 226722 - DNA, 75 bp, Artificial Sequence
  Synthetic
gagaagtgaaaataaaatggatctgaatttctcgtttgcccactctggcataaaagtgtggtcaaaaactgtcct

SEQ ID NO: 226723 - DNA, 75 bp, Artificial Sequence
  Synthetic
cccatcaattataggaagcaatgtaacccccacactctgtaaatcttgttttaaagaattcaacttcacagagtc

SEQ ID NO: 226724 - DNA, 75 bp, Artificial Sequence
  Synthetic
ctcattatacttttgctcaaaatttgaaggtgagctcctaacaaaacattctagtaataccaatacatttccagt

SEQ ID NO: 226725 - DNA, 75 bp, Artificial Sequence
  Synthetic
cagtttaaaaccatctggaacaacaaagggtaaaccaggactcagtatacctctgttgagtaagatcacctcaac

SEQ ID NO: 226726 - DNA, 75 bp, Artificial Sequence
  Synthetic
actcaattcctctgtgttgtgttcacaaccattagcctcacaactatctaattctatgcatagagaaagcaactt

SEQ ID NO: 226727 - DNA, 75 bp, Artificial Sequence
  Synthetic
aaggccctcaatcaataagttttgaggctcagattggatcaaaaagttcaacttttgtctggataatctctgatc

SEQ ID NO: 226728 - DNA, 75 bp, Artificial Sequence
  Synthetic
gttagctaagtatttggaaaccaagtcttttgcctcacatatacttgtctccataataaggctttcacaaaagac

SEQ ID NO: 226729 - DNA, 75 bp, Artificial Sequence
  Synthetic
ttgcctcacatatacttgtctccataataaggctttcacaaaagacaacgtcaaatgcctaggatcctcggtgcg

SEQ ID NO: 226730 - DNA, 75 bp, Artificial Sequence
  Synthetic
ggggatcctaggcattttgggcgcgctttacaagtcactcatttaataggtgaggtgccaactaagatggggcaa

SEQ ID NO: 226731 - DNA, 75 bp, Artificial Sequence
  Synthetic
ataatcaccttctttcaagaggtgccacacatagtggaggaagtgatgaacatagtcctcatcactctatccctt

SEQ ID NO: 226732 - DNA, 75 bp, Artificial Sequence
  Synthetic
cttgcgatcctcaaaggaatatacaacctggcgacatgtggattgctgggcttgatttcattcctatttctgtgt

SEQ ID NO: 226733 - DNA, 75 bp, Artificial Sequence
  Synthetic
gggaggtcctgcacattggtatacaaggacaactatgctttgaatagtgtggaactcgatatgtccactctgaat

SEQ ID NO: 226734 - DNA, 75 bp, Artificial Sequence
  Synthetic
ttcacaatgccgctgtcttgttccaagaacaatacccaccattacattcagacctacaatgattctggtttggag

SEQ ID NO: 226735 - DNA, 75 bp, Artificial Sequence
  Synthetic
ctcacactgacaaacatgtctattttaaatcacaagttctgcaacctctctgatgcacacagaaaaaacctgtat

SEQ ID NO: 226736 - DNA, 75 bp, Artificial Sequence
  Synthetic
gaccacaccctaatgtccgtggtgacaacctttcacttgagtatccccaatttcaaccagtatgaatccatggct

SEQ ID NO: 226737 - DNA, 75 bp, Artificial Sequence
  Synthetic
tgtgactttgacggcgggaagataactgttcaatacaacttaagtcattcaacaccagtagaggcagcaaaccac

SEQ ID NO: 226738 - DNA, 75 bp, Artificial Sequence
  Synthetic
tgtggcacagttgcgaatggtgtcctagacacattcaggagaatgcactggggaccagctcactttcccaaccct

SEQ ID NO: 226739 - DNA, 75 bp, Artificial Sequence
  Synthetic
ccttttacaattggagggacttcgtgcattcagacaagttatcagtacctcattattcaaaacacaacatgggaa

SEQ ID NO: 226740 - DNA, 75 bp, Artificial Sequence
  Synthetic
gatcactgccaaatgtcaagacccacacccatgggctacttatccctaatagcacagaggacaaggcagttgtac

SEQ ID NO: 226741 - DNA, 75 bp, Artificial Sequence
  Synthetic
atctccagaagacttatgggaacctttacatggactttgtccgactctagtgggaatgatctacctggtggctat

SEQ ID NO: 226742 - DNA, 75 bp, Artificial Sequence
  Synthetic
tgcttacagaggtggatgctgattgaggctgagatgaaatgttttggcaataccgctgtagctaagtgcaaccaa

SEQ ID NO: 226743 - DNA, 75 bp, Artificial Sequence
  Synthetic
caacatgatgaagagttttgtgatatgctgagattgtttgatttcaacaaggaagcaatcaaaagactgaaaact

SEQ ID NO: 226744 - DNA, 75 bp, Artificial Sequence
  Synthetic
gaggctgagaagagcattaacctcatcaacaaagcagttaattctctcatcaatgaccaactgataataaggaac

SEQ ID NO: 226745 - DNA, 75 bp, Artificial Sequence
  Synthetic
catctaagggatctgatgggtataccttactgcaactattcaaaattctggtatctaaatgacacaaggaatggg

SEQ ID NO: 226746 - DNA, 75 bp, Artificial Sequence
  Synthetic
aagacatccctgccaaaatgctggaaagtgtcgaacaactcttacctcaatgagacccacttttcgaatgaaatt

SEQ ID NO: 226747 - DNA, 75 bp, Artificial Sequence
  Synthetic
gaggaggaggccaacaacatgataacagaaatgctcagaaaggagtacgagaagagacaaagcacaactcctctt

SEQ ID NO: 226748 - DNA, 75 bp, Artificial Sequence
  Synthetic
ggcttagtggacctctttgtgttctcaactagtttctatctgatcactgtgtttcttcacttaatgaaaatccca

SEQ ID NO: 226749 - DNA, 75 bp, Artificial Sequence
  Synthetic
acacacagacacattgttggcaaaggctgccctaaacctcacagattgaaccacaaggcggtttgcagctgtggt

SEQ ID NO: 226750 - DNA, 75 bp, Artificial Sequence
  Synthetic
gcttttggccaacccggactgcctgtgagatggaagagatagggacccaaaaggggcccccgtgacccaccgcct

SEQ ID NO: 226751 - DNA, 75 bp, Artificial Sequence
  Synthetic
tgtggcggtgggtcacgggggcgtcctcttacaagacgactctcggtgatgctgttctgaacactagatctttgg

SEQ ID NO: 226752 - DNA, 75 bp, Artificial Sequence
  Synthetic
gaagcacggcccttagttgtggaagattcacgtgcccaactgttgcagcctcatacatcaagcaatccattaggg

SEQ ID NO: 226753 - DNA, 75 bp, Artificial Sequence
  Synthetic
cacaatgtggagtgatctcctctttcccgcctctcttcttcttctcaactacaatgccagtatgcatcttacaca

SEQ ID NO: 226754 - DNA, 75 bp, Artificial Sequence
  Synthetic
ggggtttgtagcggtcccagatttcgtcctcaaatttcctggcttcaggctttgccatcccaacatcaatcaact

SEQ ID NO: 226755 - DNA, 75 bp, Artificial Sequence
  Synthetic
tgatgtcccttcttccctgggactccatgagcttcctgatgtcatctgccccttgacaggtgagaaccatgttct

SEQ ID NO: 226756 - DNA, 75 bp, Artificial Sequence
  Synthetic
taggtagactctctaatacagcactagtgagtccaggctgaacattaaacaggtcttgaatgtccaacccatgag

SEQ ID NO: 226757 - DNA, 75 bp, Artificial Sequence
  Synthetic
aatgtttggaatcctgcttaaactgctttaaatctgtcggttcgcgatagaaatggatgtaatgtccatttgcag

SEQ ID NO: 226758 - DNA, 75 bp, Artificial Sequence
  Synthetic
gctgaacaatggctatctcaacagggtcctcagccctcccctcaatgtcaatccaggtcttagcatttgggtcta

SEQ ID NO: 226759 - DNA, 75 bp, Artificial Sequence
  Synthetic
attgtaacaaggaatcctttagttccatgacttgagagtaggtcaatgtggtgggaaagccctgcgcctgtgcta

SEQ ID NO: 226760 - DNA, 75 bp, Artificial Sequence
  Synthetic
gtctggtgccaccaggcataacaggtttgctttctggtgggctgttccctcccaggtcgacagttgtattgtccc

SEQ ID NO: 226761 - DNA, 75 bp, Artificial Sequence
  Synthetic
aggccctccccaggatggaggttcttgaggcgatgtagggccaaccatcacctgaaaggcacaacttgtacaaga

SEQ ID NO: 226762 - DNA, 75 bp, Artificial Sequence
  Synthetic
gattctcatatgggttcctgtctcctggtgtttcagatatgaacattcccaatgaccttttaaccttcaatatgg

SEQ ID NO: 226763 - DNA, 75 bp, Artificial Sequence
  Synthetic
ctttcagaatgtcttggatgtttttgggactgactctgatagtctcaagcatgttccccccatccagcaaacttg

SEQ ID NO: 226764 - DNA, 75 bp, Artificial Sequence
  Synthetic
cacctgctttaacagctgcactcaggctgaagttgtacccagagatattaatggcactcttgttcacatctatta

SEQ ID NO: 226765 - DNA, 75 bp, Artificial Sequence
  Synthetic
aattgagaatgggatgagtttgagctaacttgtcaagatctgatgtatttggatattttgctgtatacaccagcc

SEQ ID NO: 226766 - DNA, 75 bp, Artificial Sequence
  Synthetic
ccaaatcactaagagattgaatgacatcgttcaggtcaacctgaccttgtttgcacatgcatgcaacagttaggc

SEQ ID NO: 226767 - DNA, 75 bp, Artificial Sequence
  Synthetic
ttggcatggttccaaactgattgttgagtagttccgggtttcttacatcccatactctcactataccatcacctc

SEQ ID NO: 226768 - DNA, 75 bp, Artificial Sequence
  Synthetic
tcaccattggatttaagtttctctgccccatgccaatcatctggaggagagctttcctttggtccagctgttgag

SEQ ID NO: 226769 - DNA, 75 bp, Artificial Sequence
  Synthetic
ctgtcagattccccatgtaaacaccagctgttaaaggtctttctgatctagtgatctttgatttgagtttctcaa

SEQ ID NO: 226770 - DNA, 75 bp, Artificial Sequence
  Synthetic
gatctgcggccagtatcagaaggtcatctgatgataatgtccccacacgtaacacattcttctgttgtgaagatt

SEQ ID NO: 226771 - DNA, 75 bp, Artificial Sequence
  Synthetic
taagttcaacaagattgttgactgcttgatttaagtctctcagtcttttgagatctgagtcatctcttttttcct

SEQ ID NO: 226772 - DNA, 75 bp, Artificial Sequence
  Synthetic
ttctcatcagcctttggacattactaacctctgaaaagtctaagccatgtaaaagtgcctgtgcatctttgatga

SEQ ID NO: 226773 - DNA, 75 bp, Artificial Sequence
  Synthetic
cctgcactttgacatttgaacaaaaccctgacaattcccttctaagggactgggtccataagaaggacttgactt

SEQ ID NO: 226774 - DNA, 75 bp, Artificial Sequence
  Synthetic
tgacttctttggaattgctcatgtttggaaaggttttccaatatgcgcaatcaaatagcctaggatccactgtgc

SEQ ID NO: 226775 - DNA, 75 bp, Artificial Sequence
  Synthetic
gggatcctaggcaagtttgaaactcttttgagtgaaatctagtcaaccgggcgcccacctcacagtccacaatcc

SEQ ID NO: 226776 - DNA, 75 bp, Artificial Sequence
  Synthetic
aaagagaccccagacagaacctgcccgagggacaccccccgccacccacaatgggcaaatcccagtctaaacaaa

SEQ ID NO: 226777 - DNA, 75 bp, Artificial Sequence
  Synthetic
accatgcggccccaaaccccaagcccaggacggagctgattcccgacgcttcgggccatggacctgaattctgca

SEQ ID NO: 226778 - DNA, 75 bp, Artificial Sequence
  Synthetic
agagctgctggcttgagagaagaggtcttgtcagatgttatgatcattatctatgtttgaactgtctaacacttc

SEQ ID NO: 226779 - DNA, 75 bp, Artificial Sequence
  Synthetic
ttctcacaatatccgacaggtgtcccatttgcaagtaccctctaccaacagaactgcaaatcaacacaacaccaa

SEQ ID NO: 226780 - DNA, 75 bp, Artificial Sequence
  Synthetic
ccgcccccaaagaaccggcccgaaaccctccaccatacagtccctagatccacccaaacacagaccctcacccac

SEQ ID NO: 226781 - DNA, 75 bp, Artificial Sequence
  Synthetic
cccaagctcccccccgggggggccccccgccggggtcccccccgggggaaggagcgctgagtccactggagcacc

SEQ ID NO: 226782 - DNA, 75 bp, Artificial Sequence
  Synthetic
actggggtcagtcaatgtcctgcacttcctcaatctcctcgaacaacttgtcacactgcttccctttcaacctgt

SEQ ID NO: 226783 - DNA, 75 bp, Artificial Sequence
  Synthetic
atttcccttgtgaactgtacaccattatgttactcaaggtcttgctaaagcacaggttgtaacccttgaaaccca

SEQ ID NO: 226784 - DNA, 75 bp, Artificial Sequence
  Synthetic
accattcacacacatcctgcagagtttctttaaggaatgctttataatcattaggtctgcactttttgacaacac

SEQ ID NO: 226785 - DNA, 75 bp, Artificial Sequence
  Synthetic
caaccaagtccagctccaaccagtgtagaccctggtctagcctttgtctcaagatgttgccaatcactgtaggag

SEQ ID NO: 226786 - DNA, 75 bp, Artificial Sequence
  Synthetic
gtgagccaacacaactctcatccatttccgaaatcaacacctccatgtcctggtcaaggatgctcggatttatcg

SEQ ID NO: 226787 - DNA, 75 bp, Artificial Sequence
  Synthetic
gtatgactctcttcctgccctcaaccaaataaccattctccactaccagaggcacaggctcaggttctggtccta

SEQ ID NO: 226788 - DNA, 75 bp, Artificial Sequence
  Synthetic
tatgcacaaagtcatattcagtgaggtctacaatatcctcgctcaattcaacattgagcctcacaacttgcccta

SEQ ID NO: 226789 - DNA, 75 bp, Artificial Sequence
  Synthetic
ttgatttgggatcctcaagaagctctgatagattatccgtatccactgtccacacaggctttagtttgcaaaaat

SEQ ID NO: 226790 - DNA, 75 bp, Artificial Sequence
  Synthetic
ggtcactattcaacaccaacctccagcaatccagtaatagagatctgtgcacttggccactatagagcacctcca

SEQ ID NO: 226791 - DNA, 75 bp, Artificial Sequence
  Synthetic
acctgcatggcacaaaggaaccagtgtgactcactatgccccaagtttcaacatgaaatgcaaattcttcactca

SEQ ID NO: 226792 - DNA, 75 bp, Artificial Sequence
  Synthetic
atgtttcccctttacttttaattgtgaagtaaactgaaaaggtaagttgaacggaaccactcggcagtgattgaa

SEQ ID NO: 226793 - DNA, 75 bp, Artificial Sequence
  Synthetic
gatcctcccagaattcatccaaggatgcaaaccgctgatcacaattgaagccagaagcaataagctgattcaggt

SEQ ID NO: 226794 - DNA, 75 bp, Artificial Sequence
  Synthetic
tcaaatgagctggttttactaccatatccatccatgagaatcccatgtagaggtccgacttaaacattggtcttt

SEQ ID NO: 226795 - DNA, 75 bp, Artificial Sequence
  Synthetic
caacacccttgtaaatcaccttctccacaaaagatgcaaatgggccgagaaggcttagtccctcagaagcaggga

SEQ ID NO: 226796 - DNA, 75 bp, Artificial Sequence
  Synthetic
gtgacgtcctgtgaggaaaccaggtaaaagatcctaatgttctgcttgtcgcaacaaagggtctaatgaaggact

SEQ ID NO: 226797 - DNA, 75 bp, Artificial Sequence
  Synthetic
caaaaaagacttgccttaagaaattctttgccacatcttcggtactaaccaccctttcttccaccaaagatacat

SEQ ID NO: 226798 - DNA, 75 bp, Artificial Sequence
  Synthetic
gagatcgatcatgagcttctgacaactctgatgatagaacaatgtaatgctcctctcgcttccacttgaccacat

SEQ ID NO: 226799 - DNA, 75 bp, Artificial Sequence
  Synthetic
ggctaatgagggacattgcttcacaattgacgtccaagacaacacacaggtcaagaaatttcactcttggggacc

SEQ ID NO: 226800 - DNA, 75 bp, Artificial Sequence
  Synthetic
acttcatttttgtggaagccaaatcactcataaaaggcaacaagtgcctttcaaatagtgacgggtaaagtcttc

SEQ ID NO: 226801 - DNA, 75 bp, Artificial Sequence
  Synthetic
tgaatgagtgtataatgtggttgaaccccactttatcctccagtaactttgtgattgtgggtttcaagggaaagt

SEQ ID NO: 226802 - DNA, 75 bp, Artificial Sequence
  Synthetic
aatcacaaggcttaaaatttattgcagggacctttgcttttagttttggctcacctaagacccaaggcccaatct

SEQ ID NO: 226803 - DNA, 75 bp, Artificial Sequence
  Synthetic
ctaatgcacaagagagagcaatgcacatgtaatcccacaatacaggtctgaggaacttgattagccagtcatttg

SEQ ID NO: 226804 - DNA, 75 bp, Artificial Sequence
  Synthetic
aacatctctgattggcaggaagaaaccatagattcatacccttctgaacaaatcccttcacatcagctcgccctt

SEQ ID NO: 226805 - DNA, 75 bp, Artificial Sequence
  Synthetic
caagttggcccacaagcgacttaatataataattgaacttatcaggacctcttacacatttgctacccaatgtcc

SEQ ID NO: 226806 - DNA, 75 bp, Artificial Sequence
  Synthetic
tgcacagcccaacaaaccctgaagcgatgctgctttggaatgcactcttatttattgcctcagacaggagttttt

SEQ ID NO: 226807 - DNA, 75 bp, Artificial Sequence
  Synthetic
gtgctcctctagtaaaattagaagagagcttattttgaagtgttttaactaatgttggcactttttcttcctcaa

SEQ ID NO: 226808 - DNA, 75 bp, Artificial Sequence
  Synthetic
gactcaaggcacctgtataaataactttctgtcttagcaccattcttaaggggaagtaagctgagaggtttaacc

SEQ ID NO: 226809 - DNA, 75 bp, Artificial Sequence
  Synthetic
aacacaaacctgattctgactcttccaaggggtccacatcaagcagtgagcaaattctctgcagcgactcagtag

SEQ ID NO: 226810 - DNA, 75 bp, Artificial Sequence
  Synthetic
gatctccagacagataggcagctgtaaactcctcatgtaactcaccggtctttagcttattatagagccgtctaa

SEQ ID NO: 226811 - DNA, 75 bp, Artificial Sequence
  Synthetic
ggaaatacctaaccttctttgttccgcttgggcaaattagctctatgttcctcatgattctataacccctattgc

SEQ ID NO: 226812 - DNA, 75 bp, Artificial Sequence
  Synthetic
catcaacccaatctttgacatcagagtcacaatacattaaaaacgggtcaatcggatattgcgcatacctaagaa

SEQ ID NO: 226813 - DNA, 75 bp, Artificial Sequence
  Synthetic
gatccaaggttcgttgttgtatcaggttacacaatctcacaggtaccccatttgccacagactggtcaatgattg

SEQ ID NO: 226814 - DNA, 75 bp, Artificial Sequence
  Synthetic
tgtcaatggtctctgccaactgatgtggttctttgcacttaacattgtgcaaggctgctgcgacaaacttcgtca

SEQ ID NO: 226815 - DNA, 75 bp, Artificial Sequence
  Synthetic
gtagcgggacttcatcaccccaaacataaaaccttgacttgaactctgcaacaaaccggcctatgacactttttg

SEQ ID NO: 226816 - DNA, 75 bp, Artificial Sequence
  Synthetic
gactgataaatttattcaatctgtcactcaaataattgtgaaactctaagatgtactcaaattcatcaggatctc

SEQ ID NO: 226817 - DNA, 75 bp, Artificial Sequence
  Synthetic
tgtctaacagactagtcaacctgtgatcaaataaagagatctggtcatcactagaagtgtatgattttagagtcc

SEQ ID NO: 226818 - DNA, 75 bp, Artificial Sequence
  Synthetic
cctcataaagcaaaccaatggaatagttgatgaatttttctgttataagtccgtaaaagtcagaggcattatgaa

SEQ ID NO: 226819 - DNA, 75 bp, Artificial Sequence
  Synthetic
ggataccttgccccatgtctaaaattgagctgatgtgagagggtactacacccagtttaaagtgtctaaagaaga

SEQ ID NO: 226820 - DNA, 75 bp, Artificial Sequence
  Synthetic
aggcctcagttaatgtttcatgcagtgatttttttagccctaaatttgtctttaaataagatctcatcatggcat

SEQ ID NO: 226821 - DNA, 75 bp, Artificial Sequence
  Synthetic
tgacaactggatggggaacttctattaatttatgtatgtgccaggagagcagagtgcttacataatctctgcttt

SEQ ID NO: 226822 - DNA, 75 bp, Artificial Sequence
  Synthetic
tcacatcctccaacacatctgaagatccccaatgaatgttttgtaagactgcaaggaataatagtgggttcatca

SEQ ID NO: 226823 - DNA, 75 bp, Artificial Sequence
  Synthetic
tgggcccccacttactatgatccagactgtagcaaacttgagctaatgatacatttagcttcattgacaacacag

SEQ ID NO: 226824 - DNA, 75 bp, Artificial Sequence
  Synthetic
cattttcaaattctgattcactattcagacaactacctctaaattgacttgttaaagattcaaaataatcctcga

SEQ ID NO: 226825 - DNA, 75 bp, Artificial Sequence
  Synthetic
tcagcctcgtaaacatctttgttctcaagtcacctatatataactctctgttccccccaacctgttctttataag

SEQ ID NO: 226826 - DNA, 75 bp, Artificial Sequence
  Synthetic
ataaagaaaatttcagtcttcctgtgtcgggtccaatagatgtatatgattgtggagattcctgactgtaaaaac

SEQ ID NO: 226827 - DNA, 75 bp, Artificial Sequence
  Synthetic
ataggttctttagaactgcagttgtgcaattagtgagggaaagtgccttgctcaaagcttcagagttactctccc

SEQ ID NO: 226828 - DNA, 75 bp, Artificial Sequence
  Synthetic
tatcacttaatctgcagtcatccatcaatctttctctattcagcttgaagtttacacacttcgatttataatgac

SEQ ID NO: 226829 - DNA, 75 bp, Artificial Sequence
  Synthetic
tgtacttccccacgagtttgttggcattcatctgtagcaaaatggatttgaagcacaagaaatattctgcatttt

SEQ ID NO: 226830 - DNA, 75 bp, Artificial Sequence
  Synthetic
cataagttctagttgtcacagccctggtaatctctgagatggcacatgaatccattggtcctgagtaaaaatatt

SEQ ID NO: 226831 - DNA, 75 bp, Artificial Sequence
  Synthetic
tacctttcaactcatcattcaaacaaactttctcacaaataactttgtagtcatcatcggataaaagtgactggt

SEQ ID NO: 226832 - DNA, 75 bp, Artificial Sequence
  Synthetic
caaaatcctctatcaaatgattggataattctgataaaattaacttcaagtgcattgggtcatcaacaaccttat

SEQ ID NO: 226833 - DNA, 75 bp, Artificial Sequence
  Synthetic
gcagatcatttatgtcaccagcattgactttatcaagtttttcatcacttagattcctgtagctctccattacag

SEQ ID NO: 226834 - DNA, 75 bp, Artificial Sequence
  Synthetic
tccttactgaatttttgatgtcttcaagatgagaggaggcagcaccactaatcaacacttcatccaactcttcag

SEQ ID NO: 226835 - DNA, 75 bp, Artificial Sequence
  Synthetic
tagacattccttcaccagaaaggttcttattgccgatcactagacttgcaatcactttcataatcttgtaatcat

SEQ ID NO: 226836 - DNA, 75 bp, Artificial Sequence
  Synthetic
attcctctttacttaaaaaatatttactttttctctcaaatgtttctgacaattggcacactgcagcggcaacaa

SEQ ID NO: 226837 - DNA, 75 bp, Artificial Sequence
  Synthetic
gtttgtcataatcatagttcaacaccctttcaccatcaacatacttatttatgaccacacttttattactggcta

SEQ ID NO: 226838 - DNA, 75 bp, Artificial Sequence
  Synthetic
gatccatcgcagttgcacaaccactaaggaccaagggatctttaatttcccctttgaactcttgcttgctaaaaa

SEQ ID NO: 226839 - DNA, 75 bp, Artificial Sequence
  Synthetic
gagcaccattattaaatgatgatgtgaccaaggataaaatcttctttgagacacctggtcttttaaattgcatgc

SEQ ID NO: 226840 - DNA, 75 bp, Artificial Sequence
  Synthetic
tgcctgtgtcagtacacgacgacttacccataaaggtggccccactcattagtaaactggacaactcagtatcct

SEQ ID NO: 226841 - DNA, 75 bp, Artificial Sequence
  Synthetic
ctgcagactcaagaggattcacattgacggagtcaaactctaattttggttctaaatatttctcaaagcatttaa

SEQ ID NO: 226842 - DNA, 75 bp, Artificial Sequence
  Synthetic
tctgatctgtgagtctgtcgggtgtttcctttgtaatgaagtgacaaatgtaagagacatttagtacgaatttga

SEQ ID NO: 226843 - DNA, 75 bp, Artificial Sequence
  Synthetic
atctgtttgtcagcattgtgttaattgtggggttgaggaccttacaaatcaatgttctcaaaaccctaaaaagaa

SEQ ID NO: 226844 - DNA, 75 bp, Artificial Sequence
  Synthetic
agaactcaacctttgttattagtttctcctccaatttacttagaaggtctttgtggtaatattcagaaacatatg

SEQ ID NO: 226845 - DNA, 75 bp, Artificial Sequence
  Synthetic
ccatgatgaagtatcttaggttctggagaaatttctgagacctcttacttgggtgggttaaaaccaatataaaga

SEQ ID NO: 226846 - DNA, 75 bp, Artificial Sequence
  Synthetic
tcattttcaatagtgcttcaatgtccttcaaatcctgcttcaattctaaacagtcgttcaaccagctcaccatca

SEQ ID NO: 226847 - DNA, 75 bp, Artificial Sequence
  Synthetic
cttttatagtttcagatatgacagattgtgagaagatagctgggaagaaccttttaggatcagcataaaaggaac

SEQ ID NO: 226848 - DNA, 75 bp, Artificial Sequence
  Synthetic
aaacttcacctttacgagagctgttaattgcatagcattttgagcattctcctgttttctggtacagtaatctaa

SEQ ID NO: 226849 - DNA, 75 bp, Artificial Sequence
  Synthetic
atctggtcccagccatgtaaaactcttggcaataagcttccttacagatcactcttttgaaccttccagaacctc

SEQ ID NO: 226850 - DNA, 75 bp, Artificial Sequence
  Synthetic
tctcattttgtctcagtttaacaactgaggatgttttcattgagttcacaatagccagtgaaatgctcgagagtc

SEQ ID NO: 226851 - DNA, 75 bp, Artificial Sequence
  Synthetic
gttttaagtcatcctcagtctctagtgttggagtcagcttataagggaagtcactaaggtcattcttttcataat

SEQ ID NO: 226852 - DNA, 75 bp, Artificial Sequence
  Synthetic
tgatagatggcatgatgccttccacctcaactcccattatctttttaaaacttgaagttgagaatatgttttcca

SEQ ID NO: 226853 - DNA, 75 bp, Artificial Sequence
  Synthetic
acacaccataatcagaaaacttcaaatcagcaactgctaatgcctgttcagctttcttcagagtggagctaacaa

SEQ ID NO: 226854 - DNA, 75 bp, Artificial Sequence
  Synthetic
ggttataatacaccagttctcgatcctcatatcttgagcttggcctttttgcttgattcattcttctcctttcca

SEQ ID NO: 226855 - DNA, 75 bp, Artificial Sequence
  Synthetic
tccattgatacaattctctttttgtagcagtcaacgagacgagcctatcgttcacactcagaaatgaagaaccga

SEQ ID NO: 226856 - DNA, 75 bp, Artificial Sequence
  Synthetic
gccactcagattcttcaaagtggccaacgacttccttgtcagtggcatggcacagcaagattattgaatcaaaca

SEQ ID NO: 226857 - DNA, 75 bp, Artificial Sequence
  Synthetic
atagcaaggtctttctcctagtattaagtatgtggagacttttaattttgttcaacaatgacctccaagctggga

SEQ ID NO: 226858 - DNA, 75 bp, Artificial Sequence
  Synthetic
cacagctgtgcttggatcctaactcttcagtgctatcaatgtcagcataaagtaatgttatcgtgggagatagca

SEQ ID NO: 226859 - DNA, 75 bp, Artificial Sequence
  Synthetic
tgaagaattctcccttcaatttccctacactttctgcctccacgccataatctgaaggatacatcttacagaaag

SEQ ID NO: 226860 - DNA, 75 bp, Artificial Sequence
  Synthetic
actctaacagctcagatttgtcaactcttctaaattgtctggggattgacccagagctcacaccatttctaaaag

SEQ ID NO: 226861 - DNA, 75 bp, Artificial Sequence
  Synthetic
cttggaactcattgatgatttctcgcttgacatccatagagttcatagagttgtcaatccccatgtgacacaatt

SEQ ID NO: 226862 - DNA, 75 bp, Artificial Sequence
  Synthetic
tcaaaatttcctcgtgatgtcttgccctacaatcttgaaggatgttgagactctctattcctgatcttttgccct

SEQ ID NO: 226863 - DNA, 75 bp, Artificial Sequence
  Synthetic
ctacattcctcaatgattcacagagtctactgtactctgattcctccaacatcctcgatgattcctgagcgaatt

SEQ ID NO: 226864 - DNA, 75 bp, Artificial Sequence
  Synthetic
ggagaagtgagaaaagaatcgacctgaatctttcgttggcccactccggcatgaaagtatgatcaaagactgtcc

SEQ ID NO: 226865 - DNA, 75 bp, Artificial Sequence
  Synthetic
tcccatcaattatagggagcaaagttattcccacactctgcaggtcttgtttcaaggagctcaactttacagagt

SEQ ID NO: 226866 - DNA, 75 bp, Artificial Sequence
  Synthetic
cttcattatacttttgctcaaagtttgaaggtgagcttctaacaaaacactctagcaagaccaatacatttccag

SEQ ID NO: 226867 - DNA, 75 bp, Artificial Sequence
  Synthetic
taagtttaaaaccgtctggcacgacaaagggcaggccaggactcaagatacctttattaagcaagatcacctcaa

SEQ ID NO: 226868 - DNA, 75 bp, Artificial Sequence
  Synthetic
cactcaactcctctgtgttgtgctcacaaccattagcctcacaactgtccagttctatacacaaagagagcagct

SEQ ID NO: 226869 - DNA, 75 bp, Artificial Sequence
  Synthetic
tgaggccctcaatcaagaggttgtttggctcagactggatcaggaagtttaatttttgcctggataatctctgat

SEQ ID NO: 226870 - DNA, 75 bp, Artificial Sequence
  Synthetic
cattggccaagtatttagaaattagatccttcgcctcacacacacttgtctccattataagacttccataaaaga

SEQ ID NO: 226871 - DNA, 75 bp, Artificial Sequence
  Synthetic
gaaattagatccttcgcctcacacacacttgtctccattataagacttccataaaagataatgccaaatgcctag

SEQ ID NO: 226872 - DNA, 75 bp, Artificial Sequence
  Synthetic
cgcaccggggatcctaggcattttgggcgcgctttacaaaccactcatttgaaaggcggagtgccaaccaaatgg

SEQ ID NO: 226873 - DNA, 75 bp, Artificial Sequence
  Synthetic
ggcaaataatcaccttctttcaggaagtgcctcacataatagaggaagtgatgaacatagtcctcatcactcttt

SEQ ID NO: 226874 - DNA, 75 bp, Artificial Sequence
  Synthetic
ccctccttgcaattctcaaggggatctacaacctagcgacatgtggactgctaggtctgatatcattcttggttt

SEQ ID NO: 226875 - DNA, 75 bp, Artificial Sequence
  Synthetic
tgtgtgggaggtcttgcacaacaatgatttataaggacaattatgttctgaacagtgtggagcttgacatgtcca

SEQ ID NO: 226876 - DNA, 75 bp, Artificial Sequence
  Synthetic
ctctgaatttcacaatgccgttgtcctgctccaagaacaacacccaccattacattcagacctacaacaactccg

SEQ ID NO: 226877 - DNA, 75 bp, Artificial Sequence
  Synthetic
gcttagagctcacactaacaaacgattccattttgaaccataaattctgcaacctctctgatgcacacaagagga

SEQ ID NO: 226878 - DNA, 75 bp, Artificial Sequence
  Synthetic
atttgtacgaccacaccttaatgtccatagtaacaacttttcacctgagcattcctaatttcaaccagtatgagt

SEQ ID NO: 226879 - DNA, 75 bp, Artificial Sequence
  Synthetic
ccatggcttgtgacttcaacgacgggaagataactgttcagtacaacttgagtcattcaacaccagttggtgcag

SEQ ID NO: 226880 - DNA, 75 bp, Artificial Sequence
  Synthetic
caaaccattgtggtacagttgcaaatggtgtcctggacacattcagaaggatgcactggggaccagcacactttc

SEQ ID NO: 226881 - DNA, 75 bp, Artificial Sequence
  Synthetic
ccaaccctcccttcactataggaggtgtttcgtgcattcagacgagttataagtacctcatcattcaaaatacaa

SEQ ID NO: 226882 - DNA, 75 bp, Artificial Sequence
  Synthetic
catgggaggatcattgccaaatgtcacgacctacacctatgggctacttgtccctaatagcacagaggacaaggc

SEQ ID NO: 226883 - DNA, 75 bp, Artificial Sequence
  Synthetic
agttatacatctcaagaagactcatgggaacattcacctggactctatctgactctgccggaaatgatctacctg

SEQ ID NO: 226884 - DNA, 75 bp, Artificial Sequence
  Synthetic
gaggctactgtctacagaggtggatgttgattgaagctgagatgaaatgctttggcaacactgctgtggctaaat

SEQ ID NO: 226885 - DNA, 75 bp, Artificial Sequence
  Synthetic
gcaatcagcaacatgatgaagagttttgtgacatgctgagattgttcgacttcaataaggaggcaatcaagagat

SEQ ID NO: 226886 - DNA, 75 bp, Artificial Sequence
  Synthetic
tgaaagttgaggccgagagaagcatcaacctcatcaacaaggcagttaattccctcattaatgatcaattaataa

SEQ ID NO: 226887 - DNA, 75 bp, Artificial Sequence
  Synthetic
taagaaaccatttaagggatctgatgggtataccttactgtaactattcaaaattttggtacctaaatgatacaa

SEQ ID NO: 226888 - DNA, 75 bp, Artificial Sequence
  Synthetic
ggaatggaaagacatctctgcctaaatgctggaaagtgtccaacaactcttaccttaatgaaacccacttctcaa

SEQ ID NO: 226889 - DNA, 75 bp, Artificial Sequence
  Synthetic
atgaaattgaggaggaggccaacaacatgataacagaaatgctaaggaaagagtacgagaggagacagagcacaa

SEQ ID NO: 226890 - DNA, 75 bp, Artificial Sequence
  Synthetic
cccctcttggcttagtggacctctttgtattctcgacctccttttacctaatcagtgtgtttctccacttgataa

SEQ ID NO: 226891 - DNA, 75 bp, Artificial Sequence
  Synthetic
agatccctacacatagacacattgttggcaagagctgccccaaacctcacagactgaaccacatggcagtttgta

SEQ ID NO: 226892 - DNA, 75 bp, Artificial Sequence
  Synthetic
gctgtggtgcttttggccagcccgggctgcctgtgaagtggaaaagatagacacccagggggcccccgtgaccca

SEQ ID NO: 226893 - DNA, 75 bp, Artificial Sequence
  Synthetic
ccgcctcacggcggtgggtcacgggggcgtccttttacaggacgactctgggtgaagttgttctaaacactagat

SEQ ID NO: 226894 - DNA, 75 bp, Artificial Sequence
  Synthetic
cattggaaagtacagccctcaattgtggaagtttcacacccccaactgttgcagcctcatacatcaagcagtcca

SEQ ID NO: 226895 - DNA, 75 bp, Artificial Sequence
  Synthetic
ttagggcacaatgtggagttatctcctccttcccacccctcttctttttctctaccacaacaccggtgtgcatct

SEQ ID NO: 226896 - DNA, 75 bp, Artificial Sequence
  Synthetic
tgcacaagggtttatagtggtcccaaacatcgtcctcaaatttcctggattcagacttaggcatcccaacatcaa

SEQ ID NO: 226897 - DNA, 75 bp, Artificial Sequence
  Synthetic
tcaacttgatgtctcttcttccctgagactccagcaactttttgatgtcatccgccccttgacaggtgagaacca

SEQ ID NO: 226898 - DNA, 75 bp, Artificial Sequence
  Synthetic
tgttcttgggtaggctctccaacacagcactggtgagcccaggctgaacattgaataagtcttgaatatccagtc

SEQ ID NO: 226899 - DNA, 75 bp, Artificial Sequence
  Synthetic
catgagagtgcttagagtcctgcttaaactgctttagatctgttggctcacgatagaaatggatgtagtgcccat

SEQ ID NO: 226900 - DNA, 75 bp, Artificial Sequence
  Synthetic
ttgcaggctgaacaatggctatctcaacaggatcctcagccctcccctcaatgtcaatccaagttttagcatttg

SEQ ID NO: 226901 - DNA, 75 bp, Artificial Sequence
  Synthetic
ggtccaactgcaacatggaatcctttaactccatgacttgagagtaagttaatgcggtaggaaagccctgtgcct

SEQ ID NO: 226902 - DNA, 75 bp, Artificial Sequence
  Synthetic
gtgcgagcctggtgccgccaggcgcaggaggcttgctttctggcgggctatttcctcctagatcaacagttgtat

SEQ ID NO: 226903 - DNA, 75 bp, Artificial Sequence
  Synthetic
tgtcccaggctctccccaggatagaggttcttgaggcgatgtagggccagccatcacctgagagacacagcttgt

SEQ ID NO: 226904 - DNA, 75 bp, Artificial Sequence
  Synthetic
acaaaagattctcatacggattcctgtcccctggtgcttcggatatgaacatccccagtgatttcttaaccttca

SEQ ID NO: 226905 - DNA, 75 bp, Artificial Sequence
  Synthetic
acacagctttcaggatgtcttgaatatttttagggctgactctgatggtttcaagcatatttcccccatccaata

SEQ ID NO: 226906 - DNA, 75 bp, Artificial Sequence
  Synthetic
gacttgcacctgccttgacagctgcactcaagctgaagttgtacccagagatgttgatggcgctcttgttaacat

SEQ ID NO: 226907 - DNA, 75 bp, Artificial Sequence
  Synthetic
ctatcaaattgagcacaggatgagtctgagtcaatttgtcaagatctgatgtgtttgggtactttgctgtgtaca

SEQ ID NO: 226908 - DNA, 75 bp, Artificial Sequence
  Synthetic
ccagccccaagtcactgagggactgaatgacatcatttaagtcaacctgaccttgtttgcacatgcatgcaacag

SEQ ID NO: 226909 - DNA, 75 bp, Artificial Sequence
  Synthetic
tcaaactcggcatggttccaaactgattgttaagtaattccgggtttctcacatcccacactctcactatgccat

SEQ ID NO: 226910 - DNA, 75 bp, Artificial Sequence
  Synthetic
cacctctaaccatcggatttgggtttctttgccccatgccaatcatctggaggagagccttcctctggtccagtt

SEQ ID NO: 226911 - DNA, 75 bp, Artificial Sequence
  Synthetic
gttgagctgtcagattccccatgtagatgccagctgttaagggtctctctgatctagtgatttttgatttgagct

SEQ ID NO: 226912 - DNA, 75 bp, Artificial Sequence
  Synthetic
tctcaagatctgcagctaatgttaacaggtcatctgatgataatgtccccacacgtagaacattcctttgttgtg

SEQ ID NO: 226913 - DNA, 75 bp, Artificial Sequence
  Synthetic
aagatttaagctcaacaagattattgaccgcttggttcaagtctctcagcctcttgaggtctgaatcatctctct

SEQ ID NO: 226914 - DNA, 75 bp, Artificial Sequence
  Synthetic
tctccttcctcatcagtctttggacattgctaacttctgaaaaatccaggccatgcaagagtgcctgtgcatcct

SEQ ID NO: 226915 - DNA, 75 bp, Artificial Sequence
  Synthetic
tgatgacttgcactttaacattggagcaaaaacccgacagttcccttctaagagattgggtccacaaaaaggatt

SEQ ID NO: 226916 - DNA, 75 bp, Artificial Sequence
  Synthetic
tgacttccttggaattgctcatatttcagaaatgctttccaatatgcgcaaccaaatagcctaggatcccctgtg

SEQ ID NO: 226917 - DNA, 75 bp, Artificial Sequence
  Synthetic
acttccttggaattgctcatatttcagaaatgctttccaatatgcgcaaccaaatagcctaggatcccctgtgcg

SEQ ID NO: 226918 - DNA, 75 bp, Artificial Sequence
  Synthetic
cgcaccggggatcctaggcaagtttgaaactcatttgagttgaatctagtcaactaggtgctcaccttgcagccc

SEQ ID NO: 226919 - DNA, 75 bp, Artificial Sequence
  Synthetic
atattccaaagggaccccaatcagcacccatccgcagaacaatcccctctgctcacaatgggcaagacccagtca

SEQ ID NO: 226920 - DNA, 75 bp, Artificial Sequence
  Synthetic
aaacaaacccatgtggcccaggaccctggtcccaggacagagttaattcccgatgcctcaggctatggacctgag

SEQ ID NO: 226921 - DNA, 75 bp, Artificial Sequence
  Synthetic
ttctgcaagagctgttggtttgaaagaaggggccttgttaggtgttatgatcattacttatgtatgaactgtcta

SEQ ID NO: 226922 - DNA, 75 bp, Artificial Sequence
  Synthetic
acactccttctcacaatatccgagagatgccctatttgcaaataccctctaccaacaaaactacaaatcaacacc

SEQ ID NO: 226923 - DNA, 75 bp, Artificial Sequence
  Synthetic
acaccaaccgcccccaaagagccggcccgaaatcccccaccatacagcccctaaacccatccaaccgcactccct

SEQ ID NO: 226924 - DNA, 75 bp, Artificial Sequence
  Synthetic
cacctaccccaagctcccccccgggggggccccccgccggggtcccccccgggggaaagccgccagctcccctgg

SEQ ID NO: 226925 - DNA, 75 bp, Artificial Sequence
  Synthetic
cacaccgctggggctagtcgatgtcctggatttcctcagcctcctcgaacagtctgtcacactgcctccccttca

SEQ ID NO: 226926 - DNA, 75 bp, Artificial Sequence
  Synthetic
acctgtacttcccctgtgaactgtgcaccattatttcacccagggtcttactgaaacacagactgtaacccttaa

SEQ ID NO: 226927 - DNA, 75 bp, Artificial Sequence
  Synthetic
agcctaaccattcacatacattttgaagagcttctttaaggaatgctttataatcattgggtatgcattttttga

SEQ ID NO: 226928 - DNA, 75 bp, Artificial Sequence
  Synthetic
caacaccaactaggtccaactccaaccaatgcaaaccttgatcaagcctctgtcccaaaatactaccaatcacta

SEQ ID NO: 226929 - DNA, 75 bp, Artificial Sequence
  Synthetic
tgggaggtgaactgacacaactcccatccatttccgaaatcaacacttctatgtcctggtcatgaatgcttgggt

SEQ ID NO: 226930 - DNA, 75 bp, Artificial Sequence
  Synthetic
ttattgggatgatcctctttctgccctcaaccaagtagccgttctccagcaccaggggcacaggttcaacatctg

SEQ ID NO: 226931 - DNA, 75 bp, Artificial Sequence
  Synthetic
gtccaatgtgcacaaaatcatgttcagtgaggtctgcaatattctcactcaactcaacattgagcctcacaattt

SEQ ID NO: 226932 - DNA, 75 bp, Artificial Sequence
  Synthetic
gaccaactgacttggggtcctcaagaaattctgacagattatctgtatctactgtccatacaggcttcagtttgc

SEQ ID NO: 226933 - DNA, 75 bp, Artificial Sequence
  Synthetic
aaaactgatcactattcagtaccaatctccagcaatctagcaacagagatctgtgcacttgaccactgtagagca

SEQ ID NO: 226934 - DNA, 75 bp, Artificial Sequence
  Synthetic
cctccaatctgctcggcacaaaggaacccgtgtgatttatcacaccccaagtttcgacatgaaatgcaaattcct

SEQ ID NO: 226935 - DNA, 75 bp, Artificial Sequence
  Synthetic
cactcaatgtctcccctttacttttgatcgtaaaataaacagaaaaagtgagttgaatggaaccttttggcaata

SEQ ID NO: 226936 - DNA, 75 bp, Artificial Sequence
  Synthetic
attgaagggcttcccagaactcatctagggacgtgaactgttgatcatgattgaggccagaagcagcaagttgat

SEQ ID NO: 226937 - DNA, 75 bp, Artificial Sequence
  Synthetic
tcatgtttagaaaggctggtttgatcaccatatccatccatgagaatcccatataaagatccgacttaaacattg

SEQ ID NO: 226938 - DNA, 75 bp, Artificial Sequence
  Synthetic
gtctttcaacacctttatagattaccttttccacaaaagacgcaaatggaccaagaaggcttagcccttcagaag

SEQ ID NO: 226939 - DNA, 75 bp, Artificial Sequence
  Synthetic
caggaagtgatgttctgtgaggaaaccaggtaaaagatcctagtgttctactggttgcaacaaagggtctaatga

SEQ ID NO: 226940 - DNA, 75 bp, Artificial Sequence
  Synthetic
aagactcaaaataaacttgtcttaagaagttctttgctacatcctcagtactcactaccctttcttctaccaaag

SEQ ID NO: 226941 - DNA, 75 bp, Artificial Sequence
  Synthetic
atacgtgagatcgatcgtgggcttctgacaactctgatgataaaacaatgtaatgctcttctcgcttccacttga

SEQ ID NO: 226942 - DNA, 75 bp, Artificial Sequence
  Synthetic
ccacatggctaataagagacattgcttcacaattaacatctaaaacaacacataggtcaagaaactttactctag

SEQ ID NO: 226943 - DNA, 75 bp, Artificial Sequence
  Synthetic
gagaccatttcatttttgtggaggctaagtcactcatgaaaggcaataagtgccgttcaaatagtgatgggtaaa

SEQ ID NO: 226944 - DNA, 75 bp, Artificial Sequence
  Synthetic
gtctcctaaatgagtgtataatatggttgaaccctactttgtcctccagtagttttgtgattgtgggctttaagg

SEQ ID NO: 226945 - DNA, 75 bp, Artificial Sequence
  Synthetic
gaaagtaatcacaaggcttaaagtttattgcggagacccttgcctttaactttggttcacctaggacccaaggcc

SEQ ID NO: 226946 - DNA, 75 bp, Artificial Sequence
  Synthetic
caatctctaatgcacaagagagggcaatgcacatgtaatcccataacactggtctgaggaacttgaccaaccagt

SEQ ID NO: 226947 - DNA, 75 bp, Artificial Sequence
  Synthetic
catttgaacatctctgatcagaagggacagaccacagattcatacctttttgaacaaaccccttcacatcaactc

SEQ ID NO: 226948 - DNA, 75 bp, Artificial Sequence
  Synthetic
gcccttcaagctggctcactagtgacttaatatagtaattgaacttattagggcctctaacacacttgcttccca

SEQ ID NO: 226949 - DNA, 75 bp, Artificial Sequence
  Synthetic
gtgttctacacaatccaacaaaccctgaagcaatgctgctttggaatgcacttttgtttattgcttcagatagta

SEQ ID NO: 226950 - DNA, 75 bp, Artificial Sequence
  Synthetic
gtttctgcgctcctctagtgaagttggaggaaagcttattctgaagtgttttgaccagtgttggcaatttctcct

SEQ ID NO: 226951 - DNA, 75 bp, Artificial Sequence
  Synthetic
cctcaagattcaaggcacctgtgtaaacaactttttgtctaagcaccattctcaaggggaagtaagcagaaagat

SEQ ID NO: 226952 - DNA, 75 bp, Artificial Sequence
  Synthetic
ttagccaacacaaactcaactctgattcttctaaagggtccacatcaagcagtgagcaaattctctgtaatgact

SEQ ID NO: 226953 - DNA, 75 bp, Artificial Sequence
  Synthetic
cactaggatcaccagacaagtaagcagctgtgaactcttcatgcaactcgccagtcttaagtttattgtagagtc

SEQ ID NO: 226954 - DNA, 75 bp, Artificial Sequence
  Synthetic
ttctaagaagatacctaatcttctttgttccgcctgggcaaattagttctatgttcctcataattctatagcctc

SEQ ID NO: 226955 - DNA, 75 bp, Artificial Sequence
  Synthetic
tattgccatcaacccaatccttgacatcagagtcacaaaacatcaaaaacgggtcaattgggtattgtgcatacc

SEQ ID NO: 226956 - DNA, 75 bp, Artificial Sequence
  Synthetic
taagaagatctaaggtcctttgctggattaggttgcagagcttcacaggcaccccatttgccacactctggtcaa

SEQ ID NO: 226957 - DNA, 75 bp, Artificial Sequence
  Synthetic
tgattgtgtcaatggtctctgctaactgatgtggttccttgcacttgacattgtgcaaagctgctgcaacaaact

SEQ ID NO: 226958 - DNA, 75 bp, Artificial Sequence
  Synthetic
ttgtcagtaatgggacctcatcaccccagacataaaacctagacttgaactcagcaacaaaccggcctataacac

SEQ ID NO: 226959 - DNA, 75 bp, Artificial Sequence
  Synthetic
tttttggactaataaatttattcaatctgtcacttaaataattgtggaattctaaaatgtactcaaattcatcag

SEQ ID NO: 226960 - DNA, 75 bp, Artificial Sequence
  Synthetic
ggtctctgtccaacaaattagtcaatttatgatcaaacaaagagatctgatcatcactagaagtatatgatttaa

SEQ ID NO: 226961 - DNA, 75 bp, Artificial Sequence
  Synthetic
gagtcccttcgtaaagcaaaccaatagagtagtttatgaatttctcagttatcagtccatagaagtcagaagcat

SEQ ID NO: 226962 - DNA, 75 bp, Artificial Sequence
  Synthetic
tgtgaagaattccctgccccatgtctaaaattgagctaatgtgagagggcactacaccgagcttgaagtgcctaa

SEQ ID NO: 226963 - DNA, 75 bp, Artificial Sequence
  Synthetic
aaaagaaagcttcagttagtgtttcatgcaatgatttctttaaacctaagtttgtcttcaaataagacctcatca

SEQ ID NO: 226964 - DNA, 75 bp, Artificial Sequence
  Synthetic
tggcattgacaactgggtggggtacttctattaacttgtgaatatgccatgagagcaaagtacttacataatctc

SEQ ID NO: 226965 - DNA, 75 bp, Artificial Sequence
  Synthetic
tacttttcacatcctctaacacatctgaagaactccaatgaatgttttgcaagactacaaggaataataatggat

SEQ ID NO: 226966 - DNA, 75 bp, Artificial Sequence
  Synthetic
tcatcatgggcccccatttactatgatctaggctgtagcaaacttgagctaatgacacattgagtttcattgaca

SEQ ID NO: 226967 - DNA, 75 bp, Artificial Sequence
  Synthetic
gcacagcattttcaaactctgattcactattcaaacaactacctctaaattggtttgttaaggactcaaaatagt

SEQ ID NO: 226968 - DNA, 75 bp, Artificial Sequence
  Synthetic
cctcaattagccttgtaaacatcttggttcttaaatcacctatatacaactctctattccctccaacttgttctt

SEQ ID NO: 226969 - DNA, 75 bp, Artificial Sequence
  Synthetic
tgtaagataaagagaactttagccttcctgtgtcgggtccaatagatgtgtatgattgtggagattcctgactat

SEQ ID NO: 226970 - DNA, 75 bp, Artificial Sequence
  Synthetic
aaaagcacaaattttttaaaaccgcagttgtgcagttagtgagagagagtgctttactcaaagcttcagaattac

SEQ ID NO: 226971 - DNA, 75 bp, Artificial Sequence
  Synthetic
tctccctatcacttaatctgcaatcatccattagtctttccctattcaatttaaagtttatacattttgacttat

SEQ ID NO: 226972 - DNA, 75 bp, Artificial Sequence
  Synthetic
aatgactgtatttccccacgagtctattggcattcatctgcagtaaaatagatttgaaacaaaggaagtactctg

SEQ ID NO: 226973 - DNA, 75 bp, Artificial Sequence
  Synthetic
catttttataggttctagttgttacagctctagtgatctctgagatagcacatgagtccattggtcctgagtaaa

SEQ ID NO: 226974 - DNA, 75 bp, Artificial Sequence
  Synthetic
aatatttgctcttcaattcactatttgagtgtactttgtcacagattaccttgtagtcatcatcagacaataatg

SEQ ID NO: 226975 - DNA, 75 bp, Artificial Sequence
  Synthetic
actggtcaaagtcttctattaaatggttagatagttctgataaaatcaattttaagtgcatcgtgttatcaacaa

SEQ ID NO: 226976 - DNA, 75 bp, Artificial Sequence
  Synthetic
tcttgtgtagatcatttatgtcaccagtgttctccttattgagtttttcatttcccaggttcttataaccctcta

SEQ ID NO: 226977 - DNA, 75 bp, Artificial Sequence
  Synthetic
ttacagccctcactgagtctttgatgtcctcaagataggaagaggcagtaccattaactaatatttcatccaact

SEQ ID NO: 226978 - DNA, 75 bp, Artificial Sequence
  Synthetic
cttcagtaggcattcctccaccagaagcatttttgctgccaatcactaaacttgcaatcactttcatgatcttgt

SEQ ID NO: 226979 - DNA, 75 bp, Artificial Sequence
  Synthetic
aatcatactcctctttacttagaaaatacttgctttttctttcaaatgtctccgacaattggcacactgcagcag

SEQ ID NO: 226980 - DNA, 75 bp, Artificial Sequence
  Synthetic
caacaagcttatcataatcatagtttagcactctctcaccatcaacatacttgtttatgactacactcttattgc

SEQ ID NO: 226981 - DNA, 75 bp, Artificial Sequence
  Synthetic
tggctaagtccatagcagttgcacaaccactaaggactaaggggtctttgatctcacctttgaactcttgtttac

SEQ ID NO: 226982 - DNA, 75 bp, Artificial Sequence
  Synthetic
taaaaagaacaccattgttgaatgacgatgtgactaaagacaaaattttctttgagacacccggtcttttaaatt

SEQ ID NO: 226983 - DNA, 75 bp, Artificial Sequence
  Synthetic
ggatatcacccgcatcagagcataatggtttacccagaaaggttgccccgctcattagtaaactagacaactcag

SEQ ID NO: 226984 - DNA, 75 bp, Artificial Sequence
  Synthetic
tagcctctgcagactcaaaggggttcacattgacagaatcaaattctaactttggctctaggtatttctcgaaac

SEQ ID NO: 226985 - DNA, 75 bp, Artificial Sequence
  Synthetic
acttaatttgatctgtaagtctgtctggtgtttcctttgtgataaagtgacagatgtaagatacattaagaatga

SEQ ID NO: 226986 - DNA, 75 bp, Artificial Sequence
  Synthetic
acttaaatctgtttgttaacattgtgttaattgagggattgaggactttacaaagcaatgttctcaaaaccctaa

SEQ ID NO: 226987 - DNA, 75 bp, Artificial Sequence
  Synthetic
agagaaagaattcaacttttgttattagtttctcctctaacttgctcaagaggtccttatggtagtactcagaaa

SEQ ID NO: 226988 - DNA, 75 bp, Artificial Sequence
  Synthetic
catatgccatgatgaagtatctcaggttttgaagaaacttctgagacctcttactcggatgagtcaagattaata

SEQ ID NO: 226989 - DNA, 75 bp, Artificial Sequence
  Synthetic
taaagaccattttcagtaatgcctcaatgtccttcaaatcttgtttcaattctaaacagtcgtttaaccagctca

SEQ ID NO: 226990 - DNA, 75 bp, Artificial Sequence
  Synthetic
ccatcacttttatggtctcagatatgacagattgtgaaaaaatggctggaaagaacctcttgggatcagcataaa

SEQ ID NO: 226991 - DNA, 75 bp, Artificial Sequence
  Synthetic
aggaacaaacttcacctttacgagagttattaatagcataacattttgagcattcccctgttttctgatacagta

SEQ ID NO: 226992 - DNA, 75 bp, Artificial Sequence
  Synthetic
gtctaaatctggtcccagccatgtagaattcttgacagtaagcttccttacagatcacctttttgaacctaccag

SEQ ID NO: 226993 - DNA, 75 bp, Artificial Sequence
  Synthetic
agcctctctcattttgtctcagtttaacaactgaggatgttttcattgaatttacaatagccagtgaaatgctag

SEQ ID NO: 226994 - DNA, 75 bp, Artificial Sequence
  Synthetic
aaagccgcttcaagtcatcctctgtctctagttctggacttaaatcataaggaaagtcattaagatcattcttct

SEQ ID NO: 226995 - DNA, 75 bp, Artificial Sequence
  Synthetic
cataattaatggatggcatgacgccatccacctcaacccccattatcttcttgaaacttgaaactgaaattatgt

SEQ ID NO: 226996 - DNA, 75 bp, Artificial Sequence
  Synthetic
tttctaatacaccataatcggaaaatttcaagcccacaactgccaatgcctgttcagctttctttaaggtggagt

SEQ ID NO: 226997 - DNA, 75 bp, Artificial Sequence
  Synthetic
taacaagattataatacaccaactcttgatcctcacatcttgagcttagtttttttgcttgattcatccttcttc

SEQ ID NO: 226998 - DNA, 75 bp, Artificial Sequence
  Synthetic
tttctatccactgacgtagttctttctttgtggcggttagtgagacgagcctatcattcacactcaggaatgaag

SEQ ID NO: 226999 - DNA, 75 bp, Artificial Sequence
  Synthetic
aaccaagccactctgattcttcaaagtggcctaccacctccttgtcagtagcatgacaaagtaagattattgagt

SEQ ID NO: 227000 - DNA, 75 bp, Artificial Sequence
  Synthetic
caaacagtagtaaagtcttcctcctagtattaagtatgtgaagactcttgattttgttcaataatgatctccaag

SEQ ID NO: 227001 - DNA, 75 bp, Artificial Sequence
  Synthetic
ctgggacacaactatgtttggttcttagttcctcaatgctgtcaatcttagcataaagtattgttattgtgggag

SEQ ID NO: 227002 - DNA, 75 bp, Artificial Sequence
  Synthetic
acagcacaaagaattcctccctcaatttctccacgtcctctgcctccactccataatctgaaggatacattttac

SEQ ID NO: 227003 - DNA, 75 bp, Artificial Sequence
  Synthetic
aaaaagactccaacatttcagacttgtcaaccctcctaaattgcctgggaattgtcccagagcttatgccattcc

SEQ ID NO: 227004 - DNA, 75 bp, Artificial Sequence
  Synthetic
tgaaggcctggaactcattgatgatttctcgtttgacatctatagagctcatagagttgtcgatccccatatgac

SEQ ID NO: 227005 - DNA, 75 bp, Artificial Sequence
  Synthetic
acaactttaaaatctcctcatgatgtttcgccctacagtcttggaggatgttgatgctctctatcccagaccttt

SEQ ID NO: 227006 - DNA, 75 bp, Artificial Sequence
  Synthetic
tgccttctatgtttctcaatgattcacagagtctactgtattctgattcctccaacatccttgatgattcttgag

SEQ ID NO: 227007 - DNA, 75 bp, Artificial Sequence
  Synthetic
caaattgaagaagtgagaaaagaatggacctgaacttttcgttagcccactccggcatgaaagtgtgatcaaaaa

SEQ ID NO: 227008 - DNA, 75 bp, Artificial Sequence
  Synthetic
ccgttctcccatcaattatgggaagcaaagtcacccccacaccttgcagatcttgtttcaaggaattaagcttca

SEQ ID NO: 227009 - DNA, 75 bp, Artificial Sequence
  Synthetic
cagtgtcttcattgtatttttgttcaaagtttgaaggtgagctcctaacaaagcactctaacaacaccaacacat

SEQ ID NO: 227010 - DNA, 75 bp, Artificial Sequence
  Synthetic
ttccagttagtttaaaaccatctggtacaacaaaaggcaaaccaggactcaatatgcctctattgagtaggatca

SEQ ID NO: 227011 - DNA, 75 bp, Artificial Sequence
  Synthetic
cttcaacactcaattcatctgtgttatgctcacaaccattggcctcacaactgtccagttctatacacagggaaa

SEQ ID NO: 227012 - DNA, 75 bp, Artificial Sequence
  Synthetic
gtagtttaaggccctcaatcaacaagttttgcggttcagattgaatcaagaagttcaacttttgcctggataatc

SEQ ID NO: 227013 - DNA, 75 bp, Artificial Sequence
  Synthetic
tctgatcattggctaagtatttggaaattagatcttttgcctcagacacgcttgcctccattgtaagggtttccc

SEQ ID NO: 227014 - DNA, 75 bp, Artificial Sequence
  Synthetic
ttgcctcagacacgcttgcctccattgtaagggtttcccagaaggcaacgtcaaatgcctaggatcccctgtgcg

SEQ ID NO: 227015 - DNA, 75 bp, Artificial Sequence
  Synthetic
gggatcctaggcattttgggcgcgcatttcacgttgcctattacactggtccaaaagatcacggatcagcaccca

SEQ ID NO: 227016 - DNA, 75 bp, Artificial Sequence
  Synthetic
gtatggggcagatggtcaccttctttcaggaggtgcctcacataatagaggaagtgatgaatattgttctcatta

SEQ ID NO: 227017 - DNA, 75 bp, Artificial Sequence
  Synthetic
ccttgtccctccttgccatactcaaaggaatatacaactttgctacatgtggactcctgggtttaatctcattct

SEQ ID NO: 227018 - DNA, 75 bp, Artificial Sequence
  Synthetic
tgctcctgtgtgggaggtcctgtacacaggtgtacaaagacaattacagattgaacagcattgaactcgatatgt

SEQ ID NO: 227019 - DNA, 75 bp, Artificial Sequence
  Synthetic
ccacccttaacttcacaatgcctctgtcctgttccaagaacaacactcaccattacattcagacctacaatgatt

SEQ ID NO: 227020 - DNA, 75 bp, Artificial Sequence
  Synthetic
ccggtctggaactcacattgaccaacgattccattttgagccacaaattctgcaatctctctgatgctcacagaa

SEQ ID NO: 227021 - DNA, 75 bp, Artificial Sequence
  Synthetic
gaaatctgtatgatcacacacttatgtctgtagtgacaaccttccatttgagcattccaaacttcaatcaatatg

SEQ ID NO: 227022 - DNA, 75 bp, Artificial Sequence
  Synthetic
aatccatggcatgtgacttcaatggtgggaagataactgttcagtacaacttgagccactcaaccacagttgatg

SEQ ID NO: 227023 - DNA, 75 bp, Artificial Sequence
  Synthetic
ctgccaatcactgtggcacagtcgcaaatggtgtcttggacacatttaggaggatgcattgggggccggctcacc

SEQ ID NO: 227024 - DNA, 75 bp, Artificial Sequence
  Synthetic
ttcccaaccccccattcacaataggaggtgttcagtgcattcaaacaagttatcaatacctcatcatccaaaaca

SEQ ID NO: 227025 - DNA, 75 bp, Artificial Sequence
  Synthetic
caacctgggaagaccactgccaaatgtcgaggcctacacctatgggttacttatccctgatagctcaaaggacaa

SEQ ID NO: 227026 - DNA, 75 bp, Artificial Sequence
  Synthetic
ggcagttgtacatttccagaaggcttatgggcactttcacttggacattgtcggattctgcaggaaacgatctgc

SEQ ID NO: 227027 - DNA, 75 bp, Artificial Sequence
  Synthetic
ctggaggttactgtcttcaaaggtggatgctgattgaagccgagatgaagtgctttggcaacacagctgtagcta

SEQ ID NO: 227028 - DNA, 75 bp, Artificial Sequence
  Synthetic
agtgtaaccagcaacatgatgaggaattctgtgatatgttaagattatttgatttcaacagagaagcaattagca

SEQ ID NO: 227029 - DNA, 75 bp, Artificial Sequence
  Synthetic
gactgaaagtagagactgagagaagtatcaaccttattaacaaggcagtcaattcccttattaatgatcaactca

SEQ ID NO: 227030 - DNA, 75 bp, Artificial Sequence
  Synthetic
taataagaaatcatttaagagatctgatgggcattccatactgtaactactcaaggttttggtacctgaatgaca

SEQ ID NO: 227031 - DNA, 75 bp, Artificial Sequence
  Synthetic
cgaggaatggaaagacatccttacctaaatgctggaaagtgtcaaacaactcatacctaaatgaaacacactttt

SEQ ID NO: 227032 - DNA, 75 bp, Artificial Sequence
  Synthetic
caaatgaaattgaggaagaagctaataatatgatcacagaaatgcttagaaaagagtacgagaaaagacagagca

SEQ ID NO: 227033 - DNA, 75 bp, Artificial Sequence
  Synthetic
caactcctctcggccttgtagatctctttgtgttctcgacatccttttatctaattagtgtgtttcttcacttga

SEQ ID NO: 227034 - DNA, 75 bp, Artificial Sequence
  Synthetic
ttaaaattccgactcacagacatattattggtaagggttgccccaaacctcacagattgaaccacatggcagttt

SEQ ID NO: 227035 - DNA, 75 bp, Artificial Sequence
  Synthetic
gcagttgtggtgtgtatggtcaacctgggctacctgtaaaatggaagagatgatgacccaaggggcccccgtgac

SEQ ID NO: 227036 - DNA, 75 bp, Artificial Sequence
  Synthetic
ccaccgcctgctggcggtgggtcacgggggcgtccatttacaggacgactctaggagatgttgtcctgaagacga

SEQ ID NO: 227037 - DNA, 75 bp, Artificial Sequence
  Synthetic
ggtcttttgaaagtacagccctcaattgtggaagtttcacacctccaactgtggctgcttcatacatcagacaat

SEQ ID NO: 227038 - DNA, 75 bp, Artificial Sequence
  Synthetic
ccattaaggcacaatgcggtgtgatttcctctttcccacctctcttcttcttttcaacaacaataccagtgtgca

SEQ ID NO: 227039 - DNA, 75 bp, Artificial Sequence
  Synthetic
tcttgcataggggtttgtagtggtcccacacatcgtcctcaaattttctagcttcagacttggccatcccgacat

SEQ ID NO: 227040 - DNA, 75 bp, Artificial Sequence
  Synthetic
caatcaacttgatgtctcttctgccctgagactccagaagctttctaatgtcatctgcaccttgacaggtgagaa

SEQ ID NO: 227041 - DNA, 75 bp, Artificial Sequence
  Synthetic
ccatgtttttaggaagactctctagtacggcactggtgagcccaggctgcacgctgaacaaatcttggatgtcaa

SEQ ID NO: 227042 - DNA, 75 bp, Artificial Sequence
  Synthetic
gcccatgagagtgtttagagtcttgcttgaattgtttcaggtctgttggctcacgatagaaatggatatagtgcc

SEQ ID NO: 227043 - DNA, 75 bp, Artificial Sequence
  Synthetic
catttgcaggttgcacaatggcgatctcaacagggtcctcagctctcccctcaatgtctatccaagtcttagcat

SEQ ID NO: 227044 - DNA, 75 bp, Artificial Sequence
  Synthetic
tgggatccagctgcaacattgagtctttcagttccatgatctgagagtatgtcagtgtggtgggaaagccttgtg

SEQ ID NO: 227045 - DNA, 75 bp, Artificial Sequence
  Synthetic
cttgtgcaagtcgggtgctgccagacacaggagaattgttcactggtgggctccccccttctaggtcaacagttg

SEQ ID NO: 227046 - DNA, 75 bp, Artificial Sequence
  Synthetic
tgttgtcccaagctcttcccaggatcgaggttctggaagcaatgtagggccagccttctcctgagagacacagtt

SEQ ID NO: 227047 - DNA, 75 bp, Artificial Sequence
  Synthetic
tgtataagagattctcatacgggttcctatcacccggtgtttcagatacaaacatcccaagtgatttttttgcct

SEQ ID NO: 227048 - DNA, 75 bp, Artificial Sequence
  Synthetic
tcagcacagcctttagaatgtcctgaatgtttttagggctgactctgatggtttcaagcatatttccaccatcta

SEQ ID NO: 227049 - DNA, 75 bp, Artificial Sequence
  Synthetic
ataagcttgcacctgctttgaccgctgcactcaaactgaaattatacccagaaatgttaatggcactcttgttca

SEQ ID NO: 227050 - DNA, 75 bp, Artificial Sequence
  Synthetic
catctattaagttgagaacagggtgagactgggccaacctctcaagatctgatgtattggggtactttgctgtgt

SEQ ID NO: 227051 - DNA, 75 bp, Artificial Sequence
  Synthetic
atatgagccccaaatcagtgagggactgaataacatcattcaggtcaacttggccctgtttgcacatgcatgcaa

SEQ ID NO: 227052 - DNA, 75 bp, Artificial Sequence
  Synthetic
cagtcagacttggcatagtcccgaattggttgttcaataattcagggttcctaacatcccaaattttcactattc

SEQ ID NO: 227053 - DNA, 75 bp, Artificial Sequence
  Synthetic
catcacctctaaccattggaccagggcccttctgccccatgccgatcatttgaaggagagccctcctctggtcta

SEQ ID NO: 227054 - DNA, 75 bp, Artificial Sequence
  Synthetic
gttgctgtgcagttaggttccccatgtaaataccagctgtctggggcctttctgttctggttattttagatttga

SEQ ID NO: 227055 - DNA, 75 bp, Artificial Sequence
  Synthetic
gcttctcaagatctgcagccaatatgaggaggtcatctgatgacagtgtccctacacgcagaacattcttttgtt

SEQ ID NO: 227056 - DNA, 75 bp, Artificial Sequence
  Synthetic
gtgtcgacttaagctcaacaaggttattaactgcttggtttagatctctcagtctcttgaggtcagaatcatctc

SEQ ID NO: 227057 - DNA, 75 bp, Artificial Sequence
  Synthetic
tcttttctttcctcatcagtctttgtacattgctgacttctgaaaagtccagaccatgaaggagtgcttgagcat

SEQ ID NO: 227058 - DNA, 75 bp, Artificial Sequence
  Synthetic
ccttgatgacttgtactttgacattggaacaaaaccctgacaactcccttctaagggattgagtccacagaaagg

SEQ ID NO: 227059 - DNA, 75 bp, Artificial Sequence
  Synthetic
ggatttgacttctttagaattgctcatttttggaagtctttccaatatgcgcaatctaatagccatactaggtgt

SEQ ID NO: 227060 - DNA, 75 bp, Artificial Sequence
  Synthetic
caccggggatcctaggcaattttgatattcatttaaataaacatcagtaaatcgactactagcttcgccgcccag

SEQ ID NO: 227061 - DNA, 75 bp, Artificial Sequence
  Synthetic
atcctgagcacacaccaccacctagaatgggcaaaactcagtctaaatcaaaatgtgcgcctcaagacctggagc

SEQ ID NO: 227062 - DNA, 75 bp, Artificial Sequence
  Synthetic
ctagagtggagctaattcccgacgcctcaggccacgggcccgaattctgcaagagctgctggtttgaaagaaggg

SEQ ID NO: 227063 - DNA, 75 bp, Artificial Sequence
  Synthetic
gtcttgtaaaatgctatgaccattacctctgtatgagctgcttgacacttcttcttaccatctctgagaggtgcc

SEQ ID NO: 227064 - DNA, 75 bp, Artificial Sequence
  Synthetic
ccatctgcaagtatcctttaccaacaagactgcagatgggcaaaacaccaaccgcccccacagcaccagccaaca

SEQ ID NO: 227065 - DNA, 75 bp, Artificial Sequence
  Synthetic
accccccaccctacagcccctgagaccacacagccaaacacccagacacccaacccaccccaagctccccccggg

SEQ ID NO: 227066 - DNA, 75 bp, Artificial Sequence
  Synthetic
ggggcccccgccggggtcccccccgggggagcaggggaactccagcatcaatcgatctcttgaatttctttgatc

SEQ ID NO: 227067 - DNA, 75 bp, Artificial Sequence
  Synthetic
ccctcgaataaccgactgcactgctttccccttaatctaaattctccttgagaactgtgtaccattatgtcgtct

SEQ ID NO: 227068 - DNA, 75 bp, Artificial Sequence
  Synthetic
aaagtcttactgaaacatagattatagccattaaaacccagccactcattgacatccaatagggccactttgaga

SEQ ID NO: 227069 - DNA, 75 bp, Artificial Sequence
  Synthetic
aatgtcttgtaatcctctggcctacacctttttacaaccccaactaaatccaattccaaccaatgtaaaccttga

SEQ ID NO: 227070 - DNA, 75 bp, Artificial Sequence
  Synthetic
cttaatctctgtctaaggatattaccaataatcaatgggggagaatccacacagctcccttccatttcatggatt

SEQ ID NO: 227071 - DNA, 75 bp, Artificial Sequence
  Synthetic
aacacctccatgtcttgatcatgaacacttggatttattgggattattttcttcctgccttcaactaggtaacca

SEQ ID NO: 227072 - DNA, 75 bp, Artificial Sequence
  Synthetic
ttctccacaaccaagggaacgggctctggatctgggcctatatgggtaaagtcatactcagtaagccttgttata

SEQ ID NO: 227073 - DNA, 75 bp, Artificial Sequence
  Synthetic
ttctcattcaatatgacattgagtttaacaagctgtcctaatgacttagagtcctcaaaaagttctgatagatta

SEQ ID NO: 227074 - DNA, 75 bp, Artificial Sequence
  Synthetic
tcggcatccactgcccacacaggccttaatttacagaattgatcacaactcagtaccaatctccaacaatctaaa

SEQ ID NO: 227075 - DNA, 75 bp, Artificial Sequence
  Synthetic
agtattgatctatgcacctgaccactgtaaagaacctctaatctgctcggtatgaagtagtcttcatcattcatg

SEQ ID NO: 227076 - DNA, 75 bp, Artificial Sequence
  Synthetic
atgccccatgtttcaatgtgaaatgtgaactcctcacctaatgtctctcctttacttttgattgagaaatatact

SEQ ID NO: 227077 - DNA, 75 bp, Artificial Sequence
  Synthetic
ggaagagtgacatgaacagaaccaccaggcagcgactggagggcttcccaaaattcacctacacatgtaaacttt

SEQ ID NO: 227078 - DNA, 75 bp, Artificial Sequence
  Synthetic
ttttcacaaacaaagccagacgccacaatttgattcagattcaaataagctggattaaccaccatatccatccat

SEQ ID NO: 227079 - DNA, 75 bp, Artificial Sequence
  Synthetic
gaaaagcccatatagaggtctgacttgaacattggtctttcagtacccttatatataaccttctccacaaatgat

SEQ ID NO: 227080 - DNA, 75 bp, Artificial Sequence
  Synthetic
gcaaatggcccaagaagctctaagccttcagaggcagggagtgaagttctgtgcggaaaccaggtgaatgatccc

SEQ ID NO: 227081 - DNA, 75 bp, Artificial Sequence
  Synthetic
agtgtcctactggttgcaacaaaaggtctaataaaggattcaaaatagacttgtcttaaaaagttctttgctaca

SEQ ID NO: 227082 - DNA, 75 bp, Artificial Sequence
  Synthetic
tcttctgtgctcaccaccctttcatccaacagtgacatgtgggaccgatcgtgcgcttctgacagctctgatgac

SEQ ID NO: 227083 - DNA, 75 bp, Artificial Sequence
  Synthetic
aagaccacataatgctcctcccgtttccacttgactacatggctaatgagggacattgcctcacaattgacatct

SEQ ID NO: 227084 - DNA, 75 bp, Artificial Sequence
  Synthetic
aaaacaacacatagatcaagaaacttcactctaggagaccatttcatttttgttgaagctaaatcactcataaaa

SEQ ID NO: 227085 - DNA, 75 bp, Artificial Sequence
  Synthetic
ggtaacaaatgcttctcaaacaatgatgggtaaagtcttctgaaagaatgtattatgtgattgaaccccacttta

SEQ ID NO: 227086 - DNA, 75 bp, Artificial Sequence
  Synthetic
tcttctaataattttgtaattgtgggcttgagtggaaaataatcacaaggcttgaagtctattgcagacactttc

SEQ ID NO: 227087 - DNA, 75 bp, Artificial Sequence
  Synthetic
acctttggtttcggctcacctagaacccaagggccaatttctaatgcacatgccagggcgatgcacatgtagtcc

SEQ ID NO: 227088 - DNA, 75 bp, Artificial Sequence
  Synthetic
cacaatactggtctgaggtacttaaacagccagtcatttgaacacctctgtccagaaggaatagaccagaggttc

SEQ ID NO: 227089 - DNA, 75 bp, Artificial Sequence
  Synthetic
atgcctcctattatgagtcccttcactccaactcgcgtttcaagttggctaacgagtgactttatataataattc

SEQ ID NO: 227090 - DNA, 75 bp, Artificial Sequence
  Synthetic
aacttatcaggacccctgacacacttgctgcctagtgttctacacaacccaatgaagcctgaggcaatgctactc

SEQ ID NO: 227091 - DNA, 75 bp, Artificial Sequence
  Synthetic
tggaatgcacttttatttattgcttcagacaagagtttttgtgctcctctagtgaaacttgaggaaagcttattt

SEQ ID NO: 227092 - DNA, 75 bp, Artificial Sequence
  Synthetic
tgcagtgttctgactaaagtaggtaatttctcttcctcaagatttagagcacctgtgtaaacaactttctgcctc

SEQ ID NO: 227093 - DNA, 75 bp, Artificial Sequence
  Synthetic
aacaccatccttaagggaaagtaagcggaaaggttcaaccaacatagactcaactcttggtcacttaaagggtca

SEQ ID NO: 227094 - DNA, 75 bp, Artificial Sequence
  Synthetic
acatcaagtagtgaacacattttttgtagtgactcagtgggatctccagctaagtaagctgctgtaaactcttcg

SEQ ID NO: 227095 - DNA, 75 bp, Artificial Sequence
  Synthetic
tgtaactcaccagtcttgagtttgttgtaaagccttctaagaaaatatctaatctttttggttccatcggggcag

SEQ ID NO: 227096 - DNA, 75 bp, Artificial Sequence
  Synthetic
atagattctatgttcctcataattctataacccctattaccgtcaacccaatctttgacatcagaatcacaaaac

SEQ ID NO: 227097 - DNA, 75 bp, Artificial Sequence
  Synthetic
atcaaaaatggatcaattggatactgtgtgtacctgaggagatccaaagttctctgctgtattaaattgcagagc

SEQ ID NO: 227098 - DNA, 75 bp, Artificial Sequence
  Synthetic
ctcacaggcactccatttgccacagactggtcaataattgtgtcaatagtttctgccaactgatgtggttcttta

SEQ ID NO: 227099 - DNA, 75 bp, Artificial Sequence
  Synthetic
cacttaacattgtgcaaggctgcagcaacaaacttggttaaaagtgggacttcatcaccccaaacataaaacctt

SEQ ID NO: 227100 - DNA, 75 bp, Artificial Sequence
  Synthetic
gatttgaattctgctacaaacctgccaattacactcttcgggctaataaacttgttcaatctatcactcaagtag

SEQ ID NO: 227101 - DNA, 75 bp, Artificial Sequence
  Synthetic
ttatgaaactccagaatgtattcaaattcgctaggatctctgtcaagcaattcagttaatttatgatcaaacaaa

SEQ ID NO: 227102 - DNA, 75 bp, Artificial Sequence
  Synthetic
gatatttgatcatcactagaggtgtatgacttgagagttccctcgtagagcaatcctatggaataattgatgaac

SEQ ID NO: 227103 - DNA, 75 bp, Artificial Sequence
  Synthetic
ctctcagttattagcccatagaagtcagaggtgttgtggagtatcccttgccccatgtccaagattgagctaata

SEQ ID NO: 227104 - DNA, 75 bp, Artificial Sequence
  Synthetic
tgagacggcactatgccaagcttgaagtgtctgaagaaaaaagcctcagtcaatgtctcatgaagtgactttttt

SEQ ID NO: 227105 - DNA, 75 bp, Artificial Sequence
  Synthetic
agccctaggtttgttttcaaataagacctcatcatggcgttaacaaccgggtggggtacttctatcaacttatga

SEQ ID NO: 227106 - DNA, 75 bp, Artificial Sequence
  Synthetic
atgtgccaagagaggagtgtgcttacataatctctacttttaacatcctcaagtgcatctgaagaactccaatga

SEQ ID NO: 227107 - DNA, 75 bp, Artificial Sequence
  Synthetic
atgttctgcaacatcaccaagaataacagtgggttcatcataggcccccatttgctatgatccaaactataacaa

SEQ ID NO: 227108 - DNA, 75 bp, Artificial Sequence
  Synthetic
acttgtgctaaagacacattgagtttcattgataagacagcattttcaaactctgattcactattcaagcaactg

SEQ ID NO: 227109 - DNA, 75 bp, Artificial Sequence
  Synthetic
cctttaaattgacctgtcaaggattcaaaataatcctcaatcaatcttgtaaacatcttagttctcaaatcacct

SEQ ID NO: 227110 - DNA, 75 bp, Artificial Sequence
  Synthetic
atatataattctctgttcccaccaacctgttctttgtaagataaggaaaatttcaaccttcctgtgtcaggtccg

SEQ ID NO: 227111 - DNA, 75 bp, Artificial Sequence
  Synthetic
acggatgtgtatgactgtggagattcttgactataaaaacacaagttttttaaaactgcagttgtgcagttggtt

SEQ ID NO: 227112 - DNA, 75 bp, Artificial Sequence
  Synthetic
aatgagagtgctttacttagagcttctgaattgctttccctgtcactaagcctacagtcatccattaatctctct

SEQ ID NO: 227113 - DNA, 75 bp, Artificial Sequence
  Synthetic
ctgtttaatttaaaattaatacattttgacttatagtggctgtattttcctgtgagtctattagcgttcatctga

SEQ ID NO: 227114 - DNA, 75 bp, Artificial Sequence
  Synthetic
agtaggattgatttgaaacacagaaagtactcagtattctcaaaggtcctggttgtcacagctctagtgatctct

SEQ ID NO: 227115 - DNA, 75 bp, Artificial Sequence
  Synthetic
gaaatggcacaagagctcattgggcctgagtaaaagtatttgtctctcagttctccaattgaataaatgctttca

SEQ ID NO: 227116 - DNA, 75 bp, Artificial Sequence
  Synthetic
catattgccttataatcactctcagacatcaatgattggtcgaaatcctcaattaaatgattggataattctgac

SEQ ID NO: 227117 - DNA, 75 bp, Artificial Sequence
  Synthetic
attatcaacttcaggtgcactgggttttcaacaactctttgaagatcatttatgtcacctgtgttgaccttatca

SEQ ID NO: 227118 - DNA, 75 bp, Artificial Sequence
  Synthetic
gacttcacatcatccaattttttgtacctctccatgacagatctcactgagtccctgatttcttcaagatgagag

SEQ ID NO: 227119 - DNA, 75 bp, Artificial Sequence
  Synthetic
gaagcattgccatcaatcaacacctcatctaattcctcgataggcaccccttcatcagaaccctttgcattgccg

SEQ ID NO: 227120 - DNA, 75 bp, Artificial Sequence
  Synthetic
atgacaagacttgctataactctcatgatcttataatcatactcttctttgctgagaaaatacttgctcttcctc

SEQ ID NO: 227121 - DNA, 75 bp, Artificial Sequence
  Synthetic
tcaaatgtttctgacagttggcacactgcagcggcaaccaacttatcgtaatcatagtttaaaaccctttcaccg

SEQ ID NO: 227122 - DNA, 75 bp, Artificial Sequence
  Synthetic
tcaacatatttgtttacaaccacactcttattgctagccaaatccattgcagttgcgcagccactaagaattaga

SEQ ID NO: 227123 - DNA, 75 bp, Artificial Sequence
  Synthetic
ggatccttaatttcgcccctaaattcttgtttgctaaagagggcaccattattgaatgacgatgttactaaggac

SEQ ID NO: 227124 - DNA, 75 bp, Artificial Sequence
  Synthetic
attattttctttgagatgcctggtttcttaaactgtacgtcacctaagtcagtgcatgacgccttacctaagaat

SEQ ID NO: 227125 - DNA, 75 bp, Artificial Sequence
  Synthetic
gaggccccactcattagtaaacttgataattcttcagtctctgccatttctgagggattaacattgacagaatca

SEQ ID NO: 227126 - DNA, 75 bp, Artificial Sequence
  Synthetic
aattccaacttcggttctaggtatttctcaaaacatttaatctgatctgttagtctatctggtgtctccttagtt

SEQ ID NO: 227127 - DNA, 75 bp, Artificial Sequence
  Synthetic
ataaagtgacagatataagacacattaagaacaaatttgaatctattagtcagcatggaactaattgtaggattg

SEQ ID NO: 227128 - DNA, 75 bp, Artificial Sequence
  Synthetic
aggactttacagagtaaagctcttaatactctgaagaggaagaactcaacttttgttatcagtttctcctcgagt

SEQ ID NO: 227129 - DNA, 75 bp, Artificial Sequence
  Synthetic
ttgccaaggagatcattgtgatgatactctgaaacatatgccatcacaaaatacctcaggttctggagaaacttt

SEQ ID NO: 227130 - DNA, 75 bp, Artificial Sequence
  Synthetic
tgagatctcttacttgggtgagtcaaaaccaatataaacaccatcttcaacaacacttcaatgtcctttatgtca

SEQ ID NO: 227131 - DNA, 75 bp, Artificial Sequence
  Synthetic
gatttcagttctaaacagtcactaagccagctcatcatcacttttatagtttcagtaatgacagactgagaaaaa

SEQ ID NO: 227132 - DNA, 75 bp, Artificial Sequence
  Synthetic
atggccggaaaaaacctcttaggatcagcataaaaggaacagatctcacccttgtgagagttgttaatcgcatag

SEQ ID NO: 227133 - DNA, 75 bp, Artificial Sequence
  Synthetic
cactttgaacactctccagttttttggtacaacaatctgaatctactaccagccatgtaaaactcttgacagtaa

SEQ ID NO: 227134 - DNA, 75 bp, Artificial Sequence
  Synthetic
gcttctttacaaatcacccttttgaacctggcagaccccttttcattttgcctcaatttgacaactgaagatgtt

SEQ ID NO: 227135 - DNA, 75 bp, Artificial Sequence
  Synthetic
ttcattgagttaacaatggccaatgagatgcttgaaagtcgttttaaatcatcatctgtctcaaatgctgggtcc

SEQ ID NO: 227136 - DNA, 75 bp, Artificial Sequence
  Synthetic
agtttgtatggaaagtcacttagatcatttctctcataattgatagatggcatggggccctctacctcaaccccc

SEQ ID NO: 227137 - DNA, 75 bp, Artificial Sequence
  Synthetic
attatcttctcaaaacttgaagaagtgagaatgctctctaaaacaccgtaatcagaaaactttaaattcacaatt

SEQ ID NO: 227138 - DNA, 75 bp, Artificial Sequence
  Synthetic
aatagagcctctctagccttccttaaagtagagtcaacaaggtcatgatacactaaactcaagcttccatgagca

SEQ ID NO: 227139 - DNA, 75 bp, Artificial Sequence
  Synthetic
aatcctgctttttttacctggtttaaccttctcctctccatccattgatgtaattccctctttgttgcagccagt

SEQ ID NO: 227140 - DNA, 75 bp, Artificial Sequence
  Synthetic
gacacaagtctatcattcacactcaaaaatgatgtgccaagccactctgatttctcaaactgtccagttacttcc

SEQ ID NO: 227141 - DNA, 75 bp, Artificial Sequence
  Synthetic
ttgtcaatagcatggcatagaagtattatcgaatcaaacaacaacaatgtctttcttctagtgttcaatatgtgg

SEQ ID NO: 227142 - DNA, 75 bp, Artificial Sequence
  Synthetic
agacttttcaccttgtttaatagtgacctccaggctgggacacaactctgcttagattctatttgatcaatgtcg

SEQ ID NO: 227143 - DNA, 75 bp, Artificial Sequence
  Synthetic
tcaatgtctgcataaagcagtgttatggttggggaaagtttaagaaattctctcttcaattccaatacaccctct

SEQ ID NO: 227144 - DNA, 75 bp, Artificial Sequence
  Synthetic
gcctcaactccatagtctgatggatacatcttgcagaaggagtttaataactcagatttttctacccttttgaac

SEQ ID NO: 227145 - DNA, 75 bp, Artificial Sequence
  Synthetic
tgtctagctatttgaccagaatttagaccattcctgaaggcctgatactcattaataatttctctcttgacatcc

SEQ ID NO: 227146 - DNA, 75 bp, Artificial Sequence
  Synthetic
atagggctcatggaattgtctatccccatgtgacacagttttagaatttcctcatggtgatttgccctacagtca

SEQ ID NO: 227147 - DNA, 75 bp, Artificial Sequence
  Synthetic
tggaggatatttaggttctctattccagaccttttgccttcaacatttctcaatgattcacaaagcctgctatat

SEQ ID NO: 227148 - DNA, 75 bp, Artificial Sequence
  Synthetic
tctgattcttccaacattcttgatgactcctgggcaaactgaaggagtgaaaaaagtatggatctgaatctttcg

SEQ ID NO: 227149 - DNA, 75 bp, Artificial Sequence
  Synthetic
tttgcccattcaggcatgaaggtgtggtcgaaaactgttctcccgtcaatgatgggaagtaaagtaattcccaca

SEQ ID NO: 227150 - DNA, 75 bp, Artificial Sequence
  Synthetic
ctctgcaaatcctgttttagggaacttagttttattgaatcttcattgtacttctgttcaaaattagagggtgag

SEQ ID NO: 227151 - DNA, 75 bp, Artificial Sequence
  Synthetic
ctcctgacaaagcattctagcaacactagaacattcccagtcaacttgaagccgtctggtacaacaaaaggtaaa

SEQ ID NO: 227152 - DNA, 75 bp, Artificial Sequence
  Synthetic
ccaggactcagtatacctctactaagtaagattacttcaacactggactcctctgtgttgtgttcacacccattg

SEQ ID NO: 227153 - DNA, 75 bp, Artificial Sequence
  Synthetic
gcctcacaactatctaattctatgcataaggaaagcaatttgagaccttcaatcagtaggttctggggctcagac

SEQ ID NO: 227154 - DNA, 75 bp, Artificial Sequence
  Synthetic
tggattaggaagttcagcttttgtttagacaacctctgatcattggccaaatattttgaaatcaggtcttttgct

SEQ ID NO: 227155 - DNA, 75 bp, Artificial Sequence
  Synthetic
tcggatacacttgactccatggttagagacacatgcgagggtcaggggatgcacgtggggaagtggactcaagga

SEQ ID NO: 227156 - DNA, 75 bp, Artificial Sequence
  Synthetic
tgagcatataaagaaaacaccatcaaccaaacagacacacaatgattgatcaataaacactgtcaaatgcctagg

SEQ ID NO: 227157 - DNA, 75 bp, Artificial Sequence
  Synthetic
gaaaacaccatcaaccaaacagacacacaatgattgatcaataaacactgtcaaatgcctaggatcctcggtgcg

SEQ ID NO: 227158 - DNA, 75 bp, Artificial Sequence
  Synthetic
cgcaccggggatcctaggcatttttggacgcgctttgcaaaccactcatttgatagtggggtgccaataaaaatg

SEQ ID NO: 227159 - DNA, 75 bp, Artificial Sequence
  Synthetic
ggacaaataatcaccttctttcaggaggtgccacacatcatagaagaagtgatgaacatagtcctcatcactctg

SEQ ID NO: 227160 - DNA, 75 bp, Artificial Sequence
  Synthetic
tcccttcttgcaatactcaaaggaatttacaacctggcaacatgtggactgttaggtttgatttcatttttattt

SEQ ID NO: 227161 - DNA, 75 bp, Artificial Sequence
  Synthetic
ctctgtgggaggtcatgcacaatggtatacaaggacaactatgctctgaacagtgtggagctcgacatgtccact

SEQ ID NO: 227162 - DNA, 75 bp, Artificial Sequence
  Synthetic
ttgaattatacaatgccgttgtcctgttctaagaacaacacccatcattacattcagacctacaatgattccggc

SEQ ID NO: 227163 - DNA, 75 bp, Artificial Sequence
  Synthetic
ttggagcttacattgacaaacaattccattttgagtcataagttctgcaatctctctgatgcacacaaaaggaac

SEQ ID NO: 227164 - DNA, 75 bp, Artificial Sequence
  Synthetic
ctgtatgatcacacccttatgtccatagtaacaactttccacctaagcattccaaacttcaatcagtatgagtct

SEQ ID NO: 227165 - DNA, 75 bp, Artificial Sequence
  Synthetic
atggcctgtgactttaatggcgggaagataactgttcagtacaatttaagtcactcatcaccaactgatgcagca

SEQ ID NO: 227166 - DNA, 75 bp, Artificial Sequence
  Synthetic
aaccactgtggtacagttgcaaatggtgtcctagacacattcagaaggatgcattggggaccagcacattttccc

SEQ ID NO: 227167 - DNA, 75 bp, Artificial Sequence
  Synthetic
aacccccccttcaccattggaggggtttcgtgcatccagacaagctatcagtacctcatcattcagaacacaaca

SEQ ID NO: 227168 - DNA, 75 bp, Artificial Sequence
  Synthetic
tgggaagatcattgccaaatgtcaaggcccacacccatgggctacttatcactgatagcacagagaacaagacaa

SEQ ID NO: 227169 - DNA, 75 bp, Artificial Sequence
  Synthetic
ctatacatttcaagaagactaatggggacctttacctggaccttgtctgattctgccgggaatgatctgcctgga

SEQ ID NO: 227170 - DNA, 75 bp, Artificial Sequence
  Synthetic
ggttactgcctacagaggtggatgttgattgaggctgagatgaagtgttttggcaacactgctgtagctaaatgc

SEQ ID NO: 227171 - DNA, 75 bp, Artificial Sequence
  Synthetic
aatcaacagcatgatgaggagttttgtgatatgctgagactgttcgatttcaacaaagaagcaattagaagactg

SEQ ID NO: 227172 - DNA, 75 bp, Artificial Sequence
  Synthetic
aaagttgaggcagagagaagcatcaaccttatcaacaaagcagtgaattcccttattaatgatcagctgataata

SEQ ID NO: 227173 - DNA, 75 bp, Artificial Sequence
  Synthetic
agaaaccacctgagggatctaatgggtataccttactgcaactactcaaagttctggtacctaaatgacacaagg

SEQ ID NO: 227174 - DNA, 75 bp, Artificial Sequence
  Synthetic
aacggaaagacatctctgccaaaatgttggaaagtttcgaacaactcttaccttaatgaaacccacttttcaaat

SEQ ID NO: 227175 - DNA, 75 bp, Artificial Sequence
  Synthetic
gaaattgaggaggaggccaacaatatgataacagaaatgctcagaaaggagtatgagaagagacagagtacaact

SEQ ID NO: 227176 - DNA, 75 bp, Artificial Sequence
  Synthetic
ccccttggtttggtggacctctttgtattctcaacctctttctacttaattagtgtgtttcttcacctaataaag

SEQ ID NO: 227177 - DNA, 75 bp, Artificial Sequence
  Synthetic
atccctacacacagacacattgttggcaagggctgccccaaaccccacagattgaatcacatggcggtttgtagc

SEQ ID NO: 227178 - DNA, 75 bp, Artificial Sequence
  Synthetic
tgtggtgtttttggccaaccaggacttcctgtgagatggaagagatgaggacccagggggcccccgtgacccacc

SEQ ID NO: 227179 - DNA, 75 bp, Artificial Sequence
  Synthetic
gccttatggcggtgggtcacgggggcgtcccctttacaggacgactctcggtgatgctgttctgaacactagatc

SEQ ID NO: 227180 - DNA, 75 bp, Artificial Sequence
  Synthetic
cttagaaagcacagcccttagttgtggaagtttcacgttcccaactgttgcggcttcatacatcaagcaatccat

SEQ ID NO: 227181 - DNA, 75 bp, Artificial Sequence
  Synthetic
tagggcacaatgtggagttatctcctctttcccacctctcttcttcttttcaactacaatcccagtgtgcatttt

SEQ ID NO: 227182 - DNA, 75 bp, Artificial Sequence
  Synthetic
gcacaagggcttgtagtggtcccaaatttcgtcttcgaatttcctggcttcaggctttgtcatcccaacatcaat

SEQ ID NO: 227183 - DNA, 75 bp, Artificial Sequence
  Synthetic
cagcttgatgtcccttcttccctgagactccaagagcttcctgatgtcatctgccccctgacaggtgagaaccat

SEQ ID NO: 227184 - DNA, 75 bp, Artificial Sequence
  Synthetic
gttcttaggtagactctctaacacagcgctagtaagtccaggctgaacattgaaaaggtcttgaatgtccagacc

SEQ ID NO: 227185 - DNA, 75 bp, Artificial Sequence
  Synthetic
atgagaatgtttggaatcctgtttaaactgttttaaatctgtcggttcacgatagaaatggatataatgtccatt

SEQ ID NO: 227186 - DNA, 75 bp, Artificial Sequence
  Synthetic
tgcgggttgaagaatggctatctcaacagggtcctcagccctcccttcaatgtcaatccaagttttggcatttgg

SEQ ID NO: 227187 - DNA, 75 bp, Artificial Sequence
  Synthetic
gtccagctgcagcatagaatcctttagctccatgacttgagaataggtcagtgcagtggggaagccctgtgcctg

SEQ ID NO: 227188 - DNA, 75 bp, Artificial Sequence
  Synthetic
tgctagcctggtgccaccaggcaaggcgggtttgctctccggcgggctgttccctcccaagtcaacagctgtgtt

SEQ ID NO: 227189 - DNA, 75 bp, Artificial Sequence
  Synthetic
gtcccaggctctccccaggatagaggttcttgaggcgatgtagggccagccatcacctgaaagacacaatttgta

SEQ ID NO: 227190 - DNA, 75 bp, Artificial Sequence
  Synthetic
caagaggttttcatatggattcctatctcctggtgcttcagatatgaacattccaagtgaccttttaaccttcaa

SEQ ID NO: 227191 - DNA, 75 bp, Artificial Sequence
  Synthetic
cacagctttcagaatgtcctggatattcttggggctgactctgatggtttcaagcatattccccccgtctagtaa

SEQ ID NO: 227192 - DNA, 75 bp, Artificial Sequence
  Synthetic
acttgcacctgccttgacagctgcactcaagctgaagttgtacccagagatgttgatggcgcttctattaacatc

SEQ ID NO: 227193 - DNA, 75 bp, Artificial Sequence
  Synthetic
tatcaaattgagaacaggatgagtttgagctaatttgtccagatctgatgtatttgggtactttgctgtatacac

SEQ ID NO: 227194 - DNA, 75 bp, Artificial Sequence
  Synthetic
taaccctaaatcactaagggactggatgacatcgtttaagtcaacctgaccctgtttgcacatgcatgcaacagt

SEQ ID NO: 227195 - DNA, 75 bp, Artificial Sequence
  Synthetic
caagcttggcatggtgccgaactgattattgagtagttccgggtttctcacatcccacactctcactatgccatc

SEQ ID NO: 227196 - DNA, 75 bp, Artificial Sequence
  Synthetic
acccctcactgctggatttgggcctctctgccccatgccgatcatctggaggagggccttcctttggtccagctg

SEQ ID NO: 227197 - DNA, 75 bp, Artificial Sequence
  Synthetic
ttgagctgttagattccccatgtagattccggctgttaagggcctttcagatctagtgatttttgatttgagttt

SEQ ID NO: 227198 - DNA, 75 bp, Artificial Sequence
  Synthetic
ttcaagatctgcagcaagtatcagaaggtcatccgatgataatgtccccacacgtaggacattcttctgttgtga

SEQ ID NO: 227199 - DNA, 75 bp, Artificial Sequence
  Synthetic
agacttgagctcaacaagattgttaactgcttggtttaagtccctcagcctcttgagatctgagtcgtctctctt

SEQ ID NO: 227200 - DNA, 75 bp, Artificial Sequence
  Synthetic
ttcctttctcatcagtctttggacattgctaacctctgagaagtctaggccatgtaagagtgcttgcgcatcttt

SEQ ID NO: 227201 - DNA, 75 bp, Artificial Sequence
  Synthetic
aatgacctgcactttgacatttgaacaaaatcctgacagttcccttctaagggactgggtccacaaaaaggactt

SEQ ID NO: 227202 - DNA, 75 bp, Artificial Sequence
  Synthetic
gacttctttagaattgctcatgtttcggaatagttttccaatatgcgcaaccaaagtagcctaggatccactgtg

SEQ ID NO: 227203 - DNA, 75 bp, Artificial Sequence
  Synthetic
cttctttagaattgctcatgtttcggaatagttttccaatatgcgcaaccaaagtagcctaggatccactgtgcg

SEQ ID NO: 227204 - DNA, 75 bp, Artificial Sequence
  Synthetic
cgcaccggggatcctaggcaagtttgatgctcatttgagtggaatctagccagctaggtgcctatttcaccaccc

SEQ ID NO: 227205 - DNA, 75 bp, Artificial Sequence
  Synthetic
acactctgagggagcctcaagcagaacttgtctgcaaaactccctctaccattcacaatggggaaagcccagtcc

SEQ ID NO: 227206 - DNA, 75 bp, Artificial Sequence
  Synthetic
aaacaaaaccacatagcccaaggctctgagcccaggacggagctgatacctgacgcctcaggctatgggcctgag

SEQ ID NO: 227207 - DNA, 75 bp, Artificial Sequence
  Synthetic
ttctgcaaaagctgctggtttgagagaaggggtcttgtcaaatgttatgaccattatttatgcatgaattgtctg

SEQ ID NO: 227208 - DNA, 75 bp, Artificial Sequence
  Synthetic
acattgcttcttacaatctccgacagatgcccaatctgcaagtatcctctgccaacaaaactgcagatcaacaaa

SEQ ID NO: 227209 - DNA, 75 bp, Artificial Sequence
  Synthetic
acaccaaccgctcccaaagagtcggccagcaatcccccgccgtacagtccctgaacccacccaaccacaaacctc

SEQ ID NO: 227210 - DNA, 75 bp, Artificial Sequence
  Synthetic
cacccaccccaagctcccccccgggggggccccccgccggggtcccccccgggggaaagacggctgagcccaccg

SEQ ID NO: 227211 - DNA, 75 bp, Artificial Sequence
  Synthetic
actgaggctagtcaatatcctgcacctccctgacctcctcaaacagtttatcacactgcctccctttcaatctgt

SEQ ID NO: 227212 - DNA, 75 bp, Artificial Sequence
  Synthetic
atttaccctgtgaactgtgtaccattatgtcacctaaagttttgctaaagcacaaattgtaaccattaaagccca

SEQ ID NO: 227213 - DNA, 75 bp, Artificial Sequence
  Synthetic
accattcacatacatcctgtagagcatctttaagaaacactttataatcattgggcctgcactttttgacaaccc

SEQ ID NO: 227214 - DNA, 75 bp, Artificial Sequence
  Synthetic
caaccaggtccagttccaaccagtgcaaaccttgatcaagcctctgtctcaaaatgttcccaaccactatagggg

SEQ ID NO: 227215 - DNA, 75 bp, Artificial Sequence
  Synthetic
gtgagttaacacaactcccatccatttctgaaatcaacacctccatgtcttgatcatgaatactcgggtttattg

SEQ ID NO: 227216 - DNA, 75 bp, Artificial Sequence
  Synthetic
gtaaaattttcttcctgccttcaatcaagtagccatcctccacaaccagaggcaggggctcaggatttggtccta

SEQ ID NO: 227217 - DNA, 75 bp, Artificial Sequence
  Synthetic
cgtgcacaaaatcatattcggtgaggcctgtaacattctcacttagtttaacattgagcctaactacctgcccaa

SEQ ID NO: 227218 - DNA, 75 bp, Artificial Sequence
  Synthetic
ttgatttgggatcctcaagaaattctgataggttgtcagcatcaactatccacacaggctccggcttacaaaact

SEQ ID NO: 227219 - DNA, 75 bp, Artificial Sequence
  Synthetic
gatcagtgttcaataccaacctccaacaatccaataacagagacctgtgcacttgaccactatatagcacttcta

SEQ ID NO: 227220 - DNA, 75 bp, Artificial Sequence
  Synthetic
acctacttaacacaaaggaacctgtgtggtctatcatgccccatgttttgacatgaaacgcaaattcttcactca

SEQ ID NO: 227221 - DNA, 75 bp, Artificial Sequence
  Synthetic
gggtctcccctttactcttaatcgtaaagaaaaccgaaaatgtgagttgagtggatctactcggcaatgattgga

SEQ ID NO: 227222 - DNA, 75 bp, Artificial Sequence
  Synthetic
gagcctcccaaaattcatctaaagacgcaaactgctgatcaagagtgatgccagaagctataagctggtttagat

SEQ ID NO: 227223 - DNA, 75 bp, Artificial Sequence
  Synthetic
ttagataagctggtttaatcaccatatccatccaagagaatcccatatataggtctgatttaaacattggccttt

SEQ ID NO: 227224 - DNA, 75 bp, Artificial Sequence
  Synthetic
caacacctttataaatcaccttttctacaaatgatgcaaatggaccaagaagattcagtccctcagaagcaggga

SEQ ID NO: 227225 - DNA, 75 bp, Artificial Sequence
  Synthetic
gcgatgtcttatgaggaaaccaggtaaatgatcctaatgttctgctagttgcaacaaaaggcctaatgaaggact

SEQ ID NO: 227226 - DNA, 75 bp, Artificial Sequence
  Synthetic
cgaaaaagatttgtcttaagaagttctttgccacatcttcagtacttaccaccctttcctctgttaaagacatgt

SEQ ID NO: 227227 - DNA, 75 bp, Artificial Sequence
  Synthetic
gagatcgatcatgagcttctgacaactctgatgacagaacaatatagtactcctctcttttccacttgacaacat

SEQ ID NO: 227228 - DNA, 75 bp, Artificial Sequence
  Synthetic
ggctaatgagagacattgcttcacaattgacatccaaaacaacacataagtcaagaaattttattctgggagacc

SEQ ID NO: 227229 - DNA, 75 bp, Artificial Sequence
  Synthetic
acttcatttttgttgaagccaaatcactcataaaaggtaacaaatgcttttcaaatagtgatggatataaccttc

SEQ ID NO: 227230 - DNA, 75 bp, Artificial Sequence
  Synthetic
taaatgaatgtataatatggttgaacccaactttatcctccagcaactttgtgattgtaggttttaaggggaagt

SEQ ID NO: 227231 - DNA, 75 bp, Artificial Sequence
  Synthetic
aatcacaaggtttgaaatttattgcagggatttttgcctttagctttggctcacctaaaacccaaggtccaatct

SEQ ID NO: 227232 - DNA, 75 bp, Artificial Sequence
  Synthetic
ctaatgcacaagagagggcaatacacatgtaatcccacaacactggcctgagaaattttataagccagtcatttg

SEQ ID NO: 227233 - DNA, 75 bp, Artificial Sequence
  Synthetic
aacatctctgacagacagggacagaccacagattcatacccttcaaaataaaccccttcacatcagttcgccctt

SEQ ID NO: 227234 - DNA, 75 bp, Artificial Sequence
  Synthetic
caagttggcttacaattgacttaataaagtagttggacttatcaaagccccttacacatttactccccaatgtct

SEQ ID NO: 227235 - DNA, 75 bp, Artificial Sequence
  Synthetic
tgcataacccaacaaaccctgaagcaatgctactttgaaatgcactcttgtttattgcctctgataggagttttt

SEQ ID NO: 227236 - DNA, 75 bp, Artificial Sequence
  Synthetic
gtgctcccctagtaaagttggaagagagcttgttctgaagagttttgactagggttggtaatttttcctcttcaa

SEQ ID NO: 227237 - DNA, 75 bp, Artificial Sequence
  Synthetic
gattcaaggcacctgtgtaaataactttctgccttaacaccattctcaaagggaagtaggcagagaggtttagcc

SEQ ID NO: 227238 - DNA, 75 bp, Artificial Sequence
  Synthetic
aacacagacttaactctgactcttctaaagggtctacattaagtagtgaacaaattttttgtaacgactcactag

SEQ ID NO: 227239 - DNA, 75 bp, Artificial Sequence
  Synthetic
gatctccagataggtaagcagctgtgaattcttcatgtaattcaccagttttaagtttattgtaaagtcttctaa

SEQ ID NO: 227240 - DNA, 75 bp, Artificial Sequence
  Synthetic
ggaagtacctaactttctttgttccacctgggcaaagttgctctatgttcctcatgattctataccccctattac

SEQ ID NO: 227241 - DNA, 75 bp, Artificial Sequence
  Synthetic
cgtcaacccaatctttcacatcggagtcacaatacatcaagaatgggtcaatcggatattgtgcatacctcagaa

SEQ ID NO: 227242 - DNA, 75 bp, Artificial Sequence
  Synthetic
gatctaaagttctctgttggattagattgcagagcttcacgggcaccccgtttgccacagactgatcaatgattg

SEQ ID NO: 227243 - DNA, 75 bp, Artificial Sequence
  Synthetic
tatcaatagtctccgccaactggtgcggttccttgcacttaacattgtgtaaagctgctgcaacaaacttcgtca

SEQ ID NO: 227244 - DNA, 75 bp, Artificial Sequence
  Synthetic
atagtggaacctcatcaccccagacataaaaccttgacttgaactcagcaacaaaccgccctattacactttttg

SEQ ID NO: 227245 - DNA, 75 bp, Artificial Sequence
  Synthetic
gactaataaatttgttcaatctgtcactcaagtaattatgaaattccaaaatgtattcaaattcatcagggtctc

SEQ ID NO: 227246 - DNA, 75 bp, Artificial Sequence
  Synthetic
tgtctagcagattagtcaacttatgatcaaataaggagatctgatcatcactggaagtatatgatttaagagtcc

SEQ ID NO: 227247 - DNA, 75 bp, Artificial Sequence
  Synthetic
cctcataaagtaagccgatagaatagttaataaatttttcagtgatcagtccatagaagtcggaggcattatgga

SEQ ID NO: 227248 - DNA, 75 bp, Artificial Sequence
  Synthetic
ggattccctgccccatgtctaaaattgagctgatgtgagagggcacaacaccaagtttaaagtgtctaaaaaaga

SEQ ID NO: 227249 - DNA, 75 bp, Artificial Sequence
  Synthetic
aagcttcagttagtgtttcatgtaatgatttcttcaaccctaagtttgttttaagataggacctcatcatggcat

SEQ ID NO: 227250 - DNA, 75 bp, Artificial Sequence
  Synthetic
tcacaactggatggggaacttctatcaatttatgtatgtgccaggagagcaatgtgctcacataatctctacttt

SEQ ID NO: 227251 - DNA, 75 bp, Artificial Sequence
  Synthetic
tcacatcctctaatatatccgaagaattccagtgaatgttctgtaagattacaaggaacaacagggggttcatca

SEQ ID NO: 227252 - DNA, 75 bp, Artificial Sequence
  Synthetic
taggtccccatttgctatgatctagactgtagcatacttgagccaatgatacattaagcttcattgacaacacag

SEQ ID NO: 227253 - DNA, 75 bp, Artificial Sequence
  Synthetic
cattttcaaactctgattcactatttaggcagctgcctctaaattgacctgtcaaagattcaaaataatcctcaa

SEQ ID NO: 227254 - DNA, 75 bp, Artificial Sequence
  Synthetic
tcagccttgtgaacattttggttcttaaatcaccaatataaagttctctattcccaccaacttgttccttataag

SEQ ID NO: 227255 - DNA, 75 bp, Artificial Sequence
  Synthetic
ataaggaaaatttcaatcttcctgtgtcaggaccaatagatgtgtatgactgtggagactcttgactataaaaac

SEQ ID NO: 227256 - DNA, 75 bp, Artificial Sequence
  Synthetic
ataagttctttaaaactgcagttgtacaattggtaagagaaagtgctttgctcaaagcctcagaattactttctc

SEQ ID NO: 227257 - DNA, 75 bp, Artificial Sequence
  Synthetic
tatcacttaatctgcaatcatccattaacctctctctatttaacttaaagtttatgcatttcgacttataatgac

SEQ ID NO: 227258 - DNA, 75 bp, Artificial Sequence
  Synthetic
tgtatttccctacaagtctattggcattcatctgcaacaaaatggacttgaaacacaagaaatattctgcatttt

SEQ ID NO: 227259 - DNA, 75 bp, Artificial Sequence
  Synthetic
cataggttctggttgtcactgccctggtgatctctgagatggcacatgagtccattggtcctaagtaaaagtatt

SEQ ID NO: 227260 - DNA, 75 bp, Artificial Sequence
  Synthetic
taccttttaactcatcgtttaaatagaccttctcacaaactgctttgtaatcatcatcagacatcaatgattggt

SEQ ID NO: 227261 - DNA, 75 bp, Artificial Sequence
  Synthetic
caaagtcttctattaaatggttggacagttctgacagaatcaatttcaagtgcattgggttgtcaacaactttgt

SEQ ID NO: 227262 - DNA, 75 bp, Artificial Sequence
  Synthetic
gtagatcatttatgtcaccagcgttcaccttaccaagtttttcatcacttaggcttttataactttccatcacag

SEQ ID NO: 227263 - DNA, 75 bp, Artificial Sequence
  Synthetic
ttctcactgactctttgatgtcctcaaagtaggaagaagcggcaccactaatcaatacttcatccagttcctcag

SEQ ID NO: 227264 - DNA, 75 bp, Artificial Sequence
  Synthetic
tggatatccctccatcagaagtctttgtactaccaatcactagacttgcaatcactttcataatcttgtagtcat

SEQ ID NO: 227265 - DNA, 75 bp, Artificial Sequence
  Synthetic
actcctctttacttagaaagtacttacttttcctctcgaatgtctccgataattgacatactgcagcagcaacaa

SEQ ID NO: 227266 - DNA, 75 bp, Artificial Sequence
  Synthetic
gtttgtcataatcatagtttagcaccctctcaccatcaacatacttatttataacaacacttttattgctggcta

SEQ ID NO: 227267 - DNA, 75 bp, Artificial Sequence
  Synthetic
ggtccattgcagttgcacaaccactaaggactaaaggatcctttatttcacccttgaattcttgtttactaaaaa

SEQ ID NO: 227268 - DNA, 75 bp, Artificial Sequence
  Synthetic
gagtgccattattgaatgatgatgtgactaaagacagtatctttttagagatacccggttttttaaattggatgc

SEQ ID NO: 227269 - DNA, 75 bp, Artificial Sequence
  Synthetic
cacccatttcagtacatgatgtcttacccaaaaaggcagccccgctcatcaataagctggacaactcagtggcct

SEQ ID NO: 227270 - DNA, 75 bp, Artificial Sequence
  Synthetic
ctgcgggttcaagggggttcacattgacggagtcaaattctaattttggctccaagtatttctcaaagcacttaa

SEQ ID NO: 227271 - DNA, 75 bp, Artificial Sequence
  Synthetic
tttgatctgtgagtctgtctggtgtctcttttgtaatgaagtgacaaatgtaagagacattgaggacaaatttaa

SEQ ID NO: 227272 - DNA, 75 bp, Artificial Sequence
  Synthetic
acctattcgtcaacattgtgttaatcgtagggttgagaaccttactaatcaatgttctcaaaactctaaaaagaa

SEQ ID NO: 227273 - DNA, 75 bp, Artificial Sequence
  Synthetic
aaaactcaacttttgttatcaatttttcctccaacttactcaaaaggtccttgtgataatattcagagacgtatg

SEQ ID NO: 227274 - DNA, 75 bp, Artificial Sequence
  Synthetic
ccataacaaagtatctcaaattttggaggaacttttgagatcttttgctcggatgggttaaaaccagtataaaga

SEQ ID NO: 227275 - DNA, 75 bp, Artificial Sequence
  Synthetic
tcatttttagcaatgcttcaatgtctctcaaatcctgctttaattctaaacaatcattcaaccagctcaccatca

SEQ ID NO: 227276 - DNA, 75 bp, Artificial Sequence
  Synthetic
ctttaatagtctcagatataactgactgcgaaaagatagctggaaagaacctcttaggatcagcataaaaggaac

SEQ ID NO: 227277 - DNA, 75 bp, Artificial Sequence
  Synthetic
agacctcacctttacgagaattgttaattgcataacattttgagcattctcctgtcttctggtacaacagtctaa

SEQ ID NO: 227278 - DNA, 75 bp, Artificial Sequence
  Synthetic
atctggtcccagccatgtaaaactcttggcagtaagcttccttacaaatcaccttcttaaacctctcggcacctc

SEQ ID NO: 227279 - DNA, 75 bp, Artificial Sequence
  Synthetic
tctcattttgtcttaatttgacaacagaggatgtcttcattgaattcacaattgccagtgaaatgcttgagagcc

SEQ ID NO: 227280 - DNA, 75 bp, Artificial Sequence
  Synthetic
cgcaccggggatcctaggcattttggattgcgctttgttgtggtcctttgttatactccacgattcgaggtgcca

SEQ ID NO: 227281 - DNA, 75 bp, Artificial Sequence
  Synthetic
ccgtactacacagaggggaccaatggggcagattgtaaccctctttgagtcactgcctcacattattgatgaggt

SEQ ID NO: 227282 - DNA, 75 bp, Artificial Sequence
  Synthetic
gatcaacattgtcatcatggtcctcattttaatcacagccataaaggcagtctacaacctctgcacatgtggctt

SEQ ID NO: 227283 - DNA, 75 bp, Artificial Sequence
  Synthetic
gtttgcgctgatcatgttcctgtttatggcaggcagatcatgttctctagaaggcccaggcatgtacaagggaac

SEQ ID NO: 227284 - DNA, 75 bp, Artificial Sequence
  Synthetic
ctatcagttcaagagtgttgagttgaacatgtcacaattcaaccagacactccctaacgcatgttctgtgaacaa

SEQ ID NO: 227285 - DNA, 75 bp, Artificial Sequence
  Synthetic
cagtcaccattacatcgggatgggtgactcgggtttggagctgacattcaccaatgactcaattattgaccacaa

SEQ ID NO: 227286 - DNA, 75 bp, Artificial Sequence
  Synthetic
ccagtgtaacctgactgattacttcaagaagtcccactttgatcatgtgctctctagtatcataactcatctgca

SEQ ID NO: 227287 - DNA, 75 bp, Artificial Sequence
  Synthetic
tctatcagtcagggggcatagctactataaagctgttagttgtgacttcaacaatggaataacaattcagtacaa

SEQ ID NO: 227288 - DNA, 75 bp, Artificial Sequence
  Synthetic
cttgagcatcaacactcctcaaaaggctgtggataactgcagatctttcagagggagggtgttagacatgtttag

SEQ ID NO: 227289 - DNA, 75 bp, Artificial Sequence
  Synthetic
aaccgcttttggagggaagcacatgagagcaggttttgggatgacagatgcaaatgggaaagccacttggtgcag

SEQ ID NO: 227290 - DNA, 75 bp, Artificial Sequence
  Synthetic
tcaaactgattacaactatttaatcattcaaaacaggacttgggataaccactgtgagtatgcaaatcccatggg

SEQ ID NO: 227291 - DNA, 75 bp, Artificial Sequence
  Synthetic
attcgccaggctcctatttgctcaagagaagaccaagttcctgacaagaaggttgatggggacattcacatggac

SEQ ID NO: 227292 - DNA, 75 bp, Artificial Sequence
  Synthetic
tctctcagacagctccggagtggaaagttcgtcaggttactgtctcacaaggtggatgataatagcagcagattt

SEQ ID NO: 227293 - DNA, 75 bp, Artificial Sequence
  Synthetic
gaaatgttttgggaacacagcagttgccaagtgcaacctaaatcatgatgaagagttctgcgatatgcttaaatt

SEQ ID NO: 227294 - DNA, 75 bp, Artificial Sequence
  Synthetic
aattgactataacaaggcagccttgacgaagttcaagaaagatgttgaatctgctttgcacctgtttaaagtgac

SEQ ID NO: 227295 - DNA, 75 bp, Artificial Sequence
  Synthetic
aatgaattccctcatatctgacaccctcctaatgaggaatcaccttagggatcttatgggaataccttattgcaa

SEQ ID NO: 227296 - DNA, 75 bp, Artificial Sequence
  Synthetic
ctactcaaaattctggtatctagaacattacaaaactggtgaaacaagtttacctaagtgttggctcgtgagtaa

SEQ ID NO: 227297 - DNA, 75 bp, Artificial Sequence
  Synthetic
tgggtcttatttaaatgagactcatttctcagatgagattgaacaagaagctaataatatgattacagaaatgtt

SEQ ID NO: 227298 - DNA, 75 bp, Artificial Sequence
  Synthetic
aagaaaggactactacaagaggcaaggatcaactccactggctctaatggatatattgatgttctctacatctgc

SEQ ID NO: 227299 - DNA, 75 bp, Artificial Sequence
  Synthetic
ctatctaatcagtgtcttccttcatctattgagaatcccgactcacagacacgtaaaaggcgggacatgtccaaa

SEQ ID NO: 227300 - DNA, 75 bp, Artificial Sequence
  Synthetic
gccgcaccgcctcaacagcaaagggatttgctcttgtggagcttttaaagttccaggtgtcaaggtgatctggaa

SEQ ID NO: 227301 - DNA, 75 bp, Artificial Sequence
  Synthetic
gaggaactaaccctgaacggacacccccctgacctcccacctctttcgaggtgggaggtcaggggggccggttgg

SEQ ID NO: 227302 - DNA, 75 bp, Artificial Sequence
  Synthetic
cttctagagattcacgatgtttggacctctatatatcaggtcatgtggtaatatgttgtggattcctttgagatc

SEQ ID NO: 227303 - DNA, 75 bp, Artificial Sequence
  Synthetic
gatgagctttgcttttgttgcagactcaaaaatcagacaatccatcaaagcacaatgcggtgtgatttccttttt

SEQ ID NO: 227304 - DNA, 75 bp, Artificial Sequence
  Synthetic
ctttttatccttgaccaccccagtgtgctttttgcaaagaaatccatatttgtcccaaactttatcttcgaactc

SEQ ID NO: 227305 - DNA, 75 bp, Artificial Sequence
  Synthetic
tcttgaggcatcttttgacatttcaatgtcaattagcttgatgtccttcctgccctgtgagtcaagcaatttgcg

SEQ ID NO: 227306 - DNA, 75 bp, Artificial Sequence
  Synthetic
gatgtcatctgaaccctggcatgacagaaccatgccaggtggcagtgcaccaaggacagcagacgtcagacctgg

SEQ ID NO: 227307 - DNA, 75 bp, Artificial Sequence
  Synthetic
ttggacatcaagtaggtcagcaatgtccatcccatgagaaaacttggagtcctgtttgaattgtttctgatccac

SEQ ID NO: 227308 - DNA, 75 bp, Artificial Sequence
  Synthetic
aggctccctgtaaaagtgaatatattgcccatttccaggttggaagaaggcaatttccactggatcgtcatgcct

SEQ ID NO: 227309 - DNA, 75 bp, Artificial Sequence
  Synthetic
accctcaatgtccacccaggttggggcatttggatcaatcccccccatcaagtctttcaacaacatgatttggga

SEQ ID NO: 227310 - DNA, 75 bp, Artificial Sequence
  Synthetic
gtagcctaagcccactgctggaggccctgcagatcctgggttcatcctcactggtgtatttctattcttgtctcc

SEQ ID NO: 227311 - DNA, 75 bp, Artificial Sequence
  Synthetic
actcatgtcaattgttgtgttctcccatgccctcccagtgatgcccgttctgcaggcgatgtagggccacccctc

SEQ ID NO: 227312 - DNA, 75 bp, Artificial Sequence
  Synthetic
tcctgaaagacaggttttgtagagtatgttctcataaggattcctgtctcctgactgttcagacacaaacatccc

SEQ ID NO: 227313 - DNA, 75 bp, Artificial Sequence
  Synthetic
aagctttttcttggctgataaaattgccttcagcaggtcatctgtgttattaggcttgatttgtatagtttcaag

SEQ ID NO: 227314 - DNA, 75 bp, Artificial Sequence
  Synthetic
catgttgcccccatcgaggagtgaagcacctgccttcacagctgcatttagactaaaattgtatccagatatatt

SEQ ID NO: 227315 - DNA, 75 bp, Artificial Sequence
  Synthetic
tatcccagactgctgctctgtcactatccccaacactggatgcttctcccttagtttttccaggtcagtgaggtt

SEQ ID NO: 227316 - DNA, 75 bp, Artificial Sequence
  Synthetic
gggatatttgactgtataaagcaatcccaggtctgtcagtgcttgcacaacatcattgagaggtgtctgtgactg

SEQ ID NO: 227317 - DNA, 75 bp, Artificial Sequence
  Synthetic
tttggccatgcaagccattgtcagagagggcatggttccaaactgattgttaagtaaggaggagtctttgacatc

SEQ ID NO: 227318 - DNA, 75 bp, Artificial Sequence
  Synthetic
ccacactctcactacaccatttgatcttgggttctctcgactcatccccaccatttgcaagatttgtgatctttg

SEQ ID NO: 227319 - DNA, 75 bp, Artificial Sequence
  Synthetic
atctagttgttgagtggtgaggttccccaagtagaccccacttacctgtggcctctcagatctcaagaccttcag

SEQ ID NO: 227320 - DNA, 75 bp, Artificial Sequence
  Synthetic
cttgagtttctccaagtcagcagcaagtgacatcaactcttcggcagtgagtcttcctatcttcaaaacattctt

SEQ ID NO: 227321 - DNA, 75 bp, Artificial Sequence
  Synthetic
tttcgttgaagatttgagctcaaccagagagttgacggtctgatttaaactgcgaagcctctgtagatctttgtc

SEQ ID NO: 227322 - DNA, 75 bp, Artificial Sequence
  Synthetic
gtctcttttgtccttcctcattattctctgaacgttgctgacttctgcaaagtctaacccattcaacaagtttgt

SEQ ID NO: 227323 - DNA, 75 bp, Artificial Sequence
  Synthetic
ggcatctcggatcacagctgctttcacatttgaagtgaaactctggagctctctcctgaggcattgagtccactg

SEQ ID NO: 227324 - DNA, 75 bp, Artificial Sequence
  Synthetic
gaagctcttcacttccttggattgtgccatcttcagcaagccaactatgagctaatctttctcccacaaagtagg

SEQ ID NO: 227325 - DNA, 75 bp, Artificial Sequence
  Synthetic
ctatgagctaatctttctcccacaaagtaggtcaaagaaactgcgctctaattcgcctaggatccactgtgcgcg

SEQ ID NO: 227326 - DNA, 75 bp, Artificial Sequence
  Synthetic
cgcaccggggatcctaggctttttggtttgcgctttgaaccagttgctatggggcaggtgaaatcacggaaagac

SEQ ID NO: 227327 - DNA, 75 bp, Artificial Sequence
  Synthetic
cccaagcagggagtgagtgaagttcagcgttgtgacctgattcccaattccgcagacattggtcctgcttattgc

SEQ ID NO: 227328 - DNA, 75 bp, Artificial Sequence
  Synthetic
aagtcatgctggatgaaggcagatggtcttacactgtgttatgaccattacctctgcagagaatgtctaaatctc

SEQ ID NO: 227329 - DNA, 75 bp, Artificial Sequence
  Synthetic
cttctctctgtgtctgaccgctgccctatctgcaagcacactctgccaacaaaactcagagtggcagccaccccc

SEQ ID NO: 227330 - DNA, 75 bp, Artificial Sequence
  Synthetic
tccgctccgccaccaccatacagcctctgagaagacacacacaggcccgagcagagccacgccccaagaggcaca

SEQ ID NO: 227331 - DNA, 75 bp, Artificial Sequence
  Synthetic
caaacacacagacacacacaaacaaacgacacaccacacagacacacacacacacacacacccccagcagggggg

SEQ ID NO: 227332 - DNA, 75 bp, Artificial Sequence
  Synthetic
ccccccacggggggcccccccagggggcgtgctccccgcccgcccagcgcaggggtccgtcactctatttcctcc

SEQ ID NO: 227333 - DNA, 75 bp, Artificial Sequence
  Synthetic
tgcactgcctccaccagccagtcatcacaggactttcccttcaatctaaatctccctatagatgtttcatacatt

SEQ ID NO: 227334 - DNA, 75 bp, Artificial Sequence
  Synthetic
attgtctctttggccttgctgtagcataaactggtgtccctaaaacggaaccagtcagtcacctctttcagaggg

SEQ ID NO: 227335 - DNA, 75 bp, Artificial Sequence
  Synthetic
tctatgagggtgtgttttgctatttgggcgtctctcagaactagctgaatgtctacatccataagatgttctcct

SEQ ID NO: 227336 - DNA, 75 bp, Artificial Sequence
  Synthetic
gttttaaatctatgtttaaaaagtgccgccagagacacagactgtgtggggtgcccttcagtttctacaaggaag

SEQ ID NO: 227337 - DNA, 75 bp, Artificial Sequence
  Synthetic
atgagaaagtctttattccccagtgcaaggctcaagggttgcaccagcatgcaaccctcatacaagttcccgttt

SEQ ID NO: 227338 - DNA, 75 bp, Artificial Sequence
  Synthetic
ttgatggatagaggaacaggctcccattcaggacccactctttggaagtcatcagatgtaacatcctttaggatt

SEQ ID NO: 227339 - DNA, 75 bp, Artificial Sequence
  Synthetic
gcatcagaattagtaataacgagctccacaatacaccccaaagacagaggatctttcacatactcctggaactca

SEQ ID NO: 227340 - DNA, 75 bp, Artificial Sequence
  Synthetic
tcagaccttaagtccaacctcacattgttccctttgaacatcatatctgttctcagaagacacaagcactcatca

SEQ ID NO: 227341 - DNA, 75 bp, Artificial Sequence
  Synthetic
agcagtcttctgtccacatctccttggaaatagtaagtgcaatctaacattctagactgtcccacatctgttact

SEQ ID NO: 227342 - DNA, 75 bp, Artificial Sequence
  Synthetic
tggcacttaatttgaaacgatatagaaaacttccttaagcaactccctccactttgattgtgcgtgaagttgact

SEQ ID NO: 227343 - DNA, 75 bp, Artificial Sequence
  Synthetic
gaaaaattgagttgaagaattccacttgtgttttctatgacatagttccaaaactctgtcataccattgaataag

SEQ ID NO: 227344 - DNA, 75 bp, Artificial Sequence
  Synthetic
tgtgtctctgtgagtcctatctgtaccagttgggcaagagcacagatgatatcactaaattgataagaaaaccac

SEQ ID NO: 227345 - DNA, 75 bp, Artificial Sequence
  Synthetic
ccaaagccatgttgtaaatctgttctgtacattggtctctcaaaacccttattcacaactttgctgacaaacgtc

SEQ ID NO: 227346 - DNA, 75 bp, Artificial Sequence
  Synthetic
tggaaaggtcccagcaactcaattccatcatctgagggggtcatactcttatgagggaaccatgaaaaattgccg

SEQ ID NO: 227347 - DNA, 75 bp, Artificial Sequence
  Synthetic
attgtccttgatgtaattacaaactctctcacaaaagactcaaaaaacacttgctttaagaagttcctgcaaaca

SEQ ID NO: 227348 - DNA, 75 bp, Artificial Sequence
  Synthetic
tcactactactcaccacaaattcatcctttaaggatgtgtcttctctagaatggcaccttgctaaatccgaggtt

SEQ ID NO: 227349 - DNA, 75 bp, Artificial Sequence
  Synthetic
agaacaacataatgttcatccctcttgtatttgacaatatgtgaaattagagaaagacattccgagtggatgtct

SEQ ID NO: 227350 - DNA, 75 bp, Artificial Sequence
  Synthetic
attagcacacagaggtccaaaaactttatccttgggctccatttcatcattttggaactttgatcagacataaat

SEQ ID NO: 227351 - DNA, 75 bp, Artificial Sequence
  Synthetic
ggcaacagctggtcttcatagattttaggaaacaatctccgaactgactgaaggatatggttgagtgttacccta

SEQ ID NO: 227352 - DNA, 75 bp, Artificial Sequence
  Synthetic
tcttctaataacctaactcctgtgggtttcctaccaacatagtcatttaagttcatctggctagacataaaccca

SEQ ID NO: 227353 - DNA, 75 bp, Artificial Sequence
  Synthetic
tcctcaggaggtggtgaggggtctgcaatgacccagacaccaagctcaaaagaattgctcagtgtgatacagata

SEQ ID NO: 227354 - DNA, 75 bp, Artificial Sequence
  Synthetic
taatcccacaaaatgggtctcaagaagcatgttgaatcaattgctgggcagggtactgtggtgtttcctttattt

SEQ ID NO: 227355 - DNA, 75 bp, Artificial Sequence
  Synthetic
agtttgtatagtgtgatatcatgaaccttgctcagctccgctgacactctggcgtctttttccaactcagaaaca

SEQ ID NO: 227356 - DNA, 75 bp, Artificial Sequence
  Synthetic
accttctttatgtacagtgtttctttctctttgtttctgatgcaacggctacctagagtcttacagagtccaata

SEQ ID NO: 227357 - DNA, 75 bp, Artificial Sequence
  Synthetic
aaccctgatgatatacaactttggaaagcagacttattgattgcctctgccaatagcttctgagcacccctcgta

SEQ ID NO: 227358 - DNA, 75 bp, Artificial Sequence
  Synthetic
aatttggaactcagtttgttctgaagtgtctttaccaacgatggtagcctttcctcattaaagttcatgctggat

SEQ ID NO: 227359 - DNA, 75 bp, Artificial Sequence
  Synthetic
ggatatatgactttttgtctcaacaccatcctcattggaaactgttcgttgagattgagccagcagagatctccc

SEQ ID NO: 227360 - DNA, 75 bp, Artificial Sequence
  Synthetic
aatcctgtcaagtcttcagtgaggtccaataccttgcccaggtgctctataacttgtggtttatcacgattgaat

SEQ ID NO: 227361 - DNA, 75 bp, Artificial Sequence
  Synthetic
aaatccaccagaaattcttcactaagctcaccattctttaatttgtgatggagtcttctgaccagctttctcatg

SEQ ID NO: 227362 - DNA, 75 bp, Artificial Sequence
  Synthetic
acctttgtttgggaaggacacaatgtctcaatcaacctttgaattctgtatcccctggaaccatctagccaatcc

SEQ ID NO: 227363 - DNA, 75 bp, Artificial Sequence
  Synthetic
ttaacatcagtctgacaatttagcataaatggatcgattgggcagtttgcatactttaacagtgacaacgtgcgg

SEQ ID NO: 227364 - DNA, 75 bp, Artificial Sequence
  Synthetic
ctttgtatgcgatttaccagccttacaggtacaccgtttgctacagcctggtctagtattgtgtctattgtctca

SEQ ID NO: 227365 - DNA, 75 bp, Artificial Sequence
  Synthetic
caaagttggtgtggctctttgcacttcacattgtgcagtgcagcagaaacaaacttggtcaacaaaggcacttcc

SEQ ID NO: 227366 - DNA, 75 bp, Artificial Sequence
  Synthetic
tcaccccaaacataaaacctagatttaaattctgcagcaaaacgactcaccacactctttggactcacaaatttg

SEQ ID NO: 227367 - DNA, 75 bp, Artificial Sequence
  Synthetic
ttcaataaagcactcatgtggctgtggaattcgagcagaattaagacttcctctgggtcatcttctgccaaatta

SEQ ID NO: 227368 - DNA, 75 bp, Artificial Sequence
  Synthetic
ctgattcgctcatcaaaaagggttatctggtcatcactagatgtgtaggcatcaacagcttctccatatagaagg

SEQ ID NO: 227369 - DNA, 75 bp, Artificial Sequence
  Synthetic
gatatactgtagttaataaatctctcactcagaaggccataaaagtctgaggcattatgtaggatgccttgaccc

SEQ ID NO: 227370 - DNA, 75 bp, Artificial Sequence
  Synthetic
atatcaatcaaactggtgatgtgggaaggaacaactcccttctcaaagtagtttctaaataacctctcagttggt

SEQ ID NO: 227371 - DNA, 75 bp, Artificial Sequence
  Synthetic
gtacaatgagagcctttcagtaatttcagcttgtcttttatgtatgatctcatcatggcactcaccacattatga

SEQ ID NO: 227372 - DNA, 75 bp, Artificial Sequence
  Synthetic
ggaacttccaccattttgtgaatatgccaggctaaaagcgtgctgatgtggtccttcccccctctcacatattgc

SEQ ID NO: 227373 - DNA, 75 bp, Artificial Sequence
  Synthetic
tcatcactcaactttaaattctgcagtaacatcaaaaataggaaaggacacatcattggaccccacttgctgtga

SEQ ID NO: 227374 - DNA, 75 bp, Artificial Sequence
  Synthetic
tccatactatagctaagaaacccctgcctgacatttattgtcatgctcaatattgcattttcaaactctttctca

SEQ ID NO: 227375 - DNA, 75 bp, Artificial Sequence
  Synthetic
tcattgaggcatgatccggaaaaaaacccagttaatgactcaaaataatcctcaataagccgtgtaaacattttg

SEQ ID NO: 227376 - DNA, 75 bp, Artificial Sequence
  Synthetic
gttctcatatctcctatgtaaagttccctgttacccccaacctgttctttataagagagggcaaatttcaaccta

SEQ ID NO: 227377 - DNA, 75 bp, Artificial Sequence
  Synthetic
ccagagtcagggcctattgaggtatatgatgtcggtgcctcttcagaataaaaacataagttctttaacgcagag

SEQ ID NO: 227378 - DNA, 75 bp, Artificial Sequence
  Synthetic
ctaagacacttacttaatgacaaagctttgcttaaggactcagagttgctttctctctcactgatccttgcatct

SEQ ID NO: 227379 - DNA, 75 bp, Artificial Sequence
  Synthetic
tcctccaatttgcatctgtcgaatttaaaattcaattgttgccgatgattgaacctgtatttccctgagtaggtg

SEQ ID NO: 227380 - DNA, 75 bp, Artificial Sequence
  Synthetic
ttggcattcatttgaaggaggatcatcttgaagcaagaaaaccattcaccatcctcaaaaaaccttctacaaaga

SEQ ID NO: 227381 - DNA, 75 bp, Artificial Sequence
  Synthetic
ttgggagccatatcatctagggtgcattgttccttgaattcctttgtgaaataaagcttacccaggacattatgg

SEQ ID NO: 227382 - DNA, 75 bp, Artificial Sequence
  Synthetic
gtctgcgttctttcacacacatacttcaaatcatcttgtgataagcatgaagggtcaaaatcttcaaccaagtga

SEQ ID NO: 227383 - DNA, 75 bp, Artificial Sequence
  Synthetic
tatgaaatttctgagagtatgagctttctcaacccagccttctcccctggcaagacatcctgtagatggtgtaat

SEQ ID NO: 227384 - DNA, 75 bp, Artificial Sequence
  Synthetic
cccttcctttcctttgagtgagtgtcagagtactctgtttgttttctcacaccgtaattcagcataattgactca

SEQ ID NO: 227385 - DNA, 75 bp, Artificial Sequence
  Synthetic
accctgtctttgacttcatggaagaactcaagctcttcctgcccatcaaaaatgtgatctggcttgaggtcatca

SEQ ID NO: 227386 - DNA, 75 bp, Artificial Sequence
  Synthetic
gtctccagcttgtcagcacctccccctttagaagttgagatgatcagctttgagactgcttttgaaactttatac

SEQ ID NO: 227387 - DNA, 75 bp, Artificial Sequence
  Synthetic
tcataatcacctgcatttaatgtcaattttcctttcctcatgaagttttctgttatttggctaactgagttaacg

SEQ ID NO: 227388 - DNA, 75 bp, Artificial Sequence
  Synthetic
agtaacttgttaaagtcatattccagtaagcgttcgccattaagagttttgttgacaacaacacttttgttgctc

SEQ ID NO: 227389 - DNA, 75 bp, Artificial Sequence
  Synthetic
gccaaatctagtgcggttgcacaacctgagttcatcatggggtctaaaagatctaactttttttcacctttacac

SEQ ID NO: 227390 - DNA, 75 bp, Artificial Sequence
  Synthetic
accaatgtcccgttgttgatggaggagaccattaaactaaatgccttcttgtttattcctggagtttttgactgg

SEQ ID NO: 227391 - DNA, 75 bp, Artificial Sequence
  Synthetic
cacttaagatctttactagtgaacttaaccatttgcttatataacaggtctttctcctcatctgtgatgacctcc

SEQ ID NO: 227392 - DNA, 75 bp, Artificial Sequence
  Synthetic
tttgggttcacaaagaacccaaagtctttcttgggctcaaaaaacttctcaaaacatttaatctgatctgtcaag

SEQ ID NO: 227393 - DNA, 75 bp, Artificial Sequence
  Synthetic
cgatcgggggtctcttttgtgattagatggcataggtatgagacattcaacataaatttgaatctggtagtcagc

SEQ ID NO: 227394 - DNA, 75 bp, Artificial Sequence
  Synthetic
aatgtctttttttcaacgaggaaaacttctctgacaaggtagaccattaattggtgaaccaacttttctgcatca

SEQ ID NO: 227395 - DNA, 75 bp, Artificial Sequence
  Synthetic
gtgatcagatcctccctcaacttgtccattagctcaacatggtggaagtcagacactagggccatggttaggtat

SEQ ID NO: 227396 - DNA, 75 bp, Artificial Sequence
  Synthetic
ctaaggttttggacctgtctttgattcctctttgatgggttggttaagaggaggagtacaagtgttcttagtgcc

SEQ ID NO: 227397 - DNA, 75 bp, Artificial Sequence
  Synthetic
aagtgaacacttgggatagatccttctaggtcagagcagggggttaaccatgacatcatgatgtctaacatttct

SEQ ID NO: 227398 - DNA, 75 bp, Artificial Sequence
  Synthetic
aaaatcacatcatgtgaaaagattggtaagaagaatctctttggatcggcataaaatgatgcaatgtgggaagag

SEQ ID NO: 227399 - DNA, 75 bp, Artificial Sequence
  Synthetic
tgatcatgaatcgaataacacctagagacttccccagttttctggtatagcaagtaaaaatcccctgagtctgtc

SEQ ID NO: 227400 - DNA, 75 bp, Artificial Sequence
  Synthetic
ttgacatcctgatagaagacttccttgcactcaacactcttgtatctttgggcacctgattcattctgtctaagc

SEQ ID NO: 227401 - DNA, 75 bp, Artificial Sequence
  Synthetic
ctcacaacagagctcgtcttcatgctgtttgttatagccaaagatattgaggacaacttctggaaagcagcattc

SEQ ID NO: 227402 - DNA, 75 bp, Artificial Sequence
  Synthetic
tccagtgacaccattgagtcataattatagcagtctaccttttcatagtgcatagtggggggggggttatctcta

SEQ ID NO: 227403 - DNA, 75 bp, Artificial Sequence
  Synthetic
gtaaactcaaagaagtctgagaacttgatggcacactcatctgacaagttctctgtgagattatagttcatgaaa

SEQ ID NO: 227404 - DNA, 75 bp, Artificial Sequence
  Synthetic
tttaaacctgccaattgcaagcatttcttcaccttgctgatgaatccagacagagtattgtcaaagatgatactt

SEQ ID NO: 227405 - DNA, 75 bp, Artificial Sequence
  Synthetic
aacgggactccacggaaaggcccagatttttgtctgtttctaagaaccttgagaaaatcattttttgtgctctga

SEQ ID NO: 227406 - DNA, 75 bp, Artificial Sequence
  Synthetic
tggctaacaagcctatcatttacactaacatggcaacaccccagccagtaattggagtcttttgacctcaatggg

SEQ ID NO: 227407 - DNA, 75 bp, Artificial Sequence
  Synthetic
tctgtcttctcaaattttattaaggcagacaacattaagacatccaggttgagtaactgcttccgccgtgtattc

SEQ ID NO: 227408 - DNA, 75 bp, Artificial Sequence
  Synthetic
agaagcttcagacttttaactttatttaacatggacaataagttatcaacataggaaactctacacctgtgttta

SEQ ID NO: 227409 - DNA, 75 bp, Artificial Sequence
  Synthetic
tcagatcctttcagacttgagttaataaatctcattaaagggcaagatctaacagccagtttgcatatttctttc

SEQ ID NO: 227410 - DNA, 75 bp, Artificial Sequence
  Synthetic
aggtcatccttataaagattaccttcataaaggtgagtgaattctgatatcaactggccaggattgctaactctg

SEQ ID NO: 227411 - DNA, 75 bp, Artificial Sequence
  Synthetic
aaattccttttcaattcccctgaaagcagatccctcctgaactcaccataaatctggtttatgcccaaggcaacc

SEQ ID NO: 227412 - DNA, 75 bp, Artificial Sequence
  Synthetic
tcctcacttgacattgatggattgatctctgtatgacacattctgatgatctcatcattgtgagatgacctatca

SEQ ID NO: 227413 - DNA, 75 bp, Artificial Sequence
  Synthetic
tccctgagcactttcatagagtcaatacctgaccttctgtcaactgaggttttcaaagactcacatagcctcata

SEQ ID NO: 227414 - DNA, 75 bp, Artificial Sequence
  Synthetic
tactcagactcttcaaagatcctctcattttcatttgaaaactcaagaagcctgaacaatagatctctgaacttg

SEQ ID NO: 227415 - DNA, 75 bp, Artificial Sequence
  Synthetic
tggttgacccaatcaggcatcatggagttctcatatgtgcaccgaccatccaccattggaaccaagataatgcct

SEQ ID NO: 227416 - DNA, 75 bp, Artificial Sequence
  Synthetic
gccattgccaaatcgtctttgatgcttgaaagcttattagtgtcctctatgaattttgcctcaaacccagccggg

SEQ ID NO: 227417 - DNA, 75 bp, Artificial Sequence
  Synthetic
gaactcctcacaaagcattctaacaagattaaggtgttgtcaatcagtttataaccatctggaataatcaggggt

SEQ ID NO: 227418 - DNA, 75 bp, Artificial Sequence
  Synthetic
aacccggggcagatgacaccagcctcaatcaagatggtctccactgatttgtcttcatgattgtgaacacagcca

SEQ ID NO: 227419 - DNA, 75 bp, Artificial Sequence
  Synthetic
ttcttgtcagcactgtctatctctatgcaccttgataacaacttcaacccttctatcaaagtcagcttcggctct

SEQ ID NO: 227420 - DNA, 75 bp, Artificial Sequence
  Synthetic
gactgacttaagaagtttaattttgcctggacagacgctcatcttgactcatgtaacttaaacacagatgcctta

SEQ ID NO: 227421 - DNA, 75 bp, Artificial Sequence
  Synthetic
ccttatctctccaataatgtcttccattccagataccaaaaatgcgcatcaaaatagcctaggatcctcggtgcg

SEQ ID NO: 227422 - DNA, 75 bp, Artificial Sequence; identical to SEQ ID NO: 211507
  Synthetic

SEQ ID NO: 227423 - DNA, 75 bp, Artificial Sequence; identical to SEQ ID NO: 211509
  Synthetic

SEQ ID NO: 227424 - DNA, 75 bp, Artificial Sequence
  Synthetic
atacaaataccctgcgattgtggataaaaagaaacctagtatcaccctgggaaaagcccccgatctgaatacagc

SEQ ID NO: 227425 - DNA, 75 bp, Artificial Sequence
  Synthetic
atacaagtcaatcctatccgggatgaatgctgccaagcttgatcctgatgatgtgtgttcttatttggctgcggc

SEQ ID NO: 227426 - DNA, 75 bp, Artificial Sequence; identical to SEQ ID NO: 211515
  Synthetic

SEQ ID NO: 227427 - DNA, 75 bp, Artificial Sequence
  Synthetic
gataactcctgcagtcctggttgatatacaaaggacaaacacagaagggaactgggctcaagctggaggacaaga

SEQ ID NO: 227428 - DNA, 75 bp, Artificial Sequence; identical to SEQ ID NO: 211519
  Synthetic

SEQ ID NO: 227429 - DNA, 75 bp, Artificial Sequence; identical to SEQ ID NO: 211521
  Synthetic

SEQ ID NO: 227430 - DNA, 75 bp, Artificial Sequence
  Synthetic
gtttgtcaaaattgtggaacatcacaccttaatgaccacccacaaaatgtgtgcaaattggagcacaataccaaa

SEQ ID NO: 227431 - DNA, 75 bp, Artificial Sequence; identical to SEQ ID NO: 211525
  Synthetic

SEQ ID NO: 227432 - DNA, 75 bp, Artificial Sequence
  Synthetic
aacagttgtgactgcgtatgaagactgctcagggctggtgtcatttaccacgtttatcagacaaattaacttaac

SEQ ID NO: 227433 - DNA, 75 bp, Artificial Sequence; identical to SEQ ID NO: 211529
  Synthetic

SEQ ID NO: 227434 - DNA, 75 bp, Artificial Sequence; identical to SEQ ID NO: 211531
  Synthetic

SEQ ID NO: 227435 - DNA, 75 bp, Artificial Sequence; identical to SEQ ID NO: 211533
  Synthetic

SEQ ID NO: 227436 - DNA, 75 bp, Artificial Sequence
  Synthetic
cactgtcatacaaagttgtgctccaaacgagatgtctgtgttaggaggatatctgggagaggagttctttgggag

SEQ ID NO: 227437 - DNA, 75 bp, Artificial Sequence
  Synthetic
aggaacctttgaaagacgattcttcagggatgagaaggagctgcaggactatgaagccgctgaagcaactaagat

SEQ ID NO: 227438 - DNA, 75 bp, Artificial Sequence
  Synthetic
agacttagcgttggaggacgatggaaccgtgaactcagatgatgaagacttcttctccggagagactagaagccc

SEQ ID NO: 227439 - DNA, 75 bp, Artificial Sequence; identical to SEQ ID NO: 211541
  Synthetic

SEQ ID NO: 227440 - DNA, 75 bp, Artificial Sequence
  Synthetic
cagttcaaaccatcaggctagacccaattcctttgcagagtttctcaacaagacttatgccagtgatacaaggta

SEQ ID NO: 227441 - DNA, 75 bp, Artificial Sequence
  Synthetic
aacccattcatctatcaagatttgagaatatccaagttgatctcacaacatcctgaaaaaaactaacaccactcc

SEQ ID NO: 227442 - DNA, 75 bp, Artificial Sequence; identical to SEQ ID NO: 211547
  Synthetic

SEQ ID NO: 227443 - DNA, 75 bp, Artificial Sequence
  Synthetic
atggcagaagagaccattgatttgatcaatagaaccatagaggacaatcaggcccatttgcaaggagtccctata

SEQ ID NO: 227444 - DNA, 75 bp, Artificial Sequence; identical to SEQ ID NO: 211551
  Synthetic

SEQ ID NO: 227445 - DNA, 75 bp, Artificial Sequence; identical to SEQ ID NO: 211553
  Synthetic

SEQ ID NO: 227446 - DNA, 75 bp, Artificial Sequence
  Synthetic
tcataccttgatgctgttgggattcaacttgttaggaagatgaagacaggagagggattcctcaagatttggtca

SEQ ID NO: 227447 - DNA, 75 bp, Artificial Sequence
  Synthetic
aaggctgccgaggaaatagtctcctatgttgccatcaactttccccttcctgcagacaagaactctgcagaaaaa

SEQ ID NO: 227448 - DNA, 75 bp, Artificial Sequence
  Synthetic
tcaactcagactgtggcggaacctcccaagtccaacactgcatcgaccacccccagcaagaggtctaaacccaca

SEQ ID NO: 227449 - DNA, 75 bp, Artificial Sequence
  Synthetic
atatccacagatctgaaggctcaagaatcatctggccctcacggcatcgactgggcagcaagcaatgacgaggat

SEQ ID NO: 227450 - DNA, 75 bp, Artificial Sequence; identical to SEQ ID NO: 211563
  Synthetic

SEQ ID NO: 227451 - DNA, 75 bp, Artificial Sequence
  Synthetic
tcatctgggatctttctttggaactttgaacagcttaaactgaatttggatgacattgttagtggggcgaaggag

SEQ ID NO: 227452 - DNA, 75 bp, Artificial Sequence
  Synthetic
attccgggcgtaattaggatggctaaagaaggcaataagctgccactcaggtgcatcctgggaggtgtggcatta

SEQ ID NO: 227453 - DNA, 75 bp, Artificial Sequence; identical to SEQ ID NO: 211569
  Synthetic

SEQ ID NO: 227454 - DNA, 75 bp, Artificial Sequence
  Synthetic
taccttgcaaattaacctacaactagtcacctcaattagttgtcgttaaaacaggtcaataactaatcatggaaa

SEQ ID NO: 227455 - DNA, 75 bp, Artificial Sequence; identical to SEQ ID NO: 211573
  Synthetic

SEQ ID NO: 227456 - DNA, 75 bp, Artificial Sequence; identical to SEQ ID NO: 211575
  Synthetic

SEQ ID NO: 227457 - DNA, 75 bp, Artificial Sequence; identical to SEQ ID NO: 211577
  Synthetic

SEQ ID NO: 227458 - DNA, 75 bp, Artificial Sequence; identical to SEQ ID NO: 211579
  Synthetic

SEQ ID NO: 227459 - DNA, 75 bp, Artificial Sequence
  Synthetic
tcaaggtggtgataggtttggctctctctggggccccggttcctgaggggatgaactgggtttataagataaggc

SEQ ID NO: 227460 - DNA, 75 bp, Artificial Sequence; identical to SEQ ID NO: 211583
  Synthetic

SEQ ID NO: 227461 - DNA, 75 bp, Artificial Sequence
  Synthetic
cctgggacgatgactcagagtttgtaggactgcaaatccgggtaagcgccagacagtgtcacattcaagggagac

SEQ ID NO: 227462 - DNA, 75 bp, Artificial Sequence; identical to SEQ ID NO: 211587
  Synthetic

SEQ ID NO: 227463 - DNA, 75 bp, Artificial Sequence
  Synthetic
aagacaagaacacttccctgcttcttgaatgaccataactaaacgctctgatcatatggattacctccacaccaa

SEQ ID NO: 227464 - DNA, 75 bp, Artificial Sequence
  Synthetic
accatgcacacaagcactctcttccgtctttatgcgagcaatagatcaacatatgtaatggtgcctcactatagc

SEQ ID NO: 227465 - DNA, 75 bp, Artificial Sequence
  Synthetic
tgcatactcttgatatatataatcagataccttcacatgtgaatccactgcaatgtgaaaaaaacattcaacatc

SEQ ID NO: 227466 - DNA, 75 bp, Artificial Sequence
  Synthetic
cctcgaaaaagctcaaaagccatgtcgctcctcactgccgttattgcctttttcttcattagcaccttctgttca

SEQ ID NO: 227467 - DNA, 75 bp, Artificial Sequence
  Synthetic
ggaaaattccccatttacacgatccccgacaaaatcgggccttggagccctattgatataaatcatcttagctgt

SEQ ID NO: 227468 - DNA, 75 bp, Artificial Sequence
  Synthetic
ccaaacaacttagaggtagaagatgaggggtgcaccaccctcaccgcgtttgactacatggaactcaaggtggga

SEQ ID NO: 227469 - DNA, 75 bp, Artificial Sequence
  Synthetic
tacataacctctattaaggtcgacgggttcacttgcacaggggtagtcaccgaggcagagacctacacgaatttt

SEQ ID NO: 227470 - DNA, 75 bp, Artificial Sequence
  Synthetic
gtgggatatgtgactacaacgtttaaaagaaagcacttccgtcctaatgtcaacgcatgcagagccgcttttagt

SEQ ID NO: 227471 - DNA, 75 bp, Artificial Sequence
  Synthetic
tggaagatagcaggtgatccaaggtacgaggagtcattacacaatccttatcctgattcccattggttgaggaca

SEQ ID NO: 227472 - DNA, 75 bp, Artificial Sequence
  Synthetic
gtaaccaccacaaaagaagctttgttgattatatctcctagtgttgttgacatggatgcctatgataagacactt

SEQ ID NO: 227473 - DNA, 75 bp, Artificial Sequence
  Synthetic
tattccaaactatttcccaccggaaaatgcttcccacctatatcggattctcctttttgctcgacaaatcatgat

SEQ ID NO: 227474 - DNA, 75 bp, Artificial Sequence
  Synthetic
tatactttatggcttccggagaaggagaaactcagcatgtcctgcaatatatttgtctccagtaaggggaagaaa

SEQ ID NO: 227475 - DNA, 75 bp, Artificial Sequence
  Synthetic
gcaacaaagaacggcagactgtgtggatttgtcgatgagagagggctgtacaagtctctgaagggggcatgtaaa

SEQ ID NO: 227476 - DNA, 75 bp, Artificial Sequence
  Synthetic
ctaaagttgtgtggaatggcaggcatgaggctgatggatgggtcctgggtgtctctgcaaaaaggagatgcccct

SEQ ID NO: 227477 - DNA, 75 bp, Artificial Sequence
  Synthetic
gagtggtgtccccccggtgctcttgttaatgtgcatgacttccattcagacgagatcgcccacttcgtcgtagag

SEQ ID NO: 227478 - DNA, 75 bp, Artificial Sequence
  Synthetic
gagctaataaagaaacgagaagagtgcttggacaccttagagaccatcctaaccaccaagtctataagtttcagg

SEQ ID NO: 227479 - DNA, 75 bp, Artificial Sequence
  Synthetic
cgtctgagccattttagaaagctggtgcccggtctggggaaggcatatactttgataaataataccttgatggaa

SEQ ID NO: 227480 - DNA, 75 bp, Artificial Sequence
  Synthetic
gctgaggctcactataagtctatcagggaatggaaagagattattccatccaaaggttgtttgaaggcggggggg

SEQ ID NO: 227481 - DNA, 75 bp, Artificial Sequence
  Synthetic
cgttgtcatcctcattatgatgggatcttttttaatgggataatcctcggcccgaacggagatgtgctcatcccg

SEQ ID NO: 227482 - DNA, 75 bp, Artificial Sequence
  Synthetic
gagatgcaatcatccttgcttcagcaacacatagagttattggagtcgtctaggattccccttagacaccctctg

SEQ ID NO: 227483 - DNA, 75 bp, Artificial Sequence
  Synthetic
gctgattcctctgctgtattcaggagtgacaatgaagctgaggactttgtagatgttcatcttcctgatgcacaa

SEQ ID NO: 227484 - DNA, 75 bp, Artificial Sequence
  Synthetic
aagcaagtgtcagatatcgatttggggttcccggaatggaagcgctatttcttgataggggtgtctgcaattgcc

SEQ ID NO: 227485 - DNA, 75 bp, Artificial Sequence
  Synthetic
ttgttctctttagcaataataatagctgtttgttgcagaaagttcaagagaaggaagaggcccaaaccaagccct

SEQ ID NO: 227486 - DNA, 75 bp, Artificial Sequence
  Synthetic
attgagctggtgaggaaagtctcagtcacttcccaaagtggaaaggtggttccgtcttgggagtcctacaaagag

SEQ ID NO: 227487 - DNA, 75 bp, Artificial Sequence
  Synthetic
ggtgccacaagtcaaccttaacaattcactgtatgtttgatcgattgaggtggctggatcctcctcatcacatcc

SEQ ID NO: 227488 - DNA, 75 bp, Artificial Sequence
  Synthetic
acatcagggtcctgaaaccatcatttcacttgaccattcttcaggtgatagccttcgcgaaccaaatattgtggt

SEQ ID NO: 227489 - DNA, 75 bp, Artificial Sequence
  Synthetic
gaatcaatgatttgacaattgttctctgacaggggtggtgtcactcttcacagtaagagtgggcatgtcagaaca

SEQ ID NO: 227490 - DNA, 75 bp, Artificial Sequence
  Synthetic
ctgtgattagtgcactccggagattagcatgggatcacatttgcataagatgccggtgcttccagtgatccgaac

SEQ ID NO: 227491 - DNA, 75 bp, Artificial Sequence
  Synthetic
tgcgcagcttgatggggtcatttcgagataatgctcataggaggattctaatcggcaatccataagaatcataca

SEQ ID NO: 227492 - DNA, 75 bp, Artificial Sequence
  Synthetic
gatctgcttcgcactaactgtctcatctctcaagcttgaataaaacctcaccttagacctccaccgaatggaatt

SEQ ID NO: 227493 - DNA, 75 bp, Artificial Sequence
  Synthetic
ctgagacatggagattcatcttcacaaatctaggagcatgattatggacagtaaaggcggcactcagagttagaa

SEQ ID NO: 227494 - DNA, 75 bp, Artificial Sequence
  Synthetic
tctcatgaaaaaaacatgacacatgtgaaaacctaacacccctccttcatgataacctctccaacatgattgagt

SEQ ID NO: 227495 - DNA, 75 bp, Artificial Sequence
  Synthetic
ctactgaggtttatgacgacccggtagatcctgtagaacctgatgttgacgttagaaacaactctgtcgtaccta

SEQ ID NO: 227496 - DNA, 75 bp, Artificial Sequence
  Synthetic
acattcttagaaactctgactataacttgaactctccactattagaagacccttcccgactcatgttggactggc

SEQ ID NO: 227497 - DNA, 75 bp, Artificial Sequence
  Synthetic
ttatcaccgggaataaaccttgtcgattgaatctaacagacaacctgttcaggtcctataaagtcttgaggagct

SEQ ID NO: 227498 - DNA, 75 bp, Artificial Sequence
  Synthetic
atttcaaaaaaattgatataggctccctaaaagtgggaagtctcggtgcacagtccatgacaactctatggctac

SEQ ID NO: 227499 - DNA, 75 bp, Artificial Sequence
  Synthetic
atggatcacatgcggagtcgactaggagcagaaaatgtctatctgacctttctcagttttacaagaaatcctctc

SEQ ID NO: 227500 - DNA, 75 bp, Artificial Sequence
  Synthetic
ctatagaaatccttctgaactatacattggagaatcgagggctccaaaccccggccgagggagtcctatctagcc

SEQ ID NO: 227501 - DNA, 75 bp, Artificial Sequence
  Synthetic
taaacaaagtccattatgatcaggcgtttggacgctatctaggaaacacttactctgcttatctgttcttccatg

SEQ ID NO: 227502 - DNA, 75 bp, Artificial Sequence
  Synthetic
tcataatattatacatgaatgcgttggactgggatgaagagaagactatattggcgttgtggaaggatattgcgt

SEQ ID NO: 227503 - DNA, 75 bp, Artificial Sequence
  Synthetic
ccatagatgtcaagaatgatctagttaaattcagagatcagatctggggatctcttgtagtgactaaagactttg

SEQ ID NO: 227504 - DNA, 75 bp, Artificial Sequence
  Synthetic
tgtattcccaaagtgccaactgcctctttgaccgaaattacacactaatgctcaaagacttattcctttctagat

SEQ ID NO: 227505 - DNA, 75 bp, Artificial Sequence
  Synthetic
ttaattcacttctgatcctgctgtctcctccagagtttcgatattctgatgacctagtttctaccctatgtcagc

SEQ ID NO: 227506 - DNA, 75 bp, Artificial Sequence
  Synthetic
tttacatagctggggacaaggtcttggcatcatgtggcaactctggatatgatgtcatcaagatgttggagcctt

SEQ ID NO: 227507 - DNA, 75 bp, Artificial Sequence
  Synthetic
acattgtcaacaagctggtgcaaagggcagagagcttcaggcctcttatccactctttaggagatttccctcaat

SEQ ID NO: 227508 - DNA, 75 bp, Artificial Sequence
  Synthetic
tcatccgagacaagacaacccagctggaagggatctttggccccagagcaagagagttctttcagactatggact

SEQ ID NO: 227509 - DNA, 75 bp, Artificial Sequence
  Synthetic
tgctagacaatatacatgacctcgtcttcacctatggttgttataggcattggggacacccttatattgattaca

SEQ ID NO: 227510 - DNA, 75 bp, Artificial Sequence
  Synthetic
ggaaggggcttactaaactctatgatcaggttcatgtaaagaaggtgatagaccaacaataccaagaatgtttgg

SEQ ID NO: 227511 - DNA, 75 bp, Artificial Sequence
  Synthetic
caagtgatttggcaaaaaggatactccgatgggggtttgacaaatattcacgttggtatctagaccaagaactct

SEQ ID NO: 227512 - DNA, 75 bp, Artificial Sequence
  Synthetic
tgcccaaagatcatccgttgactccctatgtgaagacacagacatggcctcccaaacatgtagttgacataatcg

SEQ ID NO: 227513 - DNA, 75 bp, Artificial Sequence
  Synthetic
gggattcctggcataatctcccaattacccagttgtttgaaattccggaatctatggacccttctgaaattctag

SEQ ID NO: 227514 - DNA, 75 bp, Artificial Sequence
  Synthetic
atgacaaatcccactctttcaccaggacaaagctggcctcttggctttcagaaaacaggggtggtccagttcccg

SEQ ID NO: 227515 - DNA, 75 bp, Artificial Sequence
  Synthetic
gtgagaaggtcatcatcacggcgctgtccaggccccccgtcaatccaagagagttcctcaggtctatagatgtgg

SEQ ID NO: 227516 - DNA, 75 bp, Artificial Sequence
  Synthetic
gggggctgcccgacgatgacctaatcattggcttaaagcctaaggaaagggagctcaaagtagaggggagattct

SEQ ID NO: 227517 - DNA, 75 bp, Artificial Sequence
  Synthetic
tcgcactgatgtcttggaaccttcgactttactttgtaatcacagaaaagctactagcaacttacattttgcccc

SEQ ID NO: 227518 - DNA, 75 bp, Artificial Sequence
  Synthetic
tatttgatgcattgaccatgacagacaacctgaacaaagtttttaagaagctcatagatagagtgacgggacaag

SEQ ID NO: 227519 - DNA, 75 bp, Artificial Sequence
  Synthetic
gtttgttagattactccagagtaacctatgcattccacttggactatgaaaagtggaacaaccatcagaggctgg

SEQ ID NO: 227520 - DNA, 75 bp, Artificial Sequence
  Synthetic
aatcaacaaaagatgtcttctcagttcttgataaggcattcggacttaagagggtgttctcaagaacgcacgagt

SEQ ID NO: 227521 - DNA, 75 bp, Artificial Sequence
  Synthetic
tcttccaaaaatcctgggtttactattctgatagatcggacttaataggtctatggaaggaccaaatttactgtc

SEQ ID NO: 227522 - DNA, 75 bp, Artificial Sequence
  Synthetic
tggacatgagcaacggcccaacatgttggaacgggcaggatggaggactagagggcttaaggcaaaagggatgga

SEQ ID NO: 227523 - DNA, 75 bp, Artificial Sequence
  Synthetic
gtttagtcagtcttctaatgattgacagagagtctcaaactaggaacactcggactaagattctcgcacaggggg

SEQ ID NO: 227524 - DNA, 75 bp, Artificial Sequence
  Synthetic
acaaccaggtgttgtgtccgacgtatatgttgtcatcagggttgaccaaggagggtcttctttatgaactagata

SEQ ID NO: 227525 - DNA, 75 bp, Artificial Sequence
  Synthetic
gtatatcaaggaatgccatctctatatacagggccatagaagagggggcctcgaaactgggactcatcatcaaaa

SEQ ID NO: 227526 - DNA, 75 bp, Artificial Sequence
  Synthetic
aagacgagactatgtgcagttacgactttctcatctacggtaaaaccccgtggtttagaggaaacatattggtgc

SEQ ID NO: 227527 - DNA, 75 bp, Artificial Sequence
  Synthetic
cagaatctaaaagatgggctcgggtatcttgtatatctaacgatcagatagtcaacctggcaaacatcatgtcta

SEQ ID NO: 227528 - DNA, 75 bp, Artificial Sequence
  Synthetic
ctgtgtcaacaaatgccttgactgtggcacaacactctcagtcgttggtcaagccaatgagagactttctactca

SEQ ID NO: 227529 - DNA, 75 bp, Artificial Sequence
  Synthetic
tgtctgttcaagccgtctttcactatctcctattcagccctatactgaaagacagagtatacaagatcctagtgg

SEQ ID NO: 227530 - DNA, 75 bp, Artificial Sequence
  Synthetic
cggaggggaatgaatttctgctagccatgtccaggatcgtatacctggatccgtccctagggggagtttcaggga

SEQ ID NO: 227531 - DNA, 75 bp, Artificial Sequence
  Synthetic
tgtcgttaggacgatttcatattcgccaattttccgatccggtgtcagaagggttagcattttggcgggagatct

SEQ ID NO: 227532 - DNA, 75 bp, Artificial Sequence
  Synthetic
ggttgagctcaaatgagccttggatccattctctgtgtcaggaggcaggcaatcctgaccttggtgatagaagtt

SEQ ID NO: 227533 - DNA, 75 bp, Artificial Sequence
  Synthetic
tagagagtttcactagacttttggaagaccctacaaccctaaacatcagaggaggtgccagccctactattctat

SEQ ID NO: 227534 - DNA, 75 bp, Artificial Sequence
  Synthetic
taaaagaggcaattaggaaggccctatatgaagaggttgacaaggtggaaaactcggagttcagagaggcgatct

SEQ ID NO: 227535 - DNA, 75 bp, Artificial Sequence
  Synthetic
tactatccaaaacccatagggataacttcatacttttcctcaagtctgtggagcccctctttccccgattcctca

SEQ ID NO: 227536 - DNA, 75 bp, Artificial Sequence
  Synthetic
gcgaattgtttagctcctccttcttggggatcccagaatcaataataggcctaatccagaactcccggacaatta

SEQ ID NO: 227537 - DNA, 75 bp, Artificial Sequence
  Synthetic
ggagacaatttaggagaagtttatctagggctttagaagaatccttctttaactcagagattcatggggtcaacc

SEQ ID NO: 227538 - DNA, 75 bp, Artificial Sequence
  Synthetic
gaatgactcaggttccgcaaaggatagggcgagtctgggcatgctctgcagagcgcgctgatcaactgcgagaga

SEQ ID NO: 227539 - DNA, 75 bp, Artificial Sequence
  Synthetic
tatcctggggaaggaaggtagttggaacgacagtgcctcacccttctgagatgatagcactcatccccaaatcat

SEQ ID NO: 227540 - DNA, 75 bp, Artificial Sequence
  Synthetic
caatttcatgcacatgtagccagtcaggagaagccaatccccgaatttcagtatcagtcttgccatcttttgacc

SEQ ID NO: 227541 - DNA, 75 bp, Artificial Sequence
  Synthetic
agtcatatttctcacgaggacctttgaagggatatctgggatcttccacttccatgtctacccagttgttccatg

SEQ ID NO: 227542 - DNA, 75 bp, Artificial Sequence
  Synthetic
catgggagaaagtgacaaatgtgcatgttgtgaagagggcactgtccctcaaggaatcaattaactggttcatca

SEQ ID NO: 227543 - DNA, 75 bp, Artificial Sequence
  Synthetic
ccagagattcaaatctagcccagacattgatcaaaaacattgtttccttgactgggcccacattccctctagaag

SEQ ID NO: 227544 - DNA, 75 bp, Artificial Sequence
  Synthetic
aagctcctgtattcaagcgaaccggatctgccctccatcgcttcaaatcagctagatacagtgagggaggttact

SEQ ID NO: 227545 - DNA, 75 bp, Artificial Sequence
  Synthetic
cctctgtatgccccaacctgttgtcgcatatttctgtcagcaccgacaccatgtcagacctcacacaggatggaa

SEQ ID NO: 227546 - DNA, 75 bp, Artificial Sequence
  Synthetic
ccaactttgattttatgttccagcccctcatgctttacgcccaaacatggacatcagagttggtgcaaaaagatc

SEQ ID NO: 227547 - DNA, 75 bp, Artificial Sequence
  Synthetic
tgcgtcttaaagactctacatttcactggcacctcagatgcttgaaatgtataaggccaatagacgacgtgatct

SEQ ID NO: 227548 - DNA, 75 bp, Artificial Sequence
  Synthetic
tagagacccctcaagttttcgccttccctgatgtatcaaagaggatatcccggatggtgtcaggggcagttcctc

SEQ ID NO: 227549 - DNA, 75 bp, Artificial Sequence
  Synthetic
aattcagaaagctcccagatataactctgaaacccgggaagtttgatgctctgagggggaaggagaagtcacagc

SEQ ID NO: 227550 - DNA, 75 bp, Artificial Sequence
  Synthetic
acataggaacggcacagggtctcctttattccatattggttgccacacatgactcagggtataatgatggaacaa

SEQ ID NO: 227551 - DNA, 75 bp, Artificial Sequence
  Synthetic
tatttcctgttaacatctatggcaaggtgtctccaagagactacttaaggggattagctaggggtgtcttgattg

SEQ ID NO: 227552 - DNA, 75 bp, Artificial Sequence
  Synthetic
gatcttctatatgcttcctcacaagaatgaccaacatcaacataaacagacccctagagctgatttccggggtca

SEQ ID NO: 227553 - DNA, 75 bp, Artificial Sequence
  Synthetic
tctcttacattcttctaaggttggacaatcatccttctttatatgtcatgctaaaggaaccatccttgagatctg

SEQ ID NO: 227554 - DNA, 75 bp, Artificial Sequence
  Synthetic
agatcttctctatcccgcagaagatgcctgctgcgtaccccacaaccatgaaagagggtaaccgatcagtcctat

SEQ ID NO: 227555 - DNA, 75 bp, Artificial Sequence
  Synthetic
gttatctgcaacatgttcttcgatatgaaagggaagcaatcacagcatctccagaaaatgactggctctggatat

SEQ ID NO: 227556 - DNA, 75 bp, Artificial Sequence
  Synthetic
tctcggatttccgaagtataaagatgacttatctgacattgatcacctaccaatctcacattttacttcagaaag

SEQ ID NO: 227557 - DNA, 75 bp, Artificial Sequence
  Synthetic
tcgagaagaacctgtccaaacagatgagggtcaagcttcgacaactcaactcactcatgagacaggtgcttggag

SEQ ID NO: 227558 - DNA, 75 bp, Artificial Sequence
  Synthetic
gccatggagagagtacactagactctgatgaagatatacagggtttattgagggattctctgaggaggacaaaat

SEQ ID NO: 227559 - DNA, 75 bp, Artificial Sequence
  Synthetic
gggtagatcaagaagtacgacacgcggcaaagacgatgacgtgcgagtatagtcccagtaagaaagtgtctcgga

SEQ ID NO: 227560 - DNA, 75 bp, Artificial Sequence
  Synthetic
aggctgggtgttcagagtggatatgttctgcacagcaagtggcaatttctacctcctcgaatcctgccccagtct

SEQ ID NO: 227561 - DNA, 75 bp, Artificial Sequence
  Synthetic
ccgagatggatgtccgagcactctccaagaagctccaaaaccctcttatctcgggtctaagggtagttcagtggg

SEQ ID NO: 227562 - DNA, 75 bp, Artificial Sequence
  Synthetic
caacaggtgcacattataaactcaagcccattttagacgacctggacttctatcccacactctgcttggttgttg

SEQ ID NO: 227563 - DNA, 75 bp, Artificial Sequence
  Synthetic
gtgatggatctggggggatatctcgggcagttctgagcatgtttcctgatgccaagttagtctttaacagtctac

SEQ ID NO: 227564 - DNA, 75 bp, Artificial Sequence
  Synthetic
tagaggtgaatgatctgatggcctctggaactcacccattaccaccttccgccttgatgagtggaggggaggaca

SEQ ID NO: 227565 - DNA, 75 bp, Artificial Sequence
  Synthetic
tcatctcaagagtgattgactttaactccatctgggagaagccttcagatctgcgaaatacagctacatggaagt

SEQ ID NO: 227566 - DNA, 75 bp, Artificial Sequence
  Synthetic
attttcagtctatccaacagtctatcaacatgtcttacgacttaatcatctgtgatgcggaagtgactgacattc

SEQ ID NO: 227567 - DNA, 75 bp, Artificial Sequence
  Synthetic
attcagtgaacaagataaccttgctgatgtccgatttttcactttctatcaacggtcctcttaacttgattttta

SEQ ID NO: 227568 - DNA, 75 bp, Artificial Sequence
  Synthetic
agacctatggaaccatgctggtcagcccggagtataaggccatccaacacttgtcacgggcttttccatctgtga

SEQ ID NO: 227569 - DNA, 75 bp, Artificial Sequence
  Synthetic
caggatacatcacccaaatgacatcttccttctcatctgagttgtatctgaagttctctaagcgagggaagtttt

SEQ ID NO: 227570 - DNA, 75 bp, Artificial Sequence
  Synthetic
tccgagatcctgaatacctgacatcgtccactttgagggagatgagcctagttctctttaattgtagcagctcaa

SEQ ID NO: 227571 - DNA, 75 bp, Artificial Sequence
  Synthetic
agagtgaaatgctgagggcccgatcactaaactatcaagacctagtaagagggttccctgaagagataatttcta

SEQ ID NO: 227572 - DNA, 75 bp, Artificial Sequence
  Synthetic
atccttacaacgaaatgataataactctcatagacaatgacgtcgagtcatttcttgttcataagatggttgatg

SEQ ID NO: 227573 - DNA, 75 bp, Artificial Sequence
  Synthetic
accttgaactgcagagagggtcattctccaaaatgtctatcatagttactatcatgttggtgttttccaacagag

SEQ ID NO: 227574 - DNA, 75 bp, Artificial Sequence
  Synthetic
tcttcaatgtgtccaaaccgttgaatgatcctaaattttaccctccatctgatcccaaaatattgaggcacttta

SEQ ID NO: 227575 - DNA, 75 bp, Artificial Sequence
  Synthetic
acatatgctgtggaactctgatatacttgtccaccgcattgggggatgttctcaatttcgcaagacttcatgaat

SEQ ID NO: 227576 - DNA, 75 bp, Artificial Sequence
  Synthetic
tatacaacaatcctgtgacctattacttcaaaaagcaggtcttaggaggaaggatgtatctttcatggagctggg

SEQ ID NO: 227577 - DNA, 75 bp, Artificial Sequence
  Synthetic
cggacaacactcccatttttaaaagagttgcctgcaactccagtctgagtctctcgtctcattggataagattga

SEQ ID NO: 227578 - DNA, 75 bp, Artificial Sequence
  Synthetic
tatacaaaattgtgaaaaccacaaggctaatcggaaatgctcatgatctctcaaaggaagttgagagacatttga

SEQ ID NO: 227579 - DNA, 75 bp, Artificial Sequence
  Synthetic
ggaattacaatagatggatcaatttcaatgatctgagatctagatcatctctattggactatagttgtctatgac

SEQ ID NO: 227580 - DNA, 75 bp, Artificial Sequence
  Synthetic
aaatttagagtcaatatcttgctatgccaatctctgtcattcaatagagcgtgaaaaaaacttttccgacagcca

SEQ ID NO: 227581 - DNA, 75 bp, Artificial Sequence; identical to SEQ ID NO: 211814
  Synthetic

SEQ ID NO: 227582 - DNA, 75 bp, Artificial Sequence
  Synthetic
cgcaccggggatcctaggcgattcttgatcgcgcttattagctaaccaatttaatttggtgttgaagtgttgaca

SEQ ID NO: 227583 - DNA, 75 bp, Artificial Sequence
  Synthetic
tgatcgcgcttattagctaaccaatttaatttggtgttgaagtgttgacacgctctctaacacatggggcagctt

SEQ ID NO: 227584 - DNA, 75 bp, Artificial Sequence
  Synthetic
aaaggtgcccaaacttctcccaaatttgttgatcatagagtcttgcctgatcagatgtgagcttcacatcaacca

SEQ ID NO: 227585 - DNA, 75 bp, Artificial Sequence
  Synthetic
atcagcttctttcaggagattcctgtttttctacaggaagctctgaacatcgctttagtggctgttagtctcata

SEQ ID NO: 227586 - DNA, 75 bp, Artificial Sequence
  Synthetic
gctttaagtccttccgcccatgaatgtctaaaagttttcttatgtcgtcggagccttgagttgtaatcaccatat

SEQ ID NO: 227587 - DNA, 75 bp, Artificial Sequence
  Synthetic
gctgtcatcaaaggcatcattaacctttacaaaagtggtctcttccagttcatcttctttctcctcctagcaggg

SEQ ID NO: 227588 - DNA, 75 bp, Artificial Sequence
  Synthetic
cttgtggcagtaagcctatgacataacttaatactcctggcattgcatcctcgatgtctttcatcaagatgccat

SEQ ID NO: 227589 - DNA, 75 bp, Artificial Sequence
  Synthetic
aggtcctgctcggatggcacattcaaaataggcctacacactgagttccagtcagtcacccttaccatgcagaga

SEQ ID NO: 227590 - DNA, 75 bp, Artificial Sequence
  Synthetic
gtgaatgtctgctgccgtttttgaaacccttttcatcatgtggctttctaaaacaatgaatataatgcttgttgg

SEQ ID NO: 227591 - DNA, 75 bp, Artificial Sequence
  Synthetic
cttttagctaaccattcaaatgagctcccatctctctgcatgcttaacaatagtttttattatatgaggggaggt

SEQ ID NO: 227592 - DNA, 75 bp, Artificial Sequence
  Synthetic
ctggctgatatagtgccaattccacagggtctgttggaggtccttcaatgtcaagccacagtgtatttgtgggat

SEQ ID NO: 227593 - DNA, 75 bp, Artificial Sequence
  Synthetic
gtgaacaccttcctgattcgtgtttctgatatttcagtcctcatgaaggagtatgatgtatcaatctatgaacca

SEQ ID NO: 227594 - DNA, 75 bp, Artificial Sequence
  Synthetic
ctaacttttttacagcctctttaatcaccgcttcttgcatttcagttaggtttgctagtcttaaattctgaccgt

SEQ ID NO: 227595 - DNA, 75 bp, Artificial Sequence
  Synthetic
gaagaccttggaaattgtcttaacaagtctgactcaagctgggctattcattggttctcaaatgctttgggacat

SEQ ID NO: 227596 - DNA, 75 bp, Artificial Sequence
  Synthetic
ttttatcgggttgtcttggtccaacttgaggtttctttgttagatcaacacttgtattgtcccaagatctcccaa

SEQ ID NO: 227597 - DNA, 75 bp, Artificial Sequence
  Synthetic
ttttttcgggttgtcttggtccaacttgaggtttctttgttagatcaacacttgtattgtcccaagatctcccaa

SEQ ID NO: 227598 - DNA, 75 bp, Artificial Sequence
  Synthetic
ttttctcgggttgtcttggtccaacttgaggtttctttgttagatcaacacttgtattgtcccaagatctcccaa

SEQ ID NO: 227599 - DNA, 75 bp, Artificial Sequence
  Synthetic
ttttgtcgggttgtcttggtccaacttgaggtttctttgttagatcaacacttgtattgtcccaagatctcccaa

SEQ ID NO: 227600 - DNA, 75 bp, Artificial Sequence
  Synthetic
gactggcttatggatcctccaatgctatgtagaaacaagacaaagaaggagggatctaacattcaattcaacatc

SEQ ID NO: 227601 - DNA, 75 bp, Artificial Sequence
  Synthetic
gtatttgtgatctggaaccaatgtaaggccacccgtcacctgaaagacacaatttatacaaaaggttttcataag

SEQ ID NO: 227602 - DNA, 75 bp, Artificial Sequence
  Synthetic
agcaaagctgatgatgccagagtgtatggaaagaagataagaaatggtatgaggcatctcttcaggggcttccat

SEQ ID NO: 227603 - DNA, 75 bp, Artificial Sequence
  Synthetic
gatttcgatttccaggtctctcatctacaaacatcccctcttttcgcttgacttgtagagttgatttaatcaagc

SEQ ID NO: 227604 - DNA, 75 bp, Artificial Sequence
  Synthetic
gacccgtgtgaggaagggaaagtgtgctacctgaccatcaatcagtgtggtgaccccagttcctttgactactgt

SEQ ID NO: 227605 - DNA, 75 bp, Artificial Sequence
  Synthetic
tggaaaaattgtcgggagtgaccctaattgtctccagcatgttcccgccatcgagtattgaggcgccagctttta

SEQ ID NO: 227606 - DNA, 75 bp, Artificial Sequence
  Synthetic
ggcgtgaatcatctttccaaatgtcagtttgaccatgtgaacacccttcatttccttgtgagaagtaagacacat

SEQ ID NO: 227607 - DNA, 75 bp, Artificial Sequence
  Synthetic
cagcagctgacagactgaagttatagccagagatgttaatagagctctcatccttagtcacaatttgcaagcatt

SEQ ID NO: 227608 - DNA, 75 bp, Artificial Sequence
  Synthetic
ctcaactttgagaggtctttgaaagcatttttctcatggtctctgacagactcctcaggaaaggacatgccagga

SEQ ID NO: 227609 - DNA, 75 bp, Artificial Sequence
  Synthetic
cgtgctccagagtcagcttatcaaggtcatttaagttcggatacttaacagtgtataacaggcccagagatgtta

SEQ ID NO: 227610 - DNA, 75 bp, Artificial Sequence
  Synthetic
ggttattgtctagaggaatggatgttgatagcagccaaaatgaaatgtttcggaaacactgctgttgctaaatgt

SEQ ID NO: 227611 - DNA, 75 bp, Artificial Sequence
  Synthetic
acgcttggaccacactgttcatcgtttctccaccctggacagtcatgcaagcaattgtgagagctggcatagaac

SEQ ID NO: 227612 - DNA, 75 bp, Artificial Sequence
  Synthetic
aatcaaaatcatgactcagagttctgtgatatgctgaggctattcgactataacaagaatgcaataaagaccctc

SEQ ID NO: 227613 - DNA, 75 bp, Artificial Sequence
  Synthetic
caaattgattattcagttttgatggatctgaaacatcccaaattctaaccacaccatttccagcacctctctgct

SEQ ID NO: 227614 - DNA, 75 bp, Artificial Sequence
  Synthetic
caaattgattattcagttttgatggatctgtaacatcccaaattctaaccacaccatttccagcacctctctgct

SEQ ID NO: 227615 - DNA, 75 bp, Artificial Sequence
  Synthetic
caaattgattattcagttttgatggatctgcaacatcccaaattctaaccacaccatttccagcacctctctgct

SEQ ID NO: 227616 - DNA, 75 bp, Artificial Sequence
  Synthetic
caaattgattattcagttttgatggatctggaacatcccaaattctaaccacaccatttccagcacctctctgct

SEQ ID NO: 227617 - DNA, 75 bp, Artificial Sequence
  Synthetic
aatgatgaatcaaagaaagaaatcaatcttctaagccagacagtgaatgccttaatctcagataatttgttaatg

SEQ ID NO: 227618 - DNA, 75 bp, Artificial Sequence
  Synthetic
gttgaaatcccagggtcttcaagatttccgatctttttgtcagttgcagttgtgacagattacccatgtacaacc

SEQ ID NO: 227619 - DNA, 75 bp, Artificial Sequence
  Synthetic
ttccgatctttttgtcagttgcagttgtgacagattacccatgtacaacccttgggaacctgactcagtcctctt

SEQ ID NO: 227620 - DNA, 75 bp, Artificial Sequence
  Synthetic
aagaataaaattaaagagctaatgagcatcccttattgtaattacacaaagttttggtatgtcaatcataccctg

SEQ ID NO: 227621 - DNA, 75 bp, Artificial Sequence
  Synthetic
acagggcagcacactcttccaagatgttggttgataaggaatggaagttatcttaacacttctgaattcaggaat

SEQ ID NO: 227622 - DNA, 75 bp, Artificial Sequence
  Synthetic
tatggtgtttttctggatgcttttcatggacatgagcctatccacttctttgtttaaatctctcagtttgtttag

SEQ ID NO: 227623 - DNA, 75 bp, Artificial Sequence
  Synthetic
gactggattttagagagtgatcacctcatctcagagatgttaagtaaggaatatgctgaaaggcaaggcaaaacc

SEQ ID NO: 227624 - DNA, 75 bp, Artificial Sequence
  Synthetic
atcctcctcacccctcttgttctttctgagagccctttggacttgtgaaacctggttgaagtcaatgctgtcagc

SEQ ID NO: 227625 - DNA, 75 bp, Artificial Sequence
  Synthetic
ccaatcacattagttgatatttgtttctggagcacaattttcttcacagcatcattgttccttcatctagtcgga

SEQ ID NO: 227626 - DNA, 75 bp, Artificial Sequence
  Synthetic
tatgagcttggcatctttcaaaacatctgtttttacggtatgggtgaactgacttaggcctcttctcaatgattg

SEQ ID NO: 227627 - DNA, 75 bp, Artificial Sequence
  Synthetic
atacccacccatcgacacctcaaaggcgaagcctgtcctttgcctcataagctggacagcttcggaggttgtaga

SEQ ID NO: 227628 - DNA, 75 bp, Artificial Sequence
  Synthetic
agtccaccgaaagctgggaatttccttggagtgagccatggtggcttataaccaaagggtctgaaataaagctca

SEQ ID NO: 227629 - DNA, 75 bp, Artificial Sequence
  Synthetic
ggtggcttataaccaaagggtctgaaataaagctcagtagaagagttagacactttgcctaggatccactgtgag

SEQ ID NO: 227630 - DNA, 75 bp, Artificial Sequence
  Synthetic
ggtggcttataaccaaagggtctgaaataaagctcagtagaagagttagacactttgcctaggatccactgtgtg

SEQ ID NO: 227631 - DNA, 75 bp, Artificial Sequence
  Synthetic
ggtggcttataaccaaagggtctgaaataaagctcagtagaagagttagacactttgcctaggatccactgtgcg

SEQ ID NO: 227632 - DNA, 75 bp, Artificial Sequence
  Synthetic
ggtggcttataaccaaagggtctgaaataaagctcagtagaagagttagacactttgcctaggatccactgtggg

SEQ ID NO: 227633 - DNA, 75 bp, Artificial Sequence
  Synthetic
tgtggcaaatatcccagattgaagaaacccaccatctggcacaaaagacattaaacacagccaagacccctgccg

SEQ ID NO: 227634 - DNA, 75 bp, Artificial Sequence
  Synthetic
gcaccggggatcctaggcgtaactagatcaagtttttactgagtactgaataaatataaacatattgagcatcca

SEQ ID NO: 227635 - DNA, 75 bp, Artificial Sequence
  Synthetic
acccgggcccagcccgggtcggcggggccccccagtccgcggctctgccgcggactggggaggcactgcttacag

SEQ ID NO: 227636 - DNA, 75 bp, Artificial Sequence
  Synthetic
gccaatctgtgcaagacagcacagagcctcccacaatgggcaactgcaataagcctctcaagaggcctcccaaca

SEQ ID NO: 227637 - DNA, 75 bp, Artificial Sequence
  Synthetic
tgcaaaggctgccttgggtagaaatagaaggctgagaggtaaaagtgccactggttcttcatctaccattttgcc

SEQ ID NO: 227638 - DNA, 75 bp, Artificial Sequence
  Synthetic
cacaaacaacacccaaccaaccttcagcagagttcagaagaacagccccacccagtctctacggtcgctataact

SEQ ID NO: 227639 - DNA, 75 bp, Artificial Sequence
  Synthetic
atccatcactgattgatacatgatacaatccaacagagcacagtgaggttcaccagaactcaatttgaatggaga

SEQ ID NO: 227640 - DNA, 75 bp, Artificial Sequence
  Synthetic
gtaaatgttgttggtttgccgacacaaatctgatcacatgcaatgaccactatttgtgcctgagatgtcatcaaa

SEQ ID NO: 227641 - DNA, 75 bp, Artificial Sequence
  Synthetic
gtctttttctctctttttcttgttgacaacaactccattatgatgtttgcaaagatgtccaaacttctcccaaat

SEQ ID NO: 227642 - DNA, 75 bp, Artificial Sequence
  Synthetic
caatgctcaggaactctgaactctgtcatatatgttggaaaccactaccgacatccatcatagttcctgtagagc

SEQ ID NO: 227643 - DNA, 75 bp, Artificial Sequence
  Synthetic
ttgctgatcatagagtcttgcttgatcagatgtgagtttcacatctaccagctttaaatccttccgtccatgaat

SEQ ID NO: 227644 - DNA, 75 bp, Artificial Sequence
  Synthetic
caagcgctcccccaccatgaccaaccacaaacccggtccatcagacccccggggggccccaacggggcccccacg

SEQ ID NO: 227645 - DNA, 75 bp, Artificial Sequence
  Synthetic
gtctaaaagtttccttatgtcgtcagaaccttgagttgtaatcaccatatcttgtggtagtaaacctattacata

SEQ ID NO: 227646 - DNA, 75 bp, Artificial Sequence
  Synthetic
ggggatccccgggggtgttgggctgcgtcactcgatgtcctccactcgaggcatgcctgccaggggtctgcacat

SEQ ID NO: 227647 - DNA, 75 bp, Artificial Sequence
  Synthetic
acttaatactcctggcattgcatcctcgatgtcttgcatcaagatgccatgtgaatgtctgctgccatttttgaa

SEQ ID NO: 227648 - DNA, 75 bp, Artificial Sequence
  Synthetic
cacacccttcaatctgaatgacccctggatgtctgatatcacaagctctttgagtgatttactataggcaacctt

SEQ ID NO: 227649 - DNA, 75 bp, Artificial Sequence
  Synthetic
gcccttctcatcatgtggctttctaaaacaatgaatataatgcttgttggctggctgatatagtgccaattccac

SEQ ID NO: 227650 - DNA, 75 bp, Artificial Sequence
  Synthetic
aaagttggtgaattcaatccattcaccaaaactttctattgactttgtaagctgttccttatacagatcatggac

SEQ ID NO: 227651 - DNA, 75 bp, Artificial Sequence
  Synthetic
agggtctgttggaggcccttcaatgtcaagccacagtgtattagtggggtctaacttctttacagcctctttaat

SEQ ID NO: 227652 - DNA, 75 bp, Artificial Sequence
  Synthetic
aatggtgaaatcctcctgttgaaacaaaataacctgtgatgttgcctttaaataaggccacagatggtgcagcat

SEQ ID NO: 227653 - DNA, 75 bp, Artificial Sequence
  Synthetic
cactgcttcttgcatttcagtcaggtttgctagtcttagattctgaccgtttttctcgggttgtctcggtccaac

SEQ ID NO: 227654 - DNA, 75 bp, Artificial Sequence
  Synthetic
ggaaacaataccttcatcatcttctagggcccccaatgctttcactatcacatcacctgtaaactccactttata

SEQ ID NO: 227655 - DNA, 75 bp, Artificial Sequence
  Synthetic
ctttgattcttaacgtttgatagactatgaattaatcgttgatattcctggtcctcaatatcaatctcaagcatg

SEQ ID NO: 227656 - DNA, 75 bp, Artificial Sequence
  Synthetic
ttgaggtttctttgttagatcaacacttgtgttgtcccaagatctcccaagaatttgtgatctggaaccaatgta

SEQ ID NO: 227657 - DNA, 75 bp, Artificial Sequence
  Synthetic
cgtggacagtctttcacctcccacataaaaggcaccatccttcaagaccaacggatcttcttggttttcaggtcc

SEQ ID NO: 227658 - DNA, 75 bp, Artificial Sequence
  Synthetic
aggccacccgtcacctgagagacacaatttatacagaaggttctcataaggatttcgattcccaggtttctcgtc

SEQ ID NO: 227659 - DNA, 75 bp, Artificial Sequence
  Synthetic
tgagagcctgtaggagtatttgtcactcaactccagagaaaattcacctaaatccaaggtaacatgcctcatcaa

SEQ ID NO: 227660 - DNA, 75 bp, Artificial Sequence
  Synthetic
tataaacatcccctcttttcgcttgacttgcagagttgatttaatcaagctggagaaattatcaggagtgaccct

SEQ ID NO: 227661 - DNA, 75 bp, Artificial Sequence
  Synthetic
aaagctgtcatttgaaccagccagatttgattcgatcaacattgcagctaaatcaaaactggcctgcccggtgaa

SEQ ID NO: 227662 - DNA, 75 bp, Artificial Sequence
  Synthetic
aattgtttccagcatgttcccaccgtcaagtattgaggcgccagctttcacagcagctgacagactgaagttata

SEQ ID NO: 227663 - DNA, 75 bp, Artificial Sequence
  Synthetic
caatggaaggcctgcaacaaccgatacaccatccaatagcatatggtttcctcctgacccagacacagactgatc

SEQ ID NO: 227664 - DNA, 75 bp, Artificial Sequence
  Synthetic
gccagagatgttgatggagctctcgtccttagttacgatctgcaagcattcgtgctctagagttagcttgtcaag

SEQ ID NO: 227665 - DNA, 75 bp, Artificial Sequence
  Synthetic
gactgccaccaccttcaagttgacttccttgttccggatctctcccacatccattatgcattccaaagaaaagct

SEQ ID NO: 227666 - DNA, 75 bp, Artificial Sequence
  Synthetic
gtcatttaaattcggatatttaacagtgtataacaggcccagagatgtcaacgcttggaccacactattcatcgt

SEQ ID NO: 227667 - DNA, 75 bp, Artificial Sequence
  Synthetic
gtacaccatttttctctttaacttgaacttcgtagacatccttgcatgatcaatttgcaccactaagcctacagt

SEQ ID NO: 227668 - DNA, 75 bp, Artificial Sequence
  Synthetic
ttctccaccctggacagtcatacaagcgattgtgagagctggcatggaaccaaactgattattcagttttgatgg

SEQ ID NO: 227669 - DNA, 75 bp, Artificial Sequence
  Synthetic
aatattctcagccttaattccaaacaattcacctacatcaggggctttttcctggggtggcaattgaacaccatc

SEQ ID NO: 227670 - DNA, 75 bp, Artificial Sequence
  Synthetic
ccaaactcgcacctctcaggaatgtgctttctaataagccctttcaactcttggacatattcatccatggccaag

SEQ ID NO: 227671 - DNA, 75 bp, Artificial Sequence
  Synthetic
atctgagacatcccagattctaaccacaccatttccagcacctctctgctgttggaatcccagggtcttcaagat

SEQ ID NO: 227672 - DNA, 75 bp, Artificial Sequence
  Synthetic
aaccaccacgctgcttaatgagattctgacaccctcgaagttggagacaacataacccattgcgatatcctccac

SEQ ID NO: 227673 - DNA, 75 bp, Artificial Sequence
  Synthetic
gtgctttctaataagccctttcaactcttggacatattcatccatggccaagtgtcgcctaggatcctcggtgcg

SEQ ID NO: 227674 - DNA, 75 bp, Artificial Sequence
  Synthetic
ttctgacctctttgtcagttgcagctgtgacaaattacccatgtacagcccttggggacctgactcagtcctctt

SEQ ID NO: 227675 - DNA, 75 bp, Artificial Sequence
  Synthetic
aaacatagctctggtaacattgtgatttttaaccattaaggcaaagtcagttaattctgctaactcaatttgact

SEQ ID NO: 227676 - DNA, 75 bp, Artificial Sequence
  Synthetic
tatcttgttcttcagtttttccaagtctgatgcaagctccatcaattcatctctccccagatctccaatcttgaa

SEQ ID NO: 227677 - DNA, 75 bp, Artificial Sequence
  Synthetic
atcatcctctagttctaggacttcattgaaccagaaaaatgatttcaaacaagatgttgaaaggactaatgggtt

SEQ ID NO: 227678 - DNA, 75 bp, Artificial Sequence
  Synthetic
tatggtgtttttctggatgcttttcatagacatgagcctatccacttctttgtttaaatccctcagcttgttcag

SEQ ID NO: 227679 - DNA, 75 bp, Artificial Sequence
  Synthetic
taccattgacgataggaccagttgagttttgaaatttgtacagatttgctggggactaagtcccaattcccagtc

SEQ ID NO: 227680 - DNA, 75 bp, Artificial Sequence
  Synthetic
atcctcttcaccccttttgttctttctgagagccctctgcacttgtgaaacctggttgaagtcgatgctgtcagc

SEQ ID NO: 227681 - DNA, 75 bp, Artificial Sequence
  Synthetic
agtgtagctcgattgccttgtgtgtgctgaagcacaatcgctttgtttgactatgtaaacactgttatctctggt

SEQ ID NO: 227682 - DNA, 75 bp, Artificial Sequence
  Synthetic
tatgagcttggcatctttcaacacatctgttttcacagtgtgggtgaactgactcaggcctcttctcagtgactg

SEQ ID NO: 227683 - DNA, 75 bp, Artificial Sequence
  Synthetic
cttcaacaggtgactaatgatgccaaggttttcattcatcatgtctaaagcaatgcaaacatccagaaattttag

SEQ ID NO: 227684 - DNA, 75 bp, Artificial Sequence
  Synthetic
agtccaccgaaagctgggaatttccttggagtgagccatagtggctaataaccaaaggatttgaaataaagctca

SEQ ID NO: 227685 - DNA, 75 bp, Artificial Sequence
  Synthetic
cctcccactatccattgttctgctgacctgaaggtcattcataaatggagccaagtgttcatcaaaaagaactgg

SEQ ID NO: 227686 - DNA, 75 bp, Artificial Sequence
  Synthetic
agtggctaataaccaaaggatttgaaataaagctcagtagaagagttagacactttgcctaggatccactgtgcg

SEQ ID NO: 227687 - DNA, 75 bp, Artificial Sequence
  Synthetic
ataatttctccttatagattgcaggacatgattcatccccagttggtcctcaatttgtctcaccactttaggctt

SEQ ID NO: 227688 - DNA, 75 bp, Artificial Sequence
  Synthetic
tagatcaagttttgctgagtaaaattttaaacacattgagtatccgtgcaagacagcgcagagctccccacaatg

SEQ ID NO: 227689 - DNA, 75 bp, Artificial Sequence
  Synthetic
gcgcacagtggatcctaggcgtaactagatcaagttttgctgagtaaaattttaaacacattgagtatccgtgca

SEQ ID NO: 227690 - DNA, 75 bp, Artificial Sequence
  Synthetic
cacagcccaaaagaagttttggttgttcaacaccagcggcttttggggctctttaactgtagaaaatacccactc

SEQ ID NO: 227691 - DNA, 75 bp, Artificial Sequence
  Synthetic
ggcaactgcaataagcctcccaagaggcctcccaacacacaaacatcatccaaccaaccctcagcagagttcagg

SEQ ID NO: 227692 - DNA, 75 bp, Artificial Sequence
  Synthetic
tccaagctcacatgcgtttgttaggaccaatgagaaataatcccacaaaataggctttgaaaactggctcacttt

SEQ ID NO: 227693 - DNA, 75 bp, Artificial Sequence
  Synthetic
agaacagccccacccagtctctatggtcgctacaactgcaaatgctgttggtttgccgacacaaacttgattaca

SEQ ID NO: 227694 - DNA, 75 bp, Artificial Sequence
  Synthetic
atcaagtgaattgttgcaatatatgatcttgggcttcaacgcacatatttcacatgtgcaagtactcacacctga

SEQ ID NO: 227695 - DNA, 75 bp, Artificial Sequence
  Synthetic
tgtaacgaccactacttgtgcctgagatgtcatcaaacaatgctcaggaattctgaactctgtcacatatgctgg

SEQ ID NO: 227696 - DNA, 75 bp, Artificial Sequence
  Synthetic
gtacacttcttttatgtataagaatcctcctttcccatctctaacacacttgctgcccatacttttgcagaaccc

SEQ ID NO: 227697 - DNA, 75 bp, Artificial Sequence
  Synthetic
aaaccactaccgacatccatcacagttcccgtggagccaagtgcccccccaccatgaacatccccaaactcggtc

SEQ ID NO: 227698 - DNA, 75 bp, Artificial Sequence
  Synthetic
aataaaccccgaggcaacagatgactggaaagctgacttattaattgactcagcaaggatcttcttaactccttt

SEQ ID NO: 227699 - DNA, 75 bp, Artificial Sequence
  Synthetic
cacaagacccccggggggccccaacggggcccccacgggggatccccgggggtcttgggctgcgtcactcaatgt

SEQ ID NO: 227700 - DNA, 75 bp, Artificial Sequence
  Synthetic
tgtgaagtttctggaaagtttggactgcaaggttttaattaaagttggcacttcttccctttcaagaactcttct

SEQ ID NO: 227701 - DNA, 75 bp, Artificial Sequence
  Synthetic
cctccacttggggcgtgcttgccaggggtctacacatcacacccttcagtctgaatgacccctgggtgtctgata

SEQ ID NO: 227702 - DNA, 75 bp, Artificial Sequence
  Synthetic
acttgtcatcaactttgtcctcaaaactagtctaagatctccaaaacttgataagttcacccatctatagtttaa

SEQ ID NO: 227703 - DNA, 75 bp, Artificial Sequence
  Synthetic
tcacaagctctttgagtgatttactataggcaaccttaaagttggtaaattcgatccattcgccaaagctttcaa

SEQ ID NO: 227704 - DNA, 75 bp, Artificial Sequence
  Synthetic
cacgcgactaacttcttgttcactacagcctgcatactgcaaaaaaccagtcaaggcctcatcaccacccctacc

SEQ ID NO: 227705 - DNA, 75 bp, Artificial Sequence
  Synthetic
ttgattttgtgagctgtttcttgtacaaatcatgaacaatggtgaaatcttcctgttgaaacaaaataacctgtg

SEQ ID NO: 227706 - DNA, 75 bp, Artificial Sequence
  Synthetic
aatcaaactaatcaaattctcttcaaatattctgcctcgttttatatcattaaaaacctttctagcacagttcct

SEQ ID NO: 227707 - DNA, 75 bp, Artificial Sequence
  Synthetic
atgttgctttcaaataaggccacagttggtgcagcatagaaacaacactctcatcatcttctagggcccccaatg

SEQ ID NO: 227708 - DNA, 75 bp, Artificial Sequence
  Synthetic
gatgaaagaggtttccttgtcatcctgaaaaatagcttcaattttcctttgtagacggtaaccccttgtgccatc

SEQ ID NO: 227709 - DNA, 75 bp, Artificial Sequence
  Synthetic
ctttcaccacaagatcacctgtaaactctactttatatgtggacagtctctcacctcccacatagaaggcaccat

SEQ ID NO: 227710 - DNA, 75 bp, Artificial Sequence
  Synthetic
aacccagtccttcacatcttgatcctcaatagccccaaaaggggtttccccatacccagagtatctaatcagttg

SEQ ID NO: 227711 - DNA, 75 bp, Artificial Sequence
  Synthetic
ccttcaagaccaacgggtcttcttggttttcaggtcccgagagcctgtaggaatatttgtcactcaactctgggg

SEQ ID NO: 227712 - DNA, 75 bp, Artificial Sequence
  Synthetic
gttgactcgcttagatattctggacactattttagtgctgactccatttgcaatgcattgatcacagatagtatc

SEQ ID NO: 227713 - DNA, 75 bp, Artificial Sequence
  Synthetic
aaaatccacctaaatccaaggtaacatttctcattaagaaattatcatttgagccagccagatttgactcgatta

SEQ ID NO: 227714 - DNA, 75 bp, Artificial Sequence
  Synthetic
tatagtctctgacaattgtgtgggtgtcttacacttcacattatgtaaggctgcagcaacaaactttgtgagcaa

SEQ ID NO: 227715 - DNA, 75 bp, Artificial Sequence
  Synthetic
acattgcagccaaatcaaaactggcctgcccagtaaataatgggaggcttgcaacaaccgacacaccatccagca

SEQ ID NO: 227716 - DNA, 75 bp, Artificial Sequence
  Synthetic
tggtgtttcttcacccatgacaaagaatcttgatttgaactctgcgacaaaagtcccgatgacacttttgggact

SEQ ID NO: 227717 - DNA, 75 bp, Artificial Sequence
  Synthetic
gcatatggtttcctcctgacccagacacagactgatcgactgccaccaccttcaaaataacctctttgttctgga

SEQ ID NO: 227718 - DNA, 75 bp, Artificial Sequence
  Synthetic
gacaaacttgtttaatttagatgacagaaactcatggaagcagatcatttcgagccactctgcagcatttgaacc

SEQ ID NO: 227719 - DNA, 75 bp, Artificial Sequence
  Synthetic
tctctcctacatccattatgcattccaaagagaaactatacaccatttttctcttcaacttgaacttcgttgaca

SEQ ID NO: 227720 - DNA, 75 bp, Artificial Sequence
  Synthetic
ctcctctacatctagagaaggtgtcttgattagagtaatctgatcatcactagaggtgtatgacacagggatcac

SEQ ID NO: 227721 - DNA, 75 bp, Artificial Sequence
  Synthetic
ttcttacatgatcgatctgcaccactaggcccacaatgacattctcagccttcaatccaaacaattcacctatat

SEQ ID NO: 227722 - DNA, 75 bp, Artificial Sequence
  Synthetic
gtcatacaagagatcgagtgcataacacaaaaattgctccgtaattaatccatacaaatcagaagtgttgtgtag

SEQ ID NO: 227723 - DNA, 75 bp, Artificial Sequence
  Synthetic
caggagccttctcctgaggcggcaattgaacaccatcaaccatcacgttgcttaacgagattctaacaccctcga

SEQ ID NO: 227724 - DNA, 75 bp, Artificial Sequence
  Synthetic
tatcccttgccccatgtccaaaacagacataatgtgactgggaatctgaccatttaactgcatggtctggtggaa

SEQ ID NO: 227725 - DNA, 75 bp, Artificial Sequence
  Synthetic
agttagagacaacataccccattgcgatatcctccacaaacatagctctggaaacattttgattcttaaccatta

SEQ ID NO: 227726 - DNA, 75 bp, Artificial Sequence
  Synthetic
gaactcttcactcagactggtggaaccgcagcccatcaatccaagggacctttttagctttccagtacagtaggc

SEQ ID NO: 227727 - DNA, 75 bp, Artificial Sequence
  Synthetic
aggcaaagtcagtcaattctgctaactcaatttgactatcatcctctagctctaggacttcattgaaccagaaaa

SEQ ID NO: 227728 - DNA, 75 bp, Artificial Sequence
  Synthetic
ttcagccacattaataggcacttccacaactttgtgaagatgccatttcagtatacttttaacagaatcaagatc

SEQ ID NO: 227729 - DNA, 75 bp, Artificial Sequence
  Synthetic
atgacttcagacaagatgttgaaaggactaatgggtttaccattgaagataggaccagctgggtcttgaagtttg

SEQ ID NO: 227730 - DNA, 75 bp, Artificial Sequence
  Synthetic
tatttttgacctgtcaacaggggttctcaattccagcatttgtaataatgctaggaaaagtgcaggactcattgt

SEQ ID NO: 227731 - DNA, 75 bp, Artificial Sequence
  Synthetic
tgcaaatctgctgcggactaagtcctaattcccaatctgtgtagcttgactgccttatgtgtgctaaggcacaat

SEQ ID NO: 227732 - DNA, 75 bp, Artificial Sequence
  Synthetic
tggaccccattttgagtgatcataagaacatgacaaatcaccattgttcaccgccatcttcatatcacaaattgc

SEQ ID NO: 227733 - DNA, 75 bp, Artificial Sequence
  Synthetic
cactttgtttaactatgtaaacactgttgtctctggtcttcaacaggtgactgatgataccaaggttttcattca

SEQ ID NO: 227734 - DNA, 75 bp, Artificial Sequence
  Synthetic
ccgttcaaattctttttcagaattcagacaggtgtacctcatagaattccctacagcttctgaaaagtcctccac

SEQ ID NO: 227735 - DNA, 75 bp, Artificial Sequence
  Synthetic
tcatgtctaaagcaatgcagacatccagaaattttagcctcccgctatccattgttctgctgacctgaagatcat

SEQ ID NO: 227736 - DNA, 75 bp, Artificial Sequence
  Synthetic
caaccttgtcatcagttttgtgttaaggtctcccacatagagctctctgtttgaacccacttgttctttataact

SEQ ID NO: 227737 - DNA, 75 bp, Artificial Sequence
  Synthetic
tcataaatggagtcaagtgttcgtcaaaaagaactggataatttctccttatagattgcagaacatggttcattc

SEQ ID NO: 227738 - DNA, 75 bp, Artificial Sequence
  Synthetic
caggccaaatttgaggttccctgagttggaactaatgcttgtgaactcagtgggtgagtcttcagaataaaagca

SEQ ID NO: 227739 - DNA, 75 bp, Artificial Sequence
  Synthetic
caggccaaatttgaggttccctgagttggaacttatgcttgtgaactcagtgggtgagtcttcagaataaaagca

SEQ ID NO: 227740 - DNA, 75 bp, Artificial Sequence
  Synthetic
caggccaaatttgaggttccctgagttggaactcatgcttgtgaactcagtgggtgagtcttcagaataaaagca

SEQ ID NO: 227741 - DNA, 75 bp, Artificial Sequence
  Synthetic
caggccaaatttgaggttccctgagttggaactgatgcttgtgaactcagtgggtgagtcttcagaataaaagca

SEQ ID NO: 227742 - DNA, 75 bp, Artificial Sequence
  Synthetic
ccagttggtcttcaatttgtctcaccactttaggcttcacagcccaaaaaaagttttggttgttcaacaccaatg

SEQ ID NO: 227743 - DNA, 75 bp, Artificial Sequence
  Synthetic
caaattccttaatgctgcattggtaaagtagcttttatccaacttatctgcaatcgcctccgaattgctttctct

SEQ ID NO: 227744 - DNA, 75 bp, Artificial Sequence
  Synthetic
gcttttggggctctttaactgtggaaaacacccactctccaagttcacatgcatttgttaggactaatgaaaaat

SEQ ID NO: 227745 - DNA, 75 bp, Artificial Sequence
  Synthetic
tatactgagtctaacctcgtctttgagtctcagtgtctcatcggtgaaacctagtctagatctacttttgtgctc

SEQ ID NO: 227746 - DNA, 75 bp, Artificial Sequence
  Synthetic
aatcccacaaaataggttttgaaaactgactcactttgttaagtgagttgttgcaatatatgatcttgggcttta

SEQ ID NO: 227747 - DNA, 75 bp, Artificial Sequence
  Synthetic
ataacttcccagtttttgatcaaagtggccttgtatcaagaggtacttaaaacacatgaaatactcttcatcttt

SEQ ID NO: 227748 - DNA, 75 bp, Artificial Sequence
  Synthetic
acgcacatatttcacatgtacaagcacttacacctgaatacacttcttttatgtataagaatccccctttcccat

SEQ ID NO: 227749 - DNA, 75 bp, Artificial Sequence
  Synthetic
ataacttgatgtggtcaggttttttagcagtaaccccaagggacagacatctagtacttcctcaaggaagtaatt

SEQ ID NO: 227750 - DNA, 75 bp, Artificial Sequence
  Synthetic
ctctaacgcacttgctacccatgcttttgcagaacccaataaaacctgaggcaacggatgactggaaagctgact

SEQ ID NO: 227751 - DNA, 75 bp, Artificial Sequence
  Synthetic
gtatttttctgacgatgtgtaaactgcgtcacataactccttgtacatctcaggaagaagtacgtctgggtcaaa

SEQ ID NO: 227752 - DNA, 75 bp, Artificial Sequence
  Synthetic
gtatttttctgacgatgtgtaaactgcgtcacataactccttgtacatctcaggatgaagtacgtctgggtcaaa

SEQ ID NO: 227753 - DNA, 75 bp, Artificial Sequence
  Synthetic
gtatttttctgacgatgtgtaaactgcgtcacataactccttgtacatctcaggacgaagtacgtctgggtcaaa

SEQ ID NO: 227754 - DNA, 75 bp, Artificial Sequence
  Synthetic
gtatttttctgacgatgtgtaaactgcgtcacataactccttgtacatctcaggaggaagtacgtctgggtcaaa

SEQ ID NO: 227755 - DNA, 75 bp, Artificial Sequence
  Synthetic
tattaattgactcagcaaggatcttcttaactccttttgtgaagtttctggaaagtttggattgcaaggttttaa

SEQ ID NO: 227756 - DNA, 75 bp, Artificial Sequence
  Synthetic
atcctttacttcatgtaacgacacttcagctctaatctctttcatcacaccaaaaggagaccacaaattgtctaa

SEQ ID NO: 227757 - DNA, 75 bp, Artificial Sequence
  Synthetic
ttaaagttggcacttcctccctttcaagaactcttctacttgtcatcaactttgtcctcaaaactaacctaagat

SEQ ID NO: 227758 - DNA, 75 bp, Artificial Sequence
  Synthetic
aggactatttccactttttactgagttgttagcttggccgaggtttttagaacttatcttcacactgttgtcagc

SEQ ID NO: 227759 - DNA, 75 bp, Artificial Sequence
  Synthetic
ctccaaaacttgataaattcacccatctatagttcaacacgcgattaacttcttgttcactgcaacctgcatact

SEQ ID NO: 227760 - DNA, 75 bp, Artificial Sequence
  Synthetic
catcttggctaaggcaacttgtacatcatgcttaatttcgttaaatgattcaacctgttcttctgttaacgcctc

SEQ ID NO: 227761 - DNA, 75 bp, Artificial Sequence
  Synthetic
gtaaaaaaccagtcaaggcctcatcaccacctctaccaatcaaattgatcagattctcctcaaatattctgccac

SEQ ID NO: 227762 - DNA, 75 bp, Artificial Sequence
  Synthetic
atacatcaaagacagttcttcttgactgctcttagcttttggccctgcactcaccagaccagttagattttttag

SEQ ID NO: 227763 - DNA, 75 bp, Artificial Sequence
  Synthetic
gctttatatcattaaaaacctttctggcacagttcctaataaaagaggtttccttgtcatcatgaaagatagctt

SEQ ID NO: 227764 - DNA, 75 bp, Artificial Sequence
  Synthetic
aattaaatagtcagttgactctggatccagattgtatctccctttggttttgaacctttctgctaaagaggaaac

SEQ ID NO: 227765 - DNA, 75 bp, Artificial Sequence
  Synthetic
caatctttctctgtagacggtaaccccttgagccatccacccagtctttcacatcttgatcttcaatagccccaa

SEQ ID NO: 227766 - DNA, 75 bp, Artificial Sequence
  Synthetic
acatgctgacaccagtttttccttgtcataggtagagaggatgttgcctaactcatctagttttggtatgacaac

SEQ ID NO: 227767 - DNA, 75 bp, Artificial Sequence
  Synthetic
agggggtctctccatatccggagtatctaattaattggttaactcgcttagatattcttgtcactattttggtgc

SEQ ID NO: 227768 - DNA, 75 bp, Artificial Sequence
  Synthetic
actcttattacttgataggtccagagcagtacttgttatattgggtctaaagggattgtttttaagctccccaga

SEQ ID NO: 227769 - DNA, 75 bp, Artificial Sequence
  Synthetic
tgactccatttgcaatgcattgatcacagatggtatctatagtttctgacaattgtgtgggtgttttacacttta

SEQ ID NO: 227770 - DNA, 75 bp, Artificial Sequence
  Synthetic
aacctttaactttcccctattaaacagagacacacagtagtttaagagttctttacacacacctggtgtctgcac

SEQ ID NO: 227771 - DNA, 75 bp, Artificial Sequence
  Synthetic
cattgtgtaaagctgcagcaacaaactttgtgagcaatggtgtttcttcacccatgacaaaaaatcttgatttga

SEQ ID NO: 227772 - DNA, 75 bp, Artificial Sequence
  Synthetic
atcttcagtgtcccttaaagattttgaaaagaacttccttagaccactaatcatggtgtcttcctgatctacagt

SEQ ID NO: 227773 - DNA, 75 bp, Artificial Sequence
  Synthetic
cccatgacaaaaaatcttgatttgaactctgcgacaaaagtcccgatgacactcttggggctgacaaacttattc

SEQ ID NO: 227774 - DNA, 75 bp, Artificial Sequence
  Synthetic
aatttagatgacagaaactcatggaagcagatcatctcgagccactccgcagcatctgaacccccttctatatcc

SEQ ID NO: 227775 - DNA, 75 bp, Artificial Sequence
  Synthetic
cagttttccattcagagatgggttcaccacagcacatccaaatttaactttaggctcaatgaatttctcaaaaca

SEQ ID NO: 227776 - DNA, 75 bp, Artificial Sequence
  Synthetic
agagaaggtgtcttgataagagtgatctgatcgtcactagaggtatatgacacagggattacatcatacaaaaga

SEQ ID NO: 227777 - DNA, 75 bp, Artificial Sequence
  Synthetic
cttgatttgatctgttagtcgatcaggcgtttcttttgtgattaaatggcaaagataactaacatttagcaagta

SEQ ID NO: 227778 - DNA, 75 bp, Artificial Sequence
  Synthetic
tcgagtgcataacacaaaaattgctctgtgattaatccatacaaatcagaagtgttatgtagtatcccttgcccc

SEQ ID NO: 227779 - DNA, 75 bp, Artificial Sequence
  Synthetic
tttaaatcttcttgagaaaaacaagcttgcatctgactcaccaccaagaagcctaataaagagtcccactgcaag

SEQ ID NO: 227780 - DNA, 75 bp, Artificial Sequence
  Synthetic
atgtccaaaacagacataatgtgactaggaatctgaccatttaactgcatggtctgatggaagaattcttcactc

SEQ ID NO: 227781 - DNA, 75 bp, Artificial Sequence
  Synthetic
cctttgaaccaccacttctgaacttgacttgcattccactaccaatttagatatcaggtcgacatgatggatctg

SEQ ID NO: 227782 - DNA, 75 bp, Artificial Sequence
  Synthetic
aaactggtggaaccgcagcccatcaatccaagggacctttttagctttccaatacagtaggcttcagccacattg

SEQ ID NO: 227783 - DNA, 75 bp, Artificial Sequence
  Synthetic
gttggcaaaggccatcagaaagtatctcaatccttgtaaaaaggtttgattcctttttgacggggaacagagtat

SEQ ID NO: 227784 - DNA, 75 bp, Artificial Sequence
  Synthetic
ataggcacttctacaactttgtgaaggtgccatttcagtatacttttaacagaatcaagatcaatttttgacctg

SEQ ID NO: 227785 - DNA, 75 bp, Artificial Sequence
  Synthetic
ggccaggactaacaacctcaatgtgggcccggtgtcgttcaccagcccggcatcaaaatccaaccagcttgtcat

SEQ ID NO: 227786 - DNA, 75 bp, Artificial Sequence
  Synthetic
tcaacaggggttctcaattccagcatttgtaataatgccaggaaaagtgcaggactcattgttggaccccatttt

SEQ ID NO: 227787 - DNA, 75 bp, Artificial Sequence
  Synthetic
ttcctcacacatcccagctaaaacctcatcggaaaaaacaggcaagaagaatctctttggatcacagtaaaatga

SEQ ID NO: 227788 - DNA, 75 bp, Artificial Sequence
  Synthetic
gagtgatcataagaacatgacaaatcaccattattcactgccatcttcatgtcacaaatggcccgttcaaattct

SEQ ID NO: 227789 - DNA, 75 bp, Artificial Sequence
  Synthetic
accctgttctgacatcacaccattatcagacagataaattgaataacaccttgacctttcacctgttttttgata

SEQ ID NO: 227790 - DNA, 75 bp, Artificial Sequence
  Synthetic
ttttcagagttcagacaggtgtacttcatagaattccctacagcttcagaaaaatcctccaccaatcttgtcatc

SEQ ID NO: 227791 - DNA, 75 bp, Artificial Sequence
  Synthetic
aaagagaaaaccaactaaaccctcagccaaataaaacctttgaacataacactctctgagtctaacattaccaaa

SEQ ID NO: 227792 - DNA, 75 bp, Artificial Sequence
  Synthetic
agttttgtgttgaggtctcctacatagagctctctgtttgaacccacctgttccttataacttagaccaaattta

SEQ ID NO: 227793 - DNA, 75 bp, Artificial Sequence
  Synthetic
gtacttagaaaattctctttcatttacaagcaaccttgatgaaaaggatgtcttcatagaattaattagtgacaa

SEQ ID NO: 227794 - DNA, 75 bp, Artificial Sequence
  Synthetic
aggtttcctgagttggaactaatgcttgtgaactcagtgggcgaatcttcagaataaaaacacagattccttaat

SEQ ID NO: 227795 - DNA, 75 bp, Artificial Sequence
  Synthetic
agatattgaggacaaagttttaaataatctcatttgctcaaaacaagacatctcctggtacaatctatgtttaca

SEQ ID NO: 227796 - DNA, 75 bp, Artificial Sequence
  Synthetic
gcggcattggtgaagtaacttttatccaacttgtctgcaatcgcctctgagttgctttctcttatactaagtcta

SEQ ID NO: 227797 - DNA, 75 bp, Artificial Sequence
  Synthetic
agtcttatcagagcctctttccactgaatacctcataattggtctgtctgagacaaggtgttgggctattagaat

SEQ ID NO: 227798 - DNA, 75 bp, Artificial Sequence
  Synthetic
agtcttttcagagcctctttccactgaatacctcataattggtctgtctgagacaaggtgttgggctattagaat

SEQ ID NO: 227799 - DNA, 75 bp, Artificial Sequence
  Synthetic
agtcttctcagagcctctttccactgaatacctcataattggtctgtctgagacaaggtgttgggctattagaat

SEQ ID NO: 227800 - DNA, 75 bp, Artificial Sequence
  Synthetic
agtcttgtcagagcctctttccactgaatacctcataattggtctgtctgagacaaggtgttgggctattagaat

SEQ ID NO: 227801 - DNA, 75 bp, Artificial Sequence
  Synthetic
acctcgtctttgagtcttaatgtctcatcggtgaaacccagtctagatctgcttttgtgctcataacttcctagt

SEQ ID NO: 227802 - DNA, 75 bp, Artificial Sequence
  Synthetic
caagctgttgaagtctggttgttttatcaaagtgcctaagtaatgccatatttctggatgtgatctctctagaat

SEQ ID NO: 227803 - DNA, 75 bp, Artificial Sequence
  Synthetic
ttttgatcaaagtgaccttgtatcaagaggtatttaaaacacataaaatactcttcgtccacataacttgatgtg

SEQ ID NO: 227804 - DNA, 75 bp, Artificial Sequence
  Synthetic
ccttgaacaattcttgacccaatttggattagtcccaatcttttttctaataagcttgacagcctccaaaatgtc

SEQ ID NO: 227805 - DNA, 75 bp, Artificial Sequence
  Synthetic
gtcagatttttcagcagcaaccccaagggacagacatcaagtactccctcaaggaagaagttgcatttttctgac

SEQ ID NO: 227806 - DNA, 75 bp, Artificial Sequence
  Synthetic
caacactctatcattcactaacataatcatctgacccactaccaatcccgatttcctcaaactctcaatcgcacc

SEQ ID NO: 227807 - DNA, 75 bp, Artificial Sequence
  Synthetic
aaggaagaagttgcatttttctgacgatttgtaaactgcgtcacacaactccttgtacacttcaggaggaagaac

SEQ ID NO: 227808 - DNA, 75 bp, Artificial Sequence
  Synthetic
ctggcaactgctactgatgtcaaccatcagatttaacattatgaggtctaagaatagcagagtgttcctcctggt

SEQ ID NO: 227809 - DNA, 75 bp, Artificial Sequence
  Synthetic
atctgggtcaaaatccttgacttcgtgtaacgatacttcagctctaatctctttcatcaccccaaaaggtgacca

SEQ ID NO: 227810 - DNA, 75 bp, Artificial Sequence
  Synthetic
attaaagactttcaaaccctttatattattacacaaggataagatgctaaggtaatgtttttctacattagagtg

SEQ ID NO: 227811 - DNA, 75 bp, Artificial Sequence
  Synthetic
attaaagactttcaaaccctttattttattacacaaggataagatgctaaggtaatgtttttctacattagagtg

SEQ ID NO: 227812 - DNA, 75 bp, Artificial Sequence
  Synthetic
attaaagactttcaaaccctttatcttattacacaaggataagatgctaaggtaatgtttttctacattagagtg

SEQ ID NO: 227813 - DNA, 75 bp, Artificial Sequence
  Synthetic
attaaagactttcaaaccctttatgttattacacaaggataagatgctaaggtaatgtttttctacattagagtg

SEQ ID NO: 227814 - DNA, 75 bp, Artificial Sequence
  Synthetic
caaattgtccaaaggattattcccattttttactgaattatcagctcggccgagatttttagttcttgtgttcac

SEQ ID NO: 227815 - DNA, 75 bp, Artificial Sequence
  Synthetic
tgtggtattcaactgctggctcactgtatctgtgccatcggtcctttcaacatagctaagagtcacattgtaaac

SEQ ID NO: 227816 - DNA, 75 bp, Artificial Sequence
  Synthetic
actgttgtcagccatcttggctaaggcaacttgtacatcatgtttaatttcgttgaatgattcaacctgttcttc

SEQ ID NO: 227817 - DNA, 75 bp, Artificial Sequence
  Synthetic
aatttccatcagcttattgttgcagaagggacagtttgacacatcactatctagatgagcacctaaacccgatag

SEQ ID NO: 227818 - DNA, 75 bp, Artificial Sequence
  Synthetic
tgttaacgcctcgtacattaaagacaattcttcttgagtactcttagctttcggccctgcactcaccaaacctgt

SEQ ID NO: 227819 - DNA, 75 bp, Artificial Sequence
  Synthetic
ggacttcagtaactcccttctgtcagtcaacttaaatttacctagacccttgctgaagacctcatccttgaacca

SEQ ID NO: 227820 - DNA, 75 bp, Artificial Sequence
  Synthetic
ggacttcagtaactcccttctgtcagtcatcttaaatttacctagacccttgctgaagacctcatccttgaacca

SEQ ID NO: 227821 - DNA, 75 bp, Artificial Sequence
  Synthetic
ggacttcagtaactcccttctgtcagtcaccttaaatttacctagacccttgctgaagacctcatccttgaacca

SEQ ID NO: 227822 - DNA, 75 bp, Artificial Sequence
  Synthetic
ggacttcagtaactcccttctgtcagtcagcttaaatttacctagacccttgctgaagacctcatccttgaacca

SEQ ID NO: 227823 - DNA, 75 bp, Artificial Sequence
  Synthetic
cagattttttagaatcaaatagtcagttgaatctggatctagattgtaccttcctttggttttaaacctctctgc

SEQ ID NO: 227824 - DNA, 75 bp, Artificial Sequence
  Synthetic
caatttcagtttgataagttcttctctcactgtcgactctctaacatctcctttcagaccaacaaacaatgattc

SEQ ID NO: 227825 - DNA, 75 bp, Artificial Sequence
  Synthetic
catagaggaaacacatgctgacactagtttttccttgtcataggtggagaggatgttgcctaactcatctagttt

SEQ ID NO: 227826 - DNA, 75 bp, Artificial Sequence
  Synthetic
attcaacctctcatcataatctagagaattccttttcaagcattctagattttccaaccccaagctttgattctt

SEQ ID NO: 227827 - DNA, 75 bp, Artificial Sequence
  Synthetic
tggtataacaacactcttgttacttgataagtccaaagcagtacttgttatattaggtctaaagggattattttt

SEQ ID NO: 227828 - DNA, 75 bp, Artificial Sequence
  Synthetic
gacgtttgatagactatgaattaatcgttgatattcctggtcctcaatatcaatgtcaagcatagatttggatgc

SEQ ID NO: 227829 - DNA, 75 bp, Artificial Sequence
  Synthetic
aagctccccagaaacctttaactttcccctattaaacaaagacacacaataatttaagagttctttacacacacc

SEQ ID NO: 227830 - DNA, 75 bp, Artificial Sequence
  Synthetic
tttcaaaatctcaataagcaaccatcttattctttcaatcacccagtcagcaacaaatctgttattgtaattgct

SEQ ID NO: 227831 - DNA, 75 bp, Artificial Sequence
  Synthetic
tggtgtctgcacatcctcagtgtcccttaaggattttgaaaaaaacttctttaaaccatttatcataatgtcttc

SEQ ID NO: 227832 - DNA, 75 bp, Artificial Sequence
  Synthetic
tctgccatcaactataggaactagagtcacacccgacttttgtaagtcatgcttcaggttcaaaagctttgacat

SEQ ID NO: 227833 - DNA, 75 bp, Artificial Sequence
  Synthetic
ctgatctacagtcagctttccatttagagatgggttcaccacagcacatccaaacttaactttgggctcaatgaa

SEQ ID NO: 227834 - DNA, 75 bp, Artificial Sequence
  Synthetic
gtcagctttccatttcttctcgaattcatctgggttcactctcacaaaggtctctagcaaaattagagtttttcc

SEQ ID NO: 227835 - DNA, 75 bp, Artificial Sequence
  Synthetic
agagatgggttcaccacagcacatccaaacttaactttgggctcaatgaacttctcaaaacatttcatctgatct

SEQ ID NO: 227836 - DNA, 75 bp, Artificial Sequence
  Synthetic
gttaatcggtcaggcgtttcttttgtgattaaatggcaaaggtaactaacatttagcagatatttgaatcttctt

SEQ ID NO: 227837 - DNA, 75 bp, Artificial Sequence
  Synthetic
agttagtttgaacccatcggggatcacctttggtaaggttggacataaaatcccgttatcagatagtattacatc

SEQ ID NO: 227838 - DNA, 75 bp, Artificial Sequence
  Synthetic
gagaaaaataaacttgcatctgactcaccactaagtagtctaatgaagagtcccactgcaagcctttgaaccacc

SEQ ID NO: 227839 - DNA, 75 bp, Artificial Sequence
  Synthetic
tacaaatctttgatcggtgtttgcttggcaggcgtgtgcttcgcaggactcaagttcaacaaggctagagagcag

SEQ ID NO: 227840 - DNA, 75 bp, Artificial Sequence
  Synthetic
acttctgaacttgacttgcattccactaccaatttagatgtcaggtcgatatgatgaatttggttagcaaaagcc

SEQ ID NO: 227841 - DNA, 75 bp, Artificial Sequence
  Synthetic
cttgaagccttcagtgagcaagggactgggatgaacctgagatagaaatgtgaccttttgatgtacaagttcgca

SEQ ID NO: 227842 - DNA, 75 bp, Artificial Sequence
  Synthetic
attaaaaagtatcttaatccttgtagaaaggtttgattcctctttgatggggagcagagtatagccagaactaac

SEQ ID NO: 227843 - DNA, 75 bp, Artificial Sequence
  Synthetic
cctctcaggaatatgttttctaatgagccctttcaattcttggacacattcatccatggccaagtgtcgcctagg

SEQ ID NO: 227844 - DNA, 75 bp, Artificial Sequence
  Synthetic
cgcaccggggatcctaggcgtaactagatcaagttttgctgagtaaaattttaaacacattgagtatccgtgcaa

SEQ ID NO: 227845 - DNA, 75 bp, Artificial Sequence
  Synthetic
aaccttaatatgggcccagtgtcattcattaatccggtgtcaaaatccagccagcttgtcatttcctcacacatt

SEQ ID NO: 227846 - DNA, 75 bp, Artificial Sequence
  Synthetic
atgttttctaatgagccctttcaattcttggacacattcatccatggccaagtgtcgcctaggatcctcggtgcg

SEQ ID NO: 227847 - DNA, 75 bp, Artificial Sequence
  Synthetic
ccagccaaaacttcatcagaaaaaacaggcaagaagaatctctttggatcacaataaaatgaaccctgttctgac

SEQ ID NO: 227848 - DNA, 75 bp, Artificial Sequence
  Synthetic
atcacaccgttatcagataaataaactgaataacacctggacctttcacctgtcttctgatagaaaagaaagcca

SEQ ID NO: 227849 - DNA, 75 bp, Artificial Sequence
  Synthetic
actaaactctcagccaaataaaacctttgggcataacactctctgagtctaacattaccaaagtacttagaaaat

SEQ ID NO: 227850 - DNA, 75 bp, Artificial Sequence
  Synthetic
tctctctcattcacaagcaatcttgaagaaaaggatgtcttcatagaattgattagtgacaaggatattgaggac

SEQ ID NO: 227851 - DNA, 75 bp, Artificial Sequence
  Synthetic
aaagtcttgaataacctcatttgctcaaagctagacatctcctggaacaatttatgtctacaaatcttatcagag

SEQ ID NO: 227852 - DNA, 75 bp, Artificial Sequence
  Synthetic
cctctttccactgaatacctcataattggtctatctgagacaagatgttgggctattgaaatcaagctattgaag

SEQ ID NO: 227853 - DNA, 75 bp, Artificial Sequence
  Synthetic
tctggttgctttatcaaagtgcttaagtgatgccatatttctggatgtgatctctctagaatttttgaacaattc

SEQ ID NO: 227854 - DNA, 75 bp, Artificial Sequence
  Synthetic
ttgacccaattgggattagtcccaatcttttttctgatgagtttaacagcctccaaaatgtccagcactctatca

SEQ ID NO: 227855 - DNA, 75 bp, Artificial Sequence
  Synthetic
ttcactaacataaccatctgacccactatcaatcccgattttctcaaactttcaatcgcgtcctggcaactgtca

SEQ ID NO: 227856 - DNA, 75 bp, Artificial Sequence
  Synthetic
ctaatgtcaaccatcaaattaaccattatgagatctaagaatagtagggtgtttcttctggtgttaaagaccttc

SEQ ID NO: 227857 - DNA, 75 bp, Artificial Sequence
  Synthetic
aacccctttattttattgcacaaagataagacactaaggtaatgtttttctatgttagagtgtgtggtgctaaac

SEQ ID NO: 227858 - DNA, 75 bp, Artificial Sequence
  Synthetic
tgctggtccactgtggctacaccatcggtcctttcaacacagctaaaggtcacattgtaaacaatttccatcaac

SEQ ID NO: 227859 - DNA, 75 bp, Artificial Sequence
  Synthetic
ttattgttacaaaagggacagcttgacacatcactatctagatgagcacctaagctcgatagggactctaataat

SEQ ID NO: 227860 - DNA, 75 bp, Artificial Sequence
  Synthetic
tcccttctgtcagtcaatttgaatttgcccagacctttgctgaagacctcatccttgaaccacaatttaagtttg

SEQ ID NO: 227861 - DNA, 75 bp, Artificial Sequence
  Synthetic
atgagttcttccctcactgtcgactctctaatgtctcctttcaaaccaataaacaatgactcattcaacctctca

SEQ ID NO: 227862 - DNA, 75 bp, Artificial Sequence
  Synthetic
tcataatctaaagaattccttttcaaatgttctaggttttccaaccccaagctttgattcttaacgtttgataga

SEQ ID NO: 227863 - DNA, 75 bp, Artificial Sequence
  Synthetic
ctatgaattaatcgttgatattcctggtcctcaatatcaatctcaagcatggatttggatgctttcaaaatcccg

SEQ ID NO: 227864 - DNA, 75 bp, Artificial Sequence
  Synthetic
ataagcaaccatcttattctttcaatcacccaatcagcaacaaatctattgttgtaattgctcctgccatcaaca

SEQ ID NO: 227865 - DNA, 75 bp, Artificial Sequence
  Synthetic
ataggaaccaaagtcacgcccgacttttgcaggtcatgcttcaggtttaaaagctttgacatgtcagctttccat

SEQ ID NO: 227866 - DNA, 75 bp, Artificial Sequence
  Synthetic
ttcttctcgaactcatctgggtttactcttacaaaggtctccagcagaattagggttttcccagttaatttgaac

SEQ ID NO: 227867 - DNA, 75 bp, Artificial Sequence
  Synthetic
ccatcggggatcacctttggtaaagttggacataaaatcccattgtcagatagtattacatctacgaatctttga

SEQ ID NO: 227868 - DNA, 75 bp, Artificial Sequence
  Synthetic
tcagtgtttgcctggcaggcgtgtgcttcacaggactcaagttcaacaagactagagagcaacttgaagccttct

SEQ ID NO: 227869 - DNA, 75 bp, Artificial Sequence
  Synthetic
gtgagcaagggactgggatgcacctgagataggaatgtgaccttttgatgtccaaactcgcacctctcaggaatg

SEQ ID NO: 227870 - DNA, 75 bp, Artificial Sequence
  Synthetic
gcgcactggccgtcgttttacacgccttcaccacagcacatccaaacttaacgacggcctaggatccactgtgcg

SEQ ID NO: 227871 - DNA, 75 bp, Artificial Sequence
  Synthetic
cgcacatgtgatcctaggcgattcttgatcgcgcttattagctaaccaatttaatttggtgttgaagtgttgaca

SEQ ID NO: 227872 - DNA, 75 bp, Artificial Sequence
  Synthetic
gcgcaccggggatcctaggcgtaactagatcaagttttgctgagtaaaattttaaacacattgagtatccgtgca

SEQ ID NO: 227873 - DNA, 75 bp, Artificial Sequence
  Synthetic
cccatgacaaaaaatcttgatttgaactctgcgacaaaagtcccgatgacactcttgggactgacaaacttattc

SEQ ID NO: 227874 - DNA, 75 bp, Artificial Sequence
  Synthetic
aaggaagaagttgcatttttctgacgatttgtaaactgcgtcacacaactccttgtacacctcaggaggaagaac

SEQ ID NO: 227875 - DNA, 75 bp, Artificial Sequence
  Synthetic
agagatgggttcaccacagcacatccaaacttaactttgggctcaatgaacttctcaaaacacttgatctgatct

SEQ ID NO: 227876 - DNA, 75 bp, Artificial Sequence
  Synthetic
ctatgaattaatcgttgatattcctggtcctcaatatcaatctcaagcatggatttggatgctttcaaaatctcg

SEQ ID NO: 227877 - DNA, 75 bp, Artificial Sequence
  Synthetic
gtgctttctaataagccctttcaactcttggacatattcatccatggccaagtgtcgcctaggatccactgtgcg

SEQ ID NO: 227878 - DNA, 75 bp, Artificial Sequence
  Synthetic
cgcacagtggatcctaggcgattcttgatcgcgcttattagctaaccaatttaatttggtgttgaagtgttgaca

SEQ ID NO: 227879 - DNA, 75 bp, Artificial Sequence
  Synthetic
tagtggctaataaccaaaggatttgaaataaagctcagtagaagagttagacactttgcctaggatccactgtgc

SEQ ID NO: 227880 - DNA, 75 bp, Artificial Sequence
  Synthetic
ggcaccggggatcctaggcgattcttgatcgcgcttattggctgaccaatttattttggtattgaagtgttgacg

SEQ ID NO: 227881 - DNA, 75 bp, Artificial Sequence
  Synthetic
cgctcgttgacacatggggcagctcatcagcttctttcaagagattcctgtttttctacaggaagccctaaacat

SEQ ID NO: 227882 - DNA, 75 bp, Artificial Sequence
  Synthetic
cgctctggtggctgttagcctgatagctgtcatcaaaggcatcataaacctctacaaaagtggtctcttccagtt

SEQ ID NO: 227883 - DNA, 75 bp, Artificial Sequence
  Synthetic
catcttctttctcctcctagaagggaggtcctgctctgatggcacattcaaaataggcctacatactgagttcca

SEQ ID NO: 227884 - DNA, 75 bp, Artificial Sequence
  Synthetic
catcttctttctcctcctagtagggaggtcctgctctgatggcacattcaaaataggcctacatactgagttcca

SEQ ID NO: 227885 - DNA, 75 bp, Artificial Sequence
  Synthetic
catcttctttctcctcctagcagggaggtcctgctctgatggcacattcaaaataggcctacatactgagttcca

SEQ ID NO: 227886 - DNA, 75 bp, Artificial Sequence
  Synthetic
catcttctttctcctcctaggagggaggtcctgctctgatggcacattcaaaataggcctacatactgagttcca

SEQ ID NO: 227887 - DNA, 75 bp, Artificial Sequence
  Synthetic
gtcagttaccctcactatgcagaggctcctagccaaccattcaaacgagctcccatctctctgcatgcttaacaa

SEQ ID NO: 227888 - DNA, 75 bp, Artificial Sequence
  Synthetic
tagcatctattatatgaagggaggtgtgaacaccttcctgattcgggtctctagtgtatctgtcctcatgaagga

SEQ ID NO: 227889 - DNA, 75 bp, Artificial Sequence
  Synthetic
tagcttctattatatgaagggaggtgtgaacaccttcctgattcgggtctctagtgtatctgtcctcatgaagga

SEQ ID NO: 227890 - DNA, 75 bp, Artificial Sequence
  Synthetic
tagcctctattatatgaagggaggtgtgaacaccttcctgattcgggtctctagtgtatctgtcctcatgaagga

SEQ ID NO: 227891 - DNA, 75 bp, Artificial Sequence
  Synthetic
tagcgtctattatatgaagggaggtgtgaacaccttcctgattcgggtctctagtgtatctgtcctcatgaagga

SEQ ID NO: 227892 - DNA, 75 bp, Artificial Sequence
  Synthetic
gaatgatgtatcagtctatgaaccagaagaccttggaaattgtctcaataagtctgactcaagctgggctgttca

SEQ ID NO: 227893 - DNA, 75 bp, Artificial Sequence
  Synthetic
gtatgatgtatcagtctatgaaccagaagaccttggaaattgtctcaataagtctgactcaagctgggctgttca

SEQ ID NO: 227894 - DNA, 75 bp, Artificial Sequence
  Synthetic
gcatgatgtatcagtctatgaaccagaagaccttggaaattgtctcaataagtctgactcaagctgggctgttca

SEQ ID NO: 227895 - DNA, 75 bp, Artificial Sequence
  Synthetic
ggatgatgtatcagtctatgaaccagaagaccttggaaattgtctcaataagtctgactcaagctgggctgttca

SEQ ID NO: 227896 - DNA, 75 bp, Artificial Sequence
  Synthetic
ttggctctcaaatgctttagggcatgactggctcatggattctccaatgttatgcagaaacaagacaaagatgga

SEQ ID NO: 227897 - DNA, 75 bp, Artificial Sequence
  Synthetic
ttggctctcaaatgctttagggcatgactggctcatggattctccaatgttatgcagaaacaagacaatgatgga

SEQ ID NO: 227898 - DNA, 75 bp, Artificial Sequence
  Synthetic
ttggctctcaaatgctttagggcatgactggctcatggattctccaatgttatgcagaaacaagacaacgatgga

SEQ ID NO: 227899 - DNA, 75 bp, Artificial Sequence
  Synthetic
ttggctctcaaatgctttagggcatgactggctcatggattctccaatgttatgcagaaacaagacaaggatgga

SEQ ID NO: 227900 - DNA, 75 bp, Artificial Sequence
  Synthetic
gggatccaatattcagctcaatatcagcaaagctgatgatgccagggtgtatggaaagaagataaggaatggtat

SEQ ID NO: 227901 - DNA, 75 bp, Artificial Sequence
  Synthetic
gaggcatctcttcaggggattccatgactcgtgtgaagaagggaaattgtgctatctgactatcaatcaatgtgg

SEQ ID NO: 227902 - DNA, 75 bp, Artificial Sequence
  Synthetic
gaggcatctcttcaggggtttccatgactcgtgtgaagaagggaaattgtgctatctgactatcaatcaatgtgg

SEQ ID NO: 227903 - DNA, 75 bp, Artificial Sequence
  Synthetic
gaggcatctcttcaggggcttccatgactcgtgtgaagaagggaaattgtgctatctgactatcaatcaatgtgg

SEQ ID NO: 227904 - DNA, 75 bp, Artificial Sequence
  Synthetic
gaggcatctcttcagggggttccatgactcgtgtgaagaagggaaattgtgctatctgactatcaatcaatgtgg

SEQ ID NO: 227905 - DNA, 75 bp, Artificial Sequence
  Synthetic
tgaccccagttcctttgactattgtagcacaaatcatctttccaaatgtcagtttgaccatgtgaacactcttca

SEQ ID NO: 227906 - DNA, 75 bp, Artificial Sequence
  Synthetic
tttccttgtgagaagtaagtcgcatctcaactttgaaaggtctttgaaagcatttttctcatggtctctaacaga

SEQ ID NO: 227907 - DNA, 75 bp, Artificial Sequence
  Synthetic
ctcctcaggaaaagacatgccaggaggttattgtctagaagaatggatgttaataacagcaaagatgaaatgttt

SEQ ID NO: 227908 - DNA, 75 bp, Artificial Sequence
  Synthetic
ctcctcaggaaaagacatgccaggaggttattgtctagaagaatggatgttaatatcagcaaagatgaaatgttt

SEQ ID NO: 227909 - DNA, 75 bp, Artificial Sequence
  Synthetic
ctcctcaggaaaagacatgccaggaggttattgtctagaagaatggatgttaataccagcaaagatgaaatgttt

SEQ ID NO: 227910 - DNA, 75 bp, Artificial Sequence
  Synthetic
ctcctcaggaaaagacatgccaggaggttattgtctagaagaatggatgttaatagcagcaaagatgaaatgttt

SEQ ID NO: 227911 - DNA, 75 bp, Artificial Sequence
  Synthetic
ctcctcaggaaaagacatgccaggtggttattgtctagaagaatggatgttaataacagcaaagatgaaatgttt

SEQ ID NO: 227912 - DNA, 75 bp, Artificial Sequence
  Synthetic
ctcctcaggaaaagacatgccaggtggttattgtctagaagaatggatgttaatatcagcaaagatgaaatgttt

SEQ ID NO: 227913 - DNA, 75 bp, Artificial Sequence
  Synthetic
ctcctcaggaaaagacatgccaggtggttattgtctagaagaatggatgttaataccagcaaagatgaaatgttt

SEQ ID NO: 227914 - DNA, 75 bp, Artificial Sequence
  Synthetic
ctcctcaggaaaagacatgccaggtggttattgtctagaagaatggatgttaatagcagcaaagatgaaatgttt

SEQ ID NO: 227915 - DNA, 75 bp, Artificial Sequence
  Synthetic
ctcctcaggaaaagacatgccaggcggttattgtctagaagaatggatgttaataacagcaaagatgaaatgttt

SEQ ID NO: 227916 - DNA, 75 bp, Artificial Sequence
  Synthetic
ctcctcaggaaaagacatgccaggcggttattgtctagaagaatggatgttaatatcagcaaagatgaaatgttt

SEQ ID NO: 227917 - DNA, 75 bp, Artificial Sequence
  Synthetic
ctcctcaggaaaagacatgccaggcggttattgtctagaagaatggatgttaataccagcaaagatgaaatgttt

SEQ ID NO: 227918 - DNA, 75 bp, Artificial Sequence
  Synthetic
ctcctcaggaaaagacatgccaggcggttattgtctagaagaatggatgttaatagcagcaaagatgaaatgttt

SEQ ID NO: 227919 - DNA, 75 bp, Artificial Sequence
  Synthetic
ctcctcaggaaaagacatgccagggggttattgtctagaagaatggatgttaataacagcaaagatgaaatgttt

SEQ ID NO: 227920 - DNA, 75 bp, Artificial Sequence
  Synthetic
ctcctcaggaaaagacatgccagggggttattgtctagaagaatggatgttaatatcagcaaagatgaaatgttt

SEQ ID NO: 227921 - DNA, 75 bp, Artificial Sequence
  Synthetic
ctcctcaggaaaagacatgccagggggttattgtctagaagaatggatgttaataccagcaaagatgaaatgttt

SEQ ID NO: 227922 - DNA, 75 bp, Artificial Sequence
  Synthetic
ctcctcaggaaaagacatgccagggggttattgtctagaagaatggatgttaatagcagcaaagatgaaatgttt

SEQ ID NO: 227923 - DNA, 75 bp, Artificial Sequence
  Synthetic
tggaaacactgctgttgctaagtgtaatcaaaatcatgactcagagttctgtgatatgctgaggctattcgacta

SEQ ID NO: 227924 - DNA, 75 bp, Artificial Sequence
  Synthetic
taacaagaatgcaataaagactctcaatgatgaatcaaagaaagaaatcaattttctaagccagacagtgaatgc

SEQ ID NO: 227925 - DNA, 75 bp, Artificial Sequence
  Synthetic
cttaatttcagataatttgttaatgaagaataaaattaaagagctgatgagcattccttattgcaattacacaaa

SEQ ID NO: 227926 - DNA, 75 bp, Artificial Sequence
  Synthetic
gttttggtatgtcaatcacaccttgacagggcagcacactttaccaagatgctggttaataaggaatggaagtta

SEQ ID NO: 227927 - DNA, 75 bp, Artificial Sequence
  Synthetic
tcttaacacttctgaattcagaaatgactggattttagaaagtgatcacctcatctcagagatgttaagcaagga

SEQ ID NO: 227928 - DNA, 75 bp, Artificial Sequence
  Synthetic
atatgctgaaaggcaaggcaaaaccccgatcacattggttgatatttgtttctggagcacaattttctttacagc

SEQ ID NO: 227929 - DNA, 75 bp, Artificial Sequence
  Synthetic
gtcattattccttcatctagtcggaatacccacccatcgacacctcaaaggcgaagcttgtcctttgccccatag

SEQ ID NO: 227930 - DNA, 75 bp, Artificial Sequence
  Synthetic
gctggacagcttaggaggctgtagatgcggcaaatatcctagactgaagaaacccaccgtctggcacagaagaca

SEQ ID NO: 227931 - DNA, 75 bp, Artificial Sequence
  Synthetic
ctaaagacagccaagacccctgccgacccgggctcggcccgggtcggcggggccccccagtccgcggctttgccg

SEQ ID NO: 227932 - DNA, 75 bp, Artificial Sequence
  Synthetic
cggactggggaggcactgcttacagtgcgaaggctgccttgggtaggaatagcaggctgagaggtagaagtgccg

SEQ ID NO: 227933 - DNA, 75 bp, Artificial Sequence
  Synthetic
ctggttcttcatctaccattttgccatccattactgattgatacatgatgcaatccaatagagcacagtgaggtt

SEQ ID NO: 227934 - DNA, 75 bp, Artificial Sequence
  Synthetic
cactggaactcaatttgaatggggagtctttttctctctttttcttgttgacaacaactccattgtgatgtctgc

SEQ ID NO: 227935 - DNA, 75 bp, Artificial Sequence
  Synthetic
ccaacagacttccatccagtgaaggcaccatctcaggtggaaatgctcaaagaggaaatagagcgactaaaagct

SEQ ID NO: 227936 - DNA, 75 bp, Artificial Sequence
  Synthetic
gaatgtcagcatatcctaatgatgagtggggaagtggcgaacagccaccaagccagcacatccaagagatttctt

SEQ ID NO: 227937 - DNA, 75 bp, Artificial Sequence
  Synthetic
agaggaaatagagcgactaaaagctcaattgaattccgccgctgagaactcagtgaccgccgttacgcaacaacc

SEQ ID NO: 227938 - DNA, 75 bp, Artificial Sequence
  Synthetic
accacaagcctatgattggatcgtaaggggtctaatctttcccaccattggaaaaacttatttccaacgagttgt

SEQ ID NO: 227939 - DNA, 75 bp, Artificial Sequence
  Synthetic
aggggtctaatctttcccaccattggaaaaacttatttccaacgagttgttgtgattactggtgggcttgaggat

SEQ ID NO: 227940 - DNA, 75 bp, Artificial Sequence
  Synthetic
ttgtcagaactgcaatggaacgtgagatgaaggtattgcgtgatgaaatcaatgggatacttgcaccattcctac

SEQ ID NO: 227941 - DNA, 75 bp, Artificial Sequence
  Synthetic
gactgcaaagcagcttcgtgactctggccttccagccaggctcacagaagagcaactccatcgcatttggagggg

SEQ ID NO: 227942 - DNA, 75 bp, Artificial Sequence
  Synthetic
acaggatggcacacggtgagccatactatagttctaaacctgacaaagatttcaactttgggagcacaatggcac

SEQ ID NO: 227943 - DNA, 75 bp, Artificial Sequence
  Synthetic
atggcagagaatgggtggagatctacccgatagagcatctgaatctcatgtcatctctgaaactaatacacaaag

SEQ ID NO: 227944 - DNA, 75 bp, Artificial Sequence
  Synthetic
agcaactccatcgcatttggaggggaggaccaaagaagtgtgatggctagcaagtctgacaagcaagtcactgtt

SEQ ID NO: 227945 - DNA, 75 bp, Artificial Sequence
  Synthetic
ttatcagtgtatagataatatttttcctacactcttttgtcaaatagctgacaggatggcacacggtgagccata

SEQ ID NO: 227946 - DNA, 75 bp, Artificial Sequence
  Synthetic
ccaatgctcttcaggagaggttacgtctctcccaggaggagaaagccacccttgctcttgatgtacaattccttc

SEQ ID NO: 227947 - DNA, 75 bp, Artificial Sequence
  Synthetic
gccagaagctgaaacacaaccacttgatttgtctcagaagaaagagaaacaaccagaacatgagcaacaagtggt

SEQ ID NO: 227948 - DNA, 75 bp, Artificial Sequence
  Synthetic
ttggttaaggacgctactgggagtactcagtttggcccagtgcaggcgctaggagcgcagtattcaatgtggaag

SEQ ID NO: 227949 - DNA, 75 bp, Artificial Sequence
  Synthetic
tagcaaacataaccattagtgacaagctagatgccgtgaggcaaattcttaattttgcctttgtacctagagctc

SEQ ID NO: 227950 - DNA, 75 bp, Artificial Sequence
  Synthetic
cgtctatggtcggtgcttcagcggtgaatggcactgtagtgaggatatcactcaatccaacttccactccatcct

SEQ ID NO: 227951 - DNA, 75 bp, Artificial Sequence
  Synthetic
catccattattatgaaatgtggaatatttttatgtttgttcttgcaattggcactgtcatgaggagcgcccgccc

SEQ ID NO: 227952 - DNA, 75 bp, Artificial Sequence
  Synthetic
atttttatgtttgttcttgcaattggcactgtcatgaggagcgcccgccctggtactgatttaattacacttgca

SEQ ID NO: 227953 - DNA, 75 bp, Artificial Sequence
  Synthetic
acgcaagcatttagatgttactgttgggaaaaatgcagtcttcaaattgaaaccttccgacttgggtggaccccg

SEQ ID NO: 227954 - DNA, 75 bp, Artificial Sequence
  Synthetic
aaaatcttgaccttagaattaagctcgcactagcaaacataaccattagtgacaagctagatgctgtgaggcaaa

SEQ ID NO: 227955 - DNA, 75 bp, Artificial Sequence
  Synthetic
gggaaaaatgcagtcttcaaattgaaaccttccgacttgggtggaccccgtgatggatggtggttaacaaacaca

SEQ ID NO: 227956 - DNA, 75 bp, Artificial Sequence
  Synthetic
agctcattggttaagaactgtcttctattatatccattattatgaaatgtggaatatttttatgtttgttcttgc

SEQ ID NO: 227957 - DNA, 75 bp, Artificial Sequence
  Synthetic
gtccatccattgaaatacatacattgggccaaactatgtcatcataccagaacacacagttcacaggcggcctat

SEQ ID NO: 227958 - DNA, 75 bp, Artificial Sequence
  Synthetic
gggccaaactatgtcatcataccagaacacacagttcacaggcggcctattcttggtggagctttcatcagcatg

SEQ ID NO: 227959 - DNA, 75 bp, Artificial Sequence
  Synthetic
aacacacagttcacaggcggcctattcttggtggagctttcatcagcatggtgttttactggatatgcggctaat

SEQ ID NO: 227960 - DNA, 75 bp, Artificial Sequence
  Synthetic
ttaattgctggtgggcacgcctgcttgacacttacaggcacaaccacgtcattatttgttgtcatactaacttgt

SEQ ID NO: 227961 - DNA, 75 bp, Artificial Sequence
  Synthetic
tgacacttacaggcacaaccacgtcattatttgttgtcatactaacttgtaggttcatacgaatggcaacagttt

SEQ ID NO: 227962 - DNA, 75 bp, Artificial Sequence
  Synthetic
tttcgaaggctcagccggaacaccgctcataatgaatgtgcctgaacacagccatttcgctagaacagcggtgga

SEQ ID NO: 227963 - DNA, 75 bp, Artificial Sequence
  Synthetic
ctcataatgaatgtgcctgaacacagccatttcgctagaacagcggtggaacactcttctctgtccacatccatc

SEQ ID NO: 227964 - DNA, 75 bp, Artificial Sequence
  Synthetic
actgtaccaactaggatcaaaaatgttgcatttgacttcttccagaagctaaaacagtcaggggtaagagttgga

SEQ ID NO: 227965 - DNA, 75 bp, Artificial Sequence
  Synthetic
ctgacactgtttggcaagtcttgaacaccgctgtttcggcagccgagctggtaaccccaccgccattcaattggc

SEQ ID NO: 227966 - DNA, 75 bp, Artificial Sequence
  Synthetic
caccgctgtttcggcagccgagctggtaaccccaccgccattcaattggctggttaaaggtggctggtggtttgt

SEQ ID NO: 227967 - DNA, 75 bp, Artificial Sequence
  Synthetic
actggtgcgcgtaggttttatgtttatcctagttaccaagatgctctgtctaataaacctgccctttgcaccggt

SEQ ID NO: 227968 - DNA, 75 bp, Artificial Sequence
  Synthetic
cagcacatgtcgttggtaataacacttttgtgaatgtgtgctatgagggcttgatgtacgaagcgaaggttcggt

SEQ ID NO: 227969 - DNA, 75 bp, Artificial Sequence
  Synthetic
atcctagttaccaagatgctctgtctaataaacctgccctttgcaccggtggtgttcctgccagcgctaggcaaa

SEQ ID NO: 227970 - DNA, 75 bp, Artificial Sequence
  Synthetic
gttcacacagatgaatcagcctagtctaggtcatggtgctaccccaatgacttttggccgctccataccagaacc

SEQ ID NO: 227971 - DNA, 75 bp, Artificial Sequence
  Synthetic
ccaacagcaagattaaaattatcaaaaaacccagattatagttgtgtcacagtcatggcttatgtaaatgaagat

SEQ ID NO: 227972 - DNA, 75 bp, Artificial Sequence
  Synthetic
actattggacctccaatggcccctaacacagccaactctcagaattgggtgaacaaaacaatcgttccacccgag

SEQ ID NO: 227973 - DNA, 75 bp, Artificial Sequence
  Synthetic
tagaccttgagcattatactacaatgcagggatttacccctgttgagagtgtgagttggtacacaactgatttcc

SEQ ID NO: 227974 - DNA, 75 bp, Artificial Sequence
  Synthetic
gctgttataatagacccaacagacttccatccagtgaaggcaccatctcaggtggaaatgctcaaagaggaaata

SEQ ID NO: 227975 - DNA, 75 bp, Artificial Sequence
  Synthetic
aaccttctgacgagcccagcccaatacccgggctatatgctcgtgtagacaacaccaagaaagctgatgtttatg

SEQ ID NO: 227976 - DNA, 75 bp, Artificial Sequence
  Synthetic
ggtggaaatgctcaaagaggaaatagagcgattaaaagctcaattgaattccgctgctgagaactcagtgaccgc

SEQ ID NO: 227977 - DNA, 75 bp, Artificial Sequence
  Synthetic
caccaataatagacaccagataaccagtgtgtttcttgtgagagtgacaactagcttccaggtgataaactacac

SEQ ID NO: 227978 - DNA, 75 bp, Artificial Sequence
  Synthetic
gtgatgttgttgaccttgtcagaactgcaatggaacgtgagatgaaggtattgcgtgatgaaatcaatgggatac

SEQ ID NO: 227979 - DNA, 75 bp, Artificial Sequence
  Synthetic
tagctacttcataagaggtgctgaaagtggctcaaatgtctctaatgtaaaaattagggaccaaacataccacac

SEQ ID NO: 227980 - DNA, 75 bp, Artificial Sequence
  Synthetic
ttgcgtgatgaaatcaatgggatacttgcaccattcctacaaaaaaagaaaggcaagaccaaacatggtaggggt

SEQ ID NO: 227981 - DNA, 75 bp, Artificial Sequence
  Synthetic
aggcaagaccaaacatggtaggggtagagtcagacgtaaccttagaaagggtgtgaaactccttactgaggaaga

SEQ ID NO: 227982 - DNA, 75 bp, Artificial Sequence
  Synthetic
tggtacctgctaactagcacagttatgcatgatggtcctacatcatcaggctgggtttggatgaatcaagagcta

SEQ ID NO: 227983 - DNA, 75 bp, Artificial Sequence
  Synthetic
tgcatgatggtcctacatcatcaggctgggtttggatgaatcaagagctaactaacaatattgcatatagaattg

SEQ ID NO: 227984 - DNA, 75 bp, Artificial Sequence
  Synthetic
ggccgcaacaggagtaaatcaagggcccgttcacaatctaggggccgagacaaatcagtcaagattacagtcaat

SEQ ID NO: 227985 - DNA, 75 bp, Artificial Sequence
  Synthetic
acctccaccagccgcatcacagctttattttgaactgcatactgtgcttcctcaagcaagatcagaggaacctga

SEQ ID NO: 227986 - DNA, 75 bp, Artificial Sequence
  Synthetic
ttatagaccgtattattggagagaggtctggctatcctgactatgatgatgaggattattatgatgaagatgatg

SEQ ID NO: 227987 - DNA, 75 bp, Artificial Sequence
  Synthetic
atggttggggaatggttggtgacgatgtagaatttgattatactgaagtaattaattttgaccaagcaaaaccaa

SEQ ID NO: 227988 - DNA, 75 bp, Artificial Sequence
  Synthetic
tattttgaactgcatactgtgcttcctcaagcaagatcagaggaacctgagacatatgtggatgctctcttgcct

SEQ ID NO: 227989 - DNA, 75 bp, Artificial Sequence
  Synthetic
agacagacagtgactttgagagtacagaggacgaaaacgatgaagtggacaggttcgatctccatccctcttctg

SEQ ID NO: 227990 - DNA, 75 bp, Artificial Sequence
  Synthetic
cgaccgtgcaaccctcctctctaccctcctcaatcaaggaatttcagtggagcgcgccactagaattactaatgg

SEQ ID NO: 227991 - DNA, 75 bp, Artificial Sequence
  Synthetic
aagcctcagaagaatgagcctcaaccatactcacaaacttatggcaaggcaccaatctgggaatcctatgatttt

SEQ ID NO: 227992 - DNA, 75 bp, Artificial Sequence
  Synthetic
tgatgatggatggggtatggttggtgatgatgtagaatttgattatactgaagtgattaactttgaccaaacaaa

SEQ ID NO: 227993 - DNA, 75 bp, Artificial Sequence
  Synthetic
ctcctcaatcaaggaatttcagtggagcgcgccactagaattactaatggtgcattcccagcactcgccgctaga

SEQ ID NO: 227994 - DNA, 75 bp, Artificial Sequence
  Synthetic
tcattctgccagcaccacaccggttaaccaaggcagatgaaatagttcttggatcaaaaattgtcaagcttagga

SEQ ID NO: 227995 - DNA, 75 bp, Artificial Sequence
  Synthetic
tgttggtttccgggcttagccctggtgcagcatggtcccatgcgtgcgaacaagcacgcagagcaggtgacaatc

SEQ ID NO: 227996 - DNA, 75 bp, Artificial Sequence
  Synthetic
aaatccgtaccaacttcttcagagaagttaccaaaaccttgccctgagccagaagttgaagcgcaaccacttgat

SEQ ID NO: 227997 - DNA, 75 bp, Artificial Sequence
  Synthetic
cgattattgaaacagccataaaaacccagaactatagtgcactacctgaagctgtgtttgagctcgacaaagcag

SEQ ID NO: 227998 - DNA, 75 bp, Artificial Sequence
  Synthetic
cggccacgccgagtaggatcgagggtacagcttcctatctctcttttctgtttctgtttagattattttaatcac

SEQ ID NO: 227999 - DNA, 75 bp, Artificial Sequence
  Synthetic
agttaccaaaaccttgccctgagccagaagttgaagcgcaaccacttgatttgtcccagaagaaagttgctgaga

SEQ ID NO: 228000 - DNA, 75 bp, Artificial Sequence
  Synthetic
tacagcttcctatctctcttttctgtttctgtttagattattttaatcaccatttaaaattgatttaatcagaag

SEQ ID NO: 228001 - DNA, 75 bp, Artificial Sequence
  Synthetic
ccaagaggggggtggcgattggcctttggcttatcacataactacaatatcctcttcttggtattacacacatac

SEQ ID NO: 228002 - DNA, 75 bp, Artificial Sequence
  Synthetic
ttggcttatcacataactacaatatcctcttcttggtattacacacataccaccaatatgacacttggtgaacca

SEQ ID NO: 228003 - DNA, 75 bp, Artificial Sequence
  Synthetic
tgcagcatggtcccatgcgtgcgaacaagcacgcagagcaggtgacaatcatgacctgcaaccttctggaagccg

SEQ ID NO: 228004 - DNA, 75 bp, Artificial Sequence
  Synthetic
caccaatatgacacttggtgaaccatattacagttctaagcctgacaaggactttgactttgggagcacgatggc

SEQ ID NO: 228005 - DNA, 75 bp, Artificial Sequence
  Synthetic
ctctgctagaacccccgcgagagcggaggtgcgtccctgctaattttccattattaggtcatttaccaattaata

SEQ ID NO: 228006 - DNA, 75 bp, Artificial Sequence
  Synthetic
gaggtgcgtccctgctaattttccattattaggtcatttaccaattaataggcccatttttgatgataagaaacc

SEQ ID NO: 228007 - DNA, 75 bp, Artificial Sequence
  Synthetic
ttattaggtcatttaccaattaataggcccatttttgatgataagaaacctagggatgatcttcttggtctactt

SEQ ID NO: 228008 - DNA, 75 bp, Artificial Sequence
  Synthetic
gttgaaaagctacctaaatttgtcaggaattctccacaagcctatgattggattgtaagaggtctgatcttcccc

SEQ ID NO: 228009 - DNA, 75 bp, Artificial Sequence
  Synthetic
gggtagtggtggtcactggtgggcttgaagatggcacgtatggttcatttgcatttgatggtaaggagtgggttg

SEQ ID NO: 228010 - DNA, 75 bp, Artificial Sequence
  Synthetic
tgaagatggcacgtatggttcatttgcatttgatggtaaggagtgggttgagattcacccaatagagcatttaaa

SEQ ID NO: 228011 - DNA, 75 bp, Artificial Sequence
  Synthetic
acttatcgcgaatttcggtatctagaggatactagagtgatacacataactgcaactgagaaaaatactgattca

SEQ ID NO: 228012 - DNA, 75 bp, Artificial Sequence
  Synthetic
cataagagtaacgctctacaggagaggcttcgccattcccaagaagagaaagccaccctcgctctagatgtacaa

SEQ ID NO: 228013 - DNA, 75 bp, Artificial Sequence
  Synthetic
ggcttcgccattcccaagaagagaaagccaccctcgctctagatgtacaattccttcaacacgaaaacgtacgac

SEQ ID NO: 228014 - DNA, 75 bp, Artificial Sequence
  Synthetic
ggaagcacatgggtgggcaccatatattagagaattcactagagttttcaaaggagacaaacctgaagtactttg

SEQ ID NO: 228015 - DNA, 75 bp, Artificial Sequence
  Synthetic
accaagagtaatacaaatgaagtgggtgattttgggggctgtgcttacgtttctatcattaatacctggtggata

SEQ ID NO: 228016 - DNA, 75 bp, Artificial Sequence
  Synthetic
gtgattttgggggctgtgcttacgtttctatcattaatacctggtggatatgcacatagccagcagaacaaaact

SEQ ID NO: 228017 - DNA, 75 bp, Artificial Sequence
  Synthetic
gtatctatttcttaaaaaagaaatcattaaggaggaaaaaattaagaattctgacattcggcagatagtgtgcgc

SEQ ID NO: 228018 - DNA, 75 bp, Artificial Sequence
  Synthetic
cgcgagttccggtacctagaggataccagggtaatacatataactgcaactgagaagaatactgattcaacacct

SEQ ID NO: 228019 - DNA, 75 bp, Artificial Sequence
  Synthetic
gcaaatattcaacagagactttgacagaaaatcttgacctcagaattaaaatagccctggcaaatataaccatta

SEQ ID NO: 228020 - DNA, 75 bp, Artificial Sequence
  Synthetic
agaaaatcttgacctcagaattaaaatagccctggcaaatataaccattactgacaagttggatgctatgaagca

SEQ ID NO: 228021 - DNA, 75 bp, Artificial Sequence
  Synthetic
ttcagttggtcaatgtgggtggtcaccaatggaaggcgtctttaaaaaaacaatgcagcgcctagtaaacaaagg

SEQ ID NO: 228022 - DNA, 75 bp, Artificial Sequence
  Synthetic
agggtgcactggctgcgaactgtcttccattatatccattactatgaaatgtggaatatttttatgtttgtactt

SEQ ID NO: 228023 - DNA, 75 bp, Artificial Sequence
  Synthetic
tccattatatccattactatgaaatgtggaatatttttatgtttgtacttgctgtcagtacagtcatgaaaagca

SEQ ID NO: 228024 - DNA, 75 bp, Artificial Sequence
  Synthetic
caccagcactcttcaagcacatcaaagaaattaggtggaatttcatcaataaagaccaacgtgaaaagtacagac

SEQ ID NO: 228025 - DNA, 75 bp, Artificial Sequence
  Synthetic
tttagcaacatctcgattgtctggttttagaatggctgttttaccaactataccattccacactacgctaacctt

SEQ ID NO: 228026 - DNA, 75 bp, Artificial Sequence
  Synthetic
tccggcagatagtttgtgccgaccccatttacaccaggataggggcgtgcttagaggcacatcagaatgctttga

SEQ ID NO: 228027 - DNA, 75 bp, Artificial Sequence
  Synthetic
cctccttaatcgccatgtacttctaccatctggtgaagtcaccttgcagacacgaggcaatccatctgggcagtt

SEQ ID NO: 228028 - DNA, 75 bp, Artificial Sequence
  Synthetic
tttagaatggctgttttaccaactataccattccacactacgctaaccttgtgggttatggacaccctcatgtta

SEQ ID NO: 228029 - DNA, 75 bp, Artificial Sequence
  Synthetic
ctataactcgagcactgttggcaccgatccttggaattgttttcttatgcttcatggaggactccaactatgtta

SEQ ID NO: 228030 - DNA, 75 bp, Artificial Sequence
  Synthetic
gatccttggaattgttttcttatgcttcatggaggactccaactatgttaaccaagttcgtggtcttatagccac

SEQ ID NO: 228031 - DNA, 75 bp, Artificial Sequence
  Synthetic
taggtggaatttcatcaataaagaccaacgtgaaaagtacagacatgtgcatgaatggtatgttgataacctcct

SEQ ID NO: 228032 - DNA, 75 bp, Artificial Sequence
  Synthetic
gcctgtttaacacttactggcacgaccacgtcattgtttgttgtcatactgacatgcagatttatacgtatggca

SEQ ID NO: 228033 - DNA, 75 bp, Artificial Sequence
  Synthetic
tttctacaacaccttcagtgcctgatgattatgaggagagagtgattactatgtatagagacatctttggcatgt

SEQ ID NO: 228034 - DNA, 75 bp, Artificial Sequence
  Synthetic
ccacgtcattgtttgttgtcatactgacatgcagatttatacgtatggcaacagtgtttgttggagcaaggtttg

SEQ ID NO: 228035 - DNA, 75 bp, Artificial Sequence
  Synthetic
tgtagcaactgtaccaactagaataaggaatgctgcatttgatttcttccaaaaattaaaacagtctggagtgcg

SEQ ID NO: 228036 - DNA, 75 bp, Artificial Sequence
  Synthetic
tggataattgtgggagcagtgctcacatttttatctctaatacctgggggctatgcgcaaagccaagccaacaac

SEQ ID NO: 228037 - DNA, 75 bp, Artificial Sequence
  Synthetic
aggaatgctgcatttgatttcttccaaaaattaaaacagtctggagtgcgagtcggggtcaatgactttgtggta

SEQ ID NO: 228038 - DNA, 75 bp, Artificial Sequence
  Synthetic
aaaccttacaaaattttacctgaccttgaatcactccatgggaagctcctatgctatcagttgcttgctgcgttc

SEQ ID NO: 228039 - DNA, 75 bp, Artificial Sequence
  Synthetic
ttgaatcactccatgggaagctcctatgctatcagttgcttgctgcgttcatggcagaagaccacccttttaagg

SEQ ID NO: 228040 - DNA, 75 bp, Artificial Sequence
  Synthetic
ttgatacacccgagggcaagggaaccggtttcttctccggtaacgacataattacagcagctcatgtcgttggta

SEQ ID NO: 228041 - DNA, 75 bp, Artificial Sequence
  Synthetic
aacagaaaaccttgaccttagaattaagctcgcactagcaaatataaccatcagtgataagctagatgccgtgag

SEQ ID NO: 228042 - DNA, 75 bp, Artificial Sequence
  Synthetic
cggtttcttctccggtaacgacataattacagcagctcatgtcgttggtaacaacacctttgttaatgtatgcta

SEQ ID NO: 228043 - DNA, 75 bp, Artificial Sequence
  Synthetic
agagacatctttggcatgtgggtgaagcctgggaaggttatttgtagagatagcatagttgggctatccttttgt

SEQ ID NO: 228044 - DNA, 75 bp, Artificial Sequence
  Synthetic
gtacgatacatgcctgagaaagacatagcatttataacatgccctggtgatttgcatccaacaacaagattgaaa

SEQ ID NO: 228045 - DNA, 75 bp, Artificial Sequence
  Synthetic
agcaactccatcgcatttggaggggaggaccaaagaagtgtgatggctagcaagtccaacaagcaggtaactgtt

SEQ ID NO: 228046 - DNA, 75 bp, Artificial Sequence
  Synthetic
aacccgtgccaacctctccagaaaaattgatggcatcgttactaaaaccttataaaattttacctgatcttgaat

SEQ ID NO: 228047 - DNA, 75 bp, Artificial Sequence
  Synthetic
tagcatttataacatgccctggtgatttgcatccaacaacaagattgaaattggcaaaaaatccagattacagta

SEQ ID NO: 228048 - DNA, 75 bp, Artificial Sequence
  Synthetic
tgaagagctggttgtctcaaccgccactgccatggtccatggtaacactctttcctatgcagcacgcacccagga

SEQ ID NO: 228049 - DNA, 75 bp, Artificial Sequence
  Synthetic
actgccatggtccatggtaacactctttcctatgcagcacgcacccaggacggaatgtcgggtgcacctgtttgt

SEQ ID NO: 228050 - DNA, 75 bp, Artificial Sequence
  Synthetic
caaacgtcaatcttctcaacgtgtccgtaacattgtcaataaacaactcaggaaacaaggtgtcacaggaccaaa

SEQ ID NO: 228051 - DNA, 75 bp, Artificial Sequence
  Synthetic
aaaaaaagaaaggcaagaccaagcacggtaggggtagagtcagacgtaaccttagaaaaggcgtgaaactcctta

SEQ ID NO: 228052 - DNA, 75 bp, Artificial Sequence
  Synthetic
ccagccaggctcacagaagagcaactccatcgcatttggaggggaggaccaaagaagtgtgatggctagcaagtc

SEQ ID NO: 228053 - DNA, 75 bp, Artificial Sequence
  Synthetic
ttcatcaaaccaacactggttacactggtggtgctgttgtgatagacccagcagattttcatccagtaaaagctc

SEQ ID NO: 228054 - DNA, 75 bp, Artificial Sequence
  Synthetic
tggtggtgctgttgtgatagacccagcagattttcatccagtaaaagctccatctcaaattgaacaacttaagga

SEQ ID NO: 228055 - DNA, 75 bp, Artificial Sequence
  Synthetic
acaccagtggcactaccgagattgaggcgtgtattctcctcaaccctgtccttgttaaggacgctactgggagca

SEQ ID NO: 228056 - DNA, 75 bp, Artificial Sequence
  Synthetic
gaagatgatgatggatgggggatggttggtgatgatgtagaatttgactatactgaagtaatcaattttgaccaa

SEQ ID NO: 228057 - DNA, 75 bp, Artificial Sequence
  Synthetic
ctgagcgctacgacagaaagtgcaccagacaccactgagccacagtccattgccacgttagaacagaaaaatgtt

SEQ ID NO: 228058 - DNA, 75 bp, Artificial Sequence
  Synthetic
aggtcgaagcagatcagtcaagattacagtcaattcccataataaaggcagaagacagaacggacgcaacaaata

SEQ ID NO: 228059 - DNA, 75 bp, Artificial Sequence
  Synthetic
ctgaagtatctgaatgtcaaactgacttctatggttggtgcgtctgccgtcaatggcactgtccttagagtttca

SEQ ID NO: 228060 - DNA, 75 bp, Artificial Sequence
  Synthetic
tcaatctaatcaacgtgtccgtaaaattgtcaataaacaactcaggaaacagggtgtcacaggaccaaaacctgc

SEQ ID NO: 228061 - DNA, 75 bp, Artificial Sequence
  Synthetic
ttaggattgcaatggagcgtgaaatgaaggtgttacgggatgaaattaataaagttttagaaccattcatacaaa

SEQ ID NO: 228062 - DNA, 75 bp, Artificial Sequence
  Synthetic
ccactagttggtcagggttgggtgcacgtaagcaccttgatgttacagtgggcaaaaatgcaacatttaaattga

SEQ ID NO: 228063 - DNA, 75 bp, Artificial Sequence
  Synthetic
tagaggtagggtcagacgtaaccttaggaagggagtgaaacttctgaccgaagaagaataccgtgaactcttaga

SEQ ID NO: 228064 - DNA, 75 bp, Artificial Sequence
  Synthetic
aagaagaataccgtgaactcttagaaaaaggtctggatcgtgaaacattccttgatcttatagaccgcataattg

SEQ ID NO: 228065 - DNA, 75 bp, Artificial Sequence
  Synthetic
tgatgatgatgaatattatgatgatgatgatgatggatggggattagttggtgatgatgtggaatttgattatac

SEQ ID NO: 228066 - DNA, 75 bp, Artificial Sequence
  Synthetic
cggacgaacaatgtcctcatacaagaatgagcagttcacagggggtttattcttggttgaacttgcttcagagtg

SEQ ID NO: 228067 - DNA, 75 bp, Artificial Sequence
  Synthetic
gatgatgatggatggggattagttggtgatgatgtggaatttgattatacagaggttattaattttgatcaacac

SEQ ID NO: 228068 - DNA, 75 bp, Artificial Sequence
  Synthetic
gtgctttacaggttatgctgccaacccaaatcttgttaacttggtcaaatcaacagacaggcaagtatctgtaac

SEQ ID NO: 228069 - DNA, 75 bp, Artificial Sequence
  Synthetic
ccaaatcttgttaacttggtcaaatcaacagacaggcaagtatctgtaacatttgaaggtagcgctggatcccca

SEQ ID NO: 228070 - DNA, 75 bp, Artificial Sequence
  Synthetic
gtatatttaaaccaaagctcgctcctgcaccagtgactgaggtacaaccacttgacctatcttgcaagcaacaag

SEQ ID NO: 228071 - DNA, 75 bp, Artificial Sequence
  Synthetic
catgcttttgaggaatacggaccaaccacatggggcccacaagcttttattaaatcttttgataaattcttttat

SEQ ID NO: 228072 - DNA, 75 bp, Artificial Sequence
  Synthetic
acatctagatgttactgttggcaaaaatgcagtttttaagttaaagccttctgacttaggtgggcctcgagatgg

SEQ ID NO: 228073 - DNA, 75 bp, Artificial Sequence
  Synthetic
gtcactttgctcggacagcacttgcacgctcgacagtgcccaccaccttagcgcgtgcaggtgagcggaccactt

SEQ ID NO: 228074 - DNA, 75 bp, Artificial Sequence
  Synthetic
tacagtcagaacctgaacagcaacctgagcccattaagacccaaaaaaatgagccccagccatactcacaaacat

SEQ ID NO: 228075 - DNA, 75 bp, Artificial Sequence
  Synthetic
acgctcgacagtgcccaccaccttagcgcgtgcaggtgagcggaccacttcagacacagtgtggcaggtacttaa

SEQ ID NO: 228076 - DNA, 75 bp, Artificial Sequence
  Synthetic
ctatgattttgattgggatgaagatgatgcaaggtatatattgccagcaccacaccgtctaacaaaagctgatga

SEQ ID NO: 228077 - DNA, 75 bp, Artificial Sequence
  Synthetic
gtcacacctccgccattcaattggttggtcaagggaggttggtggttcgtgaaacttattgctgggaggactaga

SEQ ID NO: 228078 - DNA, 75 bp, Artificial Sequence
  Synthetic
aagcttaggactattattgagacagctataaaaacccagaactacggtgccttgcctgaagccgtctttgaacta

SEQ ID NO: 228079 - DNA, 75 bp, Artificial Sequence
  Synthetic
atcctagctaccaagatgcattgtccaataagccagcactctgcaccggcagcactccaggaggcatgaggacgc

SEQ ID NO: 228080 - DNA, 75 bp, Artificial Sequence
  Synthetic
tagaagggtttctacagagagtaaaatcaaagaataaggctccaaaaaactacaaagggccccagaagaccaagg

SEQ ID NO: 228081 - DNA, 75 bp, Artificial Sequence
  Synthetic
gctggtggtgagtcatcatctgacactgtttggcaagttttgaacacagctgtctcagcagcagagcttgtgact

SEQ ID NO: 228082 - DNA, 75 bp, Artificial Sequence
  Synthetic
tacaaagggccccagaagaccaaggggcccaaaactaccactcattagatgcatggcaagtgttgttggagcccc

SEQ ID NO: 228083 - DNA, 75 bp, Artificial Sequence
  Synthetic
aaggcggttggtggtttgttaaacttattgctgggcgtgctcgcactggtgcgcgtagattctatgtttatccta

SEQ ID NO: 228084 - DNA, 75 bp, Artificial Sequence
  Synthetic
aaatttcccactagttggccatttacccatcaataggcctatctatgatgataagaaaccaagagatgacttact

SEQ ID NO: 228085 - DNA, 75 bp, Artificial Sequence
  Synthetic
tattgctgggcgtgctcgcactggtgcgcgtagattctatgtttatcctagttatcaagatgctctatccaacaa

SEQ ID NO: 228086 - DNA, 75 bp, Artificial Sequence
  Synthetic
catgcttttgaggaatacggaccaaccacatggggcccacaggctttcatcaaatcttttgataaatttttctat

SEQ ID NO: 228087 - DNA, 75 bp, Artificial Sequence
  Synthetic
gttgactggtacactatagatttccaaccatctgaggcgcctgcgccgattcaaggcctgcaggtacttgtgaac

SEQ ID NO: 228088 - DNA, 75 bp, Artificial Sequence
  Synthetic
tcttcttataccagacagagcaatccagtgcgtaccacgctgcagttcacacagatgaatcaacctagtcttggc

SEQ ID NO: 228089 - DNA, 75 bp, Artificial Sequence
  Synthetic
cacggtgccactccagcaacgttgggccggtctatcccagagcctggtgaccaattcaaagttatcatgactgcc

SEQ ID NO: 228090 - DNA, 75 bp, Artificial Sequence
  Synthetic
ccacatggggcccacaggctttcatcaaatcttttgataaatttttctatgctgaaccaattgattttttctcag

SEQ ID NO: 228091 - DNA, 75 bp, Artificial Sequence
  Synthetic
tgattgggcaacgtatcgcgaattccggtacctagaggataccagagtgatacatataactgcaactgagaaaaa

SEQ ID NO: 228092 - DNA, 75 bp, Artificial Sequence
  Synthetic
cggtacctagaggataccagagtgatacatataactgcaactgagaaaaatacagattccaccccagcttatcct

SEQ ID NO: 228093 - DNA, 75 bp, Artificial Sequence
  Synthetic
aagaatatctggaagcacatggatgggcaccatacatcagagaattcactagggtattcagaggggagaggcctg

SEQ ID NO: 228094 - DNA, 75 bp, Artificial Sequence
  Synthetic
ggcaccatacatcagagaattcactagggtattcagaggggagaggcctgaggtactttggtatcttttccttaa

SEQ ID NO: 228095 - DNA, 75 bp, Artificial Sequence
  Synthetic
agggataagttttacccagggtggatggtatttgttgacaaatacatctattgttgatggggctatgccacctgg

SEQ ID NO: 228096 - DNA, 75 bp, Artificial Sequence
  Synthetic
attaggaattctgatattcggcaaatagtatgtgccgatcccatttacaccaggataggggcgtgcttagaagca

SEQ ID NO: 228097 - DNA, 75 bp, Artificial Sequence
  Synthetic
aagaaggcactggtgtattttatgcaacaatatgtaaactcacatactaataataaacaccaggtttccagcatc

SEQ ID NO: 228098 - DNA, 75 bp, Artificial Sequence
  Synthetic
tagtatgtgccgatcccatttacaccaggataggggcgtgcttagaagcacatcagaattcgctgatgaagcagc

SEQ ID NO: 228099 - DNA, 75 bp, Artificial Sequence
  Synthetic
tgggtggtcacctatggaaggcggctttaagaaaacaatgcagcgcctagttaacaggggcaataagtacttcat

SEQ ID NO: 228100 - DNA, 75 bp, Artificial Sequence
  Synthetic
ctatgagagtgacaacactgaatacttggatgctccagactctgctgaccagttaaatgaagacatagagacaga

SEQ ID NO: 228101 - DNA, 75 bp, Artificial Sequence
  Synthetic
tttaagaaaacaatgcagcgcctagttaacaggggcaataagtacttcattgagtttgactggacccgctatgat

SEQ ID NO: 228102 - DNA, 75 bp, Artificial Sequence
  Synthetic
ggcatattaaagagataaggtggaacttcatcaataaggaccaacgtgaaaagtatagacatgttcatgagtggt

SEQ ID NO: 228103 - DNA, 75 bp, Artificial Sequence
  Synthetic
atatcatagacacttctgatgaagaagatgaaaatgagacagaccgtgtaaccctcctctcaactctcgtaaacc

SEQ ID NO: 228104 - DNA, 75 bp, Artificial Sequence
  Synthetic
atggcccacctccatcagggtggatttgggacaacatggagctgacaaatgaaaacatatattatgctgaccaag

SEQ ID NO: 228105 - DNA, 75 bp, Artificial Sequence
  Synthetic
accctcctctcaactctcgtaaaccaaggaatgacaatgacgcgtgccacaaagatagcaaggcgcgcattcccc

SEQ ID NO: 228106 - DNA, 75 bp, Artificial Sequence
  Synthetic
ctgcccccatacaaggtctgcaggtacttgtgaatagctctaaaaaagctgatgtgtatgcagtcaaacaatttg

SEQ ID NO: 228107 - DNA, 75 bp, Artificial Sequence
  Synthetic
accgtgcagacacggggcaacccatctggacagttctcaacaaccatggacaacaacatggtcaatttctggcta

SEQ ID NO: 228108 - DNA, 75 bp, Artificial Sequence
  Synthetic
gaagtgcatacaacaatgccccagccgagtatgagaaatgttggtcttgatgaggatcagaccgataattggcaa

SEQ ID NO: 228109 - DNA, 75 bp, Artificial Sequence
  Synthetic
cttcatcaataaggaccaacgtgaaaagtatagacatgttcatgagtggtatgttgacaaccttctcaaccgcca

SEQ ID NO: 228110 - DNA, 75 bp, Artificial Sequence
  Synthetic
ttgggacaacatggagctgacaaatgaaaacatatattatgctgaccaagttctatcccacttcataaacccacc

SEQ ID NO: 228111 - DNA, 75 bp, Artificial Sequence
  Synthetic
tctcatgcgtgtgaagaagcacgcaaagcagcaggggaaatcaatccctgcacatctggaagccgcggccacgcc

SEQ ID NO: 228112 - DNA, 75 bp, Artificial Sequence
  Synthetic
agattctctagatgatgaatcagatgatgaagacacttatataaacagagagcttgttatcaacactctagtcaa

SEQ ID NO: 228113 - DNA, 75 bp, Artificial Sequence
  Synthetic
atggcccagataaggatctctggaggacctacgacaccgtagtctacggggatgacagactctctaccacacctt

SEQ ID NO: 228114 - DNA, 75 bp, Artificial Sequence
  Synthetic
gagtaggaacgagggtacagcttccttcttttctgtctctgtttagattatttaatcaccatttaaaattgattt

SEQ ID NO: 228115 - DNA, 75 bp, Artificial Sequence
  Synthetic
gacctacgacaccgtagtctacggggatgacagactctctaccacaccttcagtaccagataactatgaggaaag

SEQ ID NO: 228116 - DNA, 75 bp, Artificial Sequence
  Synthetic
tttggtatgtgggttaaacctggcaaggtgatttgtagagatagtatagttgggctatctttttgtggcttcaca

SEQ ID NO: 228117 - DNA, 75 bp, Artificial Sequence
  Synthetic
acttacattggtatgtcagcatatcctagtgttgagtggggaagtggtgaacaatctacaagccagcacatctta

SEQ ID NO: 228118 - DNA, 75 bp, Artificial Sequence
  Synthetic
aagcagcaggggaaatcaatccctgcacatctggaagccgcggccacgccgagtaggaacgagggtacagcttcc

SEQ ID NO: 228119 - DNA, 75 bp, Artificial Sequence
  Synthetic
gtcaatgcaaaccttgaacctgtaccaacttcaccagaaaaactgatggcatctcttctgaaaccctacaagatc

SEQ ID NO: 228120 - DNA, 75 bp, Artificial Sequence
  Synthetic
ttggcttatcacataaatataatattttcttcttggtattatacacattaccaccaatatggcactaggtgaacc

SEQ ID NO: 228121 - DNA, 75 bp, Artificial Sequence
  Synthetic
tgagcgcaaacaacagtcgctcagtcaagggagccgcggccacgccgagtaggatcgagggtacagctcccattc

SEQ ID NO: 228122 - DNA, 75 bp, Artificial Sequence
  Synthetic
ccaccaatatggcactaggtgaaccatactacagttctaagcctgacaaggactttaactttgggagcacgatgg

SEQ ID NO: 228123 - DNA, 75 bp, Artificial Sequence
  Synthetic
ccaagaggggggtggtgattggcctttggcttatcacataaatataatattttcttcttggtattatacacatta

SEQ ID NO: 228124 - DNA, 75 bp, Artificial Sequence
  Synthetic
ccaagaggggggtggtgattggcctttggcttatcagtgtatagaaaacatttttctgctcttttatcatacaat

SEQ ID NO: 228125 - DNA, 75 bp, Artificial Sequence
  Synthetic
ttggcttatcagtgtatagaaaacatttttctgctcttttatcatacaattaccaataagatggcacacggcgag

SEQ ID NO: 228126 - DNA, 75 bp, Artificial Sequence
  Synthetic
aagattttaatttcggaagcacaatggcacgtagacagatgacacctactatggtgacaaaacttcccaaatttg

SEQ ID NO: 228127 - DNA, 75 bp, Artificial Sequence
  Synthetic
ggttactgttgaggtcaataacaatggccgaggcaggagcaaatctagagcccgatctcagtcaagaggtcgggg

SEQ ID NO: 228128 - DNA, 75 bp, Artificial Sequence
  Synthetic
atacacaaagccaatgctcttcaggagaggttacgtctctcccaggaagagaaagccacccttgctcttgatgta

SEQ ID NO: 228129 - DNA, 75 bp, Artificial Sequence
  Synthetic
ttggatcgtaagaggtctaatctttcccaccattggcaaaacttatttccaacgagttgttgtggttactggtgg

SEQ ID NO: 228130 - DNA, 75 bp, Artificial Sequence
  Synthetic
ttgaagacggcacgtatggttcatttgcatttgatggtaaggagtgggtggagatttatccaatagagcacttaa

SEQ ID NO: 228131 - DNA, 75 bp, Artificial Sequence
  Synthetic
cccaccattggcaaaacttatttccaacgagttgttgtggttactggtgggcttgatgatggaacttatggctca

SEQ ID NO: 228132 - DNA, 75 bp, Artificial Sequence
  Synthetic
tgggatgtcgggtgcaccagtttgtgacaaatatggacgagtgttggcagtccatcaaactaacactggatatac

SEQ ID NO: 228133 - DNA, 75 bp, Artificial Sequence
  Synthetic
tggagattcacccaatagagcacttaaatcttatgtcatctttgaaactaatacacaaagccaacgctcttcaag

SEQ ID NO: 228134 - DNA, 75 bp, Artificial Sequence
  Synthetic
tggataattgtgggagcagtgcttacattcttatctctaatacctgggggttatgcgcagcgtcagaccaacaac

SEQ ID NO: 228135 - DNA, 75 bp, Artificial Sequence
  Synthetic
aagcaactcaggaaacagggtgtcacaggaccaagaccagcaatatgtcagaaagcaacagcaacacttggaacc

SEQ ID NO: 228136 - DNA, 75 bp, Artificial Sequence
  Synthetic
aaatcttatgtcatctttgaaactaatacacaaagccaacgctcttcaagagagactgcgtctttctcaagaaga

SEQ ID NO: 228137 - DNA, 75 bp, Artificial Sequence
  Synthetic
ctgagattgaggcgtgcatcctcctcaatcctgtccttgttaaggacgctactggaagcactcagtttgggcctg

SEQ ID NO: 228138 - DNA, 75 bp, Artificial Sequence
  Synthetic
caaatccttcagcacggaaacgtgcgggtgaaggagttgattccaaaaccggagccacgaaagatacagatgaag

SEQ ID NO: 228139 - DNA, 75 bp, Artificial Sequence
  Synthetic
caatcctgtccttgttaaggacgctactggaagcactcagtttgggcctgtgcaggcgttaggagcccagtatag

SEQ ID NO: 228140 - DNA, 75 bp, Artificial Sequence
  Synthetic
tgcaaatattcaacagagactttaaccgaaaaccttgacctcagaatcaaaatagccctggcaaatataaccatc

SEQ ID NO: 228141 - DNA, 75 bp, Artificial Sequence
  Synthetic
ccgaaaaccttgacctcagaatcaaaatagccctggcaaatataaccatcactgacaagttggatgctatgaagc

SEQ ID NO: 228142 - DNA, 75 bp, Artificial Sequence
  Synthetic
gtcaggttaacatcaatggttggtgcttcagcagtaaatggcacagtagtcagggtctcacttaaccctacctca

SEQ ID NO: 228143 - DNA, 75 bp, Artificial Sequence
  Synthetic
ctatgcgcaaagccagaccaacaacactatattcacagacatgatagctgcctgcaagtactcaactgagacact

SEQ ID NO: 228144 - DNA, 75 bp, Artificial Sequence
  Synthetic
cagggtctcacttaaccctacctcaacaccatcttccactagttggtcaggattaggggcccgcaagcaccttga

SEQ ID NO: 228145 - DNA, 75 bp, Artificial Sequence
  Synthetic
tagggtgcactggctgcgaactgccttccattacatccattattatgagatgtggaacatttttatgtttgtact

SEQ ID NO: 228146 - DNA, 75 bp, Artificial Sequence
  Synthetic
actatattcacagacatgatagctgcctgcaagtactcaactgagacactgacagaaaatcttgacctcagaatc

SEQ ID NO: 228147 - DNA, 75 bp, Artificial Sequence
  Synthetic
tacacttgcaacgtcccacttgtctggctttaggatggctgttttacccacaattccatttcacaccactatgac

SEQ ID NO: 228148 - DNA, 75 bp, Artificial Sequence
  Synthetic
tttaaattaaaaccatcagaccttggtggcccacgtgatgggtggtggctcacaaacaccaatgacaatgcttca

SEQ ID NO: 228149 - DNA, 75 bp, Artificial Sequence
  Synthetic
gtggcccacgtgatgggtggtggctcacaaacaccaatgacaatgcttcagatacgcttggcccgtctgttgaaa

SEQ ID NO: 228150 - DNA, 75 bp, Artificial Sequence
  Synthetic
ctttagcaacatcccacctgtctggttttagaatggctgtgttaccaactatacccttccacactacactaacct

SEQ ID NO: 228151 - DNA, 75 bp, Artificial Sequence
  Synthetic
gtttgttactactttgacaatttgctagcaataacaatggcaatactagcaccaattcttggcataatcttcttg

SEQ ID NO: 228152 - DNA, 75 bp, Artificial Sequence
  Synthetic
ttccattacatccattattatgagatgtggaacatttttatgtttgtacttgcagtcagtacagttatgaaaagc

SEQ ID NO: 228153 - DNA, 75 bp, Artificial Sequence
  Synthetic
gtcataccaaaatcagcagtttacggggggccttttcctagtggaattagcttctgagtggtgcttcaccggcta

SEQ ID NO: 228154 - DNA, 75 bp, Artificial Sequence
  Synthetic
cttgcgatcggcactgtcatgaggagcgcccgccctggtacagacttaatcacacttgcaacatcacatttatct

SEQ ID NO: 228155 - DNA, 75 bp, Artificial Sequence
  Synthetic
gctataactctagcattgttggcacctatccttggaattgttttcttatgcttcatggaggactccaactatgtt

SEQ ID NO: 228156 - DNA, 75 bp, Artificial Sequence
  Synthetic
gggggccttttcctagtggaattagcttctgagtggtgcttcaccggctacgcagccaacccaaaccttgttaac

SEQ ID NO: 228157 - DNA, 75 bp, Artificial Sequence
  Synthetic
ttttagaatggctgtgttaccaactatacccttccacactacactaaccttgtgggttatgaacattcttatgtt

SEQ ID NO: 228158 - DNA, 75 bp, Artificial Sequence
  Synthetic
tgaatgtcacctttgaagggtctgcaggcacaccattggtcatgaatgttcccgctgcaagtcactttgctagaa

SEQ ID NO: 228159 - DNA, 75 bp, Artificial Sequence
  Synthetic
cttgtgggttatgaacactcttatggtttgctactattttgataacttactagcaataacaatggcaattttggc

SEQ ID NO: 228160 - DNA, 75 bp, Artificial Sequence
  Synthetic
cgcctgtttaacacttactggcacgaccacatcactatttgttgtcatactgacatgcagatttatacgcatggc

SEQ ID NO: 228161 - DNA, 75 bp, Artificial Sequence
  Synthetic
accaatccttggcatcatcttcctgtgtttcatggaagactctaactatgtgagccaaatacgtggccttattgc

SEQ ID NO: 228162 - DNA, 75 bp, Artificial Sequence
  Synthetic
aggcacaccattggtcatgaatgttcccgctgcaagtcactttgctagaacagttgcccaacgctctacattacc

SEQ ID NO: 228163 - DNA, 75 bp, Artificial Sequence
  Synthetic
aatacaacttctgacacggtatggcaggtgctcaatgcagcggtatctgctgcagagctggttactccaccacct

SEQ ID NO: 228164 - DNA, 75 bp, Artificial Sequence
  Synthetic
aggtgctcaatgcagcggtatctgctgcagagctggttactccaccacctttcaattggctagttaaaggtggat

SEQ ID NO: 228165 - DNA, 75 bp, Artificial Sequence
  Synthetic
ttgtggcaactgtgccaactagaattagaaatgctgcatttgatttctttcaaaaactaaaacagtctggagtgc

SEQ ID NO: 228166 - DNA, 75 bp, Artificial Sequence
  Synthetic
accacatcactatttgttgtcatactgacatgcagatttatacgcatggcaacagtgtttgttggagcgaggttt

SEQ ID NO: 228167 - DNA, 75 bp, Artificial Sequence
  Synthetic
tagaaatgctgcatttgatttctttcaaaaactaaaacagtctggagtgcgagtcggagtcaatgactttgtggt

SEQ ID NO: 228168 - DNA, 75 bp, Artificial Sequence
  Synthetic
tagggtgcgtagtggaaaccgtagtttctatgtctatgcaagctatcaagatgcactgtccaataaaccagctct

SEQ ID NO: 228169 - DNA, 75 bp, Artificial Sequence
  Synthetic
attgatacacctgagggtaagggaactggtttcttctctggtaacgacataattacagcagctcatgtcgttggt

SEQ ID NO: 228170 - DNA, 75 bp, Artificial Sequence
  Synthetic
ctggtttcttctctggtaacgacataattacagcagctcatgtcgttggtaataatacctttgttaatatatgct

SEQ ID NO: 228171 - DNA, 75 bp, Artificial Sequence
  Synthetic
atgagaacacgcccagcagtaatgacaacattacagttcacacaaatgaaccaacctagtttaggccatggtgag

SEQ ID NO: 228172 - DNA, 75 bp, Artificial Sequence
  Synthetic
caacattacagttcacacaaatgaaccaacctagtttaggccatggtgagacgcctgcgacacttggcaggtcta

SEQ ID NO: 228173 - DNA, 75 bp, Artificial Sequence
  Synthetic
agtacgatatatgcctgaaaaagacatagcatttataacttgccctggtgacttgcacccaacaacaagattgaa

SEQ ID NO: 228174 - DNA, 75 bp, Artificial Sequence
  Synthetic
atagcatttataacttgccctggtgacttgcacccaacaacaagattgaaattggcaaaaaacccagattacagt

SEQ ID NO: 228175 - DNA, 75 bp, Artificial Sequence
  Synthetic
ggtgcttctcactattgggaaccctattagccctaatgaaactaacaaacaaacttgggttaataagacaattga

SEQ ID NO: 228176 - DNA, 75 bp, Artificial Sequence
  Synthetic
attagccctaatgaaactaacaaacaaacttgggttaataagacaattgaacctcctggagctgtggtcaagata

SEQ ID NO: 228177 - DNA, 75 bp, Artificial Sequence
  Synthetic
ctctctcatatgcagttcgcactcaagacgggatgtcaggtgcaccagtttgtgacaaatatggtcgggtgttag

SEQ ID NO: 228178 - DNA, 75 bp, Artificial Sequence
  Synthetic
atgaagatttggtggtttcaaccgccactgccatggtccatggaaacactctttcctatgcagtacgtacccagg

SEQ ID NO: 228179 - DNA, 75 bp, Artificial Sequence
  Synthetic
aaagtccgatacatgcctgaaaaagatatagcattcataacttgccctggtgacttgcacccaacagcaagatta

SEQ ID NO: 228180 - DNA, 75 bp, Artificial Sequence
  Synthetic
caatgaacgggttcacccttatcactaaggttgattggttcactgaagaattccaaccatctgaagaacctgccc

SEQ ID NO: 228181 - DNA, 75 bp, Artificial Sequence
  Synthetic
gcagctgccatggtacatggtaacactctctcatatgcagttcgcactcaagacgggatgtcaggtgcaccagtt

SEQ ID NO: 228182 - DNA, 75 bp, Artificial Sequence
  Synthetic
taaggttgattggttcactgaagaattccaaccatctgaagaacctgcccctgtccaaggcttgatggtgcttct

SEQ ID NO: 228183 - DNA, 75 bp, Artificial Sequence
  Synthetic
gttcatcagactaatactggttacactggtggtgctgttgtgatagatccagcagactttcacccagtaaaggct

SEQ ID NO: 228184 - DNA, 75 bp, Artificial Sequence
  Synthetic
cactgccatggtccatggaaacactctttcctatgcagtacgtacccaggacggaatgtcgggtgcgcctgtttg

SEQ ID NO: 228185 - DNA, 75 bp, Artificial Sequence
  Synthetic
tacgccgctcagcagtacaaaaaccctatcaccaatgacaaacagcaagtaaccagtgttttcttggttagagtg

SEQ ID NO: 228186 - DNA, 75 bp, Artificial Sequence
  Synthetic
ctctttcatatgcagttcgcacccaagacggaatgtcgggtgcgccagtttgtgacaaatatggtcgggtgttag

SEQ ID NO: 228187 - DNA, 75 bp, Artificial Sequence
  Synthetic
ctatcaccaatgacaaacagcaagtaaccagtgttttcttggttagagtgaatgaagggtttcaggtaaccaacc

SEQ ID NO: 228188 - DNA, 75 bp, Artificial Sequence
  Synthetic
gttgaacgccacaacagaggttgcaccagatcccactgagccacagcccgttgccacattagaacaaaaaaatgt

SEQ ID NO: 228189 - DNA, 75 bp, Artificial Sequence
  Synthetic
ctggtggtgctgttgtgatagatccagcagactttcacccagtaaaggctccatctcaaattgaacaacttaagg

SEQ ID NO: 228190 - DNA, 75 bp, Artificial Sequence
  Synthetic
cgtcaacaccgatgctgtcgagaacatcaagattaggtctgccaccagacacacgacagtccggtttaatcaggg

SEQ ID NO: 228191 - DNA, 75 bp, Artificial Sequence
  Synthetic
atcaagattaggtctgccaccagacacacgacagtccggtttaatcagggtagttggtacctactcacaagcacc

SEQ ID NO: 228192 - DNA, 75 bp, Artificial Sequence
  Synthetic
gttaggattgcaatggagcgtgagatgaaggtgctgcgggatgaaatcaacaaagtcttagaaccatttatacaa

SEQ ID NO: 228193 - DNA, 75 bp, Artificial Sequence
  Synthetic
agaggagatagagcggctcaaagcccaactaaactctgccactgagaatgcaacgactgtcgttacacaacaacc

SEQ ID NO: 228194 - DNA, 75 bp, Artificial Sequence
  Synthetic
caggatggctgtggatgaaccaagagttacaaaatgaccaggcctacatcattgaccaaggaactatgcatttaa

SEQ ID NO: 228195 - DNA, 75 bp, Artificial Sequence
  Synthetic
gttacaaaatgaccaggcctacatcattgaccaaggaactatgcatttaataactccccctccagtctcatctca

SEQ ID NO: 228196 - DNA, 75 bp, Artificial Sequence
  Synthetic
gaagaagaataccgtgagctcttagaaaaaggtcttgatcgtgagacattccttgatctcatagaccgcataatt

SEQ ID NO: 228197 - DNA, 75 bp, Artificial Sequence
  Synthetic
gttcctcagactaggactagtggagaagaaactgggcttgaactagctatgggactatctgaagatgaacatcca

SEQ ID NO: 228198 - DNA, 75 bp, Artificial Sequence
  Synthetic
aagaaactgggcttgaactagctatgggactatctgaagatgaacatccaatctcccatgtcaatgatgaggaag

SEQ ID NO: 228199 - DNA, 75 bp, Artificial Sequence
  Synthetic
tgatgatgatgggtggggattagttggtgatgatgtagaatttgattatacagaagttattaattttgatcagca

SEQ ID NO: 228200 - DNA, 75 bp, Artificial Sequence
  Synthetic
ttccttgatctcatagaccgcattattggtgagaggtctggctaccctgactatgatgatgaagattattatgat

SEQ ID NO: 228201 - DNA, 75 bp, Artificial Sequence
  Synthetic
tgaggacgaaaccgatgaagtggacaggtttgatctctgttgtacttccgattcggaggacgacattgagagcaa

SEQ ID NO: 228202 - DNA, 75 bp, Artificial Sequence
  Synthetic
cgcacaattaaaccaaagctcgctcctgcaccagcgattgaggcacaaccacttgatctaacttgtaagcagcga

SEQ ID NO: 228203 - DNA, 75 bp, Artificial Sequence
  Synthetic
aggtttgatctctgttgtacttccgattcggaggacgacattgagagcaaccgcgtaaccctcctctcaactctc

SEQ ID NO: 228204 - DNA, 75 bp, Artificial Sequence
  Synthetic
gcgcaaccatgatcacaagtcgcgctttccccacgccaaatcacaaatctaggcgtgaactttcaaatgacctgc

SEQ ID NO: 228205 - DNA, 75 bp, Artificial Sequence
  Synthetic
gtacagccagaacctgaacagcagtctgagcctactaaaacccaaaaaaataagccccagccatactcacaaact

SEQ ID NO: 228206 - DNA, 75 bp, Artificial Sequence
  Synthetic
caactaagccaaaaatttgccccgaaccagaagtcgaatcacaaccacttgatttgtcccaaaagaaaggaaaac

SEQ ID NO: 228207 - DNA, 75 bp, Artificial Sequence
  Synthetic
accagaagtcgaatcacaaccacttgatttgtcccaaaagaaaggaaaacaatcagaatatgaacaacaagagat

SEQ ID NO: 228208 - DNA, 75 bp, Artificial Sequence
  Synthetic
tttccccacgccaaatcacaaatctaggcgtgaactttcaaatgacctgctgggccccagcgattgtctggcgac

SEQ ID NO: 228209 - DNA, 75 bp, Artificial Sequence
  Synthetic
ccataaaaacccagaactatagtgcactacctgaagctgtgtttgagcttgacaaagcagcttatgaagcaggtt

SEQ ID NO: 228210 - DNA, 75 bp, Artificial Sequence
  Synthetic
ctttcttttctgtctctgtttagattattttaatcaccatttaaaattgatttaatcagaagcaaaaaaaaaaaa

SEQ ID NO: 228211 - DNA, 75 bp, Artificial Sequence
  Synthetic
atggcactcggtgagccatactatagttccaaacctgacaaagacttcaattttggaagcacaatggcacgtagg

SEQ ID NO: 228212 - DNA, 75 bp, Artificial Sequence
  Synthetic
atcaaagaataaggctccaaaaaactacaaagggccccagaagaccaaggggcccaaaattaccactcattagat

SEQ ID NO: 228213 - DNA, 75 bp, Artificial Sequence
  Synthetic
tccacaagcctatgattggatcgtaagaggtttaatctttcccaccactggaaaaacttatttccaacgagttgt

SEQ ID NO: 228214 - DNA, 75 bp, Artificial Sequence
  Synthetic
tccttggatctaaaattgtcaagcttagaacgattattgaaacagctataaagactcagaattatagtgcattgc

SEQ ID NO: 228215 - DNA, 75 bp, Artificial Sequence
  Synthetic
gaaaaacttatttccaacgagttgttgttgttactggtgggcttgaggatggaacatatggttcattcgcatttg

SEQ ID NO: 228216 - DNA, 75 bp, Artificial Sequence
  Synthetic
ctacaaagggccccagaagaccaaggggcccaaaactatcactcattagatgcatggcaagagttattggagcct

SEQ ID NO: 228217 - DNA, 75 bp, Artificial Sequence
  Synthetic
caaactttccactggtgggccacttacctattaatagacctatctatgatgacaagaaaccaagagatgacctac

SEQ ID NO: 228218 - DNA, 75 bp, Artificial Sequence
  Synthetic
ccacatggggcccacaggcttttattaaatcttttgataagttcttttatgcagaaccaagtgattttttctcag

SEQ ID NO: 228219 - DNA, 75 bp, Artificial Sequence
  Synthetic
aaacccagggacgatctccttggcctacttccagaaccaacctggcatgcttttgaggaatatggaccaaccaca

SEQ ID NO: 228220 - DNA, 75 bp, Artificial Sequence
  Synthetic
gttgattccaaaaccagagccacggaaaatacagatgaagtggataatagtgggagcagtgcttacatttttatc

SEQ ID NO: 228221 - DNA, 75 bp, Artificial Sequence
  Synthetic
ctgattgggcaacatatcgtgaatttcggtatctagaggatactagagtgatacacataactgcaactgagaaaa

SEQ ID NO: 228222 - DNA, 75 bp, Artificial Sequence
  Synthetic
tacacataactgcaactgagaagaatactgattcaacacctgcttatcctaagatgaattattttgatactgaag

SEQ ID NO: 228223 - DNA, 75 bp, Artificial Sequence
  Synthetic
tcggtatctagaggatactagagtgatacacataactgcaactgagaaaaacacagattccaccccagcttatcc

SEQ ID NO: 228224 - DNA, 75 bp, Artificial Sequence
  Synthetic
ttcaactgagacattaacagagaaccttgaccttagaattaagctcgcactagcaaacataaccattaatgataa

SEQ ID NO: 228225 - DNA, 75 bp, Artificial Sequence
  Synthetic
gaaaaatatttggaagcacacggatgggcaccatatatcagagaattttctagggtgttcaaaggggagaggcct

SEQ ID NO: 228226 - DNA, 75 bp, Artificial Sequence
  Synthetic
gggcaccatatatcagagaattttctagggtgttcaaaggggagaggcctgaggtactttggtatcttttcctca

SEQ ID NO: 228227 - DNA, 75 bp, Artificial Sequence
  Synthetic
aattagggattctgatattcggcaaatagtatgcgccgaccccatttacaccagaataggggcgtgcttagaagc

SEQ ID NO: 228228 - DNA, 75 bp, Artificial Sequence
  Synthetic
atagtatgcgccgaccccatttacaccagaataggggcgtgcttagaagcacatcagaattcgctgatgaagcaa

SEQ ID NO: 228229 - DNA, 75 bp, Artificial Sequence
  Synthetic
tgggtggtcaccaatggaaggcggctttaaaaaaactatgcagcgcctagtaaacaaagggaataaacattttat

SEQ ID NO: 228230 - DNA, 75 bp, Artificial Sequence
  Synthetic
gtgggtggtcacctatggaaggaggctttaagaaaacaatgcaacgccttgttaataggggtaataagtatttca

SEQ ID NO: 228231 - DNA, 75 bp, Artificial Sequence
  Synthetic
ctttaagaaaacaatgcaacgccttgttaataggggtaataagtatttcattgagtttgactggacccgctatga

SEQ ID NO: 228232 - DNA, 75 bp, Artificial Sequence
  Synthetic
ggaactataccaccagcactcttcaaacacatcaaagaaattaggtggaatttcatcaataaagaccaacgtgaa

SEQ ID NO: 228233 - DNA, 75 bp, Artificial Sequence
  Synthetic
actttgataatctgctagcaataacaatagcaatcctagcaccaattcttggcatcatcttcttgtgtttcatgg

SEQ ID NO: 228234 - DNA, 75 bp, Artificial Sequence
  Synthetic
agacatatcaaagagataaggtggaacttcatcaacaaggaccaacgtgagaagtacagacatgtacatgagtgg

SEQ ID NO: 228235 - DNA, 75 bp, Artificial Sequence
  Synthetic
acttcatcaacaaggaccaacgtgagaagtacagacatgtacatgagtggtatgttgacaaccttctcaaccgcc

SEQ ID NO: 228236 - DNA, 75 bp, Artificial Sequence
  Synthetic
ttgactggacccgctatgatggaactataccaccagcactctttaaacacatcaaagaaattaggtggaatttca

SEQ ID NO: 228237 - DNA, 75 bp, Artificial Sequence
  Synthetic
ttaattgctggtgggcatgcctgcttgacactcacaggcacaaccacgtcattatttgttgtcatactaacttgt

SEQ ID NO: 228238 - DNA, 75 bp, Artificial Sequence
  Synthetic
caggcttttgagtttgcttattttaatggcccagacaaagacctttggaagacttatgacactgtagtttatgga

SEQ ID NO: 228239 - DNA, 75 bp, Artificial Sequence
  Synthetic
tactgtgcagacacggggcaatccatctggacagttctcaacaactatggacaataacatggttaatttctggct

SEQ ID NO: 228240 - DNA, 75 bp, Artificial Sequence
  Synthetic
aggttcatacgtatggcaacggttttcattggcactagatttgagatccgtgatgttaatgggaaggttgtggcc

SEQ ID NO: 228241 - DNA, 75 bp, Artificial Sequence
  Synthetic
tctggacagttctcaacaactatggacaataacatggttaatttctggctacaagcttttgaatttgcctatttt

SEQ ID NO: 228242 - DNA, 75 bp, Artificial Sequence
  Synthetic
cagtgcctgatgattatgaggagagagtgattactatgtatagagacatctttggcatgtgggtaaagcctggga

SEQ ID NO: 228243 - DNA, 75 bp, Artificial Sequence
  Synthetic
tgatgttaatgggaaggttgtggccacagtaccaaccaggatcaaaaatgttgcatttgacttcttccagaagct

SEQ ID NO: 228244 - DNA, 75 bp, Artificial Sequence
  Synthetic
agacttatgataccgtagtctatggagatgacaggctctctaccacaccttcagtaccagataactatgaagaaa

SEQ ID NO: 228245 - DNA, 75 bp, Artificial Sequence
  Synthetic
caattttcaacaacaatggataataacatggtcaacttttggttacaggcttttgagtttgcttactttaatgga

SEQ ID NO: 228246 - DNA, 75 bp, Artificial Sequence
  Synthetic
caggtgcattatgcattatagacacccctgaagggaaagggacaggcttcttttctggtaacgacatagtaacag

SEQ ID NO: 228247 - DNA, 75 bp, Artificial Sequence
  Synthetic
cagcacatgtcgttggtaacaacacttttgtgagtgtgtgttatgagggcttggtgtacgaagctaaggttcggt

SEQ ID NO: 228248 - DNA, 75 bp, Artificial Sequence
  Synthetic
tatccttttgtggcttcactgttaatgaaaatcttgagcctgtgccaacttctcctgaaaagctaatggcatcac

SEQ ID NO: 228249 - DNA, 75 bp, Artificial Sequence
  Synthetic
gggaagctcctatgctaccagttgcttgctgcgttcatggcagaagatcatccttttaaggtatatgtagaacac

SEQ ID NO: 228250 - DNA, 75 bp, Artificial Sequence
  Synthetic
tcgtgactctggccttccggccagactcacagaagagcaactccatcgcatttggaggggaggaccaaagaagtg

SEQ ID NO: 228251 - DNA, 75 bp, Artificial Sequence
  Synthetic
ccaacagcaagattaaagttatcaaagaatccagactacagtagtgtcacagtaatggcttatgtgaatgaagat

SEQ ID NO: 228252 - DNA, 75 bp, Artificial Sequence
  Synthetic
cataacttgtcctggtgacttgcatccaacagcaagattaaagttatcaaagaatccagactacagtagtgtcac

SEQ ID NO: 228253 - DNA, 75 bp, Artificial Sequence
  Synthetic
aggttactgttgaggtcaacaataatggccgaagcaggagcaaatctagaacccgatcccagtcaagaggtcggg

SEQ ID NO: 228254 - DNA, 75 bp, Artificial Sequence
  Synthetic
ttcccagaataaaagcagaagacaaaacggacgcaacaaacgtcagtctaatcaacgtgtccgtaacattgtcaa

SEQ ID NO: 228255 - DNA, 75 bp, Artificial Sequence
  Synthetic
cattacacaacaacctattgctacactagagcagaaaagtgttagcgatagtgaagtgattgaccttgtcagaac

SEQ ID NO: 228256 - DNA, 75 bp, Artificial Sequence
  Synthetic
gccgttaatggtactgtcctcagggtctcacttaaccccacatctacgccatcttccactagttggtcaggatta

SEQ ID NO: 228257 - DNA, 75 bp, Artificial Sequence
  Synthetic
tgttaggttaacatcaatggttggtgcttcagcagtgaatggtacagtagtcagggtctcactcaaccctacctc

SEQ ID NO: 228258 - DNA, 75 bp, Artificial Sequence
  Synthetic
ggcgcacgtaaacatcttgatgtcacggttggcaagaatgcaacatttaacttgaaaccctctgaccttggtgga

SEQ ID NO: 228259 - DNA, 75 bp, Artificial Sequence
  Synthetic
tcagggtctcactcaaccctacctcaacaccatcttcgactagttggtcaggactgggggcccgcaagcatcttg

SEQ ID NO: 228260 - DNA, 75 bp, Artificial Sequence
  Synthetic
gtgggcctagagatggctggtggctcacaaacaccaatgacaatgcatctgacaccctgggaccctccattgaaa

SEQ ID NO: 228261 - DNA, 75 bp, Artificial Sequence
  Synthetic
gaggattattatgatgaagatgatgatggatggggaatggttggtgatgatgtagaatttgattatactgaagta

SEQ ID NO: 228262 - DNA, 75 bp, Artificial Sequence
  Synthetic
acaagaatgagcagttcacaggagggctatttctggttgaacttgcttcagagtggtgttttacaggttatgctg

SEQ ID NO: 228263 - DNA, 75 bp, Artificial Sequence
  Synthetic
cgtgccaacctcttcagagaagttaccaaagccttgccccgagccagaagctgaagcacaaccactcgatttgtc

SEQ ID NO: 228264 - DNA, 75 bp, Artificial Sequence
  Synthetic
cgtcataccagaaccagcagtttacagggggccttttcttagtggaattagcttctgagtggtgcttcactggct

SEQ ID NO: 228265 - DNA, 75 bp, Artificial Sequence
  Synthetic
caccattaataatgaatgtgccagaggggagtcattttgcacgtacagttcttgcacgatcagcaacacccacca

SEQ ID NO: 228266 - DNA, 75 bp, Artificial Sequence
  Synthetic
agggggccttttcttagtggaattagcttctgagtggtgcttcactggctatgcagccaacccaaaccttgttaa

SEQ ID NO: 228267 - DNA, 75 bp, Artificial Sequence
  Synthetic
gtaaatgtcacctttgaagggtctgcaggcacgccattggtcatgaatgttcccgccacaagtcactttgctagg

SEQ ID NO: 228268 - DNA, 75 bp, Artificial Sequence
  Synthetic
aatcttatgattttgactgggatgaggatgatgccaagtttatcctgccagcgccacaccggctaactaaagcag

SEQ ID NO: 228269 - DNA, 75 bp, Artificial Sequence
  Synthetic
caggcacgccattggtcatgaatgttcccgccacaagtcactttgctaggacagttgcccaacgctctacattgc

SEQ ID NO: 228270 - DNA, 75 bp, Artificial Sequence
  Synthetic
tgttaaacttagaacaattattgaaacagccataaagacccagacctatagtgcactacctgaagctgtgtttga

SEQ ID NO: 228271 - DNA, 75 bp, Artificial Sequence
  Synthetic
aaatacaacttctgacacagtctggcaggtgctcaacacagctgtgtctgctgcagagctggttactccaccacc

SEQ ID NO: 228272 - DNA, 75 bp, Artificial Sequence
  Synthetic
acagccataaagacccagacctatagtgcactacctgaagctgtgtttgagctggataaagcagcttatgaagca

SEQ ID NO: 228273 - DNA, 75 bp, Artificial Sequence
  Synthetic
caggtgctcaacacagctgtgtctgctgcagagctggttactccaccaccttttaactggctggttaaaggtggg

SEQ ID NO: 228274 - DNA, 75 bp, Artificial Sequence
  Synthetic
ttaaatcaaaaaataaggccccaaaactaccactcattagaagggccccagaagaccaacgggcccaaacctacc

SEQ ID NO: 228275 - DNA, 75 bp, Artificial Sequence
  Synthetic
gcagggtgcgtagtggaaaccgcagcttctatgtttatgcaagttatcaagatgcattgtccaataaaccagcat

SEQ ID NO: 228276 - DNA, 75 bp, Artificial Sequence
  Synthetic
cttctatgtttatgcaagttatcaagatgcattgtccaataaaccagcattgtgtacaggaagtacgccaggaag

SEQ ID NO: 228277 - DNA, 75 bp, Artificial Sequence
  Synthetic
ccaacctagtctagggcacggtgaagcaccagctgcgtttggtagatccattccagcacctggtgaggagtttaa

SEQ ID NO: 228278 - DNA, 75 bp, Artificial Sequence
  Synthetic
acacctggtgaggagtttaaagtcatcctcacatttggagccccaatgagccctaacgcaaacaacaaacagaca

SEQ ID NO: 228279 - DNA, 75 bp, Artificial Sequence
  Synthetic
acaacattacagttcacacaaatgaaccagcctagtctaggccatggagagacacctgcgacgcttggcaggtct

SEQ ID NO: 228280 - DNA, 75 bp, Artificial Sequence
  Synthetic
ttccagcacctggtgaggagtttaaagttgtcctcacatttggagccccaatgagccctaatgcaaataacaaac

SEQ ID NO: 228281 - DNA, 75 bp, Artificial Sequence
  Synthetic
catttttgatgacaaaaaacctaaagatgatctccttggcctacttccagaaccaacttggcacgcttttgagga

SEQ ID NO: 228282 - DNA, 75 bp, Artificial Sequence
  Synthetic
agacttgggtcaataaaccccttgatgcgccttcgggccattacaatgtgaaaattgcaaaggatgttgaccact

SEQ ID NO: 228283 - DNA, 75 bp, Artificial Sequence
  Synthetic
actaccactcattagaagggccccagaagaccaacgggcccaaacctaccactcattagatgcatggaaatggtt

SEQ ID NO: 228284 - DNA, 75 bp, Artificial Sequence
  Synthetic
acttgtgaacagctcgaaaaaagctgatgtgtatgctgtcaaacaatttgtcacagcgcagaccaacaacaagca

SEQ ID NO: 228285 - DNA, 75 bp, Artificial Sequence
  Synthetic
ctaaggttgattggttcactgaagaattccaaccatctgaagaacctgctcctgtccagggcttaatggtgcttt

SEQ ID NO: 228286 - DNA, 75 bp, Artificial Sequence
  Synthetic
aaagtaacaactggtttccaagtgaacaactacctgagttacttttacagggcgtctgccactggggatgctata

SEQ ID NO: 228287 - DNA, 75 bp, Artificial Sequence
  Synthetic
ctatgccgcccagcagtacaaaaaccctatcaccaatgataaacagcaggtaaccagtgttttcttggtcagagt

SEQ ID NO: 228288 - DNA, 75 bp, Artificial Sequence
  Synthetic
cctatcaccaatgataaacagcaggtaaccagtgttttcttggtcagagtgaacgaagggtttcaggtaaccaac

SEQ ID NO: 228289 - DNA, 75 bp, Artificial Sequence
  Synthetic
gcgtcaacaccgatgctgtcgaaaacatcaaaatcaggtctgccaccagacacacgacagtccggtttaaccagg

SEQ ID NO: 228290 - DNA, 75 bp, Artificial Sequence
  Synthetic
catcaaaatcaggtctgccaccagacacacgacagtccggtttaaccagggtagttggtacctactcacaagtac

SEQ ID NO: 228291 - DNA, 75 bp, Artificial Sequence
  Synthetic
tcaggatggctgtggatgaatcaagagttacaaaatgaccaggcctatattattgaccaaggaataatgcattta

SEQ ID NO: 228292 - DNA, 75 bp, Artificial Sequence
  Synthetic
agttacaaaatgaccaggcctatattattgaccaaggaataatgcatttaataactcctcctccagtctcatctc

SEQ ID NO: 228293 - DNA, 75 bp, Artificial Sequence
  Synthetic
tgtccctcagactaggtctggtggcgaagacactgggcttggaatggctctgggattctctgatgatgaataccc

SEQ ID NO: 228294 - DNA, 75 bp, Artificial Sequence
  Synthetic
gaagacactgggcttggaatggctctgggattctctgatgatgaatacccaacctcccaggtcaatgatgaggaa

SEQ ID NO: 228295 - DNA, 75 bp, Artificial Sequence
  Synthetic
aaaccaaggaatgacaatgacgcgcgccacaaggatagcaaggcgtgcattccccacgctttctgacaggattaa

SEQ ID NO: 228296 - DNA, 75 bp, Artificial Sequence
  Synthetic
atgaggacgaaaccgatgaagtggacaggtttgatctctgttatacttctgattcggaagatgacattgagaaca

SEQ ID NO: 228297 - DNA, 75 bp, Artificial Sequence
  Synthetic
aggtaatccatctggccagttttcaacaacaatggacaacaacatggttaacttttggttacaggcttttgagtt

SEQ ID NO: 228298 - DNA, 75 bp, Artificial Sequence
  Synthetic
caggtttgatctctgttatacttctgattcggaagatgacattgagaacaaccgcgtaaccctcctctcaactct

SEQ ID NO: 228299 - DNA, 75 bp, Artificial Sequence
  Synthetic
cgcgcaactatgatcacaaatcgcgctttccccacgccaaatcacagatctaggcgtgaacaaccaaatgacctg

SEQ ID NO: 228300 - DNA, 75 bp, Artificial Sequence
  Synthetic
ctttccccacgccaaatcacagatctaggcgtgaacaaccaaatgacctgctgacccccagcgattgcctggtga

SEQ ID NO: 228301 - DNA, 75 bp, Artificial Sequence
  Synthetic
aacaacaccttcggtgcctgataattatgaggagagagtgattaccatgtatagagacatttttggcatgtgggt

SEQ ID NO: 228302 - DNA, 75 bp, Artificial Sequence
  Synthetic
tcaatccctgcacatctggaagccgcggccacgccgagtaggaacgagggtacagcttccttcttttctgtctct

SEQ ID NO: 228303 - DNA, 75 bp, Artificial Sequence
  Synthetic
ttatcagtgtatagataagattttttccacacttttatcaaatatctgacaagatggcacacggtgagccatact

SEQ ID NO: 228304 - DNA, 75 bp, Artificial Sequence
  Synthetic
agggtacagcttccttcttttctgtctctgtttagattattttaatcaccatttaaaattgatttaatcagaagc

SEQ ID NO: 228305 - DNA, 75 bp, Artificial Sequence
  Synthetic
aacatgccaattttcaggaagccgcggccacgccgagtaggatcgagggtacagcttcctttcttttctgtctct

SEQ ID NO: 228306 - DNA, 75 bp, Artificial Sequence
  Synthetic
gtggctttactgttaatgaaaaccttgaacccgtgccaacctctccagaaaagttgatggcatcactgttaaagc

SEQ ID NO: 228307 - DNA, 75 bp, Artificial Sequence
  Synthetic
ttctgtgttatttacattttaccatcaatatggtgcttggtgaaccatattacagttccaagcctgataaggact

SEQ ID NO: 228308 - DNA, 75 bp, Artificial Sequence
  Synthetic
gacagtatagttggattatccttctgtggctttactgttaatgaaaaccttgaacccgtgccaacctctccagaa

SEQ ID NO: 228309 - DNA, 75 bp, Artificial Sequence
  Synthetic
ccaagaggggggtggtgattggcctttggcttatcagtgtatagacaatatttcttctacactcttttgtcaaaa

SEQ ID NO: 228310 - DNA, 75 bp, Artificial Sequence
  Synthetic
caatatggtgcttggtgaaccatattacagttccaagcctgataaggacttcgactttggaagtacgatggcacg

SEQ ID NO: 228311 - DNA, 75 bp, Artificial Sequence
  Synthetic
ggaaaattgcccaaatttgtcaggaattctccacaagcctacgattggatcgtaagaggtttaatctttcctact

SEQ ID NO: 228312 - DNA, 75 bp, Artificial Sequence
  Synthetic
attctccacaagcctacgattggatcgtaagaggtttaatctttcctactactgataagacttacttccaacgtt

SEQ ID NO: 228313 - DNA, 75 bp, Artificial Sequence
  Synthetic
ccatactatagttctaaacttgacaaagatttcaattttgggagcacaatggcacgtagacaaatgacacctact

SEQ ID NO: 228314 - DNA, 75 bp, Artificial Sequence
  Synthetic
ttatcacgcaaacatttttattctcttctgtgttatttacattttaccatcaatatggtgcttggtgaaccatat

SEQ ID NO: 228315 - DNA, 75 bp, Artificial Sequence
  Synthetic
cgatggtacatatggttcattcgtatttgatggtaaggggtggatagaaatttttccaatagaacatttgaatct

SEQ ID NO: 228316 - DNA, 75 bp, Artificial Sequence
  Synthetic
tttgatggtaaggggtggatagaaatttttccaatagaacatttgaatcttatggcctccctgaagttgatacat

SEQ ID NO: 228317 - DNA, 75 bp, Artificial Sequence
  Synthetic
tacgccactcccaagaagagaaagctaccctcgctctggacgtgcaattccttcagcacgagaatgttcgaatga

SEQ ID NO: 228318 - DNA, 75 bp, Artificial Sequence
  Synthetic
taccctcgctctggacgtgcaattccttcagcacgagaatgttcgaatgaaggagttgataccaaaacagaaacc

SEQ ID NO: 228319 - DNA, 75 bp, Artificial Sequence
  Synthetic
atacacaaagccaatgctcttcaggagagactacgtctttcccaggaggagaaagccacccttgctcttgatgtg

SEQ ID NO: 228320 - DNA, 75 bp, Artificial Sequence
  Synthetic
attttgggtgctgttctcacattcttatcactaatacctggtggatatgctcaaggtcaacaaaacaacacagtg

SEQ ID NO: 228321 - DNA, 75 bp, Artificial Sequence
  Synthetic
tatcactaatacctggtggatatgctcaaggtcaacaaaacaacacagtgtttacagacatgtttgctgcctgca

SEQ ID NO: 228322 - DNA, 75 bp, Artificial Sequence
  Synthetic
gactgaaggaattgattccaaaaccagaaccacggaagattcagatgaagtggataatcgtgggagcagtgctta

SEQ ID NO: 228323 - DNA, 75 bp, Artificial Sequence
  Synthetic
gaacctcaaccttaggattaagatagcattggcaaacataactattgctgacaagctagatgctgtgaaacaaat

SEQ ID NO: 228324 - DNA, 75 bp, Artificial Sequence
  Synthetic
gcattggcaaacataactattgctgacaagctagatgctgtgaaacaaattcttaattttgcctttgtacctagg

SEQ ID NO: 228325 - DNA, 75 bp, Artificial Sequence
  Synthetic
attatatccactattatgagatgtggaacatctttatgtttgtgcttgcagtcagcacagtgatgaagagcactc

SEQ ID NO: 228326 - DNA, 75 bp, Artificial Sequence
  Synthetic
aagcttgcactagcaaatataactattagtgacaagctagatgctgtgaggcaaatccttaatttcgcctttgta

SEQ ID NO: 228327 - DNA, 75 bp, Artificial Sequence
  Synthetic
accccacatctacaccatcgtccactagctggtcaggattgggtgcacgtaagcaccttgatgttacggtcggta

SEQ ID NO: 228328 - DNA, 75 bp, Artificial Sequence
  Synthetic
gaacatctttatgtttgtgcttgcagtcagcacagtgatgaagagcactcgccctggaacagatttaattacatt

SEQ ID NO: 228329 - DNA, 75 bp, Artificial Sequence
  Synthetic
atttcacaccactatgactttgtgggtcatgaacacgcttatggtttgttactattttgacaatttgttatcaat

SEQ ID NO: 228330 - DNA, 75 bp, Artificial Sequence
  Synthetic
agaatggctgtgttaccaactatcccattccacaccacattaaccttatgggttatgaacacactcatgatggtg

SEQ ID NO: 228331 - DNA, 75 bp, Artificial Sequence
  Synthetic
ttccgctattggtggtgatcaattacttctacaaggtggacatcaccctgaccttggattgagtttctacaccaa

SEQ ID NO: 228332 - DNA, 75 bp, Artificial Sequence
  Synthetic
gcgcccgccccggtacagacttaattacacttgcaacatcccacttgtctggttttaagatggctgttttaccca

SEQ ID NO: 228333 - DNA, 75 bp, Artificial Sequence
  Synthetic
tacacttgcaacatcccacttgtctggttttaagatggctgttttacccacaattccattccacaccactatgac

SEQ ID NO: 228334 - DNA, 75 bp, Artificial Sequence
  Synthetic
cattccacaccacattaaccttatgggttatgaacacactcatgatggtgtacttctttgacaatttactagcaa

SEQ ID NO: 228335 - DNA, 75 bp, Artificial Sequence
  Synthetic
tcttggaatagttttcttatgctttatggaagattcgaactatgtcaaccaagtacgtggtcttattgctacagc

SEQ ID NO: 228336 - DNA, 75 bp, Artificial Sequence
  Synthetic
tagggccaccagaaattgcgcacgtagcaaaactggaaggcatgagccaccttgaagtctggacggccattcaag

SEQ ID NO: 228337 - DNA, 75 bp, Artificial Sequence
  Synthetic
atggaagattcgaactatgtcaaccaagtacgtggtcttattgctacagcgatattgattgctgggggccatgcc

SEQ ID NO: 228338 - DNA, 75 bp, Artificial Sequence
  Synthetic
cttctacaaggtggacatcaccctgaccttggattgagtttctacaccaaccttttcaaacaactaaaggaactt

SEQ ID NO: 228339 - DNA, 75 bp, Artificial Sequence
  Synthetic
agcaaaactggaaggcatgagccaccttgaagtctggacggccattcaagaagctggattggattccctgccggg

SEQ ID NO: 228340 - DNA, 75 bp, Artificial Sequence
  Synthetic
gccactgtaccaactaggatcaaaaatgttgcatttgacttcttccagaagctgaagcagtcaggtgtgagagtt

SEQ ID NO: 228341 - DNA, 75 bp, Artificial Sequence
  Synthetic
catcattgtttgttgtcatactaacttgtagattcatacgtatggctacagtttttgtgggggctaggtttgaaa

SEQ ID NO: 228342 - DNA, 75 bp, Artificial Sequence
  Synthetic
cgtgtccgtatattgatctctatgggtaaatgtggtggtcaagaatggttggatgtgatgcgtgctgcccacaaa

SEQ ID NO: 228343 - DNA, 75 bp, Artificial Sequence
  Synthetic
ttgtagattcatacgtatggctacagtttttgtgggggctaggtttgaaatccgtgatgtcaatgggaaagttgt

SEQ ID NO: 228344 - DNA, 75 bp, Artificial Sequence
  Synthetic
gtaaatgtggtggtcaagaatggttggatgtgatgcgtgctgcccacaaaatcaatcttccaacttcggcaacca

SEQ ID NO: 228345 - DNA, 75 bp, Artificial Sequence
  Synthetic
aacgctgcatttgactttttccaaaaattgaaacaatctggggtacgaattggagtcaatgattttgttgtcata

SEQ ID NO: 228346 - DNA, 75 bp, Artificial Sequence
  Synthetic
tcgaagaacgtttcgagcacttggtatggcttcgcgaagtacaaagcgaaaaaccagccgatgcttatggattca

SEQ ID NO: 228347 - DNA, 75 bp, Artificial Sequence
  Synthetic
aattgaaacaatctggggtacgaattggagtcaatgattttgttgtcataaaaccgggtgctttatgtattatag

SEQ ID NO: 228348 - DNA, 75 bp, Artificial Sequence
  Synthetic
agaggatggtggtttgtgaaactcattgctggaagaactagaactggcacccgtagcttttatgtatatcccagc

SEQ ID NO: 228349 - DNA, 75 bp, Artificial Sequence
  Synthetic
ttttttctccggcaacgacataataacagcagcccatgtcgttgggaacaatacatttgttaatgtttgctatga

SEQ ID NO: 228350 - DNA, 75 bp, Artificial Sequence
  Synthetic
acagcagcccatgtcgttgggaacaatacatttgttaatgtttgctatgaaggcttgatgtatgaggctaaggtc

SEQ ID NO: 228351 - DNA, 75 bp, Artificial Sequence
  Synthetic
gttataaaaccaggtgcattatgcattatagacacccctgaagggaaagggacaggcttcttttctggtaacgac

SEQ ID NO: 228352 - DNA, 75 bp, Artificial Sequence
  Synthetic
catttataacctgccctggtgacttacacccgacaactagattgaagttagcaaagaacccagattacagtagtg

SEQ ID NO: 228353 - DNA, 75 bp, Artificial Sequence
  Synthetic
acacccgacaactagattgaagttagcaaagaacccagattacagtagtgtcacagtcatggcctatgtgaatga

SEQ ID NO: 228354 - DNA, 75 bp, Artificial Sequence
  Synthetic
gcagcggtccatggaaacaccctttcatatgcggtccgcacccaggatggtatgtctggcgcgccggtatgcgac

SEQ ID NO: 228355 - DNA, 75 bp, Artificial Sequence
  Synthetic
catatgcggtccgcacccaggatggtatgtctggcgcgccggtatgcgacaagtatggtcgtgtgctggcagtcc

SEQ ID NO: 228356 - DNA, 75 bp, Artificial Sequence
  Synthetic
cccttgatgcgccttcgggccattacaatgttaaaattgccaaggatgttgatcactatctaaccatgcagggtt

SEQ ID NO: 228357 - DNA, 75 bp, Artificial Sequence
  Synthetic
caatgttaaaattgccaaggatgttgatcactatctaaccatgcagggttttacctctatagcatctgttgactg

SEQ ID NO: 228358 - DNA, 75 bp, Artificial Sequence
  Synthetic
aggcgctgttataatagatccagcagacttccacccaattaaggctccatctcaggtggaattactcaaggagga

SEQ ID NO: 228359 - DNA, 75 bp, Artificial Sequence
  Synthetic
gacttccacccaattaaggctccatctcaggtggaattactcaaggaggagatagagcgactaaaagctcagcta

SEQ ID NO: 228360 - DNA, 75 bp, Artificial Sequence
  Synthetic
taccggaggggctgttataatagatccagcagatttccatccagtgaaagccccatctcaggtggaattgctcaa

SEQ ID NO: 228361 - DNA, 75 bp, Artificial Sequence
  Synthetic
ccaccattgtatcacaaccagtcgccacattggagcaaaagagtgttaatgagaacgatgtggttgaacttgtta

SEQ ID NO: 228362 - DNA, 75 bp, Artificial Sequence
  Synthetic
ccagcagatttccatccagtgaaagccccatctcaggtggaattgctcaaagaggaaatagagcgattgaaagcc

SEQ ID NO: 228363 - DNA, 75 bp, Artificial Sequence
  Synthetic
cctagtaaaggtaacaactggattccaggtgaacaactacctgagttactttcatagggcgtctcccagtggaga

SEQ ID NO: 228364 - DNA, 75 bp, Artificial Sequence
  Synthetic
cacattggagcaaaagagtgttaatgagaacgatgtggttgaacttgttaggactgcaatggagcgtgagatgag

SEQ ID NO: 228365 - DNA, 75 bp, Artificial Sequence
  Synthetic
atcctaacaccttttttacagaagaagaaggggaaaaccaagcatgggaggggtagagtcaggcgaaacctcagg

SEQ ID NO: 228366 - DNA, 75 bp, Artificial Sequence
  Synthetic
ggtgatacatatacagcagggataagcttcacccagggtggatggtatttgttgacaaatacatccattgttgat

SEQ ID NO: 228367 - DNA, 75 bp, Artificial Sequence
  Synthetic
gcttcacccagggtggatggtatttgttgacaaatacatccattgttgatggggcgttgccacctggttggatct

SEQ ID NO: 228368 - DNA, 75 bp, Artificial Sequence
  Synthetic
agaaggggaaaaccaagcatgggaggggtagagtcaggcgaaacctcaggaaaggcgtaaagcttttaactgagg

SEQ ID NO: 228369 - DNA, 75 bp, Artificial Sequence
  Synthetic
aaaaaaagaagggcaagaccaagcatggtaggggtagagtcagacgtaaccttaggaaaggtgtgaaacttctca

SEQ ID NO: 228370 - DNA, 75 bp, Artificial Sequence
  Synthetic
cacagcataccacatggacaaaggcctgatccacctaataatgcctttgcctgagtctacacaaatgtgctatga

SEQ ID NO: 228371 - DNA, 75 bp, Artificial Sequence
  Synthetic
aggtcttgaccgtgaaacattccttgacctcatagaccgcataataggagagagatctggctaccccgactatga

SEQ ID NO: 228372 - DNA, 75 bp, Artificial Sequence
  Synthetic
ctgatccacctaataatgcctttgcctgagtctacacaaatgtgctatgaaatgttgacatctattccacgctcc

SEQ ID NO: 228373 - DNA, 75 bp, Artificial Sequence
  Synthetic
gccaagactttgccctgagccagaatctaacaagcctgccctaactgatgcacaaccacttgacttatttcagaa

SEQ ID NO: 228374 - DNA, 75 bp, Artificial Sequence
  Synthetic
atgatgttgagtttgactacactgaagtgattaatttcgatcaggcaaaaccagtgccagccccacgcacactga

SEQ ID NO: 228375 - DNA, 75 bp, Artificial Sequence
  Synthetic
gtgacaacactgaatacttggatgccccagactttgctgaccagctcagagaagacatagagacagacacagaca

SEQ ID NO: 228376 - DNA, 75 bp, Artificial Sequence
  Synthetic
gacctcatagaccgcataataggagagagatctggctaccccgactatgatgatgaggagtattatgatgatgat

SEQ ID NO: 228377 - DNA, 75 bp, Artificial Sequence
  Synthetic
agtgattaatttcgatcaggcaaaaccagtgccagccccacgcacactgaagtcgaaaactgcttctgaacctga

SEQ ID NO: 228378 - DNA, 75 bp, Artificial Sequence
  Synthetic
tctaacaagcctgccctaactgatgcacaaccacttgacttatttcagaagaaagagaaacaaacagaacacgaa

SEQ ID NO: 228379 - DNA, 75 bp, Artificial Sequence
  Synthetic
acccaaaaaccaggaaaacagcttgaacaagagcaacaatcaagtaaatcttcaaaaccccaaaagaatgagcct

SEQ ID NO: 228380 - DNA, 75 bp, Artificial Sequence
  Synthetic
aacaagagcaacaatcaagtaaatcttcaaaaccccaaaagaatgagcctcagccatattcacaaacctatggca

SEQ ID NO: 228381 - DNA, 75 bp, Artificial Sequence
  Synthetic
ttttgattgggatgaagatgatgcaaaatttattttaccagcaccacatcggctgacaaaagcagatgagattgt

SEQ ID NO: 228382 - DNA, 75 bp, Artificial Sequence
  Synthetic
aaatttattttaccagcaccacatcggctgacaaaagcagatgagattgtgcttggctcaaaaattgtgaaactc

SEQ ID NO: 228383 - DNA, 75 bp, Artificial Sequence
  Synthetic
caagaggggggtggtgattggcctttggcttatcagagtatagacaagatttctcatacactcttttatcaaata

SEQ ID NO: 228384 - DNA, 75 bp, Artificial Sequence
  Synthetic
aaacacaaaattatagtgctttacctgaggccgtttttgaacttgacaaggcagcttatgaagctggtttggaag

SEQ ID NO: 228385 - DNA, 75 bp, Artificial Sequence
  Synthetic
tgaggccgtttttgaacttgacaaggcagcttatgaagctggtttggaaggctttctccagagggttaaatcaaa

SEQ ID NO: 228386 - DNA, 75 bp, Artificial Sequence
  Synthetic
gtttacaagatggcacacggtgagccatactatagctccaaacctgacaaggatttcaattttggaagcacaatg

SEQ ID NO: 228387 - DNA, 75 bp, Artificial Sequence
  Synthetic
gggccccagaagatcagggggcccaaaactaccactcattagatgcatggcaactattactggaggccccacgag

SEQ ID NO: 228388 - DNA, 75 bp, Artificial Sequence
  Synthetic
aaactaccactcattagatgcatggcaactattactggaggccccacgagagcggaagtgtgtacccactaactt

SEQ ID NO: 228389 - DNA, 75 bp, Artificial Sequence
  Synthetic
aaccaacctggcatgcttttgaggaatatggaccaactacatggggcccacaagcttttatcaaatcttttgaca

SEQ ID NO: 228390 - DNA, 75 bp, Artificial Sequence
  Synthetic
ccaccactggaaaaacttatttccaacgagttgttgtgattactggtgggcttgaggatggaacatatggctcat

SEQ ID NO: 228391 - DNA, 75 bp, Artificial Sequence
  Synthetic
acgagttgttgtgattactggtgggcttgaggatggaacatatggctcattcgtatttgatggtagagaatgggt

SEQ ID NO: 228392 - DNA, 75 bp, Artificial Sequence
  Synthetic
aatagacctatctatgatgacaaaaaacccagggatgacttattaggattattaccagaaccaacttggcatgct

SEQ ID NO: 228393 - DNA, 75 bp, Artificial Sequence
  Synthetic
aggccccaaaaaactacaaagggccccagaagaccaaggggcccaaacctaccactcattagatgcatggaaatc

SEQ ID NO: 228394 - DNA, 75 bp, Artificial Sequence
  Synthetic
aggtgtgtgcctgctaattttccattattaggacatttgccaattaatagacccatttttgatgacaaaaaacct

SEQ ID NO: 228395 - DNA, 75 bp, Artificial Sequence
  Synthetic
ttttgaaaaattcttctatgctgaaccaactgatttcttctcagaatatccacgactgtgtgcctttgctgattg

SEQ ID NO: 228396 - DNA, 75 bp, Artificial Sequence
  Synthetic
aacccagggatgacttattaggattattaccagaaccaacttggcatgcttttgaggagtatgggcctactacat

SEQ ID NO: 228397 - DNA, 75 bp, Artificial Sequence
  Synthetic
ccaactgatttcttctcagaatatccacgactgtgtgcctttgctgattgggccacgtatcgtgagtttaggtac

SEQ ID NO: 228398 - DNA, 75 bp, Artificial Sequence
  Synthetic
ctgcatatcccaaaatgaattattttgatactgaggaagattatttggaagcacatgggtgggcaccatatataa

SEQ ID NO: 228399 - DNA, 75 bp, Artificial Sequence
  Synthetic
taactgcaactgagaagaacactgattctacaccggcataccccaaaatgaactactttgatactgaagaagaat

SEQ ID NO: 228400 - DNA, 75 bp, Artificial Sequence
  Synthetic
actaaaggaattgattccaaaacctgagccacgcaagatccagatgaagtggataattgtgggagcagtacttac

SEQ ID NO: 228401 - DNA, 75 bp, Artificial Sequence
  Synthetic
ttctacaccggcataccccaaaatgaactactttgatactgaagaagaatatctggaagtacatggatgggcccc

SEQ ID NO: 228402 - DNA, 75 bp, Artificial Sequence
  Synthetic
gagccacgcaagatccagatgaagtggataattgtgggagcagtacttacatttttatctctaatacctgggggt

SEQ ID NO: 228403 - DNA, 75 bp, Artificial Sequence
  Synthetic
cctatcgcgagttccggtacctagaggatactagggtaatacatataactgcaactgaaaagaacactgattcaa

SEQ ID NO: 228404 - DNA, 75 bp, Artificial Sequence
  Synthetic
ctatatttacagacatgatagctgcctgcaaatattcaactgagacattaacagaaaaccttgaccttagaatca

SEQ ID NO: 228405 - DNA, 75 bp, Artificial Sequence
  Synthetic
ctgcaaatattcaactgagacattaacagaaaaccttgaccttagaatcaagctcgcactagcaaacataaccat

SEQ ID NO: 228406 - DNA, 75 bp, Artificial Sequence
  Synthetic
aggaggaaaaaattaggaattctgatatccggcagatagtatgtgccgaccccatttacaccaggataggggcgt

SEQ ID NO: 228407 - DNA, 75 bp, Artificial Sequence
  Synthetic
gcttagaggcacatcagaatgctttgatgaaacagcataccgacacctcagttggtcaatgtgggtggtcaccaa

SEQ ID NO: 228408 - DNA, 75 bp, Artificial Sequence
  Synthetic
gaagcacatgggtgggcaccatatataagagaattcactagggtctttaaaggagacaaacctgaagtactttgg

SEQ ID NO: 228409 - DNA, 75 bp, Artificial Sequence
  Synthetic
tttaagggagataagcctgaagtgctgtggtatttgttcctcaagaaggaaatcataaaagaggaaaagatcaaa

SEQ ID NO: 228410 - DNA, 75 bp, Artificial Sequence
  Synthetic
gtgccgaccctatatacaccaggataggggcgtgcttagaagcacatcagaatgcactgatgaaacagcacactg

SEQ ID NO: 228411 - DNA, 75 bp, Artificial Sequence
  Synthetic
gtcaccaatggaaggcggctttaagaaaacaatgcagcgcctagttaatagaggtaataaatacttcattgaatt

SEQ ID NO: 228412 - DNA, 75 bp, Artificial Sequence
  Synthetic
aaaacaatgcagcgcctagttaatagaggtaataaatacttcattgaatttgactggacccgctacgatggtact

SEQ ID NO: 228413 - DNA, 75 bp, Artificial Sequence
  Synthetic
acacttgcaacgtcccacttgtctggttttaggatggctgtcttacccacaattccattccacaccactatgaca

SEQ ID NO: 228414 - DNA, 75 bp, Artificial Sequence
  Synthetic
tcaaagagattagatggaatttcataaataaagaccaacgtgaaaaatacagacatgtgcatgaatggtatgttg

SEQ ID NO: 228415 - DNA, 75 bp, Artificial Sequence
  Synthetic
aaataaagaccaacgtgaaaaatacagacatgtgcatgaatggtatgttgacaacctcctcaatcgtcatgtgtt

SEQ ID NO: 228416 - DNA, 75 bp, Artificial Sequence
  Synthetic
atttctggttacaggcttttgagtttgcttattttaatggtccagacaaagatctttggaagacttatgacactg

SEQ ID NO: 228417 - DNA, 75 bp, Artificial Sequence
  Synthetic
caaacacggggaaacccgtctggacaattttcaacaactatggacaacaatatggttaatttctggctacaagct

SEQ ID NO: 228418 - DNA, 75 bp, Artificial Sequence
  Synthetic
gagccagatacgtggtcttattgctacagcagtattaattgctggtgggcacgcctgcttgacacttacaggcac

SEQ ID NO: 228419 - DNA, 75 bp, Artificial Sequence
  Synthetic
aattttcaacaactatggacaacaatatggttaatttctggctacaagcttttgagtttgcctactttaatgggc

SEQ ID NO: 228420 - DNA, 75 bp, Artificial Sequence
  Synthetic
tgacaccgtagtctatggagatgataggctctccaccacaccttcagtaccagacaattatgaagaaagagtaat

SEQ ID NO: 228421 - DNA, 75 bp, Artificial Sequence
  Synthetic
aggctctccaccacaccttcagtaccagacaattatgaagaaagagtaattgccatgtatagagacatctttggc

SEQ ID NO: 228422 - DNA, 75 bp, Artificial Sequence
  Synthetic
tctgtagggagagcatagttggtctatctttttgtggctttacagttaattcagaccttgagcctgtaccaacat

SEQ ID NO: 228423 - DNA, 75 bp, Artificial Sequence
  Synthetic
ttataaagccaggtgcattatgtgttatagatacccctgaagggaaaggaacaggtttcttttctggcaacgaca

SEQ ID NO: 228424 - DNA, 75 bp, Artificial Sequence
  Synthetic
tcagaccttgagcctgtaccaacatcaccagaaaaactgatggcatctctcctcaaaccatataaagttctacct

SEQ ID NO: 228425 - DNA, 75 bp, Artificial Sequence
  Synthetic
tagtaacagcagcacatgctgttggtaataatacttttgtgaatgtttgctatgagggcttgatgtacgaagcga

SEQ ID NO: 228426 - DNA, 75 bp, Artificial Sequence
  Synthetic
atttatggcagaagatcacccttttaaggtgtatgtagaacactgcctgtctcggactgctaagcagcttcgtga

SEQ ID NO: 228427 - DNA, 75 bp, Artificial Sequence
  Synthetic
tcaataataatggccgaaacaggagcaaatctagacctcggtcacaatcaagaggtcgaggtagagcagtcaaaa

SEQ ID NO: 228428 - DNA, 75 bp, Artificial Sequence
  Synthetic
caaatctagacctcggtcacaatcaagaggtcgaggtagagcagtcaaaattacagtcaactcccagaataaggg

SEQ ID NO: 228429 - DNA, 75 bp, Artificial Sequence
  Synthetic
aacaggagcaagtctagagcccgatcccaatctagaggtcgaggtagatctgtcaaaatcacagtcaactctcag

SEQ ID NO: 228430 - DNA, 75 bp, Artificial Sequence
  Synthetic
acagggtgtcacaggaccaaaacctgcaatatgccagcgagccaccgcaacactcggcacaattggctcaaacac

SEQ ID NO: 228431 - DNA, 75 bp, Artificial Sequence
  Synthetic
gtgacaaatatggtcgggtattggcagttcatcaaactaatactgggtacactggaggtgctgtcataatagacc

SEQ ID NO: 228432 - DNA, 75 bp, Artificial Sequence
  Synthetic
gcaacaaatatcagtctactcaacgtgtccgtaaaattgtcaataagcaactcaggaaacagggtgtcacaggac

SEQ ID NO: 228433 - DNA, 75 bp, Artificial Sequence
  Synthetic
gagtaaatcaagggcccgctcacaatctagagggcgggacagagcagttaaaatcacagttaattcaaaaaacag

SEQ ID NO: 228434 - DNA, 75 bp, Artificial Sequence
  Synthetic
tgcatacttctcaatcccgtcctggttaaggatgctactgggagtactcagtttggaccagtgcaggcactaggg

SEQ ID NO: 228435 - DNA, 75 bp, Artificial Sequence
  Synthetic
ctcaggaaacagggtgtcacaggaccaaaacctgcaatatgccagagagccactgcaacacttggaacaattgga

SEQ ID NO: 228436 - DNA, 75 bp, Artificial Sequence
  Synthetic
ttaaggatgctactgggagtactcagtttggaccagtgcaggcactaggggcccagtactcaatgtggaagctta

SEQ ID NO: 228437 - DNA, 75 bp, Artificial Sequence
  Synthetic
catggttggcgcatcagctgtcaatggtactgtgcttcgcatttcacttaatcccacatctacaccatcatcaac

SEQ ID NO: 228438 - DNA, 75 bp, Artificial Sequence
  Synthetic
cgtcctggttaaggacgctactgggagtactcagtttgggccagtgcaggcgctaggcgctcagtattcgatgtg

SEQ ID NO: 228439 - DNA, 75 bp, Artificial Sequence
  Synthetic
ggtactgtgcttcgcatttcacttaatcccacatctacaccatcatcaaccagttggtctggattgggtgcccgc

SEQ ID NO: 228440 - DNA, 75 bp, Artificial Sequence
  Synthetic
aaaaaagaaaggcaagaccaaacatggtaggggtagagtcagacgtaaccttagaaaaggtgtgaaacttcttac

SEQ ID NO: 228441 - DNA, 75 bp, Artificial Sequence
  Synthetic
ttgacttccatggtgggcgcctcagctgtcaatgggactgtactccgcatctcgctcaatcctacatccactcca

SEQ ID NO: 228442 - DNA, 75 bp, Artificial Sequence
  Synthetic
gaaatgcagtgttcaagcttagaccatcagacttggggggaccgagagatggttggtggcttaccaacactaatg

SEQ ID NO: 228443 - DNA, 75 bp, Artificial Sequence
  Synthetic
ctgtcaatgggactgtactccgcatctcgctcaatcctacatccactccatcatcaactagttggtctggtctcg

SEQ ID NO: 228444 - DNA, 75 bp, Artificial Sequence
  Synthetic
atcagacttggggggaccgagagatggttggtggcttaccaacactaatgataatgcctcagacacattaggccc

SEQ ID NO: 228445 - DNA, 75 bp, Artificial Sequence
  Synthetic
agttggaaggaatgcagtctttaaacttagaccatcagatcttggagggcccagggatggctggtggcttaccaa

SEQ ID NO: 228446 - DNA, 75 bp, Artificial Sequence
  Synthetic
aaaactatgtcttcatacaagaatgagcaatttacaggtggactattccttgttgagcttgcttctgaatggtgt

SEQ ID NO: 228447 - DNA, 75 bp, Artificial Sequence
  Synthetic
cttagaccatcagatcttggagggcccagggatggctggtggcttaccaataccaatgacaatgcttccgacaca

SEQ ID NO: 228448 - DNA, 75 bp, Artificial Sequence
  Synthetic
agcaatttacaggtggactattccttgttgagcttgcttctgaatggtgttttactggctatgcagcaaacccaa

SEQ ID NO: 228449 - DNA, 75 bp, Artificial Sequence
  Synthetic
gagaaaggtctagatcgtgaaacattccttgatcttatagaccgcattattggtgagaggtctggctaccctgac

SEQ ID NO: 228450 - DNA, 75 bp, Artificial Sequence
  Synthetic
cccttggtaaaaccatgtcttcatataaaaatgagcaattcacaggtgggctatttcttgtcgagcttgcctcag

SEQ ID NO: 228451 - DNA, 75 bp, Artificial Sequence
  Synthetic
tgatcatgaagttaatgtcacattcgagggatcaaaaggcacacccctaataatgaatgtacctgagcatagcca

SEQ ID NO: 228452 - DNA, 75 bp, Artificial Sequence
  Synthetic
agtcaaaccaaaaacttgccccgagccagaagctgaaacacaaccacttgacttgtctcagaagaaagagaaaca

SEQ ID NO: 228453 - DNA, 75 bp, Artificial Sequence
  Synthetic
accttccgaccttggtggacctagggatggttggtggcttacaaacaccaacgataatgcatctgacactttggg

SEQ ID NO: 228454 - DNA, 75 bp, Artificial Sequence
  Synthetic
gatggttggtggcttacaaacaccaacgataatgcatctgacactttggggccctccatcgaaatacacacactt

SEQ ID NO: 228455 - DNA, 75 bp, Artificial Sequence
  Synthetic
aaatccactgatcatgaggttaatgtcacctttgagggctcaaaaggcacgcccctaataatgaatgttccagag

SEQ ID NO: 228456 - DNA, 75 bp, Artificial Sequence
  Synthetic
gagctggtggagatgcaacatctgacactgtttggcaggttttaaatactgcagtctctgcagcagaacttgtaa

SEQ ID NO: 228457 - DNA, 75 bp, Artificial Sequence
  Synthetic
ccagaagctgaaacacaaccacttgacttgtctcagaagaaagagaaacaactagaacatgagcaacaagtggtg

SEQ ID NO: 228458 - DNA, 75 bp, Artificial Sequence
  Synthetic
taaaaatgagcaattcacaggtgggctatttcttgtcgagcttgcctcagaatggtgtttcactggctatgcagc

SEQ ID NO: 228459 - DNA, 75 bp, Artificial Sequence
  Synthetic
tgctttacaggttatgctgccaacccaaaccttgttaatttggtcaagtcaacagataagcaagtatctgtgaca

SEQ ID NO: 228460 - DNA, 75 bp, Artificial Sequence
  Synthetic
attctcaagagctggaggagatgcaacatccgatactgtctggcaggtgctgaatacagcagtctcagcagcaga

SEQ ID NO: 228461 - DNA, 75 bp, Artificial Sequence
  Synthetic
aacagataagcaagtatctgtgacatttgaaggtagtgctggatcaccattaataatgaatgtgccagaggggag

SEQ ID NO: 228462 - DNA, 75 bp, Artificial Sequence
  Synthetic
ctaattgcagggagagccaggactggcaccaagcagttttatgtttatccaagctaccaggacgccctgtcaaac

SEQ ID NO: 228463 - DNA, 75 bp, Artificial Sequence
  Synthetic
tcacctttgagggctcaaaaggcacgcccctaataatgaatgttccagagcatagccactttgcaaggatggctg

SEQ ID NO: 228464 - DNA, 75 bp, Artificial Sequence
  Synthetic
acatccgatactgtctggcaggtgctgaatacagcagtctcagcagcagagcttgtgacaccaccaccgttcaat

SEQ ID NO: 228465 - DNA, 75 bp, Artificial Sequence
  Synthetic
ttgtaaaattaattgcaggtaggactagaactggtaccaagcaattttatgtttatccaagctatcaggatgctt

SEQ ID NO: 228466 - DNA, 75 bp, Artificial Sequence
  Synthetic
accagtaacaactttacagtttacacagatgaaccagccaagtttagggcatggtgagcacactgctactcttgg

SEQ ID NO: 228467 - DNA, 75 bp, Artificial Sequence
  Synthetic
cgcgtgcaggtgaaagaaccacttcagacacagtatggcaggtgcttaatacagctgtatctgctgctgaacttg

SEQ ID NO: 228468 - DNA, 75 bp, Artificial Sequence
  Synthetic
tcaaaaaataaggctccaaaaaactacaaagggccccagaagaccaaggggcccaaaactatcactcattagatg

SEQ ID NO: 228469 - DNA, 75 bp, Artificial Sequence
  Synthetic
tagaactggtaccaagcaattttatgtttatccaagctatcaggatgctttatcaaataaaccagccctttgcac

SEQ ID NO: 228470 - DNA, 75 bp, Artificial Sequence
  Synthetic
cgcaccacaccagtaacaactctacagttcactcaaatgaaccagccaagtcttggccatggtgagcaaactgct

SEQ ID NO: 228471 - DNA, 75 bp, Artificial Sequence
  Synthetic
gttcaataatgggcccgaattcagctgacaggcaggtgtggttaaataagacactgacagcaccaggatccaata

SEQ ID NO: 228472 - DNA, 75 bp, Artificial Sequence
  Synthetic
agttcactcaaatgaaccagccaagtcttggccatggtgagcaaactgctactattggccgtattgtacaagatc

SEQ ID NO: 228473 - DNA, 75 bp, Artificial Sequence
  Synthetic
cagatgaaccagccaagtttagggcatggtgagcacactgctactcttggccgtatggtgcaagacccaagtgga

SEQ ID NO: 228474 - DNA, 75 bp, Artificial Sequence
  Synthetic
caattaataggcctatttttgatgataagaaacctagggatgaccttcttggcctacttccagaaccaacctggc

SEQ ID NO: 228475 - DNA, 75 bp, Artificial Sequence
  Synthetic
gcactccaggaggcatgaggacccggaatcctgtgacaacaaccctacagttcacacaaatgaaccaacctagtc

SEQ ID NO: 228476 - DNA, 75 bp, Artificial Sequence
  Synthetic
aactgttggctcaatcatgaaccctaactcagccgacagacaagtttggctgaacaaaactctgacagcgccagg

SEQ ID NO: 228477 - DNA, 75 bp, Artificial Sequence
  Synthetic
cactacttaattatgcaagggtttttgcacataaagtcggtggagtggtacactcctgacttccaaccctcacgt

SEQ ID NO: 228478 - DNA, 75 bp, Artificial Sequence
  Synthetic
aacaagcccaaatgacaatcttgtgaagatagcccatgacctgggtcactatttggtcatgcaagggtttatgca

SEQ ID NO: 228479 - DNA, 75 bp, Artificial Sequence
  Synthetic
tgacaggcaggtgtggttaaataagacactgacagcaccaggatccaatacaagtggagctaatccagaaaatct

SEQ ID NO: 228480 - DNA, 75 bp, Artificial Sequence
  Synthetic
tgcacataaagtcggtggagtggtacactcctgacttccaaccctcacgtgacccaggccctatttctggtatgt

SEQ ID NO: 228481 - DNA, 75 bp, Artificial Sequence
  Synthetic
ggcagatgtctacttcatgaggcaatttaagaattcccacactaacaaccgccaccagataacaagcatcttttt

SEQ ID NO: 228482 - DNA, 75 bp, Artificial Sequence
  Synthetic
cctgatttccaaccttcgcgtgacccaactcctattgctggcatgtcagtgatggttaacataacaaagaaggct

SEQ ID NO: 228483 - DNA, 75 bp, Artificial Sequence
  Synthetic
caactcctattgctggcatgtcagtgatggttaacataacaaagaaggctgatgtctactttatgaagcagttca

SEQ ID NO: 228484 - DNA, 75 bp, Artificial Sequence
  Synthetic
tttaagaattcccacactaacaaccgccaccagataacaagcatctttttgattaaacctgtggcagactttgag

SEQ ID NO: 228485 - DNA, 75 bp, Artificial Sequence
  Synthetic
actgattcaacacctgcttatcctaaaatgaattactttgatactgaagaaaattacttggaagcacatgggtgg

SEQ ID NO: 228486 - DNA, 75 bp, Artificial Sequence
  Synthetic
agagggattcacaagacaatgacagtgctgtcaatctcacagtcaggagcatgacaactaccaagactgtcagat

SEQ ID NO: 228487 - DNA, 75 bp, Artificial Sequence
  Synthetic
tcaaataacaagcatctttctagttaaaccattggcagattttgaagtgcaaagttatatgagctactttaaaag

SEQ ID NO: 228488 - DNA, 75 bp, Artificial Sequence
  Synthetic
tgctgtcaatctcacagtcaggagcatgacaactaccaagactgtcagattccaaacaggggagtggtacttgct

SEQ ID NO: 228489 - DNA, 75 bp, Artificial Sequence
  Synthetic
aaagttatatgagctactttaaaagagagtcacatgataataatgatggagttgccaatcttacagtgagaagta

SEQ ID NO: 228490 - DNA, 75 bp, Artificial Sequence
  Synthetic
agtttgccagaatcttgggtgtgggacagagtggagcttcagagtaacacagcatactatgccgaccaggcgttg

SEQ ID NO: 228491 - DNA, 75 bp, Artificial Sequence
  Synthetic
ttaggaattctgatatccggcagatagtgtgtgccgaccccatttacaccagaataggggcgtgcttagaggcac

SEQ ID NO: 228492 - DNA, 75 bp, Artificial Sequence
  Synthetic
tcaagctggagaatggtatttgctaacaagtaccacacttaaggagaacaacctaccagagggctgggtttggga

SEQ ID NO: 228493 - DNA, 75 bp, Artificial Sequence
  Synthetic
ccctgttcctagtaaaggtaacaactggattccaggtgaacaactacctgagctacttttacagggcgtctgcca

SEQ ID NO: 228494 - DNA, 75 bp, Artificial Sequence
  Synthetic
acaagtaccacacttaaggagaacaacctaccagagggctgggtttgggacaaggtggagcttaagagcgacaca

SEQ ID NO: 228495 - DNA, 75 bp, Artificial Sequence
  Synthetic
cagcattgaattacctagcacttccacactacaagcagactctagtgtccgggctactggcgcccgaggtgcaaa

SEQ ID NO: 228496 - DNA, 75 bp, Artificial Sequence
  Synthetic
acagagtggagcttcagagtaacacagcatactatgccgaccaggcgttggcatatttcataacacccccaccag

SEQ ID NO: 228497 - DNA, 75 bp, Artificial Sequence
  Synthetic
catatttcataacaccacccccagtggactctcaaatcttatttgaaggtagcaccacattgcccaggatctcat

SEQ ID NO: 228498 - DNA, 75 bp, Artificial Sequence
  Synthetic
agtgtgtgccgaccccatttacaccagaataggggcgtgcttagaggcacatcagaacgccttgatgaaacagca

SEQ ID NO: 228499 - DNA, 75 bp, Artificial Sequence
  Synthetic
gcttatgcatcagaagagacagaaactgatgatgaggaagacgaggacgaagacgacgaagcggacaggtttgat

SEQ ID NO: 228500 - DNA, 75 bp, Artificial Sequence
  Synthetic
ctctgcctgacaatcccagtgggcgatatgtggaaagccagcaacagggctgtgacacttctgatgatgaggatg

SEQ ID NO: 228501 - DNA, 75 bp, Artificial Sequence
  Synthetic
agagacagaaactgaggatgaggaagatgaggacgaagacgatgaagcggacaggtttgatctccacagctccta

SEQ ID NO: 228502 - DNA, 75 bp, Artificial Sequence
  Synthetic
tgtaaccctcctctctacactcataaatcaaggaatgacagtggaacgcgcaacaagaataacaaagcgcgcctt

SEQ ID NO: 228503 - DNA, 75 bp, Artificial Sequence
  Synthetic
tggatgccccagactttgctgaccagctcagagaagacatagagacagacacagacatcgagagtacagaggacg

SEQ ID NO: 228504 - DNA, 75 bp, Artificial Sequence
  Synthetic
cgtagtgtttacatggacctgcttgcttccggtgcatcgccgagcagtgcatggtcaaatgcgtgtgatgaagca

SEQ ID NO: 228505 - DNA, 75 bp, Artificial Sequence
  Synthetic
gagaacaaccgagtaaccctcctctctacactcataaaccaaggaatgacagtggaacgcgcaacaaggataact

SEQ ID NO: 228506 - DNA, 75 bp, Artificial Sequence
  Synthetic
agaaaacaaagcgcagtgtatacatggacctgcttgcctccggcgcatcgccgagcagtgcatggtcaaacgcgt

SEQ ID NO: 228507 - DNA, 75 bp, Artificial Sequence
  Synthetic
ggtgcctgatgattatgaggagagagttattaatatgtatagagatatttttggcatgtgggtcaaacctgggaa

SEQ ID NO: 228508 - DNA, 75 bp, Artificial Sequence
  Synthetic
ccaagaggggggtggtgattggcctttggcttatcagtgtatagataacatttctctgctcgtttaccatacaat

SEQ ID NO: 228509 - DNA, 75 bp, Artificial Sequence
  Synthetic
ttggcttatcagtgtatagataacatttctctgctcgtttaccatacaattaacaacaagatggcacacggtgag

SEQ ID NO: 228510 - DNA, 75 bp, Artificial Sequence
  Synthetic
caatcagctgaccaaactttctggagaccgcggccacgccgagtaggatcgagggtacagtctccattacttttc

SEQ ID NO: 228511 - DNA, 75 bp, Artificial Sequence
  Synthetic
gaccgcggccacgccgagtaggatcgagggtacagtctccattacttttctgtctctgtttagattattttaatc

SEQ ID NO: 228512 - DNA, 75 bp, Artificial Sequence
  Synthetic
ggactatcattttgtggttttactgtcaatgaaaatcttgaacccgtgccaacctctccagaaaagttgatggca

SEQ ID NO: 228513 - DNA, 75 bp, Artificial Sequence
  Synthetic
gagggtacagtctccattacttttctgtctctgtttagattattttaatcaccatttaaaattgatttaatcaga

SEQ ID NO: 228514 - DNA, 75 bp, Artificial Sequence
  Synthetic
ccaagaggggggtggtgattggcctttggcttatcagtgtgtatataagatttctacactcttttatcaagtact

SEQ ID NO: 228515 - DNA, 75 bp, Artificial Sequence
  Synthetic
ttggcttatcagtgtgtatataagatttctacactcttttatcaagtactctacaggatggcacacggtgagcca

SEQ ID NO: 228516 - DNA, 75 bp, Artificial Sequence
  Synthetic
ctacaggatggcacacggtgagccatactacagttctaaacctgacaaagatttcaattttggaagcacaatggc

SEQ ID NO: 228517 - DNA, 75 bp, Artificial Sequence
  Synthetic
ttggcttatcagtgtataaacaagattttctacactcttttattaaataattgacatgatggcactcggtgagcc

SEQ ID NO: 228518 - DNA, 75 bp, Artificial Sequence
  Synthetic
ccaaaaggggggtggtgattggcctttggcttatcagtgtataaacaagattttctacactcttttattaaataa

SEQ ID NO: 228519 - DNA, 75 bp, Artificial Sequence
  Synthetic
ttgacatgatggcactcggtgagccatactatagttccaaacctgacaaagattttaattttgggagcacaatgg

SEQ ID NO: 228520 - DNA, 75 bp, Artificial Sequence
  Synthetic
ggaattctccacaagcctatgattggatcgtaagaggtctaatcttccccaccactggaaaaacttatttccaac

SEQ ID NO: 228521 - DNA, 75 bp, Artificial Sequence
  Synthetic
gccgaagcaggagcaaatccagagctcgatcacaatctagaggtcgaggtagatcagtcaaaattacagtcaatt

SEQ ID NO: 228522 - DNA, 75 bp, Artificial Sequence
  Synthetic
tctcatgtcatctttgaaactaatacacaaagccaatgctcttcaggagagattacgtctctcccaagaagagaa

SEQ ID NO: 228523 - DNA, 75 bp, Artificial Sequence
  Synthetic
cacaaagccaatgctcttcaggagagattacgtctctcccaagaagagaaagccacccttgctcttgatgtgcaa

SEQ ID NO: 228524 - DNA, 75 bp, Artificial Sequence
  Synthetic
aggaccaaaacctgcaatttgtcaaacagccaccgcaacacttggaacaattggatcaaacaccacaggagcaac

SEQ ID NO: 228525 - DNA, 75 bp, Artificial Sequence
  Synthetic
tattctattatatccattactatgaaatgtggaatatttttatgtttgttcttgctattggtactgtcatgggga

SEQ ID NO: 228526 - DNA, 75 bp, Artificial Sequence
  Synthetic
ctgggagtactcaatttggcccagtgcaggcgctaggagcgcagtattcaatgtggaagcttaaatacctcaatg

SEQ ID NO: 228527 - DNA, 75 bp, Artificial Sequence
  Synthetic
agccacgtaagatacagatgaagtggataattgtgggagcggttcttacatttttatctctaatacctgggggtt

SEQ ID NO: 228528 - DNA, 75 bp, Artificial Sequence
  Synthetic
ttagattaacatctatggtgggtgcctcagcagtcgatggtaccgtagtgaggatatcacttaacccaacttcca

SEQ ID NO: 228529 - DNA, 75 bp, Artificial Sequence
  Synthetic
ctcgcactagcaaacataaccattagtgacaagttagacgctgtgaggcaaattcttaactttgcctttgtacct

SEQ ID NO: 228530 - DNA, 75 bp, Artificial Sequence
  Synthetic
gcttggagcgcgcaaacatctagatgttactgttggtaagaatgcagtttttaaattaaagccttctgatttagg

SEQ ID NO: 228531 - DNA, 75 bp, Artificial Sequence
  Synthetic
acttgcaacgtcccacttgtctggttttaggctggctgttttacccacaattccattccataccactatgacttt

SEQ ID NO: 228532 - DNA, 75 bp, Artificial Sequence
  Synthetic
tcttaccagaatacacaatttacaggaggcttatttttggtggggttgtcttctgcatggtgcttcacaggatat

SEQ ID NO: 228533 - DNA, 75 bp, Artificial Sequence
  Synthetic
tagtaaaatctacagacaaaagtgttgatgtcacttttgagggttcagctggaacaccacttattatgaatgtac

SEQ ID NO: 228534 - DNA, 75 bp, Artificial Sequence
  Synthetic
tgatgtcacttttgagggttcagctggaacaccacttattatgaatgtacctgagcacagccattttgcgagaat

SEQ ID NO: 228535 - DNA, 75 bp, Artificial Sequence
  Synthetic
actaccctttccagggccggtggtgagtcatcatctgacactgtttggcaagtcttgaacacagctgtttcagca

SEQ ID NO: 228536 - DNA, 75 bp, Artificial Sequence
  Synthetic
agtcatcatctgacactgtttggcaagtcttgaacacagctgtttcagcagccgagcttgttactccaccgcctt

SEQ ID NO: 228537 - DNA, 75 bp, Artificial Sequence
  Synthetic
gtggtttgtcaagcttattgctgggcgcgctcgcactggtgcgcgcaggttctatgtttatcctagctaccagga

SEQ ID NO: 228538 - DNA, 75 bp, Artificial Sequence
  Synthetic
cgcgctcgcactggtgcgcgcaggttctatgtttatcctagctaccaggatgccctatctaataaacctgccctt

SEQ ID NO: 228539 - DNA, 75 bp, Artificial Sequence
  Synthetic
ttgtggccactgtaccaactaggatcaaaaacgttgcatttgatttcttccagaagctgaaacagtcaggggtga

SEQ ID NO: 228540 - DNA, 75 bp, Artificial Sequence
  Synthetic
tagacacccctgaagggaaaggaacaggtttcttttctggcaatgacatagtaacagcagcacatgttgttggca

SEQ ID NO: 228541 - DNA, 75 bp, Artificial Sequence
  Synthetic
ccagacagagcaatccagtgcgcaccacactccagttcacacaaatgaaccaacctagtcttggtcgtggtgcca

SEQ ID NO: 228542 - DNA, 75 bp, Artificial Sequence
  Synthetic
cacactccagttcacacaaatgaaccaacctagtcttggtcgtggtgccactccagcaacattgggccgatccat

SEQ ID NO: 228543 - DNA, 75 bp, Artificial Sequence
  Synthetic
gtcatcatgactgttggtgcactagtgcagcccaacaggtccgatacccagaattggttgttcaaaacagtcact

SEQ ID NO: 228544 - DNA, 75 bp, Artificial Sequence
  Synthetic
tagcattcataacttgtcctggtgacttgcatccaacagcaagattaaaattatcaaagaacccagattatagtt

SEQ ID NO: 228545 - DNA, 75 bp, Artificial Sequence
  Synthetic
tgcagcccaacaggtccgatacccagaattggttgttcaaaacagtcactccacctacaggacatgatgctgcca

SEQ ID NO: 228546 - DNA, 75 bp, Artificial Sequence
  Synthetic
tttaaccatacaaggattccttcttatagatagtctggagtggttaacacctaacttgcaggaatctcaagaacc

SEQ ID NO: 228547 - DNA, 75 bp, Artificial Sequence
  Synthetic
attgtcaaagaatccagattatagttgtgtcacagttatggcttatgtgaatgaagatcttgtggtttcaactgc

SEQ ID NO: 228548 - DNA, 75 bp, Artificial Sequence
  Synthetic
gctgccatggtgcatggtaacactctctcatatgcagttcgcacccaagacgggatgtcgggtgcaccagtttgt

SEQ ID NO: 228549 - DNA, 75 bp, Artificial Sequence
  Synthetic
atagatagtctggagtggttaacacctaacttgcaggaatctcaagaaccaccattaatcccagagttgggtgtc

SEQ ID NO: 228550 - DNA, 75 bp, Artificial Sequence
  Synthetic
tagtgtatttcatgcagcagtatgtgaacccacacaccaacaacaaacaccaggtctccagcattttcctaataa

SEQ ID NO: 228551 - DNA, 75 bp, Artificial Sequence
  Synthetic
gaacccacacaccaacaacaaacaccaggtctccagcattttcctaataaagccaactgaaaatttcagtgtcac

SEQ ID NO: 228552 - DNA, 75 bp, Artificial Sequence
  Synthetic
gcagactttcatccagtgaaggccccatctcaggtggaattgctcaaagaggaaatagagcgactaaaagcccaa

SEQ ID NO: 228553 - DNA, 75 bp, Artificial Sequence
  Synthetic
ggaaatagagcgactaaaagcccaattgaattccgccgctgagaacccagcgactgttgctacacaacaacctgc

SEQ ID NO: 228554 - DNA, 75 bp, Artificial Sequence
  Synthetic
gaaagccaaagtgaccagaatgtggcaaatttaaaaatacgtccacagacttggcagcaaacagtgaacttccaa

SEQ ID NO: 228555 - DNA, 75 bp, Artificial Sequence
  Synthetic
agcagatttccatccagtgaaggccccatctcaggtggaattgctcaaagaggaaatcgagcgactgaaagccca

SEQ ID NO: 228556 - DNA, 75 bp, Artificial Sequence
  Synthetic
cgtggaaagtggtatctggttacaaatacagccattaggaatggaccacccccatcagggtgggtctgggacaac

SEQ ID NO: 228557 - DNA, 75 bp, Artificial Sequence
  Synthetic
cacaccggttgactaaggcagatgaaatagtccttggatctaaaatcgtcaagcttagaacgattattgaaacag

SEQ ID NO: 228558 - DNA, 75 bp, Artificial Sequence
  Synthetic
gtgaccgtcgttacacaacaacctatcgttacactagaacagaaaagtgttagtgatagtgatgtggttgacctt

SEQ ID NO: 228559 - DNA, 75 bp, Artificial Sequence
  Synthetic
attatgctgaccaggtcttggcccactttataaatccacccccacagaactccaagatctattttgaagtgcata

SEQ ID NO: 228560 - DNA, 75 bp, Artificial Sequence
  Synthetic
tgaaagtgctgcgtgatgaaatcaatgggatccttgcaccattcctacaaaaaaagaaaggcaagaccaagcatg

SEQ ID NO: 228561 - DNA, 75 bp, Artificial Sequence
  Synthetic
ctttataaatccacccccacagaactccaagatctattttgaagtgcatacaacaatgccccagtcgcgtgcgag

SEQ ID NO: 228562 - DNA, 75 bp, Artificial Sequence
  Synthetic
atcaaaaaacaaggccccaaaaaactacaaagggccccagaagaccaaggggcccaaaattaccactcattagat

SEQ ID NO: 228563 - DNA, 75 bp, Artificial Sequence
  Synthetic
actgacaactggcaagaaccagatgaagatctccaaacctcgactgaagagagtgattatgaaacagattctcta

SEQ ID NO: 228564 - DNA, 75 bp, Artificial Sequence
  Synthetic
aagatctccaaacctcgactgaagagagtgattatgaaacagattctctagaggatgaatctgatgatgaagact

SEQ ID NO: 228565 - DNA, 75 bp, Artificial Sequence
  Synthetic
tgatgatgaggattattatgatgaagatgatgatggatggggaatggttggtgatgatgtagaatttgattatac

SEQ ID NO: 228566 - DNA, 75 bp, Artificial Sequence
  Synthetic
gatgatgatggatggggaatggttggtgatgatgtagaatttgattatactgaagtaattaattttgaccaagca

SEQ ID NO: 228567 - DNA, 75 bp, Artificial Sequence
  Synthetic
taattttccattattaggccatttaccaattaatagacccatctttgatgataagaaacccagggacgatctcct

SEQ ID NO: 228568 - DNA, 75 bp, Artificial Sequence
  Synthetic
taacactcttgttaaccagggcattagcagggagcgtgctacgtacattggtatgtcagcatatcccaatgttga

SEQ ID NO: 228569 - DNA, 75 bp, Artificial Sequence
  Synthetic
ggtgatgatgtagaatttgattatactgaagtaatcaattttgaccaagcaaaaccaacccctgccccgagaaca

SEQ ID NO: 228570 - DNA, 75 bp, Artificial Sequence
  Synthetic
gtatgtcagcatatcccaatgttgagtggggaagtggtgaacaatcaacaagtcagcacatccaggaaatctcct

SEQ ID NO: 228571 - DNA, 75 bp, Artificial Sequence
  Synthetic
ttgtctcagaagaaagagaaacaaccagaacatgaacaacaagtggtgaagtctaccaagcctcagaagaatgaa

SEQ ID NO: 228572 - DNA, 75 bp, Artificial Sequence
  Synthetic
caaaaatcgaagcacaaccacttgatttgtctcagaaaaaagagaaacaaccagaacatgagcaacaagtggcga

SEQ ID NO: 228573 - DNA, 75 bp, Artificial Sequence
  Synthetic
tttgtctcagaaaaaagagaaacaaccagaacatgagcaacaagtggcgaagcccaccaagcctcagaagattga

SEQ ID NO: 228574 - DNA, 75 bp, Artificial Sequence
  Synthetic
gcggccacgccgagtaggatcgagggtacagctcccattcttttctgtttctgtttagatgattttaatcaacat

SEQ ID NO: 228575 - DNA, 75 bp, Artificial Sequence
  Synthetic
gcaaggcaccaatctgggaatcttatgattttgactgggacgaggatgatgccaagttcatcctgccagcaccac

SEQ ID NO: 228576 - DNA, 75 bp, Artificial Sequence
  Synthetic
gccaagaggggggtggtgattggcctttggcttatccttgtatagataaaattttcctacactcatttattaaat

SEQ ID NO: 228577 - DNA, 75 bp, Artificial Sequence
  Synthetic
ggtaaggcaccaatctgggagtcttatgattttgactgggatgaggatgatgccaagtttatcctaccagcgcca

SEQ ID NO: 228578 - DNA, 75 bp, Artificial Sequence
  Synthetic
ggcaccatatattagagaattcactagggtcttcaaaggagacaaacctgaagtactttggtacctatttcttaa

SEQ ID NO: 228579 - DNA, 75 bp, Artificial Sequence
  Synthetic
atggttacaaaacttcccaagtttgttaggaattctccacaagcctatgattggatcgtaagaggtctaatcttc

SEQ ID NO: 228580 - DNA, 75 bp, Artificial Sequence
  Synthetic
aaagggccccagaagaccaaggggcccaaaattatcactcattagatgcatggaaatcattgctagaacctccac

SEQ ID NO: 228581 - DNA, 75 bp, Artificial Sequence
  Synthetic
ataccgacacctcagttggtcaatgtgggtggtcaccaatggaaggcggctttaaaaaaaccatgcagcgcctag

SEQ ID NO: 228582 - DNA, 75 bp, Artificial Sequence
  Synthetic
aacgagttgtggtgattactggtggacttgaggatggaacatatggctcatttgtatttgatggtagagaatggg

SEQ ID NO: 228583 - DNA, 75 bp, Artificial Sequence
  Synthetic
ttttccattgttaggtcatttaccaattaatagacccatctttgatgataagaaacccagggatgatctccttgg

SEQ ID NO: 228584 - DNA, 75 bp, Artificial Sequence
  Synthetic
attacttccagaaccaacctggcatgcttttgaggaatatggaccaactacatggggcccacaagctttcattaa

SEQ ID NO: 228585 - DNA, 75 bp, Artificial Sequence
  Synthetic
aatcaatagacccatttttgatgataagaaacctagagatgatctccttggtttacttccagaaccaacctggca

SEQ ID NO: 228586 - DNA, 75 bp, Artificial Sequence
  Synthetic
gaaagccacccttgctcttgatgtgcaattccttcagcatgaaaacgtgcgattgaaggaattgatcccaaaacc

SEQ ID NO: 228587 - DNA, 75 bp, Artificial Sequence
  Synthetic
gattgaaggaattgatcccaaaaccggagccacgaaagatacagatgaagtggataattgtgggagcagtgctta

SEQ ID NO: 228588 - DNA, 75 bp, Artificial Sequence
  Synthetic
atgttgacaacctccttaatcgccatgtacttctaccatctggtgaagtcaccttgcagacacgaggtaatccat

SEQ ID NO: 228589 - DNA, 75 bp, Artificial Sequence
  Synthetic
agaaccaattgattttttctcagaatatccgcagttgtgtgccttcgcagattgggcaacctatcgcgagtttcg

SEQ ID NO: 228590 - DNA, 75 bp, Artificial Sequence
  Synthetic
cctgcaaatattcaactgagacattaacagaaaaccttgaccttagaattaagctcgcactagcaaatataacca

SEQ ID NO: 228591 - DNA, 75 bp, Artificial Sequence
  Synthetic
gacctatgacactgtagtttatggagatgacaggctttctacaacaccttcggtgcctgatgattatgaggagag

SEQ ID NO: 228592 - DNA, 75 bp, Artificial Sequence
  Synthetic
catataactgcaactgaaaaaaatactgattcaacacctgcatatcctaaaatgaattattttgatactgaggaa

SEQ ID NO: 228593 - DNA, 75 bp, Artificial Sequence
  Synthetic
tccatatattagagaattcactagggtcttcaaaggagacaaacctgaagtactgtggtacctatttcttaagaa

SEQ ID NO: 228594 - DNA, 75 bp, Artificial Sequence
  Synthetic
agtgattactatgtatagagacatctttggcatgtgggttaagcctgggaaggttatctgtagagacagcatagt

SEQ ID NO: 228595 - DNA, 75 bp, Artificial Sequence
  Synthetic
caacttctcctgaaaagctaatggcatcactgttaaaaccttacaaaatactacctgatcttgaatcactccatg

SEQ ID NO: 228596 - DNA, 75 bp, Artificial Sequence
  Synthetic
tacacttgcaacgtcccacttgtctggctttaggatggctgttttacccacaattccattccacactactatgac

SEQ ID NO: 228597 - DNA, 75 bp, Artificial Sequence
  Synthetic
ctacctgatcttgaatcactccatgggaagctcctatgctatcagttgcttgctgcgttcatggcagaggaccac

SEQ ID NO: 228598 - DNA, 75 bp, Artificial Sequence
  Synthetic
gtggtcaccaatggaaggcggctttaaaaaaacaatgcaacgcctagtaaataaagggaataagtactttattga

SEQ ID NO: 228599 - DNA, 75 bp, Artificial Sequence
  Synthetic
taggaattctgatattcggcagatagtgtgtgccgaccccatttacaccaggataggggcgtgcttagaggcaca

SEQ ID NO: 228600 - DNA, 75 bp, Artificial Sequence
  Synthetic
gtttgttactactttgataatttgctagcaataacaatggcaatcttagcaccaattcttggcatcatcttcttg

SEQ ID NO: 228601 - DNA, 75 bp, Artificial Sequence
  Synthetic
tttgtgggtcatgaacacgcttatggtttgttactactttgataatttgctagcaataacaatggcaatcttagc

SEQ ID NO: 228602 - DNA, 75 bp, Artificial Sequence
  Synthetic
accaattcttggcatcatcttcttgtgcttcatggaagactccaattatgtgagccagatacgtggtcttattgc

SEQ ID NO: 228603 - DNA, 75 bp, Artificial Sequence
  Synthetic
tgcttcatggaagactccaattatgtgagccagatacgtggtcttattgctacagcagtattaattgctggtggg

SEQ ID NO: 228604 - DNA, 75 bp, Artificial Sequence
  Synthetic
aataaagggaataaacattttattgaatttgactggacccgctatgatggaactataccaccagcactcttcaaa

SEQ ID NO: 228605 - DNA, 75 bp, Artificial Sequence
  Synthetic
acttctaccatctggtgaagttaccttgcagacacgaggcaatccatctgggcagttttcaacaacaatggataa

SEQ ID NO: 228606 - DNA, 75 bp, Artificial Sequence
  Synthetic
caaccacgtcattatttgttgtcatattaacttgtaggttcatacgtatggcaacggtttttattggcaccagat

SEQ ID NO: 228607 - DNA, 75 bp, Artificial Sequence
  Synthetic
tactcctaccatccggtgaagtcaccttgcagacacgaggcaatccatctgggcagttttcaacaccaatggata

SEQ ID NO: 228608 - DNA, 75 bp, Artificial Sequence
  Synthetic
gcttttgagttcgcttatttcaatggcccagacaaagacctttggaagacctatgacactgtggtttatggagat

SEQ ID NO: 228609 - DNA, 75 bp, Artificial Sequence
  Synthetic
tcaacgtgtccgtaacattgtcaataagcaactcaggaaacagggtgtcacaggaccaaaacctgcaatatgtca

SEQ ID NO: 228610 - DNA, 75 bp, Artificial Sequence
  Synthetic
ggtcgtagctactgtaccaactaggataaaaaatgttgcatttgatttcttccagaagttaaaacagtcaggggt

SEQ ID NO: 228611 - DNA, 75 bp, Artificial Sequence
  Synthetic
gcccagacaaagacctttggaagacctatgacactgtggtttatggagatgacaggctctctacaacaccttcgg

SEQ ID NO: 228612 - DNA, 75 bp, Artificial Sequence
  Synthetic
gtcataaaaccaggtgcgttatgtgttatagatacccctgaaggaaaaggaacaggtttcttctctggcaacgac

SEQ ID NO: 228613 - DNA, 75 bp, Artificial Sequence
  Synthetic
gatcactatgtatagagacatctttggcatgtgggttaagcccgggaaggtcatctgtagaaacagcatagttgg

SEQ ID NO: 228614 - DNA, 75 bp, Artificial Sequence
  Synthetic
atagtaacagcagcacatgttgttggcaataatacctttgtgaatgtgtgctatgagggcttgatgtacgaagcg

SEQ ID NO: 228615 - DNA, 75 bp, Artificial Sequence
  Synthetic
attatccttttgtggctttactgttaatgaaaatcttgaacctgtgccaacctctccggaaaagttgatggcatc

SEQ ID NO: 228616 - DNA, 75 bp, Artificial Sequence
  Synthetic
ggctatccttttgtggctttactgttaatgaaaatcttgaacccgtgccaacctctccggaaaagttgatggcat

SEQ ID NO: 228617 - DNA, 75 bp, Artificial Sequence
  Synthetic
aaagttcggtacatgcctgaaaaggacatagcattcataacctgtcctggtgacttgcatccaacagcaagacta

SEQ ID NO: 228618 - DNA, 75 bp, Artificial Sequence
  Synthetic
gaatgaagatctcgtggtttcaaccgcagctgccatggtacatggtaacactctctcatatgcagttcgcaccca

SEQ ID NO: 228619 - DNA, 75 bp, Artificial Sequence
  Synthetic
tttaaactgaaaccttctgaccttggtggacctagggatggttggtggctcacaaacaccaacgacaatgcatct

SEQ ID NO: 228620 - DNA, 75 bp, Artificial Sequence
  Synthetic
ggaggggaggaccaaagaagtgtgatggctagcaagtctgacaagcaagtcactgttgaggtcaataacaatggc

SEQ ID NO: 228621 - DNA, 75 bp, Artificial Sequence
  Synthetic
tgtgacaaatatggtcgagtgttggcagtccatcaaaccaacactgggtatactggaggtgccgtcataattgac

SEQ ID NO: 228622 - DNA, 75 bp, Artificial Sequence
  Synthetic
ggggggctatttttggttgaacttgcttcagagtggtgctttacaggttatgctgccaacccaaaccttgttaat

SEQ ID NO: 228623 - DNA, 75 bp, Artificial Sequence
  Synthetic
ctccatctcaggtggaattgctcaaagaggaaatagagcgactaaaagcccaactgaattctgccactgagaact

SEQ ID NO: 228624 - DNA, 75 bp, Artificial Sequence
  Synthetic
agaggaaatagagcgactaaaagcccaactgaattctgccactgagaactcgacgaatgtcgtcacacaacagcc

SEQ ID NO: 228625 - DNA, 75 bp, Artificial Sequence
  Synthetic
gttagcgatagtgatgttgttgacctagtcagaactgcaatggaacgtgagatgaaggtgctgcgtgatgaaatt

SEQ ID NO: 228626 - DNA, 75 bp, Artificial Sequence
  Synthetic
agatcgaggcgtgcatactccttaatcccgtcctggttaaggacgctactggaagtactcagtttgggccagtgc

SEQ ID NO: 228627 - DNA, 75 bp, Artificial Sequence
  Synthetic
tcccgtcctggttaaggacgctactggaagtactcagtttgggccagtgcaggcgctaggtgctcagtattcaat

SEQ ID NO: 228628 - DNA, 75 bp, Artificial Sequence
  Synthetic
cttagaaaaggtgtgaaactccttactgaggaagagtatcgagaactcttagagaaaggtctagatcgtgaaaca

SEQ ID NO: 228629 - DNA, 75 bp, Artificial Sequence
  Synthetic
ggtggtttgtgaaacttattgccgggagaaccagaactggctctcgtagcttctatgtgtatcccagctaccaag

SEQ ID NO: 228630 - DNA, 75 bp, Artificial Sequence
  Synthetic
aaactgacttccatggtgggcgcctcagctgttaacgggactgtactccgcatctcgctcaaccctacatccact

SEQ ID NO: 228631 - DNA, 75 bp, Artificial Sequence
  Synthetic
cagctgttaacgggactgtactccgcatctcgctcaaccctacatccactccatcatcaactagctggtctggac

SEQ ID NO: 228632 - DNA, 75 bp, Artificial Sequence
  Synthetic
atgctttgtccaataagccagcactctgcaccggcagcactccaggaggcatgaggacgcggaatcctgtgacaa

SEQ ID NO: 228633 - DNA, 75 bp, Artificial Sequence
  Synthetic
ctatgatgatgaagactatagtgatgaagatgatgatggatgggtgatggttacaaatgaagtagaatttgacta

SEQ ID NO: 228634 - DNA, 75 bp, Artificial Sequence
  Synthetic
cagactgacgtctatggttggtgcttcagcagtaaacggcaccgtagtgagaatatcactcaatccaacttccac

SEQ ID NO: 228635 - DNA, 75 bp, Artificial Sequence
  Synthetic
tacagtgggcaggaatgcagtctttaaacttagaccatcagaccttggagggccaagggatggctggtggctcac

SEQ ID NO: 228636 - DNA, 75 bp, Artificial Sequence
  Synthetic
tactgaagtaatcaattttgaccaagcaaaaccaactcctgcccccaggacaaccaaattaaaacctaaccctga

SEQ ID NO: 228637 - DNA, 75 bp, Artificial Sequence
  Synthetic
aaacttagaccatcagaccttggagggccaagggatggctggtggctcactaataccaatgacaatgcatctgat

SEQ ID NO: 228638 - DNA, 75 bp, Artificial Sequence
  Synthetic
caaccaaattaaaacctaaccctgagccagaagttgaagcacaaccacttgacttatcccagaagaaagagaaac

SEQ ID NO: 228639 - DNA, 75 bp, Artificial Sequence
  Synthetic
acacccttggtaaaaccatgtcttcatataaaaatgagcaatttacaggtggactatttcttgttgagcttgctt

SEQ ID NO: 228640 - DNA, 75 bp, Artificial Sequence
  Synthetic
gacttatcccagaagaaagagaaacaaccagaacacgaacaacaggccgtgaagcccaataagcctcaaaagagt

SEQ ID NO: 228641 - DNA, 75 bp, Artificial Sequence
  Synthetic
tgcgccttcgggccattacaatgtgaaaattgcaaaggatgttgaccactatctaaccatgcagggtttcacttc

SEQ ID NO: 228642 - DNA, 75 bp, Artificial Sequence
  Synthetic
atataaaaatgagcaatttacaggtggactatttcttgttgagcttgcttcagaatggtgttttactggctatgc

SEQ ID NO: 228643 - DNA, 75 bp, Artificial Sequence
  Synthetic
atggtaaggcaccaatctgggaatcttatgattttgattgggatgaggatgatgccaagttcatccttccagcgc

SEQ ID NO: 228644 - DNA, 75 bp, Artificial Sequence
  Synthetic
gttaaatccactgatcatgaggtgaatgtcacttttgagggctcaaaaggtacgcccctaataatgaatgtcgca

SEQ ID NO: 228645 - DNA, 75 bp, Artificial Sequence
  Synthetic
atctaaccatgcagggtttcacttctatagcatctgttgactggtacactatagattttcaaccatctgaggcgc

SEQ ID NO: 228646 - DNA, 75 bp, Artificial Sequence
  Synthetic
ttatgattttgattgggatgaggatgatgccaagttcatccttccagcgccacatcgactaactaaagcagatga

SEQ ID NO: 228647 - DNA, 75 bp, Artificial Sequence
  Synthetic
ggtgaagtctacagataagagtgttaatgtcacttttgaaggctcagccggaacaccgctcataatgaatgtgcc

SEQ ID NO: 228648 - DNA, 75 bp, Artificial Sequence
  Synthetic
aagcttagaacgatcattgaaacagccataaagacccagaactatagtgcattacctgaagctgtgtttgagcta

SEQ ID NO: 228649 - DNA, 75 bp, Artificial Sequence
  Synthetic
aacattttcaagagctggaggcgatgcaacatctgacactgtttggcaggtgctgaacacagcagtctcagcagc

SEQ ID NO: 228650 - DNA, 75 bp, Artificial Sequence
  Synthetic
ccataaagacccagaactatagtgcattacctgaagctgtgtttgagctagataaagcagcctatgaagcaggtc

SEQ ID NO: 228651 - DNA, 75 bp, Artificial Sequence
  Synthetic
atgtcacttttgagggctcaaaaggtacgcccctaataatgaatgtcgcagagcacagccactttgcaagaatgg

SEQ ID NO: 228652 - DNA, 75 bp, Artificial Sequence
  Synthetic
gcaacatctgacactgtttggcaggtgctgaacacagcagtctcagcagcagagcttgtagccccaccaccgttc

SEQ ID NO: 228653 - DNA, 75 bp, Artificial Sequence
  Synthetic
gtcaaaaaataaggctccaaaaaactacaaagggccccagaagaccaaggggcccaaacctaccactcattagat

SEQ ID NO: 228654 - DNA, 75 bp, Artificial Sequence
  Synthetic
ggtttgtaaagttgattgcaggtagaactagaactggtaccaagcaattttatgtttatcctagttatcaggatg

SEQ ID NO: 228655 - DNA, 75 bp, Artificial Sequence
  Synthetic
gtcttcatctgacactgtttggcaagtcttgaacaccgctgtttcggcagctgagctggtaaccccaccgccatt

SEQ ID NO: 228656 - DNA, 75 bp, Artificial Sequence
  Synthetic
aactagaactggtaccaagcaattttatgtttatcctagttatcaggatgctttatcaaataaaccagctctttg

SEQ ID NO: 228657 - DNA, 75 bp, Artificial Sequence
  Synthetic
cgcgggagcgaaggtgtgtacctgctaatttcccattattaggacatttaccaattaatagacccatttttgatg

SEQ ID NO: 228658 - DNA, 75 bp, Artificial Sequence
  Synthetic
gcgcgcgcactggtgcgcgtaggttctatgtctatcttagttaccaagatgccctgtctaataaacctgcccttt

SEQ ID NO: 228659 - DNA, 75 bp, Artificial Sequence
  Synthetic
ctacgtaccacaccggtaacaactctacagttcactcaaatgaaccagccaagccttgggcatggtgagcacact

SEQ ID NO: 228660 - DNA, 75 bp, Artificial Sequence
  Synthetic
tacagttcactcaaatgaaccagccaagccttgggcatggtgagcacactgccaccattggcagtattgtgcaag

SEQ ID NO: 228661 - DNA, 75 bp, Artificial Sequence
  Synthetic
ctatgtctatcttagttaccaagatgccctgtctaataaacctgccctttgcaccggtggtgttcctgccagtgc

SEQ ID NO: 228662 - DNA, 75 bp, Artificial Sequence
  Synthetic
gtcttgaacaccgctgtttcggcagctgagctggtaaccccaccgccattcaattggctggtcaagggtggctgg

SEQ ID NO: 228663 - DNA, 75 bp, Artificial Sequence
  Synthetic
ccacatggggcccacaagcttttattaaatcttttgataaattcttttatgcagaaccaattgattttttctcag

SEQ ID NO: 228664 - DNA, 75 bp, Artificial Sequence
  Synthetic
gctaacagttggctcaatcatgagcccgaattcagctgataggcaagtttggctgaacaaaactctgacagcgcc

SEQ ID NO: 228665 - DNA, 75 bp, Artificial Sequence
  Synthetic
acactccagtttacacagatgaatcagcctagtttaggtcatggtgctactccaatgacatttggccgctccata

SEQ ID NO: 228666 - DNA, 75 bp, Artificial Sequence
  Synthetic
ttttgctaactgttggacccccaatggctcctaacacagccaactctcagaattgggtgaacaagacaattgtcc

SEQ ID NO: 228667 - DNA, 75 bp, Artificial Sequence
  Synthetic
aggaacaaattcaaatgacaatcttgtaaagatagcccacgacttgggtcactatttgatcatgcaagggtttat

SEQ ID NO: 228668 - DNA, 75 bp, Artificial Sequence
  Synthetic
tacatataactgcaactgagaaaaacactgattcaacacctgcgtatcctaaaatgaattattttgacaccgagg

SEQ ID NO: 228669 - DNA, 75 bp, Artificial Sequence
  Synthetic
acccaacccctattgctggcatgtcagtgatggttaacataacaaagaaggctgatgtctacttcatgaagcaat

SEQ ID NO: 228670 - DNA, 75 bp, Artificial Sequence
  Synthetic
tgatttccaaccctctgatgagcccagcccaatacccgggctatatgcccgcgtgaataacaccaagaaggctga

SEQ ID NO: 228671 - DNA, 75 bp, Artificial Sequence
  Synthetic
ccatcaaataacaagcatctttttaattaaaccattggcagattttaaggtgcaatgttatatgagctactttaa

SEQ ID NO: 228672 - DNA, 75 bp, Artificial Sequence
  Synthetic
tgcaatgttatatgagctactttaaaagagagtcacatgacaatgatggggttgccaatcttacagtgagaagta

SEQ ID NO: 228673 - DNA, 75 bp, Artificial Sequence
  Synthetic
ggtgacaactagcttccaggtgataaactacaccagctacttcataagaggtgctgaaagtggctcaaatgtctc

SEQ ID NO: 228674 - DNA, 75 bp, Artificial Sequence
  Synthetic
aactacaccagctacttcataagaggtgctgaaagtggctcaaatgtctctaatctaaagattagagaccaaaca

SEQ ID NO: 228675 - DNA, 75 bp, Artificial Sequence
  Synthetic
acaagtaccacacttaaggagaacaacctaccagagggctgggtttgggatagggtggagcttaagagtgacaca

SEQ ID NO: 228676 - DNA, 75 bp, Artificial Sequence
  Synthetic
cacagttatgcatgatggccccacatcatcaggctgggtttggatgaatcaagagctaactaacaacattgcata

SEQ ID NO: 228677 - DNA, 75 bp, Artificial Sequence
  Synthetic
catatttcataacaccacccccagtggactcccaaattttatttgaaggtaacaccacattgcccagaatttcct

SEQ ID NO: 228678 - DNA, 75 bp, Artificial Sequence
  Synthetic
ctccgcctgacaatcccagcgggcgatatatggaaagccaccagcaagactgtgactcttctgatgatgaggatg

SEQ ID NO: 228679 - DNA, 75 bp, Artificial Sequence
  Synthetic
cttatcacacctcccccagccgcatcacaactttattttgaactgcatactgtgcttcctcaagcaagatcagag

SEQ ID NO: 228680 - DNA, 75 bp, Artificial Sequence
  Synthetic
tgaacctgaggactctgatgagaacaaccgtgtaaccctcctctctacactcataaaccaaggaatgacagtgga

SEQ ID NO: 228681 - DNA, 75 bp, Artificial Sequence
  Synthetic
aaccgtgtaaccctcctctctacactcataaaccaaggaatgacagtggagcgcgcaacaagaataactaaacgc

SEQ ID NO: 228682 - DNA, 75 bp, Artificial Sequence
  Synthetic
tctctaccctcctcaaccaaggaatttcagtggagcgcgccactagaatcactaatggtgcattcccaacacgcg

SEQ ID NO: 228683 - DNA, 75 bp, Artificial Sequence
  Synthetic
tttggcatgtgggttaagcctgggaaggtcatctgtagagacagtatagttggattatccttttgtggcttcact

SEQ ID NO: 228684 - DNA, 75 bp, Artificial Sequence
  Synthetic
tgaagcgcagcgtgtacatggacctgcttgcctccggtgcatcgccgagcagtgcatggtcaaacgcgtgtgatg

SEQ ID NO: 228685 - DNA, 75 bp, Artificial Sequence
  Synthetic
caatgacctgttggtttccgggctcagccctggtgcagcatggtcccatgcgtgcgaacaagcacgcagagcagg

SEQ ID NO: 228686 - DNA, 75 bp, Artificial Sequence
  Synthetic
caacttctccagaaaagttgatggcatcgctgttaaagccttacaaaattttgcctgatcttgaatcactccatg

SEQ ID NO: 228687 - DNA, 75 bp, Artificial Sequence
  Synthetic
atcgagggtacagcttcctatccttcttttctgtctctgtttagattattttaatcaccatttaaaattgattta

SEQ ID NO: 228688 - DNA, 75 bp, Artificial Sequence
  Synthetic
ccaagaggggggtggtgattggcctttggcttatcagtgtatatataagattttctacatccttctatcaggtat

SEQ ID NO: 228689 - DNA, 75 bp, Artificial Sequence
  Synthetic
ttggcttatcagtgtatatataagattttctacatccttctatcaggtattctacaagatggcacacggtgagcc

SEQ ID NO: 228690 - DNA, 75 bp, Artificial Sequence
  Synthetic
tacactcttttatcaaatggtgtacaagatggcacacgttgagccatactacagttctaaacctgacaaagattt

SEQ ID NO: 228691 - DNA, 75 bp, Artificial Sequence
  Synthetic
ttttctacatccttctatcaggtattctacaagatggcacacggtgagccatattatagttctaaacctgacaaa

SEQ ID NO: 228692 - DNA, 75 bp, Artificial Sequence
  Synthetic
ttatcattgtatagataagattttctacactcttttatcaaatggtgtacaagatggcacacgttgagccatact

SEQ ID NO: 228693 - DNA, 75 bp, Artificial Sequence
  Synthetic
cacgtaggcaaatgacacctaccatggttacaaaacttcccaagtttgtcaggaattccccacaagtctatgatt

SEQ ID NO: 228694 - DNA, 75 bp, Artificial Sequence
  Synthetic
ggttacaaaacttcccaagtttgtcaggaattccccacaagtctatgattggatcgtaagaggtctaatcttccc

SEQ ID NO: 228695 - DNA, 75 bp, Artificial Sequence
  Synthetic
cgagttgttgtgattactggtgggtttgaggatggaacatatggttcattcgcatttgatggtagagaatgggta

SEQ ID NO: 228696 - DNA, 75 bp, Artificial Sequence
  Synthetic
ttgatggcagagaatgggtggagatctacccaatagagcatctaaacctaatgtcatctttaaagctaatacata

SEQ ID NO: 228697 - DNA, 75 bp, Artificial Sequence
  Synthetic
gtcgggtcaaacaccagtggcaccactgagattgaggcgtgtattctcctcaaccctgtccttgttaaggacgct

SEQ ID NO: 228698 - DNA, 75 bp, Artificial Sequence
  Synthetic
actgggagcactcagtttggccccgtgcaggcgttaggtgcacaatattccatgtggaagctgaagtacctgaat

SEQ ID NO: 228699 - DNA, 75 bp, Artificial Sequence
  Synthetic
aagccacccttactcttgatgtgcaattccttcaacatgaaaacgtacgactgaaggaattgatttcaaaaccag

SEQ ID NO: 228700 - DNA, 75 bp, Artificial Sequence
  Synthetic
catgtggaagctgaagtacctgaatgttaagctaacctctatggttggcgcatctgctgtcaatggtactgtcct

SEQ ID NO: 228701 - DNA, 75 bp, Artificial Sequence
  Synthetic
tgttacggttggtaagaatgcaacatttaaattgaaaccttctgaccttggtggacctagggatggttggtggct

SEQ ID NO: 228702 - DNA, 75 bp, Artificial Sequence
  Synthetic
taagctagatgctgtgaggcaaattcttaatttcgcctttgtacctagggctcattggttaagaactgtcttcta

SEQ ID NO: 228703 - DNA, 75 bp, Artificial Sequence
  Synthetic
gcttgcattagcaaacataaccattagtgacaagctagatgctgtgaggcaaatccttaattttgcttttgtacc

SEQ ID NO: 228704 - DNA, 75 bp, Artificial Sequence
  Synthetic
gggggcctatttttggttgaacttgcttcagagtggtgctttacaggttatgctgcaaatccaaaccttgttaat

SEQ ID NO: 228705 - DNA, 75 bp, Artificial Sequence
  Synthetic
cataccagaacacacagttcacaggaggcctatttttggtggagctttcatcagcatggtgctttactggatatg

SEQ ID NO: 228706 - DNA, 75 bp, Artificial Sequence
  Synthetic
tatctgtaacatttgaaggtagtgctggatcgccattaataatgaatgtgccagagggaagccattttgcccgaa

SEQ ID NO: 228707 - DNA, 75 bp, Artificial Sequence
  Synthetic
cacttgcaacttcccacttgtctggttttaggatggctgttttacccacaattccatttcataccactatgactc

SEQ ID NO: 228708 - DNA, 75 bp, Artificial Sequence
  Synthetic
tggatcgccattaataatgaatgtgccagagggaagccattttgcccgaacagtacttgcgcgctcgactacacc

SEQ ID NO: 228709 - DNA, 75 bp, Artificial Sequence
  Synthetic
agaaccacctcagacacagtatggcaggtgctcaatactgctgtatctgctgctgagcttgtcacacctccgccg

SEQ ID NO: 228710 - DNA, 75 bp, Artificial Sequence
  Synthetic
ggtggttcgtaaaacttattgctggaagaactaggactggcacccgtagcttttatgtgtatcccagctaccaag

SEQ ID NO: 228711 - DNA, 75 bp, Artificial Sequence
  Synthetic
cagcagtattaattgctggtgggcacgcctgtttgacacttacaggaacaaccacgtcattgtttgttgtcatac

SEQ ID NO: 228712 - DNA, 75 bp, Artificial Sequence
  Synthetic
taacttgtaggttcgtgcgtatggcaacgatatttattggcaccagattcgagatccgtgatgccaatgggaagg

SEQ ID NO: 228713 - DNA, 75 bp, Artificial Sequence
  Synthetic
aaagaatgctgcatttgatttcttccagaggctgaaacaatcaggggtgagagttggagtcaacgaatttgttgt

SEQ ID NO: 228714 - DNA, 75 bp, Artificial Sequence
  Synthetic
gcaccagctgcatttgggagatccattccaacacctggggaggagtttaaagttattctcacatttggagcccca

SEQ ID NO: 228715 - DNA, 75 bp, Artificial Sequence
  Synthetic
ttccaacacctggggaggagtttaaagttattctcacatttggagccccaatgagccctaatgcaaacaacaaac

SEQ ID NO: 228716 - DNA, 75 bp, Artificial Sequence
  Synthetic
cacccctgaagggaaaggaacaggtttcttttctggtaacgacatagtaacagcagcacatgtcgttggcaacaa

SEQ ID NO: 228717 - DNA, 75 bp, Artificial Sequence
  Synthetic
caggattcttttctggcaacgacatagtaacagcagcacatgttgttggcaacaatacttttgtgaatgtgtgct

SEQ ID NO: 228718 - DNA, 75 bp, Artificial Sequence
  Synthetic
tgcgccttcgggccattacaatgttaagattgctaaggatgttgatcactatctgaccatgcagggttttacttc

SEQ ID NO: 228719 - DNA, 75 bp, Artificial Sequence
  Synthetic
aagattgctaaggatgttgatcactatctgaccatgcagggttttacttctatagcatctgttgattggtacact

SEQ ID NO: 228720 - DNA, 75 bp, Artificial Sequence
  Synthetic
gaacaccgctcataatgaatgtgccagaacacagccatttcgctagaacagcggtggagcactcttctctgtcca

SEQ ID NO: 228721 - DNA, 75 bp, Artificial Sequence
  Synthetic
ccaggtcacaaccctgttcctagtaaaggtaacaactggattccaggtgaacaactacctgagctacttttacag

SEQ ID NO: 228722 - DNA, 75 bp, Artificial Sequence
  Synthetic
atgtcgggcgcaccagtttgtgataaatatggtcgggtgttggcggtccatcaaactaatactgggtacactgga

SEQ ID NO: 228723 - DNA, 75 bp, Artificial Sequence
  Synthetic
catacacagcagggataagctttacccagggtggatggtatttgttgacaaatacatccattgttgatggggcac

SEQ ID NO: 228724 - DNA, 75 bp, Artificial Sequence
  Synthetic
ccagggtggatggtatttgttgacaaatacatccattgttgatggggcactaccacctggctggatctggaacaa

SEQ ID NO: 228725 - DNA, 75 bp, Artificial Sequence
  Synthetic
ccatctcaggtggaattgctcaaagaggaaatagagcgactaaaagcccaattgaattccgctgctgagaaccca

SEQ ID NO: 228726 - DNA, 75 bp, Artificial Sequence
  Synthetic
aggaaatagagcgactaaaagcccaattgaattccgctgctgagaacccatctactgtcattacacaacaaccta

SEQ ID NO: 228727 - DNA, 75 bp, Artificial Sequence
  Synthetic
acactagaacagaaaagtgttagcgatagtgatgtggttgaccttgtcagaactgcaatggaacgtgagatgaag

SEQ ID NO: 228728 - DNA, 75 bp, Artificial Sequence
  Synthetic
taccacatggacaaaggcctgattcacctgataatgcccttgcctgaatccacacaaatgtgctatgagatgttg

SEQ ID NO: 228729 - DNA, 75 bp, Artificial Sequence
  Synthetic
taacgatagtgatgttgttgaccttgtcaggactgcaatggaacgtgagatgaagatactgcgtgatgaaattaa

SEQ ID NO: 228730 - DNA, 75 bp, Artificial Sequence
  Synthetic
gtcaggactgcaatggaacgtgagatgaagatactgcgtgatgaaattaatggcatacttgcaccatttctacaa

SEQ ID NO: 228731 - DNA, 75 bp, Artificial Sequence
  Synthetic
acctgataatgcccttgcctgaatccacacaaatgtgctatgagatgttgacatctattccacgctccagagcag

SEQ ID NO: 228732 - DNA, 75 bp, Artificial Sequence
  Synthetic
gcaggggtagagtcaggcgtaatcttaggaaaggtgtgaaactccttactgaggaagagtatcgagaacttttag

SEQ ID NO: 228733 - DNA, 75 bp, Artificial Sequence
  Synthetic
gaggtctggctaccctgactatgatgatgaggattattatgatgaagatgatgatggatgggggatggttggtga

SEQ ID NO: 228734 - DNA, 75 bp, Artificial Sequence
  Synthetic
gatgaggattattatgatgaagatgatgatggatgggggatggttggtgatgatgtagaatttgattatactgaa

SEQ ID NO: 228735 - DNA, 75 bp, Artificial Sequence
  Synthetic
ctcgtaaaccaaggaatgacaatgacgcgtgccataaagatagcgaggcgcgcattccccacgcttacagatagg

SEQ ID NO: 228736 - DNA, 75 bp, Artificial Sequence
  Synthetic
cgcgtgccataaagatagcgaggcgcgcattccccacgcttacagataggattaagcgtggagtatacatggacc

SEQ ID NO: 228737 - DNA, 75 bp, Artificial Sequence
  Synthetic
accaaaccaaaaccttgccccgagccagaagctgaaacacaaccacttgatttgtctcagaaaaaagataaacaa

SEQ ID NO: 228738 - DNA, 75 bp, Artificial Sequence
  Synthetic
aaccatactcacaaacttatggtaaggcaccaatatgggaatcttatgattttgactgggatgaggatgatgcca

SEQ ID NO: 228739 - DNA, 75 bp, Artificial Sequence
  Synthetic
ttggcttatcagtgtatagataacatttctctgaccgtttaccacacaattaacaacaatatggcatacggtgag

SEQ ID NO: 228740 - DNA, 75 bp, Artificial Sequence
  Synthetic
ccaagaggggggtggtgattggcctttggcttatcagtgtatagataacatttctctgaccgtttaccacacaat

SEQ ID NO: 228741 - DNA, 75 bp, Artificial Sequence
  Synthetic
aagatttcaattttggaagcacaatggcacgtaggcagatgacacctactatggtaacaaagcttcccaaatttg

SEQ ID NO: 228742 - DNA, 75 bp, Artificial Sequence
  Synthetic
tagttcttggatcaaaaattgtcaagcttaggacgattattgaaacagccataaagacccagaactacagtgcat

SEQ ID NO: 228743 - DNA, 75 bp, Artificial Sequence
  Synthetic
ggcacgtaggcagatgacacctactatggtaacaaagcttcccaaatttgttaggaattctccacaagcttatga

SEQ ID NO: 228744 - DNA, 75 bp, Artificial Sequence
  Synthetic
aataaggccccaaaaaactacaaagggccccagaagaccaaggggcccaaaactaccactcattagatgcatgga

SEQ ID NO: 228745 - DNA, 75 bp, Artificial Sequence
  Synthetic
gagggtttcctccaaagagttaaatcgaaaaataaggctccaaaaaactacaaagggccccagaagaccaagggg

SEQ ID NO: 228746 - DNA, 75 bp, Artificial Sequence
  Synthetic
gcttgaggatggaacatatggctcattcgcatttgacggtaaagagtgggtagggatctacccaatagagcactt

SEQ ID NO: 228747 - DNA, 75 bp, Artificial Sequence
  Synthetic
atacacaaagccaacgctcttcaggagagactgcgtctctcccaagaagagaaagccaccctcgctctggatgtg

SEQ ID NO: 228748 - DNA, 75 bp, Artificial Sequence
  Synthetic
cgggagcggagatgtgtacctgctaacttcccactgttaggccatttaccaattgatagaccaatttttgatgat

SEQ ID NO: 228749 - DNA, 75 bp, Artificial Sequence
  Synthetic
acttcccactgttaggccatttaccaattgatagaccaatttttgatgataagaaacctagggatgatctccttg

SEQ ID NO: 228750 - DNA, 75 bp, Artificial Sequence
  Synthetic
gattgaaggagatgatcccaaagccagagccacggaaaatacagatgaagtggataataatgggagcagtgctta

SEQ ID NO: 228751 - DNA, 75 bp, Artificial Sequence
  Synthetic
gggcccacaagcttttgttaaatcttttgacaaatttttttatgcagaaccaactgactttttctcagaacatcc

SEQ ID NO: 228752 - DNA, 75 bp, Artificial Sequence
  Synthetic
agagccacggaaaatacagatgaagtggataataatgggagcagtgcttacattcttatctctgatacctggggg

SEQ ID NO: 228753 - DNA, 75 bp, Artificial Sequence
  Synthetic
accatatttactgacatgatagctgcctgcaagtactcaactgagacactaacagaaaatcttgaccttagaatc

SEQ ID NO: 228754 - DNA, 75 bp, Artificial Sequence
  Synthetic
cctgcaagtactcaactgagacactaacagaaaatcttgaccttagaatcaagcttgcactagcaaacataacca

SEQ ID NO: 228755 - DNA, 75 bp, Artificial Sequence
  Synthetic
gtatctagaggatactagagtgatacatataactgcaactgagaaaaacactgattctacacccgcatatccaaa

SEQ ID NO: 228756 - DNA, 75 bp, Artificial Sequence
  Synthetic
catataactgcaactgagaaaaacactgattctacacccgcatatccaaaaatgaattattttgacactgaagag

SEQ ID NO: 228757 - DNA, 75 bp, Artificial Sequence
  Synthetic
attgggcgacttatcgcgaattccggtatctagaggatactagagtgatacatataactgcaactgagaaaaaca

SEQ ID NO: 228758 - DNA, 75 bp, Artificial Sequence
  Synthetic
gcaaattcttaactttgcctttgtgcccagagcccattggttgagaactgtgttctattatatccattactatga

SEQ ID NO: 228759 - DNA, 75 bp, Artificial Sequence
  Synthetic
caccatacataagagaatttactagggtcttcaaaggagataaacctgaagtactttggtacctattcctcaaga

SEQ ID NO: 228760 - DNA, 75 bp, Artificial Sequence
  Synthetic
ggtcttcaaaggagataaacctgaagtactttggtacctattcctcaagaaagagatcatcaaggaggaaaaaat

SEQ ID NO: 228761 - DNA, 75 bp, Artificial Sequence
  Synthetic
tacacttgcaacatcccacttgtctggttttaggatggctgtcctacccacaattccatttcacaccactatgac

SEQ ID NO: 228762 - DNA, 75 bp, Artificial Sequence
  Synthetic
gtgtgtgccgaccccatctataccaggataggggcgtgcctagaggcacatcagaatgccctaatgaaacaacat

SEQ ID NO: 228763 - DNA, 75 bp, Artificial Sequence
  Synthetic
ggataggggcgtgcctagaggcacatcagaatgccctaatgaaacaacataccgaaacctcggttggtcaatgcg

SEQ ID NO: 228764 - DNA, 75 bp, Artificial Sequence
  Synthetic
tttgtgggttatgaacacacttatggtttgttattattttgacaacttgctagcaataacattggcaatcttagc

SEQ ID NO: 228765 - DNA, 75 bp, Artificial Sequence
  Synthetic
cacctcagttggccaatgtgggtggtcaccaatggaaggcggctttaaaaaaactatgcagcgcctagtaaataa

SEQ ID NO: 228766 - DNA, 75 bp, Artificial Sequence
  Synthetic
taagaaaacaatgcaacgcctagtaaacaaaggaaataaatacttcattgagtttgactggacccgctatgatgg

SEQ ID NO: 228767 - DNA, 75 bp, Artificial Sequence
  Synthetic
aacaaaggaaataaatacttcattgagtttgactggacccgctatgatggaactataccaccatcactttttagg

SEQ ID NO: 228768 - DNA, 75 bp, Artificial Sequence
  Synthetic
catgcatgtttgacactcacaggcacgaccacgtcattgtttgttgtcatactaacctgtaggttcatacgtatg

SEQ ID NO: 228769 - DNA, 75 bp, Artificial Sequence
  Synthetic
tcataaataaagaccaacgtgagaagtatagacatgtacatgaatggtatgttgataacctcctcaaccgtcatg

SEQ ID NO: 228770 - DNA, 75 bp, Artificial Sequence
  Synthetic
cgaccacgtcattgtttgttgtcatactaacctgtaggttcatacgtatggcaactgttttcattggcaccaggt

SEQ ID NO: 228771 - DNA, 75 bp, Artificial Sequence
  Synthetic
gtatagacatgtacatgaatggtatgttgataacctcctcaaccgtcatgtgcttctaccatctggtgaagtcac

SEQ ID NO: 228772 - DNA, 75 bp, Artificial Sequence
  Synthetic
ggttgtggccactgtaccaactaggattaaaaatgttgcatttgacttttttcagaagctgaagcagtcaggggt

SEQ ID NO: 228773 - DNA, 75 bp, Artificial Sequence
  Synthetic
ggacaattttcaactacaatggataataacatgattaacttctggttacaggcttttgagtttgcttactttaat

SEQ ID NO: 228774 - DNA, 75 bp, Artificial Sequence
  Synthetic
ttgagtttgcttatttcaatggcccagacaaagacctttggaagacctatgacactgtagtttatggggatgaca

SEQ ID NO: 228775 - DNA, 75 bp, Artificial Sequence
  Synthetic
gcgagttggagtcaacgaattcgttgtcataaaaccaggtgcattatgtgttatagacacccctgaaggaaaagg

SEQ ID NO: 228776 - DNA, 75 bp, Artificial Sequence
  Synthetic
ataacatgattaacttctggttacaggcttttgagtttgcttactttaatggcccaaacaaggacctttggaaga

SEQ ID NO: 228777 - DNA, 75 bp, Artificial Sequence
  Synthetic
tgatagactctccactacaccttcagtgccagaaaattatgaagaaagagtgatcgacatgtacagggatatttt

SEQ ID NO: 228778 - DNA, 75 bp, Artificial Sequence
  Synthetic
atagtaacagcagcacatgttgttggcaataatacttttgtgaatgtgtgctatgagggtttgatgtatgaagcg

SEQ ID NO: 228779 - DNA, 75 bp, Artificial Sequence
  Synthetic
gtgatttgtagagagagtatagttgggctatcattttgtggattcacagtcaacgcagacctagaacctgtacca

SEQ ID NO: 228780 - DNA, 75 bp, Artificial Sequence
  Synthetic
ggctatcattttgtggattcacagtcaacgcagacctagaacctgtaccaacctcaccagaaaaactgatggcat

SEQ ID NO: 228781 - DNA, 75 bp, Artificial Sequence
  Synthetic
gttgtgtcacagttatggcttatgtgaatgaggatcttgtggtttcaaccgcagcagctatggtgcatggcaaca

SEQ ID NO: 228782 - DNA, 75 bp, Artificial Sequence
  Synthetic
acctgacttagaatcactccatgggaagctcctatgctaccagttgcttgctgcgttcatggcagaagatcatcc

SEQ ID NO: 228783 - DNA, 75 bp, Artificial Sequence
  Synthetic
ggacgggatgtcgggtgcaccagtctgtgacaaatatggtcgggtgttagcagtccatcaaacaaacactgggta

SEQ ID NO: 228784 - DNA, 75 bp, Artificial Sequence
  Synthetic
ctgtcacggactgctaagcagcttcgtgattctggcctcccggccagactcacagaagagcaactccatcgcatt

SEQ ID NO: 228785 - DNA, 75 bp, Artificial Sequence
  Synthetic
cactggaggtgctgtcataatagacccagcagacttccatccagtgaaagccccatctcaggtggaattgctcaa

SEQ ID NO: 228786 - DNA, 75 bp, Artificial Sequence
  Synthetic
gttgaggtcaataacaatggccgaagcaggagcaaatccagagctcgatctcaatctagaggtcgaggcagatca

SEQ ID NO: 228787 - DNA, 75 bp, Artificial Sequence
  Synthetic
atggctagcaagcccagcaaacaggtaactgttgaggtcaataatggccgaagcaggagcagatctaggcctcga

SEQ ID NO: 228788 - DNA, 75 bp, Artificial Sequence
  Synthetic
ccccatctcaggtggaattgctcaaagaggaaatagagcggctaaaagctcaactgaactctgccactgagaacg

SEQ ID NO: 228789 - DNA, 75 bp, Artificial Sequence
  Synthetic
cagtcaagattactgttaattccagaaacaaaggtagaagacaaaacggacgcaacaaacatcaatctaatcaac

SEQ ID NO: 228790 - DNA, 75 bp, Artificial Sequence
  Synthetic
gtcagcgatagtgatgtagttgaccttgtcagaactgcaatggaacgtgagatgaaggtgctgcgtgatgaaatc

SEQ ID NO: 228791 - DNA, 75 bp, Artificial Sequence
  Synthetic
tagtgctgcactagaacagaaaagtgtcagcgatagtgatgtagttgaccttgtcagaactgcaatggaacgtga

SEQ ID NO: 228792 - DNA, 75 bp, Artificial Sequence
  Synthetic
actcaggaaacagggtgtcacaggaccaaaaccagcaatatgtcagcgagcaacagcaacgctcggaactgtcgg

SEQ ID NO: 228793 - DNA, 75 bp, Artificial Sequence
  Synthetic
aaaaaaagaaaggtaagaccaagcatggtaggggtagagtcaggcgtaaccttagaaaaggtgtgaaacttctta

SEQ ID NO: 228794 - DNA, 75 bp, Artificial Sequence
  Synthetic
tggtaggggtagagtcaggcgtaaccttagaaaaggtgtgaaacttcttaccgaggaagagtatcgagaactctt

SEQ ID NO: 228795 - DNA, 75 bp, Artificial Sequence
  Synthetic
attgaggcgtgtattctcctcaatccggtacttgttaaggatgctacagggagtactcaatttgggccagtgcaa

SEQ ID NO: 228796 - DNA, 75 bp, Artificial Sequence
  Synthetic
cggtacttgttaaggatgctacagggagtactcaatttgggccagtgcaagcgctaggagcgcaatattcaatgt

SEQ ID NO: 228797 - DNA, 75 bp, Artificial Sequence
  Synthetic
agagaaaggtcttgatcgtgagacattccttgatctcatagaccgcattattggtgagaggtctggctaccctga

SEQ ID NO: 228798 - DNA, 75 bp, Artificial Sequence
  Synthetic
ttggtgagaggtctggctaccctgactatgatgatgaagattactatgatgaagatgatgatggctggggaatgg

SEQ ID NO: 228799 - DNA, 75 bp, Artificial Sequence
  Synthetic
gcttacctctatggttggatcctctgcagtcaatggcactgtagtaagagtatctttaaatccaacatctacacc

SEQ ID NO: 228800 - DNA, 75 bp, Artificial Sequence
  Synthetic
ttggtgatgatgtagaatttgattatactgaagtaattaactttgaccaagcaaaaccaattcctgccccgagaa

SEQ ID NO: 228801 - DNA, 75 bp, Artificial Sequence
  Synthetic
gcagtcaatggcactgtagtaagagtatctttaaatccaacatctacaccttcttccactagctggtctggcttg

SEQ ID NO: 228802 - DNA, 75 bp, Artificial Sequence
  Synthetic
accagaagtcgaatcacaaccacttgatttgtcccaaaagaaagaaaaacaatcagaatatgaacaacaagtggt

SEQ ID NO: 228803 - DNA, 75 bp, Artificial Sequence
  Synthetic
cagttggcaagaatgctgtgtttaagttgaagccagctgatctgggcggccctagagatggttggtggttaacaa

SEQ ID NO: 228804 - DNA, 75 bp, Artificial Sequence
  Synthetic
acaaatgataatgcttcagacacacttggtccatctatagaaatacatacattgggtcaaactatgtcatcttac

SEQ ID NO: 228805 - DNA, 75 bp, Artificial Sequence
  Synthetic
gttgaagccagctgatctgggcggccctagagatggttggtggttaacaaacactaatgacaatgcttctgatac

SEQ ID NO: 228806 - DNA, 75 bp, Artificial Sequence
  Synthetic
gaacatgaacaacaagtggtgaagcctatcaagcctcagaagagtgagcctcaaccatactcacaaacttacggc

SEQ ID NO: 228807 - DNA, 75 bp, Artificial Sequence
  Synthetic
ctatcaagcctcagaagagtgagcctcaaccatactcacaaacttacggcaaggcaccaatctgggaatcttacg

SEQ ID NO: 228808 - DNA, 75 bp, Artificial Sequence
  Synthetic
actttgggtagaactatgtcatcctatcaaaaccagcaatttactggagggctgtttcttgtggagcttgcctct

SEQ ID NO: 228809 - DNA, 75 bp, Artificial Sequence
  Synthetic
atcaaaaccagcaatttactggagggctgtttcttgtggagcttgcctctgagtggtgctttacaggctatgctg

SEQ ID NO: 228810 - DNA, 75 bp, Artificial Sequence
  Synthetic
tcaaccatactcacaaacttacggcaaggcaccaatctgggaatcttacgattttgactgggatgaggatgatgc

SEQ ID NO: 228811 - DNA, 75 bp, Artificial Sequence
  Synthetic
gaagtcgactgacaaacaagtcaatgtcactttcaatggctcggctggggagccactggtaatgagtgtacctgc

SEQ ID NO: 228812 - DNA, 75 bp, Artificial Sequence
  Synthetic
tccttggatccaaaatcgtcaagcttagaacgattattgaaacagccataaagactcagaattatagtgcattac

SEQ ID NO: 228813 - DNA, 75 bp, Artificial Sequence
  Synthetic
gtcactttcaatggctcggctggggagccactggtaatgagtgtacctgcaacaagccactttgttcgcgcagtc

SEQ ID NO: 228814 - DNA, 75 bp, Artificial Sequence
  Synthetic
ggaacattcctccctgtccacttccctttcgagggctggtggtgagtcatcatctgacactgtttggcaagtctt

SEQ ID NO: 228815 - DNA, 75 bp, Artificial Sequence
  Synthetic
ccttagcacgggctggggagagaacaacatctgacactgtctggcaggtacttaacaccgccgtgtctgccgctg

SEQ ID NO: 228816 - DNA, 75 bp, Artificial Sequence
  Synthetic
agcagcttatgaagcaggtttggaaggttttctccaaagggttaaatcgaaaaacaaggccccaaaaaactacaa

SEQ ID NO: 228817 - DNA, 75 bp, Artificial Sequence
  Synthetic
aacatctgacactgtctggcaggtacttaacaccgccgtgtctgccgctgaattagtcactcctccaccattcaa

SEQ ID NO: 228818 - DNA, 75 bp, Artificial Sequence
  Synthetic
tttgttaagctgattgcaggtagaacaaggaatggtacgcgcagtttctatgtgtatccaagctatcaggatgca

SEQ ID NO: 228819 - DNA, 75 bp, Artificial Sequence
  Synthetic
cgcactggtgcgcgtaggttctatgtttaccctagctaccaggatgctctatccaacaagcctgccctttgcacc

SEQ ID NO: 228820 - DNA, 75 bp, Artificial Sequence
  Synthetic
ctggtgggctacctagtggactgagagcagcatctgcagttgccacaactttgcagttcacccagatgaatcaac

SEQ ID NO: 228821 - DNA, 75 bp, Artificial Sequence
  Synthetic
tggggcccacaagcttttatcaaatcttttgataaatttttttatgcagaaccaattgactttttctcagaatat

SEQ ID NO: 228822 - DNA, 75 bp, Artificial Sequence
  Synthetic
agcaacgttgggtaggtctattgctacagctggcgaccgtcttaaagtaattctcactgtgggtcagccagtgac

SEQ ID NO: 228823 - DNA, 75 bp, Artificial Sequence
  Synthetic
cttttgataaatttttttatgcagaaccaattgactttttctcagaatatccacagttgtgtgctttcgctgatt

SEQ ID NO: 228824 - DNA, 75 bp, Artificial Sequence
  Synthetic
ttctcactgtgggtcagccagtgacacccaatgaaaacaacaaacaaacctgggttgggaagacaaatacaccta

SEQ ID NO: 228825 - DNA, 75 bp, Artificial Sequence
  Synthetic
gtgataaatatggtcgggtgttggcagtccatcaaactaatactgggtacactggaggtgctgttataatagacc

SEQ ID NO: 228826 - DNA, 75 bp, Artificial Sequence
  Synthetic
ataactgcaactgagaaaaacactgattcaacacctgcttatcctaaaatgaattattttgacactgaagaaaat

SEQ ID NO: 228827 - DNA, 75 bp, Artificial Sequence
  Synthetic
aaacactcagaactacaatgtcatgaatggctttaccatgatatccagtatagactggtatgatgaggaaatgca

SEQ ID NO: 228828 - DNA, 75 bp, Artificial Sequence
  Synthetic
agcctggaatggctaacacccaacctgcaagaatctcaggaaccaccatctatcccagagttgggtgtttatgtt

SEQ ID NO: 228829 - DNA, 75 bp, Artificial Sequence
  Synthetic
aatggctttaccatgatatccagtatagactggtatgatgaggaaatgcagcccctggaggttcctgtaccgatg

SEQ ID NO: 228830 - DNA, 75 bp, Artificial Sequence
  Synthetic
ggcatacataagaaagcactagtgtattttatgcagcaatatgtaaacccacatactaataacaaacaccaggtt

SEQ ID NO: 228831 - DNA, 75 bp, Artificial Sequence
  Synthetic
tcaacaagaaggcagatgtatacgctgcacaacaatacaagaactctatcagtaataataagcaccaaataacta

SEQ ID NO: 228832 - DNA, 75 bp, Artificial Sequence
  Synthetic
tgcacaacaatacaagaactctatcagtaataataagcaccaaataactagtgtctatctggttagagttaaaga

SEQ ID NO: 228833 - DNA, 75 bp, Artificial Sequence
  Synthetic
agttacttctttagagagaaggttgacactactgcaactgaacttatgaagattagacctcaaacatattataca

SEQ ID NO: 228834 - DNA, 75 bp, Artificial Sequence
  Synthetic
gattagacctcaaacatattatacaactgtcaattttgtccagaataattggtatctcttgactagtacagtctt

SEQ ID NO: 228835 - DNA, 75 bp, Artificial Sequence
  Synthetic
tgggtttggatgaaccaggaactcatgaataatgagaactacattgttgaccagggcatgaagcatcttatgact

SEQ ID NO: 228836 - DNA, 75 bp, Artificial Sequence
  Synthetic
actttgagatgcttacttctttgccacaggctatggcagaacactttgatcaaggtgatcaagcagtagtagctc

SEQ ID NO: 228837 - DNA, 75 bp, Artificial Sequence
  Synthetic
tagtgctgaagagacagatagtgactttgagagtaccgaggacgaaaccgatgaagtggacaggtttgatctcca

SEQ ID NO: 228838 - DNA, 75 bp, Artificial Sequence
  Synthetic
ttatgagacagattctctagaggatgaatcagatgatgaagacacttatacaaacagagagcttgttattaacac

SEQ ID NO: 228839 - DNA, 75 bp, Artificial Sequence
  Synthetic
atgaagtggacaggtttgatctccatctctcttctgagtcagatgacgatgatgttgagaacaaccgtgtaaccc

SEQ ID NO: 228840 - DNA, 75 bp, Artificial Sequence
  Synthetic
gaatcagatgatgaagacacttatacaaacagagagcttgttattaacactctagtcaatcagggcattagtaag

SEQ ID NO: 228841 - DNA, 75 bp, Artificial Sequence
  Synthetic
aatgtcagtggagcgcgccacaagaatcaccagcaacgcgttcccaacacgcgccgctagattgaggcgcagtgt

SEQ ID NO: 228842 - DNA, 75 bp, Artificial Sequence
  Synthetic
catgtgggttaagcctgggaaggttatctgtagagacagcatagttggattgtccttttgtggcttcactgttaa

SEQ ID NO: 228843 - DNA, 75 bp, Artificial Sequence
  Synthetic
cttggtccagatgcagcatggtcccatgcgtgcgaacaagcacgcaaagtaggtgataatcatgacctacaagct

SEQ ID NO: 228844 - DNA, 75 bp, Artificial Sequence
  Synthetic
acgccgagtaggatcgagggtacagctcccattcttttctgtctctgtttagatgattttaatcaacatttaaaa

SEQ ID NO: 228845 - DNA, 75 bp, Artificial Sequence
  Synthetic
acagcttcctttttctcttttctgtctctgtttagattattttaatcaacatttaaaattgatttaatcagatgc

SEQ ID NO: 228846 - DNA, 75 bp, Artificial Sequence
  Synthetic
cagcaggagtaaatcaagggcccgttcacaatctaggggccgagacaaatcagtcaagatcacagtcaattcaag

SEQ ID NO: 228847 - DNA, 75 bp, Artificial Sequence
  Synthetic
gcgctaggtgcacagtattccatgtggaagttgaagtatttgaatgtcaaattgacctctatggttggtgcatct

SEQ ID NO: 228848 - DNA, 75 bp, Artificial Sequence
  Synthetic
gctgttaatggtactgtctcaggggtctcacttaaccccactaccacgcctacttctactagttggtcaggatta

SEQ ID NO: 228849 - DNA, 75 bp, Artificial Sequence
  Synthetic
cgtgaggcaaattcttaattttgcctttgtacctagagctcattggttaaggactgtcttctattacatccatta

SEQ ID NO: 228850 - DNA, 75 bp, Artificial Sequence
  Synthetic
ttatgaaatgtggaatatttttatgtttgttcttgcaattggcactgtcatgaggagcgcccgccctggtacaga

SEQ ID NO: 228851 - DNA, 75 bp, Artificial Sequence
  Synthetic
gagtggtgcttcacaggttatgctgccaacccaaaccttgttaacttggtcaagtcaacagataatcaagtatct

SEQ ID NO: 228852 - DNA, 75 bp, Artificial Sequence
  Synthetic
caccattaataatgaatgtgccagaggggagccattttgcacgaacagttcttgcacgctcaacaacacccacca

SEQ ID NO: 228853 - DNA, 75 bp, Artificial Sequence
  Synthetic
cacctcagacacagtatggcaggtgctcaatacagctgtatctgctgctgagcttgtcacgcctcctccattcaa

SEQ ID NO: 228854 - DNA, 75 bp, Artificial Sequence
  Synthetic
ctctctcatatgcagttcgcacccaagacgggatgtcgggtgcaccagtttgtgacaaatatggtcgggtattgg

SEQ ID NO: 228855 - DNA, 75 bp, Artificial Sequence
  Synthetic
ccagatttgagatccgtgatgctaatgggaaggtcgttgctactgtaccaactaggatcaaaaatgttgcatttg

SEQ ID NO: 228856 - DNA, 75 bp, Artificial Sequence
  Synthetic
actaggatcaaaaatgttgcatttgacttcttccagaagctaaaacagtcaggggtaagggttggagtcaacgaa

SEQ ID NO: 228857 - DNA, 75 bp, Artificial Sequence
  Synthetic
tttgtagtcataaaaccaggtgcattatgtgttatagacacacctgaaggaaaagggacaggtttcttttccggc

SEQ ID NO: 228858 - DNA, 75 bp, Artificial Sequence
  Synthetic
gaagcgaaggttcggtacatgcccgaaaaggacatagcattcataacttgtcctggtgacttgcatccaacagca

SEQ ID NO: 228859 - DNA, 75 bp, Artificial Sequence
  Synthetic
ttttcaaccatctgaggcccctgccccaatacaaggcctgcaggtacttgtgaacagctcgaaaaaagctgatgt

SEQ ID NO: 228860 - DNA, 75 bp, Artificial Sequence
  Synthetic
ccaatacaaggcctgcaggtacttgtgaacagctcgaaaaaagctgatgtgtatgccatcaaacaatttgttaca

SEQ ID NO: 228861 - DNA, 75 bp, Artificial Sequence
  Synthetic
ttacaagcctgttcctagtaaaagtgacaactggttttcaggtgaacaactacctgagttacttttacagggcgt

SEQ ID NO: 228862 - DNA, 75 bp, Artificial Sequence
  Synthetic
gtggatggtatttgttgacaaatacatctattgttgatggggctatgccacctggttgggtctggaataacgtgg

SEQ ID NO: 228863 - DNA, 75 bp, Artificial Sequence
  Synthetic
catggacaaaggcttggtccatttaataatgcctttgcctgagtccacgcaaatgtgttatgagatgctgacatc

SEQ ID NO: 228864 - DNA, 75 bp, Artificial Sequence
  Synthetic
catggttatgagagtgacaacaccgaatacttggatgctccagactctgctgaccagtttaaagaagacatagag

SEQ ID NO: 228865 - DNA, 75 bp, Artificial Sequence
  Synthetic
aatacttggatgctccagactctgctgaccagtttaaagaagacatagagacagatacagacattgagagtacag

SEQ ID NO: 228866 - DNA, 75 bp, Artificial Sequence
  Synthetic
tccttactgaggaagagtatagagaactcttagagaaaggtctagatcgtgaaacattccttgatctcatagacc

SEQ ID NO: 228867 - DNA, 75 bp, Artificial Sequence
  Synthetic
ccacgctttccgataggatcaagcgtggagtatacatggacctgcttgtctcgggggcaagcccaggcaatgcat

SEQ ID NO: 228868 - DNA, 75 bp, Artificial Sequence
  Synthetic
aagattatttggaagcacatgggtgggcaccatacataagagaattcactagggtctttaaaggagacaaacctg

SEQ ID NO: 228869 - DNA, 75 bp, Artificial Sequence
  Synthetic
caagaggggggtggtgattggcctttggcttatcattgtatagataagattttctacactctttcatcaaatagt

SEQ ID NO: 228870 - DNA, 75 bp, Artificial Sequence
  Synthetic
tactatagttctaaacctgacaaagatttcaattttgggagcacaatggcacgtagacaaatgacaactaccatg

SEQ ID NO: 228871 - DNA, 75 bp, Artificial Sequence
  Synthetic
caagcttttgagtttgcttatttcaatggtccagataaagatctctggaagacttatgatactgtggtctatgga

SEQ ID NO: 228872 - DNA, 75 bp, Artificial Sequence
  Synthetic
agatctacccaatagagcatataaacctaatgtcatctctaaagctaatacataaagtcaatgctcttcaggaga

SEQ ID NO: 228873 - DNA, 75 bp, Artificial Sequence
  Synthetic
agccacccttgctcttgatgtgcagttccttcagcatgaaaacgtgcgactgaaggaattgattccaaaaccaga

SEQ ID NO: 228874 - DNA, 75 bp, Artificial Sequence
  Synthetic
tgctcaaggccaaaccaataacactatatttacagacatgatagctgcctgcaaatattcaactgagacattgac

SEQ ID NO: 228875 - DNA, 75 bp, Artificial Sequence
  Synthetic
gaatttcggtatctagaggatactagagtgatacacataactgcaactgagaaaaatactgattcaacacctgct

SEQ ID NO: 228876 - DNA, 75 bp, Artificial Sequence
  Synthetic
ggccgcaacaggagcaaatcaagagcccgctcgcaatctagagggcgggacagatcagttaaaatcacagttaat

SEQ ID NO: 228877 - DNA, 75 bp, Artificial Sequence
  Synthetic
ttcactagagttttcaaaggagacaaacctgaagtactttggtatctatttcttaagaaagaaatcattaaggag

SEQ ID NO: 228878 - DNA, 75 bp, Artificial Sequence
  Synthetic
tttaggatggctgttttacccacaattccattccacactactatgactttatgggtcatgaacacacttatggtc

SEQ ID NO: 228879 - DNA, 75 bp, Artificial Sequence
  Synthetic
ttacaccagaataggggcgtgcttagaggcacatcagaatgctttgatgaaacagcatactgatacttcagttgg

SEQ ID NO: 228880 - DNA, 75 bp, Artificial Sequence
  Synthetic
caataacaatggcaatcttagcaccaattcttggcatcatcttcttgtgcttcatggaagactccaattatgtga

SEQ ID NO: 228881 - DNA, 75 bp, Artificial Sequence
  Synthetic
tatgatggaactataccaccagcactcttcaaacacatcaaagaaattaggtggaatttcatcaataaagaccaa

SEQ ID NO: 228882 - DNA, 75 bp, Artificial Sequence
  Synthetic
cgagtatgagaaatgttggtcttgatgaggatcagaccgataattggcaagaaccagatgaagatctccagacct

SEQ ID NO: 228883 - DNA, 75 bp, Artificial Sequence
  Synthetic
cgtgaaaagtacagacatgttcatgaatggtatgttgataacctccttaatcgccatgtacttctaccatctggt

SEQ ID NO: 228884 - DNA, 75 bp, Artificial Sequence
  Synthetic
acagtttttattggtactagatttgagatccgtgatgctaatgggaaggttgtggccactgtaccaactaggatc

SEQ ID NO: 228885 - DNA, 75 bp, Artificial Sequence
  Synthetic
aagaatgttgcatttgatttcttccagaagctgaaacaatcaggggtgagagttggagttaatgacttcgtagtc

SEQ ID NO: 228886 - DNA, 75 bp, Artificial Sequence
  Synthetic
tatagttggattatccttttgtggctttactgttaatgaaaaccttgagcccgtgccaacttctcctgaaaagtt

SEQ ID NO: 228887 - DNA, 75 bp, Artificial Sequence
  Synthetic
ctgtcaaagaatccagattatggctgtgtcacagttatggcttatatgaatgaagatcttgtggtttcaactgca

SEQ ID NO: 228888 - DNA, 75 bp, Artificial Sequence
  Synthetic
tccatcaaaccaatactgggtacactggaggcgctgtcataatagacccgacagatttccatccagtgaaggccc

SEQ ID NO: 228889 - DNA, 75 bp, Artificial Sequence
  Synthetic
tagagacagacacagacattgagagtacagaggacgaagacgatgaagcggacaggtttgacatcatagacactt

SEQ ID NO: 228890 - DNA, 75 bp, Artificial Sequence
  Synthetic
tgcttgcttcgggggcaagcccaggcaatgcatggtcccatgcgtgtgaagaagcacgcaaagcagcaggggaaa

SEQ ID NO: 228891 - DNA, 75 bp, Artificial Sequence
  Synthetic
ccaagaggggggtggtgattggcctttggcttatcagtgtatgtataagacttctcctatacttctatcgtatat

SEQ ID NO: 228892 - DNA, 75 bp, Artificial Sequence
  Synthetic
aggaaaggtgtgaaacttcttaccgaggaagagtatcgagagctcttagagaaaggtcttgatcgtgaaacattc

SEQ ID NO: 228893 - DNA, 75 bp, Artificial Sequence
  Synthetic
cttgatctcatagaccgtatcattggtgagaggtctggctaccctgactatgatgatgaggattattatgatgaa

SEQ ID NO: 228894 - DNA, 75 bp, Artificial Sequence
  Synthetic
gtattccatgtggaaactgaagtatctgaatgtcaaactgacttctatggttggtgcgtctgccgttaatggcac

SEQ ID NO: 228895 - DNA, 75 bp, Artificial Sequence
  Synthetic
agaaatcgaggcacaaccacttgatctgtctcagaaggaagaaaaacaaccagaacatgagcaacaagtggcgaa

SEQ ID NO: 228896 - DNA, 75 bp, Artificial Sequence
  Synthetic
atctcatgtcatctttgaaactgatacacaaagccaatgctcttcaggagagactacgtctctcccaagaagaga

SEQ ID NO: 228897 - DNA, 75 bp, Artificial Sequence
  Synthetic
gcatctgacaccctgggaccctccattgaaatacacacactcggacggacaatgtcctcatacaagaatgagcag

SEQ ID NO: 228898 - DNA, 75 bp, Artificial Sequence
  Synthetic
gtaaggcaccaatatgggaatcttatgattttgactgggatgaggatgatgccaagtttatcctaccagcgcctc

SEQ ID NO: 228899 - DNA, 75 bp, Artificial Sequence
  Synthetic
cttagaacgattattgaaacagccataaagacccagaactacagtgcattacctgaagctgtatttgagctcgac

SEQ ID NO: 228900 - DNA, 75 bp, Artificial Sequence
  Synthetic
catattcacagacatgatagctgcctgcaagtattcaactgagtcattgacagaaaatcttgaccttagaatcaa

SEQ ID NO: 228901 - DNA, 75 bp, Artificial Sequence
  Synthetic
tgcaagtattcaactgagtcattgacagaaaatcttgaccttagaatcaagcttgctctagcaaacataactatt

SEQ ID NO: 228902 - DNA, 75 bp, Artificial Sequence
  Synthetic
aaggcttcctccaaagggttaaatcaaaaaacaaggccccaaaaaactacaaagggccccagaagaccaaggggc

SEQ ID NO: 228903 - DNA, 75 bp, Artificial Sequence
  Synthetic
aaagggccccagaagaccaaggggcccaaaactaccactcattagatgcatggaaatcactactagaacctccgc

SEQ ID NO: 228904 - DNA, 75 bp, Artificial Sequence
  Synthetic
aaattattaatttcgcctttgtacctagaacacattggttaagaactgtcttctattacatccattattatgaaa

SEQ ID NO: 228905 - DNA, 75 bp, Artificial Sequence
  Synthetic
tagaacacattggttaagaactgtcttctattacatccattattatgaaatgtggaacatctttatgtttgtcct

SEQ ID NO: 228906 - DNA, 75 bp, Artificial Sequence
  Synthetic
tttcccattattaggtcatttaccaatcaatagacccatttatgatgataagaaacccagagatgatctccttgg

SEQ ID NO: 228907 - DNA, 75 bp, Artificial Sequence
  Synthetic
gcccgtcctggcacagacttaatcacacttgcaacgtcacacttatctggttttaggatggctgttttgcccaca

SEQ ID NO: 228908 - DNA, 75 bp, Artificial Sequence
  Synthetic
atccgcagttgtgtgtcttcgcggattgggcaacctatcgcgagtttcggtacctagaggatactagagtaatac

SEQ ID NO: 228909 - DNA, 75 bp, Artificial Sequence
  Synthetic
cgcctgcttgacacttacaggcacaaccacgtcattattcgttgtcatactaacctgtagattcattcgtatggc

SEQ ID NO: 228910 - DNA, 75 bp, Artificial Sequence
  Synthetic
gagatccgtgatgctaatggaaaggtcgtagctactgtaccaaccagaattaaaaatgtggcatttgactttttc

SEQ ID NO: 228911 - DNA, 75 bp, Artificial Sequence
  Synthetic
taaaaatgtggcatttgactttttccagaagctaaaacagtcaggtgtgagggttggagtcaatgaattcgttgt

SEQ ID NO: 228912 - DNA, 75 bp, Artificial Sequence
  Synthetic
agtaacagcagcacatgtcgttggcaataacacttttgtcaatgtgtgctatgagggcctaatgtacgaagcgaa

SEQ ID NO: 228913 - DNA, 75 bp, Artificial Sequence
  Synthetic
gagatacatacacagcagggataagttttacccagggtggatggtatttgttgacaaatacatctattgttgatg

SEQ ID NO: 228914 - DNA, 75 bp, Artificial Sequence
  Synthetic
atagcattcataacctgtcctggtgacttgcatccaacagcaagattaaagttatcaaagaacccagattacagt

SEQ ID NO: 228915 - DNA, 75 bp, Artificial Sequence
  Synthetic
acttgcatccaacagcaagattaaagttatcaaagaacccagattacagttgtgtcacagttatggcctatgtga

SEQ ID NO: 228916 - DNA, 75 bp, Artificial Sequence
  Synthetic
ggtgattttgggggctgtgcttacgtttctatcattaatacctggtggatatgcgcatagtcatcagaataaaac

SEQ ID NO: 228917 - DNA, 75 bp, Artificial Sequence
  Synthetic
tggtccatctaataatgcctttacctgagtctacgcaaatgtgttatgagatgctgacatctattccacgctcca

SEQ ID NO: 228918 - DNA, 75 bp, Artificial Sequence
  Synthetic
actcttaccatccggtgaagtcaccttgcagacacggggcaatccatctgggcagttttcaacaacgatggataa

SEQ ID NO: 228919 - DNA, 75 bp, Artificial Sequence
  Synthetic
agctgctatggtccatggcaatacgctctcatatgcagtccgcactcaagatgggatgtcgggtgcaccagtttg

SEQ ID NO: 228920 - DNA, 75 bp, Artificial Sequence
  Synthetic
ctctcatatgcagtccgcactcaagatgggatgtcgggtgcaccagtttgtgacaaatatggtcgtgtgttggca

SEQ ID NO: 228921 - DNA, 75 bp, Artificial Sequence
  Synthetic
ctggaggtgctgttataatagatccagcggatttccatccagtgaaggcaccatctcaagtggaattgctcaaag

SEQ ID NO: 228922 - DNA, 75 bp, Artificial Sequence
  Synthetic
gcccagacaaagatctttggaagacctatgacactgtagtttatggggatgacaggctttctacaacaccctcgg

SEQ ID NO: 228923 - DNA, 75 bp, Artificial Sequence
  Synthetic
attgaattccactgctgcgaacccaacggctgccgttacgcagcaacctatcgccacactagaacagaaaaacgt

SEQ ID NO: 228924 - DNA, 75 bp, Artificial Sequence
  Synthetic
gattactatgtatagagacatctttggcatgtgggtaaagcctgggaaggtcatctgtagagatagtatagttgg

SEQ ID NO: 228925 - DNA, 75 bp, Artificial Sequence
  Synthetic
acacttctgatgaagaagatgaaaatgagacagaccgtgtaaccctcctctcaactctcgtaaaccaaggaatga

SEQ ID NO: 228926 - DNA, 75 bp, Artificial Sequence
  Synthetic
tgaaggtactgcgtgatgaaattaatgggatacttgcaccattcctacagaaaaagaaaggcaagaccaagcatg

SEQ ID NO: 228927 - DNA, 75 bp, Artificial Sequence
  Synthetic
caggaaaggcgtgaaactccttactgaggaagagtatcgagaactcttggagaagggtctagatcgtgaaacatt

SEQ ID NO: 228928 - DNA, 75 bp, Artificial Sequence
  Synthetic
aagaggggggtggtgattggcctttggcttatcagtgtatagacaatattttcctacactctttttctaaatagt

SEQ ID NO: 228929 - DNA, 75 bp, Artificial Sequence
  Synthetic
ggcttatcagtgtatagacaatattttcctacactctttttctaaatagtagacaagatgacacacggtgagcca

SEQ ID NO: 228930 - DNA, 75 bp, Artificial Sequence
  Synthetic
ttcctacactctttttctaaatagtagacaagatgacacacggtgagccatactatagttctaaacctgacaaag

SEQ ID NO: 228931 - DNA, 75 bp, Artificial Sequence
  Synthetic
acgtagacaaatgacatctactatggttgcaaaactcccaaaatttgttaggaactctccacaagcttatgattg

SEQ ID NO: 228932 - DNA, 75 bp, Artificial Sequence
  Synthetic
actaaaccaaaaccttgccccgagccagaggctgaaatacaaccacttgatttgtctcagaagaaagagaaacaa

SEQ ID NO: 228933 - DNA, 75 bp, Artificial Sequence
  Synthetic
gttgcaaaactcccaaaatttgttaggaactctccacaagcttatgattggatcgtaagaggtctaatctttccc

SEQ ID NO: 228934 - DNA, 75 bp, Artificial Sequence
  Synthetic
cagaggctgaaatacaaccacttgatttgtctcagaagaaagagaaacaaccggaacaagaacaacaagtggtga

SEQ ID NO: 228935 - DNA, 75 bp, Artificial Sequence
  Synthetic
gaattgttgtgattactggtgggcttgaggatggaacatatggctcattcgcatttgatggcagagaatgggttg

SEQ ID NO: 228936 - DNA, 75 bp, Artificial Sequence
  Synthetic
tcctcagccatactcacaaacgtatggcaaggcgccaatctgggaatcttatgattttgattgggatgaggatga

SEQ ID NO: 228937 - DNA, 75 bp, Artificial Sequence
  Synthetic
tgaggatggaacatatggctcattcgcatttgatggcagagaatgggttgagatctacccaatagaacatctgaa

SEQ ID NO: 228938 - DNA, 75 bp, Artificial Sequence
  Synthetic
agatctacccaatagaacatctgaaccttatgtcatctttaaagctaatacacaaagccaatgctcttcaggaga

SEQ ID NO: 228939 - DNA, 75 bp, Artificial Sequence
  Synthetic
caccggttaactaaggcagatgaaatagttcttggatcaaaaattgtcaagcttaggacgattattgaaacagcc

SEQ ID NO: 228940 - DNA, 75 bp, Artificial Sequence
  Synthetic
ttccttcagcatgagaacgtacgactgaaggaattgattccaaaaccagaaccacggaagattcagatggggtgg

SEQ ID NO: 228941 - DNA, 75 bp, Artificial Sequence
  Synthetic
cagcagtcaatggcaccgtagtgaggatatcacttaatccgacttccactccttcctctactagttggtctgggc

SEQ ID NO: 228942 - DNA, 75 bp, Artificial Sequence
  Synthetic
ttttatctcttatacctgggggctatgcgcaaagccagaacaataacactatatttacagacatgatagctgcct

SEQ ID NO: 228943 - DNA, 75 bp, Artificial Sequence
  Synthetic
tactgttggtaaaaatgcagtcttcaagttaaagccttctgatctgggtgggcctcgagatggttggtggttaac

SEQ ID NO: 228944 - DNA, 75 bp, Artificial Sequence
  Synthetic
tgcgcaaagccagaacaataacactatatttacagacatgatagctgcctgcaaatattcaactgagacattaac

SEQ ID NO: 228945 - DNA, 75 bp, Artificial Sequence
  Synthetic
cgggagcggaggtgtgttcctgctaatttcccattattaggtcatttaccaatcaatagacccatttttgatgac

SEQ ID NO: 228946 - DNA, 75 bp, Artificial Sequence
  Synthetic
ctcgcactagcaaacataaccattagtgacaagctagatgctgtgagacaaattcttaacttcgcctttgtacct

SEQ ID NO: 228947 - DNA, 75 bp, Artificial Sequence
  Synthetic
ggcctatttttggtggagttgtcttcagcatggtgcttcacagggtatgcagcaaacccaaatttagttaatcta

SEQ ID NO: 228948 - DNA, 75 bp, Artificial Sequence
  Synthetic
acatggggcccacaagcttttattaaatcttttgacaaattcttttatgcggaaccagttgattttttctcagaa

SEQ ID NO: 228949 - DNA, 75 bp, Artificial Sequence
  Synthetic
acttgcaacatcccatttatctggttttaagatggctgttttacccacaatcccatttcacaccactatgacttt

SEQ ID NO: 228950 - DNA, 75 bp, Artificial Sequence
  Synthetic
gtatctagaggatactagagtgatacacataactgcaactgagaaaaatactgattctacaccagcatatccaaa

SEQ ID NO: 228951 - DNA, 75 bp, Artificial Sequence
  Synthetic
tgagcttgtgactccaccgccgttcaattggctggtcaaaggtggttggtggtttgtcaaactcattgctgggcg

SEQ ID NO: 228952 - DNA, 75 bp, Artificial Sequence
  Synthetic
aaatatcttgaatcacatggatgggcaccatatattagagagtttaccaggatcttcaaaggagataagcctgaa

SEQ ID NO: 228953 - DNA, 75 bp, Artificial Sequence
  Synthetic
gccagatacgtggtcttattgctacaacagcactaattgctggtgggcatgcctgcttgacactcacaggcacaa

SEQ ID NO: 228954 - DNA, 75 bp, Artificial Sequence
  Synthetic
caccggcggggtgtctgcttataccagacagagcaacccagttcgtaccacgctccagttcacacagatgaatca

SEQ ID NO: 228955 - DNA, 75 bp, Artificial Sequence
  Synthetic
gtatgtgccgaccccatttacaccaggataggggcgtgcctagaggcacatcagaatgtcctaatgaaacagcat

SEQ ID NO: 228956 - DNA, 75 bp, Artificial Sequence
  Synthetic
ccagcaacgctgggccggtccatcccagagcctggtgaccaattcaaagttatcatgactgctggcgcactggtg

SEQ ID NO: 228957 - DNA, 75 bp, Artificial Sequence
  Synthetic
ggtggtcaccaatggagggcggctttaagaaaacaatgcaacgccttgtaaatagagggaataaatacttcattg

SEQ ID NO: 228958 - DNA, 75 bp, Artificial Sequence
  Synthetic
taagaaaacaatgcaacgccttgtaaatagagggaataaatacttcattgagtttgactggacccgctatgatgg

SEQ ID NO: 228959 - DNA, 75 bp, Artificial Sequence
  Synthetic
attggctattcaaaactgtcactccacctacaggacatgatgctgctagggttggctggaatacacaacattatt

SEQ ID NO: 228960 - DNA, 75 bp, Artificial Sequence
  Synthetic
cacatcaaagaaattaggtggaatttcataaacaaagaccaacgtgagaagtatagacatgtacatgaatggtac

SEQ ID NO: 228961 - DNA, 75 bp, Artificial Sequence
  Synthetic
tcataaacaaagaccaacgtgagaagtatagacatgtacatgaatggtacgttgataatctcctcaaccgccatg

SEQ ID NO: 228962 - DNA, 75 bp, Artificial Sequence
  Synthetic
gggtgaaggagttgattccaaaaccggagccacgaaagatacagatgaagtggataatattgggggcaatactta

SEQ ID NO: 228963 - DNA, 75 bp, Artificial Sequence
  Synthetic
cttacagacacgaggcaatccatccggacaattttcaacaacaatggataataacatggtcaacttctggttaca

SEQ ID NO: 228964 - DNA, 75 bp, Artificial Sequence
  Synthetic
ggacaattttcaacaacaatggataataacatggtcaacttctggttacaagcgtttgagtttgcctacttcaat

SEQ ID NO: 228965 - DNA, 75 bp, Artificial Sequence
  Synthetic
ttatcaaagaatccagactatagtagtgtcacagtaatggcttatgtgaatgaagatcttgtggtttcaactgca

SEQ ID NO: 228966 - DNA, 75 bp, Artificial Sequence
  Synthetic
cctacgacactgtggtttatggtgatgatagactctctactacaccctcagtgccagaaaattatgaagaaagag

SEQ ID NO: 228967 - DNA, 75 bp, Artificial Sequence
  Synthetic
attatatgagctactttttcagagaaagccaaagtgaccagaatgtggctaatttgaaaatacgcccacaaacat

SEQ ID NO: 228968 - DNA, 75 bp, Artificial Sequence
  Synthetic
tctcttatgcagttcgcacccaagatgggatgtcgggtgcaccagtttgtgacaaatatggacgagtgttggcag

SEQ ID NO: 228969 - DNA, 75 bp, Artificial Sequence
  Synthetic
aagccaaagtgaccagaatgtggctaatttgaaaatacgcccacaaacatggcagcaaacagtgaatttccaacg

SEQ ID NO: 228970 - DNA, 75 bp, Artificial Sequence
  Synthetic
ccaactgaaaattttagtatcacaaattatatgagctactttttcagagaaagccaaagtgaccagaatgtggct

SEQ ID NO: 228971 - DNA, 75 bp, Artificial Sequence
  Synthetic
gtgatttgtagagagagtatagttgggctatcattttgtggttttacagttaatgcagaccttgaacctgtacca

SEQ ID NO: 228972 - DNA, 75 bp, Artificial Sequence
  Synthetic
actgccattagaaatggctcacctccatcagggtggatttgggacaacatggagctaacaaatgacagcatatat

SEQ ID NO: 228973 - DNA, 75 bp, Artificial Sequence
  Synthetic
catcagggtggatttgggacaacatggagctaacaaatgacagcatatattatgctgatcaagtcctagcccact

SEQ ID NO: 228974 - DNA, 75 bp, Artificial Sequence
  Synthetic
tgatagactctctactacaccctcagtgccagaaaattatgaagaaagagtgattgatatgtacagggatatttt

SEQ ID NO: 228975 - DNA, 75 bp, Artificial Sequence
  Synthetic
ggctatcattttgtggttttacagttaatgcagaccttgaacctgtaccaacctcaccagaaaaactgatggcat

SEQ ID NO: 228976 - DNA, 75 bp, Artificial Sequence
  Synthetic
tgactgccgttacacaacaacctgtcgttgcactagaacagaaaagtgttagcgatagtggtgtggttgaccttg

SEQ ID NO: 228977 - DNA, 75 bp, Artificial Sequence
  Synthetic
caagctctattttgaagtgcatacaacaatgccccagtcgagtatgagaaaagttggttttgatgaggatcaaac

SEQ ID NO: 228978 - DNA, 75 bp, Artificial Sequence
  Synthetic
acaatgccccagtcgagtatgagaaaagttggttttgatgaggatcaaaccgataattggcaagaactagatgaa

SEQ ID NO: 228979 - DNA, 75 bp, Artificial Sequence
  Synthetic
ctatccttggaattgttttcttatgcttcatggaggactccaactatgttaaccaagttcgtggtctcatagcta

SEQ ID NO: 228980 - DNA, 75 bp, Artificial Sequence
  Synthetic
agcgatagtggtgtggttgaccttgtcagaactgcaatggaacgtgagatgaaggtactgcgtgatgaaatcaat

SEQ ID NO: 228981 - DNA, 75 bp, Artificial Sequence
  Synthetic
gtgattatgagacagattccctagaggatgaatcagatgatgaagacacttacacaagcagacagcttgttatta

SEQ ID NO: 228982 - DNA, 75 bp, Artificial Sequence
  Synthetic
ggatgaatcagatgatgaagacacttacacaagcagacagcttgttattaacactctagtcaatcagggcattag

SEQ ID NO: 228983 - DNA, 75 bp, Artificial Sequence
  Synthetic
aagatgatgatggttggggggtggttggtgatgatgtagaatttgattatactgaagtaattaattttgaccagg

SEQ ID NO: 228984 - DNA, 75 bp, Artificial Sequence
  Synthetic
aggaagagtatcgagaactcttggagaaaggtctggatcgtgaaacatttcttgatctcatagatcgtatcattg

SEQ ID NO: 228985 - DNA, 75 bp, Artificial Sequence
  Synthetic
atgtcagcatatcctagtgttgagtggggaagtggtgaaaaatctacaagccagcacatctcagaaattccttca

SEQ ID NO: 228986 - DNA, 75 bp, Artificial Sequence
  Synthetic
gtacgtgtgcctgtgagcgcaaacaacattcgctcagtcaagggagccgcggccacgccgagtaggatcgagggt

SEQ ID NO: 228987 - DNA, 75 bp, Artificial Sequence
  Synthetic
tggacagttttcaacaacaatggataacaacatggtcaacttttggctacaagcttttgagtttgcttattttaa

SEQ ID NO: 228988 - DNA, 75 bp, Artificial Sequence
  Synthetic
cggtacttgttaaggatgctacagggagtactcaatttggaccagtgcaggcgctaggggcgcagtattcaatgt

SEQ ID NO: 228989 - DNA, 75 bp, Artificial Sequence
  Synthetic
ccaagaggggggtggtgattggcctttggcttatcagaatatagataagatatctcctacactcttttatcaaat

SEQ ID NO: 228990 - DNA, 75 bp, Artificial Sequence
  Synthetic
gcttacttccatggttggatcctctgcagtcaatggtactgtagtgagagtatctttaaatccaacgtctacacc

SEQ ID NO: 228991 - DNA, 75 bp, Artificial Sequence
  Synthetic
gagaaacaagtggtgaagcctaagcctcagaagagtgagccacaaccatattcacagacctatggtaaggcacca

SEQ ID NO: 228992 - DNA, 75 bp, Artificial Sequence
  Synthetic
gcagtcaatggtactgtagtgagagtatctttaaatccaacgtctacaccttcttccactagctggtctggcttg

SEQ ID NO: 228993 - DNA, 75 bp, Artificial Sequence
  Synthetic
gaacccagagaaacaaccggagtatgagaaacaagtggtgaagcctaagcctcagaagagtgagccacaaccata

SEQ ID NO: 228994 - DNA, 75 bp, Artificial Sequence
  Synthetic
cagttggtaagaatgctgtgttcaagttgaaaccagctgacctgggtggccctagagatggttggtggttaacaa

SEQ ID NO: 228995 - DNA, 75 bp, Artificial Sequence
  Synthetic
atggttacaaaacttcccaaatttgtcaggaattcaccacaagcctatgattggatcgtaaggggtctaatcttt

SEQ ID NO: 228996 - DNA, 75 bp, Artificial Sequence
  Synthetic
gggatgaggatgatgccaaatttatcctgccagcgccgctccggctaactaaagcagatgaaatagttcttggat

SEQ ID NO: 228997 - DNA, 75 bp, Artificial Sequence
  Synthetic
gttgaaaccagctgacctgggtggccctagagatggttggtggttaacaaacaccaatgacaatgcttctgacac

SEQ ID NO: 228998 - DNA, 75 bp, Artificial Sequence
  Synthetic
gcaaattcttaatttcgcatttgtgcctagagctcattggttaagaactgtcttttattatatccactattatga

SEQ ID NO: 228999 - DNA, 75 bp, Artificial Sequence
  Synthetic
aaatctcatgtcatccctgaaactaatacacaaggccaatgctcttcaggagaggttacgtctctcccaagaaga

SEQ ID NO: 229000 - DNA, 75 bp, Artificial Sequence
  Synthetic
ccccaaaaaaactacaaagggccccagaagaccaaggggtccaaacctaccactcattagatgcatggaaattgt

SEQ ID NO: 229001 - DNA, 75 bp, Artificial Sequence
  Synthetic
gaagtcgaccgacaaacaggtcaatgtcaccttcagtggctcagccggagagccactggttatgagtgtacctgc

SEQ ID NO: 229002 - DNA, 75 bp, Artificial Sequence
  Synthetic
cactcattagatgcatggaaattgttgttagaacctccgcgagagcggaggtgtgtacctgctaatttcccatta

SEQ ID NO: 229003 - DNA, 75 bp, Artificial Sequence
  Synthetic
gtcaccttcagtggctcagccggagagccactggttatgagtgtacctgcaacaagccactttgttcgcgcagtt

SEQ ID NO: 229004 - DNA, 75 bp, Artificial Sequence
  Synthetic
ctttagcacgggctggggagagaacaacatctgatactgtttggcaggtactcaacaccgccgtgtctgccgctg

SEQ ID NO: 229005 - DNA, 75 bp, Artificial Sequence
  Synthetic
tggataattgtgggagcagtgcttacatttttatctctaatacctggaggttatgcacagagtcaaactaataac

SEQ ID NO: 229006 - DNA, 75 bp, Artificial Sequence
  Synthetic
aacatctgatactgtttggcaggtactcaacaccgccgtgtctgccgctgaactggttactcccccaccattcaa

SEQ ID NO: 229007 - DNA, 75 bp, Artificial Sequence
  Synthetic
tttgtcaagctgattgcaggtagaacaaggaatggcacgcgtagcttctatgtgtatccaagctaccaggatgcg

SEQ ID NO: 229008 - DNA, 75 bp, Artificial Sequence
  Synthetic
gtgtgcttttgctgattgggcaacctatcgcgagttccggtacctagaggataccagggtaatacatataactgc

SEQ ID NO: 229009 - DNA, 75 bp, Artificial Sequence
  Synthetic
ctggagggcttccaagtgggctgagagcagcgtctgcagtcaccacaactttgcagttcacccagatgaatcaac

SEQ ID NO: 229010 - DNA, 75 bp, Artificial Sequence
  Synthetic
gcgcccgccctggtacagacttaatcacacttgcaacatcacatttatctggttttaggatggctgttttaccca

SEQ ID NO: 229011 - DNA, 75 bp, Artificial Sequence
  Synthetic
caattccattccacaccactatgacattgtgggttatgaatactcttatggtttgttactactttgacaacttgc

SEQ ID NO: 229012 - DNA, 75 bp, Artificial Sequence
  Synthetic
ttctcactgtgggtcagccagtaacacccaatgaaatcaacaaacaaaactgggttgggaaaacaaatacaccta

SEQ ID NO: 229013 - DNA, 75 bp, Artificial Sequence
  Synthetic
aaggaggaaaaaattaggaattctgatatccggcagatagtgtgtgccgaccccatttacaccaggataggggcg

SEQ ID NO: 229014 - DNA, 75 bp, Artificial Sequence
  Synthetic
accaatacttggtatcatcttcttgtgcttcatggaagactctaattatgtgagccagatacgtggtcttattgc

SEQ ID NO: 229015 - DNA, 75 bp, Artificial Sequence
  Synthetic
aatggttttaccatgatatccagtatagactggtatgatgaggaaatgcaacccctggaggttcctgcaccgatg

SEQ ID NO: 229016 - DNA, 75 bp, Artificial Sequence
  Synthetic
tcaataagaaggcagatgtgtatgcagcacagcaatacaagaactctatcagtaacaataagcaccagataacca

SEQ ID NO: 229017 - DNA, 75 bp, Artificial Sequence
  Synthetic
taaacattttattgaatttgactggacccgctatgatggaactataccaccagcacttttcaaacatatcaaaga

SEQ ID NO: 229018 - DNA, 75 bp, Artificial Sequence
  Synthetic
agcacagcaatacaagaactctatcagtaacaataagcaccagataaccagtgtatacctgattagagttaagga

SEQ ID NO: 229019 - DNA, 75 bp, Artificial Sequence
  Synthetic
agctacttctttagagagaaagttgataccactgcagttgaacttatgaagattaggcctcaaacataccataca

SEQ ID NO: 229020 - DNA, 75 bp, Artificial Sequence
  Synthetic
gagggttggagtcaatgaatttgtagtcataaagccaggtgcattatgtgttatagacacacctgaaggaaaagg

SEQ ID NO: 229021 - DNA, 75 bp, Artificial Sequence
  Synthetic
gattaggcctcaaacataccatacaactgttaactttgtccaaaacaattggtatcttttgactagcacagtctt

SEQ ID NO: 229022 - DNA, 75 bp, Artificial Sequence
  Synthetic
gaggcaatccatctggccagttttcaacaacaatggacaacaacatggtcaacttttggttacaagcttttgagt

SEQ ID NO: 229023 - DNA, 75 bp, Artificial Sequence
  Synthetic
ttgcttatttcaatggtccaaacaaagacctctggaagacttatgatactgtggtttatggagatgataggcttt

SEQ ID NO: 229024 - DNA, 75 bp, Artificial Sequence
  Synthetic
tgacttgcatccaacagcaagattaaaattatcaaagaacccagattatagttgtgtcacagttatggcttatgt

SEQ ID NO: 229025 - DNA, 75 bp, Artificial Sequence
  Synthetic
actttgagatgcttacctctctgccacaagctatggcagaacaatctgaccaaagtgaacaagcagtaacatttt

SEQ ID NO: 229026 - DNA, 75 bp, Artificial Sequence
  Synthetic
ctatcagttgcttgctgcgttcatggcagaagatcacccttttaaggtgtatgtagaacactgcctatcacggac

SEQ ID NO: 229027 - DNA, 75 bp, Artificial Sequence
  Synthetic
cagcgactgttgttacacaacaacctattgctacactagagcagaaaagtgtcagcgatagcgatgtgattgacc

SEQ ID NO: 229028 - DNA, 75 bp, Artificial Sequence
  Synthetic
cttggcccagatgcagcatggtcccatgcgtgtgatcaagcacgcaaagtaggcgataatcatgacctacaagtt

SEQ ID NO: 229029 - DNA, 75 bp, Artificial Sequence
  Synthetic
tattgctacactagagcagaaaagtgtcagcgatagcgatgtgattgaccttgttagaactgcaatggaacgtga

SEQ ID NO: 229030 - DNA, 75 bp, Artificial Sequence
  Synthetic
aatgggatacttgcaccgttcctacaaaaaaagaaaggtaagaccaagcatggtaggggtagagtcagacgaaac

SEQ ID NO: 229031 - DNA, 75 bp, Artificial Sequence
  Synthetic
ccaagaggggggtggtgattggcctttggcttatcagtgtatagataacatttcctgctcgtttatcatacaatt

SEQ ID NO: 229032 - DNA, 75 bp, Artificial Sequence
  Synthetic
ttggcttatcagtgtatagataacatttcctgctcgtttatcatacaattaacaacaagatggcacacggtgagc

SEQ ID NO: 229033 - DNA, 75 bp, Artificial Sequence
  Synthetic
tggtaggggtagagtcagacgaaaccttaggaaaggtgtgaaacttctcactgaggaagaatatcgagagctctt

SEQ ID NO: 229034 - DNA, 75 bp, Artificial Sequence
  Synthetic
caagtaagccacaacaagccaacacttctcaaaaaccccgccccgagctagaagctgaagcacaaccgcttgatt

SEQ ID NO: 229035 - DNA, 75 bp, Artificial Sequence
  Synthetic
cttgatgatggaacatatggctcattcgcatttgatggtaaagagtgggtggagatctacccaatagagcattta

SEQ ID NO: 229036 - DNA, 75 bp, Artificial Sequence
  Synthetic
ttctcaaaaaccccgccccgagctagaagctgaagcacaaccgcttgatttgtctcagaagaaagagaaacaacc

SEQ ID NO: 229037 - DNA, 75 bp, Artificial Sequence
  Synthetic
tggtactgtcctcagagtttcacttaaccccacatctacaccatcgtccactagttggtcaggattgggtgcacg

SEQ ID NO: 229038 - DNA, 75 bp, Artificial Sequence
  Synthetic
cctaccaagatgcagaagaatgaacctcaaccatattcacaaacttatggcaaggcaccaatctgggaatcctat

SEQ ID NO: 229039 - DNA, 75 bp, Artificial Sequence
  Synthetic
gagactgcgtctctctcaagaagagaaggccaccctcgctctggatgtgcaattccttcagcatgaaaatgtgcg

SEQ ID NO: 229040 - DNA, 75 bp, Artificial Sequence
  Synthetic
ctcaaccatattcacaaacttatggcaaggcaccaatctgggaatcctatgactttgattgggatgaggatgacg

SEQ ID NO: 229041 - DNA, 75 bp, Artificial Sequence
  Synthetic
gagccacggaagatacagatgaagtggataatagtaggagcagtacttacattcttatctctaatacctgggggc

SEQ ID NO: 229042 - DNA, 75 bp, Artificial Sequence
  Synthetic
ccgattaaccaaagcagatgaaatagtccttggatcaaaaattgtcaagcttagaacaattattgagacagcaat

SEQ ID NO: 229043 - DNA, 75 bp, Artificial Sequence
  Synthetic
gtccttggatcaaaaattgtcaagcttagaacaattattgagacagcaataaaaacacaaaattatagtgcttta

SEQ ID NO: 229044 - DNA, 75 bp, Artificial Sequence
  Synthetic
cctccattgaaatacacacacttggacgaacaatgtcctcatataagaatgagcagtttacaggggggctatttt

SEQ ID NO: 229045 - DNA, 75 bp, Artificial Sequence
  Synthetic
acgaacaatgtcctcatataagaatgagcagtttacaggggggctatttttggttgaacttgcttcagagtggtg

SEQ ID NO: 229046 - DNA, 75 bp, Artificial Sequence
  Synthetic
ctatatttacagacatgatagctgcctgcaagtactcaactgagacattaacagaaaaccttgacctcagaatca

SEQ ID NO: 229047 - DNA, 75 bp, Artificial Sequence
  Synthetic
aagcagcttatgaagctggtttggaaggctttctccagagggtcaaatcaaaaaataaggctccaaaaaactaca

SEQ ID NO: 229048 - DNA, 75 bp, Artificial Sequence
  Synthetic
aggctttctccagagggtcaaatcaaaaaataaggctccaaaaaactacaaagggccccagaagaccagggggcc

SEQ ID NO: 229049 - DNA, 75 bp, Artificial Sequence
  Synthetic
tagtgataagctagatgctgtgaggcaaattcttaatttcgcatttgtgcctagagctcattggttaaggactgt

SEQ ID NO: 229050 - DNA, 75 bp, Artificial Sequence
  Synthetic
caaattcttaatttcgcatttgtgcctagagctcattggttaaggactgttttttactacatacactactatgaa

SEQ ID NO: 229051 - DNA, 75 bp, Artificial Sequence
  Synthetic
ggcagctactactggaggccccacgggagcggaagtgtgtacctactaacttcccactggttggccacctaccca

SEQ ID NO: 229052 - DNA, 75 bp, Artificial Sequence
  Synthetic
ggagcggaagtgtgtacctactaacttcccactggttggccacctacccattaatagacccatctatgatgataa

SEQ ID NO: 229053 - DNA, 75 bp, Artificial Sequence
  Synthetic
ttgcaattggcactgtcatgaggagcgcccgccctggcacagatttaatcacacttgcaacatcccatttatctg

SEQ ID NO: 229054 - DNA, 75 bp, Artificial Sequence
  Synthetic
cgcccgccctggcacagatttaatcacacttgcaacatcccatttatctggtttcaggatggctgttttacccac

SEQ ID NO: 229055 - DNA, 75 bp, Artificial Sequence
  Synthetic
ttattaccagaaccaacttggcatgcttttgaggagtatggacctaccacatggggcccacaggctttcatcaag

SEQ ID NO: 229056 - DNA, 75 bp, Artificial Sequence
  Synthetic
cttttgaggagtatggacctaccacatggggcccacaggctttcatcaagtcttttgaaaaattcttctatgctg

SEQ ID NO: 229057 - DNA, 75 bp, Artificial Sequence
  Synthetic
ctgtgggttatgaacactcttatggtttgctactattttgataacttgctagcaataacaatggcaattttggca

SEQ ID NO: 229058 - DNA, 75 bp, Artificial Sequence
  Synthetic
acttattgctgggaggacgaggactggcacccgtagcttttatgtatatcccagctaccaagatgctttgtctaa

SEQ ID NO: 229059 - DNA, 75 bp, Artificial Sequence
  Synthetic
tttgctactattttgataacttgctagcaataacaatggcaattttggcaccaatccttggcatcatttttttgt

SEQ ID NO: 229060 - DNA, 75 bp, Artificial Sequence
  Synthetic
cccacgattgtgtgcctttgctgattgggctacatatcgtgagtttagatacttggaggatactagggtcataca

SEQ ID NO: 229061 - DNA, 75 bp, Artificial Sequence
  Synthetic
tgggctacatatcgtgagtttagatacttggaggatactagggtcatacatataactgccactgagaagaatact

SEQ ID NO: 229062 - DNA, 75 bp, Artificial Sequence
  Synthetic
tttgaaggtagtgctggatcaccattaataatgaatgtgccagaggggagccattttgcccgaacagtacttgcg

SEQ ID NO: 229063 - DNA, 75 bp, Artificial Sequence
  Synthetic
taagccagcactttgcactggcagcactccaggaggcatgaggacccggaatcctgtgacaacaaccctacagtt

SEQ ID NO: 229064 - DNA, 75 bp, Artificial Sequence
  Synthetic
tgaactattttgacactgaagaagaatatctggaagcacatggatgggccccatacattagggaatttactagag

SEQ ID NO: 229065 - DNA, 75 bp, Artificial Sequence
  Synthetic
atatctggaagcacatggatgggccccatacattagggaatttactagagtttttaaaggagaaaaacctgaggt

SEQ ID NO: 229066 - DNA, 75 bp, Artificial Sequence
  Synthetic
tgagatccgtgatgctaatgggaaggttgtggccactgtaccaactaggatcaaaaatgtagcatttgacttctt

SEQ ID NO: 229067 - DNA, 75 bp, Artificial Sequence
  Synthetic
gaaattataaaagaggaaaaaatcaaaaattctgacattcggcaaatagtatgtgccgaccctatttacaccagg

SEQ ID NO: 229068 - DNA, 75 bp, Artificial Sequence
  Synthetic
cgggttggagtcaatgaatttgttgtcataaaaccaggtgcattgtgtgttatagacactcctgaagggaaagga

SEQ ID NO: 229069 - DNA, 75 bp, Artificial Sequence
  Synthetic
atgtgccgaccctatttacaccaggataggggcctgcttagaagcacatcagaatgcattgatgaaacagcacac

SEQ ID NO: 229070 - DNA, 75 bp, Artificial Sequence
  Synthetic
catccgaggcgcctgcccctatacaaggtctgcaggtactcgtgaatagctccaagaaagctgatgtgtatgcag

SEQ ID NO: 229071 - DNA, 75 bp, Artificial Sequence
  Synthetic
tagtaacagcagcacacgtcgttggcaataacacttttgtgaatgtgtgctatgagggcttaatgtacgaggcta

SEQ ID NO: 229072 - DNA, 75 bp, Artificial Sequence
  Synthetic
caataacacttttgtgaatgtgtgctatgagggcttaatgtacgaggctaaggtccggtacatgcctgaaaagga

SEQ ID NO: 229073 - DNA, 75 bp, Artificial Sequence
  Synthetic
gagggatcaaaaggcacacccctaataatgaatgtacctgagcatagccactttgccagaatggctgagcaacac

SEQ ID NO: 229074 - DNA, 75 bp, Artificial Sequence
  Synthetic
agaaaacaatgcagcgcctagttaatagaggtaatagatacttcattgaatttgactggacccgctatgacggta

SEQ ID NO: 229075 - DNA, 75 bp, Artificial Sequence
  Synthetic
tccaagaaagctgatgtgtatgcagtcaaacaatttgttacagcgcagacaaacaacaagcaccaggttacaacc

SEQ ID NO: 229076 - DNA, 75 bp, Artificial Sequence
  Synthetic
catcaaagagataaggtggaattttataaacaaagaccaacgtgaaaagtatagacatgtgcatgaatggtatgt

SEQ ID NO: 229077 - DNA, 75 bp, Artificial Sequence
  Synthetic
gatctgcacccaacagcaaggttaaaattagcaaagaatccagactatagttgtgtcacagttatggcttatgtg

SEQ ID NO: 229078 - DNA, 75 bp, Artificial Sequence
  Synthetic
ttgtgtcacagttatggcttatgtgaatgaagaccttgtggtttcaactgcagcagctatggtacatggtaacac

SEQ ID NO: 229079 - DNA, 75 bp, Artificial Sequence
  Synthetic
gatttcaggtgaacaactacctgagctacttttacagggcgtctgctactggagatgctataactaacttgttgg

SEQ ID NO: 229080 - DNA, 75 bp, Artificial Sequence
  Synthetic
tataagcttcacccagggtggatggtatttgctgacaaatacatccattgttgatggggcattgccacctggctg

SEQ ID NO: 229081 - DNA, 75 bp, Artificial Sequence
  Synthetic
tgcaaacacggggtaacccgtctggacaattttcaacaactatggacaacaatatggtcaatttttggctacaag

SEQ ID NO: 229082 - DNA, 75 bp, Artificial Sequence
  Synthetic
tatttgctgacaaatacatccattgttgatggggcattgccacctggctggatttggaataacgtggagcttaaa

SEQ ID NO: 229083 - DNA, 75 bp, Artificial Sequence
  Synthetic
ataaacaaagaccaacgtgaaaagtatagacatgtgcatgaatggtatgttgacaatctcctcaatcgccatgtg

SEQ ID NO: 229084 - DNA, 75 bp, Artificial Sequence
  Synthetic
acaattttcaacaactatggacaacaatatggtcaatttttggctacaagcttttgaattcgcctacttcaacgg

SEQ ID NO: 229085 - DNA, 75 bp, Artificial Sequence
  Synthetic
aaggcctgattcacctaataatgcccttgcctgagtccacacaaatgtgctatgagatgctgacatctattccac

SEQ ID NO: 229086 - DNA, 75 bp, Artificial Sequence
  Synthetic
tatgatactgtggtctatggagacgatagactctccactacaccttcagtaccagacaattatgaagaaagagta

SEQ ID NO: 229087 - DNA, 75 bp, Artificial Sequence
  Synthetic
tccatctcaggtggaattactcaaagaagaaatagagcggttaaaagcccaattgaattccaccactgagaacgt

SEQ ID NO: 229088 - DNA, 75 bp, Artificial Sequence
  Synthetic
atagactctccactacaccttcagtaccagacaattatgaagaaagagtaattgccatgtatagagacatttttg

SEQ ID NO: 229089 - DNA, 75 bp, Artificial Sequence
  Synthetic
gaagaaatagagcggttaaaagcccaattgaattccaccactgagaacgtaacgactgccgttacacaacaacct

SEQ ID NO: 229090 - DNA, 75 bp, Artificial Sequence
  Synthetic
cttgcctgagtccacacaaatgtgctatgagatgctgacatctattccacgctccagggcagctggctatggtta

SEQ ID NO: 229091 - DNA, 75 bp, Artificial Sequence
  Synthetic
catttgcagagagagcataattggtttatcattttgtggctttacagttaactcagaccttgaacctgtaccaac

SEQ ID NO: 229092 - DNA, 75 bp, Artificial Sequence
  Synthetic
agacatcgagagtacagaggacgaagacgacgaagcggacaggtttgatatcatagacacttctgatgaagaaga

SEQ ID NO: 229093 - DNA, 75 bp, Artificial Sequence
  Synthetic
actcagaccttgaacctgtaccaacctcaccagaaaaactaatggcatccctccttaaaccttataaagttctac

SEQ ID NO: 229094 - DNA, 75 bp, Artificial Sequence
  Synthetic
cactgtttggcaggttttaaatactgcagtctctgcagcagaacttgtaacaccaccaccatttaattggctcat

SEQ ID NO: 229095 - DNA, 75 bp, Artificial Sequence
  Synthetic
aaaaaagaaaggcaagaccaagcatggaaggggtagagtcaggcgcaaccttagaaaaggtgtgaaacttctcac

SEQ ID NO: 229096 - DNA, 75 bp, Artificial Sequence
  Synthetic
gctcctgtgctatcagttgctcgctgcatttatggcagaagatcacccttttaaggtgtatgtagaacactgcct

SEQ ID NO: 229097 - DNA, 75 bp, Artificial Sequence
  Synthetic
aatagcaaggcgcgcattccccacgcttacagataggatcaagcgtggagtatacatggacctgcttgtttcggg

SEQ ID NO: 229098 - DNA, 75 bp, Artificial Sequence
  Synthetic
gaggggaggaccaaagaagtgcgatggctagcaagtctgataagcaagtcactgttgaggtcaaaaataacaaca

SEQ ID NO: 229099 - DNA, 75 bp, Artificial Sequence
  Synthetic
actgaagtgattaactttgatcaagcaaaaccaactcctgccccgagaacaatcaagccaaaaccttgtcctgaa

SEQ ID NO: 229100 - DNA, 75 bp, Artificial Sequence
  Synthetic
ggcccggtctcagtctagaggccgtggcaagtcagtcaaaattacagtcaattccaggagtagaggtagaagaca

SEQ ID NO: 229101 - DNA, 75 bp, Artificial Sequence
  Synthetic
ccaaaaggggggtggtgattggcctttggcttatcagtgtatagataagatttttcttacattttaccaaatatc

SEQ ID NO: 229102 - DNA, 75 bp, Artificial Sequence
  Synthetic
ggcaagtcagtcaaaattacagtcaattccaggagtagaggtagaagacaaaacggacgcgacaaatatcagtct

SEQ ID NO: 229103 - DNA, 75 bp, Artificial Sequence
  Synthetic
caaaaccaactcctgccccgagaacaatcaagccaaaaccttgtcctgaaccagaagccgagacacagccacttg

SEQ ID NO: 229104 - DNA, 75 bp, Artificial Sequence
  Synthetic
accagaacatgagcaacaaatagttaagtccaccaagcctcagaagagtgagccccaaccatactcacaaaccta

SEQ ID NO: 229105 - DNA, 75 bp, Artificial Sequence
  Synthetic
ctaaacaactcaggaaacagggtgtcacaggacctaaaccagcaatttgccaacgtgccacagcaacacttggga

SEQ ID NO: 229106 - DNA, 75 bp, Artificial Sequence
  Synthetic
tactatagttccaaacctgacaaagacttcaattttggaagcacaatggcacgtaggcaaatgacaactactatg

SEQ ID NO: 229107 - DNA, 75 bp, Artificial Sequence
  Synthetic
cacaggacctaaaccagcaatttgccaacgtgccacagcaacacttgggacaatcggctcaaacaccagtggaac

SEQ ID NO: 229108 - DNA, 75 bp, Artificial Sequence
  Synthetic
aagtccaccaagcctcagaagagtgagccccaaccatactcacaaacctatggtaaggcaccaatctgggagtct

SEQ ID NO: 229109 - DNA, 75 bp, Artificial Sequence
  Synthetic
atgctaagtttatcctgccagcaccacaccgactaactaaggcagatgaaatagttcttgggtcaaagattgtca

SEQ ID NO: 229110 - DNA, 75 bp, Artificial Sequence
  Synthetic
cttaatcccgtccttgttaaggatgctactgggagtactcaatttgggccagtgcaggcgttaggggcacaatat

SEQ ID NO: 229111 - DNA, 75 bp, Artificial Sequence
  Synthetic
ctactgggagtactcaatttgggccagtgcaggcgttaggggcacaatattctatgtggaaattgaagtacctaa

SEQ ID NO: 229112 - DNA, 75 bp, Artificial Sequence
  Synthetic
agctcagaacgatcattgagacagccataaagacccagaattatagtgcactacctgaagctgtatttgaacttg

SEQ ID NO: 229113 - DNA, 75 bp, Artificial Sequence
  Synthetic
gcaccaagcagttttatgtttatccaagctaccaggacgccctgtcaaacaagccagccctctgcactggtgggg

SEQ ID NO: 229114 - DNA, 75 bp, Artificial Sequence
  Synthetic
gagttgttgttgttactggtgggcttgaggatggaacatatggttcattcgcatttgatggtagagaatgggtag

SEQ ID NO: 229115 - DNA, 75 bp, Artificial Sequence
  Synthetic
tgcatcagccgttaatggtacagttgtaagggtttctctcaatccaacctcaacgccttcatccacgagctggtc

SEQ ID NO: 229116 - DNA, 75 bp, Artificial Sequence
  Synthetic
gtaagggtttctctcaatccaacctcaacgccttcatccacgagctggtctgggcttggcgctcgtaaacatctt

SEQ ID NO: 229117 - DNA, 75 bp, Artificial Sequence
  Synthetic
agccacccttgctcttgatgtacaattccttcagcatgaaaatgtgcgactgaaggagttgattccaaaaccaga

SEQ ID NO: 229118 - DNA, 75 bp, Artificial Sequence
  Synthetic
tttttaaacttaaaccagccgacctgggtgggcccagggatgggtggtggttgactaacacaaatgataatgctt

SEQ ID NO: 229119 - DNA, 75 bp, Artificial Sequence
  Synthetic
gggtgggcccagggatgggtggtggttgactaacacaaatgataatgcttcagacacactagggccctctgttga

SEQ ID NO: 229120 - DNA, 75 bp, Artificial Sequence
  Synthetic
ataatagtgggagcagtgcttacatttttatctctaatacctgggggctatgcgcaaagtcagaccaacaacact

SEQ ID NO: 229121 - DNA, 75 bp, Artificial Sequence
  Synthetic
gccacggaaaatacagatgaagtggataatagtgggagcagtgcttacatttttatctctaatacctgggggcta

SEQ ID NO: 229122 - DNA, 75 bp, Artificial Sequence
  Synthetic
tcctcatataaaaatgagcaatttacaggagggcttttcctagttgaattggcctcagagtggtgttttacaggt

SEQ ID NO: 229123 - DNA, 75 bp, Artificial Sequence
  Synthetic
caggagggcttttcctagttgaattggcctcagagtggtgttttacaggttatgcagctaaccctaacctggtga

SEQ ID NO: 229124 - DNA, 75 bp, Artificial Sequence
  Synthetic
ctcgcactagcaaacataaccattaatgataagctagacgctgtgaggcaaattcttaattttgcctttgtacct

SEQ ID NO: 229125 - DNA, 75 bp, Artificial Sequence
  Synthetic
agttaatgtaacttttgaaggttctaatggcacgccactcataatgaaggttccagaagcaagccattttgccag

SEQ ID NO: 229126 - DNA, 75 bp, Artificial Sequence
  Synthetic
aatggcacgccactcataatgaaggttccagaagcaagccattttgccaggactgccgtagcgcgttcctcagta

SEQ ID NO: 229127 - DNA, 75 bp, Artificial Sequence
  Synthetic
gtggaatatatttatgtttgttcttgcaattggcactgttatgaggagcgctcgccccggcacagacttgattac

SEQ ID NO: 229128 - DNA, 75 bp, Artificial Sequence
  Synthetic
aaaacaccacctccgacacagtctggcaagttttgaacactgctgtctcagctgcagagctggtaacaccgccac

SEQ ID NO: 229129 - DNA, 75 bp, Artificial Sequence
  Synthetic
gcaagttttgaacactgctgtctcagctgcagagctggtaacaccgccaccatttaactggcttgttaagggtgg

SEQ ID NO: 229130 - DNA, 75 bp, Artificial Sequence
  Synthetic
tttaggatggctgttttacccacaattccatttcacaccactatgactttgtgggtcatgaacacacttatggtt

SEQ ID NO: 229131 - DNA, 75 bp, Artificial Sequence
  Synthetic
gcaccatatattagagaattcaccagggtcttcaaaggagacaaacctgaggtactttggtacctatttctcaag

SEQ ID NO: 229132 - DNA, 75 bp, Artificial Sequence
  Synthetic
acttgcaacttcccatttgtctggttttaggatggctgttttacccacaattccatttcacaccactatgacttt

SEQ ID NO: 229133 - DNA, 75 bp, Artificial Sequence
  Synthetic
ggaagggctagaactggaacacgtagtttctacgtctatcctagctatcaggacgccctctcaaataaaccagct

SEQ ID NO: 229134 - DNA, 75 bp, Artificial Sequence
  Synthetic
gtttctacgtctatcctagctatcaggacgccctctcaaataaaccagctctatgtactggcagtgcaccaagtg

SEQ ID NO: 229135 - DNA, 75 bp, Artificial Sequence
  Synthetic
agtgtgtgccgaccccatttacaccagaataggggcgtgcttagaagcacatcagaatgccctaatgaaacaaca

SEQ ID NO: 229136 - DNA, 75 bp, Artificial Sequence
  Synthetic
gacaacgctgcaattcacacaaatgaaccagcccagtcttggacatggagagatgaccgccactctaggtagagc

SEQ ID NO: 229137 - DNA, 75 bp, Artificial Sequence
  Synthetic
ggatggtcaccaatggagggcggcttcaagaagacaatgcagcgcctagtgaataaagggaataagcactttatt

SEQ ID NO: 229138 - DNA, 75 bp, Artificial Sequence
  Synthetic
gcctgcttgacacttacaggcacaaccacgtcattatttgttgtcatactaacttgtagattcatacgtatggca

SEQ ID NO: 229139 - DNA, 75 bp, Artificial Sequence
  Synthetic
aaccagcccagtcttggacatggagagatgaccgccactctaggtagagccataccatctcctggtgacaacttt

SEQ ID NO: 229140 - DNA, 75 bp, Artificial Sequence
  Synthetic
tcaagaagacaatgcagcgcctagtgaataaagggaataagcactttattgaatttgactggacccgctatgatg

SEQ ID NO: 229141 - DNA, 75 bp, Artificial Sequence
  Synthetic
agatccgtgatgctaatgggaaggttgtggctactgtaccaactaggatcaaaaatgttgcatttgacttcttcc

SEQ ID NO: 229142 - DNA, 75 bp, Artificial Sequence
  Synthetic
cattggctccaaacacattgacaaaacagaattggctgaataagacaacagtgtcgccacaaaaccatcatgtgg

SEQ ID NO: 229143 - DNA, 75 bp, Artificial Sequence
  Synthetic
acacatcaaagagattaggtggaatttcatcaataaagaccagcgcgaaaagtacagacatgtacatgaatggta

SEQ ID NO: 229144 - DNA, 75 bp, Artificial Sequence
  Synthetic
acagaattggctgaataagacaacagtgtcgccacaaaaccatcatgtggtgaaaattgctaaagatgtgaataa

SEQ ID NO: 229145 - DNA, 75 bp, Artificial Sequence
  Synthetic
ttcatcaataaagaccagcgcgaaaagtacagacatgtacatgaatggtatgttgataatctccttaatcgccat

SEQ ID NO: 229146 - DNA, 75 bp, Artificial Sequence
  Synthetic
ataaaaccaggtgctttatgtgttatagacactcctgaagggaaaggtacaggcttcttttctggcaacgacata

SEQ ID NO: 229147 - DNA, 75 bp, Artificial Sequence
  Synthetic
cctattagctctgttgattggtacactacagatttccagccatcagaggcccccacccccatacccggattgcag

SEQ ID NO: 229148 - DNA, 75 bp, Artificial Sequence
  Synthetic
ccttgcagacacggggtaatccatctggacagttttcaacaacaatggataacaacatggtcaacttttggctac

SEQ ID NO: 229149 - DNA, 75 bp, Artificial Sequence
  Synthetic
tagacactcctgaagggaaaggtacaggcttcttttctggcaacgacatagttacagcagctcatgtcgttggca

SEQ ID NO: 229150 - DNA, 75 bp, Artificial Sequence
  Synthetic
ctacagatttccagccatcagaggcccccacccccatacccggattgcaggtgctggttaatagttctaagaagg

SEQ ID NO: 229151 - DNA, 75 bp, Artificial Sequence
  Synthetic
cttaaataaccagacaaacaataaagtacaacttactagcattttcctggttaaagtcactaccagttttcaggt

SEQ ID NO: 229152 - DNA, 75 bp, Artificial Sequence
  Synthetic
acctatgatactgtggtttatggagatgacaggctttctacaacaccttcggtgcctaataactatgaggagaga

SEQ ID NO: 229153 - DNA, 75 bp, Artificial Sequence
  Synthetic
tgggggtttggtgtacgaagcgaaggttcggtacatgcccgaaaaggacatagcattcataacttgccctggtga

SEQ ID NO: 229154 - DNA, 75 bp, Artificial Sequence
  Synthetic
ggtgcctaataactatgaggagagagtaattactatgtatagagatatttttggcatgtgggttaagcctgggaa

SEQ ID NO: 229155 - DNA, 75 bp, Artificial Sequence
  Synthetic
ttatcaaagaacccagattatagttgtgtaacagttatggcttatgtgaatgaagatcttgtggtctcaactgca

SEQ ID NO: 229156 - DNA, 75 bp, Artificial Sequence
  Synthetic
ttgaaaatctgaaggtgcgttcagacactactgcacaggatgtcaactttcctgttggttggtacctcatgacca

SEQ ID NO: 229157 - DNA, 75 bp, Artificial Sequence
  Synthetic
gtacaacttactagcattttcctggttaaagtcactaccagttttcaggttaacaactatttgagctatttctac

SEQ ID NO: 229158 - DNA, 75 bp, Artificial Sequence
  Synthetic
cactactgcacaggatgtcaactttcctgttggttggtacctcatgaccagtacggccatttttaacgcacccgc

SEQ ID NO: 229159 - DNA, 75 bp, Artificial Sequence
  Synthetic
cgggatgtcgggtgcaccagtttgtgacaaatatggtcgggttttggcagttcatcaaactaatactggatacac

SEQ ID NO: 229160 - DNA, 75 bp, Artificial Sequence
  Synthetic
gttgagcttctgaatgatacagcttaccttattgaccagggtatgatgcaccttattatgccacctcctgcaaac

SEQ ID NO: 229161 - DNA, 75 bp, Artificial Sequence
  Synthetic
accttattgaccagggtatgatgcaccttattatgccacctcctgcaaacactcagttgctgtttgagatgcgca

SEQ ID NO: 229162 - DNA, 75 bp, Artificial Sequence
  Synthetic
gcagacttccatccagtgaaagccccatctcaagtggaattgctcaaagaggaaatagaacggcttaaagctcaa

SEQ ID NO: 229163 - DNA, 75 bp, Artificial Sequence
  Synthetic
gatctctagtgaggaacctgacacccatgaacctggtgatgaatggtgcgacgcactcgatgcaagtgactctcg

SEQ ID NO: 229164 - DNA, 75 bp, Artificial Sequence
  Synthetic
catgaacctggtgatgaatggtgcgacgcactcgatgcaagtgactctcgagtgttgttggaagagacagattat

SEQ ID NO: 229165 - DNA, 75 bp, Artificial Sequence
  Synthetic
acgatgaagcggacaggtttgatcttcatagttcttatggttcggaacctgaggacgatgatgagaataaccgtg

SEQ ID NO: 229166 - DNA, 75 bp, Artificial Sequence
  Synthetic
gaaggtgctgcgtgatgaaatcaatggggtacttgcaccattcctacaaaagaagaaaggcaagaccaaacatgg

SEQ ID NO: 229167 - DNA, 75 bp, Artificial Sequence
  Synthetic
tcatagttcttatggttcggaacctgaggacgatgatgagaataaccgtgtaaccctcctctctacactcataaa

SEQ ID NO: 229168 - DNA, 75 bp, Artificial Sequence
  Synthetic
tcggggtagagtcagacgcaaccttaggaaaggtgtgaaacttcttactgaggaagagtatcgagaactcttaga

SEQ ID NO: 229169 - DNA, 75 bp, Artificial Sequence
  Synthetic
acaaggatcaccaaacgtgcgttccccactagcgctggaaaaacaaagcgcagtgtctacatggacctgcttgca

SEQ ID NO: 229170 - DNA, 75 bp, Artificial Sequence
  Synthetic
aaaaggtctagatcgtgaaacattccttgatctcatagaccgcattattggtgagaggtctggctatcctgacta

SEQ ID NO: 229171 - DNA, 75 bp, Artificial Sequence
  Synthetic
tcggatcaaataccacaggagcaacagagattgaggcgtgcatcctccttaatccagtcttggttaaggatgcta

SEQ ID NO: 229172 - DNA, 75 bp, Artificial Sequence
  Synthetic
cagtgtctacatggacctgcttgcatctggtctttcaccaggcaatgcatggtcacatgcgtgcgaagaggcacg

SEQ ID NO: 229173 - DNA, 75 bp, Artificial Sequence
  Synthetic
agagattgaggcgtgcatcctccttaatccagtcttggttaaggatgctactgggagtactcagtttggtccagt

SEQ ID NO: 229174 - DNA, 75 bp, Artificial Sequence
  Synthetic
atgtggaagcttaaatacctcaatgttagattaacatctatggttggtgcctcagcagtcaatggtaccgtagtg

SEQ ID NO: 229175 - DNA, 75 bp, Artificial Sequence
  Synthetic
ttagattaacatctatggttggtgcctcagcagtcaatggtaccgtagtgaggatatcactcaatccaacttcca

SEQ ID NO: 229176 - DNA, 75 bp, Artificial Sequence
  Synthetic
caaagccaaaaccttgccctgagccagaatctaacaagcctgctctaattgaggcacaaccacttgacttatctc

SEQ ID NO: 229177 - DNA, 75 bp, Artificial Sequence
  Synthetic
agaatctaacaagcctgctctaattgaggcacaaccacttgacttatctcgaaagaaggagaaacaaacagaaca

SEQ ID NO: 229178 - DNA, 75 bp, Artificial Sequence
  Synthetic
ccatattatagttccaagcctgacaaagatttcaattttggaagcacaatggcacgtagacaaatgacacctacc

SEQ ID NO: 229179 - DNA, 75 bp, Artificial Sequence
  Synthetic
gcttggagcgcgcaagcatctagatgttactgttggtaaaaatgcagtttttaagttaaagccttctgacctagg

SEQ ID NO: 229180 - DNA, 75 bp, Artificial Sequence
  Synthetic
aagcatcagaagagtgagcctcaaccatactcacagacttatggtaaggcaccaatttgggaatcttatgatttt

SEQ ID NO: 229181 - DNA, 75 bp, Artificial Sequence
  Synthetic
catactcacagacttatggtaaggcaccaatttgggaatcttatgattttgactgggatgaagatgatgccaagt

SEQ ID NO: 229182 - DNA, 75 bp, Artificial Sequence
  Synthetic
gttactgttggtaaaaatgcagtttttaagttaaagccttctgacctaggtggaccccgtgatgggtggtggtta

SEQ ID NO: 229183 - DNA, 75 bp, Artificial Sequence
  Synthetic
acacacttggtccatccatagaaatacatacattaggccagactatgtcatcataccaaaacacacagtttacag

SEQ ID NO: 229184 - DNA, 75 bp, Artificial Sequence
  Synthetic
acatacattaggccagactatgtcatcataccaaaacacacagtttacaggaggcctatttctggtggagttatc

SEQ ID NO: 229185 - DNA, 75 bp, Artificial Sequence
  Synthetic
aactaaagcagatgaaatagttcttggatcaaagattgtcaaacttagaacgattattgaaacagctataaagac

SEQ ID NO: 229186 - DNA, 75 bp, Artificial Sequence
  Synthetic
gcagcaaacccaaatttagttaatttagtgaaatctacagacaaaagtgttgatgtcacttttgaggggtcagct

SEQ ID NO: 229187 - DNA, 75 bp, Artificial Sequence
  Synthetic
gccgtgtttgagttagacaaggcagcttatgaagcaggtctagagggttttctccaaagggttaaatcaaaaaat

SEQ ID NO: 229188 - DNA, 75 bp, Artificial Sequence
  Synthetic
tagtgaaatctacagacaaaagtgttgatgtcacttttgaggggtcagctggaacaccactcattatgaatgtac

SEQ ID NO: 229189 - DNA, 75 bp, Artificial Sequence
  Synthetic
aaggccccaaaaaactacaaagggccccagaagatcaaggggcccaaaattaccactcattagatgcgtggaaac

SEQ ID NO: 229190 - DNA, 75 bp, Artificial Sequence
  Synthetic
tgagccacgcaagatacagatgaagtggataattgtgggagcagtgcttacattcttatctctaatacctggggg

SEQ ID NO: 229191 - DNA, 75 bp, Artificial Sequence
  Synthetic
ggcaatggaacactcctccctgtctacttccctttcaagggctggtggtgaatcatcatctgacactgtttggca

SEQ ID NO: 229192 - DNA, 75 bp, Artificial Sequence
  Synthetic
acttccctttcaagggctggtggtgaatcatcatctgacactgtttggcaagttttgaacacagctgtttcagca

SEQ ID NO: 229193 - DNA, 75 bp, Artificial Sequence
  Synthetic
gaggtgcgtacctgctaatttcccattattaggacatttaccaattaatagacccatttttgatgataagaaacc

SEQ ID NO: 229194 - DNA, 75 bp, Artificial Sequence
  Synthetic
tcaactggctggtcaaaggtggctggtggtttgtcaagcttattgctgggcgtgctcgcactggtgcacgcaggt

SEQ ID NO: 229195 - DNA, 75 bp, Artificial Sequence
  Synthetic
gtggtttgtcaagcttattgctgggcgtgctcgcactggtgcacgcaggttctatgtctatcctagctatcaaga

SEQ ID NO: 229196 - DNA, 75 bp, Artificial Sequence
  Synthetic
aggaatatggaccaactacatggggcccacaagcttttatcaaatcttttgacaaatttttctatgcagaaccaa

SEQ ID NO: 229197 - DNA, 75 bp, Artificial Sequence
  Synthetic
tgcaccggcggcgtatccacttacgccaggcagagcaatccagtgcgcaccacacttcaatttacacaaatgaat

SEQ ID NO: 229198 - DNA, 75 bp, Artificial Sequence
  Synthetic
ttgattttttctcagaatatccgcagttgtgtgctttcgctgattgggcaacttatcgcgagtttcggtatctag

SEQ ID NO: 229199 - DNA, 75 bp, Artificial Sequence
  Synthetic
gttgtgtgctttcgctgattgggcaacttatcgcgagtttcggtatctagaggatactagagtaatacatataac

SEQ ID NO: 229200 - DNA, 75 bp, Artificial Sequence
  Synthetic
ccaggcagagcaatccagtgcgcaccacacttcaatttacacaaatgaatcaacctagccttggtcatggtgcca

SEQ ID NO: 229201 - DNA, 75 bp, Artificial Sequence
  Synthetic
cccagagcctggtgaccagttcaaagttatcatgactgttggtgcattagtgcggcctaacaggtctgacaccca

SEQ ID NO: 229202 - DNA, 75 bp, Artificial Sequence
  Synthetic
gttatcatgactgttggtgcattagtgcggcctaacaggtctgacacccagaattggctgttcaagacaaccact

SEQ ID NO: 229203 - DNA, 75 bp, Artificial Sequence
  Synthetic
ataagagaattcactagggtctttaaaggagacaaacctgaagtactttggtacctatttctcaagaaagagatc

SEQ ID NO: 229204 - DNA, 75 bp, Artificial Sequence
  Synthetic
gagttggctggaatacacagcattatttgaccatacaaggctttcttctcatagacagcctggagtggttaacac

SEQ ID NO: 229205 - DNA, 75 bp, Artificial Sequence
  Synthetic
tttgaccatacaaggctttcttctcatagacagcctggagtggttaacacctagcttgcaagaatcccaagaacc

SEQ ID NO: 229206 - DNA, 75 bp, Artificial Sequence
  Synthetic
tacattggcatacataagaaagcattagtgtatttcatgcagcagtatgtgaacccacatactaacaacaaacat

SEQ ID NO: 229207 - DNA, 75 bp, Artificial Sequence
  Synthetic
tagtgtatttcatgcagcagtatgtgaacccacatactaacaacaaacatcaggtgtccagcattttcctgataa

SEQ ID NO: 229208 - DNA, 75 bp, Artificial Sequence
  Synthetic
aaattatatgagctacttctttagggaaagccaaagtgaccagaatgtggcaaatctgaaaatacgcccacaaac

SEQ ID NO: 229209 - DNA, 75 bp, Artificial Sequence
  Synthetic
cgtgggaagtggtatctggtcacaaacactgccattaggaatggaccacctccatcagggtgggtctgggacaac

SEQ ID NO: 229210 - DNA, 75 bp, Artificial Sequence
  Synthetic
cctccttaatcgccacgtacttctaccatctggcgaagtcaccttgcaaacccgaggcaacccatctgggcagtt

SEQ ID NO: 229211 - DNA, 75 bp, Artificial Sequence
  Synthetic
ctttataaatccacccccacagaattccaagatctattttgaagtgcacacaacaatgccccagtcgagtgtgag

SEQ ID NO: 229212 - DNA, 75 bp, Artificial Sequence
  Synthetic
agtttgcttattttaatggcccagacaaagatctttggaagacttatgacactgtggtttatggagatgataggc

SEQ ID NO: 229213 - DNA, 75 bp, Artificial Sequence
  Synthetic
attgataactggcaggagccagatgaatatctccagacctcgactgaagagagtgactatgagacagattctcta

SEQ ID NO: 229214 - DNA, 75 bp, Artificial Sequence
  Synthetic
aatatctccagacctcgactgaagagagtgactatgagacagattctctagaagatgaatctgatgatgaagaca

SEQ ID NO: 229215 - DNA, 75 bp, Artificial Sequence
  Synthetic
caactatgaggagagagtcataactatgtatagagacatctttggcatgtgggttaaacctgggaaggttatttg

SEQ ID NO: 229216 - DNA, 75 bp, Artificial Sequence
  Synthetic
taacactcttgttaaccagggcatcagtagggagcgtgctatgtacattggaatgtcagcatatcctaatgatga

SEQ ID NO: 229217 - DNA, 75 bp, Artificial Sequence
  Synthetic
agtagtgtacccctaggttacaacatacaacgattctaagaacatatcaatcaaaaatgaatcctgataaaattg

SEQ ID NO: 229218 - DNA, 75 bp, Artificial Sequence
  Synthetic
cagaaatgttcttaggaacattcagattctacccacttgcaattggcatctacaaggttcaaaagaaagaaatgg

SEQ ID NO: 229219 - DNA, 75 bp, Artificial Sequence
  Synthetic
tcaaaaatgaatcctgataaaattgaggaataccgtaataggattgaattgtgccgagacccagaaagagctcag

SEQ ID NO: 229220 - DNA, 75 bp, Artificial Sequence
  Synthetic
atccaaaatatctggaaaagacaatgaggcagcgctatatggggctagaagcatccagttggacagtgagcaaag

SEQ ID NO: 229221 - DNA, 75 bp, Artificial Sequence
  Synthetic
gagatatggagagctttactggttgaaaggcataattacttctctagagaattttgtgattctgcaggatgggag

SEQ ID NO: 229222 - DNA, 75 bp, Artificial Sequence
  Synthetic
tctcagaagttcagagtgctttaacagttgtctcaggcttaggctggaagaaaactaacgtcagtgctgcagctc

SEQ ID NO: 229223 - DNA, 75 bp, Artificial Sequence
  Synthetic
attttgtgattctgcaggatgggagtacaggaatgatgtgccgtctgaagatatttgctcagaagttctaccgaa

SEQ ID NO: 229224 - DNA, 75 bp, Artificial Sequence
  Synthetic
tgatattgctaggcgggttaggtattgcacacctgacaactactatatagacactaatgggaaaatttacatcat

SEQ ID NO: 229225 - DNA, 75 bp, Artificial Sequence
  Synthetic
gtgaattcttggcaaaattcggaataaatatgtaaacaaattgagtaattgaatctggctaaaaatttctacttg

SEQ ID NO: 229226 - DNA, 75 bp, Artificial Sequence
  Synthetic
tgactttaaagtagccatagatgaaagaagtgcaagggaggcccgagaaaagtacaatgaaatttttggtgaaat

SEQ ID NO: 229227 - DNA, 75 bp, Artificial Sequence
  Synthetic
aatttggcaaaaagggcaatagcgccaccaactttagtctttgttttttagggtaaatgagggcctgaggatatc

SEQ ID NO: 229228 - DNA, 75 bp, Artificial Sequence
  Synthetic
attcaatgcaaatggaatagattatgagatcgtgattataaagcataatccaacgacaaacactaccatgataga

SEQ ID NO: 229229 - DNA, 75 bp, Artificial Sequence
  Synthetic
atgatcgctgtacttttgctatcagctgttgctgcaatagcttcagcacaccctcttactaaaagccacataggc

SEQ ID NO: 229230 - DNA, 75 bp, Artificial Sequence
  Synthetic
gagggcctgaggatatcagcaaaatttatcacattatatcagtattttaaaagttttacggtggagcacactact

SEQ ID NO: 229231 - DNA, 75 bp, Artificial Sequence
  Synthetic
ctcagataatttaaggagagaattaggccacataaaccttactatagacctatcttggttttttgaattaaaaga

SEQ ID NO: 229232 - DNA, 75 bp, Artificial Sequence
  Synthetic
ctgttgctgcaatagcttcagcacaccctcttactaaaagccacataggcgagaggtgttttgcaggaggctcca

SEQ ID NO: 229233 - DNA, 75 bp, Artificial Sequence
  Synthetic
tattaaaagatgttaaccaaactacgggcataggtgaagtctgtgtaaaagatgacatatctataatcaaaagtg

SEQ ID NO: 229234 - DNA, 75 bp, Artificial Sequence
  Synthetic
tcgttataccaagaaaagaaggcaaggtctcaatgaattggataaggttctacagagtgtacattgtcaaagact

SEQ ID NO: 229235 - DNA, 75 bp, Artificial Sequence
  Synthetic
gccctggcttgaagaggatacaccagagttatttgagcatagaaagtttttagaatttatagaatctatgcctga

SEQ ID NO: 229236 - DNA, 75 bp, Artificial Sequence
  Synthetic
tacagagtgtacattgtcaaagactggcacgactgcaatccaattgtagacaagaaaggagatttcatgatactg

SEQ ID NO: 229237 - DNA, 75 bp, Artificial Sequence
  Synthetic
agaagaacgtgagactttctttcaagcattaggctttcgttctgatgacgcatcaaaatggaatgaatgcttaca

SEQ ID NO: 229238 - DNA, 75 bp, Artificial Sequence
  Synthetic
aaccataatggatcaatataaaagtcggtataattcctttatcagaaagagtgcccaagagatcttcaatacatc

SEQ ID NO: 229239 - DNA, 75 bp, Artificial Sequence
  Synthetic
gtgcccaagagatcttcaatacatctgggcaatatcctagaccaacaaaggaagctatcgacgagggatgggcgg

SEQ ID NO: 229240 - DNA, 75 bp, Artificial Sequence
  Synthetic
aaatggttgccagagttaaaaacgaaagaaatgtaaccactgatatggcaaaacagaaacctagctttcatttta

SEQ ID NO: 229241 - DNA, 75 bp, Artificial Sequence
  Synthetic
cattagagcatacttgtgagcatttaactgccacatgtggtcaaaaaacattaaggttccatgcttgttttaggc

SEQ ID NO: 229242 - DNA, 75 bp, Artificial Sequence
  Synthetic
aactgccacatgtggtcaaaaaacattaaggttccatgcttgttttaggcagcataggtcatgtgtgaggtattt

SEQ ID NO: 229243 - DNA, 75 bp, Artificial Sequence
  Synthetic
tctggtcacccaactcggatgagtcaaattccaatataccgaaaatactaaaactgtcaaaaaaattacaatcta

SEQ ID NO: 229244 - DNA, 75 bp, Artificial Sequence
  Synthetic
aagaaatgtaaccactgatatggcaaaacagaaacctagctttcattttatctggtcacccaactcggatgagtc

SEQ ID NO: 229245 - DNA, 75 bp, Artificial Sequence
  Synthetic
taacaggggtagggtcatttgtaaaggccttccgatcactaggaaagttgatggatttcagtggcgatatctctg

SEQ ID NO: 229246 - DNA, 75 bp, Artificial Sequence
  Synthetic
tacgtttgtagcatttgcatttagtatgattataacaagaacttatattgcttatttaatgatccctgtctttta

SEQ ID NO: 229247 - DNA, 75 bp, Artificial Sequence
  Synthetic
ggtatgagaggttttgtaacaaattgaaaatcgatgccaggtcgacacctaaacgattagacaaaaagatagagg

SEQ ID NO: 229248 - DNA, 75 bp, Artificial Sequence
  Synthetic
cccggctacttatatatacggaaaactttacaataaatacttcaagttatgtgtcaattgcaacttagcagtgca

SEQ ID NO: 229249 - DNA, 75 bp, Artificial Sequence
  Synthetic
agttcacatcagggacttgtactgcattatgggagcagcagtttaaattggacacagctgttattactaaagaag

SEQ ID NO: 229250 - DNA, 75 bp, Artificial Sequence
  Synthetic
tccgttcaatgattgtggaaatttatgtgtatgtggatccaggttcacatgtacagagcaagtgaaggtccatcg

SEQ ID NO: 229251 - DNA, 75 bp, Artificial Sequence
  Synthetic
attatgggagcagcagtttaaattggacacagctgttattactaaagaagatcggatacatttaatgaaggatta

SEQ ID NO: 229252 - DNA, 75 bp, Artificial Sequence
  Synthetic
ttttgggataggaaatcataaatcatttgctaagagactaaatgatgatttagatttagataagcctaccatttt

SEQ ID NO: 229253 - DNA, 75 bp, Artificial Sequence
  Synthetic
ggatttcaatgatcctgatattatcaggaaatgtaaggcccaatacaacaatgtagaagagatactaggaaaagt

SEQ ID NO: 229254 - DNA, 75 bp, Artificial Sequence
  Synthetic
tatctctgccatactggctggtatcttcttattttcgtttataacaccaataaacgcagatgagagattgtataa

SEQ ID NO: 229255 - DNA, 75 bp, Artificial Sequence
  Synthetic
ttcttattttcgtttataacaccaataaacgcagatgagagattgtataagctagacgagttagcagatgatttt

SEQ ID NO: 229256 - DNA, 75 bp, Artificial Sequence
  Synthetic
caatcgtttagacaaaattggaaattacttagatcactattcacccaaaatccagagtgcaagtacaaaaatgtg

SEQ ID NO: 229257 - DNA, 75 bp, Artificial Sequence
  Synthetic
ggacgtggttttcaaaatatccaaaacacaattttggcaatgcataaacgattactccacactgatgaagaatat

SEQ ID NO: 229258 - DNA, 75 bp, Artificial Sequence
  Synthetic
acacaattttggcaatgcataaacgattactccacactgatgaagaatatgcttgctgtatctcaatacaacaaa

SEQ ID NO: 229259 - DNA, 75 bp, Artificial Sequence
  Synthetic
gcttgctgtatctcaatacaacaaatacaacactttccgagtagtcacttgtgcaaataacaacatcttcggcat

SEQ ID NO: 229260 - DNA, 75 bp, Artificial Sequence
  Synthetic
tgtgatgccgagctcagacatcaagacaaaaaaagcaacactagtatattgtgttgtaaccattcatagcaatga

SEQ ID NO: 229261 - DNA, 75 bp, Artificial Sequence
  Synthetic
cagatgaagatggttatgaaatccccctaagagacatgcacaagcaacaggaatcatgcaaatatatttctgtta

SEQ ID NO: 229262 - DNA, 75 bp, Artificial Sequence
  Synthetic
agaagatgttgcacaccttggttcattgtatgggacctttaggtcttctaactgttatgtcagcatatctaaggc

SEQ ID NO: 229263 - DNA, 75 bp, Artificial Sequence
  Synthetic
cctaagagacatgcacaagcaacaggaatcatgcaaatatatttctgttagaaatcactatagaaatatgaaaat

SEQ ID NO: 229264 - DNA, 75 bp, Artificial Sequence
  Synthetic
atttagactagataaagagagatgtcaaagaatagtctcttcaccaggtctatttatgatgacagcatgtctatt

SEQ ID NO: 229265 - DNA, 75 bp, Artificial Sequence
  Synthetic
cattggagacaataataccttacacttcgacaacctcttgaacttctcgtttcatacatcagtctcgataacaaa

SEQ ID NO: 229266 - DNA, 75 bp, Artificial Sequence
  Synthetic
atttgttattgataaaattaatttaacaagatgctttggccactttttgaacttaacagattgcagcctaactaa

SEQ ID NO: 229267 - DNA, 75 bp, Artificial Sequence
  Synthetic
ttcgacaacctcttgaacttctcgtttcatacatcagtctcgataacaaaggcgatgctatctttgactgaacct

SEQ ID NO: 229268 - DNA, 75 bp, Artificial Sequence
  Synthetic
atatatctctgaaaaattcgccccttatacaaaaactgctttttctgtagttatgacagacctaataaagaaagg

SEQ ID NO: 229269 - DNA, 75 bp, Artificial Sequence
  Synthetic
ttgttacaatgcattcaatcaaagagaaaaagtgcaattgagagatatacatatgacagattatgatgtcacaca

SEQ ID NO: 229270 - DNA, 75 bp, Artificial Sequence
  Synthetic
tatttattttaaaggaaactgtgagaagctcaacactatgaaaggcaactctgggccattcaacgtggcatggag

SEQ ID NO: 229271 - DNA, 75 bp, Artificial Sequence
  Synthetic
ctgggccattcaacgtggcatggaggacctatattaaagcccaccacttggatgcatgtgggcaacttccacaca

SEQ ID NO: 229272 - DNA, 75 bp, Artificial Sequence
  Synthetic
aaaaggtgttcagaaaaaaagagatctaagatcaatctggtttcctggtaaagttgatcttaaagaatatataaa

SEQ ID NO: 229273 - DNA, 75 bp, Artificial Sequence
  Synthetic
ctaagatcaatctggtttcctggtaaagttgatcttaaagaatatataaaccagatatatatgccattttacttt

SEQ ID NO: 229274 - DNA, 75 bp, Artificial Sequence
  Synthetic
ccagatatatatgccattttactttaactctaaaggtttgcatgagaaacatcatgttctagttgatctcgcaaa

SEQ ID NO: 229275 - DNA, 75 bp, Artificial Sequence
  Synthetic
aaccattctggagatagaaaaagatcaaagagaaaatctaccagaaccatggagtgaaaagccaaaaaaacagac

SEQ ID NO: 229276 - DNA, 75 bp, Artificial Sequence
  Synthetic
ggagtgaaaagccaaaaaaacagacagtgaatcttgatatacttatatatgctattgcaaaaaacctgaatctag

SEQ ID NO: 229277 - DNA, 75 bp, Artificial Sequence
  Synthetic
tcggagctagatatacttttaacaaatatggattatagtttgaaaaccaatttacaactaagaggtataatcaga

SEQ ID NO: 229278 - DNA, 75 bp, Artificial Sequence
  Synthetic
acacttcaagacataattttgtaagaagtagagttgagaattctaacaacctaaaaaggtcaataactactattg

SEQ ID NO: 229279 - DNA, 75 bp, Artificial Sequence
  Synthetic
aagtagagttgagaattctaacaacctaaaaaggtcaataactactattgccacttttaccagttccaaatcatg

SEQ ID NO: 229280 - DNA, 75 bp, Artificial Sequence
  Synthetic
ttcgctaagatgatggggaaaatgtctagagctaagccatcaagattgcagaggtcttcaatattttcaataaat

SEQ ID NO: 229281 - DNA, 75 bp, Artificial Sequence
  Synthetic
tatcaaaagaggggattttacagaattcaaaacaaggattcaaaagaaagttgacaagaatataaaaaaagaggt

SEQ ID NO: 229282 - DNA, 75 bp, Artificial Sequence
  Synthetic
gaggagcctgaactgaaagggtctcaattttcagacttcagtatccacaatgaggatattaaaatttgcaaagag

SEQ ID NO: 229283 - DNA, 75 bp, Artificial Sequence
  Synthetic
ttcaaaacaaggattcaaaagaaagttgacaagaatataaaaaaagaggtaaaaaaagtcacgattgctaaccca

SEQ ID NO: 229284 - DNA, 75 bp, Artificial Sequence
  Synthetic
aaaaaaagtcacgattgctaacccatctctgatagaagaaataactaacgacatggaaatacatcatgcaactta

SEQ ID NO: 229285 - DNA, 75 bp, Artificial Sequence
  Synthetic
aaagacagagaacttctcaaaacaatttccttttgtgcaagattgaatctaaatggaaggttttcaaatggccag

SEQ ID NO: 229286 - DNA, 75 bp, Artificial Sequence
  Synthetic
tttagatatcaaaaaagcagtcccagagtatatagattttatgtctaccaaagtatttgatagactttatgaaat

SEQ ID NO: 229287 - DNA, 75 bp, Artificial Sequence
  Synthetic
actaaaagaaaacaaatacaatactgaaaggacaatagatattatctttaaagtaatgcatgaacatacagagtt

SEQ ID NO: 229288 - DNA, 75 bp, Artificial Sequence
  Synthetic
gaaaggacaatagatattatctttaaagtaatgcatgaacatacagagtttgtttttgcattttttaataaaggc

SEQ ID NO: 229289 - DNA, 75 bp, Artificial Sequence
  Synthetic
cagaagacagctaaagatagagaaatctttttaggtgaatttgaagccaaattgtgtctatacttaattgaaagg

SEQ ID NO: 229290 - DNA, 75 bp, Artificial Sequence
  Synthetic
attgtgtctatacttaattgaaaggatagcaaaagaacgttgcaaactcaatccagatgagatgataagtgaacc

SEQ ID NO: 229291 - DNA, 75 bp, Artificial Sequence
  Synthetic
ggggtctcatggcctgttattcattgtaaaaatgataaatactatcacagtgatactaaagagcatgcaaaagac

SEQ ID NO: 229292 - DNA, 75 bp, Artificial Sequence
  Synthetic
gggagattctaaacttagaatactggagaagcaagctgaagatgaaataaggttccttgcaaaaactatcaaaaa

SEQ ID NO: 229293 - DNA, 75 bp, Artificial Sequence
  Synthetic
ggcaacattaatagttactgcctgtcagaagcttgtaaattagataaactgcctgtacataagtcatggtttaaa

SEQ ID NO: 229294 - DNA, 75 bp, Artificial Sequence
  Synthetic
tgtaaataaagaacttttggataaacttaagataggagcatggggtggagatttcagcctagatgatctaggcca

SEQ ID NO: 229295 - DNA, 75 bp, Artificial Sequence
  Synthetic
gcctgtacataagtcatggtttaaattgtgcaattgggactcagttgtaaaagaagacctcgaaataaaagaatt

SEQ ID NO: 229296 - DNA, 75 bp, Artificial Sequence
  Synthetic
tgacaaggcacatgggatgaaattagaaatcaatgcagacatgtcgaaatggagtgctcaagatgtgatctacaa

SEQ ID NO: 229297 - DNA, 75 bp, Artificial Sequence
  Synthetic
gtacttctggttgattgctatggatcccatcctatacccaaatgaaaaaaagagaatcctctatttcctatgcaa

SEQ ID NO: 229298 - DNA, 75 bp, Artificial Sequence
  Synthetic
ttatatggaaaagaagctactcttacctgatgagttaatgcagataattctagatcagagagttcctagatacaa

SEQ ID NO: 229299 - DNA, 75 bp, Artificial Sequence
  Synthetic
ggaacactcccagccattagtgggttagcagctggttatcatcttagtgcgccagatggacagcaactatttgat

SEQ ID NO: 229300 - DNA, 75 bp, Artificial Sequence
  Synthetic
tgatatcatagggcagatgaccgaaggttaccacagaaattgggtggttattgagagaaattggctccagggaaa

SEQ ID NO: 229301 - DNA, 75 bp, Artificial Sequence
  Synthetic
catgaattatacatccagttaccttcatagttgttctatgtctgtctttaaagatgtaatgagagagtgtgccaa

SEQ ID NO: 229302 - DNA, 75 bp, Artificial Sequence
  Synthetic
aagatgtaatgagagagtgtgccaatctattagaaggggaggtgttagttaactctttagtacattctgatgaca

SEQ ID NO: 229303 - DNA, 75 bp, Artificial Sequence
  Synthetic
atcaaacatccatttgcatggttcaaaacaaagtgaaggatgacaatgttatagaattcacaatcaaattatttg

SEQ ID NO: 229304 - DNA, 75 bp, Artificial Sequence
  Synthetic
aatttatctgcttgacattcggaaaccaagcaaatatgaagaaaacctatgttactaattttattaaagaatttg

SEQ ID NO: 229305 - DNA, 75 bp, Artificial Sequence
  Synthetic
aggctctgagcagacactgattgaggtatgcataagcacacctcatgaaactatgtgcaatgatctagatgtttt

SEQ ID NO: 229306 - DNA, 75 bp, Artificial Sequence
  Synthetic
tctctctttttaatatacatggtgagccattctcagtctacggtaggtttctattaactgctgttggagactgtg

SEQ ID NO: 229307 - DNA, 75 bp, Artificial Sequence
  Synthetic
gccattctcagtctacggtaggtttctattaactgctgttggagactgtgcatatttagggccatatgaagactt

SEQ ID NO: 229308 - DNA, 75 bp, Artificial Sequence
  Synthetic
gaagtatctttccaaacaactcagtctgtgcatatgccaactcttgtgggcttgaggaaagggggcctatatact

SEQ ID NO: 229309 - DNA, 75 bp, Artificial Sequence
  Synthetic
agcaagcagactctcagctactcaaactgctattaaacatggctgcccagcatccttagcatggatttcaatagc

SEQ ID NO: 229310 - DNA, 75 bp, Artificial Sequence
  Synthetic
actgctattaaacatggctgcccagcatccttagcatggatttcaatagctttaaatcattggattacacatact

SEQ ID NO: 229311 - DNA, 75 bp, Artificial Sequence
  Synthetic
tttaaatcattggattacacatactacctacaacatgttgccaaatcaaataaatgacccattacctttttttcc

SEQ ID NO: 229312 - DNA, 75 bp, Artificial Sequence
  Synthetic
cagggaacacctaaatttgactatatctgccatgctgcaaaaaggaaagatgtaattgtcaggaggtgttacaat

SEQ ID NO: 229313 - DNA, 75 bp, Artificial Sequence
  Synthetic
tactacaaatagagaggaaatacccattgaaatgtgcggtctgctcaattcagaacttcaaactatagcactagt

SEQ ID NO: 229314 - DNA, 75 bp, Artificial Sequence
  Synthetic
aaccactatgtaacatgtgaattgttggagaagagaaataatatcctgcacaccatacaaggggctgacatgtat

SEQ ID NO: 229315 - DNA, 75 bp, Artificial Sequence
  Synthetic
cagaacttcaaactatagcactagttggcttagaggcaggaaatttatcatatttaacctcactactcagaagaa

SEQ ID NO: 229316 - DNA, 75 bp, Artificial Sequence
  Synthetic
gcgtcattaagtggcaataacttaggtttgatgaatttccggattgcacttggggatataaactacaaagcattt

SEQ ID NO: 229317 - DNA, 75 bp, Artificial Sequence
  Synthetic
tgtcccctataactcatcaaagagagtctgtacaaagccaatgtagccagataaagacatgggatctaaaattgc

SEQ ID NO: 229318 - DNA, 75 bp, Artificial Sequence
  Synthetic
gtctgtacaaagccaatgtagccagataaagacatgggatctaaaattgctaacatctatggatctaattaagtt

SEQ ID NO: 229319 - DNA, 75 bp, Artificial Sequence
  Synthetic
taacatctatggatctaattaagttaaaatctctaagatacatttctttagatagcgaagttaccactgatgatg

SEQ ID NO: 229320 - DNA, 75 bp, Artificial Sequence
  Synthetic
atgtctatagtctctcaaggtgaaatattgtgcccaataaactcagaatgtgatctatatatgagcaatctacta

SEQ ID NO: 229321 - DNA, 75 bp, Artificial Sequence
  Synthetic
gaatgggtgaaactagcgaaatgaggtctagatctctcctaactcctaggaaattcactaccagtggatcattaa

SEQ ID NO: 229322 - DNA, 75 bp, Artificial Sequence
  Synthetic
attaagcctgaaattgaaaaatatgccatcaagatgtcatgcaaaaaggcatcagactctgttgaaattggaata

SEQ ID NO: 229323 - DNA, 75 bp, Artificial Sequence
  Synthetic
atcgattaatatcatacaatgacttccaaagagtaatatccgatgaggctgaaaaagaaagaatgtttgaatttt

SEQ ID NO: 229324 - DNA, 75 bp, Artificial Sequence
  Synthetic
gaaaaagaaagaatgtttgaattttttgtcagacatcctgaattattagtaacaaaaggtgaaactgctcaagaa

SEQ ID NO: 229325 - DNA, 75 bp, Artificial Sequence
  Synthetic
gatcgacttgtctaaactagacgagtcaaattttgttaaggaagaagatctcaagtgtggaacttggttatgcaa

SEQ ID NO: 229326 - DNA, 75 bp, Artificial Sequence
  Synthetic
tacatgaattctgtagtattcagatataactcaaagaaattcaaagaatcactatctatccaaaatccatcacag

SEQ ID NO: 229327 - DNA, 75 bp, Artificial Sequence
  Synthetic
tcaaattttgttaaggaagaagatctcaagtgtggaacttggttatgcaaagttaaagatgaaggcataggtttt

SEQ ID NO: 229328 - DNA, 75 bp, Artificial Sequence
  Synthetic
cttttcatagagcagatactgttctcaagcaaacctgttatagattacacaagcatacatgataaaatatttgga

SEQ ID NO: 229329 - DNA, 75 bp, Artificial Sequence
  Synthetic
taggaaaaatttggagcattgtcatatattgtttaagtgggatacttgttgtcatgttgctgatatacttcattt

SEQ ID NO: 229330 - DNA, 75 bp, Artificial Sequence
  Synthetic
aagcatacatgataaaatatttggattgcaagaccaccctgacttagaagaaatggacaccattataggcaagaa

SEQ ID NO: 229331 - DNA, 75 bp, Artificial Sequence
  Synthetic
aacatttgttcagagctatgttcaaattatagatgacttgtccaaattcgatttaacccatgatgatatcgaaac

SEQ ID NO: 229332 - DNA, 75 bp, Artificial Sequence
  Synthetic
atgaatcctgataaaattgaggaataccgtaataggattgaattatgccgagacccagaaaaagctcaggagata

SEQ ID NO: 229333 - DNA, 75 bp, Artificial Sequence
  Synthetic
ccatgctgtaagagattaaaaggtgttttagagaagaacgagatggagttcttagcggagcagaaaataaaatag

SEQ ID NO: 229334 - DNA, 75 bp, Artificial Sequence
  Synthetic
agtttactcgtattgcttacttaatgaccctttgttagtaacagcatcgaataacatcgtcatgtctgttaaagg

SEQ ID NO: 229335 - DNA, 75 bp, Artificial Sequence
  Synthetic
agctgaacaagaaagacttggacagtcagcttgcaggatgccagaaatgagaagtttaaaattgatatatcactc

SEQ ID NO: 229336 - DNA, 75 bp, Artificial Sequence
  Synthetic
tgattctgcaggatgggagtataggaatgatgtgccatctgaagatatttgctcggaagtcctaccaaatgatat

SEQ ID NO: 229337 - DNA, 75 bp, Artificial Sequence
  Synthetic
accagcattagtgttaagagcctatgtaaatcagagccctgaggtgccaggtgctgatccagatgaaatgcttag

SEQ ID NO: 229338 - DNA, 75 bp, Artificial Sequence
  Synthetic
tgctaggcgggttaggtattgcacacctgacaactactatatagacactaatgggaaaatttatatcattgactt

SEQ ID NO: 229339 - DNA, 75 bp, Artificial Sequence
  Synthetic
agatttgacacatctagaggaatttattgaaaaaactagacttcgatctcatatgagagaaagaatagagataaa

SEQ ID NO: 229340 - DNA, 75 bp, Artificial Sequence
  Synthetic
taaagtagcaatagatgaaagaagtgcaagagaagcccgagaaaagtacaatgaaatttttggtgaaatattcaa

SEQ ID NO: 229341 - DNA, 75 bp, Artificial Sequence
  Synthetic
ccagaagaaaatgatgaagcgagacatccagttcgaagtaaaagaattgactagattttatcaagttctctatga

SEQ ID NO: 229342 - DNA, 75 bp, Artificial Sequence
  Synthetic
tgcaaatggaatagattatgaggtcgtgattataaaacataatccaacaacaaacactaccatgatagactcaga

SEQ ID NO: 229343 - DNA, 75 bp, Artificial Sequence
  Synthetic
ttacattaagtctactgagcacaaaatcaaggtctttatactcccgtataaagtttatacacctattgatttttg

SEQ ID NO: 229344 - DNA, 75 bp, Artificial Sequence
  Synthetic
ggttttttgaattaaaagacttcctatttggaaaatttaaagatgatgaaagattcctggaaattataaaccaag

SEQ ID NO: 229345 - DNA, 75 bp, Artificial Sequence
  Synthetic
aaagatgacaaatggcatattattcacttcctcaaaaacataatttcaaccacacacaaagctcaagttgcaact

SEQ ID NO: 229346 - DNA, 75 bp, Artificial Sequence
  Synthetic
gagattttactatgaccatgccctggcttgaagaggatacaccagagttatttgagcatagaaagtttttagaat

SEQ ID NO: 229347 - DNA, 75 bp, Artificial Sequence
  Synthetic
acttcctcaaaaacataatttcaaccacacacaaagctcaagttgcaacttcgccagacttggaggttcagcttg

SEQ ID NO: 229348 - DNA, 75 bp, Artificial Sequence
  Synthetic
ctatggagtgttttagactcattgctcatttcggggatatgtttttagcagaagaatctagagtcccattcctca

SEQ ID NO: 229349 - DNA, 75 bp, Artificial Sequence
  Synthetic
ttatagaatctatgcctgaagaagaacgtgagaccttctttcaagcattaggctttcgttctgatgacgcatcaa

SEQ ID NO: 229350 - DNA, 75 bp, Artificial Sequence
  Synthetic
agtggaatgagtgcttacagactataatggatcaatataaaagccggtataattcctttatcagaaagagtgccc

SEQ ID NO: 229351 - DNA, 75 bp, Artificial Sequence
  Synthetic
aaggaattattgaaaagttttcctataaggccatccctgtgtctagactctatgataaattaagagaatctaagc

SEQ ID NO: 229352 - DNA, 75 bp, Artificial Sequence
  Synthetic
atagaataaagtttatacccatattattccatatggatgatttaacacagagggatttaaacaaatatgatgcag

SEQ ID NO: 229353 - DNA, 75 bp, Artificial Sequence
  Synthetic
aagagatcttcaatacatctggacaatatcctagaccaacaaaagaagctattgatgagggatgggcggaaatgg

SEQ ID NO: 229354 - DNA, 75 bp, Artificial Sequence
  Synthetic
acaaatctgatgagagaataacatggaacaactggcaagtatcacgggaaatgaacactggtccgatagatctaa

SEQ ID NO: 229355 - DNA, 75 bp, Artificial Sequence
  Synthetic
ttattactggttatgatagacaaattcagattcggggagaagatgaccaattattaggtgcagaattaaaattag

SEQ ID NO: 229356 - DNA, 75 bp, Artificial Sequence
  Synthetic
cacccaactcggatgagtcaaattccaatataccaaaaatactaaaattgtcaaaaaaattacaatctataacag

SEQ ID NO: 229357 - DNA, 75 bp, Artificial Sequence
  Synthetic
tcagattcggggagaagatgaccaattattaggtgcagaattaaaattagctagagtaagtagagaaaccatttc

SEQ ID NO: 229358 - DNA, 75 bp, Artificial Sequence
  Synthetic
ctagagtaagtagagaaaccatttcaggtcatgctaaatctatccttaacagaaaacatggcttgaagtttgaaa

SEQ ID NO: 229359 - DNA, 75 bp, Artificial Sequence
  Synthetic
gggtaggatcatttgtaaaagcctttcgatcactagggaagttgatggatttcagtggagatatttctgggtatg

SEQ ID NO: 229360 - DNA, 75 bp, Artificial Sequence
  Synthetic
agatgaagaaaatagaggaaatgtctgataaattagactacattgtttaccaacagcggggcaggaataggttct

SEQ ID NO: 229361 - DNA, 75 bp, Artificial Sequence
  Synthetic
agaggttttgtaacaaattgaaaattgatgccaggtcaacacctaagcgattagacaaaaagatagaggaattca

SEQ ID NO: 229362 - DNA, 75 bp, Artificial Sequence
  Synthetic
tgataaattagactacattgtttaccaacagcggggcaggaataggttcttttataatatattgccgaaacagat

SEQ ID NO: 229363 - DNA, 75 bp, Artificial Sequence
  Synthetic
catcaggtacttgtactgcattatgggagcagcaattcaaattggacacagccgttattactaaagaagatcgga

SEQ ID NO: 229364 - DNA, 75 bp, Artificial Sequence
  Synthetic
tatattggaccacaattcaagagtcgacaagacaaaaagcattggagaatcaaaatggatacctgtatgtccagt

SEQ ID NO: 229365 - DNA, 75 bp, Artificial Sequence
  Synthetic
ggagcagcaattcaaattggacacagccgttattactaaagaagatcggatacatttaatgaaggactattttgg

SEQ ID NO: 229366 - DNA, 75 bp, Artificial Sequence
  Synthetic
caaaatggatacctgtatgtccagtagtggtaagaaaattatatcagcaaaagaggccagacaaagacaaaatta

SEQ ID NO: 229367 - DNA, 75 bp, Artificial Sequence
  Synthetic
agtggtaagaaaattatatcagcaaaagaggccagacaaagacaaaattatgagattgaatatgcaggtttacac

SEQ ID NO: 229368 - DNA, 75 bp, Artificial Sequence
  Synthetic
gataggaaatcacaaatcatttgctaagagactaaatgatgatttagatttagataagcctaccattttggattt

SEQ ID NO: 229369 - DNA, 75 bp, Artificial Sequence
  Synthetic
tttgagcaaattacaagtaaatccaaatgagtatgctacagttaggaaagcacatttccaaaagatgacattctt

SEQ ID NO: 229370 - DNA, 75 bp, Artificial Sequence
  Synthetic
caacgatcctgatatcatcaggaaatgtaaggcccaatacaccaatgtagaagagatactgggaaaagtcaattg

SEQ ID NO: 229371 - DNA, 75 bp, Artificial Sequence
  Synthetic
ttctggtccccctattaaaagcggagggatggatatagctgcattgatgtcaagcccaagtctattgagcttgaa

SEQ ID NO: 229372 - DNA, 75 bp, Artificial Sequence
  Synthetic
cttagataaaattggaaattacttagatcactattcacccaagatccagaatgcaagcacaaaaatgtgggatgt

SEQ ID NO: 229373 - DNA, 75 bp, Artificial Sequence
  Synthetic
ttatgatacaatggcacaagcgtccctcattgatatgtgcagagttttcaaatgtgaaggttacaaagaagacca

SEQ ID NO: 229374 - DNA, 75 bp, Artificial Sequence
  Synthetic
gatggcatttgagtttttatcagatgaagtgatgcaagtcgacatagaagagcagttggagtgtaaccccatatt

SEQ ID NO: 229375 - DNA, 75 bp, Artificial Sequence
  Synthetic
tgtatctcaatacaataaatataacactttccgagtagtcacttgtgcaaataacaatgtcttcggtattgtgat

SEQ ID NO: 229376 - DNA, 75 bp, Artificial Sequence
  Synthetic
gaagtgatgcaagtcgacatagaagagcagttggagtgtaaccccatattctctgttgtctacaacaccaaaggt

SEQ ID NO: 229377 - DNA, 75 bp, Artificial Sequence
  Synthetic
gccgagctcagacataaagacaaaaaaagcaacactagtatactgtgttataactattcatagcaatgaagaaga

SEQ ID NO: 229378 - DNA, 75 bp, Artificial Sequence
  Synthetic
gagagaggaatgacctacaaaggggcatttaggactgccttaataagagaatgtgagaaattcgaaaaagcattt

SEQ ID NO: 229379 - DNA, 75 bp, Artificial Sequence
  Synthetic
cgttgcgcaccttggttcattatatgggacctttaggtcttctaactgttatgtcagcatatctaaagcatttag

SEQ ID NO: 229380 - DNA, 75 bp, Artificial Sequence
  Synthetic
gacttccttgacatgggattttgctcaaacgagaatctatcaatactcgaagaaatacattggattgtgattgaa

SEQ ID NO: 229381 - DNA, 75 bp, Artificial Sequence
  Synthetic
actagataaggagagatgtcaaagaatagtctcttcgccaggtctatttatgatgacagcatgcctattcattgg

SEQ ID NO: 229382 - DNA, 75 bp, Artificial Sequence
  Synthetic
ttaaaaactaaccaatggtcaacagaattagaccaatgtatacacatgtgtatgtatagaaacaacatggatcca

SEQ ID NO: 229383 - DNA, 75 bp, Artificial Sequence
  Synthetic
agacaataataccttacactttgacaaccttttgaacttctcatttcatacatcagtctcaataacaaaggcaat

SEQ ID NO: 229384 - DNA, 75 bp, Artificial Sequence
  Synthetic
tatgtatagaaacaacatggatccagagtttcaccaatttgacatccctaaagtattcttagaagacccgatttt

SEQ ID NO: 229385 - DNA, 75 bp, Artificial Sequence
  Synthetic
aaggacaattaagtggaagcgtgtgcggaaatttttagaagttcttcgagatttcaaggtcaaagaagaaccttg

SEQ ID NO: 229386 - DNA, 75 bp, Artificial Sequence
  Synthetic
gctatctttaactgaaccttctagatatatgatgatgaactcgttagcaatgtctagtcatgttaaagaatatat

SEQ ID NO: 229387 - DNA, 75 bp, Artificial Sequence
  Synthetic
cggaaatttttagaagttcttcgagatttcaaggtcaaagaagaaccttggaagtcaatcattcagcatttttgc

SEQ ID NO: 229388 - DNA, 75 bp, Artificial Sequence
  Synthetic
ctccgaaaagtttgctccctatacaaaaactgctttttccgtagttatgacagacctaataaaaaaaggctgtta

SEQ ID NO: 229389 - DNA, 75 bp, Artificial Sequence
  Synthetic
gaagtcaatcattcagcatttttgcgacaaagcattcagattaaccaatgaaaggattagacagaaccaaaaatc

SEQ ID NO: 229390 - DNA, 75 bp, Artificial Sequence
  Synthetic
agaagggtttgaagctttcatagaccctgaaaaaagaggtggtagatccaaatttgaatttaattagagtaattc

SEQ ID NO: 229391 - DNA, 75 bp, Artificial Sequence
  Synthetic
agtgtgcccacaaaatttaaaattcactttaatgacctttttgtaaatatattaatgttcctaggggcacactac

SEQ ID NO: 229392 - DNA, 75 bp, Artificial Sequence
  Synthetic
gtgtgcccacaaaatttaaaattcactttaatgacctttttgtaaatatattaatgttcctaggggcacactact

SEQ ID NO: 229393 - DNA, 75 bp, Artificial Sequence
  Synthetic
agtagtgtactccacaattcaaaaacttaaagtcctttaatagtatggcagatgcgatagttttcaatgatgtac

SEQ ID NO: 229394 - DNA, 75 bp, Artificial Sequence
  Synthetic
atatatgccattttactttaactctaaaggcttacatgaaaaacatcacgtcctagttgatctcgcaaaaaccat

SEQ ID NO: 229395 - DNA, 75 bp, Artificial Sequence
  Synthetic
ctcagcgggctcaatctacgtttgatccggaggcacaatatgtggcatttgaaaatacatacagggcaaacctca

SEQ ID NO: 229396 - DNA, 75 bp, Artificial Sequence
  Synthetic
tctggagatagaaaaagatcaaagagaaaatctaccggagccatggagtgaaaagccaaaaaaacagacagtgaa

SEQ ID NO: 229397 - DNA, 75 bp, Artificial Sequence
  Synthetic
ctgttaacaccgctcgagttttcttcctcaatcagaagagagccaaagatactttacgtcagacgccgaggccca

SEQ ID NO: 229398 - DNA, 75 bp, Artificial Sequence
  Synthetic
aaaagccaaaaaaacagacagtgaatcttgatatacttatatacgctattgcaaaaaacctaaatctagacactt

SEQ ID NO: 229399 - DNA, 75 bp, Artificial Sequence
  Synthetic
atgttaatcttacttttggacagtgcacatttccagtggttaataaccattttccacaattccaatcgaatccgg

SEQ ID NO: 229400 - DNA, 75 bp, Artificial Sequence
  Synthetic
agttgagaattctaacaacctaaaaaggtcaataactactattgccaccttcaccagttccaaatcgtgcatcaa

SEQ ID NO: 229401 - DNA, 75 bp, Artificial Sequence
  Synthetic
ttaacgatacagcccttaccttgcaccgcctctctggataccttgcgagatggctgatgactttctatgcccaga

SEQ ID NO: 229402 - DNA, 75 bp, Artificial Sequence
  Synthetic
gcccagtcaaccaggcagctgtccgtgaggcagttatcattcccctggctgaggttaagggttgttcatgggatg

SEQ ID NO: 229403 - DNA, 75 bp, Artificial Sequence
  Synthetic
agtcacgattgctaacccatccttgatagaagaaataactaacgacatggaaatacatcatgcaacttatctaga

SEQ ID NO: 229404 - DNA, 75 bp, Artificial Sequence
  Synthetic
atggacctgccctctaccttggatttgctgcaggtgcagagatgtttctgcagacatttactttttttccacttg

SEQ ID NO: 229405 - DNA, 75 bp, Artificial Sequence
  Synthetic
tataaaaaaagcagtcccagagtatatagatttcatgtctaccaaagtatttgatagactttatgaaatactgaa

SEQ ID NO: 229406 - DNA, 75 bp, Artificial Sequence
  Synthetic
tgattgagatgcaccgcgtactgaaagatgggatggatgtcaactttatgagaaaagttctgcgccaacgatatg

SEQ ID NO: 229407 - DNA, 75 bp, Artificial Sequence
  Synthetic
agaagacaaatataaaactgaaaggacaatagatattatctttaaagtgatgcatgaacatacagagtttgtttt

SEQ ID NO: 229408 - DNA, 75 bp, Artificial Sequence
  Synthetic
acaatagatattatctttaaagtgatgcatgaacatacagagtttgtttttgcatttttcaataagggccagaag

SEQ ID NO: 229409 - DNA, 75 bp, Artificial Sequence
  Synthetic
gcgcactgactgcagaacaatggatgaggcaggagatagtggcaattagggcagcatttgaggctgttggcgcac

SEQ ID NO: 229410 - DNA, 75 bp, Artificial Sequence
  Synthetic
ttccttgggcaagaactggattctcgccagctgccagggaattccttgctcaatttggaatccgtatctaaatca

SEQ ID NO: 229411 - DNA, 75 bp, Artificial Sequence
  Synthetic
tctatacttaattgaaaggatagcaaaagaacgttgcaaactcaatccagatgagatgattagtgaaccaggaga

SEQ ID NO: 229412 - DNA, 75 bp, Artificial Sequence
  Synthetic
aaaaaagcccccgtagttggagtaccgataaaataaataaaaacacaaaaaaatacataaaataataaaacaaaa

SEQ ID NO: 229413 - DNA, 75 bp, Artificial Sequence
  Synthetic
ttctaaacttagaatactggagaagcaagcagaagatgaaataaggttccttgcaaaaactattaaaaatgtaaa

SEQ ID NO: 229414 - DNA, 75 bp, Artificial Sequence
  Synthetic
taaaaaatataaaaataataaaaacaaaaataaaaatatagtagtacttggactagccgagtactacaacaatag

SEQ ID NO: 229415 - DNA, 75 bp, Artificial Sequence
  Synthetic
taaagaacttttagacaaacttaagataggagcatggggtggggatttcagcctagatgatctaggtcatgacaa

SEQ ID NO: 229416 - DNA, 75 bp, Artificial Sequence
  Synthetic
cagctgctaatgtcgttgtaagttctccacttcaatttataataaggtctgtataatcatctttgaattgggagc

SEQ ID NO: 229417 - DNA, 75 bp, Artificial Sequence
  Synthetic
ggcacatgggatgaaactagaaattaatgcagatatgtcaaaatggagtgctcaggatgtaatctacaagtactt

SEQ ID NO: 229418 - DNA, 75 bp, Artificial Sequence
  Synthetic
agtagtgtactaccacatacaacaaacttttcagagaattaaaatgatcgctgtacttttgctatcagctgttgc

SEQ ID NO: 229419 - DNA, 75 bp, Artificial Sequence
  Synthetic
aatgtcgttgtaagttctccacttcaatttataataaggtctgtataatcatctttgaattgggagcacactact

SEQ ID NO: 229420 - DNA, 75 bp, Artificial Sequence
  Synthetic
ctggctgattgctatggatcccatcctctacccaaatgaaaaaaagagaatcctctatttcctatgcaattatat

SEQ ID NO: 229421 - DNA, 75 bp, Artificial Sequence
  Synthetic
ctgtacttttgctatcagctgttgctgcaatagcttcagcacaccctcttgctaaaagccacatgggcgagaggt

SEQ ID NO: 229422 - DNA, 75 bp, Artificial Sequence
  Synthetic
gttttgcaggaggctccatattaaaagatgttaaccaaactacgggcataggtgaagtctgtgtaaaggatgaca

SEQ ID NO: 229423 - DNA, 75 bp, Artificial Sequence
  Synthetic
ggaaaaaaagttactcttacctgatgagttaatgcagataattctagaccagagagtccctagatacaatgacat

SEQ ID NO: 229424 - DNA, 75 bp, Artificial Sequence
  Synthetic
tatcaataatcaaaagtgtcgttataccaagaaaagaaggcaaggtctcaatgaattggataagattctatagag

SEQ ID NO: 229425 - DNA, 75 bp, Artificial Sequence
  Synthetic
catagggcagatgaccgaaggttaccacagaaattgggtagtcatcgagagaaattggctccaaggaaacatgaa

SEQ ID NO: 229426 - DNA, 75 bp, Artificial Sequence
  Synthetic
atgaattggataagattctatagagtgtacattgtcaaagactggcacgactgtaatccaattgtagacaaaaaa

SEQ ID NO: 229427 - DNA, 75 bp, Artificial Sequence
  Synthetic
ttatacatccagttaccttcatagttgttctatgtctgtttttaaagatgtgatgagagagtgtgccaatctatt

SEQ ID NO: 229428 - DNA, 75 bp, Artificial Sequence
  Synthetic
ggagatttcatgatactggatgtaacagaggcagggactctagtccctaaaatgcatatttgcagagctacatgt

SEQ ID NO: 229429 - DNA, 75 bp, Artificial Sequence
  Synthetic
tgatgagagagtgtgccaatctattagaaggagaagtgttagttaactctctagtacattctgatgataatcaaa

SEQ ID NO: 229430 - DNA, 75 bp, Artificial Sequence
  Synthetic
gatatatccctcgatagagataacgcggaaatcattttcatgtcatccaaaacaaatcactatgaagtctcaggt

SEQ ID NO: 229431 - DNA, 75 bp, Artificial Sequence
  Synthetic
catccatttgcatggttcaaaacaaagtgaaggatgacaatgttatagaattcacaatcaaattatttgagttta

SEQ ID NO: 229432 - DNA, 75 bp, Artificial Sequence
  Synthetic
actactgtgataaatggctggtttaagcaaactataagtgtgtcattagagcatacttgtgagcatttaactgcc

SEQ ID NO: 229433 - DNA, 75 bp, Artificial Sequence
  Synthetic
tctgcttgacattcgggaaccaagcaaatatgaagaaaacttatgttactaattttattaaagaatttgtctctc

SEQ ID NO: 229434 - DNA, 75 bp, Artificial Sequence
  Synthetic
gcatacttgtgagcatttaactgccacatgtggtcaaaaaacattaaggttccatgcttgttttaggcaacacag

SEQ ID NO: 229435 - DNA, 75 bp, Artificial Sequence
  Synthetic
tttttaatattcatggtgagccattttcagtctacggtaggtttctattaactgctgttggagactgtgcatatt

SEQ ID NO: 229436 - DNA, 75 bp, Artificial Sequence
  Synthetic
ttcagtctacggtaggtttctattaactgctgttggagactgtgcatatttagggccatatgaggacttagcaag

SEQ ID NO: 229437 - DNA, 75 bp, Artificial Sequence
  Synthetic
gtcatgtgtgaggtatttcaaaaatagttacataccatataggatgatagaatctatgtgccagaatcttgaact

SEQ ID NO: 229438 - DNA, 75 bp, Artificial Sequence
  Synthetic
aataataatgatattatttacgtttgtagcatttgcatttagtatgattataacaagaacttatattgcttattt

SEQ ID NO: 229439 - DNA, 75 bp, Artificial Sequence
  Synthetic
tcattggattacacatactacctacaacatgctgccaaaccaaataaatgacccattgcctttttttcctactac

SEQ ID NO: 229440 - DNA, 75 bp, Artificial Sequence
  Synthetic
acttatatatacggaaaactttacaataaatacttcaagttatgtgtcaattgcaacttagcagtgcacccgttc

SEQ ID NO: 229441 - DNA, 75 bp, Artificial Sequence
  Synthetic
aaatagagaggaaatacctattgaaatgtgcggtttgctcaattcagaactccaaactatagcactagttggctt

SEQ ID NO: 229442 - DNA, 75 bp, Artificial Sequence
  Synthetic
ttgcaacttagcagtgcacccgttcaataattgtggaaatttatgtatatgtggatccagattcacatgcacaga

SEQ ID NO: 229443 - DNA, 75 bp, Artificial Sequence
  Synthetic
tccaaactatagcactagttggcttagaggcagggaatttatcatatttaacttcactactcagaagaatgtctc

SEQ ID NO: 229444 - DNA, 75 bp, Artificial Sequence
  Synthetic
gcaagtgaaggtccatcggatatgtggagcttgtcccggatacaagtcattgagcaaagccagggctatgtgtaa

SEQ ID NO: 229445 - DNA, 75 bp, Artificial Sequence
  Synthetic
ggagcttgtcccggatacaagtcattgagcaaagccagggctatgtgtaaatctaaaacctggtcattcatctct

SEQ ID NO: 229446 - DNA, 75 bp, Artificial Sequence
  Synthetic
atctaaaacctggtcattcatctctgctatactggctggtatcttcttattttcatttataacaccaataaacgc

SEQ ID NO: 229447 - DNA, 75 bp, Artificial Sequence
  Synthetic
ctatggatctaattaagttgaaatctttaagatacatttcattagatagcgaagttaccactgatgatggaatgg

SEQ ID NO: 229448 - DNA, 75 bp, Artificial Sequence
  Synthetic
gctatactggctggtatcttcttattttcatttataacaccaataaacgcagatgagagactgtataagttagac

SEQ ID NO: 229449 - DNA, 75 bp, Artificial Sequence
  Synthetic
gagttagcagatgattttatcgaaatttctaataaattatcagagaaccaatttaatagaatggtgtacaaaatc

SEQ ID NO: 229450 - DNA, 75 bp, Artificial Sequence
  Synthetic
gtgaaactagcgaaatgagatctagatctcttttaactcctaggaaatttactactagtggatcattaaatcgat

SEQ ID NO: 229451 - DNA, 75 bp, Artificial Sequence
  Synthetic
acattgtctacgattctaggtataattatggctatacttctatctgaaaaatgtgtttttaataaaatgttcaac

SEQ ID NO: 229452 - DNA, 75 bp, Artificial Sequence
  Synthetic
taatatcatacaatgactttcaaagagtaatatctgatgaggctgaaaaagaaagaatgtttgagttttttgtta

SEQ ID NO: 229453 - DNA, 75 bp, Artificial Sequence
  Synthetic
gaaagaatgtttgagttttttgttagacatcctgaattattagtaacaaagggcgaaactgctcaagaatacatg

SEQ ID NO: 229454 - DNA, 75 bp, Artificial Sequence
  Synthetic
catttctatagacactgttctatatgcagcatgatacattatagacctggactaagattcaactcatctgtgaca

SEQ ID NO: 229455 - DNA, 75 bp, Artificial Sequence
  Synthetic
actaagattcaactcatctgtgacaaataggtgcgggacatgtatctgtggatataatgagcagcagccagatga

SEQ ID NO: 229456 - DNA, 75 bp, Artificial Sequence
  Synthetic
aaatggttatgaaatccccctaagagacatgcacaagcaacaggagtcatgcaagtatatttctgttagaaatca

SEQ ID NO: 229457 - DNA, 75 bp, Artificial Sequence
  Synthetic
acatgataaaatatttggattgcaagaccaccctgacttagaagaaatggacactattataggcaagaagacatt

SEQ ID NO: 229458 - DNA, 75 bp, Artificial Sequence
  Synthetic
ttatagaaatatgaaaataatattgattatattagttttaaccactcaagttattactgcttcatctgacgaaaa

SEQ ID NO: 229459 - DNA, 75 bp, Artificial Sequence
  Synthetic
ttattactgcttcatctgacgaaaaagagtgcttaaaatatccatttgttattgataaaattaacttaacaagat

SEQ ID NO: 229460 - DNA, 75 bp, Artificial Sequence
  Synthetic
tgttcagagctatgttcaaattatagatgacttgtctaaatttgacttaacccacgatgatattgaaacagttta

SEQ ID NO: 229461 - DNA, 75 bp, Artificial Sequence
  Synthetic
agagtgcttaaaatatccatttgttattgataaaattaacttaacaagatgctttggccattttttgaatctaac

SEQ ID NO: 229462 - DNA, 75 bp, Artificial Sequence
  Synthetic
ctcgtattgcttacttaatgaccctttgttagtaacagcatcgaataacatcgtcatgtctgttaaaggagctga

SEQ ID NO: 229463 - DNA, 75 bp, Artificial Sequence
  Synthetic
agattgtagcctaactaacaaagagagactttttacgagtttaaaatctgaaaaccttattactgacatggataa

SEQ ID NO: 229464 - DNA, 75 bp, Artificial Sequence
  Synthetic
acaggaaaggcttggacagtcagcttgcagaatgccagaaatgaggagtttaaaattgatatatcactcgccagc

SEQ ID NO: 229465 - DNA, 75 bp, Artificial Sequence
  Synthetic
aatagattttgacatactagattataaatcagatactgcttttgaaaggatagagatgtcccaagacttacacaa

SEQ ID NO: 229466 - DNA, 75 bp, Artificial Sequence
  Synthetic
aaatcagatactgcttttgaaaggatagagatgtcccaagacttacacaagatgatactattagagtatatttat

SEQ ID NO: 229467 - DNA, 75 bp, Artificial Sequence
  Synthetic
attagtgttaagagcctatgtaaaccagagccctgaggtgccaggtgctgagccagatgaaatgcttagagattt

SEQ ID NO: 229468 - DNA, 75 bp, Artificial Sequence
  Synthetic
gatgatactattagagtatatttatttcaaaggaaactgcgagaagctcaacactatgaaaggcaactctgggcc

SEQ ID NO: 229469 - DNA, 75 bp, Artificial Sequence
  Synthetic
gacacatctagaggaatttatcgaaaaaaccagacttcgatctcacatgagaggaagaatagagataaaccagaa

SEQ ID NO: 229470 - DNA, 75 bp, Artificial Sequence
  Synthetic
acactatgaaaggcaactctgggccattcaacgtggcatggaggacctatattaaagcccatcatttggatgcat

SEQ ID NO: 229471 - DNA, 75 bp, Artificial Sequence
  Synthetic
gtgggcaacttccacacaaaattatatgcagatgcataagctctcaccagtactgtcagagtgctgatattgatg

SEQ ID NO: 229472 - DNA, 75 bp, Artificial Sequence
  Synthetic
gaaaatgatgaagcgagacatccaattcgaagtaaaagaattaactagattttatcaggttctttatgactacat

SEQ ID NO: 229473 - DNA, 75 bp, Artificial Sequence
  Synthetic
ccttaagtgaacttgagacatattacactacacaccaagctgcttacttaatggattatgagactatcataacaa

SEQ ID NO: 229474 - DNA, 75 bp, Artificial Sequence
  Synthetic
taagtctactgagcacaaaatcaaggtctttatactcccgtataaagtttatacacctattgatttttgcgcagc

SEQ ID NO: 229475 - DNA, 75 bp, Artificial Sequence
  Synthetic
atggattatgagactatcataacaactatagccttagcttttagagggattgggaaagtcttaatagaagacttt

SEQ ID NO: 229476 - DNA, 75 bp, Artificial Sequence
  Synthetic
acttacaggaaatctcattaaagatgacaaatggcatattattcacttcctcaaaaacataatttcaaccacaca

SEQ ID NO: 229477 - DNA, 75 bp, Artificial Sequence
  Synthetic
tgggaaagtcttaatagaagactttgcagcagggaattcagactcggagctagatatacttttaacaaatatgga

SEQ ID NO: 229478 - DNA, 75 bp, Artificial Sequence
  Synthetic
gacaaatggcatattattcacttcctcaaaaacataatttcaaccacacacaaagctcaggttgcaacttcacca

SEQ ID NO: 229479 - DNA, 75 bp, Artificial Sequence
  Synthetic
tagatatacttttaacaaatatggattatagtttgaaaaccaatttgcaactaagaggtataatcagatttgcta

SEQ ID NO: 229480 - DNA, 75 bp, Artificial Sequence
  Synthetic
gacttggaggttcagcttgctatggagtgttttagactcattgctcatttcggggatatgtttttggcagaagaa

SEQ ID NO: 229481 - DNA, 75 bp, Artificial Sequence
  Synthetic
agatgatggggaaaatgtctagagctaagccatcaagactgcagagatcttcaatattttcaataagtgaggagc

SEQ ID NO: 229482 - DNA, 75 bp, Artificial Sequence
  Synthetic
tctagagtcccattcctcaaaggaattattgaaaagttttcctataaagccatccctgtgtctagactctatgat

SEQ ID NO: 229483 - DNA, 75 bp, Artificial Sequence
  Synthetic
tcaatattttcaataagtgaggagcctgaattgaaaggatctcaattttcagacttcagtattcacaatgaggat

SEQ ID NO: 229484 - DNA, 75 bp, Artificial Sequence
  Synthetic
aagttaagagaatctaagcatagaataaagttcatacccatattattccatatggatgatttaacacaaagggat

SEQ ID NO: 229485 - DNA, 75 bp, Artificial Sequence
  Synthetic
attaaaatttgcaaagagccccactctatgatgtgttattccaaaagacagagaacttctcaaaacaatttcctt

SEQ ID NO: 229486 - DNA, 75 bp, Artificial Sequence
  Synthetic
ctatgatgtgttattccaaaagacagagaacttctcaaaacaatttccttttgtgtaaaattgaatccaaatgga

SEQ ID NO: 229487 - DNA, 75 bp, Artificial Sequence
  Synthetic
ttaaataaatatgatgcagacaaatctgatgaaagaataacatggaacaactggcaagtatcacgagaaatgaac

SEQ ID NO: 229488 - DNA, 75 bp, Artificial Sequence
  Synthetic
ctgatgaaagaataacatggaacaactggcaagtatcacgagaaatgaacactggtccgatagatttaattatta

SEQ ID NO: 229489 - DNA, 75 bp, Artificial Sequence
  Synthetic
aggttttcaaatggccagaaaagccaactctgaatactgactctggattatgctatggggacaagcattgtaatc

SEQ ID NO: 229490 - DNA, 75 bp, Artificial Sequence
  Synthetic
tgaaattccctaggctagatgcggatactgctatcaagcaagtctcttgtttcaagtcaagctttacagagaacc

SEQ ID NO: 229491 - DNA, 75 bp, Artificial Sequence
  Synthetic
taagtagagaaaccatttcaggccatgccaaatctatcctcaacagaaaacatggcttgaagtttgagaaaatga

SEQ ID NO: 229492 - DNA, 75 bp, Artificial Sequence
  Synthetic
catcaggaatgaatgaacaactcaagaaatgcactgctatatccgttggtgattgtgatacaatttctggggtct

SEQ ID NO: 229493 - DNA, 75 bp, Artificial Sequence
  Synthetic
gattgtgatacaatttctggggtctcatggcctgttattcattgtaaaaatgataaatactatcacagcgatact

SEQ ID NO: 229494 - DNA, 75 bp, Artificial Sequence
  Synthetic
aaaaaatagaggaaatgtctgataaattggactacattgtttaccaacaacggggtaggaataggttcttctata

SEQ ID NO: 229495 - DNA, 75 bp, Artificial Sequence
  Synthetic
aaagagcatgcaaaagatggcaacattaatagttactgcctatcagaagcttgcaaattagataaactgcctgtt

SEQ ID NO: 229496 - DNA, 75 bp, Artificial Sequence
  Synthetic
atatattgccgaaacagattatattggaccacaattcaagagttgacaagacaaaaagcattggagaatcaaaat

SEQ ID NO: 229497 - DNA, 75 bp, Artificial Sequence
  Synthetic
ttgcaaattagataaactgcctgttcataagtcatggtttaaattatgcaattgggattcagttgtaaaagaaga

SEQ ID NO: 229498 - DNA, 75 bp, Artificial Sequence
  Synthetic
aagaaaattatatcagcaaaagaggccagacaaagacaaaattatgaggttgaacatgcaggtttacactttgag

SEQ ID NO: 229499 - DNA, 75 bp, Artificial Sequence
  Synthetic
cctcgaaataaaagaatttacgcatctcgacatcgaatcctatagaaaagctattgagtcagatatcaaaacaga

SEQ ID NO: 229500 - DNA, 75 bp, Artificial Sequence
  Synthetic
cctaatattgaaccatttcaaactaacaaaaaacttgccacatacagtcccgaaatatagatcgatgacagttca

SEQ ID NO: 229501 - DNA, 75 bp, Artificial Sequence
  Synthetic
gggggtagactatcaagatggaatacagaatgcttatataactggaacactcccagctattagtgggttagcagc

SEQ ID NO: 229502 - DNA, 75 bp, Artificial Sequence
  Synthetic
caagtctattgagcttgaattatgatacaatggctcaagcgtccctcattgatatgtgcagagttttcaaatgtg

SEQ ID NO: 229503 - DNA, 75 bp, Artificial Sequence
  Synthetic
cagaatgcttatataactggaacactcccagctattagtgggttagcagctggttatcatcttagcgcaccagat

SEQ ID NO: 229504 - DNA, 75 bp, Artificial Sequence
  Synthetic
ggacagcaactatttgatattgtaatcttcttgaaaaaagctgtttataaagccagatataccaagatttactca

SEQ ID NO: 229505 - DNA, 75 bp, Artificial Sequence
  Synthetic
aaggttacaaagaggaccagatggcttttgaatttttatcagatgaggtgatgcaagttgacatagaagagcagt

SEQ ID NO: 229506 - DNA, 75 bp, Artificial Sequence
  Synthetic
atgcaagttgacatagaagagcagttagaatgtaaccccatattctctgttgtttacaacaccaaaggtgagaga

SEQ ID NO: 229507 - DNA, 75 bp, Artificial Sequence
  Synthetic
actgggccaactatatcaattaatatccaacacaatgaacagtgtacagggtcatgccctaaaagtatcccaaag

SEQ ID NO: 229508 - DNA, 75 bp, Artificial Sequence
  Synthetic
ggaatgacctacaaaggggcatttaggactgctttaataagagaatgtgagaaattcgaaaaagcatttgacttc

SEQ ID NO: 229509 - DNA, 75 bp, Artificial Sequence
  Synthetic
caggatggatggctaacgttctctaaagaacacacaagtaattggggctgtgaagaattcggttgtttagcaata

SEQ ID NO: 229510 - DNA, 75 bp, Artificial Sequence
  Synthetic
cttgacatggggttttgctcaaatgagaatctatcaatactcgaagaaatacattggattgtgattgaattaaaa

SEQ ID NO: 229511 - DNA, 75 bp, Artificial Sequence
  Synthetic
gatagcggatgtctgtatggatcatgccaagatgtaattagacccgaaatggatgtatataaaatacaaggttct

SEQ ID NO: 229512 - DNA, 75 bp, Artificial Sequence
  Synthetic
actaatcaatggtcgacagaattagaccaatgtatacacatgtgtatgtatagaaacaacatggatccggaattt

SEQ ID NO: 229513 - DNA, 75 bp, Artificial Sequence
  Synthetic
ggatgtatataaaatacaaggttctgagcagacactgattgagatatgcataagcacacctcatgagactatgtg

SEQ ID NO: 229514 - DNA, 75 bp, Artificial Sequence
  Synthetic
tagaaacaacatggatccggaatttcaccaatttgacatccctaaagtattcttagaagacccgattctaaggac

SEQ ID NO: 229515 - DNA, 75 bp, Artificial Sequence
  Synthetic
caatgatctagatgttttagaacctttaataggtgacaaaatagaagtatctttccaaacaactcagtctgtgca

SEQ ID NO: 229516 - DNA, 75 bp, Artificial Sequence
  Synthetic
ttaataggtgacaaaatagaagtatctttccaaacaactcagtctgtgcatatgccaactcttatgggcttgagg

SEQ ID NO: 229517 - DNA, 75 bp, Artificial Sequence
  Synthetic
aaagggggcctatacactggtcaaataaatgatattggcaatactgctgaaatgtgtggatcagttcaattaata

SEQ ID NO: 229518 - DNA, 75 bp, Artificial Sequence
  Synthetic
aatcattcagcatttttgcgacaaagcattcagattgactaatgaaaggatcaggcagaaccaaaaatcagaagg

SEQ ID NO: 229519 - DNA, 75 bp, Artificial Sequence
  Synthetic
aacgggtcactgataggccagggaacacctaaatttgactatatctgccatgctgcaaaaaggaaagatgtaatt

SEQ ID NO: 229520 - DNA, 75 bp, Artificial Sequence
  Synthetic
caaaaatcagaagggtttgaagctttcatagaccctgaaaaaagaggtggtagatctaaatttgaatttaattag

SEQ ID NO: 229521 - DNA, 75 bp, Artificial Sequence
  Synthetic
gtcaggaggtgttacaacaatcactatgtaacatgtgaattgttggagaagagaaataatatcctgcacaccata

SEQ ID NO: 229522 - DNA, 75 bp, Artificial Sequence
  Synthetic
caggggactgacatgtatgcgtcattaagtggtaataacttaggtttgatgaacttccggattgcacttggagat

SEQ ID NO: 229523 - DNA, 75 bp, Artificial Sequence
  Synthetic
ataaactacaaagcatttattaaagacactaattttgaaataaaaggatcgtgtgtaggatgtgttagatgttcc

SEQ ID NO: 229524 - DNA, 75 bp, Artificial Sequence
  Synthetic
acactaattttgaaataaaaggatcgtgtgtaggatgtgttagatgttccgaagaaattgtttgtgagatgtcta

SEQ ID NO: 229525 - DNA, 75 bp, Artificial Sequence
  Synthetic
gaagaaattgtttgtgagatgtctatagtttctcaaggtgaaatattatgcccaataaactcagaatgtgattta

SEQ ID NO: 229526 - DNA, 75 bp, Artificial Sequence
  Synthetic
tatatgagcaatctactaatcaagcctgaaattgaaaaatacgccattaagatgtcatgcaaaaaagcatcagat

SEQ ID NO: 229527 - DNA, 75 bp, Artificial Sequence
  Synthetic
tctgttgaaattggaatatgtgggcggtcaggaaaatacagcttaactgttaaaccacatcagcagaaaatcgac

SEQ ID NO: 229528 - DNA, 75 bp, Artificial Sequence
  Synthetic
ttgtctaaactagacgagtcaaattttgttaaagaagaggatcttaagtgtggaacttggttatgcaaagtcaaa

SEQ ID NO: 229529 - DNA, 75 bp, Artificial Sequence
  Synthetic
gatgaaggcataggttttattttcgataatatttttaacaagataggaaaaatttggagcattgtcatatattgt

SEQ ID NO: 229530 - DNA, 75 bp, Artificial Sequence
  Synthetic
ataatatttttaacaagataggaaaaatttggagcattgtcatatattgtttaagtgggatccttgttgtcatgt

SEQ ID NO: 229531 - DNA, 75 bp, Artificial Sequence
  Synthetic
tgctaatatacttcatttacccatgctgtaagagattaaaaggtgttttagagaagaacgagatggagttcttag

SEQ ID NO: 229532 - DNA, 75 bp, Artificial Sequence
  Synthetic
cggagcagaaaataaaatagatgcaatgtatatagcaagcgggattaaatcaactaataaacatagacgaataaa

SEQ ID NO: 229533 - DNA, 75 bp, Artificial Sequence
  Synthetic
ataaaataaaatagaaccgaaaggttctacacaactgctagttaaataaatttgaatgtttgtacgtggtagcac

SEQ ID NO: 229534 - DNA, 75 bp, Artificial Sequence
  Synthetic
taaaatagaaccgaaaggttctacacaactgctagttaaataaatttgaatgtttgtacgtggtagcacactact

SEQ ID NO: 229535 - DNA, 75 bp, Artificial Sequence
  Synthetic
agtagtgtactccacactacaaacttgctattgatacaaatccgtaacggagggtccagagctggctcatttctt

SEQ ID NO: 229536 - DNA, 75 bp, Artificial Sequence
  Synthetic
gcctttaaatggtaggaatagaatttcatgatgtcgctgctaacaccagcagtacttttgacccagaggtcgcat

SEQ ID NO: 229537 - DNA, 75 bp, Artificial Sequence
  Synthetic
atgctaactttaagcgtatccacaccaatgggcttagttatgacaacatacgaatcttctacattaaaggacgcg

SEQ ID NO: 229538 - DNA, 75 bp, Artificial Sequence
  Synthetic
agattaaaactagtctcgcaaagagaagtgaatgggaggttacacttaaccttgggggctggaaggttgctgtat

SEQ ID NO: 229539 - DNA, 75 bp, Artificial Sequence
  Synthetic
acaatacgaattttcctggcaaccggaacaacccagttcctgacgacggtcttaccctccaccgcctcagtggat

SEQ ID NO: 229540 - DNA, 75 bp, Artificial Sequence
  Synthetic
tcctacacaagtccttactagatacaatgctgttagtcagtgaaccagataaattgattattaaatctaaaataa

SEQ ID NO: 229541 - DNA, 75 bp, Artificial Sequence
  Synthetic
tcaacccaatggctgaaaagaatgggatcacttggaacgacggagaggaagtttatctctctttcttcccgggat

SEQ ID NO: 229542 - DNA, 75 bp, Artificial Sequence
  Synthetic
accaaggggaaaaaatagatataggttttttacaaaaaataaaagaaagttgattaggcccgaaggtgtctactt

SEQ ID NO: 229543 - DNA, 75 bp, Artificial Sequence
  Synthetic
gaaccttcaaatccctttgctggcacatttaacagggcgtgctatggtgaattctattataggattagatgaatc

SEQ ID NO: 229544 - DNA, 75 bp, Artificial Sequence
  Synthetic
tcgtggccgactgcggtctcaacacttcttactaagccaatcaatactaactgccaaaatgtcgtctgtgctgag

SEQ ID NO: 229545 - DNA, 75 bp, Artificial Sequence
  Synthetic
aacatctattatgaatgatgcgatcatagaatcagattacacatctaattggatcagtgagtgtctccacacgta

SEQ ID NO: 229546 - DNA, 75 bp, Artificial Sequence
  Synthetic
tatgtttgagcgcttcacaatggagcaggaactccaagaccgtggagcggagggcactctcccaccagaaactat

SEQ ID NO: 229547 - DNA, 75 bp, Artificial Sequence
  Synthetic
cattgatcaggtgtttgtgtttgccgcttggaacctcctactagagctctcctaccaaatgtattatttgagggt

SEQ ID NO: 229548 - DNA, 75 bp, Artificial Sequence
  Synthetic
caaatccaccattaaggtgttcatacttaattcagatgacccccgcttaagatggaaaatgatgaacttctgctt

SEQ ID NO: 229549 - DNA, 75 bp, Artificial Sequence
  Synthetic
acggggctgggacaatatattagattatgtatacgtcacgctccgacgtatccctggaatggcattatcagggat

SEQ ID NO: 229550 - DNA, 75 bp, Artificial Sequence
  Synthetic
gcgcttgatcatgagcgatgctgcaaagatatctagaaaggtaggagccatgataaccttattctccttgccggc

SEQ ID NO: 229551 - DNA, 75 bp, Artificial Sequence
  Synthetic
gtgtgcaacaattagtcatccacgcatactaaggcgcctaattgatatgcagatcgtggttcctggcaactcacc

SEQ ID NO: 229552 - DNA, 75 bp, Artificial Sequence
  Synthetic
atctgggatgcagaatcatgtgcgattagctgaccgatctccagatgctcagattgagcggatagagattgaagg

SEQ ID NO: 229553 - DNA, 75 bp, Artificial Sequence
  Synthetic
ctatctcgcaaccctcgactttaccaagctttgcgttgacgcactaatttggggctgtaaacaggccttaaccaa

SEQ ID NO: 229554 - DNA, 75 bp, Artificial Sequence
  Synthetic
gtttgcaccggattcatttaagcttatactgaatgagcgatcatcaatgactcaggaggagattaattcgctcga

SEQ ID NO: 229555 - DNA, 75 bp, Artificial Sequence
  Synthetic
cataaaggaaggatttgatctggagattgtggttccatcggagataagctttatactcagtgatcggatcctgaa

SEQ ID NO: 229556 - DNA, 75 bp, Artificial Sequence
  Synthetic
tttcatggcacgtgagctgccaaaaggcttccagggtaagactgtgtatttgaatgtcgatgcagaagggttagt

SEQ ID NO: 229557 - DNA, 75 bp, Artificial Sequence
  Synthetic
cttggtggcaaggaagctatcactgctcgccgtcacactatctgaatctaccatgcctcctagagtgaaaggaat

SEQ ID NO: 229558 - DNA, 75 bp, Artificial Sequence
  Synthetic
atgtgatgaggttgagcagtttttagacagagcctatactgttctcctccaagtgtggatcctagcatgtaaatg

SEQ ID NO: 229559 - DNA, 75 bp, Artificial Sequence
  Synthetic
gtcccctgaggacaagtgtgcagctatcacgaagtaccttcatgagttcgcactgccgctattagtggaggatga

SEQ ID NO: 229560 - DNA, 75 bp, Artificial Sequence
  Synthetic
catgactgcgtatgaccagccagctgcatcaatcaagaagagaactgacaaatacaaacaacaggggcgcttttt

SEQ ID NO: 229561 - DNA, 75 bp, Artificial Sequence
  Synthetic
tcgccgattgaggttggagaagatcattgacgagccgcaaattaccgcttaccctaataatctgtactatctagc

SEQ ID NO: 229562 - DNA, 75 bp, Artificial Sequence
  Synthetic
ggctacttataccctgcaggctcaggcacaagccactcttcagaatgtgatacggcaaagcttaatagtcagaca

SEQ ID NO: 229563 - DNA, 75 bp, Artificial Sequence
  Synthetic
cagaaagattctcaataacatacggtcttctgatgagggccaattccttttggagatgtattatgaacctttctc

SEQ ID NO: 229564 - DNA, 75 bp, Artificial Sequence
  Synthetic
atttatggcctatgaacttcaaatttctcgccaccaaggaacaatcaccaatcgatattatgccctagtaggtga

SEQ ID NO: 229565 - DNA, 75 bp, Artificial Sequence
  Synthetic
atcgcaattagagatcccccgcagcgcaacacctgaaacagataatcctgacttaaggagtaccttaacagtcaa

SEQ ID NO: 229566 - DNA, 75 bp, Artificial Sequence
  Synthetic
cataggtaaatatatagagaatgctgggatgtctgccttctttttaactataaaatacgcactagggacacggtg

SEQ ID NO: 229567 - DNA, 75 bp, Artificial Sequence
  Synthetic
tgatttctacattagtattgttgactcagcaacgcagttagagaagcacgatgctattgactggattgatgaccc

SEQ ID NO: 229568 - DNA, 75 bp, Artificial Sequence
  Synthetic
gcaaccactcgcattggcagcattctctggggagctcaccaagattaaatcattaatgatgctgtacagggacct

SEQ ID NO: 229569 - DNA, 75 bp, Artificial Sequence
  Synthetic
atcatctgggaagagcaagttctctaggcccccaagccatcatgtactgcgtcctctcggactatcttctacatc

SEQ ID NO: 229570 - DNA, 75 bp, Artificial Sequence
  Synthetic
gggagagaacgccagatatctcgcattactggaagctcctcagatgatggagtttgcccctgccaactacccgct

SEQ ID NO: 229571 - DNA, 75 bp, Artificial Sequence
  Synthetic
ctggtataagagtattagtattgtagagtatctgtctagactgtcccttagcctaggttcacatctgtaccttgc

SEQ ID NO: 229572 - DNA, 75 bp, Artificial Sequence
  Synthetic
cctatatagctatgcaatggggattgggactgttcttgatgctcaaatgaggaactacaaatatggcagggactt

SEQ ID NO: 229573 - DNA, 75 bp, Artificial Sequence
  Synthetic
ggaggggagtggtgcctcaatggcatatatagaatactacattcccgcgcccacaattttctataatagcttctt

SEQ ID NO: 229574 - DNA, 75 bp, Artificial Sequence
  Synthetic
cttgaatcctgtgtttttccagtttggggttgagacagcaagaaagcagcagagcgcagttgatgttaagatggc

SEQ ID NO: 229575 - DNA, 75 bp, Artificial Sequence
  Synthetic
cagcagctctgacaatccccctcaaagaaactttgagcccctcccaacccaatttgtagaaagtgtagtttacaa

SEQ ID NO: 229576 - DNA, 75 bp, Artificial Sequence
  Synthetic
tgctgaactaggcgtaacaaccactgacaaggaggaaatggcacagactctgacgagactcggggcagcacgccg

SEQ ID NO: 229577 - DNA, 75 bp, Artificial Sequence
  Synthetic
gcaaattctggctgaagtgattacgccgctcgggtttccgcaagagttcagagtgctgtgggatgggcatacaga

SEQ ID NO: 229578 - DNA, 75 bp, Artificial Sequence
  Synthetic
aactgatgcatcagcttatgccgccacacctttctcaggcccagcacagcaagcacaggcaatgccagcacctca

SEQ ID NO: 229579 - DNA, 75 bp, Artificial Sequence
  Synthetic
ccacaccgacttaacgaaatcagcttgtgcacaatttatcataagcaaagtagggcctgagacttgctccctcgt

SEQ ID NO: 229580 - DNA, 75 bp, Artificial Sequence
  Synthetic
ggcaatcgactcaagggacagcaccgcccagcctgccgctcctgatcccgtgccggatgactcctttagcagcaa

SEQ ID NO: 229581 - DNA, 75 bp, Artificial Sequence
  Synthetic
tcatgcagactgggaagacaacaatcaagcagaaaccactcgattatcaaatgctttaattcacattactctgat

SEQ ID NO: 229582 - DNA, 75 bp, Artificial Sequence
  Synthetic
gtatcagtcatatctgatcatgcaggaaaaaatgaaggatccagctcttattgatggaatcagagctaacctgct

SEQ ID NO: 229583 - DNA, 75 bp, Artificial Sequence
  Synthetic
ctctagtattgtcttaaaaccagggggttacttagtactcaaaaccaggtggctcccctttcaaccattctctca

SEQ ID NO: 229584 - DNA, 75 bp, Artificial Sequence
  Synthetic
cagtgatccgaactgccctgaggacatatcagcctcggacctgcagggagctgttgagaggtacgtgcatgaagt

SEQ ID NO: 229585 - DNA, 75 bp, Artificial Sequence
  Synthetic
cttggttgctctcttatggtcatatttctctgacatagtggctcttagaagtgcttactctgaccccaactccac

SEQ ID NO: 229586 - DNA, 75 bp, Artificial Sequence
  Synthetic
catagaacgagtcaggcagcaaggggactacactggaatctggccatctgccggagcaaccgcagctgaggacgc

SEQ ID NO: 229587 - DNA, 75 bp, Artificial Sequence
  Synthetic
tgaagtgattttatgctgtaagctgggagtagactgcaaatctgtttcatttaaccatgcgctgagtgcaagcgg

SEQ ID NO: 229588 - DNA, 75 bp, Artificial Sequence
  Synthetic
cataggcgacttccaatcataaaatctgctacagtataaactcatctcacactggtatcaccttcggaattaaga

SEQ ID NO: 229589 - DNA, 75 bp, Artificial Sequence
  Synthetic
cagcttgacatcacagaaatttaccataatcccgcctgagtgtgtcaaggagtttttttcacagctgtatacaca

SEQ ID NO: 229590 - DNA, 75 bp, Artificial Sequence
  Synthetic
aaaaacaaagataggcccgaatggccatagcgattcgctataccgttcggccttaattggttctagtggaggtgt

SEQ ID NO: 229591 - DNA, 75 bp, Artificial Sequence
  Synthetic
aagctcaagagtgcaagatgcaatcgatcgtgcgattgtgcaatgtacgttggctcatacccactcagacacaat

SEQ ID NO: 229592 - DNA, 75 bp, Artificial Sequence
  Synthetic
gtgctacttatctgaattgcaaaccaatctctcgtctagatatcactcacgggccatggacctcaccttctctcc

SEQ ID NO: 229593 - DNA, 75 bp, Artificial Sequence
  Synthetic
gcacttaatcaatgtcgggggtgttcctcccaatagtaaatggaatgattcatcagtctaccagtccttctctga

SEQ ID NO: 229594 - DNA, 75 bp, Artificial Sequence
  Synthetic
ctctgagatcgatgacctattcggtacagggctggacaccatccagttcattacagatcaaaagtcaaagcagaa

SEQ ID NO: 229595 - DNA, 75 bp, Artificial Sequence
  Synthetic
cctgattatgtccataattaagataatcacaattcaccttaaagaaattatagagattctgaaaacagacagtag

SEQ ID NO: 229596 - DNA, 75 bp, Artificial Sequence
  Synthetic
tgatgctcatggctctgcaaaggacagccccccgcaaactcagaatggacccgactccggcccaagcgatccaac

SEQ ID NO: 229597 - DNA, 75 bp, Artificial Sequence
  Synthetic
tgatcatgagagcttgcttctaaccgcatataatgtgggaattctagggagaattaacacagtaatacagctcat

SEQ ID NO: 229598 - DNA, 75 bp, Artificial Sequence
  Synthetic
acaggtgcaaggtgcaaaaccaaagagccacggaatttacccacctattcctactgcacctcctgtgcccactgc

SEQ ID NO: 229599 - DNA, 75 bp, Artificial Sequence
  Synthetic
gactgagcggatacttgtgaaggtagtatcatcctgggggttgttttctgaccacactcggagccaattgaggag

SEQ ID NO: 229600 - DNA, 75 bp, Artificial Sequence
  Synthetic
aaggcaccctggctcgagagttgacgatccagttctctatgactaccctagacgtgggaaagtgaccacccacga

SEQ ID NO: 229601 - DNA, 75 bp, Artificial Sequence
  Synthetic
agacttagagatggggtgtttttctgtgtctacaatcctatcatcggaagaatttcttaggaagacagacaaccg

SEQ ID NO: 229602 - DNA, 75 bp, Artificial Sequence
  Synthetic
gcccaaagagtccagccaggccgatggttatgaatatgactcttacttagcacaaaatgcaaaaaccaacattct

SEQ ID NO: 229603 - DNA, 75 bp, Artificial Sequence
  Synthetic
caagtacctcagcaaagaactcacaacttctctaatccatgatgttatcaacaatagagccagtatccaattttc

SEQ ID NO: 229604 - DNA, 75 bp, Artificial Sequence
  Synthetic
caaaaggtggacagatgtaagcggggatgttgagccgatcccgatgaaccccgaagtgtttaagaggggggcaga

SEQ ID NO: 229605 - DNA, 75 bp, Artificial Sequence
  Synthetic
acgatcacaacaaaagcagatttggaaggctatagggtgttctgcattggtcgatcaaccccaggaattcataga

SEQ ID NO: 229606 - DNA, 75 bp, Artificial Sequence
  Synthetic
cctcaccaagcccacaaatcccaatccaggtcatcgccgagaatggagcattgggtgggttgggtcaacagtcaa

SEQ ID NO: 229607 - DNA, 75 bp, Artificial Sequence
  Synthetic
tcagaatgcagttgaccgatatagtgaggacgaagagagggacatccatggagatgagatctagcatttgcactg

SEQ ID NO: 229608 - DNA, 75 bp, Artificial Sequence
  Synthetic
ggtcttggagtggtgcaaccccacctgctctccaattacagcaacatcccgatactatgaatgtgtctgtggaat

SEQ ID NO: 229609 - DNA, 75 bp, Artificial Sequence
  Synthetic
acaaattaagtatgttttaagaaaaaacccaaaaattatcatgctaccatcccatctcaaaacaagaagagctgc

SEQ ID NO: 229610 - DNA, 75 bp, Artificial Sequence
  Synthetic
ctgccctaagatctgcccccgatgtgtcggagattatggacatgttgagacggctggacgcaaggattggctcag

SEQ ID NO: 229611 - DNA, 75 bp, Artificial Sequence
  Synthetic
cctgcgcaaggcaaccggaaccggagtcggacaagcaactctgaattgttttttaagaaataagaaaaccctaat

SEQ ID NO: 229612 - DNA, 75 bp, Artificial Sequence
  Synthetic
tagaggcgaagatggatcggattctagcagtaggggcgactgtgaatcagatcaagaatgaagtcagttcattaa

SEQ ID NO: 229613 - DNA, 75 bp, Artificial Sequence
  Synthetic
aactctgaattgttttttaagaaataagaaaaccctaattaaaatttaagtaccattatttattttccccttggt

SEQ ID NO: 229614 - DNA, 75 bp, Artificial Sequence
  Synthetic
aatcgatcactgccacaatagaagggatgattacaactgtaaggatcatggaccctggcaccccgagccatatga

SEQ ID NO: 229615 - DNA, 75 bp, Artificial Sequence
  Synthetic
gtgcaactgaagtaagaagacagttgagtgacgtcccactagttatcagtggacccggtccagtcccccaacttg

SEQ ID NO: 229616 - DNA, 75 bp, Artificial Sequence
  Synthetic
accccagaagagacttaattgccttagatgagcttgctaggcctaaggttgtgcagagccccccggttgcttctc

SEQ ID NO: 229617 - DNA, 75 bp, Artificial Sequence
  Synthetic
ccgcaccctccatggcctcccagctaagtgatggcacccgcatcatgatccttcagatgataaaagaatgcgtct

SEQ ID NO: 229618 - DNA, 75 bp, Artificial Sequence
  Synthetic
ctgatccgcttgaacaatccagatttgaaactaaattgagcagctgcacaaccgaggaccaagggaaagcaataa

SEQ ID NO: 229619 - DNA, 75 bp, Artificial Sequence
  Synthetic
agatggaaatcttacggagagcaacctaaaaactagctgacacactgctcaacatcaaccacccctgcaacccac

SEQ ID NO: 229620 - DNA, 75 bp, Artificial Sequence
  Synthetic
ccacatgcgcaaccgcagcccagagcacacacccaacaccgactcaatcaattaagaaaaaacataggcccgact

SEQ ID NO: 229621 - DNA, 75 bp, Artificial Sequence
  Synthetic
ggctgcaaacccagtcggaaccccggccatggcccgacacgccaagattccactgggattacccgatgaaccgga

SEQ ID NO: 229622 - DNA, 75 bp, Artificial Sequence
  Synthetic
accgaggactctcagagcattccctctagttatgactgagggccctgggggtaagggcagattgatgaagcaatt

SEQ ID NO: 229623 - DNA, 75 bp, Artificial Sequence
  Synthetic
aagaattagtaagatccaatcttccaacattggtgaccacatcataacattcataaatacctacggcttcgtacg

SEQ ID NO: 229624 - DNA, 75 bp, Artificial Sequence
  Synthetic
gcgaaattggacgtacacgcaatttgtatcagagcggcacactgcatcagtccagcctgtagtcacgtcttgcat

SEQ ID NO: 229625 - DNA, 75 bp, Artificial Sequence
  Synthetic
gcttccttttggctgtggaccagacatccagcaccccgaggcccttatcgagcatctggaacactgcactattaa

SEQ ID NO: 229626 - DNA, 75 bp, Artificial Sequence
  Synthetic
agtgcggaaaagtgcatcattgaaggaagagatttattttgaggtgcaagtgctaccaaaaatttttgagccgta

SEQ ID NO: 229627 - DNA, 75 bp, Artificial Sequence
  Synthetic
tcagatagcaaaacagaactatatgtgtgtctcatccgagaaatatgtgaaagcacctggaaagatagttgcagg

SEQ ID NO: 229628 - DNA, 75 bp, Artificial Sequence
  Synthetic
ggtggactatctctacttcccgaccttcatctctcttacttactgtgcagaggagatgaaattcagggtggctaa

SEQ ID NO: 229629 - DNA, 75 bp, Artificial Sequence
  Synthetic
gcctatagcacaggctcggacatcattcatgaggagtatccatctggaagtaatcttgtcttttgcatgtcaaga

SEQ ID NO: 229630 - DNA, 75 bp, Artificial Sequence
  Synthetic
ggactcccccatagcaaagagtctagctaaggacaaagaaactggacggttcattgcttcagtgtggatccacct

SEQ ID NO: 229631 - DNA, 75 bp, Artificial Sequence
  Synthetic
gtgcaacatcagcaaaaatcgtccaattaccaaggaatatgatgataagtactttgcccaaaagatacttgcaat

SEQ ID NO: 229632 - DNA, 75 bp, Artificial Sequence
  Synthetic
gaaattgacagtgggattagtggatatgtggggtcccacagtgattgtgcatgctgaaggaaagatccccaaatc

SEQ ID NO: 229633 - DNA, 75 bp, Artificial Sequence
  Synthetic
agcactattattttttaataagaaggggaaggcatgccacccgctagcggaggtagcacccactgttgcaaagca

SEQ ID NO: 229634 - DNA, 75 bp, Artificial Sequence
  Synthetic
tgcatggtccgttggttgcactatcatcgaagccaatgctatcatgcaagagtcagatttgaaagggcttggtca

SEQ ID NO: 229635 - DNA, 75 bp, Artificial Sequence
  Synthetic
gatggatgacattgtcttcagaaaggtatcccttaatcccgaagccctcagcctcaagtcgtctcggtggaaccc

SEQ ID NO: 229636 - DNA, 75 bp, Artificial Sequence
  Synthetic
gttcactaaacagcagtaataatcagacatgatcatatgccttgcaacagctgtctgctattctaaaagtttcag

SEQ ID NO: 229637 - DNA, 75 bp, Artificial Sequence
  Synthetic
taaccaccgatccaattaactggcacccatttaatccatctatttgcctttcttgactcccagctgcacactcct

SEQ ID NO: 229638 - DNA, 75 bp, Artificial Sequence
  Synthetic
ccgggcaactctgccatcttctggcttctatagactcacgatctgcaatccggcccccgccttcctgcatctggc

SEQ ID NO: 229639 - DNA, 75 bp, Artificial Sequence
  Synthetic
attccaaagtgaggctcgatctcagcatttagaaaaaaccatataggcccgactggcaccacccacccccccgac

SEQ ID NO: 229640 - DNA, 75 bp, Artificial Sequence
  Synthetic
ccaaccgccagccgggaacacaaccccacaccccacagcaagcccacacccgcccaccagcggagacccagcgga

SEQ ID NO: 229641 - DNA, 75 bp, Artificial Sequence
  Synthetic
gaatgaggagctctctctttttagttctgacccttctggtccctttcgctcacagcatcgactctataactttag

SEQ ID NO: 229642 - DNA, 75 bp, Artificial Sequence
  Synthetic
agcagtacggaactgtgataacatctgtacggtcattagcttactttcttgaaacaaacccaacttatatctcag

SEQ ID NO: 229643 - DNA, 75 bp, Artificial Sequence
  Synthetic
tacgtttaatgcctgctatacagactgattcttcacactgcagctatcacagcattgagaattataatttaaccc

SEQ ID NO: 229644 - DNA, 75 bp, Artificial Sequence
  Synthetic
taacaaagctcttattacccctacaggagaatctccatcaaataacggatagtcttagttcaagacggcgtaaaa

SEQ ID NO: 229645 - DNA, 75 bp, Artificial Sequence
  Synthetic
agaggtttgccggagtggctgtaggcctggctgccttaggagttgcgacggctgcacaggtaacagcagcaattg

SEQ ID NO: 229646 - DNA, 75 bp, Artificial Sequence
  Synthetic
ctgtggtaaaggcaaaagagaattccgctaagattgctcagcttacaagtgcaatatcagagacaaacagggcag

SEQ ID NO: 229647 - DNA, 75 bp, Artificial Sequence
  Synthetic
tacaagatttgattgaaggaagtaaacagctggcagtagctgtccaagcaatccaagaccaaatcaataacgtaa

SEQ ID NO: 229648 - DNA, 75 bp, Artificial Sequence
  Synthetic
tccagcctcaattaactaatctcagttgtcaggtagcagatgctcaggtcggaacaatcctgaatatgtacctca

SEQ ID NO: 229649 - DNA, 75 bp, Artificial Sequence
  Synthetic
ctgaattgaccacagtattccatcctcaaatcacaaactcagctttaacaccgattactattcaagctcttcggt

SEQ ID NO: 229650 - DNA, 75 bp, Artificial Sequence
  Synthetic
ctctgcttggcagcacacttcctcaggttgtgacctcaactataaaaacagatgtacccttacaagatctgctca

SEQ ID NO: 229651 - DNA, 75 bp, Artificial Sequence
  Synthetic
cttctgggctgttaaagggacagatagtatacctagatctccaatcgatgattatggttgttagtgtaagtgtgc

SEQ ID NO: 229652 - DNA, 75 bp, Artificial Sequence
  Synthetic
caactattgcactccatagcatggcaaaggtttacacccttaaggctatttctgcacatgtaaacaatgcagaag

SEQ ID NO: 229653 - DNA, 75 bp, Artificial Sequence
  Synthetic
ttcaaatgcaggtcccatcccgagttatggagctaggatcagaaatcatggggtacgatatagatcagtgtgaag

SEQ ID NO: 229654 - DNA, 75 bp, Artificial Sequence
  Synthetic
agacttcacgttaccttttttgtccctataatggaggatcgatcttatcagcaactatgaaaatgtgcctgaacg

SEQ ID NO: 229655 - DNA, 75 bp, Artificial Sequence
  Synthetic
ggaatatctcgcaatgtgtattcactcctatttatggaagctttctgcagagatttgttcttgtagatggtgtga

SEQ ID NO: 229656 - DNA, 75 bp, Artificial Sequence
  Synthetic
tagttgcaaactgtcgcgatatgacttgtgcatgcaagagcccctctaagatcatcactcaacccgactccctac

SEQ ID NO: 229657 - DNA, 75 bp, Artificial Sequence
  Synthetic
cagtgaccataattgattcaacttcatgctcaaatcttgtgctagatacgcttgaattacctattatttctataa

SEQ ID NO: 229658 - DNA, 75 bp, Artificial Sequence
  Synthetic
acaatgcaacttatagacctgttcagtatgttgggcctaatcaaataatcttcagtcaacctctagatttgttgt

SEQ ID NO: 229659 - DNA, 75 bp, Artificial Sequence
  Synthetic
cccagctaggtaagattaactcatcactctctgacgcaattgagcacctagctaaaagtgatgaaatacttgagc

SEQ ID NO: 229660 - DNA, 75 bp, Artificial Sequence
  Synthetic
agatccagtgggactcacctcaaggttacactctgattgccttaacatctgtacttgcatttgttgtcgtagcca

SEQ ID NO: 229661 - DNA, 75 bp, Artificial Sequence
  Synthetic
ttgtagggttgctgatttctacaaggtatcttatctttgagattagaagaatcaacactactctaacacagcagt

SEQ ID NO: 229662 - DNA, 75 bp, Artificial Sequence
  Synthetic
tgtcatcttatgttttatccaataaaatcattcaatattaggttgggtgtcttctcaaacgaatcagcctgcatg

SEQ ID NO: 229663 - DNA, 75 bp, Artificial Sequence
  Synthetic
tctaacactactgttataccgatctacctctacctggtgttgggtctataaacactgtactaccttctgtaatgt

SEQ ID NO: 229664 - DNA, 75 bp, Artificial Sequence
  Synthetic
agggaatgcattactcaaaactggaatctccccagtagtttaataaaaaaccggttgaacatgacagtatattat

SEQ ID NO: 229665 - DNA, 75 bp, Artificial Sequence
  Synthetic
ttagcttatggctaatactccatacagctaagtaggcccgactcaggtgctacccaacccccagccagccatggc

SEQ ID NO: 229666 - DNA, 75 bp, Artificial Sequence
  Synthetic
atccctccaatctgagccgggttcacaaaagccacactaccaatcggatgatcaactagttaaaagaacatggag

SEQ ID NO: 229667 - DNA, 75 bp, Artificial Sequence
  Synthetic
atctttctttaggttctctgtccttgtagtaactatcactagcctggccttgagcataatcactttaataggtgt

SEQ ID NO: 229668 - DNA, 75 bp, Artificial Sequence
  Synthetic
gaatcgcatttcgacagctaagcagatttcaaatgcatttgcagctattcaagccaatatattgagctctatccc

SEQ ID NO: 229669 - DNA, 75 bp, Artificial Sequence
  Synthetic
ggatatccgccccataaacagcttgcttaatcaactagtctatacatcatctgtcacacttcctttgcgcatatc

SEQ ID NO: 229670 - DNA, 75 bp, Artificial Sequence
  Synthetic
ctcactagagtcaaacgtcctagcagccatccaggaggcatgtacgtaccgtgattctcaatcttcctgctcagc

SEQ ID NO: 229671 - DNA, 75 bp, Artificial Sequence
  Synthetic
aacaatgagtgttatgaatgaccagaggtacatcgaaggtatacaagtctatagtgggtcatttctcgatcttca

SEQ ID NO: 229672 - DNA, 75 bp, Artificial Sequence
  Synthetic
gaaacacacgttgagccctcctattgcatttcccagttttattccaacctccactacaactgtgggatgtacacg

SEQ ID NO: 229673 - DNA, 75 bp, Artificial Sequence
  Synthetic
gattccgtcattctctctcacaaaaacccactggtgctatacccataattatataaagacgggctgtcgtgatgc

SEQ ID NO: 229674 - DNA, 75 bp, Artificial Sequence
  Synthetic
aactcaatcaaatcagtatatagcacttggaacaatctatactgaccctgatggtacccctgggttcagtacgtc

SEQ ID NO: 229675 - DNA, 75 bp, Artificial Sequence
  Synthetic
aagatcccaatatctgaatgatggtgtcaacagaaagagctgctctatatcggcagttccgatgggttgtgcatt

SEQ ID NO: 229676 - DNA, 75 bp, Artificial Sequence
  Synthetic
atactgttttatatcagtaaaggaggaggtggattattacaagggcaccgtgccccctgcacaaaccctgatcct

SEQ ID NO: 229677 - DNA, 75 bp, Artificial Sequence
  Synthetic
gttcttctttaatggcactgttcatgaacaccggattgttccttcaagcatgaattcagaatgggttatgctgtc

SEQ ID NO: 229678 - DNA, 75 bp, Artificial Sequence
  Synthetic
tccaggagtaggcagtggagtattttataacaactacataatattcccactatatggtgggatgaccaaagataa

SEQ ID NO: 229679 - DNA, 75 bp, Artificial Sequence
  Synthetic
agcagaaaagagaggtgaactcacacgattctttacgcctaagaactcgaggtccttgtgcaagatgaatgacag

SEQ ID NO: 229680 - DNA, 75 bp, Artificial Sequence
  Synthetic
tgtcttttccaatgctgctcaaagtgcttactatccaccctatttcagtagtagatggattagatcagggctgct

SEQ ID NO: 229681 - DNA, 75 bp, Artificial Sequence
  Synthetic
cgcttgcaattggaatcagataattacaacaaattgcgagatccttactttttcaaatcaggtcatgatgatggg

SEQ ID NO: 229682 - DNA, 75 bp, Artificial Sequence
  Synthetic
agccgaggggcgattgattctaataaatgatgacttgttttattatcaaagaagcacatcatggtggccgaggcc

SEQ ID NO: 229683 - DNA, 75 bp, Artificial Sequence
  Synthetic
actggtatataaattagatatcgaattaaattatcctgatagtcacattcaaagggtagaccaagtagaagtgac

SEQ ID NO: 229684 - DNA, 75 bp, Artificial Sequence
  Synthetic
tttcccgactagaccggggtggggaggctgtgtcgggaacaacttttgccctatgatctgcgtgtcaggagttta

SEQ ID NO: 229685 - DNA, 75 bp, Artificial Sequence
  Synthetic
ccaggatgtctggcctgtcacaaacccagtcaatacaacagacagcaggacattgtgggtaggtggcacactgtt

SEQ ID NO: 229686 - DNA, 75 bp, Artificial Sequence
  Synthetic
gagcaacaccacaagagagaatccggcaagcgtagtgacctcaggaggatccatcagtcaaacagtatcatggtt

SEQ ID NO: 229687 - DNA, 75 bp, Artificial Sequence
  Synthetic
caaccagactgtcccaggtgcttactcgaccaccacttgttttaatgatcaagttcagggtagaatattctgcct

SEQ ID NO: 229688 - DNA, 75 bp, Artificial Sequence
  Synthetic
aataatattcgaagtgggcggtggattactaggcgaatatcagattgtcccattcctcaaagaattaaagtatca

SEQ ID NO: 229689 - DNA, 75 bp, Artificial Sequence
  Synthetic
aggggcggtgcacgcatgaatcaagaatgaccccattgaaatacagtatggaagtgattctatcatcttccacta

SEQ ID NO: 229690 - DNA, 75 bp, Artificial Sequence
  Synthetic
ttggtctcctgagtgatgacttgactacttgatgcactttcaataagccagatttgtacactacacaatgctcat

SEQ ID NO: 229691 - DNA, 75 bp, Artificial Sequence
  Synthetic
cacactaatgtcttatagttaatatttaataaaaaaatcatagtaggccagaatggcttctcaaccagagatcat

SEQ ID NO: 229692 - DNA, 75 bp, Artificial Sequence
  Synthetic
tctgcctgaagttcatctcgattcaccgatcgtcaagcacaaacttctttatcttcttcggctaggcgccttccc

SEQ ID NO: 229693 - DNA, 75 bp, Artificial Sequence
  Synthetic
aacactccaagcctttgaaaatgatggtcccctagctgggcaaaattgggcaagaatcagaaatgaagagtcaaa

SEQ ID NO: 229694 - DNA, 75 bp, Artificial Sequence
  Synthetic
tctatattcacggctcaaaactcagaaatttgaattagagcgaagattgggcattgtaagtacacaaattaatca

SEQ ID NO: 229695 - DNA, 75 bp, Artificial Sequence
  Synthetic
gcggagacactgcgtactcttgtggccgagaattataccaaagctgtcgcacataaaaattagtgagtatcttga

SEQ ID NO: 229696 - DNA, 75 bp, Artificial Sequence
  Synthetic
gaagaccaaagaatggaaacatttgatagaggcctcgatccaaaatgccagtaatcagctgatcacttgcacgca

SEQ ID NO: 229697 - DNA, 75 bp, Artificial Sequence
  Synthetic
acagatcagctctaaattaacaggtagaaaggacctgtttgtcagatcaagagttaatgattccggaacacttga

SEQ ID NO: 229698 - DNA, 75 bp, Artificial Sequence
  Synthetic
tcaatatcccagtcctattcagcttgcacaggcatggcatgcaaatatttggcacaggcaggttgaggcctggct

SEQ ID NO: 229699 - DNA, 75 bp, Artificial Sequence
  Synthetic
tctcataaagcatagaatgagacaactgatatctgagctcagacaaatgccggcaatgtgtgaaataacaatcct

SEQ ID NO: 229700 - DNA, 75 bp, Artificial Sequence
  Synthetic
tgacacgagatcttgtattatcctgatcggtcctgaattagtggtgctctaccttagagaggaacgagtcataag

SEQ ID NO: 229701 - DNA, 75 bp, Artificial Sequence
  Synthetic
ctacttcacttttgagatggttttaatggtctcggatgttatggaggggagactgaatgttacagctcttgcatc

SEQ ID NO: 229702 - DNA, 75 bp, Artificial Sequence
  Synthetic
catcagtcattatctcagtccgctcttgccccgcatctctaagcttttagaccttgttgatcagctagctttgat

SEQ ID NO: 229703 - DNA, 75 bp, Artificial Sequence
  Synthetic
cattggagactatgtatttgatgtcattgtttctcttgagagcttttgctatgcgcaactccaattgttggatcc

SEQ ID NO: 229704 - DNA, 75 bp, Artificial Sequence
  Synthetic
tgtagatgagctaaaaggagacttctatgcttttatgtgcaatgagattctagagactttagaaagtactaatgc

SEQ ID NO: 229705 - DNA, 75 bp, Artificial Sequence
  Synthetic
tttctctcaagatgaatccatgctgcttactatgcaactgacgagttgttactcaaaattaactcctgatctcac

SEQ ID NO: 229706 - DNA, 75 bp, Artificial Sequence
  Synthetic
agctgagctactatgcattatgcggttatgggggcacccaagtctcacggcaactcaggctgcagacaaagtccg

SEQ ID NO: 229707 - DNA, 75 bp, Artificial Sequence
  Synthetic
tgagtcgatgtgtgctgctaaagttattaaattagagactgttctaaagactagggccttcttccatactatctt

SEQ ID NO: 229708 - DNA, 75 bp, Artificial Sequence
  Synthetic
aatcaatgggtacaggcgccgccacaacgggatttggcctccacataagctcccagaatctgcccctttaagcct

SEQ ID NO: 229709 - DNA, 75 bp, Artificial Sequence
  Synthetic
aatcgaattggctcacgacaacaatgaaatcacctaccaatatgccctcaagaattggaaggcaatcacttatat

SEQ ID NO: 229710 - DNA, 75 bp, Artificial Sequence
  Synthetic
ccagttttacaagtgctttgattctgaccctggggaggatttgagcatttttatgaaagataaagcaatcagctg

SEQ ID NO: 229711 - DNA, 75 bp, Artificial Sequence
  Synthetic
tcctaaagatgattggatgagtgtttttcggagaagtttgattaaggagaggtttgtagctgcaagaaaagagct

SEQ ID NO: 229712 - DNA, 75 bp, Artificial Sequence
  Synthetic
tccaaatcaagtaaatcgacgcttgctgctgaatttcttggatgatcctaatttcaatccagaggaagaattaaa

SEQ ID NO: 229713 - DNA, 75 bp, Artificial Sequence
  Synthetic
gtatgtaaccacaggagagtacctaactgatgatcaattttgcgcgtcttattcactaaaagagaaggaaattaa

SEQ ID NO: 229714 - DNA, 75 bp, Artificial Sequence
  Synthetic
aaccacagggagaatatttgcaaaattgactagaaggatgagatcatgccaggtaattgctgagtccatgcttgc

SEQ ID NO: 229715 - DNA, 75 bp, Artificial Sequence
  Synthetic
taatcatgctgggaagctcatgaaagagaatggagttgtccacgatcagcttaaacttacaaagtctctacttac

SEQ ID NO: 229716 - DNA, 75 bp, Artificial Sequence
  Synthetic
aatgaatcaaattgggattatctctcattcccagaggagattcaccaaagataatcaaacagtgcttagcccctt

SEQ ID NO: 229717 - DNA, 75 bp, Artificial Sequence
  Synthetic
caaatccaaatcaaaacatcctaatgatgctgatcctatgtctactacaacaaactctcatgaaatcgctgcatg

SEQ ID NO: 229718 - DNA, 75 bp, Artificial Sequence
  Synthetic
cttcctcactactgacctcaagaaatattgcctacaatggagataccagaccatcatcccttttgcacagactct

SEQ ID NO: 229719 - DNA, 75 bp, Artificial Sequence
  Synthetic
taatgcaatgtatggttacccccatctattcgaatggatccatctaaggttgatgcgaagcactttgtatgtagg

SEQ ID NO: 229720 - DNA, 75 bp, Artificial Sequence
  Synthetic
tgaccctttcaatcccccagacagtgataatccattagacttagatgaagtgctgaacggggacatcttcatagt

SEQ ID NO: 229721 - DNA, 75 bp, Artificial Sequence
  Synthetic
gtcccccagggggggaattgaagggctctgtcaaaaattgtggactatgatatccatctcaactatcatcttgtc

SEQ ID NO: 229722 - DNA, 75 bp, Artificial Sequence
  Synthetic
tgcaactgaggccaacactcgagtgatgagcatggtccaaggggacaatcaagtcatcgcagttacaacaaaagt

SEQ ID NO: 229723 - DNA, 75 bp, Artificial Sequence
  Synthetic
gccacgatcaatcccgcacaaagagaaaaaggcaattgcacttcgggcttgtcaaggtttcttcgaacgcctccg

SEQ ID NO: 229724 - DNA, 75 bp, Artificial Sequence
  Synthetic
tgagaacaactatggcatagggcatcatctaaaggcacaagaaaccatcctcagctctgatttcttcatatatag

SEQ ID NO: 229725 - DNA, 75 bp, Artificial Sequence
  Synthetic
caaacgggtattctttagaggccgtatcttgacacaggccttaaagaatgccagtaagctgtgtttaacggcaga

SEQ ID NO: 229726 - DNA, 75 bp, Artificial Sequence
  Synthetic
catcttgggggattgcactcaatcatcatgctctaatcttgcaacaactgtgatgcggttagcagagaatgggat

SEQ ID NO: 229727 - DNA, 75 bp, Artificial Sequence
  Synthetic
tgagaaggacttgtgtatctacctgaattactacctcacggtaagacaactaacttttgatttaactttccctca

SEQ ID NO: 229728 - DNA, 75 bp, Artificial Sequence
  Synthetic
atatgctaatccaaatactagcgttaacactttgtacacaaatcaccccacctggatctcacgtctagctttgct

SEQ ID NO: 229729 - DNA, 75 bp, Artificial Sequence
  Synthetic
gccttcccagctaggcgggctcaattacctatcatgtagcaggttgttcaatcgcaatattggtgaccctctagt

SEQ ID NO: 229730 - DNA, 75 bp, Artificial Sequence
  Synthetic
ctccgctatagctgacttgaagcgtttgatcatatcacaatgtattgaaccttggatactcgggaacctactcgg

SEQ ID NO: 229731 - DNA, 75 bp, Artificial Sequence
  Synthetic
ccgccgaccggggaaagggacttggagtaccattgctgctgacccttatgcactcaacattgattacctctaccc

SEQ ID NO: 229732 - DNA, 75 bp, Artificial Sequence
  Synthetic
cccaaccacctttcttaaacgacacactcagagtgtactcatggaagggagtcaaaacccattattggctggaat

SEQ ID NO: 229733 - DNA, 75 bp, Artificial Sequence
  Synthetic
tttctctgaaaatgcccaatccgaggagaacgaactggctcaattcttgctagatcgagagatagtgatgccaag

SEQ ID NO: 229734 - DNA, 75 bp, Artificial Sequence
  Synthetic
ggtggcacatgtagtcatagcacagacaagctgcgggaggagaaagcagattcaaggatatcttgactccaccag

SEQ ID NO: 229735 - DNA, 75 bp, Artificial Sequence
  Synthetic
gacgattattcgacatgctctgaaaatccagcctctgtcaactaagcgtgtcattacaatagttgaatataactc

SEQ ID NO: 229736 - DNA, 75 bp, Artificial Sequence
  Synthetic
actctatctggcttatgtacttgaaatcattgaaactccaagagaagtccccccttatctcttatcactgtctgt

SEQ ID NO: 229737 - DNA, 75 bp, Artificial Sequence
  Synthetic
gcaagactgcagcattgatatagctagaactttgcgaaagttgtcttgggcttcccttcttggagggagacctat

SEQ ID NO: 229738 - DNA, 75 bp, Artificial Sequence
  Synthetic
tgagggtctcgaaacaccagacccaattgaattgctagatggccaccttcttcttggcgattctgtttgctatag

SEQ ID NO: 229739 - DNA, 75 bp, Artificial Sequence
  Synthetic
ttgtgaagctggggatgagaagtactcctggttctacttaccttcgggagtatatctggatagggatcctgctga

SEQ ID NO: 229740 - DNA, 75 bp, Artificial Sequence
  Synthetic
gaatcccccaattagagttccatacattggttccagaactgatgagagaagggtagcatcaatgacttacatcaa

SEQ ID NO: 229741 - DNA, 75 bp, Artificial Sequence
  Synthetic
gggggcttcatctccactgaaagcagctctaaggcttgcaggggtatatatctgggcttttggagagtcagacga

SEQ ID NO: 229742 - DNA, 75 bp, Artificial Sequence
  Synthetic
cagttgggccgaggcatatcaattggcatcatcacgagttgatatctctcttgacgatttacaaactctcactcc

SEQ ID NO: 229743 - DNA, 75 bp, Artificial Sequence
  Synthetic
acttcccacatctgccaacataacacacaggctagatgatggcacaactcagctaaaatttactcctgctagttc

SEQ ID NO: 229744 - DNA, 75 bp, Artificial Sequence
  Synthetic
ttatgcattttctagcttcgtccatatttctaatgattcacaacaattagagatagatgaacgagtcactgactc

SEQ ID NO: 229745 - DNA, 75 bp, Artificial Sequence
  Synthetic
aaatctaatataccaacaggtcatgattactggcttgggaatcatcgaggcatggaataatccaccgatcaattg

SEQ ID NO: 229746 - DNA, 75 bp, Artificial Sequence
  Synthetic
taatctgactgaactcactcttcacctgcatactgggtcctcttgctgcatccggcctgtagatagttgcttcct

SEQ ID NO: 229747 - DNA, 75 bp, Artificial Sequence
  Synthetic
gaatccaccctgggtagcagtgcccgaacttaatgtccctgtagagaactcatttgtcttcgattctcaccccat

SEQ ID NO: 229748 - DNA, 75 bp, Artificial Sequence
  Synthetic
tgatatccatgagtcgcttagactatcagacttaaaatacgcttcaaagatcaatagtattgattatatgcctct

SEQ ID NO: 229749 - DNA, 75 bp, Artificial Sequence; identical to SEQ ID NO: 62602
  Synthetic

SEQ ID NO: 229750 - DNA, 75 bp, Artificial Sequence
  Synthetic
gccaatcaaactgccaaatccttggaactcttattaagagtcacaaccgaggaaaggacattttccttaattaat

SEQ ID NO: 229751 - DNA, 75 bp, Artificial Sequence
  Synthetic
ttatttgacacaaatcatcaggttagtatttgtaatcagataatagatgcaataaactcagggattgatcttgga

SEQ ID NO: 229752 - DNA, 75 bp, Artificial Sequence
  Synthetic
caaggtggggaggaacatgcaaagtgcttggacctgattgttgcattggaatagaagacttgtccaggaatattt

SEQ ID NO: 229753 - DNA, 75 bp, Artificial Sequence
  Synthetic
agtgtcatgggtgataatcaatgtataacaactctaagtctgtttccagttgatgctcccaatgattatcaagag

SEQ ID NO: 229754 - DNA, 75 bp, Artificial Sequence
  Synthetic
gatcttctagaaggaggtttgctgactttgtgtgttgaacattactataattctgataaagataaattcaacaca

SEQ ID NO: 229755 - DNA, 75 bp, Artificial Sequence
  Synthetic
gcaatatcttaacggtgttcaactgccacaatcattgaaaacaatggcaaggtgtggacccttgtctgactctat

SEQ ID NO: 229756 - DNA, 75 bp, Artificial Sequence
  Synthetic
gattaaagctttaggacaattgctactgagcccttcttctaatctactgaaatcaacttgggagatttttaagaa

SEQ ID NO: 229757 - DNA, 75 bp, Artificial Sequence
  Synthetic
cagagggggagaattgggctcttcttgtcattttgcagtctttttctcccaaaacttgtcgtcggagaccgggct

SEQ ID NO: 229758 - DNA, 75 bp, Artificial Sequence
  Synthetic
ctgagcccttcttctaatctactgaaatcaacttgggagatttttaagaagctgataatttaatgtgaatcagta

SEQ ID NO: 229759 - DNA, 75 bp, Artificial Sequence
  Synthetic
actacaggccatatgaaagtaatttttggtattttgaggtctagctttattttaaagtttgtgttgattcatcaa

SEQ ID NO: 229760 - DNA, 75 bp, Artificial Sequence
  Synthetic
aacgccccaagttttaggagggttatcatttttgaatccagagaaattgttctaccggaacataagtgatcctct

SEQ ID NO: 229761 - DNA, 75 bp, Artificial Sequence
  Synthetic
atgcctatgacagtatcatcagtaattcagtaggtcaaactagattctcaggacttcttattgtgaaaacagttc

SEQ ID NO: 229762 - DNA, 75 bp, Artificial Sequence
  Synthetic
ttcagtaggtcaaactagattctcaggacttcttattgtgaaaacagttctcgagttcatcttgcaaaaaactga

SEQ ID NO: 229763 - DNA, 75 bp, Artificial Sequence
  Synthetic
acttacttgggcttgaagacatagttaagactggccgaaaatgctctccagtcaactccattccccctcagaaga

SEQ ID NO: 229764 - DNA, 75 bp, Artificial Sequence
  Synthetic
ttataactaaccattgtaagaattaatttactctttccgttatacttatctacattaattccttgaatgtccagc

SEQ ID NO: 229765 - DNA, 75 bp, Artificial Sequence
  Synthetic
aataataacgttccttagacagacagttcgtgaaaatatcacaatcacatcgcaaaatagaataataaattctct

SEQ ID NO: 229766 - DNA, 75 bp, Artificial Sequence
  Synthetic
tatcatcaaaccccgtaatgagccgatttgctgctgacatcttttcaagaacacccagtggaaaacggcttcaag

SEQ ID NO: 229767 - DNA, 75 bp, Artificial Sequence
  Synthetic
gcaattgcgctgggtgtggcaacagcacacggcagcacattggctggtgtcaatgtcggcgaacaatatcaacag

SEQ ID NO: 229768 - DNA, 75 bp, Artificial Sequence
  Synthetic
aggtaaaactacaaaggcgacatgaacatcaggaaattcaagctattgccgaagatgacgaggaaaggaagatat

SEQ ID NO: 229769 - DNA, 75 bp, Artificial Sequence
  Synthetic
gccgtcctcagccagaaacgagaaaaattagctcgtcttgctgcagaaattgaaaacaatattgtggaagatcag

SEQ ID NO: 229770 - DNA, 75 bp, Artificial Sequence
  Synthetic
aattagctcgtcttgctgcagaaattgaaaacaatattgtggaagatcagggatttaaacaatcacagaatcggg

SEQ ID NO: 229771 - DNA, 75 bp, Artificial Sequence
  Synthetic
tacacctgttgaagtaacggttcaagccagacctgtgaatcgaccaactgctctgcctcctccagttgacgacaa

SEQ ID NO: 229772 - DNA, 75 bp, Artificial Sequence
  Synthetic
tatctgaggatttaagggaacaatttaatctgtcttcagacgcagagtcaactataaattttttgccatatgact

SEQ ID NO: 229773 - DNA, 75 bp, Artificial Sequence
  Synthetic
tcatgaaactcagttgccctccaaacctcactacaccaatcatcatccacgtgcaagatcgatgagctcaacccg

SEQ ID NO: 229774 - DNA, 75 bp, Artificial Sequence
  Synthetic
tgccacattaccgtgtttactagagcaatttaaggtaaaatggattaatttatctgaggatttaagggaacaatt

SEQ ID NO: 229775 - DNA, 75 bp, Artificial Sequence
  Synthetic
ctcgataacagccaaggaaagcaggaagatgaatcaacaaacccgattaaaaaacagtttctgagatatcaagaa

SEQ ID NO: 229776 - DNA, 75 bp, Artificial Sequence
  Synthetic
aagatgaatcaacaaacccgattaaaaaacagtttctgagatatcaagaacttcctcctgttcaagaagatgatg

SEQ ID NO: 229777 - DNA, 75 bp, Artificial Sequence
  Synthetic
aaaacagtttctgagatatcaagaacttcctcctgttcaagaagatgatgaatcggaatatacaactgactctca

SEQ ID NO: 229778 - DNA, 75 bp, Artificial Sequence
  Synthetic
gggtcaccgtctctttctaaagggctctcaaaagataaacaggagcaaacgaaagatgtgttgaccttggaaaat

SEQ ID NO: 229779 - DNA, 75 bp, Artificial Sequence
  Synthetic
tctcaaaagataaacaggagcaaacgaaagatgtgttgaccttggaaaatctaggacacattctgaactacctcc

SEQ ID NO: 229780 - DNA, 75 bp, Artificial Sequence
  Synthetic
ctttttacctacacactactcaggcaatatagttcatagatataatgatcaatatggacaacattcttttatggc

SEQ ID NO: 229781 - DNA, 75 bp, Artificial Sequence
  Synthetic
aagtttgacgtgtgctggaattcgaaagacgaatagatccttgatcaacaccatgaccgaattacacattaacca

SEQ ID NO: 229782 - DNA, 75 bp, Artificial Sequence
  Synthetic
ccggcagcaagctctcaggatccctttggcagtattggtgatgtaaatggtgatatcttagaacccataagatca

SEQ ID NO: 229783 - DNA, 75 bp, Artificial Sequence
  Synthetic
ttggcagtattggtgatgtaaatggtgatatcttagaacccataagatcaccttcttcaccgtctgctcctcagg

SEQ ID NO: 229784 - DNA, 75 bp, Artificial Sequence
  Synthetic
cgtgcaattatatcaactaacacactgggtaaatacgcagggggaggtcaagctgcgattgatagtaatataatc

SEQ ID NO: 229785 - DNA, 75 bp, Artificial Sequence
  Synthetic
tgatatcttagaacccataagatcaccttcttcaccgtctgctcctcaggaagacacaagggcaagggaagccta

SEQ ID NO: 229786 - DNA, 75 bp, Artificial Sequence
  Synthetic
tcttgctaaattgtcgtcatcatcaaatgtcactttccgtttgatgttaagtaaatgctgcacacggcatgtacc

SEQ ID NO: 229787 - DNA, 75 bp, Artificial Sequence
  Synthetic
cctttagacgtggatctgaacaagtatatggataatgaactggtttatgacaatgaccccctttgcagtgggatt

SEQ ID NO: 229788 - DNA, 75 bp, Artificial Sequence
  Synthetic
tgtcatttgacgaaaggagacatgttgctatgaacttgtagtccagataacacagtacggttacccacttatcca

SEQ ID NO: 229789 - DNA, 75 bp, Artificial Sequence
  Synthetic
tttagtttcaactcttattgcgagacttgaacacaattctactaacttcaataagtgaccccaaattcaagttta

SEQ ID NO: 229790 - DNA, 75 bp, Artificial Sequence
  Synthetic
atggcaatcaaatctatttgaatattcaaaccactttttaatatcctattacttgttactattgtgtgagacaac

SEQ ID NO: 229791 - DNA, 75 bp, Artificial Sequence
  Synthetic
tcaaaccactttttaatatcctattacttgttactattgtgtgagacaacataagctatcaaataacaatcacgg

SEQ ID NO: 229792 - DNA, 75 bp, Artificial Sequence
  Synthetic
caaaaactttcgtcacacatttccttgtgtatccagttgagagtattttttatgcatttggagctaacttaatag

SEQ ID NO: 229793 - DNA, 75 bp, Artificial Sequence
  Synthetic
caaatcaatcaagaacctctcagatttaacattccttatatcatccacaatcaggaatttatcacatagatcact

SEQ ID NO: 229794 - DNA, 75 bp, Artificial Sequence
  Synthetic
atacaactataaacctccgtacatttgccgcagtactgtaatcaacactgctgtatctcttcttcaagccatctt

SEQ ID NO: 229795 - DNA, 75 bp, Artificial Sequence
  Synthetic
atttaacttaataaacatgacttgattcagagaatatgctgaaaatgttattgattgaacttctcaaatggtgca

SEQ ID NO: 229796 - DNA, 75 bp, Artificial Sequence
  Synthetic
cccaccacataccgttaatttctttgatgttagggggctctgcaggagagaaaagttcatcagatgccgtccggc

SEQ ID NO: 229797 - DNA, 75 bp, Artificial Sequence
  Synthetic
ttcaatcatacacataataaccattttagtagcgttacctttcaatacaatctaggtgattgtgaaaagacttcc

SEQ ID NO: 229798 - DNA, 75 bp, Artificial Sequence
  Synthetic
ctataaatcacttactcgatagaatgtcaagtctacaagtttggagtctccttactctaataaatgtaataatta

SEQ ID NO: 229799 - DNA, 75 bp, Artificial Sequence
  Synthetic
tttcatcaacaatttcagttgtctgataaaaaagggccaatcatcactgccagtttggctttactttcctagcga

SEQ ID NO: 229800 - DNA, 75 bp, Artificial Sequence
  Synthetic
cttactctaataaatgtaataattaactgttggcttagagaataacaggtatgagattgtataataacttatagt

SEQ ID NO: 229801 - DNA, 75 bp, Artificial Sequence
  Synthetic
ataaaaaagggccaatcatcactgccagtttggctttactttcctagcgaagggcaacagttgaaacctatattg

SEQ ID NO: 229802 - DNA, 75 bp, Artificial Sequence
  Synthetic
tgttttcacctgacaaagttcaaaagcgtaaaattttagctgacacctgttatccagttgatagcttttgggttt

SEQ ID NO: 229803 - DNA, 75 bp, Artificial Sequence
  Synthetic
tattgttcatccagaaaatattcctgaaacgaatgcaagaaccgaattaatgaattatggatcaacaactttaca

SEQ ID NO: 229804 - DNA, 75 bp, Artificial Sequence
  Synthetic
ttgggaatctatttgacctcagacatgtttaaaattctgatggcaggtgtgaaaaatttctttaataagatgttc

SEQ ID NO: 229805 - DNA, 75 bp, Artificial Sequence
  Synthetic
gaaacgaatgcaagaaccgaattaatgaattatggatcaacaactttacaggggatggacatcaaaatgccactc

SEQ ID NO: 229806 - DNA, 75 bp, Artificial Sequence
  Synthetic
ttatttgggaccaactgatcgtgaagaaaacactagctgacctacttataccgataaataggcagatatcagaca

SEQ ID NO: 229807 - DNA, 75 bp, Artificial Sequence
  Synthetic
gtcgaccatcaaagggcatcagatgcaaggacaatcaaaaaataataaaacatgaccaaagatatgggaagaagg

SEQ ID NO: 229808 - DNA, 75 bp, Artificial Sequence
  Synthetic
caaggacaatcaaaaaataataaaacatgaccaaagatatgggaagaaggagtcctcatcgcaacaaatgctccc

SEQ ID NO: 229809 - DNA, 75 bp, Artificial Sequence
  Synthetic
caattacatgagattaccccagttttaaaaatgggaaggacactggaagcaatttccaaggggatgtcagaaatg

SEQ ID NO: 229810 - DNA, 75 bp, Artificial Sequence
  Synthetic
tacatacatggctcctccccatctcaaaccattataaaatcactagatgtacatgaggactttgatgcctcgaag

SEQ ID NO: 229811 - DNA, 75 bp, Artificial Sequence
  Synthetic
tttcaactggaagaaccactgcaccagctgctgcctttgatgcttacttaaatgagcatggtgtccctccccctc

SEQ ID NO: 229812 - DNA, 75 bp, Artificial Sequence
  Synthetic
accctaaccttacagattgtacccttaatacaaagttcttgacaactctcaccgggacagaaattttaggtacaa

SEQ ID NO: 229813 - DNA, 75 bp, Artificial Sequence
  Synthetic
ggttgcccaacaagcttgtagcaaggggaccatggttaaaaatgcaacaacagatgcagccgacaagatgtcaaa

SEQ ID NO: 229814 - DNA, 75 bp, Artificial Sequence
  Synthetic
ccacataataatgttggaggcacagtacattatagttaattatcctgtataacaaagaatatacctaccctgatt

SEQ ID NO: 229815 - DNA, 75 bp, Artificial Sequence
  Synthetic
attttataaaccaaacaattaacttcttactttttaagaatcaactaacaacatagaaaagacatttatccttat

SEQ ID NO: 229816 - DNA, 75 bp, Artificial Sequence
  Synthetic
ttctatctctctagacccgggttttcggaatatgtctgatcagaatcaagttcaaatgttaatcaatgcctataa

SEQ ID NO: 229817 - DNA, 75 bp, Artificial Sequence
  Synthetic
aggatttagcccttttattgttcacccatctacccggcaataacactccattccatatattagctcaggtcctct

SEQ ID NO: 229818 - DNA, 75 bp, Artificial Sequence
  Synthetic
aagcagaacatttgatgctttcctcggagtggttcctccagtgataagagtcaaaaacttccaaacagtccctcg

SEQ ID NO: 229819 - DNA, 75 bp, Artificial Sequence
  Synthetic
gttacttttgaagtggaaggaaactgattatttattcttcaacactctggctacagattcacagcaagaagcaga

SEQ ID NO: 229820 - DNA, 75 bp, Artificial Sequence
  Synthetic
ggagtggttcctccagtgataagagtcaaaaacttccaaacagtccctcgcccgtgtcaaaaaagccttcgggct

SEQ ID NO: 229821 - DNA, 75 bp, Artificial Sequence
  Synthetic
ctacagattcacagcaagaagcagagatcttgagtggcagggtaataccgagaatgttgtataatatagacaaat

SEQ ID NO: 229822 - DNA, 75 bp, Artificial Sequence
  Synthetic
ttgcaagggaagtgatcttcccgagttaatacaaagacactaaacatttcaaaagcatgtatgtgggcaaaacgt

SEQ ID NO: 229823 - DNA, 75 bp, Artificial Sequence
  Synthetic
ataccaaaatcctgtctcagccaaggagctccaagcagattggcccgacatgtcatttgatgaaaggagacatgt

SEQ ID NO: 229824 - DNA, 75 bp, Artificial Sequence
  Synthetic
catttatatattatagggaaactaatgttactaacaagaggggtctacctaacggatgtgattgagtgatcagtg

SEQ ID NO: 229825 - DNA, 75 bp, Artificial Sequence
  Synthetic
tgttactaacaagaggggtctacctaacggatgtgattgagtgatcagtgtgtcttataaaccaaacaattgact

SEQ ID NO: 229826 - DNA, 75 bp, Artificial Sequence; identical to SEQ ID NO: 62907
  Synthetic

SEQ ID NO: 229827 - DNA, 75 bp, Artificial Sequence
  Synthetic
aacatagaaaacacatttatccttatgtaatcctcggcttagctggaattaacttttgttgtaattcaatacgct

SEQ ID NO: 229828 - DNA, 75 bp, Artificial Sequence
  Synthetic
atacccacaaaagatattgttttaattaagaaaaactatgaagaacattaagaagatttttctctcgtagtgttc

SEQ ID NO: 229829 - DNA, 75 bp, Artificial Sequence
  Synthetic
caatacttgaaccctcctccttatgctgatcacggtgcaaaccagttaatcccggcagaccagctatcaaatcag

SEQ ID NO: 229830 - DNA, 75 bp, Artificial Sequence
  Synthetic
aaaaggtaaaaattggtcacagcttgttgagacccttcccaatatgcattcagtatgcatagtacacgtagacca

SEQ ID NO: 229831 - DNA, 75 bp, Artificial Sequence
  Synthetic
gcgatttaaacttagatgaccagtttaaagggaatgtctgccacgctttcactttagaggcgataattgacatat

SEQ ID NO: 229832 - DNA, 75 bp, Artificial Sequence
  Synthetic
taaagggaatgtctgccacgctttcactttagaggcgataattgacatatctgcgtataacgagcgaacagtcaa

SEQ ID NO: 229833 - DNA, 75 bp, Artificial Sequence
  Synthetic
gaaatacaaaaatcgcagagcaaaaattgcttaatagagtaatcgggtatatcctgttctttccgttcggtctgt

SEQ ID NO: 229834 - DNA, 75 bp, Artificial Sequence
  Synthetic
gggattatgagcaattttgaatatcctttagctcatactgtggctgcattgctcacaggcagctatacaatcacc

SEQ ID NO: 229835 - DNA, 75 bp, Artificial Sequence
  Synthetic
actttaacagagagaacttcatttaattcacaaaaataatctatttaaaagtgggggttaaattttctagggtgt

SEQ ID NO: 229836 - DNA, 75 bp, Artificial Sequence
  Synthetic
attcacaaaaataatctatttaaaagtgggggttaaattttctagggtgttgtatgagaaatcataaaataaaca

SEQ ID NO: 229837 - DNA, 75 bp, Artificial Sequence
  Synthetic
gtatacaaacacatggcatctttacaccaggaaaatactggttccaatcacagaggattgagtcatattatgagg

SEQ ID NO: 229838 - DNA, 75 bp, Artificial Sequence
  Synthetic
atgttgcgtgaaggaaatcaagcttttattcagaacatggtgatccccaggaatttttccactaatcaattcacc

SEQ ID NO: 229839 - DNA, 75 bp, Artificial Sequence
  Synthetic
cttactttacagaagataatcttataacgctttaggccttacacaggttagaaaattacgcgcacagattaactt

SEQ ID NO: 229840 - DNA, 75 bp, Artificial Sequence
  Synthetic
ttatataatgatgttgcactagataaggttaaaaaacatgcgcaatctgtaaaaatcttaaaacctaaagtcatg

SEQ ID NO: 229841 - DNA, 75 bp, Artificial Sequence
  Synthetic
aacgctttaggccttacacaggttagaaaattacgcgcacagattaacttgtgattgaacgttcagttacaacaa

SEQ ID NO: 229842 - DNA, 75 bp, Artificial Sequence
  Synthetic
caaacattattgatcataattagtgttagcattggcacatggggtgaatccttgaactttatccctaatatgagg

SEQ ID NO: 229843 - DNA, 75 bp, Artificial Sequence
  Synthetic
ttagcattggcacatggggtgaatccttgaactttatccctaatatgaggcaagagattaaggaaatactgagat

SEQ ID NO: 229844 - DNA, 75 bp, Artificial Sequence
  Synthetic
attgggaacaccatgcatcctgcaatctccatccacccgaatttgccgcctattgttctaccaacagtcaagaag

SEQ ID NO: 229845 - DNA, 75 bp, Artificial Sequence
  Synthetic
tgccatatatcataaatataaaagaactgtttgctataatctataagcctctcttttagatacattggagaaaga

SEQ ID NO: 229846 - DNA, 75 bp, Artificial Sequence
  Synthetic
gtcgaaaaagtcccagagaagacaagcctgtttaggatttcgcttcctgccgacatgttctcagtaaaagagggt

SEQ ID NO: 229847 - DNA, 75 bp, Artificial Sequence
  Synthetic
atcagcatctttgggagtggtatttcgtggagcatgaacctcttttctcaactaaaataataagtgatttaagta

SEQ ID NO: 229848 - DNA, 75 bp, Artificial Sequence
  Synthetic
acgaggttatcattgagatcgaaaaacctacgttacattttctctgatgataagtgataaaatttcgtagctaaa

SEQ ID NO: 229849 - DNA, 75 bp, Artificial Sequence
  Synthetic
aacaatagacaggttgtactagcatatgcgaatccaacactcagtgccatttgaaatgatgttcaaatgagacag

SEQ ID NO: 229850 - DNA, 75 bp, Artificial Sequence
  Synthetic
acaaaaacaagagatgatgattttgtgtatcatataaataaagaagaatattaacattgacattgagacttgtca

SEQ ID NO: 229851 - DNA, 75 bp, Artificial Sequence
  Synthetic
gctttaaatgattgatcaagctgattaacttgtaatatgtaacctcttttgggccatcaaagctataataggttt

SEQ ID NO: 229852 - DNA, 75 bp, Artificial Sequence
  Synthetic
actgagagggaacagaaagaagcattattgcatcaggcttcttggcaccacaattcagcaagcataggggaaaac

SEQ ID NO: 229853 - DNA, 75 bp, Artificial Sequence
  Synthetic
tgttatggtgtgaagaatttattcgattggatgcattttttaataccactatgttatatgcatgtcagtgatttt

SEQ ID NO: 229854 - DNA, 75 bp, Artificial Sequence
  Synthetic
tgattaagttctttaaatttgatcaaagtaatattttgtcagtgaatacattcccacatcacttgattaaaaaca

SEQ ID NO: 229855 - DNA, 75 bp, Artificial Sequence
  Synthetic
attagaaagtactgaatctcagagggggagaattgggctcttcttatcattttgcagtctttttctcccaaaact

SEQ ID NO: 229856 - DNA, 75 bp, Artificial Sequence
  Synthetic
catgcttctttatcagtctcatcttaatccaagggataaaaactctccctattttggagatagccagtaacgatc

SEQ ID NO: 229857 - DNA, 75 bp, Artificial Sequence
  Synthetic
attttggagatagccagtaacgatcaaccccaaaatgtggattcggtatgctccggaactctccagaaaacagaa

SEQ ID NO: 229858 - DNA, 75 bp, Artificial Sequence
  Synthetic
gcccagatcacccttgtagagttaaaaactaaattaaaattaaaatccagtgttatgggtgataatcaatgtata

SEQ ID NO: 229859 - DNA, 75 bp, Artificial Sequence
  Synthetic
ttttgaggtctagctttattttaaagtttgtgttgattcatcaaggagtaaatttggtgacaggtcatgatgcct

SEQ ID NO: 229860 - DNA, 75 bp, Artificial Sequence
  Synthetic
agggaacatagcagccatgattgtcaataagacagtgcacaaaatgattttctcgaggcaaggacaagggtaccg

SEQ ID NO: 229861 - DNA, 75 bp, Artificial Sequence
  Synthetic
ccatttgcacgggttctgaatttatcagggattaacaacctcgagcatggactctatcctcagctctcagcaatt

SEQ ID NO: 229862 - DNA, 75 bp, Artificial Sequence
  Synthetic
tgtggacccttatctgactctatttttgatgatcttcaaggttccctggccagtattggtacatcctttgagaga

SEQ ID NO: 229863 - DNA, 75 bp, Artificial Sequence
  Synthetic
ttcgtggagcatgaacctcttttctcaactaaaataataagtgatttaagtatttttataaaagacagggctact

SEQ ID NO: 229864 - DNA, 75 bp, Artificial Sequence
  Synthetic
acgaagaaccaaacatgtgctccgtctaaaacacccccaccaccgcccacagcccatccggagatcaaacccaca

SEQ ID NO: 229865 - DNA, 75 bp, Artificial Sequence
  Synthetic
agcccatccggagatcaaacccacaagcaccccaaccgatgccactagactcaacaccacaaacccaaacagtga

SEQ ID NO: 229866 - DNA, 75 bp, Artificial Sequence
  Synthetic
agcaccccaaccgatgccactagactcaacaccacaaacccaaacagtgatgatgaggatctcacaacatccggc

SEQ ID NO: 229867 - DNA, 75 bp, Artificial Sequence
  Synthetic
aaaaaacctggtttagcagatgcctcagatttcgtcatgaatccattaggcttaaatgtaccaggatcaagggaa

SEQ ID NO: 229868 - DNA, 75 bp, Artificial Sequence
  Synthetic
atacgacttctgatgcggtcactaagcaagggctttcatcaacaatgccacccactccctcaccgcaaccaggca

SEQ ID NO: 229869 - DNA, 75 bp, Artificial Sequence
  Synthetic
cgccacagcaaggaggaaacaacacaaaccactcccaagacgctgcaactgaacttgacaacaccaatacaactg

SEQ ID NO: 229870 - DNA, 75 bp, Artificial Sequence
  Synthetic
gcatgaatctacagaagatagctcttcttcaagtagctttgttgacttgaatgatccatttgcactgctgaatga

SEQ ID NO: 229871 - DNA, 75 bp, Artificial Sequence
  Synthetic
caccaccacaatctccaccaacaacacctccaaacacaacctcagcaccctctccgaaccaccacaaaacaccac

SEQ ID NO: 229872 - DNA, 75 bp, Artificial Sequence
  Synthetic
accaacaatacaaaaagccccaccacaatggaaccaaataaaacaaatggacatttcactagtccctcctccacc

SEQ ID NO: 229873 - DNA, 75 bp, Artificial Sequence
  Synthetic
tcttctagttctggtgcttcagccgaggaagatcaacatgcatcctccaatatcagtttaactttatcttatctt

SEQ ID NO: 229874 - DNA, 75 bp, Artificial Sequence
  Synthetic
actctggagaaaatgaaaatgattgtgatgcagagctaagaatttggagcgttcaggaggacgacctggcagcag

SEQ ID NO: 229875 - DNA, 75 bp, Artificial Sequence
  Synthetic
gataatcagcagaattggccacaaagagtggtgacaaagaagggtaggactttcctttatcccaatgatcttctg

SEQ ID NO: 229876 - DNA, 75 bp, Artificial Sequence
  Synthetic
gttgtgctctcgaccggaaagttgtccagaaacatccctctgttaatcgtctagcttggacaataggaaatcgag

SEQ ID NO: 229877 - DNA, 75 bp, Artificial Sequence
  Synthetic
ccctggaatcgaaggactttataccgctggtttaattaaaaatcaaaacaatttggtctgcaggttgaggcgtct

SEQ ID NO: 229878 - DNA, 75 bp, Artificial Sequence
  Synthetic
taacagccctcgttgaggaataccaaaatcctgtctcagccaaggagctccaagcagattggcccgacatgtcat

SEQ ID NO: 229879 - DNA, 75 bp, Artificial Sequence
  Synthetic
accgtatataggatcacggacagaagacaagatcggttatcctcccttaagagtaaattgtccatcagcggcact

SEQ ID NO: 229880 - DNA, 75 bp, Artificial Sequence
  Synthetic
atttggtctgcaggttgaggcgtctagccaatcaaactgcaaaatctttggaactcttactaagggtcacaaccg

SEQ ID NO: 229881 - DNA, 75 bp, Artificial Sequence
  Synthetic
acaaggtggggaggaacatgcaaagtgcttggacctgattgttgcataggaatagaagacttgtccagaaatatt

SEQ ID NO: 229882 - DNA, 75 bp, Artificial Sequence
  Synthetic
tgcaattatatcaactaacacactgggcaaatatgctggggggggtcaagctgctgttgatagtaatataatctt

SEQ ID NO: 229883 - DNA, 75 bp, Artificial Sequence
  Synthetic
ctttgattgattttgcaaggagttataaaaatcttgaaggataaattgttataaagtagagtcgaagaacattaa

SEQ ID NO: 229884 - DNA, 75 bp, Artificial Sequence
  Synthetic
tgtatttgtcgtatctttactaaatatattggatagcgttaagtgtgtaatgattagagctttaggacaattgct

SEQ ID NO: 229885 - DNA, 75 bp, Artificial Sequence
  Synthetic
ggcagttttagatattgcattatctcttgctaaattgtcgtcagcatcaaatgtcactttccgtttaatgttaaa

SEQ ID NO: 229886 - DNA, 75 bp, Artificial Sequence
  Synthetic
gcagttttagatattgcattatctcttgctaaattgtcgtcagcatcaaatgtcactttccgtttgatgttaaat

SEQ ID NO: 229887 - DNA, 75 bp, Artificial Sequence
  Synthetic
atgttctttgttagaattattcatctaagttgtttttgagtatattcgcttcaatacaactcctcttatatttga

SEQ ID NO: 229888 - DNA, 75 bp, Artificial Sequence
  Synthetic
aaatcaacttgggagatttttaagaagccgataactcaatgtgaatcaatagtttatgtattattgattattata

SEQ ID NO: 229889 - DNA, 75 bp, Artificial Sequence
  Synthetic
tcaggaatgaccttttttatttgttacattaacgttttaaactacctcttaagcctttgtaggtggtctcaatat

SEQ ID NO: 229890 - DNA, 75 bp, Artificial Sequence
  Synthetic
tttcttgttgcacagtttcttgcattacttatttggacttgaagacatagttaagactggccgaaaatgctctcc

SEQ ID NO: 229891 - DNA, 75 bp, Artificial Sequence
  Synthetic
tacttatttggacttgaagacatagttaagactggccgaaaatgctctccagtcaactccgttcccgctcagaag

SEQ ID NO: 229892 - DNA, 75 bp, Artificial Sequence
  Synthetic
ttaagactggccgaaaatgctctccagtcaactccgttcccgctcagaagggacatgctgttcaaggaattttaa

SEQ ID NO: 229893 - DNA, 75 bp, Artificial Sequence
  Synthetic
caattaagaaaaactaaaaattgaagaatattaaagattttctttaatattcagaaaagattttttattctcttc

SEQ ID NO: 229894 - DNA, 75 bp, Artificial Sequence
  Synthetic
ctgatcccacttgtaatagagatcatgaccttgataatctaacaaatcgtgaacttttgctattgatggcccgaa

SEQ ID NO: 229895 - DNA, 75 bp, Artificial Sequence
  Synthetic
aatttactttttccgttatacttacttgcattaattctttgaatatttagcatcattaacgacttgtcttaattc

SEQ ID NO: 229896 - DNA, 75 bp, Artificial Sequence
  Synthetic
aataattctcacaatgtgggactcatcatatatgcaacaagtcagcgaggggttgatgactggaaaagttcccat

SEQ ID NO: 229897 - DNA, 75 bp, Artificial Sequence
  Synthetic
atgaattggtgctcacccgactagcccaccacataccgttaatttctttaatgttagggggttctgcaggagaga

SEQ ID NO: 229898 - DNA, 75 bp, Artificial Sequence
  Synthetic
ttagagaagctatacaagagaagaaaaccaaaaggcacagttggactacaatgtagtccttgtctaatgtcaaag

SEQ ID NO: 229899 - DNA, 75 bp, Artificial Sequence
  Synthetic
ctgaactgaggaaatttcccttatcagcttaaaatctgatctgttaagtcatgggcccttaataatctgtttgag

SEQ ID NO: 229900 - DNA, 75 bp, Artificial Sequence
  Synthetic
agatgtgttgaccttggaaaatctaggacacattctgagctatctccacagatcagaaattggaaattggatgag

SEQ ID NO: 229901 - DNA, 75 bp, Artificial Sequence
  Synthetic
tgatagtgcatttgcatagactcaattatcctttattaagaaaaagataaatagaacacagagaattgataaaat

SEQ ID NO: 229902 - DNA, 75 bp, Artificial Sequence
  Synthetic
ggcaacaattaaaacctatattaaaaatcttacagagattatcagacttgttatcacctgacaaagttcaaaagc

SEQ ID NO: 229903 - DNA, 75 bp, Artificial Sequence
  Synthetic
cattcaagttgtttttgagtatatctacttcaacacaactcccctttatatttgattcaagatttaaaatgcaac

SEQ ID NO: 229904 - DNA, 75 bp, Artificial Sequence
  Synthetic
tgcaagcctcatacgaatcattttattcttcctcaaagtcaaggtaaaggacagtgattattgttcgaaagttga

SEQ ID NO: 229905 - DNA, 75 bp, Artificial Sequence
  Synthetic
caaccaccaagccataccgtctatatatcatgaaactcaattgccctccaaacctaattacaccaatcaccatcc

SEQ ID NO: 229906 - DNA, 75 bp, Artificial Sequence
  Synthetic
tttcaacccttatcgcgagacttgaatacaatcctactaacttcaataagtgaccccaaattcaagtttgctgaa

SEQ ID NO: 229907 - DNA, 75 bp, Artificial Sequence
  Synthetic
cgtagtagtacagaaagtagtcccaccaatcacattccccgtgctcgaccaccctcaacatttaacttatcaaaa

SEQ ID NO: 229908 - DNA, 75 bp, Artificial Sequence
  Synthetic
aaataaatgcaagaatcaaattaataaattatggatcaacagctcaacaggggatggatatcaagatgccactct

SEQ ID NO: 229909 - DNA, 75 bp, Artificial Sequence
  Synthetic
aagccaaacctttcagctaaggatttagcccttttattgttcacccatctacccggcaataacactccattccat

SEQ ID NO: 229910 - DNA, 75 bp, Artificial Sequence
  Synthetic
atgcactgatctcacttgtaatagagatcatgaccttgataatctaacaaatcgtgaacttttgctactgatggc

SEQ ID NO: 229911 - DNA, 75 bp, Artificial Sequence
  Synthetic
aaggacaatccaaaaacaacaaaacatgaccagggatgtgtggggaaggactcttcaccgcgacaaatgtcccct

SEQ ID NO: 229912 - DNA, 75 bp, Artificial Sequence
  Synthetic
agcatttttggatgcatttcaccagattctaagtgaaggagagaatgctcaggcggcactaactcgactaagcag

SEQ ID NO: 229913 - DNA, 75 bp, Artificial Sequence
  Synthetic
ttgcttacaagtcagggaaatccggagcatttttggatgcatttcaccagattctaagtgaaggagagaatgctc

SEQ ID NO: 229914 - DNA, 75 bp, Artificial Sequence
  Synthetic
gctctcaaaagacaaacaggagcaaacaaaagatgtgttgaccttggaaaatctaggacatattctgaattatct

SEQ ID NO: 229915 - DNA, 75 bp, Artificial Sequence
  Synthetic
catacatagttcccccccatatcaaacccttacaaaatcaccagatgtacatgaggactttgatgcctcgaaggt

SEQ ID NO: 229916 - DNA, 75 bp, Artificial Sequence
  Synthetic
ccaaatccaacaattgacaaaggatgggtttgtgtttattcatctgagcaaggtgaaacacgggcccttaaaatc

SEQ ID NO: 229917 - DNA, 75 bp, Artificial Sequence
  Synthetic
gatgagacatcacttcgtgcagcattaagtttgacgtgtgccggaattcgaaagacaaatagatctttgatcaac

SEQ ID NO: 229918 - DNA, 75 bp, Artificial Sequence
  Synthetic
tggcagaattatcaacgcgttacaacttgcctgcaaatgttacggaaaatagtataaatcttgaccttaattcca

SEQ ID NO: 229919 - DNA, 75 bp, Artificial Sequence
  Synthetic
atgaaaacctcccgcaagaccaaaacggtgttatcaagcagacatatacaggtattcaccttgacaaaggaggtc

SEQ ID NO: 229920 - DNA, 75 bp, Artificial Sequence; identical to SEQ ID NO: 62745
  Synthetic

SEQ ID NO: 229921 - DNA, 75 bp, Artificial Sequence
  Synthetic
atactggaatgacattgttgcatcatttaaagtctaacttcgttgttccagagtggcaacaaacaaggaatctat

SEQ ID NO: 229922 - DNA, 75 bp, Artificial Sequence
  Synthetic
gaatatgtctgatcagaatcaagttcaaatgttaatcaatacctacaaacgtgatttacatgcttgttttgatag

SEQ ID NO: 229923 - DNA, 75 bp, Artificial Sequence
  Synthetic
tcctgaaagctaggataacaataatcacaaggtcattgtaaattactcgatcaaaatgttattaagctatcttaa

SEQ ID NO: 229924 - DNA, 75 bp, Artificial Sequence
  Synthetic
gtttaagatattttaaatcatacccacaaaagatattgttttaattaagaaaaactatgaagaacattaagaaga

SEQ ID NO: 229925 - DNA, 75 bp, Artificial Sequence
  Synthetic
cacaaggtcattgtaaattactcgatcaaaatgttattaagctatcttaaacttaatgatgcagctctgtttcac

SEQ ID NO: 229926 - DNA, 75 bp, Artificial Sequence
  Synthetic
aaattacagatattacaaatccattatggctagattctgtaatacaatacttacctgaagatagcgacattctta

SEQ ID NO: 229927 - DNA, 75 bp, Artificial Sequence
  Synthetic
ccagcagtattgaaataaagttaactggacaacagatcattatcactcgtgttaatatggggtttctagtggaag

SEQ ID NO: 229928 - DNA, 75 bp, Artificial Sequence
  Synthetic
ctatattcaagtgtctgattaacaatttgtacctctaaggaaagtcatgaagaacattaagaaaaaggatgttct

SEQ ID NO: 229929 - DNA, 75 bp, Artificial Sequence
  Synthetic
tgaaacaagggaacagctttataagactattgtgaatatttggacacgtacttctcctaatattccaaaaattag

SEQ ID NO: 229930 - DNA, 75 bp, Artificial Sequence
  Synthetic
caattacaacacatacatgcaatacttgaaccctcctccttatgctgatcacggtgcaaaccagttaatcccggc

SEQ ID NO: 229931 - DNA, 75 bp, Artificial Sequence
  Synthetic
tcagttgtttttggactagtggctgaggcagttctaagagaacacagtcaaatggagaagggccaacctctcaat

SEQ ID NO: 229932 - DNA, 75 bp, Artificial Sequence
  Synthetic
aatggagaagggccaacctctcaatctgacacaatacatgaacagcaaaattgctatataagtggcttaaattag

SEQ ID NO: 229933 - DNA, 75 bp, Artificial Sequence
  Synthetic
gttacaacttgcctgcaaatgttacagaaaagagcataaatcttgaccttaattccacagcacgatggataaaag

SEQ ID NO: 229934 - DNA, 75 bp, Artificial Sequence
  Synthetic
ataacgagcgaacagtcaaaggtgttccagcatggctgcctcttgggattatgagcaattttgaatatcctttag

SEQ ID NO: 229935 - DNA, 75 bp, Artificial Sequence
  Synthetic
accaggtaggaatttttctgatttgtaaagcaatgtcgcgccaaagacaagcaattccttactggttaaaacata

SEQ ID NO: 229936 - DNA, 75 bp, Artificial Sequence
  Synthetic
taaagcaatgtcgcgccaaagacaagcaattccttactggttaaaacatatagaaaagaattatcctgcttcatt

SEQ ID NO: 229937 - DNA, 75 bp, Artificial Sequence
  Synthetic
aggcagctatacaatcacccaatttactcacaacgggcaaaaattcgtccgtgtcaatcgactcggtacaggaat

SEQ ID NO: 229938 - DNA, 75 bp, Artificial Sequence
  Synthetic
gtgtcaatcgactcggtacaggaatcccggcacacccactcagaatgttgcgtgaaggaaatcaagcttttattc

SEQ ID NO: 229939 - DNA, 75 bp, Artificial Sequence
  Synthetic
caaaatatatcttttgcaagtgatgtgtgcttgaatacttcgatataatacatactaataacgattgattaagaa

SEQ ID NO: 229940 - DNA, 75 bp, Artificial Sequence
  Synthetic
aggctgttcctataatctgattgtgagattataaacttgtagaattaccgtgggtcacaactgttgcatatcctc

SEQ ID NO: 229941 - DNA, 75 bp, Artificial Sequence
  Synthetic
ggttccagaatggcaacaaacaaggaatctattttctcatctctttaaaaaccccaagtcaacaattatagaacc

SEQ ID NO: 229942 - DNA, 75 bp, Artificial Sequence
  Synthetic
aaaaacttcctgatgatgcctggcgcccatccaaggacaaattaattgggaacaccatgcatcctgcagtctcca

SEQ ID NO: 229943 - DNA, 75 bp, Artificial Sequence
  Synthetic
ctagacttgagaaatcactttatttgctcattgaggggaaagataactaagtattacaatgatatattaaagtta

SEQ ID NO: 229944 - DNA, 75 bp, Artificial Sequence
  Synthetic
atgtttaagattctgatggcaggtgtgaaaaatttcttcaataagatgttcactcttcatgttgtaaatgaccac

SEQ ID NO: 229945 - DNA, 75 bp, Artificial Sequence
  Synthetic
aatctagttatcaaggcagtagagaaaggtaaaaattggtcacaacttgttgagacccttcctaatatgcattca

SEQ ID NO: 229946 - DNA, 75 bp, Artificial Sequence
  Synthetic
gcagcatccaactcaatatcctgatgcaaggttgtcctctcctataatcctagaccagtgtgacttattagccag

SEQ ID NO: 229947 - DNA, 75 bp, Artificial Sequence
  Synthetic
taaatctgaatcattaagagcataaccttaacaaagagaacttcatttaattcacaaagataatctatttaaaaa

SEQ ID NO: 229948 - DNA, 75 bp, Artificial Sequence
  Synthetic
gtggctgaggcagttctaagagaacacagccagatggagaagggccaacccctcaacctgacacaatacatgaac

SEQ ID NO: 229949 - DNA, 75 bp, Artificial Sequence
  Synthetic
tcaccgttccttttcattcaatttgggatcatattttaacttccattcaatatgatgcaattaatcatgttgatg

SEQ ID NO: 229950 - DNA, 75 bp, Artificial Sequence
  Synthetic
aaatctgaatcattaacagcataactttaacaaagagaacttcatttaattcacgaaaataatctatttaaaaat

SEQ ID NO: 229951 - DNA, 75 bp, Artificial Sequence
  Synthetic
aaattagcatgggtatcccaagtttaatcacataataatgttggaggcacagtatattatagttgattgttctgt

SEQ ID NO: 229952 - DNA, 75 bp, Artificial Sequence
  Synthetic
atctgtataaggagtatggcttaggtggatatttgtcagattcttacaagattagtttgtattgatttcaataat

SEQ ID NO: 229953 - DNA, 75 bp, Artificial Sequence
  Synthetic
tcgctttaagccttacataagtgagaaaatcacgtgcacagattaacttgtgattaaacattcggtcacaccggt

SEQ ID NO: 229954 - DNA, 75 bp, Artificial Sequence
  Synthetic
acaataaaggatatacctactctgagttatatttactggtatatgatagtagcgtcatcttattaaataattgtc

SEQ ID NO: 229955 - DNA, 75 bp, Artificial Sequence
  Synthetic
gttatatttactggtatatgatagtagcgtcatcttattaaataattgtcatacaataggctgttcctataatct

SEQ ID NO: 229956 - DNA, 75 bp, Artificial Sequence
  Synthetic
aaatcacgcgcacaaattaacttgtgattgaacgttcggtcacaccagtggtaacttttcaatgttagttactca

SEQ ID NO: 229957 - DNA, 75 bp, Artificial Sequence
  Synthetic
gattgtgagagtataaacttgtagaattaccgtgagtcacaactgttgcatatcttccaaaatatatcttttgta

SEQ ID NO: 229958 - DNA, 75 bp, Artificial Sequence
  Synthetic
ttgagctttatccttaatataatgtaagaaattaaggaaatactgagatatactagttgaattgagttatgacat

SEQ ID NO: 229959 - DNA, 75 bp, Artificial Sequence
  Synthetic
tataaacaatttttgctcagttttgctttgatttaataacatatatcattgtgcccttcattgccaagtcaactc

SEQ ID NO: 229960 - DNA, 75 bp, Artificial Sequence
  Synthetic
tattatacatacgagtaacgattgattaagaaaaatcaatgatggatattaaatgtccatcaagcaggtgtcgta

SEQ ID NO: 229961 - DNA, 75 bp, Artificial Sequence
  Synthetic
cgatctgctataatctataggcatctcttttacatacattggggaaagaactaggttatcgttgagattagaagg

SEQ ID NO: 229962 - DNA, 75 bp, Artificial Sequence
  Synthetic
atagtaagaaaaactaatgaagaacattaattgctggataaaagtgattaagttctttaaatttgatcaaagtaa

SEQ ID NO: 229963 - DNA, 75 bp, Artificial Sequence
  Synthetic
ttaagaaaaatcaatgatggatattaaatgtccatcaagcaggtgtcgtaagataccaggggtttcacatactgc

SEQ ID NO: 229964 - DNA, 75 bp, Artificial Sequence
  Synthetic
atagtcctagaccagtgtgatttattagccagaagtttagggttatacagtcattattcacataatccgaaattg

SEQ ID NO: 229965 - DNA, 75 bp, Artificial Sequence
  Synthetic
tttaccgtttaaggaattcaacagcattaaaaacatttcttcagaactgttcaatactcaccgttccttttcatt

SEQ ID NO: 229966 - DNA, 75 bp, Artificial Sequence
  Synthetic
catcacattcaaggtcaaaaccctcatgcgcaggggatcgccctccatttgtggggagcatttttcctatatgat

SEQ ID NO: 229967 - DNA, 75 bp, Artificial Sequence
  Synthetic
gttactcctgaaatggaaagaaacggatcatttattcttcaacactctggctacggattcacaacaagaagcaga

SEQ ID NO: 229968 - DNA, 75 bp, Artificial Sequence
  Synthetic
ggcaaggacaagggtaccgtcacatgaatctgacttctactaataaatattggacaagtagcaacggaacgcaaa

SEQ ID NO: 229969 - DNA, 75 bp, Artificial Sequence
  Synthetic
gtttggaatagcagactttattatttttaaggttccagtaaaaacgataatccggaatgcagtaagtttacaagc

SEQ ID NO: 229970 - DNA, 75 bp, Artificial Sequence
  Synthetic
taccgtgaccaaaacttgaccccttatctatgtgacgatgagtttattgtaagcgtcgctagttatgaatgtttt

SEQ ID NO: 229971 - DNA, 75 bp, Artificial Sequence
  Synthetic
agaggtataatacatgggaaatatgtgcccgcgcttggctcgaagacagtgatggagctgattatcctcctcttg

SEQ ID NO: 229972 - DNA, 75 bp, Artificial Sequence
  Synthetic
ttccagcaattacaatacatacatgcaataccttaacccccctccttatgctgaccacggtgcaaaccagttaat

SEQ ID NO: 229973 - DNA, 75 bp, Artificial Sequence
  Synthetic
agcaaggaggaaacaacacaaaccactcccaagacgctacaactgaacttgataacaccaacacaactgcacaac

SEQ ID NO: 229974 - DNA, 75 bp, Artificial Sequence
  Synthetic
acaccaagaaaatattggttccaatcacagatgattaagtcatattatgatgagctctgtgatcttaatctgaaa

SEQ ID NO: 229975 - DNA, 75 bp, Artificial Sequence
  Synthetic
agtgtgcccaaaactttattaaaaccataattcaggcaaaattgacccctcaacaatactgtgaattattctctc

SEQ ID NO: 229976 - DNA, 75 bp, Artificial Sequence
  Synthetic
caacaatactgtgaattattctctctacaaaaacattggggtcatcccgttttatacaatgatgttgcactagat

SEQ ID NO: 229977 - DNA, 75 bp, Artificial Sequence
  Synthetic
tcaggaggaaacgaagtatcctctggagggaaggcgacatgttcccttttctagatgggttaataaatgctccaa

SEQ ID NO: 229978 - DNA, 75 bp, Artificial Sequence
  Synthetic
tcaacttgttggattaattataacttaagttgtcccttttaaaattaattcacataaggtagtttaaatttgtat

SEQ ID NO: 229979 - DNA, 75 bp, Artificial Sequence
  Synthetic
ttatcaacatctttgggagtggtattttgtggagcatgaacctcttttttcaactaaaattataagtgatttaag

SEQ ID NO: 229980 - DNA, 75 bp, Artificial Sequence
  Synthetic
ccaacaatggaccactgctggccatatctggcatccttcatcaactgagggttgaaaaagtcccagagaagacaa

SEQ ID NO: 229981 - DNA, 75 bp, Artificial Sequence
  Synthetic
cgacatgttctcagtaaaagagggtatgatgaagaaaagaggagaaagttccccggtagtttattttcaagcgcc

SEQ ID NO: 229982 - DNA, 75 bp, Artificial Sequence
  Synthetic
ttaattaaaaatcaaaacaatttggtctgcaggttgaggcgtctagccaatcaaactgcaaaatccttggaactc

SEQ ID NO: 229983 - DNA, 75 bp, Artificial Sequence
  Synthetic
atactttatgaacaatttttgctcagttttgttttgatttaataatatatatcgttgtgcccttcattgctaaat

SEQ ID NO: 229984 - DNA, 75 bp, Artificial Sequence
  Synthetic
tgctattgactttctactcacaaggtggggaggaacatgcaaagtgcttggacctgattgttgcatcggaataga

SEQ ID NO: 229985 - DNA, 75 bp, Artificial Sequence
  Synthetic
aacaaaaagaggggactggttggggtctgggtggtaaatggtggacatccgactggggtgttcttactaacttgg

SEQ ID NO: 229986 - DNA, 75 bp, Artificial Sequence
  Synthetic
gggaattactccaacatgaggactacatgcttctttatcagtctcatcttaatccaagggataaaaactctccct

SEQ ID NO: 229987 - DNA, 75 bp, Artificial Sequence
  Synthetic
gactggggtgttcttactaacttgggcattttactactattgtccatagctgtcttgattgctctatcctgtatt

SEQ ID NO: 229988 - DNA, 75 bp, Artificial Sequence
  Synthetic
cacagtacggttacccacttatccactctgatacgaattatccccagatcatggcaatcaaatctatttgaatat

SEQ ID NO: 229989 - DNA, 75 bp, Artificial Sequence
  Synthetic
cacaattcagcaagcataggggaaaacgccatagtgaggggtgcgagttttgttactgatcttgagaaatacaac

SEQ ID NO: 229990 - DNA, 75 bp, Artificial Sequence
  Synthetic
gaagataaccgaaataacccacctgattgtgctaatgcttatcattatcacttaggaggtatagagggacttcaa

SEQ ID NO: 229991 - DNA, 75 bp, Artificial Sequence
  Synthetic
cttaggaggtatagagggacttcaacagaaattgtggacatgtatatcatgtgcccaaatcacccttgtggagtt

SEQ ID NO: 229992 - DNA, 75 bp, Artificial Sequence
  Synthetic
ctattctactgttttactcagcttagtataccgcaacatataagtggactctccacccctctcctcgtgcatttt

SEQ ID NO: 229993 - DNA, 75 bp, Artificial Sequence
  Synthetic
gcaatatctcaacggtgttcaactgccacaatcgctaaaaacaatggcaaggtgtggacccttatctgactctat

SEQ ID NO: 229994 - DNA, 75 bp, Artificial Sequence
  Synthetic
gttgatgtggctaatttcttgagggcatattcatggtctgacgtcttaaaagggaaaaggctaattggtgccaca

SEQ ID NO: 229995 - DNA, 75 bp, Artificial Sequence
  Synthetic
tcttgtttcaaaaagcctcttaccttctcggaaaaattaattgctctcataacgccccaagttttaggagggtta

SEQ ID NO: 229996 - DNA, 75 bp, Artificial Sequence
  Synthetic
tctacaggaatataagtgatcctctcacttcgggtctatttcaactcaagaatgcattggaatttcttggaaagg

SEQ ID NO: 229997 - DNA, 75 bp, Artificial Sequence
  Synthetic
aagaattgttttatatcttgattgctaaaaaacctgggttagcagatgcctcagatttcgtcatgaatccattag

SEQ ID NO: 229998 - DNA, 75 bp, Artificial Sequence
  Synthetic
aactggatcatcttaattgaagtagtaatttatttctgttttaaatgtgattttaacttttaaagggttaaatgg

SEQ ID NO: 229999 - DNA, 75 bp, Artificial Sequence
  Synthetic
aataataacgttccttagacaaacagttcgtgaaaatatcacgatcacgtcacaaaatagaataataaattctct

SEQ ID NO: 230000 - DNA, 75 bp, Artificial Sequence
  Synthetic
catcattaacgacttgtcttaattcaatttttcggatgtaaactataagaaaaaatgagccactttccctctact

SEQ ID NO: 230001 - DNA, 75 bp, Artificial Sequence
  Synthetic
gttcgtgaaaatatcacgatcacgtcacaaaatagaataataaattctctctttcatataggttctgatttagag

SEQ ID NO: 230002 - DNA, 75 bp, Artificial Sequence
  Synthetic
ctatcagacagtgcttaactttttacctacacactactcaggcaacatagttcatagatataatgatcaatatgg

SEQ ID NO: 230003 - DNA, 75 bp, Artificial Sequence
  Synthetic
acatgaaaattggattgccatgcactgatctcacttgtaatagagatcatgaccttgataatctaacaaatcgtg

SEQ ID NO: 230004 - DNA, 75 bp, Artificial Sequence
  Synthetic
atgagtaatacatctacacgtgcaattatatcaactaacacactgggtaaatatgctgggggaggtcaagctgct

SEQ ID NO: 230005 - DNA, 75 bp, Artificial Sequence
  Synthetic
agtttaactacagaagggacaatgttgatgaaattaagagaattaacaagaaaccgatggaaaagctggttttct

SEQ ID NO: 230006 - DNA, 75 bp, Artificial Sequence
  Synthetic
tatctgagtctttagaaaaattcacatgtactgttgatgtggctaatttcttgagggcatattcatggtccgaca

SEQ ID NO: 230007 - DNA, 75 bp, Artificial Sequence
  Synthetic
tacctatattttgataaacctttagatgtggatttgaacaagtatatggacaatgagttggtttatgacaatgac

SEQ ID NO: 230008 - DNA, 75 bp, Artificial Sequence
  Synthetic
aatcagtgtgcaagcctcatacgaccattttattcttcctcaaagtcaaggtaaaggacagtgattattgatcga

SEQ ID NO: 230009 - DNA, 75 bp, Artificial Sequence
  Synthetic
tatctgaggatttaagggaacaatttaacctgtctccagaatcagaattaactataaatttgttgccgtatgact

SEQ ID NO: 230010 - DNA, 75 bp, Artificial Sequence
  Synthetic
caatgacacagagttaaattatgtcagttgtgctctcgaccggaaagttgtccagaaacatccctccgttaaacg

SEQ ID NO: 230011 - DNA, 75 bp, Artificial Sequence
  Synthetic
cttaagtggatatttgtcagattcttacaagattagtttgtattgattttaataatgctttaaccttacattgct

SEQ ID NO: 230012 - DNA, 75 bp, Artificial Sequence
  Synthetic
aagataagattggttatcctcccttaagagtgaattgcccatcagcagcacttaaagaagctattgagatggttt

SEQ ID NO: 230013 - DNA, 75 bp, Artificial Sequence
  Synthetic
cactgcagatcgagaaaaattgcttattcctcttctcaattcaagagtaaatctagactaccagacagtgcttaa

SEQ ID NO: 230014 - DNA, 75 bp, Artificial Sequence
  Synthetic
tgattaagttctttaaatttgatcaaagtaatattttgtcagtgaatacattcccatatcacttgattaaaaaca

SEQ ID NO: 230015 - DNA, 75 bp, Artificial Sequence
  Synthetic
ctttttacctactcactactcaggcaacatagttcatagatataatgatcaatatgggcaacattcctttatggc

SEQ ID NO: 230016 - DNA, 75 bp, Artificial Sequence
  Synthetic
cataccgttaatttctttaatgttagggggctctgcaggagagaagagttcatcagatgctgttcggctatttct

SEQ ID NO: 230017 - DNA, 75 bp, Artificial Sequence
  Synthetic
cgtgcaattatatcaactaatacgctgggtaaatatgctgggggaggtcaagctgccattgatagtaatataatc

SEQ ID NO: 230018 - DNA, 75 bp, Artificial Sequence
  Synthetic
agctgccattgatagtaatataatcttccaaaatactattaatttaggagttgcagttttagatattgcattatc

SEQ ID NO: 230019 - DNA, 75 bp, Artificial Sequence
  Synthetic
tgatacctctgagggacaactcttgacaccagaccacggatcaaacatattttaatcaaacaccctaaattttta

SEQ ID NO: 230020 - DNA, 75 bp, Artificial Sequence
  Synthetic
aatgtcactttccgtttaatgttaaataagtgctgcacacggcatgtaccatctgagtatctattttttgataaa

SEQ ID NO: 230021 - DNA, 75 bp, Artificial Sequence
  Synthetic
cgcaaacaaatgacactggatgctttggtactcttcaagaatacaattctacgaagaaccaaacatgtgctccgt

SEQ ID NO: 230022 - DNA, 75 bp, Artificial Sequence
  Synthetic
gagcataaatcttgaccttaattccacagcacgatggataaaagaacccagtgttgggggctggacagtgaagtg

SEQ ID NO: 230023 - DNA, 75 bp, Artificial Sequence
  Synthetic
tttccaactattgctgcatggacactaggagaaactatagtcggaagcattttttctgatgagtcttctcaaagt

SEQ ID NO: 230024 - DNA, 75 bp, Artificial Sequence
  Synthetic
taggagaaactatagtcggaagcattttttctgatgagtcttctcaaagtacagatccgataagttcaggttgca

SEQ ID NO: 230025 - DNA, 75 bp, Artificial Sequence
  Synthetic
aatactggaatgacattgttgcatcatttaaagtctaacttcgttgttccagaatggcaacaaacaaggaatcta

SEQ ID NO: 230026 - DNA, 75 bp, Artificial Sequence
  Synthetic
tgtgtacccagttgagagtattttttatgcatttggggctaacttaatagtagaaagtttaagcctgagtaggat

SEQ ID NO: 230027 - DNA, 75 bp, Artificial Sequence
  Synthetic
gctttgaaggatcaagaattacagcaatcattgattcctggatttagatccattgttcatatgctttcagaatgg

SEQ ID NO: 230028 - DNA, 75 bp, Artificial Sequence
  Synthetic
tcaggaatttatcacatagatcacttcggattcttcaatctactttccgacatgaattagtgctcacccggctag

SEQ ID NO: 230029 - DNA, 75 bp, Artificial Sequence
  Synthetic
tccatattagccccaatctgttgggaatctatttgacttcagatatgtttaagattctgatggcaggtgtgaaaa

SEQ ID NO: 230030 - DNA, 75 bp, Artificial Sequence
  Synthetic
aatgttagggggctctgcaggagagaaaagttcatcagatgctgttcgactatttcttacagcaagttaccagaa

SEQ ID NO: 230031 - DNA, 75 bp, Artificial Sequence
  Synthetic
aaaagttcatcagatgctgttcgactatttcttacagcaagttaccagaatttcatccacaatttcagttgtctg

SEQ ID NO: 230032 - DNA, 75 bp, Artificial Sequence
  Synthetic
cggtttggctttactttcctagtgaagggcaacaattgaaacctatattaaaaatcttacagagattgtcagact

SEQ ID NO: 230033 - DNA, 75 bp, Artificial Sequence
  Synthetic
atcagttgtttttgggctagtggctgaggcagttctaagagaacacagccagatggagaagggccaacccctcaa

SEQ ID NO: 230034 - DNA, 75 bp, Artificial Sequence
  Synthetic
gtgtaaaactttagctgacacctgttgttcaattgatagcttttgggtttatccaagcaagtctacgcggactaa

SEQ ID NO: 230035 - DNA, 75 bp, Artificial Sequence
  Synthetic
tggagagacaaggctaataaggtcaagaatactcctttttcgcatttgataaattgttcatttcttgaactttct

SEQ ID NO: 230036 - DNA, 75 bp, Artificial Sequence
  Synthetic
tatttttcatccagaagagattcctgaaataaatacaaggactaaattgatagaatatggatcaacagctctaca

SEQ ID NO: 230037 - DNA, 75 bp, Artificial Sequence
  Synthetic
aaattgttcatttcttgaactttcttcacataccagttcagtctcttctaatcaacatgtgaccaattcaaaata

SEQ ID NO: 230038 - DNA, 75 bp, Artificial Sequence
  Synthetic
gaggatggatatcaagatgccaccctcggagcagaatctgggcgaaaattgtcgaccatcaaaggacatcagatt

SEQ ID NO: 230039 - DNA, 75 bp, Artificial Sequence
  Synthetic
aaacctttataaaatcgatagatgtacatgaggactttgatgcctcgagagtaatcttaaattctaaaataaata

SEQ ID NO: 230040 - DNA, 75 bp, Artificial Sequence
  Synthetic
tcttaagtgaatcctttcttcaatatgcagcatccaactcaatatcctgatgcaaggttgtcctctcctatagtc

SEQ ID NO: 230041 - DNA, 75 bp, Artificial Sequence
  Synthetic
ccatctagagagcaagcctcatatttgtatgttgattgcagtaatattccttctatctctctagacccgggtttt

SEQ ID NO: 230042 - DNA, 75 bp, Artificial Sequence
  Synthetic
aaggctttcaagagtccgcaggactgtgggtcaccgtctctttctaaagggctctcaaaagacaaacaggagcaa

SEQ ID NO: 230043 - DNA, 75 bp, Artificial Sequence
  Synthetic
ttctttagagtcatctttctgccatcgttatactattccattcagtgaaggaaaggctctttttcacaaggtcca

SEQ ID NO: 230044 - DNA, 75 bp, Artificial Sequence
  Synthetic
gggtagtctcatcaatgcattacaagctttatgatcttttgcctccaggtgaattgagaaaggcgatttgcttgg

SEQ ID NO: 230045 - DNA, 75 bp, Artificial Sequence
  Synthetic
catttacattctcttatgttggattatgaaaacaattcacctctactagacttgagaaatcactttatttgctca

SEQ ID NO: 230046 - DNA, 75 bp, Artificial Sequence
  Synthetic
ctacggattcacaacaagaagcagagattttgagcggccgggtaataccaagaatgttgtataatatagacagat

SEQ ID NO: 230047 - DNA, 75 bp, Artificial Sequence
  Synthetic
cagaaggataaaaggacaaagagggtcattaagaagtaactggaagtttataggaacagatttggagttgtttgg

SEQ ID NO: 230048 - DNA, 75 bp, Artificial Sequence
  Synthetic
aggttgacaatcagatcaccttcagttttcagtttcaactcttattgtgagacttgaacacaattctactaactt

SEQ ID NO: 230049 - DNA, 75 bp, Artificial Sequence
  Synthetic
ttaaattggattttatcagaaatacaaagatcgcagaacaaaaattacttaacagagtaatcgggtatatcctat

SEQ ID NO: 230050 - DNA, 75 bp, Artificial Sequence
  Synthetic
attaaagacgtcttcattgagaggtataacacatgggaaatatgtgcccgcgcttggctcgaagacagtgatgga

SEQ ID NO: 230051 - DNA, 75 bp, Artificial Sequence
  Synthetic
taacagtacatcaagaacaagggattgtcacataccctaatcactggcttactacaggccatatgaaagtaattt

SEQ ID NO: 230052 - DNA, 75 bp, Artificial Sequence
  Synthetic
tattctctaactaaacctgaatatcctttgttgatacctctgagggaccacttttgacactagaccacggatcaa

SEQ ID NO: 230053 - DNA, 75 bp, Artificial Sequence
  Synthetic
ttttcaatcatacacataataaccactttagtagcgttacctttcagtacagtataggtaatcgaggaaagactt

SEQ ID NO: 230054 - DNA, 75 bp, Artificial Sequence
  Synthetic
ctttagtagcgttacctttcagtacagtataggtaatcgaggaaagacttctgagcatggcagaattatcaacgc

SEQ ID NO: 230055 - DNA, 75 bp, Artificial Sequence
  Synthetic
ctcaaatgcaaaaaactcagaatggtacttgtgttgcagtaaacgaagaattcaacgactccaaattgattttcc

SEQ ID NO: 230056 - DNA, 75 bp, Artificial Sequence
  Synthetic
tatagaaaagaattatcctgcttcattacacgagtttttcctaactttagggtttccttctttagaatcatcttt

SEQ ID NO: 230057 - DNA, 75 bp, Artificial Sequence
  Synthetic
gttcttggctctgaggatcttgcttggagttgctttgaaggatcaagaattacagcaatcattgattcctggatt

SEQ ID NO: 230058 - DNA, 75 bp, Artificial Sequence
  Synthetic
agtgaaggaaaggctctttttcacaaggtccagtcttatgttcgtcaaggcaaacaacatttacattctcttatg

SEQ ID NO: 230059 - DNA, 75 bp, Artificial Sequence
  Synthetic
tcttaaaacctaaagtcatgttcgaaaccttttgtgttttcaaatttatagtagcaaagaatcattatcattctc

SEQ ID NO: 230060 - DNA, 75 bp, Artificial Sequence
  Synthetic
aaccttttgtgttttcaaatttatagtagcaaagaatcattatcattctcaaggatcatggtataaaaccacaca

SEQ ID NO: 230061 - DNA, 75 bp, Artificial Sequence
  Synthetic
gaaaggtaaaaattggtcacaacttgttgaaacccttcctaatatgcattcagtatgcatagtacatgtagatca

SEQ ID NO: 230062 - DNA, 75 bp, Artificial Sequence
  Synthetic
tgatttgcatttgactccatatcttagacaacatattgtgtcaaattcatttccgtcacaagccgaaatttatca

SEQ ID NO: 230063 - DNA, 75 bp, Artificial Sequence
  Synthetic
ttattacttaaattggattttattagaaatacaaaaatcgcagaacaaaaattacttaatagagtaatcgggtat

SEQ ID NO: 230064 - DNA, 75 bp, Artificial Sequence
  Synthetic
tttgatccgattcgtcctcagatcacagtaatcaaatttatttgaatattcaaactactctttaggatcccatca

SEQ ID NO: 230065 - DNA, 75 bp, Artificial Sequence
  Synthetic
actttaacaaagagaacttcatttaattcacaaaaacaatctatttaaaagggagggtgacattttctagggtgt

SEQ ID NO: 230066 - DNA, 75 bp, Artificial Sequence
  Synthetic
caagccatcaaataacaatcacgggcaagaaccgggcacaccatggtgatgcgagggcaccattcagtgctacaa

SEQ ID NO: 230067 - DNA, 75 bp, Artificial Sequence
  Synthetic
tcttctgttttccctttcctttataatatgccaattaagaaaaactaaaaattgaagaatattaaagattttctt

SEQ ID NO: 230068 - DNA, 75 bp, Artificial Sequence
  Synthetic
aagcagacttttccttgaatcaaatattggattttgctgaaaagttagagtatttggctccttcttataggaatt

SEQ ID NO: 230069 - DNA, 75 bp, Artificial Sequence
  Synthetic
gggagggtgacattttctagggtgttgtatgagaaataataaagtaaacaagaaaaagagaaaaatattagacag

SEQ ID NO: 230070 - DNA, 75 bp, Artificial Sequence
  Synthetic
atcaccttaagcctcacacaagtgagagaattacacgcacagattaacttgtgattggatgttcggtcacaacaa

SEQ ID NO: 230071 - DNA, 75 bp, Artificial Sequence
  Synthetic
gagaattacacgcacagattaacttgtgattggatgttcggtcacaacaatggtaactatttagtgttggtcact

SEQ ID NO: 230072 - DNA, 75 bp, Artificial Sequence
  Synthetic
tcagagagtgtgccgaaaatgttattgattgagcttctcaaatggtgcaccatcccactgttttgctcagcctag

SEQ ID NO: 230073 - DNA, 75 bp, Artificial Sequence
  Synthetic
catcccactgttttgctcagcctagtatactgtaacacataagtggactctccacctctcctctcgagcattccc

SEQ ID NO: 230074 - DNA, 75 bp, Artificial Sequence
  Synthetic
ttaatattggtacattgggtgaatccttgagctttatcctttatatgatgtaaaagattaaggaaatactaagat

SEQ ID NO: 230075 - DNA, 75 bp, Artificial Sequence
  Synthetic
cctagtaacatgatggttgtcactgagagggaacagaaagaagctttattgcatcaggcttcttggcaccacaat

SEQ ID NO: 230076 - DNA, 75 bp, Artificial Sequence
  Synthetic
tatactgtaacacataagtggactctccacctctcctctcgagcattccccataagtgatccacttgacagaatg

SEQ ID NO: 230077 - DNA, 75 bp, Artificial Sequence
  Synthetic
cccactccctcaccacaaccaagcacgccacagcaagaaggaaacaacacagaccattcccaaggtgctgtgact

SEQ ID NO: 230078 - DNA, 75 bp, Artificial Sequence
  Synthetic
taccatatatcaaagatacagaagaactgtttgctgtgagctctaagcatttcttttaaacacattggggaaaga

SEQ ID NO: 230079 - DNA, 75 bp, Artificial Sequence
  Synthetic
tgatcttgagaaatacaaccttgccttccgatatgaatttacacggcatttcataaactactgtaatcgatgtta

SEQ ID NO: 230080 - DNA, 75 bp, Artificial Sequence
  Synthetic
ttcttttaaacacattggggaaagagctaggttaccattgagatcaagaaaactacgttatgttttctttgatga

SEQ ID NO: 230081 - DNA, 75 bp, Artificial Sequence
  Synthetic
ctactctaatgattgtaataattaactgttggcctagatgacaacagacacgaggctatacaatcactcatagta

SEQ ID NO: 230082 - DNA, 75 bp, Artificial Sequence
  Synthetic
agactagttaaattgagttataacataccatatatcaaagatacagaagaactgtttgctgtgagctctaagcat

SEQ ID NO: 230083 - DNA, 75 bp, Artificial Sequence
  Synthetic
caagtgataaaactttgtagttacagttccagaatgtcaatgtgaatgtgaattaagaaaaactaatatataaaa

SEQ ID NO: 230084 - DNA, 75 bp, Artificial Sequence
  Synthetic
ctgttggcctagatgacaacagacacgaggctatacaatcactcatagtacaaagtataattcttgcctctgtct

SEQ ID NO: 230085 - DNA, 75 bp, Artificial Sequence
  Synthetic
aattaagaaaaactaatatataaaattaaaaaactgaaaagctttgatacaagtaacacaaaacattcttcatct

SEQ ID NO: 230086 - DNA, 75 bp, Artificial Sequence
  Synthetic
actgtttgctgtgagctctaagcatttcttttaaacacattggggaaagagctaggttaccattgagatcaagaa

SEQ ID NO: 230087 - DNA, 75 bp, Artificial Sequence
  Synthetic
tattaaatcagaatcaccttgggtttcccttagggttcaatattgatatttcttgtttcaaaaagcctcttacct

SEQ ID NO: 230088 - DNA, 75 bp, Artificial Sequence
  Synthetic
aaatcacccttgtggagttaaagactaaattaaaattaaagtccagtgtcatgggtgataaccaatgtataacaa

SEQ ID NO: 230089 - DNA, 75 bp, Artificial Sequence
  Synthetic
atgggtgataaccaatgtataacaactctaagtctttttccaattgatgctcccaacgattatcaagagaacgaa

SEQ ID NO: 230090 - DNA, 75 bp, Artificial Sequence
  Synthetic
tcatgttcgtaataagaaggtgatattatttgacacaaatcatcaggttagtatctgtaatcagataatagatgc

SEQ ID NO: 230091 - DNA, 75 bp, Artificial Sequence
  Synthetic
tcccaacgattatcaagagaacgaagctgaattgaatgcggcacgagttgctgtcgaattagctattactacggg

SEQ ID NO: 230092 - DNA, 75 bp, Artificial Sequence
  Synthetic
tattcttcaactaaacttgcatatcctttgttgatacccttgggagacaacttttgacactagatcacggatcaa

SEQ ID NO: 230093 - DNA, 75 bp, Artificial Sequence
  Synthetic
aataaactcagggattgatcttggagatcttctagaagggggtttgctgacgttgtgtgttgaacattactataa

SEQ ID NO: 230094 - DNA, 75 bp, Artificial Sequence
  Synthetic
gatcttctagaagggggtttgctgacgttgtgtgttgaacattactataattccgataaagataaattcaacaca

SEQ ID NO: 230095 - DNA, 75 bp, Artificial Sequence
  Synthetic
ctggatgtgattcctaatgaacctcattacagtcctttaattttggcccttaagacattggaaagtactgaatct

SEQ ID NO: 230096 - DNA, 75 bp, Artificial Sequence
  Synthetic
taagacattggaaagtactgaatctcagagggggagaattgggctctttttgtcattttgcagtctttttctccc

SEQ ID NO: 230097 - DNA, 75 bp, Artificial Sequence
  Synthetic
tttaaaatttgtgttaattcatcaaggagtaaatttggtgacaggtcatgatgcctatgacagtatcattagtaa

SEQ ID NO: 230098 - DNA, 75 bp, Artificial Sequence
  Synthetic
tacgcaccattcgcacgggttctgaatttatcagggattaacaacctcgaacatggactctatcctcagctttca

SEQ ID NO: 230099 - DNA, 75 bp, Artificial Sequence
  Synthetic
cacacggcagtacattggctggtgtcaatgttggcgaacagtatcaacagctacgagaggcggcacatgatgcgg

SEQ ID NO: 230100 - DNA, 75 bp, Artificial Sequence
  Synthetic
actagcttctcggacaatcagtttaactacagaagggacaatgttgatgaaattaagagaattaacaagaaaccg

SEQ ID NO: 230101 - DNA, 75 bp, Artificial Sequence
  Synthetic
acatcaggaaattcaagctattgcggaggatgatgaggagagaaagatattagaacaattccaccttcagaaaac

SEQ ID NO: 230102 - DNA, 75 bp, Artificial Sequence
  Synthetic
atggaaaagctggttttcttatattgatgcattggacgatgatttatctgagtctttagaaaaattcacatgtac

SEQ ID NO: 230103 - DNA, 75 bp, Artificial Sequence
  Synthetic
attctattttttccgttcggtctgtttaaatctgaatcattaagagcataactttaacaaagagaacttcattta

SEQ ID NO: 230104 - DNA, 75 bp, Artificial Sequence
  Synthetic
tacacctgtggaagtgacggttcaagccaggcccataaatcgaccaactgctctgcctcccccagttgacaacaa

SEQ ID NO: 230105 - DNA, 75 bp, Artificial Sequence
  Synthetic
agctcttcttcaagcagctttgttgatcttaatgatccatttgcgctgctgaatgaggacgaagacactcttgac

SEQ ID NO: 230106 - DNA, 75 bp, Artificial Sequence
  Synthetic
ctcaacaacagccaaggaaagcaggaagatgaatctacaaatccgattaagaaacagtttctgagatatcaagaa

SEQ ID NO: 230107 - DNA, 75 bp, Artificial Sequence
  Synthetic
tatataggctcacggacagaagataagattggttatcctcccttaagagtgaattgcccgtcagcagcacttaaa

SEQ ID NO: 230108 - DNA, 75 bp, Artificial Sequence
  Synthetic
acttctcctaatattccaaaaattagcatcatcaaggtgtttttattagactatgaagggactttattcttaatg

SEQ ID NO: 230109 - DNA, 75 bp, Artificial Sequence
  Synthetic
aagatgaatctacaaatccgattaagaaacagtttctgagatatcaagaactgcctccggttcaagaggatgatg

SEQ ID NO: 230110 - DNA, 75 bp, Artificial Sequence
  Synthetic
acaatgagttggtttatgacaatgaccctctttgcagtgggattaaagggagattaggcagagtatctcgatcaa

SEQ ID NO: 230111 - DNA, 75 bp, Artificial Sequence
  Synthetic
tgtcatttgatgaaaggagacatgttgctatgaacttgtagtccagataacacagcatggttacctacttatcta

SEQ ID NO: 230112 - DNA, 75 bp, Artificial Sequence
  Synthetic
acagcaatcaaatttatttaaatattcaaactactttttaggatcctattacttgttactattgtgtgagacaac

SEQ ID NO: 230113 - DNA, 75 bp, Artificial Sequence
  Synthetic
gcaagaactaggcatactatggtgatgcgagggcattattcagtgctacaaattcttttttcaattgctataatg

SEQ ID NO: 230114 - DNA, 75 bp, Artificial Sequence
  Synthetic
ttccttatatcatccacaatcaggaatttatcacatagatcacttcggattcttcaatctactttccgacatgaa

SEQ ID NO: 230115 - DNA, 75 bp, Artificial Sequence
  Synthetic
atttaacttaataaacatgacttgattcagagagtgtgctgaaaatgttattgattgagcttctcaaatggtgca

SEQ ID NO: 230116 - DNA, 75 bp, Artificial Sequence
  Synthetic
ctatcctactgttttgctcagcctagtatattgtaacatataagtggactctccacttctcttctcgagtattcc

SEQ ID NO: 230117 - DNA, 75 bp, Artificial Sequence
  Synthetic
gtatattgtaacatataagtggactctccacttctcttctcgagtattccctataagtgatttacttgatagaat

SEQ ID NO: 230118 - DNA, 75 bp, Artificial Sequence
  Synthetic
tttccaatcatacacctaataaccactttagtagcgttacctttcagtacagtataggtaatcgaggaaaaactt

SEQ ID NO: 230119 - DNA, 75 bp, Artificial Sequence
  Synthetic
ctcctttttcgcatttgataaattgttcatttcttgaactttcttcacataccagttcagtctcttctaatcaac

SEQ ID NO: 230120 - DNA, 75 bp, Artificial Sequence
  Synthetic
aggtgaccaattcaaaatatattgttcatccagaagatattcctgaaataaatacaaggactaaattgatagagt

SEQ ID NO: 230121 - DNA, 75 bp, Artificial Sequence
  Synthetic
gaaggaaaccaaaaggcacagttggactacaatgtagcccttgtctaatgtcaaaggcgacaagcactgatgata

SEQ ID NO: 230122 - DNA, 75 bp, Artificial Sequence
  Synthetic
ttgtttgggaccaactgatcgtgaagaaaacactagctgatctacttataccgataaataggcaaatatcggaca

SEQ ID NO: 230123 - DNA, 75 bp, Artificial Sequence
  Synthetic
gaaaacactagctgatctacttataccgataaataggcaaatatcggacattcaaagcactctaaacgaagtaac

SEQ ID NO: 230124 - DNA, 75 bp, Artificial Sequence
  Synthetic
caattacatgagataaccccagtgttaaaaatgggaaggacactggaagcaatttccaaggggatgtcagaaatg

SEQ ID NO: 230125 - DNA, 75 bp, Artificial Sequence
  Synthetic
cagagatatgagaagaaggaatcctcacaacaacaaatgtcccctgaagacaacatgcagactcttgcgtacatg

SEQ ID NO: 230126 - DNA, 75 bp, Artificial Sequence
  Synthetic
ctccaattgattttgatccagttccaaatacaaagacaatctttgatgaatcttctagttctggtgcttcagctg

SEQ ID NO: 230127 - DNA, 75 bp, Artificial Sequence
  Synthetic
agctgctgcctttgatgcttacttaaatgagcatggtgtccctcccccccaacccgcgattttcaaagatcttgg

SEQ ID NO: 230128 - DNA, 75 bp, Artificial Sequence
  Synthetic
ggacatgctgttcaaggaattttaatttataaccaaccattgcaagaattaatttactttttccgttatacttac

SEQ ID NO: 230129 - DNA, 75 bp, Artificial Sequence
  Synthetic
aaatttattgacaacccctaccgggacagaatttttagatacaagcccattacaatcctctaggtattcatcaac

SEQ ID NO: 230130 - DNA, 75 bp, Artificial Sequence
  Synthetic
gggaccatggttaaaaatgaaacaacagatgcagccgacaagatgtcgaaagttcttgaactcagtgaggagacg

SEQ ID NO: 230131 - DNA, 75 bp, Artificial Sequence
  Synthetic
ttatcctttattaagaaaaagataaatagaacacagagaattgataaaatttttctttgatcattcttgcgagga

SEQ ID NO: 230132 - DNA, 75 bp, Artificial Sequence
  Synthetic
tgttaatcaatgcctacaaacgtgatttacatgcttgttttgatagcaatcaattctgtcggtttacaggggtag

SEQ ID NO: 230133 - DNA, 75 bp, Artificial Sequence
  Synthetic
caattctgtcggtttacaggggtagtctcatcaatgcattacaagctttatgatcttttgcctccaggtgaattg

SEQ ID NO: 230134 - DNA, 75 bp, Artificial Sequence
  Synthetic
caccagattctaagtgaaggagagaatgctcaggcagcattaactcgactaagcagaacatttgatgccttcctc

SEQ ID NO: 230135 - DNA, 75 bp, Artificial Sequence
  Synthetic
tcaaaaacttccaaacagtccctcgcccatgtcaaaagagtcttcgggctgtccctcccaacccaacaattgaca

SEQ ID NO: 230136 - DNA, 75 bp, Artificial Sequence
  Synthetic
aaggatgggtctgtgtttattcatctgagcaggatgagacacgggccctgaaaatctaattctcattgttaacag

SEQ ID NO: 230137 - DNA, 75 bp, Artificial Sequence
  Synthetic
aaaatctaattctcattgttaacagttgcaaggggagtgatctttccgagttgatacaaagacactaaacatttc

SEQ ID NO: 230138 - DNA, 75 bp, Artificial Sequence
  Synthetic
attgaacaatctaactatccaaattacagatattacaaatccattatggctagattctgtaatacaatatttacc

SEQ ID NO: 230139 - DNA, 75 bp, Artificial Sequence
  Synthetic
taatttatttctgtcttaagtgtgattttcaccttgaaagagttaaatggtgatagattaatccttgaagttact

SEQ ID NO: 230140 - DNA, 75 bp, Artificial Sequence
  Synthetic
tgtgaatatttggacacgtacttctcctaatattccaaaaattagcatcatcaaggtgtttttattagactatga

SEQ ID NO: 230141 - DNA, 75 bp, Artificial Sequence
  Synthetic
aagcctgaagaaacatttgtccattcagggttcatttattttggtaaaaagcaatatctcaacggtgttcaactg

SEQ ID NO: 230142 - DNA, 75 bp, Artificial Sequence
  Synthetic
agcaggtatgattgagtgatcagtatattttataaaccaagcaattgacttctcactttttaagaatcaactaac

SEQ ID NO: 230143 - DNA, 75 bp, Artificial Sequence
  Synthetic
ttatataattctcttcgatacacatcatatctttagcaaagcaacgaaaacaactttatcatgttagacgccagt

SEQ ID NO: 230144 - DNA, 75 bp, Artificial Sequence
  Synthetic
ctgcgtataatgaacgaacagtcaaaggtgttccagcatggctgcctcttgggattatgagcaattttgaatacc

SEQ ID NO: 230145 - DNA, 75 bp, Artificial Sequence
  Synthetic
gagatggatttacacagtttgttggagttgggtacaaaacccactgcccctcatgttcgtaataagaaagtgata

SEQ ID NO: 230146 - DNA, 75 bp, Artificial Sequence
  Synthetic
taatagagtaatcgggtatatcctattctttccgttcggtttgtctaaatctagatcattaagggcataacttta

SEQ ID NO: 230147 - DNA, 75 bp, Artificial Sequence
  Synthetic
gcttacaggcagctatacaatcacccaatttactcataatgggcaaaaattcgtccgtgtcaatcgactcggtac

SEQ ID NO: 230148 - DNA, 75 bp, Artificial Sequence
  Synthetic
caatttactcataatgggcaaaaattcgtccgtgtcaatcgactcggtacaggaatcccagcacacccactcaga

SEQ ID NO: 230149 - DNA, 75 bp, Artificial Sequence
  Synthetic
gatctcctagaagggggtttgctgacgttgtgtgttgagcattactataattctgataaggataaattcaacaca

SEQ ID NO: 230150 - DNA, 75 bp, Artificial Sequence
  Synthetic
ttattcagaatatggtgatccccagaaatttttccaccaatcaattcacctacaatctcactaacttagtattga

SEQ ID NO: 230151 - DNA, 75 bp, Artificial Sequence
  Synthetic
atgcgggctatgaatttgatgtcatcaagaatgcagatgcaacccgctttctggatgtgattcctaatgaacctc

SEQ ID NO: 230152 - DNA, 75 bp, Artificial Sequence
  Synthetic
catgaccagagatacgagaagaaagaatcctcattacaacaaatgtcccctgaaaacaacatgcagactcttgcg

SEQ ID NO: 230153 - DNA, 75 bp, Artificial Sequence
  Synthetic
tattgttctaccaacagtcaagaagcaggcttatcgtcagcataaaaatcccaacaatggaccactgctggccat

SEQ ID NO: 230154 - DNA, 75 bp, Artificial Sequence
  Synthetic
caggcttatcgtcagcataaaaatcccaacaatggaccactgctggccatatctggcatccttcaccaactgagg

SEQ ID NO: 230155 - DNA, 75 bp, Artificial Sequence
  Synthetic
gcctgtttaggatttcacttcctgccgacatgttctcagtaaaagaaggtatgatgaagaaaaggggagaaaatt

SEQ ID NO: 230156 - DNA, 75 bp, Artificial Sequence
  Synthetic
cgacatgttctcagtaaaagaaggtatgatgaagaaaaggggagaaaattccccggtggtttattttcaagcacc

SEQ ID NO: 230157 - DNA, 75 bp, Artificial Sequence
  Synthetic
ctatctagagaacaagcctcatatttgtatgttgattgcagtaatattccttctatctctctagacccgggtttt

SEQ ID NO: 230158 - DNA, 75 bp, Artificial Sequence
  Synthetic
atgcaaatccaacgctcagtgccgtttgaaatgatgctcaaatgagataggagcccatctgcataagaagcatgg

SEQ ID NO: 230159 - DNA, 75 bp, Artificial Sequence
  Synthetic
aattgaaaagctttgatacaagtaacacaaaacattattcatcttttttgtgtgtcccatcttttttgtgtgtcc

SEQ ID NO: 230160 - DNA, 75 bp, Artificial Sequence
  Synthetic
cacaagattagtttgtattgctttcaataatgctttaaccttacattgctgctttaaatggttaattaagctgat

SEQ ID NO: 230161 - DNA, 75 bp, Artificial Sequence
  Synthetic
attttgtgtatcatataaataaagaagaatattaacattgacattaagactagtcattttgttaatattctttaa

SEQ ID NO: 230162 - DNA, 75 bp, Artificial Sequence
  Synthetic
gggtcatcagatctataatgggtttactagattatataaaagaaatagtaatattttataaacaattcttgctta

SEQ ID NO: 230163 - DNA, 75 bp, Artificial Sequence
  Synthetic
aattaggtacaaaacccacagcccctcatgttcgtaataagaaggtgatattgtttgatacaaaccatcaggtta

SEQ ID NO: 230164 - DNA, 75 bp, Artificial Sequence
  Synthetic
tcatgttcgtaataagaaggtgatattgtttgatacaaaccatcaggttagtatctgtaaccagataatagatgc

SEQ ID NO: 230165 - DNA, 75 bp, Artificial Sequence
  Synthetic
atcattgtgcccttcattgctaagtaaactcaactgatgatgatattccttctgaaatagtaagaaaaactaatg

SEQ ID NO: 230166 - DNA, 75 bp, Artificial Sequence
  Synthetic
tctgaaatagtaagaaaaactaatgaagaacattaattgccaggtaagagtgattaagttctttaaatttgacca

SEQ ID NO: 230167 - DNA, 75 bp, Artificial Sequence
  Synthetic
gatcttttggaaggcggcttgttgacattatgtgttgaacattattacaattctgacaaagataaattcaataca

SEQ ID NO: 230168 - DNA, 75 bp, Artificial Sequence
  Synthetic
cattatgtgttgaacattattacaattctgacaaagataaattcaatacaagtcctattgcaaaatatctgcggg

SEQ ID NO: 230169 - DNA, 75 bp, Artificial Sequence
  Synthetic
ccgggacagaaatcttaggtataagtccgttacgatcctctagatattcatcaacttccagggaacggtctcgac

SEQ ID NO: 230170 - DNA, 75 bp, Artificial Sequence
  Synthetic
caagaatcctgatgcaactcgctttctagaggttattcccaatgaacctcattacagccctttgattttggctct

SEQ ID NO: 230171 - DNA, 75 bp, Artificial Sequence
  Synthetic
ctagaggttattcccaatgaacctcattacagccctttgattttggctctcaaaaccttagaaagcactgaatct

SEQ ID NO: 230172 - DNA, 75 bp, Artificial Sequence
  Synthetic
tgtcattttgcagtctttttctcccgaaactcgttgtcggagaccgagctagcatcgaaaaggccctgagacaag

SEQ ID NO: 230173 - DNA, 75 bp, Artificial Sequence
  Synthetic
gaaactcgttgtcggagaccgagctagcatcgaaaaggccctgagacaagtaacagtgcatcaggaacaagggat

SEQ ID NO: 230174 - DNA, 75 bp, Artificial Sequence
  Synthetic
ggtagtctcatcaatgcattacaagctttatgatctcttgcctccaggtgaattgagaaaggcaatttgcttggc

SEQ ID NO: 230175 - DNA, 75 bp, Artificial Sequence
  Synthetic
gacagtgtcatgatcccgggcacaacatcgagagaatttcaagggattcctgaaccgccaagacaatcccaagac

SEQ ID NO: 230176 - DNA, 75 bp, Artificial Sequence
  Synthetic
actacaggtcacatgaaagtaatctttgggattttaagatctagcttcattttaaagtttgtcttaatccatcag

SEQ ID NO: 230177 - DNA, 75 bp, Artificial Sequence
  Synthetic
tttcttgttgcacagttttttgtattacttacttgggcttgaagacatagttaagactggccgaaaatgctctcc

SEQ ID NO: 230178 - DNA, 75 bp, Artificial Sequence
  Synthetic
aagatgaatccacaaatccgattaagaaacagtttctgagatatcaagaattgcctcctgttcaagaggatgatg

SEQ ID NO: 230179 - DNA, 75 bp, Artificial Sequence
  Synthetic
ttgggattttaagatctagcttcattttaaagtttgtcttaatccatcagggagtaaacttggtgacaggtcatg

SEQ ID NO: 230180 - DNA, 75 bp, Artificial Sequence
  Synthetic
ttcagtaggacaaactagattctcagggcttcttattgtgaaaacagttctagagttcatcctacaaaaaactga

SEQ ID NO: 230181 - DNA, 75 bp, Artificial Sequence
  Synthetic
gacaatgaacaaggagttgatcttccacctcctccgttgtacgctcaggaaaaaagacaggacccaatacagcac

SEQ ID NO: 230182 - DNA, 75 bp, Artificial Sequence
  Synthetic
tatgatcgcattgcctccacaacaatgtaccgaggcagagtcttcactgaagggaacatagcagctatgattgtc

SEQ ID NO: 230183 - DNA, 75 bp, Artificial Sequence
  Synthetic
gtgcggacctcaaaagtaaaaaatgaagttgcaagcttcaaacaggcattgagtaacttagctcgtcatggagag

SEQ ID NO: 230184 - DNA, 75 bp, Artificial Sequence
  Synthetic
tctcgaggcaaggacaagggtaccgtcacatgaatctgacttctactaataaatattggacaagtaacaacggaa

SEQ ID NO: 230185 - DNA, 75 bp, Artificial Sequence
  Synthetic
aagttgcaagcttcaaacaggcattgagtaacttagctcgtcatggagagtacgcaccatttgcacgggttttga

SEQ ID NO: 230186 - DNA, 75 bp, Artificial Sequence
  Synthetic
gcatgggctctatcctcagctttcagcaattgcactgggcgttgcaacagcacatggcagtacattggctggtgt

SEQ ID NO: 230187 - DNA, 75 bp, Artificial Sequence
  Synthetic
gcaattgcactgggcgttgcaacagcacatggcagtacattggctggtgttaacgttggcgaacaataccaacaa

SEQ ID NO: 230188 - DNA, 75 bp, Artificial Sequence
  Synthetic
aacccgctcagagattaaacccacaagcaccccaactgatgccaccgcactcaacaccacagacccaaacagcga

SEQ ID NO: 230189 - DNA, 75 bp, Artificial Sequence
  Synthetic
aagtaaaattacaaaggcgacatgaacaccaggaaattcaggccatcgccgaggatgacgaagagagaaaaatat

SEQ ID NO: 230190 - DNA, 75 bp, Artificial Sequence
  Synthetic
acaccaggaaattcaggccatcgccgaggatgacgaagagagaaaaatattagaacagttccatctccagaagac

SEQ ID NO: 230191 - DNA, 75 bp, Artificial Sequence
  Synthetic
tgatgaggaccttataacatccggttcagggtccggagaacaggaaccctatacaacttccgatgcagtcactaa

SEQ ID NO: 230192 - DNA, 75 bp, Artificial Sequence
  Synthetic
gccgtcctcagccagaaacgagagaaactagcccgtcttgctgcagaaattgaaaacaacattgcagaggatcag

SEQ ID NO: 230193 - DNA, 75 bp, Artificial Sequence
  Synthetic
ctaatcatattccccgtgctcgaccacccccaacattcaacttatcgaaaccccctcctcctccaaaagacatgt

SEQ ID NO: 230194 - DNA, 75 bp, Artificial Sequence
  Synthetic
ttttgatatgactcatcctcagatcacagcaatcaaatttatttgaatatttgaaccaccttttagtatcctatt

SEQ ID NO: 230195 - DNA, 75 bp, Artificial Sequence
  Synthetic
gggttcaaacaatcgcagaatcaggtgtcacagtctttcttaaatgatcccacacctgtagaagtgacagtccaa

SEQ ID NO: 230196 - DNA, 75 bp, Artificial Sequence
  Synthetic
cacaaccgtccatgccccctcacaacaccactgcaatctctactaacaacacctccaagagcaacttcagcaccc

SEQ ID NO: 230197 - DNA, 75 bp, Artificial Sequence; identical to SEQ ID NO: 62633
  Synthetic

SEQ ID NO: 230198 - DNA, 75 bp, Artificial Sequence; identical to SEQ ID NO: 62632
  Synthetic

SEQ ID NO: 230199 - DNA, 75 bp, Artificial Sequence
  Synthetic
ccctgccccccccagtcgacaacaaaattgagcatgaaactgaagaggacagctcctcatcaagtagttttgttg

SEQ ID NO: 230200 - DNA, 75 bp, Artificial Sequence
  Synthetic
gcaaggactgggcatactatggtggtcttagagcattgtccagtgctacaaattcttttttcaattgctataatt

SEQ ID NO: 230201 - DNA, 75 bp, Artificial Sequence
  Synthetic
aattgagcatgaaactgaagaggacagctcctcatcaagtagttttgttgacttgaatgatccatttgcactgct

SEQ ID NO: 230202 - DNA, 75 bp, Artificial Sequence
  Synthetic
tctctgcaccaccacaaaacaccaccaattatggcacacagagcacagccactgaaaatgaacaaaccagtgccc

SEQ ID NO: 230203 - DNA, 75 bp, Artificial Sequence
  Synthetic
aatagtgtcatggccccaagcactactttgagagaacccaaagaagtttccgaaccactaaggcaaactcaggac

SEQ ID NO: 230204 - DNA, 75 bp, Artificial Sequence
  Synthetic
ctttgagagaacccaaagaagtttccgaaccactaaggcaaactcaggaccttgatattagccaaaagaaacagg

SEQ ID NO: 230205 - DNA, 75 bp, Artificial Sequence; identical to SEQ ID NO: 62636
  Synthetic

SEQ ID NO: 230206 - DNA, 75 bp, Artificial Sequence
  Synthetic
ctatcctactgttttgctcagcttagtatattgtaatatgtaagtggactctccccttctcctctcgtgtattct

SEQ ID NO: 230207 - DNA, 75 bp, Artificial Sequence
  Synthetic
cctctggagggaaggcgacatgttcccttttctggacgggttaataaatgctccaattgattttgatccagttcc

SEQ ID NO: 230208 - DNA, 75 bp, Artificial Sequence
  Synthetic
aaaacaattcttacgatatcaagaattacctcctgttcaagaagacgatgaatcagaatacacaactgattctca

SEQ ID NO: 230209 - DNA, 75 bp, Artificial Sequence
  Synthetic
ttacctcctgttcaagaagacgatgaatcagaatacacaactgattctcaggaaagtgacgatcaaccaggatct

SEQ ID NO: 230210 - DNA, 75 bp, Artificial Sequence
  Synthetic
aaatacaaagacgatctttgatgaatcttctagttctggtgcttcggctgaggaagatcaacatgcctcccccaa

SEQ ID NO: 230211 - DNA, 75 bp, Artificial Sequence; identical to SEQ ID NO: 62639
  Synthetic

SEQ ID NO: 230212 - DNA, 75 bp, Artificial Sequence
  Synthetic
caccacctccattatatgctcaggaaaagagacaggatcccatacagcatccagccgtgagctcccaagatccct

SEQ ID NO: 230213 - DNA, 75 bp, Artificial Sequence
  Synthetic
gtatattgtaatatgtaagtggactctccccttctcctctcgtgtattctttataaatcacttacttgatagaat

SEQ ID NO: 230214 - DNA, 75 bp, Artificial Sequence
  Synthetic
cctaatataaatgaaaacactgcctactctggagaaaatgagaacgattgtgatgcagagttaagaatttggagc

SEQ ID NO: 230215 - DNA, 75 bp, Artificial Sequence
  Synthetic
ccagccgtgagctcccaagatccctttggcagtattggtgatgtagatggtgatattttggaacctataagatcg

SEQ ID NO: 230216 - DNA, 75 bp, Artificial Sequence
  Synthetic
tgatgcagagttaagaatttggagcgttcaggaggatgacctggcagcagggctcagttggataccgttttttgg

SEQ ID NO: 230217 - DNA, 75 bp, Artificial Sequence
  Synthetic
ccttcctcaccgtctgctcctcaggaggacacaaggatgggagaagcctatgaattatcacctgattttacaagc

SEQ ID NO: 230218 - DNA, 75 bp, Artificial Sequence
  Synthetic
gttcaggaggatgacctggcagcagggctcagttggataccgttttttggccctggaatcgaaggactttatact

SEQ ID NO: 230219 - DNA, 75 bp, Artificial Sequence
  Synthetic
ctattctttctttttacaaacgtattgaaatagtaattctcacaatgtgggactcatcatacatgcagcaagtca

SEQ ID NO: 230220 - DNA, 75 bp, Artificial Sequence
  Synthetic
aggacacaaggatgggagaagcctatgaattatcacctgattttacaagctatgaggataatcagcagaattggc

SEQ ID NO: 230221 - DNA, 75 bp, Artificial Sequence
  Synthetic
atttggtctgcaggttgaggcgtctagccaatcaaactgccaaatccttggaactcttattaagagtcacaaccg

SEQ ID NO: 230222 - DNA, 75 bp, Artificial Sequence
  Synthetic
caggaccttcctttatcctaatgaccttttacagacgagtcctccagagtcattaataacagcccttgttgaaga

SEQ ID NO: 230223 - DNA, 75 bp, Artificial Sequence
  Synthetic
cttttacagacgagtcctccagagtcattaataacagcccttgttgaagagtaccaaaaccctgtctcagcaaaa

SEQ ID NO: 230224 - DNA, 75 bp, Artificial Sequence
  Synthetic
gaagaaaaccaaaaggcacagttggactacaatgtagcccttgtctaatgtcaaaggcgacaagtactgatgata

SEQ ID NO: 230225 - DNA, 75 bp, Artificial Sequence
  Synthetic
tagacatgccattgattttctactcacaaggtggggaggaacatgcaaagtgcttggacctgattgttgcatcgg

SEQ ID NO: 230226 - DNA, 75 bp, Artificial Sequence
  Synthetic
tgtcatttgatgagaggaggcatgttgctatgaacttgtaatttcgacaacacagcacgactactcatttattta

SEQ ID NO: 230227 - DNA, 75 bp, Artificial Sequence
  Synthetic
tgctatgaacttgtaatttcgacaacacagcacgactactcatttatttacttcaatatattttacctccgaaac

SEQ ID NO: 230228 - DNA, 75 bp, Artificial Sequence
  Synthetic
aatagaagacttgtccaggaatatttcagagcaaattgaccaaatcaaaaaagatgaacaaaaagaggggactgg

SEQ ID NO: 230229 - DNA, 75 bp, Artificial Sequence; identical to SEQ ID NO: 62646
  Synthetic

SEQ ID NO: 230230 - DNA, 75 bp, Artificial Sequence
  Synthetic
ctagaccactttcaaataccttgttatatatcactgttatgtgagatggtgcaaaccttagaatgataaccaaag

SEQ ID NO: 230231 - DNA, 75 bp, Artificial Sequence
  Synthetic
acttgggcattttgctactattatccatagctgtcttgattgctctatcctgtatttgtcgtatctttaccaaat

SEQ ID NO: 230232 - DNA, 75 bp, Artificial Sequence
  Synthetic
gtaggaactggttatatgacagtacctcgaaggtgttattcaatggtttagatctctcctctaattgctacgata

SEQ ID NO: 230233 - DNA, 75 bp, Artificial Sequence
  Synthetic
gatctctcctctaattgctacgataatacaactacaaacctctttaccttggttacaatactgtaatagatatga

SEQ ID NO: 230234 - DNA, 75 bp, Artificial Sequence; identical to SEQ ID NO: 62649
  Synthetic

SEQ ID NO: 230235 - DNA, 75 bp, Artificial Sequence
  Synthetic
attcaacttgatagatataacttgattcagagaacattttgggaacgtcattaactaaattctctaaatgatgta

SEQ ID NO: 230236 - DNA, 75 bp, Artificial Sequence
  Synthetic
gtttgatattcaattgttatcatagtcaagagtaactttttctatttgatgcattaatgttttaaactacctctt

SEQ ID NO: 230237 - DNA, 75 bp, Artificial Sequence
  Synthetic
ttctccaagccaaacctttcagctaaggatttagcccttttattgtttacccatctacccggcaacaacactcca

SEQ ID NO: 230238 - DNA, 75 bp, Artificial Sequence
  Synthetic
aggatttagcccttttattgtttacccatctacccggcaacaacactccattccatatcctagctcaggtccttt

SEQ ID NO: 230239 - DNA, 75 bp, Artificial Sequence
  Synthetic
ttatatagtagcatattaatggatcctttacctctcctcctatgctcttcttataagtcactcaaccggtgaaac

SEQ ID NO: 230240 - DNA, 75 bp, Artificial Sequence
  Synthetic
gtgcgtagaggttaatttaaaaagatttcttgttgcacagttttttgtattgcttacttgggcttgaagacatag

SEQ ID NO: 230241 - DNA, 75 bp, Artificial Sequence
  Synthetic
aaatattggacaagcagcaatgaaacgcggagaaatgatacgggatgttttggcatcctccaagaatacaactcc

SEQ ID NO: 230242 - DNA, 75 bp, Artificial Sequence
  Synthetic
tcaagagtaactttttctatttgatgcattaatgttttaaactacctcttaagcttttgtggatggtttcaatgt

SEQ ID NO: 230243 - DNA, 75 bp, Artificial Sequence
  Synthetic
cctgttttactgaatgtagtaattaatgattgacttgagtgttgatggaatcaagatagtgcgatgattcatatt

SEQ ID NO: 230244 - DNA, 75 bp, Artificial Sequence
  Synthetic
tttcttgttgcacagttttttgtattgcttacttgggcttgaagacatagttaaaactggccgaaaatgctctcc

SEQ ID NO: 230245 - DNA, 75 bp, Artificial Sequence
  Synthetic
catgtttttccagcttctgcaaggtcacaatgtgaggatttttctcctaaggaaaatccttattattgggggatg

SEQ ID NO: 230246 - DNA, 75 bp, Artificial Sequence
  Synthetic
agacgtgccgttcaaagagtcttgatttataattaaccattgtaaggattaatttactctttccgttatacttat

SEQ ID NO: 230247 - DNA, 75 bp, Artificial Sequence
  Synthetic
ttgccaatgtatcctcttccttatcacatgccaatcaagaaaaacaaagagtcgaagaatattaaagattctctt

SEQ ID NO: 230248 - DNA, 75 bp, Artificial Sequence
  Synthetic
acatgccaatcaagaaaaacaaagagtcgaagaatattaaagattctctttaatattcaaaaacagttcttaatt

SEQ ID NO: 230249 - DNA, 75 bp, Artificial Sequence
  Synthetic
tgcccgcgcctggctcgaagacagtgatggagctgattatcctcctcttgatgtgttaggtgagttatacaacca

SEQ ID NO: 230250 - DNA, 75 bp, Artificial Sequence
  Synthetic
catcattaacgacttgtcttaattcaatcctttggatgcaaaccataaggaaaaatgagccactttccctctact

SEQ ID NO: 230251 - DNA, 75 bp, Artificial Sequence
  Synthetic
aaggatgggtctgtgtttattcatctgagcaaggtgaaacacgggcccttaaaatctaattctcattgttcatag

SEQ ID NO: 230252 - DNA, 75 bp, Artificial Sequence
  Synthetic
tatatcgataaatcttacaatgtgggactcgtcatacatgcaacaagtgagtgagggactgatgactggaaaagt

SEQ ID NO: 230253 - DNA, 75 bp, Artificial Sequence
  Synthetic
ggaagacggtttcaaattgattaaacacttggaacccttgtgtgtcagctgtatacaaacacatggcatctttac

SEQ ID NO: 230254 - DNA, 75 bp, Artificial Sequence
  Synthetic
gtatacaaacacatggcatctttacaccaagaaaatactggttccaatcacagatgattaagtcatattatgatg

SEQ ID NO: 230255 - DNA, 75 bp, Artificial Sequence
  Synthetic
tccaatagatcaagtgttcggcactaatcccttagaaaagttatataagagaagaaagccgaaagggacagtggg

SEQ ID NO: 230256 - DNA, 75 bp, Artificial Sequence
  Synthetic
taatagtgcatttgtatagattcaattatcctttattaagaaaaagatagacagaacacaaagaattgacaaaat

SEQ ID NO: 230257 - DNA, 75 bp, Artificial Sequence; identical to SEQ ID NO: 62656
  Synthetic

SEQ ID NO: 230258 - DNA, 75 bp, Artificial Sequence
  Synthetic
aaaagcatgtatgtggacaaaacataattagaccatcttaattggagtagtaatttatttctgtcttaaatgtga

SEQ ID NO: 230259 - DNA, 75 bp, Artificial Sequence
  Synthetic
tcaaaatcaacaagtactgacgacattgtttgggatcagctaatcgtaaagaaaacattggctgacttgcttata

SEQ ID NO: 230260 - DNA, 75 bp, Artificial Sequence
  Synthetic
tgatagattaatccttgaagttactcttctatatattatagagaaaccaatgttactaacaaaaggggtctacct

SEQ ID NO: 230261 - DNA, 75 bp, Artificial Sequence
  Synthetic
ttgtttgggatcagctaatcgtaaagaaaacattggctgacttgcttatacctataaataggcaaatgtcggaca

SEQ ID NO: 230262 - DNA, 75 bp, Artificial Sequence
  Synthetic
aacaaaagtccatgagatcgagcgtcaactacatgatatcaccccagttgtaaaaatgggaaaaacgctagaagc

SEQ ID NO: 230263 - DNA, 75 bp, Artificial Sequence
  Synthetic
cgcgtcaatacaacttcccttcatatttgattcaagatttaaaatgcaacaaccccgtggaagaagtcgaactcg

SEQ ID NO: 230264 - DNA, 75 bp, Artificial Sequence
  Synthetic
caactacatgatatcaccccagttgtaaaaatgggaaaaacgctagaagcaatttccaaaggaatgtcagagatg

SEQ ID NO: 230265 - DNA, 75 bp, Artificial Sequence
  Synthetic
tcttactttttaagaatcaactaacaacatagaaaagacatttatccttatgtaatcctcggcttagttgaaatt

SEQ ID NO: 230266 - DNA, 75 bp, Artificial Sequence
  Synthetic
tttcaactggaagaaccaccgcaccagctgctgcctttgatgcttacttaaacgagcatggagtccccccccctc

SEQ ID NO: 230267 - DNA, 75 bp, Artificial Sequence
  Synthetic
agctgctgcctttgatgcttacttaaacgagcatggagtccccccccctcagcctgcaatcttcaaagatcttgg

SEQ ID NO: 230268 - DNA, 75 bp, Artificial Sequence
  Synthetic
aagactatggtcaaaaaccaaacaacagatgcagctgacaaaatgtcaaaggttctggaactcagtgaagaaaca

SEQ ID NO: 230269 - DNA, 75 bp, Artificial Sequence
  Synthetic
tcagcttgttggattaattgttacttaaattgtcctttttgaaattaattcacacaaggtagtttaaatttatat

SEQ ID NO: 230270 - DNA, 75 bp, Artificial Sequence
  Synthetic
cagatgcagctgacaaaatgtcaaaggttctggaactcagtgaagaaacattttccaagccaaacctttcagcta

SEQ ID NO: 230271 - DNA, 75 bp, Artificial Sequence
  Synthetic
gagttgctgtcgaattagctattactacgggttatagtggtatatttttgaagcctgaagaaacatttgtccatt

SEQ ID NO: 230272 - DNA, 75 bp, Artificial Sequence; identical to SEQ ID NO: 62664
  Synthetic

SEQ ID NO: 230273 - DNA, 75 bp, Artificial Sequence
  Synthetic
tcatctccctggcaacaacactccattccacatactcgcccaagtcctttcaaaaattgcttacaaatcaggaaa

SEQ ID NO: 230274 - DNA, 75 bp, Artificial Sequence
  Synthetic
ttccacatactcgcccaagtcctttcaaaaattgcttacaaatcaggaaagtctggagcattcttggatgcattc

SEQ ID NO: 230275 - DNA, 75 bp, Artificial Sequence
  Synthetic
atcgtgaacttttgctattgatggcccgaaaaatgctccccaatacagacaagacttttagaagtctgcaggact

SEQ ID NO: 230276 - DNA, 75 bp, Artificial Sequence
  Synthetic
acgaaagatgtgttgaccttggaaaatctaggacacattctgaactacctccacagatcagaaattgggaaattg

SEQ ID NO: 230277 - DNA, 75 bp, Artificial Sequence
  Synthetic
atgctcaggctgcattaacccgattaagcagaacattcgatgctttccttggagcagttcctccagtaataaaag

SEQ ID NO: 230278 - DNA, 75 bp, Artificial Sequence
  Synthetic
aagcagaacattcgatgctttccttggagcagttcctccagtaataaaagttaaaaactttcaaacggtcccccg

SEQ ID NO: 230279 - DNA, 75 bp, Artificial Sequence
  Synthetic
gttcccccaaatccaacaattgacaagggatgggtctgtgtctattcatctgaacagggtgaaacccgggctctt

SEQ ID NO: 230280 - DNA, 75 bp, Artificial Sequence
  Synthetic
aaaatctaatccttgcgattcattcttgaacaaagaatgatctttctaggttaatacaaaaacactaaacatttc

SEQ ID NO: 230281 - DNA, 75 bp, Artificial Sequence
  Synthetic
aattcgaagccgccttatggcaaggttgggataagagatcgatatctctattcgtacaagcagctttatatgtaa

SEQ ID NO: 230282 - DNA, 75 bp, Artificial Sequence
  Synthetic
atttgggtaaatttaatcaggatagtagtttaaatttgttttaagcgtgattttcattaagagagggttaattag

SEQ ID NO: 230283 - DNA, 75 bp, Artificial Sequence
  Synthetic
aaccagtgtgcaagcctcatacgatcattttattcttcctcaaagccaaagtaaaggacaatgattattgtttga

SEQ ID NO: 230284 - DNA, 75 bp, Artificial Sequence
  Synthetic
ttttcattaagagagggttaattagttatagattgatctttagtgtactccatacgcataatatagagaaattaa

SEQ ID NO: 230285 - DNA, 75 bp, Artificial Sequence
  Synthetic
gtgtgcaaaaacttcctgatgatgcctggcgcccatccaaggacaaattaattgggaacactatgcatcccgcag

SEQ ID NO: 230286 - DNA, 75 bp, Artificial Sequence
  Synthetic
aacggatttgattaatagatcagtatatctcaaaagccaaataattgacttcttactctttgggaatttactaac

SEQ ID NO: 230287 - DNA, 75 bp, Artificial Sequence
  Synthetic
tcttaaaagggaaaaggctaattggtgccacattgccatgtttactagagcaatttaaggtaaagtggattaatt

SEQ ID NO: 230288 - DNA, 75 bp, Artificial Sequence
  Synthetic
cactaattcattgtaaattactcgattaaaatgttcttaagctatcttaaacttgatgatgcagctctgtttcac

SEQ ID NO: 230289 - DNA, 75 bp, Artificial Sequence
  Synthetic
tcttactctttgggaatttactaacaatataggaaagatatttattcttacgtaatccttggcccaacggaaact

SEQ ID NO: 230290 - DNA, 75 bp, Artificial Sequence
  Synthetic
ctatatctaagtgtctaattaacaacttgtacctctaaggaaaatcatgaagaacattaagaaaaaggatgttct

SEQ ID NO: 230291 - DNA, 75 bp, Artificial Sequence
  Synthetic
tgctcatgatatatccagagattttttataagttcaaaacgttgtaaattatacttgcataaaatactgttttaa

SEQ ID NO: 230292 - DNA, 75 bp, Artificial Sequence
  Synthetic
ttataagttcaaaacgttgtaaattatacttgcataaaatactgttttaattaagaaaaactatgaagaacatta

SEQ ID NO: 230293 - DNA, 75 bp, Artificial Sequence
  Synthetic
aataacagacaagttgtgctagcgtatgcgaatccaacgctcagtgccgtttgaaatgatgctcaaatgagacag

SEQ ID NO: 230294 - DNA, 75 bp, Artificial Sequence
  Synthetic
ttttacaaagcaaggtttttaaattcaagtagatcaagtctactcttgctgaacttacttctttaaaaattaatt

SEQ ID NO: 230295 - DNA, 75 bp, Artificial Sequence
  Synthetic
cttaaatggatatttgtcaaattcttacaagattagtttgtattgatttcaacaatgctttaaccttacattgct

SEQ ID NO: 230296 - DNA, 75 bp, Artificial Sequence
  Synthetic
acggaacaaattcagatatggccagttccagcaattataatacgtatatgcaatacctgaaccctcccccttatg

SEQ ID NO: 230297 - DNA, 75 bp, Artificial Sequence; identical to SEQ ID NO: 62677
  Synthetic

SEQ ID NO: 230298 - DNA, 75 bp, Artificial Sequence
  Synthetic
ctgatcatggtgcaaatcagttaatcccagcagaccagctatcaaatcaacatggtataactccgaattatgtgg

SEQ ID NO: 230299 - DNA, 75 bp, Artificial Sequence
  Synthetic
gggccatcagatccataatgggtttactagactatataagagaaatagtaatattttataaacaattcttgctca

SEQ ID NO: 230300 - DNA, 75 bp, Artificial Sequence
  Synthetic
catggtataactccgaattatgtgggcgacttgaatctagatgatcagtttaaagggaatgtttgtcacgccttc

SEQ ID NO: 230301 - DNA, 75 bp, Artificial Sequence
  Synthetic
gcgacttgaatctagatgatcagtttaaagggaatgtttgtcacgccttcactttggaagcaataattgatatat

SEQ ID NO: 230302 - DNA, 75 bp, Artificial Sequence
  Synthetic
actagactatataagagaaatagtaatattttataaacaattcttgctcagttttactgtgatttaataacatat

SEQ ID NO: 230303 - DNA, 75 bp, Artificial Sequence
  Synthetic
cccagcagaccagctatcaaatcaacatggtataactccgaattatgtgggcgacttgaatctagatgatcagtt

SEQ ID NO: 230304 - DNA, 75 bp, Artificial Sequence
  Synthetic
caactcaattgacgataatactccttctgaaatagtaagaaaaactaatgaagaacattaattgctgggtaaaag

SEQ ID NO: 230305 - DNA, 75 bp, Artificial Sequence
  Synthetic
aggagtcccagcgtggctgcctcttgggatcatgagcaattttgaataccctttagcccacactgttgctgcatt

SEQ ID NO: 230306 - DNA, 75 bp, Artificial Sequence
  Synthetic
tgttccagagtggcaacaaacaaggaatctattctcccacctctttaaaaacccaaagtcaacaattatagaacc

SEQ ID NO: 230307 - DNA, 75 bp, Artificial Sequence
  Synthetic
gggatcatgagcaattttgaataccctttagcccacactgttgctgcattgcttacagggagctacacgattacc

SEQ ID NO: 230308 - DNA, 75 bp, Artificial Sequence
  Synthetic
tctgaaatagtaagaaaaactaatgaagaacattaattgctgggtaaaagtgattaatttctttaaatttgacca

SEQ ID NO: 230309 - DNA, 75 bp, Artificial Sequence
  Synthetic
ttctcatatcacttgattaaaaacagaaaattaccctaacatgaagaccacatgtttccttatcagtcttatctt

SEQ ID NO: 230310 - DNA, 75 bp, Artificial Sequence
  Synthetic
ttgttcgtgttaatcgacttgggacaggaatcccagcacatccactcagaatgctgcgggaaggaaaccaagctt

SEQ ID NO: 230311 - DNA, 75 bp, Artificial Sequence
  Synthetic
aggaatcccagcacatccactcagaatgctgcgggaaggaaaccaagcttttgtccaaaacatggtgattcccag

SEQ ID NO: 230312 - DNA, 75 bp, Artificial Sequence
  Synthetic
tacagcaatcattaattcctggatttagatctattgttcacatgctttcagaatggttgctcctagaggtaacgt

SEQ ID NO: 230313 - DNA, 75 bp, Artificial Sequence
  Synthetic
aaccccaaaatgtggattcggtatgctccggaactctccagaagacagaagacgtccatctgatgggattcacac

SEQ ID NO: 230314 - DNA, 75 bp, Artificial Sequence
  Synthetic
tacaatcttactaatctagtattgagcgtgcaaaagcttcctgatgatgcttggcgcccgtccaaagacaaatta

SEQ ID NO: 230315 - DNA, 75 bp, Artificial Sequence
  Synthetic
tgtccaattgacagcttttgggtctatccaagcaagtccacaaggactaaccactattatgcaagccttaattat

SEQ ID NO: 230316 - DNA, 75 bp, Artificial Sequence
  Synthetic
atcggaaacaccatgcaccctgcggtttctgtacacccaaacctgccgcctattgtcctaccaacagttaaaaaa

SEQ ID NO: 230317 - DNA, 75 bp, Artificial Sequence
  Synthetic
agttaactggacaacagatcattatcactcgtgttaatatggggtttctagtggaagtcaggaggattgatattg

SEQ ID NO: 230318 - DNA, 75 bp, Artificial Sequence
  Synthetic
ggaagccaaaacatgctacaatataagtgtaacggatccctctggaaaatccttgctgttagatcctcctaccaa

SEQ ID NO: 230319 - DNA, 75 bp, Artificial Sequence
  Synthetic
atctggcatccttcatcaactgagggttgaaaaagtcccagagaagacgagcttattcaggatttcacttcctgc

SEQ ID NO: 230320 - DNA, 75 bp, Artificial Sequence
  Synthetic
tgtaccgaggcaaagtcttcactgaagggaacatagcagctatgattgtcaataagacagtgcacaaaatgattt

SEQ ID NO: 230321 - DNA, 75 bp, Artificial Sequence
  Synthetic
atgatgaagaaaagaggagaaggttctccggtagtttatttccaagcgcctgagaattttcctttgaatggcttc

SEQ ID NO: 230322 - DNA, 75 bp, Artificial Sequence
  Synthetic
agtacattatagttaattatcctgtataacaaagaatatacctaccctaatttatatttactggtataaaatagt

SEQ ID NO: 230323 - DNA, 75 bp, Artificial Sequence
  Synthetic
tgagaattttcctttgaatggcttcaacaaccggcaagttgtgctagcatatgctaacccgacactcagtgctgt

SEQ ID NO: 230324 - DNA, 75 bp, Artificial Sequence
  Synthetic
tcatatgaatctgacttctactaataaatattggacaagtagtaacggaacgcaaacgaatgacactggatgttt

SEQ ID NO: 230325 - DNA, 75 bp, Artificial Sequence
  Synthetic
tggcccttctgtacaaagggtctgattcagatagatatttgtcagattcatgcaggatcattttaagttgatttt

SEQ ID NO: 230326 - DNA, 75 bp, Artificial Sequence; identical to SEQ ID NO: 62695
  Synthetic

SEQ ID NO: 230327 - DNA, 75 bp, Artificial Sequence
  Synthetic
ttcagatagatatttgtcagattcatgcaggatcattttaagttgattttaatagtgctttaacccttcactgct

SEQ ID NO: 230328 - DNA, 75 bp, Artificial Sequence
  Synthetic
gattgtgagattataaacttgtagaattaccgtgggtcacaactgttgcatatcttccaaaatatatcttttgca

SEQ ID NO: 230329 - DNA, 75 bp, Artificial Sequence
  Synthetic
taacctataatgtataacttcttttaaaccgctaaatcaatcataagtttgtcagatcatataggatgaatgtta

SEQ ID NO: 230330 - DNA, 75 bp, Artificial Sequence
  Synthetic
tataatacatactaataatgattgattaagaaaaaccaatgatggatattaaatatccatcaagcaggtgttgca

SEQ ID NO: 230331 - DNA, 75 bp, Artificial Sequence
  Synthetic
tcaataccacggacccaagcagtgatgatgaggacctcgcaacatccggctcagggtccggagaacgagaacccc

SEQ ID NO: 230332 - DNA, 75 bp, Artificial Sequence
  Synthetic
aaaccgctaaatcaatcataagtttgtcagatcatataggatgaatgttaatacgtgataaatggttcctattca

SEQ ID NO: 230333 - DNA, 75 bp, Artificial Sequence
  Synthetic
gcaagggctttcatcaacaatgccacccactccctcaccacaaccaagcacgccacagcaaggaggaaacaacac

SEQ ID NO: 230334 - DNA, 75 bp, Artificial Sequence
  Synthetic
cttataagactactcatcttcaagttgatcaattcaaagataatttcccttctaaaataataagaaaaactaatg

SEQ ID NO: 230335 - DNA, 75 bp, Artificial Sequence
  Synthetic
catatttactaaatcttacataggattatataattctcttcgatacacgttatatctttagcaaagtaatgaaaa

SEQ ID NO: 230336 - DNA, 75 bp, Artificial Sequence
  Synthetic
tgatcaattcaaagataatttcccttctaaaataataagaaaaactaatgaagaacattaattgctaggtaaagg

SEQ ID NO: 230337 - DNA, 75 bp, Artificial Sequence; identical to SEQ ID NO: 62698
  Synthetic

SEQ ID NO: 230338 - DNA, 75 bp, Artificial Sequence
  Synthetic
cacaaccgtccatgccccctcataacactaccacaatctctactaacaacacctccaaacacaacttcagcactc

SEQ ID NO: 230339 - DNA, 75 bp, Artificial Sequence
  Synthetic
tgagcgggcaaaaagttgctgattcccctttggaggcatccaagcgatgggctttcaggacaggtgtacctccta

SEQ ID NO: 230340 - DNA, 75 bp, Artificial Sequence
  Synthetic
aagtaaggtttcactagtgagtaaattcctgtattagtagattaaaaccaaggaagcaccccgacatgaagacca

SEQ ID NO: 230341 - DNA, 75 bp, Artificial Sequence
  Synthetic
ttcctgtattagtagattaaaaccaaggaagcaccccgacatgaagaccatatattttctgattagtctcatttt

SEQ ID NO: 230342 - DNA, 75 bp, Artificial Sequence
  Synthetic
cactaccacaatctctactaacaacacctccaaacacaacttcagcactctctctgcaccattacaaaacaccac

SEQ ID NO: 230343 - DNA, 75 bp, Artificial Sequence; identical to SEQ ID NO: 62701
  Synthetic

SEQ ID NO: 230344 - DNA, 75 bp, Artificial Sequence
  Synthetic
gttttagaaattgctagtaacagccaacctcaagatgtagattcagtgtgctccggaaccctccaaaagacagaa

SEQ ID NO: 230345 - DNA, 75 bp, Artificial Sequence
  Synthetic
aacctcaagatgtagattcagtgtgctccggaaccctccaaaagacagaagatgttcatctgatgggatttacac

SEQ ID NO: 230346 - DNA, 75 bp, Artificial Sequence
  Synthetic
caacggcaccaaacacgacaaatgagcatttcaccagtcctccccccacccccagctcgactgcacaacatcttg

SEQ ID NO: 230347 - DNA, 75 bp, Artificial Sequence
  Synthetic
cattcaacatgatgcaattaatcatgttgatgactttaaatacctattgccctctgagctagtcaagtatgcaaa

SEQ ID NO: 230348 - DNA, 75 bp, Artificial Sequence
  Synthetic
ccctttggaagcatctaaacgatgggctttcaggacaggtgttcctcccaagaacgttgagtatacggaaggaga

SEQ ID NO: 230349 - DNA, 75 bp, Artificial Sequence
  Synthetic
gctttcaggacaggtgttcctcccaagaacgttgagtatacggaaggagaagaagccaaaacatgttacaatata

SEQ ID NO: 230350 - DNA, 75 bp, Artificial Sequence
  Synthetic
ccttgctgctggatcctcccagtaatatccgcgattaccctaaatgtaaaactgttcatcatattcaaggtcaaa

SEQ ID NO: 230351 - DNA, 75 bp, Artificial Sequence
  Synthetic
aaatacaaaaacaatctttgatgaatcctctagttctggtgcctcggctgaggaagatcaacatgcctcccccaa

SEQ ID NO: 230352 - DNA, 75 bp, Artificial Sequence
  Synthetic
tatccgcgattaccctaaatgtaaaactgttcatcatattcaaggtcaaaaccctcatgcacaggggattgccct

SEQ ID NO: 230353 - DNA, 75 bp, Artificial Sequence
  Synthetic
tatgatcgcgttgcctctacaacaatgtaccgaggcaaggtcttcactgaaggaaatatagcagctatgattgtt

SEQ ID NO: 230354 - DNA, 75 bp, Artificial Sequence
  Synthetic
tgtaccgaggcaaggtcttcactgaaggaaatatagcagctatgattgttaataagacagttcacagaatgattt

SEQ ID NO: 230355 - DNA, 75 bp, Artificial Sequence
  Synthetic
tcacatgaacttgacctccaccaataaatattggacaagcagcaatgaaacgcagagaaatgatacgggatgttt

SEQ ID NO: 230356 - DNA, 75 bp, Artificial Sequence
  Synthetic
atatgagtgaaagggctcaatcaacaaatcatgagccaacagctttacaagaggtgtgcactgagatacccttct

SEQ ID NO: 230357 - DNA, 75 bp, Artificial Sequence
  Synthetic
aaatcatgagccaacagctttacaagaggtgtgcactgagatacccttctcggaacaagatccagccaaaagtta

SEQ ID NO: 230358 - DNA, 75 bp, Artificial Sequence
  Synthetic
ctcttaaacctccatccctgcccacagtaactccgagcattcactctacaaatactcaaattaatactgctaaat

SEQ ID NO: 230359 - DNA, 75 bp, Artificial Sequence
  Synthetic
agtaactccgagcattcactctacaaatactcaaattaatactgctaaatctggaactatgaacccaagtagcga

SEQ ID NO: 230360 - DNA, 75 bp, Artificial Sequence; identical to SEQ ID NO: 62710
  Synthetic

SEQ ID NO: 230361 - DNA, 75 bp, Artificial Sequence
  Synthetic
tcaggatctggagaacaggggccccacacaactcttaatgtagtcactgaacagaaacaatcgtcaacaatattg

SEQ ID NO: 230362 - DNA, 75 bp, Artificial Sequence
  Synthetic
acacaactcttaatgtagtcactgaacagaaacaatcgtcaacaatattgtccactccttcactacatccaagca

SEQ ID NO: 230363 - DNA, 75 bp, Artificial Sequence; identical to SEQ ID NO: 62716
  Synthetic

SEQ ID NO: 230364 - DNA, 75 bp, Artificial Sequence
  Synthetic
gaatccttcccgacatgctgtaactgagcacaatggaaccgacccaacaacacaaccagcaacgctcctcaacaa

SEQ ID NO: 230365 - DNA, 75 bp, Artificial Sequence
  Synthetic
agtgtgctcaaaactttattaaaactataattcaggcgaaattgactcctcaacaatactgtgaattattctctc

SEQ ID NO: 230366 - DNA, 75 bp, Artificial Sequence
  Synthetic
aaatcaacttgggagatttttaagaagctgataacttaatgtgaatcaatagtttatgtattatcgattattatg

SEQ ID NO: 230367 - DNA, 75 bp, Artificial Sequence
  Synthetic
gagcacaatggaaccgacccaacaacacaaccagcaacgctcctcaacaatactaatacaactcccacctataac

SEQ ID NO: 230368 - DNA, 75 bp, Artificial Sequence
  Synthetic
tttcaaatttcaggcaataaagctgagtgtgctcaaaactttattaaaactataattcaggcgaaattgactcct

SEQ ID NO: 230369 - DNA, 75 bp, Artificial Sequence
  Synthetic
cttcccctccaacccgcaacatcaccaataatgatacacaacgtgaactagcagaaagcgaacaaaccaatgctc

SEQ ID NO: 230370 - DNA, 75 bp, Artificial Sequence
  Synthetic
gtttgatattcaattgttattattgtcaggagtgaccttttctatttgatgcattaatgttttaaactacctctt

SEQ ID NO: 230371 - DNA, 75 bp, Artificial Sequence
  Synthetic
caataatgatacacaacgtgaactagcagaaagcgaacaaaccaatgctcagttgaacacaactctagatccaac

SEQ ID NO: 230372 - DNA, 75 bp, Artificial Sequence
  Synthetic
caagtgacaaaatttcgtagttaaatttctagaatgtcaatgtgaatgtaaattaagaaaaaccaatatataaaa

SEQ ID NO: 230373 - DNA, 75 bp, Artificial Sequence
  Synthetic
gtgcgtaggggttaatttaaagggatttcttattgtacagttttctgtattacttatttgggcttgaagacatag

SEQ ID NO: 230374 - DNA, 75 bp, Artificial Sequence
  Synthetic
accaacagcacaaccaacatcatcatgacgacatcagatataacaagcaaacaccccacaaattcttctccggat

SEQ ID NO: 230375 - DNA, 75 bp, Artificial Sequence
  Synthetic
tgacgacatcagatataacaagcaaacaccccacaaattcttctccggattctagtccgacaacccgccctccta

SEQ ID NO: 230376 - DNA, 75 bp, Artificial Sequence; identical to SEQ ID NO: 62726
  Synthetic

SEQ ID NO: 230377 - DNA, 75 bp, Artificial Sequence
  Synthetic
agacgtgctgttcaaagagtcttaatttataaccaactattgcaagaattaatttactttttccgttatacttag

SEQ ID NO: 230378 - DNA, 75 bp, Artificial Sequence
  Synthetic
tttctggaaagaaggtgatatattcccgtttttagatgggttaataaatactgaaattgattttgatccaatccc

SEQ ID NO: 230379 - DNA, 75 bp, Artificial Sequence
  Synthetic
ccgtttttagatgggttaataaatactgaaattgattttgatccaatcccaaacacagaaacaatctttgatgaa

SEQ ID NO: 230380 - DNA, 75 bp, Artificial Sequence
  Synthetic
tttataaccaactattgcaagaattaatttactttttccgttatacttagttacattaatcttttgactgttcag

SEQ ID NO: 230381 - DNA, 75 bp, Artificial Sequence
  Synthetic
gtgtcttcgatagaagtgtattagggtataaccctcctgttagatttcagtcaaaaagagtgccagagcaatttt

SEQ ID NO: 230382 - DNA, 75 bp, Artificial Sequence; identical to SEQ ID NO: 62728
  Synthetic

SEQ ID NO: 230383 - DNA, 75 bp, Artificial Sequence
  Synthetic
atgaggaacaacacactcccccgaatatcagtttaactttctcttattttcctgataaaaatggagatactgcct

SEQ ID NO: 230384 - DNA, 75 bp, Artificial Sequence
  Synthetic
tgggccaagcagacttttccttgaatcagatactggattttgctgaaaagttagaatatttggctccttcttata

SEQ ID NO: 230385 - DNA, 75 bp, Artificial Sequence
  Synthetic
tatcagtttaactttctcttattttcctgataaaaatggagatactgcctactctggggaaaacgagaatgattg

SEQ ID NO: 230386 - DNA, 75 bp, Artificial Sequence
  Synthetic
aaaaatgagcctccttccccctattctgggctgagaaaatttctcttatccgcctaaaatctgatctgttaggtc

SEQ ID NO: 230387 - DNA, 75 bp, Artificial Sequence
  Synthetic
catgaatattgatcaaatgaccaaatgatagtgcatttgtatagactcaattatcctttattaagaaaaagataa

SEQ ID NO: 230388 - DNA, 75 bp, Artificial Sequence
  Synthetic
gtgcaggaggacgatttggcggcagggcttagctggataccattttttggccctggaatcgaaggactctatact

SEQ ID NO: 230389 - DNA, 75 bp, Artificial Sequence
  Synthetic
ggcttagctggataccattttttggccctggaatcgaaggactctatactgccggtttaatcaaaaatcagaaca

SEQ ID NO: 230390 - DNA, 75 bp, Artificial Sequence
  Synthetic
tttgggaaattaccatatcgtgtcagaaatgtccaaacactcgcagaagccttgctagcagatgggctagcaaaa

SEQ ID NO: 230391 - DNA, 75 bp, Artificial Sequence
  Synthetic
agctaatcaaactgctaaatccttggagctcttgttaagggtcacaaccgaggaaaggacattttccttaatcaa

SEQ ID NO: 230392 - DNA, 75 bp, Artificial Sequence
  Synthetic
aggaaaggacattttccttaatcaataggcatgcaattgactttttgcttacgaggtggggcggaacatgcaagg

SEQ ID NO: 230393 - DNA, 75 bp, Artificial Sequence
  Synthetic
acgctatagtaaggggtgcaagttttgttactgatcttgagaaatacaaccttgccttccgatatgaatttacac

SEQ ID NO: 230394 - DNA, 75 bp, Artificial Sequence
  Synthetic
aacctcgcggaagaagtcgaacccgcaaccaccaagtcacaccgactatatatcatgaaactcaattgccctcca

SEQ ID NO: 230395 - DNA, 75 bp, Artificial Sequence
  Synthetic
aatagaagatctatctaaaaatatctcagaacaaatcgacaaaatcagaaaggatgaacaaaaggaggaaactgg

SEQ ID NO: 230396 - DNA, 75 bp, Artificial Sequence
  Synthetic
tcagaacaaatcgacaaaatcagaaaggatgaacaaaaggaggaaactggctggggtctaggtggcaaatggtgg

SEQ ID NO: 230397 - DNA, 75 bp, Artificial Sequence
  Synthetic
acgtgcaagatcgatgagctcaacccgtagtagtgcagaaagtagtcccaccaatcatattccccgtgctcgacc

SEQ ID NO: 230398 - DNA, 75 bp, Artificial Sequence
  Synthetic
atttgggcatcctgctactattatctatagctgttctgattgctctgtcctgtatctgtcgtatcttcactaaat

SEQ ID NO: 230399 - DNA, 75 bp, Artificial Sequence
  Synthetic
tatagctgttctgattgctctgtcctgtatctgtcgtatcttcactaaatacattggatgacataaagtttacaa

SEQ ID NO: 230400 - DNA, 75 bp, Artificial Sequence
  Synthetic
gctgagccctttgtctaatctactgaaatcgacttaaagaatcctcagggagcttataactcaatgtgaatcgat

SEQ ID NO: 230401 - DNA, 75 bp, Artificial Sequence
  Synthetic
agtgtcatgggtgataatcaatgtataacaactctaagtctttttccaattgatgctcctgacgattatcaagag

SEQ ID NO: 230402 - DNA, 75 bp, Artificial Sequence
  Synthetic
gaatgaggacgaagacactcttgacgacagtgtcatgattccgagtacaacatcgagagaatttcaaaggattcc

SEQ ID NO: 230403 - DNA, 75 bp, Artificial Sequence
  Synthetic
tccctatatattgttgatcgtgatgatatagcagtcaagtgtcaccatcattaggagcaattcttctgatccaat

SEQ ID NO: 230404 - DNA, 75 bp, Artificial Sequence
  Synthetic
aaatccttatctttaatccgaatattcacatagaaatcaattttgggaaaattccagtagtgcgtcttttcatgt

SEQ ID NO: 230405 - DNA, 75 bp, Artificial Sequence
  Synthetic
tcacatagaaatcaattttgggaaaattccagtagtgcgtcttttcatgtcacttctctgaacctaagaccataa

SEQ ID NO: 230406 - DNA, 75 bp, Artificial Sequence
  Synthetic
taagtctgacgtgtgctggaattcgaaagacgaatagatccttgatcaacaccatgacagaattacacatgaacc

SEQ ID NO: 230407 - DNA, 75 bp, Artificial Sequence
  Synthetic
gccagtattggtacatcctttgagagaggaacaagtgagacacggcacatttttccgagtcgttggatagcttca

SEQ ID NO: 230408 - DNA, 75 bp, Artificial Sequence
  Synthetic
ggtcaatcttctattttcatattaaagatatactgctcagaaactcctagtttgcaacccaatcttggaaaaata

SEQ ID NO: 230409 - DNA, 75 bp, Artificial Sequence
  Synthetic
tgaattgtcgcctgatttcacaaattatgaggataatcagcagaattggccacaaagagtggtgacaaagaaggg

SEQ ID NO: 230410 - DNA, 75 bp, Artificial Sequence
  Synthetic
ttttccgagtcgttggatagcttcatttcattcaatgttagcaataaatttattaaatcagaatcacctcgggtt

SEQ ID NO: 230411 - DNA, 75 bp, Artificial Sequence
  Synthetic
agatatactgctcagaaactcctagtttgcaacccaatcttggaaaaataaacctcctcttttgatcataactat

SEQ ID NO: 230412 - DNA, 75 bp, Artificial Sequence
  Synthetic
tattattaacaacttatttttatttaatcttttaaatgcaaatcaaaagaggacatgagccaccctcattttact

SEQ ID NO: 230413 - DNA, 75 bp, Artificial Sequence
  Synthetic
aacgccccaagttctaggagggttatcatttttgaatccggagaaattgttctaccggaacataagtgatccgct

SEQ ID NO: 230414 - DNA, 75 bp, Artificial Sequence
  Synthetic
agcctacattttaatttaccaggtgataaacttttggtaatttaccttaacataggtgctgataagatgattgga

SEQ ID NO: 230415 - DNA, 75 bp, Artificial Sequence
  Synthetic
ataaacttttggtaatttaccttaacataggtgctgataagatgattggatgataacacatttaccgagatttaa

SEQ ID NO: 230416 - DNA, 75 bp, Artificial Sequence
  Synthetic
cataggtgctgataagatgattggatgataacacatttaccgagatttaatcgtatctcattaagaaaaagataa

SEQ ID NO: 230417 - DNA, 75 bp, Artificial Sequence
  Synthetic
aatgcattggaatttcttgaaaaggaagaattattctatatcttgattgctaaaaaacctggtttagcagatgcc

SEQ ID NO: 230418 - DNA, 75 bp, Artificial Sequence
  Synthetic
cactagttcattgtaaattactcgatcaaaatgttcttaagctatcttaagcttactgatgcggctctgcttcac

SEQ ID NO: 230419 - DNA, 75 bp, Artificial Sequence
  Synthetic
aagaattattctatatcttgattgctaaaaaacctggtttagcagatgcctcagatttcgtcatgaatccattag

SEQ ID NO: 230420 - DNA, 75 bp, Artificial Sequence
  Synthetic
tctattttgatcaatgtagaaaagaattataaaaatcttagtaaataaattactgcaaagtaaaaacgaagaaca

SEQ ID NO: 230421 - DNA, 75 bp, Artificial Sequence
  Synthetic
attataaaaatcttagtaaataaattactgcaaagtaaaaacgaagaacattaagtgttctttattaaaattgtt

SEQ ID NO: 230422 - DNA, 75 bp, Artificial Sequence; identical to SEQ ID NO: 62752
  Synthetic

SEQ ID NO: 230423 - DNA, 75 bp, Artificial Sequence
  Synthetic
ataagctatcaaataacaatcacgtgcaagaactgggcatactatggtgatgcgagggcattattcagtgttaca

SEQ ID NO: 230424 - DNA, 75 bp, Artificial Sequence
  Synthetic
tgatcaaatacaacttcatttggtattcattccaagattcagaatgcaacagcctcgtgggagaagccgaaatcg

SEQ ID NO: 230425 - DNA, 75 bp, Artificial Sequence
  Synthetic
gaccaaagggtgtgtgagtggcttttatcatcaaaccccgtaatgagccgatttgctgctgacatcttttcaaga

SEQ ID NO: 230426 - DNA, 75 bp, Artificial Sequence
  Synthetic
cttttgacaccagatcacggatcaagcacacttcaatcaagcaccctaaattttcaatcatacacataataacca

SEQ ID NO: 230427 - DNA, 75 bp, Artificial Sequence
  Synthetic
atttgctgctgacatcttttcaagaacgcctagtggaaaacggcttcaagtcttaggctatctggaaggaacaag

SEQ ID NO: 230428 - DNA, 75 bp, Artificial Sequence
  Synthetic
ttcattccaagattcagaatgcaacagcctcgtgggagaagccgaaatcgtagccaccaagttgcactatccaca

SEQ ID NO: 230429 - DNA, 75 bp, Artificial Sequence
  Synthetic
aacctcagtacattaaccatcatccacgtgcaagatcaatgagttcaacccgtagtagtacagaaggtagcccta

SEQ ID NO: 230430 - DNA, 75 bp, Artificial Sequence
  Synthetic
acgtgcaagatcaatgagttcaacccgtagtagtacagaaggtagccctactaatcatgcttcccgtgctcgacc

SEQ ID NO: 230431 - DNA, 75 bp, Artificial Sequence
  Synthetic
cttactctaatgattgtaataattaactgttggcttagatgataacagatatgaggttatataattactcatagt

SEQ ID NO: 230432 - DNA, 75 bp, Artificial Sequence
  Synthetic
gcacacttcaatcaagcaccctaaattttcaatcatacacataataaccattttagtagcgttgcctttcagtac

SEQ ID NO: 230433 - DNA, 75 bp, Artificial Sequence
  Synthetic
actgttggcctagatgataacagatatgaggttatataattactcatagtgtaaagtataattcttacctctgtt

SEQ ID NO: 230434 - DNA, 75 bp, Artificial Sequence
  Synthetic
cctcctccccccccgaaagacatgtgcaggaacatgaaaattgggttaccctgtactgaccccgcttgcaacagg

SEQ ID NO: 230435 - DNA, 75 bp, Artificial Sequence
  Synthetic
gcaggaacatgaaaattgggttaccctgtactgaccccgcttgcaacagggatcatgaccttgataatctaacaa

SEQ ID NO: 230436 - DNA, 75 bp, Artificial Sequence
  Synthetic
tatattgatgcattggacgatgatttatctgagtccttagaaaaattcacatgtactgttgatgtagctaatttc

SEQ ID NO: 230437 - DNA, 75 bp, Artificial Sequence
  Synthetic
acggaagatgctccccaatacagataaggctttcaaaagtcagcaggactgtggatcgccatctctttccaaagg

SEQ ID NO: 230438 - DNA, 75 bp, Artificial Sequence
  Synthetic
aaggctttcaaaagtcagcaggactgtggatcgccatctctttccaaagggctttcaaaggacaagcaggaacaa

SEQ ID NO: 230439 - DNA, 75 bp, Artificial Sequence
  Synthetic
caatctgtcttcagaatcagaatcaactataaatttattgccgtatgactgcaaggaactgcgacttggaagaag

SEQ ID NO: 230440 - DNA, 75 bp, Artificial Sequence
  Synthetic
tacagcaatcattgattcctggatttagatctattgttcatatgctatcagaatggctgctcctggaggtcacgt

SEQ ID NO: 230441 - DNA, 75 bp, Artificial Sequence
  Synthetic
atctagggcacatattgaattatcttcatagatcagaaatcggaaaattggacgagacatcactccgtgcagcat

SEQ ID NO: 230442 - DNA, 75 bp, Artificial Sequence
  Synthetic
caatgacacagagttaaactatgtcagttgtgctctcgaccggaaagttgtccagaaacatccctctgttaatcg

SEQ ID NO: 230443 - DNA, 75 bp, Artificial Sequence
  Synthetic
tcatagatcagaaatcggaaaattggacgagacatcactccgtgcagcattgagtttaacatgtgccggaatccg

SEQ ID NO: 230444 - DNA, 75 bp, Artificial Sequence
  Synthetic
tctggcttggacaataggaaatcgagcaccgtatataggatcacggacagaagacaagatcggttatcctccctt

SEQ ID NO: 230445 - DNA, 75 bp, Artificial Sequence
  Synthetic
actatgacagaattgcatatcaaccatgagaatcttccacaggaccaaaatggtgttattaagcagacatataca

SEQ ID NO: 230446 - DNA, 75 bp, Artificial Sequence
  Synthetic
atgagaatcttccacaggaccaaaatggtgttattaagcagacatatacaggtattcatcttgacaaagggggtc

SEQ ID NO: 230447 - DNA, 75 bp, Artificial Sequence
  Synthetic
cttaaggaagccattgagatggtttctagattattgtgggtgactcaaggcactgcagaccgagaaaaattgctt

SEQ ID NO: 230448 - DNA, 75 bp, Artificial Sequence
  Synthetic
ctgggacaagaagtcaatatcgttgtttgtgcaagctgcattatatgtgatgaataatatcccctgtgaatcgtc

SEQ ID NO: 230449 - DNA, 75 bp, Artificial Sequence
  Synthetic
tttgtgcaagctgcattatatgtgatgaataatatcccctgtgaatcgtccatcagtgtgcaggcctcatatgat

SEQ ID NO: 230450 - DNA, 75 bp, Artificial Sequence
  Synthetic
tctcaatctgacacaatacatgaacagcaaaattgctatataagtggcttaaattagcatgggtattcctagttc

SEQ ID NO: 230451 - DNA, 75 bp, Artificial Sequence
  Synthetic
ctttttacctacacactactcaggcaacatagttcatagatataatgaccaatatggacaacattcttttatggc

SEQ ID NO: 230452 - DNA, 75 bp, Artificial Sequence; identical to SEQ ID NO: 62774
  Synthetic

SEQ ID NO: 230453 - DNA, 75 bp, Artificial Sequence
  Synthetic
gtgaaagacaatgattgtcatttcaaaatcaacgatataattattgttaacattctaccttggttcttattgtaa

SEQ ID NO: 230454 - DNA, 75 bp, Artificial Sequence
  Synthetic
aaatcaacgatataattattgttaacattctaccttggttcttattgtaagacttgtatactctcctatcaactg

SEQ ID NO: 230455 - DNA, 75 bp, Artificial Sequence
  Synthetic
cgtgcaattatatcaactaacacactaggtaaatatgctggggggggtcaagctgctattgatagtaatataatc

SEQ ID NO: 230456 - DNA, 75 bp, Artificial Sequence
  Synthetic
atacaataggctgttcctataatctgattgtgagattataaacttgtagaattaccgtgggtcacaactgttgca

SEQ ID NO: 230457 - DNA, 75 bp, Artificial Sequence
  Synthetic
cacaaaaattcaatcgcattgtaatcaattatttatcatcgattgtttagtttgagggattccacatcatcttaa

SEQ ID NO: 230458 - DNA, 75 bp, Artificial Sequence
  Synthetic
caattatttatcatcgattgtttagtttgagggattccacatcatcttaaatccaataacacgattttgtttgat

SEQ ID NO: 230459 - DNA, 75 bp, Artificial Sequence
  Synthetic
agtgatgtgtgcttgaatacttcgatataatacatactaataacgattgattaagaaaaatcaatgatggatatt

SEQ ID NO: 230460 - DNA, 75 bp, Artificial Sequence
  Synthetic
caacatacaagtgtctgacgaacgacctgtgtttctatggaaaaacatgaagaacattaagaaaaaggatgttct

SEQ ID NO: 230461 - DNA, 75 bp, Artificial Sequence; identical to SEQ ID NO: 62779
  Synthetic

SEQ ID NO: 230462 - DNA, 75 bp, Artificial Sequence
  Synthetic
cctgtgtttctatggaaaaacatgaagaacattaagaaaaaggatgttcttgtatttcaaccaaggttgtatata

SEQ ID NO: 230463 - DNA, 75 bp, Artificial Sequence
  Synthetic
ttatataattcttttcgatacacgttatatctttagcaaagtgaggaaaacagctttatcatgttagatgccagt

SEQ ID NO: 230464 - DNA, 75 bp, Artificial Sequence
  Synthetic
tattcatagtagattatatgattttttataagtttaagatatcttaaattatacccacaagagatactgttttaa

SEQ ID NO: 230465 - DNA, 75 bp, Artificial Sequence
  Synthetic
ttgtcaatatctgacaattgatcatacacattccaataatacattatagactttttatcatatatagaactggga

SEQ ID NO: 230466 - DNA, 75 bp, Artificial Sequence
  Synthetic
acacattccaataatacattatagactttttatcatatatagaactgggattctaatagttctacttcttagtgc

SEQ ID NO: 230467 - DNA, 75 bp, Artificial Sequence; identical to SEQ ID NO: 62784
  Synthetic

SEQ ID NO: 230468 - DNA, 75 bp, Artificial Sequence
  Synthetic
tcattattcacataatccgaaattgcgtaattgtaggattccacatcacatttaccgtttaaggaattcgacagc

SEQ ID NO: 230469 - DNA, 75 bp, Artificial Sequence
  Synthetic
ctgagtatggcagaactgtcaacacgttacaacttaccaacaaatattacagagaagagcataaatcttgatctc

SEQ ID NO: 230470 - DNA, 75 bp, Artificial Sequence
  Synthetic
gttacaacttaccaacaaatattacagagaagagcataaatcttgatctcaattctactgcacggtgggtaaaag

SEQ ID NO: 230471 - DNA, 75 bp, Artificial Sequence
  Synthetic
ctaaaacaaattttaatatggccagttccagcaattataacacatacatgcaatacttgaacccccctccttatg

SEQ ID NO: 230472 - DNA, 75 bp, Artificial Sequence
  Synthetic
gaaatgggggaattttatctttcacatcccaaataccggaatgacattgttgcatcatttaaaatctaattttgt

SEQ ID NO: 230473 - DNA, 75 bp, Artificial Sequence
  Synthetic
atcccaaataccggaatgacattgttgcatcatttaaaatctaattttgttgttccagaatggcaacaaacaagg

SEQ ID NO: 230474 - DNA, 75 bp, Artificial Sequence
  Synthetic
acccaaaatcaaccatcatggagcctttcttggctttgaggatcttacttggcgttgctttgaaggatcaagaat

SEQ ID NO: 230475 - DNA, 75 bp, Artificial Sequence
  Synthetic
aatgttagggggttctgcaggagagaaaagttcatcagatgctgttcggctatttcttacagcaagttaccagaa

SEQ ID NO: 230476 - DNA, 75 bp, Artificial Sequence
  Synthetic
accatgttttttcagcttctgcaaggtcacagtgtgaggatttttctcctaaggagaatccttattattggggga

SEQ ID NO: 230477 - DNA, 75 bp, Artificial Sequence
  Synthetic
tgcagcaatcattgattcctggatttagatccattgtgcatatgctttcagaatggctgcttttagaagttacgt

SEQ ID NO: 230478 - DNA, 75 bp, Artificial Sequence
  Synthetic
cggtttggctttactttcctagtgaagggcaacaattaaaacctatattaaaaatcttacagagattatcagact

SEQ ID NO: 230479 - DNA, 75 bp, Artificial Sequence
  Synthetic
gttggggatctatttgacctcagacatgtttaaaatcctaatggcaggtgtgaaaaactttttcaataagctgtt

SEQ ID NO: 230480 - DNA, 75 bp, Artificial Sequence
  Synthetic
gtttggaatagcagattttgttatttttaaggttccagtaaaaacaataatccgaaatgctgtaagcttacaagc

SEQ ID NO: 230481 - DNA, 75 bp, Artificial Sequence
  Synthetic
atgtttaaaatcctaatggcaggtgtgaaaaactttttcaataagctgtttaccctccatgttgtaaatgatcat

SEQ ID NO: 230482 - DNA, 75 bp, Artificial Sequence
  Synthetic
atgcgaatccaacgctcagtgccgtttgaaatgatgctcaaatgagataggagtccatctgcataagaagcatgg

SEQ ID NO: 230483 - DNA, 75 bp, Artificial Sequence
  Synthetic
aattaaccggacaacagatcataatcactcgagttaacatggggttcttagtagaagttaggaggattgacattg

SEQ ID NO: 230484 - DNA, 75 bp, Artificial Sequence
  Synthetic
cactcgagttaacatggggttcttagtagaagttaggaggattgacattgaaccttgctgcggcgagactgtcct

SEQ ID NO: 230485 - DNA, 75 bp, Artificial Sequence
  Synthetic
ccactattatgcaagccttaattattggagagacaaagctaataaggtcaagaatactcctttttcgcatttgat

SEQ ID NO: 230486 - DNA, 75 bp, Artificial Sequence
  Synthetic
gtagctgaagcagtcctaagggaacacagccagattgagagaggtcaacctcttaatttgacacaatacatgaac

SEQ ID NO: 230487 - DNA, 75 bp, Artificial Sequence
  Synthetic
tattgttcatccagagaatatccctgaaataaatgcaagaaccaaattaataaattatggatcaacagctctaca

SEQ ID NO: 230488 - DNA, 75 bp, Artificial Sequence
  Synthetic
gggagaccaaattattgccatgtacctggaggacggtttcaaattgattaaacacttagaacccttgtgtgtcag

SEQ ID NO: 230489 - DNA, 75 bp, Artificial Sequence
  Synthetic
agcaaaattgctatttagacagcttgattcggcatctaaagctttaattcagctgtataaggatattgagaagac

SEQ ID NO: 230490 - DNA, 75 bp, Artificial Sequence
  Synthetic
ttcttatattgcttgattaaaaacaagaaattatcctaacatgaagaccacatgtctctttatcggtcttatctt

SEQ ID NO: 230491 - DNA, 75 bp, Artificial Sequence
  Synthetic
ctgtatacaaacacatggcatctttacaccaagaaaatattggttccaatcacagatgattaagtcatattatga

SEQ ID NO: 230492 - DNA, 75 bp, Artificial Sequence
  Synthetic
taaattatggatcaacagctctacaggggatggatatcaagatgccactctcggagcaaaatctggttgaaaatt

SEQ ID NO: 230493 - DNA, 75 bp, Artificial Sequence
  Synthetic
ataataaaagatgtagttgccctaatttgtattcactaacctaaaataatagtattatcacactagatagtcatc

SEQ ID NO: 230494 - DNA, 75 bp, Artificial Sequence
  Synthetic
tgaactccatgatctcaatttgaaacttcaaatttcagacaataaggctgagtgtgcccaaaactttattaaaac

SEQ ID NO: 230495 - DNA, 75 bp, Artificial Sequence
  Synthetic
tttgtattcactaacctaaaataatagtattatcacactagatagtcatcacataataagttgtttctatgaatt

SEQ ID NO: 230496 - DNA, 75 bp, Artificial Sequence
  Synthetic
tgaagacaacatgcagactcctgcatacatacatagttcccccccatatcaaacccttataaaatcatcagatgt

SEQ ID NO: 230497 - DNA, 75 bp, Artificial Sequence
  Synthetic
gtcgaccatcaaaggacattagattcaaggacaatccaaaaacaacaaaacatgaccagggatgtgtggggaagg

SEQ ID NO: 230498 - DNA, 75 bp, Artificial Sequence
  Synthetic
attactatgggttctatatacggcatttattccggactgtatcctttgtaaacaatgcatgcttaagtattctca

SEQ ID NO: 230499 - DNA, 75 bp, Artificial Sequence
  Synthetic
acatgaggactttgatgccttgaaggtaatcttaaattctgaaataaataaccttaaccttacggattgtacgct

SEQ ID NO: 230500 - DNA, 75 bp, Artificial Sequence
  Synthetic
tttattccggactgtatcctttgtaaacaatgcatgcttaagtattctcatatcatacatgttatcactgcctga

SEQ ID NO: 230501 - DNA, 75 bp, Artificial Sequence
  Synthetic
gtaatcttaaattctgaaataaataaccttaaccttacggattgtacgcttaatacaaagtcattgacaattcct

SEQ ID NO: 230502 - DNA, 75 bp, Artificial Sequence
  Synthetic
tatcttagacaacatattgtgtcaaattcatttccatcacaagccgaaatttatcagcatctttgggagtggtat

SEQ ID NO: 230503 - DNA, 75 bp, Artificial Sequence
  Synthetic
aaacatccttcaattgactgttttgagactttaaaatcttacaggctgtcttgatttttaaattctctacgggat

SEQ ID NO: 230504 - DNA, 75 bp, Artificial Sequence
  Synthetic
atcaacttccagggaacggtctctactatctagagaacaagcttcatatttgtatgttgattgcagtaatattcc

SEQ ID NO: 230505 - DNA, 75 bp, Artificial Sequence
  Synthetic
gtccgttacgatcctctagatattcatcaacttccagggaacggtctctactatctagagaacaagcttcatatt

SEQ ID NO: 230506 - DNA, 75 bp, Artificial Sequence
  Synthetic
agactttaaaatcttacaggctgtcttgatttttaaattctctacgggattatacagtcacctttagcatacatt

SEQ ID NO: 230507 - DNA, 75 bp, Artificial Sequence
  Synthetic
gactctatgacattccgagccaggtctttatcttgaattaaccctctttttggtatgcaacacccgactcaatat

SEQ ID NO: 230508 - DNA, 75 bp, Artificial Sequence
  Synthetic
ctttatcttgaattaaccctctttttggtatgcaacacccgactcaatatccagatgcaagattatcttctccca

SEQ ID NO: 230509 - DNA, 75 bp, Artificial Sequence
  Synthetic
tcaacatcacagacccaaacagtgatgatgaggacctcataacatccggttcagggtccgaagaacaggaacctt

SEQ ID NO: 230510 - DNA, 75 bp, Artificial Sequence
  Synthetic
gaccagaagtctagggttgtatagtcattactcacacaatccaaaactacgtaattgtaggattccataccacat

SEQ ID NO: 230511 - DNA, 75 bp, Artificial Sequence
  Synthetic
cattactcacacaatccaaaactacgtaattgtaggattccataccacatttatcgcttgaggaattctacagca

SEQ ID NO: 230512 - DNA, 75 bp, Artificial Sequence
  Synthetic
gttacttttgaagtggaagaagacggattatttatttttcaacacgttggctacggattcacagcaagaagcaga

SEQ ID NO: 230513 - DNA, 75 bp, Artificial Sequence
  Synthetic
cgatactcacagttccttttcactcaatttgggatcacatcataacttcaattcaacacgatgcaattaatcata

SEQ ID NO: 230514 - DNA, 75 bp, Artificial Sequence
  Synthetic
tctctgcaccactacaaaacaccaccaattacgacacacagagcacagccactgaaaatgaacaaaccagtgccc

SEQ ID NO: 230515 - DNA, 75 bp, Artificial Sequence
  Synthetic
aatttgggatcacatcataacttcaattcaacacgatgcaattaatcatatcaatgatttcaaatacctattacc

SEQ ID NO: 230516 - DNA, 75 bp, Artificial Sequence
  Synthetic
agaatgttatataacatagataggttaaatgctttgcttgaatcaagaagactaatattgaacaacctaactatc

SEQ ID NO: 230517 - DNA, 75 bp, Artificial Sequence
  Synthetic
tgggacaatgagttcttaagagtattccttaacaagatcttgagactcgatcatgcttttacaaattctgcaaag

SEQ ID NO: 230518 - DNA, 75 bp, Artificial Sequence
  Synthetic
tccttaacaagatcttgagactcgatcatgcttttacaaattctgcaaagttacaatgtgaggatttctctccca

SEQ ID NO: 230519 - DNA, 75 bp, Artificial Sequence
  Synthetic
gttattgctcgtgcatttatctcaacttgccagaaggattaagggacaaagagggtctttaaggagcaactggaa

SEQ ID NO: 230520 - DNA, 75 bp, Artificial Sequence
  Synthetic
cttgccagaaggattaagggacaaagagggtctttaaggagcaactggaagtttataggagttgatttggaacta

SEQ ID NO: 230521 - DNA, 75 bp, Artificial Sequence
  Synthetic
gtatcatcaaggtatttttattagactatgaagggactttgttcttaatgaggaatgccattcagtattatgggc

SEQ ID NO: 230522 - DNA, 75 bp, Artificial Sequence
  Synthetic
ttaaagttccgataaaagcaataattcggaatgctacaagtttacaggcctcaaaaccagggttaaagacatggt

SEQ ID NO: 230523 - DNA, 75 bp, Artificial Sequence
  Synthetic
ctcaaatgcaaagaactcagaatggtacttgtgttgcggtaaacgaagaattcaacgactcaaaattgatttctc

SEQ ID NO: 230524 - DNA, 75 bp, Artificial Sequence
  Synthetic
tctgtgtgatgatgaatttgttgtaagcatcgctagttatgaatgttttatcatgattaaagatgtcttcatcga

SEQ ID NO: 230525 - DNA, 75 bp, Artificial Sequence
  Synthetic
gctcgcgcttgggtcgaagataatgaagaagctgattacccacctcttggtatattaagagatttgtacaatcaa

SEQ ID NO: 230526 - DNA, 75 bp, Artificial Sequence
  Synthetic
aagaagctgattacccacctcttggtatattaagagatttgtacaatcaaggggaccaaattataaccatgtatc

SEQ ID NO: 230527 - DNA, 75 bp, Artificial Sequence
  Synthetic
acacttagaacccttatgtgtcagttgtatacaaacgtacggtatttttacgccgaggaagtactggtttcaatc

SEQ ID NO: 230528 - DNA, 75 bp, Artificial Sequence
  Synthetic
tgtatacaaacgtacggtatttttacgccgaggaagtactggtttcaatctcagatgattaaatcatattatgat

SEQ ID NO: 230529 - DNA, 75 bp, Artificial Sequence
  Synthetic
ttggattatgaaaacaattcacctctactagacttgagaaatcactttatttgctcattaaggggaaagataact

SEQ ID NO: 230530 - DNA, 75 bp, Artificial Sequence
  Synthetic
agcctaaaatctgatccgttgggtcatgggcccttcataatctgtttgagcatgaatgttgatcaaatgaccaag

SEQ ID NO: 230531 - DNA, 75 bp, Artificial Sequence
  Synthetic
ttcagattccagataataggactgaatgtgcacagaactttattaaaaccataattcaggcaaaactgactcctc

SEQ ID NO: 230532 - DNA, 75 bp, Artificial Sequence
  Synthetic
atgtgcacagaactttattaaaaccataattcaggcaaaactgactcctcaacaatactgtgaattgttctcttt

SEQ ID NO: 230533 - DNA, 75 bp, Artificial Sequence
  Synthetic
gaaaggcaaaaactggtcacaacttgttgagacccttcctaatatgcattcagtctgcatagtacacgtggatca

SEQ ID NO: 230534 - DNA, 75 bp, Artificial Sequence
  Synthetic
attataaaaatcttgagggacaaattattgcaacgtagagtcgaagaacattaagtgttctttgttagaattatt

SEQ ID NO: 230535 - DNA, 75 bp, Artificial Sequence
  Synthetic
ttatacaatgatgttgcactagacaaagtgaagaaacatgcccaatcaacaaaaattttaaaacctaaggtcatg

SEQ ID NO: 230536 - DNA, 75 bp, Artificial Sequence
  Synthetic
ttactactcaaactggattttattagaaacacaaagatcgcagaacaaaaattacttaatagagtaatcgggtat

SEQ ID NO: 230537 - DNA, 75 bp, Artificial Sequence
  Synthetic
aagtgaagaaacatgcccaatcaacaaaaattttaaaacctaaggtcatgtttgaaactttttgtgtctttaagt

SEQ ID NO: 230538 - DNA, 75 bp, Artificial Sequence
  Synthetic
ctctcaaggatcgtggtacaaaaccacacatgatctacatttgaccccatatctacggcagcacattgtgtcaaa

SEQ ID NO: 230539 - DNA, 75 bp, Artificial Sequence
  Synthetic
acacatgatctacatttgaccccatatctacggcagcacattgtgtcaaattcatttccatcgcaagccgagatt

SEQ ID NO: 230540 - DNA, 75 bp, Artificial Sequence
  Synthetic
ttaaatctgaatcattaagagcataactttaacaaagagaacttcatttaattcacagaaataatctatttaaaa

SEQ ID NO: 230541 - DNA, 75 bp, Artificial Sequence
  Synthetic
tgtatgagaaataataaaataaacaagaagaagaaaaaactattagacagcttactttacacaagataatcttat

SEQ ID NO: 230542 - DNA, 75 bp, Artificial Sequence
  Synthetic
ttgtagagcatgaacctcttttttctacaaaaataataagtgatttgagtattttcataaaagatagagctactg

SEQ ID NO: 230543 - DNA, 75 bp, Artificial Sequence
  Synthetic
tacaaaaataataagtgatttgagtattttcataaaagatagagctactgctgtaaatcgagagtgttgggacag

SEQ ID NO: 230544 - DNA, 75 bp, Artificial Sequence
  Synthetic
cttactttacacaagataatcttatatcgccttaagccttacataagtgagaaaatcacgcgcacagattaactt

SEQ ID NO: 230545 - DNA, 75 bp, Artificial Sequence
  Synthetic
gtgattgaacgttcggtcacaccagtggtaactttttaatgttagttactcaaatattattgctcataattggta

SEQ ID NO: 230546 - DNA, 75 bp, Artificial Sequence
  Synthetic
tacaatccccctgtcagatttcaatcaaagagggtacctgagcaattcttaggtcaagcagatttctctttaaat

SEQ ID NO: 230547 - DNA, 75 bp, Artificial Sequence
  Synthetic
caaagagggtacctgagcaattcttaggtcaagcagatttctctttaaatcaaatattggattttgctgagaaat

SEQ ID NO: 230548 - DNA, 75 bp, Artificial Sequence
  Synthetic
tggtaactttttaatgttagttactcaaatattattgctcataattggtattaatattgacacattgggtgagtc

SEQ ID NO: 230549 - DNA, 75 bp, Artificial Sequence
  Synthetic
aaacttttccttttcattaaaggaaaaagaattgaatattgggagaacattcgggaagttgccctatcgtgtcag

SEQ ID NO: 230550 - DNA, 75 bp, Artificial Sequence
  Synthetic
aaagaattgaatattgggagaacattcgggaagttgccctatcgtgtcagaaatgtccaaacacttgcagaagcc

SEQ ID NO: 230551 - DNA, 75 bp, Artificial Sequence
  Synthetic
tatattgatgcactggacgatgatttatctgagtccttggaaaagttcacatgtactgttgatgtggctaatttc

SEQ ID NO: 230552 - DNA, 75 bp, Artificial Sequence
  Synthetic
ttcttttacatacattggggaaagaactaggttatcgttgagattaaaaagactacgttacgttttctctgatga

SEQ ID NO: 230553 - DNA, 75 bp, Artificial Sequence
  Synthetic
taccatatatcataaatataaaagaacgatctgctgtaatctataagcatttcttttacatacattggggaaaga

SEQ ID NO: 230554 - DNA, 75 bp, Artificial Sequence
  Synthetic
cattccctagtaatatgatggttgttactgagagagagcagaaagaagctctattgcatcaagcctcttggcacc

SEQ ID NO: 230555 - DNA, 75 bp, Artificial Sequence
  Synthetic
tactgagagagagcagaaagaagctctattgcatcaagcctcttggcaccataattcagcaagtataggggagaa

SEQ ID NO: 230556 - DNA, 75 bp, Artificial Sequence
  Synthetic
gtaaaggacaatgattattgtttgaaagctgacaatcaaatcactttcagtttttagtttcaactcttattgcga

SEQ ID NO: 230557 - DNA, 75 bp, Artificial Sequence
  Synthetic
agaatattaacattgacattgagacttgtcagtctgttaatattcttgaagagatggatttacatagtttgttag

SEQ ID NO: 230558 - DNA, 75 bp, Artificial Sequence
  Synthetic
gttactgatcttgagaaatacaatcttgcctttagatatgagtttacacgacatttcatagactactgtaatcga

SEQ ID NO: 230559 - DNA, 75 bp, Artificial Sequence; identical to SEQ ID NO: 62856
  Synthetic

SEQ ID NO: 230560 - DNA, 75 bp, Artificial Sequence
  Synthetic
gaatgaggacgaagatactcttgatgacagtgtcatgatcccgagcacaacatcgagagaatttcaagggattcc

SEQ ID NO: 230561 - DNA, 75 bp, Artificial Sequence
  Synthetic
ttgcctttagatatgagtttacacgacatttcatagactactgtaatcgatgttacggtgttaaaaatttattcg

SEQ ID NO: 230562 - DNA, 75 bp, Artificial Sequence
  Synthetic
atgctatatgcatgtcagtgacttttatagccctcctcactgcgtgacagaaaataaccgaaataacccacctga

SEQ ID NO: 230563 - DNA, 75 bp, Artificial Sequence
  Synthetic
tatagccctcctcactgcgtgacagaaaataaccgaaataacccacctgattgtgccaatgcttatcattatcat

SEQ ID NO: 230564 - DNA, 75 bp, Artificial Sequence
  Synthetic
ggagagtattgaccagccaggatccgacaatgaacaaggagttgatcttccacctcctccgttgtacgctcagga

SEQ ID NO: 230565 - DNA, 75 bp, Artificial Sequence; identical to SEQ ID NO: 62859
  Synthetic

SEQ ID NO: 230566 - DNA, 75 bp, Artificial Sequence
  Synthetic
cttaaagaagctattgagatggtttctagattgttatgggtgactcaaggcactgcagaccgagaaaaattgctt

SEQ ID NO: 230567 - DNA, 75 bp, Artificial Sequence
  Synthetic
agaaattgtggacatgtatatcatgtgctcaaatcacgcttgtagaactgaaaactaagttaaaattgaaatcca

SEQ ID NO: 230568 - DNA, 75 bp, Artificial Sequence
  Synthetic
atgcgggttatgaatttgatgtcatcaagaatgcagatgcaacccgctttctggatgtgatccccaatgaacctc

SEQ ID NO: 230569 - DNA, 75 bp, Artificial Sequence
  Synthetic
tgctcaaatcacgcttgtagaactgaaaactaagttaaaattgaaatccagtgtcatgggtgataatcaatgtat

SEQ ID NO: 230570 - DNA, 75 bp, Artificial Sequence
  Synthetic
caagaatgcagatgcaacccgctttctggatgtgatccccaatgaacctcattacagccctttaattctggccct

SEQ ID NO: 230571 - DNA, 75 bp, Artificial Sequence
  Synthetic
gatgctcccaatgattatcaagaaaatgaggcagaattaaatgctgcacgagttgctgttgaattagctattact

SEQ ID NO: 230572 - DNA, 75 bp, Artificial Sequence
  Synthetic
cagagggggaggattgggctctttttgtcattctgcagtctttttctcccaaaacttgtcgtcggagaccgggcc

SEQ ID NO: 230573 - DNA, 75 bp, Artificial Sequence
  Synthetic
atgaggcagaattaaatgctgcacgagttgctgttgaattagctattactacaggctatagtgggatattcttaa

SEQ ID NO: 230574 - DNA, 75 bp, Artificial Sequence
  Synthetic
agtatcgaaaaggccttaagacaagtgacagtacatcaagaacagggaattgtcacataccctaatcattggctt

SEQ ID NO: 230575 - DNA, 75 bp, Artificial Sequence
  Synthetic
agggtttatttactttggtaaaaagcaatacctaaatggtgttcaattaccacaatcattgaagacaatggcaag

SEQ ID NO: 230576 - DNA, 75 bp, Artificial Sequence
  Synthetic
caatacctaaatggtgttcaattaccacaatcattgaagacaatggcaaggtgtggacctttatcagattccatt

SEQ ID NO: 230577 - DNA, 75 bp, Artificial Sequence
  Synthetic
ccagtattggcacatcatttgagagaggggcaagcgagacacggcatatttttccaagtcgttggatagctgcat

SEQ ID NO: 230578 - DNA, 75 bp, Artificial Sequence
  Synthetic
aggggcaagcgagacacggcatatttttccaagtcgttggatagctgcatttcattccatgttagccgtaaattt

SEQ ID NO: 230579 - DNA, 75 bp, Artificial Sequence
  Synthetic
gtgcggacctccaaagtgaaaaacgaagttgctagtttcaagcaggcgttgagcaacttagcccgacacggagag

SEQ ID NO: 230580 - DNA, 75 bp, Artificial Sequence
  Synthetic
cccctaggatttagtattgatgtatcctgttttaaaaagcctcttactttctcggagaaattaattgctttgatc

SEQ ID NO: 230581 - DNA, 75 bp, Artificial Sequence
  Synthetic
aaagggagattaggcagagtatctcgatcaacactctcattgagtttgaatgtcagtgacattggttcttatgac

SEQ ID NO: 230582 - DNA, 75 bp, Artificial Sequence
  Synthetic
cctgttttaaaaagcctcttactttctcggagaaattaattgctttgatcacacctcaagtgctagggggattat

SEQ ID NO: 230583 - DNA, 75 bp, Artificial Sequence
  Synthetic
atttatcagggattaacaatctcgaacatggactctatcctcagctctcagcaattgcgctgggtgtagcgacag

SEQ ID NO: 230584 - DNA, 75 bp, Artificial Sequence
  Synthetic
ctatcggaacatcagtgatcctcttacttcagggttatttcaactcaggaatgcattagagttccttagaaagga

SEQ ID NO: 230585 - DNA, 75 bp, Artificial Sequence
  Synthetic
gcaattgcgctgggtgtagcgacagcacatggcagtacattggctggtgtcaatgtcggcgaacaatatcaacag

SEQ ID NO: 230586 - DNA, 75 bp, Artificial Sequence
  Synthetic
acttcagggttatttcaactcaggaatgcattagagttccttagaaaggaagagttgttctacatcttgattgct

SEQ ID NO: 230587 - DNA, 75 bp, Artificial Sequence
  Synthetic
catatttaccaaatcttacataggattatatgattctcttcgatactcgttatatctttagcaaagtaatgaaaa

SEQ ID NO: 230588 - DNA, 75 bp, Artificial Sequence
  Synthetic
cagatttcgttatgaatccattaggtttaaatgtgccaggatctagggaaataataacgtttctcaggcaaacag

SEQ ID NO: 230589 - DNA, 75 bp, Artificial Sequence
  Synthetic
acatcaggaaattcaagctattgccgaagatgacgaggaaaggaagatattagaacaattccaccttcagaaaac

SEQ ID NO: 230590 - DNA, 75 bp, Artificial Sequence
  Synthetic
tttaaatgtgccaggatctagggaaataataacgtttctcaggcaaacagttcgtgaaaacataacaattacatc

SEQ ID NO: 230591 - DNA, 75 bp, Artificial Sequence
  Synthetic
tttcacataggttccgacttagaggatcaaagagtatgtgaatggcttttatcatcaaaccctgtaatgagccga

SEQ ID NO: 230592 - DNA, 75 bp, Artificial Sequence
  Synthetic
atcaaagagtatgtgaatggcttttatcatcaaaccctgtaatgagccgatttgctgctgatattttttcacgaa

SEQ ID NO: 230593 - DNA, 75 bp, Artificial Sequence
  Synthetic
tatcttaataagatcttaggacttgaccatgtttttccagcttctgcaaggtcacaatgtgaggatttttctcct

SEQ ID NO: 230594 - DNA, 75 bp, Artificial Sequence
  Synthetic
aagagttcatcagatgctgttcggctatttcttacagcaagttatcagaattttatcaataatttcagttgtctg

SEQ ID NO: 230595 - DNA, 75 bp, Artificial Sequence
  Synthetic
tttaggttacttggaaggaaccagaacgttattagcttcccgcacgatcagtttaaccactgagggtacaatgtt

SEQ ID NO: 230596 - DNA, 75 bp, Artificial Sequence
  Synthetic
acgttattagcttcccgcacgatcagtttaaccactgagggtacaatgttgatgagattaagagagttaactaag

SEQ ID NO: 230597 - DNA, 75 bp, Artificial Sequence
  Synthetic
acattgatgcattagatgatgatttgtctgagtctcttgaaaagttcatatgcactgttgatgtggctaatttct

SEQ ID NO: 230598 - DNA, 75 bp, Artificial Sequence
  Synthetic
agaggtataacacgtgggaaatatgtgcccgcgcctggctcgaagacagtgatggagctgattatcctcctcttg

SEQ ID NO: 230599 - DNA, 75 bp, Artificial Sequence
  Synthetic
gatagtgtcatgatcccgagcacaacatcgagagaatttcaagggattcctgaaccgccaagacaatctcaggac

SEQ ID NO: 230600 - DNA, 75 bp, Artificial Sequence
  Synthetic
gtctgagtctcttgaaaagttcatatgcactgttgatgtggctaatttcttgagagcatattcatggtcagatgt

SEQ ID NO: 230601 - DNA, 75 bp, Artificial Sequence; identical to SEQ ID NO: 62883
  Synthetic

SEQ ID NO: 230602 - DNA, 75 bp, Artificial Sequence
  Synthetic
gccacactaccatgtttactggagcaattcaatgtaaagtgggtcaacttgtctgaagacttaaaggagcaattt

SEQ ID NO: 230603 - DNA, 75 bp, Artificial Sequence
  Synthetic
aagatgaatcaacaaacctgattaagaaaccgtttttgcgatatcaagaactgcctcctgtccaggaggatgatg

SEQ ID NO: 230604 - DNA, 75 bp, Artificial Sequence
  Synthetic
aaattgttcatttcctgaattttcttcacataccagttcagtctcctctaatcaacaagtgaccaattcgaagta

SEQ ID NO: 230605 - DNA, 75 bp, Artificial Sequence
  Synthetic
aattcaatgtaaagtgggtcaacttgtctgaagacttaaaggagcaatttaagctatcttcagatctgggatcac

SEQ ID NO: 230606 - DNA, 75 bp, Artificial Sequence
  Synthetic
tcacataccagttcagtctcctctaatcaacaagtgaccaattcgaagtatattgtttatccagaaaatatcact

SEQ ID NO: 230607 - DNA, 75 bp, Artificial Sequence
  Synthetic
caatggactgcattcaaagggggccgataacgcagaattaaattatgtgagttgtgcccttgaccggaaaattgt

SEQ ID NO: 230608 - DNA, 75 bp, Artificial Sequence; identical to SEQ ID NO: 62886
  Synthetic

SEQ ID NO: 230609 - DNA, 75 bp, Artificial Sequence
  Synthetic
gataacgcagaattaaattatgtgagttgtgcccttgaccggaaaattgttcaaaagcatccatctgacaatcgc

SEQ ID NO: 230610 - DNA, 75 bp, Artificial Sequence
  Synthetic
ggggatggacaccaagatgccactctcagagcaaaatctagtcgaaaattgtcgaccatcagagggcatcagatt

SEQ ID NO: 230611 - DNA, 75 bp, Artificial Sequence
  Synthetic
caccgtatatagggtcacgaacagaagataaaattggttaccctcctttaagagtaaactgcccatcggcagccc

SEQ ID NO: 230612 - DNA, 75 bp, Artificial Sequence
  Synthetic
catgaccagagatgtgagagggaggaatcttcaccgcaacagatgttccctgaagataacatgcagactcctgcg

SEQ ID NO: 230613 - DNA, 75 bp, Artificial Sequence
  Synthetic
agataaaattggttaccctcctttaagagtaaactgcccatcggcagcccttaaagaagctattgaaatggtctc

SEQ ID NO: 230614 - DNA, 75 bp, Artificial Sequence; identical to SEQ ID NO: 62888
  Synthetic

SEQ ID NO: 230615 - DNA, 75 bp, Artificial Sequence
  Synthetic
accgcagatcgagaaaaattgctcattcctcttctcaattcaagagttaatttagactatcagacagtgctcaac

SEQ ID NO: 230616 - DNA, 75 bp, Artificial Sequence
  Synthetic
acatgaggactttgatgcctcgaagataatcttaaattctgaaataaataatcttaaccttacggagtatactct

SEQ ID NO: 230617 - DNA, 75 bp, Artificial Sequence
  Synthetic
ttcctcttctcaattcaagagttaatttagactatcagacagtgctcaacttcctgcccactcactactcaggca

SEQ ID NO: 230618 - DNA, 75 bp, Artificial Sequence
  Synthetic
ataatcttaaattctgaaataaataatcttaaccttacggagtatactcttaatacaaagttattgacaactcct

SEQ ID NO: 230619 - DNA, 75 bp, Artificial Sequence
  Synthetic
atatggacaacactcctttatggcaaatagaatgagcaatacatccactcgtgcaatcatatcaactaacacact

SEQ ID NO: 230620 - DNA, 75 bp, Artificial Sequence
  Synthetic
aatagaatgagcaatacatccactcgtgcaatcatatcaactaacacactagggaaatatgctggagggggtcaa

SEQ ID NO: 230621 - DNA, 75 bp, Artificial Sequence
  Synthetic
tacagcacgattacccacccatccacttcgatatgattcaccctcagatcacagcaatcaaccctatttgaatat

SEQ ID NO: 230622 - DNA, 75 bp, Artificial Sequence
  Synthetic
tccagaacactattaatttaggtgttgcagttttggacattacattgtctctttctaaattgtcatcaacatcaa

SEQ ID NO: 230623 - DNA, 75 bp, Artificial Sequence
  Synthetic
tgcagttttggacattacattgtctctttctaaattgtcatcaacatcaaatgtttctttccgtttaatgttaag

SEQ ID NO: 230624 - DNA, 75 bp, Artificial Sequence
  Synthetic
agcaatcaattctgtcggtttacaggggtagtctcatcaatgcattacaagctttatgatcttttgcctccaggt

SEQ ID NO: 230625 - DNA, 75 bp, Artificial Sequence
  Synthetic
tctgagtatttattctttgataaacctttagatgtggatttgaacaagtacatggacaacgagttagtttacgat

SEQ ID NO: 230626 - DNA, 75 bp, Artificial Sequence
  Synthetic
aattcttttttcaattgctataatgatacaactacaaatctccgtacacttgccgcaatactgtaattaacactg

SEQ ID NO: 230627 - DNA, 75 bp, Artificial Sequence
  Synthetic
ctttagatgtggatttgaacaagtacatggacaacgagttagtttacgataatgatcctctctgtagtggaataa

SEQ ID NO: 230628 - DNA, 75 bp, Artificial Sequence; identical to SEQ ID NO: 62894
  Synthetic

SEQ ID NO: 230629 - DNA, 75 bp, Artificial Sequence
  Synthetic
gttacttttgaagtggaaggaaacggattatttattcttcaacactttggctacggattcacaacaagaagccga

SEQ ID NO: 230630 - DNA, 75 bp, Artificial Sequence
  Synthetic
atcaacactctcattgagtctaaatgtaagcgatattggatcttacgactttccgactattgctgcgtggacttt

SEQ ID NO: 230631 - DNA, 75 bp, Artificial Sequence; identical to SEQ ID NO: 62898
  Synthetic

SEQ ID NO: 230632 - DNA, 75 bp, Artificial Sequence
  Synthetic
gtaagcgatattggatcttacgactttccgactattgctgcgtggactttaggagagacaattattggaagtatt

SEQ ID NO: 230633 - DNA, 75 bp, Artificial Sequence
  Synthetic
ttcagagaatatgctgaaaatgttattgattgaacttctcaaatggtgcactatcctactgttttactcaacttg

SEQ ID NO: 230634 - DNA, 75 bp, Artificial Sequence
  Synthetic
cagaccctataagttcaggctgtacaaaaacttttgtaacacactttcttgtgtatccagttgagagtatctttt

SEQ ID NO: 230635 - DNA, 75 bp, Artificial Sequence
  Synthetic
ctccacttttcttcttgtatattctctataagtcatttacttgatagaatgtcaagtctactggttcagagtctc

SEQ ID NO: 230636 - DNA, 75 bp, Artificial Sequence
  Synthetic
aaaaacttttgtaacacactttcttgtgtatccagttgagagtatcttttatgcctttggagctaatctaatagt

SEQ ID NO: 230637 - DNA, 75 bp, Artificial Sequence
  Synthetic
ctcactccaatgaatgtaataattaactgttagcttagatgacaacagttatgaggttatataattactcatggt

SEQ ID NO: 230638 - DNA, 75 bp, Artificial Sequence
  Synthetic
aattcaatcaagagcctctcagatttaacatttcttatatcatccacaatcagaaatttgtcacacagatcactt

SEQ ID NO: 230639 - DNA, 75 bp, Artificial Sequence
  Synthetic
taacatttcttatatcatccacaatcagaaatttgtcacacagatcacttcgaattcttcaatctactttccgac

SEQ ID NO: 230640 - DNA, 75 bp, Artificial Sequence
  Synthetic
tcatcatataccattgatttccttaatgctaggaggttctgcgggtgagaaaagttcgtcggatgctgtccgact

SEQ ID NO: 230641 - DNA, 75 bp, Artificial Sequence
  Synthetic
atgctaggaggttctgcgggtgagaaaagttcgtcggatgctgtccgactatttcttacggcaagttatcaaaat

SEQ ID NO: 230642 - DNA, 75 bp, Artificial Sequence
  Synthetic
gactcatcatatatgcaacaagtcagcgaagggttgatgactggaaaagttcccatagatcaggtgtttggtacc

SEQ ID NO: 230643 - DNA, 75 bp, Artificial Sequence
  Synthetic
tgagaaagaaccaatcaccattaccagtttggctttatttccctagtgaagggcaacaactaaaacctattttaa

SEQ ID NO: 230644 - DNA, 75 bp, Artificial Sequence
  Synthetic
agtttggctttatttccctagtgaagggcaacaactaaaacctattttaaaaattttgcaaaggttatcatgttt

SEQ ID NO: 230645 - DNA, 75 bp, Artificial Sequence
  Synthetic
cacagacctgtagctgatacttgttttttgactgataatttttgggtctatccaagcaaatcaacgagaactaat

SEQ ID NO: 230646 - DNA, 75 bp, Artificial Sequence
  Synthetic
ttgctcattaaggggaaagataactaaatattacaatgatatattaaagttaaatctagtcatcaaggcagtaga

SEQ ID NO: 230647 - DNA, 75 bp, Artificial Sequence
  Synthetic
gaaaacactagctgatctacttataccgataaataggcagatatcggacattcaaagtactctaagtgaagtaac

SEQ ID NO: 230648 - DNA, 75 bp, Artificial Sequence
  Synthetic
ttttgactgataatttttgggtctatccaagcaaatcaacgagaactaatcattattatgcaagtcttaattatt

SEQ ID NO: 230649 - DNA, 75 bp, Artificial Sequence
  Synthetic
caattacatgaaatcaccccagtcttgaaaatgggaaggacactggaagcaatctccaaggggatgtcagaaatg

SEQ ID NO: 230650 - DNA, 75 bp, Artificial Sequence
  Synthetic
gaatacttcattttcacatttgataaactattcattttctgaaccctctctacatgcgagctctatctcttctag

SEQ ID NO: 230651 - DNA, 75 bp, Artificial Sequence
  Synthetic
aaaaggtaaaaattggtcacaacttgttgagatccttcctaatatgcattcagtatgcatagtgcacgtggatca

SEQ ID NO: 230652 - DNA, 75 bp, Artificial Sequence
  Synthetic
aactattcattttctgaaccctctctacatgcgagctctatctcttctagtcaagaagtggtcaatttaaaacac

SEQ ID NO: 230653 - DNA, 75 bp, Artificial Sequence; identical to SEQ ID NO: 62916
  Synthetic

SEQ ID NO: 230654 - DNA, 75 bp, Artificial Sequence
  Synthetic
atttcaacagagagaacttcatttaattcacaaaaacaatctatttaagagtgagggttacattgtctaagatat

SEQ ID NO: 230655 - DNA, 75 bp, Artificial Sequence
  Synthetic
attcacaaaaacaatctatttaagagtgagggttacattgtctaagatattgtatgagaagtaataaaataaata

SEQ ID NO: 230656 - DNA, 75 bp, Artificial Sequence
  Synthetic
agggatgatcagaaaatattaagacatgatcagaaagctgagaggggtgaacctctttcattgcaagtgtcttct

SEQ ID NO: 230657 - DNA, 75 bp, Artificial Sequence
  Synthetic
atgatcagaaagctgagaggggtgaacctctttcattgcaagtgtcttctaggggttgcctgcaggctcttactt

SEQ ID NO: 230658 - DNA, 75 bp, Artificial Sequence
  Synthetic
atgaaaaagggccagtcatcactaccggtttggctttactttcctagtgaagggcaacaattaaaacctatatta

SEQ ID NO: 230659 - DNA, 75 bp, Artificial Sequence; identical to SEQ ID NO: 62919
  Synthetic

SEQ ID NO: 230660 - DNA, 75 bp, Artificial Sequence
  Synthetic
gggactacggttaaaaatgcaacaacagatgcagccgacaagatgtcgaaggtccttgaactcagtgaggaaacg

SEQ ID NO: 230661 - DNA, 75 bp, Artificial Sequence
  Synthetic
aaccaccacagaaccactaagcatgcttaggaattgtgacgccataaaagcagccttacgttctgagacgaatga

SEQ ID NO: 230662 - DNA, 75 bp, Artificial Sequence
  Synthetic
cttaggaattgtgacgccataaaagcagccttacgttctgagacgaatgatccccgtcttatgagcagtatcctt

SEQ ID NO: 230663 - DNA, 75 bp, Artificial Sequence
  Synthetic
aggtaactttttaacgttaattactcagatgttattgctcataattagcattaatattggcacattgggtgaatc

SEQ ID NO: 230664 - DNA, 75 bp, Artificial Sequence
  Synthetic
cagatgttattgctcataattagcattaatattggcacattgggtgaatccttgagctttatccctaatatggtg

SEQ ID NO: 230665 - DNA, 75 bp, Artificial Sequence
  Synthetic
ttaatattggcacattgggtgaatccttgagctttatccctaatatggtgtaagaaattaaggaaatactgagat

SEQ ID NO: 230666 - DNA, 75 bp, Artificial Sequence
  Synthetic
tgagaatagaatctcgaaacacgagtctattgcaaccttctgagtgtctgtcaacttctaagggaaaatctgtac

SEQ ID NO: 230667 - DNA, 75 bp, Artificial Sequence
  Synthetic
tctattgcaaccttctgagtgtctgtcaacttctaagggaaaatctgtactgtctagagaacaggcttcatacct

SEQ ID NO: 230668 - DNA, 75 bp, Artificial Sequence
  Synthetic
gtccctccaaatccaacaatcgacaaaggatgggtctgtgtttattcatctgagcaaggtgagacacgggctctt

SEQ ID NO: 230669 - DNA, 75 bp, Artificial Sequence
  Synthetic
taccatatatcataaatataaaaaagtgtctgctgtaatctacaagcacctcttttaaatacattaggaaaagaa

SEQ ID NO: 230670 - DNA, 75 bp, Artificial Sequence
  Synthetic
tctatttctctggattcaggttttcgaaatatgtctgatagaaatcaagtccaaatgctaataaatacttacaaa

SEQ ID NO: 230671 - DNA, 75 bp, Artificial Sequence
  Synthetic
ttaagttaccgttgagatcaaaaaaaccacgtcatgttttctctgatgacaagtgataaaacttcgtagttaaat

SEQ ID NO: 230672 - DNA, 75 bp, Artificial Sequence
  Synthetic
gaaatatgtctgatagaaatcaagtccaaatgctaataaatacttacaaacgtgacttatacacttgttttgata

SEQ ID NO: 230673 - DNA, 75 bp, Artificial Sequence
  Synthetic
ttgatacaaagacactaaacatttcaaaagcatgtatgtgggcaaaacgtaactagaccatcttgattgaagtag

SEQ ID NO: 230674 - DNA, 75 bp, Artificial Sequence
  Synthetic
attaagaaaaaccaatatataaaattaaaaaattaaaaagctttgatataagtaacacaaaacattcttcatctt

SEQ ID NO: 230675 - DNA, 75 bp, Artificial Sequence
  Synthetic
ggtcgtttcatcaatgcattataagctttatgatcttttgccagcaggcaaactcggaaaggcaatctgcctagc

SEQ ID NO: 230676 - DNA, 75 bp, Artificial Sequence
  Synthetic
ttttcacttcaagagagttaaatggtgatagatcaatctttgaaattacccatttatacattatagagaaactaa

SEQ ID NO: 230677 - DNA, 75 bp, Artificial Sequence
  Synthetic
ctttatgatcttttgccagcaggcaaactcggaaaggcaatctgcctagccgaaggggaagggagtggcgctcga

SEQ ID NO: 230678 - DNA, 75 bp, Artificial Sequence
  Synthetic
tgatagatcaatctttgaaattacccatttatacattatagagaaactaatattactaacaaaaggggtctacct

SEQ ID NO: 230679 - DNA, 75 bp, Artificial Sequence
  Synthetic
attatttattcttcaatactttggccacagattcacaacaggaagcagaaattttgagtggtcgagttattccaa

SEQ ID NO: 230680 - DNA, 75 bp, Artificial Sequence
  Synthetic
cacagattcacaacaggaagcagaaattttgagtggtcgagttattccaaggatgttgtataacatagataagct

SEQ ID NO: 230681 - DNA, 75 bp, Artificial Sequence
  Synthetic
tatcttataaaccaaacaattgacttcttactttttaagaatcaactaacagcatagaaaccacatttatcctta

SEQ ID NO: 230682 - DNA, 75 bp, Artificial Sequence
  Synthetic
ttaatcttgaataatctaactattcaaatcacggatattacaaacccactatggctggactctgtcatacaatac

SEQ ID NO: 230683 - DNA, 75 bp, Artificial Sequence
  Synthetic
cgtaatctttggcttagttggaattaacttttgttgtaattcaatacgtttagtcatagtatattgtaggatttt

SEQ ID NO: 230684 - DNA, 75 bp, Artificial Sequence
  Synthetic
aaatcacggatattacaaacccactatggctggactctgtcatacaatacctacctgaagatagtgacattctaa

SEQ ID NO: 230685 - DNA, 75 bp, Artificial Sequence
  Synthetic
agagacaagagagcaactctataaaactatcataaatatttgggcacgtacttctcctaatatccctaaaaccag

SEQ ID NO: 230686 - DNA, 75 bp, Artificial Sequence
  Synthetic
agaagatctttctctcgtagtgttcttttactggaagaagtattccaatcttaacttgttggatcagttgtcact

SEQ ID NO: 230687 - DNA, 75 bp, Artificial Sequence
  Synthetic
actatcataaatatttgggcacgtacttctcctaatatccctaaaaccagcatcattaaagtgtttttattagat

SEQ ID NO: 230688 - DNA, 75 bp, Artificial Sequence
  Synthetic
agaatgctattcaatattatggacaagttcaacttaagaaaccatatagttcaaatgcaaaaaattcagaatggt

SEQ ID NO: 230689 - DNA, 75 bp, Artificial Sequence
  Synthetic
agttcaacttaagaaaccatatagttcaaatgcaaaaaattcagaatggtacttatgttgtggaaaacgaagagt

SEQ ID NO: 230690 - DNA, 75 bp, Artificial Sequence
  Synthetic
gaccaagtaggaatattcttgatctgtaaagcaatgtcacgtcagaggcaagcaattccttactggctaaagcac

SEQ ID NO: 230691 - DNA, 75 bp, Artificial Sequence
  Synthetic
gtaaagcaatgtcacgtcagaggcaagcaattccttactggctaaagcacatagaaaagaattaccctgcttcat

SEQ ID NO: 230692 - DNA, 75 bp, Artificial Sequence
  Synthetic
cagggtataactccaaattatgtgggtgatttaaacctagatgaccagttcaaagggaatgtctgccatgctttc

SEQ ID NO: 230693 - DNA, 75 bp, Artificial Sequence
  Synthetic
caaagggaatgtctgccatgctttcactttagaggcaataattgacatatctgcgtataacgaacgaacagtcaa

SEQ ID NO: 230694 - DNA, 75 bp, Artificial Sequence
  Synthetic
ttttccttctttagagtcatctttctgccatcgctacaccattccgttcactgagggaacggctctctttcacaa

SEQ ID NO: 230695 - DNA, 75 bp, Artificial Sequence
  Synthetic
aggcgttccggcatggctgcctcttgggatcatgagcaatttcgaatatcctttagcccatacagtggctgcgtt

SEQ ID NO: 230696 - DNA, 75 bp, Artificial Sequence
  Synthetic
tgccatcgctacaccattccgttcactgagggaacggctctctttcacaaggtccagtcttatgtccgacaaggt

SEQ ID NO: 230697 - DNA, 75 bp, Artificial Sequence
  Synthetic
tagattacgaaaataattcacccctcctagatctgagaaatcacttcatatgctcattgaggggaaagataacca

SEQ ID NO: 230698 - DNA, 75 bp, Artificial Sequence
  Synthetic
cctagatctgagaaatcacttcatatgctcattgaggggaaagataaccaagtattacaatgacatattgaaatt

SEQ ID NO: 230699 - DNA, 75 bp, Artificial Sequence
  Synthetic
atgttgcgtgaaggaaatcaagcttttattcagaatatggtgatccccaggaatttttccaccaatcaattcacc

SEQ ID NO: 230700 - DNA, 75 bp, Artificial Sequence
  Synthetic
agagggaaaaattggtcgcaactcgttgagtcccttcctaatatgcactcagtatgcataacacatgttgatcac

SEQ ID NO: 230701 - DNA, 75 bp, Artificial Sequence
  Synthetic
ctggcgtccgtccaaggacaaattaattggaaacaccatgcatcctgcagtctccgttcacccgaatttaccgcc

SEQ ID NO: 230702 - DNA, 75 bp, Artificial Sequence
  Synthetic
gaatgtattggctgtgagagacggttattacttaaattggactttgtcagaaatacaaagatagcagaacaaaag

SEQ ID NO: 230703 - DNA, 75 bp, Artificial Sequence
  Synthetic
aaatacaaagatagcagaacaaaagttactcaatagggtaattgggtatattctattcttcccttttggtttctc

SEQ ID NO: 230704 - DNA, 75 bp, Artificial Sequence
  Synthetic
tattgttctaccaacagtcaagaagcaggcttatcgccagcacaaaaatcccaacaatggtccactgctggccat

SEQ ID NO: 230705 - DNA, 75 bp, Artificial Sequence
  Synthetic
ttactcaatagggtaattgggtatattctattcttcccttttggtttctccagacccaagtgactacagatatat

SEQ ID NO: 230706 - DNA, 75 bp, Artificial Sequence
  Synthetic
ttaaatctgaatcattaagagcataacttttacaaagagaacttcatttaatctacagaaataatctatttaaaa

SEQ ID NO: 230707 - DNA, 75 bp, Artificial Sequence
  Synthetic
actcacagaaataatctacttcaaaacaaggatcacccattttggaacattgtataagaaactgcaagacaaata

SEQ ID NO: 230708 - DNA, 75 bp, Artificial Sequence
  Synthetic
acaaggatcacccattttggaacattgtataagaaactgcaagacaaataataaggaaaggatactactgtataa

SEQ ID NO: 230709 - DNA, 75 bp, Artificial Sequence
  Synthetic
gtcattttaagcatgatgcaaataaaaaatcgtctacatagccgaactgaccgctcagtacttattcacaatcat

SEQ ID NO: 230710 - DNA, 75 bp, Artificial Sequence
  Synthetic
aaaatcgtctacatagccgaactgaccgctcagtacttattcacaatcatgctaacttttagtttttaattgtgc

SEQ ID NO: 230711 - DNA, 75 bp, Artificial Sequence
  Synthetic
aacaacagacaagttgtactagcgtatgcgaatccaacactcagcgccgtttaaaatgatgctcaaataaaacag

SEQ ID NO: 230712 - DNA, 75 bp, Artificial Sequence
  Synthetic
tgatattaaaacattaaatggacatttgagttttatgcctagaataatataaagaaatttaagagacatttagat

SEQ ID NO: 230713 - DNA, 75 bp, Artificial Sequence
  Synthetic
cttaaatgggtatttgtcagattcttaagagattagtttgtattgatttaaataatgctttaaccttacattgct

SEQ ID NO: 230714 - DNA, 75 bp, Artificial Sequence
  Synthetic
ttgagttttatgcctagaataatataaagaaatttaagagacatttagatatatcagttgaattgatttatgaca

SEQ ID NO: 230715 - DNA, 75 bp, Artificial Sequence
  Synthetic
taagagattagtttgtattgatttaaataatgctttaaccttacattgctgctttaaatggttgattaagctgat

SEQ ID NO: 230716 - DNA, 75 bp, Artificial Sequence
  Synthetic
caaatattattgctcataattggtattaatattggcacattgggtgagtccttgagctttatccttaatataatg

SEQ ID NO: 230717 - DNA, 75 bp, Artificial Sequence
  Synthetic
aaaaattgttgcaattcaggaatatcttatttaaatgtattagagagaaagtcagattattatcaaaatcaagca

SEQ ID NO: 230718 - DNA, 75 bp, Artificial Sequence
  Synthetic
gggccatcagatctgtaatgggtttactagattatatacaagacacagtaatattttataaacaattcttgctca

SEQ ID NO: 230719 - DNA, 75 bp, Artificial Sequence
  Synthetic
atattttataaacaattcttgctcagttttgctttgatttaataacatacatcattgtgcctttcattgctaggt

SEQ ID NO: 230720 - DNA, 75 bp, Artificial Sequence
  Synthetic
cttatttaaatgtattagagagaaagtcagattattatcaaaatcaagcaaaatacaataggttttttcaaagaa

SEQ ID NO: 230721 - DNA, 75 bp, Artificial Sequence
  Synthetic
ttttaaagatgtcaatgtgaatttttattaagaaaaagtaatgcatgaaattaaaaaattaaagaactttgatat

SEQ ID NO: 230722 - DNA, 75 bp, Artificial Sequence
  Synthetic
tattaagaaaaagtaatgcatgaaattaaaaaattaaagaactttgatataagtaacacaaaacactcttcatct

SEQ ID NO: 230723 - DNA, 75 bp, Artificial Sequence
  Synthetic
ggaaattatcctaacatgaaaaccacatgtctccttatcagtcttatcttaatccaaggggtaaaaactctccct

SEQ ID NO: 230724 - DNA, 75 bp, Artificial Sequence
  Synthetic
catgtctccttatcagtcttatcttaatccaaggggtaaaaactctccctattttagagatagccagtaacattc

SEQ ID NO: 230725 - DNA, 75 bp, Artificial Sequence
  Synthetic
ctccgggactctccagaagacagaagacgttcatctgatgggattcacactgagcgggcaaaaagttgctgattc

SEQ ID NO: 230726 - DNA, 75 bp, Artificial Sequence
  Synthetic
tgagcgggcaaaaagttgctgattcccctttagaggcatccaaacgatgggccttcagggcaggtgtacctccca

SEQ ID NO: 230727 - DNA, 75 bp, Artificial Sequence
  Synthetic
acggaacaaattcagatatggccagttccagcaatcacaatacgtatatgcaatacctgaaccctcccccccatg

SEQ ID NO: 230728 - DNA, 75 bp, Artificial Sequence
  Synthetic
actatccatcatattcaaggtcaaaaccctcatgcacaggggatcgctctccatttgtggggagcatttttcttg

SEQ ID NO: 230729 - DNA, 75 bp, Artificial Sequence
  Synthetic
gtatcgaaaaggctttaagacaagtaacagtacatcaagaacaggggatcgtcacataccctaatcactggctta

SEQ ID NO: 230730 - DNA, 75 bp, Artificial Sequence
  Synthetic
tcacatgaacctaacttctactaataaatattggacaagtagcaacggaacgcaaacgaatgacactggatgctt

SEQ ID NO: 230731 - DNA, 75 bp, Artificial Sequence
  Synthetic
acaaagaaccaaacatgtgctccgtccaaaaaacctttaccactgcccacagcccatccggaggtcaagctcact

SEQ ID NO: 230732 - DNA, 75 bp, Artificial Sequence
  Synthetic
tcacatagaaatcaattttgggaaaattccagtagtgcgtctcttcatgtcacttctccgaacccaagaccacaa

SEQ ID NO: 230733 - DNA, 75 bp, Artificial Sequence
  Synthetic
tcaggggtgacactacatcctttggtgcggacctccaaagtaaaaaatgaagttgctagtttcaagcaggcgttg

SEQ ID NO: 230734 - DNA, 75 bp, Artificial Sequence
  Synthetic
caatcccaacacacaaagcatggccactgaaaatgagaaaaccagtgcccccccgaaaacaaccctgcctccaac

SEQ ID NO: 230735 - DNA, 75 bp, Artificial Sequence
  Synthetic
tcaataccacagacccaaacagtgatgatgaggacctcacaacatctggctcagggtctggagaacaggaacctt

SEQ ID NO: 230736 - DNA, 75 bp, Artificial Sequence
  Synthetic
ggtcaatcctccacccccatattaaagatatactgctcagaaactcctagcttgcaacccaatcccggaaaaaca

SEQ ID NO: 230737 - DNA, 75 bp, Artificial Sequence
  Synthetic
agatatactgctcagaaactcctagcttgcaacccaatcccggaaaaacaaacctcctcccttgatcacaaccac

SEQ ID NO: 230738 - DNA, 75 bp, Artificial Sequence
  Synthetic
tattactaacaaaaggggtctacctaacaggtatgattgagtgatcagtatattttataaaccaagcaattgact

SEQ ID NO: 230739 - DNA, 75 bp, Artificial Sequence
  Synthetic
cccactccctcaccacaaccaagcacgccacagcaaggaggaaacaacacgaaccattcccaaggtgttgtgact

SEQ ID NO: 230740 - DNA, 75 bp, Artificial Sequence
  Synthetic
cacaaccgtccatgccccctcacaacactactacaatctctactaacaacacctccaagcacaacctcagcactc

SEQ ID NO: 230741 - DNA, 75 bp, Artificial Sequence
  Synthetic
cactactacaatctctactaacaacacctccaagcacaacctcagcactccctctgtaccaatacaaaatgccac

SEQ ID NO: 230742 - DNA, 75 bp, Artificial Sequence
  Synthetic
cctgaaaatgagcaaaccagtgccccctcgaaaacaaccctgcttccaacagaaaatcctacaacagcaaagagc

SEQ ID NO: 230743 - DNA, 75 bp, Artificial Sequence
  Synthetic
cctcgaaaacaaccctgcttccaacagaaaatcctacaacagcaaagagcaccaatagtacaaaaagccccacta

SEQ ID NO: 230744 - DNA, 75 bp, Artificial Sequence
  Synthetic
gtgtgcaaaagcttcctgatgatgcctggcgcccatccaaggacaaattaattgggaacaccatgcatcccgcag

SEQ ID NO: 230745 - DNA, 75 bp, Artificial Sequence
  Synthetic
gtattccaccagtccctcccccacccccaactcgactgcacaacatcttgtatatttcagaaggaaacgaaatat

SEQ ID NO: 230746 - DNA, 75 bp, Artificial Sequence
  Synthetic
gtcacagtcgtttttgaatgaccctacacctgtggaagtaacggttcaagccaggcccataaatcgaccaactgc

SEQ ID NO: 230747 - DNA, 75 bp, Artificial Sequence
  Synthetic
cccaactcgactgcacaacatcttgtatatttcagaaggaaacgaaatattctctggagggaaggcgacatgttc

SEQ ID NO: 230748 - DNA, 75 bp, Artificial Sequence
  Synthetic
tgtacttattaaattttacataggattatataattctcttcgatacacatcatatctttaacaaagtaacgaaaa

SEQ ID NO: 230749 - DNA, 75 bp, Artificial Sequence
  Synthetic
acttgtcactattgtgtgagacaacataagctatcaaataacaatcacgggcaagaactgggcacatgatggtga

SEQ ID NO: 230750 - DNA, 75 bp, Artificial Sequence
  Synthetic
ctccgattgattttgatccggttccaaatacaaagacaatctttgatgaatcctctagttctggtgcttcagctg

SEQ ID NO: 230751 - DNA, 75 bp, Artificial Sequence
  Synthetic
tcctctagttctggtgcttcagctgaggaagatcagcatgcctcccctaatatcagtttaactttatcttacttt

SEQ ID NO: 230752 - DNA, 75 bp, Artificial Sequence
  Synthetic
aatgaggacgaagacactcttgacgacagtgtcatgatcccgagcacaacatcgagagaatttcaagggattcca

SEQ ID NO: 230753 - DNA, 75 bp, Artificial Sequence
  Synthetic
tcagggtccggagaacaggaaccccacacaacttccgatgcagtcactaagcaagggttttcatcaacaatgcca

SEQ ID NO: 230754 - DNA, 75 bp, Artificial Sequence
  Synthetic
tggcagtattggtgatgtaaatggtgatatcttagaacccataagatcaccttcttcaccatctgctcctcagga

SEQ ID NO: 230755 - DNA, 75 bp, Artificial Sequence
  Synthetic
ttggggtctgggtggtaaatggtggacatcagactggggtgttcttactaacttgggcatcttgctactactgtc

SEQ ID NO: 230756 - DNA, 75 bp, Artificial Sequence
  Synthetic
aggactttcctttatcctaatgatcttctgcagacaaatcctccagaatcacttataacagccctcgtagaggaa

SEQ ID NO: 230757 - DNA, 75 bp, Artificial Sequence
  Synthetic
tgtatttgtcgtatttttactaaatatattggataacattaagtgtgcaatgatgagaactttaagataattgct

SEQ ID NO: 230758 - DNA, 75 bp, Artificial Sequence
  Synthetic
atattggataacattaagtgtgcaatgatgagaactttaagataattgctactgagcccttcttctgatctactg

SEQ ID NO: 230759 - DNA, 75 bp, Artificial Sequence
  Synthetic
tttgagagcgctgcctagtgctacaaattcttcttttaattaccataatgatacaactataaacctccgtacatt

SEQ ID NO: 230760 - DNA, 75 bp, Artificial Sequence
  Synthetic
agctccaagcagattggcccgacatgtcatttgatgaaaggagacatgttgctatgaacttgtagtccagataac

SEQ ID NO: 230761 - DNA, 75 bp, Artificial Sequence
  Synthetic
agctgataacttaatgtgaatcaacagtttacgtattatcgattattatggtttgagattcaactgttatcatcg

SEQ ID NO: 230762 - DNA, 75 bp, Artificial Sequence
  Synthetic
agtttacgtattatcgattattatggtttgagattcaactgttatcatcgtcaagagtgacctttcctatttgat

SEQ ID NO: 230763 - DNA, 75 bp, Artificial Sequence
  Synthetic
aaacctttgtggatggtctcaatatgcgcgtaagggttaatttaaagagatttcttgttgcatagtttttcgtgt

SEQ ID NO: 230764 - DNA, 75 bp, Artificial Sequence
  Synthetic
gcgcgtaagggttaatttaaagagatttcttgttgcatagtttttcgtgttactgatttaggcttgaagacatag

SEQ ID NO: 230765 - DNA, 75 bp, Artificial Sequence
  Synthetic
tacaactacgaacctccatacatttgccgcaatactgtaatcaacactgctgtatctctccttcaagccatctga

SEQ ID NO: 230766 - DNA, 75 bp, Artificial Sequence
  Synthetic
agtcaactccatttcctctcaggggagacgtgctgtccaaagagtcttaatccataatcaaccattgcaagaatt

SEQ ID NO: 230767 - DNA, 75 bp, Artificial Sequence
  Synthetic
tccgataaagataaattcaacacaagtcctatcgcaaaatacttgcgtgatgcgggctatgagtttgatgtcatc

SEQ ID NO: 230768 - DNA, 75 bp, Artificial Sequence
  Synthetic
agacgtgctgtccaaagagtcttaatccataatcaaccattgcaagaattaatttactttttccgttatacttat

SEQ ID NO: 230769 - DNA, 75 bp, Artificial Sequence
  Synthetic
cattattaacaacttgccttacttcaatcttttggatgcaaatcataaggaaagatgagccactttccctctacc

SEQ ID NO: 230770 - DNA, 75 bp, Artificial Sequence
  Synthetic
aatcttttggatgcaaatcataaggaaagatgagccactttccctctaccctaagctaaggaaatttctcttatc

SEQ ID NO: 230771 - DNA, 75 bp, Artificial Sequence
  Synthetic
acgggccattcataatctgtttgagcgtgaatattgatcaaataaccaaatgatgttgcatttgtatagacgcaa

SEQ ID NO: 230772 - DNA, 75 bp, Artificial Sequence
  Synthetic
aatcttttggatgcaaaccataaggaaaaatgagccactttccctctactctgagctaaggaaatttctcttatc

SEQ ID NO: 230773 - DNA, 75 bp, Artificial Sequence
  Synthetic
atagaacacagatagttgacaaaattttactttgataaattttgcgaggaattataaaaatcttgaaggataatt

SEQ ID NO: 230774 - DNA, 75 bp, Artificial Sequence
  Synthetic
ttaagtgttctttgttagaattattcatccaagttgtttttgagtatattcgcttcaatacaactcctctttata

SEQ ID NO: 230775 - DNA, 75 bp, Artificial Sequence
  Synthetic
tcttctttctttttgcaaacatattgaaataataattttcacaatgtgggactcatcatatatgcaacaagtcag

SEQ ID NO: 230776 - DNA, 75 bp, Artificial Sequence
  Synthetic
aacctcgtggaaggagtcgaacccgtaaccaccaagccacaccgtctatatatcatgaaactcaattgccctcca

SEQ ID NO: 230777 - DNA, 75 bp, Artificial Sequence
  Synthetic
acgtgcaagatctatgagctcaacccgtagtagtgcagaaagcagtcccaccaatcacattccccgtgctcgacc

SEQ ID NO: 230778 - DNA, 75 bp, Artificial Sequence
  Synthetic
ccccctcctcccccaaaggacatgtgcaggaatatgaaaattggattgccgtgcactgatcctacttgtaatagg

SEQ ID NO: 230779 - DNA, 75 bp, Artificial Sequence
  Synthetic
gagagcatcgaccaaccaggatccgacaatgaacaaggagttgatcttccacctcctccattgtacgctcaggaa

SEQ ID NO: 230780 - DNA, 75 bp, Artificial Sequence
  Synthetic
gatcatgaccttgataatctaacaaatcgtgaacttttgctattgatggcccgaaaaatgctccccaatacggat

SEQ ID NO: 230781 - DNA, 75 bp, Artificial Sequence
  Synthetic
tttttagtttcaactcttattgcgagatttgaacacaattctactaactgcaataagtgaccccgaattcaagtt

SEQ ID NO: 230782 - DNA, 75 bp, Artificial Sequence
  Synthetic
ccacagatcagaaattgggaaattggatgagacatcacttcgtgcagcattaagtttgacgtgtgctggaattcg

SEQ ID NO: 230783 - DNA, 75 bp, Artificial Sequence
  Synthetic
aaagacgaatagatccttgatcaacaccatgacagaattacacattaatcacgaaaatctcccgcaagaccaaaa

SEQ ID NO: 230784 - DNA, 75 bp, Artificial Sequence
  Synthetic
acagcacggttacctacttatctactttgatccgattcgtcctcagatcacagcaatcaaatttatttaaatatt

SEQ ID NO: 230785 - DNA, 75 bp, Artificial Sequence
  Synthetic
gatcagtgtgcaagcctcatacgatcattttattcttcctcaaagtcaaggcaaaggacaatgattattgttcga

SEQ ID NO: 230786 - DNA, 75 bp, Artificial Sequence
  Synthetic
gccgcaatactgtaatcaacactgctgtatctcttcttcaagccatctgatttaacttaataaacatgacttgat

SEQ ID NO: 230787 - DNA, 75 bp, Artificial Sequence
  Synthetic
attataaaaatctcgaaggacaaactattgtaaaacagagtcgaagaacattaagtgttctttgttgaaactatt

SEQ ID NO: 230788 - DNA, 75 bp, Artificial Sequence
  Synthetic
cattttattcttcctcaaagtcaaggcaaaggacaatgattattgttcgaagattgacaatttgatcactttcag

SEQ ID NO: 230789 - DNA, 75 bp, Artificial Sequence
  Synthetic
gatttggacacgatcttactaacttcaataactgaccccaaattcaagtttactaaaggctaagatgaaaataat

SEQ ID NO: 230790 - DNA, 75 bp, Artificial Sequence
  Synthetic
cactagtttgttgtaaattactcgatcaaaatgttcttaagctatcttcaacttaatgatgcaactctgtttcat

SEQ ID NO: 230791 - DNA, 75 bp, Artificial Sequence
  Synthetic
actagaccatcttaatagaagtagtaatttatttctgtcttaagtgtgattttcaccttgaaagagttaaatggt

SEQ ID NO: 230792 - DNA, 75 bp, Artificial Sequence
  Synthetic
cttgtacctctaaggaaaaccatgaagaacattaagaaaaaggatgttctgattcttcaactgaacttgtatatc

SEQ ID NO: 230793 - DNA, 75 bp, Artificial Sequence
  Synthetic
cttctgttttctctttcctttgtaatatgccaattaagaaaaactaaaaatcgaagaatattaaagattttcttt

SEQ ID NO: 230794 - DNA, 75 bp, Artificial Sequence
  Synthetic
tatgccaattaagaaaaactaaaaatcgaagaatattaaagattttctttaatattcagaaaaggttttttattc

SEQ ID NO: 230795 - DNA, 75 bp, Artificial Sequence
  Synthetic
ttttatatattatagaggaactaatattactaacaaaaggggtctacctaacaggtatgactgagtgatcagtat

SEQ ID NO: 230796 - DNA, 75 bp, Artificial Sequence
  Synthetic
ctgttgacgctagatcacggatcaagcatatttcaatcaaacatcctaaattttcaatcgtacacataataacca

SEQ ID NO: 230797 - DNA, 75 bp, Artificial Sequence
  Synthetic
ctcactttttaagaatcaactaacaacatagaaaacatatttatccttgtgtaattctcggcttagttggaatta

SEQ ID NO: 230798 - DNA, 75 bp, Artificial Sequence
  Synthetic
ttttggtagcattgctttgcagtataggataggtggtcgtgaaaagacttccaagcatggcagaactatcaacgc

SEQ ID NO: 230799 - DNA, 75 bp, Artificial Sequence
  Synthetic
cccatagatcaagtgtttggtgccaatcccttagagaagttatacaagagaaggaaaccaaaaggcacagttgga

SEQ ID NO: 230800 - DNA, 75 bp, Artificial Sequence
  Synthetic
gtaattctcggcttagttggaattaacttttgttgcaattcaagacgcttattcatagtagattatatgattttt

SEQ ID NO: 230801 - DNA, 75 bp, Artificial Sequence
  Synthetic
aacccagtgttgggggctggacagtgaagtggggaaactttgttttccacataccaaatactggaatgacattgt

SEQ ID NO: 230802 - DNA, 75 bp, Artificial Sequence
  Synthetic
tttactggaaggagtatcccaatctcagcttgttgaattaattgttacttaagtcattctttttaaaattaattc

SEQ ID NO: 230803 - DNA, 75 bp, Artificial Sequence
  Synthetic
tgcatcatttaaagtctaattttgttgttccagagtggcaacaaacaaggaatctattctcccatctcttcaaaa

SEQ ID NO: 230804 - DNA, 75 bp, Artificial Sequence
  Synthetic
aaccttgttgtggtgagacaatcctttcagagtcagttgtttttggactagtggctgaggcagttctaagagaac

SEQ ID NO: 230805 - DNA, 75 bp, Artificial Sequence
  Synthetic
taggtctattgttcatatgctttcggaatggttgctcctggaggtcacgtcggcaatccacattagtcccaatct

SEQ ID NO: 230806 - DNA, 75 bp, Artificial Sequence
  Synthetic
agggtataactccaaattatgtgggtgacttaaacctagatgatcagttcaaagggaatgtctgccatgctttca

SEQ ID NO: 230807 - DNA, 75 bp, Artificial Sequence
  Synthetic
gagcaaggtgagacacgggccctgaaaatctaattctcactgttaatagttgcaaggagagtgatctttccaagt

SEQ ID NO: 230808 - DNA, 75 bp, Artificial Sequence
  Synthetic
aaatctaattctcactgttaatagttgcaaggagagtgatctttccaagttgatacaaagacactaaacatttca

SEQ ID NO: 230809 - DNA, 75 bp, Artificial Sequence
  Synthetic
aaccctgttgtggtgagacagtcctttcagaatcagttgtttttgggctagtggctgaggcagttctaagagaac

SEQ ID NO: 230810 - DNA, 75 bp, Artificial Sequence
  Synthetic
tctcaatctgacacaatacatgaacagcaaaattgctatataagtggcttaaactagcatgagtatttccaggtc

SEQ ID NO: 230811 - DNA, 75 bp, Artificial Sequence
  Synthetic
agtacattatagttgattatcctgtataataaaggatatacttaccctgatttatatttactggtataaaatagt

SEQ ID NO: 230812 - DNA, 75 bp, Artificial Sequence
  Synthetic
ataataaaggatatacttaccctgatttatatttactggtataaaatagtagcatcatcttatcaactagttgtc

SEQ ID NO: 230813 - DNA, 75 bp, Artificial Sequence
  Synthetic
ctcactttttaagaatcaactaacaacatagaaaacatatttatctttgtgtgatcctcggcttagttggaatta

SEQ ID NO: 230814 - DNA, 75 bp, Artificial Sequence
  Synthetic
gatggtgaaagtataagcttgtagagttaccatgagtcacaactgttgtatattgtccaaaatatatcttgtgca

SEQ ID NO: 230815 - DNA, 75 bp, Artificial Sequence
  Synthetic
tacccacaaaagatactgttttaattaagaaaaactatgaagaacattaagaagatctttctctcgtagtgttct

SEQ ID NO: 230816 - DNA, 75 bp, Artificial Sequence
  Synthetic
gttaccatgagtcacaactgttgtatattgtccaaaatatatcttgtgcaagtagtgtgtgcttgaatatgctga

SEQ ID NO: 230817 - DNA, 75 bp, Artificial Sequence
  Synthetic
acacaaggtagtttaaatttgtatctagaacaaattttaatatggccagttccagcaattacaatacatacatgc

SEQ ID NO: 230818 - DNA, 75 bp, Artificial Sequence
  Synthetic
ttaagaaaaatcaatgatggatattaaatgtccatcaagcaggtgtcgtaaaatattaggggtttcaaatgctgc

SEQ ID NO: 230819 - DNA, 75 bp, Artificial Sequence
  Synthetic
tccagcaattacaatacatacatgcaatacttgaatccccctccttatgctgatcacggtgcaaaccagttaatc

SEQ ID NO: 230820 - DNA, 75 bp, Artificial Sequence
  Synthetic
gagaacttccctttgaatggcttcaacaacagacaagttgtactagcgtatgcgaatccaacgctcagtgccgtt

SEQ ID NO: 230821 - DNA, 75 bp, Artificial Sequence
  Synthetic
cagacttactaaattttacataggattatataattctcttcgatatacgttatatctttagcaaagtaatgaaaa

SEQ ID NO: 230822 - DNA, 75 bp, Artificial Sequence
  Synthetic
cattcaatatgatgcaattaatcatgttgatgattttaaatacctattgccatctgagctagtcaagtatgcaaa

SEQ ID NO: 230823 - DNA, 75 bp, Artificial Sequence
  Synthetic
gttgatgattttaaatacctattgccatctgagctagtcaagtatgcaaattgggacaacgagttcttaaaggca

SEQ ID NO: 230824 - DNA, 75 bp, Artificial Sequence
  Synthetic
acttgccaggaggataaaaggacaaagagggtcattaagaagtaactggaagtttataggaacagatttggagct

SEQ ID NO: 230825 - DNA, 75 bp, Artificial Sequence
  Synthetic
ttttagagatagctagtaacaatcaaccccaaaatgtggattcggtatgctccggaactctccagaagacagaag

SEQ ID NO: 230826 - DNA, 75 bp, Artificial Sequence
  Synthetic
atgtgctaggtgagttatacaaccaaggagatcaaattattgccatgtacctggaggacggcttcaaattgatta

SEQ ID NO: 230827 - DNA, 75 bp, Artificial Sequence
  Synthetic
tatggctagattctgtaatacaatatttacccgaagatagtgacattcttacaatggacgcagagaccactaagg

SEQ ID NO: 230828 - DNA, 75 bp, Artificial Sequence
  Synthetic
acaccaagaaaatactggttccaatcacagatgatcaagtcatattatgatgaactctgttgtctcaatttgaag

SEQ ID NO: 230829 - DNA, 75 bp, Artificial Sequence
  Synthetic
atccgtgactatcctaaatgcaaaactatccatcatattcaaggtcaaaaccctcatgcacaagggatcgccctc

SEQ ID NO: 230830 - DNA, 75 bp, Artificial Sequence
  Synthetic
tacaaaagcattggggtcatcccgttctatacaatgatgttgcactagataaggtcaaaaaacatgcacaatcta

SEQ ID NO: 230831 - DNA, 75 bp, Artificial Sequence
  Synthetic
gcaccccaactgatgccaccacactcaacaccacagacccaaacaatgatgatgaggacctcataacatccggtt

SEQ ID NO: 230832 - DNA, 75 bp, Artificial Sequence
  Synthetic
caacaccacagacccaaacaatgatgatgaggacctcataacatccggttcagggtccggagaacaggaacccta

SEQ ID NO: 230833 - DNA, 75 bp, Artificial Sequence
  Synthetic
caagggctttcatcaacaatgccacccactccctcaccacaaccaagcacgccacagcaagaaggaaacaacaca

SEQ ID NO: 230834 - DNA, 75 bp, Artificial Sequence
  Synthetic
ggcgctcttcaagaatacaactccacgaagaatcaaacatgtgctccgtccaaaataccttcaccactgcccaca

SEQ ID NO: 230835 - DNA, 75 bp, Artificial Sequence
  Synthetic
cgaagaatcaaacatgtgctccgtccaaaataccttcaccactgcccacaacccgtccagagaacaaacccacaa

SEQ ID NO: 230836 - DNA, 75 bp, Artificial Sequence
  Synthetic
tagtcttgtcatgttagacgccagttatccatcttaagtgaatcctttcttcaatatgcagcatccaactcaata

SEQ ID NO: 230837 - DNA, 75 bp, Artificial Sequence
  Synthetic
gctgtgaaccaggagtgttgggacagtgtcttcgatagaagtgtattaggatataaccctcctgttagatttcag

SEQ ID NO: 230838 - DNA, 75 bp, Artificial Sequence
  Synthetic
caacaccacagatccaaatagtgatgatgaggacctcacaacatccggttcagggtccggagaacaggaacccca

SEQ ID NO: 230839 - DNA, 75 bp, Artificial Sequence
  Synthetic
actgttagcttagatgacaacagttatgaggttatataattactcatggtgtaaaatgcaattcctacctccatt

SEQ ID NO: 230840 - DNA, 75 bp, Artificial Sequence
  Synthetic
atatgccaattaagaaaaactaaaaatcgaagaatattaaagatcctcctcaacattcagaaaaggcttttcact

SEQ ID NO: 230841 - DNA, 75 bp, Artificial Sequence
  Synthetic
atcgaagaatattaaagatcctcctcaacattcagaaaaggcttttcactcccctccctccccccacaaatatgc

SEQ ID NO: 230842 - DNA, 75 bp, Artificial Sequence
  Synthetic
aaaagagttgaatataggaagaacttttgggaaattaccgtatcgtgtcagaaatgtccaaacactcgcagaagc

SEQ ID NO: 230843 - DNA, 75 bp, Artificial Sequence
  Synthetic
ccaacccgaccacacaacatcttgtatatttcagaaagaaacgaagtatcctctggagggaaggcgacatgtttc

SEQ ID NO: 230844 - DNA, 75 bp, Artificial Sequence
  Synthetic
tttgggaaattaccgtatcgtgtcagaaatgtccaaacactcgcagaagccttgctggctgatggattagcaaaa

SEQ ID NO: 230845 - DNA, 75 bp, Artificial Sequence
  Synthetic
tcactgagagggaacagaaagaagcattactgcatcaggcttcttggcaccataattcagcaagcataggggaaa

SEQ ID NO: 230846 - DNA, 75 bp, Artificial Sequence
  Synthetic
ggaaatcttaccacagcaaagagcaccaacaacacgaaaggccccaccacaacggcaccaaatatgacaaatggg

SEQ ID NO: 230847 - DNA, 75 bp, Artificial Sequence
  Synthetic
ggcatttcatagactactgtaatcgatgttatggtgtgaagaatttattcgattggatgcactttttaataccac

SEQ ID NO: 230848 - DNA, 75 bp, Artificial Sequence
  Synthetic
cctatctaataatataccttatactggactagtgccaatattaaaatgaagtgggcgtagtgtgtaatttgattg

SEQ ID NO: 230849 - DNA, 75 bp, Artificial Sequence
  Synthetic
ggactagtgccaatattaaaatgaagtgggcgtagtgtgtaatttgattgggtggaggtgtggctttggcgtgct

SEQ ID NO: 230850 - DNA, 75 bp, Artificial Sequence
  Synthetic
gtgggcgtagtgtgtaatttgattgggtggaggtgtggctttggcgtgcttgtaagtttgggcggatgaggaagt

SEQ ID NO: 230851 - DNA, 75 bp, Artificial Sequence
  Synthetic
gccggatgtgacgttttagacgccattttacacggaaatgatgttttttgggcgttgtttgtgcaaattttgtgt

SEQ ID NO: 230852 - DNA, 75 bp, Artificial Sequence
  Synthetic
ttttacacggaaatgatgttttttgggcgttgtttgtgcaaattttgtgttttaggcgcgaaaactgaaatgcgg

SEQ ID NO: 230853 - DNA, 75 bp, Artificial Sequence
  Synthetic
tattataggcgcggaatatttaccgagggcagagtgaactctgagcctctacgtgtgggtttcgatacgtgagcg

SEQ ID NO: 230854 - DNA, 75 bp, Artificial Sequence
  Synthetic
agggcagagtgaactctgagcctctacgtgtgggtttcgatacgtgagcgacggggaaactccacgttggcgctc

SEQ ID NO: 230855 - DNA, 75 bp, Artificial Sequence
  Synthetic
gctgatcgtttgggtatttaatgccgccgtgttcgtcaagaggccactcttgagtgccagcgagaagagttttct

SEQ ID NO: 230856 - DNA, 75 bp, Artificial Sequence
  Synthetic
gccgtgttcgtcaagaggccactcttgagtgccagcgagaagagttttctctgccagctcattttcacggcgcca

SEQ ID NO: 230857 - DNA, 75 bp, Artificial Sequence
  Synthetic
ggtcctgtcgtatcaggaagctgacgacatattggagcatttggtggacaacttttttaacgaggtacccagtga

SEQ ID NO: 230858 - DNA, 75 bp, Artificial Sequence
  Synthetic
gacatattggagcatttggtggacaacttttttaacgaggtacccagtgatgatgatctttatgttccgtctctt

SEQ ID NO: 230859 - DNA, 75 bp, Artificial Sequence
  Synthetic
agtctgccggtgaagataataatgaacaggcggtgaatgagttttttcccgaatcgcttattttagctgccagtg

SEQ ID NO: 230860 - DNA, 75 bp, Artificial Sequence
  Synthetic
acaggcggtgaatgagttttttcccgaatcgcttattttagctgccagtgaggggttgtttttaccggagcctcc

SEQ ID NO: 230861 - DNA, 75 bp, Artificial Sequence
  Synthetic
attgggggcgaatgtatgccacaactgcaccctgaagatatggatttattgtgctacgagatgggctttccctgt

SEQ ID NO: 230862 - DNA, 75 bp, Artificial Sequence
  Synthetic
tgcaccctgaagatatggatttattgtgctacgagatgggctttccctgtagcgattcggaagacgagcaagacg

SEQ ID NO: 230863 - DNA, 75 bp, Artificial Sequence
  Synthetic
atccgcagctgctgctgccgctgatagggaacgtgaggagtttcagttagaccatccagagttgcccggacacaa

SEQ ID NO: 230864 - DNA, 75 bp, Artificial Sequence
  Synthetic
agggaacgtgaggagtttcagttagaccatccagagttgcccggacacaattgtaagtcctgtgagcaccaccgg

SEQ ID NO: 230865 - DNA, 75 bp, Artificial Sequence
  Synthetic
tgtgctctttgtgctatctgcgagcctacaacatgttcatttacagtaagtgtgctatgggaggtgggaggtgat

SEQ ID NO: 230866 - DNA, 75 bp, Artificial Sequence
  Synthetic
ctacaacatgttcatttacagtaagtgtgctatgggaggtgggaggtgatttttttttcttaagcagtgaaaaat

SEQ ID NO: 230867 - DNA, 75 bp, Artificial Sequence
  Synthetic
tttccgataatgagcctgaacctaatagcactttggatggcgatgagcgaccctcacccccgaaactaggaagtg

SEQ ID NO: 230868 - DNA, 75 bp, Artificial Sequence
  Synthetic
tagcactttggatggcgatgagcgaccctcacccccgaaactaggaagtgcggttccagaaggagtaataaaacc

SEQ ID NO: 230869 - DNA, 75 bp, Artificial Sequence
  Synthetic
cgtagatgtgctgtggaaagcattttggatttgattcaagaggaagaaagagaacaaacagtgcctgttgatctg

SEQ ID NO: 230870 - DNA, 75 bp, Artificial Sequence
  Synthetic
tggatttgattcaagaggaagaaagagaacaaacagtgcctgttgatctgtcagtgaaacgccctagatgtaatt

SEQ ID NO: 230871 - DNA, 75 bp, Artificial Sequence
  Synthetic
aaaataggggtaatgtggtttttgtgagtcatgtataataaaactggtttcggttgaagtgtcttgttaatgttt

SEQ ID NO: 230872 - DNA, 75 bp, Artificial Sequence
  Synthetic
gagtcatgtataataaaactggtttcggttgaagtgtcttgttaatgtttgtttgggcgtggttaaacagggata

SEQ ID NO: 230873 - DNA, 75 bp, Artificial Sequence
  Synthetic
atagttcatcttagtaatggagttggaaactgtgctgcaaagttttcagagcgttcgccagctcttgcagtatac

SEQ ID NO: 230874 - DNA, 75 bp, Artificial Sequence
  Synthetic
gaaactgtgctgcaaagttttcagagcgttcgccagctcttgcagtatacctctaaaaacacttcaggtttttgg

SEQ ID NO: 230875 - DNA, 75 bp, Artificial Sequence
  Synthetic
gcaaggtggtaaatagggtgaaagaagactatagagaggaatttgaaaacatattggccgactgtccagggcttt

SEQ ID NO: 230876 - DNA, 75 bp, Artificial Sequence
  Synthetic
agactatagagaggaatttgaaaacatattggccgactgtccagggcttttggcttcactagacctttgttacca

SEQ ID NO: 230877 - DNA, 75 bp, Artificial Sequence
  Synthetic
agatccttagatttttcatctgtgggacgaacggttgcttctattgcttttttggcaaccatattggataaatgg

SEQ ID NO: 230878 - DNA, 75 bp, Artificial Sequence
  Synthetic
gacgaacggttgcttctattgcttttttggcaaccatattggataaatggagcgagaaatcccacctgagttggg

SEQ ID NO: 230879 - DNA, 75 bp, Artificial Sequence
  Synthetic
gcagctgtggagggcatggctgaagaggagggtttgcatttactcgctggcgcggcctttgaccatgccgccgct

SEQ ID NO: 230880 - DNA, 75 bp, Artificial Sequence
  Synthetic
aggagggtttgcatttactcgctggcgcggcctttgaccatgccgccgctgccgacgttgcaagaggagaaggag

SEQ ID NO: 230881 - DNA, 75 bp, Artificial Sequence
  Synthetic
agaagtaaacatggaacaacaggtgcaagaaggccatgtacttgactctggcgaagggcctagttgcgcagatga

SEQ ID NO: 230882 - DNA, 75 bp, Artificial Sequence
  Synthetic
caagaaggccatgtacttgactctggcgaagggcctagttgcgcagatgatagagataagcaggaaaaaaaagaa

SEQ ID NO: 230883 - DNA, 75 bp, Artificial Sequence
  Synthetic
gtaggctaactgttaatctgatgtcccgcccgcgtttggaaactgtatattggcaggagttgcaggatgaatttc

SEQ ID NO: 230884 - DNA, 75 bp, Artificial Sequence
  Synthetic
ccgcccgcgtttggaaactgtatattggcaggagttgcaggatgaatttcagcggggtgatatgcatttacagta

SEQ ID NO: 230885 - DNA, 75 bp, Artificial Sequence
  Synthetic
acccactggttagagccatgggaggatatggagtgtgctattaaagcttttgctaaattggccttacgtcctgat

SEQ ID NO: 230886 - DNA, 75 bp, Artificial Sequence
  Synthetic
atatggagtgtgctattaaagcttttgctaaattggccttacgtcctgattgtagctacagaattactaaaacag

SEQ ID NO: 230887 - DNA, 75 bp, Artificial Sequence
  Synthetic
tataggtaacggggcaatagttgaggtagatacaagcgacagagttgcttttagatgtcgaatgcagggtatggg

SEQ ID NO: 230888 - DNA, 75 bp, Artificial Sequence
  Synthetic
gtagatacaagcgacagagttgcttttagatgtcgaatgcagggtatgggcccaggggtggtgggtttggatgga

SEQ ID NO: 230889 - DNA, 75 bp, Artificial Sequence
  Synthetic
ctggagataagtttaaaggcattatgttcgaagctaatacctgtcttgtcttgcatggtgtttactttcttaact

SEQ ID NO: 230890 - DNA, 75 bp, Artificial Sequence
  Synthetic
gttcgaagctaatacctgtcttgtcttgcatggtgtttactttcttaactttagtaacatttgtgtagagtcttg

SEQ ID NO: 230891 - DNA, 75 bp, Artificial Sequence
  Synthetic
actttttatggatgttggaagggtttggtgggtagaccaaaaagtaaactgtctgtaaaaaagtgtttgtttgaa

SEQ ID NO: 230892 - DNA, 75 bp, Artificial Sequence
  Synthetic
tggtgggtagaccaaaaagtaaactgtctgtaaaaaagtgtttgtttgaaaaatgtgtacttgctttaattgtag

SEQ ID NO: 230893 - DNA, 75 bp, Artificial Sequence
  Synthetic
tgcagcttcagaaaatgcctgttttgtattattgaagggaatggctattttaaagcataatatggtttgtggggt

SEQ ID NO: 230894 - DNA, 75 bp, Artificial Sequence
  Synthetic
gtattattgaagggaatggctattttaaagcataatatggtttgtggggtgtctgatcaaactatgcgacgtttt

SEQ ID NO: 230895 - DNA, 75 bp, Artificial Sequence
  Synthetic
ataccttaaaaactgttcatattgtgagccacagtagacattgttggcctgtatgtgatcataacatgtttatgc

SEQ ID NO: 230896 - DNA, 75 bp, Artificial Sequence
  Synthetic
gagccacagtagacattgttggcctgtatgtgatcataacatgtttatgcgctgtaccatacatttaggcttaag

SEQ ID NO: 230897 - DNA, 75 bp, Artificial Sequence
  Synthetic
tgtaacttcagccactcaaacattatgctggaacctgaagtgttttctagagtgtgtttaaatggggtatttgat

SEQ ID NO: 230898 - DNA, 75 bp, Artificial Sequence
  Synthetic
tgctggaacctgaagtgttttctagagtgtgtttaaatggggtatttgatttatctgtggaattatgtaaggtta

SEQ ID NO: 230899 - DNA, 75 bp, Artificial Sequence
  Synthetic
tcgttgccgacagtgtgagtgtggtagcagtcatctagaacttcgtcccattgtgctaaatgtaactgaggagct

SEQ ID NO: 230900 - DNA, 75 bp, Artificial Sequence
  Synthetic
agcagtcatctagaacttcgtcccattgtgctaaatgtaactgaggagctgagaagtgaccaccttaccctgtct

SEQ ID NO: 230901 - DNA, 75 bp, Artificial Sequence
  Synthetic
gtgatgaagacgacaactgaggtaagtgggtggagctaggtgggattataaaaggctggaagtcaactaaaaatt

SEQ ID NO: 230902 - DNA, 75 bp, Artificial Sequence
  Synthetic
gtgggtggagctaggtgggattataaaaggctggaagtcaactaaaaattgtttttgttcttttaacagcacgat

SEQ ID NO: 230903 - DNA, 75 bp, Artificial Sequence
  Synthetic
gcgctttttgatggaggggtttttagcccttatttgacttccaggttaccatattgggccggagtacgtcagaat

SEQ ID NO: 230904 - DNA, 75 bp, Artificial Sequence
  Synthetic
gcccttatttgacttccaggttaccatattgggccggagtacgtcagaatgtggtaggatctacagtggacggtc

SEQ ID NO: 230905 - DNA, 75 bp, Artificial Sequence
  Synthetic
aacattaacctatgcaactattggaccctcgcctttggataccgccgccgccgctgcagcttccgcggccgcttc

SEQ ID NO: 230906 - DNA, 75 bp, Artificial Sequence
  Synthetic
ccctcgcctttggataccgccgccgccgctgcagcttccgcggccgcttctacggctcgcagtatggcagctgat

SEQ ID NO: 230907 - DNA, 75 bp, Artificial Sequence
  Synthetic
cgaatgctgtgacacgcaccgcagttcgagaggacattctgactgttatgcttgccaagcttgaaactctaactg

SEQ ID NO: 230908 - DNA, 75 bp, Artificial Sequence
  Synthetic
tcgagaggacattctgactgttatgcttgccaagcttgaaactctaactgctcagctggaagagctatcgcaaaa

SEQ ID NO: 230909 - DNA, 75 bp, Artificial Sequence
  Synthetic
acccataccccagcccaacctgtaacccaataaagaaaaaacttaaattgagatggtgttatgaatctttattga

SEQ ID NO: 230910 - DNA, 75 bp, Artificial Sequence
  Synthetic
cccaataaagaaaaaacttaaattgagatggtgttatgaatctttattgatacttgttttttctgacatggtaag

SEQ ID NO: 230911 - DNA, 75 bp, Artificial Sequence
  Synthetic
aagaacacggtgaatgtgttccagtattttgtaaagatgagcctgtatattaaggtacattggcattaggccatc

SEQ ID NO: 230912 - DNA, 75 bp, Artificial Sequence
  Synthetic
attttgtaaagatgagcctgtatattaaggtacattggcattaggccatctttgggatgaaggtaggaccattga

SEQ ID NO: 230913 - DNA, 75 bp, Artificial Sequence
  Synthetic
tgtagataatccagtcatagcaacaacgctgggcatggtgattaaatatatcttttaacaacaagctaattgcta

SEQ ID NO: 230914 - DNA, 75 bp, Artificial Sequence
  Synthetic
acgctgggcatggtgattaaatatatcttttaacaacaagctaattgctaatggaagacctttagtataggtatt

SEQ ID NO: 230915 - DNA, 75 bp, Artificial Sequence
  Synthetic
tgcatccgaggtgacatgatatgaagttttgattgtattttgagattggcaatgttacctgccaaatctcttctt

SEQ ID NO: 230916 - DNA, 75 bp, Artificial Sequence
  Synthetic
gttttgattgtattttgagattggcaatgttacctgccaaatctcttcttggattcatattgtggagaaccacga

SEQ ID NO: 230917 - DNA, 75 bp, Artificial Sequence
  Synthetic
aaatttgtcatggagtttagaaggaaaggcatggaaaaacttggaaacgcctttgtgacttcccaaattttccat

SEQ ID NO: 230918 - DNA, 75 bp, Artificial Sequence
  Synthetic
aaggcatggaaaaacttggaaacgcctttgtgacttcccaaattttccatacactcatccattattatggcaatt

SEQ ID NO: 230919 - DNA, 75 bp, Artificial Sequence
  Synthetic
aaatgttttctggatcagaaacatcatagttgtggtctagagttaggtcatcgtaggacaacttaacaaatttag

SEQ ID NO: 230920 - DNA, 75 bp, Artificial Sequence
  Synthetic
atagttgtggtctagagttaggtcatcgtaggacaacttaacaaatttaggacacagcgttccagattgtggaat

SEQ ID NO: 230921 - DNA, 75 bp, Artificial Sequence
  Synthetic
taatttccctcacaaatttgcatttcccaagatttaatttcagatgggggaatcatgtccacttgcggaacaata

SEQ ID NO: 230922 - DNA, 75 bp, Artificial Sequence
  Synthetic
cccaagatttaatttcagatgggggaatcatgtccacttgcggaacaataaaaaaaacagtttctggagcaggtg

SEQ ID NO: 230923 - DNA, 75 bp, Artificial Sequence
  Synthetic
acgcaacaactgagacttcccacagccagtgggtccataaattaccccaattacaggttgcaagtgatagtttaa

SEQ ID NO: 230924 - DNA, 75 bp, Artificial Sequence
  Synthetic
ccagtgggtccataaattaccccaattacaggttgcaagtgatagtttaacgaggtgcagctgccgtcttcgtgg

SEQ ID NO: 230925 - DNA, 75 bp, Artificial Sequence
  Synthetic
tttgtcggacgcggatgttttgcttggccagttcccctaacagacgctctccgcctaaggaaagtaactcttgta

SEQ ID NO: 230926 - DNA, 75 bp, Artificial Sequence
  Synthetic
ggccagttcccctaacagacgctctccgcctaaggaaagtaactcttgtaaagatttgaaatttttaagtggctt

SEQ ID NO: 230927 - DNA, 75 bp, Artificial Sequence
  Synthetic
tccagggtttgcttcagcagttgcaagcgatcccatagctcagttatattttctatgccatctcgatccagcaaa

SEQ ID NO: 230928 - DNA, 75 bp, Artificial Sequence
  Synthetic
agcgatcccatagctcagttatattttctatgccatctcgatccagcaaacttcctcgttgcgggggtttggctg

SEQ ID NO: 230929 - DNA, 75 bp, Artificial Sequence
  Synthetic
tgagcatccaaatggacgagggttttgtccttccagggacgtaatgtgcgcgtcagggttgtttcggtcacggtg

SEQ ID NO: 230930 - DNA, 75 bp, Artificial Sequence
  Synthetic
tgtccttccagggacgtaatgtgcgcgtcagggttgtttcggtcacggtgaatggatgcgctcctggttgagcgc

SEQ ID NO: 230931 - DNA, 75 bp, Artificial Sequence
  Synthetic
gcggctggtgctgaagcgcgtgtcttctccctgtgcttcggcaaggtagcattttaacataagatcataagacaa

SEQ ID NO: 230932 - DNA, 75 bp, Artificial Sequence
  Synthetic
tctccctgtgcttcggcaaggtagcattttaacataagatcataagacaaagcctctgtagcgtggcctttagcc

SEQ ID NO: 230933 - DNA, 75 bp, Artificial Sequence
  Synthetic
cgcagtgaggacactgaaggcatttaagggcgtacagttttggagccaaaaaaacagattctggagaataagcat

SEQ ID NO: 230934 - DNA, 75 bp, Artificial Sequence
  Synthetic
aaaacagattctggagaataagcatctgcgccacaataactacaaacagtttcacattcaactgaccaggtcagc

SEQ ID NO: 230935 - DNA, 75 bp, Artificial Sequence
  Synthetic
gtttccctccgtactttttgatgcgtttcttaccttgcgactccataaggcggcgtcctttctctgtgacaaaaa

SEQ ID NO: 230936 - DNA, 75 bp, Artificial Sequence
  Synthetic
tttcttaccttgcgactccataaggcggcgtcctttctctgtgacaaaaagactgtcagtgtctccgtatacaga

SEQ ID NO: 230937 - DNA, 75 bp, Artificial Sequence
  Synthetic
attccgcggtcctcctcgtacaggaattctgaccactctgacacaaaagctctagtccaagcaagtacaaaggaa

SEQ ID NO: 230938 - DNA, 75 bp, Artificial Sequence
  Synthetic
attctgaccactctgacacaaaagctctagtccaagcaagtacaaaggaagccacatgggaagggtaccgatcgt

SEQ ID NO: 230939 - DNA, 75 bp, Artificial Sequence
  Synthetic
taaggtgtgtaaacacatgtctccttcttcagcgtccatgaatgtgattggtttgtaggtgtaagtcacgtgttc

SEQ ID NO: 230940 - DNA, 75 bp, Artificial Sequence
  Synthetic
tcttcagcgtccatgaatgtgattggtttgtaggtgtaagtcacgtgttcacaattttctggtggtgggctataa

SEQ ID NO: 230941 - DNA, 75 bp, Artificial Sequence
  Synthetic
cgctttcttctgcttcgctgtttacgagcgccaactggttgggtgagtacacgcgctcaaaggcaggcattacct

SEQ ID NO: 230942 - DNA, 75 bp, Artificial Sequence
  Synthetic
gagcgccaactggttgggtgagtacacgcgctcaaaggcaggcattacctctgtactcaacgtgtcagtttctat

SEQ ID NO: 230943 - DNA, 75 bp, Artificial Sequence
  Synthetic
cgccccgctgcaatttctttcattaggctttcttccatttgatcagaaaaaactatttttttgttatctagtttg

SEQ ID NO: 230944 - DNA, 75 bp, Artificial Sequence
  Synthetic
ggctttcttccatttgatcagaaaaaactatttttttgttatctagtttggtagcaaaagatccgtacaaggcat

SEQ ID NO: 230945 - DNA, 75 bp, Artificial Sequence
  Synthetic
tagggtttgatttttgtccctatcggcccgttcttttgcggcaatattgagttgcacatattcgcgtgccaggca

SEQ ID NO: 230946 - DNA, 75 bp, Artificial Sequence
  Synthetic
gcccgttcttttgcggcaatattgagttgcacatattcgcgtgccaggcatttccaggtggggaaaatggtggtg

SEQ ID NO: 230947 - DNA, 75 bp, Artificial Sequence
  Synthetic
gccacccgcgattatgcagtgtaaccagatctacgctggtaactacttcaccgcgcaagctttcattggtccagg

SEQ ID NO: 230948 - DNA, 75 bp, Artificial Sequence
  Synthetic
cagatctacgctggtaactacttcaccgcgcaagctttcattggtccaggctaaacgaccgccttttctagaaca

SEQ ID NO: 230949 - DNA, 75 bp, Artificial Sequence
  Synthetic
ttttcatctggggggtcggcatctatagtaaaaatgccaggacaaagatttttgtcaaaataatcaattttgcaa

SEQ ID NO: 230950 - DNA, 75 bp, Artificial Sequence
  Synthetic
tagtaaaaatgccaggacaaagatttttgtcaaaataatcaattttgcaagtgtaattttccagcgccacctgcc

SEQ ID NO: 230951 - DNA, 75 bp, Artificial Sequence
  Synthetic
ataggggttaaggggaggaccccaaggcatggggtgtgtgagggccgatgcatacatgccgcaaatatcatatac

SEQ ID NO: 230952 - DNA, 75 bp, Artificial Sequence
  Synthetic
ggcatggggtgtgtgagggccgatgcatacatgccgcaaatatcatatacatatatgggctcttttagtactcct

SEQ ID NO: 230953 - DNA, 75 bp, Artificial Sequence
  Synthetic
cacgaatgctggcgcgaacgtagtcatatagctcatgtgaaggcgccaggatgttgggcccaagatgtgtgcgct

SEQ ID NO: 230954 - DNA, 75 bp, Artificial Sequence
  Synthetic
atatagctcatgtgaaggcgccaggatgttgggcccaagatgtgtgcgctgtggtttttcggcgcggtacaaaat

SEQ ID NO: 230955 - DNA, 75 bp, Artificial Sequence
  Synthetic
gaggaaatggtaggacgctgaaacacattaaaatgtgccgcgtcaagacccactgcgtcagtaacaaactgggcg

SEQ ID NO: 230956 - DNA, 75 bp, Artificial Sequence
  Synthetic
cattaaaatgtgccgcgtcaagacccactgcgtcagtaacaaactgggcgtatgagctacgcagtttttctacca

SEQ ID NO: 230957 - DNA, 75 bp, Artificial Sequence
  Synthetic
ggcacaatagtttaatgtttccccgataagattgtaatttttttctcctttttttttccatagttcttgatttag

SEQ ID NO: 230958 - DNA, 75 bp, Artificial Sequence
  Synthetic
ataagattgtaatttttttctcctttttttttccatagttcttgatttaggaggtattcctccttatccttccag

SEQ ID NO: 230959 - DNA, 75 bp, Artificial Sequence
  Synthetic
catctgcacggtaagaaccaagcatataaaactgatttaccgccttgtacggacaacatcctttttctacaggca

SEQ ID NO: 230960 - DNA, 75 bp, Artificial Sequence
  Synthetic
ataaaactgatttaccgccttgtacggacaacatcctttttctacaggcagggcatacgcttgtgcagcctttct

SEQ ID NO: 230961 - DNA, 75 bp, Artificial Sequence
  Synthetic
gtatctctgaccattacttttaaatactggtatttaaaatcttggtcgtcacaccctccgtgttcccacagtagg

SEQ ID NO: 230962 - DNA, 75 bp, Artificial Sequence
  Synthetic
actggtatttaaaatcttggtcgtcacaccctccgtgttcccacagtaggaagttagttcgctttttgtagtggg

SEQ ID NO: 230963 - DNA, 75 bp, Artificial Sequence
  Synthetic
attaaataatattttgccagctcttggaataaaatttctagaaattttaaagggtccagggacgtccaagcggtt

SEQ ID NO: 230964 - DNA, 75 bp, Artificial Sequence
  Synthetic
ggaataaaatttctagaaattttaaagggtccagggacgtccaagcggttattgattacctgagcggcaagaaca

SEQ ID NO: 230965 - DNA, 75 bp, Artificial Sequence
  Synthetic
gtcctactatatacaactctacaaatcttggctcacccttaattgcaggggctcttttaagatcttcgtaggaaa

SEQ ID NO: 230966 - DNA, 75 bp, Artificial Sequence
  Synthetic
tcttggctcacccttaattgcaggggctcttttaagatcttcgtaggaaagatcttcaagcgcgactagtccgtt

SEQ ID NO: 230967 - DNA, 75 bp, Artificial Sequence
  Synthetic
tgtggatttttttgtaaaaaagtcatccaaagatcagtagctaaggaggtttgtaagcggtttctataggtacga

SEQ ID NO: 230968 - DNA, 75 bp, Artificial Sequence
  Synthetic
tccaaagatcagtagctaaggaggtttgtaagcggtttctataggtacgaaactgttgaccgaccttcatttttt

SEQ ID NO: 230969 - DNA, 75 bp, Artificial Sequence
  Synthetic
agagtctttttcccattggtcccatccaagttctaatgcaagttgtaaggcatgtttgacaagattgtcatcccc

SEQ ID NO: 230970 - DNA, 75 bp, Artificial Sequence
  Synthetic
ccaagttctaatgcaagttgtaaggcatgtttgacaagattgtcatccccagacagtttcatcaccagcataaat

SEQ ID NO: 230971 - DNA, 75 bp, Artificial Sequence
  Synthetic
ccatccaggtgtaggtttctacatcataggtaataaaaaggcgctcagtgcgaggatgcgaaccgattgggaaaa

SEQ ID NO: 230972 - DNA, 75 bp, Artificial Sequence
  Synthetic
ataggtaataaaaaggcgctcagtgcgaggatgcgaaccgattgggaaaaagtggatctcctgccaccagttgga

SEQ ID NO: 230973 - DNA, 75 bp, Artificial Sequence
  Synthetic
tagaaatctcgtcggcggacagagcattcatgctgatgtttgtaaaagcgtgcgcagtgttcgcatcgttgcacg

SEQ ID NO: 230974 - DNA, 75 bp, Artificial Sequence
  Synthetic
attcatgctgatgtttgtaaaagcgtgcgcagtgttcgcatcgttgcacgggctgtatctgttgaatgaggtgta

SEQ ID NO: 230975 - DNA, 75 bp, Artificial Sequence
  Synthetic
gatgggaaaatcaataccacttggcagctgccgttcgtcctcttcctcttctgctgcattgccactaccgtttgg

SEQ ID NO: 230976 - DNA, 75 bp, Artificial Sequence
  Synthetic
agctgccgttcgtcctcttcctcttctgctgcattgccactaccgtttggatcctcgaaagcgagaacggagagg

SEQ ID NO: 230977 - DNA, 75 bp, Artificial Sequence
  Synthetic
tccagatttcagcacgagaggggcggaaacgggaaatcagggcgtacagcctggagctgtccatggtatcagtca

SEQ ID NO: 230978 - DNA, 75 bp, Artificial Sequence
  Synthetic
gaaacgggaaatcagggcgtacagcctggagctgtccatggtatcagtcagagagaaaagcatgtccgcggggac

SEQ ID NO: 230979 - DNA, 75 bp, Artificial Sequence
  Synthetic
cgggtaagagcaggctggaggtgcaggtaatacttaatttctagaggcgtgccgttggcagagtctattgcgtga

SEQ ID NO: 230980 - DNA, 75 bp, Artificial Sequence
  Synthetic
ggtaatacttaatttctagaggcgtgccgttggcagagtctattgcgtgaagtattccatgagcccggggactaa

SEQ ID NO: 230981 - DNA, 75 bp, Artificial Sequence
  Synthetic
aatgcgcctgcttaaaatcggcggcgcggacgagctcccggaggaagcggcggttcgggtcctgcgggaagcggg

SEQ ID NO: 230982 - DNA, 75 bp, Artificial Sequence
  Synthetic
gcggacgagctcccggaggaagcggcggttcgggtcctgcgggaagcgggggaagcggtatgtcggcctgacgct

SEQ ID NO: 230983 - DNA, 75 bp, Artificial Sequence
  Synthetic
aagttgactggcatgggcgactacccggcgattgatatcttgaatctgtcggcgttgtgtaaacactaccggccc

SEQ ID NO: 230984 - DNA, 75 bp, Artificial Sequence
  Synthetic
cggcgattgatatcttgaatctgtcggcgttgtgtaaacactaccggccctgttgttttgaacctgaaagaaagt

SEQ ID NO: 230985 - DNA, 75 bp, Artificial Sequence
  Synthetic
ttactgcagcctgtcttaaaatctcctgaacgtcgcctgagttatcttggtaggcaatttctgccattaattgat

SEQ ID NO: 230986 - DNA, 75 bp, Artificial Sequence
  Synthetic
ctgaacgtcgcctgagttatcttggtaggcaatttctgccattaattgatcaatttcttcctcctggaggtctcc

SEQ ID NO: 230987 - DNA, 75 bp, Artificial Sequence
  Synthetic
gcaaggtcattagatatccgactcataagctgtgaaaatgcgtttagtccaatttcgttccagactcggctgtat

SEQ ID NO: 230988 - DNA, 75 bp, Artificial Sequence
  Synthetic
taagctgtgaaaatgcgtttagtccaatttcgttccagactcggctgtatactacccctccttcgctgtcccgag

SEQ ID NO: 230989 - DNA, 75 bp, Artificial Sequence
  Synthetic
gagttccacgagccgtgcgaacacgccgtagttgcgcaagcgctgaaacaggtagtttaaggtggtggcaacgtg

SEQ ID NO: 230990 - DNA, 75 bp, Artificial Sequence
  Synthetic
ccgtagttgcgcaagcgctgaaacaggtagtttaaggtggtggcaacgtgttctgagacgaagaaatacagaatc

SEQ ID NO: 230991 - DNA, 75 bp, Artificial Sequence
  Synthetic
tgtcacctaaggcttcaagacgttccatggcttcgtaaaagtctactgcaaaattgaaaaactgggagttgcgag

SEQ ID NO: 230992 - DNA, 75 bp, Artificial Sequence
  Synthetic
catggcttcgtaaaagtctactgcaaaattgaaaaactgggagttgcgagctgccaccgtcaattcttcttccaa

SEQ ID NO: 230993 - DNA, 75 bp, Artificial Sequence
  Synthetic
tcgcgcacttcttgctgaaatgcgcccggaactatttcttgttcttcctcttctacctccattatttcttcctcg

SEQ ID NO: 230994 - DNA, 75 bp, Artificial Sequence
  Synthetic
ccggaactatttcttgttcttcctcttctacctccattatttcttcctcgaccacaggtggtgggggttgtcttc

SEQ ID NO: 230995 - DNA, 75 bp, Artificial Sequence
  Synthetic
gtctacaaatctttcaatcatttcgccgcgacggcggcgcatagtttcggttactgctcgaccgttttcacgtgg

SEQ ID NO: 230996 - DNA, 75 bp, Artificial Sequence
  Synthetic
ccgcgacggcggcgcatagtttcggttactgctcgaccgttttcacgtggtcgtaactcaaaaactccacctcta

SEQ ID NO: 230997 - DNA, 75 bp, Artificial Sequence
  Synthetic
atgaggcgttgcgaggggcgttaggtagggatacagcgctgattatgcattttattatttgctgcgtaggaactc

SEQ ID NO: 230998 - DNA, 75 bp, Artificial Sequence
  Synthetic
tagggatacagcgctgattatgcattttattatttgctgcgtaggaactccgcgcaaggagctaagcgtctgcat

SEQ ID NO: 230999 - DNA, 75 bp, Artificial Sequence
  Synthetic
agaaaggcatctagccagtcacagtcacaaggtaggctaagttttgtttcttctaaagtaccaggaagctgagca

SEQ ID NO: 231000 - DNA, 75 bp, Artificial Sequence
  Synthetic
cacaaggtaggctaagttttgtttcttctaaagtaccaggaagctgagcaatgctactaataatgtaattgaagt

SEQ ID NO: 231001 - DNA, 75 bp, Artificial Sequence
  Synthetic
tttaagaagcaccacatctttgggtccggcttgttgaattcgcaggcggtctgccattccccacacgtcactttg

SEQ ID NO: 231002 - DNA, 75 bp, Artificial Sequence
  Synthetic
ccggcttgttgaattcgcaggcggtctgccattccccacacgtcactttgacatcgtccaagatctttgtagtag

SEQ ID NO: 231003 - DNA, 75 bp, Artificial Sequence
  Synthetic
cctcgcggtttccgcgatcagccatgtgcgtgcttccgtagccttgcagcggttgtaataaagctaaatctgcca

SEQ ID NO: 231004 - DNA, 75 bp, Artificial Sequence
  Synthetic
gtgcgtgcttccgtagccttgcagcggttgtaataaagctaaatctgccactacccgttccgcaagcactgcctg

SEQ ID NO: 231005 - DNA, 75 bp, Artificial Sequence
  Synthetic
aagtcatccacatctacaaagcggtgataagctcctgcattaatggtgtagctgcagtttgtcattactgaccaa

SEQ ID NO: 231006 - DNA, 75 bp, Artificial Sequence
  Synthetic
gataagctcctgcattaatggtgtagctgcagtttgtcattactgaccaattaacagtttgcgtgcctggctgta

SEQ ID NO: 231007 - DNA, 75 bp, Artificial Sequence
  Synthetic
gtaagcccgagagtcaaaaacatagtcattgcaggtgcgcactaggtattgatagcccacaaggaaatgaggagg

SEQ ID NO: 231008 - DNA, 75 bp, Artificial Sequence
  Synthetic
tcattgcaggtgcgcactaggtattgatagcccacaaggaaatgaggaggaggttcgcgatacaacggccagcca

SEQ ID NO: 231009 - DNA, 75 bp, Artificial Sequence
  Synthetic
gatcttccaacatgaggcggtggtattcatatatgtatctggacatccatgtgatgccggcagcggtagttgttg

SEQ ID NO: 231010 - DNA, 75 bp, Artificial Sequence
  Synthetic
ccaaatattgcgcaggggtaaaaagcgttcaatagttgccacgctttgaccggtcaggcgtgcgcagtcttgaat

SEQ ID NO: 231011 - DNA, 75 bp, Artificial Sequence
  Synthetic
ttggtggaaaagtcacaagggtaccatagcgaggaaccccggttcgaaaccggcaggatccgctatgagcacaag

SEQ ID NO: 231012 - DNA, 75 bp, Artificial Sequence
  Synthetic
ccaaggacccccagacacggagaggagtctttttttatttattttttcttagatgcatcctgtcctgcgacaaat

SEQ ID NO: 231013 - DNA, 75 bp, Artificial Sequence
  Synthetic
agtctttttttatttattttttcttagatgcatcctgtcctgcgacaaatgcgacctcagcccagggcaaccacg

SEQ ID NO: 231014 - DNA, 75 bp, Artificial Sequence
  Synthetic
gctctggcgaacaggaagagcctcaatgtcctacattggagttggaagaaggagaaggcatagcccgattgggcg

SEQ ID NO: 231015 - DNA, 75 bp, Artificial Sequence
  Synthetic
atgtcctacattggagttggaagaaggagaaggcatagcccgattgggcgcccactctcctgagcgtcacccaag

SEQ ID NO: 231016 - DNA, 75 bp, Artificial Sequence
  Synthetic
gtggcatttgtgcctcgtcagaacatgtttcgcgacaacagcggggaggaagctgaggaaatgcgagactgcagg

SEQ ID NO: 231017 - DNA, 75 bp, Artificial Sequence
  Synthetic
tgtttcgcgacaacagcggggaggaagctgaggaaatgcgagactgcaggtttagggccggtcgcgagctgcgcc

SEQ ID NO: 231018 - DNA, 75 bp, Artificial Sequence
  Synthetic
gcgtgaggaggactttgagccagatgaacattcggggattagttctgcacgggcccatgtatcagcagccaactt

SEQ ID NO: 231019 - DNA, 75 bp, Artificial Sequence
  Synthetic
gaacattcggggattagttctgcacgggcccatgtatcagcagccaacttagtaacagcatatgaacaaacggtt

SEQ ID NO: 231020 - DNA, 75 bp, Artificial Sequence
  Synthetic
gctttaataaccatgtgcgcacactaatagcgcgagaagaagtagccattggtttaatgcatctttgggactttg

SEQ ID NO: 231021 - DNA, 75 bp, Artificial Sequence
  Synthetic
aatagcgcgagaagaagtagccattggtttaatgcatctttgggactttgtagaagcttatgtacataatccagc

SEQ ID NO: 231022 - DNA, 75 bp, Artificial Sequence
  Synthetic
ttcttaatagttcaacatagtagagacaatgaaacttttagggatgcaatgcttaacatagctgaaccccagggt

SEQ ID NO: 231023 - DNA, 75 bp, Artificial Sequence
  Synthetic
acaatgaaacttttagggatgcaatgcttaacatagctgaaccccagggtcggtggttactcgatttaattaaca

SEQ ID NO: 231024 - DNA, 75 bp, Artificial Sequence
  Synthetic
acgcagtcttagtttggcagacaaggtggccgccattaattactccatgttaagtttgggaaagttttatgctcg

SEQ ID NO: 231025 - DNA, 75 bp, Artificial Sequence
  Synthetic
gtggccgccattaattactccatgttaagtttgggaaagttttatgctcgtaaaatctacaaaagtccgtatgtt

SEQ ID NO: 231026 - DNA, 75 bp, Artificial Sequence
  Synthetic
acagcttttatatgcgcatggctttaaaggtactaacattaagcgacgatcttggagtgtaccgcaatgaccgaa

SEQ ID NO: 231027 - DNA, 75 bp, Artificial Sequence
  Synthetic
aaaggtactaacattaagcgacgatcttggagtgtaccgcaatgaccgaatccacaaagcagtaagcgccagtcg

SEQ ID NO: 231028 - DNA, 75 bp, Artificial Sequence
  Synthetic
cttatgcatagcttacaaagggcgctgacgggagcaggaacagaggacgagtcgttctttgatatgggcgcagac

SEQ ID NO: 231029 - DNA, 75 bp, Artificial Sequence
  Synthetic
tgacgggagcaggaacagaggacgagtcgttctttgatatgggcgcagacctacggtggcagccaagcgctcgcg

SEQ ID NO: 231030 - DNA, 75 bp, Artificial Sequence
  Synthetic
tgctgacgtcactggcgatgacgatgacgaagaccagtacgaggactgatcggccgtaccttttgttagatgcag

SEQ ID NO: 231031 - DNA, 75 bp, Artificial Sequence
  Synthetic
cggccgtaccttttgttagatgcagcgaccggcgatcatcgcggagagggctcctaacctggatcccgcggtttt

SEQ ID NO: 231032 - DNA, 75 bp, Artificial Sequence
  Synthetic
agtgccgtctcgtactaaccctactcacgagaaagtgttaaccattgtaaatgctttgttggatagcaaagccat

SEQ ID NO: 231033 - DNA, 75 bp, Artificial Sequence
  Synthetic
cacgagaaagtgttaaccattgtaaatgctttgttggatagcaaagccatccgcaaagatgaggctggtttaata

SEQ ID NO: 231034 - DNA, 75 bp, Artificial Sequence
  Synthetic
cacgctataacagtaccaatgtgcaggctaacttagaccggatgggtacagatgtaaaggaggcgctggctcaac

SEQ ID NO: 231035 - DNA, 75 bp, Artificial Sequence
  Synthetic
ggctaacttagaccggatgggtacagatgtaaaggaggcgctggctcaacgagagcgctttcatcgcgatggtaa

SEQ ID NO: 231036 - DNA, 75 bp, Artificial Sequence
  Synthetic
gcttttttgagtactcagccggctaatgttccgcgtggtcaggaagattatacaaacttcatcagcgccttgcga

SEQ ID NO: 231037 - DNA, 75 bp, Artificial Sequence
  Synthetic
atgttccgcgtggtcaggaagattatacaaacttcatcagcgccttgcgactaatggttactgaagtgcctcaaa

SEQ ID NO: 231038 - DNA, 75 bp, Artificial Sequence
  Synthetic
ttacttttttcaaacgtccaggcagggtttgcaaaccgtaaacttaactcaggcttttaaaaatttgcaaggttt

SEQ ID NO: 231039 - DNA, 75 bp, Artificial Sequence
  Synthetic
ggtttgcaaaccgtaaacttaactcaggcttttaaaaatttgcaaggtttgtggggggttcgtgctccagtaggc

SEQ ID NO: 231040 - DNA, 75 bp, Artificial Sequence
  Synthetic
taacaccaaactcgcgcctattactgttgctaattgccccctttaccaacaccaacagtttaagtcgagattcat

SEQ ID NO: 231041 - DNA, 75 bp, Artificial Sequence
  Synthetic
gttgctaattgccccctttaccaacaccaacagtttaagtcgagattcatacctgggtcacttagttactttgta

SEQ ID NO: 231042 - DNA, 75 bp, Artificial Sequence
  Synthetic
gtagacgaacaaacttatcaagaaataaccagtgttagtcgcgcactgggccaggaggacactggcagtttagag

SEQ ID NO: 231043 - DNA, 75 bp, Artificial Sequence
  Synthetic
taaccagtgttagtcgcgcactgggccaggaggacactggcagtttagaggccacacttaactttttactaacta

SEQ ID NO: 231044 - DNA, 75 bp, Artificial Sequence
  Synthetic
gtacactttaaatgcggaagaagaacgcatattgcgctatgtacagcaatctgtaagtttgtatcttatgcgtga

SEQ ID NO: 231045 - DNA, 75 bp, Artificial Sequence
  Synthetic
cgcatattgcgctatgtacagcaatctgtaagtttgtatcttatgcgtgagggtgccacccccagtgccgcctta

SEQ ID NO: 231046 - DNA, 75 bp, Artificial Sequence
  Synthetic
cgtccttctacgcttccaatcgagctttcattaatcgcttgatggattaccttcaccgcgctgcggccatgaacg

SEQ ID NO: 231047 - DNA, 75 bp, Artificial Sequence
  Synthetic
tttcattaatcgcttgatggattaccttcaccgcgctgcggccatgaacggggaatactttacaaatgcaattct

SEQ ID NO: 231048 - DNA, 75 bp, Artificial Sequence
  Synthetic
ggattttacactggtgaatttgatttgccggaaggaaatgatggctttttgtgggatgatgttacggacagtctg

SEQ ID NO: 231049 - DNA, 75 bp, Artificial Sequence
  Synthetic
tgccggaaggaaatgatggctttttgtgggatgatgttacggacagtctgtttagtcctgcagttattggacacc

SEQ ID NO: 231050 - DNA, 75 bp, Artificial Sequence
  Synthetic
aggtcccttgcttgactctcgggcgagttctccattccccagtttaactagtttacccgccagtgttaacagcgg

SEQ ID NO: 231051 - DNA, 75 bp, Artificial Sequence
  Synthetic
agttctccattccccagtttaactagtttacccgccagtgttaacagcggtcgtaccaccagaccccgactaaca

SEQ ID NO: 231052 - DNA, 75 bp, Artificial Sequence
  Synthetic
ccatcttgtttccagtgcgcgacaaaaattttcccaacaatggcatagaaagtttggtagataaaatgtctcgct

SEQ ID NO: 231053 - DNA, 75 bp, Artificial Sequence
  Synthetic
aaattttcccaacaatggcatagaaagtttggtagataaaatgtctcgctggaaaacatatgcacaagagcggcg

SEQ ID NO: 231054 - DNA, 75 bp, Artificial Sequence
  Synthetic
ccagttcgccctcctaggcaacgttggcagcgacgcaaaaaaggggcacatgcgggggatgaaggaagcgatgac

SEQ ID NO: 231055 - DNA, 75 bp, Artificial Sequence
  Synthetic
ggcagcgacgcaaaaaaggggcacatgcgggggatgaaggaagcgatgactcagctgacgacagtagtgtattag

SEQ ID NO: 231056 - DNA, 75 bp, Artificial Sequence
  Synthetic
tgctcatttgcgcccacagggttgcatagggtcattgtattaaattgaataaaagcatacttaccaaagccatgg

SEQ ID NO: 231057 - DNA, 75 bp, Artificial Sequence
  Synthetic
atagggtcattgtattaaattgaataaaagcatacttaccaaagccatggcgaccagtgttcgtcttattttcct

SEQ ID NO: 231058 - DNA, 75 bp, Artificial Sequence
  Synthetic
gcgcggtggaactgcagacagtggcttttcctgagacaccacctccctcttacgaaaccgtgatggcagcggcgc

SEQ ID NO: 231059 - DNA, 75 bp, Artificial Sequence
  Synthetic
ttttcctgagacaccacctccctcttacgaaaccgtgatggcagcggcgccaccctacgtgcctccccgctattt

SEQ ID NO: 231060 - DNA, 75 bp, Artificial Sequence
  Synthetic
atccgttactcggaattgtcaccgttgtacgataccactcgagtgtacttggtggacaacaagtcttctgacatt

SEQ ID NO: 231061 - DNA, 75 bp, Artificial Sequence
  Synthetic
tgtacgataccactcgagtgtacttggtggacaacaagtcttctgacattgcttcattgaattaccagaatgatc

SEQ ID NO: 231062 - DNA, 75 bp, Artificial Sequence
  Synthetic
gcaaaataatgactattcccctatagaggctggcacgcaaactattaactttgatgaaaggtctagatggggtgg

SEQ ID NO: 231063 - DNA, 75 bp, Artificial Sequence
  Synthetic
gaggctggcacgcaaactattaactttgatgaaaggtctagatggggtggagatttaaaaaccatcttacatacc

SEQ ID NO: 231064 - DNA, 75 bp, Artificial Sequence
  Synthetic
tgtttaccaccaaatttaaggccagggtaatggtggctaggaaaacaaacaacgaaggccaaaccattttagaat

SEQ ID NO: 231065 - DNA, 75 bp, Artificial Sequence
  Synthetic
ggtaatggtggctaggaaaacaaacaacgaaggccaaaccattttagaatatgagtgggcagaatttgtgctacc

SEQ ID NO: 231066 - DNA, 75 bp, Artificial Sequence
  Synthetic
actattgacttaatgaacaatgctattattgagcattatttgcgagtaggaagacagcatggagtgctggaaagt

SEQ ID NO: 231067 - DNA, 75 bp, Artificial Sequence
  Synthetic
ttattgagcattatttgcgagtaggaagacagcatggagtgctggaaagtgacattggagttaagtttgacacca

SEQ ID NO: 231068 - DNA, 75 bp, Artificial Sequence
  Synthetic
cgaaacccaattagtaactccgggagtgtacactaatgaggcttttcatccagatatagtactgcttccaggttg

SEQ ID NO: 231069 - DNA, 75 bp, Artificial Sequence
  Synthetic
gtgtacactaatgaggcttttcatccagatatagtactgcttccaggttgcggggttgattttacagagagcaga

SEQ ID NO: 231070 - DNA, 75 bp, Artificial Sequence
  Synthetic
agaggcagccgtttcaggaaggatttgtgattatgtatgaacacttagagggaggcaatattccagctcttttgg

SEQ ID NO: 231071 - DNA, 75 bp, Artificial Sequence
  Synthetic
tgtgattatgtatgaacacttagagggaggcaatattccagctcttttggatgtaaaaaaatacgaaaacagtct

SEQ ID NO: 231072 - DNA, 75 bp, Artificial Sequence
  Synthetic
gacaactttattgccttaaataaggctgctaggattgaaccggttgaaacagaccccaaaggacgcagttacaac

SEQ ID NO: 231073 - DNA, 75 bp, Artificial Sequence
  Synthetic
ctgctaggattgaaccggttgaaacagaccccaaaggacgcagttacaacttgcttccagacaaaaaaaatacta

SEQ ID NO: 231074 - DNA, 75 bp, Artificial Sequence
  Synthetic
caactacggagacccagaaaaaggagttcggtcatggactctactaacaactccagatgtaacaggcggctccga

SEQ ID NO: 231075 - DNA, 75 bp, Artificial Sequence
  Synthetic
gttcggtcatggactctactaacaactccagatgtaacaggcggctccgaacaggtgtactggtccctacccgat

SEQ ID NO: 231076 - DNA, 75 bp, Artificial Sequence
  Synthetic
gctcctcgcgtcaagttagcaactatcctgtagttgcagcagaattactgccagttcatgctaaaagcttctaca

SEQ ID NO: 231077 - DNA, 75 bp, Artificial Sequence
  Synthetic
tcctgtagttgcagcagaattactgccagttcatgctaaaagcttctacaacgagcaagccgtctactcacagct

SEQ ID NO: 231078 - DNA, 75 bp, Artificial Sequence
  Synthetic
cgcgtgtttaatcgctttcccgagaaccagatactggtgcgtccaccagccgctaccatcactaccgtcagtgaa

SEQ ID NO: 231079 - DNA, 75 bp, Artificial Sequence
  Synthetic
ggaccctgccgctgcgtagcagtatcagtggagttcagcgagtcaccatcactgacgcccgccgccggacctgtc

SEQ ID NO: 231080 - DNA, 75 bp, Artificial Sequence
  Synthetic
cagtggagttcagcgagtcaccatcactgacgcccgccgccggacctgtccctacgtttacaaagcactgggcat

SEQ ID NO: 231081 - DNA, 75 bp, Artificial Sequence
  Synthetic
actgacgcccgccgccggacctgtccctacgtttacaaagcactgggcatagtttctccacgagtgctttctagt

SEQ ID NO: 231082 - DNA, 75 bp, Artificial Sequence
  Synthetic
catgtccattttggtttcgccaagtaacaacacgggctggggactgggtgccgcccgcatgtatggaggagctaa

SEQ ID NO: 231083 - DNA, 75 bp, Artificial Sequence
  Synthetic
aacaacacgggctggggactgggtgccgcccgcatgtatggaggagctaaaacaaggtctagccaacatccagtg

SEQ ID NO: 231084 - DNA, 75 bp, Artificial Sequence
  Synthetic
catggggcgcgcatacccgaggacgcactggtcgcaccactgtagacgatgttattgactcggtagtggccgatg

SEQ ID NO: 231085 - DNA, 75 bp, Artificial Sequence
  Synthetic
cactggtcgcaccactgtagacgatgttattgactcggtagtggccgatgctcgcaagtaccgcgcgcccgctga

SEQ ID NO: 231086 - DNA, 75 bp, Artificial Sequence
  Synthetic
gtaattgatgaggtagtggcaaacgcgcgggcttatgcaaggcgccgcagacggctgcgtcgccggcgtagacca

SEQ ID NO: 231087 - DNA, 75 bp, Artificial Sequence
  Synthetic
cgcgggcttatgcaaggcgccgcagacggctgcgtcgccggcgtagaccaaccaccgccatgcgcgcggccagag

SEQ ID NO: 231088 - DNA, 75 bp, Artificial Sequence
  Synthetic
tgggcggcgagctatgatgcgggcagccaggcgggctgcaacgcctgccggtcgagcgcggagacgggccgcagc

SEQ ID NO: 231089 - DNA, 75 bp, Artificial Sequence
  Synthetic
ctagctgctccgcgacgaggaaatgtatactgggtgcgcgactcagtgaccgggacgcgtgtgccagttcgtacg

SEQ ID NO: 231090 - DNA, 75 bp, Artificial Sequence
  Synthetic
tatactgggtgcgcgactcagtgaccgggacgcgtgtgccagttcgtacgcgtccacctcacccttagaagacaa

SEQ ID NO: 231091 - DNA, 75 bp, Artificial Sequence
  Synthetic
tgcccagcatgaccaaacgcaagttcaaagaagagctgctgcaggccttagcgcctgaaatatatggcccatcgg

SEQ ID NO: 231092 - DNA, 75 bp, Artificial Sequence
  Synthetic
caaagaagagctgctgcaggccttagcgcctgaaatatatggcccatcggataaccttaccaagcgcgatatcaa

SEQ ID NO: 231093 - DNA, 75 bp, Artificial Sequence
  Synthetic
gaggaagaagtcgccgcggcgtcagcagacggcgtcgagtttgtgcgctcatttgcgcccagacgtagggtacag

SEQ ID NO: 231094 - DNA, 75 bp, Artificial Sequence
  Synthetic
cagacggcgtcgagtttgtgcgctcatttgcgcccagacgtagggtacagtggaagggacggcaagtaaaacgca

SEQ ID NO: 231095 - DNA, 75 bp, Artificial Sequence
  Synthetic
tttttctcccggagagcgaacgattatgcgtcccctaaagcgcgagtacgacgaagtgtacgcagacgatgacat

SEQ ID NO: 231096 - DNA, 75 bp, Artificial Sequence
  Synthetic
atgcgtcccctaaagcgcgagtacgacgaagtgtacgcagacgatgacattttggagcaagcggcacaacagact

SEQ ID NO: 231097 - DNA, 75 bp, Artificial Sequence
  Synthetic
ggcgttacggagacaaaattgctattcctttggacgagggaaatccaacacccagtttaaaggctgtcactttgc

SEQ ID NO: 231098 - DNA, 75 bp, Artificial Sequence
  Synthetic
tcctttggacgagggaaatccaacacccagtttaaaggctgtcactttgcaacaagtgttgcccgtccttgggcc

SEQ ID NO: 231099 - DNA, 75 bp, Artificial Sequence
  Synthetic
agggaagccatggatgaattgcagcctacaatgcaactgatggtgcctaagcggcaaaagttagaggacgtacta

SEQ ID NO: 231100 - DNA, 75 bp, Artificial Sequence
  Synthetic
ctacaatgcaactgatggtgcctaagcggcaaaagttagaggacgtactagagcacatgaaggtggatcctagcg

SEQ ID NO: 231101 - DNA, 75 bp, Artificial Sequence
  Synthetic
gataaaaaaggtagctccaggattgggagttcaaacagtggacattcaaattcctgtgcaaactgcattgggtga

SEQ ID NO: 231102 - DNA, 75 bp, Artificial Sequence
  Synthetic
ggagttcaaacagtggacattcaaattcctgtgcaaactgcattgggtgaaactatggaaatccaaacttcgcca

SEQ ID NO: 231103 - DNA, 75 bp, Artificial Sequence
  Synthetic
tgcaaacagacccttggtacccgccagtgctttcaacaaaaaaaaagcgtcactacagacaaacaagttcgcttt

SEQ ID NO: 231104 - DNA, 75 bp, Artificial Sequence
  Synthetic
agtgctttcaacaaaaaaaaagcgtcactacagacaaacaagttcgcttttgccagactacgttttacatccttc

SEQ ID NO: 231105 - DNA, 75 bp, Artificial Sequence
  Synthetic
gggacaacttttcagcgccgagccacagcccctagccgtagacgaggtccatcacgccgtagacgtcgacgcaaa

SEQ ID NO: 231106 - DNA, 75 bp, Artificial Sequence
  Synthetic
atcacgccgtagacgtcgacgcaaagccactttagccccagcggcagtacgtcgcgttgtacaaagggggcgcac

SEQ ID NO: 231107 - DNA, 75 bp, Artificial Sequence
  Synthetic
caccctagcattctctaacaagctgcgctgccgttttttcagatggctcttacttgccgaatgcgcatacccatt

SEQ ID NO: 231108 - DNA, 75 bp, Artificial Sequence
  Synthetic
cgctgccgttttttcagatggctcttacttgccgaatgcgcatacccattccaggatacagaggacgaccccgcc

SEQ ID NO: 231109 - DNA, 75 bp, Artificial Sequence
  Synthetic
tcgatttcggcggcgtagtatgcgcagacgcatgaagggtggggtgctgcccttcctaattccacttattgctgc

SEQ ID NO: 231110 - DNA, 75 bp, Artificial Sequence
  Synthetic
ccttcctaattccacttattgctgcggccattggagccgttcccggaattgcctcagtagccttgcaggcttctc

SEQ ID NO: 231111 - DNA, 75 bp, Artificial Sequence
  Synthetic
tccaacttattactggtactatgactgttttatgcagactaaatggaagacatcaatttttcgtcgctggccccg

SEQ ID NO: 231112 - DNA, 75 bp, Artificial Sequence
  Synthetic
ccagctgaacgggggcgccttcaattggaacagtatctggagcggtcttaaaaattttggttccacgattaagac

SEQ ID NO: 231113 - DNA, 75 bp, Artificial Sequence
  Synthetic
tggaacagtatctggagcggtcttaaaaattttggttccacgattaagacatatggcaccaaggcgtggaacagc

SEQ ID NO: 231114 - DNA, 75 bp, Artificial Sequence
  Synthetic
agttaaaagaccaaaattttcaacagaaagttgtagatggtctggcttcgggaattaatggagttgtagacatag

SEQ ID NO: 231115 - DNA, 75 bp, Artificial Sequence
  Synthetic
gaaagttgtagatggtctggcttcgggaattaatggagttgtagacatagccaatcaggctgtacagaaaaaaat

SEQ ID NO: 231116 - DNA, 75 bp, Artificial Sequence
  Synthetic
gacgaggtaatggtagaggaaaagctgccacctctagaaactgtgcccggatccgttccaaccaaaggagaaaag

SEQ ID NO: 231117 - DNA, 75 bp, Artificial Sequence
  Synthetic
tgccacctctagaaactgtgcccggatccgttccaaccaaaggagaaaagcggccacggccggatgcagaggaaa

SEQ ID NO: 231118 - DNA, 75 bp, Artificial Sequence
  Synthetic
gccgtcctatgaggaagcaataaaacaaggagccgctctgtcacctaccacctatcccatgaccaagcctatttt

SEQ ID NO: 231119 - DNA, 75 bp, Artificial Sequence
  Synthetic
caaggagccgctctgtcacctaccacctatcccatgaccaagcctattttacccatggctactagagtgtatgga

SEQ ID NO: 231120 - DNA, 75 bp, Artificial Sequence
  Synthetic
ttgagctgcctcctttgccagaacccactatcgcggatcccgtaggttccgttcctgttgcatctgttccagttg

SEQ ID NO: 231121 - DNA, 75 bp, Artificial Sequence
  Synthetic
cactatcgcggatcccgtaggttccgttcctgttgcatctgttccagttgcatcgacagtgagccgtccagcagt

SEQ ID NO: 231122 - DNA, 75 bp, Artificial Sequence
  Synthetic
cgaaacccacgatccagtaattggcaaagtaccctaaacagtattgtgggactgggagtaaagtctctcaaacgc

SEQ ID NO: 231123 - DNA, 75 bp, Artificial Sequence
  Synthetic
cgagtgttaattcccatctgtgtatacgcctcctatgttagcgccagaggaccaacgcgtgaatcgcagtcacca

SEQ ID NO: 231124 - DNA, 75 bp, Artificial Sequence
  Synthetic
ctcgatgatgccgcagtggtcttacatgcacatcgccggtcaggatgcctcggagtacctgagtcccggtctggt

SEQ ID NO: 231125 - DNA, 75 bp, Artificial Sequence
  Synthetic
gaaaccccaccgtggctcccacccatgatgttaccaccgatcgctcgcagcgtctgacgctgcgttttgtgcccg

SEQ ID NO: 231126 - DNA, 75 bp, Artificial Sequence
  Synthetic
tgatgttaccaccgatcgctcgcagcgtctgacgctgcgttttgtgcccgtggatcgggaagatactacctactc

SEQ ID NO: 231127 - DNA, 75 bp, Artificial Sequence
  Synthetic
gtgggtgacaaccgcgtgttagacatggctagttcttactttgacattcgaggggtactggatcgtggtcccagt

SEQ ID NO: 231128 - DNA, 75 bp, Artificial Sequence
  Synthetic
tggctagttcttactttgacattcgaggggtactggatcgtggtcccagttttaagccctattccggaaccgcct

SEQ ID NO: 231129 - DNA, 75 bp, Artificial Sequence
  Synthetic
tcctaatgcttcacaatggtcagataacgctaagcttaatacctttgctcaggcgccgtatcttagcgacactat

SEQ ID NO: 231130 - DNA, 75 bp, Artificial Sequence
  Synthetic
aacgctaagcttaatacctttgctcaggcgccgtatcttagcgacactatcaccgccgccgatggtattaaagtt

SEQ ID NO: 231131 - DNA, 75 bp, Artificial Sequence
  Synthetic
cggcggtgtatgccaacaaaacttatcagccagagccgcaagtaggaccaagtgaatggaacaccagcattgaaa

SEQ ID NO: 231132 - DNA, 75 bp, Artificial Sequence
  Synthetic
tcagccagagccgcaagtaggaccaagtgaatggaacaccagcattgaaaacgttaaagctggcgggagggcatt

SEQ ID NO: 231133 - DNA, 75 bp, Artificial Sequence
  Synthetic
tgctatggctcctacgctcgtccaaccaacgaacacggaggacaatccaaggatgacaacattgaacttaagttc

SEQ ID NO: 231134 - DNA, 75 bp, Artificial Sequence
  Synthetic
ccaacgaacacggaggacaatccaaggatgacaacattgaacttaagttctttgattcagctaacaatgcagcaa

SEQ ID NO: 231135 - DNA, 75 bp, Artificial Sequence
  Synthetic
cgaagacgtaaaccttgaaatgccagacacgcatcttgtgtttaagcctactgttaccaatggaacaattgcttc

SEQ ID NO: 231136 - DNA, 75 bp, Artificial Sequence
  Synthetic
gacacgcatcttgtgtttaagcctactgttaccaatggaacaattgcttctgagtcgctgttgggacagcaagca

SEQ ID NO: 231137 - DNA, 75 bp, Artificial Sequence
  Synthetic
cattcagagataattttattggcctgatgtattacaacagtacaggcaacatgggtgtattggccgggcaagctt

SEQ ID NO: 231138 - DNA, 75 bp, Artificial Sequence
  Synthetic
gatgtattacaacagtacaggcaacatgggtgtattggccgggcaagcttcccaacttaacgcagtagtagacct

SEQ ID NO: 231139 - DNA, 75 bp, Artificial Sequence
  Synthetic
taccagttaatgctggatgctttgggagacagaacacggtacttttccttgtggaattccgcagtggacagttac

SEQ ID NO: 231140 - DNA, 75 bp, Artificial Sequence
  Synthetic
gagacagaacacggtacttttccttgtggaattccgcagtggacagttacgaccctgacgttcgcgttattgaga

SEQ ID NO: 231141 - DNA, 75 bp, Artificial Sequence
  Synthetic
aaattattgctttcctcttagcgcagtaggtgaaataaaaaattacaaaggcattaagccagataacggaggagg

SEQ ID NO: 231142 - DNA, 75 bp, Artificial Sequence
  Synthetic
gtaggtgaaataaaaaattacaaaggcattaagccagataacggaggaggaggtggctggactgccgacaacact

SEQ ID NO: 231143 - DNA, 75 bp, Artificial Sequence
  Synthetic
ttgggaatatagccgccatggaaattaatttgcaggctaatttgtggagaagcttcttgtactcaaatgtgggct

SEQ ID NO: 231144 - DNA, 75 bp, Artificial Sequence
  Synthetic
taatttgcaggctaatttgtggagaagcttcttgtactcaaatgtgggcttatacctaccagacgacttaaaata

SEQ ID NO: 231145 - DNA, 75 bp, Artificial Sequence
  Synthetic
gataacaagaacacctacgagtacatgaacgggcgtgtgactgccccggggttggtggatacctatgtcaatatc

SEQ ID NO: 231146 - DNA, 75 bp, Artificial Sequence
  Synthetic
tgaacgggcgtgtgactgccccggggttggtggatacctatgtcaatatcggcgctcgctggtccccagatgtga

SEQ ID NO: 231147 - DNA, 75 bp, Artificial Sequence
  Synthetic
ccaccgaaacgcagggttgcgctacagatccatgttgctaggcaatgggagatttgttccttttcacattcaggt

SEQ ID NO: 231148 - DNA, 75 bp, Artificial Sequence
  Synthetic
agatccatgttgctaggcaatgggagatttgttccttttcacattcaggtgccgcaaaaattttttgccatcaga

SEQ ID NO: 231149 - DNA, 75 bp, Artificial Sequence
  Synthetic
acacttacgaatggaactttagaaaggatgtaaacatgattcttcagagcacactgggaaatgatcttcgggtgg

SEQ ID NO: 231150 - DNA, 75 bp, Artificial Sequence
  Synthetic
ggatgtaaacatgattcttcagagcacactgggaaatgatcttcgggtggacggagccagcgttcgctttgacaa

SEQ ID NO: 231151 - DNA, 75 bp, Artificial Sequence
  Synthetic
cccatggcacataacacagcttctactttagaagccatgttaagaaatgacaccaacgaccagtcttttaacgat

SEQ ID NO: 231152 - DNA, 75 bp, Artificial Sequence
  Synthetic
ctttagaagccatgttaagaaatgacaccaacgaccagtcttttaacgattatttgtgtgctgcaaacatgctgt

SEQ ID NO: 231153 - DNA, 75 bp, Artificial Sequence
  Synthetic
cgtgcccatttcaataccttcgcgaaattgggcggcatttagaggctggagctttactcgcctaaaaactaaaga

SEQ ID NO: 231154 - DNA, 75 bp, Artificial Sequence
  Synthetic
aattgggcggcatttagaggctggagctttactcgcctaaaaactaaagaaactccttccctgggttcagggttt

SEQ ID NO: 231155 - DNA, 75 bp, Artificial Sequence
  Synthetic
ccattccctatttagacggcaccttttacctaaaccacacttttaagaaggtgtcaatcatgtttgactcctccg

SEQ ID NO: 231156 - DNA, 75 bp, Artificial Sequence
  Synthetic
ttacctaaaccacacttttaagaaggtgtcaatcatgtttgactcctccgtgagttggcctggaaatgaccgttt

SEQ ID NO: 231157 - DNA, 75 bp, Artificial Sequence
  Synthetic
aagcgttctgtggatggggagggatacaatgtggcccaatgcaatatgactaaggattggttcctaatacaaatg

SEQ ID NO: 231158 - DNA, 75 bp, Artificial Sequence
  Synthetic
acaatgtggcccaatgcaatatgactaaggattggttcctaatacaaatgcttagtcattacaacattggatacc

SEQ ID NO: 231159 - DNA, 75 bp, Artificial Sequence
  Synthetic
caaggaccgcatgtattctttctttagaaactttcagcccatgagtaggcaagttgtggataccacagaatataa

SEQ ID NO: 231160 - DNA, 75 bp, Artificial Sequence
  Synthetic
agaaactttcagcccatgagtaggcaagttgtggataccacagaatataagaactacaaaaaagtaaccgtagag

SEQ ID NO: 231161 - DNA, 75 bp, Artificial Sequence
  Synthetic
tgggatacctgggccccactatgcgggagggacaagcttaccccgccaactatccctaccctcttataggccaaa

SEQ ID NO: 231162 - DNA, 75 bp, Artificial Sequence
  Synthetic
ggagggacaagcttaccccgccaactatccctaccctcttataggccaaacagctgtggaaagcatcacacagaa

SEQ ID NO: 231163 - DNA, 75 bp, Artificial Sequence
  Synthetic
tggcgcatcccattttctagtaacttcatgtctatgggggcgctaacggatcttgggcaaaatatgctgtacgca

SEQ ID NO: 231164 - DNA, 75 bp, Artificial Sequence
  Synthetic
tcatgtctatgggggcgctaacggatcttgggcaaaatatgctgtacgcaaactcagcccatgctctagacatga

SEQ ID NO: 231165 - DNA, 75 bp, Artificial Sequence
  Synthetic
gcctacccttctttatgttttatttgaagttttcgacgtggtacgcattcaccagccacaccgcggcgtcattga

SEQ ID NO: 231166 - DNA, 75 bp, Artificial Sequence
  Synthetic
gaagttttcgacgtggtacgcattcaccagccacaccgcggcgtcattgaagcggtctacctgcgcacgcccttc

SEQ ID NO: 231167 - DNA, 75 bp, Artificial Sequence
  Synthetic
aaggcaccctcccagactgctgtaatgggttcaagcgaacaggagctgacggccattgttcgagatctaggctgt

SEQ ID NO: 231168 - DNA, 75 bp, Artificial Sequence
  Synthetic
tatttattcgatccatttggattttctgatcaacgactaaaacaaatctatcagtttgagtacgaaagtctgttg

SEQ ID NO: 231169 - DNA, 75 bp, Artificial Sequence
  Synthetic
ttttctgcagcgtgcggcctgttttgttgtatgttcttacacgcttttactcactggcctgaccatccaatggat

SEQ ID NO: 231170 - DNA, 75 bp, Artificial Sequence
  Synthetic
aaaaatcccactatggacctacttactggggtgcctaattgtatgctacaaagtcctcaggtagtgggcacattg

SEQ ID NO: 231171 - DNA, 75 bp, Artificial Sequence
  Synthetic
ctggggtgcctaattgtatgctacaaagtcctcaggtagtgggcacattgcaacgcaatcagaatgaattgtata

SEQ ID NO: 231172 - DNA, 75 bp, Artificial Sequence
  Synthetic
gaaaaagctacatcttttactaaaatgcaaaatggactcaaataaacgtgtacacaatgcattaataataaaacc

SEQ ID NO: 231173 - DNA, 75 bp, Artificial Sequence
  Synthetic
gcttgactgttttattaaaaatcaaatggctcttcgcgacagtcgccgtggttggtgggcagggatatgtttctg

SEQ ID NO: 231174 - DNA, 75 bp, Artificial Sequence
  Synthetic
atggctcttcgcgacagtcgccgtggttggtgggcagggatatgtttctgtactgcaaacgctgatgccacttga

SEQ ID NO: 231175 - DNA, 75 bp, Artificial Sequence
  Synthetic
ggagccgtcaaaattttctccccacagctggcgcacaagttgcagggcgcccataacatcaggagcagaaatctt

SEQ ID NO: 231176 - DNA, 75 bp, Artificial Sequence
  Synthetic
agctggcgcacaagttgcagggcgcccataacatcaggagcagaaatcttgaagtcgcaattagggccagcattg

SEQ ID NO: 231177 - DNA, 75 bp, Artificial Sequence
  Synthetic
ttgcgcactgaaaaaccaacaaacacggatacttaatactggctaacgctccagggtcggttacttcgttgatat

SEQ ID NO: 231178 - DNA, 75 bp, Artificial Sequence
  Synthetic
cggatacttaatactggctaacgctccagggtcggttacttcgttgatatcaatgttatccacattgctgaggtt

SEQ ID NO: 231179 - DNA, 75 bp, Artificial Sequence
  Synthetic
cgccccatccgtggcaggccatcttgcttgtttaaacattcgcagcgcactggcataaggagacgtttttgccca

SEQ ID NO: 231180 - DNA, 75 bp, Artificial Sequence
  Synthetic
gcttgtttaaacattcgcagcgcactggcataaggagacgtttttgcccatgtcgcatgtgagggtagtcggcca

SEQ ID NO: 231181 - DNA, 75 bp, Artificial Sequence
  Synthetic
agctatttgagccttcattccttcagaataaaacaagccgcaggactttccggagaaagaattattcccgcagcc

SEQ ID NO: 231182 - DNA, 75 bp, Artificial Sequence
  Synthetic
gaataaaacaagccgcaggactttccggagaaagaattattcccgcagccaacatcatgaaaacagcagcgggca

SEQ ID NO: 231183 - DNA, 75 bp, Artificial Sequence
  Synthetic
tacgcccccagcggttttgcgccaccttggctttcgaggggttctctttcaacgctcgttgcccactttcgctgg

SEQ ID NO: 231184 - DNA, 75 bp, Artificial Sequence
  Synthetic
cttggctttcgaggggttctctttcaacgctcgttgcccactttcgctggttacatccatttccaccaaatgctc

SEQ ID NO: 231185 - DNA, 75 bp, Artificial Sequence
  Synthetic
aggcatctaagctccccttcgcgctcggtacacttatgctcccacacgcagcaaccggtgggttcccaggaattc

SEQ ID NO: 231186 - DNA, 75 bp, Artificial Sequence
  Synthetic
cggtacacttatgctcccacacgcagcaaccggtgggttcccaggaattctgttggacaccggcataagcttgca

SEQ ID NO: 231187 - DNA, 75 bp, Artificial Sequence
  Synthetic
gagctcctgaaaggttttttgggatgaaaaagtcagctgcaaaccgcgcttttcttcgttgagccatgttgtgca

SEQ ID NO: 231188 - DNA, 75 bp, Artificial Sequence
  Synthetic
gaaaaagtcagctgcaaaccgcgcttttcttcgttgagccatgttgtgcatattttcttgtacacgctgccctga

SEQ ID NO: 231189 - DNA, 75 bp, Artificial Sequence
  Synthetic
gctcgtcgtgatccacatggtacttttccattagcatagccatggcttccatgcctttttcccaagctgaaacta

SEQ ID NO: 231190 - DNA, 75 bp, Artificial Sequence
  Synthetic
ttccattagcatagccatggcttccatgcctttttcccaagctgaaactaggggctggcttgccggattgcgaac

SEQ ID NO: 231191 - DNA, 75 bp, Artificial Sequence
  Synthetic
tcgctgttttgagcggaagccttcaaaacgtgtacctgcctggtttccattttttgaaaagactgagaaccgtct

SEQ ID NO: 231192 - DNA, 75 bp, Artificial Sequence
  Synthetic
aaacgtgtacctgcctggtttccattttttgaaaagactgagaaccgtctgcatgatgcataatgcggacgggcg

SEQ ID NO: 231193 - DNA, 75 bp, Artificial Sequence
  Synthetic
aactgctcttggtggttctgcctcttcttcttctgcactctctggggaaagaggtatcgcagccatagatttctt

SEQ ID NO: 231194 - DNA, 75 bp, Artificial Sequence
  Synthetic
gacttttttctttggaggtaaaggcacagcttccagttcttcttcgctttcggaatccagaaagtatctgcccat

SEQ ID NO: 231195 - DNA, 75 bp, Artificial Sequence
  Synthetic
cggtctggggtgcgctccctctgtgagtgctgattgctggccattatttaatcctaggcaaagaaacacatgatg

SEQ ID NO: 231196 - DNA, 75 bp, Artificial Sequence
  Synthetic
agtgctgattgctggccattatttaatcctaggcaaagaaacacatgatggatctggagccacaggaaagcttaa

SEQ ID NO: 231197 - DNA, 75 bp, Artificial Sequence
  Synthetic
cgctacggctgtcatggagaaggacaaaagtctactcataccccaagacgcaccggttgagcagaacttgggcta

SEQ ID NO: 231198 - DNA, 75 bp, Artificial Sequence
  Synthetic
aaaagtctactcataccccaagacgcaccggttgagcagaacttgggctacgagactccccccgaggaatttgaa

SEQ ID NO: 231199 - DNA, 75 bp, Artificial Sequence
  Synthetic
caaatgagcaaaacgctgggctcgaggaccatgactacctaaacgagggagatgtcctgtttaaacatctacagc

SEQ ID NO: 231200 - DNA, 75 bp, Artificial Sequence
  Synthetic
ggaccatgactacctaaacgagggagatgtcctgtttaaacatctacagcgacaaagcactatcgttcgcgacgc

SEQ ID NO: 231201 - DNA, 75 bp, Artificial Sequence
  Synthetic
gtttcaattgcagaactatcttgcatctacgaacgcaacctgttctccccacgtgtgccccctaaacggcaagcc

SEQ ID NO: 231202 - DNA, 75 bp, Artificial Sequence
  Synthetic
tctacgaacgcaacctgttctccccacgtgtgccccctaaacggcaagccaacggcacatgcgagccaaatcctc

SEQ ID NO: 231203 - DNA, 75 bp, Artificial Sequence
  Synthetic
agtgccagaagcactggcaacataccatattttctttaaaaatcacaaaatacccctatcctgtcgagctaaccg

SEQ ID NO: 231204 - DNA, 75 bp, Artificial Sequence
  Synthetic
catattttctttaaaaatcacaaaatacccctatcctgtcgagctaaccgcagccgcgcagatgagcttcttgct

SEQ ID NO: 231205 - DNA, 75 bp, Artificial Sequence
  Synthetic
ggattgtgtccttggaagaggtgcctaaaatttttgaaggtttaggtcgggatgaaaaacgagcagcaaatgccc

SEQ ID NO: 231206 - DNA, 75 bp, Artificial Sequence
  Synthetic
taaaatttttgaaggtttaggtcgggatgaaaaacgagcagcaaatgccctgcaaaaagaaaatgaacaaaatca

SEQ ID NO: 231207 - DNA, 75 bp, Artificial Sequence
  Synthetic
ctggaaggtgacaatgcccgcctggcagttttaaagcgcaatattgaggttactcactttgcctacccggcagta

SEQ ID NO: 231208 - DNA, 75 bp, Artificial Sequence
  Synthetic
cagttttaaagcgcaatattgaggttactcactttgcctacccggcagtaaatcttccgccaaaggtaatgagcg

SEQ ID NO: 231209 - DNA, 75 bp, Artificial Sequence
  Synthetic
gcgagcccaacccattgacaaagatgcaaacttgcaagacccggaggcaacagatgatggaaagccggttgtaag

SEQ ID NO: 231210 - DNA, 75 bp, Artificial Sequence
  Synthetic
gcaaacttgcaagacccggaggcaacagatgatggaaagccggttgtaagcgacgagcaattaactaagtggttg

SEQ ID NO: 231211 - DNA, 75 bp, Artificial Sequence
  Synthetic
aacagcggcgtaaactcatgatggccgccgtacttgtaactgtggaactcgagtgcatgcatcgttttttctccg

SEQ ID NO: 231212 - DNA, 75 bp, Artificial Sequence
  Synthetic
cgccgtacttgtaactgtggaactcgagtgcatgcatcgttttttctccgacatcaccacattgcgcaaaattga

SEQ ID NO: 231213 - DNA, 75 bp, Artificial Sequence
  Synthetic
catggctacgtgcgccaagcctgtaaaatttctaatgtggagctgagcaatctagtttcttacatgggcatcttg

SEQ ID NO: 231214 - DNA, 75 bp, Artificial Sequence
  Synthetic
aaatttctaatgtggagctgagcaatctagtttcttacatgggcatcttgcatgaaaaccgattgggacagaacg

SEQ ID NO: 231215 - DNA, 75 bp, Artificial Sequence
  Synthetic
agcacgcagagattacgtgcgagactgcatttaccttttcctgttacatacctggcaaactgggatgggtgtttg

SEQ ID NO: 231216 - DNA, 75 bp, Artificial Sequence
  Synthetic
tgcatttaccttttcctgttacatacctggcaaactgggatgggtgtttggcagcaatgcttggaagaaaaaaac

SEQ ID NO: 231217 - DNA, 75 bp, Artificial Sequence
  Synthetic
acagagcactaaaatccctatggaccggttttgacgaacggacagtagctgcagagctagctgacataattttcc

SEQ ID NO: 231218 - DNA, 75 bp, Artificial Sequence
  Synthetic
cggttttgacgaacggacagtagctgcagagctagctgacataattttcccagaaaggttaatgataaccttgca

SEQ ID NO: 231219 - DNA, 75 bp, Artificial Sequence
  Synthetic
caaagtatgctgcacaattatcgctcttttatattagagcgttctgggatgcttcctagcatgtgttgtgcactt

SEQ ID NO: 231220 - DNA, 75 bp, Artificial Sequence
  Synthetic
cttttatattagagcgttctgggatgcttcctagcatgtgttgtgcacttccttcagattttgtgcctatatatt

SEQ ID NO: 231221 - DNA, 75 bp, Artificial Sequence
  Synthetic
gagccactgctacttactacgacttgctaactacctagcttaccactcagaccttatgacagattcaagcggcga

SEQ ID NO: 231222 - DNA, 75 bp, Artificial Sequence
  Synthetic
gctaactacctagcttaccactcagaccttatgacagattcaagcggcgaaggcctaatggagtgtcactgccgc

SEQ ID NO: 231223 - DNA, 75 bp, Artificial Sequence
  Synthetic
ctttggtttgcaatactgaactattaagtgaaagtcaagtcattggtaccttcgaaatgcagggaccgcagtctg

SEQ ID NO: 231224 - DNA, 75 bp, Artificial Sequence
  Synthetic
aagtgaaagtcaagtcattggtaccttcgaaatgcagggaccgcagtctgacagcaatttcacgacgaacctaag

SEQ ID NO: 231225 - DNA, 75 bp, Artificial Sequence
  Synthetic
gcctacctgcgcaaatttgaaccccaagattaccacgcccacagtatcaatttttacgaagaccaatccaaaccc

SEQ ID NO: 231226 - DNA, 75 bp, Artificial Sequence
  Synthetic
aagattaccacgcccacagtatcaatttttacgaagaccaatccaaacccccaaaagcgccactaacggcttgcg

SEQ ID NO: 231227 - DNA, 75 bp, Artificial Sequence
  Synthetic
ccaattgcatgctattaagcaagcgcgcgaagagtttttacttaaaaaaggacacggagtgtaccttgatcccca

SEQ ID NO: 231228 - DNA, 75 bp, Artificial Sequence
  Synthetic
cgcgaagagtttttacttaaaaaaggacacggagtgtaccttgatccccaaaccggcgaggaactaaaccttcca

SEQ ID NO: 231229 - DNA, 75 bp, Artificial Sequence
  Synthetic
cccattcgcagcatgtccccgaaagccgcaaaacaggctattgcgcagcaacgctcaaagaaacagcagcaacgg

SEQ ID NO: 231230 - DNA, 75 bp, Artificial Sequence
  Synthetic
ccgcaaaacaggctattgcgcagcaacgctcaaagaaacagcagcaacggcaggaaatctgggaggaagaatctt

SEQ ID NO: 231231 - DNA, 75 bp, Artificial Sequence
  Synthetic
cgaggacttggaagaatgggaggaggaggaggcggacagcctagacgaggatccagaggaggaggaggaaggttc

SEQ ID NO: 231232 - DNA, 75 bp, Artificial Sequence
  Synthetic
gaggaggcggacagcctagacgaggatccagaggaggaggaggaaggttccaaggacggagcgaccgccgccaaa

SEQ ID NO: 231233 - DNA, 75 bp, Artificial Sequence
  Synthetic
caatgaaacccgctgtgagcaaatctcagaaagccaaccgtagatgggacaccattgaaaccagcgccgcaaact

SEQ ID NO: 231234 - DNA, 75 bp, Artificial Sequence
  Synthetic
tcagaaagccaaccgtagatgggacaccattgaaaccagcgccgcaaacttgggtaagaatcgcaagcaggcgcg

SEQ ID NO: 231235 - DNA, 75 bp, Artificial Sequence
  Synthetic
caccaaagtaatattgtagcctgctttcagcactgcggggggaatatctcatttgcaaggcggtatttgctatac

SEQ ID NO: 231236 - DNA, 75 bp, Artificial Sequence
  Synthetic
ttcagcactgcggggggaatatctcatttgcaaggcggtatttgctataccatgatggagtggcgattccaagga

SEQ ID NO: 231237 - DNA, 75 bp, Artificial Sequence
  Synthetic
ctacagcccctttgaagagctcgacaaggaaccgacctgcaacagccaagcggcccactagaatcggcaacagca

SEQ ID NO: 231238 - DNA, 75 bp, Artificial Sequence
  Synthetic
aaggaaccgacctgcaacagccaagcggcccactagaatcggcaacagcagcaacaaggaaagtcctgaggcgcg

SEQ ID NO: 231239 - DNA, 75 bp, Artificial Sequence
  Synthetic
actttatatgctatttttcagcagagtcgaggtcaagaacacgaactgaaaataaaaaaccgttccctgcgttca

SEQ ID NO: 231240 - DNA, 75 bp, Artificial Sequence
  Synthetic
gtcgaggtcaagaacacgaactgaaaataaaaaaccgttccctgcgttcacttacccgcagctgtctctacctca

SEQ ID NO: 231241 - DNA, 75 bp, Artificial Sequence
  Synthetic
cttgcaggacgcagaagctctgttcaataaatactgctccctctcgcttaaagagtaaaaaaagcccgcgcgcgg

SEQ ID NO: 231242 - DNA, 75 bp, Artificial Sequence
  Synthetic
aataaatactgctccctctcgcttaaagagtaaaaaaagcccgcgcgcggactttcaacaggcgggaaaagtgac

SEQ ID NO: 231243 - DNA, 75 bp, Artificial Sequence
  Synthetic
tcccacgccttacatgtggagctttcaaccccaaatgggactggcggccggcgcggctcaagactattctagcaa

SEQ ID NO: 231244 - DNA, 75 bp, Artificial Sequence
  Synthetic
caaccccaaatgggactggcggccggcgcggctcaagactattctagcaaaatgaattggttaagcgccggaccc

SEQ ID NO: 231245 - DNA, 75 bp, Artificial Sequence
  Synthetic
tacgagcccggcgtaaccaaatactgctagaacaagccgctctcaccgctacaccacgtaatcaacttaaccctc

SEQ ID NO: 231246 - DNA, 75 bp, Artificial Sequence
  Synthetic
gctagaacaagccgctctcaccgctacaccacgtaatcaacttaaccctccctcttggccagctgccctgatata

SEQ ID NO: 231247 - DNA, 75 bp, Artificial Sequence
  Synthetic
gtacttttgcctcgcgacgcccaggccgaagtccatatgactaacgctggggcacagcttgcgggcggtgcacgt

SEQ ID NO: 231248 - DNA, 75 bp, Artificial Sequence
  Synthetic
ccgaagtccatatgactaacgctggggcacagcttgcgggcggtgcacgtcacagtttcaggtataaaggtcgca

SEQ ID NO: 231249 - DNA, 75 bp, Artificial Sequence
  Synthetic
aaaaagagtactcatcagagggaaaggtattcagctgaacgacgaagtcacatcgccattgggagtcagacccga

SEQ ID NO: 231250 - DNA, 75 bp, Artificial Sequence
  Synthetic
ggtattcagctgaacgacgaagtcacatcgccattgggagtcagacccgacggagtgtttcagctcggagggtcc

SEQ ID NO: 231251 - DNA, 75 bp, Artificial Sequence
  Synthetic
aagcctacctgacactacagagctcatcctcagctccgagatctggtggtattggaactctccaatttgtggagg

SEQ ID NO: 231252 - DNA, 75 bp, Artificial Sequence
  Synthetic
atcctcagctccgagatctggtggtattggaactctccaatttgtggaggaatttactccatctgtttacttcaa

SEQ ID NO: 231253 - DNA, 75 bp, Artificial Sequence
  Synthetic
tatcctgacgccttcatacccaactttgacgcagtgagtgaatctgtggatggctatgattaatgtctaatggag

SEQ ID NO: 231254 - DNA, 75 bp, Artificial Sequence
  Synthetic
ttgacgcagtgagtgaatctgtggatggctatgattaatgtctaatggagcggctgacagagcgcggctgcgaca

SEQ ID NO: 231255 - DNA, 75 bp, Artificial Sequence
  Synthetic
tgctttgctcgagacatctgtgtctttacctactttgagcttccagaggagcacccccaggggccagctcacggt

SEQ ID NO: 231256 - DNA, 75 bp, Artificial Sequence
  Synthetic
ttacctactttgagcttccagaggagcacccccaggggccagctcacggtgtcagaataacagttgaaaaaggaa

SEQ ID NO: 231257 - DNA, 75 bp, Artificial Sequence
  Synthetic
caccaaacgcccgctattggtggaaaaagatcaaggaaatactatattaactttatattgcatttgtcctgttcc

SEQ ID NO: 231258 - DNA, 75 bp, Artificial Sequence
  Synthetic
aaagatcaaggaaatactatattaactttatattgcatttgtcctgttcccggattacatgaagatttctgctgt

SEQ ID NO: 231259 - DNA, 75 bp, Artificial Sequence
  Synthetic
tgtagtggcgctgtaccgcctgaagaagaacctaactgtcatccgcatttaagcaacattaaaatcaacctttcg

SEQ ID NO: 231260 - DNA, 75 bp, Artificial Sequence
  Synthetic
aagaacctaactgtcatccgcatttaagcaacattaaaatcaacctttcgatccctcatatcactcttcgctgca

SEQ ID NO: 231261 - DNA, 75 bp, Artificial Sequence
  Synthetic
gacctttaacggaaaacacgttaccaatacagatataaagtttaaactacacaaagaaaacatcactctatttca

SEQ ID NO: 231262 - DNA, 75 bp, Artificial Sequence
  Synthetic
aatacagatataaagtttaaactacacaaagaaaacatcactctatttcaacctattaacctgggatactaccgc

SEQ ID NO: 231263 - DNA, 75 bp, Artificial Sequence
  Synthetic
cattttttgttgctccagttattgacaaacgccctgctccgacaacagctgctgtcactgagcacatcaccgagg

SEQ ID NO: 231264 - DNA, 75 bp, Artificial Sequence
  Synthetic
caaacgccctgctccgacaacagctgctgtcactgagcacatcaccgaggcagtttctccttctaaaggtacaga

SEQ ID NO: 231265 - DNA, 75 bp, Artificial Sequence
  Synthetic
acaaaccacttagttttaaattgttcctgttctaactccttaatttcatggtttgctaacagctctctgtgcaaa

SEQ ID NO: 231266 - DNA, 75 bp, Artificial Sequence
  Synthetic
cctgttctaactccttaatttcatggtttgctaacagctctctgtgcaaaactttctaccaaggaaaacttttgt

SEQ ID NO: 231267 - DNA, 75 bp, Artificial Sequence
  Synthetic
ccagagcaccccttcccaccttactctattgccaccttttgttgccggtcgttacttttgcataggagctgcacg

SEQ ID NO: 231268 - DNA, 75 bp, Artificial Sequence
  Synthetic
ctattgccaccttttgttgccggtcgttacttttgcataggagctgcacgtactagcccctgtcaacagcattgg

SEQ ID NO: 231269 - DNA, 75 bp, Artificial Sequence
  Synthetic
tgtcgccctttgtgatcaatactgaatatttagactataatcccttgcttgcttacggcggtctcgcagctctta

SEQ ID NO: 231270 - DNA, 75 bp, Artificial Sequence
  Synthetic
atatttagactataatcccttgcttgcttacggcggtctcgcagctcttattttattcctgatttctaacttgtt

SEQ ID NO: 231271 - DNA, 75 bp, Artificial Sequence
  Synthetic
taacaatgctttccatttttcttttatttctcttttctttaccttctggcttgtatgctcaaacagccgaaagac

SEQ ID NO: 231272 - DNA, 75 bp, Artificial Sequence
  Synthetic
atttctcttttctttaccttctggcttgtatgctcaaacagccgaaagaccactaaaagtcgtggtggaagctgg

SEQ ID NO: 231273 - DNA, 75 bp, Artificial Sequence
  Synthetic
tctggttcacaccaaactggccatgttacttggctagtagagacatcagattatggttcagcttctccagacaac

SEQ ID NO: 231274 - DNA, 75 bp, Artificial Sequence
  Synthetic
ttacttggctagtagagacatcagattatggttcagcttctccagacaacttcattttcagtggacaaaaactat

SEQ ID NO: 231275 - DNA, 75 bp, Artificial Sequence
  Synthetic
gtggccttattacaatttacattttaactgtgaaaattatgaccttaatctgttttggcttaaggtggaaaattc

SEQ ID NO: 231276 - DNA, 75 bp, Artificial Sequence
  Synthetic
aactgtgaaaattatgaccttaatctgttttggcttaaggtggaaaattcggctatttacaacgttaaaaataca

SEQ ID NO: 231277 - DNA, 75 bp, Artificial Sequence
  Synthetic
actatgatttaagagtagtacaaatttttccacctaaatgcatcattacttcaaagtaccttacaaacgattatt

SEQ ID NO: 231278 - DNA, 75 bp, Artificial Sequence
  Synthetic
ttttccacctaaatgcatcattacttcaaagtaccttacaaacgattattgtcacattacaattaactgcactaa

SEQ ID NO: 231279 - DNA, 75 bp, Artificial Sequence
  Synthetic
tttaataatgtcagtcgatggtactacggatacggtaagggcagcccaacccttcccaactactttataactaac

SEQ ID NO: 231280 - DNA, 75 bp, Artificial Sequence
  Synthetic
acggatacggtaagggcagcccaacccttcccaactactttataactaactttaatgtttcaggtattactaaaa

SEQ ID NO: 231281 - DNA, 75 bp, Artificial Sequence
  Synthetic
tgagctctgtgattatcccacatcccaatctcaacacagtttaacacatacagtaagcacagtaatctttttagg

SEQ ID NO: 231282 - DNA, 75 bp, Artificial Sequence
  Synthetic
caatctcaacacagtttaacacatacagtaagcacagtaatctttttaggaataattggcttcagcattttgatt

SEQ ID NO: 231283 - DNA, 75 bp, Artificial Sequence
  Synthetic
gctggcatagaaaatctttgtgtgtttctaaaacagaacctcttatgccgattccttactagttttcttttttct

SEQ ID NO: 231284 - DNA, 75 bp, Artificial Sequence
  Synthetic
ttctaaaacagaacctcttatgccgattccttactagttttcttttttcttacagtatggtgacggttcttctca

SEQ ID NO: 231285 - DNA, 75 bp, Artificial Sequence
  Synthetic
ttcttcttcgacttttgccgcagtcagtgaccttgatcccgagtgtttagccccctttgcggtgtacctgatttt

SEQ ID NO: 231286 - DNA, 75 bp, Artificial Sequence
  Synthetic
agtgaccttgatcccgagtgtttagccccctttgcggtgtacctgattttcacatttgtgactgctacctgcgtc

SEQ ID NO: 231287 - DNA, 75 bp, Artificial Sequence
  Synthetic
cctcgctccaattttttgattactactacgtgagaattgtttaccgcagacaccacccccgttaccaaaaccctc

SEQ ID NO: 231288 - DNA, 75 bp, Artificial Sequence
  Synthetic
ctacgtgagaattgtttaccgcagacaccacccccgttaccaaaaccctcaaattgcggctcttttgcagctcca

SEQ ID NO: 231289 - DNA, 75 bp, Artificial Sequence
  Synthetic
tctttatgttaatcccagtttgggctagttcttgtcaactacataaaccatggaattttttagattgttatacta

SEQ ID NO: 231290 - DNA, 75 bp, Artificial Sequence
  Synthetic
tagttcttgtcaactacataaaccatggaattttttagattgttatactaaagaaacaaactacataggctgggt

SEQ ID NO: 231291 - DNA, 75 bp, Artificial Sequence
  Synthetic
tttgtctcctctgtagtttctttacaactgtatgcgcgccttaattttagttggaataagtatactgatgatctt

SEQ ID NO: 231292 - DNA, 75 bp, Artificial Sequence
  Synthetic
aactgtatgcgcgccttaattttagttggaataagtatactgatgatcttcccgaatatccaaacccccaggatg

SEQ ID NO: 231293 - DNA, 75 bp, Artificial Sequence
  Synthetic
agagcccccgcgtcctccttctgttgttagctattttaagttcaccggtgaagatgattgaacctgatctagaaa

SEQ ID NO: 231294 - DNA, 75 bp, Artificial Sequence
  Synthetic
gttagctattttaagttcaccggtgaagatgattgaacctgatctagaaattgatggaagaatcaccgaacagag

SEQ ID NO: 231295 - DNA, 75 bp, Artificial Sequence
  Synthetic
cgccaacaggatcaaaaaaataaagagttaattgatttacaaaccgtgcatcagtgtaaaaaaggacttttttgc

SEQ ID NO: 231296 - DNA, 75 bp, Artificial Sequence
  Synthetic
agttaattgatttacaaaccgtgcatcagtgtaaaaaaggacttttttgcctggtaaaacaagctacccttcgct

SEQ ID NO: 231297 - DNA, 75 bp, Artificial Sequence
  Synthetic
tcaactgtgctacacgctgcccactcagcgacaaacctttactgcaatggtgggctcggtacctattaaagtgtc

SEQ ID NO: 231298 - DNA, 75 bp, Artificial Sequence
  Synthetic
cagcgacaaacctttactgcaatggtgggctcggtacctattaaagtgtcccaacaagcaggagaacaagaaggc

SEQ ID NO: 231299 - DNA, 75 bp, Artificial Sequence
  Synthetic
ctgaatgtttgtacactttaataaaaacactgtgcggtttaagaaatcttttaccaatgaattaaataaattact

SEQ ID NO: 231300 - DNA, 75 bp, Artificial Sequence
  Synthetic
aacactgtgcggtttaagaaatcttttaccaatgaattaaataaattacttaccggaaatctgaaaatacatcat

SEQ ID NO: 231301 - DNA, 75 bp, Artificial Sequence
  Synthetic
tccctcttcccaactgtcaaacctgacagacttgcaaacagcaaactttctccaaatcttaaatggaaggtcaga

SEQ ID NO: 231302 - DNA, 75 bp, Artificial Sequence
  Synthetic
acagacttgcaaacagcaaactttctccaaatcttaaatggaaggtcagattcttcttcccaatccctacccacc

SEQ ID NO: 231303 - DNA, 75 bp, Artificial Sequence
  Synthetic
cagcagaacccagtatgctgaagaaacagaagaaaatgatgacttcaaccccgtttacccttttgacccatttga

SEQ ID NO: 231304 - DNA, 75 bp, Artificial Sequence
  Synthetic
acagaagaaaatgatgacttcaaccccgtttacccttttgacccatttgacacatcagacgtaccctttgttaca

SEQ ID NO: 231305 - DNA, 75 bp, Artificial Sequence
  Synthetic
ttcaagaaaaaccaccaggtgtattagcacttaattacaaagaccccattgtaactgaaaatggaacccttacac

SEQ ID NO: 231306 - DNA, 75 bp, Artificial Sequence
  Synthetic
agcacttaattacaaagaccccattgtaactgaaaatggaacccttacactcaagctaggggacggaataaaact

SEQ ID NO: 231307 - DNA, 75 bp, Artificial Sequence
  Synthetic
agtaataatatcaatgttttggagccccttaccaacacctcacaaggtcttaaactttcttggagcgccccccta

SEQ ID NO: 231308 - DNA, 75 bp, Artificial Sequence
  Synthetic
cccttaccaacacctcacaaggtcttaaactttcttggagcgcccccctagcagtaaaggctagtgccctcacac

SEQ ID NO: 231309 - DNA, 75 bp, Artificial Sequence
  Synthetic
aacggatgaaagcttagccttaataaccgcccctcccattacagtagagtcttcgcgtttgggcttggccaccat

SEQ ID NO: 231310 - DNA, 75 bp, Artificial Sequence
  Synthetic
accgcccctcccattacagtagagtcttcgcgtttgggcttggccaccatagcccctctaagcttagatggaggt

SEQ ID NO: 231311 - DNA, 75 bp, Artificial Sequence
  Synthetic
ctcccctggacgttagtaacaacaatttgcatctcaccactgaaactcccttagttgtaaattctagcggtgccc

SEQ ID NO: 231312 - DNA, 75 bp, Artificial Sequence
  Synthetic
tttgcatctcaccactgaaactcccttagttgtaaattctagcggtgccctatctgttgctactgcagaccccat

SEQ ID NO: 231313 - DNA, 75 bp, Artificial Sequence
  Synthetic
ctacctacggcagatccgttaatggtgagctccgatgggttgggaataagtgtcactagtcccattacagtaata

SEQ ID NO: 231314 - DNA, 75 bp, Artificial Sequence
  Synthetic
tgagctccgatgggttgggaataagtgtcactagtcccattacagtaataaacggttccttagccttgtctacaa

SEQ ID NO: 231315 - DNA, 75 bp, Artificial Sequence
  Synthetic
cactttaagtctgtctgttgccaatcctctgactatttcacaagacacattgactgtttccactggtaacggtct

SEQ ID NO: 231316 - DNA, 75 bp, Artificial Sequence
  Synthetic
cctctgactatttcacaagacacattgactgtttccactggtaacggtcttcaagtgtcggggtctcaattagta

SEQ ID NO: 231317 - DNA, 75 bp, Artificial Sequence
  Synthetic
tcgataatggggtcatgaaagtaaacgttgccgggggaatgagaacttctggcggtagaataattttagatgtta

SEQ ID NO: 231318 - DNA, 75 bp, Artificial Sequence
  Synthetic
cgttgccgggggaatgagaacttctggcggtagaataattttagatgttaattatccctttgatgcgagcaataa

SEQ ID NO: 231319 - DNA, 75 bp, Artificial Sequence
  Synthetic
ctaatttataaccaatctacaaactggaacttaacaactgatattagtaccgaaaaaggtttaatgtttagtggc

SEQ ID NO: 231320 - DNA, 75 bp, Artificial Sequence
  Synthetic
ggaacttaacaactgatattagtaccgaaaaaggtttaatgtttagtggcaatcaaatagctcttaatgcaggtc

SEQ ID NO: 231321 - DNA, 75 bp, Artificial Sequence
  Synthetic
acttagggttaagttgggagctggacttatttttgattcaaacaataacattgccttaggcagcagcagcaacac

SEQ ID NO: 231322 - DNA, 75 bp, Artificial Sequence
  Synthetic
cttatttttgattcaaacaataacattgccttaggcagcagcagcaacactccatacgaccctctgacactgtgg

SEQ ID NO: 231323 - DNA, 75 bp, Artificial Sequence
  Synthetic
gcagcctcatacaagagctagatgcaaaactcaccctgtgcttaacaaaaaacggatctattgttaatggcattg

SEQ ID NO: 231324 - DNA, 75 bp, Artificial Sequence
  Synthetic
aaaactcaccctgtgcttaacaaaaaacggatctattgttaatggcattgtaagtttagtgggtgttaagggtaa

SEQ ID NO: 231325 - DNA, 75 bp, Artificial Sequence
  Synthetic
accactgtaggagtgcatttagtgtttgatgaacagggaagattaatcacatcaacccctactgccctggttccc

SEQ ID NO: 231326 - DNA, 75 bp, Artificial Sequence
  Synthetic
ttgatgaacagggaagattaatcacatcaacccctactgccctggttccccaagcttcgtggggatatagacaag

SEQ ID NO: 231327 - DNA, 75 bp, Artificial Sequence
  Synthetic
taccaatggtctaggttttatgcctaatgtgagtgcttaccctagaccaaatgccagtgaggctaaaagccaaat

SEQ ID NO: 231328 - DNA, 75 bp, Artificial Sequence
  Synthetic
aatgtgagtgcttaccctagaccaaatgccagtgaggctaaaagccaaatggtaagtctcacgtacttacaggga

SEQ ID NO: 231329 - DNA, 75 bp, Artificial Sequence
  Synthetic
aagttgcatttaatggcattacgtcgctaaatggatactctttaacattcatgtggtcaggtctatcaaactata

SEQ ID NO: 231330 - DNA, 75 bp, Artificial Sequence
  Synthetic
gctaaatggatactctttaacattcatgtggtcaggtctatcaaactatataaatcagcctttctctacaccatc

SEQ ID NO: 231331 - DNA, 75 bp, Artificial Sequence
  Synthetic
gaataaaaacacacacaaaacacaaattgcgtacttattgtttatttttttttttttttacactatacgcgtggt

SEQ ID NO: 231332 - DNA, 75 bp, Artificial Sequence
  Synthetic
attgcgtacttattgtttatttttttttttttttacactatacgcgtggttaaactgcctccttcccattttacc

SEQ ID NO: 231333 - DNA, 75 bp, Artificial Sequence
  Synthetic
tagctgaaaacaactgcacttgaatatttcgacttaggttttttggcgttagcgtccacacagtttctttacggg

SEQ ID NO: 231334 - DNA, 75 bp, Artificial Sequence
  Synthetic
atttcgacttaggttttttggcgttagcgtccacacagtttctttacgggcaaagcgagggtcggtgatggaaac

SEQ ID NO: 231335 - DNA, 75 bp, Artificial Sequence
  Synthetic
aagcggcattccccatccaaaaccaggtccatgattttatcctacaaaaagtaacaacagtcagtgtccatcagc

SEQ ID NO: 231336 - DNA, 75 bp, Artificial Sequence
  Synthetic
ggtccatgattttatcctacaaaaagtaacaacagtcagtgtccatcagccgcccaaggattctctcgttgatta

SEQ ID NO: 231337 - DNA, 75 bp, Artificial Sequence
  Synthetic
gatgcataattaaaccctttagcagttgctgacgataacgttcatgccgactatgttttagagggcgaacagtgt

SEQ ID NO: 231338 - DNA, 75 bp, Artificial Sequence
  Synthetic
ttgctgacgataacgttcatgccgactatgttttagagggcgaacagtgttttcagcaattacttgaacaacttt

SEQ ID NO: 231339 - DNA, 75 bp, Artificial Sequence
  Synthetic
gcgcaacagcgcatgcgtatctcacttaagtctttacaataatcacaacacagcactaacatgttatttaaaatt

SEQ ID NO: 231340 - DNA, 75 bp, Artificial Sequence
  Synthetic
ttaagtctttacaataatcacaacacagcactaacatgttatttaaaattccataattaaaggcgctccatccaa

SEQ ID NO: 231341 - DNA, 75 bp, Artificial Sequence
  Synthetic
ggcatggccatcatacataattttaaagtaaattaaatggcgacctctaacaaaggtgcttcccacatacatcac

SEQ ID NO: 231342 - DNA, 75 bp, Artificial Sequence
  Synthetic
caaaggtgcttcccacatacatcacctctttaggcattaaatggttaacaacctcccgataccaaaaacaccttt

SEQ ID NO: 231343 - DNA, 75 bp, Artificial Sequence
  Synthetic
cattttgaaccagcgtcccaaaagcatcccagctgacatacactgtagtgaacccggacgctggcaatgacaatg

SEQ ID NO: 231344 - DNA, 75 bp, Artificial Sequence
  Synthetic
atcccagctgacatacactgtagtgaacccggacgctggcaatgacaatgaataagccaccgctcatgaccatgt

SEQ ID NO: 231345 - DNA, 75 bp, Artificial Sequence
  Synthetic
tagtggcacaacacatacatacactcatgtattttttcaaaataaacatctcataatcagttagaatcatatccc

SEQ ID NO: 231346 - DNA, 75 bp, Artificial Sequence
  Synthetic
catgtattttttcaaaataaacatctcataatcagttagaatcatatcccacggtattggccattcctgcagcac

SEQ ID NO: 231347 - DNA, 75 bp, Artificial Sequence
  Synthetic
cctcttacctcacttacattatgtaaagtcagactattacactcaggccataaagaattttccgaagtactcaac

SEQ ID NO: 231348 - DNA, 75 bp, Artificial Sequence
  Synthetic
aagtcagactattacactcaggccataaagaattttccgaagtactcaacgtagcttttgactgttcctcacagg

SEQ ID NO: 231349 - DNA, 75 bp, Artificial Sequence
  Synthetic
tgccaatctgtagcgataccgtctgtcgcgctgcatcgtaaacaacagacttgcgagcgtcttcgtacttaaaaa

SEQ ID NO: 231350 - DNA, 75 bp, Artificial Sequence
  Synthetic
tcgcgctgcatcgtaaacaacagacttgcgagcgtcttcgtacttaaaaaaacaaaaccacgtacgaccactggt

SEQ ID NO: 231351 - DNA, 75 bp, Artificial Sequence
  Synthetic
cagcgttggcgttccgtcaaaaaagcaaagtacaaccactctcgcaggcttgctaaaatgtattcagcttcaggt

SEQ ID NO: 231352 - DNA, 75 bp, Artificial Sequence
  Synthetic
gttatcttcaaatcatgatgtttaataaagcgcagagtatccacacaggatgcatgggctaaaccaagccatgct

SEQ ID NO: 231353 - DNA, 75 bp, Artificial Sequence
  Synthetic
caggaggaggaggaatacaaggtagaggcataaaaacttaatcaagacggtcagcaaggatttgaatgcgtaaat

SEQ ID NO: 231354 - DNA, 75 bp, Artificial Sequence
  Synthetic
aggcataaaaacttaatcaagacggtcagcaaggatttgaatgcgtaaatctcgcaggtggcagcgatcgcctcc

SEQ ID NO: 231355 - DNA, 75 bp, Artificial Sequence
  Synthetic
agatcaaattgtaagcgattttccaaatgttcaacaacagcttctaaaagagccacagctctgatttcgataaac

SEQ ID NO: 231356 - DNA, 75 bp, Artificial Sequence
  Synthetic
accgtgaatattaaaaagctctgtaagggcgccctccaccgccatccgcaggcagtacttcatatttgctgaaaa

SEQ ID NO: 231357 - DNA, 75 bp, Artificial Sequence
  Synthetic
agggcgccctccaccgccatccgcaggcagtacttcatatttgctgaaaaaagtctggatcttcaaacacctgca

SEQ ID NO: 231358 - DNA, 75 bp, Artificial Sequence
  Synthetic
catacaaatcagaagccagcagcaaagaaagttcacctccaggtacaagttccggagttcccacagaacatacaa

SEQ ID NO: 231359 - DNA, 75 bp, Artificial Sequence
  Synthetic
aagcgtggcgccaacgtagacatcgcgcataggaggagttaaataatgcattaccagcagccaaaactcaggtag

SEQ ID NO: 231360 - DNA, 75 bp, Artificial Sequence
  Synthetic
tccgtaaagactccggaaacaacacggagtaatgaacaagcgacctctgaaacatgctttaggttagcctgaaaa

SEQ ID NO: 231361 - DNA, 75 bp, Artificial Sequence
  Synthetic
ggagtaatgaacaagcgacctctgaaacatgctttaggttagcctgaaaaataaaaatatgttaaattaaagatg

SEQ ID NO: 231362 - DNA, 75 bp, Artificial Sequence
  Synthetic
tctacttaaaagcaagcgcgcgactggctgctttgcgcgaacatcgcaaaacacgtcggaatgattaaacaacaa

SEQ ID NO: 231363 - DNA, 75 bp, Artificial Sequence
  Synthetic
ggataaagcgtttcagcgccaacaaaaacccctctggcgttcatgtcgcataatgaaaacaatgttcccaaatat

SEQ ID NO: 231364 - DNA, 75 bp, Artificial Sequence
  Synthetic
gcaaatataaaagcacaactccatgtggaggtataacaaaattcgcaggagaaaataacacataagcattagagt

SEQ ID NO: 231365 - DNA, 75 bp, Artificial Sequence
  Synthetic
tggaggtataacaaaattcgcaggagaaaataacacataagcattagagtcgccctcttgtttaggcaacatagc

SEQ ID NO: 231366 - DNA, 75 bp, Artificial Sequence
  Synthetic
agagtctcaaaagcagccataatgccttaccagaaaaacagtacaaagccaggcacagcagacacaatctgccgc

SEQ ID NO: 231367 - DNA, 75 bp, Artificial Sequence
  Synthetic
atagtgacgtaaatggccaaagttcgcctacacaacacaaaaaaaaccccaaaagcccgcgaaaaaaatcacttc

SEQ ID NO: 231368 - DNA, 75 bp, Artificial Sequence
  Synthetic
gttctcacgacacgtcacatccggcgcgcccggctcccacgccgcgccccacttcctcatccgcccaaacttaca

SEQ ID NO: 231369 - DNA, 75 bp, Artificial Sequence
  Synthetic
caatcaaattacacactacgcccacttcattttaatattggcactagtccagtataaggtatattattagatagg

SEQ ID NO: 231370 - DNA, 75 bp, Artificial Sequence
  Synthetic
catcatcaataatataccttacactggacttgagccaatattaaaatgaagtgggcggagtgaatagttaattga

SEQ ID NO: 231371 - DNA, 75 bp, Artificial Sequence
  Synthetic
ggacttgagccaatattaaaatgaagtgggcggagtgaatagttaattgaccgtaggcgtggtttgcaagtttgc

SEQ ID NO: 231372 - DNA, 75 bp, Artificial Sequence
  Synthetic
gtgggcggagtgaatagttaattgaccgtaggcgtggtttgcaagtttgccgaagccggatgtgacgcgtgtggg

SEQ ID NO: 231373 - DNA, 75 bp, Artificial Sequence
  Synthetic
ttagtcgccatttttataggaaatgacatgttttttgggcgttgttgtgtaagttttgtgtttttggcggtaaaa

SEQ ID NO: 231374 - DNA, 75 bp, Artificial Sequence
  Synthetic
acatgttttttgggcgttgttgtgtaagttttgtgtttttggcggtaaaagtgatttgcggaagtgaaaactgtt

SEQ ID NO: 231375 - DNA, 75 bp, Artificial Sequence
  Synthetic
aatatttaccgagggcaaagtgaactttgagccactacgtggtggtttcgatacgtgagcgatagggaaactcca

SEQ ID NO: 231376 - DNA, 75 bp, Artificial Sequence
  Synthetic
tttgagccactacgtggtggtttcgatacgtgagcgatagggaaactccacgttggtgtccaaaggacacgttta

SEQ ID NO: 231377 - DNA, 75 bp, Artificial Sequence
  Synthetic
cccgctgcgtttgtcaagaggccactcttgagtgccagcgagaagagttttctctgcgagctgacatacggcgcc

SEQ ID NO: 231378 - DNA, 75 bp, Artificial Sequence
  Synthetic
tcttgagtgccagcgagaagagttttctctgcgagctgacatacggcgccattatgagaactgaaataactcctt

SEQ ID NO: 231379 - DNA, 75 bp, Artificial Sequence
  Synthetic
tgacatattggagcatttggtggagaacttttttaacgaggtacccagcgatgatgatttttatgttccctcgct

SEQ ID NO: 231380 - DNA, 75 bp, Artificial Sequence
  Synthetic
aacttttttaacgaggtacccagcgatgatgatttttatgttccctcgcttcacgaactgtatgatattgatgtg

SEQ ID NO: 231381 - DNA, 75 bp, Artificial Sequence
  Synthetic
aacaggctgtgaatgatttttttccggaatcgtttattttagctgctgctgaaggggtaatattaccggagcccc

SEQ ID NO: 231382 - DNA, 75 bp, Artificial Sequence
  Synthetic
ggaatcgtttattttagctgctgctgaaggggtaatattaccggagccccctgtgctttctcctatttgtgaacc

SEQ ID NO: 231383 - DNA, 75 bp, Artificial Sequence
  Synthetic
ttgtgttctgaagatatggatttgttgtgttatgaggcggcttttccctgtagcgactctgaaggtgagcaagac

SEQ ID NO: 231384 - DNA, 75 bp, Artificial Sequence
  Synthetic
tgtgttatgaggcggcttttccctgtagcgactctgaaggtgagcaagacgaaaacggaatggcgcatgtttctg

SEQ ID NO: 231385 - DNA, 75 bp, Artificial Sequence
  Synthetic
tagagaacgtgaggagtttcagttagaccatccggagttgcctggacatgattgtaagtcctgcgagtaccaccg

SEQ ID NO: 231386 - DNA, 75 bp, Artificial Sequence
  Synthetic
atgtgctctttgtgttatctgcgagcctacagcatgtttatttacagtaagtgcgctatttggacggtgggaggt

SEQ ID NO: 231387 - DNA, 75 bp, Artificial Sequence
  Synthetic
gacagcactacggatgacaatgagagaccgtcgcccccagaactgggagatgtagttccggaaggagtagtgaaa

SEQ ID NO: 231388 - DNA, 75 bp, Artificial Sequence
  Synthetic
gaccgtcgcccccagaactgggagatgtagttccggaaggagtagtgaaacctgtacctcagcgggtgactggga

SEQ ID NO: 231389 - DNA, 75 bp, Artificial Sequence
  Synthetic
ggatttgatccaagaggaagaatgtgaacaaacagtgcctgttgatttgtcagtgaaacgccctaaatgtaatta

SEQ ID NO: 231390 - DNA, 75 bp, Artificial Sequence
  Synthetic
gaacaaacagtgcctgttgatttgtcagtgaaacgccctaaatgtaattaatgaactttgcacacctggcaataa

SEQ ID NO: 231391 - DNA, 75 bp, Artificial Sequence
  Synthetic
ataataaactgtttgcgtgttttatttgggcgtggttagtaggcatataaaggtgggttggcgctgcctagcatg

SEQ ID NO: 231392 - DNA, 75 bp, Artificial Sequence
  Synthetic
ttgggcgtggttagtaggcatataaaggtgggttggcgctgcctagcatgagatactgaagaatggagctagaag

SEQ ID NO: 231393 - DNA, 75 bp, Artificial Sequence
  Synthetic
tcgtcagcttctgcagtatacctctaaaaacacttcaggtttttggagatatctgtttggttctactttaagcaa

SEQ ID NO: 231394 - DNA, 75 bp, Artificial Sequence
  Synthetic
aaaaacacttcaggtttttggagatatctgtttggttctactttaagcaaggtggtacatagggtgaaggaagat

SEQ ID NO: 231395 - DNA, 75 bp, Artificial Sequence
  Synthetic
tggccgactgtccagggcttttagcttcattagatctttgccaccactctgtttttcaggaaagagtggtcagat

SEQ ID NO: 231396 - DNA, 75 bp, Artificial Sequence
  Synthetic
ttcattagatctttgccaccactctgtttttcaggaaagagtggtcagatctttagatttttcatcttctggccg

SEQ ID NO: 231397 - DNA, 75 bp, Artificial Sequence
  Synthetic
gcaaccgtgttggataaatggagcgagaggtcccacctgagctgggattacatgctggattacatggcaatgcat

SEQ ID NO: 231398 - DNA, 75 bp, Artificial Sequence
  Synthetic
agaggtcccacctgagctgggattacatgctggattacatggcaatgcatttgtggagggcatggctgaagagga

SEQ ID NO: 231399 - DNA, 75 bp, Artificial Sequence
  Synthetic
gcctctaaccatgccgccgttgcaggaggagcagcagaacactacgacggaggagtaaacatggaaccacaggtg

SEQ ID NO: 231400 - DNA, 75 bp, Artificial Sequence
  Synthetic
gaggagcagcagaacactacgacggaggagtaaacatggaaccacaggtgcaagaaggccatgaacctgaccccg

SEQ ID NO: 231401 - DNA, 75 bp, Artificial Sequence
  Synthetic
taaaaagcgggaaagaaaagaaagtttaaaggaaactgtccttaataggctgactgttaacctaatgtctcgccc

SEQ ID NO: 231402 - DNA, 75 bp, Artificial Sequence
  Synthetic
ttaaaggaaactgtccttaataggctgactgttaacctaatgtctcgcccgcgcttggaaactgtatattggcag

SEQ ID NO: 231403 - DNA, 75 bp, Artificial Sequence
  Synthetic
gacacatgcatctacaatacaagtacagttttgagcagctaaaaacccactggctagaaccatgggaggatttag

SEQ ID NO: 231404 - DNA, 75 bp, Artificial Sequence
  Synthetic
cagttttgagcagctaaaaacccactggctagaaccatgggaggatttagagtgtgctattaaagcttttgctaa

SEQ ID NO: 231405 - DNA, 75 bp, Artificial Sequence
  Synthetic
tataaaatctctaagacagtaactattacgtcatgtacgtacattataggcaatggggcagtagttgaggtggac

SEQ ID NO: 231406 - DNA, 75 bp, Artificial Sequence
  Synthetic
ttacgtcatgtacgtacattataggcaatggggcagtagttgaggtggacactagtgatagagttgcttttaggt

SEQ ID NO: 231407 - DNA, 75 bp, Artificial Sequence
  Synthetic
ggtggtaggtttggatggcattacatttatgaatgttaggtttgctggagaaaaatttaagggcattatgtttga

SEQ ID NO: 231408 - DNA, 75 bp, Artificial Sequence
  Synthetic
tttatgaatgttaggtttgctggagaaaaatttaagggcattatgtttgaggctaacacaagtgttgtgttgcat

SEQ ID NO: 231409 - DNA, 75 bp, Artificial Sequence
  Synthetic
acacgtgtgtagagtgttggaataaggtttctgccaggggttgcactttttatgggtgttggaaggccttggtag

SEQ ID NO: 231410 - DNA, 75 bp, Artificial Sequence
  Synthetic
ggtttctgccaggggttgcactttttatgggtgttggaaggccttggtaggtaggcccaaaagtaaaatgtctgt

SEQ ID NO: 231411 - DNA, 75 bp, Artificial Sequence
  Synthetic
gtgcttgctttaattgtagaaggggatgctcacattagacataatgcagcttcagaaaatacctgttttattcta

SEQ ID NO: 231412 - DNA, 75 bp, Artificial Sequence
  Synthetic
ttcagaaaatacctgttttattctactgaagggaatggctattttaaagcacaatatggtttgcggggtgtctga

SEQ ID NO: 231413 - DNA, 75 bp, Artificial Sequence
  Synthetic
tgtgctgatggaaattgtcacactttgaaaactgttcatattgtgagtcatgctagatattgttggcctgtgtgt

SEQ ID NO: 231414 - DNA, 75 bp, Artificial Sequence
  Synthetic
gaccataacatgtttatgcgctgcacaatacatttgggtctccggcggggtgtgtttagaccttcccagtgtaac

SEQ ID NO: 231415 - DNA, 75 bp, Artificial Sequence
  Synthetic
agcccgaggcgttttccagagtgagtttaaatggggtgtttgatttatctgtggaattatgcaagattatcaggt

SEQ ID NO: 231416 - DNA, 75 bp, Artificial Sequence
  Synthetic
tttaaatggggtgtttgatttatctgtggaattatgcaagattatcaggtatgacgatgctgcccgtcatcgctg

SEQ ID NO: 231417 - DNA, 75 bp, Artificial Sequence
  Synthetic
catctagaacttcgccccgtcatgctgaatgtaactgaggagctaagaagtgaccatcttaccctgtcttgtctg

SEQ ID NO: 231418 - DNA, 75 bp, Artificial Sequence
  Synthetic
tgaatgtaactgaggagctaagaagtgaccatcttaccctgtcttgtctgcgaaccgactatgagtctagcgatg

SEQ ID NO: 231419 - DNA, 75 bp, Artificial Sequence
  Synthetic
gttatgtgggactataaaatgcttaaaggaattgtaaagttgtttttgttattttggcagcgcaatgaacggaac

SEQ ID NO: 231420 - DNA, 75 bp, Artificial Sequence
  Synthetic
aaggaattgtaaagttgtttttgttattttggcagcgcaatgaacggaactgctggggacaacgctgtgcttttt

SEQ ID NO: 231421 - DNA, 75 bp, Artificial Sequence
  Synthetic
tgacgtcaaggttaccgtattgggccggagtgcgtcagaatgtggtaggatctactccagacggacgacctgtag

SEQ ID NO: 231422 - DNA, 75 bp, Artificial Sequence
  Synthetic
cggagtgcgtcagaatgtggtaggatctactccagacggacgacctgtagcgcctgcaaattcgtcaacgttaac

SEQ ID NO: 231423 - DNA, 75 bp, Artificial Sequence
  Synthetic
ttggataccgccgccgccgctgcagcttctgcggcggcttgtacggctcgcaatatggcagctgattttagtctc

SEQ ID NO: 231424 - DNA, 75 bp, Artificial Sequence
  Synthetic
cttgagaccttaactgctcagctagaggagctgtcgcataaggttgaagaattagctgatgctaccactcccacc

SEQ ID NO: 231425 - DNA, 75 bp, Artificial Sequence
  Synthetic
aaaagctttaaattgtatgctgtttgactgtttattgatgtttgttttttctgacatggtaagctctggaccatc

SEQ ID NO: 231426 - DNA, 75 bp, Artificial Sequence
  Synthetic
gactgtttattgatgtttgttttttctgacatggtaagctctggaccatcgttccctatcattaagaacacggtg

SEQ ID NO: 231427 - DNA, 75 bp, Artificial Sequence
  Synthetic
tgggcttgtatgttaaggtacattggcataagaccatctgtgggatgcaggtaggaccactgtagggcttcttgc

SEQ ID NO: 231428 - DNA, 75 bp, Artificial Sequence
  Synthetic
gcataagaccatctgtgggatgcaggtaggaccactgtagggcttcttgctcaggggtggtgttgtaaataatcc

SEQ ID NO: 231429 - DNA, 75 bp, Artificial Sequence
  Synthetic
gtggtgaaatatatctttaagcaacaagctgattgctaagggaagacctttagtgtaggtatttataaagcggtt

SEQ ID NO: 231430 - DNA, 75 bp, Artificial Sequence
  Synthetic
tagtgtaggtatttataaagcggttaagctgggtggggtgcatacggggggacataatatgtagttttgattgta

SEQ ID NO: 231431 - DNA, 75 bp, Artificial Sequence
  Synthetic
cagatctctcctcggattcatgttgtggagaaccacaaaaacagtgtagccagtgcatttggggaatttatcatg

SEQ ID NO: 231432 - DNA, 75 bp, Artificial Sequence
  Synthetic
aatttggagacgcctttgtggcttcccagattttccatacactcatccattattatagcaattggcccgcaagca

SEQ ID NO: 231433 - DNA, 75 bp, Artificial Sequence
  Synthetic
gatcagaaacatcatagttgtggtctaacgttaaatcatcgtacgagagcttaacaaatttagggcagagcgttc

SEQ ID NO: 231434 - DNA, 75 bp, Artificial Sequence
  Synthetic
taacgttaaatcatcgtacgagagcttaacaaatttagggcagagcgttccggactgtgggataatggttccctg

SEQ ID NO: 231435 - DNA, 75 bp, Artificial Sequence
  Synthetic
caaatttgcatttcccaagatttaatttccgaaggcggaatcatgtccacttggggaacaataaaaaaaacagtt

SEQ ID NO: 231436 - DNA, 75 bp, Artificial Sequence
  Synthetic
tttccgaaggcggaatcatgtccacttggggaacaataaaaaaaacagtttctggagcaggtgtgaccagctggg

SEQ ID NO: 231437 - DNA, 75 bp, Artificial Sequence
  Synthetic
agatttcccacatccagtaggtccataaatcaccccaataactggctgcaagtgatagtttaacgaggtgcagct

SEQ ID NO: 231438 - DNA, 75 bp, Artificial Sequence
  Synthetic
taaatcaccccaataactggctgcaagtgatagtttaacgaggtgcagctgccgtcgtcgcggagaagcggagcc

SEQ ID NO: 231439 - DNA, 75 bp, Artificial Sequence
  Synthetic
gcatgttttgcttgacaagttccctgagaaggcgttcaccgcccaaggagagcaactcttgcaaagagttgaaag

SEQ ID NO: 231440 - DNA, 75 bp, Artificial Sequence
  Synthetic
tttttaatggtttcagaccgtcagccattggcatgtggtccagggtttgttttaacagttgcaagcggtcccata

SEQ ID NO: 231441 - DNA, 75 bp, Artificial Sequence
  Synthetic
tcgatccaacagacttcctcgttgcggggattgggctggctgttgctgtaaggaacaaggcgatgagcatccaag

SEQ ID NO: 231442 - DNA, 75 bp, Artificial Sequence
  Synthetic
ggggattgggctggctgttgctgtaaggaacaaggcgatgagcatccaagtgcaccagggttttgtccttccatg

SEQ ID NO: 231443 - DNA, 75 bp, Artificial Sequence
  Synthetic
ttcggtcacggtgaacggatgcgcccctggttgggcgctggccagcgtgcgctttaagctggtgcggctggtgct

SEQ ID NO: 231444 - DNA, 75 bp, Artificial Sequence
  Synthetic
gctttaagctggtgcggctggtgctgaagtgtgtgtcttctccctgtgcttcggcaaggtagcattttaacatga

SEQ ID NO: 231445 - DNA, 75 bp, Artificial Sequence
  Synthetic
gtgacctttagcccgtattttcccctttgaagtgctgccacaatcaggacactgaaggcatttaagggcgtacag

SEQ ID NO: 231446 - DNA, 75 bp, Artificial Sequence
  Synthetic
tttcggagccaaaaaaacagactctggagcgtaagcatctgcaccgcagttagcacaaacagtttcgcattccac

SEQ ID NO: 231447 - DNA, 75 bp, Artificial Sequence
  Synthetic
cgactccataaggcggcgtcctttctctgtgacaaaaagactgtctgtgtctccgtatacagatttaatgggtct

SEQ ID NO: 231448 - DNA, 75 bp, Artificial Sequence
  Synthetic
tcctcgtacagaaactctgaccactctgacacaaaggccctagtccaagccagtacaaacgaggccacatgggaa

SEQ ID NO: 231449 - DNA, 75 bp, Artificial Sequence
  Synthetic
ctgacacaaaggccctagtccaagccagtacaaacgaggccacatgggaagggtaccgatcgttactaattaaag

SEQ ID NO: 231450 - DNA, 75 bp, Artificial Sequence
  Synthetic
gcacatatcctcttcttcagcatctatgaatgtgattggtttgtaggtgtaagtcacgtgatcagagttccctgg

SEQ ID NO: 231451 - DNA, 75 bp, Artificial Sequence
  Synthetic
cactgatcttcatcgctgtcttcggcttcgctgtttacgagcgccagctgttgcggtgagtacgcgcgctgaaag

SEQ ID NO: 231452 - DNA, 75 bp, Artificial Sequence
  Synthetic
tatcagtttctataaacgatgaggatttgatgtgcaaacggcccgctgcaatttcttttatgagcccctcttcca

SEQ ID NO: 231453 - DNA, 75 bp, Artificial Sequence
  Synthetic
tttgatgtgcaaacggcccgctgcaatttcttttatgagcccctcttccatttgatcagaaaaaacaattttttt

SEQ ID NO: 231454 - DNA, 75 bp, Artificial Sequence
  Synthetic
ccgtacagggcgtttgaaagtaacttggctatagatcttagcgtttggtttttgtccctgtctgcccgttctttt

SEQ ID NO: 231455 - DNA, 75 bp, Artificial Sequence
  Synthetic
tggctatagatcttagcgtttggtttttgtccctgtctgcccgttcttttgcggcgatattgagttgtacatatt

SEQ ID NO: 231456 - DNA, 75 bp, Artificial Sequence
  Synthetic
aaaaacggtggtacgttcgtctggtaataatcgcagacgccacccgcgattatgcagtgtaactaagtctacact

SEQ ID NO: 231457 - DNA, 75 bp, Artificial Sequence
  Synthetic
tcattagtccaggctaaacgaccgccttttcgagagcaaaaaggaggaagaacatccagctggttctcgtctgga

SEQ ID NO: 231458 - DNA, 75 bp, Artificial Sequence
  Synthetic
caggacataaaattttatcaaaataatcaattttggaagtaagattttcaagtgccacctgccactgccgtacgg

SEQ ID NO: 231459 - DNA, 75 bp, Artificial Sequence
  Synthetic
aggaggaccccaaggcatagggtgtgtaagggctgatgcatacatgccacaaatatcatatacatatatgggttc

SEQ ID NO: 231460 - DNA, 75 bp, Artificial Sequence
  Synthetic
gtaagggctgatgcatacatgccacaaatatcatatacatatatgggttcctgtataacacctatataggtagga

SEQ ID NO: 231461 - DNA, 75 bp, Artificial Sequence
  Synthetic
cgcgaacatagtcgtatagttcgtgcgaaggcgccaaaaggttagggcctaaatgtgtgcgttttggtttctctg

SEQ ID NO: 231462 - DNA, 75 bp, Artificial Sequence
  Synthetic
cgcatgagagttagaggagatggtgggacgttgaaacacattgaagtgtgcctgctgaagacccaccgactgatt

SEQ ID NO: 231463 - DNA, 75 bp, Artificial Sequence
  Synthetic
ggacgttgaaacacattgaagtgtgcctgctgaagacccaccgactgattaacaaactgggcgtaggaactgcgc

SEQ ID NO: 231464 - DNA, 75 bp, Artificial Sequence
  Synthetic
cctgctgaagacccaccgactgattaacaaactgggcgtaggaactgcgcagtttttctaccaataaggtcgtaa

SEQ ID NO: 231465 - DNA, 75 bp, Artificial Sequence
  Synthetic
taaagtttccagaataagattgtaatttttttctcctttttttttccatagttcttggtttaggaggtattcctg

SEQ ID NO: 231466 - DNA, 75 bp, Artificial Sequence
  Synthetic
tttttttctcctttttttttccatagttcttggtttaggaggtattcctgtttatccttccaatactcctctaca

SEQ ID NO: 231467 - DNA, 75 bp, Artificial Sequence
  Synthetic
aagaaccaagcatgtaaaattgatttatggccttgtagggacaacaacctttttctacaggcagggcataagctt

SEQ ID NO: 231468 - DNA, 75 bp, Artificial Sequence
  Synthetic
tatggccttgtagggacaacaacctttttctacaggcagggcataagcttcagcggcctttcttaaagatgtatg

SEQ ID NO: 231469 - DNA, 75 bp, Artificial Sequence
  Synthetic
attacttttaaatactggtatttaaagtcctggtcgtcacatcctccttgctcccacagcaggaagtcagtgcgc

SEQ ID NO: 231470 - DNA, 75 bp, Artificial Sequence
  Synthetic
agtcctggtcgtcacatcctccttgctcccacagcaggaagtcagtgcgctttttgtagtaaggattagggagag

SEQ ID NO: 231471 - DNA, 75 bp, Artificial Sequence
  Synthetic
tttaccagctcttggaataaaatttctagagattttaaatggcgccggtacatctgaccgattgtttatgacctg

SEQ ID NO: 231472 - DNA, 75 bp, Artificial Sequence
  Synthetic
catctgaccgattgtttatgacctgcgcggcaagaactatttcatcaaatccattaatattgtgccccactatgt

SEQ ID NO: 231473 - DNA, 75 bp, Artificial Sequence
  Synthetic
ataactctagaaatcttggctgccccttgatgacaggagcttttttaagctgttcaaaggtcagatcgtcaggac

SEQ ID NO: 231474 - DNA, 75 bp, Artificial Sequence
  Synthetic
tgttcaaaggtcagatcgtcaggactaaccagaccattttgctgttgcgcccactgatgcaactgcggattgttt

SEQ ID NO: 231475 - DNA, 75 bp, Artificial Sequence
  Synthetic
tgtaaaaaagtattccagaggttagcggctaaagacgtttgcaagcgatttctgtaggtacggaattgctgaccg

SEQ ID NO: 231476 - DNA, 75 bp, Artificial Sequence
  Synthetic
accttcattttttctggggtaatacaatagaaagtagaggagtctttctcccattggtcccatccaagttctaag

SEQ ID NO: 231477 - DNA, 75 bp, Artificial Sequence
  Synthetic
ggctactgtccccagacagtttcattaccagcataaatggtacaagttgctttccaaacgagcccatccaggtgt

SEQ ID NO: 231478 - DNA, 75 bp, Artificial Sequence
  Synthetic
taccagcataaatggtacaagttgctttccaaacgagcccatccaggtgtaggtttctatgtcataggtaataaa

SEQ ID NO: 231479 - DNA, 75 bp, Artificial Sequence
  Synthetic
ccgaccgggaaaaactggatctcctgccaccagttggaagagtgggcgttaatgtggtggaagtagaaatctcgc

SEQ ID NO: 231480 - DNA, 75 bp, Artificial Sequence
  Synthetic
gccaccagttggaagagtgggcgttaatgtggtggaagtagaaatctcgccggcgagcagagcattcatgtcgat

SEQ ID NO: 231481 - DNA, 75 bp, Artificial Sequence
  Synthetic
gcatcgttgcatgggctgtatgtgttgaatgaggtgcacctgacgaccgcgcaccaaaaagcgcatgggaaaatg

SEQ ID NO: 231482 - DNA, 75 bp, Artificial Sequence
  Synthetic
gcaccaaaaagcgcatgggaaaatggatgccacttcttggcagttgccgttcgttgtcttcctgttctgttgcat

SEQ ID NO: 231483 - DNA, 75 bp, Artificial Sequence
  Synthetic
agtgacaacggaaagggtaacggcgcctcgaccgctgcacgtccatatttcggctcgagcggggctgaagcagga

SEQ ID NO: 231484 - DNA, 75 bp, Artificial Sequence
  Synthetic
cctcgaccgctgcacgtccatatttcggctcgagcggggctgaagcaggaaatcaaagcttgcagtctggaactg

SEQ ID NO: 231485 - DNA, 75 bp, Artificial Sequence
  Synthetic
gcgcgtctgcggggaaagcttgcaagttaacttcacaaaggcgggtaagagcaggccgtaggtgaaggtgatact

SEQ ID NO: 231486 - DNA, 75 bp, Artificial Sequence
  Synthetic
agaatctattgcgtgcagtgtgccgtaagcccgaggtgcaattactgttccgcggtgagcaacacgcctgcttaa

SEQ ID NO: 231487 - DNA, 75 bp, Artificial Sequence
  Synthetic
taagcccgaggtgcaattactgttccgcggtgagcaacacgcctgcttaaaagcgacggcgtgcaggaactggga

SEQ ID NO: 231488 - DNA, 75 bp, Artificial Sequence
  Synthetic
cgcggtgagcaacacgcctgcttaaaagcgacggcgtgcaggaactgggacttccgcttctgcgggagcttgagg

SEQ ID NO: 231489 - DNA, 75 bp, Artificial Sequence
  Synthetic
ggtagtggaaggtgctgagcccgtagttgactggcatgggcgacgacacgacgattgatgttctgaatttgccga

SEQ ID NO: 231490 - DNA, 75 bp, Artificial Sequence
  Synthetic
acgattgatgttctgaatttgccgacgttgtgtaaacaccactggtcccgttgttttgaacctgaaagaaagttc

SEQ ID NO: 231491 - DNA, 75 bp, Artificial Sequence
  Synthetic
actgcagcctgcctcaaaatttcctgaatatcccctgagttatcttggtaggcaatttctgccattagttgatca

SEQ ID NO: 231492 - DNA, 75 bp, Artificial Sequence
  Synthetic
atttcttcctcctggagatctccatgacccgctcgttcaatggtagctgcaaggtcattagatatgcgtcccata

SEQ ID NO: 231493 - DNA, 75 bp, Artificial Sequence
  Synthetic
tttcgttccagacgcggctgtacacaactcctccgtcgctgtctctggcacgcataaccacttgcgccaagttaa

SEQ ID NO: 231494 - DNA, 75 bp, Artificial Sequence
  Synthetic
gtagttgcgtaaacgctgaaacaggtagtttaaggtagtagctatgtgttctgaaacaaaaaaataaagaatcca

SEQ ID NO: 231495 - DNA, 75 bp, Artificial Sequence
  Synthetic
tagtttaaggtagtagctatgtgttctgaaacaaaaaaataaagaatccaccgacgaagcgtgagctcgttgatg

SEQ ID NO: 231496 - DNA, 75 bp, Artificial Sequence
  Synthetic
ctgaaacaaaaaaataaagaatccaccgacgaagcgtgagctcgttgatgtctcccagagcttccaaacgttcca

SEQ ID NO: 231497 - DNA, 75 bp, Artificial Sequence
  Synthetic
agtaaaaaactgggagtttcgagctgcaacagttaattcttcttctaaaagacgaataatttcagccaccgtgtg

SEQ ID NO: 231498 - DNA, 75 bp, Artificial Sequence
  Synthetic
gcaacagttaattcttcttctaaaagacgaataatttcagccaccgtgtggcgcacttcaagcgcgaaagcctcc

SEQ ID NO: 231499 - DNA, 75 bp, Artificial Sequence
  Synthetic
ctacttccattgtttcttcttgaaccgcgggcggagagggtagccttcttcgtcgccggcgaacgggcagcctgt

SEQ ID NO: 231500 - DNA, 75 bp, Artificial Sequence
  Synthetic
ttgtagggtaggaaatgcgttgcgaggtgcgtttggtagcgacacagcacttactatgcattttatgatttgttg

SEQ ID NO: 231501 - DNA, 75 bp, Artificial Sequence
  Synthetic
agcgactgcatatctactgggtcggaaaacctttcaaggaaggcgtcaatccagtcacagtcacaaggtaggcta

SEQ ID NO: 231502 - DNA, 75 bp, Artificial Sequence
  Synthetic
aaaacctttcaaggaaggcgtcaatccagtcacagtcacaaggtaggctaagttttgtttgctgtgaatcaccgg

SEQ ID NO: 231503 - DNA, 75 bp, Artificial Sequence
  Synthetic
gtaattaaaataggctgttttaagtctgcggatggttttaagaagcaccacgtcttttggtccggcttgttgaac

SEQ ID NO: 231504 - DNA, 75 bp, Artificial Sequence
  Synthetic
cgtcttttggtccggcttgttgaactcgcaggcggtctgccattccccacacactactttgacaacgtccaagat

SEQ ID NO: 231505 - DNA, 75 bp, Artificial Sequence
  Synthetic
ttccactggtatttcgcggtcttggcgatcagccatgtgcgttgcaccatagccttgtaatggttgcaataaagc

SEQ ID NO: 231506 - DNA, 75 bp, Artificial Sequence
  Synthetic
cgatcagccatgtgcgttgcaccatagccttgtaatggttgcaataaagctaaatctgcaactacccgttcagca

SEQ ID NO: 231507 - DNA, 75 bp, Artificial Sequence
  Synthetic
gagtattttcaaagtcatccatatctacaaagcggtggtaagctcctgtattaatggtgtaactgcagttggtca

SEQ ID NO: 231508 - DNA, 75 bp, Artificial Sequence
  Synthetic
cgtaagcgcgagtaagctcgagagtcaaaaacataatcgttgcaagcgcgcaccaaatactgatagcccactaga

SEQ ID NO: 231509 - DNA, 75 bp, Artificial Sequence
  Synthetic
caccaaatactgatagcccactagaaaatgaggaggaggttcttgatataacggccaccgaagtgtagccgccgc

SEQ ID NO: 231510 - DNA, 75 bp, Artificial Sequence
  Synthetic
accgggagcaaggtcttctaacatgaggcggtggtattcatatatgtatctggacatccacgtgatgccggcggc

SEQ ID NO: 231511 - DNA, 75 bp, Artificial Sequence
  Synthetic
aggcggtggtattcatatatgtatctggacatccacgtgatgccggcggcagtggttgttgcccgggcaaactgg

SEQ ID NO: 231512 - DNA, 75 bp, Artificial Sequence
  Synthetic
ggggtaaaaagcgttcaatggttgggacgctttgaccggtgaggcgtgcgcagtcttgaatgctctagatgtaaa

SEQ ID NO: 231513 - DNA, 75 bp, Artificial Sequence
  Synthetic
gacgctttgaccggtgaggcgtgcgcagtcttgaatgctctagatgtaaagaaaatgaaagtcggtaagcgactc

SEQ ID NO: 231514 - DNA, 75 bp, Artificial Sequence
  Synthetic
acaagggtaccacagcgaggaaccccggttcgaaaccggcaggatccgctgtgagcgtatatagggcgtctgcgc

SEQ ID NO: 231515 - DNA, 75 bp, Artificial Sequence
  Synthetic
cggttcgaaaccggcaggatccgctgtgagcgtatatagggcgtctgcgcgtagaacccagccaaagacccccag

SEQ ID NO: 231516 - DNA, 75 bp, Artificial Sequence
  Synthetic
ttttagatgcatcccgtcctgcgacagatgcgacctcaatccagggcacccacgccctcaggaccaatagcgctt

SEQ ID NO: 231517 - DNA, 75 bp, Artificial Sequence
  Synthetic
agatgcgacctcaatccagggcacccacgccctcaggaccaatagcgcttgggggctctggcgaacctgaagagc

SEQ ID NO: 231518 - DNA, 75 bp, Artificial Sequence
  Synthetic
agaaggcttagcccgtctgggcgctcactctcctgagcgacacccaagggtgcagcttactcgcgatagtcgtgc

SEQ ID NO: 231519 - DNA, 75 bp, Artificial Sequence
  Synthetic
ggacttaatcgcgagcgactgctacgagaagaagattttgagcctgatgaacgttctgggattagtcccgcgcga

SEQ ID NO: 231520 - DNA, 75 bp, Artificial Sequence
  Synthetic
acgttctgggattagtcccgcgcgagctcatgtttccgcggccaacttagtgtcagcctatgaacaaaccgttac

SEQ ID NO: 231521 - DNA, 75 bp, Artificial Sequence
  Synthetic
tttaataatcacgtgcgcacgctaattgcgcgtgaagaagtggctattggtttaatgcatctttgggactttgtg

SEQ ID NO: 231522 - DNA, 75 bp, Artificial Sequence
  Synthetic
tttaatgcatctttgggactttgtggaagcgtatgtacataatccagcaagcaaacctttgactgctcagctttt

SEQ ID NO: 231523 - DNA, 75 bp, Artificial Sequence
  Synthetic
aatgaaacatttagagacgcaatgcttaacattgctgagccacagggtcggtggctacttgatttaattaatatc

SEQ ID NO: 231524 - DNA, 75 bp, Artificial Sequence
  Synthetic
ttaacattgctgagccacagggtcggtggctacttgatttaattaatatcttgcaaagtattgtggttcaggaac

SEQ ID NO: 231525 - DNA, 75 bp, Artificial Sequence
  Synthetic
aggtactaacattgagcgacgatttgggagtataccgcaatgatcgaatccacaaagcggtgagcgcaagtcgtc

SEQ ID NO: 231526 - DNA, 75 bp, Artificial Sequence
  Synthetic
gggagtataccgcaatgatcgaatccacaaagcggtgagcgcaagtcgtcgaagagaacttagtgacaaggaact

SEQ ID NO: 231527 - DNA, 75 bp, Artificial Sequence
  Synthetic
atgatgatgatgatgacgaagaccagtacgaggactgaccgggccgtaccttttgttagatgcagcgaccggcta

SEQ ID NO: 231528 - DNA, 75 bp, Artificial Sequence
  Synthetic
ttttgttagatgcagcgaccggctatcatcacggacggggcccgtaacctggatcccgcggtctcggcggccatg

SEQ ID NO: 231529 - DNA, 75 bp, Artificial Sequence
  Synthetic
cttcagatgactggacagcggccatggatcgtattatggctttaacggcgcgcagtcctgaggcttttcgccagc

SEQ ID NO: 231530 - DNA, 75 bp, Artificial Sequence
  Synthetic
cgaactaatcccacccatgagaaagtgctaaccatagtgaacgctctgttggacagcaaagctatccgtaaagat

SEQ ID NO: 231531 - DNA, 75 bp, Artificial Sequence
  Synthetic
ttctggagcgcgtggcgcgctacaacagtaccaacgtacaggctaacttggaccggatgggtatggatgtaaagg

SEQ ID NO: 231532 - DNA, 75 bp, Artificial Sequence
  Synthetic
aagcacttgcgcaacgagagcgatttcatcgcgacggcaatcttggctccctggttgcgctaaatgcctttttaa

SEQ ID NO: 231533 - DNA, 75 bp, Artificial Sequence
  Synthetic
ccgtaaatttaagccaagcttttaagaatttgcaaggcctgtggggggtacgcgctcctgtgggtgatcgctcaa

SEQ ID NO: 231534 - DNA, 75 bp, Artificial Sequence
  Synthetic
ctgtctccagtctgttaacgccaaattctcgattattattgttgttaattgccccttttaccaacagcgatagtt

SEQ ID NO: 231535 - DNA, 75 bp, Artificial Sequence
  Synthetic
cttaattactttgtatcgcgaagccattggtcaagcgcaggtagatgagcaaacgtatcaagaaataaccagcgt

SEQ ID NO: 231536 - DNA, 75 bp, Artificial Sequence
  Synthetic
attggtcaagcgcaggtagatgagcaaacgtatcaagaaataaccagcgtgagtcgcgctctgggacaggaggat

SEQ ID NO: 231537 - DNA, 75 bp, Artificial Sequence
  Synthetic
actttttactaacaaaccgccgtcagcaagtgcctccgcaatacagtttgaatgcagaagaagagcgcatactgc

SEQ ID NO: 231538 - DNA, 75 bp, Artificial Sequence
  Synthetic
gcaagtgcctccgcaatacagtttgaatgcagaagaagagcgcatactgcgctacattcagcaatcagtgagctt

SEQ ID NO: 231539 - DNA, 75 bp, Artificial Sequence
  Synthetic
cccagtgccgctttagatatgactgcgcgcaacatggagccgtcattctactcttccaatagagcatttattaat

SEQ ID NO: 231540 - DNA, 75 bp, Artificial Sequence
  Synthetic
ctcttccaatagagcatttattaatcgtttaatggattaccttcaccgagccgcggccatgaacggagaatactt

SEQ ID NO: 231541 - DNA, 75 bp, Artificial Sequence
  Synthetic
tggttaccacctcctggtttttatactggagaatttgatttaccggagggaaacgatggctttttgtgggatgat

SEQ ID NO: 231542 - DNA, 75 bp, Artificial Sequence
  Synthetic
gttacagacagtctgttcagcccggcagccattggtcaccatggtaaaaaggagggagcagatgaaggtccgtta

SEQ ID NO: 231543 - DNA, 75 bp, Artificial Sequence
  Synthetic
ttcccagcctaagcagtattaacagcggtcgtacaacaagaccgaaactatcaggggaaagcgagtatttaaatg

SEQ ID NO: 231544 - DNA, 75 bp, Artificial Sequence
  Synthetic
cggtcgtacaacaagaccgaaactatcaggggaaagcgagtatttaaatgatcccctgttacgtccagcacgcga

SEQ ID NO: 231545 - DNA, 75 bp, Artificial Sequence
  Synthetic
gagagcttagtagacaaaatgtctcgttggaaaacgtatgcgcaagagcggcatgaatgggaagagagacaaccc

SEQ ID NO: 231546 - DNA, 75 bp, Artificial Sequence
  Synthetic
gttggaaaacgtatgcgcaagagcggcatgaatgggaagagagacaacccaaaccggtgccccctccgagacaac

SEQ ID NO: 231547 - DNA, 75 bp, Artificial Sequence
  Synthetic
gcatgcgcttgacgaaggaagcgatgactcagcagatgacagtagtgtgctagacctaggagggacagggaaccc

SEQ ID NO: 231548 - DNA, 75 bp, Artificial Sequence
  Synthetic
gactcagcagatgacagtagtgtgctagacctaggagggacagggaacccatttgctcatttgcgtccgcaaggt

SEQ ID NO: 231549 - DNA, 75 bp, Artificial Sequence
  Synthetic
aataaaagcactcttaccaaagccatggcgaccagcgttcgtcttatttgttttttccgttagctgcaaaatgag

SEQ ID NO: 231550 - DNA, 75 bp, Artificial Sequence
  Synthetic
tggcgaccagcgttcgtcttatttgttttttccgttagctgcaaaatgaggcgcgcggtggaactgcagacagtg

SEQ ID NO: 231551 - DNA, 75 bp, Artificial Sequence
  Synthetic
cttacgaaaccgtgatggcagcagctcaaacttccgcactggaagctccctacgtgcctccccgctatttggctc

SEQ ID NO: 231552 - DNA, 75 bp, Artificial Sequence
  Synthetic
tacgtgcctccccgctatttggctcctacggagggaagaaatagcattcgttattcagaattgtcaccgttatac

SEQ ID NO: 231553 - DNA, 75 bp, Artificial Sequence
  Synthetic
acaacaagtcttctgatatcgcttctttaaactaccaaaatgatcacagcaactttctaaccactgtagtccaaa

SEQ ID NO: 231554 - DNA, 75 bp, Artificial Sequence
  Synthetic
tttaaactaccaaaatgatcacagcaactttctaaccactgtagtccaaaacaacgactattcccctatagaagc

SEQ ID NO: 231555 - DNA, 75 bp, Artificial Sequence
  Synthetic
gaaaggtcccgatggggcggtgatttgaaaactattttgcatactaacatgcccaacgtaaatgattttatgttt

SEQ ID NO: 231556 - DNA, 75 bp, Artificial Sequence
  Synthetic
tgaaaactattttgcatactaacatgcccaacgtaaatgattttatgtttacaactaaatttaaggccagggtaa

SEQ ID NO: 231557 - DNA, 75 bp, Artificial Sequence
  Synthetic
agaccagtccaaagacattttgaaatacgagtgggcagaatttgtgttacccgaaggtaactactcggaaaccat

SEQ ID NO: 231558 - DNA, 75 bp, Artificial Sequence
  Synthetic
gactatcgacttaatgaacaacgcaatcatcgagcattacttgcgagttggccgtcagaacggtgtgctagaaag

SEQ ID NO: 231559 - DNA, 75 bp, Artificial Sequence
  Synthetic
agaaactttcgcctgggttgggaccccgaaactaaattagtgactccgggagtgtatactaacgaggcttttcat

SEQ ID NO: 231560 - DNA, 75 bp, Artificial Sequence
  Synthetic
ccgaaactaaattagtgactccgggagtgtatactaacgaggcttttcatccagatatagtattgctaccaggat

SEQ ID NO: 231561 - DNA, 75 bp, Artificial Sequence
  Synthetic
attaagcaacatgctgggaatcagaaaaagacagccttttcaggagggttttgttatcatgtatgaagacttaga

SEQ ID NO: 231562 - DNA, 75 bp, Artificial Sequence
  Synthetic
ttgttatcatgtatgaagacttagaagggggaaatatcccagcgcttttagatgttaaaaaatacgaagacagct

SEQ ID NO: 231563 - DNA, 75 bp, Artificial Sequence
  Synthetic
tgacaactttattgccttaaacaaggccgcaaaaatcgaagcagtcgaggctgattccaaaggccgaagttacaa

SEQ ID NO: 231564 - DNA, 75 bp, Artificial Sequence
  Synthetic
gccgcaaaaatcgaagcagtcgaggctgattccaaaggccgaagttacaacttgcttcccgacaaaaaaaatact

SEQ ID NO: 231565 - DNA, 75 bp, Artificial Sequence
  Synthetic
acaactatggagatccagaaaaaggtgttcgttcttggactcttctaacaaccccagacgtgacaggcggttccg

SEQ ID NO: 231566 - DNA, 75 bp, Artificial Sequence
  Synthetic
tgttcgttcttggactcttctaacaaccccagacgtgacaggcggttccgagcaggtctattggtcgcttcccga

SEQ ID NO: 231567 - DNA, 75 bp, Artificial Sequence
  Synthetic
cgctcctcgcgtcaagtcagcaactatccggtagttgcggccgaactaatgccggttcacgccaaaagcttctac

SEQ ID NO: 231568 - DNA, 75 bp, Artificial Sequence
  Synthetic
atccggtagttgcggccgaactaatgccggttcacgccaaaagcttctacaacgaacaagccgtctactcacagc

SEQ ID NO: 231569 - DNA, 75 bp, Artificial Sequence
  Synthetic
acacgtgtttaatcgctttcccgagaaccagatactagtgcgtccaccagctgctaccgtcactaccgtcagtga

SEQ ID NO: 231570 - DNA, 75 bp, Artificial Sequence
  Synthetic
cactgacgcccgccgccggacctgtccttacgtttacaaagcactgggcatagtttctccacgagtactttctag

SEQ ID NO: 231571 - DNA, 75 bp, Artificial Sequence
  Synthetic
catgtccatcttggtttcgccaagtaacaacacgggctggggattgggagctggccgcatgtacggaggagctaa

SEQ ID NO: 231572 - DNA, 75 bp, Artificial Sequence
  Synthetic
aacaacacgggctggggattgggagctggccgcatgtacggaggagctaaaaccaggtccagccaacatccagtt

SEQ ID NO: 231573 - DNA, 75 bp, Artificial Sequence
  Synthetic
catggggagcacatacccgcggacgcactggtcgcaccactgtggacgatgttatcgactcggtcgtagccgatg

SEQ ID NO: 231574 - DNA, 75 bp, Artificial Sequence
  Synthetic
cactggtcgcaccactgtggacgatgttatcgactcggtcgtagccgatgctcgaaaataccgtccaccagccaa

SEQ ID NO: 231575 - DNA, 75 bp, Artificial Sequence
  Synthetic
gtcattgatgaggtagtggcaaacgcacgagcttatgccagacgtcgcagaaggccgcgtcggcgccgacctact

SEQ ID NO: 231576 - DNA, 75 bp, Artificial Sequence
  Synthetic
aaggccgcgtcggcgccgacctactgctgctgtgcgtgcggctagagcgttagtgcgacgcgctagacgcgtcgg

SEQ ID NO: 231577 - DNA, 75 bp, Artificial Sequence
  Synthetic
aggcaagctgtaacgcctgccggtagagcgcggagacaggccgcagctgcggccgcaacagctattgccaaccta

SEQ ID NO: 231578 - DNA, 75 bp, Artificial Sequence
  Synthetic
gagcgcggagacaggccgcagctgcggccgcaacagctattgccaacctagccgctcccagacgaggaaatgtgt

SEQ ID NO: 231579 - DNA, 75 bp, Artificial Sequence
  Synthetic
gactcgagtcccggttcgtacgcgtccacctcacccttagaagacaaagagttgattgataacctgttatgtatg

SEQ ID NO: 231580 - DNA, 75 bp, Artificial Sequence
  Synthetic
ccacctcacccttagaagacaaagagttgattgataacctgttatgtatgcccagcatgaccaaacgcaagttca

SEQ ID NO: 231581 - DNA, 75 bp, Artificial Sequence
  Synthetic
gcctgaaatatacggcccagcggatcacattaccaagcgcgaaatcaagcatgttaaaaaactggaccaaaaaaa

SEQ ID NO: 231582 - DNA, 75 bp, Artificial Sequence
  Synthetic
agaggaagaaatggccgcagcgctagcggacgaagtcgacttcgtgcgctcctttgcgcccagacgtagaataca

SEQ ID NO: 231583 - DNA, 75 bp, Artificial Sequence
  Synthetic
gttttgcgacccggcactacaatagttttttctcctggggagcgaacggctatgcgccccctcaagcgcgaatac

SEQ ID NO: 231584 - DNA, 75 bp, Artificial Sequence
  Synthetic
ttttttctcctggggagcgaacggctatgcgccccctcaagcgcgaatacgatgaagtgtatgccgatgatgaca

SEQ ID NO: 231585 - DNA, 75 bp, Artificial Sequence
  Synthetic
tggtgaattcgcctatggaaaaagaagccgttacgacgacaaaattgctattcctttggacgagggaaatcccac

SEQ ID NO: 231586 - DNA, 75 bp, Artificial Sequence
  Synthetic
agccgttacgacgacaaaattgctattcctttggacgagggaaatcccacacccagtttaaaggctgtcacttta

SEQ ID NO: 231587 - DNA, 75 bp, Artificial Sequence
  Synthetic
cctcagaagaaaagcgaggcataaaaagggaagctatgaatgacttacagcccacaatgcaacttatggtgccca

SEQ ID NO: 231588 - DNA, 75 bp, Artificial Sequence
  Synthetic
aagggaagctatgaatgacttacagcccacaatgcaacttatggtgcccaagcggcaaaagttagaggacgtact

SEQ ID NO: 231589 - DNA, 75 bp, Artificial Sequence
  Synthetic
attcagccggacgtaaaaatacgtcccataaaaaaagttgccccaggattaggagtccaaacagtggacatccaa

SEQ ID NO: 231590 - DNA, 75 bp, Artificial Sequence
  Synthetic
ccataaaaaaagttgccccaggattaggagtccaaacagtggacatccaaattcccgtacaagctgcgcaaagta

SEQ ID NO: 231591 - DNA, 75 bp, Artificial Sequence
  Synthetic
aataaaaacagcagtggacagcggcatgcaaaccgagccttggtacccgccaacttttacaagaaaaaaacgcca

SEQ ID NO: 231592 - DNA, 75 bp, Artificial Sequence
  Synthetic
atgcaaaccgagccttggtacccgccaacttttacaagaaaaaaacgccactacaaacaaacaaacgcgctcttg

SEQ ID NO: 231593 - DNA, 75 bp, Artificial Sequence
  Synthetic
ttgtgcccacgccggggtatcgcgggtcaactttccagcgcagagccctagtttatagtcgcagaagaactccgt

SEQ ID NO: 231594 - DNA, 75 bp, Artificial Sequence
  Synthetic
gtcaactttccagcgcagagccctagtttatagtcgcagaagaactccgtcgcgacgcagacgtcgacgcagagc

SEQ ID NO: 231595 - DNA, 75 bp, Artificial Sequence
  Synthetic
cgcgttgtacgaaaagggcgcacactgacgcttccatctgtgcgttaccaccctagcatactctaataagctgcg

SEQ ID NO: 231596 - DNA, 75 bp, Artificial Sequence
  Synthetic
tgacgcttccatctgtgcgttaccaccctagcatactctaataagctgcgctgccgttttacagatggctcttac

SEQ ID NO: 231597 - DNA, 75 bp, Artificial Sequence
  Synthetic
ggatacagaggaagatctcatcggaggagagggctgaccgggaacggtcgatttcggcgacgtagcgcgcgcagg

SEQ ID NO: 231598 - DNA, 75 bp, Artificial Sequence
  Synthetic
cagatgctaagggacaagttaaaagaccagaacttccaacaaaaagtggtagacggtctggcttctggaatcaat

SEQ ID NO: 231599 - DNA, 75 bp, Artificial Sequence
  Synthetic
accagaacttccaacaaaaagtggtagacggtctggcttctggaatcaatggagttgtagacatagctaatcaag

SEQ ID NO: 231600 - DNA, 75 bp, Artificial Sequence
  Synthetic
tttagagccgcgacccgacgaagtaatggtagaggaaaagttaccgcctctggaaacggtgcccggatcagttcc

SEQ ID NO: 231601 - DNA, 75 bp, Artificial Sequence
  Synthetic
atggtagaggaaaagttaccgcctctggaaacggtgcccggatcagttccgtccaaaggagaaaagcggccgcgg

SEQ ID NO: 231602 - DNA, 75 bp, Artificial Sequence
  Synthetic
cgcacaccatagagcccccttcttatgaggaagcagttaaacaaggagcagctttggcacctactacttatccca

SEQ ID NO: 231603 - DNA, 75 bp, Artificial Sequence
  Synthetic
gctttggcacctactacttatcccatgaccaagcctattctacccatggctaccagggtgtatgggaaaaatgaa

SEQ ID NO: 231604 - DNA, 75 bp, Artificial Sequence
  Synthetic
ctcccttgccagaacctactgttgcggaacctgtggttactgctccgattgtttcaactgtatcgcgtccagaag

SEQ ID NO: 231605 - DNA, 75 bp, Artificial Sequence
  Synthetic
gactgggagtaaagtctttaaaacgcagacgctgctattaacattaacaaacatgtgttactccgtctgtatacg

SEQ ID NO: 231606 - DNA, 75 bp, Artificial Sequence
  Synthetic
aacaagtttaggaatcccactgtggctcccacccatgatgtcaccaccgaccgctcgcagcggttgacgctgcgt

SEQ ID NO: 231607 - DNA, 75 bp, Artificial Sequence
  Synthetic
ccgctcgcagcggttgacgctgcgttttgtgcccgtggatcgggaagatactgcttattcttacaaggctcgctt

SEQ ID NO: 231608 - DNA, 75 bp, Artificial Sequence
  Synthetic
ttgatattagaggggtgctggatcgcggtcccagttttaagccttattcgggtaccgcctataactctttagctc

SEQ ID NO: 231609 - DNA, 75 bp, Artificial Sequence
  Synthetic
atggctaactacaaacaatggcaacaaaactcacacttttgctcaagcgccttacataggagactctatcagtaa

SEQ ID NO: 231610 - DNA, 75 bp, Artificial Sequence
  Synthetic
aaaactcacacttttgctcaagcgccttacataggagactctatcagtaaagacggcattcaagttgggacaaac

SEQ ID NO: 231611 - DNA, 75 bp, Artificial Sequence
  Synthetic
atgccgacaaaacataccagccagaacctcaagtaggcgaaagtcaatggaacgcttcagtatctaacaatgcaa

SEQ ID NO: 231612 - DNA, 75 bp, Artificial Sequence
  Synthetic
acctcaagtaggcgaaagtcaatggaacgcttcagtatctaacaatgcaaaagcagcaggaagggtgttaaaaag

SEQ ID NO: 231613 - DNA, 75 bp, Artificial Sequence
  Synthetic
gggtcttatgcacgagcaacaaatgaaaaaggaggtcaatcaaaaaataacgacggtgtggaaatgcgatttttt

SEQ ID NO: 231614 - DNA, 75 bp, Artificial Sequence
  Synthetic
aaaaaggaggtcaatcaaaaaataacgacggtgtggaaatgcgattttttgcatccagtgcgaatgacaatcaaa

SEQ ID NO: 231615 - DNA, 75 bp, Artificial Sequence
  Synthetic
cgaggacgtaaacttagaggctcctgacacacacattgtttacaaaccagctgtaactgcggacactatcagttc

SEQ ID NO: 231616 - DNA, 75 bp, Artificial Sequence
  Synthetic
gacacacacattgtttacaaaccagctgtaactgcggacactatcagttcagaactcctcctaggacaacaagca

SEQ ID NO: 231617 - DNA, 75 bp, Artificial Sequence
  Synthetic
ccttcagagacaattttattgggcttatgtattacaacagcactggaaacatgggagtacttgcaggacaggctt

SEQ ID NO: 231618 - DNA, 75 bp, Artificial Sequence
  Synthetic
tatgtattacaacagcactggaaacatgggagtacttgcaggacaggcttctcagctcaatgcagtggttgatct

SEQ ID NO: 231619 - DNA, 75 bp, Artificial Sequence
  Synthetic
taccaacttatgttggatgctttaggcgatagaagccgttatttttccatgtggaattctgccgtcgacagctac

SEQ ID NO: 231620 - DNA, 75 bp, Artificial Sequence
  Synthetic
gcgatagaagccgttatttttccatgtggaattctgccgtcgacagctacgatccagacgtgcgaattattgaaa

SEQ ID NO: 231621 - DNA, 75 bp, Artificial Sequence
  Synthetic
caattactgttttccgttaggggctgtaggcgttgtgaattcatacaaaggtgtgaaacaaaatgacggaaatgg

SEQ ID NO: 231622 - DNA, 75 bp, Artificial Sequence
  Synthetic
ttgggtaaaagatgacagtgtagcagataccaatgacatagccaaaggtaatatatttgccatggaaattaactt

SEQ ID NO: 231623 - DNA, 75 bp, Artificial Sequence
  Synthetic
ctgtattcaaatgtggggctgtacctgcctgacgacttgaaatacacccccgggaacataaaacttccagaaaac

SEQ ID NO: 231624 - DNA, 75 bp, Artificial Sequence
  Synthetic
cgggaacataaaacttccagaaaacaaaaacacctacgagtacatgaacgggcgcgtgactgttcccggtctggt

SEQ ID NO: 231625 - DNA, 75 bp, Artificial Sequence
  Synthetic
cgctggtctcctgacgtaatggataacataaacccttttaaccaccaccgaaacgcagggttgcgctataggtcc

SEQ ID NO: 231626 - DNA, 75 bp, Artificial Sequence
  Synthetic
acataaacccttttaaccaccaccgaaacgcagggttgcgctataggtccatgttactgggcaacggtagatttg

SEQ ID NO: 231627 - DNA, 75 bp, Artificial Sequence
  Synthetic
gaaatttttcgctattaagaatttgctgctgttaccagggtcctacacttacgagtggaacttcagaaaagatgt

SEQ ID NO: 231628 - DNA, 75 bp, Artificial Sequence
  Synthetic
ctgctgttaccagggtcctacacttacgagtggaacttcagaaaagatgtaaacatgatacttcagagcaccctg

SEQ ID NO: 231629 - DNA, 75 bp, Artificial Sequence
  Synthetic
ccagcattcgctttgacaacattgccctgtatgcaaacttcttccccatggctcacaatacagcttctacattgg

SEQ ID NO: 231630 - DNA, 75 bp, Artificial Sequence
  Synthetic
cctgtatgcaaacttcttccccatggctcacaatacagcttctacattggaagccatgctgcgaaatgacaccaa

SEQ ID NO: 231631 - DNA, 75 bp, Artificial Sequence
  Synthetic
tgcgcggcgaacatgttgtatcccattccagcaaatgccaccagcgtgcccatttcaataccttcgcgaaattgg

SEQ ID NO: 231632 - DNA, 75 bp, Artificial Sequence
  Synthetic
gcagccttcagagggtggagttttactcgccttaaaactaaagagacaccttctcttggttcagggtttgacccc

SEQ ID NO: 231633 - DNA, 75 bp, Artificial Sequence
  Synthetic
cctacctggacgggactttttacctgaaccacacttttaaaaaggtgtcaatcatgtttgactcctctgttagct

SEQ ID NO: 231634 - DNA, 75 bp, Artificial Sequence
  Synthetic
accaaatgaatttgaaataaaacgttctgtagacggggaaggctacaatgtggcccaatgtaatatgaccaaaga

SEQ ID NO: 231635 - DNA, 75 bp, Artificial Sequence
  Synthetic
cattataatattggataccagggtttttacgttccagagagctacaaagaccgcatgtattctttcttcagaaac

SEQ ID NO: 231636 - DNA, 75 bp, Artificial Sequence
  Synthetic
tttacgttccagagagctacaaagaccgcatgtattctttcttcagaaactttcagcccatgagcaggcaggttg

SEQ ID NO: 231637 - DNA, 75 bp, Artificial Sequence
  Synthetic
taaaaaagtaaccgtggaattccagcataacaactcagggtttgtgggatacctgggtcctactatgcgcgaggg

SEQ ID NO: 231638 - DNA, 75 bp, Artificial Sequence
  Synthetic
cataacaactcagggtttgtgggatacctgggtcctactatgcgcgagggacaagcttatcccgcaaactacccc

SEQ ID NO: 231639 - DNA, 75 bp, Artificial Sequence
  Synthetic
tacaaagcgtcacacaaaaaaagtttctctgtgaccgtgtgatgtggcgcattccattttctagcaattttatgt

SEQ ID NO: 231640 - DNA, 75 bp, Artificial Sequence
  Synthetic
gcaaaatatgctgtatgcaaattcggcccatgcgttagatatgacatttgaagttgaccccatggaagagcccac

SEQ ID NO: 231641 - DNA, 75 bp, Artificial Sequence
  Synthetic
gcccatgcgttagatatgacatttgaagttgaccccatggaagagcccacccttctttatgttttgtttgaagtt

SEQ ID NO: 231642 - DNA, 75 bp, Artificial Sequence
  Synthetic
aagttgaccccatggaagagcccacccttctttatgttttgtttgaagttttcgacgtggtgcgcattcatcaac

SEQ ID NO: 231643 - DNA, 75 bp, Artificial Sequence
  Synthetic
ctatctgcgcacacccttctccgcgggtaacgccaccacctaaagaaggcactttcccagatcgctgtaatgggt

SEQ ID NO: 231644 - DNA, 75 bp, Artificial Sequence
  Synthetic
actttcccagatcgctgtaatgggttcaagcgaacaggagctgacggcgattgttcgagatctaggctgtggacc

SEQ ID NO: 231645 - DNA, 75 bp, Artificial Sequence
  Synthetic
accgcttatcatgcgctattgttaacactgccggtcgcgaaactgggggcgtacactggctggcctttgcatgga

SEQ ID NO: 231646 - DNA, 75 bp, Artificial Sequence
  Synthetic
attcgatccatttggattctctgatcagcggttaaaacaaatctatcagtttgagtacgaaagtctgttgcgccg

SEQ ID NO: 231647 - DNA, 75 bp, Artificial Sequence
  Synthetic
tcccactatgaatctactaactggggttccaaatagtatgttacaaagtccgcaggtggaggacacactgcggag

SEQ ID NO: 231648 - DNA, 75 bp, Artificial Sequence
  Synthetic
cgcaggtggaggacacactgcggaggaatcagcaagaactatatattttcttaaacaaattgtcaccttactttc

SEQ ID NO: 231649 - DNA, 75 bp, Artificial Sequence
  Synthetic
ttaaacaaattgtcaccttactttcgcaacaaccgccagcgcatagaaaaagccacctctttcactaaaatgaaa

SEQ ID NO: 231650 - DNA, 75 bp, Artificial Sequence
  Synthetic
aattgatacaaatacacatgtacgtaatgcattaataaacaattttattagagaattgattacaagactgttttt

SEQ ID NO: 231651 - DNA, 75 bp, Artificial Sequence
  Synthetic
gttggtgggcagggctatgtttctatactgcaaacgtggatgccacttgaactctggaataacaagcctaggaag

SEQ ID NO: 231652 - DNA, 75 bp, Artificial Sequence
  Synthetic
agctgtcgcacaagctgcaatgcacccatgacatcaggagctgatatcttgaagtcgcaattaggaccggcgtta

SEQ ID NO: 231653 - DNA, 75 bp, Artificial Sequence
  Synthetic
gaagtcgcaattaggaccggcgttaccgcgggcattgcgataaactggatttgcgcactgaaaaaccagcaaaca

SEQ ID NO: 231654 - DNA, 75 bp, Artificial Sequence
  Synthetic
ccagggtcgctgacttcgttaacgtcgatgttttcaacattgctgaggttaaatggagtaattttacacagctga

SEQ ID NO: 231655 - DNA, 75 bp, Artificial Sequence
  Synthetic
gcttgtttaaacattcacaacgaactggcatcaggaaccgcttctgcccctgtcgcatgtgagggtagtcggcca

SEQ ID NO: 231656 - DNA, 75 bp, Artificial Sequence
  Synthetic
agccatttgagccttcgttccttctgaataaaacaaaccgcatgactttccggaaaaagaattattcccgcagcc

SEQ ID NO: 231657 - DNA, 75 bp, Artificial Sequence
  Synthetic
agagctcgctgcccgctctcgctggttacatccatctctatcaagtgctctttgcgcaccatttccatgccgtgc

SEQ ID NO: 231658 - DNA, 75 bp, Artificial Sequence
  Synthetic
tttgcgcaccatttccatgccgtgcaggcatctaagctccccttcgcgttcagtgcactggtgctcccatacaca

SEQ ID NO: 231659 - DNA, 75 bp, Artificial Sequence
  Synthetic
tgttgaacaccggcataggcttgcatatatccttgtaggaagcgtcccataagctcctgaaaggttttctgggat

SEQ ID NO: 231660 - DNA, 75 bp, Artificial Sequence
  Synthetic
tatatccttgtaggaagcgtcccataagctcctgaaaggttttctgggatgaaaaagttagctgcaacccgcgtt

SEQ ID NO: 231661 - DNA, 75 bp, Artificial Sequence
  Synthetic
aatttttttgtacaccgctccctgatctggcaaaaacctaaagctggcacgctcgtcgtgatccacatggtactt

SEQ ID NO: 231662 - DNA, 75 bp, Artificial Sequence
  Synthetic
tctggcaaaaacctaaagctggcacgctcgtcgtgatccacatggtacttctccatcagcatagccattgcctcc

SEQ ID NO: 231663 - DNA, 75 bp, Artificial Sequence
  Synthetic
gaggctcgctcgtggggttgcgaactattactacgcctttttgttctttgccttccatgttttgagcagcggcct

SEQ ID NO: 231664 - DNA, 75 bp, Artificial Sequence
  Synthetic
cattttttgaaaagactgagaaccgtctgcatgatgcataatgcgaacaggaggcatgctgaaacccatgactcc

SEQ ID NO: 231665 - DNA, 75 bp, Artificial Sequence
  Synthetic
tcttcttctttttcgctctccggagatagagggatggtagccatggacctcctggcttttttctttggaggcaaa

SEQ ID NO: 231666 - DNA, 75 bp, Artificial Sequence
  Synthetic
tgctgccatggaaaagaacaaatgtctactcataccccaagatgcaccgcttgcgcaggactcgggctacgtgac

SEQ ID NO: 231667 - DNA, 75 bp, Artificial Sequence
  Synthetic
tcgcgacgccgtagctgaccgctctttattgccagtctcaatcgcggaactttcttgcgcatacgaacgcaacct

SEQ ID NO: 231668 - DNA, 75 bp, Artificial Sequence
  Synthetic
cgacaagccaatggtacctgcgaaccaaatcctcggctgaacttttacccggtttttgcgataccagaagctctg

SEQ ID NO: 231669 - DNA, 75 bp, Artificial Sequence
  Synthetic
atcatagaatacctctgtcttgccgagccaaccgcagtcgcgcagataagctccttacccttagcggtggtgctt

SEQ ID NO: 231670 - DNA, 75 bp, Artificial Sequence
  Synthetic
ccatacctggtatagtgtccttggaagaggtgcctcggattttcgaaggcttggatcgcgatgaaaagcgagcag

SEQ ID NO: 231671 - DNA, 75 bp, Artificial Sequence
  Synthetic
gcaaaatcaaagtgcgctcatagaactagaaggtgacaatgcccgtttggccattttaaaacgcaatgttgaagt

SEQ ID NO: 231672 - DNA, 75 bp, Artificial Sequence
  Synthetic
ctagaaggtgacaatgcccgtttggccattttaaaacgcaatgttgaagtaactcacttcgcatacccggcagtg

SEQ ID NO: 231673 - DNA, 75 bp, Artificial Sequence
  Synthetic
cagtaatgaatcaactactaattaagcgcgctcagcccattgacaaagatgcaaacttgcaagattcagaggcat

SEQ ID NO: 231674 - DNA, 75 bp, Artificial Sequence
  Synthetic
gcgcgctcagcccattgacaaagatgcaaacttgcaagattcagaggcatcagatgatggaaaaccagttgtaag

SEQ ID NO: 231675 - DNA, 75 bp, Artificial Sequence
  Synthetic
ggaacagacaaccccgccaaactacagcagcggcgtaaacaaatgatggcggcagtacttgtaacggtggaactg

SEQ ID NO: 231676 - DNA, 75 bp, Artificial Sequence
  Synthetic
agcagcggcgtaaacaaatgatggcggcagtacttgtaacggtggaactggagtgcatgcaccgttttttttcca

SEQ ID NO: 231677 - DNA, 75 bp, Artificial Sequence
  Synthetic
agaatgtctccactacacctttcggcatggttatgtgcgccaagcctgcaaaatttccaatgtggagctaagcaa

SEQ ID NO: 231678 - DNA, 75 bp, Artificial Sequence
  Synthetic
aaatttccaatgtggagctaagcaaccttatctcatacatgggtattttgcacgaaaacagattgggacaaaatg

SEQ ID NO: 231679 - DNA, 75 bp, Artificial Sequence
  Synthetic
agcgcgcagagattacgtgcgggactgtgtttatctttttttgctacatacttggcaaaccggaatgggggtgtg

SEQ ID NO: 231680 - DNA, 75 bp, Artificial Sequence
  Synthetic
ctcagagaactcaacaaactgcttgacagagcgttgaaatcattatggacaggttttgacgagagaacggtagcg

SEQ ID NO: 231681 - DNA, 75 bp, Artificial Sequence
  Synthetic
cagaaaggctcatgataaccttgcaaaatggtctgcctgactttatgagtcaaagtatgctgcataattaccgtt

SEQ ID NO: 231682 - DNA, 75 bp, Artificial Sequence
  Synthetic
aaatggtctgcctgactttatgagtcaaagtatgctgcataattaccgttcttttatattggagcgatctggctt

SEQ ID NO: 231683 - DNA, 75 bp, Artificial Sequence
  Synthetic
ccttcagattttgtgcccattcattttagagaatgtccccctcctctgtggagtcactgctacttgttcaaactt

SEQ ID NO: 231684 - DNA, 75 bp, Artificial Sequence
  Synthetic
tttgaaatgcaaggaccgcactctgatagcaatctcaccacaaacctgaggctgacacctggcctttggacttcc

SEQ ID NO: 231685 - DNA, 75 bp, Artificial Sequence
  Synthetic
atagcaatctcaccacaaacctgaggctgacacctggcctttggacttccgcttacctgcgcaaatttgaacccc

SEQ ID NO: 231686 - DNA, 75 bp, Artificial Sequence
  Synthetic
tttttatgaagatcagttaaagccccctaaagcgccactaacggcctgcgtcattacgcagggaaaaattttagc

SEQ ID NO: 231687 - DNA, 75 bp, Artificial Sequence
  Synthetic
cctaaagcgccactaacggcctgcgtcattacgcagggaaaaattttagcccaattacaagccattaaacaagcg

SEQ ID NO: 231688 - DNA, 75 bp, Artificial Sequence
  Synthetic
gacgcggagtgtaccttgacccccagaccggcgaggaactgaaccttccatcacctctgtgtgctactgcatcct

SEQ ID NO: 231689 - DNA, 75 bp, Artificial Sequence
  Synthetic
gaccggcgaggaactgaaccttccatcacctctgtgtgctactgcatcctctccccattcgcagcatgtccccga

SEQ ID NO: 231690 - DNA, 75 bp, Artificial Sequence
  Synthetic
gcaacgctcaaagaagcagctacaacagcaggaaatctgggaggaagattcttgggacagtcaggcacaggagga

SEQ ID NO: 231691 - DNA, 75 bp, Artificial Sequence
  Synthetic
cagcaggaaatctgggaggaagattcttgggacagtcaggcacaggaggaccaggacttggaagaatgggaggag

SEQ ID NO: 231692 - DNA, 75 bp, Artificial Sequence
  Synthetic
aggacggttccaaggacggagcgaccgccgcaaaaccgtcgctttcaaccgaaccctctccagtgaaacacactg

SEQ ID NO: 231693 - DNA, 75 bp, Artificial Sequence
  Synthetic
cgccgcaaaaccgtcgctttcaaccgaaccctctccagtgaaacacactgtcaacaaatctcagaaagcgagccg

SEQ ID NO: 231694 - DNA, 75 bp, Artificial Sequence
  Synthetic
gtcgtaaacatgggtaagaaatgcaagcaggtgcggcggggctactgctcatggcgggctcataaaagtaatatc

SEQ ID NO: 231695 - DNA, 75 bp, Artificial Sequence
  Synthetic
agcaggtgcggcggggctactgctcatggcgggctcataaaagtaatatcatagcctgcttgcaacactgcgggg

SEQ ID NO: 231696 - DNA, 75 bp, Artificial Sequence
  Synthetic
tctgctctttcacgatggagtggcaattcctaggaatgttctccattactaccgtcatctctacagccccttcga

SEQ ID NO: 231697 - DNA, 75 bp, Artificial Sequence
  Synthetic
attcctaggaatgttctccattactaccgtcatctctacagccccttcgaagagatccacaaagaatcgacgtct

SEQ ID NO: 231698 - DNA, 75 bp, Artificial Sequence
  Synthetic
accggcagcagcaacaaggaaagtccagaggcgcgcgagttaagaaaacgcatttttcccactctatatgctatt

SEQ ID NO: 231699 - DNA, 75 bp, Artificial Sequence
  Synthetic
tttcagcagagccgaggccaagaacacgaactgaaaataaaaaacagatccctccgttcacttacccgcagctgt

SEQ ID NO: 231700 - DNA, 75 bp, Artificial Sequence
  Synthetic
gatgagtaaagatattcccacgccttacatgtggagttttcaacctcaaatggggctagcggcgggtgcggctca

SEQ ID NO: 231701 - DNA, 75 bp, Artificial Sequence
  Synthetic
tacatgtggagttttcaacctcaaatggggctagcggcgggtgcggctcaagactattctactaaaatgaattgg

SEQ ID NO: 231702 - DNA, 75 bp, Artificial Sequence
  Synthetic
cccaagtaaatggaattcgcgcccggcgaaaccaaatgctactacaacaagccgctctcaccgctacaccgcgta

SEQ ID NO: 231703 - DNA, 75 bp, Artificial Sequence
  Synthetic
gcgaaaccaaatgctactacaacaagccgctctcaccgctacaccgcgtaaccagcttaacccaccctcttggcc

SEQ ID NO: 231704 - DNA, 75 bp, Artificial Sequence
  Synthetic
ccccctccaacaacggtacttttgcctcgcgacgcccaggccgaagtccgcatgactaatgctggcgcacaactc

SEQ ID NO: 231705 - DNA, 75 bp, Artificial Sequence
  Synthetic
ctcgcgacgcccaggccgaagtccgcatgactaatgctggcgcacaactcgcgggcggcgcacgtcatagtttca

SEQ ID NO: 231706 - DNA, 75 bp, Artificial Sequence
  Synthetic
ctcatcttctgctataaaaacaatacgcattagaggaaaaggtattcagctgaacgacgaggcaacatcgccact

SEQ ID NO: 231707 - DNA, 75 bp, Artificial Sequence
  Synthetic
cgcattagaggaaaaggtattcagctgaacgacgaggcaacatcgccactgggactcaggcccgacggagtgttt

SEQ ID NO: 231708 - DNA, 75 bp, Artificial Sequence
  Synthetic
ccttcactactcgtcaagcctacctaacacttcagagttcgtcaacagctccaagatccggcgggattggaactc

SEQ ID NO: 231709 - DNA, 75 bp, Artificial Sequence
  Synthetic
aacacttcagagttcgtcaacagctccaagatccggcgggattggaactcttcaatttgtggaggaatttactcc

SEQ ID NO: 231710 - DNA, 75 bp, Artificial Sequence
  Synthetic
ggctcgcctggacactatcctgacgccttcatacccaactttgacgccgtgagcgaatctgtggatggttatgat

SEQ ID NO: 231711 - DNA, 75 bp, Artificial Sequence
  Synthetic
ccttcatacccaactttgacgccgtgagcgaatctgtggatggttatgattaatgtctaatggagcggccgacag

SEQ ID NO: 231712 - DNA, 75 bp, Artificial Sequence
  Synthetic
tgtcgccaacctcgctgctttgctcgagacatctgcgagtttacttactttgagctgccagaggaacaccctcag

SEQ ID NO: 231713 - DNA, 75 bp, Artificial Sequence
  Synthetic
tgagctgccagaggaacaccctcagggaccagctcacggcgtaaggataacagttgaaaaaggaattgatacaca

SEQ ID NO: 231714 - DNA, 75 bp, Artificial Sequence
  Synthetic
ccgctattggttgaaaaggatcaagggaatactgtactaactctatattgcatttgtcctgcccccggattacat

SEQ ID NO: 231715 - DNA, 75 bp, Artificial Sequence
  Synthetic
ggaatactgtactaactctatattgcatttgtcctgcccccggattacatgaagatttttgctgtcatttgtgtg

SEQ ID NO: 231716 - DNA, 75 bp, Artificial Sequence
  Synthetic
gtttaccgcctgaagaagaacctaactgtcatccgcctcttagtaacattaaaattaacctttcaatctctgaca

SEQ ID NO: 231717 - DNA, 75 bp, Artificial Sequence
  Synthetic
aaaattaacctttcaatctctgacattactcttcgctgcaattttttctccacccatctcacctggagttttaac

SEQ ID NO: 231718 - DNA, 75 bp, Artificial Sequence
  Synthetic
taaagtttcagctacacaaagaaaacatcactttatttgcacctattcacctgggatactaccgctgcgcagctc

SEQ ID NO: 231719 - DNA, 75 bp, Artificial Sequence
  Synthetic
catcactttatttgcacctattcacctgggatactaccgctgcgcagctccaccctgtcagcaagccttttttgt

SEQ ID NO: 231720 - DNA, 75 bp, Artificial Sequence
  Synthetic
gctacaacaacacctgtcactcggcaaaacatccagacgacttctcctactaaaggtatagaggaaattgtgtac

SEQ ID NO: 231721 - DNA, 75 bp, Artificial Sequence
  Synthetic
aaaacatccagacgacttctcctactaaaggtatagaggaaattgtgtacttttcaaactttacaaaccacttac

SEQ ID NO: 231722 - DNA, 75 bp, Artificial Sequence
  Synthetic
cttaatctcatggtttgctaataacactttgtgtaaagctttttaccaacaaaaacttttgtattctgccaattt

SEQ ID NO: 231723 - DNA, 75 bp, Artificial Sequence
  Synthetic
actttgtgtaaagctttttaccaacaaaaacttttgtattctgccaatttaacactgtgtaaccaaaccacttct

SEQ ID NO: 231724 - DNA, 75 bp, Artificial Sequence
  Synthetic
ttgtcgctggtcgttatttttgcttaggagctgccggtactagcccctgtcaacagcactggagattaacttatc

SEQ ID NO: 231725 - DNA, 75 bp, Artificial Sequence
  Synthetic
accttgcttctatatagtggtcttgtggctcttactctatttctaatttctaacttgtttctagtgcagcatttg

SEQ ID NO: 231726 - DNA, 75 bp, Artificial Sequence
  Synthetic
tatttgtactaatcatgcttagtattttagtctttgtttttttacctttcctcctacatgctcaaacatctgaga

SEQ ID NO: 231727 - DNA, 75 bp, Artificial Sequence
  Synthetic
tttagtctttgtttttttacctttcctcctacatgctcaaacatctgagaaaccattgaaagtatttgtggaagt

SEQ ID NO: 231728 - DNA, 75 bp, Artificial Sequence
  Synthetic
ctcctacatgctcaaacatctgagaaaccattgaaagtatttgtggaagttggccataatgtaaccctcccccat

SEQ ID NO: 231729 - DNA, 75 bp, Artificial Sequence
  Synthetic
gccatgtgacttggctagtagaaacagcagattacggtgtagcttctccaaacaactttatttttagtggacaaa

SEQ ID NO: 231730 - DNA, 75 bp, Artificial Sequence
  Synthetic
aacaactttatttttagtggacaaaaactatgccagtttacttccagaactatggtgtggccttatgccaatcta

SEQ ID NO: 231731 - DNA, 75 bp, Artificial Sequence
  Synthetic
tccatttgtttcggcttaaggtagaaaattcagccatttacaatgttaaaaataccatcaatgcatctgaaatga

SEQ ID NO: 231732 - DNA, 75 bp, Artificial Sequence
  Synthetic
tgacattcttccacccaaatgcatcattacttcaaagtacctcacaaataattattgtcacattaccattaactg

SEQ ID NO: 231733 - DNA, 75 bp, Artificial Sequence
  Synthetic
attacttcaaagtacctcacaaataattattgtcacattaccattaactgcaccaactcggtgtatccaaacaaa

SEQ ID NO: 231734 - DNA, 75 bp, Artificial Sequence
  Synthetic
caccaactcggtgtatccaaacaaagttcagtttaataatgtcactcgattctactatggatacgccaagggagg

SEQ ID NO: 231735 - DNA, 75 bp, Artificial Sequence
  Synthetic
actaattttaatgtatcaggtattactaaaagctttaaccacagttacccttttaatgagctgtgtgatgacccc

SEQ ID NO: 231736 - DNA, 75 bp, Artificial Sequence
  Synthetic
aattgcatttagcgttctcattattattgcagccctcacttacctgtgctgtcacaaacagacttaaatcttata

SEQ ID NO: 231737 - DNA, 75 bp, Artificial Sequence
  Synthetic
ggtgacggttcttcttatattcttatgcctgccaatcattttttcttcttcaacttttgcagcagtgagtcacat

SEQ ID NO: 231738 - DNA, 75 bp, Artificial Sequence
  Synthetic
tgcctgccaatcattttttcttcttcaacttttgcagcagtgagtcacattgatcctgattgtatagcacccttt

SEQ ID NO: 231739 - DNA, 75 bp, Artificial Sequence
  Synthetic
tgaccgccacgtgcgtctgcagtcttataactttacttcttacctcgcttcaattttttgattactactacgtgc

SEQ ID NO: 231740 - DNA, 75 bp, Artificial Sequence
  Synthetic
caattttttgattactactacgtgcgatacgtttaccgcagacatcaccctcgttatcaaaacccccacattgca

SEQ ID NO: 231741 - DNA, 75 bp, Artificial Sequence
  Synthetic
agcagcgttagccatcttcatgttaactccaatgttggccacttcttgtaagcttcacgtgccatggactttctt

SEQ ID NO: 231742 - DNA, 75 bp, Artificial Sequence
  Synthetic
agcttcacgtgccatggactttcttagactgctacaccaaagagacagattacataggctgggtgtatgggatta

SEQ ID NO: 231743 - DNA, 75 bp, Artificial Sequence
  Synthetic
tgtagtttccttaaaactttatacgcttattaattttagttggaatcaatacactgatgatctccctgagtaccc

SEQ ID NO: 231744 - DNA, 75 bp, Artificial Sequence
  Synthetic
cttattaattttagttggaatcaatacactgatgatctccctgagtacccacaccaccaggatgatttaccccta

SEQ ID NO: 231745 - DNA, 75 bp, Artificial Sequence
  Synthetic
gtcctccttcggttgttagctattttaagttcgccggtgaagatgattgaacccgacctacaaatggatggaaca

SEQ ID NO: 231746 - DNA, 75 bp, Artificial Sequence
  Synthetic
atgaccgaacagaggttgcttgctgatcgcgctaggcgtcgccaacaggatcaaaaaaataaagagttacttgat

SEQ ID NO: 231747 - DNA, 75 bp, Artificial Sequence
  Synthetic
tcaaaaaaataaagagttacttgatttacaaaccgttcatcagtgtaaaaaaggacttttttgcctggtaaaaca

SEQ ID NO: 231748 - DNA, 75 bp, Artificial Sequence
  Synthetic
ttacaaaccgttcatcagtgtaaaaaaggacttttttgcctggtaaaacaagccaccctccgctacgagaattta

SEQ ID NO: 231749 - DNA, 75 bp, Artificial Sequence
  Synthetic
acacgctgcctactcagcgacaaagcttcaccgcagtcgtgggttcggtgcctattaaagtgtcccaacaagcag

SEQ ID NO: 231750 - DNA, 75 bp, Artificial Sequence
  Synthetic
gacagcaagaaggctccatttgctgcctatgtaccagccctgaatgtttgtacactttaataaaaacactgtgcg

SEQ ID NO: 231751 - DNA, 75 bp, Artificial Sequence
  Synthetic
ttaaataaatcacttacctgaaatttaaaaatacattgtggtctccatgtactcttacaaaatttccttcttccc

SEQ ID NO: 231752 - DNA, 75 bp, Artificial Sequence
  Synthetic
taaaaatacattgtggtctccatgtactcttacaaaatttccttcttcccaactatcaaagccaatagacttgca

SEQ ID NO: 231753 - DNA, 75 bp, Artificial Sequence
  Synthetic
aatggaatgtcagaattttcttcccaattcctacccaccatcttcagcttttttagatgaagcgcagcagaaccc

SEQ ID NO: 231754 - DNA, 75 bp, Artificial Sequence
  Synthetic
aattcctacccaccatcttcagcttttttagatgaagcgcagcagaacccagtacgctgaagaacctgaagaaaa

SEQ ID NO: 231755 - DNA, 75 bp, Artificial Sequence
  Synthetic
tttgacccatatgacacagcgcatgtgccctttgttacacccccttttacctcttccaatgcttttcaagaaaaa

SEQ ID NO: 231756 - DNA, 75 bp, Artificial Sequence
  Synthetic
tgccctttgttacacccccttttacctcttccaatgcttttcaagaaaaaccacccggtgtattatcacttaatt

SEQ ID NO: 231757 - DNA, 75 bp, Artificial Sequence
  Synthetic
tggatcccttaccctaaagttagggaacggaataaagcttaattcacaaggtcaacttacaaccactaacactaa

SEQ ID NO: 231758 - DNA, 75 bp, Artificial Sequence
  Synthetic
tcacagggtcttacactttcttggagcgccccattatcagttaaggccagtgcccttacacttaatacaatggca

SEQ ID NO: 231759 - DNA, 75 bp, Artificial Sequence
  Synthetic
gcgccccattatcagttaaggccagtgcccttacacttaatacaatggcaccattcacaacaacaaacgaaagct

SEQ ID NO: 231760 - DNA, 75 bp, Artificial Sequence
  Synthetic
tacagtggaagcttcacaattgggcttagccagctgtagcacctctaagcttagaggagggggaaaccttggttt

SEQ ID NO: 231761 - DNA, 75 bp, Artificial Sequence
  Synthetic
ctgcttcagatccgttaactgtaaattccaatagtttaggattaaatattaccagtcccattacactaataaacg

SEQ ID NO: 231762 - DNA, 75 bp, Artificial Sequence
  Synthetic
ttccaatagtttaggattaaatattaccagtcccattacactaataaacggatccttggctttagccacatcccc

SEQ ID NO: 231763 - DNA, 75 bp, Artificial Sequence
  Synthetic
ttaaatctttctgttgctgctcctctcagtgtttcacagaacgcactcactgtttcaaccggtaacggtcttcaa

SEQ ID NO: 231764 - DNA, 75 bp, Artificial Sequence
  Synthetic
gaataggagatggcttacgatttgataatggggttataaaagcacatgttgccggggggaatgagactctcaggg

SEQ ID NO: 231765 - DNA, 75 bp, Artificial Sequence
  Synthetic
gtaaaataattttagatgttaattatccctttgatgcaaccaccaacctttcattgaggagaggatcgggcctca

SEQ ID NO: 231766 - DNA, 75 bp, Artificial Sequence
  Synthetic
tcattgaggagaggatcgggcctcatatataatgagtctacaaactggaacttaacaactgatatcagcaccgaa

SEQ ID NO: 231767 - DNA, 75 bp, Artificial Sequence
  Synthetic
aaatagctatcaacgcaggtccatgtggtctcacgtttaataaccgcaagcttcaggtaaaattgggcgcgggac

SEQ ID NO: 231768 - DNA, 75 bp, Artificial Sequence
  Synthetic
tgccttaaatagtattgctactccgtatgatcctttaacgttgtggacaactccggatcctccgcccaactgcac

SEQ ID NO: 231769 - DNA, 75 bp, Artificial Sequence
  Synthetic
tatgatcctttaacgttgtggacaactccggatcctccgcccaactgcactctcagacaagaacttgatgcaaaa

SEQ ID NO: 231770 - DNA, 75 bp, Artificial Sequence
  Synthetic
aatctattgtgaatggcatagttagtttgataggtgttaagggggatctcttacatattcaacctaccaccacca

SEQ ID NO: 231771 - DNA, 75 bp, Artificial Sequence
  Synthetic
tttgataggtgttaagggggatctcttacatattcaacctaccaccaccactgtgggactgcatttagtgtttga

SEQ ID NO: 231772 - DNA, 75 bp, Artificial Sequence
  Synthetic
acgcccactgccttagttccccaggcttcctggggatataaacaaggtcaatcggtatctagcagcgctgttgct

SEQ ID NO: 231773 - DNA, 75 bp, Artificial Sequence
  Synthetic
cttcctggggatataaacaaggtcaatcggtatctagcagcgctgttgctaatgctttaggattcatgcctaatg

SEQ ID NO: 231774 - DNA, 75 bp, Artificial Sequence
  Synthetic
gggtgaagccaaaagtcaaatgttaagtcagacatatttacagggagatacaactaaacctattacaatgaaagt

SEQ ID NO: 231775 - DNA, 75 bp, Artificial Sequence
  Synthetic
agtcagacatatttacagggagatacaactaaacctattacaatgaaagttgtatttaatggcaatgcaacagtg

SEQ ID NO: 231776 - DNA, 75 bp, Artificial Sequence
  Synthetic
ggacaggtgtgtcaaactatctaaaccaacagttttcaacaccatcttgttcattttcgtatattgcccaagaat

SEQ ID NO: 231777 - DNA, 75 bp, Artificial Sequence
  Synthetic
aaaaaaaacacaaatttgcataccgtgatcatttattaattcttttttacaatacgagtagttatactgccttct

SEQ ID NO: 231778 - DNA, 75 bp, Artificial Sequence
  Synthetic
aatacgagtagttatactgccttcttcccatttcaccttgtatacctccctctcccactttgttgcggaaaacag

SEQ ID NO: 231779 - DNA, 75 bp, Artificial Sequence
  Synthetic
tcccatttcaccttgtatacctccctctcccactttgttgcggaaaacagctgcgcttgaatgtttctactttgg

SEQ ID NO: 231780 - DNA, 75 bp, Artificial Sequence
  Synthetic
tttccttctgggcaaaacgacagtcggtgatacaaacaaatccttcgcccgcacagtctcttaaactgcattcca

SEQ ID NO: 231781 - DNA, 75 bp, Artificial Sequence
  Synthetic
ggtgatacaaacaaatccttcgcccgcacagtctcttaaactgcattccattttatcctacaaaaggtaacaaca

SEQ ID NO: 231782 - DNA, 75 bp, Artificial Sequence
  Synthetic
gttttctcgatgattgtaatctccaaataaaattgcttgatgatgcataataagaccctttagcagtcgctgacg

SEQ ID NO: 231783 - DNA, 75 bp, Artificial Sequence
  Synthetic
aataaaattgcttgatgatgcataataagaccctttagcagtcgctgacgatggccttcgcaccaactatgtttt

SEQ ID NO: 231784 - DNA, 75 bp, Artificial Sequence
  Synthetic
ttactttaacaacttttaacattaatagtctggtacgacgagcgcaacagcgcatgcgtatttcacttaagtctt

SEQ ID NO: 231785 - DNA, 75 bp, Artificial Sequence
  Synthetic
tagtctggtacgacgagcgcaacagcgcatgcgtatttcacttaagtctttgcaatagtcacagcacaacactaa

SEQ ID NO: 231786 - DNA, 75 bp, Artificial Sequence
  Synthetic
aaggtactccatccaaaactaatcttttctagcgctaaccaagcatggccatcatacataattttaacataaatc

SEQ ID NO: 231787 - DNA, 75 bp, Artificial Sequence
  Synthetic
tttctagcgctaaccaagcatggccatcatacataattttaacataaatcaaatggcgacctctaacaaaggtgc

SEQ ID NO: 231788 - DNA, 75 bp, Artificial Sequence
  Synthetic
cataaaatggttaacaacctcccgataccaaaaacatcttttgttaattaatgttccatatacagccattttgaa

SEQ ID NO: 231789 - DNA, 75 bp, Artificial Sequence
  Synthetic
taccaaaaacatcttttgttaattaatgttccatatacagccattttgaaccagcgtcctaaaagcatcccagct

SEQ ID NO: 231790 - DNA, 75 bp, Artificial Sequence
  Synthetic
gctggcaatgacaatgtattagccaccgctcataaccatgtaacaattgagtaatttcaacatctatggtggcac

SEQ ID NO: 231791 - DNA, 75 bp, Artificial Sequence
  Synthetic
ccgctcataaccatgtaacaattgagtaatttcaacatctatggtggcacaacacaaacacacactcatgtattt

SEQ ID NO: 231792 - DNA, 75 bp, Artificial Sequence
  Synthetic
gttaaaatcatatcccatggtattggccattcttgcaatacagtaaaccctacacatgaaggaatacctcttacc

SEQ ID NO: 231793 - DNA, 75 bp, Artificial Sequence
  Synthetic
gccattcttgcaatacagtaaaccctacacatgaaggaatacctcttacctcacttacattatgcaaagtcagac

SEQ ID NO: 231794 - DNA, 75 bp, Artificial Sequence
  Synthetic
ctctgacagagtagcttttgactgctgttcacaaggtggtagatggtacttgctgtacggcgccagtctgcaacc

SEQ ID NO: 231795 - DNA, 75 bp, Artificial Sequence
  Synthetic
tgctgtacggcgccagtctgcaaccataccgtctgtcgcgctgcatcgtaaaccacagacttgcgagcgtcttcg

SEQ ID NO: 231796 - DNA, 75 bp, Artificial Sequence
  Synthetic
gcccactggttacagcgccgcgtcccttttgctttcgacgttggcgttccgtcacaaacgcaaaatataaccact

SEQ ID NO: 231797 - DNA, 75 bp, Artificial Sequence
  Synthetic
cttttgctttcgacgttggcgttccgtcacaaacgcaaaatataaccactctcgcaggcttaatagaatgtactc

SEQ ID NO: 231798 - DNA, 75 bp, Artificial Sequence
  Synthetic
tgctctttaacaaagcgaatagtatccacacaggtcgcatgggccaaaccaagccatccaatacaggcagctgta

SEQ ID NO: 231799 - DNA, 75 bp, Artificial Sequence
  Synthetic
ccacacaggtcgcatgggccaaaccaagccatccaatacaggcagctgtatcccgacatatgggaggttgaggaa

SEQ ID NO: 231800 - DNA, 75 bp, Artificial Sequence
  Synthetic
tcaagacggtcagcaagtatttgaatgcgtaaatctcgcaggtggcagcgatcacctccgctgtgctggtgaaaa

SEQ ID NO: 231801 - DNA, 75 bp, Artificial Sequence
  Synthetic
tgcgtaaatctcgcaggtggcagcgatcacctccgctgtgctggtgaaaaatcacagccagatcaaattgtaagc

SEQ ID NO: 231802 - DNA, 75 bp, Artificial Sequence
  Synthetic
atctaaaagagccacggctctaatttccacaaacaaaagtaaagcaaatgcgttatcatgaaactcttctatcat

SEQ ID NO: 231803 - DNA, 75 bp, Artificial Sequence
  Synthetic
cagactgcctgactgaaccattcccaaataattttcattcttccactgttgtattatttgaacacactgattttg

SEQ ID NO: 231804 - DNA, 75 bp, Artificial Sequence
  Synthetic
gtataaaatcatgcaaatcagaagccagcagcaaagaaagttcacctccaggtacaagttccggagtccccacag

SEQ ID NO: 231805 - DNA, 75 bp, Artificial Sequence
  Synthetic
tagacatcgcgcataggaggagttaaataatgcattaccaacagccaaaactcaggtagcacgtctttaagaaac

SEQ ID NO: 231806 - DNA, 75 bp, Artificial Sequence
  Synthetic
gcaaatagttcaataaagactccggaaacatcacggagtaatgaacaagcggcctctgaaacatgctttaggtta

SEQ ID NO: 231807 - DNA, 75 bp, Artificial Sequence
  Synthetic
gtaaagttgcctggcgaataggtggaaaaataactctatttaaaaccaagcgcgcaactggctgctttgcgcgga

SEQ ID NO: 231808 - DNA, 75 bp, Artificial Sequence
  Synthetic
aaacaacaaaacactaagctccattcttgagcctggataaagcgtttcagcgccaacaaaaacccctctggcgtt

SEQ ID NO: 231809 - DNA, 75 bp, Artificial Sequence
  Synthetic
ctgctatgtttaaatatagaagcacaactccgtgtggaggtataacaaaattcgcaggagaaaataacacataag

SEQ ID NO: 231810 - DNA, 75 bp, Artificial Sequence
  Synthetic
aactccgtgtggaggtataacaaaattcgcaggagaaaataacacataagcattagaatagccttcttgttcagg

SEQ ID NO: 231811 - DNA, 75 bp, Artificial Sequence
  Synthetic
tacacatatacagcctcgaaaacagccataataccttaccgaaaaaacagtacaaagccaggcacagcagacaca

SEQ ID NO: 231812 - DNA, 75 bp, Artificial Sequence
  Synthetic
aatattcccacggttcgtcacatccggcgcgcccggctcccacacgcgtcacatccggcttcggcaaacttgcaa

SEQ ID NO: 231813 - DNA, 75 bp, Artificial Sequence
  Synthetic
accacgcctacggtcaattaactattcactccgcccacttcattttaatattggctcaagtccagtgtaaggtat

SEQ ID NO: 231814 - DNA, 75 bp, Artificial Sequence
  Synthetic
cctatctaaatatataccttatactggactagagccaatattaaaatgaagtgggtgtggcgatgtactttgatt

SEQ ID NO: 231815 - DNA, 75 bp, Artificial Sequence
  Synthetic
ggactagagccaatattaaaatgaagtgggtgtggcgatgtactttgattgggtggaggtgtggcctgggcgtgt

SEQ ID NO: 231816 - DNA, 75 bp, Artificial Sequence
  Synthetic
gtgggtgtggcgatgtactttgattgggtggaggtgtggcctgggcgtgtttgtaagtttgggcggatgaggaag

SEQ ID NO: 231817 - DNA, 75 bp, Artificial Sequence
  Synthetic
cgccggatgtgacgtgtttaacgccattttaatgcggaaatgatgtgttttgggcgttggttgtgaaaattctgt

SEQ ID NO: 231818 - DNA, 75 bp, Artificial Sequence
  Synthetic
attttaatgcggaaatgatgtgttttgggcgttggttgtgaaaattctgtatttttggcgcgaaaacctgaaata

SEQ ID NO: 231819 - DNA, 75 bp, Artificial Sequence
  Synthetic
tttattataggcgcgtaatatttaccgagggcagagtgaactttgagcctctacgtgtgggtttcggtacgtgag

SEQ ID NO: 231820 - DNA, 75 bp, Artificial Sequence
  Synthetic
cgagggcagagtgaactttgagcctctacgtgtgggtttcggtacgtgagtgttagggaatgtccacgttggcgt

SEQ ID NO: 231821 - DNA, 75 bp, Artificial Sequence
  Synthetic
gctgggtatttaattccgctgggattgtcaagaggccactcttgagtgccagcgagaagagatttctctgccagc

SEQ ID NO: 231822 - DNA, 75 bp, Artificial Sequence
  Synthetic
tgtcaagaggccactcttgagtgccagcgagaagagatttctctgccagctccactcggcgccattatgaggaca

SEQ ID NO: 231823 - DNA, 75 bp, Artificial Sequence
  Synthetic
gtgaagaggctgatgacatattggaggacttggtgaacaatttttttaccgaggtacccgatgatggggatgatt

SEQ ID NO: 231824 - DNA, 75 bp, Artificial Sequence
  Synthetic
ggacttggtgaacaatttttttaccgaggtacccgatgatggggatgatttttatactccttctctttatgaact

SEQ ID NO: 231825 - DNA, 75 bp, Artificial Sequence
  Synthetic
gacaacgattgtgatgagcaggctgtaagtgcattttttcctgagtcgctacttttagccaccagtgaggggctg

SEQ ID NO: 231826 - DNA, 75 bp, Artificial Sequence
  Synthetic
taagtgcattttttcctgagtcgctacttttagccaccagtgaggggctgttgttgacagaacctccagttattt

SEQ ID NO: 231827 - DNA, 75 bp, Artificial Sequence
  Synthetic
gttgttgacagaccctccgattctttctccggtatgtgaacccgttgggggtgaatatatgccccgactgcagcc

SEQ ID NO: 231828 - DNA, 75 bp, Artificial Sequence
  Synthetic
tctccggtatgtgaacccgttgggggtgaatatatgccccgactgcagcctgaagatatggatttgttgtgctat

SEQ ID NO: 231829 - DNA, 75 bp, Artificial Sequence
  Synthetic
ctgaagatgagcaggatgtacgcggaatggcattggtgtccgcatctgctatggctgctgttacgcatcatgaga

SEQ ID NO: 231830 - DNA, 75 bp, Artificial Sequence
  Synthetic
aatggcattggtgtccgcatctgctatggctgctgttacgcatcatgagaagtttgagttagataatccagaact

SEQ ID NO: 231831 - DNA, 75 bp, Artificial Sequence
  Synthetic
gaatatcatcggaatagtactggaaataatgacttaatgtgttctctgtgttatctgcgagcatacggcatgttt

SEQ ID NO: 231832 - DNA, 75 bp, Artificial Sequence
  Synthetic
ataatgacttaatgtgttctctgtgttatctgcgagcatacggcatgtttatttacagtaagtgcattttaaaac

SEQ ID NO: 231833 - DNA, 75 bp, Artificial Sequence
  Synthetic
actcaaagtaatttttttttttactgttttaggtcctgtttcagacaatgaggtagatgactctaatagggacaa

SEQ ID NO: 231834 - DNA, 75 bp, Artificial Sequence
  Synthetic
aggtagatgactctaatagggacaaacgaccgtcgcctccaacactaggaaacgcagttcctgaaggagtgttaa

SEQ ID NO: 231835 - DNA, 75 bp, Artificial Sequence
  Synthetic
gtgaacaaacagagcctgttgatttgtcagtgaaacgccctagatatgattagtggactttgcacacctgtgcaa

SEQ ID NO: 231836 - DNA, 75 bp, Artificial Sequence
  Synthetic
tagtgacgtacaataaaattgtttttctgttaagtgttttattggtttcattgggcgtggttaacatggatataa

SEQ ID NO: 231837 - DNA, 75 bp, Artificial Sequence
  Synthetic
tctgttaagtgttttattggtttcattgggcgtggttaacatggatataaaggtggggtggtagtgctgaggctg

SEQ ID NO: 231838 - DNA, 75 bp, Artificial Sequence
  Synthetic
ctgtgctgcaaagttatcagggcgttcgtcagctcttacagtatacctctaaaaacacttcaggtttttggagat

SEQ ID NO: 231839 - DNA, 75 bp, Artificial Sequence
  Synthetic
agtggtacatagggtaaaagaagactacaggaaggaatttgaaaacatactggccggctgtccagggcttttggc

SEQ ID NO: 231840 - DNA, 75 bp, Artificial Sequence
  Synthetic
tacaggaaggaatttgaaaacatactggccggctgtccagggcttttggcatctttagatctttgccaccactcg

SEQ ID NO: 231841 - DNA, 75 bp, Artificial Sequence
  Synthetic
ctttggatttttcatctgcagggcgaacggttgcttctattgcttttttggtaaccgttttagataaatggagcc

SEQ ID NO: 231842 - DNA, 75 bp, Artificial Sequence
  Synthetic
ctgtggagggcatggctcacgaggagggtttgcatttactcgctggcgcggcctttgaccatgccgcgactgcca

SEQ ID NO: 231843 - DNA, 75 bp, Artificial Sequence
  Synthetic
gggtttgcatttactcgctggcgcggcctttgaccatgccgcgactgccaacgttgcaggaggaggagctggagc

SEQ ID NO: 231844 - DNA, 75 bp, Artificial Sequence
  Synthetic
aacatggaacaacaggtgcaagaaggccatgcacttgaccctgaggaagggcccagctgtgcagctgttaacatt

SEQ ID NO: 231845 - DNA, 75 bp, Artificial Sequence
  Synthetic
gccatgcacttgaccctgaggaagggcccagctgtgcagctgttaacattaagcgggaacgggaaacggttctta

SEQ ID NO: 231846 - DNA, 75 bp, Artificial Sequence
  Synthetic
tcgcccgcgcttagaaactgtgtattggcaggaactgcaaaatgagtttcagcaaggagatatgcatttacagta

SEQ ID NO: 231847 - DNA, 75 bp, Artificial Sequence
  Synthetic
tggcaggaactgcaaaatgagtttcagcaaggagatatgcatttacagtacaagtatggttttgagcaattaaaa

SEQ ID NO: 231848 - DNA, 75 bp, Artificial Sequence
  Synthetic
atattgagagtgctattaaaacttttgcaaagttagctttacgccctgatcgcagctataaaattagtaaaacaa

SEQ ID NO: 231849 - DNA, 75 bp, Artificial Sequence
  Synthetic
tgcaaagttagctttacgccctgatcgcagctataaaattagtaaaacaataactattgcttcatatgcttacat

SEQ ID NO: 231850 - DNA, 75 bp, Artificial Sequence
  Synthetic
gtggatacaagtgacagggttgctttcagatgtcgcatgcagggcatgggtcctggggtggtggggttgggcggt

SEQ ID NO: 231851 - DNA, 75 bp, Artificial Sequence
  Synthetic
tcagatgtcgcatgcagggcatgggtcctggggtggtggggttgggcggtattacctttattaatgttagatttg

SEQ ID NO: 231852 - DNA, 75 bp, Artificial Sequence
  Synthetic
gtttgaagccaacaccagccttgttttgcatggtgtttattttcttaattttagtaatacttgtgtggagtcttg

SEQ ID NO: 231853 - DNA, 75 bp, Artificial Sequence
  Synthetic
ttagtaatacttgtgtggagtcttggattaaggtttccgcaaggggctgtacgttttatggttgtaggaggggtt

SEQ ID NO: 231854 - DNA, 75 bp, Artificial Sequence
  Synthetic
gtctgtaaaaaaatgcttgtttgagaaatgcgtgctagccttaattgtggagggggatgcgcatattagacataa

SEQ ID NO: 231855 - DNA, 75 bp, Artificial Sequence
  Synthetic
gttctagtgaagggaatggctgttttaaggcacaatatggtttgtggagtgtccgatcaatctgcgcgccgttat

SEQ ID NO: 231856 - DNA, 75 bp, Artificial Sequence
  Synthetic
gtccgatcaatctgcgcgccgttatgttacttgcgctgatggaaattgtcatgccttaaaaactattcatgttgt

SEQ ID NO: 231857 - DNA, 75 bp, Artificial Sequence
  Synthetic
gtgtgtgatcataatatgtttatgcgttgttccatgcatttaggcttaaggcgtggcatgtttgtgccttttcaa

SEQ ID NO: 231858 - DNA, 75 bp, Artificial Sequence
  Synthetic
gttgttccatgcatttaggcttaaggcgtggcatgtttgtgccttttcaatgtaaccttagtcatacaaatgtat

SEQ ID NO: 231859 - DNA, 75 bp, Artificial Sequence
  Synthetic
aataagtttaaatggggtgtttgacctgtctgtggaattgtataaggttataagatatgatgatactcgtcaccg

SEQ ID NO: 231860 - DNA, 75 bp, Artificial Sequence
  Synthetic
ctgtctgtggaattgtataaggttataagatatgatgatactcgtcaccgttgtcgacagtgtgagtgtggcagc

SEQ ID NO: 231861 - DNA, 75 bp, Artificial Sequence
  Synthetic
tattgaatgtgacggaggagctgaggagtgaccaccttaccttatcttgcctgcgaactgactacgaatccagtg

SEQ ID NO: 231862 - DNA, 75 bp, Artificial Sequence
  Synthetic
gagtgaccaccttaccttatcttgcctgcgaactgactacgaatccagtgatgaagacggcaactaagggtaagt

SEQ ID NO: 231863 - DNA, 75 bp, Artificial Sequence
  Synthetic
caccataaggaaaacttaagctattttgttattttacagcaacatgaatggaactacgcaagacaacgctgcgct

SEQ ID NO: 231864 - DNA, 75 bp, Artificial Sequence
  Synthetic
ttgttattttacagcaacatgaatggaactacgcaagacaacgctgcgctttttgatggaggggttttcagtcct

SEQ ID NO: 231865 - DNA, 75 bp, Artificial Sequence
  Synthetic
gggccggagtgcgtcagaatgtgatgggatctaccttggacggccgacctgtggcacctgctaattcgtcaacct

SEQ ID NO: 231866 - DNA, 75 bp, Artificial Sequence
  Synthetic
gggatctaccttggacggccgacctgtggcacctgctaattcgtcaaccttaacatatgcaactgtgggaccttc

SEQ ID NO: 231867 - DNA, 75 bp, Artificial Sequence
  Synthetic
gcggcctctgcagccgcttccaccgctcgcagtatggcagccgatttcaacttctacagtcacttagcttcaaac

SEQ ID NO: 231868 - DNA, 75 bp, Artificial Sequence
  Synthetic
ctcgcagtatggcagccgatttcaacttctacagtcacttagcttcaaacgctgtgacgcgcactgcggttcggg

SEQ ID NO: 231869 - DNA, 75 bp, Artificial Sequence
  Synthetic
taagcttgagactctaaccgctcagttagaagatctatcgcagaaggttgaagagcttgctgttgcctctacccg

SEQ ID NO: 231870 - DNA, 75 bp, Artificial Sequence
  Synthetic
ttagaagatctatcgcagaaggttgaagagcttgctgttgcctctacccgtacccccccagcccaacctgtagcc

SEQ ID NO: 231871 - DNA, 75 bp, Artificial Sequence
  Synthetic
actgtgttagaatctttattagtgtttgttttttcttacatgataggctctggtccatctttccctgtcactaat

SEQ ID NO: 231872 - DNA, 75 bp, Artificial Sequence
  Synthetic
aacacgatgaatgtgttctagtatgctatagagatgcgattgtatattaagatacattggcataagaccgtcttt

SEQ ID NO: 231873 - DNA, 75 bp, Artificial Sequence
  Synthetic
gcttcatgttctggggtggtgttataaataatccaatcatagcaagaacgctgggcatggtggtgaaatatgtcc

SEQ ID NO: 231874 - DNA, 75 bp, Artificial Sequence
  Synthetic
gaagccctttagtgtaggtatttataaagcgattaagctgggtggggtgcatacgtggagacatgatgtgcattt

SEQ ID NO: 231875 - DNA, 75 bp, Artificial Sequence
  Synthetic
gttaccggccaaatctcttctgggattcatgttatgtaaaaccactaaaactgtgtatccggtacatttaggaaa

SEQ ID NO: 231876 - DNA, 75 bp, Artificial Sequence
  Synthetic
gcatggaagaacttagaaacggctttgtggctgcccaaattttccatgcactcgtccattattatggcaattggc

SEQ ID NO: 231877 - DNA, 75 bp, Artificial Sequence
  Synthetic
tgttttttggatcagaaacatcatagttgtggtccagagttaagtcatcgtaggacagcttaacaaatttagggc

SEQ ID NO: 231878 - DNA, 75 bp, Artificial Sequence
  Synthetic
gttgtggtccagagttaagtcatcgtaggacagcttaacaaatttagggcgcaatgttccagattggggtattaa

SEQ ID NO: 231879 - DNA, 75 bp, Artificial Sequence
  Synthetic
ttcccttcacaaatttgcatttcccaagctttaatttcagacgggggaatcatatcaacctggggagcaataaaa

SEQ ID NO: 231880 - DNA, 75 bp, Artificial Sequence
  Synthetic
aagctttaatttcagacgggggaatcatatcaacctggggagcaataaaaaaaacagtttctggagcaggtgtaa

SEQ ID NO: 231881 - DNA, 75 bp, Artificial Sequence
  Synthetic
caatagctgcgatttaccgcaaccagtaggtccgtaaataaccccaataactggttgtaaatgatagtttaacga

SEQ ID NO: 231882 - DNA, 75 bp, Artificial Sequence
  Synthetic
gtaggtccgtaaataaccccaataactggttgtaaatgatagtttaacgaggtgcagctgccgtcttctcggagg

SEQ ID NO: 231883 - DNA, 75 bp, Artificial Sequence
  Synthetic
gtctgacgcatgtgttttgcttagctagttcccccaaaagacgctctccgcccagcgatagcaactcctgtaaag

SEQ ID NO: 231884 - DNA, 75 bp, Artificial Sequence
  Synthetic
atttaaaatttttaagaggttttaaaccatcagccataggcatgtgatctagggtttgcttcagcagctgcagcc

SEQ ID NO: 231885 - DNA, 75 bp, Artificial Sequence
  Synthetic
tatggcatctcgatccagcaaatttcctcgttgcgggggttgggttggctgttgctgtaagggatgagacgatga

SEQ ID NO: 231886 - DNA, 75 bp, Artificial Sequence
  Synthetic
cctcgttgcgggggttgggttggctgttgctgtaagggatgagacgatgagcgtctaggtgggcgagagttttgt

SEQ ID NO: 231887 - DNA, 75 bp, Artificial Sequence
  Synthetic
gagagttgtttccgtcactgtaaatggatgcgctcctggttgtgcgctggccaatgtgcgcttcaaactcagacg

SEQ ID NO: 231888 - DNA, 75 bp, Artificial Sequence
  Synthetic
ccctgtgcttcggcaaggtagcattttaacatgagatcataagacagagcatctgcggcatgtcctttagctcgt

SEQ ID NO: 231889 - DNA, 75 bp, Artificial Sequence
  Synthetic
agctgggacactgaaggcatttaagggcgtatagttttggagccaaaaacacagattctggagagtatgcatcag

SEQ ID NO: 231890 - DNA, 75 bp, Artificial Sequence
  Synthetic
acattcaactgaccaggtcagctcaggacaagatggatcaaaaacaagttttccaccgtgctttttgatgcgttt

SEQ ID NO: 231891 - DNA, 75 bp, Artificial Sequence
  Synthetic
cgtccttcctctgtcacaaaaaggctgtctgtgtctccgtacacggatttaagaggtctgtccttcaggggtatt

SEQ ID NO: 231892 - DNA, 75 bp, Artificial Sequence
  Synthetic
ctgaccactctgacacaaaagccctagtccaagcgagtacaaaggaagcaacatgggaaggataccggtcgttac

SEQ ID NO: 231893 - DNA, 75 bp, Artificial Sequence
  Synthetic
ggtgtgtaagcacatatccccttcttcagcatccagaaatgtgattggcttgtaggtgtaagtcacatgacctga

SEQ ID NO: 231894 - DNA, 75 bp, Artificial Sequence
  Synthetic
ggggcgggtccttgatcttcatcgctttcttctgcatcgctgtttacgagcgccagctgttggggtaagtacacg

SEQ ID NO: 231895 - DNA, 75 bp, Artificial Sequence
  Synthetic
cgctcaaaagcaggcattacatctgtactcaaggtgtcagtttctataaatgatgaggatttgatgtttaagcga

SEQ ID NO: 231896 - DNA, 75 bp, Artificial Sequence
  Synthetic
cttcttccatttgatcagaaaaaacaatttttttattgtcaagtttggtggcaaaagatccatacagggcatttg

SEQ ID NO: 231897 - DNA, 75 bp, Artificial Sequence
  Synthetic
gcaaaagatccatacagggcatttgaaagcagtttggctatggagcgtagggtttgattcttgtccttatctgcg

SEQ ID NO: 231898 - DNA, 75 bp, Artificial Sequence
  Synthetic
cgttcctttgcagcgatattaagttgcacatattcacgtgccaggcacttccaggtaggaaagatggtggtgcgt

SEQ ID NO: 231899 - DNA, 75 bp, Artificial Sequence
  Synthetic
gcacatattcacgtgccaggcacttccaggtaggaaagatggtggtgcgttcgtcaggaaggaggcgcactcgcc

SEQ ID NO: 231900 - DNA, 75 bp, Artificial Sequence
  Synthetic
gtctacactagtaactacttccccccgcaagcgctcattggtccacactaggcgaccgccttttcgtgaacaata

SEQ ID NO: 231901 - DNA, 75 bp, Artificial Sequence
  Synthetic
tggagggagaatatctagttgattttcatctggaggatcagcatctacagtaaaaatacctggacaaagattttt

SEQ ID NO: 231902 - DNA, 75 bp, Artificial Sequence
  Synthetic
tagttttccagcgccatgtgccattgccgcgcggccaatgcgcgttcataggggttaaggggtggaccccaaggc

SEQ ID NO: 231903 - DNA, 75 bp, Artificial Sequence
  Synthetic
gccgcgcggccaatgcgcgttcataggggttaaggggtggaccccaaggcatagggtgtgttagtgctgatgcat

SEQ ID NO: 231904 - DNA, 75 bp, Artificial Sequence
  Synthetic
tatgggttgttttaatactcctatgtaggtaggataacacctaccgccgcggatgctggcgcgaacatagtcata

SEQ ID NO: 231905 - DNA, 75 bp, Artificial Sequence
  Synthetic
ggatgctggcgcgaacatagtcatataattcatgtgacggcgccaggatgttgggtccaaggtttgtccgctgtg

SEQ ID NO: 231906 - DNA, 75 bp, Artificial Sequence
  Synthetic
cctaaaaattgcatgagagttagaggaaatggtaggtcgctgaaatacattaaagtgtgccgcatgaaggcccac

SEQ ID NO: 231907 - DNA, 75 bp, Artificial Sequence
  Synthetic
gaaatggtaggtcgctgaaatacattaaagtgtgccgcatgaaggcccacagagttagtaataaagtgggcatag

SEQ ID NO: 231908 - DNA, 75 bp, Artificial Sequence
  Synthetic
cggctgtaacaagtacatccagggcacaatagtttaatgtttccttaataaggttgtaatttttttctttctttg

SEQ ID NO: 231909 - DNA, 75 bp, Artificial Sequence
  Synthetic
acaatagtttaatgtttccttaataaggttgtaatttttttctttctttgttttccatagttgttggtttaggag

SEQ ID NO: 231910 - DNA, 75 bp, Artificial Sequence
  Synthetic
tcttccacgggaaaaccgtctgcatttgcacggtaagaaccaagcatataaaattcatttatagctttgtaggga

SEQ ID NO: 231911 - DNA, 75 bp, Artificial Sequence
  Synthetic
ttgcacggtaagaaccaagcatataaaattcatttatagctttgtagggacaacatcctttttctacagaaaggg

SEQ ID NO: 231912 - DNA, 75 bp, Artificial Sequence
  Synthetic
tgatgtatgagtaagagcaaatgtgtctctaaccattactttcaaatactgatatttaaagtcttggtcattaca

SEQ ID NO: 231913 - DNA, 75 bp, Artificial Sequence
  Synthetic
tctctaaccattactttcaaatactgatatttaaagtcttggtcattacaacctccttgttcccacagtgaaaag

SEQ ID NO: 231914 - DNA, 75 bp, Artificial Sequence
  Synthetic
taggaagagcgaaggtgatatcattaaataagattttgccagctcttggcatgaaatttctagaaattttaaagg

SEQ ID NO: 231915 - DNA, 75 bp, Artificial Sequence
  Synthetic
aaataagattttgccagctcttggcatgaaatttctagaaattttaaagggtccaggaacgtctgagcggctgtt

SEQ ID NO: 231916 - DNA, 75 bp, Artificial Sequence
  Synthetic
tcatcaaatccattaatgttgtgtcctacaatgtataattctacgaaccttggctgacccttaattgctggagct

SEQ ID NO: 231917 - DNA, 75 bp, Artificial Sequence
  Synthetic
ctacaatgtataattctacgaaccttggctgacccttaattgctggagcttttttaaggtcttcgtaggcaaggt

SEQ ID NO: 231918 - DNA, 75 bp, Artificial Sequence
  Synthetic
ctgttgagcccaatgaggcaagtggggatttttttgtaaaaaatgtgaccaaatatcattggctaaggatgtttg

SEQ ID NO: 231919 - DNA, 75 bp, Artificial Sequence
  Synthetic
ggatttttttgtaaaaaatgtgaccaaatatcattggctaaggatgtttgcaagcggtttctgtaggttcgaaac

SEQ ID NO: 231920 - DNA, 75 bp, Artificial Sequence
  Synthetic
ggtttatgcaataaaaagtagtggggtctttttcccactggtcccatccaagttccaaagcaagttgtaacccct

SEQ ID NO: 231921 - DNA, 75 bp, Artificial Sequence
  Synthetic
gtctttttcccactggtcccatccaagttccaaagcaagttgtaacccctggtttacaagacactcatccccagt

SEQ ID NO: 231922 - DNA, 75 bp, Artificial Sequence
  Synthetic
acaagctgctttccaaatgcccccatccaggtataggtttctacatcataggtaataaaaagacgctcagtgcga

SEQ ID NO: 231923 - DNA, 75 bp, Artificial Sequence
  Synthetic
ggatctcctgccaccaattggaagaatggctgttgatgtggtgaaagtagaaatctcggcggcggacagagcatt

SEQ ID NO: 231924 - DNA, 75 bp, Artificial Sequence
  Synthetic
atggctgttgatgtggtgaaagtagaaatctcggcggcggacagagcattcatgctgatgtttataaaagcgacc

SEQ ID NO: 231925 - DNA, 75 bp, Artificial Sequence
  Synthetic
aaatctcggcggcggacagagcattcatgctgatgtttataaaagcgaccgcagtgttcgcatcgttgcacgggt

SEQ ID NO: 231926 - DNA, 75 bp, Artificial Sequence
  Synthetic
ggcgacctcgcgccaaaaagcagaggggaaaatcgaccccttgttttggcgggtgccgttcgtcctctttctctt

SEQ ID NO: 231927 - DNA, 75 bp, Artificial Sequence
  Synthetic
gggaaaatcgaccccttgttttggcgggtgccgttcgtcctctttctcttcttgtgcattgtcactaccgcctgg

SEQ ID NO: 231928 - DNA, 75 bp, Artificial Sequence
  Synthetic
gtgacggtgccccgagagccgcacgtccagatctcagcacgagtggggcggagatgagaaaccagggcgtgcagc

SEQ ID NO: 231929 - DNA, 75 bp, Artificial Sequence
  Synthetic
tccagatctcagcacgagtggggcggagatgagaaaccagggcgtgcagcttggcgctgtccatggtatcgccaa

SEQ ID NO: 231930 - DNA, 75 bp, Artificial Sequence
  Synthetic
agctttcaagttaactgcacacaggcgggtaagagcaggttgaaggtgcaggtgatacttgatttcaaggggagt

SEQ ID NO: 231931 - DNA, 75 bp, Artificial Sequence
  Synthetic
cgggtaagagcaggttgaaggtgcaggtgatacttgatttcaaggggagtgccggtggcagaattgattgcatgt

SEQ ID NO: 231932 - DNA, 75 bp, Artificial Sequence
  Synthetic
gcaccgttccacgatgaactttttctatgcctttgtttaaaatcggcggcgtggtcgggctcccggaggaagagg

SEQ ID NO: 231933 - DNA, 75 bp, Artificial Sequence
  Synthetic
ggaaggggtatgtcggcttgtcgctctggcaggggaagatgttgagcacgaagttgactggcccgggcaactacc

SEQ ID NO: 231934 - DNA, 75 bp, Artificial Sequence
  Synthetic
ggcgttgtgtaaacactactggccctgttgtcttgaacctgaaagaaagttcaacagaatcaatttcggtatcat

SEQ ID NO: 231935 - DNA, 75 bp, Artificial Sequence
  Synthetic
tgttgtcttgaacctgaaagaaagttcaacagaatcaatttcggtatcatttactgcagcctgtctaagaatttc

SEQ ID NO: 231936 - DNA, 75 bp, Artificial Sequence
  Synthetic
taggcaatttctgccattaattgatcaatttcttcgtcctggaggtcgccatgtcccgcccgttcaatggtggcg

SEQ ID NO: 231937 - DNA, 75 bp, Artificial Sequence
  Synthetic
caatttcttcgtcctggaggtcgccatgtcccgcccgttcaatggtggcggcaagatcgttagatatgcgactca

SEQ ID NO: 231938 - DNA, 75 bp, Artificial Sequence
  Synthetic
aatttcgttccagacgcggctgtataccactcctccatcgctatctcgggcgcgcatcaccacctgtgccaggtt

SEQ ID NO: 231939 - DNA, 75 bp, Artificial Sequence
  Synthetic
accactcctccatcgctatctcgggcgcgcatcaccacctgtgccaggtttaattctactagtcgtgcaaacacg

SEQ ID NO: 231940 - DNA, 75 bp, Artificial Sequence
  Synthetic
ggtagttcaaggtggtggcaatatgttccgagacaaagaaataaagaatccagcggcgcagcgttagctcgttga

SEQ ID NO: 231941 - DNA, 75 bp, Artificial Sequence
  Synthetic
ttccgagacaaagaaataaagaatccagcggcgcagcgttagctcgttgatgtctcctagggcctcaagacggtc

SEQ ID NO: 231942 - DNA, 75 bp, Artificial Sequence
  Synthetic
aagctgaaaaactgggagttgcgagccgccaccgttaactcctgttctagaagacgaatgagctcggctactgtt

SEQ ID NO: 231943 - DNA, 75 bp, Artificial Sequence
  Synthetic
ccgccaccgttaactcctgttctagaagacgaatgagctcggctactgtttcgcgaacttcccgttcaaatgccc

SEQ ID NO: 231944 - DNA, 75 bp, Artificial Sequence
  Synthetic
ttgtatttccattatttcttcttcttccggcggaggtgggggcgcacgtctctgtcgacggcgtattggcaatcg

SEQ ID NO: 231945 - DNA, 75 bp, Artificial Sequence
  Synthetic
tccggcggaggtgggggcgcacgtctctgtcgacggcgtattggcaatcggtcaacaaatctttcaataatttcg

SEQ ID NO: 231946 - DNA, 75 bp, Artificial Sequence
  Synthetic
ttacagcttgaccgttttcgcggggacgtaactcaaatgctccacctctaaatcctgtcccactgaaagtaggga

SEQ ID NO: 231947 - DNA, 75 bp, Artificial Sequence
  Synthetic
tggaagcattggaaggggtgttgggcaatgacacagcacttactatgcattttatgatttgttgcgtaggaactc

SEQ ID NO: 231948 - DNA, 75 bp, Artificial Sequence
  Synthetic
atccaccggatcagaaaatttttcaaggaaggcatctagccaatcgcagtcacaaggtaggctgagttttgtttg

SEQ ID NO: 231949 - DNA, 75 bp, Artificial Sequence
  Synthetic
aggaaggcatctagccaatcgcagtcacaaggtaggctgagttttgtttgatttgcagaatcagaatggtctcca

SEQ ID NO: 231950 - DNA, 75 bp, Artificial Sequence
  Synthetic
aggccgacttaagacgacgaatggttgtaagaagcactgcgtcttttggaccggcttgttggatccgcagacggt

SEQ ID NO: 231951 - DNA, 75 bp, Artificial Sequence
  Synthetic
tgtaagaagcactgcgtcttttggaccggcttgttggatccgcagacggtcagccattccccaaacttcgctttg

SEQ ID NO: 231952 - DNA, 75 bp, Artificial Sequence
  Synthetic
tcatgcatcaacctttccacatctacttcgcgctgttcgcggtcagccatacgtgtgctgccatatccttgtaac

SEQ ID NO: 231953 - DNA, 75 bp, Artificial Sequence
  Synthetic
cttcgcgctgttcgcggtcagccatacgtgtgctgccatatccttgtaacggttgcaacaaggcaagatcggcca

SEQ ID NO: 231954 - DNA, 75 bp, Artificial Sequence
  Synthetic
ttggatttgagctagggtggtggcaaagtcatccaagtccacaaacctgtgatatgctcccgtattaatagtgta

SEQ ID NO: 231955 - DNA, 75 bp, Artificial Sequence
  Synthetic
aagtcatccaagtccacaaacctgtgatatgctcccgtattaatagtgtagctgcagtttgtcattaccgaccag

SEQ ID NO: 231956 - DNA, 75 bp, Artificial Sequence
  Synthetic
cagtttctgtgtagcgtaagcgcgagtacgcacgggagtcaaacacatagtcattgcagacacggactagatact

SEQ ID NO: 231957 - DNA, 75 bp, Artificial Sequence
  Synthetic
gtacgcacgggagtcaaacacatagtcattgcagacacggactagatactggtagcctaccagaagatgaggggg

SEQ ID NO: 231958 - DNA, 75 bp, Artificial Sequence
  Synthetic
aaagtggccggagcaccaggagcaaggtcttccagcataaggcggtggtattcatatatgtatcgagacatccat

SEQ ID NO: 231959 - DNA, 75 bp, Artificial Sequence
  Synthetic
ggtcttccagcataaggcggtggtattcatatatgtatcgagacatccatgtgattccggcggcggtggtggttg

SEQ ID NO: 231960 - DNA, 75 bp, Artificial Sequence
  Synthetic
ccaaatgttgcgcaggggtaaaaagcgttgaattgtagccatagtctgaccggtcaaacgagcgcaatcttgaat

SEQ ID NO: 231961 - DNA, 75 bp, Artificial Sequence
  Synthetic
ttggtggaaaagtcacaagggtaccatagcgaggaaccccggttcgaaaccggcaggatccgctatgagcgtaag

SEQ ID NO: 231962 - DNA, 75 bp, Artificial Sequence
  Synthetic
ccaaagacccccagacacggagaggagtctttttttttttatattttcttagatgcatccagttctgcgacaaat

SEQ ID NO: 231963 - DNA, 75 bp, Artificial Sequence
  Synthetic
agtctttttttttttatattttcttagatgcatccagttctgcgacaaatgcgaccccagcccagggtaactacg

SEQ ID NO: 231964 - DNA, 75 bp, Artificial Sequence
  Synthetic
gccttccacgttggagttagaagaaggagaaggcatagcccgattgggcgcccattctcctgagcgacacccacg

SEQ ID NO: 231965 - DNA, 75 bp, Artificial Sequence
  Synthetic
gcggatttaatcgcgagcacctgctgcgcgaggaagactttgaaccaaatgagcgttcgggcattagtccagcac

SEQ ID NO: 231966 - DNA, 75 bp, Artificial Sequence
  Synthetic
ggtttaatgcatctgtgggactttgtagaagcttatgtacataatccagcaagtaaaccccttactgcccaactg

SEQ ID NO: 231967 - DNA, 75 bp, Artificial Sequence
  Synthetic
ataatgaaacttttagggacgcaatgctaaacatagctgaaccacagggtcgttggttacttgatttaattaaca

SEQ ID NO: 231968 - DNA, 75 bp, Artificial Sequence
  Synthetic
gctaaacatagctgaaccacagggtcgttggttacttgatttaattaacattctccaaagcattgtagtgcagga

SEQ ID NO: 231969 - DNA, 75 bp, Artificial Sequence
  Synthetic
gtggctgcggttaattactccatgttaagtcttggaaagttttacgcccgcaagatttataaaagtccgtatgtt

SEQ ID NO: 231970 - DNA, 75 bp, Artificial Sequence
  Synthetic
taagtcttggaaagttttacgcccgcaagatttataaaagtccgtatgttccgatcgacaaggaagtaaaaatag

SEQ ID NO: 231971 - DNA, 75 bp, Artificial Sequence
  Synthetic
aaaggtactaacattaagcgatgatcttggagtgtatcgcaatgacaaaatccacaaagcagtgagtgccagtcg

SEQ ID NO: 231972 - DNA, 75 bp, Artificial Sequence
  Synthetic
cttggagtgtatcgcaatgacaaaatccacaaagcagtgagtgccagtcgccgcaaggagctgagcgacaaagaa

SEQ ID NO: 231973 - DNA, 75 bp, Artificial Sequence
  Synthetic
tcacgggcgcgggaacagaggaggaggagtcgttttttgatatgggagcagacctccggtggcagcccagcgctc

SEQ ID NO: 231974 - DNA, 75 bp, Artificial Sequence
  Synthetic
ggagtcgttttttgatatgggagcagacctccggtggcagcccagcgctcgtgctctggaggcggtcggagcaac

SEQ ID NO: 231975 - DNA, 75 bp, Artificial Sequence
  Synthetic
gatgacgaagaccagtatgaggactgatgggccgtaccttttgatagatgcagcgaccggcgatcaccacggacg

SEQ ID NO: 231976 - DNA, 75 bp, Artificial Sequence
  Synthetic
gatgggccgtaccttttgatagatgcagcgaccggcgatcaccacggacgggacccctaacctggatcccgcggt

SEQ ID NO: 231977 - DNA, 75 bp, Artificial Sequence
  Synthetic
tctggggttacagcttcagatgactggacagcggccatggatcgtatcatggctttaacggcgcgcagtcctgag

SEQ ID NO: 231978 - DNA, 75 bp, Artificial Sequence
  Synthetic
ggacagcggccatggatcgtatcatggctttaacggcgcgcagtcctgaggcttttcgccaacagccccaagcaa

SEQ ID NO: 231979 - DNA, 75 bp, Artificial Sequence
  Synthetic
agtagtgccttctcgcactaaccctacacatgaaaaagtgttaaccattgtgaatgccttgctggatagcaaagc

SEQ ID NO: 231980 - DNA, 75 bp, Artificial Sequence
  Synthetic
acacatgaaaaagtgttaaccattgtgaatgccttgctggatagcaaagctatccgcaaagatgaagcgggttta

SEQ ID NO: 231981 - DNA, 75 bp, Artificial Sequence
  Synthetic
tggcgcgctacaatagtactaacgttcaggcaaacttagatcggatgggaactgatgtcaaggaggcgttggcaa

SEQ ID NO: 231982 - DNA, 75 bp, Artificial Sequence
  Synthetic
tcaggcaaacttagatcggatgggaactgatgtcaaggaggcgttggcaaaaagagagcgctttcatcgcgacgg

SEQ ID NO: 231983 - DNA, 75 bp, Artificial Sequence
  Synthetic
aatgcttttttgagtactttgccagccaacgttccgcgcggccaagaggattacacaaactttattagcgcactg

SEQ ID NO: 231984 - DNA, 75 bp, Artificial Sequence
  Synthetic
ccaacgttccgcgcggccaagaggattacacaaactttattagcgcactgcggctcatggtcaccgaggtaccgc

SEQ ID NO: 231985 - DNA, 75 bp, Artificial Sequence
  Synthetic
cgattatttttttcaaacttccaggcagggtttgcaaactgttaatttaacgcaggcttttaaaaatttgcaagg

SEQ ID NO: 231986 - DNA, 75 bp, Artificial Sequence
  Synthetic
cagggtttgcaaactgttaatttaacgcaggcttttaaaaatttgcaaggcttgtggggagtccgtgctcctgtg

SEQ ID NO: 231987 - DNA, 75 bp, Artificial Sequence
  Synthetic
tgttaacgccaaactcacgcttattgctgttgctgattgccccctttaccaatagcggtagtttaagtcaagatt

SEQ ID NO: 231988 - DNA, 75 bp, Artificial Sequence
  Synthetic
gctgttgctgattgccccctttaccaatagcggtagtttaagtcaagattcataccttggtcacctaattacttt

SEQ ID NO: 231989 - DNA, 75 bp, Artificial Sequence
  Synthetic
caggtagatgaacagacatatcaagaaataactagtgttagccgagcgctgggtcaggaggacactggcagttta

SEQ ID NO: 231990 - DNA, 75 bp, Artificial Sequence
  Synthetic
aaataactagtgttagccgagcgctgggtcaggaggacactggcagtttagaggcaacattaaactttctcctaa

SEQ ID NO: 231991 - DNA, 75 bp, Artificial Sequence
  Synthetic
gcagtatagtttaaatgcagaagaagagcgtatattacgctatgtacagcaatcggtaagcttgtatcttatgcg

SEQ ID NO: 231992 - DNA, 75 bp, Artificial Sequence
  Synthetic
gagcgtatattacgctatgtacagcaatcggtaagcttgtatcttatgcgagagggcgccacgcccagcactgct

SEQ ID NO: 231993 - DNA, 75 bp, Artificial Sequence
  Synthetic
agccgtctttctatgcttccaatcgagcattcattaatcgccttatggattaccttcaccgcgcagcggccatga

SEQ ID NO: 231994 - DNA, 75 bp, Artificial Sequence
  Synthetic
agcattcattaatcgccttatggattaccttcaccgcgcagcggccatgaacggcgaatactttaccaatgctat

SEQ ID NO: 231995 - DNA, 75 bp, Artificial Sequence
  Synthetic
cctggcttttatactggcgagtttgatttacccgaaggaaatgatggctttttgtgggatgatgttacagacagt

SEQ ID NO: 231996 - DNA, 75 bp, Artificial Sequence
  Synthetic
atttacccgaaggaaatgatggctttttgtgggatgatgttacagacagtttgtttagtccagcagccattagtc

SEQ ID NO: 231997 - DNA, 75 bp, Artificial Sequence
  Synthetic
tgaaggtccgctgattagttctcgatcaagttctccgtttcctagcttaacaagtattaacagtggacgggacac

SEQ ID NO: 231998 - DNA, 75 bp, Artificial Sequence
  Synthetic
tcaagttctccgtttcctagcttaacaagtattaacagtggacgggacaccaggccgcgactaactggggaaagc

SEQ ID NO: 231999 - DNA, 75 bp, Artificial Sequence
  Synthetic
ttccagtacgggacaaaaactttcctaacaatggtattgagaggctggtagacaaaatggcccgttggaaaacat

SEQ ID NO: 232000 - DNA, 75 bp, Artificial Sequence
  Synthetic
taacaatggtattgagaggctggtagacaaaatggcccgttggaaaacatacgcgcaggaacgccgagaatggga

SEQ ID NO: 232001 - DNA, 75 bp, Artificial Sequence
  Synthetic
cctcccaggcaacgctggcagcgccgcaggaaaggagcatatgcttctgaaccagaaagcgacgattctgccgat

SEQ ID NO: 232002 - DNA, 75 bp, Artificial Sequence
  Synthetic
gcaggaaaggagcatatgcttctgaaccagaaagcgacgattctgccgatgatagcagtgtgctggatttaggcg

SEQ ID NO: 232003 - DNA, 75 bp, Artificial Sequence
  Synthetic
gcgtccccagggttacataggtcctctgtattaaaatacatatatataataaaagcatacttactaaggccatgg

SEQ ID NO: 232004 - DNA, 75 bp, Artificial Sequence
  Synthetic
ctgtattaaaatacatatatataataaaagcatacttactaaggccatggcgaccagcgttcgtcttgttgtttt

SEQ ID NO: 232005 - DNA, 75 bp, Artificial Sequence
  Synthetic
cggtggaactccagccagtggcttttgctgaggcgccacctccctcttatgaaaccgtgatggcagcagcggcag

SEQ ID NO: 232006 - DNA, 75 bp, Artificial Sequence
  Synthetic
gaaaccgtgatggcagcagcggcagcccaaccttctacactggaagcaccctacgtgcctccccgatacttgggt

SEQ ID NO: 232007 - DNA, 75 bp, Artificial Sequence
  Synthetic
gttattcagaattatccccattgtatgataccactcgggtgtatctggtggataacaaatcatctgacattgctt

SEQ ID NO: 232008 - DNA, 75 bp, Artificial Sequence
  Synthetic
cgctgaattaccaaaacgatcacagcaactttttaactactgtggtgcagaataacgactactcccctattgagg

SEQ ID NO: 232009 - DNA, 75 bp, Artificial Sequence
  Synthetic
caactttttaactactgtggtgcagaataacgactactcccctattgaggccggcacgcagactattaactttga

SEQ ID NO: 232010 - DNA, 75 bp, Artificial Sequence
  Synthetic
ttgaaaacaatactgcataccaacatgccaaatgtgaacgatttcatgttcacaaccaaatttaaagctaaggtt

SEQ ID NO: 232011 - DNA, 75 bp, Artificial Sequence
  Synthetic
tgccaaatgtgaacgatttcatgttcacaaccaaatttaaagctaaggttatggttgccagggaaaaaaataaag

SEQ ID NO: 232012 - DNA, 75 bp, Artificial Sequence
  Synthetic
gtatgaatgggcagaatttgttttgcctgagggtaactattctgaaaccatgaccattgatctaatgaataacgc

SEQ ID NO: 232013 - DNA, 75 bp, Artificial Sequence
  Synthetic
cctgagggtaactattctgaaaccatgaccattgatctaatgaataacgccattattgagcactacctgttagta

SEQ ID NO: 232014 - DNA, 75 bp, Artificial Sequence
  Synthetic
gcgacataggagttaagtttgacacgagaaactttcgcctgggctgggaccccgagactaaacttattacgccgg

SEQ ID NO: 232015 - DNA, 75 bp, Artificial Sequence
  Synthetic
gagaaactttcgcctgggctgggaccccgagactaaacttattacgccgggtgtttacacaaatgaggcgtttca

SEQ ID NO: 232016 - DNA, 75 bp, Artificial Sequence
  Synthetic
tgcggcgttgactttacagagagcagattaagtaacgttcttggcattaggaagcgccagccttttcaggaagga

SEQ ID NO: 232017 - DNA, 75 bp, Artificial Sequence
  Synthetic
agggaggaaacattccggctcttctggatgtaaaaaagtacgaagacagcctgaagaatgagagcgccataagag

SEQ ID NO: 232018 - DNA, 75 bp, Artificial Sequence
  Synthetic
gcggattccaaagggcgcagttacaacttgcttccagacaaaaaaaatactgagtatcgcagctggtacttggca

SEQ ID NO: 232019 - DNA, 75 bp, Artificial Sequence
  Synthetic
tacaactacggagactcagaaaaaggggtccggtcttggactctcttaactaccccagatgtcacaggcggctct

SEQ ID NO: 232020 - DNA, 75 bp, Artificial Sequence
  Synthetic
acatgatgcaagatccggtgactttccgctcgtcgcgtcaagttagcaactacccggtagttgcggcagaactgt

SEQ ID NO: 232021 - DNA, 75 bp, Artificial Sequence
  Synthetic
caacgatcaagccgtctactcgcagctcattcgccagtcaaccgcgcttacacacgtgtttaatcgctttcccga

SEQ ID NO: 232022 - DNA, 75 bp, Artificial Sequence
  Synthetic
ctcattcgccagtcaaccgcgcttacacacgtgtttaatcgctttcccgagaaccagatattggtgcgcccacca

SEQ ID NO: 232023 - DNA, 75 bp, Artificial Sequence
  Synthetic
gaaccagatattggtgcgcccaccagccgctaccatcactaccgtcagtgaaaacgttcccgccctcacagatca

SEQ ID NO: 232024 - DNA, 75 bp, Artificial Sequence
  Synthetic
tcactgacgcccgccgccggacctgtccctacgtttacaaagcactgggcatagtttcaccacgtgtgctttcta

SEQ ID NO: 232025 - DNA, 75 bp, Artificial Sequence
  Synthetic
catgtcaattttgatttcgccaagtaataacacagggtggggcttaggttccactcgaatgtatggaggcgccaa

SEQ ID NO: 232026 - DNA, 75 bp, Artificial Sequence
  Synthetic
aataacacagggtggggcttaggttccactcgaatgtatggaggcgccaaaacaaggtccagccaacatccagtg

SEQ ID NO: 232027 - DNA, 75 bp, Artificial Sequence
  Synthetic
cttggggagcacatactcgaggacgcacagggcgcactactgtagacgatgttatcgattccgtagtggcagacg

SEQ ID NO: 232028 - DNA, 75 bp, Artificial Sequence
  Synthetic
cacagggcgcactactgtagacgatgttatcgattccgtagtggcagacgcgcgcaaataccgcagacccgctac

SEQ ID NO: 232029 - DNA, 75 bp, Artificial Sequence
  Synthetic
gtcattgacgaggtggttgccaacgctcgagattatgctagacgccgcagacgtcttcgccaccgccgtcgtaga

SEQ ID NO: 232030 - DNA, 75 bp, Artificial Sequence
  Synthetic
ctcgagattatgctagacgccgcagacgtcttcgccaccgccgtcgtagaccaaccgctgctatgcgcgccgcca

SEQ ID NO: 232031 - DNA, 75 bp, Artificial Sequence
  Synthetic
cgttgggcgccgagctatgctgcgggcggcaagacgggctgccacacctactggtcgagcacgcaggcgtgccgc

SEQ ID NO: 232032 - DNA, 75 bp, Artificial Sequence
  Synthetic
gcggcaagacgggctgccacacctactggtcgagcacgcaggcgtgccgcagctgcggcggcaagtgctattgca

SEQ ID NO: 232033 - DNA, 75 bp, Artificial Sequence
  Synthetic
atgtatattgggtgcgcgactcagtaaccggaatgcgcgtaccagttcgtacgcgtccaccacatccttagaaga

SEQ ID NO: 232034 - DNA, 75 bp, Artificial Sequence
  Synthetic
aaccggaatgcgcgtaccagttcgtacgcgtccaccacatccttagaagacaaagagtgactcatgtcctgttat

SEQ ID NO: 232035 - DNA, 75 bp, Artificial Sequence
  Synthetic
gtttaaagaagagctgctgcaggccattgcgcctgaaatatatggcccatcggaagctaacaataccaaacgtga

SEQ ID NO: 232036 - DNA, 75 bp, Artificial Sequence
  Synthetic
attgcgcctgaaatatatggcccatcggaagctaacaataccaaacgtgaaatcaagcatgtaacaaaacgagaa

SEQ ID NO: 232037 - DNA, 75 bp, Artificial Sequence
  Synthetic
tagcagacggcgtggagttcgttcgctcctttgcacccagacgtagggtacagtggaaggggcggcgcgtaaagc

SEQ ID NO: 232038 - DNA, 75 bp, Artificial Sequence
  Synthetic
ctcctttgcacccagacgtagggtacagtggaaggggcggcgcgtaaagcgcattttgcggccgggaaccacagt

SEQ ID NO: 232039 - DNA, 75 bp, Artificial Sequence
  Synthetic
gttatgcgaccgctaaagcgcgagtacgacgaagtgtatgccgaccatgacattctggaacaagcggcgcagcag

SEQ ID NO: 232040 - DNA, 75 bp, Artificial Sequence
  Synthetic
acgacgaagtgtatgccgaccatgacattctggaacaagcggcgcagcagactggggagtttgcctatggaaaaa

SEQ ID NO: 232041 - DNA, 75 bp, Artificial Sequence
  Synthetic
catccctttggacgatggcaatccaacacccagtttaaaggccgttactctacagcaagtattgccagtgcttgg

SEQ ID NO: 232042 - DNA, 75 bp, Artificial Sequence
  Synthetic
acacccagtttaaaggccgttactctacagcaagtattgccagtgcttgggccttcggaagaaaagcgtggaatt

SEQ ID NO: 232043 - DNA, 75 bp, Artificial Sequence
  Synthetic
aacccaccatgcaactgatggtgcctaagaaacaaaaactagaggatgtactagagcacatagaagtggacccta

SEQ ID NO: 232044 - DNA, 75 bp, Artificial Sequence
  Synthetic
taagaaacaaaaactagaggatgtactagagcacatagaagtggaccctagcatacagccagatgtcaaaatacg

SEQ ID NO: 232045 - DNA, 75 bp, Artificial Sequence
  Synthetic
ttgggagttcaaacagtggacattcaaattcctgtgaaaaccgcgtttggtgaacctatggaaacccaaacttcg

SEQ ID NO: 232046 - DNA, 75 bp, Artificial Sequence
  Synthetic
aaattcctgtgaaaaccgcgtttggtgaacctatggaaacccaaacttcgccaatggaaacccaaacttcgccaa

SEQ ID NO: 232047 - DNA, 75 bp, Artificial Sequence
  Synthetic
gcagacagatccttattacctacctaggctttccaaaaaacgttactacagaaaagcaagtgcgcttttaccaaa

SEQ ID NO: 232048 - DNA, 75 bp, Artificial Sequence
  Synthetic
cccacacctggatatcgcgggtccacttttaaacgccgagctgcgggctccagccgcaggcagggcccatcccgc

SEQ ID NO: 232049 - DNA, 75 bp, Artificial Sequence
  Synthetic
tgtacgaagggggcgcacactggttcttccgtccgtgcgttaccaccctagcattctctaataagctgcgctgcc

SEQ ID NO: 232050 - DNA, 75 bp, Artificial Sequence
  Synthetic
cgaatgcgcatacccataccaggatacagaggaagaccccgccggaggagagggctggccggtaacggtcgattt

SEQ ID NO: 232051 - DNA, 75 bp, Artificial Sequence
  Synthetic
tgaagggcggggttctacccctcctaatccctcttattgctgcggccattggggccgttcccggaattgcttcag

SEQ ID NO: 232052 - DNA, 75 bp, Artificial Sequence
  Synthetic
cagactaaatggaagacatcaatttttcgtcgctggccccgcggcacggcacgcgtccgtacatgggtacctgga

SEQ ID NO: 232053 - DNA, 75 bp, Artificial Sequence
  Synthetic
cgggggcgccttcaattggaacagtatttggagcggtcttaaaaattttggctccacaattaaatcatatggcac

SEQ ID NO: 232054 - DNA, 75 bp, Artificial Sequence
  Synthetic
atttggagcggtcttaaaaattttggctccacaattaaatcatatggcaccaaagcgtggaacagccaaaccggt

SEQ ID NO: 232055 - DNA, 75 bp, Artificial Sequence
  Synthetic
accaaaacttccaacaaaaagtggtagatggtctggcttcgggaatcaatggagttgtagacatagccaatcagg

SEQ ID NO: 232056 - DNA, 75 bp, Artificial Sequence
  Synthetic
agatggtctggcttcgggaatcaatggagttgtagacatagccaatcaggctgtacaaaaacagattgcaaaccg

SEQ ID NO: 232057 - DNA, 75 bp, Artificial Sequence
  Synthetic
atggtggaggaaaagctaccccctttacaaacggtgcccgcatccgttccatccaaaggagaaaagcgcccacgg

SEQ ID NO: 232058 - DNA, 75 bp, Artificial Sequence
  Synthetic
tacaaacggtgcccgcatccgttccatccaaaggagaaaagcgcccacggccggatgcagaggaaaccctagtaa

SEQ ID NO: 232059 - DNA, 75 bp, Artificial Sequence
  Synthetic
tgaggaagcagtaaaacagggagcctcagtgttgcccaccacgtaccctatgacaaaaccgattttacccatggc

SEQ ID NO: 232060 - DNA, 75 bp, Artificial Sequence
  Synthetic
tcagtgttgcccaccacgtaccctatgacaaaaccgattttacccatggctaccagggtgtatggaaaaaatgaa

SEQ ID NO: 232061 - DNA, 75 bp, Artificial Sequence
  Synthetic
cgcctctgccggaacccactattgccgagccagtgctttcgacaccaccagttgcaacagtgacgcgtccagaag

SEQ ID NO: 232062 - DNA, 75 bp, Artificial Sequence
  Synthetic
cgagccagtgctttcgacaccaccagttgcaacagtgacgcgtccagaagtacggccagtggctgtggccagctt

SEQ ID NO: 232063 - DNA, 75 bp, Artificial Sequence
  Synthetic
caaagcacgctgaacagcattgtggggttgggagtgaaatctctcaaacgccgtcgctgctattaaactaaaaaa

SEQ ID NO: 232064 - DNA, 75 bp, Artificial Sequence
  Synthetic
caaagagtgttaacatcccatctgtgtatacacctcctatgtcagcgccagaggaccaacgcgcgaatcgcagtt

SEQ ID NO: 232065 - DNA, 75 bp, Artificial Sequence
  Synthetic
agaaatcccactgtagctcccactcatgacgttaccaccgatcgttctcagcggctgacactgcgttttgtgccc

SEQ ID NO: 232066 - DNA, 75 bp, Artificial Sequence
  Synthetic
atgacgttaccaccgatcgttctcagcggctgacactgcgttttgtgcccgtggatcgggaagatactgcttact

SEQ ID NO: 232067 - DNA, 75 bp, Artificial Sequence
  Synthetic
tgtgggtgataaccgcgtacttgatatggctagttcctactttgacattagaggggtactagaccgcggtcccag

SEQ ID NO: 232068 - DNA, 75 bp, Artificial Sequence
  Synthetic
atggctagttcctactttgacattagaggggtactagaccgcggtcccagtttcaagccgtattctggaacggct

SEQ ID NO: 232069 - DNA, 75 bp, Artificial Sequence
  Synthetic
cgcccaatgctagccagtggctgactactaatgacaacaagtcccacacttttgctcaagcgccttacataggga

SEQ ID NO: 232070 - DNA, 75 bp, Artificial Sequence
  Synthetic
tactaatgacaacaagtcccacacttttgctcaagcgccttacatagggagctccatcactaaagatggcattca

SEQ ID NO: 232071 - DNA, 75 bp, Artificial Sequence
  Synthetic
ccacaaccagtatatgccgacaagacatatcaacccgaacctcaagtaggcgagagtcaatggaacgcgcctttg

SEQ ID NO: 232072 - DNA, 75 bp, Artificial Sequence
  Synthetic
catatcaacccgaacctcaagtaggcgagagtcaatggaacgcgcctttgcctaacaacgcaaaagcagcaggaa

SEQ ID NO: 232073 - DNA, 75 bp, Artificial Sequence
  Synthetic
gtacccctgctatgggtcttacgcccgagccacaaatgaaaacggaggacaatcaaaaaataacgaaggggtgga

SEQ ID NO: 232074 - DNA, 75 bp, Artificial Sequence
  Synthetic
cgagccacaaatgaaaacggaggacaatcaaaaaataacgaaggggtggaaatgcaattttttgcatccgctgct

SEQ ID NO: 232075 - DNA, 75 bp, Artificial Sequence
  Synthetic
tgctgtacagtgaggacgtaaacctggaagcccctgacacgcacattgtttttaagccagctgtagcagcagaca

SEQ ID NO: 232076 - DNA, 75 bp, Artificial Sequence
  Synthetic
ggaagcccctgacacgcacattgtttttaagccagctgtagcagcagacactgttagttcggaactgctactagg

SEQ ID NO: 232077 - DNA, 75 bp, Artificial Sequence
  Synthetic
aattacattggcttcagagataacttcataggactaatgtactacaacagcactggaaatatgggagtgcttgcc

SEQ ID NO: 232078 - DNA, 75 bp, Artificial Sequence
  Synthetic
tggtggacctgcaggacaggaatacagagctgtcctaccaacttatgctagacgctttaggcgaccgcagtcggt

SEQ ID NO: 232079 - DNA, 75 bp, Artificial Sequence
  Synthetic
attattgaaaatcatggggtggaagacgaacttcccaattactgctttccactaggcgctgtggggattgtgaat

SEQ ID NO: 232080 - DNA, 75 bp, Artificial Sequence
  Synthetic
caaatgcctgggcaaaggataacaacaaagcagataataataacttagcaacaggtaacatcttcgccatggaaa

SEQ ID NO: 232081 - DNA, 75 bp, Artificial Sequence
  Synthetic
caaagcagataataataacttagcaacaggtaacatcttcgccatggaaataaacttgcaggctaatctgtggcg

SEQ ID NO: 232082 - DNA, 75 bp, Artificial Sequence
  Synthetic
ttgtacttacctgacagcttaaaatacactccgggaaacataaagctgcctgataataaaaacacctacgagtac

SEQ ID NO: 232083 - DNA, 75 bp, Artificial Sequence
  Synthetic
acactccgggaaacataaagctgcctgataataaaaacacctacgagtacatgaatggccgtgttacagccccgg

SEQ ID NO: 232084 - DNA, 75 bp, Artificial Sequence
  Synthetic
cggagctcgttggtcgccagatgttatggataacataaatccttttaaccaccaccgaaacgcagggctccgata

SEQ ID NO: 232085 - DNA, 75 bp, Artificial Sequence
  Synthetic
aggtttgtgccttttcacattcaggtgccgcagaaattttttgccataagaaacttgctgcttttacctggttcg

SEQ ID NO: 232086 - DNA, 75 bp, Artificial Sequence
  Synthetic
aagatgtaaatatgatacttcaaagcaccctaggcaatgacctgcgggtggatggggcaagcattcgctttgaca

SEQ ID NO: 232087 - DNA, 75 bp, Artificial Sequence
  Synthetic
ccctatggctcataatacggcgtccaccctagaagctatgttgagaaatgacaccaacgaccagtcatttaatga

SEQ ID NO: 232088 - DNA, 75 bp, Artificial Sequence
  Synthetic
accctagaagctatgttgagaaatgacaccaacgaccagtcatttaatgactacctatgcgctgcaaacatgctg

SEQ ID NO: 232089 - DNA, 75 bp, Artificial Sequence
  Synthetic
gtgtgccgatttctataccttccagaaattgggcagcatttaggggatggagttttactcgcttaaaaactaagg

SEQ ID NO: 232090 - DNA, 75 bp, Artificial Sequence
  Synthetic
aaattgggcagcatttaggggatggagttttactcgcttaaaaactaaggaaacaccgtcactgggctctggctt

SEQ ID NO: 232091 - DNA, 75 bp, Artificial Sequence
  Synthetic
accattccctatttggacggtacattttatcttaatcatactttcaaaaaggtgtcaattatgtttgactcctct

SEQ ID NO: 232092 - DNA, 75 bp, Artificial Sequence
  Synthetic
tttatcttaatcatactttcaaaaaggtgtcaattatgtttgactcctctgttagctggccgggaaacgaccgtt

SEQ ID NO: 232093 - DNA, 75 bp, Artificial Sequence
  Synthetic
taagcgttctgtggatggggaagggtacaacgtggctcaatgcaacatgactaaagactggtttcttatccagat

SEQ ID NO: 232094 - DNA, 75 bp, Artificial Sequence
  Synthetic
tacaacgtggctcaatgcaacatgactaaagactggtttcttatccagatgcttagtcactacaacattgggtac

SEQ ID NO: 232095 - DNA, 75 bp, Artificial Sequence
  Synthetic
acaaagaccgaatgtattctttcttcagaaactttcagcctatgagtagacaggttgttgacactactgagtaca

SEQ ID NO: 232096 - DNA, 75 bp, Artificial Sequence
  Synthetic
cagaaactttcagcctatgagtagacaggttgttgacactactgagtacaaagactacaaacaagtaacagtgaa

SEQ ID NO: 232097 - DNA, 75 bp, Artificial Sequence
  Synthetic
gtgggctacttgggtcccaccatgcgggaaggtcaagcttatccagctaactatccctatcccctaattggaaag

SEQ ID NO: 232098 - DNA, 75 bp, Artificial Sequence
  Synthetic
aaaagtttttgtgcgatcgcgtaatgtggcgcatcccattttccagcaattttatgtctatgggagcgcttaccg

SEQ ID NO: 232099 - DNA, 75 bp, Artificial Sequence
  Synthetic
aaattccgcccatgctttggacatgacatttgaggtggatccaatggacgagcccacccttctttatgttttgtt

SEQ ID NO: 232100 - DNA, 75 bp, Artificial Sequence
  Synthetic
catcagccgcaccgcggcgtcatcgaagcggtatacctacgcacgcctttctctgcgggtaacgctaccacctaa

SEQ ID NO: 232101 - DNA, 75 bp, Artificial Sequence
  Synthetic
atgggttcaagcgagcaggagctcacggccattgttcgagacctaggttgcgggccctattttatgggtacattt

SEQ ID NO: 232102 - DNA, 75 bp, Artificial Sequence
  Synthetic
cccgcgaccgcttatcctgtgctattgttaacactgctggtcgcgaaactgggggcgtgcattggcttgcttttg

SEQ ID NO: 232103 - DNA, 75 bp, Artificial Sequence
  Synthetic
tgttaacactgctggtcgcgaaactgggggcgtgcattggcttgcttttggatggaaccccaaatctcatacatg

SEQ ID NO: 232104 - DNA, 75 bp, Artificial Sequence
  Synthetic
tctgacaagcgtctaaaacaaatatatcactttgagtacgagggactgttgcgccgcagcgcactagcagccact

SEQ ID NO: 232105 - DNA, 75 bp, Artificial Sequence
  Synthetic
atcactttgagtacgagggactgttgcgccgcagcgcactagcagccactaaggaccgttgcgttaccctacaaa

SEQ ID NO: 232106 - DNA, 75 bp, Artificial Sequence
  Synthetic
attttctgcagcttgtggccttttttgctgtatgtttttacatgcttttactcattggcctgaccacccaatgga

SEQ ID NO: 232107 - DNA, 75 bp, Artificial Sequence
  Synthetic
tgctgtatgtttttacatgcttttactcattggcctgaccacccaatggataaaaatccaactatggacctactt

SEQ ID NO: 232108 - DNA, 75 bp, Artificial Sequence
  Synthetic
aaagtcctcaggtagtaggcatactgcagcgcaaccaggaggagttgtatagatttttaaacaccctatcccctt

SEQ ID NO: 232109 - DNA, 75 bp, Artificial Sequence
  Synthetic
gcagcgcaaccaggaggagttgtatagatttttaaacaccctatccccttactttcgtcacaaccgcgagcgcat

SEQ ID NO: 232110 - DNA, 75 bp, Artificial Sequence
  Synthetic
atgcaaatgaactgaaataaacatgttacacagtgtattaataaaaacatttttattaactcattgattcacaaa

SEQ ID NO: 232111 - DNA, 75 bp, Artificial Sequence
  Synthetic
ttacacagtgtattaataaaaacatttttattaactcattgattcacaaactggtttttattaaaaatcaaacgg

SEQ ID NO: 232112 - DNA, 75 bp, Artificial Sequence
  Synthetic
gtaggtagggatagattcctgtactgcagacgcgggtgccacttgaattctggaataacaagcctaggaagcggg

SEQ ID NO: 232113 - DNA, 75 bp, Artificial Sequence
  Synthetic
gcagacgcgggtgccacttgaattctggaataacaagcctaggaagcgggccttcaaaattttctctccacagct

SEQ ID NO: 232114 - DNA, 75 bp, Artificial Sequence
  Synthetic
aacatcaggagcagatatcttgaagtcgcaattgggcccggcattaccgcgggtgttgcggtaaacgggatttgc

SEQ ID NO: 232115 - DNA, 75 bp, Artificial Sequence
  Synthetic
tcgcaattgggcccggcattaccgcgggtgttgcggtaaacgggatttgcacactgaaaaaccagcaagcaagga

SEQ ID NO: 232116 - DNA, 75 bp, Artificial Sequence
  Synthetic
ggtcggttacttcgccagtgtcaatgttttctacattgctaagggtaaacggcgtcatcttgcagagttgtcgcc

SEQ ID NO: 232117 - DNA, 75 bp, Artificial Sequence
  Synthetic
gttttctacattgctaagggtaaacggcgtcatcttgcagagttgtcgccccatccgtggtacaccatcttgctt

SEQ ID NO: 232118 - DNA, 75 bp, Artificial Sequence
  Synthetic
ataagaacgcgtttctgcccctgtcgcatgtgagggtagtcggccaacataaaggcttcgatctgtttaaaagcc

SEQ ID NO: 232119 - DNA, 75 bp, Artificial Sequence
  Synthetic
gcatgtgagggtagtcggccaacataaaggcttcgatctgtttaaaagccatttgggcctttgacccctcagaga

SEQ ID NO: 232120 - DNA, 75 bp, Artificial Sequence
  Synthetic
aaaagagttgcttccgcagccgacatcatggaaacagcagcgagcgtcatcgtttttaatttgcactacattgcg

SEQ ID NO: 232121 - DNA, 75 bp, Artificial Sequence
  Synthetic
tcatggaaacagcagcgagcgtcatcgtttttaatttgcactacattgcgaccccagcgattttgtaccacctta

SEQ ID NO: 232122 - DNA, 75 bp, Artificial Sequence
  Synthetic
cccgctggccattttcactggttacatccatttctaccaggtgctctttacgcaccatttctatgccatgcaaac

SEQ ID NO: 232123 - DNA, 75 bp, Artificial Sequence
  Synthetic
atccatttctaccaggtgctctttacgcaccatttctatgccatgcaaacacctaagctctccctcccgctcggt

SEQ ID NO: 232124 - DNA, 75 bp, Artificial Sequence
  Synthetic
ccggtgggttcccaggttttatgttgtacgccggcatatgcttgcatgtatccttgcaagaagcggcccattagc

SEQ ID NO: 232125 - DNA, 75 bp, Artificial Sequence
  Synthetic
gtacgccggcatatgcttgcatgtatccttgcaagaagcggcccattagctcctggaacgttttttgggatgaaa

SEQ ID NO: 232126 - DNA, 75 bp, Artificial Sequence
  Synthetic
ttcgccaatccaggttgcgcatatttttttgtatatgccactctgttctggcaaaaatctaaagttggaacgctc

SEQ ID NO: 232127 - DNA, 75 bp, Artificial Sequence
  Synthetic
tttttgtatatgccactctgttctggcaaaaatctaaagttggaacgctcgtcatgatccacatggtacttctcc

SEQ ID NO: 232128 - DNA, 75 bp, Artificial Sequence
  Synthetic
ccttctcccaagccgttactaggggctcgttcgcaggatttcggacaacaaaactttcttcactgcttatttgca

SEQ ID NO: 232129 - DNA, 75 bp, Artificial Sequence
  Synthetic
ctcgttcgcaggatttcggacaacaaaactttcttcactgcttatttgcattgcggcatttgcggggtttcgttt

SEQ ID NO: 232130 - DNA, 75 bp, Artificial Sequence
  Synthetic
tgcgacccgtctgcatgaggtataatgcgaacagggggcatgctgaatcccattattcctaagactgcctttggc

SEQ ID NO: 232131 - DNA, 75 bp, Artificial Sequence
  Synthetic
tgcgaacagggggcatgctgaatcccattattcctaagactgcctttggcgtttccactactccttcctcttctt

SEQ ID NO: 232132 - DNA, 75 bp, Artificial Sequence
  Synthetic
cggaggaagaggctttgcggacttcatctttcgttttgaaggcagaggcgcaggagctcccatgtcttcctcgct

SEQ ID NO: 232133 - DNA, 75 bp, Artificial Sequence
  Synthetic
atttttggaggcggcggctgaacactgcgatctggggtgcgctccctctgtgagtgttgattgctggccattatt

SEQ ID NO: 232134 - DNA, 75 bp, Artificial Sequence
  Synthetic
tgcgatctggggtgcgctccctctgtgagtgttgattgctggccattatttaatcctaggcaaagaaacacatga

SEQ ID NO: 232135 - DNA, 75 bp, Artificial Sequence
  Synthetic
tgcactactgctgtcatggaaaaggaaaacagcctacccataccccaggacgcaccggtggagcaggacttgggc

SEQ ID NO: 232136 - DNA, 75 bp, Artificial Sequence
  Synthetic
atcaaccagactctcttctaaaccaaaatcagccaaatgaggaacaggcagaaagcaatgaacaaaatgccgggt

SEQ ID NO: 232137 - DNA, 75 bp, Artificial Sequence
  Synthetic
aaatcagccaaatgaggaacaggcagaaagcaatgaacaaaatgccgggttaaagaatgactacctaggcgaggg

SEQ ID NO: 232138 - DNA, 75 bp, Artificial Sequence
  Synthetic
cgacaaaccactatcgtacgcgacgctatagccgaccgcttgtccttgccaatttcagtttcagagttaagcagt

SEQ ID NO: 232139 - DNA, 75 bp, Artificial Sequence
  Synthetic
aatttcagtttcagagttaagcagtgcatacgagcggaatttgttttccccacgtgtgcctccaaagcgacaagc

SEQ ID NO: 232140 - DNA, 75 bp, Artificial Sequence
  Synthetic
cgccttaacttttatccagtttttgcagtgccagaagcacttgcaacatatcatatttttttcaaaaatcacaag

SEQ ID NO: 232141 - DNA, 75 bp, Artificial Sequence
  Synthetic
cagtgccagaagcacttgcaacatatcatatttttttcaaaaatcacaagatccccgtgtcctgccgagccaacc

SEQ ID NO: 232142 - DNA, 75 bp, Artificial Sequence
  Synthetic
tttaaggtccggcgccgccatacctggtattgtatccttagaggaggtacccagaatttttgaaggcttgggacg

SEQ ID NO: 232143 - DNA, 75 bp, Artificial Sequence
  Synthetic
ggtattgtatccttagaggaggtacccagaatttttgaaggcttgggacgtgatgaaaaacgagcggcaaatacc

SEQ ID NO: 232144 - DNA, 75 bp, Artificial Sequence
  Synthetic
agtacggaactagcgccctggtagagctggaaggtgacaacgctcggttggcggtactgaagcgaaacgttgcag

SEQ ID NO: 232145 - DNA, 75 bp, Artificial Sequence
  Synthetic
gctggaaggtgacaacgctcggttggcggtactgaagcgaaacgttgcagtgacccactttgcctatccggcgct

SEQ ID NO: 232146 - DNA, 75 bp, Artificial Sequence
  Synthetic
gcagtaatgaatcaggtattaattaagcttgccaaaccaattgatgaacaagcaaacttgcaagatactgaaaca

SEQ ID NO: 232147 - DNA, 75 bp, Artificial Sequence
  Synthetic
agcttgccaaaccaattgatgaacaagcaaacttgcaagatactgaaacaacggacgatggaaaaccagctgtaa

SEQ ID NO: 232148 - DNA, 75 bp, Artificial Sequence
  Synthetic
ggggacaaacgatagtaaggaactagaacatcggcgcaaattaatgatgggcgctgtactaataactacagaact

SEQ ID NO: 232149 - DNA, 75 bp, Artificial Sequence
  Synthetic
gaacatcggcgcaaattaatgatgggcgctgtactaataactacagaacttgagtgcatgcaccgctttttttct

SEQ ID NO: 232150 - DNA, 75 bp, Artificial Sequence
  Synthetic
aggaatgccttcactataccttccgccatggctacgtgcgccaagcttgtaaagtgtccaatgtggaattaagca

SEQ ID NO: 232151 - DNA, 75 bp, Artificial Sequence
  Synthetic
ccatggctacgtgcgccaagcttgtaaagtgtccaatgtggaattaagcaatctagtttcttacatgggcatttt

SEQ ID NO: 232152 - DNA, 75 bp, Artificial Sequence
  Synthetic
gtcctccactctacccttagcggcgaagcgcgcagagactatgtgcgcgattgcatttatctgtttctactgcac

SEQ ID NO: 232153 - DNA, 75 bp, Artificial Sequence
  Synthetic
aagcgcgcagagactatgtgcgcgattgcatttatctgtttctactgcacacctggcaaaccggcatgggggtgt

SEQ ID NO: 232154 - DNA, 75 bp, Artificial Sequence
  Synthetic
cttgcaagaactacataaactccttgacaagtcgctgagatgcctttggacaggctttgatgaaagaacggtagc

SEQ ID NO: 232155 - DNA, 75 bp, Artificial Sequence
  Synthetic
gacaagtcgctgagatgcctttggacaggctttgatgaaagaacggtagctgccaacctcgccgacattattttt

SEQ ID NO: 232156 - DNA, 75 bp, Artificial Sequence
  Synthetic
tcttttattttggagcgatctggcatgcttcctagcatgtgttgtgcgctgccttcagattttgtacctatttac

SEQ ID NO: 232157 - DNA, 75 bp, Artificial Sequence
  Synthetic
ggagccattgctacctactacaactggccaactacctagcctatcactcagaccttatgacagactccagcggtg

SEQ ID NO: 232158 - DNA, 75 bp, Artificial Sequence
  Synthetic
ggccaactacctagcctatcactcagaccttatgacagactccagcggtgagggtctaatggagtgtcattgtcg

SEQ ID NO: 232159 - DNA, 75 bp, Artificial Sequence
  Synthetic
tccctggtttgtaacacagaactactgagtgaaagtcaacttataggaacctttgaaatgcaggggccgcagtct

SEQ ID NO: 232160 - DNA, 75 bp, Artificial Sequence
  Synthetic
tgagtgaaagtcaacttataggaacctttgaaatgcaggggccgcagtctgacaacaacaccgcaacaagtttca

SEQ ID NO: 232161 - DNA, 75 bp, Artificial Sequence
  Synthetic
agcgtatctgcgtaaatttgagcccgaagattaccacgcccatactatacatttttacgaagaccaatccagacc

SEQ ID NO: 232162 - DNA, 75 bp, Artificial Sequence
  Synthetic
gaagattaccacgcccatactatacatttttacgaagaccaatccagacccccaaaggctccgttaacagcttgc

SEQ ID NO: 232163 - DNA, 75 bp, Artificial Sequence
  Synthetic
cccaattgcaagctattaagcaagcgcgcgaagagtttttacttaaaaaaggacacggagtgtaccttgaccccc

SEQ ID NO: 232164 - DNA, 75 bp, Artificial Sequence
  Synthetic
aaagccgccaaacaggccattgctctacaacgttcaaagaaacagcagcaacagcaggaaatctgggaggaagaa

SEQ ID NO: 232165 - DNA, 75 bp, Artificial Sequence
  Synthetic
acgaggacttggaagaatgggaggaggaggaggaatacaacagcctagaagaggaggaggaaggtatcgaggacg

SEQ ID NO: 232166 - DNA, 75 bp, Artificial Sequence
  Synthetic
ggaggaggaatacaacagcctagaagaggaggaggaaggtatcgaggacggagcgaccgccacaaaaccgtcgct

SEQ ID NO: 232167 - DNA, 75 bp, Artificial Sequence
  Synthetic
cccacagtgagcaaatctcaaaaagccagccgtagatgggacaacactgaaacaagcaccgcagcctcaaactgg

SEQ ID NO: 232168 - DNA, 75 bp, Artificial Sequence
  Synthetic
ccagccgtagatgggacaacactgaaacaagcaccgcagcctcaaactggggtaagaaccgcaagcagacgcgtc

SEQ ID NO: 232169 - DNA, 75 bp, Artificial Sequence
  Synthetic
caaaagtaacattgtggcctgcctacaacactgcggggggaatatctcattcgcaaggagatatttgctattcca

SEQ ID NO: 232170 - DNA, 75 bp, Artificial Sequence
  Synthetic
gtcctgcattactaccgtaatctttacagccccttcgaagcgcccaacaaagaagcaacctgcggcgaccaagcg

SEQ ID NO: 232171 - DNA, 75 bp, Artificial Sequence
  Synthetic
acagccccttcgaagcgcccaacaaagaagcaacctgcggcgaccaagcggtccattagaaaaagaagcaacaac

SEQ ID NO: 232172 - DNA, 75 bp, Artificial Sequence
  Synthetic
gcgagctaagaaaacgcatttttcccactctatatgctatttttcagcagagtcgaggtcaagaacacgaactga

SEQ ID NO: 232173 - DNA, 75 bp, Artificial Sequence
  Synthetic
cactctatatgctatttttcagcagagtcgaggtcaagaacacgaactgaaaataaaaaaccggtccctgcgttc

SEQ ID NO: 232174 - DNA, 75 bp, Artificial Sequence
  Synthetic
aaaagcgaagaccagttgcagcgcaccttggaagacgcagaagctctgttcaataaatactgcgctctctcgctt

SEQ ID NO: 232175 - DNA, 75 bp, Artificial Sequence
  Synthetic
caataaatactgcgctctctcgcttaaagactaaaaaaaaagcccgcgcgcggactttacaggcgggaaagtgac

SEQ ID NO: 232176 - DNA, 75 bp, Artificial Sequence
  Synthetic
ccacgccttacatgtggagcttccaaccccaaatgggtttggccgcaggtgcggctcaggactactccagcagaa

SEQ ID NO: 232177 - DNA, 75 bp, Artificial Sequence
  Synthetic
tatgatttccaaagtaaacggaattcgcgcccagcgtaaccaaattctgctggagcaggcggctctcacggccac

SEQ ID NO: 232178 - DNA, 75 bp, Artificial Sequence
  Synthetic
tcttggccagctgccctggtataccaggaaaatcccccgcctactactgtacttttaccccgcgacgcccaggcc

SEQ ID NO: 232179 - DNA, 75 bp, Artificial Sequence
  Synthetic
aggaaaatcccccgcctactactgtacttttaccccgcgacgcccaggccgaagttcacatgactaacactgggg

SEQ ID NO: 232180 - DNA, 75 bp, Artificial Sequence
  Synthetic
cagtttcaggtgtaaaggtcgctcctggccctaccccacttcaggtataaagcgactgctcatcagagggaaagg

SEQ ID NO: 232181 - DNA, 75 bp, Artificial Sequence
  Synthetic
tggccctaccccacttcaggtataaagcgactgctcatcagagggaaaggtatacagctcaacgacgaggcagtc

SEQ ID NO: 232182 - DNA, 75 bp, Artificial Sequence
  Synthetic
acggagtatttcagctcggaggatccggtcgctcctcctttactacccgccaagcctacctaacgctgcagagct

SEQ ID NO: 232183 - DNA, 75 bp, Artificial Sequence
  Synthetic
cggtcgctcctcctttactacccgccaagcctacctaacgctgcagagctcctcatccgctcctaggtccggcgg

SEQ ID NO: 232184 - DNA, 75 bp, Artificial Sequence
  Synthetic
gagtttactccatcagtttacttcaaccccttttcgggttctccaggccactacccagacgccttcatccccaac

SEQ ID NO: 232185 - DNA, 75 bp, Artificial Sequence
  Synthetic
accccttttcgggttctccaggccactacccagacgccttcatccccaacttcgacgcagtgagtgaatctgtgg

SEQ ID NO: 232186 - DNA, 75 bp, Artificial Sequence
  Synthetic
acagctgacacagctcggctgcgacatttagaacattgtcgccgacttcgctgctttgcccgagacgtgtgtgat

SEQ ID NO: 232187 - DNA, 75 bp, Artificial Sequence
  Synthetic
atttagaacattgtcgccgacttcgctgctttgcccgagacgtgtgtgattttgtttactttgagctccccgagg

SEQ ID NO: 232188 - DNA, 75 bp, Artificial Sequence
  Synthetic
tgtaagggtaacagttgataaaggaattgatacccaccttattaagtttttcaccaaacgtccacttttggtgga

SEQ ID NO: 232189 - DNA, 75 bp, Artificial Sequence
  Synthetic
attgatacccaccttattaagtttttcaccaaacgtccacttttggtggaaaaggaccaaggaaacactgtacta

SEQ ID NO: 232190 - DNA, 75 bp, Artificial Sequence
  Synthetic
ctgaattacatgaagatttttgttgtcatttgtgtactgaatttaataaattgtagtggcgctttgtcacctgaa

SEQ ID NO: 232191 - DNA, 75 bp, Artificial Sequence
  Synthetic
tcatttgtgtactgaatttaataaattgtagtggcgctttgtcacctgaagaggaacctaattgtcgtccgcctc

SEQ ID NO: 232192 - DNA, 75 bp, Artificial Sequence
  Synthetic
aaccactcacgttacccttcaatgcaagtttttttctacacaactcacttggacctttaatggaaaaaacgtcgc

SEQ ID NO: 232193 - DNA, 75 bp, Artificial Sequence
  Synthetic
aagtttttttctacacaactcacttggacctttaatggaaaaaacgtcgccgaggcaaatttaaagtaccatatc

SEQ ID NO: 232194 - DNA, 75 bp, Artificial Sequence
  Synthetic
cgcctattcacctgggatattaccgctgctttgccacaccttgtgtgcaagcgttttttctggctccagttatca

SEQ ID NO: 232195 - DNA, 75 bp, Artificial Sequence
  Synthetic
ctgctttgccacaccttgtgtgcaagcgttttttctggctccagttatcaaccctcgtcctgcaactactgctca

SEQ ID NO: 232196 - DNA, 75 bp, Artificial Sequence
  Synthetic
tccaccgctattgctactactgctacaaaaggtacagaagaaatcatatacttttcaaactttacaactaattta

SEQ ID NO: 232197 - DNA, 75 bp, Artificial Sequence
  Synthetic
caaaaggtacagaagaaatcatatacttttcaaactttacaactaatttacttttaaattgctcgtgctctaact

SEQ ID NO: 232198 - DNA, 75 bp, Artificial Sequence
  Synthetic
caccttctgcaaagctttttttcaaggaacaactttgtattcggctaaacttgaactttgtaacaccagcactcc

SEQ ID NO: 232199 - DNA, 75 bp, Artificial Sequence
  Synthetic
ggaacaactttgtattcggctaaacttgaactttgtaacaccagcactccttctaaccttactttgttacctcct

SEQ ID NO: 232200 - DNA, 75 bp, Artificial Sequence
  Synthetic
taggagcaggcgggcatccttgtcagcggcattggaaattagtttttcgtccaacgctggttttacctacgtctg

SEQ ID NO: 232201 - DNA, 75 bp, Artificial Sequence
  Synthetic
gcggcattggaaattagtttttcgtccaacgctggttttacctacgtctgctgatcctactctgtccccaacccc

SEQ ID NO: 232202 - DNA, 75 bp, Artificial Sequence
  Synthetic
cttatagcttttactttatttttactttgcaatttattcttaattaatttttactaacaatgcttcacatcttaa

SEQ ID NO: 232203 - DNA, 75 bp, Artificial Sequence
  Synthetic
tttgcaatttattcttaattaatttttactaacaatgcttcacatcttaattttgttcttttctctaactcccat

SEQ ID NO: 232204 - DNA, 75 bp, Artificial Sequence
  Synthetic
ccactaaaggttgtggctgaagctggtcataatgtcacacttcctcatttgctgcctggatttaacaaaactggt

SEQ ID NO: 232205 - DNA, 75 bp, Artificial Sequence
  Synthetic
gtcataatgtcacacttcctcatttgctgcctggatttaacaaaactggtcatgtaacttggttaatagaaatac

SEQ ID NO: 232206 - DNA, 75 bp, Artificial Sequence
  Synthetic
caaatttgtttttagcggacaaaagctctgtgagtttgccagcaaaaacctaacgtggtcttttccacaattaat

SEQ ID NO: 232207 - DNA, 75 bp, Artificial Sequence
  Synthetic
ctctgtgagtttgccagcaaaaacctaacgtggtcttttccacaattaatttttaaatgtgacaattatgacatt

SEQ ID NO: 232208 - DNA, 75 bp, Artificial Sequence
  Synthetic
attcggctatttacaatgtaaaaaacacaatagaagccaccgaaagcaatatatactatcagttaacagtaatac

SEQ ID NO: 232209 - DNA, 75 bp, Artificial Sequence
  Synthetic
cacaatagaagccaccgaaagcaatatatactatcagttaacagtaatacaaattaatccgcccaactgtatcat

SEQ ID NO: 232210 - DNA, 75 bp, Artificial Sequence
  Synthetic
tattgtcacattacaattaattgtacaaactctcgctatcctaacaaggttatctttaacaatgtcactagatct

SEQ ID NO: 232211 - DNA, 75 bp, Artificial Sequence
  Synthetic
caaactctcgctatcctaacaaggttatctttaacaatgtcactagatcttattatggttatgctaaaggcagtt

SEQ ID NO: 232212 - DNA, 75 bp, Artificial Sequence
  Synthetic
cagctttaatgtttcaggtatcactaaaacatttaagcataactatccttttagtgagctatgtacttatccgtc

SEQ ID NO: 232213 - DNA, 75 bp, Artificial Sequence
  Synthetic
aaaacatttaagcataactatccttttagtgagctatgtacttatccgtcttccgaaaatttctacaattcaaaa
